United States Patent 12,188,016 (ANTISENSE OLIGONUCLEOTIDES FOR MODULATING THE FUNCTION OF A T CELL) - sequence listing, part 2

SEQ ID NO: 22558 - RNA, 27 nt, Artificial Sequence
  Synthetic Oligonucleotide; PD-L1 exons 4 and 5; Set C
ugacuucggccuugggguagcccucag

SEQ ID NO: 22559 - RNA, 25 nt, Artificial Sequence
  Synthetic Oligonucleotide; PD-L1 exons 4 and 5; Set C
gacuucggccuugggguagcccuca

SEQ ID NO: 22560 - RNA, 28 nt, Artificial Sequence
  Synthetic Oligonucleotide; PD-L1 exons 4 and 5; Set C
augacuucggccuugggguagcccucag

SEQ ID NO: 22561 - RNA, 26 nt, Artificial Sequence
  Synthetic Oligonucleotide; PD-L1 exons 4 and 5; Set C
ugacuucggccuugggguagcccuca

SEQ ID NO: 22562 - RNA, 27 nt, Artificial Sequence
  Synthetic Oligonucleotide; PD-L1 exons 4 and 5; Set C
augacuucggccuugggguagcccuca

SEQ ID NO: 22563 - RNA, 34 nt, Artificial Sequence
  Synthetic Oligonucleotide; PD-L1 exons 4 and 5; Set C
uguccagaugacuucggccuugggguagcccuca

SEQ ID NO: 22564 - RNA, 17 nt, Artificial Sequence
  Synthetic Oligonucleotide; PD-L1 exons 4 and 5; Set C
augacuucggccuuggg

SEQ ID NO: 22565 - RNA, 16 nt, Artificial Sequence
  Synthetic Oligonucleotide; PD-L1 exons 4 and 5; Set C
augacuucggccuugg

SEQ ID NO: 22566 - RNA, 18 nt, Artificial Sequence
  Synthetic Oligonucleotide; PD-L1 exons 4 and 5; Set A
gaugacuucggccuuggg

SEQ ID NO: 22567 - RNA, 27 nt, Artificial Sequence
  Synthetic Oligonucleotide; PD-L1 exons 4 and 5; Set C
guccagaugacuucggccuugggguag

SEQ ID NO: 22568 - RNA, 17 nt, Artificial Sequence
  Synthetic Oligonucleotide; PD-L1 exons 4 and 5; Set C
gaugacuucggccuugg

SEQ ID NO: 22569 - RNA, 15 nt, Artificial Sequence
  Synthetic Oligonucleotide; PD-L1 exons 4 and 5; Set C
augacuucggccuug

SEQ ID NO: 22570 - RNA, 26 nt, Artificial Sequence
  Synthetic Oligonucleotide; PD-L1 exons 4 and 5; Set C
guccagaugacuucggccuuggggua

SEQ ID NO: 22571 - RNA, 16 nt, Artificial Sequence
  Synthetic Oligonucleotide; PD-L1 exons 4 and 5; Set C
gaugacuucggccuug

SEQ ID NO: 22572 - RNA, 25 nt, Artificial Sequence
  Synthetic Oligonucleotide; PD-L1 exons 4 and 5; Set C
guccagaugacuucggccuuggggu

SEQ ID NO: 22573 - RNA, 24 nt, Artificial Sequence
  Synthetic Oligonucleotide; PD-L1 exons 4 and 5; Set C
guccagaugacuucggccuugggg

SEQ ID NO: 22574 - RNA, 24 nt, Artificial Sequence
  Synthetic Oligonucleotide; PD-L1 exons 4 and 5; Set C
uguccagaugacuucggccuuggg

SEQ ID NO: 22575 - RNA, 23 nt, Artificial Sequence
  Synthetic Oligonucleotide; PD-L1 exons 4 and 5; Set A
uguccagaugacuucggccuugg

SEQ ID NO: 22576 - RNA, 25 nt, Artificial Sequence
  Synthetic Oligonucleotide; PD-L1 exons 4 and 5; Set C
uuguccagaugacuucggccuuggg

SEQ ID NO: 22577 - RNA, 24 nt, Artificial Sequence
  Synthetic Oligonucleotide; PD-L1 exons 4 and 5; Set A
uuguccagaugacuucggccuugg

SEQ ID NO: 22578 - RNA, 22 nt, Artificial Sequence
  Synthetic Oligonucleotide; PD-L1 exons 4 and 5; Set A
uguccagaugacuucggccuug

SEQ ID NO: 22579 - RNA, 26 nt, Artificial Sequence
  Synthetic Oligonucleotide; PD-L1 exons 4 and 5; Set C
cuuguccagaugacuucggccuuggg

SEQ ID NO: 22580 - RNA, 25 nt, Artificial Sequence
  Synthetic Oligonucleotide; PD-L1 exons 4 and 5; Set A
cuuguccagaugacuucggccuugg

SEQ ID NO: 22581 - RNA, 23 nt, Artificial Sequence
  Synthetic Oligonucleotide; PD-L1 exons 4 and 5; Set A
uuguccagaugacuucggccuug

SEQ ID NO: 22582 - RNA, 24 nt, Artificial Sequence
  Synthetic Oligonucleotide; PD-L1 exons 4 and 5; Set A
cuuguccagaugacuucggccuug

SEQ ID NO: 22583 - RNA, 15 nt, Artificial Sequence
  Synthetic Oligonucleotide; PD-L1 exons 4 and 5; Set C
guccagaugacuucg

SEQ ID NO: 22584 - RNA, 29 nt, Artificial Sequence
  Synthetic Oligonucleotide; PD-L1 exons 4 and 5; Set C
uggucacugcuuguccagaugacuucggc

SEQ ID NO: 22585 - RNA, 28 nt, Artificial Sequence
  Synthetic Oligonucleotide; PD-L1 exons 4 and 5; Set C
uggucacugcuuguccagaugacuucgg

SEQ ID NO: 22586 - RNA, 24 nt, Artificial Sequence
  Synthetic Oligonucleotide; PD-L1 exons 4 and 5; Set A
uggucacugcuuguccagaugacu

SEQ ID NO: 22587 - RNA, 23 nt, Artificial Sequence
  Synthetic Oligonucleotide; PD-L1 exons 4 and 5; Set A
uggucacugcuuguccagaugac

SEQ ID NO: 22588 - RNA, 35 nt, Artificial Sequence
  Synthetic Oligonucleotide; PD-L1 exons 4 and 5; Set C
acuugauggucacugcuuguccagaugacuucggc

SEQ ID NO: 22589 - RNA, 22 nt, Artificial Sequence
  Synthetic Oligonucleotide; PD-L1 exons 4 and 5; Set A
uggucacugcuuguccagauga

SEQ ID NO: 22590 - RNA, 24 nt, Artificial Sequence
  Synthetic Oligonucleotide; PD-L1 exons 4 and 5; Set A
auggucacugcuuguccagaugac

SEQ ID NO: 22591 - RNA, 34 nt, Artificial Sequence
  Synthetic Oligonucleotide; PD-L1 exons 4 and 5; Set C
acuugauggucacugcuuguccagaugacuucgg

SEQ ID NO: 22592 - RNA, 23 nt, Artificial Sequence
  Synthetic Oligonucleotide; PD-L1 exons 4 and 5; Set A
auggucacugcuuguccagauga

SEQ ID NO: 22593 - RNA, 34 nt, Artificial Sequence
  Synthetic Oligonucleotide; PD-L1 exons 4 and 5; Set C
gacuugauggucacugcuuguccagaugacuucg

SEQ ID NO: 22594 - RNA, 24 nt, Artificial Sequence
  Synthetic Oligonucleotide; PD-L1 exons 4 and 5; Set A
gauggucacugcuuguccagauga

SEQ ID NO: 22595 - RNA, 33 nt, Artificial Sequence
  Synthetic Oligonucleotide; PD-L1 exons 4 and 5; Set C
gacuugauggucacugcuuguccagaugacuuc

SEQ ID NO: 22596 - RNA, 35 nt, Artificial Sequence
  Synthetic Oligonucleotide; PD-L1 exons 4 and 5; Set C
ggacuugauggucacugcuuguccagaugacuucg

SEQ ID NO: 22597 - RNA, 34 nt, Artificial Sequence
  Synthetic Oligonucleotide; PD-L1 exons 4 and 5; Set C
ggacuugauggucacugcuuguccagaugacuuc

SEQ ID NO: 22598 - RNA, 32 nt, Artificial Sequence
  Synthetic Oligonucleotide; PD-L1 exons 4 and 5; Set C
gacuugauggucacugcuuguccagaugacuu

SEQ ID NO: 22599 - RNA, 30 nt, Artificial Sequence
  Synthetic Oligonucleotide; PD-L1 exons 4 and 5; Set C
acuugauggucacugcuuguccagaugacu

SEQ ID NO: 22600 - RNA, 33 nt, Artificial Sequence
  Synthetic Oligonucleotide; PD-L1 exons 4 and 5; Set C
ggacuugauggucacugcuuguccagaugacuu

SEQ ID NO: 22601 - RNA, 29 nt, Artificial Sequence
  Synthetic Oligonucleotide; PD-L1 exons 4 and 5; Set C
acuugauggucacugcuuguccagaugac

SEQ ID NO: 22602 - RNA, 28 nt, Artificial Sequence
  Synthetic Oligonucleotide; PD-L1 exons 4 and 5; Set C
acuugauggucacugcuuguccagauga

SEQ ID NO: 22603 - RNA, 27 nt, Artificial Sequence
  Synthetic Oligonucleotide; PD-L1 exons 4 and 5; Set A
acuugauggucacugcuuguccagaug

SEQ ID NO: 22604 - RNA, 26 nt, Artificial Sequence
  Synthetic Oligonucleotide; PD-L1 exons 4 and 5; Set A
acuugauggucacugcuuguccagau

SEQ ID NO: 22605 - RNA, 28 nt, Artificial Sequence
  Synthetic Oligonucleotide; PD-L1 exons 4 and 5; Set C
gacuugauggucacugcuuguccagaug

SEQ ID NO: 22606 - RNA, 27 nt, Artificial Sequence
  Synthetic Oligonucleotide; PD-L1 exons 4 and 5; Set C
gacuugauggucacugcuuguccagau

SEQ ID NO: 22607 - RNA, 29 nt, Artificial Sequence
  Synthetic Oligonucleotide; PD-L1 exons 4 and 5; Set C
ggacuugauggucacugcuuguccagaug

SEQ ID NO: 22608 - RNA, 17 nt, Artificial Sequence
  Synthetic Oligonucleotide; PD-L1 exons 4 and 5; Set C
gauggucacugcuuguc

SEQ ID NO: 22609 - RNA, 28 nt, Artificial Sequence
  Synthetic Oligonucleotide; PD-L1 exons 4 and 5; Set C
ggacuugauggucacugcuuguccagau

SEQ ID NO: 22610 - RNA, 18 nt, Artificial Sequence
  Synthetic Oligonucleotide; PD-L1 exons 4 and 5; Set C
ugauggucacugcuuguc

SEQ ID NO: 22611 - RNA, 19 nt, Artificial Sequence
  Synthetic Oligonucleotide; PD-L1 exons 4 and 5; Set C
uugauggucacugcuuguc

SEQ ID NO: 22612 - RNA, 20 nt, Artificial Sequence
  Synthetic Oligonucleotide; PD-L1 exons 4 and 5; Set C
cuugauggucacugcuuguc

SEQ ID NO: 22613 - RNA, 21 nt, Artificial Sequence
  Synthetic Oligonucleotide; PD-L1 exons 4 and 5; Set A
gacuugauggucacugcuugu

SEQ ID NO: 22614 - RNA, 20 nt, Artificial Sequence
  Synthetic Oligonucleotide; PD-L1 exons 4 and 5; Set C
gacuugauggucacugcuug

SEQ ID NO: 22615 - RNA, 22 nt, Artificial Sequence
  Synthetic Oligonucleotide; PD-L1 exons 4 and 5; Set A
ggacuugauggucacugcuugu

SEQ ID NO: 22616 - RNA, 19 nt, Artificial Sequence
  Synthetic Oligonucleotide; PD-L1 exons 4 and 5; Set C
gacuugauggucacugcuu

SEQ ID NO: 22617 - RNA, 21 nt, Artificial Sequence
  Synthetic Oligonucleotide; PD-L1 exons 4 and 5; Set A
ggacuugauggucacugcuug

SEQ ID NO: 22618 - RNA, 20 nt, Artificial Sequence
  Synthetic Oligonucleotide; PD-L1 exons 4 and 5; Set A
ggacuugauggucacugcuu

SEQ ID NO: 22619 - RNA, 17 nt, Artificial Sequence
  Synthetic Oligonucleotide; PD-L1 exons 4 and 5; Set C
cuuaccacucaggacuu

SEQ ID NO: 22620 - RNA, 18 nt, Artificial Sequence
  Synthetic Oligonucleotide; PD-L1 exons 4 and 5; Set C
ucuuaccacucaggacuu

SEQ ID NO: 22621 - RNA, 18 nt, Artificial Sequence
  Synthetic Oligonucleotide; PD-L1 exons 4 and 5; Set C
gucuuaccacucaggacu

SEQ ID NO: 22622 - RNA, 19 nt, Artificial Sequence
  Synthetic Oligonucleotide; PD-L1 exons 4 and 5; Set A
ggucuuaccacucaggacu

SEQ ID NO: 22623 - RNA, 29 nt, Artificial Sequence
  Synthetic Oligonucleotide; PD-L1 exons 4 and 5; Set C
guggugguggucuuaccacucaggacuug

SEQ ID NO: 22624 - RNA, 28 nt, Artificial Sequence
  Synthetic Oligonucleotide; PD-L1 exons 4 and 5; Set C
guggugguggucuuaccacucaggacuu

SEQ ID NO: 22625 - RNA, 29 nt, Artificial Sequence
  Synthetic Oligonucleotide; PD-L1 exons 4 and 5; Set C
gguggugguggucuuaccacucaggacuu

SEQ ID NO: 22626 - RNA, 29 nt, Artificial Sequence
  Synthetic Oligonucleotide; PD-L1 exons 4 and 5; Set C
ugguggugguggucuuaccacucaggacu

SEQ ID NO: 22627 - RNA, 30 nt, Artificial Sequence
  Synthetic Oligonucleotide; PD-L1 exons 4 and 5; Set C
uugguggugguggucuuaccacucaggacu

SEQ ID NO: 22628 - RNA, 31 nt, Artificial Sequence
  Synthetic Oligonucleotide; PD-L1 exons 4 and 5; Set C
auugguggugguggucuuaccacucaggacu

SEQ ID NO: 22629 - RNA, 39 nt, Artificial Sequence
  Synthetic Oligonucleotide; PD-L1 exons 4 and 5; Set C
uuggaauugguggugguggucuuaccacucaggacuuga

SEQ ID NO: 22630 - RNA, 38 nt, Artificial Sequence
  Synthetic Oligonucleotide; PD-L1 exons 4 and 5; Set C
uuggaauugguggugguggucuuaccacucaggacuug

SEQ ID NO: 22631 - RNA, 37 nt, Artificial Sequence
  Synthetic Oligonucleotide; PD-L1 exons 4 and 5; Set C
uuggaauugguggugguggucuuaccacucaggacuu

SEQ ID NO: 22632 - RNA, 37 nt, Artificial Sequence
  Synthetic Oligonucleotide; PD-L1 exons 4 and 5; Set C
cuuggaauugguggugguggucuuaccacucaggacu

SEQ ID NO: 22633 - RNA, 38 nt, Artificial Sequence
  Synthetic Oligonucleotide; PD-L1 exons 4 and 5; Set C
ucuuggaauugguggugguggucuuaccacucaggacu

SEQ ID NO: 22634 - RNA, 36 nt, Artificial Sequence
  Synthetic Oligonucleotide; PD-L1 exons 4 and 5; Set C
cuuggaauugguggugguggucuuaccacucaggac

SEQ ID NO: 22635 - RNA, 39 nt, Artificial Sequence
  Synthetic Oligonucleotide; PD-L1 exons 4 and 5; Set C
cucuuggaauugguggugguggucuuaccacucaggacu

SEQ ID NO: 22636 - RNA, 37 nt, Artificial Sequence
  Synthetic Oligonucleotide; PD-L1 exons 4 and 5; Set C
ucuuggaauugguggugguggucuuaccacucaggac

SEQ ID NO: 22637 - RNA, 35 nt, Artificial Sequence
  Synthetic Oligonucleotide; PD-L1 exons 4 and 5; Set C
cuuggaauugguggugguggucuuaccacucagga

SEQ ID NO: 22638 - RNA, 40 nt, Artificial Sequence
  Synthetic Oligonucleotide; PD-L1 exons 4 and 5; Set C
ucucuuggaauugguggugguggucuuaccacucaggacu

SEQ ID NO: 22639 - RNA, 38 nt, Artificial Sequence
  Synthetic Oligonucleotide; PD-L1 exons 4 and 5; Set C
cucuuggaauugguggugguggucuuaccacucaggac

SEQ ID NO: 22640 - RNA, 36 nt, Artificial Sequence
  Synthetic Oligonucleotide; PD-L1 exons 4 and 5; Set C
ucuuggaauugguggugguggucuuaccacucagga

SEQ ID NO: 22641 - RNA, 39 nt, Artificial Sequence
  Synthetic Oligonucleotide; PD-L1 exons 4 and 5; Set C
ucucuuggaauugguggugguggucuuaccacucaggac

SEQ ID NO: 22642 - RNA, 37 nt, Artificial Sequence
  Synthetic Oligonucleotide; PD-L1 exons 4 and 5; Set C
cucuuggaauugguggugguggucuuaccacucagga

SEQ ID NO: 22643 - RNA, 40 nt, Artificial Sequence
  Synthetic Oligonucleotide; PD-L1 exons 4 and 5; Set C
cucucuuggaauugguggugguggucuuaccacucaggac

SEQ ID NO: 22644 - RNA, 38 nt, Artificial Sequence
  Synthetic Oligonucleotide; PD-L1 exons 4 and 5; Set C
ucucuuggaauugguggugguggucuuaccacucagga

SEQ ID NO: 22645 - RNA, 39 nt, Artificial Sequence
  Synthetic Oligonucleotide; PD-L1 exons 4 and 5; Set C
cucucuuggaauugguggugguggucuuaccacucagga

SEQ ID NO: 22646 - RNA, 19 nt, Artificial Sequence
  Synthetic Oligonucleotide; PD-L1 exons 4 and 5; Set C
auugguggugguggucuua

SEQ ID NO: 22647 - RNA, 40 nt, Artificial Sequence
  Synthetic Oligonucleotide; PD-L1 exons 4 and 5; Set C
ucucucuuggaauugguggugguggucuuaccacucagga

SEQ ID NO: 22648 - RNA, 19 nt, Artificial Sequence
  Synthetic Oligonucleotide; PD-L1 exons 4 and 5; Set C
aauugguggugguggucuu

SEQ ID NO: 22649 - RNA, 20 nt, Artificial Sequence
  Synthetic Oligonucleotide; PD-L1 exons 4 and 5; Set C
gaauugguggugguggucuu

SEQ ID NO: 22650 - RNA, 18 nt, Artificial Sequence
  Synthetic Oligonucleotide; PD-L1 exons 4 and 5; Set C
aauugguggugguggucu

SEQ ID NO: 22651 - RNA, 19 nt, Artificial Sequence
  Synthetic Oligonucleotide; PD-L1 exons 4 and 5; Set C
gaauugguggugguggucu

SEQ ID NO: 22652 - RNA, 17 nt, Artificial Sequence
  Synthetic Oligonucleotide; PD-L1 exons 4 and 5; Set C
aauuggugguggugguc

SEQ ID NO: 22653 - RNA, 16 nt, Artificial Sequence
  Synthetic Oligonucleotide; PD-L1 exons 4 and 5; Set C
aauugguggugguggu

SEQ ID NO: 22654 - RNA, 18 nt, Artificial Sequence
  Synthetic Oligonucleotide; PD-L1 exons 4 and 5; Set C
gaauuggugguggugguc

SEQ ID NO: 22655 - RNA, 17 nt, Artificial Sequence
  Synthetic Oligonucleotide; PD-L1 exons 4 and 5; Set C
gaauugguggugguggu

SEQ ID NO: 22656 - RNA, 25 nt, Artificial Sequence
  Synthetic Oligonucleotide; PD-L1 exons 4 and 5; Set A
cuuggaauugguggugguggucuua

SEQ ID NO: 22657 - RNA, 26 nt, Artificial Sequence
  Synthetic Oligonucleotide; PD-L1 exons 4 and 5; Set A
ucuuggaauugguggugguggucuua

SEQ ID NO: 22658 - RNA, 27 nt, Artificial Sequence
  Synthetic Oligonucleotide; PD-L1 exons 4 and 5; Set A
cucuuggaauugguggugguggucuua

SEQ ID NO: 22659 - RNA, 28 nt, Artificial Sequence
  Synthetic Oligonucleotide; PD-L1 exons 4 and 5; Set A
ucucuuggaauugguggugguggucuua

SEQ ID NO: 22660 - RNA, 29 nt, Artificial Sequence
  Synthetic Oligonucleotide; PD-L1 exons 4 and 5; Set C
cucucuuggaauugguggugguggucuua

SEQ ID NO: 22661 - RNA, 30 nt, Artificial Sequence
  Synthetic Oligonucleotide; PD-L1 exons 4 and 5; Set C
ucucucuuggaauugguggugguggucuua

SEQ ID NO: 22662 - RNA, 37 nt, Artificial Sequence
  Synthetic Oligonucleotide; PD-L1 exons 4 and 5; Set C
cuucuccucucucuuggaauugguggugguggucuua

SEQ ID NO: 22663 - RNA, 38 nt, Artificial Sequence
  Synthetic Oligonucleotide; PD-L1 exons 4 and 5; Set C
gcuucuccucucucuuggaauugguggugguggucuua

SEQ ID NO: 22664 - RNA, 39 nt, Artificial Sequence
  Synthetic Oligonucleotide; PD-L1 exons 4 and 5; Set C
aagcuucuccucucucuuggaauugguggugguggucuu

SEQ ID NO: 22665 - RNA, 38 nt, Artificial Sequence
  Synthetic Oligonucleotide; PD-L1 exons 4 and 5; Set C
aagcuucuccucucucuuggaauugguggugguggucu

SEQ ID NO: 22666 - RNA, 37 nt, Artificial Sequence
  Synthetic Oligonucleotide; PD-L1 exons 4 and 5; Set C
aagcuucuccucucucuuggaauuggugguggugguc

SEQ ID NO: 22667 - RNA, 36 nt, Artificial Sequence
  Synthetic Oligonucleotide; PD-L1 exons 4 and 5; Set C
aagcuucuccucucucuuggaauugguggugguggu

SEQ ID NO: 22668 - RNA, 22 nt, Artificial Sequence
  Synthetic Oligonucleotide; PD-L1 exons 4 and 5; Set C
cuccucucucuuggaauuggug

SEQ ID NO: 22669 - RNA, 21 nt, Artificial Sequence
  Synthetic Oligonucleotide; PD-L1 exons 4 and 5; Set C
cuccucucucuuggaauuggu

SEQ ID NO: 22670 - RNA, 20 nt, Artificial Sequence
  Synthetic Oligonucleotide; PD-L1 exons 4 and 5; Set C
cuccucucucuuggaauugg

SEQ ID NO: 22671 - RNA, 19 nt, Artificial Sequence
  Synthetic Oligonucleotide; PD-L1 exons 4 and 5; Set C
cuccucucucuuggaauug

SEQ ID NO: 22672 - RNA, 18 nt, Artificial Sequence
  Synthetic Oligonucleotide; PD-L1 exons 4 and 5; Set C
ucuccucucucuuggaau

SEQ ID NO: 22673 - RNA, 19 nt, Artificial Sequence
  Synthetic Oligonucleotide; PD-L1 exons 4 and 5; Set C
uucuccucucucuuggaau

SEQ ID NO: 22674 - RNA, 17 nt, Artificial Sequence
  Synthetic Oligonucleotide; PD-L1 exons 4 and 5; Set C
ucuccucucucuuggaa

SEQ ID NO: 22675 - RNA, 20 nt, Artificial Sequence
  Synthetic Oligonucleotide; PD-L1 exons 4 and 5; Set C
cuucuccucucucuuggaau

SEQ ID NO: 22676 - RNA, 18 nt, Artificial Sequence
  Synthetic Oligonucleotide; PD-L1 exons 4 and 5; Set C
uucuccucucucuuggaa

SEQ ID NO: 22677 - RNA, 21 nt, Artificial Sequence
  Synthetic Oligonucleotide; PD-L1 exons 4 and 5; Set C
gcuucuccucucucuuggaau

SEQ ID NO: 22678 - RNA, 19 nt, Artificial Sequence
  Synthetic Oligonucleotide; PD-L1 exons 4 and 5; Set C
cuucuccucucucuuggaa

SEQ ID NO: 22679 - RNA, 22 nt, Artificial Sequence
  Synthetic Oligonucleotide; PD-L1 exons 4 and 5; Set C
agcuucuccucucucuuggaau

SEQ ID NO: 22680 - RNA, 20 nt, Artificial Sequence
  Synthetic Oligonucleotide; PD-L1 exons 4 and 5; Set C
gcuucuccucucucuuggaa

SEQ ID NO: 22681 - RNA, 18 nt, Artificial Sequence
  Synthetic Oligonucleotide; PD-L1 exons 4 and 5; Set C
cuucuccucucucuugga

SEQ ID NO: 22682 - RNA, 21 nt, Artificial Sequence
  Synthetic Oligonucleotide; PD-L1 exons 4 and 5; Set C
agcuucuccucucucuuggaa

SEQ ID NO: 22683 - RNA, 17 nt, Artificial Sequence
  Synthetic Oligonucleotide; PD-L1 exons 4 and 5; Set C
cuucuccucucucuugg

SEQ ID NO: 22684 - RNA, 19 nt, Artificial Sequence
  Synthetic Oligonucleotide; PD-L1 exons 4 and 5; Set A
gcuucuccucucucuugga

SEQ ID NO: 22685 - RNA, 18 nt, Artificial Sequence
  Synthetic Oligonucleotide; PD-L1 exons 4 and 5; Set C
gcuucuccucucucuugg

SEQ ID NO: 22686 - RNA, 19 nt, Artificial Sequence
  Synthetic Oligonucleotide; PD-L1 exons 4 and 5; Set C
agcuucuccucucucuugg

SEQ ID NO: 22687 - RNA, 19 nt, Artificial Sequence
  Synthetic Oligonucleotide; PD-L1 exons 4 and 5; Set C
aagcuucuccucucucuug

SEQ ID NO: 22688 - RNA, 35 nt, Artificial Sequence
  Synthetic Oligonucleotide; PD-L1 exons 4 and 5; Set A
ggucacauugaaaagcuucuccucucucuuggaau

SEQ ID NO: 22689 - RNA, 40 nt, Artificial Sequence
  Synthetic Oligonucleotide; PD-L1 exons 4 and 5; Set C
gcuggucacauugaaaagcuucuccucucucuuggaauug

SEQ ID NO: 22690 - RNA, 36 nt, Artificial Sequence
  Synthetic Oligonucleotide; PD-L1 exons 4 and 5; Set C
uggucacauugaaaagcuucuccucucucuuggaau

SEQ ID NO: 22691 - RNA, 39 nt, Artificial Sequence
  Synthetic Oligonucleotide; PD-L1 exons 4 and 5; Set C
gcuggucacauugaaaagcuucuccucucucuuggaauu

SEQ ID NO: 22692 - RNA, 37 nt, Artificial Sequence
  Synthetic Oligonucleotide; PD-L1 exons 4 and 5; Set C
cuggucacauugaaaagcuucuccucucucuuggaau

SEQ ID NO: 22693 - RNA, 40 nt, Artificial Sequence
  Synthetic Oligonucleotide; PD-L1 exons 4 and 5; Set C
ugcuggucacauugaaaagcuucuccucucucuuggaauu

SEQ ID NO: 22694 - RNA, 31 nt, Artificial Sequence
  Synthetic Oligonucleotide; PD-L1 exons 4 and 5; Set A
ggucacauugaaaagcuucuccucucucuug

SEQ ID NO: 22695 - RNA, 33 nt, Artificial Sequence
  Synthetic Oligonucleotide; PD-L1 exons 4 and 5; Set C
gcuggucacauugaaaagcuucuccucucucuu

SEQ ID NO: 22696 - RNA, 32 nt, Artificial Sequence
  Synthetic Oligonucleotide; PD-L1 exons 4 and 5; Set C
gcuggucacauugaaaagcuucuccucucucu

SEQ ID NO: 22697 - RNA, 34 nt, Artificial Sequence
  Synthetic Oligonucleotide; PD-L1 exons 4 and 5; Set C
ugcuggucacauugaaaagcuucuccucucucuu

SEQ ID NO: 22698 - RNA, 33 nt, Artificial Sequence
  Synthetic Oligonucleotide; PD-L1 exons 4 and 5; Set C
ugcuggucacauugaaaagcuucuccucucucu

SEQ ID NO: 22699 - RNA, 35 nt, Artificial Sequence
  Synthetic Oligonucleotide; PD-L1 exons 4 and 5; Set C
gugcuggucacauugaaaagcuucuccucucucuu

SEQ ID NO: 22700 - RNA, 31 nt, Artificial Sequence
  Synthetic Oligonucleotide; PD-L1 exons 4 and 5; Set A
gcuggucacauugaaaagcuucuccucucuc

SEQ ID NO: 22701 - RNA, 25 nt, Artificial Sequence
  Synthetic Oligonucleotide; PD-L1 exons 4 and 5; Set A
ggucacauugaaaagcuucuccucu

SEQ ID NO: 22702 - RNA, 37 nt, Artificial Sequence
  Synthetic Oligonucleotide; PD-L1 exons 4 and 5; Set C
ugugcuggucacauugaaaagcuucuccucucucuug

SEQ ID NO: 22703 - RNA, 34 nt, Artificial Sequence
  Synthetic Oligonucleotide; PD-L1 exons 4 and 5; Set C
gugcuggucacauugaaaagcuucuccucucucu

SEQ ID NO: 22704 - RNA, 36 nt, Artificial Sequence
  Synthetic Oligonucleotide; PD-L1 exons 4 and 5; Set C
ugugcuggucacauugaaaagcuucuccucucucuu

SEQ ID NO: 22705 - RNA, 32 nt, Artificial Sequence
  Synthetic Oligonucleotide; PD-L1 exons 4 and 5; Set C
ugcuggucacauugaaaagcuucuccucucuc

SEQ ID NO: 22706 - RNA, 30 nt, Artificial Sequence
  Synthetic Oligonucleotide; PD-L1 exons 4 and 5; Set A
gcuggucacauugaaaagcuucuccucucu

SEQ ID NO: 22707 - RNA, 35 nt, Artificial Sequence
  Synthetic Oligonucleotide; PD-L1 exons 4 and 5; Set C
ugugcuggucacauugaaaagcuucuccucucucu

SEQ ID NO: 22708 - RNA, 33 nt, Artificial Sequence
  Synthetic Oligonucleotide; PD-L1 exons 4 and 5; Set C
gugcuggucacauugaaaagcuucuccucucuc

SEQ ID NO: 22709 - RNA, 31 nt, Artificial Sequence
  Synthetic Oligonucleotide; PD-L1 exons 4 and 5; Set A
ugcuggucacauugaaaagcuucuccucucu

SEQ ID NO: 22710 - RNA, 29 nt, Artificial Sequence
  Synthetic Oligonucleotide; PD-L1 exons 4 and 5; Set A
gcuggucacauugaaaagcuucuccucuc

SEQ ID NO: 22711 - RNA, 39 nt, Artificial Sequence
  Synthetic Oligonucleotide; PD-L1 exons 4 and 5; Set C
agugugcuggucacauugaaaagcuucuccucucucuug

SEQ ID NO: 22712 - RNA, 34 nt, Artificial Sequence
  Synthetic Oligonucleotide; PD-L1 exons 4 and 5; Set C
ugugcuggucacauugaaaagcuucuccucucuc

SEQ ID NO: 22713 - RNA, 32 nt, Artificial Sequence
  Synthetic Oligonucleotide; PD-L1 exons 4 and 5; Set C
gugcuggucacauugaaaagcuucuccucucu

SEQ ID NO: 22714 - RNA, 30 nt, Artificial Sequence
  Synthetic Oligonucleotide; PD-L1 exons 4 and 5; Set A
ugcuggucacauugaaaagcuucuccucuc

SEQ ID NO: 22715 - RNA, 33 nt, Artificial Sequence
  Synthetic Oligonucleotide; PD-L1 exons 4 and 5; Set C
ugugcuggucacauugaaaagcuucuccucucu

SEQ ID NO: 22716 - RNA, 31 nt, Artificial Sequence
  Synthetic Oligonucleotide; PD-L1 exons 4 and 5; Set C
gugcuggucacauugaaaagcuucuccucuc

SEQ ID NO: 22717 - RNA, 32 nt, Artificial Sequence
  Synthetic Oligonucleotide; PD-L1 exons 4 and 5; Set C
ugugcuggucacauugaaaagcuucuccucuc

SEQ ID NO: 22718 - RNA, 20 nt, Artificial Sequence
  Synthetic Oligonucleotide; PD-L1 exons 4 and 5; Set C
ggucacauugaaaagcuucu

SEQ ID NO: 22719 - RNA, 31 nt, Artificial Sequence
  Synthetic Oligonucleotide; PD-L1 exons 4 and 5; Set C
ugugcuggucacauugaaaagcuucuccucu

SEQ ID NO: 22720 - RNA, 21 nt, Artificial Sequence
  Synthetic Oligonucleotide; PD-L1 exons 4 and 5; Set C
uggucacauugaaaagcuucu

SEQ ID NO: 22721 - RNA, 18 nt, Artificial Sequence
  Synthetic Oligonucleotide; PD-L1 exons 4 and 5; Set C
ggucacauugaaaagcuu

SEQ ID NO: 22722 - RNA, 22 nt, Artificial Sequence
  Synthetic Oligonucleotide; PD-L1 exons 4 and 5; Set C
cuggucacauugaaaagcuucu

SEQ ID NO: 22723 - RNA, 20 nt, Artificial Sequence
  Synthetic Oligonucleotide; PD-L1 exons 4 and 5; Set C
uggucacauugaaaagcuuc

SEQ ID NO: 22724 - RNA, 33 nt, Artificial Sequence
  Synthetic Oligonucleotide; PD-L1 exons 4 and 5; Set C
agugugcuggucacauugaaaagcuucuccucu

SEQ ID NO: 22725 - RNA, 17 nt, Artificial Sequence
  Synthetic Oligonucleotide; PD-L1 exons 4 and 5; Set C
ggucacauugaaaagcu

SEQ ID NO: 22726 - RNA, 19 nt, Artificial Sequence
  Synthetic Oligonucleotide; PD-L1 exons 4 and 5; Set C
uggucacauugaaaagcuu

SEQ ID NO: 22727 - RNA, 21 nt, Artificial Sequence
  Synthetic Oligonucleotide; PD-L1 exons 4 and 5; Set C
cuggucacauugaaaagcuuc

SEQ ID NO: 22728 - RNA, 18 nt, Artificial Sequence
  Synthetic Oligonucleotide; PD-L1 exons 4 and 5; Set C
uggucacauugaaaagcu

SEQ ID NO: 22729 - RNA, 20 nt, Artificial Sequence
  Synthetic Oligonucleotide; PD-L1 exons 4 and 5; Set C
cuggucacauugaaaagcuu

SEQ ID NO: 22730 - RNA, 19 nt, Artificial Sequence
  Synthetic Oligonucleotide; PD-L1 exons 4 and 5; Set C
cuggucacauugaaaagcu

SEQ ID NO: 22731 - RNA, 17 nt, Artificial Sequence
  Synthetic Oligonucleotide; PD-L1 exons 4 and 5; Set C
uggucacauugaaaagc

SEQ ID NO: 22732 - RNA, 18 nt, Artificial Sequence
  Synthetic Oligonucleotide; PD-L1 exons 4 and 5; Set C
cuggucacauugaaaagc

SEQ ID NO: 22733 - RNA, 27 nt, Artificial Sequence
  Synthetic Oligonucleotide; PD-L1 exons 4 and 5; Set A
gugugcuggucacauugaaaagcuucu

SEQ ID NO: 22734 - RNA, 28 nt, Artificial Sequence
  Synthetic Oligonucleotide; PD-L1 exons 4 and 5; Set A
agugugcuggucacauugaaaagcuucu

SEQ ID NO: 22735 - RNA, 26 nt, Artificial Sequence
  Synthetic Oligonucleotide; PD-L1 exons 4 and 5; Set A
gugugcuggucacauugaaaagcuuc

SEQ ID NO: 22736 - RNA, 25 nt, Artificial Sequence
  Synthetic Oligonucleotide; PD-L1 exons 4 and 5; Set A
gugugcuggucacauugaaaagcuu

SEQ ID NO: 22737 - RNA, 27 nt, Artificial Sequence
  Synthetic Oligonucleotide; PD-L1 exons 4 and 5; Set A
agugugcuggucacauugaaaagcuuc

SEQ ID NO: 22738 - RNA, 40 nt, Artificial Sequence
  Synthetic Oligonucleotide; PD-L1 exons 4 and 5; Set C
gauucucagugugcuggucacauugaaaagcuucuccucu

SEQ ID NO: 22739 - RNA, 24 nt, Artificial Sequence
  Synthetic Oligonucleotide; PD-L1 exons 4 and 5; Set A
gugugcuggucacauugaaaagcu

SEQ ID NO: 22740 - RNA, 26 nt, Artificial Sequence
  Synthetic Oligonucleotide; PD-L1 exons 4 and 5; Set A
agugugcuggucacauugaaaagcuu

SEQ ID NO: 22741 - RNA, 25 nt, Artificial Sequence
  Synthetic Oligonucleotide; PD-L1 exons 4 and 5; Set A
agugugcuggucacauugaaaagcu

SEQ ID NO: 22742 - RNA, 23 nt, Artificial Sequence
  Synthetic Oligonucleotide; PD-L1 exons 4 and 5; Set A
gugugcuggucacauugaaaagc

SEQ ID NO: 22743 - RNA, 24 nt, Artificial Sequence
  Synthetic Oligonucleotide; PD-L1 exons 4 and 5; Set A
agugugcuggucacauugaaaagc

SEQ ID NO: 22744 - RNA, 35 nt, Artificial Sequence
  Synthetic Oligonucleotide; PD-L1 exons 4 and 5; Set C
gauucucagugugcuggucacauugaaaagcuucu

SEQ ID NO: 22745 - RNA, 36 nt, Artificial Sequence
  Synthetic Oligonucleotide; PD-L1 exons 4 and 5; Set C
ugauucucagugugcuggucacauugaaaagcuucu

SEQ ID NO: 22746 - RNA, 34 nt, Artificial Sequence
  Synthetic Oligonucleotide; PD-L1 exons 4 and 5; Set A
gauucucagugugcuggucacauugaaaagcuuc

SEQ ID NO: 22747 - RNA, 33 nt, Artificial Sequence
  Synthetic Oligonucleotide; PD-L1 exons 4 and 5; Set A
gauucucagugugcuggucacauugaaaagcuu

SEQ ID NO: 22748 - RNA, 37 nt, Artificial Sequence
  Synthetic Oligonucleotide; PD-L1 exons 4 and 5; Set C
uugauucucagugugcuggucacauugaaaagcuucu

SEQ ID NO: 22749 - RNA, 35 nt, Artificial Sequence
  Synthetic Oligonucleotide; PD-L1 exons 4 and 5; Set C
ugauucucagugugcuggucacauugaaaagcuuc

SEQ ID NO: 22750 - RNA, 32 nt, Artificial Sequence
  Synthetic Oligonucleotide; PD-L1 exons 4 and 5; Set A
gauucucagugugcuggucacauugaaaagcu

SEQ ID NO: 22751 - RNA, 38 nt, Artificial Sequence
  Synthetic Oligonucleotide; PD-L1 exons 4 and 5; Set C
guugauucucagugugcuggucacauugaaaagcuucu

SEQ ID NO: 22752 - RNA, 36 nt, Artificial Sequence
  Synthetic Oligonucleotide; PD-L1 exons 4 and 5; Set C
uugauucucagugugcuggucacauugaaaagcuuc

SEQ ID NO: 22753 - RNA, 31 nt, Artificial Sequence
  Synthetic Oligonucleotide; PD-L1 exons 4 and 5; Set A
gauucucagugugcuggucacauugaaaagc

SEQ ID NO: 22754 - RNA, 39 nt, Artificial Sequence
  Synthetic Oligonucleotide; PD-L1 exons 4 and 5; Set C
uguugauucucagugugcuggucacauugaaaagcuucu

SEQ ID NO: 22755 - RNA, 37 nt, Artificial Sequence
  Synthetic Oligonucleotide; PD-L1 exons 4 and 5; Set C
guugauucucagugugcuggucacauugaaaagcuuc

SEQ ID NO: 22756 - RNA, 32 nt, Artificial Sequence
  Synthetic Oligonucleotide; PD-L1 exons 4 and 5; Set A
ugauucucagugugcuggucacauugaaaagc

SEQ ID NO: 22757 - RNA, 40 nt, Artificial Sequence
  Synthetic Oligonucleotide; PD-L1 exons 4 and 5; Set C
guguugauucucagugugcuggucacauugaaaagcuucu

SEQ ID NO: 22758 - RNA, 38 nt, Artificial Sequence
  Synthetic Oligonucleotide; PD-L1 exons 4 and 5; Set C
uguugauucucagugugcuggucacauugaaaagcuuc

SEQ ID NO: 22759 - RNA, 33 nt, Artificial Sequence
  Synthetic Oligonucleotide; PD-L1 exons 4 and 5; Set A
uugauucucagugugcuggucacauugaaaagc

SEQ ID NO: 22760 - RNA, 39 nt, Artificial Sequence
  Synthetic Oligonucleotide; PD-L1 exons 4 and 5; Set C
guguugauucucagugugcuggucacauugaaaagcuuc

SEQ ID NO: 22761 - RNA, 34 nt, Artificial Sequence
  Synthetic Oligonucleotide; PD-L1 exons 4 and 5; Set C
guugauucucagugugcuggucacauugaaaagc

SEQ ID NO: 22762 - RNA, 40 nt, Artificial Sequence
  Synthetic Oligonucleotide; PD-L1 exons 4 and 5; Set C
uguguugauucucagugugcuggucacauugaaaagcuuc

SEQ ID NO: 22763 - RNA, 35 nt, Artificial Sequence
  Synthetic Oligonucleotide; PD-L1 exons 4 and 5; Set C
uguugauucucagugugcuggucacauugaaaagc

SEQ ID NO: 22764 - RNA, 36 nt, Artificial Sequence
  Synthetic Oligonucleotide; PD-L1 exons 4 and 5; Set C
guguugauucucagugugcuggucacauugaaaagc

SEQ ID NO: 22765 - RNA, 39 nt, Artificial Sequence
  Synthetic Oligonucleotide; PD-L1 exons 4 and 5; Set C
uguuguguugauucucagugugcuggucacauugaaaag

SEQ ID NO: 22766 - RNA, 40 nt, Artificial Sequence
  Synthetic Oligonucleotide; PD-L1 exons 4 and 5; Set C
uuguuguguugauucucagugugcuggucacauugaaaag

SEQ ID NO: 22767 - RNA, 15 nt, Artificial Sequence
  Synthetic Oligonucleotide; PD-L1 exons 4 and 5; Set C
gauucucagugugcu

SEQ ID NO: 22768 - RNA, 15 nt, Artificial Sequence
  Synthetic Oligonucleotide; PD-L1 exons 4 and 5; Set C
ugauucucagugugc

SEQ ID NO: 22769 - RNA, 16 nt, Artificial Sequence
  Synthetic Oligonucleotide; PD-L1 exons 4 and 5; Set C
uugauucucagugugc

SEQ ID NO: 22770 - RNA, 17 nt, Artificial Sequence
  Synthetic Oligonucleotide; PD-L1 exons 4 and 5; Set C
guugauucucagugugc

SEQ ID NO: 22771 - RNA, 15 nt, Artificial Sequence
  Synthetic Oligonucleotide; PD-L1 exons 4 and 5; Set C
uugauucucagugug

SEQ ID NO: 22772 - RNA, 16 nt, Artificial Sequence
  Synthetic Oligonucleotide; PD-L1 exons 4 and 5; Set C
guugauucucagugug

SEQ ID NO: 22773 - RNA, 15 nt, Artificial Sequence
  Synthetic Oligonucleotide; PD-L1 exons 4 and 5; Set C
guugauucucagugu

SEQ ID NO: 22774 - RNA, 17 nt, Artificial Sequence
  Synthetic Oligonucleotide; PD-L1 exons 4 and 5; Set C
uguugauucucagugug

SEQ ID NO: 22775 - RNA, 33 nt, Artificial Sequence
  Synthetic Oligonucleotide; PD-L1 exons 4 and 5; Set A
cucauuaguuguuguguugauucucagugugcu

SEQ ID NO: 22776 - RNA, 34 nt, Artificial Sequence
  Synthetic Oligonucleotide; PD-L1 exons 4 and 5; Set A
ucucauuaguuguuguguugauucucagugugcu

SEQ ID NO: 22777 - RNA, 32 nt, Artificial Sequence
  Synthetic Oligonucleotide; PD-L1 exons 4 and 5; Set A
cucauuaguuguuguguugauucucagugugc

SEQ ID NO: 22778 - RNA, 35 nt, Artificial Sequence
  Synthetic Oligonucleotide; PD-L1 exons 4 and 5; Set A
aucucauuaguuguuguguugauucucagugugcu

SEQ ID NO: 22779 - RNA, 33 nt, Artificial Sequence
  Synthetic Oligonucleotide; PD-L1 exons 4 and 5; Set A
ucucauuaguuguuguguugauucucagugugc

SEQ ID NO: 22780 - RNA, 31 nt, Artificial Sequence
  Synthetic Oligonucleotide; PD-L1 exons 4 and 5; Set A
cucauuaguuguuguguugauucucagugug

SEQ ID NO: 22781 - RNA, 30 nt, Artificial Sequence
  Synthetic Oligonucleotide; PD-L1 exons 4 and 5; Set A
cucauuaguuguuguguugauucucagugu

SEQ ID NO: 22782 - RNA, 34 nt, Artificial Sequence
  Synthetic Oligonucleotide; PD-L1 exons 4 and 5; Set A
aucucauuaguuguuguguugauucucagugugc

SEQ ID NO: 22783 - RNA, 32 nt, Artificial Sequence
  Synthetic Oligonucleotide; PD-L1 exons 4 and 5; Set A
ucucauuaguuguuguguugauucucagugug

SEQ ID NO: 22784 - RNA, 37 nt, Artificial Sequence
  Synthetic Oligonucleotide; PD-L1 exons 4 and 5; Set A
aaaucucauuaguuguuguguugauucucagugugcu

SEQ ID NO: 22785 - RNA, 31 nt, Artificial Sequence
  Synthetic Oligonucleotide; PD-L1 exons 4 and 5; Set A
ucucauuaguuguuguguugauucucagugu

SEQ ID NO: 22786 - RNA, 33 nt, Artificial Sequence
  Synthetic Oligonucleotide; PD-L1 exons 4 and 5; Set A
aucucauuaguuguuguguugauucucagugug

SEQ ID NO: 22787 - RNA, 15 nt, Artificial Sequence
  Synthetic Oligonucleotide; PD-L1 exons 4 and 5; Set C
guuguuguguugauu

SEQ ID NO: 22788 - RNA, 38 nt, Artificial Sequence
  Synthetic Oligonucleotide; PD-L1 exons 4 and 5; Set A
aaaaucucauuaguuguuguguugauucucagugugcu

SEQ ID NO: 22789 - RNA, 32 nt, Artificial Sequence
  Synthetic Oligonucleotide; PD-L1 exons 4 and 5; Set A
aucucauuaguuguuguguugauucucagugu

SEQ ID NO: 22790 - RNA, 36 nt, Artificial Sequence
  Synthetic Oligonucleotide; PD-L1 exons 4 and 5; Set A
aaaucucauuaguuguuguguugauucucagugugc

SEQ ID NO: 22791 - RNA, 16 nt, Artificial Sequence
  Synthetic Oligonucleotide; PD-L1 exons 4 and 5; Set C
aguuguuguguugauu

SEQ ID NO: 22792 - RNA, 29 nt, Artificial Sequence
  Synthetic Oligonucleotide; PD-L1 exons 4 and 5; Set A
ucucauuaguuguuguguugauucucagu

SEQ ID NO: 22793 - RNA, 39 nt, Artificial Sequence
  Synthetic Oligonucleotide; PD-L1 exons 4 and 5; Set A
gaaaaucucauuaguuguuguguugauucucagugugcu

SEQ ID NO: 22794 - RNA, 37 nt, Artificial Sequence
  Synthetic Oligonucleotide; PD-L1 exons 4 and 5; Set A
aaaaucucauuaguuguuguguugauucucagugugc

SEQ ID NO: 22795 - RNA, 35 nt, Artificial Sequence
  Synthetic Oligonucleotide; PD-L1 exons 4 and 5; Set A
aaaucucauuaguuguuguguugauucucagugug

SEQ ID NO: 22796 - RNA, 17 nt, Artificial Sequence
  Synthetic Oligonucleotide; PD-L1 exons 4 and 5; Set C
uaguuguuguguugauu

SEQ ID NO: 22797 - RNA, 30 nt, Artificial Sequence
  Synthetic Oligonucleotide; PD-L1 exons 4 and 5; Set A
aucucauuaguuguuguguugauucucagu

SEQ ID NO: 22798 - RNA, 40 nt, Artificial Sequence
  Synthetic Oligonucleotide; PD-L1 exons 4 and 5; Set A
agaaaaucucauuaguuguuguguugauucucagugugcu

SEQ ID NO: 22799 - RNA, 34 nt, Artificial Sequence
  Synthetic Oligonucleotide; PD-L1 exons 4 and 5; Set A
aaaucucauuaguuguuguguugauucucagugu

SEQ ID NO: 22800 - RNA, 38 nt, Artificial Sequence
  Synthetic Oligonucleotide; PD-L1 exons 4 and 5; Set A
gaaaaucucauuaguuguuguguugauucucagugugc

SEQ ID NO: 22801 - RNA, 36 nt, Artificial Sequence
  Synthetic Oligonucleotide; PD-L1 exons 4 and 5; Set A
aaaaucucauuaguuguuguguugauucucagugug

SEQ ID NO: 22802 - RNA, 35 nt, Artificial Sequence
  Synthetic Oligonucleotide; PD-L1 exons 4 and 5; Set A
aaaaucucauuaguuguuguguugauucucagugu

SEQ ID NO: 22803 - RNA, 39 nt, Artificial Sequence
  Synthetic Oligonucleotide; PD-L1 exons 4 and 5; Set A
agaaaaucucauuaguuguuguguugauucucagugugc

SEQ ID NO: 22804 - RNA, 37 nt, Artificial Sequence
  Synthetic Oligonucleotide; PD-L1 exons 4 and 5; Set A
gaaaaucucauuaguuguuguguugauucucagugug

SEQ ID NO: 22805 - RNA, 36 nt, Artificial Sequence
  Synthetic Oligonucleotide; PD-L1 exons 4 and 5; Set A
gaaaaucucauuaguuguuguguugauucucagugu

SEQ ID NO: 22806 - RNA, 38 nt, Artificial Sequence
  Synthetic Oligonucleotide; PD-L1 exons 4 and 5; Set A
agaaaaucucauuaguuguuguguugauucucagugug

SEQ ID NO: 22807 - RNA, 37 nt, Artificial Sequence
  Synthetic Oligonucleotide; PD-L1 exons 4 and 5; Set A
agaaaaucucauuaguuguuguguugauucucagugu

SEQ ID NO: 22808 - RNA, 25 nt, Artificial Sequence
  Synthetic Oligonucleotide; PD-L1 exons 4 and 5; Set C
aaucucauuaguuguuguguugauu

SEQ ID NO: 22809 - RNA, 40 nt, Artificial Sequence
  Synthetic Oligonucleotide; PD-L1 exons 4 and 5; Set A
caguagaaaaucucauuaguuguuguguugauucucagug

SEQ ID NO: 22810 - RNA, 26 nt, Artificial Sequence
  Synthetic Oligonucleotide; PD-L1 exons 4 and 5; Set C
aaaucucauuaguuguuguguugauu

SEQ ID NO: 22811 - RNA, 39 nt, Artificial Sequence
  Synthetic Oligonucleotide; PD-L1 exons 4 and 5; Set A
caguagaaaaucucauuaguuguuguguugauucucagu

SEQ ID NO: 22812 - RNA, 40 nt, Artificial Sequence
  Synthetic Oligonucleotide; PD-L1 exons 4 and 5; Set A
gcaguagaaaaucucauuaguuguuguguugauucucagu

SEQ ID NO: 22813 - RNA, 28 nt, Artificial Sequence
  Synthetic Oligonucleotide; PD-L1 exons 4 and 5; Set C
gaaaaucucauuaguuguuguguugauu

SEQ ID NO: 22814 - RNA, 29 nt, Artificial Sequence
  Synthetic Oligonucleotide; PD-L1 exons 4 and 5; Set C
agaaaaucucauuaguuguuguguugauu

SEQ ID NO: 22815 - RNA, 30 nt, Artificial Sequence
  Synthetic Oligonucleotide; PD-L1 exons 4 and 5; Set C
uagaaaaucucauuaguuguuguguugauu

SEQ ID NO: 22816 - RNA, 32 nt, Artificial Sequence
  Synthetic Oligonucleotide; PD-L1 exons 4 and 5; Set C
aguagaaaaucucauuaguuguuguguugauu

SEQ ID NO: 22817 - RNA, 32 nt, Artificial Sequence
  Synthetic Oligonucleotide; PD-L1 exons 4 and 5; Set C
caguagaaaaucucauuaguuguuguguugau

SEQ ID NO: 22818 - RNA, 33 nt, Artificial Sequence
  Synthetic Oligonucleotide; PD-L1 exons 4 and 5; Set A
gcaguagaaaaucucauuaguuguuguguugau

SEQ ID NO: 22819 - RNA, 34 nt, Artificial Sequence
  Synthetic Oligonucleotide; PD-L1 exons 4 and 5; Set A
ugcaguagaaaaucucauuaguuguuguguugau

SEQ ID NO: 22820 - RNA, 37 nt, Artificial Sequence
  Synthetic Oligonucleotide; PD-L1 exons 4 and 5; Set A
agugcaguagaaaaucucauuaguuguuguguugauu

SEQ ID NO: 22821 - RNA, 38 nt, Artificial Sequence
  Synthetic Oligonucleotide; PD-L1 exons 4 and 5; Set A
aagugcaguagaaaaucucauuaguuguuguguugauu

SEQ ID NO: 22822 - RNA, 38 nt, Artificial Sequence
  Synthetic Oligonucleotide; PD-L1 exons 4 and 5; Set A
aaagugcaguagaaaaucucauuaguuguuguguugau

SEQ ID NO: 22823 - RNA, 21 nt, Artificial Sequence
  Synthetic Oligonucleotide; PD-L1 exons 4 and 5; Set C
caguagaaaaucucauuaguu

SEQ ID NO: 22824 - RNA, 20 nt, Artificial Sequence
  Synthetic Oligonucleotide; PD-L1 exons 4 and 5; Set C
caguagaaaaucucauuagu

SEQ ID NO: 22825 - RNA, 22 nt, Artificial Sequence
  Synthetic Oligonucleotide; PD-L1 exons 4 and 5; Set C
gcaguagaaaaucucauuaguu

SEQ ID NO: 22826 - RNA, 23 nt, Artificial Sequence
  Synthetic Oligonucleotide; PD-L1 exons 4 and 5; Set C
ugcaguagaaaaucucauuaguu

SEQ ID NO: 22827 - RNA, 19 nt, Artificial Sequence
  Synthetic Oligonucleotide; PD-L1 exons 4 and 5; Set C
caguagaaaaucucauuag

SEQ ID NO: 22828 - RNA, 21 nt, Artificial Sequence
  Synthetic Oligonucleotide; PD-L1 exons 4 and 5; Set C
gcaguagaaaaucucauuagu

SEQ ID NO: 22829 - RNA, 22 nt, Artificial Sequence
  Synthetic Oligonucleotide; PD-L1 exons 4 and 5; Set C
ugcaguagaaaaucucauuagu

SEQ ID NO: 22830 - RNA, 20 nt, Artificial Sequence
  Synthetic Oligonucleotide; PD-L1 exons 4 and 5; Set C
gcaguagaaaaucucauuag

SEQ ID NO: 22831 - RNA, 21 nt, Artificial Sequence
  Synthetic Oligonucleotide; PD-L1 exons 4 and 5; Set C
ugcaguagaaaaucucauuag

SEQ ID NO: 22832 - RNA, 27 nt, Artificial Sequence
  Synthetic Oligonucleotide; PD-L1 exons 4 and 5; Set C
aaagugcaguagaaaaucucauuaguu

SEQ ID NO: 22833 - RNA, 16 nt, Artificial Sequence
  Synthetic Oligonucleotide; PD-L1 exons 4 and 5; Set C
gcaguagaaaaucuca

SEQ ID NO: 22834 - RNA, 26 nt, Artificial Sequence
  Synthetic Oligonucleotide; PD-L1 exons 4 and 5; Set C
aaagugcaguagaaaaucucauuagu

SEQ ID NO: 22835 - RNA, 25 nt, Artificial Sequence
  Synthetic Oligonucleotide; PD-L1 exons 4 and 5; Set C
aaagugcaguagaaaaucucauuag

SEQ ID NO: 22836 - RNA, 40 nt, Artificial Sequence
  Synthetic Oligonucleotide; PD-L1 exons 4 and 5; Set B
uaaucuccuaaaagugcaguagaaaaucucauuaguuguu

SEQ ID NO: 22837 - RNA, 34 nt, Artificial Sequence
  Synthetic Oligonucleotide; PD-L1 exons 4 and 5; Set B
ucuccuaaaagugcaguagaaaaucucauuaguu

SEQ ID NO: 22838 - RNA, 39 nt, Artificial Sequence
  Synthetic Oligonucleotide; PD-L1 exons 4 and 5; Set B
uaaucuccuaaaagugcaguagaaaaucucauuaguugu

SEQ ID NO: 22839 - RNA, 33 nt, Artificial Sequence
  Synthetic Oligonucleotide; PD-L1 exons 4 and 5; Set B
ucuccuaaaagugcaguagaaaaucucauuagu

SEQ ID NO: 22840 - RNA, 38 nt, Artificial Sequence
  Synthetic Oligonucleotide; PD-L1 exons 4 and 5; Set B
uaaucuccuaaaagugcaguagaaaaucucauuaguug

SEQ ID NO: 22841 - RNA, 40 nt, Artificial Sequence
  Synthetic Oligonucleotide; PD-L1 exons 4 and 5; Set B
cuaaucuccuaaaagugcaguagaaaaucucauuaguugu

SEQ ID NO: 22842 - RNA, 32 nt, Artificial Sequence
  Synthetic Oligonucleotide; PD-L1 exons 4 and 5; Set C
ucuccuaaaagugcaguagaaaaucucauuag

SEQ ID NO: 22843 - RNA, 39 nt, Artificial Sequence
  Synthetic Oligonucleotide; PD-L1 exons 4 and 5; Set B
cuaaucuccuaaaagugcaguagaaaaucucauuaguug

SEQ ID NO: 22844 - RNA, 37 nt, Artificial Sequence
  Synthetic Oligonucleotide; PD-L1 exons 4 and 5; Set B
uaaucuccuaaaagugcaguagaaaaucucauuaguu

SEQ ID NO: 22845 - RNA, 17 nt, Artificial Sequence
  Synthetic Oligonucleotide; PD-L1 exons 4 and 5; Set C
aaagugcaguagaaaau

SEQ ID NO: 22846 - RNA, 30 nt, Artificial Sequence
  Synthetic Oligonucleotide; PD-L1 exons 4 and 5; Set C
ucuccuaaaagugcaguagaaaaucucauu

SEQ ID NO: 22847 - RNA, 40 nt, Artificial Sequence
  Synthetic Oligonucleotide; PD-L1 exons 4 and 5; Set B
ucuaaucuccuaaaagugcaguagaaaaucucauuaguug

SEQ ID NO: 22848 - RNA, 36 nt, Artificial Sequence
  Synthetic Oligonucleotide; PD-L1 exons 4 and 5; Set C
uaaucuccuaaaagugcaguagaaaaucucauuagu

SEQ ID NO: 22849 - RNA, 38 nt, Artificial Sequence
  Synthetic Oligonucleotide; PD-L1 exons 4 and 5; Set B
cuaaucuccuaaaagugcaguagaaaaucucauuaguu

SEQ ID NO: 22850 - RNA, 29 nt, Artificial Sequence
  Synthetic Oligonucleotide; PD-L1 exons 4 and 5; Set C
ucuccuaaaagugcaguagaaaaucucau

SEQ ID NO: 22851 - RNA, 39 nt, Artificial Sequence
  Synthetic Oligonucleotide; PD-L1 exons 4 and 5; Set B
ucuaaucuccuaaaagugcaguagaaaaucucauuaguu

SEQ ID NO: 22852 - RNA, 35 nt, Artificial Sequence
  Synthetic Oligonucleotide; PD-L1 exons 4 and 5; Set C
uaaucuccuaaaagugcaguagaaaaucucauuag

SEQ ID NO: 22853 - RNA, 37 nt, Artificial Sequence
  Synthetic Oligonucleotide; PD-L1 exons 4 and 5; Set B
cuaaucuccuaaaagugcaguagaaaaucucauuagu

SEQ ID NO: 22854 - RNA, 34 nt, Artificial Sequence
  Synthetic Oligonucleotide; PD-L1 exons 4 and 5; Set C
uaaucuccuaaaagugcaguagaaaaucucauua

SEQ ID NO: 22855 - RNA, 28 nt, Artificial Sequence
  Synthetic Oligonucleotide; PD-L1 exons 4 and 5; Set C
ucuccuaaaagugcaguagaaaaucuca

SEQ ID NO: 22856 - RNA, 38 nt, Artificial Sequence
  Synthetic Oligonucleotide; PD-L1 exons 4 and 5; Set B
ucuaaucuccuaaaagugcaguagaaaaucucauuagu

SEQ ID NO: 22857 - RNA, 36 nt, Artificial Sequence
  Synthetic Oligonucleotide; PD-L1 exons 4 and 5; Set C
cuaaucuccuaaaagugcaguagaaaaucucauuag

SEQ ID NO: 22858 - RNA, 35 nt, Artificial Sequence
  Synthetic Oligonucleotide; PD-L1 exons 4 and 5; Set C
cuaaucuccuaaaagugcaguagaaaaucucauua

SEQ ID NO: 22859 - RNA, 33 nt, Artificial Sequence
  Synthetic Oligonucleotide; PD-L1 exons 4 and 5; Set C
uaaucuccuaaaagugcaguagaaaaucucauu

SEQ ID NO: 22860 - RNA, 37 nt, Artificial Sequence
  Synthetic Oligonucleotide; PD-L1 exons 4 and 5; Set B
ucuaaucuccuaaaagugcaguagaaaaucucauuag

SEQ ID NO: 22861 - RNA, 36 nt, Artificial Sequence
  Synthetic Oligonucleotide; PD-L1 exons 4 and 5; Set B
ucuaaucuccuaaaagugcaguagaaaaucucauua

SEQ ID NO: 22862 - RNA, 34 nt, Artificial Sequence
  Synthetic Oligonucleotide; PD-L1 exons 4 and 5; Set C
cuaaucuccuaaaagugcaguagaaaaucucauu

SEQ ID NO: 22863 - RNA, 32 nt, Artificial Sequence
  Synthetic Oligonucleotide; PD-L1 exons 4 and 5; Set C
uaaucuccuaaaagugcaguagaaaaucucau

SEQ ID NO: 22864 - RNA, 35 nt, Artificial Sequence
  Synthetic Oligonucleotide; PD-L1 exons 4 and 5; Set C
ucuaaucuccuaaaagugcaguagaaaaucucauu

SEQ ID NO: 22865 - RNA, 33 nt, Artificial Sequence
  Synthetic Oligonucleotide; PD-L1 exons 4 and 5; Set C
cuaaucuccuaaaagugcaguagaaaaucucau

SEQ ID NO: 22866 - RNA, 31 nt, Artificial Sequence
  Synthetic Oligonucleotide; PD-L1 exons 4 and 5; Set C
uaaucuccuaaaagugcaguagaaaaucuca

SEQ ID NO: 22867 - RNA, 34 nt, Artificial Sequence
  Synthetic Oligonucleotide; PD-L1 exons 4 and 5; Set C
ucuaaucuccuaaaagugcaguagaaaaucucau

SEQ ID NO: 22868 - RNA, 32 nt, Artificial Sequence
  Synthetic Oligonucleotide; PD-L1 exons 4 and 5; Set C
cuaaucuccuaaaagugcaguagaaaaucuca

SEQ ID NO: 22869 - RNA, 24 nt, Artificial Sequence
  Synthetic Oligonucleotide; PD-L1 exons 4 and 5; Set C
ucuccuaaaagugcaguagaaaau

SEQ ID NO: 22870 - RNA, 33 nt, Artificial Sequence
  Synthetic Oligonucleotide; PD-L1 exons 4 and 5; Set C
ucuaaucuccuaaaagugcaguagaaaaucuca

SEQ ID NO: 22871 - RNA, 25 nt, Artificial Sequence
  Synthetic Oligonucleotide; PD-L1 exons 4 and 5; Set C
aucuccuaaaagugcaguagaaaau

SEQ ID NO: 22872 - RNA, 26 nt, Artificial Sequence
  Synthetic Oligonucleotide; PD-L1 exons 4 and 5; Set C
aaucuccuaaaagugcaguagaaaau

SEQ ID NO: 22873 - RNA, 25 nt, Artificial Sequence
  Synthetic Oligonucleotide; PD-L1 exons 4 and 5; Set C
aaucuccuaaaagugcaguagaaaa

SEQ ID NO: 22874 - RNA, 33 nt, Artificial Sequence
  Synthetic Oligonucleotide; PD-L1 exons 4 and 5; Set C
aucuaaucuccuaaaagugcaguagaaaaucuc

SEQ ID NO: 22875 - RNA, 32 nt, Artificial Sequence
  Synthetic Oligonucleotide; PD-L1 exons 4 and 5; Set C
aucuaaucuccuaaaagugcaguagaaaaucu

SEQ ID NO: 22876 - RNA, 29 nt, Artificial Sequence
  Synthetic Oligonucleotide; PD-L1 exons 4 and 5; Set C
ucuaaucuccuaaaagugcaguagaaaau

SEQ ID NO: 22877 - RNA, 31 nt, Artificial Sequence
  Synthetic Oligonucleotide; PD-L1 exons 4 and 5; Set C
aucuaaucuccuaaaagugcaguagaaaauc

SEQ ID NO: 22878 - RNA, 18 nt, Artificial Sequence
  Synthetic Oligonucleotide; PD-L1 exons 4 and 5; Set C
ucuccuaaaagugcagua

SEQ ID NO: 22879 - RNA, 20 nt, Artificial Sequence
  Synthetic Oligonucleotide; PD-L1 exons 4 and 5; Set C
aucuccuaaaagugcaguag

SEQ ID NO: 22880 - RNA, 19 nt, Artificial Sequence
  Synthetic Oligonucleotide; PD-L1 exons 4 and 5; Set C
aucuccuaaaagugcagua

SEQ ID NO: 22881 - RNA, 21 nt, Artificial Sequence
  Synthetic Oligonucleotide; PD-L1 exons 4 and 5; Set C
aaucuccuaaaagugcaguag

SEQ ID NO: 22882 - RNA, 29 nt, Artificial Sequence
  Synthetic Oligonucleotide; PD-L1 exons 4 and 5; Set C
aucuaaucuccuaaaagugcaguagaaaa

SEQ ID NO: 22883 - RNA, 20 nt, Artificial Sequence
  Synthetic Oligonucleotide; PD-L1 exons 4 and 5; Set C
aaucuccuaaaagugcagua

SEQ ID NO: 22884 - RNA, 18 nt, Artificial Sequence
  Synthetic Oligonucleotide; PD-L1 exons 4 and 5; Set C
aucuccuaaaagugcagu

SEQ ID NO: 22885 - RNA, 28 nt, Artificial Sequence
  Synthetic Oligonucleotide; PD-L1 exons 4 and 5; Set C
aucuaaucuccuaaaagugcaguagaaa

SEQ ID NO: 22886 - RNA, 21 nt, Artificial Sequence
  Synthetic Oligonucleotide; PD-L1 exons 4 and 5; Set C
uaaucuccuaaaagugcagua

SEQ ID NO: 22887 - RNA, 19 nt, Artificial Sequence
  Synthetic Oligonucleotide; PD-L1 exons 4 and 5; Set C
aaucuccuaaaagugcagu

SEQ ID NO: 22888 - RNA, 27 nt, Artificial Sequence
  Synthetic Oligonucleotide; PD-L1 exons 4 and 5; Set C
aucuaaucuccuaaaagugcaguagaa

SEQ ID NO: 22889 - RNA, 22 nt, Artificial Sequence
  Synthetic Oligonucleotide; PD-L1 exons 4 and 5; Set C
cuaaucuccuaaaagugcagua

SEQ ID NO: 22890 - RNA, 26 nt, Artificial Sequence
  Synthetic Oligonucleotide; PD-L1 exons 4 and 5; Set C
aucuaaucuccuaaaagugcaguaga

SEQ ID NO: 22891 - RNA, 23 nt, Artificial Sequence
  Synthetic Oligonucleotide; PD-L1 exons 4 and 5; Set C
ucuaaucuccuaaaagugcagua

SEQ ID NO: 22892 - RNA, 22 nt, Artificial Sequence
  Synthetic Oligonucleotide; PD-L1 exons 4 and 5; Set C
ucuaaucuccuaaaagugcagu

SEQ ID NO: 22893 - RNA, 17 nt, Artificial Sequence
  Synthetic Oligonucleotide; PD-L1 exons 4 and 5; Set C
aucuaaucuccuaaaag

SEQ ID NO: 22894 - RNA, 35 nt, Artificial Sequence
  Synthetic Oligonucleotide; PD-L1 exons 4 and 5; Set B
guaugguuuuccucaggaucuaaucuccuaaaagu

SEQ ID NO: 22895 - RNA, 34 nt, Artificial Sequence
  Synthetic Oligonucleotide; PD-L1 exons 4 and 5; Set B
guaugguuuuccucaggaucuaaucuccuaaaag

SEQ ID NO: 22896 - RNA, 35 nt, Artificial Sequence
  Synthetic Oligonucleotide; PD-L1 exons 4 and 5; Set B
uguaugguuuuccucaggaucuaaucuccuaaaag

SEQ ID NO: 22897 - RNA, 36 nt, Artificial Sequence
  Synthetic Oligonucleotide; PD-L1 exons 4 and 5; Set B
cuguaugguuuuccucaggaucuaaucuccuaaaag

SEQ ID NO: 22898 - RNA, 37 nt, Artificial Sequence
  Synthetic Oligonucleotide; PD-L1 exons 4 and 5; Set B
gcuguaugguuuuccucaggaucuaaucuccuaaaag

SEQ ID NO: 22899 - RNA, 38 nt, Artificial Sequence
  Synthetic Oligonucleotide; PD-L1 exons 4 and 5; Set B
agcuguaugguuuuccucaggaucuaaucuccuaaaag

SEQ ID NO: 22900 - RNA, 39 nt, Artificial Sequence
  Synthetic Oligonucleotide; PD-L1 exons 4 and 5; Set B
cagcuguaugguuuuccucaggaucuaaucuccuaaaag

SEQ ID NO: 22901 - RNA, 40 nt, Artificial Sequence
  Synthetic Oligonucleotide; PD-L1 exons 4 and 5; Set B
ucagcuguaugguuuuccucaggaucuaaucuccuaaaag

SEQ ID NO: 22902 - RNA, 25 nt, Artificial Sequence
  Synthetic Oligonucleotide; PD-L1 exons 4 and 5; Set C
guaugguuuuccucaggaucuaauc

SEQ ID NO: 22903 - RNA, 24 nt, Artificial Sequence
  Synthetic Oligonucleotide; PD-L1 exons 4 and 5; Set C
guaugguuuuccucaggaucuaau

SEQ ID NO: 22904 - RNA, 26 nt, Artificial Sequence
  Synthetic Oligonucleotide; PD-L1 exons 4 and 5; Set C
uguaugguuuuccucaggaucuaauc

SEQ ID NO: 22905 - RNA, 28 nt, Artificial Sequence
  Synthetic Oligonucleotide; PD-L1 exons 4 and 5; Set B
cuguaugguuuuccucaggaucuaaucu

SEQ ID NO: 22906 - RNA, 25 nt, Artificial Sequence
  Synthetic Oligonucleotide; PD-L1 exons 4 and 5; Set C
uguaugguuuuccucaggaucuaau

SEQ ID NO: 22907 - RNA, 27 nt, Artificial Sequence
  Synthetic Oligonucleotide; PD-L1 exons 4 and 5; Set B
cuguaugguuuuccucaggaucuaauc

SEQ ID NO: 22908 - RNA, 29 nt, Artificial Sequence
  Synthetic Oligonucleotide; PD-L1 exons 4 and 5; Set B
gcuguaugguuuuccucaggaucuaaucu

SEQ ID NO: 22909 - RNA, 26 nt, Artificial Sequence
  Synthetic Oligonucleotide; PD-L1 exons 4 and 5; Set B
cuguaugguuuuccucaggaucuaau

SEQ ID NO: 22910 - RNA, 28 nt, Artificial Sequence
  Synthetic Oligonucleotide; PD-L1 exons 4 and 5; Set B
gcuguaugguuuuccucaggaucuaauc

SEQ ID NO: 22911 - RNA, 30 nt, Artificial Sequence
  Synthetic Oligonucleotide; PD-L1 exons 4 and 5; Set B
agcuguaugguuuuccucaggaucuaaucu

SEQ ID NO: 22912 - RNA, 27 nt, Artificial Sequence
  Synthetic Oligonucleotide; PD-L1 exons 4 and 5; Set B
gcuguaugguuuuccucaggaucuaau

SEQ ID NO: 22913 - RNA, 29 nt, Artificial Sequence
  Synthetic Oligonucleotide; PD-L1 exons 4 and 5; Set B
agcuguaugguuuuccucaggaucuaauc

SEQ ID NO: 22914 - RNA, 31 nt, Artificial Sequence
  Synthetic Oligonucleotide; PD-L1 exons 4 and 5; Set B
cagcuguaugguuuuccucaggaucuaaucu

SEQ ID NO: 22915 - RNA, 20 nt, Artificial Sequence
  Synthetic Oligonucleotide; PD-L1 exons 4 and 5; Set C
guaugguuuuccucaggauc

SEQ ID NO: 22916 - RNA, 28 nt, Artificial Sequence
  Synthetic Oligonucleotide; PD-L1 exons 4 and 5; Set B
agcuguaugguuuuccucaggaucuaau

SEQ ID NO: 22917 - RNA, 30 nt, Artificial Sequence
  Synthetic Oligonucleotide; PD-L1 exons 4 and 5; Set B
cagcuguaugguuuuccucaggaucuaauc

SEQ ID NO: 22918 - RNA, 32 nt, Artificial Sequence
  Synthetic Oligonucleotide; PD-L1 exons 4 and 5; Set B
ucagcuguaugguuuuccucaggaucuaaucu

SEQ ID NO: 22919 - RNA, 21 nt, Artificial Sequence
  Synthetic Oligonucleotide; PD-L1 exons 4 and 5; Set C
uguaugguuuuccucaggauc

SEQ ID NO: 22920 - RNA, 29 nt, Artificial Sequence
  Synthetic Oligonucleotide; PD-L1 exons 4 and 5; Set B
cagcuguaugguuuuccucaggaucuaau

SEQ ID NO: 22921 - RNA, 31 nt, Artificial Sequence
  Synthetic Oligonucleotide; PD-L1 exons 4 and 5; Set B
ucagcuguaugguuuuccucaggaucuaauc

SEQ ID NO: 22922 - RNA, 33 nt, Artificial Sequence
  Synthetic Oligonucleotide; PD-L1 exons 4 and 5; Set B
uucagcuguaugguuuuccucaggaucuaaucu

SEQ ID NO: 22923 - RNA, 22 nt, Artificial Sequence
  Synthetic Oligonucleotide; PD-L1 exons 4 and 5; Set C
cuguaugguuuuccucaggauc

SEQ ID NO: 22924 - RNA, 30 nt, Artificial Sequence
  Synthetic Oligonucleotide; PD-L1 exons 4 and 5; Set B
ucagcuguaugguuuuccucaggaucuaau

SEQ ID NO: 22925 - RNA, 32 nt, Artificial Sequence
  Synthetic Oligonucleotide; PD-L1 exons 4 and 5; Set B
uucagcuguaugguuuuccucaggaucuaauc

SEQ ID NO: 22926 - RNA, 34 nt, Artificial Sequence
  Synthetic Oligonucleotide; PD-L1 exons 4 and 5; Set B
auucagcuguaugguuuuccucaggaucuaaucu

SEQ ID NO: 22927 - RNA, 23 nt, Artificial Sequence
  Synthetic Oligonucleotide; PD-L1 exons 4 and 5; Set B
gcuguaugguuuuccucaggauc

SEQ ID NO: 22928 - RNA, 31 nt, Artificial Sequence
  Synthetic Oligonucleotide; PD-L1 exons 4 and 5; Set B
uucagcuguaugguuuuccucaggaucuaau

SEQ ID NO: 22929 - RNA, 33 nt, Artificial Sequence
  Synthetic Oligonucleotide; PD-L1 exons 4 and 5; Set B
auucagcuguaugguuuuccucaggaucuaauc

SEQ ID NO: 22930 - RNA, 32 nt, Artificial Sequence
  Synthetic Oligonucleotide; PD-L1 exons 4 and 5; Set B
auucagcuguaugguuuuccucaggaucuaau

SEQ ID NO: 22931 - RNA, 31 nt, Artificial Sequence
  Synthetic Oligonucleotide; PD-L1 exons 4 and 5; Set B
auucagcuguaugguuuuccucaggaucuaa

SEQ ID NO: 22932 - RNA, 29 nt, Artificial Sequence
  Synthetic Oligonucleotide; PD-L1 exons 4 and 5; Set B
auucagcuguaugguuuuccucaggaucu

SEQ ID NO: 22933 - RNA, 15 nt, Artificial Sequence
  Synthetic Oligonucleotide; PD-L1 exons 4 and 5; Set C
cagcuguaugguuuu

SEQ ID NO: 22934 - RNA, 16 nt, Artificial Sequence
  Synthetic Oligonucleotide; PD-L1 exons 4 and 5; Set C
ucagcuguaugguuuu

SEQ ID NO: 22935 - RNA, 15 nt, Artificial Sequence
  Synthetic Oligonucleotide; PD-L1 exons 4 and 5; Set C
uucagcuguaugguu

SEQ ID NO: 22936 - RNA, 16 nt, Artificial Sequence
  Synthetic Oligonucleotide; PD-L1 exons 4 and 5; Set C
auucagcuguaugguu

SEQ ID NO: 22937 - RNA, 15 nt, Artificial Sequence
  Synthetic Oligonucleotide; PD-L1 exons 4 and 5; Set C
auucagcuguauggu

SEQ ID NO: 22938 - RNA, 27 nt, Artificial Sequence
  Synthetic Oligonucleotide; PD-L1 exons 4 and 5; Set B
uuaccugggaugaccaauucagcugua

SEQ ID NO: 22939 - RNA, 26 nt, Artificial Sequence
  Synthetic Oligonucleotide; PD-L1 exons 4 and 5; Set B
uuaccugggaugaccaauucagcugu

SEQ ID NO: 22940 - RNA, 25 nt, Artificial Sequence
  Synthetic Oligonucleotide; PD-L1 exons 4 and 5; Set B
uuaccugggaugaccaauucagcug

SEQ ID NO: 22941 - RNA, 24 nt, Artificial Sequence
  Synthetic Oligonucleotide; PD-L1 exons 4 and 5; Set B
uuaccugggaugaccaauucagcu

SEQ ID NO: 22942 - RNA, 37 nt, Artificial Sequence
  Synthetic Oligonucleotide; PD-L1 exons 4 and 5; Set C
auucagaauauuaccugggaugaccaauucagcugua

SEQ ID NO: 22943 - RNA, 36 nt, Artificial Sequence
  Synthetic Oligonucleotide; PD-L1 exons 4 and 5; Set C
auucagaauauuaccugggaugaccaauucagcugu

SEQ ID NO: 22944 - RNA, 40 nt, Artificial Sequence
  Synthetic Oligonucleotide; PD-L1 exons 4 and 5; Set C
acacauucagaauauuaccugggaugaccaauucagcugu

SEQ ID NO: 22945 - RNA, 39 nt, Artificial Sequence
  Synthetic Oligonucleotide; PD-L1 exons 4 and 5; Set C
acacauucagaauauuaccugggaugaccaauucagcug

SEQ ID NO: 22946 - RNA, 40 nt, Artificial Sequence
  Synthetic Oligonucleotide; PD-L1 exons 4 and 5; Set C
gacacauucagaauauuaccugggaugaccaauucagcug

SEQ ID NO: 22947 - RNA, 40 nt, Artificial Sequence
  Synthetic Oligonucleotide; PD-L1 exons 4 and 5; Set C
aauggacacauucagaauauuaccugggaugaccaauuca

SEQ ID NO: 22948 - RNA, 39 nt, Artificial Sequence
  Synthetic Oligonucleotide; PD-L1 exons 4 and 5; Set C
aauggacacauucagaauauuaccugggaugaccaauuc

SEQ ID NO: 22949 - RNA, 38 nt, Artificial Sequence
  Synthetic Oligonucleotide; PD-L1 exons 4 and 5; Set C
aauggacacauucagaauauuaccugggaugaccaauu

SEQ ID NO: 22950 - RNA, 15 nt, Artificial Sequence
  Synthetic Oligonucleotide; PD-L1 exons 4 and 5; Set C
acauucagaauauua

SEQ ID NO: 22951 - RNA, 16 nt, Artificial Sequence
  Synthetic Oligonucleotide; PD-L1 exons 4 and 5; Set C
cacauucagaauauua

SEQ ID NO: 22952 - RNA, 17 nt, Artificial Sequence
  Synthetic Oligonucleotide; PD-L1 exons 4 and 5; Set C
acacauucagaauauua

SEQ ID NO: 22953 - RNA, 18 nt, Artificial Sequence
  Synthetic Oligonucleotide; PD-L1 exons 4 and 5; Set C
gacacauucagaauauua

SEQ ID NO: 22954 - RNA, 25 nt, Artificial Sequence
  Synthetic Oligonucleotide; PD-L1 exons 4 and 5; Set C
uuaauggacacauucagaauauuac

SEQ ID NO: 22955 - RNA, 26 nt, Artificial Sequence
  Synthetic Oligonucleotide; PD-L1 exons 4 and 5; Set C
uuuaauggacacauucagaauauuac

SEQ ID NO: 22956 - RNA, 27 nt, Artificial Sequence
  Synthetic Oligonucleotide; PD-L1 exons 4 and 5; Set C
uuuuaauggacacauucagaauauuac

SEQ ID NO: 22957 - RNA, 28 nt, Artificial Sequence
  Synthetic Oligonucleotide; PD-L1 exons 4 and 5; Set C
auuuuaauggacacauucagaauauuac

SEQ ID NO: 22958 - RNA, 15 nt, Artificial Sequence
  Synthetic Oligonucleotide; PD-L1 exons 4 and 5; Set C
aauggacacauucag

SEQ ID NO: 22959 - RNA, 15 nt, Artificial Sequence
  Synthetic Oligonucleotide; PD-L1 exons 4 and 5; Set C
uaauggacacauuca

SEQ ID NO: 22960 - RNA, 33 nt, Artificial Sequence
  Synthetic Oligonucleotide; PD-L1 exons 4 and 5; Set C
agacauauuuuaauggacacauucagaauauua

SEQ ID NO: 22961 - RNA, 34 nt, Artificial Sequence
  Synthetic Oligonucleotide; PD-L1 exons 4 and 5; Set C
uagacauauuuuaauggacacauucagaauauua

SEQ ID NO: 22962 - RNA, 36 nt, Artificial Sequence
  Synthetic Oligonucleotide; PD-L1 exons 4 and 5; Set B
uuagacauauuuuaauggacacauucagaauauuac

SEQ ID NO: 22963 - RNA, 21 nt, Artificial Sequence
  Synthetic Oligonucleotide; PD-L1 exons 4 and 5; Set C
uauuuuaauggacacauucag

SEQ ID NO: 22964 - RNA, 19 nt, Artificial Sequence
  Synthetic Oligonucleotide; PD-L1 exons 4 and 5; Set C
uauuuuaauggacacauuc

SEQ ID NO: 22965 - RNA, 17 nt, Artificial Sequence
  Synthetic Oligonucleotide; PD-L1 exons 4 and 5; Set C
uauuuuaauggacacau

SEQ ID NO: 22966 - RNA, 40 nt, Artificial Sequence
  Synthetic Oligonucleotide; PD-L1 exons 4 and 5; Set B
caguguuagacauauuuuaauggacacauucagaauauua

SEQ ID NO: 22967 - RNA, 16 nt, Artificial Sequence
  Synthetic Oligonucleotide; PD-L1 exons 4 and 5; Set C
uauuuuaauggacaca

SEQ ID NO: 22968 - RNA, 15 nt, Artificial Sequence
  Synthetic Oligonucleotide; PD-L1 exons 4 and 5; Set C
uauuuuaauggacac

SEQ ID NO: 22969 - RNA, 23 nt, Artificial Sequence
  Synthetic Oligonucleotide; PD-L1 exons 4 and 5; Set C
agacauauuuuaauggacacauu

SEQ ID NO: 22970 - RNA, 27 nt, Artificial Sequence
  Synthetic Oligonucleotide; PD-L1 exons 4 and 5; Set C
uuagacauauuuuaauggacacauuca

SEQ ID NO: 22971 - RNA, 24 nt, Artificial Sequence
  Synthetic Oligonucleotide; PD-L1 exons 4 and 5; Set C
uagacauauuuuaauggacacauu

SEQ ID NO: 22972 - RNA, 26 nt, Artificial Sequence
  Synthetic Oligonucleotide; PD-L1 exons 4 and 5; Set C
uuagacauauuuuaauggacacauuc

SEQ ID NO: 22973 - RNA, 28 nt, Artificial Sequence
  Synthetic Oligonucleotide; PD-L1 exons 4 and 5; Set C
guuagacauauuuuaauggacacauuca

SEQ ID NO: 22974 - RNA, 27 nt, Artificial Sequence
  Synthetic Oligonucleotide; PD-L1 exons 4 and 5; Set C
guuagacauauuuuaauggacacauuc

SEQ ID NO: 22975 - RNA, 29 nt, Artificial Sequence
  Synthetic Oligonucleotide; PD-L1 exons 4 and 5; Set C
uguuagacauauuuuaauggacacauuca

SEQ ID NO: 22976 - RNA, 28 nt, Artificial Sequence
  Synthetic Oligonucleotide; PD-L1 exons 4 and 5; Set C
uguuagacauauuuuaauggacacauuc

SEQ ID NO: 22977 - RNA, 30 nt, Artificial Sequence
  Synthetic Oligonucleotide; PD-L1 exons 4 and 5; Set B
guguuagacauauuuuaauggacacauuca

SEQ ID NO: 22978 - RNA, 33 nt, Artificial Sequence
  Synthetic Oligonucleotide; PD-L1 exons 4 and 5; Set B
caguguuagacauauuuuaauggacacauucag

SEQ ID NO: 22979 - RNA, 29 nt, Artificial Sequence
  Synthetic Oligonucleotide; PD-L1 exons 4 and 5; Set C
guguuagacauauuuuaauggacacauuc

SEQ ID NO: 22980 - RNA, 31 nt, Artificial Sequence
  Synthetic Oligonucleotide; PD-L1 exons 4 and 5; Set B
aguguuagacauauuuuaauggacacauuca

SEQ ID NO: 22981 - RNA, 20 nt, Artificial Sequence
  Synthetic Oligonucleotide; PD-L1 exons 4 and 5; Set C
uagacauauuuuaauggaca

SEQ ID NO: 22982 - RNA, 34 nt, Artificial Sequence
  Synthetic Oligonucleotide; PD-L1 exons 4 and 5; Set B
acaguguuagacauauuuuaauggacacauucag

SEQ ID NO: 22983 - RNA, 30 nt, Artificial Sequence
  Synthetic Oligonucleotide; PD-L1 exons 4 and 5; Set C
aguguuagacauauuuuaauggacacauuc

SEQ ID NO: 22984 - RNA, 35 nt, Artificial Sequence
  Synthetic Oligonucleotide; PD-L1 exons 4 and 5; Set B
gacaguguuagacauauuuuaauggacacauucag

SEQ ID NO: 22985 - RNA, 30 nt, Artificial Sequence
  Synthetic Oligonucleotide; PD-L1 exons 4 and 5; Set B
caguguuagacauauuuuaauggacacauu

SEQ ID NO: 22986 - RNA, 31 nt, Artificial Sequence
  Synthetic Oligonucleotide; PD-L1 exons 4 and 5; Set B
acaguguuagacauauuuuaauggacacauu

SEQ ID NO: 22987 - RNA, 29 nt, Artificial Sequence
  Synthetic Oligonucleotide; PD-L1 exons 4 and 5; Set C
caguguuagacauauuuuaauggacacau

SEQ ID NO: 22988 - RNA, 35 nt, Artificial Sequence
  Synthetic Oligonucleotide; PD-L1 exons 4 and 5; Set B
ggacaguguuagacauauuuuaauggacacauuca

SEQ ID NO: 22989 - RNA, 32 nt, Artificial Sequence
  Synthetic Oligonucleotide; PD-L1 exons 4 and 5; Set B
gacaguguuagacauauuuuaauggacacauu

SEQ ID NO: 22990 - RNA, 30 nt, Artificial Sequence
  Synthetic Oligonucleotide; PD-L1 exons 4 and 5; Set B
acaguguuagacauauuuuaauggacacau

SEQ ID NO: 22991 - RNA, 28 nt, Artificial Sequence
  Synthetic Oligonucleotide; PD-L1 exons 4 and 5; Set C
caguguuagacauauuuuaauggacaca

SEQ ID NO: 22992 - RNA, 34 nt, Artificial Sequence
  Synthetic Oligonucleotide; PD-L1 exons 4 and 5; Set B
ggacaguguuagacauauuuuaauggacacauuc

SEQ ID NO: 22993 - RNA, 36 nt, Artificial Sequence
  Synthetic Oligonucleotide; PD-L1 exons 4 and 5; Set C
gggacaguguuagacauauuuuaauggacacauuca

SEQ ID NO: 22994 - RNA, 18 nt, Artificial Sequence
  Synthetic Oligonucleotide; PD-L1 exons 4 and 5; Set C
uuagacauauuuuaaugg

SEQ ID NO: 22995 - RNA, 15 nt, Artificial Sequence
  Synthetic Oligonucleotide; PD-L1 exons 4 and 5; Set C
uagacauauuuuaau

SEQ ID NO: 22996 - RNA, 31 nt, Artificial Sequence
  Synthetic Oligonucleotide; PD-L1 exons 4 and 5; Set B
gacaguguuagacauauuuuaauggacacau

SEQ ID NO: 22997 - RNA, 29 nt, Artificial Sequence
  Synthetic Oligonucleotide; PD-L1 exons 4 and 5; Set B
acaguguuagacauauuuuaauggacaca

SEQ ID NO: 22998 - RNA, 27 nt, Artificial Sequence
  Synthetic Oligonucleotide; PD-L1 exons 4 and 5; Set C
caguguuagacauauuuuaauggacac

SEQ ID NO: 22999 - RNA, 37 nt, Artificial Sequence
  Synthetic Oligonucleotide; PD-L1 exons 4 and 5; Set C
ggggacaguguuagacauauuuuaauggacacauuca

SEQ ID NO: 23000 - RNA, 17 nt, Artificial Sequence
  Synthetic Oligonucleotide; PD-L1 exons 4 and 5; Set C
uuagacauauuuuaaug

SEQ ID NO: 23001 - RNA, 19 nt, Artificial Sequence
  Synthetic Oligonucleotide; PD-L1 exons 4 and 5; Set C
guuagacauauuuuaaugg

SEQ ID NO: 23002 - RNA, 26 nt, Artificial Sequence
  Synthetic Oligonucleotide; PD-L1 exons 4 and 5; Set C
caguguuagacauauuuuaauggaca

SEQ ID NO: 23003 - RNA, 30 nt, Artificial Sequence
  Synthetic Oligonucleotide; PD-L1 exons 4 and 5; Set B
gacaguguuagacauauuuuaauggacaca

SEQ ID NO: 23004 - RNA, 28 nt, Artificial Sequence
  Synthetic Oligonucleotide; PD-L1 exons 4 and 5; Set C
acaguguuagacauauuuuaauggacac

SEQ ID NO: 23005 - RNA, 38 nt, Artificial Sequence
  Synthetic Oligonucleotide; PD-L1 exons 4 and 5; Set C
aggggacaguguuagacauauuuuaauggacacauuca

SEQ ID NO: 23006 - RNA, 18 nt, Artificial Sequence
  Synthetic Oligonucleotide; PD-L1 exons 4 and 5; Set C
guuagacauauuuuaaug

SEQ ID NO: 23007 - RNA, 20 nt, Artificial Sequence
  Synthetic Oligonucleotide; PD-L1 exons 4 and 5; Set C
uguuagacauauuuuaaugg

SEQ ID NO: 23008 - RNA, 27 nt, Artificial Sequence
  Synthetic Oligonucleotide; PD-L1 exons 4 and 5; Set C
acaguguuagacauauuuuaauggaca

SEQ ID NO: 23009 - RNA, 25 nt, Artificial Sequence
  Synthetic Oligonucleotide; PD-L1 exons 4 and 5; Set C
caguguuagacauauuuuaauggac

SEQ ID NO: 23010 - RNA, 29 nt, Artificial Sequence
  Synthetic Oligonucleotide; PD-L1 exons 4 and 5; Set B
gacaguguuagacauauuuuaauggacac

SEQ ID NO: 23011 - RNA, 39 nt, Artificial Sequence
  Synthetic Oligonucleotide; PD-L1 exons 4 and 5; Set C
uaggggacaguguuagacauauuuuaauggacacauuca

SEQ ID NO: 23012 - RNA, 19 nt, Artificial Sequence
  Synthetic Oligonucleotide; PD-L1 exons 4 and 5; Set C
uguuagacauauuuuaaug

SEQ ID NO: 23013 - RNA, 21 nt, Artificial Sequence
  Synthetic Oligonucleotide; PD-L1 exons 4 and 5; Set C
guguuagacauauuuuaaugg

SEQ ID NO: 23014 - RNA, 28 nt, Artificial Sequence
  Synthetic Oligonucleotide; PD-L1 exons 4 and 5; Set B
gacaguguuagacauauuuuaauggaca

SEQ ID NO: 23015 - RNA, 26 nt, Artificial Sequence
  Synthetic Oligonucleotide; PD-L1 exons 4 and 5; Set C
acaguguuagacauauuuuaauggac

SEQ ID NO: 23016 - RNA, 38 nt, Artificial Sequence
  Synthetic Oligonucleotide; PD-L1 exons 4 and 5; Set C
uaggggacaguguuagacauauuuuaauggacacauuc

SEQ ID NO: 23017 - RNA, 22 nt, Artificial Sequence
  Synthetic Oligonucleotide; PD-L1 exons 4 and 5; Set C
aguguuagacauauuuuaaugg

SEQ ID NO: 23018 - RNA, 20 nt, Artificial Sequence
  Synthetic Oligonucleotide; PD-L1 exons 4 and 5; Set C
guguuagacauauuuuaaug

SEQ ID NO: 23019 - RNA, 27 nt, Artificial Sequence
  Synthetic Oligonucleotide; PD-L1 exons 4 and 5; Set C
gacaguguuagacauauuuuaauggac

SEQ ID NO: 23020 - RNA, 21 nt, Artificial Sequence
  Synthetic Oligonucleotide; PD-L1 exons 4 and 5; Set C
aguguuagacauauuuuaaug

SEQ ID NO: 23021 - RNA, 26 nt, Artificial Sequence
  Synthetic Oligonucleotide; PD-L1 exons 4 and 5; Set C
ggacaguguuagacauauuuuaaugg

SEQ ID NO: 23022 - RNA, 28 nt, Artificial Sequence
  Synthetic Oligonucleotide; PD-L1 exons 4 and 5; Set B
gggacaguguuagacauauuuuaaugga

SEQ ID NO: 23023 - RNA, 27 nt, Artificial Sequence
  Synthetic Oligonucleotide; PD-L1 exons 4 and 5; Set C
gggacaguguuagacauauuuuaaugg

SEQ ID NO: 23024 - RNA, 25 nt, Artificial Sequence
  Synthetic Oligonucleotide; PD-L1 exons 4 and 5; Set C
ggacaguguuagacauauuuuaaug

SEQ ID NO: 23025 - RNA, 29 nt, Artificial Sequence
  Synthetic Oligonucleotide; PD-L1 exons 4 and 5; Set B
ggggacaguguuagacauauuuuaaugga

SEQ ID NO: 23026 - RNA, 26 nt, Artificial Sequence
  Synthetic Oligonucleotide; PD-L1 exons 4 and 5; Set C
gggacaguguuagacauauuuuaaug

SEQ ID NO: 23027 - RNA, 28 nt, Artificial Sequence
  Synthetic Oligonucleotide; PD-L1 exons 4 and 5; Set B
ggggacaguguuagacauauuuuaaugg

SEQ ID NO: 23028 - RNA, 30 nt, Artificial Sequence
  Synthetic Oligonucleotide; PD-L1 exons 4 and 5; Set B
aggggacaguguuagacauauuuuaaugga

SEQ ID NO: 23029 - RNA, 29 nt, Artificial Sequence
  Synthetic Oligonucleotide; PD-L1 exons 4 and 5; Set B
aggggacaguguuagacauauuuuaaugg

SEQ ID NO: 23030 - RNA, 27 nt, Artificial Sequence
  Synthetic Oligonucleotide; PD-L1 exons 4 and 5; Set C
ggggacaguguuagacauauuuuaaug

SEQ ID NO: 23031 - RNA, 28 nt, Artificial Sequence
  Synthetic Oligonucleotide; PD-L1 exons 4 and 5; Set C
aggggacaguguuagacauauuuuaaug

SEQ ID NO: 23032 - RNA, 30 nt, Artificial Sequence
  Synthetic Oligonucleotide; PD-L1 exons 4 and 5; Set B
uaggggacaguguuagacauauuuuaaugg

SEQ ID NO: 23033 - RNA, 15 nt, Artificial Sequence
  Synthetic Oligonucleotide; PD-L1 exons 4 and 5; Set C
caguguuagacauau

SEQ ID NO: 23034 - RNA, 29 nt, Artificial Sequence
  Synthetic Oligonucleotide; PD-L1 exons 4 and 5; Set B
uaggggacaguguuagacauauuuuaaug

SEQ ID NO: 23035 - RNA, 16 nt, Artificial Sequence
  Synthetic Oligonucleotide; PD-L1 exons 4 and 5; Set C
acaguguuagacauau

SEQ ID NO: 23036 - RNA, 17 nt, Artificial Sequence
  Synthetic Oligonucleotide; PD-L1 exons 4 and 5; Set C
gacaguguuagacauau

SEQ ID NO: 23037 - RNA, 17 nt, Artificial Sequence
  Synthetic Oligonucleotide; PD-L1 exons 4 and 5; Set C
ggacaguguuagacaua

SEQ ID NO: 23038 - RNA, 18 nt, Artificial Sequence
  Synthetic Oligonucleotide; PD-L1 exons 4 and 5; Set C
gggacaguguuagacaua

SEQ ID NO: 23039 - RNA, 19 nt, Artificial Sequence
  Synthetic Oligonucleotide; PD-L1 exons 4 and 5; Set C
ggggacaguguuagacaua

SEQ ID NO: 23040 - RNA, 20 nt, Artificial Sequence
  Synthetic Oligonucleotide; PD-L1 exons 4 and 5; Set C
aggggacaguguuagacaua

SEQ ID NO: 23041 - RNA, 21 nt, Artificial Sequence
  Synthetic Oligonucleotide; PD-L1 exons 4 and 5; Set C
uaggggacaguguuagacaua

SEQ ID NO: 23042 - RNA, 17 nt, Artificial Sequence
  Synthetic Oligonucleotide; PD-L1 exons 4 and 5; Set C
uaggggacaguguuaga

SEQ ID NO: 23043 - RNA, 27 nt, Artificial Sequence
  Synthetic Oligonucleotide; PD-L1 exons 4 and 5; Set C
aacaaaaagaagucagggcuuuugcug

SEQ ID NO: 23044 - RNA, 26 nt, Artificial Sequence
  Synthetic Oligonucleotide; PD-L1 exons 4 and 5; Set C
aacaaaaagaagucagggcuuuugcu

SEQ ID NO: 23045 - RNA, 21 nt, Artificial Sequence
  Synthetic Oligonucleotide; PD-L1 exons 4 and 5; Set C
caaaaagaagucagggcuuuu

SEQ ID NO: 23046 - RNA, 25 nt, Artificial Sequence
  Synthetic Oligonucleotide; PD-L1 exons 4 and 5; Set C
aacaaaaagaagucagggcuuuugc

SEQ ID NO: 23047 - RNA, 24 nt, Artificial Sequence
  Synthetic Oligonucleotide; PD-L1 exons 4 and 5; Set C
aacaaaaagaagucagggcuuuug

SEQ ID NO: 23048 - RNA, 23 nt, Artificial Sequence
  Synthetic Oligonucleotide; PD-L1 exons 4 and 5; Set C
aacaaaaagaagucagggcuuuu

SEQ ID NO: 23049 - RNA, 31 nt, Artificial Sequence
  Synthetic Oligonucleotide; PD-L1 exons 4 and 5; Set C
cauaaacaaaaagaagucagggcuuuugcug

SEQ ID NO: 23050 - RNA, 22 nt, Artificial Sequence
  Synthetic Oligonucleotide; PD-L1 exons 4 and 5; Set C
aacaaaaagaagucagggcuuu

SEQ ID NO: 23051 - RNA, 32 nt, Artificial Sequence
  Synthetic Oligonucleotide; PD-L1 exons 4 and 5; Set A
acauaaacaaaaagaagucagggcuuuugcug

SEQ ID NO: 23052 - RNA, 30 nt, Artificial Sequence
  Synthetic Oligonucleotide; PD-L1 exons 4 and 5; Set C
cauaaacaaaaagaagucagggcuuuugcu

SEQ ID NO: 23053 - RNA, 21 nt, Artificial Sequence
  Synthetic Oligonucleotide; PD-L1 exons 4 and 5; Set C
aacaaaaagaagucagggcuu

SEQ ID NO: 23054 - RNA, 31 nt, Artificial Sequence
  Synthetic Oligonucleotide; PD-L1 exons 4 and 5; Set A
acauaaacaaaaagaagucagggcuuuugcu

SEQ ID NO: 23055 - RNA, 29 nt, Artificial Sequence
  Synthetic Oligonucleotide; PD-L1 exons 4 and 5; Set C
cauaaacaaaaagaagucagggcuuuugc

SEQ ID NO: 23056 - RNA, 20 nt, Artificial Sequence
  Synthetic Oligonucleotide; PD-L1 exons 4 and 5; Set C
aacaaaaagaagucagggcu

SEQ ID NO: 23057 - RNA, 28 nt, Artificial Sequence
  Synthetic Oligonucleotide; PD-L1 exons 4 and 5; Set C
cauaaacaaaaagaagucagggcuuuug

SEQ ID NO: 23058 - RNA, 30 nt, Artificial Sequence
  Synthetic Oligonucleotide; PD-L1 exons 4 and 5; Set C
acauaaacaaaaagaagucagggcuuuugc

SEQ ID NO: 23059 - RNA, 19 nt, Artificial Sequence
  Synthetic Oligonucleotide; PD-L1 exons 4 and 5; Set C
aacaaaaagaagucagggc

SEQ ID NO: 23060 - RNA, 29 nt, Artificial Sequence
  Synthetic Oligonucleotide; PD-L1 exons 4 and 5; Set C
acauaaacaaaaagaagucagggcuuuug

SEQ ID NO: 23061 - RNA, 18 nt, Artificial Sequence
  Synthetic Oligonucleotide; PD-L1 exons 4 and 5; Set C
aacaaaaagaagucaggg

SEQ ID NO: 23062 - RNA, 25 nt, Artificial Sequence
  Synthetic Oligonucleotide; PD-L1 exons 4 and 5; Set C
cauaaacaaaaagaagucagggcuu

SEQ ID NO: 23063 - RNA, 26 nt, Artificial Sequence
  Synthetic Oligonucleotide; PD-L1 exons 4 and 5; Set C
acauaaacaaaaagaagucagggcuu

SEQ ID NO: 23064 - RNA, 24 nt, Artificial Sequence
  Synthetic Oligonucleotide; PD-L1 exons 4 and 5; Set C
cauaaacaaaaagaagucagggcu

SEQ ID NO: 23065 - RNA, 25 nt, Artificial Sequence
  Synthetic Oligonucleotide; PD-L1 exons 4 and 5; Set C
acauaaacaaaaagaagucagggcu

SEQ ID NO: 23066 - RNA, 23 nt, Artificial Sequence
  Synthetic Oligonucleotide; PD-L1 exons 4 and 5; Set C
cauaaacaaaaagaagucagggc

SEQ ID NO: 23067 - RNA, 22 nt, Artificial Sequence
  Synthetic Oligonucleotide; PD-L1 exons 4 and 5; Set C
cauaaacaaaaagaagucaggg

SEQ ID NO: 23068 - RNA, 24 nt, Artificial Sequence
  Synthetic Oligonucleotide; PD-L1 exons 4 and 5; Set C
acauaaacaaaaagaagucagggc

SEQ ID NO: 23069 - RNA, 23 nt, Artificial Sequence
  Synthetic Oligonucleotide; PD-L1 exons 4 and 5; Set C
acauaaacaaaaagaagucaggg

SEQ ID NO: 23070 - RNA, 17 nt, Artificial Sequence
  Synthetic Oligonucleotide; PD-L1 exons 4 and 5; Set C
cauaaacaaaaagaagu

SEQ ID NO: 23071 - RNA, 16 nt, Artificial Sequence
  Synthetic Oligonucleotide; PD-L1 exons 4 and 5; Set C
cauaaacaaaaagaag

SEQ ID NO: 23072 - RNA, 18 nt, Artificial Sequence
  Synthetic Oligonucleotide; PD-L1 exons 4 and 5; Set C
acauaaacaaaaagaagu

SEQ ID NO: 23073 - RNA, 15 nt, Artificial Sequence
  Synthetic Oligonucleotide; PD-L1 exons 4 and 5; Set C
cauaaacaaaaagaa

SEQ ID NO: 23074 - RNA, 17 nt, Artificial Sequence
  Synthetic Oligonucleotide; PD-L1 exons 4 and 5; Set C
acauaaacaaaaagaag

SEQ ID NO: 23075 - RNA, 16 nt, Artificial Sequence
  Synthetic Oligonucleotide; PD-L1 exons 4 and 5; Set C
acauaaacaaaaagaa

SEQ ID NO: 23076 - RNA, 15 nt, Artificial Sequence
  Synthetic Oligonucleotide; PD-L1 exons 4 and 5; Set C
acauaaacaaaaaga

SEQ ID NO: 23077 - RNA, 15 nt, Artificial Sequence
  Synthetic Oligonucleotide; PD-L1 exons 4 and 5; Set C
gacauaaacaaaaag

SEQ ID NO: 23078 - RNA, 28 nt, Artificial Sequence
  Synthetic Oligonucleotide; PD-L1 exons 4 and 5; Set C
ggggcuaggacauaaacaaaaagaaguc

SEQ ID NO: 23079 - RNA, 15 nt, Artificial Sequence
  Synthetic Oligonucleotide; PD-L1 exons 4 and 5; Set C
ggcuaggacauaaac

SEQ ID NO: 23080 - RNA, 16 nt, Artificial Sequence
  Synthetic Oligonucleotide; PD-L1 exons 4 and 5; Set C
gggcuaggacauaaac

SEQ ID NO: 23081 - RNA, 17 nt, Artificial Sequence
  Synthetic Oligonucleotide; PD-L1 exons 4 and 5; Set C
ggggcuaggacauaaac

SEQ ID NO: 23082 - RNA, 18 nt, Artificial Sequence
  Synthetic Oligonucleotide; PD-L1 exons 4 and 5; Set C
uggggcuaggacauaaac

SEQ ID NO: 23083 - RNA, 19 nt, Artificial Sequence
  Synthetic Oligonucleotide; PD-L1 exons 4 and 5; Set C
auggggcuaggacauaaac

SEQ ID NO: 23084 - RNA, 20 nt, Artificial Sequence
  Synthetic Oligonucleotide; PD-L1 exons 4 and 5; Set C
uauggggcuaggacauaaac

SEQ ID NO: 23085 - RNA, 21 nt, Artificial Sequence
  Synthetic Oligonucleotide; PD-L1 exons 4 and 5; Set C
guauggggcuaggacauaaac

SEQ ID NO: 23086 - RNA, 25 nt, Artificial Sequence
  Synthetic Oligonucleotide; PD-L1 exons 4 and 5; Set A
uuguauggggcuaggacauaaacaa

SEQ ID NO: 23087 - RNA, 22 nt, Artificial Sequence
  Synthetic Oligonucleotide; PD-L1 exons 4 and 5; Set C
uguauggggcuaggacauaaac

SEQ ID NO: 23088 - RNA, 26 nt, Artificial Sequence
  Synthetic Oligonucleotide; PD-L1 exons 4 and 5; Set A
guuguauggggcuaggacauaaacaa

SEQ ID NO: 23089 - RNA, 23 nt, Artificial Sequence
  Synthetic Oligonucleotide; PD-L1 exons 4 and 5; Set C
uuguauggggcuaggacauaaac

SEQ ID NO: 23090 - RNA, 27 nt, Artificial Sequence
  Synthetic Oligonucleotide; PD-L1 exons 4 and 5; Set A
uguuguauggggcuaggacauaaacaa

SEQ ID NO: 23091 - RNA, 36 nt, Artificial Sequence
  Synthetic Oligonucleotide; PD-L1 exons 4 and 5; Set A
gauuuuguuguauggggcuaggacauaaacaaaaag

SEQ ID NO: 23092 - RNA, 24 nt, Artificial Sequence
  Synthetic Oligonucleotide; PD-L1 exons 4 and 5; Set A
guuguauggggcuaggacauaaac

SEQ ID NO: 23093 - RNA, 28 nt, Artificial Sequence
  Synthetic Oligonucleotide; PD-L1 exons 4 and 5; Set A
uuguuguauggggcuaggacauaaacaa

SEQ ID NO: 23094 - RNA, 26 nt, Artificial Sequence
  Synthetic Oligonucleotide; PD-L1 exons 4 and 5; Set A
uguuguauggggcuaggacauaaaca

SEQ ID NO: 23095 - RNA, 35 nt, Artificial Sequence
  Synthetic Oligonucleotide; PD-L1 exons 4 and 5; Set A
gauuuuguuguauggggcuaggacauaaacaaaaa

SEQ ID NO: 23096 - RNA, 25 nt, Artificial Sequence
  Synthetic Oligonucleotide; PD-L1 exons 4 and 5; Set A
uguuguauggggcuaggacauaaac

SEQ ID NO: 23097 - RNA, 29 nt, Artificial Sequence
  Synthetic Oligonucleotide; PD-L1 exons 4 and 5; Set A
uuuguuguauggggcuaggacauaaacaa

SEQ ID NO: 23098 - RNA, 34 nt, Artificial Sequence
  Synthetic Oligonucleotide; PD-L1 exons 4 and 5; Set A
gauuuuguuguauggggcuaggacauaaacaaaa

SEQ ID NO: 23099 - RNA, 26 nt, Artificial Sequence
  Synthetic Oligonucleotide; PD-L1 exons 4 and 5; Set A
uuguuguauggggcuaggacauaaac

SEQ ID NO: 23100 - RNA, 30 nt, Artificial Sequence
  Synthetic Oligonucleotide; PD-L1 exons 4 and 5; Set A
uuuuguuguauggggcuaggacauaaacaa

SEQ ID NO: 23101 - RNA, 27 nt, Artificial Sequence
  Synthetic Oligonucleotide; PD-L1 exons 4 and 5; Set A
uuuguuguauggggcuaggacauaaac

SEQ ID NO: 23102 - RNA, 31 nt, Artificial Sequence
  Synthetic Oligonucleotide; PD-L1 exons 4 and 5; Set A
auuuuguuguauggggcuaggacauaaacaa

SEQ ID NO: 23103 - RNA, 28 nt, Artificial Sequence
  Synthetic Oligonucleotide; PD-L1 exons 4 and 5; Set A
uuuuguuguauggggcuaggacauaaac

SEQ ID NO: 23104 - RNA, 29 nt, Artificial Sequence
  Synthetic Oligonucleotide; PD-L1 exons 4 and 5; Set A
auuuuguuguauggggcuaggacauaaac

SEQ ID NO: 23105 - RNA, 29 nt, Artificial Sequence
  Synthetic Oligonucleotide; PD-L1 exons 4 and 5; Set A
gauuuuguuguauggggcuaggacauaaa

SEQ ID NO: 23106 - RNA, 28 nt, Artificial Sequence
  Synthetic Oligonucleotide; PD-L1 exons 4 and 5; Set A
gauuuuguuguauggggcuaggacauaa

SEQ ID NO: 23107 - RNA, 36 nt, Artificial Sequence
  Synthetic Oligonucleotide; PD-L1 exons 4 and 5; Set C
uucuuugguugauuuuguuguauggggcuaggacau

SEQ ID NO: 23108 - RNA, 37 nt, Artificial Sequence
  Synthetic Oligonucleotide; PD-L1 exons 4 and 5; Set C
auucuuugguugauuuuguuguauggggcuaggacau

SEQ ID NO: 23109 - RNA, 35 nt, Artificial Sequence
  Synthetic Oligonucleotide; PD-L1 exons 4 and 5; Set C
uucuuugguugauuuuguuguauggggcuaggaca

SEQ ID NO: 23110 - RNA, 36 nt, Artificial Sequence
  Synthetic Oligonucleotide; PD-L1 exons 4 and 5; Set C
auucuuugguugauuuuguuguauggggcuaggaca

SEQ ID NO: 23111 - RNA, 34 nt, Artificial Sequence
  Synthetic Oligonucleotide; PD-L1 exons 4 and 5; Set A
ccacaaccaaaauucuuugguugauuuuguugua

SEQ ID NO: 23112 - RNA, 33 nt, Artificial Sequence
  Synthetic Oligonucleotide; PD-L1 exons 4 and 5; Set A
ccacaaccaaaauucuuugguugauuuuguugu

SEQ ID NO: 23113 - RNA, 32 nt, Artificial Sequence
  Synthetic Oligonucleotide; PD-L1 exons 4 and 5; Set A
ccacaaccaaaauucuuugguugauuuuguug

SEQ ID NO: 23114 - RNA, 31 nt, Artificial Sequence
  Synthetic Oligonucleotide; PD-L1 exons 4 and 5; Set A
ccacaaccaaaauucuuugguugauuuuguu

SEQ ID NO: 23115 - RNA, 30 nt, Artificial Sequence
  Synthetic Oligonucleotide; PD-L1 exons 4 and 5; Set A
ccacaaccaaaauucuuugguugauuuugu

SEQ ID NO: 23116 - RNA, 32 nt, Artificial Sequence
  Synthetic Oligonucleotide; PD-L1 exons 4 and 5; Set A
uccacaaccaaaauucuuugguugauuuuguu

SEQ ID NO: 23117 - RNA, 40 nt, Artificial Sequence
  Synthetic Oligonucleotide; PD-L1 exons 4 and 5; Set A
uggauccacaaccaaaauucuuugguugauuuuguuguau

SEQ ID NO: 23118 - RNA, 31 nt, Artificial Sequence
  Synthetic Oligonucleotide; PD-L1 exons 4 and 5; Set A
uccacaaccaaaauucuuugguugauuuugu

SEQ ID NO: 23119 - RNA, 29 nt, Artificial Sequence
  Synthetic Oligonucleotide; PD-L1 exons 4 and 5; Set C
ccacaaccaaaauucuuugguugauuuug

SEQ ID NO: 23120 - RNA, 39 nt, Artificial Sequence
  Synthetic Oligonucleotide; PD-L1 exons 4 and 5; Set A
uggauccacaaccaaaauucuuugguugauuuuguugua

SEQ ID NO: 23121 - RNA, 32 nt, Artificial Sequence
  Synthetic Oligonucleotide; PD-L1 exons 4 and 5; Set A
auccacaaccaaaauucuuugguugauuuugu

SEQ ID NO: 23122 - RNA, 38 nt, Artificial Sequence
  Synthetic Oligonucleotide; PD-L1 exons 4 and 5; Set A
uggauccacaaccaaaauucuuugguugauuuuguugu

SEQ ID NO: 23123 - RNA, 28 nt, Artificial Sequence
  Synthetic Oligonucleotide; PD-L1 exons 4 and 5; Set C
ccacaaccaaaauucuuugguugauuuu

SEQ ID NO: 23124 - RNA, 30 nt, Artificial Sequence
  Synthetic Oligonucleotide; PD-L1 exons 4 and 5; Set C
uccacaaccaaaauucuuugguugauuuug

SEQ ID NO: 23125 - RNA, 37 nt, Artificial Sequence
  Synthetic Oligonucleotide; PD-L1 exons 4 and 5; Set A
uggauccacaaccaaaauucuuugguugauuuuguug

SEQ ID NO: 23126 - RNA, 29 nt, Artificial Sequence
  Synthetic Oligonucleotide; PD-L1 exons 4 and 5; Set C
uccacaaccaaaauucuuugguugauuuu

SEQ ID NO: 23127 - RNA, 27 nt, Artificial Sequence
  Synthetic Oligonucleotide; PD-L1 exons 4 and 5; Set C
ccacaaccaaaauucuuugguugauuu

SEQ ID NO: 23128 - RNA, 31 nt, Artificial Sequence
  Synthetic Oligonucleotide; PD-L1 exons 4 and 5; Set C
auccacaaccaaaauucuuugguugauuuug

SEQ ID NO: 23129 - RNA, 36 nt, Artificial Sequence
  Synthetic Oligonucleotide; PD-L1 exons 4 and 5; Set A
uggauccacaaccaaaauucuuugguugauuuuguu

SEQ ID NO: 23130 - RNA, 30 nt, Artificial Sequence
  Synthetic Oligonucleotide; PD-L1 exons 4 and 5; Set C
auccacaaccaaaauucuuugguugauuuu

SEQ ID NO: 23131 - RNA, 28 nt, Artificial Sequence
  Synthetic Oligonucleotide; PD-L1 exons 4 and 5; Set C
uccacaaccaaaauucuuugguugauuu

SEQ ID NO: 23132 - RNA, 35 nt, Artificial Sequence
  Synthetic Oligonucleotide; PD-L1 exons 4 and 5; Set A
uggauccacaaccaaaauucuuugguugauuuugu

SEQ ID NO: 23133 - RNA, 31 nt, Artificial Sequence
  Synthetic Oligonucleotide; PD-L1 exons 4 and 5; Set A
gauccacaaccaaaauucuuugguugauuuu

SEQ ID NO: 23134 - RNA, 29 nt, Artificial Sequence
  Synthetic Oligonucleotide; PD-L1 exons 4 and 5; Set C
auccacaaccaaaauucuuugguugauuu

SEQ ID NO: 23135 - RNA, 27 nt, Artificial Sequence
  Synthetic Oligonucleotide; PD-L1 exons 4 and 5; Set C
uccacaaccaaaauucuuugguugauu

SEQ ID NO: 23136 - RNA, 33 nt, Artificial Sequence
  Synthetic Oligonucleotide; PD-L1 exons 4 and 5; Set A
ggauccacaaccaaaauucuuugguugauuuug

SEQ ID NO: 23137 - RNA, 30 nt, Artificial Sequence
  Synthetic Oligonucleotide; PD-L1 exons 4 and 5; Set A
gauccacaaccaaaauucuuugguugauuu

SEQ ID NO: 23138 - RNA, 32 nt, Artificial Sequence
  Synthetic Oligonucleotide; PD-L1 exons 4 and 5; Set A
ggauccacaaccaaaauucuuugguugauuuu

SEQ ID NO: 23139 - RNA, 28 nt, Artificial Sequence
  Synthetic Oligonucleotide; PD-L1 exons 4 and 5; Set C
auccacaaccaaaauucuuugguugauu

SEQ ID NO: 23140 - RNA, 34 nt, Artificial Sequence
  Synthetic Oligonucleotide; PD-L1 exons 4 and 5; Set A
uggauccacaaccaaaauucuuugguugauuuug

SEQ ID NO: 23141 - RNA, 29 nt, Artificial Sequence
  Synthetic Oligonucleotide; PD-L1 exons 4 and 5; Set C
gauccacaaccaaaauucuuugguugauu

SEQ ID NO: 23142 - RNA, 31 nt, Artificial Sequence
  Synthetic Oligonucleotide; PD-L1 exons 4 and 5; Set A
ggauccacaaccaaaauucuuugguugauuu

SEQ ID NO: 23143 - RNA, 33 nt, Artificial Sequence
  Synthetic Oligonucleotide; PD-L1 exons 4 and 5; Set A
uggauccacaaccaaaauucuuugguugauuuu

SEQ ID NO: 23144 - RNA, 30 nt, Artificial Sequence
  Synthetic Oligonucleotide; PD-L1 exons 4 and 5; Set A
ggauccacaaccaaaauucuuugguugauu

SEQ ID NO: 23145 - RNA, 32 nt, Artificial Sequence
  Synthetic Oligonucleotide; PD-L1 exons 4 and 5; Set A
uggauccacaaccaaaauucuuugguugauuu

SEQ ID NO: 23146 - RNA, 35 nt, Artificial Sequence
  Synthetic Oligonucleotide; PD-L1 exons 4 and 5; Set A
ugacuggauccacaaccaaaauucuuugguugauu

SEQ ID NO: 23147 - RNA, 15 nt, Artificial Sequence
  Synthetic Oligonucleotide; PD-L1 exons 4 and 5; Set C
ccacaaccaaaauuc

SEQ ID NO: 23148 - RNA, 16 nt, Artificial Sequence
  Synthetic Oligonucleotide; PD-L1 exons 4 and 5; Set C
uccacaaccaaaauuc

SEQ ID NO: 23149 - RNA, 15 nt, Artificial Sequence
  Synthetic Oligonucleotide; PD-L1 exons 4 and 5; Set C
uccacaaccaaaauu

SEQ ID NO: 23150 - RNA, 17 nt, Artificial Sequence
  Synthetic Oligonucleotide; PD-L1 exons 4 and 5; Set C
auccacaaccaaaauuc

SEQ ID NO: 23151 - RNA, 16 nt, Artificial Sequence
  Synthetic Oligonucleotide; PD-L1 exons 4 and 5; Set C
auccacaaccaaaauu

SEQ ID NO: 23152 - RNA, 17 nt, Artificial Sequence
  Synthetic Oligonucleotide; PD-L1 exons 4 and 5; Set C
gauccacaaccaaaauu

SEQ ID NO: 23153 - RNA, 18 nt, Artificial Sequence
  Synthetic Oligonucleotide; PD-L1 exons 4 and 5; Set C
ggauccacaaccaaaauu

SEQ ID NO: 23154 - RNA, 20 nt, Artificial Sequence
  Synthetic Oligonucleotide; PD-L1 exons 4 and 5; Set C
uggauccacaaccaaaauuc

SEQ ID NO: 23155 - RNA, 19 nt, Artificial Sequence
  Synthetic Oligonucleotide; PD-L1 exons 4 and 5; Set C
uggauccacaaccaaaauu

SEQ ID NO: 23156 - RNA, 27 nt, Artificial Sequence
  Synthetic Oligonucleotide; PD-L1 exons 4 and 5; Set A
aggugacuggauccacaaccaaaauuc

SEQ ID NO: 23157 - RNA, 26 nt, Artificial Sequence
  Synthetic Oligonucleotide; PD-L1 exons 4 and 5; Set A
aggugacuggauccacaaccaaaauu

SEQ ID NO: 23158 - RNA, 31 nt, Artificial Sequence
  Synthetic Oligonucleotide; PD-L1 exons 4 and 5; Set A
ucagaggugacuggauccacaaccaaaauuc

SEQ ID NO: 23159 - RNA, 30 nt, Artificial Sequence
  Synthetic Oligonucleotide; PD-L1 exons 4 and 5; Set A
ucagaggugacuggauccacaaccaaaauu

SEQ ID NO: 23160 - RNA, 32 nt, Artificial Sequence
  Synthetic Oligonucleotide; PD-L1 exons 4 and 5; Set A
uucagaggugacuggauccacaaccaaaauuc

SEQ ID NO: 23161 - RNA, 31 nt, Artificial Sequence
  Synthetic Oligonucleotide; PD-L1 exons 4 and 5; Set A
uucagaggugacuggauccacaaccaaaauu

SEQ ID NO: 23162 - RNA, 15 nt, Artificial Sequence
  Synthetic Oligonucleotide; PD-L1 exons 4 and 5; Set C
guucagaggugacug

SEQ ID NO: 23163 - RNA, 16 nt, Artificial Sequence
  Synthetic Oligonucleotide; PD-L1 exons 4 and 5; Set C
uguucagaggugacug

SEQ ID NO: 23164 - RNA, 17 nt, Artificial Sequence
  Synthetic Oligonucleotide; PD-L1 exons 4 and 5; Set C
auguucagaggugacug

SEQ ID NO: 23165 - RNA, 15 nt, Artificial Sequence
  Synthetic Oligonucleotide; PD-L1 exons 4 and 5; Set C
uguucagaggugacu

SEQ ID NO: 23166 - RNA, 16 nt, Artificial Sequence
  Synthetic Oligonucleotide; PD-L1 exons 4 and 5; Set C
auguucagaggugacu

SEQ ID NO: 23167 - RNA, 15 nt, Artificial Sequence
  Synthetic Oligonucleotide; PD-L1 exons 4 and 5; Set C
auguucagaggugac

SEQ ID NO: 23168 - RNA, 19 nt, Artificial Sequence
  Synthetic Oligonucleotide; PD-L1 exons 4 and 5; Set C
gucaguucauguucagagg

SEQ ID NO: 23169 - RNA, 20 nt, Artificial Sequence
  Synthetic Oligonucleotide; PD-L1 exons 4 and 5; Set C
ugucaguucauguucagagg

SEQ ID NO: 23170 - RNA, 21 nt, Artificial Sequence
  Synthetic Oligonucleotide; PD-L1 exons 4 and 5; Set C
augucaguucauguucagagg

SEQ ID NO: 23171 - RNA, 15 nt, Artificial Sequence
  Synthetic Oligonucleotide; PD-L1 exons 4 and 5; Set C
gucaguucauguuca

SEQ ID NO: 23172 - RNA, 16 nt, Artificial Sequence
  Synthetic Oligonucleotide; PD-L1 exons 4 and 5; Set C
ugucaguucauguuca

SEQ ID NO: 23173 - RNA, 15 nt, Artificial Sequence
  Synthetic Oligonucleotide; PD-L1 exons 4 and 5; Set C
ugucaguucauguuc

SEQ ID NO: 23174 - RNA, 17 nt, Artificial Sequence
  Synthetic Oligonucleotide; PD-L1 exons 4 and 5; Set C
augucaguucauguuca

SEQ ID NO: 23175 - RNA, 16 nt, Artificial Sequence
  Synthetic Oligonucleotide; PD-L1 exons 4 and 5; Set C
augucaguucauguuc

SEQ ID NO: 23176 - RNA, 30 nt, Artificial Sequence
  Synthetic Oligonucleotide; PD-L1 exons 4 and 5; Set C
cagccugacaugucaguucauguucagagg

SEQ ID NO: 23177 - RNA, 31 nt, Artificial Sequence
  Synthetic Oligonucleotide; PD-L1 exons 4 and 5; Set C
ucagccugacaugucaguucauguucagagg

SEQ ID NO: 23178 - RNA, 26 nt, Artificial Sequence
  Synthetic Oligonucleotide; PD-L1 exons 4 and 5; Set A
cagccugacaugucaguucauguuca

SEQ ID NO: 23179 - RNA, 25 nt, Artificial Sequence
  Synthetic Oligonucleotide; PD-L1 exons 4 and 5; Set A
cagccugacaugucaguucauguuc

SEQ ID NO: 23180 - RNA, 27 nt, Artificial Sequence
  Synthetic Oligonucleotide; PD-L1 exons 4 and 5; Set A
ucagccugacaugucaguucauguuca

SEQ ID NO: 23181 - RNA, 26 nt, Artificial Sequence
  Synthetic Oligonucleotide; PD-L1 exons 4 and 5; Set A
ucagccugacaugucaguucauguuc

SEQ ID NO: 23182 - RNA, 37 nt, Artificial Sequence
  Synthetic Oligonucleotide; PD-L1 exons 4 and 5; Set C
uagcccucagccugacaugucaguucauguucagagg

SEQ ID NO: 23183 - RNA, 22 nt, Artificial Sequence
  Synthetic Oligonucleotide; PD-L1 exons 4 and 5; Set A
cagccugacaugucaguucaug

SEQ ID NO: 23184 - RNA, 38 nt, Artificial Sequence
  Synthetic Oligonucleotide; PD-L1 exons 4 and 5; Set C
guagcccucagccugacaugucaguucauguucagagg

SEQ ID NO: 23185 - RNA, 23 nt, Artificial Sequence
  Synthetic Oligonucleotide; PD-L1 exons 4 and 5; Set A
ucagccugacaugucaguucaug

SEQ ID NO: 23186 - RNA, 39 nt, Artificial Sequence
  Synthetic Oligonucleotide; PD-L1 exons 4 and 5; Set C
gguagcccucagccugacaugucaguucauguucagagg

SEQ ID NO: 23187 - RNA, 40 nt, Artificial Sequence
  Synthetic Oligonucleotide; PD-L1 exons 4 and 5; Set C
ggguagcccucagccugacaugucaguucauguucagagg

SEQ ID NO: 23188 - RNA, 33 nt, Artificial Sequence
  Synthetic Oligonucleotide; PD-L1 exons 4 and 5; Set C
uagcccucagccugacaugucaguucauguuca

SEQ ID NO: 23189 - RNA, 32 nt, Artificial Sequence
  Synthetic Oligonucleotide; PD-L1 exons 4 and 5; Set C
uagcccucagccugacaugucaguucauguuc

SEQ ID NO: 23190 - RNA, 34 nt, Artificial Sequence
  Synthetic Oligonucleotide; PD-L1 exons 4 and 5; Set C
guagcccucagccugacaugucaguucauguuca

SEQ ID NO: 23191 - RNA, 33 nt, Artificial Sequence
  Synthetic Oligonucleotide; PD-L1 exons 4 and 5; Set C
guagcccucagccugacaugucaguucauguuc

SEQ ID NO: 23192 - RNA, 35 nt, Artificial Sequence
  Synthetic Oligonucleotide; PD-L1 exons 4 and 5; Set C
gguagcccucagccugacaugucaguucauguuca

SEQ ID NO: 23193 - RNA, 34 nt, Artificial Sequence
  Synthetic Oligonucleotide; PD-L1 exons 4 and 5; Set C
gguagcccucagccugacaugucaguucauguuc

SEQ ID NO: 23194 - RNA, 36 nt, Artificial Sequence
  Synthetic Oligonucleotide; PD-L1 exons 4 and 5; Set C
ggguagcccucagccugacaugucaguucauguuca

SEQ ID NO: 23195 - RNA, 35 nt, Artificial Sequence
  Synthetic Oligonucleotide; PD-L1 exons 4 and 5; Set C
ggguagcccucagccugacaugucaguucauguuc

SEQ ID NO: 23196 - RNA, 29 nt, Artificial Sequence
  Synthetic Oligonucleotide; PD-L1 exons 4 and 5; Set C
gggguagcccucagccugacaugucaguu

SEQ ID NO: 23197 - RNA, 30 nt, Artificial Sequence
  Synthetic Oligonucleotide; PD-L1 exons 4 and 5; Set C
ugggguagcccucagccugacaugucaguu

SEQ ID NO: 23198 - RNA, 40 nt, Artificial Sequence
  Synthetic Oligonucleotide; PD-L1 exons 4 and 5; Set C
ggccuugggguagcccucagccugacaugucaguucaugu

SEQ ID NO: 23199 - RNA, 29 nt, Artificial Sequence
  Synthetic Oligonucleotide; PD-L1 exons 4 and 5; Set C
ugggguagcccucagccugacaugucagu

SEQ ID NO: 23200 - RNA, 31 nt, Artificial Sequence
  Synthetic Oligonucleotide; PD-L1 exons 4 and 5; Set C
uugggguagcccucagccugacaugucaguu

SEQ ID NO: 23201 - RNA, 39 nt, Artificial Sequence
  Synthetic Oligonucleotide; PD-L1 exons 4 and 5; Set C
ggccuugggguagcccucagccugacaugucaguucaug

SEQ ID NO: 23202 - RNA, 30 nt, Artificial Sequence
  Synthetic Oligonucleotide; PD-L1 exons 4 and 5; Set C
uugggguagcccucagccugacaugucagu

SEQ ID NO: 23203 - RNA, 40 nt, Artificial Sequence
  Synthetic Oligonucleotide; PD-L1 exons 4 and 5; Set C
cggccuugggguagcccucagccugacaugucaguucaug

SEQ ID NO: 23204 - RNA, 29 nt, Artificial Sequence
  Synthetic Oligonucleotide; PD-L1 exons 4 and 5; Set C
uugggguagcccucagccugacaugucag

SEQ ID NO: 23205 - RNA, 33 nt, Artificial Sequence
  Synthetic Oligonucleotide; PD-L1 exons 4 and 5; Set C
ucggccuugggguagcccucagccugacauguc

SEQ ID NO: 23206 - RNA, 34 nt, Artificial Sequence
  Synthetic Oligonucleotide; PD-L1 exons 4 and 5; Set C
uucggccuugggguagcccucagccugacauguc

SEQ ID NO: 23207 - RNA, 32 nt, Artificial Sequence
  Synthetic Oligonucleotide; PD-L1 exons 4 and 5; Set C
ucggccuugggguagcccucagccugacaugu

SEQ ID NO: 23208 - RNA, 35 nt, Artificial Sequence
  Synthetic Oligonucleotide; PD-L1 exons 4 and 5; Set C
cuucggccuugggguagcccucagccugacauguc

SEQ ID NO: 23209 - RNA, 33 nt, Artificial Sequence
  Synthetic Oligonucleotide; PD-L1 exons 4 and 5; Set C
uucggccuugggguagcccucagccugacaugu

SEQ ID NO: 23210 - RNA, 31 nt, Artificial Sequence
  Synthetic Oligonucleotide; PD-L1 exons 4 and 5; Set C
ucggccuugggguagcccucagccugacaug

SEQ ID NO: 23211 - RNA, 34 nt, Artificial Sequence
  Synthetic Oligonucleotide; PD-L1 exons 4 and 5; Set C
cuucggccuugggguagcccucagccugacaugu

SEQ ID NO: 23212 - RNA, 32 nt, Artificial Sequence
  Synthetic Oligonucleotide; PD-L1 exons 4 and 5; Set C
uucggccuugggguagcccucagccugacaug

SEQ ID NO: 23213 - RNA, 33 nt, Artificial Sequence
  Synthetic Oligonucleotide; PD-L1 exons 4 and 5; Set C
cuucggccuugggguagcccucagccugacaug

SEQ ID NO: 23214 - RNA, 39 nt, Artificial Sequence
  Synthetic Oligonucleotide; PD-L1 exons 4 and 5; Set C
augacuucggccuugggguagcccucagccugacauguc

SEQ ID NO: 23215 - RNA, 40 nt, Artificial Sequence
  Synthetic Oligonucleotide; PD-L1 exons 4 and 5; Set C
gaugacuucggccuugggguagcccucagccugacauguc

SEQ ID NO: 23216 - RNA, 38 nt, Artificial Sequence
  Synthetic Oligonucleotide; PD-L1 exons 4 and 5; Set C
augacuucggccuugggguagcccucagccugacaugu

SEQ ID NO: 23217 - RNA, 39 nt, Artificial Sequence
  Synthetic Oligonucleotide; PD-L1 exons 4 and 5; Set C
gaugacuucggccuugggguagcccucagccugacaugu

SEQ ID NO: 23218 - RNA, 37 nt, Artificial Sequence
  Synthetic Oligonucleotide; PD-L1 exons 4 and 5; Set C
augacuucggccuugggguagcccucagccugacaug

SEQ ID NO: 23219 - RNA, 20 nt, Artificial Sequence
  Synthetic Oligonucleotide; PD-L1 exons 4 and 5; Set C
ggccuugggguagcccucag

SEQ ID NO: 23220 - RNA, 38 nt, Artificial Sequence
  Synthetic Oligonucleotide; PD-L1 exons 4 and 5; Set C
gaugacuucggccuugggguagcccucagccugacaug

SEQ ID NO: 23221 - RNA, 21 nt, Artificial Sequence
  Synthetic Oligonucleotide; PD-L1 exons 4 and 5; Set C
cggccuugggguagcccucag

SEQ ID NO: 23222 - RNA, 19 nt, Artificial Sequence
  Synthetic Oligonucleotide; PD-L1 exons 4 and 5; Set C
ggccuugggguagcccuca

SEQ ID NO: 23223 - RNA, 20 nt, Artificial Sequence
  Synthetic Oligonucleotide; PD-L1 exons 4 and 5; Set C
cggccuugggguagcccuca

SEQ ID NO: 23224 - RNA, 34 nt, Artificial Sequence
  Synthetic Oligonucleotide; PD-L1 exons 4 and 5; Set C
guccagaugacuucggccuugggguagcccucag

SEQ ID NO: 23225 - RNA, 33 nt, Artificial Sequence
  Synthetic Oligonucleotide; PD-L1 exons 4 and 5; Set C
guccagaugacuucggccuugggguagcccuca

SEQ ID NO: 23226 - RNA, 23 nt, Artificial Sequence
  Synthetic Oligonucleotide; PD-L1 exons 4 and 5; Set A
agaugacuucggccuugggguag

SEQ ID NO: 23227 - RNA, 15 nt, Artificial Sequence
  Synthetic Oligonucleotide; PD-L1 exons 4 and 5; Set C
gacuucggccuuggg

SEQ ID NO: 23228 - RNA, 22 nt, Artificial Sequence
  Synthetic Oligonucleotide; PD-L1 exons 4 and 5; Set A
agaugacuucggccuuggggua

SEQ ID NO: 23229 - RNA, 16 nt, Artificial Sequence
  Synthetic Oligonucleotide; PD-L1 exons 4 and 5; Set C
ugacuucggccuuggg

SEQ ID NO: 23230 - RNA, 21 nt, Artificial Sequence
  Synthetic Oligonucleotide; PD-L1 exons 4 and 5; Set A
agaugacuucggccuuggggu

SEQ ID NO: 23231 - RNA, 15 nt, Artificial Sequence
  Synthetic Oligonucleotide; PD-L1 exons 4 and 5; Set C
ugacuucggccuugg

SEQ ID NO: 23232 - RNA, 17 nt, Artificial Sequence
  Synthetic Oligonucleotide; PD-L1 exons 4 and 5; Set C
guccagaugacuucggc

SEQ ID NO: 23233 - RNA, 16 nt, Artificial Sequence
  Synthetic Oligonucleotide; PD-L1 exons 4 and 5; Set C
guccagaugacuucgg

SEQ ID NO: 23234 - RNA, 35 nt, Artificial Sequence
  Synthetic Oligonucleotide; PD-L1 exons 4 and 5; Set C
uggucacugcuuguccagaugacuucggccuuggg

SEQ ID NO: 23235 - RNA, 34 nt, Artificial Sequence
  Synthetic Oligonucleotide; PD-L1 exons 4 and 5; Set C
uggucacugcuuguccagaugacuucggccuugg

SEQ ID NO: 23236 - RNA, 36 nt, Artificial Sequence
  Synthetic Oligonucleotide; PD-L1 exons 4 and 5; Set C
auggucacugcuuguccagaugacuucggccuuggg

SEQ ID NO: 23237 - RNA, 35 nt, Artificial Sequence
  Synthetic Oligonucleotide; PD-L1 exons 4 and 5; Set C
auggucacugcuuguccagaugacuucggccuugg

SEQ ID NO: 23238 - RNA, 33 nt, Artificial Sequence
  Synthetic Oligonucleotide; PD-L1 exons 4 and 5; Set C
uggucacugcuuguccagaugacuucggccuug

SEQ ID NO: 23239 - RNA, 37 nt, Artificial Sequence
  Synthetic Oligonucleotide; PD-L1 exons 4 and 5; Set C
gauggucacugcuuguccagaugacuucggccuuggg

SEQ ID NO: 23240 - RNA, 36 nt, Artificial Sequence
  Synthetic Oligonucleotide; PD-L1 exons 4 and 5; Set C
gauggucacugcuuguccagaugacuucggccuugg

SEQ ID NO: 23241 - RNA, 34 nt, Artificial Sequence
  Synthetic Oligonucleotide; PD-L1 exons 4 and 5; Set C
auggucacugcuuguccagaugacuucggccuug

SEQ ID NO: 23242 - RNA, 38 nt, Artificial Sequence
  Synthetic Oligonucleotide; PD-L1 exons 4 and 5; Set C
ugauggucacugcuuguccagaugacuucggccuuggg

SEQ ID NO: 23243 - RNA, 35 nt, Artificial Sequence
  Synthetic Oligonucleotide; PD-L1 exons 4 and 5; Set C
gauggucacugcuuguccagaugacuucggccuug

SEQ ID NO: 23244 - RNA, 37 nt, Artificial Sequence
  Synthetic Oligonucleotide; PD-L1 exons 4 and 5; Set C
ugauggucacugcuuguccagaugacuucggccuugg

SEQ ID NO: 23245 - RNA, 39 nt, Artificial Sequence
  Synthetic Oligonucleotide; PD-L1 exons 4 and 5; Set C
uugauggucacugcuuguccagaugacuucggccuuggg

SEQ ID NO: 23246 - RNA, 38 nt, Artificial Sequence
  Synthetic Oligonucleotide; PD-L1 exons 4 and 5; Set C
uugauggucacugcuuguccagaugacuucggccuugg

SEQ ID NO: 23247 - RNA, 36 nt, Artificial Sequence
  Synthetic Oligonucleotide; PD-L1 exons 4 and 5; Set C
ugauggucacugcuuguccagaugacuucggccuug

SEQ ID NO: 23248 - RNA, 40 nt, Artificial Sequence
  Synthetic Oligonucleotide; PD-L1 exons 4 and 5; Set C
cuugauggucacugcuuguccagaugacuucggccuuggg

SEQ ID NO: 23249 - RNA, 37 nt, Artificial Sequence
  Synthetic Oligonucleotide; PD-L1 exons 4 and 5; Set C
uugauggucacugcuuguccagaugacuucggccuug

SEQ ID NO: 23250 - RNA, 39 nt, Artificial Sequence
  Synthetic Oligonucleotide; PD-L1 exons 4 and 5; Set C
cuugauggucacugcuuguccagaugacuucggccuugg

SEQ ID NO: 23251 - RNA, 38 nt, Artificial Sequence
  Synthetic Oligonucleotide; PD-L1 exons 4 and 5; Set C
cuugauggucacugcuuguccagaugacuucggccuug

SEQ ID NO: 23252 - RNA, 40 nt, Artificial Sequence
  Synthetic Oligonucleotide; PD-L1 exons 4 and 5; Set C
acuugauggucacugcuuguccagaugacuucggccuugg

SEQ ID NO: 23253 - RNA, 39 nt, Artificial Sequence
  Synthetic Oligonucleotide; PD-L1 exons 4 and 5; Set C
acuugauggucacugcuuguccagaugacuucggccuug

SEQ ID NO: 23254 - RNA, 36 nt, Artificial Sequence
  Synthetic Oligonucleotide; PD-L1 exons 4 and 5; Set C
gacuugauggucacugcuuguccagaugacuucggc

SEQ ID NO: 23255 - RNA, 35 nt, Artificial Sequence
  Synthetic Oligonucleotide; PD-L1 exons 4 and 5; Set C
gacuugauggucacugcuuguccagaugacuucgg

SEQ ID NO: 23256 - RNA, 37 nt, Artificial Sequence
  Synthetic Oligonucleotide; PD-L1 exons 4 and 5; Set C
ggacuugauggucacugcuuguccagaugacuucggc

SEQ ID NO: 23257 - RNA, 36 nt, Artificial Sequence
  Synthetic Oligonucleotide; PD-L1 exons 4 and 5; Set C
ggacuugauggucacugcuuguccagaugacuucgg

SEQ ID NO: 23258 - RNA, 31 nt, Artificial Sequence
  Synthetic Oligonucleotide; PD-L1 exons 4 and 5; Set C
gacuugauggucacugcuuguccagaugacu

SEQ ID NO: 23259 - RNA, 32 nt, Artificial Sequence
  Synthetic Oligonucleotide; PD-L1 exons 4 and 5; Set C
ggacuugauggucacugcuuguccagaugacu

SEQ ID NO: 23260 - RNA, 30 nt, Artificial Sequence
  Synthetic Oligonucleotide; PD-L1 exons 4 and 5; Set C
gacuugauggucacugcuuguccagaugac

SEQ ID NO: 23261 - RNA, 29 nt, Artificial Sequence
  Synthetic Oligonucleotide; PD-L1 exons 4 and 5; Set C
gacuugauggucacugcuuguccagauga

SEQ ID NO: 23262 - RNA, 31 nt, Artificial Sequence
  Synthetic Oligonucleotide; PD-L1 exons 4 and 5; Set C
ggacuugauggucacugcuuguccagaugac

SEQ ID NO: 23263 - RNA, 15 nt, Artificial Sequence
  Synthetic Oligonucleotide; PD-L1 exons 4 and 5; Set C
uggucacugcuuguc

SEQ ID NO: 23264 - RNA, 30 nt, Artificial Sequence
  Synthetic Oligonucleotide; PD-L1 exons 4 and 5; Set C
ggacuugauggucacugcuuguccagauga

SEQ ID NO: 23265 - RNA, 16 nt, Artificial Sequence
  Synthetic Oligonucleotide; PD-L1 exons 4 and 5; Set C
auggucacugcuuguc

SEQ ID NO: 23266 - RNA, 21 nt, Artificial Sequence
  Synthetic Oligonucleotide; PD-L1 exons 4 and 5; Set A
acuugauggucacugcuuguc

SEQ ID NO: 23267 - RNA, 22 nt, Artificial Sequence
  Synthetic Oligonucleotide; PD-L1 exons 4 and 5; Set A
gacuugauggucacugcuuguc

SEQ ID NO: 23268 - RNA, 23 nt, Artificial Sequence
  Synthetic Oligonucleotide; PD-L1 exons 4 and 5; Set A
ggacuugauggucacugcuuguc

SEQ ID NO: 23269 - RNA, 38 nt, Artificial Sequence
  Synthetic Oligonucleotide; PD-L1 exons 4 and 5; Set C
uuaccacucaggacuugauggucacugcuuguccagau

SEQ ID NO: 23270 - RNA, 34 nt, Artificial Sequence
  Synthetic Oligonucleotide; PD-L1 exons 4 and 5; Set C
cuuaccacucaggacuugauggucacugcuuguc

SEQ ID NO: 23271 - RNA, 31 nt, Artificial Sequence
  Synthetic Oligonucleotide; PD-L1 exons 4 and 5; Set C
uuaccacucaggacuugauggucacugcuug

SEQ ID NO: 23272 - RNA, 35 nt, Artificial Sequence
  Synthetic Oligonucleotide; PD-L1 exons 4 and 5; Set C
ucuuaccacucaggacuugauggucacugcuuguc

SEQ ID NO: 23273 - RNA, 36 nt, Artificial Sequence
  Synthetic Oligonucleotide; PD-L1 exons 4 and 5; Set C
gucuuaccacucaggacuugauggucacugcuuguc

SEQ ID NO: 23274 - RNA, 37 nt, Artificial Sequence
  Synthetic Oligonucleotide; PD-L1 exons 4 and 5; Set C
ggucuuaccacucaggacuugauggucacugcuuguc

SEQ ID NO: 23275 - RNA, 21 nt, Artificial Sequence
  Synthetic Oligonucleotide; PD-L1 exons 4 and 5; Set C
uuaccacucaggacuugaugg

SEQ ID NO: 23276 - RNA, 20 nt, Artificial Sequence
  Synthetic Oligonucleotide; PD-L1 exons 4 and 5; Set C
uuaccacucaggacuugaug

SEQ ID NO: 23277 - RNA, 19 nt, Artificial Sequence
  Synthetic Oligonucleotide; PD-L1 exons 4 and 5; Set C
uuaccacucaggacuugau

SEQ ID NO: 23278 - RNA, 16 nt, Artificial Sequence
  Synthetic Oligonucleotide; PD-L1 exons 4 and 5; Set C
cuuaccacucaggacu

SEQ ID NO: 23279 - RNA, 17 nt, Artificial Sequence
  Synthetic Oligonucleotide; PD-L1 exons 4 and 5; Set C
ucuuaccacucaggacu

SEQ ID NO: 23280 - RNA, 15 nt, Artificial Sequence
  Synthetic Oligonucleotide; PD-L1 exons 4 and 5; Set C
cuuaccacucaggac

SEQ ID NO: 23281 - RNA, 16 nt, Artificial Sequence
  Synthetic Oligonucleotide; PD-L1 exons 4 and 5; Set C
ucuuaccacucaggac

SEQ ID NO: 23282 - RNA, 17 nt, Artificial Sequence
  Synthetic Oligonucleotide; PD-L1 exons 4 and 5; Set C
gucuuaccacucaggac

SEQ ID NO: 23283 - RNA, 15 nt, Artificial Sequence
  Synthetic Oligonucleotide; PD-L1 exons 4 and 5; Set C
ucuuaccacucagga

SEQ ID NO: 23284 - RNA, 18 nt, Artificial Sequence
  Synthetic Oligonucleotide; PD-L1 exons 4 and 5; Set C
ggucuuaccacucaggac

SEQ ID NO: 23285 - RNA, 16 nt, Artificial Sequence
  Synthetic Oligonucleotide; PD-L1 exons 4 and 5; Set C
gucuuaccacucagga

SEQ ID NO: 23286 - RNA, 17 nt, Artificial Sequence
  Synthetic Oligonucleotide; PD-L1 exons 4 and 5; Set C
ggucuuaccacucagga

SEQ ID NO: 23287 - RNA, 38 nt, Artificial Sequence
  Synthetic Oligonucleotide; PD-L1 exons 4 and 5; Set C
aauugguggugguggucuuaccacucaggacuugaugg

SEQ ID NO: 23288 - RNA, 37 nt, Artificial Sequence
  Synthetic Oligonucleotide; PD-L1 exons 4 and 5; Set C
aauugguggugguggucuuaccacucaggacuugaug

SEQ ID NO: 23289 - RNA, 39 nt, Artificial Sequence
  Synthetic Oligonucleotide; PD-L1 exons 4 and 5; Set C
gaauugguggugguggucuuaccacucaggacuugaugg

SEQ ID NO: 23290 - RNA, 27 nt, Artificial Sequence
  Synthetic Oligonucleotide; PD-L1 exons 4 and 5; Set C
guggugguggucuuaccacucaggacu

SEQ ID NO: 23291 - RNA, 36 nt, Artificial Sequence
  Synthetic Oligonucleotide; PD-L1 exons 4 and 5; Set C
aauugguggugguggucuuaccacucaggacuugau

SEQ ID NO: 23292 - RNA, 38 nt, Artificial Sequence
  Synthetic Oligonucleotide; PD-L1 exons 4 and 5; Set C
gaauugguggugguggucuuaccacucaggacuugaug

SEQ ID NO: 23293 - RNA, 40 nt, Artificial Sequence
  Synthetic Oligonucleotide; PD-L1 exons 4 and 5; Set C
ggaauugguggugguggucuuaccacucaggacuugaugg

SEQ ID NO: 23294 - RNA, 28 nt, Artificial Sequence
  Synthetic Oligonucleotide; PD-L1 exons 4 and 5; Set C
gguggugguggucuuaccacucaggacu

SEQ ID NO: 23295 - RNA, 26 nt, Artificial Sequence
  Synthetic Oligonucleotide; PD-L1 exons 4 and 5; Set C
guggugguggucuuaccacucaggac

SEQ ID NO: 23296 - RNA, 37 nt, Artificial Sequence
  Synthetic Oligonucleotide; PD-L1 exons 4 and 5; Set C
gaauugguggugguggucuuaccacucaggacuugau

SEQ ID NO: 23297 - RNA, 39 nt, Artificial Sequence
  Synthetic Oligonucleotide; PD-L1 exons 4 and 5; Set C
ggaauugguggugguggucuuaccacucaggacuugaug

SEQ ID NO: 23298 - RNA, 35 nt, Artificial Sequence
  Synthetic Oligonucleotide; PD-L1 exons 4 and 5; Set C
aauugguggugguggucuuaccacucaggacuuga

SEQ ID NO: 23299 - RNA, 27 nt, Artificial Sequence
  Synthetic Oligonucleotide; PD-L1 exons 4 and 5; Set C
gguggugguggucuuaccacucaggac

SEQ ID NO: 23300 - RNA, 25 nt, Artificial Sequence
  Synthetic Oligonucleotide; PD-L1 exons 4 and 5; Set C
guggugguggucuuaccacucagga

SEQ ID NO: 23301 - RNA, 40 nt, Artificial Sequence
  Synthetic Oligonucleotide; PD-L1 exons 4 and 5; Set C
uggaauugguggugguggucuuaccacucaggacuugaug

SEQ ID NO: 23302 - RNA, 38 nt, Artificial Sequence
  Synthetic Oligonucleotide; PD-L1 exons 4 and 5; Set C
ggaauugguggugguggucuuaccacucaggacuugau

SEQ ID NO: 23303 - RNA, 34 nt, Artificial Sequence
  Synthetic Oligonucleotide; PD-L1 exons 4 and 5; Set C
aauugguggugguggucuuaccacucaggacuug

SEQ ID NO: 23304 - RNA, 36 nt, Artificial Sequence
  Synthetic Oligonucleotide; PD-L1 exons 4 and 5; Set C
gaauugguggugguggucuuaccacucaggacuuga

SEQ ID NO: 23305 - RNA, 28 nt, Artificial Sequence
  Synthetic Oligonucleotide; PD-L1 exons 4 and 5; Set C
ugguggugguggucuuaccacucaggac

SEQ ID NO: 23306 - RNA, 26 nt, Artificial Sequence
  Synthetic Oligonucleotide; PD-L1 exons 4 and 5; Set C
gguggugguggucuuaccacucagga

SEQ ID NO: 23307 - RNA, 39 nt, Artificial Sequence
  Synthetic Oligonucleotide; PD-L1 exons 4 and 5; Set C
uggaauugguggugguggucuuaccacucaggacuugau

SEQ ID NO: 23308 - RNA, 35 nt, Artificial Sequence
  Synthetic Oligonucleotide; PD-L1 exons 4 and 5; Set C
gaauugguggugguggucuuaccacucaggacuug

SEQ ID NO: 23309 - RNA, 37 nt, Artificial Sequence
  Synthetic Oligonucleotide; PD-L1 exons 4 and 5; Set C
ggaauugguggugguggucuuaccacucaggacuuga

SEQ ID NO: 23310 - RNA, 33 nt, Artificial Sequence
  Synthetic Oligonucleotide; PD-L1 exons 4 and 5; Set C
aauugguggugguggucuuaccacucaggacuu

SEQ ID NO: 23311 - RNA, 29 nt, Artificial Sequence
  Synthetic Oligonucleotide; PD-L1 exons 4 and 5; Set C
uugguggugguggucuuaccacucaggac

SEQ ID NO: 23312 - RNA, 27 nt, Artificial Sequence
  Synthetic Oligonucleotide; PD-L1 exons 4 and 5; Set C
ugguggugguggucuuaccacucagga

SEQ ID NO: 23313 - RNA, 36 nt, Artificial Sequence
  Synthetic Oligonucleotide; PD-L1 exons 4 and 5; Set C
ggaauugguggugguggucuuaccacucaggacuug

SEQ ID NO: 23314 - RNA, 38 nt, Artificial Sequence
  Synthetic Oligonucleotide; PD-L1 exons 4 and 5; Set C
uggaauugguggugguggucuuaccacucaggacuuga

SEQ ID NO: 23315 - RNA, 34 nt, Artificial Sequence
  Synthetic Oligonucleotide; PD-L1 exons 4 and 5; Set C
gaauugguggugguggucuuaccacucaggacuu

SEQ ID NO: 23316 - RNA, 30 nt, Artificial Sequence
  Synthetic Oligonucleotide; PD-L1 exons 4 and 5; Set C
auugguggugguggucuuaccacucaggac

SEQ ID NO: 23317 - RNA, 28 nt, Artificial Sequence
  Synthetic Oligonucleotide; PD-L1 exons 4 and 5; Set C
uugguggugguggucuuaccacucagga

SEQ ID NO: 23318 - RNA, 37 nt, Artificial Sequence
  Synthetic Oligonucleotide; PD-L1 exons 4 and 5; Set C
uggaauugguggugguggucuuaccacucaggacuug

SEQ ID NO: 23319 - RNA, 29 nt, Artificial Sequence
  Synthetic Oligonucleotide; PD-L1 exons 4 and 5; Set C
auugguggugguggucuuaccacucagga

SEQ ID NO: 23320 - RNA, 36 nt, Artificial Sequence
  Synthetic Oligonucleotide; PD-L1 exons 4 and 5; Set C
uggaauugguggugguggucuuaccacucaggacuu

SEQ ID NO: 23321 - RNA, 36 nt, Artificial Sequence
  Synthetic Oligonucleotide; PD-L1 exons 4 and 5; Set C
uuggaauugguggugguggucuuaccacucaggacu

SEQ ID NO: 23322 - RNA, 35 nt, Artificial Sequence
  Synthetic Oligonucleotide; PD-L1 exons 4 and 5; Set C
uuggaauugguggugguggucuuaccacucaggac

SEQ ID NO: 23323 - RNA, 34 nt, Artificial Sequence
  Synthetic Oligonucleotide; PD-L1 exons 4 and 5; Set C
uuggaauugguggugguggucuuaccacucagga

SEQ ID NO: 23324 - RNA, 15 nt, Artificial Sequence
  Synthetic Oligonucleotide; PD-L1 exons 4 and 5; Set C
guggugguggucuua

SEQ ID NO: 23325 - RNA, 16 nt, Artificial Sequence
  Synthetic Oligonucleotide; PD-L1 exons 4 and 5; Set C
gguggugguggucuua

SEQ ID NO: 23326 - RNA, 17 nt, Artificial Sequence
  Synthetic Oligonucleotide; PD-L1 exons 4 and 5; Set C
ugguggugguggucuua

SEQ ID NO: 23327 - RNA, 18 nt, Artificial Sequence
  Synthetic Oligonucleotide; PD-L1 exons 4 and 5; Set C
uugguggugguggucuua

SEQ ID NO: 23328 - RNA, 21 nt, Artificial Sequence
  Synthetic Oligonucleotide; PD-L1 exons 4 and 5; Set A
ggaauugguggugguggucuu

SEQ ID NO: 23329 - RNA, 22 nt, Artificial Sequence
  Synthetic Oligonucleotide; PD-L1 exons 4 and 5; Set A
uggaauugguggugguggucuu

SEQ ID NO: 23330 - RNA, 20 nt, Artificial Sequence
  Synthetic Oligonucleotide; PD-L1 exons 4 and 5; Set A
ggaauugguggugguggucu

SEQ ID NO: 23331 - RNA, 24 nt, Artificial Sequence
  Synthetic Oligonucleotide; PD-L1 exons 4 and 5; Set A
uuggaauugguggugguggucuua

SEQ ID NO: 23332 - RNA, 21 nt, Artificial Sequence
  Synthetic Oligonucleotide; PD-L1 exons 4 and 5; Set A
uggaauugguggugguggucu

SEQ ID NO: 23333 - RNA, 19 nt, Artificial Sequence
  Synthetic Oligonucleotide; PD-L1 exons 4 and 5; Set A
ggaauuggugguggugguc

SEQ ID NO: 23334 - RNA, 20 nt, Artificial Sequence
  Synthetic Oligonucleotide; PD-L1 exons 4 and 5; Set A
uggaauuggugguggugguc

SEQ ID NO: 23335 - RNA, 18 nt, Artificial Sequence
  Synthetic Oligonucleotide; PD-L1 exons 4 and 5; Set C
ggaauugguggugguggu

SEQ ID NO: 23336 - RNA, 19 nt, Artificial Sequence
  Synthetic Oligonucleotide; PD-L1 exons 4 and 5; Set C
uggaauugguggugguggu

SEQ ID NO: 23337 - RNA, 33 nt, Artificial Sequence
  Synthetic Oligonucleotide; PD-L1 exons 4 and 5; Set C
cuccucucucuuggaauugguggugguggucuu

SEQ ID NO: 23338 - RNA, 35 nt, Artificial Sequence
  Synthetic Oligonucleotide; PD-L1 exons 4 and 5; Set C
ucuccucucucuuggaauugguggugguggucuua

SEQ ID NO: 23339 - RNA, 32 nt, Artificial Sequence
  Synthetic Oligonucleotide; PD-L1 exons 4 and 5; Set C
cuccucucucuuggaauugguggugguggucu

SEQ ID NO: 23340 - RNA, 36 nt, Artificial Sequence
  Synthetic Oligonucleotide; PD-L1 exons 4 and 5; Set C
uucuccucucucuuggaauugguggugguggucuua

SEQ ID NO: 23341 - RNA, 31 nt, Artificial Sequence
  Synthetic Oligonucleotide; PD-L1 exons 4 and 5; Set C
cuccucucucuuggaauuggugguggugguc

SEQ ID NO: 23342 - RNA, 30 nt, Artificial Sequence
  Synthetic Oligonucleotide; PD-L1 exons 4 and 5; Set C
cuccucucucuuggaauugguggugguggu

SEQ ID NO: 23343 - RNA, 39 nt, Artificial Sequence
  Synthetic Oligonucleotide; PD-L1 exons 4 and 5; Set C
agcuucuccucucucuuggaauugguggugguggucuua

SEQ ID NO: 23344 - RNA, 18 nt, Artificial Sequence
  Synthetic Oligonucleotide; PD-L1 exons 4 and 5; Set C
cuccucucucuuggaauu

SEQ ID NO: 23345 - RNA, 16 nt, Artificial Sequence
  Synthetic Oligonucleotide; PD-L1 exons 4 and 5; Set C
ucuccucucucuugga

SEQ ID NO: 23346 - RNA, 15 nt, Artificial Sequence
  Synthetic Oligonucleotide; PD-L1 exons 4 and 5; Set C
ucuccucucucuugg

SEQ ID NO: 23347 - RNA, 17 nt, Artificial Sequence
  Synthetic Oligonucleotide; PD-L1 exons 4 and 5; Set C
uucuccucucucuugga

SEQ ID NO: 23348 - RNA, 16 nt, Artificial Sequence
  Synthetic Oligonucleotide; PD-L1 exons 4 and 5; Set C
uucuccucucucuugg

SEQ ID NO: 23349 - RNA, 23 nt, Artificial Sequence
  Synthetic Oligonucleotide; PD-L1 exons 4 and 5; Set C
aagcuucuccucucucuuggaau

SEQ ID NO: 23350 - RNA, 22 nt, Artificial Sequence
  Synthetic Oligonucleotide; PD-L1 exons 4 and 5; Set C
aagcuucuccucucucuuggaa

SEQ ID NO: 23351 - RNA, 20 nt, Artificial Sequence
  Synthetic Oligonucleotide; PD-L1 exons 4 and 5; Set A
agcuucuccucucucuugga

SEQ ID NO: 23352 - RNA, 34 nt, Artificial Sequence
  Synthetic Oligonucleotide; PD-L1 exons 4 and 5; Set C
ggucacauugaaaagcuucuccucucucuuggaa

SEQ ID NO: 23353 - RNA, 35 nt, Artificial Sequence
  Synthetic Oligonucleotide; PD-L1 exons 4 and 5; Set C
uggucacauugaaaagcuucuccucucucuuggaa

SEQ ID NO: 23354 - RNA, 33 nt, Artificial Sequence
  Synthetic Oligonucleotide; PD-L1 exons 4 and 5; Set C
ggucacauugaaaagcuucuccucucucuugga

SEQ ID NO: 23355 - RNA, 36 nt, Artificial Sequence
  Synthetic Oligonucleotide; PD-L1 exons 4 and 5; Set C
cuggucacauugaaaagcuucuccucucucuuggaa

SEQ ID NO: 23356 - RNA, 32 nt, Artificial Sequence
  Synthetic Oligonucleotide; PD-L1 exons 4 and 5; Set A
ggucacauugaaaagcuucuccucucucuugg

SEQ ID NO: 23357 - RNA, 34 nt, Artificial Sequence
  Synthetic Oligonucleotide; PD-L1 exons 4 and 5; Set C
uggucacauugaaaagcuucuccucucucuugga

SEQ ID NO: 23358 - RNA, 33 nt, Artificial Sequence
  Synthetic Oligonucleotide; PD-L1 exons 4 and 5; Set A
uggucacauugaaaagcuucuccucucucuugg

SEQ ID NO: 23359 - RNA, 35 nt, Artificial Sequence
  Synthetic Oligonucleotide; PD-L1 exons 4 and 5; Set C
cuggucacauugaaaagcuucuccucucucuugga

SEQ ID NO: 23360 - RNA, 34 nt, Artificial Sequence
  Synthetic Oligonucleotide; PD-L1 exons 4 and 5; Set C
cuggucacauugaaaagcuucuccucucucuugg

SEQ ID NO: 23361 - RNA, 34 nt, Artificial Sequence
  Synthetic Oligonucleotide; PD-L1 exons 4 and 5; Set C
gcuggucacauugaaaagcuucuccucucucuug

SEQ ID NO: 23362 - RNA, 35 nt, Artificial Sequence
  Synthetic Oligonucleotide; PD-L1 exons 4 and 5; Set C
ugcuggucacauugaaaagcuucuccucucucuug

SEQ ID NO: 23363 - RNA, 36 nt, Artificial Sequence
  Synthetic Oligonucleotide; PD-L1 exons 4 and 5; Set C
gugcuggucacauugaaaagcuucuccucucucuug

SEQ ID NO: 23364 - RNA, 40 nt, Artificial Sequence
  Synthetic Oligonucleotide; PD-L1 exons 4 and 5; Set C
gugugcuggucacauugaaaagcuucuccucucucuugga

SEQ ID NO: 23365 - RNA, 39 nt, Artificial Sequence
  Synthetic Oligonucleotide; PD-L1 exons 4 and 5; Set C
gugugcuggucacauugaaaagcuucuccucucucuugg

SEQ ID NO: 23366 - RNA, 40 nt, Artificial Sequence
  Synthetic Oligonucleotide; PD-L1 exons 4 and 5; Set C
agugugcuggucacauugaaaagcuucuccucucucuugg

SEQ ID NO: 23367 - RNA, 28 nt, Artificial Sequence
  Synthetic Oligonucleotide; PD-L1 exons 4 and 5; Set A
gcuggucacauugaaaagcuucuccucu

SEQ ID NO: 23368 - RNA, 29 nt, Artificial Sequence
  Synthetic Oligonucleotide; PD-L1 exons 4 and 5; Set A
ugcuggucacauugaaaagcuucuccucu

SEQ ID NO: 23369 - RNA, 30 nt, Artificial Sequence
  Synthetic Oligonucleotide; PD-L1 exons 4 and 5; Set A
gugcuggucacauugaaaagcuucuccucu

SEQ ID NO: 23370 - RNA, 19 nt, Artificial Sequence
  Synthetic Oligonucleotide; PD-L1 exons 4 and 5; Set C
ggucacauugaaaagcuuc

SEQ ID NO: 23371 - RNA, 23 nt, Artificial Sequence
  Synthetic Oligonucleotide; PD-L1 exons 4 and 5; Set C
gcuggucacauugaaaagcuucu

SEQ ID NO: 23372 - RNA, 16 nt, Artificial Sequence
  Synthetic Oligonucleotide; PD-L1 exons 4 and 5; Set C
ggucacauugaaaagc

SEQ ID NO: 23373 - RNA, 24 nt, Artificial Sequence
  Synthetic Oligonucleotide; PD-L1 exons 4 and 5; Set A
ugcuggucacauugaaaagcuucu

SEQ ID NO: 23374 - RNA, 22 nt, Artificial Sequence
  Synthetic Oligonucleotide; PD-L1 exons 4 and 5; Set C
gcuggucacauugaaaagcuuc

SEQ ID NO: 23375 - RNA, 21 nt, Artificial Sequence
  Synthetic Oligonucleotide; PD-L1 exons 4 and 5; Set C
gcuggucacauugaaaagcuu

SEQ ID NO: 23376 - RNA, 25 nt, Artificial Sequence
  Synthetic Oligonucleotide; PD-L1 exons 4 and 5; Set A
gugcuggucacauugaaaagcuucu

SEQ ID NO: 23377 - RNA, 23 nt, Artificial Sequence
  Synthetic Oligonucleotide; PD-L1 exons 4 and 5; Set C
ugcuggucacauugaaaagcuuc

SEQ ID NO: 23378 - RNA, 20 nt, Artificial Sequence
  Synthetic Oligonucleotide; PD-L1 exons 4 and 5; Set C
gcuggucacauugaaaagcu

SEQ ID NO: 23379 - RNA, 22 nt, Artificial Sequence
  Synthetic Oligonucleotide; PD-L1 exons 4 and 5; Set C
ugcuggucacauugaaaagcuu

SEQ ID NO: 23380 - RNA, 26 nt, Artificial Sequence
  Synthetic Oligonucleotide; PD-L1 exons 4 and 5; Set A
ugugcuggucacauugaaaagcuucu

SEQ ID NO: 23381 - RNA, 24 nt, Artificial Sequence
  Synthetic Oligonucleotide; PD-L1 exons 4 and 5; Set A
gugcuggucacauugaaaagcuuc

SEQ ID NO: 23382 - RNA, 21 nt, Artificial Sequence
  Synthetic Oligonucleotide; PD-L1 exons 4 and 5; Set C
ugcuggucacauugaaaagcu

SEQ ID NO: 23383 - RNA, 23 nt, Artificial Sequence
  Synthetic Oligonucleotide; PD-L1 exons 4 and 5; Set C
gugcuggucacauugaaaagcuu

SEQ ID NO: 23384 - RNA, 19 nt, Artificial Sequence
  Synthetic Oligonucleotide; PD-L1 exons 4 and 5; Set C
gcuggucacauugaaaagc

SEQ ID NO: 23385 - RNA, 25 nt, Artificial Sequence
  Synthetic Oligonucleotide; PD-L1 exons 4 and 5; Set A
ugugcuggucacauugaaaagcuuc

SEQ ID NO: 23386 - RNA, 22 nt, Artificial Sequence
  Synthetic Oligonucleotide; PD-L1 exons 4 and 5; Set C
gugcuggucacauugaaaagcu

SEQ ID NO: 23387 - RNA, 24 nt, Artificial Sequence
  Synthetic Oligonucleotide; PD-L1 exons 4 and 5; Set A
ugugcuggucacauugaaaagcuu

SEQ ID NO: 23388 - RNA, 20 nt, Artificial Sequence
  Synthetic Oligonucleotide; PD-L1 exons 4 and 5; Set C
ugcuggucacauugaaaagc

SEQ ID NO: 23389 - RNA, 23 nt, Artificial Sequence
  Synthetic Oligonucleotide; PD-L1 exons 4 and 5; Set A
ugugcuggucacauugaaaagcu

SEQ ID NO: 23390 - RNA, 21 nt, Artificial Sequence
  Synthetic Oligonucleotide; PD-L1 exons 4 and 5; Set C
gugcuggucacauugaaaagc

SEQ ID NO: 23391 - RNA, 22 nt, Artificial Sequence
  Synthetic Oligonucleotide; PD-L1 exons 4 and 5; Set C
ugugcuggucacauugaaaagc

SEQ ID NO: 23392 - RNA, 22 nt, Artificial Sequence
  Synthetic Oligonucleotide; PD-L1 exons 4 and 5; Set C
gugugcuggucacauugaaaag

SEQ ID NO: 23393 - RNA, 23 nt, Artificial Sequence
  Synthetic Oligonucleotide; PD-L1 exons 4 and 5; Set C
agugugcuggucacauugaaaag

SEQ ID NO: 23394 - RNA, 31 nt, Artificial Sequence
  Synthetic Oligonucleotide; PD-L1 exons 4 and 5; Set A
ugauucucagugugcuggucacauugaaaag

SEQ ID NO: 23395 - RNA, 32 nt, Artificial Sequence
  Synthetic Oligonucleotide; PD-L1 exons 4 and 5; Set A
uugauucucagugugcuggucacauugaaaag

SEQ ID NO: 23396 - RNA, 33 nt, Artificial Sequence
  Synthetic Oligonucleotide; PD-L1 exons 4 and 5; Set A
guugauucucagugugcuggucacauugaaaag

SEQ ID NO: 23397 - RNA, 34 nt, Artificial Sequence
  Synthetic Oligonucleotide; PD-L1 exons 4 and 5; Set A
uguugauucucagugugcuggucacauugaaaag

SEQ ID NO: 23398 - RNA, 35 nt, Artificial Sequence
  Synthetic Oligonucleotide; PD-L1 exons 4 and 5; Set A
guguugauucucagugugcuggucacauugaaaag

SEQ ID NO: 23399 - RNA, 36 nt, Artificial Sequence
  Synthetic Oligonucleotide; PD-L1 exons 4 and 5; Set A
uguguugauucucagugugcuggucacauugaaaag

SEQ ID NO: 23400 - RNA, 37 nt, Artificial Sequence
  Synthetic Oligonucleotide; PD-L1 exons 4 and 5; Set A
uuguguugauucucagugugcuggucacauugaaaag

SEQ ID NO: 23401 - RNA, 38 nt, Artificial Sequence
  Synthetic Oligonucleotide; PD-L1 exons 4 and 5; Set C
guuguguugauucucagugugcuggucacauugaaaag

SEQ ID NO: 23402 - RNA, 17 nt, Artificial Sequence
  Synthetic Oligonucleotide; PD-L1 exons 4 and 5; Set C
auucucagugugcuggu

SEQ ID NO: 23403 - RNA, 16 nt, Artificial Sequence
  Synthetic Oligonucleotide; PD-L1 exons 4 and 5; Set C
auucucagugugcugg

SEQ ID NO: 23404 - RNA, 15 nt, Artificial Sequence
  Synthetic Oligonucleotide; PD-L1 exons 4 and 5; Set C
auucucagugugcug

SEQ ID NO: 23405 - RNA, 15 nt, Artificial Sequence
  Synthetic Oligonucleotide; PD-L1 exons 4 and 5; Set C
uguuguguugauucu

SEQ ID NO: 23406 - RNA, 16 nt, Artificial Sequence
  Synthetic Oligonucleotide; PD-L1 exons 4 and 5; Set C
uuguuguguugauucu

SEQ ID NO: 23407 - RNA, 15 nt, Artificial Sequence
  Synthetic Oligonucleotide; PD-L1 exons 4 and 5; Set C
uuguuguguugauuc

SEQ ID NO: 23408 - RNA, 17 nt, Artificial Sequence
  Synthetic Oligonucleotide; PD-L1 exons 4 and 5; Set C
guuguuguguugauucu

SEQ ID NO: 23409 - RNA, 16 nt, Artificial Sequence
  Synthetic Oligonucleotide; PD-L1 exons 4 and 5; Set C
guuguuguguugauuc

SEQ ID NO: 23410 - RNA, 18 nt, Artificial Sequence
  Synthetic Oligonucleotide; PD-L1 exons 4 and 5; Set C
aguuguuguguugauucu

SEQ ID NO: 23411 - RNA, 17 nt, Artificial Sequence
  Synthetic Oligonucleotide; PD-L1 exons 4 and 5; Set C
aguuguuguguugauuc

SEQ ID NO: 23412 - RNA, 19 nt, Artificial Sequence
  Synthetic Oligonucleotide; PD-L1 exons 4 and 5; Set C
uaguuguuguguugauucu

SEQ ID NO: 23413 - RNA, 18 nt, Artificial Sequence
  Synthetic Oligonucleotide; PD-L1 exons 4 and 5; Set C
uaguuguuguguugauuc

SEQ ID NO: 23414 - RNA, 20 nt, Artificial Sequence
  Synthetic Oligonucleotide; PD-L1 exons 4 and 5; Set C
uuaguuguuguguugauucu

SEQ ID NO: 23415 - RNA, 19 nt, Artificial Sequence
  Synthetic Oligonucleotide; PD-L1 exons 4 and 5; Set C
uuaguuguuguguugauuc

SEQ ID NO: 23416 - RNA, 21 nt, Artificial Sequence
  Synthetic Oligonucleotide; PD-L1 exons 4 and 5; Set C
auuaguuguuguguugauucu

SEQ ID NO: 23417 - RNA, 20 nt, Artificial Sequence
  Synthetic Oligonucleotide; PD-L1 exons 4 and 5; Set C
auuaguuguuguguugauuc

SEQ ID NO: 23418 - RNA, 22 nt, Artificial Sequence
  Synthetic Oligonucleotide; PD-L1 exons 4 and 5; Set C
cauuaguuguuguguugauucu

SEQ ID NO: 23419 - RNA, 21 nt, Artificial Sequence
  Synthetic Oligonucleotide; PD-L1 exons 4 and 5; Set C
cauuaguuguuguguugauuc

SEQ ID NO: 23420 - RNA, 23 nt, Artificial Sequence
  Synthetic Oligonucleotide; PD-L1 exons 4 and 5; Set C
ucauuaguuguuguguugauucu

SEQ ID NO: 23421 - RNA, 22 nt, Artificial Sequence
  Synthetic Oligonucleotide; PD-L1 exons 4 and 5; Set C
ucauuaguuguuguguugauuc

SEQ ID NO: 23422 - RNA, 22 nt, Artificial Sequence
  Synthetic Oligonucleotide; PD-L1 exons 4 and 5; Set C
cucauuaguuguuguguugauu

SEQ ID NO: 23423 - RNA, 23 nt, Artificial Sequence
  Synthetic Oligonucleotide; PD-L1 exons 4 and 5; Set C
ucucauuaguuguuguguugauu

SEQ ID NO: 23424 - RNA, 24 nt, Artificial Sequence
  Synthetic Oligonucleotide; PD-L1 exons 4 and 5; Set C
aucucauuaguuguuguguugauu

SEQ ID NO: 23425 - RNA, 26 nt, Artificial Sequence
  Synthetic Oligonucleotide; PD-L1 exons 4 and 5; Set C
aaucucauuaguuguuguguugauuc

SEQ ID NO: 23426 - RNA, 27 nt, Artificial Sequence
  Synthetic Oligonucleotide; PD-L1 exons 4 and 5; Set C
aaaaucucauuaguuguuguguugauu

SEQ ID NO: 23427 - RNA, 33 nt, Artificial Sequence
  Synthetic Oligonucleotide; PD-L1 exons 4 and 5; Set A
guagaaaaucucauuaguuguuguguugauucu

SEQ ID NO: 23428 - RNA, 32 nt, Artificial Sequence
  Synthetic Oligonucleotide; PD-L1 exons 4 and 5; Set C
guagaaaaucucauuaguuguuguguugauuc

SEQ ID NO: 23429 - RNA, 34 nt, Artificial Sequence
  Synthetic Oligonucleotide; PD-L1 exons 4 and 5; Set A
aguagaaaaucucauuaguuguuguguugauucu

SEQ ID NO: 23430 - RNA, 33 nt, Artificial Sequence
  Synthetic Oligonucleotide; PD-L1 exons 4 and 5; Set C
aguagaaaaucucauuaguuguuguguugauuc

SEQ ID NO: 23431 - RNA, 39 nt, Artificial Sequence
  Synthetic Oligonucleotide; PD-L1 exons 4 and 5; Set A
agugcaguagaaaaucucauuaguuguuguguugauucu

SEQ ID NO: 23432 - RNA, 36 nt, Artificial Sequence
  Synthetic Oligonucleotide; PD-L1 exons 4 and 5; Set A
gugcaguagaaaaucucauuaguuguuguguugauu

SEQ ID NO: 23433 - RNA, 38 nt, Artificial Sequence
  Synthetic Oligonucleotide; PD-L1 exons 4 and 5; Set A
agugcaguagaaaaucucauuaguuguuguguugauuc

SEQ ID NO: 23434 - RNA, 15 nt, Artificial Sequence
  Synthetic Oligonucleotide; PD-L1 exons 4 and 5; Set C
gcaguagaaaaucuc

SEQ ID NO: 23435 - RNA, 16 nt, Artificial Sequence
  Synthetic Oligonucleotide; PD-L1 exons 4 and 5; Set C
ugcaguagaaaaucuc

SEQ ID NO: 23436 - RNA, 17 nt, Artificial Sequence
  Synthetic Oligonucleotide; PD-L1 exons 4 and 5; Set C
gugcaguagaaaaucuc

SEQ ID NO: 23437 - RNA, 15 nt, Artificial Sequence
  Synthetic Oligonucleotide; PD-L1 exons 4 and 5; Set C
ugcaguagaaaaucu

SEQ ID NO: 23438 - RNA, 16 nt, Artificial Sequence
  Synthetic Oligonucleotide; PD-L1 exons 4 and 5; Set C
gugcaguagaaaaucu

SEQ ID NO: 23439 - RNA, 15 nt, Artificial Sequence
  Synthetic Oligonucleotide; PD-L1 exons 4 and 5; Set C
gugcaguagaaaauc

SEQ ID NO: 23440 - RNA, 20 nt, Artificial Sequence
  Synthetic Oligonucleotide; PD-L1 exons 4 and 5; Set C
aaagugcaguagaaaaucuc

SEQ ID NO: 23441 - RNA, 19 nt, Artificial Sequence
  Synthetic Oligonucleotide; PD-L1 exons 4 and 5; Set C
aaagugcaguagaaaaucu

SEQ ID NO: 23442 - RNA, 18 nt, Artificial Sequence
  Synthetic Oligonucleotide; PD-L1 exons 4 and 5; Set C
aaagugcaguagaaaauc

SEQ ID NO: 23443 - RNA, 16 nt, Artificial Sequence
  Synthetic Oligonucleotide; PD-L1 exons 4 and 5; Set C
aaagugcaguagaaaa

SEQ ID NO: 23444 - RNA, 15 nt, Artificial Sequence
  Synthetic Oligonucleotide; PD-L1 exons 4 and 5; Set C
aaagugcaguagaaa

SEQ ID NO: 23445 - RNA, 27 nt, Artificial Sequence
  Synthetic Oligonucleotide; PD-L1 exons 4 and 5; Set C
ucuccuaaaagugcaguagaaaaucuc

SEQ ID NO: 23446 - RNA, 28 nt, Artificial Sequence
  Synthetic Oligonucleotide; PD-L1 exons 4 and 5; Set C
aucuccuaaaagugcaguagaaaaucuc

SEQ ID NO: 23447 - RNA, 26 nt, Artificial Sequence
  Synthetic Oligonucleotide; PD-L1 exons 4 and 5; Set C
ucuccuaaaagugcaguagaaaaucu

SEQ ID NO: 23448 - RNA, 29 nt, Artificial Sequence
  Synthetic Oligonucleotide; PD-L1 exons 4 and 5; Set C
aaucuccuaaaagugcaguagaaaaucuc

SEQ ID NO: 23449 - RNA, 27 nt, Artificial Sequence
  Synthetic Oligonucleotide; PD-L1 exons 4 and 5; Set C
aucuccuaaaagugcaguagaaaaucu

SEQ ID NO: 23450 - RNA, 25 nt, Artificial Sequence
  Synthetic Oligonucleotide; PD-L1 exons 4 and 5; Set C
ucuccuaaaagugcaguagaaaauc

SEQ ID NO: 23451 - RNA, 30 nt, Artificial Sequence
  Synthetic Oligonucleotide; PD-L1 exons 4 and 5; Set C
uaaucuccuaaaagugcaguagaaaaucuc

SEQ ID NO: 23452 - RNA, 28 nt, Artificial Sequence
  Synthetic Oligonucleotide; PD-L1 exons 4 and 5; Set C
aaucuccuaaaagugcaguagaaaaucu

SEQ ID NO: 23453 - RNA, 26 nt, Artificial Sequence
  Synthetic Oligonucleotide; PD-L1 exons 4 and 5; Set C
aucuccuaaaagugcaguagaaaauc

SEQ ID NO: 23454 - RNA, 23 nt, Artificial Sequence
  Synthetic Oligonucleotide; PD-L1 exons 4 and 5; Set C
ucuccuaaaagugcaguagaaaa

SEQ ID NO: 23455 - RNA, 31 nt, Artificial Sequence
  Synthetic Oligonucleotide; PD-L1 exons 4 and 5; Set C
cuaaucuccuaaaagugcaguagaaaaucuc

SEQ ID NO: 23456 - RNA, 27 nt, Artificial Sequence
  Synthetic Oligonucleotide; PD-L1 exons 4 and 5; Set C
aaucuccuaaaagugcaguagaaaauc

SEQ ID NO: 23457 - RNA, 22 nt, Artificial Sequence
  Synthetic Oligonucleotide; PD-L1 exons 4 and 5; Set C
ucuccuaaaagugcaguagaaa

SEQ ID NO: 23458 - RNA, 24 nt, Artificial Sequence
  Synthetic Oligonucleotide; PD-L1 exons 4 and 5; Set C
aucuccuaaaagugcaguagaaaa

SEQ ID NO: 23459 - RNA, 32 nt, Artificial Sequence
  Synthetic Oligonucleotide; PD-L1 exons 4 and 5; Set C
ucuaaucuccuaaaagugcaguagaaaaucuc

SEQ ID NO: 23460 - RNA, 30 nt, Artificial Sequence
  Synthetic Oligonucleotide; PD-L1 exons 4 and 5; Set C
cuaaucuccuaaaagugcaguagaaaaucu

SEQ ID NO: 23461 - RNA, 27 nt, Artificial Sequence
  Synthetic Oligonucleotide; PD-L1 exons 4 and 5; Set C
uaaucuccuaaaagugcaguagaaaau

SEQ ID NO: 23462 - RNA, 21 nt, Artificial Sequence
  Synthetic Oligonucleotide; PD-L1 exons 4 and 5; Set C
ucuccuaaaagugcaguagaa

SEQ ID NO: 23463 - RNA, 23 nt, Artificial Sequence
  Synthetic Oligonucleotide; PD-L1 exons 4 and 5; Set C
aucuccuaaaagugcaguagaaa

SEQ ID NO: 23464 - RNA, 31 nt, Artificial Sequence
  Synthetic Oligonucleotide; PD-L1 exons 4 and 5; Set C
ucuaaucuccuaaaagugcaguagaaaaucu

SEQ ID NO: 23465 - RNA, 28 nt, Artificial Sequence
  Synthetic Oligonucleotide; PD-L1 exons 4 and 5; Set C
cuaaucuccuaaaagugcaguagaaaau

SEQ ID NO: 23466 - RNA, 20 nt, Artificial Sequence
  Synthetic Oligonucleotide; PD-L1 exons 4 and 5; Set C
ucuccuaaaagugcaguaga

SEQ ID NO: 23467 - RNA, 22 nt, Artificial Sequence
  Synthetic Oligonucleotide; PD-L1 exons 4 and 5; Set C
aucuccuaaaagugcaguagaa

SEQ ID NO: 23468 - RNA, 24 nt, Artificial Sequence
  Synthetic Oligonucleotide; PD-L1 exons 4 and 5; Set C
aaucuccuaaaagugcaguagaaa

SEQ ID NO: 23469 - RNA, 26 nt, Artificial Sequence
  Synthetic Oligonucleotide; PD-L1 exons 4 and 5; Set C
uaaucuccuaaaagugcaguagaaaa

SEQ ID NO: 23470 - RNA, 30 nt, Artificial Sequence
  Synthetic Oligonucleotide; PD-L1 exons 4 and 5; Set C
ucuaaucuccuaaaagugcaguagaaaauc

SEQ ID NO: 23471 - RNA, 19 nt, Artificial Sequence
  Synthetic Oligonucleotide; PD-L1 exons 4 and 5; Set C
ucuccuaaaagugcaguag

SEQ ID NO: 23472 - RNA, 21 nt, Artificial Sequence
  Synthetic Oligonucleotide; PD-L1 exons 4 and 5; Set C
aucuccuaaaagugcaguaga

SEQ ID NO: 23473 - RNA, 23 nt, Artificial Sequence
  Synthetic Oligonucleotide; PD-L1 exons 4 and 5; Set C
aaucuccuaaaagugcaguagaa

SEQ ID NO: 23474 - RNA, 25 nt, Artificial Sequence
  Synthetic Oligonucleotide; PD-L1 exons 4 and 5; Set C
uaaucuccuaaaagugcaguagaaa

SEQ ID NO: 23475 - RNA, 27 nt, Artificial Sequence
  Synthetic Oligonucleotide; PD-L1 exons 4 and 5; Set C
cuaaucuccuaaaagugcaguagaaaa

SEQ ID NO: 23476 - RNA, 22 nt, Artificial Sequence
  Synthetic Oligonucleotide; PD-L1 exons 4 and 5; Set C
aaucuccuaaaagugcaguaga

SEQ ID NO: 23477 - RNA, 24 nt, Artificial Sequence
  Synthetic Oligonucleotide; PD-L1 exons 4 and 5; Set C
uaaucuccuaaaagugcaguagaa

SEQ ID NO: 23478 - RNA, 26 nt, Artificial Sequence
  Synthetic Oligonucleotide; PD-L1 exons 4 and 5; Set C
cuaaucuccuaaaagugcaguagaaa

SEQ ID NO: 23479 - RNA, 28 nt, Artificial Sequence
  Synthetic Oligonucleotide; PD-L1 exons 4 and 5; Set C
ucuaaucuccuaaaagugcaguagaaaa

SEQ ID NO: 23480 - RNA, 17 nt, Artificial Sequence
  Synthetic Oligonucleotide; PD-L1 exons 4 and 5; Set C
ucuccuaaaagugcagu

SEQ ID NO: 23481 - RNA, 23 nt, Artificial Sequence
  Synthetic Oligonucleotide; PD-L1 exons 4 and 5; Set C
uaaucuccuaaaagugcaguaga

SEQ ID NO: 23482 - RNA, 25 nt, Artificial Sequence
  Synthetic Oligonucleotide; PD-L1 exons 4 and 5; Set C
cuaaucuccuaaaagugcaguagaa

SEQ ID NO: 23483 - RNA, 27 nt, Artificial Sequence
  Synthetic Oligonucleotide; PD-L1 exons 4 and 5; Set C
ucuaaucuccuaaaagugcaguagaaa

SEQ ID NO: 23484 - RNA, 22 nt, Artificial Sequence
  Synthetic Oligonucleotide; PD-L1 exons 4 and 5; Set C
uaaucuccuaaaagugcaguag

SEQ ID NO: 23485 - RNA, 24 nt, Artificial Sequence
  Synthetic Oligonucleotide; PD-L1 exons 4 and 5; Set C
cuaaucuccuaaaagugcaguaga

SEQ ID NO: 23486 - RNA, 26 nt, Artificial Sequence
  Synthetic Oligonucleotide; PD-L1 exons 4 and 5; Set C
ucuaaucuccuaaaagugcaguagaa

SEQ ID NO: 23487 - RNA, 23 nt, Artificial Sequence
  Synthetic Oligonucleotide; PD-L1 exons 4 and 5; Set C
cuaaucuccuaaaagugcaguag

SEQ ID NO: 23488 - RNA, 25 nt, Artificial Sequence
  Synthetic Oligonucleotide; PD-L1 exons 4 and 5; Set C
ucuaaucuccuaaaagugcaguaga

SEQ ID NO: 23489 - RNA, 20 nt, Artificial Sequence
  Synthetic Oligonucleotide; PD-L1 exons 4 and 5; Set C
uaaucuccuaaaagugcagu

SEQ ID NO: 23490 - RNA, 24 nt, Artificial Sequence
  Synthetic Oligonucleotide; PD-L1 exons 4 and 5; Set C
ucuaaucuccuaaaagugcaguag

SEQ ID NO: 23491 - RNA, 21 nt, Artificial Sequence
  Synthetic Oligonucleotide; PD-L1 exons 4 and 5; Set C
cuaaucuccuaaaagugcagu

SEQ ID NO: 23492 - RNA, 22 nt, Artificial Sequence
  Synthetic Oligonucleotide; PD-L1 exons 4 and 5; Set C
aucuaaucuccuaaaagugcag

SEQ ID NO: 23493 - RNA, 15 nt, Artificial Sequence
  Synthetic Oligonucleotide; PD-L1 exons 4 and 5; Set C
uaaucuccuaaaagu

SEQ ID NO: 23494 - RNA, 21 nt, Artificial Sequence
  Synthetic Oligonucleotide; PD-L1 exons 4 and 5; Set C
aucuaaucuccuaaaagugca

SEQ ID NO: 23495 - RNA, 16 nt, Artificial Sequence
  Synthetic Oligonucleotide; PD-L1 exons 4 and 5; Set C
cuaaucuccuaaaagu

SEQ ID NO: 23496 - RNA, 20 nt, Artificial Sequence
  Synthetic Oligonucleotide; PD-L1 exons 4 and 5; Set C
aucuaaucuccuaaaagugc

SEQ ID NO: 23497 - RNA, 17 nt, Artificial Sequence
  Synthetic Oligonucleotide; PD-L1 exons 4 and 5; Set C
ucuaaucuccuaaaagu

SEQ ID NO: 23498 - RNA, 19 nt, Artificial Sequence
  Synthetic Oligonucleotide; PD-L1 exons 4 and 5; Set C
aucuaaucuccuaaaagug

SEQ ID NO: 23499 - RNA, 16 nt, Artificial Sequence
  Synthetic Oligonucleotide; PD-L1 exons 4 and 5; Set C
ucuaaucuccuaaaag

SEQ ID NO: 23500 - RNA, 35 nt, Artificial Sequence
  Synthetic Oligonucleotide; PD-L1 exons 4 and 5; Set B
uuuuccucaggaucuaaucuccuaaaagugcagua

SEQ ID NO: 23501 - RNA, 34 nt, Artificial Sequence
  Synthetic Oligonucleotide; PD-L1 exons 4 and 5; Set B
uuuuccucaggaucuaaucuccuaaaagugcagu

SEQ ID NO: 23502 - RNA, 40 nt, Artificial Sequence
  Synthetic Oligonucleotide; PD-L1 exons 4 and 5; Set C
uaugguuuuccucaggaucuaaucuccuaaaagugcagua

SEQ ID NO: 23503 - RNA, 39 nt, Artificial Sequence
  Synthetic Oligonucleotide; PD-L1 exons 4 and 5; Set C
uaugguuuuccucaggaucuaaucuccuaaaagugcagu

SEQ ID NO: 23504 - RNA, 36 nt, Artificial Sequence
  Synthetic Oligonucleotide; PD-L1 exons 4 and 5; Set B
guaugguuuuccucaggaucuaaucuccuaaaagug

SEQ ID NO: 23505 - RNA, 37 nt, Artificial Sequence
  Synthetic Oligonucleotide; PD-L1 exons 4 and 5; Set B
uguaugguuuuccucaggaucuaaucuccuaaaagug

SEQ ID NO: 23506 - RNA, 38 nt, Artificial Sequence
  Synthetic Oligonucleotide; PD-L1 exons 4 and 5; Set B
cuguaugguuuuccucaggaucuaaucuccuaaaagug

SEQ ID NO: 23507 - RNA, 39 nt, Artificial Sequence
  Synthetic Oligonucleotide; PD-L1 exons 4 and 5; Set B
gcuguaugguuuuccucaggaucuaaucuccuaaaagug

SEQ ID NO: 23508 - RNA, 40 nt, Artificial Sequence
  Synthetic Oligonucleotide; PD-L1 exons 4 and 5; Set B
agcuguaugguuuuccucaggaucuaaucuccuaaaagug

SEQ ID NO: 23509 - RNA, 26 nt, Artificial Sequence
  Synthetic Oligonucleotide; PD-L1 exons 4 and 5; Set B
guaugguuuuccucaggaucuaaucu

SEQ ID NO: 23510 - RNA, 40 nt, Artificial Sequence
  Synthetic Oligonucleotide; PD-L1 exons 4 and 5; Set C
uucagcuguaugguuuuccucaggaucuaaucuccuaaaa

SEQ ID NO: 23511 - RNA, 27 nt, Artificial Sequence
  Synthetic Oligonucleotide; PD-L1 exons 4 and 5; Set B
uguaugguuuuccucaggaucuaaucu

SEQ ID NO: 23512 - RNA, 23 nt, Artificial Sequence
  Synthetic Oligonucleotide; PD-L1 exons 4 and 5; Set C
guaugguuuuccucaggaucuaa

SEQ ID NO: 23513 - RNA, 24 nt, Artificial Sequence
  Synthetic Oligonucleotide; PD-L1 exons 4 and 5; Set C
uguaugguuuuccucaggaucuaa

SEQ ID NO: 23514 - RNA, 22 nt, Artificial Sequence
  Synthetic Oligonucleotide; PD-L1 exons 4 and 5; Set C
guaugguuuuccucaggaucua

SEQ ID NO: 23515 - RNA, 21 nt, Artificial Sequence
  Synthetic Oligonucleotide; PD-L1 exons 4 and 5; Set C
guaugguuuuccucaggaucu

SEQ ID NO: 23516 - RNA, 25 nt, Artificial Sequence
  Synthetic Oligonucleotide; PD-L1 exons 4 and 5; Set B
cuguaugguuuuccucaggaucuaa

SEQ ID NO: 23517 - RNA, 23 nt, Artificial Sequence
  Synthetic Oligonucleotide; PD-L1 exons 4 and 5; Set C
uguaugguuuuccucaggaucua

SEQ ID NO: 23518 - RNA, 22 nt, Artificial Sequence
  Synthetic Oligonucleotide; PD-L1 exons 4 and 5; Set C
uguaugguuuuccucaggaucu

SEQ ID NO: 23519 - RNA, 26 nt, Artificial Sequence
  Synthetic Oligonucleotide; PD-L1 exons 4 and 5; Set B
gcuguaugguuuuccucaggaucuaa

SEQ ID NO: 23520 - RNA, 24 nt, Artificial Sequence
  Synthetic Oligonucleotide; PD-L1 exons 4 and 5; Set B
cuguaugguuuuccucaggaucua

SEQ ID NO: 23521 - RNA, 23 nt, Artificial Sequence
  Synthetic Oligonucleotide; PD-L1 exons 4 and 5; Set B
cuguaugguuuuccucaggaucu

SEQ ID NO: 23522 - RNA, 27 nt, Artificial Sequence
  Synthetic Oligonucleotide; PD-L1 exons 4 and 5; Set B
agcuguaugguuuuccucaggaucuaa

SEQ ID NO: 23523 - RNA, 25 nt, Artificial Sequence
  Synthetic Oligonucleotide; PD-L1 exons 4 and 5; Set B
gcuguaugguuuuccucaggaucua

SEQ ID NO: 23524 - RNA, 24 nt, Artificial Sequence
  Synthetic Oligonucleotide; PD-L1 exons 4 and 5; Set B
gcuguaugguuuuccucaggaucu

SEQ ID NO: 23525 - RNA, 28 nt, Artificial Sequence
  Synthetic Oligonucleotide; PD-L1 exons 4 and 5; Set B
cagcuguaugguuuuccucaggaucuaa

SEQ ID NO: 23526 - RNA, 26 nt, Artificial Sequence
  Synthetic Oligonucleotide; PD-L1 exons 4 and 5; Set B
agcuguaugguuuuccucaggaucua

SEQ ID NO: 23527 - RNA, 25 nt, Artificial Sequence
  Synthetic Oligonucleotide; PD-L1 exons 4 and 5; Set B
agcuguaugguuuuccucaggaucu

SEQ ID NO: 23528 - RNA, 29 nt, Artificial Sequence
  Synthetic Oligonucleotide; PD-L1 exons 4 and 5; Set B
ucagcuguaugguuuuccucaggaucuaa

SEQ ID NO: 23529 - RNA, 27 nt, Artificial Sequence
  Synthetic Oligonucleotide; PD-L1 exons 4 and 5; Set B
cagcuguaugguuuuccucaggaucua

SEQ ID NO: 23530 - RNA, 26 nt, Artificial Sequence
  Synthetic Oligonucleotide; PD-L1 exons 4 and 5; Set B
cagcuguaugguuuuccucaggaucu

SEQ ID NO: 23531 - RNA, 30 nt, Artificial Sequence
  Synthetic Oligonucleotide; PD-L1 exons 4 and 5; Set B
uucagcuguaugguuuuccucaggaucuaa

SEQ ID NO: 23532 - RNA, 28 nt, Artificial Sequence
  Synthetic Oligonucleotide; PD-L1 exons 4 and 5; Set B
ucagcuguaugguuuuccucaggaucua

SEQ ID NO: 23533 - RNA, 27 nt, Artificial Sequence
  Synthetic Oligonucleotide; PD-L1 exons 4 and 5; Set B
ucagcuguaugguuuuccucaggaucu

SEQ ID NO: 23534 - RNA, 29 nt, Artificial Sequence
  Synthetic Oligonucleotide; PD-L1 exons 4 and 5; Set B
uucagcuguaugguuuuccucaggaucua

SEQ ID NO: 23535 - RNA, 28 nt, Artificial Sequence
  Synthetic Oligonucleotide; PD-L1 exons 4 and 5; Set B
uucagcuguaugguuuuccucaggaucu

SEQ ID NO: 23536 - RNA, 30 nt, Artificial Sequence
  Synthetic Oligonucleotide; PD-L1 exons 4 and 5; Set B
auucagcuguaugguuuuccucaggaucua

SEQ ID NO: 23537 - RNA, 15 nt, Artificial Sequence
  Synthetic Oligonucleotide; PD-L1 exons 4 and 5; Set C
agcuguaugguuuuc

SEQ ID NO: 23538 - RNA, 16 nt, Artificial Sequence
  Synthetic Oligonucleotide; PD-L1 exons 4 and 5; Set C
cagcuguaugguuuuc

SEQ ID NO: 23539 - RNA, 17 nt, Artificial Sequence
  Synthetic Oligonucleotide; PD-L1 exons 4 and 5; Set C
ucagcuguaugguuuuc

SEQ ID NO: 23540 - RNA, 18 nt, Artificial Sequence
  Synthetic Oligonucleotide; PD-L1 exons 4 and 5; Set C
uucagcuguaugguuuuc

SEQ ID NO: 23541 - RNA, 19 nt, Artificial Sequence
  Synthetic Oligonucleotide; PD-L1 exons 4 and 5; Set C
auucagcuguaugguuuuc

SEQ ID NO: 23542 - RNA, 17 nt, Artificial Sequence
  Synthetic Oligonucleotide; PD-L1 exons 4 and 5; Set C
ugaccaauucagcugua

SEQ ID NO: 23543 - RNA, 18 nt, Artificial Sequence
  Synthetic Oligonucleotide; PD-L1 exons 4 and 5; Set C
augaccaauucagcugua

SEQ ID NO: 23544 - RNA, 16 nt, Artificial Sequence
  Synthetic Oligonucleotide; PD-L1 exons 4 and 5; Set C
ugaccaauucagcugu

SEQ ID NO: 23545 - RNA, 19 nt, Artificial Sequence
  Synthetic Oligonucleotide; PD-L1 exons 4 and 5; Set C
gaugaccaauucagcugua

SEQ ID NO: 23546 - RNA, 17 nt, Artificial Sequence
  Synthetic Oligonucleotide; PD-L1 exons 4 and 5; Set C
augaccaauucagcugu

SEQ ID NO: 23547 - RNA, 15 nt, Artificial Sequence
  Synthetic Oligonucleotide; PD-L1 exons 4 and 5; Set C
ugaccaauucagcug

SEQ ID NO: 23548 - RNA, 18 nt, Artificial Sequence
  Synthetic Oligonucleotide; PD-L1 exons 4 and 5; Set C
gaugaccaauucagcugu

SEQ ID NO: 23549 - RNA, 16 nt, Artificial Sequence
  Synthetic Oligonucleotide; PD-L1 exons 4 and 5; Set C
augaccaauucagcug

SEQ ID NO: 23550 - RNA, 17 nt, Artificial Sequence
  Synthetic Oligonucleotide; PD-L1 exons 4 and 5; Set C
gaugaccaauucagcug

SEQ ID NO: 23551 - RNA, 23 nt, Artificial Sequence
  Synthetic Oligonucleotide; PD-L1 exons 4 and 5; Set B
uuaccugggaugaccaauucagc

SEQ ID NO: 23552 - RNA, 22 nt, Artificial Sequence
  Synthetic Oligonucleotide; PD-L1 exons 4 and 5; Set C
uuaccugggaugaccaauucag

SEQ ID NO: 23553 - RNA, 21 nt, Artificial Sequence
  Synthetic Oligonucleotide; PD-L1 exons 4 and 5; Set C
uuaccugggaugaccaauuca

SEQ ID NO: 23554 - RNA, 34 nt, Artificial Sequence
  Synthetic Oligonucleotide; PD-L1 exons 4 and 5; Set C
cagaauauuaccugggaugaccaauucagcugua

SEQ ID NO: 23555 - RNA, 20 nt, Artificial Sequence
  Synthetic Oligonucleotide; PD-L1 exons 4 and 5; Set C
uuaccugggaugaccaauuc

SEQ ID NO: 23556 - RNA, 33 nt, Artificial Sequence
  Synthetic Oligonucleotide; PD-L1 exons 4 and 5; Set C
cagaauauuaccugggaugaccaauucagcugu

SEQ ID NO: 23557 - RNA, 19 nt, Artificial Sequence
  Synthetic Oligonucleotide; PD-L1 exons 4 and 5; Set C
uuaccugggaugaccaauu

SEQ ID NO: 23558 - RNA, 36 nt, Artificial Sequence
  Synthetic Oligonucleotide; PD-L1 exons 4 and 5; Set C
uucagaauauuaccugggaugaccaauucagcugua

SEQ ID NO: 23559 - RNA, 32 nt, Artificial Sequence
  Synthetic Oligonucleotide; PD-L1 exons 4 and 5; Set B
cagaauauuaccugggaugaccaauucagcug

SEQ ID NO: 23560 - RNA, 31 nt, Artificial Sequence
  Synthetic Oligonucleotide; PD-L1 exons 4 and 5; Set B
cagaauauuaccugggaugaccaauucagcu

SEQ ID NO: 23561 - RNA, 38 nt, Artificial Sequence
  Synthetic Oligonucleotide; PD-L1 exons 4 and 5; Set C
cauucagaauauuaccugggaugaccaauucagcugua

SEQ ID NO: 23562 - RNA, 30 nt, Artificial Sequence
  Synthetic Oligonucleotide; PD-L1 exons 4 and 5; Set B
cagaauauuaccugggaugaccaauucagc

SEQ ID NO: 23563 - RNA, 39 nt, Artificial Sequence
  Synthetic Oligonucleotide; PD-L1 exons 4 and 5; Set C
acauucagaauauuaccugggaugaccaauucagcugua

SEQ ID NO: 23564 - RNA, 37 nt, Artificial Sequence
  Synthetic Oligonucleotide; PD-L1 exons 4 and 5; Set C
cauucagaauauuaccugggaugaccaauucagcugu

SEQ ID NO: 23565 - RNA, 35 nt, Artificial Sequence
  Synthetic Oligonucleotide; PD-L1 exons 4 and 5; Set B
auucagaauauuaccugggaugaccaauucagcug

SEQ ID NO: 23566 - RNA, 29 nt, Artificial Sequence
  Synthetic Oligonucleotide; PD-L1 exons 4 and 5; Set B
cagaauauuaccugggaugaccaauucag

SEQ ID NO: 23567 - RNA, 40 nt, Artificial Sequence
  Synthetic Oligonucleotide; PD-L1 exons 4 and 5; Set C
cacauucagaauauuaccugggaugaccaauucagcugua

SEQ ID NO: 23568 - RNA, 38 nt, Artificial Sequence
  Synthetic Oligonucleotide; PD-L1 exons 4 and 5; Set C
acauucagaauauuaccugggaugaccaauucagcugu

SEQ ID NO: 23569 - RNA, 34 nt, Artificial Sequence
  Synthetic Oligonucleotide; PD-L1 exons 4 and 5; Set B
auucagaauauuaccugggaugaccaauucagcu

SEQ ID NO: 23570 - RNA, 36 nt, Artificial Sequence
  Synthetic Oligonucleotide; PD-L1 exons 4 and 5; Set C
cauucagaauauuaccugggaugaccaauucagcug

SEQ ID NO: 23571 - RNA, 39 nt, Artificial Sequence
  Synthetic Oligonucleotide; PD-L1 exons 4 and 5; Set C
cacauucagaauauuaccugggaugaccaauucagcugu

SEQ ID NO: 23572 - RNA, 35 nt, Artificial Sequence
  Synthetic Oligonucleotide; PD-L1 exons 4 and 5; Set C
cauucagaauauuaccugggaugaccaauucagcu

SEQ ID NO: 23573 - RNA, 37 nt, Artificial Sequence
  Synthetic Oligonucleotide; PD-L1 exons 4 and 5; Set C
acauucagaauauuaccugggaugaccaauucagcug

SEQ ID NO: 23574 - RNA, 33 nt, Artificial Sequence
  Synthetic Oligonucleotide; PD-L1 exons 4 and 5; Set B
auucagaauauuaccugggaugaccaauucagc

SEQ ID NO: 23575 - RNA, 36 nt, Artificial Sequence
  Synthetic Oligonucleotide; PD-L1 exons 4 and 5; Set C
acauucagaauauuaccugggaugaccaauucagcu

SEQ ID NO: 23576 - RNA, 38 nt, Artificial Sequence
  Synthetic Oligonucleotide; PD-L1 exons 4 and 5; Set C
cacauucagaauauuaccugggaugaccaauucagcug

SEQ ID NO: 23577 - RNA, 34 nt, Artificial Sequence
  Synthetic Oligonucleotide; PD-L1 exons 4 and 5; Set B
cauucagaauauuaccugggaugaccaauucagc

SEQ ID NO: 23578 - RNA, 32 nt, Artificial Sequence
  Synthetic Oligonucleotide; PD-L1 exons 4 and 5; Set B
auucagaauauuaccugggaugaccaauucag

SEQ ID NO: 23579 - RNA, 37 nt, Artificial Sequence
  Synthetic Oligonucleotide; PD-L1 exons 4 and 5; Set C
cacauucagaauauuaccugggaugaccaauucagcu

SEQ ID NO: 23580 - RNA, 35 nt, Artificial Sequence
  Synthetic Oligonucleotide; PD-L1 exons 4 and 5; Set C
acauucagaauauuaccugggaugaccaauucagc

SEQ ID NO: 23581 - RNA, 31 nt, Artificial Sequence
  Synthetic Oligonucleotide; PD-L1 exons 4 and 5; Set B
auucagaauauuaccugggaugaccaauuca

SEQ ID NO: 23582 - RNA, 33 nt, Artificial Sequence
  Synthetic Oligonucleotide; PD-L1 exons 4 and 5; Set B
cauucagaauauuaccugggaugaccaauucag

SEQ ID NO: 23583 - RNA, 38 nt, Artificial Sequence
  Synthetic Oligonucleotide; PD-L1 exons 4 and 5; Set C
acacauucagaauauuaccugggaugaccaauucagcu

SEQ ID NO: 23584 - RNA, 36 nt, Artificial Sequence
  Synthetic Oligonucleotide; PD-L1 exons 4 and 5; Set C
cacauucagaauauuaccugggaugaccaauucagc

SEQ ID NO: 23585 - RNA, 30 nt, Artificial Sequence
  Synthetic Oligonucleotide; PD-L1 exons 4 and 5; Set B
auucagaauauuaccugggaugaccaauuc

SEQ ID NO: 23586 - RNA, 32 nt, Artificial Sequence
  Synthetic Oligonucleotide; PD-L1 exons 4 and 5; Set B
cauucagaauauuaccugggaugaccaauuca

SEQ ID NO: 23587 - RNA, 34 nt, Artificial Sequence
  Synthetic Oligonucleotide; PD-L1 exons 4 and 5; Set B
acauucagaauauuaccugggaugaccaauucag

SEQ ID NO: 23588 - RNA, 39 nt, Artificial Sequence
  Synthetic Oligonucleotide; PD-L1 exons 4 and 5; Set C
gacacauucagaauauuaccugggaugaccaauucagcu

SEQ ID NO: 23589 - RNA, 37 nt, Artificial Sequence
  Synthetic Oligonucleotide; PD-L1 exons 4 and 5; Set C
acacauucagaauauuaccugggaugaccaauucagc

SEQ ID NO: 23590 - RNA, 29 nt, Artificial Sequence
  Synthetic Oligonucleotide; PD-L1 exons 4 and 5; Set B
auucagaauauuaccugggaugaccaauu

SEQ ID NO: 23591 - RNA, 31 nt, Artificial Sequence
  Synthetic Oligonucleotide; PD-L1 exons 4 and 5; Set B
cauucagaauauuaccugggaugaccaauuc

SEQ ID NO: 23592 - RNA, 33 nt, Artificial Sequence
  Synthetic Oligonucleotide; PD-L1 exons 4 and 5; Set B
acauucagaauauuaccugggaugaccaauuca

SEQ ID NO: 23593 - RNA, 35 nt, Artificial Sequence
  Synthetic Oligonucleotide; PD-L1 exons 4 and 5; Set B
cacauucagaauauuaccugggaugaccaauucag

SEQ ID NO: 23594 - RNA, 38 nt, Artificial Sequence
  Synthetic Oligonucleotide; PD-L1 exons 4 and 5; Set C
gacacauucagaauauuaccugggaugaccaauucagc

SEQ ID NO: 23595 - RNA, 30 nt, Artificial Sequence
  Synthetic Oligonucleotide; PD-L1 exons 4 and 5; Set B
cauucagaauauuaccugggaugaccaauu

SEQ ID NO: 23596 - RNA, 32 nt, Artificial Sequence
  Synthetic Oligonucleotide; PD-L1 exons 4 and 5; Set B
acauucagaauauuaccugggaugaccaauuc

SEQ ID NO: 23597 - RNA, 36 nt, Artificial Sequence
  Synthetic Oligonucleotide; PD-L1 exons 4 and 5; Set C
acacauucagaauauuaccugggaugaccaauucag

SEQ ID NO: 23598 - RNA, 34 nt, Artificial Sequence
  Synthetic Oligonucleotide; PD-L1 exons 4 and 5; Set B
cacauucagaauauuaccugggaugaccaauuca

SEQ ID NO: 23599 - RNA, 31 nt, Artificial Sequence
  Synthetic Oligonucleotide; PD-L1 exons 4 and 5; Set B
acauucagaauauuaccugggaugaccaauu

SEQ ID NO: 23600 - RNA, 33 nt, Artificial Sequence
  Synthetic Oligonucleotide; PD-L1 exons 4 and 5; Set B
cacauucagaauauuaccugggaugaccaauuc

SEQ ID NO: 23601 - RNA, 35 nt, Artificial Sequence
  Synthetic Oligonucleotide; PD-L1 exons 4 and 5; Set C
acacauucagaauauuaccugggaugaccaauuca

SEQ ID NO: 23602 - RNA, 37 nt, Artificial Sequence
  Synthetic Oligonucleotide; PD-L1 exons 4 and 5; Set C
gacacauucagaauauuaccugggaugaccaauucag

SEQ ID NO: 23603 - RNA, 32 nt, Artificial Sequence
  Synthetic Oligonucleotide; PD-L1 exons 4 and 5; Set B
cacauucagaauauuaccugggaugaccaauu

SEQ ID NO: 23604 - RNA, 34 nt, Artificial Sequence
  Synthetic Oligonucleotide; PD-L1 exons 4 and 5; Set B
acacauucagaauauuaccugggaugaccaauuc

SEQ ID NO: 23605 - RNA, 36 nt, Artificial Sequence
  Synthetic Oligonucleotide; PD-L1 exons 4 and 5; Set C
gacacauucagaauauuaccugggaugaccaauuca

SEQ ID NO: 23606 - RNA, 33 nt, Artificial Sequence
  Synthetic Oligonucleotide; PD-L1 exons 4 and 5; Set B
acacauucagaauauuaccugggaugaccaauu

SEQ ID NO: 23607 - RNA, 35 nt, Artificial Sequence
  Synthetic Oligonucleotide; PD-L1 exons 4 and 5; Set C
gacacauucagaauauuaccugggaugaccaauuc

SEQ ID NO: 23608 - RNA, 34 nt, Artificial Sequence
  Synthetic Oligonucleotide; PD-L1 exons 4 and 5; Set C
gacacauucagaauauuaccugggaugaccaauu

SEQ ID NO: 23609 - RNA, 33 nt, Artificial Sequence
  Synthetic Oligonucleotide; PD-L1 exons 4 and 5; Set B
uaauggacacauucagaauauuaccugggauga

SEQ ID NO: 23610 - RNA, 34 nt, Artificial Sequence
  Synthetic Oligonucleotide; PD-L1 exons 4 and 5; Set B
uuaauggacacauucagaauauuaccugggauga

SEQ ID NO: 23611 - RNA, 35 nt, Artificial Sequence
  Synthetic Oligonucleotide; PD-L1 exons 4 and 5; Set B
uuuaauggacacauucagaauauuaccugggauga

SEQ ID NO: 23612 - RNA, 36 nt, Artificial Sequence
  Synthetic Oligonucleotide; PD-L1 exons 4 and 5; Set B
uuuuaauggacacauucagaauauuaccugggauga

SEQ ID NO: 23613 - RNA, 34 nt, Artificial Sequence
  Synthetic Oligonucleotide; PD-L1 exons 4 and 5; Set B
uuuaauggacacauucagaauauuaccugggaug

SEQ ID NO: 23614 - RNA, 37 nt, Artificial Sequence
  Synthetic Oligonucleotide; PD-L1 exons 4 and 5; Set B
auuuuaauggacacauucagaauauuaccugggauga

SEQ ID NO: 23615 - RNA, 35 nt, Artificial Sequence
  Synthetic Oligonucleotide; PD-L1 exons 4 and 5; Set B
uuuuaauggacacauucagaauauuaccugggaug

SEQ ID NO: 23616 - RNA, 36 nt, Artificial Sequence
  Synthetic Oligonucleotide; PD-L1 exons 4 and 5; Set B
auuuuaauggacacauucagaauauuaccugggaug

SEQ ID NO: 23617 - RNA, 34 nt, Artificial Sequence
  Synthetic Oligonucleotide; PD-L1 exons 4 and 5; Set B
uuuuaauggacacauucagaauauuaccugggau

SEQ ID NO: 23618 - RNA, 35 nt, Artificial Sequence
  Synthetic Oligonucleotide; PD-L1 exons 4 and 5; Set B
auuuuaauggacacauucagaauauuaccugggau

SEQ ID NO: 23619 - RNA, 20 nt, Artificial Sequence
  Synthetic Oligonucleotide; PD-L1 exons 4 and 5; Set C
uggacacauucagaauauua

SEQ ID NO: 23620 - RNA, 21 nt, Artificial Sequence
  Synthetic Oligonucleotide; PD-L1 exons 4 and 5; Set C
auggacacauucagaauauua

SEQ ID NO: 23621 - RNA, 23 nt, Artificial Sequence
  Synthetic Oligonucleotide; PD-L1 exons 4 and 5; Set C
aauggacacauucagaauauuac

SEQ ID NO: 23622 - RNA, 24 nt, Artificial Sequence
  Synthetic Oligonucleotide; PD-L1 exons 4 and 5; Set C
uaauggacacauucagaauauuac

SEQ ID NO: 23623 - RNA, 29 nt, Artificial Sequence
  Synthetic Oligonucleotide; PD-L1 exons 4 and 5; Set C
uauuuuaauggacacauucagaauauuac

SEQ ID NO: 23624 - RNA, 29 nt, Artificial Sequence
  Synthetic Oligonucleotide; PD-L1 exons 4 and 5; Set C
auauuuuaauggacacauucagaauauua

SEQ ID NO: 23625 - RNA, 37 nt, Artificial Sequence
  Synthetic Oligonucleotide; PD-L1 exons 4 and 5; Set B
guuagacauauuuuaauggacacauucagaauauuac

SEQ ID NO: 23626 - RNA, 22 nt, Artificial Sequence
  Synthetic Oligonucleotide; PD-L1 exons 4 and 5; Set C
auauuuuaauggacacauucag

SEQ ID NO: 23627 - RNA, 20 nt, Artificial Sequence
  Synthetic Oligonucleotide; PD-L1 exons 4 and 5; Set C
uauuuuaauggacacauuca

SEQ ID NO: 23628 - RNA, 38 nt, Artificial Sequence
  Synthetic Oligonucleotide; PD-L1 exons 4 and 5; Set B
uguuagacauauuuuaauggacacauucagaauauuac

SEQ ID NO: 23629 - RNA, 39 nt, Artificial Sequence
  Synthetic Oligonucleotide; PD-L1 exons 4 and 5; Set B
guguuagacauauuuuaauggacacauucagaauauuac

SEQ ID NO: 23630 - RNA, 40 nt, Artificial Sequence
  Synthetic Oligonucleotide; PD-L1 exons 4 and 5; Set B
aguguuagacauauuuuaauggacacauucagaauauuac

SEQ ID NO: 23631 - RNA, 19 nt, Artificial Sequence
  Synthetic Oligonucleotide; PD-L1 exons 4 and 5; Set C
auauuuuaauggacacauu

SEQ ID NO: 23632 - RNA, 18 nt, Artificial Sequence
  Synthetic Oligonucleotide; PD-L1 exons 4 and 5; Set C
auauuuuaauggacacau

SEQ ID NO: 23633 - RNA, 26 nt, Artificial Sequence
  Synthetic Oligonucleotide; PD-L1 exons 4 and 5; Set C
agacauauuuuaauggacacauucag

SEQ ID NO: 23634 - RNA, 17 nt, Artificial Sequence
  Synthetic Oligonucleotide; PD-L1 exons 4 and 5; Set C
auauuuuaauggacaca

SEQ ID NO: 23635 - RNA, 27 nt, Artificial Sequence
  Synthetic Oligonucleotide; PD-L1 exons 4 and 5; Set C
uagacauauuuuaauggacacauucag

SEQ ID NO: 23636 - RNA, 16 nt, Artificial Sequence
  Synthetic Oligonucleotide; PD-L1 exons 4 and 5; Set C
auauuuuaauggacac

SEQ ID NO: 23637 - RNA, 26 nt, Artificial Sequence
  Synthetic Oligonucleotide; PD-L1 exons 4 and 5; Set C
uagacauauuuuaauggacacauuca

SEQ ID NO: 23638 - RNA, 15 nt, Artificial Sequence
  Synthetic Oligonucleotide; PD-L1 exons 4 and 5; Set C
auauuuuaauggaca

SEQ ID NO: 23639 - RNA, 25 nt, Artificial Sequence
  Synthetic Oligonucleotide; PD-L1 exons 4 and 5; Set C
uagacauauuuuaauggacacauuc

SEQ ID NO: 23640 - RNA, 22 nt, Artificial Sequence
  Synthetic Oligonucleotide; PD-L1 exons 4 and 5; Set C
agacauauuuuaauggacacau

SEQ ID NO: 23641 - RNA, 23 nt, Artificial Sequence
  Synthetic Oligonucleotide; PD-L1 exons 4 and 5; Set C
uagacauauuuuaauggacacau

SEQ ID NO: 23642 - RNA, 21 nt, Artificial Sequence
  Synthetic Oligonucleotide; PD-L1 exons 4 and 5; Set C
agacauauuuuaauggacaca

SEQ ID NO: 23643 - RNA, 22 nt, Artificial Sequence
  Synthetic Oligonucleotide; PD-L1 exons 4 and 5; Set C
uagacauauuuuaauggacaca

SEQ ID NO: 23644 - RNA, 20 nt, Artificial Sequence
  Synthetic Oligonucleotide; PD-L1 exons 4 and 5; Set C
agacauauuuuaauggacac

SEQ ID NO: 23645 - RNA, 19 nt, Artificial Sequence
  Synthetic Oligonucleotide; PD-L1 exons 4 and 5; Set C
agacauauuuuaauggaca

SEQ ID NO: 23646 - RNA, 21 nt, Artificial Sequence
  Synthetic Oligonucleotide; PD-L1 exons 4 and 5; Set C
uagacauauuuuaauggacac

SEQ ID NO: 23647 - RNA, 18 nt, Artificial Sequence
  Synthetic Oligonucleotide; PD-L1 exons 4 and 5; Set C
agacauauuuuaauggac

SEQ ID NO: 23648 - RNA, 32 nt, Artificial Sequence
  Synthetic Oligonucleotide; PD-L1 exons 4 and 5; Set B
caguguuagacauauuuuaauggacacauuca

SEQ ID NO: 23649 - RNA, 19 nt, Artificial Sequence
  Synthetic Oligonucleotide; PD-L1 exons 4 and 5; Set C
uagacauauuuuaauggac

SEQ ID NO: 23650 - RNA, 31 nt, Artificial Sequence
  Synthetic Oligonucleotide; PD-L1 exons 4 and 5; Set B
caguguuagacauauuuuaauggacacauuc

SEQ ID NO: 23651 - RNA, 33 nt, Artificial Sequence
  Synthetic Oligonucleotide; PD-L1 exons 4 and 5; Set B
acaguguuagacauauuuuaauggacacauuca

SEQ ID NO: 23652 - RNA, 32 nt, Artificial Sequence
  Synthetic Oligonucleotide; PD-L1 exons 4 and 5; Set B
acaguguuagacauauuuuaauggacacauuc

SEQ ID NO: 23653 - RNA, 34 nt, Artificial Sequence
  Synthetic Oligonucleotide; PD-L1 exons 4 and 5; Set B
gacaguguuagacauauuuuaauggacacauuca

SEQ ID NO: 23654 - RNA, 33 nt, Artificial Sequence
  Synthetic Oligonucleotide; PD-L1 exons 4 and 5; Set B
gacaguguuagacauauuuuaauggacacauuc

SEQ ID NO: 23655 - RNA, 19 nt, Artificial Sequence
  Synthetic Oligonucleotide; PD-L1 exons 4 and 5; Set C
uuagacauauuuuaaugga

SEQ ID NO: 23656 - RNA, 20 nt, Artificial Sequence
  Synthetic Oligonucleotide; PD-L1 exons 4 and 5; Set C
guuagacauauuuuaaugga

SEQ ID NO: 23657 - RNA, 21 nt, Artificial Sequence
  Synthetic Oligonucleotide; PD-L1 exons 4 and 5; Set C
uguuagacauauuuuaaugga

SEQ ID NO: 23658 - RNA, 22 nt, Artificial Sequence
  Synthetic Oligonucleotide; PD-L1 exons 4 and 5; Set C
guguuagacauauuuuaaugga

SEQ ID NO: 23659 - RNA, 23 nt, Artificial Sequence
  Synthetic Oligonucleotide; PD-L1 exons 4 and 5; Set C
aguguuagacauauuuuaaugga

SEQ ID NO: 23660 - RNA, 23 nt, Artificial Sequence
  Synthetic Oligonucleotide; PD-L1 exons 4 and 5; Set C
caguguuagacauauuuuaaugg

SEQ ID NO: 23661 - RNA, 24 nt, Artificial Sequence
  Synthetic Oligonucleotide; PD-L1 exons 4 and 5; Set C
acaguguuagacauauuuuaaugg

SEQ ID NO: 23662 - RNA, 22 nt, Artificial Sequence
  Synthetic Oligonucleotide; PD-L1 exons 4 and 5; Set C
caguguuagacauauuuuaaug

SEQ ID NO: 23663 - RNA, 25 nt, Artificial Sequence
  Synthetic Oligonucleotide; PD-L1 exons 4 and 5; Set C
gacaguguuagacauauuuuaaugg

SEQ ID NO: 23664 - RNA, 23 nt, Artificial Sequence
  Synthetic Oligonucleotide; PD-L1 exons 4 and 5; Set C
acaguguuagacauauuuuaaug

SEQ ID NO: 23665 - RNA, 27 nt, Artificial Sequence
  Synthetic Oligonucleotide; PD-L1 exons 4 and 5; Set C
ggacaguguuagacauauuuuaaugga

SEQ ID NO: 23666 - RNA, 24 nt, Artificial Sequence
  Synthetic Oligonucleotide; PD-L1 exons 4 and 5; Set C
gacaguguuagacauauuuuaaug

SEQ ID NO: 23667 - RNA, 31 nt, Artificial Sequence
  Synthetic Oligonucleotide; PD-L1 exons 4 and 5; Set B
uaggggacaguguuagacauauuuuaaugga

SEQ ID NO: 23668 - RNA, 15 nt, Artificial Sequence
  Synthetic Oligonucleotide; PD-L1 exons 4 and 5; Set C
acaguguuagacaua

SEQ ID NO: 23669 - RNA, 28 nt, Artificial Sequence
  Synthetic Oligonucleotide; PD-L1 exons 4 and 5; Set B
cuaggggacaguguuagacauauuuuaa

SEQ ID NO: 23670 - RNA, 16 nt, Artificial Sequence
  Synthetic Oligonucleotide; PD-L1 exons 4 and 5; Set C
gacaguguuagacaua

SEQ ID NO: 23671 - RNA, 27 nt, Artificial Sequence
  Synthetic Oligonucleotide; PD-L1 exons 4 and 5; Set B
cuaggggacaguguuagacauauuuua

SEQ ID NO: 23672 - RNA, 29 nt, Artificial Sequence
  Synthetic Oligonucleotide; PD-L1 exons 4 and 5; Set B
gcuaggggacaguguuagacauauuuuaa

SEQ ID NO: 23673 - RNA, 26 nt, Artificial Sequence
  Synthetic Oligonucleotide; PD-L1 exons 4 and 5; Set B
cuaggggacaguguuagacauauuuu

SEQ ID NO: 23674 - RNA, 28 nt, Artificial Sequence
  Synthetic Oligonucleotide; PD-L1 exons 4 and 5; Set B
gcuaggggacaguguuagacauauuuua

SEQ ID NO: 23675 - RNA, 16 nt, Artificial Sequence
  Synthetic Oligonucleotide; PD-L1 exons 4 and 5; Set C
ggacaguguuagacau

SEQ ID NO: 23676 - RNA, 25 nt, Artificial Sequence
  Synthetic Oligonucleotide; PD-L1 exons 4 and 5; Set B
cuaggggacaguguuagacauauuu

SEQ ID NO: 23677 - RNA, 27 nt, Artificial Sequence
  Synthetic Oligonucleotide; PD-L1 exons 4 and 5; Set B
gcuaggggacaguguuagacauauuuu

SEQ ID NO: 23678 - RNA, 17 nt, Artificial Sequence
  Synthetic Oligonucleotide; PD-L1 exons 4 and 5; Set C
gggacaguguuagacau

SEQ ID NO: 23679 - RNA, 15 nt, Artificial Sequence
  Synthetic Oligonucleotide; PD-L1 exons 4 and 5; Set C
ggacaguguuagaca

SEQ ID NO: 23680 - RNA, 26 nt, Artificial Sequence
  Synthetic Oligonucleotide; PD-L1 exons 4 and 5; Set B
gcuaggggacaguguuagacauauuu

SEQ ID NO: 23681 - RNA, 24 nt, Artificial Sequence
  Synthetic Oligonucleotide; PD-L1 exons 4 and 5; Set B
cuaggggacaguguuagacauauu

SEQ ID NO: 23682 - RNA, 18 nt, Artificial Sequence
  Synthetic Oligonucleotide; PD-L1 exons 4 and 5; Set C
ggggacaguguuagacau

SEQ ID NO: 23683 - RNA, 16 nt, Artificial Sequence
  Synthetic Oligonucleotide; PD-L1 exons 4 and 5; Set C
gggacaguguuagaca

SEQ ID NO: 23684 - RNA, 25 nt, Artificial Sequence
  Synthetic Oligonucleotide; PD-L1 exons 4 and 5; Set B
gcuaggggacaguguuagacauauu

SEQ ID NO: 23685 - RNA, 19 nt, Artificial Sequence
  Synthetic Oligonucleotide; PD-L1 exons 4 and 5; Set C
aggggacaguguuagacau

SEQ ID NO: 23686 - RNA, 17 nt, Artificial Sequence
  Synthetic Oligonucleotide; PD-L1 exons 4 and 5; Set C
ggggacaguguuagaca

SEQ ID NO: 23687 - RNA, 15 nt, Artificial Sequence
  Synthetic Oligonucleotide; PD-L1 exons 4 and 5; Set C
gggacaguguuagac

SEQ ID NO: 23688 - RNA, 18 nt, Artificial Sequence
  Synthetic Oligonucleotide; PD-L1 exons 4 and 5; Set C
aggggacaguguuagaca

SEQ ID NO: 23689 - RNA, 16 nt, Artificial Sequence
  Synthetic Oligonucleotide; PD-L1 exons 4 and 5; Set C
ggggacaguguuagac

SEQ ID NO: 23690 - RNA, 17 nt, Artificial Sequence
  Synthetic Oligonucleotide; PD-L1 exons 4 and 5; Set C
aggggacaguguuagac

SEQ ID NO: 23691 - RNA, 16 nt, Artificial Sequence
  Synthetic Oligonucleotide; PD-L1 exons 4 and 5; Set C
cuaggggacaguguua

SEQ ID NO: 23692 - RNA, 17 nt, Artificial Sequence
  Synthetic Oligonucleotide; PD-L1 exons 4 and 5; Set C
gcuaggggacaguguua

SEQ ID NO: 23693 - RNA, 15 nt, Artificial Sequence
  Synthetic Oligonucleotide; PD-L1 exons 4 and 5; Set C
cuaggggacaguguu

SEQ ID NO: 23694 - RNA, 16 nt, Artificial Sequence
  Synthetic Oligonucleotide; PD-L1 exons 4 and 5; Set C
gcuaggggacaguguu

SEQ ID NO: 23695 - RNA, 15 nt, Artificial Sequence
  Synthetic Oligonucleotide; PD-L1 exons 4 and 5; Set C
gcuaggggacagugu

SEQ ID NO: 23696 - RNA, 15 nt, Artificial Sequence
  Synthetic Oligonucleotide; PD-L1 exon 6; Set C
aaacaaaacgaaaac

SEQ ID NO: 23697 - RNA, 21 nt, Artificial Sequence
  Synthetic Oligonucleotide; PD-L1 exon 6; Set C
aaaacaaaacaaaacgaaaac

SEQ ID NO: 23698 - RNA, 22 nt, Artificial Sequence
  Synthetic Oligonucleotide; PD-L1 exon 6; Set C
aaaaacaaaacaaaacgaaaac

SEQ ID NO: 23699 - RNA, 15 nt, Artificial Sequence
  Synthetic Oligonucleotide; PD-L1 exon 6; Set C
aagauaaaauuuuga

SEQ ID NO: 23700 - RNA, 15 nt, Artificial Sequence
  Synthetic Oligonucleotide; PD-L1 exon 6; Set C
uaaagauaaaauuuu

SEQ ID NO: 23701 - RNA, 19 nt, Artificial Sequence
  Synthetic Oligonucleotide; PD-L1 exon 6; Set C
acuaaagauaaaauuuuga

SEQ ID NO: 23702 - RNA, 16 nt, Artificial Sequence
  Synthetic Oligonucleotide; PD-L1 exon 6; Set C
cuaaagauaaaauuuu

SEQ ID NO: 23703 - RNA, 18 nt, Artificial Sequence
  Synthetic Oligonucleotide; PD-L1 exon 6; Set C
acuaaagauaaaauuuug

SEQ ID NO: 23704 - RNA, 17 nt, Artificial Sequence
  Synthetic Oligonucleotide; PD-L1 exon 6; Set C
acuaaagauaaaauuuu

SEQ ID NO: 23705 - RNA, 15 nt, Artificial Sequence
  Synthetic Oligonucleotide; PD-L1 exon 6; Set C
cuaaagauaaaauuu

SEQ ID NO: 23706 - RNA, 16 nt, Artificial Sequence
  Synthetic Oligonucleotide; PD-L1 exon 6; Set C
acuaaagauaaaauuu

SEQ ID NO: 23707 - RNA, 26 nt, Artificial Sequence
  Synthetic Oligonucleotide; PD-L1 exon 6; Set C
aacaaacugacuaaagauaaaauuuu

SEQ ID NO: 23708 - RNA, 25 nt, Artificial Sequence
  Synthetic Oligonucleotide; PD-L1 exon 6; Set C
aacaaacugacuaaagauaaaauuu

SEQ ID NO: 23709 - RNA, 27 nt, Artificial Sequence
  Synthetic Oligonucleotide; PD-L1 exon 6; Set C
aaacaaacugacuaaagauaaaauuuu

SEQ ID NO: 23710 - RNA, 28 nt, Artificial Sequence
  Synthetic Oligonucleotide; PD-L1 exon 6; Set C
aaaacaaacugacuaaagauaaaauuuu

SEQ ID NO: 23711 - RNA, 26 nt, Artificial Sequence
  Synthetic Oligonucleotide; PD-L1 exon 6; Set C
aaacaaacugacuaaagauaaaauuu

SEQ ID NO: 23712 - RNA, 32 nt, Artificial Sequence
  Synthetic Oligonucleotide; PD-L1 exon 6; Set C
cgaaaacaaacugacuaaagauaaaauuuuga

SEQ ID NO: 23713 - RNA, 27 nt, Artificial Sequence
  Synthetic Oligonucleotide; PD-L1 exon 6; Set C
aaaacaaacugacuaaagauaaaauuu

SEQ ID NO: 23714 - RNA, 29 nt, Artificial Sequence
  Synthetic Oligonucleotide; PD-L1 exon 6; Set C
gaaaacaaacugacuaaagauaaaauuuu

SEQ ID NO: 23715 - RNA, 31 nt, Artificial Sequence
  Synthetic Oligonucleotide; PD-L1 exon 6; Set C
cgaaaacaaacugacuaaagauaaaauuuug

SEQ ID NO: 23716 - RNA, 28 nt, Artificial Sequence
  Synthetic Oligonucleotide; PD-L1 exon 6; Set C
gaaaacaaacugacuaaagauaaaauuu

SEQ ID NO: 23717 - RNA, 30 nt, Artificial Sequence
  Synthetic Oligonucleotide; PD-L1 exon 6; Set C
cgaaaacaaacugacuaaagauaaaauuuu

SEQ ID NO: 23718 - RNA, 34 nt, Artificial Sequence
  Synthetic Oligonucleotide; PD-L1 exon 6; Set C
aacgaaaacaaacugacuaaagauaaaauuuuga

SEQ ID NO: 23719 - RNA, 29 nt, Artificial Sequence
  Synthetic Oligonucleotide; PD-L1 exon 6; Set C
cgaaaacaaacugacuaaagauaaaauuu

SEQ ID NO: 23720 - RNA, 31 nt, Artificial Sequence
  Synthetic Oligonucleotide; PD-L1 exon 6; Set C
acgaaaacaaacugacuaaagauaaaauuuu

SEQ ID NO: 23721 - RNA, 35 nt, Artificial Sequence
  Synthetic Oligonucleotide; PD-L1 exon 6; Set C
aaacgaaaacaaacugacuaaagauaaaauuuuga

SEQ ID NO: 23722 - RNA, 33 nt, Artificial Sequence
  Synthetic Oligonucleotide; PD-L1 exon 6; Set C
aacgaaaacaaacugacuaaagauaaaauuuug

SEQ ID NO: 23723 - RNA, 32 nt, Artificial Sequence
  Synthetic Oligonucleotide; PD-L1 exon 6; Set C
aacgaaaacaaacugacuaaagauaaaauuuu

SEQ ID NO: 23724 - RNA, 30 nt, Artificial Sequence
  Synthetic Oligonucleotide; PD-L1 exon 6; Set C
acgaaaacaaacugacuaaagauaaaauuu

SEQ ID NO: 23725 - RNA, 36 nt, Artificial Sequence
  Synthetic Oligonucleotide; PD-L1 exon 6; Set C
aaaacgaaaacaaacugacuaaagauaaaauuuuga

SEQ ID NO: 23726 - RNA, 34 nt, Artificial Sequence
  Synthetic Oligonucleotide; PD-L1 exon 6; Set C
aaacgaaaacaaacugacuaaagauaaaauuuug

SEQ ID NO: 23727 - RNA, 33 nt, Artificial Sequence
  Synthetic Oligonucleotide; PD-L1 exon 6; Set C
aaacgaaaacaaacugacuaaagauaaaauuuu

SEQ ID NO: 23728 - RNA, 31 nt, Artificial Sequence
  Synthetic Oligonucleotide; PD-L1 exon 6; Set C
aacgaaaacaaacugacuaaagauaaaauuu

SEQ ID NO: 23729 - RNA, 35 nt, Artificial Sequence
  Synthetic Oligonucleotide; PD-L1 exon 6; Set C
aaaacgaaaacaaacugacuaaagauaaaauuuug

SEQ ID NO: 23730 - RNA, 34 nt, Artificial Sequence
  Synthetic Oligonucleotide; PD-L1 exon 6; Set C
aaaacgaaaacaaacugacuaaagauaaaauuuu

SEQ ID NO: 23731 - RNA, 32 nt, Artificial Sequence
  Synthetic Oligonucleotide; PD-L1 exon 6; Set C
aaacgaaaacaaacugacuaaagauaaaauuu

SEQ ID NO: 23732 - RNA, 33 nt, Artificial Sequence
  Synthetic Oligonucleotide; PD-L1 exon 6; Set C
aaaacgaaaacaaacugacuaaagauaaaauuu

SEQ ID NO: 23733 - RNA, 35 nt, Artificial Sequence
  Synthetic Oligonucleotide; PD-L1 exon 6; Set C
caaaacgaaaacaaacugacuaaagauaaaauuuu

SEQ ID NO: 23734 - RNA, 36 nt, Artificial Sequence
  Synthetic Oligonucleotide; PD-L1 exon 6; Set C
acaaaacgaaaacaaacugacuaaagauaaaauuuu

SEQ ID NO: 23735 - RNA, 34 nt, Artificial Sequence
  Synthetic Oligonucleotide; PD-L1 exon 6; Set C
caaaacgaaaacaaacugacuaaagauaaaauuu

SEQ ID NO: 23736 - RNA, 32 nt, Artificial Sequence
  Synthetic Oligonucleotide; PD-L1 exon 6; Set C
aaaacgaaaacaaacugacuaaagauaaaauu

SEQ ID NO: 23737 - RNA, 35 nt, Artificial Sequence
  Synthetic Oligonucleotide; PD-L1 exon 6; Set C
acaaaacgaaaacaaacugacuaaagauaaaauuu

SEQ ID NO: 23738 - RNA, 15 nt, Artificial Sequence
  Synthetic Oligonucleotide; PD-L1 exon 6; Set C
acaaaacgaaaacaa

SEQ ID NO: 23739 - RNA, 16 nt, Artificial Sequence
  Synthetic Oligonucleotide; PD-L1 exon 6; Set C
aaacaaaacgaaaaca

SEQ ID NO: 23740 - RNA, 20 nt, Artificial Sequence
  Synthetic Oligonucleotide; PD-L1 exon 6; Set C
aaacaaaacaaaacgaaaac

SEQ ID NO: 23741 - RNA, 22 nt, Artificial Sequence
  Synthetic Oligonucleotide; PD-L1 exon 6; Set C
aaaacaaaacaaaacgaaaaca

SEQ ID NO: 23742 - RNA, 19 nt, Artificial Sequence
  Synthetic Oligonucleotide; PD-L1 exon 6; Set C
aaacaaaacaaaacgaaaa

SEQ ID NO: 23743 - RNA, 23 nt, Artificial Sequence
  Synthetic Oligonucleotide; PD-L1 exon 6; Set C
aaaaacaaaacaaaacgaaaaca

SEQ ID NO: 23744 - RNA, 18 nt, Artificial Sequence
  Synthetic Oligonucleotide; PD-L1 exon 6; Set C
aaacaaaacaaaacgaaa

SEQ ID NO: 23745 - RNA, 20 nt, Artificial Sequence
  Synthetic Oligonucleotide; PD-L1 exon 6; Set C
aaaacaaaacaaaacgaaaa

SEQ ID NO: 23746 - RNA, 19 nt, Artificial Sequence
  Synthetic Oligonucleotide; PD-L1 exon 6; Set C
aaaacaaaacaaaacgaaa

SEQ ID NO: 23747 - RNA, 21 nt, Artificial Sequence
  Synthetic Oligonucleotide; PD-L1 exon 6; Set C
aaaaacaaaacaaaacgaaaa

SEQ ID NO: 23748 - RNA, 17 nt, Artificial Sequence
  Synthetic Oligonucleotide; PD-L1 exon 6; Set C
aaacaaaacaaaacgaa

SEQ ID NO: 23749 - RNA, 20 nt, Artificial Sequence
  Synthetic Oligonucleotide; PD-L1 exon 6; Set C
aaaaacaaaacaaaacgaaa

SEQ ID NO: 23750 - RNA, 18 nt, Artificial Sequence
  Synthetic Oligonucleotide; PD-L1 exon 6; Set C
aaaacaaaacaaaacgaa

SEQ ID NO: 23751 - RNA, 16 nt, Artificial Sequence
  Synthetic Oligonucleotide; PD-L1 exon 6; Set C
aaacaaaacaaaacga

SEQ ID NO: 23752 - RNA, 19 nt, Artificial Sequence
  Synthetic Oligonucleotide; PD-L1 exon 6; Set C
aaaaacaaaacaaaacgaa

SEQ ID NO: 23753 - RNA, 17 nt, Artificial Sequence
  Synthetic Oligonucleotide; PD-L1 exon 6; Set C
aaaacaaaacaaaacga

SEQ ID NO: 23754 - RNA, 15 nt, Artificial Sequence
  Synthetic Oligonucleotide; PD-L1 exon 6; Set C
aaacaaaacaaaacg

SEQ ID NO: 23755 - RNA, 18 nt, Artificial Sequence
  Synthetic Oligonucleotide; PD-L1 exon 6; Set C
aaaaacaaaacaaaacga

SEQ ID NO: 23756 - RNA, 16 nt, Artificial Sequence
  Synthetic Oligonucleotide; PD-L1 exon 6; Set C
aaaacaaaacaaaacg

SEQ ID NO: 23757 - RNA, 15 nt, Artificial Sequence
  Synthetic Oligonucleotide; PD-L1 exon 6; Set C
aaaacaaaacaaaac

SEQ ID NO: 23758 - RNA, 17 nt, Artificial Sequence
  Synthetic Oligonucleotide; PD-L1 exon 6; Set C
aaaaacaaaacaaaacg

SEQ ID NO: 23759 - RNA, 16 nt, Artificial Sequence
  Synthetic Oligonucleotide; PD-L1 exon 6; Set C
aaaaacaaaacaaaac

SEQ ID NO: 23760 - RNA, 15 nt, Artificial Sequence
  Synthetic Oligonucleotide; PD-L1 exon 6; Set C
aaaaacaaaacaaaa

SEQ ID NO: 23761 - RNA, 31 nt, Artificial Sequence
  Synthetic Oligonucleotide; PD-L1 exon 6; Set C
guaguucugaaaaacaaaacaaaacgaaaac

SEQ ID NO: 23762 - RNA, 32 nt, Artificial Sequence
  Synthetic Oligonucleotide; PD-L1 exon 6; Set C
gguaguucugaaaaacaaaacaaaacgaaaac

SEQ ID NO: 23763 - RNA, 30 nt, Artificial Sequence
  Synthetic Oligonucleotide; PD-L1 exon 6; Set C
guaguucugaaaaacaaaacaaaacgaaaa

SEQ ID NO: 23764 - RNA, 31 nt, Artificial Sequence
  Synthetic Oligonucleotide; PD-L1 exon 6; Set C
gguaguucugaaaaacaaaacaaaacgaaaa

SEQ ID NO: 23765 - RNA, 33 nt, Artificial Sequence
  Synthetic Oligonucleotide; PD-L1 exon 6; Set A
uuuggaggaugugccagagguaguucugaaaaa

SEQ ID NO: 23766 - RNA, 15 nt, Artificial Sequence
  Synthetic Oligonucleotide; PD-L1 exon 6; Set C
augugccagagguag

SEQ ID NO: 23767 - RNA, 16 nt, Artificial Sequence
  Synthetic Oligonucleotide; PD-L1 exon 6; Set C
gaugugccagagguag

SEQ ID NO: 23768 - RNA, 15 nt, Artificial Sequence
  Synthetic Oligonucleotide; PD-L1 exon 6; Set C
gaugugccagaggua

SEQ ID NO: 23769 - RNA, 20 nt, Artificial Sequence
  Synthetic Oligonucleotide; PD-L1 exon 6; Set A
uggaggaugugccagaggua

SEQ ID NO: 23770 - RNA, 21 nt, Artificial Sequence
  Synthetic Oligonucleotide; PD-L1 exon 6; Set A
uuggaggaugugccagaggua

SEQ ID NO: 23771 - RNA, 19 nt, Artificial Sequence
  Synthetic Oligonucleotide; PD-L1 exon 6; Set A
uggaggaugugccagaggu

SEQ ID NO: 23772 - RNA, 23 nt, Artificial Sequence
  Synthetic Oligonucleotide; PD-L1 exon 6; Set A
uuuggaggaugugccagagguag

SEQ ID NO: 23773 - RNA, 22 nt, Artificial Sequence
  Synthetic Oligonucleotide; PD-L1 exon 6; Set A
uuuggaggaugugccagaggua

SEQ ID NO: 23774 - RNA, 20 nt, Artificial Sequence
  Synthetic Oligonucleotide; PD-L1 exon 6; Set A
uuggaggaugugccagaggu

SEQ ID NO: 23775 - RNA, 24 nt, Artificial Sequence
  Synthetic Oligonucleotide; PD-L1 exon 6; Set A
auuuggaggaugugccagagguag

SEQ ID NO: 23776 - RNA, 23 nt, Artificial Sequence
  Synthetic Oligonucleotide; PD-L1 exon 6; Set A
auuuggaggaugugccagaggua

SEQ ID NO: 23777 - RNA, 21 nt, Artificial Sequence
  Synthetic Oligonucleotide; PD-L1 exon 6; Set A
uuuggaggaugugccagaggu

SEQ ID NO: 23778 - RNA, 25 nt, Artificial Sequence
  Synthetic Oligonucleotide; PD-L1 exon 6; Set A
cauuuggaggaugugccagagguag

SEQ ID NO: 23779 - RNA, 24 nt, Artificial Sequence
  Synthetic Oligonucleotide; PD-L1 exon 6; Set A
cauuuggaggaugugccagaggua

SEQ ID NO: 23780 - RNA, 22 nt, Artificial Sequence
  Synthetic Oligonucleotide; PD-L1 exon 6; Set A
auuuggaggaugugccagaggu

SEQ ID NO: 23781 - RNA, 20 nt, Artificial Sequence
  Synthetic Oligonucleotide; PD-L1 exon 6; Set A
uuuggaggaugugccagagg

SEQ ID NO: 23782 - RNA, 26 nt, Artificial Sequence
  Synthetic Oligonucleotide; PD-L1 exon 6; Set A
ucauuuggaggaugugccagagguag

SEQ ID NO: 23783 - RNA, 25 nt, Artificial Sequence
  Synthetic Oligonucleotide; PD-L1 exon 6; Set A
ucauuuggaggaugugccagaggua

SEQ ID NO: 23784 - RNA, 23 nt, Artificial Sequence
  Synthetic Oligonucleotide; PD-L1 exon 6; Set A
cauuuggaggaugugccagaggu

SEQ ID NO: 23785 - RNA, 21 nt, Artificial Sequence
  Synthetic Oligonucleotide; PD-L1 exon 6; Set A
auuuggaggaugugccagagg

SEQ ID NO: 23786 - RNA, 19 nt, Artificial Sequence
  Synthetic Oligonucleotide; PD-L1 exon 6; Set C
uuuggaggaugugccagag

SEQ ID NO: 23787 - RNA, 27 nt, Artificial Sequence
  Synthetic Oligonucleotide; PD-L1 exon 6; Set A
uucauuuggaggaugugccagagguag

SEQ ID NO: 23788 - RNA, 26 nt, Artificial Sequence
  Synthetic Oligonucleotide; PD-L1 exon 6; Set A
uucauuuggaggaugugccagaggua

SEQ ID NO: 23789 - RNA, 24 nt, Artificial Sequence
  Synthetic Oligonucleotide; PD-L1 exon 6; Set A
ucauuuggaggaugugccagaggu

SEQ ID NO: 23790 - RNA, 22 nt, Artificial Sequence
  Synthetic Oligonucleotide; PD-L1 exon 6; Set A
cauuuggaggaugugccagagg

SEQ ID NO: 23791 - RNA, 20 nt, Artificial Sequence
  Synthetic Oligonucleotide; PD-L1 exon 6; Set C
auuuggaggaugugccagag

SEQ ID NO: 23792 - RNA, 25 nt, Artificial Sequence
  Synthetic Oligonucleotide; PD-L1 exon 6; Set A
uucauuuggaggaugugccagaggu

SEQ ID NO: 23793 - RNA, 23 nt, Artificial Sequence
  Synthetic Oligonucleotide; PD-L1 exon 6; Set A
ucauuuggaggaugugccagagg

SEQ ID NO: 23794 - RNA, 21 nt, Artificial Sequence
  Synthetic Oligonucleotide; PD-L1 exon 6; Set A
cauuuggaggaugugccagag

SEQ ID NO: 23795 - RNA, 24 nt, Artificial Sequence
  Synthetic Oligonucleotide; PD-L1 exon 6; Set A
uucauuuggaggaugugccagagg

SEQ ID NO: 23796 - RNA, 22 nt, Artificial Sequence
  Synthetic Oligonucleotide; PD-L1 exon 6; Set A
ucauuuggaggaugugccagag

SEQ ID NO: 23797 - RNA, 23 nt, Artificial Sequence
  Synthetic Oligonucleotide; PD-L1 exon 6; Set A
uucauuuggaggaugugccagag

SEQ ID NO: 23798 - RNA, 31 nt, Artificial Sequence
  Synthetic Oligonucleotide; PD-L1 exon 6; Set C
guccuuucauuuggaggaugugccagaggua

SEQ ID NO: 23799 - RNA, 30 nt, Artificial Sequence
  Synthetic Oligonucleotide; PD-L1 exon 6; Set C
guccuuucauuuggaggaugugccagaggu

SEQ ID NO: 23800 - RNA, 15 nt, Artificial Sequence
  Synthetic Oligonucleotide; PD-L1 exon 6; Set C
cauuuggaggaugug

SEQ ID NO: 23801 - RNA, 16 nt, Artificial Sequence
  Synthetic Oligonucleotide; PD-L1 exon 6; Set C
ucauuuggaggaugug

SEQ ID NO: 23802 - RNA, 15 nt, Artificial Sequence
  Synthetic Oligonucleotide; PD-L1 exon 6; Set C
ucauuuggaggaugu

SEQ ID NO: 23803 - RNA, 17 nt, Artificial Sequence
  Synthetic Oligonucleotide; PD-L1 exon 6; Set C
uucauuuggaggaugug

SEQ ID NO: 23804 - RNA, 16 nt, Artificial Sequence
  Synthetic Oligonucleotide; PD-L1 exon 6; Set C
uucauuuggaggaugu

SEQ ID NO: 23805 - RNA, 15 nt, Artificial Sequence
  Synthetic Oligonucleotide; PD-L1 exon 6; Set C
uucauuuggaggaug

SEQ ID NO: 23806 - RNA, 22 nt, Artificial Sequence
  Synthetic Oligonucleotide; PD-L1 exon 6; Set C
guccuuucauuuggaggaugug

SEQ ID NO: 23807 - RNA, 21 nt, Artificial Sequence
  Synthetic Oligonucleotide; PD-L1 exon 6; Set C
guccuuucauuuggaggaugu

SEQ ID NO: 23808 - RNA, 20 nt, Artificial Sequence
  Synthetic Oligonucleotide; PD-L1 exon 6; Set C
guccuuucauuuggaggaug

SEQ ID NO: 23809 - RNA, 19 nt, Artificial Sequence
  Synthetic Oligonucleotide; PD-L1 exon 6; Set C
guccuuucauuuggaggau

SEQ ID NO: 23810 - RNA, 28 nt, Artificial Sequence
  Synthetic Oligonucleotide; PD-L1 exon 6; Set A
gucagugcuacaccaaggcauaauaaga

SEQ ID NO: 23811 - RNA, 27 nt, Artificial Sequence
  Synthetic Oligonucleotide; PD-L1 exon 6; Set A
gucagugcuacaccaaggcauaauaag

SEQ ID NO: 23812 - RNA, 29 nt, Artificial Sequence
  Synthetic Oligonucleotide; PD-L1 exon 6; Set A
ugucagugcuacaccaaggcauaauaaga

SEQ ID NO: 23813 - RNA, 26 nt, Artificial Sequence
  Synthetic Oligonucleotide; PD-L1 exon 6; Set A
gucagugcuacaccaaggcauaauaa

SEQ ID NO: 23814 - RNA, 28 nt, Artificial Sequence
  Synthetic Oligonucleotide; PD-L1 exon 6; Set A
ugucagugcuacaccaaggcauaauaag

SEQ ID NO: 23815 - RNA, 30 nt, Artificial Sequence
  Synthetic Oligonucleotide; PD-L1 exon 6; Set A
augucagugcuacaccaaggcauaauaaga

SEQ ID NO: 23816 - RNA, 27 nt, Artificial Sequence
  Synthetic Oligonucleotide; PD-L1 exon 6; Set A
ugucagugcuacaccaaggcauaauaa

SEQ ID NO: 23817 - RNA, 29 nt, Artificial Sequence
  Synthetic Oligonucleotide; PD-L1 exon 6; Set A
augucagugcuacaccaaggcauaauaag

SEQ ID NO: 23818 - RNA, 28 nt, Artificial Sequence
  Synthetic Oligonucleotide; PD-L1 exon 6; Set A
augucagugcuacaccaaggcauaauaa

SEQ ID NO: 23819 - RNA, 29 nt, Artificial Sequence
  Synthetic Oligonucleotide; PD-L1 exon 6; Set A
aaugucagugcuacaccaaggcauaauaa

SEQ ID NO: 23820 - RNA, 33 nt, Artificial Sequence
  Synthetic Oligonucleotide; PD-L1 exon 6; Set A
ugaaugucagugcuacaccaaggcauaauaaga

SEQ ID NO: 23821 - RNA, 30 nt, Artificial Sequence
  Synthetic Oligonucleotide; PD-L1 exon 6; Set A
gaaugucagugcuacaccaaggcauaauaa

SEQ ID NO: 23822 - RNA, 32 nt, Artificial Sequence
  Synthetic Oligonucleotide; PD-L1 exon 6; Set A
ugaaugucagugcuacaccaaggcauaauaag

SEQ ID NO: 23823 - RNA, 31 nt, Artificial Sequence
  Synthetic Oligonucleotide; PD-L1 exon 6; Set A
ugaaugucagugcuacaccaaggcauaauaa

SEQ ID NO: 23824 - RNA, 40 nt, Artificial Sequence
  Synthetic Oligonucleotide; PD-L1 exon 6; Set C
aacggaagaugaaugucagugcuacaccaaggcauaauaa

SEQ ID NO: 23825 - RNA, 15 nt, Artificial Sequence
  Synthetic Oligonucleotide; PD-L1 exon 6; Set C
aaugucagugcuaca

SEQ ID NO: 23826 - RNA, 16 nt, Artificial Sequence
  Synthetic Oligonucleotide; PD-L1 exon 6; Set C
gaaugucagugcuaca

SEQ ID NO: 23827 - RNA, 17 nt, Artificial Sequence
  Synthetic Oligonucleotide; PD-L1 exon 6; Set C
ugaaugucagugcuaca

SEQ ID NO: 23828 - RNA, 15 nt, Artificial Sequence
  Synthetic Oligonucleotide; PD-L1 exon 6; Set C
gaaugucagugcuac

SEQ ID NO: 23829 - RNA, 16 nt, Artificial Sequence
  Synthetic Oligonucleotide; PD-L1 exon 6; Set C
ugaaugucagugcuac

SEQ ID NO: 23830 - RNA, 15 nt, Artificial Sequence
  Synthetic Oligonucleotide; PD-L1 exon 6; Set C
ugaaugucagugcua

SEQ ID NO: 23831 - RNA, 27 nt, Artificial Sequence
  Synthetic Oligonucleotide; PD-L1 exon 6; Set A
aaacggaagaugaaugucagugcuaca

SEQ ID NO: 23832 - RNA, 28 nt, Artificial Sequence
  Synthetic Oligonucleotide; PD-L1 exon 6; Set A
uaaacggaagaugaaugucagugcuaca

SEQ ID NO: 23833 - RNA, 29 nt, Artificial Sequence
  Synthetic Oligonucleotide; PD-L1 exon 6; Set A
uuaaacggaagaugaaugucagugcuaca

SEQ ID NO: 23834 - RNA, 26 nt, Artificial Sequence
  Synthetic Oligonucleotide; PD-L1 exon 6; Set C
uaaacggaagaugaaugucagugcua

SEQ ID NO: 23835 - RNA, 30 nt, Artificial Sequence
  Synthetic Oligonucleotide; PD-L1 exon 6; Set A
cuuaaacggaagaugaaugucagugcuaca

SEQ ID NO: 23836 - RNA, 28 nt, Artificial Sequence
  Synthetic Oligonucleotide; PD-L1 exon 6; Set A
uuaaacggaagaugaaugucagugcuac

SEQ ID NO: 23837 - RNA, 27 nt, Artificial Sequence
  Synthetic Oligonucleotide; PD-L1 exon 6; Set C
uuaaacggaagaugaaugucagugcua

SEQ ID NO: 23838 - RNA, 31 nt, Artificial Sequence
  Synthetic Oligonucleotide; PD-L1 exon 6; Set A
ucuuaaacggaagaugaaugucagugcuaca

SEQ ID NO: 23839 - RNA, 29 nt, Artificial Sequence
  Synthetic Oligonucleotide; PD-L1 exon 6; Set A
cuuaaacggaagaugaaugucagugcuac

SEQ ID NO: 23840 - RNA, 28 nt, Artificial Sequence
  Synthetic Oligonucleotide; PD-L1 exon 6; Set A
cuuaaacggaagaugaaugucagugcua

SEQ ID NO: 23841 - RNA, 32 nt, Artificial Sequence
  Synthetic Oligonucleotide; PD-L1 exon 6; Set A
uucuuaaacggaagaugaaugucagugcuaca

SEQ ID NO: 23842 - RNA, 30 nt, Artificial Sequence
  Synthetic Oligonucleotide; PD-L1 exon 6; Set A
ucuuaaacggaagaugaaugucagugcuac

SEQ ID NO: 23843 - RNA, 29 nt, Artificial Sequence
  Synthetic Oligonucleotide; PD-L1 exon 6; Set A
ucuuaaacggaagaugaaugucagugcua

SEQ ID NO: 23844 - RNA, 31 nt, Artificial Sequence
  Synthetic Oligonucleotide; PD-L1 exon 6; Set A
uucuuaaacggaagaugaaugucagugcuac

SEQ ID NO: 23845 - RNA, 30 nt, Artificial Sequence
  Synthetic Oligonucleotide; PD-L1 exon 6; Set A
uucuuaaacggaagaugaaugucagugcua

SEQ ID NO: 23846 - RNA, 17 nt, Artificial Sequence
  Synthetic Oligonucleotide; PD-L1 exon 6; Set C
aacggaagaugaauguc

SEQ ID NO: 23847 - RNA, 18 nt, Artificial Sequence
  Synthetic Oligonucleotide; PD-L1 exon 6; Set C
aaacggaagaugaauguc

SEQ ID NO: 23848 - RNA, 19 nt, Artificial Sequence
  Synthetic Oligonucleotide; PD-L1 exon 6; Set C
uaaacggaagaugaauguc

SEQ ID NO: 23849 - RNA, 17 nt, Artificial Sequence
  Synthetic Oligonucleotide; PD-L1 exon 6; Set C
aaacggaagaugaaugu

SEQ ID NO: 23850 - RNA, 20 nt, Artificial Sequence
  Synthetic Oligonucleotide; PD-L1 exon 6; Set C
uuaaacggaagaugaauguc

SEQ ID NO: 23851 - RNA, 18 nt, Artificial Sequence
  Synthetic Oligonucleotide; PD-L1 exon 6; Set C
uaaacggaagaugaaugu

SEQ ID NO: 23852 - RNA, 21 nt, Artificial Sequence
  Synthetic Oligonucleotide; PD-L1 exon 6; Set C
cuuaaacggaagaugaauguc

SEQ ID NO: 23853 - RNA, 19 nt, Artificial Sequence
  Synthetic Oligonucleotide; PD-L1 exon 6; Set C
uuaaacggaagaugaaugu

SEQ ID NO: 23854 - RNA, 17 nt, Artificial Sequence
  Synthetic Oligonucleotide; PD-L1 exon 6; Set C
uaaacggaagaugaaug

SEQ ID NO: 23855 - RNA, 22 nt, Artificial Sequence
  Synthetic Oligonucleotide; PD-L1 exon 6; Set C
ucuuaaacggaagaugaauguc

SEQ ID NO: 23856 - RNA, 20 nt, Artificial Sequence
  Synthetic Oligonucleotide; PD-L1 exon 6; Set C
cuuaaacggaagaugaaugu

SEQ ID NO: 23857 - RNA, 18 nt, Artificial Sequence
  Synthetic Oligonucleotide; PD-L1 exon 6; Set C
uuaaacggaagaugaaug

SEQ ID NO: 23858 - RNA, 23 nt, Artificial Sequence
  Synthetic Oligonucleotide; PD-L1 exon 6; Set C
uucuuaaacggaagaugaauguc

SEQ ID NO: 23859 - RNA, 21 nt, Artificial Sequence
  Synthetic Oligonucleotide; PD-L1 exon 6; Set C
ucuuaaacggaagaugaaugu

SEQ ID NO: 23860 - RNA, 19 nt, Artificial Sequence
  Synthetic Oligonucleotide; PD-L1 exon 6; Set C
cuuaaacggaagaugaaug

SEQ ID NO: 23861 - RNA, 22 nt, Artificial Sequence
  Synthetic Oligonucleotide; PD-L1 exon 6; Set C
uucuuaaacggaagaugaaugu

SEQ ID NO: 23862 - RNA, 20 nt, Artificial Sequence
  Synthetic Oligonucleotide; PD-L1 exon 6; Set C
ucuuaaacggaagaugaaug

SEQ ID NO: 23863 - RNA, 21 nt, Artificial Sequence
  Synthetic Oligonucleotide; PD-L1 exon 6; Set C
uucuuaaacggaagaugaaug

SEQ ID NO: 23864 - RNA, 19 nt, Artificial Sequence
  Synthetic Oligonucleotide; PD-L1 exon 6; Set C
ucuuaaacggaagaugaau

SEQ ID NO: 23865 - RNA, 39 nt, Artificial Sequence
  Synthetic Oligonucleotide; PD-L1 exon 6; Set A
uacuaccuuuucuuaaacggaagaugaaugucagugcua

SEQ ID NO: 23866 - RNA, 20 nt, Artificial Sequence
  Synthetic Oligonucleotide; PD-L1 exon 6; Set C
uucuuaaacggaagaugaau

SEQ ID NO: 23867 - RNA, 18 nt, Artificial Sequence
  Synthetic Oligonucleotide; PD-L1 exon 6; Set C
ucuuaaacggaagaugaa

SEQ ID NO: 23868 - RNA, 19 nt, Artificial Sequence
  Synthetic Oligonucleotide; PD-L1 exon 6; Set C
uucuuaaacggaagaugaa

SEQ ID NO: 23869 - RNA, 18 nt, Artificial Sequence
  Synthetic Oligonucleotide; PD-L1 exon 6; Set C
uucuuaaacggaagauga

SEQ ID NO: 23870 - RNA, 30 nt, Artificial Sequence
  Synthetic Oligonucleotide; PD-L1 exon 6; Set C
cuaccuuuucuuaaacggaagaugaauguc

SEQ ID NO: 23871 - RNA, 31 nt, Artificial Sequence
  Synthetic Oligonucleotide; PD-L1 exon 6; Set A
acuaccuuuucuuaaacggaagaugaauguc

SEQ ID NO: 23872 - RNA, 32 nt, Artificial Sequence
  Synthetic Oligonucleotide; PD-L1 exon 6; Set A
uacuaccuuuucuuaaacggaagaugaauguc

SEQ ID NO: 23873 - RNA, 30 nt, Artificial Sequence
  Synthetic Oligonucleotide; PD-L1 exon 6; Set C
acuaccuuuucuuaaacggaagaugaaugu

SEQ ID NO: 23874 - RNA, 33 nt, Artificial Sequence
  Synthetic Oligonucleotide; PD-L1 exon 6; Set A
auacuaccuuuucuuaaacggaagaugaauguc

SEQ ID NO: 23875 - RNA, 31 nt, Artificial Sequence
  Synthetic Oligonucleotide; PD-L1 exon 6; Set A
uacuaccuuuucuuaaacggaagaugaaugu

SEQ ID NO: 23876 - RNA, 34 nt, Artificial Sequence
  Synthetic Oligonucleotide; PD-L1 exon 6; Set A
aauacuaccuuuucuuaaacggaagaugaauguc

SEQ ID NO: 23877 - RNA, 32 nt, Artificial Sequence
  Synthetic Oligonucleotide; PD-L1 exon 6; Set A
auacuaccuuuucuuaaacggaagaugaaugu

SEQ ID NO: 23878 - RNA, 30 nt, Artificial Sequence
  Synthetic Oligonucleotide; PD-L1 exon 6; Set C
uacuaccuuuucuuaaacggaagaugaaug

SEQ ID NO: 23879 - RNA, 18 nt, Artificial Sequence
  Synthetic Oligonucleotide; PD-L1 exon 6; Set C
cuaccuuuucuuaaacgg

SEQ ID NO: 23880 - RNA, 17 nt, Artificial Sequence
  Synthetic Oligonucleotide; PD-L1 exon 6; Set C
cuaccuuuucuuaaacg

SEQ ID NO: 23881 - RNA, 19 nt, Artificial Sequence
  Synthetic Oligonucleotide; PD-L1 exon 6; Set C
acuaccuuuucuuaaacgg

SEQ ID NO: 23882 - RNA, 16 nt, Artificial Sequence
  Synthetic Oligonucleotide; PD-L1 exon 6; Set C
cuaccuuuucuuaaac

SEQ ID NO: 23883 - RNA, 18 nt, Artificial Sequence
  Synthetic Oligonucleotide; PD-L1 exon 6; Set C
acuaccuuuucuuaaacg

SEQ ID NO: 23884 - RNA, 20 nt, Artificial Sequence
  Synthetic Oligonucleotide; PD-L1 exon 6; Set C
uacuaccuuuucuuaaacgg

SEQ ID NO: 23885 - RNA, 15 nt, Artificial Sequence
  Synthetic Oligonucleotide; PD-L1 exon 6; Set C
cuaccuuuucuuaaa

SEQ ID NO: 23886 - RNA, 17 nt, Artificial Sequence
  Synthetic Oligonucleotide; PD-L1 exon 6; Set C
acuaccuuuucuuaaac

SEQ ID NO: 23887 - RNA, 19 nt, Artificial Sequence
  Synthetic Oligonucleotide; PD-L1 exon 6; Set C
uacuaccuuuucuuaaacg

SEQ ID NO: 23888 - RNA, 21 nt, Artificial Sequence
  Synthetic Oligonucleotide; PD-L1 exon 6; Set C
auacuaccuuuucuuaaacgg

SEQ ID NO: 23889 - RNA, 16 nt, Artificial Sequence
  Synthetic Oligonucleotide; PD-L1 exon 6; Set C
acuaccuuuucuuaaa

SEQ ID NO: 23890 - RNA, 18 nt, Artificial Sequence
  Synthetic Oligonucleotide; PD-L1 exon 6; Set C
uacuaccuuuucuuaaac

SEQ ID NO: 23891 - RNA, 20 nt, Artificial Sequence
  Synthetic Oligonucleotide; PD-L1 exon 6; Set C
auacuaccuuuucuuaaacg

SEQ ID NO: 23892 - RNA, 22 nt, Artificial Sequence
  Synthetic Oligonucleotide; PD-L1 exon 6; Set C
aauacuaccuuuucuuaaacgg

SEQ ID NO: 23893 - RNA, 15 nt, Artificial Sequence
  Synthetic Oligonucleotide; PD-L1 exon 6; Set C
acuaccuuuucuuaa

SEQ ID NO: 23894 - RNA, 17 nt, Artificial Sequence
  Synthetic Oligonucleotide; PD-L1 exon 6; Set C
uacuaccuuuucuuaaa

SEQ ID NO: 23895 - RNA, 19 nt, Artificial Sequence
  Synthetic Oligonucleotide; PD-L1 exon 6; Set C
auacuaccuuuucuuaaac

SEQ ID NO: 23896 - RNA, 21 nt, Artificial Sequence
  Synthetic Oligonucleotide; PD-L1 exon 6; Set C
aauacuaccuuuucuuaaacg

SEQ ID NO: 23897 - RNA, 16 nt, Artificial Sequence
  Synthetic Oligonucleotide; PD-L1 exon 6; Set C
uacuaccuuuucuuaa

SEQ ID NO: 23898 - RNA, 18 nt, Artificial Sequence
  Synthetic Oligonucleotide; PD-L1 exon 6; Set C
auacuaccuuuucuuaaa

SEQ ID NO: 23899 - RNA, 20 nt, Artificial Sequence
  Synthetic Oligonucleotide; PD-L1 exon 6; Set C
aauacuaccuuuucuuaaac

SEQ ID NO: 23900 - RNA, 22 nt, Artificial Sequence
  Synthetic Oligonucleotide; PD-L1 exon 6; Set C
aaauacuaccuuuucuuaaacg

SEQ ID NO: 23901 - RNA, 15 nt, Artificial Sequence
  Synthetic Oligonucleotide; PD-L1 exon 6; Set C
uacuaccuuuucuua

SEQ ID NO: 23902 - RNA, 17 nt, Artificial Sequence
  Synthetic Oligonucleotide; PD-L1 exon 6; Set C
auacuaccuuuucuuaa

SEQ ID NO: 23903 - RNA, 19 nt, Artificial Sequence
  Synthetic Oligonucleotide; PD-L1 exon 6; Set C
aauacuaccuuuucuuaaa

SEQ ID NO: 23904 - RNA, 21 nt, Artificial Sequence
  Synthetic Oligonucleotide; PD-L1 exon 6; Set C
aaauacuaccuuuucuuaaac

SEQ ID NO: 23905 - RNA, 16 nt, Artificial Sequence
  Synthetic Oligonucleotide; PD-L1 exon 6; Set C
auacuaccuuuucuua

SEQ ID NO: 23906 - RNA, 18 nt, Artificial Sequence
  Synthetic Oligonucleotide; PD-L1 exon 6; Set C
aauacuaccuuuucuuaa

SEQ ID NO: 23907 - RNA, 20 nt, Artificial Sequence
  Synthetic Oligonucleotide; PD-L1 exon 6; Set C
aaauacuaccuuuucuuaaa

SEQ ID NO: 23908 - RNA, 15 nt, Artificial Sequence
  Synthetic Oligonucleotide; PD-L1 exon 6; Set C
auacuaccuuuucuu

SEQ ID NO: 23909 - RNA, 17 nt, Artificial Sequence
  Synthetic Oligonucleotide; PD-L1 exon 6; Set C
aauacuaccuuuucuua

SEQ ID NO: 23910 - RNA, 19 nt, Artificial Sequence
  Synthetic Oligonucleotide; PD-L1 exon 6; Set C
aaauacuaccuuuucuuaa

SEQ ID NO: 23911 - RNA, 16 nt, Artificial Sequence
  Synthetic Oligonucleotide; PD-L1 exon 6; Set C
aauacuaccuuuucuu

SEQ ID NO: 23912 - RNA, 18 nt, Artificial Sequence
  Synthetic Oligonucleotide; PD-L1 exon 6; Set C
aaauacuaccuuuucuua

SEQ ID NO: 23913 - RNA, 15 nt, Artificial Sequence
  Synthetic Oligonucleotide; PD-L1 exon 6; Set C
aauacuaccuuuucu

SEQ ID NO: 23914 - RNA, 17 nt, Artificial Sequence
  Synthetic Oligonucleotide; PD-L1 exon 6; Set C
aaauacuaccuuuucuu

SEQ ID NO: 23915 - RNA, 16 nt, Artificial Sequence
  Synthetic Oligonucleotide; PD-L1 exon 6; Set C
aaauacuaccuuuucu

SEQ ID NO: 23916 - RNA, 15 nt, Artificial Sequence
  Synthetic Oligonucleotide; PD-L1 exon 6; Set C
aaauacuaccuuuuc

SEQ ID NO: 23917 - RNA, 29 nt, Artificial Sequence
  Synthetic Oligonucleotide; PD-L1 exon 6; Set C
auuaaggaaauacuaccuuuucuuaaacg

SEQ ID NO: 23918 - RNA, 28 nt, Artificial Sequence
  Synthetic Oligonucleotide; PD-L1 exon 6; Set C
auuaaggaaauacuaccuuuucuuaaac

SEQ ID NO: 23919 - RNA, 30 nt, Artificial Sequence
  Synthetic Oligonucleotide; PD-L1 exon 6; Set C
aauuaaggaaauacuaccuuuucuuaaacg

SEQ ID NO: 23920 - RNA, 29 nt, Artificial Sequence
  Synthetic Oligonucleotide; PD-L1 exon 6; Set C
aauuaaggaaauacuaccuuuucuuaaac

SEQ ID NO: 23921 - RNA, 31 nt, Artificial Sequence
  Synthetic Oligonucleotide; PD-L1 exon 6; Set C
caauuaaggaaauacuaccuuuucuuaaacg

SEQ ID NO: 23922 - RNA, 28 nt, Artificial Sequence
  Synthetic Oligonucleotide; PD-L1 exon 6; Set C
aauuaaggaaauacuaccuuuucuuaaa

SEQ ID NO: 23923 - RNA, 30 nt, Artificial Sequence
  Synthetic Oligonucleotide; PD-L1 exon 6; Set C
caauuaaggaaauacuaccuuuucuuaaac

SEQ ID NO: 23924 - RNA, 27 nt, Artificial Sequence
  Synthetic Oligonucleotide; PD-L1 exon 6; Set C
aauuaaggaaauacuaccuuuucuuaa

SEQ ID NO: 23925 - RNA, 29 nt, Artificial Sequence
  Synthetic Oligonucleotide; PD-L1 exon 6; Set C
caauuaaggaaauacuaccuuuucuuaaa

SEQ ID NO: 23926 - RNA, 26 nt, Artificial Sequence
  Synthetic Oligonucleotide; PD-L1 exon 6; Set C
aauuaaggaaauacuaccuuuucuua

SEQ ID NO: 23927 - RNA, 28 nt, Artificial Sequence
  Synthetic Oligonucleotide; PD-L1 exon 6; Set C
caauuaaggaaauacuaccuuuucuuaa

SEQ ID NO: 23928 - RNA, 25 nt, Artificial Sequence
  Synthetic Oligonucleotide; PD-L1 exon 6; Set C
aauuaaggaaauacuaccuuuucuu

SEQ ID NO: 23929 - RNA, 27 nt, Artificial Sequence
  Synthetic Oligonucleotide; PD-L1 exon 6; Set C
caauuaaggaaauacuaccuuuucuua

SEQ ID NO: 23930 - RNA, 24 nt, Artificial Sequence
  Synthetic Oligonucleotide; PD-L1 exon 6; Set C
aauuaaggaaauacuaccuuuucu

SEQ ID NO: 23931 - RNA, 26 nt, Artificial Sequence
  Synthetic Oligonucleotide; PD-L1 exon 6; Set C
caauuaaggaaauacuaccuuuucuu

SEQ ID NO: 23932 - RNA, 23 nt, Artificial Sequence
  Synthetic Oligonucleotide; PD-L1 exon 6; Set C
aauuaaggaaauacuaccuuuuc

SEQ ID NO: 23933 - RNA, 25 nt, Artificial Sequence
  Synthetic Oligonucleotide; PD-L1 exon 6; Set C
caauuaaggaaauacuaccuuuucu

SEQ ID NO: 23934 - RNA, 24 nt, Artificial Sequence
  Synthetic Oligonucleotide; PD-L1 exon 6; Set C
caauuaaggaaauacuaccuuuuc

SEQ ID NO: 23935 - RNA, 15 nt, Artificial Sequence
  Synthetic Oligonucleotide; PD-L1 exon 6; Set C
auuaaggaaauacua

SEQ ID NO: 23936 - RNA, 16 nt, Artificial Sequence
  Synthetic Oligonucleotide; PD-L1 exon 6; Set C
aauuaaggaaauacua

SEQ ID NO: 23937 - RNA, 15 nt, Artificial Sequence
  Synthetic Oligonucleotide; PD-L1 exon 6; Set C
aauuaaggaaauacu

SEQ ID NO: 23938 - RNA, 17 nt, Artificial Sequence
  Synthetic Oligonucleotide; PD-L1 exon 6; Set C
caauuaaggaaauacua

SEQ ID NO: 23939 - RNA, 16 nt, Artificial Sequence
  Synthetic Oligonucleotide; PD-L1 exon 6; Set C
caauuaaggaaauacu

SEQ ID NO: 23940 - RNA, 15 nt, Artificial Sequence
  Synthetic Oligonucleotide; PD-L1 exon 6; Set C
caauuaaggaaauac

SEQ ID NO: 23941 - RNA, 16 nt, Artificial Sequence
  Synthetic Oligonucleotide; PD-L1 exon 6; Set C
aaagauaaaauuuuga

SEQ ID NO: 23942 - RNA, 17 nt, Artificial Sequence
  Synthetic Oligonucleotide; PD-L1 exon 6; Set C
uaaagauaaaauuuuga

SEQ ID NO: 23943 - RNA, 15 nt, Artificial Sequence
  Synthetic Oligonucleotide; PD-L1 exon 6; Set C
aaagauaaaauuuug

SEQ ID NO: 23944 - RNA, 16 nt, Artificial Sequence
  Synthetic Oligonucleotide; PD-L1 exon 6; Set C
uaaagauaaaauuuug

SEQ ID NO: 23945 - RNA, 18 nt, Artificial Sequence
  Synthetic Oligonucleotide; PD-L1 exon 6; Set C
cuaaagauaaaauuuuga

SEQ ID NO: 23946 - RNA, 17 nt, Artificial Sequence
  Synthetic Oligonucleotide; PD-L1 exon 6; Set C
cuaaagauaaaauuuug

SEQ ID NO: 23947 - RNA, 15 nt, Artificial Sequence
  Synthetic Oligonucleotide; PD-L1 exon 6; Set C
acuaaagauaaaauu

SEQ ID NO: 23948 - RNA, 28 nt, Artificial Sequence
  Synthetic Oligonucleotide; PD-L1 exon 6; Set C
aacaaacugacuaaagauaaaauuuuga

SEQ ID NO: 23949 - RNA, 25 nt, Artificial Sequence
  Synthetic Oligonucleotide; PD-L1 exon 6; Set C
acaaacugacuaaagauaaaauuuu

SEQ ID NO: 23950 - RNA, 27 nt, Artificial Sequence
  Synthetic Oligonucleotide; PD-L1 exon 6; Set C
aacaaacugacuaaagauaaaauuuug

SEQ ID NO: 23951 - RNA, 29 nt, Artificial Sequence
  Synthetic Oligonucleotide; PD-L1 exon 6; Set C
aaacaaacugacuaaagauaaaauuuuga

SEQ ID NO: 23952 - RNA, 24 nt, Artificial Sequence
  Synthetic Oligonucleotide; PD-L1 exon 6; Set C
acaaacugacuaaagauaaaauuu

SEQ ID NO: 23953 - RNA, 30 nt, Artificial Sequence
  Synthetic Oligonucleotide; PD-L1 exon 6; Set C
aaaacaaacugacuaaagauaaaauuuuga

SEQ ID NO: 23954 - RNA, 28 nt, Artificial Sequence
  Synthetic Oligonucleotide; PD-L1 exon 6; Set C
aaacaaacugacuaaagauaaaauuuug

SEQ ID NO: 23955 - RNA, 29 nt, Artificial Sequence
  Synthetic Oligonucleotide; PD-L1 exon 6; Set C
aaaacaaacugacuaaagauaaaauuuug

SEQ ID NO: 23956 - RNA, 31 nt, Artificial Sequence
  Synthetic Oligonucleotide; PD-L1 exon 6; Set C
gaaaacaaacugacuaaagauaaaauuuuga

SEQ ID NO: 23957 - RNA, 30 nt, Artificial Sequence
  Synthetic Oligonucleotide; PD-L1 exon 6; Set C
gaaaacaaacugacuaaagauaaaauuuug

SEQ ID NO: 23958 - RNA, 24 nt, Artificial Sequence
  Synthetic Oligonucleotide; PD-L1 exon 6; Set C
aacaaacugacuaaagauaaaauu

SEQ ID NO: 23959 - RNA, 33 nt, Artificial Sequence
  Synthetic Oligonucleotide; PD-L1 exon 6; Set C
acgaaaacaaacugacuaaagauaaaauuuuga

SEQ ID NO: 23960 - RNA, 25 nt, Artificial Sequence
  Synthetic Oligonucleotide; PD-L1 exon 6; Set C
aaacaaacugacuaaagauaaaauu

SEQ ID NO: 23961 - RNA, 23 nt, Artificial Sequence
  Synthetic Oligonucleotide; PD-L1 exon 6; Set C
aacaaacugacuaaagauaaaau

SEQ ID NO: 23962 - RNA, 32 nt, Artificial Sequence
  Synthetic Oligonucleotide; PD-L1 exon 6; Set C
acgaaaacaaacugacuaaagauaaaauuuug

SEQ ID NO: 23963 - RNA, 26 nt, Artificial Sequence
  Synthetic Oligonucleotide; PD-L1 exon 6; Set C
aaaacaaacugacuaaagauaaaauu

SEQ ID NO: 23964 - RNA, 24 nt, Artificial Sequence
  Synthetic Oligonucleotide; PD-L1 exon 6; Set C
aaacaaacugacuaaagauaaaau

SEQ ID NO: 23965 - RNA, 22 nt, Artificial Sequence
  Synthetic Oligonucleotide; PD-L1 exon 6; Set C
aacaaacugacuaaagauaaaa

SEQ ID NO: 23966 - RNA, 27 nt, Artificial Sequence
  Synthetic Oligonucleotide; PD-L1 exon 6; Set C
gaaaacaaacugacuaaagauaaaauu

SEQ ID NO: 23967 - RNA, 25 nt, Artificial Sequence
  Synthetic Oligonucleotide; PD-L1 exon 6; Set C
aaaacaaacugacuaaagauaaaau

SEQ ID NO: 23968 - RNA, 23 nt, Artificial Sequence
  Synthetic Oligonucleotide; PD-L1 exon 6; Set C
aaacaaacugacuaaagauaaaa

SEQ ID NO: 23969 - RNA, 28 nt, Artificial Sequence
  Synthetic Oligonucleotide; PD-L1 exon 6; Set C
cgaaaacaaacugacuaaagauaaaauu

SEQ ID NO: 23970 - RNA, 26 nt, Artificial Sequence
  Synthetic Oligonucleotide; PD-L1 exon 6; Set C
gaaaacaaacugacuaaagauaaaau

SEQ ID NO: 23971 - RNA, 24 nt, Artificial Sequence
  Synthetic Oligonucleotide; PD-L1 exon 6; Set C
aaaacaaacugacuaaagauaaaa

SEQ ID NO: 23972 - RNA, 22 nt, Artificial Sequence
  Synthetic Oligonucleotide; PD-L1 exon 6; Set C
aaacaaacugacuaaagauaaa

SEQ ID NO: 23973 - RNA, 37 nt, Artificial Sequence
  Synthetic Oligonucleotide; PD-L1 exon 6; Set C
caaaacgaaaacaaacugacuaaagauaaaauuuuga

SEQ ID NO: 23974 - RNA, 29 nt, Artificial Sequence
  Synthetic Oligonucleotide; PD-L1 exon 6; Set C
acgaaaacaaacugacuaaagauaaaauu

SEQ ID NO: 23975 - RNA, 27 nt, Artificial Sequence
  Synthetic Oligonucleotide; PD-L1 exon 6; Set C
cgaaaacaaacugacuaaagauaaaau

SEQ ID NO: 23976 - RNA, 25 nt, Artificial Sequence
  Synthetic Oligonucleotide; PD-L1 exon 6; Set C
gaaaacaaacugacuaaagauaaaa

SEQ ID NO: 23977 - RNA, 23 nt, Artificial Sequence
  Synthetic Oligonucleotide; PD-L1 exon 6; Set C
aaaacaaacugacuaaagauaaa

SEQ ID NO: 23978 - RNA, 38 nt, Artificial Sequence
  Synthetic Oligonucleotide; PD-L1 exon 6; Set C
acaaaacgaaaacaaacugacuaaagauaaaauuuuga

SEQ ID NO: 23979 - RNA, 36 nt, Artificial Sequence
  Synthetic Oligonucleotide; PD-L1 exon 6; Set C
caaaacgaaaacaaacugacuaaagauaaaauuuug

SEQ ID NO: 23980 - RNA, 30 nt, Artificial Sequence
  Synthetic Oligonucleotide; PD-L1 exon 6; Set C
aacgaaaacaaacugacuaaagauaaaauu

SEQ ID NO: 23981 - RNA, 28 nt, Artificial Sequence
  Synthetic Oligonucleotide; PD-L1 exon 6; Set C
acgaaaacaaacugacuaaagauaaaau

SEQ ID NO: 23982 - RNA, 26 nt, Artificial Sequence
  Synthetic Oligonucleotide; PD-L1 exon 6; Set C
cgaaaacaaacugacuaaagauaaaa

SEQ ID NO: 23983 - RNA, 22 nt, Artificial Sequence
  Synthetic Oligonucleotide; PD-L1 exon 6; Set C
aaaacaaacugacuaaagauaa

SEQ ID NO: 23984 - RNA, 24 nt, Artificial Sequence
  Synthetic Oligonucleotide; PD-L1 exon 6; Set C
gaaaacaaacugacuaaagauaaa

SEQ ID NO: 23985 - RNA, 37 nt, Artificial Sequence
  Synthetic Oligonucleotide; PD-L1 exon 6; Set C
acaaaacgaaaacaaacugacuaaagauaaaauuuug

SEQ ID NO: 23986 - RNA, 39 nt, Artificial Sequence
  Synthetic Oligonucleotide; PD-L1 exon 6; Set C
aacaaaacgaaaacaaacugacuaaagauaaaauuuuga

SEQ ID NO: 23987 - RNA, 31 nt, Artificial Sequence
  Synthetic Oligonucleotide; PD-L1 exon 6; Set C
aaacgaaaacaaacugacuaaagauaaaauu

SEQ ID NO: 23988 - RNA, 29 nt, Artificial Sequence
  Synthetic Oligonucleotide; PD-L1 exon 6; Set C
aacgaaaacaaacugacuaaagauaaaau

SEQ ID NO: 23989 - RNA, 27 nt, Artificial Sequence
  Synthetic Oligonucleotide; PD-L1 exon 6; Set C
acgaaaacaaacugacuaaagauaaaa

SEQ ID NO: 23990 - RNA, 23 nt, Artificial Sequence
  Synthetic Oligonucleotide; PD-L1 exon 6; Set C
gaaaacaaacugacuaaagauaa

SEQ ID NO: 23991 - RNA, 25 nt, Artificial Sequence
  Synthetic Oligonucleotide; PD-L1 exon 6; Set C
cgaaaacaaacugacuaaagauaaa

SEQ ID NO: 23992 - RNA, 40 nt, Artificial Sequence
  Synthetic Oligonucleotide; PD-L1 exon 6; Set C
aaacaaaacgaaaacaaacugacuaaagauaaaauuuuga

SEQ ID NO: 23993 - RNA, 38 nt, Artificial Sequence
  Synthetic Oligonucleotide; PD-L1 exon 6; Set C
aacaaaacgaaaacaaacugacuaaagauaaaauuuug

SEQ ID NO: 23994 - RNA, 30 nt, Artificial Sequence
  Synthetic Oligonucleotide; PD-L1 exon 6; Set C
aaacgaaaacaaacugacuaaagauaaaau

SEQ ID NO: 23995 - RNA, 28 nt, Artificial Sequence
  Synthetic Oligonucleotide; PD-L1 exon 6; Set C
aacgaaaacaaacugacuaaagauaaaa

SEQ ID NO: 23996 - RNA, 24 nt, Artificial Sequence
  Synthetic Oligonucleotide; PD-L1 exon 6; Set C
cgaaaacaaacugacuaaagauaa

SEQ ID NO: 23997 - RNA, 26 nt, Artificial Sequence
  Synthetic Oligonucleotide; PD-L1 exon 6; Set C
acgaaaacaaacugacuaaagauaaa

SEQ ID NO: 23998 - RNA, 22 nt, Artificial Sequence
  Synthetic Oligonucleotide; PD-L1 exon 6; Set C
gaaaacaaacugacuaaagaua

SEQ ID NO: 23999 - RNA, 37 nt, Artificial Sequence
  Synthetic Oligonucleotide; PD-L1 exon 6; Set C
aacaaaacgaaaacaaacugacuaaagauaaaauuuu

SEQ ID NO: 24000 - RNA, 39 nt, Artificial Sequence
  Synthetic Oligonucleotide; PD-L1 exon 6; Set C
aaacaaaacgaaaacaaacugacuaaagauaaaauuuug

SEQ ID NO: 24001 - RNA, 33 nt, Artificial Sequence
  Synthetic Oligonucleotide; PD-L1 exon 6; Set C
caaaacgaaaacaaacugacuaaagauaaaauu

SEQ ID NO: 24002 - RNA, 31 nt, Artificial Sequence
  Synthetic Oligonucleotide; PD-L1 exon 6; Set C
aaaacgaaaacaaacugacuaaagauaaaau

SEQ ID NO: 24003 - RNA, 29 nt, Artificial Sequence
  Synthetic Oligonucleotide; PD-L1 exon 6; Set C
aaacgaaaacaaacugacuaaagauaaaa

SEQ ID NO: 24004 - RNA, 27 nt, Artificial Sequence
  Synthetic Oligonucleotide; PD-L1 exon 6; Set C
aacgaaaacaaacugacuaaagauaaa

SEQ ID NO: 24005 - RNA, 25 nt, Artificial Sequence
  Synthetic Oligonucleotide; PD-L1 exon 6; Set C
acgaaaacaaacugacuaaagauaa

SEQ ID NO: 24006 - RNA, 23 nt, Artificial Sequence
  Synthetic Oligonucleotide; PD-L1 exon 6; Set C
cgaaaacaaacugacuaaagaua

SEQ ID NO: 24007 - RNA, 38 nt, Artificial Sequence
  Synthetic Oligonucleotide; PD-L1 exon 6; Set C
aaacaaaacgaaaacaaacugacuaaagauaaaauuuu

SEQ ID NO: 24008 - RNA, 36 nt, Artificial Sequence
  Synthetic Oligonucleotide; PD-L1 exon 6; Set C
aacaaaacgaaaacaaacugacuaaagauaaaauuu

SEQ ID NO: 24009 - RNA, 34 nt, Artificial Sequence
  Synthetic Oligonucleotide; PD-L1 exon 6; Set C
acaaaacgaaaacaaacugacuaaagauaaaauu

SEQ ID NO: 24010 - RNA, 32 nt, Artificial Sequence
  Synthetic Oligonucleotide; PD-L1 exon 6; Set C
caaaacgaaaacaaacugacuaaagauaaaau

SEQ ID NO: 24011 - RNA, 30 nt, Artificial Sequence
  Synthetic Oligonucleotide; PD-L1 exon 6; Set C
aaaacgaaaacaaacugacuaaagauaaaa

SEQ ID NO: 24012 - RNA, 28 nt, Artificial Sequence
  Synthetic Oligonucleotide; PD-L1 exon 6; Set C
aaacgaaaacaaacugacuaaagauaaa

SEQ ID NO: 24013 - RNA, 26 nt, Artificial Sequence
  Synthetic Oligonucleotide; PD-L1 exon 6; Set C
aacgaaaacaaacugacuaaagauaa

SEQ ID NO: 24014 - RNA, 24 nt, Artificial Sequence
  Synthetic Oligonucleotide; PD-L1 exon 6; Set C
acgaaaacaaacugacuaaagaua

SEQ ID NO: 24015 - RNA, 22 nt, Artificial Sequence
  Synthetic Oligonucleotide; PD-L1 exon 6; Set C
cgaaaacaaacugacuaaagau

SEQ ID NO: 24016 - RNA, 37 nt, Artificial Sequence
  Synthetic Oligonucleotide; PD-L1 exon 6; Set C
aaacaaaacgaaaacaaacugacuaaagauaaaauuu

SEQ ID NO: 24017 - RNA, 35 nt, Artificial Sequence
  Synthetic Oligonucleotide; PD-L1 exon 6; Set C
aacaaaacgaaaacaaacugacuaaagauaaaauu

SEQ ID NO: 24018 - RNA, 33 nt, Artificial Sequence
  Synthetic Oligonucleotide; PD-L1 exon 6; Set C
acaaaacgaaaacaaacugacuaaagauaaaau

SEQ ID NO: 24019 - RNA, 31 nt, Artificial Sequence
  Synthetic Oligonucleotide; PD-L1 exon 6; Set C
caaaacgaaaacaaacugacuaaagauaaaa

SEQ ID NO: 24020 - RNA, 29 nt, Artificial Sequence
  Synthetic Oligonucleotide; PD-L1 exon 6; Set C
aaaacgaaaacaaacugacuaaagauaaa

SEQ ID NO: 24021 - RNA, 21 nt, Artificial Sequence
  Synthetic Oligonucleotide; PD-L1 exon 6; Set C
cgaaaacaaacugacuaaaga

SEQ ID NO: 24022 - RNA, 27 nt, Artificial Sequence
  Synthetic Oligonucleotide; PD-L1 exon 6; Set C
aaacgaaaacaaacugacuaaagauaa

SEQ ID NO: 24023 - RNA, 25 nt, Artificial Sequence
  Synthetic Oligonucleotide; PD-L1 exon 6; Set C
aacgaaaacaaacugacuaaagaua

SEQ ID NO: 24024 - RNA, 23 nt, Artificial Sequence
  Synthetic Oligonucleotide; PD-L1 exon 6; Set C
acgaaaacaaacugacuaaagau

SEQ ID NO: 24025 - RNA, 36 nt, Artificial Sequence
  Synthetic Oligonucleotide; PD-L1 exon 6; Set C
aaacaaaacgaaaacaaacugacuaaagauaaaauu

SEQ ID NO: 24026 - RNA, 34 nt, Artificial Sequence
  Synthetic Oligonucleotide; PD-L1 exon 6; Set C
aacaaaacgaaaacaaacugacuaaagauaaaau

SEQ ID NO: 24027 - RNA, 32 nt, Artificial Sequence
  Synthetic Oligonucleotide; PD-L1 exon 6; Set C
acaaaacgaaaacaaacugacuaaagauaaaa

SEQ ID NO: 24028 - RNA, 28 nt, Artificial Sequence
  Synthetic Oligonucleotide; PD-L1 exon 6; Set C
aaaacgaaaacaaacugacuaaagauaa

SEQ ID NO: 24029 - RNA, 22 nt, Artificial Sequence
  Synthetic Oligonucleotide; PD-L1 exon 6; Set C
acgaaaacaaacugacuaaaga

SEQ ID NO: 24030 - RNA, 30 nt, Artificial Sequence
  Synthetic Oligonucleotide; PD-L1 exon 6; Set C
caaaacgaaaacaaacugacuaaagauaaa

SEQ ID NO: 24031 - RNA, 26 nt, Artificial Sequence
  Synthetic Oligonucleotide; PD-L1 exon 6; Set C
aaacgaaaacaaacugacuaaagaua

SEQ ID NO: 24032 - RNA, 24 nt, Artificial Sequence
  Synthetic Oligonucleotide; PD-L1 exon 6; Set C
aacgaaaacaaacugacuaaagau

SEQ ID NO: 24033 - RNA, 35 nt, Artificial Sequence
  Synthetic Oligonucleotide; PD-L1 exon 6; Set C
aaacaaaacgaaaacaaacugacuaaagauaaaau

SEQ ID NO: 24034 - RNA, 23 nt, Artificial Sequence
  Synthetic Oligonucleotide; PD-L1 exon 6; Set C
aacgaaaacaaacugacuaaaga

SEQ ID NO: 24035 - RNA, 31 nt, Artificial Sequence
  Synthetic Oligonucleotide; PD-L1 exon 6; Set C
acaaaacgaaaacaaacugacuaaagauaaa

SEQ ID NO: 24036 - RNA, 29 nt, Artificial Sequence
  Synthetic Oligonucleotide; PD-L1 exon 6; Set C
caaaacgaaaacaaacugacuaaagauaa

SEQ ID NO: 24037 - RNA, 27 nt, Artificial Sequence
  Synthetic Oligonucleotide; PD-L1 exon 6; Set C
aaaacgaaaacaaacugacuaaagaua

SEQ ID NO: 24038 - RNA, 25 nt, Artificial Sequence
  Synthetic Oligonucleotide; PD-L1 exon 6; Set C
aaacgaaaacaaacugacuaaagau

SEQ ID NO: 24039 - RNA, 34 nt, Artificial Sequence
  Synthetic Oligonucleotide; PD-L1 exon 6; Set C
aaacaaaacgaaaacaaacugacuaaagauaaaa

SEQ ID NO: 24040 - RNA, 22 nt, Artificial Sequence
  Synthetic Oligonucleotide; PD-L1 exon 6; Set C
aacgaaaacaaacugacuaaag

SEQ ID NO: 24041 - RNA, 24 nt, Artificial Sequence
  Synthetic Oligonucleotide; PD-L1 exon 6; Set C
aaacgaaaacaaacugacuaaaga

SEQ ID NO: 24042 - RNA, 30 nt, Artificial Sequence
  Synthetic Oligonucleotide; PD-L1 exon 6; Set C
acaaaacgaaaacaaacugacuaaagauaa

SEQ ID NO: 24043 - RNA, 28 nt, Artificial Sequence
  Synthetic Oligonucleotide; PD-L1 exon 6; Set C
caaaacgaaaacaaacugacuaaagaua

SEQ ID NO: 24044 - RNA, 26 nt, Artificial Sequence
  Synthetic Oligonucleotide; PD-L1 exon 6; Set C
aaaacgaaaacaaacugacuaaagau

SEQ ID NO: 24045 - RNA, 23 nt, Artificial Sequence
  Synthetic Oligonucleotide; PD-L1 exon 6; Set C
aaacgaaaacaaacugacuaaag

SEQ ID NO: 24046 - RNA, 25 nt, Artificial Sequence
  Synthetic Oligonucleotide; PD-L1 exon 6; Set C
aaaacgaaaacaaacugacuaaaga

SEQ ID NO: 24047 - RNA, 29 nt, Artificial Sequence
  Synthetic Oligonucleotide; PD-L1 exon 6; Set C
acaaaacgaaaacaaacugacuaaagaua

SEQ ID NO: 24048 - RNA, 24 nt, Artificial Sequence
  Synthetic Oligonucleotide; PD-L1 exon 6; Set C
aaaacgaaaacaaacugacuaaag

SEQ ID NO: 24049 - RNA, 26 nt, Artificial Sequence
  Synthetic Oligonucleotide; PD-L1 exon 6; Set C
caaaacgaaaacaaacugacuaaaga

SEQ ID NO: 24050 - RNA, 28 nt, Artificial Sequence
  Synthetic Oligonucleotide; PD-L1 exon 6; Set C
acaaaacgaaaacaaacugacuaaagau

SEQ ID NO: 24051 - RNA, 27 nt, Artificial Sequence
  Synthetic Oligonucleotide; PD-L1 exon 6; Set C
acaaaacgaaaacaaacugacuaaaga

SEQ ID NO: 24052 - RNA, 40 nt, Artificial Sequence
  Synthetic Oligonucleotide; PD-L1 exon 6; Set C
aaacaaaacaaaacgaaaacaaacugacuaaagauaaaau

SEQ ID NO: 24053 - RNA, 26 nt, Artificial Sequence
  Synthetic Oligonucleotide; PD-L1 exon 6; Set C
acaaaacgaaaacaaacugacuaaag

SEQ ID NO: 24054 - RNA, 39 nt, Artificial Sequence
  Synthetic Oligonucleotide; PD-L1 exon 6; Set C
aaacaaaacaaaacgaaaacaaacugacuaaagauaaaa

SEQ ID NO: 24055 - RNA, 40 nt, Artificial Sequence
  Synthetic Oligonucleotide; PD-L1 exon 6; Set C
aaaacaaaacaaaacgaaaacaaacugacuaaagauaaaa

SEQ ID NO: 24056 - RNA, 38 nt, Artificial Sequence
  Synthetic Oligonucleotide; PD-L1 exon 6; Set C
aaacaaaacaaaacgaaaacaaacugacuaaagauaaa

SEQ ID NO: 24057 - RNA, 37 nt, Artificial Sequence
  Synthetic Oligonucleotide; PD-L1 exon 6; Set C
aaacaaaacaaaacgaaaacaaacugacuaaagauaa

SEQ ID NO: 24058 - RNA, 39 nt, Artificial Sequence
  Synthetic Oligonucleotide; PD-L1 exon 6; Set C
aaaacaaaacaaaacgaaaacaaacugacuaaagauaaa

SEQ ID NO: 24059 - RNA, 38 nt, Artificial Sequence
  Synthetic Oligonucleotide; PD-L1 exon 6; Set C
aaaacaaaacaaaacgaaaacaaacugacuaaagauaa

SEQ ID NO: 24060 - RNA, 40 nt, Artificial Sequence
  Synthetic Oligonucleotide; PD-L1 exon 6; Set C
aaaaacaaaacaaaacgaaaacaaacugacuaaagauaaa

SEQ ID NO: 24061 - RNA, 36 nt, Artificial Sequence
  Synthetic Oligonucleotide; PD-L1 exon 6; Set C
aaacaaaacaaaacgaaaacaaacugacuaaagaua

SEQ ID NO: 24062 - RNA, 39 nt, Artificial Sequence
  Synthetic Oligonucleotide; PD-L1 exon 6; Set C
aaaaacaaaacaaaacgaaaacaaacugacuaaagauaa

SEQ ID NO: 24063 - RNA, 37 nt, Artificial Sequence
  Synthetic Oligonucleotide; PD-L1 exon 6; Set C
aaaacaaaacaaaacgaaaacaaacugacuaaagaua

SEQ ID NO: 24064 - RNA, 35 nt, Artificial Sequence
  Synthetic Oligonucleotide; PD-L1 exon 6; Set C
aaacaaaacaaaacgaaaacaaacugacuaaagau

SEQ ID NO: 24065 - RNA, 34 nt, Artificial Sequence
  Synthetic Oligonucleotide; PD-L1 exon 6; Set C
aaacaaaacaaaacgaaaacaaacugacuaaaga

SEQ ID NO: 24066 - RNA, 38 nt, Artificial Sequence
  Synthetic Oligonucleotide; PD-L1 exon 6; Set C
aaaaacaaaacaaaacgaaaacaaacugacuaaagaua

SEQ ID NO: 24067 - RNA, 36 nt, Artificial Sequence
  Synthetic Oligonucleotide; PD-L1 exon 6; Set C
aaaacaaaacaaaacgaaaacaaacugacuaaagau

SEQ ID NO: 24068 - RNA, 33 nt, Artificial Sequence
  Synthetic Oligonucleotide; PD-L1 exon 6; Set C
aaacaaaacaaaacgaaaacaaacugacuaaag

SEQ ID NO: 24069 - RNA, 35 nt, Artificial Sequence
  Synthetic Oligonucleotide; PD-L1 exon 6; Set C
aaaacaaaacaaaacgaaaacaaacugacuaaaga

SEQ ID NO: 24070 - RNA, 37 nt, Artificial Sequence
  Synthetic Oligonucleotide; PD-L1 exon 6; Set C
aaaaacaaaacaaaacgaaaacaaacugacuaaagau

SEQ ID NO: 24071 - RNA, 34 nt, Artificial Sequence
  Synthetic Oligonucleotide; PD-L1 exon 6; Set C
aaaacaaaacaaaacgaaaacaaacugacuaaag

SEQ ID NO: 24072 - RNA, 36 nt, Artificial Sequence
  Synthetic Oligonucleotide; PD-L1 exon 6; Set C
aaaaacaaaacaaaacgaaaacaaacugacuaaaga

SEQ ID NO: 24073 - RNA, 35 nt, Artificial Sequence
  Synthetic Oligonucleotide; PD-L1 exon 6; Set C
aaaaacaaaacaaaacgaaaacaaacugacuaaag

SEQ ID NO: 24074 - RNA, 30 nt, Artificial Sequence
  Synthetic Oligonucleotide; PD-L1 exon 6; Set C
aaaacaaaacaaaacgaaaacaaacugacu

SEQ ID NO: 24075 - RNA, 16 nt, Artificial Sequence
  Synthetic Oligonucleotide; PD-L1 exon 6; Set C
aacaaaacgaaaacaa

SEQ ID NO: 24076 - RNA, 31 nt, Artificial Sequence
  Synthetic Oligonucleotide; PD-L1 exon 6; Set C
aaaaacaaaacaaaacgaaaacaaacugacu

SEQ ID NO: 24077 - RNA, 15 nt, Artificial Sequence
  Synthetic Oligonucleotide; PD-L1 exon 6; Set C
aacaaaacgaaaaca

SEQ ID NO: 24078 - RNA, 17 nt, Artificial Sequence
  Synthetic Oligonucleotide; PD-L1 exon 6; Set C
aaacaaaacgaaaacaa

SEQ ID NO: 24079 - RNA, 22 nt, Artificial Sequence
  Synthetic Oligonucleotide; PD-L1 exon 6; Set C
aaacaaaacaaaacgaaaacaa

SEQ ID NO: 24080 - RNA, 21 nt, Artificial Sequence
  Synthetic Oligonucleotide; PD-L1 exon 6; Set C
aaacaaaacaaaacgaaaaca

SEQ ID NO: 24081 - RNA, 23 nt, Artificial Sequence
  Synthetic Oligonucleotide; PD-L1 exon 6; Set C
aaaacaaaacaaaacgaaaacaa

SEQ ID NO: 24082 - RNA, 24 nt, Artificial Sequence
  Synthetic Oligonucleotide; PD-L1 exon 6; Set C
aaaaacaaaacaaaacgaaaacaa

SEQ ID NO: 24083 - RNA, 33 nt, Artificial Sequence
  Synthetic Oligonucleotide; PD-L1 exon 6; Set C
guaguucugaaaaacaaaacaaaacgaaaacaa

SEQ ID NO: 24084 - RNA, 30 nt, Artificial Sequence
  Synthetic Oligonucleotide; PD-L1 exon 6; Set C
uaguucugaaaaacaaaacaaaacgaaaac

SEQ ID NO: 24085 - RNA, 32 nt, Artificial Sequence
  Synthetic Oligonucleotide; PD-L1 exon 6; Set C
guaguucugaaaaacaaaacaaaacgaaaaca

SEQ ID NO: 24086 - RNA, 34 nt, Artificial Sequence
  Synthetic Oligonucleotide; PD-L1 exon 6; Set C
gguaguucugaaaaacaaaacaaaacgaaaacaa

SEQ ID NO: 24087 - RNA, 29 nt, Artificial Sequence
  Synthetic Oligonucleotide; PD-L1 exon 6; Set C
uaguucugaaaaacaaaacaaaacgaaaa

SEQ ID NO: 24088 - RNA, 33 nt, Artificial Sequence
  Synthetic Oligonucleotide; PD-L1 exon 6; Set C
gguaguucugaaaaacaaaacaaaacgaaaaca

SEQ ID NO: 24089 - RNA, 28 nt, Artificial Sequence
  Synthetic Oligonucleotide; PD-L1 exon 6; Set C
uaguucugaaaaacaaaacaaaacgaaa

SEQ ID NO: 24090 - RNA, 33 nt, Artificial Sequence
  Synthetic Oligonucleotide; PD-L1 exon 6; Set C
agguaguucugaaaaacaaaacaaaacgaaaac

SEQ ID NO: 24091 - RNA, 29 nt, Artificial Sequence
  Synthetic Oligonucleotide; PD-L1 exon 6; Set C
guaguucugaaaaacaaaacaaaacgaaa

SEQ ID NO: 24092 - RNA, 27 nt, Artificial Sequence
  Synthetic Oligonucleotide; PD-L1 exon 6; Set C
uaguucugaaaaacaaaacaaaacgaa

SEQ ID NO: 24093 - RNA, 34 nt, Artificial Sequence
  Synthetic Oligonucleotide; PD-L1 exon 6; Set C
gagguaguucugaaaaacaaaacaaaacgaaaac

SEQ ID NO: 24094 - RNA, 30 nt, Artificial Sequence
  Synthetic Oligonucleotide; PD-L1 exon 6; Set C
gguaguucugaaaaacaaaacaaaacgaaa

SEQ ID NO: 24095 - RNA, 32 nt, Artificial Sequence
  Synthetic Oligonucleotide; PD-L1 exon 6; Set C
agguaguucugaaaaacaaaacaaaacgaaaa

SEQ ID NO: 24096 - RNA, 28 nt, Artificial Sequence
  Synthetic Oligonucleotide; PD-L1 exon 6; Set C
guaguucugaaaaacaaaacaaaacgaa

SEQ ID NO: 24097 - RNA, 26 nt, Artificial Sequence
  Synthetic Oligonucleotide; PD-L1 exon 6; Set C
uaguucugaaaaacaaaacaaaacga

SEQ ID NO: 24098 - RNA, 31 nt, Artificial Sequence
  Synthetic Oligonucleotide; PD-L1 exon 6; Set C
agguaguucugaaaaacaaaacaaaacgaaa

SEQ ID NO: 24099 - RNA, 33 nt, Artificial Sequence
  Synthetic Oligonucleotide; PD-L1 exon 6; Set C
gagguaguucugaaaaacaaaacaaaacgaaaa

SEQ ID NO: 24100 - RNA, 29 nt, Artificial Sequence
  Synthetic Oligonucleotide; PD-L1 exon 6; Set C
gguaguucugaaaaacaaaacaaaacgaa

SEQ ID NO: 24101 - RNA, 27 nt, Artificial Sequence
  Synthetic Oligonucleotide; PD-L1 exon 6; Set C
guaguucugaaaaacaaaacaaaacga

SEQ ID NO: 24102 - RNA, 25 nt, Artificial Sequence
  Synthetic Oligonucleotide; PD-L1 exon 6; Set C
uaguucugaaaaacaaaacaaaacg

SEQ ID NO: 24103 - RNA, 32 nt, Artificial Sequence
  Synthetic Oligonucleotide; PD-L1 exon 6; Set C
gagguaguucugaaaaacaaaacaaaacgaaa

SEQ ID NO: 24104 - RNA, 30 nt, Artificial Sequence
  Synthetic Oligonucleotide; PD-L1 exon 6; Set C
agguaguucugaaaaacaaaacaaaacgaa

SEQ ID NO: 24105 - RNA, 28 nt, Artificial Sequence
  Synthetic Oligonucleotide; PD-L1 exon 6; Set C
gguaguucugaaaaacaaaacaaaacga

SEQ ID NO: 24106 - RNA, 26 nt, Artificial Sequence
  Synthetic Oligonucleotide; PD-L1 exon 6; Set C
guaguucugaaaaacaaaacaaaacg

SEQ ID NO: 24107 - RNA, 31 nt, Artificial Sequence
  Synthetic Oligonucleotide; PD-L1 exon 6; Set C
gagguaguucugaaaaacaaaacaaaacgaa

SEQ ID NO: 24108 - RNA, 29 nt, Artificial Sequence
  Synthetic Oligonucleotide; PD-L1 exon 6; Set C
agguaguucugaaaaacaaaacaaaacga

SEQ ID NO: 24109 - RNA, 25 nt, Artificial Sequence
  Synthetic Oligonucleotide; PD-L1 exon 6; Set C
guaguucugaaaaacaaaacaaaac

SEQ ID NO: 24110 - RNA, 27 nt, Artificial Sequence
  Synthetic Oligonucleotide; PD-L1 exon 6; Set C
gguaguucugaaaaacaaaacaaaacg

SEQ ID NO: 24111 - RNA, 30 nt, Artificial Sequence
  Synthetic Oligonucleotide; PD-L1 exon 6; Set C
gagguaguucugaaaaacaaaacaaaacga

SEQ ID NO: 24112 - RNA, 24 nt, Artificial Sequence
  Synthetic Oligonucleotide; PD-L1 exon 6; Set C
guaguucugaaaaacaaaacaaaa

SEQ ID NO: 24113 - RNA, 26 nt, Artificial Sequence
  Synthetic Oligonucleotide; PD-L1 exon 6; Set C
gguaguucugaaaaacaaaacaaaac

SEQ ID NO: 24114 - RNA, 28 nt, Artificial Sequence
  Synthetic Oligonucleotide; PD-L1 exon 6; Set C
agguaguucugaaaaacaaaacaaaacg

SEQ ID NO: 24115 - RNA, 23 nt, Artificial Sequence
  Synthetic Oligonucleotide; PD-L1 exon 6; Set C
guaguucugaaaaacaaaacaaa

SEQ ID NO: 24116 - RNA, 25 nt, Artificial Sequence
  Synthetic Oligonucleotide; PD-L1 exon 6; Set C
gguaguucugaaaaacaaaacaaaa

SEQ ID NO: 24117 - RNA, 27 nt, Artificial Sequence
  Synthetic Oligonucleotide; PD-L1 exon 6; Set C
agguaguucugaaaaacaaaacaaaac

SEQ ID NO: 24118 - RNA, 29 nt, Artificial Sequence
  Synthetic Oligonucleotide; PD-L1 exon 6; Set C
gagguaguucugaaaaacaaaacaaaacg

SEQ ID NO: 24119 - RNA, 24 nt, Artificial Sequence
  Synthetic Oligonucleotide; PD-L1 exon 6; Set C
gguaguucugaaaaacaaaacaaa

SEQ ID NO: 24120 - RNA, 40 nt, Artificial Sequence
  Synthetic Oligonucleotide; PD-L1 exon 6; Set A
gugccagagguaguucugaaaaacaaaacaaaacgaaaac

SEQ ID NO: 24121 - RNA, 26 nt, Artificial Sequence
  Synthetic Oligonucleotide; PD-L1 exon 6; Set C
agguaguucugaaaaacaaaacaaaa

SEQ ID NO: 24122 - RNA, 28 nt, Artificial Sequence
  Synthetic Oligonucleotide; PD-L1 exon 6; Set C
gagguaguucugaaaaacaaaacaaaac

SEQ ID NO: 24123 - RNA, 25 nt, Artificial Sequence
  Synthetic Oligonucleotide; PD-L1 exon 6; Set C
agguaguucugaaaaacaaaacaaa

SEQ ID NO: 24124 - RNA, 39 nt, Artificial Sequence
  Synthetic Oligonucleotide; PD-L1 exon 6; Set A
gugccagagguaguucugaaaaacaaaacaaaacgaaaa

SEQ ID NO: 24125 - RNA, 27 nt, Artificial Sequence
  Synthetic Oligonucleotide; PD-L1 exon 6; Set C
gagguaguucugaaaaacaaaacaaaa

SEQ ID NO: 24126 - RNA, 26 nt, Artificial Sequence
  Synthetic Oligonucleotide; PD-L1 exon 6; Set C
gagguaguucugaaaaacaaaacaaa

SEQ ID NO: 24127 - RNA, 40 nt, Artificial Sequence
  Synthetic Oligonucleotide; PD-L1 exon 6; Set A
ugugccagagguaguucugaaaaacaaaacaaaacgaaaa

SEQ ID NO: 24128 - RNA, 38 nt, Artificial Sequence
  Synthetic Oligonucleotide; PD-L1 exon 6; Set A
gugccagagguaguucugaaaaacaaaacaaaacgaaa

SEQ ID NO: 24129 - RNA, 39 nt, Artificial Sequence
  Synthetic Oligonucleotide; PD-L1 exon 6; Set A
ugugccagagguaguucugaaaaacaaaacaaaacgaaa

SEQ ID NO: 24130 - RNA, 37 nt, Artificial Sequence
  Synthetic Oligonucleotide; PD-L1 exon 6; Set A
gugccagagguaguucugaaaaacaaaacaaaacgaa

SEQ ID NO: 24131 - RNA, 40 nt, Artificial Sequence
  Synthetic Oligonucleotide; PD-L1 exon 6; Set A
augugccagagguaguucugaaaaacaaaacaaaacgaaa

SEQ ID NO: 24132 - RNA, 38 nt, Artificial Sequence
  Synthetic Oligonucleotide; PD-L1 exon 6; Set A
ugugccagagguaguucugaaaaacaaaacaaaacgaa

SEQ ID NO: 24133 - RNA, 36 nt, Artificial Sequence
  Synthetic Oligonucleotide; PD-L1 exon 6; Set A
gugccagagguaguucugaaaaacaaaacaaaacga

SEQ ID NO: 24134 - RNA, 39 nt, Artificial Sequence
  Synthetic Oligonucleotide; PD-L1 exon 6; Set A
augugccagagguaguucugaaaaacaaaacaaaacgaa

SEQ ID NO: 24135 - RNA, 37 nt, Artificial Sequence
  Synthetic Oligonucleotide; PD-L1 exon 6; Set A
ugugccagagguaguucugaaaaacaaaacaaaacga

SEQ ID NO: 24136 - RNA, 35 nt, Artificial Sequence
  Synthetic Oligonucleotide; PD-L1 exon 6; Set A
gugccagagguaguucugaaaaacaaaacaaaacg

SEQ ID NO: 24137 - RNA, 40 nt, Artificial Sequence
  Synthetic Oligonucleotide; PD-L1 exon 6; Set A
gaugugccagagguaguucugaaaaacaaaacaaaacgaa

SEQ ID NO: 24138 - RNA, 38 nt, Artificial Sequence
  Synthetic Oligonucleotide; PD-L1 exon 6; Set A
augugccagagguaguucugaaaaacaaaacaaaacga

SEQ ID NO: 24139 - RNA, 34 nt, Artificial Sequence
  Synthetic Oligonucleotide; PD-L1 exon 6; Set A
gugccagagguaguucugaaaaacaaaacaaaac

SEQ ID NO: 24140 - RNA, 36 nt, Artificial Sequence
  Synthetic Oligonucleotide; PD-L1 exon 6; Set A
ugugccagagguaguucugaaaaacaaaacaaaacg

SEQ ID NO: 24141 - RNA, 39 nt, Artificial Sequence
  Synthetic Oligonucleotide; PD-L1 exon 6; Set A
gaugugccagagguaguucugaaaaacaaaacaaaacga

SEQ ID NO: 24142 - RNA, 35 nt, Artificial Sequence
  Synthetic Oligonucleotide; PD-L1 exon 6; Set A
ugugccagagguaguucugaaaaacaaaacaaaac

SEQ ID NO: 24143 - RNA, 33 nt, Artificial Sequence
  Synthetic Oligonucleotide; PD-L1 exon 6; Set C
gugccagagguaguucugaaaaacaaaacaaaa

SEQ ID NO: 24144 - RNA, 37 nt, Artificial Sequence
  Synthetic Oligonucleotide; PD-L1 exon 6; Set A
augugccagagguaguucugaaaaacaaaacaaaacg

SEQ ID NO: 24145 - RNA, 32 nt, Artificial Sequence
  Synthetic Oligonucleotide; PD-L1 exon 6; Set A
gugccagagguaguucugaaaaacaaaacaaa

SEQ ID NO: 24146 - RNA, 34 nt, Artificial Sequence
  Synthetic Oligonucleotide; PD-L1 exon 6; Set A
ugugccagagguaguucugaaaaacaaaacaaaa

SEQ ID NO: 24147 - RNA, 36 nt, Artificial Sequence
  Synthetic Oligonucleotide; PD-L1 exon 6; Set A
augugccagagguaguucugaaaaacaaaacaaaac

SEQ ID NO: 24148 - RNA, 38 nt, Artificial Sequence
  Synthetic Oligonucleotide; PD-L1 exon 6; Set A
gaugugccagagguaguucugaaaaacaaaacaaaacg

SEQ ID NO: 24149 - RNA, 15 nt, Artificial Sequence
  Synthetic Oligonucleotide; PD-L1 exon 6; Set C
gguaguucugaaaaa

SEQ ID NO: 24150 - RNA, 33 nt, Artificial Sequence
  Synthetic Oligonucleotide; PD-L1 exon 6; Set A
ugugccagagguaguucugaaaaacaaaacaaa

SEQ ID NO: 24151 - RNA, 37 nt, Artificial Sequence
  Synthetic Oligonucleotide; PD-L1 exon 6; Set A
gaugugccagagguaguucugaaaaacaaaacaaaac

SEQ ID NO: 24152 - RNA, 35 nt, Artificial Sequence
  Synthetic Oligonucleotide; PD-L1 exon 6; Set A
augugccagagguaguucugaaaaacaaaacaaaa

SEQ ID NO: 24153 - RNA, 16 nt, Artificial Sequence
  Synthetic Oligonucleotide; PD-L1 exon 6; Set C
agguaguucugaaaaa

SEQ ID NO: 24154 - RNA, 34 nt, Artificial Sequence
  Synthetic Oligonucleotide; PD-L1 exon 6; Set A
augugccagagguaguucugaaaaacaaaacaaa

SEQ ID NO: 24155 - RNA, 36 nt, Artificial Sequence
  Synthetic Oligonucleotide; PD-L1 exon 6; Set A
gaugugccagagguaguucugaaaaacaaaacaaaa

SEQ ID NO: 24156 - RNA, 32 nt, Artificial Sequence
  Synthetic Oligonucleotide; PD-L1 exon 6; Set A
ugugccagagguaguucugaaaaacaaaacaa

SEQ ID NO: 24157 - RNA, 17 nt, Artificial Sequence
  Synthetic Oligonucleotide; PD-L1 exon 6; Set C
gagguaguucugaaaaa

SEQ ID NO: 24158 - RNA, 35 nt, Artificial Sequence
  Synthetic Oligonucleotide; PD-L1 exon 6; Set A
gaugugccagagguaguucugaaaaacaaaacaaa

SEQ ID NO: 24159 - RNA, 15 nt, Artificial Sequence
  Synthetic Oligonucleotide; PD-L1 exon 6; Set C
agguaguucugaaaa

SEQ ID NO: 24160 - RNA, 33 nt, Artificial Sequence
  Synthetic Oligonucleotide; PD-L1 exon 6; Set A
augugccagagguaguucugaaaaacaaaacaa

SEQ ID NO: 24161 - RNA, 16 nt, Artificial Sequence
  Synthetic Oligonucleotide; PD-L1 exon 6; Set C
gagguaguucugaaaa

SEQ ID NO: 24162 - RNA, 34 nt, Artificial Sequence
  Synthetic Oligonucleotide; PD-L1 exon 6; Set A
gaugugccagagguaguucugaaaaacaaaacaa

SEQ ID NO: 24163 - RNA, 15 nt, Artificial Sequence
  Synthetic Oligonucleotide; PD-L1 exon 6; Set C
gagguaguucugaaa

SEQ ID NO: 24164 - RNA, 33 nt, Artificial Sequence
  Synthetic Oligonucleotide; PD-L1 exon 6; Set A
gaugugccagagguaguucugaaaaacaaaaca

SEQ ID NO: 24165 - RNA, 40 nt, Artificial Sequence
  Synthetic Oligonucleotide; PD-L1 exon 6; Set A
uggaggaugugccagagguaguucugaaaaacaaaacaaa

SEQ ID NO: 24166 - RNA, 23 nt, Artificial Sequence
  Synthetic Oligonucleotide; PD-L1 exon 6; Set C
gugccagagguaguucugaaaaa

SEQ ID NO: 24167 - RNA, 24 nt, Artificial Sequence
  Synthetic Oligonucleotide; PD-L1 exon 6; Set C
ugugccagagguaguucugaaaaa

SEQ ID NO: 24168 - RNA, 22 nt, Artificial Sequence
  Synthetic Oligonucleotide; PD-L1 exon 6; Set C
gugccagagguaguucugaaaa

SEQ ID NO: 24169 - RNA, 25 nt, Artificial Sequence
  Synthetic Oligonucleotide; PD-L1 exon 6; Set C
augugccagagguaguucugaaaaa

SEQ ID NO: 24170 - RNA, 23 nt, Artificial Sequence
  Synthetic Oligonucleotide; PD-L1 exon 6; Set C
ugugccagagguaguucugaaaa

SEQ ID NO: 24171 - RNA, 21 nt, Artificial Sequence
  Synthetic Oligonucleotide; PD-L1 exon 6; Set C
gugccagagguaguucugaaa

SEQ ID NO: 24172 - RNA, 26 nt, Artificial Sequence
  Synthetic Oligonucleotide; PD-L1 exon 6; Set A
gaugugccagagguaguucugaaaaa

SEQ ID NO: 24173 - RNA, 24 nt, Artificial Sequence
  Synthetic Oligonucleotide; PD-L1 exon 6; Set C
augugccagagguaguucugaaaa

SEQ ID NO: 24174 - RNA, 22 nt, Artificial Sequence
  Synthetic Oligonucleotide; PD-L1 exon 6; Set C
ugugccagagguaguucugaaa

SEQ ID NO: 24175 - RNA, 40 nt, Artificial Sequence
  Synthetic Oligonucleotide; PD-L1 exon 6; Set A
uuuggaggaugugccagagguaguucugaaaaacaaaaca

SEQ ID NO: 24176 - RNA, 25 nt, Artificial Sequence
  Synthetic Oligonucleotide; PD-L1 exon 6; Set A
gaugugccagagguaguucugaaaa

SEQ ID NO: 24177 - RNA, 23 nt, Artificial Sequence
  Synthetic Oligonucleotide; PD-L1 exon 6; Set C
augugccagagguaguucugaaa

SEQ ID NO: 24178 - RNA, 24 nt, Artificial Sequence
  Synthetic Oligonucleotide; PD-L1 exon 6; Set A
gaugugccagagguaguucugaaa

SEQ ID NO: 24179 - RNA, 31 nt, Artificial Sequence
  Synthetic Oligonucleotide; PD-L1 exon 6; Set A
uggaggaugugccagagguaguucugaaaaa

SEQ ID NO: 24180 - RNA, 32 nt, Artificial Sequence
  Synthetic Oligonucleotide; PD-L1 exon 6; Set A
uuggaggaugugccagagguaguucugaaaaa

SEQ ID NO: 24181 - RNA, 30 nt, Artificial Sequence
  Synthetic Oligonucleotide; PD-L1 exon 6; Set A
uggaggaugugccagagguaguucugaaaa

SEQ ID NO: 24182 - RNA, 31 nt, Artificial Sequence
  Synthetic Oligonucleotide; PD-L1 exon 6; Set A
uuggaggaugugccagagguaguucugaaaa

SEQ ID NO: 24183 - RNA, 29 nt, Artificial Sequence
  Synthetic Oligonucleotide; PD-L1 exon 6; Set A
uggaggaugugccagagguaguucugaaa

SEQ ID NO: 24184 - RNA, 15 nt, Artificial Sequence
  Synthetic Oligonucleotide; PD-L1 exon 6; Set C
ugugccagagguagu

SEQ ID NO: 24185 - RNA, 34 nt, Artificial Sequence
  Synthetic Oligonucleotide; PD-L1 exon 6; Set A
auuuggaggaugugccagagguaguucugaaaaa

SEQ ID NO: 24186 - RNA, 32 nt, Artificial Sequence
  Synthetic Oligonucleotide; PD-L1 exon 6; Set A
uuuggaggaugugccagagguaguucugaaaa

SEQ ID NO: 24187 - RNA, 30 nt, Artificial Sequence
  Synthetic Oligonucleotide; PD-L1 exon 6; Set A
uuggaggaugugccagagguaguucugaaa

SEQ ID NO: 24188 - RNA, 16 nt, Artificial Sequence
  Synthetic Oligonucleotide; PD-L1 exon 6; Set C
augugccagagguagu

SEQ ID NO: 24189 - RNA, 35 nt, Artificial Sequence
  Synthetic Oligonucleotide; PD-L1 exon 6; Set A
cauuuggaggaugugccagagguaguucugaaaaa

SEQ ID NO: 24190 - RNA, 33 nt, Artificial Sequence
  Synthetic Oligonucleotide; PD-L1 exon 6; Set A
auuuggaggaugugccagagguaguucugaaaa

SEQ ID NO: 24191 - RNA, 31 nt, Artificial Sequence
  Synthetic Oligonucleotide; PD-L1 exon 6; Set A
uuuggaggaugugccagagguaguucugaaa

SEQ ID NO: 24192 - RNA, 17 nt, Artificial Sequence
  Synthetic Oligonucleotide; PD-L1 exon 6; Set C
gaugugccagagguagu

SEQ ID NO: 24193 - RNA, 36 nt, Artificial Sequence
  Synthetic Oligonucleotide; PD-L1 exon 6; Set A
ucauuuggaggaugugccagagguaguucugaaaaa

SEQ ID NO: 24194 - RNA, 34 nt, Artificial Sequence
  Synthetic Oligonucleotide; PD-L1 exon 6; Set A
cauuuggaggaugugccagagguaguucugaaaa

SEQ ID NO: 24195 - RNA, 32 nt, Artificial Sequence
  Synthetic Oligonucleotide; PD-L1 exon 6; Set A
auuuggaggaugugccagagguaguucugaaa

SEQ ID NO: 24196 - RNA, 37 nt, Artificial Sequence
  Synthetic Oligonucleotide; PD-L1 exon 6; Set A
uucauuuggaggaugugccagagguaguucugaaaaa

SEQ ID NO: 24197 - RNA, 35 nt, Artificial Sequence
  Synthetic Oligonucleotide; PD-L1 exon 6; Set C
ucauuuggaggaugugccagagguaguucugaaaa

SEQ ID NO: 24198 - RNA, 33 nt, Artificial Sequence
  Synthetic Oligonucleotide; PD-L1 exon 6; Set C
cauuuggaggaugugccagagguaguucugaaa

SEQ ID NO: 24199 - RNA, 17 nt, Artificial Sequence
  Synthetic Oligonucleotide; PD-L1 exon 6; Set C
ggaugugccagagguag

SEQ ID NO: 24200 - RNA, 16 nt, Artificial Sequence
  Synthetic Oligonucleotide; PD-L1 exon 6; Set C
ggaugugccagaggua

SEQ ID NO: 24201 - RNA, 36 nt, Artificial Sequence
  Synthetic Oligonucleotide; PD-L1 exon 6; Set C
uucauuuggaggaugugccagagguaguucugaaaa

SEQ ID NO: 24202 - RNA, 34 nt, Artificial Sequence
  Synthetic Oligonucleotide; PD-L1 exon 6; Set C
ucauuuggaggaugugccagagguaguucugaaa

SEQ ID NO: 24203 - RNA, 17 nt, Artificial Sequence
  Synthetic Oligonucleotide; PD-L1 exon 6; Set C
aggaugugccagaggua

SEQ ID NO: 24204 - RNA, 35 nt, Artificial Sequence
  Synthetic Oligonucleotide; PD-L1 exon 6; Set C
uucauuuggaggaugugccagagguaguucugaaa

SEQ ID NO: 24205 - RNA, 15 nt, Artificial Sequence
  Synthetic Oligonucleotide; PD-L1 exon 6; Set C
ggaugugccagaggu

SEQ ID NO: 24206 - RNA, 18 nt, Artificial Sequence
  Synthetic Oligonucleotide; PD-L1 exon 6; Set C
gaggaugugccagaggua

SEQ ID NO: 24207 - RNA, 16 nt, Artificial Sequence
  Synthetic Oligonucleotide; PD-L1 exon 6; Set C
aggaugugccagaggu

SEQ ID NO: 24208 - RNA, 22 nt, Artificial Sequence
  Synthetic Oligonucleotide; PD-L1 exon 6; Set A
uggaggaugugccagagguagu

SEQ ID NO: 24209 - RNA, 19 nt, Artificial Sequence
  Synthetic Oligonucleotide; PD-L1 exon 6; Set A
ggaggaugugccagaggua

SEQ ID NO: 24210 - RNA, 17 nt, Artificial Sequence
  Synthetic Oligonucleotide; PD-L1 exon 6; Set C
gaggaugugccagaggu

SEQ ID NO: 24211 - RNA, 21 nt, Artificial Sequence
  Synthetic Oligonucleotide; PD-L1 exon 6; Set A
uggaggaugugccagagguag

SEQ ID NO: 24212 - RNA, 23 nt, Artificial Sequence
  Synthetic Oligonucleotide; PD-L1 exon 6; Set A
uuggaggaugugccagagguagu

SEQ ID NO: 24213 - RNA, 18 nt, Artificial Sequence
  Synthetic Oligonucleotide; PD-L1 exon 6; Set A
ggaggaugugccagaggu

SEQ ID NO: 24214 - RNA, 22 nt, Artificial Sequence
  Synthetic Oligonucleotide; PD-L1 exon 6; Set A
uuggaggaugugccagagguag

SEQ ID NO: 24215 - RNA, 24 nt, Artificial Sequence
  Synthetic Oligonucleotide; PD-L1 exon 6; Set A
uuuggaggaugugccagagguagu

SEQ ID NO: 24216 - RNA, 25 nt, Artificial Sequence
  Synthetic Oligonucleotide; PD-L1 exon 6; Set A
auuuggaggaugugccagagguagu

SEQ ID NO: 24217 - RNA, 40 nt, Artificial Sequence
  Synthetic Oligonucleotide; PD-L1 exon 6; Set C
guccuuucauuuggaggaugugccagagguaguucugaaa

SEQ ID NO: 24218 - RNA, 18 nt, Artificial Sequence
  Synthetic Oligonucleotide; PD-L1 exon 6; Set A
uggaggaugugccagagg

SEQ ID NO: 24219 - RNA, 26 nt, Artificial Sequence
  Synthetic Oligonucleotide; PD-L1 exon 6; Set A
cauuuggaggaugugccagagguagu

SEQ ID NO: 24220 - RNA, 19 nt, Artificial Sequence
  Synthetic Oligonucleotide; PD-L1 exon 6; Set A
uuggaggaugugccagagg

SEQ ID NO: 24221 - RNA, 17 nt, Artificial Sequence
  Synthetic Oligonucleotide; PD-L1 exon 6; Set C
uggaggaugugccagag

SEQ ID NO: 24222 - RNA, 27 nt, Artificial Sequence
  Synthetic Oligonucleotide; PD-L1 exon 6; Set A
ucauuuggaggaugugccagagguagu

SEQ ID NO: 24223 - RNA, 18 nt, Artificial Sequence
  Synthetic Oligonucleotide; PD-L1 exon 6; Set C
uuggaggaugugccagag

SEQ ID NO: 24224 - RNA, 28 nt, Artificial Sequence
  Synthetic Oligonucleotide; PD-L1 exon 6; Set A
uucauuuggaggaugugccagagguagu

SEQ ID NO: 24225 - RNA, 33 nt, Artificial Sequence
  Synthetic Oligonucleotide; PD-L1 exon 6; Set C
guccuuucauuuggaggaugugccagagguagu

SEQ ID NO: 24226 - RNA, 32 nt, Artificial Sequence
  Synthetic Oligonucleotide; PD-L1 exon 6; Set C
guccuuucauuuggaggaugugccagagguag

SEQ ID NO: 24227 - RNA, 29 nt, Artificial Sequence
  Synthetic Oligonucleotide; PD-L1 exon 6; Set C
guccuuucauuuggaggaugugccagagg

SEQ ID NO: 24228 - RNA, 28 nt, Artificial Sequence
  Synthetic Oligonucleotide; PD-L1 exon 6; Set A
guccuuucauuuggaggaugugccagag

SEQ ID NO: 24229 - RNA, 38 nt, Artificial Sequence
  Synthetic Oligonucleotide; PD-L1 exon 6; Set C
aagugaguccuuucauuuggaggaugugccagagguag

SEQ ID NO: 24230 - RNA, 37 nt, Artificial Sequence
  Synthetic Oligonucleotide; PD-L1 exon 6; Set C
aagugaguccuuucauuuggaggaugugccagaggua

SEQ ID NO: 24231 - RNA, 39 nt, Artificial Sequence
  Synthetic Oligonucleotide; PD-L1 exon 6; Set C
caagugaguccuuucauuuggaggaugugccagagguag

SEQ ID NO: 24232 - RNA, 38 nt, Artificial Sequence
  Synthetic Oligonucleotide; PD-L1 exon 6; Set C
caagugaguccuuucauuuggaggaugugccagaggua

SEQ ID NO: 24233 - RNA, 36 nt, Artificial Sequence
  Synthetic Oligonucleotide; PD-L1 exon 6; Set C
aagugaguccuuucauuuggaggaugugccagaggu

SEQ ID NO: 24234 - RNA, 37 nt, Artificial Sequence
  Synthetic Oligonucleotide; PD-L1 exon 6; Set C
caagugaguccuuucauuuggaggaugugccagaggu

SEQ ID NO: 24235 - RNA, 35 nt, Artificial Sequence
  Synthetic Oligonucleotide; PD-L1 exon 6; Set C
aagugaguccuuucauuuggaggaugugccagagg

SEQ ID NO: 24236 - RNA, 36 nt, Artificial Sequence
  Synthetic Oligonucleotide; PD-L1 exon 6; Set C
caagugaguccuuucauuuggaggaugugccagagg

SEQ ID NO: 24237 - RNA, 34 nt, Artificial Sequence
  Synthetic Oligonucleotide; PD-L1 exon 6; Set C
aagugaguccuuucauuuggaggaugugccagag

SEQ ID NO: 24238 - RNA, 35 nt, Artificial Sequence
  Synthetic Oligonucleotide; PD-L1 exon 6; Set C
caagugaguccuuucauuuggaggaugugccagag

SEQ ID NO: 24239 - RNA, 18 nt, Artificial Sequence
  Synthetic Oligonucleotide; PD-L1 exon 6; Set C
guccuuucauuuggagga

SEQ ID NO: 24240 - RNA, 28 nt, Artificial Sequence
  Synthetic Oligonucleotide; PD-L1 exon 6; Set A
aagugaguccuuucauuuggaggaugug

SEQ ID NO: 24241 - RNA, 27 nt, Artificial Sequence
  Synthetic Oligonucleotide; PD-L1 exon 6; Set A
aagugaguccuuucauuuggaggaugu

SEQ ID NO: 24242 - RNA, 29 nt, Artificial Sequence
  Synthetic Oligonucleotide; PD-L1 exon 6; Set A
caagugaguccuuucauuuggaggaugug

SEQ ID NO: 24243 - RNA, 28 nt, Artificial Sequence
  Synthetic Oligonucleotide; PD-L1 exon 6; Set A
caagugaguccuuucauuuggaggaugu

SEQ ID NO: 24244 - RNA, 26 nt, Artificial Sequence
  Synthetic Oligonucleotide; PD-L1 exon 6; Set A
aagugaguccuuucauuuggaggaug

SEQ ID NO: 24245 - RNA, 25 nt, Artificial Sequence
  Synthetic Oligonucleotide; PD-L1 exon 6; Set C
aagugaguccuuucauuuggaggau

SEQ ID NO: 24246 - RNA, 27 nt, Artificial Sequence
  Synthetic Oligonucleotide; PD-L1 exon 6; Set A
caagugaguccuuucauuuggaggaug

SEQ ID NO: 24247 - RNA, 26 nt, Artificial Sequence
  Synthetic Oligonucleotide; PD-L1 exon 6; Set A
caagugaguccuuucauuuggaggau

SEQ ID NO: 24248 - RNA, 18 nt, Artificial Sequence
  Synthetic Oligonucleotide; PD-L1 exon 6; Set C
aagugaguccuuucauuu

SEQ ID NO: 24249 - RNA, 19 nt, Artificial Sequence
  Synthetic Oligonucleotide; PD-L1 exon 6; Set C
caagugaguccuuucauuu

SEQ ID NO: 24250 - RNA, 39 nt, Artificial Sequence
  Synthetic Oligonucleotide; PD-L1 exon 6; Set C
agauggcucccagaauuaccaagugaguccuuucauuug

SEQ ID NO: 24251 - RNA, 38 nt, Artificial Sequence
  Synthetic Oligonucleotide; PD-L1 exon 6; Set C
agauggcucccagaauuaccaagugaguccuuucauuu

SEQ ID NO: 24252 - RNA, 40 nt, Artificial Sequence
  Synthetic Oligonucleotide; PD-L1 exon 6; Set C
aagauggcucccagaauuaccaagugaguccuuucauuug

SEQ ID NO: 24253 - RNA, 39 nt, Artificial Sequence
  Synthetic Oligonucleotide; PD-L1 exon 6; Set C
aagauggcucccagaauuaccaagugaguccuuucauuu

SEQ ID NO: 24254 - RNA, 37 nt, Artificial Sequence
  Synthetic Oligonucleotide; PD-L1 exon 6; Set C
agauggcucccagaauuaccaagugaguccuuucauu

SEQ ID NO: 24255 - RNA, 40 nt, Artificial Sequence
  Synthetic Oligonucleotide; PD-L1 exon 6; Set C
uaagauggcucccagaauuaccaagugaguccuuucauuu

SEQ ID NO: 24256 - RNA, 36 nt, Artificial Sequence
  Synthetic Oligonucleotide; PD-L1 exon 6; Set C
agauggcucccagaauuaccaagugaguccuuucau

SEQ ID NO: 24257 - RNA, 38 nt, Artificial Sequence
  Synthetic Oligonucleotide; PD-L1 exon 6; Set C
aagauggcucccagaauuaccaagugaguccuuucauu

SEQ ID NO: 24258 - RNA, 37 nt, Artificial Sequence
  Synthetic Oligonucleotide; PD-L1 exon 6; Set C
aagauggcucccagaauuaccaagugaguccuuucau

SEQ ID NO: 24259 - RNA, 35 nt, Artificial Sequence
  Synthetic Oligonucleotide; PD-L1 exon 6; Set C
agauggcucccagaauuaccaagugaguccuuuca

SEQ ID NO: 24260 - RNA, 39 nt, Artificial Sequence
  Synthetic Oligonucleotide; PD-L1 exon 6; Set C
uaagauggcucccagaauuaccaagugaguccuuucauu

SEQ ID NO: 24261 - RNA, 38 nt, Artificial Sequence
  Synthetic Oligonucleotide; PD-L1 exon 6; Set C
uaagauggcucccagaauuaccaagugaguccuuucau

SEQ ID NO: 24262 - RNA, 36 nt, Artificial Sequence
  Synthetic Oligonucleotide; PD-L1 exon 6; Set C
aagauggcucccagaauuaccaagugaguccuuuca

SEQ ID NO: 24263 - RNA, 37 nt, Artificial Sequence
  Synthetic Oligonucleotide; PD-L1 exon 6; Set C
uaagauggcucccagaauuaccaagugaguccuuuca

SEQ ID NO: 24264 - RNA, 35 nt, Artificial Sequence
  Synthetic Oligonucleotide; PD-L1 exon 6; Set C
aagauggcucccagaauuaccaagugaguccuuuc

SEQ ID NO: 24265 - RNA, 36 nt, Artificial Sequence
  Synthetic Oligonucleotide; PD-L1 exon 6; Set C
uaagauggcucccagaauuaccaagugaguccuuuc

SEQ ID NO: 24266 - RNA, 40 nt, Artificial Sequence
  Synthetic Oligonucleotide; PD-L1 exon 6; Set C
auaauaagauggcucccagaauuaccaagugaguccuuuc

SEQ ID NO: 24267 - RNA, 31 nt, Artificial Sequence
  Synthetic Oligonucleotide; PD-L1 exon 6; Set A
uaagauggcucccagaauuaccaagugaguc

SEQ ID NO: 24268 - RNA, 23 nt, Artificial Sequence
  Synthetic Oligonucleotide; PD-L1 exon 6; Set A
agauggcucccagaauuaccaag

SEQ ID NO: 24269 - RNA, 36 nt, Artificial Sequence
  Synthetic Oligonucleotide; PD-L1 exon 6; Set A
cauaauaagauggcucccagaauuaccaagugaguc

SEQ ID NO: 24270 - RNA, 24 nt, Artificial Sequence
  Synthetic Oligonucleotide; PD-L1 exon 6; Set C
aagauggcucccagaauuaccaag

SEQ ID NO: 24271 - RNA, 22 nt, Artificial Sequence
  Synthetic Oligonucleotide; PD-L1 exon 6; Set A
agauggcucccagaauuaccaa

SEQ ID NO: 24272 - RNA, 25 nt, Artificial Sequence
  Synthetic Oligonucleotide; PD-L1 exon 6; Set C
uaagauggcucccagaauuaccaag

SEQ ID NO: 24273 - RNA, 23 nt, Artificial Sequence
  Synthetic Oligonucleotide; PD-L1 exon 6; Set C
aagauggcucccagaauuaccaa

SEQ ID NO: 24274 - RNA, 24 nt, Artificial Sequence
  Synthetic Oligonucleotide; PD-L1 exon 6; Set C
uaagauggcucccagaauuaccaa

SEQ ID NO: 24275 - RNA, 29 nt, Artificial Sequence
  Synthetic Oligonucleotide; PD-L1 exon 6; Set C
auaauaagauggcucccagaauuaccaag

SEQ ID NO: 24276 - RNA, 30 nt, Artificial Sequence
  Synthetic Oligonucleotide; PD-L1 exon 6; Set A
cauaauaagauggcucccagaauuaccaag

SEQ ID NO: 24277 - RNA, 28 nt, Artificial Sequence
  Synthetic Oligonucleotide; PD-L1 exon 6; Set C
auaauaagauggcucccagaauuaccaa

SEQ ID NO: 24278 - RNA, 29 nt, Artificial Sequence
  Synthetic Oligonucleotide; PD-L1 exon 6; Set A
cauaauaagauggcucccagaauuaccaa

SEQ ID NO: 24279 - RNA, 35 nt, Artificial Sequence
  Synthetic Oligonucleotide; PD-L1 exon 6; Set A
caaggcauaauaagauggcucccagaauuaccaag

SEQ ID NO: 24280 - RNA, 39 nt, Artificial Sequence
  Synthetic Oligonucleotide; PD-L1 exon 6; Set C
acaccaaggcauaauaagauggcucccagaauuaccaag

SEQ ID NO: 24281 - RNA, 40 nt, Artificial Sequence
  Synthetic Oligonucleotide; PD-L1 exon 6; Set C
uacaccaaggcauaauaagauggcucccagaauuaccaag

SEQ ID NO: 24282 - RNA, 38 nt, Artificial Sequence
  Synthetic Oligonucleotide; PD-L1 exon 6; Set C
acaccaaggcauaauaagauggcucccagaauuaccaa

SEQ ID NO: 24283 - RNA, 40 nt, Artificial Sequence
  Synthetic Oligonucleotide; PD-L1 exon 6; Set C
cuacaccaaggcauaauaagauggcucccagaauuaccaa

SEQ ID NO: 24284 - RNA, 16 nt, Artificial Sequence
  Synthetic Oligonucleotide; PD-L1 exon 6; Set C
caaggcauaauaagau

SEQ ID NO: 24285 - RNA, 15 nt, Artificial Sequence
  Synthetic Oligonucleotide; PD-L1 exon 6; Set C
caaggcauaauaaga

SEQ ID NO: 24286 - RNA, 20 nt, Artificial Sequence
  Synthetic Oligonucleotide; PD-L1 exon 6; Set C
acaccaaggcauaauaagau

SEQ ID NO: 24287 - RNA, 19 nt, Artificial Sequence
  Synthetic Oligonucleotide; PD-L1 exon 6; Set C
acaccaaggcauaauaaga

SEQ ID NO: 24288 - RNA, 18 nt, Artificial Sequence
  Synthetic Oligonucleotide; PD-L1 exon 6; Set C
acaccaaggcauaauaag

SEQ ID NO: 24289 - RNA, 20 nt, Artificial Sequence
  Synthetic Oligonucleotide; PD-L1 exon 6; Set C
uacaccaaggcauaauaaga

SEQ ID NO: 24290 - RNA, 22 nt, Artificial Sequence
  Synthetic Oligonucleotide; PD-L1 exon 6; Set C
cuacaccaaggcauaauaagau

SEQ ID NO: 24291 - RNA, 17 nt, Artificial Sequence
  Synthetic Oligonucleotide; PD-L1 exon 6; Set C
acaccaaggcauaauaa

SEQ ID NO: 24292 - RNA, 19 nt, Artificial Sequence
  Synthetic Oligonucleotide; PD-L1 exon 6; Set C
uacaccaaggcauaauaag

SEQ ID NO: 24293 - RNA, 21 nt, Artificial Sequence
  Synthetic Oligonucleotide; PD-L1 exon 6; Set C
cuacaccaaggcauaauaaga

SEQ ID NO: 24294 - RNA, 18 nt, Artificial Sequence
  Synthetic Oligonucleotide; PD-L1 exon 6; Set C
uacaccaaggcauaauaa

SEQ ID NO: 24295 - RNA, 20 nt, Artificial Sequence
  Synthetic Oligonucleotide; PD-L1 exon 6; Set C
cuacaccaaggcauaauaag

SEQ ID NO: 24296 - RNA, 22 nt, Artificial Sequence
  Synthetic Oligonucleotide; PD-L1 exon 6; Set C
gcuacaccaaggcauaauaaga

SEQ ID NO: 24297 - RNA, 19 nt, Artificial Sequence
  Synthetic Oligonucleotide; PD-L1 exon 6; Set C
cuacaccaaggcauaauaa

SEQ ID NO: 24298 - RNA, 21 nt, Artificial Sequence
  Synthetic Oligonucleotide; PD-L1 exon 6; Set C
gcuacaccaaggcauaauaag

SEQ ID NO: 24299 - RNA, 20 nt, Artificial Sequence
  Synthetic Oligonucleotide; PD-L1 exon 6; Set C
gcuacaccaaggcauaauaa

SEQ ID NO: 24300 - RNA, 15 nt, Artificial Sequence
  Synthetic Oligonucleotide; PD-L1 exon 6; Set C
cuacaccaaggcaua

SEQ ID NO: 24301 - RNA, 29 nt, Artificial Sequence
  Synthetic Oligonucleotide; PD-L1 exon 6; Set A
gucagugcuacaccaaggcauaauaagau

SEQ ID NO: 24302 - RNA, 16 nt, Artificial Sequence
  Synthetic Oligonucleotide; PD-L1 exon 6; Set C
gcuacaccaaggcaua

SEQ ID NO: 24303 - RNA, 30 nt, Artificial Sequence
  Synthetic Oligonucleotide; PD-L1 exon 6; Set A
ugucagugcuacaccaaggcauaauaagau

SEQ ID NO: 24304 - RNA, 15 nt, Artificial Sequence
  Synthetic Oligonucleotide; PD-L1 exon 6; Set C
gcuacaccaaggcau

SEQ ID NO: 24305 - RNA, 31 nt, Artificial Sequence
  Synthetic Oligonucleotide; PD-L1 exon 6; Set A
augucagugcuacaccaaggcauaauaagau

SEQ ID NO: 24306 - RNA, 32 nt, Artificial Sequence
  Synthetic Oligonucleotide; PD-L1 exon 6; Set A
aaugucagugcuacaccaaggcauaauaagau

SEQ ID NO: 24307 - RNA, 31 nt, Artificial Sequence
  Synthetic Oligonucleotide; PD-L1 exon 6; Set A
aaugucagugcuacaccaaggcauaauaaga

SEQ ID NO: 24308 - RNA, 33 nt, Artificial Sequence
  Synthetic Oligonucleotide; PD-L1 exon 6; Set A
gaaugucagugcuacaccaaggcauaauaagau

SEQ ID NO: 24309 - RNA, 30 nt, Artificial Sequence
  Synthetic Oligonucleotide; PD-L1 exon 6; Set A
aaugucagugcuacaccaaggcauaauaag

SEQ ID NO: 24310 - RNA, 32 nt, Artificial Sequence
  Synthetic Oligonucleotide; PD-L1 exon 6; Set A
gaaugucagugcuacaccaaggcauaauaaga

SEQ ID NO: 24311 - RNA, 34 nt, Artificial Sequence
  Synthetic Oligonucleotide; PD-L1 exon 6; Set A
ugaaugucagugcuacaccaaggcauaauaagau

SEQ ID NO: 24312 - RNA, 31 nt, Artificial Sequence
  Synthetic Oligonucleotide; PD-L1 exon 6; Set A
gaaugucagugcuacaccaaggcauaauaag

SEQ ID NO: 24313 - RNA, 22 nt, Artificial Sequence
  Synthetic Oligonucleotide; PD-L1 exon 6; Set A
gucagugcuacaccaaggcaua

SEQ ID NO: 24314 - RNA, 21 nt, Artificial Sequence
  Synthetic Oligonucleotide; PD-L1 exon 6; Set A
gucagugcuacaccaaggcau

SEQ ID NO: 24315 - RNA, 23 nt, Artificial Sequence
  Synthetic Oligonucleotide; PD-L1 exon 6; Set A
ugucagugcuacaccaaggcaua

SEQ ID NO: 24316 - RNA, 22 nt, Artificial Sequence
  Synthetic Oligonucleotide; PD-L1 exon 6; Set A
ugucagugcuacaccaaggcau

SEQ ID NO: 24317 - RNA, 24 nt, Artificial Sequence
  Synthetic Oligonucleotide; PD-L1 exon 6; Set A
augucagugcuacaccaaggcaua

SEQ ID NO: 24318 - RNA, 23 nt, Artificial Sequence
  Synthetic Oligonucleotide; PD-L1 exon 6; Set A
augucagugcuacaccaaggcau

SEQ ID NO: 24319 - RNA, 25 nt, Artificial Sequence
  Synthetic Oligonucleotide; PD-L1 exon 6; Set A
aaugucagugcuacaccaaggcaua

SEQ ID NO: 24320 - RNA, 26 nt, Artificial Sequence
  Synthetic Oligonucleotide; PD-L1 exon 6; Set A
gaaugucagugcuacaccaaggcaua

SEQ ID NO: 24321 - RNA, 24 nt, Artificial Sequence
  Synthetic Oligonucleotide; PD-L1 exon 6; Set A
aaugucagugcuacaccaaggcau

SEQ ID NO: 24322 - RNA, 27 nt, Artificial Sequence
  Synthetic Oligonucleotide; PD-L1 exon 6; Set A
ugaaugucagugcuacaccaaggcaua

SEQ ID NO: 24323 - RNA, 25 nt, Artificial Sequence
  Synthetic Oligonucleotide; PD-L1 exon 6; Set A
gaaugucagugcuacaccaaggcau

SEQ ID NO: 24324 - RNA, 17 nt, Artificial Sequence
  Synthetic Oligonucleotide; PD-L1 exon 6; Set C
gucagugcuacaccaag

SEQ ID NO: 24325 - RNA, 40 nt, Artificial Sequence
  Synthetic Oligonucleotide; PD-L1 exon 6; Set C
cggaagaugaaugucagugcuacaccaaggcauaauaaga

SEQ ID NO: 24326 - RNA, 26 nt, Artificial Sequence
  Synthetic Oligonucleotide; PD-L1 exon 6; Set A
ugaaugucagugcuacaccaaggcau

SEQ ID NO: 24327 - RNA, 16 nt, Artificial Sequence
  Synthetic Oligonucleotide; PD-L1 exon 6; Set C
gucagugcuacaccaa

SEQ ID NO: 24328 - RNA, 18 nt, Artificial Sequence
  Synthetic Oligonucleotide; PD-L1 exon 6; Set C
ugucagugcuacaccaag

SEQ ID NO: 24329 - RNA, 39 nt, Artificial Sequence
  Synthetic Oligonucleotide; PD-L1 exon 6; Set C
cggaagaugaaugucagugcuacaccaaggcauaauaag

SEQ ID NO: 24330 - RNA, 17 nt, Artificial Sequence
  Synthetic Oligonucleotide; PD-L1 exon 6; Set C
ugucagugcuacaccaa

SEQ ID NO: 24331 - RNA, 19 nt, Artificial Sequence
  Synthetic Oligonucleotide; PD-L1 exon 6; Set C
augucagugcuacaccaag

SEQ ID NO: 24332 - RNA, 38 nt, Artificial Sequence
  Synthetic Oligonucleotide; PD-L1 exon 6; Set C
cggaagaugaaugucagugcuacaccaaggcauaauaa

SEQ ID NO: 24333 - RNA, 40 nt, Artificial Sequence
  Synthetic Oligonucleotide; PD-L1 exon 6; Set C
acggaagaugaaugucagugcuacaccaaggcauaauaag

SEQ ID NO: 24334 - RNA, 18 nt, Artificial Sequence
  Synthetic Oligonucleotide; PD-L1 exon 6; Set C
augucagugcuacaccaa

SEQ ID NO: 24335 - RNA, 20 nt, Artificial Sequence
  Synthetic Oligonucleotide; PD-L1 exon 6; Set C
aaugucagugcuacaccaag

SEQ ID NO: 24336 - RNA, 39 nt, Artificial Sequence
  Synthetic Oligonucleotide; PD-L1 exon 6; Set C
acggaagaugaaugucagugcuacaccaaggcauaauaa

SEQ ID NO: 24337 - RNA, 19 nt, Artificial Sequence
  Synthetic Oligonucleotide; PD-L1 exon 6; Set C
aaugucagugcuacaccaa

SEQ ID NO: 24338 - RNA, 21 nt, Artificial Sequence
  Synthetic Oligonucleotide; PD-L1 exon 6; Set C
gaaugucagugcuacaccaag

SEQ ID NO: 24339 - RNA, 20 nt, Artificial Sequence
  Synthetic Oligonucleotide; PD-L1 exon 6; Set C
gaaugucagugcuacaccaa

SEQ ID NO: 24340 - RNA, 22 nt, Artificial Sequence
  Synthetic Oligonucleotide; PD-L1 exon 6; Set C
ugaaugucagugcuacaccaag

SEQ ID NO: 24341 - RNA, 21 nt, Artificial Sequence
  Synthetic Oligonucleotide; PD-L1 exon 6; Set C
ugaaugucagugcuacaccaa

SEQ ID NO: 24342 - RNA, 34 nt, Artificial Sequence
  Synthetic Oligonucleotide; PD-L1 exon 6; Set C
cggaagaugaaugucagugcuacaccaaggcaua

SEQ ID NO: 24343 - RNA, 35 nt, Artificial Sequence
  Synthetic Oligonucleotide; PD-L1 exon 6; Set C
acggaagaugaaugucagugcuacaccaaggcaua

SEQ ID NO: 24344 - RNA, 33 nt, Artificial Sequence
  Synthetic Oligonucleotide; PD-L1 exon 6; Set C
cggaagaugaaugucagugcuacaccaaggcau

SEQ ID NO: 24345 - RNA, 36 nt, Artificial Sequence
  Synthetic Oligonucleotide; PD-L1 exon 6; Set C
aacggaagaugaaugucagugcuacaccaaggcaua

SEQ ID NO: 24346 - RNA, 34 nt, Artificial Sequence
  Synthetic Oligonucleotide; PD-L1 exon 6; Set C
acggaagaugaaugucagugcuacaccaaggcau

SEQ ID NO: 24347 - RNA, 37 nt, Artificial Sequence
  Synthetic Oligonucleotide; PD-L1 exon 6; Set C
aaacggaagaugaaugucagugcuacaccaaggcaua

SEQ ID NO: 24348 - RNA, 35 nt, Artificial Sequence
  Synthetic Oligonucleotide; PD-L1 exon 6; Set C
aacggaagaugaaugucagugcuacaccaaggcau

SEQ ID NO: 24349 - RNA, 38 nt, Artificial Sequence
  Synthetic Oligonucleotide; PD-L1 exon 6; Set C
uaaacggaagaugaaugucagugcuacaccaaggcaua

SEQ ID NO: 24350 - RNA, 36 nt, Artificial Sequence
  Synthetic Oligonucleotide; PD-L1 exon 6; Set C
aaacggaagaugaaugucagugcuacaccaaggcau

SEQ ID NO: 24351 - RNA, 39 nt, Artificial Sequence
  Synthetic Oligonucleotide; PD-L1 exon 6; Set C
uuaaacggaagaugaaugucagugcuacaccaaggcaua

SEQ ID NO: 24352 - RNA, 37 nt, Artificial Sequence
  Synthetic Oligonucleotide; PD-L1 exon 6; Set C
uaaacggaagaugaaugucagugcuacaccaaggcau

SEQ ID NO: 24353 - RNA, 40 nt, Artificial Sequence
  Synthetic Oligonucleotide; PD-L1 exon 6; Set C
cuuaaacggaagaugaaugucagugcuacaccaaggcaua

SEQ ID NO: 24354 - RNA, 38 nt, Artificial Sequence
  Synthetic Oligonucleotide; PD-L1 exon 6; Set C
uuaaacggaagaugaaugucagugcuacaccaaggcau

SEQ ID NO: 24355 - RNA, 30 nt, Artificial Sequence
  Synthetic Oligonucleotide; PD-L1 exon 6; Set A
acggaagaugaaugucagugcuacaccaag

SEQ ID NO: 24356 - RNA, 39 nt, Artificial Sequence
  Synthetic Oligonucleotide; PD-L1 exon 6; Set C
cuuaaacggaagaugaaugucagugcuacaccaaggcau

SEQ ID NO: 24357 - RNA, 29 nt, Artificial Sequence
  Synthetic Oligonucleotide; PD-L1 exon 6; Set A
acggaagaugaaugucagugcuacaccaa

SEQ ID NO: 24358 - RNA, 31 nt, Artificial Sequence
  Synthetic Oligonucleotide; PD-L1 exon 6; Set A
aacggaagaugaaugucagugcuacaccaag

SEQ ID NO: 24359 - RNA, 40 nt, Artificial Sequence
  Synthetic Oligonucleotide; PD-L1 exon 6; Set C
ucuuaaacggaagaugaaugucagugcuacaccaaggcau

SEQ ID NO: 24360 - RNA, 30 nt, Artificial Sequence
  Synthetic Oligonucleotide; PD-L1 exon 6; Set A
aacggaagaugaaugucagugcuacaccaa

SEQ ID NO: 24361 - RNA, 32 nt, Artificial Sequence
  Synthetic Oligonucleotide; PD-L1 exon 6; Set A
aaacggaagaugaaugucagugcuacaccaag

SEQ ID NO: 24362 - RNA, 31 nt, Artificial Sequence
  Synthetic Oligonucleotide; PD-L1 exon 6; Set A
aaacggaagaugaaugucagugcuacaccaa

SEQ ID NO: 24363 - RNA, 33 nt, Artificial Sequence
  Synthetic Oligonucleotide; PD-L1 exon 6; Set A
uaaacggaagaugaaugucagugcuacaccaag

SEQ ID NO: 24364 - RNA, 24 nt, Artificial Sequence
  Synthetic Oligonucleotide; PD-L1 exon 6; Set A
cggaagaugaaugucagugcuaca

SEQ ID NO: 24365 - RNA, 32 nt, Artificial Sequence
  Synthetic Oligonucleotide; PD-L1 exon 6; Set A
uaaacggaagaugaaugucagugcuacaccaa

SEQ ID NO: 24366 - RNA, 34 nt, Artificial Sequence
  Synthetic Oligonucleotide; PD-L1 exon 6; Set A
uuaaacggaagaugaaugucagugcuacaccaag

SEQ ID NO: 24367 - RNA, 25 nt, Artificial Sequence
  Synthetic Oligonucleotide; PD-L1 exon 6; Set A
acggaagaugaaugucagugcuaca

SEQ ID NO: 24368 - RNA, 23 nt, Artificial Sequence
  Synthetic Oligonucleotide; PD-L1 exon 6; Set C
cggaagaugaaugucagugcuac

SEQ ID NO: 24369 - RNA, 33 nt, Artificial Sequence
  Synthetic Oligonucleotide; PD-L1 exon 6; Set A
uuaaacggaagaugaaugucagugcuacaccaa

SEQ ID NO: 24370 - RNA, 35 nt, Artificial Sequence
  Synthetic Oligonucleotide; PD-L1 exon 6; Set A
cuuaaacggaagaugaaugucagugcuacaccaag

SEQ ID NO: 24371 - RNA, 22 nt, Artificial Sequence
  Synthetic Oligonucleotide; PD-L1 exon 6; Set C
cggaagaugaaugucagugcua

SEQ ID NO: 24372 - RNA, 26 nt, Artificial Sequence
  Synthetic Oligonucleotide; PD-L1 exon 6; Set A
aacggaagaugaaugucagugcuaca

SEQ ID NO: 24373 - RNA, 24 nt, Artificial Sequence
  Synthetic Oligonucleotide; PD-L1 exon 6; Set A
acggaagaugaaugucagugcuac

SEQ ID NO: 24374 - RNA, 34 nt, Artificial Sequence
  Synthetic Oligonucleotide; PD-L1 exon 6; Set A
cuuaaacggaagaugaaugucagugcuacaccaa

SEQ ID NO: 24375 - RNA, 36 nt, Artificial Sequence
  Synthetic Oligonucleotide; PD-L1 exon 6; Set A
ucuuaaacggaagaugaaugucagugcuacaccaag

SEQ ID NO: 24376 - RNA, 23 nt, Artificial Sequence
  Synthetic Oligonucleotide; PD-L1 exon 6; Set C
acggaagaugaaugucagugcua

SEQ ID NO: 24377 - RNA, 25 nt, Artificial Sequence
  Synthetic Oligonucleotide; PD-L1 exon 6; Set C
aacggaagaugaaugucagugcuac

SEQ ID NO: 24378 - RNA, 35 nt, Artificial Sequence
  Synthetic Oligonucleotide; PD-L1 exon 6; Set A
ucuuaaacggaagaugaaugucagugcuacaccaa

SEQ ID NO: 24379 - RNA, 37 nt, Artificial Sequence
  Synthetic Oligonucleotide; PD-L1 exon 6; Set A
uucuuaaacggaagaugaaugucagugcuacaccaag

SEQ ID NO: 24380 - RNA, 24 nt, Artificial Sequence
  Synthetic Oligonucleotide; PD-L1 exon 6; Set C
aacggaagaugaaugucagugcua

SEQ ID NO: 24381 - RNA, 26 nt, Artificial Sequence
  Synthetic Oligonucleotide; PD-L1 exon 6; Set C
aaacggaagaugaaugucagugcuac

SEQ ID NO: 24382 - RNA, 36 nt, Artificial Sequence
  Synthetic Oligonucleotide; PD-L1 exon 6; Set A
uucuuaaacggaagaugaaugucagugcuacaccaa

SEQ ID NO: 24383 - RNA, 22 nt, Artificial Sequence
  Synthetic Oligonucleotide; PD-L1 exon 6; Set C
acggaagaugaaugucagugcu

SEQ ID NO: 24384 - RNA, 25 nt, Artificial Sequence
  Synthetic Oligonucleotide; PD-L1 exon 6; Set C
aaacggaagaugaaugucagugcua

SEQ ID NO: 24385 - RNA, 27 nt, Artificial Sequence
  Synthetic Oligonucleotide; PD-L1 exon 6; Set C
uaaacggaagaugaaugucagugcuac

SEQ ID NO: 24386 - RNA, 23 nt, Artificial Sequence
  Synthetic Oligonucleotide; PD-L1 exon 6; Set C
aacggaagaugaaugucagugcu

SEQ ID NO: 24387 - RNA, 24 nt, Artificial Sequence
  Synthetic Oligonucleotide; PD-L1 exon 6; Set C
aaacggaagaugaaugucagugcu

SEQ ID NO: 24388 - RNA, 25 nt, Artificial Sequence
  Synthetic Oligonucleotide; PD-L1 exon 6; Set C
uaaacggaagaugaaugucagugcu

SEQ ID NO: 24389 - RNA, 26 nt, Artificial Sequence
  Synthetic Oligonucleotide; PD-L1 exon 6; Set C
uuaaacggaagaugaaugucagugcu

SEQ ID NO: 24390 - RNA, 15 nt, Artificial Sequence
  Synthetic Oligonucleotide; PD-L1 exon 6; Set C
cggaagaugaauguc

SEQ ID NO: 24391 - RNA, 27 nt, Artificial Sequence
  Synthetic Oligonucleotide; PD-L1 exon 6; Set C
cuuaaacggaagaugaaugucagugcu

SEQ ID NO: 24392 - RNA, 16 nt, Artificial Sequence
  Synthetic Oligonucleotide; PD-L1 exon 6; Set C
acggaagaugaauguc

SEQ ID NO: 24393 - RNA, 28 nt, Artificial Sequence
  Synthetic Oligonucleotide; PD-L1 exon 6; Set A
ucuuaaacggaagaugaaugucagugcu

SEQ ID NO: 24394 - RNA, 15 nt, Artificial Sequence
  Synthetic Oligonucleotide; PD-L1 exon 6; Set C
acggaagaugaaugu

SEQ ID NO: 24395 - RNA, 29 nt, Artificial Sequence
  Synthetic Oligonucleotide; PD-L1 exon 6; Set A
uucuuaaacggaagaugaaugucagugcu

SEQ ID NO: 24396 - RNA, 16 nt, Artificial Sequence
  Synthetic Oligonucleotide; PD-L1 exon 6; Set C
aacggaagaugaaugu

SEQ ID NO: 24397 - RNA, 15 nt, Artificial Sequence
  Synthetic Oligonucleotide; PD-L1 exon 6; Set C
aacggaagaugaaug

SEQ ID NO: 24398 - RNA, 16 nt, Artificial Sequence
  Synthetic Oligonucleotide; PD-L1 exon 6; Set C
aaacggaagaugaaug

SEQ ID NO: 24399 - RNA, 15 nt, Artificial Sequence
  Synthetic Oligonucleotide; PD-L1 exon 6; Set C
aaacggaagaugaau

SEQ ID NO: 24400 - RNA, 39 nt, Artificial Sequence
  Synthetic Oligonucleotide; PD-L1 exon 6; Set C
cuaccuuuucuuaaacggaagaugaaugucagugcuaca

SEQ ID NO: 24401 - RNA, 16 nt, Artificial Sequence
  Synthetic Oligonucleotide; PD-L1 exon 6; Set C
uaaacggaagaugaau

SEQ ID NO: 24402 - RNA, 40 nt, Artificial Sequence
  Synthetic Oligonucleotide; PD-L1 exon 6; Set C
acuaccuuuucuuaaacggaagaugaaugucagugcuaca

SEQ ID NO: 24403 - RNA, 38 nt, Artificial Sequence
  Synthetic Oligonucleotide; PD-L1 exon 6; Set A
cuaccuuuucuuaaacggaagaugaaugucagugcuac

SEQ ID NO: 24404 - RNA, 17 nt, Artificial Sequence
  Synthetic Oligonucleotide; PD-L1 exon 6; Set C
uuaaacggaagaugaau

SEQ ID NO: 24405 - RNA, 15 nt, Artificial Sequence
  Synthetic Oligonucleotide; PD-L1 exon 6; Set C
uaaacggaagaugaa

SEQ ID NO: 24406 - RNA, 37 nt, Artificial Sequence
  Synthetic Oligonucleotide; PD-L1 exon 6; Set A
cuaccuuuucuuaaacggaagaugaaugucagugcua

SEQ ID NO: 24407 - RNA, 39 nt, Artificial Sequence
  Synthetic Oligonucleotide; PD-L1 exon 6; Set A
acuaccuuuucuuaaacggaagaugaaugucagugcuac

SEQ ID NO: 24408 - RNA, 18 nt, Artificial Sequence
  Synthetic Oligonucleotide; PD-L1 exon 6; Set C
cuuaaacggaagaugaau

SEQ ID NO: 24409 - RNA, 16 nt, Artificial Sequence
  Synthetic Oligonucleotide; PD-L1 exon 6; Set C
uuaaacggaagaugaa

SEQ ID NO: 24410 - RNA, 38 nt, Artificial Sequence
  Synthetic Oligonucleotide; PD-L1 exon 6; Set A
acuaccuuuucuuaaacggaagaugaaugucagugcua

SEQ ID NO: 24411 - RNA, 40 nt, Artificial Sequence
  Synthetic Oligonucleotide; PD-L1 exon 6; Set C
uacuaccuuuucuuaaacggaagaugaaugucagugcuac

SEQ ID NO: 24412 - RNA, 36 nt, Artificial Sequence
  Synthetic Oligonucleotide; PD-L1 exon 6; Set A
cuaccuuuucuuaaacggaagaugaaugucagugcu

SEQ ID NO: 24413 - RNA, 15 nt, Artificial Sequence
  Synthetic Oligonucleotide; PD-L1 exon 6; Set C
uuaaacggaagauga

SEQ ID NO: 24414 - RNA, 17 nt, Artificial Sequence
  Synthetic Oligonucleotide; PD-L1 exon 6; Set C
cuuaaacggaagaugaa

SEQ ID NO: 24415 - RNA, 37 nt, Artificial Sequence
  Synthetic Oligonucleotide; PD-L1 exon 6; Set A
acuaccuuuucuuaaacggaagaugaaugucagugcu

SEQ ID NO: 24416 - RNA, 16 nt, Artificial Sequence
  Synthetic Oligonucleotide; PD-L1 exon 6; Set C
cuuaaacggaagauga

SEQ ID NO: 24417 - RNA, 40 nt, Artificial Sequence
  Synthetic Oligonucleotide; PD-L1 exon 6; Set A
auacuaccuuuucuuaaacggaagaugaaugucagugcua

SEQ ID NO: 24418 - RNA, 38 nt, Artificial Sequence
  Synthetic Oligonucleotide; PD-L1 exon 6; Set A
uacuaccuuuucuuaaacggaagaugaaugucagugcu

SEQ ID NO: 24419 - RNA, 17 nt, Artificial Sequence
  Synthetic Oligonucleotide; PD-L1 exon 6; Set C
ucuuaaacggaagauga

SEQ ID NO: 24420 - RNA, 39 nt, Artificial Sequence
  Synthetic Oligonucleotide; PD-L1 exon 6; Set A
auacuaccuuuucuuaaacggaagaugaaugucagugcu

SEQ ID NO: 24421 - RNA, 40 nt, Artificial Sequence
  Synthetic Oligonucleotide; PD-L1 exon 6; Set A
aauacuaccuuuucuuaaacggaagaugaaugucagugcu

SEQ ID NO: 24422 - RNA, 29 nt, Artificial Sequence
  Synthetic Oligonucleotide; PD-L1 exon 6; Set C
cuaccuuuucuuaaacggaagaugaaugu

SEQ ID NO: 24423 - RNA, 28 nt, Artificial Sequence
  Synthetic Oligonucleotide; PD-L1 exon 6; Set C
cuaccuuuucuuaaacggaagaugaaug

SEQ ID NO: 24424 - RNA, 29 nt, Artificial Sequence
  Synthetic Oligonucleotide; PD-L1 exon 6; Set C
acuaccuuuucuuaaacggaagaugaaug

SEQ ID NO: 24425 - RNA, 27 nt, Artificial Sequence
  Synthetic Oligonucleotide; PD-L1 exon 6; Set C
cuaccuuuucuuaaacggaagaugaau

SEQ ID NO: 24426 - RNA, 28 nt, Artificial Sequence
  Synthetic Oligonucleotide; PD-L1 exon 6; Set C
acuaccuuuucuuaaacggaagaugaau

SEQ ID NO: 24427 - RNA, 26 nt, Artificial Sequence
  Synthetic Oligonucleotide; PD-L1 exon 6; Set C
cuaccuuuucuuaaacggaagaugaa

SEQ ID NO: 24428 - RNA, 35 nt, Artificial Sequence
  Synthetic Oligonucleotide; PD-L1 exon 6; Set C
aaauacuaccuuuucuuaaacggaagaugaauguc

SEQ ID NO: 24429 - RNA, 33 nt, Artificial Sequence
  Synthetic Oligonucleotide; PD-L1 exon 6; Set C
aauacuaccuuuucuuaaacggaagaugaaugu

SEQ ID NO: 24430 - RNA, 31 nt, Artificial Sequence
  Synthetic Oligonucleotide; PD-L1 exon 6; Set C
auacuaccuuuucuuaaacggaagaugaaug

SEQ ID NO: 24431 - RNA, 25 nt, Artificial Sequence
  Synthetic Oligonucleotide; PD-L1 exon 6; Set C
cuaccuuuucuuaaacggaagauga

SEQ ID NO: 24432 - RNA, 29 nt, Artificial Sequence
  Synthetic Oligonucleotide; PD-L1 exon 6; Set C
uacuaccuuuucuuaaacggaagaugaau

SEQ ID NO: 24433 - RNA, 27 nt, Artificial Sequence
  Synthetic Oligonucleotide; PD-L1 exon 6; Set C
acuaccuuuucuuaaacggaagaugaa

SEQ ID NO: 24434 - RNA, 34 nt, Artificial Sequence
  Synthetic Oligonucleotide; PD-L1 exon 6; Set C
aaauacuaccuuuucuuaaacggaagaugaaugu

SEQ ID NO: 24435 - RNA, 32 nt, Artificial Sequence
  Synthetic Oligonucleotide; PD-L1 exon 6; Set C
aauacuaccuuuucuuaaacggaagaugaaug

SEQ ID NO: 24436 - RNA, 26 nt, Artificial Sequence
  Synthetic Oligonucleotide; PD-L1 exon 6; Set C
acuaccuuuucuuaaacggaagauga

SEQ ID NO: 24437 - RNA, 28 nt, Artificial Sequence
  Synthetic Oligonucleotide; PD-L1 exon 6; Set C
uacuaccuuuucuuaaacggaagaugaa

SEQ ID NO: 24438 - RNA, 30 nt, Artificial Sequence
  Synthetic Oligonucleotide; PD-L1 exon 6; Set C
auacuaccuuuucuuaaacggaagaugaau

SEQ ID NO: 24439 - RNA, 33 nt, Artificial Sequence
  Synthetic Oligonucleotide; PD-L1 exon 6; Set C
aaauacuaccuuuucuuaaacggaagaugaaug

SEQ ID NO: 24440 - RNA, 27 nt, Artificial Sequence
  Synthetic Oligonucleotide; PD-L1 exon 6; Set C
uacuaccuuuucuuaaacggaagauga

SEQ ID NO: 24441 - RNA, 29 nt, Artificial Sequence
  Synthetic Oligonucleotide; PD-L1 exon 6; Set C
auacuaccuuuucuuaaacggaagaugaa

SEQ ID NO: 24442 - RNA, 31 nt, Artificial Sequence
  Synthetic Oligonucleotide; PD-L1 exon 6; Set C
aauacuaccuuuucuuaaacggaagaugaau

SEQ ID NO: 24443 - RNA, 28 nt, Artificial Sequence
  Synthetic Oligonucleotide; PD-L1 exon 6; Set C
auacuaccuuuucuuaaacggaagauga

SEQ ID NO: 24444 - RNA, 30 nt, Artificial Sequence
  Synthetic Oligonucleotide; PD-L1 exon 6; Set C
aauacuaccuuuucuuaaacggaagaugaa

SEQ ID NO: 24445 - RNA, 32 nt, Artificial Sequence
  Synthetic Oligonucleotide; PD-L1 exon 6; Set C
aaauacuaccuuuucuuaaacggaagaugaau

SEQ ID NO: 24446 - RNA, 29 nt, Artificial Sequence
  Synthetic Oligonucleotide; PD-L1 exon 6; Set C
aauacuaccuuuucuuaaacggaagauga

SEQ ID NO: 24447 - RNA, 31 nt, Artificial Sequence
  Synthetic Oligonucleotide; PD-L1 exon 6; Set C
aaauacuaccuuuucuuaaacggaagaugaa

SEQ ID NO: 24448 - RNA, 30 nt, Artificial Sequence
  Synthetic Oligonucleotide; PD-L1 exon 6; Set C
aaauacuaccuuuucuuaaacggaagauga

SEQ ID NO: 24449 - RNA, 40 nt, Artificial Sequence
  Synthetic Oligonucleotide; PD-L1 exon 6; Set A
auuaaggaaauacuaccuuuucuuaaacggaagaugaaug

SEQ ID NO: 24450 - RNA, 39 nt, Artificial Sequence
  Synthetic Oligonucleotide; PD-L1 exon 6; Set A
auuaaggaaauacuaccuuuucuuaaacggaagaugaau

SEQ ID NO: 24451 - RNA, 40 nt, Artificial Sequence
  Synthetic Oligonucleotide; PD-L1 exon 6; Set A
aauuaaggaaauacuaccuuuucuuaaacggaagaugaau

SEQ ID NO: 24452 - RNA, 38 nt, Artificial Sequence
  Synthetic Oligonucleotide; PD-L1 exon 6; Set A
auuaaggaaauacuaccuuuucuuaaacggaagaugaa

SEQ ID NO: 24453 - RNA, 37 nt, Artificial Sequence
  Synthetic Oligonucleotide; PD-L1 exon 6; Set A
auuaaggaaauacuaccuuuucuuaaacggaagauga

SEQ ID NO: 24454 - RNA, 39 nt, Artificial Sequence
  Synthetic Oligonucleotide; PD-L1 exon 6; Set A
aauuaaggaaauacuaccuuuucuuaaacggaagaugaa

SEQ ID NO: 24455 - RNA, 23 nt, Artificial Sequence
  Synthetic Oligonucleotide; PD-L1 exon 6; Set C
aaauacuaccuuuucuuaaacgg

SEQ ID NO: 24456 - RNA, 38 nt, Artificial Sequence
  Synthetic Oligonucleotide; PD-L1 exon 6; Set A
aauuaaggaaauacuaccuuuucuuaaacggaagauga

SEQ ID NO: 24457 - RNA, 40 nt, Artificial Sequence
  Synthetic Oligonucleotide; PD-L1 exon 6; Set A
caauuaaggaaauacuaccuuuucuuaaacggaagaugaa

SEQ ID NO: 24458 - RNA, 39 nt, Artificial Sequence
  Synthetic Oligonucleotide; PD-L1 exon 6; Set A
caauuaaggaaauacuaccuuuucuuaaacggaagauga

SEQ ID NO: 24459 - RNA, 30 nt, Artificial Sequence
  Synthetic Oligonucleotide; PD-L1 exon 6; Set C
auuaaggaaauacuaccuuuucuuaaacgg

SEQ ID NO: 24460 - RNA, 31 nt, Artificial Sequence
  Synthetic Oligonucleotide; PD-L1 exon 6; Set C
aauuaaggaaauacuaccuuuucuuaaacgg

SEQ ID NO: 24461 - RNA, 32 nt, Artificial Sequence
  Synthetic Oligonucleotide; PD-L1 exon 6; Set C
caauuaaggaaauacuaccuuuucuuaaacgg

SEQ ID NO: 24462 - RNA, 27 nt, Artificial Sequence
  Synthetic Oligonucleotide; PD-L1 exon 6; Set C
auuaaggaaauacuaccuuuucuuaaa

SEQ ID NO: 24463 - RNA, 26 nt, Artificial Sequence
  Synthetic Oligonucleotide; PD-L1 exon 6; Set C
auuaaggaaauacuaccuuuucuuaa

SEQ ID NO: 24464 - RNA, 25 nt, Artificial Sequence
  Synthetic Oligonucleotide; PD-L1 exon 6; Set C
auuaaggaaauacuaccuuuucuua

SEQ ID NO: 24465 - RNA, 24 nt, Artificial Sequence
  Synthetic Oligonucleotide; PD-L1 exon 6; Set C
auuaaggaaauacuaccuuuucuu

SEQ ID NO: 24466 - RNA, 23 nt, Artificial Sequence
  Synthetic Oligonucleotide; PD-L1 exon 6; Set C
auuaaggaaauacuaccuuuucu

SEQ ID NO: 24467 - RNA, 22 nt, Artificial Sequence
  Synthetic Oligonucleotide; PD-L1 exon 6; Set C
auuaaggaaauacuaccuuuuc

SEQ ID NO: 24468 - RNA, 40 nt, Artificial Sequence
  Synthetic Oligonucleotide; PD-L1 exon 6; Set B
agaccacugcaauuaaggaaauacuaccuuuucuuaaacg

SEQ ID NO: 24469 - RNA, 39 nt, Artificial Sequence
  Synthetic Oligonucleotide; PD-L1 exon 6; Set B
agaccacugcaauuaaggaaauacuaccuuuucuuaaac

SEQ ID NO: 24470 - RNA, 38 nt, Artificial Sequence
  Synthetic Oligonucleotide; PD-L1 exon 6; Set B
agaccacugcaauuaaggaaauacuaccuuuucuuaaa

SEQ ID NO: 24471 - RNA, 37 nt, Artificial Sequence
  Synthetic Oligonucleotide; PD-L1 exon 6; Set B
agaccacugcaauuaaggaaauacuaccuuuucuuaa

SEQ ID NO: 24472 - RNA, 36 nt, Artificial Sequence
  Synthetic Oligonucleotide; PD-L1 exon 6; Set B
agaccacugcaauuaaggaaauacuaccuuuucuua

SEQ ID NO: 24473 - RNA, 35 nt, Artificial Sequence
  Synthetic Oligonucleotide; PD-L1 exon 6; Set B
agaccacugcaauuaaggaaauacuaccuuuucuu

SEQ ID NO: 24474 - RNA, 26 nt, Artificial Sequence
  Synthetic Oligonucleotide; PD-L1 exon 6; Set C
caaacugacuaaagauaaaauuuuga

SEQ ID NO: 24475 - RNA, 27 nt, Artificial Sequence
  Synthetic Oligonucleotide; PD-L1 exon 6; Set C
acaaacugacuaaagauaaaauuuuga

SEQ ID NO: 24476 - RNA, 25 nt, Artificial Sequence
  Synthetic Oligonucleotide; PD-L1 exon 6; Set C
caaacugacuaaagauaaaauuuug

SEQ ID NO: 24477 - RNA, 24 nt, Artificial Sequence
  Synthetic Oligonucleotide; PD-L1 exon 6; Set C
caaacugacuaaagauaaaauuuu

SEQ ID NO: 24478 - RNA, 26 nt, Artificial Sequence
  Synthetic Oligonucleotide; PD-L1 exon 6; Set C
acaaacugacuaaagauaaaauuuug

SEQ ID NO: 24479 - RNA, 23 nt, Artificial Sequence
  Synthetic Oligonucleotide; PD-L1 exon 6; Set C
caaacugacuaaagauaaaauuu

SEQ ID NO: 24480 - RNA, 22 nt, Artificial Sequence
  Synthetic Oligonucleotide; PD-L1 exon 6; Set C
caaacugacuaaagauaaaauu

SEQ ID NO: 24481 - RNA, 23 nt, Artificial Sequence
  Synthetic Oligonucleotide; PD-L1 exon 6; Set C
acaaacugacuaaagauaaaauu

SEQ ID NO: 24482 - RNA, 21 nt, Artificial Sequence
  Synthetic Oligonucleotide; PD-L1 exon 6; Set C
caaacugacuaaagauaaaau

SEQ ID NO: 24483 - RNA, 22 nt, Artificial Sequence
  Synthetic Oligonucleotide; PD-L1 exon 6; Set C
acaaacugacuaaagauaaaau

SEQ ID NO: 24484 - RNA, 21 nt, Artificial Sequence
  Synthetic Oligonucleotide; PD-L1 exon 6; Set C
acaaacugacuaaagauaaaa

SEQ ID NO: 24485 - RNA, 21 nt, Artificial Sequence
  Synthetic Oligonucleotide; PD-L1 exon 6; Set C
aacaaacugacuaaagauaaa

SEQ ID NO: 24486 - RNA, 20 nt, Artificial Sequence
  Synthetic Oligonucleotide; PD-L1 exon 6; Set C
aacaaacugacuaaagauaa

SEQ ID NO: 24487 - RNA, 21 nt, Artificial Sequence
  Synthetic Oligonucleotide; PD-L1 exon 6; Set C
aaacaaacugacuaaagauaa

SEQ ID NO: 24488 - RNA, 19 nt, Artificial Sequence
  Synthetic Oligonucleotide; PD-L1 exon 6; Set C
aacaaacugacuaaagaua

SEQ ID NO: 24489 - RNA, 20 nt, Artificial Sequence
  Synthetic Oligonucleotide; PD-L1 exon 6; Set C
aaacaaacugacuaaagaua

SEQ ID NO: 24490 - RNA, 18 nt, Artificial Sequence
  Synthetic Oligonucleotide; PD-L1 exon 6; Set C
aacaaacugacuaaagau

SEQ ID NO: 24491 - RNA, 17 nt, Artificial Sequence
  Synthetic Oligonucleotide; PD-L1 exon 6; Set C
aacaaacugacuaaaga

SEQ ID NO: 24492 - RNA, 21 nt, Artificial Sequence
  Synthetic Oligonucleotide; PD-L1 exon 6; Set C
aaaacaaacugacuaaagaua

SEQ ID NO: 24493 - RNA, 19 nt, Artificial Sequence
  Synthetic Oligonucleotide; PD-L1 exon 6; Set C
aaacaaacugacuaaagau

SEQ ID NO: 24494 - RNA, 16 nt, Artificial Sequence
  Synthetic Oligonucleotide; PD-L1 exon 6; Set C
aacaaacugacuaaag

SEQ ID NO: 24495 - RNA, 18 nt, Artificial Sequence
  Synthetic Oligonucleotide; PD-L1 exon 6; Set C
aaacaaacugacuaaaga

SEQ ID NO: 24496 - RNA, 20 nt, Artificial Sequence
  Synthetic Oligonucleotide; PD-L1 exon 6; Set C
aaaacaaacugacuaaagau

SEQ ID NO: 24497 - RNA, 17 nt, Artificial Sequence
  Synthetic Oligonucleotide; PD-L1 exon 6; Set C
aaacaaacugacuaaag

SEQ ID NO: 24498 - RNA, 19 nt, Artificial Sequence
  Synthetic Oligonucleotide; PD-L1 exon 6; Set C
aaaacaaacugacuaaaga

SEQ ID NO: 24499 - RNA, 21 nt, Artificial Sequence
  Synthetic Oligonucleotide; PD-L1 exon 6; Set C
gaaaacaaacugacuaaagau

SEQ ID NO: 24500 - RNA, 18 nt, Artificial Sequence
  Synthetic Oligonucleotide; PD-L1 exon 6; Set C
aaaacaaacugacuaaag

SEQ ID NO: 24501 - RNA, 20 nt, Artificial Sequence
  Synthetic Oligonucleotide; PD-L1 exon 6; Set C
gaaaacaaacugacuaaaga

SEQ ID NO: 24502 - RNA, 19 nt, Artificial Sequence
  Synthetic Oligonucleotide; PD-L1 exon 6; Set C
gaaaacaaacugacuaaag

SEQ ID NO: 24503 - RNA, 17 nt, Artificial Sequence
  Synthetic Oligonucleotide; PD-L1 exon 6; Set C
aaaacaaacugacuaaa

SEQ ID NO: 24504 - RNA, 20 nt, Artificial Sequence
  Synthetic Oligonucleotide; PD-L1 exon 6; Set C
cgaaaacaaacugacuaaag

SEQ ID NO: 24505 - RNA, 16 nt, Artificial Sequence
  Synthetic Oligonucleotide; PD-L1 exon 6; Set C
aaaacaaacugacuaa

SEQ ID NO: 24506 - RNA, 18 nt, Artificial Sequence
  Synthetic Oligonucleotide; PD-L1 exon 6; Set C
gaaaacaaacugacuaaa

SEQ ID NO: 24507 - RNA, 33 nt, Artificial Sequence
  Synthetic Oligonucleotide; PD-L1 exon 6; Set C
aacaaaacgaaaacaaacugacuaaagauaaaa

SEQ ID NO: 24508 - RNA, 21 nt, Artificial Sequence
  Synthetic Oligonucleotide; PD-L1 exon 6; Set C
acgaaaacaaacugacuaaag

SEQ ID NO: 24509 - RNA, 17 nt, Artificial Sequence
  Synthetic Oligonucleotide; PD-L1 exon 6; Set C
gaaaacaaacugacuaa

SEQ ID NO: 24510 - RNA, 19 nt, Artificial Sequence
  Synthetic Oligonucleotide; PD-L1 exon 6; Set C
cgaaaacaaacugacuaaa

SEQ ID NO: 24511 - RNA, 32 nt, Artificial Sequence
  Synthetic Oligonucleotide; PD-L1 exon 6; Set C
aacaaaacgaaaacaaacugacuaaagauaaa

SEQ ID NO: 24512 - RNA, 16 nt, Artificial Sequence
  Synthetic Oligonucleotide; PD-L1 exon 6; Set C
gaaaacaaacugacua

SEQ ID NO: 24513 - RNA, 18 nt, Artificial Sequence
  Synthetic Oligonucleotide; PD-L1 exon 6; Set C
cgaaaacaaacugacuaa

SEQ ID NO: 24514 - RNA, 20 nt, Artificial Sequence
  Synthetic Oligonucleotide; PD-L1 exon 6; Set C
acgaaaacaaacugacuaaa

SEQ ID NO: 24515 - RNA, 33 nt, Artificial Sequence
  Synthetic Oligonucleotide; PD-L1 exon 6; Set C
aaacaaaacgaaaacaaacugacuaaagauaaa

SEQ ID NO: 24516 - RNA, 31 nt, Artificial Sequence
  Synthetic Oligonucleotide; PD-L1 exon 6; Set C
aacaaaacgaaaacaaacugacuaaagauaa

SEQ ID NO: 24517 - RNA, 27 nt, Artificial Sequence
  Synthetic Oligonucleotide; PD-L1 exon 6; Set C
caaaacgaaaacaaacugacuaaagau

SEQ ID NO: 24518 - RNA, 15 nt, Artificial Sequence
  Synthetic Oligonucleotide; PD-L1 exon 6; Set C
gaaaacaaacugacu

SEQ ID NO: 24519 - RNA, 17 nt, Artificial Sequence
  Synthetic Oligonucleotide; PD-L1 exon 6; Set C
cgaaaacaaacugacua

SEQ ID NO: 24520 - RNA, 19 nt, Artificial Sequence
  Synthetic Oligonucleotide; PD-L1 exon 6; Set C
acgaaaacaaacugacuaa

SEQ ID NO: 24521 - RNA, 21 nt, Artificial Sequence
  Synthetic Oligonucleotide; PD-L1 exon 6; Set C
aacgaaaacaaacugacuaaa

SEQ ID NO: 24522 - RNA, 32 nt, Artificial Sequence
  Synthetic Oligonucleotide; PD-L1 exon 6; Set C
aaacaaaacgaaaacaaacugacuaaagauaa

SEQ ID NO: 24523 - RNA, 30 nt, Artificial Sequence
  Synthetic Oligonucleotide; PD-L1 exon 6; Set C
aacaaaacgaaaacaaacugacuaaagaua

SEQ ID NO: 24524 - RNA, 16 nt, Artificial Sequence
  Synthetic Oligonucleotide; PD-L1 exon 6; Set C
cgaaaacaaacugacu

SEQ ID NO: 24525 - RNA, 20 nt, Artificial Sequence
  Synthetic Oligonucleotide; PD-L1 exon 6; Set C
aacgaaaacaaacugacuaa

SEQ ID NO: 24526 - RNA, 18 nt, Artificial Sequence
  Synthetic Oligonucleotide; PD-L1 exon 6; Set C
acgaaaacaaacugacua

SEQ ID NO: 24527 - RNA, 22 nt, Artificial Sequence
  Synthetic Oligonucleotide; PD-L1 exon 6; Set C
aaacgaaaacaaacugacuaaa

SEQ ID NO: 24528 - RNA, 25 nt, Artificial Sequence
  Synthetic Oligonucleotide; PD-L1 exon 6; Set C
caaaacgaaaacaaacugacuaaag

SEQ ID NO: 24529 - RNA, 31 nt, Artificial Sequence
  Synthetic Oligonucleotide; PD-L1 exon 6; Set C
aaacaaaacgaaaacaaacugacuaaagaua

SEQ ID NO: 24530 - RNA, 29 nt, Artificial Sequence
  Synthetic Oligonucleotide; PD-L1 exon 6; Set C
aacaaaacgaaaacaaacugacuaaagau

SEQ ID NO: 24531 - RNA, 17 nt, Artificial Sequence
  Synthetic Oligonucleotide; PD-L1 exon 6; Set C
acgaaaacaaacugacu

SEQ ID NO: 24532 - RNA, 21 nt, Artificial Sequence
  Synthetic Oligonucleotide; PD-L1 exon 6; Set C
aaacgaaaacaaacugacuaa

SEQ ID NO: 24533 - RNA, 19 nt, Artificial Sequence
  Synthetic Oligonucleotide; PD-L1 exon 6; Set C
aacgaaaacaaacugacua

SEQ ID NO: 24534 - RNA, 23 nt, Artificial Sequence
  Synthetic Oligonucleotide; PD-L1 exon 6; Set C
aaaacgaaaacaaacugacuaaa

SEQ ID NO: 24535 - RNA, 28 nt, Artificial Sequence
  Synthetic Oligonucleotide; PD-L1 exon 6; Set C
aacaaaacgaaaacaaacugacuaaaga

SEQ ID NO: 24536 - RNA, 30 nt, Artificial Sequence
  Synthetic Oligonucleotide; PD-L1 exon 6; Set C
aaacaaaacgaaaacaaacugacuaaagau

SEQ ID NO: 24537 - RNA, 18 nt, Artificial Sequence
  Synthetic Oligonucleotide; PD-L1 exon 6; Set C
aacgaaaacaaacugacu

SEQ ID NO: 24538 - RNA, 22 nt, Artificial Sequence
  Synthetic Oligonucleotide; PD-L1 exon 6; Set C
aaaacgaaaacaaacugacuaa

SEQ ID NO: 24539 - RNA, 20 nt, Artificial Sequence
  Synthetic Oligonucleotide; PD-L1 exon 6; Set C
aaacgaaaacaaacugacua

SEQ ID NO: 24540 - RNA, 24 nt, Artificial Sequence
  Synthetic Oligonucleotide; PD-L1 exon 6; Set C
caaaacgaaaacaaacugacuaaa

SEQ ID NO: 24541 - RNA, 27 nt, Artificial Sequence
  Synthetic Oligonucleotide; PD-L1 exon 6; Set C
aacaaaacgaaaacaaacugacuaaag

SEQ ID NO: 24542 - RNA, 29 nt, Artificial Sequence
  Synthetic Oligonucleotide; PD-L1 exon 6; Set C
aaacaaaacgaaaacaaacugacuaaaga

SEQ ID NO: 24543 - RNA, 19 nt, Artificial Sequence
  Synthetic Oligonucleotide; PD-L1 exon 6; Set C
aaacgaaaacaaacugacu

SEQ ID NO: 24544 - RNA, 21 nt, Artificial Sequence
  Synthetic Oligonucleotide; PD-L1 exon 6; Set C
aaaacgaaaacaaacugacua

SEQ ID NO: 24545 - RNA, 23 nt, Artificial Sequence
  Synthetic Oligonucleotide; PD-L1 exon 6; Set C
caaaacgaaaacaaacugacuaa

SEQ ID NO: 24546 - RNA, 25 nt, Artificial Sequence
  Synthetic Oligonucleotide; PD-L1 exon 6; Set C
acaaaacgaaaacaaacugacuaaa

SEQ ID NO: 24547 - RNA, 28 nt, Artificial Sequence
  Synthetic Oligonucleotide; PD-L1 exon 6; Set C
aaacaaaacgaaaacaaacugacuaaag

SEQ ID NO: 24548 - RNA, 20 nt, Artificial Sequence
  Synthetic Oligonucleotide; PD-L1 exon 6; Set C
aaaacgaaaacaaacugacu

SEQ ID NO: 24549 - RNA, 24 nt, Artificial Sequence
  Synthetic Oligonucleotide; PD-L1 exon 6; Set C
acaaaacgaaaacaaacugacuaa

SEQ ID NO: 24550 - RNA, 22 nt, Artificial Sequence
  Synthetic Oligonucleotide; PD-L1 exon 6; Set C
caaaacgaaaacaaacugacua

SEQ ID NO: 24551 - RNA, 26 nt, Artificial Sequence
  Synthetic Oligonucleotide; PD-L1 exon 6; Set C
aacaaaacgaaaacaaacugacuaaa

SEQ ID NO: 24552 - RNA, 21 nt, Artificial Sequence
  Synthetic Oligonucleotide; PD-L1 exon 6; Set C
caaaacgaaaacaaacugacu

SEQ ID NO: 24553 - RNA, 23 nt, Artificial Sequence
  Synthetic Oligonucleotide; PD-L1 exon 6; Set C
acaaaacgaaaacaaacugacua

SEQ ID NO: 24554 - RNA, 25 nt, Artificial Sequence
  Synthetic Oligonucleotide; PD-L1 exon 6; Set C
aacaaaacgaaaacaaacugacuaa

SEQ ID NO: 24555 - RNA, 27 nt, Artificial Sequence
  Synthetic Oligonucleotide; PD-L1 exon 6; Set C
aaacaaaacgaaaacaaacugacuaaa

SEQ ID NO: 24556 - RNA, 22 nt, Artificial Sequence
  Synthetic Oligonucleotide; PD-L1 exon 6; Set C
acaaaacgaaaacaaacugacu

SEQ ID NO: 24557 - RNA, 26 nt, Artificial Sequence
  Synthetic Oligonucleotide; PD-L1 exon 6; Set C
aaacaaaacgaaaacaaacugacuaa

SEQ ID NO: 24558 - RNA, 24 nt, Artificial Sequence
  Synthetic Oligonucleotide; PD-L1 exon 6; Set C
aacaaaacgaaaacaaacugacua

SEQ ID NO: 24559 - RNA, 23 nt, Artificial Sequence
  Synthetic Oligonucleotide; PD-L1 exon 6; Set C
aacaaaacgaaaacaaacugacu

SEQ ID NO: 24560 - RNA, 25 nt, Artificial Sequence
  Synthetic Oligonucleotide; PD-L1 exon 6; Set C
aaacaaaacgaaaacaaacugacua

SEQ ID NO: 24561 - RNA, 24 nt, Artificial Sequence
  Synthetic Oligonucleotide; PD-L1 exon 6; Set C
aaacaaaacgaaaacaaacugacu

SEQ ID NO: 24562 - RNA, 32 nt, Artificial Sequence
  Synthetic Oligonucleotide; PD-L1 exon 6; Set C
aaacaaaacaaaacgaaaacaaacugacuaaa

SEQ ID NO: 24563 - RNA, 31 nt, Artificial Sequence
  Synthetic Oligonucleotide; PD-L1 exon 6; Set C
aaacaaaacaaaacgaaaacaaacugacuaa

SEQ ID NO: 24564 - RNA, 33 nt, Artificial Sequence
  Synthetic Oligonucleotide; PD-L1 exon 6; Set C
aaaacaaaacaaaacgaaaacaaacugacuaaa

SEQ ID NO: 24565 - RNA, 30 nt, Artificial Sequence
  Synthetic Oligonucleotide; PD-L1 exon 6; Set C
aaacaaaacaaaacgaaaacaaacugacua

SEQ ID NO: 24566 - RNA, 32 nt, Artificial Sequence
  Synthetic Oligonucleotide; PD-L1 exon 6; Set C
aaaacaaaacaaaacgaaaacaaacugacuaa

SEQ ID NO: 24567 - RNA, 34 nt, Artificial Sequence
  Synthetic Oligonucleotide; PD-L1 exon 6; Set C
aaaaacaaaacaaaacgaaaacaaacugacuaaa

SEQ ID NO: 24568 - RNA, 29 nt, Artificial Sequence
  Synthetic Oligonucleotide; PD-L1 exon 6; Set C
aaacaaaacaaaacgaaaacaaacugacu

SEQ ID NO: 24569 - RNA, 31 nt, Artificial Sequence
  Synthetic Oligonucleotide; PD-L1 exon 6; Set C
aaaacaaaacaaaacgaaaacaaacugacua

SEQ ID NO: 24570 - RNA, 33 nt, Artificial Sequence
  Synthetic Oligonucleotide; PD-L1 exon 6; Set C
aaaaacaaaacaaaacgaaaacaaacugacuaa

SEQ ID NO: 24571 - RNA, 32 nt, Artificial Sequence
  Synthetic Oligonucleotide; PD-L1 exon 6; Set C
aaaaacaaaacaaaacgaaaacaaacugacua

SEQ ID NO: 24572 - RNA, 39 nt, Artificial Sequence
  Synthetic Oligonucleotide; PD-L1 exon 6; Set C
uaguucugaaaaacaaaacaaaacgaaaacaaacugacu

SEQ ID NO: 24573 - RNA, 40 nt, Artificial Sequence
  Synthetic Oligonucleotide; PD-L1 exon 6; Set C
guaguucugaaaaacaaaacaaaacgaaaacaaacugacu

SEQ ID NO: 24574 - RNA, 32 nt, Artificial Sequence
  Synthetic Oligonucleotide; PD-L1 exon 6; Set C
uaguucugaaaaacaaaacaaaacgaaaacaa

SEQ ID NO: 24575 - RNA, 29 nt, Artificial Sequence
  Synthetic Oligonucleotide; PD-L1 exon 6; Set C
aguucugaaaaacaaaacaaaacgaaaac

SEQ ID NO: 24576 - RNA, 31 nt, Artificial Sequence
  Synthetic Oligonucleotide; PD-L1 exon 6; Set C
uaguucugaaaaacaaaacaaaacgaaaaca

SEQ ID NO: 24577 - RNA, 28 nt, Artificial Sequence
  Synthetic Oligonucleotide; PD-L1 exon 6; Set C
aguucugaaaaacaaaacaaaacgaaaa

SEQ ID NO: 24578 - RNA, 27 nt, Artificial Sequence
  Synthetic Oligonucleotide; PD-L1 exon 6; Set C
aguucugaaaaacaaaacaaaacgaaa

SEQ ID NO: 24579 - RNA, 35 nt, Artificial Sequence
  Synthetic Oligonucleotide; PD-L1 exon 6; Set C
agguaguucugaaaaacaaaacaaaacgaaaacaa

SEQ ID NO: 24580 - RNA, 26 nt, Artificial Sequence
  Synthetic Oligonucleotide; PD-L1 exon 6; Set C
aguucugaaaaacaaaacaaaacgaa

SEQ ID NO: 24581 - RNA, 34 nt, Artificial Sequence
  Synthetic Oligonucleotide; PD-L1 exon 6; Set C
agguaguucugaaaaacaaaacaaaacgaaaaca

SEQ ID NO: 24582 - RNA, 36 nt, Artificial Sequence
  Synthetic Oligonucleotide; PD-L1 exon 6; Set C
gagguaguucugaaaaacaaaacaaaacgaaaacaa

SEQ ID NO: 24583 - RNA, 25 nt, Artificial Sequence
  Synthetic Oligonucleotide; PD-L1 exon 6; Set C
aguucugaaaaacaaaacaaaacga

SEQ ID NO: 24584 - RNA, 35 nt, Artificial Sequence
  Synthetic Oligonucleotide; PD-L1 exon 6; Set C
gagguaguucugaaaaacaaaacaaaacgaaaaca

SEQ ID NO: 24585 - RNA, 24 nt, Artificial Sequence
  Synthetic Oligonucleotide; PD-L1 exon 6; Set C
aguucugaaaaacaaaacaaaacg

SEQ ID NO: 24586 - RNA, 23 nt, Artificial Sequence
  Synthetic Oligonucleotide; PD-L1 exon 6; Set C
aguucugaaaaacaaaacaaaac

SEQ ID NO: 24587 - RNA, 24 nt, Artificial Sequence
  Synthetic Oligonucleotide; PD-L1 exon 6; Set C
uaguucugaaaaacaaaacaaaac

SEQ ID NO: 24588 - RNA, 22 nt, Artificial Sequence
  Synthetic Oligonucleotide; PD-L1 exon 6; Set C
aguucugaaaaacaaaacaaaa

SEQ ID NO: 24589 - RNA, 21 nt, Artificial Sequence
  Synthetic Oligonucleotide; PD-L1 exon 6; Set C
aguucugaaaaacaaaacaaa

SEQ ID NO: 24590 - RNA, 23 nt, Artificial Sequence
  Synthetic Oligonucleotide; PD-L1 exon 6; Set C
uaguucugaaaaacaaaacaaaa

SEQ ID NO: 24591 - RNA, 22 nt, Artificial Sequence
  Synthetic Oligonucleotide; PD-L1 exon 6; Set C
uaguucugaaaaacaaaacaaa

SEQ ID NO: 24592 - RNA, 21 nt, Artificial Sequence
  Synthetic Oligonucleotide; PD-L1 exon 6; Set C
uaguucugaaaaacaaaacaa

SEQ ID NO: 24593 - RNA, 22 nt, Artificial Sequence
  Synthetic Oligonucleotide; PD-L1 exon 6; Set C
guaguucugaaaaacaaaacaa

SEQ ID NO: 24594 - RNA, 20 nt, Artificial Sequence
  Synthetic Oligonucleotide; PD-L1 exon 6; Set C
uaguucugaaaaacaaaaca

SEQ ID NO: 24595 - RNA, 21 nt, Artificial Sequence
  Synthetic Oligonucleotide; PD-L1 exon 6; Set C
guaguucugaaaaacaaaaca

SEQ ID NO: 24596 - RNA, 23 nt, Artificial Sequence
  Synthetic Oligonucleotide; PD-L1 exon 6; Set C
gguaguucugaaaaacaaaacaa

SEQ ID NO: 24597 - RNA, 22 nt, Artificial Sequence
  Synthetic Oligonucleotide; PD-L1 exon 6; Set C
gguaguucugaaaaacaaaaca

SEQ ID NO: 24598 - RNA, 24 nt, Artificial Sequence
  Synthetic Oligonucleotide; PD-L1 exon 6; Set C
agguaguucugaaaaacaaaacaa

SEQ ID NO: 24599 - RNA, 20 nt, Artificial Sequence
  Synthetic Oligonucleotide; PD-L1 exon 6; Set C
guaguucugaaaaacaaaac

SEQ ID NO: 24600 - RNA, 23 nt, Artificial Sequence
  Synthetic Oligonucleotide; PD-L1 exon 6; Set C
agguaguucugaaaaacaaaaca

SEQ ID NO: 24601 - RNA, 25 nt, Artificial Sequence
  Synthetic Oligonucleotide; PD-L1 exon 6; Set C
gagguaguucugaaaaacaaaacaa

SEQ ID NO: 24602 - RNA, 19 nt, Artificial Sequence
  Synthetic Oligonucleotide; PD-L1 exon 6; Set C
guaguucugaaaaacaaaa

SEQ ID NO: 24603 - RNA, 21 nt, Artificial Sequence
  Synthetic Oligonucleotide; PD-L1 exon 6; Set C
gguaguucugaaaaacaaaac

SEQ ID NO: 24604 - RNA, 24 nt, Artificial Sequence
  Synthetic Oligonucleotide; PD-L1 exon 6; Set C
gagguaguucugaaaaacaaaaca

SEQ ID NO: 24605 - RNA, 20 nt, Artificial Sequence
  Synthetic Oligonucleotide; PD-L1 exon 6; Set C
gguaguucugaaaaacaaaa

SEQ ID NO: 24606 - RNA, 22 nt, Artificial Sequence
  Synthetic Oligonucleotide; PD-L1 exon 6; Set C
agguaguucugaaaaacaaaac

SEQ ID NO: 24607 - RNA, 21 nt, Artificial Sequence
  Synthetic Oligonucleotide; PD-L1 exon 6; Set C
agguaguucugaaaaacaaaa

SEQ ID NO: 24608 - RNA, 23 nt, Artificial Sequence
  Synthetic Oligonucleotide; PD-L1 exon 6; Set C
gagguaguucugaaaaacaaaac

SEQ ID NO: 24609 - RNA, 22 nt, Artificial Sequence
  Synthetic Oligonucleotide; PD-L1 exon 6; Set C
gagguaguucugaaaaacaaaa

SEQ ID NO: 24610 - RNA, 40 nt, Artificial Sequence
  Synthetic Oligonucleotide; PD-L1 exon 6; Set A
ggaugugccagagguaguucugaaaaacaaaacaaaacga

SEQ ID NO: 24611 - RNA, 39 nt, Artificial Sequence
  Synthetic Oligonucleotide; PD-L1 exon 6; Set A
ggaugugccagagguaguucugaaaaacaaaacaaaacg

SEQ ID NO: 24612 - RNA, 31 nt, Artificial Sequence
  Synthetic Oligonucleotide; PD-L1 exon 6; Set A
gugccagagguaguucugaaaaacaaaacaa

SEQ ID NO: 24613 - RNA, 38 nt, Artificial Sequence
  Synthetic Oligonucleotide; PD-L1 exon 6; Set A
ggaugugccagagguaguucugaaaaacaaaacaaaac

SEQ ID NO: 24614 - RNA, 40 nt, Artificial Sequence
  Synthetic Oligonucleotide; PD-L1 exon 6; Set A
aggaugugccagagguaguucugaaaaacaaaacaaaacg

SEQ ID NO: 24615 - RNA, 30 nt, Artificial Sequence
  Synthetic Oligonucleotide; PD-L1 exon 6; Set A
gugccagagguaguucugaaaaacaaaaca

SEQ ID NO: 24616 - RNA, 37 nt, Artificial Sequence
  Synthetic Oligonucleotide; PD-L1 exon 6; Set A
ggaugugccagagguaguucugaaaaacaaaacaaaa

SEQ ID NO: 24617 - RNA, 39 nt, Artificial Sequence
  Synthetic Oligonucleotide; PD-L1 exon 6; Set A
aggaugugccagagguaguucugaaaaacaaaacaaaac

SEQ ID NO: 24618 - RNA, 31 nt, Artificial Sequence
  Synthetic Oligonucleotide; PD-L1 exon 6; Set A
ugugccagagguaguucugaaaaacaaaaca

SEQ ID NO: 24619 - RNA, 29 nt, Artificial Sequence
  Synthetic Oligonucleotide; PD-L1 exon 6; Set C
gugccagagguaguucugaaaaacaaaac

SEQ ID NO: 24620 - RNA, 36 nt, Artificial Sequence
  Synthetic Oligonucleotide; PD-L1 exon 6; Set A
ggaugugccagagguaguucugaaaaacaaaacaaa

SEQ ID NO: 24621 - RNA, 38 nt, Artificial Sequence
  Synthetic Oligonucleotide; PD-L1 exon 6; Set A
aggaugugccagagguaguucugaaaaacaaaacaaaa

SEQ ID NO: 24622 - RNA, 40 nt, Artificial Sequence
  Synthetic Oligonucleotide; PD-L1 exon 6; Set A
gaggaugugccagagguaguucugaaaaacaaaacaaaac

SEQ ID NO: 24623 - RNA, 32 nt, Artificial Sequence
  Synthetic Oligonucleotide; PD-L1 exon 6; Set A
augugccagagguaguucugaaaaacaaaaca

SEQ ID NO: 24624 - RNA, 28 nt, Artificial Sequence
  Synthetic Oligonucleotide; PD-L1 exon 6; Set C
gugccagagguaguucugaaaaacaaaa

SEQ ID NO: 24625 - RNA, 30 nt, Artificial Sequence
  Synthetic Oligonucleotide; PD-L1 exon 6; Set A
ugugccagagguaguucugaaaaacaaaac

SEQ ID NO: 24626 - RNA, 37 nt, Artificial Sequence
  Synthetic Oligonucleotide; PD-L1 exon 6; Set A
aggaugugccagagguaguucugaaaaacaaaacaaa

SEQ ID NO: 24627 - RNA, 39 nt, Artificial Sequence
  Synthetic Oligonucleotide; PD-L1 exon 6; Set A
gaggaugugccagagguaguucugaaaaacaaaacaaaa

SEQ ID NO: 24628 - RNA, 35 nt, Artificial Sequence
  Synthetic Oligonucleotide; PD-L1 exon 6; Set A
ggaugugccagagguaguucugaaaaacaaaacaa

SEQ ID NO: 24629 - RNA, 29 nt, Artificial Sequence
  Synthetic Oligonucleotide; PD-L1 exon 6; Set C
ugugccagagguaguucugaaaaacaaaa

SEQ ID NO: 24630 - RNA, 31 nt, Artificial Sequence
  Synthetic Oligonucleotide; PD-L1 exon 6; Set A
augugccagagguaguucugaaaaacaaaac

SEQ ID NO: 24631 - RNA, 38 nt, Artificial Sequence
  Synthetic Oligonucleotide; PD-L1 exon 6; Set A
gaggaugugccagagguaguucugaaaaacaaaacaaa

SEQ ID NO: 24632 - RNA, 40 nt, Artificial Sequence
  Synthetic Oligonucleotide; PD-L1 exon 6; Set A
ggaggaugugccagagguaguucugaaaaacaaaacaaaa

SEQ ID NO: 24633 - RNA, 30 nt, Artificial Sequence
  Synthetic Oligonucleotide; PD-L1 exon 6; Set C
augugccagagguaguucugaaaaacaaaa

SEQ ID NO: 24634 - RNA, 32 nt, Artificial Sequence
  Synthetic Oligonucleotide; PD-L1 exon 6; Set A
gaugugccagagguaguucugaaaaacaaaac

SEQ ID NO: 24635 - RNA, 39 nt, Artificial Sequence
  Synthetic Oligonucleotide; PD-L1 exon 6; Set A
ggaggaugugccagagguaguucugaaaaacaaaacaaa

SEQ ID NO: 24636 - RNA, 31 nt, Artificial Sequence
  Synthetic Oligonucleotide; PD-L1 exon 6; Set A
gaugugccagagguaguucugaaaaacaaaa

SEQ ID NO: 24637 - RNA, 39 nt, Artificial Sequence
  Synthetic Oligonucleotide; PD-L1 exon 6; Set A
uggaggaugugccagagguaguucugaaaaacaaaacaa

SEQ ID NO: 24638 - RNA, 40 nt, Artificial Sequence
  Synthetic Oligonucleotide; PD-L1 exon 6; Set A
uuggaggaugugccagagguaguucugaaaaacaaaacaa

SEQ ID NO: 24639 - RNA, 38 nt, Artificial Sequence
  Synthetic Oligonucleotide; PD-L1 exon 6; Set A
uggaggaugugccagagguaguucugaaaaacaaaaca

SEQ ID NO: 24640 - RNA, 39 nt, Artificial Sequence
  Synthetic Oligonucleotide; PD-L1 exon 6; Set A
uuggaggaugugccagagguaguucugaaaaacaaaaca

SEQ ID NO: 24641 - RNA, 37 nt, Artificial Sequence
  Synthetic Oligonucleotide; PD-L1 exon 6; Set A
uggaggaugugccagagguaguucugaaaaacaaaac

SEQ ID NO: 24642 - RNA, 36 nt, Artificial Sequence
  Synthetic Oligonucleotide; PD-L1 exon 6; Set A
uggaggaugugccagagguaguucugaaaaacaaaa

SEQ ID NO: 24643 - RNA, 38 nt, Artificial Sequence
  Synthetic Oligonucleotide; PD-L1 exon 6; Set A
uuggaggaugugccagagguaguucugaaaaacaaaac

SEQ ID NO: 24644 - RNA, 27 nt, Artificial Sequence
  Synthetic Oligonucleotide; PD-L1 exon 6; Set A
ggaugugccagagguaguucugaaaaa

SEQ ID NO: 24645 - RNA, 37 nt, Artificial Sequence
  Synthetic Oligonucleotide; PD-L1 exon 6; Set A
uuggaggaugugccagagguaguucugaaaaacaaaa

SEQ ID NO: 24646 - RNA, 39 nt, Artificial Sequence
  Synthetic Oligonucleotide; PD-L1 exon 6; Set A
uuuggaggaugugccagagguaguucugaaaaacaaaac

SEQ ID NO: 24647 - RNA, 28 nt, Artificial Sequence
  Synthetic Oligonucleotide; PD-L1 exon 6; Set A
aggaugugccagagguaguucugaaaaa

SEQ ID NO: 24648 - RNA, 26 nt, Artificial Sequence
  Synthetic Oligonucleotide; PD-L1 exon 6; Set A
ggaugugccagagguaguucugaaaa

SEQ ID NO: 24649 - RNA, 38 nt, Artificial Sequence
  Synthetic Oligonucleotide; PD-L1 exon 6; Set A
uuuggaggaugugccagagguaguucugaaaaacaaaa

SEQ ID NO: 24650 - RNA, 40 nt, Artificial Sequence
  Synthetic Oligonucleotide; PD-L1 exon 6; Set A
auuuggaggaugugccagagguaguucugaaaaacaaaac

SEQ ID NO: 24651 - RNA, 29 nt, Artificial Sequence
  Synthetic Oligonucleotide; PD-L1 exon 6; Set A
gaggaugugccagagguaguucugaaaaa

SEQ ID NO: 24652 - RNA, 27 nt, Artificial Sequence
  Synthetic Oligonucleotide; PD-L1 exon 6; Set A
aggaugugccagagguaguucugaaaa

SEQ ID NO: 24653 - RNA, 25 nt, Artificial Sequence
  Synthetic Oligonucleotide; PD-L1 exon 6; Set A
ggaugugccagagguaguucugaaa

SEQ ID NO: 24654 - RNA, 39 nt, Artificial Sequence
  Synthetic Oligonucleotide; PD-L1 exon 6; Set A
auuuggaggaugugccagagguaguucugaaaaacaaaa

SEQ ID NO: 24655 - RNA, 30 nt, Artificial Sequence
  Synthetic Oligonucleotide; PD-L1 exon 6; Set A
ggaggaugugccagagguaguucugaaaaa

SEQ ID NO: 24656 - RNA, 28 nt, Artificial Sequence
  Synthetic Oligonucleotide; PD-L1 exon 6; Set A
gaggaugugccagagguaguucugaaaa

SEQ ID NO: 24657 - RNA, 26 nt, Artificial Sequence
  Synthetic Oligonucleotide; PD-L1 exon 6; Set A
aggaugugccagagguaguucugaaa

SEQ ID NO: 24658 - RNA, 40 nt, Artificial Sequence
  Synthetic Oligonucleotide; PD-L1 exon 6; Set A
cauuuggaggaugugccagagguaguucugaaaaacaaaa

SEQ ID NO: 24659 - RNA, 29 nt, Artificial Sequence
  Synthetic Oligonucleotide; PD-L1 exon 6; Set A
ggaggaugugccagagguaguucugaaaa

SEQ ID NO: 24660 - RNA, 27 nt, Artificial Sequence
  Synthetic Oligonucleotide; PD-L1 exon 6; Set A
gaggaugugccagagguaguucugaaa

SEQ ID NO: 24661 - RNA, 28 nt, Artificial Sequence
  Synthetic Oligonucleotide; PD-L1 exon 6; Set A
ggaggaugugccagagguaguucugaaa

SEQ ID NO: 24662 - RNA, 18 nt, Artificial Sequence
  Synthetic Oligonucleotide; PD-L1 exon 6; Set C
ggaugugccagagguagu

SEQ ID NO: 24663 - RNA, 19 nt, Artificial Sequence
  Synthetic Oligonucleotide; PD-L1 exon 6; Set C
aggaugugccagagguagu

SEQ ID NO: 24664 - RNA, 38 nt, Artificial Sequence
  Synthetic Oligonucleotide; PD-L1 exon 6; Set A
uuucauuuggaggaugugccagagguaguucugaaaaa

SEQ ID NO: 24665 - RNA, 18 nt, Artificial Sequence
  Synthetic Oligonucleotide; PD-L1 exon 6; Set C
aggaugugccagagguag

SEQ ID NO: 24666 - RNA, 20 nt, Artificial Sequence
  Synthetic Oligonucleotide; PD-L1 exon 6; Set A
gaggaugugccagagguagu

SEQ ID NO: 24667 - RNA, 37 nt, Artificial Sequence
  Synthetic Oligonucleotide; PD-L1 exon 6; Set C
uuucauuuggaggaugugccagagguaguucugaaaa

SEQ ID NO: 24668 - RNA, 19 nt, Artificial Sequence
  Synthetic Oligonucleotide; PD-L1 exon 6; Set C
gaggaugugccagagguag

SEQ ID NO: 24669 - RNA, 21 nt, Artificial Sequence
  Synthetic Oligonucleotide; PD-L1 exon 6; Set A
ggaggaugugccagagguagu

SEQ ID NO: 24670 - RNA, 20 nt, Artificial Sequence
  Synthetic Oligonucleotide; PD-L1 exon 6; Set A
ggaggaugugccagagguag

SEQ ID NO: 24671 - RNA, 15 nt, Artificial Sequence
  Synthetic Oligonucleotide; PD-L1 exon 6; Set C
aggaugugccagagg

SEQ ID NO: 24672 - RNA, 16 nt, Artificial Sequence
  Synthetic Oligonucleotide; PD-L1 exon 6; Set C
gaggaugugccagagg

SEQ ID NO: 24673 - RNA, 17 nt, Artificial Sequence
  Synthetic Oligonucleotide; PD-L1 exon 6; Set C
ggaggaugugccagagg

SEQ ID NO: 24674 - RNA, 15 nt, Artificial Sequence
  Synthetic Oligonucleotide; PD-L1 exon 6; Set C
gaggaugugccagag

SEQ ID NO: 24675 - RNA, 16 nt, Artificial Sequence
  Synthetic Oligonucleotide; PD-L1 exon 6; Set C
ggaggaugugccagag

SEQ ID NO: 24676 - RNA, 28 nt, Artificial Sequence
  Synthetic Oligonucleotide; PD-L1 exon 6; Set A
uuucauuuggaggaugugccagagguag

SEQ ID NO: 24677 - RNA, 27 nt, Artificial Sequence
  Synthetic Oligonucleotide; PD-L1 exon 6; Set A
uuucauuuggaggaugugccagaggua

SEQ ID NO: 24678 - RNA, 26 nt, Artificial Sequence
  Synthetic Oligonucleotide; PD-L1 exon 6; Set A
uuucauuuggaggaugugccagaggu

SEQ ID NO: 24679 - RNA, 25 nt, Artificial Sequence
  Synthetic Oligonucleotide; PD-L1 exon 6; Set A
uuucauuuggaggaugugccagagg

SEQ ID NO: 24680 - RNA, 24 nt, Artificial Sequence
  Synthetic Oligonucleotide; PD-L1 exon 6; Set A
uuucauuuggaggaugugccagag

SEQ ID NO: 24681 - RNA, 39 nt, Artificial Sequence
  Synthetic Oligonucleotide; PD-L1 exon 6; Set C
aagugaguccuuucauuuggaggaugugccagagguagu

SEQ ID NO: 24682 - RNA, 18 nt, Artificial Sequence
  Synthetic Oligonucleotide; PD-L1 exon 6; Set C
uuucauuuggaggaugug

SEQ ID NO: 24683 - RNA, 40 nt, Artificial Sequence
  Synthetic Oligonucleotide; PD-L1 exon 6; Set C
caagugaguccuuucauuuggaggaugugccagagguagu

SEQ ID NO: 24684 - RNA, 17 nt, Artificial Sequence
  Synthetic Oligonucleotide; PD-L1 exon 6; Set C
uuucauuuggaggaugu

SEQ ID NO: 24685 - RNA, 16 nt, Artificial Sequence
  Synthetic Oligonucleotide; PD-L1 exon 6; Set C
uuucauuuggaggaug

SEQ ID NO: 24686 - RNA, 15 nt, Artificial Sequence
  Synthetic Oligonucleotide; PD-L1 exon 6; Set C
uuucauuuggaggau

SEQ ID NO: 24687 - RNA, 17 nt, Artificial Sequence
  Synthetic Oligonucleotide; PD-L1 exon 6; Set C
guccuuucauuuggagg

SEQ ID NO: 24688 - RNA, 16 nt, Artificial Sequence
  Synthetic Oligonucleotide; PD-L1 exon 6; Set C
guccuuucauuuggag

SEQ ID NO: 24689 - RNA, 15 nt, Artificial Sequence
  Synthetic Oligonucleotide; PD-L1 exon 6; Set C
guccuuucauuugga

SEQ ID NO: 24690 - RNA, 24 nt, Artificial Sequence
  Synthetic Oligonucleotide; PD-L1 exon 6; Set C
aagugaguccuuucauuuggagga

SEQ ID NO: 24691 - RNA, 25 nt, Artificial Sequence
  Synthetic Oligonucleotide; PD-L1 exon 6; Set A
caagugaguccuuucauuuggagga

SEQ ID NO: 24692 - RNA, 23 nt, Artificial Sequence
  Synthetic Oligonucleotide; PD-L1 exon 6; Set C
aagugaguccuuucauuuggagg

SEQ ID NO: 24693 - RNA, 20 nt, Artificial Sequence
  Synthetic Oligonucleotide; PD-L1 exon 6; Set C
aagugaguccuuucauuugg

SEQ ID NO: 24694 - RNA, 19 nt, Artificial Sequence
  Synthetic Oligonucleotide; PD-L1 exon 6; Set C
aagugaguccuuucauuug

SEQ ID NO: 24695 - RNA, 21 nt, Artificial Sequence
  Synthetic Oligonucleotide; PD-L1 exon 6; Set C
caagugaguccuuucauuugg

SEQ ID NO: 24696 - RNA, 20 nt, Artificial Sequence
  Synthetic Oligonucleotide; PD-L1 exon 6; Set C
caagugaguccuuucauuug

SEQ ID NO: 24697 - RNA, 17 nt, Artificial Sequence
  Synthetic Oligonucleotide; PD-L1 exon 6; Set C
aagugaguccuuucauu

SEQ ID NO: 24698 - RNA, 16 nt, Artificial Sequence
  Synthetic Oligonucleotide; PD-L1 exon 6; Set C
aagugaguccuuucau

SEQ ID NO: 24699 - RNA, 18 nt, Artificial Sequence
  Synthetic Oligonucleotide; PD-L1 exon 6; Set C
caagugaguccuuucauu

SEQ ID NO: 24700 - RNA, 15 nt, Artificial Sequence
  Synthetic Oligonucleotide; PD-L1 exon 6; Set C
aagugaguccuuuca

SEQ ID NO: 24701 - RNA, 17 nt, Artificial Sequence
  Synthetic Oligonucleotide; PD-L1 exon 6; Set C
caagugaguccuuucau

SEQ ID NO: 24702 - RNA, 16 nt, Artificial Sequence
  Synthetic Oligonucleotide; PD-L1 exon 6; Set C
caagugaguccuuuca

SEQ ID NO: 24703 - RNA, 15 nt, Artificial Sequence
  Synthetic Oligonucleotide; PD-L1 exon 6; Set C
caagugaguccuuuc

SEQ ID NO: 24704 - RNA, 39 nt, Artificial Sequence
  Synthetic Oligonucleotide; PD-L1 exon 6; Set C
gauggcucccagaauuaccaagugaguccuuucauuugg

SEQ ID NO: 24705 - RNA, 38 nt, Artificial Sequence
  Synthetic Oligonucleotide; PD-L1 exon 6; Set C
gauggcucccagaauuaccaagugaguccuuucauuug

SEQ ID NO: 24706 - RNA, 40 nt, Artificial Sequence
  Synthetic Oligonucleotide; PD-L1 exon 6; Set C
agauggcucccagaauuaccaagugaguccuuucauuugg

SEQ ID NO: 24707 - RNA, 37 nt, Artificial Sequence
  Synthetic Oligonucleotide; PD-L1 exon 6; Set C
gauggcucccagaauuaccaagugaguccuuucauuu

SEQ ID NO: 24708 - RNA, 36 nt, Artificial Sequence
  Synthetic Oligonucleotide; PD-L1 exon 6; Set C
gauggcucccagaauuaccaagugaguccuuucauu

SEQ ID NO: 24709 - RNA, 35 nt, Artificial Sequence
  Synthetic Oligonucleotide; PD-L1 exon 6; Set C
gauggcucccagaauuaccaagugaguccuuucau

SEQ ID NO: 24710 - RNA, 34 nt, Artificial Sequence
  Synthetic Oligonucleotide; PD-L1 exon 6; Set C
gauggcucccagaauuaccaagugaguccuuuca

SEQ ID NO: 24711 - RNA, 33 nt, Artificial Sequence
  Synthetic Oligonucleotide; PD-L1 exon 6; Set C
gauggcucccagaauuaccaagugaguccuuuc

SEQ ID NO: 24712 - RNA, 34 nt, Artificial Sequence
  Synthetic Oligonucleotide; PD-L1 exon 6; Set C
agauggcucccagaauuaccaagugaguccuuuc

SEQ ID NO: 24713 - RNA, 28 nt, Artificial Sequence
  Synthetic Oligonucleotide; PD-L1 exon 6; Set A
gauggcucccagaauuaccaagugaguc

SEQ ID NO: 24714 - RNA, 29 nt, Artificial Sequence
  Synthetic Oligonucleotide; PD-L1 exon 6; Set A
agauggcucccagaauuaccaagugaguc

SEQ ID NO: 24715 - RNA, 30 nt, Artificial Sequence
  Synthetic Oligonucleotide; PD-L1 exon 6; Set A
aagauggcucccagaauuaccaagugaguc

SEQ ID NO: 24716 - RNA, 22 nt, Artificial Sequence
  Synthetic Oligonucleotide; PD-L1 exon 6; Set C
gauggcucccagaauuaccaag

SEQ ID NO: 24717 - RNA, 35 nt, Artificial Sequence
  Synthetic Oligonucleotide; PD-L1 exon 6; Set A
auaauaagauggcucccagaauuaccaagugaguc

SEQ ID NO: 24718 - RNA, 21 nt, Artificial Sequence
  Synthetic Oligonucleotide; PD-L1 exon 6; Set C
gauggcucccagaauuaccaa

SEQ ID NO: 24719 - RNA, 40 nt, Artificial Sequence
  Synthetic Oligonucleotide; PD-L1 exon 6; Set C
aaggcauaauaagauggcucccagaauuaccaagugaguc

SEQ ID NO: 24720 - RNA, 34 nt, Artificial Sequence
  Synthetic Oligonucleotide; PD-L1 exon 6; Set A
aaggcauaauaagauggcucccagaauuaccaag

SEQ ID NO: 24721 - RNA, 33 nt, Artificial Sequence
  Synthetic Oligonucleotide; PD-L1 exon 6; Set A
aaggcauaauaagauggcucccagaauuaccaa

SEQ ID NO: 24722 - RNA, 34 nt, Artificial Sequence
  Synthetic Oligonucleotide; PD-L1 exon 6; Set A
caaggcauaauaagauggcucccagaauuaccaa

SEQ ID NO: 24723 - RNA, 39 nt, Artificial Sequence
  Synthetic Oligonucleotide; PD-L1 exon 6; Set C
uacaccaaggcauaauaagauggcucccagaauuaccaa

SEQ ID NO: 24724 - RNA, 15 nt, Artificial Sequence
  Synthetic Oligonucleotide; PD-L1 exon 6; Set C
aaggcauaauaagau

SEQ ID NO: 24725 - RNA, 21 nt, Artificial Sequence
  Synthetic Oligonucleotide; PD-L1 exon 6; Set C
uacaccaaggcauaauaagau

SEQ ID NO: 24726 - RNA, 23 nt, Artificial Sequence
  Synthetic Oligonucleotide; PD-L1 exon 6; Set C
gcuacaccaaggcauaauaagau

SEQ ID NO: 24727 - RNA, 23 nt, Artificial Sequence
  Synthetic Oligonucleotide; PD-L1 exon 6; Set C
ugcuacaccaaggcauaauaaga

SEQ ID NO: 24728 - RNA, 22 nt, Artificial Sequence
  Synthetic Oligonucleotide; PD-L1 exon 6; Set C
ugcuacaccaaggcauaauaag

SEQ ID NO: 24729 - RNA, 21 nt, Artificial Sequence
  Synthetic Oligonucleotide; PD-L1 exon 6; Set C
ugcuacaccaaggcauaauaa

SEQ ID NO: 24730 - RNA, 29 nt, Artificial Sequence
  Synthetic Oligonucleotide; PD-L1 exon 6; Set A
cggaagaugaaugucagugcuacaccaag

SEQ ID NO: 24731 - RNA, 28 nt, Artificial Sequence
  Synthetic Oligonucleotide; PD-L1 exon 6; Set A
cggaagaugaaugucagugcuacaccaa

SEQ ID NO: 24732 - RNA, 21 nt, Artificial Sequence
  Synthetic Oligonucleotide; PD-L1 exon 6; Set C
cggaagaugaaugucagugcu

SEQ ID NO: 24733 - RNA, 21 nt, Artificial Sequence
  Synthetic Oligonucleotide; PD-L1 exon 6; Set C
acggaagaugaaugucagugc

SEQ ID NO: 24734 - RNA, 22 nt, Artificial Sequence
  Synthetic Oligonucleotide; PD-L1 exon 6; Set C
aacggaagaugaaugucagugc

SEQ ID NO: 24735 - RNA, 23 nt, Artificial Sequence
  Synthetic Oligonucleotide; PD-L1 exon 6; Set C
aaacggaagaugaaugucagugc

SEQ ID NO: 24736 - RNA, 24 nt, Artificial Sequence
  Synthetic Oligonucleotide; PD-L1 exon 6; Set C
uaaacggaagaugaaugucagugc

SEQ ID NO: 24737 - RNA, 25 nt, Artificial Sequence
  Synthetic Oligonucleotide; PD-L1 exon 6; Set C
uuaaacggaagaugaaugucagugc

SEQ ID NO: 24738 - RNA, 26 nt, Artificial Sequence
  Synthetic Oligonucleotide; PD-L1 exon 6; Set C
cuuaaacggaagaugaaugucagugc

SEQ ID NO: 24739 - RNA, 27 nt, Artificial Sequence
  Synthetic Oligonucleotide; PD-L1 exon 6; Set C
ucuuaaacggaagaugaaugucagugc

SEQ ID NO: 24740 - RNA, 28 nt, Artificial Sequence
  Synthetic Oligonucleotide; PD-L1 exon 6; Set C
uucuuaaacggaagaugaaugucagugc

SEQ ID NO: 24741 - RNA, 22 nt, Artificial Sequence
  Synthetic Oligonucleotide; PD-L1 exon 6; Set C
cuuaaacggaagaugaauguca

SEQ ID NO: 24742 - RNA, 23 nt, Artificial Sequence
  Synthetic Oligonucleotide; PD-L1 exon 6; Set C
ucuuaaacggaagaugaauguca

SEQ ID NO: 24743 - RNA, 24 nt, Artificial Sequence
  Synthetic Oligonucleotide; PD-L1 exon 6; Set C
uucuuaaacggaagaugaauguca

SEQ ID NO: 24744 - RNA, 35 nt, Artificial Sequence
  Synthetic Oligonucleotide; PD-L1 exon 6; Set A
cuaccuuuucuuaaacggaagaugaaugucagugc

SEQ ID NO: 24745 - RNA, 36 nt, Artificial Sequence
  Synthetic Oligonucleotide; PD-L1 exon 6; Set A
acuaccuuuucuuaaacggaagaugaaugucagugc

SEQ ID NO: 24746 - RNA, 37 nt, Artificial Sequence
  Synthetic Oligonucleotide; PD-L1 exon 6; Set A
uacuaccuuuucuuaaacggaagaugaaugucagugc

SEQ ID NO: 24747 - RNA, 38 nt, Artificial Sequence
  Synthetic Oligonucleotide; PD-L1 exon 6; Set A
auacuaccuuuucuuaaacggaagaugaaugucagugc

SEQ ID NO: 24748 - RNA, 39 nt, Artificial Sequence
  Synthetic Oligonucleotide; PD-L1 exon 6; Set A
aauacuaccuuuucuuaaacggaagaugaaugucagugc

SEQ ID NO: 24749 - RNA, 40 nt, Artificial Sequence
  Synthetic Oligonucleotide; PD-L1 exon 6; Set A
aaauacuaccuuuucuuaaacggaagaugaaugucagugc

SEQ ID NO: 24750 - RNA, 34 nt, Artificial Sequence
  Synthetic Oligonucleotide; PD-L1 exon 6; Set B
agaccacugcaauuaaggaaauacuaccuuuucu

SEQ ID NO: 24751 - RNA, 33 nt, Artificial Sequence
  Synthetic Oligonucleotide; PD-L1 exon 6; Set B
agaccacugcaauuaaggaaauacuaccuuuuc

SEQ ID NO: 24752 - RNA, 26 nt, Artificial Sequence
  Synthetic Oligonucleotide; PD-L1 exon 6; Set C
agaccacugcaauuaaggaaauacua

SEQ ID NO: 24753 - RNA, 25 nt, Artificial Sequence
  Synthetic Oligonucleotide; PD-L1 exon 6; Set C
agaccacugcaauuaaggaaauacu

SEQ ID NO: 24754 - RNA, 24 nt, Artificial Sequence
  Synthetic Oligonucleotide; PD-L1 exon 6; Set C
agaccacugcaauuaaggaaauac

SEQ ID NO: 24755 - RNA, 23 nt, Artificial Sequence
  Synthetic Oligonucleotide; PD-L1 exon 6; Set C
agaccacugcaauuaaggaaaua

SEQ ID NO: 24756 - RNA, 22 nt, Artificial Sequence
  Synthetic Oligonucleotide; PD-L1 exon 6; Set C
agaccacugcaauuaaggaaau

SEQ ID NO: 24757 - RNA, 35 nt, Artificial Sequence
  Synthetic Oligonucleotide; PD-L1 exon 6; Set C
ccccaguggagaccacugcaauuaaggaaauacua

SEQ ID NO: 24758 - RNA, 34 nt, Artificial Sequence
  Synthetic Oligonucleotide; PD-L1 exon 6; Set C
ccccaguggagaccacugcaauuaaggaaauacu

SEQ ID NO: 24759 - RNA, 36 nt, Artificial Sequence
  Synthetic Oligonucleotide; PD-L1 exon 6; Set C
cccccaguggagaccacugcaauuaaggaaauacua

SEQ ID NO: 24760 - RNA, 33 nt, Artificial Sequence
  Synthetic Oligonucleotide; PD-L1 exon 6; Set C
ccccaguggagaccacugcaauuaaggaaauac

SEQ ID NO: 24761 - RNA, 35 nt, Artificial Sequence
  Synthetic Oligonucleotide; PD-L1 exon 6; Set C
cccccaguggagaccacugcaauuaaggaaauacu

SEQ ID NO: 24762 - RNA, 34 nt, Artificial Sequence
  Synthetic Oligonucleotide; PD-L1 exon 6; Set C
cccccaguggagaccacugcaauuaaggaaauac

SEQ ID NO: 24763 - RNA, 32 nt, Artificial Sequence
  Synthetic Oligonucleotide; PD-L1 exon 6; Set C
ccccaguggagaccacugcaauuaaggaaaua

SEQ ID NO: 24764 - RNA, 33 nt, Artificial Sequence
  Synthetic Oligonucleotide; PD-L1 exon 6; Set C
cccccaguggagaccacugcaauuaaggaaaua

SEQ ID NO: 24765 - RNA, 20 nt, Artificial Sequence
  Synthetic Oligonucleotide; PD-L1 exon 6; Set C
caaacugacuaaagauaaaa

SEQ ID NO: 24766 - RNA, 19 nt, Artificial Sequence
  Synthetic Oligonucleotide; PD-L1 exon 6; Set C
caaacugacuaaagauaaa

SEQ ID NO: 24767 - RNA, 20 nt, Artificial Sequence
  Synthetic Oligonucleotide; PD-L1 exon 6; Set C
acaaacugacuaaagauaaa

SEQ ID NO: 24768 - RNA, 18 nt, Artificial Sequence
  Synthetic Oligonucleotide; PD-L1 exon 6; Set C
caaacugacuaaagauaa

SEQ ID NO: 24769 - RNA, 19 nt, Artificial Sequence
  Synthetic Oligonucleotide; PD-L1 exon 6; Set C
acaaacugacuaaagauaa

SEQ ID NO: 24770 - RNA, 17 nt, Artificial Sequence
  Synthetic Oligonucleotide; PD-L1 exon 6; Set C
caaacugacuaaagaua

SEQ ID NO: 24771 - RNA, 18 nt, Artificial Sequence
  Synthetic Oligonucleotide; PD-L1 exon 6; Set C
acaaacugacuaaagaua

SEQ ID NO: 24772 - RNA, 16 nt, Artificial Sequence
  Synthetic Oligonucleotide; PD-L1 exon 6; Set C
caaacugacuaaagau

SEQ ID NO: 24773 - RNA, 15 nt, Artificial Sequence
  Synthetic Oligonucleotide; PD-L1 exon 6; Set C
caaacugacuaaaga

SEQ ID NO: 24774 - RNA, 17 nt, Artificial Sequence
  Synthetic Oligonucleotide; PD-L1 exon 6; Set C
acaaacugacuaaagau

SEQ ID NO: 24775 - RNA, 16 nt, Artificial Sequence
  Synthetic Oligonucleotide; PD-L1 exon 6; Set C
acaaacugacuaaaga

SEQ ID NO: 24776 - RNA, 15 nt, Artificial Sequence
  Synthetic Oligonucleotide; PD-L1 exon 6; Set C
acaaacugacuaaag

SEQ ID NO: 24777 - RNA, 15 nt, Artificial Sequence
  Synthetic Oligonucleotide; PD-L1 exon 6; Set C
aacaaacugacuaaa

SEQ ID NO: 24778 - RNA, 16 nt, Artificial Sequence
  Synthetic Oligonucleotide; PD-L1 exon 6; Set C
aaacaaacugacuaaa

SEQ ID NO: 24779 - RNA, 15 nt, Artificial Sequence
  Synthetic Oligonucleotide; PD-L1 exon 6; Set C
aaacaaacugacuaa

SEQ ID NO: 24780 - RNA, 15 nt, Artificial Sequence
  Synthetic Oligonucleotide; PD-L1 exon 6; Set C
aaaacaaacugacua

SEQ ID NO: 24781 - RNA, 40 nt, Artificial Sequence
  Synthetic Oligonucleotide; PD-L1 exon 6; Set C
aguucugaaaaacaaaacaaaacgaaaacaaacugacuaa

SEQ ID NO: 24782 - RNA, 39 nt, Artificial Sequence
  Synthetic Oligonucleotide; PD-L1 exon 6; Set C
aguucugaaaaacaaaacaaaacgaaaacaaacugacua

SEQ ID NO: 24783 - RNA, 38 nt, Artificial Sequence
  Synthetic Oligonucleotide; PD-L1 exon 6; Set C
aguucugaaaaacaaaacaaaacgaaaacaaacugacu

SEQ ID NO: 24784 - RNA, 40 nt, Artificial Sequence
  Synthetic Oligonucleotide; PD-L1 exon 6; Set C
uaguucugaaaaacaaaacaaaacgaaaacaaacugacua

SEQ ID NO: 24785 - RNA, 31 nt, Artificial Sequence
  Synthetic Oligonucleotide; PD-L1 exon 6; Set C
aguucugaaaaacaaaacaaaacgaaaacaa

SEQ ID NO: 24786 - RNA, 30 nt, Artificial Sequence
  Synthetic Oligonucleotide; PD-L1 exon 6; Set C
aguucugaaaaacaaaacaaaacgaaaaca

SEQ ID NO: 24787 - RNA, 20 nt, Artificial Sequence
  Synthetic Oligonucleotide; PD-L1 exon 6; Set C
aguucugaaaaacaaaacaa

SEQ ID NO: 24788 - RNA, 19 nt, Artificial Sequence
  Synthetic Oligonucleotide; PD-L1 exon 6; Set C
aguucugaaaaacaaaaca

SEQ ID NO: 24789 - RNA, 19 nt, Artificial Sequence
  Synthetic Oligonucleotide; PD-L1 exon 6; Set C
uaguucugaaaaacaaaac

SEQ ID NO: 24790 - RNA, 18 nt, Artificial Sequence
  Synthetic Oligonucleotide; PD-L1 exon 6; Set C
uaguucugaaaaacaaaa

SEQ ID NO: 24791 - RNA, 34 nt, Artificial Sequence
  Synthetic Oligonucleotide; PD-L1 exon 6; Set A
ggaugugccagagguaguucugaaaaacaaaaca

SEQ ID NO: 24792 - RNA, 36 nt, Artificial Sequence
  Synthetic Oligonucleotide; PD-L1 exon 6; Set A
aggaugugccagagguaguucugaaaaacaaaacaa

SEQ ID NO: 24793 - RNA, 35 nt, Artificial Sequence
  Synthetic Oligonucleotide; PD-L1 exon 6; Set A
aggaugugccagagguaguucugaaaaacaaaaca

SEQ ID NO: 24794 - RNA, 37 nt, Artificial Sequence
  Synthetic Oligonucleotide; PD-L1 exon 6; Set A
gaggaugugccagagguaguucugaaaaacaaaacaa

SEQ ID NO: 24795 - RNA, 33 nt, Artificial Sequence
  Synthetic Oligonucleotide; PD-L1 exon 6; Set A
ggaugugccagagguaguucugaaaaacaaaac

SEQ ID NO: 24796 - RNA, 38 nt, Artificial Sequence
  Synthetic Oligonucleotide; PD-L1 exon 6; Set A
ggaggaugugccagagguaguucugaaaaacaaaacaa

SEQ ID NO: 24797 - RNA, 36 nt, Artificial Sequence
  Synthetic Oligonucleotide; PD-L1 exon 6; Set A
gaggaugugccagagguaguucugaaaaacaaaaca

SEQ ID NO: 24798 - RNA, 32 nt, Artificial Sequence
  Synthetic Oligonucleotide; PD-L1 exon 6; Set A
ggaugugccagagguaguucugaaaaacaaaa

SEQ ID NO: 24799 - RNA, 34 nt, Artificial Sequence
  Synthetic Oligonucleotide; PD-L1 exon 6; Set A
aggaugugccagagguaguucugaaaaacaaaac

SEQ ID NO: 24800 - RNA, 37 nt, Artificial Sequence
  Synthetic Oligonucleotide; PD-L1 exon 6; Set A
ggaggaugugccagagguaguucugaaaaacaaaaca

SEQ ID NO: 24801 - RNA, 33 nt, Artificial Sequence
  Synthetic Oligonucleotide; PD-L1 exon 6; Set A
aggaugugccagagguaguucugaaaaacaaaa

SEQ ID NO: 24802 - RNA, 35 nt, Artificial Sequence
  Synthetic Oligonucleotide; PD-L1 exon 6; Set A
gaggaugugccagagguaguucugaaaaacaaaac

SEQ ID NO: 24803 - RNA, 34 nt, Artificial Sequence
  Synthetic Oligonucleotide; PD-L1 exon 6; Set A
gaggaugugccagagguaguucugaaaaacaaaa

SEQ ID NO: 24804 - RNA, 36 nt, Artificial Sequence
  Synthetic Oligonucleotide; PD-L1 exon 6; Set A
ggaggaugugccagagguaguucugaaaaacaaaac

SEQ ID NO: 24805 - RNA, 35 nt, Artificial Sequence
  Synthetic Oligonucleotide; PD-L1 exon 6; Set A
ggaggaugugccagagguaguucugaaaaacaaaa

SEQ ID NO: 24806 - RNA, 36 nt, Artificial Sequence
  Synthetic Oligonucleotide; PD-L1 exon 6; Set C
uuucauuuggaggaugugccagagguaguucugaaa

SEQ ID NO: 24807 - RNA, 29 nt, Artificial Sequence
  Synthetic Oligonucleotide; PD-L1 exon 6; Set A
uuucauuuggaggaugugccagagguagu

SEQ ID NO: 24808 - RNA, 40 nt, Artificial Sequence
  Synthetic Oligonucleotide; PD-L1 exon 6; Set C
auuaccaagugaguccuuucauuuggaggaugugccagag

SEQ ID NO: 24809 - RNA, 34 nt, Artificial Sequence
  Synthetic Oligonucleotide; PD-L1 exon 6; Set A
auuaccaagugaguccuuucauuuggaggaugug

SEQ ID NO: 24810 - RNA, 24 nt, Artificial Sequence
  Synthetic Oligonucleotide; PD-L1 exon 6; Set C
caagugaguccuuucauuuggagg

SEQ ID NO: 24811 - RNA, 22 nt, Artificial Sequence
  Synthetic Oligonucleotide; PD-L1 exon 6; Set C
aagugaguccuuucauuuggag

SEQ ID NO: 24812 - RNA, 33 nt, Artificial Sequence
  Synthetic Oligonucleotide; PD-L1 exon 6; Set A
auuaccaagugaguccuuucauuuggaggaugu

SEQ ID NO: 24813 - RNA, 35 nt, Artificial Sequence
  Synthetic Oligonucleotide; PD-L1 exon 6; Set A
aauuaccaagugaguccuuucauuuggaggaugug

SEQ ID NO: 24814 - RNA, 21 nt, Artificial Sequence
  Synthetic Oligonucleotide; PD-L1 exon 6; Set C
aagugaguccuuucauuugga

SEQ ID NO: 24815 - RNA, 23 nt, Artificial Sequence
  Synthetic Oligonucleotide; PD-L1 exon 6; Set C
caagugaguccuuucauuuggag

SEQ ID NO: 24816 - RNA, 34 nt, Artificial Sequence
  Synthetic Oligonucleotide; PD-L1 exon 6; Set A
aauuaccaagugaguccuuucauuuggaggaugu

SEQ ID NO: 24817 - RNA, 32 nt, Artificial Sequence
  Synthetic Oligonucleotide; PD-L1 exon 6; Set A
auuaccaagugaguccuuucauuuggaggaug

SEQ ID NO: 24818 - RNA, 22 nt, Artificial Sequence
  Synthetic Oligonucleotide; PD-L1 exon 6; Set C
caagugaguccuuucauuugga

SEQ ID NO: 24819 - RNA, 31 nt, Artificial Sequence
  Synthetic Oligonucleotide; PD-L1 exon 6; Set A
auuaccaagugaguccuuucauuuggaggau

SEQ ID NO: 24820 - RNA, 33 nt, Artificial Sequence
  Synthetic Oligonucleotide; PD-L1 exon 6; Set A
aauuaccaagugaguccuuucauuuggaggaug

SEQ ID NO: 24821 - RNA, 32 nt, Artificial Sequence
  Synthetic Oligonucleotide; PD-L1 exon 6; Set A
aauuaccaagugaguccuuucauuuggaggau

SEQ ID NO: 24822 - RNA, 40 nt, Artificial Sequence
  Synthetic Oligonucleotide; PD-L1 exon 6; Set C
gauggcucccagaauuaccaagugaguccuuucauuugga

SEQ ID NO: 24823 - RNA, 33 nt, Artificial Sequence
  Synthetic Oligonucleotide; PD-L1 exon 6; Set C
agauggcucccagaauuaccaagugaguccuuu

SEQ ID NO: 24824 - RNA, 34 nt, Artificial Sequence
  Synthetic Oligonucleotide; PD-L1 exon 6; Set C
aagauggcucccagaauuaccaagugaguccuuu

SEQ ID NO: 24825 - RNA, 35 nt, Artificial Sequence
  Synthetic Oligonucleotide; PD-L1 exon 6; Set C
uaagauggcucccagaauuaccaagugaguccuuu

SEQ ID NO: 24826 - RNA, 39 nt, Artificial Sequence
  Synthetic Oligonucleotide; PD-L1 exon 6; Set C
auaauaagauggcucccagaauuaccaagugaguccuuu

SEQ ID NO: 24827 - RNA, 40 nt, Artificial Sequence
  Synthetic Oligonucleotide; PD-L1 exon 6; Set C
cauaauaagauggcucccagaauuaccaagugaguccuuu

SEQ ID NO: 24828 - RNA, 27 nt, Artificial Sequence
  Synthetic Oligonucleotide; PD-L1 exon 6; Set C
aauaagauggcucccagaauuaccaag

SEQ ID NO: 24829 - RNA, 28 nt, Artificial Sequence
  Synthetic Oligonucleotide; PD-L1 exon 6; Set C
uaauaagauggcucccagaauuaccaag

SEQ ID NO: 24830 - RNA, 16 nt, Artificial Sequence
  Synthetic Oligonucleotide; PD-L1 exon 6; Set C
gauggcucccagaauu

SEQ ID NO: 24831 - RNA, 15 nt, Artificial Sequence
  Synthetic Oligonucleotide; PD-L1 exon 6; Set C
gauggcucccagaau

SEQ ID NO: 24832 - RNA, 17 nt, Artificial Sequence
  Synthetic Oligonucleotide; PD-L1 exon 6; Set C
agauggcucccagaauu

SEQ ID NO: 24833 - RNA, 16 nt, Artificial Sequence
  Synthetic Oligonucleotide; PD-L1 exon 6; Set C
agauggcucccagaau

SEQ ID NO: 24834 - RNA, 18 nt, Artificial Sequence
  Synthetic Oligonucleotide; PD-L1 exon 6; Set C
aagauggcucccagaauu

SEQ ID NO: 24835 - RNA, 17 nt, Artificial Sequence
  Synthetic Oligonucleotide; PD-L1 exon 6; Set C
aagauggcucccagaau

SEQ ID NO: 24836 - RNA, 19 nt, Artificial Sequence
  Synthetic Oligonucleotide; PD-L1 exon 6; Set C
uaagauggcucccagaauu

SEQ ID NO: 24837 - RNA, 18 nt, Artificial Sequence
  Synthetic Oligonucleotide; PD-L1 exon 6; Set C
uaagauggcucccagaau

SEQ ID NO: 24838 - RNA, 17 nt, Artificial Sequence
  Synthetic Oligonucleotide; PD-L1 exon 6; Set C
uaagauggcucccagaa

SEQ ID NO: 24839 - RNA, 15 nt, Artificial Sequence
  Synthetic Oligonucleotide; PD-L1 exon 6; Set C
aagauggcucccaga

SEQ ID NO: 24840 - RNA, 16 nt, Artificial Sequence
  Synthetic Oligonucleotide; PD-L1 exon 6; Set C
uaagauggcucccaga

SEQ ID NO: 24841 - RNA, 23 nt, Artificial Sequence
  Synthetic Oligonucleotide; PD-L1 exon 6; Set C
auaauaagauggcucccagaauu

SEQ ID NO: 24842 - RNA, 22 nt, Artificial Sequence
  Synthetic Oligonucleotide; PD-L1 exon 6; Set C
auaauaagauggcucccagaau

SEQ ID NO: 24843 - RNA, 24 nt, Artificial Sequence
  Synthetic Oligonucleotide; PD-L1 exon 6; Set C
cauaauaagauggcucccagaauu

SEQ ID NO: 24844 - RNA, 23 nt, Artificial Sequence
  Synthetic Oligonucleotide; PD-L1 exon 6; Set C
cauaauaagauggcucccagaau

SEQ ID NO: 24845 - RNA, 20 nt, Artificial Sequence
  Synthetic Oligonucleotide; PD-L1 exon 6; Set C
auaauaagauggcucccaga

SEQ ID NO: 24846 - RNA, 22 nt, Artificial Sequence
  Synthetic Oligonucleotide; PD-L1 exon 6; Set C
cauaauaagauggcucccagaa

SEQ ID NO: 24847 - RNA, 21 nt, Artificial Sequence
  Synthetic Oligonucleotide; PD-L1 exon 6; Set C
cauaauaagauggcucccaga

SEQ ID NO: 24848 - RNA, 28 nt, Artificial Sequence
  Synthetic Oligonucleotide; PD-L1 exon 6; Set A
aaggcauaauaagauggcucccagaauu

SEQ ID NO: 24849 - RNA, 27 nt, Artificial Sequence
  Synthetic Oligonucleotide; PD-L1 exon 6; Set A
aaggcauaauaagauggcucccagaau

SEQ ID NO: 24850 - RNA, 29 nt, Artificial Sequence
  Synthetic Oligonucleotide; PD-L1 exon 6; Set A
caaggcauaauaagauggcucccagaauu

SEQ ID NO: 24851 - RNA, 28 nt, Artificial Sequence
  Synthetic Oligonucleotide; PD-L1 exon 6; Set A
caaggcauaauaagauggcucccagaau

SEQ ID NO: 24852 - RNA, 16 nt, Artificial Sequence
  Synthetic Oligonucleotide; PD-L1 exon 6; Set C
auaauaagauggcucc

SEQ ID NO: 24853 - RNA, 17 nt, Artificial Sequence
  Synthetic Oligonucleotide; PD-L1 exon 6; Set C
cauaauaagauggcucc

SEQ ID NO: 24854 - RNA, 15 nt, Artificial Sequence
  Synthetic Oligonucleotide; PD-L1 exon 6; Set C
auaauaagauggcuc

SEQ ID NO: 24855 - RNA, 16 nt, Artificial Sequence
  Synthetic Oligonucleotide; PD-L1 exon 6; Set C
cauaauaagauggcuc

SEQ ID NO: 24856 - RNA, 33 nt, Artificial Sequence
  Synthetic Oligonucleotide; PD-L1 exon 6; Set C
acaccaaggcauaauaagauggcucccagaauu

SEQ ID NO: 24857 - RNA, 15 nt, Artificial Sequence
  Synthetic Oligonucleotide; PD-L1 exon 6; Set C
cauaauaagauggcu

SEQ ID NO: 24858 - RNA, 32 nt, Artificial Sequence
  Synthetic Oligonucleotide; PD-L1 exon 6; Set A
acaccaaggcauaauaagauggcucccagaau

SEQ ID NO: 24859 - RNA, 34 nt, Artificial Sequence
  Synthetic Oligonucleotide; PD-L1 exon 6; Set C
uacaccaaggcauaauaagauggcucccagaauu

SEQ ID NO: 24860 - RNA, 33 nt, Artificial Sequence
  Synthetic Oligonucleotide; PD-L1 exon 6; Set C
uacaccaaggcauaauaagauggcucccagaau

SEQ ID NO: 24861 - RNA, 35 nt, Artificial Sequence
  Synthetic Oligonucleotide; PD-L1 exon 6; Set C
cuacaccaaggcauaauaagauggcucccagaauu

SEQ ID NO: 24862 - RNA, 34 nt, Artificial Sequence
  Synthetic Oligonucleotide; PD-L1 exon 6; Set C
cuacaccaaggcauaauaagauggcucccagaau

SEQ ID NO: 24863 - RNA, 36 nt, Artificial Sequence
  Synthetic Oligonucleotide; PD-L1 exon 6; Set C
gcuacaccaaggcauaauaagauggcucccagaauu

SEQ ID NO: 24864 - RNA, 35 nt, Artificial Sequence
  Synthetic Oligonucleotide; PD-L1 exon 6; Set C
gcuacaccaaggcauaauaagauggcucccagaau

SEQ ID NO: 24865 - RNA, 18 nt, Artificial Sequence
  Synthetic Oligonucleotide; PD-L1 exon 6; Set C
aaggcauaauaagauggc

SEQ ID NO: 24866 - RNA, 19 nt, Artificial Sequence
  Synthetic Oligonucleotide; PD-L1 exon 6; Set C
caaggcauaauaagauggc

SEQ ID NO: 24867 - RNA, 18 nt, Artificial Sequence
  Synthetic Oligonucleotide; PD-L1 exon 6; Set C
caaggcauaauaagaugg

SEQ ID NO: 24868 - RNA, 17 nt, Artificial Sequence
  Synthetic Oligonucleotide; PD-L1 exon 6; Set C
caaggcauaauaagaug

SEQ ID NO: 24869 - RNA, 23 nt, Artificial Sequence
  Synthetic Oligonucleotide; PD-L1 exon 6; Set C
acaccaaggcauaauaagauggc

SEQ ID NO: 24870 - RNA, 24 nt, Artificial Sequence
  Synthetic Oligonucleotide; PD-L1 exon 6; Set C
uacaccaaggcauaauaagauggc

SEQ ID NO: 24871 - RNA, 22 nt, Artificial Sequence
  Synthetic Oligonucleotide; PD-L1 exon 6; Set C
acaccaaggcauaauaagaugg

SEQ ID NO: 24872 - RNA, 26 nt, Artificial Sequence
  Synthetic Oligonucleotide; PD-L1 exon 6; Set A
cuacaccaaggcauaauaagauggcu

SEQ ID NO: 24873 - RNA, 40 nt, Artificial Sequence
  Synthetic Oligonucleotide; PD-L1 exon 6; Set C
gucagugcuacaccaaggcauaauaagauggcucccagaa

SEQ ID NO: 24874 - RNA, 25 nt, Artificial Sequence
  Synthetic Oligonucleotide; PD-L1 exon 6; Set A
cuacaccaaggcauaauaagauggc

SEQ ID NO: 24875 - RNA, 23 nt, Artificial Sequence
  Synthetic Oligonucleotide; PD-L1 exon 6; Set C
uacaccaaggcauaauaagaugg

SEQ ID NO: 24876 - RNA, 21 nt, Artificial Sequence
  Synthetic Oligonucleotide; PD-L1 exon 6; Set C
acaccaaggcauaauaagaug

SEQ ID NO: 24877 - RNA, 39 nt, Artificial Sequence
  Synthetic Oligonucleotide; PD-L1 exon 6; Set C
gucagugcuacaccaaggcauaauaagauggcucccaga

SEQ ID NO: 24878 - RNA, 26 nt, Artificial Sequence
  Synthetic Oligonucleotide; PD-L1 exon 6; Set A
gcuacaccaaggcauaauaagauggc

SEQ ID NO: 24879 - RNA, 24 nt, Artificial Sequence
  Synthetic Oligonucleotide; PD-L1 exon 6; Set C
cuacaccaaggcauaauaagaugg

SEQ ID NO: 24880 - RNA, 40 nt, Artificial Sequence
  Synthetic Oligonucleotide; PD-L1 exon 6; Set C
ugucagugcuacaccaaggcauaauaagauggcucccaga

SEQ ID NO: 24881 - RNA, 23 nt, Artificial Sequence
  Synthetic Oligonucleotide; PD-L1 exon 6; Set C
cuacaccaaggcauaauaagaug

SEQ ID NO: 24882 - RNA, 35 nt, Artificial Sequence
  Synthetic Oligonucleotide; PD-L1 exon 6; Set C
gucagugcuacaccaaggcauaauaagauggcucc

SEQ ID NO: 24883 - RNA, 24 nt, Artificial Sequence
  Synthetic Oligonucleotide; PD-L1 exon 6; Set C
ugcuacaccaaggcauaauaagau

SEQ ID NO: 24884 - RNA, 16 nt, Artificial Sequence
  Synthetic Oligonucleotide; PD-L1 exon 6; Set C
acaccaaggcauaaua

SEQ ID NO: 24885 - RNA, 36 nt, Artificial Sequence
  Synthetic Oligonucleotide; PD-L1 exon 6; Set C
ugucagugcuacaccaaggcauaauaagauggcucc

SEQ ID NO: 24886 - RNA, 34 nt, Artificial Sequence
  Synthetic Oligonucleotide; PD-L1 exon 6; Set C
gucagugcuacaccaaggcauaauaagauggcuc

SEQ ID NO: 24887 - RNA, 33 nt, Artificial Sequence
  Synthetic Oligonucleotide; PD-L1 exon 6; Set C
gucagugcuacaccaaggcauaauaagauggcu

SEQ ID NO: 24888 - RNA, 37 nt, Artificial Sequence
  Synthetic Oligonucleotide; PD-L1 exon 6; Set C
augucagugcuacaccaaggcauaauaagauggcucc

SEQ ID NO: 24889 - RNA, 35 nt, Artificial Sequence
  Synthetic Oligonucleotide; PD-L1 exon 6; Set C
ugucagugcuacaccaaggcauaauaagauggcuc

SEQ ID NO: 24890 - RNA, 24 nt, Artificial Sequence
  Synthetic Oligonucleotide; PD-L1 exon 6; Set A
gugcuacaccaaggcauaauaaga

SEQ ID NO: 24891 - RNA, 32 nt, Artificial Sequence
  Synthetic Oligonucleotide; PD-L1 exon 6; Set C
gucagugcuacaccaaggcauaauaagauggc

SEQ ID NO: 24892 - RNA, 18 nt, Artificial Sequence
  Synthetic Oligonucleotide; PD-L1 exon 6; Set C
cuacaccaaggcauaaua

SEQ ID NO: 24893 - RNA, 34 nt, Artificial Sequence
  Synthetic Oligonucleotide; PD-L1 exon 6; Set C
ugucagugcuacaccaaggcauaauaagauggcu

SEQ ID NO: 24894 - RNA, 38 nt, Artificial Sequence
  Synthetic Oligonucleotide; PD-L1 exon 6; Set C
aaugucagugcuacaccaaggcauaauaagauggcucc

SEQ ID NO: 24895 - RNA, 36 nt, Artificial Sequence
  Synthetic Oligonucleotide; PD-L1 exon 6; Set C
augucagugcuacaccaaggcauaauaagauggcuc

SEQ ID NO: 24896 - RNA, 23 nt, Artificial Sequence
  Synthetic Oligonucleotide; PD-L1 exon 6; Set C
gugcuacaccaaggcauaauaag

SEQ ID NO: 24897 - RNA, 25 nt, Artificial Sequence
  Synthetic Oligonucleotide; PD-L1 exon 6; Set A
agugcuacaccaaggcauaauaaga

SEQ ID NO: 24898 - RNA, 17 nt, Artificial Sequence
  Synthetic Oligonucleotide; PD-L1 exon 6; Set C
cuacaccaaggcauaau

SEQ ID NO: 24899 - RNA, 33 nt, Artificial Sequence
  Synthetic Oligonucleotide; PD-L1 exon 6; Set C
ugucagugcuacaccaaggcauaauaagauggc

SEQ ID NO: 24900 - RNA, 31 nt, Artificial Sequence
  Synthetic Oligonucleotide; PD-L1 exon 6; Set A
gucagugcuacaccaaggcauaauaagaugg

SEQ ID NO: 24901 - RNA, 35 nt, Artificial Sequence
  Synthetic Oligonucleotide; PD-L1 exon 6; Set C
augucagugcuacaccaaggcauaauaagauggcu

SEQ ID NO: 24902 - RNA, 39 nt, Artificial Sequence
  Synthetic Oligonucleotide; PD-L1 exon 6; Set C
gaaugucagugcuacaccaaggcauaauaagauggcucc

SEQ ID NO: 24903 - RNA, 37 nt, Artificial Sequence
  Synthetic Oligonucleotide; PD-L1 exon 6; Set C
aaugucagugcuacaccaaggcauaauaagauggcuc

SEQ ID NO: 24904 - RNA, 22 nt, Artificial Sequence
  Synthetic Oligonucleotide; PD-L1 exon 6; Set C
gugcuacaccaaggcauaauaa

SEQ ID NO: 24905 - RNA, 24 nt, Artificial Sequence
  Synthetic Oligonucleotide; PD-L1 exon 6; Set C
agugcuacaccaaggcauaauaag

SEQ ID NO: 24906 - RNA, 26 nt, Artificial Sequence
  Synthetic Oligonucleotide; PD-L1 exon 6; Set A
cagugcuacaccaaggcauaauaaga

SEQ ID NO: 24907 - RNA, 28 nt, Artificial Sequence
  Synthetic Oligonucleotide; PD-L1 exon 6; Set A
ucagugcuacaccaaggcauaauaagau

SEQ ID NO: 24908 - RNA, 16 nt, Artificial Sequence
  Synthetic Oligonucleotide; PD-L1 exon 6; Set C
cuacaccaaggcauaa

SEQ ID NO: 24909 - RNA, 34 nt, Artificial Sequence
  Synthetic Oligonucleotide; PD-L1 exon 6; Set C
augucagugcuacaccaaggcauaauaagauggc

SEQ ID NO: 24910 - RNA, 32 nt, Artificial Sequence
  Synthetic Oligonucleotide; PD-L1 exon 6; Set A
ugucagugcuacaccaaggcauaauaagaugg

SEQ ID NO: 24911 - RNA, 30 nt, Artificial Sequence
  Synthetic Oligonucleotide; PD-L1 exon 6; Set A
gucagugcuacaccaaggcauaauaagaug

SEQ ID NO: 24912 - RNA, 36 nt, Artificial Sequence
  Synthetic Oligonucleotide; PD-L1 exon 6; Set C
aaugucagugcuacaccaaggcauaauaagauggcu

SEQ ID NO: 24913 - RNA, 40 nt, Artificial Sequence
  Synthetic Oligonucleotide; PD-L1 exon 6; Set C
ugaaugucagugcuacaccaaggcauaauaagauggcucc

SEQ ID NO: 24914 - RNA, 38 nt, Artificial Sequence
  Synthetic Oligonucleotide; PD-L1 exon 6; Set C
gaaugucagugcuacaccaaggcauaauaagauggcuc

SEQ ID NO: 24915 - RNA, 23 nt, Artificial Sequence
  Synthetic Oligonucleotide; PD-L1 exon 6; Set C
agugcuacaccaaggcauaauaa

SEQ ID NO: 24916 - RNA, 25 nt, Artificial Sequence
  Synthetic Oligonucleotide; PD-L1 exon 6; Set A
cagugcuacaccaaggcauaauaag

SEQ ID NO: 24917 - RNA, 27 nt, Artificial Sequence
  Synthetic Oligonucleotide; PD-L1 exon 6; Set A
ucagugcuacaccaaggcauaauaaga

SEQ ID NO: 24918 - RNA, 35 nt, Artificial Sequence
  Synthetic Oligonucleotide; PD-L1 exon 6; Set C
aaugucagugcuacaccaaggcauaauaagauggc

SEQ ID NO: 24919 - RNA, 33 nt, Artificial Sequence
  Synthetic Oligonucleotide; PD-L1 exon 6; Set A
augucagugcuacaccaaggcauaauaagaugg

SEQ ID NO: 24920 - RNA, 31 nt, Artificial Sequence
  Synthetic Oligonucleotide; PD-L1 exon 6; Set A
ugucagugcuacaccaaggcauaauaagaug

SEQ ID NO: 24921 - RNA, 37 nt, Artificial Sequence
  Synthetic Oligonucleotide; PD-L1 exon 6; Set C
gaaugucagugcuacaccaaggcauaauaagauggcu

SEQ ID NO: 24922 - RNA, 39 nt, Artificial Sequence
  Synthetic Oligonucleotide; PD-L1 exon 6; Set C
ugaaugucagugcuacaccaaggcauaauaagauggcuc

SEQ ID NO: 24923 - RNA, 24 nt, Artificial Sequence
  Synthetic Oligonucleotide; PD-L1 exon 6; Set A
cagugcuacaccaaggcauaauaa

SEQ ID NO: 24924 - RNA, 26 nt, Artificial Sequence
  Synthetic Oligonucleotide; PD-L1 exon 6; Set A
ucagugcuacaccaaggcauaauaag

SEQ ID NO: 24925 - RNA, 36 nt, Artificial Sequence
  Synthetic Oligonucleotide; PD-L1 exon 6; Set C
gaaugucagugcuacaccaaggcauaauaagauggc

SEQ ID NO: 24926 - RNA, 34 nt, Artificial Sequence
  Synthetic Oligonucleotide; PD-L1 exon 6; Set A
aaugucagugcuacaccaaggcauaauaagaugg

SEQ ID NO: 24927 - RNA, 32 nt, Artificial Sequence
  Synthetic Oligonucleotide; PD-L1 exon 6; Set A
augucagugcuacaccaaggcauaauaagaug

SEQ ID NO: 24928 - RNA, 38 nt, Artificial Sequence
  Synthetic Oligonucleotide; PD-L1 exon 6; Set C
ugaaugucagugcuacaccaaggcauaauaagauggcu

SEQ ID NO: 24929 - RNA, 25 nt, Artificial Sequence
  Synthetic Oligonucleotide; PD-L1 exon 6; Set A
ucagugcuacaccaaggcauaauaa

SEQ ID NO: 24930 - RNA, 17 nt, Artificial Sequence
  Synthetic Oligonucleotide; PD-L1 exon 6; Set C
ugcuacaccaaggcaua

SEQ ID NO: 24931 - RNA, 37 nt, Artificial Sequence
  Synthetic Oligonucleotide; PD-L1 exon 6; Set C
ugaaugucagugcuacaccaaggcauaauaagauggc

SEQ ID NO: 24932 - RNA, 35 nt, Artificial Sequence
  Synthetic Oligonucleotide; PD-L1 exon 6; Set A
gaaugucagugcuacaccaaggcauaauaagaugg

SEQ ID NO: 24933 - RNA, 33 nt, Artificial Sequence
  Synthetic Oligonucleotide; PD-L1 exon 6; Set A
aaugucagugcuacaccaaggcauaauaagaug

SEQ ID NO: 24934 - RNA, 16 nt, Artificial Sequence
  Synthetic Oligonucleotide; PD-L1 exon 6; Set C
ugcuacaccaaggcau

SEQ ID NO: 24935 - RNA, 36 nt, Artificial Sequence
  Synthetic Oligonucleotide; PD-L1 exon 6; Set A
ugaaugucagugcuacaccaaggcauaauaagaugg

SEQ ID NO: 24936 - RNA, 34 nt, Artificial Sequence
  Synthetic Oligonucleotide; PD-L1 exon 6; Set A
gaaugucagugcuacaccaaggcauaauaagaug

SEQ ID NO: 24937 - RNA, 19 nt, Artificial Sequence
  Synthetic Oligonucleotide; PD-L1 exon 6; Set C
agugcuacaccaaggcaua

SEQ ID NO: 24938 - RNA, 25 nt, Artificial Sequence
  Synthetic Oligonucleotide; PD-L1 exon 6; Set A
gucagugcuacaccaaggcauaaua

SEQ ID NO: 24939 - RNA, 35 nt, Artificial Sequence
  Synthetic Oligonucleotide; PD-L1 exon 6; Set A
ugaaugucagugcuacaccaaggcauaauaagaug

SEQ ID NO: 24940 - RNA, 18 nt, Artificial Sequence
  Synthetic Oligonucleotide; PD-L1 exon 6; Set C
agugcuacaccaaggcau

SEQ ID NO: 24941 - RNA, 20 nt, Artificial Sequence
  Synthetic Oligonucleotide; PD-L1 exon 6; Set A
cagugcuacaccaaggcaua

SEQ ID NO: 24942 - RNA, 24 nt, Artificial Sequence
  Synthetic Oligonucleotide; PD-L1 exon 6; Set A
gucagugcuacaccaaggcauaau

SEQ ID NO: 24943 - RNA, 26 nt, Artificial Sequence
  Synthetic Oligonucleotide; PD-L1 exon 6; Set A
ugucagugcuacaccaaggcauaaua

SEQ ID NO: 24944 - RNA, 21 nt, Artificial Sequence
  Synthetic Oligonucleotide; PD-L1 exon 6; Set A
ucagugcuacaccaaggcaua

SEQ ID NO: 24945 - RNA, 19 nt, Artificial Sequence
  Synthetic Oligonucleotide; PD-L1 exon 6; Set A
cagugcuacaccaaggcau

SEQ ID NO: 24946 - RNA, 23 nt, Artificial Sequence
  Synthetic Oligonucleotide; PD-L1 exon 6; Set A
gucagugcuacaccaaggcauaa

SEQ ID NO: 24947 - RNA, 25 nt, Artificial Sequence
  Synthetic Oligonucleotide; PD-L1 exon 6; Set A
ugucagugcuacaccaaggcauaau

SEQ ID NO: 24948 - RNA, 27 nt, Artificial Sequence
  Synthetic Oligonucleotide; PD-L1 exon 6; Set A
augucagugcuacaccaaggcauaaua

SEQ ID NO: 24949 - RNA, 20 nt, Artificial Sequence
  Synthetic Oligonucleotide; PD-L1 exon 6; Set A
ucagugcuacaccaaggcau

SEQ ID NO: 24950 - RNA, 24 nt, Artificial Sequence
  Synthetic Oligonucleotide; PD-L1 exon 6; Set A
ugucagugcuacaccaaggcauaa

SEQ ID NO: 24951 - RNA, 26 nt, Artificial Sequence
  Synthetic Oligonucleotide; PD-L1 exon 6; Set A
augucagugcuacaccaaggcauaau

SEQ ID NO: 24952 - RNA, 28 nt, Artificial Sequence
  Synthetic Oligonucleotide; PD-L1 exon 6; Set A
aaugucagugcuacaccaaggcauaaua

SEQ ID NO: 24953 - RNA, 25 nt, Artificial Sequence
  Synthetic Oligonucleotide; PD-L1 exon 6; Set A
augucagugcuacaccaaggcauaa

SEQ ID NO: 24954 - RNA, 27 nt, Artificial Sequence
  Synthetic Oligonucleotide; PD-L1 exon 6; Set A
aaugucagugcuacaccaaggcauaau

SEQ ID NO: 24955 - RNA, 29 nt, Artificial Sequence
  Synthetic Oligonucleotide; PD-L1 exon 6; Set A
gaaugucagugcuacaccaaggcauaaua

SEQ ID NO: 24956 - RNA, 28 nt, Artificial Sequence
  Synthetic Oligonucleotide; PD-L1 exon 6; Set A
gaaugucagugcuacaccaaggcauaau

SEQ ID NO: 24957 - RNA, 26 nt, Artificial Sequence
  Synthetic Oligonucleotide; PD-L1 exon 6; Set A
aaugucagugcuacaccaaggcauaa

SEQ ID NO: 24958 - RNA, 30 nt, Artificial Sequence
  Synthetic Oligonucleotide; PD-L1 exon 6; Set A
ugaaugucagugcuacaccaaggcauaaua

SEQ ID NO: 24959 - RNA, 29 nt, Artificial Sequence
  Synthetic Oligonucleotide; PD-L1 exon 6; Set A
ugaaugucagugcuacaccaaggcauaau

SEQ ID NO: 24960 - RNA, 27 nt, Artificial Sequence
  Synthetic Oligonucleotide; PD-L1 exon 6; Set A
gaaugucagugcuacaccaaggcauaa

SEQ ID NO: 24961 - RNA, 16 nt, Artificial Sequence
  Synthetic Oligonucleotide; PD-L1 exon 6; Set C
ucagugcuacaccaag

SEQ ID NO: 24962 - RNA, 28 nt, Artificial Sequence
  Synthetic Oligonucleotide; PD-L1 exon 6; Set A
ugaaugucagugcuacaccaaggcauaa

SEQ ID NO: 24963 - RNA, 15 nt, Artificial Sequence
  Synthetic Oligonucleotide; PD-L1 exon 6; Set C
ucagugcuacaccaa

SEQ ID NO: 24964 - RNA, 38 nt, Artificial Sequence
  Synthetic Oligonucleotide; PD-L1 exon 6; Set C
acggaagaugaaugucagugcuacaccaaggcauaaua

SEQ ID NO: 24965 - RNA, 37 nt, Artificial Sequence
  Synthetic Oligonucleotide; PD-L1 exon 6; Set C
acggaagaugaaugucagugcuacaccaaggcauaau

SEQ ID NO: 24966 - RNA, 39 nt, Artificial Sequence
  Synthetic Oligonucleotide; PD-L1 exon 6; Set C
aacggaagaugaaugucagugcuacaccaaggcauaaua

SEQ ID NO: 24967 - RNA, 38 nt, Artificial Sequence
  Synthetic Oligonucleotide; PD-L1 exon 6; Set C
aacggaagaugaaugucagugcuacaccaaggcauaau

SEQ ID NO: 24968 - RNA, 36 nt, Artificial Sequence
  Synthetic Oligonucleotide; PD-L1 exon 6; Set C
acggaagaugaaugucagugcuacaccaaggcauaa

SEQ ID NO: 24969 - RNA, 40 nt, Artificial Sequence
  Synthetic Oligonucleotide; PD-L1 exon 6; Set C
aaacggaagaugaaugucagugcuacaccaaggcauaaua

SEQ ID NO: 24970 - RNA, 39 nt, Artificial Sequence
  Synthetic Oligonucleotide; PD-L1 exon 6; Set C
aaacggaagaugaaugucagugcuacaccaaggcauaau

SEQ ID NO: 24971 - RNA, 37 nt, Artificial Sequence
  Synthetic Oligonucleotide; PD-L1 exon 6; Set C
aacggaagaugaaugucagugcuacaccaaggcauaa

SEQ ID NO: 24972 - RNA, 40 nt, Artificial Sequence
  Synthetic Oligonucleotide; PD-L1 exon 6; Set C
uaaacggaagaugaaugucagugcuacaccaaggcauaau

SEQ ID NO: 24973 - RNA, 38 nt, Artificial Sequence
  Synthetic Oligonucleotide; PD-L1 exon 6; Set C
aaacggaagaugaaugucagugcuacaccaaggcauaa

SEQ ID NO: 24974 - RNA, 39 nt, Artificial Sequence
  Synthetic Oligonucleotide; PD-L1 exon 6; Set C
uaaacggaagaugaaugucagugcuacaccaaggcauaa

SEQ ID NO: 24975 - RNA, 40 nt, Artificial Sequence
  Synthetic Oligonucleotide; PD-L1 exon 6; Set C
uuaaacggaagaugaaugucagugcuacaccaaggcauaa

SEQ ID NO: 24976 - RNA, 20 nt, Artificial Sequence
  Synthetic Oligonucleotide; PD-L1 exon 6; Set C
cggaagaugaaugucagugc

SEQ ID NO: 24977 - RNA, 20 nt, Artificial Sequence
  Synthetic Oligonucleotide; PD-L1 exon 6; Set C
acggaagaugaaugucagug

SEQ ID NO: 24978 - RNA, 19 nt, Artificial Sequence
  Synthetic Oligonucleotide; PD-L1 exon 6; Set C
acggaagaugaaugucagu

SEQ ID NO: 24979 - RNA, 21 nt, Artificial Sequence
  Synthetic Oligonucleotide; PD-L1 exon 6; Set C
aacggaagaugaaugucagug

SEQ ID NO: 24980 - RNA, 20 nt, Artificial Sequence
  Synthetic Oligonucleotide; PD-L1 exon 6; Set C
aacggaagaugaaugucagu

SEQ ID NO: 24981 - RNA, 18 nt, Artificial Sequence
  Synthetic Oligonucleotide; PD-L1 exon 6; Set C
acggaagaugaaugucag

SEQ ID NO: 24982 - RNA, 22 nt, Artificial Sequence
  Synthetic Oligonucleotide; PD-L1 exon 6; Set C
aaacggaagaugaaugucagug

SEQ ID NO: 24983 - RNA, 33 nt, Artificial Sequence
  Synthetic Oligonucleotide; PD-L1 exon 6; Set A
uuucuuaaacggaagaugaaugucagugcuaca

SEQ ID NO: 24984 - RNA, 17 nt, Artificial Sequence
  Synthetic Oligonucleotide; PD-L1 exon 6; Set C
acggaagaugaauguca

SEQ ID NO: 24985 - RNA, 21 nt, Artificial Sequence
  Synthetic Oligonucleotide; PD-L1 exon 6; Set C
aaacggaagaugaaugucagu

SEQ ID NO: 24986 - RNA, 19 nt, Artificial Sequence
  Synthetic Oligonucleotide; PD-L1 exon 6; Set C
aacggaagaugaaugucag

SEQ ID NO: 24987 - RNA, 23 nt, Artificial Sequence
  Synthetic Oligonucleotide; PD-L1 exon 6; Set C
uaaacggaagaugaaugucagug

SEQ ID NO: 24988 - RNA, 34 nt, Artificial Sequence
  Synthetic Oligonucleotide; PD-L1 exon 6; Set A
uuuucuuaaacggaagaugaaugucagugcuaca

SEQ ID NO: 24989 - RNA, 32 nt, Artificial Sequence
  Synthetic Oligonucleotide; PD-L1 exon 6; Set A
uuucuuaaacggaagaugaaugucagugcuac

SEQ ID NO: 24990 - RNA, 18 nt, Artificial Sequence
  Synthetic Oligonucleotide; PD-L1 exon 6; Set C
aacggaagaugaauguca

SEQ ID NO: 24991 - RNA, 22 nt, Artificial Sequence
  Synthetic Oligonucleotide; PD-L1 exon 6; Set C
uaaacggaagaugaaugucagu

SEQ ID NO: 24992 - RNA, 20 nt, Artificial Sequence
  Synthetic Oligonucleotide; PD-L1 exon 6; Set C
aaacggaagaugaaugucag

SEQ ID NO: 24993 - RNA, 24 nt, Artificial Sequence
  Synthetic Oligonucleotide; PD-L1 exon 6; Set C
uuaaacggaagaugaaugucagug

SEQ ID NO: 24994 - RNA, 31 nt, Artificial Sequence
  Synthetic Oligonucleotide; PD-L1 exon 6; Set A
uuucuuaaacggaagaugaaugucagugcua

SEQ ID NO: 24995 - RNA, 19 nt, Artificial Sequence
  Synthetic Oligonucleotide; PD-L1 exon 6; Set C
aaacggaagaugaauguca

SEQ ID NO: 24996 - RNA, 23 nt, Artificial Sequence
  Synthetic Oligonucleotide; PD-L1 exon 6; Set C
uuaaacggaagaugaaugucagu

SEQ ID NO: 24997 - RNA, 21 nt, Artificial Sequence
  Synthetic Oligonucleotide; PD-L1 exon 6; Set C
uaaacggaagaugaaugucag

SEQ ID NO: 24998 - RNA, 25 nt, Artificial Sequence
  Synthetic Oligonucleotide; PD-L1 exon 6; Set C
cuuaaacggaagaugaaugucagug

SEQ ID NO: 24999 - RNA, 32 nt, Artificial Sequence
  Synthetic Oligonucleotide; PD-L1 exon 6; Set A
uuuucuuaaacggaagaugaaugucagugcua

SEQ ID NO: 25000 - RNA, 20 nt, Artificial Sequence
  Synthetic Oligonucleotide; PD-L1 exon 6; Set C
uaaacggaagaugaauguca

SEQ ID NO: 25001 - RNA, 24 nt, Artificial Sequence
  Synthetic Oligonucleotide; PD-L1 exon 6; Set C
cuuaaacggaagaugaaugucagu

SEQ ID NO: 25002 - RNA, 22 nt, Artificial Sequence
  Synthetic Oligonucleotide; PD-L1 exon 6; Set C
uuaaacggaagaugaaugucag

SEQ ID NO: 25003 - RNA, 26 nt, Artificial Sequence
  Synthetic Oligonucleotide; PD-L1 exon 6; Set C
ucuuaaacggaagaugaaugucagug

SEQ ID NO: 25004 - RNA, 21 nt, Artificial Sequence
  Synthetic Oligonucleotide; PD-L1 exon 6; Set C
uuaaacggaagaugaauguca

SEQ ID NO: 25005 - RNA, 25 nt, Artificial Sequence
  Synthetic Oligonucleotide; PD-L1 exon 6; Set C
ucuuaaacggaagaugaaugucagu

SEQ ID NO: 25006 - RNA, 23 nt, Artificial Sequence
  Synthetic Oligonucleotide; PD-L1 exon 6; Set C
cuuaaacggaagaugaaugucag

SEQ ID NO: 25007 - RNA, 27 nt, Artificial Sequence
  Synthetic Oligonucleotide; PD-L1 exon 6; Set C
uucuuaaacggaagaugaaugucagug

SEQ ID NO: 25008 - RNA, 26 nt, Artificial Sequence
  Synthetic Oligonucleotide; PD-L1 exon 6; Set C
uucuuaaacggaagaugaaugucagu

SEQ ID NO: 25009 - RNA, 24 nt, Artificial Sequence
  Synthetic Oligonucleotide; PD-L1 exon 6; Set C
ucuuaaacggaagaugaaugucag

SEQ ID NO: 25010 - RNA, 25 nt, Artificial Sequence
  Synthetic Oligonucleotide; PD-L1 exon 6; Set C
uucuuaaacggaagaugaaugucag

SEQ ID NO: 25011 - RNA, 24 nt, Artificial Sequence
  Synthetic Oligonucleotide; PD-L1 exon 6; Set C
uuucuuaaacggaagaugaauguc

SEQ ID NO: 25012 - RNA, 25 nt, Artificial Sequence
  Synthetic Oligonucleotide; PD-L1 exon 6; Set C
uuuucuuaaacggaagaugaauguc

SEQ ID NO: 25013 - RNA, 23 nt, Artificial Sequence
  Synthetic Oligonucleotide; PD-L1 exon 6; Set C
uuucuuaaacggaagaugaaugu

SEQ ID NO: 25014 - RNA, 24 nt, Artificial Sequence
  Synthetic Oligonucleotide; PD-L1 exon 6; Set C
uuuucuuaaacggaagaugaaugu

SEQ ID NO: 25015 - RNA, 22 nt, Artificial Sequence
  Synthetic Oligonucleotide; PD-L1 exon 6; Set C
uuucuuaaacggaagaugaaug

SEQ ID NO: 25016 - RNA, 34 nt, Artificial Sequence
  Synthetic Oligonucleotide; PD-L1 exon 6; Set A
cuaccuuuucuuaaacggaagaugaaugucagug

SEQ ID NO: 25017 - RNA, 23 nt, Artificial Sequence
  Synthetic Oligonucleotide; PD-L1 exon 6; Set C
uuuucuuaaacggaagaugaaug

SEQ ID NO: 25018 - RNA, 21 nt, Artificial Sequence
  Synthetic Oligonucleotide; PD-L1 exon 6; Set C
uuucuuaaacggaagaugaau

SEQ ID NO: 25019 - RNA, 33 nt, Artificial Sequence
  Synthetic Oligonucleotide; PD-L1 exon 6; Set A
cuaccuuuucuuaaacggaagaugaaugucagu

SEQ ID NO: 25020 - RNA, 35 nt, Artificial Sequence
  Synthetic Oligonucleotide; PD-L1 exon 6; Set A
acuaccuuuucuuaaacggaagaugaaugucagug

SEQ ID NO: 25021 - RNA, 20 nt, Artificial Sequence
  Synthetic Oligonucleotide; PD-L1 exon 6; Set C
uuucuuaaacggaagaugaa

SEQ ID NO: 25022 - RNA, 34 nt, Artificial Sequence
  Synthetic Oligonucleotide; PD-L1 exon 6; Set A
acuaccuuuucuuaaacggaagaugaaugucagu

SEQ ID NO: 25023 - RNA, 32 nt, Artificial Sequence
  Synthetic Oligonucleotide; PD-L1 exon 6; Set A
cuaccuuuucuuaaacggaagaugaaugucag

SEQ ID NO: 25024 - RNA, 36 nt, Artificial Sequence
  Synthetic Oligonucleotide; PD-L1 exon 6; Set A
uacuaccuuuucuuaaacggaagaugaaugucagug

SEQ ID NO: 25025 - RNA, 31 nt, Artificial Sequence
  Synthetic Oligonucleotide; PD-L1 exon 6; Set A
cuaccuuuucuuaaacggaagaugaauguca

SEQ ID NO: 25026 - RNA, 35 nt, Artificial Sequence
  Synthetic Oligonucleotide; PD-L1 exon 6; Set A
uacuaccuuuucuuaaacggaagaugaaugucagu

SEQ ID NO: 25027 - RNA, 33 nt, Artificial Sequence
  Synthetic Oligonucleotide; PD-L1 exon 6; Set A
acuaccuuuucuuaaacggaagaugaaugucag

SEQ ID NO: 25028 - RNA, 37 nt, Artificial Sequence
  Synthetic Oligonucleotide; PD-L1 exon 6; Set A
auacuaccuuuucuuaaacggaagaugaaugucagug

SEQ ID NO: 25029 - RNA, 32 nt, Artificial Sequence
  Synthetic Oligonucleotide; PD-L1 exon 6; Set A
acuaccuuuucuuaaacggaagaugaauguca

SEQ ID NO: 25030 - RNA, 36 nt, Artificial Sequence
  Synthetic Oligonucleotide; PD-L1 exon 6; Set A
auacuaccuuuucuuaaacggaagaugaaugucagu

SEQ ID NO: 25031 - RNA, 34 nt, Artificial Sequence
  Synthetic Oligonucleotide; PD-L1 exon 6; Set A
uacuaccuuuucuuaaacggaagaugaaugucag

SEQ ID NO: 25032 - RNA, 38 nt, Artificial Sequence
  Synthetic Oligonucleotide; PD-L1 exon 6; Set A
aauacuaccuuuucuuaaacggaagaugaaugucagug

SEQ ID NO: 25033 - RNA, 33 nt, Artificial Sequence
  Synthetic Oligonucleotide; PD-L1 exon 6; Set A
uacuaccuuuucuuaaacggaagaugaauguca

SEQ ID NO: 25034 - RNA, 37 nt, Artificial Sequence
  Synthetic Oligonucleotide; PD-L1 exon 6; Set A
aauacuaccuuuucuuaaacggaagaugaaugucagu

SEQ ID NO: 25035 - RNA, 35 nt, Artificial Sequence
  Synthetic Oligonucleotide; PD-L1 exon 6; Set A
auacuaccuuuucuuaaacggaagaugaaugucag

SEQ ID NO: 25036 - RNA, 39 nt, Artificial Sequence
  Synthetic Oligonucleotide; PD-L1 exon 6; Set A
aaauacuaccuuuucuuaaacggaagaugaaugucagug

SEQ ID NO: 25037 - RNA, 34 nt, Artificial Sequence
  Synthetic Oligonucleotide; PD-L1 exon 6; Set A
auacuaccuuuucuuaaacggaagaugaauguca

SEQ ID NO: 25038 - RNA, 38 nt, Artificial Sequence
  Synthetic Oligonucleotide; PD-L1 exon 6; Set A
aaauacuaccuuuucuuaaacggaagaugaaugucagu

SEQ ID NO: 25039 - RNA, 36 nt, Artificial Sequence
  Synthetic Oligonucleotide; PD-L1 exon 6; Set A
aauacuaccuuuucuuaaacggaagaugaaugucag

SEQ ID NO: 25040 - RNA, 35 nt, Artificial Sequence
  Synthetic Oligonucleotide; PD-L1 exon 6; Set A
aauacuaccuuuucuuaaacggaagaugaauguca

SEQ ID NO: 25041 - RNA, 37 nt, Artificial Sequence
  Synthetic Oligonucleotide; PD-L1 exon 6; Set A
aaauacuaccuuuucuuaaacggaagaugaaugucag

SEQ ID NO: 25042 - RNA, 36 nt, Artificial Sequence
  Synthetic Oligonucleotide; PD-L1 exon 6; Set A
aaauacuaccuuuucuuaaacggaagaugaauguca

SEQ ID NO: 25043 - RNA, 27 nt, Artificial Sequence
  Synthetic Oligonucleotide; PD-L1 exon 6; Set C
uaaggaaauacuaccuuuucuuaaacg

SEQ ID NO: 25044 - RNA, 26 nt, Artificial Sequence
  Synthetic Oligonucleotide; PD-L1 exon 6; Set C
uaaggaaauacuaccuuuucuuaaac

SEQ ID NO: 25045 - RNA, 28 nt, Artificial Sequence
  Synthetic Oligonucleotide; PD-L1 exon 6; Set C
uuaaggaaauacuaccuuuucuuaaacg

SEQ ID NO: 25046 - RNA, 25 nt, Artificial Sequence
  Synthetic Oligonucleotide; PD-L1 exon 6; Set C
uaaggaaauacuaccuuuucuuaaa

SEQ ID NO: 25047 - RNA, 27 nt, Artificial Sequence
  Synthetic Oligonucleotide; PD-L1 exon 6; Set C
uuaaggaaauacuaccuuuucuuaaac

SEQ ID NO: 25048 - RNA, 24 nt, Artificial Sequence
  Synthetic Oligonucleotide; PD-L1 exon 6; Set C
uaaggaaauacuaccuuuucuuaa

SEQ ID NO: 25049 - RNA, 26 nt, Artificial Sequence
  Synthetic Oligonucleotide; PD-L1 exon 6; Set C
uuaaggaaauacuaccuuuucuuaaa

SEQ ID NO: 25050 - RNA, 25 nt, Artificial Sequence
  Synthetic Oligonucleotide; PD-L1 exon 6; Set C
uuaaggaaauacuaccuuuucuuaa

SEQ ID NO: 25051 - RNA, 23 nt, Artificial Sequence
  Synthetic Oligonucleotide; PD-L1 exon 6; Set C
uaaggaaauacuaccuuuucuua

SEQ ID NO: 25052 - RNA, 24 nt, Artificial Sequence
  Synthetic Oligonucleotide; PD-L1 exon 6; Set C
uuaaggaaauacuaccuuuucuua

SEQ ID NO: 25053 - RNA, 23 nt, Artificial Sequence
  Synthetic Oligonucleotide; PD-L1 exon 6; Set C
uuaaggaaauacuaccuuuucuu

SEQ ID NO: 25054 - RNA, 22 nt, Artificial Sequence
  Synthetic Oligonucleotide; PD-L1 exon 6; Set C
aauuaaggaaauacuaccuuuu

SEQ ID NO: 25055 - RNA, 23 nt, Artificial Sequence
  Synthetic Oligonucleotide; PD-L1 exon 6; Set C
caauuaaggaaauacuaccuuuu

SEQ ID NO: 25056 - RNA, 21 nt, Artificial Sequence
  Synthetic Oligonucleotide; PD-L1 exon 6; Set C
agaccacugcaauuaaggaaa

SEQ ID NO: 25057 - RNA, 31 nt, Artificial Sequence
  Synthetic Oligonucleotide; PD-L1 exon 6; Set C
ccccaguggagaccacugcaauuaaggaaau

SEQ ID NO: 25058 - RNA, 32 nt, Artificial Sequence
  Synthetic Oligonucleotide; PD-L1 exon 6; Set C
cccccaguggagaccacugcaauuaaggaaau

SEQ ID NO: 25059 - RNA, 30 nt, Artificial Sequence
  Synthetic Oligonucleotide; PD-L1 exon 6; Set C
ccccaguggagaccacugcaauuaaggaaa

SEQ ID NO: 25060 - RNA, 31 nt, Artificial Sequence
  Synthetic Oligonucleotide; PD-L1 exon 6; Set C
cccccaguggagaccacugcaauuaaggaaa

SEQ ID NO: 25061 - RNA, 23 nt, Artificial Sequence
  Synthetic Oligonucleotide; PD-L1 exon 6; Set B
ccccaguggagaccacugcaauu

SEQ ID NO: 25062 - RNA, 22 nt, Artificial Sequence
  Synthetic Oligonucleotide; PD-L1 exon 6; Set B
ccccaguggagaccacugcaau

SEQ ID NO: 25063 - RNA, 24 nt, Artificial Sequence
  Synthetic Oligonucleotide; PD-L1 exon 6; Set C
cccccaguggagaccacugcaauu

SEQ ID NO: 25064 - RNA, 23 nt, Artificial Sequence
  Synthetic Oligonucleotide; PD-L1 exon 6; Set C
cccccaguggagaccacugcaau

SEQ ID NO: 25065 - RNA, 21 nt, Artificial Sequence
  Synthetic Oligonucleotide; PD-L1 exon 6; Set C
ccccaguggagaccacugcaa

SEQ ID NO: 25066 - RNA, 22 nt, Artificial Sequence
  Synthetic Oligonucleotide; PD-L1 exon 6; Set C
cccccaguggagaccacugcaa

SEQ ID NO: 25067 - RNA, 30 nt, Artificial Sequence
  Synthetic Oligonucleotide; PRDM1 exon 4; Set B
uuuguucuguaauccacuuacugagauuca

SEQ ID NO: 25068 - RNA, 31 nt, Artificial Sequence
  Synthetic Oligonucleotide; PRDM1 exon 4; Set B
uuuuguucuguaauccacuuacugagauuca

SEQ ID NO: 25069 - RNA, 29 nt, Artificial Sequence
  Synthetic Oligonucleotide; PRDM1 exon 4; Set B
uuuguucuguaauccacuuacugagauuc

SEQ ID NO: 25070 - RNA, 32 nt, Artificial Sequence
  Synthetic Oligonucleotide; PRDM1 exon 4; Set B
uuuuuguucuguaauccacuuacugagauuca

SEQ ID NO: 25071 - RNA, 30 nt, Artificial Sequence
  Synthetic Oligonucleotide; PRDM1 exon 4; Set B
uuuuguucuguaauccacuuacugagauuc

SEQ ID NO: 25072 - RNA, 28 nt, Artificial Sequence
  Synthetic Oligonucleotide; PRDM1 exon 4; Set B
uuuguucuguaauccacuuacugagauu

SEQ ID NO: 25073 - RNA, 33 nt, Artificial Sequence
  Synthetic Oligonucleotide; PRDM1 exon 4; Set B
uuuuuuguucuguaauccacuuacugagauuca

SEQ ID NO: 25074 - RNA, 31 nt, Artificial Sequence
  Synthetic Oligonucleotide; PRDM1 exon 4; Set B
uuuuuguucuguaauccacuuacugagauuc

SEQ ID NO: 25075 - RNA, 29 nt, Artificial Sequence
  Synthetic Oligonucleotide; PRDM1 exon 4; Set B
uuuuguucuguaauccacuuacugagauu

SEQ ID NO: 25076 - RNA, 34 nt, Artificial Sequence
  Synthetic Oligonucleotide; PRDM1 exon 4; Set B
uuuuuuuguucuguaauccacuuacugagauuca

SEQ ID NO: 25077 - RNA, 32 nt, Artificial Sequence
  Synthetic Oligonucleotide; PRDM1 exon 4; Set B
uuuuuuguucuguaauccacuuacugagauuc

SEQ ID NO: 25078 - RNA, 30 nt, Artificial Sequence
  Synthetic Oligonucleotide; PRDM1 exon 4; Set B
uuuuuguucuguaauccacuuacugagauu

SEQ ID NO: 25079 - RNA, 35 nt, Artificial Sequence
  Synthetic Oligonucleotide; PRDM1 exon 4; Set B
auuuuuuuguucuguaauccacuuacugagauuca

SEQ ID NO: 25080 - RNA, 33 nt, Artificial Sequence
  Synthetic Oligonucleotide; PRDM1 exon 4; Set B
uuuuuuuguucuguaauccacuuacugagauuc

SEQ ID NO: 25081 - RNA, 31 nt, Artificial Sequence
  Synthetic Oligonucleotide; PRDM1 exon 4; Set B
uuuuuuguucuguaauccacuuacugagauu

SEQ ID NO: 25082 - RNA, 29 nt, Artificial Sequence
  Synthetic Oligonucleotide; PRDM1 exon 4; Set B
uuuuuguucuguaauccacuuacugagau

SEQ ID NO: 25083 - RNA, 36 nt, Artificial Sequence
  Synthetic Oligonucleotide; PRDM1 exon 4; Set B
uauuuuuuuguucuguaauccacuuacugagauuca

SEQ ID NO: 25084 - RNA, 34 nt, Artificial Sequence
  Synthetic Oligonucleotide; PRDM1 exon 4; Set B
auuuuuuuguucuguaauccacuuacugagauuc

SEQ ID NO: 25085 - RNA, 32 nt, Artificial Sequence
  Synthetic Oligonucleotide; PRDM1 exon 4; Set B
uuuuuuuguucuguaauccacuuacugagauu

SEQ ID NO: 25086 - RNA, 30 nt, Artificial Sequence
  Synthetic Oligonucleotide; PRDM1 exon 4; Set B
uuuuuuguucuguaauccacuuacugagau

SEQ ID NO: 25087 - RNA, 37 nt, Artificial Sequence
  Synthetic Oligonucleotide; PRDM1 exon 4; Set B
uuauuuuuuuguucuguaauccacuuacugagauuca

SEQ ID NO: 25088 - RNA, 35 nt, Artificial Sequence
  Synthetic Oligonucleotide; PRDM1 exon 4; Set B
uauuuuuuuguucuguaauccacuuacugagauuc

SEQ ID NO: 25089 - RNA, 33 nt, Artificial Sequence
  Synthetic Oligonucleotide; PRDM1 exon 4; Set B
auuuuuuuguucuguaauccacuuacugagauu

SEQ ID NO: 25090 - RNA, 31 nt, Artificial Sequence
  Synthetic Oligonucleotide; PRDM1 exon 4; Set B
uuuuuuuguucuguaauccacuuacugagau

SEQ ID NO: 25091 - RNA, 38 nt, Artificial Sequence
  Synthetic Oligonucleotide; PRDM1 exon 4; Set B
uuuauuuuuuuguucuguaauccacuuacugagauuca

SEQ ID NO: 25092 - RNA, 36 nt, Artificial Sequence
  Synthetic Oligonucleotide; PRDM1 exon 4; Set B
uuauuuuuuuguucuguaauccacuuacugagauuc

SEQ ID NO: 25093 - RNA, 34 nt, Artificial Sequence
  Synthetic Oligonucleotide; PRDM1 exon 4; Set B
uauuuuuuuguucuguaauccacuuacugagauu

SEQ ID NO: 25094 - RNA, 32 nt, Artificial Sequence
  Synthetic Oligonucleotide; PRDM1 exon 4; Set B
auuuuuuuguucuguaauccacuuacugagau

SEQ ID NO: 25095 - RNA, 39 nt, Artificial Sequence
  Synthetic Oligonucleotide; PRDM1 exon 4; Set B
uuuuauuuuuuuguucuguaauccacuuacugagauuca

SEQ ID NO: 25096 - RNA, 37 nt, Artificial Sequence
  Synthetic Oligonucleotide; PRDM1 exon 4; Set B
uuuauuuuuuuguucuguaauccacuuacugagauuc

SEQ ID NO: 25097 - RNA, 35 nt, Artificial Sequence
  Synthetic Oligonucleotide; PRDM1 exon 4; Set B
uuauuuuuuuguucuguaauccacuuacugagauu

SEQ ID NO: 25098 - RNA, 33 nt, Artificial Sequence
  Synthetic Oligonucleotide; PRDM1 exon 4; Set B
uauuuuuuuguucuguaauccacuuacugagau

SEQ ID NO: 25099 - RNA, 38 nt, Artificial Sequence
  Synthetic Oligonucleotide; PRDM1 exon 4; Set B
uuuuauuuuuuuguucuguaauccacuuacugagauuc

SEQ ID NO: 25100 - RNA, 40 nt, Artificial Sequence
  Synthetic Oligonucleotide; PRDM1 exon 4; Set B
uuuuuauuuuuuuguucuguaauccacuuacugagauuca

SEQ ID NO: 25101 - RNA, 36 nt, Artificial Sequence
  Synthetic Oligonucleotide; PRDM1 exon 4; Set B
uuuauuuuuuuguucuguaauccacuuacugagauu

SEQ ID NO: 25102 - RNA, 34 nt, Artificial Sequence
  Synthetic Oligonucleotide; PRDM1 exon 4; Set B
uuauuuuuuuguucuguaauccacuuacugagau

SEQ ID NO: 25103 - RNA, 39 nt, Artificial Sequence
  Synthetic Oligonucleotide; PRDM1 exon 4; Set B
uuuuuauuuuuuuguucuguaauccacuuacugagauuc

SEQ ID NO: 25104 - RNA, 37 nt, Artificial Sequence
  Synthetic Oligonucleotide; PRDM1 exon 4; Set B
uuuuauuuuuuuguucuguaauccacuuacugagauu

SEQ ID NO: 25105 - RNA, 35 nt, Artificial Sequence
  Synthetic Oligonucleotide; PRDM1 exon 4; Set B
uuuauuuuuuuguucuguaauccacuuacugagau

SEQ ID NO: 25106 - RNA, 40 nt, Artificial Sequence
  Synthetic Oligonucleotide; PRDM1 exon 4; Set B
uuuuuuauuuuuuuguucuguaauccacuuacugagauuc

SEQ ID NO: 25107 - RNA, 38 nt, Artificial Sequence
  Synthetic Oligonucleotide; PRDM1 exon 4; Set B
uuuuuauuuuuuuguucuguaauccacuuacugagauu

SEQ ID NO: 25108 - RNA, 36 nt, Artificial Sequence
  Synthetic Oligonucleotide; PRDM1 exon 4; Set B
uuuuauuuuuuuguucuguaauccacuuacugagau

SEQ ID NO: 25109 - RNA, 39 nt, Artificial Sequence
  Synthetic Oligonucleotide; PRDM1 exon 4; Set B
uuuuuuauuuuuuuguucuguaauccacuuacugagauu

SEQ ID NO: 25110 - RNA, 37 nt, Artificial Sequence
  Synthetic Oligonucleotide; PRDM1 exon 4; Set B
uuuuuauuuuuuuguucuguaauccacuuacugagau

SEQ ID NO: 25111 - RNA, 40 nt, Artificial Sequence
  Synthetic Oligonucleotide; PRDM1 exon 4; Set B
auuuuuuauuuuuuuguucuguaauccacuuacugagauu

SEQ ID NO: 25112 - RNA, 38 nt, Artificial Sequence
  Synthetic Oligonucleotide; PRDM1 exon 4; Set B
uuuuuuauuuuuuuguucuguaauccacuuacugagau

SEQ ID NO: 25113 - RNA, 39 nt, Artificial Sequence
  Synthetic Oligonucleotide; PRDM1 exon 4; Set B
auuuuuuauuuuuuuguucuguaauccacuuacugagau

SEQ ID NO: 25114 - RNA, 40 nt, Artificial Sequence
  Synthetic Oligonucleotide; PRDM1 exon 4; Set B
cauuuuuuauuuuuuuguucuguaauccacuuacugagau

SEQ ID NO: 25115 - RNA, 15 nt, Artificial Sequence
  Synthetic Oligonucleotide; PRDM1 exon 4; Set C
uuauuuuuuuguucu

SEQ ID NO: 25116 - RNA, 16 nt, Artificial Sequence
  Synthetic Oligonucleotide; PRDM1 exon 4; Set C
uuuauuuuuuuguucu

SEQ ID NO: 25117 - RNA, 15 nt, Artificial Sequence
  Synthetic Oligonucleotide; PRDM1 exon 4; Set C
uuuauuuuuuuguuc

SEQ ID NO: 25118 - RNA, 17 nt, Artificial Sequence
  Synthetic Oligonucleotide; PRDM1 exon 4; Set C
uuuuauuuuuuuguucu

SEQ ID NO: 25119 - RNA, 16 nt, Artificial Sequence
  Synthetic Oligonucleotide; PRDM1 exon 4; Set C
uuuuauuuuuuuguuc

SEQ ID NO: 25120 - RNA, 18 nt, Artificial Sequence
  Synthetic Oligonucleotide; PRDM1 exon 4; Set C
uuuuuauuuuuuuguucu

SEQ ID NO: 25121 - RNA, 15 nt, Artificial Sequence
  Synthetic Oligonucleotide; PRDM1 exon 4; Set C
uuuuauuuuuuuguu

SEQ ID NO: 25122 - RNA, 17 nt, Artificial Sequence
  Synthetic Oligonucleotide; PRDM1 exon 4; Set C
uuuuuauuuuuuuguuc

SEQ ID NO: 25123 - RNA, 19 nt, Artificial Sequence
  Synthetic Oligonucleotide; PRDM1 exon 4; Set C
uuuuuuauuuuuuuguucu

SEQ ID NO: 25124 - RNA, 16 nt, Artificial Sequence
  Synthetic Oligonucleotide; PRDM1 exon 4; Set C
uuuuuauuuuuuuguu

SEQ ID NO: 25125 - RNA, 18 nt, Artificial Sequence
  Synthetic Oligonucleotide; PRDM1 exon 4; Set C
uuuuuuauuuuuuuguuc

SEQ ID NO: 25126 - RNA, 20 nt, Artificial Sequence
  Synthetic Oligonucleotide; PRDM1 exon 4; Set C
auuuuuuauuuuuuuguucu

SEQ ID NO: 25127 - RNA, 15 nt, Artificial Sequence
  Synthetic Oligonucleotide; PRDM1 exon 4; Set C
uuuuuauuuuuuugu

SEQ ID NO: 25128 - RNA, 17 nt, Artificial Sequence
  Synthetic Oligonucleotide; PRDM1 exon 4; Set C
uuuuuuauuuuuuuguu

SEQ ID NO: 25129 - RNA, 19 nt, Artificial Sequence
  Synthetic Oligonucleotide; PRDM1 exon 4; Set C
auuuuuuauuuuuuuguuc

SEQ ID NO: 25130 - RNA, 21 nt, Artificial Sequence
  Synthetic Oligonucleotide; PRDM1 exon 4; Set C
cauuuuuuauuuuuuuguucu

SEQ ID NO: 25131 - RNA, 16 nt, Artificial Sequence
  Synthetic Oligonucleotide; PRDM1 exon 4; Set C
uuuuuuauuuuuuugu

SEQ ID NO: 25132 - RNA, 18 nt, Artificial Sequence
  Synthetic Oligonucleotide; PRDM1 exon 4; Set C
auuuuuuauuuuuuuguu

SEQ ID NO: 25133 - RNA, 20 nt, Artificial Sequence
  Synthetic Oligonucleotide; PRDM1 exon 4; Set C
cauuuuuuauuuuuuuguuc

SEQ ID NO: 25134 - RNA, 22 nt, Artificial Sequence
  Synthetic Oligonucleotide; PRDM1 exon 4; Set C
gcauuuuuuauuuuuuuguucu

SEQ ID NO: 25135 - RNA, 15 nt, Artificial Sequence
  Synthetic Oligonucleotide; PRDM1 exon 4; Set C
uuuuuuauuuuuuug

SEQ ID NO: 25136 - RNA, 17 nt, Artificial Sequence
  Synthetic Oligonucleotide; PRDM1 exon 4; Set C
auuuuuuauuuuuuugu

SEQ ID NO: 25137 - RNA, 19 nt, Artificial Sequence
  Synthetic Oligonucleotide; PRDM1 exon 4; Set C
cauuuuuuauuuuuuuguu

SEQ ID NO: 25138 - RNA, 21 nt, Artificial Sequence
  Synthetic Oligonucleotide; PRDM1 exon 4; Set C
gcauuuuuuauuuuuuuguuc

SEQ ID NO: 25139 - RNA, 16 nt, Artificial Sequence
  Synthetic Oligonucleotide; PRDM1 exon 4; Set C
auuuuuuauuuuuuug

SEQ ID NO: 25140 - RNA, 18 nt, Artificial Sequence
  Synthetic Oligonucleotide; PRDM1 exon 4; Set C
cauuuuuuauuuuuuugu

SEQ ID NO: 25141 - RNA, 20 nt, Artificial Sequence
  Synthetic Oligonucleotide; PRDM1 exon 4; Set C
gcauuuuuuauuuuuuuguu

SEQ ID NO: 25142 - RNA, 15 nt, Artificial Sequence
  Synthetic Oligonucleotide; PRDM1 exon 4; Set C
auuuuuuauuuuuuu

SEQ ID NO: 25143 - RNA, 17 nt, Artificial Sequence
  Synthetic Oligonucleotide; PRDM1 exon 4; Set C
cauuuuuuauuuuuuug

SEQ ID NO: 25144 - RNA, 19 nt, Artificial Sequence
  Synthetic Oligonucleotide; PRDM1 exon 4; Set C
gcauuuuuuauuuuuuugu

SEQ ID NO: 25145 - RNA, 16 nt, Artificial Sequence
  Synthetic Oligonucleotide; PRDM1 exon 4; Set C
cauuuuuuauuuuuuu

SEQ ID NO: 25146 - RNA, 18 nt, Artificial Sequence
  Synthetic Oligonucleotide; PRDM1 exon 4; Set C
gcauuuuuuauuuuuuug

SEQ ID NO: 25147 - RNA, 15 nt, Artificial Sequence
  Synthetic Oligonucleotide; PRDM1 exon 4; Set C
cauuuuuuauuuuuu

SEQ ID NO: 25148 - RNA, 17 nt, Artificial Sequence
  Synthetic Oligonucleotide; PRDM1 exon 4; Set C
gcauuuuuuauuuuuuu

SEQ ID NO: 25149 - RNA, 27 nt, Artificial Sequence
  Synthetic Oligonucleotide; PRDM1 exon 4; Set C
uacuggcauuuuuuauuuuuuuguucu

SEQ ID NO: 25150 - RNA, 16 nt, Artificial Sequence
  Synthetic Oligonucleotide; PRDM1 exon 4; Set C
gcauuuuuuauuuuuu

SEQ ID NO: 25151 - RNA, 26 nt, Artificial Sequence
  Synthetic Oligonucleotide; PRDM1 exon 4; Set C
uacuggcauuuuuuauuuuuuuguuc

SEQ ID NO: 25152 - RNA, 28 nt, Artificial Sequence
  Synthetic Oligonucleotide; PRDM1 exon 4; Set C
uuacuggcauuuuuuauuuuuuuguucu

SEQ ID NO: 25153 - RNA, 15 nt, Artificial Sequence
  Synthetic Oligonucleotide; PRDM1 exon 4; Set C
gcauuuuuuauuuuu

SEQ ID NO: 25154 - RNA, 25 nt, Artificial Sequence
  Synthetic Oligonucleotide; PRDM1 exon 4; Set C
uacuggcauuuuuuauuuuuuuguu

SEQ ID NO: 25155 - RNA, 27 nt, Artificial Sequence
  Synthetic Oligonucleotide; PRDM1 exon 4; Set C
uuacuggcauuuuuuauuuuuuuguuc

SEQ ID NO: 25156 - RNA, 24 nt, Artificial Sequence
  Synthetic Oligonucleotide; PRDM1 exon 4; Set C
uacuggcauuuuuuauuuuuuugu

SEQ ID NO: 25157 - RNA, 26 nt, Artificial Sequence
  Synthetic Oligonucleotide; PRDM1 exon 4; Set C
uuacuggcauuuuuuauuuuuuuguu

SEQ ID NO: 25158 - RNA, 25 nt, Artificial Sequence
  Synthetic Oligonucleotide; PRDM1 exon 4; Set C
uuacuggcauuuuuuauuuuuuugu

SEQ ID NO: 25159 - RNA, 23 nt, Artificial Sequence
  Synthetic Oligonucleotide; PRDM1 exon 4; Set C
uacuggcauuuuuuauuuuuuug

SEQ ID NO: 25160 - RNA, 22 nt, Artificial Sequence
  Synthetic Oligonucleotide; PRDM1 exon 4; Set C
uacuggcauuuuuuauuuuuuu

SEQ ID NO: 25161 - RNA, 24 nt, Artificial Sequence
  Synthetic Oligonucleotide; PRDM1 exon 4; Set C
uuacuggcauuuuuuauuuuuuug

SEQ ID NO: 25162 - RNA, 23 nt, Artificial Sequence
  Synthetic Oligonucleotide; PRDM1 exon 4; Set C
uuacuggcauuuuuuauuuuuuu

SEQ ID NO: 25163 - RNA, 21 nt, Artificial Sequence
  Synthetic Oligonucleotide; PRDM1 exon 4; Set C
uacuggcauuuuuuauuuuuu

SEQ ID NO: 25164 - RNA, 20 nt, Artificial Sequence
  Synthetic Oligonucleotide; PRDM1 exon 4; Set C
uacuggcauuuuuuauuuuu

SEQ ID NO: 25165 - RNA, 22 nt, Artificial Sequence
  Synthetic Oligonucleotide; PRDM1 exon 4; Set C
uuacuggcauuuuuuauuuuuu

SEQ ID NO: 25166 - RNA, 21 nt, Artificial Sequence
  Synthetic Oligonucleotide; PRDM1 exon 4; Set C
uuacuggcauuuuuuauuuuu

SEQ ID NO: 25167 - RNA, 19 nt, Artificial Sequence
  Synthetic Oligonucleotide; PRDM1 exon 4; Set C
uacuggcauuuuuuauuuu

SEQ ID NO: 25168 - RNA, 20 nt, Artificial Sequence
  Synthetic Oligonucleotide; PRDM1 exon 4; Set C
uuacuggcauuuuuuauuuu

SEQ ID NO: 25169 - RNA, 18 nt, Artificial Sequence
  Synthetic Oligonucleotide; PRDM1 exon 4; Set C
uacuggcauuuuuuauuu

SEQ ID NO: 25170 - RNA, 19 nt, Artificial Sequence
  Synthetic Oligonucleotide; PRDM1 exon 4; Set C
uuacuggcauuuuuuauuu

SEQ ID NO: 25171 - RNA, 17 nt, Artificial Sequence
  Synthetic Oligonucleotide; PRDM1 exon 4; Set C
uacuggcauuuuuuauu

SEQ ID NO: 25172 - RNA, 18 nt, Artificial Sequence
  Synthetic Oligonucleotide; PRDM1 exon 4; Set C
uuacuggcauuuuuuauu

SEQ ID NO: 25173 - RNA, 16 nt, Artificial Sequence
  Synthetic Oligonucleotide; PRDM1 exon 4; Set C
uacuggcauuuuuuau

SEQ ID NO: 25174 - RNA, 17 nt, Artificial Sequence
  Synthetic Oligonucleotide; PRDM1 exon 4; Set C
uuacuggcauuuuuuau

SEQ ID NO: 25175 - RNA, 15 nt, Artificial Sequence
  Synthetic Oligonucleotide; PRDM1 exon 4; Set C
uacuggcauuuuuua

SEQ ID NO: 25176 - RNA, 16 nt, Artificial Sequence
  Synthetic Oligonucleotide; PRDM1 exon 4; Set C
uuacuggcauuuuuua

SEQ ID NO: 25177 - RNA, 15 nt, Artificial Sequence
  Synthetic Oligonucleotide; PRDM1 exon 4; Set C
uuacuggcauuuuuu

SEQ ID NO: 25178 - RNA, 17 nt, Artificial Sequence
  Synthetic Oligonucleotide; PRDM1 exon 4; Set C
agucagacccaaagcuc

SEQ ID NO: 25179 - RNA, 16 nt, Artificial Sequence
  Synthetic Oligonucleotide; PRDM1 exon 4; Set C
agucagacccaaagcu

SEQ ID NO: 25180 - RNA, 15 nt, Artificial Sequence
  Synthetic Oligonucleotide; PRDM1 exon 4; Set C
agucagacccaaagc

SEQ ID NO: 25181 - RNA, 15 nt, Artificial Sequence
  Synthetic Oligonucleotide; PRDM1 exon 4; Set C
gguuuugcucccggg

SEQ ID NO: 25182 - RNA, 16 nt, Artificial Sequence
  Synthetic Oligonucleotide; PRDM1 exon 4; Set C
agguuuugcucccggg

SEQ ID NO: 25183 - RNA, 16 nt, Artificial Sequence
  Synthetic Oligonucleotide; PRDM1 exon 4; Set C
cacuuacugagauuca

SEQ ID NO: 25184 - RNA, 17 nt, Artificial Sequence
  Synthetic Oligonucleotide; PRDM1 exon 4; Set C
ccacuuacugagauuca

SEQ ID NO: 25185 - RNA, 15 nt, Artificial Sequence
  Synthetic Oligonucleotide; PRDM1 exon 4; Set C
cacuuacugagauuc

SEQ ID NO: 25186 - RNA, 18 nt, Artificial Sequence
  Synthetic Oligonucleotide; PRDM1 exon 4; Set C
uccacuuacugagauuca

SEQ ID NO: 25187 - RNA, 16 nt, Artificial Sequence
  Synthetic Oligonucleotide; PRDM1 exon 4; Set C
ccacuuacugagauuc

SEQ ID NO: 25188 - RNA, 17 nt, Artificial Sequence
  Synthetic Oligonucleotide; PRDM1 exon 4; Set C
uccacuuacugagauuc

SEQ ID NO: 25189 - RNA, 15 nt, Artificial Sequence
  Synthetic Oligonucleotide; PRDM1 exon 4; Set C
ccacuuacugagauu

SEQ ID NO: 25190 - RNA, 16 nt, Artificial Sequence
  Synthetic Oligonucleotide; PRDM1 exon 4; Set C
uccacuuacugagauu

SEQ ID NO: 25191 - RNA, 15 nt, Artificial Sequence
  Synthetic Oligonucleotide; PRDM1 exon 4; Set C
uccacuuacugagau

SEQ ID NO: 25192 - RNA, 25 nt, Artificial Sequence
  Synthetic Oligonucleotide; PRDM1 exon 4; Set C
ucuguaauccacuuacugagauuca

SEQ ID NO: 25193 - RNA, 26 nt, Artificial Sequence
  Synthetic Oligonucleotide; PRDM1 exon 4; Set C
uucuguaauccacuuacugagauuca

SEQ ID NO: 25194 - RNA, 24 nt, Artificial Sequence
  Synthetic Oligonucleotide; PRDM1 exon 4; Set C
ucuguaauccacuuacugagauuc

SEQ ID NO: 25195 - RNA, 27 nt, Artificial Sequence
  Synthetic Oligonucleotide; PRDM1 exon 4; Set B
guucuguaauccacuuacugagauuca

SEQ ID NO: 25196 - RNA, 25 nt, Artificial Sequence
  Synthetic Oligonucleotide; PRDM1 exon 4; Set C
uucuguaauccacuuacugagauuc

SEQ ID NO: 25197 - RNA, 23 nt, Artificial Sequence
  Synthetic Oligonucleotide; PRDM1 exon 4; Set C
ucuguaauccacuuacugagauu

SEQ ID NO: 25198 - RNA, 28 nt, Artificial Sequence
  Synthetic Oligonucleotide; PRDM1 exon 4; Set B
uguucuguaauccacuuacugagauuca

SEQ ID NO: 25199 - RNA, 26 nt, Artificial Sequence
  Synthetic Oligonucleotide; PRDM1 exon 4; Set C
guucuguaauccacuuacugagauuc

SEQ ID NO: 25200 - RNA, 24 nt, Artificial Sequence
  Synthetic Oligonucleotide; PRDM1 exon 4; Set C
uucuguaauccacuuacugagauu

SEQ ID NO: 25201 - RNA, 22 nt, Artificial Sequence
  Synthetic Oligonucleotide; PRDM1 exon 4; Set C
ucuguaauccacuuacugagau

SEQ ID NO: 25202 - RNA, 29 nt, Artificial Sequence
  Synthetic Oligonucleotide; PRDM1 exon 4; Set B
uuguucuguaauccacuuacugagauuca

SEQ ID NO: 25203 - RNA, 27 nt, Artificial Sequence
  Synthetic Oligonucleotide; PRDM1 exon 4; Set B
uguucuguaauccacuuacugagauuc

SEQ ID NO: 25204 - RNA, 25 nt, Artificial Sequence
  Synthetic Oligonucleotide; PRDM1 exon 4; Set C
guucuguaauccacuuacugagauu

SEQ ID NO: 25205 - RNA, 23 nt, Artificial Sequence
  Synthetic Oligonucleotide; PRDM1 exon 4; Set C
uucuguaauccacuuacugagau

SEQ ID NO: 25206 - RNA, 35 nt, Artificial Sequence
  Synthetic Oligonucleotide; PRDM1 exon 4; Set B
uuuuuguucuguaauccacuuacugagauucauca

SEQ ID NO: 25207 - RNA, 28 nt, Artificial Sequence
  Synthetic Oligonucleotide; PRDM1 exon 4; Set B
uuguucuguaauccacuuacugagauuc

SEQ ID NO: 25208 - RNA, 26 nt, Artificial Sequence
  Synthetic Oligonucleotide; PRDM1 exon 4; Set C
uguucuguaauccacuuacugagauu

SEQ ID NO: 25209 - RNA, 24 nt, Artificial Sequence
  Synthetic Oligonucleotide; PRDM1 exon 4; Set C
guucuguaauccacuuacugagau

SEQ ID NO: 25210 - RNA, 36 nt, Artificial Sequence
  Synthetic Oligonucleotide; PRDM1 exon 4; Set B
uuuuuuguucuguaauccacuuacugagauucauca

SEQ ID NO: 25211 - RNA, 38 nt, Artificial Sequence
  Synthetic Oligonucleotide; PRDM1 exon 4; Set B
uuuuuuuguucuguaauccacuuacugagauucaucau

SEQ ID NO: 25212 - RNA, 27 nt, Artificial Sequence
  Synthetic Oligonucleotide; PRDM1 exon 4; Set C
uuguucuguaauccacuuacugagauu

SEQ ID NO: 25213 - RNA, 25 nt, Artificial Sequence
  Synthetic Oligonucleotide; PRDM1 exon 4; Set C
uguucuguaauccacuuacugagau

SEQ ID NO: 25214 - RNA, 33 nt, Artificial Sequence
  Synthetic Oligonucleotide; PRDM1 exon 4; Set B
uuuuuguucuguaauccacuuacugagauucau

SEQ ID NO: 25215 - RNA, 37 nt, Artificial Sequence
  Synthetic Oligonucleotide; PRDM1 exon 4; Set B
uuuuuuuguucuguaauccacuuacugagauucauca

SEQ ID NO: 25216 - RNA, 35 nt, Artificial Sequence
  Synthetic Oligonucleotide; PRDM1 exon 4; Set B
uuuuuuguucuguaauccacuuacugagauucauc

SEQ ID NO: 25217 - RNA, 39 nt, Artificial Sequence
  Synthetic Oligonucleotide; PRDM1 exon 4; Set B
auuuuuuuguucuguaauccacuuacugagauucaucau

SEQ ID NO: 25218 - RNA, 26 nt, Artificial Sequence
  Synthetic Oligonucleotide; PRDM1 exon 4; Set C
uuguucuguaauccacuuacugagau

SEQ ID NO: 25219 - RNA, 34 nt, Artificial Sequence
  Synthetic Oligonucleotide; PRDM1 exon 4; Set B
uuuuuuguucuguaauccacuuacugagauucau

SEQ ID NO: 25220 - RNA, 38 nt, Artificial Sequence
  Synthetic Oligonucleotide; PRDM1 exon 4; Set B
auuuuuuuguucuguaauccacuuacugagauucauca

SEQ ID NO: 25221 - RNA, 36 nt, Artificial Sequence
  Synthetic Oligonucleotide; PRDM1 exon 4; Set B
uuuuuuuguucuguaauccacuuacugagauucauc

SEQ ID NO: 25222 - RNA, 40 nt, Artificial Sequence
  Synthetic Oligonucleotide; PRDM1 exon 4; Set B
uauuuuuuuguucuguaauccacuuacugagauucaucau

SEQ ID NO: 25223 - RNA, 27 nt, Artificial Sequence
  Synthetic Oligonucleotide; PRDM1 exon 4; Set C
uuuguucuguaauccacuuacugagau

SEQ ID NO: 25224 - RNA, 35 nt, Artificial Sequence
  Synthetic Oligonucleotide; PRDM1 exon 4; Set B
uuuuuuuguucuguaauccacuuacugagauucau

SEQ ID NO: 25225 - RNA, 39 nt, Artificial Sequence
  Synthetic Oligonucleotide; PRDM1 exon 4; Set B
uauuuuuuuguucuguaauccacuuacugagauucauca

SEQ ID NO: 25226 - RNA, 37 nt, Artificial Sequence
  Synthetic Oligonucleotide; PRDM1 exon 4; Set B
auuuuuuuguucuguaauccacuuacugagauucauc

SEQ ID NO: 25227 - RNA, 28 nt, Artificial Sequence
  Synthetic Oligonucleotide; PRDM1 exon 4; Set B
uuuuguucuguaauccacuuacugagau

SEQ ID NO: 25228 - RNA, 36 nt, Artificial Sequence
  Synthetic Oligonucleotide; PRDM1 exon 4; Set B
auuuuuuuguucuguaauccacuuacugagauucau

SEQ ID NO: 25229 - RNA, 40 nt, Artificial Sequence
  Synthetic Oligonucleotide; PRDM1 exon 4; Set B
uuauuuuuuuguucuguaauccacuuacugagauucauca

SEQ ID NO: 25230 - RNA, 38 nt, Artificial Sequence
  Synthetic Oligonucleotide; PRDM1 exon 4; Set B
uauuuuuuuguucuguaauccacuuacugagauucauc

SEQ ID NO: 25231 - RNA, 37 nt, Artificial Sequence
  Synthetic Oligonucleotide; PRDM1 exon 4; Set B
uauuuuuuuguucuguaauccacuuacugagauucau

SEQ ID NO: 25232 - RNA, 39 nt, Artificial Sequence
  Synthetic Oligonucleotide; PRDM1 exon 4; Set B
uuauuuuuuuguucuguaauccacuuacugagauucauc

SEQ ID NO: 25233 - RNA, 38 nt, Artificial Sequence
  Synthetic Oligonucleotide; PRDM1 exon 4; Set B
uuauuuuuuuguucuguaauccacuuacugagauucau

SEQ ID NO: 25234 - RNA, 40 nt, Artificial Sequence
  Synthetic Oligonucleotide; PRDM1 exon 4; Set B
uuuauuuuuuuguucuguaauccacuuacugagauucauc

SEQ ID NO: 25235 - RNA, 39 nt, Artificial Sequence
  Synthetic Oligonucleotide; PRDM1 exon 4; Set B
uuuauuuuuuuguucuguaauccacuuacugagauucau

SEQ ID NO: 25236 - RNA, 40 nt, Artificial Sequence
  Synthetic Oligonucleotide; PRDM1 exon 4; Set B
uuuuauuuuuuuguucuguaauccacuuacugagauucau

SEQ ID NO: 25237 - RNA, 15 nt, Artificial Sequence
  Synthetic Oligonucleotide; PRDM1 exon 4; Set C
uguucuguaauccac

SEQ ID NO: 25238 - RNA, 16 nt, Artificial Sequence
  Synthetic Oligonucleotide; PRDM1 exon 4; Set C
uuguucuguaauccac

SEQ ID NO: 25239 - RNA, 17 nt, Artificial Sequence
  Synthetic Oligonucleotide; PRDM1 exon 4; Set C
uuuguucuguaauccac

SEQ ID NO: 25240 - RNA, 15 nt, Artificial Sequence
  Synthetic Oligonucleotide; PRDM1 exon 4; Set C
uuguucuguaaucca

SEQ ID NO: 25241 - RNA, 18 nt, Artificial Sequence
  Synthetic Oligonucleotide; PRDM1 exon 4; Set C
uuuuguucuguaauccac

SEQ ID NO: 25242 - RNA, 16 nt, Artificial Sequence
  Synthetic Oligonucleotide; PRDM1 exon 4; Set C
uuuguucuguaaucca

SEQ ID NO: 25243 - RNA, 15 nt, Artificial Sequence
  Synthetic Oligonucleotide; PRDM1 exon 4; Set C
uuuguucuguaaucc

SEQ ID NO: 25244 - RNA, 19 nt, Artificial Sequence
  Synthetic Oligonucleotide; PRDM1 exon 4; Set C
uuuuuguucuguaauccac

SEQ ID NO: 25245 - RNA, 17 nt, Artificial Sequence
  Synthetic Oligonucleotide; PRDM1 exon 4; Set C
uuuuguucuguaaucca

SEQ ID NO: 25246 - RNA, 16 nt, Artificial Sequence
  Synthetic Oligonucleotide; PRDM1 exon 4; Set C
uuuuguucuguaaucc

SEQ ID NO: 25247 - RNA, 20 nt, Artificial Sequence
  Synthetic Oligonucleotide; PRDM1 exon 4; Set C
uuuuuuguucuguaauccac

SEQ ID NO: 25248 - RNA, 18 nt, Artificial Sequence
  Synthetic Oligonucleotide; PRDM1 exon 4; Set C
uuuuuguucuguaaucca

SEQ ID NO: 25249 - RNA, 17 nt, Artificial Sequence
  Synthetic Oligonucleotide; PRDM1 exon 4; Set C
uuuuuguucuguaaucc

SEQ ID NO: 25250 - RNA, 21 nt, Artificial Sequence
  Synthetic Oligonucleotide; PRDM1 exon 4; Set C
uuuuuuuguucuguaauccac

SEQ ID NO: 25251 - RNA, 19 nt, Artificial Sequence
  Synthetic Oligonucleotide; PRDM1 exon 4; Set C
uuuuuuguucuguaaucca

SEQ ID NO: 25252 - RNA, 15 nt, Artificial Sequence
  Synthetic Oligonucleotide; PRDM1 exon 4; Set C
uuuuguucuguaauc

SEQ ID NO: 25253 - RNA, 18 nt, Artificial Sequence
  Synthetic Oligonucleotide; PRDM1 exon 4; Set C
uuuuuuguucuguaaucc

SEQ ID NO: 25254 - RNA, 22 nt, Artificial Sequence
  Synthetic Oligonucleotide; PRDM1 exon 4; Set C
auuuuuuuguucuguaauccac

SEQ ID NO: 25255 - RNA, 20 nt, Artificial Sequence
  Synthetic Oligonucleotide; PRDM1 exon 4; Set C
uuuuuuuguucuguaaucca

SEQ ID NO: 25256 - RNA, 16 nt, Artificial Sequence
  Synthetic Oligonucleotide; PRDM1 exon 4; Set C
uuuuuguucuguaauc

SEQ ID NO: 25257 - RNA, 19 nt, Artificial Sequence
  Synthetic Oligonucleotide; PRDM1 exon 4; Set C
uuuuuuuguucuguaaucc

SEQ ID NO: 25258 - RNA, 23 nt, Artificial Sequence
  Synthetic Oligonucleotide; PRDM1 exon 4; Set C
uauuuuuuuguucuguaauccac

SEQ ID NO: 25259 - RNA, 21 nt, Artificial Sequence
  Synthetic Oligonucleotide; PRDM1 exon 4; Set C
auuuuuuuguucuguaaucca

SEQ ID NO: 25260 - RNA, 17 nt, Artificial Sequence
  Synthetic Oligonucleotide; PRDM1 exon 4; Set C
uuuuuuguucuguaauc

SEQ ID NO: 25261 - RNA, 20 nt, Artificial Sequence
  Synthetic Oligonucleotide; PRDM1 exon 4; Set C
auuuuuuuguucuguaaucc

SEQ ID NO: 25262 - RNA, 24 nt, Artificial Sequence
  Synthetic Oligonucleotide; PRDM1 exon 4; Set C
uuauuuuuuuguucuguaauccac

SEQ ID NO: 25263 - RNA, 22 nt, Artificial Sequence
  Synthetic Oligonucleotide; PRDM1 exon 4; Set C
uauuuuuuuguucuguaaucca

SEQ ID NO: 25264 - RNA, 18 nt, Artificial Sequence
  Synthetic Oligonucleotide; PRDM1 exon 4; Set C
uuuuuuuguucuguaauc

SEQ ID NO: 25265 - RNA, 21 nt, Artificial Sequence
  Synthetic Oligonucleotide; PRDM1 exon 4; Set C
uauuuuuuuguucuguaaucc

SEQ ID NO: 25266 - RNA, 25 nt, Artificial Sequence
  Synthetic Oligonucleotide; PRDM1 exon 4; Set C
uuuauuuuuuuguucuguaauccac

SEQ ID NO: 25267 - RNA, 23 nt, Artificial Sequence
  Synthetic Oligonucleotide; PRDM1 exon 4; Set C
uuauuuuuuuguucuguaaucca

SEQ ID NO: 25268 - RNA, 19 nt, Artificial Sequence
  Synthetic Oligonucleotide; PRDM1 exon 4; Set C
auuuuuuuguucuguaauc

SEQ ID NO: 25269 - RNA, 15 nt, Artificial Sequence
  Synthetic Oligonucleotide; PRDM1 exon 4; Set C
uuuuuuguucuguaa

SEQ ID NO: 25270 - RNA, 22 nt, Artificial Sequence
  Synthetic Oligonucleotide; PRDM1 exon 4; Set C
uuauuuuuuuguucuguaaucc

SEQ ID NO: 25271 - RNA, 26 nt, Artificial Sequence
  Synthetic Oligonucleotide; PRDM1 exon 4; Set C
uuuuauuuuuuuguucuguaauccac

SEQ ID NO: 25272 - RNA, 24 nt, Artificial Sequence
  Synthetic Oligonucleotide; PRDM1 exon 4; Set C
uuuauuuuuuuguucuguaaucca

SEQ ID NO: 25273 - RNA, 20 nt, Artificial Sequence
  Synthetic Oligonucleotide; PRDM1 exon 4; Set C
uauuuuuuuguucuguaauc

SEQ ID NO: 25274 - RNA, 16 nt, Artificial Sequence
  Synthetic Oligonucleotide; PRDM1 exon 4; Set C
uuuuuuuguucuguaa

SEQ ID NO: 25275 - RNA, 23 nt, Artificial Sequence
  Synthetic Oligonucleotide; PRDM1 exon 4; Set C
uuuauuuuuuuguucuguaaucc

SEQ ID NO: 25276 - RNA, 25 nt, Artificial Sequence
  Synthetic Oligonucleotide; PRDM1 exon 4; Set C
uuuuauuuuuuuguucuguaaucca

SEQ ID NO: 25277 - RNA, 27 nt, Artificial Sequence
  Synthetic Oligonucleotide; PRDM1 exon 4; Set C
uuuuuauuuuuuuguucuguaauccac

SEQ ID NO: 25278 - RNA, 21 nt, Artificial Sequence
  Synthetic Oligonucleotide; PRDM1 exon 4; Set C
uuauuuuuuuguucuguaauc

SEQ ID NO: 25279 - RNA, 17 nt, Artificial Sequence
  Synthetic Oligonucleotide; PRDM1 exon 4; Set C
auuuuuuuguucuguaa

SEQ ID NO: 25280 - RNA, 24 nt, Artificial Sequence
  Synthetic Oligonucleotide; PRDM1 exon 4; Set C
uuuuauuuuuuuguucuguaaucc

SEQ ID NO: 25281 - RNA, 26 nt, Artificial Sequence
  Synthetic Oligonucleotide; PRDM1 exon 4; Set C
uuuuuauuuuuuuguucuguaaucca

SEQ ID NO: 25282 - RNA, 28 nt, Artificial Sequence
  Synthetic Oligonucleotide; PRDM1 exon 4; Set C
uuuuuuauuuuuuuguucuguaauccac

SEQ ID NO: 25283 - RNA, 22 nt, Artificial Sequence
  Synthetic Oligonucleotide; PRDM1 exon 4; Set C
uuuauuuuuuuguucuguaauc

SEQ ID NO: 25284 - RNA, 18 nt, Artificial Sequence
  Synthetic Oligonucleotide; PRDM1 exon 4; Set C
uauuuuuuuguucuguaa

SEQ ID NO: 25285 - RNA, 25 nt, Artificial Sequence
  Synthetic Oligonucleotide; PRDM1 exon 4; Set C
uuuuuauuuuuuuguucuguaaucc

SEQ ID NO: 25286 - RNA, 27 nt, Artificial Sequence
  Synthetic Oligonucleotide; PRDM1 exon 4; Set C
uuuuuuauuuuuuuguucuguaaucca

SEQ ID NO: 25287 - RNA, 29 nt, Artificial Sequence
  Synthetic Oligonucleotide; PRDM1 exon 4; Set C
auuuuuuauuuuuuuguucuguaauccac

SEQ ID NO: 25288 - RNA, 23 nt, Artificial Sequence
  Synthetic Oligonucleotide; PRDM1 exon 4; Set C
uuuuauuuuuuuguucuguaauc

SEQ ID NO: 25289 - RNA, 19 nt, Artificial Sequence
  Synthetic Oligonucleotide; PRDM1 exon 4; Set C
uuauuuuuuuguucuguaa

SEQ ID NO: 25290 - RNA, 26 nt, Artificial Sequence
  Synthetic Oligonucleotide; PRDM1 exon 4; Set C
uuuuuuauuuuuuuguucuguaaucc

SEQ ID NO: 25291 - RNA, 28 nt, Artificial Sequence
  Synthetic Oligonucleotide; PRDM1 exon 4; Set C
auuuuuuauuuuuuuguucuguaaucca

SEQ ID NO: 25292 - RNA, 30 nt, Artificial Sequence
  Synthetic Oligonucleotide; PRDM1 exon 4; Set C
cauuuuuuauuuuuuuguucuguaauccac

SEQ ID NO: 25293 - RNA, 24 nt, Artificial Sequence
  Synthetic Oligonucleotide; PRDM1 exon 4; Set C
uuuuuauuuuuuuguucuguaauc

SEQ ID NO: 25294 - RNA, 20 nt, Artificial Sequence
  Synthetic Oligonucleotide; PRDM1 exon 4; Set C
uuuauuuuuuuguucuguaa

SEQ ID NO: 25295 - RNA, 27 nt, Artificial Sequence
  Synthetic Oligonucleotide; PRDM1 exon 4; Set C
auuuuuuauuuuuuuguucuguaaucc

SEQ ID NO: 25296 - RNA, 29 nt, Artificial Sequence
  Synthetic Oligonucleotide; PRDM1 exon 4; Set C
cauuuuuuauuuuuuuguucuguaaucca

SEQ ID NO: 25297 - RNA, 31 nt, Artificial Sequence
  Synthetic Oligonucleotide; PRDM1 exon 4; Set C
gcauuuuuuauuuuuuuguucuguaauccac

SEQ ID NO: 25298 - RNA, 25 nt, Artificial Sequence
  Synthetic Oligonucleotide; PRDM1 exon 4; Set C
uuuuuuauuuuuuuguucuguaauc

SEQ ID NO: 25299 - RNA, 21 nt, Artificial Sequence
  Synthetic Oligonucleotide; PRDM1 exon 4; Set C
uuuuauuuuuuuguucuguaa

SEQ ID NO: 25300 - RNA, 28 nt, Artificial Sequence
  Synthetic Oligonucleotide; PRDM1 exon 4; Set C
cauuuuuuauuuuuuuguucuguaaucc

SEQ ID NO: 25301 - RNA, 30 nt, Artificial Sequence
  Synthetic Oligonucleotide; PRDM1 exon 4; Set C
gcauuuuuuauuuuuuuguucuguaaucca

SEQ ID NO: 25302 - RNA, 26 nt, Artificial Sequence
  Synthetic Oligonucleotide; PRDM1 exon 4; Set C
auuuuuuauuuuuuuguucuguaauc

SEQ ID NO: 25303 - RNA, 22 nt, Artificial Sequence
  Synthetic Oligonucleotide; PRDM1 exon 4; Set C
uuuuuauuuuuuuguucuguaa

SEQ ID NO: 25304 - RNA, 29 nt, Artificial Sequence
  Synthetic Oligonucleotide; PRDM1 exon 4; Set C
gcauuuuuuauuuuuuuguucuguaaucc

SEQ ID NO: 25305 - RNA, 27 nt, Artificial Sequence
  Synthetic Oligonucleotide; PRDM1 exon 4; Set C
cauuuuuuauuuuuuuguucuguaauc

SEQ ID NO: 25306 - RNA, 23 nt, Artificial Sequence
  Synthetic Oligonucleotide; PRDM1 exon 4; Set C
uuuuuuauuuuuuuguucuguaa

SEQ ID NO: 25307 - RNA, 28 nt, Artificial Sequence
  Synthetic Oligonucleotide; PRDM1 exon 4; Set C
gcauuuuuuauuuuuuuguucuguaauc

SEQ ID NO: 25308 - RNA, 24 nt, Artificial Sequence
  Synthetic Oligonucleotide; PRDM1 exon 4; Set C
auuuuuuauuuuuuuguucuguaa

SEQ ID NO: 25309 - RNA, 25 nt, Artificial Sequence
  Synthetic Oligonucleotide; PRDM1 exon 4; Set C
cauuuuuuauuuuuuuguucuguaa

SEQ ID NO: 25310 - RNA, 36 nt, Artificial Sequence
  Synthetic Oligonucleotide; PRDM1 exon 4; Set B
uacuggcauuuuuuauuuuuuuguucuguaauccac

SEQ ID NO: 25311 - RNA, 26 nt, Artificial Sequence
  Synthetic Oligonucleotide; PRDM1 exon 4; Set C
gcauuuuuuauuuuuuuguucuguaa

SEQ ID NO: 25312 - RNA, 37 nt, Artificial Sequence
  Synthetic Oligonucleotide; PRDM1 exon 4; Set B
uuacuggcauuuuuuauuuuuuuguucuguaauccac

SEQ ID NO: 25313 - RNA, 35 nt, Artificial Sequence
  Synthetic Oligonucleotide; PRDM1 exon 4; Set B
uacuggcauuuuuuauuuuuuuguucuguaaucca

SEQ ID NO: 25314 - RNA, 34 nt, Artificial Sequence
  Synthetic Oligonucleotide; PRDM1 exon 4; Set B
uacuggcauuuuuuauuuuuuuguucuguaaucc

SEQ ID NO: 25315 - RNA, 36 nt, Artificial Sequence
  Synthetic Oligonucleotide; PRDM1 exon 4; Set B
uuacuggcauuuuuuauuuuuuuguucuguaaucca

SEQ ID NO: 25316 - RNA, 35 nt, Artificial Sequence
  Synthetic Oligonucleotide; PRDM1 exon 4; Set B
uuacuggcauuuuuuauuuuuuuguucuguaaucc

SEQ ID NO: 25317 - RNA, 33 nt, Artificial Sequence
  Synthetic Oligonucleotide; PRDM1 exon 4; Set C
uacuggcauuuuuuauuuuuuuguucuguaauc

SEQ ID NO: 25318 - RNA, 34 nt, Artificial Sequence
  Synthetic Oligonucleotide; PRDM1 exon 4; Set C
uuacuggcauuuuuuauuuuuuuguucuguaauc

SEQ ID NO: 25319 - RNA, 31 nt, Artificial Sequence
  Synthetic Oligonucleotide; PRDM1 exon 4; Set C
uacuggcauuuuuuauuuuuuuguucuguaa

SEQ ID NO: 25320 - RNA, 32 nt, Artificial Sequence
  Synthetic Oligonucleotide; PRDM1 exon 4; Set C
uuacuggcauuuuuuauuuuuuuguucuguaa

SEQ ID NO: 25321 - RNA, 21 nt, Artificial Sequence
  Synthetic Oligonucleotide; PRDM1 exon 4; Set C
acuggcauuuuuuauuuuuuu

SEQ ID NO: 25322 - RNA, 20 nt, Artificial Sequence
  Synthetic Oligonucleotide; PRDM1 exon 4; Set C
acuggcauuuuuuauuuuuu

SEQ ID NO: 25323 - RNA, 19 nt, Artificial Sequence
  Synthetic Oligonucleotide; PRDM1 exon 4; Set C
acuggcauuuuuuauuuuu

SEQ ID NO: 25324 - RNA, 18 nt, Artificial Sequence
  Synthetic Oligonucleotide; PRDM1 exon 4; Set C
acuggcauuuuuuauuuu

SEQ ID NO: 25325 - RNA, 17 nt, Artificial Sequence
  Synthetic Oligonucleotide; PRDM1 exon 4; Set C
acuggcauuuuuuauuu

SEQ ID NO: 25326 - RNA, 16 nt, Artificial Sequence
  Synthetic Oligonucleotide; PRDM1 exon 4; Set C
acuggcauuuuuuauu

SEQ ID NO: 25327 - RNA, 15 nt, Artificial Sequence
  Synthetic Oligonucleotide; PRDM1 exon 4; Set C
acuggcauuuuuuau

SEQ ID NO: 25328 - RNA, 15 nt, Artificial Sequence
  Synthetic Oligonucleotide; PRDM1 exon 4; Set C
ucagacccaaagcuc

SEQ ID NO: 25329 - RNA, 16 nt, Artificial Sequence
  Synthetic Oligonucleotide; PRDM1 exon 4; Set C
gucagacccaaagcuc

SEQ ID NO: 25330 - RNA, 15 nt, Artificial Sequence
  Synthetic Oligonucleotide; PRDM1 exon 4; Set C
gucagacccaaagcu

SEQ ID NO: 25331 - RNA, 40 nt, Artificial Sequence
  Synthetic Oligonucleotide; PRDM1 exon 4; Set A
agaucuguccaaaagagaagacaggcauguaaaaggaagu

SEQ ID NO: 25332 - RNA, 21 nt, Artificial Sequence
  Synthetic Oligonucleotide; PRDM1 exon 4; Set A
gguuuugcucccggggagagu

SEQ ID NO: 25333 - RNA, 22 nt, Artificial Sequence
  Synthetic Oligonucleotide; PRDM1 exon 4; Set A
agguuuugcucccggggagagu

SEQ ID NO: 25334 - RNA, 29 nt, Artificial Sequence
  Synthetic Oligonucleotide; PRDM1 exon 4; Set C
cgcagccagguuuugcucccggggagagu

SEQ ID NO: 25335 - RNA, 15 nt, Artificial Sequence
  Synthetic Oligonucleotide; PRDM1 exon 4; Set C
agguuuugcucccgg

SEQ ID NO: 25336 - RNA, 23 nt, Artificial Sequence
  Synthetic Oligonucleotide; PRDM1 exon 4; Set C
cgcagccagguuuugcucccggg

SEQ ID NO: 25337 - RNA, 40 nt, Artificial Sequence
  Synthetic Oligonucleotide; PRDM1 exon 4; Set C
uucaucccguucugacacgcagccagguuuugcucccggg

SEQ ID NO: 25338 - RNA, 17 nt, Artificial Sequence
  Synthetic Oligonucleotide; PRDM1 exon 4; Set C
uagauguucaucccguu

SEQ ID NO: 25339 - RNA, 18 nt, Artificial Sequence
  Synthetic Oligonucleotide; PRDM1 exon 4; Set C
guagauguucaucccguu

SEQ ID NO: 25340 - RNA, 17 nt, Artificial Sequence
  Synthetic Oligonucleotide; PRDM1 exon 4; Set C
guagauguucaucccgu

SEQ ID NO: 25341 - RNA, 21 nt, Artificial Sequence
  Synthetic Oligonucleotide; PRDM1 exon 4; Set C
augguguagaaguagauguuc

SEQ ID NO: 25342 - RNA, 20 nt, Artificial Sequence
  Synthetic Oligonucleotide; PRDM1 exon 4; Set C
augguguagaaguagauguu

SEQ ID NO: 25343 - RNA, 22 nt, Artificial Sequence
  Synthetic Oligonucleotide; PRDM1 exon 4; Set C
aaugguguagaaguagauguuc

SEQ ID NO: 25344 - RNA, 21 nt, Artificial Sequence
  Synthetic Oligonucleotide; PRDM1 exon 4; Set C
aaugguguagaaguagauguu

SEQ ID NO: 25345 - RNA, 23 nt, Artificial Sequence
  Synthetic Oligonucleotide; PRDM1 exon 4; Set C
uaaugguguagaaguagauguuc

SEQ ID NO: 25346 - RNA, 22 nt, Artificial Sequence
  Synthetic Oligonucleotide; PRDM1 exon 4; Set C
uaaugguguagaaguagauguu

SEQ ID NO: 25347 - RNA, 18 nt, Artificial Sequence
  Synthetic Oligonucleotide; PRDM1 exon 4; Set C
ucugcaaagucccgacaa

SEQ ID NO: 25348 - RNA, 17 nt, Artificial Sequence
  Synthetic Oligonucleotide; PRDM1 exon 4; Set C
ucugcaaagucccgaca

SEQ ID NO: 25349 - RNA, 16 nt, Artificial Sequence
  Synthetic Oligonucleotide; PRDM1 exon 4; Set C
ucugcaaagucccgac

SEQ ID NO: 25350 - RNA, 29 nt, Artificial Sequence
  Synthetic Oligonucleotide; PRDM1 exon 4; Set B
agugaagccuuucugcaaagucccgacaa

SEQ ID NO: 25351 - RNA, 30 nt, Artificial Sequence
  Synthetic Oligonucleotide; PRDM1 exon 4; Set B
uagugaagccuuucugcaaagucccgacaa

SEQ ID NO: 25352 - RNA, 28 nt, Artificial Sequence
  Synthetic Oligonucleotide; PRDM1 exon 4; Set B
agugaagccuuucugcaaagucccgaca

SEQ ID NO: 25353 - RNA, 29 nt, Artificial Sequence
  Synthetic Oligonucleotide; PRDM1 exon 4; Set C
uagugaagccuuucugcaaagucccgaca

SEQ ID NO: 25354 - RNA, 27 nt, Artificial Sequence
  Synthetic Oligonucleotide; PRDM1 exon 4; Set B
agugaagccuuucugcaaagucccgac

SEQ ID NO: 25355 - RNA, 31 nt, Artificial Sequence
  Synthetic Oligonucleotide; PRDM1 exon 4; Set C
guagugaagccuuucugcaaagucccgacaa

SEQ ID NO: 25356 - RNA, 28 nt, Artificial Sequence
  Synthetic Oligonucleotide; PRDM1 exon 4; Set B
uagugaagccuuucugcaaagucccgac

SEQ ID NO: 25357 - RNA, 30 nt, Artificial Sequence
  Synthetic Oligonucleotide; PRDM1 exon 4; Set C
guagugaagccuuucugcaaagucccgaca

SEQ ID NO: 25358 - RNA, 29 nt, Artificial Sequence
  Synthetic Oligonucleotide; PRDM1 exon 4; Set B
guagugaagccuuucugcaaagucccgac

SEQ ID NO: 25359 - RNA, 16 nt, Artificial Sequence
  Synthetic Oligonucleotide; PRDM1 exon 4; Set C
uagugaagccuuucug

SEQ ID NO: 25360 - RNA, 15 nt, Artificial Sequence
  Synthetic Oligonucleotide; PRDM1 exon 4; Set C
uagugaagccuuucu

SEQ ID NO: 25361 - RNA, 17 nt, Artificial Sequence
  Synthetic Oligonucleotide; PRDM1 exon 4; Set C
guagugaagccuuucug

SEQ ID NO: 25362 - RNA, 16 nt, Artificial Sequence
  Synthetic Oligonucleotide; PRDM1 exon 4; Set C
guagugaagccuuucu

SEQ ID NO: 25363 - RNA, 37 nt, Artificial Sequence
  Synthetic Oligonucleotide; PRDM1 exon 4; Set C
ucaucauugucagcucuccgggauaaggguagugaag

SEQ ID NO: 25364 - RNA, 38 nt, Artificial Sequence
  Synthetic Oligonucleotide; PRDM1 exon 4; Set C
uucaucauugucagcucuccgggauaaggguagugaag

SEQ ID NO: 25365 - RNA, 36 nt, Artificial Sequence
  Synthetic Oligonucleotide; PRDM1 exon 4; Set C
ucaucauugucagcucuccgggauaaggguagugaa

SEQ ID NO: 25366 - RNA, 37 nt, Artificial Sequence
  Synthetic Oligonucleotide; PRDM1 exon 4; Set C
uucaucauugucagcucuccgggauaaggguagugaa

SEQ ID NO: 25367 - RNA, 39 nt, Artificial Sequence
  Synthetic Oligonucleotide; PRDM1 exon 4; Set C
auucaucauugucagcucuccgggauaaggguagugaag

SEQ ID NO: 25368 - RNA, 35 nt, Artificial Sequence
  Synthetic Oligonucleotide; PRDM1 exon 4; Set C
ucaucauugucagcucuccgggauaaggguaguga

SEQ ID NO: 25369 - RNA, 34 nt, Artificial Sequence
  Synthetic Oligonucleotide; PRDM1 exon 4; Set C
ucaucauugucagcucuccgggauaaggguagug

SEQ ID NO: 25370 - RNA, 38 nt, Artificial Sequence
  Synthetic Oligonucleotide; PRDM1 exon 4; Set C
auucaucauugucagcucuccgggauaaggguagugaa

SEQ ID NO: 25371 - RNA, 40 nt, Artificial Sequence
  Synthetic Oligonucleotide; PRDM1 exon 4; Set C
gauucaucauugucagcucuccgggauaaggguagugaag

SEQ ID NO: 25372 - RNA, 36 nt, Artificial Sequence
  Synthetic Oligonucleotide; PRDM1 exon 4; Set C
uucaucauugucagcucuccgggauaaggguaguga

SEQ ID NO: 25373 - RNA, 33 nt, Artificial Sequence
  Synthetic Oligonucleotide; PRDM1 exon 4; Set C
ucaucauugucagcucuccgggauaaggguagu

SEQ ID NO: 25374 - RNA, 35 nt, Artificial Sequence
  Synthetic Oligonucleotide; PRDM1 exon 4; Set C
uucaucauugucagcucuccgggauaaggguagug

SEQ ID NO: 25375 - RNA, 39 nt, Artificial Sequence
  Synthetic Oligonucleotide; PRDM1 exon 4; Set C
gauucaucauugucagcucuccgggauaaggguagugaa

SEQ ID NO: 25376 - RNA, 37 nt, Artificial Sequence
  Synthetic Oligonucleotide; PRDM1 exon 4; Set C
auucaucauugucagcucuccgggauaaggguaguga

SEQ ID NO: 25377 - RNA, 32 nt, Artificial Sequence
  Synthetic Oligonucleotide; PRDM1 exon 4; Set C
ucaucauugucagcucuccgggauaaggguag

SEQ ID NO: 25378 - RNA, 34 nt, Artificial Sequence
  Synthetic Oligonucleotide; PRDM1 exon 4; Set C
uucaucauugucagcucuccgggauaaggguagu

SEQ ID NO: 25379 - RNA, 36 nt, Artificial Sequence
  Synthetic Oligonucleotide; PRDM1 exon 4; Set C
auucaucauugucagcucuccgggauaaggguagug

SEQ ID NO: 25380 - RNA, 38 nt, Artificial Sequence
  Synthetic Oligonucleotide; PRDM1 exon 4; Set C
gauucaucauugucagcucuccgggauaaggguaguga

SEQ ID NO: 25381 - RNA, 33 nt, Artificial Sequence
  Synthetic Oligonucleotide; PRDM1 exon 4; Set C
uucaucauugucagcucuccgggauaaggguag

SEQ ID NO: 25382 - RNA, 35 nt, Artificial Sequence
  Synthetic Oligonucleotide; PRDM1 exon 4; Set C
auucaucauugucagcucuccgggauaaggguagu

SEQ ID NO: 25383 - RNA, 31 nt, Artificial Sequence
  Synthetic Oligonucleotide; PRDM1 exon 4; Set C
ucaucauugucagcucuccgggauaagggua

SEQ ID NO: 25384 - RNA, 37 nt, Artificial Sequence
  Synthetic Oligonucleotide; PRDM1 exon 4; Set C
gauucaucauugucagcucuccgggauaaggguagug

SEQ ID NO: 25385 - RNA, 34 nt, Artificial Sequence
  Synthetic Oligonucleotide; PRDM1 exon 4; Set C
auucaucauugucagcucuccgggauaaggguag

SEQ ID NO: 25386 - RNA, 36 nt, Artificial Sequence
  Synthetic Oligonucleotide; PRDM1 exon 4; Set C
gauucaucauugucagcucuccgggauaaggguagu

SEQ ID NO: 25387 - RNA, 32 nt, Artificial Sequence
  Synthetic Oligonucleotide; PRDM1 exon 4; Set C
uucaucauugucagcucuccgggauaagggua

SEQ ID NO: 25388 - RNA, 35 nt, Artificial Sequence
  Synthetic Oligonucleotide; PRDM1 exon 4; Set C
gauucaucauugucagcucuccgggauaaggguag

SEQ ID NO: 25389 - RNA, 33 nt, Artificial Sequence
  Synthetic Oligonucleotide; PRDM1 exon 4; Set C
auucaucauugucagcucuccgggauaagggua

SEQ ID NO: 25390 - RNA, 34 nt, Artificial Sequence
  Synthetic Oligonucleotide; PRDM1 exon 4; Set C
gauucaucauugucagcucuccgggauaagggua

SEQ ID NO: 25391 - RNA, 19 nt, Artificial Sequence
  Synthetic Oligonucleotide; PRDM1 exon 4; Set C
cacuuacugagauucauca

SEQ ID NO: 25392 - RNA, 21 nt, Artificial Sequence
  Synthetic Oligonucleotide; PRDM1 exon 4; Set C
ccacuuacugagauucaucau

SEQ ID NO: 25393 - RNA, 20 nt, Artificial Sequence
  Synthetic Oligonucleotide; PRDM1 exon 4; Set C
ccacuuacugagauucauca

SEQ ID NO: 25394 - RNA, 22 nt, Artificial Sequence
  Synthetic Oligonucleotide; PRDM1 exon 4; Set C
uccacuuacugagauucaucau

SEQ ID NO: 25395 - RNA, 17 nt, Artificial Sequence
  Synthetic Oligonucleotide; PRDM1 exon 4; Set C
cacuuacugagauucau

SEQ ID NO: 25396 - RNA, 21 nt, Artificial Sequence
  Synthetic Oligonucleotide; PRDM1 exon 4; Set C
uccacuuacugagauucauca

SEQ ID NO: 25397 - RNA, 18 nt, Artificial Sequence
  Synthetic Oligonucleotide; PRDM1 exon 4; Set C
ccacuuacugagauucau

SEQ ID NO: 25398 - RNA, 20 nt, Artificial Sequence
  Synthetic Oligonucleotide; PRDM1 exon 4; Set C
uccacuuacugagauucauc

SEQ ID NO: 25399 - RNA, 19 nt, Artificial Sequence
  Synthetic Oligonucleotide; PRDM1 exon 4; Set C
uccacuuacugagauucau

SEQ ID NO: 25400 - RNA, 19 nt, Artificial Sequence
  Synthetic Oligonucleotide; PRDM1 exon 4; Set C
auccacuuacugagauuca

SEQ ID NO: 25401 - RNA, 18 nt, Artificial Sequence
  Synthetic Oligonucleotide; PRDM1 exon 4; Set C
auccacuuacugagauuc

SEQ ID NO: 25402 - RNA, 20 nt, Artificial Sequence
  Synthetic Oligonucleotide; PRDM1 exon 4; Set C
aauccacuuacugagauuca

SEQ ID NO: 25403 - RNA, 21 nt, Artificial Sequence
  Synthetic Oligonucleotide; PRDM1 exon 4; Set C
uaauccacuuacugagauuca

SEQ ID NO: 25404 - RNA, 19 nt, Artificial Sequence
  Synthetic Oligonucleotide; PRDM1 exon 4; Set C
aauccacuuacugagauuc

SEQ ID NO: 25405 - RNA, 17 nt, Artificial Sequence
  Synthetic Oligonucleotide; PRDM1 exon 4; Set C
auccacuuacugagauu

SEQ ID NO: 25406 - RNA, 29 nt, Artificial Sequence
  Synthetic Oligonucleotide; PRDM1 exon 4; Set B
ucuguaauccacuuacugagauucaucau

SEQ ID NO: 25407 - RNA, 20 nt, Artificial Sequence
  Synthetic Oligonucleotide; PRDM1 exon 4; Set C
uaauccacuuacugagauuc

SEQ ID NO: 25408 - RNA, 16 nt, Artificial Sequence
  Synthetic Oligonucleotide; PRDM1 exon 4; Set C
auccacuuacugagau

SEQ ID NO: 25409 - RNA, 28 nt, Artificial Sequence
  Synthetic Oligonucleotide; PRDM1 exon 4; Set B
ucuguaauccacuuacugagauucauca

SEQ ID NO: 25410 - RNA, 30 nt, Artificial Sequence
  Synthetic Oligonucleotide; PRDM1 exon 4; Set B
uucuguaauccacuuacugagauucaucau

SEQ ID NO: 25411 - RNA, 19 nt, Artificial Sequence
  Synthetic Oligonucleotide; PRDM1 exon 4; Set C
uaauccacuuacugagauu

SEQ ID NO: 25412 - RNA, 29 nt, Artificial Sequence
  Synthetic Oligonucleotide; PRDM1 exon 4; Set B
uucuguaauccacuuacugagauucauca

SEQ ID NO: 25413 - RNA, 27 nt, Artificial Sequence
  Synthetic Oligonucleotide; PRDM1 exon 4; Set B
ucuguaauccacuuacugagauucauc

SEQ ID NO: 25414 - RNA, 31 nt, Artificial Sequence
  Synthetic Oligonucleotide; PRDM1 exon 4; Set B
guucuguaauccacuuacugagauucaucau

SEQ ID NO: 25415 - RNA, 18 nt, Artificial Sequence
  Synthetic Oligonucleotide; PRDM1 exon 4; Set C
uaauccacuuacugagau

SEQ ID NO: 25416 - RNA, 26 nt, Artificial Sequence
  Synthetic Oligonucleotide; PRDM1 exon 4; Set C
ucuguaauccacuuacugagauucau

SEQ ID NO: 25417 - RNA, 30 nt, Artificial Sequence
  Synthetic Oligonucleotide; PRDM1 exon 4; Set B
guucuguaauccacuuacugagauucauca

SEQ ID NO: 25418 - RNA, 28 nt, Artificial Sequence
  Synthetic Oligonucleotide; PRDM1 exon 4; Set B
uucuguaauccacuuacugagauucauc

SEQ ID NO: 25419 - RNA, 32 nt, Artificial Sequence
  Synthetic Oligonucleotide; PRDM1 exon 4; Set B
uguucuguaauccacuuacugagauucaucau

SEQ ID NO: 25420 - RNA, 27 nt, Artificial Sequence
  Synthetic Oligonucleotide; PRDM1 exon 4; Set C
uucuguaauccacuuacugagauucau

SEQ ID NO: 25421 - RNA, 31 nt, Artificial Sequence
  Synthetic Oligonucleotide; PRDM1 exon 4; Set B
uguucuguaauccacuuacugagauucauca

SEQ ID NO: 25422 - RNA, 29 nt, Artificial Sequence
  Synthetic Oligonucleotide; PRDM1 exon 4; Set B
guucuguaauccacuuacugagauucauc

SEQ ID NO: 25423 - RNA, 33 nt, Artificial Sequence
  Synthetic Oligonucleotide; PRDM1 exon 4; Set B
uuguucuguaauccacuuacugagauucaucau

SEQ ID NO: 25424 - RNA, 35 nt, Artificial Sequence
  Synthetic Oligonucleotide; PRDM1 exon 4; Set B
uuuguucuguaauccacuuacugagauucaucauu

SEQ ID NO: 25425 - RNA, 28 nt, Artificial Sequence
  Synthetic Oligonucleotide; PRDM1 exon 4; Set B
guucuguaauccacuuacugagauucau

SEQ ID NO: 25426 - RNA, 32 nt, Artificial Sequence
  Synthetic Oligonucleotide; PRDM1 exon 4; Set B
uuguucuguaauccacuuacugagauucauca

SEQ ID NO: 25427 - RNA, 30 nt, Artificial Sequence
  Synthetic Oligonucleotide; PRDM1 exon 4; Set B
uguucuguaauccacuuacugagauucauc

SEQ ID NO: 25428 - RNA, 34 nt, Artificial Sequence
  Synthetic Oligonucleotide; PRDM1 exon 4; Set B
uuuguucuguaauccacuuacugagauucaucau

SEQ ID NO: 25429 - RNA, 36 nt, Artificial Sequence
  Synthetic Oligonucleotide; PRDM1 exon 4; Set B
uuuuguucuguaauccacuuacugagauucaucauu

SEQ ID NO: 25430 - RNA, 29 nt, Artificial Sequence
  Synthetic Oligonucleotide; PRDM1 exon 4; Set B
uguucuguaauccacuuacugagauucau

SEQ ID NO: 25431 - RNA, 33 nt, Artificial Sequence
  Synthetic Oligonucleotide; PRDM1 exon 4; Set B
uuuguucuguaauccacuuacugagauucauca

SEQ ID NO: 25432 - RNA, 31 nt, Artificial Sequence
  Synthetic Oligonucleotide; PRDM1 exon 4; Set B
uuguucuguaauccacuuacugagauucauc

SEQ ID NO: 25433 - RNA, 35 nt, Artificial Sequence
  Synthetic Oligonucleotide; PRDM1 exon 4; Set B
uuuuguucuguaauccacuuacugagauucaucau

SEQ ID NO: 25434 - RNA, 37 nt, Artificial Sequence
  Synthetic Oligonucleotide; PRDM1 exon 4; Set B
uuuuuguucuguaauccacuuacugagauucaucauu

SEQ ID NO: 25435 - RNA, 30 nt, Artificial Sequence
  Synthetic Oligonucleotide; PRDM1 exon 4; Set B
uuguucuguaauccacuuacugagauucau

SEQ ID NO: 25436 - RNA, 34 nt, Artificial Sequence
  Synthetic Oligonucleotide; PRDM1 exon 4; Set B
uuuuguucuguaauccacuuacugagauucauca

SEQ ID NO: 25437 - RNA, 32 nt, Artificial Sequence
  Synthetic Oligonucleotide; PRDM1 exon 4; Set B
uuuguucuguaauccacuuacugagauucauc

SEQ ID NO: 25438 - RNA, 36 nt, Artificial Sequence
  Synthetic Oligonucleotide; PRDM1 exon 4; Set B
uuuuuguucuguaauccacuuacugagauucaucau

SEQ ID NO: 25439 - RNA, 38 nt, Artificial Sequence
  Synthetic Oligonucleotide; PRDM1 exon 4; Set B
uuuuuuguucuguaauccacuuacugagauucaucauu

SEQ ID NO: 25440 - RNA, 31 nt, Artificial Sequence
  Synthetic Oligonucleotide; PRDM1 exon 4; Set B
uuuguucuguaauccacuuacugagauucau

SEQ ID NO: 25441 - RNA, 33 nt, Artificial Sequence
  Synthetic Oligonucleotide; PRDM1 exon 4; Set B
uuuuguucuguaauccacuuacugagauucauc

SEQ ID NO: 25442 - RNA, 37 nt, Artificial Sequence
  Synthetic Oligonucleotide; PRDM1 exon 4; Set B
uuuuuuguucuguaauccacuuacugagauucaucau

SEQ ID NO: 25443 - RNA, 39 nt, Artificial Sequence
  Synthetic Oligonucleotide; PRDM1 exon 4; Set B
uuuuuuuguucuguaauccacuuacugagauucaucauu

SEQ ID NO: 25444 - RNA, 32 nt, Artificial Sequence
  Synthetic Oligonucleotide; PRDM1 exon 4; Set B
uuuuguucuguaauccacuuacugagauucau

SEQ ID NO: 25445 - RNA, 34 nt, Artificial Sequence
  Synthetic Oligonucleotide; PRDM1 exon 4; Set B
uuuuuguucuguaauccacuuacugagauucauc

SEQ ID NO: 25446 - RNA, 40 nt, Artificial Sequence
  Synthetic Oligonucleotide; PRDM1 exon 4; Set B
auuuuuuuguucuguaauccacuuacugagauucaucauu

SEQ ID NO: 25447 - RNA, 23 nt, Artificial Sequence
  Synthetic Oligonucleotide; PRDM1 exon 4; Set C
guucuguaauccacuuacugaga

SEQ ID NO: 25448 - RNA, 24 nt, Artificial Sequence
  Synthetic Oligonucleotide; PRDM1 exon 4; Set C
uguucuguaauccacuuacugaga

SEQ ID NO: 25449 - RNA, 25 nt, Artificial Sequence
  Synthetic Oligonucleotide; PRDM1 exon 4; Set C
uuguucuguaauccacuuacugaga

SEQ ID NO: 25450 - RNA, 23 nt, Artificial Sequence
  Synthetic Oligonucleotide; PRDM1 exon 4; Set C
uguucuguaauccacuuacugag

SEQ ID NO: 25451 - RNA, 26 nt, Artificial Sequence
  Synthetic Oligonucleotide; PRDM1 exon 4; Set C
uuuguucuguaauccacuuacugaga

SEQ ID NO: 25452 - RNA, 24 nt, Artificial Sequence
  Synthetic Oligonucleotide; PRDM1 exon 4; Set C
uuguucuguaauccacuuacugag

SEQ ID NO: 25453 - RNA, 27 nt, Artificial Sequence
  Synthetic Oligonucleotide; PRDM1 exon 4; Set B
uuuuguucuguaauccacuuacugaga

SEQ ID NO: 25454 - RNA, 23 nt, Artificial Sequence
  Synthetic Oligonucleotide; PRDM1 exon 4; Set C
uuguucuguaauccacuuacuga

SEQ ID NO: 25455 - RNA, 25 nt, Artificial Sequence
  Synthetic Oligonucleotide; PRDM1 exon 4; Set C
uuuguucuguaauccacuuacugag

SEQ ID NO: 25456 - RNA, 28 nt, Artificial Sequence
  Synthetic Oligonucleotide; PRDM1 exon 4; Set B
uuuuuguucuguaauccacuuacugaga

SEQ ID NO: 25457 - RNA, 24 nt, Artificial Sequence
  Synthetic Oligonucleotide; PRDM1 exon 4; Set C
uuuguucuguaauccacuuacuga

SEQ ID NO: 25458 - RNA, 26 nt, Artificial Sequence
  Synthetic Oligonucleotide; PRDM1 exon 4; Set C
uuuuguucuguaauccacuuacugag

SEQ ID NO: 25459 - RNA, 29 nt, Artificial Sequence
  Synthetic Oligonucleotide; PRDM1 exon 4; Set B
uuuuuuguucuguaauccacuuacugaga

SEQ ID NO: 25460 - RNA, 25 nt, Artificial Sequence
  Synthetic Oligonucleotide; PRDM1 exon 4; Set C
uuuuguucuguaauccacuuacuga

SEQ ID NO: 25461 - RNA, 27 nt, Artificial Sequence
  Synthetic Oligonucleotide; PRDM1 exon 4; Set C
uuuuuguucuguaauccacuuacugag

SEQ ID NO: 25462 - RNA, 30 nt, Artificial Sequence
  Synthetic Oligonucleotide; PRDM1 exon 4; Set B
uuuuuuuguucuguaauccacuuacugaga

SEQ ID NO: 25463 - RNA, 26 nt, Artificial Sequence
  Synthetic Oligonucleotide; PRDM1 exon 4; Set C
uuuuuguucuguaauccacuuacuga

SEQ ID NO: 25464 - RNA, 28 nt, Artificial Sequence
  Synthetic Oligonucleotide; PRDM1 exon 4; Set C
uuuuuuguucuguaauccacuuacugag

SEQ ID NO: 25465 - RNA, 31 nt, Artificial Sequence
  Synthetic Oligonucleotide; PRDM1 exon 4; Set B
auuuuuuuguucuguaauccacuuacugaga

SEQ ID NO: 25466 - RNA, 27 nt, Artificial Sequence
  Synthetic Oligonucleotide; PRDM1 exon 4; Set C
uuuuuuguucuguaauccacuuacuga

SEQ ID NO: 25467 - RNA, 29 nt, Artificial Sequence
  Synthetic Oligonucleotide; PRDM1 exon 4; Set C
uuuuuuuguucuguaauccacuuacugag

SEQ ID NO: 25468 - RNA, 32 nt, Artificial Sequence
  Synthetic Oligonucleotide; PRDM1 exon 4; Set B
uauuuuuuuguucuguaauccacuuacugaga

SEQ ID NO: 25469 - RNA, 28 nt, Artificial Sequence
  Synthetic Oligonucleotide; PRDM1 exon 4; Set C
uuuuuuuguucuguaauccacuuacuga

SEQ ID NO: 25470 - RNA, 30 nt, Artificial Sequence
  Synthetic Oligonucleotide; PRDM1 exon 4; Set C
auuuuuuuguucuguaauccacuuacugag

SEQ ID NO: 25471 - RNA, 33 nt, Artificial Sequence
  Synthetic Oligonucleotide; PRDM1 exon 4; Set B
uuauuuuuuuguucuguaauccacuuacugaga

SEQ ID NO: 25472 - RNA, 29 nt, Artificial Sequence
  Synthetic Oligonucleotide; PRDM1 exon 4; Set C
auuuuuuuguucuguaauccacuuacuga

SEQ ID NO: 25473 - RNA, 31 nt, Artificial Sequence
  Synthetic Oligonucleotide; PRDM1 exon 4; Set C
uauuuuuuuguucuguaauccacuuacugag

SEQ ID NO: 25474 - RNA, 34 nt, Artificial Sequence
  Synthetic Oligonucleotide; PRDM1 exon 4; Set B
uuuauuuuuuuguucuguaauccacuuacugaga

SEQ ID NO: 25475 - RNA, 30 nt, Artificial Sequence
  Synthetic Oligonucleotide; PRDM1 exon 4; Set C
uauuuuuuuguucuguaauccacuuacuga

SEQ ID NO: 25476 - RNA, 32 nt, Artificial Sequence
  Synthetic Oligonucleotide; PRDM1 exon 4; Set C
uuauuuuuuuguucuguaauccacuuacugag

SEQ ID NO: 25477 - RNA, 35 nt, Artificial Sequence
  Synthetic Oligonucleotide; PRDM1 exon 4; Set B
uuuuauuuuuuuguucuguaauccacuuacugaga

SEQ ID NO: 25478 - RNA, 31 nt, Artificial Sequence
  Synthetic Oligonucleotide; PRDM1 exon 4; Set C
uuauuuuuuuguucuguaauccacuuacuga

SEQ ID NO: 25479 - RNA, 33 nt, Artificial Sequence
  Synthetic Oligonucleotide; PRDM1 exon 4; Set B
uuuauuuuuuuguucuguaauccacuuacugag

SEQ ID NO: 25480 - RNA, 36 nt, Artificial Sequence
  Synthetic Oligonucleotide; PRDM1 exon 4; Set B
uuuuuauuuuuuuguucuguaauccacuuacugaga

SEQ ID NO: 25481 - RNA, 32 nt, Artificial Sequence
  Synthetic Oligonucleotide; PRDM1 exon 4; Set B
uuuauuuuuuuguucuguaauccacuuacuga

SEQ ID NO: 25482 - RNA, 34 nt, Artificial Sequence
  Synthetic Oligonucleotide; PRDM1 exon 4; Set B
uuuuauuuuuuuguucuguaauccacuuacugag

SEQ ID NO: 25483 - RNA, 37 nt, Artificial Sequence
  Synthetic Oligonucleotide; PRDM1 exon 4; Set B
uuuuuuauuuuuuuguucuguaauccacuuacugaga

SEQ ID NO: 25484 - RNA, 33 nt, Artificial Sequence
  Synthetic Oligonucleotide; PRDM1 exon 4; Set B
uuuuauuuuuuuguucuguaauccacuuacuga

SEQ ID NO: 25485 - RNA, 35 nt, Artificial Sequence
  Synthetic Oligonucleotide; PRDM1 exon 4; Set B
uuuuuauuuuuuuguucuguaauccacuuacugag

SEQ ID NO: 25486 - RNA, 38 nt, Artificial Sequence
  Synthetic Oligonucleotide; PRDM1 exon 4; Set B
auuuuuuauuuuuuuguucuguaauccacuuacugaga

SEQ ID NO: 25487 - RNA, 34 nt, Artificial Sequence
  Synthetic Oligonucleotide; PRDM1 exon 4; Set B
uuuuuauuuuuuuguucuguaauccacuuacuga

SEQ ID NO: 25488 - RNA, 36 nt, Artificial Sequence
  Synthetic Oligonucleotide; PRDM1 exon 4; Set B
uuuuuuauuuuuuuguucuguaauccacuuacugag

SEQ ID NO: 25489 - RNA, 39 nt, Artificial Sequence
  Synthetic Oligonucleotide; PRDM1 exon 4; Set B
cauuuuuuauuuuuuuguucuguaauccacuuacugaga

SEQ ID NO: 25490 - RNA, 35 nt, Artificial Sequence
  Synthetic Oligonucleotide; PRDM1 exon 4; Set B
uuuuuuauuuuuuuguucuguaauccacuuacuga

SEQ ID NO: 25491 - RNA, 37 nt, Artificial Sequence
  Synthetic Oligonucleotide; PRDM1 exon 4; Set B
auuuuuuauuuuuuuguucuguaauccacuuacugag

SEQ ID NO: 25492 - RNA, 40 nt, Artificial Sequence
  Synthetic Oligonucleotide; PRDM1 exon 4; Set B
gcauuuuuuauuuuuuuguucuguaauccacuuacugaga

SEQ ID NO: 25493 - RNA, 36 nt, Artificial Sequence
  Synthetic Oligonucleotide; PRDM1 exon 4; Set B
auuuuuuauuuuuuuguucuguaauccacuuacuga

SEQ ID NO: 25494 - RNA, 38 nt, Artificial Sequence
  Synthetic Oligonucleotide; PRDM1 exon 4; Set B
cauuuuuuauuuuuuuguucuguaauccacuuacugag

SEQ ID NO: 25495 - RNA, 37 nt, Artificial Sequence
  Synthetic Oligonucleotide; PRDM1 exon 4; Set B
cauuuuuuauuuuuuuguucuguaauccacuuacuga

SEQ ID NO: 25496 - RNA, 39 nt, Artificial Sequence
  Synthetic Oligonucleotide; PRDM1 exon 4; Set B
gcauuuuuuauuuuuuuguucuguaauccacuuacugag

SEQ ID NO: 25497 - RNA, 15 nt, Artificial Sequence
  Synthetic Oligonucleotide; PRDM1 exon 4; Set C
uuuuuguucuguaau

SEQ ID NO: 25498 - RNA, 38 nt, Artificial Sequence
  Synthetic Oligonucleotide; PRDM1 exon 4; Set B
gcauuuuuuauuuuuuuguucuguaauccacuuacuga

SEQ ID NO: 25499 - RNA, 16 nt, Artificial Sequence
  Synthetic Oligonucleotide; PRDM1 exon 4; Set C
uuuuuuguucuguaau

SEQ ID NO: 25500 - RNA, 17 nt, Artificial Sequence
  Synthetic Oligonucleotide; PRDM1 exon 4; Set C
uuuuuuuguucuguaau

SEQ ID NO: 25501 - RNA, 18 nt, Artificial Sequence
  Synthetic Oligonucleotide; PRDM1 exon 4; Set C
auuuuuuuguucuguaau

SEQ ID NO: 25502 - RNA, 19 nt, Artificial Sequence
  Synthetic Oligonucleotide; PRDM1 exon 4; Set C
uauuuuuuuguucuguaau

SEQ ID NO: 25503 - RNA, 15 nt, Artificial Sequence
  Synthetic Oligonucleotide; PRDM1 exon 4; Set C
uuuuuuuguucugua

SEQ ID NO: 25504 - RNA, 20 nt, Artificial Sequence
  Synthetic Oligonucleotide; PRDM1 exon 4; Set C
uuauuuuuuuguucuguaau

SEQ ID NO: 25505 - RNA, 16 nt, Artificial Sequence
  Synthetic Oligonucleotide; PRDM1 exon 4; Set C
auuuuuuuguucugua

SEQ ID NO: 25506 - RNA, 21 nt, Artificial Sequence
  Synthetic Oligonucleotide; PRDM1 exon 4; Set C
uuuauuuuuuuguucuguaau

SEQ ID NO: 25507 - RNA, 15 nt, Artificial Sequence
  Synthetic Oligonucleotide; PRDM1 exon 4; Set C
auuuuuuuguucugu

SEQ ID NO: 25508 - RNA, 17 nt, Artificial Sequence
  Synthetic Oligonucleotide; PRDM1 exon 4; Set C
uauuuuuuuguucugua

SEQ ID NO: 25509 - RNA, 22 nt, Artificial Sequence
  Synthetic Oligonucleotide; PRDM1 exon 4; Set C
uuuuauuuuuuuguucuguaau

SEQ ID NO: 25510 - RNA, 16 nt, Artificial Sequence
  Synthetic Oligonucleotide; PRDM1 exon 4; Set C
uauuuuuuuguucugu

SEQ ID NO: 25511 - RNA, 18 nt, Artificial Sequence
  Synthetic Oligonucleotide; PRDM1 exon 4; Set C
uuauuuuuuuguucugua

SEQ ID NO: 25512 - RNA, 23 nt, Artificial Sequence
  Synthetic Oligonucleotide; PRDM1 exon 4; Set C
uuuuuauuuuuuuguucuguaau

SEQ ID NO: 25513 - RNA, 17 nt, Artificial Sequence
  Synthetic Oligonucleotide; PRDM1 exon 4; Set C
uuauuuuuuuguucugu

SEQ ID NO: 25514 - RNA, 19 nt, Artificial Sequence
  Synthetic Oligonucleotide; PRDM1 exon 4; Set C
uuuauuuuuuuguucugua

SEQ ID NO: 25515 - RNA, 24 nt, Artificial Sequence
  Synthetic Oligonucleotide; PRDM1 exon 4; Set C
uuuuuuauuuuuuuguucuguaau

SEQ ID NO: 25516 - RNA, 18 nt, Artificial Sequence
  Synthetic Oligonucleotide; PRDM1 exon 4; Set C
uuuauuuuuuuguucugu

SEQ ID NO: 25517 - RNA, 20 nt, Artificial Sequence
  Synthetic Oligonucleotide; PRDM1 exon 4; Set C
uuuuauuuuuuuguucugua

SEQ ID NO: 25518 - RNA, 25 nt, Artificial Sequence
  Synthetic Oligonucleotide; PRDM1 exon 4; Set C
auuuuuuauuuuuuuguucuguaau

SEQ ID NO: 25519 - RNA, 19 nt, Artificial Sequence
  Synthetic Oligonucleotide; PRDM1 exon 4; Set C
uuuuauuuuuuuguucugu

SEQ ID NO: 25520 - RNA, 21 nt, Artificial Sequence
  Synthetic Oligonucleotide; PRDM1 exon 4; Set C
uuuuuauuuuuuuguucugua

SEQ ID NO: 25521 - RNA, 17 nt, Artificial Sequence
  Synthetic Oligonucleotide; PRDM1 exon 4; Set C
uuuauuuuuuuguucug

SEQ ID NO: 25522 - RNA, 26 nt, Artificial Sequence
  Synthetic Oligonucleotide; PRDM1 exon 4; Set C
cauuuuuuauuuuuuuguucuguaau

SEQ ID NO: 25523 - RNA, 20 nt, Artificial Sequence
  Synthetic Oligonucleotide; PRDM1 exon 4; Set C
uuuuuauuuuuuuguucugu

SEQ ID NO: 25524 - RNA, 22 nt, Artificial Sequence
  Synthetic Oligonucleotide; PRDM1 exon 4; Set C
uuuuuuauuuuuuuguucugua

SEQ ID NO: 25525 - RNA, 18 nt, Artificial Sequence
  Synthetic Oligonucleotide; PRDM1 exon 4; Set C
uuuuauuuuuuuguucug

SEQ ID NO: 25526 - RNA, 35 nt, Artificial Sequence
  Synthetic Oligonucleotide; PRDM1 exon 4; Set B
acuggcauuuuuuauuuuuuuguucuguaauccac

SEQ ID NO: 25527 - RNA, 27 nt, Artificial Sequence
  Synthetic Oligonucleotide; PRDM1 exon 4; Set C
gcauuuuuuauuuuuuuguucuguaau

SEQ ID NO: 25528 - RNA, 21 nt, Artificial Sequence
  Synthetic Oligonucleotide; PRDM1 exon 4; Set C
uuuuuuauuuuuuuguucugu

SEQ ID NO: 25529 - RNA, 23 nt, Artificial Sequence
  Synthetic Oligonucleotide; PRDM1 exon 4; Set C
auuuuuuauuuuuuuguucugua

SEQ ID NO: 25530 - RNA, 19 nt, Artificial Sequence
  Synthetic Oligonucleotide; PRDM1 exon 4; Set C
uuuuuauuuuuuuguucug

SEQ ID NO: 25531 - RNA, 34 nt, Artificial Sequence
  Synthetic Oligonucleotide; PRDM1 exon 4; Set B
acuggcauuuuuuauuuuuuuguucuguaaucca

SEQ ID NO: 25532 - RNA, 22 nt, Artificial Sequence
  Synthetic Oligonucleotide; PRDM1 exon 4; Set C
auuuuuuauuuuuuuguucugu

SEQ ID NO: 25533 - RNA, 24 nt, Artificial Sequence
  Synthetic Oligonucleotide; PRDM1 exon 4; Set C
cauuuuuuauuuuuuuguucugua

SEQ ID NO: 25534 - RNA, 20 nt, Artificial Sequence
  Synthetic Oligonucleotide; PRDM1 exon 4; Set C
uuuuuuauuuuuuuguucug

SEQ ID NO: 25535 - RNA, 33 nt, Artificial Sequence
  Synthetic Oligonucleotide; PRDM1 exon 4; Set B
acuggcauuuuuuauuuuuuuguucuguaaucc

SEQ ID NO: 25536 - RNA, 23 nt, Artificial Sequence
  Synthetic Oligonucleotide; PRDM1 exon 4; Set C
cauuuuuuauuuuuuuguucugu

SEQ ID NO: 25537 - RNA, 25 nt, Artificial Sequence
  Synthetic Oligonucleotide; PRDM1 exon 4; Set C
gcauuuuuuauuuuuuuguucugua

SEQ ID NO: 25538 - RNA, 24 nt, Artificial Sequence
  Synthetic Oligonucleotide; PRDM1 exon 4; Set C
gcauuuuuuauuuuuuuguucugu

SEQ ID NO: 25539 - RNA, 32 nt, Artificial Sequence
  Synthetic Oligonucleotide; PRDM1 exon 4; Set C
uacuggcauuuuuuauuuuuuuguucuguaau

SEQ ID NO: 25540 - RNA, 23 nt, Artificial Sequence
  Synthetic Oligonucleotide; PRDM1 exon 4; Set C
ggcauuuuuuauuuuuuuguucu

SEQ ID NO: 25541 - RNA, 33 nt, Artificial Sequence
  Synthetic Oligonucleotide; PRDM1 exon 4; Set C
uuacuggcauuuuuuauuuuuuuguucuguaau

SEQ ID NO: 25542 - RNA, 22 nt, Artificial Sequence
  Synthetic Oligonucleotide; PRDM1 exon 4; Set C
ggcauuuuuuauuuuuuuguuc

SEQ ID NO: 25543 - RNA, 30 nt, Artificial Sequence
  Synthetic Oligonucleotide; PRDM1 exon 4; Set C
uacuggcauuuuuuauuuuuuuguucugua

SEQ ID NO: 25544 - RNA, 21 nt, Artificial Sequence
  Synthetic Oligonucleotide; PRDM1 exon 4; Set C
ggcauuuuuuauuuuuuuguu

SEQ ID NO: 25545 - RNA, 23 nt, Artificial Sequence
  Synthetic Oligonucleotide; PRDM1 exon 4; Set C
uggcauuuuuuauuuuuuuguuc

SEQ ID NO: 25546 - RNA, 29 nt, Artificial Sequence
  Synthetic Oligonucleotide; PRDM1 exon 4; Set C
uacuggcauuuuuuauuuuuuuguucugu

SEQ ID NO: 25547 - RNA, 31 nt, Artificial Sequence
  Synthetic Oligonucleotide; PRDM1 exon 4; Set C
uuacuggcauuuuuuauuuuuuuguucugua

SEQ ID NO: 25548 - RNA, 20 nt, Artificial Sequence
  Synthetic Oligonucleotide; PRDM1 exon 4; Set C
ggcauuuuuuauuuuuuugu

SEQ ID NO: 25549 - RNA, 22 nt, Artificial Sequence
  Synthetic Oligonucleotide; PRDM1 exon 4; Set C
uggcauuuuuuauuuuuuuguu

SEQ ID NO: 25550 - RNA, 24 nt, Artificial Sequence
  Synthetic Oligonucleotide; PRDM1 exon 4; Set C
cuggcauuuuuuauuuuuuuguuc

SEQ ID NO: 25551 - RNA, 26 nt, Artificial Sequence
  Synthetic Oligonucleotide; PRDM1 exon 4; Set C
acuggcauuuuuuauuuuuuuguucu

SEQ ID NO: 25552 - RNA, 30 nt, Artificial Sequence
  Synthetic Oligonucleotide; PRDM1 exon 4; Set C
uuacuggcauuuuuuauuuuuuuguucugu

SEQ ID NO: 25553 - RNA, 19 nt, Artificial Sequence
  Synthetic Oligonucleotide; PRDM1 exon 4; Set C
ggcauuuuuuauuuuuuug

SEQ ID NO: 25554 - RNA, 21 nt, Artificial Sequence
  Synthetic Oligonucleotide; PRDM1 exon 4; Set C
uggcauuuuuuauuuuuuugu

SEQ ID NO: 25555 - RNA, 23 nt, Artificial Sequence
  Synthetic Oligonucleotide; PRDM1 exon 4; Set C
cuggcauuuuuuauuuuuuuguu

SEQ ID NO: 25556 - RNA, 25 nt, Artificial Sequence
  Synthetic Oligonucleotide; PRDM1 exon 4; Set C
acuggcauuuuuuauuuuuuuguuc

SEQ ID NO: 25557 - RNA, 18 nt, Artificial Sequence
  Synthetic Oligonucleotide; PRDM1 exon 4; Set C
ggcauuuuuuauuuuuuu

SEQ ID NO: 25558 - RNA, 22 nt, Artificial Sequence
  Synthetic Oligonucleotide; PRDM1 exon 4; Set C
cuggcauuuuuuauuuuuuugu

SEQ ID NO: 25559 - RNA, 20 nt, Artificial Sequence
  Synthetic Oligonucleotide; PRDM1 exon 4; Set C
uggcauuuuuuauuuuuuug

SEQ ID NO: 25560 - RNA, 24 nt, Artificial Sequence
  Synthetic Oligonucleotide; PRDM1 exon 4; Set C
acuggcauuuuuuauuuuuuuguu

SEQ ID NO: 25561 - RNA, 17 nt, Artificial Sequence
  Synthetic Oligonucleotide; PRDM1 exon 4; Set C
ggcauuuuuuauuuuuu

SEQ ID NO: 25562 - RNA, 19 nt, Artificial Sequence
  Synthetic Oligonucleotide; PRDM1 exon 4; Set C
uggcauuuuuuauuuuuuu

SEQ ID NO: 25563 - RNA, 23 nt, Artificial Sequence
  Synthetic Oligonucleotide; PRDM1 exon 4; Set C
acuggcauuuuuuauuuuuuugu

SEQ ID NO: 25564 - RNA, 21 nt, Artificial Sequence
  Synthetic Oligonucleotide; PRDM1 exon 4; Set C
cuggcauuuuuuauuuuuuug

SEQ ID NO: 25565 - RNA, 16 nt, Artificial Sequence
  Synthetic Oligonucleotide; PRDM1 exon 4; Set C
ggcauuuuuuauuuuu

SEQ ID NO: 25566 - RNA, 20 nt, Artificial Sequence
  Synthetic Oligonucleotide; PRDM1 exon 4; Set C
cuggcauuuuuuauuuuuuu

SEQ ID NO: 25567 - RNA, 18 nt, Artificial Sequence
  Synthetic Oligonucleotide; PRDM1 exon 4; Set C
uggcauuuuuuauuuuuu

SEQ ID NO: 25568 - RNA, 22 nt, Artificial Sequence
  Synthetic Oligonucleotide; PRDM1 exon 4; Set C
acuggcauuuuuuauuuuuuug

SEQ ID NO: 25569 - RNA, 15 nt, Artificial Sequence
  Synthetic Oligonucleotide; PRDM1 exon 4; Set C
ggcauuuuuuauuuu

SEQ ID NO: 25570 - RNA, 17 nt, Artificial Sequence
  Synthetic Oligonucleotide; PRDM1 exon 4; Set C
uggcauuuuuuauuuuu

SEQ ID NO: 25571 - RNA, 19 nt, Artificial Sequence
  Synthetic Oligonucleotide; PRDM1 exon 4; Set C
cuggcauuuuuuauuuuuu

SEQ ID NO: 25572 - RNA, 18 nt, Artificial Sequence
  Synthetic Oligonucleotide; PRDM1 exon 4; Set C
cuggcauuuuuuauuuuu

SEQ ID NO: 25573 - RNA, 16 nt, Artificial Sequence
  Synthetic Oligonucleotide; PRDM1 exon 4; Set C
uggcauuuuuuauuuu

SEQ ID NO: 25574 - RNA, 17 nt, Artificial Sequence
  Synthetic Oligonucleotide; PRDM1 exon 4; Set C
cuggcauuuuuuauuuu

SEQ ID NO: 25575 - RNA, 15 nt, Artificial Sequence
  Synthetic Oligonucleotide; PRDM1 exon 4; Set C
uggcauuuuuuauuu

SEQ ID NO: 25576 - RNA, 16 nt, Artificial Sequence
  Synthetic Oligonucleotide; PRDM1 exon 4; Set C
cuggcauuuuuuauuu

SEQ ID NO: 25577 - RNA, 15 nt, Artificial Sequence
  Synthetic Oligonucleotide; PRDM1 exon 4; Set C
cuggcauuuuuuauu

SEQ ID NO: 25578 - RNA, 40 nt, Artificial Sequence
  Synthetic Oligonucleotide; PRDM1 exon 4; Set A
cuguccaaaagagaagacaggcauguaaaaggaagucaga

SEQ ID NO: 25579 - RNA, 39 nt, Artificial Sequence
  Synthetic Oligonucleotide; PRDM1 exon 4; Set A
cuguccaaaagagaagacaggcauguaaaaggaagucag

SEQ ID NO: 25580 - RNA, 40 nt, Artificial Sequence
  Synthetic Oligonucleotide; PRDM1 exon 4; Set A
ucuguccaaaagagaagacaggcauguaaaaggaagucag

SEQ ID NO: 25581 - RNA, 38 nt, Artificial Sequence
  Synthetic Oligonucleotide; PRDM1 exon 4; Set A
cuguccaaaagagaagacaggcauguaaaaggaaguca

SEQ ID NO: 25582 - RNA, 39 nt, Artificial Sequence
  Synthetic Oligonucleotide; PRDM1 exon 4; Set A
ucuguccaaaagagaagacaggcauguaaaaggaaguca

SEQ ID NO: 25583 - RNA, 37 nt, Artificial Sequence
  Synthetic Oligonucleotide; PRDM1 exon 4; Set A
cuguccaaaagagaagacaggcauguaaaaggaaguc

SEQ ID NO: 25584 - RNA, 36 nt, Artificial Sequence
  Synthetic Oligonucleotide; PRDM1 exon 4; Set A
cuguccaaaagagaagacaggcauguaaaaggaagu

SEQ ID NO: 25585 - RNA, 40 nt, Artificial Sequence
  Synthetic Oligonucleotide; PRDM1 exon 4; Set A
aucuguccaaaagagaagacaggcauguaaaaggaaguca

SEQ ID NO: 25586 - RNA, 38 nt, Artificial Sequence
  Synthetic Oligonucleotide; PRDM1 exon 4; Set A
ucuguccaaaagagaagacaggcauguaaaaggaaguc

SEQ ID NO: 25587 - RNA, 37 nt, Artificial Sequence
  Synthetic Oligonucleotide; PRDM1 exon 4; Set A
ucuguccaaaagagaagacaggcauguaaaaggaagu

SEQ ID NO: 25588 - RNA, 39 nt, Artificial Sequence
  Synthetic Oligonucleotide; PRDM1 exon 4; Set A
aucuguccaaaagagaagacaggcauguaaaaggaaguc

SEQ ID NO: 25589 - RNA, 38 nt, Artificial Sequence
  Synthetic Oligonucleotide; PRDM1 exon 4; Set A
aucuguccaaaagagaagacaggcauguaaaaggaagu

SEQ ID NO: 25590 - RNA, 40 nt, Artificial Sequence
  Synthetic Oligonucleotide; PRDM1 exon 4; Set A
gaucuguccaaaagagaagacaggcauguaaaaggaaguc

SEQ ID NO: 25591 - RNA, 39 nt, Artificial Sequence
  Synthetic Oligonucleotide; PRDM1 exon 4; Set A
gaucuguccaaaagagaagacaggcauguaaaaggaagu

SEQ ID NO: 25592 - RNA, 27 nt, Artificial Sequence
  Synthetic Oligonucleotide; PRDM1 exon 4; Set A
gugaagcuccccucuggaauagaucug

SEQ ID NO: 25593 - RNA, 28 nt, Artificial Sequence
  Synthetic Oligonucleotide; PRDM1 exon 4; Set A
ggugaagcuccccucuggaauagaucug

SEQ ID NO: 25594 - RNA, 26 nt, Artificial Sequence
  Synthetic Oligonucleotide; PRDM1 exon 4; Set A
gugaagcuccccucuggaauagaucu

SEQ ID NO: 25595 - RNA, 29 nt, Artificial Sequence
  Synthetic Oligonucleotide; PRDM1 exon 4; Set A
uggugaagcuccccucuggaauagaucug

SEQ ID NO: 25596 - RNA, 27 nt, Artificial Sequence
  Synthetic Oligonucleotide; PRDM1 exon 4; Set A
ggugaagcuccccucuggaauagaucu

SEQ ID NO: 25597 - RNA, 28 nt, Artificial Sequence
  Synthetic Oligonucleotide; PRDM1 exon 4; Set A
uggugaagcuccccucuggaauagaucu

SEQ ID NO: 25598 - RNA, 26 nt, Artificial Sequence
  Synthetic Oligonucleotide; PRDM1 exon 4; Set A
ggugaagcuccccucuggaauagauc

SEQ ID NO: 25599 - RNA, 25 nt, Artificial Sequence
  Synthetic Oligonucleotide; PRDM1 exon 4; Set A
ggugaagcuccccucuggaauagau

SEQ ID NO: 25600 - RNA, 27 nt, Artificial Sequence
  Synthetic Oligonucleotide; PRDM1 exon 4; Set A
uggugaagcuccccucuggaauagauc

SEQ ID NO: 25601 - RNA, 24 nt, Artificial Sequence
  Synthetic Oligonucleotide; PRDM1 exon 4; Set A
ggugaagcuccccucuggaauaga

SEQ ID NO: 25602 - RNA, 26 nt, Artificial Sequence
  Synthetic Oligonucleotide; PRDM1 exon 4; Set A
uggugaagcuccccucuggaauagau

SEQ ID NO: 25603 - RNA, 25 nt, Artificial Sequence
  Synthetic Oligonucleotide; PRDM1 exon 4; Set A
uggugaagcuccccucuggaauaga

SEQ ID NO: 25604 - RNA, 24 nt, Artificial Sequence
  Synthetic Oligonucleotide; PRDM1 exon 4; Set A
uggugaagcuccccucuggaauag

SEQ ID NO: 25605 - RNA, 23 nt, Artificial Sequence
  Synthetic Oligonucleotide; PRDM1 exon 4; Set A
uggugaagcuccccucuggaaua

SEQ ID NO: 25606 - RNA, 17 nt, Artificial Sequence
  Synthetic Oligonucleotide; PRDM1 exon 4; Set C
ucucuucauuaaagccg

SEQ ID NO: 25607 - RNA, 18 nt, Artificial Sequence
  Synthetic Oligonucleotide; PRDM1 exon 4; Set C
uucucuucauuaaagccg

SEQ ID NO: 25608 - RNA, 16 nt, Artificial Sequence
  Synthetic Oligonucleotide; PRDM1 exon 4; Set C
ucucuucauuaaagcc

SEQ ID NO: 25609 - RNA, 17 nt, Artificial Sequence
  Synthetic Oligonucleotide; PRDM1 exon 4; Set C
uucucuucauuaaagcc

SEQ ID NO: 25610 - RNA, 16 nt, Artificial Sequence
  Synthetic Oligonucleotide; PRDM1 exon 4; Set C
uucucuucauuaaagc

SEQ ID NO: 25611 - RNA, 25 nt, Artificial Sequence
  Synthetic Oligonucleotide; PRDM1 exon 4; Set C
guugcuuuucucuucauuaaagccg

SEQ ID NO: 25612 - RNA, 26 nt, Artificial Sequence
  Synthetic Oligonucleotide; PRDM1 exon 4; Set C
aguugcuuuucucuucauuaaagccg

SEQ ID NO: 25613 - RNA, 24 nt, Artificial Sequence
  Synthetic Oligonucleotide; PRDM1 exon 4; Set C
guugcuuuucucuucauuaaagcc

SEQ ID NO: 25614 - RNA, 23 nt, Artificial Sequence
  Synthetic Oligonucleotide; PRDM1 exon 4; Set C
guugcuuuucucuucauuaaagc

SEQ ID NO: 25615 - RNA, 15 nt, Artificial Sequence
  Synthetic Oligonucleotide; PRDM1 exon 4; Set A
gcucccggggagagu

SEQ ID NO: 25616 - RNA, 16 nt, Artificial Sequence
  Synthetic Oligonucleotide; PRDM1 exon 4; Set A
ugcucccggggagagu

SEQ ID NO: 25617 - RNA, 17 nt, Artificial Sequence
  Synthetic Oligonucleotide; PRDM1 exon 4; Set A
uugcucccggggagagu

SEQ ID NO: 25618 - RNA, 18 nt, Artificial Sequence
  Synthetic Oligonucleotide; PRDM1 exon 4; Set A
uuugcucccggggagagu

SEQ ID NO: 25619 - RNA, 24 nt, Artificial Sequence
  Synthetic Oligonucleotide; PRDM1 exon 4; Set C
gguuuugcucccggggagagugug

SEQ ID NO: 25620 - RNA, 19 nt, Artificial Sequence
  Synthetic Oligonucleotide; PRDM1 exon 4; Set A
uuuugcucccggggagagu

SEQ ID NO: 25621 - RNA, 23 nt, Artificial Sequence
  Synthetic Oligonucleotide; PRDM1 exon 4; Set C
gguuuugcucccggggagagugu

SEQ ID NO: 25622 - RNA, 25 nt, Artificial Sequence
  Synthetic Oligonucleotide; PRDM1 exon 4; Set C
agguuuugcucccggggagagugug

SEQ ID NO: 25623 - RNA, 20 nt, Artificial Sequence
  Synthetic Oligonucleotide; PRDM1 exon 4; Set A
guuuugcucccggggagagu

SEQ ID NO: 25624 - RNA, 24 nt, Artificial Sequence
  Synthetic Oligonucleotide; PRDM1 exon 4; Set C
agguuuugcucccggggagagugu

SEQ ID NO: 25625 - RNA, 22 nt, Artificial Sequence
  Synthetic Oligonucleotide; PRDM1 exon 4; Set A
gguuuugcucccggggagagug

SEQ ID NO: 25626 - RNA, 23 nt, Artificial Sequence
  Synthetic Oligonucleotide; PRDM1 exon 4; Set A
agguuuugcucccggggagagug

SEQ ID NO: 25627 - RNA, 32 nt, Artificial Sequence
  Synthetic Oligonucleotide; PRDM1 exon 4; Set C
cgcagccagguuuugcucccggggagagugug

SEQ ID NO: 25628 - RNA, 31 nt, Artificial Sequence
  Synthetic Oligonucleotide; PRDM1 exon 4; Set C
cgcagccagguuuugcucccggggagagugu

SEQ ID NO: 25629 - RNA, 28 nt, Artificial Sequence
  Synthetic Oligonucleotide; PRDM1 exon 4; Set C
gcagccagguuuugcucccggggagagu

SEQ ID NO: 25630 - RNA, 30 nt, Artificial Sequence
  Synthetic Oligonucleotide; PRDM1 exon 4; Set C
cgcagccagguuuugcucccggggagagug

SEQ ID NO: 25631 - RNA, 17 nt, Artificial Sequence
  Synthetic Oligonucleotide; PRDM1 exon 4; Set A
cagguuuugcucccggg

SEQ ID NO: 25632 - RNA, 22 nt, Artificial Sequence
  Synthetic Oligonucleotide; PRDM1 exon 4; Set C
gcagccagguuuugcucccggg

SEQ ID NO: 25633 - RNA, 22 nt, Artificial Sequence
  Synthetic Oligonucleotide; PRDM1 exon 4; Set C
cgcagccagguuuugcucccgg

SEQ ID NO: 25634 - RNA, 38 nt, Artificial Sequence
  Synthetic Oligonucleotide; PRDM1 exon 4; Set C
guucugacacgcagccagguuuugcucccggggagagu

SEQ ID NO: 25635 - RNA, 39 nt, Artificial Sequence
  Synthetic Oligonucleotide; PRDM1 exon 4; Set C
cguucugacacgcagccagguuuugcucccggggagagu

SEQ ID NO: 25636 - RNA, 17 nt, Artificial Sequence
  Synthetic Oligonucleotide; PRDM1 exon 4; Set A
cgcagccagguuuugcu

SEQ ID NO: 25637 - RNA, 16 nt, Artificial Sequence
  Synthetic Oligonucleotide; PRDM1 exon 4; Set C
cgcagccagguuuugc

SEQ ID NO: 25638 - RNA, 15 nt, Artificial Sequence
  Synthetic Oligonucleotide; PRDM1 exon 4; Set C
cgcagccagguuuug

SEQ ID NO: 25639 - RNA, 32 nt, Artificial Sequence
  Synthetic Oligonucleotide; PRDM1 exon 4; Set C
guucugacacgcagccagguuuugcucccggg

SEQ ID NO: 25640 - RNA, 33 nt, Artificial Sequence
  Synthetic Oligonucleotide; PRDM1 exon 4; Set C
cguucugacacgcagccagguuuugcucccggg

SEQ ID NO: 25641 - RNA, 39 nt, Artificial Sequence
  Synthetic Oligonucleotide; PRDM1 exon 4; Set C
uucaucccguucugacacgcagccagguuuugcucccgg

SEQ ID NO: 25642 - RNA, 40 nt, Artificial Sequence
  Synthetic Oligonucleotide; PRDM1 exon 4; Set C
guucaucccguucugacacgcagccagguuuugcucccgg

SEQ ID NO: 25643 - RNA, 20 nt, Artificial Sequence
  Synthetic Oligonucleotide; PRDM1 exon 4; Set A
guucugacacgcagccaggu

SEQ ID NO: 25644 - RNA, 21 nt, Artificial Sequence
  Synthetic Oligonucleotide; PRDM1 exon 4; Set C
cguucugacacgcagccaggu

SEQ ID NO: 25645 - RNA, 20 nt, Artificial Sequence
  Synthetic Oligonucleotide; PRDM1 exon 4; Set A
cguucugacacgcagccagg

SEQ ID NO: 25646 - RNA, 35 nt, Artificial Sequence
  Synthetic Oligonucleotide; PRDM1 exon 4; Set C
guucaucccguucugacacgcagccagguuuugcu

SEQ ID NO: 25647 - RNA, 32 nt, Artificial Sequence
  Synthetic Oligonucleotide; PRDM1 exon 4; Set C
uucaucccguucugacacgcagccagguuuug

SEQ ID NO: 25648 - RNA, 34 nt, Artificial Sequence
  Synthetic Oligonucleotide; PRDM1 exon 4; Set C
guucaucccguucugacacgcagccagguuuugc

SEQ ID NO: 25649 - RNA, 33 nt, Artificial Sequence
  Synthetic Oligonucleotide; PRDM1 exon 4; Set C
guucaucccguucugacacgcagccagguuuug

SEQ ID NO: 25650 - RNA, 32 nt, Artificial Sequence
  Synthetic Oligonucleotide; PRDM1 exon 4; Set C
guucaucccguucugacacgcagccagguuuu

SEQ ID NO: 25651 - RNA, 31 nt, Artificial Sequence
  Synthetic Oligonucleotide; PRDM1 exon 4; Set C
guucaucccguucugacacgcagccagguuu

SEQ ID NO: 25652 - RNA, 28 nt, Artificial Sequence
  Synthetic Oligonucleotide; PRDM1 exon 4; Set C
uucaucccguucugacacgcagccaggu

SEQ ID NO: 25653 - RNA, 29 nt, Artificial Sequence
  Synthetic Oligonucleotide; PRDM1 exon 4; Set C
guucaucccguucugacacgcagccaggu

SEQ ID NO: 25654 - RNA, 27 nt, Artificial Sequence
  Synthetic Oligonucleotide; PRDM1 exon 4; Set C
uucaucccguucugacacgcagccagg

SEQ ID NO: 25655 - RNA, 30 nt, Artificial Sequence
  Synthetic Oligonucleotide; PRDM1 exon 4; Set C
uguucaucccguucugacacgcagccaggu

SEQ ID NO: 25656 - RNA, 28 nt, Artificial Sequence
  Synthetic Oligonucleotide; PRDM1 exon 4; Set C
guucaucccguucugacacgcagccagg

SEQ ID NO: 25657 - RNA, 31 nt, Artificial Sequence
  Synthetic Oligonucleotide; PRDM1 exon 4; Set C
auguucaucccguucugacacgcagccaggu

SEQ ID NO: 25658 - RNA, 29 nt, Artificial Sequence
  Synthetic Oligonucleotide; PRDM1 exon 4; Set C
uguucaucccguucugacacgcagccagg

SEQ ID NO: 25659 - RNA, 32 nt, Artificial Sequence
  Synthetic Oligonucleotide; PRDM1 exon 4; Set C
gauguucaucccguucugacacgcagccaggu

SEQ ID NO: 25660 - RNA, 30 nt, Artificial Sequence
  Synthetic Oligonucleotide; PRDM1 exon 4; Set C
auguucaucccguucugacacgcagccagg

SEQ ID NO: 25661 - RNA, 33 nt, Artificial Sequence
  Synthetic Oligonucleotide; PRDM1 exon 4; Set C
agauguucaucccguucugacacgcagccaggu

SEQ ID NO: 25662 - RNA, 31 nt, Artificial Sequence
  Synthetic Oligonucleotide; PRDM1 exon 4; Set C
gauguucaucccguucugacacgcagccagg

SEQ ID NO: 25663 - RNA, 34 nt, Artificial Sequence
  Synthetic Oligonucleotide; PRDM1 exon 4; Set C
uagauguucaucccguucugacacgcagccaggu

SEQ ID NO: 25664 - RNA, 32 nt, Artificial Sequence
  Synthetic Oligonucleotide; PRDM1 exon 4; Set C
agauguucaucccguucugacacgcagccagg

SEQ ID NO: 25665 - RNA, 35 nt, Artificial Sequence
  Synthetic Oligonucleotide; PRDM1 exon 4; Set C
guagauguucaucccguucugacacgcagccaggu

SEQ ID NO: 25666 - RNA, 33 nt, Artificial Sequence
  Synthetic Oligonucleotide; PRDM1 exon 4; Set C
uagauguucaucccguucugacacgcagccagg

SEQ ID NO: 25667 - RNA, 34 nt, Artificial Sequence
  Synthetic Oligonucleotide; PRDM1 exon 4; Set C
guagauguucaucccguucugacacgcagccagg

SEQ ID NO: 25668 - RNA, 21 nt, Artificial Sequence
  Synthetic Oligonucleotide; PRDM1 exon 4; Set A
guucaucccguucugacacgc

SEQ ID NO: 25669 - RNA, 15 nt, Artificial Sequence
  Synthetic Oligonucleotide; PRDM1 exon 4; Set C
gauguucaucccguu

SEQ ID NO: 25670 - RNA, 16 nt, Artificial Sequence
  Synthetic Oligonucleotide; PRDM1 exon 4; Set C
agauguucaucccguu

SEQ ID NO: 25671 - RNA, 15 nt, Artificial Sequence
  Synthetic Oligonucleotide; PRDM1 exon 4; Set C
agauguucaucccgu

SEQ ID NO: 25672 - RNA, 16 nt, Artificial Sequence
  Synthetic Oligonucleotide; PRDM1 exon 4; Set C
uagauguucaucccgu

SEQ ID NO: 25673 - RNA, 38 nt, Artificial Sequence
  Synthetic Oligonucleotide; PRDM1 exon 4; Set C
augguguagaaguagauguucaucccguucugacacgc

SEQ ID NO: 25674 - RNA, 39 nt, Artificial Sequence
  Synthetic Oligonucleotide; PRDM1 exon 4; Set C
aaugguguagaaguagauguucaucccguucugacacgc

SEQ ID NO: 25675 - RNA, 40 nt, Artificial Sequence
  Synthetic Oligonucleotide; PRDM1 exon 4; Set C
uaaugguguagaaguagauguucaucccguucugacacgc

SEQ ID NO: 25676 - RNA, 29 nt, Artificial Sequence
  Synthetic Oligonucleotide; PRDM1 exon 4; Set A
augguguagaaguagauguucaucccguu

SEQ ID NO: 25677 - RNA, 30 nt, Artificial Sequence
  Synthetic Oligonucleotide; PRDM1 exon 4; Set A
aaugguguagaaguagauguucaucccguu

SEQ ID NO: 25678 - RNA, 28 nt, Artificial Sequence
  Synthetic Oligonucleotide; PRDM1 exon 4; Set A
augguguagaaguagauguucaucccgu

SEQ ID NO: 25679 - RNA, 31 nt, Artificial Sequence
  Synthetic Oligonucleotide; PRDM1 exon 4; Set A
uaaugguguagaaguagauguucaucccguu

SEQ ID NO: 25680 - RNA, 29 nt, Artificial Sequence
  Synthetic Oligonucleotide; PRDM1 exon 4; Set A
aaugguguagaaguagauguucaucccgu

SEQ ID NO: 25681 - RNA, 30 nt, Artificial Sequence
  Synthetic Oligonucleotide; PRDM1 exon 4; Set A
uaaugguguagaaguagauguucaucccgu

SEQ ID NO: 25682 - RNA, 19 nt, Artificial Sequence
  Synthetic Oligonucleotide; PRDM1 exon 4; Set C
augguguagaaguagaugu

SEQ ID NO: 25683 - RNA, 18 nt, Artificial Sequence
  Synthetic Oligonucleotide; PRDM1 exon 4; Set C
augguguagaaguagaug

SEQ ID NO: 25684 - RNA, 20 nt, Artificial Sequence
  Synthetic Oligonucleotide; PRDM1 exon 4; Set C
aaugguguagaaguagaugu

SEQ ID NO: 25685 - RNA, 19 nt, Artificial Sequence
  Synthetic Oligonucleotide; PRDM1 exon 4; Set C
aaugguguagaaguagaug

SEQ ID NO: 25686 - RNA, 17 nt, Artificial Sequence
  Synthetic Oligonucleotide; PRDM1 exon 4; Set C
augguguagaaguagau

SEQ ID NO: 25687 - RNA, 21 nt, Artificial Sequence
  Synthetic Oligonucleotide; PRDM1 exon 4; Set C
uaaugguguagaaguagaugu

SEQ ID NO: 25688 - RNA, 20 nt, Artificial Sequence
  Synthetic Oligonucleotide; PRDM1 exon 4; Set C
uaaugguguagaaguagaug

SEQ ID NO: 25689 - RNA, 18 nt, Artificial Sequence
  Synthetic Oligonucleotide; PRDM1 exon 4; Set C
aaugguguagaaguagau

SEQ ID NO: 25690 - RNA, 17 nt, Artificial Sequence
  Synthetic Oligonucleotide; PRDM1 exon 4; Set C
aaugguguagaaguaga

SEQ ID NO: 25691 - RNA, 19 nt, Artificial Sequence
  Synthetic Oligonucleotide; PRDM1 exon 4; Set C
uaaugguguagaaguagau

SEQ ID NO: 25692 - RNA, 18 nt, Artificial Sequence
  Synthetic Oligonucleotide; PRDM1 exon 4; Set C
uaaugguguagaaguaga

SEQ ID NO: 25693 - RNA, 17 nt, Artificial Sequence
  Synthetic Oligonucleotide; PRDM1 exon 4; Set C
uaaugguguagaaguag

SEQ ID NO: 25694 - RNA, 29 nt, Artificial Sequence
  Synthetic Oligonucleotide; PRDM1 exon 4; Set C
guuccugguuggcagggaugggcuuaaug

SEQ ID NO: 25695 - RNA, 30 nt, Artificial Sequence
  Synthetic Oligonucleotide; PRDM1 exon 4; Set C
aguuccugguuggcagggaugggcuuaaug

SEQ ID NO: 25696 - RNA, 29 nt, Artificial Sequence
  Synthetic Oligonucleotide; PRDM1 exon 4; Set C
aguuccugguuggcagggaugggcuuaau

SEQ ID NO: 25697 - RNA, 31 nt, Artificial Sequence
  Synthetic Oligonucleotide; PRDM1 exon 4; Set C
aaguuccugguuggcagggaugggcuuaaug

SEQ ID NO: 25698 - RNA, 30 nt, Artificial Sequence
  Synthetic Oligonucleotide; PRDM1 exon 4; Set C
aaguuccugguuggcagggaugggcuuaau

SEQ ID NO: 25699 - RNA, 29 nt, Artificial Sequence
  Synthetic Oligonucleotide; PRDM1 exon 4; Set C
aaguuccugguuggcagggaugggcuuaa

SEQ ID NO: 25700 - RNA, 19 nt, Artificial Sequence
  Synthetic Oligonucleotide; PRDM1 exon 4; Set C
caauaccacacaagaaguu

SEQ ID NO: 25701 - RNA, 20 nt, Artificial Sequence
  Synthetic Oligonucleotide; PRDM1 exon 4; Set C
acaauaccacacaagaaguu

SEQ ID NO: 25702 - RNA, 18 nt, Artificial Sequence
  Synthetic Oligonucleotide; PRDM1 exon 4; Set C
caauaccacacaagaagu

SEQ ID NO: 25703 - RNA, 21 nt, Artificial Sequence
  Synthetic Oligonucleotide; PRDM1 exon 4; Set C
gacaauaccacacaagaaguu

SEQ ID NO: 25704 - RNA, 19 nt, Artificial Sequence
  Synthetic Oligonucleotide; PRDM1 exon 4; Set C
acaauaccacacaagaagu

SEQ ID NO: 25705 - RNA, 20 nt, Artificial Sequence
  Synthetic Oligonucleotide; PRDM1 exon 4; Set C
gacaauaccacacaagaagu

SEQ ID NO: 25706 - RNA, 18 nt, Artificial Sequence
  Synthetic Oligonucleotide; PRDM1 exon 4; Set C
acaauaccacacaagaag

SEQ ID NO: 25707 - RNA, 19 nt, Artificial Sequence
  Synthetic Oligonucleotide; PRDM1 exon 4; Set C
gacaauaccacacaagaag

SEQ ID NO: 25708 - RNA, 33 nt, Artificial Sequence
  Synthetic Oligonucleotide; PRDM1 exon 4; Set C
cugcaaagucccgacaauaccacacaagaaguu

SEQ ID NO: 25709 - RNA, 34 nt, Artificial Sequence
  Synthetic Oligonucleotide; PRDM1 exon 4; Set C
ucugcaaagucccgacaauaccacacaagaaguu

SEQ ID NO: 25710 - RNA, 33 nt, Artificial Sequence
  Synthetic Oligonucleotide; PRDM1 exon 4; Set C
ucugcaaagucccgacaauaccacacaagaagu

SEQ ID NO: 25711 - RNA, 32 nt, Artificial Sequence
  Synthetic Oligonucleotide; PRDM1 exon 4; Set A
ucugcaaagucccgacaauaccacacaagaag

SEQ ID NO: 25712 - RNA, 17 nt, Artificial Sequence
  Synthetic Oligonucleotide; PRDM1 exon 4; Set C
cugcaaagucccgacaa

SEQ ID NO: 25713 - RNA, 16 nt, Artificial Sequence
  Synthetic Oligonucleotide; PRDM1 exon 4; Set C
cugcaaagucccgaca

SEQ ID NO: 25714 - RNA, 15 nt, Artificial Sequence
  Synthetic Oligonucleotide; PRDM1 exon 4; Set C
cugcaaagucccgac

SEQ ID NO: 25715 - RNA, 25 nt, Artificial Sequence
  Synthetic Oligonucleotide; PRDM1 exon 4; Set B
aagccuuucugcaaagucccgacaa

SEQ ID NO: 25716 - RNA, 26 nt, Artificial Sequence
  Synthetic Oligonucleotide; PRDM1 exon 4; Set B
gaagccuuucugcaaagucccgacaa

SEQ ID NO: 25717 - RNA, 24 nt, Artificial Sequence
  Synthetic Oligonucleotide; PRDM1 exon 4; Set B
aagccuuucugcaaagucccgaca

SEQ ID NO: 25718 - RNA, 25 nt, Artificial Sequence
  Synthetic Oligonucleotide; PRDM1 exon 4; Set B
gaagccuuucugcaaagucccgaca

SEQ ID NO: 25719 - RNA, 23 nt, Artificial Sequence
  Synthetic Oligonucleotide; PRDM1 exon 4; Set B
aagccuuucugcaaagucccgac

SEQ ID NO: 25720 - RNA, 27 nt, Artificial Sequence
  Synthetic Oligonucleotide; PRDM1 exon 4; Set B
ugaagccuuucugcaaagucccgacaa

SEQ ID NO: 25721 - RNA, 28 nt, Artificial Sequence
  Synthetic Oligonucleotide; PRDM1 exon 4; Set B
gugaagccuuucugcaaagucccgacaa

SEQ ID NO: 25722 - RNA, 24 nt, Artificial Sequence
  Synthetic Oligonucleotide; PRDM1 exon 4; Set B
gaagccuuucugcaaagucccgac

SEQ ID NO: 25723 - RNA, 26 nt, Artificial Sequence
  Synthetic Oligonucleotide; PRDM1 exon 4; Set B
ugaagccuuucugcaaagucccgaca

SEQ ID NO: 25724 - RNA, 27 nt, Artificial Sequence
  Synthetic Oligonucleotide; PRDM1 exon 4; Set C
gugaagccuuucugcaaagucccgaca

SEQ ID NO: 25725 - RNA, 25 nt, Artificial Sequence
  Synthetic Oligonucleotide; PRDM1 exon 4; Set B
ugaagccuuucugcaaagucccgac

SEQ ID NO: 25726 - RNA, 26 nt, Artificial Sequence
  Synthetic Oligonucleotide; PRDM1 exon 4; Set B
gugaagccuuucugcaaagucccgac

SEQ ID NO: 25727 - RNA, 15 nt, Artificial Sequence
  Synthetic Oligonucleotide; PRDM1 exon 4; Set C
agugaagccuuucug

SEQ ID NO: 25728 - RNA, 40 nt, Artificial Sequence
  Synthetic Oligonucleotide; PRDM1 exon 4; Set C
cauugucagcucuccgggauaaggguagugaagccuuucu

SEQ ID NO: 25729 - RNA, 36 nt, Artificial Sequence
  Synthetic Oligonucleotide; PRDM1 exon 4; Set C
caucauugucagcucuccgggauaaggguagugaag

SEQ ID NO: 25730 - RNA, 29 nt, Artificial Sequence
  Synthetic Oligonucleotide; PRDM1 exon 4; Set C
cauugucagcucuccgggauaaggguagu

SEQ ID NO: 25731 - RNA, 35 nt, Artificial Sequence
  Synthetic Oligonucleotide; PRDM1 exon 4; Set C
caucauugucagcucuccgggauaaggguagugaa

SEQ ID NO: 25732 - RNA, 28 nt, Artificial Sequence
  Synthetic Oligonucleotide; PRDM1 exon 4; Set B
cauugucagcucuccgggauaaggguag

SEQ ID NO: 25733 - RNA, 30 nt, Artificial Sequence
  Synthetic Oligonucleotide; PRDM1 exon 4; Set C
ucauugucagcucuccgggauaaggguagu

SEQ ID NO: 25734 - RNA, 29 nt, Artificial Sequence
  Synthetic Oligonucleotide; PRDM1 exon 4; Set C
ucauugucagcucuccgggauaaggguag

SEQ ID NO: 25735 - RNA, 31 nt, Artificial Sequence
  Synthetic Oligonucleotide; PRDM1 exon 4; Set C
aucauugucagcucuccgggauaaggguagu

SEQ ID NO: 25736 - RNA, 27 nt, Artificial Sequence
  Synthetic Oligonucleotide; PRDM1 exon 4; Set C
cauugucagcucuccgggauaagggua

SEQ ID NO: 25737 - RNA, 33 nt, Artificial Sequence
  Synthetic Oligonucleotide; PRDM1 exon 4; Set C
caucauugucagcucuccgggauaaggguagug

SEQ ID NO: 25738 - RNA, 30 nt, Artificial Sequence
  Synthetic Oligonucleotide; PRDM1 exon 4; Set C
aucauugucagcucuccgggauaaggguag

SEQ ID NO: 25739 - RNA, 32 nt, Artificial Sequence
  Synthetic Oligonucleotide; PRDM1 exon 4; Set C
caucauugucagcucuccgggauaaggguagu

SEQ ID NO: 25740 - RNA, 28 nt, Artificial Sequence
  Synthetic Oligonucleotide; PRDM1 exon 4; Set C
ucauugucagcucuccgggauaagggua

SEQ ID NO: 25741 - RNA, 31 nt, Artificial Sequence
  Synthetic Oligonucleotide; PRDM1 exon 4; Set C
caucauugucagcucuccgggauaaggguag

SEQ ID NO: 25742 - RNA, 29 nt, Artificial Sequence
  Synthetic Oligonucleotide; PRDM1 exon 4; Set C
aucauugucagcucuccgggauaagggua

SEQ ID NO: 25743 - RNA, 30 nt, Artificial Sequence
  Synthetic Oligonucleotide; PRDM1 exon 4; Set C
caucauugucagcucuccgggauaagggua

SEQ ID NO: 25744 - RNA, 37 nt, Artificial Sequence
  Synthetic Oligonucleotide; PRDM1 exon 4; Set C
agauucaucauugucagcucuccgggauaaggguagu

SEQ ID NO: 25745 - RNA, 36 nt, Artificial Sequence
  Synthetic Oligonucleotide; PRDM1 exon 4; Set C
agauucaucauugucagcucuccgggauaaggguag

SEQ ID NO: 25746 - RNA, 38 nt, Artificial Sequence
  Synthetic Oligonucleotide; PRDM1 exon 4; Set C
gagauucaucauugucagcucuccgggauaaggguagu

SEQ ID NO: 25747 - RNA, 37 nt, Artificial Sequence
  Synthetic Oligonucleotide; PRDM1 exon 4; Set C
gagauucaucauugucagcucuccgggauaaggguag

SEQ ID NO: 25748 - RNA, 39 nt, Artificial Sequence
  Synthetic Oligonucleotide; PRDM1 exon 4; Set C
ugagauucaucauugucagcucuccgggauaaggguagu

SEQ ID NO: 25749 - RNA, 35 nt, Artificial Sequence
  Synthetic Oligonucleotide; PRDM1 exon 4; Set C
agauucaucauugucagcucuccgggauaagggua

SEQ ID NO: 25750 - RNA, 38 nt, Artificial Sequence
  Synthetic Oligonucleotide; PRDM1 exon 4; Set C
ugagauucaucauugucagcucuccgggauaaggguag

SEQ ID NO: 25751 - RNA, 36 nt, Artificial Sequence
  Synthetic Oligonucleotide; PRDM1 exon 4; Set C
gagauucaucauugucagcucuccgggauaagggua

SEQ ID NO: 25752 - RNA, 37 nt, Artificial Sequence
  Synthetic Oligonucleotide; PRDM1 exon 4; Set C
ugagauucaucauugucagcucuccgggauaagggua

SEQ ID NO: 25753 - RNA, 21 nt, Artificial Sequence
  Synthetic Oligonucleotide; PRDM1 exon 4; Set C
cacuuacugagauucaucauu

SEQ ID NO: 25754 - RNA, 20 nt, Artificial Sequence
  Synthetic Oligonucleotide; PRDM1 exon 4; Set C
cacuuacugagauucaucau

SEQ ID NO: 25755 - RNA, 22 nt, Artificial Sequence
  Synthetic Oligonucleotide; PRDM1 exon 4; Set C
ccacuuacugagauucaucauu

SEQ ID NO: 25756 - RNA, 23 nt, Artificial Sequence
  Synthetic Oligonucleotide; PRDM1 exon 4; Set C
uccacuuacugagauucaucauu

SEQ ID NO: 25757 - RNA, 18 nt, Artificial Sequence
  Synthetic Oligonucleotide; PRDM1 exon 4; Set C
cacuuacugagauucauc

SEQ ID NO: 25758 - RNA, 19 nt, Artificial Sequence
  Synthetic Oligonucleotide; PRDM1 exon 4; Set C
ccacuuacugagauucauc

SEQ ID NO: 25759 - RNA, 23 nt, Artificial Sequence
  Synthetic Oligonucleotide; PRDM1 exon 4; Set C
auccacuuacugagauucaucau

SEQ ID NO: 25760 - RNA, 22 nt, Artificial Sequence
  Synthetic Oligonucleotide; PRDM1 exon 4; Set C
auccacuuacugagauucauca

SEQ ID NO: 25761 - RNA, 21 nt, Artificial Sequence
  Synthetic Oligonucleotide; PRDM1 exon 4; Set C
auccacuuacugagauucauc

SEQ ID NO: 25762 - RNA, 25 nt, Artificial Sequence
  Synthetic Oligonucleotide; PRDM1 exon 4; Set C
uaauccacuuacugagauucaucau

SEQ ID NO: 25763 - RNA, 20 nt, Artificial Sequence
  Synthetic Oligonucleotide; PRDM1 exon 4; Set C
auccacuuacugagauucau

SEQ ID NO: 25764 - RNA, 24 nt, Artificial Sequence
  Synthetic Oligonucleotide; PRDM1 exon 4; Set C
uaauccacuuacugagauucauca

SEQ ID NO: 25765 - RNA, 23 nt, Artificial Sequence
  Synthetic Oligonucleotide; PRDM1 exon 4; Set C
uaauccacuuacugagauucauc

SEQ ID NO: 25766 - RNA, 22 nt, Artificial Sequence
  Synthetic Oligonucleotide; PRDM1 exon 4; Set C
uaauccacuuacugagauucau

SEQ ID NO: 25767 - RNA, 30 nt, Artificial Sequence
  Synthetic Oligonucleotide; PRDM1 exon 4; Set B
ucuguaauccacuuacugagauucaucauu

SEQ ID NO: 25768 - RNA, 34 nt, Artificial Sequence
  Synthetic Oligonucleotide; PRDM1 exon 4; Set B
guucuguaauccacuuacugagauucaucauugu

SEQ ID NO: 25769 - RNA, 31 nt, Artificial Sequence
  Synthetic Oligonucleotide; PRDM1 exon 4; Set B
uucuguaauccacuuacugagauucaucauu

SEQ ID NO: 25770 - RNA, 33 nt, Artificial Sequence
  Synthetic Oligonucleotide; PRDM1 exon 4; Set B
guucuguaauccacuuacugagauucaucauug

SEQ ID NO: 25771 - RNA, 35 nt, Artificial Sequence
  Synthetic Oligonucleotide; PRDM1 exon 4; Set B
uguucuguaauccacuuacugagauucaucauugu

SEQ ID NO: 25772 - RNA, 22 nt, Artificial Sequence
  Synthetic Oligonucleotide; PRDM1 exon 4; Set C
guaauccacuuacugagauuca

SEQ ID NO: 25773 - RNA, 18 nt, Artificial Sequence
  Synthetic Oligonucleotide; PRDM1 exon 4; Set C
aauccacuuacugagauu

SEQ ID NO: 25774 - RNA, 32 nt, Artificial Sequence
  Synthetic Oligonucleotide; PRDM1 exon 4; Set B
guucuguaauccacuuacugagauucaucauu

SEQ ID NO: 25775 - RNA, 34 nt, Artificial Sequence
  Synthetic Oligonucleotide; PRDM1 exon 4; Set B
uguucuguaauccacuuacugagauucaucauug

SEQ ID NO: 25776 - RNA, 36 nt, Artificial Sequence
  Synthetic Oligonucleotide; PRDM1 exon 4; Set B
uuguucuguaauccacuuacugagauucaucauugu

SEQ ID NO: 25777 - RNA, 23 nt, Artificial Sequence
  Synthetic Oligonucleotide; PRDM1 exon 4; Set C
uguaauccacuuacugagauuca

SEQ ID NO: 25778 - RNA, 21 nt, Artificial Sequence
  Synthetic Oligonucleotide; PRDM1 exon 4; Set C
guaauccacuuacugagauuc

SEQ ID NO: 25779 - RNA, 17 nt, Artificial Sequence
  Synthetic Oligonucleotide; PRDM1 exon 4; Set C
aauccacuuacugagau

SEQ ID NO: 25780 - RNA, 33 nt, Artificial Sequence
  Synthetic Oligonucleotide; PRDM1 exon 4; Set B
uguucuguaauccacuuacugagauucaucauu

SEQ ID NO: 25781 - RNA, 35 nt, Artificial Sequence
  Synthetic Oligonucleotide; PRDM1 exon 4; Set B
uuguucuguaauccacuuacugagauucaucauug

SEQ ID NO: 25782 - RNA, 37 nt, Artificial Sequence
  Synthetic Oligonucleotide; PRDM1 exon 4; Set B
uuuguucuguaauccacuuacugagauucaucauugu

SEQ ID NO: 25783 - RNA, 22 nt, Artificial Sequence
  Synthetic Oligonucleotide; PRDM1 exon 4; Set C
uguaauccacuuacugagauuc

SEQ ID NO: 25784 - RNA, 24 nt, Artificial Sequence
  Synthetic Oligonucleotide; PRDM1 exon 4; Set C
cuguaauccacuuacugagauuca

SEQ ID NO: 25785 - RNA, 20 nt, Artificial Sequence
  Synthetic Oligonucleotide; PRDM1 exon 4; Set C
guaauccacuuacugagauu

SEQ ID NO: 25786 - RNA, 34 nt, Artificial Sequence
  Synthetic Oligonucleotide; PRDM1 exon 4; Set B
uuguucuguaauccacuuacugagauucaucauu

SEQ ID NO: 25787 - RNA, 36 nt, Artificial Sequence
  Synthetic Oligonucleotide; PRDM1 exon 4; Set B
uuuguucuguaauccacuuacugagauucaucauug

SEQ ID NO: 25788 - RNA, 38 nt, Artificial Sequence
  Synthetic Oligonucleotide; PRDM1 exon 4; Set B
uuuuguucuguaauccacuuacugagauucaucauugu

SEQ ID NO: 25789 - RNA, 23 nt, Artificial Sequence
  Synthetic Oligonucleotide; PRDM1 exon 4; Set C
cuguaauccacuuacugagauuc

SEQ ID NO: 25790 - RNA, 21 nt, Artificial Sequence
  Synthetic Oligonucleotide; PRDM1 exon 4; Set C
uguaauccacuuacugagauu

SEQ ID NO: 25791 - RNA, 19 nt, Artificial Sequence
  Synthetic Oligonucleotide; PRDM1 exon 4; Set C
guaauccacuuacugagau

SEQ ID NO: 25792 - RNA, 37 nt, Artificial Sequence
  Synthetic Oligonucleotide; PRDM1 exon 4; Set B
uuuuguucuguaauccacuuacugagauucaucauug

SEQ ID NO: 25793 - RNA, 39 nt, Artificial Sequence
  Synthetic Oligonucleotide; PRDM1 exon 4; Set B
uuuuuguucuguaauccacuuacugagauucaucauugu

SEQ ID NO: 25794 - RNA, 22 nt, Artificial Sequence
  Synthetic Oligonucleotide; PRDM1 exon 4; Set C
cuguaauccacuuacugagauu

SEQ ID NO: 25795 - RNA, 20 nt, Artificial Sequence
  Synthetic Oligonucleotide; PRDM1 exon 4; Set C
uguaauccacuuacugagau

SEQ ID NO: 25796 - RNA, 38 nt, Artificial Sequence
  Synthetic Oligonucleotide; PRDM1 exon 4; Set B
uuuuuguucuguaauccacuuacugagauucaucauug

SEQ ID NO: 25797 - RNA, 40 nt, Artificial Sequence
  Synthetic Oligonucleotide; PRDM1 exon 4; Set B
uuuuuuguucuguaauccacuuacugagauucaucauugu

SEQ ID NO: 25798 - RNA, 39 nt, Artificial Sequence
  Synthetic Oligonucleotide; PRDM1 exon 4; Set B
uuuuuuguucuguaauccacuuacugagauucaucauug

SEQ ID NO: 25799 - RNA, 40 nt, Artificial Sequence
  Synthetic Oligonucleotide; PRDM1 exon 4; Set B
uuuuuuuguucuguaauccacuuacugagauucaucauug

SEQ ID NO: 25800 - RNA, 21 nt, Artificial Sequence
  Synthetic Oligonucleotide; PRDM1 exon 4; Set C
ucuguaauccacuuacugaga

SEQ ID NO: 25801 - RNA, 22 nt, Artificial Sequence
  Synthetic Oligonucleotide; PRDM1 exon 4; Set C
uucuguaauccacuuacugaga

SEQ ID NO: 25802 - RNA, 20 nt, Artificial Sequence
  Synthetic Oligonucleotide; PRDM1 exon 4; Set C
ucuguaauccacuuacugag

SEQ ID NO: 25803 - RNA, 19 nt, Artificial Sequence
  Synthetic Oligonucleotide; PRDM1 exon 4; Set C
ucuguaauccacuuacuga

SEQ ID NO: 25804 - RNA, 21 nt, Artificial Sequence
  Synthetic Oligonucleotide; PRDM1 exon 4; Set C
uucuguaauccacuuacugag

SEQ ID NO: 25805 - RNA, 20 nt, Artificial Sequence
  Synthetic Oligonucleotide; PRDM1 exon 4; Set C
uucuguaauccacuuacuga

SEQ ID NO: 25806 - RNA, 22 nt, Artificial Sequence
  Synthetic Oligonucleotide; PRDM1 exon 4; Set C
guucuguaauccacuuacugag

SEQ ID NO: 25807 - RNA, 21 nt, Artificial Sequence
  Synthetic Oligonucleotide; PRDM1 exon 4; Set C
guucuguaauccacuuacuga

SEQ ID NO: 25808 - RNA, 22 nt, Artificial Sequence
  Synthetic Oligonucleotide; PRDM1 exon 4; Set C
uguucuguaauccacuuacuga

SEQ ID NO: 25809 - RNA, 19 nt, Artificial Sequence
  Synthetic Oligonucleotide; PRDM1 exon 4; Set C
uuuguucuguaauccacuu

SEQ ID NO: 25810 - RNA, 18 nt, Artificial Sequence
  Synthetic Oligonucleotide; PRDM1 exon 4; Set C
uuuguucuguaauccacu

SEQ ID NO: 25811 - RNA, 20 nt, Artificial Sequence
  Synthetic Oligonucleotide; PRDM1 exon 4; Set C
uuuuguucuguaauccacuu

SEQ ID NO: 25812 - RNA, 19 nt, Artificial Sequence
  Synthetic Oligonucleotide; PRDM1 exon 4; Set C
uuuuguucuguaauccacu

SEQ ID NO: 25813 - RNA, 21 nt, Artificial Sequence
  Synthetic Oligonucleotide; PRDM1 exon 4; Set C
uuuuuguucuguaauccacuu

SEQ ID NO: 25814 - RNA, 20 nt, Artificial Sequence
  Synthetic Oligonucleotide; PRDM1 exon 4; Set C
uuuuuguucuguaauccacu

SEQ ID NO: 25815 - RNA, 22 nt, Artificial Sequence
  Synthetic Oligonucleotide; PRDM1 exon 4; Set C
uuuuuuguucuguaauccacuu

SEQ ID NO: 25816 - RNA, 21 nt, Artificial Sequence
  Synthetic Oligonucleotide; PRDM1 exon 4; Set C
uuuuuuguucuguaauccacu

SEQ ID NO: 25817 - RNA, 23 nt, Artificial Sequence
  Synthetic Oligonucleotide; PRDM1 exon 4; Set C
uuuuuuuguucuguaauccacuu

SEQ ID NO: 25818 - RNA, 22 nt, Artificial Sequence
  Synthetic Oligonucleotide; PRDM1 exon 4; Set C
uuuuuuuguucuguaauccacu

SEQ ID NO: 25819 - RNA, 24 nt, Artificial Sequence
  Synthetic Oligonucleotide; PRDM1 exon 4; Set C
auuuuuuuguucuguaauccacuu

SEQ ID NO: 25820 - RNA, 26 nt, Artificial Sequence
  Synthetic Oligonucleotide; PRDM1 exon 4; Set C
uauuuuuuuguucuguaauccacuua

SEQ ID NO: 25821 - RNA, 23 nt, Artificial Sequence
  Synthetic Oligonucleotide; PRDM1 exon 4; Set C
auuuuuuuguucuguaauccacu

SEQ ID NO: 25822 - RNA, 25 nt, Artificial Sequence
  Synthetic Oligonucleotide; PRDM1 exon 4; Set C
uauuuuuuuguucuguaauccacuu

SEQ ID NO: 25823 - RNA, 27 nt, Artificial Sequence
  Synthetic Oligonucleotide; PRDM1 exon 4; Set C
uuauuuuuuuguucuguaauccacuua

SEQ ID NO: 25824 - RNA, 24 nt, Artificial Sequence
  Synthetic Oligonucleotide; PRDM1 exon 4; Set C
uauuuuuuuguucuguaauccacu

SEQ ID NO: 25825 - RNA, 26 nt, Artificial Sequence
  Synthetic Oligonucleotide; PRDM1 exon 4; Set C
uuauuuuuuuguucuguaauccacuu

SEQ ID NO: 25826 - RNA, 28 nt, Artificial Sequence
  Synthetic Oligonucleotide; PRDM1 exon 4; Set C
uuuauuuuuuuguucuguaauccacuua

SEQ ID NO: 25827 - RNA, 25 nt, Artificial Sequence
  Synthetic Oligonucleotide; PRDM1 exon 4; Set C
uuauuuuuuuguucuguaauccacu

SEQ ID NO: 25828 - RNA, 27 nt, Artificial Sequence
  Synthetic Oligonucleotide; PRDM1 exon 4; Set C
uuuauuuuuuuguucuguaauccacuu

SEQ ID NO: 25829 - RNA, 29 nt, Artificial Sequence
  Synthetic Oligonucleotide; PRDM1 exon 4; Set C
uuuuauuuuuuuguucuguaauccacuua

SEQ ID NO: 25830 - RNA, 26 nt, Artificial Sequence
  Synthetic Oligonucleotide; PRDM1 exon 4; Set C
uuuauuuuuuuguucuguaauccacu

SEQ ID NO: 25831 - RNA, 28 nt, Artificial Sequence
  Synthetic Oligonucleotide; PRDM1 exon 4; Set C
uuuuauuuuuuuguucuguaauccacuu

SEQ ID NO: 25832 - RNA, 30 nt, Artificial Sequence
  Synthetic Oligonucleotide; PRDM1 exon 4; Set C
uuuuuauuuuuuuguucuguaauccacuua

SEQ ID NO: 25833 - RNA, 27 nt, Artificial Sequence
  Synthetic Oligonucleotide; PRDM1 exon 4; Set C
uuuuauuuuuuuguucuguaauccacu

SEQ ID NO: 25834 - RNA, 29 nt, Artificial Sequence
  Synthetic Oligonucleotide; PRDM1 exon 4; Set C
uuuuuauuuuuuuguucuguaauccacuu

SEQ ID NO: 25835 - RNA, 31 nt, Artificial Sequence
  Synthetic Oligonucleotide; PRDM1 exon 4; Set C
uuuuuuauuuuuuuguucuguaauccacuua

SEQ ID NO: 25836 - RNA, 28 nt, Artificial Sequence
  Synthetic Oligonucleotide; PRDM1 exon 4; Set C
uuuuuauuuuuuuguucuguaauccacu

SEQ ID NO: 25837 - RNA, 30 nt, Artificial Sequence
  Synthetic Oligonucleotide; PRDM1 exon 4; Set C
uuuuuuauuuuuuuguucuguaauccacuu

SEQ ID NO: 25838 - RNA, 29 nt, Artificial Sequence
  Synthetic Oligonucleotide; PRDM1 exon 4; Set C
uuuuuuauuuuuuuguucuguaauccacu

SEQ ID NO: 25839 - RNA, 31 nt, Artificial Sequence
  Synthetic Oligonucleotide; PRDM1 exon 4; Set C
auuuuuuauuuuuuuguucuguaauccacuu

SEQ ID NO: 25840 - RNA, 30 nt, Artificial Sequence
  Synthetic Oligonucleotide; PRDM1 exon 4; Set C
auuuuuuauuuuuuuguucuguaauccacu

SEQ ID NO: 25841 - RNA, 32 nt, Artificial Sequence
  Synthetic Oligonucleotide; PRDM1 exon 4; Set C
cauuuuuuauuuuuuuguucuguaauccacuu

SEQ ID NO: 25842 - RNA, 31 nt, Artificial Sequence
  Synthetic Oligonucleotide; PRDM1 exon 4; Set C
cauuuuuuauuuuuuuguucuguaauccacu

SEQ ID NO: 25843 - RNA, 33 nt, Artificial Sequence
  Synthetic Oligonucleotide; PRDM1 exon 4; Set B
gcauuuuuuauuuuuuuguucuguaauccacuu

SEQ ID NO: 25844 - RNA, 32 nt, Artificial Sequence
  Synthetic Oligonucleotide; PRDM1 exon 4; Set B
gcauuuuuuauuuuuuuguucuguaauccacu

SEQ ID NO: 25845 - RNA, 15 nt, Artificial Sequence
  Synthetic Oligonucleotide; PRDM1 exon 4; Set C
uauuuuuuuguucug

SEQ ID NO: 25846 - RNA, 32 nt, Artificial Sequence
  Synthetic Oligonucleotide; PRDM1 exon 4; Set B
ggcauuuuuuauuuuuuuguucuguaauccac

SEQ ID NO: 25847 - RNA, 16 nt, Artificial Sequence
  Synthetic Oligonucleotide; PRDM1 exon 4; Set C
uuauuuuuuuguucug

SEQ ID NO: 25848 - RNA, 31 nt, Artificial Sequence
  Synthetic Oligonucleotide; PRDM1 exon 4; Set C
ggcauuuuuuauuuuuuuguucuguaaucca

SEQ ID NO: 25849 - RNA, 33 nt, Artificial Sequence
  Synthetic Oligonucleotide; PRDM1 exon 4; Set B
uggcauuuuuuauuuuuuuguucuguaauccac

SEQ ID NO: 25850 - RNA, 39 nt, Artificial Sequence
  Synthetic Oligonucleotide; PRDM1 exon 4; Set B
uacuggcauuuuuuauuuuuuuguucuguaauccacuua

SEQ ID NO: 25851 - RNA, 30 nt, Artificial Sequence
  Synthetic Oligonucleotide; PRDM1 exon 4; Set C
ggcauuuuuuauuuuuuuguucuguaaucc

SEQ ID NO: 25852 - RNA, 34 nt, Artificial Sequence
  Synthetic Oligonucleotide; PRDM1 exon 4; Set B
cuggcauuuuuuauuuuuuuguucuguaauccac

SEQ ID NO: 25853 - RNA, 32 nt, Artificial Sequence
  Synthetic Oligonucleotide; PRDM1 exon 4; Set B
uggcauuuuuuauuuuuuuguucuguaaucca

SEQ ID NO: 25854 - RNA, 38 nt, Artificial Sequence
  Synthetic Oligonucleotide; PRDM1 exon 4; Set B
uacuggcauuuuuuauuuuuuuguucuguaauccacuu

SEQ ID NO: 25855 - RNA, 40 nt, Artificial Sequence
  Synthetic Oligonucleotide; PRDM1 exon 4; Set B
uuacuggcauuuuuuauuuuuuuguucuguaauccacuua

SEQ ID NO: 25856 - RNA, 31 nt, Artificial Sequence
  Synthetic Oligonucleotide; PRDM1 exon 4; Set C
uggcauuuuuuauuuuuuuguucuguaaucc

SEQ ID NO: 25857 - RNA, 33 nt, Artificial Sequence
  Synthetic Oligonucleotide; PRDM1 exon 4; Set B
cuggcauuuuuuauuuuuuuguucuguaaucca

SEQ ID NO: 25858 - RNA, 29 nt, Artificial Sequence
  Synthetic Oligonucleotide; PRDM1 exon 4; Set C
ggcauuuuuuauuuuuuuguucuguaauc

SEQ ID NO: 25859 - RNA, 37 nt, Artificial Sequence
  Synthetic Oligonucleotide; PRDM1 exon 4; Set B
uacuggcauuuuuuauuuuuuuguucuguaauccacu

SEQ ID NO: 25860 - RNA, 39 nt, Artificial Sequence
  Synthetic Oligonucleotide; PRDM1 exon 4; Set B
uuacuggcauuuuuuauuuuuuuguucuguaauccacuu

SEQ ID NO: 25861 - RNA, 32 nt, Artificial Sequence
  Synthetic Oligonucleotide; PRDM1 exon 4; Set C
cuggcauuuuuuauuuuuuuguucuguaaucc

SEQ ID NO: 25862 - RNA, 30 nt, Artificial Sequence
  Synthetic Oligonucleotide; PRDM1 exon 4; Set C
uggcauuuuuuauuuuuuuguucuguaauc

SEQ ID NO: 25863 - RNA, 38 nt, Artificial Sequence
  Synthetic Oligonucleotide; PRDM1 exon 4; Set B
uuacuggcauuuuuuauuuuuuuguucuguaauccacu

SEQ ID NO: 25864 - RNA, 31 nt, Artificial Sequence
  Synthetic Oligonucleotide; PRDM1 exon 4; Set C
cuggcauuuuuuauuuuuuuguucuguaauc

SEQ ID NO: 25865 - RNA, 27 nt, Artificial Sequence
  Synthetic Oligonucleotide; PRDM1 exon 4; Set C
ggcauuuuuuauuuuuuuguucuguaa

SEQ ID NO: 25866 - RNA, 21 nt, Artificial Sequence
  Synthetic Oligonucleotide; PRDM1 exon 4; Set C
auuuuuuauuuuuuuguucug

SEQ ID NO: 25867 - RNA, 32 nt, Artificial Sequence
  Synthetic Oligonucleotide; PRDM1 exon 4; Set C
acuggcauuuuuuauuuuuuuguucuguaauc

SEQ ID NO: 25868 - RNA, 28 nt, Artificial Sequence
  Synthetic Oligonucleotide; PRDM1 exon 4; Set C
uggcauuuuuuauuuuuuuguucuguaa

SEQ ID NO: 25869 - RNA, 22 nt, Artificial Sequence
  Synthetic Oligonucleotide; PRDM1 exon 4; Set C
cauuuuuuauuuuuuuguucug

SEQ ID NO: 25870 - RNA, 29 nt, Artificial Sequence
  Synthetic Oligonucleotide; PRDM1 exon 4; Set C
cuggcauuuuuuauuuuuuuguucuguaa

SEQ ID NO: 25871 - RNA, 23 nt, Artificial Sequence
  Synthetic Oligonucleotide; PRDM1 exon 4; Set C
gcauuuuuuauuuuuuuguucug

SEQ ID NO: 25872 - RNA, 30 nt, Artificial Sequence
  Synthetic Oligonucleotide; PRDM1 exon 4; Set C
acuggcauuuuuuauuuuuuuguucuguaa

SEQ ID NO: 25873 - RNA, 24 nt, Artificial Sequence
  Synthetic Oligonucleotide; PRDM1 exon 4; Set C
uggcauuuuuuauuuuuuuguucu

SEQ ID NO: 25874 - RNA, 25 nt, Artificial Sequence
  Synthetic Oligonucleotide; PRDM1 exon 4; Set C
cuggcauuuuuuauuuuuuuguucu

SEQ ID NO: 25875 - RNA, 28 nt, Artificial Sequence
  Synthetic Oligonucleotide; PRDM1 exon 4; Set C
uacuggcauuuuuuauuuuuuuguucug

SEQ ID NO: 25876 - RNA, 29 nt, Artificial Sequence
  Synthetic Oligonucleotide; PRDM1 exon 4; Set C
uuacuggcauuuuuuauuuuuuuguucug

SEQ ID NO: 25877 - RNA, 27 nt, Artificial Sequence
  Synthetic Oligonucleotide; PRDM1 exon 4; Set C
auuacuggcauuuuuuauuuuuuuguu

SEQ ID NO: 25878 - RNA, 26 nt, Artificial Sequence
  Synthetic Oligonucleotide; PRDM1 exon 4; Set C
auuacuggcauuuuuuauuuuuuugu

SEQ ID NO: 25879 - RNA, 25 nt, Artificial Sequence
  Synthetic Oligonucleotide; PRDM1 exon 4; Set C
auuacuggcauuuuuuauuuuuuug

SEQ ID NO: 25880 - RNA, 24 nt, Artificial Sequence
  Synthetic Oligonucleotide; PRDM1 exon 4; Set C
auuacuggcauuuuuuauuuuuuu

SEQ ID NO: 25881 - RNA, 23 nt, Artificial Sequence
  Synthetic Oligonucleotide; PRDM1 exon 4; Set C
auuacuggcauuuuuuauuuuuu

SEQ ID NO: 25882 - RNA, 22 nt, Artificial Sequence
  Synthetic Oligonucleotide; PRDM1 exon 4; Set C
auuacuggcauuuuuuauuuuu

SEQ ID NO: 25883 - RNA, 21 nt, Artificial Sequence
  Synthetic Oligonucleotide; PRDM1 exon 4; Set C
auuacuggcauuuuuuauuuu

SEQ ID NO: 25884 - RNA, 20 nt, Artificial Sequence
  Synthetic Oligonucleotide; PRDM1 exon 4; Set C
auuacuggcauuuuuuauuu

SEQ ID NO: 25885 - RNA, 28 nt, Artificial Sequence
  Synthetic Oligonucleotide; PRDM1 exon 4; Set C
cgacauuacuggcauuuuuuauuuuuuu

SEQ ID NO: 25886 - RNA, 19 nt, Artificial Sequence
  Synthetic Oligonucleotide; PRDM1 exon 4; Set C
auuacuggcauuuuuuauu

SEQ ID NO: 25887 - RNA, 27 nt, Artificial Sequence
  Synthetic Oligonucleotide; PRDM1 exon 4; Set C
cgacauuacuggcauuuuuuauuuuuu

SEQ ID NO: 25888 - RNA, 26 nt, Artificial Sequence
  Synthetic Oligonucleotide; PRDM1 exon 4; Set C
cgacauuacuggcauuuuuuauuuuu

SEQ ID NO: 25889 - RNA, 18 nt, Artificial Sequence
  Synthetic Oligonucleotide; PRDM1 exon 4; Set C
auuacuggcauuuuuuau

SEQ ID NO: 25890 - RNA, 25 nt, Artificial Sequence
  Synthetic Oligonucleotide; PRDM1 exon 4; Set C
cgacauuacuggcauuuuuuauuuu

SEQ ID NO: 25891 - RNA, 17 nt, Artificial Sequence
  Synthetic Oligonucleotide; PRDM1 exon 4; Set C
auuacuggcauuuuuua

SEQ ID NO: 25892 - RNA, 24 nt, Artificial Sequence
  Synthetic Oligonucleotide; PRDM1 exon 4; Set C
cgacauuacuggcauuuuuuauuu

SEQ ID NO: 25893 - RNA, 16 nt, Artificial Sequence
  Synthetic Oligonucleotide; PRDM1 exon 4; Set C
auuacuggcauuuuuu

SEQ ID NO: 25894 - RNA, 23 nt, Artificial Sequence
  Synthetic Oligonucleotide; PRDM1 exon 4; Set C
cgacauuacuggcauuuuuuauu

SEQ ID NO: 25895 - RNA, 15 nt, Artificial Sequence
  Synthetic Oligonucleotide; PRDM1 exon 4; Set C
auuacuggcauuuuu

SEQ ID NO: 25896 - RNA, 23 nt, Artificial Sequence
  Synthetic Oligonucleotide; PRDM1 exon 4; Set C
aaaggaagucagacccaaagcuc

SEQ ID NO: 25897 - RNA, 22 nt, Artificial Sequence
  Synthetic Oligonucleotide; PRDM1 exon 4; Set C
aaaggaagucagacccaaagcu

SEQ ID NO: 25898 - RNA, 24 nt, Artificial Sequence
  Synthetic Oligonucleotide; PRDM1 exon 4; Set C
aaaaggaagucagacccaaagcuc

SEQ ID NO: 25899 - RNA, 21 nt, Artificial Sequence
  Synthetic Oligonucleotide; PRDM1 exon 4; Set C
aaaggaagucagacccaaagc

SEQ ID NO: 25900 - RNA, 23 nt, Artificial Sequence
  Synthetic Oligonucleotide; PRDM1 exon 4; Set C
aaaaggaagucagacccaaagcu

SEQ ID NO: 25901 - RNA, 20 nt, Artificial Sequence
  Synthetic Oligonucleotide; PRDM1 exon 4; Set C
aaaggaagucagacccaaag

SEQ ID NO: 25902 - RNA, 22 nt, Artificial Sequence
  Synthetic Oligonucleotide; PRDM1 exon 4; Set C
aaaaggaagucagacccaaagc

SEQ ID NO: 25903 - RNA, 19 nt, Artificial Sequence
  Synthetic Oligonucleotide; PRDM1 exon 4; Set C
aaaggaagucagacccaaa

SEQ ID NO: 25904 - RNA, 21 nt, Artificial Sequence
  Synthetic Oligonucleotide; PRDM1 exon 4; Set C
aaaaggaagucagacccaaag

SEQ ID NO: 25905 - RNA, 20 nt, Artificial Sequence
  Synthetic Oligonucleotide; PRDM1 exon 4; Set C
aaaaggaagucagacccaaa

SEQ ID NO: 25906 - RNA, 32 nt, Artificial Sequence
  Synthetic Oligonucleotide; PRDM1 exon 4; Set A
aggcauguaaaaggaagucagacccaaagcuc

SEQ ID NO: 25907 - RNA, 31 nt, Artificial Sequence
  Synthetic Oligonucleotide; PRDM1 exon 4; Set A
aggcauguaaaaggaagucagacccaaagcu

SEQ ID NO: 25908 - RNA, 30 nt, Artificial Sequence
  Synthetic Oligonucleotide; PRDM1 exon 4; Set A
aggcauguaaaaggaagucagacccaaagc

SEQ ID NO: 25909 - RNA, 29 nt, Artificial Sequence
  Synthetic Oligonucleotide; PRDM1 exon 4; Set A
aggcauguaaaaggaagucagacccaaag

SEQ ID NO: 25910 - RNA, 28 nt, Artificial Sequence
  Synthetic Oligonucleotide; PRDM1 exon 4; Set A
aggcauguaaaaggaagucagacccaaa

SEQ ID NO: 25911 - RNA, 22 nt, Artificial Sequence
  Synthetic Oligonucleotide; PRDM1 exon 4; Set C
aggcauguaaaaggaagucaga

SEQ ID NO: 25912 - RNA, 21 nt, Artificial Sequence
  Synthetic Oligonucleotide; PRDM1 exon 4; Set C
aggcauguaaaaggaagucag

SEQ ID NO: 25913 - RNA, 20 nt, Artificial Sequence
  Synthetic Oligonucleotide; PRDM1 exon 4; Set C
aggcauguaaaaggaaguca

SEQ ID NO: 25914 - RNA, 19 nt, Artificial Sequence
  Synthetic Oligonucleotide; PRDM1 exon 4; Set C
aggcauguaaaaggaaguc

SEQ ID NO: 25915 - RNA, 18 nt, Artificial Sequence
  Synthetic Oligonucleotide; PRDM1 exon 4; Set C
aggcauguaaaaggaagu

SEQ ID NO: 25916 - RNA, 29 nt, Artificial Sequence
  Synthetic Oligonucleotide; PRDM1 exon 4; Set A
agaagacaggcauguaaaaggaagucaga

SEQ ID NO: 25917 - RNA, 30 nt, Artificial Sequence
  Synthetic Oligonucleotide; PRDM1 exon 4; Set A
gagaagacaggcauguaaaaggaagucaga

SEQ ID NO: 25918 - RNA, 28 nt, Artificial Sequence
  Synthetic Oligonucleotide; PRDM1 exon 4; Set C
agaagacaggcauguaaaaggaagucag

SEQ ID NO: 25919 - RNA, 31 nt, Artificial Sequence
  Synthetic Oligonucleotide; PRDM1 exon 4; Set A
agagaagacaggcauguaaaaggaagucaga

SEQ ID NO: 25920 - RNA, 29 nt, Artificial Sequence
  Synthetic Oligonucleotide; PRDM1 exon 4; Set A
gagaagacaggcauguaaaaggaagucag

SEQ ID NO: 25921 - RNA, 32 nt, Artificial Sequence
  Synthetic Oligonucleotide; PRDM1 exon 4; Set A
aagagaagacaggcauguaaaaggaagucaga

SEQ ID NO: 25922 - RNA, 30 nt, Artificial Sequence
  Synthetic Oligonucleotide; PRDM1 exon 4; Set A
agagaagacaggcauguaaaaggaagucag

SEQ ID NO: 25923 - RNA, 31 nt, Artificial Sequence
  Synthetic Oligonucleotide; PRDM1 exon 4; Set A
aagagaagacaggcauguaaaaggaagucag

SEQ ID NO: 25924 - RNA, 29 nt, Artificial Sequence
  Synthetic Oligonucleotide; PRDM1 exon 4; Set A
agagaagacaggcauguaaaaggaaguca

SEQ ID NO: 25925 - RNA, 33 nt, Artificial Sequence
  Synthetic Oligonucleotide; PRDM1 exon 4; Set A
aaagagaagacaggcauguaaaaggaagucaga

SEQ ID NO: 25926 - RNA, 30 nt, Artificial Sequence
  Synthetic Oligonucleotide; PRDM1 exon 4; Set A
aagagaagacaggcauguaaaaggaaguca

SEQ ID NO: 25927 - RNA, 34 nt, Artificial Sequence
  Synthetic Oligonucleotide; PRDM1 exon 4; Set A
aaaagagaagacaggcauguaaaaggaagucaga

SEQ ID NO: 25928 - RNA, 32 nt, Artificial Sequence
  Synthetic Oligonucleotide; PRDM1 exon 4; Set A
aaagagaagacaggcauguaaaaggaagucag

SEQ ID NO: 25929 - RNA, 33 nt, Artificial Sequence
  Synthetic Oligonucleotide; PRDM1 exon 4; Set C
aaaagagaagacaggcauguaaaaggaagucag

SEQ ID NO: 25930 - RNA, 31 nt, Artificial Sequence
  Synthetic Oligonucleotide; PRDM1 exon 4; Set A
aaagagaagacaggcauguaaaaggaaguca

SEQ ID NO: 25931 - RNA, 32 nt, Artificial Sequence
  Synthetic Oligonucleotide; PRDM1 exon 4; Set C
aaaagagaagacaggcauguaaaaggaaguca

SEQ ID NO: 25932 - RNA, 31 nt, Artificial Sequence
  Synthetic Oligonucleotide; PRDM1 exon 4; Set A
ucuguccaaaagagaagacaggcauguaaaa

SEQ ID NO: 25933 - RNA, 32 nt, Artificial Sequence
  Synthetic Oligonucleotide; PRDM1 exon 4; Set A
aucuguccaaaagagaagacaggcauguaaaa

SEQ ID NO: 25934 - RNA, 33 nt, Artificial Sequence
  Synthetic Oligonucleotide; PRDM1 exon 4; Set A
gaucuguccaaaagagaagacaggcauguaaaa

SEQ ID NO: 25935 - RNA, 34 nt, Artificial Sequence
  Synthetic Oligonucleotide; PRDM1 exon 4; Set A
agaucuguccaaaagagaagacaggcauguaaaa

SEQ ID NO: 25936 - RNA, 35 nt, Artificial Sequence
  Synthetic Oligonucleotide; PRDM1 exon 4; Set A
uagaucuguccaaaagagaagacaggcauguaaaa

SEQ ID NO: 25937 - RNA, 33 nt, Artificial Sequence
  Synthetic Oligonucleotide; PRDM1 exon 4; Set A
agaucuguccaaaagagaagacaggcauguaaa

SEQ ID NO: 25938 - RNA, 36 nt, Artificial Sequence
  Synthetic Oligonucleotide; PRDM1 exon 4; Set A
auagaucuguccaaaagagaagacaggcauguaaaa

SEQ ID NO: 25939 - RNA, 34 nt, Artificial Sequence
  Synthetic Oligonucleotide; PRDM1 exon 4; Set A
uagaucuguccaaaagagaagacaggcauguaaa

SEQ ID NO: 25940 - RNA, 35 nt, Artificial Sequence
  Synthetic Oligonucleotide; PRDM1 exon 4; Set A
auagaucuguccaaaagagaagacaggcauguaaa

SEQ ID NO: 25941 - RNA, 27 nt, Artificial Sequence
  Synthetic Oligonucleotide; PRDM1 exon 4; Set C
auagaucuguccaaaagagaagacagg

SEQ ID NO: 25942 - RNA, 19 nt, Artificial Sequence
  Synthetic Oligonucleotide; PRDM1 exon 4; Set C
uagaucuguccaaaagaga

SEQ ID NO: 25943 - RNA, 18 nt, Artificial Sequence
  Synthetic Oligonucleotide; PRDM1 exon 4; Set C
uagaucuguccaaaagag

SEQ ID NO: 25944 - RNA, 20 nt, Artificial Sequence
  Synthetic Oligonucleotide; PRDM1 exon 4; Set C
auagaucuguccaaaagaga

SEQ ID NO: 25945 - RNA, 17 nt, Artificial Sequence
  Synthetic Oligonucleotide; PRDM1 exon 4; Set C
uagaucuguccaaaaga

SEQ ID NO: 25946 - RNA, 19 nt, Artificial Sequence
  Synthetic Oligonucleotide; PRDM1 exon 4; Set C
auagaucuguccaaaagag

SEQ ID NO: 25947 - RNA, 16 nt, Artificial Sequence
  Synthetic Oligonucleotide; PRDM1 exon 4; Set C
uagaucuguccaaaag

SEQ ID NO: 25948 - RNA, 18 nt, Artificial Sequence
  Synthetic Oligonucleotide; PRDM1 exon 4; Set C
auagaucuguccaaaaga

SEQ ID NO: 25949 - RNA, 17 nt, Artificial Sequence
  Synthetic Oligonucleotide; PRDM1 exon 4; Set C
auagaucuguccaaaag

SEQ ID NO: 25950 - RNA, 15 nt, Artificial Sequence
  Synthetic Oligonucleotide; PRDM1 exon 4; Set C
uagaucuguccaaaa

SEQ ID NO: 25951 - RNA, 16 nt, Artificial Sequence
  Synthetic Oligonucleotide; PRDM1 exon 4; Set C
auagaucuguccaaaa

SEQ ID NO: 25952 - RNA, 15 nt, Artificial Sequence
  Synthetic Oligonucleotide; PRDM1 exon 4; Set C
auagaucuguccaaa

SEQ ID NO: 25953 - RNA, 25 nt, Artificial Sequence
  Synthetic Oligonucleotide; PRDM1 exon 4; Set A
gugaagcuccccucuggaauagauc

SEQ ID NO: 25954 - RNA, 24 nt, Artificial Sequence
  Synthetic Oligonucleotide; PRDM1 exon 4; Set A
gugaagcuccccucuggaauagau

SEQ ID NO: 25955 - RNA, 23 nt, Artificial Sequence
  Synthetic Oligonucleotide; PRDM1 exon 4; Set A
gugaagcuccccucuggaauaga

SEQ ID NO: 25956 - RNA, 22 nt, Artificial Sequence
  Synthetic Oligonucleotide; PRDM1 exon 4; Set A
gugaagcuccccucuggaauag

SEQ ID NO: 25957 - RNA, 23 nt, Artificial Sequence
  Synthetic Oligonucleotide; PRDM1 exon 4; Set A
ggugaagcuccccucuggaauag

SEQ ID NO: 25958 - RNA, 21 nt, Artificial Sequence
  Synthetic Oligonucleotide; PRDM1 exon 4; Set A
gugaagcuccccucuggaaua

SEQ ID NO: 25959 - RNA, 22 nt, Artificial Sequence
  Synthetic Oligonucleotide; PRDM1 exon 4; Set A
ggugaagcuccccucuggaaua

SEQ ID NO: 25960 - RNA, 40 nt, Artificial Sequence
  Synthetic Oligonucleotide; PRDM1 exon 4; Set C
ccgucaaugaaguggugaagcuccccucuggaauagaucu

SEQ ID NO: 25961 - RNA, 39 nt, Artificial Sequence
  Synthetic Oligonucleotide; PRDM1 exon 4; Set C
ccgucaaugaaguggugaagcuccccucuggaauagauc

SEQ ID NO: 25962 - RNA, 38 nt, Artificial Sequence
  Synthetic Oligonucleotide; PRDM1 exon 4; Set C
ccgucaaugaaguggugaagcuccccucuggaauagau

SEQ ID NO: 25963 - RNA, 40 nt, Artificial Sequence
  Synthetic Oligonucleotide; PRDM1 exon 4; Set C
gccgucaaugaaguggugaagcuccccucuggaauagauc

SEQ ID NO: 25964 - RNA, 37 nt, Artificial Sequence
  Synthetic Oligonucleotide; PRDM1 exon 4; Set C
ccgucaaugaaguggugaagcuccccucuggaauaga

SEQ ID NO: 25965 - RNA, 39 nt, Artificial Sequence
  Synthetic Oligonucleotide; PRDM1 exon 4; Set C
gccgucaaugaaguggugaagcuccccucuggaauagau

SEQ ID NO: 25966 - RNA, 36 nt, Artificial Sequence
  Synthetic Oligonucleotide; PRDM1 exon 4; Set C
ccgucaaugaaguggugaagcuccccucuggaauag

SEQ ID NO: 25967 - RNA, 38 nt, Artificial Sequence
  Synthetic Oligonucleotide; PRDM1 exon 4; Set C
gccgucaaugaaguggugaagcuccccucuggaauaga

SEQ ID NO: 25968 - RNA, 40 nt, Artificial Sequence
  Synthetic Oligonucleotide; PRDM1 exon 4; Set C
agccgucaaugaaguggugaagcuccccucuggaauagau

SEQ ID NO: 25969 - RNA, 37 nt, Artificial Sequence
  Synthetic Oligonucleotide; PRDM1 exon 4; Set C
gccgucaaugaaguggugaagcuccccucuggaauag

SEQ ID NO: 25970 - RNA, 39 nt, Artificial Sequence
  Synthetic Oligonucleotide; PRDM1 exon 4; Set C
agccgucaaugaaguggugaagcuccccucuggaauaga

SEQ ID NO: 25971 - RNA, 35 nt, Artificial Sequence
  Synthetic Oligonucleotide; PRDM1 exon 4; Set C
ccgucaaugaaguggugaagcuccccucuggaaua

SEQ ID NO: 25972 - RNA, 38 nt, Artificial Sequence
  Synthetic Oligonucleotide; PRDM1 exon 4; Set C
agccgucaaugaaguggugaagcuccccucuggaauag

SEQ ID NO: 25973 - RNA, 36 nt, Artificial Sequence
  Synthetic Oligonucleotide; PRDM1 exon 4; Set C
gccgucaaugaaguggugaagcuccccucuggaaua

SEQ ID NO: 25974 - RNA, 37 nt, Artificial Sequence
  Synthetic Oligonucleotide; PRDM1 exon 4; Set C
agccgucaaugaaguggugaagcuccccucuggaaua

SEQ ID NO: 25975 - RNA, 17 nt, Artificial Sequence
  Synthetic Oligonucleotide; PRDM1 exon 4; Set C
ccgucaaugaaguggug

SEQ ID NO: 25976 - RNA, 16 nt, Artificial Sequence
  Synthetic Oligonucleotide; PRDM1 exon 4; Set C
ccgucaaugaaguggu

SEQ ID NO: 25977 - RNA, 18 nt, Artificial Sequence
  Synthetic Oligonucleotide; PRDM1 exon 4; Set C
gccgucaaugaaguggug

SEQ ID NO: 25978 - RNA, 17 nt, Artificial Sequence
  Synthetic Oligonucleotide; PRDM1 exon 4; Set C
gccgucaaugaaguggu

SEQ ID NO: 25979 - RNA, 19 nt, Artificial Sequence
  Synthetic Oligonucleotide; PRDM1 exon 4; Set C
agccgucaaugaaguggug

SEQ ID NO: 25980 - RNA, 16 nt, Artificial Sequence
  Synthetic Oligonucleotide; PRDM1 exon 4; Set C
gccgucaaugaagugg

SEQ ID NO: 25981 - RNA, 18 nt, Artificial Sequence
  Synthetic Oligonucleotide; PRDM1 exon 4; Set C
agccgucaaugaaguggu

SEQ ID NO: 25982 - RNA, 17 nt, Artificial Sequence
  Synthetic Oligonucleotide; PRDM1 exon 4; Set C
agccgucaaugaagugg

SEQ ID NO: 25983 - RNA, 31 nt, Artificial Sequence
  Synthetic Oligonucleotide; PRDM1 exon 4; Set A
ucucuucauuaaagccgucaaugaaguggug

SEQ ID NO: 25984 - RNA, 30 nt, Artificial Sequence
  Synthetic Oligonucleotide; PRDM1 exon 4; Set A
ucucuucauuaaagccgucaaugaaguggu

SEQ ID NO: 25985 - RNA, 32 nt, Artificial Sequence
  Synthetic Oligonucleotide; PRDM1 exon 4; Set A
uucucuucauuaaagccgucaaugaaguggug

SEQ ID NO: 25986 - RNA, 29 nt, Artificial Sequence
  Synthetic Oligonucleotide; PRDM1 exon 4; Set A
ucucuucauuaaagccgucaaugaagugg

SEQ ID NO: 25987 - RNA, 31 nt, Artificial Sequence
  Synthetic Oligonucleotide; PRDM1 exon 4; Set A
uucucuucauuaaagccgucaaugaaguggu

SEQ ID NO: 25988 - RNA, 30 nt, Artificial Sequence
  Synthetic Oligonucleotide; PRDM1 exon 4; Set A
uucucuucauuaaagccgucaaugaagugg

SEQ ID NO: 25989 - RNA, 39 nt, Artificial Sequence
  Synthetic Oligonucleotide; PRDM1 exon 4; Set C
guugcuuuucucuucauuaaagccgucaaugaaguggug

SEQ ID NO: 25990 - RNA, 38 nt, Artificial Sequence
  Synthetic Oligonucleotide; PRDM1 exon 4; Set C
guugcuuuucucuucauuaaagccgucaaugaaguggu

SEQ ID NO: 25991 - RNA, 40 nt, Artificial Sequence
  Synthetic Oligonucleotide; PRDM1 exon 4; Set C
aguugcuuuucucuucauuaaagccgucaaugaaguggug

SEQ ID NO: 25992 - RNA, 37 nt, Artificial Sequence
  Synthetic Oligonucleotide; PRDM1 exon 4; Set A
guugcuuuucucuucauuaaagccgucaaugaagugg

SEQ ID NO: 25993 - RNA, 39 nt, Artificial Sequence
  Synthetic Oligonucleotide; PRDM1 exon 4; Set C
aguugcuuuucucuucauuaaagccgucaaugaaguggu

SEQ ID NO: 25994 - RNA, 38 nt, Artificial Sequence
  Synthetic Oligonucleotide; PRDM1 exon 4; Set A
aguugcuuuucucuucauuaaagccgucaaugaagugg

SEQ ID NO: 25995 - RNA, 15 nt, Artificial Sequence
  Synthetic Oligonucleotide; PRDM1 exon 4; Set C
ucucuucauuaaagc

SEQ ID NO: 25996 - RNA, 25 nt, Artificial Sequence
  Synthetic Oligonucleotide; PRDM1 exon 4; Set C
aguugcuuuucucuucauuaaagcc

SEQ ID NO: 25997 - RNA, 24 nt, Artificial Sequence
  Synthetic Oligonucleotide; PRDM1 exon 4; Set C
aguugcuuuucucuucauuaaagc

SEQ ID NO: 25998 - RNA, 23 nt, Artificial Sequence
  Synthetic Oligonucleotide; PRDM1 exon 4; Set A
auagcgcauccaguugcuuuucu

SEQ ID NO: 25999 - RNA, 39 nt, Artificial Sequence
  Synthetic Oligonucleotide; PRDM1 exon 4; Set C
agugugcuggauucacauagcgcauccaguugcuuuucu

SEQ ID NO: 26000 - RNA, 38 nt, Artificial Sequence
  Synthetic Oligonucleotide; PRDM1 exon 4; Set C
agugugcuggauucacauagcgcauccaguugcuuuuc

SEQ ID NO: 26001 - RNA, 37 nt, Artificial Sequence
  Synthetic Oligonucleotide; PRDM1 exon 4; Set C
ggggagagugugcuggauucacauagcgcauccaguu

SEQ ID NO: 26002 - RNA, 37 nt, Artificial Sequence
  Synthetic Oligonucleotide; PRDM1 exon 4; Set C
gguuuugcucccggggagagugugcuggauucacaua

SEQ ID NO: 26003 - RNA, 38 nt, Artificial Sequence
  Synthetic Oligonucleotide; PRDM1 exon 4; Set C
agguuuugcucccggggagagugugcuggauucacaua

SEQ ID NO: 26004 - RNA, 18 nt, Artificial Sequence
  Synthetic Oligonucleotide; PRDM1 exon 4; Set A
gcucccggggagagugug

SEQ ID NO: 26005 - RNA, 17 nt, Artificial Sequence
  Synthetic Oligonucleotide; PRDM1 exon 4; Set A
gcucccggggagagugu

SEQ ID NO: 26006 - RNA, 19 nt, Artificial Sequence
  Synthetic Oligonucleotide; PRDM1 exon 4; Set A
ugcucccggggagagugug

SEQ ID NO: 26007 - RNA, 18 nt, Artificial Sequence
  Synthetic Oligonucleotide; PRDM1 exon 4; Set A
ugcucccggggagagugu

SEQ ID NO: 26008 - RNA, 16 nt, Artificial Sequence
  Synthetic Oligonucleotide; PRDM1 exon 4; Set A
gcucccggggagagug

SEQ ID NO: 26009 - RNA, 20 nt, Artificial Sequence
  Synthetic Oligonucleotide; PRDM1 exon 4; Set A
uugcucccggggagagugug

SEQ ID NO: 26010 - RNA, 19 nt, Artificial Sequence
  Synthetic Oligonucleotide; PRDM1 exon 4; Set A
uugcucccggggagagugu

SEQ ID NO: 26011 - RNA, 17 nt, Artificial Sequence
  Synthetic Oligonucleotide; PRDM1 exon 4; Set A
ugcucccggggagagug

SEQ ID NO: 26012 - RNA, 21 nt, Artificial Sequence
  Synthetic Oligonucleotide; PRDM1 exon 4; Set A
uuugcucccggggagagugug

SEQ ID NO: 26013 - RNA, 20 nt, Artificial Sequence
  Synthetic Oligonucleotide; PRDM1 exon 4; Set A
uuugcucccggggagagugu

SEQ ID NO: 26014 - RNA, 18 nt, Artificial Sequence
  Synthetic Oligonucleotide; PRDM1 exon 4; Set A
uugcucccggggagagug

SEQ ID NO: 26015 - RNA, 22 nt, Artificial Sequence
  Synthetic Oligonucleotide; PRDM1 exon 4; Set A
uuuugcucccggggagagugug

SEQ ID NO: 26016 - RNA, 21 nt, Artificial Sequence
  Synthetic Oligonucleotide; PRDM1 exon 4; Set A
uuuugcucccggggagagugu

SEQ ID NO: 26017 - RNA, 19 nt, Artificial Sequence
  Synthetic Oligonucleotide; PRDM1 exon 4; Set A
uuugcucccggggagagug

SEQ ID NO: 26018 - RNA, 23 nt, Artificial Sequence
  Synthetic Oligonucleotide; PRDM1 exon 4; Set A
guuuugcucccggggagagugug

SEQ ID NO: 26019 - RNA, 22 nt, Artificial Sequence
  Synthetic Oligonucleotide; PRDM1 exon 4; Set A
guuuugcucccggggagagugu

SEQ ID NO: 26020 - RNA, 20 nt, Artificial Sequence
  Synthetic Oligonucleotide; PRDM1 exon 4; Set A
uuuugcucccggggagagug

SEQ ID NO: 26021 - RNA, 21 nt, Artificial Sequence
  Synthetic Oligonucleotide; PRDM1 exon 4; Set A
guuuugcucccggggagagug

SEQ ID NO: 26022 - RNA, 25 nt, Artificial Sequence
  Synthetic Oligonucleotide; PRDM1 exon 4; Set C
cagguuuugcucccggggagagugu

SEQ ID NO: 26023 - RNA, 23 nt, Artificial Sequence
  Synthetic Oligonucleotide; PRDM1 exon 4; Set C
cagguuuugcucccggggagagu

SEQ ID NO: 26024 - RNA, 31 nt, Artificial Sequence
  Synthetic Oligonucleotide; PRDM1 exon 4; Set C
gcagccagguuuugcucccggggagagugug

SEQ ID NO: 26025 - RNA, 30 nt, Artificial Sequence
  Synthetic Oligonucleotide; PRDM1 exon 4; Set C
gcagccagguuuugcucccggggagagugu

SEQ ID NO: 26026 - RNA, 29 nt, Artificial Sequence
  Synthetic Oligonucleotide; PRDM1 exon 4; Set C
gcagccagguuuugcucccggggagagug

SEQ ID NO: 26027 - RNA, 16 nt, Artificial Sequence
  Synthetic Oligonucleotide; PRDM1 exon 4; Set C
cagguuuugcucccgg

SEQ ID NO: 26028 - RNA, 21 nt, Artificial Sequence
  Synthetic Oligonucleotide; PRDM1 exon 4; Set C
gcagccagguuuugcucccgg

SEQ ID NO: 26029 - RNA, 24 nt, Artificial Sequence
  Synthetic Oligonucleotide; PRDM1 exon 4; Set C
acgcagccagguuuugcucccggg

SEQ ID NO: 26030 - RNA, 40 nt, Artificial Sequence
  Synthetic Oligonucleotide; PRDM1 exon 4; Set C
guucugacacgcagccagguuuugcucccggggagagugu

SEQ ID NO: 26031 - RNA, 39 nt, Artificial Sequence
  Synthetic Oligonucleotide; PRDM1 exon 4; Set C
guucugacacgcagccagguuuugcucccggggagagug

SEQ ID NO: 26032 - RNA, 19 nt, Artificial Sequence
  Synthetic Oligonucleotide; PRDM1 exon 4; Set A
gcagccagguuuugcuccc

SEQ ID NO: 26033 - RNA, 21 nt, Artificial Sequence
  Synthetic Oligonucleotide; PRDM1 exon 4; Set C
cgcagccagguuuugcucccg

SEQ ID NO: 26034 - RNA, 40 nt, Artificial Sequence
  Synthetic Oligonucleotide; PRDM1 exon 4; Set C
cguucugacacgcagccagguuuugcucccggggagagug

SEQ ID NO: 26035 - RNA, 20 nt, Artificial Sequence
  Synthetic Oligonucleotide; PRDM1 exon 4; Set A
cgcagccagguuuugcuccc

SEQ ID NO: 26036 - RNA, 18 nt, Artificial Sequence
  Synthetic Oligonucleotide; PRDM1 exon 4; Set A
gcagccagguuuugcucc

SEQ ID NO: 26037 - RNA, 19 nt, Artificial Sequence
  Synthetic Oligonucleotide; PRDM1 exon 4; Set A
cgcagccagguuuugcucc

SEQ ID NO: 26038 - RNA, 17 nt, Artificial Sequence
  Synthetic Oligonucleotide; PRDM1 exon 4; Set C
gcagccagguuuugcuc

SEQ ID NO: 26039 - RNA, 16 nt, Artificial Sequence
  Synthetic Oligonucleotide; PRDM1 exon 4; Set C
gcagccagguuuugcu

SEQ ID NO: 26040 - RNA, 18 nt, Artificial Sequence
  Synthetic Oligonucleotide; PRDM1 exon 4; Set A
cgcagccagguuuugcuc

SEQ ID NO: 26041 - RNA, 15 nt, Artificial Sequence
  Synthetic Oligonucleotide; PRDM1 exon 4; Set C
gcagccagguuuugc

SEQ ID NO: 26042 - RNA, 31 nt, Artificial Sequence
  Synthetic Oligonucleotide; PRDM1 exon 4; Set C
guucugacacgcagccagguuuugcucccgg

SEQ ID NO: 26043 - RNA, 32 nt, Artificial Sequence
  Synthetic Oligonucleotide; PRDM1 exon 4; Set C
cguucugacacgcagccagguuuugcucccgg

SEQ ID NO: 26044 - RNA, 26 nt, Artificial Sequence
  Synthetic Oligonucleotide; PRDM1 exon 4; Set C
guucugacacgcagccagguuuugcu

SEQ ID NO: 26045 - RNA, 25 nt, Artificial Sequence
  Synthetic Oligonucleotide; PRDM1 exon 4; Set C
guucugacacgcagccagguuuugc

SEQ ID NO: 26046 - RNA, 27 nt, Artificial Sequence
  Synthetic Oligonucleotide; PRDM1 exon 4; Set C
cguucugacacgcagccagguuuugcu

SEQ ID NO: 26047 - RNA, 24 nt, Artificial Sequence
  Synthetic Oligonucleotide; PRDM1 exon 4; Set A
guucugacacgcagccagguuuug

SEQ ID NO: 26048 - RNA, 26 nt, Artificial Sequence
  Synthetic Oligonucleotide; PRDM1 exon 4; Set C
cguucugacacgcagccagguuuugc

SEQ ID NO: 26049 - RNA, 25 nt, Artificial Sequence
  Synthetic Oligonucleotide; PRDM1 exon 4; Set C
cguucugacacgcagccagguuuug

SEQ ID NO: 26050 - RNA, 23 nt, Artificial Sequence
  Synthetic Oligonucleotide; PRDM1 exon 4; Set A
guucugacacgcagccagguuuu

SEQ ID NO: 26051 - RNA, 22 nt, Artificial Sequence
  Synthetic Oligonucleotide; PRDM1 exon 4; Set A
guucugacacgcagccagguuu

SEQ ID NO: 26052 - RNA, 24 nt, Artificial Sequence
  Synthetic Oligonucleotide; PRDM1 exon 4; Set C
cguucugacacgcagccagguuuu

SEQ ID NO: 26053 - RNA, 38 nt, Artificial Sequence
  Synthetic Oligonucleotide; PRDM1 exon 4; Set C
uucaucccguucugacacgcagccagguuuugcucccg

SEQ ID NO: 26054 - RNA, 21 nt, Artificial Sequence
  Synthetic Oligonucleotide; PRDM1 exon 4; Set A
guucugacacgcagccagguu

SEQ ID NO: 26055 - RNA, 23 nt, Artificial Sequence
  Synthetic Oligonucleotide; PRDM1 exon 4; Set C
cguucugacacgcagccagguuu

SEQ ID NO: 26056 - RNA, 37 nt, Artificial Sequence
  Synthetic Oligonucleotide; PRDM1 exon 4; Set C
uucaucccguucugacacgcagccagguuuugcuccc

SEQ ID NO: 26057 - RNA, 39 nt, Artificial Sequence
  Synthetic Oligonucleotide; PRDM1 exon 4; Set C
guucaucccguucugacacgcagccagguuuugcucccg

SEQ ID NO: 26058 - RNA, 22 nt, Artificial Sequence
  Synthetic Oligonucleotide; PRDM1 exon 4; Set C
cguucugacacgcagccagguu

SEQ ID NO: 26059 - RNA, 38 nt, Artificial Sequence
  Synthetic Oligonucleotide; PRDM1 exon 4; Set C
guucaucccguucugacacgcagccagguuuugcuccc

SEQ ID NO: 26060 - RNA, 36 nt, Artificial Sequence
  Synthetic Oligonucleotide; PRDM1 exon 4; Set C
uucaucccguucugacacgcagccagguuuugcucc

SEQ ID NO: 26061 - RNA, 19 nt, Artificial Sequence
  Synthetic Oligonucleotide; PRDM1 exon 4; Set A
guucugacacgcagccagg

SEQ ID NO: 26062 - RNA, 37 nt, Artificial Sequence
  Synthetic Oligonucleotide; PRDM1 exon 4; Set C
guucaucccguucugacacgcagccagguuuugcucc

SEQ ID NO: 26063 - RNA, 35 nt, Artificial Sequence
  Synthetic Oligonucleotide; PRDM1 exon 4; Set C
uucaucccguucugacacgcagccagguuuugcuc

SEQ ID NO: 26064 - RNA, 34 nt, Artificial Sequence
  Synthetic Oligonucleotide; PRDM1 exon 4; Set C
uucaucccguucugacacgcagccagguuuugcu

SEQ ID NO: 26065 - RNA, 40 nt, Artificial Sequence
  Synthetic Oligonucleotide; PRDM1 exon 4; Set C
auguucaucccguucugacacgcagccagguuuugcuccc

SEQ ID NO: 26066 - RNA, 36 nt, Artificial Sequence
  Synthetic Oligonucleotide; PRDM1 exon 4; Set C
guucaucccguucugacacgcagccagguuuugcuc

SEQ ID NO: 26067 - RNA, 33 nt, Artificial Sequence
  Synthetic Oligonucleotide; PRDM1 exon 4; Set C
uucaucccguucugacacgcagccagguuuugc

SEQ ID NO: 26068 - RNA, 36 nt, Artificial Sequence
  Synthetic Oligonucleotide; PRDM1 exon 4; Set C
uguucaucccguucugacacgcagccagguuuugcu

SEQ ID NO: 26069 - RNA, 31 nt, Artificial Sequence
  Synthetic Oligonucleotide; PRDM1 exon 4; Set C
uucaucccguucugacacgcagccagguuuu

SEQ ID NO: 26070 - RNA, 35 nt, Artificial Sequence
  Synthetic Oligonucleotide; PRDM1 exon 4; Set C
uguucaucccguucugacacgcagccagguuuugc

SEQ ID NO: 26071 - RNA, 37 nt, Artificial Sequence
  Synthetic Oligonucleotide; PRDM1 exon 4; Set C
auguucaucccguucugacacgcagccagguuuugcu

SEQ ID NO: 26072 - RNA, 30 nt, Artificial Sequence
  Synthetic Oligonucleotide; PRDM1 exon 4; Set C
uucaucccguucugacacgcagccagguuu

SEQ ID NO: 26073 - RNA, 34 nt, Artificial Sequence
  Synthetic Oligonucleotide; PRDM1 exon 4; Set C
uguucaucccguucugacacgcagccagguuuug

SEQ ID NO: 26074 - RNA, 36 nt, Artificial Sequence
  Synthetic Oligonucleotide; PRDM1 exon 4; Set C
auguucaucccguucugacacgcagccagguuuugc

SEQ ID NO: 26075 - RNA, 38 nt, Artificial Sequence
  Synthetic Oligonucleotide; PRDM1 exon 4; Set C
gauguucaucccguucugacacgcagccagguuuugcu

SEQ ID NO: 26076 - RNA, 40 nt, Artificial Sequence
  Synthetic Oligonucleotide; PRDM1 exon 4; Set C
agauguucaucccguucugacacgcagccagguuuugcuc

SEQ ID NO: 26077 - RNA, 29 nt, Artificial Sequence
  Synthetic Oligonucleotide; PRDM1 exon 4; Set C
uucaucccguucugacacgcagccagguu

SEQ ID NO: 26078 - RNA, 35 nt, Artificial Sequence
  Synthetic Oligonucleotide; PRDM1 exon 4; Set C
auguucaucccguucugacacgcagccagguuuug

SEQ ID NO: 26079 - RNA, 33 nt, Artificial Sequence
  Synthetic Oligonucleotide; PRDM1 exon 4; Set C
uguucaucccguucugacacgcagccagguuuu

SEQ ID NO: 26080 - RNA, 37 nt, Artificial Sequence
  Synthetic Oligonucleotide; PRDM1 exon 4; Set C
gauguucaucccguucugacacgcagccagguuuugc

SEQ ID NO: 26081 - RNA, 39 nt, Artificial Sequence
  Synthetic Oligonucleotide; PRDM1 exon 4; Set C
agauguucaucccguucugacacgcagccagguuuugcu

SEQ ID NO: 26082 - RNA, 30 nt, Artificial Sequence
  Synthetic Oligonucleotide; PRDM1 exon 4; Set C
guucaucccguucugacacgcagccagguu

SEQ ID NO: 26083 - RNA, 32 nt, Artificial Sequence
  Synthetic Oligonucleotide; PRDM1 exon 4; Set C
uguucaucccguucugacacgcagccagguuu

SEQ ID NO: 26084 - RNA, 36 nt, Artificial Sequence
  Synthetic Oligonucleotide; PRDM1 exon 4; Set C
gauguucaucccguucugacacgcagccagguuuug

SEQ ID NO: 26085 - RNA, 34 nt, Artificial Sequence
  Synthetic Oligonucleotide; PRDM1 exon 4; Set C
auguucaucccguucugacacgcagccagguuuu

SEQ ID NO: 26086 - RNA, 38 nt, Artificial Sequence
  Synthetic Oligonucleotide; PRDM1 exon 4; Set C
agauguucaucccguucugacacgcagccagguuuugc

SEQ ID NO: 26087 - RNA, 40 nt, Artificial Sequence
  Synthetic Oligonucleotide; PRDM1 exon 4; Set C
uagauguucaucccguucugacacgcagccagguuuugcu

SEQ ID NO: 26088 - RNA, 31 nt, Artificial Sequence
  Synthetic Oligonucleotide; PRDM1 exon 4; Set C
uguucaucccguucugacacgcagccagguu

SEQ ID NO: 26089 - RNA, 33 nt, Artificial Sequence
  Synthetic Oligonucleotide; PRDM1 exon 4; Set C
auguucaucccguucugacacgcagccagguuu

SEQ ID NO: 26090 - RNA, 37 nt, Artificial Sequence
  Synthetic Oligonucleotide; PRDM1 exon 4; Set C
agauguucaucccguucugacacgcagccagguuuug

SEQ ID NO: 26091 - RNA, 35 nt, Artificial Sequence
  Synthetic Oligonucleotide; PRDM1 exon 4; Set C
gauguucaucccguucugacacgcagccagguuuu

SEQ ID NO: 26092 - RNA, 39 nt, Artificial Sequence
  Synthetic Oligonucleotide; PRDM1 exon 4; Set C
uagauguucaucccguucugacacgcagccagguuuugc

SEQ ID NO: 26093 - RNA, 32 nt, Artificial Sequence
  Synthetic Oligonucleotide; PRDM1 exon 4; Set C
auguucaucccguucugacacgcagccagguu

SEQ ID NO: 26094 - RNA, 34 nt, Artificial Sequence
  Synthetic Oligonucleotide; PRDM1 exon 4; Set C
gauguucaucccguucugacacgcagccagguuu

SEQ ID NO: 26095 - RNA, 38 nt, Artificial Sequence
  Synthetic Oligonucleotide; PRDM1 exon 4; Set C
uagauguucaucccguucugacacgcagccagguuuug

SEQ ID NO: 26096 - RNA, 36 nt, Artificial Sequence
  Synthetic Oligonucleotide; PRDM1 exon 4; Set C
agauguucaucccguucugacacgcagccagguuuu

SEQ ID NO: 26097 - RNA, 40 nt, Artificial Sequence
  Synthetic Oligonucleotide; PRDM1 exon 4; Set C
guagauguucaucccguucugacacgcagccagguuuugc

SEQ ID NO: 26098 - RNA, 33 nt, Artificial Sequence
  Synthetic Oligonucleotide; PRDM1 exon 4; Set C
gauguucaucccguucugacacgcagccagguu

SEQ ID NO: 26099 - RNA, 35 nt, Artificial Sequence
  Synthetic Oligonucleotide; PRDM1 exon 4; Set C
agauguucaucccguucugacacgcagccagguuu

SEQ ID NO: 26100 - RNA, 39 nt, Artificial Sequence
  Synthetic Oligonucleotide; PRDM1 exon 4; Set C
guagauguucaucccguucugacacgcagccagguuuug

SEQ ID NO: 26101 - RNA, 37 nt, Artificial Sequence
  Synthetic Oligonucleotide; PRDM1 exon 4; Set C
uagauguucaucccguucugacacgcagccagguuuu

SEQ ID NO: 26102 - RNA, 34 nt, Artificial Sequence
  Synthetic Oligonucleotide; PRDM1 exon 4; Set C
agauguucaucccguucugacacgcagccagguu

SEQ ID NO: 26103 - RNA, 36 nt, Artificial Sequence
  Synthetic Oligonucleotide; PRDM1 exon 4; Set C
uagauguucaucccguucugacacgcagccagguuu

SEQ ID NO: 26104 - RNA, 38 nt, Artificial Sequence
  Synthetic Oligonucleotide; PRDM1 exon 4; Set C
guagauguucaucccguucugacacgcagccagguuuu

SEQ ID NO: 26105 - RNA, 35 nt, Artificial Sequence
  Synthetic Oligonucleotide; PRDM1 exon 4; Set C
uagauguucaucccguucugacacgcagccagguu

SEQ ID NO: 26106 - RNA, 37 nt, Artificial Sequence
  Synthetic Oligonucleotide; PRDM1 exon 4; Set C
guagauguucaucccguucugacacgcagccagguuu

SEQ ID NO: 26107 - RNA, 36 nt, Artificial Sequence
  Synthetic Oligonucleotide; PRDM1 exon 4; Set C
guagauguucaucccguucugacacgcagccagguu

SEQ ID NO: 26108 - RNA, 21 nt, Artificial Sequence
  Synthetic Oligonucleotide; PRDM1 exon 4; Set A
uucaucccguucugacacgca

SEQ ID NO: 26109 - RNA, 20 nt, Artificial Sequence
  Synthetic Oligonucleotide; PRDM1 exon 4; Set A
uucaucccguucugacacgc

SEQ ID NO: 26110 - RNA, 22 nt, Artificial Sequence
  Synthetic Oligonucleotide; PRDM1 exon 4; Set C
guucaucccguucugacacgca

SEQ ID NO: 26111 - RNA, 23 nt, Artificial Sequence
  Synthetic Oligonucleotide; PRDM1 exon 4; Set C
uguucaucccguucugacacgca

SEQ ID NO: 26112 - RNA, 22 nt, Artificial Sequence
  Synthetic Oligonucleotide; PRDM1 exon 4; Set A
uguucaucccguucugacacgc

SEQ ID NO: 26113 - RNA, 24 nt, Artificial Sequence
  Synthetic Oligonucleotide; PRDM1 exon 4; Set C
auguucaucccguucugacacgca

SEQ ID NO: 26114 - RNA, 23 nt, Artificial Sequence
  Synthetic Oligonucleotide; PRDM1 exon 4; Set A
auguucaucccguucugacacgc

SEQ ID NO: 26115 - RNA, 25 nt, Artificial Sequence
  Synthetic Oligonucleotide; PRDM1 exon 4; Set C
gauguucaucccguucugacacgca

SEQ ID NO: 26116 - RNA, 24 nt, Artificial Sequence
  Synthetic Oligonucleotide; PRDM1 exon 4; Set A
gauguucaucccguucugacacgc

SEQ ID NO: 26117 - RNA, 26 nt, Artificial Sequence
  Synthetic Oligonucleotide; PRDM1 exon 4; Set C
agauguucaucccguucugacacgca

SEQ ID NO: 26118 - RNA, 25 nt, Artificial Sequence
  Synthetic Oligonucleotide; PRDM1 exon 4; Set A
agauguucaucccguucugacacgc

SEQ ID NO: 26119 - RNA, 27 nt, Artificial Sequence
  Synthetic Oligonucleotide; PRDM1 exon 4; Set C
uagauguucaucccguucugacacgca

SEQ ID NO: 26120 - RNA, 26 nt, Artificial Sequence
  Synthetic Oligonucleotide; PRDM1 exon 4; Set A
uagauguucaucccguucugacacgc

SEQ ID NO: 26121 - RNA, 28 nt, Artificial Sequence
  Synthetic Oligonucleotide; PRDM1 exon 4; Set C
guagauguucaucccguucugacacgca

SEQ ID NO: 26122 - RNA, 27 nt, Artificial Sequence
  Synthetic Oligonucleotide; PRDM1 exon 4; Set C
guagauguucaucccguucugacacgc

SEQ ID NO: 26123 - RNA, 39 nt, Artificial Sequence
  Synthetic Oligonucleotide; PRDM1 exon 4; Set C
augguguagaaguagauguucaucccguucugacacgca

SEQ ID NO: 26124 - RNA, 40 nt, Artificial Sequence
  Synthetic Oligonucleotide; PRDM1 exon 4; Set C
aaugguguagaaguagauguucaucccguucugacacgca

SEQ ID NO: 26125 - RNA, 16 nt, Artificial Sequence
  Synthetic Oligonucleotide; PRDM1 exon 4; Set C
augguguagaaguaga

SEQ ID NO: 26126 - RNA, 15 nt, Artificial Sequence
  Synthetic Oligonucleotide; PRDM1 exon 4; Set C
augguguagaaguag

SEQ ID NO: 26127 - RNA, 16 nt, Artificial Sequence
  Synthetic Oligonucleotide; PRDM1 exon 4; Set C
aaugguguagaaguag

SEQ ID NO: 26128 - RNA, 15 nt, Artificial Sequence
  Synthetic Oligonucleotide; PRDM1 exon 4; Set C
aaugguguagaagua

SEQ ID NO: 26129 - RNA, 16 nt, Artificial Sequence
  Synthetic Oligonucleotide; PRDM1 exon 4; Set C
uaaugguguagaagua

SEQ ID NO: 26130 - RNA, 15 nt, Artificial Sequence
  Synthetic Oligonucleotide; PRDM1 exon 4; Set C
gggaugggcuuaaug

SEQ ID NO: 26131 - RNA, 40 nt, Artificial Sequence
  Synthetic Oligonucleotide; PRDM1 exon 4; Set C
guuccugguuggcagggaugggcuuaaugguguagaagua

SEQ ID NO: 26132 - RNA, 28 nt, Artificial Sequence
  Synthetic Oligonucleotide; PRDM1 exon 4; Set C
guuccugguuggcagggaugggcuuaau

SEQ ID NO: 26133 - RNA, 27 nt, Artificial Sequence
  Synthetic Oligonucleotide; PRDM1 exon 4; Set C
guuccugguuggcagggaugggcuuaa

SEQ ID NO: 26134 - RNA, 28 nt, Artificial Sequence
  Synthetic Oligonucleotide; PRDM1 exon 4; Set C
aguuccugguuggcagggaugggcuuaa

SEQ ID NO: 26135 - RNA, 17 nt, Artificial Sequence
  Synthetic Oligonucleotide; PRDM1 exon 4; Set C
caauaccacacaagaag

SEQ ID NO: 26136 - RNA, 32 nt, Artificial Sequence
  Synthetic Oligonucleotide; PRDM1 exon 4; Set C
cugcaaagucccgacaauaccacacaagaagu

SEQ ID NO: 26137 - RNA, 31 nt, Artificial Sequence
  Synthetic Oligonucleotide; PRDM1 exon 4; Set A
cugcaaagucccgacaauaccacacaagaag

SEQ ID NO: 26138 - RNA, 40 nt, Artificial Sequence
  Synthetic Oligonucleotide; PRDM1 exon 4; Set C
aagccuuucugcaaagucccgacaauaccacacaagaagu

SEQ ID NO: 26139 - RNA, 39 nt, Artificial Sequence
  Synthetic Oligonucleotide; PRDM1 exon 4; Set C
aagccuuucugcaaagucccgacaauaccacacaagaag

SEQ ID NO: 26140 - RNA, 40 nt, Artificial Sequence
  Synthetic Oligonucleotide; PRDM1 exon 4; Set C
gaagccuuucugcaaagucccgacaauaccacacaagaag

SEQ ID NO: 26141 - RNA, 20 nt, Artificial Sequence
  Synthetic Oligonucleotide; PRDM1 exon 4; Set C
agugaagccuuucugcaaag

SEQ ID NO: 26142 - RNA, 19 nt, Artificial Sequence
  Synthetic Oligonucleotide; PRDM1 exon 4; Set C
agugaagccuuucugcaaa

SEQ ID NO: 26143 - RNA, 21 nt, Artificial Sequence
  Synthetic Oligonucleotide; PRDM1 exon 4; Set C
uagugaagccuuucugcaaag

SEQ ID NO: 26144 - RNA, 20 nt, Artificial Sequence
  Synthetic Oligonucleotide; PRDM1 exon 4; Set C
uagugaagccuuucugcaaa

SEQ ID NO: 26145 - RNA, 22 nt, Artificial Sequence
  Synthetic Oligonucleotide; PRDM1 exon 4; Set C
guagugaagccuuucugcaaag

SEQ ID NO: 26146 - RNA, 21 nt, Artificial Sequence
  Synthetic Oligonucleotide; PRDM1 exon 4; Set C
guagugaagccuuucugcaaa

SEQ ID NO: 26147 - RNA, 20 nt, Artificial Sequence
  Synthetic Oligonucleotide; PRDM1 exon 4; Set C
aaggguagugaagccuuucu

SEQ ID NO: 26148 - RNA, 21 nt, Artificial Sequence
  Synthetic Oligonucleotide; PRDM1 exon 4; Set C
uaaggguagugaagccuuucu

SEQ ID NO: 26149 - RNA, 37 nt, Artificial Sequence
  Synthetic Oligonucleotide; PRDM1 exon 4; Set C
ugucagcucuccgggauaaggguagugaagccuuucu

SEQ ID NO: 26150 - RNA, 38 nt, Artificial Sequence
  Synthetic Oligonucleotide; PRDM1 exon 4; Set C
uugucagcucuccgggauaaggguagugaagccuuucu

SEQ ID NO: 26151 - RNA, 40 nt, Artificial Sequence
  Synthetic Oligonucleotide; PRDM1 exon 4; Set C
auugucagcucuccgggauaaggguagugaagccuuucug

SEQ ID NO: 26152 - RNA, 39 nt, Artificial Sequence
  Synthetic Oligonucleotide; PRDM1 exon 4; Set C
auugucagcucuccgggauaaggguagugaagccuuucu

SEQ ID NO: 26153 - RNA, 32 nt, Artificial Sequence
  Synthetic Oligonucleotide; PRDM1 exon 4; Set C
auugucagcucuccgggauaaggguagugaag

SEQ ID NO: 26154 - RNA, 33 nt, Artificial Sequence
  Synthetic Oligonucleotide; PRDM1 exon 4; Set C
cauugucagcucuccgggauaaggguagugaag

SEQ ID NO: 26155 - RNA, 34 nt, Artificial Sequence
  Synthetic Oligonucleotide; PRDM1 exon 4; Set C
ucauugucagcucuccgggauaaggguagugaag

SEQ ID NO: 26156 - RNA, 32 nt, Artificial Sequence
  Synthetic Oligonucleotide; PRDM1 exon 4; Set C
cauugucagcucuccgggauaaggguagugaa

SEQ ID NO: 26157 - RNA, 27 nt, Artificial Sequence
  Synthetic Oligonucleotide; PRDM1 exon 4; Set C
uugucagcucuccgggauaaggguagu

SEQ ID NO: 26158 - RNA, 33 nt, Artificial Sequence
  Synthetic Oligonucleotide; PRDM1 exon 4; Set C
ucauugucagcucuccgggauaaggguagugaa

SEQ ID NO: 26159 - RNA, 35 nt, Artificial Sequence
  Synthetic Oligonucleotide; PRDM1 exon 4; Set C
aucauugucagcucuccgggauaaggguagugaag

SEQ ID NO: 26160 - RNA, 31 nt, Artificial Sequence
  Synthetic Oligonucleotide; PRDM1 exon 4; Set C
cauugucagcucuccgggauaaggguaguga

SEQ ID NO: 26161 - RNA, 26 nt, Artificial Sequence
  Synthetic Oligonucleotide; PRDM1 exon 4; Set B
uugucagcucuccgggauaaggguag

SEQ ID NO: 26162 - RNA, 28 nt, Artificial Sequence
  Synthetic Oligonucleotide; PRDM1 exon 4; Set C
auugucagcucuccgggauaaggguagu

SEQ ID NO: 26163 - RNA, 30 nt, Artificial Sequence
  Synthetic Oligonucleotide; PRDM1 exon 4; Set C
cauugucagcucuccgggauaaggguagug

SEQ ID NO: 26164 - RNA, 34 nt, Artificial Sequence
  Synthetic Oligonucleotide; PRDM1 exon 4; Set C
aucauugucagcucuccgggauaaggguagugaa

SEQ ID NO: 26165 - RNA, 32 nt, Artificial Sequence
  Synthetic Oligonucleotide; PRDM1 exon 4; Set C
ucauugucagcucuccgggauaaggguaguga

SEQ ID NO: 26166 - RNA, 27 nt, Artificial Sequence
  Synthetic Oligonucleotide; PRDM1 exon 4; Set B
auugucagcucuccgggauaaggguag

SEQ ID NO: 26167 - RNA, 25 nt, Artificial Sequence
  Synthetic Oligonucleotide; PRDM1 exon 4; Set B
uugucagcucuccgggauaagggua

SEQ ID NO: 26168 - RNA, 31 nt, Artificial Sequence
  Synthetic Oligonucleotide; PRDM1 exon 4; Set C
ucauugucagcucuccgggauaaggguagug

SEQ ID NO: 26169 - RNA, 33 nt, Artificial Sequence
  Synthetic Oligonucleotide; PRDM1 exon 4; Set C
aucauugucagcucuccgggauaaggguaguga

SEQ ID NO: 26170 - RNA, 26 nt, Artificial Sequence
  Synthetic Oligonucleotide; PRDM1 exon 4; Set B
auugucagcucuccgggauaagggua

SEQ ID NO: 26171 - RNA, 32 nt, Artificial Sequence
  Synthetic Oligonucleotide; PRDM1 exon 4; Set C
aucauugucagcucuccgggauaaggguagug

SEQ ID NO: 26172 - RNA, 34 nt, Artificial Sequence
  Synthetic Oligonucleotide; PRDM1 exon 4; Set C
caucauugucagcucuccgggauaaggguaguga

SEQ ID NO: 26173 - RNA, 40 nt, Artificial Sequence
  Synthetic Oligonucleotide; PRDM1 exon 4; Set C
agauucaucauugucagcucuccgggauaaggguagugaa

SEQ ID NO: 26174 - RNA, 39 nt, Artificial Sequence
  Synthetic Oligonucleotide; PRDM1 exon 4; Set C
agauucaucauugucagcucuccgggauaaggguaguga

SEQ ID NO: 26175 - RNA, 38 nt, Artificial Sequence
  Synthetic Oligonucleotide; PRDM1 exon 4; Set C
agauucaucauugucagcucuccgggauaaggguagug

SEQ ID NO: 26176 - RNA, 40 nt, Artificial Sequence
  Synthetic Oligonucleotide; PRDM1 exon 4; Set C
gagauucaucauugucagcucuccgggauaaggguaguga

SEQ ID NO: 26177 - RNA, 39 nt, Artificial Sequence
  Synthetic Oligonucleotide; PRDM1 exon 4; Set C
gagauucaucauugucagcucuccgggauaaggguagug

SEQ ID NO: 26178 - RNA, 40 nt, Artificial Sequence
  Synthetic Oligonucleotide; PRDM1 exon 4; Set C
ugagauucaucauugucagcucuccgggauaaggguagug

SEQ ID NO: 26179 - RNA, 27 nt, Artificial Sequence
  Synthetic Oligonucleotide; PRDM1 exon 4; Set B
ucaucauugucagcucuccgggauaag

SEQ ID NO: 26180 - RNA, 26 nt, Artificial Sequence
  Synthetic Oligonucleotide; PRDM1 exon 4; Set B
ucaucauugucagcucuccgggauaa

SEQ ID NO: 26181 - RNA, 28 nt, Artificial Sequence
  Synthetic Oligonucleotide; PRDM1 exon 4; Set B
uucaucauugucagcucuccgggauaag

SEQ ID NO: 26182 - RNA, 27 nt, Artificial Sequence
  Synthetic Oligonucleotide; PRDM1 exon 4; Set B
uucaucauugucagcucuccgggauaa

SEQ ID NO: 26183 - RNA, 29 nt, Artificial Sequence
  Synthetic Oligonucleotide; PRDM1 exon 4; Set B
auucaucauugucagcucuccgggauaag

SEQ ID NO: 26184 - RNA, 28 nt, Artificial Sequence
  Synthetic Oligonucleotide; PRDM1 exon 4; Set B
auucaucauugucagcucuccgggauaa

SEQ ID NO: 26185 - RNA, 30 nt, Artificial Sequence
  Synthetic Oligonucleotide; PRDM1 exon 4; Set B
gauucaucauugucagcucuccgggauaag

SEQ ID NO: 26186 - RNA, 29 nt, Artificial Sequence
  Synthetic Oligonucleotide; PRDM1 exon 4; Set B
gauucaucauugucagcucuccgggauaa

SEQ ID NO: 26187 - RNA, 20 nt, Artificial Sequence
  Synthetic Oligonucleotide; PRDM1 exon 4; Set C
ucaucauugucagcucuccg

SEQ ID NO: 26188 - RNA, 19 nt, Artificial Sequence
  Synthetic Oligonucleotide; PRDM1 exon 4; Set C
ucaucauugucagcucucc

SEQ ID NO: 26189 - RNA, 21 nt, Artificial Sequence
  Synthetic Oligonucleotide; PRDM1 exon 4; Set C
uucaucauugucagcucuccg

SEQ ID NO: 26190 - RNA, 20 nt, Artificial Sequence
  Synthetic Oligonucleotide; PRDM1 exon 4; Set C
uucaucauugucagcucucc

SEQ ID NO: 26191 - RNA, 22 nt, Artificial Sequence
  Synthetic Oligonucleotide; PRDM1 exon 4; Set C
auucaucauugucagcucuccg

SEQ ID NO: 26192 - RNA, 21 nt, Artificial Sequence
  Synthetic Oligonucleotide; PRDM1 exon 4; Set C
auucaucauugucagcucucc

SEQ ID NO: 26193 - RNA, 23 nt, Artificial Sequence
  Synthetic Oligonucleotide; PRDM1 exon 4; Set B
gauucaucauugucagcucuccg

SEQ ID NO: 26194 - RNA, 22 nt, Artificial Sequence
  Synthetic Oligonucleotide; PRDM1 exon 4; Set C
gauucaucauugucagcucucc

SEQ ID NO: 26195 - RNA, 15 nt, Artificial Sequence
  Synthetic Oligonucleotide; PRDM1 exon 4; Set C
auucaucauugucag

SEQ ID NO: 26196 - RNA, 16 nt, Artificial Sequence
  Synthetic Oligonucleotide; PRDM1 exon 4; Set C
gauucaucauugucag

SEQ ID NO: 26197 - RNA, 15 nt, Artificial Sequence
  Synthetic Oligonucleotide; PRDM1 exon 4; Set C
gauucaucauuguca

SEQ ID NO: 26198 - RNA, 15 nt, Artificial Sequence
  Synthetic Oligonucleotide; PRDM1 exon 4; Set C
ugagauucaucauug

SEQ ID NO: 26199 - RNA, 23 nt, Artificial Sequence
  Synthetic Oligonucleotide; PRDM1 exon 4; Set C
cacuuacugagauucaucauugu

SEQ ID NO: 26200 - RNA, 22 nt, Artificial Sequence
  Synthetic Oligonucleotide; PRDM1 exon 4; Set C
cacuuacugagauucaucauug

SEQ ID NO: 26201 - RNA, 24 nt, Artificial Sequence
  Synthetic Oligonucleotide; PRDM1 exon 4; Set C
ccacuuacugagauucaucauugu

SEQ ID NO: 26202 - RNA, 23 nt, Artificial Sequence
  Synthetic Oligonucleotide; PRDM1 exon 4; Set C
ccacuuacugagauucaucauug

SEQ ID NO: 26203 - RNA, 25 nt, Artificial Sequence
  Synthetic Oligonucleotide; PRDM1 exon 4; Set B
uccacuuacugagauucaucauugu

SEQ ID NO: 26204 - RNA, 24 nt, Artificial Sequence
  Synthetic Oligonucleotide; PRDM1 exon 4; Set C
uccacuuacugagauucaucauug

SEQ ID NO: 26205 - RNA, 25 nt, Artificial Sequence
  Synthetic Oligonucleotide; PRDM1 exon 4; Set C
auccacuuacugagauucaucauug

SEQ ID NO: 26206 - RNA, 24 nt, Artificial Sequence
  Synthetic Oligonucleotide; PRDM1 exon 4; Set C
auccacuuacugagauucaucauu

SEQ ID NO: 26207 - RNA, 15 nt, Artificial Sequence
  Synthetic Oligonucleotide; PRDM1 exon 4; Set C
acuuacugagauuca

SEQ ID NO: 26208 - RNA, 27 nt, Artificial Sequence
  Synthetic Oligonucleotide; PRDM1 exon 4; Set C
uaauccacuuacugagauucaucauug

SEQ ID NO: 26209 - RNA, 24 nt, Artificial Sequence
  Synthetic Oligonucleotide; PRDM1 exon 4; Set C
aauccacuuacugagauucaucau

SEQ ID NO: 26210 - RNA, 26 nt, Artificial Sequence
  Synthetic Oligonucleotide; PRDM1 exon 4; Set C
uaauccacuuacugagauucaucauu

SEQ ID NO: 26211 - RNA, 23 nt, Artificial Sequence
  Synthetic Oligonucleotide; PRDM1 exon 4; Set C
aauccacuuacugagauucauca

SEQ ID NO: 26212 - RNA, 22 nt, Artificial Sequence
  Synthetic Oligonucleotide; PRDM1 exon 4; Set C
aauccacuuacugagauucauc

SEQ ID NO: 26213 - RNA, 26 nt, Artificial Sequence
  Synthetic Oligonucleotide; PRDM1 exon 4; Set C
guaauccacuuacugagauucaucau

SEQ ID NO: 26214 - RNA, 32 nt, Artificial Sequence
  Synthetic Oligonucleotide; PRDM1 exon 4; Set B
ucuguaauccacuuacugagauucaucauugu

SEQ ID NO: 26215 - RNA, 36 nt, Artificial Sequence
  Synthetic Oligonucleotide; PRDM1 exon 4; Set B
guucuguaauccacuuacugagauucaucauuguca

SEQ ID NO: 26216 - RNA, 21 nt, Artificial Sequence
  Synthetic Oligonucleotide; PRDM1 exon 4; Set C
aauccacuuacugagauucau

SEQ ID NO: 26217 - RNA, 25 nt, Artificial Sequence
  Synthetic Oligonucleotide; PRDM1 exon 4; Set C
guaauccacuuacugagauucauca

SEQ ID NO: 26218 - RNA, 27 nt, Artificial Sequence
  Synthetic Oligonucleotide; PRDM1 exon 4; Set C
uguaauccacuuacugagauucaucau

SEQ ID NO: 26219 - RNA, 31 nt, Artificial Sequence
  Synthetic Oligonucleotide; PRDM1 exon 4; Set B
ucuguaauccacuuacugagauucaucauug

SEQ ID NO: 26220 - RNA, 33 nt, Artificial Sequence
  Synthetic Oligonucleotide; PRDM1 exon 4; Set B
uucuguaauccacuuacugagauucaucauugu

SEQ ID NO: 26221 - RNA, 37 nt, Artificial Sequence
  Synthetic Oligonucleotide; PRDM1 exon 4; Set C
uguucuguaauccacuuacugagauucaucauuguca

SEQ ID NO: 26222 - RNA, 35 nt, Artificial Sequence
  Synthetic Oligonucleotide; PRDM1 exon 4; Set B
guucuguaauccacuuacugagauucaucauuguc

SEQ ID NO: 26223 - RNA, 26 nt, Artificial Sequence
  Synthetic Oligonucleotide; PRDM1 exon 4; Set C
uguaauccacuuacugagauucauca

SEQ ID NO: 26224 - RNA, 24 nt, Artificial Sequence
  Synthetic Oligonucleotide; PRDM1 exon 4; Set C
guaauccacuuacugagauucauc

SEQ ID NO: 26225 - RNA, 28 nt, Artificial Sequence
  Synthetic Oligonucleotide; PRDM1 exon 4; Set B
cuguaauccacuuacugagauucaucau

SEQ ID NO: 26226 - RNA, 32 nt, Artificial Sequence
  Synthetic Oligonucleotide; PRDM1 exon 4; Set B
uucuguaauccacuuacugagauucaucauug

SEQ ID NO: 26227 - RNA, 38 nt, Artificial Sequence
  Synthetic Oligonucleotide; PRDM1 exon 4; Set C
uuguucuguaauccacuuacugagauucaucauuguca

SEQ ID NO: 26228 - RNA, 36 nt, Artificial Sequence
  Synthetic Oligonucleotide; PRDM1 exon 4; Set B
uguucuguaauccacuuacugagauucaucauuguc

SEQ ID NO: 26229 - RNA, 40 nt, Artificial Sequence
  Synthetic Oligonucleotide; PRDM1 exon 4; Set B
uuuguucuguaauccacuuacugagauucaucauugucag

SEQ ID NO: 26230 - RNA, 23 nt, Artificial Sequence
  Synthetic Oligonucleotide; PRDM1 exon 4; Set C
guaauccacuuacugagauucau

SEQ ID NO: 26231 - RNA, 27 nt, Artificial Sequence
  Synthetic Oligonucleotide; PRDM1 exon 4; Set B
cuguaauccacuuacugagauucauca

SEQ ID NO: 26232 - RNA, 25 nt, Artificial Sequence
  Synthetic Oligonucleotide; PRDM1 exon 4; Set C
uguaauccacuuacugagauucauc

SEQ ID NO: 26233 - RNA, 39 nt, Artificial Sequence
  Synthetic Oligonucleotide; PRDM1 exon 4; Set C
uuuguucuguaauccacuuacugagauucaucauuguca

SEQ ID NO: 26234 - RNA, 37 nt, Artificial Sequence
  Synthetic Oligonucleotide; PRDM1 exon 4; Set B
uuguucuguaauccacuuacugagauucaucauuguc

SEQ ID NO: 26235 - RNA, 24 nt, Artificial Sequence
  Synthetic Oligonucleotide; PRDM1 exon 4; Set C
uguaauccacuuacugagauucau

SEQ ID NO: 26236 - RNA, 26 nt, Artificial Sequence
  Synthetic Oligonucleotide; PRDM1 exon 4; Set C
cuguaauccacuuacugagauucauc

SEQ ID NO: 26237 - RNA, 40 nt, Artificial Sequence
  Synthetic Oligonucleotide; PRDM1 exon 4; Set C
uuuuguucuguaauccacuuacugagauucaucauuguca

SEQ ID NO: 26238 - RNA, 38 nt, Artificial Sequence
  Synthetic Oligonucleotide; PRDM1 exon 4; Set B
uuuguucuguaauccacuuacugagauucaucauuguc

SEQ ID NO: 26239 - RNA, 25 nt, Artificial Sequence
  Synthetic Oligonucleotide; PRDM1 exon 4; Set C
cuguaauccacuuacugagauucau

SEQ ID NO: 26240 - RNA, 15 nt, Artificial Sequence
  Synthetic Oligonucleotide; PRDM1 exon 4; Set C
auccacuuacugaga

SEQ ID NO: 26241 - RNA, 39 nt, Artificial Sequence
  Synthetic Oligonucleotide; PRDM1 exon 4; Set B
uuuuguucuguaauccacuuacugagauucaucauuguc

SEQ ID NO: 26242 - RNA, 16 nt, Artificial Sequence
  Synthetic Oligonucleotide; PRDM1 exon 4; Set C
aauccacuuacugaga

SEQ ID NO: 26243 - RNA, 40 nt, Artificial Sequence
  Synthetic Oligonucleotide; PRDM1 exon 4; Set B
uuuuuguucuguaauccacuuacugagauucaucauuguc

SEQ ID NO: 26244 - RNA, 17 nt, Artificial Sequence
  Synthetic Oligonucleotide; PRDM1 exon 4; Set C
uaauccacuuacugaga

SEQ ID NO: 26245 - RNA, 16 nt, Artificial Sequence
  Synthetic Oligonucleotide; PRDM1 exon 4; Set C
uaauccacuuacugag

SEQ ID NO: 26246 - RNA, 21 nt, Artificial Sequence
  Synthetic Oligonucleotide; PRDM1 exon 4; Set C
cuguaauccacuuacugagau

SEQ ID NO: 26247 - RNA, 19 nt, Artificial Sequence
  Synthetic Oligonucleotide; PRDM1 exon 4; Set C
uguaauccacuuacugaga

SEQ ID NO: 26248 - RNA, 15 nt, Artificial Sequence
  Synthetic Oligonucleotide; PRDM1 exon 4; Set C
uaauccacuuacuga

SEQ ID NO: 26249 - RNA, 16 nt, Artificial Sequence
  Synthetic Oligonucleotide; PRDM1 exon 4; Set C
uucuguaauccacuua

SEQ ID NO: 26250 - RNA, 15 nt, Artificial Sequence
  Synthetic Oligonucleotide; PRDM1 exon 4; Set C
uucuguaauccacuu

SEQ ID NO: 26251 - RNA, 17 nt, Artificial Sequence
  Synthetic Oligonucleotide; PRDM1 exon 4; Set C
guucuguaauccacuua

SEQ ID NO: 26252 - RNA, 16 nt, Artificial Sequence
  Synthetic Oligonucleotide; PRDM1 exon 4; Set C
guucuguaauccacuu

SEQ ID NO: 26253 - RNA, 18 nt, Artificial Sequence
  Synthetic Oligonucleotide; PRDM1 exon 4; Set C
uguucuguaauccacuua

SEQ ID NO: 26254 - RNA, 15 nt, Artificial Sequence
  Synthetic Oligonucleotide; PRDM1 exon 4; Set C
guucuguaauccacu

SEQ ID NO: 26255 - RNA, 17 nt, Artificial Sequence
  Synthetic Oligonucleotide; PRDM1 exon 4; Set C
uguucuguaauccacuu

SEQ ID NO: 26256 - RNA, 19 nt, Artificial Sequence
  Synthetic Oligonucleotide; PRDM1 exon 4; Set C
uuguucuguaauccacuua

SEQ ID NO: 26257 - RNA, 16 nt, Artificial Sequence
  Synthetic Oligonucleotide; PRDM1 exon 4; Set C
uguucuguaauccacu

SEQ ID NO: 26258 - RNA, 18 nt, Artificial Sequence
  Synthetic Oligonucleotide; PRDM1 exon 4; Set C
uuguucuguaauccacuu

SEQ ID NO: 26259 - RNA, 20 nt, Artificial Sequence
  Synthetic Oligonucleotide; PRDM1 exon 4; Set C
uuuguucuguaauccacuua

SEQ ID NO: 26260 - RNA, 17 nt, Artificial Sequence
  Synthetic Oligonucleotide; PRDM1 exon 4; Set C
uuguucuguaauccacu

SEQ ID NO: 26261 - RNA, 21 nt, Artificial Sequence
  Synthetic Oligonucleotide; PRDM1 exon 4; Set C
uuuuguucuguaauccacuua

SEQ ID NO: 26262 - RNA, 22 nt, Artificial Sequence
  Synthetic Oligonucleotide; PRDM1 exon 4; Set C
uuuuuguucuguaauccacuua

SEQ ID NO: 26263 - RNA, 26 nt, Artificial Sequence
  Synthetic Oligonucleotide; PRDM1 exon 4; Set C
uuuuuuuguucuguaauccacuuacu

SEQ ID NO: 26264 - RNA, 23 nt, Artificial Sequence
  Synthetic Oligonucleotide; PRDM1 exon 4; Set C
uuuuuuguucuguaauccacuua

SEQ ID NO: 26265 - RNA, 27 nt, Artificial Sequence
  Synthetic Oligonucleotide; PRDM1 exon 4; Set C
auuuuuuuguucuguaauccacuuacu

SEQ ID NO: 26266 - RNA, 24 nt, Artificial Sequence
  Synthetic Oligonucleotide; PRDM1 exon 4; Set C
uuuuuuuguucuguaauccacuua

SEQ ID NO: 26267 - RNA, 28 nt, Artificial Sequence
  Synthetic Oligonucleotide; PRDM1 exon 4; Set C
uauuuuuuuguucuguaauccacuuacu

SEQ ID NO: 26268 - RNA, 25 nt, Artificial Sequence
  Synthetic Oligonucleotide; PRDM1 exon 4; Set C
auuuuuuuguucuguaauccacuua

SEQ ID NO: 26269 - RNA, 29 nt, Artificial Sequence
  Synthetic Oligonucleotide; PRDM1 exon 4; Set C
uuauuuuuuuguucuguaauccacuuacu

SEQ ID NO: 26270 - RNA, 31 nt, Artificial Sequence
  Synthetic Oligonucleotide; PRDM1 exon 4; Set C
uuuauuuuuuuguucuguaauccacuuacug

SEQ ID NO: 26271 - RNA, 30 nt, Artificial Sequence
  Synthetic Oligonucleotide; PRDM1 exon 4; Set C
uuuauuuuuuuguucuguaauccacuuacu

SEQ ID NO: 26272 - RNA, 32 nt, Artificial Sequence
  Synthetic Oligonucleotide; PRDM1 exon 4; Set C
uuuuauuuuuuuguucuguaauccacuuacug

SEQ ID NO: 26273 - RNA, 31 nt, Artificial Sequence
  Synthetic Oligonucleotide; PRDM1 exon 4; Set C
uuuuauuuuuuuguucuguaauccacuuacu

SEQ ID NO: 26274 - RNA, 33 nt, Artificial Sequence
  Synthetic Oligonucleotide; PRDM1 exon 4; Set C
uuuuuauuuuuuuguucuguaauccacuuacug

SEQ ID NO: 26275 - RNA, 32 nt, Artificial Sequence
  Synthetic Oligonucleotide; PRDM1 exon 4; Set C
uuuuuauuuuuuuguucuguaauccacuuacu

SEQ ID NO: 26276 - RNA, 34 nt, Artificial Sequence
  Synthetic Oligonucleotide; PRDM1 exon 4; Set C
uuuuuuauuuuuuuguucuguaauccacuuacug

SEQ ID NO: 26277 - RNA, 33 nt, Artificial Sequence
  Synthetic Oligonucleotide; PRDM1 exon 4; Set C
uuuuuuauuuuuuuguucuguaauccacuuacu

SEQ ID NO: 26278 - RNA, 40 nt, Artificial Sequence
  Synthetic Oligonucleotide; PRDM1 exon 4; Set B
ggcauuuuuuauuuuuuuguucuguaauccacuuacugag

SEQ ID NO: 26279 - RNA, 34 nt, Artificial Sequence
  Synthetic Oligonucleotide; PRDM1 exon 4; Set C
auuuuuuauuuuuuuguucuguaauccacuuacu

SEQ ID NO: 26280 - RNA, 39 nt, Artificial Sequence
  Synthetic Oligonucleotide; PRDM1 exon 4; Set B
ggcauuuuuuauuuuuuuguucuguaauccacuuacuga

SEQ ID NO: 26281 - RNA, 35 nt, Artificial Sequence
  Synthetic Oligonucleotide; PRDM1 exon 4; Set B
cauuuuuuauuuuuuuguucuguaauccacuuacu

SEQ ID NO: 26282 - RNA, 40 nt, Artificial Sequence
  Synthetic Oligonucleotide; PRDM1 exon 4; Set B
uggcauuuuuuauuuuuuuguucuguaauccacuuacuga

SEQ ID NO: 26283 - RNA, 32 nt, Artificial Sequence
  Synthetic Oligonucleotide; PRDM1 exon 4; Set C
auuuuuuauuuuuuuguucuguaauccacuua

SEQ ID NO: 26284 - RNA, 36 nt, Artificial Sequence
  Synthetic Oligonucleotide; PRDM1 exon 4; Set B
gcauuuuuuauuuuuuuguucuguaauccacuuacu

SEQ ID NO: 26285 - RNA, 33 nt, Artificial Sequence
  Synthetic Oligonucleotide; PRDM1 exon 4; Set C
cauuuuuuauuuuuuuguucuguaauccacuua

SEQ ID NO: 26286 - RNA, 34 nt, Artificial Sequence
  Synthetic Oligonucleotide; PRDM1 exon 4; Set B
gcauuuuuuauuuuuuuguucuguaauccacuua

SEQ ID NO: 26287 - RNA, 40 nt, Artificial Sequence
  Synthetic Oligonucleotide; PRDM1 exon 4; Set B
uacuggcauuuuuuauuuuuuuguucuguaauccacuuac

SEQ ID NO: 26288 - RNA, 28 nt, Artificial Sequence
  Synthetic Oligonucleotide; PRDM1 exon 4; Set C
ggcauuuuuuauuuuuuuguucuguaau

SEQ ID NO: 26289 - RNA, 29 nt, Artificial Sequence
  Synthetic Oligonucleotide; PRDM1 exon 4; Set C
uggcauuuuuuauuuuuuuguucuguaau

SEQ ID NO: 26290 - RNA, 38 nt, Artificial Sequence
  Synthetic Oligonucleotide; PRDM1 exon 4; Set B
auuacuggcauuuuuuauuuuuuuguucuguaauccac

SEQ ID NO: 26291 - RNA, 30 nt, Artificial Sequence
  Synthetic Oligonucleotide; PRDM1 exon 4; Set C
cuggcauuuuuuauuuuuuuguucuguaau

SEQ ID NO: 26292 - RNA, 26 nt, Artificial Sequence
  Synthetic Oligonucleotide; PRDM1 exon 4; Set C
ggcauuuuuuauuuuuuuguucugua

SEQ ID NO: 26293 - RNA, 37 nt, Artificial Sequence
  Synthetic Oligonucleotide; PRDM1 exon 4; Set B
auuacuggcauuuuuuauuuuuuuguucuguaaucca

SEQ ID NO: 26294 - RNA, 31 nt, Artificial Sequence
  Synthetic Oligonucleotide; PRDM1 exon 4; Set C
acuggcauuuuuuauuuuuuuguucuguaau

SEQ ID NO: 26295 - RNA, 25 nt, Artificial Sequence
  Synthetic Oligonucleotide; PRDM1 exon 4; Set C
ggcauuuuuuauuuuuuuguucugu

SEQ ID NO: 26296 - RNA, 27 nt, Artificial Sequence
  Synthetic Oligonucleotide; PRDM1 exon 4; Set C
uggcauuuuuuauuuuuuuguucugua

SEQ ID NO: 26297 - RNA, 36 nt, Artificial Sequence
  Synthetic Oligonucleotide; PRDM1 exon 4; Set B
auuacuggcauuuuuuauuuuuuuguucuguaaucc

SEQ ID NO: 26298 - RNA, 26 nt, Artificial Sequence
  Synthetic Oligonucleotide; PRDM1 exon 4; Set C
uggcauuuuuuauuuuuuuguucugu

SEQ ID NO: 26299 - RNA, 28 nt, Artificial Sequence
  Synthetic Oligonucleotide; PRDM1 exon 4; Set C
cuggcauuuuuuauuuuuuuguucugua

SEQ ID NO: 26300 - RNA, 27 nt, Artificial Sequence
  Synthetic Oligonucleotide; PRDM1 exon 4; Set C
cuggcauuuuuuauuuuuuuguucugu

SEQ ID NO: 26301 - RNA, 29 nt, Artificial Sequence
  Synthetic Oligonucleotide; PRDM1 exon 4; Set C
acuggcauuuuuuauuuuuuuguucugua

SEQ ID NO: 26302 - RNA, 28 nt, Artificial Sequence
  Synthetic Oligonucleotide; PRDM1 exon 4; Set C
acuggcauuuuuuauuuuuuuguucugu

SEQ ID NO: 26303 - RNA, 27 nt, Artificial Sequence
  Synthetic Oligonucleotide; PRDM1 exon 4; Set C
acuggcauuuuuuauuuuuuuguucug

SEQ ID NO: 26304 - RNA, 40 nt, Artificial Sequence
  Synthetic Oligonucleotide; PRDM1 exon 4; Set B
cgacauuacuggcauuuuuuauuuuuuuguucuguaaucc

SEQ ID NO: 26305 - RNA, 29 nt, Artificial Sequence
  Synthetic Oligonucleotide; PRDM1 exon 4; Set C
auuacuggcauuuuuuauuuuuuuguucu

SEQ ID NO: 26306 - RNA, 28 nt, Artificial Sequence
  Synthetic Oligonucleotide; PRDM1 exon 4; Set C
auuacuggcauuuuuuauuuuuuuguuc

SEQ ID NO: 26307 - RNA, 33 nt, Artificial Sequence
  Synthetic Oligonucleotide; PRDM1 exon 4; Set B
cgacauuacuggcauuuuuuauuuuuuuguucu

SEQ ID NO: 26308 - RNA, 32 nt, Artificial Sequence
  Synthetic Oligonucleotide; PRDM1 exon 4; Set B
cgacauuacuggcauuuuuuauuuuuuuguuc

SEQ ID NO: 26309 - RNA, 31 nt, Artificial Sequence
  Synthetic Oligonucleotide; PRDM1 exon 4; Set B
cgacauuacuggcauuuuuuauuuuuuuguu

SEQ ID NO: 26310 - RNA, 30 nt, Artificial Sequence
  Synthetic Oligonucleotide; PRDM1 exon 4; Set B
cgacauuacuggcauuuuuuauuuuuuugu

SEQ ID NO: 26311 - RNA, 29 nt, Artificial Sequence
  Synthetic Oligonucleotide; PRDM1 exon 4; Set C
cgacauuacuggcauuuuuuauuuuuuug

SEQ ID NO: 26312 - RNA, 22 nt, Artificial Sequence
  Synthetic Oligonucleotide; PRDM1 exon 4; Set C
cgacauuacuggcauuuuuuau

SEQ ID NO: 26313 - RNA, 21 nt, Artificial Sequence
  Synthetic Oligonucleotide; PRDM1 exon 4; Set C
cgacauuacuggcauuuuuua

SEQ ID NO: 26314 - RNA, 20 nt, Artificial Sequence
  Synthetic Oligonucleotide; PRDM1 exon 4; Set C
cgacauuacuggcauuuuuu

SEQ ID NO: 26315 - RNA, 19 nt, Artificial Sequence
  Synthetic Oligonucleotide; PRDM1 exon 4; Set C
cgacauuacuggcauuuuu

SEQ ID NO: 26316 - RNA, 18 nt, Artificial Sequence
  Synthetic Oligonucleotide; PRDM1 exon 4; Set C
cgacauuacuggcauuuu

SEQ ID NO: 26317 - RNA, 17 nt, Artificial Sequence
  Synthetic Oligonucleotide; PRDM1 exon 4; Set C
cgacauuacuggcauuu

SEQ ID NO: 26318 - RNA, 16 nt, Artificial Sequence
  Synthetic Oligonucleotide; PRDM1 exon 4; Set C
cgacauuacuggcauu

SEQ ID NO: 26319 - RNA, 15 nt, Artificial Sequence
  Synthetic Oligonucleotide; PRDM1 exon 4; Set C
cgacauuacuggcau

SEQ ID NO: 26320 - RNA, 21 nt, Artificial Sequence
  Synthetic Oligonucleotide; PRDM1 exon 5; Set C
aauaaagaaaaaggggcgauu

SEQ ID NO: 26321 - RNA, 22 nt, Artificial Sequence
  Synthetic Oligonucleotide; PRDM1 exon 5; Set C
aaauaaagaaaaaggggcgauu

SEQ ID NO: 26322 - RNA, 23 nt, Artificial Sequence
  Synthetic Oligonucleotide; PRDM1 exon 5; Set C
gaaauaaagaaaaaggggcgauu

SEQ ID NO: 26323 - RNA, 21 nt, Artificial Sequence
  Synthetic Oligonucleotide; PRDM1 exon 5; Set C
aaauaaagaaaaaggggcgau

SEQ ID NO: 26324 - RNA, 22 nt, Artificial Sequence
  Synthetic Oligonucleotide; PRDM1 exon 5; Set C
gaaauaaagaaaaaggggcgau

SEQ ID NO: 26325 - RNA, 15 nt, Artificial Sequence
  Synthetic Oligonucleotide; PRDM1 exon 5; Set C
aauaaagaaaaaggg

SEQ ID NO: 26326 - RNA, 16 nt, Artificial Sequence
  Synthetic Oligonucleotide; PRDM1 exon 5; Set C
aaauaaagaaaaaggg

SEQ ID NO: 26327 - RNA, 17 nt, Artificial Sequence
  Synthetic Oligonucleotide; PRDM1 exon 5; Set C
gaaauaaagaaaaaggg

SEQ ID NO: 26328 - RNA, 15 nt, Artificial Sequence
  Synthetic Oligonucleotide; PRDM1 exon 5; Set C
aaauaaagaaaaagg

SEQ ID NO: 26329 - RNA, 18 nt, Artificial Sequence
  Synthetic Oligonucleotide; PRDM1 exon 5; Set C
ugaaauaaagaaaaaggg

SEQ ID NO: 26330 - RNA, 16 nt, Artificial Sequence
  Synthetic Oligonucleotide; PRDM1 exon 5; Set C
gaaauaaagaaaaagg

SEQ ID NO: 26331 - RNA, 15 nt, Artificial Sequence
  Synthetic Oligonucleotide; PRDM1 exon 5; Set C
gaaauaaagaaaaag

SEQ ID NO: 26332 - RNA, 17 nt, Artificial Sequence
  Synthetic Oligonucleotide; PRDM1 exon 5; Set C
ugaaauaaagaaaaagg

SEQ ID NO: 26333 - RNA, 16 nt, Artificial Sequence
  Synthetic Oligonucleotide; PRDM1 exon 5; Set C
ugaaauaaagaaaaag

SEQ ID NO: 26334 - RNA, 15 nt, Artificial Sequence
  Synthetic Oligonucleotide; PRDM1 exon 5; Set C
ugaaauaaagaaaaa

SEQ ID NO: 26335 - RNA, 16 nt, Artificial Sequence
  Synthetic Oligonucleotide; PRDM1 exon 5; Set C
uuuaggauuucuuuca

SEQ ID NO: 26336 - RNA, 17 nt, Artificial Sequence
  Synthetic Oligonucleotide; PRDM1 exon 5; Set C
uuuuaggauuucuuuca

SEQ ID NO: 26337 - RNA, 15 nt, Artificial Sequence
  Synthetic Oligonucleotide; PRDM1 exon 5; Set C
uuuaggauuucuuuc

SEQ ID NO: 26338 - RNA, 16 nt, Artificial Sequence
  Synthetic Oligonucleotide; PRDM1 exon 5; Set C
uuuuaggauuucuuuc

SEQ ID NO: 26339 - RNA, 15 nt, Artificial Sequence
  Synthetic Oligonucleotide; PRDM1 exon 5; Set C
uuuuaggauuucuuu

SEQ ID NO: 26340 - RNA, 16 nt, Artificial Sequence
  Synthetic Oligonucleotide; PRDM1 exon 5; Set C
uuuggagggguuggag

SEQ ID NO: 26341 - RNA, 15 nt, Artificial Sequence
  Synthetic Oligonucleotide; PRDM1 exon 5; Set C
uuuggagggguugga

SEQ ID NO: 26342 - RNA, 17 nt, Artificial Sequence
  Synthetic Oligonucleotide; PRDM1 exon 5; Set C
cuuuggagggguuggag

SEQ ID NO: 26343 - RNA, 18 nt, Artificial Sequence
  Synthetic Oligonucleotide; PRDM1 exon 5; Set C
ccuuuggagggguuggag

SEQ ID NO: 26344 - RNA, 16 nt, Artificial Sequence
  Synthetic Oligonucleotide; PRDM1 exon 5; Set C
cuuuggagggguugga

SEQ ID NO: 26345 - RNA, 19 nt, Artificial Sequence
  Synthetic Oligonucleotide; PRDM1 exon 5; Set A
uccuuuggagggguuggag

SEQ ID NO: 26346 - RNA, 17 nt, Artificial Sequence
  Synthetic Oligonucleotide; PRDM1 exon 5; Set C
ccuuuggagggguugga

SEQ ID NO: 26347 - RNA, 15 nt, Artificial Sequence
  Synthetic Oligonucleotide; PRDM1 exon 5; Set C
cuuuggagggguugg

SEQ ID NO: 26348 - RNA, 20 nt, Artificial Sequence
  Synthetic Oligonucleotide; PRDM1 exon 5; Set A
uuccuuuggagggguuggag

SEQ ID NO: 26349 - RNA, 18 nt, Artificial Sequence
  Synthetic Oligonucleotide; PRDM1 exon 5; Set A
uccuuuggagggguugga

SEQ ID NO: 26350 - RNA, 16 nt, Artificial Sequence
  Synthetic Oligonucleotide; PRDM1 exon 5; Set C
ccuuuggagggguugg

SEQ ID NO: 26351 - RNA, 19 nt, Artificial Sequence
  Synthetic Oligonucleotide; PRDM1 exon 5; Set A
uuccuuuggagggguugga

SEQ ID NO: 26352 - RNA, 17 nt, Artificial Sequence
  Synthetic Oligonucleotide; PRDM1 exon 5; Set C
uccuuuggagggguugg

SEQ ID NO: 26353 - RNA, 15 nt, Artificial Sequence
  Synthetic Oligonucleotide; PRDM1 exon 5; Set C
ccuuuggagggguug

SEQ ID NO: 26354 - RNA, 18 nt, Artificial Sequence
  Synthetic Oligonucleotide; PRDM1 exon 5; Set C
uuccuuuggagggguugg

SEQ ID NO: 26355 - RNA, 16 nt, Artificial Sequence
  Synthetic Oligonucleotide; PRDM1 exon 5; Set C
uccuuuggagggguug

SEQ ID NO: 26356 - RNA, 17 nt, Artificial Sequence
  Synthetic Oligonucleotide; PRDM1 exon 5; Set C
uuccuuuggagggguug

SEQ ID NO: 26357 - RNA, 15 nt, Artificial Sequence
  Synthetic Oligonucleotide; PRDM1 exon 5; Set C
uccuuuggagggguu

SEQ ID NO: 26358 - RNA, 16 nt, Artificial Sequence
  Synthetic Oligonucleotide; PRDM1 exon 5; Set C
uuccuuuggagggguu

SEQ ID NO: 26359 - RNA, 15 nt, Artificial Sequence
  Synthetic Oligonucleotide; PRDM1 exon 5; Set C
uuccuuuggaggggu

SEQ ID NO: 26360 - RNA, 15 nt, Artificial Sequence
  Synthetic Oligonucleotide; PRDM1 exon 5; Set C
gaggggugaaauguu

SEQ ID NO: 26361 - RNA, 16 nt, Artificial Sequence
  Synthetic Oligonucleotide; PRDM1 exon 5; Set C
ugaggggugaaauguu

SEQ ID NO: 26362 - RNA, 15 nt, Artificial Sequence
  Synthetic Oligonucleotide; PRDM1 exon 5; Set C
ugaggggugaaaugu

SEQ ID NO: 26363 - RNA, 40 nt, Artificial Sequence
  Synthetic Oligonucleotide; PRDM1 exon 5; Set C
agucaucgagguccuuuucugaugugaggggugaaauguu

SEQ ID NO: 26364 - RNA, 39 nt, Artificial Sequence
  Synthetic Oligonucleotide; PRDM1 exon 5; Set C
agucaucgagguccuuuucugaugugaggggugaaaugu

SEQ ID NO: 26365 - RNA, 40 nt, Artificial Sequence
  Synthetic Oligonucleotide; PRDM1 exon 5; Set C
aagucaucgagguccuuuucugaugugaggggugaaaugu

SEQ ID NO: 26366 - RNA, 18 nt, Artificial Sequence
  Synthetic Oligonucleotide; PRDM1 exon 5; Set C
agucaucgagguccuuuu

SEQ ID NO: 26367 - RNA, 19 nt, Artificial Sequence
  Synthetic Oligonucleotide; PRDM1 exon 5; Set C
aagucaucgagguccuuuu

SEQ ID NO: 26368 - RNA, 17 nt, Artificial Sequence
  Synthetic Oligonucleotide; PRDM1 exon 5; Set C
agucaucgagguccuuu

SEQ ID NO: 26369 - RNA, 20 nt, Artificial Sequence
  Synthetic Oligonucleotide; PRDM1 exon 5; Set C
aaagucaucgagguccuuuu

SEQ ID NO: 26370 - RNA, 18 nt, Artificial Sequence
  Synthetic Oligonucleotide; PRDM1 exon 5; Set C
aagucaucgagguccuuu

SEQ ID NO: 26371 - RNA, 16 nt, Artificial Sequence
  Synthetic Oligonucleotide; PRDM1 exon 5; Set C
agucaucgagguccuu

SEQ ID NO: 26372 - RNA, 19 nt, Artificial Sequence
  Synthetic Oligonucleotide; PRDM1 exon 5; Set C
aaagucaucgagguccuuu

SEQ ID NO: 26373 - RNA, 17 nt, Artificial Sequence
  Synthetic Oligonucleotide; PRDM1 exon 5; Set C
aagucaucgagguccuu

SEQ ID NO: 26374 - RNA, 15 nt, Artificial Sequence
  Synthetic Oligonucleotide; PRDM1 exon 5; Set C
agucaucgagguccu

SEQ ID NO: 26375 - RNA, 18 nt, Artificial Sequence
  Synthetic Oligonucleotide; PRDM1 exon 5; Set C
aaagucaucgagguccuu

SEQ ID NO: 26376 - RNA, 16 nt, Artificial Sequence
  Synthetic Oligonucleotide; PRDM1 exon 5; Set C
aagucaucgagguccu

SEQ ID NO: 26377 - RNA, 15 nt, Artificial Sequence
  Synthetic Oligonucleotide; PRDM1 exon 5; Set C
aagucaucgaggucc

SEQ ID NO: 26378 - RNA, 17 nt, Artificial Sequence
  Synthetic Oligonucleotide; PRDM1 exon 5; Set C
aaagucaucgagguccu

SEQ ID NO: 26379 - RNA, 16 nt, Artificial Sequence
  Synthetic Oligonucleotide; PRDM1 exon 5; Set C
aaagucaucgaggucc

SEQ ID NO: 26380 - RNA, 15 nt, Artificial Sequence
  Synthetic Oligonucleotide; PRDM1 exon 5; Set C
gguagaagggcauuu

SEQ ID NO: 26381 - RNA, 16 nt, Artificial Sequence
  Synthetic Oligonucleotide; PRDM1 exon 5; Set C
ggguagaagggcauuu

SEQ ID NO: 26382 - RNA, 15 nt, Artificial Sequence
  Synthetic Oligonucleotide; PRDM1 exon 5; Set C
ggguagaagggcauu

SEQ ID NO: 26383 - RNA, 17 nt, Artificial Sequence
  Synthetic Oligonucleotide; PRDM1 exon 5; Set C
aggguagaagggcauuu

SEQ ID NO: 26384 - RNA, 16 nt, Artificial Sequence
  Synthetic Oligonucleotide; PRDM1 exon 5; Set C
aggguagaagggcauu

SEQ ID NO: 26385 - RNA, 18 nt, Artificial Sequence
  Synthetic Oligonucleotide; PRDM1 exon 5; Set C
gaggguagaagggcauuu

SEQ ID NO: 26386 - RNA, 17 nt, Artificial Sequence
  Synthetic Oligonucleotide; PRDM1 exon 5; Set C
gaggguagaagggcauu

SEQ ID NO: 26387 - RNA, 15 nt, Artificial Sequence
  Synthetic Oligonucleotide; PRDM1 exon 5; Set C
aggguagaagggcau

SEQ ID NO: 26388 - RNA, 18 nt, Artificial Sequence
  Synthetic Oligonucleotide; PRDM1 exon 5; Set C
cgaggguagaagggcauu

SEQ ID NO: 26389 - RNA, 16 nt, Artificial Sequence
  Synthetic Oligonucleotide; PRDM1 exon 5; Set C
gaggguagaagggcau

SEQ ID NO: 26390 - RNA, 15 nt, Artificial Sequence
  Synthetic Oligonucleotide; PRDM1 exon 5; Set C
gaggguagaagggca

SEQ ID NO: 26391 - RNA, 33 nt, Artificial Sequence
  Synthetic Oligonucleotide; PRDM1 exon 5; Set C
ugggguaaacgacccgaggguagaagggcauuu

SEQ ID NO: 26392 - RNA, 32 nt, Artificial Sequence
  Synthetic Oligonucleotide; PRDM1 exon 5; Set C
ugggguaaacgacccgaggguagaagggcauu

SEQ ID NO: 26393 - RNA, 35 nt, Artificial Sequence
  Synthetic Oligonucleotide; PRDM1 exon 5; Set C
gaugggguaaacgacccgaggguagaagggcauuu

SEQ ID NO: 26394 - RNA, 34 nt, Artificial Sequence
  Synthetic Oligonucleotide; PRDM1 exon 5; Set C
gaugggguaaacgacccgaggguagaagggcauu

SEQ ID NO: 26395 - RNA, 36 nt, Artificial Sequence
  Synthetic Oligonucleotide; PRDM1 exon 5; Set C
ggaugggguaaacgacccgaggguagaagggcauuu

SEQ ID NO: 26396 - RNA, 35 nt, Artificial Sequence
  Synthetic Oligonucleotide; PRDM1 exon 5; Set C
ggaugggguaaacgacccgaggguagaagggcauu

SEQ ID NO: 26397 - RNA, 28 nt, Artificial Sequence
  Synthetic Oligonucleotide; PRDM1 exon 5; Set C
ggaugggguaaacgacccgaggguagaa

SEQ ID NO: 26398 - RNA, 15 nt, Artificial Sequence
  Synthetic Oligonucleotide; PRDM1 exon 5; Set C
uggaggauggaaugg

SEQ ID NO: 26399 - RNA, 16 nt, Artificial Sequence
  Synthetic Oligonucleotide; PRDM1 exon 5; Set C
guggaggauggaaugg

SEQ ID NO: 26400 - RNA, 17 nt, Artificial Sequence
  Synthetic Oligonucleotide; PRDM1 exon 5; Set C
gguggaggauggaaugg

SEQ ID NO: 26401 - RNA, 15 nt, Artificial Sequence
  Synthetic Oligonucleotide; PRDM1 exon 5; Set C
guggaggauggaaug

SEQ ID NO: 26402 - RNA, 18 nt, Artificial Sequence
  Synthetic Oligonucleotide; PRDM1 exon 5; Set C
ugguggaggauggaaugg

SEQ ID NO: 26403 - RNA, 16 nt, Artificial Sequence
  Synthetic Oligonucleotide; PRDM1 exon 5; Set C
gguggaggauggaaug

SEQ ID NO: 26404 - RNA, 19 nt, Artificial Sequence
  Synthetic Oligonucleotide; PRDM1 exon 5; Set C
gugguggaggauggaaugg

SEQ ID NO: 26405 - RNA, 17 nt, Artificial Sequence
  Synthetic Oligonucleotide; PRDM1 exon 5; Set C
ugguggaggauggaaug

SEQ ID NO: 26406 - RNA, 15 nt, Artificial Sequence
  Synthetic Oligonucleotide; PRDM1 exon 5; Set C
gguggaggauggaau

SEQ ID NO: 26407 - RNA, 20 nt, Artificial Sequence
  Synthetic Oligonucleotide; PRDM1 exon 5; Set C
agugguggaggauggaaugg

SEQ ID NO: 26408 - RNA, 18 nt, Artificial Sequence
  Synthetic Oligonucleotide; PRDM1 exon 5; Set C
gugguggaggauggaaug

SEQ ID NO: 26409 - RNA, 16 nt, Artificial Sequence
  Synthetic Oligonucleotide; PRDM1 exon 5; Set C
ugguggaggauggaau

SEQ ID NO: 26410 - RNA, 21 nt, Artificial Sequence
  Synthetic Oligonucleotide; PRDM1 exon 5; Set A
gagugguggaggauggaaugg

SEQ ID NO: 26411 - RNA, 19 nt, Artificial Sequence
  Synthetic Oligonucleotide; PRDM1 exon 5; Set C
agugguggaggauggaaug

SEQ ID NO: 26412 - RNA, 17 nt, Artificial Sequence
  Synthetic Oligonucleotide; PRDM1 exon 5; Set C
gugguggaggauggaau

SEQ ID NO: 26413 - RNA, 15 nt, Artificial Sequence
  Synthetic Oligonucleotide; PRDM1 exon 5; Set C
ugguggaggauggaa

SEQ ID NO: 26414 - RNA, 22 nt, Artificial Sequence
  Synthetic Oligonucleotide; PRDM1 exon 5; Set A
ggagugguggaggauggaaugg

SEQ ID NO: 26415 - RNA, 20 nt, Artificial Sequence
  Synthetic Oligonucleotide; PRDM1 exon 5; Set C
gagugguggaggauggaaug

SEQ ID NO: 26416 - RNA, 18 nt, Artificial Sequence
  Synthetic Oligonucleotide; PRDM1 exon 5; Set C
agugguggaggauggaau

SEQ ID NO: 26417 - RNA, 16 nt, Artificial Sequence
  Synthetic Oligonucleotide; PRDM1 exon 5; Set C
gugguggaggauggaa

SEQ ID NO: 26418 - RNA, 23 nt, Artificial Sequence
  Synthetic Oligonucleotide; PRDM1 exon 5; Set A
uggagugguggaggauggaaugg

SEQ ID NO: 26419 - RNA, 21 nt, Artificial Sequence
  Synthetic Oligonucleotide; PRDM1 exon 5; Set A
ggagugguggaggauggaaug

SEQ ID NO: 26420 - RNA, 19 nt, Artificial Sequence
  Synthetic Oligonucleotide; PRDM1 exon 5; Set C
gagugguggaggauggaau

SEQ ID NO: 26421 - RNA, 17 nt, Artificial Sequence
  Synthetic Oligonucleotide; PRDM1 exon 5; Set C
agugguggaggauggaa

SEQ ID NO: 26422 - RNA, 15 nt, Artificial Sequence
  Synthetic Oligonucleotide; PRDM1 exon 5; Set C
gugguggaggaugga

SEQ ID NO: 26423 - RNA, 24 nt, Artificial Sequence
  Synthetic Oligonucleotide; PRDM1 exon 5; Set A
uuggagugguggaggauggaaugg

SEQ ID NO: 26424 - RNA, 22 nt, Artificial Sequence
  Synthetic Oligonucleotide; PRDM1 exon 5; Set A
uggagugguggaggauggaaug

SEQ ID NO: 26425 - RNA, 20 nt, Artificial Sequence
  Synthetic Oligonucleotide; PRDM1 exon 5; Set A
ggagugguggaggauggaau

SEQ ID NO: 26426 - RNA, 18 nt, Artificial Sequence
  Synthetic Oligonucleotide; PRDM1 exon 5; Set C
gagugguggaggauggaa

SEQ ID NO: 26427 - RNA, 16 nt, Artificial Sequence
  Synthetic Oligonucleotide; PRDM1 exon 5; Set C
agugguggaggaugga

SEQ ID NO: 26428 - RNA, 23 nt, Artificial Sequence
  Synthetic Oligonucleotide; PRDM1 exon 5; Set A
uuggagugguggaggauggaaug

SEQ ID NO: 26429 - RNA, 21 nt, Artificial Sequence
  Synthetic Oligonucleotide; PRDM1 exon 5; Set A
uggagugguggaggauggaau

SEQ ID NO: 26430 - RNA, 19 nt, Artificial Sequence
  Synthetic Oligonucleotide; PRDM1 exon 5; Set A
ggagugguggaggauggaa

SEQ ID NO: 26431 - RNA, 17 nt, Artificial Sequence
  Synthetic Oligonucleotide; PRDM1 exon 5; Set C
gagugguggaggaugga

SEQ ID NO: 26432 - RNA, 15 nt, Artificial Sequence
  Synthetic Oligonucleotide; PRDM1 exon 5; Set C
agugguggaggaugg

SEQ ID NO: 26433 - RNA, 22 nt, Artificial Sequence
  Synthetic Oligonucleotide; PRDM1 exon 5; Set A
uuggagugguggaggauggaau

SEQ ID NO: 26434 - RNA, 20 nt, Artificial Sequence
  Synthetic Oligonucleotide; PRDM1 exon 5; Set A
uggagugguggaggauggaa

SEQ ID NO: 26435 - RNA, 18 nt, Artificial Sequence
  Synthetic Oligonucleotide; PRDM1 exon 5; Set A
ggagugguggaggaugga

SEQ ID NO: 26436 - RNA, 16 nt, Artificial Sequence
  Synthetic Oligonucleotide; PRDM1 exon 5; Set C
gagugguggaggaugg

SEQ ID NO: 26437 - RNA, 21 nt, Artificial Sequence
  Synthetic Oligonucleotide; PRDM1 exon 5; Set A
uuggagugguggaggauggaa

SEQ ID NO: 26438 - RNA, 15 nt, Artificial Sequence
  Synthetic Oligonucleotide; PRDM1 exon 5; Set C
gagugguggaggaug

SEQ ID NO: 26439 - RNA, 19 nt, Artificial Sequence
  Synthetic Oligonucleotide; PRDM1 exon 5; Set A
uggagugguggaggaugga

SEQ ID NO: 26440 - RNA, 17 nt, Artificial Sequence
  Synthetic Oligonucleotide; PRDM1 exon 5; Set C
ggagugguggaggaugg

SEQ ID NO: 26441 - RNA, 16 nt, Artificial Sequence
  Synthetic Oligonucleotide; PRDM1 exon 5; Set C
ggagugguggaggaug

SEQ ID NO: 26442 - RNA, 20 nt, Artificial Sequence
  Synthetic Oligonucleotide; PRDM1 exon 5; Set A
uuggagugguggaggaugga

SEQ ID NO: 26443 - RNA, 18 nt, Artificial Sequence
  Synthetic Oligonucleotide; PRDM1 exon 5; Set C
uggagugguggaggaugg

SEQ ID NO: 26444 - RNA, 15 nt, Artificial Sequence
  Synthetic Oligonucleotide; PRDM1 exon 5; Set C
ggagugguggaggau

SEQ ID NO: 26445 - RNA, 17 nt, Artificial Sequence
  Synthetic Oligonucleotide; PRDM1 exon 5; Set C
uggagugguggaggaug

SEQ ID NO: 26446 - RNA, 19 nt, Artificial Sequence
  Synthetic Oligonucleotide; PRDM1 exon 5; Set C
uuggagugguggaggaugg

SEQ ID NO: 26447 - RNA, 16 nt, Artificial Sequence
  Synthetic Oligonucleotide; PRDM1 exon 5; Set C
uggagugguggaggau

SEQ ID NO: 26448 - RNA, 18 nt, Artificial Sequence
  Synthetic Oligonucleotide; PRDM1 exon 5; Set C
uuggagugguggaggaug

SEQ ID NO: 26449 - RNA, 17 nt, Artificial Sequence
  Synthetic Oligonucleotide; PRDM1 exon 5; Set C
uuggagugguggaggau

SEQ ID NO: 26450 - RNA, 15 nt, Artificial Sequence
  Synthetic Oligonucleotide; PRDM1 exon 5; Set C
uggagugguggagga

SEQ ID NO: 26451 - RNA, 16 nt, Artificial Sequence
  Synthetic Oligonucleotide; PRDM1 exon 5; Set C
uuggagugguggagga

SEQ ID NO: 26452 - RNA, 15 nt, Artificial Sequence
  Synthetic Oligonucleotide; PRDM1 exon 5; Set C
uuggagugguggagg

SEQ ID NO: 26453 - RNA, 37 nt, Artificial Sequence
  Synthetic Oligonucleotide; PRDM1 exon 5; Set C
cuugcagaggggcuuggagugguggaggauggaaugg

SEQ ID NO: 26454 - RNA, 38 nt, Artificial Sequence
  Synthetic Oligonucleotide; PRDM1 exon 5; Set C
ucuugcagaggggcuuggagugguggaggauggaaugg

SEQ ID NO: 26455 - RNA, 36 nt, Artificial Sequence
  Synthetic Oligonucleotide; PRDM1 exon 5; Set C
cuugcagaggggcuuggagugguggaggauggaaug

SEQ ID NO: 26456 - RNA, 39 nt, Artificial Sequence
  Synthetic Oligonucleotide; PRDM1 exon 5; Set C
uucuugcagaggggcuuggagugguggaggauggaaugg

SEQ ID NO: 26457 - RNA, 37 nt, Artificial Sequence
  Synthetic Oligonucleotide; PRDM1 exon 5; Set C
ucuugcagaggggcuuggagugguggaggauggaaug

SEQ ID NO: 26458 - RNA, 35 nt, Artificial Sequence
  Synthetic Oligonucleotide; PRDM1 exon 5; Set C
cuugcagaggggcuuggagugguggaggauggaau

SEQ ID NO: 26459 - RNA, 38 nt, Artificial Sequence
  Synthetic Oligonucleotide; PRDM1 exon 5; Set C
uucuugcagaggggcuuggagugguggaggauggaaug

SEQ ID NO: 26460 - RNA, 36 nt, Artificial Sequence
  Synthetic Oligonucleotide; PRDM1 exon 5; Set C
ucuugcagaggggcuuggagugguggaggauggaau

SEQ ID NO: 26461 - RNA, 34 nt, Artificial Sequence
  Synthetic Oligonucleotide; PRDM1 exon 5; Set C
cuugcagaggggcuuggagugguggaggauggaa

SEQ ID NO: 26462 - RNA, 37 nt, Artificial Sequence
  Synthetic Oligonucleotide; PRDM1 exon 5; Set C
uucuugcagaggggcuuggagugguggaggauggaau

SEQ ID NO: 26463 - RNA, 35 nt, Artificial Sequence
  Synthetic Oligonucleotide; PRDM1 exon 5; Set C
ucuugcagaggggcuuggagugguggaggauggaa

SEQ ID NO: 26464 - RNA, 33 nt, Artificial Sequence
  Synthetic Oligonucleotide; PRDM1 exon 5; Set C
cuugcagaggggcuuggagugguggaggaugga

SEQ ID NO: 26465 - RNA, 36 nt, Artificial Sequence
  Synthetic Oligonucleotide; PRDM1 exon 5; Set C
uucuugcagaggggcuuggagugguggaggauggaa

SEQ ID NO: 26466 - RNA, 34 nt, Artificial Sequence
  Synthetic Oligonucleotide; PRDM1 exon 5; Set C
ucuugcagaggggcuuggagugguggaggaugga

SEQ ID NO: 26467 - RNA, 32 nt, Artificial Sequence
  Synthetic Oligonucleotide; PRDM1 exon 5; Set C
cuugcagaggggcuuggagugguggaggaugg

SEQ ID NO: 26468 - RNA, 31 nt, Artificial Sequence
  Synthetic Oligonucleotide; PRDM1 exon 5; Set C
cuugcagaggggcuuggagugguggaggaug

SEQ ID NO: 26469 - RNA, 35 nt, Artificial Sequence
  Synthetic Oligonucleotide; PRDM1 exon 5; Set C
uucuugcagaggggcuuggagugguggaggaugga

SEQ ID NO: 26470 - RNA, 33 nt, Artificial Sequence
  Synthetic Oligonucleotide; PRDM1 exon 5; Set C
ucuugcagaggggcuuggagugguggaggaugg

SEQ ID NO: 26471 - RNA, 30 nt, Artificial Sequence
  Synthetic Oligonucleotide; PRDM1 exon 5; Set C
cuugcagaggggcuuggagugguggaggau

SEQ ID NO: 26472 - RNA, 32 nt, Artificial Sequence
  Synthetic Oligonucleotide; PRDM1 exon 5; Set C
ucuugcagaggggcuuggagugguggaggaug

SEQ ID NO: 26473 - RNA, 34 nt, Artificial Sequence
  Synthetic Oligonucleotide; PRDM1 exon 5; Set C
uucuugcagaggggcuuggagugguggaggaugg

SEQ ID NO: 26474 - RNA, 31 nt, Artificial Sequence
  Synthetic Oligonucleotide; PRDM1 exon 5; Set C
ucuugcagaggggcuuggagugguggaggau

SEQ ID NO: 26475 - RNA, 29 nt, Artificial Sequence
  Synthetic Oligonucleotide; PRDM1 exon 5; Set C
cuugcagaggggcuuggagugguggagga

SEQ ID NO: 26476 - RNA, 33 nt, Artificial Sequence
  Synthetic Oligonucleotide; PRDM1 exon 5; Set C
uucuugcagaggggcuuggagugguggaggaug

SEQ ID NO: 26477 - RNA, 32 nt, Artificial Sequence
  Synthetic Oligonucleotide; PRDM1 exon 5; Set C
uucuugcagaggggcuuggagugguggaggau

SEQ ID NO: 26478 - RNA, 30 nt, Artificial Sequence
  Synthetic Oligonucleotide; PRDM1 exon 5; Set C
ucuugcagaggggcuuggagugguggagga

SEQ ID NO: 26479 - RNA, 31 nt, Artificial Sequence
  Synthetic Oligonucleotide; PRDM1 exon 5; Set C
uucuugcagaggggcuuggagugguggagga

SEQ ID NO: 26480 - RNA, 29 nt, Artificial Sequence
  Synthetic Oligonucleotide; PRDM1 exon 5; Set C
ucuugcagaggggcuuggagugguggagg

SEQ ID NO: 26481 - RNA, 30 nt, Artificial Sequence
  Synthetic Oligonucleotide; PRDM1 exon 5; Set C
uucuugcagaggggcuuggagugguggagg

SEQ ID NO: 26482 - RNA, 29 nt, Artificial Sequence
  Synthetic Oligonucleotide; PRDM1 exon 5; Set C
uucuugcagaggggcuuggagugguggag

SEQ ID NO: 26483 - RNA, 15 nt, Artificial Sequence
  Synthetic Oligonucleotide; PRDM1 exon 5; Set C
ucaaguaagcguagg

SEQ ID NO: 26484 - RNA, 16 nt, Artificial Sequence
  Synthetic Oligonucleotide; PRDM1 exon 5; Set C
uucaaguaagcguagg

SEQ ID NO: 26485 - RNA, 17 nt, Artificial Sequence
  Synthetic Oligonucleotide; PRDM1 exon 5; Set C
guucaaguaagcguagg

SEQ ID NO: 26486 - RNA, 22 nt, Artificial Sequence
  Synthetic Oligonucleotide; PRDM1 exon 5; Set C
gggugcguagccaggguaggag

SEQ ID NO: 26487 - RNA, 21 nt, Artificial Sequence
  Synthetic Oligonucleotide; PRDM1 exon 5; Set C
gggugcguagccaggguagga

SEQ ID NO: 26488 - RNA, 23 nt, Artificial Sequence
  Synthetic Oligonucleotide; PRDM1 exon 5; Set C
ggggugcguagccaggguaggag

SEQ ID NO: 26489 - RNA, 20 nt, Artificial Sequence
  Synthetic Oligonucleotide; PRDM1 exon 5; Set C
gggugcguagccaggguagg

SEQ ID NO: 26490 - RNA, 22 nt, Artificial Sequence
  Synthetic Oligonucleotide; PRDM1 exon 5; Set C
ggggugcguagccaggguagga

SEQ ID NO: 26491 - RNA, 19 nt, Artificial Sequence
  Synthetic Oligonucleotide; PRDM1 exon 5; Set A
gggugcguagccaggguag

SEQ ID NO: 26492 - RNA, 21 nt, Artificial Sequence
  Synthetic Oligonucleotide; PRDM1 exon 5; Set C
ggggugcguagccaggguagg

SEQ ID NO: 26493 - RNA, 23 nt, Artificial Sequence
  Synthetic Oligonucleotide; PRDM1 exon 5; Set C
aggggugcguagccaggguagga

SEQ ID NO: 26494 - RNA, 20 nt, Artificial Sequence
  Synthetic Oligonucleotide; PRDM1 exon 5; Set C
ggggugcguagccaggguag

SEQ ID NO: 26495 - RNA, 22 nt, Artificial Sequence
  Synthetic Oligonucleotide; PRDM1 exon 5; Set C
aggggugcguagccaggguagg

SEQ ID NO: 26496 - RNA, 21 nt, Artificial Sequence
  Synthetic Oligonucleotide; PRDM1 exon 5; Set C
aggggugcguagccaggguag

SEQ ID NO: 26497 - RNA, 19 nt, Artificial Sequence
  Synthetic Oligonucleotide; PRDM1 exon 5; Set C
ggggugcguagccagggua

SEQ ID NO: 26498 - RNA, 29 nt, Artificial Sequence
  Synthetic Oligonucleotide; PRDM1 exon 5; Set C
uggggcaggggugcguagccaggguagga

SEQ ID NO: 26499 - RNA, 31 nt, Artificial Sequence
  Synthetic Oligonucleotide; PRDM1 exon 5; Set C
guggggcaggggugcguagccaggguaggag

SEQ ID NO: 26500 - RNA, 28 nt, Artificial Sequence
  Synthetic Oligonucleotide; PRDM1 exon 5; Set C
uggggcaggggugcguagccaggguagg

SEQ ID NO: 26501 - RNA, 30 nt, Artificial Sequence
  Synthetic Oligonucleotide; PRDM1 exon 5; Set C
guggggcaggggugcguagccaggguagga

SEQ ID NO: 26502 - RNA, 32 nt, Artificial Sequence
  Synthetic Oligonucleotide; PRDM1 exon 5; Set C
gguggggcaggggugcguagccaggguaggag

SEQ ID NO: 26503 - RNA, 27 nt, Artificial Sequence
  Synthetic Oligonucleotide; PRDM1 exon 5; Set C
uggggcaggggugcguagccaggguag

SEQ ID NO: 26504 - RNA, 29 nt, Artificial Sequence
  Synthetic Oligonucleotide; PRDM1 exon 5; Set C
guggggcaggggugcguagccaggguagg

SEQ ID NO: 26505 - RNA, 31 nt, Artificial Sequence
  Synthetic Oligonucleotide; PRDM1 exon 5; Set C
gguggggcaggggugcguagccaggguagga

SEQ ID NO: 26506 - RNA, 33 nt, Artificial Sequence
  Synthetic Oligonucleotide; PRDM1 exon 5; Set C
agguggggcaggggugcguagccaggguaggag

SEQ ID NO: 26507 - RNA, 28 nt, Artificial Sequence
  Synthetic Oligonucleotide; PRDM1 exon 5; Set C
guggggcaggggugcguagccaggguag

SEQ ID NO: 26508 - RNA, 26 nt, Artificial Sequence
  Synthetic Oligonucleotide; PRDM1 exon 5; Set C
uggggcaggggugcguagccagggua

SEQ ID NO: 26509 - RNA, 30 nt, Artificial Sequence
  Synthetic Oligonucleotide; PRDM1 exon 5; Set C
gguggggcaggggugcguagccaggguagg

SEQ ID NO: 26510 - RNA, 32 nt, Artificial Sequence
  Synthetic Oligonucleotide; PRDM1 exon 5; Set C
agguggggcaggggugcguagccaggguagga

SEQ ID NO: 26511 - RNA, 29 nt, Artificial Sequence
  Synthetic Oligonucleotide; PRDM1 exon 5; Set C
gguggggcaggggugcguagccaggguag

SEQ ID NO: 26512 - RNA, 27 nt, Artificial Sequence
  Synthetic Oligonucleotide; PRDM1 exon 5; Set C
guggggcaggggugcguagccagggua

SEQ ID NO: 26513 - RNA, 31 nt, Artificial Sequence
  Synthetic Oligonucleotide; PRDM1 exon 5; Set C
agguggggcaggggugcguagccaggguagg

SEQ ID NO: 26514 - RNA, 30 nt, Artificial Sequence
  Synthetic Oligonucleotide; PRDM1 exon 5; Set C
agguggggcaggggugcguagccaggguag

SEQ ID NO: 26515 - RNA, 28 nt, Artificial Sequence
  Synthetic Oligonucleotide; PRDM1 exon 5; Set C
gguggggcaggggugcguagccagggua

SEQ ID NO: 26516 - RNA, 26 nt, Artificial Sequence
  Synthetic Oligonucleotide; PRDM1 exon 5; Set C
guggggcaggggugcguagccagggu

SEQ ID NO: 26517 - RNA, 29 nt, Artificial Sequence
  Synthetic Oligonucleotide; PRDM1 exon 5; Set C
agguggggcaggggugcguagccagggua

SEQ ID NO: 26518 - RNA, 27 nt, Artificial Sequence
  Synthetic Oligonucleotide; PRDM1 exon 5; Set C
gguggggcaggggugcguagccagggu

SEQ ID NO: 26519 - RNA, 28 nt, Artificial Sequence
  Synthetic Oligonucleotide; PRDM1 exon 5; Set C
agguggggcaggggugcguagccagggu

SEQ ID NO: 26520 - RNA, 15 nt, Artificial Sequence
  Synthetic Oligonucleotide; PRDM1 exon 5; Set A
gggcaggggugcgua

SEQ ID NO: 26521 - RNA, 16 nt, Artificial Sequence
  Synthetic Oligonucleotide; PRDM1 exon 5; Set A
ggggcaggggugcgua

SEQ ID NO: 26522 - RNA, 17 nt, Artificial Sequence
  Synthetic Oligonucleotide; PRDM1 exon 5; Set A
uggggcaggggugcgua

SEQ ID NO: 26523 - RNA, 15 nt, Artificial Sequence
  Synthetic Oligonucleotide; PRDM1 exon 5; Set A
ggggcaggggugcgu

SEQ ID NO: 26524 - RNA, 18 nt, Artificial Sequence
  Synthetic Oligonucleotide; PRDM1 exon 5; Set C
guggggcaggggugcgua

SEQ ID NO: 26525 - RNA, 16 nt, Artificial Sequence
  Synthetic Oligonucleotide; PRDM1 exon 5; Set A
uggggcaggggugcgu

SEQ ID NO: 26526 - RNA, 19 nt, Artificial Sequence
  Synthetic Oligonucleotide; PRDM1 exon 5; Set C
gguggggcaggggugcgua

SEQ ID NO: 26527 - RNA, 17 nt, Artificial Sequence
  Synthetic Oligonucleotide; PRDM1 exon 5; Set C
guggggcaggggugcgu

SEQ ID NO: 26528 - RNA, 15 nt, Artificial Sequence
  Synthetic Oligonucleotide; PRDM1 exon 5; Set A
uggggcaggggugcg

SEQ ID NO: 26529 - RNA, 20 nt, Artificial Sequence
  Synthetic Oligonucleotide; PRDM1 exon 5; Set C
agguggggcaggggugcgua

SEQ ID NO: 26530 - RNA, 18 nt, Artificial Sequence
  Synthetic Oligonucleotide; PRDM1 exon 5; Set C
gguggggcaggggugcgu

SEQ ID NO: 26531 - RNA, 16 nt, Artificial Sequence
  Synthetic Oligonucleotide; PRDM1 exon 5; Set A
guggggcaggggugcg

SEQ ID NO: 26532 - RNA, 19 nt, Artificial Sequence
  Synthetic Oligonucleotide; PRDM1 exon 5; Set C
agguggggcaggggugcgu

SEQ ID NO: 26533 - RNA, 15 nt, Artificial Sequence
  Synthetic Oligonucleotide; PRDM1 exon 5; Set A
guggggcaggggugc

SEQ ID NO: 26534 - RNA, 17 nt, Artificial Sequence
  Synthetic Oligonucleotide; PRDM1 exon 5; Set C
gguggggcaggggugcg

SEQ ID NO: 26535 - RNA, 16 nt, Artificial Sequence
  Synthetic Oligonucleotide; PRDM1 exon 5; Set A
gguggggcaggggugc

SEQ ID NO: 26536 - RNA, 18 nt, Artificial Sequence
  Synthetic Oligonucleotide; PRDM1 exon 5; Set C
agguggggcaggggugcg

SEQ ID NO: 26537 - RNA, 17 nt, Artificial Sequence
  Synthetic Oligonucleotide; PRDM1 exon 5; Set A
agguggggcaggggugc

SEQ ID NO: 26538 - RNA, 15 nt, Artificial Sequence
  Synthetic Oligonucleotide; PRDM1 exon 5; Set A
gguggggcaggggug

SEQ ID NO: 26539 - RNA, 16 nt, Artificial Sequence
  Synthetic Oligonucleotide; PRDM1 exon 5; Set A
agguggggcaggggug

SEQ ID NO: 26540 - RNA, 15 nt, Artificial Sequence
  Synthetic Oligonucleotide; PRDM1 exon 5; Set A
agguggggcaggggu

SEQ ID NO: 26541 - RNA, 31 nt, Artificial Sequence
  Synthetic Oligonucleotide; PRDM1 exon 5; Set C
aagcuggcgggagguggggcaggggugcgua

SEQ ID NO: 26542 - RNA, 32 nt, Artificial Sequence
  Synthetic Oligonucleotide; PRDM1 exon 5; Set C
aaagcuggcgggagguggggcaggggugcgua

SEQ ID NO: 26543 - RNA, 30 nt, Artificial Sequence
  Synthetic Oligonucleotide; PRDM1 exon 5; Set C
aagcuggcgggagguggggcaggggugcgu

SEQ ID NO: 26544 - RNA, 33 nt, Artificial Sequence
  Synthetic Oligonucleotide; PRDM1 exon 5; Set C
gaaagcuggcgggagguggggcaggggugcgua

SEQ ID NO: 26545 - RNA, 31 nt, Artificial Sequence
  Synthetic Oligonucleotide; PRDM1 exon 5; Set C
aaagcuggcgggagguggggcaggggugcgu

SEQ ID NO: 26546 - RNA, 29 nt, Artificial Sequence
  Synthetic Oligonucleotide; PRDM1 exon 5; Set C
aagcuggcgggagguggggcaggggugcg

SEQ ID NO: 26547 - RNA, 34 nt, Artificial Sequence
  Synthetic Oligonucleotide; PRDM1 exon 5; Set C
ugaaagcuggcgggagguggggcaggggugcgua

SEQ ID NO: 26548 - RNA, 32 nt, Artificial Sequence
  Synthetic Oligonucleotide; PRDM1 exon 5; Set C
gaaagcuggcgggagguggggcaggggugcgu

SEQ ID NO: 26549 - RNA, 28 nt, Artificial Sequence
  Synthetic Oligonucleotide; PRDM1 exon 5; Set C
aagcuggcgggagguggggcaggggugc

SEQ ID NO: 26550 - RNA, 30 nt, Artificial Sequence
  Synthetic Oligonucleotide; PRDM1 exon 5; Set C
aaagcuggcgggagguggggcaggggugcg

SEQ ID NO: 26551 - RNA, 35 nt, Artificial Sequence
  Synthetic Oligonucleotide; PRDM1 exon 5; Set C
augaaagcuggcgggagguggggcaggggugcgua

SEQ ID NO: 26552 - RNA, 33 nt, Artificial Sequence
  Synthetic Oligonucleotide; PRDM1 exon 5; Set C
ugaaagcuggcgggagguggggcaggggugcgu

SEQ ID NO: 26553 - RNA, 29 nt, Artificial Sequence
  Synthetic Oligonucleotide; PRDM1 exon 5; Set C
aaagcuggcgggagguggggcaggggugc

SEQ ID NO: 26554 - RNA, 27 nt, Artificial Sequence
  Synthetic Oligonucleotide; PRDM1 exon 5; Set C
aagcuggcgggagguggggcaggggug

SEQ ID NO: 26555 - RNA, 31 nt, Artificial Sequence
  Synthetic Oligonucleotide; PRDM1 exon 5; Set C
gaaagcuggcgggagguggggcaggggugcg

SEQ ID NO: 26556 - RNA, 36 nt, Artificial Sequence
  Synthetic Oligonucleotide; PRDM1 exon 5; Set C
gaugaaagcuggcgggagguggggcaggggugcgua

SEQ ID NO: 26557 - RNA, 34 nt, Artificial Sequence
  Synthetic Oligonucleotide; PRDM1 exon 5; Set C
augaaagcuggcgggagguggggcaggggugcgu

SEQ ID NO: 26558 - RNA, 30 nt, Artificial Sequence
  Synthetic Oligonucleotide; PRDM1 exon 5; Set C
gaaagcuggcgggagguggggcaggggugc

SEQ ID NO: 26559 - RNA, 28 nt, Artificial Sequence
  Synthetic Oligonucleotide; PRDM1 exon 5; Set C
aaagcuggcgggagguggggcaggggug

SEQ ID NO: 26560 - RNA, 32 nt, Artificial Sequence
  Synthetic Oligonucleotide; PRDM1 exon 5; Set C
ugaaagcuggcgggagguggggcaggggugcg

SEQ ID NO: 26561 - RNA, 37 nt, Artificial Sequence
  Synthetic Oligonucleotide; PRDM1 exon 5; Set C
ggaugaaagcuggcgggagguggggcaggggugcgua

SEQ ID NO: 26562 - RNA, 35 nt, Artificial Sequence
  Synthetic Oligonucleotide; PRDM1 exon 5; Set C
gaugaaagcuggcgggagguggggcaggggugcgu

SEQ ID NO: 26563 - RNA, 31 nt, Artificial Sequence
  Synthetic Oligonucleotide; PRDM1 exon 5; Set C
ugaaagcuggcgggagguggggcaggggugc

SEQ ID NO: 26564 - RNA, 29 nt, Artificial Sequence
  Synthetic Oligonucleotide; PRDM1 exon 5; Set C
gaaagcuggcgggagguggggcaggggug

SEQ ID NO: 26565 - RNA, 33 nt, Artificial Sequence
  Synthetic Oligonucleotide; PRDM1 exon 5; Set C
augaaagcuggcgggagguggggcaggggugcg

SEQ ID NO: 26566 - RNA, 38 nt, Artificial Sequence
  Synthetic Oligonucleotide; PRDM1 exon 5; Set C
gggaugaaagcuggcgggagguggggcaggggugcgua

SEQ ID NO: 26567 - RNA, 36 nt, Artificial Sequence
  Synthetic Oligonucleotide; PRDM1 exon 5; Set C
ggaugaaagcuggcgggagguggggcaggggugcgu

SEQ ID NO: 26568 - RNA, 32 nt, Artificial Sequence
  Synthetic Oligonucleotide; PRDM1 exon 5; Set C
augaaagcuggcgggagguggggcaggggugc

SEQ ID NO: 26569 - RNA, 30 nt, Artificial Sequence
  Synthetic Oligonucleotide; PRDM1 exon 5; Set C
ugaaagcuggcgggagguggggcaggggug

SEQ ID NO: 26570 - RNA, 34 nt, Artificial Sequence
  Synthetic Oligonucleotide; PRDM1 exon 5; Set C
gaugaaagcuggcgggagguggggcaggggugcg

SEQ ID NO: 26571 - RNA, 37 nt, Artificial Sequence
  Synthetic Oligonucleotide; PRDM1 exon 5; Set C
gggaugaaagcuggcgggagguggggcaggggugcgu

SEQ ID NO: 26572 - RNA, 33 nt, Artificial Sequence
  Synthetic Oligonucleotide; PRDM1 exon 5; Set C
gaugaaagcuggcgggagguggggcaggggugc

SEQ ID NO: 26573 - RNA, 31 nt, Artificial Sequence
  Synthetic Oligonucleotide; PRDM1 exon 5; Set C
augaaagcuggcgggagguggggcaggggug

SEQ ID NO: 26574 - RNA, 35 nt, Artificial Sequence
  Synthetic Oligonucleotide; PRDM1 exon 5; Set C
ggaugaaagcuggcgggagguggggcaggggugcg

SEQ ID NO: 26575 - RNA, 34 nt, Artificial Sequence
  Synthetic Oligonucleotide; PRDM1 exon 5; Set C
ggaugaaagcuggcgggagguggggcaggggugc

SEQ ID NO: 26576 - RNA, 32 nt, Artificial Sequence
  Synthetic Oligonucleotide; PRDM1 exon 5; Set C
gaugaaagcuggcgggagguggggcaggggug

SEQ ID NO: 26577 - RNA, 28 nt, Artificial Sequence
  Synthetic Oligonucleotide; PRDM1 exon 5; Set C
ugaaagcuggcgggagguggggcagggg

SEQ ID NO: 26578 - RNA, 36 nt, Artificial Sequence
  Synthetic Oligonucleotide; PRDM1 exon 5; Set C
gggaugaaagcuggcgggagguggggcaggggugcg

SEQ ID NO: 26579 - RNA, 30 nt, Artificial Sequence
  Synthetic Oligonucleotide; PRDM1 exon 5; Set C
augaaagcuggcgggagguggggcaggggu

SEQ ID NO: 26580 - RNA, 35 nt, Artificial Sequence
  Synthetic Oligonucleotide; PRDM1 exon 5; Set C
gggaugaaagcuggcgggagguggggcaggggugc

SEQ ID NO: 26581 - RNA, 33 nt, Artificial Sequence
  Synthetic Oligonucleotide; PRDM1 exon 5; Set C
ggaugaaagcuggcgggagguggggcaggggug

SEQ ID NO: 26582 - RNA, 29 nt, Artificial Sequence
  Synthetic Oligonucleotide; PRDM1 exon 5; Set C
augaaagcuggcgggagguggggcagggg

SEQ ID NO: 26583 - RNA, 31 nt, Artificial Sequence
  Synthetic Oligonucleotide; PRDM1 exon 5; Set C
gaugaaagcuggcgggagguggggcaggggu

SEQ ID NO: 26584 - RNA, 34 nt, Artificial Sequence
  Synthetic Oligonucleotide; PRDM1 exon 5; Set C
gggaugaaagcuggcgggagguggggcaggggug

SEQ ID NO: 26585 - RNA, 30 nt, Artificial Sequence
  Synthetic Oligonucleotide; PRDM1 exon 5; Set C
gaugaaagcuggcgggagguggggcagggg

SEQ ID NO: 26586 - RNA, 28 nt, Artificial Sequence
  Synthetic Oligonucleotide; PRDM1 exon 5; Set C
augaaagcuggcgggagguggggcaggg

SEQ ID NO: 26587 - RNA, 32 nt, Artificial Sequence
  Synthetic Oligonucleotide; PRDM1 exon 5; Set C
ggaugaaagcuggcgggagguggggcaggggu

SEQ ID NO: 26588 - RNA, 31 nt, Artificial Sequence
  Synthetic Oligonucleotide; PRDM1 exon 5; Set C
ggaugaaagcuggcgggagguggggcagggg

SEQ ID NO: 26589 - RNA, 29 nt, Artificial Sequence
  Synthetic Oligonucleotide; PRDM1 exon 5; Set C
gaugaaagcuggcgggagguggggcaggg

SEQ ID NO: 26590 - RNA, 33 nt, Artificial Sequence
  Synthetic Oligonucleotide; PRDM1 exon 5; Set C
gggaugaaagcuggcgggagguggggcaggggu

SEQ ID NO: 26591 - RNA, 27 nt, Artificial Sequence
  Synthetic Oligonucleotide; PRDM1 exon 5; Set C
augaaagcuggcgggagguggggcagg

SEQ ID NO: 26592 - RNA, 32 nt, Artificial Sequence
  Synthetic Oligonucleotide; PRDM1 exon 5; Set C
gggaugaaagcuggcgggagguggggcagggg

SEQ ID NO: 26593 - RNA, 30 nt, Artificial Sequence
  Synthetic Oligonucleotide; PRDM1 exon 5; Set C
ggaugaaagcuggcgggagguggggcaggg

SEQ ID NO: 26594 - RNA, 40 nt, Artificial Sequence
  Synthetic Oligonucleotide; PRDM1 exon 5; Set C
cgaggggaugaaagcuggcgggagguggggcaggggugcg

SEQ ID NO: 26595 - RNA, 28 nt, Artificial Sequence
  Synthetic Oligonucleotide; PRDM1 exon 5; Set C
gaugaaagcuggcgggagguggggcagg

SEQ ID NO: 26596 - RNA, 39 nt, Artificial Sequence
  Synthetic Oligonucleotide; PRDM1 exon 5; Set C
cgaggggaugaaagcuggcgggagguggggcaggggugc

SEQ ID NO: 26597 - RNA, 31 nt, Artificial Sequence
  Synthetic Oligonucleotide; PRDM1 exon 5; Set C
gggaugaaagcuggcgggagguggggcaggg

SEQ ID NO: 26598 - RNA, 29 nt, Artificial Sequence
  Synthetic Oligonucleotide; PRDM1 exon 5; Set C
ggaugaaagcuggcgggagguggggcagg

SEQ ID NO: 26599 - RNA, 38 nt, Artificial Sequence
  Synthetic Oligonucleotide; PRDM1 exon 5; Set C
cgaggggaugaaagcuggcgggagguggggcaggggug

SEQ ID NO: 26600 - RNA, 30 nt, Artificial Sequence
  Synthetic Oligonucleotide; PRDM1 exon 5; Set C
gggaugaaagcuggcgggagguggggcagg

SEQ ID NO: 26601 - RNA, 37 nt, Artificial Sequence
  Synthetic Oligonucleotide; PRDM1 exon 5; Set C
cgaggggaugaaagcuggcgggagguggggcaggggu

SEQ ID NO: 26602 - RNA, 36 nt, Artificial Sequence
  Synthetic Oligonucleotide; PRDM1 exon 5; Set C
cgaggggaugaaagcuggcgggagguggggcagggg

SEQ ID NO: 26603 - RNA, 35 nt, Artificial Sequence
  Synthetic Oligonucleotide; PRDM1 exon 5; Set C
cgaggggaugaaagcuggcgggagguggggcaggg

SEQ ID NO: 26604 - RNA, 34 nt, Artificial Sequence
  Synthetic Oligonucleotide; PRDM1 exon 5; Set C
cgaggggaugaaagcuggcgggagguggggcagg

SEQ ID NO: 26605 - RNA, 16 nt, Artificial Sequence
  Synthetic Oligonucleotide; PRDM1 exon 5; Set C
cgaggggaugaaagcu

SEQ ID NO: 26606 - RNA, 15 nt, Artificial Sequence
  Synthetic Oligonucleotide; PRDM1 exon 5; Set C
cgaggggaugaaagc

SEQ ID NO: 26607 - RNA, 15 nt, Artificial Sequence
  Synthetic Oligonucleotide; PRDM1 exon 5; Set C
acgaggggaugaaag

SEQ ID NO: 26608 - RNA, 40 nt, Artificial Sequence
  Synthetic Oligonucleotide; PRDM1 exon 5; Set C
uagugagcguuguacgaggggaugaaagcuggcgggaggu

SEQ ID NO: 26609 - RNA, 39 nt, Artificial Sequence
  Synthetic Oligonucleotide; PRDM1 exon 5; Set C
uagugagcguuguacgaggggaugaaagcuggcgggagg

SEQ ID NO: 26610 - RNA, 40 nt, Artificial Sequence
  Synthetic Oligonucleotide; PRDM1 exon 5; Set C
guagugagcguuguacgaggggaugaaagcuggcgggagg

SEQ ID NO: 26611 - RNA, 22 nt, Artificial Sequence
  Synthetic Oligonucleotide; PRDM1 exon 5; Set A
guuguacgaggggaugaaagcu

SEQ ID NO: 26612 - RNA, 21 nt, Artificial Sequence
  Synthetic Oligonucleotide; PRDM1 exon 5; Set C
guuguacgaggggaugaaagc

SEQ ID NO: 26613 - RNA, 20 nt, Artificial Sequence
  Synthetic Oligonucleotide; PRDM1 exon 5; Set C
guuguacgaggggaugaaag

SEQ ID NO: 26614 - RNA, 21 nt, Artificial Sequence
  Synthetic Oligonucleotide; PRDM1 exon 5; Set C
cguuguacgaggggaugaaag

SEQ ID NO: 26615 - RNA, 19 nt, Artificial Sequence
  Synthetic Oligonucleotide; PRDM1 exon 5; Set C
guuguacgaggggaugaaa

SEQ ID NO: 26616 - RNA, 22 nt, Artificial Sequence
  Synthetic Oligonucleotide; PRDM1 exon 5; Set A
gcguuguacgaggggaugaaag

SEQ ID NO: 26617 - RNA, 18 nt, Artificial Sequence
  Synthetic Oligonucleotide; PRDM1 exon 5; Set C
guuguacgaggggaugaa

SEQ ID NO: 26618 - RNA, 20 nt, Artificial Sequence
  Synthetic Oligonucleotide; PRDM1 exon 5; Set C
cguuguacgaggggaugaaa

SEQ ID NO: 26619 - RNA, 23 nt, Artificial Sequence
  Synthetic Oligonucleotide; PRDM1 exon 5; Set A
agcguuguacgaggggaugaaag

SEQ ID NO: 26620 - RNA, 17 nt, Artificial Sequence
  Synthetic Oligonucleotide; PRDM1 exon 5; Set C
guuguacgaggggauga

SEQ ID NO: 26621 - RNA, 19 nt, Artificial Sequence
  Synthetic Oligonucleotide; PRDM1 exon 5; Set C
cguuguacgaggggaugaa

SEQ ID NO: 26622 - RNA, 21 nt, Artificial Sequence
  Synthetic Oligonucleotide; PRDM1 exon 5; Set A
gcguuguacgaggggaugaaa

SEQ ID NO: 26623 - RNA, 16 nt, Artificial Sequence
  Synthetic Oligonucleotide; PRDM1 exon 5; Set C
guuguacgaggggaug

SEQ ID NO: 26624 - RNA, 24 nt, Artificial Sequence
  Synthetic Oligonucleotide; PRDM1 exon 5; Set A
gagcguuguacgaggggaugaaag

SEQ ID NO: 26625 - RNA, 18 nt, Artificial Sequence
  Synthetic Oligonucleotide; PRDM1 exon 5; Set C
cguuguacgaggggauga

SEQ ID NO: 26626 - RNA, 22 nt, Artificial Sequence
  Synthetic Oligonucleotide; PRDM1 exon 5; Set A
agcguuguacgaggggaugaaa

SEQ ID NO: 26627 - RNA, 20 nt, Artificial Sequence
  Synthetic Oligonucleotide; PRDM1 exon 5; Set A
gcguuguacgaggggaugaa

SEQ ID NO: 26628 - RNA, 15 nt, Artificial Sequence
  Synthetic Oligonucleotide; PRDM1 exon 5; Set C
guuguacgaggggau

SEQ ID NO: 26629 - RNA, 17 nt, Artificial Sequence
  Synthetic Oligonucleotide; PRDM1 exon 5; Set C
cguuguacgaggggaug

SEQ ID NO: 26630 - RNA, 25 nt, Artificial Sequence
  Synthetic Oligonucleotide; PRDM1 exon 5; Set A
ugagcguuguacgaggggaugaaag

SEQ ID NO: 26631 - RNA, 23 nt, Artificial Sequence
  Synthetic Oligonucleotide; PRDM1 exon 5; Set A
gagcguuguacgaggggaugaaa

SEQ ID NO: 26632 - RNA, 21 nt, Artificial Sequence
  Synthetic Oligonucleotide; PRDM1 exon 5; Set A
agcguuguacgaggggaugaa

SEQ ID NO: 26633 - RNA, 19 nt, Artificial Sequence
  Synthetic Oligonucleotide; PRDM1 exon 5; Set A
gcguuguacgaggggauga

SEQ ID NO: 26634 - RNA, 29 nt, Artificial Sequence
  Synthetic Oligonucleotide; PRDM1 exon 5; Set C
agugagcguuguacgaggggaugaaagcu

SEQ ID NO: 26635 - RNA, 16 nt, Artificial Sequence
  Synthetic Oligonucleotide; PRDM1 exon 5; Set C
cguuguacgaggggau

SEQ ID NO: 26636 - RNA, 18 nt, Artificial Sequence
  Synthetic Oligonucleotide; PRDM1 exon 5; Set A
gcguuguacgaggggaug

SEQ ID NO: 26637 - RNA, 26 nt, Artificial Sequence
  Synthetic Oligonucleotide; PRDM1 exon 5; Set A
gugagcguuguacgaggggaugaaag

SEQ ID NO: 26638 - RNA, 24 nt, Artificial Sequence
  Synthetic Oligonucleotide; PRDM1 exon 5; Set A
ugagcguuguacgaggggaugaaa

SEQ ID NO: 26639 - RNA, 22 nt, Artificial Sequence
  Synthetic Oligonucleotide; PRDM1 exon 5; Set A
gagcguuguacgaggggaugaa

SEQ ID NO: 26640 - RNA, 20 nt, Artificial Sequence
  Synthetic Oligonucleotide; PRDM1 exon 5; Set A
agcguuguacgaggggauga

SEQ ID NO: 26641 - RNA, 28 nt, Artificial Sequence
  Synthetic Oligonucleotide; PRDM1 exon 5; Set A
agugagcguuguacgaggggaugaaagc

SEQ ID NO: 26642 - RNA, 30 nt, Artificial Sequence
  Synthetic Oligonucleotide; PRDM1 exon 5; Set C
uagugagcguuguacgaggggaugaaagcu

SEQ ID NO: 26643 - RNA, 15 nt, Artificial Sequence
  Synthetic Oligonucleotide; PRDM1 exon 5; Set C
cguuguacgagggga

SEQ ID NO: 26644 - RNA, 17 nt, Artificial Sequence
  Synthetic Oligonucleotide; PRDM1 exon 5; Set C
gcguuguacgaggggau

SEQ ID NO: 26645 - RNA, 19 nt, Artificial Sequence
  Synthetic Oligonucleotide; PRDM1 exon 5; Set A
agcguuguacgaggggaug

SEQ ID NO: 26646 - RNA, 27 nt, Artificial Sequence
  Synthetic Oligonucleotide; PRDM1 exon 5; Set A
agugagcguuguacgaggggaugaaag

SEQ ID NO: 26647 - RNA, 25 nt, Artificial Sequence
  Synthetic Oligonucleotide; PRDM1 exon 5; Set A
gugagcguuguacgaggggaugaaa

SEQ ID NO: 26648 - RNA, 23 nt, Artificial Sequence
  Synthetic Oligonucleotide; PRDM1 exon 5; Set A
ugagcguuguacgaggggaugaa

SEQ ID NO: 26649 - RNA, 21 nt, Artificial Sequence
  Synthetic Oligonucleotide; PRDM1 exon 5; Set A
gagcguuguacgaggggauga

SEQ ID NO: 26650 - RNA, 29 nt, Artificial Sequence
  Synthetic Oligonucleotide; PRDM1 exon 5; Set C
uagugagcguuguacgaggggaugaaagc

SEQ ID NO: 26651 - RNA, 31 nt, Artificial Sequence
  Synthetic Oligonucleotide; PRDM1 exon 5; Set C
guagugagcguuguacgaggggaugaaagcu

SEQ ID NO: 26652 - RNA, 18 nt, Artificial Sequence
  Synthetic Oligonucleotide; PRDM1 exon 5; Set A
agcguuguacgaggggau

SEQ ID NO: 26653 - RNA, 16 nt, Artificial Sequence
  Synthetic Oligonucleotide; PRDM1 exon 5; Set C
gcguuguacgagggga

SEQ ID NO: 26654 - RNA, 20 nt, Artificial Sequence
  Synthetic Oligonucleotide; PRDM1 exon 5; Set A
gagcguuguacgaggggaug

SEQ ID NO: 26655 - RNA, 28 nt, Artificial Sequence
  Synthetic Oligonucleotide; PRDM1 exon 5; Set A
uagugagcguuguacgaggggaugaaag

SEQ ID NO: 26656 - RNA, 26 nt, Artificial Sequence
  Synthetic Oligonucleotide; PRDM1 exon 5; Set A
agugagcguuguacgaggggaugaaa

SEQ ID NO: 26657 - RNA, 24 nt, Artificial Sequence
  Synthetic Oligonucleotide; PRDM1 exon 5; Set A
gugagcguuguacgaggggaugaa

SEQ ID NO: 26658 - RNA, 22 nt, Artificial Sequence
  Synthetic Oligonucleotide; PRDM1 exon 5; Set A
ugagcguuguacgaggggauga

SEQ ID NO: 26659 - RNA, 30 nt, Artificial Sequence
  Synthetic Oligonucleotide; PRDM1 exon 5; Set C
guagugagcguuguacgaggggaugaaagc

SEQ ID NO: 26660 - RNA, 32 nt, Artificial Sequence
  Synthetic Oligonucleotide; PRDM1 exon 5; Set C
gguagugagcguuguacgaggggaugaaagcu

SEQ ID NO: 26661 - RNA, 15 nt, Artificial Sequence
  Synthetic Oligonucleotide; PRDM1 exon 5; Set C
gcguuguacgagggg

SEQ ID NO: 26662 - RNA, 19 nt, Artificial Sequence
  Synthetic Oligonucleotide; PRDM1 exon 5; Set A
gagcguuguacgaggggau

SEQ ID NO: 26663 - RNA, 17 nt, Artificial Sequence
  Synthetic Oligonucleotide; PRDM1 exon 5; Set A
agcguuguacgagggga

SEQ ID NO: 26664 - RNA, 21 nt, Artificial Sequence
  Synthetic Oligonucleotide; PRDM1 exon 5; Set A
ugagcguuguacgaggggaug

SEQ ID NO: 26665 - RNA, 29 nt, Artificial Sequence
  Synthetic Oligonucleotide; PRDM1 exon 5; Set A
guagugagcguuguacgaggggaugaaag

SEQ ID NO: 26666 - RNA, 27 nt, Artificial Sequence
  Synthetic Oligonucleotide; PRDM1 exon 5; Set A
uagugagcguuguacgaggggaugaaa

SEQ ID NO: 26667 - RNA, 25 nt, Artificial Sequence
  Synthetic Oligonucleotide; PRDM1 exon 5; Set A
agugagcguuguacgaggggaugaa

SEQ ID NO: 26668 - RNA, 23 nt, Artificial Sequence
  Synthetic Oligonucleotide; PRDM1 exon 5; Set A
gugagcguuguacgaggggauga

SEQ ID NO: 26669 - RNA, 31 nt, Artificial Sequence
  Synthetic Oligonucleotide; PRDM1 exon 5; Set C
gguagugagcguuguacgaggggaugaaagc

SEQ ID NO: 26670 - RNA, 33 nt, Artificial Sequence
  Synthetic Oligonucleotide; PRDM1 exon 5; Set C
ggguagugagcguuguacgaggggaugaaagcu

SEQ ID NO: 26671 - RNA, 16 nt, Artificial Sequence
  Synthetic Oligonucleotide; PRDM1 exon 5; Set C
agcguuguacgagggg

SEQ ID NO: 26672 - RNA, 20 nt, Artificial Sequence
  Synthetic Oligonucleotide; PRDM1 exon 5; Set A
ugagcguuguacgaggggau

SEQ ID NO: 26673 - RNA, 18 nt, Artificial Sequence
  Synthetic Oligonucleotide; PRDM1 exon 5; Set A
gagcguuguacgagggga

SEQ ID NO: 26674 - RNA, 22 nt, Artificial Sequence
  Synthetic Oligonucleotide; PRDM1 exon 5; Set A
gugagcguuguacgaggggaug

SEQ ID NO: 26675 - RNA, 30 nt, Artificial Sequence
  Synthetic Oligonucleotide; PRDM1 exon 5; Set C
gguagugagcguuguacgaggggaugaaag

SEQ ID NO: 26676 - RNA, 26 nt, Artificial Sequence
  Synthetic Oligonucleotide; PRDM1 exon 5; Set A
uagugagcguuguacgaggggaugaa

SEQ ID NO: 26677 - RNA, 28 nt, Artificial Sequence
  Synthetic Oligonucleotide; PRDM1 exon 5; Set A
guagugagcguuguacgaggggaugaaa

SEQ ID NO: 26678 - RNA, 24 nt, Artificial Sequence
  Synthetic Oligonucleotide; PRDM1 exon 5; Set A
agugagcguuguacgaggggauga

SEQ ID NO: 26679 - RNA, 32 nt, Artificial Sequence
  Synthetic Oligonucleotide; PRDM1 exon 5; Set C
ggguagugagcguuguacgaggggaugaaagc

SEQ ID NO: 26680 - RNA, 34 nt, Artificial Sequence
  Synthetic Oligonucleotide; PRDM1 exon 5; Set C
gggguagugagcguuguacgaggggaugaaagcu

SEQ ID NO: 26681 - RNA, 17 nt, Artificial Sequence
  Synthetic Oligonucleotide; PRDM1 exon 5; Set C
gagcguuguacgagggg

SEQ ID NO: 26682 - RNA, 21 nt, Artificial Sequence
  Synthetic Oligonucleotide; PRDM1 exon 5; Set A
gugagcguuguacgaggggau

SEQ ID NO: 26683 - RNA, 19 nt, Artificial Sequence
  Synthetic Oligonucleotide; PRDM1 exon 5; Set A
ugagcguuguacgagggga

SEQ ID NO: 26684 - RNA, 23 nt, Artificial Sequence
  Synthetic Oligonucleotide; PRDM1 exon 5; Set A
agugagcguuguacgaggggaug

SEQ ID NO: 26685 - RNA, 31 nt, Artificial Sequence
  Synthetic Oligonucleotide; PRDM1 exon 5; Set C
ggguagugagcguuguacgaggggaugaaag

SEQ ID NO: 26686 - RNA, 25 nt, Artificial Sequence
  Synthetic Oligonucleotide; PRDM1 exon 5; Set A
uagugagcguuguacgaggggauga

SEQ ID NO: 26687 - RNA, 29 nt, Artificial Sequence
  Synthetic Oligonucleotide; PRDM1 exon 5; Set C
gguagugagcguuguacgaggggaugaaa

SEQ ID NO: 26688 - RNA, 27 nt, Artificial Sequence
  Synthetic Oligonucleotide; PRDM1 exon 5; Set C
guagugagcguuguacgaggggaugaa

SEQ ID NO: 26689 - RNA, 33 nt, Artificial Sequence
  Synthetic Oligonucleotide; PRDM1 exon 5; Set C
gggguagugagcguuguacgaggggaugaaagc

SEQ ID NO: 26690 - RNA, 35 nt, Artificial Sequence
  Synthetic Oligonucleotide; PRDM1 exon 5; Set C
ugggguagugagcguuguacgaggggaugaaagcu

SEQ ID NO: 26691 - RNA, 18 nt, Artificial Sequence
  Synthetic Oligonucleotide; PRDM1 exon 5; Set A
ugagcguuguacgagggg

SEQ ID NO: 26692 - RNA, 22 nt, Artificial Sequence
  Synthetic Oligonucleotide; PRDM1 exon 5; Set A
agugagcguuguacgaggggau

SEQ ID NO: 26693 - RNA, 20 nt, Artificial Sequence
  Synthetic Oligonucleotide; PRDM1 exon 5; Set A
gugagcguuguacgagggga

SEQ ID NO: 26694 - RNA, 24 nt, Artificial Sequence
  Synthetic Oligonucleotide; PRDM1 exon 5; Set A
uagugagcguuguacgaggggaug

SEQ ID NO: 26695 - RNA, 32 nt, Artificial Sequence
  Synthetic Oligonucleotide; PRDM1 exon 5; Set C
gggguagugagcguuguacgaggggaugaaag

SEQ ID NO: 26696 - RNA, 28 nt, Artificial Sequence
  Synthetic Oligonucleotide; PRDM1 exon 5; Set C
gguagugagcguuguacgaggggaugaa

SEQ ID NO: 26697 - RNA, 30 nt, Artificial Sequence
  Synthetic Oligonucleotide; PRDM1 exon 5; Set C
ggguagugagcguuguacgaggggaugaaa

SEQ ID NO: 26698 - RNA, 26 nt, Artificial Sequence
  Synthetic Oligonucleotide; PRDM1 exon 5; Set C
guagugagcguuguacgaggggauga

SEQ ID NO: 26699 - RNA, 34 nt, Artificial Sequence
  Synthetic Oligonucleotide; PRDM1 exon 5; Set C
ugggguagugagcguuguacgaggggaugaaagc

SEQ ID NO: 26700 - RNA, 19 nt, Artificial Sequence
  Synthetic Oligonucleotide; PRDM1 exon 5; Set A
gugagcguuguacgagggg

SEQ ID NO: 26701 - RNA, 23 nt, Artificial Sequence
  Synthetic Oligonucleotide; PRDM1 exon 5; Set A
uagugagcguuguacgaggggau

SEQ ID NO: 26702 - RNA, 21 nt, Artificial Sequence
  Synthetic Oligonucleotide; PRDM1 exon 5; Set A
agugagcguuguacgagggga

SEQ ID NO: 26703 - RNA, 25 nt, Artificial Sequence
  Synthetic Oligonucleotide; PRDM1 exon 5; Set A
guagugagcguuguacgaggggaug

SEQ ID NO: 26704 - RNA, 33 nt, Artificial Sequence
  Synthetic Oligonucleotide; PRDM1 exon 5; Set C
ugggguagugagcguuguacgaggggaugaaag

SEQ ID NO: 26705 - RNA, 31 nt, Artificial Sequence
  Synthetic Oligonucleotide; PRDM1 exon 5; Set C
gggguagugagcguuguacgaggggaugaaa

SEQ ID NO: 26706 - RNA, 27 nt, Artificial Sequence
  Synthetic Oligonucleotide; PRDM1 exon 5; Set C
gguagugagcguuguacgaggggauga

SEQ ID NO: 26707 - RNA, 29 nt, Artificial Sequence
  Synthetic Oligonucleotide; PRDM1 exon 5; Set C
ggguagugagcguuguacgaggggaugaa

SEQ ID NO: 26708 - RNA, 20 nt, Artificial Sequence
  Synthetic Oligonucleotide; PRDM1 exon 5; Set A
agugagcguuguacgagggg

SEQ ID NO: 26709 - RNA, 22 nt, Artificial Sequence
  Synthetic Oligonucleotide; PRDM1 exon 5; Set A
uagugagcguuguacgagggga

SEQ ID NO: 26710 - RNA, 24 nt, Artificial Sequence
  Synthetic Oligonucleotide; PRDM1 exon 5; Set A
guagugagcguuguacgaggggau

SEQ ID NO: 26711 - RNA, 26 nt, Artificial Sequence
  Synthetic Oligonucleotide; PRDM1 exon 5; Set C
gguagugagcguuguacgaggggaug

SEQ ID NO: 26712 - RNA, 34 nt, Artificial Sequence
  Synthetic Oligonucleotide; PRDM1 exon 5; Set C
uugggguagugagcguuguacgaggggaugaaag

SEQ ID NO: 26713 - RNA, 32 nt, Artificial Sequence
  Synthetic Oligonucleotide; PRDM1 exon 5; Set C
ugggguagugagcguuguacgaggggaugaaa

SEQ ID NO: 26714 - RNA, 30 nt, Artificial Sequence
  Synthetic Oligonucleotide; PRDM1 exon 5; Set C
gggguagugagcguuguacgaggggaugaa

SEQ ID NO: 26715 - RNA, 28 nt, Artificial Sequence
  Synthetic Oligonucleotide; PRDM1 exon 5; Set C
ggguagugagcguuguacgaggggauga

SEQ ID NO: 26716 - RNA, 21 nt, Artificial Sequence
  Synthetic Oligonucleotide; PRDM1 exon 5; Set A
uagugagcguuguacgagggg

SEQ ID NO: 26717 - RNA, 25 nt, Artificial Sequence
  Synthetic Oligonucleotide; PRDM1 exon 5; Set C
gguagugagcguuguacgaggggau

SEQ ID NO: 26718 - RNA, 23 nt, Artificial Sequence
  Synthetic Oligonucleotide; PRDM1 exon 5; Set A
guagugagcguuguacgagggga

SEQ ID NO: 26719 - RNA, 27 nt, Artificial Sequence
  Synthetic Oligonucleotide; PRDM1 exon 5; Set C
ggguagugagcguuguacgaggggaug

SEQ ID NO: 26720 - RNA, 31 nt, Artificial Sequence
  Synthetic Oligonucleotide; PRDM1 exon 5; Set C
ugggguagugagcguuguacgaggggaugaa

SEQ ID NO: 26721 - RNA, 29 nt, Artificial Sequence
  Synthetic Oligonucleotide; PRDM1 exon 5; Set C
gggguagugagcguuguacgaggggauga

SEQ ID NO: 26722 - RNA, 33 nt, Artificial Sequence
  Synthetic Oligonucleotide; PRDM1 exon 5; Set C
uugggguagugagcguuguacgaggggaugaaa

SEQ ID NO: 26723 - RNA, 22 nt, Artificial Sequence
  Synthetic Oligonucleotide; PRDM1 exon 5; Set A
guagugagcguuguacgagggg

SEQ ID NO: 26724 - RNA, 24 nt, Artificial Sequence
  Synthetic Oligonucleotide; PRDM1 exon 5; Set C
gguagugagcguuguacgagggga

SEQ ID NO: 26725 - RNA, 26 nt, Artificial Sequence
  Synthetic Oligonucleotide; PRDM1 exon 5; Set C
ggguagugagcguuguacgaggggau

SEQ ID NO: 26726 - RNA, 28 nt, Artificial Sequence
  Synthetic Oligonucleotide; PRDM1 exon 5; Set C
gggguagugagcguuguacgaggggaug

SEQ ID NO: 26727 - RNA, 30 nt, Artificial Sequence
  Synthetic Oligonucleotide; PRDM1 exon 5; Set C
ugggguagugagcguuguacgaggggauga

SEQ ID NO: 26728 - RNA, 32 nt, Artificial Sequence
  Synthetic Oligonucleotide; PRDM1 exon 5; Set C
uugggguagugagcguuguacgaggggaugaa

SEQ ID NO: 26729 - RNA, 23 nt, Artificial Sequence
  Synthetic Oligonucleotide; PRDM1 exon 5; Set A
gguagugagcguuguacgagggg

SEQ ID NO: 26730 - RNA, 27 nt, Artificial Sequence
  Synthetic Oligonucleotide; PRDM1 exon 5; Set C
gggguagugagcguuguacgaggggau

SEQ ID NO: 26731 - RNA, 25 nt, Artificial Sequence
  Synthetic Oligonucleotide; PRDM1 exon 5; Set C
ggguagugagcguuguacgagggga

SEQ ID NO: 26732 - RNA, 29 nt, Artificial Sequence
  Synthetic Oligonucleotide; PRDM1 exon 5; Set C
ugggguagugagcguuguacgaggggaug

SEQ ID NO: 26733 - RNA, 15 nt, Artificial Sequence
  Synthetic Oligonucleotide; PRDM1 exon 5; Set C
gugagcguuguacga

SEQ ID NO: 26734 - RNA, 31 nt, Artificial Sequence
  Synthetic Oligonucleotide; PRDM1 exon 5; Set C
uugggguagugagcguuguacgaggggauga

SEQ ID NO: 26735 - RNA, 24 nt, Artificial Sequence
  Synthetic Oligonucleotide; PRDM1 exon 5; Set C
ggguagugagcguuguacgagggg

SEQ ID NO: 26736 - RNA, 28 nt, Artificial Sequence
  Synthetic Oligonucleotide; PRDM1 exon 5; Set C
ugggguagugagcguuguacgaggggau

SEQ ID NO: 26737 - RNA, 26 nt, Artificial Sequence
  Synthetic Oligonucleotide; PRDM1 exon 5; Set C
gggguagugagcguuguacgagggga

SEQ ID NO: 26738 - RNA, 30 nt, Artificial Sequence
  Synthetic Oligonucleotide; PRDM1 exon 5; Set C
uugggguagugagcguuguacgaggggaug

SEQ ID NO: 26739 - RNA, 16 nt, Artificial Sequence
  Synthetic Oligonucleotide; PRDM1 exon 5; Set C
agugagcguuguacga

SEQ ID NO: 26740 - RNA, 25 nt, Artificial Sequence
  Synthetic Oligonucleotide; PRDM1 exon 5; Set C
gggguagugagcguuguacgagggg

SEQ ID NO: 26741 - RNA, 27 nt, Artificial Sequence
  Synthetic Oligonucleotide; PRDM1 exon 5; Set C
ugggguagugagcguuguacgagggga

SEQ ID NO: 26742 - RNA, 29 nt, Artificial Sequence
  Synthetic Oligonucleotide; PRDM1 exon 5; Set C
uugggguagugagcguuguacgaggggau

SEQ ID NO: 26743 - RNA, 39 nt, Artificial Sequence
  Synthetic Oligonucleotide; PRDM1 exon 5; Set C
ggaacuugggguagugagcguuguacgaggggaugaaag

SEQ ID NO: 26744 - RNA, 17 nt, Artificial Sequence
  Synthetic Oligonucleotide; PRDM1 exon 5; Set C
uagugagcguuguacga

SEQ ID NO: 26745 - RNA, 26 nt, Artificial Sequence
  Synthetic Oligonucleotide; PRDM1 exon 5; Set C
ugggguagugagcguuguacgagggg

SEQ ID NO: 26746 - RNA, 28 nt, Artificial Sequence
  Synthetic Oligonucleotide; PRDM1 exon 5; Set C
uugggguagugagcguuguacgagggga

SEQ ID NO: 26747 - RNA, 40 nt, Artificial Sequence
  Synthetic Oligonucleotide; PRDM1 exon 5; Set C
aggaacuugggguagugagcguuguacgaggggaugaaag

SEQ ID NO: 26748 - RNA, 18 nt, Artificial Sequence
  Synthetic Oligonucleotide; PRDM1 exon 5; Set C
guagugagcguuguacga

SEQ ID NO: 26749 - RNA, 38 nt, Artificial Sequence
  Synthetic Oligonucleotide; PRDM1 exon 5; Set C
ggaacuugggguagugagcguuguacgaggggaugaaa

SEQ ID NO: 26750 - RNA, 27 nt, Artificial Sequence
  Synthetic Oligonucleotide; PRDM1 exon 5; Set C
uugggguagugagcguuguacgagggg

SEQ ID NO: 26751 - RNA, 19 nt, Artificial Sequence
  Synthetic Oligonucleotide; PRDM1 exon 5; Set A
gguagugagcguuguacga

SEQ ID NO: 26752 - RNA, 37 nt, Artificial Sequence
  Synthetic Oligonucleotide; PRDM1 exon 5; Set C
ggaacuugggguagugagcguuguacgaggggaugaa

SEQ ID NO: 26753 - RNA, 39 nt, Artificial Sequence
  Synthetic Oligonucleotide; PRDM1 exon 5; Set C
aggaacuugggguagugagcguuguacgaggggaugaaa

SEQ ID NO: 26754 - RNA, 20 nt, Artificial Sequence
  Synthetic Oligonucleotide; PRDM1 exon 5; Set A
ggguagugagcguuguacga

SEQ ID NO: 26755 - RNA, 40 nt, Artificial Sequence
  Synthetic Oligonucleotide; PRDM1 exon 5; Set C
gaggaacuugggguagugagcguuguacgaggggaugaaa

SEQ ID NO: 26756 - RNA, 36 nt, Artificial Sequence
  Synthetic Oligonucleotide; PRDM1 exon 5; Set C
ggaacuugggguagugagcguuguacgaggggauga

SEQ ID NO: 26757 - RNA, 38 nt, Artificial Sequence
  Synthetic Oligonucleotide; PRDM1 exon 5; Set C
aggaacuugggguagugagcguuguacgaggggaugaa

SEQ ID NO: 26758 - RNA, 35 nt, Artificial Sequence
  Synthetic Oligonucleotide; PRDM1 exon 5; Set C
ggaacuugggguagugagcguuguacgaggggaug

SEQ ID NO: 26759 - RNA, 21 nt, Artificial Sequence
  Synthetic Oligonucleotide; PRDM1 exon 5; Set A
gggguagugagcguuguacga

SEQ ID NO: 26760 - RNA, 39 nt, Artificial Sequence
  Synthetic Oligonucleotide; PRDM1 exon 5; Set C
gaggaacuugggguagugagcguuguacgaggggaugaa

SEQ ID NO: 26761 - RNA, 37 nt, Artificial Sequence
  Synthetic Oligonucleotide; PRDM1 exon 5; Set C
aggaacuugggguagugagcguuguacgaggggauga

SEQ ID NO: 26762 - RNA, 34 nt, Artificial Sequence
  Synthetic Oligonucleotide; PRDM1 exon 5; Set C
ggaacuugggguagugagcguuguacgaggggau

SEQ ID NO: 26763 - RNA, 36 nt, Artificial Sequence
  Synthetic Oligonucleotide; PRDM1 exon 5; Set C
aggaacuugggguagugagcguuguacgaggggaug

SEQ ID NO: 26764 - RNA, 22 nt, Artificial Sequence
  Synthetic Oligonucleotide; PRDM1 exon 5; Set A
ugggguagugagcguuguacga

SEQ ID NO: 26765 - RNA, 38 nt, Artificial Sequence
  Synthetic Oligonucleotide; PRDM1 exon 5; Set C
gaggaacuugggguagugagcguuguacgaggggauga

SEQ ID NO: 26766 - RNA, 40 nt, Artificial Sequence
  Synthetic Oligonucleotide; PRDM1 exon 5; Set C
agaggaacuugggguagugagcguuguacgaggggaugaa

SEQ ID NO: 26767 - RNA, 33 nt, Artificial Sequence
  Synthetic Oligonucleotide; PRDM1 exon 5; Set C
ggaacuugggguagugagcguuguacgagggga

SEQ ID NO: 26768 - RNA, 35 nt, Artificial Sequence
  Synthetic Oligonucleotide; PRDM1 exon 5; Set C
aggaacuugggguagugagcguuguacgaggggau

SEQ ID NO: 26769 - RNA, 37 nt, Artificial Sequence
  Synthetic Oligonucleotide; PRDM1 exon 5; Set C
gaggaacuugggguagugagcguuguacgaggggaug

SEQ ID NO: 26770 - RNA, 23 nt, Artificial Sequence
  Synthetic Oligonucleotide; PRDM1 exon 5; Set A
uugggguagugagcguuguacga

SEQ ID NO: 26771 - RNA, 39 nt, Artificial Sequence
  Synthetic Oligonucleotide; PRDM1 exon 5; Set C
agaggaacuugggguagugagcguuguacgaggggauga

SEQ ID NO: 26772 - RNA, 21 nt, Artificial Sequence
  Synthetic Oligonucleotide; PRDM1 exon 5; Set A
ugggguagugagcguuguacg

SEQ ID NO: 26773 - RNA, 32 nt, Artificial Sequence
  Synthetic Oligonucleotide; PRDM1 exon 5; Set C
ggaacuugggguagugagcguuguacgagggg

SEQ ID NO: 26774 - RNA, 36 nt, Artificial Sequence
  Synthetic Oligonucleotide; PRDM1 exon 5; Set C
gaggaacuugggguagugagcguuguacgaggggau

SEQ ID NO: 26775 - RNA, 34 nt, Artificial Sequence
  Synthetic Oligonucleotide; PRDM1 exon 5; Set C
aggaacuugggguagugagcguuguacgagggga

SEQ ID NO: 26776 - RNA, 38 nt, Artificial Sequence
  Synthetic Oligonucleotide; PRDM1 exon 5; Set C
agaggaacuugggguagugagcguuguacgaggggaug

SEQ ID NO: 26777 - RNA, 33 nt, Artificial Sequence
  Synthetic Oligonucleotide; PRDM1 exon 5; Set C
aggaacuugggguagugagcguuguacgagggg

SEQ ID NO: 26778 - RNA, 35 nt, Artificial Sequence
  Synthetic Oligonucleotide; PRDM1 exon 5; Set C
gaggaacuugggguagugagcguuguacgagggga

SEQ ID NO: 26779 - RNA, 37 nt, Artificial Sequence
  Synthetic Oligonucleotide; PRDM1 exon 5; Set C
agaggaacuugggguagugagcguuguacgaggggau

SEQ ID NO: 26780 - RNA, 34 nt, Artificial Sequence
  Synthetic Oligonucleotide; PRDM1 exon 5; Set C
gaggaacuugggguagugagcguuguacgagggg

SEQ ID NO: 26781 - RNA, 36 nt, Artificial Sequence
  Synthetic Oligonucleotide; PRDM1 exon 5; Set C
agaggaacuugggguagugagcguuguacgagggga

SEQ ID NO: 26782 - RNA, 35 nt, Artificial Sequence
  Synthetic Oligonucleotide; PRDM1 exon 5; Set C
agaggaacuugggguagugagcguuguacgagggg

SEQ ID NO: 26783 - RNA, 15 nt, Artificial Sequence
  Synthetic Oligonucleotide; PRDM1 exon 5; Set C
gggguagugagcguu

SEQ ID NO: 26784 - RNA, 16 nt, Artificial Sequence
  Synthetic Oligonucleotide; PRDM1 exon 5; Set C
ugggguagugagcguu

SEQ ID NO: 26785 - RNA, 29 nt, Artificial Sequence
  Synthetic Oligonucleotide; PRDM1 exon 5; Set C
aggaacuugggguagugagcguuguacga

SEQ ID NO: 26786 - RNA, 15 nt, Artificial Sequence
  Synthetic Oligonucleotide; PRDM1 exon 5; Set C
ugggguagugagcgu

SEQ ID NO: 26787 - RNA, 30 nt, Artificial Sequence
  Synthetic Oligonucleotide; PRDM1 exon 5; Set C
gaggaacuugggguagugagcguuguacga

SEQ ID NO: 26788 - RNA, 31 nt, Artificial Sequence
  Synthetic Oligonucleotide; PRDM1 exon 5; Set C
agaggaacuugggguagugagcguuguacga

SEQ ID NO: 26789 - RNA, 24 nt, Artificial Sequence
  Synthetic Oligonucleotide; PRDM1 exon 5; Set A
gaggaacuugggguagugagcguu

SEQ ID NO: 26790 - RNA, 25 nt, Artificial Sequence
  Synthetic Oligonucleotide; PRDM1 exon 5; Set A
agaggaacuugggguagugagcguu

SEQ ID NO: 26791 - RNA, 38 nt, Artificial Sequence
  Synthetic Oligonucleotide; PRDM1 exon 5; Set C
gggggcaagaggaacuugggguagugagcguuguacga

SEQ ID NO: 26792 - RNA, 39 nt, Artificial Sequence
  Synthetic Oligonucleotide; PRDM1 exon 5; Set C
ggggggcaagaggaacuugggguagugagcguuguacga

SEQ ID NO: 26793 - RNA, 40 nt, Artificial Sequence
  Synthetic Oligonucleotide; PRDM1 exon 5; Set C
aggggggcaagaggaacuugggguagugagcguuguacga

SEQ ID NO: 26794 - RNA, 16 nt, Artificial Sequence
  Synthetic Oligonucleotide; PRDM1 exon 5; Set C
gaggaacuugggguag

SEQ ID NO: 26795 - RNA, 18 nt, Artificial Sequence
  Synthetic Oligonucleotide; PRDM1 exon 5; Set C
agaggaacuugggguagu

SEQ ID NO: 26796 - RNA, 17 nt, Artificial Sequence
  Synthetic Oligonucleotide; PRDM1 exon 5; Set C
agaggaacuugggguag

SEQ ID NO: 26797 - RNA, 15 nt, Artificial Sequence
  Synthetic Oligonucleotide; PRDM1 exon 5; Set C
gagagaagugggguu

SEQ ID NO: 26798 - RNA, 16 nt, Artificial Sequence
  Synthetic Oligonucleotide; PRDM1 exon 5; Set C
ggagagaagugggguu

SEQ ID NO: 26799 - RNA, 15 nt, Artificial Sequence
  Synthetic Oligonucleotide; PRDM1 exon 5; Set C
ggagagaaguggggu

SEQ ID NO: 26800 - RNA, 17 nt, Artificial Sequence
  Synthetic Oligonucleotide; PRDM1 exon 5; Set C
gggagagaagugggguu

SEQ ID NO: 26801 - RNA, 16 nt, Artificial Sequence
  Synthetic Oligonucleotide; PRDM1 exon 5; Set C
gggagagaaguggggu

SEQ ID NO: 26802 - RNA, 15 nt, Artificial Sequence
  Synthetic Oligonucleotide; PRDM1 exon 5; Set C
gggagagaagugggg

SEQ ID NO: 26803 - RNA, 24 nt, Artificial Sequence
  Synthetic Oligonucleotide; PRDM1 exon 5; Set C
cgagcucgggagagaagugggguu

SEQ ID NO: 26804 - RNA, 23 nt, Artificial Sequence
  Synthetic Oligonucleotide; PRDM1 exon 5; Set C
cgagcucgggagagaaguggggu

SEQ ID NO: 26805 - RNA, 22 nt, Artificial Sequence
  Synthetic Oligonucleotide; PRDM1 exon 5; Set A
cgagcucgggagagaagugggg

SEQ ID NO: 26806 - RNA, 16 nt, Artificial Sequence
  Synthetic Oligonucleotide; PRDM1 exon 5; Set C
uuucuuuuguuuuuaa

SEQ ID NO: 26807 - RNA, 15 nt, Artificial Sequence
  Synthetic Oligonucleotide; PRDM1 exon 5; Set C
uuucuuuuguuuuua

SEQ ID NO: 26808 - RNA, 15 nt, Artificial Sequence
  Synthetic Oligonucleotide; PRDM1 exon 5; Set C
gaaaaaggggcgauu

SEQ ID NO: 26809 - RNA, 16 nt, Artificial Sequence
  Synthetic Oligonucleotide; PRDM1 exon 5; Set C
agaaaaaggggcgauu

SEQ ID NO: 26810 - RNA, 17 nt, Artificial Sequence
  Synthetic Oligonucleotide; PRDM1 exon 5; Set C
aagaaaaaggggcgauu

SEQ ID NO: 26811 - RNA, 15 nt, Artificial Sequence
  Synthetic Oligonucleotide; PRDM1 exon 5; Set C
agaaaaaggggcgau

SEQ ID NO: 26812 - RNA, 18 nt, Artificial Sequence
  Synthetic Oligonucleotide; PRDM1 exon 5; Set C
aaagaaaaaggggcgauu

SEQ ID NO: 26813 - RNA, 16 nt, Artificial Sequence
  Synthetic Oligonucleotide; PRDM1 exon 5; Set C
aagaaaaaggggcgau

SEQ ID NO: 26814 - RNA, 19 nt, Artificial Sequence
  Synthetic Oligonucleotide; PRDM1 exon 5; Set C
uaaagaaaaaggggcgauu

SEQ ID NO: 26815 - RNA, 17 nt, Artificial Sequence
  Synthetic Oligonucleotide; PRDM1 exon 5; Set C
aaagaaaaaggggcgau

SEQ ID NO: 26816 - RNA, 20 nt, Artificial Sequence
  Synthetic Oligonucleotide; PRDM1 exon 5; Set C
auaaagaaaaaggggcgauu

SEQ ID NO: 26817 - RNA, 18 nt, Artificial Sequence
  Synthetic Oligonucleotide; PRDM1 exon 5; Set C
uaaagaaaaaggggcgau

SEQ ID NO: 26818 - RNA, 19 nt, Artificial Sequence
  Synthetic Oligonucleotide; PRDM1 exon 5; Set C
auaaagaaaaaggggcgau

SEQ ID NO: 26819 - RNA, 20 nt, Artificial Sequence
  Synthetic Oligonucleotide; PRDM1 exon 5; Set C
aauaaagaaaaaggggcgau

SEQ ID NO: 26820 - RNA, 24 nt, Artificial Sequence
  Synthetic Oligonucleotide; PRDM1 exon 5; Set C
ugaaauaaagaaaaaggggcgauu

SEQ ID NO: 26821 - RNA, 23 nt, Artificial Sequence
  Synthetic Oligonucleotide; PRDM1 exon 5; Set C
ugaaauaaagaaaaaggggcgau

SEQ ID NO: 26822 - RNA, 29 nt, Artificial Sequence
  Synthetic Oligonucleotide; PRDM1 exon 5; Set C
ugugcugaaauaaagaaaaaggggcgauu

SEQ ID NO: 26823 - RNA, 30 nt, Artificial Sequence
  Synthetic Oligonucleotide; PRDM1 exon 5; Set C
uugugcugaaauaaagaaaaaggggcgauu

SEQ ID NO: 26824 - RNA, 28 nt, Artificial Sequence
  Synthetic Oligonucleotide; PRDM1 exon 5; Set C
ugugcugaaauaaagaaaaaggggcgau

SEQ ID NO: 26825 - RNA, 29 nt, Artificial Sequence
  Synthetic Oligonucleotide; PRDM1 exon 5; Set C
uugugcugaaauaaagaaaaaggggcgau

SEQ ID NO: 26826 - RNA, 23 nt, Artificial Sequence
  Synthetic Oligonucleotide; PRDM1 exon 5; Set C
ugugcugaaauaaagaaaaaggg

SEQ ID NO: 26827 - RNA, 24 nt, Artificial Sequence
  Synthetic Oligonucleotide; PRDM1 exon 5; Set C
uugugcugaaauaaagaaaaaggg

SEQ ID NO: 26828 - RNA, 22 nt, Artificial Sequence
  Synthetic Oligonucleotide; PRDM1 exon 5; Set C
ugugcugaaauaaagaaaaagg

SEQ ID NO: 26829 - RNA, 21 nt, Artificial Sequence
  Synthetic Oligonucleotide; PRDM1 exon 5; Set C
ugugcugaaauaaagaaaaag

SEQ ID NO: 26830 - RNA, 23 nt, Artificial Sequence
  Synthetic Oligonucleotide; PRDM1 exon 5; Set C
uugugcugaaauaaagaaaaagg

SEQ ID NO: 26831 - RNA, 20 nt, Artificial Sequence
  Synthetic Oligonucleotide; PRDM1 exon 5; Set C
ugugcugaaauaaagaaaaa

SEQ ID NO: 26832 - RNA, 22 nt, Artificial Sequence
  Synthetic Oligonucleotide; PRDM1 exon 5; Set C
uugugcugaaauaaagaaaaag

SEQ ID NO: 26833 - RNA, 19 nt, Artificial Sequence
  Synthetic Oligonucleotide; PRDM1 exon 5; Set C
ugugcugaaauaaagaaaa

SEQ ID NO: 26834 - RNA, 21 nt, Artificial Sequence
  Synthetic Oligonucleotide; PRDM1 exon 5; Set C
uugugcugaaauaaagaaaaa

SEQ ID NO: 26835 - RNA, 20 nt, Artificial Sequence
  Synthetic Oligonucleotide; PRDM1 exon 5; Set C
uugugcugaaauaaagaaaa

SEQ ID NO: 26836 - RNA, 18 nt, Artificial Sequence
  Synthetic Oligonucleotide; PRDM1 exon 5; Set C
ugugcugaaauaaagaaa

SEQ ID NO: 26837 - RNA, 19 nt, Artificial Sequence
  Synthetic Oligonucleotide; PRDM1 exon 5; Set C
uugugcugaaauaaagaaa

SEQ ID NO: 26838 - RNA, 17 nt, Artificial Sequence
  Synthetic Oligonucleotide; PRDM1 exon 5; Set C
ugugcugaaauaaagaa

SEQ ID NO: 26839 - RNA, 18 nt, Artificial Sequence
  Synthetic Oligonucleotide; PRDM1 exon 5; Set C
uugugcugaaauaaagaa

SEQ ID NO: 26840 - RNA, 16 nt, Artificial Sequence
  Synthetic Oligonucleotide; PRDM1 exon 5; Set C
ugugcugaaauaaaga

SEQ ID NO: 26841 - RNA, 17 nt, Artificial Sequence
  Synthetic Oligonucleotide; PRDM1 exon 5; Set C
uugugcugaaauaaaga

SEQ ID NO: 26842 - RNA, 15 nt, Artificial Sequence
  Synthetic Oligonucleotide; PRDM1 exon 5; Set C
ugugcugaaauaaag

SEQ ID NO: 26843 - RNA, 16 nt, Artificial Sequence
  Synthetic Oligonucleotide; PRDM1 exon 5; Set C
uugugcugaaauaaag

SEQ ID NO: 26844 - RNA, 15 nt, Artificial Sequence
  Synthetic Oligonucleotide; PRDM1 exon 5; Set C
uugugcugaaauaaa

SEQ ID NO: 26845 - RNA, 15 nt, Artificial Sequence
  Synthetic Oligonucleotide; PRDM1 exon 5; Set C
ucucuuugggacauu

SEQ ID NO: 26846 - RNA, 16 nt, Artificial Sequence
  Synthetic Oligonucleotide; PRDM1 exon 5; Set C
cucucuuugggacauu

SEQ ID NO: 26847 - RNA, 17 nt, Artificial Sequence
  Synthetic Oligonucleotide; PRDM1 exon 5; Set C
ucucucuuugggacauu

SEQ ID NO: 26848 - RNA, 34 nt, Artificial Sequence
  Synthetic Oligonucleotide; PRDM1 exon 5; Set C
uuucuuucacgcuguacucucucuuugggacauu

SEQ ID NO: 26849 - RNA, 23 nt, Artificial Sequence
  Synthetic Oligonucleotide; PRDM1 exon 5; Set A
cuuucacgcuguacucucucuuu

SEQ ID NO: 26850 - RNA, 24 nt, Artificial Sequence
  Synthetic Oligonucleotide; PRDM1 exon 5; Set A
ucuuucacgcuguacucucucuuu

SEQ ID NO: 26851 - RNA, 40 nt, Artificial Sequence
  Synthetic Oligonucleotide; PRDM1 exon 5; Set C
uuaggauuucuuucacgcuguacucucucuuugggacauu

SEQ ID NO: 26852 - RNA, 25 nt, Artificial Sequence
  Synthetic Oligonucleotide; PRDM1 exon 5; Set A
uucuuucacgcuguacucucucuuu

SEQ ID NO: 26853 - RNA, 26 nt, Artificial Sequence
  Synthetic Oligonucleotide; PRDM1 exon 5; Set A
uuucuuucacgcuguacucucucuuu

SEQ ID NO: 26854 - RNA, 24 nt, Artificial Sequence
  Synthetic Oligonucleotide; PRDM1 exon 5; Set A
uucuuucacgcuguacucucucuu

SEQ ID NO: 26855 - RNA, 25 nt, Artificial Sequence
  Synthetic Oligonucleotide; PRDM1 exon 5; Set A
uuucuuucacgcuguacucucucuu

SEQ ID NO: 26856 - RNA, 36 nt, Artificial Sequence
  Synthetic Oligonucleotide; PRDM1 exon 5; Set C
uuaggauuucuuucacgcuguacucucucuuuggga

SEQ ID NO: 26857 - RNA, 37 nt, Artificial Sequence
  Synthetic Oligonucleotide; PRDM1 exon 5; Set C
uuuaggauuucuuucacgcuguacucucucuuuggga

SEQ ID NO: 26858 - RNA, 39 nt, Artificial Sequence
  Synthetic Oligonucleotide; PRDM1 exon 5; Set C
uuuuaggauuucuuucacgcuguacucucucuuugggac

SEQ ID NO: 26859 - RNA, 38 nt, Artificial Sequence
  Synthetic Oligonucleotide; PRDM1 exon 5; Set C
uuuuaggauuucuuucacgcuguacucucucuuuggga

SEQ ID NO: 26860 - RNA, 36 nt, Artificial Sequence
  Synthetic Oligonucleotide; PRDM1 exon 5; Set C
uuuaggauuucuuucacgcuguacucucucuuuggg

SEQ ID NO: 26861 - RNA, 35 nt, Artificial Sequence
  Synthetic Oligonucleotide; PRDM1 exon 5; Set C
uuuaggauuucuuucacgcuguacucucucuuugg

SEQ ID NO: 26862 - RNA, 37 nt, Artificial Sequence
  Synthetic Oligonucleotide; PRDM1 exon 5; Set C
uuuuaggauuucuuucacgcuguacucucucuuuggg

SEQ ID NO: 26863 - RNA, 32 nt, Artificial Sequence
  Synthetic Oligonucleotide; PRDM1 exon 5; Set A
uuaggauuucuuucacgcuguacucucucuuu

SEQ ID NO: 26864 - RNA, 34 nt, Artificial Sequence
  Synthetic Oligonucleotide; PRDM1 exon 5; Set A
uuuaggauuucuuucacgcuguacucucucuuug

SEQ ID NO: 26865 - RNA, 36 nt, Artificial Sequence
  Synthetic Oligonucleotide; PRDM1 exon 5; Set C
uuuuaggauuucuuucacgcuguacucucucuuugg

SEQ ID NO: 26866 - RNA, 33 nt, Artificial Sequence
  Synthetic Oligonucleotide; PRDM1 exon 5; Set A
uuuaggauuucuuucacgcuguacucucucuuu

SEQ ID NO: 26867 - RNA, 31 nt, Artificial Sequence
  Synthetic Oligonucleotide; PRDM1 exon 5; Set A
uuaggauuucuuucacgcuguacucucucuu

SEQ ID NO: 26868 - RNA, 35 nt, Artificial Sequence
  Synthetic Oligonucleotide; PRDM1 exon 5; Set A
uuuuaggauuucuuucacgcuguacucucucuuug

SEQ ID NO: 26869 - RNA, 34 nt, Artificial Sequence
  Synthetic Oligonucleotide; PRDM1 exon 5; Set A
uuuuaggauuucuuucacgcuguacucucucuuu

SEQ ID NO: 26870 - RNA, 32 nt, Artificial Sequence
  Synthetic Oligonucleotide; PRDM1 exon 5; Set A
uuuaggauuucuuucacgcuguacucucucuu

SEQ ID NO: 26871 - RNA, 30 nt, Artificial Sequence
  Synthetic Oligonucleotide; PRDM1 exon 5; Set A
uuaggauuucuuucacgcuguacucucucu

SEQ ID NO: 26872 - RNA, 33 nt, Artificial Sequence
  Synthetic Oligonucleotide; PRDM1 exon 5; Set A
uuuuaggauuucuuucacgcuguacucucucuu

SEQ ID NO: 26873 - RNA, 31 nt, Artificial Sequence
  Synthetic Oligonucleotide; PRDM1 exon 5; Set A
uuuaggauuucuuucacgcuguacucucucu

SEQ ID NO: 26874 - RNA, 29 nt, Artificial Sequence
  Synthetic Oligonucleotide; PRDM1 exon 5; Set A
uuaggauuucuuucacgcuguacucucuc

SEQ ID NO: 26875 - RNA, 32 nt, Artificial Sequence
  Synthetic Oligonucleotide; PRDM1 exon 5; Set A
uuuuaggauuucuuucacgcuguacucucucu

SEQ ID NO: 26876 - RNA, 30 nt, Artificial Sequence
  Synthetic Oligonucleotide; PRDM1 exon 5; Set A
uuuaggauuucuuucacgcuguacucucuc

SEQ ID NO: 26877 - RNA, 28 nt, Artificial Sequence
  Synthetic Oligonucleotide; PRDM1 exon 5; Set A
uuaggauuucuuucacgcuguacucucu

SEQ ID NO: 26878 - RNA, 31 nt, Artificial Sequence
  Synthetic Oligonucleotide; PRDM1 exon 5; Set A
uuuuaggauuucuuucacgcuguacucucuc

SEQ ID NO: 26879 - RNA, 29 nt, Artificial Sequence
  Synthetic Oligonucleotide; PRDM1 exon 5; Set A
uuuaggauuucuuucacgcuguacucucu

SEQ ID NO: 26880 - RNA, 30 nt, Artificial Sequence
  Synthetic Oligonucleotide; PRDM1 exon 5; Set A
uuuuaggauuucuuucacgcuguacucucu

SEQ ID NO: 26881 - RNA, 16 nt, Artificial Sequence
  Synthetic Oligonucleotide; PRDM1 exon 5; Set C
uuaggauuucuuucac

SEQ ID NO: 26882 - RNA, 18 nt, Artificial Sequence
  Synthetic Oligonucleotide; PRDM1 exon 5; Set C
uuuaggauuucuuucacg

SEQ ID NO: 26883 - RNA, 15 nt, Artificial Sequence
  Synthetic Oligonucleotide; PRDM1 exon 5; Set C
uuaggauuucuuuca

SEQ ID NO: 26884 - RNA, 17 nt, Artificial Sequence
  Synthetic Oligonucleotide; PRDM1 exon 5; Set C
uuuaggauuucuuucac

SEQ ID NO: 26885 - RNA, 19 nt, Artificial Sequence
  Synthetic Oligonucleotide; PRDM1 exon 5; Set C
uuuuaggauuucuuucacg

SEQ ID NO: 26886 - RNA, 18 nt, Artificial Sequence
  Synthetic Oligonucleotide; PRDM1 exon 5; Set C
uuuuaggauuucuuucac

SEQ ID NO: 26887 - RNA, 22 nt, Artificial Sequence
  Synthetic Oligonucleotide; PRDM1 exon 5; Set C
gaguccaauuuuaggauuucuu

SEQ ID NO: 26888 - RNA, 23 nt, Artificial Sequence
  Synthetic Oligonucleotide; PRDM1 exon 5; Set C
ggaguccaauuuuaggauuucuu

SEQ ID NO: 26889 - RNA, 24 nt, Artificial Sequence
  Synthetic Oligonucleotide; PRDM1 exon 5; Set C
uggaguccaauuuuaggauuucuu

SEQ ID NO: 26890 - RNA, 22 nt, Artificial Sequence
  Synthetic Oligonucleotide; PRDM1 exon 5; Set C
ggaguccaauuuuaggauuucu

SEQ ID NO: 26891 - RNA, 21 nt, Artificial Sequence
  Synthetic Oligonucleotide; PRDM1 exon 5; Set C
ggaguccaauuuuaggauuuc

SEQ ID NO: 26892 - RNA, 25 nt, Artificial Sequence
  Synthetic Oligonucleotide; PRDM1 exon 5; Set C
uuggaguccaauuuuaggauuucuu

SEQ ID NO: 26893 - RNA, 23 nt, Artificial Sequence
  Synthetic Oligonucleotide; PRDM1 exon 5; Set C
uggaguccaauuuuaggauuucu

SEQ ID NO: 26894 - RNA, 31 nt, Artificial Sequence
  Synthetic Oligonucleotide; PRDM1 exon 5; Set A
ggguuggaguccaauuuuaggauuucuuuca

SEQ ID NO: 26895 - RNA, 20 nt, Artificial Sequence
  Synthetic Oligonucleotide; PRDM1 exon 5; Set C
ggaguccaauuuuaggauuu

SEQ ID NO: 26896 - RNA, 22 nt, Artificial Sequence
  Synthetic Oligonucleotide; PRDM1 exon 5; Set C
uggaguccaauuuuaggauuuc

SEQ ID NO: 26897 - RNA, 24 nt, Artificial Sequence
  Synthetic Oligonucleotide; PRDM1 exon 5; Set C
uuggaguccaauuuuaggauuucu

SEQ ID NO: 26898 - RNA, 26 nt, Artificial Sequence
  Synthetic Oligonucleotide; PRDM1 exon 5; Set C
guuggaguccaauuuuaggauuucuu

SEQ ID NO: 26899 - RNA, 32 nt, Artificial Sequence
  Synthetic Oligonucleotide; PRDM1 exon 5; Set A
gggguuggaguccaauuuuaggauuucuuuca

SEQ ID NO: 26900 - RNA, 21 nt, Artificial Sequence
  Synthetic Oligonucleotide; PRDM1 exon 5; Set C
uggaguccaauuuuaggauuu

SEQ ID NO: 26901 - RNA, 23 nt, Artificial Sequence
  Synthetic Oligonucleotide; PRDM1 exon 5; Set C
uuggaguccaauuuuaggauuuc

SEQ ID NO: 26902 - RNA, 25 nt, Artificial Sequence
  Synthetic Oligonucleotide; PRDM1 exon 5; Set C
guuggaguccaauuuuaggauuucu

SEQ ID NO: 26903 - RNA, 27 nt, Artificial Sequence
  Synthetic Oligonucleotide; PRDM1 exon 5; Set A
gguuggaguccaauuuuaggauuucuu

SEQ ID NO: 26904 - RNA, 31 nt, Artificial Sequence
  Synthetic Oligonucleotide; PRDM1 exon 5; Set A
gggguuggaguccaauuuuaggauuucuuuc

SEQ ID NO: 26905 - RNA, 22 nt, Artificial Sequence
  Synthetic Oligonucleotide; PRDM1 exon 5; Set C
uuggaguccaauuuuaggauuu

SEQ ID NO: 26906 - RNA, 24 nt, Artificial Sequence
  Synthetic Oligonucleotide; PRDM1 exon 5; Set C
guuggaguccaauuuuaggauuuc

SEQ ID NO: 26907 - RNA, 28 nt, Artificial Sequence
  Synthetic Oligonucleotide; PRDM1 exon 5; Set A
ggguuggaguccaauuuuaggauuucuu

SEQ ID NO: 26908 - RNA, 26 nt, Artificial Sequence
  Synthetic Oligonucleotide; PRDM1 exon 5; Set A
gguuggaguccaauuuuaggauuucu

SEQ ID NO: 26909 - RNA, 30 nt, Artificial Sequence
  Synthetic Oligonucleotide; PRDM1 exon 5; Set A
gggguuggaguccaauuuuaggauuucuuu

SEQ ID NO: 26910 - RNA, 23 nt, Artificial Sequence
  Synthetic Oligonucleotide; PRDM1 exon 5; Set C
guuggaguccaauuuuaggauuu

SEQ ID NO: 26911 - RNA, 25 nt, Artificial Sequence
  Synthetic Oligonucleotide; PRDM1 exon 5; Set C
gguuggaguccaauuuuaggauuuc

SEQ ID NO: 26912 - RNA, 29 nt, Artificial Sequence
  Synthetic Oligonucleotide; PRDM1 exon 5; Set A
gggguuggaguccaauuuuaggauuucuu

SEQ ID NO: 26913 - RNA, 27 nt, Artificial Sequence
  Synthetic Oligonucleotide; PRDM1 exon 5; Set A
ggguuggaguccaauuuuaggauuucu

SEQ ID NO: 26914 - RNA, 24 nt, Artificial Sequence
  Synthetic Oligonucleotide; PRDM1 exon 5; Set C
gguuggaguccaauuuuaggauuu

SEQ ID NO: 26915 - RNA, 26 nt, Artificial Sequence
  Synthetic Oligonucleotide; PRDM1 exon 5; Set A
ggguuggaguccaauuuuaggauuuc

SEQ ID NO: 26916 - RNA, 28 nt, Artificial Sequence
  Synthetic Oligonucleotide; PRDM1 exon 5; Set A
gggguuggaguccaauuuuaggauuucu

SEQ ID NO: 26917 - RNA, 25 nt, Artificial Sequence
  Synthetic Oligonucleotide; PRDM1 exon 5; Set A
ggguuggaguccaauuuuaggauuu

SEQ ID NO: 26918 - RNA, 27 nt, Artificial Sequence
  Synthetic Oligonucleotide; PRDM1 exon 5; Set A
gggguuggaguccaauuuuaggauuuc

SEQ ID NO: 26919 - RNA, 26 nt, Artificial Sequence
  Synthetic Oligonucleotide; PRDM1 exon 5; Set A
gggguuggaguccaauuuuaggauuu

SEQ ID NO: 26920 - RNA, 39 nt, Artificial Sequence
  Synthetic Oligonucleotide; PRDM1 exon 5; Set C
cuuuggagggguuggaguccaauuuuaggauuucuuuca

SEQ ID NO: 26921 - RNA, 40 nt, Artificial Sequence
  Synthetic Oligonucleotide; PRDM1 exon 5; Set C
ccuuuggagggguuggaguccaauuuuaggauuucuuuca

SEQ ID NO: 26922 - RNA, 35 nt, Artificial Sequence
  Synthetic Oligonucleotide; PRDM1 exon 5; Set C
uuuggagggguuggaguccaauuuuaggauuucuu

SEQ ID NO: 26923 - RNA, 39 nt, Artificial Sequence
  Synthetic Oligonucleotide; PRDM1 exon 5; Set C
ccuuuggagggguuggaguccaauuuuaggauuucuuuc

SEQ ID NO: 26924 - RNA, 34 nt, Artificial Sequence
  Synthetic Oligonucleotide; PRDM1 exon 5; Set C
uuuggagggguuggaguccaauuuuaggauuucu

SEQ ID NO: 26925 - RNA, 36 nt, Artificial Sequence
  Synthetic Oligonucleotide; PRDM1 exon 5; Set C
cuuuggagggguuggaguccaauuuuaggauuucuu

SEQ ID NO: 26926 - RNA, 40 nt, Artificial Sequence
  Synthetic Oligonucleotide; PRDM1 exon 5; Set C
uccuuuggagggguuggaguccaauuuuaggauuucuuuc

SEQ ID NO: 26927 - RNA, 38 nt, Artificial Sequence
  Synthetic Oligonucleotide; PRDM1 exon 5; Set C
ccuuuggagggguuggaguccaauuuuaggauuucuuu

SEQ ID NO: 26928 - RNA, 33 nt, Artificial Sequence
  Synthetic Oligonucleotide; PRDM1 exon 5; Set A
uuuggagggguuggaguccaauuuuaggauuuc

SEQ ID NO: 26929 - RNA, 19 nt, Artificial Sequence
  Synthetic Oligonucleotide; PRDM1 exon 5; Set C
ggguuggaguccaauuuua

SEQ ID NO: 26930 - RNA, 37 nt, Artificial Sequence
  Synthetic Oligonucleotide; PRDM1 exon 5; Set C
ccuuuggagggguuggaguccaauuuuaggauuucuu

SEQ ID NO: 26931 - RNA, 35 nt, Artificial Sequence
  Synthetic Oligonucleotide; PRDM1 exon 5; Set C
cuuuggagggguuggaguccaauuuuaggauuucu

SEQ ID NO: 26932 - RNA, 39 nt, Artificial Sequence
  Synthetic Oligonucleotide; PRDM1 exon 5; Set C
uccuuuggagggguuggaguccaauuuuaggauuucuuu

SEQ ID NO: 26933 - RNA, 18 nt, Artificial Sequence
  Synthetic Oligonucleotide; PRDM1 exon 5; Set C
ggguuggaguccaauuuu

SEQ ID NO: 26934 - RNA, 32 nt, Artificial Sequence
  Synthetic Oligonucleotide; PRDM1 exon 5; Set A
uuuggagggguuggaguccaauuuuaggauuu

SEQ ID NO: 26935 - RNA, 34 nt, Artificial Sequence
  Synthetic Oligonucleotide; PRDM1 exon 5; Set C
cuuuggagggguuggaguccaauuuuaggauuuc

SEQ ID NO: 26936 - RNA, 20 nt, Artificial Sequence
  Synthetic Oligonucleotide; PRDM1 exon 5; Set C
gggguuggaguccaauuuua

SEQ ID NO: 26937 - RNA, 38 nt, Artificial Sequence
  Synthetic Oligonucleotide; PRDM1 exon 5; Set C
uccuuuggagggguuggaguccaauuuuaggauuucuu

SEQ ID NO: 26938 - RNA, 36 nt, Artificial Sequence
  Synthetic Oligonucleotide; PRDM1 exon 5; Set C
ccuuuggagggguuggaguccaauuuuaggauuucu

SEQ ID NO: 26939 - RNA, 40 nt, Artificial Sequence
  Synthetic Oligonucleotide; PRDM1 exon 5; Set C
uuccuuuggagggguuggaguccaauuuuaggauuucuuu

SEQ ID NO: 26940 - RNA, 19 nt, Artificial Sequence
  Synthetic Oligonucleotide; PRDM1 exon 5; Set C
gggguuggaguccaauuuu

SEQ ID NO: 26941 - RNA, 33 nt, Artificial Sequence
  Synthetic Oligonucleotide; PRDM1 exon 5; Set C
cuuuggagggguuggaguccaauuuuaggauuu

SEQ ID NO: 26942 - RNA, 35 nt, Artificial Sequence
  Synthetic Oligonucleotide; PRDM1 exon 5; Set C
ccuuuggagggguuggaguccaauuuuaggauuuc

SEQ ID NO: 26943 - RNA, 39 nt, Artificial Sequence
  Synthetic Oligonucleotide; PRDM1 exon 5; Set C
uuccuuuggagggguuggaguccaauuuuaggauuucuu

SEQ ID NO: 26944 - RNA, 37 nt, Artificial Sequence
  Synthetic Oligonucleotide; PRDM1 exon 5; Set C
uccuuuggagggguuggaguccaauuuuaggauuucu

SEQ ID NO: 26945 - RNA, 18 nt, Artificial Sequence
  Synthetic Oligonucleotide; PRDM1 exon 5; Set C
gggguuggaguccaauuu

SEQ ID NO: 26946 - RNA, 34 nt, Artificial Sequence
  Synthetic Oligonucleotide; PRDM1 exon 5; Set C
ccuuuggagggguuggaguccaauuuuaggauuu

SEQ ID NO: 26947 - RNA, 36 nt, Artificial Sequence
  Synthetic Oligonucleotide; PRDM1 exon 5; Set C
uccuuuggagggguuggaguccaauuuuaggauuuc

SEQ ID NO: 26948 - RNA, 38 nt, Artificial Sequence
  Synthetic Oligonucleotide; PRDM1 exon 5; Set C
uuccuuuggagggguuggaguccaauuuuaggauuucu

SEQ ID NO: 26949 - RNA, 35 nt, Artificial Sequence
  Synthetic Oligonucleotide; PRDM1 exon 5; Set C
uccuuuggagggguuggaguccaauuuuaggauuu

SEQ ID NO: 26950 - RNA, 37 nt, Artificial Sequence
  Synthetic Oligonucleotide; PRDM1 exon 5; Set C
uuccuuuggagggguuggaguccaauuuuaggauuuc

SEQ ID NO: 26951 - RNA, 36 nt, Artificial Sequence
  Synthetic Oligonucleotide; PRDM1 exon 5; Set C
uuccuuuggagggguuggaguccaauuuuaggauuu

SEQ ID NO: 26952 - RNA, 26 nt, Artificial Sequence
  Synthetic Oligonucleotide; PRDM1 exon 5; Set A
uuuggagggguuggaguccaauuuua

SEQ ID NO: 26953 - RNA, 25 nt, Artificial Sequence
  Synthetic Oligonucleotide; PRDM1 exon 5; Set A
uuuggagggguuggaguccaauuuu

SEQ ID NO: 26954 - RNA, 27 nt, Artificial Sequence
  Synthetic Oligonucleotide; PRDM1 exon 5; Set A
cuuuggagggguuggaguccaauuuua

SEQ ID NO: 26955 - RNA, 24 nt, Artificial Sequence
  Synthetic Oligonucleotide; PRDM1 exon 5; Set A
uuuggagggguuggaguccaauuu

SEQ ID NO: 26956 - RNA, 26 nt, Artificial Sequence
  Synthetic Oligonucleotide; PRDM1 exon 5; Set A
cuuuggagggguuggaguccaauuuu

SEQ ID NO: 26957 - RNA, 28 nt, Artificial Sequence
  Synthetic Oligonucleotide; PRDM1 exon 5; Set A
ccuuuggagggguuggaguccaauuuua

SEQ ID NO: 26958 - RNA, 27 nt, Artificial Sequence
  Synthetic Oligonucleotide; PRDM1 exon 5; Set A
ccuuuggagggguuggaguccaauuuu

SEQ ID NO: 26959 - RNA, 25 nt, Artificial Sequence
  Synthetic Oligonucleotide; PRDM1 exon 5; Set A
cuuuggagggguuggaguccaauuu

SEQ ID NO: 26960 - RNA, 29 nt, Artificial Sequence
  Synthetic Oligonucleotide; PRDM1 exon 5; Set A
uccuuuggagggguuggaguccaauuuua

SEQ ID NO: 26961 - RNA, 28 nt, Artificial Sequence
  Synthetic Oligonucleotide; PRDM1 exon 5; Set A
uccuuuggagggguuggaguccaauuuu

SEQ ID NO: 26962 - RNA, 26 nt, Artificial Sequence
  Synthetic Oligonucleotide; PRDM1 exon 5; Set A
ccuuuggagggguuggaguccaauuu

SEQ ID NO: 26963 - RNA, 30 nt, Artificial Sequence
  Synthetic Oligonucleotide; PRDM1 exon 5; Set A
uuccuuuggagggguuggaguccaauuuua

SEQ ID NO: 26964 - RNA, 29 nt, Artificial Sequence
  Synthetic Oligonucleotide; PRDM1 exon 5; Set A
uuccuuuggagggguuggaguccaauuuu

SEQ ID NO: 26965 - RNA, 27 nt, Artificial Sequence
  Synthetic Oligonucleotide; PRDM1 exon 5; Set A
uccuuuggagggguuggaguccaauuu

SEQ ID NO: 26966 - RNA, 28 nt, Artificial Sequence
  Synthetic Oligonucleotide; PRDM1 exon 5; Set A
uuccuuuggagggguuggaguccaauuu

SEQ ID NO: 26967 - RNA, 36 nt, Artificial Sequence
  Synthetic Oligonucleotide; PRDM1 exon 5; Set C
agguccuuuccuuuggagggguuggaguccaauuuu

SEQ ID NO: 26968 - RNA, 38 nt, Artificial Sequence
  Synthetic Oligonucleotide; PRDM1 exon 5; Set C
gagguccuuuccuuuggagggguuggaguccaauuuua

SEQ ID NO: 26969 - RNA, 20 nt, Artificial Sequence
  Synthetic Oligonucleotide; PRDM1 exon 5; Set A
uccuuuggagggguuggagu

SEQ ID NO: 26970 - RNA, 37 nt, Artificial Sequence
  Synthetic Oligonucleotide; PRDM1 exon 5; Set C
gagguccuuuccuuuggagggguuggaguccaauuuu

SEQ ID NO: 26971 - RNA, 35 nt, Artificial Sequence
  Synthetic Oligonucleotide; PRDM1 exon 5; Set C
agguccuuuccuuuggagggguuggaguccaauuu

SEQ ID NO: 26972 - RNA, 39 nt, Artificial Sequence
  Synthetic Oligonucleotide; PRDM1 exon 5; Set C
agagguccuuuccuuuggagggguuggaguccaauuuua

SEQ ID NO: 26973 - RNA, 21 nt, Artificial Sequence
  Synthetic Oligonucleotide; PRDM1 exon 5; Set A
uuccuuuggagggguuggagu

SEQ ID NO: 26974 - RNA, 38 nt, Artificial Sequence
  Synthetic Oligonucleotide; PRDM1 exon 5; Set C
agagguccuuuccuuuggagggguuggaguccaauuuu

SEQ ID NO: 26975 - RNA, 36 nt, Artificial Sequence
  Synthetic Oligonucleotide; PRDM1 exon 5; Set C
gagguccuuuccuuuggagggguuggaguccaauuu

SEQ ID NO: 26976 - RNA, 40 nt, Artificial Sequence
  Synthetic Oligonucleotide; PRDM1 exon 5; Set C
uagagguccuuuccuuuggagggguuggaguccaauuuua

SEQ ID NO: 26977 - RNA, 37 nt, Artificial Sequence
  Synthetic Oligonucleotide; PRDM1 exon 5; Set C
agagguccuuuccuuuggagggguuggaguccaauuu

SEQ ID NO: 26978 - RNA, 39 nt, Artificial Sequence
  Synthetic Oligonucleotide; PRDM1 exon 5; Set C
uagagguccuuuccuuuggagggguuggaguccaauuuu

SEQ ID NO: 26979 - RNA, 38 nt, Artificial Sequence
  Synthetic Oligonucleotide; PRDM1 exon 5; Set C
uagagguccuuuccuuuggagggguuggaguccaauuu

SEQ ID NO: 26980 - RNA, 40 nt, Artificial Sequence
  Synthetic Oligonucleotide; PRDM1 exon 5; Set C
guagagguccuuuccuuuggagggguuggaguccaauuuu

SEQ ID NO: 26981 - RNA, 39 nt, Artificial Sequence
  Synthetic Oligonucleotide; PRDM1 exon 5; Set C
guagagguccuuuccuuuggagggguuggaguccaauuu

SEQ ID NO: 26982 - RNA, 27 nt, Artificial Sequence
  Synthetic Oligonucleotide; PRDM1 exon 5; Set C
agguccuuuccuuuggagggguuggag

SEQ ID NO: 26983 - RNA, 28 nt, Artificial Sequence
  Synthetic Oligonucleotide; PRDM1 exon 5; Set C
gagguccuuuccuuuggagggguuggag

SEQ ID NO: 26984 - RNA, 26 nt, Artificial Sequence
  Synthetic Oligonucleotide; PRDM1 exon 5; Set C
agguccuuuccuuuggagggguugga

SEQ ID NO: 26985 - RNA, 29 nt, Artificial Sequence
  Synthetic Oligonucleotide; PRDM1 exon 5; Set C
agagguccuuuccuuuggagggguuggag

SEQ ID NO: 26986 - RNA, 27 nt, Artificial Sequence
  Synthetic Oligonucleotide; PRDM1 exon 5; Set C
gagguccuuuccuuuggagggguugga

SEQ ID NO: 26987 - RNA, 25 nt, Artificial Sequence
  Synthetic Oligonucleotide; PRDM1 exon 5; Set C
agguccuuuccuuuggagggguugg

SEQ ID NO: 26988 - RNA, 28 nt, Artificial Sequence
  Synthetic Oligonucleotide; PRDM1 exon 5; Set C
agagguccuuuccuuuggagggguugga

SEQ ID NO: 26989 - RNA, 26 nt, Artificial Sequence
  Synthetic Oligonucleotide; PRDM1 exon 5; Set C
gagguccuuuccuuuggagggguugg

SEQ ID NO: 26990 - RNA, 30 nt, Artificial Sequence
  Synthetic Oligonucleotide; PRDM1 exon 5; Set C
uagagguccuuuccuuuggagggguuggag

SEQ ID NO: 26991 - RNA, 24 nt, Artificial Sequence
  Synthetic Oligonucleotide; PRDM1 exon 5; Set A
agguccuuuccuuuggagggguug

SEQ ID NO: 26992 - RNA, 27 nt, Artificial Sequence
  Synthetic Oligonucleotide; PRDM1 exon 5; Set C
agagguccuuuccuuuggagggguugg

SEQ ID NO: 26993 - RNA, 25 nt, Artificial Sequence
  Synthetic Oligonucleotide; PRDM1 exon 5; Set A
gagguccuuuccuuuggagggguug

SEQ ID NO: 26994 - RNA, 29 nt, Artificial Sequence
  Synthetic Oligonucleotide; PRDM1 exon 5; Set C
uagagguccuuuccuuuggagggguugga

SEQ ID NO: 26995 - RNA, 31 nt, Artificial Sequence
  Synthetic Oligonucleotide; PRDM1 exon 5; Set C
guagagguccuuuccuuuggagggguuggag

SEQ ID NO: 26996 - RNA, 23 nt, Artificial Sequence
  Synthetic Oligonucleotide; PRDM1 exon 5; Set A
agguccuuuccuuuggagggguu

SEQ ID NO: 26997 - RNA, 26 nt, Artificial Sequence
  Synthetic Oligonucleotide; PRDM1 exon 5; Set A
agagguccuuuccuuuggagggguug

SEQ ID NO: 26998 - RNA, 28 nt, Artificial Sequence
  Synthetic Oligonucleotide; PRDM1 exon 5; Set C
uagagguccuuuccuuuggagggguugg

SEQ ID NO: 26999 - RNA, 30 nt, Artificial Sequence
  Synthetic Oligonucleotide; PRDM1 exon 5; Set C
guagagguccuuuccuuuggagggguugga

SEQ ID NO: 27000 - RNA, 24 nt, Artificial Sequence
  Synthetic Oligonucleotide; PRDM1 exon 5; Set A
gagguccuuuccuuuggagggguu

SEQ ID NO: 27001 - RNA, 22 nt, Artificial Sequence
  Synthetic Oligonucleotide; PRDM1 exon 5; Set A
agguccuuuccuuuggaggggu

SEQ ID NO: 27002 - RNA, 21 nt, Artificial Sequence
  Synthetic Oligonucleotide; PRDM1 exon 5; Set A
agguccuuuccuuuggagggg

SEQ ID NO: 27003 - RNA, 27 nt, Artificial Sequence
  Synthetic Oligonucleotide; PRDM1 exon 5; Set A
uagagguccuuuccuuuggagggguug

SEQ ID NO: 27004 - RNA, 29 nt, Artificial Sequence
  Synthetic Oligonucleotide; PRDM1 exon 5; Set C
guagagguccuuuccuuuggagggguugg

SEQ ID NO: 27005 - RNA, 25 nt, Artificial Sequence
  Synthetic Oligonucleotide; PRDM1 exon 5; Set A
agagguccuuuccuuuggagggguu

SEQ ID NO: 27006 - RNA, 23 nt, Artificial Sequence
  Synthetic Oligonucleotide; PRDM1 exon 5; Set A
gagguccuuuccuuuggaggggu

SEQ ID NO: 27007 - RNA, 20 nt, Artificial Sequence
  Synthetic Oligonucleotide; PRDM1 exon 5; Set A
agguccuuuccuuuggaggg

SEQ ID NO: 27008 - RNA, 22 nt, Artificial Sequence
  Synthetic Oligonucleotide; PRDM1 exon 5; Set A
gagguccuuuccuuuggagggg

SEQ ID NO: 27009 - RNA, 28 nt, Artificial Sequence
  Synthetic Oligonucleotide; PRDM1 exon 5; Set C
guagagguccuuuccuuuggagggguug

SEQ ID NO: 27010 - RNA, 26 nt, Artificial Sequence
  Synthetic Oligonucleotide; PRDM1 exon 5; Set A
uagagguccuuuccuuuggagggguu

SEQ ID NO: 27011 - RNA, 24 nt, Artificial Sequence
  Synthetic Oligonucleotide; PRDM1 exon 5; Set A
agagguccuuuccuuuggaggggu

SEQ ID NO: 27012 - RNA, 21 nt, Artificial Sequence
  Synthetic Oligonucleotide; PRDM1 exon 5; Set A
gagguccuuuccuuuggaggg

SEQ ID NO: 27013 - RNA, 23 nt, Artificial Sequence
  Synthetic Oligonucleotide; PRDM1 exon 5; Set A
agagguccuuuccuuuggagggg

SEQ ID NO: 27014 - RNA, 27 nt, Artificial Sequence
  Synthetic Oligonucleotide; PRDM1 exon 5; Set C
guagagguccuuuccuuuggagggguu

SEQ ID NO: 27015 - RNA, 25 nt, Artificial Sequence
  Synthetic Oligonucleotide; PRDM1 exon 5; Set A
uagagguccuuuccuuuggaggggu

SEQ ID NO: 27016 - RNA, 22 nt, Artificial Sequence
  Synthetic Oligonucleotide; PRDM1 exon 5; Set A
agagguccuuuccuuuggaggg

SEQ ID NO: 27017 - RNA, 24 nt, Artificial Sequence
  Synthetic Oligonucleotide; PRDM1 exon 5; Set A
uagagguccuuuccuuuggagggg

SEQ ID NO: 27018 - RNA, 26 nt, Artificial Sequence
  Synthetic Oligonucleotide; PRDM1 exon 5; Set C
guagagguccuuuccuuuggaggggu

SEQ ID NO: 27019 - RNA, 23 nt, Artificial Sequence
  Synthetic Oligonucleotide; PRDM1 exon 5; Set A
uagagguccuuuccuuuggaggg

SEQ ID NO: 27020 - RNA, 25 nt, Artificial Sequence
  Synthetic Oligonucleotide; PRDM1 exon 5; Set A
guagagguccuuuccuuuggagggg

SEQ ID NO: 27021 - RNA, 24 nt, Artificial Sequence
  Synthetic Oligonucleotide; PRDM1 exon 5; Set A
guagagguccuuuccuuuggaggg

SEQ ID NO: 27022 - RNA, 40 nt, Artificial Sequence
  Synthetic Oligonucleotide; PRDM1 exon 5; Set C
guuagaacgguagagguccuuuccuuuggagggguuggag

SEQ ID NO: 27023 - RNA, 15 nt, Artificial Sequence
  Synthetic Oligonucleotide; PRDM1 exon 5; Set C
gagguccuuuccuuu

SEQ ID NO: 27024 - RNA, 39 nt, Artificial Sequence
  Synthetic Oligonucleotide; PRDM1 exon 5; Set C
guuagaacgguagagguccuuuccuuuggagggguugga

SEQ ID NO: 27025 - RNA, 16 nt, Artificial Sequence
  Synthetic Oligonucleotide; PRDM1 exon 5; Set C
agagguccuuuccuuu

SEQ ID NO: 27026 - RNA, 40 nt, Artificial Sequence
  Synthetic Oligonucleotide; PRDM1 exon 5; Set C
uguuagaacgguagagguccuuuccuuuggagggguugga

SEQ ID NO: 27027 - RNA, 38 nt, Artificial Sequence
  Synthetic Oligonucleotide; PRDM1 exon 5; Set C
guuagaacgguagagguccuuuccuuuggagggguugg

SEQ ID NO: 27028 - RNA, 17 nt, Artificial Sequence
  Synthetic Oligonucleotide; PRDM1 exon 5; Set C
uagagguccuuuccuuu

SEQ ID NO: 27029 - RNA, 15 nt, Artificial Sequence
  Synthetic Oligonucleotide; PRDM1 exon 5; Set C
agagguccuuuccuu

SEQ ID NO: 27030 - RNA, 39 nt, Artificial Sequence
  Synthetic Oligonucleotide; PRDM1 exon 5; Set C
uguuagaacgguagagguccuuuccuuuggagggguugg

SEQ ID NO: 27031 - RNA, 37 nt, Artificial Sequence
  Synthetic Oligonucleotide; PRDM1 exon 5; Set C
guuagaacgguagagguccuuuccuuuggagggguug

SEQ ID NO: 27032 - RNA, 18 nt, Artificial Sequence
  Synthetic Oligonucleotide; PRDM1 exon 5; Set C
guagagguccuuuccuuu

SEQ ID NO: 27033 - RNA, 16 nt, Artificial Sequence
  Synthetic Oligonucleotide; PRDM1 exon 5; Set C
uagagguccuuuccuu

SEQ ID NO: 27034 - RNA, 38 nt, Artificial Sequence
  Synthetic Oligonucleotide; PRDM1 exon 5; Set C
uguuagaacgguagagguccuuuccuuuggagggguug

SEQ ID NO: 27035 - RNA, 40 nt, Artificial Sequence
  Synthetic Oligonucleotide; PRDM1 exon 5; Set C
auguuagaacgguagagguccuuuccuuuggagggguugg

SEQ ID NO: 27036 - RNA, 36 nt, Artificial Sequence
  Synthetic Oligonucleotide; PRDM1 exon 5; Set C
guuagaacgguagagguccuuuccuuuggagggguu

SEQ ID NO: 27037 - RNA, 15 nt, Artificial Sequence
  Synthetic Oligonucleotide; PRDM1 exon 5; Set C
uagagguccuuuccu

SEQ ID NO: 27038 - RNA, 17 nt, Artificial Sequence
  Synthetic Oligonucleotide; PRDM1 exon 5; Set C
guagagguccuuuccuu

SEQ ID NO: 27039 - RNA, 39 nt, Artificial Sequence
  Synthetic Oligonucleotide; PRDM1 exon 5; Set C
auguuagaacgguagagguccuuuccuuuggagggguug

SEQ ID NO: 27040 - RNA, 37 nt, Artificial Sequence
  Synthetic Oligonucleotide; PRDM1 exon 5; Set C
uguuagaacgguagagguccuuuccuuuggagggguu

SEQ ID NO: 27041 - RNA, 35 nt, Artificial Sequence
  Synthetic Oligonucleotide; PRDM1 exon 5; Set C
guuagaacgguagagguccuuuccuuuggaggggu

SEQ ID NO: 27042 - RNA, 16 nt, Artificial Sequence
  Synthetic Oligonucleotide; PRDM1 exon 5; Set C
guagagguccuuuccu

SEQ ID NO: 27043 - RNA, 34 nt, Artificial Sequence
  Synthetic Oligonucleotide; PRDM1 exon 5; Set C
guuagaacgguagagguccuuuccuuuggagggg

SEQ ID NO: 27044 - RNA, 40 nt, Artificial Sequence
  Synthetic Oligonucleotide; PRDM1 exon 5; Set C
aauguuagaacgguagagguccuuuccuuuggagggguug

SEQ ID NO: 27045 - RNA, 38 nt, Artificial Sequence
  Synthetic Oligonucleotide; PRDM1 exon 5; Set C
auguuagaacgguagagguccuuuccuuuggagggguu

SEQ ID NO: 27046 - RNA, 36 nt, Artificial Sequence
  Synthetic Oligonucleotide; PRDM1 exon 5; Set C
uguuagaacgguagagguccuuuccuuuggaggggu

SEQ ID NO: 27047 - RNA, 33 nt, Artificial Sequence
  Synthetic Oligonucleotide; PRDM1 exon 5; Set C
guuagaacgguagagguccuuuccuuuggaggg

SEQ ID NO: 27048 - RNA, 15 nt, Artificial Sequence
  Synthetic Oligonucleotide; PRDM1 exon 5; Set C
guagagguccuuucc

SEQ ID NO: 27049 - RNA, 35 nt, Artificial Sequence
  Synthetic Oligonucleotide; PRDM1 exon 5; Set C
uguuagaacgguagagguccuuuccuuuggagggg

SEQ ID NO: 27050 - RNA, 39 nt, Artificial Sequence
  Synthetic Oligonucleotide; PRDM1 exon 5; Set C
aauguuagaacgguagagguccuuuccuuuggagggguu

SEQ ID NO: 27051 - RNA, 37 nt, Artificial Sequence
  Synthetic Oligonucleotide; PRDM1 exon 5; Set C
auguuagaacgguagagguccuuuccuuuggaggggu

SEQ ID NO: 27052 - RNA, 34 nt, Artificial Sequence
  Synthetic Oligonucleotide; PRDM1 exon 5; Set C
uguuagaacgguagagguccuuuccuuuggaggg

SEQ ID NO: 27053 - RNA, 36 nt, Artificial Sequence
  Synthetic Oligonucleotide; PRDM1 exon 5; Set C
auguuagaacgguagagguccuuuccuuuggagggg

SEQ ID NO: 27054 - RNA, 40 nt, Artificial Sequence
  Synthetic Oligonucleotide; PRDM1 exon 5; Set C
aaauguuagaacgguagagguccuuuccuuuggagggguu

SEQ ID NO: 27055 - RNA, 38 nt, Artificial Sequence
  Synthetic Oligonucleotide; PRDM1 exon 5; Set C
aauguuagaacgguagagguccuuuccuuuggaggggu

SEQ ID NO: 27056 - RNA, 35 nt, Artificial Sequence
  Synthetic Oligonucleotide; PRDM1 exon 5; Set C
auguuagaacgguagagguccuuuccuuuggaggg

SEQ ID NO: 27057 - RNA, 37 nt, Artificial Sequence
  Synthetic Oligonucleotide; PRDM1 exon 5; Set C
aauguuagaacgguagagguccuuuccuuuggagggg

SEQ ID NO: 27058 - RNA, 39 nt, Artificial Sequence
  Synthetic Oligonucleotide; PRDM1 exon 5; Set C
aaauguuagaacgguagagguccuuuccuuuggaggggu

SEQ ID NO: 27059 - RNA, 36 nt, Artificial Sequence
  Synthetic Oligonucleotide; PRDM1 exon 5; Set C
aauguuagaacgguagagguccuuuccuuuggaggg

SEQ ID NO: 27060 - RNA, 38 nt, Artificial Sequence
  Synthetic Oligonucleotide; PRDM1 exon 5; Set C
aaauguuagaacgguagagguccuuuccuuuggagggg

SEQ ID NO: 27061 - RNA, 40 nt, Artificial Sequence
  Synthetic Oligonucleotide; PRDM1 exon 5; Set C
gaaauguuagaacgguagagguccuuuccuuuggaggggu

SEQ ID NO: 27062 - RNA, 37 nt, Artificial Sequence
  Synthetic Oligonucleotide; PRDM1 exon 5; Set C
aaauguuagaacgguagagguccuuuccuuuggaggg

SEQ ID NO: 27063 - RNA, 39 nt, Artificial Sequence
  Synthetic Oligonucleotide; PRDM1 exon 5; Set C
gaaauguuagaacgguagagguccuuuccuuuggagggg

SEQ ID NO: 27064 - RNA, 38 nt, Artificial Sequence
  Synthetic Oligonucleotide; PRDM1 exon 5; Set C
gaaauguuagaacgguagagguccuuuccuuuggaggg

SEQ ID NO: 27065 - RNA, 40 nt, Artificial Sequence
  Synthetic Oligonucleotide; PRDM1 exon 5; Set C
ugaaauguuagaacgguagagguccuuuccuuuggagggg

SEQ ID NO: 27066 - RNA, 39 nt, Artificial Sequence
  Synthetic Oligonucleotide; PRDM1 exon 5; Set C
ugaaauguuagaacgguagagguccuuuccuuuggaggg

SEQ ID NO: 27067 - RNA, 40 nt, Artificial Sequence
  Synthetic Oligonucleotide; PRDM1 exon 5; Set C
gugaaauguuagaacgguagagguccuuuccuuuggaggg

SEQ ID NO: 27068 - RNA, 30 nt, Artificial Sequence
  Synthetic Oligonucleotide; PRDM1 exon 5; Set A
aauguuagaacgguagagguccuuuccuuu

SEQ ID NO: 27069 - RNA, 31 nt, Artificial Sequence
  Synthetic Oligonucleotide; PRDM1 exon 5; Set A
aaauguuagaacgguagagguccuuuccuuu

SEQ ID NO: 27070 - RNA, 32 nt, Artificial Sequence
  Synthetic Oligonucleotide; PRDM1 exon 5; Set A
gaaauguuagaacgguagagguccuuuccuuu

SEQ ID NO: 27071 - RNA, 30 nt, Artificial Sequence
  Synthetic Oligonucleotide; PRDM1 exon 5; Set A
aaauguuagaacgguagagguccuuuccuu

SEQ ID NO: 27072 - RNA, 29 nt, Artificial Sequence
  Synthetic Oligonucleotide; PRDM1 exon 5; Set A
aaauguuagaacgguagagguccuuuccu

SEQ ID NO: 27073 - RNA, 33 nt, Artificial Sequence
  Synthetic Oligonucleotide; PRDM1 exon 5; Set A
ugaaauguuagaacgguagagguccuuuccuuu

SEQ ID NO: 27074 - RNA, 31 nt, Artificial Sequence
  Synthetic Oligonucleotide; PRDM1 exon 5; Set A
gaaauguuagaacgguagagguccuuuccuu

SEQ ID NO: 27075 - RNA, 30 nt, Artificial Sequence
  Synthetic Oligonucleotide; PRDM1 exon 5; Set A
gaaauguuagaacgguagagguccuuuccu

SEQ ID NO: 27076 - RNA, 34 nt, Artificial Sequence
  Synthetic Oligonucleotide; PRDM1 exon 5; Set A
gugaaauguuagaacgguagagguccuuuccuuu

SEQ ID NO: 27077 - RNA, 32 nt, Artificial Sequence
  Synthetic Oligonucleotide; PRDM1 exon 5; Set A
ugaaauguuagaacgguagagguccuuuccuu

SEQ ID NO: 27078 - RNA, 31 nt, Artificial Sequence
  Synthetic Oligonucleotide; PRDM1 exon 5; Set A
ugaaauguuagaacgguagagguccuuuccu

SEQ ID NO: 27079 - RNA, 29 nt, Artificial Sequence
  Synthetic Oligonucleotide; PRDM1 exon 5; Set A
gaaauguuagaacgguagagguccuuucc

SEQ ID NO: 27080 - RNA, 35 nt, Artificial Sequence
  Synthetic Oligonucleotide; PRDM1 exon 5; Set C
ggugaaauguuagaacgguagagguccuuuccuuu

SEQ ID NO: 27081 - RNA, 33 nt, Artificial Sequence
  Synthetic Oligonucleotide; PRDM1 exon 5; Set A
gugaaauguuagaacgguagagguccuuuccuu

SEQ ID NO: 27082 - RNA, 28 nt, Artificial Sequence
  Synthetic Oligonucleotide; PRDM1 exon 5; Set A
gaaauguuagaacgguagagguccuuuc

SEQ ID NO: 27083 - RNA, 32 nt, Artificial Sequence
  Synthetic Oligonucleotide; PRDM1 exon 5; Set A
gugaaauguuagaacgguagagguccuuuccu

SEQ ID NO: 27084 - RNA, 30 nt, Artificial Sequence
  Synthetic Oligonucleotide; PRDM1 exon 5; Set A
ugaaauguuagaacgguagagguccuuucc

SEQ ID NO: 27085 - RNA, 36 nt, Artificial Sequence
  Synthetic Oligonucleotide; PRDM1 exon 5; Set C
gggugaaauguuagaacgguagagguccuuuccuuu

SEQ ID NO: 27086 - RNA, 34 nt, Artificial Sequence
  Synthetic Oligonucleotide; PRDM1 exon 5; Set C
ggugaaauguuagaacgguagagguccuuuccuu

SEQ ID NO: 27087 - RNA, 29 nt, Artificial Sequence
  Synthetic Oligonucleotide; PRDM1 exon 5; Set A
ugaaauguuagaacgguagagguccuuuc

SEQ ID NO: 27088 - RNA, 33 nt, Artificial Sequence
  Synthetic Oligonucleotide; PRDM1 exon 5; Set C
ggugaaauguuagaacgguagagguccuuuccu

SEQ ID NO: 27089 - RNA, 31 nt, Artificial Sequence
  Synthetic Oligonucleotide; PRDM1 exon 5; Set A
gugaaauguuagaacgguagagguccuuucc

SEQ ID NO: 27090 - RNA, 37 nt, Artificial Sequence
  Synthetic Oligonucleotide; PRDM1 exon 5; Set C
ggggugaaauguuagaacgguagagguccuuuccuuu

SEQ ID NO: 27091 - RNA, 35 nt, Artificial Sequence
  Synthetic Oligonucleotide; PRDM1 exon 5; Set C
gggugaaauguuagaacgguagagguccuuuccuu

SEQ ID NO: 27092 - RNA, 30 nt, Artificial Sequence
  Synthetic Oligonucleotide; PRDM1 exon 5; Set A
gugaaauguuagaacgguagagguccuuuc

SEQ ID NO: 27093 - RNA, 34 nt, Artificial Sequence
  Synthetic Oligonucleotide; PRDM1 exon 5; Set C
gggugaaauguuagaacgguagagguccuuuccu

SEQ ID NO: 27094 - RNA, 32 nt, Artificial Sequence
  Synthetic Oligonucleotide; PRDM1 exon 5; Set A
ggugaaauguuagaacgguagagguccuuucc

SEQ ID NO: 27095 - RNA, 38 nt, Artificial Sequence
  Synthetic Oligonucleotide; PRDM1 exon 5; Set C
aggggugaaauguuagaacgguagagguccuuuccuuu

SEQ ID NO: 27096 - RNA, 36 nt, Artificial Sequence
  Synthetic Oligonucleotide; PRDM1 exon 5; Set C
ggggugaaauguuagaacgguagagguccuuuccuu

SEQ ID NO: 27097 - RNA, 31 nt, Artificial Sequence
  Synthetic Oligonucleotide; PRDM1 exon 5; Set A
ggugaaauguuagaacgguagagguccuuuc

SEQ ID NO: 27098 - RNA, 33 nt, Artificial Sequence
  Synthetic Oligonucleotide; PRDM1 exon 5; Set C
gggugaaauguuagaacgguagagguccuuucc

SEQ ID NO: 27099 - RNA, 35 nt, Artificial Sequence
  Synthetic Oligonucleotide; PRDM1 exon 5; Set C
ggggugaaauguuagaacgguagagguccuuuccu

SEQ ID NO: 27100 - RNA, 39 nt, Artificial Sequence
  Synthetic Oligonucleotide; PRDM1 exon 5; Set C
gaggggugaaauguuagaacgguagagguccuuuccuuu

SEQ ID NO: 27101 - RNA, 32 nt, Artificial Sequence
  Synthetic Oligonucleotide; PRDM1 exon 5; Set A
gggugaaauguuagaacgguagagguccuuuc

SEQ ID NO: 27102 - RNA, 34 nt, Artificial Sequence
  Synthetic Oligonucleotide; PRDM1 exon 5; Set C
ggggugaaauguuagaacgguagagguccuuucc

SEQ ID NO: 27103 - RNA, 36 nt, Artificial Sequence
  Synthetic Oligonucleotide; PRDM1 exon 5; Set C
aggggugaaauguuagaacgguagagguccuuuccu

SEQ ID NO: 27104 - RNA, 40 nt, Artificial Sequence
  Synthetic Oligonucleotide; PRDM1 exon 5; Set C
ugaggggugaaauguuagaacgguagagguccuuuccuuu

SEQ ID NO: 27105 - RNA, 38 nt, Artificial Sequence
  Synthetic Oligonucleotide; PRDM1 exon 5; Set C
gaggggugaaauguuagaacgguagagguccuuuccuu

SEQ ID NO: 27106 - RNA, 33 nt, Artificial Sequence
  Synthetic Oligonucleotide; PRDM1 exon 5; Set C
ggggugaaauguuagaacgguagagguccuuuc

SEQ ID NO: 27107 - RNA, 37 nt, Artificial Sequence
  Synthetic Oligonucleotide; PRDM1 exon 5; Set C
gaggggugaaauguuagaacgguagagguccuuuccu

SEQ ID NO: 27108 - RNA, 39 nt, Artificial Sequence
  Synthetic Oligonucleotide; PRDM1 exon 5; Set C
ugaggggugaaauguuagaacgguagagguccuuuccuu

SEQ ID NO: 27109 - RNA, 18 nt, Artificial Sequence
  Synthetic Oligonucleotide; PRDM1 exon 5; Set C
aauguuagaacgguagag

SEQ ID NO: 27110 - RNA, 38 nt, Artificial Sequence
  Synthetic Oligonucleotide; PRDM1 exon 5; Set C
ugaggggugaaauguuagaacgguagagguccuuuccu

SEQ ID NO: 27111 - RNA, 36 nt, Artificial Sequence
  Synthetic Oligonucleotide; PRDM1 exon 5; Set C
gaggggugaaauguuagaacgguagagguccuuucc

SEQ ID NO: 27112 - RNA, 19 nt, Artificial Sequence
  Synthetic Oligonucleotide; PRDM1 exon 5; Set C
aaauguuagaacgguagag

SEQ ID NO: 27113 - RNA, 35 nt, Artificial Sequence
  Synthetic Oligonucleotide; PRDM1 exon 5; Set C
gaggggugaaauguuagaacgguagagguccuuuc

SEQ ID NO: 27114 - RNA, 37 nt, Artificial Sequence
  Synthetic Oligonucleotide; PRDM1 exon 5; Set C
ugaggggugaaauguuagaacgguagagguccuuucc

SEQ ID NO: 27115 - RNA, 21 nt, Artificial Sequence
  Synthetic Oligonucleotide; PRDM1 exon 5; Set C
gaaauguuagaacgguagagg

SEQ ID NO: 27116 - RNA, 20 nt, Artificial Sequence
  Synthetic Oligonucleotide; PRDM1 exon 5; Set C
gaaauguuagaacgguagag

SEQ ID NO: 27117 - RNA, 18 nt, Artificial Sequence
  Synthetic Oligonucleotide; PRDM1 exon 5; Set C
aaauguuagaacgguaga

SEQ ID NO: 27118 - RNA, 36 nt, Artificial Sequence
  Synthetic Oligonucleotide; PRDM1 exon 5; Set C
ugaggggugaaauguuagaacgguagagguccuuuc

SEQ ID NO: 27119 - RNA, 22 nt, Artificial Sequence
  Synthetic Oligonucleotide; PRDM1 exon 5; Set C
ugaaauguuagaacgguagagg

SEQ ID NO: 27120 - RNA, 21 nt, Artificial Sequence
  Synthetic Oligonucleotide; PRDM1 exon 5; Set C
ugaaauguuagaacgguagag

SEQ ID NO: 27121 - RNA, 19 nt, Artificial Sequence
  Synthetic Oligonucleotide; PRDM1 exon 5; Set C
gaaauguuagaacgguaga

SEQ ID NO: 27122 - RNA, 23 nt, Artificial Sequence
  Synthetic Oligonucleotide; PRDM1 exon 5; Set C
gugaaauguuagaacgguagagg

SEQ ID NO: 27123 - RNA, 22 nt, Artificial Sequence
  Synthetic Oligonucleotide; PRDM1 exon 5; Set C
gugaaauguuagaacgguagag

SEQ ID NO: 27124 - RNA, 20 nt, Artificial Sequence
  Synthetic Oligonucleotide; PRDM1 exon 5; Set C
ugaaauguuagaacgguaga

SEQ ID NO: 27125 - RNA, 18 nt, Artificial Sequence
  Synthetic Oligonucleotide; PRDM1 exon 5; Set C
gaaauguuagaacgguag

SEQ ID NO: 27126 - RNA, 24 nt, Artificial Sequence
  Synthetic Oligonucleotide; PRDM1 exon 5; Set C
ggugaaauguuagaacgguagagg

SEQ ID NO: 27127 - RNA, 23 nt, Artificial Sequence
  Synthetic Oligonucleotide; PRDM1 exon 5; Set C
ggugaaauguuagaacgguagag

SEQ ID NO: 27128 - RNA, 21 nt, Artificial Sequence
  Synthetic Oligonucleotide; PRDM1 exon 5; Set C
gugaaauguuagaacgguaga

SEQ ID NO: 27129 - RNA, 19 nt, Artificial Sequence
  Synthetic Oligonucleotide; PRDM1 exon 5; Set C
ugaaauguuagaacgguag

SEQ ID NO: 27130 - RNA, 25 nt, Artificial Sequence
  Synthetic Oligonucleotide; PRDM1 exon 5; Set A
gggugaaauguuagaacgguagagg

SEQ ID NO: 27131 - RNA, 24 nt, Artificial Sequence
  Synthetic Oligonucleotide; PRDM1 exon 5; Set C
gggugaaauguuagaacgguagag

SEQ ID NO: 27132 - RNA, 22 nt, Artificial Sequence
  Synthetic Oligonucleotide; PRDM1 exon 5; Set C
ggugaaauguuagaacgguaga

SEQ ID NO: 27133 - RNA, 20 nt, Artificial Sequence
  Synthetic Oligonucleotide; PRDM1 exon 5; Set C
gugaaauguuagaacgguag

SEQ ID NO: 27134 - RNA, 18 nt, Artificial Sequence
  Synthetic Oligonucleotide; PRDM1 exon 5; Set C
ugaaauguuagaacggua

SEQ ID NO: 27135 - RNA, 26 nt, Artificial Sequence
  Synthetic Oligonucleotide; PRDM1 exon 5; Set A
ggggugaaauguuagaacgguagagg

SEQ ID NO: 27136 - RNA, 23 nt, Artificial Sequence
  Synthetic Oligonucleotide; PRDM1 exon 5; Set C
gggugaaauguuagaacgguaga

SEQ ID NO: 27137 - RNA, 25 nt, Artificial Sequence
  Synthetic Oligonucleotide; PRDM1 exon 5; Set A
ggggugaaauguuagaacgguagag

SEQ ID NO: 27138 - RNA, 21 nt, Artificial Sequence
  Synthetic Oligonucleotide; PRDM1 exon 5; Set C
ggugaaauguuagaacgguag

SEQ ID NO: 27139 - RNA, 19 nt, Artificial Sequence
  Synthetic Oligonucleotide; PRDM1 exon 5; Set C
gugaaauguuagaacggua

SEQ ID NO: 27140 - RNA, 27 nt, Artificial Sequence
  Synthetic Oligonucleotide; PRDM1 exon 5; Set A
aggggugaaauguuagaacgguagagg

SEQ ID NO: 27141 - RNA, 24 nt, Artificial Sequence
  Synthetic Oligonucleotide; PRDM1 exon 5; Set A
ggggugaaauguuagaacgguaga

SEQ ID NO: 27142 - RNA, 26 nt, Artificial Sequence
  Synthetic Oligonucleotide; PRDM1 exon 5; Set A
aggggugaaauguuagaacgguagag

SEQ ID NO: 27143 - RNA, 22 nt, Artificial Sequence
  Synthetic Oligonucleotide; PRDM1 exon 5; Set C
gggugaaauguuagaacgguag

SEQ ID NO: 27144 - RNA, 20 nt, Artificial Sequence
  Synthetic Oligonucleotide; PRDM1 exon 5; Set C
ggugaaauguuagaacggua

SEQ ID NO: 27145 - RNA, 28 nt, Artificial Sequence
  Synthetic Oligonucleotide; PRDM1 exon 5; Set A
gaggggugaaauguuagaacgguagagg

SEQ ID NO: 27146 - RNA, 25 nt, Artificial Sequence
  Synthetic Oligonucleotide; PRDM1 exon 5; Set A
aggggugaaauguuagaacgguaga

SEQ ID NO: 27147 - RNA, 27 nt, Artificial Sequence
  Synthetic Oligonucleotide; PRDM1 exon 5; Set A
gaggggugaaauguuagaacgguagag

SEQ ID NO: 27148 - RNA, 23 nt, Artificial Sequence
  Synthetic Oligonucleotide; PRDM1 exon 5; Set C
ggggugaaauguuagaacgguag

SEQ ID NO: 27149 - RNA, 21 nt, Artificial Sequence
  Synthetic Oligonucleotide; PRDM1 exon 5; Set C
gggugaaauguuagaacggua

SEQ ID NO: 27150 - RNA, 29 nt, Artificial Sequence
  Synthetic Oligonucleotide; PRDM1 exon 5; Set A
ugaggggugaaauguuagaacgguagagg

SEQ ID NO: 27151 - RNA, 28 nt, Artificial Sequence
  Synthetic Oligonucleotide; PRDM1 exon 5; Set A
ugaggggugaaauguuagaacgguagag

SEQ ID NO: 27152 - RNA, 26 nt, Artificial Sequence
  Synthetic Oligonucleotide; PRDM1 exon 5; Set A
gaggggugaaauguuagaacgguaga

SEQ ID NO: 27153 - RNA, 24 nt, Artificial Sequence
  Synthetic Oligonucleotide; PRDM1 exon 5; Set C
aggggugaaauguuagaacgguag

SEQ ID NO: 27154 - RNA, 22 nt, Artificial Sequence
  Synthetic Oligonucleotide; PRDM1 exon 5; Set C
ggggugaaauguuagaacggua

SEQ ID NO: 27155 - RNA, 27 nt, Artificial Sequence
  Synthetic Oligonucleotide; PRDM1 exon 5; Set A
ugaggggugaaauguuagaacgguaga

SEQ ID NO: 27156 - RNA, 25 nt, Artificial Sequence
  Synthetic Oligonucleotide; PRDM1 exon 5; Set A
gaggggugaaauguuagaacgguag

SEQ ID NO: 27157 - RNA, 23 nt, Artificial Sequence
  Synthetic Oligonucleotide; PRDM1 exon 5; Set C
aggggugaaauguuagaacggua

SEQ ID NO: 27158 - RNA, 26 nt, Artificial Sequence
  Synthetic Oligonucleotide; PRDM1 exon 5; Set A
ugaggggugaaauguuagaacgguag

SEQ ID NO: 27159 - RNA, 24 nt, Artificial Sequence
  Synthetic Oligonucleotide; PRDM1 exon 5; Set A
gaggggugaaauguuagaacggua

SEQ ID NO: 27160 - RNA, 25 nt, Artificial Sequence
  Synthetic Oligonucleotide; PRDM1 exon 5; Set A
ugaggggugaaauguuagaacggua

SEQ ID NO: 27161 - RNA, 38 nt, Artificial Sequence
  Synthetic Oligonucleotide; PRDM1 exon 5; Set C
uuucugaugugaggggugaaauguuagaacgguagagg

SEQ ID NO: 27162 - RNA, 37 nt, Artificial Sequence
  Synthetic Oligonucleotide; PRDM1 exon 5; Set A
uuucugaugugaggggugaaauguuagaacgguagag

SEQ ID NO: 27163 - RNA, 39 nt, Artificial Sequence
  Synthetic Oligonucleotide; PRDM1 exon 5; Set C
uuuucugaugugaggggugaaauguuagaacgguagagg

SEQ ID NO: 27164 - RNA, 36 nt, Artificial Sequence
  Synthetic Oligonucleotide; PRDM1 exon 5; Set C
uuucugaugugaggggugaaauguuagaacgguaga

SEQ ID NO: 27165 - RNA, 38 nt, Artificial Sequence
  Synthetic Oligonucleotide; PRDM1 exon 5; Set A
uuuucugaugugaggggugaaauguuagaacgguagag

SEQ ID NO: 27166 - RNA, 40 nt, Artificial Sequence
  Synthetic Oligonucleotide; PRDM1 exon 5; Set C
cuuuucugaugugaggggugaaauguuagaacgguagagg

SEQ ID NO: 27167 - RNA, 37 nt, Artificial Sequence
  Synthetic Oligonucleotide; PRDM1 exon 5; Set C
uuuucugaugugaggggugaaauguuagaacgguaga

SEQ ID NO: 27168 - RNA, 39 nt, Artificial Sequence
  Synthetic Oligonucleotide; PRDM1 exon 5; Set C
cuuuucugaugugaggggugaaauguuagaacgguagag

SEQ ID NO: 27169 - RNA, 35 nt, Artificial Sequence
  Synthetic Oligonucleotide; PRDM1 exon 5; Set A
uuucugaugugaggggugaaauguuagaacgguag

SEQ ID NO: 27170 - RNA, 38 nt, Artificial Sequence
  Synthetic Oligonucleotide; PRDM1 exon 5; Set C
cuuuucugaugugaggggugaaauguuagaacgguaga

SEQ ID NO: 27171 - RNA, 40 nt, Artificial Sequence
  Synthetic Oligonucleotide; PRDM1 exon 5; Set C
ccuuuucugaugugaggggugaaauguuagaacgguagag

SEQ ID NO: 27172 - RNA, 36 nt, Artificial Sequence
  Synthetic Oligonucleotide; PRDM1 exon 5; Set A
uuuucugaugugaggggugaaauguuagaacgguag

SEQ ID NO: 27173 - RNA, 34 nt, Artificial Sequence
  Synthetic Oligonucleotide; PRDM1 exon 5; Set A
uuucugaugugaggggugaaauguuagaacggua

SEQ ID NO: 27174 - RNA, 39 nt, Artificial Sequence
  Synthetic Oligonucleotide; PRDM1 exon 5; Set C
ccuuuucugaugugaggggugaaauguuagaacgguaga

SEQ ID NO: 27175 - RNA, 37 nt, Artificial Sequence
  Synthetic Oligonucleotide; PRDM1 exon 5; Set A
cuuuucugaugugaggggugaaauguuagaacgguag

SEQ ID NO: 27176 - RNA, 35 nt, Artificial Sequence
  Synthetic Oligonucleotide; PRDM1 exon 5; Set A
uuuucugaugugaggggugaaauguuagaacggua

SEQ ID NO: 27177 - RNA, 40 nt, Artificial Sequence
  Synthetic Oligonucleotide; PRDM1 exon 5; Set C
uccuuuucugaugugaggggugaaauguuagaacgguaga

SEQ ID NO: 27178 - RNA, 38 nt, Artificial Sequence
  Synthetic Oligonucleotide; PRDM1 exon 5; Set C
ccuuuucugaugugaggggugaaauguuagaacgguag

SEQ ID NO: 27179 - RNA, 36 nt, Artificial Sequence
  Synthetic Oligonucleotide; PRDM1 exon 5; Set A
cuuuucugaugugaggggugaaauguuagaacggua

SEQ ID NO: 27180 - RNA, 39 nt, Artificial Sequence
  Synthetic Oligonucleotide; PRDM1 exon 5; Set C
uccuuuucugaugugaggggugaaauguuagaacgguag

SEQ ID NO: 27181 - RNA, 37 nt, Artificial Sequence
  Synthetic Oligonucleotide; PRDM1 exon 5; Set C
ccuuuucugaugugaggggugaaauguuagaacggua

SEQ ID NO: 27182 - RNA, 40 nt, Artificial Sequence
  Synthetic Oligonucleotide; PRDM1 exon 5; Set C
guccuuuucugaugugaggggugaaauguuagaacgguag

SEQ ID NO: 27183 - RNA, 38 nt, Artificial Sequence
  Synthetic Oligonucleotide; PRDM1 exon 5; Set C
uccuuuucugaugugaggggugaaauguuagaacggua

SEQ ID NO: 27184 - RNA, 39 nt, Artificial Sequence
  Synthetic Oligonucleotide; PRDM1 exon 5; Set C
guccuuuucugaugugaggggugaaauguuagaacggua

SEQ ID NO: 27185 - RNA, 25 nt, Artificial Sequence
  Synthetic Oligonucleotide; PRDM1 exon 5; Set C
uuucugaugugaggggugaaauguu

SEQ ID NO: 27186 - RNA, 24 nt, Artificial Sequence
  Synthetic Oligonucleotide; PRDM1 exon 5; Set C
uuucugaugugaggggugaaaugu

SEQ ID NO: 27187 - RNA, 26 nt, Artificial Sequence
  Synthetic Oligonucleotide; PRDM1 exon 5; Set C
uuuucugaugugaggggugaaauguu

SEQ ID NO: 27188 - RNA, 25 nt, Artificial Sequence
  Synthetic Oligonucleotide; PRDM1 exon 5; Set C
uuuucugaugugaggggugaaaugu

SEQ ID NO: 27189 - RNA, 23 nt, Artificial Sequence
  Synthetic Oligonucleotide; PRDM1 exon 5; Set C
uuucugaugugaggggugaaaug

SEQ ID NO: 27190 - RNA, 27 nt, Artificial Sequence
  Synthetic Oligonucleotide; PRDM1 exon 5; Set A
cuuuucugaugugaggggugaaauguu

SEQ ID NO: 27191 - RNA, 26 nt, Artificial Sequence
  Synthetic Oligonucleotide; PRDM1 exon 5; Set A
cuuuucugaugugaggggugaaaugu

SEQ ID NO: 27192 - RNA, 22 nt, Artificial Sequence
  Synthetic Oligonucleotide; PRDM1 exon 5; Set C
uuucugaugugaggggugaaau

SEQ ID NO: 27193 - RNA, 24 nt, Artificial Sequence
  Synthetic Oligonucleotide; PRDM1 exon 5; Set C
uuuucugaugugaggggugaaaug

SEQ ID NO: 27194 - RNA, 28 nt, Artificial Sequence
  Synthetic Oligonucleotide; PRDM1 exon 5; Set A
ccuuuucugaugugaggggugaaauguu

SEQ ID NO: 27195 - RNA, 27 nt, Artificial Sequence
  Synthetic Oligonucleotide; PRDM1 exon 5; Set A
ccuuuucugaugugaggggugaaaugu

SEQ ID NO: 27196 - RNA, 21 nt, Artificial Sequence
  Synthetic Oligonucleotide; PRDM1 exon 5; Set C
uuucugaugugaggggugaaa

SEQ ID NO: 27197 - RNA, 23 nt, Artificial Sequence
  Synthetic Oligonucleotide; PRDM1 exon 5; Set C
uuuucugaugugaggggugaaau

SEQ ID NO: 27198 - RNA, 25 nt, Artificial Sequence
  Synthetic Oligonucleotide; PRDM1 exon 5; Set C
cuuuucugaugugaggggugaaaug

SEQ ID NO: 27199 - RNA, 29 nt, Artificial Sequence
  Synthetic Oligonucleotide; PRDM1 exon 5; Set A
uccuuuucugaugugaggggugaaauguu

SEQ ID NO: 27200 - RNA, 28 nt, Artificial Sequence
  Synthetic Oligonucleotide; PRDM1 exon 5; Set A
uccuuuucugaugugaggggugaaaugu

SEQ ID NO: 27201 - RNA, 20 nt, Artificial Sequence
  Synthetic Oligonucleotide; PRDM1 exon 5; Set C
uuucugaugugaggggugaa

SEQ ID NO: 27202 - RNA, 22 nt, Artificial Sequence
  Synthetic Oligonucleotide; PRDM1 exon 5; Set C
uuuucugaugugaggggugaaa

SEQ ID NO: 27203 - RNA, 24 nt, Artificial Sequence
  Synthetic Oligonucleotide; PRDM1 exon 5; Set C
cuuuucugaugugaggggugaaau

SEQ ID NO: 27204 - RNA, 26 nt, Artificial Sequence
  Synthetic Oligonucleotide; PRDM1 exon 5; Set A
ccuuuucugaugugaggggugaaaug

SEQ ID NO: 27205 - RNA, 30 nt, Artificial Sequence
  Synthetic Oligonucleotide; PRDM1 exon 5; Set A
guccuuuucugaugugaggggugaaauguu

SEQ ID NO: 27206 - RNA, 29 nt, Artificial Sequence
  Synthetic Oligonucleotide; PRDM1 exon 5; Set A
guccuuuucugaugugaggggugaaaugu

SEQ ID NO: 27207 - RNA, 19 nt, Artificial Sequence
  Synthetic Oligonucleotide; PRDM1 exon 5; Set C
uuucugaugugagggguga

SEQ ID NO: 27208 - RNA, 21 nt, Artificial Sequence
  Synthetic Oligonucleotide; PRDM1 exon 5; Set C
uuuucugaugugaggggugaa

SEQ ID NO: 27209 - RNA, 23 nt, Artificial Sequence
  Synthetic Oligonucleotide; PRDM1 exon 5; Set C
cuuuucugaugugaggggugaaa

SEQ ID NO: 27210 - RNA, 27 nt, Artificial Sequence
  Synthetic Oligonucleotide; PRDM1 exon 5; Set A
uccuuuucugaugugaggggugaaaug

SEQ ID NO: 27211 - RNA, 25 nt, Artificial Sequence
  Synthetic Oligonucleotide; PRDM1 exon 5; Set A
ccuuuucugaugugaggggugaaau

SEQ ID NO: 27212 - RNA, 31 nt, Artificial Sequence
  Synthetic Oligonucleotide; PRDM1 exon 5; Set A
gguccuuuucugaugugaggggugaaauguu

SEQ ID NO: 27213 - RNA, 30 nt, Artificial Sequence
  Synthetic Oligonucleotide; PRDM1 exon 5; Set A
gguccuuuucugaugugaggggugaaaugu

SEQ ID NO: 27214 - RNA, 18 nt, Artificial Sequence
  Synthetic Oligonucleotide; PRDM1 exon 5; Set C
uuucugaugugaggggug

SEQ ID NO: 27215 - RNA, 20 nt, Artificial Sequence
  Synthetic Oligonucleotide; PRDM1 exon 5; Set C
uuuucugaugugagggguga

SEQ ID NO: 27216 - RNA, 22 nt, Artificial Sequence
  Synthetic Oligonucleotide; PRDM1 exon 5; Set C
cuuuucugaugugaggggugaa

SEQ ID NO: 27217 - RNA, 26 nt, Artificial Sequence
  Synthetic Oligonucleotide; PRDM1 exon 5; Set A
uccuuuucugaugugaggggugaaau

SEQ ID NO: 27218 - RNA, 24 nt, Artificial Sequence
  Synthetic Oligonucleotide; PRDM1 exon 5; Set A
ccuuuucugaugugaggggugaaa

SEQ ID NO: 27219 - RNA, 28 nt, Artificial Sequence
  Synthetic Oligonucleotide; PRDM1 exon 5; Set A
guccuuuucugaugugaggggugaaaug

SEQ ID NO: 27220 - RNA, 32 nt, Artificial Sequence
  Synthetic Oligonucleotide; PRDM1 exon 5; Set A
agguccuuuucugaugugaggggugaaauguu

SEQ ID NO: 27221 - RNA, 17 nt, Artificial Sequence
  Synthetic Oligonucleotide; PRDM1 exon 5; Set C
uuucugaugugaggggu

SEQ ID NO: 27222 - RNA, 31 nt, Artificial Sequence
  Synthetic Oligonucleotide; PRDM1 exon 5; Set A
agguccuuuucugaugugaggggugaaaugu

SEQ ID NO: 27223 - RNA, 19 nt, Artificial Sequence
  Synthetic Oligonucleotide; PRDM1 exon 5; Set C
uuuucugaugugaggggug

SEQ ID NO: 27224 - RNA, 21 nt, Artificial Sequence
  Synthetic Oligonucleotide; PRDM1 exon 5; Set C
cuuuucugaugugagggguga

SEQ ID NO: 27225 - RNA, 25 nt, Artificial Sequence
  Synthetic Oligonucleotide; PRDM1 exon 5; Set A
uccuuuucugaugugaggggugaaa

SEQ ID NO: 27226 - RNA, 23 nt, Artificial Sequence
  Synthetic Oligonucleotide; PRDM1 exon 5; Set A
ccuuuucugaugugaggggugaa

SEQ ID NO: 27227 - RNA, 27 nt, Artificial Sequence
  Synthetic Oligonucleotide; PRDM1 exon 5; Set A
guccuuuucugaugugaggggugaaau

SEQ ID NO: 27228 - RNA, 33 nt, Artificial Sequence
  Synthetic Oligonucleotide; PRDM1 exon 5; Set C
gagguccuuuucugaugugaggggugaaauguu

SEQ ID NO: 27229 - RNA, 29 nt, Artificial Sequence
  Synthetic Oligonucleotide; PRDM1 exon 5; Set A
gguccuuuucugaugugaggggugaaaug

SEQ ID NO: 27230 - RNA, 16 nt, Artificial Sequence
  Synthetic Oligonucleotide; PRDM1 exon 5; Set C
uuucugaugugagggg

SEQ ID NO: 27231 - RNA, 18 nt, Artificial Sequence
  Synthetic Oligonucleotide; PRDM1 exon 5; Set C
uuuucugaugugaggggu

SEQ ID NO: 27232 - RNA, 32 nt, Artificial Sequence
  Synthetic Oligonucleotide; PRDM1 exon 5; Set C
gagguccuuuucugaugugaggggugaaaugu

SEQ ID NO: 27233 - RNA, 20 nt, Artificial Sequence
  Synthetic Oligonucleotide; PRDM1 exon 5; Set C
cuuuucugaugugaggggug

SEQ ID NO: 27234 - RNA, 24 nt, Artificial Sequence
  Synthetic Oligonucleotide; PRDM1 exon 5; Set A
uccuuuucugaugugaggggugaa

SEQ ID NO: 27235 - RNA, 22 nt, Artificial Sequence
  Synthetic Oligonucleotide; PRDM1 exon 5; Set A
ccuuuucugaugugagggguga

SEQ ID NO: 27236 - RNA, 26 nt, Artificial Sequence
  Synthetic Oligonucleotide; PRDM1 exon 5; Set A
guccuuuucugaugugaggggugaaa

SEQ ID NO: 27237 - RNA, 30 nt, Artificial Sequence
  Synthetic Oligonucleotide; PRDM1 exon 5; Set A
agguccuuuucugaugugaggggugaaaug

SEQ ID NO: 27238 - RNA, 28 nt, Artificial Sequence
  Synthetic Oligonucleotide; PRDM1 exon 5; Set A
gguccuuuucugaugugaggggugaaau

SEQ ID NO: 27239 - RNA, 17 nt, Artificial Sequence
  Synthetic Oligonucleotide; PRDM1 exon 5; Set C
uuuucugaugugagggg

SEQ ID NO: 27240 - RNA, 19 nt, Artificial Sequence
  Synthetic Oligonucleotide; PRDM1 exon 5; Set C
cuuuucugaugugaggggu

SEQ ID NO: 27241 - RNA, 21 nt, Artificial Sequence
  Synthetic Oligonucleotide; PRDM1 exon 5; Set A
ccuuuucugaugugaggggug

SEQ ID NO: 27242 - RNA, 23 nt, Artificial Sequence
  Synthetic Oligonucleotide; PRDM1 exon 5; Set A
uccuuuucugaugugagggguga

SEQ ID NO: 27243 - RNA, 25 nt, Artificial Sequence
  Synthetic Oligonucleotide; PRDM1 exon 5; Set A
guccuuuucugaugugaggggugaa

SEQ ID NO: 27244 - RNA, 31 nt, Artificial Sequence
  Synthetic Oligonucleotide; PRDM1 exon 5; Set A
gagguccuuuucugaugugaggggugaaaug

SEQ ID NO: 27245 - RNA, 29 nt, Artificial Sequence
  Synthetic Oligonucleotide; PRDM1 exon 5; Set A
agguccuuuucugaugugaggggugaaau

SEQ ID NO: 27246 - RNA, 27 nt, Artificial Sequence
  Synthetic Oligonucleotide; PRDM1 exon 5; Set A
gguccuuuucugaugugaggggugaaa

SEQ ID NO: 27247 - RNA, 15 nt, Artificial Sequence
  Synthetic Oligonucleotide; PRDM1 exon 5; Set C
uuucugaugugaggg

SEQ ID NO: 27248 - RNA, 18 nt, Artificial Sequence
  Synthetic Oligonucleotide; PRDM1 exon 5; Set C
cuuuucugaugugagggg

SEQ ID NO: 27249 - RNA, 20 nt, Artificial Sequence
  Synthetic Oligonucleotide; PRDM1 exon 5; Set C
ccuuuucugaugugaggggu

SEQ ID NO: 27250 - RNA, 22 nt, Artificial Sequence
  Synthetic Oligonucleotide; PRDM1 exon 5; Set A
uccuuuucugaugugaggggug

SEQ ID NO: 27251 - RNA, 24 nt, Artificial Sequence
  Synthetic Oligonucleotide; PRDM1 exon 5; Set A
guccuuuucugaugugagggguga

SEQ ID NO: 27252 - RNA, 30 nt, Artificial Sequence
  Synthetic Oligonucleotide; PRDM1 exon 5; Set A
gagguccuuuucugaugugaggggugaaau

SEQ ID NO: 27253 - RNA, 28 nt, Artificial Sequence
  Synthetic Oligonucleotide; PRDM1 exon 5; Set A
agguccuuuucugaugugaggggugaaa

SEQ ID NO: 27254 - RNA, 26 nt, Artificial Sequence
  Synthetic Oligonucleotide; PRDM1 exon 5; Set A
gguccuuuucugaugugaggggugaa

SEQ ID NO: 27255 - RNA, 16 nt, Artificial Sequence
  Synthetic Oligonucleotide; PRDM1 exon 5; Set C
uuuucugaugugaggg

SEQ ID NO: 27256 - RNA, 21 nt, Artificial Sequence
  Synthetic Oligonucleotide; PRDM1 exon 5; Set A
uccuuuucugaugugaggggu

SEQ ID NO: 27257 - RNA, 19 nt, Artificial Sequence
  Synthetic Oligonucleotide; PRDM1 exon 5; Set C
ccuuuucugaugugagggg

SEQ ID NO: 27258 - RNA, 23 nt, Artificial Sequence
  Synthetic Oligonucleotide; PRDM1 exon 5; Set A
guccuuuucugaugugaggggug

SEQ ID NO: 27259 - RNA, 29 nt, Artificial Sequence
  Synthetic Oligonucleotide; PRDM1 exon 5; Set A
gagguccuuuucugaugugaggggugaaa

SEQ ID NO: 27260 - RNA, 27 nt, Artificial Sequence
  Synthetic Oligonucleotide; PRDM1 exon 5; Set A
agguccuuuucugaugugaggggugaa

SEQ ID NO: 27261 - RNA, 25 nt, Artificial Sequence
  Synthetic Oligonucleotide; PRDM1 exon 5; Set A
gguccuuuucugaugugagggguga

SEQ ID NO: 27262 - RNA, 17 nt, Artificial Sequence
  Synthetic Oligonucleotide; PRDM1 exon 5; Set C
cuuuucugaugugaggg

SEQ ID NO: 27263 - RNA, 20 nt, Artificial Sequence
  Synthetic Oligonucleotide; PRDM1 exon 5; Set C
uccuuuucugaugugagggg

SEQ ID NO: 27264 - RNA, 22 nt, Artificial Sequence
  Synthetic Oligonucleotide; PRDM1 exon 5; Set A
guccuuuucugaugugaggggu

SEQ ID NO: 27265 - RNA, 24 nt, Artificial Sequence
  Synthetic Oligonucleotide; PRDM1 exon 5; Set A
gguccuuuucugaugugaggggug

SEQ ID NO: 27266 - RNA, 28 nt, Artificial Sequence
  Synthetic Oligonucleotide; PRDM1 exon 5; Set A
gagguccuuuucugaugugaggggugaa

SEQ ID NO: 27267 - RNA, 26 nt, Artificial Sequence
  Synthetic Oligonucleotide; PRDM1 exon 5; Set A
agguccuuuucugaugugagggguga

SEQ ID NO: 27268 - RNA, 38 nt, Artificial Sequence
  Synthetic Oligonucleotide; PRDM1 exon 5; Set C
ucaucgagguccuuuucugaugugaggggugaaauguu

SEQ ID NO: 27269 - RNA, 18 nt, Artificial Sequence
  Synthetic Oligonucleotide; PRDM1 exon 5; Set C
ccuuuucugaugugaggg

SEQ ID NO: 27270 - RNA, 21 nt, Artificial Sequence
  Synthetic Oligonucleotide; PRDM1 exon 5; Set A
guccuuuucugaugugagggg

SEQ ID NO: 27271 - RNA, 23 nt, Artificial Sequence
  Synthetic Oligonucleotide; PRDM1 exon 5; Set A
gguccuuuucugaugugaggggu

SEQ ID NO: 27272 - RNA, 37 nt, Artificial Sequence
  Synthetic Oligonucleotide; PRDM1 exon 5; Set C
ucaucgagguccuuuucugaugugaggggugaaaugu

SEQ ID NO: 27273 - RNA, 25 nt, Artificial Sequence
  Synthetic Oligonucleotide; PRDM1 exon 5; Set A
agguccuuuucugaugugaggggug

SEQ ID NO: 27274 - RNA, 27 nt, Artificial Sequence
  Synthetic Oligonucleotide; PRDM1 exon 5; Set C
gagguccuuuucugaugugagggguga

SEQ ID NO: 27275 - RNA, 39 nt, Artificial Sequence
  Synthetic Oligonucleotide; PRDM1 exon 5; Set C
gucaucgagguccuuuucugaugugaggggugaaauguu

SEQ ID NO: 27276 - RNA, 19 nt, Artificial Sequence
  Synthetic Oligonucleotide; PRDM1 exon 5; Set C
uccuuuucugaugugaggg

SEQ ID NO: 27277 - RNA, 17 nt, Artificial Sequence
  Synthetic Oligonucleotide; PRDM1 exon 5; Set C
ccuuuucugaugugagg

SEQ ID NO: 27278 - RNA, 24 nt, Artificial Sequence
  Synthetic Oligonucleotide; PRDM1 exon 5; Set A
agguccuuuucugaugugaggggu

SEQ ID NO: 27279 - RNA, 22 nt, Artificial Sequence
  Synthetic Oligonucleotide; PRDM1 exon 5; Set A
gguccuuuucugaugugagggg

SEQ ID NO: 27280 - RNA, 38 nt, Artificial Sequence
  Synthetic Oligonucleotide; PRDM1 exon 5; Set C
gucaucgagguccuuuucugaugugaggggugaaaugu

SEQ ID NO: 27281 - RNA, 26 nt, Artificial Sequence
  Synthetic Oligonucleotide; PRDM1 exon 5; Set A
gagguccuuuucugaugugaggggug

SEQ ID NO: 27282 - RNA, 36 nt, Artificial Sequence
  Synthetic Oligonucleotide; PRDM1 exon 5; Set C
ucaucgagguccuuuucugaugugaggggugaaaug

SEQ ID NO: 27283 - RNA, 20 nt, Artificial Sequence
  Synthetic Oligonucleotide; PRDM1 exon 5; Set C
guccuuuucugaugugaggg

SEQ ID NO: 27284 - RNA, 18 nt, Artificial Sequence
  Synthetic Oligonucleotide; PRDM1 exon 5; Set C
uccuuuucugaugugagg

SEQ ID NO: 27285 - RNA, 25 nt, Artificial Sequence
  Synthetic Oligonucleotide; PRDM1 exon 5; Set A
gagguccuuuucugaugugaggggu

SEQ ID NO: 27286 - RNA, 23 nt, Artificial Sequence
  Synthetic Oligonucleotide; PRDM1 exon 5; Set A
agguccuuuucugaugugagggg

SEQ ID NO: 27287 - RNA, 37 nt, Artificial Sequence
  Synthetic Oligonucleotide; PRDM1 exon 5; Set C
gucaucgagguccuuuucugaugugaggggugaaaug

SEQ ID NO: 27288 - RNA, 35 nt, Artificial Sequence
  Synthetic Oligonucleotide; PRDM1 exon 5; Set C
ucaucgagguccuuuucugaugugaggggugaaau

SEQ ID NO: 27289 - RNA, 19 nt, Artificial Sequence
  Synthetic Oligonucleotide; PRDM1 exon 5; Set C
guccuuuucugaugugagg

SEQ ID NO: 27290 - RNA, 24 nt, Artificial Sequence
  Synthetic Oligonucleotide; PRDM1 exon 5; Set A
gagguccuuuucugaugugagggg

SEQ ID NO: 27291 - RNA, 38 nt, Artificial Sequence
  Synthetic Oligonucleotide; PRDM1 exon 5; Set C
agucaucgagguccuuuucugaugugaggggugaaaug

SEQ ID NO: 27292 - RNA, 36 nt, Artificial Sequence
  Synthetic Oligonucleotide; PRDM1 exon 5; Set C
gucaucgagguccuuuucugaugugaggggugaaau

SEQ ID NO: 27293 - RNA, 22 nt, Artificial Sequence
  Synthetic Oligonucleotide; PRDM1 exon 5; Set A
agguccuuuucugaugugaggg

SEQ ID NO: 27294 - RNA, 16 nt, Artificial Sequence
  Synthetic Oligonucleotide; PRDM1 exon 5; Set C
uccuuuucugauguga

SEQ ID NO: 27295 - RNA, 18 nt, Artificial Sequence
  Synthetic Oligonucleotide; PRDM1 exon 5; Set C
guccuuuucugaugugag

SEQ ID NO: 27296 - RNA, 37 nt, Artificial Sequence
  Synthetic Oligonucleotide; PRDM1 exon 5; Set C
agucaucgagguccuuuucugaugugaggggugaaau

SEQ ID NO: 27297 - RNA, 39 nt, Artificial Sequence
  Synthetic Oligonucleotide; PRDM1 exon 5; Set C
aagucaucgagguccuuuucugaugugaggggugaaaug

SEQ ID NO: 27298 - RNA, 35 nt, Artificial Sequence
  Synthetic Oligonucleotide; PRDM1 exon 5; Set C
gucaucgagguccuuuucugaugugaggggugaaa

SEQ ID NO: 27299 - RNA, 23 nt, Artificial Sequence
  Synthetic Oligonucleotide; PRDM1 exon 5; Set A
gagguccuuuucugaugugaggg

SEQ ID NO: 27300 - RNA, 17 nt, Artificial Sequence
  Synthetic Oligonucleotide; PRDM1 exon 5; Set C
guccuuuucugauguga

SEQ ID NO: 27301 - RNA, 36 nt, Artificial Sequence
  Synthetic Oligonucleotide; PRDM1 exon 5; Set C
agucaucgagguccuuuucugaugugaggggugaaa

SEQ ID NO: 27302 - RNA, 38 nt, Artificial Sequence
  Synthetic Oligonucleotide; PRDM1 exon 5; Set C
aagucaucgagguccuuuucugaugugaggggugaaau

SEQ ID NO: 27303 - RNA, 40 nt, Artificial Sequence
  Synthetic Oligonucleotide; PRDM1 exon 5; Set C
aaagucaucgagguccuuuucugaugugaggggugaaaug

SEQ ID NO: 27304 - RNA, 35 nt, Artificial Sequence
  Synthetic Oligonucleotide; PRDM1 exon 5; Set C
agucaucgagguccuuuucugaugugaggggugaa

SEQ ID NO: 27305 - RNA, 37 nt, Artificial Sequence
  Synthetic Oligonucleotide; PRDM1 exon 5; Set C
aagucaucgagguccuuuucugaugugaggggugaaa

SEQ ID NO: 27306 - RNA, 39 nt, Artificial Sequence
  Synthetic Oligonucleotide; PRDM1 exon 5; Set C
aaagucaucgagguccuuuucugaugugaggggugaaau

SEQ ID NO: 27307 - RNA, 34 nt, Artificial Sequence
  Synthetic Oligonucleotide; PRDM1 exon 5; Set C
agucaucgagguccuuuucugaugugagggguga

SEQ ID NO: 27308 - RNA, 36 nt, Artificial Sequence
  Synthetic Oligonucleotide; PRDM1 exon 5; Set C
aagucaucgagguccuuuucugaugugaggggugaa

SEQ ID NO: 27309 - RNA, 38 nt, Artificial Sequence
  Synthetic Oligonucleotide; PRDM1 exon 5; Set C
aaagucaucgagguccuuuucugaugugaggggugaaa

SEQ ID NO: 27310 - RNA, 33 nt, Artificial Sequence
  Synthetic Oligonucleotide; PRDM1 exon 5; Set C
agucaucgagguccuuuucugaugugaggggug

SEQ ID NO: 27311 - RNA, 35 nt, Artificial Sequence
  Synthetic Oligonucleotide; PRDM1 exon 5; Set C
aagucaucgagguccuuuucugaugugagggguga

SEQ ID NO: 27312 - RNA, 37 nt, Artificial Sequence
  Synthetic Oligonucleotide; PRDM1 exon 5; Set C
aaagucaucgagguccuuuucugaugugaggggugaa

SEQ ID NO: 27313 - RNA, 32 nt, Artificial Sequence
  Synthetic Oligonucleotide; PRDM1 exon 5; Set C
agucaucgagguccuuuucugaugugaggggu

SEQ ID NO: 27314 - RNA, 34 nt, Artificial Sequence
  Synthetic Oligonucleotide; PRDM1 exon 5; Set C
aagucaucgagguccuuuucugaugugaggggug

SEQ ID NO: 27315 - RNA, 36 nt, Artificial Sequence
  Synthetic Oligonucleotide; PRDM1 exon 5; Set C
aaagucaucgagguccuuuucugaugugagggguga

SEQ ID NO: 27316 - RNA, 31 nt, Artificial Sequence
  Synthetic Oligonucleotide; PRDM1 exon 5; Set C
agucaucgagguccuuuucugaugugagggg

SEQ ID NO: 27317 - RNA, 33 nt, Artificial Sequence
  Synthetic Oligonucleotide; PRDM1 exon 5; Set C
aagucaucgagguccuuuucugaugugaggggu

SEQ ID NO: 27318 - RNA, 35 nt, Artificial Sequence
  Synthetic Oligonucleotide; PRDM1 exon 5; Set C
aaagucaucgagguccuuuucugaugugaggggug

SEQ ID NO: 27319 - RNA, 32 nt, Artificial Sequence
  Synthetic Oligonucleotide; PRDM1 exon 5; Set C
aagucaucgagguccuuuucugaugugagggg

SEQ ID NO: 27320 - RNA, 34 nt, Artificial Sequence
  Synthetic Oligonucleotide; PRDM1 exon 5; Set C
aaagucaucgagguccuuuucugaugugaggggu

SEQ ID NO: 27321 - RNA, 30 nt, Artificial Sequence
  Synthetic Oligonucleotide; PRDM1 exon 5; Set C
agucaucgagguccuuuucugaugugaggg

SEQ ID NO: 27322 - RNA, 33 nt, Artificial Sequence
  Synthetic Oligonucleotide; PRDM1 exon 5; Set C
aaagucaucgagguccuuuucugaugugagggg

SEQ ID NO: 27323 - RNA, 31 nt, Artificial Sequence
  Synthetic Oligonucleotide; PRDM1 exon 5; Set A
aagucaucgagguccuuuucugaugugaggg

SEQ ID NO: 27324 - RNA, 29 nt, Artificial Sequence
  Synthetic Oligonucleotide; PRDM1 exon 5; Set A
agucaucgagguccuuuucugaugugagg

SEQ ID NO: 27325 - RNA, 32 nt, Artificial Sequence
  Synthetic Oligonucleotide; PRDM1 exon 5; Set A
aaagucaucgagguccuuuucugaugugaggg

SEQ ID NO: 27326 - RNA, 30 nt, Artificial Sequence
  Synthetic Oligonucleotide; PRDM1 exon 5; Set A
aagucaucgagguccuuuucugaugugagg

SEQ ID NO: 27327 - RNA, 28 nt, Artificial Sequence
  Synthetic Oligonucleotide; PRDM1 exon 5; Set A
agucaucgagguccuuuucugaugugag

SEQ ID NO: 27328 - RNA, 27 nt, Artificial Sequence
  Synthetic Oligonucleotide; PRDM1 exon 5; Set A
agucaucgagguccuuuucugauguga

SEQ ID NO: 27329 - RNA, 31 nt, Artificial Sequence
  Synthetic Oligonucleotide; PRDM1 exon 5; Set A
aaagucaucgagguccuuuucugaugugagg

SEQ ID NO: 27330 - RNA, 29 nt, Artificial Sequence
  Synthetic Oligonucleotide; PRDM1 exon 5; Set A
aagucaucgagguccuuuucugaugugag

SEQ ID NO: 27331 - RNA, 28 nt, Artificial Sequence
  Synthetic Oligonucleotide; PRDM1 exon 5; Set A
aagucaucgagguccuuuucugauguga

SEQ ID NO: 27332 - RNA, 30 nt, Artificial Sequence
  Synthetic Oligonucleotide; PRDM1 exon 5; Set A
aaagucaucgagguccuuuucugaugugag

SEQ ID NO: 27333 - RNA, 29 nt, Artificial Sequence
  Synthetic Oligonucleotide; PRDM1 exon 5; Set A
aaagucaucgagguccuuuucugauguga

SEQ ID NO: 27334 - RNA, 16 nt, Artificial Sequence
  Synthetic Oligonucleotide; PRDM1 exon 5; Set C
ucaucgagguccuuuu

SEQ ID NO: 27335 - RNA, 17 nt, Artificial Sequence
  Synthetic Oligonucleotide; PRDM1 exon 5; Set C
gucaucgagguccuuuu

SEQ ID NO: 27336 - RNA, 15 nt, Artificial Sequence
  Synthetic Oligonucleotide; PRDM1 exon 5; Set C
ucaucgagguccuuu

SEQ ID NO: 27337 - RNA, 16 nt, Artificial Sequence
  Synthetic Oligonucleotide; PRDM1 exon 5; Set C
gucaucgagguccuuu

SEQ ID NO: 27338 - RNA, 15 nt, Artificial Sequence
  Synthetic Oligonucleotide; PRDM1 exon 5; Set C
gucaucgagguccuu

SEQ ID NO: 27339 - RNA, 15 nt, Artificial Sequence
  Synthetic Oligonucleotide; PRDM1 exon 5; Set C
aaagucaucgagguc

SEQ ID NO: 27340 - RNA, 19 nt, Artificial Sequence
  Synthetic Oligonucleotide; PRDM1 exon 5; Set C
cgaggguagaagggcauuu

SEQ ID NO: 27341 - RNA, 17 nt, Artificial Sequence
  Synthetic Oligonucleotide; PRDM1 exon 5; Set C
cgaggguagaagggcau

SEQ ID NO: 27342 - RNA, 16 nt, Artificial Sequence
  Synthetic Oligonucleotide; PRDM1 exon 5; Set C
cgaggguagaagggca

SEQ ID NO: 27343 - RNA, 15 nt, Artificial Sequence
  Synthetic Oligonucleotide; PRDM1 exon 5; Set C
cgaggguagaagggc

SEQ ID NO: 27344 - RNA, 27 nt, Artificial Sequence
  Synthetic Oligonucleotide; PRDM1 exon 5; Set A
aaacgacccgaggguagaagggcauuu

SEQ ID NO: 27345 - RNA, 26 nt, Artificial Sequence
  Synthetic Oligonucleotide; PRDM1 exon 5; Set A
aaacgacccgaggguagaagggcauu

SEQ ID NO: 27346 - RNA, 28 nt, Artificial Sequence
  Synthetic Oligonucleotide; PRDM1 exon 5; Set C
uaaacgacccgaggguagaagggcauuu

SEQ ID NO: 27347 - RNA, 27 nt, Artificial Sequence
  Synthetic Oligonucleotide; PRDM1 exon 5; Set C
uaaacgacccgaggguagaagggcauu

SEQ ID NO: 27348 - RNA, 29 nt, Artificial Sequence
  Synthetic Oligonucleotide; PRDM1 exon 5; Set C
guaaacgacccgaggguagaagggcauuu

SEQ ID NO: 27349 - RNA, 25 nt, Artificial Sequence
  Synthetic Oligonucleotide; PRDM1 exon 5; Set A
aaacgacccgaggguagaagggcau

SEQ ID NO: 27350 - RNA, 28 nt, Artificial Sequence
  Synthetic Oligonucleotide; PRDM1 exon 5; Set C
guaaacgacccgaggguagaagggcauu

SEQ ID NO: 27351 - RNA, 30 nt, Artificial Sequence
  Synthetic Oligonucleotide; PRDM1 exon 5; Set C
gguaaacgacccgaggguagaagggcauuu

SEQ ID NO: 27352 - RNA, 26 nt, Artificial Sequence
  Synthetic Oligonucleotide; PRDM1 exon 5; Set C
uaaacgacccgaggguagaagggcau

SEQ ID NO: 27353 - RNA, 24 nt, Artificial Sequence
  Synthetic Oligonucleotide; PRDM1 exon 5; Set A
aaacgacccgaggguagaagggca

SEQ ID NO: 27354 - RNA, 29 nt, Artificial Sequence
  Synthetic Oligonucleotide; PRDM1 exon 5; Set C
gguaaacgacccgaggguagaagggcauu

SEQ ID NO: 27355 - RNA, 31 nt, Artificial Sequence
  Synthetic Oligonucleotide; PRDM1 exon 5; Set C
ggguaaacgacccgaggguagaagggcauuu

SEQ ID NO: 27356 - RNA, 23 nt, Artificial Sequence
  Synthetic Oligonucleotide; PRDM1 exon 5; Set A
aaacgacccgaggguagaagggc

SEQ ID NO: 27357 - RNA, 27 nt, Artificial Sequence
  Synthetic Oligonucleotide; PRDM1 exon 5; Set C
guaaacgacccgaggguagaagggcau

SEQ ID NO: 27358 - RNA, 25 nt, Artificial Sequence
  Synthetic Oligonucleotide; PRDM1 exon 5; Set C
uaaacgacccgaggguagaagggca

SEQ ID NO: 27359 - RNA, 30 nt, Artificial Sequence
  Synthetic Oligonucleotide; PRDM1 exon 5; Set C
ggguaaacgacccgaggguagaagggcauu

SEQ ID NO: 27360 - RNA, 32 nt, Artificial Sequence
  Synthetic Oligonucleotide; PRDM1 exon 5; Set C
gggguaaacgacccgaggguagaagggcauuu

SEQ ID NO: 27361 - RNA, 24 nt, Artificial Sequence
  Synthetic Oligonucleotide; PRDM1 exon 5; Set A
uaaacgacccgaggguagaagggc

SEQ ID NO: 27362 - RNA, 22 nt, Artificial Sequence
  Synthetic Oligonucleotide; PRDM1 exon 5; Set A
aaacgacccgaggguagaaggg

SEQ ID NO: 27363 - RNA, 28 nt, Artificial Sequence
  Synthetic Oligonucleotide; PRDM1 exon 5; Set C
gguaaacgacccgaggguagaagggcau

SEQ ID NO: 27364 - RNA, 26 nt, Artificial Sequence
  Synthetic Oligonucleotide; PRDM1 exon 5; Set C
guaaacgacccgaggguagaagggca

SEQ ID NO: 27365 - RNA, 31 nt, Artificial Sequence
  Synthetic Oligonucleotide; PRDM1 exon 5; Set C
gggguaaacgacccgaggguagaagggcauu

SEQ ID NO: 27366 - RNA, 25 nt, Artificial Sequence
  Synthetic Oligonucleotide; PRDM1 exon 5; Set A
guaaacgacccgaggguagaagggc

SEQ ID NO: 27367 - RNA, 21 nt, Artificial Sequence
  Synthetic Oligonucleotide; PRDM1 exon 5; Set C
aaacgacccgaggguagaagg

SEQ ID NO: 27368 - RNA, 23 nt, Artificial Sequence
  Synthetic Oligonucleotide; PRDM1 exon 5; Set A
uaaacgacccgaggguagaaggg

SEQ ID NO: 27369 - RNA, 29 nt, Artificial Sequence
  Synthetic Oligonucleotide; PRDM1 exon 5; Set C
ggguaaacgacccgaggguagaagggcau

SEQ ID NO: 27370 - RNA, 27 nt, Artificial Sequence
  Synthetic Oligonucleotide; PRDM1 exon 5; Set C
gguaaacgacccgaggguagaagggca

SEQ ID NO: 27371 - RNA, 34 nt, Artificial Sequence
  Synthetic Oligonucleotide; PRDM1 exon 5; Set C
augggguaaacgacccgaggguagaagggcauuu

SEQ ID NO: 27372 - RNA, 20 nt, Artificial Sequence
  Synthetic Oligonucleotide; PRDM1 exon 5; Set C
aaacgacccgaggguagaag

SEQ ID NO: 27373 - RNA, 26 nt, Artificial Sequence
  Synthetic Oligonucleotide; PRDM1 exon 5; Set C
gguaaacgacccgaggguagaagggc

SEQ ID NO: 27374 - RNA, 22 nt, Artificial Sequence
  Synthetic Oligonucleotide; PRDM1 exon 5; Set A
uaaacgacccgaggguagaagg

SEQ ID NO: 27375 - RNA, 24 nt, Artificial Sequence
  Synthetic Oligonucleotide; PRDM1 exon 5; Set A
guaaacgacccgaggguagaaggg

SEQ ID NO: 27376 - RNA, 30 nt, Artificial Sequence
  Synthetic Oligonucleotide; PRDM1 exon 5; Set C
gggguaaacgacccgaggguagaagggcau

SEQ ID NO: 27377 - RNA, 28 nt, Artificial Sequence
  Synthetic Oligonucleotide; PRDM1 exon 5; Set C
ggguaaacgacccgaggguagaagggca

SEQ ID NO: 27378 - RNA, 19 nt, Artificial Sequence
  Synthetic Oligonucleotide; PRDM1 exon 5; Set C
aaacgacccgaggguagaa

SEQ ID NO: 27379 - RNA, 33 nt, Artificial Sequence
  Synthetic Oligonucleotide; PRDM1 exon 5; Set C
augggguaaacgacccgaggguagaagggcauu

SEQ ID NO: 27380 - RNA, 21 nt, Artificial Sequence
  Synthetic Oligonucleotide; PRDM1 exon 5; Set C
uaaacgacccgaggguagaag

SEQ ID NO: 27381 - RNA, 23 nt, Artificial Sequence
  Synthetic Oligonucleotide; PRDM1 exon 5; Set A
guaaacgacccgaggguagaagg

SEQ ID NO: 27382 - RNA, 27 nt, Artificial Sequence
  Synthetic Oligonucleotide; PRDM1 exon 5; Set C
ggguaaacgacccgaggguagaagggc

SEQ ID NO: 27383 - RNA, 25 nt, Artificial Sequence
  Synthetic Oligonucleotide; PRDM1 exon 5; Set A
gguaaacgacccgaggguagaaggg

SEQ ID NO: 27384 - RNA, 31 nt, Artificial Sequence
  Synthetic Oligonucleotide; PRDM1 exon 5; Set C
ugggguaaacgacccgaggguagaagggcau

SEQ ID NO: 27385 - RNA, 29 nt, Artificial Sequence
  Synthetic Oligonucleotide; PRDM1 exon 5; Set C
gggguaaacgacccgaggguagaagggca

SEQ ID NO: 27386 - RNA, 20 nt, Artificial Sequence
  Synthetic Oligonucleotide; PRDM1 exon 5; Set C
uaaacgacccgaggguagaa

SEQ ID NO: 27387 - RNA, 18 nt, Artificial Sequence
  Synthetic Oligonucleotide; PRDM1 exon 5; Set C
aaacgacccgaggguaga

SEQ ID NO: 27388 - RNA, 22 nt, Artificial Sequence
  Synthetic Oligonucleotide; PRDM1 exon 5; Set C
guaaacgacccgaggguagaag

SEQ ID NO: 27389 - RNA, 24 nt, Artificial Sequence
  Synthetic Oligonucleotide; PRDM1 exon 5; Set A
gguaaacgacccgaggguagaagg

SEQ ID NO: 27390 - RNA, 28 nt, Artificial Sequence
  Synthetic Oligonucleotide; PRDM1 exon 5; Set C
gggguaaacgacccgaggguagaagggc

SEQ ID NO: 27391 - RNA, 26 nt, Artificial Sequence
  Synthetic Oligonucleotide; PRDM1 exon 5; Set C
ggguaaacgacccgaggguagaaggg

SEQ ID NO: 27392 - RNA, 32 nt, Artificial Sequence
  Synthetic Oligonucleotide; PRDM1 exon 5; Set C
augggguaaacgacccgaggguagaagggcau

SEQ ID NO: 27393 - RNA, 30 nt, Artificial Sequence
  Synthetic Oligonucleotide; PRDM1 exon 5; Set C
ugggguaaacgacccgaggguagaagggca

SEQ ID NO: 27394 - RNA, 21 nt, Artificial Sequence
  Synthetic Oligonucleotide; PRDM1 exon 5; Set C
guaaacgacccgaggguagaa

SEQ ID NO: 27395 - RNA, 19 nt, Artificial Sequence
  Synthetic Oligonucleotide; PRDM1 exon 5; Set C
uaaacgacccgaggguaga

SEQ ID NO: 27396 - RNA, 17 nt, Artificial Sequence
  Synthetic Oligonucleotide; PRDM1 exon 5; Set C
aaacgacccgaggguag

SEQ ID NO: 27397 - RNA, 23 nt, Artificial Sequence
  Synthetic Oligonucleotide; PRDM1 exon 5; Set A
gguaaacgacccgaggguagaag

SEQ ID NO: 27398 - RNA, 29 nt, Artificial Sequence
  Synthetic Oligonucleotide; PRDM1 exon 5; Set C
ugggguaaacgacccgaggguagaagggc

SEQ ID NO: 27399 - RNA, 25 nt, Artificial Sequence
  Synthetic Oligonucleotide; PRDM1 exon 5; Set A
ggguaaacgacccgaggguagaagg

SEQ ID NO: 27400 - RNA, 27 nt, Artificial Sequence
  Synthetic Oligonucleotide; PRDM1 exon 5; Set C
gggguaaacgacccgaggguagaaggg

SEQ ID NO: 27401 - RNA, 33 nt, Artificial Sequence
  Synthetic Oligonucleotide; PRDM1 exon 5; Set C
gaugggguaaacgacccgaggguagaagggcau

SEQ ID NO: 27402 - RNA, 31 nt, Artificial Sequence
  Synthetic Oligonucleotide; PRDM1 exon 5; Set C
augggguaaacgacccgaggguagaagggca

SEQ ID NO: 27403 - RNA, 16 nt, Artificial Sequence
  Synthetic Oligonucleotide; PRDM1 exon 5; Set C
aaacgacccgagggua

SEQ ID NO: 27404 - RNA, 22 nt, Artificial Sequence
  Synthetic Oligonucleotide; PRDM1 exon 5; Set A
gguaaacgacccgaggguagaa

SEQ ID NO: 27405 - RNA, 20 nt, Artificial Sequence
  Synthetic Oligonucleotide; PRDM1 exon 5; Set A
guaaacgacccgaggguaga

SEQ ID NO: 27406 - RNA, 18 nt, Artificial Sequence
  Synthetic Oligonucleotide; PRDM1 exon 5; Set C
uaaacgacccgaggguag

SEQ ID NO: 27407 - RNA, 24 nt, Artificial Sequence
  Synthetic Oligonucleotide; PRDM1 exon 5; Set A
ggguaaacgacccgaggguagaag

SEQ ID NO: 27408 - RNA, 30 nt, Artificial Sequence
  Synthetic Oligonucleotide; PRDM1 exon 5; Set C
augggguaaacgacccgaggguagaagggc

SEQ ID NO: 27409 - RNA, 26 nt, Artificial Sequence
  Synthetic Oligonucleotide; PRDM1 exon 5; Set C
gggguaaacgacccgaggguagaagg

SEQ ID NO: 27410 - RNA, 28 nt, Artificial Sequence
  Synthetic Oligonucleotide; PRDM1 exon 5; Set C
ugggguaaacgacccgaggguagaaggg

SEQ ID NO: 27411 - RNA, 34 nt, Artificial Sequence
  Synthetic Oligonucleotide; PRDM1 exon 5; Set C
ggaugggguaaacgacccgaggguagaagggcau

SEQ ID NO: 27412 - RNA, 32 nt, Artificial Sequence
  Synthetic Oligonucleotide; PRDM1 exon 5; Set C
gaugggguaaacgacccgaggguagaagggca

SEQ ID NO: 27413 - RNA, 17 nt, Artificial Sequence
  Synthetic Oligonucleotide; PRDM1 exon 5; Set C
uaaacgacccgagggua

SEQ ID NO: 27414 - RNA, 15 nt, Artificial Sequence
  Synthetic Oligonucleotide; PRDM1 exon 5; Set C
aaacgacccgagggu

SEQ ID NO: 27415 - RNA, 21 nt, Artificial Sequence
  Synthetic Oligonucleotide; PRDM1 exon 5; Set A
gguaaacgacccgaggguaga

SEQ ID NO: 27416 - RNA, 19 nt, Artificial Sequence
  Synthetic Oligonucleotide; PRDM1 exon 5; Set C
guaaacgacccgaggguag

SEQ ID NO: 27417 - RNA, 23 nt, Artificial Sequence
  Synthetic Oligonucleotide; PRDM1 exon 5; Set A
ggguaaacgacccgaggguagaa

SEQ ID NO: 27418 - RNA, 25 nt, Artificial Sequence
  Synthetic Oligonucleotide; PRDM1 exon 5; Set A
gggguaaacgacccgaggguagaag

SEQ ID NO: 27419 - RNA, 27 nt, Artificial Sequence
  Synthetic Oligonucleotide; PRDM1 exon 5; Set C
ugggguaaacgacccgaggguagaagg

SEQ ID NO: 27420 - RNA, 31 nt, Artificial Sequence
  Synthetic Oligonucleotide; PRDM1 exon 5; Set C
gaugggguaaacgacccgaggguagaagggc

SEQ ID NO: 27421 - RNA, 29 nt, Artificial Sequence
  Synthetic Oligonucleotide; PRDM1 exon 5; Set C
augggguaaacgacccgaggguagaaggg

SEQ ID NO: 27422 - RNA, 33 nt, Artificial Sequence
  Synthetic Oligonucleotide; PRDM1 exon 5; Set C
ggaugggguaaacgacccgaggguagaagggca

SEQ ID NO: 27423 - RNA, 18 nt, Artificial Sequence
  Synthetic Oligonucleotide; PRDM1 exon 5; Set C
guaaacgacccgagggua

SEQ ID NO: 27424 - RNA, 16 nt, Artificial Sequence
  Synthetic Oligonucleotide; PRDM1 exon 5; Set C
uaaacgacccgagggu

SEQ ID NO: 27425 - RNA, 20 nt, Artificial Sequence
  Synthetic Oligonucleotide; PRDM1 exon 5; Set A
gguaaacgacccgaggguag

SEQ ID NO: 27426 - RNA, 24 nt, Artificial Sequence
  Synthetic Oligonucleotide; PRDM1 exon 5; Set A
gggguaaacgacccgaggguagaa

SEQ ID NO: 27427 - RNA, 22 nt, Artificial Sequence
  Synthetic Oligonucleotide; PRDM1 exon 5; Set A
ggguaaacgacccgaggguaga

SEQ ID NO: 27428 - RNA, 26 nt, Artificial Sequence
  Synthetic Oligonucleotide; PRDM1 exon 5; Set A
ugggguaaacgacccgaggguagaag

SEQ ID NO: 27429 - RNA, 32 nt, Artificial Sequence
  Synthetic Oligonucleotide; PRDM1 exon 5; Set C
ggaugggguaaacgacccgaggguagaagggc

SEQ ID NO: 27430 - RNA, 28 nt, Artificial Sequence
  Synthetic Oligonucleotide; PRDM1 exon 5; Set C
augggguaaacgacccgaggguagaagg

SEQ ID NO: 27431 - RNA, 30 nt, Artificial Sequence
  Synthetic Oligonucleotide; PRDM1 exon 5; Set C
gaugggguaaacgacccgaggguagaaggg

SEQ ID NO: 27432 - RNA, 19 nt, Artificial Sequence
  Synthetic Oligonucleotide; PRDM1 exon 5; Set A
gguaaacgacccgagggua

SEQ ID NO: 27433 - RNA, 17 nt, Artificial Sequence
  Synthetic Oligonucleotide; PRDM1 exon 5; Set C
guaaacgacccgagggu

SEQ ID NO: 27434 - RNA, 25 nt, Artificial Sequence
  Synthetic Oligonucleotide; PRDM1 exon 5; Set C
ugggguaaacgacccgaggguagaa

SEQ ID NO: 27435 - RNA, 15 nt, Artificial Sequence
  Synthetic Oligonucleotide; PRDM1 exon 5; Set C
uaaacgacccgaggg

SEQ ID NO: 27436 - RNA, 23 nt, Artificial Sequence
  Synthetic Oligonucleotide; PRDM1 exon 5; Set C
gggguaaacgacccgaggguaga

SEQ ID NO: 27437 - RNA, 21 nt, Artificial Sequence
  Synthetic Oligonucleotide; PRDM1 exon 5; Set A
ggguaaacgacccgaggguag

SEQ ID NO: 27438 - RNA, 27 nt, Artificial Sequence
  Synthetic Oligonucleotide; PRDM1 exon 5; Set A
augggguaaacgacccgaggguagaag

SEQ ID NO: 27439 - RNA, 29 nt, Artificial Sequence
  Synthetic Oligonucleotide; PRDM1 exon 5; Set C
gaugggguaaacgacccgaggguagaagg

SEQ ID NO: 27440 - RNA, 31 nt, Artificial Sequence
  Synthetic Oligonucleotide; PRDM1 exon 5; Set C
ggaugggguaaacgacccgaggguagaaggg

SEQ ID NO: 27441 - RNA, 18 nt, Artificial Sequence
  Synthetic Oligonucleotide; PRDM1 exon 5; Set A
gguaaacgacccgagggu

SEQ ID NO: 27442 - RNA, 20 nt, Artificial Sequence
  Synthetic Oligonucleotide; PRDM1 exon 5; Set A
ggguaaacgacccgagggua

SEQ ID NO: 27443 - RNA, 24 nt, Artificial Sequence
  Synthetic Oligonucleotide; PRDM1 exon 5; Set C
ugggguaaacgacccgaggguaga

SEQ ID NO: 27444 - RNA, 16 nt, Artificial Sequence
  Synthetic Oligonucleotide; PRDM1 exon 5; Set C
guaaacgacccgaggg

SEQ ID NO: 27445 - RNA, 26 nt, Artificial Sequence
  Synthetic Oligonucleotide; PRDM1 exon 5; Set A
augggguaaacgacccgaggguagaa

SEQ ID NO: 27446 - RNA, 22 nt, Artificial Sequence
  Synthetic Oligonucleotide; PRDM1 exon 5; Set A
gggguaaacgacccgaggguag

SEQ ID NO: 27447 - RNA, 28 nt, Artificial Sequence
  Synthetic Oligonucleotide; PRDM1 exon 5; Set C
gaugggguaaacgacccgaggguagaag

SEQ ID NO: 27448 - RNA, 30 nt, Artificial Sequence
  Synthetic Oligonucleotide; PRDM1 exon 5; Set C
ggaugggguaaacgacccgaggguagaagg

SEQ ID NO: 27449 - RNA, 21 nt, Artificial Sequence
  Synthetic Oligonucleotide; PRDM1 exon 5; Set A
gggguaaacgacccgagggua

SEQ ID NO: 27450 - RNA, 19 nt, Artificial Sequence
  Synthetic Oligonucleotide; PRDM1 exon 5; Set A
ggguaaacgacccgagggu

SEQ ID NO: 27451 - RNA, 23 nt, Artificial Sequence
  Synthetic Oligonucleotide; PRDM1 exon 5; Set A
ugggguaaacgacccgaggguag

SEQ ID NO: 27452 - RNA, 17 nt, Artificial Sequence
  Synthetic Oligonucleotide; PRDM1 exon 5; Set C
gguaaacgacccgaggg

SEQ ID NO: 27453 - RNA, 27 nt, Artificial Sequence
  Synthetic Oligonucleotide; PRDM1 exon 5; Set C
gaugggguaaacgacccgaggguagaa

SEQ ID NO: 27454 - RNA, 25 nt, Artificial Sequence
  Synthetic Oligonucleotide; PRDM1 exon 5; Set C
augggguaaacgacccgaggguaga

SEQ ID NO: 27455 - RNA, 15 nt, Artificial Sequence
  Synthetic Oligonucleotide; PRDM1 exon 5; Set C
guaaacgacccgagg

SEQ ID NO: 27456 - RNA, 29 nt, Artificial Sequence
  Synthetic Oligonucleotide; PRDM1 exon 5; Set C
ggaugggguaaacgacccgaggguagaag

SEQ ID NO: 27457 - RNA, 22 nt, Artificial Sequence
  Synthetic Oligonucleotide; PRDM1 exon 5; Set A
ugggguaaacgacccgagggua

SEQ ID NO: 27458 - RNA, 20 nt, Artificial Sequence
  Synthetic Oligonucleotide; PRDM1 exon 5; Set A
gggguaaacgacccgagggu

SEQ ID NO: 27459 - RNA, 26 nt, Artificial Sequence
  Synthetic Oligonucleotide; PRDM1 exon 5; Set C
gaugggguaaacgacccgaggguaga

SEQ ID NO: 27460 - RNA, 24 nt, Artificial Sequence
  Synthetic Oligonucleotide; PRDM1 exon 5; Set A
augggguaaacgacccgaggguag

SEQ ID NO: 27461 - RNA, 18 nt, Artificial Sequence
  Synthetic Oligonucleotide; PRDM1 exon 5; Set A
ggguaaacgacccgaggg

SEQ ID NO: 27462 - RNA, 16 nt, Artificial Sequence
  Synthetic Oligonucleotide; PRDM1 exon 5; Set C
gguaaacgacccgagg

SEQ ID NO: 27463 - RNA, 21 nt, Artificial Sequence
  Synthetic Oligonucleotide; PRDM1 exon 5; Set A
ugggguaaacgacccgagggu

SEQ ID NO: 27464 - RNA, 23 nt, Artificial Sequence
  Synthetic Oligonucleotide; PRDM1 exon 5; Set A
augggguaaacgacccgagggua

SEQ ID NO: 27465 - RNA, 27 nt, Artificial Sequence
  Synthetic Oligonucleotide; PRDM1 exon 5; Set C
ggaugggguaaacgacccgaggguaga

SEQ ID NO: 27466 - RNA, 25 nt, Artificial Sequence
  Synthetic Oligonucleotide; PRDM1 exon 5; Set C
gaugggguaaacgacccgaggguag

SEQ ID NO: 27467 - RNA, 19 nt, Artificial Sequence
  Synthetic Oligonucleotide; PRDM1 exon 5; Set A
gggguaaacgacccgaggg

SEQ ID NO: 27468 - RNA, 15 nt, Artificial Sequence
  Synthetic Oligonucleotide; PRDM1 exon 5; Set C
gguaaacgacccgag

SEQ ID NO: 27469 - RNA, 17 nt, Artificial Sequence
  Synthetic Oligonucleotide; PRDM1 exon 5; Set C
ggguaaacgacccgagg

SEQ ID NO: 27470 - RNA, 24 nt, Artificial Sequence
  Synthetic Oligonucleotide; PRDM1 exon 5; Set C
gaugggguaaacgacccgagggua

SEQ ID NO: 27471 - RNA, 22 nt, Artificial Sequence
  Synthetic Oligonucleotide; PRDM1 exon 5; Set A
augggguaaacgacccgagggu

SEQ ID NO: 27472 - RNA, 20 nt, Artificial Sequence
  Synthetic Oligonucleotide; PRDM1 exon 5; Set A
ugggguaaacgacccgaggg

SEQ ID NO: 27473 - RNA, 26 nt, Artificial Sequence
  Synthetic Oligonucleotide; PRDM1 exon 5; Set C
ggaugggguaaacgacccgaggguag

SEQ ID NO: 27474 - RNA, 18 nt, Artificial Sequence
  Synthetic Oligonucleotide; PRDM1 exon 5; Set A
gggguaaacgacccgagg

SEQ ID NO: 27475 - RNA, 16 nt, Artificial Sequence
  Synthetic Oligonucleotide; PRDM1 exon 5; Set C
ggguaaacgacccgag

SEQ ID NO: 27476 - RNA, 40 nt, Artificial Sequence
  Synthetic Oligonucleotide; PRDM1 exon 5; Set C
ggggcccggaugggguaaacgacccgaggguagaagggca

SEQ ID NO: 27477 - RNA, 25 nt, Artificial Sequence
  Synthetic Oligonucleotide; PRDM1 exon 5; Set C
ggaugggguaaacgacccgagggua

SEQ ID NO: 27478 - RNA, 23 nt, Artificial Sequence
  Synthetic Oligonucleotide; PRDM1 exon 5; Set C
gaugggguaaacgacccgagggu

SEQ ID NO: 27479 - RNA, 21 nt, Artificial Sequence
  Synthetic Oligonucleotide; PRDM1 exon 5; Set A
augggguaaacgacccgaggg

SEQ ID NO: 27480 - RNA, 19 nt, Artificial Sequence
  Synthetic Oligonucleotide; PRDM1 exon 5; Set A
ugggguaaacgacccgagg

SEQ ID NO: 27481 - RNA, 17 nt, Artificial Sequence
  Synthetic Oligonucleotide; PRDM1 exon 5; Set C
gggguaaacgacccgag

SEQ ID NO: 27482 - RNA, 39 nt, Artificial Sequence
  Synthetic Oligonucleotide; PRDM1 exon 5; Set C
ggggcccggaugggguaaacgacccgaggguagaagggc

SEQ ID NO: 27483 - RNA, 24 nt, Artificial Sequence
  Synthetic Oligonucleotide; PRDM1 exon 5; Set C
ggaugggguaaacgacccgagggu

SEQ ID NO: 27484 - RNA, 22 nt, Artificial Sequence
  Synthetic Oligonucleotide; PRDM1 exon 5; Set A
gaugggguaaacgacccgaggg

SEQ ID NO: 27485 - RNA, 18 nt, Artificial Sequence
  Synthetic Oligonucleotide; PRDM1 exon 5; Set C
ugggguaaacgacccgag

SEQ ID NO: 27486 - RNA, 20 nt, Artificial Sequence
  Synthetic Oligonucleotide; PRDM1 exon 5; Set A
augggguaaacgacccgagg

SEQ ID NO: 27487 - RNA, 40 nt, Artificial Sequence
  Synthetic Oligonucleotide; PRDM1 exon 5; Set C
aggggcccggaugggguaaacgacccgaggguagaagggc

SEQ ID NO: 27488 - RNA, 38 nt, Artificial Sequence
  Synthetic Oligonucleotide; PRDM1 exon 5; Set C
ggggcccggaugggguaaacgacccgaggguagaaggg

SEQ ID NO: 27489 - RNA, 23 nt, Artificial Sequence
  Synthetic Oligonucleotide; PRDM1 exon 5; Set C
ggaugggguaaacgacccgaggg

SEQ ID NO: 27490 - RNA, 21 nt, Artificial Sequence
  Synthetic Oligonucleotide; PRDM1 exon 5; Set A
gaugggguaaacgacccgagg

SEQ ID NO: 27491 - RNA, 19 nt, Artificial Sequence
  Synthetic Oligonucleotide; PRDM1 exon 5; Set C
augggguaaacgacccgag

SEQ ID NO: 27492 - RNA, 37 nt, Artificial Sequence
  Synthetic Oligonucleotide; PRDM1 exon 5; Set C
ggggcccggaugggguaaacgacccgaggguagaagg

SEQ ID NO: 27493 - RNA, 39 nt, Artificial Sequence
  Synthetic Oligonucleotide; PRDM1 exon 5; Set C
aggggcccggaugggguaaacgacccgaggguagaaggg

SEQ ID NO: 27494 - RNA, 22 nt, Artificial Sequence
  Synthetic Oligonucleotide; PRDM1 exon 5; Set A
ggaugggguaaacgacccgagg

SEQ ID NO: 27495 - RNA, 20 nt, Artificial Sequence
  Synthetic Oligonucleotide; PRDM1 exon 5; Set A
gaugggguaaacgacccgag

SEQ ID NO: 27496 - RNA, 36 nt, Artificial Sequence
  Synthetic Oligonucleotide; PRDM1 exon 5; Set C
ggggcccggaugggguaaacgacccgaggguagaag

SEQ ID NO: 27497 - RNA, 38 nt, Artificial Sequence
  Synthetic Oligonucleotide; PRDM1 exon 5; Set C
aggggcccggaugggguaaacgacccgaggguagaagg

SEQ ID NO: 27498 - RNA, 40 nt, Artificial Sequence
  Synthetic Oligonucleotide; PRDM1 exon 5; Set C
gaggggcccggaugggguaaacgacccgaggguagaaggg

SEQ ID NO: 27499 - RNA, 35 nt, Artificial Sequence
  Synthetic Oligonucleotide; PRDM1 exon 5; Set C
ggggcccggaugggguaaacgacccgaggguagaa

SEQ ID NO: 27500 - RNA, 21 nt, Artificial Sequence
  Synthetic Oligonucleotide; PRDM1 exon 5; Set A
ggaugggguaaacgacccgag

SEQ ID NO: 27501 - RNA, 37 nt, Artificial Sequence
  Synthetic Oligonucleotide; PRDM1 exon 5; Set C
aggggcccggaugggguaaacgacccgaggguagaag

SEQ ID NO: 27502 - RNA, 39 nt, Artificial Sequence
  Synthetic Oligonucleotide; PRDM1 exon 5; Set C
gaggggcccggaugggguaaacgacccgaggguagaagg

SEQ ID NO: 27503 - RNA, 36 nt, Artificial Sequence
  Synthetic Oligonucleotide; PRDM1 exon 5; Set C
aggggcccggaugggguaaacgacccgaggguagaa

SEQ ID NO: 27504 - RNA, 34 nt, Artificial Sequence
  Synthetic Oligonucleotide; PRDM1 exon 5; Set C
ggggcccggaugggguaaacgacccgaggguaga

SEQ ID NO: 27505 - RNA, 38 nt, Artificial Sequence
  Synthetic Oligonucleotide; PRDM1 exon 5; Set C
gaggggcccggaugggguaaacgacccgaggguagaag

SEQ ID NO: 27506 - RNA, 40 nt, Artificial Sequence
  Synthetic Oligonucleotide; PRDM1 exon 5; Set C
agaggggcccggaugggguaaacgacccgaggguagaagg

SEQ ID NO: 27507 - RNA, 37 nt, Artificial Sequence
  Synthetic Oligonucleotide; PRDM1 exon 5; Set C
gaggggcccggaugggguaaacgacccgaggguagaa

SEQ ID NO: 27508 - RNA, 35 nt, Artificial Sequence
  Synthetic Oligonucleotide; PRDM1 exon 5; Set C
aggggcccggaugggguaaacgacccgaggguaga

SEQ ID NO: 27509 - RNA, 33 nt, Artificial Sequence
  Synthetic Oligonucleotide; PRDM1 exon 5; Set C
ggggcccggaugggguaaacgacccgaggguag

SEQ ID NO: 27510 - RNA, 39 nt, Artificial Sequence
  Synthetic Oligonucleotide; PRDM1 exon 5; Set C
agaggggcccggaugggguaaacgacccgaggguagaag

SEQ ID NO: 27511 - RNA, 32 nt, Artificial Sequence
  Synthetic Oligonucleotide; PRDM1 exon 5; Set C
ggggcccggaugggguaaacgacccgagggua

SEQ ID NO: 27512 - RNA, 38 nt, Artificial Sequence
  Synthetic Oligonucleotide; PRDM1 exon 5; Set C
agaggggcccggaugggguaaacgacccgaggguagaa

SEQ ID NO: 27513 - RNA, 36 nt, Artificial Sequence
  Synthetic Oligonucleotide; PRDM1 exon 5; Set C
gaggggcccggaugggguaaacgacccgaggguaga

SEQ ID NO: 27514 - RNA, 34 nt, Artificial Sequence
  Synthetic Oligonucleotide; PRDM1 exon 5; Set C
aggggcccggaugggguaaacgacccgaggguag

SEQ ID NO: 27515 - RNA, 33 nt, Artificial Sequence
  Synthetic Oligonucleotide; PRDM1 exon 5; Set C
aggggcccggaugggguaaacgacccgagggua

SEQ ID NO: 27516 - RNA, 31 nt, Artificial Sequence
  Synthetic Oligonucleotide; PRDM1 exon 5; Set C
ggggcccggaugggguaaacgacccgagggu

SEQ ID NO: 27517 - RNA, 37 nt, Artificial Sequence
  Synthetic Oligonucleotide; PRDM1 exon 5; Set C
agaggggcccggaugggguaaacgacccgaggguaga

SEQ ID NO: 27518 - RNA, 35 nt, Artificial Sequence
  Synthetic Oligonucleotide; PRDM1 exon 5; Set C
gaggggcccggaugggguaaacgacccgaggguag

SEQ ID NO: 27519 - RNA, 34 nt, Artificial Sequence
  Synthetic Oligonucleotide; PRDM1 exon 5; Set C
gaggggcccggaugggguaaacgacccgagggua

SEQ ID NO: 27520 - RNA, 32 nt, Artificial Sequence
  Synthetic Oligonucleotide; PRDM1 exon 5; Set C
aggggcccggaugggguaaacgacccgagggu

SEQ ID NO: 27521 - RNA, 36 nt, Artificial Sequence
  Synthetic Oligonucleotide; PRDM1 exon 5; Set C
agaggggcccggaugggguaaacgacccgaggguag

SEQ ID NO: 27522 - RNA, 30 nt, Artificial Sequence
  Synthetic Oligonucleotide; PRDM1 exon 5; Set C
ggggcccggaugggguaaacgacccgaggg

SEQ ID NO: 27523 - RNA, 35 nt, Artificial Sequence
  Synthetic Oligonucleotide; PRDM1 exon 5; Set C
agaggggcccggaugggguaaacgacccgagggua

SEQ ID NO: 27524 - RNA, 33 nt, Artificial Sequence
  Synthetic Oligonucleotide; PRDM1 exon 5; Set C
gaggggcccggaugggguaaacgacccgagggu

SEQ ID NO: 27525 - RNA, 31 nt, Artificial Sequence
  Synthetic Oligonucleotide; PRDM1 exon 5; Set C
aggggcccggaugggguaaacgacccgaggg

SEQ ID NO: 27526 - RNA, 29 nt, Artificial Sequence
  Synthetic Oligonucleotide; PRDM1 exon 5; Set C
ggggcccggaugggguaaacgacccgagg

SEQ ID NO: 27527 - RNA, 34 nt, Artificial Sequence
  Synthetic Oligonucleotide; PRDM1 exon 5; Set C
agaggggcccggaugggguaaacgacccgagggu

SEQ ID NO: 27528 - RNA, 32 nt, Artificial Sequence
  Synthetic Oligonucleotide; PRDM1 exon 5; Set C
gaggggcccggaugggguaaacgacccgaggg

SEQ ID NO: 27529 - RNA, 30 nt, Artificial Sequence
  Synthetic Oligonucleotide; PRDM1 exon 5; Set C
aggggcccggaugggguaaacgacccgagg

SEQ ID NO: 27530 - RNA, 33 nt, Artificial Sequence
  Synthetic Oligonucleotide; PRDM1 exon 5; Set C
agaggggcccggaugggguaaacgacccgaggg

SEQ ID NO: 27531 - RNA, 31 nt, Artificial Sequence
  Synthetic Oligonucleotide; PRDM1 exon 5; Set C
gaggggcccggaugggguaaacgacccgagg

SEQ ID NO: 27532 - RNA, 29 nt, Artificial Sequence
  Synthetic Oligonucleotide; PRDM1 exon 5; Set C
aggggcccggaugggguaaacgacccgag

SEQ ID NO: 27533 - RNA, 32 nt, Artificial Sequence
  Synthetic Oligonucleotide; PRDM1 exon 5; Set C
agaggggcccggaugggguaaacgacccgagg

SEQ ID NO: 27534 - RNA, 30 nt, Artificial Sequence
  Synthetic Oligonucleotide; PRDM1 exon 5; Set C
gaggggcccggaugggguaaacgacccgag

SEQ ID NO: 27535 - RNA, 31 nt, Artificial Sequence
  Synthetic Oligonucleotide; PRDM1 exon 5; Set C
agaggggcccggaugggguaaacgacccgag

SEQ ID NO: 27536 - RNA, 19 nt, Artificial Sequence
  Synthetic Oligonucleotide; PRDM1 exon 5; Set A
ggggcccggaugggguaaa

SEQ ID NO: 27537 - RNA, 18 nt, Artificial Sequence
  Synthetic Oligonucleotide; PRDM1 exon 5; Set C
ggggcccggaugggguaa

SEQ ID NO: 27538 - RNA, 20 nt, Artificial Sequence
  Synthetic Oligonucleotide; PRDM1 exon 5; Set A
aggggcccggaugggguaaa

SEQ ID NO: 27539 - RNA, 17 nt, Artificial Sequence
  Synthetic Oligonucleotide; PRDM1 exon 5; Set C
ggggcccggauggggua

SEQ ID NO: 27540 - RNA, 19 nt, Artificial Sequence
  Synthetic Oligonucleotide; PRDM1 exon 5; Set C
aggggcccggaugggguaa

SEQ ID NO: 27541 - RNA, 21 nt, Artificial Sequence
  Synthetic Oligonucleotide; PRDM1 exon 5; Set C
gaggggcccggaugggguaaa

SEQ ID NO: 27542 - RNA, 18 nt, Artificial Sequence
  Synthetic Oligonucleotide; PRDM1 exon 5; Set C
aggggcccggauggggua

SEQ ID NO: 27543 - RNA, 16 nt, Artificial Sequence
  Synthetic Oligonucleotide; PRDM1 exon 5; Set C
ggggcccggauggggu

SEQ ID NO: 27544 - RNA, 20 nt, Artificial Sequence
  Synthetic Oligonucleotide; PRDM1 exon 5; Set C
gaggggcccggaugggguaa

SEQ ID NO: 27545 - RNA, 22 nt, Artificial Sequence
  Synthetic Oligonucleotide; PRDM1 exon 5; Set C
agaggggcccggaugggguaaa

SEQ ID NO: 27546 - RNA, 19 nt, Artificial Sequence
  Synthetic Oligonucleotide; PRDM1 exon 5; Set C
gaggggcccggauggggua

SEQ ID NO: 27547 - RNA, 17 nt, Artificial Sequence
  Synthetic Oligonucleotide; PRDM1 exon 5; Set C
aggggcccggauggggu

SEQ ID NO: 27548 - RNA, 21 nt, Artificial Sequence
  Synthetic Oligonucleotide; PRDM1 exon 5; Set C
agaggggcccggaugggguaa

SEQ ID NO: 27549 - RNA, 20 nt, Artificial Sequence
  Synthetic Oligonucleotide; PRDM1 exon 5; Set C
agaggggcccggauggggua

SEQ ID NO: 27550 - RNA, 18 nt, Artificial Sequence
  Synthetic Oligonucleotide; PRDM1 exon 5; Set C
gaggggcccggauggggu

SEQ ID NO: 27551 - RNA, 16 nt, Artificial Sequence
  Synthetic Oligonucleotide; PRDM1 exon 5; Set A
aggggcccggaugggg

SEQ ID NO: 27552 - RNA, 19 nt, Artificial Sequence
  Synthetic Oligonucleotide; PRDM1 exon 5; Set C
agaggggcccggauggggu

SEQ ID NO: 27553 - RNA, 17 nt, Artificial Sequence
  Synthetic Oligonucleotide; PRDM1 exon 5; Set C
gaggggcccggaugggg

SEQ ID NO: 27554 - RNA, 18 nt, Artificial Sequence
  Synthetic Oligonucleotide; PRDM1 exon 5; Set C
agaggggcccggaugggg

SEQ ID NO: 27555 - RNA, 16 nt, Artificial Sequence
  Synthetic Oligonucleotide; PRDM1 exon 5; Set A
gaggggcccggauggg

SEQ ID NO: 27556 - RNA, 15 nt, Artificial Sequence
  Synthetic Oligonucleotide; PRDM1 exon 5; Set A
gaggggcccggaugg

SEQ ID NO: 27557 - RNA, 17 nt, Artificial Sequence
  Synthetic Oligonucleotide; PRDM1 exon 5; Set A
agaggggcccggauggg

SEQ ID NO: 27558 - RNA, 16 nt, Artificial Sequence
  Synthetic Oligonucleotide; PRDM1 exon 5; Set A
agaggggcccggaugg

SEQ ID NO: 27559 - RNA, 15 nt, Artificial Sequence
  Synthetic Oligonucleotide; PRDM1 exon 5; Set C
agaggggcccggaug

SEQ ID NO: 27560 - RNA, 39 nt, Artificial Sequence
  Synthetic Oligonucleotide; PRDM1 exon 5; Set C
gguggaggauggaaugggggagcgagugauguacguggg

SEQ ID NO: 27561 - RNA, 40 nt, Artificial Sequence
  Synthetic Oligonucleotide; PRDM1 exon 5; Set C
ugguggaggauggaaugggggagcgagugauguacguggg

SEQ ID NO: 27562 - RNA, 39 nt, Artificial Sequence
  Synthetic Oligonucleotide; PRDM1 exon 5; Set C
ugguggaggauggaaugggggagcgagugauguacgugg

SEQ ID NO: 27563 - RNA, 40 nt, Artificial Sequence
  Synthetic Oligonucleotide; PRDM1 exon 5; Set C
gugguggaggauggaaugggggagcgagugauguacgugg

SEQ ID NO: 27564 - RNA, 39 nt, Artificial Sequence
  Synthetic Oligonucleotide; PRDM1 exon 5; Set C
gugguggaggauggaaugggggagcgagugauguacgug

SEQ ID NO: 27565 - RNA, 40 nt, Artificial Sequence
  Synthetic Oligonucleotide; PRDM1 exon 5; Set C
agugguggaggauggaaugggggagcgagugauguacgug

SEQ ID NO: 27566 - RNA, 39 nt, Artificial Sequence
  Synthetic Oligonucleotide; PRDM1 exon 5; Set C
agugguggaggauggaaugggggagcgagugauguacgu

SEQ ID NO: 27567 - RNA, 40 nt, Artificial Sequence
  Synthetic Oligonucleotide; PRDM1 exon 5; Set C
gagugguggaggauggaaugggggagcgagugauguacgu

SEQ ID NO: 27568 - RNA, 39 nt, Artificial Sequence
  Synthetic Oligonucleotide; PRDM1 exon 5; Set C
gagugguggaggauggaaugggggagcgagugauguacg

SEQ ID NO: 27569 - RNA, 40 nt, Artificial Sequence
  Synthetic Oligonucleotide; PRDM1 exon 5; Set C
ggagugguggaggauggaaugggggagcgagugauguacg

SEQ ID NO: 27570 - RNA, 39 nt, Artificial Sequence
  Synthetic Oligonucleotide; PRDM1 exon 5; Set C
ggagugguggaggauggaaugggggagcgagugauguac

SEQ ID NO: 27571 - RNA, 40 nt, Artificial Sequence
  Synthetic Oligonucleotide; PRDM1 exon 5; Set C
uggagugguggaggauggaaugggggagcgagugauguac

SEQ ID NO: 27572 - RNA, 39 nt, Artificial Sequence
  Synthetic Oligonucleotide; PRDM1 exon 5; Set C
uggagugguggaggauggaaugggggagcgagugaugua

SEQ ID NO: 27573 - RNA, 38 nt, Artificial Sequence
  Synthetic Oligonucleotide; PRDM1 exon 5; Set C
uggagugguggaggauggaaugggggagcgagugaugu

SEQ ID NO: 27574 - RNA, 40 nt, Artificial Sequence
  Synthetic Oligonucleotide; PRDM1 exon 5; Set C
uuggagugguggaggauggaaugggggagcgagugaugua

SEQ ID NO: 27575 - RNA, 39 nt, Artificial Sequence
  Synthetic Oligonucleotide; PRDM1 exon 5; Set C
uuggagugguggaggauggaaugggggagcgagugaugu

SEQ ID NO: 27576 - RNA, 30 nt, Artificial Sequence
  Synthetic Oligonucleotide; PRDM1 exon 5; Set C
aggggcuuggagugguggaggauggaaugg

SEQ ID NO: 27577 - RNA, 29 nt, Artificial Sequence
  Synthetic Oligonucleotide; PRDM1 exon 5; Set C
aggggcuuggagugguggaggauggaaug

SEQ ID NO: 27578 - RNA, 28 nt, Artificial Sequence
  Synthetic Oligonucleotide; PRDM1 exon 5; Set C
aggggcuuggagugguggaggauggaau

SEQ ID NO: 27579 - RNA, 27 nt, Artificial Sequence
  Synthetic Oligonucleotide; PRDM1 exon 5; Set C
aggggcuuggagugguggaggauggaa

SEQ ID NO: 27580 - RNA, 28 nt, Artificial Sequence
  Synthetic Oligonucleotide; PRDM1 exon 5; Set C
cuugcagaggggcuuggagugguggagg

SEQ ID NO: 27581 - RNA, 27 nt, Artificial Sequence
  Synthetic Oligonucleotide; PRDM1 exon 5; Set C
cuugcagaggggcuuggagugguggag

SEQ ID NO: 27582 - RNA, 28 nt, Artificial Sequence
  Synthetic Oligonucleotide; PRDM1 exon 5; Set C
ucuugcagaggggcuuggagugguggag

SEQ ID NO: 27583 - RNA, 26 nt, Artificial Sequence
  Synthetic Oligonucleotide; PRDM1 exon 5; Set C
cuugcagaggggcuuggaguggugga

SEQ ID NO: 27584 - RNA, 27 nt, Artificial Sequence
  Synthetic Oligonucleotide; PRDM1 exon 5; Set C
ucuugcagaggggcuuggaguggugga

SEQ ID NO: 27585 - RNA, 25 nt, Artificial Sequence
  Synthetic Oligonucleotide; PRDM1 exon 5; Set C
cuugcagaggggcuuggaguggugg

SEQ ID NO: 27586 - RNA, 28 nt, Artificial Sequence
  Synthetic Oligonucleotide; PRDM1 exon 5; Set C
uucuugcagaggggcuuggaguggugga

SEQ ID NO: 27587 - RNA, 26 nt, Artificial Sequence
  Synthetic Oligonucleotide; PRDM1 exon 5; Set C
ucuugcagaggggcuuggaguggugg

SEQ ID NO: 27588 - RNA, 24 nt, Artificial Sequence
  Synthetic Oligonucleotide; PRDM1 exon 5; Set C
cuugcagaggggcuuggaguggug

SEQ ID NO: 27589 - RNA, 23 nt, Artificial Sequence
  Synthetic Oligonucleotide; PRDM1 exon 5; Set C
cuugcagaggggcuuggaguggu

SEQ ID NO: 27590 - RNA, 27 nt, Artificial Sequence
  Synthetic Oligonucleotide; PRDM1 exon 5; Set C
uucuugcagaggggcuuggaguggugg

SEQ ID NO: 27591 - RNA, 25 nt, Artificial Sequence
  Synthetic Oligonucleotide; PRDM1 exon 5; Set C
ucuugcagaggggcuuggaguggug

SEQ ID NO: 27592 - RNA, 24 nt, Artificial Sequence
  Synthetic Oligonucleotide; PRDM1 exon 5; Set C
ucuugcagaggggcuuggaguggu

SEQ ID NO: 27593 - RNA, 22 nt, Artificial Sequence
  Synthetic Oligonucleotide; PRDM1 exon 5; Set A
cuugcagaggggcuuggagugg

SEQ ID NO: 27594 - RNA, 40 nt, Artificial Sequence
  Synthetic Oligonucleotide; PRDM1 exon 5; Set C
gggcugcuucuugcagaggggcuuggagugguggaggaug

SEQ ID NO: 27595 - RNA, 26 nt, Artificial Sequence
  Synthetic Oligonucleotide; PRDM1 exon 5; Set C
uucuugcagaggggcuuggaguggug

SEQ ID NO: 27596 - RNA, 39 nt, Artificial Sequence
  Synthetic Oligonucleotide; PRDM1 exon 5; Set C
gggcugcuucuugcagaggggcuuggagugguggaggau

SEQ ID NO: 27597 - RNA, 25 nt, Artificial Sequence
  Synthetic Oligonucleotide; PRDM1 exon 5; Set C
uucuugcagaggggcuuggaguggu

SEQ ID NO: 27598 - RNA, 23 nt, Artificial Sequence
  Synthetic Oligonucleotide; PRDM1 exon 5; Set C
ucuugcagaggggcuuggagugg

SEQ ID NO: 27599 - RNA, 21 nt, Artificial Sequence
  Synthetic Oligonucleotide; PRDM1 exon 5; Set A
cuugcagaggggcuuggagug

SEQ ID NO: 27600 - RNA, 24 nt, Artificial Sequence
  Synthetic Oligonucleotide; PRDM1 exon 5; Set C
uucuugcagaggggcuuggagugg

SEQ ID NO: 27601 - RNA, 22 nt, Artificial Sequence
  Synthetic Oligonucleotide; PRDM1 exon 5; Set A
ucuugcagaggggcuuggagug

SEQ ID NO: 27602 - RNA, 20 nt, Artificial Sequence
  Synthetic Oligonucleotide; PRDM1 exon 5; Set A
cuugcagaggggcuuggagu

SEQ ID NO: 27603 - RNA, 38 nt, Artificial Sequence
  Synthetic Oligonucleotide; PRDM1 exon 5; Set C
gggcugcuucuugcagaggggcuuggagugguggagga

SEQ ID NO: 27604 - RNA, 23 nt, Artificial Sequence
  Synthetic Oligonucleotide; PRDM1 exon 5; Set A
uucuugcagaggggcuuggagug

SEQ ID NO: 27605 - RNA, 21 nt, Artificial Sequence
  Synthetic Oligonucleotide; PRDM1 exon 5; Set A
ucuugcagaggggcuuggagu

SEQ ID NO: 27606 - RNA, 19 nt, Artificial Sequence
  Synthetic Oligonucleotide; PRDM1 exon 5; Set A
cuugcagaggggcuuggag

SEQ ID NO: 27607 - RNA, 37 nt, Artificial Sequence
  Synthetic Oligonucleotide; PRDM1 exon 5; Set C
gggcugcuucuugcagaggggcuuggagugguggagg

SEQ ID NO: 27608 - RNA, 22 nt, Artificial Sequence
  Synthetic Oligonucleotide; PRDM1 exon 5; Set A
uucuugcagaggggcuuggagu

SEQ ID NO: 27609 - RNA, 20 nt, Artificial Sequence
  Synthetic Oligonucleotide; PRDM1 exon 5; Set A
ucuugcagaggggcuuggag

SEQ ID NO: 27610 - RNA, 18 nt, Artificial Sequence
  Synthetic Oligonucleotide; PRDM1 exon 5; Set A
cuugcagaggggcuugga

SEQ ID NO: 27611 - RNA, 36 nt, Artificial Sequence
  Synthetic Oligonucleotide; PRDM1 exon 5; Set C
gggcugcuucuugcagaggggcuuggagugguggag

SEQ ID NO: 27612 - RNA, 21 nt, Artificial Sequence
  Synthetic Oligonucleotide; PRDM1 exon 5; Set A
uucuugcagaggggcuuggag

SEQ ID NO: 27613 - RNA, 19 nt, Artificial Sequence
  Synthetic Oligonucleotide; PRDM1 exon 5; Set A
ucuugcagaggggcuugga

SEQ ID NO: 27614 - RNA, 17 nt, Artificial Sequence
  Synthetic Oligonucleotide; PRDM1 exon 5; Set A
cuugcagaggggcuugg

SEQ ID NO: 27615 - RNA, 35 nt, Artificial Sequence
  Synthetic Oligonucleotide; PRDM1 exon 5; Set C
gggcugcuucuugcagaggggcuuggaguggugga

SEQ ID NO: 27616 - RNA, 20 nt, Artificial Sequence
  Synthetic Oligonucleotide; PRDM1 exon 5; Set A
uucuugcagaggggcuugga

SEQ ID NO: 27617 - RNA, 18 nt, Artificial Sequence
  Synthetic Oligonucleotide; PRDM1 exon 5; Set A
ucuugcagaggggcuugg

SEQ ID NO: 27618 - RNA, 16 nt, Artificial Sequence
  Synthetic Oligonucleotide; PRDM1 exon 5; Set C
cuugcagaggggcuug

SEQ ID NO: 27619 - RNA, 34 nt, Artificial Sequence
  Synthetic Oligonucleotide; PRDM1 exon 5; Set C
gggcugcuucuugcagaggggcuuggaguggugg

SEQ ID NO: 27620 - RNA, 19 nt, Artificial Sequence
  Synthetic Oligonucleotide; PRDM1 exon 5; Set A
uucuugcagaggggcuugg

SEQ ID NO: 27621 - RNA, 17 nt, Artificial Sequence
  Synthetic Oligonucleotide; PRDM1 exon 5; Set C
ucuugcagaggggcuug

SEQ ID NO: 27622 - RNA, 33 nt, Artificial Sequence
  Synthetic Oligonucleotide; PRDM1 exon 5; Set C
gggcugcuucuugcagaggggcuuggaguggug

SEQ ID NO: 27623 - RNA, 32 nt, Artificial Sequence
  Synthetic Oligonucleotide; PRDM1 exon 5; Set C
gggcugcuucuugcagaggggcuuggaguggu

SEQ ID NO: 27624 - RNA, 18 nt, Artificial Sequence
  Synthetic Oligonucleotide; PRDM1 exon 5; Set C
uucuugcagaggggcuug

SEQ ID NO: 27625 - RNA, 31 nt, Artificial Sequence
  Synthetic Oligonucleotide; PRDM1 exon 5; Set C
gggcugcuucuugcagaggggcuuggagugg

SEQ ID NO: 27626 - RNA, 30 nt, Artificial Sequence
  Synthetic Oligonucleotide; PRDM1 exon 5; Set C
gggcugcuucuugcagaggggcuuggagug

SEQ ID NO: 27627 - RNA, 40 nt, Artificial Sequence
  Synthetic Oligonucleotide; PRDM1 exon 5; Set C
ggucggggcugcuucuugcagaggggcuuggaguggugga

SEQ ID NO: 27628 - RNA, 29 nt, Artificial Sequence
  Synthetic Oligonucleotide; PRDM1 exon 5; Set C
gggcugcuucuugcagaggggcuuggagu

SEQ ID NO: 27629 - RNA, 39 nt, Artificial Sequence
  Synthetic Oligonucleotide; PRDM1 exon 5; Set C
ggucggggcugcuucuugcagaggggcuuggaguggugg

SEQ ID NO: 27630 - RNA, 40 nt, Artificial Sequence
  Synthetic Oligonucleotide; PRDM1 exon 5; Set C
uggucggggcugcuucuugcagaggggcuuggaguggugg

SEQ ID NO: 27631 - RNA, 38 nt, Artificial Sequence
  Synthetic Oligonucleotide; PRDM1 exon 5; Set C
ggucggggcugcuucuugcagaggggcuuggaguggug

SEQ ID NO: 27632 - RNA, 37 nt, Artificial Sequence
  Synthetic Oligonucleotide; PRDM1 exon 5; Set C
ggucggggcugcuucuugcagaggggcuuggaguggu

SEQ ID NO: 27633 - RNA, 39 nt, Artificial Sequence
  Synthetic Oligonucleotide; PRDM1 exon 5; Set C
uggucggggcugcuucuugcagaggggcuuggaguggug

SEQ ID NO: 27634 - RNA, 38 nt, Artificial Sequence
  Synthetic Oligonucleotide; PRDM1 exon 5; Set C
uggucggggcugcuucuugcagaggggcuuggaguggu

SEQ ID NO: 27635 - RNA, 36 nt, Artificial Sequence
  Synthetic Oligonucleotide; PRDM1 exon 5; Set C
ggucggggcugcuucuugcagaggggcuuggagugg

SEQ ID NO: 27636 - RNA, 40 nt, Artificial Sequence
  Synthetic Oligonucleotide; PRDM1 exon 5; Set C
uuggucggggcugcuucuugcagaggggcuuggaguggug

SEQ ID NO: 27637 - RNA, 37 nt, Artificial Sequence
  Synthetic Oligonucleotide; PRDM1 exon 5; Set C
uggucggggcugcuucuugcagaggggcuuggagugg

SEQ ID NO: 27638 - RNA, 35 nt, Artificial Sequence
  Synthetic Oligonucleotide; PRDM1 exon 5; Set C
ggucggggcugcuucuugcagaggggcuuggagug

SEQ ID NO: 27639 - RNA, 39 nt, Artificial Sequence
  Synthetic Oligonucleotide; PRDM1 exon 5; Set C
uuggucggggcugcuucuugcagaggggcuuggaguggu

SEQ ID NO: 27640 - RNA, 40 nt, Artificial Sequence
  Synthetic Oligonucleotide; PRDM1 exon 5; Set C
uuuggucggggcugcuucuugcagaggggcuuggaguggu

SEQ ID NO: 27641 - RNA, 36 nt, Artificial Sequence
  Synthetic Oligonucleotide; PRDM1 exon 5; Set C
uggucggggcugcuucuugcagaggggcuuggagug

SEQ ID NO: 27642 - RNA, 38 nt, Artificial Sequence
  Synthetic Oligonucleotide; PRDM1 exon 5; Set C
uuggucggggcugcuucuugcagaggggcuuggagugg

SEQ ID NO: 27643 - RNA, 39 nt, Artificial Sequence
  Synthetic Oligonucleotide; PRDM1 exon 5; Set C
uuuggucggggcugcuucuugcagaggggcuuggagugg

SEQ ID NO: 27644 - RNA, 35 nt, Artificial Sequence
  Synthetic Oligonucleotide; PRDM1 exon 5; Set C
uggucggggcugcuucuugcagaggggcuuggagu

SEQ ID NO: 27645 - RNA, 37 nt, Artificial Sequence
  Synthetic Oligonucleotide; PRDM1 exon 5; Set C
uuggucggggcugcuucuugcagaggggcuuggagug

SEQ ID NO: 27646 - RNA, 38 nt, Artificial Sequence
  Synthetic Oligonucleotide; PRDM1 exon 5; Set C
uuuggucggggcugcuucuugcagaggggcuuggagug

SEQ ID NO: 27647 - RNA, 36 nt, Artificial Sequence
  Synthetic Oligonucleotide; PRDM1 exon 5; Set C
uuggucggggcugcuucuugcagaggggcuuggagu

SEQ ID NO: 27648 - RNA, 37 nt, Artificial Sequence
  Synthetic Oligonucleotide; PRDM1 exon 5; Set C
uuuggucggggcugcuucuugcagaggggcuuggagu

SEQ ID NO: 27649 - RNA, 35 nt, Artificial Sequence
  Synthetic Oligonucleotide; PRDM1 exon 5; Set C
uuggucggggcugcuucuugcagaggggcuuggag

SEQ ID NO: 27650 - RNA, 36 nt, Artificial Sequence
  Synthetic Oligonucleotide; PRDM1 exon 5; Set C
uuuggucggggcugcuucuugcagaggggcuuggag

SEQ ID NO: 27651 - RNA, 35 nt, Artificial Sequence
  Synthetic Oligonucleotide; PRDM1 exon 5; Set C
uuuggucggggcugcuucuugcagaggggcuugga

SEQ ID NO: 27652 - RNA, 34 nt, Artificial Sequence
  Synthetic Oligonucleotide; PRDM1 exon 5; Set C
uuuggucggggcugcuucuugcagaggggcuugg

SEQ ID NO: 27653 - RNA, 33 nt, Artificial Sequence
  Synthetic Oligonucleotide; PRDM1 exon 5; Set C
uuuggucggggcugcuucuugcagaggggcuug

SEQ ID NO: 27654 - RNA, 20 nt, Artificial Sequence
  Synthetic Oligonucleotide; PRDM1 exon 5; Set A
uuuggucggggcugcuucuu

SEQ ID NO: 27655 - RNA, 19 nt, Artificial Sequence
  Synthetic Oligonucleotide; PRDM1 exon 5; Set A
uuuggucggggcugcuucu

SEQ ID NO: 27656 - RNA, 18 nt, Artificial Sequence
  Synthetic Oligonucleotide; PRDM1 exon 5; Set A
uuuggucggggcugcuuc

SEQ ID NO: 27657 - RNA, 19 nt, Artificial Sequence
  Synthetic Oligonucleotide; PRDM1 exon 5; Set C
uucaaguaagcguaggagu

SEQ ID NO: 27658 - RNA, 16 nt, Artificial Sequence
  Synthetic Oligonucleotide; PRDM1 exon 5; Set C
ucaaguaagcguagga

SEQ ID NO: 27659 - RNA, 20 nt, Artificial Sequence
  Synthetic Oligonucleotide; PRDM1 exon 5; Set C
guucaaguaagcguaggagu

SEQ ID NO: 27660 - RNA, 17 nt, Artificial Sequence
  Synthetic Oligonucleotide; PRDM1 exon 5; Set C
uucaaguaagcguagga

SEQ ID NO: 27661 - RNA, 18 nt, Artificial Sequence
  Synthetic Oligonucleotide; PRDM1 exon 5; Set C
guucaaguaagcguagga

SEQ ID NO: 27662 - RNA, 15 nt, Artificial Sequence
  Synthetic Oligonucleotide; PRDM1 exon 5; Set C
uucaaguaagcguag

SEQ ID NO: 27663 - RNA, 16 nt, Artificial Sequence
  Synthetic Oligonucleotide; PRDM1 exon 5; Set C
guucaaguaagcguag

SEQ ID NO: 27664 - RNA, 15 nt, Artificial Sequence
  Synthetic Oligonucleotide; PRDM1 exon 5; Set C
guucaaguaagcgua

SEQ ID NO: 27665 - RNA, 27 nt, Artificial Sequence
  Synthetic Oligonucleotide; PRDM1 exon 5; Set A
cguaggacgcguucaaguaagcguagg

SEQ ID NO: 27666 - RNA, 31 nt, Artificial Sequence
  Synthetic Oligonucleotide; PRDM1 exon 5; Set C
gugccguaggacgcguucaaguaagcguagg

SEQ ID NO: 27667 - RNA, 30 nt, Artificial Sequence
  Synthetic Oligonucleotide; PRDM1 exon 5; Set C
gugccguaggacgcguucaaguaagcguag

SEQ ID NO: 27668 - RNA, 20 nt, Artificial Sequence
  Synthetic Oligonucleotide; PRDM1 exon 5; Set C
cguaggacgcguucaaguaa

SEQ ID NO: 27669 - RNA, 19 nt, Artificial Sequence
  Synthetic Oligonucleotide; PRDM1 exon 5; Set C
cguaggacgcguucaagua

SEQ ID NO: 27670 - RNA, 18 nt, Artificial Sequence
  Synthetic Oligonucleotide; PRDM1 exon 5; Set C
cguaggacgcguucaagu

SEQ ID NO: 27671 - RNA, 17 nt, Artificial Sequence
  Synthetic Oligonucleotide; PRDM1 exon 5; Set C
cguaggacgcguucaag

SEQ ID NO: 27672 - RNA, 16 nt, Artificial Sequence
  Synthetic Oligonucleotide; PRDM1 exon 5; Set C
cguaggacgcguucaa

SEQ ID NO: 27673 - RNA, 24 nt, Artificial Sequence
  Synthetic Oligonucleotide; PRDM1 exon 5; Set A
gugccguaggacgcguucaaguaa

SEQ ID NO: 27674 - RNA, 15 nt, Artificial Sequence
  Synthetic Oligonucleotide; PRDM1 exon 5; Set C
cguaggacgcguuca

SEQ ID NO: 27675 - RNA, 23 nt, Artificial Sequence
  Synthetic Oligonucleotide; PRDM1 exon 5; Set C
gugccguaggacgcguucaagua

SEQ ID NO: 27676 - RNA, 22 nt, Artificial Sequence
  Synthetic Oligonucleotide; PRDM1 exon 5; Set A
gugccguaggacgcguucaagu

SEQ ID NO: 27677 - RNA, 21 nt, Artificial Sequence
  Synthetic Oligonucleotide; PRDM1 exon 5; Set A
gugccguaggacgcguucaag

SEQ ID NO: 27678 - RNA, 20 nt, Artificial Sequence
  Synthetic Oligonucleotide; PRDM1 exon 5; Set A
gugccguaggacgcguucaa

SEQ ID NO: 27679 - RNA, 19 nt, Artificial Sequence
  Synthetic Oligonucleotide; PRDM1 exon 5; Set A
gugccguaggacgcguuca

SEQ ID NO: 27680 - RNA, 18 nt, Artificial Sequence
  Synthetic Oligonucleotide; PRDM1 exon 5; Set A
gugccguaggacgcguuc

SEQ ID NO: 27681 - RNA, 17 nt, Artificial Sequence
  Synthetic Oligonucleotide; PRDM1 exon 5; Set A
gugccguaggacgcguu

SEQ ID NO: 27682 - RNA, 39 nt, Artificial Sequence
  Synthetic Oligonucleotide; PRDM1 exon 5; Set C
gagcccaaaccuuccgugccguaggacgcguucaaguaa

SEQ ID NO: 27683 - RNA, 38 nt, Artificial Sequence
  Synthetic Oligonucleotide; PRDM1 exon 5; Set C
gagcccaaaccuuccgugccguaggacgcguucaagua

SEQ ID NO: 27684 - RNA, 40 nt, Artificial Sequence
  Synthetic Oligonucleotide; PRDM1 exon 5; Set C
ggagcccaaaccuuccgugccguaggacgcguucaaguaa

SEQ ID NO: 27685 - RNA, 37 nt, Artificial Sequence
  Synthetic Oligonucleotide; PRDM1 exon 5; Set C
gagcccaaaccuuccgugccguaggacgcguucaagu

SEQ ID NO: 27686 - RNA, 39 nt, Artificial Sequence
  Synthetic Oligonucleotide; PRDM1 exon 5; Set C
ggagcccaaaccuuccgugccguaggacgcguucaagua

SEQ ID NO: 27687 - RNA, 38 nt, Artificial Sequence
  Synthetic Oligonucleotide; PRDM1 exon 5; Set C
ggagcccaaaccuuccgugccguaggacgcguucaagu

SEQ ID NO: 27688 - RNA, 40 nt, Artificial Sequence
  Synthetic Oligonucleotide; PRDM1 exon 5; Set C
aggagcccaaaccuuccgugccguaggacgcguucaagua

SEQ ID NO: 27689 - RNA, 39 nt, Artificial Sequence
  Synthetic Oligonucleotide; PRDM1 exon 5; Set C
aggagcccaaaccuuccgugccguaggacgcguucaagu

SEQ ID NO: 27690 - RNA, 37 nt, Artificial Sequence
  Synthetic Oligonucleotide; PRDM1 exon 5; Set C
ggagcccaaaccuuccgugccguaggacgcguucaag

SEQ ID NO: 27691 - RNA, 34 nt, Artificial Sequence
  Synthetic Oligonucleotide; PRDM1 exon 5; Set C
gagcccaaaccuuccgugccguaggacgcguuca

SEQ ID NO: 27692 - RNA, 36 nt, Artificial Sequence
  Synthetic Oligonucleotide; PRDM1 exon 5; Set C
ggagcccaaaccuuccgugccguaggacgcguucaa

SEQ ID NO: 27693 - RNA, 40 nt, Artificial Sequence
  Synthetic Oligonucleotide; PRDM1 exon 5; Set C
uaggagcccaaaccuuccgugccguaggacgcguucaagu

SEQ ID NO: 27694 - RNA, 38 nt, Artificial Sequence
  Synthetic Oligonucleotide; PRDM1 exon 5; Set C
aggagcccaaaccuuccgugccguaggacgcguucaag

SEQ ID NO: 27695 - RNA, 35 nt, Artificial Sequence
  Synthetic Oligonucleotide; PRDM1 exon 5; Set C
ggagcccaaaccuuccgugccguaggacgcguuca

SEQ ID NO: 27696 - RNA, 37 nt, Artificial Sequence
  Synthetic Oligonucleotide; PRDM1 exon 5; Set C
aggagcccaaaccuuccgugccguaggacgcguucaa

SEQ ID NO: 27697 - RNA, 39 nt, Artificial Sequence
  Synthetic Oligonucleotide; PRDM1 exon 5; Set C
uaggagcccaaaccuuccgugccguaggacgcguucaag

SEQ ID NO: 27698 - RNA, 36 nt, Artificial Sequence
  Synthetic Oligonucleotide; PRDM1 exon 5; Set C
aggagcccaaaccuuccgugccguaggacgcguuca

SEQ ID NO: 27699 - RNA, 34 nt, Artificial Sequence
  Synthetic Oligonucleotide; PRDM1 exon 5; Set C
ggagcccaaaccuuccgugccguaggacgcguuc

SEQ ID NO: 27700 - RNA, 38 nt, Artificial Sequence
  Synthetic Oligonucleotide; PRDM1 exon 5; Set C
uaggagcccaaaccuuccgugccguaggacgcguucaa

SEQ ID NO: 27701 - RNA, 40 nt, Artificial Sequence
  Synthetic Oligonucleotide; PRDM1 exon 5; Set C
guaggagcccaaaccuuccgugccguaggacgcguucaag

SEQ ID NO: 27702 - RNA, 37 nt, Artificial Sequence
  Synthetic Oligonucleotide; PRDM1 exon 5; Set C
uaggagcccaaaccuuccgugccguaggacgcguuca

SEQ ID NO: 27703 - RNA, 35 nt, Artificial Sequence
  Synthetic Oligonucleotide; PRDM1 exon 5; Set C
aggagcccaaaccuuccgugccguaggacgcguuc

SEQ ID NO: 27704 - RNA, 33 nt, Artificial Sequence
  Synthetic Oligonucleotide; PRDM1 exon 5; Set C
ggagcccaaaccuuccgugccguaggacgcguu

SEQ ID NO: 27705 - RNA, 39 nt, Artificial Sequence
  Synthetic Oligonucleotide; PRDM1 exon 5; Set C
guaggagcccaaaccuuccgugccguaggacgcguucaa

SEQ ID NO: 27706 - RNA, 36 nt, Artificial Sequence
  Synthetic Oligonucleotide; PRDM1 exon 5; Set C
uaggagcccaaaccuuccgugccguaggacgcguuc

SEQ ID NO: 27707 - RNA, 38 nt, Artificial Sequence
  Synthetic Oligonucleotide; PRDM1 exon 5; Set C
guaggagcccaaaccuuccgugccguaggacgcguuca

SEQ ID NO: 27708 - RNA, 34 nt, Artificial Sequence
  Synthetic Oligonucleotide; PRDM1 exon 5; Set C
aggagcccaaaccuuccgugccguaggacgcguu

SEQ ID NO: 27709 - RNA, 40 nt, Artificial Sequence
  Synthetic Oligonucleotide; PRDM1 exon 5; Set C
gguaggagcccaaaccuuccgugccguaggacgcguucaa

SEQ ID NO: 27710 - RNA, 37 nt, Artificial Sequence
  Synthetic Oligonucleotide; PRDM1 exon 5; Set C
guaggagcccaaaccuuccgugccguaggacgcguuc

SEQ ID NO: 27711 - RNA, 39 nt, Artificial Sequence
  Synthetic Oligonucleotide; PRDM1 exon 5; Set C
gguaggagcccaaaccuuccgugccguaggacgcguuca

SEQ ID NO: 27712 - RNA, 35 nt, Artificial Sequence
  Synthetic Oligonucleotide; PRDM1 exon 5; Set C
uaggagcccaaaccuuccgugccguaggacgcguu

SEQ ID NO: 27713 - RNA, 38 nt, Artificial Sequence
  Synthetic Oligonucleotide; PRDM1 exon 5; Set C
gguaggagcccaaaccuuccgugccguaggacgcguuc

SEQ ID NO: 27714 - RNA, 40 nt, Artificial Sequence
  Synthetic Oligonucleotide; PRDM1 exon 5; Set C
ggguaggagcccaaaccuuccgugccguaggacgcguuca

SEQ ID NO: 27715 - RNA, 36 nt, Artificial Sequence
  Synthetic Oligonucleotide; PRDM1 exon 5; Set C
guaggagcccaaaccuuccgugccguaggacgcguu

SEQ ID NO: 27716 - RNA, 39 nt, Artificial Sequence
  Synthetic Oligonucleotide; PRDM1 exon 5; Set C
ggguaggagcccaaaccuuccgugccguaggacgcguuc

SEQ ID NO: 27717 - RNA, 37 nt, Artificial Sequence
  Synthetic Oligonucleotide; PRDM1 exon 5; Set C
gguaggagcccaaaccuuccgugccguaggacgcguu

SEQ ID NO: 27718 - RNA, 40 nt, Artificial Sequence
  Synthetic Oligonucleotide; PRDM1 exon 5; Set C
aggguaggagcccaaaccuuccgugccguaggacgcguuc

SEQ ID NO: 27719 - RNA, 38 nt, Artificial Sequence
  Synthetic Oligonucleotide; PRDM1 exon 5; Set C
ggguaggagcccaaaccuuccgugccguaggacgcguu

SEQ ID NO: 27720 - RNA, 39 nt, Artificial Sequence
  Synthetic Oligonucleotide; PRDM1 exon 5; Set C
aggguaggagcccaaaccuuccgugccguaggacgcguu

SEQ ID NO: 27721 - RNA, 25 nt, Artificial Sequence
  Synthetic Oligonucleotide; PRDM1 exon 5; Set C
aggguaggagcccaaaccuuccgug

SEQ ID NO: 27722 - RNA, 34 nt, Artificial Sequence
  Synthetic Oligonucleotide; PRDM1 exon 5; Set C
ugcguagccaggguaggagcccaaaccuuccgug

SEQ ID NO: 27723 - RNA, 35 nt, Artificial Sequence
  Synthetic Oligonucleotide; PRDM1 exon 5; Set C
gugcguagccaggguaggagcccaaaccuuccgug

SEQ ID NO: 27724 - RNA, 36 nt, Artificial Sequence
  Synthetic Oligonucleotide; PRDM1 exon 5; Set C
ggugcguagccaggguaggagcccaaaccuuccgug

SEQ ID NO: 27725 - RNA, 37 nt, Artificial Sequence
  Synthetic Oligonucleotide; PRDM1 exon 5; Set C
gggugcguagccaggguaggagcccaaaccuuccgug

SEQ ID NO: 27726 - RNA, 38 nt, Artificial Sequence
  Synthetic Oligonucleotide; PRDM1 exon 5; Set C
ggggugcguagccaggguaggagcccaaaccuuccgug

SEQ ID NO: 27727 - RNA, 39 nt, Artificial Sequence
  Synthetic Oligonucleotide; PRDM1 exon 5; Set C
aggggugcguagccaggguaggagcccaaaccuuccgug

SEQ ID NO: 27728 - RNA, 16 nt, Artificial Sequence
  Synthetic Oligonucleotide; PRDM1 exon 5; Set C
guagccaggguaggag

SEQ ID NO: 27729 - RNA, 15 nt, Artificial Sequence
  Synthetic Oligonucleotide; PRDM1 exon 5; Set C
guagccaggguagga

SEQ ID NO: 27730 - RNA, 17 nt, Artificial Sequence
  Synthetic Oligonucleotide; PRDM1 exon 5; Set C
cguagccaggguaggag

SEQ ID NO: 27731 - RNA, 16 nt, Artificial Sequence
  Synthetic Oligonucleotide; PRDM1 exon 5; Set C
cguagccaggguagga

SEQ ID NO: 27732 - RNA, 18 nt, Artificial Sequence
  Synthetic Oligonucleotide; PRDM1 exon 5; Set A
gcguagccaggguaggag

SEQ ID NO: 27733 - RNA, 15 nt, Artificial Sequence
  Synthetic Oligonucleotide; PRDM1 exon 5; Set C
cguagccaggguagg

SEQ ID NO: 27734 - RNA, 17 nt, Artificial Sequence
  Synthetic Oligonucleotide; PRDM1 exon 5; Set A
gcguagccaggguagga

SEQ ID NO: 27735 - RNA, 19 nt, Artificial Sequence
  Synthetic Oligonucleotide; PRDM1 exon 5; Set A
ugcguagccaggguaggag

SEQ ID NO: 27736 - RNA, 16 nt, Artificial Sequence
  Synthetic Oligonucleotide; PRDM1 exon 5; Set A
gcguagccaggguagg

SEQ ID NO: 27737 - RNA, 18 nt, Artificial Sequence
  Synthetic Oligonucleotide; PRDM1 exon 5; Set A
ugcguagccaggguagga

SEQ ID NO: 27738 - RNA, 20 nt, Artificial Sequence
  Synthetic Oligonucleotide; PRDM1 exon 5; Set A
gugcguagccaggguaggag

SEQ ID NO: 27739 - RNA, 15 nt, Artificial Sequence
  Synthetic Oligonucleotide; PRDM1 exon 5; Set C
gcguagccaggguag

SEQ ID NO: 27740 - RNA, 17 nt, Artificial Sequence
  Synthetic Oligonucleotide; PRDM1 exon 5; Set A
ugcguagccaggguagg

SEQ ID NO: 27741 - RNA, 19 nt, Artificial Sequence
  Synthetic Oligonucleotide; PRDM1 exon 5; Set A
gugcguagccaggguagga

SEQ ID NO: 27742 - RNA, 21 nt, Artificial Sequence
  Synthetic Oligonucleotide; PRDM1 exon 5; Set A
ggugcguagccaggguaggag

SEQ ID NO: 27743 - RNA, 16 nt, Artificial Sequence
  Synthetic Oligonucleotide; PRDM1 exon 5; Set C
ugcguagccaggguag

SEQ ID NO: 27744 - RNA, 18 nt, Artificial Sequence
  Synthetic Oligonucleotide; PRDM1 exon 5; Set A
gugcguagccaggguagg

SEQ ID NO: 27745 - RNA, 20 nt, Artificial Sequence
  Synthetic Oligonucleotide; PRDM1 exon 5; Set C
ggugcguagccaggguagga

SEQ ID NO: 27746 - RNA, 17 nt, Artificial Sequence
  Synthetic Oligonucleotide; PRDM1 exon 5; Set A
gugcguagccaggguag

SEQ ID NO: 27747 - RNA, 15 nt, Artificial Sequence
  Synthetic Oligonucleotide; PRDM1 exon 5; Set C
ugcguagccagggua

SEQ ID NO: 27748 - RNA, 19 nt, Artificial Sequence
  Synthetic Oligonucleotide; PRDM1 exon 5; Set A
ggugcguagccaggguagg

SEQ ID NO: 27749 - RNA, 18 nt, Artificial Sequence
  Synthetic Oligonucleotide; PRDM1 exon 5; Set A
ggugcguagccaggguag

SEQ ID NO: 27750 - RNA, 16 nt, Artificial Sequence
  Synthetic Oligonucleotide; PRDM1 exon 5; Set A
gugcguagccagggua

SEQ ID NO: 27751 - RNA, 24 nt, Artificial Sequence
  Synthetic Oligonucleotide; PRDM1 exon 5; Set C
aggggugcguagccaggguaggag

SEQ ID NO: 27752 - RNA, 17 nt, Artificial Sequence
  Synthetic Oligonucleotide; PRDM1 exon 5; Set A
ggugcguagccagggua

SEQ ID NO: 27753 - RNA, 15 nt, Artificial Sequence
  Synthetic Oligonucleotide; PRDM1 exon 5; Set A
gugcguagccagggu

SEQ ID NO: 27754 - RNA, 25 nt, Artificial Sequence
  Synthetic Oligonucleotide; PRDM1 exon 5; Set C
caggggugcguagccaggguaggag

SEQ ID NO: 27755 - RNA, 18 nt, Artificial Sequence
  Synthetic Oligonucleotide; PRDM1 exon 5; Set A
gggugcguagccagggua

SEQ ID NO: 27756 - RNA, 16 nt, Artificial Sequence
  Synthetic Oligonucleotide; PRDM1 exon 5; Set A
ggugcguagccagggu

SEQ ID NO: 27757 - RNA, 24 nt, Artificial Sequence
  Synthetic Oligonucleotide; PRDM1 exon 5; Set C
caggggugcguagccaggguagga

SEQ ID NO: 27758 - RNA, 26 nt, Artificial Sequence
  Synthetic Oligonucleotide; PRDM1 exon 5; Set C
gcaggggugcguagccaggguaggag

SEQ ID NO: 27759 - RNA, 17 nt, Artificial Sequence
  Synthetic Oligonucleotide; PRDM1 exon 5; Set A
gggugcguagccagggu

SEQ ID NO: 27760 - RNA, 23 nt, Artificial Sequence
  Synthetic Oligonucleotide; PRDM1 exon 5; Set C
caggggugcguagccaggguagg

SEQ ID NO: 27761 - RNA, 25 nt, Artificial Sequence
  Synthetic Oligonucleotide; PRDM1 exon 5; Set C
gcaggggugcguagccaggguagga

SEQ ID NO: 27762 - RNA, 27 nt, Artificial Sequence
  Synthetic Oligonucleotide; PRDM1 exon 5; Set C
ggcaggggugcguagccaggguaggag

SEQ ID NO: 27763 - RNA, 15 nt, Artificial Sequence
  Synthetic Oligonucleotide; PRDM1 exon 5; Set A
ggugcguagccaggg

SEQ ID NO: 27764 - RNA, 22 nt, Artificial Sequence
  Synthetic Oligonucleotide; PRDM1 exon 5; Set C
caggggugcguagccaggguag

SEQ ID NO: 27765 - RNA, 20 nt, Artificial Sequence
  Synthetic Oligonucleotide; PRDM1 exon 5; Set C
aggggugcguagccagggua

SEQ ID NO: 27766 - RNA, 18 nt, Artificial Sequence
  Synthetic Oligonucleotide; PRDM1 exon 5; Set C
ggggugcguagccagggu

SEQ ID NO: 27767 - RNA, 24 nt, Artificial Sequence
  Synthetic Oligonucleotide; PRDM1 exon 5; Set C
gcaggggugcguagccaggguagg

SEQ ID NO: 27768 - RNA, 26 nt, Artificial Sequence
  Synthetic Oligonucleotide; PRDM1 exon 5; Set C
ggcaggggugcguagccaggguagga

SEQ ID NO: 27769 - RNA, 28 nt, Artificial Sequence
  Synthetic Oligonucleotide; PRDM1 exon 5; Set C
gggcaggggugcguagccaggguaggag

SEQ ID NO: 27770 - RNA, 16 nt, Artificial Sequence
  Synthetic Oligonucleotide; PRDM1 exon 5; Set A
gggugcguagccaggg

SEQ ID NO: 27771 - RNA, 23 nt, Artificial Sequence
  Synthetic Oligonucleotide; PRDM1 exon 5; Set C
gcaggggugcguagccaggguag

SEQ ID NO: 27772 - RNA, 21 nt, Artificial Sequence
  Synthetic Oligonucleotide; PRDM1 exon 5; Set C
caggggugcguagccagggua

SEQ ID NO: 27773 - RNA, 19 nt, Artificial Sequence
  Synthetic Oligonucleotide; PRDM1 exon 5; Set C
aggggugcguagccagggu

SEQ ID NO: 27774 - RNA, 25 nt, Artificial Sequence
  Synthetic Oligonucleotide; PRDM1 exon 5; Set C
ggcaggggugcguagccaggguagg

SEQ ID NO: 27775 - RNA, 27 nt, Artificial Sequence
  Synthetic Oligonucleotide; PRDM1 exon 5; Set C
gggcaggggugcguagccaggguagga

SEQ ID NO: 27776 - RNA, 15 nt, Artificial Sequence
  Synthetic Oligonucleotide; PRDM1 exon 5; Set A
gggugcguagccagg

SEQ ID NO: 27777 - RNA, 29 nt, Artificial Sequence
  Synthetic Oligonucleotide; PRDM1 exon 5; Set C
ggggcaggggugcguagccaggguaggag

SEQ ID NO: 27778 - RNA, 17 nt, Artificial Sequence
  Synthetic Oligonucleotide; PRDM1 exon 5; Set A
ggggugcguagccaggg

SEQ ID NO: 27779 - RNA, 24 nt, Artificial Sequence
  Synthetic Oligonucleotide; PRDM1 exon 5; Set C
ggcaggggugcguagccaggguag

SEQ ID NO: 27780 - RNA, 22 nt, Artificial Sequence
  Synthetic Oligonucleotide; PRDM1 exon 5; Set C
gcaggggugcguagccagggua

SEQ ID NO: 27781 - RNA, 26 nt, Artificial Sequence
  Synthetic Oligonucleotide; PRDM1 exon 5; Set C
gggcaggggugcguagccaggguagg

SEQ ID NO: 27782 - RNA, 20 nt, Artificial Sequence
  Synthetic Oligonucleotide; PRDM1 exon 5; Set C
caggggugcguagccagggu

SEQ ID NO: 27783 - RNA, 28 nt, Artificial Sequence
  Synthetic Oligonucleotide; PRDM1 exon 5; Set C
ggggcaggggugcguagccaggguagga

SEQ ID NO: 27784 - RNA, 16 nt, Artificial Sequence
  Synthetic Oligonucleotide; PRDM1 exon 5; Set A
ggggugcguagccagg

SEQ ID NO: 27785 - RNA, 30 nt, Artificial Sequence
  Synthetic Oligonucleotide; PRDM1 exon 5; Set C
uggggcaggggugcguagccaggguaggag

SEQ ID NO: 27786 - RNA, 18 nt, Artificial Sequence
  Synthetic Oligonucleotide; PRDM1 exon 5; Set A
aggggugcguagccaggg

SEQ ID NO: 27787 - RNA, 25 nt, Artificial Sequence
  Synthetic Oligonucleotide; PRDM1 exon 5; Set C
gggcaggggugcguagccaggguag

SEQ ID NO: 27788 - RNA, 23 nt, Artificial Sequence
  Synthetic Oligonucleotide; PRDM1 exon 5; Set C
ggcaggggugcguagccagggua

SEQ ID NO: 27789 - RNA, 27 nt, Artificial Sequence
  Synthetic Oligonucleotide; PRDM1 exon 5; Set C
ggggcaggggugcguagccaggguagg

SEQ ID NO: 27790 - RNA, 21 nt, Artificial Sequence
  Synthetic Oligonucleotide; PRDM1 exon 5; Set C
gcaggggugcguagccagggu

SEQ ID NO: 27791 - RNA, 17 nt, Artificial Sequence
  Synthetic Oligonucleotide; PRDM1 exon 5; Set A
aggggugcguagccagg

SEQ ID NO: 27792 - RNA, 19 nt, Artificial Sequence
  Synthetic Oligonucleotide; PRDM1 exon 5; Set C
caggggugcguagccaggg

SEQ ID NO: 27793 - RNA, 26 nt, Artificial Sequence
  Synthetic Oligonucleotide; PRDM1 exon 5; Set C
ggggcaggggugcguagccaggguag

SEQ ID NO: 27794 - RNA, 24 nt, Artificial Sequence
  Synthetic Oligonucleotide; PRDM1 exon 5; Set C
gggcaggggugcguagccagggua

SEQ ID NO: 27795 - RNA, 22 nt, Artificial Sequence
  Synthetic Oligonucleotide; PRDM1 exon 5; Set C
ggcaggggugcguagccagggu

SEQ ID NO: 27796 - RNA, 18 nt, Artificial Sequence
  Synthetic Oligonucleotide; PRDM1 exon 5; Set A
caggggugcguagccagg

SEQ ID NO: 27797 - RNA, 20 nt, Artificial Sequence
  Synthetic Oligonucleotide; PRDM1 exon 5; Set C
gcaggggugcguagccaggg

SEQ ID NO: 27798 - RNA, 25 nt, Artificial Sequence
  Synthetic Oligonucleotide; PRDM1 exon 5; Set C
ggggcaggggugcguagccagggua

SEQ ID NO: 27799 - RNA, 23 nt, Artificial Sequence
  Synthetic Oligonucleotide; PRDM1 exon 5; Set C
gggcaggggugcguagccagggu

SEQ ID NO: 27800 - RNA, 19 nt, Artificial Sequence
  Synthetic Oligonucleotide; PRDM1 exon 5; Set C
gcaggggugcguagccagg

SEQ ID NO: 27801 - RNA, 21 nt, Artificial Sequence
  Synthetic Oligonucleotide; PRDM1 exon 5; Set C
ggcaggggugcguagccaggg

SEQ ID NO: 27802 - RNA, 24 nt, Artificial Sequence
  Synthetic Oligonucleotide; PRDM1 exon 5; Set C
ggggcaggggugcguagccagggu

SEQ ID NO: 27803 - RNA, 20 nt, Artificial Sequence
  Synthetic Oligonucleotide; PRDM1 exon 5; Set C
ggcaggggugcguagccagg

SEQ ID NO: 27804 - RNA, 34 nt, Artificial Sequence
  Synthetic Oligonucleotide; PRDM1 exon 5; Set C
gagguggggcaggggugcguagccaggguaggag

SEQ ID NO: 27805 - RNA, 22 nt, Artificial Sequence
  Synthetic Oligonucleotide; PRDM1 exon 5; Set C
gggcaggggugcguagccaggg

SEQ ID NO: 27806 - RNA, 25 nt, Artificial Sequence
  Synthetic Oligonucleotide; PRDM1 exon 5; Set C
uggggcaggggugcguagccagggu

SEQ ID NO: 27807 - RNA, 33 nt, Artificial Sequence
  Synthetic Oligonucleotide; PRDM1 exon 5; Set C
gagguggggcaggggugcguagccaggguagga

SEQ ID NO: 27808 - RNA, 21 nt, Artificial Sequence
  Synthetic Oligonucleotide; PRDM1 exon 5; Set C
gggcaggggugcguagccagg

SEQ ID NO: 27809 - RNA, 35 nt, Artificial Sequence
  Synthetic Oligonucleotide; PRDM1 exon 5; Set C
ggagguggggcaggggugcguagccaggguaggag

SEQ ID NO: 27810 - RNA, 23 nt, Artificial Sequence
  Synthetic Oligonucleotide; PRDM1 exon 5; Set C
ggggcaggggugcguagccaggg

SEQ ID NO: 27811 - RNA, 32 nt, Artificial Sequence
  Synthetic Oligonucleotide; PRDM1 exon 5; Set C
gagguggggcaggggugcguagccaggguagg

SEQ ID NO: 27812 - RNA, 34 nt, Artificial Sequence
  Synthetic Oligonucleotide; PRDM1 exon 5; Set C
ggagguggggcaggggugcguagccaggguagga

SEQ ID NO: 27813 - RNA, 22 nt, Artificial Sequence
  Synthetic Oligonucleotide; PRDM1 exon 5; Set C
ggggcaggggugcguagccagg

SEQ ID NO: 27814 - RNA, 36 nt, Artificial Sequence
  Synthetic Oligonucleotide; PRDM1 exon 5; Set C
gggagguggggcaggggugcguagccaggguaggag

SEQ ID NO: 27815 - RNA, 24 nt, Artificial Sequence
  Synthetic Oligonucleotide; PRDM1 exon 5; Set C
uggggcaggggugcguagccaggg

SEQ ID NO: 27816 - RNA, 31 nt, Artificial Sequence
  Synthetic Oligonucleotide; PRDM1 exon 5; Set C
gagguggggcaggggugcguagccaggguag

SEQ ID NO: 27817 - RNA, 33 nt, Artificial Sequence
  Synthetic Oligonucleotide; PRDM1 exon 5; Set C
ggagguggggcaggggugcguagccaggguagg

SEQ ID NO: 27818 - RNA, 35 nt, Artificial Sequence
  Synthetic Oligonucleotide; PRDM1 exon 5; Set C
gggagguggggcaggggugcguagccaggguagga

SEQ ID NO: 27819 - RNA, 23 nt, Artificial Sequence
  Synthetic Oligonucleotide; PRDM1 exon 5; Set C
uggggcaggggugcguagccagg

SEQ ID NO: 27820 - RNA, 25 nt, Artificial Sequence
  Synthetic Oligonucleotide; PRDM1 exon 5; Set C
guggggcaggggugcguagccaggg

SEQ ID NO: 27821 - RNA, 32 nt, Artificial Sequence
  Synthetic Oligonucleotide; PRDM1 exon 5; Set C
ggagguggggcaggggugcguagccaggguag

SEQ ID NO: 27822 - RNA, 30 nt, Artificial Sequence
  Synthetic Oligonucleotide; PRDM1 exon 5; Set C
gagguggggcaggggugcguagccagggua

SEQ ID NO: 27823 - RNA, 34 nt, Artificial Sequence
  Synthetic Oligonucleotide; PRDM1 exon 5; Set C
gggagguggggcaggggugcguagccaggguagg

SEQ ID NO: 27824 - RNA, 24 nt, Artificial Sequence
  Synthetic Oligonucleotide; PRDM1 exon 5; Set C
guggggcaggggugcguagccagg

SEQ ID NO: 27825 - RNA, 26 nt, Artificial Sequence
  Synthetic Oligonucleotide; PRDM1 exon 5; Set C
gguggggcaggggugcguagccaggg

SEQ ID NO: 27826 - RNA, 33 nt, Artificial Sequence
  Synthetic Oligonucleotide; PRDM1 exon 5; Set C
gggagguggggcaggggugcguagccaggguag

SEQ ID NO: 27827 - RNA, 31 nt, Artificial Sequence
  Synthetic Oligonucleotide; PRDM1 exon 5; Set C
ggagguggggcaggggugcguagccagggua

SEQ ID NO: 27828 - RNA, 29 nt, Artificial Sequence
  Synthetic Oligonucleotide; PRDM1 exon 5; Set C
gagguggggcaggggugcguagccagggu

SEQ ID NO: 27829 - RNA, 25 nt, Artificial Sequence
  Synthetic Oligonucleotide; PRDM1 exon 5; Set C
gguggggcaggggugcguagccagg

SEQ ID NO: 27830 - RNA, 27 nt, Artificial Sequence
  Synthetic Oligonucleotide; PRDM1 exon 5; Set C
agguggggcaggggugcguagccaggg

SEQ ID NO: 27831 - RNA, 32 nt, Artificial Sequence
  Synthetic Oligonucleotide; PRDM1 exon 5; Set C
gggagguggggcaggggugcguagccagggua

SEQ ID NO: 27832 - RNA, 30 nt, Artificial Sequence
  Synthetic Oligonucleotide; PRDM1 exon 5; Set C
ggagguggggcaggggugcguagccagggu

SEQ ID NO: 27833 - RNA, 26 nt, Artificial Sequence
  Synthetic Oligonucleotide; PRDM1 exon 5; Set C
agguggggcaggggugcguagccagg

SEQ ID NO: 27834 - RNA, 28 nt, Artificial Sequence
  Synthetic Oligonucleotide; PRDM1 exon 5; Set C
gagguggggcaggggugcguagccaggg

SEQ ID NO: 27835 - RNA, 31 nt, Artificial Sequence
  Synthetic Oligonucleotide; PRDM1 exon 5; Set C
gggagguggggcaggggugcguagccagggu

SEQ ID NO: 27836 - RNA, 27 nt, Artificial Sequence
  Synthetic Oligonucleotide; PRDM1 exon 5; Set C
gagguggggcaggggugcguagccagg

SEQ ID NO: 27837 - RNA, 29 nt, Artificial Sequence
  Synthetic Oligonucleotide; PRDM1 exon 5; Set C
ggagguggggcaggggugcguagccaggg

SEQ ID NO: 27838 - RNA, 28 nt, Artificial Sequence
  Synthetic Oligonucleotide; PRDM1 exon 5; Set C
ggagguggggcaggggugcguagccagg

SEQ ID NO: 27839 - RNA, 30 nt, Artificial Sequence
  Synthetic Oligonucleotide; PRDM1 exon 5; Set C
gggagguggggcaggggugcguagccaggg

SEQ ID NO: 27840 - RNA, 29 nt, Artificial Sequence
  Synthetic Oligonucleotide; PRDM1 exon 5; Set C
gggagguggggcaggggugcguagccagg

SEQ ID NO: 27841 - RNA, 40 nt, Artificial Sequence
  Synthetic Oligonucleotide; PRDM1 exon 5; Set C
gcuggcgggagguggggcaggggugcguagccaggguagg

SEQ ID NO: 27842 - RNA, 39 nt, Artificial Sequence
  Synthetic Oligonucleotide; PRDM1 exon 5; Set C
gcuggcgggagguggggcaggggugcguagccaggguag

SEQ ID NO: 27843 - RNA, 40 nt, Artificial Sequence
  Synthetic Oligonucleotide; PRDM1 exon 5; Set C
agcuggcgggagguggggcaggggugcguagccaggguag

SEQ ID NO: 27844 - RNA, 38 nt, Artificial Sequence
  Synthetic Oligonucleotide; PRDM1 exon 5; Set C
gcuggcgggagguggggcaggggugcguagccagggua

SEQ ID NO: 27845 - RNA, 39 nt, Artificial Sequence
  Synthetic Oligonucleotide; PRDM1 exon 5; Set C
agcuggcgggagguggggcaggggugcguagccagggua

SEQ ID NO: 27846 - RNA, 37 nt, Artificial Sequence
  Synthetic Oligonucleotide; PRDM1 exon 5; Set C
gcuggcgggagguggggcaggggugcguagccagggu

SEQ ID NO: 27847 - RNA, 21 nt, Artificial Sequence
  Synthetic Oligonucleotide; PRDM1 exon 5; Set C
gagguggggcaggggugcgua

SEQ ID NO: 27848 - RNA, 40 nt, Artificial Sequence
  Synthetic Oligonucleotide; PRDM1 exon 5; Set C
aagcuggcgggagguggggcaggggugcguagccagggua

SEQ ID NO: 27849 - RNA, 38 nt, Artificial Sequence
  Synthetic Oligonucleotide; PRDM1 exon 5; Set C
agcuggcgggagguggggcaggggugcguagccagggu

SEQ ID NO: 27850 - RNA, 22 nt, Artificial Sequence
  Synthetic Oligonucleotide; PRDM1 exon 5; Set C
ggagguggggcaggggugcgua

SEQ ID NO: 27851 - RNA, 20 nt, Artificial Sequence
  Synthetic Oligonucleotide; PRDM1 exon 5; Set C
gagguggggcaggggugcgu

SEQ ID NO: 27852 - RNA, 36 nt, Artificial Sequence
  Synthetic Oligonucleotide; PRDM1 exon 5; Set C
gcuggcgggagguggggcaggggugcguagccaggg

SEQ ID NO: 27853 - RNA, 39 nt, Artificial Sequence
  Synthetic Oligonucleotide; PRDM1 exon 5; Set C
aagcuggcgggagguggggcaggggugcguagccagggu

SEQ ID NO: 27854 - RNA, 23 nt, Artificial Sequence
  Synthetic Oligonucleotide; PRDM1 exon 5; Set C
gggagguggggcaggggugcgua

SEQ ID NO: 27855 - RNA, 21 nt, Artificial Sequence
  Synthetic Oligonucleotide; PRDM1 exon 5; Set C
ggagguggggcaggggugcgu

SEQ ID NO: 27856 - RNA, 35 nt, Artificial Sequence
  Synthetic Oligonucleotide; PRDM1 exon 5; Set C
gcuggcgggagguggggcaggggugcguagccagg

SEQ ID NO: 27857 - RNA, 19 nt, Artificial Sequence
  Synthetic Oligonucleotide; PRDM1 exon 5; Set C
gagguggggcaggggugcg

SEQ ID NO: 27858 - RNA, 37 nt, Artificial Sequence
  Synthetic Oligonucleotide; PRDM1 exon 5; Set C
agcuggcgggagguggggcaggggugcguagccaggg

SEQ ID NO: 27859 - RNA, 40 nt, Artificial Sequence
  Synthetic Oligonucleotide; PRDM1 exon 5; Set C
aaagcuggcgggagguggggcaggggugcguagccagggu

SEQ ID NO: 27860 - RNA, 22 nt, Artificial Sequence
  Synthetic Oligonucleotide; PRDM1 exon 5; Set C
gggagguggggcaggggugcgu

SEQ ID NO: 27861 - RNA, 18 nt, Artificial Sequence
  Synthetic Oligonucleotide; PRDM1 exon 5; Set C
gagguggggcaggggugc

SEQ ID NO: 27862 - RNA, 36 nt, Artificial Sequence
  Synthetic Oligonucleotide; PRDM1 exon 5; Set C
agcuggcgggagguggggcaggggugcguagccagg

SEQ ID NO: 27863 - RNA, 20 nt, Artificial Sequence
  Synthetic Oligonucleotide; PRDM1 exon 5; Set C
ggagguggggcaggggugcg

SEQ ID NO: 27864 - RNA, 38 nt, Artificial Sequence
  Synthetic Oligonucleotide; PRDM1 exon 5; Set C
aagcuggcgggagguggggcaggggugcguagccaggg

SEQ ID NO: 27865 - RNA, 19 nt, Artificial Sequence
  Synthetic Oligonucleotide; PRDM1 exon 5; Set C
ggagguggggcaggggugc

SEQ ID NO: 27866 - RNA, 17 nt, Artificial Sequence
  Synthetic Oligonucleotide; PRDM1 exon 5; Set A
gagguggggcaggggug

SEQ ID NO: 27867 - RNA, 37 nt, Artificial Sequence
  Synthetic Oligonucleotide; PRDM1 exon 5; Set C
aagcuggcgggagguggggcaggggugcguagccagg

SEQ ID NO: 27868 - RNA, 21 nt, Artificial Sequence
  Synthetic Oligonucleotide; PRDM1 exon 5; Set C
gggagguggggcaggggugcg

SEQ ID NO: 27869 - RNA, 39 nt, Artificial Sequence
  Synthetic Oligonucleotide; PRDM1 exon 5; Set C
aaagcuggcgggagguggggcaggggugcguagccaggg

SEQ ID NO: 27870 - RNA, 20 nt, Artificial Sequence
  Synthetic Oligonucleotide; PRDM1 exon 5; Set C
gggagguggggcaggggugc

SEQ ID NO: 27871 - RNA, 18 nt, Artificial Sequence
  Synthetic Oligonucleotide; PRDM1 exon 5; Set C
ggagguggggcaggggug

SEQ ID NO: 27872 - RNA, 38 nt, Artificial Sequence
  Synthetic Oligonucleotide; PRDM1 exon 5; Set C
aaagcuggcgggagguggggcaggggugcguagccagg

SEQ ID NO: 27873 - RNA, 40 nt, Artificial Sequence
  Synthetic Oligonucleotide; PRDM1 exon 5; Set C
gaaagcuggcgggagguggggcaggggugcguagccaggg

SEQ ID NO: 27874 - RNA, 16 nt, Artificial Sequence
  Synthetic Oligonucleotide; PRDM1 exon 5; Set A
gagguggggcaggggu

SEQ ID NO: 27875 - RNA, 19 nt, Artificial Sequence
  Synthetic Oligonucleotide; PRDM1 exon 5; Set C
gggagguggggcaggggug

SEQ ID NO: 27876 - RNA, 15 nt, Artificial Sequence
  Synthetic Oligonucleotide; PRDM1 exon 5; Set A
gagguggggcagggg

SEQ ID NO: 27877 - RNA, 39 nt, Artificial Sequence
  Synthetic Oligonucleotide; PRDM1 exon 5; Set C
gaaagcuggcgggagguggggcaggggugcguagccagg

SEQ ID NO: 27878 - RNA, 17 nt, Artificial Sequence
  Synthetic Oligonucleotide; PRDM1 exon 5; Set C
ggagguggggcaggggu

SEQ ID NO: 27879 - RNA, 16 nt, Artificial Sequence
  Synthetic Oligonucleotide; PRDM1 exon 5; Set A
ggagguggggcagggg

SEQ ID NO: 27880 - RNA, 40 nt, Artificial Sequence
  Synthetic Oligonucleotide; PRDM1 exon 5; Set C
ugaaagcuggcgggagguggggcaggggugcguagccagg

SEQ ID NO: 27881 - RNA, 18 nt, Artificial Sequence
  Synthetic Oligonucleotide; PRDM1 exon 5; Set C
gggagguggggcaggggu

SEQ ID NO: 27882 - RNA, 29 nt, Artificial Sequence
  Synthetic Oligonucleotide; PRDM1 exon 5; Set C
gcuggcgggagguggggcaggggugcgua

SEQ ID NO: 27883 - RNA, 17 nt, Artificial Sequence
  Synthetic Oligonucleotide; PRDM1 exon 5; Set C
gggagguggggcagggg

SEQ ID NO: 27884 - RNA, 15 nt, Artificial Sequence
  Synthetic Oligonucleotide; PRDM1 exon 5; Set A
ggagguggggcaggg

SEQ ID NO: 27885 - RNA, 30 nt, Artificial Sequence
  Synthetic Oligonucleotide; PRDM1 exon 5; Set C
agcuggcgggagguggggcaggggugcgua

SEQ ID NO: 27886 - RNA, 28 nt, Artificial Sequence
  Synthetic Oligonucleotide; PRDM1 exon 5; Set C
gcuggcgggagguggggcaggggugcgu

SEQ ID NO: 27887 - RNA, 16 nt, Artificial Sequence
  Synthetic Oligonucleotide; PRDM1 exon 5; Set A
gggagguggggcaggg

SEQ ID NO: 27888 - RNA, 29 nt, Artificial Sequence
  Synthetic Oligonucleotide; PRDM1 exon 5; Set C
agcuggcgggagguggggcaggggugcgu

SEQ ID NO: 27889 - RNA, 27 nt, Artificial Sequence
  Synthetic Oligonucleotide; PRDM1 exon 5; Set C
gcuggcgggagguggggcaggggugcg

SEQ ID NO: 27890 - RNA, 15 nt, Artificial Sequence
  Synthetic Oligonucleotide; PRDM1 exon 5; Set A
gggagguggggcagg

SEQ ID NO: 27891 - RNA, 26 nt, Artificial Sequence
  Synthetic Oligonucleotide; PRDM1 exon 5; Set C
gcuggcgggagguggggcaggggugc

SEQ ID NO: 27892 - RNA, 28 nt, Artificial Sequence
  Synthetic Oligonucleotide; PRDM1 exon 5; Set C
agcuggcgggagguggggcaggggugcg

SEQ ID NO: 27893 - RNA, 27 nt, Artificial Sequence
  Synthetic Oligonucleotide; PRDM1 exon 5; Set C
agcuggcgggagguggggcaggggugc

SEQ ID NO: 27894 - RNA, 25 nt, Artificial Sequence
  Synthetic Oligonucleotide; PRDM1 exon 5; Set C
gcuggcgggagguggggcaggggug

SEQ ID NO: 27895 - RNA, 26 nt, Artificial Sequence
  Synthetic Oligonucleotide; PRDM1 exon 5; Set C
agcuggcgggagguggggcaggggug

SEQ ID NO: 27896 - RNA, 24 nt, Artificial Sequence
  Synthetic Oligonucleotide; PRDM1 exon 5; Set C
gcuggcgggagguggggcaggggu

SEQ ID NO: 27897 - RNA, 23 nt, Artificial Sequence
  Synthetic Oligonucleotide; PRDM1 exon 5; Set C
gcuggcgggagguggggcagggg

SEQ ID NO: 27898 - RNA, 25 nt, Artificial Sequence
  Synthetic Oligonucleotide; PRDM1 exon 5; Set C
agcuggcgggagguggggcaggggu

SEQ ID NO: 27899 - RNA, 24 nt, Artificial Sequence
  Synthetic Oligonucleotide; PRDM1 exon 5; Set C
agcuggcgggagguggggcagggg

SEQ ID NO: 27900 - RNA, 22 nt, Artificial Sequence
  Synthetic Oligonucleotide; PRDM1 exon 5; Set C
gcuggcgggagguggggcaggg

SEQ ID NO: 27901 - RNA, 26 nt, Artificial Sequence
  Synthetic Oligonucleotide; PRDM1 exon 5; Set C
aagcuggcgggagguggggcaggggu

SEQ ID NO: 27902 - RNA, 25 nt, Artificial Sequence
  Synthetic Oligonucleotide; PRDM1 exon 5; Set C
aagcuggcgggagguggggcagggg

SEQ ID NO: 27903 - RNA, 23 nt, Artificial Sequence
  Synthetic Oligonucleotide; PRDM1 exon 5; Set C
agcuggcgggagguggggcaggg

SEQ ID NO: 27904 - RNA, 27 nt, Artificial Sequence
  Synthetic Oligonucleotide; PRDM1 exon 5; Set C
aaagcuggcgggagguggggcaggggu

SEQ ID NO: 27905 - RNA, 21 nt, Artificial Sequence
  Synthetic Oligonucleotide; PRDM1 exon 5; Set C
gcuggcgggagguggggcagg

SEQ ID NO: 27906 - RNA, 26 nt, Artificial Sequence
  Synthetic Oligonucleotide; PRDM1 exon 5; Set C
aaagcuggcgggagguggggcagggg

SEQ ID NO: 27907 - RNA, 24 nt, Artificial Sequence
  Synthetic Oligonucleotide; PRDM1 exon 5; Set C
aagcuggcgggagguggggcaggg

SEQ ID NO: 27908 - RNA, 28 nt, Artificial Sequence
  Synthetic Oligonucleotide; PRDM1 exon 5; Set C
gaaagcuggcgggagguggggcaggggu

SEQ ID NO: 27909 - RNA, 22 nt, Artificial Sequence
  Synthetic Oligonucleotide; PRDM1 exon 5; Set C
agcuggcgggagguggggcagg

SEQ ID NO: 27910 - RNA, 39 nt, Artificial Sequence
  Synthetic Oligonucleotide; PRDM1 exon 5; Set C
ggggaugaaagcuggcgggagguggggcaggggugcgua

SEQ ID NO: 27911 - RNA, 27 nt, Artificial Sequence
  Synthetic Oligonucleotide; PRDM1 exon 5; Set C
gaaagcuggcgggagguggggcagggg

SEQ ID NO: 27912 - RNA, 25 nt, Artificial Sequence
  Synthetic Oligonucleotide; PRDM1 exon 5; Set C
aaagcuggcgggagguggggcaggg

SEQ ID NO: 27913 - RNA, 29 nt, Artificial Sequence
  Synthetic Oligonucleotide; PRDM1 exon 5; Set C
ugaaagcuggcgggagguggggcaggggu

SEQ ID NO: 27914 - RNA, 23 nt, Artificial Sequence
  Synthetic Oligonucleotide; PRDM1 exon 5; Set C
aagcuggcgggagguggggcagg

SEQ ID NO: 27915 - RNA, 40 nt, Artificial Sequence
  Synthetic Oligonucleotide; PRDM1 exon 5; Set C
aggggaugaaagcuggcgggagguggggcaggggugcgua

SEQ ID NO: 27916 - RNA, 38 nt, Artificial Sequence
  Synthetic Oligonucleotide; PRDM1 exon 5; Set C
ggggaugaaagcuggcgggagguggggcaggggugcgu

SEQ ID NO: 27917 - RNA, 26 nt, Artificial Sequence
  Synthetic Oligonucleotide; PRDM1 exon 5; Set C
gaaagcuggcgggagguggggcaggg

SEQ ID NO: 27918 - RNA, 24 nt, Artificial Sequence
  Synthetic Oligonucleotide; PRDM1 exon 5; Set C
aaagcuggcgggagguggggcagg

SEQ ID NO: 27919 - RNA, 22 nt, Artificial Sequence
  Synthetic Oligonucleotide; PRDM1 exon 5; Set C
aagcuggcgggagguggggcag

SEQ ID NO: 27920 - RNA, 39 nt, Artificial Sequence
  Synthetic Oligonucleotide; PRDM1 exon 5; Set C
aggggaugaaagcuggcgggagguggggcaggggugcgu

SEQ ID NO: 27921 - RNA, 27 nt, Artificial Sequence
  Synthetic Oligonucleotide; PRDM1 exon 5; Set C
ugaaagcuggcgggagguggggcaggg

SEQ ID NO: 27922 - RNA, 37 nt, Artificial Sequence
  Synthetic Oligonucleotide; PRDM1 exon 5; Set C
ggggaugaaagcuggcgggagguggggcaggggugcg

SEQ ID NO: 27923 - RNA, 25 nt, Artificial Sequence
  Synthetic Oligonucleotide; PRDM1 exon 5; Set C
gaaagcuggcgggagguggggcagg

SEQ ID NO: 27924 - RNA, 23 nt, Artificial Sequence
  Synthetic Oligonucleotide; PRDM1 exon 5; Set C
aaagcuggcgggagguggggcag

SEQ ID NO: 27925 - RNA, 21 nt, Artificial Sequence
  Synthetic Oligonucleotide; PRDM1 exon 5; Set C
aagcuggcgggagguggggca

SEQ ID NO: 27926 - RNA, 40 nt, Artificial Sequence
  Synthetic Oligonucleotide; PRDM1 exon 5; Set C
gaggggaugaaagcuggcgggagguggggcaggggugcgu

SEQ ID NO: 27927 - RNA, 36 nt, Artificial Sequence
  Synthetic Oligonucleotide; PRDM1 exon 5; Set C
ggggaugaaagcuggcgggagguggggcaggggugc

SEQ ID NO: 27928 - RNA, 38 nt, Artificial Sequence
  Synthetic Oligonucleotide; PRDM1 exon 5; Set C
aggggaugaaagcuggcgggagguggggcaggggugcg

SEQ ID NO: 27929 - RNA, 26 nt, Artificial Sequence
  Synthetic Oligonucleotide; PRDM1 exon 5; Set C
ugaaagcuggcgggagguggggcagg

SEQ ID NO: 27930 - RNA, 24 nt, Artificial Sequence
  Synthetic Oligonucleotide; PRDM1 exon 5; Set C
gaaagcuggcgggagguggggcag

SEQ ID NO: 27931 - RNA, 22 nt, Artificial Sequence
  Synthetic Oligonucleotide; PRDM1 exon 5; Set C
aaagcuggcgggagguggggca

SEQ ID NO: 27932 - RNA, 20 nt, Artificial Sequence
  Synthetic Oligonucleotide; PRDM1 exon 5; Set C
aagcuggcgggagguggggc

SEQ ID NO: 27933 - RNA, 37 nt, Artificial Sequence
  Synthetic Oligonucleotide; PRDM1 exon 5; Set C
aggggaugaaagcuggcgggagguggggcaggggugc

SEQ ID NO: 27934 - RNA, 35 nt, Artificial Sequence
  Synthetic Oligonucleotide; PRDM1 exon 5; Set C
ggggaugaaagcuggcgggagguggggcaggggug

SEQ ID NO: 27935 - RNA, 39 nt, Artificial Sequence
  Synthetic Oligonucleotide; PRDM1 exon 5; Set C
gaggggaugaaagcuggcgggagguggggcaggggugcg

SEQ ID NO: 27936 - RNA, 15 nt, Artificial Sequence
  Synthetic Oligonucleotide; PRDM1 exon 5; Set A
gcuggcgggaggugg

SEQ ID NO: 27937 - RNA, 17 nt, Artificial Sequence
  Synthetic Oligonucleotide; PRDM1 exon 5; Set A
agcuggcgggagguggg

SEQ ID NO: 27938 - RNA, 19 nt, Artificial Sequence
  Synthetic Oligonucleotide; PRDM1 exon 5; Set A
aagcuggcgggaggugggg

SEQ ID NO: 27939 - RNA, 25 nt, Artificial Sequence
  Synthetic Oligonucleotide; PRDM1 exon 5; Set C
ugaaagcuggcgggagguggggcag

SEQ ID NO: 27940 - RNA, 23 nt, Artificial Sequence
  Synthetic Oligonucleotide; PRDM1 exon 5; Set C
gaaagcuggcgggagguggggca

SEQ ID NO: 27941 - RNA, 21 nt, Artificial Sequence
  Synthetic Oligonucleotide; PRDM1 exon 5; Set C
aaagcuggcgggagguggggc

SEQ ID NO: 27942 - RNA, 38 nt, Artificial Sequence
  Synthetic Oligonucleotide; PRDM1 exon 5; Set C
gaggggaugaaagcuggcgggagguggggcaggggugc

SEQ ID NO: 27943 - RNA, 36 nt, Artificial Sequence
  Synthetic Oligonucleotide; PRDM1 exon 5; Set C
aggggaugaaagcuggcgggagguggggcaggggug

SEQ ID NO: 27944 - RNA, 34 nt, Artificial Sequence
  Synthetic Oligonucleotide; PRDM1 exon 5; Set C
ggggaugaaagcuggcgggagguggggcaggggu

SEQ ID NO: 27945 - RNA, 16 nt, Artificial Sequence
  Synthetic Oligonucleotide; PRDM1 exon 5; Set A
agcuggcgggaggugg

SEQ ID NO: 27946 - RNA, 18 nt, Artificial Sequence
  Synthetic Oligonucleotide; PRDM1 exon 5; Set A
aagcuggcgggagguggg

SEQ ID NO: 27947 - RNA, 20 nt, Artificial Sequence
  Synthetic Oligonucleotide; PRDM1 exon 5; Set A
aaagcuggcgggaggugggg

SEQ ID NO: 27948 - RNA, 26 nt, Artificial Sequence
  Synthetic Oligonucleotide; PRDM1 exon 5; Set C
augaaagcuggcgggagguggggcag

SEQ ID NO: 27949 - RNA, 24 nt, Artificial Sequence
  Synthetic Oligonucleotide; PRDM1 exon 5; Set C
ugaaagcuggcgggagguggggca

SEQ ID NO: 27950 - RNA, 22 nt, Artificial Sequence
  Synthetic Oligonucleotide; PRDM1 exon 5; Set C
gaaagcuggcgggagguggggc

SEQ ID NO: 27951 - RNA, 37 nt, Artificial Sequence
  Synthetic Oligonucleotide; PRDM1 exon 5; Set C
gaggggaugaaagcuggcgggagguggggcaggggug

SEQ ID NO: 27952 - RNA, 33 nt, Artificial Sequence
  Synthetic Oligonucleotide; PRDM1 exon 5; Set C
ggggaugaaagcuggcgggagguggggcagggg

SEQ ID NO: 27953 - RNA, 35 nt, Artificial Sequence
  Synthetic Oligonucleotide; PRDM1 exon 5; Set C
aggggaugaaagcuggcgggagguggggcaggggu

SEQ ID NO: 27954 - RNA, 17 nt, Artificial Sequence
  Synthetic Oligonucleotide; PRDM1 exon 5; Set A
aagcuggcgggaggugg

SEQ ID NO: 27955 - RNA, 15 nt, Artificial Sequence
  Synthetic Oligonucleotide; PRDM1 exon 5; Set A
agcuggcgggaggug

SEQ ID NO: 27956 - RNA, 19 nt, Artificial Sequence
  Synthetic Oligonucleotide; PRDM1 exon 5; Set A
aaagcuggcgggagguggg

SEQ ID NO: 27957 - RNA, 21 nt, Artificial Sequence
  Synthetic Oligonucleotide; PRDM1 exon 5; Set C
gaaagcuggcgggaggugggg

SEQ ID NO: 27958 - RNA, 27 nt, Artificial Sequence
  Synthetic Oligonucleotide; PRDM1 exon 5; Set C
gaugaaagcuggcgggagguggggcag

SEQ ID NO: 27959 - RNA, 25 nt, Artificial Sequence
  Synthetic Oligonucleotide; PRDM1 exon 5; Set C
augaaagcuggcgggagguggggca

SEQ ID NO: 27960 - RNA, 23 nt, Artificial Sequence
  Synthetic Oligonucleotide; PRDM1 exon 5; Set C
ugaaagcuggcgggagguggggc

SEQ ID NO: 27961 - RNA, 40 nt, Artificial Sequence
  Synthetic Oligonucleotide; PRDM1 exon 5; Set C
acgaggggaugaaagcuggcgggagguggggcaggggugc

SEQ ID NO: 27962 - RNA, 34 nt, Artificial Sequence
  Synthetic Oligonucleotide; PRDM1 exon 5; Set C
aggggaugaaagcuggcgggagguggggcagggg

SEQ ID NO: 27963 - RNA, 32 nt, Artificial Sequence
  Synthetic Oligonucleotide; PRDM1 exon 5; Set C
ggggaugaaagcuggcgggagguggggcaggg

SEQ ID NO: 27964 - RNA, 36 nt, Artificial Sequence
  Synthetic Oligonucleotide; PRDM1 exon 5; Set C
gaggggaugaaagcuggcgggagguggggcaggggu

SEQ ID NO: 27965 - RNA, 16 nt, Artificial Sequence
  Synthetic Oligonucleotide; PRDM1 exon 5; Set C
aagcuggcgggaggug

SEQ ID NO: 27966 - RNA, 18 nt, Artificial Sequence
  Synthetic Oligonucleotide; PRDM1 exon 5; Set A
aaagcuggcgggaggugg

SEQ ID NO: 27967 - RNA, 20 nt, Artificial Sequence
  Synthetic Oligonucleotide; PRDM1 exon 5; Set A
gaaagcuggcgggagguggg

SEQ ID NO: 27968 - RNA, 22 nt, Artificial Sequence
  Synthetic Oligonucleotide; PRDM1 exon 5; Set C
ugaaagcuggcgggaggugggg

SEQ ID NO: 27969 - RNA, 28 nt, Artificial Sequence
  Synthetic Oligonucleotide; PRDM1 exon 5; Set C
ggaugaaagcuggcgggagguggggcag

SEQ ID NO: 27970 - RNA, 26 nt, Artificial Sequence
  Synthetic Oligonucleotide; PRDM1 exon 5; Set C
gaugaaagcuggcgggagguggggca

SEQ ID NO: 27971 - RNA, 24 nt, Artificial Sequence
  Synthetic Oligonucleotide; PRDM1 exon 5; Set C
augaaagcuggcgggagguggggc

SEQ ID NO: 27972 - RNA, 39 nt, Artificial Sequence
  Synthetic Oligonucleotide; PRDM1 exon 5; Set C
acgaggggaugaaagcuggcgggagguggggcaggggug

SEQ ID NO: 27973 - RNA, 35 nt, Artificial Sequence
  Synthetic Oligonucleotide; PRDM1 exon 5; Set C
gaggggaugaaagcuggcgggagguggggcagggg

SEQ ID NO: 27974 - RNA, 33 nt, Artificial Sequence
  Synthetic Oligonucleotide; PRDM1 exon 5; Set C
aggggaugaaagcuggcgggagguggggcaggg

SEQ ID NO: 27975 - RNA, 31 nt, Artificial Sequence
  Synthetic Oligonucleotide; PRDM1 exon 5; Set C
ggggaugaaagcuggcgggagguggggcagg

SEQ ID NO: 27976 - RNA, 15 nt, Artificial Sequence
  Synthetic Oligonucleotide; PRDM1 exon 5; Set C
aagcuggcgggaggu

SEQ ID NO: 27977 - RNA, 19 nt, Artificial Sequence
  Synthetic Oligonucleotide; PRDM1 exon 5; Set A
gaaagcuggcgggaggugg

SEQ ID NO: 27978 - RNA, 17 nt, Artificial Sequence
  Synthetic Oligonucleotide; PRDM1 exon 5; Set C
aaagcuggcgggaggug

SEQ ID NO: 27979 - RNA, 21 nt, Artificial Sequence
  Synthetic Oligonucleotide; PRDM1 exon 5; Set A
ugaaagcuggcgggagguggg

SEQ ID NO: 27980 - RNA, 23 nt, Artificial Sequence
  Synthetic Oligonucleotide; PRDM1 exon 5; Set C
augaaagcuggcgggaggugggg

SEQ ID NO: 27981 - RNA, 29 nt, Artificial Sequence
  Synthetic Oligonucleotide; PRDM1 exon 5; Set C
gggaugaaagcuggcgggagguggggcag

SEQ ID NO: 27982 - RNA, 27 nt, Artificial Sequence
  Synthetic Oligonucleotide; PRDM1 exon 5; Set C
ggaugaaagcuggcgggagguggggca

SEQ ID NO: 27983 - RNA, 25 nt, Artificial Sequence
  Synthetic Oligonucleotide; PRDM1 exon 5; Set C
gaugaaagcuggcgggagguggggc

SEQ ID NO: 27984 - RNA, 40 nt, Artificial Sequence
  Synthetic Oligonucleotide; PRDM1 exon 5; Set C
uacgaggggaugaaagcuggcgggagguggggcaggggug

SEQ ID NO: 27985 - RNA, 34 nt, Artificial Sequence
  Synthetic Oligonucleotide; PRDM1 exon 5; Set C
gaggggaugaaagcuggcgggagguggggcaggg

SEQ ID NO: 27986 - RNA, 38 nt, Artificial Sequence
  Synthetic Oligonucleotide; PRDM1 exon 5; Set C
acgaggggaugaaagcuggcgggagguggggcaggggu

SEQ ID NO: 27987 - RNA, 32 nt, Artificial Sequence
  Synthetic Oligonucleotide; PRDM1 exon 5; Set C
aggggaugaaagcuggcgggagguggggcagg

SEQ ID NO: 27988 - RNA, 16 nt, Artificial Sequence
  Synthetic Oligonucleotide; PRDM1 exon 5; Set C
aaagcuggcgggaggu

SEQ ID NO: 27989 - RNA, 20 nt, Artificial Sequence
  Synthetic Oligonucleotide; PRDM1 exon 5; Set A
ugaaagcuggcgggaggugg

SEQ ID NO: 27990 - RNA, 18 nt, Artificial Sequence
  Synthetic Oligonucleotide; PRDM1 exon 5; Set A
gaaagcuggcgggaggug

SEQ ID NO: 27991 - RNA, 22 nt, Artificial Sequence
  Synthetic Oligonucleotide; PRDM1 exon 5; Set A
augaaagcuggcgggagguggg

SEQ ID NO: 27992 - RNA, 24 nt, Artificial Sequence
  Synthetic Oligonucleotide; PRDM1 exon 5; Set C
gaugaaagcuggcgggaggugggg

SEQ ID NO: 27993 - RNA, 28 nt, Artificial Sequence
  Synthetic Oligonucleotide; PRDM1 exon 5; Set C
gggaugaaagcuggcgggagguggggca

SEQ ID NO: 27994 - RNA, 26 nt, Artificial Sequence
  Synthetic Oligonucleotide; PRDM1 exon 5; Set C
ggaugaaagcuggcgggagguggggc

SEQ ID NO: 27995 - RNA, 37 nt, Artificial Sequence
  Synthetic Oligonucleotide; PRDM1 exon 5; Set C
acgaggggaugaaagcuggcgggagguggggcagggg

SEQ ID NO: 27996 - RNA, 39 nt, Artificial Sequence
  Synthetic Oligonucleotide; PRDM1 exon 5; Set C
uacgaggggaugaaagcuggcgggagguggggcaggggu

SEQ ID NO: 27997 - RNA, 33 nt, Artificial Sequence
  Synthetic Oligonucleotide; PRDM1 exon 5; Set C
gaggggaugaaagcuggcgggagguggggcagg

SEQ ID NO: 27998 - RNA, 15 nt, Artificial Sequence
  Synthetic Oligonucleotide; PRDM1 exon 5; Set C
aaagcuggcgggagg

SEQ ID NO: 27999 - RNA, 17 nt, Artificial Sequence
  Synthetic Oligonucleotide; PRDM1 exon 5; Set A
gaaagcuggcgggaggu

SEQ ID NO: 28000 - RNA, 21 nt, Artificial Sequence
  Synthetic Oligonucleotide; PRDM1 exon 5; Set A
augaaagcuggcgggaggugg

SEQ ID NO: 28001 - RNA, 19 nt, Artificial Sequence
  Synthetic Oligonucleotide; PRDM1 exon 5; Set A
ugaaagcuggcgggaggug

SEQ ID NO: 28002 - RNA, 23 nt, Artificial Sequence
  Synthetic Oligonucleotide; PRDM1 exon 5; Set A
gaugaaagcuggcgggagguggg

SEQ ID NO: 28003 - RNA, 25 nt, Artificial Sequence
  Synthetic Oligonucleotide; PRDM1 exon 5; Set C
ggaugaaagcuggcgggaggugggg

SEQ ID NO: 28004 - RNA, 27 nt, Artificial Sequence
  Synthetic Oligonucleotide; PRDM1 exon 5; Set C
gggaugaaagcuggcgggagguggggc

SEQ ID NO: 28005 - RNA, 38 nt, Artificial Sequence
  Synthetic Oligonucleotide; PRDM1 exon 5; Set C
uacgaggggaugaaagcuggcgggagguggggcagggg

SEQ ID NO: 28006 - RNA, 36 nt, Artificial Sequence
  Synthetic Oligonucleotide; PRDM1 exon 5; Set C
acgaggggaugaaagcuggcgggagguggggcaggg

SEQ ID NO: 28007 - RNA, 40 nt, Artificial Sequence
  Synthetic Oligonucleotide; PRDM1 exon 5; Set C
guacgaggggaugaaagcuggcgggagguggggcaggggu

SEQ ID NO: 28008 - RNA, 16 nt, Artificial Sequence
  Synthetic Oligonucleotide; PRDM1 exon 5; Set C
gaaagcuggcgggagg

SEQ ID NO: 28009 - RNA, 18 nt, Artificial Sequence
  Synthetic Oligonucleotide; PRDM1 exon 5; Set A
ugaaagcuggcgggaggu

SEQ ID NO: 28010 - RNA, 22 nt, Artificial Sequence
  Synthetic Oligonucleotide; PRDM1 exon 5; Set A
gaugaaagcuggcgggaggugg

SEQ ID NO: 28011 - RNA, 20 nt, Artificial Sequence
  Synthetic Oligonucleotide; PRDM1 exon 5; Set A
augaaagcuggcgggaggug

SEQ ID NO: 28012 - RNA, 24 nt, Artificial Sequence
  Synthetic Oligonucleotide; PRDM1 exon 5; Set C
ggaugaaagcuggcgggagguggg

SEQ ID NO: 28013 - RNA, 26 nt, Artificial Sequence
  Synthetic Oligonucleotide; PRDM1 exon 5; Set C
gggaugaaagcuggcgggaggugggg

SEQ ID NO: 28014 - RNA, 39 nt, Artificial Sequence
  Synthetic Oligonucleotide; PRDM1 exon 5; Set C
guacgaggggaugaaagcuggcgggagguggggcagggg

SEQ ID NO: 28015 - RNA, 37 nt, Artificial Sequence
  Synthetic Oligonucleotide; PRDM1 exon 5; Set C
uacgaggggaugaaagcuggcgggagguggggcaggg

SEQ ID NO: 28016 - RNA, 35 nt, Artificial Sequence
  Synthetic Oligonucleotide; PRDM1 exon 5; Set C
acgaggggaugaaagcuggcgggagguggggcagg

SEQ ID NO: 28017 - RNA, 17 nt, Artificial Sequence
  Synthetic Oligonucleotide; PRDM1 exon 5; Set C
ugaaagcuggcgggagg

SEQ ID NO: 28018 - RNA, 19 nt, Artificial Sequence
  Synthetic Oligonucleotide; PRDM1 exon 5; Set A
augaaagcuggcgggaggu

SEQ ID NO: 28019 - RNA, 23 nt, Artificial Sequence
  Synthetic Oligonucleotide; PRDM1 exon 5; Set A
ggaugaaagcuggcgggaggugg

SEQ ID NO: 28020 - RNA, 21 nt, Artificial Sequence
  Synthetic Oligonucleotide; PRDM1 exon 5; Set A
gaugaaagcuggcgggaggug

SEQ ID NO: 28021 - RNA, 25 nt, Artificial Sequence
  Synthetic Oligonucleotide; PRDM1 exon 5; Set C
gggaugaaagcuggcgggagguggg

SEQ ID NO: 28022 - RNA, 33 nt, Artificial Sequence
  Synthetic Oligonucleotide; PRDM1 exon 5; Set C
cgaggggaugaaagcuggcgggagguggggcag

SEQ ID NO: 28023 - RNA, 40 nt, Artificial Sequence
  Synthetic Oligonucleotide; PRDM1 exon 5; Set C
uguacgaggggaugaaagcuggcgggagguggggcagggg

SEQ ID NO: 28024 - RNA, 38 nt, Artificial Sequence
  Synthetic Oligonucleotide; PRDM1 exon 5; Set C
guacgaggggaugaaagcuggcgggagguggggcaggg

SEQ ID NO: 28025 - RNA, 36 nt, Artificial Sequence
  Synthetic Oligonucleotide; PRDM1 exon 5; Set C
uacgaggggaugaaagcuggcgggagguggggcagg

SEQ ID NO: 28026 - RNA, 18 nt, Artificial Sequence
  Synthetic Oligonucleotide; PRDM1 exon 5; Set C
augaaagcuggcgggagg

SEQ ID NO: 28027 - RNA, 20 nt, Artificial Sequence
  Synthetic Oligonucleotide; PRDM1 exon 5; Set A
gaugaaagcuggcgggaggu

SEQ ID NO: 28028 - RNA, 24 nt, Artificial Sequence
  Synthetic Oligonucleotide; PRDM1 exon 5; Set C
gggaugaaagcuggcgggaggugg

SEQ ID NO: 28029 - RNA, 22 nt, Artificial Sequence
  Synthetic Oligonucleotide; PRDM1 exon 5; Set A
ggaugaaagcuggcgggaggug

SEQ ID NO: 28030 - RNA, 32 nt, Artificial Sequence
  Synthetic Oligonucleotide; PRDM1 exon 5; Set C
cgaggggaugaaagcuggcgggagguggggca

SEQ ID NO: 28031 - RNA, 39 nt, Artificial Sequence
  Synthetic Oligonucleotide; PRDM1 exon 5; Set C
uguacgaggggaugaaagcuggcgggagguggggcaggg

SEQ ID NO: 28032 - RNA, 37 nt, Artificial Sequence
  Synthetic Oligonucleotide; PRDM1 exon 5; Set C
guacgaggggaugaaagcuggcgggagguggggcagg

SEQ ID NO: 28033 - RNA, 19 nt, Artificial Sequence
  Synthetic Oligonucleotide; PRDM1 exon 5; Set A
gaugaaagcuggcgggagg

SEQ ID NO: 28034 - RNA, 21 nt, Artificial Sequence
  Synthetic Oligonucleotide; PRDM1 exon 5; Set A
ggaugaaagcuggcgggaggu

SEQ ID NO: 28035 - RNA, 23 nt, Artificial Sequence
  Synthetic Oligonucleotide; PRDM1 exon 5; Set A
gggaugaaagcuggcgggaggug

SEQ ID NO: 28036 - RNA, 25 nt, Artificial Sequence
  Synthetic Oligonucleotide; PRDM1 exon 5; Set C
ggggaugaaagcuggcgggaggugg

SEQ ID NO: 28037 - RNA, 31 nt, Artificial Sequence
  Synthetic Oligonucleotide; PRDM1 exon 5; Set C
cgaggggaugaaagcuggcgggagguggggc

SEQ ID NO: 28038 - RNA, 40 nt, Artificial Sequence
  Synthetic Oligonucleotide; PRDM1 exon 5; Set C
uuguacgaggggaugaaagcuggcgggagguggggcaggg

SEQ ID NO: 28039 - RNA, 38 nt, Artificial Sequence
  Synthetic Oligonucleotide; PRDM1 exon 5; Set C
uguacgaggggaugaaagcuggcgggagguggggcagg

SEQ ID NO: 28040 - RNA, 20 nt, Artificial Sequence
  Synthetic Oligonucleotide; PRDM1 exon 5; Set A
ggaugaaagcuggcgggagg

SEQ ID NO: 28041 - RNA, 22 nt, Artificial Sequence
  Synthetic Oligonucleotide; PRDM1 exon 5; Set A
gggaugaaagcuggcgggaggu

SEQ ID NO: 28042 - RNA, 24 nt, Artificial Sequence
  Synthetic Oligonucleotide; PRDM1 exon 5; Set C
ggggaugaaagcuggcgggaggug

SEQ ID NO: 28043 - RNA, 26 nt, Artificial Sequence
  Synthetic Oligonucleotide; PRDM1 exon 5; Set C
aggggaugaaagcuggcgggaggugg

SEQ ID NO: 28044 - RNA, 30 nt, Artificial Sequence
  Synthetic Oligonucleotide; PRDM1 exon 5; Set C
cgaggggaugaaagcuggcgggaggugggg

SEQ ID NO: 28045 - RNA, 18 nt, Artificial Sequence
  Synthetic Oligonucleotide; PRDM1 exon 5; Set C
gaugaaagcuggcgggag

SEQ ID NO: 28046 - RNA, 39 nt, Artificial Sequence
  Synthetic Oligonucleotide; PRDM1 exon 5; Set C
uuguacgaggggaugaaagcuggcgggagguggggcagg

SEQ ID NO: 28047 - RNA, 21 nt, Artificial Sequence
  Synthetic Oligonucleotide; PRDM1 exon 5; Set A
gggaugaaagcuggcgggagg

SEQ ID NO: 28048 - RNA, 25 nt, Artificial Sequence
  Synthetic Oligonucleotide; PRDM1 exon 5; Set C
aggggaugaaagcuggcgggaggug

SEQ ID NO: 28049 - RNA, 27 nt, Artificial Sequence
  Synthetic Oligonucleotide; PRDM1 exon 5; Set C
gaggggaugaaagcuggcgggaggugg

SEQ ID NO: 28050 - RNA, 29 nt, Artificial Sequence
  Synthetic Oligonucleotide; PRDM1 exon 5; Set C
cgaggggaugaaagcuggcgggagguggg

SEQ ID NO: 28051 - RNA, 31 nt, Artificial Sequence
  Synthetic Oligonucleotide; PRDM1 exon 5; Set C
acgaggggaugaaagcuggcgggaggugggg

SEQ ID NO: 28052 - RNA, 19 nt, Artificial Sequence
  Synthetic Oligonucleotide; PRDM1 exon 5; Set A
ggaugaaagcuggcgggag

SEQ ID NO: 28053 - RNA, 40 nt, Artificial Sequence
  Synthetic Oligonucleotide; PRDM1 exon 5; Set C
guuguacgaggggaugaaagcuggcgggagguggggcagg

SEQ ID NO: 28054 - RNA, 28 nt, Artificial Sequence
  Synthetic Oligonucleotide; PRDM1 exon 5; Set C
cgaggggaugaaagcuggcgggaggugg

SEQ ID NO: 28055 - RNA, 26 nt, Artificial Sequence
  Synthetic Oligonucleotide; PRDM1 exon 5; Set C
gaggggaugaaagcuggcgggaggug

SEQ ID NO: 28056 - RNA, 30 nt, Artificial Sequence
  Synthetic Oligonucleotide; PRDM1 exon 5; Set C
acgaggggaugaaagcuggcgggagguggg

SEQ ID NO: 28057 - RNA, 20 nt, Artificial Sequence
  Synthetic Oligonucleotide; PRDM1 exon 5; Set A
gggaugaaagcuggcgggag

SEQ ID NO: 28058 - RNA, 25 nt, Artificial Sequence
  Synthetic Oligonucleotide; PRDM1 exon 5; Set C
gaggggaugaaagcuggcgggaggu

SEQ ID NO: 28059 - RNA, 27 nt, Artificial Sequence
  Synthetic Oligonucleotide; PRDM1 exon 5; Set C
cgaggggaugaaagcuggcgggaggug

SEQ ID NO: 28060 - RNA, 29 nt, Artificial Sequence
  Synthetic Oligonucleotide; PRDM1 exon 5; Set C
acgaggggaugaaagcuggcgggaggugg

SEQ ID NO: 28061 - RNA, 39 nt, Artificial Sequence
  Synthetic Oligonucleotide; PRDM1 exon 5; Set C
guuguacgaggggaugaaagcuggcgggagguggggcag

SEQ ID NO: 28062 - RNA, 24 nt, Artificial Sequence
  Synthetic Oligonucleotide; PRDM1 exon 5; Set C
gaggggaugaaagcuggcgggagg

SEQ ID NO: 28063 - RNA, 26 nt, Artificial Sequence
  Synthetic Oligonucleotide; PRDM1 exon 5; Set C
cgaggggaugaaagcuggcgggaggu

SEQ ID NO: 28064 - RNA, 28 nt, Artificial Sequence
  Synthetic Oligonucleotide; PRDM1 exon 5; Set C
acgaggggaugaaagcuggcgggaggug

SEQ ID NO: 28065 - RNA, 40 nt, Artificial Sequence
  Synthetic Oligonucleotide; PRDM1 exon 5; Set C
cguuguacgaggggaugaaagcuggcgggagguggggcag

SEQ ID NO: 28066 - RNA, 38 nt, Artificial Sequence
  Synthetic Oligonucleotide; PRDM1 exon 5; Set C
guuguacgaggggaugaaagcuggcgggagguggggca

SEQ ID NO: 28067 - RNA, 25 nt, Artificial Sequence
  Synthetic Oligonucleotide; PRDM1 exon 5; Set C
cgaggggaugaaagcuggcgggagg

SEQ ID NO: 28068 - RNA, 27 nt, Artificial Sequence
  Synthetic Oligonucleotide; PRDM1 exon 5; Set C
acgaggggaugaaagcuggcgggaggu

SEQ ID NO: 28069 - RNA, 39 nt, Artificial Sequence
  Synthetic Oligonucleotide; PRDM1 exon 5; Set C
cguuguacgaggggaugaaagcuggcgggagguggggca

SEQ ID NO: 28070 - RNA, 37 nt, Artificial Sequence
  Synthetic Oligonucleotide; PRDM1 exon 5; Set C
guuguacgaggggaugaaagcuggcgggagguggggc

SEQ ID NO: 28071 - RNA, 26 nt, Artificial Sequence
  Synthetic Oligonucleotide; PRDM1 exon 5; Set C
acgaggggaugaaagcuggcgggagg

SEQ ID NO: 28072 - RNA, 32 nt, Artificial Sequence
  Synthetic Oligonucleotide; PRDM1 exon 5; Set C
uguacgaggggaugaaagcuggcgggaggugg

SEQ ID NO: 28073 - RNA, 36 nt, Artificial Sequence
  Synthetic Oligonucleotide; PRDM1 exon 5; Set C
guuguacgaggggaugaaagcuggcgggaggugggg

SEQ ID NO: 28074 - RNA, 40 nt, Artificial Sequence
  Synthetic Oligonucleotide; PRDM1 exon 5; Set C
gcguuguacgaggggaugaaagcuggcgggagguggggca

SEQ ID NO: 28075 - RNA, 38 nt, Artificial Sequence
  Synthetic Oligonucleotide; PRDM1 exon 5; Set C
cguuguacgaggggaugaaagcuggcgggagguggggc

SEQ ID NO: 28076 - RNA, 24 nt, Artificial Sequence
  Synthetic Oligonucleotide; PRDM1 exon 5; Set C
cgaggggaugaaagcuggcgggag

SEQ ID NO: 28077 - RNA, 33 nt, Artificial Sequence
  Synthetic Oligonucleotide; PRDM1 exon 5; Set C
uuguacgaggggaugaaagcuggcgggaggugg

SEQ ID NO: 28078 - RNA, 31 nt, Artificial Sequence
  Synthetic Oligonucleotide; PRDM1 exon 5; Set C
uguacgaggggaugaaagcuggcgggaggug

SEQ ID NO: 28079 - RNA, 35 nt, Artificial Sequence
  Synthetic Oligonucleotide; PRDM1 exon 5; Set C
guuguacgaggggaugaaagcuggcgggagguggg

SEQ ID NO: 28080 - RNA, 37 nt, Artificial Sequence
  Synthetic Oligonucleotide; PRDM1 exon 5; Set C
cguuguacgaggggaugaaagcuggcgggaggugggg

SEQ ID NO: 28081 - RNA, 39 nt, Artificial Sequence
  Synthetic Oligonucleotide; PRDM1 exon 5; Set C
gcguuguacgaggggaugaaagcuggcgggagguggggc

SEQ ID NO: 28082 - RNA, 30 nt, Artificial Sequence
  Synthetic Oligonucleotide; PRDM1 exon 5; Set C
uguacgaggggaugaaagcuggcgggaggu

SEQ ID NO: 28083 - RNA, 34 nt, Artificial Sequence
  Synthetic Oligonucleotide; PRDM1 exon 5; Set C
guuguacgaggggaugaaagcuggcgggaggugg

SEQ ID NO: 28084 - RNA, 32 nt, Artificial Sequence
  Synthetic Oligonucleotide; PRDM1 exon 5; Set C
uuguacgaggggaugaaagcuggcgggaggug

SEQ ID NO: 28085 - RNA, 36 nt, Artificial Sequence
  Synthetic Oligonucleotide; PRDM1 exon 5; Set C
cguuguacgaggggaugaaagcuggcgggagguggg

SEQ ID NO: 28086 - RNA, 38 nt, Artificial Sequence
  Synthetic Oligonucleotide; PRDM1 exon 5; Set C
gcguuguacgaggggaugaaagcuggcgggaggugggg

SEQ ID NO: 28087 - RNA, 40 nt, Artificial Sequence
  Synthetic Oligonucleotide; PRDM1 exon 5; Set C
agcguuguacgaggggaugaaagcuggcgggagguggggc

SEQ ID NO: 28088 - RNA, 29 nt, Artificial Sequence
  Synthetic Oligonucleotide; PRDM1 exon 5; Set C
uguacgaggggaugaaagcuggcgggagg

SEQ ID NO: 28089 - RNA, 31 nt, Artificial Sequence
  Synthetic Oligonucleotide; PRDM1 exon 5; Set C
uuguacgaggggaugaaagcuggcgggaggu

SEQ ID NO: 28090 - RNA, 33 nt, Artificial Sequence
  Synthetic Oligonucleotide; PRDM1 exon 5; Set C
guuguacgaggggaugaaagcuggcgggaggug

SEQ ID NO: 28091 - RNA, 35 nt, Artificial Sequence
  Synthetic Oligonucleotide; PRDM1 exon 5; Set C
cguuguacgaggggaugaaagcuggcgggaggugg

SEQ ID NO: 28092 - RNA, 37 nt, Artificial Sequence
  Synthetic Oligonucleotide; PRDM1 exon 5; Set C
gcguuguacgaggggaugaaagcuggcgggagguggg

SEQ ID NO: 28093 - RNA, 39 nt, Artificial Sequence
  Synthetic Oligonucleotide; PRDM1 exon 5; Set C
agcguuguacgaggggaugaaagcuggcgggaggugggg

SEQ ID NO: 28094 - RNA, 30 nt, Artificial Sequence
  Synthetic Oligonucleotide; PRDM1 exon 5; Set C
uuguacgaggggaugaaagcuggcgggagg

SEQ ID NO: 28095 - RNA, 32 nt, Artificial Sequence
  Synthetic Oligonucleotide; PRDM1 exon 5; Set C
guuguacgaggggaugaaagcuggcgggaggu

SEQ ID NO: 28096 - RNA, 34 nt, Artificial Sequence
  Synthetic Oligonucleotide; PRDM1 exon 5; Set C
cguuguacgaggggaugaaagcuggcgggaggug

SEQ ID NO: 28097 - RNA, 36 nt, Artificial Sequence
  Synthetic Oligonucleotide; PRDM1 exon 5; Set C
gcguuguacgaggggaugaaagcuggcgggaggugg

SEQ ID NO: 28098 - RNA, 38 nt, Artificial Sequence
  Synthetic Oligonucleotide; PRDM1 exon 5; Set C
agcguuguacgaggggaugaaagcuggcgggagguggg

SEQ ID NO: 28099 - RNA, 40 nt, Artificial Sequence
  Synthetic Oligonucleotide; PRDM1 exon 5; Set C
gagcguuguacgaggggaugaaagcuggcgggaggugggg

SEQ ID NO: 28100 - RNA, 31 nt, Artificial Sequence
  Synthetic Oligonucleotide; PRDM1 exon 5; Set C
guuguacgaggggaugaaagcuggcgggagg

SEQ ID NO: 28101 - RNA, 33 nt, Artificial Sequence
  Synthetic Oligonucleotide; PRDM1 exon 5; Set C
cguuguacgaggggaugaaagcuggcgggaggu

SEQ ID NO: 28102 - RNA, 37 nt, Artificial Sequence
  Synthetic Oligonucleotide; PRDM1 exon 5; Set C
agcguuguacgaggggaugaaagcuggcgggaggugg

SEQ ID NO: 28103 - RNA, 35 nt, Artificial Sequence
  Synthetic Oligonucleotide; PRDM1 exon 5; Set C
gcguuguacgaggggaugaaagcuggcgggaggug

SEQ ID NO: 28104 - RNA, 39 nt, Artificial Sequence
  Synthetic Oligonucleotide; PRDM1 exon 5; Set C
gagcguuguacgaggggaugaaagcuggcgggagguggg

SEQ ID NO: 28105 - RNA, 32 nt, Artificial Sequence
  Synthetic Oligonucleotide; PRDM1 exon 5; Set C
cguuguacgaggggaugaaagcuggcgggagg

SEQ ID NO: 28106 - RNA, 34 nt, Artificial Sequence
  Synthetic Oligonucleotide; PRDM1 exon 5; Set C
gcguuguacgaggggaugaaagcuggcgggaggu

SEQ ID NO: 28107 - RNA, 38 nt, Artificial Sequence
  Synthetic Oligonucleotide; PRDM1 exon 5; Set C
gagcguuguacgaggggaugaaagcuggcgggaggugg

SEQ ID NO: 28108 - RNA, 36 nt, Artificial Sequence
  Synthetic Oligonucleotide; PRDM1 exon 5; Set C
agcguuguacgaggggaugaaagcuggcgggaggug

SEQ ID NO: 28109 - RNA, 40 nt, Artificial Sequence
  Synthetic Oligonucleotide; PRDM1 exon 5; Set C
ugagcguuguacgaggggaugaaagcuggcgggagguggg

SEQ ID NO: 28110 - RNA, 30 nt, Artificial Sequence
  Synthetic Oligonucleotide; PRDM1 exon 5; Set C
guuguacgaggggaugaaagcuggcgggag

SEQ ID NO: 28111 - RNA, 33 nt, Artificial Sequence
  Synthetic Oligonucleotide; PRDM1 exon 5; Set C
gcguuguacgaggggaugaaagcuggcgggagg

SEQ ID NO: 28112 - RNA, 35 nt, Artificial Sequence
  Synthetic Oligonucleotide; PRDM1 exon 5; Set C
agcguuguacgaggggaugaaagcuggcgggaggu

SEQ ID NO: 28113 - RNA, 39 nt, Artificial Sequence
  Synthetic Oligonucleotide; PRDM1 exon 5; Set C
ugagcguuguacgaggggaugaaagcuggcgggaggugg

SEQ ID NO: 28114 - RNA, 37 nt, Artificial Sequence
  Synthetic Oligonucleotide; PRDM1 exon 5; Set C
gagcguuguacgaggggaugaaagcuggcgggaggug

SEQ ID NO: 28115 - RNA, 15 nt, Artificial Sequence
  Synthetic Oligonucleotide; PRDM1 exon 5; Set C
gaggggaugaaagcu

SEQ ID NO: 28116 - RNA, 34 nt, Artificial Sequence
  Synthetic Oligonucleotide; PRDM1 exon 5; Set C
agcguuguacgaggggaugaaagcuggcgggagg

SEQ ID NO: 28117 - RNA, 36 nt, Artificial Sequence
  Synthetic Oligonucleotide; PRDM1 exon 5; Set C
gagcguuguacgaggggaugaaagcuggcgggaggu

SEQ ID NO: 28118 - RNA, 40 nt, Artificial Sequence
  Synthetic Oligonucleotide; PRDM1 exon 5; Set C
gugagcguuguacgaggggaugaaagcuggcgggaggugg

SEQ ID NO: 28119 - RNA, 38 nt, Artificial Sequence
  Synthetic Oligonucleotide; PRDM1 exon 5; Set C
ugagcguuguacgaggggaugaaagcuggcgggaggug

SEQ ID NO: 28120 - RNA, 35 nt, Artificial Sequence
  Synthetic Oligonucleotide; PRDM1 exon 5; Set C
gagcguuguacgaggggaugaaagcuggcgggagg

SEQ ID NO: 28121 - RNA, 37 nt, Artificial Sequence
  Synthetic Oligonucleotide; PRDM1 exon 5; Set C
ugagcguuguacgaggggaugaaagcuggcgggaggu

SEQ ID NO: 28122 - RNA, 39 nt, Artificial Sequence
  Synthetic Oligonucleotide; PRDM1 exon 5; Set C
gugagcguuguacgaggggaugaaagcuggcgggaggug

SEQ ID NO: 28123 - RNA, 17 nt, Artificial Sequence
  Synthetic Oligonucleotide; PRDM1 exon 5; Set C
acgaggggaugaaagcu

SEQ ID NO: 28124 - RNA, 36 nt, Artificial Sequence
  Synthetic Oligonucleotide; PRDM1 exon 5; Set C
ugagcguuguacgaggggaugaaagcuggcgggagg

SEQ ID NO: 28125 - RNA, 38 nt, Artificial Sequence
  Synthetic Oligonucleotide; PRDM1 exon 5; Set C
gugagcguuguacgaggggaugaaagcuggcgggaggu

SEQ ID NO: 28126 - RNA, 40 nt, Artificial Sequence
  Synthetic Oligonucleotide; PRDM1 exon 5; Set C
agugagcguuguacgaggggaugaaagcuggcgggaggug

SEQ ID NO: 28127 - RNA, 16 nt, Artificial Sequence
  Synthetic Oligonucleotide; PRDM1 exon 5; Set C
acgaggggaugaaagc

SEQ ID NO: 28128 - RNA, 18 nt, Artificial Sequence
  Synthetic Oligonucleotide; PRDM1 exon 5; Set C
uacgaggggaugaaagcu

SEQ ID NO: 28129 - RNA, 37 nt, Artificial Sequence
  Synthetic Oligonucleotide; PRDM1 exon 5; Set C
gugagcguuguacgaggggaugaaagcuggcgggagg

SEQ ID NO: 28130 - RNA, 39 nt, Artificial Sequence
  Synthetic Oligonucleotide; PRDM1 exon 5; Set C
agugagcguuguacgaggggaugaaagcuggcgggaggu

SEQ ID NO: 28131 - RNA, 17 nt, Artificial Sequence
  Synthetic Oligonucleotide; PRDM1 exon 5; Set C
uacgaggggaugaaagc

SEQ ID NO: 28132 - RNA, 19 nt, Artificial Sequence
  Synthetic Oligonucleotide; PRDM1 exon 5; Set C
guacgaggggaugaaagcu

SEQ ID NO: 28133 - RNA, 35 nt, Artificial Sequence
  Synthetic Oligonucleotide; PRDM1 exon 5; Set C
ugagcguuguacgaggggaugaaagcuggcgggag

SEQ ID NO: 28134 - RNA, 16 nt, Artificial Sequence
  Synthetic Oligonucleotide; PRDM1 exon 5; Set C
uacgaggggaugaaag

SEQ ID NO: 28135 - RNA, 38 nt, Artificial Sequence
  Synthetic Oligonucleotide; PRDM1 exon 5; Set C
agugagcguuguacgaggggaugaaagcuggcgggagg

SEQ ID NO: 28136 - RNA, 18 nt, Artificial Sequence
  Synthetic Oligonucleotide; PRDM1 exon 5; Set C
guacgaggggaugaaagc

SEQ ID NO: 28137 - RNA, 20 nt, Artificial Sequence
  Synthetic Oligonucleotide; PRDM1 exon 5; Set C
uguacgaggggaugaaagcu

SEQ ID NO: 28138 - RNA, 36 nt, Artificial Sequence
  Synthetic Oligonucleotide; PRDM1 exon 5; Set C
gugagcguuguacgaggggaugaaagcuggcgggag

SEQ ID NO: 28139 - RNA, 17 nt, Artificial Sequence
  Synthetic Oligonucleotide; PRDM1 exon 5; Set C
guacgaggggaugaaag

SEQ ID NO: 28140 - RNA, 15 nt, Artificial Sequence
  Synthetic Oligonucleotide; PRDM1 exon 5; Set C
uacgaggggaugaaa

SEQ ID NO: 28141 - RNA, 19 nt, Artificial Sequence
  Synthetic Oligonucleotide; PRDM1 exon 5; Set C
uguacgaggggaugaaagc

SEQ ID NO: 28142 - RNA, 21 nt, Artificial Sequence
  Synthetic Oligonucleotide; PRDM1 exon 5; Set C
uuguacgaggggaugaaagcu

SEQ ID NO: 28143 - RNA, 37 nt, Artificial Sequence
  Synthetic Oligonucleotide; PRDM1 exon 5; Set C
agugagcguuguacgaggggaugaaagcuggcgggag

SEQ ID NO: 28144 - RNA, 18 nt, Artificial Sequence
  Synthetic Oligonucleotide; PRDM1 exon 5; Set C
uguacgaggggaugaaag

SEQ ID NO: 28145 - RNA, 16 nt, Artificial Sequence
  Synthetic Oligonucleotide; PRDM1 exon 5; Set C
guacgaggggaugaaa

SEQ ID NO: 28146 - RNA, 20 nt, Artificial Sequence
  Synthetic Oligonucleotide; PRDM1 exon 5; Set C
uuguacgaggggaugaaagc

SEQ ID NO: 28147 - RNA, 38 nt, Artificial Sequence
  Synthetic Oligonucleotide; PRDM1 exon 5; Set C
uagugagcguuguacgaggggaugaaagcuggcgggag

SEQ ID NO: 28148 - RNA, 36 nt, Artificial Sequence
  Synthetic Oligonucleotide; PRDM1 exon 5; Set C
agugagcguuguacgaggggaugaaagcuggcggga

SEQ ID NO: 28149 - RNA, 19 nt, Artificial Sequence
  Synthetic Oligonucleotide; PRDM1 exon 5; Set C
uuguacgaggggaugaaag

SEQ ID NO: 28150 - RNA, 17 nt, Artificial Sequence
  Synthetic Oligonucleotide; PRDM1 exon 5; Set C
uguacgaggggaugaaa

SEQ ID NO: 28151 - RNA, 15 nt, Artificial Sequence
  Synthetic Oligonucleotide; PRDM1 exon 5; Set C
guacgaggggaugaa

SEQ ID NO: 28152 - RNA, 23 nt, Artificial Sequence
  Synthetic Oligonucleotide; PRDM1 exon 5; Set A
cguuguacgaggggaugaaagcu

SEQ ID NO: 28153 - RNA, 39 nt, Artificial Sequence
  Synthetic Oligonucleotide; PRDM1 exon 5; Set C
guagugagcguuguacgaggggaugaaagcuggcgggag

SEQ ID NO: 28154 - RNA, 37 nt, Artificial Sequence
  Synthetic Oligonucleotide; PRDM1 exon 5; Set C
uagugagcguuguacgaggggaugaaagcuggcggga

SEQ ID NO: 28155 - RNA, 35 nt, Artificial Sequence
  Synthetic Oligonucleotide; PRDM1 exon 5; Set C
agugagcguuguacgaggggaugaaagcuggcggg

SEQ ID NO: 28156 - RNA, 18 nt, Artificial Sequence
  Synthetic Oligonucleotide; PRDM1 exon 5; Set C
uuguacgaggggaugaaa

SEQ ID NO: 28157 - RNA, 16 nt, Artificial Sequence
  Synthetic Oligonucleotide; PRDM1 exon 5; Set C
uguacgaggggaugaa

SEQ ID NO: 28158 - RNA, 22 nt, Artificial Sequence
  Synthetic Oligonucleotide; PRDM1 exon 5; Set A
cguuguacgaggggaugaaagc

SEQ ID NO: 28159 - RNA, 24 nt, Artificial Sequence
  Synthetic Oligonucleotide; PRDM1 exon 5; Set A
gcguuguacgaggggaugaaagcu

SEQ ID NO: 28160 - RNA, 40 nt, Artificial Sequence
  Synthetic Oligonucleotide; PRDM1 exon 5; Set C
gguagugagcguuguacgaggggaugaaagcuggcgggag

SEQ ID NO: 28161 - RNA, 38 nt, Artificial Sequence
  Synthetic Oligonucleotide; PRDM1 exon 5; Set C
guagugagcguuguacgaggggaugaaagcuggcggga

SEQ ID NO: 28162 - RNA, 36 nt, Artificial Sequence
  Synthetic Oligonucleotide; PRDM1 exon 5; Set C
uagugagcguuguacgaggggaugaaagcuggcggg

SEQ ID NO: 28163 - RNA, 17 nt, Artificial Sequence
  Synthetic Oligonucleotide; PRDM1 exon 5; Set C
uuguacgaggggaugaa

SEQ ID NO: 28164 - RNA, 15 nt, Artificial Sequence
  Synthetic Oligonucleotide; PRDM1 exon 5; Set C
uguacgaggggauga

SEQ ID NO: 28165 - RNA, 23 nt, Artificial Sequence
  Synthetic Oligonucleotide; PRDM1 exon 5; Set A
gcguuguacgaggggaugaaagc

SEQ ID NO: 28166 - RNA, 25 nt, Artificial Sequence
  Synthetic Oligonucleotide; PRDM1 exon 5; Set A
agcguuguacgaggggaugaaagcu

SEQ ID NO: 28167 - RNA, 39 nt, Artificial Sequence
  Synthetic Oligonucleotide; PRDM1 exon 5; Set C
gguagugagcguuguacgaggggaugaaagcuggcggga

SEQ ID NO: 28168 - RNA, 37 nt, Artificial Sequence
  Synthetic Oligonucleotide; PRDM1 exon 5; Set C
guagugagcguuguacgaggggaugaaagcuggcggg

SEQ ID NO: 28169 - RNA, 16 nt, Artificial Sequence
  Synthetic Oligonucleotide; PRDM1 exon 5; Set C
uuguacgaggggauga

SEQ ID NO: 28170 - RNA, 24 nt, Artificial Sequence
  Synthetic Oligonucleotide; PRDM1 exon 5; Set A
agcguuguacgaggggaugaaagc

SEQ ID NO: 28171 - RNA, 26 nt, Artificial Sequence
  Synthetic Oligonucleotide; PRDM1 exon 5; Set A
gagcguuguacgaggggaugaaagcu

SEQ ID NO: 28172 - RNA, 40 nt, Artificial Sequence
  Synthetic Oligonucleotide; PRDM1 exon 5; Set C
ggguagugagcguuguacgaggggaugaaagcuggcggga

SEQ ID NO: 28173 - RNA, 38 nt, Artificial Sequence
  Synthetic Oligonucleotide; PRDM1 exon 5; Set C
gguagugagcguuguacgaggggaugaaagcuggcggg

SEQ ID NO: 28174 - RNA, 15 nt, Artificial Sequence
  Synthetic Oligonucleotide; PRDM1 exon 5; Set C
uuguacgaggggaug

SEQ ID NO: 28175 - RNA, 25 nt, Artificial Sequence
  Synthetic Oligonucleotide; PRDM1 exon 5; Set A
gagcguuguacgaggggaugaaagc

SEQ ID NO: 28176 - RNA, 27 nt, Artificial Sequence
  Synthetic Oligonucleotide; PRDM1 exon 5; Set A
ugagcguuguacgaggggaugaaagcu

SEQ ID NO: 28177 - RNA, 39 nt, Artificial Sequence
  Synthetic Oligonucleotide; PRDM1 exon 5; Set C
ggguagugagcguuguacgaggggaugaaagcuggcggg

SEQ ID NO: 28178 - RNA, 26 nt, Artificial Sequence
  Synthetic Oligonucleotide; PRDM1 exon 5; Set A
ugagcguuguacgaggggaugaaagc

SEQ ID NO: 28179 - RNA, 28 nt, Artificial Sequence
  Synthetic Oligonucleotide; PRDM1 exon 5; Set C
gugagcguuguacgaggggaugaaagcu

SEQ ID NO: 28180 - RNA, 40 nt, Artificial Sequence
  Synthetic Oligonucleotide; PRDM1 exon 5; Set C
gggguagugagcguuguacgaggggaugaaagcuggcggg

SEQ ID NO: 28181 - RNA, 27 nt, Artificial Sequence
  Synthetic Oligonucleotide; PRDM1 exon 5; Set C
gugagcguuguacgaggggaugaaagc

SEQ ID NO: 28182 - RNA, 15 nt, Artificial Sequence
  Synthetic Oligonucleotide; PRDM1 exon 5; Set C
agcguuguacgaggg

SEQ ID NO: 28183 - RNA, 36 nt, Artificial Sequence
  Synthetic Oligonucleotide; PRDM1 exon 5; Set C
uugggguagugagcguuguacgaggggaugaaagcu

SEQ ID NO: 28184 - RNA, 16 nt, Artificial Sequence
  Synthetic Oligonucleotide; PRDM1 exon 5; Set C
gagcguuguacgaggg

SEQ ID NO: 28185 - RNA, 35 nt, Artificial Sequence
  Synthetic Oligonucleotide; PRDM1 exon 5; Set C
uugggguagugagcguuguacgaggggaugaaagc

SEQ ID NO: 28186 - RNA, 17 nt, Artificial Sequence
  Synthetic Oligonucleotide; PRDM1 exon 5; Set C
ugagcguuguacgaggg

SEQ ID NO: 28187 - RNA, 15 nt, Artificial Sequence
  Synthetic Oligonucleotide; PRDM1 exon 5; Set C
gagcguuguacgagg

SEQ ID NO: 28188 - RNA, 18 nt, Artificial Sequence
  Synthetic Oligonucleotide; PRDM1 exon 5; Set A
gugagcguuguacgaggg

SEQ ID NO: 28189 - RNA, 16 nt, Artificial Sequence
  Synthetic Oligonucleotide; PRDM1 exon 5; Set C
ugagcguuguacgagg

SEQ ID NO: 28190 - RNA, 19 nt, Artificial Sequence
  Synthetic Oligonucleotide; PRDM1 exon 5; Set A
agugagcguuguacgaggg

SEQ ID NO: 28191 - RNA, 17 nt, Artificial Sequence
  Synthetic Oligonucleotide; PRDM1 exon 5; Set C
gugagcguuguacgagg

SEQ ID NO: 28192 - RNA, 15 nt, Artificial Sequence
  Synthetic Oligonucleotide; PRDM1 exon 5; Set C
ugagcguuguacgag

SEQ ID NO: 28193 - RNA, 40 nt, Artificial Sequence
  Synthetic Oligonucleotide; PRDM1 exon 5; Set C
gaacuugggguagugagcguuguacgaggggaugaaagcu

SEQ ID NO: 28194 - RNA, 20 nt, Artificial Sequence
  Synthetic Oligonucleotide; PRDM1 exon 5; Set A
uagugagcguuguacgaggg

SEQ ID NO: 28195 - RNA, 18 nt, Artificial Sequence
  Synthetic Oligonucleotide; PRDM1 exon 5; Set C
agugagcguuguacgagg

SEQ ID NO: 28196 - RNA, 16 nt, Artificial Sequence
  Synthetic Oligonucleotide; PRDM1 exon 5; Set C
gugagcguuguacgag

SEQ ID NO: 28197 - RNA, 39 nt, Artificial Sequence
  Synthetic Oligonucleotide; PRDM1 exon 5; Set C
gaacuugggguagugagcguuguacgaggggaugaaagc

SEQ ID NO: 28198 - RNA, 21 nt, Artificial Sequence
  Synthetic Oligonucleotide; PRDM1 exon 5; Set A
guagugagcguuguacgaggg

SEQ ID NO: 28199 - RNA, 19 nt, Artificial Sequence
  Synthetic Oligonucleotide; PRDM1 exon 5; Set C
uagugagcguuguacgagg

SEQ ID NO: 28200 - RNA, 17 nt, Artificial Sequence
  Synthetic Oligonucleotide; PRDM1 exon 5; Set C
agugagcguuguacgag

SEQ ID NO: 28201 - RNA, 38 nt, Artificial Sequence
  Synthetic Oligonucleotide; PRDM1 exon 5; Set C
gaacuugggguagugagcguuguacgaggggaugaaag

SEQ ID NO: 28202 - RNA, 40 nt, Artificial Sequence
  Synthetic Oligonucleotide; PRDM1 exon 5; Set C
ggaacuugggguagugagcguuguacgaggggaugaaagc

SEQ ID NO: 28203 - RNA, 22 nt, Artificial Sequence
  Synthetic Oligonucleotide; PRDM1 exon 5; Set A
gguagugagcguuguacgaggg

SEQ ID NO: 28204 - RNA, 20 nt, Artificial Sequence
  Synthetic Oligonucleotide; PRDM1 exon 5; Set A
guagugagcguuguacgagg

SEQ ID NO: 28205 - RNA, 18 nt, Artificial Sequence
  Synthetic Oligonucleotide; PRDM1 exon 5; Set C
uagugagcguuguacgag

SEQ ID NO: 28206 - RNA, 37 nt, Artificial Sequence
  Synthetic Oligonucleotide; PRDM1 exon 5; Set C
gaacuugggguagugagcguuguacgaggggaugaaa

SEQ ID NO: 28207 - RNA, 15 nt, Artificial Sequence
  Synthetic Oligonucleotide; PRDM1 exon 5; Set C
agugagcguuguacg

SEQ ID NO: 28208 - RNA, 23 nt, Artificial Sequence
  Synthetic Oligonucleotide; PRDM1 exon 5; Set A
ggguagugagcguuguacgaggg

SEQ ID NO: 28209 - RNA, 21 nt, Artificial Sequence
  Synthetic Oligonucleotide; PRDM1 exon 5; Set A
gguagugagcguuguacgagg

SEQ ID NO: 28210 - RNA, 19 nt, Artificial Sequence
  Synthetic Oligonucleotide; PRDM1 exon 5; Set C
guagugagcguuguacgag

SEQ ID NO: 28211 - RNA, 36 nt, Artificial Sequence
  Synthetic Oligonucleotide; PRDM1 exon 5; Set C
gaacuugggguagugagcguuguacgaggggaugaa

SEQ ID NO: 28212 - RNA, 16 nt, Artificial Sequence
  Synthetic Oligonucleotide; PRDM1 exon 5; Set C
uagugagcguuguacg

SEQ ID NO: 28213 - RNA, 24 nt, Artificial Sequence
  Synthetic Oligonucleotide; PRDM1 exon 5; Set C
gggguagugagcguuguacgaggg

SEQ ID NO: 28214 - RNA, 22 nt, Artificial Sequence
  Synthetic Oligonucleotide; PRDM1 exon 5; Set A
ggguagugagcguuguacgagg

SEQ ID NO: 28215 - RNA, 20 nt, Artificial Sequence
  Synthetic Oligonucleotide; PRDM1 exon 5; Set A
gguagugagcguuguacgag

SEQ ID NO: 28216 - RNA, 35 nt, Artificial Sequence
  Synthetic Oligonucleotide; PRDM1 exon 5; Set C
gaacuugggguagugagcguuguacgaggggauga

SEQ ID NO: 28217 - RNA, 17 nt, Artificial Sequence
  Synthetic Oligonucleotide; PRDM1 exon 5; Set C
guagugagcguuguacg

SEQ ID NO: 28218 - RNA, 25 nt, Artificial Sequence
  Synthetic Oligonucleotide; PRDM1 exon 5; Set C
ugggguagugagcguuguacgaggg

SEQ ID NO: 28219 - RNA, 23 nt, Artificial Sequence
  Synthetic Oligonucleotide; PRDM1 exon 5; Set A
gggguagugagcguuguacgagg

SEQ ID NO: 28220 - RNA, 21 nt, Artificial Sequence
  Synthetic Oligonucleotide; PRDM1 exon 5; Set A
ggguagugagcguuguacgag

SEQ ID NO: 28221 - RNA, 15 nt, Artificial Sequence
  Synthetic Oligonucleotide; PRDM1 exon 5; Set C
uagugagcguuguac

SEQ ID NO: 28222 - RNA, 34 nt, Artificial Sequence
  Synthetic Oligonucleotide; PRDM1 exon 5; Set C
gaacuugggguagugagcguuguacgaggggaug

SEQ ID NO: 28223 - RNA, 18 nt, Artificial Sequence
  Synthetic Oligonucleotide; PRDM1 exon 5; Set C
gguagugagcguuguacg

SEQ ID NO: 28224 - RNA, 26 nt, Artificial Sequence
  Synthetic Oligonucleotide; PRDM1 exon 5; Set C
uugggguagugagcguuguacgaggg

SEQ ID NO: 28225 - RNA, 24 nt, Artificial Sequence
  Synthetic Oligonucleotide; PRDM1 exon 5; Set A
ugggguagugagcguuguacgagg

SEQ ID NO: 28226 - RNA, 22 nt, Artificial Sequence
  Synthetic Oligonucleotide; PRDM1 exon 5; Set A
gggguagugagcguuguacgag

SEQ ID NO: 28227 - RNA, 16 nt, Artificial Sequence
  Synthetic Oligonucleotide; PRDM1 exon 5; Set C
guagugagcguuguac

SEQ ID NO: 28228 - RNA, 33 nt, Artificial Sequence
  Synthetic Oligonucleotide; PRDM1 exon 5; Set C
gaacuugggguagugagcguuguacgaggggau

SEQ ID NO: 28229 - RNA, 19 nt, Artificial Sequence
  Synthetic Oligonucleotide; PRDM1 exon 5; Set A
ggguagugagcguuguacg

SEQ ID NO: 28230 - RNA, 25 nt, Artificial Sequence
  Synthetic Oligonucleotide; PRDM1 exon 5; Set C
uugggguagugagcguuguacgagg

SEQ ID NO: 28231 - RNA, 23 nt, Artificial Sequence
  Synthetic Oligonucleotide; PRDM1 exon 5; Set A
ugggguagugagcguuguacgag

SEQ ID NO: 28232 - RNA, 15 nt, Artificial Sequence
  Synthetic Oligonucleotide; PRDM1 exon 5; Set C
guagugagcguugua

SEQ ID NO: 28233 - RNA, 17 nt, Artificial Sequence
  Synthetic Oligonucleotide; PRDM1 exon 5; Set C
gguagugagcguuguac

SEQ ID NO: 28234 - RNA, 32 nt, Artificial Sequence
  Synthetic Oligonucleotide; PRDM1 exon 5; Set C
gaacuugggguagugagcguuguacgagggga

SEQ ID NO: 28235 - RNA, 20 nt, Artificial Sequence
  Synthetic Oligonucleotide; PRDM1 exon 5; Set A
gggguagugagcguuguacg

SEQ ID NO: 28236 - RNA, 24 nt, Artificial Sequence
  Synthetic Oligonucleotide; PRDM1 exon 5; Set A
uugggguagugagcguuguacgag

SEQ ID NO: 28237 - RNA, 16 nt, Artificial Sequence
  Synthetic Oligonucleotide; PRDM1 exon 5; Set C
gguagugagcguugua

SEQ ID NO: 28238 - RNA, 18 nt, Artificial Sequence
  Synthetic Oligonucleotide; PRDM1 exon 5; Set C
ggguagugagcguuguac

SEQ ID NO: 28239 - RNA, 31 nt, Artificial Sequence
  Synthetic Oligonucleotide; PRDM1 exon 5; Set C
gaacuugggguagugagcguuguacgagggg

SEQ ID NO: 28240 - RNA, 15 nt, Artificial Sequence
  Synthetic Oligonucleotide; PRDM1 exon 5; Set C
gguagugagcguugu

SEQ ID NO: 28241 - RNA, 17 nt, Artificial Sequence
  Synthetic Oligonucleotide; PRDM1 exon 5; Set C
ggguagugagcguugua

SEQ ID NO: 28242 - RNA, 19 nt, Artificial Sequence
  Synthetic Oligonucleotide; PRDM1 exon 5; Set A
gggguagugagcguuguac

SEQ ID NO: 28243 - RNA, 22 nt, Artificial Sequence
  Synthetic Oligonucleotide; PRDM1 exon 5; Set A
uugggguagugagcguuguacg

SEQ ID NO: 28244 - RNA, 16 nt, Artificial Sequence
  Synthetic Oligonucleotide; PRDM1 exon 5; Set C
ggguagugagcguugu

SEQ ID NO: 28245 - RNA, 18 nt, Artificial Sequence
  Synthetic Oligonucleotide; PRDM1 exon 5; Set A
gggguagugagcguugua

SEQ ID NO: 28246 - RNA, 20 nt, Artificial Sequence
  Synthetic Oligonucleotide; PRDM1 exon 5; Set A
ugggguagugagcguuguac

SEQ ID NO: 28247 - RNA, 31 nt, Artificial Sequence
  Synthetic Oligonucleotide; PRDM1 exon 5; Set C
ggaacuugggguagugagcguuguacgaggg

SEQ ID NO: 28248 - RNA, 15 nt, Artificial Sequence
  Synthetic Oligonucleotide; PRDM1 exon 5; Set C
ggguagugagcguug

SEQ ID NO: 28249 - RNA, 17 nt, Artificial Sequence
  Synthetic Oligonucleotide; PRDM1 exon 5; Set C
gggguagugagcguugu

SEQ ID NO: 28250 - RNA, 19 nt, Artificial Sequence
  Synthetic Oligonucleotide; PRDM1 exon 5; Set A
ugggguagugagcguugua

SEQ ID NO: 28251 - RNA, 21 nt, Artificial Sequence
  Synthetic Oligonucleotide; PRDM1 exon 5; Set A
uugggguagugagcguuguac

SEQ ID NO: 28252 - RNA, 32 nt, Artificial Sequence
  Synthetic Oligonucleotide; PRDM1 exon 5; Set C
aggaacuugggguagugagcguuguacgaggg

SEQ ID NO: 28253 - RNA, 30 nt, Artificial Sequence
  Synthetic Oligonucleotide; PRDM1 exon 5; Set C
ggaacuugggguagugagcguuguacgagg

SEQ ID NO: 28254 - RNA, 16 nt, Artificial Sequence
  Synthetic Oligonucleotide; PRDM1 exon 5; Set C
gggguagugagcguug

SEQ ID NO: 28255 - RNA, 18 nt, Artificial Sequence
  Synthetic Oligonucleotide; PRDM1 exon 5; Set A
ugggguagugagcguugu

SEQ ID NO: 28256 - RNA, 20 nt, Artificial Sequence
  Synthetic Oligonucleotide; PRDM1 exon 5; Set A
uugggguagugagcguugua

SEQ ID NO: 28257 - RNA, 27 nt, Artificial Sequence
  Synthetic Oligonucleotide; PRDM1 exon 5; Set C
gaacuugggguagugagcguuguacga

SEQ ID NO: 28258 - RNA, 33 nt, Artificial Sequence
  Synthetic Oligonucleotide; PRDM1 exon 5; Set C
gaggaacuugggguagugagcguuguacgaggg

SEQ ID NO: 28259 - RNA, 31 nt, Artificial Sequence
  Synthetic Oligonucleotide; PRDM1 exon 5; Set C
aggaacuugggguagugagcguuguacgagg

SEQ ID NO: 28260 - RNA, 29 nt, Artificial Sequence
  Synthetic Oligonucleotide; PRDM1 exon 5; Set C
ggaacuugggguagugagcguuguacgag

SEQ ID NO: 28261 - RNA, 17 nt, Artificial Sequence
  Synthetic Oligonucleotide; PRDM1 exon 5; Set C
ugggguagugagcguug

SEQ ID NO: 28262 - RNA, 19 nt, Artificial Sequence
  Synthetic Oligonucleotide; PRDM1 exon 5; Set A
uugggguagugagcguugu

SEQ ID NO: 28263 - RNA, 28 nt, Artificial Sequence
  Synthetic Oligonucleotide; PRDM1 exon 5; Set C
ggaacuugggguagugagcguuguacga

SEQ ID NO: 28264 - RNA, 26 nt, Artificial Sequence
  Synthetic Oligonucleotide; PRDM1 exon 5; Set A
gaacuugggguagugagcguuguacg

SEQ ID NO: 28265 - RNA, 34 nt, Artificial Sequence
  Synthetic Oligonucleotide; PRDM1 exon 5; Set C
agaggaacuugggguagugagcguuguacgaggg

SEQ ID NO: 28266 - RNA, 32 nt, Artificial Sequence
  Synthetic Oligonucleotide; PRDM1 exon 5; Set C
gaggaacuugggguagugagcguuguacgagg

SEQ ID NO: 28267 - RNA, 30 nt, Artificial Sequence
  Synthetic Oligonucleotide; PRDM1 exon 5; Set C
aggaacuugggguagugagcguuguacgag

SEQ ID NO: 28268 - RNA, 18 nt, Artificial Sequence
  Synthetic Oligonucleotide; PRDM1 exon 5; Set C
uugggguagugagcguug

SEQ ID NO: 28269 - RNA, 17 nt, Artificial Sequence
  Synthetic Oligonucleotide; PRDM1 exon 5; Set C
uugggguagugagcguu

SEQ ID NO: 28270 - RNA, 27 nt, Artificial Sequence
  Synthetic Oligonucleotide; PRDM1 exon 5; Set C
ggaacuugggguagugagcguuguacg

SEQ ID NO: 28271 - RNA, 33 nt, Artificial Sequence
  Synthetic Oligonucleotide; PRDM1 exon 5; Set C
agaggaacuugggguagugagcguuguacgagg

SEQ ID NO: 28272 - RNA, 31 nt, Artificial Sequence
  Synthetic Oligonucleotide; PRDM1 exon 5; Set C
gaggaacuugggguagugagcguuguacgag

SEQ ID NO: 28273 - RNA, 16 nt, Artificial Sequence
  Synthetic Oligonucleotide; PRDM1 exon 5; Set C
uugggguagugagcgu

SEQ ID NO: 28274 - RNA, 28 nt, Artificial Sequence
  Synthetic Oligonucleotide; PRDM1 exon 5; Set C
aggaacuugggguagugagcguuguacg

SEQ ID NO: 28275 - RNA, 32 nt, Artificial Sequence
  Synthetic Oligonucleotide; PRDM1 exon 5; Set C
agaggaacuugggguagugagcguuguacgag

SEQ ID NO: 28276 - RNA, 15 nt, Artificial Sequence
  Synthetic Oligonucleotide; PRDM1 exon 5; Set C
uugggguagugagcg

SEQ ID NO: 28277 - RNA, 29 nt, Artificial Sequence
  Synthetic Oligonucleotide; PRDM1 exon 5; Set C
gaggaacuugggguagugagcguuguacg

SEQ ID NO: 28278 - RNA, 40 nt, Artificial Sequence
  Synthetic Oligonucleotide; PRDM1 exon 5; Set C
gggcaagaggaacuugggguagugagcguuguacgagggg

SEQ ID NO: 28279 - RNA, 30 nt, Artificial Sequence
  Synthetic Oligonucleotide; PRDM1 exon 5; Set C
agaggaacuugggguagugagcguuguacg

SEQ ID NO: 28280 - RNA, 24 nt, Artificial Sequence
  Synthetic Oligonucleotide; PRDM1 exon 5; Set A
ggaacuugggguagugagcguugu

SEQ ID NO: 28281 - RNA, 28 nt, Artificial Sequence
  Synthetic Oligonucleotide; PRDM1 exon 5; Set C
gaggaacuugggguagugagcguuguac

SEQ ID NO: 28282 - RNA, 21 nt, Artificial Sequence
  Synthetic Oligonucleotide; PRDM1 exon 5; Set A
gaacuugggguagugagcguu

SEQ ID NO: 28283 - RNA, 23 nt, Artificial Sequence
  Synthetic Oligonucleotide; PRDM1 exon 5; Set A
ggaacuugggguagugagcguug

SEQ ID NO: 28284 - RNA, 25 nt, Artificial Sequence
  Synthetic Oligonucleotide; PRDM1 exon 5; Set A
aggaacuugggguagugagcguugu

SEQ ID NO: 28285 - RNA, 27 nt, Artificial Sequence
  Synthetic Oligonucleotide; PRDM1 exon 5; Set C
gaggaacuugggguagugagcguugua

SEQ ID NO: 28286 - RNA, 29 nt, Artificial Sequence
  Synthetic Oligonucleotide; PRDM1 exon 5; Set C
agaggaacuugggguagugagcguuguac

SEQ ID NO: 28287 - RNA, 22 nt, Artificial Sequence
  Synthetic Oligonucleotide; PRDM1 exon 5; Set A
ggaacuugggguagugagcguu

SEQ ID NO: 28288 - RNA, 20 nt, Artificial Sequence
  Synthetic Oligonucleotide; PRDM1 exon 5; Set A
gaacuugggguagugagcgu

SEQ ID NO: 28289 - RNA, 24 nt, Artificial Sequence
  Synthetic Oligonucleotide; PRDM1 exon 5; Set A
aggaacuugggguagugagcguug

SEQ ID NO: 28290 - RNA, 26 nt, Artificial Sequence
  Synthetic Oligonucleotide; PRDM1 exon 5; Set C
gaggaacuugggguagugagcguugu

SEQ ID NO: 28291 - RNA, 28 nt, Artificial Sequence
  Synthetic Oligonucleotide; PRDM1 exon 5; Set C
agaggaacuugggguagugagcguugua

SEQ ID NO: 28292 - RNA, 23 nt, Artificial Sequence
  Synthetic Oligonucleotide; PRDM1 exon 5; Set A
aggaacuugggguagugagcguu

SEQ ID NO: 28293 - RNA, 21 nt, Artificial Sequence
  Synthetic Oligonucleotide; PRDM1 exon 5; Set A
ggaacuugggguagugagcgu

SEQ ID NO: 28294 - RNA, 19 nt, Artificial Sequence
  Synthetic Oligonucleotide; PRDM1 exon 5; Set C
gaacuugggguagugagcg

SEQ ID NO: 28295 - RNA, 25 nt, Artificial Sequence
  Synthetic Oligonucleotide; PRDM1 exon 5; Set A
gaggaacuugggguagugagcguug

SEQ ID NO: 28296 - RNA, 27 nt, Artificial Sequence
  Synthetic Oligonucleotide; PRDM1 exon 5; Set C
agaggaacuugggguagugagcguugu

SEQ ID NO: 28297 - RNA, 36 nt, Artificial Sequence
  Synthetic Oligonucleotide; PRDM1 exon 5; Set C
gggcaagaggaacuugggguagugagcguuguacga

SEQ ID NO: 28298 - RNA, 22 nt, Artificial Sequence
  Synthetic Oligonucleotide; PRDM1 exon 5; Set A
aggaacuugggguagugagcgu

SEQ ID NO: 28299 - RNA, 20 nt, Artificial Sequence
  Synthetic Oligonucleotide; PRDM1 exon 5; Set A
ggaacuugggguagugagcg

SEQ ID NO: 28300 - RNA, 18 nt, Artificial Sequence
  Synthetic Oligonucleotide; PRDM1 exon 5; Set C
gaacuugggguagugagc

SEQ ID NO: 28301 - RNA, 40 nt, Artificial Sequence
  Synthetic Oligonucleotide; PRDM1 exon 5; Set C
gggggcaagaggaacuugggguagugagcguuguacgagg

SEQ ID NO: 28302 - RNA, 26 nt, Artificial Sequence
  Synthetic Oligonucleotide; PRDM1 exon 5; Set A
agaggaacuugggguagugagcguug

SEQ ID NO: 28303 - RNA, 37 nt, Artificial Sequence
  Synthetic Oligonucleotide; PRDM1 exon 5; Set C
ggggcaagaggaacuugggguagugagcguuguacga

SEQ ID NO: 28304 - RNA, 23 nt, Artificial Sequence
  Synthetic Oligonucleotide; PRDM1 exon 5; Set A
gaggaacuugggguagugagcgu

SEQ ID NO: 28305 - RNA, 17 nt, Artificial Sequence
  Synthetic Oligonucleotide; PRDM1 exon 5; Set C
gaacuugggguagugag

SEQ ID NO: 28306 - RNA, 19 nt, Artificial Sequence
  Synthetic Oligonucleotide; PRDM1 exon 5; Set A
ggaacuugggguagugagc

SEQ ID NO: 28307 - RNA, 21 nt, Artificial Sequence
  Synthetic Oligonucleotide; PRDM1 exon 5; Set A
aggaacuugggguagugagcg

SEQ ID NO: 28308 - RNA, 39 nt, Artificial Sequence
  Synthetic Oligonucleotide; PRDM1 exon 5; Set C
gggggcaagaggaacuugggguagugagcguuguacgag

SEQ ID NO: 28309 - RNA, 16 nt, Artificial Sequence
  Synthetic Oligonucleotide; PRDM1 exon 5; Set C
gaacuugggguaguga

SEQ ID NO: 28310 - RNA, 24 nt, Artificial Sequence
  Synthetic Oligonucleotide; PRDM1 exon 5; Set A
agaggaacuugggguagugagcgu

SEQ ID NO: 28311 - RNA, 18 nt, Artificial Sequence
  Synthetic Oligonucleotide; PRDM1 exon 5; Set C
ggaacuugggguagugag

SEQ ID NO: 28312 - RNA, 22 nt, Artificial Sequence
  Synthetic Oligonucleotide; PRDM1 exon 5; Set A
gaggaacuugggguagugagcg

SEQ ID NO: 28313 - RNA, 20 nt, Artificial Sequence
  Synthetic Oligonucleotide; PRDM1 exon 5; Set A
aggaacuugggguagugagc

SEQ ID NO: 28314 - RNA, 40 nt, Artificial Sequence
  Synthetic Oligonucleotide; PRDM1 exon 5; Set C
ggggggcaagaggaacuugggguagugagcguuguacgag

SEQ ID NO: 28315 - RNA, 17 nt, Artificial Sequence
  Synthetic Oligonucleotide; PRDM1 exon 5; Set C
ggaacuugggguaguga

SEQ ID NO: 28316 - RNA, 15 nt, Artificial Sequence
  Synthetic Oligonucleotide; PRDM1 exon 5; Set C
gaacuugggguagug

SEQ ID NO: 28317 - RNA, 19 nt, Artificial Sequence
  Synthetic Oligonucleotide; PRDM1 exon 5; Set C
aggaacuugggguagugag

SEQ ID NO: 28318 - RNA, 21 nt, Artificial Sequence
  Synthetic Oligonucleotide; PRDM1 exon 5; Set A
gaggaacuugggguagugagc

SEQ ID NO: 28319 - RNA, 23 nt, Artificial Sequence
  Synthetic Oligonucleotide; PRDM1 exon 5; Set A
agaggaacuugggguagugagcg

SEQ ID NO: 28320 - RNA, 37 nt, Artificial Sequence
  Synthetic Oligonucleotide; PRDM1 exon 5; Set C
gggggcaagaggaacuugggguagugagcguuguacg

SEQ ID NO: 28321 - RNA, 16 nt, Artificial Sequence
  Synthetic Oligonucleotide; PRDM1 exon 5; Set C
ggaacuugggguagug

SEQ ID NO: 28322 - RNA, 18 nt, Artificial Sequence
  Synthetic Oligonucleotide; PRDM1 exon 5; Set C
aggaacuugggguaguga

SEQ ID NO: 28323 - RNA, 20 nt, Artificial Sequence
  Synthetic Oligonucleotide; PRDM1 exon 5; Set C
gaggaacuugggguagugag

SEQ ID NO: 28324 - RNA, 22 nt, Artificial Sequence
  Synthetic Oligonucleotide; PRDM1 exon 5; Set A
agaggaacuugggguagugagc

SEQ ID NO: 28325 - RNA, 38 nt, Artificial Sequence
  Synthetic Oligonucleotide; PRDM1 exon 5; Set C
ggggggcaagaggaacuugggguagugagcguuguacg

SEQ ID NO: 28326 - RNA, 15 nt, Artificial Sequence
  Synthetic Oligonucleotide; PRDM1 exon 5; Set C
ggaacuugggguagu

SEQ ID NO: 28327 - RNA, 19 nt, Artificial Sequence
  Synthetic Oligonucleotide; PRDM1 exon 5; Set C
gaggaacuugggguaguga

SEQ ID NO: 28328 - RNA, 17 nt, Artificial Sequence
  Synthetic Oligonucleotide; PRDM1 exon 5; Set C
aggaacuugggguagug

SEQ ID NO: 28329 - RNA, 21 nt, Artificial Sequence
  Synthetic Oligonucleotide; PRDM1 exon 5; Set C
agaggaacuugggguagugag

SEQ ID NO: 28330 - RNA, 39 nt, Artificial Sequence
  Synthetic Oligonucleotide; PRDM1 exon 5; Set C
aggggggcaagaggaacuugggguagugagcguuguacg

SEQ ID NO: 28331 - RNA, 16 nt, Artificial Sequence
  Synthetic Oligonucleotide; PRDM1 exon 5; Set C
aggaacuugggguagu

SEQ ID NO: 28332 - RNA, 30 nt, Artificial Sequence
  Synthetic Oligonucleotide; PRDM1 exon 5; Set C
gggcaagaggaacuugggguagugagcguu

SEQ ID NO: 28333 - RNA, 18 nt, Artificial Sequence
  Synthetic Oligonucleotide; PRDM1 exon 5; Set C
gaggaacuugggguagug

SEQ ID NO: 28334 - RNA, 20 nt, Artificial Sequence
  Synthetic Oligonucleotide; PRDM1 exon 5; Set C
agaggaacuugggguaguga

SEQ ID NO: 28335 - RNA, 40 nt, Artificial Sequence
  Synthetic Oligonucleotide; PRDM1 exon 5; Set C
uaggggggcaagaggaacuugggguagugagcguuguacg

SEQ ID NO: 28336 - RNA, 34 nt, Artificial Sequence
  Synthetic Oligonucleotide; PRDM1 exon 5; Set C
gggggcaagaggaacuugggguagugagcguugu

SEQ ID NO: 28337 - RNA, 38 nt, Artificial Sequence
  Synthetic Oligonucleotide; PRDM1 exon 5; Set C
aggggggcaagaggaacuugggguagugagcguuguac

SEQ ID NO: 28338 - RNA, 15 nt, Artificial Sequence
  Synthetic Oligonucleotide; PRDM1 exon 5; Set C
aggaacuugggguag

SEQ ID NO: 28339 - RNA, 17 nt, Artificial Sequence
  Synthetic Oligonucleotide; PRDM1 exon 5; Set C
gaggaacuugggguagu

SEQ ID NO: 28340 - RNA, 31 nt, Artificial Sequence
  Synthetic Oligonucleotide; PRDM1 exon 5; Set C
ggggcaagaggaacuugggguagugagcguu

SEQ ID NO: 28341 - RNA, 19 nt, Artificial Sequence
  Synthetic Oligonucleotide; PRDM1 exon 5; Set C
agaggaacuugggguagug

SEQ ID NO: 28342 - RNA, 33 nt, Artificial Sequence
  Synthetic Oligonucleotide; PRDM1 exon 5; Set C
gggggcaagaggaacuugggguagugagcguug

SEQ ID NO: 28343 - RNA, 35 nt, Artificial Sequence
  Synthetic Oligonucleotide; PRDM1 exon 5; Set C
ggggggcaagaggaacuugggguagugagcguugu

SEQ ID NO: 28344 - RNA, 37 nt, Artificial Sequence
  Synthetic Oligonucleotide; PRDM1 exon 5; Set C
aggggggcaagaggaacuugggguagugagcguugua

SEQ ID NO: 28345 - RNA, 39 nt, Artificial Sequence
  Synthetic Oligonucleotide; PRDM1 exon 5; Set C
uaggggggcaagaggaacuugggguagugagcguuguac

SEQ ID NO: 28346 - RNA, 32 nt, Artificial Sequence
  Synthetic Oligonucleotide; PRDM1 exon 5; Set C
gggggcaagaggaacuugggguagugagcguu

SEQ ID NO: 28347 - RNA, 30 nt, Artificial Sequence
  Synthetic Oligonucleotide; PRDM1 exon 5; Set C
ggggcaagaggaacuugggguagugagcgu

SEQ ID NO: 28348 - RNA, 34 nt, Artificial Sequence
  Synthetic Oligonucleotide; PRDM1 exon 5; Set C
ggggggcaagaggaacuugggguagugagcguug

SEQ ID NO: 28349 - RNA, 36 nt, Artificial Sequence
  Synthetic Oligonucleotide; PRDM1 exon 5; Set C
aggggggcaagaggaacuugggguagugagcguugu

SEQ ID NO: 28350 - RNA, 38 nt, Artificial Sequence
  Synthetic Oligonucleotide; PRDM1 exon 5; Set C
uaggggggcaagaggaacuugggguagugagcguugua

SEQ ID NO: 28351 - RNA, 40 nt, Artificial Sequence
  Synthetic Oligonucleotide; PRDM1 exon 5; Set C
guaggggggcaagaggaacuugggguagugagcguuguac

SEQ ID NO: 28352 - RNA, 15 nt, Artificial Sequence
  Synthetic Oligonucleotide; PRDM1 exon 5; Set C
gaggaacuuggggua

SEQ ID NO: 28353 - RNA, 33 nt, Artificial Sequence
  Synthetic Oligonucleotide; PRDM1 exon 5; Set C
ggggggcaagaggaacuugggguagugagcguu

SEQ ID NO: 28354 - RNA, 31 nt, Artificial Sequence
  Synthetic Oligonucleotide; PRDM1 exon 5; Set C
gggggcaagaggaacuugggguagugagcgu

SEQ ID NO: 28355 - RNA, 35 nt, Artificial Sequence
  Synthetic Oligonucleotide; PRDM1 exon 5; Set C
aggggggcaagaggaacuugggguagugagcguug

SEQ ID NO: 28356 - RNA, 37 nt, Artificial Sequence
  Synthetic Oligonucleotide; PRDM1 exon 5; Set C
uaggggggcaagaggaacuugggguagugagcguugu

SEQ ID NO: 28357 - RNA, 39 nt, Artificial Sequence
  Synthetic Oligonucleotide; PRDM1 exon 5; Set C
guaggggggcaagaggaacuugggguagugagcguugua

SEQ ID NO: 28358 - RNA, 16 nt, Artificial Sequence
  Synthetic Oligonucleotide; PRDM1 exon 5; Set C
agaggaacuuggggua

SEQ ID NO: 28359 - RNA, 34 nt, Artificial Sequence
  Synthetic Oligonucleotide; PRDM1 exon 5; Set C
aggggggcaagaggaacuugggguagugagcguu

SEQ ID NO: 28360 - RNA, 32 nt, Artificial Sequence
  Synthetic Oligonucleotide; PRDM1 exon 5; Set C
ggggggcaagaggaacuugggguagugagcgu

SEQ ID NO: 28361 - RNA, 30 nt, Artificial Sequence
  Synthetic Oligonucleotide; PRDM1 exon 5; Set C
gggggcaagaggaacuugggguagugagcg

SEQ ID NO: 28362 - RNA, 36 nt, Artificial Sequence
  Synthetic Oligonucleotide; PRDM1 exon 5; Set C
uaggggggcaagaggaacuugggguagugagcguug

SEQ ID NO: 28363 - RNA, 38 nt, Artificial Sequence
  Synthetic Oligonucleotide; PRDM1 exon 5; Set C
guaggggggcaagaggaacuugggguagugagcguugu

SEQ ID NO: 28364 - RNA, 15 nt, Artificial Sequence
  Synthetic Oligonucleotide; PRDM1 exon 5; Set C
agaggaacuuggggu

SEQ ID NO: 28365 - RNA, 35 nt, Artificial Sequence
  Synthetic Oligonucleotide; PRDM1 exon 5; Set C
uaggggggcaagaggaacuugggguagugagcguu

SEQ ID NO: 28366 - RNA, 33 nt, Artificial Sequence
  Synthetic Oligonucleotide; PRDM1 exon 5; Set C
aggggggcaagaggaacuugggguagugagcgu

SEQ ID NO: 28367 - RNA, 29 nt, Artificial Sequence
  Synthetic Oligonucleotide; PRDM1 exon 5; Set C
gggggcaagaggaacuugggguagugagc

SEQ ID NO: 28368 - RNA, 31 nt, Artificial Sequence
  Synthetic Oligonucleotide; PRDM1 exon 5; Set C
ggggggcaagaggaacuugggguagugagcg

SEQ ID NO: 28369 - RNA, 37 nt, Artificial Sequence
  Synthetic Oligonucleotide; PRDM1 exon 5; Set C
guaggggggcaagaggaacuugggguagugagcguug

SEQ ID NO: 28370 - RNA, 36 nt, Artificial Sequence
  Synthetic Oligonucleotide; PRDM1 exon 5; Set C
guaggggggcaagaggaacuugggguagugagcguu

SEQ ID NO: 28371 - RNA, 34 nt, Artificial Sequence
  Synthetic Oligonucleotide; PRDM1 exon 5; Set C
uaggggggcaagaggaacuugggguagugagcgu

SEQ ID NO: 28372 - RNA, 28 nt, Artificial Sequence
  Synthetic Oligonucleotide; PRDM1 exon 5; Set C
gggggcaagaggaacuugggguagugag

SEQ ID NO: 28373 - RNA, 32 nt, Artificial Sequence
  Synthetic Oligonucleotide; PRDM1 exon 5; Set C
aggggggcaagaggaacuugggguagugagcg

SEQ ID NO: 28374 - RNA, 30 nt, Artificial Sequence
  Synthetic Oligonucleotide; PRDM1 exon 5; Set C
ggggggcaagaggaacuugggguagugagc

SEQ ID NO: 28375 - RNA, 27 nt, Artificial Sequence
  Synthetic Oligonucleotide; PRDM1 exon 5; Set C
gggggcaagaggaacuugggguaguga

SEQ ID NO: 28376 - RNA, 35 nt, Artificial Sequence
  Synthetic Oligonucleotide; PRDM1 exon 5; Set C
guaggggggcaagaggaacuugggguagugagcgu

SEQ ID NO: 28377 - RNA, 29 nt, Artificial Sequence
  Synthetic Oligonucleotide; PRDM1 exon 5; Set C
ggggggcaagaggaacuugggguagugag

SEQ ID NO: 28378 - RNA, 33 nt, Artificial Sequence
  Synthetic Oligonucleotide; PRDM1 exon 5; Set C
uaggggggcaagaggaacuugggguagugagcg

SEQ ID NO: 28379 - RNA, 31 nt, Artificial Sequence
  Synthetic Oligonucleotide; PRDM1 exon 5; Set C
aggggggcaagaggaacuugggguagugagc

SEQ ID NO: 28380 - RNA, 22 nt, Artificial Sequence
  Synthetic Oligonucleotide; PRDM1 exon 5; Set A
gggcaagaggaacuugggguag

SEQ ID NO: 28381 - RNA, 24 nt, Artificial Sequence
  Synthetic Oligonucleotide; PRDM1 exon 5; Set C
ggggcaagaggaacuugggguagu

SEQ ID NO: 28382 - RNA, 26 nt, Artificial Sequence
  Synthetic Oligonucleotide; PRDM1 exon 5; Set C
gggggcaagaggaacuugggguagug

SEQ ID NO: 28383 - RNA, 28 nt, Artificial Sequence
  Synthetic Oligonucleotide; PRDM1 exon 5; Set C
ggggggcaagaggaacuugggguaguga

SEQ ID NO: 28384 - RNA, 30 nt, Artificial Sequence
  Synthetic Oligonucleotide; PRDM1 exon 5; Set C
aggggggcaagaggaacuugggguagugag

SEQ ID NO: 28385 - RNA, 34 nt, Artificial Sequence
  Synthetic Oligonucleotide; PRDM1 exon 5; Set C
guaggggggcaagaggaacuugggguagugagcg

SEQ ID NO: 28386 - RNA, 32 nt, Artificial Sequence
  Synthetic Oligonucleotide; PRDM1 exon 5; Set C
uaggggggcaagaggaacuugggguagugagc

SEQ ID NO: 28387 - RNA, 23 nt, Artificial Sequence
  Synthetic Oligonucleotide; PRDM1 exon 5; Set A
ggggcaagaggaacuugggguag

SEQ ID NO: 28388 - RNA, 25 nt, Artificial Sequence
  Synthetic Oligonucleotide; PRDM1 exon 5; Set C
gggggcaagaggaacuugggguagu

SEQ ID NO: 28389 - RNA, 29 nt, Artificial Sequence
  Synthetic Oligonucleotide; PRDM1 exon 5; Set C
aggggggcaagaggaacuugggguaguga

SEQ ID NO: 28390 - RNA, 27 nt, Artificial Sequence
  Synthetic Oligonucleotide; PRDM1 exon 5; Set C
ggggggcaagaggaacuugggguagug

SEQ ID NO: 28391 - RNA, 31 nt, Artificial Sequence
  Synthetic Oligonucleotide; PRDM1 exon 5; Set C
uaggggggcaagaggaacuugggguagugag

SEQ ID NO: 28392 - RNA, 33 nt, Artificial Sequence
  Synthetic Oligonucleotide; PRDM1 exon 5; Set C
guaggggggcaagaggaacuugggguagugagc

SEQ ID NO: 28393 - RNA, 24 nt, Artificial Sequence
  Synthetic Oligonucleotide; PRDM1 exon 5; Set C
gggggcaagaggaacuugggguag

SEQ ID NO: 28394 - RNA, 26 nt, Artificial Sequence
  Synthetic Oligonucleotide; PRDM1 exon 5; Set C
ggggggcaagaggaacuugggguagu

SEQ ID NO: 28395 - RNA, 30 nt, Artificial Sequence
  Synthetic Oligonucleotide; PRDM1 exon 5; Set C
uaggggggcaagaggaacuugggguaguga

SEQ ID NO: 28396 - RNA, 28 nt, Artificial Sequence
  Synthetic Oligonucleotide; PRDM1 exon 5; Set C
aggggggcaagaggaacuugggguagug

SEQ ID NO: 28397 - RNA, 32 nt, Artificial Sequence
  Synthetic Oligonucleotide; PRDM1 exon 5; Set C
guaggggggcaagaggaacuugggguagugag

SEQ ID NO: 28398 - RNA, 25 nt, Artificial Sequence
  Synthetic Oligonucleotide; PRDM1 exon 5; Set C
ggggggcaagaggaacuugggguag

SEQ ID NO: 28399 - RNA, 23 nt, Artificial Sequence
  Synthetic Oligonucleotide; PRDM1 exon 5; Set C
gggggcaagaggaacuuggggua

SEQ ID NO: 28400 - RNA, 27 nt, Artificial Sequence
  Synthetic Oligonucleotide; PRDM1 exon 5; Set C
aggggggcaagaggaacuugggguagu

SEQ ID NO: 28401 - RNA, 31 nt, Artificial Sequence
  Synthetic Oligonucleotide; PRDM1 exon 5; Set C
guaggggggcaagaggaacuugggguaguga

SEQ ID NO: 28402 - RNA, 29 nt, Artificial Sequence
  Synthetic Oligonucleotide; PRDM1 exon 5; Set C
uaggggggcaagaggaacuugggguagug

SEQ ID NO: 28403 - RNA, 26 nt, Artificial Sequence
  Synthetic Oligonucleotide; PRDM1 exon 5; Set C
aggggggcaagaggaacuugggguag

SEQ ID NO: 28404 - RNA, 22 nt, Artificial Sequence
  Synthetic Oligonucleotide; PRDM1 exon 5; Set C
gggggcaagaggaacuuggggu

SEQ ID NO: 28405 - RNA, 24 nt, Artificial Sequence
  Synthetic Oligonucleotide; PRDM1 exon 5; Set C
ggggggcaagaggaacuuggggua

SEQ ID NO: 28406 - RNA, 28 nt, Artificial Sequence
  Synthetic Oligonucleotide; PRDM1 exon 5; Set C
uaggggggcaagaggaacuugggguagu

SEQ ID NO: 28407 - RNA, 30 nt, Artificial Sequence
  Synthetic Oligonucleotide; PRDM1 exon 5; Set C
guaggggggcaagaggaacuugggguagug

SEQ ID NO: 28408 - RNA, 27 nt, Artificial Sequence
  Synthetic Oligonucleotide; PRDM1 exon 5; Set C
uaggggggcaagaggaacuugggguag

SEQ ID NO: 28409 - RNA, 23 nt, Artificial Sequence
  Synthetic Oligonucleotide; PRDM1 exon 5; Set C
ggggggcaagaggaacuuggggu

SEQ ID NO: 28410 - RNA, 21 nt, Artificial Sequence
  Synthetic Oligonucleotide; PRDM1 exon 5; Set A
gggggcaagaggaacuugggg

SEQ ID NO: 28411 - RNA, 25 nt, Artificial Sequence
  Synthetic Oligonucleotide; PRDM1 exon 5; Set C
aggggggcaagaggaacuuggggua

SEQ ID NO: 28412 - RNA, 29 nt, Artificial Sequence
  Synthetic Oligonucleotide; PRDM1 exon 5; Set C
guaggggggcaagaggaacuugggguagu

SEQ ID NO: 28413 - RNA, 28 nt, Artificial Sequence
  Synthetic Oligonucleotide; PRDM1 exon 5; Set C
guaggggggcaagaggaacuugggguag

SEQ ID NO: 28414 - RNA, 20 nt, Artificial Sequence
  Synthetic Oligonucleotide; PRDM1 exon 5; Set A
gggggcaagaggaacuuggg

SEQ ID NO: 28415 - RNA, 24 nt, Artificial Sequence
  Synthetic Oligonucleotide; PRDM1 exon 5; Set C
aggggggcaagaggaacuuggggu

SEQ ID NO: 28416 - RNA, 22 nt, Artificial Sequence
  Synthetic Oligonucleotide; PRDM1 exon 5; Set C
ggggggcaagaggaacuugggg

SEQ ID NO: 28417 - RNA, 26 nt, Artificial Sequence
  Synthetic Oligonucleotide; PRDM1 exon 5; Set C
uaggggggcaagaggaacuuggggua

SEQ ID NO: 28418 - RNA, 19 nt, Artificial Sequence
  Synthetic Oligonucleotide; PRDM1 exon 5; Set A
gggggcaagaggaacuugg

SEQ ID NO: 28419 - RNA, 21 nt, Artificial Sequence
  Synthetic Oligonucleotide; PRDM1 exon 5; Set A
ggggggcaagaggaacuuggg

SEQ ID NO: 28420 - RNA, 25 nt, Artificial Sequence
  Synthetic Oligonucleotide; PRDM1 exon 5; Set C
uaggggggcaagaggaacuuggggu

SEQ ID NO: 28421 - RNA, 23 nt, Artificial Sequence
  Synthetic Oligonucleotide; PRDM1 exon 5; Set C
aggggggcaagaggaacuugggg

SEQ ID NO: 28422 - RNA, 27 nt, Artificial Sequence
  Synthetic Oligonucleotide; PRDM1 exon 5; Set C
guaggggggcaagaggaacuuggggua

SEQ ID NO: 28423 - RNA, 20 nt, Artificial Sequence
  Synthetic Oligonucleotide; PRDM1 exon 5; Set A
ggggggcaagaggaacuugg

SEQ ID NO: 28424 - RNA, 22 nt, Artificial Sequence
  Synthetic Oligonucleotide; PRDM1 exon 5; Set A
aggggggcaagaggaacuuggg

SEQ ID NO: 28425 - RNA, 26 nt, Artificial Sequence
  Synthetic Oligonucleotide; PRDM1 exon 5; Set C
guaggggggcaagaggaacuuggggu

SEQ ID NO: 28426 - RNA, 24 nt, Artificial Sequence
  Synthetic Oligonucleotide; PRDM1 exon 5; Set C
uaggggggcaagaggaacuugggg

SEQ ID NO: 28427 - RNA, 21 nt, Artificial Sequence
  Synthetic Oligonucleotide; PRDM1 exon 5; Set A
aggggggcaagaggaacuugg

SEQ ID NO: 28428 - RNA, 23 nt, Artificial Sequence
  Synthetic Oligonucleotide; PRDM1 exon 5; Set A
uaggggggcaagaggaacuuggg

SEQ ID NO: 28429 - RNA, 25 nt, Artificial Sequence
  Synthetic Oligonucleotide; PRDM1 exon 5; Set C
guaggggggcaagaggaacuugggg

SEQ ID NO: 28430 - RNA, 22 nt, Artificial Sequence
  Synthetic Oligonucleotide; PRDM1 exon 5; Set A
uaggggggcaagaggaacuugg

SEQ ID NO: 28431 - RNA, 24 nt, Artificial Sequence
  Synthetic Oligonucleotide; PRDM1 exon 5; Set C
guaggggggcaagaggaacuuggg

SEQ ID NO: 28432 - RNA, 23 nt, Artificial Sequence
  Synthetic Oligonucleotide; PRDM1 exon 5; Set A
guaggggggcaagaggaacuugg

SEQ ID NO: 28433 - RNA, 21 nt, Artificial Sequence
  Synthetic Oligonucleotide; PRDM1 exon 5; Set A
uaggggggcaagaggaacuug

SEQ ID NO: 28434 - RNA, 22 nt, Artificial Sequence
  Synthetic Oligonucleotide; PRDM1 exon 5; Set A
guaggggggcaagaggaacuug

SEQ ID NO: 28435 - RNA, 15 nt, Artificial Sequence
  Synthetic Oligonucleotide; PRDM1 exon 5; Set C
ggggggcaagaggaa

SEQ ID NO: 28436 - RNA, 16 nt, Artificial Sequence
  Synthetic Oligonucleotide; PRDM1 exon 5; Set C
aggggggcaagaggaa

SEQ ID NO: 28437 - RNA, 37 nt, Artificial Sequence
  Synthetic Oligonucleotide; PRDM1 exon 5; Set C
auucaugccguaggggggcaagaggaacuugggguag

SEQ ID NO: 28438 - RNA, 15 nt, Artificial Sequence
  Synthetic Oligonucleotide; PRDM1 exon 5; Set C
aggggggcaagagga

SEQ ID NO: 28439 - RNA, 17 nt, Artificial Sequence
  Synthetic Oligonucleotide; PRDM1 exon 5; Set C
uaggggggcaagaggaa

SEQ ID NO: 28440 - RNA, 38 nt, Artificial Sequence
  Synthetic Oligonucleotide; PRDM1 exon 5; Set C
aauucaugccguaggggggcaagaggaacuugggguag

SEQ ID NO: 28441 - RNA, 40 nt, Artificial Sequence
  Synthetic Oligonucleotide; PRDM1 exon 5; Set C
caauucaugccguaggggggcaagaggaacuugggguagu

SEQ ID NO: 28442 - RNA, 16 nt, Artificial Sequence
  Synthetic Oligonucleotide; PRDM1 exon 5; Set C
uaggggggcaagagga

SEQ ID NO: 28443 - RNA, 18 nt, Artificial Sequence
  Synthetic Oligonucleotide; PRDM1 exon 5; Set A
guaggggggcaagaggaa

SEQ ID NO: 28444 - RNA, 39 nt, Artificial Sequence
  Synthetic Oligonucleotide; PRDM1 exon 5; Set C
caauucaugccguaggggggcaagaggaacuugggguag

SEQ ID NO: 28445 - RNA, 17 nt, Artificial Sequence
  Synthetic Oligonucleotide; PRDM1 exon 5; Set A
guaggggggcaagagga

SEQ ID NO: 28446 - RNA, 15 nt, Artificial Sequence
  Synthetic Oligonucleotide; PRDM1 exon 5; Set C
uaggggggcaagagg

SEQ ID NO: 28447 - RNA, 40 nt, Artificial Sequence
  Synthetic Oligonucleotide; PRDM1 exon 5; Set C
acaauucaugccguaggggggcaagaggaacuugggguag

SEQ ID NO: 28448 - RNA, 38 nt, Artificial Sequence
  Synthetic Oligonucleotide; PRDM1 exon 5; Set C
caauucaugccguaggggggcaagaggaacuuggggua

SEQ ID NO: 28449 - RNA, 16 nt, Artificial Sequence
  Synthetic Oligonucleotide; PRDM1 exon 5; Set C
guaggggggcaagagg

SEQ ID NO: 28450 - RNA, 15 nt, Artificial Sequence
  Synthetic Oligonucleotide; PRDM1 exon 5; Set C
guaggggggcaagag

SEQ ID NO: 28451 - RNA, 37 nt, Artificial Sequence
  Synthetic Oligonucleotide; PRDM1 exon 5; Set C
caauucaugccguaggggggcaagaggaacuuggggu

SEQ ID NO: 28452 - RNA, 39 nt, Artificial Sequence
  Synthetic Oligonucleotide; PRDM1 exon 5; Set C
acaauucaugccguaggggggcaagaggaacuuggggua

SEQ ID NO: 28453 - RNA, 38 nt, Artificial Sequence
  Synthetic Oligonucleotide; PRDM1 exon 5; Set C
acaauucaugccguaggggggcaagaggaacuuggggu

SEQ ID NO: 28454 - RNA, 40 nt, Artificial Sequence
  Synthetic Oligonucleotide; PRDM1 exon 5; Set C
uacaauucaugccguaggggggcaagaggaacuuggggua

SEQ ID NO: 28455 - RNA, 39 nt, Artificial Sequence
  Synthetic Oligonucleotide; PRDM1 exon 5; Set C
uacaauucaugccguaggggggcaagaggaacuuggggu

SEQ ID NO: 28456 - RNA, 40 nt, Artificial Sequence
  Synthetic Oligonucleotide; PRDM1 exon 5; Set C
uuacaauucaugccguaggggggcaagaggaacuuggggu

SEQ ID NO: 28457 - RNA, 38 nt, Artificial Sequence
  Synthetic Oligonucleotide; PRDM1 exon 5; Set C
uacaauucaugccguaggggggcaagaggaacuugggg

SEQ ID NO: 28458 - RNA, 35 nt, Artificial Sequence
  Synthetic Oligonucleotide; PRDM1 exon 5; Set C
acaauucaugccguaggggggcaagaggaacuugg

SEQ ID NO: 28459 - RNA, 37 nt, Artificial Sequence
  Synthetic Oligonucleotide; PRDM1 exon 5; Set C
uacaauucaugccguaggggggcaagaggaacuuggg

SEQ ID NO: 28460 - RNA, 39 nt, Artificial Sequence
  Synthetic Oligonucleotide; PRDM1 exon 5; Set C
uuacaauucaugccguaggggggcaagaggaacuugggg

SEQ ID NO: 28461 - RNA, 36 nt, Artificial Sequence
  Synthetic Oligonucleotide; PRDM1 exon 5; Set C
uacaauucaugccguaggggggcaagaggaacuugg

SEQ ID NO: 28462 - RNA, 38 nt, Artificial Sequence
  Synthetic Oligonucleotide; PRDM1 exon 5; Set C
uuacaauucaugccguaggggggcaagaggaacuuggg

SEQ ID NO: 28463 - RNA, 40 nt, Artificial Sequence
  Synthetic Oligonucleotide; PRDM1 exon 5; Set C
auuacaauucaugccguaggggggcaagaggaacuugggg

SEQ ID NO: 28464 - RNA, 37 nt, Artificial Sequence
  Synthetic Oligonucleotide; PRDM1 exon 5; Set C
uuacaauucaugccguaggggggcaagaggaacuugg

SEQ ID NO: 28465 - RNA, 39 nt, Artificial Sequence
  Synthetic Oligonucleotide; PRDM1 exon 5; Set C
auuacaauucaugccguaggggggcaagaggaacuuggg

SEQ ID NO: 28466 - RNA, 38 nt, Artificial Sequence
  Synthetic Oligonucleotide; PRDM1 exon 5; Set C
auuacaauucaugccguaggggggcaagaggaacuugg

SEQ ID NO: 28467 - RNA, 31 nt, Artificial Sequence
  Synthetic Oligonucleotide; PRDM1 exon 5; Set C
uuacaauucaugccguaggggggcaagagga

SEQ ID NO: 28468 - RNA, 28 nt, Artificial Sequence
  Synthetic Oligonucleotide; PRDM1 exon 5; Set C
uacaauucaugccguaggggggcaagag

SEQ ID NO: 28469 - RNA, 32 nt, Artificial Sequence
  Synthetic Oligonucleotide; PRDM1 exon 5; Set C
auuacaauucaugccguaggggggcaagagga

SEQ ID NO: 28470 - RNA, 29 nt, Artificial Sequence
  Synthetic Oligonucleotide; PRDM1 exon 5; Set C
uuacaauucaugccguaggggggcaagag

SEQ ID NO: 28471 - RNA, 30 nt, Artificial Sequence
  Synthetic Oligonucleotide; PRDM1 exon 5; Set C
auuacaauucaugccguaggggggcaagag

SEQ ID NO: 28472 - RNA, 28 nt, Artificial Sequence
  Synthetic Oligonucleotide; PRDM1 exon 5; Set C
uuacaauucaugccguaggggggcaaga

SEQ ID NO: 28473 - RNA, 29 nt, Artificial Sequence
  Synthetic Oligonucleotide; PRDM1 exon 5; Set C
auuacaauucaugccguaggggggcaaga

SEQ ID NO: 28474 - RNA, 18 nt, Artificial Sequence
  Synthetic Oligonucleotide; PRDM1 exon 5; Set C
caauucaugccguagggg

SEQ ID NO: 28475 - RNA, 19 nt, Artificial Sequence
  Synthetic Oligonucleotide; PRDM1 exon 5; Set C
acaauucaugccguagggg

SEQ ID NO: 28476 - RNA, 23 nt, Artificial Sequence
  Synthetic Oligonucleotide; PRDM1 exon 5; Set A
uuacaauucaugccguagggggg

SEQ ID NO: 28477 - RNA, 20 nt, Artificial Sequence
  Synthetic Oligonucleotide; PRDM1 exon 5; Set C
uacaauucaugccguagggg

SEQ ID NO: 28478 - RNA, 24 nt, Artificial Sequence
  Synthetic Oligonucleotide; PRDM1 exon 5; Set A
auuacaauucaugccguagggggg

SEQ ID NO: 28479 - RNA, 21 nt, Artificial Sequence
  Synthetic Oligonucleotide; PRDM1 exon 5; Set C
uuacaauucaugccguagggg

SEQ ID NO: 28480 - RNA, 19 nt, Artificial Sequence
  Synthetic Oligonucleotide; PRDM1 exon 5; Set C
uacaauucaugccguaggg

SEQ ID NO: 28481 - RNA, 22 nt, Artificial Sequence
  Synthetic Oligonucleotide; PRDM1 exon 5; Set C
auuacaauucaugccguagggg

SEQ ID NO: 28482 - RNA, 20 nt, Artificial Sequence
  Synthetic Oligonucleotide; PRDM1 exon 5; Set C
uuacaauucaugccguaggg

SEQ ID NO: 28483 - RNA, 18 nt, Artificial Sequence
  Synthetic Oligonucleotide; PRDM1 exon 5; Set C
uacaauucaugccguagg

SEQ ID NO: 28484 - RNA, 19 nt, Artificial Sequence
  Synthetic Oligonucleotide; PRDM1 exon 5; Set C
uuacaauucaugccguagg

SEQ ID NO: 28485 - RNA, 17 nt, Artificial Sequence
  Synthetic Oligonucleotide; PRDM1 exon 5; Set C
uacaauucaugccguag

SEQ ID NO: 28486 - RNA, 21 nt, Artificial Sequence
  Synthetic Oligonucleotide; PRDM1 exon 5; Set C
auuacaauucaugccguaggg

SEQ ID NO: 28487 - RNA, 18 nt, Artificial Sequence
  Synthetic Oligonucleotide; PRDM1 exon 5; Set C
uuacaauucaugccguag

SEQ ID NO: 28488 - RNA, 20 nt, Artificial Sequence
  Synthetic Oligonucleotide; PRDM1 exon 5; Set C
auuacaauucaugccguagg

SEQ ID NO: 28489 - RNA, 17 nt, Artificial Sequence
  Synthetic Oligonucleotide; PRDM1 exon 5; Set C
uuacaauucaugccgua

SEQ ID NO: 28490 - RNA, 19 nt, Artificial Sequence
  Synthetic Oligonucleotide; PRDM1 exon 5; Set C
auuacaauucaugccguag

SEQ ID NO: 28491 - RNA, 18 nt, Artificial Sequence
  Synthetic Oligonucleotide; PRDM1 exon 5; Set C
auuacaauucaugccgua

SEQ ID NO: 28492 - RNA, 16 nt, Artificial Sequence
  Synthetic Oligonucleotide; PRDM1 exon 5; Set C
guugaugccauucaug

SEQ ID NO: 28493 - RNA, 17 nt, Artificial Sequence
  Synthetic Oligonucleotide; PRDM1 exon 5; Set C
uguugaugccauucaug

SEQ ID NO: 28494 - RNA, 16 nt, Artificial Sequence
  Synthetic Oligonucleotide; PRDM1 exon 5; Set C
uguugaugccauucau

SEQ ID NO: 28495 - RNA, 18 nt, Artificial Sequence
  Synthetic Oligonucleotide; PRDM1 exon 5; Set C
uuguugaugccauucaug

SEQ ID NO: 28496 - RNA, 17 nt, Artificial Sequence
  Synthetic Oligonucleotide; PRDM1 exon 5; Set C
uuguugaugccauucau

SEQ ID NO: 28497 - RNA, 19 nt, Artificial Sequence
  Synthetic Oligonucleotide; PRDM1 exon 5; Set C
guuguugaugccauucaug

SEQ ID NO: 28498 - RNA, 18 nt, Artificial Sequence
  Synthetic Oligonucleotide; PRDM1 exon 5; Set C
guuguugaugccauucau

SEQ ID NO: 28499 - RNA, 20 nt, Artificial Sequence
  Synthetic Oligonucleotide; PRDM1 exon 5; Set C
aguuguugaugccauucaug

SEQ ID NO: 28500 - RNA, 16 nt, Artificial Sequence
  Synthetic Oligonucleotide; PRDM1 exon 5; Set C
uuguugaugccauuca

SEQ ID NO: 28501 - RNA, 19 nt, Artificial Sequence
  Synthetic Oligonucleotide; PRDM1 exon 5; Set C
aguuguugaugccauucau

SEQ ID NO: 28502 - RNA, 21 nt, Artificial Sequence
  Synthetic Oligonucleotide; PRDM1 exon 5; Set C
aaguuguugaugccauucaug

SEQ ID NO: 28503 - RNA, 17 nt, Artificial Sequence
  Synthetic Oligonucleotide; PRDM1 exon 5; Set C
guuguugaugccauuca

SEQ ID NO: 28504 - RNA, 20 nt, Artificial Sequence
  Synthetic Oligonucleotide; PRDM1 exon 5; Set C
aaguuguugaugccauucau

SEQ ID NO: 28505 - RNA, 22 nt, Artificial Sequence
  Synthetic Oligonucleotide; PRDM1 exon 5; Set C
aaaguuguugaugccauucaug

SEQ ID NO: 28506 - RNA, 18 nt, Artificial Sequence
  Synthetic Oligonucleotide; PRDM1 exon 5; Set C
aguuguugaugccauuca

SEQ ID NO: 28507 - RNA, 16 nt, Artificial Sequence
  Synthetic Oligonucleotide; PRDM1 exon 5; Set C
guuguugaugccauuc

SEQ ID NO: 28508 - RNA, 21 nt, Artificial Sequence
  Synthetic Oligonucleotide; PRDM1 exon 5; Set C
aaaguuguugaugccauucau

SEQ ID NO: 28509 - RNA, 19 nt, Artificial Sequence
  Synthetic Oligonucleotide; PRDM1 exon 5; Set C
aaguuguugaugccauuca

SEQ ID NO: 28510 - RNA, 17 nt, Artificial Sequence
  Synthetic Oligonucleotide; PRDM1 exon 5; Set C
aguuguugaugccauuc

SEQ ID NO: 28511 - RNA, 16 nt, Artificial Sequence
  Synthetic Oligonucleotide; PRDM1 exon 5; Set C
aguuguugaugccauu

SEQ ID NO: 28512 - RNA, 20 nt, Artificial Sequence
  Synthetic Oligonucleotide; PRDM1 exon 5; Set C
aaaguuguugaugccauuca

SEQ ID NO: 28513 - RNA, 18 nt, Artificial Sequence
  Synthetic Oligonucleotide; PRDM1 exon 5; Set C
aaguuguugaugccauuc

SEQ ID NO: 28514 - RNA, 17 nt, Artificial Sequence
  Synthetic Oligonucleotide; PRDM1 exon 5; Set C
aaguuguugaugccauu

SEQ ID NO: 28515 - RNA, 19 nt, Artificial Sequence
  Synthetic Oligonucleotide; PRDM1 exon 5; Set C
aaaguuguugaugccauuc

SEQ ID NO: 28516 - RNA, 18 nt, Artificial Sequence
  Synthetic Oligonucleotide; PRDM1 exon 5; Set C
aaaguuguugaugccauu

SEQ ID NO: 28517 - RNA, 21 nt, Artificial Sequence
  Synthetic Oligonucleotide; PRDM1 exon 5; Set C
gggaagaggccaaaguuguug

SEQ ID NO: 28518 - RNA, 18 nt, Artificial Sequence
  Synthetic Oligonucleotide; PRDM1 exon 5; Set C
ugggguggggcaggcugc

SEQ ID NO: 28519 - RNA, 17 nt, Artificial Sequence
  Synthetic Oligonucleotide; PRDM1 exon 5; Set A
ugggguggggcaggcug

SEQ ID NO: 28520 - RNA, 19 nt, Artificial Sequence
  Synthetic Oligonucleotide; PRDM1 exon 5; Set C
augggguggggcaggcugc

SEQ ID NO: 28521 - RNA, 18 nt, Artificial Sequence
  Synthetic Oligonucleotide; PRDM1 exon 5; Set A
augggguggggcaggcug

SEQ ID NO: 28522 - RNA, 17 nt, Artificial Sequence
  Synthetic Oligonucleotide; PRDM1 exon 5; Set A
augggguggggcaggcu

SEQ ID NO: 28523 - RNA, 27 nt, Artificial Sequence
  Synthetic Oligonucleotide; PRDM1 exon 5; Set C
gguugagcaugggguggggcaggcugc

SEQ ID NO: 28524 - RNA, 28 nt, Artificial Sequence
  Synthetic Oligonucleotide; PRDM1 exon 5; Set C
ggguugagcaugggguggggcaggcugc

SEQ ID NO: 28525 - RNA, 29 nt, Artificial Sequence
  Synthetic Oligonucleotide; PRDM1 exon 5; Set C
gggguugagcaugggguggggcaggcugc

SEQ ID NO: 28526 - RNA, 28 nt, Artificial Sequence
  Synthetic Oligonucleotide; PRDM1 exon 5; Set C
gggguugagcaugggguggggcaggcug

SEQ ID NO: 28527 - RNA, 30 nt, Artificial Sequence
  Synthetic Oligonucleotide; PRDM1 exon 5; Set C
ugggguugagcaugggguggggcaggcugc

SEQ ID NO: 28528 - RNA, 29 nt, Artificial Sequence
  Synthetic Oligonucleotide; PRDM1 exon 5; Set C
ugggguugagcaugggguggggcaggcug

SEQ ID NO: 28529 - RNA, 31 nt, Artificial Sequence
  Synthetic Oligonucleotide; PRDM1 exon 5; Set C
gugggguugagcaugggguggggcaggcugc

SEQ ID NO: 28530 - RNA, 28 nt, Artificial Sequence
  Synthetic Oligonucleotide; PRDM1 exon 5; Set C
ugggguugagcaugggguggggcaggcu

SEQ ID NO: 28531 - RNA, 30 nt, Artificial Sequence
  Synthetic Oligonucleotide; PRDM1 exon 5; Set C
gugggguugagcaugggguggggcaggcug

SEQ ID NO: 28532 - RNA, 32 nt, Artificial Sequence
  Synthetic Oligonucleotide; PRDM1 exon 5; Set C
agugggguugagcaugggguggggcaggcugc

SEQ ID NO: 28533 - RNA, 29 nt, Artificial Sequence
  Synthetic Oligonucleotide; PRDM1 exon 5; Set C
gugggguugagcaugggguggggcaggcu

SEQ ID NO: 28534 - RNA, 31 nt, Artificial Sequence
  Synthetic Oligonucleotide; PRDM1 exon 5; Set C
agugggguugagcaugggguggggcaggcug

SEQ ID NO: 28535 - RNA, 33 nt, Artificial Sequence
  Synthetic Oligonucleotide; PRDM1 exon 5; Set C
aagugggguugagcaugggguggggcaggcugc

SEQ ID NO: 28536 - RNA, 30 nt, Artificial Sequence
  Synthetic Oligonucleotide; PRDM1 exon 5; Set C
agugggguugagcaugggguggggcaggcu

SEQ ID NO: 28537 - RNA, 32 nt, Artificial Sequence
  Synthetic Oligonucleotide; PRDM1 exon 5; Set C
aagugggguugagcaugggguggggcaggcug

SEQ ID NO: 28538 - RNA, 34 nt, Artificial Sequence
  Synthetic Oligonucleotide; PRDM1 exon 5; Set C
gaagugggguugagcaugggguggggcaggcugc

SEQ ID NO: 28539 - RNA, 31 nt, Artificial Sequence
  Synthetic Oligonucleotide; PRDM1 exon 5; Set C
aagugggguugagcaugggguggggcaggcu

SEQ ID NO: 28540 - RNA, 33 nt, Artificial Sequence
  Synthetic Oligonucleotide; PRDM1 exon 5; Set C
gaagugggguugagcaugggguggggcaggcug

SEQ ID NO: 28541 - RNA, 35 nt, Artificial Sequence
  Synthetic Oligonucleotide; PRDM1 exon 5; Set C
agaagugggguugagcaugggguggggcaggcugc

SEQ ID NO: 28542 - RNA, 32 nt, Artificial Sequence
  Synthetic Oligonucleotide; PRDM1 exon 5; Set C
gaagugggguugagcaugggguggggcaggcu

SEQ ID NO: 28543 - RNA, 30 nt, Artificial Sequence
  Synthetic Oligonucleotide; PRDM1 exon 5; Set C
aagugggguugagcaugggguggggcaggc

SEQ ID NO: 28544 - RNA, 34 nt, Artificial Sequence
  Synthetic Oligonucleotide; PRDM1 exon 5; Set C
agaagugggguugagcaugggguggggcaggcug

SEQ ID NO: 28545 - RNA, 36 nt, Artificial Sequence
  Synthetic Oligonucleotide; PRDM1 exon 5; Set C
gagaagugggguugagcaugggguggggcaggcugc

SEQ ID NO: 28546 - RNA, 33 nt, Artificial Sequence
  Synthetic Oligonucleotide; PRDM1 exon 5; Set C
agaagugggguugagcaugggguggggcaggcu

SEQ ID NO: 28547 - RNA, 31 nt, Artificial Sequence
  Synthetic Oligonucleotide; PRDM1 exon 5; Set C
gaagugggguugagcaugggguggggcaggc

SEQ ID NO: 28548 - RNA, 29 nt, Artificial Sequence
  Synthetic Oligonucleotide; PRDM1 exon 5; Set C
aagugggguugagcaugggguggggcagg

SEQ ID NO: 28549 - RNA, 35 nt, Artificial Sequence
  Synthetic Oligonucleotide; PRDM1 exon 5; Set C
gagaagugggguugagcaugggguggggcaggcug

SEQ ID NO: 28550 - RNA, 37 nt, Artificial Sequence
  Synthetic Oligonucleotide; PRDM1 exon 5; Set C
agagaagugggguugagcaugggguggggcaggcugc

SEQ ID NO: 28551 - RNA, 34 nt, Artificial Sequence
  Synthetic Oligonucleotide; PRDM1 exon 5; Set C
gagaagugggguugagcaugggguggggcaggcu

SEQ ID NO: 28552 - RNA, 32 nt, Artificial Sequence
  Synthetic Oligonucleotide; PRDM1 exon 5; Set C
agaagugggguugagcaugggguggggcaggc

SEQ ID NO: 28553 - RNA, 30 nt, Artificial Sequence
  Synthetic Oligonucleotide; PRDM1 exon 5; Set C
gaagugggguugagcaugggguggggcagg

SEQ ID NO: 28554 - RNA, 36 nt, Artificial Sequence
  Synthetic Oligonucleotide; PRDM1 exon 5; Set C
agagaagugggguugagcaugggguggggcaggcug

SEQ ID NO: 28555 - RNA, 38 nt, Artificial Sequence
  Synthetic Oligonucleotide; PRDM1 exon 5; Set C
gagagaagugggguugagcaugggguggggcaggcugc

SEQ ID NO: 28556 - RNA, 35 nt, Artificial Sequence
  Synthetic Oligonucleotide; PRDM1 exon 5; Set C
agagaagugggguugagcaugggguggggcaggcu

SEQ ID NO: 28557 - RNA, 33 nt, Artificial Sequence
  Synthetic Oligonucleotide; PRDM1 exon 5; Set C
gagaagugggguugagcaugggguggggcaggc

SEQ ID NO: 28558 - RNA, 31 nt, Artificial Sequence
  Synthetic Oligonucleotide; PRDM1 exon 5; Set C
agaagugggguugagcaugggguggggcagg

SEQ ID NO: 28559 - RNA, 37 nt, Artificial Sequence
  Synthetic Oligonucleotide; PRDM1 exon 5; Set C
gagagaagugggguugagcaugggguggggcaggcug

SEQ ID NO: 28560 - RNA, 29 nt, Artificial Sequence
  Synthetic Oligonucleotide; PRDM1 exon 5; Set C
gaagugggguugagcaugggguggggcag

SEQ ID NO: 28561 - RNA, 39 nt, Artificial Sequence
  Synthetic Oligonucleotide; PRDM1 exon 5; Set C
ggagagaagugggguugagcaugggguggggcaggcugc

SEQ ID NO: 28562 - RNA, 36 nt, Artificial Sequence
  Synthetic Oligonucleotide; PRDM1 exon 5; Set C
gagagaagugggguugagcaugggguggggcaggcu

SEQ ID NO: 28563 - RNA, 32 nt, Artificial Sequence
  Synthetic Oligonucleotide; PRDM1 exon 5; Set C
gagaagugggguugagcaugggguggggcagg

SEQ ID NO: 28564 - RNA, 34 nt, Artificial Sequence
  Synthetic Oligonucleotide; PRDM1 exon 5; Set C
agagaagugggguugagcaugggguggggcaggc

SEQ ID NO: 28565 - RNA, 38 nt, Artificial Sequence
  Synthetic Oligonucleotide; PRDM1 exon 5; Set C
ggagagaagugggguugagcaugggguggggcaggcug

SEQ ID NO: 28566 - RNA, 30 nt, Artificial Sequence
  Synthetic Oligonucleotide; PRDM1 exon 5; Set C
agaagugggguugagcaugggguggggcag

SEQ ID NO: 28567 - RNA, 40 nt, Artificial Sequence
  Synthetic Oligonucleotide; PRDM1 exon 5; Set C
gggagagaagugggguugagcaugggguggggcaggcugc

SEQ ID NO: 28568 - RNA, 37 nt, Artificial Sequence
  Synthetic Oligonucleotide; PRDM1 exon 5; Set C
ggagagaagugggguugagcaugggguggggcaggcu

SEQ ID NO: 28569 - RNA, 35 nt, Artificial Sequence
  Synthetic Oligonucleotide; PRDM1 exon 5; Set C
gagagaagugggguugagcaugggguggggcaggc

SEQ ID NO: 28570 - RNA, 33 nt, Artificial Sequence
  Synthetic Oligonucleotide; PRDM1 exon 5; Set C
agagaagugggguugagcaugggguggggcagg

SEQ ID NO: 28571 - RNA, 39 nt, Artificial Sequence
  Synthetic Oligonucleotide; PRDM1 exon 5; Set C
gggagagaagugggguugagcaugggguggggcaggcug

SEQ ID NO: 28572 - RNA, 31 nt, Artificial Sequence
  Synthetic Oligonucleotide; PRDM1 exon 5; Set C
gagaagugggguugagcaugggguggggcag

SEQ ID NO: 28573 - RNA, 38 nt, Artificial Sequence
  Synthetic Oligonucleotide; PRDM1 exon 5; Set C
gggagagaagugggguugagcaugggguggggcaggcu

SEQ ID NO: 28574 - RNA, 34 nt, Artificial Sequence
  Synthetic Oligonucleotide; PRDM1 exon 5; Set C
gagagaagugggguugagcaugggguggggcagg

SEQ ID NO: 28575 - RNA, 36 nt, Artificial Sequence
  Synthetic Oligonucleotide; PRDM1 exon 5; Set C
ggagagaagugggguugagcaugggguggggcaggc

SEQ ID NO: 28576 - RNA, 32 nt, Artificial Sequence
  Synthetic Oligonucleotide; PRDM1 exon 5; Set C
agagaagugggguugagcaugggguggggcag

SEQ ID NO: 28577 - RNA, 37 nt, Artificial Sequence
  Synthetic Oligonucleotide; PRDM1 exon 5; Set C
gggagagaagugggguugagcaugggguggggcaggc

SEQ ID NO: 28578 - RNA, 35 nt, Artificial Sequence
  Synthetic Oligonucleotide; PRDM1 exon 5; Set C
ggagagaagugggguugagcaugggguggggcagg

SEQ ID NO: 28579 - RNA, 33 nt, Artificial Sequence
  Synthetic Oligonucleotide; PRDM1 exon 5; Set C
gagagaagugggguugagcaugggguggggcag

SEQ ID NO: 28580 - RNA, 15 nt, Artificial Sequence
  Synthetic Oligonucleotide; PRDM1 exon 5; Set C
gggguugagcauggg

SEQ ID NO: 28581 - RNA, 36 nt, Artificial Sequence
  Synthetic Oligonucleotide; PRDM1 exon 5; Set C
gggagagaagugggguugagcaugggguggggcagg

SEQ ID NO: 28582 - RNA, 34 nt, Artificial Sequence
  Synthetic Oligonucleotide; PRDM1 exon 5; Set C
ggagagaagugggguugagcaugggguggggcag

SEQ ID NO: 28583 - RNA, 16 nt, Artificial Sequence
  Synthetic Oligonucleotide; PRDM1 exon 5; Set C
ugggguugagcauggg

SEQ ID NO: 28584 - RNA, 15 nt, Artificial Sequence
  Synthetic Oligonucleotide; PRDM1 exon 5; Set C
ugggguugagcaugg

SEQ ID NO: 28585 - RNA, 35 nt, Artificial Sequence
  Synthetic Oligonucleotide; PRDM1 exon 5; Set C
gggagagaagugggguugagcaugggguggggcag

SEQ ID NO: 28586 - RNA, 17 nt, Artificial Sequence
  Synthetic Oligonucleotide; PRDM1 exon 5; Set A
gugggguugagcauggg

SEQ ID NO: 28587 - RNA, 16 nt, Artificial Sequence
  Synthetic Oligonucleotide; PRDM1 exon 5; Set C
gugggguugagcaugg

SEQ ID NO: 28588 - RNA, 18 nt, Artificial Sequence
  Synthetic Oligonucleotide; PRDM1 exon 5; Set A
agugggguugagcauggg

SEQ ID NO: 28589 - RNA, 17 nt, Artificial Sequence
  Synthetic Oligonucleotide; PRDM1 exon 5; Set C
agugggguugagcaugg

SEQ ID NO: 28590 - RNA, 15 nt, Artificial Sequence
  Synthetic Oligonucleotide; PRDM1 exon 5; Set C
gugggguugagcaug

SEQ ID NO: 28591 - RNA, 19 nt, Artificial Sequence
  Synthetic Oligonucleotide; PRDM1 exon 5; Set C
aagugggguugagcauggg

SEQ ID NO: 28592 - RNA, 18 nt, Artificial Sequence
  Synthetic Oligonucleotide; PRDM1 exon 5; Set C
aagugggguugagcaugg

SEQ ID NO: 28593 - RNA, 16 nt, Artificial Sequence
  Synthetic Oligonucleotide; PRDM1 exon 5; Set C
agugggguugagcaug

SEQ ID NO: 28594 - RNA, 20 nt, Artificial Sequence
  Synthetic Oligonucleotide; PRDM1 exon 5; Set A
gaagugggguugagcauggg

SEQ ID NO: 28595 - RNA, 19 nt, Artificial Sequence
  Synthetic Oligonucleotide; PRDM1 exon 5; Set C
gaagugggguugagcaugg

SEQ ID NO: 28596 - RNA, 17 nt, Artificial Sequence
  Synthetic Oligonucleotide; PRDM1 exon 5; Set C
aagugggguugagcaug

SEQ ID NO: 28597 - RNA, 21 nt, Artificial Sequence
  Synthetic Oligonucleotide; PRDM1 exon 5; Set A
agaagugggguugagcauggg

SEQ ID NO: 28598 - RNA, 20 nt, Artificial Sequence
  Synthetic Oligonucleotide; PRDM1 exon 5; Set C
agaagugggguugagcaugg

SEQ ID NO: 28599 - RNA, 18 nt, Artificial Sequence
  Synthetic Oligonucleotide; PRDM1 exon 5; Set C
gaagugggguugagcaug

SEQ ID NO: 28600 - RNA, 22 nt, Artificial Sequence
  Synthetic Oligonucleotide; PRDM1 exon 5; Set A
gagaagugggguugagcauggg

SEQ ID NO: 28601 - RNA, 21 nt, Artificial Sequence
  Synthetic Oligonucleotide; PRDM1 exon 5; Set A
gagaagugggguugagcaugg

SEQ ID NO: 28602 - RNA, 19 nt, Artificial Sequence
  Synthetic Oligonucleotide; PRDM1 exon 5; Set C
agaagugggguugagcaug

SEQ ID NO: 28603 - RNA, 23 nt, Artificial Sequence
  Synthetic Oligonucleotide; PRDM1 exon 5; Set A
agagaagugggguugagcauggg

SEQ ID NO: 28604 - RNA, 22 nt, Artificial Sequence
  Synthetic Oligonucleotide; PRDM1 exon 5; Set A
agagaagugggguugagcaugg

SEQ ID NO: 28605 - RNA, 20 nt, Artificial Sequence
  Synthetic Oligonucleotide; PRDM1 exon 5; Set C
gagaagugggguugagcaug

SEQ ID NO: 28606 - RNA, 24 nt, Artificial Sequence
  Synthetic Oligonucleotide; PRDM1 exon 5; Set A
gagagaagugggguugagcauggg

SEQ ID NO: 28607 - RNA, 23 nt, Artificial Sequence
  Synthetic Oligonucleotide; PRDM1 exon 5; Set A
gagagaagugggguugagcaugg

SEQ ID NO: 28608 - RNA, 21 nt, Artificial Sequence
  Synthetic Oligonucleotide; PRDM1 exon 5; Set C
agagaagugggguugagcaug

SEQ ID NO: 28609 - RNA, 25 nt, Artificial Sequence
  Synthetic Oligonucleotide; PRDM1 exon 5; Set A
ggagagaagugggguugagcauggg

SEQ ID NO: 28610 - RNA, 24 nt, Artificial Sequence
  Synthetic Oligonucleotide; PRDM1 exon 5; Set A
ggagagaagugggguugagcaugg

SEQ ID NO: 28611 - RNA, 22 nt, Artificial Sequence
  Synthetic Oligonucleotide; PRDM1 exon 5; Set A
gagagaagugggguugagcaug

SEQ ID NO: 28612 - RNA, 26 nt, Artificial Sequence
  Synthetic Oligonucleotide; PRDM1 exon 5; Set C
gggagagaagugggguugagcauggg

SEQ ID NO: 28613 - RNA, 25 nt, Artificial Sequence
  Synthetic Oligonucleotide; PRDM1 exon 5; Set A
gggagagaagugggguugagcaugg

SEQ ID NO: 28614 - RNA, 23 nt, Artificial Sequence
  Synthetic Oligonucleotide; PRDM1 exon 5; Set A
ggagagaagugggguugagcaug

SEQ ID NO: 28615 - RNA, 24 nt, Artificial Sequence
  Synthetic Oligonucleotide; PRDM1 exon 5; Set A
gggagagaagugggguugagcaug

SEQ ID NO: 28616 - RNA, 33 nt, Artificial Sequence
  Synthetic Oligonucleotide; PRDM1 exon 5; Set C
cgagcucgggagagaagugggguugagcauggg

SEQ ID NO: 28617 - RNA, 32 nt, Artificial Sequence
  Synthetic Oligonucleotide; PRDM1 exon 5; Set C
cgagcucgggagagaagugggguugagcaugg

SEQ ID NO: 28618 - RNA, 31 nt, Artificial Sequence
  Synthetic Oligonucleotide; PRDM1 exon 5; Set C
cgagcucgggagagaagugggguugagcaug

SEQ ID NO: 28619 - RNA, 40 nt, Artificial Sequence
  Synthetic Oligonucleotide; PRDM1 exon 5; Set C
agggcagcgagcucgggagagaagugggguugagcauggg

SEQ ID NO: 28620 - RNA, 39 nt, Artificial Sequence
  Synthetic Oligonucleotide; PRDM1 exon 5; Set C
agggcagcgagcucgggagagaagugggguugagcaugg

SEQ ID NO: 28621 - RNA, 40 nt, Artificial Sequence
  Synthetic Oligonucleotide; PRDM1 exon 5; Set C
gagggcagcgagcucgggagagaagugggguugagcaugg

SEQ ID NO: 28622 - RNA, 38 nt, Artificial Sequence
  Synthetic Oligonucleotide; PRDM1 exon 5; Set C
agggcagcgagcucgggagagaagugggguugagcaug

SEQ ID NO: 28623 - RNA, 39 nt, Artificial Sequence
  Synthetic Oligonucleotide; PRDM1 exon 5; Set C
gagggcagcgagcucgggagagaagugggguugagcaug

SEQ ID NO: 28624 - RNA, 40 nt, Artificial Sequence
  Synthetic Oligonucleotide; PRDM1 exon 5; Set C
ugagggcagcgagcucgggagagaagugggguugagcaug

SEQ ID NO: 28625 - RNA, 21 nt, Artificial Sequence
  Synthetic Oligonucleotide; PRDM1 exon 5; Set A
cgagcucgggagagaaguggg

SEQ ID NO: 28626 - RNA, 20 nt, Artificial Sequence
  Synthetic Oligonucleotide; PRDM1 exon 5; Set A
cgagcucgggagagaagugg

SEQ ID NO: 28627 - RNA, 19 nt, Artificial Sequence
  Synthetic Oligonucleotide; PRDM1 exon 5; Set C
cgagcucgggagagaagug

SEQ ID NO: 28628 - RNA, 18 nt, Artificial Sequence
  Synthetic Oligonucleotide; PRDM1 exon 5; Set C
cgagcucgggagagaagu

SEQ ID NO: 28629 - RNA, 31 nt, Artificial Sequence
  Synthetic Oligonucleotide; PRDM1 exon 5; Set C
agggcagcgagcucgggagagaagugggguu

SEQ ID NO: 28630 - RNA, 17 nt, Artificial Sequence
  Synthetic Oligonucleotide; PRDM1 exon 5; Set C
cgagcucgggagagaag

SEQ ID NO: 28631 - RNA, 30 nt, Artificial Sequence
  Synthetic Oligonucleotide; PRDM1 exon 5; Set C
agggcagcgagcucgggagagaaguggggu

SEQ ID NO: 28632 - RNA, 32 nt, Artificial Sequence
  Synthetic Oligonucleotide; PRDM1 exon 5; Set C
gagggcagcgagcucgggagagaagugggguu

SEQ ID NO: 28633 - RNA, 16 nt, Artificial Sequence
  Synthetic Oligonucleotide; PRDM1 exon 5; Set C
cgagcucgggagagaa

SEQ ID NO: 28634 - RNA, 31 nt, Artificial Sequence
  Synthetic Oligonucleotide; PRDM1 exon 5; Set C
gagggcagcgagcucgggagagaaguggggu

SEQ ID NO: 28635 - RNA, 29 nt, Artificial Sequence
  Synthetic Oligonucleotide; PRDM1 exon 5; Set C
agggcagcgagcucgggagagaagugggg

SEQ ID NO: 28636 - RNA, 15 nt, Artificial Sequence
  Synthetic Oligonucleotide; PRDM1 exon 5; Set C
cgagcucgggagaga

SEQ ID NO: 28637 - RNA, 33 nt, Artificial Sequence
  Synthetic Oligonucleotide; PRDM1 exon 5; Set C
ugagggcagcgagcucgggagagaagugggguu

SEQ ID NO: 28638 - RNA, 32 nt, Artificial Sequence
  Synthetic Oligonucleotide; PRDM1 exon 5; Set C
ugagggcagcgagcucgggagagaaguggggu

SEQ ID NO: 28639 - RNA, 30 nt, Artificial Sequence
  Synthetic Oligonucleotide; PRDM1 exon 5; Set C
gagggcagcgagcucgggagagaagugggg

SEQ ID NO: 28640 - RNA, 28 nt, Artificial Sequence
  Synthetic Oligonucleotide; PRDM1 exon 5; Set C
agggcagcgagcucgggagagaaguggg

SEQ ID NO: 28641 - RNA, 34 nt, Artificial Sequence
  Synthetic Oligonucleotide; PRDM1 exon 5; Set C
cugagggcagcgagcucgggagagaagugggguu

SEQ ID NO: 28642 - RNA, 33 nt, Artificial Sequence
  Synthetic Oligonucleotide; PRDM1 exon 5; Set C
cugagggcagcgagcucgggagagaaguggggu

SEQ ID NO: 28643 - RNA, 31 nt, Artificial Sequence
  Synthetic Oligonucleotide; PRDM1 exon 5; Set C
ugagggcagcgagcucgggagagaagugggg

SEQ ID NO: 28644 - RNA, 29 nt, Artificial Sequence
  Synthetic Oligonucleotide; PRDM1 exon 5; Set C
gagggcagcgagcucgggagagaaguggg

SEQ ID NO: 28645 - RNA, 35 nt, Artificial Sequence
  Synthetic Oligonucleotide; PRDM1 exon 5; Set C
ucugagggcagcgagcucgggagagaagugggguu

SEQ ID NO: 28646 - RNA, 27 nt, Artificial Sequence
  Synthetic Oligonucleotide; PRDM1 exon 5; Set C
agggcagcgagcucgggagagaagugg

SEQ ID NO: 28647 - RNA, 34 nt, Artificial Sequence
  Synthetic Oligonucleotide; PRDM1 exon 5; Set C
ucugagggcagcgagcucgggagagaaguggggu

SEQ ID NO: 28648 - RNA, 32 nt, Artificial Sequence
  Synthetic Oligonucleotide; PRDM1 exon 5; Set C
cugagggcagcgagcucgggagagaagugggg

SEQ ID NO: 28649 - RNA, 30 nt, Artificial Sequence
  Synthetic Oligonucleotide; PRDM1 exon 5; Set C
ugagggcagcgagcucgggagagaaguggg

SEQ ID NO: 28650 - RNA, 36 nt, Artificial Sequence
  Synthetic Oligonucleotide; PRDM1 exon 5; Set C
aucugagggcagcgagcucgggagagaagugggguu

SEQ ID NO: 28651 - RNA, 28 nt, Artificial Sequence
  Synthetic Oligonucleotide; PRDM1 exon 5; Set C
gagggcagcgagcucgggagagaagugg

SEQ ID NO: 28652 - RNA, 26 nt, Artificial Sequence
  Synthetic Oligonucleotide; PRDM1 exon 5; Set C
agggcagcgagcucgggagagaagug

SEQ ID NO: 28653 - RNA, 35 nt, Artificial Sequence
  Synthetic Oligonucleotide; PRDM1 exon 5; Set C
aucugagggcagcgagcucgggagagaaguggggu

SEQ ID NO: 28654 - RNA, 33 nt, Artificial Sequence
  Synthetic Oligonucleotide; PRDM1 exon 5; Set C
ucugagggcagcgagcucgggagagaagugggg

SEQ ID NO: 28655 - RNA, 31 nt, Artificial Sequence
  Synthetic Oligonucleotide; PRDM1 exon 5; Set C
cugagggcagcgagcucgggagagaaguggg

SEQ ID NO: 28656 - RNA, 29 nt, Artificial Sequence
  Synthetic Oligonucleotide; PRDM1 exon 5; Set C
ugagggcagcgagcucgggagagaagugg

SEQ ID NO: 28657 - RNA, 27 nt, Artificial Sequence
  Synthetic Oligonucleotide; PRDM1 exon 5; Set C
gagggcagcgagcucgggagagaagug

SEQ ID NO: 28658 - RNA, 25 nt, Artificial Sequence
  Synthetic Oligonucleotide; PRDM1 exon 5; Set C
agggcagcgagcucgggagagaagu

SEQ ID NO: 28659 - RNA, 34 nt, Artificial Sequence
  Synthetic Oligonucleotide; PRDM1 exon 5; Set C
aucugagggcagcgagcucgggagagaagugggg

SEQ ID NO: 28660 - RNA, 32 nt, Artificial Sequence
  Synthetic Oligonucleotide; PRDM1 exon 5; Set C
ucugagggcagcgagcucgggagagaaguggg

SEQ ID NO: 28661 - RNA, 30 nt, Artificial Sequence
  Synthetic Oligonucleotide; PRDM1 exon 5; Set C
cugagggcagcgagcucgggagagaagugg

SEQ ID NO: 28662 - RNA, 28 nt, Artificial Sequence
  Synthetic Oligonucleotide; PRDM1 exon 5; Set C
ugagggcagcgagcucgggagagaagug

SEQ ID NO: 28663 - RNA, 24 nt, Artificial Sequence
  Synthetic Oligonucleotide; PRDM1 exon 5; Set C
agggcagcgagcucgggagagaag

SEQ ID NO: 28664 - RNA, 26 nt, Artificial Sequence
  Synthetic Oligonucleotide; PRDM1 exon 5; Set C
gagggcagcgagcucgggagagaagu

SEQ ID NO: 28665 - RNA, 33 nt, Artificial Sequence
  Synthetic Oligonucleotide; PRDM1 exon 5; Set C
aucugagggcagcgagcucgggagagaaguggg

SEQ ID NO: 28666 - RNA, 23 nt, Artificial Sequence
  Synthetic Oligonucleotide; PRDM1 exon 5; Set C
agggcagcgagcucgggagagaa

SEQ ID NO: 28667 - RNA, 31 nt, Artificial Sequence
  Synthetic Oligonucleotide; PRDM1 exon 5; Set C
ucugagggcagcgagcucgggagagaagugg

SEQ ID NO: 28668 - RNA, 29 nt, Artificial Sequence
  Synthetic Oligonucleotide; PRDM1 exon 5; Set C
cugagggcagcgagcucgggagagaagug

SEQ ID NO: 28669 - RNA, 25 nt, Artificial Sequence
  Synthetic Oligonucleotide; PRDM1 exon 5; Set C
gagggcagcgagcucgggagagaag

SEQ ID NO: 28670 - RNA, 27 nt, Artificial Sequence
  Synthetic Oligonucleotide; PRDM1 exon 5; Set C
ugagggcagcgagcucgggagagaagu

SEQ ID NO: 28671 - RNA, 22 nt, Artificial Sequence
  Synthetic Oligonucleotide; PRDM1 exon 5; Set C
agggcagcgagcucgggagaga

SEQ ID NO: 28672 - RNA, 24 nt, Artificial Sequence
  Synthetic Oligonucleotide; PRDM1 exon 5; Set C
gagggcagcgagcucgggagagaa

SEQ ID NO: 28673 - RNA, 32 nt, Artificial Sequence
  Synthetic Oligonucleotide; PRDM1 exon 5; Set C
aucugagggcagcgagcucgggagagaagugg

SEQ ID NO: 28674 - RNA, 30 nt, Artificial Sequence
  Synthetic Oligonucleotide; PRDM1 exon 5; Set C
ucugagggcagcgagcucgggagagaagug

SEQ ID NO: 28675 - RNA, 26 nt, Artificial Sequence
  Synthetic Oligonucleotide; PRDM1 exon 5; Set C
ugagggcagcgagcucgggagagaag

SEQ ID NO: 28676 - RNA, 28 nt, Artificial Sequence
  Synthetic Oligonucleotide; PRDM1 exon 5; Set C
cugagggcagcgagcucgggagagaagu

SEQ ID NO: 28677 - RNA, 21 nt, Artificial Sequence
  Synthetic Oligonucleotide; PRDM1 exon 5; Set C
agggcagcgagcucgggagag

SEQ ID NO: 28678 - RNA, 23 nt, Artificial Sequence
  Synthetic Oligonucleotide; PRDM1 exon 5; Set C
gagggcagcgagcucgggagaga

SEQ ID NO: 28679 - RNA, 25 nt, Artificial Sequence
  Synthetic Oligonucleotide; PRDM1 exon 5; Set C
ugagggcagcgagcucgggagagaa

SEQ ID NO: 28680 - RNA, 31 nt, Artificial Sequence
  Synthetic Oligonucleotide; PRDM1 exon 5; Set C
aucugagggcagcgagcucgggagagaagug

SEQ ID NO: 28681 - RNA, 27 nt, Artificial Sequence
  Synthetic Oligonucleotide; PRDM1 exon 5; Set C
cugagggcagcgagcucgggagagaag

SEQ ID NO: 28682 - RNA, 29 nt, Artificial Sequence
  Synthetic Oligonucleotide; PRDM1 exon 5; Set C
ucugagggcagcgagcucgggagagaagu

SEQ ID NO: 28683 - RNA, 22 nt, Artificial Sequence
  Synthetic Oligonucleotide; PRDM1 exon 5; Set C
gagggcagcgagcucgggagag

SEQ ID NO: 28684 - RNA, 24 nt, Artificial Sequence
  Synthetic Oligonucleotide; PRDM1 exon 5; Set C
ugagggcagcgagcucgggagaga

SEQ ID NO: 28685 - RNA, 20 nt, Artificial Sequence
  Synthetic Oligonucleotide; PRDM1 exon 5; Set C
agggcagcgagcucgggaga

SEQ ID NO: 28686 - RNA, 26 nt, Artificial Sequence
  Synthetic Oligonucleotide; PRDM1 exon 5; Set C
cugagggcagcgagcucgggagagaa

SEQ ID NO: 28687 - RNA, 28 nt, Artificial Sequence
  Synthetic Oligonucleotide; PRDM1 exon 5; Set C
ucugagggcagcgagcucgggagagaag

SEQ ID NO: 28688 - RNA, 30 nt, Artificial Sequence
  Synthetic Oligonucleotide; PRDM1 exon 5; Set C
aucugagggcagcgagcucgggagagaagu

SEQ ID NO: 28689 - RNA, 23 nt, Artificial Sequence
  Synthetic Oligonucleotide; PRDM1 exon 5; Set C
ugagggcagcgagcucgggagag

SEQ ID NO: 28690 - RNA, 25 nt, Artificial Sequence
  Synthetic Oligonucleotide; PRDM1 exon 5; Set C
cugagggcagcgagcucgggagaga

SEQ ID NO: 28691 - RNA, 19 nt, Artificial Sequence
  Synthetic Oligonucleotide; PRDM1 exon 5; Set A
agggcagcgagcucgggag

SEQ ID NO: 28692 - RNA, 21 nt, Artificial Sequence
  Synthetic Oligonucleotide; PRDM1 exon 5; Set C
gagggcagcgagcucgggaga

SEQ ID NO: 28693 - RNA, 27 nt, Artificial Sequence
  Synthetic Oligonucleotide; PRDM1 exon 5; Set C
ucugagggcagcgagcucgggagagaa

SEQ ID NO: 28694 - RNA, 29 nt, Artificial Sequence
  Synthetic Oligonucleotide; PRDM1 exon 5; Set C
aucugagggcagcgagcucgggagagaag

SEQ ID NO: 28695 - RNA, 26 nt, Artificial Sequence
  Synthetic Oligonucleotide; PRDM1 exon 5; Set C
ucugagggcagcgagcucgggagaga

SEQ ID NO: 28696 - RNA, 24 nt, Artificial Sequence
  Synthetic Oligonucleotide; PRDM1 exon 5; Set C
cugagggcagcgagcucgggagag

SEQ ID NO: 28697 - RNA, 20 nt, Artificial Sequence
  Synthetic Oligonucleotide; PRDM1 exon 5; Set C
gagggcagcgagcucgggag

SEQ ID NO: 28698 - RNA, 28 nt, Artificial Sequence
  Synthetic Oligonucleotide; PRDM1 exon 5; Set C
aucugagggcagcgagcucgggagagaa

SEQ ID NO: 28699 - RNA, 22 nt, Artificial Sequence
  Synthetic Oligonucleotide; PRDM1 exon 5; Set C
ugagggcagcgagcucgggaga

SEQ ID NO: 28700 - RNA, 27 nt, Artificial Sequence
  Synthetic Oligonucleotide; PRDM1 exon 5; Set C
aucugagggcagcgagcucgggagaga

SEQ ID NO: 28701 - RNA, 25 nt, Artificial Sequence
  Synthetic Oligonucleotide; PRDM1 exon 5; Set C
ucugagggcagcgagcucgggagag

SEQ ID NO: 28702 - RNA, 21 nt, Artificial Sequence
  Synthetic Oligonucleotide; PRDM1 exon 5; Set C
ugagggcagcgagcucgggag

SEQ ID NO: 28703 - RNA, 23 nt, Artificial Sequence
  Synthetic Oligonucleotide; PRDM1 exon 5; Set C
cugagggcagcgagcucgggaga

SEQ ID NO: 28704 - RNA, 26 nt, Artificial Sequence
  Synthetic Oligonucleotide; PRDM1 exon 5; Set C
aucugagggcagcgagcucgggagag

SEQ ID NO: 28705 - RNA, 22 nt, Artificial Sequence
  Synthetic Oligonucleotide; PRDM1 exon 5; Set C
cugagggcagcgagcucgggag

SEQ ID NO: 28706 - RNA, 24 nt, Artificial Sequence
  Synthetic Oligonucleotide; PRDM1 exon 5; Set C
ucugagggcagcgagcucgggaga

SEQ ID NO: 28707 - RNA, 20 nt, Artificial Sequence
  Synthetic Oligonucleotide; PRDM1 exon 5; Set C
ugagggcagcgagcucggga

SEQ ID NO: 28708 - RNA, 23 nt, Artificial Sequence
  Synthetic Oligonucleotide; PRDM1 exon 5; Set C
ucugagggcagcgagcucgggag

SEQ ID NO: 28709 - RNA, 25 nt, Artificial Sequence
  Synthetic Oligonucleotide; PRDM1 exon 5; Set C
aucugagggcagcgagcucgggaga

SEQ ID NO: 28710 - RNA, 21 nt, Artificial Sequence
  Synthetic Oligonucleotide; PRDM1 exon 5; Set C
cugagggcagcgagcucggga

SEQ ID NO: 28711 - RNA, 24 nt, Artificial Sequence
  Synthetic Oligonucleotide; PRDM1 exon 5; Set C
aucugagggcagcgagcucgggag

SEQ ID NO: 28712 - RNA, 22 nt, Artificial Sequence
  Synthetic Oligonucleotide; PRDM1 exon 5; Set C
ucugagggcagcgagcucggga

SEQ ID NO: 28713 - RNA, 23 nt, Artificial Sequence
  Synthetic Oligonucleotide; PRDM1 exon 5; Set C
aucugagggcagcgagcucggga

SEQ ID NO: 28714 - RNA, 21 nt, Artificial Sequence
  Synthetic Oligonucleotide; PRDM1 exon 5; Set C
ucugagggcagcgagcucggg

SEQ ID NO: 28715 - RNA, 22 nt, Artificial Sequence
  Synthetic Oligonucleotide; PRDM1 exon 5; Set C
aucugagggcagcgagcucggg

SEQ ID NO: 28716 - RNA, 15 nt, Artificial Sequence
  Synthetic Oligonucleotide; PRDM1 exon 5; Set C
aucugagggcagcga

SEQ ID NO: 28717 - RNA, 23 nt, Artificial Sequence
  Synthetic Oligonucleotide; PRDM1 exon 5; Set C
gugggagacccgcuuguggggcu

SEQ ID NO: 28718 - RNA, 17 nt, Artificial Sequence
  Synthetic Oligonucleotide; PRDM1 exon 5; Set B
gugggagacccgcuugu

SEQ ID NO: 28719 - RNA, 16 nt, Artificial Sequence
  Synthetic Oligonucleotide; PRDM1 exon 5; Set B
gugggagacccgcuug

SEQ ID NO: 28720 - RNA, 15 nt, Artificial Sequence
  Synthetic Oligonucleotide; PRDM1 exon 5; Set C
gugggagacccgcuu

SEQ ID NO: 28721 - RNA, 15 nt, Artificial Sequence
  Synthetic Oligonucleotide; PRDM1 exon 5; Set C
uuuuuaaugagauuc

SEQ ID NO: 28722 - RNA, 16 nt, Artificial Sequence
  Synthetic Oligonucleotide; PRDM1 exon 5; Set C
guuuuuaaugagauuc

SEQ ID NO: 28723 - RNA, 15 nt, Artificial Sequence
  Synthetic Oligonucleotide; PRDM1 exon 5; Set C
guuuuuaaugagauu

SEQ ID NO: 28724 - RNA, 17 nt, Artificial Sequence
  Synthetic Oligonucleotide; PRDM1 exon 5; Set C
uguuuuuaaugagauuc

SEQ ID NO: 28725 - RNA, 16 nt, Artificial Sequence
  Synthetic Oligonucleotide; PRDM1 exon 5; Set C
uguuuuuaaugagauu

SEQ ID NO: 28726 - RNA, 18 nt, Artificial Sequence
  Synthetic Oligonucleotide; PRDM1 exon 5; Set C
uuguuuuuaaugagauuc

SEQ ID NO: 28727 - RNA, 17 nt, Artificial Sequence
  Synthetic Oligonucleotide; PRDM1 exon 5; Set C
uuguuuuuaaugagauu

SEQ ID NO: 28728 - RNA, 15 nt, Artificial Sequence
  Synthetic Oligonucleotide; PRDM1 exon 5; Set C
uguuuuuaaugagau

SEQ ID NO: 28729 - RNA, 19 nt, Artificial Sequence
  Synthetic Oligonucleotide; PRDM1 exon 5; Set C
uuuguuuuuaaugagauuc

SEQ ID NO: 28730 - RNA, 18 nt, Artificial Sequence
  Synthetic Oligonucleotide; PRDM1 exon 5; Set C
uuuguuuuuaaugagauu

SEQ ID NO: 28731 - RNA, 16 nt, Artificial Sequence
  Synthetic Oligonucleotide; PRDM1 exon 5; Set C
uuguuuuuaaugagau

SEQ ID NO: 28732 - RNA, 17 nt, Artificial Sequence
  Synthetic Oligonucleotide; PRDM1 exon 5; Set C
uuuguuuuuaaugagau

SEQ ID NO: 28733 - RNA, 15 nt, Artificial Sequence
  Synthetic Oligonucleotide; PRDM1 exon 5; Set C
uuguuuuuaaugaga

SEQ ID NO: 28734 - RNA, 16 nt, Artificial Sequence
  Synthetic Oligonucleotide; PRDM1 exon 5; Set C
uuuguuuuuaaugaga

SEQ ID NO: 28735 - RNA, 22 nt, Artificial Sequence
  Synthetic Oligonucleotide; PRDM1 exon 5; Set C
uucuuuuguuuuuaaugagauu

SEQ ID NO: 28736 - RNA, 24 nt, Artificial Sequence
  Synthetic Oligonucleotide; PRDM1 exon 5; Set C
uuucuuuuguuuuuaaugagauuc

SEQ ID NO: 28737 - RNA, 23 nt, Artificial Sequence
  Synthetic Oligonucleotide; PRDM1 exon 5; Set C
uuucuuuuguuuuuaaugagauu

SEQ ID NO: 28738 - RNA, 21 nt, Artificial Sequence
  Synthetic Oligonucleotide; PRDM1 exon 5; Set C
uucuuuuguuuuuaaugagau

SEQ ID NO: 28739 - RNA, 22 nt, Artificial Sequence
  Synthetic Oligonucleotide; PRDM1 exon 5; Set C
uuucuuuuguuuuuaaugagau

SEQ ID NO: 28740 - RNA, 21 nt, Artificial Sequence
  Synthetic Oligonucleotide; PRDM1 exon 5; Set C
uuucuuuuguuuuuaaugaga

SEQ ID NO: 28741 - RNA, 17 nt, Artificial Sequence
  Synthetic Oligonucleotide; PRDM1 exon 5; Set C
uucuuuuguuuuuaaug

SEQ ID NO: 28742 - RNA, 16 nt, Artificial Sequence
  Synthetic Oligonucleotide; PRDM1 exon 5; Set C
uucuuuuguuuuuaau

SEQ ID NO: 28743 - RNA, 28 nt, Artificial Sequence
  Synthetic Oligonucleotide; PRDM1 exon 5; Set C
ucauguuucuuuuguuuuuaaugagauu

SEQ ID NO: 28744 - RNA, 18 nt, Artificial Sequence
  Synthetic Oligonucleotide; PRDM1 exon 5; Set C
uuucuuuuguuuuuaaug

SEQ ID NO: 28745 - RNA, 15 nt, Artificial Sequence
  Synthetic Oligonucleotide; PRDM1 exon 5; Set C
uucuuuuguuuuuaa

SEQ ID NO: 28746 - RNA, 17 nt, Artificial Sequence
  Synthetic Oligonucleotide; PRDM1 exon 5; Set C
uuucuuuuguuuuuaau

SEQ ID NO: 28747 - RNA, 27 nt, Artificial Sequence
  Synthetic Oligonucleotide; PRDM1 exon 5; Set C
ucauguuucuuuuguuuuuaaugagau

SEQ ID NO: 28748 - RNA, 30 nt, Artificial Sequence
  Synthetic Oligonucleotide; PRDM1 exon 5; Set C
ggucauguuucuuuuguuuuuaaugagauu

SEQ ID NO: 28749 - RNA, 17 nt, Artificial Sequence
  Synthetic Oligonucleotide; PRDM1 exon 5; Set C
guuucuuuuguuuuuaa

SEQ ID NO: 28750 - RNA, 29 nt, Artificial Sequence
  Synthetic Oligonucleotide; PRDM1 exon 5; Set C
ggucauguuucuuuuguuuuuaaugagau

SEQ ID NO: 28751 - RNA, 16 nt, Artificial Sequence
  Synthetic Oligonucleotide; PRDM1 exon 5; Set C
guuucuuuuguuuuua

SEQ ID NO: 28752 - RNA, 18 nt, Artificial Sequence
  Synthetic Oligonucleotide; PRDM1 exon 5; Set C
uguuucuuuuguuuuuaa

SEQ ID NO: 28753 - RNA, 15 nt, Artificial Sequence
  Synthetic Oligonucleotide; PRDM1 exon 5; Set C
guuucuuuuguuuuu

SEQ ID NO: 28754 - RNA, 17 nt, Artificial Sequence
  Synthetic Oligonucleotide; PRDM1 exon 5; Set C
uguuucuuuuguuuuua

SEQ ID NO: 28755 - RNA, 16 nt, Artificial Sequence
  Synthetic Oligonucleotide; PRDM1 exon 5; Set C
uguuucuuuuguuuuu

SEQ ID NO: 28756 - RNA, 22 nt, Artificial Sequence
  Synthetic Oligonucleotide; PRDM1 exon 5; Set C
ucauguuucuuuuguuuuuaau

SEQ ID NO: 28757 - RNA, 21 nt, Artificial Sequence
  Synthetic Oligonucleotide; PRDM1 exon 5; Set C
ucauguuucuuuuguuuuuaa

SEQ ID NO: 28758 - RNA, 23 nt, Artificial Sequence
  Synthetic Oligonucleotide; PRDM1 exon 5; Set C
gucauguuucuuuuguuuuuaau

SEQ ID NO: 28759 - RNA, 25 nt, Artificial Sequence
  Synthetic Oligonucleotide; PRDM1 exon 5; Set C
ggucauguuucuuuuguuuuuaaug

SEQ ID NO: 28760 - RNA, 20 nt, Artificial Sequence
  Synthetic Oligonucleotide; PRDM1 exon 5; Set C
ucauguuucuuuuguuuuua

SEQ ID NO: 28761 - RNA, 22 nt, Artificial Sequence
  Synthetic Oligonucleotide; PRDM1 exon 5; Set C
gucauguuucuuuuguuuuuaa

SEQ ID NO: 28762 - RNA, 24 nt, Artificial Sequence
  Synthetic Oligonucleotide; PRDM1 exon 5; Set C
ggucauguuucuuuuguuuuuaau

SEQ ID NO: 28763 - RNA, 19 nt, Artificial Sequence
  Synthetic Oligonucleotide; PRDM1 exon 5; Set C
ucauguuucuuuuguuuuu

SEQ ID NO: 28764 - RNA, 21 nt, Artificial Sequence
  Synthetic Oligonucleotide; PRDM1 exon 5; Set C
gucauguuucuuuuguuuuua

SEQ ID NO: 28765 - RNA, 23 nt, Artificial Sequence
  Synthetic Oligonucleotide; PRDM1 exon 5; Set C
ggucauguuucuuuuguuuuuaa

SEQ ID NO: 28766 - RNA, 37 nt, Artificial Sequence
  Synthetic Oligonucleotide; PRDM1 exon 5; Set B
uguagccggucauguuucuuuuguuuuuaaugagauu

SEQ ID NO: 28767 - RNA, 22 nt, Artificial Sequence
  Synthetic Oligonucleotide; PRDM1 exon 5; Set C
ggucauguuucuuuuguuuuua

SEQ ID NO: 28768 - RNA, 18 nt, Artificial Sequence
  Synthetic Oligonucleotide; PRDM1 exon 5; Set C
ucauguuucuuuuguuuu

SEQ ID NO: 28769 - RNA, 20 nt, Artificial Sequence
  Synthetic Oligonucleotide; PRDM1 exon 5; Set C
gucauguuucuuuuguuuuu

SEQ ID NO: 28770 - RNA, 38 nt, Artificial Sequence
  Synthetic Oligonucleotide; PRDM1 exon 5; Set B
uuguagccggucauguuucuuuuguuuuuaaugagauu

SEQ ID NO: 28771 - RNA, 36 nt, Artificial Sequence
  Synthetic Oligonucleotide; PRDM1 exon 5; Set B
uguagccggucauguuucuuuuguuuuuaaugagau

SEQ ID NO: 28772 - RNA, 21 nt, Artificial Sequence
  Synthetic Oligonucleotide; PRDM1 exon 5; Set C
ggucauguuucuuuuguuuuu

SEQ ID NO: 28773 - RNA, 17 nt, Artificial Sequence
  Synthetic Oligonucleotide; PRDM1 exon 5; Set C
ucauguuucuuuuguuu

SEQ ID NO: 28774 - RNA, 19 nt, Artificial Sequence
  Synthetic Oligonucleotide; PRDM1 exon 5; Set C
gucauguuucuuuuguuuu

SEQ ID NO: 28775 - RNA, 35 nt, Artificial Sequence
  Synthetic Oligonucleotide; PRDM1 exon 5; Set B
uguagccggucauguuucuuuuguuuuuaaugaga

SEQ ID NO: 28776 - RNA, 20 nt, Artificial Sequence
  Synthetic Oligonucleotide; PRDM1 exon 5; Set C
ggucauguuucuuuuguuuu

SEQ ID NO: 28777 - RNA, 16 nt, Artificial Sequence
  Synthetic Oligonucleotide; PRDM1 exon 5; Set C
ucauguuucuuuuguu

SEQ ID NO: 28778 - RNA, 18 nt, Artificial Sequence
  Synthetic Oligonucleotide; PRDM1 exon 5; Set C
gucauguuucuuuuguuu

SEQ ID NO: 28779 - RNA, 19 nt, Artificial Sequence
  Synthetic Oligonucleotide; PRDM1 exon 5; Set C
ggucauguuucuuuuguuu

SEQ ID NO: 28780 - RNA, 15 nt, Artificial Sequence
  Synthetic Oligonucleotide; PRDM1 exon 5; Set C
ucauguuucuuuugu

SEQ ID NO: 28781 - RNA, 17 nt, Artificial Sequence
  Synthetic Oligonucleotide; PRDM1 exon 5; Set C
gucauguuucuuuuguu

SEQ ID NO: 28782 - RNA, 18 nt, Artificial Sequence
  Synthetic Oligonucleotide; PRDM1 exon 5; Set C
ggucauguuucuuuuguu

SEQ ID NO: 28783 - RNA, 16 nt, Artificial Sequence
  Synthetic Oligonucleotide; PRDM1 exon 5; Set C
gucauguuucuuuugu

SEQ ID NO: 28784 - RNA, 32 nt, Artificial Sequence
  Synthetic Oligonucleotide; PRDM1 exon 5; Set B
uguagccggucauguuucuuuuguuuuuaaug

SEQ ID NO: 28785 - RNA, 15 nt, Artificial Sequence
  Synthetic Oligonucleotide; PRDM1 exon 5; Set C
gucauguuucuuuug

SEQ ID NO: 28786 - RNA, 17 nt, Artificial Sequence
  Synthetic Oligonucleotide; PRDM1 exon 5; Set C
ggucauguuucuuuugu

SEQ ID NO: 28787 - RNA, 31 nt, Artificial Sequence
  Synthetic Oligonucleotide; PRDM1 exon 5; Set B
uguagccggucauguuucuuuuguuuuuaau

SEQ ID NO: 28788 - RNA, 16 nt, Artificial Sequence
  Synthetic Oligonucleotide; PRDM1 exon 5; Set C
ggucauguuucuuuug

SEQ ID NO: 28789 - RNA, 30 nt, Artificial Sequence
  Synthetic Oligonucleotide; PRDM1 exon 5; Set B
uguagccggucauguuucuuuuguuuuuaa

SEQ ID NO: 28790 - RNA, 32 nt, Artificial Sequence
  Synthetic Oligonucleotide; PRDM1 exon 5; Set B
uuguagccggucauguuucuuuuguuuuuaau

SEQ ID NO: 28791 - RNA, 15 nt, Artificial Sequence
  Synthetic Oligonucleotide; PRDM1 exon 5; Set C
ggucauguuucuuuu

SEQ ID NO: 28792 - RNA, 29 nt, Artificial Sequence
  Synthetic Oligonucleotide; PRDM1 exon 5; Set B
uguagccggucauguuucuuuuguuuuua

SEQ ID NO: 28793 - RNA, 31 nt, Artificial Sequence
  Synthetic Oligonucleotide; PRDM1 exon 5; Set B
uuguagccggucauguuucuuuuguuuuuaa

SEQ ID NO: 28794 - RNA, 28 nt, Artificial Sequence
  Synthetic Oligonucleotide; PRDM1 exon 5; Set B
uguagccggucauguuucuuuuguuuuu

SEQ ID NO: 28795 - RNA, 30 nt, Artificial Sequence
  Synthetic Oligonucleotide; PRDM1 exon 5; Set B
uuguagccggucauguuucuuuuguuuuua

SEQ ID NO: 28796 - RNA, 27 nt, Artificial Sequence
  Synthetic Oligonucleotide; PRDM1 exon 5; Set B
uguagccggucauguuucuuuuguuuu

SEQ ID NO: 28797 - RNA, 29 nt, Artificial Sequence
  Synthetic Oligonucleotide; PRDM1 exon 5; Set B
uuguagccggucauguuucuuuuguuuuu

SEQ ID NO: 28798 - RNA, 37 nt, Artificial Sequence
  Synthetic Oligonucleotide; PRDM1 exon 5; Set C
ggucuuguagccggucauguuucuuuuguuuuuaaug

SEQ ID NO: 28799 - RNA, 26 nt, Artificial Sequence
  Synthetic Oligonucleotide; PRDM1 exon 5; Set B
uguagccggucauguuucuuuuguuu

SEQ ID NO: 28800 - RNA, 28 nt, Artificial Sequence
  Synthetic Oligonucleotide; PRDM1 exon 5; Set B
uuguagccggucauguuucuuuuguuuu

SEQ ID NO: 28801 - RNA, 36 nt, Artificial Sequence
  Synthetic Oligonucleotide; PRDM1 exon 5; Set C
ggucuuguagccggucauguuucuuuuguuuuuaau

SEQ ID NO: 28802 - RNA, 38 nt, Artificial Sequence
  Synthetic Oligonucleotide; PRDM1 exon 5; Set C
gggucuuguagccggucauguuucuuuuguuuuuaaug

SEQ ID NO: 28803 - RNA, 25 nt, Artificial Sequence
  Synthetic Oligonucleotide; PRDM1 exon 5; Set B
uguagccggucauguuucuuuuguu

SEQ ID NO: 28804 - RNA, 27 nt, Artificial Sequence
  Synthetic Oligonucleotide; PRDM1 exon 5; Set B
uuguagccggucauguuucuuuuguuu

SEQ ID NO: 28805 - RNA, 35 nt, Artificial Sequence
  Synthetic Oligonucleotide; PRDM1 exon 5; Set C
ggucuuguagccggucauguuucuuuuguuuuuaa

SEQ ID NO: 28806 - RNA, 37 nt, Artificial Sequence
  Synthetic Oligonucleotide; PRDM1 exon 5; Set C
gggucuuguagccggucauguuucuuuuguuuuuaau

SEQ ID NO: 28807 - RNA, 39 nt, Artificial Sequence
  Synthetic Oligonucleotide; PRDM1 exon 5; Set C
agggucuuguagccggucauguuucuuuuguuuuuaaug

SEQ ID NO: 28808 - RNA, 24 nt, Artificial Sequence
  Synthetic Oligonucleotide; PRDM1 exon 5; Set B
uguagccggucauguuucuuuugu

SEQ ID NO: 28809 - RNA, 34 nt, Artificial Sequence
  Synthetic Oligonucleotide; PRDM1 exon 5; Set C
ggucuuguagccggucauguuucuuuuguuuuua

SEQ ID NO: 28810 - RNA, 26 nt, Artificial Sequence
  Synthetic Oligonucleotide; PRDM1 exon 5; Set B
uuguagccggucauguuucuuuuguu

SEQ ID NO: 28811 - RNA, 36 nt, Artificial Sequence
  Synthetic Oligonucleotide; PRDM1 exon 5; Set C
gggucuuguagccggucauguuucuuuuguuuuuaa

SEQ ID NO: 28812 - RNA, 38 nt, Artificial Sequence
  Synthetic Oligonucleotide; PRDM1 exon 5; Set C
agggucuuguagccggucauguuucuuuuguuuuuaau

SEQ ID NO: 28813 - RNA, 23 nt, Artificial Sequence
  Synthetic Oligonucleotide; PRDM1 exon 5; Set B
uguagccggucauguuucuuuug

SEQ ID NO: 28814 - RNA, 35 nt, Artificial Sequence
  Synthetic Oligonucleotide; PRDM1 exon 5; Set C
gggucuuguagccggucauguuucuuuuguuuuua

SEQ ID NO: 28815 - RNA, 33 nt, Artificial Sequence
  Synthetic Oligonucleotide; PRDM1 exon 5; Set C
ggucuuguagccggucauguuucuuuuguuuuu

SEQ ID NO: 28816 - RNA, 25 nt, Artificial Sequence
  Synthetic Oligonucleotide; PRDM1 exon 5; Set B
uuguagccggucauguuucuuuugu

SEQ ID NO: 28817 - RNA, 37 nt, Artificial Sequence
  Synthetic Oligonucleotide; PRDM1 exon 5; Set C
agggucuuguagccggucauguuucuuuuguuuuuaa

SEQ ID NO: 28818 - RNA, 22 nt, Artificial Sequence
  Synthetic Oligonucleotide; PRDM1 exon 5; Set C
uguagccggucauguuucuuuu

SEQ ID NO: 28819 - RNA, 24 nt, Artificial Sequence
  Synthetic Oligonucleotide; PRDM1 exon 5; Set B
uuguagccggucauguuucuuuug

SEQ ID NO: 28820 - RNA, 36 nt, Artificial Sequence
  Synthetic Oligonucleotide; PRDM1 exon 5; Set C
agggucuuguagccggucauguuucuuuuguuuuua

SEQ ID NO: 28821 - RNA, 34 nt, Artificial Sequence
  Synthetic Oligonucleotide; PRDM1 exon 5; Set C
gggucuuguagccggucauguuucuuuuguuuuu

SEQ ID NO: 28822 - RNA, 32 nt, Artificial Sequence
  Synthetic Oligonucleotide; PRDM1 exon 5; Set C
ggucuuguagccggucauguuucuuuuguuuu

SEQ ID NO: 28823 - RNA, 23 nt, Artificial Sequence
  Synthetic Oligonucleotide; PRDM1 exon 5; Set B
uuguagccggucauguuucuuuu

SEQ ID NO: 28824 - RNA, 35 nt, Artificial Sequence
  Synthetic Oligonucleotide; PRDM1 exon 5; Set C
agggucuuguagccggucauguuucuuuuguuuuu

SEQ ID NO: 28825 - RNA, 33 nt, Artificial Sequence
  Synthetic Oligonucleotide; PRDM1 exon 5; Set C
gggucuuguagccggucauguuucuuuuguuuu

SEQ ID NO: 28826 - RNA, 31 nt, Artificial Sequence
  Synthetic Oligonucleotide; PRDM1 exon 5; Set C
ggucuuguagccggucauguuucuuuuguuu

SEQ ID NO: 28827 - RNA, 34 nt, Artificial Sequence
  Synthetic Oligonucleotide; PRDM1 exon 5; Set C
agggucuuguagccggucauguuucuuuuguuuu

SEQ ID NO: 28828 - RNA, 32 nt, Artificial Sequence
  Synthetic Oligonucleotide; PRDM1 exon 5; Set C
gggucuuguagccggucauguuucuuuuguuu

SEQ ID NO: 28829 - RNA, 30 nt, Artificial Sequence
  Synthetic Oligonucleotide; PRDM1 exon 5; Set C
ggucuuguagccggucauguuucuuuuguu

SEQ ID NO: 28830 - RNA, 33 nt, Artificial Sequence
  Synthetic Oligonucleotide; PRDM1 exon 5; Set C
agggucuuguagccggucauguuucuuuuguuu

SEQ ID NO: 28831 - RNA, 31 nt, Artificial Sequence
  Synthetic Oligonucleotide; PRDM1 exon 5; Set C
gggucuuguagccggucauguuucuuuuguu

SEQ ID NO: 28832 - RNA, 29 nt, Artificial Sequence
  Synthetic Oligonucleotide; PRDM1 exon 5; Set C
ggucuuguagccggucauguuucuuuugu

SEQ ID NO: 28833 - RNA, 28 nt, Artificial Sequence
  Synthetic Oligonucleotide; PRDM1 exon 5; Set B
ggucuuguagccggucauguuucuuuug

SEQ ID NO: 28834 - RNA, 32 nt, Artificial Sequence
  Synthetic Oligonucleotide; PRDM1 exon 5; Set C
agggucuuguagccggucauguuucuuuuguu

SEQ ID NO: 28835 - RNA, 30 nt, Artificial Sequence
  Synthetic Oligonucleotide; PRDM1 exon 5; Set C
gggucuuguagccggucauguuucuuuugu

SEQ ID NO: 28836 - RNA, 18 nt, Artificial Sequence
  Synthetic Oligonucleotide; PRDM1 exon 5; Set C
uguagccggucauguuuc

SEQ ID NO: 28837 - RNA, 17 nt, Artificial Sequence
  Synthetic Oligonucleotide; PRDM1 exon 5; Set C
uguagccggucauguuu

SEQ ID NO: 28838 - RNA, 29 nt, Artificial Sequence
  Synthetic Oligonucleotide; PRDM1 exon 5; Set C
gggucuuguagccggucauguuucuuuug

SEQ ID NO: 28839 - RNA, 27 nt, Artificial Sequence
  Synthetic Oligonucleotide; PRDM1 exon 5; Set B
ggucuuguagccggucauguuucuuuu

SEQ ID NO: 28840 - RNA, 31 nt, Artificial Sequence
  Synthetic Oligonucleotide; PRDM1 exon 5; Set C
agggucuuguagccggucauguuucuuuugu

SEQ ID NO: 28841 - RNA, 18 nt, Artificial Sequence
  Synthetic Oligonucleotide; PRDM1 exon 5; Set C
uuguagccggucauguuu

SEQ ID NO: 28842 - RNA, 30 nt, Artificial Sequence
  Synthetic Oligonucleotide; PRDM1 exon 5; Set C
agggucuuguagccggucauguuucuuuug

SEQ ID NO: 28843 - RNA, 28 nt, Artificial Sequence
  Synthetic Oligonucleotide; PRDM1 exon 5; Set C
gggucuuguagccggucauguuucuuuu

SEQ ID NO: 28844 - RNA, 29 nt, Artificial Sequence
  Synthetic Oligonucleotide; PRDM1 exon 5; Set C
agggucuuguagccggucauguuucuuuu

SEQ ID NO: 28845 - RNA, 23 nt, Artificial Sequence
  Synthetic Oligonucleotide; PRDM1 exon 5; Set B
ggucuuguagccggucauguuuc

SEQ ID NO: 28846 - RNA, 22 nt, Artificial Sequence
  Synthetic Oligonucleotide; PRDM1 exon 5; Set B
ggucuuguagccggucauguuu

SEQ ID NO: 28847 - RNA, 24 nt, Artificial Sequence
  Synthetic Oligonucleotide; PRDM1 exon 5; Set B
gggucuuguagccggucauguuuc

SEQ ID NO: 28848 - RNA, 23 nt, Artificial Sequence
  Synthetic Oligonucleotide; PRDM1 exon 5; Set B
gggucuuguagccggucauguuu

SEQ ID NO: 28849 - RNA, 25 nt, Artificial Sequence
  Synthetic Oligonucleotide; PRDM1 exon 5; Set B
agggucuuguagccggucauguuuc

SEQ ID NO: 28850 - RNA, 24 nt, Artificial Sequence
  Synthetic Oligonucleotide; PRDM1 exon 5; Set B
agggucuuguagccggucauguuu

SEQ ID NO: 28851 - RNA, 16 nt, Artificial Sequence
  Synthetic Oligonucleotide; PRDM1 exon 5; Set C
gggucuuguagccggu

SEQ ID NO: 28852 - RNA, 17 nt, Artificial Sequence
  Synthetic Oligonucleotide; PRDM1 exon 5; Set B
agggucuuguagccggu

SEQ ID NO: 28853 - RNA, 40 nt, Artificial Sequence
  Synthetic Oligonucleotide; PRDM1 exon 5; Set C
cuucagcggguagggaagggucuuguagccggucauguuu

SEQ ID NO: 28854 - RNA, 26 nt, Artificial Sequence
  Synthetic Oligonucleotide; PRDM1 exon 5; Set C
cuucagcggguagggaagggucuugu

SEQ ID NO: 28855 - RNA, 27 nt, Artificial Sequence
  Synthetic Oligonucleotide; PRDM1 exon 5; Set C
ucuucagcggguagggaagggucuugu

SEQ ID NO: 28856 - RNA, 28 nt, Artificial Sequence
  Synthetic Oligonucleotide; PRDM1 exon 5; Set C
uucuucagcggguagggaagggucuugu

SEQ ID NO: 28857 - RNA, 22 nt, Artificial Sequence
  Synthetic Oligonucleotide; PRDM1 exon 5; Set B
ucuucagcggguagggaagggu

SEQ ID NO: 28858 - RNA, 21 nt, Artificial Sequence
  Synthetic Oligonucleotide; PRDM1 exon 5; Set B
ucuucagcggguagggaaggg

SEQ ID NO: 28859 - RNA, 20 nt, Artificial Sequence
  Synthetic Oligonucleotide; PRDM1 exon 5; Set B
ucuucagcggguagggaagg

SEQ ID NO: 28860 - RNA, 35 nt, Artificial Sequence
  Synthetic Oligonucleotide; PRDM1 exon 5; Set A
auaaagaaaaaggggcgauuacacagagggcuaga

SEQ ID NO: 28861 - RNA, 34 nt, Artificial Sequence
  Synthetic Oligonucleotide; PRDM1 exon 5; Set A
auaaagaaaaaggggcgauuacacagagggcuag

SEQ ID NO: 28862 - RNA, 36 nt, Artificial Sequence
  Synthetic Oligonucleotide; PRDM1 exon 5; Set A
aauaaagaaaaaggggcgauuacacagagggcuaga

SEQ ID NO: 28863 - RNA, 35 nt, Artificial Sequence
  Synthetic Oligonucleotide; PRDM1 exon 5; Set A
aauaaagaaaaaggggcgauuacacagagggcuag

SEQ ID NO: 28864 - RNA, 33 nt, Artificial Sequence
  Synthetic Oligonucleotide; PRDM1 exon 5; Set A
auaaagaaaaaggggcgauuacacagagggcua

SEQ ID NO: 28865 - RNA, 37 nt, Artificial Sequence
  Synthetic Oligonucleotide; PRDM1 exon 5; Set A
aaauaaagaaaaaggggcgauuacacagagggcuaga

SEQ ID NO: 28866 - RNA, 36 nt, Artificial Sequence
  Synthetic Oligonucleotide; PRDM1 exon 5; Set A
aaauaaagaaaaaggggcgauuacacagagggcuag

SEQ ID NO: 28867 - RNA, 34 nt, Artificial Sequence
  Synthetic Oligonucleotide; PRDM1 exon 5; Set A
aauaaagaaaaaggggcgauuacacagagggcua

SEQ ID NO: 28868 - RNA, 32 nt, Artificial Sequence
  Synthetic Oligonucleotide; PRDM1 exon 5; Set A
auaaagaaaaaggggcgauuacacagagggcu

SEQ ID NO: 28869 - RNA, 38 nt, Artificial Sequence
  Synthetic Oligonucleotide; PRDM1 exon 5; Set A
gaaauaaagaaaaaggggcgauuacacagagggcuaga

SEQ ID NO: 28870 - RNA, 37 nt, Artificial Sequence
  Synthetic Oligonucleotide; PRDM1 exon 5; Set A
gaaauaaagaaaaaggggcgauuacacagagggcuag

SEQ ID NO: 28871 - RNA, 35 nt, Artificial Sequence
  Synthetic Oligonucleotide; PRDM1 exon 5; Set A
aaauaaagaaaaaggggcgauuacacagagggcua

SEQ ID NO: 28872 - RNA, 33 nt, Artificial Sequence
  Synthetic Oligonucleotide; PRDM1 exon 5; Set A
aauaaagaaaaaggggcgauuacacagagggcu

SEQ ID NO: 28873 - RNA, 38 nt, Artificial Sequence
  Synthetic Oligonucleotide; PRDM1 exon 5; Set A
ugaaauaaagaaaaaggggcgauuacacagagggcuag

SEQ ID NO: 28874 - RNA, 36 nt, Artificial Sequence
  Synthetic Oligonucleotide; PRDM1 exon 5; Set A
gaaauaaagaaaaaggggcgauuacacagagggcua

SEQ ID NO: 28875 - RNA, 34 nt, Artificial Sequence
  Synthetic Oligonucleotide; PRDM1 exon 5; Set A
aaauaaagaaaaaggggcgauuacacagagggcu

SEQ ID NO: 28876 - RNA, 32 nt, Artificial Sequence
  Synthetic Oligonucleotide; PRDM1 exon 5; Set A
aauaaagaaaaaggggcgauuacacagagggc

SEQ ID NO: 28877 - RNA, 37 nt, Artificial Sequence
  Synthetic Oligonucleotide; PRDM1 exon 5; Set A
ugaaauaaagaaaaaggggcgauuacacagagggcua

SEQ ID NO: 28878 - RNA, 33 nt, Artificial Sequence
  Synthetic Oligonucleotide; PRDM1 exon 5; Set A
aaauaaagaaaaaggggcgauuacacagagggc

SEQ ID NO: 28879 - RNA, 35 nt, Artificial Sequence
  Synthetic Oligonucleotide; PRDM1 exon 5; Set A
gaaauaaagaaaaaggggcgauuacacagagggcu

SEQ ID NO: 28880 - RNA, 34 nt, Artificial Sequence
  Synthetic Oligonucleotide; PRDM1 exon 5; Set A
gaaauaaagaaaaaggggcgauuacacagagggc

SEQ ID NO: 28881 - RNA, 36 nt, Artificial Sequence
  Synthetic Oligonucleotide; PRDM1 exon 5; Set A
ugaaauaaagaaaaaggggcgauuacacagagggcu

SEQ ID NO: 28882 - RNA, 40 nt, Artificial Sequence
  Synthetic Oligonucleotide; PRDM1 exon 5; Set A
uuagacugcucuguguuugugcugaaauaaagaaaaaggg

SEQ ID NO: 28883 - RNA, 27 nt, Artificial Sequence
  Synthetic Oligonucleotide; PRDM1 exon 5; Set A
uuugggacauucuuugggcagaguuca

SEQ ID NO: 28884 - RNA, 26 nt, Artificial Sequence
  Synthetic Oligonucleotide; PRDM1 exon 5; Set A
uuugggacauucuuugggcagaguuc

SEQ ID NO: 28885 - RNA, 28 nt, Artificial Sequence
  Synthetic Oligonucleotide; PRDM1 exon 5; Set C
cuuugggacauucuuugggcagaguuca

SEQ ID NO: 28886 - RNA, 25 nt, Artificial Sequence
  Synthetic Oligonucleotide; PRDM1 exon 5; Set A
uuugggacauucuuugggcagaguu

SEQ ID NO: 28887 - RNA, 27 nt, Artificial Sequence
  Synthetic Oligonucleotide; PRDM1 exon 5; Set A
cuuugggacauucuuugggcagaguuc

SEQ ID NO: 28888 - RNA, 29 nt, Artificial Sequence
  Synthetic Oligonucleotide; PRDM1 exon 5; Set C
ucuuugggacauucuuugggcagaguuca

SEQ ID NO: 28889 - RNA, 26 nt, Artificial Sequence
  Synthetic Oligonucleotide; PRDM1 exon 5; Set A
cuuugggacauucuuugggcagaguu

SEQ ID NO: 28890 - RNA, 28 nt, Artificial Sequence
  Synthetic Oligonucleotide; PRDM1 exon 5; Set A
ucuuugggacauucuuugggcagaguuc

SEQ ID NO: 28891 - RNA, 30 nt, Artificial Sequence
  Synthetic Oligonucleotide; PRDM1 exon 5; Set C
cucuuugggacauucuuugggcagaguuca

SEQ ID NO: 28892 - RNA, 24 nt, Artificial Sequence
  Synthetic Oligonucleotide; PRDM1 exon 5; Set A
uuugggacauucuuugggcagagu

SEQ ID NO: 28893 - RNA, 27 nt, Artificial Sequence
  Synthetic Oligonucleotide; PRDM1 exon 5; Set A
ucuuugggacauucuuugggcagaguu

SEQ ID NO: 28894 - RNA, 29 nt, Artificial Sequence
  Synthetic Oligonucleotide; PRDM1 exon 5; Set C
cucuuugggacauucuuugggcagaguuc

SEQ ID NO: 28895 - RNA, 31 nt, Artificial Sequence
  Synthetic Oligonucleotide; PRDM1 exon 5; Set C
ucucuuugggacauucuuugggcagaguuca

SEQ ID NO: 28896 - RNA, 25 nt, Artificial Sequence
  Synthetic Oligonucleotide; PRDM1 exon 5; Set A
cuuugggacauucuuugggcagagu

SEQ ID NO: 28897 - RNA, 28 nt, Artificial Sequence
  Synthetic Oligonucleotide; PRDM1 exon 5; Set A
cucuuugggacauucuuugggcagaguu

SEQ ID NO: 28898 - RNA, 30 nt, Artificial Sequence
  Synthetic Oligonucleotide; PRDM1 exon 5; Set C
ucucuuugggacauucuuugggcagaguuc

SEQ ID NO: 28899 - RNA, 32 nt, Artificial Sequence
  Synthetic Oligonucleotide; PRDM1 exon 5; Set C
cucucuuugggacauucuuugggcagaguuca

SEQ ID NO: 28900 - RNA, 26 nt, Artificial Sequence
  Synthetic Oligonucleotide; PRDM1 exon 5; Set A
ucuuugggacauucuuugggcagagu

SEQ ID NO: 28901 - RNA, 29 nt, Artificial Sequence
  Synthetic Oligonucleotide; PRDM1 exon 5; Set C
ucucuuugggacauucuuugggcagaguu

SEQ ID NO: 28902 - RNA, 27 nt, Artificial Sequence
  Synthetic Oligonucleotide; PRDM1 exon 5; Set A
cucuuugggacauucuuugggcagagu

SEQ ID NO: 28903 - RNA, 28 nt, Artificial Sequence
  Synthetic Oligonucleotide; PRDM1 exon 5; Set C
ucucuuugggacauucuuugggcagagu

SEQ ID NO: 28904 - RNA, 15 nt, Artificial Sequence
  Synthetic Oligonucleotide; PRDM1 exon 5; Set C
cucucuuugggacau

SEQ ID NO: 28905 - RNA, 16 nt, Artificial Sequence
  Synthetic Oligonucleotide; PRDM1 exon 5; Set C
ucucucuuugggacau

SEQ ID NO: 28906 - RNA, 15 nt, Artificial Sequence
  Synthetic Oligonucleotide; PRDM1 exon 5; Set C
ucucucuuugggaca

SEQ ID NO: 28907 - RNA, 28 nt, Artificial Sequence
  Synthetic Oligonucleotide; PRDM1 exon 5; Set C
ucacgcuguacucucucuuugggacauu

SEQ ID NO: 28908 - RNA, 29 nt, Artificial Sequence
  Synthetic Oligonucleotide; PRDM1 exon 5; Set C
uucacgcuguacucucucuuugggacauu

SEQ ID NO: 28909 - RNA, 30 nt, Artificial Sequence
  Synthetic Oligonucleotide; PRDM1 exon 5; Set C
uuucacgcuguacucucucuuugggacauu

SEQ ID NO: 28910 - RNA, 31 nt, Artificial Sequence
  Synthetic Oligonucleotide; PRDM1 exon 5; Set C
cuuucacgcuguacucucucuuugggacauu

SEQ ID NO: 28911 - RNA, 24 nt, Artificial Sequence
  Synthetic Oligonucleotide; PRDM1 exon 5; Set A
ucacgcuguacucucucuuuggga

SEQ ID NO: 28912 - RNA, 32 nt, Artificial Sequence
  Synthetic Oligonucleotide; PRDM1 exon 5; Set C
ucuuucacgcuguacucucucuuugggacauu

SEQ ID NO: 28913 - RNA, 30 nt, Artificial Sequence
  Synthetic Oligonucleotide; PRDM1 exon 5; Set C
cuuucacgcuguacucucucuuugggacau

SEQ ID NO: 28914 - RNA, 25 nt, Artificial Sequence
  Synthetic Oligonucleotide; PRDM1 exon 5; Set A
uucacgcuguacucucucuuuggga

SEQ ID NO: 28915 - RNA, 33 nt, Artificial Sequence
  Synthetic Oligonucleotide; PRDM1 exon 5; Set C
uucuuucacgcuguacucucucuuugggacauu

SEQ ID NO: 28916 - RNA, 31 nt, Artificial Sequence
  Synthetic Oligonucleotide; PRDM1 exon 5; Set C
ucuuucacgcuguacucucucuuugggacau

SEQ ID NO: 28917 - RNA, 29 nt, Artificial Sequence
  Synthetic Oligonucleotide; PRDM1 exon 5; Set C
cuuucacgcuguacucucucuuugggaca

SEQ ID NO: 28918 - RNA, 26 nt, Artificial Sequence
  Synthetic Oligonucleotide; PRDM1 exon 5; Set A
uuucacgcuguacucucucuuuggga

SEQ ID NO: 28919 - RNA, 28 nt, Artificial Sequence
  Synthetic Oligonucleotide; PRDM1 exon 5; Set C
cuuucacgcuguacucucucuuugggac

SEQ ID NO: 28920 - RNA, 32 nt, Artificial Sequence
  Synthetic Oligonucleotide; PRDM1 exon 5; Set C
uucuuucacgcuguacucucucuuugggacau

SEQ ID NO: 28921 - RNA, 30 nt, Artificial Sequence
  Synthetic Oligonucleotide; PRDM1 exon 5; Set C
ucuuucacgcuguacucucucuuugggaca

SEQ ID NO: 28922 - RNA, 27 nt, Artificial Sequence
  Synthetic Oligonucleotide; PRDM1 exon 5; Set C
cuuucacgcuguacucucucuuuggga

SEQ ID NO: 28923 - RNA, 35 nt, Artificial Sequence
  Synthetic Oligonucleotide; PRDM1 exon 5; Set C
auuucuuucacgcuguacucucucuuugggacauu

SEQ ID NO: 28924 - RNA, 29 nt, Artificial Sequence
  Synthetic Oligonucleotide; PRDM1 exon 5; Set C
ucuuucacgcuguacucucucuuugggac

SEQ ID NO: 28925 - RNA, 33 nt, Artificial Sequence
  Synthetic Oligonucleotide; PRDM1 exon 5; Set C
uuucuuucacgcuguacucucucuuugggacau

SEQ ID NO: 28926 - RNA, 31 nt, Artificial Sequence
  Synthetic Oligonucleotide; PRDM1 exon 5; Set C
uucuuucacgcuguacucucucuuugggaca

SEQ ID NO: 28927 - RNA, 20 nt, Artificial Sequence
  Synthetic Oligonucleotide; PRDM1 exon 5; Set C
ucacgcuguacucucucuuu

SEQ ID NO: 28928 - RNA, 28 nt, Artificial Sequence
  Synthetic Oligonucleotide; PRDM1 exon 5; Set C
ucuuucacgcuguacucucucuuuggga

SEQ ID NO: 28929 - RNA, 36 nt, Artificial Sequence
  Synthetic Oligonucleotide; PRDM1 exon 5; Set C
gauuucuuucacgcuguacucucucuuugggacauu

SEQ ID NO: 28930 - RNA, 26 nt, Artificial Sequence
  Synthetic Oligonucleotide; PRDM1 exon 5; Set A
cuuucacgcuguacucucucuuuggg

SEQ ID NO: 28931 - RNA, 30 nt, Artificial Sequence
  Synthetic Oligonucleotide; PRDM1 exon 5; Set C
uucuuucacgcuguacucucucuuugggac

SEQ ID NO: 28932 - RNA, 32 nt, Artificial Sequence
  Synthetic Oligonucleotide; PRDM1 exon 5; Set C
uuucuuucacgcuguacucucucuuugggaca

SEQ ID NO: 28933 - RNA, 21 nt, Artificial Sequence
  Synthetic Oligonucleotide; PRDM1 exon 5; Set C
uucacgcuguacucucucuuu

SEQ ID NO: 28934 - RNA, 19 nt, Artificial Sequence
  Synthetic Oligonucleotide; PRDM1 exon 5; Set C
ucacgcuguacucucucuu

SEQ ID NO: 28935 - RNA, 29 nt, Artificial Sequence
  Synthetic Oligonucleotide; PRDM1 exon 5; Set C
uucuuucacgcuguacucucucuuuggga

SEQ ID NO: 28936 - RNA, 37 nt, Artificial Sequence
  Synthetic Oligonucleotide; PRDM1 exon 5; Set C
ggauuucuuucacgcuguacucucucuuugggacauu

SEQ ID NO: 28937 - RNA, 25 nt, Artificial Sequence
  Synthetic Oligonucleotide; PRDM1 exon 5; Set A
cuuucacgcuguacucucucuuugg

SEQ ID NO: 28938 - RNA, 27 nt, Artificial Sequence
  Synthetic Oligonucleotide; PRDM1 exon 5; Set A
ucuuucacgcuguacucucucuuuggg

SEQ ID NO: 28939 - RNA, 31 nt, Artificial Sequence
  Synthetic Oligonucleotide; PRDM1 exon 5; Set C
uuucuuucacgcuguacucucucuuugggac

SEQ ID NO: 28940 - RNA, 22 nt, Artificial Sequence
  Synthetic Oligonucleotide; PRDM1 exon 5; Set A
uuucacgcuguacucucucuuu

SEQ ID NO: 28941 - RNA, 20 nt, Artificial Sequence
  Synthetic Oligonucleotide; PRDM1 exon 5; Set C
uucacgcuguacucucucuu

SEQ ID NO: 28942 - RNA, 30 nt, Artificial Sequence
  Synthetic Oligonucleotide; PRDM1 exon 5; Set C
uuucuuucacgcuguacucucucuuuggga

SEQ ID NO: 28943 - RNA, 38 nt, Artificial Sequence
  Synthetic Oligonucleotide; PRDM1 exon 5; Set C
aggauuucuuucacgcuguacucucucuuugggacauu

SEQ ID NO: 28944 - RNA, 24 nt, Artificial Sequence
  Synthetic Oligonucleotide; PRDM1 exon 5; Set A
cuuucacgcuguacucucucuuug

SEQ ID NO: 28945 - RNA, 26 nt, Artificial Sequence
  Synthetic Oligonucleotide; PRDM1 exon 5; Set A
ucuuucacgcuguacucucucuuugg

SEQ ID NO: 28946 - RNA, 28 nt, Artificial Sequence
  Synthetic Oligonucleotide; PRDM1 exon 5; Set A
uucuuucacgcuguacucucucuuuggg

SEQ ID NO: 28947 - RNA, 21 nt, Artificial Sequence
  Synthetic Oligonucleotide; PRDM1 exon 5; Set C
uuucacgcuguacucucucuu

SEQ ID NO: 28948 - RNA, 31 nt, Artificial Sequence
  Synthetic Oligonucleotide; PRDM1 exon 5; Set C
auuucuuucacgcuguacucucucuuuggga

SEQ ID NO: 28949 - RNA, 39 nt, Artificial Sequence
  Synthetic Oligonucleotide; PRDM1 exon 5; Set C
uaggauuucuuucacgcuguacucucucuuugggacauu

SEQ ID NO: 28950 - RNA, 25 nt, Artificial Sequence
  Synthetic Oligonucleotide; PRDM1 exon 5; Set A
ucuuucacgcuguacucucucuuug

SEQ ID NO: 28951 - RNA, 27 nt, Artificial Sequence
  Synthetic Oligonucleotide; PRDM1 exon 5; Set A
uucuuucacgcuguacucucucuuugg

SEQ ID NO: 28952 - RNA, 29 nt, Artificial Sequence
  Synthetic Oligonucleotide; PRDM1 exon 5; Set A
uuucuuucacgcuguacucucucuuuggg

SEQ ID NO: 28953 - RNA, 22 nt, Artificial Sequence
  Synthetic Oligonucleotide; PRDM1 exon 5; Set A
cuuucacgcuguacucucucuu

SEQ ID NO: 28954 - RNA, 20 nt, Artificial Sequence
  Synthetic Oligonucleotide; PRDM1 exon 5; Set C
uuucacgcuguacucucucu

SEQ ID NO: 28955 - RNA, 32 nt, Artificial Sequence
  Synthetic Oligonucleotide; PRDM1 exon 5; Set C
gauuucuuucacgcuguacucucucuuuggga

SEQ ID NO: 28956 - RNA, 26 nt, Artificial Sequence
  Synthetic Oligonucleotide; PRDM1 exon 5; Set A
uucuuucacgcuguacucucucuuug

SEQ ID NO: 28957 - RNA, 28 nt, Artificial Sequence
  Synthetic Oligonucleotide; PRDM1 exon 5; Set A
uuucuuucacgcuguacucucucuuugg

SEQ ID NO: 28958 - RNA, 30 nt, Artificial Sequence
  Synthetic Oligonucleotide; PRDM1 exon 5; Set A
auuucuuucacgcuguacucucucuuuggg

SEQ ID NO: 28959 - RNA, 23 nt, Artificial Sequence
  Synthetic Oligonucleotide; PRDM1 exon 5; Set A
ucuuucacgcuguacucucucuu

SEQ ID NO: 28960 - RNA, 21 nt, Artificial Sequence
  Synthetic Oligonucleotide; PRDM1 exon 5; Set A
cuuucacgcuguacucucucu

SEQ ID NO: 28961 - RNA, 33 nt, Artificial Sequence
  Synthetic Oligonucleotide; PRDM1 exon 5; Set C
ggauuucuuucacgcuguacucucucuuuggga

SEQ ID NO: 28962 - RNA, 27 nt, Artificial Sequence
  Synthetic Oligonucleotide; PRDM1 exon 5; Set A
uuucuuucacgcuguacucucucuuug

SEQ ID NO: 28963 - RNA, 39 nt, Artificial Sequence
  Synthetic Oligonucleotide; PRDM1 exon 5; Set C
uuaggauuucuuucacgcuguacucucucuuugggacau

SEQ ID NO: 28964 - RNA, 22 nt, Artificial Sequence
  Synthetic Oligonucleotide; PRDM1 exon 5; Set A
ucuuucacgcuguacucucucu

SEQ ID NO: 28965 - RNA, 20 nt, Artificial Sequence
  Synthetic Oligonucleotide; PRDM1 exon 5; Set C
cuuucacgcuguacucucuc

SEQ ID NO: 28966 - RNA, 34 nt, Artificial Sequence
  Synthetic Oligonucleotide; PRDM1 exon 5; Set C
aggauuucuuucacgcuguacucucucuuuggga

SEQ ID NO: 28967 - RNA, 40 nt, Artificial Sequence
  Synthetic Oligonucleotide; PRDM1 exon 5; Set C
uuuaggauuucuuucacgcuguacucucucuuugggacau

SEQ ID NO: 28968 - RNA, 38 nt, Artificial Sequence
  Synthetic Oligonucleotide; PRDM1 exon 5; Set C
uuaggauuucuuucacgcuguacucucucuuugggaca

SEQ ID NO: 28969 - RNA, 27 nt, Artificial Sequence
  Synthetic Oligonucleotide; PRDM1 exon 5; Set A
auuucuuucacgcuguacucucucuuu

SEQ ID NO: 28970 - RNA, 23 nt, Artificial Sequence
  Synthetic Oligonucleotide; PRDM1 exon 5; Set A
uucuuucacgcuguacucucucu

SEQ ID NO: 28971 - RNA, 21 nt, Artificial Sequence
  Synthetic Oligonucleotide; PRDM1 exon 5; Set A
ucuuucacgcuguacucucuc

SEQ ID NO: 28972 - RNA, 19 nt, Artificial Sequence
  Synthetic Oligonucleotide; PRDM1 exon 5; Set C
cuuucacgcuguacucucu

SEQ ID NO: 28973 - RNA, 35 nt, Artificial Sequence
  Synthetic Oligonucleotide; PRDM1 exon 5; Set C
uaggauuucuuucacgcuguacucucucuuuggga

SEQ ID NO: 28974 - RNA, 37 nt, Artificial Sequence
  Synthetic Oligonucleotide; PRDM1 exon 5; Set C
uuaggauuucuuucacgcuguacucucucuuugggac

SEQ ID NO: 28975 - RNA, 39 nt, Artificial Sequence
  Synthetic Oligonucleotide; PRDM1 exon 5; Set C
uuuaggauuucuuucacgcuguacucucucuuugggaca

SEQ ID NO: 28976 - RNA, 28 nt, Artificial Sequence
  Synthetic Oligonucleotide; PRDM1 exon 5; Set A
gauuucuuucacgcuguacucucucuuu

SEQ ID NO: 28977 - RNA, 26 nt, Artificial Sequence
  Synthetic Oligonucleotide; PRDM1 exon 5; Set A
auuucuuucacgcuguacucucucuu

SEQ ID NO: 28978 - RNA, 24 nt, Artificial Sequence
  Synthetic Oligonucleotide; PRDM1 exon 5; Set A
uuucuuucacgcuguacucucucu

SEQ ID NO: 28979 - RNA, 22 nt, Artificial Sequence
  Synthetic Oligonucleotide; PRDM1 exon 5; Set A
uucuuucacgcuguacucucuc

SEQ ID NO: 28980 - RNA, 20 nt, Artificial Sequence
  Synthetic Oligonucleotide; PRDM1 exon 5; Set C
ucuuucacgcuguacucucu

SEQ ID NO: 28981 - RNA, 34 nt, Artificial Sequence
  Synthetic Oligonucleotide; PRDM1 exon 5; Set C
uaggauuucuuucacgcuguacucucucuuuggg

SEQ ID NO: 28982 - RNA, 38 nt, Artificial Sequence
  Synthetic Oligonucleotide; PRDM1 exon 5; Set C
uuuaggauuucuuucacgcuguacucucucuuugggac

SEQ ID NO: 28983 - RNA, 40 nt, Artificial Sequence
  Synthetic Oligonucleotide; PRDM1 exon 5; Set C
uuuuaggauuucuuucacgcuguacucucucuuugggaca

SEQ ID NO: 28984 - RNA, 29 nt, Artificial Sequence
  Synthetic Oligonucleotide; PRDM1 exon 5; Set A
ggauuucuuucacgcuguacucucucuuu

SEQ ID NO: 28985 - RNA, 27 nt, Artificial Sequence
  Synthetic Oligonucleotide; PRDM1 exon 5; Set A
gauuucuuucacgcuguacucucucuu

SEQ ID NO: 28986 - RNA, 25 nt, Artificial Sequence
  Synthetic Oligonucleotide; PRDM1 exon 5; Set A
auuucuuucacgcuguacucucucu

SEQ ID NO: 28987 - RNA, 23 nt, Artificial Sequence
  Synthetic Oligonucleotide; PRDM1 exon 5; Set A
uuucuuucacgcuguacucucuc

SEQ ID NO: 28988 - RNA, 21 nt, Artificial Sequence
  Synthetic Oligonucleotide; PRDM1 exon 5; Set C
uucuuucacgcuguacucucu

SEQ ID NO: 28989 - RNA, 35 nt, Artificial Sequence
  Synthetic Oligonucleotide; PRDM1 exon 5; Set C
uuaggauuucuuucacgcuguacucucucuuuggg

SEQ ID NO: 28990 - RNA, 30 nt, Artificial Sequence
  Synthetic Oligonucleotide; PRDM1 exon 5; Set A
aggauuucuuucacgcuguacucucucuuu

SEQ ID NO: 28991 - RNA, 28 nt, Artificial Sequence
  Synthetic Oligonucleotide; PRDM1 exon 5; Set A
ggauuucuuucacgcuguacucucucuu

SEQ ID NO: 28992 - RNA, 26 nt, Artificial Sequence
  Synthetic Oligonucleotide; PRDM1 exon 5; Set A
gauuucuuucacgcuguacucucucu

SEQ ID NO: 28993 - RNA, 24 nt, Artificial Sequence
  Synthetic Oligonucleotide; PRDM1 exon 5; Set A
auuucuuucacgcuguacucucuc

SEQ ID NO: 28994 - RNA, 22 nt, Artificial Sequence
  Synthetic Oligonucleotide; PRDM1 exon 5; Set A
uuucuuucacgcuguacucucu

SEQ ID NO: 28995 - RNA, 34 nt, Artificial Sequence
  Synthetic Oligonucleotide; PRDM1 exon 5; Set C
uuaggauuucuuucacgcuguacucucucuuugg

SEQ ID NO: 28996 - RNA, 31 nt, Artificial Sequence
  Synthetic Oligonucleotide; PRDM1 exon 5; Set A
uaggauuucuuucacgcuguacucucucuuu

SEQ ID NO: 28997 - RNA, 29 nt, Artificial Sequence
  Synthetic Oligonucleotide; PRDM1 exon 5; Set A
aggauuucuuucacgcuguacucucucuu

SEQ ID NO: 28998 - RNA, 27 nt, Artificial Sequence
  Synthetic Oligonucleotide; PRDM1 exon 5; Set A
ggauuucuuucacgcuguacucucucu

SEQ ID NO: 28999 - RNA, 25 nt, Artificial Sequence
  Synthetic Oligonucleotide; PRDM1 exon 5; Set A
gauuucuuucacgcuguacucucuc

SEQ ID NO: 29000 - RNA, 23 nt, Artificial Sequence
  Synthetic Oligonucleotide; PRDM1 exon 5; Set A
auuucuuucacgcuguacucucu

SEQ ID NO: 29001 - RNA, 33 nt, Artificial Sequence
  Synthetic Oligonucleotide; PRDM1 exon 5; Set A
uuaggauuucuuucacgcuguacucucucuuug

SEQ ID NO: 29002 - RNA, 21 nt, Artificial Sequence
  Synthetic Oligonucleotide; PRDM1 exon 5; Set C
uuucuuucacgcuguacucuc

SEQ ID NO: 29003 - RNA, 30 nt, Artificial Sequence
  Synthetic Oligonucleotide; PRDM1 exon 5; Set A
uaggauuucuuucacgcuguacucucucuu

SEQ ID NO: 29004 - RNA, 28 nt, Artificial Sequence
  Synthetic Oligonucleotide; PRDM1 exon 5; Set A
aggauuucuuucacgcuguacucucucu

SEQ ID NO: 29005 - RNA, 26 nt, Artificial Sequence
  Synthetic Oligonucleotide; PRDM1 exon 5; Set A
ggauuucuuucacgcuguacucucuc

SEQ ID NO: 29006 - RNA, 24 nt, Artificial Sequence
  Synthetic Oligonucleotide; PRDM1 exon 5; Set A
gauuucuuucacgcuguacucucu

SEQ ID NO: 29007 - RNA, 29 nt, Artificial Sequence
  Synthetic Oligonucleotide; PRDM1 exon 5; Set A
uaggauuucuuucacgcuguacucucucu

SEQ ID NO: 29008 - RNA, 27 nt, Artificial Sequence
  Synthetic Oligonucleotide; PRDM1 exon 5; Set A
aggauuucuuucacgcuguacucucuc

SEQ ID NO: 29009 - RNA, 28 nt, Artificial Sequence
  Synthetic Oligonucleotide; PRDM1 exon 5; Set A
uaggauuucuuucacgcuguacucucuc

SEQ ID NO: 29010 - RNA, 26 nt, Artificial Sequence
  Synthetic Oligonucleotide; PRDM1 exon 5; Set A
aggauuucuuucacgcuguacucucu

SEQ ID NO: 29011 - RNA, 27 nt, Artificial Sequence
  Synthetic Oligonucleotide; PRDM1 exon 5; Set A
uaggauuucuuucacgcuguacucucu

SEQ ID NO: 29012 - RNA, 27 nt, Artificial Sequence
  Synthetic Oligonucleotide; PRDM1 exon 5; Set A
uuaggauuucuuucacgcuguacucuc

SEQ ID NO: 29013 - RNA, 28 nt, Artificial Sequence
  Synthetic Oligonucleotide; PRDM1 exon 5; Set A
uuuaggauuucuuucacgcuguacucuc

SEQ ID NO: 29014 - RNA, 26 nt, Artificial Sequence
  Synthetic Oligonucleotide; PRDM1 exon 5; Set A
uuaggauuucuuucacgcuguacucu

SEQ ID NO: 29015 - RNA, 29 nt, Artificial Sequence
  Synthetic Oligonucleotide; PRDM1 exon 5; Set A
uuuuaggauuucuuucacgcuguacucuc

SEQ ID NO: 29016 - RNA, 27 nt, Artificial Sequence
  Synthetic Oligonucleotide; PRDM1 exon 5; Set A
uuuaggauuucuuucacgcuguacucu

SEQ ID NO: 29017 - RNA, 28 nt, Artificial Sequence
  Synthetic Oligonucleotide; PRDM1 exon 5; Set A
uuuuaggauuucuuucacgcuguacucu

SEQ ID NO: 29018 - RNA, 40 nt, Artificial Sequence
  Synthetic Oligonucleotide; PRDM1 exon 5; Set C
gaguccaauuuuaggauuucuuucacgcuguacucucucu

SEQ ID NO: 29019 - RNA, 39 nt, Artificial Sequence
  Synthetic Oligonucleotide; PRDM1 exon 5; Set C
gaguccaauuuuaggauuucuuucacgcuguacucucuc

SEQ ID NO: 29020 - RNA, 15 nt, Artificial Sequence
  Synthetic Oligonucleotide; PRDM1 exon 5; Set C
aggauuucuuucacg

SEQ ID NO: 29021 - RNA, 40 nt, Artificial Sequence
  Synthetic Oligonucleotide; PRDM1 exon 5; Set C
ggaguccaauuuuaggauuucuuucacgcuguacucucuc

SEQ ID NO: 29022 - RNA, 38 nt, Artificial Sequence
  Synthetic Oligonucleotide; PRDM1 exon 5; Set C
gaguccaauuuuaggauuucuuucacgcuguacucucu

SEQ ID NO: 29023 - RNA, 16 nt, Artificial Sequence
  Synthetic Oligonucleotide; PRDM1 exon 5; Set C
uaggauuucuuucacg

SEQ ID NO: 29024 - RNA, 39 nt, Artificial Sequence
  Synthetic Oligonucleotide; PRDM1 exon 5; Set C
ggaguccaauuuuaggauuucuuucacgcuguacucucu

SEQ ID NO: 29025 - RNA, 15 nt, Artificial Sequence
  Synthetic Oligonucleotide; PRDM1 exon 5; Set C
uaggauuucuuucac

SEQ ID NO: 29026 - RNA, 17 nt, Artificial Sequence
  Synthetic Oligonucleotide; PRDM1 exon 5; Set C
uuaggauuucuuucacg

SEQ ID NO: 29027 - RNA, 40 nt, Artificial Sequence
  Synthetic Oligonucleotide; PRDM1 exon 5; Set C
uggaguccaauuuuaggauuucuuucacgcuguacucucu

SEQ ID NO: 29028 - RNA, 26 nt, Artificial Sequence
  Synthetic Oligonucleotide; PRDM1 exon 5; Set C
gaguccaauuuuaggauuucuuucac

SEQ ID NO: 29029 - RNA, 25 nt, Artificial Sequence
  Synthetic Oligonucleotide; PRDM1 exon 5; Set C
gaguccaauuuuaggauuucuuuca

SEQ ID NO: 29030 - RNA, 27 nt, Artificial Sequence
  Synthetic Oligonucleotide; PRDM1 exon 5; Set C
ggaguccaauuuuaggauuucuuucac

SEQ ID NO: 29031 - RNA, 26 nt, Artificial Sequence
  Synthetic Oligonucleotide; PRDM1 exon 5; Set C
ggaguccaauuuuaggauuucuuuca

SEQ ID NO: 29032 - RNA, 24 nt, Artificial Sequence
  Synthetic Oligonucleotide; PRDM1 exon 5; Set C
gaguccaauuuuaggauuucuuuc

SEQ ID NO: 29033 - RNA, 28 nt, Artificial Sequence
  Synthetic Oligonucleotide; PRDM1 exon 5; Set A
uggaguccaauuuuaggauuucuuucac

SEQ ID NO: 29034 - RNA, 27 nt, Artificial Sequence
  Synthetic Oligonucleotide; PRDM1 exon 5; Set C
uggaguccaauuuuaggauuucuuuca

SEQ ID NO: 29035 - RNA, 25 nt, Artificial Sequence
  Synthetic Oligonucleotide; PRDM1 exon 5; Set C
ggaguccaauuuuaggauuucuuuc

SEQ ID NO: 29036 - RNA, 23 nt, Artificial Sequence
  Synthetic Oligonucleotide; PRDM1 exon 5; Set C
gaguccaauuuuaggauuucuuu

SEQ ID NO: 29037 - RNA, 29 nt, Artificial Sequence
  Synthetic Oligonucleotide; PRDM1 exon 5; Set A
uuggaguccaauuuuaggauuucuuucac

SEQ ID NO: 29038 - RNA, 31 nt, Artificial Sequence
  Synthetic Oligonucleotide; PRDM1 exon 5; Set A
guuggaguccaauuuuaggauuucuuucacg

SEQ ID NO: 29039 - RNA, 28 nt, Artificial Sequence
  Synthetic Oligonucleotide; PRDM1 exon 5; Set C
uuggaguccaauuuuaggauuucuuuca

SEQ ID NO: 29040 - RNA, 26 nt, Artificial Sequence
  Synthetic Oligonucleotide; PRDM1 exon 5; Set C
uggaguccaauuuuaggauuucuuuc

SEQ ID NO: 29041 - RNA, 24 nt, Artificial Sequence
  Synthetic Oligonucleotide; PRDM1 exon 5; Set C
ggaguccaauuuuaggauuucuuu

SEQ ID NO: 29042 - RNA, 30 nt, Artificial Sequence
  Synthetic Oligonucleotide; PRDM1 exon 5; Set A
guuggaguccaauuuuaggauuucuuucac

SEQ ID NO: 29043 - RNA, 32 nt, Artificial Sequence
  Synthetic Oligonucleotide; PRDM1 exon 5; Set A
gguuggaguccaauuuuaggauuucuuucacg

SEQ ID NO: 29044 - RNA, 21 nt, Artificial Sequence
  Synthetic Oligonucleotide; PRDM1 exon 5; Set C
gaguccaauuuuaggauuucu

SEQ ID NO: 29045 - RNA, 27 nt, Artificial Sequence
  Synthetic Oligonucleotide; PRDM1 exon 5; Set C
uuggaguccaauuuuaggauuucuuuc

SEQ ID NO: 29046 - RNA, 25 nt, Artificial Sequence
  Synthetic Oligonucleotide; PRDM1 exon 5; Set C
uggaguccaauuuuaggauuucuuu

SEQ ID NO: 29047 - RNA, 29 nt, Artificial Sequence
  Synthetic Oligonucleotide; PRDM1 exon 5; Set A
guuggaguccaauuuuaggauuucuuuca

SEQ ID NO: 29048 - RNA, 31 nt, Artificial Sequence
  Synthetic Oligonucleotide; PRDM1 exon 5; Set A
gguuggaguccaauuuuaggauuucuuucac

SEQ ID NO: 29049 - RNA, 33 nt, Artificial Sequence
  Synthetic Oligonucleotide; PRDM1 exon 5; Set A
ggguuggaguccaauuuuaggauuucuuucacg

SEQ ID NO: 29050 - RNA, 20 nt, Artificial Sequence
  Synthetic Oligonucleotide; PRDM1 exon 5; Set C
gaguccaauuuuaggauuuc

SEQ ID NO: 29051 - RNA, 26 nt, Artificial Sequence
  Synthetic Oligonucleotide; PRDM1 exon 5; Set C
uuggaguccaauuuuaggauuucuuu

SEQ ID NO: 29052 - RNA, 28 nt, Artificial Sequence
  Synthetic Oligonucleotide; PRDM1 exon 5; Set C
guuggaguccaauuuuaggauuucuuuc

SEQ ID NO: 29053 - RNA, 30 nt, Artificial Sequence
  Synthetic Oligonucleotide; PRDM1 exon 5; Set A
gguuggaguccaauuuuaggauuucuuuca

SEQ ID NO: 29054 - RNA, 32 nt, Artificial Sequence
  Synthetic Oligonucleotide; PRDM1 exon 5; Set A
ggguuggaguccaauuuuaggauuucuuucac

SEQ ID NO: 29055 - RNA, 34 nt, Artificial Sequence
  Synthetic Oligonucleotide; PRDM1 exon 5; Set C
gggguuggaguccaauuuuaggauuucuuucacg

SEQ ID NO: 29056 - RNA, 19 nt, Artificial Sequence
  Synthetic Oligonucleotide; PRDM1 exon 5; Set C
gaguccaauuuuaggauuu

SEQ ID NO: 29057 - RNA, 27 nt, Artificial Sequence
  Synthetic Oligonucleotide; PRDM1 exon 5; Set C
guuggaguccaauuuuaggauuucuuu

SEQ ID NO: 29058 - RNA, 29 nt, Artificial Sequence
  Synthetic Oligonucleotide; PRDM1 exon 5; Set A
gguuggaguccaauuuuaggauuucuuuc

SEQ ID NO: 29059 - RNA, 33 nt, Artificial Sequence
  Synthetic Oligonucleotide; PRDM1 exon 5; Set C
gggguuggaguccaauuuuaggauuucuuucac

SEQ ID NO: 29060 - RNA, 30 nt, Artificial Sequence
  Synthetic Oligonucleotide; PRDM1 exon 5; Set A
ggguuggaguccaauuuuaggauuucuuuc

SEQ ID NO: 29061 - RNA, 28 nt, Artificial Sequence
  Synthetic Oligonucleotide; PRDM1 exon 5; Set A
gguuggaguccaauuuuaggauuucuuu

SEQ ID NO: 29062 - RNA, 29 nt, Artificial Sequence
  Synthetic Oligonucleotide; PRDM1 exon 5; Set A
ggguuggaguccaauuuuaggauuucuuu

SEQ ID NO: 29063 - RNA, 19 nt, Artificial Sequence
  Synthetic Oligonucleotide; PRDM1 exon 5; Set C
ggaguccaauuuuaggauu

SEQ ID NO: 29064 - RNA, 20 nt, Artificial Sequence
  Synthetic Oligonucleotide; PRDM1 exon 5; Set C
uggaguccaauuuuaggauu

SEQ ID NO: 29065 - RNA, 21 nt, Artificial Sequence
  Synthetic Oligonucleotide; PRDM1 exon 5; Set C
uuggaguccaauuuuaggauu

SEQ ID NO: 29066 - RNA, 19 nt, Artificial Sequence
  Synthetic Oligonucleotide; PRDM1 exon 5; Set C
uggaguccaauuuuaggau

SEQ ID NO: 29067 - RNA, 22 nt, Artificial Sequence
  Synthetic Oligonucleotide; PRDM1 exon 5; Set C
guuggaguccaauuuuaggauu

SEQ ID NO: 29068 - RNA, 20 nt, Artificial Sequence
  Synthetic Oligonucleotide; PRDM1 exon 5; Set C
uuggaguccaauuuuaggau

SEQ ID NO: 29069 - RNA, 40 nt, Artificial Sequence
  Synthetic Oligonucleotide; PRDM1 exon 5; Set C
uuuggagggguuggaguccaauuuuaggauuucuuucacg

SEQ ID NO: 29070 - RNA, 23 nt, Artificial Sequence
  Synthetic Oligonucleotide; PRDM1 exon 5; Set C
gguuggaguccaauuuuaggauu

SEQ ID NO: 29071 - RNA, 21 nt, Artificial Sequence
  Synthetic Oligonucleotide; PRDM1 exon 5; Set C
guuggaguccaauuuuaggau

SEQ ID NO: 29072 - RNA, 39 nt, Artificial Sequence
  Synthetic Oligonucleotide; PRDM1 exon 5; Set C
uuuggagggguuggaguccaauuuuaggauuucuuucac

SEQ ID NO: 29073 - RNA, 38 nt, Artificial Sequence
  Synthetic Oligonucleotide; PRDM1 exon 5; Set C
uuuggagggguuggaguccaauuuuaggauuucuuuca

SEQ ID NO: 29074 - RNA, 24 nt, Artificial Sequence
  Synthetic Oligonucleotide; PRDM1 exon 5; Set A
ggguuggaguccaauuuuaggauu

SEQ ID NO: 29075 - RNA, 22 nt, Artificial Sequence
  Synthetic Oligonucleotide; PRDM1 exon 5; Set C
gguuggaguccaauuuuaggau

SEQ ID NO: 29076 - RNA, 20 nt, Artificial Sequence
  Synthetic Oligonucleotide; PRDM1 exon 5; Set C
guuggaguccaauuuuagga

SEQ ID NO: 29077 - RNA, 40 nt, Artificial Sequence
  Synthetic Oligonucleotide; PRDM1 exon 5; Set C
cuuuggagggguuggaguccaauuuuaggauuucuuucac

SEQ ID NO: 29078 - RNA, 15 nt, Artificial Sequence
  Synthetic Oligonucleotide; PRDM1 exon 5; Set C
uggaguccaauuuua

SEQ ID NO: 29079 - RNA, 37 nt, Artificial Sequence
  Synthetic Oligonucleotide; PRDM1 exon 5; Set C
uuuggagggguuggaguccaauuuuaggauuucuuuc

SEQ ID NO: 29080 - RNA, 25 nt, Artificial Sequence
  Synthetic Oligonucleotide; PRDM1 exon 5; Set A
gggguuggaguccaauuuuaggauu

SEQ ID NO: 29081 - RNA, 23 nt, Artificial Sequence
  Synthetic Oligonucleotide; PRDM1 exon 5; Set C
ggguuggaguccaauuuuaggau

SEQ ID NO: 29082 - RNA, 21 nt, Artificial Sequence
  Synthetic Oligonucleotide; PRDM1 exon 5; Set C
gguuggaguccaauuuuagga

SEQ ID NO: 29083 - RNA, 16 nt, Artificial Sequence
  Synthetic Oligonucleotide; PRDM1 exon 5; Set C
uuggaguccaauuuua

SEQ ID NO: 29084 - RNA, 36 nt, Artificial Sequence
  Synthetic Oligonucleotide; PRDM1 exon 5; Set C
uuuggagggguuggaguccaauuuuaggauuucuuu

SEQ ID NO: 29085 - RNA, 38 nt, Artificial Sequence
  Synthetic Oligonucleotide; PRDM1 exon 5; Set C
cuuuggagggguuggaguccaauuuuaggauuucuuuc

SEQ ID NO: 29086 - RNA, 24 nt, Artificial Sequence
  Synthetic Oligonucleotide; PRDM1 exon 5; Set A
gggguuggaguccaauuuuaggau

SEQ ID NO: 29087 - RNA, 22 nt, Artificial Sequence
  Synthetic Oligonucleotide; PRDM1 exon 5; Set C
ggguuggaguccaauuuuagga

SEQ ID NO: 29088 - RNA, 20 nt, Artificial Sequence
  Synthetic Oligonucleotide; PRDM1 exon 5; Set C
gguuggaguccaauuuuagg

SEQ ID NO: 29089 - RNA, 15 nt, Artificial Sequence
  Synthetic Oligonucleotide; PRDM1 exon 5; Set C
uuggaguccaauuuu

SEQ ID NO: 29090 - RNA, 17 nt, Artificial Sequence
  Synthetic Oligonucleotide; PRDM1 exon 5; Set C
guuggaguccaauuuua

SEQ ID NO: 29091 - RNA, 37 nt, Artificial Sequence
  Synthetic Oligonucleotide; PRDM1 exon 5; Set C
cuuuggagggguuggaguccaauuuuaggauuucuuu

SEQ ID NO: 29092 - RNA, 19 nt, Artificial Sequence
  Synthetic Oligonucleotide; PRDM1 exon 5; Set C
gguuggaguccaauuuuag

SEQ ID NO: 29093 - RNA, 23 nt, Artificial Sequence
  Synthetic Oligonucleotide; PRDM1 exon 5; Set A
gggguuggaguccaauuuuagga

SEQ ID NO: 29094 - RNA, 21 nt, Artificial Sequence
  Synthetic Oligonucleotide; PRDM1 exon 5; Set C
ggguuggaguccaauuuuagg

SEQ ID NO: 29095 - RNA, 16 nt, Artificial Sequence
  Synthetic Oligonucleotide; PRDM1 exon 5; Set C
guuggaguccaauuuu

SEQ ID NO: 29096 - RNA, 18 nt, Artificial Sequence
  Synthetic Oligonucleotide; PRDM1 exon 5; Set C
gguuggaguccaauuuua

SEQ ID NO: 29097 - RNA, 20 nt, Artificial Sequence
  Synthetic Oligonucleotide; PRDM1 exon 5; Set C
ggguuggaguccaauuuuag

SEQ ID NO: 29098 - RNA, 22 nt, Artificial Sequence
  Synthetic Oligonucleotide; PRDM1 exon 5; Set A
gggguuggaguccaauuuuagg

SEQ ID NO: 29099 - RNA, 15 nt, Artificial Sequence
  Synthetic Oligonucleotide; PRDM1 exon 5; Set C
guuggaguccaauuu

SEQ ID NO: 29100 - RNA, 17 nt, Artificial Sequence
  Synthetic Oligonucleotide; PRDM1 exon 5; Set C
gguuggaguccaauuuu

SEQ ID NO: 29101 - RNA, 21 nt, Artificial Sequence
  Synthetic Oligonucleotide; PRDM1 exon 5; Set C
gggguuggaguccaauuuuag

SEQ ID NO: 29102 - RNA, 16 nt, Artificial Sequence
  Synthetic Oligonucleotide; PRDM1 exon 5; Set C
gguuggaguccaauuu

SEQ ID NO: 29103 - RNA, 17 nt, Artificial Sequence
  Synthetic Oligonucleotide; PRDM1 exon 5; Set C
ggguuggaguccaauuu

SEQ ID NO: 29104 - RNA, 31 nt, Artificial Sequence
  Synthetic Oligonucleotide; PRDM1 exon 5; Set A
uuuggagggguuggaguccaauuuuaggauu

SEQ ID NO: 29105 - RNA, 40 nt, Artificial Sequence
  Synthetic Oligonucleotide; PRDM1 exon 5; Set C
uuuccuuuggagggguuggaguccaauuuuaggauuucuu

SEQ ID NO: 29106 - RNA, 32 nt, Artificial Sequence
  Synthetic Oligonucleotide; PRDM1 exon 5; Set C
cuuuggagggguuggaguccaauuuuaggauu

SEQ ID NO: 29107 - RNA, 30 nt, Artificial Sequence
  Synthetic Oligonucleotide; PRDM1 exon 5; Set A
uuuggagggguuggaguccaauuuuaggau

SEQ ID NO: 29108 - RNA, 39 nt, Artificial Sequence
  Synthetic Oligonucleotide; PRDM1 exon 5; Set C
uuuccuuuggagggguuggaguccaauuuuaggauuucu

SEQ ID NO: 29109 - RNA, 33 nt, Artificial Sequence
  Synthetic Oligonucleotide; PRDM1 exon 5; Set C
ccuuuggagggguuggaguccaauuuuaggauu

SEQ ID NO: 29110 - RNA, 31 nt, Artificial Sequence
  Synthetic Oligonucleotide; PRDM1 exon 5; Set A
cuuuggagggguuggaguccaauuuuaggau

SEQ ID NO: 29111 - RNA, 29 nt, Artificial Sequence
  Synthetic Oligonucleotide; PRDM1 exon 5; Set A
uuuggagggguuggaguccaauuuuagga

SEQ ID NO: 29112 - RNA, 38 nt, Artificial Sequence
  Synthetic Oligonucleotide; PRDM1 exon 5; Set C
uuuccuuuggagggguuggaguccaauuuuaggauuuc

SEQ ID NO: 29113 - RNA, 34 nt, Artificial Sequence
  Synthetic Oligonucleotide; PRDM1 exon 5; Set C
uccuuuggagggguuggaguccaauuuuaggauu

SEQ ID NO: 29114 - RNA, 32 nt, Artificial Sequence
  Synthetic Oligonucleotide; PRDM1 exon 5; Set C
ccuuuggagggguuggaguccaauuuuaggau

SEQ ID NO: 29115 - RNA, 30 nt, Artificial Sequence
  Synthetic Oligonucleotide; PRDM1 exon 5; Set C
cuuuggagggguuggaguccaauuuuagga

SEQ ID NO: 29116 - RNA, 28 nt, Artificial Sequence
  Synthetic Oligonucleotide; PRDM1 exon 5; Set A
uuuggagggguuggaguccaauuuuagg

SEQ ID NO: 29117 - RNA, 37 nt, Artificial Sequence
  Synthetic Oligonucleotide; PRDM1 exon 5; Set C
uuuccuuuggagggguuggaguccaauuuuaggauuu

SEQ ID NO: 29118 - RNA, 35 nt, Artificial Sequence
  Synthetic Oligonucleotide; PRDM1 exon 5; Set C
uuccuuuggagggguuggaguccaauuuuaggauu

SEQ ID NO: 29119 - RNA, 33 nt, Artificial Sequence
  Synthetic Oligonucleotide; PRDM1 exon 5; Set C
uccuuuggagggguuggaguccaauuuuaggau

SEQ ID NO: 29120 - RNA, 27 nt, Artificial Sequence
  Synthetic Oligonucleotide; PRDM1 exon 5; Set A
uuuggagggguuggaguccaauuuuag

SEQ ID NO: 29121 - RNA, 31 nt, Artificial Sequence
  Synthetic Oligonucleotide; PRDM1 exon 5; Set C
ccuuuggagggguuggaguccaauuuuagga

SEQ ID NO: 29122 - RNA, 29 nt, Artificial Sequence
  Synthetic Oligonucleotide; PRDM1 exon 5; Set A
cuuuggagggguuggaguccaauuuuagg

SEQ ID NO: 29123 - RNA, 34 nt, Artificial Sequence
  Synthetic Oligonucleotide; PRDM1 exon 5; Set C
uuccuuuggagggguuggaguccaauuuuaggau

SEQ ID NO: 29124 - RNA, 28 nt, Artificial Sequence
  Synthetic Oligonucleotide; PRDM1 exon 5; Set A
cuuuggagggguuggaguccaauuuuag

SEQ ID NO: 29125 - RNA, 32 nt, Artificial Sequence
  Synthetic Oligonucleotide; PRDM1 exon 5; Set C
uccuuuggagggguuggaguccaauuuuagga

SEQ ID NO: 29126 - RNA, 30 nt, Artificial Sequence
  Synthetic Oligonucleotide; PRDM1 exon 5; Set C
ccuuuggagggguuggaguccaauuuuagg

SEQ ID NO: 29127 - RNA, 29 nt, Artificial Sequence
  Synthetic Oligonucleotide; PRDM1 exon 5; Set A
ccuuuggagggguuggaguccaauuuuag

SEQ ID NO: 29128 - RNA, 33 nt, Artificial Sequence
  Synthetic Oligonucleotide; PRDM1 exon 5; Set C
uuccuuuggagggguuggaguccaauuuuagga

SEQ ID NO: 29129 - RNA, 31 nt, Artificial Sequence
  Synthetic Oligonucleotide; PRDM1 exon 5; Set C
uccuuuggagggguuggaguccaauuuuagg

SEQ ID NO: 29130 - RNA, 30 nt, Artificial Sequence
  Synthetic Oligonucleotide; PRDM1 exon 5; Set A
uccuuuggagggguuggaguccaauuuuag

SEQ ID NO: 29131 - RNA, 32 nt, Artificial Sequence
  Synthetic Oligonucleotide; PRDM1 exon 5; Set C
uuccuuuggagggguuggaguccaauuuuagg

SEQ ID NO: 29132 - RNA, 31 nt, Artificial Sequence
  Synthetic Oligonucleotide; PRDM1 exon 5; Set A
uuccuuuggagggguuggaguccaauuuuag

SEQ ID NO: 29133 - RNA, 31 nt, Artificial Sequence
  Synthetic Oligonucleotide; PRDM1 exon 5; Set A
uuuccuuuggagggguuggaguccaauuuua

SEQ ID NO: 29134 - RNA, 30 nt, Artificial Sequence
  Synthetic Oligonucleotide; PRDM1 exon 5; Set A
uuuccuuuggagggguuggaguccaauuuu

SEQ ID NO: 29135 - RNA, 29 nt, Artificial Sequence
  Synthetic Oligonucleotide; PRDM1 exon 5; Set A
uuuccuuuggagggguuggaguccaauuu

SEQ ID NO: 29136 - RNA, 40 nt, Artificial Sequence
  Synthetic Oligonucleotide; PRDM1 exon 5; Set C
agguccuuuccuuuggagggguuggaguccaauuuuagga

SEQ ID NO: 29137 - RNA, 15 nt, Artificial Sequence
  Synthetic Oligonucleotide; PRDM1 exon 5; Set C
uuggagggguuggag

SEQ ID NO: 29138 - RNA, 39 nt, Artificial Sequence
  Synthetic Oligonucleotide; PRDM1 exon 5; Set C
agguccuuuccuuuggagggguuggaguccaauuuuagg

SEQ ID NO: 29139 - RNA, 17 nt, Artificial Sequence
  Synthetic Oligonucleotide; PRDM1 exon 5; Set C
uuuggagggguuggagu

SEQ ID NO: 29140 - RNA, 36 nt, Artificial Sequence
  Synthetic Oligonucleotide; PRDM1 exon 5; Set C
gguccuuuccuuuggagggguuggaguccaauuuua

SEQ ID NO: 29141 - RNA, 38 nt, Artificial Sequence
  Synthetic Oligonucleotide; PRDM1 exon 5; Set C
agguccuuuccuuuggagggguuggaguccaauuuuag

SEQ ID NO: 29142 - RNA, 40 nt, Artificial Sequence
  Synthetic Oligonucleotide; PRDM1 exon 5; Set C
gagguccuuuccuuuggagggguuggaguccaauuuuagg

SEQ ID NO: 29143 - RNA, 18 nt, Artificial Sequence
  Synthetic Oligonucleotide; PRDM1 exon 5; Set C
cuuuggagggguuggagu

SEQ ID NO: 29144 - RNA, 35 nt, Artificial Sequence
  Synthetic Oligonucleotide; PRDM1 exon 5; Set C
gguccuuuccuuuggagggguuggaguccaauuuu

SEQ ID NO: 29145 - RNA, 37 nt, Artificial Sequence
  Synthetic Oligonucleotide; PRDM1 exon 5; Set C
agguccuuuccuuuggagggguuggaguccaauuuua

SEQ ID NO: 29146 - RNA, 39 nt, Artificial Sequence
  Synthetic Oligonucleotide; PRDM1 exon 5; Set C
gagguccuuuccuuuggagggguuggaguccaauuuuag

SEQ ID NO: 29147 - RNA, 19 nt, Artificial Sequence
  Synthetic Oligonucleotide; PRDM1 exon 5; Set A
ccuuuggagggguuggagu

SEQ ID NO: 29148 - RNA, 34 nt, Artificial Sequence
  Synthetic Oligonucleotide; PRDM1 exon 5; Set C
gguccuuuccuuuggagggguuggaguccaauuu

SEQ ID NO: 29149 - RNA, 40 nt, Artificial Sequence
  Synthetic Oligonucleotide; PRDM1 exon 5; Set C
agagguccuuuccuuuggagggguuggaguccaauuuuag

SEQ ID NO: 29150 - RNA, 21 nt, Artificial Sequence
  Synthetic Oligonucleotide; PRDM1 exon 5; Set A
uuuccuuuggagggguuggag

SEQ ID NO: 29151 - RNA, 20 nt, Artificial Sequence
  Synthetic Oligonucleotide; PRDM1 exon 5; Set A
uuuccuuuggagggguugga

SEQ ID NO: 29152 - RNA, 19 nt, Artificial Sequence
  Synthetic Oligonucleotide; PRDM1 exon 5; Set C
uuuccuuuggagggguugg

SEQ ID NO: 29153 - RNA, 18 nt, Artificial Sequence
  Synthetic Oligonucleotide; PRDM1 exon 5; Set C
uuuccuuuggagggguug

SEQ ID NO: 29154 - RNA, 17 nt, Artificial Sequence
  Synthetic Oligonucleotide; PRDM1 exon 5; Set C
uuuccuuuggagggguu

SEQ ID NO: 29155 - RNA, 26 nt, Artificial Sequence
  Synthetic Oligonucleotide; PRDM1 exon 5; Set C
gguccuuuccuuuggagggguuggag

SEQ ID NO: 29156 - RNA, 16 nt, Artificial Sequence
  Synthetic Oligonucleotide; PRDM1 exon 5; Set C
uuuccuuuggaggggu

SEQ ID NO: 29157 - RNA, 28 nt, Artificial Sequence
  Synthetic Oligonucleotide; PRDM1 exon 5; Set C
agguccuuuccuuuggagggguuggagu

SEQ ID NO: 29158 - RNA, 15 nt, Artificial Sequence
  Synthetic Oligonucleotide; PRDM1 exon 5; Set C
uuuccuuuggagggg

SEQ ID NO: 29159 - RNA, 25 nt, Artificial Sequence
  Synthetic Oligonucleotide; PRDM1 exon 5; Set C
gguccuuuccuuuggagggguugga

SEQ ID NO: 29160 - RNA, 29 nt, Artificial Sequence
  Synthetic Oligonucleotide; PRDM1 exon 5; Set C
gagguccuuuccuuuggagggguuggagu

SEQ ID NO: 29161 - RNA, 24 nt, Artificial Sequence
  Synthetic Oligonucleotide; PRDM1 exon 5; Set C
gguccuuuccuuuggagggguugg

SEQ ID NO: 29162 - RNA, 30 nt, Artificial Sequence
  Synthetic Oligonucleotide; PRDM1 exon 5; Set C
agagguccuuuccuuuggagggguuggagu

SEQ ID NO: 29163 - RNA, 23 nt, Artificial Sequence
  Synthetic Oligonucleotide; PRDM1 exon 5; Set A
gguccuuuccuuuggagggguug

SEQ ID NO: 29164 - RNA, 31 nt, Artificial Sequence
  Synthetic Oligonucleotide; PRDM1 exon 5; Set C
uagagguccuuuccuuuggagggguuggagu

SEQ ID NO: 29165 - RNA, 22 nt, Artificial Sequence
  Synthetic Oligonucleotide; PRDM1 exon 5; Set A
gguccuuuccuuuggagggguu

SEQ ID NO: 29166 - RNA, 32 nt, Artificial Sequence
  Synthetic Oligonucleotide; PRDM1 exon 5; Set C
guagagguccuuuccuuuggagggguuggagu

SEQ ID NO: 29167 - RNA, 21 nt, Artificial Sequence
  Synthetic Oligonucleotide; PRDM1 exon 5; Set A
gguccuuuccuuuggaggggu

SEQ ID NO: 29168 - RNA, 20 nt, Artificial Sequence
  Synthetic Oligonucleotide; PRDM1 exon 5; Set A
gguccuuuccuuuggagggg

SEQ ID NO: 29169 - RNA, 19 nt, Artificial Sequence
  Synthetic Oligonucleotide; PRDM1 exon 5; Set A
gguccuuuccuuuggaggg

SEQ ID NO: 29170 - RNA, 27 nt, Artificial Sequence
  Synthetic Oligonucleotide; PRDM1 exon 5; Set A
guuagaacgguagagguccuuuccuuu

SEQ ID NO: 29171 - RNA, 28 nt, Artificial Sequence
  Synthetic Oligonucleotide; PRDM1 exon 5; Set A
uguuagaacgguagagguccuuuccuuu

SEQ ID NO: 29172 - RNA, 26 nt, Artificial Sequence
  Synthetic Oligonucleotide; PRDM1 exon 5; Set A
guuagaacgguagagguccuuuccuu

SEQ ID NO: 29173 - RNA, 25 nt, Artificial Sequence
  Synthetic Oligonucleotide; PRDM1 exon 5; Set A
guuagaacgguagagguccuuuccu

SEQ ID NO: 29174 - RNA, 29 nt, Artificial Sequence
  Synthetic Oligonucleotide; PRDM1 exon 5; Set A
auguuagaacgguagagguccuuuccuuu

SEQ ID NO: 29175 - RNA, 27 nt, Artificial Sequence
  Synthetic Oligonucleotide; PRDM1 exon 5; Set A
uguuagaacgguagagguccuuuccuu

SEQ ID NO: 29176 - RNA, 26 nt, Artificial Sequence
  Synthetic Oligonucleotide; PRDM1 exon 5; Set A
uguuagaacgguagagguccuuuccu

SEQ ID NO: 29177 - RNA, 24 nt, Artificial Sequence
  Synthetic Oligonucleotide; PRDM1 exon 5; Set A
guuagaacgguagagguccuuucc

SEQ ID NO: 29178 - RNA, 28 nt, Artificial Sequence
  Synthetic Oligonucleotide; PRDM1 exon 5; Set A
auguuagaacgguagagguccuuuccuu

SEQ ID NO: 29179 - RNA, 23 nt, Artificial Sequence
  Synthetic Oligonucleotide; PRDM1 exon 5; Set A
guuagaacgguagagguccuuuc

SEQ ID NO: 29180 - RNA, 25 nt, Artificial Sequence
  Synthetic Oligonucleotide; PRDM1 exon 5; Set A
uguuagaacgguagagguccuuucc

SEQ ID NO: 29181 - RNA, 27 nt, Artificial Sequence
  Synthetic Oligonucleotide; PRDM1 exon 5; Set A
auguuagaacgguagagguccuuuccu

SEQ ID NO: 29182 - RNA, 29 nt, Artificial Sequence
  Synthetic Oligonucleotide; PRDM1 exon 5; Set A
aauguuagaacgguagagguccuuuccuu

SEQ ID NO: 29183 - RNA, 24 nt, Artificial Sequence
  Synthetic Oligonucleotide; PRDM1 exon 5; Set A
uguuagaacgguagagguccuuuc

SEQ ID NO: 29184 - RNA, 28 nt, Artificial Sequence
  Synthetic Oligonucleotide; PRDM1 exon 5; Set A
aauguuagaacgguagagguccuuuccu

SEQ ID NO: 29185 - RNA, 26 nt, Artificial Sequence
  Synthetic Oligonucleotide; PRDM1 exon 5; Set A
auguuagaacgguagagguccuuucc

SEQ ID NO: 29186 - RNA, 25 nt, Artificial Sequence
  Synthetic Oligonucleotide; PRDM1 exon 5; Set A
auguuagaacgguagagguccuuuc

SEQ ID NO: 29187 - RNA, 27 nt, Artificial Sequence
  Synthetic Oligonucleotide; PRDM1 exon 5; Set A
aauguuagaacgguagagguccuuucc

SEQ ID NO: 29188 - RNA, 26 nt, Artificial Sequence
  Synthetic Oligonucleotide; PRDM1 exon 5; Set A
aauguuagaacgguagagguccuuuc

SEQ ID NO: 29189 - RNA, 28 nt, Artificial Sequence
  Synthetic Oligonucleotide; PRDM1 exon 5; Set A
aaauguuagaacgguagagguccuuucc

SEQ ID NO: 29190 - RNA, 27 nt, Artificial Sequence
  Synthetic Oligonucleotide; PRDM1 exon 5; Set C
aaauguuagaacgguagagguccuuuc

SEQ ID NO: 29191 - RNA, 17 nt, Artificial Sequence
  Synthetic Oligonucleotide; PRDM1 exon 5; Set C
guuagaacgguagaggu

SEQ ID NO: 29192 - RNA, 16 nt, Artificial Sequence
  Synthetic Oligonucleotide; PRDM1 exon 5; Set C
guuagaacgguagagg

SEQ ID NO: 29193 - RNA, 18 nt, Artificial Sequence
  Synthetic Oligonucleotide; PRDM1 exon 5; Set C
uguuagaacgguagaggu

SEQ ID NO: 29194 - RNA, 15 nt, Artificial Sequence
  Synthetic Oligonucleotide; PRDM1 exon 5; Set C
guuagaacgguagag

SEQ ID NO: 29195 - RNA, 37 nt, Artificial Sequence
  Synthetic Oligonucleotide; PRDM1 exon 5; Set C
aggggugaaauguuagaacgguagagguccuuuccuu

SEQ ID NO: 29196 - RNA, 17 nt, Artificial Sequence
  Synthetic Oligonucleotide; PRDM1 exon 5; Set C
uguuagaacgguagagg

SEQ ID NO: 29197 - RNA, 19 nt, Artificial Sequence
  Synthetic Oligonucleotide; PRDM1 exon 5; Set C
auguuagaacgguagaggu

SEQ ID NO: 29198 - RNA, 16 nt, Artificial Sequence
  Synthetic Oligonucleotide; PRDM1 exon 5; Set C
uguuagaacgguagag

SEQ ID NO: 29199 - RNA, 18 nt, Artificial Sequence
  Synthetic Oligonucleotide; PRDM1 exon 5; Set C
auguuagaacgguagagg

SEQ ID NO: 29200 - RNA, 20 nt, Artificial Sequence
  Synthetic Oligonucleotide; PRDM1 exon 5; Set C
aauguuagaacgguagaggu

SEQ ID NO: 29201 - RNA, 15 nt, Artificial Sequence
  Synthetic Oligonucleotide; PRDM1 exon 5; Set C
uguuagaacgguaga

SEQ ID NO: 29202 - RNA, 17 nt, Artificial Sequence
  Synthetic Oligonucleotide; PRDM1 exon 5; Set C
auguuagaacgguagag

SEQ ID NO: 29203 - RNA, 35 nt, Artificial Sequence
  Synthetic Oligonucleotide; PRDM1 exon 5; Set C
aggggugaaauguuagaacgguagagguccuuucc

SEQ ID NO: 29204 - RNA, 19 nt, Artificial Sequence
  Synthetic Oligonucleotide; PRDM1 exon 5; Set C
aauguuagaacgguagagg

SEQ ID NO: 29205 - RNA, 21 nt, Artificial Sequence
  Synthetic Oligonucleotide; PRDM1 exon 5; Set C
aaauguuagaacgguagaggu

SEQ ID NO: 29206 - RNA, 16 nt, Artificial Sequence
  Synthetic Oligonucleotide; PRDM1 exon 5; Set C
auguuagaacgguaga

SEQ ID NO: 29207 - RNA, 34 nt, Artificial Sequence
  Synthetic Oligonucleotide; PRDM1 exon 5; Set C
aggggugaaauguuagaacgguagagguccuuuc

SEQ ID NO: 29208 - RNA, 20 nt, Artificial Sequence
  Synthetic Oligonucleotide; PRDM1 exon 5; Set C
aaauguuagaacgguagagg

SEQ ID NO: 29209 - RNA, 22 nt, Artificial Sequence
  Synthetic Oligonucleotide; PRDM1 exon 5; Set C
gaaauguuagaacgguagaggu

SEQ ID NO: 29210 - RNA, 17 nt, Artificial Sequence
  Synthetic Oligonucleotide; PRDM1 exon 5; Set C
aauguuagaacgguaga

SEQ ID NO: 29211 - RNA, 15 nt, Artificial Sequence
  Synthetic Oligonucleotide; PRDM1 exon 5; Set C
auguuagaacgguag

SEQ ID NO: 29212 - RNA, 23 nt, Artificial Sequence
  Synthetic Oligonucleotide; PRDM1 exon 5; Set C
ugaaauguuagaacgguagaggu

SEQ ID NO: 29213 - RNA, 16 nt, Artificial Sequence
  Synthetic Oligonucleotide; PRDM1 exon 5; Set C
aauguuagaacgguag

SEQ ID NO: 29214 - RNA, 24 nt, Artificial Sequence
  Synthetic Oligonucleotide; PRDM1 exon 5; Set C
gugaaauguuagaacgguagaggu

SEQ ID NO: 29215 - RNA, 17 nt, Artificial Sequence
  Synthetic Oligonucleotide; PRDM1 exon 5; Set C
aaauguuagaacgguag

SEQ ID NO: 29216 - RNA, 15 nt, Artificial Sequence
  Synthetic Oligonucleotide; PRDM1 exon 5; Set C
aauguuagaacggua

SEQ ID NO: 29217 - RNA, 25 nt, Artificial Sequence
  Synthetic Oligonucleotide; PRDM1 exon 5; Set A
ggugaaauguuagaacgguagaggu

SEQ ID NO: 29218 - RNA, 16 nt, Artificial Sequence
  Synthetic Oligonucleotide; PRDM1 exon 5; Set C
aaauguuagaacggua

SEQ ID NO: 29219 - RNA, 26 nt, Artificial Sequence
  Synthetic Oligonucleotide; PRDM1 exon 5; Set A
gggugaaauguuagaacgguagaggu

SEQ ID NO: 29220 - RNA, 17 nt, Artificial Sequence
  Synthetic Oligonucleotide; PRDM1 exon 5; Set C
gaaauguuagaacggua

SEQ ID NO: 29221 - RNA, 27 nt, Artificial Sequence
  Synthetic Oligonucleotide; PRDM1 exon 5; Set A
ggggugaaauguuagaacgguagaggu

SEQ ID NO: 29222 - RNA, 28 nt, Artificial Sequence
  Synthetic Oligonucleotide; PRDM1 exon 5; Set A
aggggugaaauguuagaacgguagaggu

SEQ ID NO: 29223 - RNA, 29 nt, Artificial Sequence
  Synthetic Oligonucleotide; PRDM1 exon 5; Set A
gaggggugaaauguuagaacgguagaggu

SEQ ID NO: 29224 - RNA, 30 nt, Artificial Sequence
  Synthetic Oligonucleotide; PRDM1 exon 5; Set A
ugaggggugaaauguuagaacgguagaggu

SEQ ID NO: 29225 - RNA, 39 nt, Artificial Sequence
  Synthetic Oligonucleotide; PRDM1 exon 5; Set C
uuucugaugugaggggugaaauguuagaacgguagaggu

SEQ ID NO: 29226 - RNA, 40 nt, Artificial Sequence
  Synthetic Oligonucleotide; PRDM1 exon 5; Set C
uuuucugaugugaggggugaaauguuagaacgguagaggu

SEQ ID NO: 29227 - RNA, 15 nt, Artificial Sequence
  Synthetic Oligonucleotide; PRDM1 exon 5; Set C
aggggugaaauguua

SEQ ID NO: 29228 - RNA, 16 nt, Artificial Sequence
  Synthetic Oligonucleotide; PRDM1 exon 5; Set C
gaggggugaaauguua

SEQ ID NO: 29229 - RNA, 17 nt, Artificial Sequence
  Synthetic Oligonucleotide; PRDM1 exon 5; Set C
ugaggggugaaauguua

SEQ ID NO: 29230 - RNA, 40 nt, Artificial Sequence
  Synthetic Oligonucleotide; PRDM1 exon 5; Set C
gguccuuuucugaugugaggggugaaauguuagaacggua

SEQ ID NO: 29231 - RNA, 26 nt, Artificial Sequence
  Synthetic Oligonucleotide; PRDM1 exon 5; Set A
uuucugaugugaggggugaaauguua

SEQ ID NO: 29232 - RNA, 27 nt, Artificial Sequence
  Synthetic Oligonucleotide; PRDM1 exon 5; Set A
uuuucugaugugaggggugaaauguua

SEQ ID NO: 29233 - RNA, 28 nt, Artificial Sequence
  Synthetic Oligonucleotide; PRDM1 exon 5; Set A
cuuuucugaugugaggggugaaauguua

SEQ ID NO: 29234 - RNA, 29 nt, Artificial Sequence
  Synthetic Oligonucleotide; PRDM1 exon 5; Set A
ccuuuucugaugugaggggugaaauguua

SEQ ID NO: 29235 - RNA, 30 nt, Artificial Sequence
  Synthetic Oligonucleotide; PRDM1 exon 5; Set A
uccuuuucugaugugaggggugaaauguua

SEQ ID NO: 29236 - RNA, 31 nt, Artificial Sequence
  Synthetic Oligonucleotide; PRDM1 exon 5; Set A
guccuuuucugaugugaggggugaaauguua

SEQ ID NO: 29237 - RNA, 34 nt, Artificial Sequence
  Synthetic Oligonucleotide; PRDM1 exon 5; Set C
gagguccuuuucugaugugaggggugaaauguua

SEQ ID NO: 29238 - RNA, 15 nt, Artificial Sequence
  Synthetic Oligonucleotide; PRDM1 exon 5; Set C
uuuucugaugugagg

SEQ ID NO: 29239 - RNA, 16 nt, Artificial Sequence
  Synthetic Oligonucleotide; PRDM1 exon 5; Set C
cuuuucugaugugagg

SEQ ID NO: 29240 - RNA, 15 nt, Artificial Sequence
  Synthetic Oligonucleotide; PRDM1 exon 5; Set C
cuuuucugaugugag

SEQ ID NO: 29241 - RNA, 16 nt, Artificial Sequence
  Synthetic Oligonucleotide; PRDM1 exon 5; Set C
ccuuuucugaugugag

SEQ ID NO: 29242 - RNA, 21 nt, Artificial Sequence
  Synthetic Oligonucleotide; PRDM1 exon 5; Set A
gguccuuuucugaugugaggg

SEQ ID NO: 29243 - RNA, 15 nt, Artificial Sequence
  Synthetic Oligonucleotide; PRDM1 exon 5; Set C
ccuuuucugauguga

SEQ ID NO: 29244 - RNA, 17 nt, Artificial Sequence
  Synthetic Oligonucleotide; PRDM1 exon 5; Set C
uccuuuucugaugugag

SEQ ID NO: 29245 - RNA, 34 nt, Artificial Sequence
  Synthetic Oligonucleotide; PRDM1 exon 5; Set C
ucaucgagguccuuuucugaugugaggggugaaa

SEQ ID NO: 29246 - RNA, 20 nt, Artificial Sequence
  Synthetic Oligonucleotide; PRDM1 exon 5; Set C
gguccuuuucugaugugagg

SEQ ID NO: 29247 - RNA, 33 nt, Artificial Sequence
  Synthetic Oligonucleotide; PRDM1 exon 5; Set C
ucaucgagguccuuuucugaugugaggggugaa

SEQ ID NO: 29248 - RNA, 21 nt, Artificial Sequence
  Synthetic Oligonucleotide; PRDM1 exon 5; Set C
agguccuuuucugaugugagg

SEQ ID NO: 29249 - RNA, 19 nt, Artificial Sequence
  Synthetic Oligonucleotide; PRDM1 exon 5; Set C
gguccuuuucugaugugag

SEQ ID NO: 29250 - RNA, 34 nt, Artificial Sequence
  Synthetic Oligonucleotide; PRDM1 exon 5; Set C
gucaucgagguccuuuucugaugugaggggugaa

SEQ ID NO: 29251 - RNA, 32 nt, Artificial Sequence
  Synthetic Oligonucleotide; PRDM1 exon 5; Set C
ucaucgagguccuuuucugaugugagggguga

SEQ ID NO: 29252 - RNA, 18 nt, Artificial Sequence
  Synthetic Oligonucleotide; PRDM1 exon 5; Set C
gguccuuuucugauguga

SEQ ID NO: 29253 - RNA, 22 nt, Artificial Sequence
  Synthetic Oligonucleotide; PRDM1 exon 5; Set A
gagguccuuuucugaugugagg

SEQ ID NO: 29254 - RNA, 20 nt, Artificial Sequence
  Synthetic Oligonucleotide; PRDM1 exon 5; Set C
agguccuuuucugaugugag

SEQ ID NO: 29255 - RNA, 31 nt, Artificial Sequence
  Synthetic Oligonucleotide; PRDM1 exon 5; Set C
ucaucgagguccuuuucugaugugaggggug

SEQ ID NO: 29256 - RNA, 33 nt, Artificial Sequence
  Synthetic Oligonucleotide; PRDM1 exon 5; Set C
gucaucgagguccuuuucugaugugagggguga

SEQ ID NO: 29257 - RNA, 19 nt, Artificial Sequence
  Synthetic Oligonucleotide; PRDM1 exon 5; Set C
agguccuuuucugauguga

SEQ ID NO: 29258 - RNA, 21 nt, Artificial Sequence
  Synthetic Oligonucleotide; PRDM1 exon 5; Set C
gagguccuuuucugaugugag

SEQ ID NO: 29259 - RNA, 30 nt, Artificial Sequence
  Synthetic Oligonucleotide; PRDM1 exon 5; Set C
ucaucgagguccuuuucugaugugaggggu

SEQ ID NO: 29260 - RNA, 32 nt, Artificial Sequence
  Synthetic Oligonucleotide; PRDM1 exon 5; Set C
gucaucgagguccuuuucugaugugaggggug

SEQ ID NO: 29261 - RNA, 20 nt, Artificial Sequence
  Synthetic Oligonucleotide; PRDM1 exon 5; Set C
gagguccuuuucugauguga

SEQ ID NO: 29262 - RNA, 31 nt, Artificial Sequence
  Synthetic Oligonucleotide; PRDM1 exon 5; Set C
gucaucgagguccuuuucugaugugaggggu

SEQ ID NO: 29263 - RNA, 29 nt, Artificial Sequence
  Synthetic Oligonucleotide; PRDM1 exon 5; Set C
ucaucgagguccuuuucugaugugagggg

SEQ ID NO: 29264 - RNA, 30 nt, Artificial Sequence
  Synthetic Oligonucleotide; PRDM1 exon 5; Set C
gucaucgagguccuuuucugaugugagggg

SEQ ID NO: 29265 - RNA, 28 nt, Artificial Sequence
  Synthetic Oligonucleotide; PRDM1 exon 5; Set A
ucaucgagguccuuuucugaugugaggg

SEQ ID NO: 29266 - RNA, 29 nt, Artificial Sequence
  Synthetic Oligonucleotide; PRDM1 exon 5; Set C
gucaucgagguccuuuucugaugugaggg

SEQ ID NO: 29267 - RNA, 27 nt, Artificial Sequence
  Synthetic Oligonucleotide; PRDM1 exon 5; Set A
ucaucgagguccuuuucugaugugagg

SEQ ID NO: 29268 - RNA, 28 nt, Artificial Sequence
  Synthetic Oligonucleotide; PRDM1 exon 5; Set A
gucaucgagguccuuuucugaugugagg

SEQ ID NO: 29269 - RNA, 26 nt, Artificial Sequence
  Synthetic Oligonucleotide; PRDM1 exon 5; Set A
ucaucgagguccuuuucugaugugag

SEQ ID NO: 29270 - RNA, 25 nt, Artificial Sequence
  Synthetic Oligonucleotide; PRDM1 exon 5; Set A
ucaucgagguccuuuucugauguga

SEQ ID NO: 29271 - RNA, 27 nt, Artificial Sequence
  Synthetic Oligonucleotide; PRDM1 exon 5; Set A
gucaucgagguccuuuucugaugugag

SEQ ID NO: 29272 - RNA, 26 nt, Artificial Sequence
  Synthetic Oligonucleotide; PRDM1 exon 5; Set A
gucaucgagguccuuuucugauguga

SEQ ID NO: 29273 - RNA, 40 nt, Artificial Sequence
  Synthetic Oligonucleotide; PRDM1 exon 5; Set C
uuucggggcucccacgucuucuaaagucaucgagguccuu

SEQ ID NO: 29274 - RNA, 39 nt, Artificial Sequence
  Synthetic Oligonucleotide; PRDM1 exon 5; Set C
uuucggggcucccacgucuucuaaagucaucgagguccu

SEQ ID NO: 29275 - RNA, 40 nt, Artificial Sequence
  Synthetic Oligonucleotide; PRDM1 exon 5; Set C
auuucggggcucccacgucuucuaaagucaucgagguccu

SEQ ID NO: 29276 - RNA, 38 nt, Artificial Sequence
  Synthetic Oligonucleotide; PRDM1 exon 5; Set C
uuucggggcucccacgucuucuaaagucaucgaggucc

SEQ ID NO: 29277 - RNA, 39 nt, Artificial Sequence
  Synthetic Oligonucleotide; PRDM1 exon 5; Set C
auuucggggcucccacgucuucuaaagucaucgaggucc

SEQ ID NO: 29278 - RNA, 37 nt, Artificial Sequence
  Synthetic Oligonucleotide; PRDM1 exon 5; Set C
uuucggggcucccacgucuucuaaagucaucgagguc

SEQ ID NO: 29279 - RNA, 40 nt, Artificial Sequence
  Synthetic Oligonucleotide; PRDM1 exon 5; Set C
cauuucggggcucccacgucuucuaaagucaucgaggucc

SEQ ID NO: 29280 - RNA, 38 nt, Artificial Sequence
  Synthetic Oligonucleotide; PRDM1 exon 5; Set C
auuucggggcucccacgucuucuaaagucaucgagguc

SEQ ID NO: 29281 - RNA, 39 nt, Artificial Sequence
  Synthetic Oligonucleotide; PRDM1 exon 5; Set C
cauuucggggcucccacgucuucuaaagucaucgagguc

SEQ ID NO: 29282 - RNA, 40 nt, Artificial Sequence
  Synthetic Oligonucleotide; PRDM1 exon 5; Set C
gcauuucggggcucccacgucuucuaaagucaucgagguc

SEQ ID NO: 29283 - RNA, 31 nt, Artificial Sequence
  Synthetic Oligonucleotide; PRDM1 exon 5; Set C
ggcauuucggggcucccacgucuucuaaagu

SEQ ID NO: 29284 - RNA, 32 nt, Artificial Sequence
  Synthetic Oligonucleotide; PRDM1 exon 5; Set C
gggcauuucggggcucccacgucuucuaaagu

SEQ ID NO: 29285 - RNA, 33 nt, Artificial Sequence
  Synthetic Oligonucleotide; PRDM1 exon 5; Set C
agggcauuucggggcucccacgucuucuaaagu

SEQ ID NO: 29286 - RNA, 31 nt, Artificial Sequence
  Synthetic Oligonucleotide; PRDM1 exon 5; Set C
gggcauuucggggcucccacgucuucuaaag

SEQ ID NO: 29287 - RNA, 34 nt, Artificial Sequence
  Synthetic Oligonucleotide; PRDM1 exon 5; Set C
aagggcauuucggggcucccacgucuucuaaagu

SEQ ID NO: 29288 - RNA, 32 nt, Artificial Sequence
  Synthetic Oligonucleotide; PRDM1 exon 5; Set C
agggcauuucggggcucccacgucuucuaaag

SEQ ID NO: 29289 - RNA, 35 nt, Artificial Sequence
  Synthetic Oligonucleotide; PRDM1 exon 5; Set C
gaagggcauuucggggcucccacgucuucuaaagu

SEQ ID NO: 29290 - RNA, 33 nt, Artificial Sequence
  Synthetic Oligonucleotide; PRDM1 exon 5; Set C
aagggcauuucggggcucccacgucuucuaaag

SEQ ID NO: 29291 - RNA, 31 nt, Artificial Sequence
  Synthetic Oligonucleotide; PRDM1 exon 5; Set C
agggcauuucggggcucccacgucuucuaaa

SEQ ID NO: 29292 - RNA, 36 nt, Artificial Sequence
  Synthetic Oligonucleotide; PRDM1 exon 5; Set C
agaagggcauuucggggcucccacgucuucuaaagu

SEQ ID NO: 29293 - RNA, 34 nt, Artificial Sequence
  Synthetic Oligonucleotide; PRDM1 exon 5; Set C
gaagggcauuucggggcucccacgucuucuaaag

SEQ ID NO: 29294 - RNA, 32 nt, Artificial Sequence
  Synthetic Oligonucleotide; PRDM1 exon 5; Set C
aagggcauuucggggcucccacgucuucuaaa

SEQ ID NO: 29295 - RNA, 37 nt, Artificial Sequence
  Synthetic Oligonucleotide; PRDM1 exon 5; Set C
uagaagggcauuucggggcucccacgucuucuaaagu

SEQ ID NO: 29296 - RNA, 35 nt, Artificial Sequence
  Synthetic Oligonucleotide; PRDM1 exon 5; Set C
agaagggcauuucggggcucccacgucuucuaaag

SEQ ID NO: 29297 - RNA, 33 nt, Artificial Sequence
  Synthetic Oligonucleotide; PRDM1 exon 5; Set C
gaagggcauuucggggcucccacgucuucuaaa

SEQ ID NO: 29298 - RNA, 38 nt, Artificial Sequence
  Synthetic Oligonucleotide; PRDM1 exon 5; Set C
guagaagggcauuucggggcucccacgucuucuaaagu

SEQ ID NO: 29299 - RNA, 36 nt, Artificial Sequence
  Synthetic Oligonucleotide; PRDM1 exon 5; Set C
uagaagggcauuucggggcucccacgucuucuaaag

SEQ ID NO: 29300 - RNA, 34 nt, Artificial Sequence
  Synthetic Oligonucleotide; PRDM1 exon 5; Set C
agaagggcauuucggggcucccacgucuucuaaa

SEQ ID NO: 29301 - RNA, 39 nt, Artificial Sequence
  Synthetic Oligonucleotide; PRDM1 exon 5; Set C
gguagaagggcauuucggggcucccacgucuucuaaagu

SEQ ID NO: 29302 - RNA, 37 nt, Artificial Sequence
  Synthetic Oligonucleotide; PRDM1 exon 5; Set C
guagaagggcauuucggggcucccacgucuucuaaag

SEQ ID NO: 29303 - RNA, 35 nt, Artificial Sequence
  Synthetic Oligonucleotide; PRDM1 exon 5; Set C
uagaagggcauuucggggcucccacgucuucuaaa

SEQ ID NO: 29304 - RNA, 40 nt, Artificial Sequence
  Synthetic Oligonucleotide; PRDM1 exon 5; Set C
ggguagaagggcauuucggggcucccacgucuucuaaagu

SEQ ID NO: 29305 - RNA, 38 nt, Artificial Sequence
  Synthetic Oligonucleotide; PRDM1 exon 5; Set C
gguagaagggcauuucggggcucccacgucuucuaaag

SEQ ID NO: 29306 - RNA, 36 nt, Artificial Sequence
  Synthetic Oligonucleotide; PRDM1 exon 5; Set C
guagaagggcauuucggggcucccacgucuucuaaa

SEQ ID NO: 29307 - RNA, 39 nt, Artificial Sequence
  Synthetic Oligonucleotide; PRDM1 exon 5; Set C
ggguagaagggcauuucggggcucccacgucuucuaaag

SEQ ID NO: 29308 - RNA, 37 nt, Artificial Sequence
  Synthetic Oligonucleotide; PRDM1 exon 5; Set C
gguagaagggcauuucggggcucccacgucuucuaaa

SEQ ID NO: 29309 - RNA, 40 nt, Artificial Sequence
  Synthetic Oligonucleotide; PRDM1 exon 5; Set C
aggguagaagggcauuucggggcucccacgucuucuaaag

SEQ ID NO: 29310 - RNA, 38 nt, Artificial Sequence
  Synthetic Oligonucleotide; PRDM1 exon 5; Set C
ggguagaagggcauuucggggcucccacgucuucuaaa

SEQ ID NO: 29311 - RNA, 39 nt, Artificial Sequence
  Synthetic Oligonucleotide; PRDM1 exon 5; Set C
aggguagaagggcauuucggggcucccacgucuucuaaa

SEQ ID NO: 29312 - RNA, 40 nt, Artificial Sequence
  Synthetic Oligonucleotide; PRDM1 exon 5; Set C
gaggguagaagggcauuucggggcucccacgucuucuaaa

SEQ ID NO: 29313 - RNA, 15 nt, Artificial Sequence
  Synthetic Oligonucleotide; PRDM1 exon 5; Set C
guagaagggcauuuc

SEQ ID NO: 29314 - RNA, 16 nt, Artificial Sequence
  Synthetic Oligonucleotide; PRDM1 exon 5; Set C
gguagaagggcauuuc

SEQ ID NO: 29315 - RNA, 17 nt, Artificial Sequence
  Synthetic Oligonucleotide; PRDM1 exon 5; Set C
ggguagaagggcauuuc

SEQ ID NO: 29316 - RNA, 18 nt, Artificial Sequence
  Synthetic Oligonucleotide; PRDM1 exon 5; Set C
aggguagaagggcauuuc

SEQ ID NO: 29317 - RNA, 19 nt, Artificial Sequence
  Synthetic Oligonucleotide; PRDM1 exon 5; Set C
gaggguagaagggcauuuc

SEQ ID NO: 29318 - RNA, 15 nt, Artificial Sequence
  Synthetic Oligonucleotide; PRDM1 exon 5; Set C
ggguaaacgacccga

SEQ ID NO: 29319 - RNA, 16 nt, Artificial Sequence
  Synthetic Oligonucleotide; PRDM1 exon 5; Set C
gggguaaacgacccga

SEQ ID NO: 29320 - RNA, 17 nt, Artificial Sequence
  Synthetic Oligonucleotide; PRDM1 exon 5; Set C
ugggguaaacgacccga

SEQ ID NO: 29321 - RNA, 18 nt, Artificial Sequence
  Synthetic Oligonucleotide; PRDM1 exon 5; Set C
augggguaaacgacccga

SEQ ID NO: 29322 - RNA, 19 nt, Artificial Sequence
  Synthetic Oligonucleotide; PRDM1 exon 5; Set A
gaugggguaaacgacccga

SEQ ID NO: 29323 - RNA, 20 nt, Artificial Sequence
  Synthetic Oligonucleotide; PRDM1 exon 5; Set A
ggaugggguaaacgacccga

SEQ ID NO: 29324 - RNA, 28 nt, Artificial Sequence
  Synthetic Oligonucleotide; PRDM1 exon 5; Set C
ggggcccggaugggguaaacgacccgag

SEQ ID NO: 29325 - RNA, 27 nt, Artificial Sequence
  Synthetic Oligonucleotide; PRDM1 exon 5; Set C
ggggcccggaugggguaaacgacccga

SEQ ID NO: 29326 - RNA, 28 nt, Artificial Sequence
  Synthetic Oligonucleotide; PRDM1 exon 5; Set C
aggggcccggaugggguaaacgacccga

SEQ ID NO: 29327 - RNA, 29 nt, Artificial Sequence
  Synthetic Oligonucleotide; PRDM1 exon 5; Set C
gaggggcccggaugggguaaacgacccga

SEQ ID NO: 29328 - RNA, 30 nt, Artificial Sequence
  Synthetic Oligonucleotide; PRDM1 exon 5; Set C
agaggggcccggaugggguaaacgacccga

SEQ ID NO: 29329 - RNA, 15 nt, Artificial Sequence
  Synthetic Oligonucleotide; PRDM1 exon 5; Set A
ggggcccggaugggg

SEQ ID NO: 29330 - RNA, 15 nt, Artificial Sequence
  Synthetic Oligonucleotide; PRDM1 exon 5; Set A
aggggcccggauggg

SEQ ID NO: 29331 - RNA, 38 nt, Artificial Sequence
  Synthetic Oligonucleotide; PRDM1 exon 5; Set C
caaaaagucuucuggcagaggggcccggaugggguaaa

SEQ ID NO: 29332 - RNA, 37 nt, Artificial Sequence
  Synthetic Oligonucleotide; PRDM1 exon 5; Set C
caaaaagucuucuggcagaggggcccggaugggguaa

SEQ ID NO: 29333 - RNA, 36 nt, Artificial Sequence
  Synthetic Oligonucleotide; PRDM1 exon 5; Set C
caaaaagucuucuggcagaggggcccggauggggua

SEQ ID NO: 29334 - RNA, 26 nt, Artificial Sequence
  Synthetic Oligonucleotide; PRDM1 exon 5; Set C
uguacgugggucucucgaucccguag

SEQ ID NO: 29335 - RNA, 26 nt, Artificial Sequence
  Synthetic Oligonucleotide; PRDM1 exon 5; Set C
augggggagcgagugauguacguggg

SEQ ID NO: 29336 - RNA, 27 nt, Artificial Sequence
  Synthetic Oligonucleotide; PRDM1 exon 5; Set C
aaugggggagcgagugauguacguggg

SEQ ID NO: 29337 - RNA, 26 nt, Artificial Sequence
  Synthetic Oligonucleotide; PRDM1 exon 5; Set C
aaugggggagcgagugauguacgugg

SEQ ID NO: 29338 - RNA, 28 nt, Artificial Sequence
  Synthetic Oligonucleotide; PRDM1 exon 5; Set C
gaaugggggagcgagugauguacguggg

SEQ ID NO: 29339 - RNA, 27 nt, Artificial Sequence
  Synthetic Oligonucleotide; PRDM1 exon 5; Set C
gaaugggggagcgagugauguacgugg

SEQ ID NO: 29340 - RNA, 29 nt, Artificial Sequence
  Synthetic Oligonucleotide; PRDM1 exon 5; Set C
ggaaugggggagcgagugauguacguggg

SEQ ID NO: 29341 - RNA, 26 nt, Artificial Sequence
  Synthetic Oligonucleotide; PRDM1 exon 5; Set C
gaaugggggagcgagugauguacgug

SEQ ID NO: 29342 - RNA, 30 nt, Artificial Sequence
  Synthetic Oligonucleotide; PRDM1 exon 5; Set C
uggaaugggggagcgagugauguacguggg

SEQ ID NO: 29343 - RNA, 28 nt, Artificial Sequence
  Synthetic Oligonucleotide; PRDM1 exon 5; Set C
ggaaugggggagcgagugauguacgugg

SEQ ID NO: 29344 - RNA, 27 nt, Artificial Sequence
  Synthetic Oligonucleotide; PRDM1 exon 5; Set C
ggaaugggggagcgagugauguacgug

SEQ ID NO: 29345 - RNA, 31 nt, Artificial Sequence
  Synthetic Oligonucleotide; PRDM1 exon 5; Set C
auggaaugggggagcgagugauguacguggg

SEQ ID NO: 29346 - RNA, 29 nt, Artificial Sequence
  Synthetic Oligonucleotide; PRDM1 exon 5; Set C
uggaaugggggagcgagugauguacgugg

SEQ ID NO: 29347 - RNA, 28 nt, Artificial Sequence
  Synthetic Oligonucleotide; PRDM1 exon 5; Set C
uggaaugggggagcgagugauguacgug

SEQ ID NO: 29348 - RNA, 32 nt, Artificial Sequence
  Synthetic Oligonucleotide; PRDM1 exon 5; Set C
gauggaaugggggagcgagugauguacguggg

SEQ ID NO: 29349 - RNA, 30 nt, Artificial Sequence
  Synthetic Oligonucleotide; PRDM1 exon 5; Set C
auggaaugggggagcgagugauguacgugg

SEQ ID NO: 29350 - RNA, 26 nt, Artificial Sequence
  Synthetic Oligonucleotide; PRDM1 exon 5; Set C
ggaaugggggagcgagugauguacgu

SEQ ID NO: 29351 - RNA, 29 nt, Artificial Sequence
  Synthetic Oligonucleotide; PRDM1 exon 5; Set C
auggaaugggggagcgagugauguacgug

SEQ ID NO: 29352 - RNA, 31 nt, Artificial Sequence
  Synthetic Oligonucleotide; PRDM1 exon 5; Set C
gauggaaugggggagcgagugauguacgugg

SEQ ID NO: 29353 - RNA, 33 nt, Artificial Sequence
  Synthetic Oligonucleotide; PRDM1 exon 5; Set C
ggauggaaugggggagcgagugauguacguggg

SEQ ID NO: 29354 - RNA, 27 nt, Artificial Sequence
  Synthetic Oligonucleotide; PRDM1 exon 5; Set C
uggaaugggggagcgagugauguacgu

SEQ ID NO: 29355 - RNA, 30 nt, Artificial Sequence
  Synthetic Oligonucleotide; PRDM1 exon 5; Set C
gauggaaugggggagcgagugauguacgug

SEQ ID NO: 29356 - RNA, 34 nt, Artificial Sequence
  Synthetic Oligonucleotide; PRDM1 exon 5; Set C
aggauggaaugggggagcgagugauguacguggg

SEQ ID NO: 29357 - RNA, 32 nt, Artificial Sequence
  Synthetic Oligonucleotide; PRDM1 exon 5; Set C
ggauggaaugggggagcgagugauguacgugg

SEQ ID NO: 29358 - RNA, 26 nt, Artificial Sequence
  Synthetic Oligonucleotide; PRDM1 exon 5; Set C
uggaaugggggagcgagugauguacg

SEQ ID NO: 29359 - RNA, 28 nt, Artificial Sequence
  Synthetic Oligonucleotide; PRDM1 exon 5; Set C
auggaaugggggagcgagugauguacgu

SEQ ID NO: 29360 - RNA, 31 nt, Artificial Sequence
  Synthetic Oligonucleotide; PRDM1 exon 5; Set C
ggauggaaugggggagcgagugauguacgug

SEQ ID NO: 29361 - RNA, 35 nt, Artificial Sequence
  Synthetic Oligonucleotide; PRDM1 exon 5; Set C
gaggauggaaugggggagcgagugauguacguggg

SEQ ID NO: 29362 - RNA, 33 nt, Artificial Sequence
  Synthetic Oligonucleotide; PRDM1 exon 5; Set C
aggauggaaugggggagcgagugauguacgugg

SEQ ID NO: 29363 - RNA, 27 nt, Artificial Sequence
  Synthetic Oligonucleotide; PRDM1 exon 5; Set C
auggaaugggggagcgagugauguacg

SEQ ID NO: 29364 - RNA, 29 nt, Artificial Sequence
  Synthetic Oligonucleotide; PRDM1 exon 5; Set C
gauggaaugggggagcgagugauguacgu

SEQ ID NO: 29365 - RNA, 32 nt, Artificial Sequence
  Synthetic Oligonucleotide; PRDM1 exon 5; Set C
aggauggaaugggggagcgagugauguacgug

SEQ ID NO: 29366 - RNA, 28 nt, Artificial Sequence
  Synthetic Oligonucleotide; PRDM1 exon 5; Set C
gauggaaugggggagcgagugauguacg

SEQ ID NO: 29367 - RNA, 34 nt, Artificial Sequence
  Synthetic Oligonucleotide; PRDM1 exon 5; Set C
gaggauggaaugggggagcgagugauguacgugg

SEQ ID NO: 29368 - RNA, 36 nt, Artificial Sequence
  Synthetic Oligonucleotide; PRDM1 exon 5; Set C
ggaggauggaaugggggagcgagugauguacguggg

SEQ ID NO: 29369 - RNA, 26 nt, Artificial Sequence
  Synthetic Oligonucleotide; PRDM1 exon 5; Set A
auggaaugggggagcgagugauguac

SEQ ID NO: 29370 - RNA, 30 nt, Artificial Sequence
  Synthetic Oligonucleotide; PRDM1 exon 5; Set C
ggauggaaugggggagcgagugauguacgu

SEQ ID NO: 29371 - RNA, 33 nt, Artificial Sequence
  Synthetic Oligonucleotide; PRDM1 exon 5; Set C
gaggauggaaugggggagcgagugauguacgug

SEQ ID NO: 29372 - RNA, 27 nt, Artificial Sequence
  Synthetic Oligonucleotide; PRDM1 exon 5; Set C
gauggaaugggggagcgagugauguac

SEQ ID NO: 29373 - RNA, 29 nt, Artificial Sequence
  Synthetic Oligonucleotide; PRDM1 exon 5; Set C
ggauggaaugggggagcgagugauguacg

SEQ ID NO: 29374 - RNA, 37 nt, Artificial Sequence
  Synthetic Oligonucleotide; PRDM1 exon 5; Set C
uggaggauggaaugggggagcgagugauguacguggg

SEQ ID NO: 29375 - RNA, 35 nt, Artificial Sequence
  Synthetic Oligonucleotide; PRDM1 exon 5; Set C
ggaggauggaaugggggagcgagugauguacgugg

SEQ ID NO: 29376 - RNA, 31 nt, Artificial Sequence
  Synthetic Oligonucleotide; PRDM1 exon 5; Set C
aggauggaaugggggagcgagugauguacgu

SEQ ID NO: 29377 - RNA, 34 nt, Artificial Sequence
  Synthetic Oligonucleotide; PRDM1 exon 5; Set C
ggaggauggaaugggggagcgagugauguacgug

SEQ ID NO: 29378 - RNA, 26 nt, Artificial Sequence
  Synthetic Oligonucleotide; PRDM1 exon 5; Set C
gauggaaugggggagcgagugaugua

SEQ ID NO: 29379 - RNA, 30 nt, Artificial Sequence
  Synthetic Oligonucleotide; PRDM1 exon 5; Set C
aggauggaaugggggagcgagugauguacg

SEQ ID NO: 29380 - RNA, 28 nt, Artificial Sequence
  Synthetic Oligonucleotide; PRDM1 exon 5; Set C
ggauggaaugggggagcgagugauguac

SEQ ID NO: 29381 - RNA, 38 nt, Artificial Sequence
  Synthetic Oligonucleotide; PRDM1 exon 5; Set C
guggaggauggaaugggggagcgagugauguacguggg

SEQ ID NO: 29382 - RNA, 36 nt, Artificial Sequence
  Synthetic Oligonucleotide; PRDM1 exon 5; Set C
uggaggauggaaugggggagcgagugauguacgugg

SEQ ID NO: 29383 - RNA, 32 nt, Artificial Sequence
  Synthetic Oligonucleotide; PRDM1 exon 5; Set C
gaggauggaaugggggagcgagugauguacgu

SEQ ID NO: 29384 - RNA, 35 nt, Artificial Sequence
  Synthetic Oligonucleotide; PRDM1 exon 5; Set C
uggaggauggaaugggggagcgagugauguacgug

SEQ ID NO: 29385 - RNA, 31 nt, Artificial Sequence
  Synthetic Oligonucleotide; PRDM1 exon 5; Set C
gaggauggaaugggggagcgagugauguacg

SEQ ID NO: 29386 - RNA, 29 nt, Artificial Sequence
  Synthetic Oligonucleotide; PRDM1 exon 5; Set C
aggauggaaugggggagcgagugauguac

SEQ ID NO: 29387 - RNA, 27 nt, Artificial Sequence
  Synthetic Oligonucleotide; PRDM1 exon 5; Set C
ggauggaaugggggagcgagugaugua

SEQ ID NO: 29388 - RNA, 37 nt, Artificial Sequence
  Synthetic Oligonucleotide; PRDM1 exon 5; Set C
guggaggauggaaugggggagcgagugauguacgugg

SEQ ID NO: 29389 - RNA, 33 nt, Artificial Sequence
  Synthetic Oligonucleotide; PRDM1 exon 5; Set C
ggaggauggaaugggggagcgagugauguacgu

SEQ ID NO: 29390 - RNA, 26 nt, Artificial Sequence
  Synthetic Oligonucleotide; PRDM1 exon 5; Set C
ggauggaaugggggagcgagugaugu

SEQ ID NO: 29391 - RNA, 36 nt, Artificial Sequence
  Synthetic Oligonucleotide; PRDM1 exon 5; Set C
guggaggauggaaugggggagcgagugauguacgug

SEQ ID NO: 29392 - RNA, 38 nt, Artificial Sequence
  Synthetic Oligonucleotide; PRDM1 exon 5; Set C
gguggaggauggaaugggggagcgagugauguacgugg

SEQ ID NO: 29393 - RNA, 30 nt, Artificial Sequence
  Synthetic Oligonucleotide; PRDM1 exon 5; Set C
gaggauggaaugggggagcgagugauguac

SEQ ID NO: 29394 - RNA, 28 nt, Artificial Sequence
  Synthetic Oligonucleotide; PRDM1 exon 5; Set C
aggauggaaugggggagcgagugaugua

SEQ ID NO: 29395 - RNA, 32 nt, Artificial Sequence
  Synthetic Oligonucleotide; PRDM1 exon 5; Set C
ggaggauggaaugggggagcgagugauguacg

SEQ ID NO: 29396 - RNA, 34 nt, Artificial Sequence
  Synthetic Oligonucleotide; PRDM1 exon 5; Set C
uggaggauggaaugggggagcgagugauguacgu

SEQ ID NO: 29397 - RNA, 27 nt, Artificial Sequence
  Synthetic Oligonucleotide; PRDM1 exon 5; Set C
aggauggaaugggggagcgagugaugu

SEQ ID NO: 29398 - RNA, 37 nt, Artificial Sequence
  Synthetic Oligonucleotide; PRDM1 exon 5; Set C
gguggaggauggaaugggggagcgagugauguacgug

SEQ ID NO: 29399 - RNA, 29 nt, Artificial Sequence
  Synthetic Oligonucleotide; PRDM1 exon 5; Set C
gaggauggaaugggggagcgagugaugua

SEQ ID NO: 29400 - RNA, 33 nt, Artificial Sequence
  Synthetic Oligonucleotide; PRDM1 exon 5; Set C
uggaggauggaaugggggagcgagugauguacg

SEQ ID NO: 29401 - RNA, 31 nt, Artificial Sequence
  Synthetic Oligonucleotide; PRDM1 exon 5; Set C
ggaggauggaaugggggagcgagugauguac

SEQ ID NO: 29402 - RNA, 35 nt, Artificial Sequence
  Synthetic Oligonucleotide; PRDM1 exon 5; Set C
guggaggauggaaugggggagcgagugauguacgu

SEQ ID NO: 29403 - RNA, 28 nt, Artificial Sequence
  Synthetic Oligonucleotide; PRDM1 exon 5; Set C
gaggauggaaugggggagcgagugaugu

SEQ ID NO: 29404 - RNA, 38 nt, Artificial Sequence
  Synthetic Oligonucleotide; PRDM1 exon 5; Set C
ugguggaggauggaaugggggagcgagugauguacgug

SEQ ID NO: 29405 - RNA, 34 nt, Artificial Sequence
  Synthetic Oligonucleotide; PRDM1 exon 5; Set C
guggaggauggaaugggggagcgagugauguacg

SEQ ID NO: 29406 - RNA, 32 nt, Artificial Sequence
  Synthetic Oligonucleotide; PRDM1 exon 5; Set C
uggaggauggaaugggggagcgagugauguac

SEQ ID NO: 29407 - RNA, 30 nt, Artificial Sequence
  Synthetic Oligonucleotide; PRDM1 exon 5; Set C
ggaggauggaaugggggagcgagugaugua

SEQ ID NO: 29408 - RNA, 36 nt, Artificial Sequence
  Synthetic Oligonucleotide; PRDM1 exon 5; Set C
gguggaggauggaaugggggagcgagugauguacgu

SEQ ID NO: 29409 - RNA, 29 nt, Artificial Sequence
  Synthetic Oligonucleotide; PRDM1 exon 5; Set C
ggaggauggaaugggggagcgagugaugu

SEQ ID NO: 29410 - RNA, 35 nt, Artificial Sequence
  Synthetic Oligonucleotide; PRDM1 exon 5; Set C
gguggaggauggaaugggggagcgagugauguacg

SEQ ID NO: 29411 - RNA, 33 nt, Artificial Sequence
  Synthetic Oligonucleotide; PRDM1 exon 5; Set C
guggaggauggaaugggggagcgagugauguac

SEQ ID NO: 29412 - RNA, 31 nt, Artificial Sequence
  Synthetic Oligonucleotide; PRDM1 exon 5; Set C
uggaggauggaaugggggagcgagugaugua

SEQ ID NO: 29413 - RNA, 37 nt, Artificial Sequence
  Synthetic Oligonucleotide; PRDM1 exon 5; Set C
ugguggaggauggaaugggggagcgagugauguacgu

SEQ ID NO: 29414 - RNA, 30 nt, Artificial Sequence
  Synthetic Oligonucleotide; PRDM1 exon 5; Set C
uggaggauggaaugggggagcgagugaugu

SEQ ID NO: 29415 - RNA, 36 nt, Artificial Sequence
  Synthetic Oligonucleotide; PRDM1 exon 5; Set C
ugguggaggauggaaugggggagcgagugauguacg

SEQ ID NO: 29416 - RNA, 34 nt, Artificial Sequence
  Synthetic Oligonucleotide; PRDM1 exon 5; Set C
gguggaggauggaaugggggagcgagugauguac

SEQ ID NO: 29417 - RNA, 32 nt, Artificial Sequence
  Synthetic Oligonucleotide; PRDM1 exon 5; Set C
guggaggauggaaugggggagcgagugaugua

SEQ ID NO: 29418 - RNA, 38 nt, Artificial Sequence
  Synthetic Oligonucleotide; PRDM1 exon 5; Set C
gugguggaggauggaaugggggagcgagugauguacgu

SEQ ID NO: 29419 - RNA, 31 nt, Artificial Sequence
  Synthetic Oligonucleotide; PRDM1 exon 5; Set C
guggaggauggaaugggggagcgagugaugu

SEQ ID NO: 29420 - RNA, 37 nt, Artificial Sequence
  Synthetic Oligonucleotide; PRDM1 exon 5; Set C
gugguggaggauggaaugggggagcgagugauguacg

SEQ ID NO: 29421 - RNA, 35 nt, Artificial Sequence
  Synthetic Oligonucleotide; PRDM1 exon 5; Set C
ugguggaggauggaaugggggagcgagugauguac

SEQ ID NO: 29422 - RNA, 33 nt, Artificial Sequence
  Synthetic Oligonucleotide; PRDM1 exon 5; Set C
gguggaggauggaaugggggagcgagugaugua

SEQ ID NO: 29423 - RNA, 32 nt, Artificial Sequence
  Synthetic Oligonucleotide; PRDM1 exon 5; Set C
gguggaggauggaaugggggagcgagugaugu

SEQ ID NO: 29424 - RNA, 38 nt, Artificial Sequence
  Synthetic Oligonucleotide; PRDM1 exon 5; Set C
agugguggaggauggaaugggggagcgagugauguacg

SEQ ID NO: 29425 - RNA, 36 nt, Artificial Sequence
  Synthetic Oligonucleotide; PRDM1 exon 5; Set C
gugguggaggauggaaugggggagcgagugauguac

SEQ ID NO: 29426 - RNA, 34 nt, Artificial Sequence
  Synthetic Oligonucleotide; PRDM1 exon 5; Set C
ugguggaggauggaaugggggagcgagugaugua

SEQ ID NO: 29427 - RNA, 33 nt, Artificial Sequence
  Synthetic Oligonucleotide; PRDM1 exon 5; Set C
ugguggaggauggaaugggggagcgagugaugu

SEQ ID NO: 29428 - RNA, 37 nt, Artificial Sequence
  Synthetic Oligonucleotide; PRDM1 exon 5; Set C
agugguggaggauggaaugggggagcgagugauguac

SEQ ID NO: 29429 - RNA, 35 nt, Artificial Sequence
  Synthetic Oligonucleotide; PRDM1 exon 5; Set C
gugguggaggauggaaugggggagcgagugaugua

SEQ ID NO: 29430 - RNA, 34 nt, Artificial Sequence
  Synthetic Oligonucleotide; PRDM1 exon 5; Set C
gugguggaggauggaaugggggagcgagugaugu

SEQ ID NO: 29431 - RNA, 38 nt, Artificial Sequence
  Synthetic Oligonucleotide; PRDM1 exon 5; Set C
gagugguggaggauggaaugggggagcgagugauguac

SEQ ID NO: 29432 - RNA, 36 nt, Artificial Sequence
  Synthetic Oligonucleotide; PRDM1 exon 5; Set C
agugguggaggauggaaugggggagcgagugaugua

SEQ ID NO: 29433 - RNA, 35 nt, Artificial Sequence
  Synthetic Oligonucleotide; PRDM1 exon 5; Set C
agugguggaggauggaaugggggagcgagugaugu

SEQ ID NO: 29434 - RNA, 37 nt, Artificial Sequence
  Synthetic Oligonucleotide; PRDM1 exon 5; Set C
gagugguggaggauggaaugggggagcgagugaugua

SEQ ID NO: 29435 - RNA, 36 nt, Artificial Sequence
  Synthetic Oligonucleotide; PRDM1 exon 5; Set C
gagugguggaggauggaaugggggagcgagugaugu

SEQ ID NO: 29436 - RNA, 38 nt, Artificial Sequence
  Synthetic Oligonucleotide; PRDM1 exon 5; Set C
ggagugguggaggauggaaugggggagcgagugaugua

SEQ ID NO: 29437 - RNA, 37 nt, Artificial Sequence
  Synthetic Oligonucleotide; PRDM1 exon 5; Set C
ggagugguggaggauggaaugggggagcgagugaugu

SEQ ID NO: 29438 - RNA, 31 nt, Artificial Sequence
  Synthetic Oligonucleotide; PRDM1 exon 5; Set C
gaggggcuuggagugguggaggauggaaugg

SEQ ID NO: 29439 - RNA, 30 nt, Artificial Sequence
  Synthetic Oligonucleotide; PRDM1 exon 5; Set C
gaggggcuuggagugguggaggauggaaug

SEQ ID NO: 29440 - RNA, 32 nt, Artificial Sequence
  Synthetic Oligonucleotide; PRDM1 exon 5; Set C
agaggggcuuggagugguggaggauggaaugg

SEQ ID NO: 29441 - RNA, 29 nt, Artificial Sequence
  Synthetic Oligonucleotide; PRDM1 exon 5; Set C
gaggggcuuggagugguggaggauggaau

SEQ ID NO: 29442 - RNA, 31 nt, Artificial Sequence
  Synthetic Oligonucleotide; PRDM1 exon 5; Set C
agaggggcuuggagugguggaggauggaaug

SEQ ID NO: 29443 - RNA, 33 nt, Artificial Sequence
  Synthetic Oligonucleotide; PRDM1 exon 5; Set C
cagaggggcuuggagugguggaggauggaaugg

SEQ ID NO: 29444 - RNA, 30 nt, Artificial Sequence
  Synthetic Oligonucleotide; PRDM1 exon 5; Set C
agaggggcuuggagugguggaggauggaau

SEQ ID NO: 29445 - RNA, 32 nt, Artificial Sequence
  Synthetic Oligonucleotide; PRDM1 exon 5; Set C
cagaggggcuuggagugguggaggauggaaug

SEQ ID NO: 29446 - RNA, 28 nt, Artificial Sequence
  Synthetic Oligonucleotide; PRDM1 exon 5; Set C
gaggggcuuggagugguggaggauggaa

SEQ ID NO: 29447 - RNA, 26 nt, Artificial Sequence
  Synthetic Oligonucleotide; PRDM1 exon 5; Set C
aggggcuuggagugguggaggaugga

SEQ ID NO: 29448 - RNA, 31 nt, Artificial Sequence
  Synthetic Oligonucleotide; PRDM1 exon 5; Set C
cagaggggcuuggagugguggaggauggaau

SEQ ID NO: 29449 - RNA, 29 nt, Artificial Sequence
  Synthetic Oligonucleotide; PRDM1 exon 5; Set C
agaggggcuuggagugguggaggauggaa

SEQ ID NO: 29450 - RNA, 25 nt, Artificial Sequence
  Synthetic Oligonucleotide; PRDM1 exon 5; Set C
aggggcuuggagugguggaggaugg

SEQ ID NO: 29451 - RNA, 27 nt, Artificial Sequence
  Synthetic Oligonucleotide; PRDM1 exon 5; Set C
gaggggcuuggagugguggaggaugga

SEQ ID NO: 29452 - RNA, 30 nt, Artificial Sequence
  Synthetic Oligonucleotide; PRDM1 exon 5; Set C
cagaggggcuuggagugguggaggauggaa

SEQ ID NO: 29453 - RNA, 24 nt, Artificial Sequence
  Synthetic Oligonucleotide; PRDM1 exon 5; Set C
aggggcuuggagugguggaggaug

SEQ ID NO: 29454 - RNA, 26 nt, Artificial Sequence
  Synthetic Oligonucleotide; PRDM1 exon 5; Set C
gaggggcuuggagugguggaggaugg

SEQ ID NO: 29455 - RNA, 28 nt, Artificial Sequence
  Synthetic Oligonucleotide; PRDM1 exon 5; Set C
agaggggcuuggagugguggaggaugga

SEQ ID NO: 29456 - RNA, 23 nt, Artificial Sequence
  Synthetic Oligonucleotide; PRDM1 exon 5; Set C
aggggcuuggagugguggaggau

SEQ ID NO: 29457 - RNA, 25 nt, Artificial Sequence
  Synthetic Oligonucleotide; PRDM1 exon 5; Set C
gaggggcuuggagugguggaggaug

SEQ ID NO: 29458 - RNA, 27 nt, Artificial Sequence
  Synthetic Oligonucleotide; PRDM1 exon 5; Set C
agaggggcuuggagugguggaggaugg

SEQ ID NO: 29459 - RNA, 29 nt, Artificial Sequence
  Synthetic Oligonucleotide; PRDM1 exon 5; Set C
cagaggggcuuggagugguggaggaugga

SEQ ID NO: 29460 - RNA, 24 nt, Artificial Sequence
  Synthetic Oligonucleotide; PRDM1 exon 5; Set C
gaggggcuuggagugguggaggau

SEQ ID NO: 29461 - RNA, 22 nt, Artificial Sequence
  Synthetic Oligonucleotide; PRDM1 exon 5; Set C
aggggcuuggagugguggagga

SEQ ID NO: 29462 - RNA, 26 nt, Artificial Sequence
  Synthetic Oligonucleotide; PRDM1 exon 5; Set C
agaggggcuuggagugguggaggaug

SEQ ID NO: 29463 - RNA, 28 nt, Artificial Sequence
  Synthetic Oligonucleotide; PRDM1 exon 5; Set C
cagaggggcuuggagugguggaggaugg

SEQ ID NO: 29464 - RNA, 25 nt, Artificial Sequence
  Synthetic Oligonucleotide; PRDM1 exon 5; Set C
agaggggcuuggagugguggaggau

SEQ ID NO: 29465 - RNA, 21 nt, Artificial Sequence
  Synthetic Oligonucleotide; PRDM1 exon 5; Set A
aggggcuuggagugguggagg

SEQ ID NO: 29466 - RNA, 23 nt, Artificial Sequence
  Synthetic Oligonucleotide; PRDM1 exon 5; Set C
gaggggcuuggagugguggagga

SEQ ID NO: 29467 - RNA, 27 nt, Artificial Sequence
  Synthetic Oligonucleotide; PRDM1 exon 5; Set C
cagaggggcuuggagugguggaggaug

SEQ ID NO: 29468 - RNA, 26 nt, Artificial Sequence
  Synthetic Oligonucleotide; PRDM1 exon 5; Set C
cagaggggcuuggagugguggaggau

SEQ ID NO: 29469 - RNA, 20 nt, Artificial Sequence
  Synthetic Oligonucleotide; PRDM1 exon 5; Set A
aggggcuuggagugguggag

SEQ ID NO: 29470 - RNA, 22 nt, Artificial Sequence
  Synthetic Oligonucleotide; PRDM1 exon 5; Set C
gaggggcuuggagugguggagg

SEQ ID NO: 29471 - RNA, 24 nt, Artificial Sequence
  Synthetic Oligonucleotide; PRDM1 exon 5; Set C
agaggggcuuggagugguggagga

SEQ ID NO: 29472 - RNA, 21 nt, Artificial Sequence
  Synthetic Oligonucleotide; PRDM1 exon 5; Set A
gaggggcuuggagugguggag

SEQ ID NO: 29473 - RNA, 23 nt, Artificial Sequence
  Synthetic Oligonucleotide; PRDM1 exon 5; Set C
agaggggcuuggagugguggagg

SEQ ID NO: 29474 - RNA, 19 nt, Artificial Sequence
  Synthetic Oligonucleotide; PRDM1 exon 5; Set A
aggggcuuggaguggugga

SEQ ID NO: 29475 - RNA, 22 nt, Artificial Sequence
  Synthetic Oligonucleotide; PRDM1 exon 5; Set A
agaggggcuuggagugguggag

SEQ ID NO: 29476 - RNA, 18 nt, Artificial Sequence
  Synthetic Oligonucleotide; PRDM1 exon 5; Set A
aggggcuuggaguggugg

SEQ ID NO: 29477 - RNA, 20 nt, Artificial Sequence
  Synthetic Oligonucleotide; PRDM1 exon 5; Set A
gaggggcuuggaguggugga

SEQ ID NO: 29478 - RNA, 17 nt, Artificial Sequence
  Synthetic Oligonucleotide; PRDM1 exon 5; Set A
aggggcuuggaguggug

SEQ ID NO: 29479 - RNA, 19 nt, Artificial Sequence
  Synthetic Oligonucleotide; PRDM1 exon 5; Set A
gaggggcuuggaguggugg

SEQ ID NO: 29480 - RNA, 21 nt, Artificial Sequence
  Synthetic Oligonucleotide; PRDM1 exon 5; Set A
agaggggcuuggaguggugga

SEQ ID NO: 29481 - RNA, 16 nt, Artificial Sequence
  Synthetic Oligonucleotide; PRDM1 exon 5; Set C
aggggcuuggaguggu

SEQ ID NO: 29482 - RNA, 18 nt, Artificial Sequence
  Synthetic Oligonucleotide; PRDM1 exon 5; Set A
gaggggcuuggaguggug

SEQ ID NO: 29483 - RNA, 20 nt, Artificial Sequence
  Synthetic Oligonucleotide; PRDM1 exon 5; Set A
agaggggcuuggaguggugg

SEQ ID NO: 29484 - RNA, 15 nt, Artificial Sequence
  Synthetic Oligonucleotide; PRDM1 exon 5; Set C
aggggcuuggagugg

SEQ ID NO: 29485 - RNA, 17 nt, Artificial Sequence
  Synthetic Oligonucleotide; PRDM1 exon 5; Set A
gaggggcuuggaguggu

SEQ ID NO: 29486 - RNA, 19 nt, Artificial Sequence
  Synthetic Oligonucleotide; PRDM1 exon 5; Set A
agaggggcuuggaguggug

SEQ ID NO: 29487 - RNA, 16 nt, Artificial Sequence
  Synthetic Oligonucleotide; PRDM1 exon 5; Set C
gaggggcuuggagugg

SEQ ID NO: 29488 - RNA, 18 nt, Artificial Sequence
  Synthetic Oligonucleotide; PRDM1 exon 5; Set A
agaggggcuuggaguggu

SEQ ID NO: 29489 - RNA, 15 nt, Artificial Sequence
  Synthetic Oligonucleotide; PRDM1 exon 5; Set C
gaggggcuuggagug

SEQ ID NO: 29490 - RNA, 17 nt, Artificial Sequence
  Synthetic Oligonucleotide; PRDM1 exon 5; Set C
agaggggcuuggagugg

SEQ ID NO: 29491 - RNA, 16 nt, Artificial Sequence
  Synthetic Oligonucleotide; PRDM1 exon 5; Set C
agaggggcuuggagug

SEQ ID NO: 29492 - RNA, 15 nt, Artificial Sequence
  Synthetic Oligonucleotide; PRDM1 exon 5; Set C
agaggggcuuggagu

SEQ ID NO: 29493 - RNA, 40 nt, Artificial Sequence
  Synthetic Oligonucleotide; PRDM1 exon 5; Set C
ggggcugcuucuugcagaggggcuuggagugguggaggau

SEQ ID NO: 29494 - RNA, 39 nt, Artificial Sequence
  Synthetic Oligonucleotide; PRDM1 exon 5; Set C
ggggcugcuucuugcagaggggcuuggagugguggagga

SEQ ID NO: 29495 - RNA, 38 nt, Artificial Sequence
  Synthetic Oligonucleotide; PRDM1 exon 5; Set C
ggggcugcuucuugcagaggggcuuggagugguggagg

SEQ ID NO: 29496 - RNA, 37 nt, Artificial Sequence
  Synthetic Oligonucleotide; PRDM1 exon 5; Set C
ggggcugcuucuugcagaggggcuuggagugguggag

SEQ ID NO: 29497 - RNA, 36 nt, Artificial Sequence
  Synthetic Oligonucleotide; PRDM1 exon 5; Set C
ggggcugcuucuugcagaggggcuuggaguggugga

SEQ ID NO: 29498 - RNA, 35 nt, Artificial Sequence
  Synthetic Oligonucleotide; PRDM1 exon 5; Set C
ggggcugcuucuugcagaggggcuuggaguggugg

SEQ ID NO: 29499 - RNA, 34 nt, Artificial Sequence
  Synthetic Oligonucleotide; PRDM1 exon 5; Set C
ggggcugcuucuugcagaggggcuuggaguggug

SEQ ID NO: 29500 - RNA, 33 nt, Artificial Sequence
  Synthetic Oligonucleotide; PRDM1 exon 5; Set C
ggggcugcuucuugcagaggggcuuggaguggu

SEQ ID NO: 29501 - RNA, 32 nt, Artificial Sequence
  Synthetic Oligonucleotide; PRDM1 exon 5; Set C
ggggcugcuucuugcagaggggcuuggagugg

SEQ ID NO: 29502 - RNA, 28 nt, Artificial Sequence
  Synthetic Oligonucleotide; PRDM1 exon 5; Set C
gggcugcuucuugcagaggggcuuggag

SEQ ID NO: 29503 - RNA, 27 nt, Artificial Sequence
  Synthetic Oligonucleotide; PRDM1 exon 5; Set C
gggcugcuucuugcagaggggcuugga

SEQ ID NO: 29504 - RNA, 26 nt, Artificial Sequence
  Synthetic Oligonucleotide; PRDM1 exon 5; Set C
gggcugcuucuugcagaggggcuugg

SEQ ID NO: 29505 - RNA, 25 nt, Artificial Sequence
  Synthetic Oligonucleotide; PRDM1 exon 5; Set C
gggcugcuucuugcagaggggcuug

SEQ ID NO: 29506 - RNA, 34 nt, Artificial Sequence
  Synthetic Oligonucleotide; PRDM1 exon 5; Set C
ggucggggcugcuucuugcagaggggcuuggagu

SEQ ID NO: 29507 - RNA, 33 nt, Artificial Sequence
  Synthetic Oligonucleotide; PRDM1 exon 5; Set C
ggucggggcugcuucuugcagaggggcuuggag

SEQ ID NO: 29508 - RNA, 34 nt, Artificial Sequence
  Synthetic Oligonucleotide; PRDM1 exon 5; Set C
uggucggggcugcuucuugcagaggggcuuggag

SEQ ID NO: 29509 - RNA, 32 nt, Artificial Sequence
  Synthetic Oligonucleotide; PRDM1 exon 5; Set C
ggucggggcugcuucuugcagaggggcuugga

SEQ ID NO: 29510 - RNA, 33 nt, Artificial Sequence
  Synthetic Oligonucleotide; PRDM1 exon 5; Set C
uggucggggcugcuucuugcagaggggcuugga

SEQ ID NO: 29511 - RNA, 31 nt, Artificial Sequence
  Synthetic Oligonucleotide; PRDM1 exon 5; Set C
ggucggggcugcuucuugcagaggggcuugg

SEQ ID NO: 29512 - RNA, 32 nt, Artificial Sequence
  Synthetic Oligonucleotide; PRDM1 exon 5; Set C
uggucggggcugcuucuugcagaggggcuugg

SEQ ID NO: 29513 - RNA, 30 nt, Artificial Sequence
  Synthetic Oligonucleotide; PRDM1 exon 5; Set C
ggucggggcugcuucuugcagaggggcuug

SEQ ID NO: 29514 - RNA, 34 nt, Artificial Sequence
  Synthetic Oligonucleotide; PRDM1 exon 5; Set C
uuggucggggcugcuucuugcagaggggcuugga

SEQ ID NO: 29515 - RNA, 31 nt, Artificial Sequence
  Synthetic Oligonucleotide; PRDM1 exon 5; Set C
uggucggggcugcuucuugcagaggggcuug

SEQ ID NO: 29516 - RNA, 33 nt, Artificial Sequence
  Synthetic Oligonucleotide; PRDM1 exon 5; Set C
uuggucggggcugcuucuugcagaggggcuugg

SEQ ID NO: 29517 - RNA, 32 nt, Artificial Sequence
  Synthetic Oligonucleotide; PRDM1 exon 5; Set C
uuggucggggcugcuucuugcagaggggcuug

SEQ ID NO: 29518 - RNA, 17 nt, Artificial Sequence
  Synthetic Oligonucleotide; PRDM1 exon 5; Set A
ggucggggcugcuucuu

SEQ ID NO: 29519 - RNA, 18 nt, Artificial Sequence
  Synthetic Oligonucleotide; PRDM1 exon 5; Set A
uggucggggcugcuucuu

SEQ ID NO: 29520 - RNA, 16 nt, Artificial Sequence
  Synthetic Oligonucleotide; PRDM1 exon 5; Set A
ggucggggcugcuucu

SEQ ID NO: 29521 - RNA, 17 nt, Artificial Sequence
  Synthetic Oligonucleotide; PRDM1 exon 5; Set A
uggucggggcugcuucu

SEQ ID NO: 29522 - RNA, 15 nt, Artificial Sequence
  Synthetic Oligonucleotide; PRDM1 exon 5; Set A
ggucggggcugcuuc

SEQ ID NO: 29523 - RNA, 19 nt, Artificial Sequence
  Synthetic Oligonucleotide; PRDM1 exon 5; Set A
uuggucggggcugcuucuu

SEQ ID NO: 29524 - RNA, 16 nt, Artificial Sequence
  Synthetic Oligonucleotide; PRDM1 exon 5; Set A
uggucggggcugcuuc

SEQ ID NO: 29525 - RNA, 18 nt, Artificial Sequence
  Synthetic Oligonucleotide; PRDM1 exon 5; Set A
uuggucggggcugcuucu

SEQ ID NO: 29526 - RNA, 17 nt, Artificial Sequence
  Synthetic Oligonucleotide; PRDM1 exon 5; Set A
uuggucggggcugcuuc

SEQ ID NO: 29527 - RNA, 35 nt, Artificial Sequence
  Synthetic Oligonucleotide; PRDM1 exon 5; Set C
uggagcucuugaggcuuuggucggggcugcuucuu

SEQ ID NO: 29528 - RNA, 18 nt, Artificial Sequence
  Synthetic Oligonucleotide; PRDM1 exon 5; Set A
uugaggcuuuggucgggg

SEQ ID NO: 29529 - RNA, 34 nt, Artificial Sequence
  Synthetic Oligonucleotide; PRDM1 exon 5; Set C
uggagcucuugaggcuuuggucggggcugcuucu

SEQ ID NO: 29530 - RNA, 33 nt, Artificial Sequence
  Synthetic Oligonucleotide; PRDM1 exon 5; Set C
uggagcucuugaggcuuuggucggggcugcuuc

SEQ ID NO: 29531 - RNA, 26 nt, Artificial Sequence
  Synthetic Oligonucleotide; PRDM1 exon 5; Set C
uggagcucuugaggcuuuggucgggg

SEQ ID NO: 29532 - RNA, 21 nt, Artificial Sequence
  Synthetic Oligonucleotide; PRDM1 exon 5; Set A
uggagcucuugaggcuuuggu

SEQ ID NO: 29533 - RNA, 20 nt, Artificial Sequence
  Synthetic Oligonucleotide; PRDM1 exon 5; Set A
uggagcucuugaggcuuugg

SEQ ID NO: 29534 - RNA, 19 nt, Artificial Sequence
  Synthetic Oligonucleotide; PRDM1 exon 5; Set C
uggagcucuugaggcuuug

SEQ ID NO: 29535 - RNA, 18 nt, Artificial Sequence
  Synthetic Oligonucleotide; PRDM1 exon 5; Set C
uggagcucuugaggcuuu

SEQ ID NO: 29536 - RNA, 36 nt, Artificial Sequence
  Synthetic Oligonucleotide; PRDM1 exon 5; Set C
gggacaccguauucccagggcugcugugagggcugg

SEQ ID NO: 29537 - RNA, 15 nt, Artificial Sequence
  Synthetic Oligonucleotide; PRDM1 exon 5; Set C
gggacaccguauucc

SEQ ID NO: 29538 - RNA, 15 nt, Artificial Sequence
  Synthetic Oligonucleotide; PRDM1 exon 5; Set C
aguaagcguaggagu

SEQ ID NO: 29539 - RNA, 16 nt, Artificial Sequence
  Synthetic Oligonucleotide; PRDM1 exon 5; Set C
aaguaagcguaggagu

SEQ ID NO: 29540 - RNA, 17 nt, Artificial Sequence
  Synthetic Oligonucleotide; PRDM1 exon 5; Set C
caaguaagcguaggagu

SEQ ID NO: 29541 - RNA, 15 nt, Artificial Sequence
  Synthetic Oligonucleotide; PRDM1 exon 5; Set C
aaguaagcguaggag

SEQ ID NO: 29542 - RNA, 18 nt, Artificial Sequence
  Synthetic Oligonucleotide; PRDM1 exon 5; Set C
ucaaguaagcguaggagu

SEQ ID NO: 29543 - RNA, 16 nt, Artificial Sequence
  Synthetic Oligonucleotide; PRDM1 exon 5; Set C
caaguaagcguaggag

SEQ ID NO: 29544 - RNA, 15 nt, Artificial Sequence
  Synthetic Oligonucleotide; PRDM1 exon 5; Set C
caaguaagcguagga

SEQ ID NO: 29545 - RNA, 17 nt, Artificial Sequence
  Synthetic Oligonucleotide; PRDM1 exon 5; Set C
ucaaguaagcguaggag

SEQ ID NO: 29546 - RNA, 18 nt, Artificial Sequence
  Synthetic Oligonucleotide; PRDM1 exon 5; Set C
uucaaguaagcguaggag

SEQ ID NO: 29547 - RNA, 19 nt, Artificial Sequence
  Synthetic Oligonucleotide; PRDM1 exon 5; Set C
guucaaguaagcguaggag

SEQ ID NO: 29548 - RNA, 30 nt, Artificial Sequence
  Synthetic Oligonucleotide; PRDM1 exon 5; Set C
cguaggacgcguucaaguaagcguaggagu

SEQ ID NO: 29549 - RNA, 28 nt, Artificial Sequence
  Synthetic Oligonucleotide; PRDM1 exon 5; Set C
cguaggacgcguucaaguaagcguagga

SEQ ID NO: 29550 - RNA, 26 nt, Artificial Sequence
  Synthetic Oligonucleotide; PRDM1 exon 5; Set A
cguaggacgcguucaaguaagcguag

SEQ ID NO: 29551 - RNA, 34 nt, Artificial Sequence
  Synthetic Oligonucleotide; PRDM1 exon 5; Set C
gugccguaggacgcguucaaguaagcguaggagu

SEQ ID NO: 29552 - RNA, 25 nt, Artificial Sequence
  Synthetic Oligonucleotide; PRDM1 exon 5; Set A
cguaggacgcguucaaguaagcgua

SEQ ID NO: 29553 - RNA, 33 nt, Artificial Sequence
  Synthetic Oligonucleotide; PRDM1 exon 5; Set C
gugccguaggacgcguucaaguaagcguaggag

SEQ ID NO: 29554 - RNA, 32 nt, Artificial Sequence
  Synthetic Oligonucleotide; PRDM1 exon 5; Set C
gugccguaggacgcguucaaguaagcguagga

SEQ ID NO: 29555 - RNA, 29 nt, Artificial Sequence
  Synthetic Oligonucleotide; PRDM1 exon 5; Set C
gugccguaggacgcguucaaguaagcgua

SEQ ID NO: 29556 - RNA, 36 nt, Artificial Sequence
  Synthetic Oligonucleotide; PRDM1 exon 5; Set C
gagcccaaaccuuccgugccguaggacgcguucaag

SEQ ID NO: 29557 - RNA, 35 nt, Artificial Sequence
  Synthetic Oligonucleotide; PRDM1 exon 5; Set C
gagcccaaaccuuccgugccguaggacgcguucaa

SEQ ID NO: 29558 - RNA, 33 nt, Artificial Sequence
  Synthetic Oligonucleotide; PRDM1 exon 5; Set C
gagcccaaaccuuccgugccguaggacgcguuc

SEQ ID NO: 29559 - RNA, 32 nt, Artificial Sequence
  Synthetic Oligonucleotide; PRDM1 exon 5; Set C
gagcccaaaccuuccgugccguaggacgcguu

SEQ ID NO: 29560 - RNA, 22 nt, Artificial Sequence
  Synthetic Oligonucleotide; PRDM1 exon 5; Set C
gagcccaaaccuuccgugccgu

SEQ ID NO: 29561 - RNA, 23 nt, Artificial Sequence
  Synthetic Oligonucleotide; PRDM1 exon 5; Set C
ggagcccaaaccuuccgugccgu

SEQ ID NO: 29562 - RNA, 24 nt, Artificial Sequence
  Synthetic Oligonucleotide; PRDM1 exon 5; Set C
aggagcccaaaccuuccgugccgu

SEQ ID NO: 29563 - RNA, 25 nt, Artificial Sequence
  Synthetic Oligonucleotide; PRDM1 exon 5; Set C
uaggagcccaaaccuuccgugccgu

SEQ ID NO: 29564 - RNA, 18 nt, Artificial Sequence
  Synthetic Oligonucleotide; PRDM1 exon 5; Set C
gagcccaaaccuuccgug

SEQ ID NO: 29565 - RNA, 26 nt, Artificial Sequence
  Synthetic Oligonucleotide; PRDM1 exon 5; Set C
guaggagcccaaaccuuccgugccgu

SEQ ID NO: 29566 - RNA, 19 nt, Artificial Sequence
  Synthetic Oligonucleotide; PRDM1 exon 5; Set A
ggagcccaaaccuuccgug

SEQ ID NO: 29567 - RNA, 27 nt, Artificial Sequence
  Synthetic Oligonucleotide; PRDM1 exon 5; Set C
gguaggagcccaaaccuuccgugccgu

SEQ ID NO: 29568 - RNA, 20 nt, Artificial Sequence
  Synthetic Oligonucleotide; PRDM1 exon 5; Set A
aggagcccaaaccuuccgug

SEQ ID NO: 29569 - RNA, 28 nt, Artificial Sequence
  Synthetic Oligonucleotide; PRDM1 exon 5; Set C
ggguaggagcccaaaccuuccgugccgu

SEQ ID NO: 29570 - RNA, 21 nt, Artificial Sequence
  Synthetic Oligonucleotide; PRDM1 exon 5; Set A
uaggagcccaaaccuuccgug

SEQ ID NO: 29571 - RNA, 29 nt, Artificial Sequence
  Synthetic Oligonucleotide; PRDM1 exon 5; Set C
aggguaggagcccaaaccuuccgugccgu

SEQ ID NO: 29572 - RNA, 22 nt, Artificial Sequence
  Synthetic Oligonucleotide; PRDM1 exon 5; Set A
guaggagcccaaaccuuccgug

SEQ ID NO: 29573 - RNA, 23 nt, Artificial Sequence
  Synthetic Oligonucleotide; PRDM1 exon 5; Set A
gguaggagcccaaaccuuccgug

SEQ ID NO: 29574 - RNA, 24 nt, Artificial Sequence
  Synthetic Oligonucleotide; PRDM1 exon 5; Set C
ggguaggagcccaaaccuuccgug

SEQ ID NO: 29575 - RNA, 35 nt, Artificial Sequence
  Synthetic Oligonucleotide; PRDM1 exon 5; Set C
guagccaggguaggagcccaaaccuuccgugccgu

SEQ ID NO: 29576 - RNA, 36 nt, Artificial Sequence
  Synthetic Oligonucleotide; PRDM1 exon 5; Set C
cguagccaggguaggagcccaaaccuuccgugccgu

SEQ ID NO: 29577 - RNA, 37 nt, Artificial Sequence
  Synthetic Oligonucleotide; PRDM1 exon 5; Set C
gcguagccaggguaggagcccaaaccuuccgugccgu

SEQ ID NO: 29578 - RNA, 38 nt, Artificial Sequence
  Synthetic Oligonucleotide; PRDM1 exon 5; Set C
ugcguagccaggguaggagcccaaaccuuccgugccgu

SEQ ID NO: 29579 - RNA, 31 nt, Artificial Sequence
  Synthetic Oligonucleotide; PRDM1 exon 5; Set C
guagccaggguaggagcccaaaccuuccgug

SEQ ID NO: 29580 - RNA, 39 nt, Artificial Sequence
  Synthetic Oligonucleotide; PRDM1 exon 5; Set C
gugcguagccaggguaggagcccaaaccuuccgugccgu

SEQ ID NO: 29581 - RNA, 32 nt, Artificial Sequence
  Synthetic Oligonucleotide; PRDM1 exon 5; Set C
cguagccaggguaggagcccaaaccuuccgug

SEQ ID NO: 29582 - RNA, 40 nt, Artificial Sequence
  Synthetic Oligonucleotide; PRDM1 exon 5; Set C
ggugcguagccaggguaggagcccaaaccuuccgugccgu

SEQ ID NO: 29583 - RNA, 33 nt, Artificial Sequence
  Synthetic Oligonucleotide; PRDM1 exon 5; Set C
gcguagccaggguaggagcccaaaccuuccgug

SEQ ID NO: 29584 - RNA, 40 nt, Artificial Sequence
  Synthetic Oligonucleotide; PRDM1 exon 5; Set C
caggggugcguagccaggguaggagcccaaaccuuccgug

SEQ ID NO: 29585 - RNA, 40 nt, Artificial Sequence
  Synthetic Oligonucleotide; PRDM1 exon 5; Set C
cuggcgggagguggggcaggggugcguagccaggguagga

SEQ ID NO: 29586 - RNA, 39 nt, Artificial Sequence
  Synthetic Oligonucleotide; PRDM1 exon 5; Set C
cuggcgggagguggggcaggggugcguagccaggguagg

SEQ ID NO: 29587 - RNA, 38 nt, Artificial Sequence
  Synthetic Oligonucleotide; PRDM1 exon 5; Set C
cuggcgggagguggggcaggggugcguagccaggguag

SEQ ID NO: 29588 - RNA, 37 nt, Artificial Sequence
  Synthetic Oligonucleotide; PRDM1 exon 5; Set C
cuggcgggagguggggcaggggugcguagccagggua

SEQ ID NO: 29589 - RNA, 36 nt, Artificial Sequence
  Synthetic Oligonucleotide; PRDM1 exon 5; Set C
cuggcgggagguggggcaggggugcguagccagggu

SEQ ID NO: 29590 - RNA, 28 nt, Artificial Sequence
  Synthetic Oligonucleotide; PRDM1 exon 5; Set C
cuggcgggagguggggcaggggugcgua

SEQ ID NO: 29591 - RNA, 27 nt, Artificial Sequence
  Synthetic Oligonucleotide; PRDM1 exon 5; Set C
cuggcgggagguggggcaggggugcgu

SEQ ID NO: 29592 - RNA, 26 nt, Artificial Sequence
  Synthetic Oligonucleotide; PRDM1 exon 5; Set C
cuggcgggagguggggcaggggugcg

SEQ ID NO: 29593 - RNA, 25 nt, Artificial Sequence
  Synthetic Oligonucleotide; PRDM1 exon 5; Set C
cuggcgggagguggggcaggggugc

SEQ ID NO: 29594 - RNA, 24 nt, Artificial Sequence
  Synthetic Oligonucleotide; PRDM1 exon 5; Set C
cuggcgggagguggggcaggggug

SEQ ID NO: 29595 - RNA, 23 nt, Artificial Sequence
  Synthetic Oligonucleotide; PRDM1 exon 5; Set C
cuggcgggagguggggcaggggu

SEQ ID NO: 29596 - RNA, 22 nt, Artificial Sequence
  Synthetic Oligonucleotide; PRDM1 exon 5; Set C
cuggcgggagguggggcagggg

SEQ ID NO: 29597 - RNA, 21 nt, Artificial Sequence
  Synthetic Oligonucleotide; PRDM1 exon 5; Set C
cuggcgggagguggggcaggg

SEQ ID NO: 29598 - RNA, 20 nt, Artificial Sequence
  Synthetic Oligonucleotide; PRDM1 exon 5; Set C
gcuggcgggagguggggcag

SEQ ID NO: 29599 - RNA, 21 nt, Artificial Sequence
  Synthetic Oligonucleotide; PRDM1 exon 5; Set C
agcuggcgggagguggggcag

SEQ ID NO: 29600 - RNA, 19 nt, Artificial Sequence
  Synthetic Oligonucleotide; PRDM1 exon 5; Set C
gcuggcgggagguggggca

SEQ ID NO: 29601 - RNA, 20 nt, Artificial Sequence
  Synthetic Oligonucleotide; PRDM1 exon 5; Set C
agcuggcgggagguggggca

SEQ ID NO: 29602 - RNA, 18 nt, Artificial Sequence
  Synthetic Oligonucleotide; PRDM1 exon 5; Set C
gcuggcgggagguggggc

SEQ ID NO: 29603 - RNA, 17 nt, Artificial Sequence
  Synthetic Oligonucleotide; PRDM1 exon 5; Set C
gcuggcgggaggugggg

SEQ ID NO: 29604 - RNA, 19 nt, Artificial Sequence
  Synthetic Oligonucleotide; PRDM1 exon 5; Set C
agcuggcgggagguggggc

SEQ ID NO: 29605 - RNA, 16 nt, Artificial Sequence
  Synthetic Oligonucleotide; PRDM1 exon 5; Set A
gcuggcgggagguggg

SEQ ID NO: 29606 - RNA, 18 nt, Artificial Sequence
  Synthetic Oligonucleotide; PRDM1 exon 5; Set C
agcuggcgggaggugggg

SEQ ID NO: 29607 - RNA, 30 nt, Artificial Sequence
  Synthetic Oligonucleotide; PRDM1 exon 5; Set C
ggggaugaaagcuggcgggagguggggcag

SEQ ID NO: 29608 - RNA, 31 nt, Artificial Sequence
  Synthetic Oligonucleotide; PRDM1 exon 5; Set C
aggggaugaaagcuggcgggagguggggcag

SEQ ID NO: 29609 - RNA, 29 nt, Artificial Sequence
  Synthetic Oligonucleotide; PRDM1 exon 5; Set C
ggggaugaaagcuggcgggagguggggca

SEQ ID NO: 29610 - RNA, 32 nt, Artificial Sequence
  Synthetic Oligonucleotide; PRDM1 exon 5; Set C
gaggggaugaaagcuggcgggagguggggcag

SEQ ID NO: 29611 - RNA, 30 nt, Artificial Sequence
  Synthetic Oligonucleotide; PRDM1 exon 5; Set C
aggggaugaaagcuggcgggagguggggca

SEQ ID NO: 29612 - RNA, 28 nt, Artificial Sequence
  Synthetic Oligonucleotide; PRDM1 exon 5; Set C
ggggaugaaagcuggcgggagguggggc

SEQ ID NO: 29613 - RNA, 27 nt, Artificial Sequence
  Synthetic Oligonucleotide; PRDM1 exon 5; Set C
ggggaugaaagcuggcgggaggugggg

SEQ ID NO: 29614 - RNA, 31 nt, Artificial Sequence
  Synthetic Oligonucleotide; PRDM1 exon 5; Set C
gaggggaugaaagcuggcgggagguggggca

SEQ ID NO: 29615 - RNA, 29 nt, Artificial Sequence
  Synthetic Oligonucleotide; PRDM1 exon 5; Set C
aggggaugaaagcuggcgggagguggggc

SEQ ID NO: 29616 - RNA, 15 nt, Artificial Sequence
  Synthetic Oligonucleotide; PRDM1 exon 5; Set C
gaaagcuggcgggag

SEQ ID NO: 29617 - RNA, 26 nt, Artificial Sequence
  Synthetic Oligonucleotide; PRDM1 exon 5; Set C
ggggaugaaagcuggcgggagguggg

SEQ ID NO: 29618 - RNA, 28 nt, Artificial Sequence
  Synthetic Oligonucleotide; PRDM1 exon 5; Set C
aggggaugaaagcuggcgggaggugggg

SEQ ID NO: 29619 - RNA, 34 nt, Artificial Sequence
  Synthetic Oligonucleotide; PRDM1 exon 5; Set C
acgaggggaugaaagcuggcgggagguggggcag

SEQ ID NO: 29620 - RNA, 30 nt, Artificial Sequence
  Synthetic Oligonucleotide; PRDM1 exon 5; Set C
gaggggaugaaagcuggcgggagguggggc

SEQ ID NO: 29621 - RNA, 16 nt, Artificial Sequence
  Synthetic Oligonucleotide; PRDM1 exon 5; Set C
ugaaagcuggcgggag

SEQ ID NO: 29622 - RNA, 27 nt, Artificial Sequence
  Synthetic Oligonucleotide; PRDM1 exon 5; Set C
aggggaugaaagcuggcgggagguggg

SEQ ID NO: 29623 - RNA, 29 nt, Artificial Sequence
  Synthetic Oligonucleotide; PRDM1 exon 5; Set C
gaggggaugaaagcuggcgggaggugggg

SEQ ID NO: 29624 - RNA, 35 nt, Artificial Sequence
  Synthetic Oligonucleotide; PRDM1 exon 5; Set C
uacgaggggaugaaagcuggcgggagguggggcag

SEQ ID NO: 29625 - RNA, 33 nt, Artificial Sequence
  Synthetic Oligonucleotide; PRDM1 exon 5; Set C
acgaggggaugaaagcuggcgggagguggggca

SEQ ID NO: 29626 - RNA, 17 nt, Artificial Sequence
  Synthetic Oligonucleotide; PRDM1 exon 5; Set C
augaaagcuggcgggag

SEQ ID NO: 29627 - RNA, 15 nt, Artificial Sequence
  Synthetic Oligonucleotide; PRDM1 exon 5; Set C
ugaaagcuggcggga

SEQ ID NO: 29628 - RNA, 28 nt, Artificial Sequence
  Synthetic Oligonucleotide; PRDM1 exon 5; Set C
gaggggaugaaagcuggcgggagguggg

SEQ ID NO: 29629 - RNA, 36 nt, Artificial Sequence
  Synthetic Oligonucleotide; PRDM1 exon 5; Set C
guacgaggggaugaaagcuggcgggagguggggcag

SEQ ID NO: 29630 - RNA, 34 nt, Artificial Sequence
  Synthetic Oligonucleotide; PRDM1 exon 5; Set C
uacgaggggaugaaagcuggcgggagguggggca

SEQ ID NO: 29631 - RNA, 32 nt, Artificial Sequence
  Synthetic Oligonucleotide; PRDM1 exon 5; Set C
acgaggggaugaaagcuggcgggagguggggc

SEQ ID NO: 29632 - RNA, 16 nt, Artificial Sequence
  Synthetic Oligonucleotide; PRDM1 exon 5; Set C
augaaagcuggcggga

SEQ ID NO: 29633 - RNA, 23 nt, Artificial Sequence
  Synthetic Oligonucleotide; PRDM1 exon 5; Set C
ggggaugaaagcuggcgggaggu

SEQ ID NO: 29634 - RNA, 37 nt, Artificial Sequence
  Synthetic Oligonucleotide; PRDM1 exon 5; Set C
uguacgaggggaugaaagcuggcgggagguggggcag

SEQ ID NO: 29635 - RNA, 35 nt, Artificial Sequence
  Synthetic Oligonucleotide; PRDM1 exon 5; Set C
guacgaggggaugaaagcuggcgggagguggggca

SEQ ID NO: 29636 - RNA, 33 nt, Artificial Sequence
  Synthetic Oligonucleotide; PRDM1 exon 5; Set C
uacgaggggaugaaagcuggcgggagguggggc

SEQ ID NO: 29637 - RNA, 17 nt, Artificial Sequence
  Synthetic Oligonucleotide; PRDM1 exon 5; Set C
gaugaaagcuggcggga

SEQ ID NO: 29638 - RNA, 15 nt, Artificial Sequence
  Synthetic Oligonucleotide; PRDM1 exon 5; Set C
augaaagcuggcggg

SEQ ID NO: 29639 - RNA, 22 nt, Artificial Sequence
  Synthetic Oligonucleotide; PRDM1 exon 5; Set A
ggggaugaaagcuggcgggagg

SEQ ID NO: 29640 - RNA, 24 nt, Artificial Sequence
  Synthetic Oligonucleotide; PRDM1 exon 5; Set C
aggggaugaaagcuggcgggaggu

SEQ ID NO: 29641 - RNA, 32 nt, Artificial Sequence
  Synthetic Oligonucleotide; PRDM1 exon 5; Set C
uacgaggggaugaaagcuggcgggaggugggg

SEQ ID NO: 29642 - RNA, 38 nt, Artificial Sequence
  Synthetic Oligonucleotide; PRDM1 exon 5; Set C
uuguacgaggggaugaaagcuggcgggagguggggcag

SEQ ID NO: 29643 - RNA, 36 nt, Artificial Sequence
  Synthetic Oligonucleotide; PRDM1 exon 5; Set C
uguacgaggggaugaaagcuggcgggagguggggca

SEQ ID NO: 29644 - RNA, 34 nt, Artificial Sequence
  Synthetic Oligonucleotide; PRDM1 exon 5; Set C
guacgaggggaugaaagcuggcgggagguggggc

SEQ ID NO: 29645 - RNA, 18 nt, Artificial Sequence
  Synthetic Oligonucleotide; PRDM1 exon 5; Set A
ggaugaaagcuggcggga

SEQ ID NO: 29646 - RNA, 16 nt, Artificial Sequence
  Synthetic Oligonucleotide; PRDM1 exon 5; Set C
gaugaaagcuggcggg

SEQ ID NO: 29647 - RNA, 23 nt, Artificial Sequence
  Synthetic Oligonucleotide; PRDM1 exon 5; Set A
aggggaugaaagcuggcgggagg

SEQ ID NO: 29648 - RNA, 31 nt, Artificial Sequence
  Synthetic Oligonucleotide; PRDM1 exon 5; Set C
uacgaggggaugaaagcuggcgggagguggg

SEQ ID NO: 29649 - RNA, 33 nt, Artificial Sequence
  Synthetic Oligonucleotide; PRDM1 exon 5; Set C
guacgaggggaugaaagcuggcgggaggugggg

SEQ ID NO: 29650 - RNA, 37 nt, Artificial Sequence
  Synthetic Oligonucleotide; PRDM1 exon 5; Set C
uuguacgaggggaugaaagcuggcgggagguggggca

SEQ ID NO: 29651 - RNA, 35 nt, Artificial Sequence
  Synthetic Oligonucleotide; PRDM1 exon 5; Set C
uguacgaggggaugaaagcuggcgggagguggggc

SEQ ID NO: 29652 - RNA, 21 nt, Artificial Sequence
  Synthetic Oligonucleotide; PRDM1 exon 5; Set A
ggggaugaaagcuggcgggag

SEQ ID NO: 29653 - RNA, 19 nt, Artificial Sequence
  Synthetic Oligonucleotide; PRDM1 exon 5; Set A
gggaugaaagcuggcggga

SEQ ID NO: 29654 - RNA, 17 nt, Artificial Sequence
  Synthetic Oligonucleotide; PRDM1 exon 5; Set C
ggaugaaagcuggcggg

SEQ ID NO: 29655 - RNA, 30 nt, Artificial Sequence
  Synthetic Oligonucleotide; PRDM1 exon 5; Set C
uacgaggggaugaaagcuggcgggaggugg

SEQ ID NO: 29656 - RNA, 32 nt, Artificial Sequence
  Synthetic Oligonucleotide; PRDM1 exon 5; Set C
guacgaggggaugaaagcuggcgggagguggg

SEQ ID NO: 29657 - RNA, 34 nt, Artificial Sequence
  Synthetic Oligonucleotide; PRDM1 exon 5; Set C
uguacgaggggaugaaagcuggcgggaggugggg

SEQ ID NO: 29658 - RNA, 36 nt, Artificial Sequence
  Synthetic Oligonucleotide; PRDM1 exon 5; Set C
uuguacgaggggaugaaagcuggcgggagguggggc

SEQ ID NO: 29659 - RNA, 22 nt, Artificial Sequence
  Synthetic Oligonucleotide; PRDM1 exon 5; Set A
aggggaugaaagcuggcgggag

SEQ ID NO: 29660 - RNA, 20 nt, Artificial Sequence
  Synthetic Oligonucleotide; PRDM1 exon 5; Set A
ggggaugaaagcuggcggga

SEQ ID NO: 29661 - RNA, 18 nt, Artificial Sequence
  Synthetic Oligonucleotide; PRDM1 exon 5; Set A
gggaugaaagcuggcggg

SEQ ID NO: 29662 - RNA, 31 nt, Artificial Sequence
  Synthetic Oligonucleotide; PRDM1 exon 5; Set C
guacgaggggaugaaagcuggcgggaggugg

SEQ ID NO: 29663 - RNA, 29 nt, Artificial Sequence
  Synthetic Oligonucleotide; PRDM1 exon 5; Set C
uacgaggggaugaaagcuggcgggaggug

SEQ ID NO: 29664 - RNA, 33 nt, Artificial Sequence
  Synthetic Oligonucleotide; PRDM1 exon 5; Set C
uguacgaggggaugaaagcuggcgggagguggg

SEQ ID NO: 29665 - RNA, 35 nt, Artificial Sequence
  Synthetic Oligonucleotide; PRDM1 exon 5; Set C
uuguacgaggggaugaaagcuggcgggaggugggg

SEQ ID NO: 29666 - RNA, 23 nt, Artificial Sequence
  Synthetic Oligonucleotide; PRDM1 exon 5; Set A
gaggggaugaaagcuggcgggag

SEQ ID NO: 29667 - RNA, 21 nt, Artificial Sequence
  Synthetic Oligonucleotide; PRDM1 exon 5; Set A
aggggaugaaagcuggcggga

SEQ ID NO: 29668 - RNA, 28 nt, Artificial Sequence
  Synthetic Oligonucleotide; PRDM1 exon 5; Set C
uacgaggggaugaaagcuggcgggaggu

SEQ ID NO: 29669 - RNA, 30 nt, Artificial Sequence
  Synthetic Oligonucleotide; PRDM1 exon 5; Set C
guacgaggggaugaaagcuggcgggaggug

SEQ ID NO: 29670 - RNA, 34 nt, Artificial Sequence
  Synthetic Oligonucleotide; PRDM1 exon 5; Set C
uuguacgaggggaugaaagcuggcgggagguggg

SEQ ID NO: 29671 - RNA, 22 nt, Artificial Sequence
  Synthetic Oligonucleotide; PRDM1 exon 5; Set A
gaggggaugaaagcuggcggga

SEQ ID NO: 29672 - RNA, 20 nt, Artificial Sequence
  Synthetic Oligonucleotide; PRDM1 exon 5; Set A
aggggaugaaagcuggcggg

SEQ ID NO: 29673 - RNA, 27 nt, Artificial Sequence
  Synthetic Oligonucleotide; PRDM1 exon 5; Set C
uacgaggggaugaaagcuggcgggagg

SEQ ID NO: 29674 - RNA, 29 nt, Artificial Sequence
  Synthetic Oligonucleotide; PRDM1 exon 5; Set C
guacgaggggaugaaagcuggcgggaggu

SEQ ID NO: 29675 - RNA, 25 nt, Artificial Sequence
  Synthetic Oligonucleotide; PRDM1 exon 5; Set C
acgaggggaugaaagcuggcgggag

SEQ ID NO: 29676 - RNA, 23 nt, Artificial Sequence
  Synthetic Oligonucleotide; PRDM1 exon 5; Set C
cgaggggaugaaagcuggcggga

SEQ ID NO: 29677 - RNA, 21 nt, Artificial Sequence
  Synthetic Oligonucleotide; PRDM1 exon 5; Set A
gaggggaugaaagcuggcggg

SEQ ID NO: 29678 - RNA, 28 nt, Artificial Sequence
  Synthetic Oligonucleotide; PRDM1 exon 5; Set C
guacgaggggaugaaagcuggcgggagg

SEQ ID NO: 29679 - RNA, 26 nt, Artificial Sequence
  Synthetic Oligonucleotide; PRDM1 exon 5; Set C
uacgaggggaugaaagcuggcgggag

SEQ ID NO: 29680 - RNA, 24 nt, Artificial Sequence
  Synthetic Oligonucleotide; PRDM1 exon 5; Set C
acgaggggaugaaagcuggcggga

SEQ ID NO: 29681 - RNA, 22 nt, Artificial Sequence
  Synthetic Oligonucleotide; PRDM1 exon 5; Set A
cgaggggaugaaagcuggcggg

SEQ ID NO: 29682 - RNA, 27 nt, Artificial Sequence
  Synthetic Oligonucleotide; PRDM1 exon 5; Set C
guacgaggggaugaaagcuggcgggag

SEQ ID NO: 29683 - RNA, 23 nt, Artificial Sequence
  Synthetic Oligonucleotide; PRDM1 exon 5; Set C
acgaggggaugaaagcuggcggg

SEQ ID NO: 29684 - RNA, 28 nt, Artificial Sequence
  Synthetic Oligonucleotide; PRDM1 exon 5; Set C
uguacgaggggaugaaagcuggcgggag

SEQ ID NO: 29685 - RNA, 29 nt, Artificial Sequence
  Synthetic Oligonucleotide; PRDM1 exon 5; Set C
uuguacgaggggaugaaagcuggcgggag

SEQ ID NO: 29686 - RNA, 27 nt, Artificial Sequence
  Synthetic Oligonucleotide; PRDM1 exon 5; Set C
uguacgaggggaugaaagcuggcggga

SEQ ID NO: 29687 - RNA, 28 nt, Artificial Sequence
  Synthetic Oligonucleotide; PRDM1 exon 5; Set C
uuguacgaggggaugaaagcuggcggga

SEQ ID NO: 29688 - RNA, 26 nt, Artificial Sequence
  Synthetic Oligonucleotide; PRDM1 exon 5; Set C
uguacgaggggaugaaagcuggcggg

SEQ ID NO: 29689 - RNA, 31 nt, Artificial Sequence
  Synthetic Oligonucleotide; PRDM1 exon 5; Set C
cguuguacgaggggaugaaagcuggcgggag

SEQ ID NO: 29690 - RNA, 29 nt, Artificial Sequence
  Synthetic Oligonucleotide; PRDM1 exon 5; Set C
guuguacgaggggaugaaagcuggcggga

SEQ ID NO: 29691 - RNA, 27 nt, Artificial Sequence
  Synthetic Oligonucleotide; PRDM1 exon 5; Set C
uuguacgaggggaugaaagcuggcggg

SEQ ID NO: 29692 - RNA, 17 nt, Artificial Sequence
  Synthetic Oligonucleotide; PRDM1 exon 5; Set C
cgaggggaugaaagcug

SEQ ID NO: 29693 - RNA, 32 nt, Artificial Sequence
  Synthetic Oligonucleotide; PRDM1 exon 5; Set C
gcguuguacgaggggaugaaagcuggcgggag

SEQ ID NO: 29694 - RNA, 30 nt, Artificial Sequence
  Synthetic Oligonucleotide; PRDM1 exon 5; Set C
cguuguacgaggggaugaaagcuggcggga

SEQ ID NO: 29695 - RNA, 28 nt, Artificial Sequence
  Synthetic Oligonucleotide; PRDM1 exon 5; Set C
guuguacgaggggaugaaagcuggcggg

SEQ ID NO: 29696 - RNA, 18 nt, Artificial Sequence
  Synthetic Oligonucleotide; PRDM1 exon 5; Set C
acgaggggaugaaagcug

SEQ ID NO: 29697 - RNA, 33 nt, Artificial Sequence
  Synthetic Oligonucleotide; PRDM1 exon 5; Set C
agcguuguacgaggggaugaaagcuggcgggag

SEQ ID NO: 29698 - RNA, 31 nt, Artificial Sequence
  Synthetic Oligonucleotide; PRDM1 exon 5; Set C
gcguuguacgaggggaugaaagcuggcggga

SEQ ID NO: 29699 - RNA, 29 nt, Artificial Sequence
  Synthetic Oligonucleotide; PRDM1 exon 5; Set C
cguuguacgaggggaugaaagcuggcggg

SEQ ID NO: 29700 - RNA, 34 nt, Artificial Sequence
  Synthetic Oligonucleotide; PRDM1 exon 5; Set C
gagcguuguacgaggggaugaaagcuggcgggag

SEQ ID NO: 29701 - RNA, 32 nt, Artificial Sequence
  Synthetic Oligonucleotide; PRDM1 exon 5; Set C
agcguuguacgaggggaugaaagcuggcggga

SEQ ID NO: 29702 - RNA, 30 nt, Artificial Sequence
  Synthetic Oligonucleotide; PRDM1 exon 5; Set C
gcguuguacgaggggaugaaagcuggcggg

SEQ ID NO: 29703 - RNA, 33 nt, Artificial Sequence
  Synthetic Oligonucleotide; PRDM1 exon 5; Set C
gagcguuguacgaggggaugaaagcuggcggga

SEQ ID NO: 29704 - RNA, 31 nt, Artificial Sequence
  Synthetic Oligonucleotide; PRDM1 exon 5; Set C
agcguuguacgaggggaugaaagcuggcggg

SEQ ID NO: 29705 - RNA, 34 nt, Artificial Sequence
  Synthetic Oligonucleotide; PRDM1 exon 5; Set C
ugagcguuguacgaggggaugaaagcuggcggga

SEQ ID NO: 29706 - RNA, 32 nt, Artificial Sequence
  Synthetic Oligonucleotide; PRDM1 exon 5; Set C
gagcguuguacgaggggaugaaagcuggcggg

SEQ ID NO: 29707 - RNA, 35 nt, Artificial Sequence
  Synthetic Oligonucleotide; PRDM1 exon 5; Set C
gugagcguuguacgaggggaugaaagcuggcggga

SEQ ID NO: 29708 - RNA, 33 nt, Artificial Sequence
  Synthetic Oligonucleotide; PRDM1 exon 5; Set C
ugagcguuguacgaggggaugaaagcuggcggg

SEQ ID NO: 29709 - RNA, 23 nt, Artificial Sequence
  Synthetic Oligonucleotide; PRDM1 exon 5; Set A
guuguacgaggggaugaaagcug

SEQ ID NO: 29710 - RNA, 34 nt, Artificial Sequence
  Synthetic Oligonucleotide; PRDM1 exon 5; Set C
gugagcguuguacgaggggaugaaagcuggcggg

SEQ ID NO: 29711 - RNA, 24 nt, Artificial Sequence
  Synthetic Oligonucleotide; PRDM1 exon 5; Set A
cguuguacgaggggaugaaagcug

SEQ ID NO: 29712 - RNA, 25 nt, Artificial Sequence
  Synthetic Oligonucleotide; PRDM1 exon 5; Set A
gcguuguacgaggggaugaaagcug

SEQ ID NO: 29713 - RNA, 26 nt, Artificial Sequence
  Synthetic Oligonucleotide; PRDM1 exon 5; Set A
agcguuguacgaggggaugaaagcug

SEQ ID NO: 29714 - RNA, 27 nt, Artificial Sequence
  Synthetic Oligonucleotide; PRDM1 exon 5; Set A
gagcguuguacgaggggaugaaagcug

SEQ ID NO: 29715 - RNA, 28 nt, Artificial Sequence
  Synthetic Oligonucleotide; PRDM1 exon 5; Set A
ugagcguuguacgaggggaugaaagcug

SEQ ID NO: 29716 - RNA, 29 nt, Artificial Sequence
  Synthetic Oligonucleotide; PRDM1 exon 5; Set C
gugagcguuguacgaggggaugaaagcug

SEQ ID NO: 29717 - RNA, 30 nt, Artificial Sequence
  Synthetic Oligonucleotide; PRDM1 exon 5; Set C
agugagcguuguacgaggggaugaaagcug

SEQ ID NO: 29718 - RNA, 31 nt, Artificial Sequence
  Synthetic Oligonucleotide; PRDM1 exon 5; Set C
uagugagcguuguacgaggggaugaaagcug

SEQ ID NO: 29719 - RNA, 32 nt, Artificial Sequence
  Synthetic Oligonucleotide; PRDM1 exon 5; Set C
guagugagcguuguacgaggggaugaaagcug

SEQ ID NO: 29720 - RNA, 33 nt, Artificial Sequence
  Synthetic Oligonucleotide; PRDM1 exon 5; Set C
gguagugagcguuguacgaggggaugaaagcug

SEQ ID NO: 29721 - RNA, 34 nt, Artificial Sequence
  Synthetic Oligonucleotide; PRDM1 exon 5; Set C
ggguagugagcguuguacgaggggaugaaagcug

SEQ ID NO: 29722 - RNA, 35 nt, Artificial Sequence
  Synthetic Oligonucleotide; PRDM1 exon 5; Set C
gggguagugagcguuguacgaggggaugaaagcug

SEQ ID NO: 29723 - RNA, 36 nt, Artificial Sequence
  Synthetic Oligonucleotide; PRDM1 exon 5; Set C
ugggguagugagcguuguacgaggggaugaaagcug

SEQ ID NO: 29724 - RNA, 37 nt, Artificial Sequence
  Synthetic Oligonucleotide; PRDM1 exon 5; Set C
uugggguagugagcguuguacgaggggaugaaagcug

SEQ ID NO: 29725 - RNA, 30 nt, Artificial Sequence
  Synthetic Oligonucleotide; PRDM1 exon 5; Set C
gaacuugggguagugagcguuguacgaggg

SEQ ID NO: 29726 - RNA, 29 nt, Artificial Sequence
  Synthetic Oligonucleotide; PRDM1 exon 5; Set C
gaacuugggguagugagcguuguacgagg

SEQ ID NO: 29727 - RNA, 28 nt, Artificial Sequence
  Synthetic Oligonucleotide; PRDM1 exon 5; Set C
gaacuugggguagugagcguuguacgag

SEQ ID NO: 29728 - RNA, 25 nt, Artificial Sequence
  Synthetic Oligonucleotide; PRDM1 exon 5; Set A
gaacuugggguagugagcguuguac

SEQ ID NO: 29729 - RNA, 24 nt, Artificial Sequence
  Synthetic Oligonucleotide; PRDM1 exon 5; Set A
gaacuugggguagugagcguugua

SEQ ID NO: 29730 - RNA, 26 nt, Artificial Sequence
  Synthetic Oligonucleotide; PRDM1 exon 5; Set C
ggaacuugggguagugagcguuguac

SEQ ID NO: 29731 - RNA, 23 nt, Artificial Sequence
  Synthetic Oligonucleotide; PRDM1 exon 5; Set A
gaacuugggguagugagcguugu

SEQ ID NO: 29732 - RNA, 25 nt, Artificial Sequence
  Synthetic Oligonucleotide; PRDM1 exon 5; Set A
ggaacuugggguagugagcguugua

SEQ ID NO: 29733 - RNA, 27 nt, Artificial Sequence
  Synthetic Oligonucleotide; PRDM1 exon 5; Set A
aggaacuugggguagugagcguuguac

SEQ ID NO: 29734 - RNA, 22 nt, Artificial Sequence
  Synthetic Oligonucleotide; PRDM1 exon 5; Set A
gaacuugggguagugagcguug

SEQ ID NO: 29735 - RNA, 26 nt, Artificial Sequence
  Synthetic Oligonucleotide; PRDM1 exon 5; Set A
aggaacuugggguagugagcguugua

SEQ ID NO: 29736 - RNA, 39 nt, Artificial Sequence
  Synthetic Oligonucleotide; PRDM1 exon 5; Set C
gggcaagaggaacuugggguagugagcguuguacgaggg

SEQ ID NO: 29737 - RNA, 40 nt, Artificial Sequence
  Synthetic Oligonucleotide; PRDM1 exon 5; Set C
ggggcaagaggaacuugggguagugagcguuguacgaggg

SEQ ID NO: 29738 - RNA, 38 nt, Artificial Sequence
  Synthetic Oligonucleotide; PRDM1 exon 5; Set C
gggcaagaggaacuugggguagugagcguuguacgagg

SEQ ID NO: 29739 - RNA, 39 nt, Artificial Sequence
  Synthetic Oligonucleotide; PRDM1 exon 5; Set C
ggggcaagaggaacuugggguagugagcguuguacgagg

SEQ ID NO: 29740 - RNA, 37 nt, Artificial Sequence
  Synthetic Oligonucleotide; PRDM1 exon 5; Set C
gggcaagaggaacuugggguagugagcguuguacgag

SEQ ID NO: 29741 - RNA, 38 nt, Artificial Sequence
  Synthetic Oligonucleotide; PRDM1 exon 5; Set C
ggggcaagaggaacuugggguagugagcguuguacgag

SEQ ID NO: 29742 - RNA, 35 nt, Artificial Sequence
  Synthetic Oligonucleotide; PRDM1 exon 5; Set C
gggcaagaggaacuugggguagugagcguuguacg

SEQ ID NO: 29743 - RNA, 36 nt, Artificial Sequence
  Synthetic Oligonucleotide; PRDM1 exon 5; Set C
ggggcaagaggaacuugggguagugagcguuguacg

SEQ ID NO: 29744 - RNA, 34 nt, Artificial Sequence
  Synthetic Oligonucleotide; PRDM1 exon 5; Set C
gggcaagaggaacuugggguagugagcguuguac

SEQ ID NO: 29745 - RNA, 33 nt, Artificial Sequence
  Synthetic Oligonucleotide; PRDM1 exon 5; Set C
gggcaagaggaacuugggguagugagcguugua

SEQ ID NO: 29746 - RNA, 35 nt, Artificial Sequence
  Synthetic Oligonucleotide; PRDM1 exon 5; Set C
ggggcaagaggaacuugggguagugagcguuguac

SEQ ID NO: 29747 - RNA, 32 nt, Artificial Sequence
  Synthetic Oligonucleotide; PRDM1 exon 5; Set C
gggcaagaggaacuugggguagugagcguugu

SEQ ID NO: 29748 - RNA, 34 nt, Artificial Sequence
  Synthetic Oligonucleotide; PRDM1 exon 5; Set C
ggggcaagaggaacuugggguagugagcguugua

SEQ ID NO: 29749 - RNA, 36 nt, Artificial Sequence
  Synthetic Oligonucleotide; PRDM1 exon 5; Set C
gggggcaagaggaacuugggguagugagcguuguac

SEQ ID NO: 29750 - RNA, 31 nt, Artificial Sequence
  Synthetic Oligonucleotide; PRDM1 exon 5; Set C
gggcaagaggaacuugggguagugagcguug

SEQ ID NO: 29751 - RNA, 33 nt, Artificial Sequence
  Synthetic Oligonucleotide; PRDM1 exon 5; Set C
ggggcaagaggaacuugggguagugagcguugu

SEQ ID NO: 29752 - RNA, 35 nt, Artificial Sequence
  Synthetic Oligonucleotide; PRDM1 exon 5; Set C
gggggcaagaggaacuugggguagugagcguugua

SEQ ID NO: 29753 - RNA, 37 nt, Artificial Sequence
  Synthetic Oligonucleotide; PRDM1 exon 5; Set C
ggggggcaagaggaacuugggguagugagcguuguac

SEQ ID NO: 29754 - RNA, 32 nt, Artificial Sequence
  Synthetic Oligonucleotide; PRDM1 exon 5; Set C
ggggcaagaggaacuugggguagugagcguug

SEQ ID NO: 29755 - RNA, 36 nt, Artificial Sequence
  Synthetic Oligonucleotide; PRDM1 exon 5; Set C
ggggggcaagaggaacuugggguagugagcguugua

SEQ ID NO: 29756 - RNA, 29 nt, Artificial Sequence
  Synthetic Oligonucleotide; PRDM1 exon 5; Set C
gggcaagaggaacuugggguagugagcgu

SEQ ID NO: 29757 - RNA, 28 nt, Artificial Sequence
  Synthetic Oligonucleotide; PRDM1 exon 5; Set C
gggcaagaggaacuugggguagugagcg

SEQ ID NO: 29758 - RNA, 29 nt, Artificial Sequence
  Synthetic Oligonucleotide; PRDM1 exon 5; Set C
ggggcaagaggaacuugggguagugagcg

SEQ ID NO: 29759 - RNA, 27 nt, Artificial Sequence
  Synthetic Oligonucleotide; PRDM1 exon 5; Set C
gggcaagaggaacuugggguagugagc

SEQ ID NO: 29760 - RNA, 26 nt, Artificial Sequence
  Synthetic Oligonucleotide; PRDM1 exon 5; Set A
gggcaagaggaacuugggguagugag

SEQ ID NO: 29761 - RNA, 28 nt, Artificial Sequence
  Synthetic Oligonucleotide; PRDM1 exon 5; Set C
ggggcaagaggaacuugggguagugagc

SEQ ID NO: 29762 - RNA, 25 nt, Artificial Sequence
  Synthetic Oligonucleotide; PRDM1 exon 5; Set C
gggcaagaggaacuugggguaguga

SEQ ID NO: 29763 - RNA, 27 nt, Artificial Sequence
  Synthetic Oligonucleotide; PRDM1 exon 5; Set C
ggggcaagaggaacuugggguagugag

SEQ ID NO: 29764 - RNA, 26 nt, Artificial Sequence
  Synthetic Oligonucleotide; PRDM1 exon 5; Set C
ggggcaagaggaacuugggguaguga

SEQ ID NO: 29765 - RNA, 24 nt, Artificial Sequence
  Synthetic Oligonucleotide; PRDM1 exon 5; Set A
gggcaagaggaacuugggguagug

SEQ ID NO: 29766 - RNA, 23 nt, Artificial Sequence
  Synthetic Oligonucleotide; PRDM1 exon 5; Set A
gggcaagaggaacuugggguagu

SEQ ID NO: 29767 - RNA, 25 nt, Artificial Sequence
  Synthetic Oligonucleotide; PRDM1 exon 5; Set C
ggggcaagaggaacuugggguagug

SEQ ID NO: 29768 - RNA, 21 nt, Artificial Sequence
  Synthetic Oligonucleotide; PRDM1 exon 5; Set A
gggcaagaggaacuuggggua

SEQ ID NO: 29769 - RNA, 20 nt, Artificial Sequence
  Synthetic Oligonucleotide; PRDM1 exon 5; Set A
gggcaagaggaacuuggggu

SEQ ID NO: 29770 - RNA, 22 nt, Artificial Sequence
  Synthetic Oligonucleotide; PRDM1 exon 5; Set A
ggggcaagaggaacuuggggua

SEQ ID NO: 29771 - RNA, 21 nt, Artificial Sequence
  Synthetic Oligonucleotide; PRDM1 exon 5; Set A
ggggcaagaggaacuuggggu

SEQ ID NO: 29772 - RNA, 19 nt, Artificial Sequence
  Synthetic Oligonucleotide; PRDM1 exon 5; Set A
gggcaagaggaacuugggg

SEQ ID NO: 29773 - RNA, 18 nt, Artificial Sequence
  Synthetic Oligonucleotide; PRDM1 exon 5; Set C
gggcaagaggaacuuggg

SEQ ID NO: 29774 - RNA, 20 nt, Artificial Sequence
  Synthetic Oligonucleotide; PRDM1 exon 5; Set A
ggggcaagaggaacuugggg

SEQ ID NO: 29775 - RNA, 17 nt, Artificial Sequence
  Synthetic Oligonucleotide; PRDM1 exon 5; Set C
gggcaagaggaacuugg

SEQ ID NO: 29776 - RNA, 19 nt, Artificial Sequence
  Synthetic Oligonucleotide; PRDM1 exon 5; Set A
ggggcaagaggaacuuggg

SEQ ID NO: 29777 - RNA, 18 nt, Artificial Sequence
  Synthetic Oligonucleotide; PRDM1 exon 5; Set C
ggggcaagaggaacuugg

SEQ ID NO: 29778 - RNA, 16 nt, Artificial Sequence
  Synthetic Oligonucleotide; PRDM1 exon 5; Set C
gggcaagaggaacuug

SEQ ID NO: 29779 - RNA, 17 nt, Artificial Sequence
  Synthetic Oligonucleotide; PRDM1 exon 5; Set C
ggggcaagaggaacuug

SEQ ID NO: 29780 - RNA, 18 nt, Artificial Sequence
  Synthetic Oligonucleotide; PRDM1 exon 5; Set C
gggggcaagaggaacuug

SEQ ID NO: 29781 - RNA, 19 nt, Artificial Sequence
  Synthetic Oligonucleotide; PRDM1 exon 5; Set A
ggggggcaagaggaacuug

SEQ ID NO: 29782 - RNA, 20 nt, Artificial Sequence
  Synthetic Oligonucleotide; PRDM1 exon 5; Set A
aggggggcaagaggaacuug

SEQ ID NO: 29783 - RNA, 40 nt, Artificial Sequence
  Synthetic Oligonucleotide; PRDM1 exon 5; Set C
auucaugccguaggggggcaagaggaacuugggguaguga

SEQ ID NO: 29784 - RNA, 39 nt, Artificial Sequence
  Synthetic Oligonucleotide; PRDM1 exon 5; Set C
auucaugccguaggggggcaagaggaacuugggguagug

SEQ ID NO: 29785 - RNA, 38 nt, Artificial Sequence
  Synthetic Oligonucleotide; PRDM1 exon 5; Set C
auucaugccguaggggggcaagaggaacuugggguagu

SEQ ID NO: 29786 - RNA, 40 nt, Artificial Sequence
  Synthetic Oligonucleotide; PRDM1 exon 5; Set C
aauucaugccguaggggggcaagaggaacuugggguagug

SEQ ID NO: 29787 - RNA, 39 nt, Artificial Sequence
  Synthetic Oligonucleotide; PRDM1 exon 5; Set C
aauucaugccguaggggggcaagaggaacuugggguagu

SEQ ID NO: 29788 - RNA, 36 nt, Artificial Sequence
  Synthetic Oligonucleotide; PRDM1 exon 5; Set C
auucaugccguaggggggcaagaggaacuuggggua

SEQ ID NO: 29789 - RNA, 35 nt, Artificial Sequence
  Synthetic Oligonucleotide; PRDM1 exon 5; Set C
auucaugccguaggggggcaagaggaacuuggggu

SEQ ID NO: 29790 - RNA, 37 nt, Artificial Sequence
  Synthetic Oligonucleotide; PRDM1 exon 5; Set C
aauucaugccguaggggggcaagaggaacuuggggua

SEQ ID NO: 29791 - RNA, 36 nt, Artificial Sequence
  Synthetic Oligonucleotide; PRDM1 exon 5; Set C
aauucaugccguaggggggcaagaggaacuuggggu

SEQ ID NO: 29792 - RNA, 34 nt, Artificial Sequence
  Synthetic Oligonucleotide; PRDM1 exon 5; Set C
auucaugccguaggggggcaagaggaacuugggg

SEQ ID NO: 29793 - RNA, 33 nt, Artificial Sequence
  Synthetic Oligonucleotide; PRDM1 exon 5; Set C
auucaugccguaggggggcaagaggaacuuggg

SEQ ID NO: 29794 - RNA, 35 nt, Artificial Sequence
  Synthetic Oligonucleotide; PRDM1 exon 5; Set C
aauucaugccguaggggggcaagaggaacuugggg

SEQ ID NO: 29795 - RNA, 32 nt, Artificial Sequence
  Synthetic Oligonucleotide; PRDM1 exon 5; Set C
auucaugccguaggggggcaagaggaacuugg

SEQ ID NO: 29796 - RNA, 34 nt, Artificial Sequence
  Synthetic Oligonucleotide; PRDM1 exon 5; Set C
aauucaugccguaggggggcaagaggaacuuggg

SEQ ID NO: 29797 - RNA, 36 nt, Artificial Sequence
  Synthetic Oligonucleotide; PRDM1 exon 5; Set C
caauucaugccguaggggggcaagaggaacuugggg

SEQ ID NO: 29798 - RNA, 33 nt, Artificial Sequence
  Synthetic Oligonucleotide; PRDM1 exon 5; Set C
aauucaugccguaggggggcaagaggaacuugg

SEQ ID NO: 29799 - RNA, 35 nt, Artificial Sequence
  Synthetic Oligonucleotide; PRDM1 exon 5; Set C
caauucaugccguaggggggcaagaggaacuuggg

SEQ ID NO: 29800 - RNA, 37 nt, Artificial Sequence
  Synthetic Oligonucleotide; PRDM1 exon 5; Set C
acaauucaugccguaggggggcaagaggaacuugggg

SEQ ID NO: 29801 - RNA, 31 nt, Artificial Sequence
  Synthetic Oligonucleotide; PRDM1 exon 5; Set C
auucaugccguaggggggcaagaggaacuug

SEQ ID NO: 29802 - RNA, 34 nt, Artificial Sequence
  Synthetic Oligonucleotide; PRDM1 exon 5; Set C
caauucaugccguaggggggcaagaggaacuugg

SEQ ID NO: 29803 - RNA, 36 nt, Artificial Sequence
  Synthetic Oligonucleotide; PRDM1 exon 5; Set C
acaauucaugccguaggggggcaagaggaacuuggg

SEQ ID NO: 29804 - RNA, 32 nt, Artificial Sequence
  Synthetic Oligonucleotide; PRDM1 exon 5; Set C
aauucaugccguaggggggcaagaggaacuug

SEQ ID NO: 29805 - RNA, 33 nt, Artificial Sequence
  Synthetic Oligonucleotide; PRDM1 exon 5; Set C
caauucaugccguaggggggcaagaggaacuug

SEQ ID NO: 29806 - RNA, 34 nt, Artificial Sequence
  Synthetic Oligonucleotide; PRDM1 exon 5; Set C
acaauucaugccguaggggggcaagaggaacuug

SEQ ID NO: 29807 - RNA, 27 nt, Artificial Sequence
  Synthetic Oligonucleotide; PRDM1 exon 5; Set C
auucaugccguaggggggcaagaggaa

SEQ ID NO: 29808 - RNA, 35 nt, Artificial Sequence
  Synthetic Oligonucleotide; PRDM1 exon 5; Set C
uacaauucaugccguaggggggcaagaggaacuug

SEQ ID NO: 29809 - RNA, 26 nt, Artificial Sequence
  Synthetic Oligonucleotide; PRDM1 exon 5; Set C
auucaugccguaggggggcaagagga

SEQ ID NO: 29810 - RNA, 28 nt, Artificial Sequence
  Synthetic Oligonucleotide; PRDM1 exon 5; Set C
aauucaugccguaggggggcaagaggaa

SEQ ID NO: 29811 - RNA, 36 nt, Artificial Sequence
  Synthetic Oligonucleotide; PRDM1 exon 5; Set C
uuacaauucaugccguaggggggcaagaggaacuug

SEQ ID NO: 29812 - RNA, 27 nt, Artificial Sequence
  Synthetic Oligonucleotide; PRDM1 exon 5; Set C
aauucaugccguaggggggcaagagga

SEQ ID NO: 29813 - RNA, 25 nt, Artificial Sequence
  Synthetic Oligonucleotide; PRDM1 exon 5; Set C
auucaugccguaggggggcaagagg

SEQ ID NO: 29814 - RNA, 29 nt, Artificial Sequence
  Synthetic Oligonucleotide; PRDM1 exon 5; Set C
caauucaugccguaggggggcaagaggaa

SEQ ID NO: 29815 - RNA, 37 nt, Artificial Sequence
  Synthetic Oligonucleotide; PRDM1 exon 5; Set C
auuacaauucaugccguaggggggcaagaggaacuug

SEQ ID NO: 29816 - RNA, 24 nt, Artificial Sequence
  Synthetic Oligonucleotide; PRDM1 exon 5; Set A
auucaugccguaggggggcaagag

SEQ ID NO: 29817 - RNA, 28 nt, Artificial Sequence
  Synthetic Oligonucleotide; PRDM1 exon 5; Set C
caauucaugccguaggggggcaagagga

SEQ ID NO: 29818 - RNA, 26 nt, Artificial Sequence
  Synthetic Oligonucleotide; PRDM1 exon 5; Set C
aauucaugccguaggggggcaagagg

SEQ ID NO: 29819 - RNA, 30 nt, Artificial Sequence
  Synthetic Oligonucleotide; PRDM1 exon 5; Set C
acaauucaugccguaggggggcaagaggaa

SEQ ID NO: 29820 - RNA, 25 nt, Artificial Sequence
  Synthetic Oligonucleotide; PRDM1 exon 5; Set A
aauucaugccguaggggggcaagag

SEQ ID NO: 29821 - RNA, 23 nt, Artificial Sequence
  Synthetic Oligonucleotide; PRDM1 exon 5; Set C
auucaugccguaggggggcaaga

SEQ ID NO: 29822 - RNA, 29 nt, Artificial Sequence
  Synthetic Oligonucleotide; PRDM1 exon 5; Set C
acaauucaugccguaggggggcaagagga

SEQ ID NO: 29823 - RNA, 27 nt, Artificial Sequence
  Synthetic Oligonucleotide; PRDM1 exon 5; Set C
caauucaugccguaggggggcaagagg

SEQ ID NO: 29824 - RNA, 31 nt, Artificial Sequence
  Synthetic Oligonucleotide; PRDM1 exon 5; Set C
uacaauucaugccguaggggggcaagaggaa

SEQ ID NO: 29825 - RNA, 26 nt, Artificial Sequence
  Synthetic Oligonucleotide; PRDM1 exon 5; Set C
caauucaugccguaggggggcaagag

SEQ ID NO: 29826 - RNA, 24 nt, Artificial Sequence
  Synthetic Oligonucleotide; PRDM1 exon 5; Set A
aauucaugccguaggggggcaaga

SEQ ID NO: 29827 - RNA, 30 nt, Artificial Sequence
  Synthetic Oligonucleotide; PRDM1 exon 5; Set C
uacaauucaugccguaggggggcaagagga

SEQ ID NO: 29828 - RNA, 28 nt, Artificial Sequence
  Synthetic Oligonucleotide; PRDM1 exon 5; Set C
acaauucaugccguaggggggcaagagg

SEQ ID NO: 29829 - RNA, 32 nt, Artificial Sequence
  Synthetic Oligonucleotide; PRDM1 exon 5; Set C
uuacaauucaugccguaggggggcaagaggaa

SEQ ID NO: 29830 - RNA, 27 nt, Artificial Sequence
  Synthetic Oligonucleotide; PRDM1 exon 5; Set C
acaauucaugccguaggggggcaagag

SEQ ID NO: 29831 - RNA, 25 nt, Artificial Sequence
  Synthetic Oligonucleotide; PRDM1 exon 5; Set C
caauucaugccguaggggggcaaga

SEQ ID NO: 29832 - RNA, 29 nt, Artificial Sequence
  Synthetic Oligonucleotide; PRDM1 exon 5; Set C
uacaauucaugccguaggggggcaagagg

SEQ ID NO: 29833 - RNA, 33 nt, Artificial Sequence
  Synthetic Oligonucleotide; PRDM1 exon 5; Set C
auuacaauucaugccguaggggggcaagaggaa

SEQ ID NO: 29834 - RNA, 26 nt, Artificial Sequence
  Synthetic Oligonucleotide; PRDM1 exon 5; Set C
acaauucaugccguaggggggcaaga

SEQ ID NO: 29835 - RNA, 30 nt, Artificial Sequence
  Synthetic Oligonucleotide; PRDM1 exon 5; Set C
uuacaauucaugccguaggggggcaagagg

SEQ ID NO: 29836 - RNA, 27 nt, Artificial Sequence
  Synthetic Oligonucleotide; PRDM1 exon 5; Set C
uacaauucaugccguaggggggcaaga

SEQ ID NO: 29837 - RNA, 31 nt, Artificial Sequence
  Synthetic Oligonucleotide; PRDM1 exon 5; Set C
auuacaauucaugccguaggggggcaagagg

SEQ ID NO: 29838 - RNA, 18 nt, Artificial Sequence
  Synthetic Oligonucleotide; PRDM1 exon 5; Set A
auucaugccguagggggg

SEQ ID NO: 29839 - RNA, 19 nt, Artificial Sequence
  Synthetic Oligonucleotide; PRDM1 exon 5; Set A
aauucaugccguagggggg

SEQ ID NO: 29840 - RNA, 17 nt, Artificial Sequence
  Synthetic Oligonucleotide; PRDM1 exon 5; Set C
auucaugccguaggggg

SEQ ID NO: 29841 - RNA, 16 nt, Artificial Sequence
  Synthetic Oligonucleotide; PRDM1 exon 5; Set C
auucaugccguagggg

SEQ ID NO: 29842 - RNA, 20 nt, Artificial Sequence
  Synthetic Oligonucleotide; PRDM1 exon 5; Set A
caauucaugccguagggggg

SEQ ID NO: 29843 - RNA, 18 nt, Artificial Sequence
  Synthetic Oligonucleotide; PRDM1 exon 5; Set C
aauucaugccguaggggg

SEQ ID NO: 29844 - RNA, 38 nt, Artificial Sequence
  Synthetic Oligonucleotide; PRDM1 exon 5; Set C
aggccauuacaauucaugccguaggggggcaagaggaa

SEQ ID NO: 29845 - RNA, 17 nt, Artificial Sequence
  Synthetic Oligonucleotide; PRDM1 exon 5; Set C
aauucaugccguagggg

SEQ ID NO: 29846 - RNA, 15 nt, Artificial Sequence
  Synthetic Oligonucleotide; PRDM1 exon 5; Set C
auucaugccguaggg

SEQ ID NO: 29847 - RNA, 37 nt, Artificial Sequence
  Synthetic Oligonucleotide; PRDM1 exon 5; Set C
aggccauuacaauucaugccguaggggggcaagagga

SEQ ID NO: 29848 - RNA, 19 nt, Artificial Sequence
  Synthetic Oligonucleotide; PRDM1 exon 5; Set C
caauucaugccguaggggg

SEQ ID NO: 29849 - RNA, 21 nt, Artificial Sequence
  Synthetic Oligonucleotide; PRDM1 exon 5; Set A
acaauucaugccguagggggg

SEQ ID NO: 29850 - RNA, 16 nt, Artificial Sequence
  Synthetic Oligonucleotide; PRDM1 exon 5; Set C
aauucaugccguaggg

SEQ ID NO: 29851 - RNA, 36 nt, Artificial Sequence
  Synthetic Oligonucleotide; PRDM1 exon 5; Set C
aggccauuacaauucaugccguaggggggcaagagg

SEQ ID NO: 29852 - RNA, 22 nt, Artificial Sequence
  Synthetic Oligonucleotide; PRDM1 exon 5; Set A
uacaauucaugccguagggggg

SEQ ID NO: 29853 - RNA, 20 nt, Artificial Sequence
  Synthetic Oligonucleotide; PRDM1 exon 5; Set A
acaauucaugccguaggggg

SEQ ID NO: 29854 - RNA, 17 nt, Artificial Sequence
  Synthetic Oligonucleotide; PRDM1 exon 5; Set C
caauucaugccguaggg

SEQ ID NO: 29855 - RNA, 15 nt, Artificial Sequence
  Synthetic Oligonucleotide; PRDM1 exon 5; Set C
aauucaugccguagg

SEQ ID NO: 29856 - RNA, 35 nt, Artificial Sequence
  Synthetic Oligonucleotide; PRDM1 exon 5; Set C
aggccauuacaauucaugccguaggggggcaagag

SEQ ID NO: 29857 - RNA, 21 nt, Artificial Sequence
  Synthetic Oligonucleotide; PRDM1 exon 5; Set A
uacaauucaugccguaggggg

SEQ ID NO: 29858 - RNA, 16 nt, Artificial Sequence
  Synthetic Oligonucleotide; PRDM1 exon 5; Set C
caauucaugccguagg

SEQ ID NO: 29859 - RNA, 18 nt, Artificial Sequence
  Synthetic Oligonucleotide; PRDM1 exon 5; Set C
acaauucaugccguaggg

SEQ ID NO: 29860 - RNA, 34 nt, Artificial Sequence
  Synthetic Oligonucleotide; PRDM1 exon 5; Set C
aggccauuacaauucaugccguaggggggcaaga

SEQ ID NO: 29861 - RNA, 22 nt, Artificial Sequence
  Synthetic Oligonucleotide; PRDM1 exon 5; Set A
uuacaauucaugccguaggggg

SEQ ID NO: 29862 - RNA, 15 nt, Artificial Sequence
  Synthetic Oligonucleotide; PRDM1 exon 5; Set C
caauucaugccguag

SEQ ID NO: 29863 - RNA, 17 nt, Artificial Sequence
  Synthetic Oligonucleotide; PRDM1 exon 5; Set C
acaauucaugccguagg

SEQ ID NO: 29864 - RNA, 23 nt, Artificial Sequence
  Synthetic Oligonucleotide; PRDM1 exon 5; Set A
auuacaauucaugccguaggggg

SEQ ID NO: 29865 - RNA, 16 nt, Artificial Sequence
  Synthetic Oligonucleotide; PRDM1 exon 5; Set C
acaauucaugccguag

SEQ ID NO: 29866 - RNA, 15 nt, Artificial Sequence
  Synthetic Oligonucleotide; PRDM1 exon 5; Set C
acaauucaugccgua

SEQ ID NO: 29867 - RNA, 16 nt, Artificial Sequence
  Synthetic Oligonucleotide; PRDM1 exon 5; Set C
uacaauucaugccgua

SEQ ID NO: 29868 - RNA, 29 nt, Artificial Sequence
  Synthetic Oligonucleotide; PRDM1 exon 5; Set C
aggccauuacaauucaugccguagggggg

SEQ ID NO: 29869 - RNA, 28 nt, Artificial Sequence
  Synthetic Oligonucleotide; PRDM1 exon 5; Set C
aggccauuacaauucaugccguaggggg

SEQ ID NO: 29870 - RNA, 27 nt, Artificial Sequence
  Synthetic Oligonucleotide; PRDM1 exon 5; Set C
aggccauuacaauucaugccguagggg

SEQ ID NO: 29871 - RNA, 26 nt, Artificial Sequence
  Synthetic Oligonucleotide; PRDM1 exon 5; Set A
aggccauuacaauucaugccguaggg

SEQ ID NO: 29872 - RNA, 25 nt, Artificial Sequence
  Synthetic Oligonucleotide; PRDM1 exon 5; Set A
aggccauuacaauucaugccguagg

SEQ ID NO: 29873 - RNA, 24 nt, Artificial Sequence
  Synthetic Oligonucleotide; PRDM1 exon 5; Set A
aggccauuacaauucaugccguag

SEQ ID NO: 29874 - RNA, 23 nt, Artificial Sequence
  Synthetic Oligonucleotide; PRDM1 exon 5; Set A
aggccauuacaauucaugccgua

SEQ ID NO: 29875 - RNA, 32 nt, Artificial Sequence
  Synthetic Oligonucleotide; PRDM1 exon 5; Set C
augcugcucacagcgcucaggccauuacaauu

SEQ ID NO: 29876 - RNA, 31 nt, Artificial Sequence
  Synthetic Oligonucleotide; PRDM1 exon 5; Set C
augcugcucacagcgcucaggccauuacaau

SEQ ID NO: 29877 - RNA, 33 nt, Artificial Sequence
  Synthetic Oligonucleotide; PRDM1 exon 5; Set C
caugcugcucacagcgcucaggccauuacaauu

SEQ ID NO: 29878 - RNA, 30 nt, Artificial Sequence
  Synthetic Oligonucleotide; PRDM1 exon 5; Set C
augcugcucacagcgcucaggccauuacaa

SEQ ID NO: 29879 - RNA, 32 nt, Artificial Sequence
  Synthetic Oligonucleotide; PRDM1 exon 5; Set C
caugcugcucacagcgcucaggccauuacaau

SEQ ID NO: 29880 - RNA, 34 nt, Artificial Sequence
  Synthetic Oligonucleotide; PRDM1 exon 5; Set C
ucaugcugcucacagcgcucaggccauuacaauu

SEQ ID NO: 29881 - RNA, 31 nt, Artificial Sequence
  Synthetic Oligonucleotide; PRDM1 exon 5; Set C
caugcugcucacagcgcucaggccauuacaa

SEQ ID NO: 29882 - RNA, 33 nt, Artificial Sequence
  Synthetic Oligonucleotide; PRDM1 exon 5; Set C
ucaugcugcucacagcgcucaggccauuacaau

SEQ ID NO: 29883 - RNA, 35 nt, Artificial Sequence
  Synthetic Oligonucleotide; PRDM1 exon 5; Set C
uucaugcugcucacagcgcucaggccauuacaauu

SEQ ID NO: 29884 - RNA, 28 nt, Artificial Sequence
  Synthetic Oligonucleotide; PRDM1 exon 5; Set C
augcugcucacagcgcucaggccauuac

SEQ ID NO: 29885 - RNA, 32 nt, Artificial Sequence
  Synthetic Oligonucleotide; PRDM1 exon 5; Set C
ucaugcugcucacagcgcucaggccauuacaa

SEQ ID NO: 29886 - RNA, 30 nt, Artificial Sequence
  Synthetic Oligonucleotide; PRDM1 exon 5; Set C
caugcugcucacagcgcucaggccauuaca

SEQ ID NO: 29887 - RNA, 34 nt, Artificial Sequence
  Synthetic Oligonucleotide; PRDM1 exon 5; Set C
uucaugcugcucacagcgcucaggccauuacaau

SEQ ID NO: 29888 - RNA, 36 nt, Artificial Sequence
  Synthetic Oligonucleotide; PRDM1 exon 5; Set C
auucaugcugcucacagcgcucaggccauuacaauu

SEQ ID NO: 29889 - RNA, 27 nt, Artificial Sequence
  Synthetic Oligonucleotide; PRDM1 exon 5; Set C
augcugcucacagcgcucaggccauua

SEQ ID NO: 29890 - RNA, 29 nt, Artificial Sequence
  Synthetic Oligonucleotide; PRDM1 exon 5; Set C
caugcugcucacagcgcucaggccauuac

SEQ ID NO: 29891 - RNA, 33 nt, Artificial Sequence
  Synthetic Oligonucleotide; PRDM1 exon 5; Set C
uucaugcugcucacagcgcucaggccauuacaa

SEQ ID NO: 29892 - RNA, 31 nt, Artificial Sequence
  Synthetic Oligonucleotide; PRDM1 exon 5; Set C
ucaugcugcucacagcgcucaggccauuaca

SEQ ID NO: 29893 - RNA, 35 nt, Artificial Sequence
  Synthetic Oligonucleotide; PRDM1 exon 5; Set C
auucaugcugcucacagcgcucaggccauuacaau

SEQ ID NO: 29894 - RNA, 28 nt, Artificial Sequence
  Synthetic Oligonucleotide; PRDM1 exon 5; Set C
caugcugcucacagcgcucaggccauua

SEQ ID NO: 29895 - RNA, 30 nt, Artificial Sequence
  Synthetic Oligonucleotide; PRDM1 exon 5; Set C
ucaugcugcucacagcgcucaggccauuac

SEQ ID NO: 29896 - RNA, 34 nt, Artificial Sequence
  Synthetic Oligonucleotide; PRDM1 exon 5; Set C
auucaugcugcucacagcgcucaggccauuacaa

SEQ ID NO: 29897 - RNA, 32 nt, Artificial Sequence
  Synthetic Oligonucleotide; PRDM1 exon 5; Set C
uucaugcugcucacagcgcucaggccauuaca

SEQ ID NO: 29898 - RNA, 29 nt, Artificial Sequence
  Synthetic Oligonucleotide; PRDM1 exon 5; Set C
ucaugcugcucacagcgcucaggccauua

SEQ ID NO: 29899 - RNA, 31 nt, Artificial Sequence
  Synthetic Oligonucleotide; PRDM1 exon 5; Set C
uucaugcugcucacagcgcucaggccauuac

SEQ ID NO: 29900 - RNA, 27 nt, Artificial Sequence
  Synthetic Oligonucleotide; PRDM1 exon 5; Set C
caugcugcucacagcgcucaggccauu

SEQ ID NO: 29901 - RNA, 33 nt, Artificial Sequence
  Synthetic Oligonucleotide; PRDM1 exon 5; Set C
auucaugcugcucacagcgcucaggccauuaca

SEQ ID NO: 29902 - RNA, 30 nt, Artificial Sequence
  Synthetic Oligonucleotide; PRDM1 exon 5; Set C
uucaugcugcucacagcgcucaggccauua

SEQ ID NO: 29903 - RNA, 32 nt, Artificial Sequence
  Synthetic Oligonucleotide; PRDM1 exon 5; Set C
auucaugcugcucacagcgcucaggccauuac

SEQ ID NO: 29904 - RNA, 28 nt, Artificial Sequence
  Synthetic Oligonucleotide; PRDM1 exon 5; Set C
ucaugcugcucacagcgcucaggccauu

SEQ ID NO: 29905 - RNA, 31 nt, Artificial Sequence
  Synthetic Oligonucleotide; PRDM1 exon 5; Set C
auucaugcugcucacagcgcucaggccauua

SEQ ID NO: 29906 - RNA, 29 nt, Artificial Sequence
  Synthetic Oligonucleotide; PRDM1 exon 5; Set C
uucaugcugcucacagcgcucaggccauu

SEQ ID NO: 29907 - RNA, 30 nt, Artificial Sequence
  Synthetic Oligonucleotide; PRDM1 exon 5; Set C
auucaugcugcucacagcgcucaggccauu

SEQ ID NO: 29908 - RNA, 40 nt, Artificial Sequence
  Synthetic Oligonucleotide; PRDM1 exon 5; Set C
uugaugccauucaugcugcucacagcgcucaggccauuac

SEQ ID NO: 29909 - RNA, 39 nt, Artificial Sequence
  Synthetic Oligonucleotide; PRDM1 exon 5; Set C
uugaugccauucaugcugcucacagcgcucaggccauua

SEQ ID NO: 29910 - RNA, 40 nt, Artificial Sequence
  Synthetic Oligonucleotide; PRDM1 exon 5; Set C
guugaugccauucaugcugcucacagcgcucaggccauua

SEQ ID NO: 29911 - RNA, 38 nt, Artificial Sequence
  Synthetic Oligonucleotide; PRDM1 exon 5; Set C
uugaugccauucaugcugcucacagcgcucaggccauu

SEQ ID NO: 29912 - RNA, 39 nt, Artificial Sequence
  Synthetic Oligonucleotide; PRDM1 exon 5; Set C
guugaugccauucaugcugcucacagcgcucaggccauu

SEQ ID NO: 29913 - RNA, 40 nt, Artificial Sequence
  Synthetic Oligonucleotide; PRDM1 exon 5; Set C
uguugaugccauucaugcugcucacagcgcucaggccauu

SEQ ID NO: 29914 - RNA, 36 nt, Artificial Sequence
  Synthetic Oligonucleotide; PRDM1 exon 5; Set C
uuguugaugccauucaugcugcucacagcgcucagg

SEQ ID NO: 29915 - RNA, 37 nt, Artificial Sequence
  Synthetic Oligonucleotide; PRDM1 exon 5; Set C
guuguugaugccauucaugcugcucacagcgcucagg

SEQ ID NO: 29916 - RNA, 38 nt, Artificial Sequence
  Synthetic Oligonucleotide; PRDM1 exon 5; Set C
aguuguugaugccauucaugcugcucacagcgcucagg

SEQ ID NO: 29917 - RNA, 39 nt, Artificial Sequence
  Synthetic Oligonucleotide; PRDM1 exon 5; Set C
aaguuguugaugccauucaugcugcucacagcgcucagg

SEQ ID NO: 29918 - RNA, 40 nt, Artificial Sequence
  Synthetic Oligonucleotide; PRDM1 exon 5; Set C
aaaguuguugaugccauucaugcugcucacagcgcucagg

SEQ ID NO: 29919 - RNA, 15 nt, Artificial Sequence
  Synthetic Oligonucleotide; PRDM1 exon 5; Set C
uugaugccauucaug

SEQ ID NO: 29920 - RNA, 15 nt, Artificial Sequence
  Synthetic Oligonucleotide; PRDM1 exon 5; Set C
guugaugccauucau

SEQ ID NO: 29921 - RNA, 15 nt, Artificial Sequence
  Synthetic Oligonucleotide; PRDM1 exon 5; Set C
uguugaugccauuca

SEQ ID NO: 29922 - RNA, 15 nt, Artificial Sequence
  Synthetic Oligonucleotide; PRDM1 exon 5; Set C
uuguugaugccauuc

SEQ ID NO: 29923 - RNA, 15 nt, Artificial Sequence
  Synthetic Oligonucleotide; PRDM1 exon 5; Set C
guuguugaugccauu

SEQ ID NO: 29924 - RNA, 31 nt, Artificial Sequence
  Synthetic Oligonucleotide; PRDM1 exon 5; Set A
gaagaggccaaaguuguugaugccauucaug

SEQ ID NO: 29925 - RNA, 30 nt, Artificial Sequence
  Synthetic Oligonucleotide; PRDM1 exon 5; Set A
gaagaggccaaaguuguugaugccauucau

SEQ ID NO: 29926 - RNA, 32 nt, Artificial Sequence
  Synthetic Oligonucleotide; PRDM1 exon 5; Set A
ggaagaggccaaaguuguugaugccauucaug

SEQ ID NO: 29927 - RNA, 31 nt, Artificial Sequence
  Synthetic Oligonucleotide; PRDM1 exon 5; Set A
ggaagaggccaaaguuguugaugccauucau

SEQ ID NO: 29928 - RNA, 33 nt, Artificial Sequence
  Synthetic Oligonucleotide; PRDM1 exon 5; Set C
gggaagaggccaaaguuguugaugccauucaug

SEQ ID NO: 29929 - RNA, 29 nt, Artificial Sequence
  Synthetic Oligonucleotide; PRDM1 exon 5; Set A
gaagaggccaaaguuguugaugccauuca

SEQ ID NO: 29930 - RNA, 32 nt, Artificial Sequence
  Synthetic Oligonucleotide; PRDM1 exon 5; Set C
gggaagaggccaaaguuguugaugccauucau

SEQ ID NO: 29931 - RNA, 30 nt, Artificial Sequence
  Synthetic Oligonucleotide; PRDM1 exon 5; Set A
ggaagaggccaaaguuguugaugccauuca

SEQ ID NO: 29932 - RNA, 28 nt, Artificial Sequence
  Synthetic Oligonucleotide; PRDM1 exon 5; Set A
gaagaggccaaaguuguugaugccauuc

SEQ ID NO: 29933 - RNA, 27 nt, Artificial Sequence
  Synthetic Oligonucleotide; PRDM1 exon 5; Set A
gaagaggccaaaguuguugaugccauu

SEQ ID NO: 29934 - RNA, 31 nt, Artificial Sequence
  Synthetic Oligonucleotide; PRDM1 exon 5; Set C
gggaagaggccaaaguuguugaugccauuca

SEQ ID NO: 29935 - RNA, 29 nt, Artificial Sequence
  Synthetic Oligonucleotide; PRDM1 exon 5; Set A
ggaagaggccaaaguuguugaugccauuc

SEQ ID NO: 29936 - RNA, 28 nt, Artificial Sequence
  Synthetic Oligonucleotide; PRDM1 exon 5; Set A
ggaagaggccaaaguuguugaugccauu

SEQ ID NO: 29937 - RNA, 30 nt, Artificial Sequence
  Synthetic Oligonucleotide; PRDM1 exon 5; Set A
gggaagaggccaaaguuguugaugccauuc

SEQ ID NO: 29938 - RNA, 29 nt, Artificial Sequence
  Synthetic Oligonucleotide; PRDM1 exon 5; Set A
gggaagaggccaaaguuguugaugccauu

SEQ ID NO: 29939 - RNA, 19 nt, Artificial Sequence
  Synthetic Oligonucleotide; PRDM1 exon 5; Set C
gaagaggccaaaguuguug

SEQ ID NO: 29940 - RNA, 18 nt, Artificial Sequence
  Synthetic Oligonucleotide; PRDM1 exon 5; Set C
gaagaggccaaaguuguu

SEQ ID NO: 29941 - RNA, 20 nt, Artificial Sequence
  Synthetic Oligonucleotide; PRDM1 exon 5; Set C
ggaagaggccaaaguuguug

SEQ ID NO: 29942 - RNA, 19 nt, Artificial Sequence
  Synthetic Oligonucleotide; PRDM1 exon 5; Set C
ggaagaggccaaaguuguu

SEQ ID NO: 29943 - RNA, 17 nt, Artificial Sequence
  Synthetic Oligonucleotide; PRDM1 exon 5; Set C
gaagaggccaaaguugu

SEQ ID NO: 29944 - RNA, 20 nt, Artificial Sequence
  Synthetic Oligonucleotide; PRDM1 exon 5; Set C
gggaagaggccaaaguuguu

SEQ ID NO: 29945 - RNA, 18 nt, Artificial Sequence
  Synthetic Oligonucleotide; PRDM1 exon 5; Set C
ggaagaggccaaaguugu

SEQ ID NO: 29946 - RNA, 16 nt, Artificial Sequence
  Synthetic Oligonucleotide; PRDM1 exon 5; Set C
gaagaggccaaaguug

SEQ ID NO: 29947 - RNA, 19 nt, Artificial Sequence
  Synthetic Oligonucleotide; PRDM1 exon 5; Set C
gggaagaggccaaaguugu

SEQ ID NO: 29948 - RNA, 17 nt, Artificial Sequence
  Synthetic Oligonucleotide; PRDM1 exon 5; Set C
ggaagaggccaaaguug

SEQ ID NO: 29949 - RNA, 15 nt, Artificial Sequence
  Synthetic Oligonucleotide; PRDM1 exon 5; Set C
gaagaggccaaaguu

SEQ ID NO: 29950 - RNA, 18 nt, Artificial Sequence
  Synthetic Oligonucleotide; PRDM1 exon 5; Set C
gggaagaggccaaaguug

SEQ ID NO: 29951 - RNA, 16 nt, Artificial Sequence
  Synthetic Oligonucleotide; PRDM1 exon 5; Set C
ggaagaggccaaaguu

SEQ ID NO: 29952 - RNA, 15 nt, Artificial Sequence
  Synthetic Oligonucleotide; PRDM1 exon 5; Set C
ggaagaggccaaagu

SEQ ID NO: 29953 - RNA, 17 nt, Artificial Sequence
  Synthetic Oligonucleotide; PRDM1 exon 5; Set C
gggaagaggccaaaguu

SEQ ID NO: 29954 - RNA, 16 nt, Artificial Sequence
  Synthetic Oligonucleotide; PRDM1 exon 5; Set C
gggaagaggccaaagu

SEQ ID NO: 29955 - RNA, 15 nt, Artificial Sequence
  Synthetic Oligonucleotide; PRDM1 exon 5; Set C
gggaagaggccaaag

SEQ ID NO: 29956 - RNA, 30 nt, Artificial Sequence
  Synthetic Oligonucleotide; PRDM1 exon 5; Set C
auugcuguagacagggcacagccucgggaa

SEQ ID NO: 29957 - RNA, 29 nt, Artificial Sequence
  Synthetic Oligonucleotide; PRDM1 exon 5; Set C
auugcuguagacagggcacagccucggga

SEQ ID NO: 29958 - RNA, 31 nt, Artificial Sequence
  Synthetic Oligonucleotide; PRDM1 exon 5; Set C
gauugcuguagacagggcacagccucgggaa

SEQ ID NO: 29959 - RNA, 28 nt, Artificial Sequence
  Synthetic Oligonucleotide; PRDM1 exon 5; Set C
auugcuguagacagggcacagccucggg

SEQ ID NO: 29960 - RNA, 30 nt, Artificial Sequence
  Synthetic Oligonucleotide; PRDM1 exon 5; Set C
gauugcuguagacagggcacagccucggga

SEQ ID NO: 29961 - RNA, 32 nt, Artificial Sequence
  Synthetic Oligonucleotide; PRDM1 exon 5; Set C
agauugcuguagacagggcacagccucgggaa

SEQ ID NO: 29962 - RNA, 29 nt, Artificial Sequence
  Synthetic Oligonucleotide; PRDM1 exon 5; Set C
gauugcuguagacagggcacagccucggg

SEQ ID NO: 29963 - RNA, 31 nt, Artificial Sequence
  Synthetic Oligonucleotide; PRDM1 exon 5; Set C
agauugcuguagacagggcacagccucggga

SEQ ID NO: 29964 - RNA, 33 nt, Artificial Sequence
  Synthetic Oligonucleotide; PRDM1 exon 5; Set C
gagauugcuguagacagggcacagccucgggaa

SEQ ID NO: 29965 - RNA, 30 nt, Artificial Sequence
  Synthetic Oligonucleotide; PRDM1 exon 5; Set C
agauugcuguagacagggcacagccucggg

SEQ ID NO: 29966 - RNA, 34 nt, Artificial Sequence
  Synthetic Oligonucleotide; PRDM1 exon 5; Set C
ggagauugcuguagacagggcacagccucgggaa

SEQ ID NO: 29967 - RNA, 32 nt, Artificial Sequence
  Synthetic Oligonucleotide; PRDM1 exon 5; Set C
gagauugcuguagacagggcacagccucggga

SEQ ID NO: 29968 - RNA, 35 nt, Artificial Sequence
  Synthetic Oligonucleotide; PRDM1 exon 5; Set C
aggagauugcuguagacagggcacagccucgggaa

SEQ ID NO: 29969 - RNA, 33 nt, Artificial Sequence
  Synthetic Oligonucleotide; PRDM1 exon 5; Set C
ggagauugcuguagacagggcacagccucggga

SEQ ID NO: 29970 - RNA, 31 nt, Artificial Sequence
  Synthetic Oligonucleotide; PRDM1 exon 5; Set C
gagauugcuguagacagggcacagccucggg

SEQ ID NO: 29971 - RNA, 36 nt, Artificial Sequence
  Synthetic Oligonucleotide; PRDM1 exon 5; Set C
gaggagauugcuguagacagggcacagccucgggaa

SEQ ID NO: 29972 - RNA, 34 nt, Artificial Sequence
  Synthetic Oligonucleotide; PRDM1 exon 5; Set C
aggagauugcuguagacagggcacagccucggga

SEQ ID NO: 29973 - RNA, 32 nt, Artificial Sequence
  Synthetic Oligonucleotide; PRDM1 exon 5; Set C
ggagauugcuguagacagggcacagccucggg

SEQ ID NO: 29974 - RNA, 35 nt, Artificial Sequence
  Synthetic Oligonucleotide; PRDM1 exon 5; Set C
gaggagauugcuguagacagggcacagccucggga

SEQ ID NO: 29975 - RNA, 33 nt, Artificial Sequence
  Synthetic Oligonucleotide; PRDM1 exon 5; Set C
aggagauugcuguagacagggcacagccucggg

SEQ ID NO: 29976 - RNA, 34 nt, Artificial Sequence
  Synthetic Oligonucleotide; PRDM1 exon 5; Set C
gaggagauugcuguagacagggcacagccucggg

SEQ ID NO: 29977 - RNA, 19 nt, Artificial Sequence
  Synthetic Oligonucleotide; PRDM1 exon 5; Set A
ugcccccaccgaggagauu

SEQ ID NO: 29978 - RNA, 20 nt, Artificial Sequence
  Synthetic Oligonucleotide; PRDM1 exon 5; Set C
cugcccccaccgaggagauu

SEQ ID NO: 29979 - RNA, 18 nt, Artificial Sequence
  Synthetic Oligonucleotide; PRDM1 exon 5; Set A
ugcccccaccgaggagau

SEQ ID NO: 29980 - RNA, 21 nt, Artificial Sequence
  Synthetic Oligonucleotide; PRDM1 exon 5; Set C
gcugcccccaccgaggagauu

SEQ ID NO: 29981 - RNA, 19 nt, Artificial Sequence
  Synthetic Oligonucleotide; PRDM1 exon 5; Set A
cugcccccaccgaggagau

SEQ ID NO: 29982 - RNA, 22 nt, Artificial Sequence
  Synthetic Oligonucleotide; PRDM1 exon 5; Set C
ggcugcccccaccgaggagauu

SEQ ID NO: 29983 - RNA, 20 nt, Artificial Sequence
  Synthetic Oligonucleotide; PRDM1 exon 5; Set C
gcugcccccaccgaggagau

SEQ ID NO: 29984 - RNA, 18 nt, Artificial Sequence
  Synthetic Oligonucleotide; PRDM1 exon 5; Set C
cugcccccaccgaggaga

SEQ ID NO: 29985 - RNA, 23 nt, Artificial Sequence
  Synthetic Oligonucleotide; PRDM1 exon 5; Set C
aggcugcccccaccgaggagauu

SEQ ID NO: 29986 - RNA, 21 nt, Artificial Sequence
  Synthetic Oligonucleotide; PRDM1 exon 5; Set C
ggcugcccccaccgaggagau

SEQ ID NO: 29987 - RNA, 19 nt, Artificial Sequence
  Synthetic Oligonucleotide; PRDM1 exon 5; Set C
gcugcccccaccgaggaga

SEQ ID NO: 29988 - RNA, 24 nt, Artificial Sequence
  Synthetic Oligonucleotide; PRDM1 exon 5; Set C
caggcugcccccaccgaggagauu

SEQ ID NO: 29989 - RNA, 22 nt, Artificial Sequence
  Synthetic Oligonucleotide; PRDM1 exon 5; Set C
aggcugcccccaccgaggagau

SEQ ID NO: 29990 - RNA, 20 nt, Artificial Sequence
  Synthetic Oligonucleotide; PRDM1 exon 5; Set C
ggcugcccccaccgaggaga

SEQ ID NO: 29991 - RNA, 18 nt, Artificial Sequence
  Synthetic Oligonucleotide; PRDM1 exon 5; Set C
gcugcccccaccgaggag

SEQ ID NO: 29992 - RNA, 23 nt, Artificial Sequence
  Synthetic Oligonucleotide; PRDM1 exon 5; Set C
caggcugcccccaccgaggagau

SEQ ID NO: 29993 - RNA, 21 nt, Artificial Sequence
  Synthetic Oligonucleotide; PRDM1 exon 5; Set C
aggcugcccccaccgaggaga

SEQ ID NO: 29994 - RNA, 19 nt, Artificial Sequence
  Synthetic Oligonucleotide; PRDM1 exon 5; Set C
ggcugcccccaccgaggag

SEQ ID NO: 29995 - RNA, 22 nt, Artificial Sequence
  Synthetic Oligonucleotide; PRDM1 exon 5; Set C
caggcugcccccaccgaggaga

SEQ ID NO: 29996 - RNA, 18 nt, Artificial Sequence
  Synthetic Oligonucleotide; PRDM1 exon 5; Set C
ggcugcccccaccgagga

SEQ ID NO: 29997 - RNA, 20 nt, Artificial Sequence
  Synthetic Oligonucleotide; PRDM1 exon 5; Set C
aggcugcccccaccgaggag

SEQ ID NO: 29998 - RNA, 19 nt, Artificial Sequence
  Synthetic Oligonucleotide; PRDM1 exon 5; Set C
aggcugcccccaccgagga

SEQ ID NO: 29999 - RNA, 21 nt, Artificial Sequence
  Synthetic Oligonucleotide; PRDM1 exon 5; Set C
caggcugcccccaccgaggag

SEQ ID NO: 30000 - RNA, 18 nt, Artificial Sequence
  Synthetic Oligonucleotide; PRDM1 exon 5; Set C
aggcugcccccaccgagg

SEQ ID NO: 30001 - RNA, 20 nt, Artificial Sequence
  Synthetic Oligonucleotide; PRDM1 exon 5; Set C
caggcugcccccaccgagga

SEQ ID NO: 30002 - RNA, 17 nt, Artificial Sequence
  Synthetic Oligonucleotide; PRDM1 exon 5; Set A
aggcugcccccaccgag

SEQ ID NO: 30003 - RNA, 19 nt, Artificial Sequence
  Synthetic Oligonucleotide; PRDM1 exon 5; Set C
caggcugcccccaccgagg

SEQ ID NO: 30004 - RNA, 18 nt, Artificial Sequence
  Synthetic Oligonucleotide; PRDM1 exon 5; Set C
caggcugcccccaccgag

SEQ ID NO: 30005 - RNA, 33 nt, Artificial Sequence
  Synthetic Oligonucleotide; PRDM1 exon 5; Set C
gggguggggcaggcugcccccaccgaggagauu

SEQ ID NO: 30006 - RNA, 34 nt, Artificial Sequence
  Synthetic Oligonucleotide; PRDM1 exon 5; Set C
ugggguggggcaggcugcccccaccgaggagauu

SEQ ID NO: 30007 - RNA, 32 nt, Artificial Sequence
  Synthetic Oligonucleotide; PRDM1 exon 5; Set C
gggguggggcaggcugcccccaccgaggagau

SEQ ID NO: 30008 - RNA, 35 nt, Artificial Sequence
  Synthetic Oligonucleotide; PRDM1 exon 5; Set C
augggguggggcaggcugcccccaccgaggagauu

SEQ ID NO: 30009 - RNA, 33 nt, Artificial Sequence
  Synthetic Oligonucleotide; PRDM1 exon 5; Set C
ugggguggggcaggcugcccccaccgaggagau

SEQ ID NO: 30010 - RNA, 34 nt, Artificial Sequence
  Synthetic Oligonucleotide; PRDM1 exon 5; Set C
augggguggggcaggcugcccccaccgaggagau

SEQ ID NO: 30011 - RNA, 32 nt, Artificial Sequence
  Synthetic Oligonucleotide; PRDM1 exon 5; Set C
ugggguggggcaggcugcccccaccgaggaga

SEQ ID NO: 30012 - RNA, 33 nt, Artificial Sequence
  Synthetic Oligonucleotide; PRDM1 exon 5; Set C
augggguggggcaggcugcccccaccgaggaga

SEQ ID NO: 30013 - RNA, 31 nt, Artificial Sequence
  Synthetic Oligonucleotide; PRDM1 exon 5; Set C
ugggguggggcaggcugcccccaccgaggag

SEQ ID NO: 30014 - RNA, 30 nt, Artificial Sequence
  Synthetic Oligonucleotide; PRDM1 exon 5; Set C
ugggguggggcaggcugcccccaccgagga

SEQ ID NO: 30015 - RNA, 32 nt, Artificial Sequence
  Synthetic Oligonucleotide; PRDM1 exon 5; Set C
augggguggggcaggcugcccccaccgaggag

SEQ ID NO: 30016 - RNA, 29 nt, Artificial Sequence
  Synthetic Oligonucleotide; PRDM1 exon 5; Set C
ugggguggggcaggcugcccccaccgagg

SEQ ID NO: 30017 - RNA, 31 nt, Artificial Sequence
  Synthetic Oligonucleotide; PRDM1 exon 5; Set C
augggguggggcaggcugcccccaccgagga

SEQ ID NO: 30018 - RNA, 28 nt, Artificial Sequence
  Synthetic Oligonucleotide; PRDM1 exon 5; Set C
ugggguggggcaggcugcccccaccgag

SEQ ID NO: 30019 - RNA, 30 nt, Artificial Sequence
  Synthetic Oligonucleotide; PRDM1 exon 5; Set C
augggguggggcaggcugcccccaccgagg

SEQ ID NO: 30020 - RNA, 29 nt, Artificial Sequence
  Synthetic Oligonucleotide; PRDM1 exon 5; Set C
augggguggggcaggcugcccccaccgag

SEQ ID NO: 30021 - RNA, 40 nt, Artificial Sequence
  Synthetic Oligonucleotide; PRDM1 exon 5; Set C
guugagcaugggguggggcaggcugcccccaccgaggaga

SEQ ID NO: 30022 - RNA, 39 nt, Artificial Sequence
  Synthetic Oligonucleotide; PRDM1 exon 5; Set C
guugagcaugggguggggcaggcugcccccaccgaggag

SEQ ID NO: 30023 - RNA, 38 nt, Artificial Sequence
  Synthetic Oligonucleotide; PRDM1 exon 5; Set C
guugagcaugggguggggcaggcugcccccaccgagga

SEQ ID NO: 30024 - RNA, 40 nt, Artificial Sequence
  Synthetic Oligonucleotide; PRDM1 exon 5; Set C
gguugagcaugggguggggcaggcugcccccaccgaggag

SEQ ID NO: 30025 - RNA, 39 nt, Artificial Sequence
  Synthetic Oligonucleotide; PRDM1 exon 5; Set C
gguugagcaugggguggggcaggcugcccccaccgagga

SEQ ID NO: 30026 - RNA, 37 nt, Artificial Sequence
  Synthetic Oligonucleotide; PRDM1 exon 5; Set C
guugagcaugggguggggcaggcugcccccaccgagg

SEQ ID NO: 30027 - RNA, 36 nt, Artificial Sequence
  Synthetic Oligonucleotide; PRDM1 exon 5; Set C
guugagcaugggguggggcaggcugcccccaccgag

SEQ ID NO: 30028 - RNA, 38 nt, Artificial Sequence
  Synthetic Oligonucleotide; PRDM1 exon 5; Set C
gguugagcaugggguggggcaggcugcccccaccgagg

SEQ ID NO: 30029 - RNA, 40 nt, Artificial Sequence
  Synthetic Oligonucleotide; PRDM1 exon 5; Set C
ggguugagcaugggguggggcaggcugcccccaccgagga

SEQ ID NO: 30030 - RNA, 37 nt, Artificial Sequence
  Synthetic Oligonucleotide; PRDM1 exon 5; Set C
gguugagcaugggguggggcaggcugcccccaccgag

SEQ ID NO: 30031 - RNA, 17 nt, Artificial Sequence
  Synthetic Oligonucleotide; PRDM1 exon 5; Set C
gggguggggcaggcugc

SEQ ID NO: 30032 - RNA, 39 nt, Artificial Sequence
  Synthetic Oligonucleotide; PRDM1 exon 5; Set C
ggguugagcaugggguggggcaggcugcccccaccgagg

SEQ ID NO: 30033 - RNA, 16 nt, Artificial Sequence
  Synthetic Oligonucleotide; PRDM1 exon 5; Set A
gggguggggcaggcug

SEQ ID NO: 30034 - RNA, 38 nt, Artificial Sequence
  Synthetic Oligonucleotide; PRDM1 exon 5; Set C
ggguugagcaugggguggggcaggcugcccccaccgag

SEQ ID NO: 30035 - RNA, 40 nt, Artificial Sequence
  Synthetic Oligonucleotide; PRDM1 exon 5; Set C
gggguugagcaugggguggggcaggcugcccccaccgagg

SEQ ID NO: 30036 - RNA, 15 nt, Artificial Sequence
  Synthetic Oligonucleotide; PRDM1 exon 5; Set A
gggguggggcaggcu

SEQ ID NO: 30037 - RNA, 39 nt, Artificial Sequence
  Synthetic Oligonucleotide; PRDM1 exon 5; Set C
gggguugagcaugggguggggcaggcugcccccaccgag

SEQ ID NO: 30038 - RNA, 16 nt, Artificial Sequence
  Synthetic Oligonucleotide; PRDM1 exon 5; Set A
ugggguggggcaggcu

SEQ ID NO: 30039 - RNA, 40 nt, Artificial Sequence
  Synthetic Oligonucleotide; PRDM1 exon 5; Set C
ugggguugagcaugggguggggcaggcugcccccaccgag

SEQ ID NO: 30040 - RNA, 15 nt, Artificial Sequence
  Synthetic Oligonucleotide; PRDM1 exon 5; Set A
ugggguggggcaggc

SEQ ID NO: 30041 - RNA, 16 nt, Artificial Sequence
  Synthetic Oligonucleotide; PRDM1 exon 5; Set A
augggguggggcaggc

SEQ ID NO: 30042 - RNA, 15 nt, Artificial Sequence
  Synthetic Oligonucleotide; PRDM1 exon 5; Set A
augggguggggcagg

SEQ ID NO: 30043 - RNA, 26 nt, Artificial Sequence
  Synthetic Oligonucleotide; PRDM1 exon 5; Set C
guugagcaugggguggggcaggcugc

SEQ ID NO: 30044 - RNA, 25 nt, Artificial Sequence
  Synthetic Oligonucleotide; PRDM1 exon 5; Set C
guugagcaugggguggggcaggcug

SEQ ID NO: 30045 - RNA, 24 nt, Artificial Sequence
  Synthetic Oligonucleotide; PRDM1 exon 5; Set C
guugagcaugggguggggcaggcu

SEQ ID NO: 30046 - RNA, 26 nt, Artificial Sequence
  Synthetic Oligonucleotide; PRDM1 exon 5; Set C
gguugagcaugggguggggcaggcug

SEQ ID NO: 30047 - RNA, 25 nt, Artificial Sequence
  Synthetic Oligonucleotide; PRDM1 exon 5; Set C
gguugagcaugggguggggcaggcu

SEQ ID NO: 30048 - RNA, 23 nt, Artificial Sequence
  Synthetic Oligonucleotide; PRDM1 exon 5; Set C
guugagcaugggguggggcaggc

SEQ ID NO: 30049 - RNA, 27 nt, Artificial Sequence
  Synthetic Oligonucleotide; PRDM1 exon 5; Set C
ggguugagcaugggguggggcaggcug

SEQ ID NO: 30050 - RNA, 26 nt, Artificial Sequence
  Synthetic Oligonucleotide; PRDM1 exon 5; Set C
ggguugagcaugggguggggcaggcu

SEQ ID NO: 30051 - RNA, 24 nt, Artificial Sequence
  Synthetic Oligonucleotide; PRDM1 exon 5; Set C
gguugagcaugggguggggcaggc

SEQ ID NO: 30052 - RNA, 22 nt, Artificial Sequence
  Synthetic Oligonucleotide; PRDM1 exon 5; Set C
guugagcaugggguggggcagg

SEQ ID NO: 30053 - RNA, 27 nt, Artificial Sequence
  Synthetic Oligonucleotide; PRDM1 exon 5; Set C
gggguugagcaugggguggggcaggcu

SEQ ID NO: 30054 - RNA, 23 nt, Artificial Sequence
  Synthetic Oligonucleotide; PRDM1 exon 5; Set C
gguugagcaugggguggggcagg

SEQ ID NO: 30055 - RNA, 25 nt, Artificial Sequence
  Synthetic Oligonucleotide; PRDM1 exon 5; Set C
ggguugagcaugggguggggcaggc

SEQ ID NO: 30056 - RNA, 21 nt, Artificial Sequence
  Synthetic Oligonucleotide; PRDM1 exon 5; Set C
guugagcaugggguggggcag

SEQ ID NO: 30057 - RNA, 24 nt, Artificial Sequence
  Synthetic Oligonucleotide; PRDM1 exon 5; Set C
ggguugagcaugggguggggcagg

SEQ ID NO: 30058 - RNA, 26 nt, Artificial Sequence
  Synthetic Oligonucleotide; PRDM1 exon 5; Set C
gggguugagcaugggguggggcaggc

SEQ ID NO: 30059 - RNA, 22 nt, Artificial Sequence
  Synthetic Oligonucleotide; PRDM1 exon 5; Set C
gguugagcaugggguggggcag

SEQ ID NO: 30060 - RNA, 25 nt, Artificial Sequence
  Synthetic Oligonucleotide; PRDM1 exon 5; Set C
gggguugagcaugggguggggcagg

SEQ ID NO: 30061 - RNA, 27 nt, Artificial Sequence
  Synthetic Oligonucleotide; PRDM1 exon 5; Set C
ugggguugagcaugggguggggcaggc

SEQ ID NO: 30062 - RNA, 23 nt, Artificial Sequence
  Synthetic Oligonucleotide; PRDM1 exon 5; Set C
ggguugagcaugggguggggcag

SEQ ID NO: 30063 - RNA, 26 nt, Artificial Sequence
  Synthetic Oligonucleotide; PRDM1 exon 5; Set C
ugggguugagcaugggguggggcagg

SEQ ID NO: 30064 - RNA, 28 nt, Artificial Sequence
  Synthetic Oligonucleotide; PRDM1 exon 5; Set C
gugggguugagcaugggguggggcaggc

SEQ ID NO: 30065 - RNA, 24 nt, Artificial Sequence
  Synthetic Oligonucleotide; PRDM1 exon 5; Set C
gggguugagcaugggguggggcag

SEQ ID NO: 30066 - RNA, 27 nt, Artificial Sequence
  Synthetic Oligonucleotide; PRDM1 exon 5; Set C
gugggguugagcaugggguggggcagg

SEQ ID NO: 30067 - RNA, 29 nt, Artificial Sequence
  Synthetic Oligonucleotide; PRDM1 exon 5; Set C
agugggguugagcaugggguggggcaggc

SEQ ID NO: 30068 - RNA, 25 nt, Artificial Sequence
  Synthetic Oligonucleotide; PRDM1 exon 5; Set C
ugggguugagcaugggguggggcag

SEQ ID NO: 30069 - RNA, 28 nt, Artificial Sequence
  Synthetic Oligonucleotide; PRDM1 exon 5; Set C
agugggguugagcaugggguggggcagg

SEQ ID NO: 30070 - RNA, 26 nt, Artificial Sequence
  Synthetic Oligonucleotide; PRDM1 exon 5; Set C
gugggguugagcaugggguggggcag

SEQ ID NO: 30071 - RNA, 27 nt, Artificial Sequence
  Synthetic Oligonucleotide; PRDM1 exon 5; Set C
agugggguugagcaugggguggggcag

SEQ ID NO: 30072 - RNA, 28 nt, Artificial Sequence
  Synthetic Oligonucleotide; PRDM1 exon 5; Set C
aagugggguugagcaugggguggggcag

SEQ ID NO: 30073 - RNA, 15 nt, Artificial Sequence
  Synthetic Oligonucleotide; PRDM1 exon 5; Set C
agagaagugggguug

SEQ ID NO: 30074 - RNA, 16 nt, Artificial Sequence
  Synthetic Oligonucleotide; PRDM1 exon 5; Set C
gagagaagugggguug

SEQ ID NO: 30075 - RNA, 17 nt, Artificial Sequence
  Synthetic Oligonucleotide; PRDM1 exon 5; Set C
ggagagaagugggguug

SEQ ID NO: 30076 - RNA, 18 nt, Artificial Sequence
  Synthetic Oligonucleotide; PRDM1 exon 5; Set C
gggagagaagugggguug

SEQ ID NO: 30077 - RNA, 25 nt, Artificial Sequence
  Synthetic Oligonucleotide; PRDM1 exon 5; Set C
cgagcucgggagagaagugggguug

SEQ ID NO: 30078 - RNA, 18 nt, Artificial Sequence
  Synthetic Oligonucleotide; PRDM1 exon 5; Set C
agggcagcgagcucggga

SEQ ID NO: 30079 - RNA, 17 nt, Artificial Sequence
  Synthetic Oligonucleotide; PRDM1 exon 5; Set A
agggcagcgagcucggg

SEQ ID NO: 30080 - RNA, 19 nt, Artificial Sequence
  Synthetic Oligonucleotide; PRDM1 exon 5; Set C
gagggcagcgagcucggga

SEQ ID NO: 30081 - RNA, 18 nt, Artificial Sequence
  Synthetic Oligonucleotide; PRDM1 exon 5; Set A
gagggcagcgagcucggg

SEQ ID NO: 30082 - RNA, 19 nt, Artificial Sequence
  Synthetic Oligonucleotide; PRDM1 exon 5; Set C
ugagggcagcgagcucggg

SEQ ID NO: 30083 - RNA, 20 nt, Artificial Sequence
  Synthetic Oligonucleotide; PRDM1 exon 5; Set C
cugagggcagcgagcucggg

SEQ ID NO: 30084 - RNA, 21 nt, Artificial Sequence
  Synthetic Oligonucleotide; PRDM1 exon 5; Set C
gggagacccgcuuguggggcu

SEQ ID NO: 30085 - RNA, 22 nt, Artificial Sequence
  Synthetic Oligonucleotide; PRDM1 exon 5; Set C
ugggagacccgcuuguggggcu

SEQ ID NO: 30086 - RNA, 16 nt, Artificial Sequence
  Synthetic Oligonucleotide; PRDM1 exon 5; Set B
gggagacccgcuugug

SEQ ID NO: 30087 - RNA, 15 nt, Artificial Sequence
  Synthetic Oligonucleotide; PRDM1 exon 5; Set C
gggagacccgcuugu

SEQ ID NO: 30088 - RNA, 17 nt, Artificial Sequence
  Synthetic Oligonucleotide; PRDM1 exon 5; Set B
ugggagacccgcuugug

SEQ ID NO: 30089 - RNA, 16 nt, Artificial Sequence
  Synthetic Oligonucleotide; PRDM1 exon 5; Set B
ugggagacccgcuugu

SEQ ID NO: 30090 - RNA, 18 nt, Artificial Sequence
  Synthetic Oligonucleotide; PRDM1 exon 5; Set B
gugggagacccgcuugug

SEQ ID NO: 30091 - RNA, 15 nt, Artificial Sequence
  Synthetic Oligonucleotide; PRDM1 exon 5; Set C
ugggagacccgcuug

SEQ ID NO: 30092 - RNA, 31 nt, Artificial Sequence
  Synthetic Oligonucleotide; PRDM1 exon 5; Set C
uucccgccgugggagacccgcuuguggggcu

SEQ ID NO: 30093 - RNA, 32 nt, Artificial Sequence
  Synthetic Oligonucleotide; PRDM1 exon 5; Set C
guucccgccgugggagacccgcuuguggggcu

SEQ ID NO: 30094 - RNA, 33 nt, Artificial Sequence
  Synthetic Oligonucleotide; PRDM1 exon 5; Set C
uguucccgccgugggagacccgcuuguggggcu

SEQ ID NO: 30095 - RNA, 34 nt, Artificial Sequence
  Synthetic Oligonucleotide; PRDM1 exon 5; Set C
cuguucccgccgugggagacccgcuuguggggcu

SEQ ID NO: 30096 - RNA, 25 nt, Artificial Sequence
  Synthetic Oligonucleotide; PRDM1 exon 5; Set C
uucccgccgugggagacccgcuugu

SEQ ID NO: 30097 - RNA, 24 nt, Artificial Sequence
  Synthetic Oligonucleotide; PRDM1 exon 5; Set C
uucccgccgugggagacccgcuug

SEQ ID NO: 30098 - RNA, 26 nt, Artificial Sequence
  Synthetic Oligonucleotide; PRDM1 exon 5; Set C
guucccgccgugggagacccgcuugu

SEQ ID NO: 30099 - RNA, 23 nt, Artificial Sequence
  Synthetic Oligonucleotide; PRDM1 exon 5; Set C
uucccgccgugggagacccgcuu

SEQ ID NO: 30100 - RNA, 25 nt, Artificial Sequence
  Synthetic Oligonucleotide; PRDM1 exon 5; Set C
guucccgccgugggagacccgcuug

SEQ ID NO: 30101 - RNA, 27 nt, Artificial Sequence
  Synthetic Oligonucleotide; PRDM1 exon 5; Set C
uguucccgccgugggagacccgcuugu

SEQ ID NO: 30102 - RNA, 24 nt, Artificial Sequence
  Synthetic Oligonucleotide; PRDM1 exon 5; Set C
guucccgccgugggagacccgcuu

SEQ ID NO: 30103 - RNA, 26 nt, Artificial Sequence
  Synthetic Oligonucleotide; PRDM1 exon 5; Set C
uguucccgccgugggagacccgcuug

SEQ ID NO: 30104 - RNA, 28 nt, Artificial Sequence
  Synthetic Oligonucleotide; PRDM1 exon 5; Set C
cuguucccgccgugggagacccgcuugu

SEQ ID NO: 30105 - RNA, 25 nt, Artificial Sequence
  Synthetic Oligonucleotide; PRDM1 exon 5; Set C
uguucccgccgugggagacccgcuu

SEQ ID NO: 30106 - RNA, 27 nt, Artificial Sequence
  Synthetic Oligonucleotide; PRDM1 exon 5; Set C
cuguucccgccgugggagacccgcuug

SEQ ID NO: 30107 - RNA, 26 nt, Artificial Sequence
  Synthetic Oligonucleotide; PRDM1 exon 5; Set C
cuguucccgccgugggagacccgcuu

SEQ ID NO: 30108 - RNA, 21 nt, Artificial Sequence
  Synthetic Oligonucleotide; PRDM1 exon 5; Set C
guucugccguggcggcuguuc

SEQ ID NO: 30109 - RNA, 20 nt, Artificial Sequence
  Synthetic Oligonucleotide; PRDM1 exon 5; Set C
guucugccguggcggcuguu

SEQ ID NO: 30110 - RNA, 22 nt, Artificial Sequence
  Synthetic Oligonucleotide; PRDM1 exon 5; Set C
uguucugccguggcggcuguuc

SEQ ID NO: 30111 - RNA, 21 nt, Artificial Sequence
  Synthetic Oligonucleotide; PRDM1 exon 5; Set C
uguucugccguggcggcuguu

SEQ ID NO: 30112 - RNA, 19 nt, Artificial Sequence
  Synthetic Oligonucleotide; PRDM1 exon 5; Set C
guucugccguggcggcugu

SEQ ID NO: 30113 - RNA, 23 nt, Artificial Sequence
  Synthetic Oligonucleotide; PRDM1 exon 5; Set C
auguucugccguggcggcuguuc

SEQ ID NO: 30114 - RNA, 20 nt, Artificial Sequence
  Synthetic Oligonucleotide; PRDM1 exon 5; Set C
uguucugccguggcggcugu

SEQ ID NO: 30115 - RNA, 22 nt, Artificial Sequence
  Synthetic Oligonucleotide; PRDM1 exon 5; Set C
auguucugccguggcggcuguu

SEQ ID NO: 30116 - RNA, 19 nt, Artificial Sequence
  Synthetic Oligonucleotide; PRDM1 exon 5; Set B
uguucugccguggcggcug

SEQ ID NO: 30117 - RNA, 37 nt, Artificial Sequence
  Synthetic Oligonucleotide; PRDM1 exon 5; Set C
uugggcugcaccacauguucugccguggcggcuguuc

SEQ ID NO: 30118 - RNA, 36 nt, Artificial Sequence
  Synthetic Oligonucleotide; PRDM1 exon 5; Set C
uugggcugcaccacauguucugccguggcggcuguu

SEQ ID NO: 30119 - RNA, 38 nt, Artificial Sequence
  Synthetic Oligonucleotide; PRDM1 exon 5; Set C
uuugggcugcaccacauguucugccguggcggcuguuc

SEQ ID NO: 30120 - RNA, 37 nt, Artificial Sequence
  Synthetic Oligonucleotide; PRDM1 exon 5; Set C
uuugggcugcaccacauguucugccguggcggcuguu

SEQ ID NO: 30121 - RNA, 35 nt, Artificial Sequence
  Synthetic Oligonucleotide; PRDM1 exon 5; Set C
uugggcugcaccacauguucugccguggcggcugu

SEQ ID NO: 30122 - RNA, 36 nt, Artificial Sequence
  Synthetic Oligonucleotide; PRDM1 exon 5; Set C
uuugggcugcaccacauguucugccguggcggcugu

SEQ ID NO: 30123 - RNA, 34 nt, Artificial Sequence
  Synthetic Oligonucleotide; PRDM1 exon 5; Set C
uugggcugcaccacauguucugccguggcggcug

SEQ ID NO: 30124 - RNA, 35 nt, Artificial Sequence
  Synthetic Oligonucleotide; PRDM1 exon 5; Set C
uuugggcugcaccacauguucugccguggcggcug

SEQ ID NO: 30125 - RNA, 18 nt, Artificial Sequence
  Synthetic Oligonucleotide; PRDM1 exon 5; Set B
ugggcugcaccacauguu

SEQ ID NO: 30126 - RNA, 17 nt, Artificial Sequence
  Synthetic Oligonucleotide; PRDM1 exon 5; Set B
ugggcugcaccacaugu

SEQ ID NO: 30127 - RNA, 19 nt, Artificial Sequence
  Synthetic Oligonucleotide; PRDM1 exon 5; Set B
uugggcugcaccacauguu

SEQ ID NO: 30128 - RNA, 18 nt, Artificial Sequence
  Synthetic Oligonucleotide; PRDM1 exon 5; Set B
uugggcugcaccacaugu

SEQ ID NO: 30129 - RNA, 20 nt, Artificial Sequence
  Synthetic Oligonucleotide; PRDM1 exon 5; Set B
uuugggcugcaccacauguu

SEQ ID NO: 30130 - RNA, 19 nt, Artificial Sequence
  Synthetic Oligonucleotide; PRDM1 exon 5; Set B
uuugggcugcaccacaugu

SEQ ID NO: 30131 - RNA, 17 nt, Artificial Sequence
  Synthetic Oligonucleotide; PRDM1 exon 5; Set B
uugggcugcaccacaug

SEQ ID NO: 30132 - RNA, 18 nt, Artificial Sequence
  Synthetic Oligonucleotide; PRDM1 exon 5; Set B
uuugggcugcaccacaug

SEQ ID NO: 30133 - RNA, 25 nt, Artificial Sequence
  Synthetic Oligonucleotide; PRDM1 exon 5; Set C
guagcuuugggcugcaccacauguu

SEQ ID NO: 30134 - RNA, 24 nt, Artificial Sequence
  Synthetic Oligonucleotide; PRDM1 exon 5; Set C
guagcuuugggcugcaccacaugu

SEQ ID NO: 30135 - RNA, 32 nt, Artificial Sequence
  Synthetic Oligonucleotide; PRDM1 exon 5; Set C
uaaugagauucauggcuucgucgcugcugggg

SEQ ID NO: 30136 - RNA, 33 nt, Artificial Sequence
  Synthetic Oligonucleotide; PRDM1 exon 5; Set C
uuaaugagauucauggcuucgucgcugcugggg

SEQ ID NO: 30137 - RNA, 34 nt, Artificial Sequence
  Synthetic Oligonucleotide; PRDM1 exon 5; Set C
uuuaaugagauucauggcuucgucgcugcugggg

SEQ ID NO: 30138 - RNA, 35 nt, Artificial Sequence
  Synthetic Oligonucleotide; PRDM1 exon 5; Set C
uuuuaaugagauucauggcuucgucgcugcugggg

SEQ ID NO: 30139 - RNA, 36 nt, Artificial Sequence
  Synthetic Oligonucleotide; PRDM1 exon 5; Set C
uuuuuaaugagauucauggcuucgucgcugcugggg

SEQ ID NO: 30140 - RNA, 37 nt, Artificial Sequence
  Synthetic Oligonucleotide; PRDM1 exon 5; Set C
guuuuuaaugagauucauggcuucgucgcugcugggg

SEQ ID NO: 30141 - RNA, 38 nt, Artificial Sequence
  Synthetic Oligonucleotide; PRDM1 exon 5; Set C
uguuuuuaaugagauucauggcuucgucgcugcugggg

SEQ ID NO: 30142 - RNA, 39 nt, Artificial Sequence
  Synthetic Oligonucleotide; PRDM1 exon 5; Set C
uuguuuuuaaugagauucauggcuucgucgcugcugggg

SEQ ID NO: 30143 - RNA, 40 nt, Artificial Sequence
  Synthetic Oligonucleotide; PRDM1 exon 5; Set C
uuuguuuuuaaugagauucauggcuucgucgcugcugggg

SEQ ID NO: 30144 - RNA, 23 nt, Artificial Sequence
  Synthetic Oligonucleotide; PRDM1 exon 5; Set C
uaaugagauucauggcuucgucg

SEQ ID NO: 30145 - RNA, 22 nt, Artificial Sequence
  Synthetic Oligonucleotide; PRDM1 exon 5; Set C
uaaugagauucauggcuucguc

SEQ ID NO: 30146 - RNA, 24 nt, Artificial Sequence
  Synthetic Oligonucleotide; PRDM1 exon 5; Set C
uuaaugagauucauggcuucgucg

SEQ ID NO: 30147 - RNA, 19 nt, Artificial Sequence
  Synthetic Oligonucleotide; PRDM1 exon 5; Set C
aaugagauucauggcuucg

SEQ ID NO: 30148 - RNA, 23 nt, Artificial Sequence
  Synthetic Oligonucleotide; PRDM1 exon 5; Set C
uuaaugagauucauggcuucguc

SEQ ID NO: 30149 - RNA, 25 nt, Artificial Sequence
  Synthetic Oligonucleotide; PRDM1 exon 5; Set C
uuuaaugagauucauggcuucgucg

SEQ ID NO: 30150 - RNA, 20 nt, Artificial Sequence
  Synthetic Oligonucleotide; PRDM1 exon 5; Set C
uaaugagauucauggcuucg

SEQ ID NO: 30151 - RNA, 24 nt, Artificial Sequence
  Synthetic Oligonucleotide; PRDM1 exon 5; Set C
uuuaaugagauucauggcuucguc

SEQ ID NO: 30152 - RNA, 26 nt, Artificial Sequence
  Synthetic Oligonucleotide; PRDM1 exon 5; Set C
uuuuaaugagauucauggcuucgucg

SEQ ID NO: 30153 - RNA, 21 nt, Artificial Sequence
  Synthetic Oligonucleotide; PRDM1 exon 5; Set C
uuaaugagauucauggcuucg

SEQ ID NO: 30154 - RNA, 25 nt, Artificial Sequence
  Synthetic Oligonucleotide; PRDM1 exon 5; Set C
uuuuaaugagauucauggcuucguc

SEQ ID NO: 30155 - RNA, 27 nt, Artificial Sequence
  Synthetic Oligonucleotide; PRDM1 exon 5; Set C
uuuuuaaugagauucauggcuucgucg

SEQ ID NO: 30156 - RNA, 22 nt, Artificial Sequence
  Synthetic Oligonucleotide; PRDM1 exon 5; Set C
uuuaaugagauucauggcuucg

SEQ ID NO: 30157 - RNA, 26 nt, Artificial Sequence
  Synthetic Oligonucleotide; PRDM1 exon 5; Set C
uuuuuaaugagauucauggcuucguc

SEQ ID NO: 30158 - RNA, 28 nt, Artificial Sequence
  Synthetic Oligonucleotide; PRDM1 exon 5; Set B
guuuuuaaugagauucauggcuucgucg

SEQ ID NO: 30159 - RNA, 23 nt, Artificial Sequence
  Synthetic Oligonucleotide; PRDM1 exon 5; Set C
uuuuaaugagauucauggcuucg

SEQ ID NO: 30160 - RNA, 27 nt, Artificial Sequence
  Synthetic Oligonucleotide; PRDM1 exon 5; Set C
guuuuuaaugagauucauggcuucguc

SEQ ID NO: 30161 - RNA, 29 nt, Artificial Sequence
  Synthetic Oligonucleotide; PRDM1 exon 5; Set B
uguuuuuaaugagauucauggcuucgucg

SEQ ID NO: 30162 - RNA, 24 nt, Artificial Sequence
  Synthetic Oligonucleotide; PRDM1 exon 5; Set C
uuuuuaaugagauucauggcuucg

SEQ ID NO: 30163 - RNA, 28 nt, Artificial Sequence
  Synthetic Oligonucleotide; PRDM1 exon 5; Set B
uguuuuuaaugagauucauggcuucguc

SEQ ID NO: 30164 - RNA, 30 nt, Artificial Sequence
  Synthetic Oligonucleotide; PRDM1 exon 5; Set B
uuguuuuuaaugagauucauggcuucgucg

SEQ ID NO: 30165 - RNA, 25 nt, Artificial Sequence
  Synthetic Oligonucleotide; PRDM1 exon 5; Set C
guuuuuaaugagauucauggcuucg

SEQ ID NO: 30166 - RNA, 29 nt, Artificial Sequence
  Synthetic Oligonucleotide; PRDM1 exon 5; Set B
uuguuuuuaaugagauucauggcuucguc

SEQ ID NO: 30167 - RNA, 31 nt, Artificial Sequence
  Synthetic Oligonucleotide; PRDM1 exon 5; Set B
uuuguuuuuaaugagauucauggcuucgucg

SEQ ID NO: 30168 - RNA, 27 nt, Artificial Sequence
  Synthetic Oligonucleotide; PRDM1 exon 5; Set C
uguuuuuaaugagauucauggcuucgu

SEQ ID NO: 30169 - RNA, 26 nt, Artificial Sequence
  Synthetic Oligonucleotide; PRDM1 exon 5; Set C
uguuuuuaaugagauucauggcuucg

SEQ ID NO: 30170 - RNA, 30 nt, Artificial Sequence
  Synthetic Oligonucleotide; PRDM1 exon 5; Set B
uuuguuuuuaaugagauucauggcuucguc

SEQ ID NO: 30171 - RNA, 28 nt, Artificial Sequence
  Synthetic Oligonucleotide; PRDM1 exon 5; Set C
uuguuuuuaaugagauucauggcuucgu

SEQ ID NO: 30172 - RNA, 27 nt, Artificial Sequence
  Synthetic Oligonucleotide; PRDM1 exon 5; Set C
uuguuuuuaaugagauucauggcuucg

SEQ ID NO: 30173 - RNA, 29 nt, Artificial Sequence
  Synthetic Oligonucleotide; PRDM1 exon 5; Set B
uuuguuuuuaaugagauucauggcuucgu

SEQ ID NO: 30174 - RNA, 28 nt, Artificial Sequence
  Synthetic Oligonucleotide; PRDM1 exon 5; Set C
uuuguuuuuaaugagauucauggcuucg

SEQ ID NO: 30175 - RNA, 27 nt, Artificial Sequence
  Synthetic Oligonucleotide; PRDM1 exon 5; Set C
uuuguuuuuaaugagauucauggcuuc

SEQ ID NO: 30176 - RNA, 34 nt, Artificial Sequence
  Synthetic Oligonucleotide; PRDM1 exon 5; Set B
uucuuuuguuuuuaaugagauucauggcuucguc

SEQ ID NO: 30177 - RNA, 36 nt, Artificial Sequence
  Synthetic Oligonucleotide; PRDM1 exon 5; Set B
uuucuuuuguuuuuaaugagauucauggcuucgucg

SEQ ID NO: 30178 - RNA, 35 nt, Artificial Sequence
  Synthetic Oligonucleotide; PRDM1 exon 5; Set B
uuucuuuuguuuuuaaugagauucauggcuucguc

SEQ ID NO: 30179 - RNA, 32 nt, Artificial Sequence
  Synthetic Oligonucleotide; PRDM1 exon 5; Set B
uucuuuuguuuuuaaugagauucauggcuucg

SEQ ID NO: 30180 - RNA, 34 nt, Artificial Sequence
  Synthetic Oligonucleotide; PRDM1 exon 5; Set B
uuucuuuuguuuuuaaugagauucauggcuucgu

SEQ ID NO: 30181 - RNA, 33 nt, Artificial Sequence
  Synthetic Oligonucleotide; PRDM1 exon 5; Set B
uuucuuuuguuuuuaaugagauucauggcuucg

SEQ ID NO: 30182 - RNA, 32 nt, Artificial Sequence
  Synthetic Oligonucleotide; PRDM1 exon 5; Set C
uuucuuuuguuuuuaaugagauucauggcuuc

SEQ ID NO: 30183 - RNA, 38 nt, Artificial Sequence
  Synthetic Oligonucleotide; PRDM1 exon 5; Set B
ucauguuucuuuuguuuuuaaugagauucauggcuucg

SEQ ID NO: 30184 - RNA, 20 nt, Artificial Sequence
  Synthetic Oligonucleotide; PRDM1 exon 5; Set C
uuuuguuuuuaaugagauuc

SEQ ID NO: 30185 - RNA, 19 nt, Artificial Sequence
  Synthetic Oligonucleotide; PRDM1 exon 5; Set C
uuuuguuuuuaaugagauu

SEQ ID NO: 30186 - RNA, 39 nt, Artificial Sequence
  Synthetic Oligonucleotide; PRDM1 exon 5; Set B
gucauguuucuuuuguuuuuaaugagauucauggcuucg

SEQ ID NO: 30187 - RNA, 21 nt, Artificial Sequence
  Synthetic Oligonucleotide; PRDM1 exon 5; Set C
cuuuuguuuuuaaugagauuc

SEQ ID NO: 30188 - RNA, 20 nt, Artificial Sequence
  Synthetic Oligonucleotide; PRDM1 exon 5; Set C
cuuuuguuuuuaaugagauu

SEQ ID NO: 30189 - RNA, 18 nt, Artificial Sequence
  Synthetic Oligonucleotide; PRDM1 exon 5; Set C
uuuuguuuuuaaugagau

SEQ ID NO: 30190 - RNA, 40 nt, Artificial Sequence
  Synthetic Oligonucleotide; PRDM1 exon 5; Set B
ggucauguuucuuuuguuuuuaaugagauucauggcuucg

SEQ ID NO: 30191 - RNA, 22 nt, Artificial Sequence
  Synthetic Oligonucleotide; PRDM1 exon 5; Set C
ucuuuuguuuuuaaugagauuc

SEQ ID NO: 30192 - RNA, 21 nt, Artificial Sequence
  Synthetic Oligonucleotide; PRDM1 exon 5; Set C
ucuuuuguuuuuaaugagauu

SEQ ID NO: 30193 - RNA, 19 nt, Artificial Sequence
  Synthetic Oligonucleotide; PRDM1 exon 5; Set C
cuuuuguuuuuaaugagau

SEQ ID NO: 30194 - RNA, 17 nt, Artificial Sequence
  Synthetic Oligonucleotide; PRDM1 exon 5; Set C
uuuuguuuuuaaugaga

SEQ ID NO: 30195 - RNA, 23 nt, Artificial Sequence
  Synthetic Oligonucleotide; PRDM1 exon 5; Set C
uucuuuuguuuuuaaugagauuc

SEQ ID NO: 30196 - RNA, 15 nt, Artificial Sequence
  Synthetic Oligonucleotide; PRDM1 exon 5; Set C
uuuguuuuuaaugag

SEQ ID NO: 30197 - RNA, 20 nt, Artificial Sequence
  Synthetic Oligonucleotide; PRDM1 exon 5; Set C
ucuuuuguuuuuaaugagau

SEQ ID NO: 30198 - RNA, 18 nt, Artificial Sequence
  Synthetic Oligonucleotide; PRDM1 exon 5; Set C
cuuuuguuuuuaaugaga

SEQ ID NO: 30199 - RNA, 19 nt, Artificial Sequence
  Synthetic Oligonucleotide; PRDM1 exon 5; Set C
ucuuuuguuuuuaaugaga

SEQ ID NO: 30200 - RNA, 24 nt, Artificial Sequence
  Synthetic Oligonucleotide; PRDM1 exon 5; Set C
guuucuuuuguuuuuaaugagauu

SEQ ID NO: 30201 - RNA, 20 nt, Artificial Sequence
  Synthetic Oligonucleotide; PRDM1 exon 5; Set C
uucuuuuguuuuuaaugaga

SEQ ID NO: 30202 - RNA, 25 nt, Artificial Sequence
  Synthetic Oligonucleotide; PRDM1 exon 5; Set C
uguuucuuuuguuuuuaaugagauu

SEQ ID NO: 30203 - RNA, 23 nt, Artificial Sequence
  Synthetic Oligonucleotide; PRDM1 exon 5; Set C
guuucuuuuguuuuuaaugagau

SEQ ID NO: 30204 - RNA, 15 nt, Artificial Sequence
  Synthetic Oligonucleotide; PRDM1 exon 5; Set C
cuuuuguuuuuaaug

SEQ ID NO: 30205 - RNA, 19 nt, Artificial Sequence
  Synthetic Oligonucleotide; PRDM1 exon 5; Set C
uucuuuuguuuuuaaugag

SEQ ID NO: 30206 - RNA, 26 nt, Artificial Sequence
  Synthetic Oligonucleotide; PRDM1 exon 5; Set C
auguuucuuuuguuuuuaaugagauu

SEQ ID NO: 30207 - RNA, 24 nt, Artificial Sequence
  Synthetic Oligonucleotide; PRDM1 exon 5; Set C
uguuucuuuuguuuuuaaugagau

SEQ ID NO: 30208 - RNA, 16 nt, Artificial Sequence
  Synthetic Oligonucleotide; PRDM1 exon 5; Set C
ucuuuuguuuuuaaug

SEQ ID NO: 30209 - RNA, 22 nt, Artificial Sequence
  Synthetic Oligonucleotide; PRDM1 exon 5; Set C
guuucuuuuguuuuuaaugaga

SEQ ID NO: 30210 - RNA, 18 nt, Artificial Sequence
  Synthetic Oligonucleotide; PRDM1 exon 5; Set C
uucuuuuguuuuuaauga

SEQ ID NO: 30211 - RNA, 20 nt, Artificial Sequence
  Synthetic Oligonucleotide; PRDM1 exon 5; Set C
uuucuuuuguuuuuaaugag

SEQ ID NO: 30212 - RNA, 15 nt, Artificial Sequence
  Synthetic Oligonucleotide; PRDM1 exon 5; Set C
ucuuuuguuuuuaau

SEQ ID NO: 30213 - RNA, 27 nt, Artificial Sequence
  Synthetic Oligonucleotide; PRDM1 exon 5; Set C
cauguuucuuuuguuuuuaaugagauu

SEQ ID NO: 30214 - RNA, 25 nt, Artificial Sequence
  Synthetic Oligonucleotide; PRDM1 exon 5; Set C
auguuucuuuuguuuuuaaugagau

SEQ ID NO: 30215 - RNA, 23 nt, Artificial Sequence
  Synthetic Oligonucleotide; PRDM1 exon 5; Set C
uguuucuuuuguuuuuaaugaga

SEQ ID NO: 30216 - RNA, 29 nt, Artificial Sequence
  Synthetic Oligonucleotide; PRDM1 exon 5; Set C
ucauguuucuuuuguuuuuaaugagauuc

SEQ ID NO: 30217 - RNA, 19 nt, Artificial Sequence
  Synthetic Oligonucleotide; PRDM1 exon 5; Set C
uuucuuuuguuuuuaauga

SEQ ID NO: 30218 - RNA, 26 nt, Artificial Sequence
  Synthetic Oligonucleotide; PRDM1 exon 5; Set C
cauguuucuuuuguuuuuaaugagau

SEQ ID NO: 30219 - RNA, 30 nt, Artificial Sequence
  Synthetic Oligonucleotide; PRDM1 exon 5; Set C
gucauguuucuuuuguuuuuaaugagauuc

SEQ ID NO: 30220 - RNA, 29 nt, Artificial Sequence
  Synthetic Oligonucleotide; PRDM1 exon 5; Set C
gucauguuucuuuuguuuuuaaugagauu

SEQ ID NO: 30221 - RNA, 19 nt, Artificial Sequence
  Synthetic Oligonucleotide; PRDM1 exon 5; Set C
guuucuuuuguuuuuaaug

SEQ ID NO: 30222 - RNA, 31 nt, Artificial Sequence
  Synthetic Oligonucleotide; PRDM1 exon 5; Set C
ggucauguuucuuuuguuuuuaaugagauuc

SEQ ID NO: 30223 - RNA, 18 nt, Artificial Sequence
  Synthetic Oligonucleotide; PRDM1 exon 5; Set C
guuucuuuuguuuuuaau

SEQ ID NO: 30224 - RNA, 28 nt, Artificial Sequence
  Synthetic Oligonucleotide; PRDM1 exon 5; Set C
gucauguuucuuuuguuuuuaaugagau

SEQ ID NO: 30225 - RNA, 20 nt, Artificial Sequence
  Synthetic Oligonucleotide; PRDM1 exon 5; Set C
uguuucuuuuguuuuuaaug

SEQ ID NO: 30226 - RNA, 26 nt, Artificial Sequence
  Synthetic Oligonucleotide; PRDM1 exon 5; Set C
ucauguuucuuuuguuuuuaaugaga

SEQ ID NO: 30227 - RNA, 19 nt, Artificial Sequence
  Synthetic Oligonucleotide; PRDM1 exon 5; Set C
uguuucuuuuguuuuuaau

SEQ ID NO: 30228 - RNA, 21 nt, Artificial Sequence
  Synthetic Oligonucleotide; PRDM1 exon 5; Set C
auguuucuuuuguuuuuaaug

SEQ ID NO: 30229 - RNA, 27 nt, Artificial Sequence
  Synthetic Oligonucleotide; PRDM1 exon 5; Set C
gucauguuucuuuuguuuuuaaugaga

SEQ ID NO: 30230 - RNA, 20 nt, Artificial Sequence
  Synthetic Oligonucleotide; PRDM1 exon 5; Set C
auguuucuuuuguuuuuaau

SEQ ID NO: 30231 - RNA, 22 nt, Artificial Sequence
  Synthetic Oligonucleotide; PRDM1 exon 5; Set C
cauguuucuuuuguuuuuaaug

SEQ ID NO: 30232 - RNA, 28 nt, Artificial Sequence
  Synthetic Oligonucleotide; PRDM1 exon 5; Set C
ggucauguuucuuuuguuuuuaaugaga

SEQ ID NO: 30233 - RNA, 24 nt, Artificial Sequence
  Synthetic Oligonucleotide; PRDM1 exon 5; Set C
ucauguuucuuuuguuuuuaauga

SEQ ID NO: 30234 - RNA, 19 nt, Artificial Sequence
  Synthetic Oligonucleotide; PRDM1 exon 5; Set C
auguuucuuuuguuuuuaa

SEQ ID NO: 30235 - RNA, 21 nt, Artificial Sequence
  Synthetic Oligonucleotide; PRDM1 exon 5; Set C
cauguuucuuuuguuuuuaau

SEQ ID NO: 30236 - RNA, 23 nt, Artificial Sequence
  Synthetic Oligonucleotide; PRDM1 exon 5; Set C
ucauguuucuuuuguuuuuaaug

SEQ ID NO: 30237 - RNA, 27 nt, Artificial Sequence
  Synthetic Oligonucleotide; PRDM1 exon 5; Set C
ggucauguuucuuuuguuuuuaaugag

SEQ ID NO: 30238 - RNA, 18 nt, Artificial Sequence
  Synthetic Oligonucleotide; PRDM1 exon 5; Set C
auguuucuuuuguuuuua

SEQ ID NO: 30239 - RNA, 20 nt, Artificial Sequence
  Synthetic Oligonucleotide; PRDM1 exon 5; Set C
cauguuucuuuuguuuuuaa

SEQ ID NO: 30240 - RNA, 24 nt, Artificial Sequence
  Synthetic Oligonucleotide; PRDM1 exon 5; Set C
gucauguuucuuuuguuuuuaaug

SEQ ID NO: 30241 - RNA, 26 nt, Artificial Sequence
  Synthetic Oligonucleotide; PRDM1 exon 5; Set C
ggucauguuucuuuuguuuuuaauga

SEQ ID NO: 30242 - RNA, 15 nt, Artificial Sequence
  Synthetic Oligonucleotide; PRDM1 exon 5; Set C
uguuucuuuuguuuu

SEQ ID NO: 30243 - RNA, 19 nt, Artificial Sequence
  Synthetic Oligonucleotide; PRDM1 exon 5; Set C
cauguuucuuuuguuuuua

SEQ ID NO: 30244 - RNA, 17 nt, Artificial Sequence
  Synthetic Oligonucleotide; PRDM1 exon 5; Set C
auguuucuuuuguuuuu

SEQ ID NO: 30245 - RNA, 18 nt, Artificial Sequence
  Synthetic Oligonucleotide; PRDM1 exon 5; Set C
cauguuucuuuuguuuuu

SEQ ID NO: 30246 - RNA, 16 nt, Artificial Sequence
  Synthetic Oligonucleotide; PRDM1 exon 5; Set C
auguuucuuuuguuuu

SEQ ID NO: 30247 - RNA, 36 nt, Artificial Sequence
  Synthetic Oligonucleotide; PRDM1 exon 5; Set B
guagccggucauguuucuuuuguuuuuaaugagauu

SEQ ID NO: 30248 - RNA, 38 nt, Artificial Sequence
  Synthetic Oligonucleotide; PRDM1 exon 5; Set B
uguagccggucauguuucuuuuguuuuuaaugagauuc

SEQ ID NO: 30249 - RNA, 17 nt, Artificial Sequence
  Synthetic Oligonucleotide; PRDM1 exon 5; Set C
cauguuucuuuuguuuu

SEQ ID NO: 30250 - RNA, 15 nt, Artificial Sequence
  Synthetic Oligonucleotide; PRDM1 exon 5; Set C
auguuucuuuuguuu

SEQ ID NO: 30251 - RNA, 39 nt, Artificial Sequence
  Synthetic Oligonucleotide; PRDM1 exon 5; Set B
uuguagccggucauguuucuuuuguuuuuaaugagauuc

SEQ ID NO: 30252 - RNA, 16 nt, Artificial Sequence
  Synthetic Oligonucleotide; PRDM1 exon 5; Set C
cauguuucuuuuguuu

SEQ ID NO: 30253 - RNA, 15 nt, Artificial Sequence
  Synthetic Oligonucleotide; PRDM1 exon 5; Set C
cauguuucuuuuguu

SEQ ID NO: 30254 - RNA, 37 nt, Artificial Sequence
  Synthetic Oligonucleotide; PRDM1 exon 5; Set B
uuguagccggucauguuucuuuuguuuuuaaugagau

SEQ ID NO: 30255 - RNA, 36 nt, Artificial Sequence
  Synthetic Oligonucleotide; PRDM1 exon 5; Set B
uuguagccggucauguuucuuuuguuuuuaaugaga

SEQ ID NO: 30256 - RNA, 34 nt, Artificial Sequence
  Synthetic Oligonucleotide; PRDM1 exon 5; Set B
uguagccggucauguuucuuuuguuuuuaaugag

SEQ ID NO: 30257 - RNA, 33 nt, Artificial Sequence
  Synthetic Oligonucleotide; PRDM1 exon 5; Set B
uguagccggucauguuucuuuuguuuuuaauga

SEQ ID NO: 30258 - RNA, 30 nt, Artificial Sequence
  Synthetic Oligonucleotide; PRDM1 exon 5; Set B
guagccggucauguuucuuuuguuuuuaau

SEQ ID NO: 30259 - RNA, 29 nt, Artificial Sequence
  Synthetic Oligonucleotide; PRDM1 exon 5; Set B
guagccggucauguuucuuuuguuuuuaa

SEQ ID NO: 30260 - RNA, 33 nt, Artificial Sequence
  Synthetic Oligonucleotide; PRDM1 exon 5; Set B
uuguagccggucauguuucuuuuguuuuuaaug

SEQ ID NO: 30261 - RNA, 28 nt, Artificial Sequence
  Synthetic Oligonucleotide; PRDM1 exon 5; Set B
guagccggucauguuucuuuuguuuuua

SEQ ID NO: 30262 - RNA, 40 nt, Artificial Sequence
  Synthetic Oligonucleotide; PRDM1 exon 5; Set C
ggucuuguagccggucauguuucuuuuguuuuuaaugaga

SEQ ID NO: 30263 - RNA, 27 nt, Artificial Sequence
  Synthetic Oligonucleotide; PRDM1 exon 5; Set B
guagccggucauguuucuuuuguuuuu

SEQ ID NO: 30264 - RNA, 39 nt, Artificial Sequence
  Synthetic Oligonucleotide; PRDM1 exon 5; Set C
ggucuuguagccggucauguuucuuuuguuuuuaaugag

SEQ ID NO: 30265 - RNA, 26 nt, Artificial Sequence
  Synthetic Oligonucleotide; PRDM1 exon 5; Set B
guagccggucauguuucuuuuguuuu

SEQ ID NO: 30266 - RNA, 32 nt, Artificial Sequence
  Synthetic Oligonucleotide; PRDM1 exon 5; Set B
cuuguagccggucauguuucuuuuguuuuuaa

SEQ ID NO: 30267 - RNA, 38 nt, Artificial Sequence
  Synthetic Oligonucleotide; PRDM1 exon 5; Set C
ggucuuguagccggucauguuucuuuuguuuuuaauga

SEQ ID NO: 30268 - RNA, 40 nt, Artificial Sequence
  Synthetic Oligonucleotide; PRDM1 exon 5; Set C
gggucuuguagccggucauguuucuuuuguuuuuaaugag

SEQ ID NO: 30269 - RNA, 25 nt, Artificial Sequence
  Synthetic Oligonucleotide; PRDM1 exon 5; Set B
guagccggucauguuucuuuuguuu

SEQ ID NO: 30270 - RNA, 31 nt, Artificial Sequence
  Synthetic Oligonucleotide; PRDM1 exon 5; Set B
cuuguagccggucauguuucuuuuguuuuua

SEQ ID NO: 30271 - RNA, 33 nt, Artificial Sequence
  Synthetic Oligonucleotide; PRDM1 exon 5; Set B
ucuuguagccggucauguuucuuuuguuuuuaa

SEQ ID NO: 30272 - RNA, 39 nt, Artificial Sequence
  Synthetic Oligonucleotide; PRDM1 exon 5; Set C
gggucuuguagccggucauguuucuuuuguuuuuaauga

SEQ ID NO: 30273 - RNA, 24 nt, Artificial Sequence
  Synthetic Oligonucleotide; PRDM1 exon 5; Set B
guagccggucauguuucuuuuguu

SEQ ID NO: 30274 - RNA, 30 nt, Artificial Sequence
  Synthetic Oligonucleotide; PRDM1 exon 5; Set B
cuuguagccggucauguuucuuuuguuuuu

SEQ ID NO: 30275 - RNA, 32 nt, Artificial Sequence
  Synthetic Oligonucleotide; PRDM1 exon 5; Set B
ucuuguagccggucauguuucuuuuguuuuua

SEQ ID NO: 30276 - RNA, 34 nt, Artificial Sequence
  Synthetic Oligonucleotide; PRDM1 exon 5; Set B
gucuuguagccggucauguuucuuuuguuuuuaa

SEQ ID NO: 30277 - RNA, 40 nt, Artificial Sequence
  Synthetic Oligonucleotide; PRDM1 exon 5; Set C
agggucuuguagccggucauguuucuuuuguuuuuaauga

SEQ ID NO: 30278 - RNA, 23 nt, Artificial Sequence
  Synthetic Oligonucleotide; PRDM1 exon 5; Set B
guagccggucauguuucuuuugu

SEQ ID NO: 30279 - RNA, 29 nt, Artificial Sequence
  Synthetic Oligonucleotide; PRDM1 exon 5; Set B
cuuguagccggucauguuucuuuuguuuu

SEQ ID NO: 30280 - RNA, 31 nt, Artificial Sequence
  Synthetic Oligonucleotide; PRDM1 exon 5; Set B
ucuuguagccggucauguuucuuuuguuuuu

SEQ ID NO: 30281 - RNA, 33 nt, Artificial Sequence
  Synthetic Oligonucleotide; PRDM1 exon 5; Set B
gucuuguagccggucauguuucuuuuguuuuua

SEQ ID NO: 30282 - RNA, 22 nt, Artificial Sequence
  Synthetic Oligonucleotide; PRDM1 exon 5; Set C
guagccggucauguuucuuuug

SEQ ID NO: 30283 - RNA, 28 nt, Artificial Sequence
  Synthetic Oligonucleotide; PRDM1 exon 5; Set B
cuuguagccggucauguuucuuuuguuu

SEQ ID NO: 30284 - RNA, 30 nt, Artificial Sequence
  Synthetic Oligonucleotide; PRDM1 exon 5; Set B
ucuuguagccggucauguuucuuuuguuuu

SEQ ID NO: 30285 - RNA, 32 nt, Artificial Sequence
  Synthetic Oligonucleotide; PRDM1 exon 5; Set B
gucuuguagccggucauguuucuuuuguuuuu

SEQ ID NO: 30286 - RNA, 21 nt, Artificial Sequence
  Synthetic Oligonucleotide; PRDM1 exon 5; Set C
guagccggucauguuucuuuu

SEQ ID NO: 30287 - RNA, 27 nt, Artificial Sequence
  Synthetic Oligonucleotide; PRDM1 exon 5; Set B
cuuguagccggucauguuucuuuuguu

SEQ ID NO: 30288 - RNA, 29 nt, Artificial Sequence
  Synthetic Oligonucleotide; PRDM1 exon 5; Set B
ucuuguagccggucauguuucuuuuguuu

SEQ ID NO: 30289 - RNA, 31 nt, Artificial Sequence
  Synthetic Oligonucleotide; PRDM1 exon 5; Set B
gucuuguagccggucauguuucuuuuguuuu

SEQ ID NO: 30290 - RNA, 26 nt, Artificial Sequence
  Synthetic Oligonucleotide; PRDM1 exon 5; Set B
cuuguagccggucauguuucuuuugu

SEQ ID NO: 30291 - RNA, 28 nt, Artificial Sequence
  Synthetic Oligonucleotide; PRDM1 exon 5; Set B
ucuuguagccggucauguuucuuuuguu

SEQ ID NO: 30292 - RNA, 30 nt, Artificial Sequence
  Synthetic Oligonucleotide; PRDM1 exon 5; Set B
gucuuguagccggucauguuucuuuuguuu

SEQ ID NO: 30293 - RNA, 38 nt, Artificial Sequence
  Synthetic Oligonucleotide; PRDM1 exon 5; Set C
aagggucuuguagccggucauguuucuuuuguuuuuaa

SEQ ID NO: 30294 - RNA, 25 nt, Artificial Sequence
  Synthetic Oligonucleotide; PRDM1 exon 5; Set B
cuuguagccggucauguuucuuuug

SEQ ID NO: 30295 - RNA, 27 nt, Artificial Sequence
  Synthetic Oligonucleotide; PRDM1 exon 5; Set B
ucuuguagccggucauguuucuuuugu

SEQ ID NO: 30296 - RNA, 29 nt, Artificial Sequence
  Synthetic Oligonucleotide; PRDM1 exon 5; Set B
gucuuguagccggucauguuucuuuuguu

SEQ ID NO: 30297 - RNA, 37 nt, Artificial Sequence
  Synthetic Oligonucleotide; PRDM1 exon 5; Set C
aagggucuuguagccggucauguuucuuuuguuuuua

SEQ ID NO: 30298 - RNA, 21 nt, Artificial Sequence
  Synthetic Oligonucleotide; PRDM1 exon 5; Set C
uguagccggucauguuucuuu

SEQ ID NO: 30299 - RNA, 24 nt, Artificial Sequence
  Synthetic Oligonucleotide; PRDM1 exon 5; Set B
cuuguagccggucauguuucuuuu

SEQ ID NO: 30300 - RNA, 26 nt, Artificial Sequence
  Synthetic Oligonucleotide; PRDM1 exon 5; Set B
ucuuguagccggucauguuucuuuug

SEQ ID NO: 30301 - RNA, 28 nt, Artificial Sequence
  Synthetic Oligonucleotide; PRDM1 exon 5; Set B
gucuuguagccggucauguuucuuuugu

SEQ ID NO: 30302 - RNA, 36 nt, Artificial Sequence
  Synthetic Oligonucleotide; PRDM1 exon 5; Set C
aagggucuuguagccggucauguuucuuuuguuuuu

SEQ ID NO: 30303 - RNA, 22 nt, Artificial Sequence
  Synthetic Oligonucleotide; PRDM1 exon 5; Set C
uuguagccggucauguuucuuu

SEQ ID NO: 30304 - RNA, 20 nt, Artificial Sequence
  Synthetic Oligonucleotide; PRDM1 exon 5; Set C
uguagccggucauguuucuu

SEQ ID NO: 30305 - RNA, 27 nt, Artificial Sequence
  Synthetic Oligonucleotide; PRDM1 exon 5; Set B
gucuuguagccggucauguuucuuuug

SEQ ID NO: 30306 - RNA, 35 nt, Artificial Sequence
  Synthetic Oligonucleotide; PRDM1 exon 5; Set C
aagggucuuguagccggucauguuucuuuuguuuu

SEQ ID NO: 30307 - RNA, 19 nt, Artificial Sequence
  Synthetic Oligonucleotide; PRDM1 exon 5; Set C
uguagccggucauguuucu

SEQ ID NO: 30308 - RNA, 21 nt, Artificial Sequence
  Synthetic Oligonucleotide; PRDM1 exon 5; Set C
uuguagccggucauguuucuu

SEQ ID NO: 30309 - RNA, 16 nt, Artificial Sequence
  Synthetic Oligonucleotide; PRDM1 exon 5; Set C
guagccggucauguuu

SEQ ID NO: 30310 - RNA, 34 nt, Artificial Sequence
  Synthetic Oligonucleotide; PRDM1 exon 5; Set C
aagggucuuguagccggucauguuucuuuuguuu

SEQ ID NO: 30311 - RNA, 20 nt, Artificial Sequence
  Synthetic Oligonucleotide; PRDM1 exon 5; Set C
uuguagccggucauguuucu

SEQ ID NO: 30312 - RNA, 33 nt, Artificial Sequence
  Synthetic Oligonucleotide; PRDM1 exon 5; Set C
aagggucuuguagccggucauguuucuuuuguu

SEQ ID NO: 30313 - RNA, 19 nt, Artificial Sequence
  Synthetic Oligonucleotide; PRDM1 exon 5; Set C
uuguagccggucauguuuc

SEQ ID NO: 30314 - RNA, 32 nt, Artificial Sequence
  Synthetic Oligonucleotide; PRDM1 exon 5; Set C
aagggucuuguagccggucauguuucuuuugu

SEQ ID NO: 30315 - RNA, 26 nt, Artificial Sequence
  Synthetic Oligonucleotide; PRDM1 exon 5; Set B
ggucuuguagccggucauguuucuuu

SEQ ID NO: 30316 - RNA, 16 nt, Artificial Sequence
  Synthetic Oligonucleotide; PRDM1 exon 5; Set C
uguagccggucauguu

SEQ ID NO: 30317 - RNA, 27 nt, Artificial Sequence
  Synthetic Oligonucleotide; PRDM1 exon 5; Set C
gggucuuguagccggucauguuucuuu

SEQ ID NO: 30318 - RNA, 25 nt, Artificial Sequence
  Synthetic Oligonucleotide; PRDM1 exon 5; Set B
ggucuuguagccggucauguuucuu

SEQ ID NO: 30319 - RNA, 15 nt, Artificial Sequence
  Synthetic Oligonucleotide; PRDM1 exon 5; Set C
uguagccggucaugu

SEQ ID NO: 30320 - RNA, 28 nt, Artificial Sequence
  Synthetic Oligonucleotide; PRDM1 exon 5; Set C
agggucuuguagccggucauguuucuuu

SEQ ID NO: 30321 - RNA, 26 nt, Artificial Sequence
  Synthetic Oligonucleotide; PRDM1 exon 5; Set C
gggucuuguagccggucauguuucuu

SEQ ID NO: 30322 - RNA, 24 nt, Artificial Sequence
  Synthetic Oligonucleotide; PRDM1 exon 5; Set B
ggucuuguagccggucauguuucu

SEQ ID NO: 30323 - RNA, 27 nt, Artificial Sequence
  Synthetic Oligonucleotide; PRDM1 exon 5; Set C
agggucuuguagccggucauguuucuu

SEQ ID NO: 30324 - RNA, 25 nt, Artificial Sequence
  Synthetic Oligonucleotide; PRDM1 exon 5; Set C
gggucuuguagccggucauguuucu

SEQ ID NO: 30325 - RNA, 26 nt, Artificial Sequence
  Synthetic Oligonucleotide; PRDM1 exon 5; Set C
agggucuuguagccggucauguuucu

SEQ ID NO: 30326 - RNA, 21 nt, Artificial Sequence
  Synthetic Oligonucleotide; PRDM1 exon 5; Set B
ggucuuguagccggucauguu

SEQ ID NO: 30327 - RNA, 40 nt, Artificial Sequence
  Synthetic Oligonucleotide; PRDM1 exon 5; Set C
gguagggaagggucuuguagccggucauguuucuuuuguu

SEQ ID NO: 30328 - RNA, 22 nt, Artificial Sequence
  Synthetic Oligonucleotide; PRDM1 exon 5; Set B
gggucuuguagccggucauguu

SEQ ID NO: 30329 - RNA, 20 nt, Artificial Sequence
  Synthetic Oligonucleotide; PRDM1 exon 5; Set B
ggucuuguagccggucaugu

SEQ ID NO: 30330 - RNA, 39 nt, Artificial Sequence
  Synthetic Oligonucleotide; PRDM1 exon 5; Set C
gguagggaagggucuuguagccggucauguuucuuuugu

SEQ ID NO: 30331 - RNA, 23 nt, Artificial Sequence
  Synthetic Oligonucleotide; PRDM1 exon 5; Set B
agggucuuguagccggucauguu

SEQ ID NO: 30332 - RNA, 21 nt, Artificial Sequence
  Synthetic Oligonucleotide; PRDM1 exon 5; Set B
gggucuuguagccggucaugu

SEQ ID NO: 30333 - RNA, 38 nt, Artificial Sequence
  Synthetic Oligonucleotide; PRDM1 exon 5; Set C
gguagggaagggucuuguagccggucauguuucuuuug

SEQ ID NO: 30334 - RNA, 22 nt, Artificial Sequence
  Synthetic Oligonucleotide; PRDM1 exon 5; Set B
agggucuuguagccggucaugu

SEQ ID NO: 30335 - RNA, 18 nt, Artificial Sequence
  Synthetic Oligonucleotide; PRDM1 exon 5; Set B
ggucuuguagccggucau

SEQ ID NO: 30336 - RNA, 20 nt, Artificial Sequence
  Synthetic Oligonucleotide; PRDM1 exon 5; Set B
gggucuuguagccggucaug

SEQ ID NO: 30337 - RNA, 37 nt, Artificial Sequence
  Synthetic Oligonucleotide; PRDM1 exon 5; Set C
gguagggaagggucuuguagccggucauguuucuuuu

SEQ ID NO: 30338 - RNA, 17 nt, Artificial Sequence
  Synthetic Oligonucleotide; PRDM1 exon 5; Set B
ggucuuguagccgguca

SEQ ID NO: 30339 - RNA, 19 nt, Artificial Sequence
  Synthetic Oligonucleotide; PRDM1 exon 5; Set B
gggucuuguagccggucau

SEQ ID NO: 30340 - RNA, 21 nt, Artificial Sequence
  Synthetic Oligonucleotide; PRDM1 exon 5; Set B
agggucuuguagccggucaug

SEQ ID NO: 30341 - RNA, 18 nt, Artificial Sequence
  Synthetic Oligonucleotide; PRDM1 exon 5; Set B
gggucuuguagccgguca

SEQ ID NO: 30342 - RNA, 16 nt, Artificial Sequence
  Synthetic Oligonucleotide; PRDM1 exon 5; Set C
ggucuuguagccgguc

SEQ ID NO: 30343 - RNA, 20 nt, Artificial Sequence
  Synthetic Oligonucleotide; PRDM1 exon 5; Set B
agggucuuguagccggucau

SEQ ID NO: 30344 - RNA, 15 nt, Artificial Sequence
  Synthetic Oligonucleotide; PRDM1 exon 5; Set C
ggucuuguagccggu

SEQ ID NO: 30345 - RNA, 19 nt, Artificial Sequence
  Synthetic Oligonucleotide; PRDM1 exon 5; Set B
agggucuuguagccgguca

SEQ ID NO: 30346 - RNA, 17 nt, Artificial Sequence
  Synthetic Oligonucleotide; PRDM1 exon 5; Set B
gggucuuguagccgguc

SEQ ID NO: 30347 - RNA, 18 nt, Artificial Sequence
  Synthetic Oligonucleotide; PRDM1 exon 5; Set B
agggucuuguagccgguc

SEQ ID NO: 30348 - RNA, 32 nt, Artificial Sequence
  Synthetic Oligonucleotide; PRDM1 exon 5; Set C
gguagggaagggucuuguagccggucauguuu

SEQ ID NO: 30349 - RNA, 39 nt, Artificial Sequence
  Synthetic Oligonucleotide; PRDM1 exon 5; Set C
uucagcggguagggaagggucuuguagccggucauguuu

SEQ ID NO: 30350 - RNA, 40 nt, Artificial Sequence
  Synthetic Oligonucleotide; PRDM1 exon 5; Set C
ucuucagcggguagggaagggucuuguagccggucauguu

SEQ ID NO: 30351 - RNA, 15 nt, Artificial Sequence
  Synthetic Oligonucleotide; PRDM1 exon 5; Set C
agggaagggucuugu

SEQ ID NO: 30352 - RNA, 39 nt, Artificial Sequence
  Synthetic Oligonucleotide; PRDM1 exon 5; Set C
ucuucagcggguagggaagggucuuguagccggucaugu

SEQ ID NO: 30353 - RNA, 16 nt, Artificial Sequence
  Synthetic Oligonucleotide; PRDM1 exon 5; Set C
uagggaagggucuugu

SEQ ID NO: 30354 - RNA, 40 nt, Artificial Sequence
  Synthetic Oligonucleotide; PRDM1 exon 5; Set C
uucuucagcggguagggaagggucuuguagccggucaugu

SEQ ID NO: 30355 - RNA, 17 nt, Artificial Sequence
  Synthetic Oligonucleotide; PRDM1 exon 5; Set C
guagggaagggucuugu

SEQ ID NO: 30356 - RNA, 35 nt, Artificial Sequence
  Synthetic Oligonucleotide; PRDM1 exon 5; Set C
cuucagcggguagggaagggucuuguagccgguca

SEQ ID NO: 30357 - RNA, 18 nt, Artificial Sequence
  Synthetic Oligonucleotide; PRDM1 exon 5; Set C
gguagggaagggucuugu

SEQ ID NO: 30358 - RNA, 36 nt, Artificial Sequence
  Synthetic Oligonucleotide; PRDM1 exon 5; Set C
ucuucagcggguagggaagggucuuguagccgguca

SEQ ID NO: 30359 - RNA, 34 nt, Artificial Sequence
  Synthetic Oligonucleotide; PRDM1 exon 5; Set C
cuucagcggguagggaagggucuuguagccgguc

SEQ ID NO: 30360 - RNA, 33 nt, Artificial Sequence
  Synthetic Oligonucleotide; PRDM1 exon 5; Set C
cuucagcggguagggaagggucuuguagccggu

SEQ ID NO: 30361 - RNA, 37 nt, Artificial Sequence
  Synthetic Oligonucleotide; PRDM1 exon 5; Set C
uucuucagcggguagggaagggucuuguagccgguca

SEQ ID NO: 30362 - RNA, 35 nt, Artificial Sequence
  Synthetic Oligonucleotide; PRDM1 exon 5; Set C
ucuucagcggguagggaagggucuuguagccgguc

SEQ ID NO: 30363 - RNA, 34 nt, Artificial Sequence
  Synthetic Oligonucleotide; PRDM1 exon 5; Set C
ucuucagcggguagggaagggucuuguagccggu

SEQ ID NO: 30364 - RNA, 36 nt, Artificial Sequence
  Synthetic Oligonucleotide; PRDM1 exon 5; Set C
uucuucagcggguagggaagggucuuguagccgguc

SEQ ID NO: 30365 - RNA, 35 nt, Artificial Sequence
  Synthetic Oligonucleotide; PRDM1 exon 5; Set C
uucuucagcggguagggaagggucuuguagccggu

SEQ ID NO: 30366 - RNA, 25 nt, Artificial Sequence
  Synthetic Oligonucleotide; PRDM1 exon 5; Set C
uucagcggguagggaagggucuugu

SEQ ID NO: 30367 - RNA, 25 nt, Artificial Sequence
  Synthetic Oligonucleotide; PRDM1 exon 5; Set B
cuucagcggguagggaagggucuug

SEQ ID NO: 30368 - RNA, 26 nt, Artificial Sequence
  Synthetic Oligonucleotide; PRDM1 exon 5; Set C
ucuucagcggguagggaagggucuug

SEQ ID NO: 30369 - RNA, 29 nt, Artificial Sequence
  Synthetic Oligonucleotide; PRDM1 exon 5; Set C
cuucuucagcggguagggaagggucuugu

SEQ ID NO: 30370 - RNA, 27 nt, Artificial Sequence
  Synthetic Oligonucleotide; PRDM1 exon 5; Set C
uucuucagcggguagggaagggucuug

SEQ ID NO: 30371 - RNA, 30 nt, Artificial Sequence
  Synthetic Oligonucleotide; PRDM1 exon 5; Set C
gcuucuucagcggguagggaagggucuugu

SEQ ID NO: 30372 - RNA, 31 nt, Artificial Sequence
  Synthetic Oligonucleotide; PRDM1 exon 5; Set C
ugcuucuucagcggguagggaagggucuugu

SEQ ID NO: 30373 - RNA, 21 nt, Artificial Sequence
  Synthetic Oligonucleotide; PRDM1 exon 5; Set B
cuucagcggguagggaagggu

SEQ ID NO: 30374 - RNA, 32 nt, Artificial Sequence
  Synthetic Oligonucleotide; PRDM1 exon 5; Set C
cugcuucuucagcggguagggaagggucuugu

SEQ ID NO: 30375 - RNA, 20 nt, Artificial Sequence
  Synthetic Oligonucleotide; PRDM1 exon 5; Set B
cuucagcggguagggaaggg

SEQ ID NO: 30376 - RNA, 33 nt, Artificial Sequence
  Synthetic Oligonucleotide; PRDM1 exon 5; Set C
ucugcuucuucagcggguagggaagggucuugu

SEQ ID NO: 30377 - RNA, 19 nt, Artificial Sequence
  Synthetic Oligonucleotide; PRDM1 exon 5; Set B
cuucagcggguagggaagg

SEQ ID NO: 30378 - RNA, 23 nt, Artificial Sequence
  Synthetic Oligonucleotide; PRDM1 exon 5; Set B
uucuucagcggguagggaagggu

SEQ ID NO: 30379 - RNA, 34 nt, Artificial Sequence
  Synthetic Oligonucleotide; PRDM1 exon 5; Set C
uucugcuucuucagcggguagggaagggucuugu

SEQ ID NO: 30380 - RNA, 22 nt, Artificial Sequence
  Synthetic Oligonucleotide; PRDM1 exon 5; Set B
uucuucagcggguagggaaggg

SEQ ID NO: 30381 - RNA, 24 nt, Artificial Sequence
  Synthetic Oligonucleotide; PRDM1 exon 5; Set B
cuucuucagcggguagggaagggu

SEQ ID NO: 30382 - RNA, 32 nt, Artificial Sequence
  Synthetic Oligonucleotide; PRDM1 exon 5; Set C
ucugcuucuucagcggguagggaagggucuug

SEQ ID NO: 30383 - RNA, 35 nt, Artificial Sequence
  Synthetic Oligonucleotide; PRDM1 exon 5; Set C
guucugcuucuucagcggguagggaagggucuugu

SEQ ID NO: 30384 - RNA, 21 nt, Artificial Sequence
  Synthetic Oligonucleotide; PRDM1 exon 5; Set B
uucuucagcggguagggaagg

SEQ ID NO: 30385 - RNA, 23 nt, Artificial Sequence
  Synthetic Oligonucleotide; PRDM1 exon 5; Set B
cuucuucagcggguagggaaggg

SEQ ID NO: 30386 - RNA, 33 nt, Artificial Sequence
  Synthetic Oligonucleotide; PRDM1 exon 5; Set C
uucugcuucuucagcggguagggaagggucuug

SEQ ID NO: 30387 - RNA, 22 nt, Artificial Sequence
  Synthetic Oligonucleotide; PRDM1 exon 5; Set B
cuucuucagcggguagggaagg

SEQ ID NO: 30388 - RNA, 34 nt, Artificial Sequence
  Synthetic Oligonucleotide; PRDM1 exon 5; Set C
guucugcuucuucagcggguagggaagggucuug

SEQ ID NO: 30389 - RNA, 28 nt, Artificial Sequence
  Synthetic Oligonucleotide; PRDM1 exon 5; Set C
ucugcuucuucagcggguagggaagggu

SEQ ID NO: 30390 - RNA, 27 nt, Artificial Sequence
  Synthetic Oligonucleotide; PRDM1 exon 5; Set C
ucugcuucuucagcggguagggaaggg

SEQ ID NO: 30391 - RNA, 29 nt, Artificial Sequence
  Synthetic Oligonucleotide; PRDM1 exon 5; Set C
uucugcuucuucagcggguagggaagggu

SEQ ID NO: 30392 - RNA, 26 nt, Artificial Sequence
  Synthetic Oligonucleotide; PRDM1 exon 5; Set C
ucugcuucuucagcggguagggaagg

SEQ ID NO: 30393 - RNA, 28 nt, Artificial Sequence
  Synthetic Oligonucleotide; PRDM1 exon 5; Set C
uucugcuucuucagcggguagggaaggg

SEQ ID NO: 30394 - RNA, 30 nt, Artificial Sequence
  Synthetic Oligonucleotide; PRDM1 exon 5; Set C
guucugcuucuucagcggguagggaagggu

SEQ ID NO: 30395 - RNA, 27 nt, Artificial Sequence
  Synthetic Oligonucleotide; PRDM1 exon 5; Set C
uucugcuucuucagcggguagggaagg

SEQ ID NO: 30396 - RNA, 29 nt, Artificial Sequence
  Synthetic Oligonucleotide; PRDM1 exon 5; Set C
guucugcuucuucagcggguagggaaggg

SEQ ID NO: 30397 - RNA, 28 nt, Artificial Sequence
  Synthetic Oligonucleotide; PRDM1 exon 5; Set C
guucugcuucuucagcggguagggaagg

SEQ ID NO: 30398 - RNA, 39 nt, Artificial Sequence
  Synthetic Oligonucleotide; PRDM1 exon 5; Set C
gaucuugccguucugcuucuucagcggguagggaagggu

SEQ ID NO: 30399 - RNA, 38 nt, Artificial Sequence
  Synthetic Oligonucleotide; PRDM1 exon 5; Set C
gaucuugccguucugcuucuucagcggguagggaaggg

SEQ ID NO: 30400 - RNA, 37 nt, Artificial Sequence
  Synthetic Oligonucleotide; PRDM1 exon 5; Set C
gaucuugccguucugcuucuucagcggguagggaagg

SEQ ID NO: 30401 - RNA, 20 nt, Artificial Sequence
  Synthetic Oligonucleotide; PRDM1 exon 5; Set B
gaucuugccguucugcuucu

SEQ ID NO: 30402 - RNA, 18 nt, Artificial Sequence
  Synthetic Oligonucleotide; PRDM1 exon 5; Set C
gauuacacagagggcuag

SEQ ID NO: 30403 - RNA, 25 nt, Artificial Sequence
  Synthetic Oligonucleotide; PRDM1 exon 5; Set A
aaggggcgauuacacagagggcuag

SEQ ID NO: 30404 - RNA, 27 nt, Artificial Sequence
  Synthetic Oligonucleotide; PRDM1 exon 5; Set C
aaaggggcgauuacacagagggcuaga

SEQ ID NO: 30405 - RNA, 26 nt, Artificial Sequence
  Synthetic Oligonucleotide; PRDM1 exon 5; Set A
aaaggggcgauuacacagagggcuag

SEQ ID NO: 30406 - RNA, 28 nt, Artificial Sequence
  Synthetic Oligonucleotide; PRDM1 exon 5; Set A
aaaaggggcgauuacacagagggcuaga

SEQ ID NO: 30407 - RNA, 27 nt, Artificial Sequence
  Synthetic Oligonucleotide; PRDM1 exon 5; Set A
aaaaggggcgauuacacagagggcuag

SEQ ID NO: 30408 - RNA, 25 nt, Artificial Sequence
  Synthetic Oligonucleotide; PRDM1 exon 5; Set A
aaaggggcgauuacacagagggcua

SEQ ID NO: 30409 - RNA, 29 nt, Artificial Sequence
  Synthetic Oligonucleotide; PRDM1 exon 5; Set A
aaaaaggggcgauuacacagagggcuaga

SEQ ID NO: 30410 - RNA, 28 nt, Artificial Sequence
  Synthetic Oligonucleotide; PRDM1 exon 5; Set A
aaaaaggggcgauuacacagagggcuag

SEQ ID NO: 30411 - RNA, 26 nt, Artificial Sequence
  Synthetic Oligonucleotide; PRDM1 exon 5; Set A
aaaaggggcgauuacacagagggcua

SEQ ID NO: 30412 - RNA, 30 nt, Artificial Sequence
  Synthetic Oligonucleotide; PRDM1 exon 5; Set C
gaaaaaggggcgauuacacagagggcuaga

SEQ ID NO: 30413 - RNA, 29 nt, Artificial Sequence
  Synthetic Oligonucleotide; PRDM1 exon 5; Set A
gaaaaaggggcgauuacacagagggcuag

SEQ ID NO: 30414 - RNA, 27 nt, Artificial Sequence
  Synthetic Oligonucleotide; PRDM1 exon 5; Set A
aaaaaggggcgauuacacagagggcua

SEQ ID NO: 30415 - RNA, 25 nt, Artificial Sequence
  Synthetic Oligonucleotide; PRDM1 exon 5; Set A
aaaaggggcgauuacacagagggcu

SEQ ID NO: 30416 - RNA, 31 nt, Artificial Sequence
  Synthetic Oligonucleotide; PRDM1 exon 5; Set C
agaaaaaggggcgauuacacagagggcuaga

SEQ ID NO: 30417 - RNA, 30 nt, Artificial Sequence
  Synthetic Oligonucleotide; PRDM1 exon 5; Set A
agaaaaaggggcgauuacacagagggcuag

SEQ ID NO: 30418 - RNA, 28 nt, Artificial Sequence
  Synthetic Oligonucleotide; PRDM1 exon 5; Set A
gaaaaaggggcgauuacacagagggcua

SEQ ID NO: 30419 - RNA, 26 nt, Artificial Sequence
  Synthetic Oligonucleotide; PRDM1 exon 5; Set A
aaaaaggggcgauuacacagagggcu

SEQ ID NO: 30420 - RNA, 32 nt, Artificial Sequence
  Synthetic Oligonucleotide; PRDM1 exon 5; Set A
aagaaaaaggggcgauuacacagagggcuaga

SEQ ID NO: 30421 - RNA, 31 nt, Artificial Sequence
  Synthetic Oligonucleotide; PRDM1 exon 5; Set A
aagaaaaaggggcgauuacacagagggcuag

SEQ ID NO: 30422 - RNA, 29 nt, Artificial Sequence
  Synthetic Oligonucleotide; PRDM1 exon 5; Set A
agaaaaaggggcgauuacacagagggcua

SEQ ID NO: 30423 - RNA, 25 nt, Artificial Sequence
  Synthetic Oligonucleotide; PRDM1 exon 5; Set A
aaaaaggggcgauuacacagagggc

SEQ ID NO: 30424 - RNA, 27 nt, Artificial Sequence
  Synthetic Oligonucleotide; PRDM1 exon 5; Set A
gaaaaaggggcgauuacacagagggcu

SEQ ID NO: 30425 - RNA, 33 nt, Artificial Sequence
  Synthetic Oligonucleotide; PRDM1 exon 5; Set A
aaagaaaaaggggcgauuacacagagggcuaga

SEQ ID NO: 30426 - RNA, 32 nt, Artificial Sequence
  Synthetic Oligonucleotide; PRDM1 exon 5; Set A
aaagaaaaaggggcgauuacacagagggcuag

SEQ ID NO: 30427 - RNA, 30 nt, Artificial Sequence
  Synthetic Oligonucleotide; PRDM1 exon 5; Set A
aagaaaaaggggcgauuacacagagggcua

SEQ ID NO: 30428 - RNA, 28 nt, Artificial Sequence
  Synthetic Oligonucleotide; PRDM1 exon 5; Set A
agaaaaaggggcgauuacacagagggcu

SEQ ID NO: 30429 - RNA, 26 nt, Artificial Sequence
  Synthetic Oligonucleotide; PRDM1 exon 5; Set A
gaaaaaggggcgauuacacagagggc

SEQ ID NO: 30430 - RNA, 34 nt, Artificial Sequence
  Synthetic Oligonucleotide; PRDM1 exon 5; Set A
uaaagaaaaaggggcgauuacacagagggcuaga

SEQ ID NO: 30431 - RNA, 33 nt, Artificial Sequence
  Synthetic Oligonucleotide; PRDM1 exon 5; Set A
uaaagaaaaaggggcgauuacacagagggcuag

SEQ ID NO: 30432 - RNA, 31 nt, Artificial Sequence
  Synthetic Oligonucleotide; PRDM1 exon 5; Set A
aaagaaaaaggggcgauuacacagagggcua

SEQ ID NO: 30433 - RNA, 29 nt, Artificial Sequence
  Synthetic Oligonucleotide; PRDM1 exon 5; Set A
aagaaaaaggggcgauuacacagagggcu

SEQ ID NO: 30434 - RNA, 27 nt, Artificial Sequence
  Synthetic Oligonucleotide; PRDM1 exon 5; Set A
agaaaaaggggcgauuacacagagggc

SEQ ID NO: 30435 - RNA, 32 nt, Artificial Sequence
  Synthetic Oligonucleotide; PRDM1 exon 5; Set A
uaaagaaaaaggggcgauuacacagagggcua

SEQ ID NO: 30436 - RNA, 30 nt, Artificial Sequence
  Synthetic Oligonucleotide; PRDM1 exon 5; Set A
aaagaaaaaggggcgauuacacagagggcu

SEQ ID NO: 30437 - RNA, 28 nt, Artificial Sequence
  Synthetic Oligonucleotide; PRDM1 exon 5; Set A
aagaaaaaggggcgauuacacagagggc

SEQ ID NO: 30438 - RNA, 31 nt, Artificial Sequence
  Synthetic Oligonucleotide; PRDM1 exon 5; Set A
uaaagaaaaaggggcgauuacacagagggcu

SEQ ID NO: 30439 - RNA, 29 nt, Artificial Sequence
  Synthetic Oligonucleotide; PRDM1 exon 5; Set A
aaagaaaaaggggcgauuacacagagggc

SEQ ID NO: 30440 - RNA, 30 nt, Artificial Sequence
  Synthetic Oligonucleotide; PRDM1 exon 5; Set A
uaaagaaaaaggggcgauuacacagagggc

SEQ ID NO: 30441 - RNA, 31 nt, Artificial Sequence
  Synthetic Oligonucleotide; PRDM1 exon 5; Set A
auaaagaaaaaggggcgauuacacagagggc

SEQ ID NO: 30442 - RNA, 39 nt, Artificial Sequence
  Synthetic Oligonucleotide; PRDM1 exon 5; Set A
ugaaauaaagaaaaaggggcgauuacacagagggcuaga

SEQ ID NO: 30443 - RNA, 35 nt, Artificial Sequence
  Synthetic Oligonucleotide; PRDM1 exon 5; Set A
ugaaauaaagaaaaaggggcgauuacacagagggc

SEQ ID NO: 30444 - RNA, 40 nt, Artificial Sequence
  Synthetic Oligonucleotide; PRDM1 exon 5; Set C
ugugcugaaauaaagaaaaaggggcgauuacacagagggc

SEQ ID NO: 30445 - RNA, 39 nt, Artificial Sequence
  Synthetic Oligonucleotide; PRDM1 exon 5; Set A
uagacugcucuguguuugugcugaaauaaagaaaaaggg

SEQ ID NO: 30446 - RNA, 38 nt, Artificial Sequence
  Synthetic Oligonucleotide; PRDM1 exon 5; Set A
uagacugcucuguguuugugcugaaauaaagaaaaagg

SEQ ID NO: 30447 - RNA, 37 nt, Artificial Sequence
  Synthetic Oligonucleotide; PRDM1 exon 5; Set A
uagacugcucuguguuugugcugaaauaaagaaaaag

SEQ ID NO: 30448 - RNA, 39 nt, Artificial Sequence
  Synthetic Oligonucleotide; PRDM1 exon 5; Set A
uuagacugcucuguguuugugcugaaauaaagaaaaagg

SEQ ID NO: 30449 - RNA, 36 nt, Artificial Sequence
  Synthetic Oligonucleotide; PRDM1 exon 5; Set A
uagacugcucuguguuugugcugaaauaaagaaaaa

SEQ ID NO: 30450 - RNA, 38 nt, Artificial Sequence
  Synthetic Oligonucleotide; PRDM1 exon 5; Set A
uuagacugcucuguguuugugcugaaauaaagaaaaag

SEQ ID NO: 30451 - RNA, 40 nt, Artificial Sequence
  Synthetic Oligonucleotide; PRDM1 exon 5; Set A
uuuagacugcucuguguuugugcugaaauaaagaaaaagg

SEQ ID NO: 30452 - RNA, 35 nt, Artificial Sequence
  Synthetic Oligonucleotide; PRDM1 exon 5; Set A
uagacugcucuguguuugugcugaaauaaagaaaa

SEQ ID NO: 30453 - RNA, 37 nt, Artificial Sequence
  Synthetic Oligonucleotide; PRDM1 exon 5; Set A
uuagacugcucuguguuugugcugaaauaaagaaaaa

SEQ ID NO: 30454 - RNA, 39 nt, Artificial Sequence
  Synthetic Oligonucleotide; PRDM1 exon 5; Set A
uuuagacugcucuguguuugugcugaaauaaagaaaaag

SEQ ID NO: 30455 - RNA, 36 nt, Artificial Sequence
  Synthetic Oligonucleotide; PRDM1 exon 5; Set A
uuagacugcucuguguuugugcugaaauaaagaaaa

SEQ ID NO: 30456 - RNA, 34 nt, Artificial Sequence
  Synthetic Oligonucleotide; PRDM1 exon 5; Set A
uagacugcucuguguuugugcugaaauaaagaaa

SEQ ID NO: 30457 - RNA, 38 nt, Artificial Sequence
  Synthetic Oligonucleotide; PRDM1 exon 5; Set A
uuuagacugcucuguguuugugcugaaauaaagaaaaa

SEQ ID NO: 30458 - RNA, 37 nt, Artificial Sequence
  Synthetic Oligonucleotide; PRDM1 exon 5; Set A
uuuagacugcucuguguuugugcugaaauaaagaaaa

SEQ ID NO: 30459 - RNA, 35 nt, Artificial Sequence
  Synthetic Oligonucleotide; PRDM1 exon 5; Set A
uuagacugcucuguguuugugcugaaauaaagaaa

SEQ ID NO: 30460 - RNA, 33 nt, Artificial Sequence
  Synthetic Oligonucleotide; PRDM1 exon 5; Set A
uagacugcucuguguuugugcugaaauaaagaa

SEQ ID NO: 30461 - RNA, 36 nt, Artificial Sequence
  Synthetic Oligonucleotide; PRDM1 exon 5; Set A
uuuagacugcucuguguuugugcugaaauaaagaaa

SEQ ID NO: 30462 - RNA, 34 nt, Artificial Sequence
  Synthetic Oligonucleotide; PRDM1 exon 5; Set A
uuagacugcucuguguuugugcugaaauaaagaa

SEQ ID NO: 30463 - RNA, 32 nt, Artificial Sequence
  Synthetic Oligonucleotide; PRDM1 exon 5; Set A
uagacugcucuguguuugugcugaaauaaaga

SEQ ID NO: 30464 - RNA, 35 nt, Artificial Sequence
  Synthetic Oligonucleotide; PRDM1 exon 5; Set A
uuuagacugcucuguguuugugcugaaauaaagaa

SEQ ID NO: 30465 - RNA, 33 nt, Artificial Sequence
  Synthetic Oligonucleotide; PRDM1 exon 5; Set A
uuagacugcucuguguuugugcugaaauaaaga

SEQ ID NO: 30466 - RNA, 31 nt, Artificial Sequence
  Synthetic Oligonucleotide; PRDM1 exon 5; Set A
uagacugcucuguguuugugcugaaauaaag

SEQ ID NO: 30467 - RNA, 34 nt, Artificial Sequence
  Synthetic Oligonucleotide; PRDM1 exon 5; Set A
uuuagacugcucuguguuugugcugaaauaaaga

SEQ ID NO: 30468 - RNA, 32 nt, Artificial Sequence
  Synthetic Oligonucleotide; PRDM1 exon 5; Set A
uuagacugcucuguguuugugcugaaauaaag

SEQ ID NO: 30469 - RNA, 30 nt, Artificial Sequence
  Synthetic Oligonucleotide; PRDM1 exon 5; Set A
uagacugcucuguguuugugcugaaauaaa

SEQ ID NO: 30470 - RNA, 29 nt, Artificial Sequence
  Synthetic Oligonucleotide; PRDM1 exon 5; Set A
uagacugcucuguguuugugcugaaauaa

SEQ ID NO: 30471 - RNA, 33 nt, Artificial Sequence
  Synthetic Oligonucleotide; PRDM1 exon 5; Set A
uuuagacugcucuguguuugugcugaaauaaag

SEQ ID NO: 30472 - RNA, 31 nt, Artificial Sequence
  Synthetic Oligonucleotide; PRDM1 exon 5; Set A
uuagacugcucuguguuugugcugaaauaaa

SEQ ID NO: 30473 - RNA, 28 nt, Artificial Sequence
  Synthetic Oligonucleotide; PRDM1 exon 5; Set A
uagacugcucuguguuugugcugaaaua

SEQ ID NO: 30474 - RNA, 30 nt, Artificial Sequence
  Synthetic Oligonucleotide; PRDM1 exon 5; Set A
uuagacugcucuguguuugugcugaaauaa

SEQ ID NO: 30475 - RNA, 32 nt, Artificial Sequence
  Synthetic Oligonucleotide; PRDM1 exon 5; Set A
uuuagacugcucuguguuugugcugaaauaaa

SEQ ID NO: 30476 - RNA, 29 nt, Artificial Sequence
  Synthetic Oligonucleotide; PRDM1 exon 5; Set A
uuagacugcucuguguuugugcugaaaua

SEQ ID NO: 30477 - RNA, 27 nt, Artificial Sequence
  Synthetic Oligonucleotide; PRDM1 exon 5; Set A
uagacugcucuguguuugugcugaaau

SEQ ID NO: 30478 - RNA, 31 nt, Artificial Sequence
  Synthetic Oligonucleotide; PRDM1 exon 5; Set A
uuuagacugcucuguguuugugcugaaauaa

SEQ ID NO: 30479 - RNA, 30 nt, Artificial Sequence
  Synthetic Oligonucleotide; PRDM1 exon 5; Set A
uuuagacugcucuguguuugugcugaaaua

SEQ ID NO: 30480 - RNA, 28 nt, Artificial Sequence
  Synthetic Oligonucleotide; PRDM1 exon 5; Set A
uuagacugcucuguguuugugcugaaau

SEQ ID NO: 30481 - RNA, 40 nt, Artificial Sequence
  Synthetic Oligonucleotide; PRDM1 exon 5; Set A
guugcuuuagacugcucuguguuugugcugaaauaaagaa

SEQ ID NO: 30482 - RNA, 29 nt, Artificial Sequence
  Synthetic Oligonucleotide; PRDM1 exon 5; Set A
uuuagacugcucuguguuugugcugaaau

SEQ ID NO: 30483 - RNA, 27 nt, Artificial Sequence
  Synthetic Oligonucleotide; PRDM1 exon 5; Set A
uuagacugcucuguguuugugcugaaa

SEQ ID NO: 30484 - RNA, 39 nt, Artificial Sequence
  Synthetic Oligonucleotide; PRDM1 exon 5; Set C
guugcuuuagacugcucuguguuugugcugaaauaaaga

SEQ ID NO: 30485 - RNA, 28 nt, Artificial Sequence
  Synthetic Oligonucleotide; PRDM1 exon 5; Set A
uuuagacugcucuguguuugugcugaaa

SEQ ID NO: 30486 - RNA, 38 nt, Artificial Sequence
  Synthetic Oligonucleotide; PRDM1 exon 5; Set A
guugcuuuagacugcucuguguuugugcugaaauaaag

SEQ ID NO: 30487 - RNA, 40 nt, Artificial Sequence
  Synthetic Oligonucleotide; PRDM1 exon 5; Set C
gguugcuuuagacugcucuguguuugugcugaaauaaaga

SEQ ID NO: 30488 - RNA, 27 nt, Artificial Sequence
  Synthetic Oligonucleotide; PRDM1 exon 5; Set A
uuuagacugcucuguguuugugcugaa

SEQ ID NO: 30489 - RNA, 37 nt, Artificial Sequence
  Synthetic Oligonucleotide; PRDM1 exon 5; Set A
guugcuuuagacugcucuguguuugugcugaaauaaa

SEQ ID NO: 30490 - RNA, 39 nt, Artificial Sequence
  Synthetic Oligonucleotide; PRDM1 exon 5; Set C
gguugcuuuagacugcucuguguuugugcugaaauaaag

SEQ ID NO: 30491 - RNA, 36 nt, Artificial Sequence
  Synthetic Oligonucleotide; PRDM1 exon 5; Set C
guugcuuuagacugcucuguguuugugcugaaauaa

SEQ ID NO: 30492 - RNA, 38 nt, Artificial Sequence
  Synthetic Oligonucleotide; PRDM1 exon 5; Set C
gguugcuuuagacugcucuguguuugugcugaaauaaa

SEQ ID NO: 30493 - RNA, 35 nt, Artificial Sequence
  Synthetic Oligonucleotide; PRDM1 exon 5; Set C
guugcuuuagacugcucuguguuugugcugaaaua

SEQ ID NO: 30494 - RNA, 37 nt, Artificial Sequence
  Synthetic Oligonucleotide; PRDM1 exon 5; Set C
gguugcuuuagacugcucuguguuugugcugaaauaa

SEQ ID NO: 30495 - RNA, 34 nt, Artificial Sequence
  Synthetic Oligonucleotide; PRDM1 exon 5; Set C
guugcuuuagacugcucuguguuugugcugaaau

SEQ ID NO: 30496 - RNA, 36 nt, Artificial Sequence
  Synthetic Oligonucleotide; PRDM1 exon 5; Set C
gguugcuuuagacugcucuguguuugugcugaaaua

SEQ ID NO: 30497 - RNA, 33 nt, Artificial Sequence
  Synthetic Oligonucleotide; PRDM1 exon 5; Set C
guugcuuuagacugcucuguguuugugcugaaa

SEQ ID NO: 30498 - RNA, 35 nt, Artificial Sequence
  Synthetic Oligonucleotide; PRDM1 exon 5; Set C
gguugcuuuagacugcucuguguuugugcugaaau

SEQ ID NO: 30499 - RNA, 34 nt, Artificial Sequence
  Synthetic Oligonucleotide; PRDM1 exon 5; Set C
gguugcuuuagacugcucuguguuugugcugaaa

SEQ ID NO: 30500 - RNA, 32 nt, Artificial Sequence
  Synthetic Oligonucleotide; PRDM1 exon 5; Set C
guugcuuuagacugcucuguguuugugcugaa

SEQ ID NO: 30501 - RNA, 33 nt, Artificial Sequence
  Synthetic Oligonucleotide; PRDM1 exon 5; Set C
gguugcuuuagacugcucuguguuugugcugaa

SEQ ID NO: 30502 - RNA, 27 nt, Artificial Sequence
  Synthetic Oligonucleotide; PRDM1 exon 5; Set A
gguugcuuuagacugcucuguguuugu

SEQ ID NO: 30503 - RNA, 29 nt, Artificial Sequence
  Synthetic Oligonucleotide; PRDM1 exon 5; Set A
ucauuuuucucagugcucgguugcuuuag

SEQ ID NO: 30504 - RNA, 28 nt, Artificial Sequence
  Synthetic Oligonucleotide; PRDM1 exon 5; Set A
ucauuuuucucagugcucgguugcuuua

SEQ ID NO: 30505 - RNA, 30 nt, Artificial Sequence
  Synthetic Oligonucleotide; PRDM1 exon 5; Set A
uucauuuuucucagugcucgguugcuuuag

SEQ ID NO: 30506 - RNA, 29 nt, Artificial Sequence
  Synthetic Oligonucleotide; PRDM1 exon 5; Set A
uucauuuuucucagugcucgguugcuuua

SEQ ID NO: 30507 - RNA, 27 nt, Artificial Sequence
  Synthetic Oligonucleotide; PRDM1 exon 5; Set A
ucauuuuucucagugcucgguugcuuu

SEQ ID NO: 30508 - RNA, 31 nt, Artificial Sequence
  Synthetic Oligonucleotide; PRDM1 exon 5; Set A
guucauuuuucucagugcucgguugcuuuag

SEQ ID NO: 30509 - RNA, 30 nt, Artificial Sequence
  Synthetic Oligonucleotide; PRDM1 exon 5; Set A
guucauuuuucucagugcucgguugcuuua

SEQ ID NO: 30510 - RNA, 28 nt, Artificial Sequence
  Synthetic Oligonucleotide; PRDM1 exon 5; Set A
uucauuuuucucagugcucgguugcuuu

SEQ ID NO: 30511 - RNA, 32 nt, Artificial Sequence
  Synthetic Oligonucleotide; PRDM1 exon 5; Set A
aguucauuuuucucagugcucgguugcuuuag

SEQ ID NO: 30512 - RNA, 29 nt, Artificial Sequence
  Synthetic Oligonucleotide; PRDM1 exon 5; Set A
guucauuuuucucagugcucgguugcuuu

SEQ ID NO: 30513 - RNA, 31 nt, Artificial Sequence
  Synthetic Oligonucleotide; PRDM1 exon 5; Set A
aguucauuuuucucagugcucgguugcuuua

SEQ ID NO: 30514 - RNA, 30 nt, Artificial Sequence
  Synthetic Oligonucleotide; PRDM1 exon 5; Set A
aguucauuuuucucagugcucgguugcuuu

SEQ ID NO: 30515 - RNA, 23 nt, Artificial Sequence
  Synthetic Oligonucleotide; PRDM1 exon 5; Set C
uucauuuuucucagugcucgguu

SEQ ID NO: 30516 - RNA, 24 nt, Artificial Sequence
  Synthetic Oligonucleotide; PRDM1 exon 5; Set A
guucauuuuucucagugcucgguu

SEQ ID NO: 30517 - RNA, 25 nt, Artificial Sequence
  Synthetic Oligonucleotide; PRDM1 exon 5; Set A
aguucauuuuucucagugcucgguu

SEQ ID NO: 30518 - RNA, 23 nt, Artificial Sequence
  Synthetic Oligonucleotide; PRDM1 exon 5; Set A
guucauuuuucucagugcucggu

SEQ ID NO: 30519 - RNA, 24 nt, Artificial Sequence
  Synthetic Oligonucleotide; PRDM1 exon 5; Set A
aguucauuuuucucagugcucggu

SEQ ID NO: 30520 - RNA, 19 nt, Artificial Sequence
  Synthetic Oligonucleotide; PRDM1 exon 5; Set C
auucuuugggcagaguuca

SEQ ID NO: 30521 - RNA, 21 nt, Artificial Sequence
  Synthetic Oligonucleotide; PRDM1 exon 5; Set C
acauucuuugggcagaguuca

SEQ ID NO: 30522 - RNA, 22 nt, Artificial Sequence
  Synthetic Oligonucleotide; PRDM1 exon 5; Set A
gacauucuuugggcagaguuca

SEQ ID NO: 30523 - RNA, 23 nt, Artificial Sequence
  Synthetic Oligonucleotide; PRDM1 exon 5; Set A
ggacauucuuugggcagaguuca

SEQ ID NO: 30524 - RNA, 21 nt, Artificial Sequence
  Synthetic Oligonucleotide; PRDM1 exon 5; Set C
gacauucuuugggcagaguuc

SEQ ID NO: 30525 - RNA, 20 nt, Artificial Sequence
  Synthetic Oligonucleotide; PRDM1 exon 5; Set C
gacauucuuugggcagaguu

SEQ ID NO: 30526 - RNA, 22 nt, Artificial Sequence
  Synthetic Oligonucleotide; PRDM1 exon 5; Set A
ggacauucuuugggcagaguuc

SEQ ID NO: 30527 - RNA, 24 nt, Artificial Sequence
  Synthetic Oligonucleotide; PRDM1 exon 5; Set A
gggacauucuuugggcagaguuca

SEQ ID NO: 30528 - RNA, 21 nt, Artificial Sequence
  Synthetic Oligonucleotide; PRDM1 exon 5; Set A
ggacauucuuugggcagaguu

SEQ ID NO: 30529 - RNA, 25 nt, Artificial Sequence
  Synthetic Oligonucleotide; PRDM1 exon 5; Set A
ugggacauucuuugggcagaguuca

SEQ ID NO: 30530 - RNA, 23 nt, Artificial Sequence
  Synthetic Oligonucleotide; PRDM1 exon 5; Set A
gggacauucuuugggcagaguuc

SEQ ID NO: 30531 - RNA, 22 nt, Artificial Sequence
  Synthetic Oligonucleotide; PRDM1 exon 5; Set A
gggacauucuuugggcagaguu

SEQ ID NO: 30532 - RNA, 26 nt, Artificial Sequence
  Synthetic Oligonucleotide; PRDM1 exon 5; Set A
uugggacauucuuugggcagaguuca

SEQ ID NO: 30533 - RNA, 24 nt, Artificial Sequence
  Synthetic Oligonucleotide; PRDM1 exon 5; Set A
ugggacauucuuugggcagaguuc

SEQ ID NO: 30534 - RNA, 20 nt, Artificial Sequence
  Synthetic Oligonucleotide; PRDM1 exon 5; Set A
ggacauucuuugggcagagu

SEQ ID NO: 30535 - RNA, 23 nt, Artificial Sequence
  Synthetic Oligonucleotide; PRDM1 exon 5; Set A
ugggacauucuuugggcagaguu

SEQ ID NO: 30536 - RNA, 25 nt, Artificial Sequence
  Synthetic Oligonucleotide; PRDM1 exon 5; Set A
uugggacauucuuugggcagaguuc

SEQ ID NO: 30537 - RNA, 21 nt, Artificial Sequence
  Synthetic Oligonucleotide; PRDM1 exon 5; Set A
gggacauucuuugggcagagu

SEQ ID NO: 30538 - RNA, 24 nt, Artificial Sequence
  Synthetic Oligonucleotide; PRDM1 exon 5; Set A
uugggacauucuuugggcagaguu

SEQ ID NO: 30539 - RNA, 22 nt, Artificial Sequence
  Synthetic Oligonucleotide; PRDM1 exon 5; Set A
ugggacauucuuugggcagagu

SEQ ID NO: 30540 - RNA, 23 nt, Artificial Sequence
  Synthetic Oligonucleotide; PRDM1 exon 5; Set A
uugggacauucuuugggcagagu

SEQ ID NO: 30541 - RNA, 31 nt, Artificial Sequence
  Synthetic Oligonucleotide; PRDM1 exon 5; Set C
cucucuuugggacauucuuugggcagaguuc

SEQ ID NO: 30542 - RNA, 33 nt, Artificial Sequence
  Synthetic Oligonucleotide; PRDM1 exon 5; Set C
ucucucuuugggacauucuuugggcagaguuca

SEQ ID NO: 30543 - RNA, 30 nt, Artificial Sequence
  Synthetic Oligonucleotide; PRDM1 exon 5; Set C
cucucuuugggacauucuuugggcagaguu

SEQ ID NO: 30544 - RNA, 32 nt, Artificial Sequence
  Synthetic Oligonucleotide; PRDM1 exon 5; Set C
ucucucuuugggacauucuuugggcagaguuc

SEQ ID NO: 30545 - RNA, 31 nt, Artificial Sequence
  Synthetic Oligonucleotide; PRDM1 exon 5; Set C
ucucucuuugggacauucuuugggcagaguu

SEQ ID NO: 30546 - RNA, 29 nt, Artificial Sequence
  Synthetic Oligonucleotide; PRDM1 exon 5; Set C
cucucuuugggacauucuuugggcagagu

SEQ ID NO: 30547 - RNA, 30 nt, Artificial Sequence
  Synthetic Oligonucleotide; PRDM1 exon 5; Set C
ucucucuuugggacauucuuugggcagagu

SEQ ID NO: 30548 - RNA, 40 nt, Artificial Sequence
  Synthetic Oligonucleotide; PRDM1 exon 5; Set C
cacgcuguacucucucuuugggacauucuuugggcagagu

SEQ ID NO: 30549 - RNA, 26 nt, Artificial Sequence
  Synthetic Oligonucleotide; PRDM1 exon 5; Set A
acgcuguacucucucuuugggacauu

SEQ ID NO: 30550 - RNA, 27 nt, Artificial Sequence
  Synthetic Oligonucleotide; PRDM1 exon 5; Set C
cacgcuguacucucucuuugggacauu

SEQ ID NO: 30551 - RNA, 26 nt, Artificial Sequence
  Synthetic Oligonucleotide; PRDM1 exon 5; Set C
cacgcuguacucucucuuugggacau

SEQ ID NO: 30552 - RNA, 27 nt, Artificial Sequence
  Synthetic Oligonucleotide; PRDM1 exon 5; Set C
ucacgcuguacucucucuuugggacau

SEQ ID NO: 30553 - RNA, 25 nt, Artificial Sequence
  Synthetic Oligonucleotide; PRDM1 exon 5; Set C
cacgcuguacucucucuuugggaca

SEQ ID NO: 30554 - RNA, 22 nt, Artificial Sequence
  Synthetic Oligonucleotide; PRDM1 exon 5; Set A
acgcuguacucucucuuuggga

SEQ ID NO: 30555 - RNA, 24 nt, Artificial Sequence
  Synthetic Oligonucleotide; PRDM1 exon 5; Set A
cacgcuguacucucucuuugggac

SEQ ID NO: 30556 - RNA, 28 nt, Artificial Sequence
  Synthetic Oligonucleotide; PRDM1 exon 5; Set C
uucacgcuguacucucucuuugggacau

SEQ ID NO: 30557 - RNA, 26 nt, Artificial Sequence
  Synthetic Oligonucleotide; PRDM1 exon 5; Set C
ucacgcuguacucucucuuugggaca

SEQ ID NO: 30558 - RNA, 23 nt, Artificial Sequence
  Synthetic Oligonucleotide; PRDM1 exon 5; Set A
cacgcuguacucucucuuuggga

SEQ ID NO: 30559 - RNA, 25 nt, Artificial Sequence
  Synthetic Oligonucleotide; PRDM1 exon 5; Set C
ucacgcuguacucucucuuugggac

SEQ ID NO: 30560 - RNA, 29 nt, Artificial Sequence
  Synthetic Oligonucleotide; PRDM1 exon 5; Set C
uuucacgcuguacucucucuuugggacau

SEQ ID NO: 30561 - RNA, 27 nt, Artificial Sequence
  Synthetic Oligonucleotide; PRDM1 exon 5; Set C
uucacgcuguacucucucuuugggaca

SEQ ID NO: 30562 - RNA, 22 nt, Artificial Sequence
  Synthetic Oligonucleotide; PRDM1 exon 5; Set A
cacgcuguacucucucuuuggg

SEQ ID NO: 30563 - RNA, 26 nt, Artificial Sequence
  Synthetic Oligonucleotide; PRDM1 exon 5; Set C
uucacgcuguacucucucuuugggac

SEQ ID NO: 30564 - RNA, 28 nt, Artificial Sequence
  Synthetic Oligonucleotide; PRDM1 exon 5; Set C
uuucacgcuguacucucucuuugggaca

SEQ ID NO: 30565 - RNA, 21 nt, Artificial Sequence
  Synthetic Oligonucleotide; PRDM1 exon 5; Set A
cacgcuguacucucucuuugg

SEQ ID NO: 30566 - RNA, 23 nt, Artificial Sequence
  Synthetic Oligonucleotide; PRDM1 exon 5; Set A
ucacgcuguacucucucuuuggg

SEQ ID NO: 30567 - RNA, 27 nt, Artificial Sequence
  Synthetic Oligonucleotide; PRDM1 exon 5; Set C
uuucacgcuguacucucucuuugggac

SEQ ID NO: 30568 - RNA, 18 nt, Artificial Sequence
  Synthetic Oligonucleotide; PRDM1 exon 5; Set C
acgcuguacucucucuuu

SEQ ID NO: 30569 - RNA, 20 nt, Artificial Sequence
  Synthetic Oligonucleotide; PRDM1 exon 5; Set C
cacgcuguacucucucuuug

SEQ ID NO: 30570 - RNA, 22 nt, Artificial Sequence
  Synthetic Oligonucleotide; PRDM1 exon 5; Set A
ucacgcuguacucucucuuugg

SEQ ID NO: 30571 - RNA, 24 nt, Artificial Sequence
  Synthetic Oligonucleotide; PRDM1 exon 5; Set A
uucacgcuguacucucucuuuggg

SEQ ID NO: 30572 - RNA, 19 nt, Artificial Sequence
  Synthetic Oligonucleotide; PRDM1 exon 5; Set C
cacgcuguacucucucuuu

SEQ ID NO: 30573 - RNA, 21 nt, Artificial Sequence
  Synthetic Oligonucleotide; PRDM1 exon 5; Set A
ucacgcuguacucucucuuug

SEQ ID NO: 30574 - RNA, 23 nt, Artificial Sequence
  Synthetic Oligonucleotide; PRDM1 exon 5; Set A
uucacgcuguacucucucuuugg

SEQ ID NO: 30575 - RNA, 25 nt, Artificial Sequence
  Synthetic Oligonucleotide; PRDM1 exon 5; Set A
uuucacgcuguacucucucuuuggg

SEQ ID NO: 30576 - RNA, 18 nt, Artificial Sequence
  Synthetic Oligonucleotide; PRDM1 exon 5; Set C
cacgcuguacucucucuu

SEQ ID NO: 30577 - RNA, 22 nt, Artificial Sequence
  Synthetic Oligonucleotide; PRDM1 exon 5; Set A
uucacgcuguacucucucuuug

SEQ ID NO: 30578 - RNA, 24 nt, Artificial Sequence
  Synthetic Oligonucleotide; PRDM1 exon 5; Set A
uuucacgcuguacucucucuuugg

SEQ ID NO: 30579 - RNA, 34 nt, Artificial Sequence
  Synthetic Oligonucleotide; PRDM1 exon 5; Set C
auuucuuucacgcuguacucucucuuugggacau

SEQ ID NO: 30580 - RNA, 17 nt, Artificial Sequence
  Synthetic Oligonucleotide; PRDM1 exon 5; Set C
cacgcuguacucucucu

SEQ ID NO: 30581 - RNA, 23 nt, Artificial Sequence
  Synthetic Oligonucleotide; PRDM1 exon 5; Set A
uuucacgcuguacucucucuuug

SEQ ID NO: 30582 - RNA, 35 nt, Artificial Sequence
  Synthetic Oligonucleotide; PRDM1 exon 5; Set C
gauuucuuucacgcuguacucucucuuugggacau

SEQ ID NO: 30583 - RNA, 33 nt, Artificial Sequence
  Synthetic Oligonucleotide; PRDM1 exon 5; Set C
auuucuuucacgcuguacucucucuuugggaca

SEQ ID NO: 30584 - RNA, 18 nt, Artificial Sequence
  Synthetic Oligonucleotide; PRDM1 exon 5; Set C
ucacgcuguacucucucu

SEQ ID NO: 30585 - RNA, 16 nt, Artificial Sequence
  Synthetic Oligonucleotide; PRDM1 exon 5; Set C
cacgcuguacucucuc

SEQ ID NO: 30586 - RNA, 32 nt, Artificial Sequence
  Synthetic Oligonucleotide; PRDM1 exon 5; Set C
auuucuuucacgcuguacucucucuuugggac

SEQ ID NO: 30587 - RNA, 36 nt, Artificial Sequence
  Synthetic Oligonucleotide; PRDM1 exon 5; Set C
ggauuucuuucacgcuguacucucucuuugggacau

SEQ ID NO: 30588 - RNA, 34 nt, Artificial Sequence
  Synthetic Oligonucleotide; PRDM1 exon 5; Set C
gauuucuuucacgcuguacucucucuuugggaca

SEQ ID NO: 30589 - RNA, 19 nt, Artificial Sequence
  Synthetic Oligonucleotide; PRDM1 exon 5; Set C
uucacgcuguacucucucu

SEQ ID NO: 30590 - RNA, 17 nt, Artificial Sequence
  Synthetic Oligonucleotide; PRDM1 exon 5; Set C
ucacgcuguacucucuc

SEQ ID NO: 30591 - RNA, 33 nt, Artificial Sequence
  Synthetic Oligonucleotide; PRDM1 exon 5; Set C
gauuucuuucacgcuguacucucucuuugggac

SEQ ID NO: 30592 - RNA, 37 nt, Artificial Sequence
  Synthetic Oligonucleotide; PRDM1 exon 5; Set C
aggauuucuuucacgcuguacucucucuuugggacau

SEQ ID NO: 30593 - RNA, 35 nt, Artificial Sequence
  Synthetic Oligonucleotide; PRDM1 exon 5; Set C
ggauuucuuucacgcuguacucucucuuugggaca

SEQ ID NO: 30594 - RNA, 18 nt, Artificial Sequence
  Synthetic Oligonucleotide; PRDM1 exon 5; Set C
uucacgcuguacucucuc

SEQ ID NO: 30595 - RNA, 16 nt, Artificial Sequence
  Synthetic Oligonucleotide; PRDM1 exon 5; Set C
ucacgcuguacucucu

SEQ ID NO: 30596 - RNA, 34 nt, Artificial Sequence
  Synthetic Oligonucleotide; PRDM1 exon 5; Set C
ggauuucuuucacgcuguacucucucuuugggac

SEQ ID NO: 30597 - RNA, 38 nt, Artificial Sequence
  Synthetic Oligonucleotide; PRDM1 exon 5; Set C
uaggauuucuuucacgcuguacucucucuuugggacau

SEQ ID NO: 30598 - RNA, 36 nt, Artificial Sequence
  Synthetic Oligonucleotide; PRDM1 exon 5; Set C
aggauuucuuucacgcuguacucucucuuugggaca

SEQ ID NO: 30599 - RNA, 19 nt, Artificial Sequence
  Synthetic Oligonucleotide; PRDM1 exon 5; Set C
uuucacgcuguacucucuc

SEQ ID NO: 30600 - RNA, 17 nt, Artificial Sequence
  Synthetic Oligonucleotide; PRDM1 exon 5; Set C
uucacgcuguacucucu

SEQ ID NO: 30601 - RNA, 29 nt, Artificial Sequence
  Synthetic Oligonucleotide; PRDM1 exon 5; Set A
auuucuuucacgcuguacucucucuuugg

SEQ ID NO: 30602 - RNA, 31 nt, Artificial Sequence
  Synthetic Oligonucleotide; PRDM1 exon 5; Set C
gauuucuuucacgcuguacucucucuuuggg

SEQ ID NO: 30603 - RNA, 35 nt, Artificial Sequence
  Synthetic Oligonucleotide; PRDM1 exon 5; Set C
aggauuucuuucacgcuguacucucucuuugggac

SEQ ID NO: 30604 - RNA, 37 nt, Artificial Sequence
  Synthetic Oligonucleotide; PRDM1 exon 5; Set C
uaggauuucuuucacgcuguacucucucuuugggaca

SEQ ID NO: 30605 - RNA, 18 nt, Artificial Sequence
  Synthetic Oligonucleotide; PRDM1 exon 5; Set C
uuucacgcuguacucucu

SEQ ID NO: 30606 - RNA, 28 nt, Artificial Sequence
  Synthetic Oligonucleotide; PRDM1 exon 5; Set A
auuucuuucacgcuguacucucucuuug

SEQ ID NO: 30607 - RNA, 30 nt, Artificial Sequence
  Synthetic Oligonucleotide; PRDM1 exon 5; Set A
gauuucuuucacgcuguacucucucuuugg

SEQ ID NO: 30608 - RNA, 32 nt, Artificial Sequence
  Synthetic Oligonucleotide; PRDM1 exon 5; Set C
ggauuucuuucacgcuguacucucucuuuggg

SEQ ID NO: 30609 - RNA, 36 nt, Artificial Sequence
  Synthetic Oligonucleotide; PRDM1 exon 5; Set C
uaggauuucuuucacgcuguacucucucuuugggac

SEQ ID NO: 30610 - RNA, 29 nt, Artificial Sequence
  Synthetic Oligonucleotide; PRDM1 exon 5; Set A
gauuucuuucacgcuguacucucucuuug

SEQ ID NO: 30611 - RNA, 31 nt, Artificial Sequence
  Synthetic Oligonucleotide; PRDM1 exon 5; Set C
ggauuucuuucacgcuguacucucucuuugg

SEQ ID NO: 30612 - RNA, 33 nt, Artificial Sequence
  Synthetic Oligonucleotide; PRDM1 exon 5; Set C
aggauuucuuucacgcuguacucucucuuuggg

SEQ ID NO: 30613 - RNA, 17 nt, Artificial Sequence
  Synthetic Oligonucleotide; PRDM1 exon 5; Set C
uuucacgcuguacucuc

SEQ ID NO: 30614 - RNA, 30 nt, Artificial Sequence
  Synthetic Oligonucleotide; PRDM1 exon 5; Set A
ggauuucuuucacgcuguacucucucuuug

SEQ ID NO: 30615 - RNA, 32 nt, Artificial Sequence
  Synthetic Oligonucleotide; PRDM1 exon 5; Set C
aggauuucuuucacgcuguacucucucuuugg

SEQ ID NO: 30616 - RNA, 18 nt, Artificial Sequence
  Synthetic Oligonucleotide; PRDM1 exon 5; Set C
cuuucacgcuguacucuc

SEQ ID NO: 30617 - RNA, 31 nt, Artificial Sequence
  Synthetic Oligonucleotide; PRDM1 exon 5; Set A
aggauuucuuucacgcuguacucucucuuug

SEQ ID NO: 30618 - RNA, 33 nt, Artificial Sequence
  Synthetic Oligonucleotide; PRDM1 exon 5; Set C
uaggauuucuuucacgcuguacucucucuuugg

SEQ ID NO: 30619 - RNA, 19 nt, Artificial Sequence
  Synthetic Oligonucleotide; PRDM1 exon 5; Set C
ucuuucacgcuguacucuc

SEQ ID NO: 30620 - RNA, 17 nt, Artificial Sequence
  Synthetic Oligonucleotide; PRDM1 exon 5; Set C
cuuucacgcuguacucu

SEQ ID NO: 30621 - RNA, 32 nt, Artificial Sequence
  Synthetic Oligonucleotide; PRDM1 exon 5; Set A
uaggauuucuuucacgcuguacucucucuuug

SEQ ID NO: 30622 - RNA, 20 nt, Artificial Sequence
  Synthetic Oligonucleotide; PRDM1 exon 5; Set C
uucuuucacgcuguacucuc

SEQ ID NO: 30623 - RNA, 18 nt, Artificial Sequence
  Synthetic Oligonucleotide; PRDM1 exon 5; Set C
ucuuucacgcuguacucu

SEQ ID NO: 30624 - RNA, 19 nt, Artificial Sequence
  Synthetic Oligonucleotide; PRDM1 exon 5; Set C
uucuuucacgcuguacucu

SEQ ID NO: 30625 - RNA, 22 nt, Artificial Sequence
  Synthetic Oligonucleotide; PRDM1 exon 5; Set C
auuucuuucacgcuguacucuc

SEQ ID NO: 30626 - RNA, 20 nt, Artificial Sequence
  Synthetic Oligonucleotide; PRDM1 exon 5; Set C
uuucuuucacgcuguacucu

SEQ ID NO: 30627 - RNA, 25 nt, Artificial Sequence
  Synthetic Oligonucleotide; PRDM1 exon 5; Set A
ggauuucuuucacgcuguacucucu

SEQ ID NO: 30628 - RNA, 23 nt, Artificial Sequence
  Synthetic Oligonucleotide; PRDM1 exon 5; Set A
gauuucuuucacgcuguacucuc

SEQ ID NO: 30629 - RNA, 21 nt, Artificial Sequence
  Synthetic Oligonucleotide; PRDM1 exon 5; Set C
auuucuuucacgcuguacucu

SEQ ID NO: 30630 - RNA, 24 nt, Artificial Sequence
  Synthetic Oligonucleotide; PRDM1 exon 5; Set A
ggauuucuuucacgcuguacucuc

SEQ ID NO: 30631 - RNA, 22 nt, Artificial Sequence
  Synthetic Oligonucleotide; PRDM1 exon 5; Set C
gauuucuuucacgcuguacucu

SEQ ID NO: 30632 - RNA, 25 nt, Artificial Sequence
  Synthetic Oligonucleotide; PRDM1 exon 5; Set A
aggauuucuuucacgcuguacucuc

SEQ ID NO: 30633 - RNA, 23 nt, Artificial Sequence
  Synthetic Oligonucleotide; PRDM1 exon 5; Set A
ggauuucuuucacgcuguacucu

SEQ ID NO: 30634 - RNA, 26 nt, Artificial Sequence
  Synthetic Oligonucleotide; PRDM1 exon 5; Set A
uaggauuucuuucacgcuguacucuc

SEQ ID NO: 30635 - RNA, 24 nt, Artificial Sequence
  Synthetic Oligonucleotide; PRDM1 exon 5; Set A
aggauuucuuucacgcuguacucu

SEQ ID NO: 30636 - RNA, 25 nt, Artificial Sequence
  Synthetic Oligonucleotide; PRDM1 exon 5; Set A
uaggauuucuuucacgcuguacucu

SEQ ID NO: 30637 - RNA, 40 nt, Artificial Sequence
  Synthetic Oligonucleotide; PRDM1 exon 5; Set C
aguccaauuuuaggauuucuuucacgcuguacucucucuu

SEQ ID NO: 30638 - RNA, 39 nt, Artificial Sequence
  Synthetic Oligonucleotide; PRDM1 exon 5; Set C
aguccaauuuuaggauuucuuucacgcuguacucucucu

SEQ ID NO: 30639 - RNA, 38 nt, Artificial Sequence
  Synthetic Oligonucleotide; PRDM1 exon 5; Set C
aguccaauuuuaggauuucuuucacgcuguacucucuc

SEQ ID NO: 30640 - RNA, 37 nt, Artificial Sequence
  Synthetic Oligonucleotide; PRDM1 exon 5; Set C
aguccaauuuuaggauuucuuucacgcuguacucucu

SEQ ID NO: 30641 - RNA, 37 nt, Artificial Sequence
  Synthetic Oligonucleotide; PRDM1 exon 5; Set C
gaguccaauuuuaggauuucuuucacgcuguacucuc

SEQ ID NO: 30642 - RNA, 38 nt, Artificial Sequence
  Synthetic Oligonucleotide; PRDM1 exon 5; Set C
ggaguccaauuuuaggauuucuuucacgcuguacucuc

SEQ ID NO: 30643 - RNA, 36 nt, Artificial Sequence
  Synthetic Oligonucleotide; PRDM1 exon 5; Set C
gaguccaauuuuaggauuucuuucacgcuguacucu

SEQ ID NO: 30644 - RNA, 39 nt, Artificial Sequence
  Synthetic Oligonucleotide; PRDM1 exon 5; Set C
uggaguccaauuuuaggauuucuuucacgcuguacucuc

SEQ ID NO: 30645 - RNA, 37 nt, Artificial Sequence
  Synthetic Oligonucleotide; PRDM1 exon 5; Set C
ggaguccaauuuuaggauuucuuucacgcuguacucu

SEQ ID NO: 30646 - RNA, 40 nt, Artificial Sequence
  Synthetic Oligonucleotide; PRDM1 exon 5; Set C
uuggaguccaauuuuaggauuucuuucacgcuguacucuc

SEQ ID NO: 30647 - RNA, 38 nt, Artificial Sequence
  Synthetic Oligonucleotide; PRDM1 exon 5; Set C
uggaguccaauuuuaggauuucuuucacgcuguacucu

SEQ ID NO: 30648 - RNA, 39 nt, Artificial Sequence
  Synthetic Oligonucleotide; PRDM1 exon 5; Set C
uuggaguccaauuuuaggauuucuuucacgcuguacucu

SEQ ID NO: 30649 - RNA, 40 nt, Artificial Sequence
  Synthetic Oligonucleotide; PRDM1 exon 5; Set C
guuggaguccaauuuuaggauuucuuucacgcuguacucu

SEQ ID NO: 30650 - RNA, 25 nt, Artificial Sequence
  Synthetic Oligonucleotide; PRDM1 exon 5; Set C
aguccaauuuuaggauuucuuucac

SEQ ID NO: 30651 - RNA, 27 nt, Artificial Sequence
  Synthetic Oligonucleotide; PRDM1 exon 5; Set C
gaguccaauuuuaggauuucuuucacg

SEQ ID NO: 30652 - RNA, 24 nt, Artificial Sequence
  Synthetic Oligonucleotide; PRDM1 exon 5; Set C
aguccaauuuuaggauuucuuuca

SEQ ID NO: 30653 - RNA, 28 nt, Artificial Sequence
  Synthetic Oligonucleotide; PRDM1 exon 5; Set A
ggaguccaauuuuaggauuucuuucacg

SEQ ID NO: 30654 - RNA, 23 nt, Artificial Sequence
  Synthetic Oligonucleotide; PRDM1 exon 5; Set C
aguccaauuuuaggauuucuuuc

SEQ ID NO: 30655 - RNA, 29 nt, Artificial Sequence
  Synthetic Oligonucleotide; PRDM1 exon 5; Set A
uggaguccaauuuuaggauuucuuucacg

SEQ ID NO: 30656 - RNA, 22 nt, Artificial Sequence
  Synthetic Oligonucleotide; PRDM1 exon 5; Set C
aguccaauuuuaggauuucuuu

SEQ ID NO: 30657 - RNA, 30 nt, Artificial Sequence
  Synthetic Oligonucleotide; PRDM1 exon 5; Set A
uuggaguccaauuuuaggauuucuuucacg

SEQ ID NO: 30658 - RNA, 21 nt, Artificial Sequence
  Synthetic Oligonucleotide; PRDM1 exon 5; Set C
aguccaauuuuaggauuucuu

SEQ ID NO: 30659 - RNA, 20 nt, Artificial Sequence
  Synthetic Oligonucleotide; PRDM1 exon 5; Set C
aguccaauuuuaggauuucu

SEQ ID NO: 30660 - RNA, 19 nt, Artificial Sequence
  Synthetic Oligonucleotide; PRDM1 exon 5; Set C
aguccaauuuuaggauuuc

SEQ ID NO: 30661 - RNA, 18 nt, Artificial Sequence
  Synthetic Oligonucleotide; PRDM1 exon 5; Set C
aguccaauuuuaggauuu

SEQ ID NO: 30662 - RNA, 18 nt, Artificial Sequence
  Synthetic Oligonucleotide; PRDM1 exon 5; Set C
gaguccaauuuuaggauu

SEQ ID NO: 30663 - RNA, 17 nt, Artificial Sequence
  Synthetic Oligonucleotide; PRDM1 exon 5; Set C
gaguccaauuuuaggau

SEQ ID NO: 30664 - RNA, 18 nt, Artificial Sequence
  Synthetic Oligonucleotide; PRDM1 exon 5; Set C
ggaguccaauuuuaggau

SEQ ID NO: 30665 - RNA, 16 nt, Artificial Sequence
  Synthetic Oligonucleotide; PRDM1 exon 5; Set C
gaguccaauuuuagga

SEQ ID NO: 30666 - RNA, 17 nt, Artificial Sequence
  Synthetic Oligonucleotide; PRDM1 exon 5; Set C
ggaguccaauuuuagga

SEQ ID NO: 30667 - RNA, 15 nt, Artificial Sequence
  Synthetic Oligonucleotide; PRDM1 exon 5; Set C
gaguccaauuuuagg

SEQ ID NO: 30668 - RNA, 30 nt, Artificial Sequence
  Synthetic Oligonucleotide; PRDM1 exon 5; Set A
agggguuggaguccaauuuuaggauuucuu

SEQ ID NO: 30669 - RNA, 36 nt, Artificial Sequence
  Synthetic Oligonucleotide; PRDM1 exon 5; Set C
uggagggguuggaguccaauuuuaggauuucuuuca

SEQ ID NO: 30670 - RNA, 18 nt, Artificial Sequence
  Synthetic Oligonucleotide; PRDM1 exon 5; Set C
uggaguccaauuuuagga

SEQ ID NO: 30671 - RNA, 16 nt, Artificial Sequence
  Synthetic Oligonucleotide; PRDM1 exon 5; Set C
ggaguccaauuuuagg

SEQ ID NO: 30672 - RNA, 29 nt, Artificial Sequence
  Synthetic Oligonucleotide; PRDM1 exon 5; Set A
agggguuggaguccaauuuuaggauuucu

SEQ ID NO: 30673 - RNA, 31 nt, Artificial Sequence
  Synthetic Oligonucleotide; PRDM1 exon 5; Set A
gagggguuggaguccaauuuuaggauuucuu

SEQ ID NO: 30674 - RNA, 37 nt, Artificial Sequence
  Synthetic Oligonucleotide; PRDM1 exon 5; Set C
uuggagggguuggaguccaauuuuaggauuucuuuca

SEQ ID NO: 30675 - RNA, 35 nt, Artificial Sequence
  Synthetic Oligonucleotide; PRDM1 exon 5; Set C
uggagggguuggaguccaauuuuaggauuucuuuc

SEQ ID NO: 30676 - RNA, 15 nt, Artificial Sequence
  Synthetic Oligonucleotide; PRDM1 exon 5; Set C
ggaguccaauuuuag

SEQ ID NO: 30677 - RNA, 19 nt, Artificial Sequence
  Synthetic Oligonucleotide; PRDM1 exon 5; Set C
uuggaguccaauuuuagga

SEQ ID NO: 30678 - RNA, 17 nt, Artificial Sequence
  Synthetic Oligonucleotide; PRDM1 exon 5; Set C
uggaguccaauuuuagg

SEQ ID NO: 30679 - RNA, 28 nt, Artificial Sequence
  Synthetic Oligonucleotide; PRDM1 exon 5; Set A
agggguuggaguccaauuuuaggauuuc

SEQ ID NO: 30680 - RNA, 30 nt, Artificial Sequence
  Synthetic Oligonucleotide; PRDM1 exon 5; Set A
gagggguuggaguccaauuuuaggauuucu

SEQ ID NO: 30681 - RNA, 32 nt, Artificial Sequence
  Synthetic Oligonucleotide; PRDM1 exon 5; Set C
ggagggguuggaguccaauuuuaggauuucuu

SEQ ID NO: 30682 - RNA, 36 nt, Artificial Sequence
  Synthetic Oligonucleotide; PRDM1 exon 5; Set C
uuggagggguuggaguccaauuuuaggauuucuuuc

SEQ ID NO: 30683 - RNA, 34 nt, Artificial Sequence
  Synthetic Oligonucleotide; PRDM1 exon 5; Set C
uggagggguuggaguccaauuuuaggauuucuuu

SEQ ID NO: 30684 - RNA, 16 nt, Artificial Sequence
  Synthetic Oligonucleotide; PRDM1 exon 5; Set C
uggaguccaauuuuag

SEQ ID NO: 30685 - RNA, 18 nt, Artificial Sequence
  Synthetic Oligonucleotide; PRDM1 exon 5; Set C
uuggaguccaauuuuagg

SEQ ID NO: 30686 - RNA, 27 nt, Artificial Sequence
  Synthetic Oligonucleotide; PRDM1 exon 5; Set A
agggguuggaguccaauuuuaggauuu

SEQ ID NO: 30687 - RNA, 29 nt, Artificial Sequence
  Synthetic Oligonucleotide; PRDM1 exon 5; Set A
gagggguuggaguccaauuuuaggauuuc

SEQ ID NO: 30688 - RNA, 33 nt, Artificial Sequence
  Synthetic Oligonucleotide; PRDM1 exon 5; Set C
uggagggguuggaguccaauuuuaggauuucuu

SEQ ID NO: 30689 - RNA, 31 nt, Artificial Sequence
  Synthetic Oligonucleotide; PRDM1 exon 5; Set C
ggagggguuggaguccaauuuuaggauuucu

SEQ ID NO: 30690 - RNA, 35 nt, Artificial Sequence
  Synthetic Oligonucleotide; PRDM1 exon 5; Set C
uuggagggguuggaguccaauuuuaggauuucuuu

SEQ ID NO: 30691 - RNA, 17 nt, Artificial Sequence
  Synthetic Oligonucleotide; PRDM1 exon 5; Set C
uuggaguccaauuuuag

SEQ ID NO: 30692 - RNA, 19 nt, Artificial Sequence
  Synthetic Oligonucleotide; PRDM1 exon 5; Set C
guuggaguccaauuuuagg

SEQ ID NO: 30693 - RNA, 28 nt, Artificial Sequence
  Synthetic Oligonucleotide; PRDM1 exon 5; Set A
gagggguuggaguccaauuuuaggauuu

SEQ ID NO: 30694 - RNA, 30 nt, Artificial Sequence
  Synthetic Oligonucleotide; PRDM1 exon 5; Set A
ggagggguuggaguccaauuuuaggauuuc

SEQ ID NO: 30695 - RNA, 34 nt, Artificial Sequence
  Synthetic Oligonucleotide; PRDM1 exon 5; Set C
uuggagggguuggaguccaauuuuaggauuucuu

SEQ ID NO: 30696 - RNA, 32 nt, Artificial Sequence
  Synthetic Oligonucleotide; PRDM1 exon 5; Set C
uggagggguuggaguccaauuuuaggauuucu

SEQ ID NO: 30697 - RNA, 18 nt, Artificial Sequence
  Synthetic Oligonucleotide; PRDM1 exon 5; Set C
guuggaguccaauuuuag

SEQ ID NO: 30698 - RNA, 29 nt, Artificial Sequence
  Synthetic Oligonucleotide; PRDM1 exon 5; Set A
ggagggguuggaguccaauuuuaggauuu

SEQ ID NO: 30699 - RNA, 31 nt, Artificial Sequence
  Synthetic Oligonucleotide; PRDM1 exon 5; Set A
uggagggguuggaguccaauuuuaggauuuc

SEQ ID NO: 30700 - RNA, 33 nt, Artificial Sequence
  Synthetic Oligonucleotide; PRDM1 exon 5; Set C
uuggagggguuggaguccaauuuuaggauuucu

SEQ ID NO: 30701 - RNA, 30 nt, Artificial Sequence
  Synthetic Oligonucleotide; PRDM1 exon 5; Set A
uggagggguuggaguccaauuuuaggauuu

SEQ ID NO: 30702 - RNA, 32 nt, Artificial Sequence
  Synthetic Oligonucleotide; PRDM1 exon 5; Set A
uuggagggguuggaguccaauuuuaggauuuc

SEQ ID NO: 30703 - RNA, 31 nt, Artificial Sequence
  Synthetic Oligonucleotide; PRDM1 exon 5; Set A
uuggagggguuggaguccaauuuuaggauuu

SEQ ID NO: 30704 - RNA, 20 nt, Artificial Sequence
  Synthetic Oligonucleotide; PRDM1 exon 5; Set C
agggguuggaguccaauuuu

SEQ ID NO: 30705 - RNA, 24 nt, Artificial Sequence
  Synthetic Oligonucleotide; PRDM1 exon 5; Set A
uggagggguuggaguccaauuuua

SEQ ID NO: 30706 - RNA, 23 nt, Artificial Sequence
  Synthetic Oligonucleotide; PRDM1 exon 5; Set A
uggagggguuggaguccaauuuu

SEQ ID NO: 30707 - RNA, 25 nt, Artificial Sequence
  Synthetic Oligonucleotide; PRDM1 exon 5; Set A
uuggagggguuggaguccaauuuua

SEQ ID NO: 30708 - RNA, 24 nt, Artificial Sequence
  Synthetic Oligonucleotide; PRDM1 exon 5; Set A
uuggagggguuggaguccaauuuu

SEQ ID NO: 30709 - RNA, 22 nt, Artificial Sequence
  Synthetic Oligonucleotide; PRDM1 exon 5; Set A
uggagggguuggaguccaauuu

SEQ ID NO: 30710 - RNA, 36 nt, Artificial Sequence
  Synthetic Oligonucleotide; PRDM1 exon 5; Set C
uuuccuuuggagggguuggaguccaauuuuaggauu

SEQ ID NO: 30711 - RNA, 23 nt, Artificial Sequence
  Synthetic Oligonucleotide; PRDM1 exon 5; Set A
uuggagggguuggaguccaauuu

SEQ ID NO: 30712 - RNA, 35 nt, Artificial Sequence
  Synthetic Oligonucleotide; PRDM1 exon 5; Set C
uuuccuuuggagggguuggaguccaauuuuaggau

SEQ ID NO: 30713 - RNA, 34 nt, Artificial Sequence
  Synthetic Oligonucleotide; PRDM1 exon 5; Set C
uuuccuuuggagggguuggaguccaauuuuagga

SEQ ID NO: 30714 - RNA, 33 nt, Artificial Sequence
  Synthetic Oligonucleotide; PRDM1 exon 5; Set C
uuuccuuuggagggguuggaguccaauuuuagg

SEQ ID NO: 30715 - RNA, 32 nt, Artificial Sequence
  Synthetic Oligonucleotide; PRDM1 exon 5; Set A
uuuccuuuggagggguuggaguccaauuuuag

SEQ ID NO: 30716 - RNA, 40 nt, Artificial Sequence
  Synthetic Oligonucleotide; PRDM1 exon 5; Set C
gguccuuuccuuuggagggguuggaguccaauuuuaggau

SEQ ID NO: 30717 - RNA, 39 nt, Artificial Sequence
  Synthetic Oligonucleotide; PRDM1 exon 5; Set C
gguccuuuccuuuggagggguuggaguccaauuuuagga

SEQ ID NO: 30718 - RNA, 38 nt, Artificial Sequence
  Synthetic Oligonucleotide; PRDM1 exon 5; Set C
gguccuuuccuuuggagggguuggaguccaauuuuagg

SEQ ID NO: 30719 - RNA, 16 nt, Artificial Sequence
  Synthetic Oligonucleotide; PRDM1 exon 5; Set C
uuggagggguuggagu

SEQ ID NO: 30720 - RNA, 37 nt, Artificial Sequence
  Synthetic Oligonucleotide; PRDM1 exon 5; Set C
gguccuuuccuuuggagggguuggaguccaauuuuag

SEQ ID NO: 30721 - RNA, 22 nt, Artificial Sequence
  Synthetic Oligonucleotide; PRDM1 exon 5; Set A
uuuccuuuggagggguuggagu

SEQ ID NO: 30722 - RNA, 27 nt, Artificial Sequence
  Synthetic Oligonucleotide; PRDM1 exon 5; Set C
gguccuuuccuuuggagggguuggagu

SEQ ID NO: 30723 - RNA, 19 nt, Artificial Sequence
  Synthetic Oligonucleotide; PRDM1 exon 5; Set C
agguccuuuccuuuggagg

SEQ ID NO: 30724 - RNA, 20 nt, Artificial Sequence
  Synthetic Oligonucleotide; PRDM1 exon 5; Set A
gagguccuuuccuuuggagg

SEQ ID NO: 30725 - RNA, 21 nt, Artificial Sequence
  Synthetic Oligonucleotide; PRDM1 exon 5; Set A
agagguccuuuccuuuggagg

SEQ ID NO: 30726 - RNA, 19 nt, Artificial Sequence
  Synthetic Oligonucleotide; PRDM1 exon 5; Set C
gagguccuuuccuuuggag

SEQ ID NO: 30727 - RNA, 16 nt, Artificial Sequence
  Synthetic Oligonucleotide; PRDM1 exon 5; Set C
agguccuuuccuuugg

SEQ ID NO: 30728 - RNA, 22 nt, Artificial Sequence
  Synthetic Oligonucleotide; PRDM1 exon 5; Set A
uagagguccuuuccuuuggagg

SEQ ID NO: 30729 - RNA, 20 nt, Artificial Sequence
  Synthetic Oligonucleotide; PRDM1 exon 5; Set C
agagguccuuuccuuuggag

SEQ ID NO: 30730 - RNA, 18 nt, Artificial Sequence
  Synthetic Oligonucleotide; PRDM1 exon 5; Set C
gagguccuuuccuuugga

SEQ ID NO: 30731 - RNA, 39 nt, Artificial Sequence
  Synthetic Oligonucleotide; PRDM1 exon 5; Set C
uuagaacgguagagguccuuuccuuuggagggguuggag

SEQ ID NO: 30732 - RNA, 15 nt, Artificial Sequence
  Synthetic Oligonucleotide; PRDM1 exon 5; Set C
agguccuuuccuuug

SEQ ID NO: 30733 - RNA, 17 nt, Artificial Sequence
  Synthetic Oligonucleotide; PRDM1 exon 5; Set C
gagguccuuuccuuugg

SEQ ID NO: 30734 - RNA, 23 nt, Artificial Sequence
  Synthetic Oligonucleotide; PRDM1 exon 5; Set A
guagagguccuuuccuuuggagg

SEQ ID NO: 30735 - RNA, 21 nt, Artificial Sequence
  Synthetic Oligonucleotide; PRDM1 exon 5; Set C
uagagguccuuuccuuuggag

SEQ ID NO: 30736 - RNA, 19 nt, Artificial Sequence
  Synthetic Oligonucleotide; PRDM1 exon 5; Set C
agagguccuuuccuuugga

SEQ ID NO: 30737 - RNA, 38 nt, Artificial Sequence
  Synthetic Oligonucleotide; PRDM1 exon 5; Set C
uuagaacgguagagguccuuuccuuuggagggguugga

SEQ ID NO: 30738 - RNA, 16 nt, Artificial Sequence
  Synthetic Oligonucleotide; PRDM1 exon 5; Set C
gagguccuuuccuuug

SEQ ID NO: 30739 - RNA, 18 nt, Artificial Sequence
  Synthetic Oligonucleotide; PRDM1 exon 5; Set C
agagguccuuuccuuugg

SEQ ID NO: 30740 - RNA, 22 nt, Artificial Sequence
  Synthetic Oligonucleotide; PRDM1 exon 5; Set A
guagagguccuuuccuuuggag

SEQ ID NO: 30741 - RNA, 20 nt, Artificial Sequence
  Synthetic Oligonucleotide; PRDM1 exon 5; Set C
uagagguccuuuccuuugga

SEQ ID NO: 30742 - RNA, 37 nt, Artificial Sequence
  Synthetic Oligonucleotide; PRDM1 exon 5; Set C
uuagaacgguagagguccuuuccuuuggagggguugg

SEQ ID NO: 30743 - RNA, 17 nt, Artificial Sequence
  Synthetic Oligonucleotide; PRDM1 exon 5; Set C
agagguccuuuccuuug

SEQ ID NO: 30744 - RNA, 19 nt, Artificial Sequence
  Synthetic Oligonucleotide; PRDM1 exon 5; Set C
uagagguccuuuccuuugg

SEQ ID NO: 30745 - RNA, 21 nt, Artificial Sequence
  Synthetic Oligonucleotide; PRDM1 exon 5; Set A
guagagguccuuuccuuugga

SEQ ID NO: 30746 - RNA, 36 nt, Artificial Sequence
  Synthetic Oligonucleotide; PRDM1 exon 5; Set C
uuagaacgguagagguccuuuccuuuggagggguug

SEQ ID NO: 30747 - RNA, 18 nt, Artificial Sequence
  Synthetic Oligonucleotide; PRDM1 exon 5; Set C
uagagguccuuuccuuug

SEQ ID NO: 30748 - RNA, 20 nt, Artificial Sequence
  Synthetic Oligonucleotide; PRDM1 exon 5; Set C
guagagguccuuuccuuugg

SEQ ID NO: 30749 - RNA, 35 nt, Artificial Sequence
  Synthetic Oligonucleotide; PRDM1 exon 5; Set C
uuagaacgguagagguccuuuccuuuggagggguu

SEQ ID NO: 30750 - RNA, 19 nt, Artificial Sequence
  Synthetic Oligonucleotide; PRDM1 exon 5; Set C
guagagguccuuuccuuug

SEQ ID NO: 30751 - RNA, 34 nt, Artificial Sequence
  Synthetic Oligonucleotide; PRDM1 exon 5; Set C
uuagaacgguagagguccuuuccuuuggaggggu

SEQ ID NO: 30752 - RNA, 33 nt, Artificial Sequence
  Synthetic Oligonucleotide; PRDM1 exon 5; Set C
uuagaacgguagagguccuuuccuuuggagggg

SEQ ID NO: 30753 - RNA, 32 nt, Artificial Sequence
  Synthetic Oligonucleotide; PRDM1 exon 5; Set C
uuagaacgguagagguccuuuccuuuggaggg

SEQ ID NO: 30754 - RNA, 35 nt, Artificial Sequence
  Synthetic Oligonucleotide; PRDM1 exon 5; Set C
aauguuagaacgguagagguccuuuccuuuggagg

SEQ ID NO: 30755 - RNA, 26 nt, Artificial Sequence
  Synthetic Oligonucleotide; PRDM1 exon 5; Set A
uuagaacgguagagguccuuuccuuu

SEQ ID NO: 30756 - RNA, 30 nt, Artificial Sequence
  Synthetic Oligonucleotide; PRDM1 exon 5; Set A
uguuagaacgguagagguccuuuccuuugg

SEQ ID NO: 30757 - RNA, 36 nt, Artificial Sequence
  Synthetic Oligonucleotide; PRDM1 exon 5; Set C
aaauguuagaacgguagagguccuuuccuuuggagg

SEQ ID NO: 30758 - RNA, 25 nt, Artificial Sequence
  Synthetic Oligonucleotide; PRDM1 exon 5; Set A
uuagaacgguagagguccuuuccuu

SEQ ID NO: 30759 - RNA, 29 nt, Artificial Sequence
  Synthetic Oligonucleotide; PRDM1 exon 5; Set A
uguuagaacgguagagguccuuuccuuug

SEQ ID NO: 30760 - RNA, 31 nt, Artificial Sequence
  Synthetic Oligonucleotide; PRDM1 exon 5; Set A
auguuagaacgguagagguccuuuccuuugg

SEQ ID NO: 30761 - RNA, 37 nt, Artificial Sequence
  Synthetic Oligonucleotide; PRDM1 exon 5; Set C
gaaauguuagaacgguagagguccuuuccuuuggagg

SEQ ID NO: 30762 - RNA, 24 nt, Artificial Sequence
  Synthetic Oligonucleotide; PRDM1 exon 5; Set A
uuagaacgguagagguccuuuccu

SEQ ID NO: 30763 - RNA, 30 nt, Artificial Sequence
  Synthetic Oligonucleotide; PRDM1 exon 5; Set A
auguuagaacgguagagguccuuuccuuug

SEQ ID NO: 30764 - RNA, 32 nt, Artificial Sequence
  Synthetic Oligonucleotide; PRDM1 exon 5; Set A
aauguuagaacgguagagguccuuuccuuugg

SEQ ID NO: 30765 - RNA, 38 nt, Artificial Sequence
  Synthetic Oligonucleotide; PRDM1 exon 5; Set C
ugaaauguuagaacgguagagguccuuuccuuuggagg

SEQ ID NO: 30766 - RNA, 36 nt, Artificial Sequence
  Synthetic Oligonucleotide; PRDM1 exon 5; Set A
gaaauguuagaacgguagagguccuuuccuuuggag

SEQ ID NO: 30767 - RNA, 31 nt, Artificial Sequence
  Synthetic Oligonucleotide; PRDM1 exon 5; Set A
aauguuagaacgguagagguccuuuccuuug

SEQ ID NO: 30768 - RNA, 33 nt, Artificial Sequence
  Synthetic Oligonucleotide; PRDM1 exon 5; Set A
aaauguuagaacgguagagguccuuuccuuugg

SEQ ID NO: 30769 - RNA, 39 nt, Artificial Sequence
  Synthetic Oligonucleotide; PRDM1 exon 5; Set C
gugaaauguuagaacgguagagguccuuuccuuuggagg

SEQ ID NO: 30770 - RNA, 37 nt, Artificial Sequence
  Synthetic Oligonucleotide; PRDM1 exon 5; Set C
ugaaauguuagaacgguagagguccuuuccuuuggag

SEQ ID NO: 30771 - RNA, 32 nt, Artificial Sequence
  Synthetic Oligonucleotide; PRDM1 exon 5; Set A
aaauguuagaacgguagagguccuuuccuuug

SEQ ID NO: 30772 - RNA, 34 nt, Artificial Sequence
  Synthetic Oligonucleotide; PRDM1 exon 5; Set A
gaaauguuagaacgguagagguccuuuccuuugg

SEQ ID NO: 30773 - RNA, 40 nt, Artificial Sequence
  Synthetic Oligonucleotide; PRDM1 exon 5; Set C
ggugaaauguuagaacgguagagguccuuuccuuuggagg

SEQ ID NO: 30774 - RNA, 38 nt, Artificial Sequence
  Synthetic Oligonucleotide; PRDM1 exon 5; Set C
gugaaauguuagaacgguagagguccuuuccuuuggag

SEQ ID NO: 30775 - RNA, 36 nt, Artificial Sequence
  Synthetic Oligonucleotide; PRDM1 exon 5; Set C
ugaaauguuagaacgguagagguccuuuccuuugga

SEQ ID NO: 30776 - RNA, 33 nt, Artificial Sequence
  Synthetic Oligonucleotide; PRDM1 exon 5; Set A
gaaauguuagaacgguagagguccuuuccuuug

SEQ ID NO: 30777 - RNA, 35 nt, Artificial Sequence
  Synthetic Oligonucleotide; PRDM1 exon 5; Set A
ugaaauguuagaacgguagagguccuuuccuuugg

SEQ ID NO: 30778 - RNA, 39 nt, Artificial Sequence
  Synthetic Oligonucleotide; PRDM1 exon 5; Set C
ggugaaauguuagaacgguagagguccuuuccuuuggag

SEQ ID NO: 30779 - RNA, 37 nt, Artificial Sequence
  Synthetic Oligonucleotide; PRDM1 exon 5; Set C
gugaaauguuagaacgguagagguccuuuccuuugga

SEQ ID NO: 30780 - RNA, 22 nt, Artificial Sequence
  Synthetic Oligonucleotide; PRDM1 exon 5; Set C
guuagaacgguagagguccuuu

SEQ ID NO: 30781 - RNA, 34 nt, Artificial Sequence
  Synthetic Oligonucleotide; PRDM1 exon 5; Set A
ugaaauguuagaacgguagagguccuuuccuuug

SEQ ID NO: 30782 - RNA, 36 nt, Artificial Sequence
  Synthetic Oligonucleotide; PRDM1 exon 5; Set C
gugaaauguuagaacgguagagguccuuuccuuugg

SEQ ID NO: 30783 - RNA, 40 nt, Artificial Sequence
  Synthetic Oligonucleotide; PRDM1 exon 5; Set C
gggugaaauguuagaacgguagagguccuuuccuuuggag

SEQ ID NO: 30784 - RNA, 38 nt, Artificial Sequence
  Synthetic Oligonucleotide; PRDM1 exon 5; Set C
ggugaaauguuagaacgguagagguccuuuccuuugga

SEQ ID NO: 30785 - RNA, 23 nt, Artificial Sequence
  Synthetic Oligonucleotide; PRDM1 exon 5; Set A
uguuagaacgguagagguccuuu

SEQ ID NO: 30786 - RNA, 35 nt, Artificial Sequence
  Synthetic Oligonucleotide; PRDM1 exon 5; Set A
gugaaauguuagaacgguagagguccuuuccuuug

SEQ ID NO: 30787 - RNA, 37 nt, Artificial Sequence
  Synthetic Oligonucleotide; PRDM1 exon 5; Set C
ggugaaauguuagaacgguagagguccuuuccuuugg

SEQ ID NO: 30788 - RNA, 39 nt, Artificial Sequence
  Synthetic Oligonucleotide; PRDM1 exon 5; Set C
gggugaaauguuagaacgguagagguccuuuccuuugga

SEQ ID NO: 30789 - RNA, 24 nt, Artificial Sequence
  Synthetic Oligonucleotide; PRDM1 exon 5; Set A
auguuagaacgguagagguccuuu

SEQ ID NO: 30790 - RNA, 36 nt, Artificial Sequence
  Synthetic Oligonucleotide; PRDM1 exon 5; Set C
ggugaaauguuagaacgguagagguccuuuccuuug

SEQ ID NO: 30791 - RNA, 38 nt, Artificial Sequence
  Synthetic Oligonucleotide; PRDM1 exon 5; Set C
gggugaaauguuagaacgguagagguccuuuccuuugg

SEQ ID NO: 30792 - RNA, 40 nt, Artificial Sequence
  Synthetic Oligonucleotide; PRDM1 exon 5; Set C
ggggugaaauguuagaacgguagagguccuuuccuuugga

SEQ ID NO: 30793 - RNA, 25 nt, Artificial Sequence
  Synthetic Oligonucleotide; PRDM1 exon 5; Set C
aauguuagaacgguagagguccuuu

SEQ ID NO: 30794 - RNA, 37 nt, Artificial Sequence
  Synthetic Oligonucleotide; PRDM1 exon 5; Set C
gggugaaauguuagaacgguagagguccuuuccuuug

SEQ ID NO: 30795 - RNA, 39 nt, Artificial Sequence
  Synthetic Oligonucleotide; PRDM1 exon 5; Set C
ggggugaaauguuagaacgguagagguccuuuccuuugg

SEQ ID NO: 30796 - RNA, 26 nt, Artificial Sequence
  Synthetic Oligonucleotide; PRDM1 exon 5; Set C
aaauguuagaacgguagagguccuuu

SEQ ID NO: 30797 - RNA, 38 nt, Artificial Sequence
  Synthetic Oligonucleotide; PRDM1 exon 5; Set C
ggggugaaauguuagaacgguagagguccuuuccuuug

SEQ ID NO: 30798 - RNA, 40 nt, Artificial Sequence
  Synthetic Oligonucleotide; PRDM1 exon 5; Set C
aggggugaaauguuagaacgguagagguccuuuccuuugg

SEQ ID NO: 30799 - RNA, 27 nt, Artificial Sequence
  Synthetic Oligonucleotide; PRDM1 exon 5; Set A
gaaauguuagaacgguagagguccuuu

SEQ ID NO: 30800 - RNA, 39 nt, Artificial Sequence
  Synthetic Oligonucleotide; PRDM1 exon 5; Set C
aggggugaaauguuagaacgguagagguccuuuccuuug

SEQ ID NO: 30801 - RNA, 28 nt, Artificial Sequence
  Synthetic Oligonucleotide; PRDM1 exon 5; Set A
ugaaauguuagaacgguagagguccuuu

SEQ ID NO: 30802 - RNA, 40 nt, Artificial Sequence
  Synthetic Oligonucleotide; PRDM1 exon 5; Set C
gaggggugaaauguuagaacgguagagguccuuuccuuug

SEQ ID NO: 30803 - RNA, 29 nt, Artificial Sequence
  Synthetic Oligonucleotide; PRDM1 exon 5; Set A
gugaaauguuagaacgguagagguccuuu

SEQ ID NO: 30804 - RNA, 30 nt, Artificial Sequence
  Synthetic Oligonucleotide; PRDM1 exon 5; Set A
ggugaaauguuagaacgguagagguccuuu

SEQ ID NO: 30805 - RNA, 31 nt, Artificial Sequence
  Synthetic Oligonucleotide; PRDM1 exon 5; Set A
gggugaaauguuagaacgguagagguccuuu

SEQ ID NO: 30806 - RNA, 32 nt, Artificial Sequence
  Synthetic Oligonucleotide; PRDM1 exon 5; Set C
ggggugaaauguuagaacgguagagguccuuu

SEQ ID NO: 30807 - RNA, 33 nt, Artificial Sequence
  Synthetic Oligonucleotide; PRDM1 exon 5; Set C
aggggugaaauguuagaacgguagagguccuuu

SEQ ID NO: 30808 - RNA, 34 nt, Artificial Sequence
  Synthetic Oligonucleotide; PRDM1 exon 5; Set C
gaggggugaaauguuagaacgguagagguccuuu

SEQ ID NO: 30809 - RNA, 35 nt, Artificial Sequence
  Synthetic Oligonucleotide; PRDM1 exon 5; Set C
ugaggggugaaauguuagaacgguagagguccuuu

SEQ ID NO: 30810 - RNA, 32 nt, Artificial Sequence
  Synthetic Oligonucleotide; PRDM1 exon 5; Set A
gguccuuuucugaugugaggggugaaauguua

SEQ ID NO: 30811 - RNA, 33 nt, Artificial Sequence
  Synthetic Oligonucleotide; PRDM1 exon 5; Set A
agguccuuuucugaugugaggggugaaauguua

SEQ ID NO: 30812 - RNA, 37 nt, Artificial Sequence
  Synthetic Oligonucleotide; PRDM1 exon 5; Set C
caucgagguccuuuucugaugugaggggugaaauguu

SEQ ID NO: 30813 - RNA, 39 nt, Artificial Sequence
  Synthetic Oligonucleotide; PRDM1 exon 5; Set C
ucaucgagguccuuuucugaugugaggggugaaauguua

SEQ ID NO: 30814 - RNA, 36 nt, Artificial Sequence
  Synthetic Oligonucleotide; PRDM1 exon 5; Set C
caucgagguccuuuucugaugugaggggugaaaugu

SEQ ID NO: 30815 - RNA, 40 nt, Artificial Sequence
  Synthetic Oligonucleotide; PRDM1 exon 5; Set C
gucaucgagguccuuuucugaugugaggggugaaauguua

SEQ ID NO: 30816 - RNA, 35 nt, Artificial Sequence
  Synthetic Oligonucleotide; PRDM1 exon 5; Set C
caucgagguccuuuucugaugugaggggugaaaug

SEQ ID NO: 30817 - RNA, 34 nt, Artificial Sequence
  Synthetic Oligonucleotide; PRDM1 exon 5; Set C
caucgagguccuuuucugaugugaggggugaaau

SEQ ID NO: 30818 - RNA, 33 nt, Artificial Sequence
  Synthetic Oligonucleotide; PRDM1 exon 5; Set C
caucgagguccuuuucugaugugaggggugaaa

SEQ ID NO: 30819 - RNA, 32 nt, Artificial Sequence
  Synthetic Oligonucleotide; PRDM1 exon 5; Set C
caucgagguccuuuucugaugugaggggugaa

SEQ ID NO: 30820 - RNA, 31 nt, Artificial Sequence
  Synthetic Oligonucleotide; PRDM1 exon 5; Set C
caucgagguccuuuucugaugugagggguga

SEQ ID NO: 30821 - RNA, 30 nt, Artificial Sequence
  Synthetic Oligonucleotide; PRDM1 exon 5; Set C
caucgagguccuuuucugaugugaggggug

SEQ ID NO: 30822 - RNA, 29 nt, Artificial Sequence
  Synthetic Oligonucleotide; PRDM1 exon 5; Set C
caucgagguccuuuucugaugugaggggu

SEQ ID NO: 30823 - RNA, 28 nt, Artificial Sequence
  Synthetic Oligonucleotide; PRDM1 exon 5; Set C
caucgagguccuuuucugaugugagggg

SEQ ID NO: 30824 - RNA, 27 nt, Artificial Sequence
  Synthetic Oligonucleotide; PRDM1 exon 5; Set A
caucgagguccuuuucugaugugaggg

SEQ ID NO: 30825 - RNA, 15 nt, Artificial Sequence
  Synthetic Oligonucleotide; PRDM1 exon 5; Set C
caucgagguccuuuu

SEQ ID NO: 30826 - RNA, 36 nt, Artificial Sequence
  Synthetic Oligonucleotide; PRDM1 exon 5; Set C
uuucggggcucccacgucuucuaaagucaucgaggu

SEQ ID NO: 30827 - RNA, 35 nt, Artificial Sequence
  Synthetic Oligonucleotide; PRDM1 exon 5; Set C
uuucggggcucccacgucuucuaaagucaucgagg

SEQ ID NO: 30828 - RNA, 37 nt, Artificial Sequence
  Synthetic Oligonucleotide; PRDM1 exon 5; Set C
auuucggggcucccacgucuucuaaagucaucgaggu

SEQ ID NO: 30829 - RNA, 34 nt, Artificial Sequence
  Synthetic Oligonucleotide; PRDM1 exon 5; Set C
uuucggggcucccacgucuucuaaagucaucgag

SEQ ID NO: 30830 - RNA, 36 nt, Artificial Sequence
  Synthetic Oligonucleotide; PRDM1 exon 5; Set C
auuucggggcucccacgucuucuaaagucaucgagg

SEQ ID NO: 30831 - RNA, 38 nt, Artificial Sequence
  Synthetic Oligonucleotide; PRDM1 exon 5; Set C
cauuucggggcucccacgucuucuaaagucaucgaggu

SEQ ID NO: 30832 - RNA, 35 nt, Artificial Sequence
  Synthetic Oligonucleotide; PRDM1 exon 5; Set C
auuucggggcucccacgucuucuaaagucaucgag

SEQ ID NO: 30833 - RNA, 37 nt, Artificial Sequence
  Synthetic Oligonucleotide; PRDM1 exon 5; Set C
cauuucggggcucccacgucuucuaaagucaucgagg

SEQ ID NO: 30834 - RNA, 39 nt, Artificial Sequence
  Synthetic Oligonucleotide; PRDM1 exon 5; Set C
gcauuucggggcucccacgucuucuaaagucaucgaggu

SEQ ID NO: 30835 - RNA, 36 nt, Artificial Sequence
  Synthetic Oligonucleotide; PRDM1 exon 5; Set C
cauuucggggcucccacgucuucuaaagucaucgag

SEQ ID NO: 30836 - RNA, 38 nt, Artificial Sequence
  Synthetic Oligonucleotide; PRDM1 exon 5; Set C
gcauuucggggcucccacgucuucuaaagucaucgagg

SEQ ID NO: 30837 - RNA, 40 nt, Artificial Sequence
  Synthetic Oligonucleotide; PRDM1 exon 5; Set C
ggcauuucggggcucccacgucuucuaaagucaucgaggu

SEQ ID NO: 30838 - RNA, 37 nt, Artificial Sequence
  Synthetic Oligonucleotide; PRDM1 exon 5; Set C
gcauuucggggcucccacgucuucuaaagucaucgag

SEQ ID NO: 30839 - RNA, 39 nt, Artificial Sequence
  Synthetic Oligonucleotide; PRDM1 exon 5; Set C
ggcauuucggggcucccacgucuucuaaagucaucgagg

SEQ ID NO: 30840 - RNA, 38 nt, Artificial Sequence
  Synthetic Oligonucleotide; PRDM1 exon 5; Set C
ggcauuucggggcucccacgucuucuaaagucaucgag

SEQ ID NO: 30841 - RNA, 40 nt, Artificial Sequence
  Synthetic Oligonucleotide; PRDM1 exon 5; Set C
gggcauuucggggcucccacgucuucuaaagucaucgagg

SEQ ID NO: 30842 - RNA, 39 nt, Artificial Sequence
  Synthetic Oligonucleotide; PRDM1 exon 5; Set C
gggcauuucggggcucccacgucuucuaaagucaucgag

SEQ ID NO: 30843 - RNA, 29 nt, Artificial Sequence
  Synthetic Oligonucleotide; PRDM1 exon 5; Set C
uuucggggcucccacgucuucuaaaguca

SEQ ID NO: 30844 - RNA, 40 nt, Artificial Sequence
  Synthetic Oligonucleotide; PRDM1 exon 5; Set C
agggcauuucggggcucccacgucuucuaaagucaucgag

SEQ ID NO: 30845 - RNA, 30 nt, Artificial Sequence
  Synthetic Oligonucleotide; PRDM1 exon 5; Set C
auuucggggcucccacgucuucuaaaguca

SEQ ID NO: 30846 - RNA, 27 nt, Artificial Sequence
  Synthetic Oligonucleotide; PRDM1 exon 5; Set C
uuucggggcucccacgucuucuaaagu

SEQ ID NO: 30847 - RNA, 29 nt, Artificial Sequence
  Synthetic Oligonucleotide; PRDM1 exon 5; Set C
auuucggggcucccacgucuucuaaaguc

SEQ ID NO: 30848 - RNA, 31 nt, Artificial Sequence
  Synthetic Oligonucleotide; PRDM1 exon 5; Set C
cauuucggggcucccacgucuucuaaaguca

SEQ ID NO: 30849 - RNA, 28 nt, Artificial Sequence
  Synthetic Oligonucleotide; PRDM1 exon 5; Set C
auuucggggcucccacgucuucuaaagu

SEQ ID NO: 30850 - RNA, 26 nt, Artificial Sequence
  Synthetic Oligonucleotide; PRDM1 exon 5; Set A
uuucggggcucccacgucuucuaaag

SEQ ID NO: 30851 - RNA, 30 nt, Artificial Sequence
  Synthetic Oligonucleotide; PRDM1 exon 5; Set C
cauuucggggcucccacgucuucuaaaguc

SEQ ID NO: 30852 - RNA, 32 nt, Artificial Sequence
  Synthetic Oligonucleotide; PRDM1 exon 5; Set C
gcauuucggggcucccacgucuucuaaaguca

SEQ ID NO: 30853 - RNA, 29 nt, Artificial Sequence
  Synthetic Oligonucleotide; PRDM1 exon 5; Set C
cauuucggggcucccacgucuucuaaagu

SEQ ID NO: 30854 - RNA, 27 nt, Artificial Sequence
  Synthetic Oligonucleotide; PRDM1 exon 5; Set A
auuucggggcucccacgucuucuaaag

SEQ ID NO: 30855 - RNA, 25 nt, Artificial Sequence
  Synthetic Oligonucleotide; PRDM1 exon 5; Set C
uuucggggcucccacgucuucuaaa

SEQ ID NO: 30856 - RNA, 31 nt, Artificial Sequence
  Synthetic Oligonucleotide; PRDM1 exon 5; Set C
gcauuucggggcucccacgucuucuaaaguc

SEQ ID NO: 30857 - RNA, 33 nt, Artificial Sequence
  Synthetic Oligonucleotide; PRDM1 exon 5; Set C
ggcauuucggggcucccacgucuucuaaaguca

SEQ ID NO: 30858 - RNA, 30 nt, Artificial Sequence
  Synthetic Oligonucleotide; PRDM1 exon 5; Set C
gcauuucggggcucccacgucuucuaaagu

SEQ ID NO: 30859 - RNA, 28 nt, Artificial Sequence
  Synthetic Oligonucleotide; PRDM1 exon 5; Set C
cauuucggggcucccacgucuucuaaag

SEQ ID NO: 30860 - RNA, 26 nt, Artificial Sequence
  Synthetic Oligonucleotide; PRDM1 exon 5; Set A
auuucggggcucccacgucuucuaaa

SEQ ID NO: 30861 - RNA, 32 nt, Artificial Sequence
  Synthetic Oligonucleotide; PRDM1 exon 5; Set C
ggcauuucggggcucccacgucuucuaaaguc

SEQ ID NO: 30862 - RNA, 34 nt, Artificial Sequence
  Synthetic Oligonucleotide; PRDM1 exon 5; Set C
gggcauuucggggcucccacgucuucuaaaguca

SEQ ID NO: 30863 - RNA, 29 nt, Artificial Sequence
  Synthetic Oligonucleotide; PRDM1 exon 5; Set C
gcauuucggggcucccacgucuucuaaag

SEQ ID NO: 30864 - RNA, 27 nt, Artificial Sequence
  Synthetic Oligonucleotide; PRDM1 exon 5; Set C
cauuucggggcucccacgucuucuaaa

SEQ ID NO: 30865 - RNA, 33 nt, Artificial Sequence
  Synthetic Oligonucleotide; PRDM1 exon 5; Set C
gggcauuucggggcucccacgucuucuaaaguc

SEQ ID NO: 30866 - RNA, 35 nt, Artificial Sequence
  Synthetic Oligonucleotide; PRDM1 exon 5; Set C
agggcauuucggggcucccacgucuucuaaaguca

SEQ ID NO: 30867 - RNA, 30 nt, Artificial Sequence
  Synthetic Oligonucleotide; PRDM1 exon 5; Set C
ggcauuucggggcucccacgucuucuaaag

SEQ ID NO: 30868 - RNA, 28 nt, Artificial Sequence
  Synthetic Oligonucleotide; PRDM1 exon 5; Set C
gcauuucggggcucccacgucuucuaaa

SEQ ID NO: 30869 - RNA, 34 nt, Artificial Sequence
  Synthetic Oligonucleotide; PRDM1 exon 5; Set C
agggcauuucggggcucccacgucuucuaaaguc

SEQ ID NO: 30870 - RNA, 36 nt, Artificial Sequence
  Synthetic Oligonucleotide; PRDM1 exon 5; Set C
aagggcauuucggggcucccacgucuucuaaaguca

SEQ ID NO: 30871 - RNA, 29 nt, Artificial Sequence
  Synthetic Oligonucleotide; PRDM1 exon 5; Set C
ggcauuucggggcucccacgucuucuaaa

SEQ ID NO: 30872 - RNA, 35 nt, Artificial Sequence
  Synthetic Oligonucleotide; PRDM1 exon 5; Set C
aagggcauuucggggcucccacgucuucuaaaguc

SEQ ID NO: 30873 - RNA, 37 nt, Artificial Sequence
  Synthetic Oligonucleotide; PRDM1 exon 5; Set C
gaagggcauuucggggcucccacgucuucuaaaguca

SEQ ID NO: 30874 - RNA, 30 nt, Artificial Sequence
  Synthetic Oligonucleotide; PRDM1 exon 5; Set C
gggcauuucggggcucccacgucuucuaaa

SEQ ID NO: 30875 - RNA, 36 nt, Artificial Sequence
  Synthetic Oligonucleotide; PRDM1 exon 5; Set C
gaagggcauuucggggcucccacgucuucuaaaguc

SEQ ID NO: 30876 - RNA, 38 nt, Artificial Sequence
  Synthetic Oligonucleotide; PRDM1 exon 5; Set C
agaagggcauuucggggcucccacgucuucuaaaguca

SEQ ID NO: 30877 - RNA, 37 nt, Artificial Sequence
  Synthetic Oligonucleotide; PRDM1 exon 5; Set C
agaagggcauuucggggcucccacgucuucuaaaguc

SEQ ID NO: 30878 - RNA, 39 nt, Artificial Sequence
  Synthetic Oligonucleotide; PRDM1 exon 5; Set C
uagaagggcauuucggggcucccacgucuucuaaaguca

SEQ ID NO: 30879 - RNA, 38 nt, Artificial Sequence
  Synthetic Oligonucleotide; PRDM1 exon 5; Set C
uagaagggcauuucggggcucccacgucuucuaaaguc

SEQ ID NO: 30880 - RNA, 40 nt, Artificial Sequence
  Synthetic Oligonucleotide; PRDM1 exon 5; Set C
guagaagggcauuucggggcucccacgucuucuaaaguca

SEQ ID NO: 30881 - RNA, 39 nt, Artificial Sequence
  Synthetic Oligonucleotide; PRDM1 exon 5; Set C
guagaagggcauuucggggcucccacgucuucuaaaguc

SEQ ID NO: 30882 - RNA, 40 nt, Artificial Sequence
  Synthetic Oligonucleotide; PRDM1 exon 5; Set C
gguagaagggcauuucggggcucccacgucuucuaaaguc

SEQ ID NO: 30883 - RNA, 15 nt, Artificial Sequence
  Synthetic Oligonucleotide; PRDM1 exon 5; Set C
uagaagggcauuucg

SEQ ID NO: 30884 - RNA, 16 nt, Artificial Sequence
  Synthetic Oligonucleotide; PRDM1 exon 5; Set C
guagaagggcauuucg

SEQ ID NO: 30885 - RNA, 17 nt, Artificial Sequence
  Synthetic Oligonucleotide; PRDM1 exon 5; Set C
gguagaagggcauuucg

SEQ ID NO: 30886 - RNA, 18 nt, Artificial Sequence
  Synthetic Oligonucleotide; PRDM1 exon 5; Set C
ggguagaagggcauuucg

SEQ ID NO: 30887 - RNA, 19 nt, Artificial Sequence
  Synthetic Oligonucleotide; PRDM1 exon 5; Set C
aggguagaagggcauuucg

SEQ ID NO: 30888 - RNA, 20 nt, Artificial Sequence
  Synthetic Oligonucleotide; PRDM1 exon 5; Set C
gaggguagaagggcauuucg

SEQ ID NO: 30889 - RNA, 21 nt, Artificial Sequence
  Synthetic Oligonucleotide; PRDM1 exon 5; Set A
cgaggguagaagggcauuucg

SEQ ID NO: 30890 - RNA, 20 nt, Artificial Sequence
  Synthetic Oligonucleotide; PRDM1 exon 5; Set C
cgaggguagaagggcauuuc

SEQ ID NO: 30891 - RNA, 24 nt, Artificial Sequence
  Synthetic Oligonucleotide; PRDM1 exon 5; Set C
cgacccgaggguagaagggcauuu

SEQ ID NO: 30892 - RNA, 23 nt, Artificial Sequence
  Synthetic Oligonucleotide; PRDM1 exon 5; Set C
cgacccgaggguagaagggcauu

SEQ ID NO: 30893 - RNA, 25 nt, Artificial Sequence
  Synthetic Oligonucleotide; PRDM1 exon 5; Set C
acgacccgaggguagaagggcauuu

SEQ ID NO: 30894 - RNA, 29 nt, Artificial Sequence
  Synthetic Oligonucleotide; PRDM1 exon 5; Set C
aaacgacccgaggguagaagggcauuucg

SEQ ID NO: 30895 - RNA, 24 nt, Artificial Sequence
  Synthetic Oligonucleotide; PRDM1 exon 5; Set C
acgacccgaggguagaagggcauu

SEQ ID NO: 30896 - RNA, 26 nt, Artificial Sequence
  Synthetic Oligonucleotide; PRDM1 exon 5; Set C
aacgacccgaggguagaagggcauuu

SEQ ID NO: 30897 - RNA, 28 nt, Artificial Sequence
  Synthetic Oligonucleotide; PRDM1 exon 5; Set C
aaacgacccgaggguagaagggcauuuc

SEQ ID NO: 30898 - RNA, 30 nt, Artificial Sequence
  Synthetic Oligonucleotide; PRDM1 exon 5; Set C
uaaacgacccgaggguagaagggcauuucg

SEQ ID NO: 30899 - RNA, 25 nt, Artificial Sequence
  Synthetic Oligonucleotide; PRDM1 exon 5; Set C
aacgacccgaggguagaagggcauu

SEQ ID NO: 30900 - RNA, 29 nt, Artificial Sequence
  Synthetic Oligonucleotide; PRDM1 exon 5; Set C
uaaacgacccgaggguagaagggcauuuc

SEQ ID NO: 30901 - RNA, 31 nt, Artificial Sequence
  Synthetic Oligonucleotide; PRDM1 exon 5; Set C
guaaacgacccgaggguagaagggcauuucg

SEQ ID NO: 30902 - RNA, 24 nt, Artificial Sequence
  Synthetic Oligonucleotide; PRDM1 exon 5; Set C
aacgacccgaggguagaagggcau

SEQ ID NO: 30903 - RNA, 30 nt, Artificial Sequence
  Synthetic Oligonucleotide; PRDM1 exon 5; Set C
guaaacgacccgaggguagaagggcauuuc

SEQ ID NO: 30904 - RNA, 32 nt, Artificial Sequence
  Synthetic Oligonucleotide; PRDM1 exon 5; Set C
gguaaacgacccgaggguagaagggcauuucg

SEQ ID NO: 30905 - RNA, 23 nt, Artificial Sequence
  Synthetic Oligonucleotide; PRDM1 exon 5; Set C
aacgacccgaggguagaagggca

SEQ ID NO: 30906 - RNA, 31 nt, Artificial Sequence
  Synthetic Oligonucleotide; PRDM1 exon 5; Set C
gguaaacgacccgaggguagaagggcauuuc

SEQ ID NO: 30907 - RNA, 33 nt, Artificial Sequence
  Synthetic Oligonucleotide; PRDM1 exon 5; Set C
ggguaaacgacccgaggguagaagggcauuucg

SEQ ID NO: 30908 - RNA, 22 nt, Artificial Sequence
  Synthetic Oligonucleotide; PRDM1 exon 5; Set A
aacgacccgaggguagaagggc

SEQ ID NO: 30909 - RNA, 32 nt, Artificial Sequence
  Synthetic Oligonucleotide; PRDM1 exon 5; Set C
ggguaaacgacccgaggguagaagggcauuuc

SEQ ID NO: 30910 - RNA, 34 nt, Artificial Sequence
  Synthetic Oligonucleotide; PRDM1 exon 5; Set C
gggguaaacgacccgaggguagaagggcauuucg

SEQ ID NO: 30911 - RNA, 33 nt, Artificial Sequence
  Synthetic Oligonucleotide; PRDM1 exon 5; Set C
gggguaaacgacccgaggguagaagggcauuuc

SEQ ID NO: 30912 - RNA, 35 nt, Artificial Sequence
  Synthetic Oligonucleotide; PRDM1 exon 5; Set C
ugggguaaacgacccgaggguagaagggcauuucg

SEQ ID NO: 30913 - RNA, 34 nt, Artificial Sequence
  Synthetic Oligonucleotide; PRDM1 exon 5; Set C
ugggguaaacgacccgaggguagaagggcauuuc

SEQ ID NO: 30914 - RNA, 36 nt, Artificial Sequence
  Synthetic Oligonucleotide; PRDM1 exon 5; Set C
augggguaaacgacccgaggguagaagggcauuucg

SEQ ID NO: 30915 - RNA, 35 nt, Artificial Sequence
  Synthetic Oligonucleotide; PRDM1 exon 5; Set C
augggguaaacgacccgaggguagaagggcauuuc

SEQ ID NO: 30916 - RNA, 37 nt, Artificial Sequence
  Synthetic Oligonucleotide; PRDM1 exon 5; Set C
gaugggguaaacgacccgaggguagaagggcauuucg

SEQ ID NO: 30917 - RNA, 18 nt, Artificial Sequence
  Synthetic Oligonucleotide; PRDM1 exon 5; Set C
aacgacccgaggguagaa

SEQ ID NO: 30918 - RNA, 36 nt, Artificial Sequence
  Synthetic Oligonucleotide; PRDM1 exon 5; Set C
gaugggguaaacgacccgaggguagaagggcauuuc

SEQ ID NO: 30919 - RNA, 38 nt, Artificial Sequence
  Synthetic Oligonucleotide; PRDM1 exon 5; Set C
ggaugggguaaacgacccgaggguagaagggcauuucg

SEQ ID NO: 30920 - RNA, 37 nt, Artificial Sequence
  Synthetic Oligonucleotide; PRDM1 exon 5; Set C
ggaugggguaaacgacccgaggguagaagggcauuuc

SEQ ID NO: 30921 - RNA, 15 nt, Artificial Sequence
  Synthetic Oligonucleotide; PRDM1 exon 5; Set C
ggaugggguaaacga

SEQ ID NO: 30922 - RNA, 23 nt, Artificial Sequence
  Synthetic Oligonucleotide; PRDM1 exon 5; Set C
agaggggcccggaugggguaaac

SEQ ID NO: 30923 - RNA, 35 nt, Artificial Sequence
  Synthetic Oligonucleotide; PRDM1 exon 5; Set C
caaaaagucuucuggcagaggggcccggauggggu

SEQ ID NO: 30924 - RNA, 34 nt, Artificial Sequence
  Synthetic Oligonucleotide; PRDM1 exon 5; Set C
caaaaagucuucuggcagaggggcccggaugggg

SEQ ID NO: 30925 - RNA, 33 nt, Artificial Sequence
  Synthetic Oligonucleotide; PRDM1 exon 5; Set C
caaaaagucuucuggcagaggggcccggauggg

SEQ ID NO: 30926 - RNA, 32 nt, Artificial Sequence
  Synthetic Oligonucleotide; PRDM1 exon 5; Set C
caaaaagucuucuggcagaggggcccggaugg

SEQ ID NO: 30927 - RNA, 31 nt, Artificial Sequence
  Synthetic Oligonucleotide; PRDM1 exon 5; Set C
caaaaagucuucuggcagaggggcccggaug

SEQ ID NO: 30928 - RNA, 30 nt, Artificial Sequence
  Synthetic Oligonucleotide; PRDM1 exon 5; Set C
caaaaagucuucuggcagaggggcccggau

SEQ ID NO: 30929 - RNA, 29 nt, Artificial Sequence
  Synthetic Oligonucleotide; PRDM1 exon 5; Set C
caaaaagucuucuggcagaggggcccgga

SEQ ID NO: 30930 - RNA, 22 nt, Artificial Sequence
  Synthetic Oligonucleotide; PRDM1 exon 5; Set C
caaaaagucuucuggcagaggg

SEQ ID NO: 30931 - RNA, 21 nt, Artificial Sequence
  Synthetic Oligonucleotide; PRDM1 exon 5; Set C
caaaaagucuucuggcagagg

SEQ ID NO: 30932 - RNA, 20 nt, Artificial Sequence
  Synthetic Oligonucleotide; PRDM1 exon 5; Set C
caaaaagucuucuggcagag

SEQ ID NO: 30933 - RNA, 21 nt, Artificial Sequence
  Synthetic Oligonucleotide; PRDM1 exon 5; Set A
guaggccagggaagcuuucaa

SEQ ID NO: 30934 - RNA, 40 nt, Artificial Sequence
  Synthetic Oligonucleotide; PRDM1 exon 5; Set C
acgugggucucucgaucccguaggccagggaagcuuucaa

SEQ ID NO: 30935 - RNA, 20 nt, Artificial Sequence
  Synthetic Oligonucleotide; PRDM1 exon 5; Set A
ugggucucucgaucccguag

SEQ ID NO: 30936 - RNA, 21 nt, Artificial Sequence
  Synthetic Oligonucleotide; PRDM1 exon 5; Set A
gugggucucucgaucccguag

SEQ ID NO: 30937 - RNA, 22 nt, Artificial Sequence
  Synthetic Oligonucleotide; PRDM1 exon 5; Set A
cgugggucucucgaucccguag

SEQ ID NO: 30938 - RNA, 20 nt, Artificial Sequence
  Synthetic Oligonucleotide; PRDM1 exon 5; Set A
gugggucucucgaucccgua

SEQ ID NO: 30939 - RNA, 23 nt, Artificial Sequence
  Synthetic Oligonucleotide; PRDM1 exon 5; Set A
acgugggucucucgaucccguag

SEQ ID NO: 30940 - RNA, 21 nt, Artificial Sequence
  Synthetic Oligonucleotide; PRDM1 exon 5; Set A
cgugggucucucgaucccgua

SEQ ID NO: 30941 - RNA, 24 nt, Artificial Sequence
  Synthetic Oligonucleotide; PRDM1 exon 5; Set C
uacgugggucucucgaucccguag

SEQ ID NO: 30942 - RNA, 22 nt, Artificial Sequence
  Synthetic Oligonucleotide; PRDM1 exon 5; Set C
acgugggucucucgaucccgua

SEQ ID NO: 30943 - RNA, 25 nt, Artificial Sequence
  Synthetic Oligonucleotide; PRDM1 exon 5; Set C
guacgugggucucucgaucccguag

SEQ ID NO: 30944 - RNA, 23 nt, Artificial Sequence
  Synthetic Oligonucleotide; PRDM1 exon 5; Set C
uacgugggucucucgaucccgua

SEQ ID NO: 30945 - RNA, 24 nt, Artificial Sequence
  Synthetic Oligonucleotide; PRDM1 exon 5; Set C
guacgugggucucucgaucccgua

SEQ ID NO: 30946 - RNA, 25 nt, Artificial Sequence
  Synthetic Oligonucleotide; PRDM1 exon 5; Set C
uguacgugggucucucgaucccgua

SEQ ID NO: 30947 - RNA, 40 nt, Artificial Sequence
  Synthetic Oligonucleotide; PRDM1 exon 5; Set C
ugggggagcgagugauguacgugggucucucgaucccgua

SEQ ID NO: 30948 - RNA, 25 nt, Artificial Sequence
  Synthetic Oligonucleotide; PRDM1 exon 5; Set C
ugggggagcgagugauguacguggg

SEQ ID NO: 30949 - RNA, 24 nt, Artificial Sequence
  Synthetic Oligonucleotide; PRDM1 exon 5; Set C
ugggggagcgagugauguacgugg

SEQ ID NO: 30950 - RNA, 23 nt, Artificial Sequence
  Synthetic Oligonucleotide; PRDM1 exon 5; Set A
ugggggagcgagugauguacgug

SEQ ID NO: 30951 - RNA, 25 nt, Artificial Sequence
  Synthetic Oligonucleotide; PRDM1 exon 5; Set C
augggggagcgagugauguacgugg

SEQ ID NO: 30952 - RNA, 24 nt, Artificial Sequence
  Synthetic Oligonucleotide; PRDM1 exon 5; Set A
augggggagcgagugauguacgug

SEQ ID NO: 30953 - RNA, 22 nt, Artificial Sequence
  Synthetic Oligonucleotide; PRDM1 exon 5; Set C
ugggggagcgagugauguacgu

SEQ ID NO: 30954 - RNA, 25 nt, Artificial Sequence
  Synthetic Oligonucleotide; PRDM1 exon 5; Set A
aaugggggagcgagugauguacgug

SEQ ID NO: 30955 - RNA, 21 nt, Artificial Sequence
  Synthetic Oligonucleotide; PRDM1 exon 5; Set A
ugggggagcgagugauguacg

SEQ ID NO: 30956 - RNA, 23 nt, Artificial Sequence
  Synthetic Oligonucleotide; PRDM1 exon 5; Set A
augggggagcgagugauguacgu

SEQ ID NO: 30957 - RNA, 22 nt, Artificial Sequence
  Synthetic Oligonucleotide; PRDM1 exon 5; Set A
augggggagcgagugauguacg

SEQ ID NO: 30958 - RNA, 20 nt, Artificial Sequence
  Synthetic Oligonucleotide; PRDM1 exon 5; Set A
ugggggagcgagugauguac

SEQ ID NO: 30959 - RNA, 24 nt, Artificial Sequence
  Synthetic Oligonucleotide; PRDM1 exon 5; Set A
aaugggggagcgagugauguacgu

SEQ ID NO: 30960 - RNA, 23 nt, Artificial Sequence
  Synthetic Oligonucleotide; PRDM1 exon 5; Set A
aaugggggagcgagugauguacg

SEQ ID NO: 30961 - RNA, 21 nt, Artificial Sequence
  Synthetic Oligonucleotide; PRDM1 exon 5; Set A
augggggagcgagugauguac

SEQ ID NO: 30962 - RNA, 25 nt, Artificial Sequence
  Synthetic Oligonucleotide; PRDM1 exon 5; Set C
gaaugggggagcgagugauguacgu

SEQ ID NO: 30963 - RNA, 22 nt, Artificial Sequence
  Synthetic Oligonucleotide; PRDM1 exon 5; Set A
aaugggggagcgagugauguac

SEQ ID NO: 30964 - RNA, 20 nt, Artificial Sequence
  Synthetic Oligonucleotide; PRDM1 exon 5; Set A
augggggagcgagugaugua

SEQ ID NO: 30965 - RNA, 24 nt, Artificial Sequence
  Synthetic Oligonucleotide; PRDM1 exon 5; Set A
gaaugggggagcgagugauguacg

SEQ ID NO: 30966 - RNA, 19 nt, Artificial Sequence
  Synthetic Oligonucleotide; PRDM1 exon 5; Set A
augggggagcgagugaugu

SEQ ID NO: 30967 - RNA, 21 nt, Artificial Sequence
  Synthetic Oligonucleotide; PRDM1 exon 5; Set A
aaugggggagcgagugaugua

SEQ ID NO: 30968 - RNA, 23 nt, Artificial Sequence
  Synthetic Oligonucleotide; PRDM1 exon 5; Set A
gaaugggggagcgagugauguac

SEQ ID NO: 30969 - RNA, 25 nt, Artificial Sequence
  Synthetic Oligonucleotide; PRDM1 exon 5; Set C
ggaaugggggagcgagugauguacg

SEQ ID NO: 30970 - RNA, 20 nt, Artificial Sequence
  Synthetic Oligonucleotide; PRDM1 exon 5; Set A
aaugggggagcgagugaugu

SEQ ID NO: 30971 - RNA, 22 nt, Artificial Sequence
  Synthetic Oligonucleotide; PRDM1 exon 5; Set A
gaaugggggagcgagugaugua

SEQ ID NO: 30972 - RNA, 24 nt, Artificial Sequence
  Synthetic Oligonucleotide; PRDM1 exon 5; Set A
ggaaugggggagcgagugauguac

SEQ ID NO: 30973 - RNA, 21 nt, Artificial Sequence
  Synthetic Oligonucleotide; PRDM1 exon 5; Set A
gaaugggggagcgagugaugu

SEQ ID NO: 30974 - RNA, 25 nt, Artificial Sequence
  Synthetic Oligonucleotide; PRDM1 exon 5; Set A
uggaaugggggagcgagugauguac

SEQ ID NO: 30975 - RNA, 23 nt, Artificial Sequence
  Synthetic Oligonucleotide; PRDM1 exon 5; Set A
ggaaugggggagcgagugaugua

SEQ ID NO: 30976 - RNA, 22 nt, Artificial Sequence
  Synthetic Oligonucleotide; PRDM1 exon 5; Set A
ggaaugggggagcgagugaugu

SEQ ID NO: 30977 - RNA, 24 nt, Artificial Sequence
  Synthetic Oligonucleotide; PRDM1 exon 5; Set A
uggaaugggggagcgagugaugua

SEQ ID NO: 30978 - RNA, 23 nt, Artificial Sequence
  Synthetic Oligonucleotide; PRDM1 exon 5; Set A
uggaaugggggagcgagugaugu

SEQ ID NO: 30979 - RNA, 25 nt, Artificial Sequence
  Synthetic Oligonucleotide; PRDM1 exon 5; Set A
auggaaugggggagcgagugaugua

SEQ ID NO: 30980 - RNA, 24 nt, Artificial Sequence
  Synthetic Oligonucleotide; PRDM1 exon 5; Set A
auggaaugggggagcgagugaugu

SEQ ID NO: 30981 - RNA, 25 nt, Artificial Sequence
  Synthetic Oligonucleotide; PRDM1 exon 5; Set A
gauggaaugggggagcgagugaugu

SEQ ID NO: 30982 - RNA, 25 nt, Artificial Sequence
  Synthetic Oligonucleotide; PRDM1 exon 5; Set A
cuuggagugguggaggauggaaugg

SEQ ID NO: 30983 - RNA, 24 nt, Artificial Sequence
  Synthetic Oligonucleotide; PRDM1 exon 5; Set A
cuuggagugguggaggauggaaug

SEQ ID NO: 30984 - RNA, 23 nt, Artificial Sequence
  Synthetic Oligonucleotide; PRDM1 exon 5; Set A
cuuggagugguggaggauggaau

SEQ ID NO: 30985 - RNA, 22 nt, Artificial Sequence
  Synthetic Oligonucleotide; PRDM1 exon 5; Set A
cuuggagugguggaggauggaa

SEQ ID NO: 30986 - RNA, 29 nt, Artificial Sequence
  Synthetic Oligonucleotide; PRDM1 exon 5; Set C
ggggcuuggagugguggaggauggaaugg

SEQ ID NO: 30987 - RNA, 21 nt, Artificial Sequence
  Synthetic Oligonucleotide; PRDM1 exon 5; Set A
cuuggagugguggaggaugga

SEQ ID NO: 30988 - RNA, 28 nt, Artificial Sequence
  Synthetic Oligonucleotide; PRDM1 exon 5; Set C
ggggcuuggagugguggaggauggaaug

SEQ ID NO: 30989 - RNA, 20 nt, Artificial Sequence
  Synthetic Oligonucleotide; PRDM1 exon 5; Set A
cuuggagugguggaggaugg

SEQ ID NO: 30990 - RNA, 27 nt, Artificial Sequence
  Synthetic Oligonucleotide; PRDM1 exon 5; Set C
ggggcuuggagugguggaggauggaau

SEQ ID NO: 30991 - RNA, 19 nt, Artificial Sequence
  Synthetic Oligonucleotide; PRDM1 exon 5; Set C
cuuggagugguggaggaug

SEQ ID NO: 30992 - RNA, 18 nt, Artificial Sequence
  Synthetic Oligonucleotide; PRDM1 exon 5; Set C
cuuggagugguggaggau

SEQ ID NO: 30993 - RNA, 26 nt, Artificial Sequence
  Synthetic Oligonucleotide; PRDM1 exon 5; Set C
ggggcuuggagugguggaggauggaa

SEQ ID NO: 30994 - RNA, 17 nt, Artificial Sequence
  Synthetic Oligonucleotide; PRDM1 exon 5; Set C
cuuggagugguggagga

SEQ ID NO: 30995 - RNA, 25 nt, Artificial Sequence
  Synthetic Oligonucleotide; PRDM1 exon 5; Set C
ggggcuuggagugguggaggaugga

SEQ ID NO: 30996 - RNA, 16 nt, Artificial Sequence
  Synthetic Oligonucleotide; PRDM1 exon 5; Set C
cuuggagugguggagg

SEQ ID NO: 30997 - RNA, 24 nt, Artificial Sequence
  Synthetic Oligonucleotide; PRDM1 exon 5; Set C
ggggcuuggagugguggaggaugg

SEQ ID NO: 30998 - RNA, 23 nt, Artificial Sequence
  Synthetic Oligonucleotide; PRDM1 exon 5; Set C
ggggcuuggagugguggaggaug

SEQ ID NO: 30999 - RNA, 22 nt, Artificial Sequence
  Synthetic Oligonucleotide; PRDM1 exon 5; Set C
ggggcuuggagugguggaggau

SEQ ID NO: 31000 - RNA, 21 nt, Artificial Sequence
  Synthetic Oligonucleotide; PRDM1 exon 5; Set C
ggggcuuggagugguggagga

SEQ ID NO: 31001 - RNA, 20 nt, Artificial Sequence
  Synthetic Oligonucleotide; PRDM1 exon 5; Set A
ggggcuuggagugguggagg

SEQ ID NO: 31002 - RNA, 19 nt, Artificial Sequence
  Synthetic Oligonucleotide; PRDM1 exon 5; Set A
ggggcuuggagugguggag

SEQ ID NO: 31003 - RNA, 18 nt, Artificial Sequence
  Synthetic Oligonucleotide; PRDM1 exon 5; Set A
ggggcuuggaguggugga

SEQ ID NO: 31004 - RNA, 25 nt, Artificial Sequence
  Synthetic Oligonucleotide; PRDM1 exon 5; Set C
cagaggggcuuggagugguggagga

SEQ ID NO: 31005 - RNA, 17 nt, Artificial Sequence
  Synthetic Oligonucleotide; PRDM1 exon 5; Set A
ggggcuuggaguggugg

SEQ ID NO: 31006 - RNA, 24 nt, Artificial Sequence
  Synthetic Oligonucleotide; PRDM1 exon 5; Set C
cagaggggcuuggagugguggagg

SEQ ID NO: 31007 - RNA, 16 nt, Artificial Sequence
  Synthetic Oligonucleotide; PRDM1 exon 5; Set A
ggggcuuggaguggug

SEQ ID NO: 31008 - RNA, 15 nt, Artificial Sequence
  Synthetic Oligonucleotide; PRDM1 exon 5; Set C
ggggcuuggaguggu

SEQ ID NO: 31009 - RNA, 23 nt, Artificial Sequence
  Synthetic Oligonucleotide; PRDM1 exon 5; Set C
cagaggggcuuggagugguggag

SEQ ID NO: 31010 - RNA, 22 nt, Artificial Sequence
  Synthetic Oligonucleotide; PRDM1 exon 5; Set C
cagaggggcuuggaguggugga

SEQ ID NO: 31011 - RNA, 21 nt, Artificial Sequence
  Synthetic Oligonucleotide; PRDM1 exon 5; Set A
cagaggggcuuggaguggugg

SEQ ID NO: 31012 - RNA, 20 nt, Artificial Sequence
  Synthetic Oligonucleotide; PRDM1 exon 5; Set A
cagaggggcuuggaguggug

SEQ ID NO: 31013 - RNA, 19 nt, Artificial Sequence
  Synthetic Oligonucleotide; PRDM1 exon 5; Set A
cagaggggcuuggaguggu

SEQ ID NO: 31014 - RNA, 18 nt, Artificial Sequence
  Synthetic Oligonucleotide; PRDM1 exon 5; Set A
cagaggggcuuggagugg

SEQ ID NO: 31015 - RNA, 17 nt, Artificial Sequence
  Synthetic Oligonucleotide; PRDM1 exon 5; Set C
cagaggggcuuggagug

SEQ ID NO: 31016 - RNA, 16 nt, Artificial Sequence
  Synthetic Oligonucleotide; PRDM1 exon 5; Set C
cagaggggcuuggagu

SEQ ID NO: 31017 - RNA, 15 nt, Artificial Sequence
  Synthetic Oligonucleotide; PRDM1 exon 5; Set C
cagaggggcuuggag

SEQ ID NO: 31018 - RNA, 31 nt, Artificial Sequence
  Synthetic Oligonucleotide; PRDM1 exon 5; Set C
ggggcugcuucuugcagaggggcuuggagug

SEQ ID NO: 31019 - RNA, 30 nt, Artificial Sequence
  Synthetic Oligonucleotide; PRDM1 exon 5; Set C
ggggcugcuucuugcagaggggcuuggagu

SEQ ID NO: 31020 - RNA, 29 nt, Artificial Sequence
  Synthetic Oligonucleotide; PRDM1 exon 5; Set C
ggggcugcuucuugcagaggggcuuggag

SEQ ID NO: 31021 - RNA, 28 nt, Artificial Sequence
  Synthetic Oligonucleotide; PRDM1 exon 5; Set C
ggggcugcuucuugcagaggggcuugga

SEQ ID NO: 31022 - RNA, 27 nt, Artificial Sequence
  Synthetic Oligonucleotide; PRDM1 exon 5; Set C
ggggcugcuucuugcagaggggcuugg

SEQ ID NO: 31023 - RNA, 26 nt, Artificial Sequence
  Synthetic Oligonucleotide; PRDM1 exon 5; Set C
ggggcugcuucuugcagaggggcuug

SEQ ID NO: 31024 - RNA, 19 nt, Artificial Sequence
  Synthetic Oligonucleotide; PRDM1 exon 5; Set A
gggcugcuucuugcagagg

SEQ ID NO: 31025 - RNA, 18 nt, Artificial Sequence
  Synthetic Oligonucleotide; PRDM1 exon 5; Set A
gggcugcuucuugcagag

SEQ ID NO: 31026 - RNA, 24 nt, Artificial Sequence
  Synthetic Oligonucleotide; PRDM1 exon 5; Set C
ggucggggcugcuucuugcagagg

SEQ ID NO: 31027 - RNA, 25 nt, Artificial Sequence
  Synthetic Oligonucleotide; PRDM1 exon 5; Set C
uggucggggcugcuucuugcagagg

SEQ ID NO: 31028 - RNA, 23 nt, Artificial Sequence
  Synthetic Oligonucleotide; PRDM1 exon 5; Set C
ggucggggcugcuucuugcagag

SEQ ID NO: 31029 - RNA, 26 nt, Artificial Sequence
  Synthetic Oligonucleotide; PRDM1 exon 5; Set C
uuggucggggcugcuucuugcagagg

SEQ ID NO: 31030 - RNA, 24 nt, Artificial Sequence
  Synthetic Oligonucleotide; PRDM1 exon 5; Set C
uggucggggcugcuucuugcagag

SEQ ID NO: 31031 - RNA, 27 nt, Artificial Sequence
  Synthetic Oligonucleotide; PRDM1 exon 5; Set C
uuuggucggggcugcuucuugcagagg

SEQ ID NO: 31032 - RNA, 25 nt, Artificial Sequence
  Synthetic Oligonucleotide; PRDM1 exon 5; Set C
uuggucggggcugcuucuugcagag

SEQ ID NO: 31033 - RNA, 23 nt, Artificial Sequence
  Synthetic Oligonucleotide; PRDM1 exon 5; Set C
uggucggggcugcuucuugcaga

SEQ ID NO: 31034 - RNA, 40 nt, Artificial Sequence
  Synthetic Oligonucleotide; PRDM1 exon 5; Set C
uugaggcuuuggucggggcugcuucuugcagaggggcuug

SEQ ID NO: 31035 - RNA, 26 nt, Artificial Sequence
  Synthetic Oligonucleotide; PRDM1 exon 5; Set C
uuuggucggggcugcuucuugcagag

SEQ ID NO: 31036 - RNA, 24 nt, Artificial Sequence
  Synthetic Oligonucleotide; PRDM1 exon 5; Set C
uuggucggggcugcuucuugcaga

SEQ ID NO: 31037 - RNA, 25 nt, Artificial Sequence
  Synthetic Oligonucleotide; PRDM1 exon 5; Set C
uuuggucggggcugcuucuugcaga

SEQ ID NO: 31038 - RNA, 27 nt, Artificial Sequence
  Synthetic Oligonucleotide; PRDM1 exon 5; Set C
uugaggcuuuggucggggcugcuucuu

SEQ ID NO: 31039 - RNA, 26 nt, Artificial Sequence
  Synthetic Oligonucleotide; PRDM1 exon 5; Set C
uugaggcuuuggucggggcugcuucu

SEQ ID NO: 31040 - RNA, 25 nt, Artificial Sequence
  Synthetic Oligonucleotide; PRDM1 exon 5; Set C
uugaggcuuuggucggggcugcuuc

SEQ ID NO: 31041 - RNA, 17 nt, Artificial Sequence
  Synthetic Oligonucleotide; PRDM1 exon 5; Set C
uugaggcuuuggucggg

SEQ ID NO: 31042 - RNA, 40 nt, Artificial Sequence
  Synthetic Oligonucleotide; PRDM1 exon 5; Set C
gagggcuggagcucuugaggcuuuggucggggcugcuucu

SEQ ID NO: 31043 - RNA, 39 nt, Artificial Sequence
  Synthetic Oligonucleotide; PRDM1 exon 5; Set C
gagggcuggagcucuugaggcuuuggucggggcugcuuc

SEQ ID NO: 31044 - RNA, 25 nt, Artificial Sequence
  Synthetic Oligonucleotide; PRDM1 exon 5; Set C
uggagcucuugaggcuuuggucggg

SEQ ID NO: 31045 - RNA, 32 nt, Artificial Sequence
  Synthetic Oligonucleotide; PRDM1 exon 5; Set C
gagggcuggagcucuugaggcuuuggucgggg

SEQ ID NO: 31046 - RNA, 40 nt, Artificial Sequence
  Synthetic Oligonucleotide; PRDM1 exon 5; Set C
ucccagggcugcugugagggcuggagcucuugaggcuuug

SEQ ID NO: 31047 - RNA, 39 nt, Artificial Sequence
  Synthetic Oligonucleotide; PRDM1 exon 5; Set C
ucccagggcugcugugagggcuggagcucuugaggcuuu

SEQ ID NO: 31048 - RNA, 40 nt, Artificial Sequence
  Synthetic Oligonucleotide; PRDM1 exon 5; Set C
uucccagggcugcugugagggcuggagcucuugaggcuuu

SEQ ID NO: 31049 - RNA, 24 nt, Artificial Sequence
  Synthetic Oligonucleotide; PRDM1 exon 5; Set C
ucccagggcugcugugagggcugg

SEQ ID NO: 31050 - RNA, 25 nt, Artificial Sequence
  Synthetic Oligonucleotide; PRDM1 exon 5; Set C
uucccagggcugcugugagggcugg

SEQ ID NO: 31051 - RNA, 26 nt, Artificial Sequence
  Synthetic Oligonucleotide; PRDM1 exon 5; Set C
auucccagggcugcugugagggcugg

SEQ ID NO: 31052 - RNA, 27 nt, Artificial Sequence
  Synthetic Oligonucleotide; PRDM1 exon 5; Set C
uauucccagggcugcugugagggcugg

SEQ ID NO: 31053 - RNA, 16 nt, Artificial Sequence
  Synthetic Oligonucleotide; PRDM1 exon 5; Set C
ggggacaccguauucc

SEQ ID NO: 31054 - RNA, 15 nt, Artificial Sequence
  Synthetic Oligonucleotide; PRDM1 exon 5; Set C
ggggacaccguauuc

SEQ ID NO: 31055 - RNA, 17 nt, Artificial Sequence
  Synthetic Oligonucleotide; PRDM1 exon 5; Set C
aggggacaccguauucc

SEQ ID NO: 31056 - RNA, 16 nt, Artificial Sequence
  Synthetic Oligonucleotide; PRDM1 exon 5; Set C
aggggacaccguauuc

SEQ ID NO: 31057 - RNA, 15 nt, Artificial Sequence
  Synthetic Oligonucleotide; PRDM1 exon 5; Set C
aggggacaccguauu

SEQ ID NO: 31058 - RNA, 26 nt, Artificial Sequence
  Synthetic Oligonucleotide; PRDM1 exon 5; Set C
ggggcccacaggggacaccguauucc

SEQ ID NO: 31059 - RNA, 25 nt, Artificial Sequence
  Synthetic Oligonucleotide; PRDM1 exon 5; Set C
ggggcccacaggggacaccguauuc

SEQ ID NO: 31060 - RNA, 24 nt, Artificial Sequence
  Synthetic Oligonucleotide; PRDM1 exon 5; Set C
ggggcccacaggggacaccguauu

SEQ ID NO: 31061 - RNA, 23 nt, Artificial Sequence
  Synthetic Oligonucleotide; PRDM1 exon 5; Set C
ggggcccacaggggacaccguau

SEQ ID NO: 31062 - RNA, 35 nt, Artificial Sequence
  Synthetic Oligonucleotide; PRDM1 exon 5; Set C
uaagcguaggagucccggugcucuugagagccggg

SEQ ID NO: 31063 - RNA, 36 nt, Artificial Sequence
  Synthetic Oligonucleotide; PRDM1 exon 5; Set C
guaagcguaggagucccggugcucuugagagccggg

SEQ ID NO: 31064 - RNA, 37 nt, Artificial Sequence
  Synthetic Oligonucleotide; PRDM1 exon 5; Set C
aguaagcguaggagucccggugcucuugagagccggg

SEQ ID NO: 31065 - RNA, 38 nt, Artificial Sequence
  Synthetic Oligonucleotide; PRDM1 exon 5; Set C
aaguaagcguaggagucccggugcucuugagagccggg

SEQ ID NO: 31066 - RNA, 39 nt, Artificial Sequence
  Synthetic Oligonucleotide; PRDM1 exon 5; Set C
caaguaagcguaggagucccggugcucuugagagccggg

SEQ ID NO: 31067 - RNA, 40 nt, Artificial Sequence
  Synthetic Oligonucleotide; PRDM1 exon 5; Set C
ucaaguaagcguaggagucccggugcucuugagagccggg

SEQ ID NO: 31068 - RNA, 28 nt, Artificial Sequence
  Synthetic Oligonucleotide; PRDM1 exon 5; Set C
guaagcguaggagucccggugcucuuga

SEQ ID NO: 31069 - RNA, 29 nt, Artificial Sequence
  Synthetic Oligonucleotide; PRDM1 exon 5; Set C
aguaagcguaggagucccggugcucuuga

SEQ ID NO: 31070 - RNA, 28 nt, Artificial Sequence
  Synthetic Oligonucleotide; PRDM1 exon 5; Set C
aguaagcguaggagucccggugcucuug

SEQ ID NO: 31071 - RNA, 30 nt, Artificial Sequence
  Synthetic Oligonucleotide; PRDM1 exon 5; Set C
aaguaagcguaggagucccggugcucuuga

SEQ ID NO: 31072 - RNA, 29 nt, Artificial Sequence
  Synthetic Oligonucleotide; PRDM1 exon 5; Set C
aaguaagcguaggagucccggugcucuug

SEQ ID NO: 31073 - RNA, 31 nt, Artificial Sequence
  Synthetic Oligonucleotide; PRDM1 exon 5; Set C
caaguaagcguaggagucccggugcucuuga

SEQ ID NO: 31074 - RNA, 30 nt, Artificial Sequence
  Synthetic Oligonucleotide; PRDM1 exon 5; Set C
caaguaagcguaggagucccggugcucuug

SEQ ID NO: 31075 - RNA, 32 nt, Artificial Sequence
  Synthetic Oligonucleotide; PRDM1 exon 5; Set C
ucaaguaagcguaggagucccggugcucuuga

SEQ ID NO: 31076 - RNA, 31 nt, Artificial Sequence
  Synthetic Oligonucleotide; PRDM1 exon 5; Set C
ucaaguaagcguaggagucccggugcucuug

SEQ ID NO: 31077 - RNA, 33 nt, Artificial Sequence
  Synthetic Oligonucleotide; PRDM1 exon 5; Set C
uucaaguaagcguaggagucccggugcucuuga

SEQ ID NO: 31078 - RNA, 32 nt, Artificial Sequence
  Synthetic Oligonucleotide; PRDM1 exon 5; Set C
uucaaguaagcguaggagucccggugcucuug

SEQ ID NO: 31079 - RNA, 34 nt, Artificial Sequence
  Synthetic Oligonucleotide; PRDM1 exon 5; Set C
guucaaguaagcguaggagucccggugcucuuga

SEQ ID NO: 31080 - RNA, 33 nt, Artificial Sequence
  Synthetic Oligonucleotide; PRDM1 exon 5; Set C
guucaaguaagcguaggagucccggugcucuug

SEQ ID NO: 31081 - RNA, 29 nt, Artificial Sequence
  Synthetic Oligonucleotide; PRDM1 exon 5; Set C
cguaggacgcguucaaguaagcguaggag

SEQ ID NO: 31082 - RNA, 28 nt, Artificial Sequence
  Synthetic Oligonucleotide; PRDM1 exon 5; Set C
ccguaggacgcguucaaguaagcguagg

SEQ ID NO: 31083 - RNA, 29 nt, Artificial Sequence
  Synthetic Oligonucleotide; PRDM1 exon 5; Set C
gccguaggacgcguucaaguaagcguagg

SEQ ID NO: 31084 - RNA, 27 nt, Artificial Sequence
  Synthetic Oligonucleotide; PRDM1 exon 5; Set A
ccguaggacgcguucaaguaagcguag

SEQ ID NO: 31085 - RNA, 30 nt, Artificial Sequence
  Synthetic Oligonucleotide; PRDM1 exon 5; Set C
ugccguaggacgcguucaaguaagcguagg

SEQ ID NO: 31086 - RNA, 28 nt, Artificial Sequence
  Synthetic Oligonucleotide; PRDM1 exon 5; Set C
gccguaggacgcguucaaguaagcguag

SEQ ID NO: 31087 - RNA, 26 nt, Artificial Sequence
  Synthetic Oligonucleotide; PRDM1 exon 5; Set C
ccguaggacgcguucaaguaagcgua

SEQ ID NO: 31088 - RNA, 29 nt, Artificial Sequence
  Synthetic Oligonucleotide; PRDM1 exon 5; Set C
ugccguaggacgcguucaaguaagcguag

SEQ ID NO: 31089 - RNA, 27 nt, Artificial Sequence
  Synthetic Oligonucleotide; PRDM1 exon 5; Set C
gccguaggacgcguucaaguaagcgua

SEQ ID NO: 31090 - RNA, 32 nt, Artificial Sequence
  Synthetic Oligonucleotide; PRDM1 exon 5; Set C
cgugccguaggacgcguucaaguaagcguagg

SEQ ID NO: 31091 - RNA, 28 nt, Artificial Sequence
  Synthetic Oligonucleotide; PRDM1 exon 5; Set C
ugccguaggacgcguucaaguaagcgua

SEQ ID NO: 31092 - RNA, 31 nt, Artificial Sequence
  Synthetic Oligonucleotide; PRDM1 exon 5; Set C
cgugccguaggacgcguucaaguaagcguag

SEQ ID NO: 31093 - RNA, 21 nt, Artificial Sequence
  Synthetic Oligonucleotide; PRDM1 exon 5; Set C
cguaggacgcguucaaguaag

SEQ ID NO: 31094 - RNA, 30 nt, Artificial Sequence
  Synthetic Oligonucleotide; PRDM1 exon 5; Set C
cgugccguaggacgcguucaaguaagcgua

SEQ ID NO: 31095 - RNA, 21 nt, Artificial Sequence
  Synthetic Oligonucleotide; PRDM1 exon 5; Set A
ccguaggacgcguucaaguaa

SEQ ID NO: 31096 - RNA, 20 nt, Artificial Sequence
  Synthetic Oligonucleotide; PRDM1 exon 5; Set A
ccguaggacgcguucaagua

SEQ ID NO: 31097 - RNA, 22 nt, Artificial Sequence
  Synthetic Oligonucleotide; PRDM1 exon 5; Set A
gccguaggacgcguucaaguaa

SEQ ID NO: 31098 - RNA, 19 nt, Artificial Sequence
  Synthetic Oligonucleotide; PRDM1 exon 5; Set A
ccguaggacgcguucaagu

SEQ ID NO: 31099 - RNA, 21 nt, Artificial Sequence
  Synthetic Oligonucleotide; PRDM1 exon 5; Set A
gccguaggacgcguucaagua

SEQ ID NO: 31100 - RNA, 23 nt, Artificial Sequence
  Synthetic Oligonucleotide; PRDM1 exon 5; Set A
ugccguaggacgcguucaaguaa

SEQ ID NO: 31101 - RNA, 25 nt, Artificial Sequence
  Synthetic Oligonucleotide; PRDM1 exon 5; Set A
gugccguaggacgcguucaaguaag

SEQ ID NO: 31102 - RNA, 18 nt, Artificial Sequence
  Synthetic Oligonucleotide; PRDM1 exon 5; Set C
ccguaggacgcguucaag

SEQ ID NO: 31103 - RNA, 20 nt, Artificial Sequence
  Synthetic Oligonucleotide; PRDM1 exon 5; Set A
gccguaggacgcguucaagu

SEQ ID NO: 31104 - RNA, 22 nt, Artificial Sequence
  Synthetic Oligonucleotide; PRDM1 exon 5; Set A
ugccguaggacgcguucaagua

SEQ ID NO: 31105 - RNA, 17 nt, Artificial Sequence
  Synthetic Oligonucleotide; PRDM1 exon 5; Set C
ccguaggacgcguucaa

SEQ ID NO: 31106 - RNA, 21 nt, Artificial Sequence
  Synthetic Oligonucleotide; PRDM1 exon 5; Set A
ugccguaggacgcguucaagu

SEQ ID NO: 31107 - RNA, 19 nt, Artificial Sequence
  Synthetic Oligonucleotide; PRDM1 exon 5; Set A
gccguaggacgcguucaag

SEQ ID NO: 31108 - RNA, 25 nt, Artificial Sequence
  Synthetic Oligonucleotide; PRDM1 exon 5; Set C
cgugccguaggacgcguucaaguaa

SEQ ID NO: 31109 - RNA, 16 nt, Artificial Sequence
  Synthetic Oligonucleotide; PRDM1 exon 5; Set C
ccguaggacgcguuca

SEQ ID NO: 31110 - RNA, 18 nt, Artificial Sequence
  Synthetic Oligonucleotide; PRDM1 exon 5; Set A
gccguaggacgcguucaa

SEQ ID NO: 31111 - RNA, 20 nt, Artificial Sequence
  Synthetic Oligonucleotide; PRDM1 exon 5; Set A
ugccguaggacgcguucaag

SEQ ID NO: 31112 - RNA, 24 nt, Artificial Sequence
  Synthetic Oligonucleotide; PRDM1 exon 5; Set C
cgugccguaggacgcguucaagua

SEQ ID NO: 31113 - RNA, 15 nt, Artificial Sequence
  Synthetic Oligonucleotide; PRDM1 exon 5; Set C
ccguaggacgcguuc

SEQ ID NO: 31114 - RNA, 17 nt, Artificial Sequence
  Synthetic Oligonucleotide; PRDM1 exon 5; Set A
gccguaggacgcguuca

SEQ ID NO: 31115 - RNA, 19 nt, Artificial Sequence
  Synthetic Oligonucleotide; PRDM1 exon 5; Set A
ugccguaggacgcguucaa

SEQ ID NO: 31116 - RNA, 23 nt, Artificial Sequence
  Synthetic Oligonucleotide; PRDM1 exon 5; Set C
cgugccguaggacgcguucaagu

SEQ ID NO: 31117 - RNA, 18 nt, Artificial Sequence
  Synthetic Oligonucleotide; PRDM1 exon 5; Set A
ugccguaggacgcguuca

SEQ ID NO: 31118 - RNA, 16 nt, Artificial Sequence
  Synthetic Oligonucleotide; PRDM1 exon 5; Set A
gccguaggacgcguuc

SEQ ID NO: 31119 - RNA, 22 nt, Artificial Sequence
  Synthetic Oligonucleotide; PRDM1 exon 5; Set A
cgugccguaggacgcguucaag

SEQ ID NO: 31120 - RNA, 17 nt, Artificial Sequence
  Synthetic Oligonucleotide; PRDM1 exon 5; Set A
ugccguaggacgcguuc

SEQ ID NO: 31121 - RNA, 15 nt, Artificial Sequence
  Synthetic Oligonucleotide; PRDM1 exon 5; Set A
gccguaggacgcguu

SEQ ID NO: 31122 - RNA, 21 nt, Artificial Sequence
  Synthetic Oligonucleotide; PRDM1 exon 5; Set A
cgugccguaggacgcguucaa

SEQ ID NO: 31123 - RNA, 20 nt, Artificial Sequence
  Synthetic Oligonucleotide; PRDM1 exon 5; Set C
cgugccguaggacgcguuca

SEQ ID NO: 31124 - RNA, 16 nt, Artificial Sequence
  Synthetic Oligonucleotide; PRDM1 exon 5; Set A
ugccguaggacgcguu

SEQ ID NO: 31125 - RNA, 19 nt, Artificial Sequence
  Synthetic Oligonucleotide; PRDM1 exon 5; Set A
cgugccguaggacgcguuc

SEQ ID NO: 31126 - RNA, 18 nt, Artificial Sequence
  Synthetic Oligonucleotide; PRDM1 exon 5; Set A
cgugccguaggacgcguu

SEQ ID NO: 31127 - RNA, 22 nt, Artificial Sequence
  Synthetic Oligonucleotide; PRDM1 exon 5; Set C
ggagcccaaaccuuccgugccg

SEQ ID NO: 31128 - RNA, 23 nt, Artificial Sequence
  Synthetic Oligonucleotide; PRDM1 exon 5; Set C
aggagcccaaaccuuccgugccg

SEQ ID NO: 31129 - RNA, 24 nt, Artificial Sequence
  Synthetic Oligonucleotide; PRDM1 exon 5; Set C
uaggagcccaaaccuuccgugccg

SEQ ID NO: 31130 - RNA, 22 nt, Artificial Sequence
  Synthetic Oligonucleotide; PRDM1 exon 5; Set C
aggagcccaaaccuuccgugcc

SEQ ID NO: 31131 - RNA, 25 nt, Artificial Sequence
  Synthetic Oligonucleotide; PRDM1 exon 5; Set C
guaggagcccaaaccuuccgugccg

SEQ ID NO: 31132 - RNA, 21 nt, Artificial Sequence
  Synthetic Oligonucleotide; PRDM1 exon 5; Set A
aggagcccaaaccuuccgugc

SEQ ID NO: 31133 - RNA, 23 nt, Artificial Sequence
  Synthetic Oligonucleotide; PRDM1 exon 5; Set C
uaggagcccaaaccuuccgugcc

SEQ ID NO: 31134 - RNA, 26 nt, Artificial Sequence
  Synthetic Oligonucleotide; PRDM1 exon 5; Set C
gguaggagcccaaaccuuccgugccg

SEQ ID NO: 31135 - RNA, 22 nt, Artificial Sequence
  Synthetic Oligonucleotide; PRDM1 exon 5; Set A
uaggagcccaaaccuuccgugc

SEQ ID NO: 31136 - RNA, 24 nt, Artificial Sequence
  Synthetic Oligonucleotide; PRDM1 exon 5; Set C
guaggagcccaaaccuuccgugcc

SEQ ID NO: 31137 - RNA, 27 nt, Artificial Sequence
  Synthetic Oligonucleotide; PRDM1 exon 5; Set C
ggguaggagcccaaaccuuccgugccg

SEQ ID NO: 31138 - RNA, 23 nt, Artificial Sequence
  Synthetic Oligonucleotide; PRDM1 exon 5; Set A
guaggagcccaaaccuuccgugc

SEQ ID NO: 31139 - RNA, 25 nt, Artificial Sequence
  Synthetic Oligonucleotide; PRDM1 exon 5; Set C
gguaggagcccaaaccuuccgugcc

SEQ ID NO: 31140 - RNA, 20 nt, Artificial Sequence
  Synthetic Oligonucleotide; PRDM1 exon 5; Set A
uaggagcccaaaccuuccgu

SEQ ID NO: 31141 - RNA, 28 nt, Artificial Sequence
  Synthetic Oligonucleotide; PRDM1 exon 5; Set C
aggguaggagcccaaaccuuccgugccg

SEQ ID NO: 31142 - RNA, 24 nt, Artificial Sequence
  Synthetic Oligonucleotide; PRDM1 exon 5; Set C
gguaggagcccaaaccuuccgugc

SEQ ID NO: 31143 - RNA, 26 nt, Artificial Sequence
  Synthetic Oligonucleotide; PRDM1 exon 5; Set C
ggguaggagcccaaaccuuccgugcc

SEQ ID NO: 31144 - RNA, 21 nt, Artificial Sequence
  Synthetic Oligonucleotide; PRDM1 exon 5; Set A
guaggagcccaaaccuuccgu

SEQ ID NO: 31145 - RNA, 25 nt, Artificial Sequence
  Synthetic Oligonucleotide; PRDM1 exon 5; Set C
ggguaggagcccaaaccuuccgugc

SEQ ID NO: 31146 - RNA, 27 nt, Artificial Sequence
  Synthetic Oligonucleotide; PRDM1 exon 5; Set C
aggguaggagcccaaaccuuccgugcc

SEQ ID NO: 31147 - RNA, 22 nt, Artificial Sequence
  Synthetic Oligonucleotide; PRDM1 exon 5; Set A
gguaggagcccaaaccuuccgu

SEQ ID NO: 31148 - RNA, 26 nt, Artificial Sequence
  Synthetic Oligonucleotide; PRDM1 exon 5; Set C
aggguaggagcccaaaccuuccgugc

SEQ ID NO: 31149 - RNA, 23 nt, Artificial Sequence
  Synthetic Oligonucleotide; PRDM1 exon 5; Set C
ggguaggagcccaaaccuuccgu

SEQ ID NO: 31150 - RNA, 24 nt, Artificial Sequence
  Synthetic Oligonucleotide; PRDM1 exon 5; Set C
aggguaggagcccaaaccuuccgu

SEQ ID NO: 31151 - RNA, 34 nt, Artificial Sequence
  Synthetic Oligonucleotide; PRDM1 exon 5; Set C
guagccaggguaggagcccaaaccuuccgugccg

SEQ ID NO: 31152 - RNA, 35 nt, Artificial Sequence
  Synthetic Oligonucleotide; PRDM1 exon 5; Set C
cguagccaggguaggagcccaaaccuuccgugccg

SEQ ID NO: 31153 - RNA, 33 nt, Artificial Sequence
  Synthetic Oligonucleotide; PRDM1 exon 5; Set C
guagccaggguaggagcccaaaccuuccgugcc

SEQ ID NO: 31154 - RNA, 36 nt, Artificial Sequence
  Synthetic Oligonucleotide; PRDM1 exon 5; Set C
gcguagccaggguaggagcccaaaccuuccgugccg

SEQ ID NO: 31155 - RNA, 32 nt, Artificial Sequence
  Synthetic Oligonucleotide; PRDM1 exon 5; Set C
guagccaggguaggagcccaaaccuuccgugc

SEQ ID NO: 31156 - RNA, 34 nt, Artificial Sequence
  Synthetic Oligonucleotide; PRDM1 exon 5; Set C
cguagccaggguaggagcccaaaccuuccgugcc

SEQ ID NO: 31157 - RNA, 37 nt, Artificial Sequence
  Synthetic Oligonucleotide; PRDM1 exon 5; Set C
ugcguagccaggguaggagcccaaaccuuccgugccg

SEQ ID NO: 31158 - RNA, 33 nt, Artificial Sequence
  Synthetic Oligonucleotide; PRDM1 exon 5; Set C
cguagccaggguaggagcccaaaccuuccgugc

SEQ ID NO: 31159 - RNA, 35 nt, Artificial Sequence
  Synthetic Oligonucleotide; PRDM1 exon 5; Set C
gcguagccaggguaggagcccaaaccuuccgugcc

SEQ ID NO: 31160 - RNA, 30 nt, Artificial Sequence
  Synthetic Oligonucleotide; PRDM1 exon 5; Set C
guagccaggguaggagcccaaaccuuccgu

SEQ ID NO: 31161 - RNA, 38 nt, Artificial Sequence
  Synthetic Oligonucleotide; PRDM1 exon 5; Set C
gugcguagccaggguaggagcccaaaccuuccgugccg

SEQ ID NO: 31162 - RNA, 34 nt, Artificial Sequence
  Synthetic Oligonucleotide; PRDM1 exon 5; Set C
gcguagccaggguaggagcccaaaccuuccgugc

SEQ ID NO: 31163 - RNA, 36 nt, Artificial Sequence
  Synthetic Oligonucleotide; PRDM1 exon 5; Set C
ugcguagccaggguaggagcccaaaccuuccgugcc

SEQ ID NO: 31164 - RNA, 31 nt, Artificial Sequence
  Synthetic Oligonucleotide; PRDM1 exon 5; Set C
cguagccaggguaggagcccaaaccuuccgu

SEQ ID NO: 31165 - RNA, 39 nt, Artificial Sequence
  Synthetic Oligonucleotide; PRDM1 exon 5; Set C
ggugcguagccaggguaggagcccaaaccuuccgugccg

SEQ ID NO: 31166 - RNA, 35 nt, Artificial Sequence
  Synthetic Oligonucleotide; PRDM1 exon 5; Set C
ugcguagccaggguaggagcccaaaccuuccgugc

SEQ ID NO: 31167 - RNA, 37 nt, Artificial Sequence
  Synthetic Oligonucleotide; PRDM1 exon 5; Set C
gugcguagccaggguaggagcccaaaccuuccgugcc

SEQ ID NO: 31168 - RNA, 32 nt, Artificial Sequence
  Synthetic Oligonucleotide; PRDM1 exon 5; Set C
gcguagccaggguaggagcccaaaccuuccgu

SEQ ID NO: 31169 - RNA, 40 nt, Artificial Sequence
  Synthetic Oligonucleotide; PRDM1 exon 5; Set C
gggugcguagccaggguaggagcccaaaccuuccgugccg

SEQ ID NO: 31170 - RNA, 36 nt, Artificial Sequence
  Synthetic Oligonucleotide; PRDM1 exon 5; Set C
gugcguagccaggguaggagcccaaaccuuccgugc

SEQ ID NO: 31171 - RNA, 38 nt, Artificial Sequence
  Synthetic Oligonucleotide; PRDM1 exon 5; Set C
ggugcguagccaggguaggagcccaaaccuuccgugcc

SEQ ID NO: 31172 - RNA, 33 nt, Artificial Sequence
  Synthetic Oligonucleotide; PRDM1 exon 5; Set C
ugcguagccaggguaggagcccaaaccuuccgu

SEQ ID NO: 31173 - RNA, 37 nt, Artificial Sequence
  Synthetic Oligonucleotide; PRDM1 exon 5; Set C
ggugcguagccaggguaggagcccaaaccuuccgugc

SEQ ID NO: 31174 - RNA, 39 nt, Artificial Sequence
  Synthetic Oligonucleotide; PRDM1 exon 5; Set C
gggugcguagccaggguaggagcccaaaccuuccgugcc

SEQ ID NO: 31175 - RNA, 15 nt, Artificial Sequence
  Synthetic Oligonucleotide; PRDM1 exon 5; Set C
aggguaggagcccaa

SEQ ID NO: 31176 - RNA, 34 nt, Artificial Sequence
  Synthetic Oligonucleotide; PRDM1 exon 5; Set C
gugcguagccaggguaggagcccaaaccuuccgu

SEQ ID NO: 31177 - RNA, 38 nt, Artificial Sequence
  Synthetic Oligonucleotide; PRDM1 exon 5; Set C
gggugcguagccaggguaggagcccaaaccuuccgugc

SEQ ID NO: 31178 - RNA, 40 nt, Artificial Sequence
  Synthetic Oligonucleotide; PRDM1 exon 5; Set C
ggggugcguagccaggguaggagcccaaaccuuccgugcc

SEQ ID NO: 31179 - RNA, 35 nt, Artificial Sequence
  Synthetic Oligonucleotide; PRDM1 exon 5; Set C
ggugcguagccaggguaggagcccaaaccuuccgu

SEQ ID NO: 31180 - RNA, 39 nt, Artificial Sequence
  Synthetic Oligonucleotide; PRDM1 exon 5; Set C
ggggugcguagccaggguaggagcccaaaccuuccgugc

SEQ ID NO: 31181 - RNA, 36 nt, Artificial Sequence
  Synthetic Oligonucleotide; PRDM1 exon 5; Set C
gggugcguagccaggguaggagcccaaaccuuccgu

SEQ ID NO: 31182 - RNA, 40 nt, Artificial Sequence
  Synthetic Oligonucleotide; PRDM1 exon 5; Set C
aggggugcguagccaggguaggagcccaaaccuuccgugc

SEQ ID NO: 31183 - RNA, 37 nt, Artificial Sequence
  Synthetic Oligonucleotide; PRDM1 exon 5; Set C
ggggugcguagccaggguaggagcccaaaccuuccgu

SEQ ID NO: 31184 - RNA, 38 nt, Artificial Sequence
  Synthetic Oligonucleotide; PRDM1 exon 5; Set C
aggggugcguagccaggguaggagcccaaaccuuccgu

SEQ ID NO: 31185 - RNA, 21 nt, Artificial Sequence
  Synthetic Oligonucleotide; PRDM1 exon 5; Set A
guagccaggguaggagcccaa

SEQ ID NO: 31186 - RNA, 22 nt, Artificial Sequence
  Synthetic Oligonucleotide; PRDM1 exon 5; Set C
cguagccaggguaggagcccaa

SEQ ID NO: 31187 - RNA, 23 nt, Artificial Sequence
  Synthetic Oligonucleotide; PRDM1 exon 5; Set C
gcguagccaggguaggagcccaa

SEQ ID NO: 31188 - RNA, 24 nt, Artificial Sequence
  Synthetic Oligonucleotide; PRDM1 exon 5; Set C
ugcguagccaggguaggagcccaa

SEQ ID NO: 31189 - RNA, 25 nt, Artificial Sequence
  Synthetic Oligonucleotide; PRDM1 exon 5; Set C
gugcguagccaggguaggagcccaa

SEQ ID NO: 31190 - RNA, 26 nt, Artificial Sequence
  Synthetic Oligonucleotide; PRDM1 exon 5; Set C
ggugcguagccaggguaggagcccaa

SEQ ID NO: 31191 - RNA, 27 nt, Artificial Sequence
  Synthetic Oligonucleotide; PRDM1 exon 5; Set C
gggugcguagccaggguaggagcccaa

SEQ ID NO: 31192 - RNA, 28 nt, Artificial Sequence
  Synthetic Oligonucleotide; PRDM1 exon 5; Set C
ggggugcguagccaggguaggagcccaa

SEQ ID NO: 31193 - RNA, 29 nt, Artificial Sequence
  Synthetic Oligonucleotide; PRDM1 exon 5; Set C
aggggugcguagccaggguaggagcccaa

SEQ ID NO: 31194 - RNA, 33 nt, Artificial Sequence
  Synthetic Oligonucleotide; PRDM1 exon 5; Set C
gggcaggggugcguagccaggguaggagcccaa

SEQ ID NO: 31195 - RNA, 34 nt, Artificial Sequence
  Synthetic Oligonucleotide; PRDM1 exon 5; Set C
ggggcaggggugcguagccaggguaggagcccaa

SEQ ID NO: 31196 - RNA, 35 nt, Artificial Sequence
  Synthetic Oligonucleotide; PRDM1 exon 5; Set C
uggggcaggggugcguagccaggguaggagcccaa

SEQ ID NO: 31197 - RNA, 37 nt, Artificial Sequence
  Synthetic Oligonucleotide; PRDM1 exon 5; Set C
guggggcaggggugcguagccaggguaggagcccaaa

SEQ ID NO: 31198 - RNA, 36 nt, Artificial Sequence
  Synthetic Oligonucleotide; PRDM1 exon 5; Set C
guggggcaggggugcguagccaggguaggagcccaa

SEQ ID NO: 31199 - RNA, 38 nt, Artificial Sequence
  Synthetic Oligonucleotide; PRDM1 exon 5; Set C
gguggggcaggggugcguagccaggguaggagcccaaa

SEQ ID NO: 31200 - RNA, 37 nt, Artificial Sequence
  Synthetic Oligonucleotide; PRDM1 exon 5; Set C
gguggggcaggggugcguagccaggguaggagcccaa

SEQ ID NO: 31201 - RNA, 39 nt, Artificial Sequence
  Synthetic Oligonucleotide; PRDM1 exon 5; Set C
agguggggcaggggugcguagccaggguaggagcccaaa

SEQ ID NO: 31202 - RNA, 38 nt, Artificial Sequence
  Synthetic Oligonucleotide; PRDM1 exon 5; Set C
agguggggcaggggugcguagccaggguaggagcccaa

SEQ ID NO: 31203 - RNA, 35 nt, Artificial Sequence
  Synthetic Oligonucleotide; PRDM1 exon 5; Set C
cuggcgggagguggggcaggggugcguagccaggg

SEQ ID NO: 31204 - RNA, 34 nt, Artificial Sequence
  Synthetic Oligonucleotide; PRDM1 exon 5; Set C
cuggcgggagguggggcaggggugcguagccagg

SEQ ID NO: 31205 - RNA, 20 nt, Artificial Sequence
  Synthetic Oligonucleotide; PRDM1 exon 5; Set C
cuggcgggagguggggcagg

SEQ ID NO: 31206 - RNA, 19 nt, Artificial Sequence
  Synthetic Oligonucleotide; PRDM1 exon 5; Set C
cuggcgggagguggggcag

SEQ ID NO: 31207 - RNA, 18 nt, Artificial Sequence
  Synthetic Oligonucleotide; PRDM1 exon 5; Set C
cuggcgggagguggggca

SEQ ID NO: 31208 - RNA, 17 nt, Artificial Sequence
  Synthetic Oligonucleotide; PRDM1 exon 5; Set C
cuggcgggagguggggc

SEQ ID NO: 31209 - RNA, 16 nt, Artificial Sequence
  Synthetic Oligonucleotide; PRDM1 exon 5; Set A
cuggcgggaggugggg

SEQ ID NO: 31210 - RNA, 15 nt, Artificial Sequence
  Synthetic Oligonucleotide; PRDM1 exon 5; Set A
cuggcgggagguggg

SEQ ID NO: 31211 - RNA, 19 nt, Artificial Sequence
  Synthetic Oligonucleotide; PRDM1 exon 5; Set A
ggggaugaaagcuggcggg

SEQ ID NO: 31212 - RNA, 25 nt, Artificial Sequence
  Synthetic Oligonucleotide; PRDM1 exon 5; Set C
uacgaggggaugaaagcuggcggga

SEQ ID NO: 31213 - RNA, 26 nt, Artificial Sequence
  Synthetic Oligonucleotide; PRDM1 exon 5; Set C
guacgaggggaugaaagcuggcggga

SEQ ID NO: 31214 - RNA, 24 nt, Artificial Sequence
  Synthetic Oligonucleotide; PRDM1 exon 5; Set C
uacgaggggaugaaagcuggcggg

SEQ ID NO: 31215 - RNA, 25 nt, Artificial Sequence
  Synthetic Oligonucleotide; PRDM1 exon 5; Set C
guacgaggggaugaaagcuggcggg

SEQ ID NO: 31216 - RNA, 15 nt, Artificial Sequence
  Synthetic Oligonucleotide; PRDM1 exon 5; Set C
aggggaugaaagcug

SEQ ID NO: 31217 - RNA, 16 nt, Artificial Sequence
  Synthetic Oligonucleotide; PRDM1 exon 5; Set C
gaggggaugaaagcug

SEQ ID NO: 31218 - RNA, 19 nt, Artificial Sequence
  Synthetic Oligonucleotide; PRDM1 exon 5; Set C
uacgaggggaugaaagcug

SEQ ID NO: 31219 - RNA, 20 nt, Artificial Sequence
  Synthetic Oligonucleotide; PRDM1 exon 5; Set C
guacgaggggaugaaagcug

SEQ ID NO: 31220 - RNA, 21 nt, Artificial Sequence
  Synthetic Oligonucleotide; PRDM1 exon 5; Set C
uguacgaggggaugaaagcug

SEQ ID NO: 31221 - RNA, 22 nt, Artificial Sequence
  Synthetic Oligonucleotide; PRDM1 exon 5; Set C
uuguacgaggggaugaaagcug

SEQ ID NO: 31222 - RNA, 36 nt, Artificial Sequence
  Synthetic Oligonucleotide; PRDM1 exon 5; Set C
uucaugccguaggggggcaagaggaacuugggguag

SEQ ID NO: 31223 - RNA, 16 nt, Artificial Sequence
  Synthetic Oligonucleotide; PRDM1 exon 5; Set C
aggccauuacaauuca

SEQ ID NO: 31224 - RNA, 15 nt, Artificial Sequence
  Synthetic Oligonucleotide; PRDM1 exon 5; Set C
aggccauuacaauuc

SEQ ID NO: 31225 - RNA, 29 nt, Artificial Sequence
  Synthetic Oligonucleotide; PRDM1 exon 5; Set C
augcugcucacagcgcucaggccauuaca

SEQ ID NO: 31226 - RNA, 26 nt, Artificial Sequence
  Synthetic Oligonucleotide; PRDM1 exon 5; Set C
augcugcucacagcgcucaggccauu

SEQ ID NO: 31227 - RNA, 21 nt, Artificial Sequence
  Synthetic Oligonucleotide; PRDM1 exon 5; Set A
augcugcucacagcgcucagg

SEQ ID NO: 31228 - RNA, 22 nt, Artificial Sequence
  Synthetic Oligonucleotide; PRDM1 exon 5; Set C
caugcugcucacagcgcucagg

SEQ ID NO: 31229 - RNA, 23 nt, Artificial Sequence
  Synthetic Oligonucleotide; PRDM1 exon 5; Set C
ucaugcugcucacagcgcucagg

SEQ ID NO: 31230 - RNA, 24 nt, Artificial Sequence
  Synthetic Oligonucleotide; PRDM1 exon 5; Set C
uucaugcugcucacagcgcucagg

SEQ ID NO: 31231 - RNA, 25 nt, Artificial Sequence
  Synthetic Oligonucleotide; PRDM1 exon 5; Set C
auucaugcugcucacagcgcucagg

SEQ ID NO: 31232 - RNA, 33 nt, Artificial Sequence
  Synthetic Oligonucleotide; PRDM1 exon 5; Set C
uugaugccauucaugcugcucacagcgcucagg

SEQ ID NO: 31233 - RNA, 34 nt, Artificial Sequence
  Synthetic Oligonucleotide; PRDM1 exon 5; Set C
guugaugccauucaugcugcucacagcgcucagg

SEQ ID NO: 31234 - RNA, 35 nt, Artificial Sequence
  Synthetic Oligonucleotide; PRDM1 exon 5; Set C
uguugaugccauucaugcugcucacagcgcucagg

SEQ ID NO: 31235 - RNA, 21 nt, Artificial Sequence
  Synthetic Oligonucleotide; PRDM1 exon 5; Set C
gaagaggccaaaguuguugau

SEQ ID NO: 31236 - RNA, 20 nt, Artificial Sequence
  Synthetic Oligonucleotide; PRDM1 exon 5; Set C
gaagaggccaaaguuguuga

SEQ ID NO: 31237 - RNA, 22 nt, Artificial Sequence
  Synthetic Oligonucleotide; PRDM1 exon 5; Set C
ggaagaggccaaaguuguugau

SEQ ID NO: 31238 - RNA, 21 nt, Artificial Sequence
  Synthetic Oligonucleotide; PRDM1 exon 5; Set C
ggaagaggccaaaguuguuga

SEQ ID NO: 31239 - RNA, 23 nt, Artificial Sequence
  Synthetic Oligonucleotide; PRDM1 exon 5; Set A
gggaagaggccaaaguuguugau

SEQ ID NO: 31240 - RNA, 22 nt, Artificial Sequence
  Synthetic Oligonucleotide; PRDM1 exon 5; Set A
gggaagaggccaaaguuguuga

SEQ ID NO: 31241 - RNA, 40 nt, Artificial Sequence
  Synthetic Oligonucleotide; PRDM1 exon 5; Set C
auugcuguagacagggcacagccucgggaagaggccaaag

SEQ ID NO: 31242 - RNA, 39 nt, Artificial Sequence
  Synthetic Oligonucleotide; PRDM1 exon 5; Set C
auugcuguagacagggcacagccucgggaagaggccaaa

SEQ ID NO: 31243 - RNA, 40 nt, Artificial Sequence
  Synthetic Oligonucleotide; PRDM1 exon 5; Set C
gauugcuguagacagggcacagccucgggaagaggccaaa

SEQ ID NO: 31244 - RNA, 15 nt, Artificial Sequence
  Synthetic Oligonucleotide; PRDM1 exon 5; Set C
auugcuguagacagg

SEQ ID NO: 31245 - RNA, 16 nt, Artificial Sequence
  Synthetic Oligonucleotide; PRDM1 exon 5; Set C
gauugcuguagacagg

SEQ ID NO: 31246 - RNA, 17 nt, Artificial Sequence
  Synthetic Oligonucleotide; PRDM1 exon 5; Set C
agauugcuguagacagg

SEQ ID NO: 31247 - RNA, 18 nt, Artificial Sequence
  Synthetic Oligonucleotide; PRDM1 exon 5; Set C
gagauugcuguagacagg

SEQ ID NO: 31248 - RNA, 19 nt, Artificial Sequence
  Synthetic Oligonucleotide; PRDM1 exon 5; Set C
ggagauugcuguagacagg

SEQ ID NO: 31249 - RNA, 20 nt, Artificial Sequence
  Synthetic Oligonucleotide; PRDM1 exon 5; Set C
aggagauugcuguagacagg

SEQ ID NO: 31250 - RNA, 21 nt, Artificial Sequence
  Synthetic Oligonucleotide; PRDM1 exon 5; Set A
gaggagauugcuguagacagg

SEQ ID NO: 31251 - RNA, 15 nt, Artificial Sequence
  Synthetic Oligonucleotide; PRDM1 exon 5; Set C
ggagauugcuguaga

SEQ ID NO: 31252 - RNA, 16 nt, Artificial Sequence
  Synthetic Oligonucleotide; PRDM1 exon 5; Set C
aggagauugcuguaga

SEQ ID NO: 31253 - RNA, 17 nt, Artificial Sequence
  Synthetic Oligonucleotide; PRDM1 exon 5; Set C
gaggagauugcuguaga

SEQ ID NO: 31254 - RNA, 15 nt, Artificial Sequence
  Synthetic Oligonucleotide; PRDM1 exon 5; Set C
aggagauugcuguag

SEQ ID NO: 31255 - RNA, 16 nt, Artificial Sequence
  Synthetic Oligonucleotide; PRDM1 exon 5; Set C
gaggagauugcuguag

SEQ ID NO: 31256 - RNA, 24 nt, Artificial Sequence
  Synthetic Oligonucleotide; PRDM1 exon 5; Set C
ugcccccaccgaggagauugcugu

SEQ ID NO: 31257 - RNA, 25 nt, Artificial Sequence
  Synthetic Oligonucleotide; PRDM1 exon 5; Set C
cugcccccaccgaggagauugcugu

SEQ ID NO: 31258 - RNA, 26 nt, Artificial Sequence
  Synthetic Oligonucleotide; PRDM1 exon 5; Set C
gcugcccccaccgaggagauugcugu

SEQ ID NO: 31259 - RNA, 27 nt, Artificial Sequence
  Synthetic Oligonucleotide; PRDM1 exon 5; Set C
ggcugcccccaccgaggagauugcugu

SEQ ID NO: 31260 - RNA, 28 nt, Artificial Sequence
  Synthetic Oligonucleotide; PRDM1 exon 5; Set C
aggcugcccccaccgaggagauugcugu

SEQ ID NO: 31261 - RNA, 29 nt, Artificial Sequence
  Synthetic Oligonucleotide; PRDM1 exon 5; Set C
caggcugcccccaccgaggagauugcugu

SEQ ID NO: 31262 - RNA, 17 nt, Artificial Sequence
  Synthetic Oligonucleotide; PRDM1 exon 5; Set A
ugcccccaccgaggaga

SEQ ID NO: 31263 - RNA, 16 nt, Artificial Sequence
  Synthetic Oligonucleotide; PRDM1 exon 5; Set A
ugcccccaccgaggag

SEQ ID NO: 31264 - RNA, 15 nt, Artificial Sequence
  Synthetic Oligonucleotide; PRDM1 exon 5; Set A
ugcccccaccgagga

SEQ ID NO: 31265 - RNA, 17 nt, Artificial Sequence
  Synthetic Oligonucleotide; PRDM1 exon 5; Set A
cugcccccaccgaggag

SEQ ID NO: 31266 - RNA, 16 nt, Artificial Sequence
  Synthetic Oligonucleotide; PRDM1 exon 5; Set A
cugcccccaccgagga

SEQ ID NO: 31267 - RNA, 17 nt, Artificial Sequence
  Synthetic Oligonucleotide; PRDM1 exon 5; Set C
gcugcccccaccgagga

SEQ ID NO: 31268 - RNA, 15 nt, Artificial Sequence
  Synthetic Oligonucleotide; PRDM1 exon 5; Set A
cugcccccaccgagg

SEQ ID NO: 31269 - RNA, 16 nt, Artificial Sequence
  Synthetic Oligonucleotide; PRDM1 exon 5; Set A
gcugcccccaccgagg

SEQ ID NO: 31270 - RNA, 15 nt, Artificial Sequence
  Synthetic Oligonucleotide; PRDM1 exon 5; Set A
gcugcccccaccgag

SEQ ID NO: 31271 - RNA, 17 nt, Artificial Sequence
  Synthetic Oligonucleotide; PRDM1 exon 5; Set C
ggcugcccccaccgagg

SEQ ID NO: 31272 - RNA, 16 nt, Artificial Sequence
  Synthetic Oligonucleotide; PRDM1 exon 5; Set A
ggcugcccccaccgag

SEQ ID NO: 31273 - RNA, 39 nt, Artificial Sequence
  Synthetic Oligonucleotide; PRDM1 exon 5; Set C
ugggguggggcaggcugcccccaccgaggagauugcugu

SEQ ID NO: 31274 - RNA, 40 nt, Artificial Sequence
  Synthetic Oligonucleotide; PRDM1 exon 5; Set C
augggguggggcaggcugcccccaccgaggagauugcugu

SEQ ID NO: 31275 - RNA, 31 nt, Artificial Sequence
  Synthetic Oligonucleotide; PRDM1 exon 5; Set C
gggguggggcaggcugcccccaccgaggaga

SEQ ID NO: 31276 - RNA, 30 nt, Artificial Sequence
  Synthetic Oligonucleotide; PRDM1 exon 5; Set C
gggguggggcaggcugcccccaccgaggag

SEQ ID NO: 31277 - RNA, 29 nt, Artificial Sequence
  Synthetic Oligonucleotide; PRDM1 exon 5; Set C
gggguggggcaggcugcccccaccgagga

SEQ ID NO: 31278 - RNA, 28 nt, Artificial Sequence
  Synthetic Oligonucleotide; PRDM1 exon 5; Set C
gggguggggcaggcugcccccaccgagg

SEQ ID NO: 31279 - RNA, 27 nt, Artificial Sequence
  Synthetic Oligonucleotide; PRDM1 exon 5; Set C
gggguggggcaggcugcccccaccgag

SEQ ID NO: 31280 - RNA, 15 nt, Artificial Sequence
  Synthetic Oligonucleotide; PRDM1 exon 5; Set C
gagaagugggguuga

SEQ ID NO: 31281 - RNA, 16 nt, Artificial Sequence
  Synthetic Oligonucleotide; PRDM1 exon 5; Set C
agagaagugggguuga

SEQ ID NO: 31282 - RNA, 17 nt, Artificial Sequence
  Synthetic Oligonucleotide; PRDM1 exon 5; Set C
gagagaagugggguuga

SEQ ID NO: 31283 - RNA, 32 nt, Artificial Sequence
  Synthetic Oligonucleotide; PRDM1 exon 5; Set C
gagcucgggagagaagugggguugagcauggg

SEQ ID NO: 31284 - RNA, 18 nt, Artificial Sequence
  Synthetic Oligonucleotide; PRDM1 exon 5; Set C
ggagagaagugggguuga

SEQ ID NO: 31285 - RNA, 31 nt, Artificial Sequence
  Synthetic Oligonucleotide; PRDM1 exon 5; Set C
gagcucgggagagaagugggguugagcaugg

SEQ ID NO: 31286 - RNA, 19 nt, Artificial Sequence
  Synthetic Oligonucleotide; PRDM1 exon 5; Set A
gggagagaagugggguuga

SEQ ID NO: 31287 - RNA, 30 nt, Artificial Sequence
  Synthetic Oligonucleotide; PRDM1 exon 5; Set C
gagcucgggagagaagugggguugagcaug

SEQ ID NO: 31288 - RNA, 39 nt, Artificial Sequence
  Synthetic Oligonucleotide; PRDM1 exon 5; Set C
gggcagcgagcucgggagagaagugggguugagcauggg

SEQ ID NO: 31289 - RNA, 38 nt, Artificial Sequence
  Synthetic Oligonucleotide; PRDM1 exon 5; Set C
gggcagcgagcucgggagagaagugggguugagcaugg

SEQ ID NO: 31290 - RNA, 37 nt, Artificial Sequence
  Synthetic Oligonucleotide; PRDM1 exon 5; Set C
gggcagcgagcucgggagagaagugggguugagcaug

SEQ ID NO: 31291 - RNA, 23 nt, Artificial Sequence
  Synthetic Oligonucleotide; PRDM1 exon 5; Set A
gagcucgggagagaagugggguu

SEQ ID NO: 31292 - RNA, 22 nt, Artificial Sequence
  Synthetic Oligonucleotide; PRDM1 exon 5; Set A
gagcucgggagagaaguggggu

SEQ ID NO: 31293 - RNA, 21 nt, Artificial Sequence
  Synthetic Oligonucleotide; PRDM1 exon 5; Set A
gagcucgggagagaagugggg

SEQ ID NO: 31294 - RNA, 20 nt, Artificial Sequence
  Synthetic Oligonucleotide; PRDM1 exon 5; Set A
gagcucgggagagaaguggg

SEQ ID NO: 31295 - RNA, 19 nt, Artificial Sequence
  Synthetic Oligonucleotide; PRDM1 exon 5; Set A
gagcucgggagagaagugg

SEQ ID NO: 31296 - RNA, 18 nt, Artificial Sequence
  Synthetic Oligonucleotide; PRDM1 exon 5; Set C
gagcucgggagagaagug

SEQ ID NO: 31297 - RNA, 17 nt, Artificial Sequence
  Synthetic Oligonucleotide; PRDM1 exon 5; Set C
gagcucgggagagaagu

SEQ ID NO: 31298 - RNA, 30 nt, Artificial Sequence
  Synthetic Oligonucleotide; PRDM1 exon 5; Set C
gggcagcgagcucgggagagaagugggguu

SEQ ID NO: 31299 - RNA, 16 nt, Artificial Sequence
  Synthetic Oligonucleotide; PRDM1 exon 5; Set C
gagcucgggagagaag

SEQ ID NO: 31300 - RNA, 32 nt, Artificial Sequence
  Synthetic Oligonucleotide; PRDM1 exon 5; Set C
agggcagcgagcucgggagagaagugggguug

SEQ ID NO: 31301 - RNA, 29 nt, Artificial Sequence
  Synthetic Oligonucleotide; PRDM1 exon 5; Set C
gggcagcgagcucgggagagaaguggggu

SEQ ID NO: 31302 - RNA, 15 nt, Artificial Sequence
  Synthetic Oligonucleotide; PRDM1 exon 5; Set C
gagcucgggagagaa

SEQ ID NO: 31303 - RNA, 33 nt, Artificial Sequence
  Synthetic Oligonucleotide; PRDM1 exon 5; Set C
gagggcagcgagcucgggagagaagugggguug

SEQ ID NO: 31304 - RNA, 28 nt, Artificial Sequence
  Synthetic Oligonucleotide; PRDM1 exon 5; Set C
gggcagcgagcucgggagagaagugggg

SEQ ID NO: 31305 - RNA, 34 nt, Artificial Sequence
  Synthetic Oligonucleotide; PRDM1 exon 5; Set C
ugagggcagcgagcucgggagagaagugggguug

SEQ ID NO: 31306 - RNA, 27 nt, Artificial Sequence
  Synthetic Oligonucleotide; PRDM1 exon 5; Set C
gggcagcgagcucgggagagaaguggg

SEQ ID NO: 31307 - RNA, 35 nt, Artificial Sequence
  Synthetic Oligonucleotide; PRDM1 exon 5; Set C
cugagggcagcgagcucgggagagaagugggguug

SEQ ID NO: 31308 - RNA, 26 nt, Artificial Sequence
  Synthetic Oligonucleotide; PRDM1 exon 5; Set C
gggcagcgagcucgggagagaagugg

SEQ ID NO: 31309 - RNA, 36 nt, Artificial Sequence
  Synthetic Oligonucleotide; PRDM1 exon 5; Set C
ucugagggcagcgagcucgggagagaagugggguug

SEQ ID NO: 31310 - RNA, 25 nt, Artificial Sequence
  Synthetic Oligonucleotide; PRDM1 exon 5; Set C
gggcagcgagcucgggagagaagug

SEQ ID NO: 31311 - RNA, 37 nt, Artificial Sequence
  Synthetic Oligonucleotide; PRDM1 exon 5; Set C
aucugagggcagcgagcucgggagagaagugggguug

SEQ ID NO: 31312 - RNA, 24 nt, Artificial Sequence
  Synthetic Oligonucleotide; PRDM1 exon 5; Set C
gggcagcgagcucgggagagaagu

SEQ ID NO: 31313 - RNA, 37 nt, Artificial Sequence
  Synthetic Oligonucleotide; PRDM1 exon 5; Set C
caucugagggcagcgagcucgggagagaagugggguu

SEQ ID NO: 31314 - RNA, 23 nt, Artificial Sequence
  Synthetic Oligonucleotide; PRDM1 exon 5; Set C
gggcagcgagcucgggagagaag

SEQ ID NO: 31315 - RNA, 36 nt, Artificial Sequence
  Synthetic Oligonucleotide; PRDM1 exon 5; Set C
caucugagggcagcgagcucgggagagaaguggggu

SEQ ID NO: 31316 - RNA, 22 nt, Artificial Sequence
  Synthetic Oligonucleotide; PRDM1 exon 5; Set C
gggcagcgagcucgggagagaa

SEQ ID NO: 31317 - RNA, 35 nt, Artificial Sequence
  Synthetic Oligonucleotide; PRDM1 exon 5; Set C
caucugagggcagcgagcucgggagagaagugggg

SEQ ID NO: 31318 - RNA, 21 nt, Artificial Sequence
  Synthetic Oligonucleotide; PRDM1 exon 5; Set C
gggcagcgagcucgggagaga

SEQ ID NO: 31319 - RNA, 20 nt, Artificial Sequence
  Synthetic Oligonucleotide; PRDM1 exon 5; Set C
gggcagcgagcucgggagag

SEQ ID NO: 31320 - RNA, 34 nt, Artificial Sequence
  Synthetic Oligonucleotide; PRDM1 exon 5; Set C
caucugagggcagcgagcucgggagagaaguggg

SEQ ID NO: 31321 - RNA, 19 nt, Artificial Sequence
  Synthetic Oligonucleotide; PRDM1 exon 5; Set C
gggcagcgagcucgggaga

SEQ ID NO: 31322 - RNA, 33 nt, Artificial Sequence
  Synthetic Oligonucleotide; PRDM1 exon 5; Set C
caucugagggcagcgagcucgggagagaagugg

SEQ ID NO: 31323 - RNA, 18 nt, Artificial Sequence
  Synthetic Oligonucleotide; PRDM1 exon 5; Set A
gggcagcgagcucgggag

SEQ ID NO: 31324 - RNA, 32 nt, Artificial Sequence
  Synthetic Oligonucleotide; PRDM1 exon 5; Set C
caucugagggcagcgagcucgggagagaagug

SEQ ID NO: 31325 - RNA, 31 nt, Artificial Sequence
  Synthetic Oligonucleotide; PRDM1 exon 5; Set C
caucugagggcagcgagcucgggagagaagu

SEQ ID NO: 31326 - RNA, 30 nt, Artificial Sequence
  Synthetic Oligonucleotide; PRDM1 exon 5; Set C
caucugagggcagcgagcucgggagagaag

SEQ ID NO: 31327 - RNA, 29 nt, Artificial Sequence
  Synthetic Oligonucleotide; PRDM1 exon 5; Set C
caucugagggcagcgagcucgggagagaa

SEQ ID NO: 31328 - RNA, 28 nt, Artificial Sequence
  Synthetic Oligonucleotide; PRDM1 exon 5; Set C
caucugagggcagcgagcucgggagaga

SEQ ID NO: 31329 - RNA, 27 nt, Artificial Sequence
  Synthetic Oligonucleotide; PRDM1 exon 5; Set C
caucugagggcagcgagcucgggagag

SEQ ID NO: 31330 - RNA, 26 nt, Artificial Sequence
  Synthetic Oligonucleotide; PRDM1 exon 5; Set C
caucugagggcagcgagcucgggaga

SEQ ID NO: 31331 - RNA, 25 nt, Artificial Sequence
  Synthetic Oligonucleotide; PRDM1 exon 5; Set C
caucugagggcagcgagcucgggag

SEQ ID NO: 31332 - RNA, 24 nt, Artificial Sequence
  Synthetic Oligonucleotide; PRDM1 exon 5; Set C
caucugagggcagcgagcucggga

SEQ ID NO: 31333 - RNA, 15 nt, Artificial Sequence
  Synthetic Oligonucleotide; PRDM1 exon 5; Set C
ucugagggcagcgag

SEQ ID NO: 31334 - RNA, 16 nt, Artificial Sequence
  Synthetic Oligonucleotide; PRDM1 exon 5; Set C
aucugagggcagcgag

SEQ ID NO: 31335 - RNA, 16 nt, Artificial Sequence
  Synthetic Oligonucleotide; PRDM1 exon 5; Set C
caucugagggcagcga

SEQ ID NO: 31336 - RNA, 37 nt, Artificial Sequence
  Synthetic Oligonucleotide; PRDM1 exon 5; Set C
gcuggagcaaccuccgggcuccaucugagggcagcga

SEQ ID NO: 31337 - RNA, 38 nt, Artificial Sequence
  Synthetic Oligonucleotide; PRDM1 exon 5; Set C
ggcuggagcaaccuccgggcuccaucugagggcagcga

SEQ ID NO: 31338 - RNA, 30 nt, Artificial Sequence
  Synthetic Oligonucleotide; PRDM1 exon 5; Set C
gcuggagcaaccuccgggcuccaucugagg

SEQ ID NO: 31339 - RNA, 31 nt, Artificial Sequence
  Synthetic Oligonucleotide; PRDM1 exon 5; Set C
ggcuggagcaaccuccgggcuccaucugagg

SEQ ID NO: 31340 - RNA, 29 nt, Artificial Sequence
  Synthetic Oligonucleotide; PRDM1 exon 5; Set C
gcuggagcaaccuccgggcuccaucugag

SEQ ID NO: 31341 - RNA, 30 nt, Artificial Sequence
  Synthetic Oligonucleotide; PRDM1 exon 5; Set C
ggcuggagcaaccuccgggcuccaucugag

SEQ ID NO: 31342 - RNA, 29 nt, Artificial Sequence
  Synthetic Oligonucleotide; PRDM1 exon 5; Set C
ggcuggagcaaccuccgggcuccaucuga

SEQ ID NO: 31343 - RNA, 31 nt, Artificial Sequence
  Synthetic Oligonucleotide; PRDM1 exon 5; Set C
gggacaagcaccucccugggaugcuccggcu

SEQ ID NO: 31344 - RNA, 17 nt, Artificial Sequence
  Synthetic Oligonucleotide; PRDM1 exon 5; Set C
gcuggcggcggccccgg

SEQ ID NO: 31345 - RNA, 18 nt, Artificial Sequence
  Synthetic Oligonucleotide; PRDM1 exon 5; Set C
ugcuggcggcggccccgg

SEQ ID NO: 31346 - RNA, 16 nt, Artificial Sequence
  Synthetic Oligonucleotide; PRDM1 exon 5; Set C
gcuggcggcggccccg

SEQ ID NO: 31347 - RNA, 17 nt, Artificial Sequence
  Synthetic Oligonucleotide; PRDM1 exon 5; Set C
ugcuggcggcggccccg

SEQ ID NO: 31348 - RNA, 16 nt, Artificial Sequence
  Synthetic Oligonucleotide; PRDM1 exon 5; Set B
acccgcuuguggggcu

SEQ ID NO: 31349 - RNA, 26 nt, Artificial Sequence
  Synthetic Oligonucleotide; PRDM1 exon 5; Set C
uucccgccgugggagacccgcuugug

SEQ ID NO: 31350 - RNA, 27 nt, Artificial Sequence
  Synthetic Oligonucleotide; PRDM1 exon 5; Set C
guucccgccgugggagacccgcuugug

SEQ ID NO: 31351 - RNA, 28 nt, Artificial Sequence
  Synthetic Oligonucleotide; PRDM1 exon 5; Set C
uguucccgccgugggagacccgcuugug

SEQ ID NO: 31352 - RNA, 29 nt, Artificial Sequence
  Synthetic Oligonucleotide; PRDM1 exon 5; Set C
cuguucccgccgugggagacccgcuugug

SEQ ID NO: 31353 - RNA, 15 nt, Artificial Sequence
  Synthetic Oligonucleotide; PRDM1 exon 5; Set B
uguucccgccguggg

SEQ ID NO: 31354 - RNA, 16 nt, Artificial Sequence
  Synthetic Oligonucleotide; PRDM1 exon 5; Set B
cuguucccgccguggg

SEQ ID NO: 31355 - RNA, 15 nt, Artificial Sequence
  Synthetic Oligonucleotide; PRDM1 exon 5; Set C
cuguucccgccgugg

SEQ ID NO: 31356 - RNA, 32 nt, Artificial Sequence
  Synthetic Oligonucleotide; PRDM1 exon 5; Set C
uguucugccguggcggcuguucccgccguggg

SEQ ID NO: 31357 - RNA, 29 nt, Artificial Sequence
  Synthetic Oligonucleotide; PRDM1 exon 5; Set C
guucugccguggcggcuguucccgccgug

SEQ ID NO: 31358 - RNA, 30 nt, Artificial Sequence
  Synthetic Oligonucleotide; PRDM1 exon 5; Set C
uguucugccguggcggcuguucccgccgug

SEQ ID NO: 31359 - RNA, 31 nt, Artificial Sequence
  Synthetic Oligonucleotide; PRDM1 exon 5; Set C
auguucugccguggcggcuguucccgccgug

SEQ ID NO: 31360 - RNA, 33 nt, Artificial Sequence
  Synthetic Oligonucleotide; PRDM1 exon 5; Set C
acauguucugccguggcggcuguucccgccgug

SEQ ID NO: 31361 - RNA, 18 nt, Artificial Sequence
  Synthetic Oligonucleotide; PRDM1 exon 5; Set B
guucugccguggcggcug

SEQ ID NO: 31362 - RNA, 24 nt, Artificial Sequence
  Synthetic Oligonucleotide; PRDM1 exon 5; Set C
cauguucugccguggcggcuguuc

SEQ ID NO: 31363 - RNA, 21 nt, Artificial Sequence
  Synthetic Oligonucleotide; PRDM1 exon 5; Set C
auguucugccguggcggcugu

SEQ ID NO: 31364 - RNA, 23 nt, Artificial Sequence
  Synthetic Oligonucleotide; PRDM1 exon 5; Set C
cauguucugccguggcggcuguu

SEQ ID NO: 31365 - RNA, 25 nt, Artificial Sequence
  Synthetic Oligonucleotide; PRDM1 exon 5; Set C
acauguucugccguggcggcuguuc

SEQ ID NO: 31366 - RNA, 22 nt, Artificial Sequence
  Synthetic Oligonucleotide; PRDM1 exon 5; Set C
cauguucugccguggcggcugu

SEQ ID NO: 31367 - RNA, 24 nt, Artificial Sequence
  Synthetic Oligonucleotide; PRDM1 exon 5; Set C
acauguucugccguggcggcuguu

SEQ ID NO: 31368 - RNA, 20 nt, Artificial Sequence
  Synthetic Oligonucleotide; PRDM1 exon 5; Set B
auguucugccguggcggcug

SEQ ID NO: 31369 - RNA, 23 nt, Artificial Sequence
  Synthetic Oligonucleotide; PRDM1 exon 5; Set C
acauguucugccguggcggcugu

SEQ ID NO: 31370 - RNA, 21 nt, Artificial Sequence
  Synthetic Oligonucleotide; PRDM1 exon 5; Set C
cauguucugccguggcggcug

SEQ ID NO: 31371 - RNA, 22 nt, Artificial Sequence
  Synthetic Oligonucleotide; PRDM1 exon 5; Set C
acauguucugccguggcggcug

SEQ ID NO: 31372 - RNA, 35 nt, Artificial Sequence
  Synthetic Oligonucleotide; PRDM1 exon 5; Set C
gggcugcaccacauguucugccguggcggcuguuc

SEQ ID NO: 31373 - RNA, 34 nt, Artificial Sequence
  Synthetic Oligonucleotide; PRDM1 exon 5; Set C
gggcugcaccacauguucugccguggcggcuguu

SEQ ID NO: 31374 - RNA, 36 nt, Artificial Sequence
  Synthetic Oligonucleotide; PRDM1 exon 5; Set C
ugggcugcaccacauguucugccguggcggcuguuc

SEQ ID NO: 31375 - RNA, 35 nt, Artificial Sequence
  Synthetic Oligonucleotide; PRDM1 exon 5; Set C
ugggcugcaccacauguucugccguggcggcuguu

SEQ ID NO: 31376 - RNA, 33 nt, Artificial Sequence
  Synthetic Oligonucleotide; PRDM1 exon 5; Set C
gggcugcaccacauguucugccguggcggcugu

SEQ ID NO: 31377 - RNA, 34 nt, Artificial Sequence
  Synthetic Oligonucleotide; PRDM1 exon 5; Set C
ugggcugcaccacauguucugccguggcggcugu

SEQ ID NO: 31378 - RNA, 32 nt, Artificial Sequence
  Synthetic Oligonucleotide; PRDM1 exon 5; Set C
gggcugcaccacauguucugccguggcggcug

SEQ ID NO: 31379 - RNA, 33 nt, Artificial Sequence
  Synthetic Oligonucleotide; PRDM1 exon 5; Set C
ugggcugcaccacauguucugccguggcggcug

SEQ ID NO: 31380 - RNA, 40 nt, Artificial Sequence
  Synthetic Oligonucleotide; PRDM1 exon 5; Set C
uagcuuugggcugcaccacauguucugccguggcggcugu

SEQ ID NO: 31381 - RNA, 39 nt, Artificial Sequence
  Synthetic Oligonucleotide; PRDM1 exon 5; Set C
uagcuuugggcugcaccacauguucugccguggcggcug

SEQ ID NO: 31382 - RNA, 40 nt, Artificial Sequence
  Synthetic Oligonucleotide; PRDM1 exon 5; Set C
guagcuuugggcugcaccacauguucugccguggcggcug

SEQ ID NO: 31383 - RNA, 17 nt, Artificial Sequence
  Synthetic Oligonucleotide; PRDM1 exon 5; Set B
gggcugcaccacauguu

SEQ ID NO: 31384 - RNA, 16 nt, Artificial Sequence
  Synthetic Oligonucleotide; PRDM1 exon 5; Set B
gggcugcaccacaugu

SEQ ID NO: 31385 - RNA, 15 nt, Artificial Sequence
  Synthetic Oligonucleotide; PRDM1 exon 5; Set C
gggcugcaccacaug

SEQ ID NO: 31386 - RNA, 16 nt, Artificial Sequence
  Synthetic Oligonucleotide; PRDM1 exon 5; Set B
ugggcugcaccacaug

SEQ ID NO: 31387 - RNA, 21 nt, Artificial Sequence
  Synthetic Oligonucleotide; PRDM1 exon 5; Set B
cuuugggcugcaccacauguu

SEQ ID NO: 31388 - RNA, 15 nt, Artificial Sequence
  Synthetic Oligonucleotide; PRDM1 exon 5; Set C
ugggcugcaccacau

SEQ ID NO: 31389 - RNA, 20 nt, Artificial Sequence
  Synthetic Oligonucleotide; PRDM1 exon 5; Set B
cuuugggcugcaccacaugu

SEQ ID NO: 31390 - RNA, 16 nt, Artificial Sequence
  Synthetic Oligonucleotide; PRDM1 exon 5; Set B
uugggcugcaccacau

SEQ ID NO: 31391 - RNA, 17 nt, Artificial Sequence
  Synthetic Oligonucleotide; PRDM1 exon 5; Set B
uuugggcugcaccacau

SEQ ID NO: 31392 - RNA, 15 nt, Artificial Sequence
  Synthetic Oligonucleotide; PRDM1 exon 5; Set B
uugggcugcaccaca

SEQ ID NO: 31393 - RNA, 24 nt, Artificial Sequence
  Synthetic Oligonucleotide; PRDM1 exon 5; Set C
uagcuuugggcugcaccacauguu

SEQ ID NO: 31394 - RNA, 16 nt, Artificial Sequence
  Synthetic Oligonucleotide; PRDM1 exon 5; Set B
uuugggcugcaccaca

SEQ ID NO: 31395 - RNA, 23 nt, Artificial Sequence
  Synthetic Oligonucleotide; PRDM1 exon 5; Set C
uagcuuugggcugcaccacaugu

SEQ ID NO: 31396 - RNA, 22 nt, Artificial Sequence
  Synthetic Oligonucleotide; PRDM1 exon 5; Set B
uagcuuugggcugcaccacaug

SEQ ID NO: 31397 - RNA, 23 nt, Artificial Sequence
  Synthetic Oligonucleotide; PRDM1 exon 5; Set C
guagcuuugggcugcaccacaug

SEQ ID NO: 31398 - RNA, 22 nt, Artificial Sequence
  Synthetic Oligonucleotide; PRDM1 exon 5; Set C
guagcuuugggcugcaccacau

SEQ ID NO: 31399 - RNA, 21 nt, Artificial Sequence
  Synthetic Oligonucleotide; PRDM1 exon 5; Set C
guagcuuugggcugcaccaca

SEQ ID NO: 31400 - RNA, 30 nt, Artificial Sequence
  Synthetic Oligonucleotide; PRDM1 exon 5; Set C
ggggcugccaucgcugcugagguagcuuug

SEQ ID NO: 31401 - RNA, 29 nt, Artificial Sequence
  Synthetic Oligonucleotide; PRDM1 exon 5; Set C
ggggcugccaucgcugcugagguagcuuu

SEQ ID NO: 31402 - RNA, 40 nt, Artificial Sequence
  Synthetic Oligonucleotide; PRDM1 exon 5; Set C
gucgcugcugggggcugccaucgcugcugagguagcuuug

SEQ ID NO: 31403 - RNA, 39 nt, Artificial Sequence
  Synthetic Oligonucleotide; PRDM1 exon 5; Set C
gucgcugcugggggcugccaucgcugcugagguagcuuu

SEQ ID NO: 31404 - RNA, 25 nt, Artificial Sequence
  Synthetic Oligonucleotide; PRDM1 exon 5; Set C
auucauggcuucgucgcugcugggg

SEQ ID NO: 31405 - RNA, 26 nt, Artificial Sequence
  Synthetic Oligonucleotide; PRDM1 exon 5; Set C
gauucauggcuucgucgcugcugggg

SEQ ID NO: 31406 - RNA, 27 nt, Artificial Sequence
  Synthetic Oligonucleotide; PRDM1 exon 5; Set C
agauucauggcuucgucgcugcugggg

SEQ ID NO: 31407 - RNA, 30 nt, Artificial Sequence
  Synthetic Oligonucleotide; PRDM1 exon 5; Set C
augagauucauggcuucgucgcugcugggg

SEQ ID NO: 31408 - RNA, 31 nt, Artificial Sequence
  Synthetic Oligonucleotide; PRDM1 exon 5; Set C
aaugagauucauggcuucgucgcugcugggg

SEQ ID NO: 31409 - RNA, 16 nt, Artificial Sequence
  Synthetic Oligonucleotide; PRDM1 exon 5; Set C
auucauggcuucgucg

SEQ ID NO: 31410 - RNA, 15 nt, Artificial Sequence
  Synthetic Oligonucleotide; PRDM1 exon 5; Set C
auucauggcuucguc

SEQ ID NO: 31411 - RNA, 17 nt, Artificial Sequence
  Synthetic Oligonucleotide; PRDM1 exon 5; Set C
gauucauggcuucgucg

SEQ ID NO: 31412 - RNA, 16 nt, Artificial Sequence
  Synthetic Oligonucleotide; PRDM1 exon 5; Set C
gauucauggcuucguc

SEQ ID NO: 31413 - RNA, 18 nt, Artificial Sequence
  Synthetic Oligonucleotide; PRDM1 exon 5; Set C
agauucauggcuucgucg

SEQ ID NO: 31414 - RNA, 17 nt, Artificial Sequence
  Synthetic Oligonucleotide; PRDM1 exon 5; Set C
agauucauggcuucguc

SEQ ID NO: 31415 - RNA, 15 nt, Artificial Sequence
  Synthetic Oligonucleotide; PRDM1 exon 5; Set C
gauucauggcuucgu

SEQ ID NO: 31416 - RNA, 15 nt, Artificial Sequence
  Synthetic Oligonucleotide; PRDM1 exon 5; Set C
agauucauggcuucg

SEQ ID NO: 31417 - RNA, 21 nt, Artificial Sequence
  Synthetic Oligonucleotide; PRDM1 exon 5; Set C
augagauucauggcuucgucg

SEQ ID NO: 31418 - RNA, 23 nt, Artificial Sequence
  Synthetic Oligonucleotide; PRDM1 exon 5; Set B
aaugagauucauggcuucgucgc

SEQ ID NO: 31419 - RNA, 20 nt, Artificial Sequence
  Synthetic Oligonucleotide; PRDM1 exon 5; Set C
augagauucauggcuucguc

SEQ ID NO: 31420 - RNA, 22 nt, Artificial Sequence
  Synthetic Oligonucleotide; PRDM1 exon 5; Set C
aaugagauucauggcuucgucg

SEQ ID NO: 31421 - RNA, 24 nt, Artificial Sequence
  Synthetic Oligonucleotide; PRDM1 exon 5; Set B
uaaugagauucauggcuucgucgc

SEQ ID NO: 31422 - RNA, 21 nt, Artificial Sequence
  Synthetic Oligonucleotide; PRDM1 exon 5; Set C
aaugagauucauggcuucguc

SEQ ID NO: 31423 - RNA, 19 nt, Artificial Sequence
  Synthetic Oligonucleotide; PRDM1 exon 5; Set C
augagauucauggcuucgu

SEQ ID NO: 31424 - RNA, 25 nt, Artificial Sequence
  Synthetic Oligonucleotide; PRDM1 exon 5; Set B
uuaaugagauucauggcuucgucgc

SEQ ID NO: 31425 - RNA, 18 nt, Artificial Sequence
  Synthetic Oligonucleotide; PRDM1 exon 5; Set C
augagauucauggcuucg

SEQ ID NO: 31426 - RNA, 20 nt, Artificial Sequence
  Synthetic Oligonucleotide; PRDM1 exon 5; Set C
aaugagauucauggcuucgu

SEQ ID NO: 31427 - RNA, 26 nt, Artificial Sequence
  Synthetic Oligonucleotide; PRDM1 exon 5; Set B
uuuaaugagauucauggcuucgucgc

SEQ ID NO: 31428 - RNA, 21 nt, Artificial Sequence
  Synthetic Oligonucleotide; PRDM1 exon 5; Set C
uaaugagauucauggcuucgu

SEQ ID NO: 31429 - RNA, 17 nt, Artificial Sequence
  Synthetic Oligonucleotide; PRDM1 exon 5; Set C
augagauucauggcuuc

SEQ ID NO: 31430 - RNA, 27 nt, Artificial Sequence
  Synthetic Oligonucleotide; PRDM1 exon 5; Set B
uuuuaaugagauucauggcuucgucgc

SEQ ID NO: 31431 - RNA, 22 nt, Artificial Sequence
  Synthetic Oligonucleotide; PRDM1 exon 5; Set C
uuaaugagauucauggcuucgu

SEQ ID NO: 31432 - RNA, 18 nt, Artificial Sequence
  Synthetic Oligonucleotide; PRDM1 exon 5; Set C
aaugagauucauggcuuc

SEQ ID NO: 31433 - RNA, 28 nt, Artificial Sequence
  Synthetic Oligonucleotide; PRDM1 exon 5; Set B
uuuuuaaugagauucauggcuucgucgc

SEQ ID NO: 31434 - RNA, 23 nt, Artificial Sequence
  Synthetic Oligonucleotide; PRDM1 exon 5; Set C
uuuaaugagauucauggcuucgu

SEQ ID NO: 31435 - RNA, 19 nt, Artificial Sequence
  Synthetic Oligonucleotide; PRDM1 exon 5; Set C
uaaugagauucauggcuuc

SEQ ID NO: 31436 - RNA, 29 nt, Artificial Sequence
  Synthetic Oligonucleotide; PRDM1 exon 5; Set B
guuuuuaaugagauucauggcuucgucgc

SEQ ID NO: 31437 - RNA, 24 nt, Artificial Sequence
  Synthetic Oligonucleotide; PRDM1 exon 5; Set C
uuuuaaugagauucauggcuucgu

SEQ ID NO: 31438 - RNA, 20 nt, Artificial Sequence
  Synthetic Oligonucleotide; PRDM1 exon 5; Set C
uuaaugagauucauggcuuc

SEQ ID NO: 31439 - RNA, 16 nt, Artificial Sequence
  Synthetic Oligonucleotide; PRDM1 exon 5; Set C
aaugagauucauggcu

SEQ ID NO: 31440 - RNA, 30 nt, Artificial Sequence
  Synthetic Oligonucleotide; PRDM1 exon 5; Set B
uguuuuuaaugagauucauggcuucgucgc

SEQ ID NO: 31441 - RNA, 18 nt, Artificial Sequence
  Synthetic Oligonucleotide; PRDM1 exon 5; Set C
uaaugagauucauggcuu

SEQ ID NO: 31442 - RNA, 25 nt, Artificial Sequence
  Synthetic Oligonucleotide; PRDM1 exon 5; Set C
uuuuuaaugagauucauggcuucgu

SEQ ID NO: 31443 - RNA, 21 nt, Artificial Sequence
  Synthetic Oligonucleotide; PRDM1 exon 5; Set C
uuuaaugagauucauggcuuc

SEQ ID NO: 31444 - RNA, 17 nt, Artificial Sequence
  Synthetic Oligonucleotide; PRDM1 exon 5; Set C
uaaugagauucauggcu

SEQ ID NO: 31445 - RNA, 31 nt, Artificial Sequence
  Synthetic Oligonucleotide; PRDM1 exon 5; Set B
uuguuuuuaaugagauucauggcuucgucgc

SEQ ID NO: 31446 - RNA, 19 nt, Artificial Sequence
  Synthetic Oligonucleotide; PRDM1 exon 5; Set C
uuaaugagauucauggcuu

SEQ ID NO: 31447 - RNA, 26 nt, Artificial Sequence
  Synthetic Oligonucleotide; PRDM1 exon 5; Set C
guuuuuaaugagauucauggcuucgu

SEQ ID NO: 31448 - RNA, 22 nt, Artificial Sequence
  Synthetic Oligonucleotide; PRDM1 exon 5; Set C
uuuuaaugagauucauggcuuc

SEQ ID NO: 31449 - RNA, 18 nt, Artificial Sequence
  Synthetic Oligonucleotide; PRDM1 exon 5; Set C
uuaaugagauucauggcu

SEQ ID NO: 31450 - RNA, 32 nt, Artificial Sequence
  Synthetic Oligonucleotide; PRDM1 exon 5; Set B
uuuguuuuuaaugagauucauggcuucgucgc

SEQ ID NO: 31451 - RNA, 20 nt, Artificial Sequence
  Synthetic Oligonucleotide; PRDM1 exon 5; Set C
uuuaaugagauucauggcuu

SEQ ID NO: 31452 - RNA, 23 nt, Artificial Sequence
  Synthetic Oligonucleotide; PRDM1 exon 5; Set C
uuuuuaaugagauucauggcuuc

SEQ ID NO: 31453 - RNA, 19 nt, Artificial Sequence
  Synthetic Oligonucleotide; PRDM1 exon 5; Set C
uuuaaugagauucauggcu

SEQ ID NO: 31454 - RNA, 21 nt, Artificial Sequence
  Synthetic Oligonucleotide; PRDM1 exon 5; Set C
uuuuaaugagauucauggcuu

SEQ ID NO: 31455 - RNA, 32 nt, Artificial Sequence
  Synthetic Oligonucleotide; PRDM1 exon 5; Set B
uuuuguuuuuaaugagauucauggcuucgucg

SEQ ID NO: 31456 - RNA, 24 nt, Artificial Sequence
  Synthetic Oligonucleotide; PRDM1 exon 5; Set C
guuuuuaaugagauucauggcuuc

SEQ ID NO: 31457 - RNA, 20 nt, Artificial Sequence
  Synthetic Oligonucleotide; PRDM1 exon 5; Set C
uuuuaaugagauucauggcu

SEQ ID NO: 31458 - RNA, 22 nt, Artificial Sequence
  Synthetic Oligonucleotide; PRDM1 exon 5; Set C
uuuuuaaugagauucauggcuu

SEQ ID NO: 31459 - RNA, 31 nt, Artificial Sequence
  Synthetic Oligonucleotide; PRDM1 exon 5; Set B
uuuuguuuuuaaugagauucauggcuucguc

SEQ ID NO: 31460 - RNA, 33 nt, Artificial Sequence
  Synthetic Oligonucleotide; PRDM1 exon 5; Set B
cuuuuguuuuuaaugagauucauggcuucgucg

SEQ ID NO: 31461 - RNA, 25 nt, Artificial Sequence
  Synthetic Oligonucleotide; PRDM1 exon 5; Set C
uguuuuuaaugagauucauggcuuc

SEQ ID NO: 31462 - RNA, 21 nt, Artificial Sequence
  Synthetic Oligonucleotide; PRDM1 exon 5; Set C
uuuuuaaugagauucauggcu

SEQ ID NO: 31463 - RNA, 23 nt, Artificial Sequence
  Synthetic Oligonucleotide; PRDM1 exon 5; Set C
guuuuuaaugagauucauggcuu

SEQ ID NO: 31464 - RNA, 32 nt, Artificial Sequence
  Synthetic Oligonucleotide; PRDM1 exon 5; Set B
cuuuuguuuuuaaugagauucauggcuucguc

SEQ ID NO: 31465 - RNA, 34 nt, Artificial Sequence
  Synthetic Oligonucleotide; PRDM1 exon 5; Set B
ucuuuuguuuuuaaugagauucauggcuucgucg

SEQ ID NO: 31466 - RNA, 30 nt, Artificial Sequence
  Synthetic Oligonucleotide; PRDM1 exon 5; Set B
uuuuguuuuuaaugagauucauggcuucgu

SEQ ID NO: 31467 - RNA, 26 nt, Artificial Sequence
  Synthetic Oligonucleotide; PRDM1 exon 5; Set C
uuguuuuuaaugagauucauggcuuc

SEQ ID NO: 31468 - RNA, 22 nt, Artificial Sequence
  Synthetic Oligonucleotide; PRDM1 exon 5; Set C
guuuuuaaugagauucauggcu

SEQ ID NO: 31469 - RNA, 36 nt, Artificial Sequence
  Synthetic Oligonucleotide; PRDM1 exon 5; Set B
uucuuuuguuuuuaaugagauucauggcuucgucgc

SEQ ID NO: 31470 - RNA, 24 nt, Artificial Sequence
  Synthetic Oligonucleotide; PRDM1 exon 5; Set C
uguuuuuaaugagauucauggcuu

SEQ ID NO: 31471 - RNA, 29 nt, Artificial Sequence
  Synthetic Oligonucleotide; PRDM1 exon 5; Set C
uuuuguuuuuaaugagauucauggcuucg

SEQ ID NO: 31472 - RNA, 33 nt, Artificial Sequence
  Synthetic Oligonucleotide; PRDM1 exon 5; Set B
ucuuuuguuuuuaaugagauucauggcuucguc

SEQ ID NO: 31473 - RNA, 35 nt, Artificial Sequence
  Synthetic Oligonucleotide; PRDM1 exon 5; Set B
uucuuuuguuuuuaaugagauucauggcuucgucg

SEQ ID NO: 31474 - RNA, 31 nt, Artificial Sequence
  Synthetic Oligonucleotide; PRDM1 exon 5; Set B
cuuuuguuuuuaaugagauucauggcuucgu

SEQ ID NO: 31475 - RNA, 23 nt, Artificial Sequence
  Synthetic Oligonucleotide; PRDM1 exon 5; Set C
uguuuuuaaugagauucauggcu

SEQ ID NO: 31476 - RNA, 37 nt, Artificial Sequence
  Synthetic Oligonucleotide; PRDM1 exon 5; Set B
uuucuuuuguuuuuaaugagauucauggcuucgucgc

SEQ ID NO: 31477 - RNA, 25 nt, Artificial Sequence
  Synthetic Oligonucleotide; PRDM1 exon 5; Set C
uuguuuuuaaugagauucauggcuu

SEQ ID NO: 31478 - RNA, 30 nt, Artificial Sequence
  Synthetic Oligonucleotide; PRDM1 exon 5; Set C
cuuuuguuuuuaaugagauucauggcuucg

SEQ ID NO: 31479 - RNA, 32 nt, Artificial Sequence
  Synthetic Oligonucleotide; PRDM1 exon 5; Set B
ucuuuuguuuuuaaugagauucauggcuucgu

SEQ ID NO: 31480 - RNA, 28 nt, Artificial Sequence
  Synthetic Oligonucleotide; PRDM1 exon 5; Set C
uuuuguuuuuaaugagauucauggcuuc

SEQ ID NO: 31481 - RNA, 24 nt, Artificial Sequence
  Synthetic Oligonucleotide; PRDM1 exon 5; Set C
uuguuuuuaaugagauucauggcu

SEQ ID NO: 31482 - RNA, 26 nt, Artificial Sequence
  Synthetic Oligonucleotide; PRDM1 exon 5; Set C
uuuguuuuuaaugagauucauggcuu

SEQ ID NO: 31483 - RNA, 31 nt, Artificial Sequence
  Synthetic Oligonucleotide; PRDM1 exon 5; Set B
ucuuuuguuuuuaaugagauucauggcuucg

SEQ ID NO: 31484 - RNA, 37 nt, Artificial Sequence
  Synthetic Oligonucleotide; PRDM1 exon 5; Set B
guuucuuuuguuuuuaaugagauucauggcuucgucg

SEQ ID NO: 31485 - RNA, 33 nt, Artificial Sequence
  Synthetic Oligonucleotide; PRDM1 exon 5; Set B
uucuuuuguuuuuaaugagauucauggcuucgu

SEQ ID NO: 31486 - RNA, 29 nt, Artificial Sequence
  Synthetic Oligonucleotide; PRDM1 exon 5; Set C
cuuuuguuuuuaaugagauucauggcuuc

SEQ ID NO: 31487 - RNA, 25 nt, Artificial Sequence
  Synthetic Oligonucleotide; PRDM1 exon 5; Set C
uuuguuuuuaaugagauucauggcu

SEQ ID NO: 31488 - RNA, 36 nt, Artificial Sequence
  Synthetic Oligonucleotide; PRDM1 exon 5; Set B
guuucuuuuguuuuuaaugagauucauggcuucguc

SEQ ID NO: 31489 - RNA, 38 nt, Artificial Sequence
  Synthetic Oligonucleotide; PRDM1 exon 5; Set B
uguuucuuuuguuuuuaaugagauucauggcuucgucg

SEQ ID NO: 31490 - RNA, 30 nt, Artificial Sequence
  Synthetic Oligonucleotide; PRDM1 exon 5; Set C
ucuuuuguuuuuaaugagauucauggcuuc

SEQ ID NO: 31491 - RNA, 26 nt, Artificial Sequence
  Synthetic Oligonucleotide; PRDM1 exon 5; Set C
uuuuguuuuuaaugagauucauggcu

SEQ ID NO: 31492 - RNA, 37 nt, Artificial Sequence
  Synthetic Oligonucleotide; PRDM1 exon 5; Set B
uguuucuuuuguuuuuaaugagauucauggcuucguc

SEQ ID NO: 31493 - RNA, 35 nt, Artificial Sequence
  Synthetic Oligonucleotide; PRDM1 exon 5; Set B
guuucuuuuguuuuuaaugagauucauggcuucgu

SEQ ID NO: 31494 - RNA, 31 nt, Artificial Sequence
  Synthetic Oligonucleotide; PRDM1 exon 5; Set C
uucuuuuguuuuuaaugagauucauggcuuc

SEQ ID NO: 31495 - RNA, 34 nt, Artificial Sequence
  Synthetic Oligonucleotide; PRDM1 exon 5; Set B
guuucuuuuguuuuuaaugagauucauggcuucg

SEQ ID NO: 31496 - RNA, 38 nt, Artificial Sequence
  Synthetic Oligonucleotide; PRDM1 exon 5; Set B
auguuucuuuuguuuuuaaugagauucauggcuucguc

SEQ ID NO: 31497 - RNA, 36 nt, Artificial Sequence
  Synthetic Oligonucleotide; PRDM1 exon 5; Set B
uguuucuuuuguuuuuaaugagauucauggcuucgu

SEQ ID NO: 31498 - RNA, 30 nt, Artificial Sequence
  Synthetic Oligonucleotide; PRDM1 exon 5; Set C
uucuuuuguuuuuaaugagauucauggcuu

SEQ ID NO: 31499 - RNA, 35 nt, Artificial Sequence
  Synthetic Oligonucleotide; PRDM1 exon 5; Set B
uguuucuuuuguuuuuaaugagauucauggcuucg

SEQ ID NO: 31500 - RNA, 39 nt, Artificial Sequence
  Synthetic Oligonucleotide; PRDM1 exon 5; Set B
cauguuucuuuuguuuuuaaugagauucauggcuucguc

SEQ ID NO: 31501 - RNA, 33 nt, Artificial Sequence
  Synthetic Oligonucleotide; PRDM1 exon 5; Set B
guuucuuuuguuuuuaaugagauucauggcuuc

SEQ ID NO: 31502 - RNA, 29 nt, Artificial Sequence
  Synthetic Oligonucleotide; PRDM1 exon 5; Set C
uucuuuuguuuuuaaugagauucauggcu

SEQ ID NO: 31503 - RNA, 31 nt, Artificial Sequence
  Synthetic Oligonucleotide; PRDM1 exon 5; Set C
uuucuuuuguuuuuaaugagauucauggcuu

SEQ ID NO: 31504 - RNA, 36 nt, Artificial Sequence
  Synthetic Oligonucleotide; PRDM1 exon 5; Set B
auguuucuuuuguuuuuaaugagauucauggcuucg

SEQ ID NO: 31505 - RNA, 40 nt, Artificial Sequence
  Synthetic Oligonucleotide; PRDM1 exon 5; Set B
ucauguuucuuuuguuuuuaaugagauucauggcuucguc

SEQ ID NO: 31506 - RNA, 30 nt, Artificial Sequence
  Synthetic Oligonucleotide; PRDM1 exon 5; Set C
uuucuuuuguuuuuaaugagauucauggcu

SEQ ID NO: 31507 - RNA, 37 nt, Artificial Sequence
  Synthetic Oligonucleotide; PRDM1 exon 5; Set B
cauguuucuuuuguuuuuaaugagauucauggcuucg

SEQ ID NO: 31508 - RNA, 39 nt, Artificial Sequence
  Synthetic Oligonucleotide; PRDM1 exon 5; Set B
ucauguuucuuuuguuuuuaaugagauucauggcuucgu

SEQ ID NO: 31509 - RNA, 40 nt, Artificial Sequence
  Synthetic Oligonucleotide; PRDM1 exon 5; Set B
gucauguuucuuuuguuuuuaaugagauucauggcuucgu

SEQ ID NO: 31510 - RNA, 37 nt, Artificial Sequence
  Synthetic Oligonucleotide; PRDM1 exon 5; Set B
ucauguuucuuuuguuuuuaaugagauucauggcuuc

SEQ ID NO: 31511 - RNA, 38 nt, Artificial Sequence
  Synthetic Oligonucleotide; PRDM1 exon 5; Set B
gucauguuucuuuuguuuuuaaugagauucauggcuuc

SEQ ID NO: 31512 - RNA, 36 nt, Artificial Sequence
  Synthetic Oligonucleotide; PRDM1 exon 5; Set B
ucauguuucuuuuguuuuuaaugagauucauggcuu

SEQ ID NO: 31513 - RNA, 39 nt, Artificial Sequence
  Synthetic Oligonucleotide; PRDM1 exon 5; Set B
ggucauguuucuuuuguuuuuaaugagauucauggcuuc

SEQ ID NO: 31514 - RNA, 35 nt, Artificial Sequence
  Synthetic Oligonucleotide; PRDM1 exon 5; Set B
ucauguuucuuuuguuuuuaaugagauucauggcu

SEQ ID NO: 31515 - RNA, 16 nt, Artificial Sequence
  Synthetic Oligonucleotide; PRDM1 exon 5; Set C
uuuuguuuuuaaugag

SEQ ID NO: 31516 - RNA, 36 nt, Artificial Sequence
  Synthetic Oligonucleotide; PRDM1 exon 5; Set B
gucauguuucuuuuguuuuuaaugagauucauggcu

SEQ ID NO: 31517 - RNA, 38 nt, Artificial Sequence
  Synthetic Oligonucleotide; PRDM1 exon 5; Set B
ggucauguuucuuuuguuuuuaaugagauucauggcuu

SEQ ID NO: 31518 - RNA, 25 nt, Artificial Sequence
  Synthetic Oligonucleotide; PRDM1 exon 5; Set C
guuucuuuuguuuuuaaugagauuc

SEQ ID NO: 31519 - RNA, 15 nt, Artificial Sequence
  Synthetic Oligonucleotide; PRDM1 exon 5; Set C
uuuuguuuuuaauga

SEQ ID NO: 31520 - RNA, 17 nt, Artificial Sequence
  Synthetic Oligonucleotide; PRDM1 exon 5; Set C
cuuuuguuuuuaaugag

SEQ ID NO: 31521 - RNA, 37 nt, Artificial Sequence
  Synthetic Oligonucleotide; PRDM1 exon 5; Set B
ggucauguuucuuuuguuuuuaaugagauucauggcu

SEQ ID NO: 31522 - RNA, 26 nt, Artificial Sequence
  Synthetic Oligonucleotide; PRDM1 exon 5; Set C
uguuucuuuuguuuuuaaugagauuc

SEQ ID NO: 31523 - RNA, 16 nt, Artificial Sequence
  Synthetic Oligonucleotide; PRDM1 exon 5; Set C
cuuuuguuuuuaauga

SEQ ID NO: 31524 - RNA, 18 nt, Artificial Sequence
  Synthetic Oligonucleotide; PRDM1 exon 5; Set C
ucuuuuguuuuuaaugag

SEQ ID NO: 31525 - RNA, 27 nt, Artificial Sequence
  Synthetic Oligonucleotide; PRDM1 exon 5; Set C
auguuucuuuuguuuuuaaugagauuc

SEQ ID NO: 31526 - RNA, 17 nt, Artificial Sequence
  Synthetic Oligonucleotide; PRDM1 exon 5; Set C
ucuuuuguuuuuaauga

SEQ ID NO: 31527 - RNA, 28 nt, Artificial Sequence
  Synthetic Oligonucleotide; PRDM1 exon 5; Set C
cauguuucuuuuguuuuuaaugagauuc

SEQ ID NO: 31528 - RNA, 21 nt, Artificial Sequence
  Synthetic Oligonucleotide; PRDM1 exon 5; Set C
guuucuuuuguuuuuaaugag

SEQ ID NO: 31529 - RNA, 24 nt, Artificial Sequence
  Synthetic Oligonucleotide; PRDM1 exon 5; Set C
auguuucuuuuguuuuuaaugaga

SEQ ID NO: 31530 - RNA, 20 nt, Artificial Sequence
  Synthetic Oligonucleotide; PRDM1 exon 5; Set C
guuucuuuuguuuuuaauga

SEQ ID NO: 31531 - RNA, 22 nt, Artificial Sequence
  Synthetic Oligonucleotide; PRDM1 exon 5; Set C
uguuucuuuuguuuuuaaugag

SEQ ID NO: 31532 - RNA, 25 nt, Artificial Sequence
  Synthetic Oligonucleotide; PRDM1 exon 5; Set C
cauguuucuuuuguuuuuaaugaga

SEQ ID NO: 31533 - RNA, 21 nt, Artificial Sequence
  Synthetic Oligonucleotide; PRDM1 exon 5; Set C
uguuucuuuuguuuuuaauga

SEQ ID NO: 31534 - RNA, 23 nt, Artificial Sequence
  Synthetic Oligonucleotide; PRDM1 exon 5; Set C
auguuucuuuuguuuuuaaugag

SEQ ID NO: 31535 - RNA, 22 nt, Artificial Sequence
  Synthetic Oligonucleotide; PRDM1 exon 5; Set C
auguuucuuuuguuuuuaauga

SEQ ID NO: 31536 - RNA, 24 nt, Artificial Sequence
  Synthetic Oligonucleotide; PRDM1 exon 5; Set C
cauguuucuuuuguuuuuaaugag

SEQ ID NO: 31537 - RNA, 23 nt, Artificial Sequence
  Synthetic Oligonucleotide; PRDM1 exon 5; Set C
cauguuucuuuuguuuuuaauga

SEQ ID NO: 31538 - RNA, 25 nt, Artificial Sequence
  Synthetic Oligonucleotide; PRDM1 exon 5; Set C
ucauguuucuuuuguuuuuaaugag

SEQ ID NO: 31539 - RNA, 26 nt, Artificial Sequence
  Synthetic Oligonucleotide; PRDM1 exon 5; Set C
gucauguuucuuuuguuuuuaaugag

SEQ ID NO: 31540 - RNA, 25 nt, Artificial Sequence
  Synthetic Oligonucleotide; PRDM1 exon 5; Set C
gucauguuucuuuuguuuuuaauga

SEQ ID NO: 31541 - RNA, 37 nt, Artificial Sequence
  Synthetic Oligonucleotide; PRDM1 exon 5; Set B
guagccggucauguuucuuuuguuuuuaaugagauuc

SEQ ID NO: 31542 - RNA, 35 nt, Artificial Sequence
  Synthetic Oligonucleotide; PRDM1 exon 5; Set B
guagccggucauguuucuuuuguuuuuaaugagau

SEQ ID NO: 31543 - RNA, 24 nt, Artificial Sequence
  Synthetic Oligonucleotide; PRDM1 exon 5; Set C
cggucauguuucuuuuguuuuuaa

SEQ ID NO: 31544 - RNA, 34 nt, Artificial Sequence
  Synthetic Oligonucleotide; PRDM1 exon 5; Set B
guagccggucauguuucuuuuguuuuuaaugaga

SEQ ID NO: 31545 - RNA, 40 nt, Artificial Sequence
  Synthetic Oligonucleotide; PRDM1 exon 5; Set B
cuuguagccggucauguuucuuuuguuuuuaaugagauuc

SEQ ID NO: 31546 - RNA, 23 nt, Artificial Sequence
  Synthetic Oligonucleotide; PRDM1 exon 5; Set C
cggucauguuucuuuuguuuuua

SEQ ID NO: 31547 - RNA, 39 nt, Artificial Sequence
  Synthetic Oligonucleotide; PRDM1 exon 5; Set B
cuuguagccggucauguuucuuuuguuuuuaaugagauu

SEQ ID NO: 31548 - RNA, 22 nt, Artificial Sequence
  Synthetic Oligonucleotide; PRDM1 exon 5; Set C
cggucauguuucuuuuguuuuu

SEQ ID NO: 31549 - RNA, 40 nt, Artificial Sequence
  Synthetic Oligonucleotide; PRDM1 exon 5; Set B
ucuuguagccggucauguuucuuuuguuuuuaaugagauu

SEQ ID NO: 31550 - RNA, 38 nt, Artificial Sequence
  Synthetic Oligonucleotide; PRDM1 exon 5; Set B
cuuguagccggucauguuucuuuuguuuuuaaugagau

SEQ ID NO: 31551 - RNA, 21 nt, Artificial Sequence
  Synthetic Oligonucleotide; PRDM1 exon 5; Set C
cggucauguuucuuuuguuuu

SEQ ID NO: 31552 - RNA, 39 nt, Artificial Sequence
  Synthetic Oligonucleotide; PRDM1 exon 5; Set B
ucuuguagccggucauguuucuuuuguuuuuaaugagau

SEQ ID NO: 31553 - RNA, 31 nt, Artificial Sequence
  Synthetic Oligonucleotide; PRDM1 exon 5; Set B
guagccggucauguuucuuuuguuuuuaaug

SEQ ID NO: 31554 - RNA, 37 nt, Artificial Sequence
  Synthetic Oligonucleotide; PRDM1 exon 5; Set B
cuuguagccggucauguuucuuuuguuuuuaaugaga

SEQ ID NO: 31555 - RNA, 35 nt, Artificial Sequence
  Synthetic Oligonucleotide; PRDM1 exon 5; Set B
uuguagccggucauguuucuuuuguuuuuaaugag

SEQ ID NO: 31556 - RNA, 20 nt, Artificial Sequence
  Synthetic Oligonucleotide; PRDM1 exon 5; Set C
cggucauguuucuuuuguuu

SEQ ID NO: 31557 - RNA, 40 nt, Artificial Sequence
  Synthetic Oligonucleotide; PRDM1 exon 5; Set C
gucuuguagccggucauguuucuuuuguuuuuaaugagau

SEQ ID NO: 31558 - RNA, 38 nt, Artificial Sequence
  Synthetic Oligonucleotide; PRDM1 exon 5; Set B
ucuuguagccggucauguuucuuuuguuuuuaaugaga

SEQ ID NO: 31559 - RNA, 34 nt, Artificial Sequence
  Synthetic Oligonucleotide; PRDM1 exon 5; Set B
uuguagccggucauguuucuuuuguuuuuaauga

SEQ ID NO: 31560 - RNA, 19 nt, Artificial Sequence
  Synthetic Oligonucleotide; PRDM1 exon 5; Set C
cggucauguuucuuuuguu

SEQ ID NO: 31561 - RNA, 39 nt, Artificial Sequence
  Synthetic Oligonucleotide; PRDM1 exon 5; Set C
gucuuguagccggucauguuucuuuuguuuuuaaugaga

SEQ ID NO: 31562 - RNA, 18 nt, Artificial Sequence
  Synthetic Oligonucleotide; PRDM1 exon 5; Set C
cggucauguuucuuuugu

SEQ ID NO: 31563 - RNA, 34 nt, Artificial Sequence
  Synthetic Oligonucleotide; PRDM1 exon 5; Set B
cuuguagccggucauguuucuuuuguuuuuaaug

SEQ ID NO: 31564 - RNA, 17 nt, Artificial Sequence
  Synthetic Oligonucleotide; PRDM1 exon 5; Set C
cggucauguuucuuuug

SEQ ID NO: 31565 - RNA, 33 nt, Artificial Sequence
  Synthetic Oligonucleotide; PRDM1 exon 5; Set B
cuuguagccggucauguuucuuuuguuuuuaau

SEQ ID NO: 31566 - RNA, 35 nt, Artificial Sequence
  Synthetic Oligonucleotide; PRDM1 exon 5; Set B
ucuuguagccggucauguuucuuuuguuuuuaaug

SEQ ID NO: 31567 - RNA, 16 nt, Artificial Sequence
  Synthetic Oligonucleotide; PRDM1 exon 5; Set C
cggucauguuucuuuu

SEQ ID NO: 31568 - RNA, 34 nt, Artificial Sequence
  Synthetic Oligonucleotide; PRDM1 exon 5; Set B
ucuuguagccggucauguuucuuuuguuuuuaau

SEQ ID NO: 31569 - RNA, 36 nt, Artificial Sequence
  Synthetic Oligonucleotide; PRDM1 exon 5; Set B
gucuuguagccggucauguuucuuuuguuuuuaaug

SEQ ID NO: 31570 - RNA, 35 nt, Artificial Sequence
  Synthetic Oligonucleotide; PRDM1 exon 5; Set B
gucuuguagccggucauguuucuuuuguuuuuaau

SEQ ID NO: 31571 - RNA, 40 nt, Artificial Sequence
  Synthetic Oligonucleotide; PRDM1 exon 5; Set C
aagggucuuguagccggucauguuucuuuuguuuuuaaug

SEQ ID NO: 31572 - RNA, 39 nt, Artificial Sequence
  Synthetic Oligonucleotide; PRDM1 exon 5; Set C
aagggucuuguagccggucauguuucuuuuguuuuuaau

SEQ ID NO: 31573 - RNA, 40 nt, Artificial Sequence
  Synthetic Oligonucleotide; PRDM1 exon 5; Set C
gaagggucuuguagccggucauguuucuuuuguuuuuaau

SEQ ID NO: 31574 - RNA, 20 nt, Artificial Sequence
  Synthetic Oligonucleotide; PRDM1 exon 5; Set C
guagccggucauguuucuuu

SEQ ID NO: 31575 - RNA, 39 nt, Artificial Sequence
  Synthetic Oligonucleotide; PRDM1 exon 5; Set C
gaagggucuuguagccggucauguuucuuuuguuuuuaa

SEQ ID NO: 31576 - RNA, 19 nt, Artificial Sequence
  Synthetic Oligonucleotide; PRDM1 exon 5; Set C
guagccggucauguuucuu

SEQ ID NO: 31577 - RNA, 38 nt, Artificial Sequence
  Synthetic Oligonucleotide; PRDM1 exon 5; Set C
gaagggucuuguagccggucauguuucuuuuguuuuua

SEQ ID NO: 31578 - RNA, 40 nt, Artificial Sequence
  Synthetic Oligonucleotide; PRDM1 exon 5; Set C
ggaagggucuuguagccggucauguuucuuuuguuuuuaa

SEQ ID NO: 31579 - RNA, 18 nt, Artificial Sequence
  Synthetic Oligonucleotide; PRDM1 exon 5; Set C
guagccggucauguuucu

SEQ ID NO: 31580 - RNA, 25 nt, Artificial Sequence
  Synthetic Oligonucleotide; PRDM1 exon 5; Set B
ucuuguagccggucauguuucuuuu

SEQ ID NO: 31581 - RNA, 39 nt, Artificial Sequence
  Synthetic Oligonucleotide; PRDM1 exon 5; Set C
ggaagggucuuguagccggucauguuucuuuuguuuuua

SEQ ID NO: 31582 - RNA, 37 nt, Artificial Sequence
  Synthetic Oligonucleotide; PRDM1 exon 5; Set C
gaagggucuuguagccggucauguuucuuuuguuuuu

SEQ ID NO: 31583 - RNA, 17 nt, Artificial Sequence
  Synthetic Oligonucleotide; PRDM1 exon 5; Set C
guagccggucauguuuc

SEQ ID NO: 31584 - RNA, 23 nt, Artificial Sequence
  Synthetic Oligonucleotide; PRDM1 exon 5; Set B
cuuguagccggucauguuucuuu

SEQ ID NO: 31585 - RNA, 26 nt, Artificial Sequence
  Synthetic Oligonucleotide; PRDM1 exon 5; Set B
gucuuguagccggucauguuucuuuu

SEQ ID NO: 31586 - RNA, 38 nt, Artificial Sequence
  Synthetic Oligonucleotide; PRDM1 exon 5; Set C
ggaagggucuuguagccggucauguuucuuuuguuuuu

SEQ ID NO: 31587 - RNA, 36 nt, Artificial Sequence
  Synthetic Oligonucleotide; PRDM1 exon 5; Set C
gaagggucuuguagccggucauguuucuuuuguuuu

SEQ ID NO: 31588 - RNA, 40 nt, Artificial Sequence
  Synthetic Oligonucleotide; PRDM1 exon 5; Set C
gggaagggucuuguagccggucauguuucuuuuguuuuua

SEQ ID NO: 31589 - RNA, 24 nt, Artificial Sequence
  Synthetic Oligonucleotide; PRDM1 exon 5; Set B
ucuuguagccggucauguuucuuu

SEQ ID NO: 31590 - RNA, 22 nt, Artificial Sequence
  Synthetic Oligonucleotide; PRDM1 exon 5; Set B
cuuguagccggucauguuucuu

SEQ ID NO: 31591 - RNA, 37 nt, Artificial Sequence
  Synthetic Oligonucleotide; PRDM1 exon 5; Set C
ggaagggucuuguagccggucauguuucuuuuguuuu

SEQ ID NO: 31592 - RNA, 35 nt, Artificial Sequence
  Synthetic Oligonucleotide; PRDM1 exon 5; Set C
gaagggucuuguagccggucauguuucuuuuguuu

SEQ ID NO: 31593 - RNA, 39 nt, Artificial Sequence
  Synthetic Oligonucleotide; PRDM1 exon 5; Set C
gggaagggucuuguagccggucauguuucuuuuguuuuu

SEQ ID NO: 31594 - RNA, 25 nt, Artificial Sequence
  Synthetic Oligonucleotide; PRDM1 exon 5; Set B
gucuuguagccggucauguuucuuu

SEQ ID NO: 31595 - RNA, 21 nt, Artificial Sequence
  Synthetic Oligonucleotide; PRDM1 exon 5; Set B
cuuguagccggucauguuucu

SEQ ID NO: 31596 - RNA, 23 nt, Artificial Sequence
  Synthetic Oligonucleotide; PRDM1 exon 5; Set B
ucuuguagccggucauguuucuu

SEQ ID NO: 31597 - RNA, 36 nt, Artificial Sequence
  Synthetic Oligonucleotide; PRDM1 exon 5; Set C
ggaagggucuuguagccggucauguuucuuuuguuu

SEQ ID NO: 31598 - RNA, 34 nt, Artificial Sequence
  Synthetic Oligonucleotide; PRDM1 exon 5; Set C
gaagggucuuguagccggucauguuucuuuuguu

SEQ ID NO: 31599 - RNA, 40 nt, Artificial Sequence
  Synthetic Oligonucleotide; PRDM1 exon 5; Set C
agggaagggucuuguagccggucauguuucuuuuguuuuu

SEQ ID NO: 31600 - RNA, 38 nt, Artificial Sequence
  Synthetic Oligonucleotide; PRDM1 exon 5; Set C
gggaagggucuuguagccggucauguuucuuuuguuuu

SEQ ID NO: 31601 - RNA, 20 nt, Artificial Sequence
  Synthetic Oligonucleotide; PRDM1 exon 5; Set C
cuuguagccggucauguuuc

SEQ ID NO: 31602 - RNA, 22 nt, Artificial Sequence
  Synthetic Oligonucleotide; PRDM1 exon 5; Set B
ucuuguagccggucauguuucu

SEQ ID NO: 31603 - RNA, 24 nt, Artificial Sequence
  Synthetic Oligonucleotide; PRDM1 exon 5; Set B
gucuuguagccggucauguuucuu

SEQ ID NO: 31604 - RNA, 19 nt, Artificial Sequence
  Synthetic Oligonucleotide; PRDM1 exon 5; Set C
cuuguagccggucauguuu

SEQ ID NO: 31605 - RNA, 31 nt, Artificial Sequence
  Synthetic Oligonucleotide; PRDM1 exon 5; Set B
aagggucuuguagccggucauguuucuuuug

SEQ ID NO: 31606 - RNA, 35 nt, Artificial Sequence
  Synthetic Oligonucleotide; PRDM1 exon 5; Set C
ggaagggucuuguagccggucauguuucuuuuguu

SEQ ID NO: 31607 - RNA, 33 nt, Artificial Sequence
  Synthetic Oligonucleotide; PRDM1 exon 5; Set C
gaagggucuuguagccggucauguuucuuuugu

SEQ ID NO: 31608 - RNA, 39 nt, Artificial Sequence
  Synthetic Oligonucleotide; PRDM1 exon 5; Set C
agggaagggucuuguagccggucauguuucuuuuguuuu

SEQ ID NO: 31609 - RNA, 37 nt, Artificial Sequence
  Synthetic Oligonucleotide; PRDM1 exon 5; Set C
gggaagggucuuguagccggucauguuucuuuuguuu

SEQ ID NO: 31610 - RNA, 21 nt, Artificial Sequence
  Synthetic Oligonucleotide; PRDM1 exon 5; Set B
ucuuguagccggucauguuuc

SEQ ID NO: 31611 - RNA, 23 nt, Artificial Sequence
  Synthetic Oligonucleotide; PRDM1 exon 5; Set B
gucuuguagccggucauguuucu

SEQ ID NO: 31612 - RNA, 17 nt, Artificial Sequence
  Synthetic Oligonucleotide; PRDM1 exon 5; Set C
uuguagccggucauguu

SEQ ID NO: 31613 - RNA, 20 nt, Artificial Sequence
  Synthetic Oligonucleotide; PRDM1 exon 5; Set C
ucuuguagccggucauguuu

SEQ ID NO: 31614 - RNA, 30 nt, Artificial Sequence
  Synthetic Oligonucleotide; PRDM1 exon 5; Set B
aagggucuuguagccggucauguuucuuuu

SEQ ID NO: 31615 - RNA, 32 nt, Artificial Sequence
  Synthetic Oligonucleotide; PRDM1 exon 5; Set C
gaagggucuuguagccggucauguuucuuuug

SEQ ID NO: 31616 - RNA, 34 nt, Artificial Sequence
  Synthetic Oligonucleotide; PRDM1 exon 5; Set C
ggaagggucuuguagccggucauguuucuuuugu

SEQ ID NO: 31617 - RNA, 40 nt, Artificial Sequence
  Synthetic Oligonucleotide; PRDM1 exon 5; Set C
uagggaagggucuuguagccggucauguuucuuuuguuuu

SEQ ID NO: 31618 - RNA, 38 nt, Artificial Sequence
  Synthetic Oligonucleotide; PRDM1 exon 5; Set C
agggaagggucuuguagccggucauguuucuuuuguuu

SEQ ID NO: 31619 - RNA, 36 nt, Artificial Sequence
  Synthetic Oligonucleotide; PRDM1 exon 5; Set C
gggaagggucuuguagccggucauguuucuuuuguu

SEQ ID NO: 31620 - RNA, 22 nt, Artificial Sequence
  Synthetic Oligonucleotide; PRDM1 exon 5; Set B
gucuuguagccggucauguuuc

SEQ ID NO: 31621 - RNA, 16 nt, Artificial Sequence
  Synthetic Oligonucleotide; PRDM1 exon 5; Set C
uuguagccggucaugu

SEQ ID NO: 31622 - RNA, 21 nt, Artificial Sequence
  Synthetic Oligonucleotide; PRDM1 exon 5; Set B
gucuuguagccggucauguuu

SEQ ID NO: 31623 - RNA, 33 nt, Artificial Sequence
  Synthetic Oligonucleotide; PRDM1 exon 5; Set C
ggaagggucuuguagccggucauguuucuuuug

SEQ ID NO: 31624 - RNA, 31 nt, Artificial Sequence
  Synthetic Oligonucleotide; PRDM1 exon 5; Set C
gaagggucuuguagccggucauguuucuuuu

SEQ ID NO: 31625 - RNA, 39 nt, Artificial Sequence
  Synthetic Oligonucleotide; PRDM1 exon 5; Set C
uagggaagggucuuguagccggucauguuucuuuuguuu

SEQ ID NO: 31626 - RNA, 37 nt, Artificial Sequence
  Synthetic Oligonucleotide; PRDM1 exon 5; Set C
agggaagggucuuguagccggucauguuucuuuuguu

SEQ ID NO: 31627 - RNA, 35 nt, Artificial Sequence
  Synthetic Oligonucleotide; PRDM1 exon 5; Set C
gggaagggucuuguagccggucauguuucuuuugu

SEQ ID NO: 31628 - RNA, 29 nt, Artificial Sequence
  Synthetic Oligonucleotide; PRDM1 exon 5; Set B
aagggucuuguagccggucauguuucuuu

SEQ ID NO: 31629 - RNA, 15 nt, Artificial Sequence
  Synthetic Oligonucleotide; PRDM1 exon 5; Set C
uuguagccggucaug

SEQ ID NO: 31630 - RNA, 32 nt, Artificial Sequence
  Synthetic Oligonucleotide; PRDM1 exon 5; Set C
ggaagggucuuguagccggucauguuucuuuu

SEQ ID NO: 31631 - RNA, 34 nt, Artificial Sequence
  Synthetic Oligonucleotide; PRDM1 exon 5; Set C
gggaagggucuuguagccggucauguuucuuuug

SEQ ID NO: 31632 - RNA, 40 nt, Artificial Sequence
  Synthetic Oligonucleotide; PRDM1 exon 5; Set C
guagggaagggucuuguagccggucauguuucuuuuguuu

SEQ ID NO: 31633 - RNA, 38 nt, Artificial Sequence
  Synthetic Oligonucleotide; PRDM1 exon 5; Set C
uagggaagggucuuguagccggucauguuucuuuuguu

SEQ ID NO: 31634 - RNA, 36 nt, Artificial Sequence
  Synthetic Oligonucleotide; PRDM1 exon 5; Set C
agggaagggucuuguagccggucauguuucuuuugu

SEQ ID NO: 31635 - RNA, 30 nt, Artificial Sequence
  Synthetic Oligonucleotide; PRDM1 exon 5; Set C
gaagggucuuguagccggucauguuucuuu

SEQ ID NO: 31636 - RNA, 28 nt, Artificial Sequence
  Synthetic Oligonucleotide; PRDM1 exon 5; Set B
aagggucuuguagccggucauguuucuu

SEQ ID NO: 31637 - RNA, 35 nt, Artificial Sequence
  Synthetic Oligonucleotide; PRDM1 exon 5; Set C
agggaagggucuuguagccggucauguuucuuuug

SEQ ID NO: 31638 - RNA, 33 nt, Artificial Sequence
  Synthetic Oligonucleotide; PRDM1 exon 5; Set C
gggaagggucuuguagccggucauguuucuuuu

SEQ ID NO: 31639 - RNA, 39 nt, Artificial Sequence
  Synthetic Oligonucleotide; PRDM1 exon 5; Set C
guagggaagggucuuguagccggucauguuucuuuuguu

SEQ ID NO: 31640 - RNA, 37 nt, Artificial Sequence
  Synthetic Oligonucleotide; PRDM1 exon 5; Set C
uagggaagggucuuguagccggucauguuucuuuugu

SEQ ID NO: 31641 - RNA, 31 nt, Artificial Sequence
  Synthetic Oligonucleotide; PRDM1 exon 5; Set C
ggaagggucuuguagccggucauguuucuuu

SEQ ID NO: 31642 - RNA, 27 nt, Artificial Sequence
  Synthetic Oligonucleotide; PRDM1 exon 5; Set B
aagggucuuguagccggucauguuucu

SEQ ID NO: 31643 - RNA, 36 nt, Artificial Sequence
  Synthetic Oligonucleotide; PRDM1 exon 5; Set C
uagggaagggucuuguagccggucauguuucuuuug

SEQ ID NO: 31644 - RNA, 34 nt, Artificial Sequence
  Synthetic Oligonucleotide; PRDM1 exon 5; Set C
agggaagggucuuguagccggucauguuucuuuu

SEQ ID NO: 31645 - RNA, 38 nt, Artificial Sequence
  Synthetic Oligonucleotide; PRDM1 exon 5; Set C
guagggaagggucuuguagccggucauguuucuuuugu

SEQ ID NO: 31646 - RNA, 26 nt, Artificial Sequence
  Synthetic Oligonucleotide; PRDM1 exon 5; Set B
aagggucuuguagccggucauguuuc

SEQ ID NO: 31647 - RNA, 25 nt, Artificial Sequence
  Synthetic Oligonucleotide; PRDM1 exon 5; Set B
aagggucuuguagccggucauguuu

SEQ ID NO: 31648 - RNA, 37 nt, Artificial Sequence
  Synthetic Oligonucleotide; PRDM1 exon 5; Set C
guagggaagggucuuguagccggucauguuucuuuug

SEQ ID NO: 31649 - RNA, 35 nt, Artificial Sequence
  Synthetic Oligonucleotide; PRDM1 exon 5; Set C
uagggaagggucuuguagccggucauguuucuuuu

SEQ ID NO: 31650 - RNA, 27 nt, Artificial Sequence
  Synthetic Oligonucleotide; PRDM1 exon 5; Set B
gaagggucuuguagccggucauguuuc

SEQ ID NO: 31651 - RNA, 15 nt, Artificial Sequence
  Synthetic Oligonucleotide; PRDM1 exon 5; Set C
ucuuguagccgguca

SEQ ID NO: 31652 - RNA, 19 nt, Artificial Sequence
  Synthetic Oligonucleotide; PRDM1 exon 5; Set B
ggucuuguagccggucaug

SEQ ID NO: 31653 - RNA, 26 nt, Artificial Sequence
  Synthetic Oligonucleotide; PRDM1 exon 5; Set B
gaagggucuuguagccggucauguuu

SEQ ID NO: 31654 - RNA, 36 nt, Artificial Sequence
  Synthetic Oligonucleotide; PRDM1 exon 5; Set C
guagggaagggucuuguagccggucauguuucuuuu

SEQ ID NO: 31655 - RNA, 40 nt, Artificial Sequence
  Synthetic Oligonucleotide; PRDM1 exon 5; Set C
ggguagggaagggucuuguagccggucauguuucuuuugu

SEQ ID NO: 31656 - RNA, 28 nt, Artificial Sequence
  Synthetic Oligonucleotide; PRDM1 exon 5; Set C
ggaagggucuuguagccggucauguuuc

SEQ ID NO: 31657 - RNA, 16 nt, Artificial Sequence
  Synthetic Oligonucleotide; PRDM1 exon 5; Set C
gucuuguagccgguca

SEQ ID NO: 31658 - RNA, 27 nt, Artificial Sequence
  Synthetic Oligonucleotide; PRDM1 exon 5; Set C
ggaagggucuuguagccggucauguuu

SEQ ID NO: 31659 - RNA, 39 nt, Artificial Sequence
  Synthetic Oligonucleotide; PRDM1 exon 5; Set C
ggguagggaagggucuuguagccggucauguuucuuuug

SEQ ID NO: 31660 - RNA, 29 nt, Artificial Sequence
  Synthetic Oligonucleotide; PRDM1 exon 5; Set C
gggaagggucuuguagccggucauguuuc

SEQ ID NO: 31661 - RNA, 15 nt, Artificial Sequence
  Synthetic Oligonucleotide; PRDM1 exon 5; Set C
gucuuguagccgguc

SEQ ID NO: 31662 - RNA, 28 nt, Artificial Sequence
  Synthetic Oligonucleotide; PRDM1 exon 5; Set C
gggaagggucuuguagccggucauguuu

SEQ ID NO: 31663 - RNA, 38 nt, Artificial Sequence
  Synthetic Oligonucleotide; PRDM1 exon 5; Set C
ggguagggaagggucuuguagccggucauguuucuuuu

SEQ ID NO: 31664 - RNA, 30 nt, Artificial Sequence
  Synthetic Oligonucleotide; PRDM1 exon 5; Set C
agggaagggucuuguagccggucauguuuc

SEQ ID NO: 31665 - RNA, 36 nt, Artificial Sequence
  Synthetic Oligonucleotide; PRDM1 exon 5; Set C
gguagggaagggucuuguagccggucauguuucuuu

SEQ ID NO: 31666 - RNA, 29 nt, Artificial Sequence
  Synthetic Oligonucleotide; PRDM1 exon 5; Set C
agggaagggucuuguagccggucauguuu

SEQ ID NO: 31667 - RNA, 31 nt, Artificial Sequence
  Synthetic Oligonucleotide; PRDM1 exon 5; Set C
uagggaagggucuuguagccggucauguuuc

SEQ ID NO: 31668 - RNA, 35 nt, Artificial Sequence
  Synthetic Oligonucleotide; PRDM1 exon 5; Set C
gguagggaagggucuuguagccggucauguuucuu

SEQ ID NO: 31669 - RNA, 30 nt, Artificial Sequence
  Synthetic Oligonucleotide; PRDM1 exon 5; Set C
uagggaagggucuuguagccggucauguuu

SEQ ID NO: 31670 - RNA, 32 nt, Artificial Sequence
  Synthetic Oligonucleotide; PRDM1 exon 5; Set C
guagggaagggucuuguagccggucauguuuc

SEQ ID NO: 31671 - RNA, 20 nt, Artificial Sequence
  Synthetic Oligonucleotide; PRDM1 exon 5; Set B
aagggucuuguagccgguca

SEQ ID NO: 31672 - RNA, 34 nt, Artificial Sequence
  Synthetic Oligonucleotide; PRDM1 exon 5; Set C
gguagggaagggucuuguagccggucauguuucu

SEQ ID NO: 31673 - RNA, 31 nt, Artificial Sequence
  Synthetic Oligonucleotide; PRDM1 exon 5; Set C
guagggaagggucuuguagccggucauguuu

SEQ ID NO: 31674 - RNA, 33 nt, Artificial Sequence
  Synthetic Oligonucleotide; PRDM1 exon 5; Set C
gguagggaagggucuuguagccggucauguuuc

SEQ ID NO: 31675 - RNA, 21 nt, Artificial Sequence
  Synthetic Oligonucleotide; PRDM1 exon 5; Set B
gaagggucuuguagccgguca

SEQ ID NO: 31676 - RNA, 19 nt, Artificial Sequence
  Synthetic Oligonucleotide; PRDM1 exon 5; Set B
aagggucuuguagccgguc

SEQ ID NO: 31677 - RNA, 18 nt, Artificial Sequence
  Synthetic Oligonucleotide; PRDM1 exon 5; Set C
aagggucuuguagccggu

SEQ ID NO: 31678 - RNA, 34 nt, Artificial Sequence
  Synthetic Oligonucleotide; PRDM1 exon 5; Set C
ggguagggaagggucuuguagccggucauguuuc

SEQ ID NO: 31679 - RNA, 22 nt, Artificial Sequence
  Synthetic Oligonucleotide; PRDM1 exon 5; Set B
ggaagggucuuguagccgguca

SEQ ID NO: 31680 - RNA, 33 nt, Artificial Sequence
  Synthetic Oligonucleotide; PRDM1 exon 5; Set C
ggguagggaagggucuuguagccggucauguuu

SEQ ID NO: 31681 - RNA, 19 nt, Artificial Sequence
  Synthetic Oligonucleotide; PRDM1 exon 5; Set B
gaagggucuuguagccggu

SEQ ID NO: 31682 - RNA, 23 nt, Artificial Sequence
  Synthetic Oligonucleotide; PRDM1 exon 5; Set C
gggaagggucuuguagccgguca

SEQ ID NO: 31683 - RNA, 20 nt, Artificial Sequence
  Synthetic Oligonucleotide; PRDM1 exon 5; Set B
ggaagggucuuguagccggu

SEQ ID NO: 31684 - RNA, 24 nt, Artificial Sequence
  Synthetic Oligonucleotide; PRDM1 exon 5; Set C
agggaagggucuuguagccgguca

SEQ ID NO: 31685 - RNA, 21 nt, Artificial Sequence
  Synthetic Oligonucleotide; PRDM1 exon 5; Set B
gggaagggucuuguagccggu

SEQ ID NO: 31686 - RNA, 25 nt, Artificial Sequence
  Synthetic Oligonucleotide; PRDM1 exon 5; Set C
uagggaagggucuuguagccgguca

SEQ ID NO: 31687 - RNA, 22 nt, Artificial Sequence
  Synthetic Oligonucleotide; PRDM1 exon 5; Set B
agggaagggucuuguagccggu

SEQ ID NO: 31688 - RNA, 26 nt, Artificial Sequence
  Synthetic Oligonucleotide; PRDM1 exon 5; Set C
guagggaagggucuuguagccgguca

SEQ ID NO: 31689 - RNA, 23 nt, Artificial Sequence
  Synthetic Oligonucleotide; PRDM1 exon 5; Set B
uagggaagggucuuguagccggu

SEQ ID NO: 31690 - RNA, 27 nt, Artificial Sequence
  Synthetic Oligonucleotide; PRDM1 exon 5; Set C
gguagggaagggucuuguagccgguca

SEQ ID NO: 31691 - RNA, 40 nt, Artificial Sequence
  Synthetic Oligonucleotide; PRDM1 exon 5; Set C
uucagcggguagggaagggucuuguagccggucauguuuc

SEQ ID NO: 31692 - RNA, 24 nt, Artificial Sequence
  Synthetic Oligonucleotide; PRDM1 exon 5; Set C
guagggaagggucuuguagccggu

SEQ ID NO: 31693 - RNA, 28 nt, Artificial Sequence
  Synthetic Oligonucleotide; PRDM1 exon 5; Set C
ggguagggaagggucuuguagccgguca

SEQ ID NO: 31694 - RNA, 26 nt, Artificial Sequence
  Synthetic Oligonucleotide; PRDM1 exon 5; Set C
gguagggaagggucuuguagccgguc

SEQ ID NO: 31695 - RNA, 25 nt, Artificial Sequence
  Synthetic Oligonucleotide; PRDM1 exon 5; Set C
gguagggaagggucuuguagccggu

SEQ ID NO: 31696 - RNA, 26 nt, Artificial Sequence
  Synthetic Oligonucleotide; PRDM1 exon 5; Set C
ggguagggaagggucuuguagccggu

SEQ ID NO: 31697 - RNA, 39 nt, Artificial Sequence
  Synthetic Oligonucleotide; PRDM1 exon 5; Set C
cuucagcggguagggaagggucuuguagccggucauguu

SEQ ID NO: 31698 - RNA, 38 nt, Artificial Sequence
  Synthetic Oligonucleotide; PRDM1 exon 5; Set C
cuucagcggguagggaagggucuuguagccggucaugu

SEQ ID NO: 31699 - RNA, 37 nt, Artificial Sequence
  Synthetic Oligonucleotide; PRDM1 exon 5; Set C
cuucagcggguagggaagggucuuguagccggucaug

SEQ ID NO: 31700 - RNA, 34 nt, Artificial Sequence
  Synthetic Oligonucleotide; PRDM1 exon 5; Set C
uucagcggguagggaagggucuuguagccgguca

SEQ ID NO: 31701 - RNA, 36 nt, Artificial Sequence
  Synthetic Oligonucleotide; PRDM1 exon 5; Set C
cuucagcggguagggaagggucuuguagccggucau

SEQ ID NO: 31702 - RNA, 38 nt, Artificial Sequence
  Synthetic Oligonucleotide; PRDM1 exon 5; Set C
ucuucagcggguagggaagggucuuguagccggucaug

SEQ ID NO: 31703 - RNA, 15 nt, Artificial Sequence
  Synthetic Oligonucleotide; PRDM1 exon 5; Set C
uagggaagggucuug

SEQ ID NO: 31704 - RNA, 33 nt, Artificial Sequence
  Synthetic Oligonucleotide; PRDM1 exon 5; Set C
uucagcggguagggaagggucuuguagccgguc

SEQ ID NO: 31705 - RNA, 37 nt, Artificial Sequence
  Synthetic Oligonucleotide; PRDM1 exon 5; Set C
ucuucagcggguagggaagggucuuguagccggucau

SEQ ID NO: 31706 - RNA, 39 nt, Artificial Sequence
  Synthetic Oligonucleotide; PRDM1 exon 5; Set C
uucuucagcggguagggaagggucuuguagccggucaug

SEQ ID NO: 31707 - RNA, 32 nt, Artificial Sequence
  Synthetic Oligonucleotide; PRDM1 exon 5; Set C
uucagcggguagggaagggucuuguagccggu

SEQ ID NO: 31708 - RNA, 16 nt, Artificial Sequence
  Synthetic Oligonucleotide; PRDM1 exon 5; Set C
guagggaagggucuug

SEQ ID NO: 31709 - RNA, 38 nt, Artificial Sequence
  Synthetic Oligonucleotide; PRDM1 exon 5; Set C
uucuucagcggguagggaagggucuuguagccggucau

SEQ ID NO: 31710 - RNA, 19 nt, Artificial Sequence
  Synthetic Oligonucleotide; PRDM1 exon 5; Set B
ggguagggaagggucuugu

SEQ ID NO: 31711 - RNA, 17 nt, Artificial Sequence
  Synthetic Oligonucleotide; PRDM1 exon 5; Set C
gguagggaagggucuug

SEQ ID NO: 31712 - RNA, 18 nt, Artificial Sequence
  Synthetic Oligonucleotide; PRDM1 exon 5; Set C
ggguagggaagggucuug

SEQ ID NO: 31713 - RNA, 38 nt, Artificial Sequence
  Synthetic Oligonucleotide; PRDM1 exon 5; Set C
cuucuucagcggguagggaagggucuuguagccgguca

SEQ ID NO: 31714 - RNA, 39 nt, Artificial Sequence
  Synthetic Oligonucleotide; PRDM1 exon 5; Set C
gcuucuucagcggguagggaagggucuuguagccgguca

SEQ ID NO: 31715 - RNA, 37 nt, Artificial Sequence
  Synthetic Oligonucleotide; PRDM1 exon 5; Set C
cuucuucagcggguagggaagggucuuguagccgguc

SEQ ID NO: 31716 - RNA, 36 nt, Artificial Sequence
  Synthetic Oligonucleotide; PRDM1 exon 5; Set C
cuucuucagcggguagggaagggucuuguagccggu

SEQ ID NO: 31717 - RNA, 40 nt, Artificial Sequence
  Synthetic Oligonucleotide; PRDM1 exon 5; Set C
ugcuucuucagcggguagggaagggucuuguagccgguca

SEQ ID NO: 31718 - RNA, 38 nt, Artificial Sequence
  Synthetic Oligonucleotide; PRDM1 exon 5; Set C
gcuucuucagcggguagggaagggucuuguagccgguc

SEQ ID NO: 31719 - RNA, 37 nt, Artificial Sequence
  Synthetic Oligonucleotide; PRDM1 exon 5; Set C
gcuucuucagcggguagggaagggucuuguagccggu

SEQ ID NO: 31720 - RNA, 39 nt, Artificial Sequence
  Synthetic Oligonucleotide; PRDM1 exon 5; Set C
ugcuucuucagcggguagggaagggucuuguagccgguc

SEQ ID NO: 31721 - RNA, 38 nt, Artificial Sequence
  Synthetic Oligonucleotide; PRDM1 exon 5; Set C
ugcuucuucagcggguagggaagggucuuguagccggu

SEQ ID NO: 31722 - RNA, 40 nt, Artificial Sequence
  Synthetic Oligonucleotide; PRDM1 exon 5; Set C
cugcuucuucagcggguagggaagggucuuguagccgguc

SEQ ID NO: 31723 - RNA, 39 nt, Artificial Sequence
  Synthetic Oligonucleotide; PRDM1 exon 5; Set C
cugcuucuucagcggguagggaagggucuuguagccggu

SEQ ID NO: 31724 - RNA, 27 nt, Artificial Sequence
  Synthetic Oligonucleotide; PRDM1 exon 5; Set C
cuucagcggguagggaagggucuugua

SEQ ID NO: 31725 - RNA, 40 nt, Artificial Sequence
  Synthetic Oligonucleotide; PRDM1 exon 5; Set C
ucugcuucuucagcggguagggaagggucuuguagccggu

SEQ ID NO: 31726 - RNA, 24 nt, Artificial Sequence
  Synthetic Oligonucleotide; PRDM1 exon 5; Set B
uucagcggguagggaagggucuug

SEQ ID NO: 31727 - RNA, 28 nt, Artificial Sequence
  Synthetic Oligonucleotide; PRDM1 exon 5; Set C
ucuucagcggguagggaagggucuugua

SEQ ID NO: 31728 - RNA, 29 nt, Artificial Sequence
  Synthetic Oligonucleotide; PRDM1 exon 5; Set C
uucuucagcggguagggaagggucuugua

SEQ ID NO: 31729 - RNA, 24 nt, Artificial Sequence
  Synthetic Oligonucleotide; PRDM1 exon 5; Set B
cuucagcggguagggaagggucuu

SEQ ID NO: 31730 - RNA, 25 nt, Artificial Sequence
  Synthetic Oligonucleotide; PRDM1 exon 5; Set C
ucuucagcggguagggaagggucuu

SEQ ID NO: 31731 - RNA, 23 nt, Artificial Sequence
  Synthetic Oligonucleotide; PRDM1 exon 5; Set B
cuucagcggguagggaagggucu

SEQ ID NO: 31732 - RNA, 20 nt, Artificial Sequence
  Synthetic Oligonucleotide; PRDM1 exon 5; Set B
uucagcggguagggaagggu

SEQ ID NO: 31733 - RNA, 28 nt, Artificial Sequence
  Synthetic Oligonucleotide; PRDM1 exon 5; Set C
cuucuucagcggguagggaagggucuug

SEQ ID NO: 31734 - RNA, 26 nt, Artificial Sequence
  Synthetic Oligonucleotide; PRDM1 exon 5; Set C
uucuucagcggguagggaagggucuu

SEQ ID NO: 31735 - RNA, 24 nt, Artificial Sequence
  Synthetic Oligonucleotide; PRDM1 exon 5; Set C
ucuucagcggguagggaagggucu

SEQ ID NO: 31736 - RNA, 22 nt, Artificial Sequence
  Synthetic Oligonucleotide; PRDM1 exon 5; Set B
cuucagcggguagggaaggguc

SEQ ID NO: 31737 - RNA, 19 nt, Artificial Sequence
  Synthetic Oligonucleotide; PRDM1 exon 5; Set B
uucagcggguagggaaggg

SEQ ID NO: 31738 - RNA, 29 nt, Artificial Sequence
  Synthetic Oligonucleotide; PRDM1 exon 5; Set C
gcuucuucagcggguagggaagggucuug

SEQ ID NO: 31739 - RNA, 25 nt, Artificial Sequence
  Synthetic Oligonucleotide; PRDM1 exon 5; Set C
uucuucagcggguagggaagggucu

SEQ ID NO: 31740 - RNA, 23 nt, Artificial Sequence
  Synthetic Oligonucleotide; PRDM1 exon 5; Set B
ucuucagcggguagggaaggguc

SEQ ID NO: 31741 - RNA, 18 nt, Artificial Sequence
  Synthetic Oligonucleotide; PRDM1 exon 5; Set C
uucagcggguagggaagg

SEQ ID NO: 31742 - RNA, 30 nt, Artificial Sequence
  Synthetic Oligonucleotide; PRDM1 exon 5; Set C
ugcuucuucagcggguagggaagggucuug

SEQ ID NO: 31743 - RNA, 34 nt, Artificial Sequence
  Synthetic Oligonucleotide; PRDM1 exon 5; Set C
ucugcuucuucagcggguagggaagggucuugua

SEQ ID NO: 31744 - RNA, 24 nt, Artificial Sequence
  Synthetic Oligonucleotide; PRDM1 exon 5; Set B
uucuucagcggguagggaaggguc

SEQ ID NO: 31745 - RNA, 31 nt, Artificial Sequence
  Synthetic Oligonucleotide; PRDM1 exon 5; Set C
cugcuucuucagcggguagggaagggucuug

SEQ ID NO: 31746 - RNA, 35 nt, Artificial Sequence
  Synthetic Oligonucleotide; PRDM1 exon 5; Set C
uucugcuucuucagcggguagggaagggucuugua

SEQ ID NO: 31747 - RNA, 36 nt, Artificial Sequence
  Synthetic Oligonucleotide; PRDM1 exon 5; Set C
guucugcuucuucagcggguagggaagggucuugua

SEQ ID NO: 31748 - RNA, 25 nt, Artificial Sequence
  Synthetic Oligonucleotide; PRDM1 exon 5; Set C
gcuucuucagcggguagggaagggu

SEQ ID NO: 31749 - RNA, 19 nt, Artificial Sequence
  Synthetic Oligonucleotide; PRDM1 exon 5; Set C
ucuucagcggguagggaag

SEQ ID NO: 31750 - RNA, 24 nt, Artificial Sequence
  Synthetic Oligonucleotide; PRDM1 exon 5; Set C
gcuucuucagcggguagggaaggg

SEQ ID NO: 31751 - RNA, 26 nt, Artificial Sequence
  Synthetic Oligonucleotide; PRDM1 exon 5; Set C
ugcuucuucagcggguagggaagggu

SEQ ID NO: 31752 - RNA, 20 nt, Artificial Sequence
  Synthetic Oligonucleotide; PRDM1 exon 5; Set C
uucuucagcggguagggaag

SEQ ID NO: 31753 - RNA, 18 nt, Artificial Sequence
  Synthetic Oligonucleotide; PRDM1 exon 5; Set C
ucuucagcggguagggaa

SEQ ID NO: 31754 - RNA, 23 nt, Artificial Sequence
  Synthetic Oligonucleotide; PRDM1 exon 5; Set B
gcuucuucagcggguagggaagg

SEQ ID NO: 31755 - RNA, 25 nt, Artificial Sequence
  Synthetic Oligonucleotide; PRDM1 exon 5; Set C
ugcuucuucagcggguagggaaggg

SEQ ID NO: 31756 - RNA, 27 nt, Artificial Sequence
  Synthetic Oligonucleotide; PRDM1 exon 5; Set C
cugcuucuucagcggguagggaagggu

SEQ ID NO: 31757 - RNA, 33 nt, Artificial Sequence
  Synthetic Oligonucleotide; PRDM1 exon 5; Set C
guucugcuucuucagcggguagggaagggucuu

SEQ ID NO: 31758 - RNA, 17 nt, Artificial Sequence
  Synthetic Oligonucleotide; PRDM1 exon 5; Set B
ucuucagcggguaggga

SEQ ID NO: 31759 - RNA, 19 nt, Artificial Sequence
  Synthetic Oligonucleotide; PRDM1 exon 5; Set C
uucuucagcggguagggaa

SEQ ID NO: 31760 - RNA, 24 nt, Artificial Sequence
  Synthetic Oligonucleotide; PRDM1 exon 5; Set B
ugcuucuucagcggguagggaagg

SEQ ID NO: 31761 - RNA, 26 nt, Artificial Sequence
  Synthetic Oligonucleotide; PRDM1 exon 5; Set C
cugcuucuucagcggguagggaaggg

SEQ ID NO: 31762 - RNA, 25 nt, Artificial Sequence
  Synthetic Oligonucleotide; PRDM1 exon 5; Set C
cugcuucuucagcggguagggaagg

SEQ ID NO: 31763 - RNA, 21 nt, Artificial Sequence
  Synthetic Oligonucleotide; PRDM1 exon 5; Set B
gaucuugccguucugcuucuu

SEQ ID NO: 31764 - RNA, 19 nt, Artificial Sequence
  Synthetic Oligonucleotide; PRDM1 exon 5; Set C
gaucuugccguucugcuuc

SEQ ID NO: 31765 - RNA, 18 nt, Artificial Sequence
  Synthetic Oligonucleotide; PRDM1 exon 5; Set C
auuacacagagggcuaga

SEQ ID NO: 31766 - RNA, 17 nt, Artificial Sequence
  Synthetic Oligonucleotide; PRDM1 exon 5; Set C
auuacacagagggcuag

SEQ ID NO: 31767 - RNA, 19 nt, Artificial Sequence
  Synthetic Oligonucleotide; PRDM1 exon 5; Set C
gauuacacagagggcuaga

SEQ ID NO: 31768 - RNA, 16 nt, Artificial Sequence
  Synthetic Oligonucleotide; PRDM1 exon 5; Set C
auuacacagagggcua

SEQ ID NO: 31769 - RNA, 17 nt, Artificial Sequence
  Synthetic Oligonucleotide; PRDM1 exon 5; Set C
gauuacacagagggcua

SEQ ID NO: 31770 - RNA, 15 nt, Artificial Sequence
  Synthetic Oligonucleotide; PRDM1 exon 5; Set C
auuacacagagggcu

SEQ ID NO: 31771 - RNA, 16 nt, Artificial Sequence
  Synthetic Oligonucleotide; PRDM1 exon 5; Set C
gauuacacagagggcu

SEQ ID NO: 31772 - RNA, 15 nt, Artificial Sequence
  Synthetic Oligonucleotide; PRDM1 exon 5; Set C
gauuacacagagggc

SEQ ID NO: 31773 - RNA, 24 nt, Artificial Sequence
  Synthetic Oligonucleotide; PRDM1 exon 5; Set C
ggggcgauuacacagagggcuaga

SEQ ID NO: 31774 - RNA, 23 nt, Artificial Sequence
  Synthetic Oligonucleotide; PRDM1 exon 5; Set C
ggggcgauuacacagagggcuag

SEQ ID NO: 31775 - RNA, 25 nt, Artificial Sequence
  Synthetic Oligonucleotide; PRDM1 exon 5; Set C
aggggcgauuacacagagggcuaga

SEQ ID NO: 31776 - RNA, 24 nt, Artificial Sequence
  Synthetic Oligonucleotide; PRDM1 exon 5; Set C
aggggcgauuacacagagggcuag

SEQ ID NO: 31777 - RNA, 22 nt, Artificial Sequence
  Synthetic Oligonucleotide; PRDM1 exon 5; Set C
ggggcgauuacacagagggcua

SEQ ID NO: 31778 - RNA, 26 nt, Artificial Sequence
  Synthetic Oligonucleotide; PRDM1 exon 5; Set C
aaggggcgauuacacagagggcuaga

SEQ ID NO: 31779 - RNA, 23 nt, Artificial Sequence
  Synthetic Oligonucleotide; PRDM1 exon 5; Set C
aggggcgauuacacagagggcua

SEQ ID NO: 31780 - RNA, 21 nt, Artificial Sequence
  Synthetic Oligonucleotide; PRDM1 exon 5; Set C
ggggcgauuacacagagggcu

SEQ ID NO: 31781 - RNA, 24 nt, Artificial Sequence
  Synthetic Oligonucleotide; PRDM1 exon 5; Set C
aaggggcgauuacacagagggcua

SEQ ID NO: 31782 - RNA, 20 nt, Artificial Sequence
  Synthetic Oligonucleotide; PRDM1 exon 5; Set C
ggggcgauuacacagagggc

SEQ ID NO: 31783 - RNA, 22 nt, Artificial Sequence
  Synthetic Oligonucleotide; PRDM1 exon 5; Set C
aggggcgauuacacagagggcu

SEQ ID NO: 31784 - RNA, 23 nt, Artificial Sequence
  Synthetic Oligonucleotide; PRDM1 exon 5; Set C
aaggggcgauuacacagagggcu

SEQ ID NO: 31785 - RNA, 21 nt, Artificial Sequence
  Synthetic Oligonucleotide; PRDM1 exon 5; Set A
aggggcgauuacacagagggc

SEQ ID NO: 31786 - RNA, 24 nt, Artificial Sequence
  Synthetic Oligonucleotide; PRDM1 exon 5; Set A
aaaggggcgauuacacagagggcu

SEQ ID NO: 31787 - RNA, 22 nt, Artificial Sequence
  Synthetic Oligonucleotide; PRDM1 exon 5; Set A
aaggggcgauuacacagagggc

SEQ ID NO: 31788 - RNA, 23 nt, Artificial Sequence
  Synthetic Oligonucleotide; PRDM1 exon 5; Set A
aaaggggcgauuacacagagggc

SEQ ID NO: 31789 - RNA, 24 nt, Artificial Sequence
  Synthetic Oligonucleotide; PRDM1 exon 5; Set A
aaaaggggcgauuacacagagggc

SEQ ID NO: 31790 - RNA, 26 nt, Artificial Sequence
  Synthetic Oligonucleotide; PRDM1 exon 5; Set A
uagacugcucuguguuugugcugaaa

SEQ ID NO: 31791 - RNA, 25 nt, Artificial Sequence
  Synthetic Oligonucleotide; PRDM1 exon 5; Set A
uagacugcucuguguuugugcugaa

SEQ ID NO: 31792 - RNA, 26 nt, Artificial Sequence
  Synthetic Oligonucleotide; PRDM1 exon 5; Set A
uuagacugcucuguguuugugcugaa

SEQ ID NO: 31793 - RNA, 24 nt, Artificial Sequence
  Synthetic Oligonucleotide; PRDM1 exon 5; Set A
uagacugcucuguguuugugcuga

SEQ ID NO: 31794 - RNA, 25 nt, Artificial Sequence
  Synthetic Oligonucleotide; PRDM1 exon 5; Set A
uuagacugcucuguguuugugcuga

SEQ ID NO: 31795 - RNA, 26 nt, Artificial Sequence
  Synthetic Oligonucleotide; PRDM1 exon 5; Set A
uuuagacugcucuguguuugugcuga

SEQ ID NO: 31796 - RNA, 19 nt, Artificial Sequence
  Synthetic Oligonucleotide; PRDM1 exon 5; Set C
uagacugcucuguguuugu

SEQ ID NO: 31797 - RNA, 20 nt, Artificial Sequence
  Synthetic Oligonucleotide; PRDM1 exon 5; Set C
uuagacugcucuguguuugu

SEQ ID NO: 31798 - RNA, 21 nt, Artificial Sequence
  Synthetic Oligonucleotide; PRDM1 exon 5; Set C
uuuagacugcucuguguuugu

SEQ ID NO: 31799 - RNA, 19 nt, Artificial Sequence
  Synthetic Oligonucleotide; PRDM1 exon 5; Set C
uuagacugcucuguguuug

SEQ ID NO: 31800 - RNA, 31 nt, Artificial Sequence
  Synthetic Oligonucleotide; PRDM1 exon 5; Set C
guugcuuuagacugcucuguguuugugcuga

SEQ ID NO: 31801 - RNA, 20 nt, Artificial Sequence
  Synthetic Oligonucleotide; PRDM1 exon 5; Set C
uuuagacugcucuguguuug

SEQ ID NO: 31802 - RNA, 32 nt, Artificial Sequence
  Synthetic Oligonucleotide; PRDM1 exon 5; Set C
gguugcuuuagacugcucuguguuugugcuga

SEQ ID NO: 31803 - RNA, 26 nt, Artificial Sequence
  Synthetic Oligonucleotide; PRDM1 exon 5; Set A
guugcuuuagacugcucuguguuugu

SEQ ID NO: 31804 - RNA, 25 nt, Artificial Sequence
  Synthetic Oligonucleotide; PRDM1 exon 5; Set A
guugcuuuagacugcucuguguuug

SEQ ID NO: 31805 - RNA, 26 nt, Artificial Sequence
  Synthetic Oligonucleotide; PRDM1 exon 5; Set A
gguugcuuuagacugcucuguguuug

SEQ ID NO: 31806 - RNA, 22 nt, Artificial Sequence
  Synthetic Oligonucleotide; PRDM1 exon 5; Set C
ucauuuuucucagugcucgguu

SEQ ID NO: 31807 - RNA, 21 nt, Artificial Sequence
  Synthetic Oligonucleotide; PRDM1 exon 5; Set C
ucauuuuucucagugcucggu

SEQ ID NO: 31808 - RNA, 22 nt, Artificial Sequence
  Synthetic Oligonucleotide; PRDM1 exon 5; Set C
uucauuuuucucagugcucggu

SEQ ID NO: 31809 - RNA, 38 nt, Artificial Sequence
  Synthetic Oligonucleotide; PRDM1 exon 5; Set C
auucuuugggcagaguucauuuuucucagugcucgguu

SEQ ID NO: 31810 - RNA, 39 nt, Artificial Sequence
  Synthetic Oligonucleotide; PRDM1 exon 5; Set C
cauucuuugggcagaguucauuuuucucagugcucgguu

SEQ ID NO: 31811 - RNA, 37 nt, Artificial Sequence
  Synthetic Oligonucleotide; PRDM1 exon 5; Set C
auucuuugggcagaguucauuuuucucagugcucggu

SEQ ID NO: 31812 - RNA, 40 nt, Artificial Sequence
  Synthetic Oligonucleotide; PRDM1 exon 5; Set C
acauucuuugggcagaguucauuuuucucagugcucgguu

SEQ ID NO: 31813 - RNA, 38 nt, Artificial Sequence
  Synthetic Oligonucleotide; PRDM1 exon 5; Set C
cauucuuugggcagaguucauuuuucucagugcucggu

SEQ ID NO: 31814 - RNA, 39 nt, Artificial Sequence
  Synthetic Oligonucleotide; PRDM1 exon 5; Set C
acauucuuugggcagaguucauuuuucucagugcucggu

SEQ ID NO: 31815 - RNA, 40 nt, Artificial Sequence
  Synthetic Oligonucleotide; PRDM1 exon 5; Set C
gacauucuuugggcagaguucauuuuucucagugcucggu

SEQ ID NO: 31816 - RNA, 18 nt, Artificial Sequence
  Synthetic Oligonucleotide; PRDM1 exon 5; Set C
auucuuugggcagaguuc

SEQ ID NO: 31817 - RNA, 20 nt, Artificial Sequence
  Synthetic Oligonucleotide; PRDM1 exon 5; Set C
cauucuuugggcagaguuca

SEQ ID NO: 31818 - RNA, 17 nt, Artificial Sequence
  Synthetic Oligonucleotide; PRDM1 exon 5; Set C
auucuuugggcagaguu

SEQ ID NO: 31819 - RNA, 19 nt, Artificial Sequence
  Synthetic Oligonucleotide; PRDM1 exon 5; Set C
cauucuuugggcagaguuc

SEQ ID NO: 31820 - RNA, 18 nt, Artificial Sequence
  Synthetic Oligonucleotide; PRDM1 exon 5; Set C
cauucuuugggcagaguu

SEQ ID NO: 31821 - RNA, 20 nt, Artificial Sequence
  Synthetic Oligonucleotide; PRDM1 exon 5; Set C
acauucuuugggcagaguuc

SEQ ID NO: 31822 - RNA, 16 nt, Artificial Sequence
  Synthetic Oligonucleotide; PRDM1 exon 5; Set C
auucuuugggcagagu

SEQ ID NO: 31823 - RNA, 19 nt, Artificial Sequence
  Synthetic Oligonucleotide; PRDM1 exon 5; Set C
acauucuuugggcagaguu

SEQ ID NO: 31824 - RNA, 17 nt, Artificial Sequence
  Synthetic Oligonucleotide; PRDM1 exon 5; Set C
cauucuuugggcagagu

SEQ ID NO: 31825 - RNA, 18 nt, Artificial Sequence
  Synthetic Oligonucleotide; PRDM1 exon 5; Set C
acauucuuugggcagagu

SEQ ID NO: 31826 - RNA, 19 nt, Artificial Sequence
  Synthetic Oligonucleotide; PRDM1 exon 5; Set C
gacauucuuugggcagagu

SEQ ID NO: 31827 - RNA, 40 nt, Artificial Sequence
  Synthetic Oligonucleotide; PRDM1 exon 5; Set C
acgcuguacucucucuuugggacauucuuugggcagaguu

SEQ ID NO: 31828 - RNA, 39 nt, Artificial Sequence
  Synthetic Oligonucleotide; PRDM1 exon 5; Set C
acgcuguacucucucuuugggacauucuuugggcagagu

SEQ ID NO: 31829 - RNA, 25 nt, Artificial Sequence
  Synthetic Oligonucleotide; PRDM1 exon 5; Set A
acgcuguacucucucuuugggacau

SEQ ID NO: 31830 - RNA, 24 nt, Artificial Sequence
  Synthetic Oligonucleotide; PRDM1 exon 5; Set A
acgcuguacucucucuuugggaca

SEQ ID NO: 31831 - RNA, 23 nt, Artificial Sequence
  Synthetic Oligonucleotide; PRDM1 exon 5; Set A
acgcuguacucucucuuugggac

SEQ ID NO: 31832 - RNA, 21 nt, Artificial Sequence
  Synthetic Oligonucleotide; PRDM1 exon 5; Set A
acgcuguacucucucuuuggg

SEQ ID NO: 31833 - RNA, 20 nt, Artificial Sequence
  Synthetic Oligonucleotide; PRDM1 exon 5; Set C
acgcuguacucucucuuugg

SEQ ID NO: 31834 - RNA, 19 nt, Artificial Sequence
  Synthetic Oligonucleotide; PRDM1 exon 5; Set C
acgcuguacucucucuuug

SEQ ID NO: 31835 - RNA, 17 nt, Artificial Sequence
  Synthetic Oligonucleotide; PRDM1 exon 5; Set C
acgcuguacucucucuu

SEQ ID NO: 31836 - RNA, 16 nt, Artificial Sequence
  Synthetic Oligonucleotide; PRDM1 exon 5; Set C
acgcuguacucucucu

SEQ ID NO: 31837 - RNA, 15 nt, Artificial Sequence
  Synthetic Oligonucleotide; PRDM1 exon 5; Set C
acgcuguacucucuc

SEQ ID NO: 31838 - RNA, 15 nt, Artificial Sequence
  Synthetic Oligonucleotide; PRDM1 exon 5; Set C
cacgcuguacucucu

SEQ ID NO: 31839 - RNA, 15 nt, Artificial Sequence
  Synthetic Oligonucleotide; PRDM1 exon 5; Set C
ucacgcuguacucuc

SEQ ID NO: 31840 - RNA, 16 nt, Artificial Sequence
  Synthetic Oligonucleotide; PRDM1 exon 5; Set C
uucacgcuguacucuc

SEQ ID NO: 31841 - RNA, 15 nt, Artificial Sequence
  Synthetic Oligonucleotide; PRDM1 exon 5; Set C
uucacgcuguacucu

SEQ ID NO: 31842 - RNA, 16 nt, Artificial Sequence
  Synthetic Oligonucleotide; PRDM1 exon 5; Set C
uuucacgcuguacucu

SEQ ID NO: 31843 - RNA, 36 nt, Artificial Sequence
  Synthetic Oligonucleotide; PRDM1 exon 5; Set C
aguccaauuuuaggauuucuuucacgcuguacucuc

SEQ ID NO: 31844 - RNA, 35 nt, Artificial Sequence
  Synthetic Oligonucleotide; PRDM1 exon 5; Set C
aguccaauuuuaggauuucuuucacgcuguacucu

SEQ ID NO: 31845 - RNA, 26 nt, Artificial Sequence
  Synthetic Oligonucleotide; PRDM1 exon 5; Set C
aguccaauuuuaggauuucuuucacg

SEQ ID NO: 31846 - RNA, 17 nt, Artificial Sequence
  Synthetic Oligonucleotide; PRDM1 exon 5; Set C
aguccaauuuuaggauu

SEQ ID NO: 31847 - RNA, 35 nt, Artificial Sequence
  Synthetic Oligonucleotide; PRDM1 exon 5; Set C
agggguuggaguccaauuuuaggauuucuuucacg

SEQ ID NO: 31848 - RNA, 16 nt, Artificial Sequence
  Synthetic Oligonucleotide; PRDM1 exon 5; Set C
aguccaauuuuaggau

SEQ ID NO: 31849 - RNA, 34 nt, Artificial Sequence
  Synthetic Oligonucleotide; PRDM1 exon 5; Set C
agggguuggaguccaauuuuaggauuucuuucac

SEQ ID NO: 31850 - RNA, 33 nt, Artificial Sequence
  Synthetic Oligonucleotide; PRDM1 exon 5; Set A
agggguuggaguccaauuuuaggauuucuuuca

SEQ ID NO: 31851 - RNA, 15 nt, Artificial Sequence
  Synthetic Oligonucleotide; PRDM1 exon 5; Set C
aguccaauuuuagga

SEQ ID NO: 31852 - RNA, 35 nt, Artificial Sequence
  Synthetic Oligonucleotide; PRDM1 exon 5; Set C
gagggguuggaguccaauuuuaggauuucuuucac

SEQ ID NO: 31853 - RNA, 32 nt, Artificial Sequence
  Synthetic Oligonucleotide; PRDM1 exon 5; Set A
agggguuggaguccaauuuuaggauuucuuuc

SEQ ID NO: 31854 - RNA, 34 nt, Artificial Sequence
  Synthetic Oligonucleotide; PRDM1 exon 5; Set C
gagggguuggaguccaauuuuaggauuucuuuca

SEQ ID NO: 31855 - RNA, 36 nt, Artificial Sequence
  Synthetic Oligonucleotide; PRDM1 exon 5; Set C
ggagggguuggaguccaauuuuaggauuucuuucac

SEQ ID NO: 31856 - RNA, 38 nt, Artificial Sequence
  Synthetic Oligonucleotide; PRDM1 exon 5; Set C
uggagggguuggaguccaauuuuaggauuucuuucacg

SEQ ID NO: 31857 - RNA, 31 nt, Artificial Sequence
  Synthetic Oligonucleotide; PRDM1 exon 5; Set A
agggguuggaguccaauuuuaggauuucuuu

SEQ ID NO: 31858 - RNA, 33 nt, Artificial Sequence
  Synthetic Oligonucleotide; PRDM1 exon 5; Set A
gagggguuggaguccaauuuuaggauuucuuuc

SEQ ID NO: 31859 - RNA, 35 nt, Artificial Sequence
  Synthetic Oligonucleotide; PRDM1 exon 5; Set C
ggagggguuggaguccaauuuuaggauuucuuuca

SEQ ID NO: 31860 - RNA, 37 nt, Artificial Sequence
  Synthetic Oligonucleotide; PRDM1 exon 5; Set C
uggagggguuggaguccaauuuuaggauuucuuucac

SEQ ID NO: 31861 - RNA, 39 nt, Artificial Sequence
  Synthetic Oligonucleotide; PRDM1 exon 5; Set C
uuggagggguuggaguccaauuuuaggauuucuuucacg

SEQ ID NO: 31862 - RNA, 32 nt, Artificial Sequence
  Synthetic Oligonucleotide; PRDM1 exon 5; Set A
gagggguuggaguccaauuuuaggauuucuuu

SEQ ID NO: 31863 - RNA, 34 nt, Artificial Sequence
  Synthetic Oligonucleotide; PRDM1 exon 5; Set C
ggagggguuggaguccaauuuuaggauuucuuuc

SEQ ID NO: 31864 - RNA, 38 nt, Artificial Sequence
  Synthetic Oligonucleotide; PRDM1 exon 5; Set C
uuggagggguuggaguccaauuuuaggauuucuuucac

SEQ ID NO: 31865 - RNA, 33 nt, Artificial Sequence
  Synthetic Oligonucleotide; PRDM1 exon 5; Set C
ggagggguuggaguccaauuuuaggauuucuuu

SEQ ID NO: 31866 - RNA, 26 nt, Artificial Sequence
  Synthetic Oligonucleotide; PRDM1 exon 5; Set A
agggguuggaguccaauuuuaggauu

SEQ ID NO: 31867 - RNA, 27 nt, Artificial Sequence
  Synthetic Oligonucleotide; PRDM1 exon 5; Set A
gagggguuggaguccaauuuuaggauu

SEQ ID NO: 31868 - RNA, 25 nt, Artificial Sequence
  Synthetic Oligonucleotide; PRDM1 exon 5; Set A
agggguuggaguccaauuuuaggau

SEQ ID NO: 31869 - RNA, 28 nt, Artificial Sequence
  Synthetic Oligonucleotide; PRDM1 exon 5; Set A
ggagggguuggaguccaauuuuaggauu

SEQ ID NO: 31870 - RNA, 26 nt, Artificial Sequence
  Synthetic Oligonucleotide; PRDM1 exon 5; Set A
gagggguuggaguccaauuuuaggau

SEQ ID NO: 31871 - RNA, 24 nt, Artificial Sequence
  Synthetic Oligonucleotide; PRDM1 exon 5; Set A
agggguuggaguccaauuuuagga

SEQ ID NO: 31872 - RNA, 29 nt, Artificial Sequence
  Synthetic Oligonucleotide; PRDM1 exon 5; Set A
uggagggguuggaguccaauuuuaggauu

SEQ ID NO: 31873 - RNA, 27 nt, Artificial Sequence
  Synthetic Oligonucleotide; PRDM1 exon 5; Set A
ggagggguuggaguccaauuuuaggau

SEQ ID NO: 31874 - RNA, 25 nt, Artificial Sequence
  Synthetic Oligonucleotide; PRDM1 exon 5; Set A
gagggguuggaguccaauuuuagga

SEQ ID NO: 31875 - RNA, 23 nt, Artificial Sequence
  Synthetic Oligonucleotide; PRDM1 exon 5; Set A
agggguuggaguccaauuuuagg

SEQ ID NO: 31876 - RNA, 30 nt, Artificial Sequence
  Synthetic Oligonucleotide; PRDM1 exon 5; Set A
uuggagggguuggaguccaauuuuaggauu

SEQ ID NO: 31877 - RNA, 28 nt, Artificial Sequence
  Synthetic Oligonucleotide; PRDM1 exon 5; Set A
uggagggguuggaguccaauuuuaggau

SEQ ID NO: 31878 - RNA, 22 nt, Artificial Sequence
  Synthetic Oligonucleotide; PRDM1 exon 5; Set C
agggguuggaguccaauuuuag

SEQ ID NO: 31879 - RNA, 26 nt, Artificial Sequence
  Synthetic Oligonucleotide; PRDM1 exon 5; Set A
ggagggguuggaguccaauuuuagga

SEQ ID NO: 31880 - RNA, 24 nt, Artificial Sequence
  Synthetic Oligonucleotide; PRDM1 exon 5; Set A
gagggguuggaguccaauuuuagg

SEQ ID NO: 31881 - RNA, 21 nt, Artificial Sequence
  Synthetic Oligonucleotide; PRDM1 exon 5; Set C
agggguuggaguccaauuuua

SEQ ID NO: 31882 - RNA, 29 nt, Artificial Sequence
  Synthetic Oligonucleotide; PRDM1 exon 5; Set A
uuggagggguuggaguccaauuuuaggau

SEQ ID NO: 31883 - RNA, 23 nt, Artificial Sequence
  Synthetic Oligonucleotide; PRDM1 exon 5; Set C
gagggguuggaguccaauuuuag

SEQ ID NO: 31884 - RNA, 27 nt, Artificial Sequence
  Synthetic Oligonucleotide; PRDM1 exon 5; Set A
uggagggguuggaguccaauuuuagga

SEQ ID NO: 31885 - RNA, 25 nt, Artificial Sequence
  Synthetic Oligonucleotide; PRDM1 exon 5; Set A
ggagggguuggaguccaauuuuagg

SEQ ID NO: 31886 - RNA, 22 nt, Artificial Sequence
  Synthetic Oligonucleotide; PRDM1 exon 5; Set C
gagggguuggaguccaauuuua

SEQ ID NO: 31887 - RNA, 24 nt, Artificial Sequence
  Synthetic Oligonucleotide; PRDM1 exon 5; Set A
ggagggguuggaguccaauuuuag

SEQ ID NO: 31888 - RNA, 28 nt, Artificial Sequence
  Synthetic Oligonucleotide; PRDM1 exon 5; Set A
uuggagggguuggaguccaauuuuagga

SEQ ID NO: 31889 - RNA, 26 nt, Artificial Sequence
  Synthetic Oligonucleotide; PRDM1 exon 5; Set A
uggagggguuggaguccaauuuuagg

SEQ ID NO: 31890 - RNA, 19 nt, Artificial Sequence
  Synthetic Oligonucleotide; PRDM1 exon 5; Set C
agggguuggaguccaauuu

SEQ ID NO: 31891 - RNA, 21 nt, Artificial Sequence
  Synthetic Oligonucleotide; PRDM1 exon 5; Set C
gagggguuggaguccaauuuu

SEQ ID NO: 31892 - RNA, 23 nt, Artificial Sequence
  Synthetic Oligonucleotide; PRDM1 exon 5; Set A
ggagggguuggaguccaauuuua

SEQ ID NO: 31893 - RNA, 25 nt, Artificial Sequence
  Synthetic Oligonucleotide; PRDM1 exon 5; Set A
uggagggguuggaguccaauuuuag

SEQ ID NO: 31894 - RNA, 27 nt, Artificial Sequence
  Synthetic Oligonucleotide; PRDM1 exon 5; Set A
uuggagggguuggaguccaauuuuagg

SEQ ID NO: 31895 - RNA, 20 nt, Artificial Sequence
  Synthetic Oligonucleotide; PRDM1 exon 5; Set C
gagggguuggaguccaauuu

SEQ ID NO: 31896 - RNA, 22 nt, Artificial Sequence
  Synthetic Oligonucleotide; PRDM1 exon 5; Set A
ggagggguuggaguccaauuuu

SEQ ID NO: 31897 - RNA, 26 nt, Artificial Sequence
  Synthetic Oligonucleotide; PRDM1 exon 5; Set A
uuggagggguuggaguccaauuuuag

SEQ ID NO: 31898 - RNA, 21 nt, Artificial Sequence
  Synthetic Oligonucleotide; PRDM1 exon 5; Set A
ggagggguuggaguccaauuu

SEQ ID NO: 31899 - RNA, 15 nt, Artificial Sequence
  Synthetic Oligonucleotide; PRDM1 exon 5; Set C
uggagggguuggagu

SEQ ID NO: 31900 - RNA, 18 nt, Artificial Sequence
  Synthetic Oligonucleotide; PRDM1 exon 5; Set C
gguccuuuccuuuggagg

SEQ ID NO: 31901 - RNA, 17 nt, Artificial Sequence
  Synthetic Oligonucleotide; PRDM1 exon 5; Set C
gguccuuuccuuuggag

SEQ ID NO: 31902 - RNA, 18 nt, Artificial Sequence
  Synthetic Oligonucleotide; PRDM1 exon 5; Set C
agguccuuuccuuuggag

SEQ ID NO: 31903 - RNA, 16 nt, Artificial Sequence
  Synthetic Oligonucleotide; PRDM1 exon 5; Set C
gguccuuuccuuugga

SEQ ID NO: 31904 - RNA, 15 nt, Artificial Sequence
  Synthetic Oligonucleotide; PRDM1 exon 5; Set C
gguccuuuccuuugg

SEQ ID NO: 31905 - RNA, 17 nt, Artificial Sequence
  Synthetic Oligonucleotide; PRDM1 exon 5; Set C
agguccuuuccuuugga

SEQ ID NO: 31906 - RNA, 40 nt, Artificial Sequence
  Synthetic Oligonucleotide; PRDM1 exon 5; Set C
uuagaacgguagagguccuuuccuuuggagggguuggagu

SEQ ID NO: 31907 - RNA, 32 nt, Artificial Sequence
  Synthetic Oligonucleotide; PRDM1 exon 5; Set C
guuagaacgguagagguccuuuccuuuggagg

SEQ ID NO: 31908 - RNA, 33 nt, Artificial Sequence
  Synthetic Oligonucleotide; PRDM1 exon 5; Set C
uguuagaacgguagagguccuuuccuuuggagg

SEQ ID NO: 31909 - RNA, 31 nt, Artificial Sequence
  Synthetic Oligonucleotide; PRDM1 exon 5; Set A
guuagaacgguagagguccuuuccuuuggag

SEQ ID NO: 31910 - RNA, 34 nt, Artificial Sequence
  Synthetic Oligonucleotide; PRDM1 exon 5; Set C
auguuagaacgguagagguccuuuccuuuggagg

SEQ ID NO: 31911 - RNA, 32 nt, Artificial Sequence
  Synthetic Oligonucleotide; PRDM1 exon 5; Set C
uguuagaacgguagagguccuuuccuuuggag

SEQ ID NO: 31912 - RNA, 30 nt, Artificial Sequence
  Synthetic Oligonucleotide; PRDM1 exon 5; Set C
guuagaacgguagagguccuuuccuuugga

SEQ ID NO: 31913 - RNA, 29 nt, Artificial Sequence
  Synthetic Oligonucleotide; PRDM1 exon 5; Set A
guuagaacgguagagguccuuuccuuugg

SEQ ID NO: 31914 - RNA, 33 nt, Artificial Sequence
  Synthetic Oligonucleotide; PRDM1 exon 5; Set C
auguuagaacgguagagguccuuuccuuuggag

SEQ ID NO: 31915 - RNA, 31 nt, Artificial Sequence
  Synthetic Oligonucleotide; PRDM1 exon 5; Set C
uguuagaacgguagagguccuuuccuuugga

SEQ ID NO: 31916 - RNA, 28 nt, Artificial Sequence
  Synthetic Oligonucleotide; PRDM1 exon 5; Set A
guuagaacgguagagguccuuuccuuug

SEQ ID NO: 31917 - RNA, 34 nt, Artificial Sequence
  Synthetic Oligonucleotide; PRDM1 exon 5; Set A
aauguuagaacgguagagguccuuuccuuuggag

SEQ ID NO: 31918 - RNA, 32 nt, Artificial Sequence
  Synthetic Oligonucleotide; PRDM1 exon 5; Set C
auguuagaacgguagagguccuuuccuuugga

SEQ ID NO: 31919 - RNA, 35 nt, Artificial Sequence
  Synthetic Oligonucleotide; PRDM1 exon 5; Set A
aaauguuagaacgguagagguccuuuccuuuggag

SEQ ID NO: 31920 - RNA, 33 nt, Artificial Sequence
  Synthetic Oligonucleotide; PRDM1 exon 5; Set A
aauguuagaacgguagagguccuuuccuuugga

SEQ ID NO: 31921 - RNA, 34 nt, Artificial Sequence
  Synthetic Oligonucleotide; PRDM1 exon 5; Set A
aaauguuagaacgguagagguccuuuccuuugga

SEQ ID NO: 31922 - RNA, 23 nt, Artificial Sequence
  Synthetic Oligonucleotide; PRDM1 exon 5; Set A
uuagaacgguagagguccuuucc

SEQ ID NO: 31923 - RNA, 35 nt, Artificial Sequence
  Synthetic Oligonucleotide; PRDM1 exon 5; Set C
gaaauguuagaacgguagagguccuuuccuuugga

SEQ ID NO: 31924 - RNA, 22 nt, Artificial Sequence
  Synthetic Oligonucleotide; PRDM1 exon 5; Set C
uuagaacgguagagguccuuuc

SEQ ID NO: 31925 - RNA, 16 nt, Artificial Sequence
  Synthetic Oligonucleotide; PRDM1 exon 5; Set C
uuagaacgguagaggu

SEQ ID NO: 31926 - RNA, 15 nt, Artificial Sequence
  Synthetic Oligonucleotide; PRDM1 exon 5; Set C
uuagaacgguagagg

SEQ ID NO: 31927 - RNA, 17 nt, Artificial Sequence
  Synthetic Oligonucleotide; PRDM1 exon 5; Set C
gugaggggugaaauguu

SEQ ID NO: 31928 - RNA, 16 nt, Artificial Sequence
  Synthetic Oligonucleotide; PRDM1 exon 5; Set C
gugaggggugaaaugu

SEQ ID NO: 31929 - RNA, 18 nt, Artificial Sequence
  Synthetic Oligonucleotide; PRDM1 exon 5; Set C
ugugaggggugaaauguu

SEQ ID NO: 31930 - RNA, 17 nt, Artificial Sequence
  Synthetic Oligonucleotide; PRDM1 exon 5; Set C
ugugaggggugaaaugu

SEQ ID NO: 31931 - RNA, 15 nt, Artificial Sequence
  Synthetic Oligonucleotide; PRDM1 exon 5; Set C
gugaggggugaaaug

SEQ ID NO: 31932 - RNA, 19 nt, Artificial Sequence
  Synthetic Oligonucleotide; PRDM1 exon 5; Set C
augugaggggugaaauguu

SEQ ID NO: 31933 - RNA, 18 nt, Artificial Sequence
  Synthetic Oligonucleotide; PRDM1 exon 5; Set C
augugaggggugaaaugu

SEQ ID NO: 31934 - RNA, 16 nt, Artificial Sequence
  Synthetic Oligonucleotide; PRDM1 exon 5; Set C
ugugaggggugaaaug

SEQ ID NO: 31935 - RNA, 15 nt, Artificial Sequence
  Synthetic Oligonucleotide; PRDM1 exon 5; Set C
ugugaggggugaaau

SEQ ID NO: 31936 - RNA, 17 nt, Artificial Sequence
  Synthetic Oligonucleotide; PRDM1 exon 5; Set C
augugaggggugaaaug

SEQ ID NO: 31937 - RNA, 16 nt, Artificial Sequence
  Synthetic Oligonucleotide; PRDM1 exon 5; Set C
augugaggggugaaau

SEQ ID NO: 31938 - RNA, 15 nt, Artificial Sequence
  Synthetic Oligonucleotide; PRDM1 exon 5; Set C
augugaggggugaaa

SEQ ID NO: 31939 - RNA, 40 nt, Artificial Sequence
  Synthetic Oligonucleotide; PRDM1 exon 5; Set C
uaaagucaucgagguccuuuucugaugugaggggugaaau

SEQ ID NO: 31940 - RNA, 39 nt, Artificial Sequence
  Synthetic Oligonucleotide; PRDM1 exon 5; Set C
uaaagucaucgagguccuuuucugaugugaggggugaaa

SEQ ID NO: 31941 - RNA, 38 nt, Artificial Sequence
  Synthetic Oligonucleotide; PRDM1 exon 5; Set C
uaaagucaucgagguccuuuucugaugugaggggugaa

SEQ ID NO: 31942 - RNA, 26 nt, Artificial Sequence
  Synthetic Oligonucleotide; PRDM1 exon 5; Set A
caucgagguccuuuucugaugugagg

SEQ ID NO: 31943 - RNA, 37 nt, Artificial Sequence
  Synthetic Oligonucleotide; PRDM1 exon 5; Set C
uaaagucaucgagguccuuuucugaugugagggguga

SEQ ID NO: 31944 - RNA, 25 nt, Artificial Sequence
  Synthetic Oligonucleotide; PRDM1 exon 5; Set A
caucgagguccuuuucugaugugag

SEQ ID NO: 31945 - RNA, 36 nt, Artificial Sequence
  Synthetic Oligonucleotide; PRDM1 exon 5; Set C
uaaagucaucgagguccuuuucugaugugaggggug

SEQ ID NO: 31946 - RNA, 24 nt, Artificial Sequence
  Synthetic Oligonucleotide; PRDM1 exon 5; Set A
caucgagguccuuuucugauguga

SEQ ID NO: 31947 - RNA, 21 nt, Artificial Sequence
  Synthetic Oligonucleotide; PRDM1 exon 5; Set C
uaaagucaucgagguccuuuu

SEQ ID NO: 31948 - RNA, 22 nt, Artificial Sequence
  Synthetic Oligonucleotide; PRDM1 exon 5; Set C
cuaaagucaucgagguccuuuu

SEQ ID NO: 31949 - RNA, 20 nt, Artificial Sequence
  Synthetic Oligonucleotide; PRDM1 exon 5; Set C
uaaagucaucgagguccuuu

SEQ ID NO: 31950 - RNA, 21 nt, Artificial Sequence
  Synthetic Oligonucleotide; PRDM1 exon 5; Set C
cuaaagucaucgagguccuuu

SEQ ID NO: 31951 - RNA, 19 nt, Artificial Sequence
  Synthetic Oligonucleotide; PRDM1 exon 5; Set C
uaaagucaucgagguccuu

SEQ ID NO: 31952 - RNA, 18 nt, Artificial Sequence
  Synthetic Oligonucleotide; PRDM1 exon 5; Set C
uaaagucaucgagguccu

SEQ ID NO: 31953 - RNA, 17 nt, Artificial Sequence
  Synthetic Oligonucleotide; PRDM1 exon 5; Set C
uaaagucaucgaggucc

SEQ ID NO: 31954 - RNA, 16 nt, Artificial Sequence
  Synthetic Oligonucleotide; PRDM1 exon 5; Set C
uaaagucaucgagguc

SEQ ID NO: 31955 - RNA, 27 nt, Artificial Sequence
  Synthetic Oligonucleotide; PRDM1 exon 5; Set A
gucuucuaaagucaucgagguccuuuu

SEQ ID NO: 31956 - RNA, 28 nt, Artificial Sequence
  Synthetic Oligonucleotide; PRDM1 exon 5; Set C
uuucggggcucccacgucuucuaaaguc

SEQ ID NO: 31957 - RNA, 37 nt, Artificial Sequence
  Synthetic Oligonucleotide; PRDM1 exon 5; Set C
aagggcauuucggggcucccacgucuucuaaagucau

SEQ ID NO: 31958 - RNA, 38 nt, Artificial Sequence
  Synthetic Oligonucleotide; PRDM1 exon 5; Set C
gaagggcauuucggggcucccacgucuucuaaagucau

SEQ ID NO: 31959 - RNA, 39 nt, Artificial Sequence
  Synthetic Oligonucleotide; PRDM1 exon 5; Set C
agaagggcauuucggggcucccacgucuucuaaagucau

SEQ ID NO: 31960 - RNA, 40 nt, Artificial Sequence
  Synthetic Oligonucleotide; PRDM1 exon 5; Set C
uagaagggcauuucggggcucccacgucuucuaaagucau

SEQ ID NO: 31961 - RNA, 16 nt, Artificial Sequence
  Synthetic Oligonucleotide; PRDM1 exon 5; Set A
agggcauuucggggcu

SEQ ID NO: 31962 - RNA, 17 nt, Artificial Sequence
  Synthetic Oligonucleotide; PRDM1 exon 5; Set A
aagggcauuucggggcu

SEQ ID NO: 31963 - RNA, 18 nt, Artificial Sequence
  Synthetic Oligonucleotide; PRDM1 exon 5; Set A
gaagggcauuucggggcu

SEQ ID NO: 31964 - RNA, 19 nt, Artificial Sequence
  Synthetic Oligonucleotide; PRDM1 exon 5; Set A
agaagggcauuucggggcu

SEQ ID NO: 31965 - RNA, 20 nt, Artificial Sequence
  Synthetic Oligonucleotide; PRDM1 exon 5; Set A
uagaagggcauuucggggcu

SEQ ID NO: 31966 - RNA, 21 nt, Artificial Sequence
  Synthetic Oligonucleotide; PRDM1 exon 5; Set A
guagaagggcauuucggggcu

SEQ ID NO: 31967 - RNA, 22 nt, Artificial Sequence
  Synthetic Oligonucleotide; PRDM1 exon 5; Set A
gguagaagggcauuucggggcu

SEQ ID NO: 31968 - RNA, 23 nt, Artificial Sequence
  Synthetic Oligonucleotide; PRDM1 exon 5; Set C
ggguagaagggcauuucggggcu

SEQ ID NO: 31969 - RNA, 24 nt, Artificial Sequence
  Synthetic Oligonucleotide; PRDM1 exon 5; Set C
aggguagaagggcauuucggggcu

SEQ ID NO: 31970 - RNA, 25 nt, Artificial Sequence
  Synthetic Oligonucleotide; PRDM1 exon 5; Set C
gaggguagaagggcauuucggggcu

SEQ ID NO: 31971 - RNA, 26 nt, Artificial Sequence
  Synthetic Oligonucleotide; PRDM1 exon 5; Set C
cgaggguagaagggcauuucggggcu

SEQ ID NO: 31972 - RNA, 34 nt, Artificial Sequence
  Synthetic Oligonucleotide; PRDM1 exon 5; Set C
aaacgacccgaggguagaagggcauuucggggcu

SEQ ID NO: 31973 - RNA, 35 nt, Artificial Sequence
  Synthetic Oligonucleotide; PRDM1 exon 5; Set C
uaaacgacccgaggguagaagggcauuucggggcu

SEQ ID NO: 31974 - RNA, 36 nt, Artificial Sequence
  Synthetic Oligonucleotide; PRDM1 exon 5; Set C
guaaacgacccgaggguagaagggcauuucggggcu

SEQ ID NO: 31975 - RNA, 37 nt, Artificial Sequence
  Synthetic Oligonucleotide; PRDM1 exon 5; Set C
gguaaacgacccgaggguagaagggcauuucggggcu

SEQ ID NO: 31976 - RNA, 38 nt, Artificial Sequence
  Synthetic Oligonucleotide; PRDM1 exon 5; Set C
ggguaaacgacccgaggguagaagggcauuucggggcu

SEQ ID NO: 31977 - RNA, 39 nt, Artificial Sequence
  Synthetic Oligonucleotide; PRDM1 exon 5; Set C
gggguaaacgacccgaggguagaagggcauuucggggcu

SEQ ID NO: 31978 - RNA, 22 nt, Artificial Sequence
  Synthetic Oligonucleotide; PRDM1 exon 5; Set C
cgacccgaggguagaagggcau

SEQ ID NO: 31979 - RNA, 40 nt, Artificial Sequence
  Synthetic Oligonucleotide; PRDM1 exon 5; Set C
ugggguaaacgacccgaggguagaagggcauuucggggcu

SEQ ID NO: 31980 - RNA, 23 nt, Artificial Sequence
  Synthetic Oligonucleotide; PRDM1 exon 5; Set C
acgacccgaggguagaagggcau

SEQ ID NO: 31981 - RNA, 21 nt, Artificial Sequence
  Synthetic Oligonucleotide; PRDM1 exon 5; Set C
cgacccgaggguagaagggca

SEQ ID NO: 31982 - RNA, 20 nt, Artificial Sequence
  Synthetic Oligonucleotide; PRDM1 exon 5; Set A
cgacccgaggguagaagggc

SEQ ID NO: 31983 - RNA, 22 nt, Artificial Sequence
  Synthetic Oligonucleotide; PRDM1 exon 5; Set C
acgacccgaggguagaagggca

SEQ ID NO: 31984 - RNA, 21 nt, Artificial Sequence
  Synthetic Oligonucleotide; PRDM1 exon 5; Set A
acgacccgaggguagaagggc

SEQ ID NO: 31985 - RNA, 19 nt, Artificial Sequence
  Synthetic Oligonucleotide; PRDM1 exon 5; Set A
cgacccgaggguagaaggg

SEQ ID NO: 31986 - RNA, 18 nt, Artificial Sequence
  Synthetic Oligonucleotide; PRDM1 exon 5; Set C
cgacccgaggguagaagg

SEQ ID NO: 31987 - RNA, 20 nt, Artificial Sequence
  Synthetic Oligonucleotide; PRDM1 exon 5; Set A
acgacccgaggguagaaggg

SEQ ID NO: 31988 - RNA, 17 nt, Artificial Sequence
  Synthetic Oligonucleotide; PRDM1 exon 5; Set C
cgacccgaggguagaag

SEQ ID NO: 31989 - RNA, 19 nt, Artificial Sequence
  Synthetic Oligonucleotide; PRDM1 exon 5; Set A
acgacccgaggguagaagg

SEQ ID NO: 31990 - RNA, 21 nt, Artificial Sequence
  Synthetic Oligonucleotide; PRDM1 exon 5; Set A
aacgacccgaggguagaaggg

SEQ ID NO: 31991 - RNA, 16 nt, Artificial Sequence
  Synthetic Oligonucleotide; PRDM1 exon 5; Set C
cgacccgaggguagaa

SEQ ID NO: 31992 - RNA, 18 nt, Artificial Sequence
  Synthetic Oligonucleotide; PRDM1 exon 5; Set C
acgacccgaggguagaag

SEQ ID NO: 31993 - RNA, 20 nt, Artificial Sequence
  Synthetic Oligonucleotide; PRDM1 exon 5; Set A
aacgacccgaggguagaagg

SEQ ID NO: 31994 - RNA, 17 nt, Artificial Sequence
  Synthetic Oligonucleotide; PRDM1 exon 5; Set C
acgacccgaggguagaa

SEQ ID NO: 31995 - RNA, 15 nt, Artificial Sequence
  Synthetic Oligonucleotide; PRDM1 exon 5; Set C
cgacccgaggguaga

SEQ ID NO: 31996 - RNA, 19 nt, Artificial Sequence
  Synthetic Oligonucleotide; PRDM1 exon 5; Set C
aacgacccgaggguagaag

SEQ ID NO: 31997 - RNA, 16 nt, Artificial Sequence
  Synthetic Oligonucleotide; PRDM1 exon 5; Set C
acgacccgaggguaga

SEQ ID NO: 31998 - RNA, 17 nt, Artificial Sequence
  Synthetic Oligonucleotide; PRDM1 exon 5; Set C
aacgacccgaggguaga

SEQ ID NO: 31999 - RNA, 15 nt, Artificial Sequence
  Synthetic Oligonucleotide; PRDM1 exon 5; Set C
acgacccgaggguag

SEQ ID NO: 32000 - RNA, 16 nt, Artificial Sequence
  Synthetic Oligonucleotide; PRDM1 exon 5; Set C
aacgacccgaggguag

SEQ ID NO: 32001 - RNA, 15 nt, Artificial Sequence
  Synthetic Oligonucleotide; PRDM1 exon 5; Set C
aacgacccgagggua

SEQ ID NO: 32002 - RNA, 22 nt, Artificial Sequence
  Synthetic Oligonucleotide; PRDM1 exon 5; Set C
ggggcccggaugggguaaacga

SEQ ID NO: 32003 - RNA, 21 nt, Artificial Sequence
  Synthetic Oligonucleotide; PRDM1 exon 5; Set C
ggggcccggaugggguaaacg

SEQ ID NO: 32004 - RNA, 23 nt, Artificial Sequence
  Synthetic Oligonucleotide; PRDM1 exon 5; Set C
aggggcccggaugggguaaacga

SEQ ID NO: 32005 - RNA, 20 nt, Artificial Sequence
  Synthetic Oligonucleotide; PRDM1 exon 5; Set C
ggggcccggaugggguaaac

SEQ ID NO: 32006 - RNA, 22 nt, Artificial Sequence
  Synthetic Oligonucleotide; PRDM1 exon 5; Set C
aggggcccggaugggguaaacg

SEQ ID NO: 32007 - RNA, 24 nt, Artificial Sequence
  Synthetic Oligonucleotide; PRDM1 exon 5; Set C
gaggggcccggaugggguaaacga

SEQ ID NO: 32008 - RNA, 21 nt, Artificial Sequence
  Synthetic Oligonucleotide; PRDM1 exon 5; Set C
aggggcccggaugggguaaac

SEQ ID NO: 32009 - RNA, 23 nt, Artificial Sequence
  Synthetic Oligonucleotide; PRDM1 exon 5; Set C
gaggggcccggaugggguaaacg

SEQ ID NO: 32010 - RNA, 25 nt, Artificial Sequence
  Synthetic Oligonucleotide; PRDM1 exon 5; Set C
agaggggcccggaugggguaaacga

SEQ ID NO: 32011 - RNA, 22 nt, Artificial Sequence
  Synthetic Oligonucleotide; PRDM1 exon 5; Set C
gaggggcccggaugggguaaac

SEQ ID NO: 32012 - RNA, 24 nt, Artificial Sequence
  Synthetic Oligonucleotide; PRDM1 exon 5; Set C
agaggggcccggaugggguaaacg

SEQ ID NO: 32013 - RNA, 19 nt, Artificial Sequence
  Synthetic Oligonucleotide; PRDM1 exon 5; Set C
caaaaagucuucuggcaga

SEQ ID NO: 32014 - RNA, 39 nt, Artificial Sequence
  Synthetic Oligonucleotide; PRDM1 exon 5; Set C
uaggccagggaagcuuucaaaaagucuucuggcagaggg

SEQ ID NO: 32015 - RNA, 38 nt, Artificial Sequence
  Synthetic Oligonucleotide; PRDM1 exon 5; Set C
uaggccagggaagcuuucaaaaagucuucuggcagagg

SEQ ID NO: 32016 - RNA, 40 nt, Artificial Sequence
  Synthetic Oligonucleotide; PRDM1 exon 5; Set C
guaggccagggaagcuuucaaaaagucuucuggcagaggg

SEQ ID NO: 32017 - RNA, 37 nt, Artificial Sequence
  Synthetic Oligonucleotide; PRDM1 exon 5; Set C
uaggccagggaagcuuucaaaaagucuucuggcagag

SEQ ID NO: 32018 - RNA, 39 nt, Artificial Sequence
  Synthetic Oligonucleotide; PRDM1 exon 5; Set C
guaggccagggaagcuuucaaaaagucuucuggcagagg

SEQ ID NO: 32019 - RNA, 36 nt, Artificial Sequence
  Synthetic Oligonucleotide; PRDM1 exon 5; Set C
uaggccagggaagcuuucaaaaagucuucuggcaga

SEQ ID NO: 32020 - RNA, 38 nt, Artificial Sequence
  Synthetic Oligonucleotide; PRDM1 exon 5; Set C
guaggccagggaagcuuucaaaaagucuucuggcagag

SEQ ID NO: 32021 - RNA, 37 nt, Artificial Sequence
  Synthetic Oligonucleotide; PRDM1 exon 5; Set C
guaggccagggaagcuuucaaaaagucuucuggcaga

SEQ ID NO: 32022 - RNA, 20 nt, Artificial Sequence
  Synthetic Oligonucleotide; PRDM1 exon 5; Set C
uaggccagggaagcuuucaa

SEQ ID NO: 32023 - RNA, 36 nt, Artificial Sequence
  Synthetic Oligonucleotide; PRDM1 exon 5; Set C
gggucucucgaucccguaggccagggaagcuuucaa

SEQ ID NO: 32024 - RNA, 37 nt, Artificial Sequence
  Synthetic Oligonucleotide; PRDM1 exon 5; Set C
ugggucucucgaucccguaggccagggaagcuuucaa

SEQ ID NO: 32025 - RNA, 38 nt, Artificial Sequence
  Synthetic Oligonucleotide; PRDM1 exon 5; Set C
gugggucucucgaucccguaggccagggaagcuuucaa

SEQ ID NO: 32026 - RNA, 39 nt, Artificial Sequence
  Synthetic Oligonucleotide; PRDM1 exon 5; Set C
cgugggucucucgaucccguaggccagggaagcuuucaa

SEQ ID NO: 32027 - RNA, 19 nt, Artificial Sequence
  Synthetic Oligonucleotide; PRDM1 exon 5; Set A
gggucucucgaucccguag

SEQ ID NO: 32028 - RNA, 18 nt, Artificial Sequence
  Synthetic Oligonucleotide; PRDM1 exon 5; Set A
gggucucucgaucccgua

SEQ ID NO: 32029 - RNA, 19 nt, Artificial Sequence
  Synthetic Oligonucleotide; PRDM1 exon 5; Set A
ugggucucucgaucccgua

SEQ ID NO: 32030 - RNA, 19 nt, Artificial Sequence
  Synthetic Oligonucleotide; PRDM1 exon 5; Set A
ugggggagcgagugaugua

SEQ ID NO: 32031 - RNA, 18 nt, Artificial Sequence
  Synthetic Oligonucleotide; PRDM1 exon 5; Set A
ugggggagcgagugaugu

SEQ ID NO: 32032 - RNA, 15 nt, Artificial Sequence
  Synthetic Oligonucleotide; PRDM1 exon 5; Set C
cuuggagugguggag

SEQ ID NO: 32033 - RNA, 20 nt, Artificial Sequence
  Synthetic Oligonucleotide; PRDM1 exon 5; Set A
gggcugcuucuugcagaggg

SEQ ID NO: 32034 - RNA, 20 nt, Artificial Sequence
  Synthetic Oligonucleotide; PRDM1 exon 5; Set A
ggggcugcuucuugcagagg

SEQ ID NO: 32035 - RNA, 17 nt, Artificial Sequence
  Synthetic Oligonucleotide; PRDM1 exon 5; Set A
gggcugcuucuugcaga

SEQ ID NO: 32036 - RNA, 16 nt, Artificial Sequence
  Synthetic Oligonucleotide; PRDM1 exon 5; Set C
gggcugcuucuugcag

SEQ ID NO: 32037 - RNA, 25 nt, Artificial Sequence
  Synthetic Oligonucleotide; PRDM1 exon 5; Set C
ggucggggcugcuucuugcagaggg

SEQ ID NO: 32038 - RNA, 26 nt, Artificial Sequence
  Synthetic Oligonucleotide; PRDM1 exon 5; Set C
uggucggggcugcuucuugcagaggg

SEQ ID NO: 32039 - RNA, 27 nt, Artificial Sequence
  Synthetic Oligonucleotide; PRDM1 exon 5; Set C
uuggucggggcugcuucuugcagaggg

SEQ ID NO: 32040 - RNA, 22 nt, Artificial Sequence
  Synthetic Oligonucleotide; PRDM1 exon 5; Set C
ggucggggcugcuucuugcaga

SEQ ID NO: 32041 - RNA, 28 nt, Artificial Sequence
  Synthetic Oligonucleotide; PRDM1 exon 5; Set C
uuuggucggggcugcuucuugcagaggg

SEQ ID NO: 32042 - RNA, 21 nt, Artificial Sequence
  Synthetic Oligonucleotide; PRDM1 exon 5; Set C
ggucggggcugcuucuugcag

SEQ ID NO: 32043 - RNA, 22 nt, Artificial Sequence
  Synthetic Oligonucleotide; PRDM1 exon 5; Set C
uggucggggcugcuucuugcag

SEQ ID NO: 32044 - RNA, 23 nt, Artificial Sequence
  Synthetic Oligonucleotide; PRDM1 exon 5; Set C
uuggucggggcugcuucuugcag

SEQ ID NO: 32045 - RNA, 24 nt, Artificial Sequence
  Synthetic Oligonucleotide; PRDM1 exon 5; Set C
uuuggucggggcugcuucuugcag

SEQ ID NO: 32046 - RNA, 34 nt, Artificial Sequence
  Synthetic Oligonucleotide; PRDM1 exon 5; Set C
uugaggcuuuggucggggcugcuucuugcagagg

SEQ ID NO: 32047 - RNA, 33 nt, Artificial Sequence
  Synthetic Oligonucleotide; PRDM1 exon 5; Set C
uugaggcuuuggucggggcugcuucuugcagag

SEQ ID NO: 32048 - RNA, 40 nt, Artificial Sequence
  Synthetic Oligonucleotide; PRDM1 exon 5; Set C
uggagcucuugaggcuuuggucggggcugcuucuugcaga

SEQ ID NO: 32049 - RNA, 39 nt, Artificial Sequence
  Synthetic Oligonucleotide; PRDM1 exon 5; Set C
uggagcucuugaggcuuuggucggggcugcuucuugcag

SEQ ID NO: 32050 - RNA, 17 nt, Artificial Sequence
  Synthetic Oligonucleotide; PRDM1 exon 5; Set A
ugaggcuuuggucgggg

SEQ ID NO: 32051 - RNA, 31 nt, Artificial Sequence
  Synthetic Oligonucleotide; PRDM1 exon 5; Set C
gagggcuggagcucuugaggcuuuggucggg

SEQ ID NO: 32052 - RNA, 27 nt, Artificial Sequence
  Synthetic Oligonucleotide; PRDM1 exon 5; Set C
gagggcuggagcucuugaggcuuuggu

SEQ ID NO: 32053 - RNA, 26 nt, Artificial Sequence
  Synthetic Oligonucleotide; PRDM1 exon 5; Set C
gagggcuggagcucuugaggcuuugg

SEQ ID NO: 32054 - RNA, 25 nt, Artificial Sequence
  Synthetic Oligonucleotide; PRDM1 exon 5; Set C
gagggcuggagcucuugaggcuuug

SEQ ID NO: 32055 - RNA, 24 nt, Artificial Sequence
  Synthetic Oligonucleotide; PRDM1 exon 5; Set C
gagggcuggagcucuugaggcuuu

SEQ ID NO: 32056 - RNA, 35 nt, Artificial Sequence
  Synthetic Oligonucleotide; PRDM1 exon 5; Set C
uauucccagggcugcugugagggcuggagcucuug

SEQ ID NO: 32057 - RNA, 28 nt, Artificial Sequence
  Synthetic Oligonucleotide; PRDM1 exon 5; Set C
guauucccagggcugcugugagggcugg

SEQ ID NO: 32058 - RNA, 19 nt, Artificial Sequence
  Synthetic Oligonucleotide; PRDM1 exon 5; Set A
uucccagggcugcugugag

SEQ ID NO: 32059 - RNA, 20 nt, Artificial Sequence
  Synthetic Oligonucleotide; PRDM1 exon 5; Set A
auucccagggcugcugugag

SEQ ID NO: 32060 - RNA, 21 nt, Artificial Sequence
  Synthetic Oligonucleotide; PRDM1 exon 5; Set A
uauucccagggcugcugugag

SEQ ID NO: 32061 - RNA, 37 nt, Artificial Sequence
  Synthetic Oligonucleotide; PRDM1 exon 5; Set C
ggggacaccguauucccagggcugcugugagggcugg

SEQ ID NO: 32062 - RNA, 38 nt, Artificial Sequence
  Synthetic Oligonucleotide; PRDM1 exon 5; Set C
aggggacaccguauucccagggcugcugugagggcugg

SEQ ID NO: 32063 - RNA, 30 nt, Artificial Sequence
  Synthetic Oligonucleotide; PRDM1 exon 5; Set C
gggacaccguauucccagggcugcugugag

SEQ ID NO: 32064 - RNA, 25 nt, Artificial Sequence
  Synthetic Oligonucleotide; PRDM1 exon 5; Set C
gggcccacaggggacaccguauucc

SEQ ID NO: 32065 - RNA, 24 nt, Artificial Sequence
  Synthetic Oligonucleotide; PRDM1 exon 5; Set C
gggcccacaggggacaccguauuc

SEQ ID NO: 32066 - RNA, 23 nt, Artificial Sequence
  Synthetic Oligonucleotide; PRDM1 exon 5; Set C
gggcccacaggggacaccguauu

SEQ ID NO: 32067 - RNA, 22 nt, Artificial Sequence
  Synthetic Oligonucleotide; PRDM1 exon 5; Set C
gggcccacaggggacaccguau

SEQ ID NO: 32068 - RNA, 22 nt, Artificial Sequence
  Synthetic Oligonucleotide; PRDM1 exon 5; Set C
ggggcccacaggggacaccgua

SEQ ID NO: 32069 - RNA, 34 nt, Artificial Sequence
  Synthetic Oligonucleotide; PRDM1 exon 5; Set C
ugagagccggggcccacaggggacaccguauucc

SEQ ID NO: 32070 - RNA, 33 nt, Artificial Sequence
  Synthetic Oligonucleotide; PRDM1 exon 5; Set C
ugagagccggggcccacaggggacaccguauuc

SEQ ID NO: 32071 - RNA, 35 nt, Artificial Sequence
  Synthetic Oligonucleotide; PRDM1 exon 5; Set C
uugagagccggggcccacaggggacaccguauucc

SEQ ID NO: 32072 - RNA, 32 nt, Artificial Sequence
  Synthetic Oligonucleotide; PRDM1 exon 5; Set C
ugagagccggggcccacaggggacaccguauu

SEQ ID NO: 32073 - RNA, 34 nt, Artificial Sequence
  Synthetic Oligonucleotide; PRDM1 exon 5; Set C
uugagagccggggcccacaggggacaccguauuc

SEQ ID NO: 32074 - RNA, 33 nt, Artificial Sequence
  Synthetic Oligonucleotide; PRDM1 exon 5; Set C
uugagagccggggcccacaggggacaccguauu

SEQ ID NO: 32075 - RNA, 31 nt, Artificial Sequence
  Synthetic Oligonucleotide; PRDM1 exon 5; Set C
ugagagccggggcccacaggggacaccguau

SEQ ID NO: 32076 - RNA, 32 nt, Artificial Sequence
  Synthetic Oligonucleotide; PRDM1 exon 5; Set C
uugagagccggggcccacaggggacaccguau

SEQ ID NO: 32077 - RNA, 23 nt, Artificial Sequence
  Synthetic Oligonucleotide; PRDM1 exon 5; Set C
uugagagccggggcccacagggg

SEQ ID NO: 32078 - RNA, 39 nt, Artificial Sequence
  Synthetic Oligonucleotide; PRDM1 exon 5; Set C
aggagucccggugcucuugagagccggggcccacagggg

SEQ ID NO: 32079 - RNA, 40 nt, Artificial Sequence
  Synthetic Oligonucleotide; PRDM1 exon 5; Set C
uaggagucccggugcucuugagagccggggcccacagggg

SEQ ID NO: 32080 - RNA, 28 nt, Artificial Sequence
  Synthetic Oligonucleotide; PRDM1 exon 5; Set C
aggagucccggugcucuugagagccggg

SEQ ID NO: 32081 - RNA, 29 nt, Artificial Sequence
  Synthetic Oligonucleotide; PRDM1 exon 5; Set C
uaggagucccggugcucuugagagccggg

SEQ ID NO: 32082 - RNA, 30 nt, Artificial Sequence
  Synthetic Oligonucleotide; PRDM1 exon 5; Set C
guaggagucccggugcucuugagagccggg

SEQ ID NO: 32083 - RNA, 36 nt, Artificial Sequence
  Synthetic Oligonucleotide; PRDM1 exon 5; Set C
uaagcguaggagucccggugcucuugagagccgggg

SEQ ID NO: 32084 - RNA, 37 nt, Artificial Sequence
  Synthetic Oligonucleotide; PRDM1 exon 5; Set C
guaagcguaggagucccggugcucuugagagccgggg

SEQ ID NO: 32085 - RNA, 20 nt, Artificial Sequence
  Synthetic Oligonucleotide; PRDM1 exon 5; Set A
aggagucccggugcucuuga

SEQ ID NO: 32086 - RNA, 38 nt, Artificial Sequence
  Synthetic Oligonucleotide; PRDM1 exon 5; Set C
aguaagcguaggagucccggugcucuugagagccgggg

SEQ ID NO: 32087 - RNA, 19 nt, Artificial Sequence
  Synthetic Oligonucleotide; PRDM1 exon 5; Set A
aggagucccggugcucuug

SEQ ID NO: 32088 - RNA, 21 nt, Artificial Sequence
  Synthetic Oligonucleotide; PRDM1 exon 5; Set A
uaggagucccggugcucuuga

SEQ ID NO: 32089 - RNA, 39 nt, Artificial Sequence
  Synthetic Oligonucleotide; PRDM1 exon 5; Set C
aaguaagcguaggagucccggugcucuugagagccgggg

SEQ ID NO: 32090 - RNA, 20 nt, Artificial Sequence
  Synthetic Oligonucleotide; PRDM1 exon 5; Set A
uaggagucccggugcucuug

SEQ ID NO: 32091 - RNA, 40 nt, Artificial Sequence
  Synthetic Oligonucleotide; PRDM1 exon 5; Set C
caaguaagcguaggagucccggugcucuugagagccgggg

SEQ ID NO: 32092 - RNA, 27 nt, Artificial Sequence
  Synthetic Oligonucleotide; PRDM1 exon 5; Set C
uaagcguaggagucccggugcucuuga

SEQ ID NO: 32093 - RNA, 26 nt, Artificial Sequence
  Synthetic Oligonucleotide; PRDM1 exon 5; Set C
uaagcguaggagucccggugcucuug

SEQ ID NO: 32094 - RNA, 27 nt, Artificial Sequence
  Synthetic Oligonucleotide; PRDM1 exon 5; Set C
guaagcguaggagucccggugcucuug

SEQ ID NO: 32095 - RNA, 18 nt, Artificial Sequence
  Synthetic Oligonucleotide; PRDM1 exon 5; Set C
cguucaaguaagcguagg

SEQ ID NO: 32096 - RNA, 19 nt, Artificial Sequence
  Synthetic Oligonucleotide; PRDM1 exon 5; Set C
gcguucaaguaagcguagg

SEQ ID NO: 32097 - RNA, 25 nt, Artificial Sequence
  Synthetic Oligonucleotide; PRDM1 exon 5; Set A
uaggacgcguucaaguaagcguagg

SEQ ID NO: 32098 - RNA, 31 nt, Artificial Sequence
  Synthetic Oligonucleotide; PRDM1 exon 5; Set C
ccguaggacgcguucaaguaagcguaggagu

SEQ ID NO: 32099 - RNA, 26 nt, Artificial Sequence
  Synthetic Oligonucleotide; PRDM1 exon 5; Set A
guaggacgcguucaaguaagcguagg

SEQ ID NO: 32100 - RNA, 24 nt, Artificial Sequence
  Synthetic Oligonucleotide; PRDM1 exon 5; Set A
uaggacgcguucaaguaagcguag

SEQ ID NO: 32101 - RNA, 32 nt, Artificial Sequence
  Synthetic Oligonucleotide; PRDM1 exon 5; Set C
gccguaggacgcguucaaguaagcguaggagu

SEQ ID NO: 32102 - RNA, 30 nt, Artificial Sequence
  Synthetic Oligonucleotide; PRDM1 exon 5; Set C
ccguaggacgcguucaaguaagcguaggag

SEQ ID NO: 32103 - RNA, 25 nt, Artificial Sequence
  Synthetic Oligonucleotide; PRDM1 exon 5; Set A
guaggacgcguucaaguaagcguag

SEQ ID NO: 32104 - RNA, 23 nt, Artificial Sequence
  Synthetic Oligonucleotide; PRDM1 exon 5; Set A
uaggacgcguucaaguaagcgua

SEQ ID NO: 32105 - RNA, 29 nt, Artificial Sequence
  Synthetic Oligonucleotide; PRDM1 exon 5; Set C
ccguaggacgcguucaaguaagcguagga

SEQ ID NO: 32106 - RNA, 33 nt, Artificial Sequence
  Synthetic Oligonucleotide; PRDM1 exon 5; Set C
ugccguaggacgcguucaaguaagcguaggagu

SEQ ID NO: 32107 - RNA, 31 nt, Artificial Sequence
  Synthetic Oligonucleotide; PRDM1 exon 5; Set C
gccguaggacgcguucaaguaagcguaggag

SEQ ID NO: 32108 - RNA, 24 nt, Artificial Sequence
  Synthetic Oligonucleotide; PRDM1 exon 5; Set A
guaggacgcguucaaguaagcgua

SEQ ID NO: 32109 - RNA, 30 nt, Artificial Sequence
  Synthetic Oligonucleotide; PRDM1 exon 5; Set C
gccguaggacgcguucaaguaagcguagga

SEQ ID NO: 32110 - RNA, 32 nt, Artificial Sequence
  Synthetic Oligonucleotide; PRDM1 exon 5; Set C
ugccguaggacgcguucaaguaagcguaggag

SEQ ID NO: 32111 - RNA, 31 nt, Artificial Sequence
  Synthetic Oligonucleotide; PRDM1 exon 5; Set C
ugccguaggacgcguucaaguaagcguagga

SEQ ID NO: 32112 - RNA, 35 nt, Artificial Sequence
  Synthetic Oligonucleotide; PRDM1 exon 5; Set C
cgugccguaggacgcguucaaguaagcguaggagu

SEQ ID NO: 32113 - RNA, 16 nt, Artificial Sequence
  Synthetic Oligonucleotide; PRDM1 exon 5; Set C
ggacgcguucaaguaa

SEQ ID NO: 32114 - RNA, 34 nt, Artificial Sequence
  Synthetic Oligonucleotide; PRDM1 exon 5; Set C
cgugccguaggacgcguucaaguaagcguaggag

SEQ ID NO: 32115 - RNA, 24 nt, Artificial Sequence
  Synthetic Oligonucleotide; PRDM1 exon 5; Set A
cguaggacgcguucaaguaagcgu

SEQ ID NO: 32116 - RNA, 15 nt, Artificial Sequence
  Synthetic Oligonucleotide; PRDM1 exon 5; Set C
ggacgcguucaagua

SEQ ID NO: 32117 - RNA, 33 nt, Artificial Sequence
  Synthetic Oligonucleotide; PRDM1 exon 5; Set C
cgugccguaggacgcguucaaguaagcguagga

SEQ ID NO: 32118 - RNA, 23 nt, Artificial Sequence
  Synthetic Oligonucleotide; PRDM1 exon 5; Set A
cguaggacgcguucaaguaagcg

SEQ ID NO: 32119 - RNA, 18 nt, Artificial Sequence
  Synthetic Oligonucleotide; PRDM1 exon 5; Set C
uaggacgcguucaaguaa

SEQ ID NO: 32120 - RNA, 22 nt, Artificial Sequence
  Synthetic Oligonucleotide; PRDM1 exon 5; Set A
cguaggacgcguucaaguaagc

SEQ ID NO: 32121 - RNA, 17 nt, Artificial Sequence
  Synthetic Oligonucleotide; PRDM1 exon 5; Set C
uaggacgcguucaagua

SEQ ID NO: 32122 - RNA, 19 nt, Artificial Sequence
  Synthetic Oligonucleotide; PRDM1 exon 5; Set C
guaggacgcguucaaguaa

SEQ ID NO: 32123 - RNA, 16 nt, Artificial Sequence
  Synthetic Oligonucleotide; PRDM1 exon 5; Set C
uaggacgcguucaagu

SEQ ID NO: 32124 - RNA, 18 nt, Artificial Sequence
  Synthetic Oligonucleotide; PRDM1 exon 5; Set C
guaggacgcguucaagua

SEQ ID NO: 32125 - RNA, 28 nt, Artificial Sequence
  Synthetic Oligonucleotide; PRDM1 exon 5; Set C
gugccguaggacgcguucaaguaagcgu

SEQ ID NO: 32126 - RNA, 17 nt, Artificial Sequence
  Synthetic Oligonucleotide; PRDM1 exon 5; Set C
guaggacgcguucaagu

SEQ ID NO: 32127 - RNA, 15 nt, Artificial Sequence
  Synthetic Oligonucleotide; PRDM1 exon 5; Set C
uaggacgcguucaag

SEQ ID NO: 32128 - RNA, 27 nt, Artificial Sequence
  Synthetic Oligonucleotide; PRDM1 exon 5; Set C
gugccguaggacgcguucaaguaagcg

SEQ ID NO: 32129 - RNA, 16 nt, Artificial Sequence
  Synthetic Oligonucleotide; PRDM1 exon 5; Set C
guaggacgcguucaag

SEQ ID NO: 32130 - RNA, 26 nt, Artificial Sequence
  Synthetic Oligonucleotide; PRDM1 exon 5; Set C
gugccguaggacgcguucaaguaagc

SEQ ID NO: 32131 - RNA, 15 nt, Artificial Sequence
  Synthetic Oligonucleotide; PRDM1 exon 5; Set C
guaggacgcguucaa

SEQ ID NO: 32132 - RNA, 40 nt, Artificial Sequence
  Synthetic Oligonucleotide; PRDM1 exon 5; Set C
aaaccuuccgugccguaggacgcguucaaguaagcguagg

SEQ ID NO: 32133 - RNA, 39 nt, Artificial Sequence
  Synthetic Oligonucleotide; PRDM1 exon 5; Set C
aaaccuuccgugccguaggacgcguucaaguaagcguag

SEQ ID NO: 32134 - RNA, 40 nt, Artificial Sequence
  Synthetic Oligonucleotide; PRDM1 exon 5; Set C
caaaccuuccgugccguaggacgcguucaaguaagcguag

SEQ ID NO: 32135 - RNA, 39 nt, Artificial Sequence
  Synthetic Oligonucleotide; PRDM1 exon 5; Set C
caaaccuuccgugccguaggacgcguucaaguaagcgua

SEQ ID NO: 32136 - RNA, 33 nt, Artificial Sequence
  Synthetic Oligonucleotide; PRDM1 exon 5; Set C
aaaccuuccgugccguaggacgcguucaaguaa

SEQ ID NO: 32137 - RNA, 32 nt, Artificial Sequence
  Synthetic Oligonucleotide; PRDM1 exon 5; Set C
aaaccuuccgugccguaggacgcguucaagua

SEQ ID NO: 32138 - RNA, 34 nt, Artificial Sequence
  Synthetic Oligonucleotide; PRDM1 exon 5; Set C
caaaccuuccgugccguaggacgcguucaaguaa

SEQ ID NO: 32139 - RNA, 31 nt, Artificial Sequence
  Synthetic Oligonucleotide; PRDM1 exon 5; Set C
aaaccuuccgugccguaggacgcguucaagu

SEQ ID NO: 32140 - RNA, 33 nt, Artificial Sequence
  Synthetic Oligonucleotide; PRDM1 exon 5; Set C
caaaccuuccgugccguaggacgcguucaagua

SEQ ID NO: 32141 - RNA, 32 nt, Artificial Sequence
  Synthetic Oligonucleotide; PRDM1 exon 5; Set C
caaaccuuccgugccguaggacgcguucaagu

SEQ ID NO: 32142 - RNA, 30 nt, Artificial Sequence
  Synthetic Oligonucleotide; PRDM1 exon 5; Set C
aaaccuuccgugccguaggacgcguucaag

SEQ ID NO: 32143 - RNA, 29 nt, Artificial Sequence
  Synthetic Oligonucleotide; PRDM1 exon 5; Set C
aaaccuuccgugccguaggacgcguucaa

SEQ ID NO: 32144 - RNA, 31 nt, Artificial Sequence
  Synthetic Oligonucleotide; PRDM1 exon 5; Set C
caaaccuuccgugccguaggacgcguucaag

SEQ ID NO: 32145 - RNA, 28 nt, Artificial Sequence
  Synthetic Oligonucleotide; PRDM1 exon 5; Set C
aaaccuuccgugccguaggacgcguuca

SEQ ID NO: 32146 - RNA, 30 nt, Artificial Sequence
  Synthetic Oligonucleotide; PRDM1 exon 5; Set C
caaaccuuccgugccguaggacgcguucaa

SEQ ID NO: 32147 - RNA, 40 nt, Artificial Sequence
  Synthetic Oligonucleotide; PRDM1 exon 5; Set C
gagcccaaaccuuccgugccguaggacgcguucaaguaag

SEQ ID NO: 32148 - RNA, 29 nt, Artificial Sequence
  Synthetic Oligonucleotide; PRDM1 exon 5; Set C
caaaccuuccgugccguaggacgcguuca

SEQ ID NO: 32149 - RNA, 27 nt, Artificial Sequence
  Synthetic Oligonucleotide; PRDM1 exon 5; Set C
aaaccuuccgugccguaggacgcguuc

SEQ ID NO: 32150 - RNA, 28 nt, Artificial Sequence
  Synthetic Oligonucleotide; PRDM1 exon 5; Set C
caaaccuuccgugccguaggacgcguuc

SEQ ID NO: 32151 - RNA, 26 nt, Artificial Sequence
  Synthetic Oligonucleotide; PRDM1 exon 5; Set C
aaaccuuccgugccguaggacgcguu

SEQ ID NO: 32152 - RNA, 27 nt, Artificial Sequence
  Synthetic Oligonucleotide; PRDM1 exon 5; Set C
caaaccuuccgugccguaggacgcguu

SEQ ID NO: 32153 - RNA, 17 nt, Artificial Sequence
  Synthetic Oligonucleotide; PRDM1 exon 5; Set C
caaaccuuccgugccgu

SEQ ID NO: 32154 - RNA, 24 nt, Artificial Sequence
  Synthetic Oligonucleotide; PRDM1 exon 5; Set C
gagcccaaaccuuccgugccguag

SEQ ID NO: 32155 - RNA, 25 nt, Artificial Sequence
  Synthetic Oligonucleotide; PRDM1 exon 5; Set C
ggagcccaaaccuuccgugccguag

SEQ ID NO: 32156 - RNA, 24 nt, Artificial Sequence
  Synthetic Oligonucleotide; PRDM1 exon 5; Set C
ggagcccaaaccuuccgugccgua

SEQ ID NO: 32157 - RNA, 26 nt, Artificial Sequence
  Synthetic Oligonucleotide; PRDM1 exon 5; Set C
aggagcccaaaccuuccgugccguag

SEQ ID NO: 32158 - RNA, 21 nt, Artificial Sequence
  Synthetic Oligonucleotide; PRDM1 exon 5; Set A
gagcccaaaccuuccgugccg

SEQ ID NO: 32159 - RNA, 25 nt, Artificial Sequence
  Synthetic Oligonucleotide; PRDM1 exon 5; Set C
aggagcccaaaccuuccgugccgua

SEQ ID NO: 32160 - RNA, 27 nt, Artificial Sequence
  Synthetic Oligonucleotide; PRDM1 exon 5; Set C
uaggagcccaaaccuuccgugccguag

SEQ ID NO: 32161 - RNA, 20 nt, Artificial Sequence
  Synthetic Oligonucleotide; PRDM1 exon 5; Set A
gagcccaaaccuuccgugcc

SEQ ID NO: 32162 - RNA, 26 nt, Artificial Sequence
  Synthetic Oligonucleotide; PRDM1 exon 5; Set C
uaggagcccaaaccuuccgugccgua

SEQ ID NO: 32163 - RNA, 28 nt, Artificial Sequence
  Synthetic Oligonucleotide; PRDM1 exon 5; Set C
guaggagcccaaaccuuccgugccguag

SEQ ID NO: 32164 - RNA, 19 nt, Artificial Sequence
  Synthetic Oligonucleotide; PRDM1 exon 5; Set A
gagcccaaaccuuccgugc

SEQ ID NO: 32165 - RNA, 21 nt, Artificial Sequence
  Synthetic Oligonucleotide; PRDM1 exon 5; Set C
ggagcccaaaccuuccgugcc

SEQ ID NO: 32166 - RNA, 27 nt, Artificial Sequence
  Synthetic Oligonucleotide; PRDM1 exon 5; Set C
guaggagcccaaaccuuccgugccgua

SEQ ID NO: 32167 - RNA, 29 nt, Artificial Sequence
  Synthetic Oligonucleotide; PRDM1 exon 5; Set C
gguaggagcccaaaccuuccgugccguag

SEQ ID NO: 32168 - RNA, 20 nt, Artificial Sequence
  Synthetic Oligonucleotide; PRDM1 exon 5; Set A
ggagcccaaaccuuccgugc

SEQ ID NO: 32169 - RNA, 28 nt, Artificial Sequence
  Synthetic Oligonucleotide; PRDM1 exon 5; Set C
gguaggagcccaaaccuuccgugccgua

SEQ ID NO: 32170 - RNA, 30 nt, Artificial Sequence
  Synthetic Oligonucleotide; PRDM1 exon 5; Set C
ggguaggagcccaaaccuuccgugccguag

SEQ ID NO: 32171 - RNA, 17 nt, Artificial Sequence
  Synthetic Oligonucleotide; PRDM1 exon 5; Set C
gagcccaaaccuuccgu

SEQ ID NO: 32172 - RNA, 29 nt, Artificial Sequence
  Synthetic Oligonucleotide; PRDM1 exon 5; Set C
ggguaggagcccaaaccuuccgugccgua

SEQ ID NO: 32173 - RNA, 31 nt, Artificial Sequence
  Synthetic Oligonucleotide; PRDM1 exon 5; Set C
aggguaggagcccaaaccuuccgugccguag

SEQ ID NO: 32174 - RNA, 18 nt, Artificial Sequence
  Synthetic Oligonucleotide; PRDM1 exon 5; Set A
ggagcccaaaccuuccgu

SEQ ID NO: 32175 - RNA, 30 nt, Artificial Sequence
  Synthetic Oligonucleotide; PRDM1 exon 5; Set C
aggguaggagcccaaaccuuccgugccgua

SEQ ID NO: 32176 - RNA, 19 nt, Artificial Sequence
  Synthetic Oligonucleotide; PRDM1 exon 5; Set A
aggagcccaaaccuuccgu

SEQ ID NO: 32177 - RNA, 37 nt, Artificial Sequence
  Synthetic Oligonucleotide; PRDM1 exon 5; Set C
guagccaggguaggagcccaaaccuuccgugccguag

SEQ ID NO: 32178 - RNA, 36 nt, Artificial Sequence
  Synthetic Oligonucleotide; PRDM1 exon 5; Set C
guagccaggguaggagcccaaaccuuccgugccgua

SEQ ID NO: 32179 - RNA, 38 nt, Artificial Sequence
  Synthetic Oligonucleotide; PRDM1 exon 5; Set C
cguagccaggguaggagcccaaaccuuccgugccguag

SEQ ID NO: 32180 - RNA, 37 nt, Artificial Sequence
  Synthetic Oligonucleotide; PRDM1 exon 5; Set C
cguagccaggguaggagcccaaaccuuccgugccgua

SEQ ID NO: 32181 - RNA, 39 nt, Artificial Sequence
  Synthetic Oligonucleotide; PRDM1 exon 5; Set C
gcguagccaggguaggagcccaaaccuuccgugccguag

SEQ ID NO: 32182 - RNA, 38 nt, Artificial Sequence
  Synthetic Oligonucleotide; PRDM1 exon 5; Set C
gcguagccaggguaggagcccaaaccuuccgugccgua

SEQ ID NO: 32183 - RNA, 40 nt, Artificial Sequence
  Synthetic Oligonucleotide; PRDM1 exon 5; Set C
ugcguagccaggguaggagcccaaaccuuccgugccguag

SEQ ID NO: 32184 - RNA, 39 nt, Artificial Sequence
  Synthetic Oligonucleotide; PRDM1 exon 5; Set C
ugcguagccaggguaggagcccaaaccuuccgugccgua

SEQ ID NO: 32185 - RNA, 40 nt, Artificial Sequence
  Synthetic Oligonucleotide; PRDM1 exon 5; Set C
gugcguagccaggguaggagcccaaaccuuccgugccgua

SEQ ID NO: 32186 - RNA, 15 nt, Artificial Sequence
  Synthetic Oligonucleotide; PRDM1 exon 5; Set C
ggguaggagcccaaa

SEQ ID NO: 32187 - RNA, 16 nt, Artificial Sequence
  Synthetic Oligonucleotide; PRDM1 exon 5; Set C
aggguaggagcccaaa

SEQ ID NO: 32188 - RNA, 22 nt, Artificial Sequence
  Synthetic Oligonucleotide; PRDM1 exon 5; Set A
guagccaggguaggagcccaaa

SEQ ID NO: 32189 - RNA, 39 nt, Artificial Sequence
  Synthetic Oligonucleotide; PRDM1 exon 5; Set C
caggggugcguagccaggguaggagcccaaaccuuccgu

SEQ ID NO: 32190 - RNA, 23 nt, Artificial Sequence
  Synthetic Oligonucleotide; PRDM1 exon 5; Set C
cguagccaggguaggagcccaaa

SEQ ID NO: 32191 - RNA, 40 nt, Artificial Sequence
  Synthetic Oligonucleotide; PRDM1 exon 5; Set C
gcaggggugcguagccaggguaggagcccaaaccuuccgu

SEQ ID NO: 32192 - RNA, 24 nt, Artificial Sequence
  Synthetic Oligonucleotide; PRDM1 exon 5; Set C
gcguagccaggguaggagcccaaa

SEQ ID NO: 32193 - RNA, 25 nt, Artificial Sequence
  Synthetic Oligonucleotide; PRDM1 exon 5; Set C
ugcguagccaggguaggagcccaaa

SEQ ID NO: 32194 - RNA, 26 nt, Artificial Sequence
  Synthetic Oligonucleotide; PRDM1 exon 5; Set C
gugcguagccaggguaggagcccaaa

SEQ ID NO: 32195 - RNA, 15 nt, Artificial Sequence
  Synthetic Oligonucleotide; PRDM1 exon 5; Set C
uagccaggguaggag

SEQ ID NO: 32196 - RNA, 27 nt, Artificial Sequence
  Synthetic Oligonucleotide; PRDM1 exon 5; Set C
ggugcguagccaggguaggagcccaaa

SEQ ID NO: 32197 - RNA, 17 nt, Artificial Sequence
  Synthetic Oligonucleotide; PRDM1 exon 5; Set A
guagccaggguaggagc

SEQ ID NO: 32198 - RNA, 28 nt, Artificial Sequence
  Synthetic Oligonucleotide; PRDM1 exon 5; Set C
gggugcguagccaggguaggagcccaaa

SEQ ID NO: 32199 - RNA, 18 nt, Artificial Sequence
  Synthetic Oligonucleotide; PRDM1 exon 5; Set A
cguagccaggguaggagc

SEQ ID NO: 32200 - RNA, 29 nt, Artificial Sequence
  Synthetic Oligonucleotide; PRDM1 exon 5; Set C
ggggugcguagccaggguaggagcccaaa

SEQ ID NO: 32201 - RNA, 19 nt, Artificial Sequence
  Synthetic Oligonucleotide; PRDM1 exon 5; Set A
gcguagccaggguaggagc

SEQ ID NO: 32202 - RNA, 30 nt, Artificial Sequence
  Synthetic Oligonucleotide; PRDM1 exon 5; Set C
aggggugcguagccaggguaggagcccaaa

SEQ ID NO: 32203 - RNA, 20 nt, Artificial Sequence
  Synthetic Oligonucleotide; PRDM1 exon 5; Set A
ugcguagccaggguaggagc

SEQ ID NO: 32204 - RNA, 31 nt, Artificial Sequence
  Synthetic Oligonucleotide; PRDM1 exon 5; Set C
caggggugcguagccaggguaggagcccaaa

SEQ ID NO: 32205 - RNA, 21 nt, Artificial Sequence
  Synthetic Oligonucleotide; PRDM1 exon 5; Set C
gugcguagccaggguaggagc

SEQ ID NO: 32206 - RNA, 30 nt, Artificial Sequence
  Synthetic Oligonucleotide; PRDM1 exon 5; Set C
caggggugcguagccaggguaggagcccaa

SEQ ID NO: 32207 - RNA, 32 nt, Artificial Sequence
  Synthetic Oligonucleotide; PRDM1 exon 5; Set C
gcaggggugcguagccaggguaggagcccaaa

SEQ ID NO: 32208 - RNA, 22 nt, Artificial Sequence
  Synthetic Oligonucleotide; PRDM1 exon 5; Set C
ggugcguagccaggguaggagc

SEQ ID NO: 32209 - RNA, 31 nt, Artificial Sequence
  Synthetic Oligonucleotide; PRDM1 exon 5; Set C
gcaggggugcguagccaggguaggagcccaa

SEQ ID NO: 32210 - RNA, 33 nt, Artificial Sequence
  Synthetic Oligonucleotide; PRDM1 exon 5; Set C
ggcaggggugcguagccaggguaggagcccaaa

SEQ ID NO: 32211 - RNA, 23 nt, Artificial Sequence
  Synthetic Oligonucleotide; PRDM1 exon 5; Set C
gggugcguagccaggguaggagc

SEQ ID NO: 32212 - RNA, 32 nt, Artificial Sequence
  Synthetic Oligonucleotide; PRDM1 exon 5; Set C
ggcaggggugcguagccaggguaggagcccaa

SEQ ID NO: 32213 - RNA, 34 nt, Artificial Sequence
  Synthetic Oligonucleotide; PRDM1 exon 5; Set C
gggcaggggugcguagccaggguaggagcccaaa

SEQ ID NO: 32214 - RNA, 24 nt, Artificial Sequence
  Synthetic Oligonucleotide; PRDM1 exon 5; Set C
ggggugcguagccaggguaggagc

SEQ ID NO: 32215 - RNA, 35 nt, Artificial Sequence
  Synthetic Oligonucleotide; PRDM1 exon 5; Set C
ggggcaggggugcguagccaggguaggagcccaaa

SEQ ID NO: 32216 - RNA, 25 nt, Artificial Sequence
  Synthetic Oligonucleotide; PRDM1 exon 5; Set C
aggggugcguagccaggguaggagc

SEQ ID NO: 32217 - RNA, 36 nt, Artificial Sequence
  Synthetic Oligonucleotide; PRDM1 exon 5; Set C
uggggcaggggugcguagccaggguaggagcccaaa

SEQ ID NO: 32218 - RNA, 29 nt, Artificial Sequence
  Synthetic Oligonucleotide; PRDM1 exon 5; Set C
gggcaggggugcguagccaggguaggagc

SEQ ID NO: 32219 - RNA, 40 nt, Artificial Sequence
  Synthetic Oligonucleotide; PRDM1 exon 5; Set C
gagguggggcaggggugcguagccaggguaggagcccaaa

SEQ ID NO: 32220 - RNA, 30 nt, Artificial Sequence
  Synthetic Oligonucleotide; PRDM1 exon 5; Set C
ggggcaggggugcguagccaggguaggagc

SEQ ID NO: 32221 - RNA, 39 nt, Artificial Sequence
  Synthetic Oligonucleotide; PRDM1 exon 5; Set C
gagguggggcaggggugcguagccaggguaggagcccaa

SEQ ID NO: 32222 - RNA, 31 nt, Artificial Sequence
  Synthetic Oligonucleotide; PRDM1 exon 5; Set C
uggggcaggggugcguagccaggguaggagc

SEQ ID NO: 32223 - RNA, 40 nt, Artificial Sequence
  Synthetic Oligonucleotide; PRDM1 exon 5; Set C
ggagguggggcaggggugcguagccaggguaggagcccaa

SEQ ID NO: 32224 - RNA, 32 nt, Artificial Sequence
  Synthetic Oligonucleotide; PRDM1 exon 5; Set C
guggggcaggggugcguagccaggguaggagc

SEQ ID NO: 32225 - RNA, 15 nt, Artificial Sequence
  Synthetic Oligonucleotide; PRDM1 exon 5; Set A
ggggugcguagccag

SEQ ID NO: 32226 - RNA, 33 nt, Artificial Sequence
  Synthetic Oligonucleotide; PRDM1 exon 5; Set C
gguggggcaggggugcguagccaggguaggagc

SEQ ID NO: 32227 - RNA, 16 nt, Artificial Sequence
  Synthetic Oligonucleotide; PRDM1 exon 5; Set A
aggggugcguagccag

SEQ ID NO: 32228 - RNA, 34 nt, Artificial Sequence
  Synthetic Oligonucleotide; PRDM1 exon 5; Set C
agguggggcaggggugcguagccaggguaggagc

SEQ ID NO: 32229 - RNA, 20 nt, Artificial Sequence
  Synthetic Oligonucleotide; PRDM1 exon 5; Set C
gggcaggggugcguagccag

SEQ ID NO: 32230 - RNA, 21 nt, Artificial Sequence
  Synthetic Oligonucleotide; PRDM1 exon 5; Set C
ggggcaggggugcguagccag

SEQ ID NO: 32231 - RNA, 22 nt, Artificial Sequence
  Synthetic Oligonucleotide; PRDM1 exon 5; Set C
uggggcaggggugcguagccag

SEQ ID NO: 32232 - RNA, 23 nt, Artificial Sequence
  Synthetic Oligonucleotide; PRDM1 exon 5; Set C
guggggcaggggugcguagccag

SEQ ID NO: 32233 - RNA, 15 nt, Artificial Sequence
  Synthetic Oligonucleotide; PRDM1 exon 5; Set A
ggcaggggugcguag

SEQ ID NO: 32234 - RNA, 24 nt, Artificial Sequence
  Synthetic Oligonucleotide; PRDM1 exon 5; Set C
gguggggcaggggugcguagccag

SEQ ID NO: 32235 - RNA, 16 nt, Artificial Sequence
  Synthetic Oligonucleotide; PRDM1 exon 5; Set A
gggcaggggugcguag

SEQ ID NO: 32236 - RNA, 25 nt, Artificial Sequence
  Synthetic Oligonucleotide; PRDM1 exon 5; Set C
agguggggcaggggugcguagccag

SEQ ID NO: 32237 - RNA, 17 nt, Artificial Sequence
  Synthetic Oligonucleotide; PRDM1 exon 5; Set A
ggggcaggggugcguag

SEQ ID NO: 32238 - RNA, 18 nt, Artificial Sequence
  Synthetic Oligonucleotide; PRDM1 exon 5; Set A
uggggcaggggugcguag

SEQ ID NO: 32239 - RNA, 19 nt, Artificial Sequence
  Synthetic Oligonucleotide; PRDM1 exon 5; Set C
guggggcaggggugcguag

SEQ ID NO: 32240 - RNA, 20 nt, Artificial Sequence
  Synthetic Oligonucleotide; PRDM1 exon 5; Set C
gguggggcaggggugcguag

SEQ ID NO: 32241 - RNA, 21 nt, Artificial Sequence
  Synthetic Oligonucleotide; PRDM1 exon 5; Set C
agguggggcaggggugcguag

SEQ ID NO: 32242 - RNA, 22 nt, Artificial Sequence
  Synthetic Oligonucleotide; PRDM1 exon 5; Set C
gagguggggcaggggugcguag

SEQ ID NO: 32243 - RNA, 23 nt, Artificial Sequence
  Synthetic Oligonucleotide; PRDM1 exon 5; Set C
ggagguggggcaggggugcguag

SEQ ID NO: 32244 - RNA, 24 nt, Artificial Sequence
  Synthetic Oligonucleotide; PRDM1 exon 5; Set C
gggagguggggcaggggugcguag

SEQ ID NO: 32245 - RNA, 35 nt, Artificial Sequence
  Synthetic Oligonucleotide; PRDM1 exon 5; Set C
agcuggcgggagguggggcaggggugcguagccag

SEQ ID NO: 32246 - RNA, 36 nt, Artificial Sequence
  Synthetic Oligonucleotide; PRDM1 exon 5; Set C
aagcuggcgggagguggggcaggggugcguagccag

SEQ ID NO: 32247 - RNA, 37 nt, Artificial Sequence
  Synthetic Oligonucleotide; PRDM1 exon 5; Set C
aaagcuggcgggagguggggcaggggugcguagccag

SEQ ID NO: 32248 - RNA, 38 nt, Artificial Sequence
  Synthetic Oligonucleotide; PRDM1 exon 5; Set C
gaaagcuggcgggagguggggcaggggugcguagccag

SEQ ID NO: 32249 - RNA, 30 nt, Artificial Sequence
  Synthetic Oligonucleotide; PRDM1 exon 5; Set C
gcuggcgggagguggggcaggggugcguag

SEQ ID NO: 32250 - RNA, 39 nt, Artificial Sequence
  Synthetic Oligonucleotide; PRDM1 exon 5; Set C
ugaaagcuggcgggagguggggcaggggugcguagccag

SEQ ID NO: 32251 - RNA, 31 nt, Artificial Sequence
  Synthetic Oligonucleotide; PRDM1 exon 5; Set C
agcuggcgggagguggggcaggggugcguag

SEQ ID NO: 32252 - RNA, 40 nt, Artificial Sequence
  Synthetic Oligonucleotide; PRDM1 exon 5; Set C
augaaagcuggcgggagguggggcaggggugcguagccag

SEQ ID NO: 32253 - RNA, 32 nt, Artificial Sequence
  Synthetic Oligonucleotide; PRDM1 exon 5; Set C
aagcuggcgggagguggggcaggggugcguag

SEQ ID NO: 32254 - RNA, 33 nt, Artificial Sequence
  Synthetic Oligonucleotide; PRDM1 exon 5; Set C
aaagcuggcgggagguggggcaggggugcguag

SEQ ID NO: 32255 - RNA, 34 nt, Artificial Sequence
  Synthetic Oligonucleotide; PRDM1 exon 5; Set C
gaaagcuggcgggagguggggcaggggugcguag

SEQ ID NO: 32256 - RNA, 35 nt, Artificial Sequence
  Synthetic Oligonucleotide; PRDM1 exon 5; Set C
ugaaagcuggcgggagguggggcaggggugcguag

SEQ ID NO: 32257 - RNA, 36 nt, Artificial Sequence
  Synthetic Oligonucleotide; PRDM1 exon 5; Set C
augaaagcuggcgggagguggggcaggggugcguag

SEQ ID NO: 32258 - RNA, 37 nt, Artificial Sequence
  Synthetic Oligonucleotide; PRDM1 exon 5; Set C
gaugaaagcuggcgggagguggggcaggggugcguag

SEQ ID NO: 32259 - RNA, 38 nt, Artificial Sequence
  Synthetic Oligonucleotide; PRDM1 exon 5; Set C
ggaugaaagcuggcgggagguggggcaggggugcguag

SEQ ID NO: 32260 - RNA, 39 nt, Artificial Sequence
  Synthetic Oligonucleotide; PRDM1 exon 5; Set C
gggaugaaagcuggcgggagguggggcaggggugcguag

SEQ ID NO: 32261 - RNA, 40 nt, Artificial Sequence
  Synthetic Oligonucleotide; PRDM1 exon 5; Set C
ucaugccguaggggggcaagaggaacuugggguagugagc

SEQ ID NO: 32262 - RNA, 39 nt, Artificial Sequence
  Synthetic Oligonucleotide; PRDM1 exon 5; Set C
ucaugccguaggggggcaagaggaacuugggguagugag

SEQ ID NO: 32263 - RNA, 38 nt, Artificial Sequence
  Synthetic Oligonucleotide; PRDM1 exon 5; Set C
ucaugccguaggggggcaagaggaacuugggguaguga

SEQ ID NO: 32264 - RNA, 40 nt, Artificial Sequence
  Synthetic Oligonucleotide; PRDM1 exon 5; Set C
uucaugccguaggggggcaagaggaacuugggguagugag

SEQ ID NO: 32265 - RNA, 39 nt, Artificial Sequence
  Synthetic Oligonucleotide; PRDM1 exon 5; Set C
uucaugccguaggggggcaagaggaacuugggguaguga

SEQ ID NO: 32266 - RNA, 37 nt, Artificial Sequence
  Synthetic Oligonucleotide; PRDM1 exon 5; Set C
ucaugccguaggggggcaagaggaacuugggguagug

SEQ ID NO: 32267 - RNA, 36 nt, Artificial Sequence
  Synthetic Oligonucleotide; PRDM1 exon 5; Set C
ucaugccguaggggggcaagaggaacuugggguagu

SEQ ID NO: 32268 - RNA, 38 nt, Artificial Sequence
  Synthetic Oligonucleotide; PRDM1 exon 5; Set C
uucaugccguaggggggcaagaggaacuugggguagug

SEQ ID NO: 32269 - RNA, 35 nt, Artificial Sequence
  Synthetic Oligonucleotide; PRDM1 exon 5; Set C
ucaugccguaggggggcaagaggaacuugggguag

SEQ ID NO: 32270 - RNA, 37 nt, Artificial Sequence
  Synthetic Oligonucleotide; PRDM1 exon 5; Set C
uucaugccguaggggggcaagaggaacuugggguagu

SEQ ID NO: 32271 - RNA, 34 nt, Artificial Sequence
  Synthetic Oligonucleotide; PRDM1 exon 5; Set C
ucaugccguaggggggcaagaggaacuuggggua

SEQ ID NO: 32272 - RNA, 33 nt, Artificial Sequence
  Synthetic Oligonucleotide; PRDM1 exon 5; Set C
ucaugccguaggggggcaagaggaacuuggggu

SEQ ID NO: 32273 - RNA, 35 nt, Artificial Sequence
  Synthetic Oligonucleotide; PRDM1 exon 5; Set C
uucaugccguaggggggcaagaggaacuuggggua

SEQ ID NO: 32274 - RNA, 34 nt, Artificial Sequence
  Synthetic Oligonucleotide; PRDM1 exon 5; Set C
uucaugccguaggggggcaagaggaacuuggggu

SEQ ID NO: 32275 - RNA, 32 nt, Artificial Sequence
  Synthetic Oligonucleotide; PRDM1 exon 5; Set C
ucaugccguaggggggcaagaggaacuugggg

SEQ ID NO: 32276 - RNA, 31 nt, Artificial Sequence
  Synthetic Oligonucleotide; PRDM1 exon 5; Set C
ucaugccguaggggggcaagaggaacuuggg

SEQ ID NO: 32277 - RNA, 33 nt, Artificial Sequence
  Synthetic Oligonucleotide; PRDM1 exon 5; Set C
uucaugccguaggggggcaagaggaacuugggg

SEQ ID NO: 32278 - RNA, 30 nt, Artificial Sequence
  Synthetic Oligonucleotide; PRDM1 exon 5; Set C
ucaugccguaggggggcaagaggaacuugg

SEQ ID NO: 32279 - RNA, 32 nt, Artificial Sequence
  Synthetic Oligonucleotide; PRDM1 exon 5; Set C
uucaugccguaggggggcaagaggaacuuggg

SEQ ID NO: 32280 - RNA, 31 nt, Artificial Sequence
  Synthetic Oligonucleotide; PRDM1 exon 5; Set C
uucaugccguaggggggcaagaggaacuugg

SEQ ID NO: 32281 - RNA, 29 nt, Artificial Sequence
  Synthetic Oligonucleotide; PRDM1 exon 5; Set C
ucaugccguaggggggcaagaggaacuug

SEQ ID NO: 32282 - RNA, 30 nt, Artificial Sequence
  Synthetic Oligonucleotide; PRDM1 exon 5; Set C
uucaugccguaggggggcaagaggaacuug

SEQ ID NO: 32283 - RNA, 25 nt, Artificial Sequence
  Synthetic Oligonucleotide; PRDM1 exon 5; Set C
ucaugccguaggggggcaagaggaa

SEQ ID NO: 32284 - RNA, 24 nt, Artificial Sequence
  Synthetic Oligonucleotide; PRDM1 exon 5; Set C
ucaugccguaggggggcaagagga

SEQ ID NO: 32285 - RNA, 26 nt, Artificial Sequence
  Synthetic Oligonucleotide; PRDM1 exon 5; Set C
uucaugccguaggggggcaagaggaa

SEQ ID NO: 32286 - RNA, 25 nt, Artificial Sequence
  Synthetic Oligonucleotide; PRDM1 exon 5; Set C
uucaugccguaggggggcaagagga

SEQ ID NO: 32287 - RNA, 23 nt, Artificial Sequence
  Synthetic Oligonucleotide; PRDM1 exon 5; Set C
ucaugccguaggggggcaagagg

SEQ ID NO: 32288 - RNA, 22 nt, Artificial Sequence
  Synthetic Oligonucleotide; PRDM1 exon 5; Set A
ucaugccguaggggggcaagag

SEQ ID NO: 32289 - RNA, 40 nt, Artificial Sequence
  Synthetic Oligonucleotide; PRDM1 exon 5; Set C
cauuacaauucaugccguaggggggcaagaggaacuuggg

SEQ ID NO: 32290 - RNA, 24 nt, Artificial Sequence
  Synthetic Oligonucleotide; PRDM1 exon 5; Set C
uucaugccguaggggggcaagagg

SEQ ID NO: 32291 - RNA, 39 nt, Artificial Sequence
  Synthetic Oligonucleotide; PRDM1 exon 5; Set C
cauuacaauucaugccguaggggggcaagaggaacuugg

SEQ ID NO: 32292 - RNA, 23 nt, Artificial Sequence
  Synthetic Oligonucleotide; PRDM1 exon 5; Set A
uucaugccguaggggggcaagag

SEQ ID NO: 32293 - RNA, 21 nt, Artificial Sequence
  Synthetic Oligonucleotide; PRDM1 exon 5; Set C
ucaugccguaggggggcaaga

SEQ ID NO: 32294 - RNA, 22 nt, Artificial Sequence
  Synthetic Oligonucleotide; PRDM1 exon 5; Set C
uucaugccguaggggggcaaga

SEQ ID NO: 32295 - RNA, 16 nt, Artificial Sequence
  Synthetic Oligonucleotide; PRDM1 exon 5; Set A
ucaugccguagggggg

SEQ ID NO: 32296 - RNA, 33 nt, Artificial Sequence
  Synthetic Oligonucleotide; PRDM1 exon 5; Set C
cauuacaauucaugccguaggggggcaagagga

SEQ ID NO: 32297 - RNA, 17 nt, Artificial Sequence
  Synthetic Oligonucleotide; PRDM1 exon 5; Set A
uucaugccguagggggg

SEQ ID NO: 32298 - RNA, 15 nt, Artificial Sequence
  Synthetic Oligonucleotide; PRDM1 exon 5; Set C
ucaugccguaggggg

SEQ ID NO: 32299 - RNA, 32 nt, Artificial Sequence
  Synthetic Oligonucleotide; PRDM1 exon 5; Set C
cauuacaauucaugccguaggggggcaagagg

SEQ ID NO: 32300 - RNA, 16 nt, Artificial Sequence
  Synthetic Oligonucleotide; PRDM1 exon 5; Set C
uucaugccguaggggg

SEQ ID NO: 32301 - RNA, 15 nt, Artificial Sequence
  Synthetic Oligonucleotide; PRDM1 exon 5; Set C
uucaugccguagggg

SEQ ID NO: 32302 - RNA, 31 nt, Artificial Sequence
  Synthetic Oligonucleotide; PRDM1 exon 5; Set C
cauuacaauucaugccguaggggggcaagag

SEQ ID NO: 32303 - RNA, 30 nt, Artificial Sequence
  Synthetic Oligonucleotide; PRDM1 exon 5; Set C
cauuacaauucaugccguaggggggcaaga

SEQ ID NO: 32304 - RNA, 25 nt, Artificial Sequence
  Synthetic Oligonucleotide; PRDM1 exon 5; Set A
cauuacaauucaugccguagggggg

SEQ ID NO: 32305 - RNA, 24 nt, Artificial Sequence
  Synthetic Oligonucleotide; PRDM1 exon 5; Set A
cauuacaauucaugccguaggggg

SEQ ID NO: 32306 - RNA, 23 nt, Artificial Sequence
  Synthetic Oligonucleotide; PRDM1 exon 5; Set A
cauuacaauucaugccguagggg

SEQ ID NO: 32307 - RNA, 22 nt, Artificial Sequence
  Synthetic Oligonucleotide; PRDM1 exon 5; Set C
cauuacaauucaugccguaggg

SEQ ID NO: 32308 - RNA, 21 nt, Artificial Sequence
  Synthetic Oligonucleotide; PRDM1 exon 5; Set C
cauuacaauucaugccguagg

SEQ ID NO: 32309 - RNA, 20 nt, Artificial Sequence
  Synthetic Oligonucleotide; PRDM1 exon 5; Set C
cauuacaauucaugccguag

SEQ ID NO: 32310 - RNA, 19 nt, Artificial Sequence
  Synthetic Oligonucleotide; PRDM1 exon 5; Set C
cauuacaauucaugccgua

SEQ ID NO: 32311 - RNA, 34 nt, Artificial Sequence
  Synthetic Oligonucleotide; PRDM1 exon 5; Set C
augcugcucacagcgcucaggccauuacaauuca

SEQ ID NO: 32312 - RNA, 33 nt, Artificial Sequence
  Synthetic Oligonucleotide; PRDM1 exon 5; Set C
augcugcucacagcgcucaggccauuacaauuc

SEQ ID NO: 32313 - RNA, 35 nt, Artificial Sequence
  Synthetic Oligonucleotide; PRDM1 exon 5; Set C
caugcugcucacagcgcucaggccauuacaauuca

SEQ ID NO: 32314 - RNA, 34 nt, Artificial Sequence
  Synthetic Oligonucleotide; PRDM1 exon 5; Set C
caugcugcucacagcgcucaggccauuacaauuc

SEQ ID NO: 32315 - RNA, 36 nt, Artificial Sequence
  Synthetic Oligonucleotide; PRDM1 exon 5; Set C
ucaugcugcucacagcgcucaggccauuacaauuca

SEQ ID NO: 32316 - RNA, 35 nt, Artificial Sequence
  Synthetic Oligonucleotide; PRDM1 exon 5; Set C
ucaugcugcucacagcgcucaggccauuacaauuc

SEQ ID NO: 32317 - RNA, 37 nt, Artificial Sequence
  Synthetic Oligonucleotide; PRDM1 exon 5; Set C
uucaugcugcucacagcgcucaggccauuacaauuca

SEQ ID NO: 32318 - RNA, 36 nt, Artificial Sequence
  Synthetic Oligonucleotide; PRDM1 exon 5; Set C
uucaugcugcucacagcgcucaggccauuacaauuc

SEQ ID NO: 32319 - RNA, 38 nt, Artificial Sequence
  Synthetic Oligonucleotide; PRDM1 exon 5; Set C
auucaugcugcucacagcgcucaggccauuacaauuca

SEQ ID NO: 32320 - RNA, 37 nt, Artificial Sequence
  Synthetic Oligonucleotide; PRDM1 exon 5; Set C
auucaugcugcucacagcgcucaggccauuacaauuc

SEQ ID NO: 32321 - RNA, 40 nt, Artificial Sequence
  Synthetic Oligonucleotide; PRDM1 exon 5; Set C
gaugccauucaugcugcucacagcgcucaggccauuacaa

SEQ ID NO: 32322 - RNA, 39 nt, Artificial Sequence
  Synthetic Oligonucleotide; PRDM1 exon 5; Set C
gaugccauucaugcugcucacagcgcucaggccauuaca

SEQ ID NO: 32323 - RNA, 38 nt, Artificial Sequence
  Synthetic Oligonucleotide; PRDM1 exon 5; Set C
gaugccauucaugcugcucacagcgcucaggccauuac

SEQ ID NO: 32324 - RNA, 40 nt, Artificial Sequence
  Synthetic Oligonucleotide; PRDM1 exon 5; Set C
ugaugccauucaugcugcucacagcgcucaggccauuaca

SEQ ID NO: 32325 - RNA, 37 nt, Artificial Sequence
  Synthetic Oligonucleotide; PRDM1 exon 5; Set C
gaugccauucaugcugcucacagcgcucaggccauua

SEQ ID NO: 32326 - RNA, 39 nt, Artificial Sequence
  Synthetic Oligonucleotide; PRDM1 exon 5; Set C
ugaugccauucaugcugcucacagcgcucaggccauuac

SEQ ID NO: 32327 - RNA, 38 nt, Artificial Sequence
  Synthetic Oligonucleotide; PRDM1 exon 5; Set C
ugaugccauucaugcugcucacagcgcucaggccauua

SEQ ID NO: 32328 - RNA, 36 nt, Artificial Sequence
  Synthetic Oligonucleotide; PRDM1 exon 5; Set C
gaugccauucaugcugcucacagcgcucaggccauu

SEQ ID NO: 32329 - RNA, 37 nt, Artificial Sequence
  Synthetic Oligonucleotide; PRDM1 exon 5; Set C
ugaugccauucaugcugcucacagcgcucaggccauu

SEQ ID NO: 32330 - RNA, 31 nt, Artificial Sequence
  Synthetic Oligonucleotide; PRDM1 exon 5; Set C
gaugccauucaugcugcucacagcgcucagg

SEQ ID NO: 32331 - RNA, 32 nt, Artificial Sequence
  Synthetic Oligonucleotide; PRDM1 exon 5; Set C
ugaugccauucaugcugcucacagcgcucagg

SEQ ID NO: 32332 - RNA, 40 nt, Artificial Sequence
  Synthetic Oligonucleotide; PRDM1 exon 5; Set C
uguagacagggcacagccucgggaagaggccaaaguuguu

SEQ ID NO: 32333 - RNA, 39 nt, Artificial Sequence
  Synthetic Oligonucleotide; PRDM1 exon 5; Set C
uguagacagggcacagccucgggaagaggccaaaguugu

SEQ ID NO: 32334 - RNA, 38 nt, Artificial Sequence
  Synthetic Oligonucleotide; PRDM1 exon 5; Set C
uguagacagggcacagccucgggaagaggccaaaguug

SEQ ID NO: 32335 - RNA, 37 nt, Artificial Sequence
  Synthetic Oligonucleotide; PRDM1 exon 5; Set C
uguagacagggcacagccucgggaagaggccaaaguu

SEQ ID NO: 32336 - RNA, 36 nt, Artificial Sequence
  Synthetic Oligonucleotide; PRDM1 exon 5; Set C
uguagacagggcacagccucgggaagaggccaaagu

SEQ ID NO: 32337 - RNA, 35 nt, Artificial Sequence
  Synthetic Oligonucleotide; PRDM1 exon 5; Set C
uguagacagggcacagccucgggaagaggccaaag

SEQ ID NO: 32338 - RNA, 34 nt, Artificial Sequence
  Synthetic Oligonucleotide; PRDM1 exon 5; Set C
uguagacagggcacagccucgggaagaggccaaa

SEQ ID NO: 32339 - RNA, 25 nt, Artificial Sequence
  Synthetic Oligonucleotide; PRDM1 exon 5; Set C
uguagacagggcacagccucgggaa

SEQ ID NO: 32340 - RNA, 24 nt, Artificial Sequence
  Synthetic Oligonucleotide; PRDM1 exon 5; Set C
uguagacagggcacagccucggga

SEQ ID NO: 32341 - RNA, 23 nt, Artificial Sequence
  Synthetic Oligonucleotide; PRDM1 exon 5; Set C
uguagacagggcacagccucggg

SEQ ID NO: 32342 - RNA, 16 nt, Artificial Sequence
  Synthetic Oligonucleotide; PRDM1 exon 5; Set C
auugcuguagacaggg

SEQ ID NO: 32343 - RNA, 17 nt, Artificial Sequence
  Synthetic Oligonucleotide; PRDM1 exon 5; Set C
gauugcuguagacaggg

SEQ ID NO: 32344 - RNA, 18 nt, Artificial Sequence
  Synthetic Oligonucleotide; PRDM1 exon 5; Set C
agauugcuguagacaggg

SEQ ID NO: 32345 - RNA, 19 nt, Artificial Sequence
  Synthetic Oligonucleotide; PRDM1 exon 5; Set C
gagauugcuguagacaggg

SEQ ID NO: 32346 - RNA, 15 nt, Artificial Sequence
  Synthetic Oligonucleotide; PRDM1 exon 5; Set C
gauugcuguagacag

SEQ ID NO: 32347 - RNA, 20 nt, Artificial Sequence
  Synthetic Oligonucleotide; PRDM1 exon 5; Set A
ggagauugcuguagacaggg

SEQ ID NO: 32348 - RNA, 16 nt, Artificial Sequence
  Synthetic Oligonucleotide; PRDM1 exon 5; Set C
agauugcuguagacag

SEQ ID NO: 32349 - RNA, 21 nt, Artificial Sequence
  Synthetic Oligonucleotide; PRDM1 exon 5; Set A
aggagauugcuguagacaggg

SEQ ID NO: 32350 - RNA, 15 nt, Artificial Sequence
  Synthetic Oligonucleotide; PRDM1 exon 5; Set C
agauugcuguagaca

SEQ ID NO: 32351 - RNA, 17 nt, Artificial Sequence
  Synthetic Oligonucleotide; PRDM1 exon 5; Set C
gagauugcuguagacag

SEQ ID NO: 32352 - RNA, 22 nt, Artificial Sequence
  Synthetic Oligonucleotide; PRDM1 exon 5; Set A
gaggagauugcuguagacaggg

SEQ ID NO: 32353 - RNA, 18 nt, Artificial Sequence
  Synthetic Oligonucleotide; PRDM1 exon 5; Set C
ggagauugcuguagacag

SEQ ID NO: 32354 - RNA, 16 nt, Artificial Sequence
  Synthetic Oligonucleotide; PRDM1 exon 5; Set C
gagauugcuguagaca

SEQ ID NO: 32355 - RNA, 19 nt, Artificial Sequence
  Synthetic Oligonucleotide; PRDM1 exon 5; Set C
aggagauugcuguagacag

SEQ ID NO: 32356 - RNA, 17 nt, Artificial Sequence
  Synthetic Oligonucleotide; PRDM1 exon 5; Set C
ggagauugcuguagaca

SEQ ID NO: 32357 - RNA, 15 nt, Artificial Sequence
  Synthetic Oligonucleotide; PRDM1 exon 5; Set C
gagauugcuguagac

SEQ ID NO: 32358 - RNA, 20 nt, Artificial Sequence
  Synthetic Oligonucleotide; PRDM1 exon 5; Set C
gaggagauugcuguagacag

SEQ ID NO: 32359 - RNA, 18 nt, Artificial Sequence
  Synthetic Oligonucleotide; PRDM1 exon 5; Set C
aggagauugcuguagaca

SEQ ID NO: 32360 - RNA, 16 nt, Artificial Sequence
  Synthetic Oligonucleotide; PRDM1 exon 5; Set C
ggagauugcuguagac

SEQ ID NO: 32361 - RNA, 19 nt, Artificial Sequence
  Synthetic Oligonucleotide; PRDM1 exon 5; Set C
gaggagauugcuguagaca

SEQ ID NO: 32362 - RNA, 17 nt, Artificial Sequence
  Synthetic Oligonucleotide; PRDM1 exon 5; Set C
aggagauugcuguagac

SEQ ID NO: 32363 - RNA, 18 nt, Artificial Sequence
  Synthetic Oligonucleotide; PRDM1 exon 5; Set C
gaggagauugcuguagac

SEQ ID NO: 32364 - RNA, 15 nt, Artificial Sequence
  Synthetic Oligonucleotide; PRDM1 exon 5; Set C
gaggagauugcugua

SEQ ID NO: 32365 - RNA, 31 nt, Artificial Sequence
  Synthetic Oligonucleotide; PRDM1 exon 5; Set C
ugcccccaccgaggagauugcuguagacagg

SEQ ID NO: 32366 - RNA, 32 nt, Artificial Sequence
  Synthetic Oligonucleotide; PRDM1 exon 5; Set C
cugcccccaccgaggagauugcuguagacagg

SEQ ID NO: 32367 - RNA, 33 nt, Artificial Sequence
  Synthetic Oligonucleotide; PRDM1 exon 5; Set C
gcugcccccaccgaggagauugcuguagacagg

SEQ ID NO: 32368 - RNA, 34 nt, Artificial Sequence
  Synthetic Oligonucleotide; PRDM1 exon 5; Set C
ggcugcccccaccgaggagauugcuguagacagg

SEQ ID NO: 32369 - RNA, 35 nt, Artificial Sequence
  Synthetic Oligonucleotide; PRDM1 exon 5; Set C
aggcugcccccaccgaggagauugcuguagacagg

SEQ ID NO: 32370 - RNA, 36 nt, Artificial Sequence
  Synthetic Oligonucleotide; PRDM1 exon 5; Set C
caggcugcccccaccgaggagauugcuguagacagg

SEQ ID NO: 32371 - RNA, 30 nt, Artificial Sequence
  Synthetic Oligonucleotide; PRDM1 exon 5; Set C
ggcugcccccaccgaggagauugcuguaga

SEQ ID NO: 32372 - RNA, 31 nt, Artificial Sequence
  Synthetic Oligonucleotide; PRDM1 exon 5; Set C
aggcugcccccaccgaggagauugcuguaga

SEQ ID NO: 32373 - RNA, 32 nt, Artificial Sequence
  Synthetic Oligonucleotide; PRDM1 exon 5; Set C
caggcugcccccaccgaggagauugcuguaga

SEQ ID NO: 32374 - RNA, 22 nt, Artificial Sequence
  Synthetic Oligonucleotide; PRDM1 exon 5; Set C
gcugcccccaccgaggagauug

SEQ ID NO: 32375 - RNA, 23 nt, Artificial Sequence
  Synthetic Oligonucleotide; PRDM1 exon 5; Set C
ggcugcccccaccgaggagauug

SEQ ID NO: 32376 - RNA, 24 nt, Artificial Sequence
  Synthetic Oligonucleotide; PRDM1 exon 5; Set C
aggcugcccccaccgaggagauug

SEQ ID NO: 32377 - RNA, 25 nt, Artificial Sequence
  Synthetic Oligonucleotide; PRDM1 exon 5; Set C
caggcugcccccaccgaggagauug

SEQ ID NO: 32378 - RNA, 38 nt, Artificial Sequence
  Synthetic Oligonucleotide; PRDM1 exon 5; Set C
gggguggggcaggcugcccccaccgaggagauugcugu

SEQ ID NO: 32379 - RNA, 36 nt, Artificial Sequence
  Synthetic Oligonucleotide; PRDM1 exon 5; Set C
augggguggggcaggcugcccccaccgaggagauug

SEQ ID NO: 32380 - RNA, 40 nt, Artificial Sequence
  Synthetic Oligonucleotide; PRDM1 exon 5; Set C
uugagcaugggguggggcaggcugcccccaccgaggagau

SEQ ID NO: 32381 - RNA, 39 nt, Artificial Sequence
  Synthetic Oligonucleotide; PRDM1 exon 5; Set C
uugagcaugggguggggcaggcugcccccaccgaggaga

SEQ ID NO: 32382 - RNA, 38 nt, Artificial Sequence
  Synthetic Oligonucleotide; PRDM1 exon 5; Set C
uugagcaugggguggggcaggcugcccccaccgaggag

SEQ ID NO: 32383 - RNA, 37 nt, Artificial Sequence
  Synthetic Oligonucleotide; PRDM1 exon 5; Set C
uugagcaugggguggggcaggcugcccccaccgagga

SEQ ID NO: 32384 - RNA, 36 nt, Artificial Sequence
  Synthetic Oligonucleotide; PRDM1 exon 5; Set C
uugagcaugggguggggcaggcugcccccaccgagg

SEQ ID NO: 32385 - RNA, 35 nt, Artificial Sequence
  Synthetic Oligonucleotide; PRDM1 exon 5; Set C
uugagcaugggguggggcaggcugcccccaccgag

SEQ ID NO: 32386 - RNA, 25 nt, Artificial Sequence
  Synthetic Oligonucleotide; PRDM1 exon 5; Set C
uugagcaugggguggggcaggcugc

SEQ ID NO: 32387 - RNA, 24 nt, Artificial Sequence
  Synthetic Oligonucleotide; PRDM1 exon 5; Set C
uugagcaugggguggggcaggcug

SEQ ID NO: 32388 - RNA, 23 nt, Artificial Sequence
  Synthetic Oligonucleotide; PRDM1 exon 5; Set C
uugagcaugggguggggcaggcu

SEQ ID NO: 32389 - RNA, 22 nt, Artificial Sequence
  Synthetic Oligonucleotide; PRDM1 exon 5; Set C
uugagcaugggguggggcaggc

SEQ ID NO: 32390 - RNA, 21 nt, Artificial Sequence
  Synthetic Oligonucleotide; PRDM1 exon 5; Set C
uugagcaugggguggggcagg

SEQ ID NO: 32391 - RNA, 20 nt, Artificial Sequence
  Synthetic Oligonucleotide; PRDM1 exon 5; Set A
uugagcaugggguggggcag

SEQ ID NO: 32392 - RNA, 18 nt, Artificial Sequence
  Synthetic Oligonucleotide; PRDM1 exon 5; Set C
cgggagagaagugggguu

SEQ ID NO: 32393 - RNA, 17 nt, Artificial Sequence
  Synthetic Oligonucleotide; PRDM1 exon 5; Set C
cgggagagaaguggggu

SEQ ID NO: 32394 - RNA, 18 nt, Artificial Sequence
  Synthetic Oligonucleotide; PRDM1 exon 5; Set A
ucgggagagaaguggggu

SEQ ID NO: 32395 - RNA, 16 nt, Artificial Sequence
  Synthetic Oligonucleotide; PRDM1 exon 5; Set C
cgggagagaagugggg

SEQ ID NO: 32396 - RNA, 15 nt, Artificial Sequence
  Synthetic Oligonucleotide; PRDM1 exon 5; Set C
cgggagagaaguggg

SEQ ID NO: 32397 - RNA, 26 nt, Artificial Sequence
  Synthetic Oligonucleotide; PRDM1 exon 5; Set C
cgagcucgggagagaagugggguuga

SEQ ID NO: 32398 - RNA, 33 nt, Artificial Sequence
  Synthetic Oligonucleotide; PRDM1 exon 5; Set C
agggcagcgagcucgggagagaagugggguuga

SEQ ID NO: 32399 - RNA, 34 nt, Artificial Sequence
  Synthetic Oligonucleotide; PRDM1 exon 5; Set C
gagggcagcgagcucgggagagaagugggguuga

SEQ ID NO: 32400 - RNA, 35 nt, Artificial Sequence
  Synthetic Oligonucleotide; PRDM1 exon 5; Set C
ugagggcagcgagcucgggagagaagugggguuga

SEQ ID NO: 32401 - RNA, 36 nt, Artificial Sequence
  Synthetic Oligonucleotide; PRDM1 exon 5; Set C
cugagggcagcgagcucgggagagaagugggguuga

SEQ ID NO: 32402 - RNA, 37 nt, Artificial Sequence
  Synthetic Oligonucleotide; PRDM1 exon 5; Set C
ucugagggcagcgagcucgggagagaagugggguuga

SEQ ID NO: 32403 - RNA, 38 nt, Artificial Sequence
  Synthetic Oligonucleotide; PRDM1 exon 5; Set C
aucugagggcagcgagcucgggagagaagugggguuga

SEQ ID NO: 32404 - RNA, 17 nt, Artificial Sequence
  Synthetic Oligonucleotide; PRDM1 exon 5; Set C
gggcagcgagcucggga

SEQ ID NO: 32405 - RNA, 16 nt, Artificial Sequence
  Synthetic Oligonucleotide; PRDM1 exon 5; Set A
gggcagcgagcucggg

SEQ ID NO: 32406 - RNA, 23 nt, Artificial Sequence
  Synthetic Oligonucleotide; PRDM1 exon 5; Set C
caucugagggcagcgagcucggg

SEQ ID NO: 32407 - RNA, 28 nt, Artificial Sequence
  Synthetic Oligonucleotide; PRDM1 exon 5; Set C
gcuggagcaaccuccgggcuccaucuga

SEQ ID NO: 32408 - RNA, 27 nt, Artificial Sequence
  Synthetic Oligonucleotide; PRDM1 exon 5; Set C
gcuggagcaaccuccgggcuccaucug

SEQ ID NO: 32409 - RNA, 26 nt, Artificial Sequence
  Synthetic Oligonucleotide; PRDM1 exon 5; Set C
gcuggagcaaccuccgggcuccaucu

SEQ ID NO: 32410 - RNA, 28 nt, Artificial Sequence
  Synthetic Oligonucleotide; PRDM1 exon 5; Set C
ggcuggagcaaccuccgggcuccaucug

SEQ ID NO: 32411 - RNA, 25 nt, Artificial Sequence
  Synthetic Oligonucleotide; PRDM1 exon 5; Set C
gcuggagcaaccuccgggcuccauc

SEQ ID NO: 32412 - RNA, 27 nt, Artificial Sequence
  Synthetic Oligonucleotide; PRDM1 exon 5; Set C
ggcuggagcaaccuccgggcuccaucu

SEQ ID NO: 32413 - RNA, 26 nt, Artificial Sequence
  Synthetic Oligonucleotide; PRDM1 exon 5; Set C
ggcuggagcaaccuccgggcuccauc

SEQ ID NO: 32414 - RNA, 15 nt, Artificial Sequence
  Synthetic Oligonucleotide; PRDM1 exon 5; Set B
ugggaugcuccggcu

SEQ ID NO: 32415 - RNA, 28 nt, Artificial Sequence
  Synthetic Oligonucleotide; PRDM1 exon 5; Set C
acaagcaccucccugggaugcuccggcu

SEQ ID NO: 32416 - RNA, 29 nt, Artificial Sequence
  Synthetic Oligonucleotide; PRDM1 exon 5; Set C
gacaagcaccucccugggaugcuccggcu

SEQ ID NO: 32417 - RNA, 27 nt, Artificial Sequence
  Synthetic Oligonucleotide; PRDM1 exon 5; Set C
acaagcaccucccugggaugcuccggc

SEQ ID NO: 32418 - RNA, 30 nt, Artificial Sequence
  Synthetic Oligonucleotide; PRDM1 exon 5; Set C
ggacaagcaccucccugggaugcuccggcu

SEQ ID NO: 32419 - RNA, 28 nt, Artificial Sequence
  Synthetic Oligonucleotide; PRDM1 exon 5; Set C
gacaagcaccucccugggaugcuccggc

SEQ ID NO: 32420 - RNA, 29 nt, Artificial Sequence
  Synthetic Oligonucleotide; PRDM1 exon 5; Set C
ggacaagcaccucccugggaugcuccggc

SEQ ID NO: 32421 - RNA, 30 nt, Artificial Sequence
  Synthetic Oligonucleotide; PRDM1 exon 5; Set C
gggacaagcaccucccugggaugcuccggc

SEQ ID NO: 32422 - RNA, 39 nt, Artificial Sequence
  Synthetic Oligonucleotide; PRDM1 exon 5; Set C
ggggcgccgggacaagcaccucccugggaugcuccggcu

SEQ ID NO: 32423 - RNA, 38 nt, Artificial Sequence
  Synthetic Oligonucleotide; PRDM1 exon 5; Set C
ggggcgccgggacaagcaccucccugggaugcuccggc

SEQ ID NO: 32424 - RNA, 35 nt, Artificial Sequence
  Synthetic Oligonucleotide; PRDM1 exon 5; Set C
cgguaaaggagaaggcacuguggggcgccgggaca

SEQ ID NO: 32425 - RNA, 36 nt, Artificial Sequence
  Synthetic Oligonucleotide; PRDM1 exon 5; Set C
ccgguaaaggagaaggcacuguggggcgccgggaca

SEQ ID NO: 32426 - RNA, 39 nt, Artificial Sequence
  Synthetic Oligonucleotide; PRDM1 exon 5; Set C
gcggccccgguaaaggagaaggcacuguggggcgccggg

SEQ ID NO: 32427 - RNA, 40 nt, Artificial Sequence
  Synthetic Oligonucleotide; PRDM1 exon 5; Set C
ggcggccccgguaaaggagaaggcacuguggggcgccggg

SEQ ID NO: 32428 - RNA, 38 nt, Artificial Sequence
  Synthetic Oligonucleotide; PRDM1 exon 5; Set C
uuguggggcuacaggccuuguccuucaugcuggcggcg

SEQ ID NO: 32429 - RNA, 39 nt, Artificial Sequence
  Synthetic Oligonucleotide; PRDM1 exon 5; Set C
cuuguggggcuacaggccuuguccuucaugcuggcggcg

SEQ ID NO: 32430 - RNA, 38 nt, Artificial Sequence
  Synthetic Oligonucleotide; PRDM1 exon 5; Set C
cuuguggggcuacaggccuuguccuucaugcuggcggc

SEQ ID NO: 32431 - RNA, 32 nt, Artificial Sequence
  Synthetic Oligonucleotide; PRDM1 exon 5; Set C
cuuguggggcuacaggccuuguccuucaugcu

SEQ ID NO: 32432 - RNA, 31 nt, Artificial Sequence
  Synthetic Oligonucleotide; PRDM1 exon 5; Set C
cuuguggggcuacaggccuuguccuucaugc

SEQ ID NO: 32433 - RNA, 15 nt, Artificial Sequence
  Synthetic Oligonucleotide; PRDM1 exon 5; Set B
cccgcuuguggggcu

SEQ ID NO: 32434 - RNA, 20 nt, Artificial Sequence
  Synthetic Oligonucleotide; PRDM1 exon 5; Set C
uguucccgccgugggagacc

SEQ ID NO: 32435 - RNA, 21 nt, Artificial Sequence
  Synthetic Oligonucleotide; PRDM1 exon 5; Set C
cuguucccgccgugggagacc

SEQ ID NO: 32436 - RNA, 31 nt, Artificial Sequence
  Synthetic Oligonucleotide; PRDM1 exon 5; Set C
guucugccguggcggcuguucccgccguggg

SEQ ID NO: 32437 - RNA, 30 nt, Artificial Sequence
  Synthetic Oligonucleotide; PRDM1 exon 5; Set C
guucugccguggcggcuguucccgccgugg

SEQ ID NO: 32438 - RNA, 31 nt, Artificial Sequence
  Synthetic Oligonucleotide; PRDM1 exon 5; Set C
uguucugccguggcggcuguucccgccgugg

SEQ ID NO: 32439 - RNA, 33 nt, Artificial Sequence
  Synthetic Oligonucleotide; PRDM1 exon 5; Set C
auguucugccguggcggcuguucccgccguggg

SEQ ID NO: 32440 - RNA, 32 nt, Artificial Sequence
  Synthetic Oligonucleotide; PRDM1 exon 5; Set C
auguucugccguggcggcuguucccgccgugg

SEQ ID NO: 32441 - RNA, 34 nt, Artificial Sequence
  Synthetic Oligonucleotide; PRDM1 exon 5; Set C
cauguucugccguggcggcuguucccgccguggg

SEQ ID NO: 32442 - RNA, 33 nt, Artificial Sequence
  Synthetic Oligonucleotide; PRDM1 exon 5; Set C
cauguucugccguggcggcuguucccgccgugg

SEQ ID NO: 32443 - RNA, 35 nt, Artificial Sequence
  Synthetic Oligonucleotide; PRDM1 exon 5; Set C
acauguucugccguggcggcuguucccgccguggg

SEQ ID NO: 32444 - RNA, 32 nt, Artificial Sequence
  Synthetic Oligonucleotide; PRDM1 exon 5; Set C
cauguucugccguggcggcuguucccgccgug

SEQ ID NO: 32445 - RNA, 34 nt, Artificial Sequence
  Synthetic Oligonucleotide; PRDM1 exon 5; Set C
acauguucugccguggcggcuguucccgccgugg

SEQ ID NO: 32446 - RNA, 39 nt, Artificial Sequence
  Synthetic Oligonucleotide; PRDM1 exon 5; Set C
cuuugggcugcaccacauguucugccguggcggcuguuc

SEQ ID NO: 32447 - RNA, 38 nt, Artificial Sequence
  Synthetic Oligonucleotide; PRDM1 exon 5; Set C
cuuugggcugcaccacauguucugccguggcggcuguu

SEQ ID NO: 32448 - RNA, 40 nt, Artificial Sequence
  Synthetic Oligonucleotide; PRDM1 exon 5; Set C
gcuuugggcugcaccacauguucugccguggcggcuguuc

SEQ ID NO: 32449 - RNA, 37 nt, Artificial Sequence
  Synthetic Oligonucleotide; PRDM1 exon 5; Set C
cuuugggcugcaccacauguucugccguggcggcugu

SEQ ID NO: 32450 - RNA, 39 nt, Artificial Sequence
  Synthetic Oligonucleotide; PRDM1 exon 5; Set C
gcuuugggcugcaccacauguucugccguggcggcuguu

SEQ ID NO: 32451 - RNA, 40 nt, Artificial Sequence
  Synthetic Oligonucleotide; PRDM1 exon 5; Set C
agcuuugggcugcaccacauguucugccguggcggcuguu

SEQ ID NO: 32452 - RNA, 38 nt, Artificial Sequence
  Synthetic Oligonucleotide; PRDM1 exon 5; Set C
gcuuugggcugcaccacauguucugccguggcggcugu

SEQ ID NO: 32453 - RNA, 36 nt, Artificial Sequence
  Synthetic Oligonucleotide; PRDM1 exon 5; Set C
cuuugggcugcaccacauguucugccguggcggcug

SEQ ID NO: 32454 - RNA, 39 nt, Artificial Sequence
  Synthetic Oligonucleotide; PRDM1 exon 5; Set C
agcuuugggcugcaccacauguucugccguggcggcugu

SEQ ID NO: 32455 - RNA, 37 nt, Artificial Sequence
  Synthetic Oligonucleotide; PRDM1 exon 5; Set C
gcuuugggcugcaccacauguucugccguggcggcug

SEQ ID NO: 32456 - RNA, 38 nt, Artificial Sequence
  Synthetic Oligonucleotide; PRDM1 exon 5; Set C
agcuuugggcugcaccacauguucugccguggcggcug

SEQ ID NO: 32457 - RNA, 22 nt, Artificial Sequence
  Synthetic Oligonucleotide; PRDM1 exon 5; Set C
gcuuugggcugcaccacauguu

SEQ ID NO: 32458 - RNA, 21 nt, Artificial Sequence
  Synthetic Oligonucleotide; PRDM1 exon 5; Set C
gcuuugggcugcaccacaugu

SEQ ID NO: 32459 - RNA, 23 nt, Artificial Sequence
  Synthetic Oligonucleotide; PRDM1 exon 5; Set C
agcuuugggcugcaccacauguu

SEQ ID NO: 32460 - RNA, 19 nt, Artificial Sequence
  Synthetic Oligonucleotide; PRDM1 exon 5; Set B
cuuugggcugcaccacaug

SEQ ID NO: 32461 - RNA, 22 nt, Artificial Sequence
  Synthetic Oligonucleotide; PRDM1 exon 5; Set C
agcuuugggcugcaccacaugu

SEQ ID NO: 32462 - RNA, 20 nt, Artificial Sequence
  Synthetic Oligonucleotide; PRDM1 exon 5; Set B
gcuuugggcugcaccacaug

SEQ ID NO: 32463 - RNA, 18 nt, Artificial Sequence
  Synthetic Oligonucleotide; PRDM1 exon 5; Set B
cuuugggcugcaccacau

SEQ ID NO: 32464 - RNA, 21 nt, Artificial Sequence
  Synthetic Oligonucleotide; PRDM1 exon 5; Set B
agcuuugggcugcaccacaug

SEQ ID NO: 32465 - RNA, 21 nt, Artificial Sequence
  Synthetic Oligonucleotide; PRDM1 exon 5; Set B
uagcuuugggcugcaccacau

SEQ ID NO: 32466 - RNA, 20 nt, Artificial Sequence
  Synthetic Oligonucleotide; PRDM1 exon 5; Set B
uagcuuugggcugcaccaca

SEQ ID NO: 32467 - RNA, 31 nt, Artificial Sequence
  Synthetic Oligonucleotide; PRDM1 exon 5; Set C
gcugagguagcuuugggcugcaccacauguu

SEQ ID NO: 32468 - RNA, 30 nt, Artificial Sequence
  Synthetic Oligonucleotide; PRDM1 exon 5; Set C
gcugagguagcuuugggcugcaccacaugu

SEQ ID NO: 32469 - RNA, 16 nt, Artificial Sequence
  Synthetic Oligonucleotide; PRDM1 exon 5; Set C
gcugagguagcuuugg

SEQ ID NO: 32470 - RNA, 15 nt, Artificial Sequence
  Synthetic Oligonucleotide; PRDM1 exon 5; Set C
gcugagguagcuuug

SEQ ID NO: 32471 - RNA, 16 nt, Artificial Sequence
  Synthetic Oligonucleotide; PRDM1 exon 5; Set C
ugcugagguagcuuug

SEQ ID NO: 32472 - RNA, 15 nt, Artificial Sequence
  Synthetic Oligonucleotide; PRDM1 exon 5; Set C
ugcugagguagcuuu

SEQ ID NO: 32473 - RNA, 32 nt, Artificial Sequence
  Synthetic Oligonucleotide; PRDM1 exon 5; Set C
ggggcugccaucgcugcugagguagcuuuggg

SEQ ID NO: 32474 - RNA, 31 nt, Artificial Sequence
  Synthetic Oligonucleotide; PRDM1 exon 5; Set C
ggggcugccaucgcugcugagguagcuuugg

SEQ ID NO: 32475 - RNA, 38 nt, Artificial Sequence
  Synthetic Oligonucleotide; PRDM1 exon 5; Set C
cgcugcugggggcugccaucgcugcugagguagcuuug

SEQ ID NO: 32476 - RNA, 40 nt, Artificial Sequence
  Synthetic Oligonucleotide; PRDM1 exon 5; Set C
ucgcugcugggggcugccaucgcugcugagguagcuuugg

SEQ ID NO: 32477 - RNA, 37 nt, Artificial Sequence
  Synthetic Oligonucleotide; PRDM1 exon 5; Set C
cgcugcugggggcugccaucgcugcugagguagcuuu

SEQ ID NO: 32478 - RNA, 39 nt, Artificial Sequence
  Synthetic Oligonucleotide; PRDM1 exon 5; Set C
ucgcugcugggggcugccaucgcugcugagguagcuuug

SEQ ID NO: 32479 - RNA, 38 nt, Artificial Sequence
  Synthetic Oligonucleotide; PRDM1 exon 5; Set C
ucgcugcugggggcugccaucgcugcugagguagcuuu

SEQ ID NO: 32480 - RNA, 40 nt, Artificial Sequence
  Synthetic Oligonucleotide; PRDM1 exon 5; Set C
cgucgcugcugggggcugccaucgcugcugagguagcuuu

SEQ ID NO: 32481 - RNA, 36 nt, Artificial Sequence
  Synthetic Oligonucleotide; PRDM1 exon 5; Set C
ucgucgcugcugggggcugccaucgcugcugaggua

SEQ ID NO: 32482 - RNA, 15 nt, Artificial Sequence
  Synthetic Oligonucleotide; PRDM1 exon 5; Set B
ucgucgcugcugggg

SEQ ID NO: 32483 - RNA, 16 nt, Artificial Sequence
  Synthetic Oligonucleotide; PRDM1 exon 5; Set B
uucgucgcugcugggg

SEQ ID NO: 32484 - RNA, 24 nt, Artificial Sequence
  Synthetic Oligonucleotide; PRDM1 exon 5; Set C
uucauggcuucgucgcugcugggg

SEQ ID NO: 32485 - RNA, 28 nt, Artificial Sequence
  Synthetic Oligonucleotide; PRDM1 exon 5; Set C
gagauucauggcuucgucgcugcugggg

SEQ ID NO: 32486 - RNA, 29 nt, Artificial Sequence
  Synthetic Oligonucleotide; PRDM1 exon 5; Set C
ugagauucauggcuucgucgcugcugggg

SEQ ID NO: 32487 - RNA, 16 nt, Artificial Sequence
  Synthetic Oligonucleotide; PRDM1 exon 5; Set C
uucauggcuucgucgc

SEQ ID NO: 32488 - RNA, 18 nt, Artificial Sequence
  Synthetic Oligonucleotide; PRDM1 exon 5; Set C
auucauggcuucgucgcu

SEQ ID NO: 32489 - RNA, 15 nt, Artificial Sequence
  Synthetic Oligonucleotide; PRDM1 exon 5; Set C
uucauggcuucgucg

SEQ ID NO: 32490 - RNA, 17 nt, Artificial Sequence
  Synthetic Oligonucleotide; PRDM1 exon 5; Set C
auucauggcuucgucgc

SEQ ID NO: 32491 - RNA, 19 nt, Artificial Sequence
  Synthetic Oligonucleotide; PRDM1 exon 5; Set B
gauucauggcuucgucgcu

SEQ ID NO: 32492 - RNA, 18 nt, Artificial Sequence
  Synthetic Oligonucleotide; PRDM1 exon 5; Set C
gauucauggcuucgucgc

SEQ ID NO: 32493 - RNA, 36 nt, Artificial Sequence
  Synthetic Oligonucleotide; PRDM1 exon 5; Set C
uuuuaaugagauucauggcuucgucgcugcuggggg

SEQ ID NO: 32494 - RNA, 19 nt, Artificial Sequence
  Synthetic Oligonucleotide; PRDM1 exon 5; Set C
agauucauggcuucgucgc

SEQ ID NO: 32495 - RNA, 37 nt, Artificial Sequence
  Synthetic Oligonucleotide; PRDM1 exon 5; Set C
uuuuuaaugagauucauggcuucgucgcugcuggggg

SEQ ID NO: 32496 - RNA, 38 nt, Artificial Sequence
  Synthetic Oligonucleotide; PRDM1 exon 5; Set C
guuuuuaaugagauucauggcuucgucgcugcuggggg

SEQ ID NO: 32497 - RNA, 19 nt, Artificial Sequence
  Synthetic Oligonucleotide; PRDM1 exon 5; Set C
gagauucauggcuucgucg

SEQ ID NO: 32498 - RNA, 23 nt, Artificial Sequence
  Synthetic Oligonucleotide; PRDM1 exon 5; Set B
augagauucauggcuucgucgcu

SEQ ID NO: 32499 - RNA, 39 nt, Artificial Sequence
  Synthetic Oligonucleotide; PRDM1 exon 5; Set C
uguuuuuaaugagauucauggcuucgucgcugcuggggg

SEQ ID NO: 32500 - RNA, 18 nt, Artificial Sequence
  Synthetic Oligonucleotide; PRDM1 exon 5; Set C
gagauucauggcuucguc

SEQ ID NO: 32501 - RNA, 20 nt, Artificial Sequence
  Synthetic Oligonucleotide; PRDM1 exon 5; Set C
ugagauucauggcuucgucg

SEQ ID NO: 32502 - RNA, 16 nt, Artificial Sequence
  Synthetic Oligonucleotide; PRDM1 exon 5; Set C
agauucauggcuucgu

SEQ ID NO: 32503 - RNA, 22 nt, Artificial Sequence
  Synthetic Oligonucleotide; PRDM1 exon 5; Set B
augagauucauggcuucgucgc

SEQ ID NO: 32504 - RNA, 24 nt, Artificial Sequence
  Synthetic Oligonucleotide; PRDM1 exon 5; Set B
aaugagauucauggcuucgucgcu

SEQ ID NO: 32505 - RNA, 40 nt, Artificial Sequence
  Synthetic Oligonucleotide; PRDM1 exon 5; Set C
uuguuuuuaaugagauucauggcuucgucgcugcuggggg

SEQ ID NO: 32506 - RNA, 19 nt, Artificial Sequence
  Synthetic Oligonucleotide; PRDM1 exon 5; Set C
ugagauucauggcuucguc

SEQ ID NO: 32507 - RNA, 17 nt, Artificial Sequence
  Synthetic Oligonucleotide; PRDM1 exon 5; Set C
gagauucauggcuucgu

SEQ ID NO: 32508 - RNA, 25 nt, Artificial Sequence
  Synthetic Oligonucleotide; PRDM1 exon 5; Set B
uaaugagauucauggcuucgucgcu

SEQ ID NO: 32509 - RNA, 16 nt, Artificial Sequence
  Synthetic Oligonucleotide; PRDM1 exon 5; Set C
gagauucauggcuucg

SEQ ID NO: 32510 - RNA, 18 nt, Artificial Sequence
  Synthetic Oligonucleotide; PRDM1 exon 5; Set C
ugagauucauggcuucgu

SEQ ID NO: 32511 - RNA, 26 nt, Artificial Sequence
  Synthetic Oligonucleotide; PRDM1 exon 5; Set B
uuaaugagauucauggcuucgucgcu

SEQ ID NO: 32512 - RNA, 17 nt, Artificial Sequence
  Synthetic Oligonucleotide; PRDM1 exon 5; Set C
ugagauucauggcuucg

SEQ ID NO: 32513 - RNA, 15 nt, Artificial Sequence
  Synthetic Oligonucleotide; PRDM1 exon 5; Set C
gagauucauggcuuc

SEQ ID NO: 32514 - RNA, 27 nt, Artificial Sequence
  Synthetic Oligonucleotide; PRDM1 exon 5; Set B
uuuaaugagauucauggcuucgucgcu

SEQ ID NO: 32515 - RNA, 39 nt, Artificial Sequence
  Synthetic Oligonucleotide; PRDM1 exon 5; Set C
uuuguuuuuaaugagauucauggcuucgucgcugcuggg

SEQ ID NO: 32516 - RNA, 16 nt, Artificial Sequence
  Synthetic Oligonucleotide; PRDM1 exon 5; Set C
ugagauucauggcuuc

SEQ ID NO: 32517 - RNA, 28 nt, Artificial Sequence
  Synthetic Oligonucleotide; PRDM1 exon 5; Set B
uuuuaaugagauucauggcuucgucgcu

SEQ ID NO: 32518 - RNA, 32 nt, Artificial Sequence
  Synthetic Oligonucleotide; PRDM1 exon 5; Set C
guuuuuaaugagauucauggcuucgucgcugc

SEQ ID NO: 32519 - RNA, 29 nt, Artificial Sequence
  Synthetic Oligonucleotide; PRDM1 exon 5; Set B
uuuuuaaugagauucauggcuucgucgcu

SEQ ID NO: 32520 - RNA, 33 nt, Artificial Sequence
  Synthetic Oligonucleotide; PRDM1 exon 5; Set C
uguuuuuaaugagauucauggcuucgucgcugc

SEQ ID NO: 32521 - RNA, 16 nt, Artificial Sequence
  Synthetic Oligonucleotide; PRDM1 exon 5; Set C
augagauucauggcuu

SEQ ID NO: 32522 - RNA, 30 nt, Artificial Sequence
  Synthetic Oligonucleotide; PRDM1 exon 5; Set B
guuuuuaaugagauucauggcuucgucgcu

SEQ ID NO: 32523 - RNA, 34 nt, Artificial Sequence
  Synthetic Oligonucleotide; PRDM1 exon 5; Set C
uuguuuuuaaugagauucauggcuucgucgcugc

SEQ ID NO: 32524 - RNA, 15 nt, Artificial Sequence
  Synthetic Oligonucleotide; PRDM1 exon 5; Set C
augagauucauggcu

SEQ ID NO: 32525 - RNA, 17 nt, Artificial Sequence
  Synthetic Oligonucleotide; PRDM1 exon 5; Set C
aaugagauucauggcuu

SEQ ID NO: 32526 - RNA, 31 nt, Artificial Sequence
  Synthetic Oligonucleotide; PRDM1 exon 5; Set B
uguuuuuaaugagauucauggcuucgucgcu

SEQ ID NO: 32527 - RNA, 35 nt, Artificial Sequence
  Synthetic Oligonucleotide; PRDM1 exon 5; Set C
uuuguuuuuaaugagauucauggcuucgucgcugc

SEQ ID NO: 32528 - RNA, 32 nt, Artificial Sequence
  Synthetic Oligonucleotide; PRDM1 exon 5; Set B
uuguuuuuaaugagauucauggcuucgucgcu

SEQ ID NO: 32529 - RNA, 33 nt, Artificial Sequence
  Synthetic Oligonucleotide; PRDM1 exon 5; Set B
uuuguuuuuaaugagauucauggcuucgucgcu

SEQ ID NO: 32530 - RNA, 34 nt, Artificial Sequence
  Synthetic Oligonucleotide; PRDM1 exon 5; Set B
uuuuguuuuuaaugagauucauggcuucgucgcu

SEQ ID NO: 32531 - RNA, 33 nt, Artificial Sequence
  Synthetic Oligonucleotide; PRDM1 exon 5; Set B
uuuuguuuuuaaugagauucauggcuucgucgc

SEQ ID NO: 32532 - RNA, 35 nt, Artificial Sequence
  Synthetic Oligonucleotide; PRDM1 exon 5; Set B
cuuuuguuuuuaaugagauucauggcuucgucgcu

SEQ ID NO: 32533 - RNA, 34 nt, Artificial Sequence
  Synthetic Oligonucleotide; PRDM1 exon 5; Set B
cuuuuguuuuuaaugagauucauggcuucgucgc

SEQ ID NO: 32534 - RNA, 36 nt, Artificial Sequence
  Synthetic Oligonucleotide; PRDM1 exon 5; Set B
ucuuuuguuuuuaaugagauucauggcuucgucgcu

SEQ ID NO: 32535 - RNA, 40 nt, Artificial Sequence
  Synthetic Oligonucleotide; PRDM1 exon 5; Set C
uuucuuuuguuuuuaaugagauucauggcuucgucgcugc

SEQ ID NO: 32536 - RNA, 35 nt, Artificial Sequence
  Synthetic Oligonucleotide; PRDM1 exon 5; Set B
ucuuuuguuuuuaaugagauucauggcuucgucgc

SEQ ID NO: 32537 - RNA, 37 nt, Artificial Sequence
  Synthetic Oligonucleotide; PRDM1 exon 5; Set C
uucuuuuguuuuuaaugagauucauggcuucgucgcu

SEQ ID NO: 32538 - RNA, 39 nt, Artificial Sequence
  Synthetic Oligonucleotide; PRDM1 exon 5; Set C
uuucuuuuguuuuuaaugagauucauggcuucgucgcug

SEQ ID NO: 32539 - RNA, 38 nt, Artificial Sequence
  Synthetic Oligonucleotide; PRDM1 exon 5; Set C
uuucuuuuguuuuuaaugagauucauggcuucgucgcu

SEQ ID NO: 32540 - RNA, 15 nt, Artificial Sequence
  Synthetic Oligonucleotide; PRDM1 exon 5; Set C
uuuaaugagauucau

SEQ ID NO: 32541 - RNA, 38 nt, Artificial Sequence
  Synthetic Oligonucleotide; PRDM1 exon 5; Set C
guuucuuuuguuuuuaaugagauucauggcuucgucgc

SEQ ID NO: 32542 - RNA, 16 nt, Artificial Sequence
  Synthetic Oligonucleotide; PRDM1 exon 5; Set C
uuuuaaugagauucau

SEQ ID NO: 32543 - RNA, 20 nt, Artificial Sequence
  Synthetic Oligonucleotide; PRDM1 exon 5; Set C
guuuuuaaugagauucaugg

SEQ ID NO: 32544 - RNA, 39 nt, Artificial Sequence
  Synthetic Oligonucleotide; PRDM1 exon 5; Set C
uguuucuuuuguuuuuaaugagauucauggcuucgucgc

SEQ ID NO: 32545 - RNA, 27 nt, Artificial Sequence
  Synthetic Oligonucleotide; PRDM1 exon 5; Set C
uuuuguuuuuaaugagauucauggcuu

SEQ ID NO: 32546 - RNA, 15 nt, Artificial Sequence
  Synthetic Oligonucleotide; PRDM1 exon 5; Set C
uuuuaaugagauuca

SEQ ID NO: 32547 - RNA, 17 nt, Artificial Sequence
  Synthetic Oligonucleotide; PRDM1 exon 5; Set C
uuuuuaaugagauucau

SEQ ID NO: 32548 - RNA, 21 nt, Artificial Sequence
  Synthetic Oligonucleotide; PRDM1 exon 5; Set C
uguuuuuaaugagauucaugg

SEQ ID NO: 32549 - RNA, 23 nt, Artificial Sequence
  Synthetic Oligonucleotide; PRDM1 exon 5; Set C
uuguuuuuaaugagauucauggc

SEQ ID NO: 32550 - RNA, 40 nt, Artificial Sequence
  Synthetic Oligonucleotide; PRDM1 exon 5; Set C
auguuucuuuuguuuuuaaugagauucauggcuucgucgc

SEQ ID NO: 32551 - RNA, 28 nt, Artificial Sequence
  Synthetic Oligonucleotide; PRDM1 exon 5; Set C
cuuuuguuuuuaaugagauucauggcuu

SEQ ID NO: 32552 - RNA, 16 nt, Artificial Sequence
  Synthetic Oligonucleotide; PRDM1 exon 5; Set C
uuuuuaaugagauuca

SEQ ID NO: 32553 - RNA, 18 nt, Artificial Sequence
  Synthetic Oligonucleotide; PRDM1 exon 5; Set C
guuuuuaaugagauucau

SEQ ID NO: 32554 - RNA, 22 nt, Artificial Sequence
  Synthetic Oligonucleotide; PRDM1 exon 5; Set C
uuguuuuuaaugagauucaugg

SEQ ID NO: 32555 - RNA, 24 nt, Artificial Sequence
  Synthetic Oligonucleotide; PRDM1 exon 5; Set C
uuuguuuuuaaugagauucauggc

SEQ ID NO: 32556 - RNA, 39 nt, Artificial Sequence
  Synthetic Oligonucleotide; PRDM1 exon 5; Set B
auguuucuuuuguuuuuaaugagauucauggcuucgucg

SEQ ID NO: 32557 - RNA, 27 nt, Artificial Sequence
  Synthetic Oligonucleotide; PRDM1 exon 5; Set C
cuuuuguuuuuaaugagauucauggcu

SEQ ID NO: 32558 - RNA, 29 nt, Artificial Sequence
  Synthetic Oligonucleotide; PRDM1 exon 5; Set C
ucuuuuguuuuuaaugagauucauggcuu

SEQ ID NO: 32559 - RNA, 17 nt, Artificial Sequence
  Synthetic Oligonucleotide; PRDM1 exon 5; Set C
guuuuuaaugagauuca

SEQ ID NO: 32560 - RNA, 19 nt, Artificial Sequence
  Synthetic Oligonucleotide; PRDM1 exon 5; Set C
uguuuuuaaugagauucau

SEQ ID NO: 32561 - RNA, 23 nt, Artificial Sequence
  Synthetic Oligonucleotide; PRDM1 exon 5; Set C
uuuguuuuuaaugagauucaugg

SEQ ID NO: 32562 - RNA, 40 nt, Artificial Sequence
  Synthetic Oligonucleotide; PRDM1 exon 5; Set B
cauguuucuuuuguuuuuaaugagauucauggcuucgucg

SEQ ID NO: 32563 - RNA, 28 nt, Artificial Sequence
  Synthetic Oligonucleotide; PRDM1 exon 5; Set C
ucuuuuguuuuuaaugagauucauggcu

SEQ ID NO: 32564 - RNA, 18 nt, Artificial Sequence
  Synthetic Oligonucleotide; PRDM1 exon 5; Set C
uguuuuuaaugagauuca

SEQ ID NO: 32565 - RNA, 20 nt, Artificial Sequence
  Synthetic Oligonucleotide; PRDM1 exon 5; Set C
uuguuuuuaaugagauucau

SEQ ID NO: 32566 - RNA, 37 nt, Artificial Sequence
  Synthetic Oligonucleotide; PRDM1 exon 5; Set B
auguuucuuuuguuuuuaaugagauucauggcuucgu

SEQ ID NO: 32567 - RNA, 19 nt, Artificial Sequence
  Synthetic Oligonucleotide; PRDM1 exon 5; Set C
uuguuuuuaaugagauuca

SEQ ID NO: 32568 - RNA, 21 nt, Artificial Sequence
  Synthetic Oligonucleotide; PRDM1 exon 5; Set C
uuuguuuuuaaugagauucau

SEQ ID NO: 32569 - RNA, 38 nt, Artificial Sequence
  Synthetic Oligonucleotide; PRDM1 exon 5; Set B
cauguuucuuuuguuuuuaaugagauucauggcuucgu

SEQ ID NO: 32570 - RNA, 34 nt, Artificial Sequence
  Synthetic Oligonucleotide; PRDM1 exon 5; Set B
uguuucuuuuguuuuuaaugagauucauggcuuc

SEQ ID NO: 32571 - RNA, 32 nt, Artificial Sequence
  Synthetic Oligonucleotide; PRDM1 exon 5; Set B
guuucuuuuguuuuuaaugagauucauggcuu

SEQ ID NO: 32572 - RNA, 20 nt, Artificial Sequence
  Synthetic Oligonucleotide; PRDM1 exon 5; Set C
uuuguuuuuaaugagauuca

SEQ ID NO: 32573 - RNA, 35 nt, Artificial Sequence
  Synthetic Oligonucleotide; PRDM1 exon 5; Set B
auguuucuuuuguuuuuaaugagauucauggcuuc

SEQ ID NO: 32574 - RNA, 31 nt, Artificial Sequence
  Synthetic Oligonucleotide; PRDM1 exon 5; Set B
guuucuuuuguuuuuaaugagauucauggcu

SEQ ID NO: 32575 - RNA, 33 nt, Artificial Sequence
  Synthetic Oligonucleotide; PRDM1 exon 5; Set B
uguuucuuuuguuuuuaaugagauucauggcuu

SEQ ID NO: 32576 - RNA, 21 nt, Artificial Sequence
  Synthetic Oligonucleotide; PRDM1 exon 5; Set C
uuuuguuuuuaaugagauuca

SEQ ID NO: 32577 - RNA, 29 nt, Artificial Sequence
  Synthetic Oligonucleotide; PRDM1 exon 5; Set C
uuucuuuuguuuuuaaugagauucauggc

SEQ ID NO: 32578 - RNA, 36 nt, Artificial Sequence
  Synthetic Oligonucleotide; PRDM1 exon 5; Set B
cauguuucuuuuguuuuuaaugagauucauggcuuc

SEQ ID NO: 32579 - RNA, 32 nt, Artificial Sequence
  Synthetic Oligonucleotide; PRDM1 exon 5; Set B
uguuucuuuuguuuuuaaugagauucauggcu

SEQ ID NO: 32580 - RNA, 34 nt, Artificial Sequence
  Synthetic Oligonucleotide; PRDM1 exon 5; Set B
auguuucuuuuguuuuuaaugagauucauggcuu

SEQ ID NO: 32581 - RNA, 28 nt, Artificial Sequence
  Synthetic Oligonucleotide; PRDM1 exon 5; Set C
uuucuuuuguuuuuaaugagauucaugg

SEQ ID NO: 32582 - RNA, 33 nt, Artificial Sequence
  Synthetic Oligonucleotide; PRDM1 exon 5; Set B
auguuucuuuuguuuuuaaugagauucauggcu

SEQ ID NO: 32583 - RNA, 35 nt, Artificial Sequence
  Synthetic Oligonucleotide; PRDM1 exon 5; Set B
cauguuucuuuuguuuuuaaugagauucauggcuu

SEQ ID NO: 32584 - RNA, 25 nt, Artificial Sequence
  Synthetic Oligonucleotide; PRDM1 exon 5; Set C
uucuuuuguuuuuaaugagauucau

SEQ ID NO: 32585 - RNA, 34 nt, Artificial Sequence
  Synthetic Oligonucleotide; PRDM1 exon 5; Set B
cauguuucuuuuguuuuuaaugagauucauggcu

SEQ ID NO: 32586 - RNA, 24 nt, Artificial Sequence
  Synthetic Oligonucleotide; PRDM1 exon 5; Set C
uucuuuuguuuuuaaugagauuca

SEQ ID NO: 32587 - RNA, 26 nt, Artificial Sequence
  Synthetic Oligonucleotide; PRDM1 exon 5; Set C
uuucuuuuguuuuuaaugagauucau

SEQ ID NO: 32588 - RNA, 37 nt, Artificial Sequence
  Synthetic Oligonucleotide; PRDM1 exon 5; Set B
gucauguuucuuuuguuuuuaaugagauucauggcuu

SEQ ID NO: 32589 - RNA, 25 nt, Artificial Sequence
  Synthetic Oligonucleotide; PRDM1 exon 5; Set C
uuucuuuuguuuuuaaugagauuca

SEQ ID NO: 32590 - RNA, 31 nt, Artificial Sequence
  Synthetic Oligonucleotide; PRDM1 exon 5; Set C
ucauguuucuuuuguuuuuaaugagauucau

SEQ ID NO: 32591 - RNA, 30 nt, Artificial Sequence
  Synthetic Oligonucleotide; PRDM1 exon 5; Set C
ucauguuucuuuuguuuuuaaugagauuca

SEQ ID NO: 32592 - RNA, 32 nt, Artificial Sequence
  Synthetic Oligonucleotide; PRDM1 exon 5; Set C
gucauguuucuuuuguuuuuaaugagauucau

SEQ ID NO: 32593 - RNA, 31 nt, Artificial Sequence
  Synthetic Oligonucleotide; PRDM1 exon 5; Set C
gucauguuucuuuuguuuuuaaugagauuca

SEQ ID NO: 32594 - RNA, 33 nt, Artificial Sequence
  Synthetic Oligonucleotide; PRDM1 exon 5; Set B
ggucauguuucuuuuguuuuuaaugagauucau

SEQ ID NO: 32595 - RNA, 32 nt, Artificial Sequence
  Synthetic Oligonucleotide; PRDM1 exon 5; Set B
ggucauguuucuuuuguuuuuaaugagauuca

SEQ ID NO: 32596 - RNA, 32 nt, Artificial Sequence
  Synthetic Oligonucleotide; PRDM1 exon 5; Set B
cggucauguuucuuuuguuuuuaaugagauuc

SEQ ID NO: 32597 - RNA, 31 nt, Artificial Sequence
  Synthetic Oligonucleotide; PRDM1 exon 5; Set C
cggucauguuucuuuuguuuuuaaugagauu

SEQ ID NO: 32598 - RNA, 30 nt, Artificial Sequence
  Synthetic Oligonucleotide; PRDM1 exon 5; Set C
cggucauguuucuuuuguuuuuaaugagau

SEQ ID NO: 32599 - RNA, 29 nt, Artificial Sequence
  Synthetic Oligonucleotide; PRDM1 exon 5; Set C
cggucauguuucuuuuguuuuuaaugaga

SEQ ID NO: 32600 - RNA, 40 nt, Artificial Sequence
  Synthetic Oligonucleotide; PRDM1 exon 5; Set B
uguagccggucauguuucuuuuguuuuuaaugagauucau

SEQ ID NO: 32601 - RNA, 39 nt, Artificial Sequence
  Synthetic Oligonucleotide; PRDM1 exon 5; Set C
uguagccggucauguuucuuuuguuuuuaaugagauuca

SEQ ID NO: 32602 - RNA, 26 nt, Artificial Sequence
  Synthetic Oligonucleotide; PRDM1 exon 5; Set C
cggucauguuucuuuuguuuuuaaug

SEQ ID NO: 32603 - RNA, 40 nt, Artificial Sequence
  Synthetic Oligonucleotide; PRDM1 exon 5; Set C
uuguagccggucauguuucuuuuguuuuuaaugagauuca

SEQ ID NO: 32604 - RNA, 25 nt, Artificial Sequence
  Synthetic Oligonucleotide; PRDM1 exon 5; Set C
cggucauguuucuuuuguuuuuaau

SEQ ID NO: 32605 - RNA, 33 nt, Artificial Sequence
  Synthetic Oligonucleotide; PRDM1 exon 5; Set B
guagccggucauguuucuuuuguuuuuaaugag

SEQ ID NO: 32606 - RNA, 32 nt, Artificial Sequence
  Synthetic Oligonucleotide; PRDM1 exon 5; Set B
guagccggucauguuucuuuuguuuuuaauga

SEQ ID NO: 32607 - RNA, 36 nt, Artificial Sequence
  Synthetic Oligonucleotide; PRDM1 exon 5; Set B
cuuguagccggucauguuucuuuuguuuuuaaugag

SEQ ID NO: 32608 - RNA, 35 nt, Artificial Sequence
  Synthetic Oligonucleotide; PRDM1 exon 5; Set B
cuuguagccggucauguuucuuuuguuuuuaauga

SEQ ID NO: 32609 - RNA, 37 nt, Artificial Sequence
  Synthetic Oligonucleotide; PRDM1 exon 5; Set B
ucuuguagccggucauguuucuuuuguuuuuaaugag

SEQ ID NO: 32610 - RNA, 36 nt, Artificial Sequence
  Synthetic Oligonucleotide; PRDM1 exon 5; Set B
ucuuguagccggucauguuucuuuuguuuuuaauga

SEQ ID NO: 32611 - RNA, 38 nt, Artificial Sequence
  Synthetic Oligonucleotide; PRDM1 exon 5; Set B
gucuuguagccggucauguuucuuuuguuuuuaaugag

SEQ ID NO: 32612 - RNA, 37 nt, Artificial Sequence
  Synthetic Oligonucleotide; PRDM1 exon 5; Set C
gucuuguagccggucauguuucuuuuguuuuuaauga

SEQ ID NO: 32613 - RNA, 15 nt, Artificial Sequence
  Synthetic Oligonucleotide; PRDM1 exon 5; Set C
cggucauguuucuuu

SEQ ID NO: 32614 - RNA, 15 nt, Artificial Sequence
  Synthetic Oligonucleotide; PRDM1 exon 5; Set C
guagccggucauguu

SEQ ID NO: 32615 - RNA, 18 nt, Artificial Sequence
  Synthetic Oligonucleotide; PRDM1 exon 5; Set C
cuuguagccggucauguu

SEQ ID NO: 32616 - RNA, 19 nt, Artificial Sequence
  Synthetic Oligonucleotide; PRDM1 exon 5; Set C
ucuuguagccggucauguu

SEQ ID NO: 32617 - RNA, 17 nt, Artificial Sequence
  Synthetic Oligonucleotide; PRDM1 exon 5; Set C
cuuguagccggucaugu

SEQ ID NO: 32618 - RNA, 20 nt, Artificial Sequence
  Synthetic Oligonucleotide; PRDM1 exon 5; Set B
gucuuguagccggucauguu

SEQ ID NO: 32619 - RNA, 18 nt, Artificial Sequence
  Synthetic Oligonucleotide; PRDM1 exon 5; Set C
ucuuguagccggucaugu

SEQ ID NO: 32620 - RNA, 16 nt, Artificial Sequence
  Synthetic Oligonucleotide; PRDM1 exon 5; Set C
cuuguagccggucaug

SEQ ID NO: 32621 - RNA, 29 nt, Artificial Sequence
  Synthetic Oligonucleotide; PRDM1 exon 5; Set C
gaagggucuuguagccggucauguuucuu

SEQ ID NO: 32622 - RNA, 19 nt, Artificial Sequence
  Synthetic Oligonucleotide; PRDM1 exon 5; Set B
gucuuguagccggucaugu

SEQ ID NO: 32623 - RNA, 15 nt, Artificial Sequence
  Synthetic Oligonucleotide; PRDM1 exon 5; Set C
cuuguagccggucau

SEQ ID NO: 32624 - RNA, 17 nt, Artificial Sequence
  Synthetic Oligonucleotide; PRDM1 exon 5; Set C
ucuuguagccggucaug

SEQ ID NO: 32625 - RNA, 32 nt, Artificial Sequence
  Synthetic Oligonucleotide; PRDM1 exon 5; Set C
gggaagggucuuguagccggucauguuucuuu

SEQ ID NO: 32626 - RNA, 30 nt, Artificial Sequence
  Synthetic Oligonucleotide; PRDM1 exon 5; Set C
ggaagggucuuguagccggucauguuucuu

SEQ ID NO: 32627 - RNA, 28 nt, Artificial Sequence
  Synthetic Oligonucleotide; PRDM1 exon 5; Set C
gaagggucuuguagccggucauguuucu

SEQ ID NO: 32628 - RNA, 16 nt, Artificial Sequence
  Synthetic Oligonucleotide; PRDM1 exon 5; Set C
ucuuguagccggucau

SEQ ID NO: 32629 - RNA, 18 nt, Artificial Sequence
  Synthetic Oligonucleotide; PRDM1 exon 5; Set C
gucuuguagccggucaug

SEQ ID NO: 32630 - RNA, 33 nt, Artificial Sequence
  Synthetic Oligonucleotide; PRDM1 exon 5; Set C
agggaagggucuuguagccggucauguuucuuu

SEQ ID NO: 32631 - RNA, 29 nt, Artificial Sequence
  Synthetic Oligonucleotide; PRDM1 exon 5; Set C
ggaagggucuuguagccggucauguuucu

SEQ ID NO: 32632 - RNA, 31 nt, Artificial Sequence
  Synthetic Oligonucleotide; PRDM1 exon 5; Set C
gggaagggucuuguagccggucauguuucuu

SEQ ID NO: 32633 - RNA, 17 nt, Artificial Sequence
  Synthetic Oligonucleotide; PRDM1 exon 5; Set C
gucuuguagccggucau

SEQ ID NO: 32634 - RNA, 34 nt, Artificial Sequence
  Synthetic Oligonucleotide; PRDM1 exon 5; Set C
uagggaagggucuuguagccggucauguuucuuu

SEQ ID NO: 32635 - RNA, 32 nt, Artificial Sequence
  Synthetic Oligonucleotide; PRDM1 exon 5; Set C
agggaagggucuuguagccggucauguuucuu

SEQ ID NO: 32636 - RNA, 30 nt, Artificial Sequence
  Synthetic Oligonucleotide; PRDM1 exon 5; Set C
gggaagggucuuguagccggucauguuucu

SEQ ID NO: 32637 - RNA, 24 nt, Artificial Sequence
  Synthetic Oligonucleotide; PRDM1 exon 5; Set B
aagggucuuguagccggucauguu

SEQ ID NO: 32638 - RNA, 35 nt, Artificial Sequence
  Synthetic Oligonucleotide; PRDM1 exon 5; Set C
guagggaagggucuuguagccggucauguuucuuu

SEQ ID NO: 32639 - RNA, 33 nt, Artificial Sequence
  Synthetic Oligonucleotide; PRDM1 exon 5; Set C
uagggaagggucuuguagccggucauguuucuu

SEQ ID NO: 32640 - RNA, 31 nt, Artificial Sequence
  Synthetic Oligonucleotide; PRDM1 exon 5; Set C
agggaagggucuuguagccggucauguuucu

SEQ ID NO: 32641 - RNA, 25 nt, Artificial Sequence
  Synthetic Oligonucleotide; PRDM1 exon 5; Set B
gaagggucuuguagccggucauguu

SEQ ID NO: 32642 - RNA, 23 nt, Artificial Sequence
  Synthetic Oligonucleotide; PRDM1 exon 5; Set B
aagggucuuguagccggucaugu

SEQ ID NO: 32643 - RNA, 34 nt, Artificial Sequence
  Synthetic Oligonucleotide; PRDM1 exon 5; Set C
guagggaagggucuuguagccggucauguuucuu

SEQ ID NO: 32644 - RNA, 32 nt, Artificial Sequence
  Synthetic Oligonucleotide; PRDM1 exon 5; Set C
uagggaagggucuuguagccggucauguuucu

SEQ ID NO: 32645 - RNA, 26 nt, Artificial Sequence
  Synthetic Oligonucleotide; PRDM1 exon 5; Set C
ggaagggucuuguagccggucauguu

SEQ ID NO: 32646 - RNA, 24 nt, Artificial Sequence
  Synthetic Oligonucleotide; PRDM1 exon 5; Set B
gaagggucuuguagccggucaugu

SEQ ID NO: 32647 - RNA, 22 nt, Artificial Sequence
  Synthetic Oligonucleotide; PRDM1 exon 5; Set B
aagggucuuguagccggucaug

SEQ ID NO: 32648 - RNA, 37 nt, Artificial Sequence
  Synthetic Oligonucleotide; PRDM1 exon 5; Set C
ggguagggaagggucuuguagccggucauguuucuuu

SEQ ID NO: 32649 - RNA, 33 nt, Artificial Sequence
  Synthetic Oligonucleotide; PRDM1 exon 5; Set C
guagggaagggucuuguagccggucauguuucu

SEQ ID NO: 32650 - RNA, 27 nt, Artificial Sequence
  Synthetic Oligonucleotide; PRDM1 exon 5; Set C
gggaagggucuuguagccggucauguu

SEQ ID NO: 32651 - RNA, 25 nt, Artificial Sequence
  Synthetic Oligonucleotide; PRDM1 exon 5; Set C
ggaagggucuuguagccggucaugu

SEQ ID NO: 32652 - RNA, 21 nt, Artificial Sequence
  Synthetic Oligonucleotide; PRDM1 exon 5; Set B
aagggucuuguagccggucau

SEQ ID NO: 32653 - RNA, 23 nt, Artificial Sequence
  Synthetic Oligonucleotide; PRDM1 exon 5; Set B
gaagggucuuguagccggucaug

SEQ ID NO: 32654 - RNA, 36 nt, Artificial Sequence
  Synthetic Oligonucleotide; PRDM1 exon 5; Set C
ggguagggaagggucuuguagccggucauguuucuu

SEQ ID NO: 32655 - RNA, 28 nt, Artificial Sequence
  Synthetic Oligonucleotide; PRDM1 exon 5; Set C
agggaagggucuuguagccggucauguu

SEQ ID NO: 32656 - RNA, 26 nt, Artificial Sequence
  Synthetic Oligonucleotide; PRDM1 exon 5; Set C
gggaagggucuuguagccggucaugu

SEQ ID NO: 32657 - RNA, 22 nt, Artificial Sequence
  Synthetic Oligonucleotide; PRDM1 exon 5; Set B
gaagggucuuguagccggucau

SEQ ID NO: 32658 - RNA, 24 nt, Artificial Sequence
  Synthetic Oligonucleotide; PRDM1 exon 5; Set B
ggaagggucuuguagccggucaug

SEQ ID NO: 32659 - RNA, 35 nt, Artificial Sequence
  Synthetic Oligonucleotide; PRDM1 exon 5; Set C
ggguagggaagggucuuguagccggucauguuucu

SEQ ID NO: 32660 - RNA, 29 nt, Artificial Sequence
  Synthetic Oligonucleotide; PRDM1 exon 5; Set C
uagggaagggucuuguagccggucauguu

SEQ ID NO: 32661 - RNA, 27 nt, Artificial Sequence
  Synthetic Oligonucleotide; PRDM1 exon 5; Set C
agggaagggucuuguagccggucaugu

SEQ ID NO: 32662 - RNA, 23 nt, Artificial Sequence
  Synthetic Oligonucleotide; PRDM1 exon 5; Set B
ggaagggucuuguagccggucau

SEQ ID NO: 32663 - RNA, 25 nt, Artificial Sequence
  Synthetic Oligonucleotide; PRDM1 exon 5; Set C
gggaagggucuuguagccggucaug

SEQ ID NO: 32664 - RNA, 15 nt, Artificial Sequence
  Synthetic Oligonucleotide; PRDM1 exon 5; Set C
gggucuuguagccgg

SEQ ID NO: 32665 - RNA, 20 nt, Artificial Sequence
  Synthetic Oligonucleotide; PRDM1 exon 5; Set B
gaagggucuuguagccgguc

SEQ ID NO: 32666 - RNA, 30 nt, Artificial Sequence
  Synthetic Oligonucleotide; PRDM1 exon 5; Set C
guagggaagggucuuguagccggucauguu

SEQ ID NO: 32667 - RNA, 28 nt, Artificial Sequence
  Synthetic Oligonucleotide; PRDM1 exon 5; Set C
uagggaagggucuuguagccggucaugu

SEQ ID NO: 32668 - RNA, 24 nt, Artificial Sequence
  Synthetic Oligonucleotide; PRDM1 exon 5; Set C
gggaagggucuuguagccggucau

SEQ ID NO: 32669 - RNA, 26 nt, Artificial Sequence
  Synthetic Oligonucleotide; PRDM1 exon 5; Set C
agggaagggucuuguagccggucaug

SEQ ID NO: 32670 - RNA, 16 nt, Artificial Sequence
  Synthetic Oligonucleotide; PRDM1 exon 5; Set C
agggucuuguagccgg

SEQ ID NO: 32671 - RNA, 21 nt, Artificial Sequence
  Synthetic Oligonucleotide; PRDM1 exon 5; Set B
ggaagggucuuguagccgguc

SEQ ID NO: 32672 - RNA, 31 nt, Artificial Sequence
  Synthetic Oligonucleotide; PRDM1 exon 5; Set C
gguagggaagggucuuguagccggucauguu

SEQ ID NO: 32673 - RNA, 29 nt, Artificial Sequence
  Synthetic Oligonucleotide; PRDM1 exon 5; Set C
guagggaagggucuuguagccggucaugu

SEQ ID NO: 32674 - RNA, 25 nt, Artificial Sequence
  Synthetic Oligonucleotide; PRDM1 exon 5; Set C
agggaagggucuuguagccggucau

SEQ ID NO: 32675 - RNA, 27 nt, Artificial Sequence
  Synthetic Oligonucleotide; PRDM1 exon 5; Set C
uagggaagggucuuguagccggucaug

SEQ ID NO: 32676 - RNA, 22 nt, Artificial Sequence
  Synthetic Oligonucleotide; PRDM1 exon 5; Set B
gggaagggucuuguagccgguc

SEQ ID NO: 32677 - RNA, 32 nt, Artificial Sequence
  Synthetic Oligonucleotide; PRDM1 exon 5; Set C
ggguagggaagggucuuguagccggucauguu

SEQ ID NO: 32678 - RNA, 30 nt, Artificial Sequence
  Synthetic Oligonucleotide; PRDM1 exon 5; Set C
gguagggaagggucuuguagccggucaugu

SEQ ID NO: 32679 - RNA, 26 nt, Artificial Sequence
  Synthetic Oligonucleotide; PRDM1 exon 5; Set C
uagggaagggucuuguagccggucau

SEQ ID NO: 32680 - RNA, 28 nt, Artificial Sequence
  Synthetic Oligonucleotide; PRDM1 exon 5; Set C
guagggaagggucuuguagccggucaug

SEQ ID NO: 32681 - RNA, 23 nt, Artificial Sequence
  Synthetic Oligonucleotide; PRDM1 exon 5; Set B
agggaagggucuuguagccgguc

SEQ ID NO: 32682 - RNA, 31 nt, Artificial Sequence
  Synthetic Oligonucleotide; PRDM1 exon 5; Set C
ggguagggaagggucuuguagccggucaugu

SEQ ID NO: 32683 - RNA, 27 nt, Artificial Sequence
  Synthetic Oligonucleotide; PRDM1 exon 5; Set C
guagggaagggucuuguagccggucau

SEQ ID NO: 32684 - RNA, 29 nt, Artificial Sequence
  Synthetic Oligonucleotide; PRDM1 exon 5; Set C
gguagggaagggucuuguagccggucaug

SEQ ID NO: 32685 - RNA, 24 nt, Artificial Sequence
  Synthetic Oligonucleotide; PRDM1 exon 5; Set B
uagggaagggucuuguagccgguc

SEQ ID NO: 32686 - RNA, 28 nt, Artificial Sequence
  Synthetic Oligonucleotide; PRDM1 exon 5; Set C
gguagggaagggucuuguagccggucau

SEQ ID NO: 32687 - RNA, 30 nt, Artificial Sequence
  Synthetic Oligonucleotide; PRDM1 exon 5; Set C
ggguagggaagggucuuguagccggucaug

SEQ ID NO: 32688 - RNA, 25 nt, Artificial Sequence
  Synthetic Oligonucleotide; PRDM1 exon 5; Set C
guagggaagggucuuguagccgguc

SEQ ID NO: 32689 - RNA, 29 nt, Artificial Sequence
  Synthetic Oligonucleotide; PRDM1 exon 5; Set C
ggguagggaagggucuuguagccggucau

SEQ ID NO: 32690 - RNA, 27 nt, Artificial Sequence
  Synthetic Oligonucleotide; PRDM1 exon 5; Set C
ggguagggaagggucuuguagccgguc

SEQ ID NO: 32691 - RNA, 38 nt, Artificial Sequence
  Synthetic Oligonucleotide; PRDM1 exon 5; Set C
uucagcggguagggaagggucuuguagccggucauguu

SEQ ID NO: 32692 - RNA, 37 nt, Artificial Sequence
  Synthetic Oligonucleotide; PRDM1 exon 5; Set C
uucagcggguagggaagggucuuguagccggucaugu

SEQ ID NO: 32693 - RNA, 15 nt, Artificial Sequence
  Synthetic Oligonucleotide; PRDM1 exon 5; Set C
gggaagggucuugua

SEQ ID NO: 32694 - RNA, 36 nt, Artificial Sequence
  Synthetic Oligonucleotide; PRDM1 exon 5; Set C
uucagcggguagggaagggucuuguagccggucaug

SEQ ID NO: 32695 - RNA, 16 nt, Artificial Sequence
  Synthetic Oligonucleotide; PRDM1 exon 5; Set C
agggaagggucuugua

SEQ ID NO: 32696 - RNA, 35 nt, Artificial Sequence
  Synthetic Oligonucleotide; PRDM1 exon 5; Set C
uucagcggguagggaagggucuuguagccggucau

SEQ ID NO: 32697 - RNA, 17 nt, Artificial Sequence
  Synthetic Oligonucleotide; PRDM1 exon 5; Set C
uagggaagggucuugua

SEQ ID NO: 32698 - RNA, 18 nt, Artificial Sequence
  Synthetic Oligonucleotide; PRDM1 exon 5; Set C
guagggaagggucuugua

SEQ ID NO: 32699 - RNA, 19 nt, Artificial Sequence
  Synthetic Oligonucleotide; PRDM1 exon 5; Set C
gguagggaagggucuugua

SEQ ID NO: 32700 - RNA, 40 nt, Artificial Sequence
  Synthetic Oligonucleotide; PRDM1 exon 5; Set C
cuucuucagcggguagggaagggucuuguagccggucaug

SEQ ID NO: 32701 - RNA, 20 nt, Artificial Sequence
  Synthetic Oligonucleotide; PRDM1 exon 5; Set B
ggguagggaagggucuugua

SEQ ID NO: 32702 - RNA, 39 nt, Artificial Sequence
  Synthetic Oligonucleotide; PRDM1 exon 5; Set C
cuucuucagcggguagggaagggucuuguagccggucau

SEQ ID NO: 32703 - RNA, 15 nt, Artificial Sequence
  Synthetic Oligonucleotide; PRDM1 exon 5; Set C
guagggaagggucuu

SEQ ID NO: 32704 - RNA, 40 nt, Artificial Sequence
  Synthetic Oligonucleotide; PRDM1 exon 5; Set C
gcuucuucagcggguagggaagggucuuguagccggucau

SEQ ID NO: 32705 - RNA, 16 nt, Artificial Sequence
  Synthetic Oligonucleotide; PRDM1 exon 5; Set C
gguagggaagggucuu

SEQ ID NO: 32706 - RNA, 17 nt, Artificial Sequence
  Synthetic Oligonucleotide; PRDM1 exon 5; Set C
ggguagggaagggucuu

SEQ ID NO: 32707 - RNA, 15 nt, Artificial Sequence
  Synthetic Oligonucleotide; PRDM1 exon 5; Set C
gguagggaagggucu

SEQ ID NO: 32708 - RNA, 33 nt, Artificial Sequence
  Synthetic Oligonucleotide; PRDM1 exon 5; Set C
ucuucagcggguagggaagggucuuguagccgg

SEQ ID NO: 32709 - RNA, 16 nt, Artificial Sequence
  Synthetic Oligonucleotide; PRDM1 exon 5; Set C
ggguagggaagggucu

SEQ ID NO: 32710 - RNA, 34 nt, Artificial Sequence
  Synthetic Oligonucleotide; PRDM1 exon 5; Set C
uucuucagcggguagggaagggucuuguagccgg

SEQ ID NO: 32711 - RNA, 15 nt, Artificial Sequence
  Synthetic Oligonucleotide; PRDM1 exon 5; Set C
ggguagggaaggguc

SEQ ID NO: 32712 - RNA, 26 nt, Artificial Sequence
  Synthetic Oligonucleotide; PRDM1 exon 5; Set C
uucagcggguagggaagggucuugua

SEQ ID NO: 32713 - RNA, 23 nt, Artificial Sequence
  Synthetic Oligonucleotide; PRDM1 exon 5; Set B
uucagcggguagggaagggucuu

SEQ ID NO: 32714 - RNA, 30 nt, Artificial Sequence
  Synthetic Oligonucleotide; PRDM1 exon 5; Set C
cuucuucagcggguagggaagggucuugua

SEQ ID NO: 32715 - RNA, 22 nt, Artificial Sequence
  Synthetic Oligonucleotide; PRDM1 exon 5; Set B
uucagcggguagggaagggucu

SEQ ID NO: 32716 - RNA, 31 nt, Artificial Sequence
  Synthetic Oligonucleotide; PRDM1 exon 5; Set C
gcuucuucagcggguagggaagggucuugua

SEQ ID NO: 32717 - RNA, 21 nt, Artificial Sequence
  Synthetic Oligonucleotide; PRDM1 exon 5; Set B
uucagcggguagggaaggguc

SEQ ID NO: 32718 - RNA, 32 nt, Artificial Sequence
  Synthetic Oligonucleotide; PRDM1 exon 5; Set C
ugcuucuucagcggguagggaagggucuugua

SEQ ID NO: 32719 - RNA, 33 nt, Artificial Sequence
  Synthetic Oligonucleotide; PRDM1 exon 5; Set C
cugcuucuucagcggguagggaagggucuugua

SEQ ID NO: 32720 - RNA, 27 nt, Artificial Sequence
  Synthetic Oligonucleotide; PRDM1 exon 5; Set C
cuucuucagcggguagggaagggucuu

SEQ ID NO: 32721 - RNA, 28 nt, Artificial Sequence
  Synthetic Oligonucleotide; PRDM1 exon 5; Set C
gcuucuucagcggguagggaagggucuu

SEQ ID NO: 32722 - RNA, 26 nt, Artificial Sequence
  Synthetic Oligonucleotide; PRDM1 exon 5; Set C
cuucuucagcggguagggaagggucu

SEQ ID NO: 32723 - RNA, 29 nt, Artificial Sequence
  Synthetic Oligonucleotide; PRDM1 exon 5; Set C
ugcuucuucagcggguagggaagggucuu

SEQ ID NO: 32724 - RNA, 27 nt, Artificial Sequence
  Synthetic Oligonucleotide; PRDM1 exon 5; Set C
gcuucuucagcggguagggaagggucu

SEQ ID NO: 32725 - RNA, 25 nt, Artificial Sequence
  Synthetic Oligonucleotide; PRDM1 exon 5; Set C
cuucuucagcggguagggaaggguc

SEQ ID NO: 32726 - RNA, 30 nt, Artificial Sequence
  Synthetic Oligonucleotide; PRDM1 exon 5; Set C
cugcuucuucagcggguagggaagggucuu

SEQ ID NO: 32727 - RNA, 28 nt, Artificial Sequence
  Synthetic Oligonucleotide; PRDM1 exon 5; Set C
ugcuucuucagcggguagggaagggucu

SEQ ID NO: 32728 - RNA, 26 nt, Artificial Sequence
  Synthetic Oligonucleotide; PRDM1 exon 5; Set C
gcuucuucagcggguagggaaggguc

SEQ ID NO: 32729 - RNA, 18 nt, Artificial Sequence
  Synthetic Oligonucleotide; PRDM1 exon 5; Set C
cuucagcggguagggaag

SEQ ID NO: 32730 - RNA, 31 nt, Artificial Sequence
  Synthetic Oligonucleotide; PRDM1 exon 5; Set C
ucugcuucuucagcggguagggaagggucuu

SEQ ID NO: 32731 - RNA, 29 nt, Artificial Sequence
  Synthetic Oligonucleotide; PRDM1 exon 5; Set C
cugcuucuucagcggguagggaagggucu

SEQ ID NO: 32732 - RNA, 27 nt, Artificial Sequence
  Synthetic Oligonucleotide; PRDM1 exon 5; Set C
ugcuucuucagcggguagggaaggguc

SEQ ID NO: 32733 - RNA, 17 nt, Artificial Sequence
  Synthetic Oligonucleotide; PRDM1 exon 5; Set C
cuucagcggguagggaa

SEQ ID NO: 32734 - RNA, 32 nt, Artificial Sequence
  Synthetic Oligonucleotide; PRDM1 exon 5; Set C
uucugcuucuucagcggguagggaagggucuu

SEQ ID NO: 32735 - RNA, 30 nt, Artificial Sequence
  Synthetic Oligonucleotide; PRDM1 exon 5; Set C
ucugcuucuucagcggguagggaagggucu

SEQ ID NO: 32736 - RNA, 28 nt, Artificial Sequence
  Synthetic Oligonucleotide; PRDM1 exon 5; Set C
cugcuucuucagcggguagggaaggguc

SEQ ID NO: 32737 - RNA, 16 nt, Artificial Sequence
  Synthetic Oligonucleotide; PRDM1 exon 5; Set C
cuucagcggguaggga

SEQ ID NO: 32738 - RNA, 31 nt, Artificial Sequence
  Synthetic Oligonucleotide; PRDM1 exon 5; Set C
uucugcuucuucagcggguagggaagggucu

SEQ ID NO: 32739 - RNA, 29 nt, Artificial Sequence
  Synthetic Oligonucleotide; PRDM1 exon 5; Set C
ucugcuucuucagcggguagggaaggguc

SEQ ID NO: 32740 - RNA, 21 nt, Artificial Sequence
  Synthetic Oligonucleotide; PRDM1 exon 5; Set B
cuucuucagcggguagggaag

SEQ ID NO: 32741 - RNA, 15 nt, Artificial Sequence
  Synthetic Oligonucleotide; PRDM1 exon 5; Set C
cuucagcggguaggg

SEQ ID NO: 32742 - RNA, 32 nt, Artificial Sequence
  Synthetic Oligonucleotide; PRDM1 exon 5; Set C
guucugcuucuucagcggguagggaagggucu

SEQ ID NO: 32743 - RNA, 30 nt, Artificial Sequence
  Synthetic Oligonucleotide; PRDM1 exon 5; Set C
uucugcuucuucagcggguagggaaggguc

SEQ ID NO: 32744 - RNA, 22 nt, Artificial Sequence
  Synthetic Oligonucleotide; PRDM1 exon 5; Set B
gcuucuucagcggguagggaag

SEQ ID NO: 32745 - RNA, 18 nt, Artificial Sequence
  Synthetic Oligonucleotide; PRDM1 exon 5; Set B
uucuucagcggguaggga

SEQ ID NO: 32746 - RNA, 20 nt, Artificial Sequence
  Synthetic Oligonucleotide; PRDM1 exon 5; Set B
cuucuucagcggguagggaa

SEQ ID NO: 32747 - RNA, 16 nt, Artificial Sequence
  Synthetic Oligonucleotide; PRDM1 exon 5; Set C
ucuucagcggguaggg

SEQ ID NO: 32748 - RNA, 31 nt, Artificial Sequence
  Synthetic Oligonucleotide; PRDM1 exon 5; Set C
guucugcuucuucagcggguagggaaggguc

SEQ ID NO: 32749 - RNA, 23 nt, Artificial Sequence
  Synthetic Oligonucleotide; PRDM1 exon 5; Set B
ugcuucuucagcggguagggaag

SEQ ID NO: 32750 - RNA, 19 nt, Artificial Sequence
  Synthetic Oligonucleotide; PRDM1 exon 5; Set B
cuucuucagcggguaggga

SEQ ID NO: 32751 - RNA, 15 nt, Artificial Sequence
  Synthetic Oligonucleotide; PRDM1 exon 5; Set C
ucuucagcggguagg

SEQ ID NO: 32752 - RNA, 17 nt, Artificial Sequence
  Synthetic Oligonucleotide; PRDM1 exon 5; Set C
uucuucagcggguaggg

SEQ ID NO: 32753 - RNA, 24 nt, Artificial Sequence
  Synthetic Oligonucleotide; PRDM1 exon 5; Set B
cugcuucuucagcggguagggaag

SEQ ID NO: 32754 - RNA, 22 nt, Artificial Sequence
  Synthetic Oligonucleotide; PRDM1 exon 5; Set B
ugcuucuucagcggguagggaa

SEQ ID NO: 32755 - RNA, 16 nt, Artificial Sequence
  Synthetic Oligonucleotide; PRDM1 exon 5; Set C
uucuucagcggguagg

SEQ ID NO: 32756 - RNA, 25 nt, Artificial Sequence
  Synthetic Oligonucleotide; PRDM1 exon 5; Set B
ucugcuucuucagcggguagggaag

SEQ ID NO: 32757 - RNA, 23 nt, Artificial Sequence
  Synthetic Oligonucleotide; PRDM1 exon 5; Set B
cugcuucuucagcggguagggaa

SEQ ID NO: 32758 - RNA, 15 nt, Artificial Sequence
  Synthetic Oligonucleotide; PRDM1 exon 5; Set C
uucuucagcggguag

SEQ ID NO: 32759 - RNA, 26 nt, Artificial Sequence
  Synthetic Oligonucleotide; PRDM1 exon 5; Set B
uucugcuucuucagcggguagggaag

SEQ ID NO: 32760 - RNA, 24 nt, Artificial Sequence
  Synthetic Oligonucleotide; PRDM1 exon 5; Set B
ucugcuucuucagcggguagggaa

SEQ ID NO: 32761 - RNA, 27 nt, Artificial Sequence
  Synthetic Oligonucleotide; PRDM1 exon 5; Set C
guucugcuucuucagcggguagggaag

SEQ ID NO: 32762 - RNA, 23 nt, Artificial Sequence
  Synthetic Oligonucleotide; PRDM1 exon 5; Set C
ucugcuucuucagcggguaggga

SEQ ID NO: 32763 - RNA, 25 nt, Artificial Sequence
  Synthetic Oligonucleotide; PRDM1 exon 5; Set B
uucugcuucuucagcggguagggaa

SEQ ID NO: 32764 - RNA, 24 nt, Artificial Sequence
  Synthetic Oligonucleotide; PRDM1 exon 5; Set C
uucugcuucuucagcggguaggga

SEQ ID NO: 32765 - RNA, 26 nt, Artificial Sequence
  Synthetic Oligonucleotide; PRDM1 exon 5; Set C
guucugcuucuucagcggguagggaa

SEQ ID NO: 32766 - RNA, 22 nt, Artificial Sequence
  Synthetic Oligonucleotide; PRDM1 exon 5; Set B
ucugcuucuucagcggguaggg

SEQ ID NO: 32767 - RNA, 25 nt, Artificial Sequence
  Synthetic Oligonucleotide; PRDM1 exon 5; Set C
guucugcuucuucagcggguaggga

SEQ ID NO: 32768 - RNA, 21 nt, Artificial Sequence
  Synthetic Oligonucleotide; PRDM1 exon 5; Set B
ucugcuucuucagcggguagg

SEQ ID NO: 32769 - RNA, 23 nt, Artificial Sequence
  Synthetic Oligonucleotide; PRDM1 exon 5; Set B
uucugcuucuucagcggguaggg

SEQ ID NO: 32770 - RNA, 16 nt, Artificial Sequence
  Synthetic Oligonucleotide; PRDM1 exon 5; Set C
ugcuucuucagcgggu

SEQ ID NO: 32771 - RNA, 20 nt, Artificial Sequence
  Synthetic Oligonucleotide; PRDM1 exon 5; Set B
ucugcuucuucagcggguag

SEQ ID NO: 32772 - RNA, 22 nt, Artificial Sequence
  Synthetic Oligonucleotide; PRDM1 exon 5; Set B
uucugcuucuucagcggguagg

SEQ ID NO: 32773 - RNA, 24 nt, Artificial Sequence
  Synthetic Oligonucleotide; PRDM1 exon 5; Set C
guucugcuucuucagcggguaggg

SEQ ID NO: 32774 - RNA, 17 nt, Artificial Sequence
  Synthetic Oligonucleotide; PRDM1 exon 5; Set C
cugcuucuucagcgggu

SEQ ID NO: 32775 - RNA, 19 nt, Artificial Sequence
  Synthetic Oligonucleotide; PRDM1 exon 5; Set B
ucugcuucuucagcgggua

SEQ ID NO: 32776 - RNA, 21 nt, Artificial Sequence
  Synthetic Oligonucleotide; PRDM1 exon 5; Set B
uucugcuucuucagcggguag

SEQ ID NO: 32777 - RNA, 23 nt, Artificial Sequence
  Synthetic Oligonucleotide; PRDM1 exon 5; Set B
guucugcuucuucagcggguagg

SEQ ID NO: 32778 - RNA, 18 nt, Artificial Sequence
  Synthetic Oligonucleotide; PRDM1 exon 5; Set B
ucugcuucuucagcgggu

SEQ ID NO: 32779 - RNA, 40 nt, Artificial Sequence
  Synthetic Oligonucleotide; PRDM1 exon 5; Set C
gaucuugccguucugcuucuucagcggguagggaaggguc

SEQ ID NO: 32780 - RNA, 20 nt, Artificial Sequence
  Synthetic Oligonucleotide; PRDM1 exon 5; Set B
uucugcuucuucagcgggua

SEQ ID NO: 32781 - RNA, 22 nt, Artificial Sequence
  Synthetic Oligonucleotide; PRDM1 exon 5; Set B
guucugcuucuucagcggguag

SEQ ID NO: 32782 - RNA, 19 nt, Artificial Sequence
  Synthetic Oligonucleotide; PRDM1 exon 5; Set B
uucugcuucuucagcgggu

SEQ ID NO: 32783 - RNA, 17 nt, Artificial Sequence
  Synthetic Oligonucleotide; PRDM1 exon 5; Set C
ucugcuucuucagcggg

SEQ ID NO: 32784 - RNA, 21 nt, Artificial Sequence
  Synthetic Oligonucleotide; PRDM1 exon 5; Set B
guucugcuucuucagcgggua

SEQ ID NO: 32785 - RNA, 20 nt, Artificial Sequence
  Synthetic Oligonucleotide; PRDM1 exon 5; Set B
guucugcuucuucagcgggu

SEQ ID NO: 32786 - RNA, 18 nt, Artificial Sequence
  Synthetic Oligonucleotide; PRDM1 exon 5; Set C
uucugcuucuucagcggg

SEQ ID NO: 32787 - RNA, 19 nt, Artificial Sequence
  Synthetic Oligonucleotide; PRDM1 exon 5; Set B
guucugcuucuucagcggg

SEQ ID NO: 32788 - RNA, 36 nt, Artificial Sequence
  Synthetic Oligonucleotide; PRDM1 exon 5; Set C
gaucuugccguucugcuucuucagcggguagggaag

SEQ ID NO: 32789 - RNA, 35 nt, Artificial Sequence
  Synthetic Oligonucleotide; PRDM1 exon 5; Set C
gaucuugccguucugcuucuucagcggguagggaa

SEQ ID NO: 32790 - RNA, 34 nt, Artificial Sequence
  Synthetic Oligonucleotide; PRDM1 exon 5; Set C
gaucuugccguucugcuucuucagcggguaggga

SEQ ID NO: 32791 - RNA, 33 nt, Artificial Sequence
  Synthetic Oligonucleotide; PRDM1 exon 5; Set C
gaucuugccguucugcuucuucagcggguaggg

SEQ ID NO: 32792 - RNA, 32 nt, Artificial Sequence
  Synthetic Oligonucleotide; PRDM1 exon 5; Set C
gaucuugccguucugcuucuucagcggguagg

SEQ ID NO: 32793 - RNA, 31 nt, Artificial Sequence
  Synthetic Oligonucleotide; PRDM1 exon 5; Set C
gaucuugccguucugcuucuucagcggguag

SEQ ID NO: 32794 - RNA, 30 nt, Artificial Sequence
  Synthetic Oligonucleotide; PRDM1 exon 5; Set C
gaucuugccguucugcuucuucagcgggua

SEQ ID NO: 32795 - RNA, 29 nt, Artificial Sequence
  Synthetic Oligonucleotide; PRDM1 exon 5; Set C
gaucuugccguucugcuucuucagcgggu

SEQ ID NO: 32796 - RNA, 22 nt, Artificial Sequence
  Synthetic Oligonucleotide; PRDM1 exon 5; Set B
gaucuugccguucugcuucuuc

SEQ ID NO: 32797 - RNA, 18 nt, Artificial Sequence
  Synthetic Oligonucleotide; PRDM1 exon 5; Set C
gaucuugccguucugcuu

SEQ ID NO: 32798 - RNA, 17 nt, Artificial Sequence
  Synthetic Oligonucleotide; PRDM1 exon 5; Set C
gaucuugccguucugcu

SEQ ID NO: 32799 - RNA, 16 nt, Artificial Sequence
  Synthetic Oligonucleotide; PRDM1 exon 5; Set C
gaucuugccguucugc

SEQ ID NO: 32800 - RNA, 15 nt, Artificial Sequence
  Synthetic Oligonucleotide; PRDM1 exon 5; Set C
ccuaccuucagauug

SEQ ID NO: 32801 - RNA, 27 nt, Artificial Sequence
  Synthetic Oligonucleotide; CD40LG exon 3; Set A
uuuucuuucuucgucuccucuuuguuu

SEQ ID NO: 32802 - RNA, 28 nt, Artificial Sequence
  Synthetic Oligonucleotide; CD40LG exon 3; Set A
guuuucuuucuucgucuccucuuuguuu

SEQ ID NO: 32803 - RNA, 29 nt, Artificial Sequence
  Synthetic Oligonucleotide; CD40LG exon 3; Set A
uguuuucuuucuucgucuccucuuuguuu

SEQ ID NO: 32804 - RNA, 37 nt, Artificial Sequence
  Synthetic Oligonucleotide; CD40LG exon 3; Set A
uucaaagcuguuuucuuucuucgucuccucuuuguuu

SEQ ID NO: 32805 - RNA, 38 nt, Artificial Sequence
  Synthetic Oligonucleotide; CD40LG exon 3; Set A
uuucaaagcuguuuucuuucuucgucuccucuuuguuu

SEQ ID NO: 32806 - RNA, 16 nt, Artificial Sequence
  Synthetic Oligonucleotide; CD40LG exon 3; Set C
uuuucuuucuucgucu

SEQ ID NO: 32807 - RNA, 39 nt, Artificial Sequence
  Synthetic Oligonucleotide; CD40LG exon 3; Set A
auuucaaagcuguuuucuuucuucgucuccucuuuguuu

SEQ ID NO: 32808 - RNA, 17 nt, Artificial Sequence
  Synthetic Oligonucleotide; CD40LG exon 3; Set C
guuuucuuucuucgucu

SEQ ID NO: 32809 - RNA, 15 nt, Artificial Sequence
  Synthetic Oligonucleotide; CD40LG exon 3; Set C
uuuucuuucuucguc

SEQ ID NO: 32810 - RNA, 18 nt, Artificial Sequence
  Synthetic Oligonucleotide; CD40LG exon 3; Set C
uguuuucuuucuucgucu

SEQ ID NO: 32811 - RNA, 16 nt, Artificial Sequence
  Synthetic Oligonucleotide; CD40LG exon 3; Set C
guuuucuuucuucguc

SEQ ID NO: 32812 - RNA, 17 nt, Artificial Sequence
  Synthetic Oligonucleotide; CD40LG exon 3; Set C
uguuuucuuucuucguc

SEQ ID NO: 32813 - RNA, 15 nt, Artificial Sequence
  Synthetic Oligonucleotide; CD40LG exon 3; Set C
guuuucuuucuucgu

SEQ ID NO: 32814 - RNA, 16 nt, Artificial Sequence
  Synthetic Oligonucleotide; CD40LG exon 3; Set C
uguuuucuuucuucgu

SEQ ID NO: 32815 - RNA, 15 nt, Artificial Sequence
  Synthetic Oligonucleotide; CD40LG exon 3; Set C
uguuuucuuucuucg

SEQ ID NO: 32816 - RNA, 20 nt, Artificial Sequence
  Synthetic Oligonucleotide; CD40LG exon 3; Set C
aaagcuguuuucuuucuucg

SEQ ID NO: 32817 - RNA, 19 nt, Artificial Sequence
  Synthetic Oligonucleotide; CD40LG exon 3; Set C
aaagcuguuuucuuucuuc

SEQ ID NO: 32818 - RNA, 21 nt, Artificial Sequence
  Synthetic Oligonucleotide; CD40LG exon 3; Set C
caaagcuguuuucuuucuucg

SEQ ID NO: 32819 - RNA, 18 nt, Artificial Sequence
  Synthetic Oligonucleotide; CD40LG exon 3; Set C
aaagcuguuuucuuucuu

SEQ ID NO: 32820 - RNA, 20 nt, Artificial Sequence
  Synthetic Oligonucleotide; CD40LG exon 3; Set C
caaagcuguuuucuuucuuc

SEQ ID NO: 32821 - RNA, 22 nt, Artificial Sequence
  Synthetic Oligonucleotide; CD40LG exon 3; Set C
ucaaagcuguuuucuuucuucg

SEQ ID NO: 32822 - RNA, 17 nt, Artificial Sequence
  Synthetic Oligonucleotide; CD40LG exon 3; Set C
aaagcuguuuucuuucu

SEQ ID NO: 32823 - RNA, 19 nt, Artificial Sequence
  Synthetic Oligonucleotide; CD40LG exon 3; Set C
caaagcuguuuucuuucuu

SEQ ID NO: 32824 - RNA, 21 nt, Artificial Sequence
  Synthetic Oligonucleotide; CD40LG exon 3; Set C
ucaaagcuguuuucuuucuuc

SEQ ID NO: 32825 - RNA, 23 nt, Artificial Sequence
  Synthetic Oligonucleotide; CD40LG exon 3; Set C
uucaaagcuguuuucuuucuucg

SEQ ID NO: 32826 - RNA, 18 nt, Artificial Sequence
  Synthetic Oligonucleotide; CD40LG exon 3; Set C
caaagcuguuuucuuucu

SEQ ID NO: 32827 - RNA, 20 nt, Artificial Sequence
  Synthetic Oligonucleotide; CD40LG exon 3; Set C
ucaaagcuguuuucuuucuu

SEQ ID NO: 32828 - RNA, 16 nt, Artificial Sequence
  Synthetic Oligonucleotide; CD40LG exon 3; Set C
aaagcuguuuucuuuc

SEQ ID NO: 32829 - RNA, 22 nt, Artificial Sequence
  Synthetic Oligonucleotide; CD40LG exon 3; Set C
uucaaagcuguuuucuuucuuc

SEQ ID NO: 32830 - RNA, 24 nt, Artificial Sequence
  Synthetic Oligonucleotide; CD40LG exon 3; Set C
uuucaaagcuguuuucuuucuucg

SEQ ID NO: 32831 - RNA, 19 nt, Artificial Sequence
  Synthetic Oligonucleotide; CD40LG exon 3; Set C
ucaaagcuguuuucuuucu

SEQ ID NO: 32832 - RNA, 21 nt, Artificial Sequence
  Synthetic Oligonucleotide; CD40LG exon 3; Set C
uucaaagcuguuuucuuucuu

SEQ ID NO: 32833 - RNA, 17 nt, Artificial Sequence
  Synthetic Oligonucleotide; CD40LG exon 3; Set C
caaagcuguuuucuuuc

SEQ ID NO: 32834 - RNA, 23 nt, Artificial Sequence
  Synthetic Oligonucleotide; CD40LG exon 3; Set C
uuucaaagcuguuuucuuucuuc

SEQ ID NO: 32835 - RNA, 25 nt, Artificial Sequence
  Synthetic Oligonucleotide; CD40LG exon 3; Set C
auuucaaagcuguuuucuuucuucg

SEQ ID NO: 32836 - RNA, 20 nt, Artificial Sequence
  Synthetic Oligonucleotide; CD40LG exon 3; Set C
uucaaagcuguuuucuuucu

SEQ ID NO: 32837 - RNA, 22 nt, Artificial Sequence
  Synthetic Oligonucleotide; CD40LG exon 3; Set C
uuucaaagcuguuuucuuucuu

SEQ ID NO: 32838 - RNA, 18 nt, Artificial Sequence
  Synthetic Oligonucleotide; CD40LG exon 3; Set C
ucaaagcuguuuucuuuc

SEQ ID NO: 32839 - RNA, 24 nt, Artificial Sequence
  Synthetic Oligonucleotide; CD40LG exon 3; Set C
auuucaaagcuguuuucuuucuuc

SEQ ID NO: 32840 - RNA, 21 nt, Artificial Sequence
  Synthetic Oligonucleotide; CD40LG exon 3; Set C
uuucaaagcuguuuucuuucu

SEQ ID NO: 32841 - RNA, 23 nt, Artificial Sequence
  Synthetic Oligonucleotide; CD40LG exon 3; Set C
auuucaaagcuguuuucuuucuu

SEQ ID NO: 32842 - RNA, 19 nt, Artificial Sequence
  Synthetic Oligonucleotide; CD40LG exon 3; Set C
uucaaagcuguuuucuuuc

SEQ ID NO: 32843 - RNA, 22 nt, Artificial Sequence
  Synthetic Oligonucleotide; CD40LG exon 3; Set C
auuucaaagcuguuuucuuucu

SEQ ID NO: 32844 - RNA, 20 nt, Artificial Sequence
  Synthetic Oligonucleotide; CD40LG exon 3; Set C
uuucaaagcuguuuucuuuc

SEQ ID NO: 32845 - RNA, 21 nt, Artificial Sequence
  Synthetic Oligonucleotide; CD40LG exon 3; Set C
auuucaaagcuguuuucuuuc

SEQ ID NO: 32846 - RNA, 30 nt, Artificial Sequence
  Synthetic Oligonucleotide; CD40LG exon 3; Set A
uuugcauuucaaagcuguuuucuuucuucg

SEQ ID NO: 32847 - RNA, 29 nt, Artificial Sequence
  Synthetic Oligonucleotide; CD40LG exon 3; Set C
uuugcauuucaaagcuguuuucuuucuuc

SEQ ID NO: 32848 - RNA, 31 nt, Artificial Sequence
  Synthetic Oligonucleotide; CD40LG exon 3; Set A
uuuugcauuucaaagcuguuuucuuucuucg

SEQ ID NO: 32849 - RNA, 28 nt, Artificial Sequence
  Synthetic Oligonucleotide; CD40LG exon 3; Set C
uuugcauuucaaagcuguuuucuuucuu

SEQ ID NO: 32850 - RNA, 30 nt, Artificial Sequence
  Synthetic Oligonucleotide; CD40LG exon 3; Set C
uuuugcauuucaaagcuguuuucuuucuuc

SEQ ID NO: 32851 - RNA, 32 nt, Artificial Sequence
  Synthetic Oligonucleotide; CD40LG exon 3; Set A
uuuuugcauuucaaagcuguuuucuuucuucg

SEQ ID NO: 32852 - RNA, 15 nt, Artificial Sequence
  Synthetic Oligonucleotide; CD40LG exon 3; Set C
uuucaaagcuguuuu

SEQ ID NO: 32853 - RNA, 27 nt, Artificial Sequence
  Synthetic Oligonucleotide; CD40LG exon 3; Set C
uuugcauuucaaagcuguuuucuuucu

SEQ ID NO: 32854 - RNA, 29 nt, Artificial Sequence
  Synthetic Oligonucleotide; CD40LG exon 3; Set C
uuuugcauuucaaagcuguuuucuuucuu

SEQ ID NO: 32855 - RNA, 31 nt, Artificial Sequence
  Synthetic Oligonucleotide; CD40LG exon 3; Set C
uuuuugcauuucaaagcuguuuucuuucuuc

SEQ ID NO: 32856 - RNA, 28 nt, Artificial Sequence
  Synthetic Oligonucleotide; CD40LG exon 3; Set C
uuuugcauuucaaagcuguuuucuuucu

SEQ ID NO: 32857 - RNA, 16 nt, Artificial Sequence
  Synthetic Oligonucleotide; CD40LG exon 3; Set C
auuucaaagcuguuuu

SEQ ID NO: 32858 - RNA, 30 nt, Artificial Sequence
  Synthetic Oligonucleotide; CD40LG exon 3; Set C
uuuuugcauuucaaagcuguuuucuuucuu

SEQ ID NO: 32859 - RNA, 26 nt, Artificial Sequence
  Synthetic Oligonucleotide; CD40LG exon 3; Set C
uuugcauuucaaagcuguuuucuuuc

SEQ ID NO: 32860 - RNA, 15 nt, Artificial Sequence
  Synthetic Oligonucleotide; CD40LG exon 3; Set C
auuucaaagcuguuu

SEQ ID NO: 32861 - RNA, 29 nt, Artificial Sequence
  Synthetic Oligonucleotide; CD40LG exon 3; Set C
uuuuugcauuucaaagcuguuuucuuucu

SEQ ID NO: 32862 - RNA, 27 nt, Artificial Sequence
  Synthetic Oligonucleotide; CD40LG exon 3; Set C
uuuugcauuucaaagcuguuuucuuuc

SEQ ID NO: 32863 - RNA, 28 nt, Artificial Sequence
  Synthetic Oligonucleotide; CD40LG exon 3; Set C
uuuuugcauuucaaagcuguuuucuuuc

SEQ ID NO: 32864 - RNA, 20 nt, Artificial Sequence
  Synthetic Oligonucleotide; CD40LG exon 3; Set C
uuugcauuucaaagcuguuu

SEQ ID NO: 32865 - RNA, 22 nt, Artificial Sequence
  Synthetic Oligonucleotide; CD40LG exon 3; Set C
uuuugcauuucaaagcuguuuu

SEQ ID NO: 32866 - RNA, 21 nt, Artificial Sequence
  Synthetic Oligonucleotide; CD40LG exon 3; Set C
uuuugcauuucaaagcuguuu

SEQ ID NO: 32867 - RNA, 19 nt, Artificial Sequence
  Synthetic Oligonucleotide; CD40LG exon 3; Set C
uuugcauuucaaagcuguu

SEQ ID NO: 32868 - RNA, 23 nt, Artificial Sequence
  Synthetic Oligonucleotide; CD40LG exon 3; Set C
uuuuugcauuucaaagcuguuuu

SEQ ID NO: 32869 - RNA, 22 nt, Artificial Sequence
  Synthetic Oligonucleotide; CD40LG exon 3; Set C
uuuuugcauuucaaagcuguuu

SEQ ID NO: 32870 - RNA, 20 nt, Artificial Sequence
  Synthetic Oligonucleotide; CD40LG exon 3; Set C
uuuugcauuucaaagcuguu

SEQ ID NO: 32871 - RNA, 18 nt, Artificial Sequence
  Synthetic Oligonucleotide; CD40LG exon 3; Set C
uuugcauuucaaagcugu

SEQ ID NO: 32872 - RNA, 19 nt, Artificial Sequence
  Synthetic Oligonucleotide; CD40LG exon 3; Set C
uuuugcauuucaaagcugu

SEQ ID NO: 32873 - RNA, 21 nt, Artificial Sequence
  Synthetic Oligonucleotide; CD40LG exon 3; Set C
uuuuugcauuucaaagcuguu

SEQ ID NO: 32874 - RNA, 20 nt, Artificial Sequence
  Synthetic Oligonucleotide; CD40LG exon 3; Set C
uuuuugcauuucaaagcugu

SEQ ID NO: 32875 - RNA, 15 nt, Artificial Sequence
  Synthetic Oligonucleotide; CD40LG exon 3; Set C
uuuuugcauuucaaa

SEQ ID NO: 32876 - RNA, 24 nt, Artificial Sequence
  Synthetic Oligonucleotide; CD40LG exon 3; Set C
uaguuuuuaggcauucauagaaau

SEQ ID NO: 32877 - RNA, 25 nt, Artificial Sequence
  Synthetic Oligonucleotide; CD40LG exon 3; Set C
uuaguuuuuaggcauucauagaaau

SEQ ID NO: 32878 - RNA, 23 nt, Artificial Sequence
  Synthetic Oligonucleotide; CD40LG exon 3; Set C
uaguuuuuaggcauucauagaaa

SEQ ID NO: 32879 - RNA, 26 nt, Artificial Sequence
  Synthetic Oligonucleotide; CD40LG exon 3; Set C
uuuaguuuuuaggcauucauagaaau

SEQ ID NO: 32880 - RNA, 24 nt, Artificial Sequence
  Synthetic Oligonucleotide; CD40LG exon 3; Set C
uuaguuuuuaggcauucauagaaa

SEQ ID NO: 32881 - RNA, 25 nt, Artificial Sequence
  Synthetic Oligonucleotide; CD40LG exon 3; Set C
uuuaguuuuuaggcauucauagaaa

SEQ ID NO: 32882 - RNA, 27 nt, Artificial Sequence
  Synthetic Oligonucleotide; CD40LG exon 3; Set C
uuuuaguuuuuaggcauucauagaaau

SEQ ID NO: 32883 - RNA, 26 nt, Artificial Sequence
  Synthetic Oligonucleotide; CD40LG exon 3; Set C
uuuuaguuuuuaggcauucauagaaa

SEQ ID NO: 32884 - RNA, 28 nt, Artificial Sequence
  Synthetic Oligonucleotide; CD40LG exon 3; Set C
cuuuuaguuuuuaggcauucauagaaau

SEQ ID NO: 32885 - RNA, 27 nt, Artificial Sequence
  Synthetic Oligonucleotide; CD40LG exon 3; Set C
cuuuuaguuuuuaggcauucauagaaa

SEQ ID NO: 32886 - RNA, 29 nt, Artificial Sequence
  Synthetic Oligonucleotide; CD40LG exon 3; Set C
ccuuuuaguuuuuaggcauucauagaaau

SEQ ID NO: 32887 - RNA, 28 nt, Artificial Sequence
  Synthetic Oligonucleotide; CD40LG exon 3; Set C
ccuuuuaguuuuuaggcauucauagaaa

SEQ ID NO: 32888 - RNA, 30 nt, Artificial Sequence
  Synthetic Oligonucleotide; CD40LG exon 3; Set C
uccuuuuaguuuuuaggcauucauagaaau

SEQ ID NO: 32889 - RNA, 31 nt, Artificial Sequence
  Synthetic Oligonucleotide; CD40LG exon 3; Set C
uuccuuuuaguuuuuaggcauucauagaaau

SEQ ID NO: 32890 - RNA, 29 nt, Artificial Sequence
  Synthetic Oligonucleotide; CD40LG exon 3; Set C
uccuuuuaguuuuuaggcauucauagaaa

SEQ ID NO: 32891 - RNA, 30 nt, Artificial Sequence
  Synthetic Oligonucleotide; CD40LG exon 3; Set C
uuccuuuuaguuuuuaggcauucauagaaa

SEQ ID NO: 32892 - RNA, 15 nt, Artificial Sequence
  Synthetic Oligonucleotide; CD40LG exon 3; Set C
uccuuuuaguuuuua

SEQ ID NO: 32893 - RNA, 16 nt, Artificial Sequence
  Synthetic Oligonucleotide; CD40LG exon 3; Set C
uuccuuuuaguuuuua

SEQ ID NO: 32894 - RNA, 15 nt, Artificial Sequence
  Synthetic Oligonucleotide; CD40LG exon 3; Set C
uuccuuuuaguuuuu

SEQ ID NO: 32895 - RNA, 15 nt, Artificial Sequence
  Synthetic Oligonucleotide; CD40LG exon 3; Set C
aggggcucugcugug

SEQ ID NO: 32896 - RNA, 21 nt, Artificial Sequence
  Synthetic Oligonucleotide; CD40LG exon 3; Set A
uuugacaggggcucugcugug

SEQ ID NO: 32897 - RNA, 22 nt, Artificial Sequence
  Synthetic Oligonucleotide; CD40LG exon 3; Set A
uuuugacaggggcucugcugug

SEQ ID NO: 32898 - RNA, 23 nt, Artificial Sequence
  Synthetic Oligonucleotide; CD40LG exon 3; Set A
auuuugacaggggcucugcugug

SEQ ID NO: 32899 - RNA, 21 nt, Artificial Sequence
  Synthetic Oligonucleotide; CD40LG exon 3; Set A
uuuugacaggggcucugcugu

SEQ ID NO: 32900 - RNA, 22 nt, Artificial Sequence
  Synthetic Oligonucleotide; CD40LG exon 3; Set A
auuuugacaggggcucugcugu

SEQ ID NO: 32901 - RNA, 29 nt, Artificial Sequence
  Synthetic Oligonucleotide; CD40LG exon 3; Set C
gaggucauuuugacaggggcucugcugug

SEQ ID NO: 32902 - RNA, 27 nt, Artificial Sequence
  Synthetic Oligonucleotide; CD40LG exon 3; Set C
auaagaagcauugcaagaggucauuuu

SEQ ID NO: 32903 - RNA, 28 nt, Artificial Sequence
  Synthetic Oligonucleotide; CD40LG exon 3; Set C
aauaagaagcauugcaagaggucauuuu

SEQ ID NO: 32904 - RNA, 26 nt, Artificial Sequence
  Synthetic Oligonucleotide; CD40LG exon 3; Set C
auaagaagcauugcaagaggucauuu

SEQ ID NO: 32905 - RNA, 29 nt, Artificial Sequence
  Synthetic Oligonucleotide; CD40LG exon 3; Set C
aaauaagaagcauugcaagaggucauuuu

SEQ ID NO: 32906 - RNA, 27 nt, Artificial Sequence
  Synthetic Oligonucleotide; CD40LG exon 3; Set C
aauaagaagcauugcaagaggucauuu

SEQ ID NO: 32907 - RNA, 25 nt, Artificial Sequence
  Synthetic Oligonucleotide; CD40LG exon 3; Set C
auaagaagcauugcaagaggucauu

SEQ ID NO: 32908 - RNA, 28 nt, Artificial Sequence
  Synthetic Oligonucleotide; CD40LG exon 3; Set C
aaauaagaagcauugcaagaggucauuu

SEQ ID NO: 32909 - RNA, 26 nt, Artificial Sequence
  Synthetic Oligonucleotide; CD40LG exon 3; Set C
aauaagaagcauugcaagaggucauu

SEQ ID NO: 32910 - RNA, 30 nt, Artificial Sequence
  Synthetic Oligonucleotide; CD40LG exon 3; Set C
aaaauaagaagcauugcaagaggucauuuu

SEQ ID NO: 32911 - RNA, 27 nt, Artificial Sequence
  Synthetic Oligonucleotide; CD40LG exon 3; Set C
aaauaagaagcauugcaagaggucauu

SEQ ID NO: 32912 - RNA, 29 nt, Artificial Sequence
  Synthetic Oligonucleotide; CD40LG exon 3; Set C
aaaauaagaagcauugcaagaggucauuu

SEQ ID NO: 32913 - RNA, 31 nt, Artificial Sequence
  Synthetic Oligonucleotide; CD40LG exon 3; Set C
uaaaauaagaagcauugcaagaggucauuuu

SEQ ID NO: 32914 - RNA, 28 nt, Artificial Sequence
  Synthetic Oligonucleotide; CD40LG exon 3; Set C
aaaauaagaagcauugcaagaggucauu

SEQ ID NO: 32915 - RNA, 30 nt, Artificial Sequence
  Synthetic Oligonucleotide; CD40LG exon 3; Set C
uaaaauaagaagcauugcaagaggucauuu

SEQ ID NO: 32916 - RNA, 29 nt, Artificial Sequence
  Synthetic Oligonucleotide; CD40LG exon 3; Set C
uaaaauaagaagcauugcaagaggucauu

SEQ ID NO: 32917 - RNA, 19 nt, Artificial Sequence
  Synthetic Oligonucleotide; CD40LG exon 3; Set C
auaagaagcauugcaagag

SEQ ID NO: 32918 - RNA, 20 nt, Artificial Sequence
  Synthetic Oligonucleotide; CD40LG exon 3; Set C
aauaagaagcauugcaagag

SEQ ID NO: 32919 - RNA, 37 nt, Artificial Sequence
  Synthetic Oligonucleotide; CD40LG exon 3; Set A
auauccuaaaauaagaagcauugcaagaggucauuuu

SEQ ID NO: 32920 - RNA, 21 nt, Artificial Sequence
  Synthetic Oligonucleotide; CD40LG exon 3; Set C
aaauaagaagcauugcaagag

SEQ ID NO: 32921 - RNA, 36 nt, Artificial Sequence
  Synthetic Oligonucleotide; CD40LG exon 3; Set A
auauccuaaaauaagaagcauugcaagaggucauuu

SEQ ID NO: 32922 - RNA, 38 nt, Artificial Sequence
  Synthetic Oligonucleotide; CD40LG exon 3; Set A
uauauccuaaaauaagaagcauugcaagaggucauuuu

SEQ ID NO: 32923 - RNA, 35 nt, Artificial Sequence
  Synthetic Oligonucleotide; CD40LG exon 3; Set A
auauccuaaaauaagaagcauugcaagaggucauu

SEQ ID NO: 32924 - RNA, 39 nt, Artificial Sequence
  Synthetic Oligonucleotide; CD40LG exon 3; Set A
uuauauccuaaaauaagaagcauugcaagaggucauuuu

SEQ ID NO: 32925 - RNA, 38 nt, Artificial Sequence
  Synthetic Oligonucleotide; CD40LG exon 3; Set A
uuauauccuaaaauaagaagcauugcaagaggucauuu

SEQ ID NO: 32926 - RNA, 38 nt, Artificial Sequence
  Synthetic Oligonucleotide; CD40LG exon 3; Set C
uuuaacauuauauccuaaaauaagaagcauugcaagag

SEQ ID NO: 32927 - RNA, 15 nt, Artificial Sequence
  Synthetic Oligonucleotide; CD40LG exon 3; Set C
uuauauccuaaaaua

SEQ ID NO: 32928 - RNA, 25 nt, Artificial Sequence
  Synthetic Oligonucleotide; CD40LG exon 3; Set C
uuuaacauuauauccuaaaauaaga

SEQ ID NO: 32929 - RNA, 24 nt, Artificial Sequence
  Synthetic Oligonucleotide; CD40LG exon 3; Set C
uuuaacauuauauccuaaaauaag

SEQ ID NO: 32930 - RNA, 21 nt, Artificial Sequence
  Synthetic Oligonucleotide; CD40LG exon 3; Set C
uuaacauuauauccuaaaaua

SEQ ID NO: 32931 - RNA, 23 nt, Artificial Sequence
  Synthetic Oligonucleotide; CD40LG exon 3; Set C
uuuaacauuauauccuaaaauaa

SEQ ID NO: 32932 - RNA, 20 nt, Artificial Sequence
  Synthetic Oligonucleotide; CD40LG exon 3; Set C
uuaacauuauauccuaaaau

SEQ ID NO: 32933 - RNA, 22 nt, Artificial Sequence
  Synthetic Oligonucleotide; CD40LG exon 3; Set C
uuuaacauuauauccuaaaaua

SEQ ID NO: 32934 - RNA, 21 nt, Artificial Sequence
  Synthetic Oligonucleotide; CD40LG exon 3; Set C
uuuaacauuauauccuaaaau

SEQ ID NO: 32935 - RNA, 19 nt, Artificial Sequence
  Synthetic Oligonucleotide; CD40LG exon 3; Set C
uuaacauuauauccuaaaa

SEQ ID NO: 32936 - RNA, 23 nt, Artificial Sequence
  Synthetic Oligonucleotide; CD40LG exon 3; Set C
guuuaacauuauauccuaaaaua

SEQ ID NO: 32937 - RNA, 20 nt, Artificial Sequence
  Synthetic Oligonucleotide; CD40LG exon 3; Set C
uuuaacauuauauccuaaaa

SEQ ID NO: 32938 - RNA, 22 nt, Artificial Sequence
  Synthetic Oligonucleotide; CD40LG exon 3; Set C
guuuaacauuauauccuaaaau

SEQ ID NO: 32939 - RNA, 24 nt, Artificial Sequence
  Synthetic Oligonucleotide; CD40LG exon 3; Set C
uguuuaacauuauauccuaaaaua

SEQ ID NO: 32940 - RNA, 23 nt, Artificial Sequence
  Synthetic Oligonucleotide; CD40LG exon 3; Set C
uguuuaacauuauauccuaaaau

SEQ ID NO: 32941 - RNA, 21 nt, Artificial Sequence
  Synthetic Oligonucleotide; CD40LG exon 3; Set C
guuuaacauuauauccuaaaa

SEQ ID NO: 32942 - RNA, 25 nt, Artificial Sequence
  Synthetic Oligonucleotide; CD40LG exon 3; Set C
uuguuuaacauuauauccuaaaaua

SEQ ID NO: 32943 - RNA, 19 nt, Artificial Sequence
  Synthetic Oligonucleotide; CD40LG exon 3; Set C
uuuaacauuauauccuaaa

SEQ ID NO: 32944 - RNA, 24 nt, Artificial Sequence
  Synthetic Oligonucleotide; CD40LG exon 3; Set C
uuguuuaacauuauauccuaaaau

SEQ ID NO: 32945 - RNA, 22 nt, Artificial Sequence
  Synthetic Oligonucleotide; CD40LG exon 3; Set C
uguuuaacauuauauccuaaaa

SEQ ID NO: 32946 - RNA, 26 nt, Artificial Sequence
  Synthetic Oligonucleotide; CD40LG exon 3; Set C
uuuguuuaacauuauauccuaaaaua

SEQ ID NO: 32947 - RNA, 18 nt, Artificial Sequence
  Synthetic Oligonucleotide; CD40LG exon 3; Set C
uuuaacauuauauccuaa

SEQ ID NO: 32948 - RNA, 25 nt, Artificial Sequence
  Synthetic Oligonucleotide; CD40LG exon 3; Set C
uuuguuuaacauuauauccuaaaau

SEQ ID NO: 32949 - RNA, 23 nt, Artificial Sequence
  Synthetic Oligonucleotide; CD40LG exon 3; Set C
uuguuuaacauuauauccuaaaa

SEQ ID NO: 32950 - RNA, 24 nt, Artificial Sequence
  Synthetic Oligonucleotide; CD40LG exon 3; Set C
uuuguuuaacauuauauccuaaaa

SEQ ID NO: 32951 - RNA, 33 nt, Artificial Sequence
  Synthetic Oligonucleotide; CD40LG exon 3; Set C
ucuccucuuuguuuaacauuauauccuaaaaua

SEQ ID NO: 32952 - RNA, 34 nt, Artificial Sequence
  Synthetic Oligonucleotide; CD40LG exon 3; Set C
gucuccucuuuguuuaacauuauauccuaaaaua

SEQ ID NO: 32953 - RNA, 35 nt, Artificial Sequence
  Synthetic Oligonucleotide; CD40LG exon 3; Set A
cgucuccucuuuguuuaacauuauauccuaaaaua

SEQ ID NO: 32954 - RNA, 15 nt, Artificial Sequence
  Synthetic Oligonucleotide; CD40LG exon 3; Set C
uuguuuaacauuaua

SEQ ID NO: 32955 - RNA, 34 nt, Artificial Sequence
  Synthetic Oligonucleotide; CD40LG exon 3; Set A
cgucuccucuuuguuuaacauuauauccuaaaau

SEQ ID NO: 32956 - RNA, 36 nt, Artificial Sequence
  Synthetic Oligonucleotide; CD40LG exon 3; Set A
ucgucuccucuuuguuuaacauuauauccuaaaaua

SEQ ID NO: 32957 - RNA, 16 nt, Artificial Sequence
  Synthetic Oligonucleotide; CD40LG exon 3; Set C
uuuguuuaacauuaua

SEQ ID NO: 32958 - RNA, 35 nt, Artificial Sequence
  Synthetic Oligonucleotide; CD40LG exon 3; Set A
ucgucuccucuuuguuuaacauuauauccuaaaau

SEQ ID NO: 32959 - RNA, 37 nt, Artificial Sequence
  Synthetic Oligonucleotide; CD40LG exon 3; Set A
uucgucuccucuuuguuuaacauuauauccuaaaaua

SEQ ID NO: 32960 - RNA, 15 nt, Artificial Sequence
  Synthetic Oligonucleotide; CD40LG exon 3; Set C
uuuguuuaacauuau

SEQ ID NO: 32961 - RNA, 36 nt, Artificial Sequence
  Synthetic Oligonucleotide; CD40LG exon 3; Set A
uucgucuccucuuuguuuaacauuauauccuaaaau

SEQ ID NO: 32962 - RNA, 34 nt, Artificial Sequence
  Synthetic Oligonucleotide; CD40LG exon 3; Set A
ucgucuccucuuuguuuaacauuauauccuaaaa

SEQ ID NO: 32963 - RNA, 38 nt, Artificial Sequence
  Synthetic Oligonucleotide; CD40LG exon 3; Set A
cuucgucuccucuuuguuuaacauuauauccuaaaaua

SEQ ID NO: 32964 - RNA, 37 nt, Artificial Sequence
  Synthetic Oligonucleotide; CD40LG exon 3; Set A
cuucgucuccucuuuguuuaacauuauauccuaaaau

SEQ ID NO: 32965 - RNA, 35 nt, Artificial Sequence
  Synthetic Oligonucleotide; CD40LG exon 3; Set A
uucgucuccucuuuguuuaacauuauauccuaaaa

SEQ ID NO: 32966 - RNA, 39 nt, Artificial Sequence
  Synthetic Oligonucleotide; CD40LG exon 3; Set A
ucuucgucuccucuuuguuuaacauuauauccuaaaaua

SEQ ID NO: 32967 - RNA, 38 nt, Artificial Sequence
  Synthetic Oligonucleotide; CD40LG exon 3; Set A
ucuucgucuccucuuuguuuaacauuauauccuaaaau

SEQ ID NO: 32968 - RNA, 36 nt, Artificial Sequence
  Synthetic Oligonucleotide; CD40LG exon 3; Set A
cuucgucuccucuuuguuuaacauuauauccuaaaa

SEQ ID NO: 32969 - RNA, 40 nt, Artificial Sequence
  Synthetic Oligonucleotide; CD40LG exon 3; Set A
uucuucgucuccucuuuguuuaacauuauauccuaaaaua

SEQ ID NO: 32970 - RNA, 37 nt, Artificial Sequence
  Synthetic Oligonucleotide; CD40LG exon 3; Set A
ucuucgucuccucuuuguuuaacauuauauccuaaaa

SEQ ID NO: 32971 - RNA, 39 nt, Artificial Sequence
  Synthetic Oligonucleotide; CD40LG exon 3; Set A
uucuucgucuccucuuuguuuaacauuauauccuaaaau

SEQ ID NO: 32972 - RNA, 35 nt, Artificial Sequence
  Synthetic Oligonucleotide; CD40LG exon 3; Set A
cuucgucuccucuuuguuuaacauuauauccuaaa

SEQ ID NO: 32973 - RNA, 38 nt, Artificial Sequence
  Synthetic Oligonucleotide; CD40LG exon 3; Set A
uucuucgucuccucuuuguuuaacauuauauccuaaaa

SEQ ID NO: 32974 - RNA, 40 nt, Artificial Sequence
  Synthetic Oligonucleotide; CD40LG exon 3; Set A
uuucuucgucuccucuuuguuuaacauuauauccuaaaau

SEQ ID NO: 32975 - RNA, 36 nt, Artificial Sequence
  Synthetic Oligonucleotide; CD40LG exon 3; Set A
ucuucgucuccucuuuguuuaacauuauauccuaaa

SEQ ID NO: 32976 - RNA, 34 nt, Artificial Sequence
  Synthetic Oligonucleotide; CD40LG exon 3; Set A
cuucgucuccucuuuguuuaacauuauauccuaa

SEQ ID NO: 32977 - RNA, 39 nt, Artificial Sequence
  Synthetic Oligonucleotide; CD40LG exon 3; Set A
uuucuucgucuccucuuuguuuaacauuauauccuaaaa

SEQ ID NO: 32978 - RNA, 37 nt, Artificial Sequence
  Synthetic Oligonucleotide; CD40LG exon 3; Set A
uucuucgucuccucuuuguuuaacauuauauccuaaa

SEQ ID NO: 32979 - RNA, 35 nt, Artificial Sequence
  Synthetic Oligonucleotide; CD40LG exon 3; Set A
ucuucgucuccucuuuguuuaacauuauauccuaa

SEQ ID NO: 32980 - RNA, 40 nt, Artificial Sequence
  Synthetic Oligonucleotide; CD40LG exon 3; Set A
cuuucuucgucuccucuuuguuuaacauuauauccuaaaa

SEQ ID NO: 32981 - RNA, 36 nt, Artificial Sequence
  Synthetic Oligonucleotide; CD40LG exon 3; Set A
uucuucgucuccucuuuguuuaacauuauauccuaa

SEQ ID NO: 32982 - RNA, 26 nt, Artificial Sequence
  Synthetic Oligonucleotide; CD40LG exon 3; Set C
ucgucuccucuuuguuuaacauuaua

SEQ ID NO: 32983 - RNA, 27 nt, Artificial Sequence
  Synthetic Oligonucleotide; CD40LG exon 3; Set C
uucgucuccucuuuguuuaacauuaua

SEQ ID NO: 32984 - RNA, 28 nt, Artificial Sequence
  Synthetic Oligonucleotide; CD40LG exon 3; Set C
cuucgucuccucuuuguuuaacauuaua

SEQ ID NO: 32985 - RNA, 29 nt, Artificial Sequence
  Synthetic Oligonucleotide; CD40LG exon 3; Set A
ucuucgucuccucuuuguuuaacauuaua

SEQ ID NO: 32986 - RNA, 30 nt, Artificial Sequence
  Synthetic Oligonucleotide; CD40LG exon 3; Set A
uucuucgucuccucuuuguuuaacauuaua

SEQ ID NO: 32987 - RNA, 28 nt, Artificial Sequence
  Synthetic Oligonucleotide; CD40LG exon 3; Set A
ucuucgucuccucuuuguuuaacauuau

SEQ ID NO: 32988 - RNA, 31 nt, Artificial Sequence
  Synthetic Oligonucleotide; CD40LG exon 3; Set A
uuucuucgucuccucuuuguuuaacauuaua

SEQ ID NO: 32989 - RNA, 29 nt, Artificial Sequence
  Synthetic Oligonucleotide; CD40LG exon 3; Set A
uucuucgucuccucuuuguuuaacauuau

SEQ ID NO: 32990 - RNA, 28 nt, Artificial Sequence
  Synthetic Oligonucleotide; CD40LG exon 3; Set A
uucuucgucuccucuuuguuuaacauua

SEQ ID NO: 32991 - RNA, 17 nt, Artificial Sequence
  Synthetic Oligonucleotide; CD40LG exon 3; Set C
ucgucuccucuuuguuu

SEQ ID NO: 32992 - RNA, 35 nt, Artificial Sequence
  Synthetic Oligonucleotide; CD40LG exon 3; Set A
uuucuuucuucgucuccucuuuguuuaacauuaua

SEQ ID NO: 32993 - RNA, 18 nt, Artificial Sequence
  Synthetic Oligonucleotide; CD40LG exon 3; Set C
uucgucuccucuuuguuu

SEQ ID NO: 32994 - RNA, 36 nt, Artificial Sequence
  Synthetic Oligonucleotide; CD40LG exon 3; Set A
uuuucuuucuucgucuccucuuuguuuaacauuaua

SEQ ID NO: 32995 - RNA, 34 nt, Artificial Sequence
  Synthetic Oligonucleotide; CD40LG exon 3; Set A
uuucuuucuucgucuccucuuuguuuaacauuau

SEQ ID NO: 32996 - RNA, 19 nt, Artificial Sequence
  Synthetic Oligonucleotide; CD40LG exon 3; Set C
cuucgucuccucuuuguuu

SEQ ID NO: 32997 - RNA, 37 nt, Artificial Sequence
  Synthetic Oligonucleotide; CD40LG exon 3; Set A
guuuucuuucuucgucuccucuuuguuuaacauuaua

SEQ ID NO: 32998 - RNA, 33 nt, Artificial Sequence
  Synthetic Oligonucleotide; CD40LG exon 3; Set A
uuucuuucuucgucuccucuuuguuuaacauua

SEQ ID NO: 32999 - RNA, 35 nt, Artificial Sequence
  Synthetic Oligonucleotide; CD40LG exon 3; Set A
uuuucuuucuucgucuccucuuuguuuaacauuau

SEQ ID NO: 33000 - RNA, 21 nt, Artificial Sequence
  Synthetic Oligonucleotide; CD40LG exon 3; Set C
ucuucgucuccucuuuguuua

SEQ ID NO: 33001 - RNA, 20 nt, Artificial Sequence
  Synthetic Oligonucleotide; CD40LG exon 3; Set C
ucuucgucuccucuuuguuu

SEQ ID NO: 33002 - RNA, 38 nt, Artificial Sequence
  Synthetic Oligonucleotide; CD40LG exon 3; Set A
uguuuucuuucuucgucuccucuuuguuuaacauuaua

SEQ ID NO: 33003 - RNA, 18 nt, Artificial Sequence
  Synthetic Oligonucleotide; CD40LG exon 3; Set C
cuucgucuccucuuuguu

SEQ ID NO: 33004 - RNA, 34 nt, Artificial Sequence
  Synthetic Oligonucleotide; CD40LG exon 3; Set A
uuuucuuucuucgucuccucuuuguuuaacauua

SEQ ID NO: 33005 - RNA, 36 nt, Artificial Sequence
  Synthetic Oligonucleotide; CD40LG exon 3; Set A
guuuucuuucuucgucuccucuuuguuuaacauuau

SEQ ID NO: 33006 - RNA, 22 nt, Artificial Sequence
  Synthetic Oligonucleotide; CD40LG exon 3; Set C
uucuucgucuccucuuuguuua

SEQ ID NO: 33007 - RNA, 21 nt, Artificial Sequence
  Synthetic Oligonucleotide; CD40LG exon 3; Set C
uucuucgucuccucuuuguuu

SEQ ID NO: 33008 - RNA, 19 nt, Artificial Sequence
  Synthetic Oligonucleotide; CD40LG exon 3; Set C
ucuucgucuccucuuuguu

SEQ ID NO: 33009 - RNA, 35 nt, Artificial Sequence
  Synthetic Oligonucleotide; CD40LG exon 3; Set A
guuuucuuucuucgucuccucuuuguuuaacauua

SEQ ID NO: 33010 - RNA, 37 nt, Artificial Sequence
  Synthetic Oligonucleotide; CD40LG exon 3; Set A
uguuuucuuucuucgucuccucuuuguuuaacauuau

SEQ ID NO: 33011 - RNA, 22 nt, Artificial Sequence
  Synthetic Oligonucleotide; CD40LG exon 3; Set C
uuucuucgucuccucuuuguuu

SEQ ID NO: 33012 - RNA, 18 nt, Artificial Sequence
  Synthetic Oligonucleotide; CD40LG exon 3; Set C
ucuucgucuccucuuugu

SEQ ID NO: 33013 - RNA, 20 nt, Artificial Sequence
  Synthetic Oligonucleotide; CD40LG exon 3; Set C
uucuucgucuccucuuuguu

SEQ ID NO: 33014 - RNA, 36 nt, Artificial Sequence
  Synthetic Oligonucleotide; CD40LG exon 3; Set A
uguuuucuuucuucgucuccucuuuguuuaacauua

SEQ ID NO: 33015 - RNA, 23 nt, Artificial Sequence
  Synthetic Oligonucleotide; CD40LG exon 3; Set C
cuuucuucgucuccucuuuguuu

SEQ ID NO: 33016 - RNA, 19 nt, Artificial Sequence
  Synthetic Oligonucleotide; CD40LG exon 3; Set C
uucuucgucuccucuuugu

SEQ ID NO: 33017 - RNA, 24 nt, Artificial Sequence
  Synthetic Oligonucleotide; CD40LG exon 3; Set C
ucuuucuucgucuccucuuuguuu

SEQ ID NO: 33018 - RNA, 25 nt, Artificial Sequence
  Synthetic Oligonucleotide; CD40LG exon 3; Set C
uucuuucuucgucuccucuuuguuu

SEQ ID NO: 33019 - RNA, 27 nt, Artificial Sequence
  Synthetic Oligonucleotide; CD40LG exon 3; Set A
uuucuuucuucgucuccucuuuguuua

SEQ ID NO: 33020 - RNA, 26 nt, Artificial Sequence
  Synthetic Oligonucleotide; CD40LG exon 3; Set A
uuucuuucuucgucuccucuuuguuu

SEQ ID NO: 33021 - RNA, 28 nt, Artificial Sequence
  Synthetic Oligonucleotide; CD40LG exon 3; Set A
uuuucuuucuucgucuccucuuuguuua

SEQ ID NO: 33022 - RNA, 25 nt, Artificial Sequence
  Synthetic Oligonucleotide; CD40LG exon 3; Set C
uuucuuucuucgucuccucuuuguu

SEQ ID NO: 33023 - RNA, 29 nt, Artificial Sequence
  Synthetic Oligonucleotide; CD40LG exon 3; Set A
guuuucuuucuucgucuccucuuuguuua

SEQ ID NO: 33024 - RNA, 26 nt, Artificial Sequence
  Synthetic Oligonucleotide; CD40LG exon 3; Set A
uuuucuuucuucgucuccucuuuguu

SEQ ID NO: 33025 - RNA, 24 nt, Artificial Sequence
  Synthetic Oligonucleotide; CD40LG exon 3; Set C
uuucuuucuucgucuccucuuugu

SEQ ID NO: 33026 - RNA, 30 nt, Artificial Sequence
  Synthetic Oligonucleotide; CD40LG exon 3; Set A
uguuuucuuucuucgucuccucuuuguuua

SEQ ID NO: 33027 - RNA, 23 nt, Artificial Sequence
  Synthetic Oligonucleotide; CD40LG exon 3; Set C
uuucuuucuucgucuccucuuug

SEQ ID NO: 33028 - RNA, 25 nt, Artificial Sequence
  Synthetic Oligonucleotide; CD40LG exon 3; Set C
uuuucuuucuucgucuccucuuugu

SEQ ID NO: 33029 - RNA, 27 nt, Artificial Sequence
  Synthetic Oligonucleotide; CD40LG exon 3; Set A
guuuucuuucuucgucuccucuuuguu

SEQ ID NO: 33030 - RNA, 22 nt, Artificial Sequence
  Synthetic Oligonucleotide; CD40LG exon 3; Set C
uuucuuucuucgucuccucuuu

SEQ ID NO: 33031 - RNA, 24 nt, Artificial Sequence
  Synthetic Oligonucleotide; CD40LG exon 3; Set C
uuuucuuucuucgucuccucuuug

SEQ ID NO: 33032 - RNA, 28 nt, Artificial Sequence
  Synthetic Oligonucleotide; CD40LG exon 3; Set A
uguuuucuuucuucgucuccucuuuguu

SEQ ID NO: 33033 - RNA, 26 nt, Artificial Sequence
  Synthetic Oligonucleotide; CD40LG exon 3; Set A
guuuucuuucuucgucuccucuuugu

SEQ ID NO: 33034 - RNA, 23 nt, Artificial Sequence
  Synthetic Oligonucleotide; CD40LG exon 3; Set C
uuuucuuucuucgucuccucuuu

SEQ ID NO: 33035 - RNA, 25 nt, Artificial Sequence
  Synthetic Oligonucleotide; CD40LG exon 3; Set C
guuuucuuucuucgucuccucuuug

SEQ ID NO: 33036 - RNA, 27 nt, Artificial Sequence
  Synthetic Oligonucleotide; CD40LG exon 3; Set A
uguuuucuuucuucgucuccucuuugu

SEQ ID NO: 33037 - RNA, 24 nt, Artificial Sequence
  Synthetic Oligonucleotide; CD40LG exon 3; Set C
guuuucuuucuucgucuccucuuu

SEQ ID NO: 33038 - RNA, 26 nt, Artificial Sequence
  Synthetic Oligonucleotide; CD40LG exon 3; Set A
uguuuucuuucuucgucuccucuuug

SEQ ID NO: 33039 - RNA, 25 nt, Artificial Sequence
  Synthetic Oligonucleotide; CD40LG exon 3; Set C
uguuuucuuucuucgucuccucuuu

SEQ ID NO: 33040 - RNA, 35 nt, Artificial Sequence
  Synthetic Oligonucleotide; CD40LG exon 3; Set A
aaagcuguuuucuuucuucgucuccucuuuguuua

SEQ ID NO: 33041 - RNA, 34 nt, Artificial Sequence
  Synthetic Oligonucleotide; CD40LG exon 3; Set A
aaagcuguuuucuuucuucgucuccucuuuguuu

SEQ ID NO: 33042 - RNA, 36 nt, Artificial Sequence
  Synthetic Oligonucleotide; CD40LG exon 3; Set A
caaagcuguuuucuuucuucgucuccucuuuguuua

SEQ ID NO: 33043 - RNA, 35 nt, Artificial Sequence
  Synthetic Oligonucleotide; CD40LG exon 3; Set A
caaagcuguuuucuuucuucgucuccucuuuguuu

SEQ ID NO: 33044 - RNA, 33 nt, Artificial Sequence
  Synthetic Oligonucleotide; CD40LG exon 3; Set A
aaagcuguuuucuuucuucgucuccucuuuguu

SEQ ID NO: 33045 - RNA, 37 nt, Artificial Sequence
  Synthetic Oligonucleotide; CD40LG exon 3; Set A
ucaaagcuguuuucuuucuucgucuccucuuuguuua

SEQ ID NO: 33046 - RNA, 15 nt, Artificial Sequence
  Synthetic Oligonucleotide; CD40LG exon 3; Set C
uucuuucuucgucuc

SEQ ID NO: 33047 - RNA, 36 nt, Artificial Sequence
  Synthetic Oligonucleotide; CD40LG exon 3; Set A
ucaaagcuguuuucuuucuucgucuccucuuuguuu

SEQ ID NO: 33048 - RNA, 32 nt, Artificial Sequence
  Synthetic Oligonucleotide; CD40LG exon 3; Set A
aaagcuguuuucuuucuucgucuccucuuugu

SEQ ID NO: 33049 - RNA, 34 nt, Artificial Sequence
  Synthetic Oligonucleotide; CD40LG exon 3; Set A
caaagcuguuuucuuucuucgucuccucuuuguu

SEQ ID NO: 33050 - RNA, 38 nt, Artificial Sequence
  Synthetic Oligonucleotide; CD40LG exon 3; Set A
uucaaagcuguuuucuuucuucgucuccucuuuguuua

SEQ ID NO: 33051 - RNA, 16 nt, Artificial Sequence
  Synthetic Oligonucleotide; CD40LG exon 3; Set C
uuucuuucuucgucuc

SEQ ID NO: 33052 - RNA, 31 nt, Artificial Sequence
  Synthetic Oligonucleotide; CD40LG exon 3; Set A
aaagcuguuuucuuucuucgucuccucuuug

SEQ ID NO: 33053 - RNA, 33 nt, Artificial Sequence
  Synthetic Oligonucleotide; CD40LG exon 3; Set A
caaagcuguuuucuuucuucgucuccucuuugu

SEQ ID NO: 33054 - RNA, 35 nt, Artificial Sequence
  Synthetic Oligonucleotide; CD40LG exon 3; Set A
ucaaagcuguuuucuuucuucgucuccucuuuguu

SEQ ID NO: 33055 - RNA, 15 nt, Artificial Sequence
  Synthetic Oligonucleotide; CD40LG exon 3; Set C
uuucuuucuucgucu

SEQ ID NO: 33056 - RNA, 39 nt, Artificial Sequence
  Synthetic Oligonucleotide; CD40LG exon 3; Set A
uuucaaagcuguuuucuuucuucgucuccucuuuguuua

SEQ ID NO: 33057 - RNA, 17 nt, Artificial Sequence
  Synthetic Oligonucleotide; CD40LG exon 3; Set C
uuuucuuucuucgucuc

SEQ ID NO: 33058 - RNA, 30 nt, Artificial Sequence
  Synthetic Oligonucleotide; CD40LG exon 3; Set A
aaagcuguuuucuuucuucgucuccucuuu

SEQ ID NO: 33059 - RNA, 32 nt, Artificial Sequence
  Synthetic Oligonucleotide; CD40LG exon 3; Set A
caaagcuguuuucuuucuucgucuccucuuug

SEQ ID NO: 33060 - RNA, 36 nt, Artificial Sequence
  Synthetic Oligonucleotide; CD40LG exon 3; Set A
uucaaagcuguuuucuuucuucgucuccucuuuguu

SEQ ID NO: 33061 - RNA, 34 nt, Artificial Sequence
  Synthetic Oligonucleotide; CD40LG exon 3; Set A
ucaaagcuguuuucuuucuucgucuccucuuugu

SEQ ID NO: 33062 - RNA, 40 nt, Artificial Sequence
  Synthetic Oligonucleotide; CD40LG exon 3; Set A
auuucaaagcuguuuucuuucuucgucuccucuuuguuua

SEQ ID NO: 33063 - RNA, 18 nt, Artificial Sequence
  Synthetic Oligonucleotide; CD40LG exon 3; Set C
guuuucuuucuucgucuc

SEQ ID NO: 33064 - RNA, 31 nt, Artificial Sequence
  Synthetic Oligonucleotide; CD40LG exon 3; Set A
caaagcuguuuucuuucuucgucuccucuuu

SEQ ID NO: 33065 - RNA, 33 nt, Artificial Sequence
  Synthetic Oligonucleotide; CD40LG exon 3; Set A
ucaaagcuguuuucuuucuucgucuccucuuug

SEQ ID NO: 33066 - RNA, 37 nt, Artificial Sequence
  Synthetic Oligonucleotide; CD40LG exon 3; Set A
uuucaaagcuguuuucuuucuucgucuccucuuuguu

SEQ ID NO: 33067 - RNA, 35 nt, Artificial Sequence
  Synthetic Oligonucleotide; CD40LG exon 3; Set A
uucaaagcuguuuucuuucuucgucuccucuuugu

SEQ ID NO: 33068 - RNA, 19 nt, Artificial Sequence
  Synthetic Oligonucleotide; CD40LG exon 3; Set C
uguuuucuuucuucgucuc

SEQ ID NO: 33069 - RNA, 32 nt, Artificial Sequence
  Synthetic Oligonucleotide; CD40LG exon 3; Set A
ucaaagcuguuuucuuucuucgucuccucuuu

SEQ ID NO: 33070 - RNA, 34 nt, Artificial Sequence
  Synthetic Oligonucleotide; CD40LG exon 3; Set A
uucaaagcuguuuucuuucuucgucuccucuuug

SEQ ID NO: 33071 - RNA, 36 nt, Artificial Sequence
  Synthetic Oligonucleotide; CD40LG exon 3; Set A
uuucaaagcuguuuucuuucuucgucuccucuuugu

SEQ ID NO: 33072 - RNA, 38 nt, Artificial Sequence
  Synthetic Oligonucleotide; CD40LG exon 3; Set A
auuucaaagcuguuuucuuucuucgucuccucuuuguu

SEQ ID NO: 33073 - RNA, 33 nt, Artificial Sequence
  Synthetic Oligonucleotide; CD40LG exon 3; Set A
uucaaagcuguuuucuuucuucgucuccucuuu

SEQ ID NO: 33074 - RNA, 35 nt, Artificial Sequence
  Synthetic Oligonucleotide; CD40LG exon 3; Set A
uuucaaagcuguuuucuuucuucgucuccucuuug

SEQ ID NO: 33075 - RNA, 37 nt, Artificial Sequence
  Synthetic Oligonucleotide; CD40LG exon 3; Set A
auuucaaagcuguuuucuuucuucgucuccucuuugu

SEQ ID NO: 33076 - RNA, 34 nt, Artificial Sequence
  Synthetic Oligonucleotide; CD40LG exon 3; Set A
uuucaaagcuguuuucuuucuucgucuccucuuu

SEQ ID NO: 33077 - RNA, 36 nt, Artificial Sequence
  Synthetic Oligonucleotide; CD40LG exon 3; Set A
auuucaaagcuguuuucuuucuucgucuccucuuug

SEQ ID NO: 33078 - RNA, 35 nt, Artificial Sequence
  Synthetic Oligonucleotide; CD40LG exon 3; Set A
auuucaaagcuguuuucuuucuucgucuccucuuu

SEQ ID NO: 33079 - RNA, 24 nt, Artificial Sequence
  Synthetic Oligonucleotide; CD40LG exon 3; Set C
aaagcuguuuucuuucuucgucuc

SEQ ID NO: 33080 - RNA, 23 nt, Artificial Sequence
  Synthetic Oligonucleotide; CD40LG exon 3; Set C
aaagcuguuuucuuucuucgucu

SEQ ID NO: 33081 - RNA, 25 nt, Artificial Sequence
  Synthetic Oligonucleotide; CD40LG exon 3; Set C
caaagcuguuuucuuucuucgucuc

SEQ ID NO: 33082 - RNA, 24 nt, Artificial Sequence
  Synthetic Oligonucleotide; CD40LG exon 3; Set C
caaagcuguuuucuuucuucgucu

SEQ ID NO: 33083 - RNA, 22 nt, Artificial Sequence
  Synthetic Oligonucleotide; CD40LG exon 3; Set C
aaagcuguuuucuuucuucguc

SEQ ID NO: 33084 - RNA, 26 nt, Artificial Sequence
  Synthetic Oligonucleotide; CD40LG exon 3; Set C
ucaaagcuguuuucuuucuucgucuc

SEQ ID NO: 33085 - RNA, 25 nt, Artificial Sequence
  Synthetic Oligonucleotide; CD40LG exon 3; Set C
ucaaagcuguuuucuuucuucgucu

SEQ ID NO: 33086 - RNA, 23 nt, Artificial Sequence
  Synthetic Oligonucleotide; CD40LG exon 3; Set C
caaagcuguuuucuuucuucguc

SEQ ID NO: 33087 - RNA, 21 nt, Artificial Sequence
  Synthetic Oligonucleotide; CD40LG exon 3; Set C
aaagcuguuuucuuucuucgu

SEQ ID NO: 33088 - RNA, 27 nt, Artificial Sequence
  Synthetic Oligonucleotide; CD40LG exon 3; Set C
uucaaagcuguuuucuuucuucgucuc

SEQ ID NO: 33089 - RNA, 40 nt, Artificial Sequence
  Synthetic Oligonucleotide; CD40LG exon 3; Set C
uuugcauuucaaagcuguuuucuuucuucgucuccucuuu

SEQ ID NO: 33090 - RNA, 26 nt, Artificial Sequence
  Synthetic Oligonucleotide; CD40LG exon 3; Set C
uucaaagcuguuuucuuucuucgucu

SEQ ID NO: 33091 - RNA, 24 nt, Artificial Sequence
  Synthetic Oligonucleotide; CD40LG exon 3; Set C
ucaaagcuguuuucuuucuucguc

SEQ ID NO: 33092 - RNA, 22 nt, Artificial Sequence
  Synthetic Oligonucleotide; CD40LG exon 3; Set C
caaagcuguuuucuuucuucgu

SEQ ID NO: 33093 - RNA, 28 nt, Artificial Sequence
  Synthetic Oligonucleotide; CD40LG exon 3; Set C
uuucaaagcuguuuucuuucuucgucuc

SEQ ID NO: 33094 - RNA, 27 nt, Artificial Sequence
  Synthetic Oligonucleotide; CD40LG exon 3; Set C
uuucaaagcuguuuucuuucuucgucu

SEQ ID NO: 33095 - RNA, 25 nt, Artificial Sequence
  Synthetic Oligonucleotide; CD40LG exon 3; Set C
uucaaagcuguuuucuuucuucguc

SEQ ID NO: 33096 - RNA, 23 nt, Artificial Sequence
  Synthetic Oligonucleotide; CD40LG exon 3; Set C
ucaaagcuguuuucuuucuucgu

SEQ ID NO: 33097 - RNA, 29 nt, Artificial Sequence
  Synthetic Oligonucleotide; CD40LG exon 3; Set C
auuucaaagcuguuuucuuucuucgucuc

SEQ ID NO: 33098 - RNA, 28 nt, Artificial Sequence
  Synthetic Oligonucleotide; CD40LG exon 3; Set C
auuucaaagcuguuuucuuucuucgucu

SEQ ID NO: 33099 - RNA, 26 nt, Artificial Sequence
  Synthetic Oligonucleotide; CD40LG exon 3; Set C
uuucaaagcuguuuucuuucuucguc

SEQ ID NO: 33100 - RNA, 24 nt, Artificial Sequence
  Synthetic Oligonucleotide; CD40LG exon 3; Set C
uucaaagcuguuuucuuucuucgu

SEQ ID NO: 33101 - RNA, 27 nt, Artificial Sequence
  Synthetic Oligonucleotide; CD40LG exon 3; Set C
auuucaaagcuguuuucuuucuucguc

SEQ ID NO: 33102 - RNA, 25 nt, Artificial Sequence
  Synthetic Oligonucleotide; CD40LG exon 3; Set C
uuucaaagcuguuuucuuucuucgu

SEQ ID NO: 33103 - RNA, 26 nt, Artificial Sequence
  Synthetic Oligonucleotide; CD40LG exon 3; Set C
auuucaaagcuguuuucuuucuucgu

SEQ ID NO: 33104 - RNA, 15 nt, Artificial Sequence
  Synthetic Oligonucleotide; CD40LG exon 3; Set C
aaagcuguuuucuuu

SEQ ID NO: 33105 - RNA, 16 nt, Artificial Sequence
  Synthetic Oligonucleotide; CD40LG exon 3; Set C
caaagcuguuuucuuu

SEQ ID NO: 33106 - RNA, 34 nt, Artificial Sequence
  Synthetic Oligonucleotide; CD40LG exon 3; Set A
uuugcauuucaaagcuguuuucuuucuucgucuc

SEQ ID NO: 33107 - RNA, 17 nt, Artificial Sequence
  Synthetic Oligonucleotide; CD40LG exon 3; Set C
ucaaagcuguuuucuuu

SEQ ID NO: 33108 - RNA, 15 nt, Artificial Sequence
  Synthetic Oligonucleotide; CD40LG exon 3; Set C
caaagcuguuuucuu

SEQ ID NO: 33109 - RNA, 33 nt, Artificial Sequence
  Synthetic Oligonucleotide; CD40LG exon 3; Set A
uuugcauuucaaagcuguuuucuuucuucgucu

SEQ ID NO: 33110 - RNA, 35 nt, Artificial Sequence
  Synthetic Oligonucleotide; CD40LG exon 3; Set A
uuuugcauuucaaagcuguuuucuuucuucgucuc

SEQ ID NO: 33111 - RNA, 18 nt, Artificial Sequence
  Synthetic Oligonucleotide; CD40LG exon 3; Set C
uucaaagcuguuuucuuu

SEQ ID NO: 33112 - RNA, 16 nt, Artificial Sequence
  Synthetic Oligonucleotide; CD40LG exon 3; Set C
ucaaagcuguuuucuu

SEQ ID NO: 33113 - RNA, 34 nt, Artificial Sequence
  Synthetic Oligonucleotide; CD40LG exon 3; Set A
uuuugcauuucaaagcuguuuucuuucuucgucu

SEQ ID NO: 33114 - RNA, 32 nt, Artificial Sequence
  Synthetic Oligonucleotide; CD40LG exon 3; Set A
uuugcauuucaaagcuguuuucuuucuucguc

SEQ ID NO: 33115 - RNA, 36 nt, Artificial Sequence
  Synthetic Oligonucleotide; CD40LG exon 3; Set A
uuuuugcauuucaaagcuguuuucuuucuucgucuc

SEQ ID NO: 33116 - RNA, 19 nt, Artificial Sequence
  Synthetic Oligonucleotide; CD40LG exon 3; Set C
uuucaaagcuguuuucuuu

SEQ ID NO: 33117 - RNA, 17 nt, Artificial Sequence
  Synthetic Oligonucleotide; CD40LG exon 3; Set C
uucaaagcuguuuucuu

SEQ ID NO: 33118 - RNA, 15 nt, Artificial Sequence
  Synthetic Oligonucleotide; CD40LG exon 3; Set C
ucaaagcuguuuucu

SEQ ID NO: 33119 - RNA, 35 nt, Artificial Sequence
  Synthetic Oligonucleotide; CD40LG exon 3; Set A
uuuuugcauuucaaagcuguuuucuuucuucgucu

SEQ ID NO: 33120 - RNA, 33 nt, Artificial Sequence
  Synthetic Oligonucleotide; CD40LG exon 3; Set A
uuuugcauuucaaagcuguuuucuuucuucguc

SEQ ID NO: 33121 - RNA, 31 nt, Artificial Sequence
  Synthetic Oligonucleotide; CD40LG exon 3; Set A
uuugcauuucaaagcuguuuucuuucuucgu

SEQ ID NO: 33122 - RNA, 20 nt, Artificial Sequence
  Synthetic Oligonucleotide; CD40LG exon 3; Set C
auuucaaagcuguuuucuuu

SEQ ID NO: 33123 - RNA, 18 nt, Artificial Sequence
  Synthetic Oligonucleotide; CD40LG exon 3; Set C
uuucaaagcuguuuucuu

SEQ ID NO: 33124 - RNA, 16 nt, Artificial Sequence
  Synthetic Oligonucleotide; CD40LG exon 3; Set C
uucaaagcuguuuucu

SEQ ID NO: 33125 - RNA, 34 nt, Artificial Sequence
  Synthetic Oligonucleotide; CD40LG exon 3; Set A
uuuuugcauuucaaagcuguuuucuuucuucguc

SEQ ID NO: 33126 - RNA, 32 nt, Artificial Sequence
  Synthetic Oligonucleotide; CD40LG exon 3; Set A
uuuugcauuucaaagcuguuuucuuucuucgu

SEQ ID NO: 33127 - RNA, 17 nt, Artificial Sequence
  Synthetic Oligonucleotide; CD40LG exon 3; Set C
uuucaaagcuguuuucu

SEQ ID NO: 33128 - RNA, 19 nt, Artificial Sequence
  Synthetic Oligonucleotide; CD40LG exon 3; Set C
auuucaaagcuguuuucuu

SEQ ID NO: 33129 - RNA, 15 nt, Artificial Sequence
  Synthetic Oligonucleotide; CD40LG exon 3; Set C
uucaaagcuguuuuc

SEQ ID NO: 33130 - RNA, 33 nt, Artificial Sequence
  Synthetic Oligonucleotide; CD40LG exon 3; Set A
uuuuugcauuucaaagcuguuuucuuucuucgu

SEQ ID NO: 33131 - RNA, 16 nt, Artificial Sequence
  Synthetic Oligonucleotide; CD40LG exon 3; Set C
uuucaaagcuguuuuc

SEQ ID NO: 33132 - RNA, 18 nt, Artificial Sequence
  Synthetic Oligonucleotide; CD40LG exon 3; Set C
auuucaaagcuguuuucu

SEQ ID NO: 33133 - RNA, 33 nt, Artificial Sequence
  Synthetic Oligonucleotide; CD40LG exon 3; Set A
cuuuuugcauuucaaagcuguuuucuuucuucg

SEQ ID NO: 33134 - RNA, 17 nt, Artificial Sequence
  Synthetic Oligonucleotide; CD40LG exon 3; Set C
auuucaaagcuguuuuc

SEQ ID NO: 33135 - RNA, 32 nt, Artificial Sequence
  Synthetic Oligonucleotide; CD40LG exon 3; Set A
cuuuuugcauuucaaagcuguuuucuuucuuc

SEQ ID NO: 33136 - RNA, 31 nt, Artificial Sequence
  Synthetic Oligonucleotide; CD40LG exon 3; Set A
cuuuuugcauuucaaagcuguuuucuuucuu

SEQ ID NO: 33137 - RNA, 25 nt, Artificial Sequence
  Synthetic Oligonucleotide; CD40LG exon 3; Set C
uuugcauuucaaagcuguuuucuuu

SEQ ID NO: 33138 - RNA, 30 nt, Artificial Sequence
  Synthetic Oligonucleotide; CD40LG exon 3; Set C
cuuuuugcauuucaaagcuguuuucuuucu

SEQ ID NO: 33139 - RNA, 26 nt, Artificial Sequence
  Synthetic Oligonucleotide; CD40LG exon 3; Set C
uuuugcauuucaaagcuguuuucuuu

SEQ ID NO: 33140 - RNA, 24 nt, Artificial Sequence
  Synthetic Oligonucleotide; CD40LG exon 3; Set C
uuugcauuucaaagcuguuuucuu

SEQ ID NO: 33141 - RNA, 29 nt, Artificial Sequence
  Synthetic Oligonucleotide; CD40LG exon 3; Set C
cuuuuugcauuucaaagcuguuuucuuuc

SEQ ID NO: 33142 - RNA, 27 nt, Artificial Sequence
  Synthetic Oligonucleotide; CD40LG exon 3; Set C
uuuuugcauuucaaagcuguuuucuuu

SEQ ID NO: 33143 - RNA, 25 nt, Artificial Sequence
  Synthetic Oligonucleotide; CD40LG exon 3; Set C
uuuugcauuucaaagcuguuuucuu

SEQ ID NO: 33144 - RNA, 23 nt, Artificial Sequence
  Synthetic Oligonucleotide; CD40LG exon 3; Set C
uuugcauuucaaagcuguuuucu

SEQ ID NO: 33145 - RNA, 24 nt, Artificial Sequence
  Synthetic Oligonucleotide; CD40LG exon 3; Set C
uuuugcauuucaaagcuguuuucu

SEQ ID NO: 33146 - RNA, 26 nt, Artificial Sequence
  Synthetic Oligonucleotide; CD40LG exon 3; Set C
uuuuugcauuucaaagcuguuuucuu

SEQ ID NO: 33147 - RNA, 22 nt, Artificial Sequence
  Synthetic Oligonucleotide; CD40LG exon 3; Set C
uuugcauuucaaagcuguuuuc

SEQ ID NO: 33148 - RNA, 21 nt, Artificial Sequence
  Synthetic Oligonucleotide; CD40LG exon 3; Set C
uuugcauuucaaagcuguuuu

SEQ ID NO: 33149 - RNA, 23 nt, Artificial Sequence
  Synthetic Oligonucleotide; CD40LG exon 3; Set C
uuuugcauuucaaagcuguuuuc

SEQ ID NO: 33150 - RNA, 25 nt, Artificial Sequence
  Synthetic Oligonucleotide; CD40LG exon 3; Set C
uuuuugcauuucaaagcuguuuucu

SEQ ID NO: 33151 - RNA, 24 nt, Artificial Sequence
  Synthetic Oligonucleotide; CD40LG exon 3; Set C
uuuuugcauuucaaagcuguuuuc

SEQ ID NO: 33152 - RNA, 24 nt, Artificial Sequence
  Synthetic Oligonucleotide; CD40LG exon 3; Set C
cuuuuugcauuucaaagcuguuuu

SEQ ID NO: 33153 - RNA, 23 nt, Artificial Sequence
  Synthetic Oligonucleotide; CD40LG exon 3; Set C
cuuuuugcauuucaaagcuguuu

SEQ ID NO: 33154 - RNA, 22 nt, Artificial Sequence
  Synthetic Oligonucleotide; CD40LG exon 3; Set C
cuuuuugcauuucaaagcuguu

SEQ ID NO: 33155 - RNA, 21 nt, Artificial Sequence
  Synthetic Oligonucleotide; CD40LG exon 3; Set C
cuuuuugcauuucaaagcugu

SEQ ID NO: 33156 - RNA, 16 nt, Artificial Sequence
  Synthetic Oligonucleotide; CD40LG exon 3; Set C
cuuuuugcauuucaaa

SEQ ID NO: 33157 - RNA, 15 nt, Artificial Sequence
  Synthetic Oligonucleotide; CD40LG exon 3; Set C
cuuuuugcauuucaa

SEQ ID NO: 33158 - RNA, 37 nt, Artificial Sequence
  Synthetic Oligonucleotide; CD40LG exon 3; Set A
auagcaaaccuaccuuuuugcauuucaaagcuguuuu

SEQ ID NO: 33159 - RNA, 36 nt, Artificial Sequence
  Synthetic Oligonucleotide; CD40LG exon 3; Set A
auagcaaaccuaccuuuuugcauuucaaagcuguuu

SEQ ID NO: 33160 - RNA, 35 nt, Artificial Sequence
  Synthetic Oligonucleotide; CD40LG exon 3; Set A
auagcaaaccuaccuuuuugcauuucaaagcuguu

SEQ ID NO: 33161 - RNA, 34 nt, Artificial Sequence
  Synthetic Oligonucleotide; CD40LG exon 3; Set A
auagcaaaccuaccuuuuugcauuucaaagcugu

SEQ ID NO: 33162 - RNA, 29 nt, Artificial Sequence
  Synthetic Oligonucleotide; CD40LG exon 3; Set C
auagcaaaccuaccuuuuugcauuucaaa

SEQ ID NO: 33163 - RNA, 28 nt, Artificial Sequence
  Synthetic Oligonucleotide; CD40LG exon 3; Set A
auagcaaaccuaccuuuuugcauuucaa

SEQ ID NO: 33164 - RNA, 27 nt, Artificial Sequence
  Synthetic Oligonucleotide; CD40LG exon 3; Set A
auagcaaaccuaccuuuuugcauuuca

SEQ ID NO: 33165 - RNA, 26 nt, Artificial Sequence
  Synthetic Oligonucleotide; CD40LG exon 3; Set C
auagcaaaccuaccuuuuugcauuuc

SEQ ID NO: 33166 - RNA, 36 nt, Artificial Sequence
  Synthetic Oligonucleotide; CD40LG exon 3; Set A
uuagcaaauagcaaaccuaccuuuuugcauuucaaa

SEQ ID NO: 33167 - RNA, 37 nt, Artificial Sequence
  Synthetic Oligonucleotide; CD40LG exon 3; Set A
auuagcaaauagcaaaccuaccuuuuugcauuucaaa

SEQ ID NO: 33168 - RNA, 38 nt, Artificial Sequence
  Synthetic Oligonucleotide; CD40LG exon 3; Set A
aauuagcaaauagcaaaccuaccuuuuugcauuucaaa

SEQ ID NO: 33169 - RNA, 36 nt, Artificial Sequence
  Synthetic Oligonucleotide; CD40LG exon 3; Set A
auuagcaaauagcaaaccuaccuuuuugcauuucaa

SEQ ID NO: 33170 - RNA, 39 nt, Artificial Sequence
  Synthetic Oligonucleotide; CD40LG exon 3; Set A
aaauuagcaaauagcaaaccuaccuuuuugcauuucaaa

SEQ ID NO: 33171 - RNA, 37 nt, Artificial Sequence
  Synthetic Oligonucleotide; CD40LG exon 3; Set A
aauuagcaaauagcaaaccuaccuuuuugcauuucaa

SEQ ID NO: 33172 - RNA, 35 nt, Artificial Sequence
  Synthetic Oligonucleotide; CD40LG exon 3; Set A
auuagcaaauagcaaaccuaccuuuuugcauuuca

SEQ ID NO: 33173 - RNA, 40 nt, Artificial Sequence
  Synthetic Oligonucleotide; CD40LG exon 3; Set A
gaaauuagcaaauagcaaaccuaccuuuuugcauuucaaa

SEQ ID NO: 33174 - RNA, 38 nt, Artificial Sequence
  Synthetic Oligonucleotide; CD40LG exon 3; Set A
aaauuagcaaauagcaaaccuaccuuuuugcauuucaa

SEQ ID NO: 33175 - RNA, 36 nt, Artificial Sequence
  Synthetic Oligonucleotide; CD40LG exon 3; Set A
aauuagcaaauagcaaaccuaccuuuuugcauuuca

SEQ ID NO: 33176 - RNA, 34 nt, Artificial Sequence
  Synthetic Oligonucleotide; CD40LG exon 3; Set A
auuagcaaauagcaaaccuaccuuuuugcauuuc

SEQ ID NO: 33177 - RNA, 33 nt, Artificial Sequence
  Synthetic Oligonucleotide; CD40LG exon 3; Set A
auuagcaaauagcaaaccuaccuuuuugcauuu

SEQ ID NO: 33178 - RNA, 39 nt, Artificial Sequence
  Synthetic Oligonucleotide; CD40LG exon 3; Set A
gaaauuagcaaauagcaaaccuaccuuuuugcauuucaa

SEQ ID NO: 33179 - RNA, 37 nt, Artificial Sequence
  Synthetic Oligonucleotide; CD40LG exon 3; Set A
aaauuagcaaauagcaaaccuaccuuuuugcauuuca

SEQ ID NO: 33180 - RNA, 35 nt, Artificial Sequence
  Synthetic Oligonucleotide; CD40LG exon 3; Set A
aauuagcaaauagcaaaccuaccuuuuugcauuuc

SEQ ID NO: 33181 - RNA, 34 nt, Artificial Sequence
  Synthetic Oligonucleotide; CD40LG exon 3; Set A
aauuagcaaauagcaaaccuaccuuuuugcauuu

SEQ ID NO: 33182 - RNA, 32 nt, Artificial Sequence
  Synthetic Oligonucleotide; CD40LG exon 3; Set A
auuagcaaauagcaaaccuaccuuuuugcauu

SEQ ID NO: 33183 - RNA, 40 nt, Artificial Sequence
  Synthetic Oligonucleotide; CD40LG exon 3; Set A
agaaauuagcaaauagcaaaccuaccuuuuugcauuucaa

SEQ ID NO: 33184 - RNA, 36 nt, Artificial Sequence
  Synthetic Oligonucleotide; CD40LG exon 3; Set A
aaauuagcaaauagcaaaccuaccuuuuugcauuuc

SEQ ID NO: 33185 - RNA, 38 nt, Artificial Sequence
  Synthetic Oligonucleotide; CD40LG exon 3; Set A
gaaauuagcaaauagcaaaccuaccuuuuugcauuuca

SEQ ID NO: 33186 - RNA, 35 nt, Artificial Sequence
  Synthetic Oligonucleotide; CD40LG exon 3; Set A
aaauuagcaaauagcaaaccuaccuuuuugcauuu

SEQ ID NO: 33187 - RNA, 33 nt, Artificial Sequence
  Synthetic Oligonucleotide; CD40LG exon 3; Set A
aauuagcaaauagcaaaccuaccuuuuugcauu

SEQ ID NO: 33188 - RNA, 37 nt, Artificial Sequence
  Synthetic Oligonucleotide; CD40LG exon 3; Set A
gaaauuagcaaauagcaaaccuaccuuuuugcauuuc

SEQ ID NO: 33189 - RNA, 36 nt, Artificial Sequence
  Synthetic Oligonucleotide; CD40LG exon 3; Set A
gaaauuagcaaauagcaaaccuaccuuuuugcauuu

SEQ ID NO: 33190 - RNA, 34 nt, Artificial Sequence
  Synthetic Oligonucleotide; CD40LG exon 3; Set A
aaauuagcaaauagcaaaccuaccuuuuugcauu

SEQ ID NO: 33191 - RNA, 35 nt, Artificial Sequence
  Synthetic Oligonucleotide; CD40LG exon 3; Set A
gaaauuagcaaauagcaaaccuaccuuuuugcauu

SEQ ID NO: 33192 - RNA, 27 nt, Artificial Sequence
  Synthetic Oligonucleotide; CD40LG exon 3; Set C
auuagcaaauagcaaaccuaccuuuuu

SEQ ID NO: 33193 - RNA, 26 nt, Artificial Sequence
  Synthetic Oligonucleotide; CD40LG exon 3; Set C
auuagcaaauagcaaaccuaccuuuu

SEQ ID NO: 33194 - RNA, 28 nt, Artificial Sequence
  Synthetic Oligonucleotide; CD40LG exon 3; Set C
aauuagcaaauagcaaaccuaccuuuuu

SEQ ID NO: 33195 - RNA, 27 nt, Artificial Sequence
  Synthetic Oligonucleotide; CD40LG exon 3; Set C
aauuagcaaauagcaaaccuaccuuuu

SEQ ID NO: 33196 - RNA, 25 nt, Artificial Sequence
  Synthetic Oligonucleotide; CD40LG exon 3; Set C
auuagcaaauagcaaaccuaccuuu

SEQ ID NO: 33197 - RNA, 29 nt, Artificial Sequence
  Synthetic Oligonucleotide; CD40LG exon 3; Set C
aaauuagcaaauagcaaaccuaccuuuuu

SEQ ID NO: 33198 - RNA, 28 nt, Artificial Sequence
  Synthetic Oligonucleotide; CD40LG exon 3; Set C
aaauuagcaaauagcaaaccuaccuuuu

SEQ ID NO: 33199 - RNA, 26 nt, Artificial Sequence
  Synthetic Oligonucleotide; CD40LG exon 3; Set C
aauuagcaaauagcaaaccuaccuuu

SEQ ID NO: 33200 - RNA, 30 nt, Artificial Sequence
  Synthetic Oligonucleotide; CD40LG exon 3; Set C
gaaauuagcaaauagcaaaccuaccuuuuu

SEQ ID NO: 33201 - RNA, 29 nt, Artificial Sequence
  Synthetic Oligonucleotide; CD40LG exon 3; Set C
gaaauuagcaaauagcaaaccuaccuuuu

SEQ ID NO: 33202 - RNA, 27 nt, Artificial Sequence
  Synthetic Oligonucleotide; CD40LG exon 3; Set C
aaauuagcaaauagcaaaccuaccuuu

SEQ ID NO: 33203 - RNA, 28 nt, Artificial Sequence
  Synthetic Oligonucleotide; CD40LG exon 3; Set C
gaaauuagcaaauagcaaaccuaccuuu

SEQ ID NO: 33204 - RNA, 28 nt, Artificial Sequence
  Synthetic Oligonucleotide; CD40LG exon 3; Set C
uuuaggcauucauagaaauuagcaaaua

SEQ ID NO: 33205 - RNA, 29 nt, Artificial Sequence
  Synthetic Oligonucleotide; CD40LG exon 3; Set C
uuuuaggcauucauagaaauuagcaaaua

SEQ ID NO: 33206 - RNA, 30 nt, Artificial Sequence
  Synthetic Oligonucleotide; CD40LG exon 3; Set C
uuuuuaggcauucauagaaauuagcaaaua

SEQ ID NO: 33207 - RNA, 31 nt, Artificial Sequence
  Synthetic Oligonucleotide; CD40LG exon 3; Set C
guuuuuaggcauucauagaaauuagcaaaua

SEQ ID NO: 33208 - RNA, 32 nt, Artificial Sequence
  Synthetic Oligonucleotide; CD40LG exon 3; Set C
aguuuuuaggcauucauagaaauuagcaaaua

SEQ ID NO: 33209 - RNA, 33 nt, Artificial Sequence
  Synthetic Oligonucleotide; CD40LG exon 3; Set C
uaguuuuuaggcauucauagaaauuagcaaaua

SEQ ID NO: 33210 - RNA, 34 nt, Artificial Sequence
  Synthetic Oligonucleotide; CD40LG exon 3; Set C
uuaguuuuuaggcauucauagaaauuagcaaaua

SEQ ID NO: 33211 - RNA, 20 nt, Artificial Sequence
  Synthetic Oligonucleotide; CD40LG exon 3; Set C
uuaggcauucauagaaauua

SEQ ID NO: 33212 - RNA, 19 nt, Artificial Sequence
  Synthetic Oligonucleotide; CD40LG exon 3; Set C
uuaggcauucauagaaauu

SEQ ID NO: 33213 - RNA, 35 nt, Artificial Sequence
  Synthetic Oligonucleotide; CD40LG exon 3; Set C
uuuaguuuuuaggcauucauagaaauuagcaaaua

SEQ ID NO: 33214 - RNA, 21 nt, Artificial Sequence
  Synthetic Oligonucleotide; CD40LG exon 3; Set C
uuuaggcauucauagaaauua

SEQ ID NO: 33215 - RNA, 18 nt, Artificial Sequence
  Synthetic Oligonucleotide; CD40LG exon 3; Set C
uuaggcauucauagaaau

SEQ ID NO: 33216 - RNA, 20 nt, Artificial Sequence
  Synthetic Oligonucleotide; CD40LG exon 3; Set C
uuuaggcauucauagaaauu

SEQ ID NO: 33217 - RNA, 36 nt, Artificial Sequence
  Synthetic Oligonucleotide; CD40LG exon 3; Set C
uuuuaguuuuuaggcauucauagaaauuagcaaaua

SEQ ID NO: 33218 - RNA, 22 nt, Artificial Sequence
  Synthetic Oligonucleotide; CD40LG exon 3; Set C
uuuuaggcauucauagaaauua

SEQ ID NO: 33219 - RNA, 19 nt, Artificial Sequence
  Synthetic Oligonucleotide; CD40LG exon 3; Set C
uuuaggcauucauagaaau

SEQ ID NO: 33220 - RNA, 17 nt, Artificial Sequence
  Synthetic Oligonucleotide; CD40LG exon 3; Set C
uuaggcauucauagaaa

SEQ ID NO: 33221 - RNA, 21 nt, Artificial Sequence
  Synthetic Oligonucleotide; CD40LG exon 3; Set C
uuuuaggcauucauagaaauu

SEQ ID NO: 33222 - RNA, 37 nt, Artificial Sequence
  Synthetic Oligonucleotide; CD40LG exon 3; Set C
cuuuuaguuuuuaggcauucauagaaauuagcaaaua

SEQ ID NO: 33223 - RNA, 23 nt, Artificial Sequence
  Synthetic Oligonucleotide; CD40LG exon 3; Set C
uuuuuaggcauucauagaaauua

SEQ ID NO: 33224 - RNA, 20 nt, Artificial Sequence
  Synthetic Oligonucleotide; CD40LG exon 3; Set C
uuuuaggcauucauagaaau

SEQ ID NO: 33225 - RNA, 18 nt, Artificial Sequence
  Synthetic Oligonucleotide; CD40LG exon 3; Set C
uuuaggcauucauagaaa

SEQ ID NO: 33226 - RNA, 16 nt, Artificial Sequence
  Synthetic Oligonucleotide; CD40LG exon 3; Set C
uuaggcauucauagaa

SEQ ID NO: 33227 - RNA, 22 nt, Artificial Sequence
  Synthetic Oligonucleotide; CD40LG exon 3; Set C
uuuuuaggcauucauagaaauu

SEQ ID NO: 33228 - RNA, 38 nt, Artificial Sequence
  Synthetic Oligonucleotide; CD40LG exon 3; Set B
ccuuuuaguuuuuaggcauucauagaaauuagcaaaua

SEQ ID NO: 33229 - RNA, 24 nt, Artificial Sequence
  Synthetic Oligonucleotide; CD40LG exon 3; Set C
guuuuuaggcauucauagaaauua

SEQ ID NO: 33230 - RNA, 21 nt, Artificial Sequence
  Synthetic Oligonucleotide; CD40LG exon 3; Set C
uuuuuaggcauucauagaaau

SEQ ID NO: 33231 - RNA, 19 nt, Artificial Sequence
  Synthetic Oligonucleotide; CD40LG exon 3; Set C
uuuuaggcauucauagaaa

SEQ ID NO: 33232 - RNA, 17 nt, Artificial Sequence
  Synthetic Oligonucleotide; CD40LG exon 3; Set C
uuuaggcauucauagaa

SEQ ID NO: 33233 - RNA, 23 nt, Artificial Sequence
  Synthetic Oligonucleotide; CD40LG exon 3; Set C
guuuuuaggcauucauagaaauu

SEQ ID NO: 33234 - RNA, 39 nt, Artificial Sequence
  Synthetic Oligonucleotide; CD40LG exon 3; Set B
uccuuuuaguuuuuaggcauucauagaaauuagcaaaua

SEQ ID NO: 33235 - RNA, 25 nt, Artificial Sequence
  Synthetic Oligonucleotide; CD40LG exon 3; Set C
aguuuuuaggcauucauagaaauua

SEQ ID NO: 33236 - RNA, 22 nt, Artificial Sequence
  Synthetic Oligonucleotide; CD40LG exon 3; Set C
guuuuuaggcauucauagaaau

SEQ ID NO: 33237 - RNA, 20 nt, Artificial Sequence
  Synthetic Oligonucleotide; CD40LG exon 3; Set C
uuuuuaggcauucauagaaa

SEQ ID NO: 33238 - RNA, 18 nt, Artificial Sequence
  Synthetic Oligonucleotide; CD40LG exon 3; Set C
uuuuaggcauucauagaa

SEQ ID NO: 33239 - RNA, 24 nt, Artificial Sequence
  Synthetic Oligonucleotide; CD40LG exon 3; Set C
aguuuuuaggcauucauagaaauu

SEQ ID NO: 33240 - RNA, 40 nt, Artificial Sequence
  Synthetic Oligonucleotide; CD40LG exon 3; Set B
uuccuuuuaguuuuuaggcauucauagaaauuagcaaaua

SEQ ID NO: 33241 - RNA, 26 nt, Artificial Sequence
  Synthetic Oligonucleotide; CD40LG exon 3; Set C
uaguuuuuaggcauucauagaaauua

SEQ ID NO: 33242 - RNA, 23 nt, Artificial Sequence
  Synthetic Oligonucleotide; CD40LG exon 3; Set C
aguuuuuaggcauucauagaaau

SEQ ID NO: 33243 - RNA, 21 nt, Artificial Sequence
  Synthetic Oligonucleotide; CD40LG exon 3; Set C
guuuuuaggcauucauagaaa

SEQ ID NO: 33244 - RNA, 19 nt, Artificial Sequence
  Synthetic Oligonucleotide; CD40LG exon 3; Set C
uuuuuaggcauucauagaa

SEQ ID NO: 33245 - RNA, 25 nt, Artificial Sequence
  Synthetic Oligonucleotide; CD40LG exon 3; Set C
uaguuuuuaggcauucauagaaauu

SEQ ID NO: 33246 - RNA, 27 nt, Artificial Sequence
  Synthetic Oligonucleotide; CD40LG exon 3; Set C
uuaguuuuuaggcauucauagaaauua

SEQ ID NO: 33247 - RNA, 22 nt, Artificial Sequence
  Synthetic Oligonucleotide; CD40LG exon 3; Set C
aguuuuuaggcauucauagaaa

SEQ ID NO: 33248 - RNA, 20 nt, Artificial Sequence
  Synthetic Oligonucleotide; CD40LG exon 3; Set C
guuuuuaggcauucauagaa

SEQ ID NO: 33249 - RNA, 26 nt, Artificial Sequence
  Synthetic Oligonucleotide; CD40LG exon 3; Set C
uuaguuuuuaggcauucauagaaauu

SEQ ID NO: 33250 - RNA, 28 nt, Artificial Sequence
  Synthetic Oligonucleotide; CD40LG exon 3; Set C
uuuaguuuuuaggcauucauagaaauua

SEQ ID NO: 33251 - RNA, 18 nt, Artificial Sequence
  Synthetic Oligonucleotide; CD40LG exon 3; Set C
uuuuuaggcauucauaga

SEQ ID NO: 33252 - RNA, 21 nt, Artificial Sequence
  Synthetic Oligonucleotide; CD40LG exon 3; Set C
aguuuuuaggcauucauagaa

SEQ ID NO: 33253 - RNA, 27 nt, Artificial Sequence
  Synthetic Oligonucleotide; CD40LG exon 3; Set C
uuuaguuuuuaggcauucauagaaauu

SEQ ID NO: 33254 - RNA, 29 nt, Artificial Sequence
  Synthetic Oligonucleotide; CD40LG exon 3; Set C
uuuuaguuuuuaggcauucauagaaauua

SEQ ID NO: 33255 - RNA, 19 nt, Artificial Sequence
  Synthetic Oligonucleotide; CD40LG exon 3; Set C
guuuuuaggcauucauaga

SEQ ID NO: 33256 - RNA, 22 nt, Artificial Sequence
  Synthetic Oligonucleotide; CD40LG exon 3; Set C
uaguuuuuaggcauucauagaa

SEQ ID NO: 33257 - RNA, 28 nt, Artificial Sequence
  Synthetic Oligonucleotide; CD40LG exon 3; Set C
uuuuaguuuuuaggcauucauagaaauu

SEQ ID NO: 33258 - RNA, 30 nt, Artificial Sequence
  Synthetic Oligonucleotide; CD40LG exon 3; Set C
cuuuuaguuuuuaggcauucauagaaauua

SEQ ID NO: 33259 - RNA, 20 nt, Artificial Sequence
  Synthetic Oligonucleotide; CD40LG exon 3; Set C
aguuuuuaggcauucauaga

SEQ ID NO: 33260 - RNA, 23 nt, Artificial Sequence
  Synthetic Oligonucleotide; CD40LG exon 3; Set C
uuaguuuuuaggcauucauagaa

SEQ ID NO: 33261 - RNA, 29 nt, Artificial Sequence
  Synthetic Oligonucleotide; CD40LG exon 3; Set C
cuuuuaguuuuuaggcauucauagaaauu

SEQ ID NO: 33262 - RNA, 31 nt, Artificial Sequence
  Synthetic Oligonucleotide; CD40LG exon 3; Set C
ccuuuuaguuuuuaggcauucauagaaauua

SEQ ID NO: 33263 - RNA, 21 nt, Artificial Sequence
  Synthetic Oligonucleotide; CD40LG exon 3; Set C
uaguuuuuaggcauucauaga

SEQ ID NO: 33264 - RNA, 24 nt, Artificial Sequence
  Synthetic Oligonucleotide; CD40LG exon 3; Set C
uuuaguuuuuaggcauucauagaa

SEQ ID NO: 33265 - RNA, 30 nt, Artificial Sequence
  Synthetic Oligonucleotide; CD40LG exon 3; Set C
ccuuuuaguuuuuaggcauucauagaaauu

SEQ ID NO: 33266 - RNA, 32 nt, Artificial Sequence
  Synthetic Oligonucleotide; CD40LG exon 3; Set C
uccuuuuaguuuuuaggcauucauagaaauua

SEQ ID NO: 33267 - RNA, 22 nt, Artificial Sequence
  Synthetic Oligonucleotide; CD40LG exon 3; Set C
uuaguuuuuaggcauucauaga

SEQ ID NO: 33268 - RNA, 25 nt, Artificial Sequence
  Synthetic Oligonucleotide; CD40LG exon 3; Set C
uuuuaguuuuuaggcauucauagaa

SEQ ID NO: 33269 - RNA, 31 nt, Artificial Sequence
  Synthetic Oligonucleotide; CD40LG exon 3; Set C
uccuuuuaguuuuuaggcauucauagaaauu

SEQ ID NO: 33270 - RNA, 33 nt, Artificial Sequence
  Synthetic Oligonucleotide; CD40LG exon 3; Set C
uuccuuuuaguuuuuaggcauucauagaaauua

SEQ ID NO: 33271 - RNA, 23 nt, Artificial Sequence
  Synthetic Oligonucleotide; CD40LG exon 3; Set C
uuuaguuuuuaggcauucauaga

SEQ ID NO: 33272 - RNA, 26 nt, Artificial Sequence
  Synthetic Oligonucleotide; CD40LG exon 3; Set C
cuuuuaguuuuuaggcauucauagaa

SEQ ID NO: 33273 - RNA, 32 nt, Artificial Sequence
  Synthetic Oligonucleotide; CD40LG exon 3; Set C
uuccuuuuaguuuuuaggcauucauagaaauu

SEQ ID NO: 33274 - RNA, 24 nt, Artificial Sequence
  Synthetic Oligonucleotide; CD40LG exon 3; Set C
uuuuaguuuuuaggcauucauaga

SEQ ID NO: 33275 - RNA, 27 nt, Artificial Sequence
  Synthetic Oligonucleotide; CD40LG exon 3; Set C
ccuuuuaguuuuuaggcauucauagaa

SEQ ID NO: 33276 - RNA, 25 nt, Artificial Sequence
  Synthetic Oligonucleotide; CD40LG exon 3; Set C
cuuuuaguuuuuaggcauucauaga

SEQ ID NO: 33277 - RNA, 28 nt, Artificial Sequence
  Synthetic Oligonucleotide; CD40LG exon 3; Set C
uccuuuuaguuuuuaggcauucauagaa

SEQ ID NO: 33278 - RNA, 26 nt, Artificial Sequence
  Synthetic Oligonucleotide; CD40LG exon 3; Set C
ccuuuuaguuuuuaggcauucauaga

SEQ ID NO: 33279 - RNA, 29 nt, Artificial Sequence
  Synthetic Oligonucleotide; CD40LG exon 3; Set C
uuccuuuuaguuuuuaggcauucauagaa

SEQ ID NO: 33280 - RNA, 27 nt, Artificial Sequence
  Synthetic Oligonucleotide; CD40LG exon 3; Set C
uccuuuuaguuuuuaggcauucauaga

SEQ ID NO: 33281 - RNA, 15 nt, Artificial Sequence
  Synthetic Oligonucleotide; CD40LG exon 3; Set C
uaguuuuuaggcauu

SEQ ID NO: 33282 - RNA, 28 nt, Artificial Sequence
  Synthetic Oligonucleotide; CD40LG exon 3; Set C
uuccuuuuaguuuuuaggcauucauaga

SEQ ID NO: 33283 - RNA, 16 nt, Artificial Sequence
  Synthetic Oligonucleotide; CD40LG exon 3; Set C
uuaguuuuuaggcauu

SEQ ID NO: 33284 - RNA, 17 nt, Artificial Sequence
  Synthetic Oligonucleotide; CD40LG exon 3; Set C
uuuaguuuuuaggcauu

SEQ ID NO: 33285 - RNA, 18 nt, Artificial Sequence
  Synthetic Oligonucleotide; CD40LG exon 3; Set C
uuuuaguuuuuaggcauu

SEQ ID NO: 33286 - RNA, 19 nt, Artificial Sequence
  Synthetic Oligonucleotide; CD40LG exon 3; Set C
cuuuuaguuuuuaggcauu

SEQ ID NO: 33287 - RNA, 20 nt, Artificial Sequence
  Synthetic Oligonucleotide; CD40LG exon 3; Set C
ccuuuuaguuuuuaggcauu

SEQ ID NO: 33288 - RNA, 21 nt, Artificial Sequence
  Synthetic Oligonucleotide; CD40LG exon 3; Set C
uccuuuuaguuuuuaggcauu

SEQ ID NO: 33289 - RNA, 22 nt, Artificial Sequence
  Synthetic Oligonucleotide; CD40LG exon 3; Set C
uuccuuuuaguuuuuaggcauu

SEQ ID NO: 33290 - RNA, 20 nt, Artificial Sequence
  Synthetic Oligonucleotide; CD40LG exon 3; Set A
uuugacaggggcucugcugu

SEQ ID NO: 33291 - RNA, 19 nt, Artificial Sequence
  Synthetic Oligonucleotide; CD40LG exon 3; Set A
uuugacaggggcucugcug

SEQ ID NO: 33292 - RNA, 20 nt, Artificial Sequence
  Synthetic Oligonucleotide; CD40LG exon 3; Set A
uuuugacaggggcucugcug

SEQ ID NO: 33293 - RNA, 21 nt, Artificial Sequence
  Synthetic Oligonucleotide; CD40LG exon 3; Set A
auuuugacaggggcucugcug

SEQ ID NO: 33294 - RNA, 30 nt, Artificial Sequence
  Synthetic Oligonucleotide; CD40LG exon 3; Set C
agaggucauuuugacaggggcucugcugug

SEQ ID NO: 33295 - RNA, 28 nt, Artificial Sequence
  Synthetic Oligonucleotide; CD40LG exon 3; Set C
gaggucauuuugacaggggcucugcugu

SEQ ID NO: 33296 - RNA, 31 nt, Artificial Sequence
  Synthetic Oligonucleotide; CD40LG exon 3; Set C
aagaggucauuuugacaggggcucugcugug

SEQ ID NO: 33297 - RNA, 29 nt, Artificial Sequence
  Synthetic Oligonucleotide; CD40LG exon 3; Set C
agaggucauuuugacaggggcucugcugu

SEQ ID NO: 33298 - RNA, 27 nt, Artificial Sequence
  Synthetic Oligonucleotide; CD40LG exon 3; Set C
gaggucauuuugacaggggcucugcug

SEQ ID NO: 33299 - RNA, 30 nt, Artificial Sequence
  Synthetic Oligonucleotide; CD40LG exon 3; Set C
aagaggucauuuugacaggggcucugcugu

SEQ ID NO: 33300 - RNA, 18 nt, Artificial Sequence
  Synthetic Oligonucleotide; CD40LG exon 3; Set C
gaggucauuuugacaggg

SEQ ID NO: 33301 - RNA, 17 nt, Artificial Sequence
  Synthetic Oligonucleotide; CD40LG exon 3; Set C
gaggucauuuugacagg

SEQ ID NO: 33302 - RNA, 34 nt, Artificial Sequence
  Synthetic Oligonucleotide; CD40LG exon 3; Set A
auaagaagcauugcaagaggucauuuugacaggg

SEQ ID NO: 33303 - RNA, 33 nt, Artificial Sequence
  Synthetic Oligonucleotide; CD40LG exon 3; Set A
auaagaagcauugcaagaggucauuuugacagg

SEQ ID NO: 33304 - RNA, 35 nt, Artificial Sequence
  Synthetic Oligonucleotide; CD40LG exon 3; Set A
aauaagaagcauugcaagaggucauuuugacaggg

SEQ ID NO: 33305 - RNA, 34 nt, Artificial Sequence
  Synthetic Oligonucleotide; CD40LG exon 3; Set A
aauaagaagcauugcaagaggucauuuugacagg

SEQ ID NO: 33306 - RNA, 36 nt, Artificial Sequence
  Synthetic Oligonucleotide; CD40LG exon 3; Set A
aaauaagaagcauugcaagaggucauuuugacaggg

SEQ ID NO: 33307 - RNA, 35 nt, Artificial Sequence
  Synthetic Oligonucleotide; CD40LG exon 3; Set A
aaauaagaagcauugcaagaggucauuuugacagg

SEQ ID NO: 33308 - RNA, 37 nt, Artificial Sequence
  Synthetic Oligonucleotide; CD40LG exon 3; Set A
aaaauaagaagcauugcaagaggucauuuugacaggg

SEQ ID NO: 33309 - RNA, 24 nt, Artificial Sequence
  Synthetic Oligonucleotide; CD40LG exon 3; Set C
agaagcauugcaagaggucauuuu

SEQ ID NO: 33310 - RNA, 36 nt, Artificial Sequence
  Synthetic Oligonucleotide; CD40LG exon 3; Set A
aaaauaagaagcauugcaagaggucauuuugacagg

SEQ ID NO: 33311 - RNA, 38 nt, Artificial Sequence
  Synthetic Oligonucleotide; CD40LG exon 3; Set A
uaaaauaagaagcauugcaagaggucauuuugacaggg

SEQ ID NO: 33312 - RNA, 25 nt, Artificial Sequence
  Synthetic Oligonucleotide; CD40LG exon 3; Set C
aagaagcauugcaagaggucauuuu

SEQ ID NO: 33313 - RNA, 23 nt, Artificial Sequence
  Synthetic Oligonucleotide; CD40LG exon 3; Set C
agaagcauugcaagaggucauuu

SEQ ID NO: 33314 - RNA, 37 nt, Artificial Sequence
  Synthetic Oligonucleotide; CD40LG exon 3; Set A
uaaaauaagaagcauugcaagaggucauuuugacagg

SEQ ID NO: 33315 - RNA, 26 nt, Artificial Sequence
  Synthetic Oligonucleotide; CD40LG exon 3; Set C
uaagaagcauugcaagaggucauuuu

SEQ ID NO: 33316 - RNA, 24 nt, Artificial Sequence
  Synthetic Oligonucleotide; CD40LG exon 3; Set C
aagaagcauugcaagaggucauuu

SEQ ID NO: 33317 - RNA, 22 nt, Artificial Sequence
  Synthetic Oligonucleotide; CD40LG exon 3; Set C
agaagcauugcaagaggucauu

SEQ ID NO: 33318 - RNA, 25 nt, Artificial Sequence
  Synthetic Oligonucleotide; CD40LG exon 3; Set C
uaagaagcauugcaagaggucauuu

SEQ ID NO: 33319 - RNA, 23 nt, Artificial Sequence
  Synthetic Oligonucleotide; CD40LG exon 3; Set C
aagaagcauugcaagaggucauu

SEQ ID NO: 33320 - RNA, 24 nt, Artificial Sequence
  Synthetic Oligonucleotide; CD40LG exon 3; Set C
uaagaagcauugcaagaggucauu

SEQ ID NO: 33321 - RNA, 32 nt, Artificial Sequence
  Synthetic Oligonucleotide; CD40LG exon 3; Set C
cuaaaauaagaagcauugcaagaggucauuuu

SEQ ID NO: 33322 - RNA, 16 nt, Artificial Sequence
  Synthetic Oligonucleotide; CD40LG exon 3; Set C
agaagcauugcaagag

SEQ ID NO: 33323 - RNA, 31 nt, Artificial Sequence
  Synthetic Oligonucleotide; CD40LG exon 3; Set C
cuaaaauaagaagcauugcaagaggucauuu

SEQ ID NO: 33324 - RNA, 17 nt, Artificial Sequence
  Synthetic Oligonucleotide; CD40LG exon 3; Set C
aagaagcauugcaagag

SEQ ID NO: 33325 - RNA, 30 nt, Artificial Sequence
  Synthetic Oligonucleotide; CD40LG exon 3; Set C
cuaaaauaagaagcauugcaagaggucauu

SEQ ID NO: 33326 - RNA, 18 nt, Artificial Sequence
  Synthetic Oligonucleotide; CD40LG exon 3; Set C
uaagaagcauugcaagag

SEQ ID NO: 33327 - RNA, 18 nt, Artificial Sequence
  Synthetic Oligonucleotide; CD40LG exon 3; Set C
auaagaagcauugcaaga

SEQ ID NO: 33328 - RNA, 19 nt, Artificial Sequence
  Synthetic Oligonucleotide; CD40LG exon 3; Set C
aauaagaagcauugcaaga

SEQ ID NO: 33329 - RNA, 17 nt, Artificial Sequence
  Synthetic Oligonucleotide; CD40LG exon 3; Set C
auaagaagcauugcaag

SEQ ID NO: 33330 - RNA, 22 nt, Artificial Sequence
  Synthetic Oligonucleotide; CD40LG exon 3; Set C
aaaauaagaagcauugcaagag

SEQ ID NO: 33331 - RNA, 20 nt, Artificial Sequence
  Synthetic Oligonucleotide; CD40LG exon 3; Set C
aaauaagaagcauugcaaga

SEQ ID NO: 33332 - RNA, 18 nt, Artificial Sequence
  Synthetic Oligonucleotide; CD40LG exon 3; Set C
aauaagaagcauugcaag

SEQ ID NO: 33333 - RNA, 37 nt, Artificial Sequence
  Synthetic Oligonucleotide; CD40LG exon 3; Set A
uauauccuaaaauaagaagcauugcaagaggucauuu

SEQ ID NO: 33334 - RNA, 23 nt, Artificial Sequence
  Synthetic Oligonucleotide; CD40LG exon 3; Set C
uaaaauaagaagcauugcaagag

SEQ ID NO: 33335 - RNA, 21 nt, Artificial Sequence
  Synthetic Oligonucleotide; CD40LG exon 3; Set C
aaaauaagaagcauugcaaga

SEQ ID NO: 33336 - RNA, 19 nt, Artificial Sequence
  Synthetic Oligonucleotide; CD40LG exon 3; Set C
aaauaagaagcauugcaag

SEQ ID NO: 33337 - RNA, 36 nt, Artificial Sequence
  Synthetic Oligonucleotide; CD40LG exon 3; Set A
uauauccuaaaauaagaagcauugcaagaggucauu

SEQ ID NO: 33338 - RNA, 40 nt, Artificial Sequence
  Synthetic Oligonucleotide; CD40LG exon 3; Set A
auuauauccuaaaauaagaagcauugcaagaggucauuuu

SEQ ID NO: 33339 - RNA, 24 nt, Artificial Sequence
  Synthetic Oligonucleotide; CD40LG exon 3; Set C
cuaaaauaagaagcauugcaagag

SEQ ID NO: 33340 - RNA, 22 nt, Artificial Sequence
  Synthetic Oligonucleotide; CD40LG exon 3; Set C
uaaaauaagaagcauugcaaga

SEQ ID NO: 33341 - RNA, 20 nt, Artificial Sequence
  Synthetic Oligonucleotide; CD40LG exon 3; Set C
aaaauaagaagcauugcaag

SEQ ID NO: 33342 - RNA, 37 nt, Artificial Sequence
  Synthetic Oligonucleotide; CD40LG exon 3; Set A
uuauauccuaaaauaagaagcauugcaagaggucauu

SEQ ID NO: 33343 - RNA, 39 nt, Artificial Sequence
  Synthetic Oligonucleotide; CD40LG exon 3; Set A
auuauauccuaaaauaagaagcauugcaagaggucauuu

SEQ ID NO: 33344 - RNA, 21 nt, Artificial Sequence
  Synthetic Oligonucleotide; CD40LG exon 3; Set C
uaaaauaagaagcauugcaag

SEQ ID NO: 33345 - RNA, 38 nt, Artificial Sequence
  Synthetic Oligonucleotide; CD40LG exon 3; Set A
auuauauccuaaaauaagaagcauugcaagaggucauu

SEQ ID NO: 33346 - RNA, 29 nt, Artificial Sequence
  Synthetic Oligonucleotide; CD40LG exon 3; Set C
auauccuaaaauaagaagcauugcaagag

SEQ ID NO: 33347 - RNA, 30 nt, Artificial Sequence
  Synthetic Oligonucleotide; CD40LG exon 3; Set C
uauauccuaaaauaagaagcauugcaagag

SEQ ID NO: 33348 - RNA, 28 nt, Artificial Sequence
  Synthetic Oligonucleotide; CD40LG exon 3; Set C
auauccuaaaauaagaagcauugcaaga

SEQ ID NO: 33349 - RNA, 31 nt, Artificial Sequence
  Synthetic Oligonucleotide; CD40LG exon 3; Set C
uuauauccuaaaauaagaagcauugcaagag

SEQ ID NO: 33350 - RNA, 29 nt, Artificial Sequence
  Synthetic Oligonucleotide; CD40LG exon 3; Set C
uauauccuaaaauaagaagcauugcaaga

SEQ ID NO: 33351 - RNA, 27 nt, Artificial Sequence
  Synthetic Oligonucleotide; CD40LG exon 3; Set C
auauccuaaaauaagaagcauugcaag

SEQ ID NO: 33352 - RNA, 32 nt, Artificial Sequence
  Synthetic Oligonucleotide; CD40LG exon 3; Set C
auuauauccuaaaauaagaagcauugcaagag

SEQ ID NO: 33353 - RNA, 30 nt, Artificial Sequence
  Synthetic Oligonucleotide; CD40LG exon 3; Set C
uuauauccuaaaauaagaagcauugcaaga

SEQ ID NO: 33354 - RNA, 29 nt, Artificial Sequence
  Synthetic Oligonucleotide; CD40LG exon 3; Set C
uuauauccuaaaauaagaagcauugcaag

SEQ ID NO: 33355 - RNA, 37 nt, Artificial Sequence
  Synthetic Oligonucleotide; CD40LG exon 3; Set C
uuaacauuauauccuaaaauaagaagcauugcaagag

SEQ ID NO: 33356 - RNA, 36 nt, Artificial Sequence
  Synthetic Oligonucleotide; CD40LG exon 3; Set C
uuaacauuauauccuaaaauaagaagcauugcaaga

SEQ ID NO: 33357 - RNA, 39 nt, Artificial Sequence
  Synthetic Oligonucleotide; CD40LG exon 3; Set C
guuuaacauuauauccuaaaauaagaagcauugcaagag

SEQ ID NO: 33358 - RNA, 37 nt, Artificial Sequence
  Synthetic Oligonucleotide; CD40LG exon 3; Set C
uuuaacauuauauccuaaaauaagaagcauugcaaga

SEQ ID NO: 33359 - RNA, 35 nt, Artificial Sequence
  Synthetic Oligonucleotide; CD40LG exon 3; Set C
uuaacauuauauccuaaaauaagaagcauugcaag

SEQ ID NO: 33360 - RNA, 40 nt, Artificial Sequence
  Synthetic Oligonucleotide; CD40LG exon 3; Set A
uguuuaacauuauauccuaaaauaagaagcauugcaagag

SEQ ID NO: 33361 - RNA, 38 nt, Artificial Sequence
  Synthetic Oligonucleotide; CD40LG exon 3; Set C
guuuaacauuauauccuaaaauaagaagcauugcaaga

SEQ ID NO: 33362 - RNA, 36 nt, Artificial Sequence
  Synthetic Oligonucleotide; CD40LG exon 3; Set C
uuuaacauuauauccuaaaauaagaagcauugcaag

SEQ ID NO: 33363 - RNA, 39 nt, Artificial Sequence
  Synthetic Oligonucleotide; CD40LG exon 3; Set A
uguuuaacauuauauccuaaaauaagaagcauugcaaga

SEQ ID NO: 33364 - RNA, 37 nt, Artificial Sequence
  Synthetic Oligonucleotide; CD40LG exon 3; Set C
guuuaacauuauauccuaaaauaagaagcauugcaag

SEQ ID NO: 33365 - RNA, 40 nt, Artificial Sequence
  Synthetic Oligonucleotide; CD40LG exon 3; Set A
uuguuuaacauuauauccuaaaauaagaagcauugcaaga

SEQ ID NO: 33366 - RNA, 38 nt, Artificial Sequence
  Synthetic Oligonucleotide; CD40LG exon 3; Set C
uguuuaacauuauauccuaaaauaagaagcauugcaag

SEQ ID NO: 33367 - RNA, 16 nt, Artificial Sequence
  Synthetic Oligonucleotide; CD40LG exon 3; Set C
auauccuaaaauaaga

SEQ ID NO: 33368 - RNA, 39 nt, Artificial Sequence
  Synthetic Oligonucleotide; CD40LG exon 3; Set C
uuguuuaacauuauauccuaaaauaagaagcauugcaag

SEQ ID NO: 33369 - RNA, 15 nt, Artificial Sequence
  Synthetic Oligonucleotide; CD40LG exon 3; Set C
auauccuaaaauaag

SEQ ID NO: 33370 - RNA, 17 nt, Artificial Sequence
  Synthetic Oligonucleotide; CD40LG exon 3; Set C
uauauccuaaaauaaga

SEQ ID NO: 33371 - RNA, 40 nt, Artificial Sequence
  Synthetic Oligonucleotide; CD40LG exon 3; Set C
uuuguuuaacauuauauccuaaaauaagaagcauugcaag

SEQ ID NO: 33372 - RNA, 18 nt, Artificial Sequence
  Synthetic Oligonucleotide; CD40LG exon 3; Set C
uuauauccuaaaauaaga

SEQ ID NO: 33373 - RNA, 16 nt, Artificial Sequence
  Synthetic Oligonucleotide; CD40LG exon 3; Set C
uauauccuaaaauaag

SEQ ID NO: 33374 - RNA, 15 nt, Artificial Sequence
  Synthetic Oligonucleotide; CD40LG exon 3; Set C
uauauccuaaaauaa

SEQ ID NO: 33375 - RNA, 17 nt, Artificial Sequence
  Synthetic Oligonucleotide; CD40LG exon 3; Set C
uuauauccuaaaauaag

SEQ ID NO: 33376 - RNA, 16 nt, Artificial Sequence
  Synthetic Oligonucleotide; CD40LG exon 3; Set C
uuauauccuaaaauaa

SEQ ID NO: 33377 - RNA, 16 nt, Artificial Sequence
  Synthetic Oligonucleotide; CD40LG exon 3; Set C
auuauauccuaaaaua

SEQ ID NO: 33378 - RNA, 15 nt, Artificial Sequence
  Synthetic Oligonucleotide; CD40LG exon 3; Set C
auuauauccuaaaau

SEQ ID NO: 33379 - RNA, 24 nt, Artificial Sequence
  Synthetic Oligonucleotide; CD40LG exon 3; Set C
uuaacauuauauccuaaaauaaga

SEQ ID NO: 33380 - RNA, 23 nt, Artificial Sequence
  Synthetic Oligonucleotide; CD40LG exon 3; Set C
uuaacauuauauccuaaaauaag

SEQ ID NO: 33381 - RNA, 22 nt, Artificial Sequence
  Synthetic Oligonucleotide; CD40LG exon 3; Set C
uuaacauuauauccuaaaauaa

SEQ ID NO: 33382 - RNA, 26 nt, Artificial Sequence
  Synthetic Oligonucleotide; CD40LG exon 3; Set C
guuuaacauuauauccuaaaauaaga

SEQ ID NO: 33383 - RNA, 27 nt, Artificial Sequence
  Synthetic Oligonucleotide; CD40LG exon 3; Set C
uguuuaacauuauauccuaaaauaaga

SEQ ID NO: 33384 - RNA, 25 nt, Artificial Sequence
  Synthetic Oligonucleotide; CD40LG exon 3; Set C
guuuaacauuauauccuaaaauaag

SEQ ID NO: 33385 - RNA, 24 nt, Artificial Sequence
  Synthetic Oligonucleotide; CD40LG exon 3; Set C
guuuaacauuauauccuaaaauaa

SEQ ID NO: 33386 - RNA, 28 nt, Artificial Sequence
  Synthetic Oligonucleotide; CD40LG exon 3; Set C
uuguuuaacauuauauccuaaaauaaga

SEQ ID NO: 33387 - RNA, 26 nt, Artificial Sequence
  Synthetic Oligonucleotide; CD40LG exon 3; Set C
uguuuaacauuauauccuaaaauaag

SEQ ID NO: 33388 - RNA, 25 nt, Artificial Sequence
  Synthetic Oligonucleotide; CD40LG exon 3; Set C
uguuuaacauuauauccuaaaauaa

SEQ ID NO: 33389 - RNA, 29 nt, Artificial Sequence
  Synthetic Oligonucleotide; CD40LG exon 3; Set C
uuuguuuaacauuauauccuaaaauaaga

SEQ ID NO: 33390 - RNA, 27 nt, Artificial Sequence
  Synthetic Oligonucleotide; CD40LG exon 3; Set C
uuguuuaacauuauauccuaaaauaag

SEQ ID NO: 33391 - RNA, 18 nt, Artificial Sequence
  Synthetic Oligonucleotide; CD40LG exon 3; Set C
uuaacauuauauccuaaa

SEQ ID NO: 33392 - RNA, 26 nt, Artificial Sequence
  Synthetic Oligonucleotide; CD40LG exon 3; Set C
uuguuuaacauuauauccuaaaauaa

SEQ ID NO: 33393 - RNA, 28 nt, Artificial Sequence
  Synthetic Oligonucleotide; CD40LG exon 3; Set C
uuuguuuaacauuauauccuaaaauaag

SEQ ID NO: 33394 - RNA, 17 nt, Artificial Sequence
  Synthetic Oligonucleotide; CD40LG exon 3; Set C
uuaacauuauauccuaa

SEQ ID NO: 33395 - RNA, 27 nt, Artificial Sequence
  Synthetic Oligonucleotide; CD40LG exon 3; Set C
uuuguuuaacauuauauccuaaaauaa

SEQ ID NO: 33396 - RNA, 20 nt, Artificial Sequence
  Synthetic Oligonucleotide; CD40LG exon 3; Set C
guuuaacauuauauccuaaa

SEQ ID NO: 33397 - RNA, 21 nt, Artificial Sequence
  Synthetic Oligonucleotide; CD40LG exon 3; Set C
uguuuaacauuauauccuaaa

SEQ ID NO: 33398 - RNA, 19 nt, Artificial Sequence
  Synthetic Oligonucleotide; CD40LG exon 3; Set C
guuuaacauuauauccuaa

SEQ ID NO: 33399 - RNA, 17 nt, Artificial Sequence
  Synthetic Oligonucleotide; CD40LG exon 3; Set C
uuuaacauuauauccua

SEQ ID NO: 33400 - RNA, 22 nt, Artificial Sequence
  Synthetic Oligonucleotide; CD40LG exon 3; Set C
uuguuuaacauuauauccuaaa

SEQ ID NO: 33401 - RNA, 20 nt, Artificial Sequence
  Synthetic Oligonucleotide; CD40LG exon 3; Set C
uguuuaacauuauauccuaa

SEQ ID NO: 33402 - RNA, 23 nt, Artificial Sequence
  Synthetic Oligonucleotide; CD40LG exon 3; Set C
uuuguuuaacauuauauccuaaa

SEQ ID NO: 33403 - RNA, 21 nt, Artificial Sequence
  Synthetic Oligonucleotide; CD40LG exon 3; Set C
uuguuuaacauuauauccuaa

SEQ ID NO: 33404 - RNA, 22 nt, Artificial Sequence
  Synthetic Oligonucleotide; CD40LG exon 3; Set C
uuuguuuaacauuauauccuaa

SEQ ID NO: 33405 - RNA, 36 nt, Artificial Sequence
  Synthetic Oligonucleotide; CD40LG exon 3; Set C
ucuccucuuuguuuaacauuauauccuaaaauaaga

SEQ ID NO: 33406 - RNA, 20 nt, Artificial Sequence
  Synthetic Oligonucleotide; CD40LG exon 3; Set C
uuguuuaacauuauauccua

SEQ ID NO: 33407 - RNA, 35 nt, Artificial Sequence
  Synthetic Oligonucleotide; CD40LG exon 3; Set C
ucuccucuuuguuuaacauuauauccuaaaauaag

SEQ ID NO: 33408 - RNA, 37 nt, Artificial Sequence
  Synthetic Oligonucleotide; CD40LG exon 3; Set A
gucuccucuuuguuuaacauuauauccuaaaauaaga

SEQ ID NO: 33409 - RNA, 21 nt, Artificial Sequence
  Synthetic Oligonucleotide; CD40LG exon 3; Set C
uuuguuuaacauuauauccua

SEQ ID NO: 33410 - RNA, 32 nt, Artificial Sequence
  Synthetic Oligonucleotide; CD40LG exon 3; Set C
cuccucuuuguuuaacauuauauccuaaaaua

SEQ ID NO: 33411 - RNA, 34 nt, Artificial Sequence
  Synthetic Oligonucleotide; CD40LG exon 3; Set C
ucuccucuuuguuuaacauuauauccuaaaauaa

SEQ ID NO: 33412 - RNA, 36 nt, Artificial Sequence
  Synthetic Oligonucleotide; CD40LG exon 3; Set C
gucuccucuuuguuuaacauuauauccuaaaauaag

SEQ ID NO: 33413 - RNA, 38 nt, Artificial Sequence
  Synthetic Oligonucleotide; CD40LG exon 3; Set A
cgucuccucuuuguuuaacauuauauccuaaaauaaga

SEQ ID NO: 33414 - RNA, 31 nt, Artificial Sequence
  Synthetic Oligonucleotide; CD40LG exon 3; Set C
cuccucuuuguuuaacauuauauccuaaaau

SEQ ID NO: 33415 - RNA, 35 nt, Artificial Sequence
  Synthetic Oligonucleotide; CD40LG exon 3; Set C
gucuccucuuuguuuaacauuauauccuaaaauaa

SEQ ID NO: 33416 - RNA, 39 nt, Artificial Sequence
  Synthetic Oligonucleotide; CD40LG exon 3; Set A
ucgucuccucuuuguuuaacauuauauccuaaaauaaga

SEQ ID NO: 33417 - RNA, 37 nt, Artificial Sequence
  Synthetic Oligonucleotide; CD40LG exon 3; Set A
cgucuccucuuuguuuaacauuauauccuaaaauaag

SEQ ID NO: 33418 - RNA, 32 nt, Artificial Sequence
  Synthetic Oligonucleotide; CD40LG exon 3; Set C
ucuccucuuuguuuaacauuauauccuaaaau

SEQ ID NO: 33419 - RNA, 30 nt, Artificial Sequence
  Synthetic Oligonucleotide; CD40LG exon 3; Set C
cuccucuuuguuuaacauuauauccuaaaa

SEQ ID NO: 33420 - RNA, 36 nt, Artificial Sequence
  Synthetic Oligonucleotide; CD40LG exon 3; Set A
cgucuccucuuuguuuaacauuauauccuaaaauaa

SEQ ID NO: 33421 - RNA, 40 nt, Artificial Sequence
  Synthetic Oligonucleotide; CD40LG exon 3; Set A
uucgucuccucuuuguuuaacauuauauccuaaaauaaga

SEQ ID NO: 33422 - RNA, 38 nt, Artificial Sequence
  Synthetic Oligonucleotide; CD40LG exon 3; Set A
ucgucuccucuuuguuuaacauuauauccuaaaauaag

SEQ ID NO: 33423 - RNA, 31 nt, Artificial Sequence
  Synthetic Oligonucleotide; CD40LG exon 3; Set C
ucuccucuuuguuuaacauuauauccuaaaa

SEQ ID NO: 33424 - RNA, 33 nt, Artificial Sequence
  Synthetic Oligonucleotide; CD40LG exon 3; Set C
gucuccucuuuguuuaacauuauauccuaaaau

SEQ ID NO: 33425 - RNA, 37 nt, Artificial Sequence
  Synthetic Oligonucleotide; CD40LG exon 3; Set A
ucgucuccucuuuguuuaacauuauauccuaaaauaa

SEQ ID NO: 33426 - RNA, 39 nt, Artificial Sequence
  Synthetic Oligonucleotide; CD40LG exon 3; Set A
uucgucuccucuuuguuuaacauuauauccuaaaauaag

SEQ ID NO: 33427 - RNA, 32 nt, Artificial Sequence
  Synthetic Oligonucleotide; CD40LG exon 3; Set C
gucuccucuuuguuuaacauuauauccuaaaa

SEQ ID NO: 33428 - RNA, 30 nt, Artificial Sequence
  Synthetic Oligonucleotide; CD40LG exon 3; Set C
ucuccucuuuguuuaacauuauauccuaaa

SEQ ID NO: 33429 - RNA, 38 nt, Artificial Sequence
  Synthetic Oligonucleotide; CD40LG exon 3; Set A
uucgucuccucuuuguuuaacauuauauccuaaaauaa

SEQ ID NO: 33430 - RNA, 40 nt, Artificial Sequence
  Synthetic Oligonucleotide; CD40LG exon 3; Set A
cuucgucuccucuuuguuuaacauuauauccuaaaauaag

SEQ ID NO: 33431 - RNA, 33 nt, Artificial Sequence
  Synthetic Oligonucleotide; CD40LG exon 3; Set A
cgucuccucuuuguuuaacauuauauccuaaaa

SEQ ID NO: 33432 - RNA, 31 nt, Artificial Sequence
  Synthetic Oligonucleotide; CD40LG exon 3; Set C
gucuccucuuuguuuaacauuauauccuaaa

SEQ ID NO: 33433 - RNA, 29 nt, Artificial Sequence
  Synthetic Oligonucleotide; CD40LG exon 3; Set C
ucuccucuuuguuuaacauuauauccuaa

SEQ ID NO: 33434 - RNA, 39 nt, Artificial Sequence
  Synthetic Oligonucleotide; CD40LG exon 3; Set A
cuucgucuccucuuuguuuaacauuauauccuaaaauaa

SEQ ID NO: 33435 - RNA, 32 nt, Artificial Sequence
  Synthetic Oligonucleotide; CD40LG exon 3; Set A
cgucuccucuuuguuuaacauuauauccuaaa

SEQ ID NO: 33436 - RNA, 30 nt, Artificial Sequence
  Synthetic Oligonucleotide; CD40LG exon 3; Set C
gucuccucuuuguuuaacauuauauccuaa

SEQ ID NO: 33437 - RNA, 40 nt, Artificial Sequence
  Synthetic Oligonucleotide; CD40LG exon 3; Set A
ucuucgucuccucuuuguuuaacauuauauccuaaaauaa

SEQ ID NO: 33438 - RNA, 33 nt, Artificial Sequence
  Synthetic Oligonucleotide; CD40LG exon 3; Set A
ucgucuccucuuuguuuaacauuauauccuaaa

SEQ ID NO: 33439 - RNA, 31 nt, Artificial Sequence
  Synthetic Oligonucleotide; CD40LG exon 3; Set A
cgucuccucuuuguuuaacauuauauccuaa

SEQ ID NO: 33440 - RNA, 34 nt, Artificial Sequence
  Synthetic Oligonucleotide; CD40LG exon 3; Set A
uucgucuccucuuuguuuaacauuauauccuaaa

SEQ ID NO: 33441 - RNA, 32 nt, Artificial Sequence
  Synthetic Oligonucleotide; CD40LG exon 3; Set A
ucgucuccucuuuguuuaacauuauauccuaa

SEQ ID NO: 33442 - RNA, 33 nt, Artificial Sequence
  Synthetic Oligonucleotide; CD40LG exon 3; Set A
uucgucuccucuuuguuuaacauuauauccuaa

SEQ ID NO: 33443 - RNA, 22 nt, Artificial Sequence
  Synthetic Oligonucleotide; CD40LG exon 3; Set C
cuccucuuuguuuaacauuaua

SEQ ID NO: 33444 - RNA, 32 nt, Artificial Sequence
  Synthetic Oligonucleotide; CD40LG exon 3; Set A
uucgucuccucuuuguuuaacauuauauccua

SEQ ID NO: 33445 - RNA, 23 nt, Artificial Sequence
  Synthetic Oligonucleotide; CD40LG exon 3; Set C
ucuccucuuuguuuaacauuaua

SEQ ID NO: 33446 - RNA, 33 nt, Artificial Sequence
  Synthetic Oligonucleotide; CD40LG exon 3; Set A
cuucgucuccucuuuguuuaacauuauauccua

SEQ ID NO: 33447 - RNA, 24 nt, Artificial Sequence
  Synthetic Oligonucleotide; CD40LG exon 3; Set C
gucuccucuuuguuuaacauuaua

SEQ ID NO: 33448 - RNA, 38 nt, Artificial Sequence
  Synthetic Oligonucleotide; CD40LG exon 3; Set A
uuucuucgucuccucuuuguuuaacauuauauccuaaa

SEQ ID NO: 33449 - RNA, 22 nt, Artificial Sequence
  Synthetic Oligonucleotide; CD40LG exon 3; Set C
ucuccucuuuguuuaacauuau

SEQ ID NO: 33450 - RNA, 34 nt, Artificial Sequence
  Synthetic Oligonucleotide; CD40LG exon 3; Set A
ucuucgucuccucuuuguuuaacauuauauccua

SEQ ID NO: 33451 - RNA, 25 nt, Artificial Sequence
  Synthetic Oligonucleotide; CD40LG exon 3; Set C
cgucuccucuuuguuuaacauuaua

SEQ ID NO: 33452 - RNA, 39 nt, Artificial Sequence
  Synthetic Oligonucleotide; CD40LG exon 3; Set A
cuuucuucgucuccucuuuguuuaacauuauauccuaaa

SEQ ID NO: 33453 - RNA, 37 nt, Artificial Sequence
  Synthetic Oligonucleotide; CD40LG exon 3; Set A
uuucuucgucuccucuuuguuuaacauuauauccuaa

SEQ ID NO: 33454 - RNA, 21 nt, Artificial Sequence
  Synthetic Oligonucleotide; CD40LG exon 3; Set C
ucuccucuuuguuuaacauua

SEQ ID NO: 33455 - RNA, 23 nt, Artificial Sequence
  Synthetic Oligonucleotide; CD40LG exon 3; Set C
gucuccucuuuguuuaacauuau

SEQ ID NO: 33456 - RNA, 35 nt, Artificial Sequence
  Synthetic Oligonucleotide; CD40LG exon 3; Set A
uucuucgucuccucuuuguuuaacauuauauccua

SEQ ID NO: 33457 - RNA, 40 nt, Artificial Sequence
  Synthetic Oligonucleotide; CD40LG exon 3; Set A
ucuuucuucgucuccucuuuguuuaacauuauauccuaaa

SEQ ID NO: 33458 - RNA, 38 nt, Artificial Sequence
  Synthetic Oligonucleotide; CD40LG exon 3; Set A
cuuucuucgucuccucuuuguuuaacauuauauccuaa

SEQ ID NO: 33459 - RNA, 22 nt, Artificial Sequence
  Synthetic Oligonucleotide; CD40LG exon 3; Set C
gucuccucuuuguuuaacauua

SEQ ID NO: 33460 - RNA, 24 nt, Artificial Sequence
  Synthetic Oligonucleotide; CD40LG exon 3; Set C
cgucuccucuuuguuuaacauuau

SEQ ID NO: 33461 - RNA, 36 nt, Artificial Sequence
  Synthetic Oligonucleotide; CD40LG exon 3; Set A
uuucuucgucuccucuuuguuuaacauuauauccua

SEQ ID NO: 33462 - RNA, 39 nt, Artificial Sequence
  Synthetic Oligonucleotide; CD40LG exon 3; Set A
ucuuucuucgucuccucuuuguuuaacauuauauccuaa

SEQ ID NO: 33463 - RNA, 23 nt, Artificial Sequence
  Synthetic Oligonucleotide; CD40LG exon 3; Set C
cgucuccucuuuguuuaacauua

SEQ ID NO: 33464 - RNA, 25 nt, Artificial Sequence
  Synthetic Oligonucleotide; CD40LG exon 3; Set C
ucgucuccucuuuguuuaacauuau

SEQ ID NO: 33465 - RNA, 40 nt, Artificial Sequence
  Synthetic Oligonucleotide; CD40LG exon 3; Set A
uucuuucuucgucuccucuuuguuuaacauuauauccuaa

SEQ ID NO: 33466 - RNA, 24 nt, Artificial Sequence
  Synthetic Oligonucleotide; CD40LG exon 3; Set C
ucgucuccucuuuguuuaacauua

SEQ ID NO: 33467 - RNA, 26 nt, Artificial Sequence
  Synthetic Oligonucleotide; CD40LG exon 3; Set C
uucgucuccucuuuguuuaacauuau

SEQ ID NO: 33468 - RNA, 25 nt, Artificial Sequence
  Synthetic Oligonucleotide; CD40LG exon 3; Set C
uucgucuccucuuuguuuaacauua

SEQ ID NO: 33469 - RNA, 27 nt, Artificial Sequence
  Synthetic Oligonucleotide; CD40LG exon 3; Set C
cuucgucuccucuuuguuuaacauuau

SEQ ID NO: 33470 - RNA, 26 nt, Artificial Sequence
  Synthetic Oligonucleotide; CD40LG exon 3; Set C
cuucgucuccucuuuguuuaacauua

SEQ ID NO: 33471 - RNA, 40 nt, Artificial Sequence
  Synthetic Oligonucleotide; CD40LG exon 3; Set A
uuucuuucuucgucuccucuuuguuuaacauuauauccua

SEQ ID NO: 33472 - RNA, 24 nt, Artificial Sequence
  Synthetic Oligonucleotide; CD40LG exon 3; Set C
uucgucuccucuuuguuuaacauu

SEQ ID NO: 33473 - RNA, 27 nt, Artificial Sequence
  Synthetic Oligonucleotide; CD40LG exon 3; Set A
ucuucgucuccucuuuguuuaacauua

SEQ ID NO: 33474 - RNA, 15 nt, Artificial Sequence
  Synthetic Oligonucleotide; CD40LG exon 3; Set C
ucuccucuuuguuua

SEQ ID NO: 33475 - RNA, 25 nt, Artificial Sequence
  Synthetic Oligonucleotide; CD40LG exon 3; Set C
cuucgucuccucuuuguuuaacauu

SEQ ID NO: 33476 - RNA, 32 nt, Artificial Sequence
  Synthetic Oligonucleotide; CD40LG exon 3; Set A
cuuucuucgucuccucuuuguuuaacauuaua

SEQ ID NO: 33477 - RNA, 30 nt, Artificial Sequence
  Synthetic Oligonucleotide; CD40LG exon 3; Set A
uuucuucgucuccucuuuguuuaacauuau

SEQ ID NO: 33478 - RNA, 16 nt, Artificial Sequence
  Synthetic Oligonucleotide; CD40LG exon 3; Set C
gucuccucuuuguuua

SEQ ID NO: 33479 - RNA, 26 nt, Artificial Sequence
  Synthetic Oligonucleotide; CD40LG exon 3; Set C
ucuucgucuccucuuuguuuaacauu

SEQ ID NO: 33480 - RNA, 15 nt, Artificial Sequence
  Synthetic Oligonucleotide; CD40LG exon 3; Set C
gucuccucuuuguuu

SEQ ID NO: 33481 - RNA, 33 nt, Artificial Sequence
  Synthetic Oligonucleotide; CD40LG exon 3; Set A
ucuuucuucgucuccucuuuguuuaacauuaua

SEQ ID NO: 33482 - RNA, 29 nt, Artificial Sequence
  Synthetic Oligonucleotide; CD40LG exon 3; Set A
uuucuucgucuccucuuuguuuaacauua

SEQ ID NO: 33483 - RNA, 31 nt, Artificial Sequence
  Synthetic Oligonucleotide; CD40LG exon 3; Set A
cuuucuucgucuccucuuuguuuaacauuau

SEQ ID NO: 33484 - RNA, 17 nt, Artificial Sequence
  Synthetic Oligonucleotide; CD40LG exon 3; Set C
cgucuccucuuuguuua

SEQ ID NO: 33485 - RNA, 27 nt, Artificial Sequence
  Synthetic Oligonucleotide; CD40LG exon 3; Set C
uucuucgucuccucuuuguuuaacauu

SEQ ID NO: 33486 - RNA, 16 nt, Artificial Sequence
  Synthetic Oligonucleotide; CD40LG exon 3; Set C
cgucuccucuuuguuu

SEQ ID NO: 33487 - RNA, 34 nt, Artificial Sequence
  Synthetic Oligonucleotide; CD40LG exon 3; Set A
uucuuucuucgucuccucuuuguuuaacauuaua

SEQ ID NO: 33488 - RNA, 30 nt, Artificial Sequence
  Synthetic Oligonucleotide; CD40LG exon 3; Set A
cuuucuucgucuccucuuuguuuaacauua

SEQ ID NO: 33489 - RNA, 32 nt, Artificial Sequence
  Synthetic Oligonucleotide; CD40LG exon 3; Set A
ucuuucuucgucuccucuuuguuuaacauuau

SEQ ID NO: 33490 - RNA, 18 nt, Artificial Sequence
  Synthetic Oligonucleotide; CD40LG exon 3; Set C
ucgucuccucuuuguuua

SEQ ID NO: 33491 - RNA, 15 nt, Artificial Sequence
  Synthetic Oligonucleotide; CD40LG exon 3; Set C
cgucuccucuuuguu

SEQ ID NO: 33492 - RNA, 31 nt, Artificial Sequence
  Synthetic Oligonucleotide; CD40LG exon 3; Set A
ucuuucuucgucuccucuuuguuuaacauua

SEQ ID NO: 33493 - RNA, 33 nt, Artificial Sequence
  Synthetic Oligonucleotide; CD40LG exon 3; Set A
uucuuucuucgucuccucuuuguuuaacauuau

SEQ ID NO: 33494 - RNA, 19 nt, Artificial Sequence
  Synthetic Oligonucleotide; CD40LG exon 3; Set C
uucgucuccucuuuguuua

SEQ ID NO: 33495 - RNA, 16 nt, Artificial Sequence
  Synthetic Oligonucleotide; CD40LG exon 3; Set C
ucgucuccucuuuguu

SEQ ID NO: 33496 - RNA, 32 nt, Artificial Sequence
  Synthetic Oligonucleotide; CD40LG exon 3; Set A
uucuuucuucgucuccucuuuguuuaacauua

SEQ ID NO: 33497 - RNA, 20 nt, Artificial Sequence
  Synthetic Oligonucleotide; CD40LG exon 3; Set C
cuucgucuccucuuuguuua

SEQ ID NO: 33498 - RNA, 17 nt, Artificial Sequence
  Synthetic Oligonucleotide; CD40LG exon 3; Set C
uucgucuccucuuuguu

SEQ ID NO: 33499 - RNA, 15 nt, Artificial Sequence
  Synthetic Oligonucleotide; CD40LG exon 3; Set C
ucgucuccucuuugu

SEQ ID NO: 33500 - RNA, 16 nt, Artificial Sequence
  Synthetic Oligonucleotide; CD40LG exon 3; Set C
uucgucuccucuuugu

SEQ ID NO: 33501 - RNA, 32 nt, Artificial Sequence
  Synthetic Oligonucleotide; CD40LG exon 3; Set A
uuucuuucuucgucuccucuuuguuuaacauu

SEQ ID NO: 33502 - RNA, 15 nt, Artificial Sequence
  Synthetic Oligonucleotide; CD40LG exon 3; Set C
uucgucuccucuuug

SEQ ID NO: 33503 - RNA, 17 nt, Artificial Sequence
  Synthetic Oligonucleotide; CD40LG exon 3; Set C
cuucgucuccucuuugu

SEQ ID NO: 33504 - RNA, 23 nt, Artificial Sequence
  Synthetic Oligonucleotide; CD40LG exon 3; Set C
uuucuucgucuccucuuuguuua

SEQ ID NO: 33505 - RNA, 33 nt, Artificial Sequence
  Synthetic Oligonucleotide; CD40LG exon 3; Set A
uuuucuuucuucgucuccucuuuguuuaacauu

SEQ ID NO: 33506 - RNA, 16 nt, Artificial Sequence
  Synthetic Oligonucleotide; CD40LG exon 3; Set C
cuucgucuccucuuug

SEQ ID NO: 33507 - RNA, 24 nt, Artificial Sequence
  Synthetic Oligonucleotide; CD40LG exon 3; Set C
cuuucuucgucuccucuuuguuua

SEQ ID NO: 33508 - RNA, 34 nt, Artificial Sequence
  Synthetic Oligonucleotide; CD40LG exon 3; Set A
guuuucuuucuucgucuccucuuuguuuaacauu

SEQ ID NO: 33509 - RNA, 15 nt, Artificial Sequence
  Synthetic Oligonucleotide; CD40LG exon 3; Set C
cuucgucuccucuuu

SEQ ID NO: 33510 - RNA, 17 nt, Artificial Sequence
  Synthetic Oligonucleotide; CD40LG exon 3; Set C
ucuucgucuccucuuug

SEQ ID NO: 33511 - RNA, 21 nt, Artificial Sequence
  Synthetic Oligonucleotide; CD40LG exon 3; Set C
uuucuucgucuccucuuuguu

SEQ ID NO: 33512 - RNA, 25 nt, Artificial Sequence
  Synthetic Oligonucleotide; CD40LG exon 3; Set C
ucuuucuucgucuccucuuuguuua

SEQ ID NO: 33513 - RNA, 35 nt, Artificial Sequence
  Synthetic Oligonucleotide; CD40LG exon 3; Set A
uguuuucuuucuucgucuccucuuuguuuaacauu

SEQ ID NO: 33514 - RNA, 16 nt, Artificial Sequence
  Synthetic Oligonucleotide; CD40LG exon 3; Set C
ucuucgucuccucuuu

SEQ ID NO: 33515 - RNA, 18 nt, Artificial Sequence
  Synthetic Oligonucleotide; CD40LG exon 3; Set C
uucuucgucuccucuuug

SEQ ID NO: 33516 - RNA, 20 nt, Artificial Sequence
  Synthetic Oligonucleotide; CD40LG exon 3; Set C
uuucuucgucuccucuuugu

SEQ ID NO: 33517 - RNA, 22 nt, Artificial Sequence
  Synthetic Oligonucleotide; CD40LG exon 3; Set C
cuuucuucgucuccucuuuguu

SEQ ID NO: 33518 - RNA, 26 nt, Artificial Sequence
  Synthetic Oligonucleotide; CD40LG exon 3; Set A
uucuuucuucgucuccucuuuguuua

SEQ ID NO: 33519 - RNA, 17 nt, Artificial Sequence
  Synthetic Oligonucleotide; CD40LG exon 3; Set C
uucuucgucuccucuuu

SEQ ID NO: 33520 - RNA, 19 nt, Artificial Sequence
  Synthetic Oligonucleotide; CD40LG exon 3; Set C
uuucuucgucuccucuuug

SEQ ID NO: 33521 - RNA, 23 nt, Artificial Sequence
  Synthetic Oligonucleotide; CD40LG exon 3; Set C
ucuuucuucgucuccucuuuguu

SEQ ID NO: 33522 - RNA, 21 nt, Artificial Sequence
  Synthetic Oligonucleotide; CD40LG exon 3; Set C
cuuucuucgucuccucuuugu

SEQ ID NO: 33523 - RNA, 18 nt, Artificial Sequence
  Synthetic Oligonucleotide; CD40LG exon 3; Set C
uuucuucgucuccucuuu

SEQ ID NO: 33524 - RNA, 20 nt, Artificial Sequence
  Synthetic Oligonucleotide; CD40LG exon 3; Set C
cuuucuucgucuccucuuug

SEQ ID NO: 33525 - RNA, 24 nt, Artificial Sequence
  Synthetic Oligonucleotide; CD40LG exon 3; Set C
uucuuucuucgucuccucuuuguu

SEQ ID NO: 33526 - RNA, 22 nt, Artificial Sequence
  Synthetic Oligonucleotide; CD40LG exon 3; Set C
ucuuucuucgucuccucuuugu

SEQ ID NO: 33527 - RNA, 19 nt, Artificial Sequence
  Synthetic Oligonucleotide; CD40LG exon 3; Set C
cuuucuucgucuccucuuu

SEQ ID NO: 33528 - RNA, 21 nt, Artificial Sequence
  Synthetic Oligonucleotide; CD40LG exon 3; Set C
ucuuucuucgucuccucuuug

SEQ ID NO: 33529 - RNA, 23 nt, Artificial Sequence
  Synthetic Oligonucleotide; CD40LG exon 3; Set C
uucuuucuucgucuccucuuugu

SEQ ID NO: 33530 - RNA, 20 nt, Artificial Sequence
  Synthetic Oligonucleotide; CD40LG exon 3; Set C
ucuuucuucgucuccucuuu

SEQ ID NO: 33531 - RNA, 22 nt, Artificial Sequence
  Synthetic Oligonucleotide; CD40LG exon 3; Set C
uucuuucuucgucuccucuuug

SEQ ID NO: 33532 - RNA, 40 nt, Artificial Sequence
  Synthetic Oligonucleotide; CD40LG exon 3; Set A
aaagcuguuuucuuucuucgucuccucuuuguuuaacauu

SEQ ID NO: 33533 - RNA, 21 nt, Artificial Sequence
  Synthetic Oligonucleotide; CD40LG exon 3; Set C
uucuuucuucgucuccucuuu

SEQ ID NO: 33534 - RNA, 37 nt, Artificial Sequence
  Synthetic Oligonucleotide; CD40LG exon 3; Set A
cuuuuugcauuucaaagcuguuuucuuucuucgucuc

SEQ ID NO: 33535 - RNA, 36 nt, Artificial Sequence
  Synthetic Oligonucleotide; CD40LG exon 3; Set A
cuuuuugcauuucaaagcuguuuucuuucuucgucu

SEQ ID NO: 33536 - RNA, 35 nt, Artificial Sequence
  Synthetic Oligonucleotide; CD40LG exon 3; Set A
cuuuuugcauuucaaagcuguuuucuuucuucguc

SEQ ID NO: 33537 - RNA, 34 nt, Artificial Sequence
  Synthetic Oligonucleotide; CD40LG exon 3; Set A
cuuuuugcauuucaaagcuguuuucuuucuucgu

SEQ ID NO: 33538 - RNA, 28 nt, Artificial Sequence
  Synthetic Oligonucleotide; CD40LG exon 3; Set C
cuuuuugcauuucaaagcuguuuucuuu

SEQ ID NO: 33539 - RNA, 27 nt, Artificial Sequence
  Synthetic Oligonucleotide; CD40LG exon 3; Set C
cuuuuugcauuucaaagcuguuuucuu

SEQ ID NO: 33540 - RNA, 36 nt, Artificial Sequence
  Synthetic Oligonucleotide; CD40LG exon 3; Set A
ccuaccuuuuugcauuucaaagcuguuuucuuucuu

SEQ ID NO: 33541 - RNA, 26 nt, Artificial Sequence
  Synthetic Oligonucleotide; CD40LG exon 3; Set C
cuuuuugcauuucaaagcuguuuucu

SEQ ID NO: 33542 - RNA, 35 nt, Artificial Sequence
  Synthetic Oligonucleotide; CD40LG exon 3; Set A
ccuaccuuuuugcauuucaaagcuguuuucuuucu

SEQ ID NO: 33543 - RNA, 25 nt, Artificial Sequence
  Synthetic Oligonucleotide; CD40LG exon 3; Set C
cuuuuugcauuucaaagcuguuuuc

SEQ ID NO: 33544 - RNA, 28 nt, Artificial Sequence
  Synthetic Oligonucleotide; CD40LG exon 3; Set A
ccuaccuuuuugcauuucaaagcuguuu

SEQ ID NO: 33545 - RNA, 40 nt, Artificial Sequence
  Synthetic Oligonucleotide; CD40LG exon 3; Set A
auagcaaaccuaccuuuuugcauuucaaagcuguuuucuu

SEQ ID NO: 33546 - RNA, 39 nt, Artificial Sequence
  Synthetic Oligonucleotide; CD40LG exon 3; Set A
auagcaaaccuaccuuuuugcauuucaaagcuguuuucu

SEQ ID NO: 33547 - RNA, 38 nt, Artificial Sequence
  Synthetic Oligonucleotide; CD40LG exon 3; Set A
auagcaaaccuaccuuuuugcauuucaaagcuguuuuc

SEQ ID NO: 33548 - RNA, 21 nt, Artificial Sequence
  Synthetic Oligonucleotide; CD40LG exon 3; Set C
ccuaccuuuuugcauuucaaa

SEQ ID NO: 33549 - RNA, 20 nt, Artificial Sequence
  Synthetic Oligonucleotide; CD40LG exon 3; Set C
ccuaccuuuuugcauuucaa

SEQ ID NO: 33550 - RNA, 38 nt, Artificial Sequence
  Synthetic Oligonucleotide; CD40LG exon 3; Set A
aauagcaaaccuaccuuuuugcauuucaaagcuguuuu

SEQ ID NO: 33551 - RNA, 37 nt, Artificial Sequence
  Synthetic Oligonucleotide; CD40LG exon 3; Set A
aauagcaaaccuaccuuuuugcauuucaaagcuguuu

SEQ ID NO: 33552 - RNA, 19 nt, Artificial Sequence
  Synthetic Oligonucleotide; CD40LG exon 3; Set C
ccuaccuuuuugcauuuca

SEQ ID NO: 33553 - RNA, 38 nt, Artificial Sequence
  Synthetic Oligonucleotide; CD40LG exon 3; Set A
aaauagcaaaccuaccuuuuugcauuucaaagcuguuu

SEQ ID NO: 33554 - RNA, 36 nt, Artificial Sequence
  Synthetic Oligonucleotide; CD40LG exon 3; Set A
aauagcaaaccuaccuuuuugcauuucaaagcuguu

SEQ ID NO: 33555 - RNA, 35 nt, Artificial Sequence
  Synthetic Oligonucleotide; CD40LG exon 3; Set A
aauagcaaaccuaccuuuuugcauuucaaagcugu

SEQ ID NO: 33556 - RNA, 37 nt, Artificial Sequence
  Synthetic Oligonucleotide; CD40LG exon 3; Set A
aaauagcaaaccuaccuuuuugcauuucaaagcuguu

SEQ ID NO: 33557 - RNA, 30 nt, Artificial Sequence
  Synthetic Oligonucleotide; CD40LG exon 3; Set C
aauagcaaaccuaccuuuuugcauuucaaa

SEQ ID NO: 33558 - RNA, 31 nt, Artificial Sequence
  Synthetic Oligonucleotide; CD40LG exon 3; Set C
aaauagcaaaccuaccuuuuugcauuucaaa

SEQ ID NO: 33559 - RNA, 29 nt, Artificial Sequence
  Synthetic Oligonucleotide; CD40LG exon 3; Set C
aauagcaaaccuaccuuuuugcauuucaa

SEQ ID NO: 33560 - RNA, 30 nt, Artificial Sequence
  Synthetic Oligonucleotide; CD40LG exon 3; Set C
aaauagcaaaccuaccuuuuugcauuucaa

SEQ ID NO: 33561 - RNA, 28 nt, Artificial Sequence
  Synthetic Oligonucleotide; CD40LG exon 3; Set A
aauagcaaaccuaccuuuuugcauuuca

SEQ ID NO: 33562 - RNA, 25 nt, Artificial Sequence
  Synthetic Oligonucleotide; CD40LG exon 3; Set C
auagcaaaccuaccuuuuugcauuu

SEQ ID NO: 33563 - RNA, 27 nt, Artificial Sequence
  Synthetic Oligonucleotide; CD40LG exon 3; Set C
aauagcaaaccuaccuuuuugcauuuc

SEQ ID NO: 33564 - RNA, 26 nt, Artificial Sequence
  Synthetic Oligonucleotide; CD40LG exon 3; Set C
aauagcaaaccuaccuuuuugcauuu

SEQ ID NO: 33565 - RNA, 24 nt, Artificial Sequence
  Synthetic Oligonucleotide; CD40LG exon 3; Set C
auagcaaaccuaccuuuuugcauu

SEQ ID NO: 33566 - RNA, 25 nt, Artificial Sequence
  Synthetic Oligonucleotide; CD40LG exon 3; Set C
aauagcaaaccuaccuuuuugcauu

SEQ ID NO: 33567 - RNA, 35 nt, Artificial Sequence
  Synthetic Oligonucleotide; CD40LG exon 3; Set A
uuagcaaauagcaaaccuaccuuuuugcauuucaa

SEQ ID NO: 33568 - RNA, 34 nt, Artificial Sequence
  Synthetic Oligonucleotide; CD40LG exon 3; Set A
uuagcaaauagcaaaccuaccuuuuugcauuuca

SEQ ID NO: 33569 - RNA, 19 nt, Artificial Sequence
  Synthetic Oligonucleotide; CD40LG exon 3; Set C
auagcaaaccuaccuuuuu

SEQ ID NO: 33570 - RNA, 33 nt, Artificial Sequence
  Synthetic Oligonucleotide; CD40LG exon 3; Set A
uuagcaaauagcaaaccuaccuuuuugcauuuc

SEQ ID NO: 33571 - RNA, 18 nt, Artificial Sequence
  Synthetic Oligonucleotide; CD40LG exon 3; Set C
auagcaaaccuaccuuuu

SEQ ID NO: 33572 - RNA, 32 nt, Artificial Sequence
  Synthetic Oligonucleotide; CD40LG exon 3; Set A
uuagcaaauagcaaaccuaccuuuuugcauuu

SEQ ID NO: 33573 - RNA, 20 nt, Artificial Sequence
  Synthetic Oligonucleotide; CD40LG exon 3; Set C
aauagcaaaccuaccuuuuu

SEQ ID NO: 33574 - RNA, 19 nt, Artificial Sequence
  Synthetic Oligonucleotide; CD40LG exon 3; Set C
aauagcaaaccuaccuuuu

SEQ ID NO: 33575 - RNA, 17 nt, Artificial Sequence
  Synthetic Oligonucleotide; CD40LG exon 3; Set C
auagcaaaccuaccuuu

SEQ ID NO: 33576 - RNA, 31 nt, Artificial Sequence
  Synthetic Oligonucleotide; CD40LG exon 3; Set A
uuagcaaauagcaaaccuaccuuuuugcauu

SEQ ID NO: 33577 - RNA, 18 nt, Artificial Sequence
  Synthetic Oligonucleotide; CD40LG exon 3; Set C
aauagcaaaccuaccuuu

SEQ ID NO: 33578 - RNA, 39 nt, Artificial Sequence
  Synthetic Oligonucleotide; CD40LG exon 3; Set A
agaaauuagcaaauagcaaaccuaccuuuuugcauuuca

SEQ ID NO: 33579 - RNA, 38 nt, Artificial Sequence
  Synthetic Oligonucleotide; CD40LG exon 3; Set A
agaaauuagcaaauagcaaaccuaccuuuuugcauuuc

SEQ ID NO: 33580 - RNA, 37 nt, Artificial Sequence
  Synthetic Oligonucleotide; CD40LG exon 3; Set A
agaaauuagcaaauagcaaaccuaccuuuuugcauuu

SEQ ID NO: 33581 - RNA, 36 nt, Artificial Sequence
  Synthetic Oligonucleotide; CD40LG exon 3; Set A
agaaauuagcaaauagcaaaccuaccuuuuugcauu

SEQ ID NO: 33582 - RNA, 26 nt, Artificial Sequence
  Synthetic Oligonucleotide; CD40LG exon 3; Set C
uuagcaaauagcaaaccuaccuuuuu

SEQ ID NO: 33583 - RNA, 25 nt, Artificial Sequence
  Synthetic Oligonucleotide; CD40LG exon 3; Set C
uuagcaaauagcaaaccuaccuuuu

SEQ ID NO: 33584 - RNA, 24 nt, Artificial Sequence
  Synthetic Oligonucleotide; CD40LG exon 3; Set C
uuagcaaauagcaaaccuaccuuu

SEQ ID NO: 33585 - RNA, 31 nt, Artificial Sequence
  Synthetic Oligonucleotide; CD40LG exon 3; Set C
agaaauuagcaaauagcaaaccuaccuuuuu

SEQ ID NO: 33586 - RNA, 25 nt, Artificial Sequence
  Synthetic Oligonucleotide; CD40LG exon 3; Set C
aauuagcaaauagcaaaccuaccuu

SEQ ID NO: 33587 - RNA, 30 nt, Artificial Sequence
  Synthetic Oligonucleotide; CD40LG exon 3; Set C
agaaauuagcaaauagcaaaccuaccuuuu

SEQ ID NO: 33588 - RNA, 26 nt, Artificial Sequence
  Synthetic Oligonucleotide; CD40LG exon 3; Set C
aaauuagcaaauagcaaaccuaccuu

SEQ ID NO: 33589 - RNA, 29 nt, Artificial Sequence
  Synthetic Oligonucleotide; CD40LG exon 3; Set C
agaaauuagcaaauagcaaaccuaccuuu

SEQ ID NO: 33590 - RNA, 27 nt, Artificial Sequence
  Synthetic Oligonucleotide; CD40LG exon 3; Set C
gaaauuagcaaauagcaaaccuaccuu

SEQ ID NO: 33591 - RNA, 36 nt, Artificial Sequence
  Synthetic Oligonucleotide; CD40LG exon 3; Set A
uucauagaaauuagcaaauagcaaaccuaccuuuuu

SEQ ID NO: 33592 - RNA, 35 nt, Artificial Sequence
  Synthetic Oligonucleotide; CD40LG exon 3; Set A
uucauagaaauuagcaaauagcaaaccuaccuuuu

SEQ ID NO: 33593 - RNA, 37 nt, Artificial Sequence
  Synthetic Oligonucleotide; CD40LG exon 3; Set A
auucauagaaauuagcaaauagcaaaccuaccuuuuu

SEQ ID NO: 33594 - RNA, 36 nt, Artificial Sequence
  Synthetic Oligonucleotide; CD40LG exon 3; Set A
auucauagaaauuagcaaauagcaaaccuaccuuuu

SEQ ID NO: 33595 - RNA, 34 nt, Artificial Sequence
  Synthetic Oligonucleotide; CD40LG exon 3; Set A
uucauagaaauuagcaaauagcaaaccuaccuuu

SEQ ID NO: 33596 - RNA, 35 nt, Artificial Sequence
  Synthetic Oligonucleotide; CD40LG exon 3; Set A
auucauagaaauuagcaaauagcaaaccuaccuuu

SEQ ID NO: 33597 - RNA, 40 nt, Artificial Sequence
  Synthetic Oligonucleotide; CD40LG exon 3; Set B
uuaggcauucauagaaauuagcaaauagcaaaccuaccuu

SEQ ID NO: 33598 - RNA, 15 nt, Artificial Sequence
  Synthetic Oligonucleotide; CD40LG exon 3; Set C
agaaauuagcaaaua

SEQ ID NO: 33599 - RNA, 21 nt, Artificial Sequence
  Synthetic Oligonucleotide; CD40LG exon 3; Set C
auucauagaaauuagcaaaua

SEQ ID NO: 33600 - RNA, 27 nt, Artificial Sequence
  Synthetic Oligonucleotide; CD40LG exon 3; Set C
uuaggcauucauagaaauuagcaaaua

SEQ ID NO: 33601 - RNA, 26 nt, Artificial Sequence
  Synthetic Oligonucleotide; CD40LG exon 3; Set C
uuaggcauucauagaaauuagcaaau

SEQ ID NO: 33602 - RNA, 27 nt, Artificial Sequence
  Synthetic Oligonucleotide; CD40LG exon 3; Set C
uuuaggcauucauagaaauuagcaaau

SEQ ID NO: 33603 - RNA, 28 nt, Artificial Sequence
  Synthetic Oligonucleotide; CD40LG exon 3; Set C
uuuuaggcauucauagaaauuagcaaau

SEQ ID NO: 33604 - RNA, 26 nt, Artificial Sequence
  Synthetic Oligonucleotide; CD40LG exon 3; Set C
uuuaggcauucauagaaauuagcaaa

SEQ ID NO: 33605 - RNA, 29 nt, Artificial Sequence
  Synthetic Oligonucleotide; CD40LG exon 3; Set C
uuuuuaggcauucauagaaauuagcaaau

SEQ ID NO: 33606 - RNA, 27 nt, Artificial Sequence
  Synthetic Oligonucleotide; CD40LG exon 3; Set C
uuuuaggcauucauagaaauuagcaaa

SEQ ID NO: 33607 - RNA, 30 nt, Artificial Sequence
  Synthetic Oligonucleotide; CD40LG exon 3; Set C
guuuuuaggcauucauagaaauuagcaaau

SEQ ID NO: 33608 - RNA, 28 nt, Artificial Sequence
  Synthetic Oligonucleotide; CD40LG exon 3; Set C
uuuuuaggcauucauagaaauuagcaaa

SEQ ID NO: 33609 - RNA, 31 nt, Artificial Sequence
  Synthetic Oligonucleotide; CD40LG exon 3; Set C
aguuuuuaggcauucauagaaauuagcaaau

SEQ ID NO: 33610 - RNA, 29 nt, Artificial Sequence
  Synthetic Oligonucleotide; CD40LG exon 3; Set C
guuuuuaggcauucauagaaauuagcaaa

SEQ ID NO: 33611 - RNA, 32 nt, Artificial Sequence
  Synthetic Oligonucleotide; CD40LG exon 3; Set C
uaguuuuuaggcauucauagaaauuagcaaau

SEQ ID NO: 33612 - RNA, 30 nt, Artificial Sequence
  Synthetic Oligonucleotide; CD40LG exon 3; Set C
aguuuuuaggcauucauagaaauuagcaaa

SEQ ID NO: 33613 - RNA, 33 nt, Artificial Sequence
  Synthetic Oligonucleotide; CD40LG exon 3; Set C
uuaguuuuuaggcauucauagaaauuagcaaau

SEQ ID NO: 33614 - RNA, 31 nt, Artificial Sequence
  Synthetic Oligonucleotide; CD40LG exon 3; Set C
uaguuuuuaggcauucauagaaauuagcaaa

SEQ ID NO: 33615 - RNA, 34 nt, Artificial Sequence
  Synthetic Oligonucleotide; CD40LG exon 3; Set C
uuuaguuuuuaggcauucauagaaauuagcaaau

SEQ ID NO: 33616 - RNA, 32 nt, Artificial Sequence
  Synthetic Oligonucleotide; CD40LG exon 3; Set C
uuaguuuuuaggcauucauagaaauuagcaaa

SEQ ID NO: 33617 - RNA, 35 nt, Artificial Sequence
  Synthetic Oligonucleotide; CD40LG exon 3; Set C
uuuuaguuuuuaggcauucauagaaauuagcaaau

SEQ ID NO: 33618 - RNA, 33 nt, Artificial Sequence
  Synthetic Oligonucleotide; CD40LG exon 3; Set C
uuuaguuuuuaggcauucauagaaauuagcaaa

SEQ ID NO: 33619 - RNA, 36 nt, Artificial Sequence
  Synthetic Oligonucleotide; CD40LG exon 3; Set C
cuuuuaguuuuuaggcauucauagaaauuagcaaau

SEQ ID NO: 33620 - RNA, 34 nt, Artificial Sequence
  Synthetic Oligonucleotide; CD40LG exon 3; Set C
uuuuaguuuuuaggcauucauagaaauuagcaaa

SEQ ID NO: 33621 - RNA, 15 nt, Artificial Sequence
  Synthetic Oligonucleotide; CD40LG exon 3; Set C
uuaggcauucauaga

SEQ ID NO: 33622 - RNA, 37 nt, Artificial Sequence
  Synthetic Oligonucleotide; CD40LG exon 3; Set B
ccuuuuaguuuuuaggcauucauagaaauuagcaaau

SEQ ID NO: 33623 - RNA, 35 nt, Artificial Sequence
  Synthetic Oligonucleotide; CD40LG exon 3; Set C
cuuuuaguuuuuaggcauucauagaaauuagcaaa

SEQ ID NO: 33624 - RNA, 16 nt, Artificial Sequence
  Synthetic Oligonucleotide; CD40LG exon 3; Set C
uuuaggcauucauaga

SEQ ID NO: 33625 - RNA, 38 nt, Artificial Sequence
  Synthetic Oligonucleotide; CD40LG exon 3; Set B
uccuuuuaguuuuuaggcauucauagaaauuagcaaau

SEQ ID NO: 33626 - RNA, 36 nt, Artificial Sequence
  Synthetic Oligonucleotide; CD40LG exon 3; Set B
ccuuuuaguuuuuaggcauucauagaaauuagcaaa

SEQ ID NO: 33627 - RNA, 17 nt, Artificial Sequence
  Synthetic Oligonucleotide; CD40LG exon 3; Set C
uuuuaggcauucauaga

SEQ ID NO: 33628 - RNA, 39 nt, Artificial Sequence
  Synthetic Oligonucleotide; CD40LG exon 3; Set B
uuccuuuuaguuuuuaggcauucauagaaauuagcaaau

SEQ ID NO: 33629 - RNA, 37 nt, Artificial Sequence
  Synthetic Oligonucleotide; CD40LG exon 3; Set B
uccuuuuaguuuuuaggcauucauagaaauuagcaaa

SEQ ID NO: 33630 - RNA, 38 nt, Artificial Sequence
  Synthetic Oligonucleotide; CD40LG exon 3; Set B
uuccuuuuaguuuuuaggcauucauagaaauuagcaaa

SEQ ID NO: 33631 - RNA, 15 nt, Artificial Sequence
  Synthetic Oligonucleotide; CD40LG exon 3; Set C
aguuuuuaggcauuc

SEQ ID NO: 33632 - RNA, 16 nt, Artificial Sequence
  Synthetic Oligonucleotide; CD40LG exon 3; Set C
uaguuuuuaggcauuc

SEQ ID NO: 33633 - RNA, 17 nt, Artificial Sequence
  Synthetic Oligonucleotide; CD40LG exon 3; Set C
uuaguuuuuaggcauuc

SEQ ID NO: 33634 - RNA, 18 nt, Artificial Sequence
  Synthetic Oligonucleotide; CD40LG exon 3; Set C
uuuaguuuuuaggcauuc

SEQ ID NO: 33635 - RNA, 19 nt, Artificial Sequence
  Synthetic Oligonucleotide; CD40LG exon 3; Set C
uuuuaguuuuuaggcauuc

SEQ ID NO: 33636 - RNA, 20 nt, Artificial Sequence
  Synthetic Oligonucleotide; CD40LG exon 3; Set C
cuuuuaguuuuuaggcauuc

SEQ ID NO: 33637 - RNA, 21 nt, Artificial Sequence
  Synthetic Oligonucleotide; CD40LG exon 3; Set C
ccuuuuaguuuuuaggcauuc

SEQ ID NO: 33638 - RNA, 22 nt, Artificial Sequence
  Synthetic Oligonucleotide; CD40LG exon 3; Set C
uccuuuuaguuuuuaggcauuc

SEQ ID NO: 33639 - RNA, 23 nt, Artificial Sequence
  Synthetic Oligonucleotide; CD40LG exon 3; Set C
uuccuuuuaguuuuuaggcauuc

SEQ ID NO: 33640 - RNA, 24 nt, Artificial Sequence
  Synthetic Oligonucleotide; CD40LG exon 3; Set A
cauuuugacaggggcucugcugug

SEQ ID NO: 33641 - RNA, 18 nt, Artificial Sequence
  Synthetic Oligonucleotide; CD40LG exon 3; Set A
uuugacaggggcucugcu

SEQ ID NO: 33642 - RNA, 25 nt, Artificial Sequence
  Synthetic Oligonucleotide; CD40LG exon 3; Set A
ucauuuugacaggggcucugcugug

SEQ ID NO: 33643 - RNA, 23 nt, Artificial Sequence
  Synthetic Oligonucleotide; CD40LG exon 3; Set A
cauuuugacaggggcucugcugu

SEQ ID NO: 33644 - RNA, 19 nt, Artificial Sequence
  Synthetic Oligonucleotide; CD40LG exon 3; Set A
uuuugacaggggcucugcu

SEQ ID NO: 33645 - RNA, 17 nt, Artificial Sequence
  Synthetic Oligonucleotide; CD40LG exon 3; Set C
uuugacaggggcucugc

SEQ ID NO: 33646 - RNA, 22 nt, Artificial Sequence
  Synthetic Oligonucleotide; CD40LG exon 3; Set A
cauuuugacaggggcucugcug

SEQ ID NO: 33647 - RNA, 20 nt, Artificial Sequence
  Synthetic Oligonucleotide; CD40LG exon 3; Set A
auuuugacaggggcucugcu

SEQ ID NO: 33648 - RNA, 18 nt, Artificial Sequence
  Synthetic Oligonucleotide; CD40LG exon 3; Set A
uuuugacaggggcucugc

SEQ ID NO: 33649 - RNA, 16 nt, Artificial Sequence
  Synthetic Oligonucleotide; CD40LG exon 3; Set C
uuugacaggggcucug

SEQ ID NO: 33650 - RNA, 19 nt, Artificial Sequence
  Synthetic Oligonucleotide; CD40LG exon 3; Set A
auuuugacaggggcucugc

SEQ ID NO: 33651 - RNA, 15 nt, Artificial Sequence
  Synthetic Oligonucleotide; CD40LG exon 3; Set C
uuugacaggggcucu

SEQ ID NO: 33652 - RNA, 17 nt, Artificial Sequence
  Synthetic Oligonucleotide; CD40LG exon 3; Set C
uuuugacaggggcucug

SEQ ID NO: 33653 - RNA, 16 nt, Artificial Sequence
  Synthetic Oligonucleotide; CD40LG exon 3; Set C
uuuugacaggggcucu

SEQ ID NO: 33654 - RNA, 18 nt, Artificial Sequence
  Synthetic Oligonucleotide; CD40LG exon 3; Set C
auuuugacaggggcucug

SEQ ID NO: 33655 - RNA, 17 nt, Artificial Sequence
  Synthetic Oligonucleotide; CD40LG exon 3; Set C
auuuugacaggggcucu

SEQ ID NO: 33656 - RNA, 28 nt, Artificial Sequence
  Synthetic Oligonucleotide; CD40LG exon 3; Set C
agaggucauuuugacaggggcucugcug

SEQ ID NO: 33657 - RNA, 26 nt, Artificial Sequence
  Synthetic Oligonucleotide; CD40LG exon 3; Set C
gaggucauuuugacaggggcucugcu

SEQ ID NO: 33658 - RNA, 29 nt, Artificial Sequence
  Synthetic Oligonucleotide; CD40LG exon 3; Set C
aagaggucauuuugacaggggcucugcug

SEQ ID NO: 33659 - RNA, 25 nt, Artificial Sequence
  Synthetic Oligonucleotide; CD40LG exon 3; Set C
gaggucauuuugacaggggcucugc

SEQ ID NO: 33660 - RNA, 23 nt, Artificial Sequence
  Synthetic Oligonucleotide; CD40LG exon 3; Set A
gaggucauuuugacaggggcucu

SEQ ID NO: 33661 - RNA, 19 nt, Artificial Sequence
  Synthetic Oligonucleotide; CD40LG exon 3; Set C
agaggucauuuugacaggg

SEQ ID NO: 33662 - RNA, 18 nt, Artificial Sequence
  Synthetic Oligonucleotide; CD40LG exon 3; Set C
agaggucauuuugacagg

SEQ ID NO: 33663 - RNA, 20 nt, Artificial Sequence
  Synthetic Oligonucleotide; CD40LG exon 3; Set C
aagaggucauuuugacaggg

SEQ ID NO: 33664 - RNA, 19 nt, Artificial Sequence
  Synthetic Oligonucleotide; CD40LG exon 3; Set C
aagaggucauuuugacagg

SEQ ID NO: 33665 - RNA, 40 nt, Artificial Sequence
  Synthetic Oligonucleotide; CD40LG exon 3; Set C
agaagcauugcaagaggucauuuugacaggggcucugcug

SEQ ID NO: 33666 - RNA, 40 nt, Artificial Sequence
  Synthetic Oligonucleotide; CD40LG exon 3; Set C
auaagaagcauugcaagaggucauuuugacaggggcucug

SEQ ID NO: 33667 - RNA, 39 nt, Artificial Sequence
  Synthetic Oligonucleotide; CD40LG exon 3; Set C
auaagaagcauugcaagaggucauuuugacaggggcucu

SEQ ID NO: 33668 - RNA, 40 nt, Artificial Sequence
  Synthetic Oligonucleotide; CD40LG exon 3; Set C
aauaagaagcauugcaagaggucauuuugacaggggcucu

SEQ ID NO: 33669 - RNA, 31 nt, Artificial Sequence
  Synthetic Oligonucleotide; CD40LG exon 3; Set A
agaagcauugcaagaggucauuuugacaggg

SEQ ID NO: 33670 - RNA, 30 nt, Artificial Sequence
  Synthetic Oligonucleotide; CD40LG exon 3; Set A
agaagcauugcaagaggucauuuugacagg

SEQ ID NO: 33671 - RNA, 32 nt, Artificial Sequence
  Synthetic Oligonucleotide; CD40LG exon 3; Set A
aagaagcauugcaagaggucauuuugacaggg

SEQ ID NO: 33672 - RNA, 31 nt, Artificial Sequence
  Synthetic Oligonucleotide; CD40LG exon 3; Set A
aagaagcauugcaagaggucauuuugacagg

SEQ ID NO: 33673 - RNA, 33 nt, Artificial Sequence
  Synthetic Oligonucleotide; CD40LG exon 3; Set A
uaagaagcauugcaagaggucauuuugacaggg

SEQ ID NO: 33674 - RNA, 32 nt, Artificial Sequence
  Synthetic Oligonucleotide; CD40LG exon 3; Set A
uaagaagcauugcaagaggucauuuugacagg

SEQ ID NO: 33675 - RNA, 39 nt, Artificial Sequence
  Synthetic Oligonucleotide; CD40LG exon 3; Set A
cuaaaauaagaagcauugcaagaggucauuuugacaggg

SEQ ID NO: 33676 - RNA, 38 nt, Artificial Sequence
  Synthetic Oligonucleotide; CD40LG exon 3; Set A
cuaaaauaagaagcauugcaagaggucauuuugacagg

SEQ ID NO: 33677 - RNA, 24 nt, Artificial Sequence
  Synthetic Oligonucleotide; CD40LG exon 3; Set C
auaagaagcauugcaagaggucau

SEQ ID NO: 33678 - RNA, 25 nt, Artificial Sequence
  Synthetic Oligonucleotide; CD40LG exon 3; Set C
aauaagaagcauugcaagaggucau

SEQ ID NO: 33679 - RNA, 26 nt, Artificial Sequence
  Synthetic Oligonucleotide; CD40LG exon 3; Set C
aaauaagaagcauugcaagaggucau

SEQ ID NO: 33680 - RNA, 15 nt, Artificial Sequence
  Synthetic Oligonucleotide; CD40LG exon 3; Set C
agaagcauugcaaga

SEQ ID NO: 33681 - RNA, 27 nt, Artificial Sequence
  Synthetic Oligonucleotide; CD40LG exon 3; Set C
aaaauaagaagcauugcaagaggucau

SEQ ID NO: 33682 - RNA, 16 nt, Artificial Sequence
  Synthetic Oligonucleotide; CD40LG exon 3; Set C
aagaagcauugcaaga

SEQ ID NO: 33683 - RNA, 28 nt, Artificial Sequence
  Synthetic Oligonucleotide; CD40LG exon 3; Set C
uaaaauaagaagcauugcaagaggucau

SEQ ID NO: 33684 - RNA, 17 nt, Artificial Sequence
  Synthetic Oligonucleotide; CD40LG exon 3; Set C
uaagaagcauugcaaga

SEQ ID NO: 33685 - RNA, 15 nt, Artificial Sequence
  Synthetic Oligonucleotide; CD40LG exon 3; Set C
aagaagcauugcaag

SEQ ID NO: 33686 - RNA, 16 nt, Artificial Sequence
  Synthetic Oligonucleotide; CD40LG exon 3; Set C
uaagaagcauugcaag

SEQ ID NO: 33687 - RNA, 34 nt, Artificial Sequence
  Synthetic Oligonucleotide; CD40LG exon 3; Set A
auauccuaaaauaagaagcauugcaagaggucau

SEQ ID NO: 33688 - RNA, 23 nt, Artificial Sequence
  Synthetic Oligonucleotide; CD40LG exon 3; Set C
cuaaaauaagaagcauugcaaga

SEQ ID NO: 33689 - RNA, 35 nt, Artificial Sequence
  Synthetic Oligonucleotide; CD40LG exon 3; Set A
uauauccuaaaauaagaagcauugcaagaggucau

SEQ ID NO: 33690 - RNA, 22 nt, Artificial Sequence
  Synthetic Oligonucleotide; CD40LG exon 3; Set C
cuaaaauaagaagcauugcaag

SEQ ID NO: 33691 - RNA, 36 nt, Artificial Sequence
  Synthetic Oligonucleotide; CD40LG exon 3; Set A
uuauauccuaaaauaagaagcauugcaagaggucau

SEQ ID NO: 33692 - RNA, 28 nt, Artificial Sequence
  Synthetic Oligonucleotide; CD40LG exon 3; Set C
uauauccuaaaauaagaagcauugcaag

SEQ ID NO: 33693 - RNA, 31 nt, Artificial Sequence
  Synthetic Oligonucleotide; CD40LG exon 3; Set C
auuauauccuaaaauaagaagcauugcaaga

SEQ ID NO: 33694 - RNA, 30 nt, Artificial Sequence
  Synthetic Oligonucleotide; CD40LG exon 3; Set C
auuauauccuaaaauaagaagcauugcaag

SEQ ID NO: 33695 - RNA, 19 nt, Artificial Sequence
  Synthetic Oligonucleotide; CD40LG exon 3; Set C
auuauauccuaaaauaaga

SEQ ID NO: 33696 - RNA, 18 nt, Artificial Sequence
  Synthetic Oligonucleotide; CD40LG exon 3; Set C
auuauauccuaaaauaag

SEQ ID NO: 33697 - RNA, 17 nt, Artificial Sequence
  Synthetic Oligonucleotide; CD40LG exon 3; Set C
auuauauccuaaaauaa

SEQ ID NO: 33698 - RNA, 17 nt, Artificial Sequence
  Synthetic Oligonucleotide; CD40LG exon 3; Set C
cauuauauccuaaaaua

SEQ ID NO: 33699 - RNA, 27 nt, Artificial Sequence
  Synthetic Oligonucleotide; CD40LG exon 3; Set C
uuuaacauuauauccuaaaauaagaag

SEQ ID NO: 33700 - RNA, 16 nt, Artificial Sequence
  Synthetic Oligonucleotide; CD40LG exon 3; Set C
cauuauauccuaaaau

SEQ ID NO: 33701 - RNA, 26 nt, Artificial Sequence
  Synthetic Oligonucleotide; CD40LG exon 3; Set C
uuuaacauuauauccuaaaauaagaa

SEQ ID NO: 33702 - RNA, 15 nt, Artificial Sequence
  Synthetic Oligonucleotide; CD40LG exon 3; Set C
cauuauauccuaaaa

SEQ ID NO: 33703 - RNA, 16 nt, Artificial Sequence
  Synthetic Oligonucleotide; CD40LG exon 3; Set C
uuaacauuauauccua

SEQ ID NO: 33704 - RNA, 18 nt, Artificial Sequence
  Synthetic Oligonucleotide; CD40LG exon 3; Set C
guuuaacauuauauccua

SEQ ID NO: 33705 - RNA, 35 nt, Artificial Sequence
  Synthetic Oligonucleotide; CD40LG exon 3; Set C
cuccucuuuguuuaacauuauauccuaaaauaaga

SEQ ID NO: 33706 - RNA, 19 nt, Artificial Sequence
  Synthetic Oligonucleotide; CD40LG exon 3; Set C
uguuuaacauuauauccua

SEQ ID NO: 33707 - RNA, 34 nt, Artificial Sequence
  Synthetic Oligonucleotide; CD40LG exon 3; Set C
cuccucuuuguuuaacauuauauccuaaaauaag

SEQ ID NO: 33708 - RNA, 33 nt, Artificial Sequence
  Synthetic Oligonucleotide; CD40LG exon 3; Set C
cuccucuuuguuuaacauuauauccuaaaauaa

SEQ ID NO: 33709 - RNA, 29 nt, Artificial Sequence
  Synthetic Oligonucleotide; CD40LG exon 3; Set C
cuccucuuuguuuaacauuauauccuaaa

SEQ ID NO: 33710 - RNA, 28 nt, Artificial Sequence
  Synthetic Oligonucleotide; CD40LG exon 3; Set C
cuccucuuuguuuaacauuauauccuaa

SEQ ID NO: 33711 - RNA, 27 nt, Artificial Sequence
  Synthetic Oligonucleotide; CD40LG exon 3; Set C
cuccucuuuguuuaacauuauauccua

SEQ ID NO: 33712 - RNA, 28 nt, Artificial Sequence
  Synthetic Oligonucleotide; CD40LG exon 3; Set C
ucuccucuuuguuuaacauuauauccua

SEQ ID NO: 33713 - RNA, 29 nt, Artificial Sequence
  Synthetic Oligonucleotide; CD40LG exon 3; Set A
gucuccucuuuguuuaacauuauauccua

SEQ ID NO: 33714 - RNA, 30 nt, Artificial Sequence
  Synthetic Oligonucleotide; CD40LG exon 3; Set A
cgucuccucuuuguuuaacauuauauccua

SEQ ID NO: 33715 - RNA, 31 nt, Artificial Sequence
  Synthetic Oligonucleotide; CD40LG exon 3; Set A
ucgucuccucuuuguuuaacauuauauccua

SEQ ID NO: 33716 - RNA, 21 nt, Artificial Sequence
  Synthetic Oligonucleotide; CD40LG exon 3; Set C
cuccucuuuguuuaacauuau

SEQ ID NO: 33717 - RNA, 20 nt, Artificial Sequence
  Synthetic Oligonucleotide; CD40LG exon 3; Set C
cuccucuuuguuuaacauua

SEQ ID NO: 33718 - RNA, 20 nt, Artificial Sequence
  Synthetic Oligonucleotide; CD40LG exon 3; Set C
ucuccucuuuguuuaacauu

SEQ ID NO: 33719 - RNA, 37 nt, Artificial Sequence
  Synthetic Oligonucleotide; CD40LG exon 3; Set A
cuuucuucgucuccucuuuguuuaacauuauauccua

SEQ ID NO: 33720 - RNA, 21 nt, Artificial Sequence
  Synthetic Oligonucleotide; CD40LG exon 3; Set C
gucuccucuuuguuuaacauu

SEQ ID NO: 33721 - RNA, 38 nt, Artificial Sequence
  Synthetic Oligonucleotide; CD40LG exon 3; Set A
ucuuucuucgucuccucuuuguuuaacauuauauccua

SEQ ID NO: 33722 - RNA, 22 nt, Artificial Sequence
  Synthetic Oligonucleotide; CD40LG exon 3; Set C
cgucuccucuuuguuuaacauu

SEQ ID NO: 33723 - RNA, 39 nt, Artificial Sequence
  Synthetic Oligonucleotide; CD40LG exon 3; Set A
uucuuucuucgucuccucuuuguuuaacauuauauccua

SEQ ID NO: 33724 - RNA, 23 nt, Artificial Sequence
  Synthetic Oligonucleotide; CD40LG exon 3; Set C
ucgucuccucuuuguuuaacauu

SEQ ID NO: 33725 - RNA, 40 nt, Artificial Sequence
  Synthetic Oligonucleotide; CD40LG exon 3; Set A
uuuucuuucuucgucuccucuuuguuuaacauuauauccu

SEQ ID NO: 33726 - RNA, 28 nt, Artificial Sequence
  Synthetic Oligonucleotide; CD40LG exon 3; Set A
uuucuucgucuccucuuuguuuaacauu

SEQ ID NO: 33727 - RNA, 29 nt, Artificial Sequence
  Synthetic Oligonucleotide; CD40LG exon 3; Set A
cuuucuucgucuccucuuuguuuaacauu

SEQ ID NO: 33728 - RNA, 30 nt, Artificial Sequence
  Synthetic Oligonucleotide; CD40LG exon 3; Set A
ucuuucuucgucuccucuuuguuuaacauu

SEQ ID NO: 33729 - RNA, 31 nt, Artificial Sequence
  Synthetic Oligonucleotide; CD40LG exon 3; Set A
uucuuucuucgucuccucuuuguuuaacauu

SEQ ID NO: 33730 - RNA, 32 nt, Artificial Sequence
  Synthetic Oligonucleotide; CD40LG exon 3; Set A
uuuucuuucuucgucuccucuuuguuuaacau

SEQ ID NO: 33731 - RNA, 33 nt, Artificial Sequence
  Synthetic Oligonucleotide; CD40LG exon 3; Set A
guuuucuuucuucgucuccucuuuguuuaacau

SEQ ID NO: 33732 - RNA, 34 nt, Artificial Sequence
  Synthetic Oligonucleotide; CD40LG exon 3; Set A
uguuuucuuucuucgucuccucuuuguuuaacau

SEQ ID NO: 33733 - RNA, 29 nt, Artificial Sequence
  Synthetic Oligonucleotide; CD40LG exon 3; Set A
uuuucuuucuucgucuccucuuuguuuaa

SEQ ID NO: 33734 - RNA, 30 nt, Artificial Sequence
  Synthetic Oligonucleotide; CD40LG exon 3; Set A
guuuucuuucuucgucuccucuuuguuuaa

SEQ ID NO: 33735 - RNA, 31 nt, Artificial Sequence
  Synthetic Oligonucleotide; CD40LG exon 3; Set A
uguuuucuuucuucgucuccucuuuguuuaa

SEQ ID NO: 33736 - RNA, 39 nt, Artificial Sequence
  Synthetic Oligonucleotide; CD40LG exon 3; Set A
aaagcuguuuucuuucuucgucuccucuuuguuuaacau

SEQ ID NO: 33737 - RNA, 30 nt, Artificial Sequence
  Synthetic Oligonucleotide; CD40LG exon 3; Set A
cuguuuucuuucuucgucuccucuuuguuu

SEQ ID NO: 33738 - RNA, 40 nt, Artificial Sequence
  Synthetic Oligonucleotide; CD40LG exon 3; Set A
caaagcuguuuucuuucuucgucuccucuuuguuuaacau

SEQ ID NO: 33739 - RNA, 36 nt, Artificial Sequence
  Synthetic Oligonucleotide; CD40LG exon 3; Set A
aaagcuguuuucuuucuucgucuccucuuuguuuaa

SEQ ID NO: 33740 - RNA, 37 nt, Artificial Sequence
  Synthetic Oligonucleotide; CD40LG exon 3; Set A
caaagcuguuuucuuucuucgucuccucuuuguuuaa

SEQ ID NO: 33741 - RNA, 38 nt, Artificial Sequence
  Synthetic Oligonucleotide; CD40LG exon 3; Set A
ucaaagcuguuuucuuucuucgucuccucuuuguuuaa

SEQ ID NO: 33742 - RNA, 39 nt, Artificial Sequence
  Synthetic Oligonucleotide; CD40LG exon 3; Set A
uucaaagcuguuuucuuucuucgucuccucuuuguuuaa

SEQ ID NO: 33743 - RNA, 40 nt, Artificial Sequence
  Synthetic Oligonucleotide; CD40LG exon 3; Set A
uuucaaagcuguuuucuuucuucgucuccucuuuguuuaa

SEQ ID NO: 33744 - RNA, 40 nt, Artificial Sequence
  Synthetic Oligonucleotide; CD40LG exon 3; Set A
cauuucaaagcuguuuucuuucuucgucuccucuuuguuu

SEQ ID NO: 33745 - RNA, 19 nt, Artificial Sequence
  Synthetic Oligonucleotide; CD40LG exon 3; Set C
cuguuuucuuucuucgucu

SEQ ID NO: 33746 - RNA, 18 nt, Artificial Sequence
  Synthetic Oligonucleotide; CD40LG exon 3; Set C
cuguuuucuuucuucguc

SEQ ID NO: 33747 - RNA, 17 nt, Artificial Sequence
  Synthetic Oligonucleotide; CD40LG exon 3; Set C
cuguuuucuuucuucgu

SEQ ID NO: 33748 - RNA, 16 nt, Artificial Sequence
  Synthetic Oligonucleotide; CD40LG exon 3; Set C
cuguuuucuuucuucg

SEQ ID NO: 33749 - RNA, 15 nt, Artificial Sequence
  Synthetic Oligonucleotide; CD40LG exon 3; Set C
cuguuuucuuucuuc

SEQ ID NO: 33750 - RNA, 29 nt, Artificial Sequence
  Synthetic Oligonucleotide; CD40LG exon 3; Set A
cauuucaaagcuguuuucuuucuucgucu

SEQ ID NO: 33751 - RNA, 26 nt, Artificial Sequence
  Synthetic Oligonucleotide; CD40LG exon 3; Set C
cauuucaaagcuguuuucuuucuucg

SEQ ID NO: 33752 - RNA, 25 nt, Artificial Sequence
  Synthetic Oligonucleotide; CD40LG exon 3; Set C
cauuucaaagcuguuuucuuucuuc

SEQ ID NO: 33753 - RNA, 24 nt, Artificial Sequence
  Synthetic Oligonucleotide; CD40LG exon 3; Set C
cauuucaaagcuguuuucuuucuu

SEQ ID NO: 33754 - RNA, 23 nt, Artificial Sequence
  Synthetic Oligonucleotide; CD40LG exon 3; Set C
cauuucaaagcuguuuucuuucu

SEQ ID NO: 33755 - RNA, 22 nt, Artificial Sequence
  Synthetic Oligonucleotide; CD40LG exon 3; Set C
cauuucaaagcuguuuucuuuc

SEQ ID NO: 33756 - RNA, 21 nt, Artificial Sequence
  Synthetic Oligonucleotide; CD40LG exon 3; Set C
cauuucaaagcuguuuucuuu

SEQ ID NO: 33757 - RNA, 34 nt, Artificial Sequence
  Synthetic Oligonucleotide; CD40LG exon 3; Set A
ccuuuuugcauuucaaagcuguuuucuuucuucg

SEQ ID NO: 33758 - RNA, 17 nt, Artificial Sequence
  Synthetic Oligonucleotide; CD40LG exon 3; Set C
cauuucaaagcuguuuu

SEQ ID NO: 33759 - RNA, 33 nt, Artificial Sequence
  Synthetic Oligonucleotide; CD40LG exon 3; Set A
ccuuuuugcauuucaaagcuguuuucuuucuuc

SEQ ID NO: 33760 - RNA, 35 nt, Artificial Sequence
  Synthetic Oligonucleotide; CD40LG exon 3; Set A
accuuuuugcauuucaaagcuguuuucuuucuucg

SEQ ID NO: 33761 - RNA, 16 nt, Artificial Sequence
  Synthetic Oligonucleotide; CD40LG exon 3; Set C
cauuucaaagcuguuu

SEQ ID NO: 33762 - RNA, 32 nt, Artificial Sequence
  Synthetic Oligonucleotide; CD40LG exon 3; Set A
ccuuuuugcauuucaaagcuguuuucuuucuu

SEQ ID NO: 33763 - RNA, 34 nt, Artificial Sequence
  Synthetic Oligonucleotide; CD40LG exon 3; Set A
accuuuuugcauuucaaagcuguuuucuuucuuc

SEQ ID NO: 33764 - RNA, 36 nt, Artificial Sequence
  Synthetic Oligonucleotide; CD40LG exon 3; Set A
uaccuuuuugcauuucaaagcuguuuucuuucuucg

SEQ ID NO: 33765 - RNA, 40 nt, Artificial Sequence
  Synthetic Oligonucleotide; CD40LG exon 3; Set C
ccuaccuuuuugcauuucaaagcuguuuucuuucuucguc

SEQ ID NO: 33766 - RNA, 15 nt, Artificial Sequence
  Synthetic Oligonucleotide; CD40LG exon 3; Set C
cauuucaaagcuguu

SEQ ID NO: 33767 - RNA, 31 nt, Artificial Sequence
  Synthetic Oligonucleotide; CD40LG exon 3; Set A
ccuuuuugcauuucaaagcuguuuucuuucu

SEQ ID NO: 33768 - RNA, 33 nt, Artificial Sequence
  Synthetic Oligonucleotide; CD40LG exon 3; Set A
accuuuuugcauuucaaagcuguuuucuuucuu

SEQ ID NO: 33769 - RNA, 35 nt, Artificial Sequence
  Synthetic Oligonucleotide; CD40LG exon 3; Set A
uaccuuuuugcauuucaaagcuguuuucuuucuuc

SEQ ID NO: 33770 - RNA, 39 nt, Artificial Sequence
  Synthetic Oligonucleotide; CD40LG exon 3; Set C
ccuaccuuuuugcauuucaaagcuguuuucuuucuucgu

SEQ ID NO: 33771 - RNA, 32 nt, Artificial Sequence
  Synthetic Oligonucleotide; CD40LG exon 3; Set A
accuuuuugcauuucaaagcuguuuucuuucu

SEQ ID NO: 33772 - RNA, 34 nt, Artificial Sequence
  Synthetic Oligonucleotide; CD40LG exon 3; Set A
uaccuuuuugcauuucaaagcuguuuucuuucuu

SEQ ID NO: 33773 - RNA, 30 nt, Artificial Sequence
  Synthetic Oligonucleotide; CD40LG exon 3; Set A
ccuuuuugcauuucaaagcuguuuucuuuc

SEQ ID NO: 33774 - RNA, 38 nt, Artificial Sequence
  Synthetic Oligonucleotide; CD40LG exon 3; Set A
ccuaccuuuuugcauuucaaagcuguuuucuuucuucg

SEQ ID NO: 33775 - RNA, 33 nt, Artificial Sequence
  Synthetic Oligonucleotide; CD40LG exon 3; Set A
uaccuuuuugcauuucaaagcuguuuucuuucu

SEQ ID NO: 33776 - RNA, 35 nt, Artificial Sequence
  Synthetic Oligonucleotide; CD40LG exon 3; Set A
cuaccuuuuugcauuucaaagcuguuuucuuucuu

SEQ ID NO: 33777 - RNA, 31 nt, Artificial Sequence
  Synthetic Oligonucleotide; CD40LG exon 3; Set A
accuuuuugcauuucaaagcuguuuucuuuc

SEQ ID NO: 33778 - RNA, 37 nt, Artificial Sequence
  Synthetic Oligonucleotide; CD40LG exon 3; Set A
ccuaccuuuuugcauuucaaagcuguuuucuuucuuc

SEQ ID NO: 33779 - RNA, 34 nt, Artificial Sequence
  Synthetic Oligonucleotide; CD40LG exon 3; Set A
cuaccuuuuugcauuucaaagcuguuuucuuucu

SEQ ID NO: 33780 - RNA, 32 nt, Artificial Sequence
  Synthetic Oligonucleotide; CD40LG exon 3; Set A
uaccuuuuugcauuucaaagcuguuuucuuuc

SEQ ID NO: 33781 - RNA, 33 nt, Artificial Sequence
  Synthetic Oligonucleotide; CD40LG exon 3; Set A
cuaccuuuuugcauuucaaagcuguuuucuuuc

SEQ ID NO: 33782 - RNA, 34 nt, Artificial Sequence
  Synthetic Oligonucleotide; CD40LG exon 3; Set A
ccuaccuuuuugcauuucaaagcuguuuucuuuc

SEQ ID NO: 33783 - RNA, 40 nt, Artificial Sequence
  Synthetic Oligonucleotide; CD40LG exon 3; Set A
aaaccuaccuuuuugcauuucaaagcuguuuucuuucuuc

SEQ ID NO: 33784 - RNA, 25 nt, Artificial Sequence
  Synthetic Oligonucleotide; CD40LG exon 3; Set C
ccuuuuugcauuucaaagcuguuuu

SEQ ID NO: 33785 - RNA, 39 nt, Artificial Sequence
  Synthetic Oligonucleotide; CD40LG exon 3; Set A
aaaccuaccuuuuugcauuucaaagcuguuuucuuucuu

SEQ ID NO: 33786 - RNA, 33 nt, Artificial Sequence
  Synthetic Oligonucleotide; CD40LG exon 3; Set A
ccuaccuuuuugcauuucaaagcuguuuucuuu

SEQ ID NO: 33787 - RNA, 17 nt, Artificial Sequence
  Synthetic Oligonucleotide; CD40LG exon 3; Set C
uuugcauuucaaagcug

SEQ ID NO: 33788 - RNA, 24 nt, Artificial Sequence
  Synthetic Oligonucleotide; CD40LG exon 3; Set C
ccuuuuugcauuucaaagcuguuu

SEQ ID NO: 33789 - RNA, 38 nt, Artificial Sequence
  Synthetic Oligonucleotide; CD40LG exon 3; Set A
aaaccuaccuuuuugcauuucaaagcuguuuucuuucu

SEQ ID NO: 33790 - RNA, 26 nt, Artificial Sequence
  Synthetic Oligonucleotide; CD40LG exon 3; Set C
accuuuuugcauuucaaagcuguuuu

SEQ ID NO: 33791 - RNA, 32 nt, Artificial Sequence
  Synthetic Oligonucleotide; CD40LG exon 3; Set A
ccuaccuuuuugcauuucaaagcuguuuucuu

SEQ ID NO: 33792 - RNA, 18 nt, Artificial Sequence
  Synthetic Oligonucleotide; CD40LG exon 3; Set C
uuuugcauuucaaagcug

SEQ ID NO: 33793 - RNA, 25 nt, Artificial Sequence
  Synthetic Oligonucleotide; CD40LG exon 3; Set C
accuuuuugcauuucaaagcuguuu

SEQ ID NO: 33794 - RNA, 23 nt, Artificial Sequence
  Synthetic Oligonucleotide; CD40LG exon 3; Set C
ccuuuuugcauuucaaagcuguu

SEQ ID NO: 33795 - RNA, 27 nt, Artificial Sequence
  Synthetic Oligonucleotide; CD40LG exon 3; Set C
uaccuuuuugcauuucaaagcuguuuu

SEQ ID NO: 33796 - RNA, 37 nt, Artificial Sequence
  Synthetic Oligonucleotide; CD40LG exon 3; Set A
aaaccuaccuuuuugcauuucaaagcuguuuucuuuc

SEQ ID NO: 33797 - RNA, 31 nt, Artificial Sequence
  Synthetic Oligonucleotide; CD40LG exon 3; Set A
ccuaccuuuuugcauuucaaagcuguuuucu

SEQ ID NO: 33798 - RNA, 19 nt, Artificial Sequence
  Synthetic Oligonucleotide; CD40LG exon 3; Set C
uuuuugcauuucaaagcug

SEQ ID NO: 33799 - RNA, 26 nt, Artificial Sequence
  Synthetic Oligonucleotide; CD40LG exon 3; Set C
uaccuuuuugcauuucaaagcuguuu

SEQ ID NO: 33800 - RNA, 22 nt, Artificial Sequence
  Synthetic Oligonucleotide; CD40LG exon 3; Set C
ccuuuuugcauuucaaagcugu

SEQ ID NO: 33801 - RNA, 24 nt, Artificial Sequence
  Synthetic Oligonucleotide; CD40LG exon 3; Set C
accuuuuugcauuucaaagcuguu

SEQ ID NO: 33802 - RNA, 36 nt, Artificial Sequence
  Synthetic Oligonucleotide; CD40LG exon 3; Set A
aaaccuaccuuuuugcauuucaaagcuguuuucuuu

SEQ ID NO: 33803 - RNA, 30 nt, Artificial Sequence
  Synthetic Oligonucleotide; CD40LG exon 3; Set A
ccuaccuuuuugcauuucaaagcuguuuuc

SEQ ID NO: 33804 - RNA, 27 nt, Artificial Sequence
  Synthetic Oligonucleotide; CD40LG exon 3; Set C
cuaccuuuuugcauuucaaagcuguuu

SEQ ID NO: 33805 - RNA, 23 nt, Artificial Sequence
  Synthetic Oligonucleotide; CD40LG exon 3; Set C
accuuuuugcauuucaaagcugu

SEQ ID NO: 33806 - RNA, 25 nt, Artificial Sequence
  Synthetic Oligonucleotide; CD40LG exon 3; Set C
uaccuuuuugcauuucaaagcuguu

SEQ ID NO: 33807 - RNA, 29 nt, Artificial Sequence
  Synthetic Oligonucleotide; CD40LG exon 3; Set A
ccuaccuuuuugcauuucaaagcuguuuu

SEQ ID NO: 33808 - RNA, 35 nt, Artificial Sequence
  Synthetic Oligonucleotide; CD40LG exon 3; Set A
aaaccuaccuuuuugcauuucaaagcuguuuucuu

SEQ ID NO: 33809 - RNA, 24 nt, Artificial Sequence
  Synthetic Oligonucleotide; CD40LG exon 3; Set C
uaccuuuuugcauuucaaagcugu

SEQ ID NO: 33810 - RNA, 26 nt, Artificial Sequence
  Synthetic Oligonucleotide; CD40LG exon 3; Set C
cuaccuuuuugcauuucaaagcuguu

SEQ ID NO: 33811 - RNA, 34 nt, Artificial Sequence
  Synthetic Oligonucleotide; CD40LG exon 3; Set A
aaaccuaccuuuuugcauuucaaagcuguuuucu

SEQ ID NO: 33812 - RNA, 27 nt, Artificial Sequence
  Synthetic Oligonucleotide; CD40LG exon 3; Set A
ccuaccuuuuugcauuucaaagcuguu

SEQ ID NO: 33813 - RNA, 33 nt, Artificial Sequence
  Synthetic Oligonucleotide; CD40LG exon 3; Set A
aaaccuaccuuuuugcauuucaaagcuguuuuc

SEQ ID NO: 33814 - RNA, 26 nt, Artificial Sequence
  Synthetic Oligonucleotide; CD40LG exon 3; Set A
ccuaccuuuuugcauuucaaagcugu

SEQ ID NO: 33815 - RNA, 32 nt, Artificial Sequence
  Synthetic Oligonucleotide; CD40LG exon 3; Set A
aaaccuaccuuuuugcauuucaaagcuguuuu

SEQ ID NO: 33816 - RNA, 17 nt, Artificial Sequence
  Synthetic Oligonucleotide; CD40LG exon 3; Set C
ccuuuuugcauuucaaa

SEQ ID NO: 33817 - RNA, 31 nt, Artificial Sequence
  Synthetic Oligonucleotide; CD40LG exon 3; Set A
aaaccuaccuuuuugcauuucaaagcuguuu

SEQ ID NO: 33818 - RNA, 18 nt, Artificial Sequence
  Synthetic Oligonucleotide; CD40LG exon 3; Set C
accuuuuugcauuucaaa

SEQ ID NO: 33819 - RNA, 30 nt, Artificial Sequence
  Synthetic Oligonucleotide; CD40LG exon 3; Set A
aaaccuaccuuuuugcauuucaaagcuguu

SEQ ID NO: 33820 - RNA, 16 nt, Artificial Sequence
  Synthetic Oligonucleotide; CD40LG exon 3; Set C
ccuuuuugcauuucaa

SEQ ID NO: 33821 - RNA, 19 nt, Artificial Sequence
  Synthetic Oligonucleotide; CD40LG exon 3; Set C
uaccuuuuugcauuucaaa

SEQ ID NO: 33822 - RNA, 29 nt, Artificial Sequence
  Synthetic Oligonucleotide; CD40LG exon 3; Set A
aaaccuaccuuuuugcauuucaaagcugu

SEQ ID NO: 33823 - RNA, 17 nt, Artificial Sequence
  Synthetic Oligonucleotide; CD40LG exon 3; Set C
accuuuuugcauuucaa

SEQ ID NO: 33824 - RNA, 15 nt, Artificial Sequence
  Synthetic Oligonucleotide; CD40LG exon 3; Set C
ccuuuuugcauuuca

SEQ ID NO: 33825 - RNA, 20 nt, Artificial Sequence
  Synthetic Oligonucleotide; CD40LG exon 3; Set C
cuaccuuuuugcauuucaaa

SEQ ID NO: 33826 - RNA, 18 nt, Artificial Sequence
  Synthetic Oligonucleotide; CD40LG exon 3; Set C
uaccuuuuugcauuucaa

SEQ ID NO: 33827 - RNA, 16 nt, Artificial Sequence
  Synthetic Oligonucleotide; CD40LG exon 3; Set C
accuuuuugcauuuca

SEQ ID NO: 33828 - RNA, 40 nt, Artificial Sequence
  Synthetic Oligonucleotide; CD40LG exon 3; Set A
aauagcaaaccuaccuuuuugcauuucaaagcuguuuucu

SEQ ID NO: 33829 - RNA, 19 nt, Artificial Sequence
  Synthetic Oligonucleotide; CD40LG exon 3; Set C
cuaccuuuuugcauuucaa

SEQ ID NO: 33830 - RNA, 15 nt, Artificial Sequence
  Synthetic Oligonucleotide; CD40LG exon 3; Set C
accuuuuugcauuuc

SEQ ID NO: 33831 - RNA, 17 nt, Artificial Sequence
  Synthetic Oligonucleotide; CD40LG exon 3; Set C
uaccuuuuugcauuuca

SEQ ID NO: 33832 - RNA, 39 nt, Artificial Sequence
  Synthetic Oligonucleotide; CD40LG exon 3; Set A
aauagcaaaccuaccuuuuugcauuucaaagcuguuuuc

SEQ ID NO: 33833 - RNA, 16 nt, Artificial Sequence
  Synthetic Oligonucleotide; CD40LG exon 3; Set C
uaccuuuuugcauuuc

SEQ ID NO: 33834 - RNA, 18 nt, Artificial Sequence
  Synthetic Oligonucleotide; CD40LG exon 3; Set C
cuaccuuuuugcauuuca

SEQ ID NO: 33835 - RNA, 40 nt, Artificial Sequence
  Synthetic Oligonucleotide; CD40LG exon 3; Set A
aaauagcaaaccuaccuuuuugcauuucaaagcuguuuuc

SEQ ID NO: 33836 - RNA, 15 nt, Artificial Sequence
  Synthetic Oligonucleotide; CD40LG exon 3; Set C
uaccuuuuugcauuu

SEQ ID NO: 33837 - RNA, 17 nt, Artificial Sequence
  Synthetic Oligonucleotide; CD40LG exon 3; Set C
cuaccuuuuugcauuuc

SEQ ID NO: 33838 - RNA, 39 nt, Artificial Sequence
  Synthetic Oligonucleotide; CD40LG exon 3; Set A
aaauagcaaaccuaccuuuuugcauuucaaagcuguuuu

SEQ ID NO: 33839 - RNA, 24 nt, Artificial Sequence
  Synthetic Oligonucleotide; CD40LG exon 3; Set C
aaaccuaccuuuuugcauuucaaa

SEQ ID NO: 33840 - RNA, 16 nt, Artificial Sequence
  Synthetic Oligonucleotide; CD40LG exon 3; Set C
cuaccuuuuugcauuu

SEQ ID NO: 33841 - RNA, 18 nt, Artificial Sequence
  Synthetic Oligonucleotide; CD40LG exon 3; Set C
ccuaccuuuuugcauuuc

SEQ ID NO: 33842 - RNA, 17 nt, Artificial Sequence
  Synthetic Oligonucleotide; CD40LG exon 3; Set C
ccuaccuuuuugcauuu

SEQ ID NO: 33843 - RNA, 23 nt, Artificial Sequence
  Synthetic Oligonucleotide; CD40LG exon 3; Set C
aaaccuaccuuuuugcauuucaa

SEQ ID NO: 33844 - RNA, 16 nt, Artificial Sequence
  Synthetic Oligonucleotide; CD40LG exon 3; Set C
ccuaccuuuuugcauu

SEQ ID NO: 33845 - RNA, 36 nt, Artificial Sequence
  Synthetic Oligonucleotide; CD40LG exon 3; Set A
aaauagcaaaccuaccuuuuugcauuucaaagcugu

SEQ ID NO: 33846 - RNA, 22 nt, Artificial Sequence
  Synthetic Oligonucleotide; CD40LG exon 3; Set C
aaaccuaccuuuuugcauuuca

SEQ ID NO: 33847 - RNA, 21 nt, Artificial Sequence
  Synthetic Oligonucleotide; CD40LG exon 3; Set C
aaaccuaccuuuuugcauuuc

SEQ ID NO: 33848 - RNA, 20 nt, Artificial Sequence
  Synthetic Oligonucleotide; CD40LG exon 3; Set C
aaaccuaccuuuuugcauuu

SEQ ID NO: 33849 - RNA, 19 nt, Artificial Sequence
  Synthetic Oligonucleotide; CD40LG exon 3; Set C
aaaccuaccuuuuugcauu

SEQ ID NO: 33850 - RNA, 29 nt, Artificial Sequence
  Synthetic Oligonucleotide; CD40LG exon 3; Set C
aaauagcaaaccuaccuuuuugcauuuca

SEQ ID NO: 33851 - RNA, 28 nt, Artificial Sequence
  Synthetic Oligonucleotide; CD40LG exon 3; Set C
aaauagcaaaccuaccuuuuugcauuuc

SEQ ID NO: 33852 - RNA, 27 nt, Artificial Sequence
  Synthetic Oligonucleotide; CD40LG exon 3; Set C
aaauagcaaaccuaccuuuuugcauuu

SEQ ID NO: 33853 - RNA, 26 nt, Artificial Sequence
  Synthetic Oligonucleotide; CD40LG exon 3; Set C
aaauagcaaaccuaccuuuuugcauu

SEQ ID NO: 33854 - RNA, 21 nt, Artificial Sequence
  Synthetic Oligonucleotide; CD40LG exon 3; Set C
aaauagcaaaccuaccuuuuu

SEQ ID NO: 33855 - RNA, 20 nt, Artificial Sequence
  Synthetic Oligonucleotide; CD40LG exon 3; Set C
aaauagcaaaccuaccuuuu

SEQ ID NO: 33856 - RNA, 16 nt, Artificial Sequence
  Synthetic Oligonucleotide; CD40LG exon 3; Set C
auagcaaaccuaccuu

SEQ ID NO: 33857 - RNA, 19 nt, Artificial Sequence
  Synthetic Oligonucleotide; CD40LG exon 3; Set C
aaauagcaaaccuaccuuu

SEQ ID NO: 33858 - RNA, 40 nt, Artificial Sequence
  Synthetic Oligonucleotide; CD40LG exon 3; Set A
uagaaauuagcaaauagcaaaccuaccuuuuugcauuuca

SEQ ID NO: 33859 - RNA, 39 nt, Artificial Sequence
  Synthetic Oligonucleotide; CD40LG exon 3; Set A
uagaaauuagcaaauagcaaaccuaccuuuuugcauuuc

SEQ ID NO: 33860 - RNA, 38 nt, Artificial Sequence
  Synthetic Oligonucleotide; CD40LG exon 3; Set A
uagaaauuagcaaauagcaaaccuaccuuuuugcauuu

SEQ ID NO: 33861 - RNA, 37 nt, Artificial Sequence
  Synthetic Oligonucleotide; CD40LG exon 3; Set A
uagaaauuagcaaauagcaaaccuaccuuuuugcauu

SEQ ID NO: 33862 - RNA, 23 nt, Artificial Sequence
  Synthetic Oligonucleotide; CD40LG exon 3; Set C
uuagcaaauagcaaaccuaccuu

SEQ ID NO: 33863 - RNA, 24 nt, Artificial Sequence
  Synthetic Oligonucleotide; CD40LG exon 3; Set C
auuagcaaauagcaaaccuaccuu

SEQ ID NO: 33864 - RNA, 32 nt, Artificial Sequence
  Synthetic Oligonucleotide; CD40LG exon 3; Set C
uagaaauuagcaaauagcaaaccuaccuuuuu

SEQ ID NO: 33865 - RNA, 31 nt, Artificial Sequence
  Synthetic Oligonucleotide; CD40LG exon 3; Set C
uagaaauuagcaaauagcaaaccuaccuuuu

SEQ ID NO: 33866 - RNA, 30 nt, Artificial Sequence
  Synthetic Oligonucleotide; CD40LG exon 3; Set C
uagaaauuagcaaauagcaaaccuaccuuu

SEQ ID NO: 33867 - RNA, 28 nt, Artificial Sequence
  Synthetic Oligonucleotide; CD40LG exon 3; Set C
agaaauuagcaaauagcaaaccuaccuu

SEQ ID NO: 33868 - RNA, 20 nt, Artificial Sequence
  Synthetic Oligonucleotide; CD40LG exon 3; Set C
aauuagcaaauagcaaaccu

SEQ ID NO: 33869 - RNA, 21 nt, Artificial Sequence
  Synthetic Oligonucleotide; CD40LG exon 3; Set C
aaauuagcaaauagcaaaccu

SEQ ID NO: 33870 - RNA, 22 nt, Artificial Sequence
  Synthetic Oligonucleotide; CD40LG exon 3; Set C
gaaauuagcaaauagcaaaccu

SEQ ID NO: 33871 - RNA, 17 nt, Artificial Sequence
  Synthetic Oligonucleotide; CD40LG exon 3; Set C
aauuagcaaauagcaaa

SEQ ID NO: 33872 - RNA, 34 nt, Artificial Sequence
  Synthetic Oligonucleotide; CD40LG exon 3; Set B
auucauagaaauuagcaaauagcaaaccuaccuu

SEQ ID NO: 33873 - RNA, 18 nt, Artificial Sequence
  Synthetic Oligonucleotide; CD40LG exon 3; Set C
aaauuagcaaauagcaaa

SEQ ID NO: 33874 - RNA, 19 nt, Artificial Sequence
  Synthetic Oligonucleotide; CD40LG exon 3; Set C
gaaauuagcaaauagcaaa

SEQ ID NO: 33875 - RNA, 16 nt, Artificial Sequence
  Synthetic Oligonucleotide; CD40LG exon 3; Set C
uagaaauuagcaaaua

SEQ ID NO: 33876 - RNA, 35 nt, Artificial Sequence
  Synthetic Oligonucleotide; CD40LG exon 3; Set B
uuaggcauucauagaaauuagcaaauagcaaaccu

SEQ ID NO: 33877 - RNA, 20 nt, Artificial Sequence
  Synthetic Oligonucleotide; CD40LG exon 3; Set C
uucauagaaauuagcaaaua

SEQ ID NO: 33878 - RNA, 36 nt, Artificial Sequence
  Synthetic Oligonucleotide; CD40LG exon 3; Set B
uuuaggcauucauagaaauuagcaaauagcaaaccu

SEQ ID NO: 33879 - RNA, 19 nt, Artificial Sequence
  Synthetic Oligonucleotide; CD40LG exon 3; Set C
uucauagaaauuagcaaau

SEQ ID NO: 33880 - RNA, 37 nt, Artificial Sequence
  Synthetic Oligonucleotide; CD40LG exon 3; Set B
uuuuaggcauucauagaaauuagcaaauagcaaaccu

SEQ ID NO: 33881 - RNA, 20 nt, Artificial Sequence
  Synthetic Oligonucleotide; CD40LG exon 3; Set C
auucauagaaauuagcaaau

SEQ ID NO: 33882 - RNA, 38 nt, Artificial Sequence
  Synthetic Oligonucleotide; CD40LG exon 3; Set B
uuuuuaggcauucauagaaauuagcaaauagcaaaccu

SEQ ID NO: 33883 - RNA, 32 nt, Artificial Sequence
  Synthetic Oligonucleotide; CD40LG exon 3; Set C
uuaggcauucauagaaauuagcaaauagcaaa

SEQ ID NO: 33884 - RNA, 19 nt, Artificial Sequence
  Synthetic Oligonucleotide; CD40LG exon 3; Set C
auucauagaaauuagcaaa

SEQ ID NO: 33885 - RNA, 39 nt, Artificial Sequence
  Synthetic Oligonucleotide; CD40LG exon 3; Set B
guuuuuaggcauucauagaaauuagcaaauagcaaaccu

SEQ ID NO: 33886 - RNA, 33 nt, Artificial Sequence
  Synthetic Oligonucleotide; CD40LG exon 3; Set C
uuuaggcauucauagaaauuagcaaauagcaaa

SEQ ID NO: 33887 - RNA, 40 nt, Artificial Sequence
  Synthetic Oligonucleotide; CD40LG exon 3; Set B
aguuuuuaggcauucauagaaauuagcaaauagcaaaccu

SEQ ID NO: 33888 - RNA, 34 nt, Artificial Sequence
  Synthetic Oligonucleotide; CD40LG exon 3; Set C
uuuuaggcauucauagaaauuagcaaauagcaaa

SEQ ID NO: 33889 - RNA, 35 nt, Artificial Sequence
  Synthetic Oligonucleotide; CD40LG exon 3; Set C
uuuuuaggcauucauagaaauuagcaaauagcaaa

SEQ ID NO: 33890 - RNA, 36 nt, Artificial Sequence
  Synthetic Oligonucleotide; CD40LG exon 3; Set B
guuuuuaggcauucauagaaauuagcaaauagcaaa

SEQ ID NO: 33891 - RNA, 37 nt, Artificial Sequence
  Synthetic Oligonucleotide; CD40LG exon 3; Set B
aguuuuuaggcauucauagaaauuagcaaauagcaaa

SEQ ID NO: 33892 - RNA, 38 nt, Artificial Sequence
  Synthetic Oligonucleotide; CD40LG exon 3; Set B
uaguuuuuaggcauucauagaaauuagcaaauagcaaa

SEQ ID NO: 33893 - RNA, 25 nt, Artificial Sequence
  Synthetic Oligonucleotide; CD40LG exon 3; Set C
uuaggcauucauagaaauuagcaaa

SEQ ID NO: 33894 - RNA, 39 nt, Artificial Sequence
  Synthetic Oligonucleotide; CD40LG exon 3; Set B
uuaguuuuuaggcauucauagaaauuagcaaauagcaaa

SEQ ID NO: 33895 - RNA, 40 nt, Artificial Sequence
  Synthetic Oligonucleotide; CD40LG exon 3; Set B
uuuaguuuuuaggcauucauagaaauuagcaaauagcaaa

SEQ ID NO: 33896 - RNA, 15 nt, Artificial Sequence
  Synthetic Oligonucleotide; CD40LG exon 3; Set C
uuuaggcauucauag

SEQ ID NO: 33897 - RNA, 16 nt, Artificial Sequence
  Synthetic Oligonucleotide; CD40LG exon 3; Set C
uuuuaggcauucauag

SEQ ID NO: 33898 - RNA, 17 nt, Artificial Sequence
  Synthetic Oligonucleotide; CD40LG exon 3; Set C
uuuuuaggcauucauag

SEQ ID NO: 33899 - RNA, 18 nt, Artificial Sequence
  Synthetic Oligonucleotide; CD40LG exon 3; Set C
guuuuuaggcauucauag

SEQ ID NO: 33900 - RNA, 19 nt, Artificial Sequence
  Synthetic Oligonucleotide; CD40LG exon 3; Set C
aguuuuuaggcauucauag

SEQ ID NO: 33901 - RNA, 20 nt, Artificial Sequence
  Synthetic Oligonucleotide; CD40LG exon 3; Set C
uaguuuuuaggcauucauag

SEQ ID NO: 33902 - RNA, 21 nt, Artificial Sequence
  Synthetic Oligonucleotide; CD40LG exon 3; Set C
uuaguuuuuaggcauucauag

SEQ ID NO: 33903 - RNA, 22 nt, Artificial Sequence
  Synthetic Oligonucleotide; CD40LG exon 3; Set C
uuuaguuuuuaggcauucauag

SEQ ID NO: 33904 - RNA, 23 nt, Artificial Sequence
  Synthetic Oligonucleotide; CD40LG exon 3; Set C
uuuuaguuuuuaggcauucauag

SEQ ID NO: 33905 - RNA, 24 nt, Artificial Sequence
  Synthetic Oligonucleotide; CD40LG exon 3; Set C
cuuuuaguuuuuaggcauucauag

SEQ ID NO: 33906 - RNA, 25 nt, Artificial Sequence
  Synthetic Oligonucleotide; CD40LG exon 3; Set C
ccuuuuaguuuuuaggcauucauag

SEQ ID NO: 33907 - RNA, 21 nt, Artificial Sequence
  Synthetic Oligonucleotide; CD40LG exon 3; Set C
uuuuaguuuuuaggcauucau

SEQ ID NO: 33908 - RNA, 26 nt, Artificial Sequence
  Synthetic Oligonucleotide; CD40LG exon 3; Set C
uccuuuuaguuuuuaggcauucauag

SEQ ID NO: 33909 - RNA, 20 nt, Artificial Sequence
  Synthetic Oligonucleotide; CD40LG exon 3; Set C
uuuuaguuuuuaggcauuca

SEQ ID NO: 33910 - RNA, 27 nt, Artificial Sequence
  Synthetic Oligonucleotide; CD40LG exon 3; Set C
uuccuuuuaguuuuuaggcauucauag

SEQ ID NO: 33911 - RNA, 25 nt, Artificial Sequence
  Synthetic Oligonucleotide; CD40LG exon 3; Set C
uuccuuuuaguuuuuaggcauucau

SEQ ID NO: 33912 - RNA, 24 nt, Artificial Sequence
  Synthetic Oligonucleotide; CD40LG exon 3; Set C
uuccuuuuaguuuuuaggcauuca

SEQ ID NO: 33913 - RNA, 15 nt, Artificial Sequence
  Synthetic Oligonucleotide; CD40LG exon 3; Set C
cuuuuaguuuuuagg

SEQ ID NO: 33914 - RNA, 16 nt, Artificial Sequence
  Synthetic Oligonucleotide; CD40LG exon 3; Set C
ccuuuuaguuuuuagg

SEQ ID NO: 33915 - RNA, 15 nt, Artificial Sequence
  Synthetic Oligonucleotide; CD40LG exon 3; Set C
ccuuuuaguuuuuag

SEQ ID NO: 33916 - RNA, 17 nt, Artificial Sequence
  Synthetic Oligonucleotide; CD40LG exon 3; Set C
uccuuuuaguuuuuagg

SEQ ID NO: 33917 - RNA, 16 nt, Artificial Sequence
  Synthetic Oligonucleotide; CD40LG exon 3; Set C
uccuuuuaguuuuuag

SEQ ID NO: 33918 - RNA, 18 nt, Artificial Sequence
  Synthetic Oligonucleotide; CD40LG exon 3; Set C
uuccuuuuaguuuuuagg

SEQ ID NO: 33919 - RNA, 17 nt, Artificial Sequence
  Synthetic Oligonucleotide; CD40LG exon 3; Set C
uuccuuuuaguuuuuag

SEQ ID NO: 33920 - RNA, 24 nt, Artificial Sequence
  Synthetic Oligonucleotide; CD40LG exon 3; Set A
ucauuuugacaggggcucugcugu

SEQ ID NO: 33921 - RNA, 23 nt, Artificial Sequence
  Synthetic Oligonucleotide; CD40LG exon 3; Set A
ucauuuugacaggggcucugcug

SEQ ID NO: 33922 - RNA, 21 nt, Artificial Sequence
  Synthetic Oligonucleotide; CD40LG exon 3; Set A
cauuuugacaggggcucugcu

SEQ ID NO: 33923 - RNA, 27 nt, Artificial Sequence
  Synthetic Oligonucleotide; CD40LG exon 3; Set C
agaggucauuuugacaggggcucugcu

SEQ ID NO: 33924 - RNA, 28 nt, Artificial Sequence
  Synthetic Oligonucleotide; CD40LG exon 3; Set C
aagaggucauuuugacaggggcucugcu

SEQ ID NO: 33925 - RNA, 26 nt, Artificial Sequence
  Synthetic Oligonucleotide; CD40LG exon 3; Set C
agaggucauuuugacaggggcucugc

SEQ ID NO: 33926 - RNA, 24 nt, Artificial Sequence
  Synthetic Oligonucleotide; CD40LG exon 3; Set A
gaggucauuuugacaggggcucug

SEQ ID NO: 33927 - RNA, 27 nt, Artificial Sequence
  Synthetic Oligonucleotide; CD40LG exon 3; Set C
aagaggucauuuugacaggggcucugc

SEQ ID NO: 33928 - RNA, 25 nt, Artificial Sequence
  Synthetic Oligonucleotide; CD40LG exon 3; Set A
agaggucauuuugacaggggcucug

SEQ ID NO: 33929 - RNA, 24 nt, Artificial Sequence
  Synthetic Oligonucleotide; CD40LG exon 3; Set A
agaggucauuuugacaggggcucu

SEQ ID NO: 33930 - RNA, 26 nt, Artificial Sequence
  Synthetic Oligonucleotide; CD40LG exon 3; Set A
aagaggucauuuugacaggggcucug

SEQ ID NO: 33931 - RNA, 25 nt, Artificial Sequence
  Synthetic Oligonucleotide; CD40LG exon 3; Set A
aagaggucauuuugacaggggcucu

SEQ ID NO: 33932 - RNA, 40 nt, Artificial Sequence
  Synthetic Oligonucleotide; CD40LG exon 3; Set C
aagcauugcaagaggucauuuugacaggggcucugcugug

SEQ ID NO: 33933 - RNA, 39 nt, Artificial Sequence
  Synthetic Oligonucleotide; CD40LG exon 3; Set C
aagcauugcaagaggucauuuugacaggggcucugcugu

SEQ ID NO: 33934 - RNA, 40 nt, Artificial Sequence
  Synthetic Oligonucleotide; CD40LG exon 3; Set C
gaagcauugcaagaggucauuuugacaggggcucugcugu

SEQ ID NO: 33935 - RNA, 39 nt, Artificial Sequence
  Synthetic Oligonucleotide; CD40LG exon 3; Set C
agaagcauugcaagaggucauuuugacaggggcucugcu

SEQ ID NO: 33936 - RNA, 40 nt, Artificial Sequence
  Synthetic Oligonucleotide; CD40LG exon 3; Set C
aagaagcauugcaagaggucauuuugacaggggcucugcu

SEQ ID NO: 33937 - RNA, 38 nt, Artificial Sequence
  Synthetic Oligonucleotide; CD40LG exon 3; Set C
agaagcauugcaagaggucauuuugacaggggcucugc

SEQ ID NO: 33938 - RNA, 39 nt, Artificial Sequence
  Synthetic Oligonucleotide; CD40LG exon 3; Set C
aagaagcauugcaagaggucauuuugacaggggcucugc

SEQ ID NO: 33939 - RNA, 37 nt, Artificial Sequence
  Synthetic Oligonucleotide; CD40LG exon 3; Set C
agaagcauugcaagaggucauuuugacaggggcucug

SEQ ID NO: 33940 - RNA, 40 nt, Artificial Sequence
  Synthetic Oligonucleotide; CD40LG exon 3; Set C
uaagaagcauugcaagaggucauuuugacaggggcucugc

SEQ ID NO: 33941 - RNA, 36 nt, Artificial Sequence
  Synthetic Oligonucleotide; CD40LG exon 3; Set C
agaagcauugcaagaggucauuuugacaggggcucu

SEQ ID NO: 33942 - RNA, 38 nt, Artificial Sequence
  Synthetic Oligonucleotide; CD40LG exon 3; Set C
aagaagcauugcaagaggucauuuugacaggggcucug

SEQ ID NO: 33943 - RNA, 37 nt, Artificial Sequence
  Synthetic Oligonucleotide; CD40LG exon 3; Set C
aagaagcauugcaagaggucauuuugacaggggcucu

SEQ ID NO: 33944 - RNA, 39 nt, Artificial Sequence
  Synthetic Oligonucleotide; CD40LG exon 3; Set C
uaagaagcauugcaagaggucauuuugacaggggcucug

SEQ ID NO: 33945 - RNA, 38 nt, Artificial Sequence
  Synthetic Oligonucleotide; CD40LG exon 3; Set C
uaagaagcauugcaagaggucauuuugacaggggcucu

SEQ ID NO: 33946 - RNA, 17 nt, Artificial Sequence
  Synthetic Oligonucleotide; CD40LG exon 3; Set C
uugcaagaggucauuuu

SEQ ID NO: 33947 - RNA, 16 nt, Artificial Sequence
  Synthetic Oligonucleotide; CD40LG exon 3; Set C
uugcaagaggucauuu

SEQ ID NO: 33948 - RNA, 35 nt, Artificial Sequence
  Synthetic Oligonucleotide; CD40LG exon 3; Set A
auaagaagcauugcaagaggucauuuugacagggg

SEQ ID NO: 33949 - RNA, 36 nt, Artificial Sequence
  Synthetic Oligonucleotide; CD40LG exon 3; Set A
aauaagaagcauugcaagaggucauuuugacagggg

SEQ ID NO: 33950 - RNA, 37 nt, Artificial Sequence
  Synthetic Oligonucleotide; CD40LG exon 3; Set A
aaauaagaagcauugcaagaggucauuuugacagggg

SEQ ID NO: 33951 - RNA, 22 nt, Artificial Sequence
  Synthetic Oligonucleotide; CD40LG exon 3; Set C
aagcauugcaagaggucauuuu

SEQ ID NO: 33952 - RNA, 21 nt, Artificial Sequence
  Synthetic Oligonucleotide; CD40LG exon 3; Set C
aagcauugcaagaggucauuu

SEQ ID NO: 33953 - RNA, 23 nt, Artificial Sequence
  Synthetic Oligonucleotide; CD40LG exon 3; Set C
gaagcauugcaagaggucauuuu

SEQ ID NO: 33954 - RNA, 20 nt, Artificial Sequence
  Synthetic Oligonucleotide; CD40LG exon 3; Set C
aagcauugcaagaggucauu

SEQ ID NO: 33955 - RNA, 22 nt, Artificial Sequence
  Synthetic Oligonucleotide; CD40LG exon 3; Set C
gaagcauugcaagaggucauuu

SEQ ID NO: 33956 - RNA, 21 nt, Artificial Sequence
  Synthetic Oligonucleotide; CD40LG exon 3; Set C
gaagcauugcaagaggucauu

SEQ ID NO: 33957 - RNA, 40 nt, Artificial Sequence
  Synthetic Oligonucleotide; CD40LG exon 3; Set A
ccuaaaauaagaagcauugcaagaggucauuuugacaggg

SEQ ID NO: 33958 - RNA, 39 nt, Artificial Sequence
  Synthetic Oligonucleotide; CD40LG exon 3; Set A
ccuaaaauaagaagcauugcaagaggucauuuugacagg

SEQ ID NO: 33959 - RNA, 21 nt, Artificial Sequence
  Synthetic Oligonucleotide; CD40LG exon 3; Set C
agaagcauugcaagaggucau

SEQ ID NO: 33960 - RNA, 22 nt, Artificial Sequence
  Synthetic Oligonucleotide; CD40LG exon 3; Set C
aagaagcauugcaagaggucau

SEQ ID NO: 33961 - RNA, 23 nt, Artificial Sequence
  Synthetic Oligonucleotide; CD40LG exon 3; Set C
uaagaagcauugcaagaggucau

SEQ ID NO: 33962 - RNA, 15 nt, Artificial Sequence
  Synthetic Oligonucleotide; CD40LG exon 3; Set C
gaagcauugcaagag

SEQ ID NO: 33963 - RNA, 23 nt, Artificial Sequence
  Synthetic Oligonucleotide; CD40LG exon 3; Set C
auaagaagcauugcaagagguca

SEQ ID NO: 33964 - RNA, 24 nt, Artificial Sequence
  Synthetic Oligonucleotide; CD40LG exon 3; Set C
aauaagaagcauugcaagagguca

SEQ ID NO: 33965 - RNA, 33 nt, Artificial Sequence
  Synthetic Oligonucleotide; CD40LG exon 3; Set A
ccuaaaauaagaagcauugcaagaggucauuuu

SEQ ID NO: 33966 - RNA, 25 nt, Artificial Sequence
  Synthetic Oligonucleotide; CD40LG exon 3; Set C
aaauaagaagcauugcaagagguca

SEQ ID NO: 33967 - RNA, 32 nt, Artificial Sequence
  Synthetic Oligonucleotide; CD40LG exon 3; Set C
ccuaaaauaagaagcauugcaagaggucauuu

SEQ ID NO: 33968 - RNA, 26 nt, Artificial Sequence
  Synthetic Oligonucleotide; CD40LG exon 3; Set C
aaaauaagaagcauugcaagagguca

SEQ ID NO: 33969 - RNA, 31 nt, Artificial Sequence
  Synthetic Oligonucleotide; CD40LG exon 3; Set C
ccuaaaauaagaagcauugcaagaggucauu

SEQ ID NO: 33970 - RNA, 29 nt, Artificial Sequence
  Synthetic Oligonucleotide; CD40LG exon 3; Set C
cuaaaauaagaagcauugcaagaggucau

SEQ ID NO: 33971 - RNA, 27 nt, Artificial Sequence
  Synthetic Oligonucleotide; CD40LG exon 3; Set C
uaaaauaagaagcauugcaagagguca

SEQ ID NO: 33972 - RNA, 25 nt, Artificial Sequence
  Synthetic Oligonucleotide; CD40LG exon 3; Set C
ccuaaaauaagaagcauugcaagag

SEQ ID NO: 33973 - RNA, 33 nt, Artificial Sequence
  Synthetic Oligonucleotide; CD40LG exon 3; Set A
auauccuaaaauaagaagcauugcaagagguca

SEQ ID NO: 33974 - RNA, 40 nt, Artificial Sequence
  Synthetic Oligonucleotide; CD40LG exon 3; Set A
cauuauauccuaaaauaagaagcauugcaagaggucauuu

SEQ ID NO: 33975 - RNA, 34 nt, Artificial Sequence
  Synthetic Oligonucleotide; CD40LG exon 3; Set A
uauauccuaaaauaagaagcauugcaagagguca

SEQ ID NO: 33976 - RNA, 39 nt, Artificial Sequence
  Synthetic Oligonucleotide; CD40LG exon 3; Set A
cauuauauccuaaaauaagaagcauugcaagaggucauu

SEQ ID NO: 33977 - RNA, 37 nt, Artificial Sequence
  Synthetic Oligonucleotide; CD40LG exon 3; Set A
auuauauccuaaaauaagaagcauugcaagaggucau

SEQ ID NO: 33978 - RNA, 35 nt, Artificial Sequence
  Synthetic Oligonucleotide; CD40LG exon 3; Set A
uuauauccuaaaauaagaagcauugcaagagguca

SEQ ID NO: 33979 - RNA, 40 nt, Artificial Sequence
  Synthetic Oligonucleotide; CD40LG exon 3; Set A
acauuauauccuaaaauaagaagcauugcaagaggucauu

SEQ ID NO: 33980 - RNA, 33 nt, Artificial Sequence
  Synthetic Oligonucleotide; CD40LG exon 3; Set C
cauuauauccuaaaauaagaagcauugcaagag

SEQ ID NO: 33981 - RNA, 34 nt, Artificial Sequence
  Synthetic Oligonucleotide; CD40LG exon 3; Set C
acauuauauccuaaaauaagaagcauugcaagag

SEQ ID NO: 33982 - RNA, 35 nt, Artificial Sequence
  Synthetic Oligonucleotide; CD40LG exon 3; Set C
aacauuauauccuaaaauaagaagcauugcaagag

SEQ ID NO: 33983 - RNA, 36 nt, Artificial Sequence
  Synthetic Oligonucleotide; CD40LG exon 3; Set C
uaacauuauauccuaaaauaagaagcauugcaagag

SEQ ID NO: 33984 - RNA, 18 nt, Artificial Sequence
  Synthetic Oligonucleotide; CD40LG exon 3; Set C
auauccuaaaauaagaag

SEQ ID NO: 33985 - RNA, 19 nt, Artificial Sequence
  Synthetic Oligonucleotide; CD40LG exon 3; Set C
uauauccuaaaauaagaag

SEQ ID NO: 33986 - RNA, 17 nt, Artificial Sequence
  Synthetic Oligonucleotide; CD40LG exon 3; Set C
auauccuaaaauaagaa

SEQ ID NO: 33987 - RNA, 20 nt, Artificial Sequence
  Synthetic Oligonucleotide; CD40LG exon 3; Set C
uuauauccuaaaauaagaag

SEQ ID NO: 33988 - RNA, 18 nt, Artificial Sequence
  Synthetic Oligonucleotide; CD40LG exon 3; Set C
uauauccuaaaauaagaa

SEQ ID NO: 33989 - RNA, 19 nt, Artificial Sequence
  Synthetic Oligonucleotide; CD40LG exon 3; Set C
uuauauccuaaaauaagaa

SEQ ID NO: 33990 - RNA, 32 nt, Artificial Sequence
  Synthetic Oligonucleotide; CD40LG exon 3; Set C
uuuaacauuauauccuaaaauaagaagcauug

SEQ ID NO: 33991 - RNA, 20 nt, Artificial Sequence
  Synthetic Oligonucleotide; CD40LG exon 3; Set C
cauuauauccuaaaauaaga

SEQ ID NO: 33992 - RNA, 19 nt, Artificial Sequence
  Synthetic Oligonucleotide; CD40LG exon 3; Set C
cauuauauccuaaaauaag

SEQ ID NO: 33993 - RNA, 18 nt, Artificial Sequence
  Synthetic Oligonucleotide; CD40LG exon 3; Set C
cauuauauccuaaaauaa

SEQ ID NO: 33994 - RNA, 26 nt, Artificial Sequence
  Synthetic Oligonucleotide; CD40LG exon 3; Set C
uuaacauuauauccuaaaauaagaag

SEQ ID NO: 33995 - RNA, 19 nt, Artificial Sequence
  Synthetic Oligonucleotide; CD40LG exon 3; Set C
acauuauauccuaaaauaa

SEQ ID NO: 33996 - RNA, 23 nt, Artificial Sequence
  Synthetic Oligonucleotide; CD40LG exon 3; Set C
uaacauuauauccuaaaauaaga

SEQ ID NO: 33997 - RNA, 25 nt, Artificial Sequence
  Synthetic Oligonucleotide; CD40LG exon 3; Set C
uuaacauuauauccuaaaauaagaa

SEQ ID NO: 33998 - RNA, 18 nt, Artificial Sequence
  Synthetic Oligonucleotide; CD40LG exon 3; Set C
acauuauauccuaaaaua

SEQ ID NO: 33999 - RNA, 20 nt, Artificial Sequence
  Synthetic Oligonucleotide; CD40LG exon 3; Set C
aacauuauauccuaaaauaa

SEQ ID NO: 34000 - RNA, 22 nt, Artificial Sequence
  Synthetic Oligonucleotide; CD40LG exon 3; Set C
uaacauuauauccuaaaauaag

SEQ ID NO: 34001 - RNA, 28 nt, Artificial Sequence
  Synthetic Oligonucleotide; CD40LG exon 3; Set C
guuuaacauuauauccuaaaauaagaag

SEQ ID NO: 34002 - RNA, 17 nt, Artificial Sequence
  Synthetic Oligonucleotide; CD40LG exon 3; Set C
acauuauauccuaaaau

SEQ ID NO: 34003 - RNA, 19 nt, Artificial Sequence
  Synthetic Oligonucleotide; CD40LG exon 3; Set C
aacauuauauccuaaaaua

SEQ ID NO: 34004 - RNA, 21 nt, Artificial Sequence
  Synthetic Oligonucleotide; CD40LG exon 3; Set C
uaacauuauauccuaaaauaa

SEQ ID NO: 34005 - RNA, 29 nt, Artificial Sequence
  Synthetic Oligonucleotide; CD40LG exon 3; Set C
uguuuaacauuauauccuaaaauaagaag

SEQ ID NO: 34006 - RNA, 27 nt, Artificial Sequence
  Synthetic Oligonucleotide; CD40LG exon 3; Set C
guuuaacauuauauccuaaaauaagaa

SEQ ID NO: 34007 - RNA, 18 nt, Artificial Sequence
  Synthetic Oligonucleotide; CD40LG exon 3; Set C
aacauuauauccuaaaau

SEQ ID NO: 34008 - RNA, 16 nt, Artificial Sequence
  Synthetic Oligonucleotide; CD40LG exon 3; Set C
acauuauauccuaaaa

SEQ ID NO: 34009 - RNA, 20 nt, Artificial Sequence
  Synthetic Oligonucleotide; CD40LG exon 3; Set C
uaacauuauauccuaaaaua

SEQ ID NO: 34010 - RNA, 30 nt, Artificial Sequence
  Synthetic Oligonucleotide; CD40LG exon 3; Set C
uuguuuaacauuauauccuaaaauaagaag

SEQ ID NO: 34011 - RNA, 28 nt, Artificial Sequence
  Synthetic Oligonucleotide; CD40LG exon 3; Set C
uguuuaacauuauauccuaaaauaagaa

SEQ ID NO: 34012 - RNA, 19 nt, Artificial Sequence
  Synthetic Oligonucleotide; CD40LG exon 3; Set C
uaacauuauauccuaaaau

SEQ ID NO: 34013 - RNA, 17 nt, Artificial Sequence
  Synthetic Oligonucleotide; CD40LG exon 3; Set C
aacauuauauccuaaaa

SEQ ID NO: 34014 - RNA, 15 nt, Artificial Sequence
  Synthetic Oligonucleotide; CD40LG exon 3; Set C
acauuauauccuaaa

SEQ ID NO: 34015 - RNA, 31 nt, Artificial Sequence
  Synthetic Oligonucleotide; CD40LG exon 3; Set C
uuuguuuaacauuauauccuaaaauaagaag

SEQ ID NO: 34016 - RNA, 29 nt, Artificial Sequence
  Synthetic Oligonucleotide; CD40LG exon 3; Set C
uuguuuaacauuauauccuaaaauaagaa

SEQ ID NO: 34017 - RNA, 18 nt, Artificial Sequence
  Synthetic Oligonucleotide; CD40LG exon 3; Set C
uaacauuauauccuaaaa

SEQ ID NO: 34018 - RNA, 16 nt, Artificial Sequence
  Synthetic Oligonucleotide; CD40LG exon 3; Set C
aacauuauauccuaaa

SEQ ID NO: 34019 - RNA, 30 nt, Artificial Sequence
  Synthetic Oligonucleotide; CD40LG exon 3; Set C
uuuguuuaacauuauauccuaaaauaagaa

SEQ ID NO: 34020 - RNA, 17 nt, Artificial Sequence
  Synthetic Oligonucleotide; CD40LG exon 3; Set C
uaacauuauauccuaaa

SEQ ID NO: 34021 - RNA, 15 nt, Artificial Sequence
  Synthetic Oligonucleotide; CD40LG exon 3; Set C
aacauuauauccuaa

SEQ ID NO: 34022 - RNA, 16 nt, Artificial Sequence
  Synthetic Oligonucleotide; CD40LG exon 3; Set C
uaacauuauauccuaa

SEQ ID NO: 34023 - RNA, 15 nt, Artificial Sequence
  Synthetic Oligonucleotide; CD40LG exon 3; Set C
uuaacauuauauccu

SEQ ID NO: 34024 - RNA, 38 nt, Artificial Sequence
  Synthetic Oligonucleotide; CD40LG exon 3; Set C
ucuccucuuuguuuaacauuauauccuaaaauaagaag

SEQ ID NO: 34025 - RNA, 16 nt, Artificial Sequence
  Synthetic Oligonucleotide; CD40LG exon 3; Set C
uuuaacauuauauccu

SEQ ID NO: 34026 - RNA, 39 nt, Artificial Sequence
  Synthetic Oligonucleotide; CD40LG exon 3; Set C
gucuccucuuuguuuaacauuauauccuaaaauaagaag

SEQ ID NO: 34027 - RNA, 37 nt, Artificial Sequence
  Synthetic Oligonucleotide; CD40LG exon 3; Set C
ucuccucuuuguuuaacauuauauccuaaaauaagaa

SEQ ID NO: 34028 - RNA, 17 nt, Artificial Sequence
  Synthetic Oligonucleotide; CD40LG exon 3; Set C
guuuaacauuauauccu

SEQ ID NO: 34029 - RNA, 40 nt, Artificial Sequence
  Synthetic Oligonucleotide; CD40LG exon 3; Set A
cgucuccucuuuguuuaacauuauauccuaaaauaagaag

SEQ ID NO: 34030 - RNA, 38 nt, Artificial Sequence
  Synthetic Oligonucleotide; CD40LG exon 3; Set C
gucuccucuuuguuuaacauuauauccuaaaauaagaa

SEQ ID NO: 34031 - RNA, 18 nt, Artificial Sequence
  Synthetic Oligonucleotide; CD40LG exon 3; Set C
uguuuaacauuauauccu

SEQ ID NO: 34032 - RNA, 39 nt, Artificial Sequence
  Synthetic Oligonucleotide; CD40LG exon 3; Set A
cgucuccucuuuguuuaacauuauauccuaaaauaagaa

SEQ ID NO: 34033 - RNA, 19 nt, Artificial Sequence
  Synthetic Oligonucleotide; CD40LG exon 3; Set C
uuguuuaacauuauauccu

SEQ ID NO: 34034 - RNA, 40 nt, Artificial Sequence
  Synthetic Oligonucleotide; CD40LG exon 3; Set A
ucgucuccucuuuguuuaacauuauauccuaaaauaagaa

SEQ ID NO: 34035 - RNA, 20 nt, Artificial Sequence
  Synthetic Oligonucleotide; CD40LG exon 3; Set C
uuuguuuaacauuauauccu

SEQ ID NO: 34036 - RNA, 27 nt, Artificial Sequence
  Synthetic Oligonucleotide; CD40LG exon 3; Set C
ucuccucuuuguuuaacauuauauccu

SEQ ID NO: 34037 - RNA, 28 nt, Artificial Sequence
  Synthetic Oligonucleotide; CD40LG exon 3; Set C
gucuccucuuuguuuaacauuauauccu

SEQ ID NO: 34038 - RNA, 29 nt, Artificial Sequence
  Synthetic Oligonucleotide; CD40LG exon 3; Set A
cgucuccucuuuguuuaacauuauauccu

SEQ ID NO: 34039 - RNA, 30 nt, Artificial Sequence
  Synthetic Oligonucleotide; CD40LG exon 3; Set A
ucgucuccucuuuguuuaacauuauauccu

SEQ ID NO: 34040 - RNA, 31 nt, Artificial Sequence
  Synthetic Oligonucleotide; CD40LG exon 3; Set A
uucgucuccucuuuguuuaacauuauauccu

SEQ ID NO: 34041 - RNA, 32 nt, Artificial Sequence
  Synthetic Oligonucleotide; CD40LG exon 3; Set A
cuucgucuccucuuuguuuaacauuauauccu

SEQ ID NO: 34042 - RNA, 19 nt, Artificial Sequence
  Synthetic Oligonucleotide; CD40LG exon 3; Set C
cuccucuuuguuuaacauu

SEQ ID NO: 34043 - RNA, 33 nt, Artificial Sequence
  Synthetic Oligonucleotide; CD40LG exon 3; Set A
ucuucgucuccucuuuguuuaacauuauauccu

SEQ ID NO: 34044 - RNA, 34 nt, Artificial Sequence
  Synthetic Oligonucleotide; CD40LG exon 3; Set A
uucuucgucuccucuuuguuuaacauuauauccu

SEQ ID NO: 34045 - RNA, 35 nt, Artificial Sequence
  Synthetic Oligonucleotide; CD40LG exon 3; Set A
uuucuucgucuccucuuuguuuaacauuauauccu

SEQ ID NO: 34046 - RNA, 19 nt, Artificial Sequence
  Synthetic Oligonucleotide; CD40LG exon 3; Set C
ucuccucuuuguuuaacau

SEQ ID NO: 34047 - RNA, 36 nt, Artificial Sequence
  Synthetic Oligonucleotide; CD40LG exon 3; Set A
cuuucuucgucuccucuuuguuuaacauuauauccu

SEQ ID NO: 34048 - RNA, 20 nt, Artificial Sequence
  Synthetic Oligonucleotide; CD40LG exon 3; Set C
gucuccucuuuguuuaacau

SEQ ID NO: 34049 - RNA, 37 nt, Artificial Sequence
  Synthetic Oligonucleotide; CD40LG exon 3; Set A
ucuuucuucgucuccucuuuguuuaacauuauauccu

SEQ ID NO: 34050 - RNA, 21 nt, Artificial Sequence
  Synthetic Oligonucleotide; CD40LG exon 3; Set C
cgucuccucuuuguuuaacau

SEQ ID NO: 34051 - RNA, 38 nt, Artificial Sequence
  Synthetic Oligonucleotide; CD40LG exon 3; Set A
uucuuucuucgucuccucuuuguuuaacauuauauccu

SEQ ID NO: 34052 - RNA, 22 nt, Artificial Sequence
  Synthetic Oligonucleotide; CD40LG exon 3; Set C
ucgucuccucuuuguuuaacau

SEQ ID NO: 34053 - RNA, 39 nt, Artificial Sequence
  Synthetic Oligonucleotide; CD40LG exon 3; Set A
uuucuuucuucgucuccucuuuguuuaacauuauauccu

SEQ ID NO: 34054 - RNA, 23 nt, Artificial Sequence
  Synthetic Oligonucleotide; CD40LG exon 3; Set C
uucgucuccucuuuguuuaacau

SEQ ID NO: 34055 - RNA, 21 nt, Artificial Sequence
  Synthetic Oligonucleotide; CD40LG exon 3; Set C
ucgucuccucuuuguuuaaca

SEQ ID NO: 34056 - RNA, 24 nt, Artificial Sequence
  Synthetic Oligonucleotide; CD40LG exon 3; Set C
cuucgucuccucuuuguuuaacau

SEQ ID NO: 34057 - RNA, 22 nt, Artificial Sequence
  Synthetic Oligonucleotide; CD40LG exon 3; Set C
uucgucuccucuuuguuuaaca

SEQ ID NO: 34058 - RNA, 20 nt, Artificial Sequence
  Synthetic Oligonucleotide; CD40LG exon 3; Set C
ucgucuccucuuuguuuaac

SEQ ID NO: 34059 - RNA, 25 nt, Artificial Sequence
  Synthetic Oligonucleotide; CD40LG exon 3; Set C
ucuucgucuccucuuuguuuaacau

SEQ ID NO: 34060 - RNA, 19 nt, Artificial Sequence
  Synthetic Oligonucleotide; CD40LG exon 3; Set C
ucgucuccucuuuguuuaa

SEQ ID NO: 34061 - RNA, 23 nt, Artificial Sequence
  Synthetic Oligonucleotide; CD40LG exon 3; Set C
cuucgucuccucuuuguuuaaca

SEQ ID NO: 34062 - RNA, 21 nt, Artificial Sequence
  Synthetic Oligonucleotide; CD40LG exon 3; Set C
uucgucuccucuuuguuuaac

SEQ ID NO: 34063 - RNA, 26 nt, Artificial Sequence
  Synthetic Oligonucleotide; CD40LG exon 3; Set C
uucuucgucuccucuuuguuuaacau

SEQ ID NO: 34064 - RNA, 20 nt, Artificial Sequence
  Synthetic Oligonucleotide; CD40LG exon 3; Set C
uucgucuccucuuuguuuaa

SEQ ID NO: 34065 - RNA, 24 nt, Artificial Sequence
  Synthetic Oligonucleotide; CD40LG exon 3; Set C
ucuucgucuccucuuuguuuaaca

SEQ ID NO: 34066 - RNA, 22 nt, Artificial Sequence
  Synthetic Oligonucleotide; CD40LG exon 3; Set C
cuucgucuccucuuuguuuaac

SEQ ID NO: 34067 - RNA, 27 nt, Artificial Sequence
  Synthetic Oligonucleotide; CD40LG exon 3; Set C
uuucuucgucuccucuuuguuuaacau

SEQ ID NO: 34068 - RNA, 21 nt, Artificial Sequence
  Synthetic Oligonucleotide; CD40LG exon 3; Set C
cuucgucuccucuuuguuuaa

SEQ ID NO: 34069 - RNA, 23 nt, Artificial Sequence
  Synthetic Oligonucleotide; CD40LG exon 3; Set C
ucuucgucuccucuuuguuuaac

SEQ ID NO: 34070 - RNA, 25 nt, Artificial Sequence
  Synthetic Oligonucleotide; CD40LG exon 3; Set C
uucuucgucuccucuuuguuuaaca

SEQ ID NO: 34071 - RNA, 28 nt, Artificial Sequence
  Synthetic Oligonucleotide; CD40LG exon 3; Set A
cuuucuucgucuccucuuuguuuaacau

SEQ ID NO: 34072 - RNA, 22 nt, Artificial Sequence
  Synthetic Oligonucleotide; CD40LG exon 3; Set C
ucuucgucuccucuuuguuuaa

SEQ ID NO: 34073 - RNA, 24 nt, Artificial Sequence
  Synthetic Oligonucleotide; CD40LG exon 3; Set C
uucuucgucuccucuuuguuuaac

SEQ ID NO: 34074 - RNA, 26 nt, Artificial Sequence
  Synthetic Oligonucleotide; CD40LG exon 3; Set C
uuucuucgucuccucuuuguuuaaca

SEQ ID NO: 34075 - RNA, 29 nt, Artificial Sequence
  Synthetic Oligonucleotide; CD40LG exon 3; Set A
ucuuucuucgucuccucuuuguuuaacau

SEQ ID NO: 34076 - RNA, 23 nt, Artificial Sequence
  Synthetic Oligonucleotide; CD40LG exon 3; Set C
uucuucgucuccucuuuguuuaa

SEQ ID NO: 34077 - RNA, 25 nt, Artificial Sequence
  Synthetic Oligonucleotide; CD40LG exon 3; Set C
uuucuucgucuccucuuuguuuaac

SEQ ID NO: 34078 - RNA, 27 nt, Artificial Sequence
  Synthetic Oligonucleotide; CD40LG exon 3; Set A
cuuucuucgucuccucuuuguuuaaca

SEQ ID NO: 34079 - RNA, 30 nt, Artificial Sequence
  Synthetic Oligonucleotide; CD40LG exon 3; Set A
uucuuucuucgucuccucuuuguuuaacau

SEQ ID NO: 34080 - RNA, 24 nt, Artificial Sequence
  Synthetic Oligonucleotide; CD40LG exon 3; Set C
uuucuucgucuccucuuuguuuaa

SEQ ID NO: 34081 - RNA, 28 nt, Artificial Sequence
  Synthetic Oligonucleotide; CD40LG exon 3; Set A
ucuuucuucgucuccucuuuguuuaaca

SEQ ID NO: 34082 - RNA, 26 nt, Artificial Sequence
  Synthetic Oligonucleotide; CD40LG exon 3; Set C
cuuucuucgucuccucuuuguuuaac

SEQ ID NO: 34083 - RNA, 39 nt, Artificial Sequence
  Synthetic Oligonucleotide; CD40LG exon 3; Set A
cuguuuucuuucuucgucuccucuuuguuuaacauuaua

SEQ ID NO: 34084 - RNA, 31 nt, Artificial Sequence
  Synthetic Oligonucleotide; CD40LG exon 3; Set A
uuucuuucuucgucuccucuuuguuuaacau

SEQ ID NO: 34085 - RNA, 25 nt, Artificial Sequence
  Synthetic Oligonucleotide; CD40LG exon 3; Set C
cuuucuucgucuccucuuuguuuaa

SEQ ID NO: 34086 - RNA, 29 nt, Artificial Sequence
  Synthetic Oligonucleotide; CD40LG exon 3; Set A
uucuuucuucgucuccucuuuguuuaaca

SEQ ID NO: 34087 - RNA, 27 nt, Artificial Sequence
  Synthetic Oligonucleotide; CD40LG exon 3; Set A
ucuuucuucgucuccucuuuguuuaac

SEQ ID NO: 34088 - RNA, 38 nt, Artificial Sequence
  Synthetic Oligonucleotide; CD40LG exon 3; Set A
cuguuuucuuucuucgucuccucuuuguuuaacauuau

SEQ ID NO: 34089 - RNA, 26 nt, Artificial Sequence
  Synthetic Oligonucleotide; CD40LG exon 3; Set C
ucuuucuucgucuccucuuuguuuaa

SEQ ID NO: 34090 - RNA, 30 nt, Artificial Sequence
  Synthetic Oligonucleotide; CD40LG exon 3; Set A
uuucuuucuucgucuccucuuuguuuaaca

SEQ ID NO: 34091 - RNA, 28 nt, Artificial Sequence
  Synthetic Oligonucleotide; CD40LG exon 3; Set A
uucuuucuucgucuccucuuuguuuaac

SEQ ID NO: 34092 - RNA, 37 nt, Artificial Sequence
  Synthetic Oligonucleotide; CD40LG exon 3; Set A
cuguuuucuuucuucgucuccucuuuguuuaacauua

SEQ ID NO: 34093 - RNA, 27 nt, Artificial Sequence
  Synthetic Oligonucleotide; CD40LG exon 3; Set C
uucuuucuucgucuccucuuuguuuaa

SEQ ID NO: 34094 - RNA, 31 nt, Artificial Sequence
  Synthetic Oligonucleotide; CD40LG exon 3; Set A
uuuucuuucuucgucuccucuuuguuuaaca

SEQ ID NO: 34095 - RNA, 29 nt, Artificial Sequence
  Synthetic Oligonucleotide; CD40LG exon 3; Set A
uuucuuucuucgucuccucuuuguuuaac

SEQ ID NO: 34096 - RNA, 28 nt, Artificial Sequence
  Synthetic Oligonucleotide; CD40LG exon 3; Set C
uuucuuucuucgucuccucuuuguuuaa

SEQ ID NO: 34097 - RNA, 30 nt, Artificial Sequence
  Synthetic Oligonucleotide; CD40LG exon 3; Set A
uuuucuuucuucgucuccucuuuguuuaac

SEQ ID NO: 34098 - RNA, 32 nt, Artificial Sequence
  Synthetic Oligonucleotide; CD40LG exon 3; Set A
guuuucuuucuucgucuccucuuuguuuaaca

SEQ ID NO: 34099 - RNA, 33 nt, Artificial Sequence
  Synthetic Oligonucleotide; CD40LG exon 3; Set A
uguuuucuuucuucgucuccucuuuguuuaaca

SEQ ID NO: 34100 - RNA, 31 nt, Artificial Sequence
  Synthetic Oligonucleotide; CD40LG exon 3; Set A
guuuucuuucuucgucuccucuuuguuuaac

SEQ ID NO: 34101 - RNA, 32 nt, Artificial Sequence
  Synthetic Oligonucleotide; CD40LG exon 3; Set A
uguuuucuuucuucgucuccucuuuguuuaac

SEQ ID NO: 34102 - RNA, 31 nt, Artificial Sequence
  Synthetic Oligonucleotide; CD40LG exon 3; Set A
cuguuuucuuucuucgucuccucuuuguuua

SEQ ID NO: 34103 - RNA, 38 nt, Artificial Sequence
  Synthetic Oligonucleotide; CD40LG exon 3; Set A
aaagcuguuuucuuucuucgucuccucuuuguuuaaca

SEQ ID NO: 34104 - RNA, 29 nt, Artificial Sequence
  Synthetic Oligonucleotide; CD40LG exon 3; Set A
cuguuuucuuucuucgucuccucuuuguu

SEQ ID NO: 34105 - RNA, 37 nt, Artificial Sequence
  Synthetic Oligonucleotide; CD40LG exon 3; Set A
aaagcuguuuucuuucuucgucuccucuuuguuuaac

SEQ ID NO: 34106 - RNA, 39 nt, Artificial Sequence
  Synthetic Oligonucleotide; CD40LG exon 3; Set A
caaagcuguuuucuuucuucgucuccucuuuguuuaaca

SEQ ID NO: 34107 - RNA, 28 nt, Artificial Sequence
  Synthetic Oligonucleotide; CD40LG exon 3; Set A
cuguuuucuuucuucgucuccucuuugu

SEQ ID NO: 34108 - RNA, 38 nt, Artificial Sequence
  Synthetic Oligonucleotide; CD40LG exon 3; Set A
caaagcuguuuucuuucuucgucuccucuuuguuuaac

SEQ ID NO: 34109 - RNA, 40 nt, Artificial Sequence
  Synthetic Oligonucleotide; CD40LG exon 3; Set C
ucaaagcuguuuucuuucuucgucuccucuuuguuuaaca

SEQ ID NO: 34110 - RNA, 27 nt, Artificial Sequence
  Synthetic Oligonucleotide; CD40LG exon 3; Set A
cuguuuucuuucuucgucuccucuuug

SEQ ID NO: 34111 - RNA, 39 nt, Artificial Sequence
  Synthetic Oligonucleotide; CD40LG exon 3; Set A
ucaaagcuguuuucuuucuucgucuccucuuuguuuaac

SEQ ID NO: 34112 - RNA, 26 nt, Artificial Sequence
  Synthetic Oligonucleotide; CD40LG exon 3; Set A
cuguuuucuuucuucgucuccucuuu

SEQ ID NO: 34113 - RNA, 40 nt, Artificial Sequence
  Synthetic Oligonucleotide; CD40LG exon 3; Set A
uucaaagcuguuuucuuucuucgucuccucuuuguuuaac

SEQ ID NO: 34114 - RNA, 20 nt, Artificial Sequence
  Synthetic Oligonucleotide; CD40LG exon 3; Set C
cuguuuucuuucuucgucuc

SEQ ID NO: 34115 - RNA, 39 nt, Artificial Sequence
  Synthetic Oligonucleotide; CD40LG exon 3; Set A
cauuucaaagcuguuuucuuucuucgucuccucuuuguu

SEQ ID NO: 34116 - RNA, 38 nt, Artificial Sequence
  Synthetic Oligonucleotide; CD40LG exon 3; Set A
cauuucaaagcuguuuucuuucuucgucuccucuuugu

SEQ ID NO: 34117 - RNA, 37 nt, Artificial Sequence
  Synthetic Oligonucleotide; CD40LG exon 3; Set A
cauuucaaagcuguuuucuuucuucgucuccucuuug

SEQ ID NO: 34118 - RNA, 36 nt, Artificial Sequence
  Synthetic Oligonucleotide; CD40LG exon 3; Set A
cauuucaaagcuguuuucuuucuucgucuccucuuu

SEQ ID NO: 34119 - RNA, 30 nt, Artificial Sequence
  Synthetic Oligonucleotide; CD40LG exon 3; Set A
cauuucaaagcuguuuucuuucuucgucuc

SEQ ID NO: 34120 - RNA, 28 nt, Artificial Sequence
  Synthetic Oligonucleotide; CD40LG exon 3; Set C
cauuucaaagcuguuuucuuucuucguc

SEQ ID NO: 34121 - RNA, 27 nt, Artificial Sequence
  Synthetic Oligonucleotide; CD40LG exon 3; Set C
cauuucaaagcuguuuucuuucuucgu

SEQ ID NO: 34122 - RNA, 38 nt, Artificial Sequence
  Synthetic Oligonucleotide; CD40LG exon 3; Set A
ccuuuuugcauuucaaagcuguuuucuuucuucgucuc

SEQ ID NO: 34123 - RNA, 37 nt, Artificial Sequence
  Synthetic Oligonucleotide; CD40LG exon 3; Set A
ccuuuuugcauuucaaagcuguuuucuuucuucgucu

SEQ ID NO: 34124 - RNA, 39 nt, Artificial Sequence
  Synthetic Oligonucleotide; CD40LG exon 3; Set C
accuuuuugcauuucaaagcuguuuucuuucuucgucuc

SEQ ID NO: 34125 - RNA, 20 nt, Artificial Sequence
  Synthetic Oligonucleotide; CD40LG exon 3; Set C
cauuucaaagcuguuuucuu

SEQ ID NO: 34126 - RNA, 38 nt, Artificial Sequence
  Synthetic Oligonucleotide; CD40LG exon 3; Set A
accuuuuugcauuucaaagcuguuuucuuucuucgucu

SEQ ID NO: 34127 - RNA, 36 nt, Artificial Sequence
  Synthetic Oligonucleotide; CD40LG exon 3; Set A
ccuuuuugcauuucaaagcuguuuucuuucuucguc

SEQ ID NO: 34128 - RNA, 40 nt, Artificial Sequence
  Synthetic Oligonucleotide; CD40LG exon 3; Set C
uaccuuuuugcauuucaaagcuguuuucuuucuucgucuc

SEQ ID NO: 34129 - RNA, 19 nt, Artificial Sequence
  Synthetic Oligonucleotide; CD40LG exon 3; Set C
cauuucaaagcuguuuucu

SEQ ID NO: 34130 - RNA, 39 nt, Artificial Sequence
  Synthetic Oligonucleotide; CD40LG exon 3; Set C
uaccuuuuugcauuucaaagcuguuuucuuucuucgucu

SEQ ID NO: 34131 - RNA, 37 nt, Artificial Sequence
  Synthetic Oligonucleotide; CD40LG exon 3; Set A
accuuuuugcauuucaaagcuguuuucuuucuucguc

SEQ ID NO: 34132 - RNA, 35 nt, Artificial Sequence
  Synthetic Oligonucleotide; CD40LG exon 3; Set A
ccuuuuugcauuucaaagcuguuuucuuucuucgu

SEQ ID NO: 34133 - RNA, 18 nt, Artificial Sequence
  Synthetic Oligonucleotide; CD40LG exon 3; Set C
cauuucaaagcuguuuuc

SEQ ID NO: 34134 - RNA, 40 nt, Artificial Sequence
  Synthetic Oligonucleotide; CD40LG exon 3; Set C
cuaccuuuuugcauuucaaagcuguuuucuuucuucgucu

SEQ ID NO: 34135 - RNA, 38 nt, Artificial Sequence
  Synthetic Oligonucleotide; CD40LG exon 3; Set A
uaccuuuuugcauuucaaagcuguuuucuuucuucguc

SEQ ID NO: 34136 - RNA, 36 nt, Artificial Sequence
  Synthetic Oligonucleotide; CD40LG exon 3; Set A
accuuuuugcauuucaaagcuguuuucuuucuucgu

SEQ ID NO: 34137 - RNA, 39 nt, Artificial Sequence
  Synthetic Oligonucleotide; CD40LG exon 3; Set A
cuaccuuuuugcauuucaaagcuguuuucuuucuucguc

SEQ ID NO: 34138 - RNA, 37 nt, Artificial Sequence
  Synthetic Oligonucleotide; CD40LG exon 3; Set A
uaccuuuuugcauuucaaagcuguuuucuuucuucgu

SEQ ID NO: 34139 - RNA, 38 nt, Artificial Sequence
  Synthetic Oligonucleotide; CD40LG exon 3; Set A
cuaccuuuuugcauuucaaagcuguuuucuuucuucgu

SEQ ID NO: 34140 - RNA, 37 nt, Artificial Sequence
  Synthetic Oligonucleotide; CD40LG exon 3; Set A
cuaccuuuuugcauuucaaagcuguuuucuuucuucg

SEQ ID NO: 34141 - RNA, 36 nt, Artificial Sequence
  Synthetic Oligonucleotide; CD40LG exon 3; Set A
cuaccuuuuugcauuucaaagcuguuuucuuucuuc

SEQ ID NO: 34142 - RNA, 39 nt, Artificial Sequence
  Synthetic Oligonucleotide; CD40LG exon 3; Set C
accuaccuuuuugcauuucaaagcuguuuucuuucuucg

SEQ ID NO: 34143 - RNA, 29 nt, Artificial Sequence
  Synthetic Oligonucleotide; CD40LG exon 3; Set C
ccuuuuugcauuucaaagcuguuuucuuu

SEQ ID NO: 34144 - RNA, 38 nt, Artificial Sequence
  Synthetic Oligonucleotide; CD40LG exon 3; Set A
accuaccuuuuugcauuucaaagcuguuuucuuucuuc

SEQ ID NO: 34145 - RNA, 40 nt, Artificial Sequence
  Synthetic Oligonucleotide; CD40LG exon 3; Set A
aaccuaccuuuuugcauuucaaagcuguuuucuuucuucg

SEQ ID NO: 34146 - RNA, 30 nt, Artificial Sequence
  Synthetic Oligonucleotide; CD40LG exon 3; Set A
accuuuuugcauuucaaagcuguuuucuuu

SEQ ID NO: 34147 - RNA, 28 nt, Artificial Sequence
  Synthetic Oligonucleotide; CD40LG exon 3; Set C
ccuuuuugcauuucaaagcuguuuucuu

SEQ ID NO: 34148 - RNA, 37 nt, Artificial Sequence
  Synthetic Oligonucleotide; CD40LG exon 3; Set A
accuaccuuuuugcauuucaaagcuguuuucuuucuu

SEQ ID NO: 34149 - RNA, 39 nt, Artificial Sequence
  Synthetic Oligonucleotide; CD40LG exon 3; Set A
aaccuaccuuuuugcauuucaaagcuguuuucuuucuuc

SEQ ID NO: 34150 - RNA, 31 nt, Artificial Sequence
  Synthetic Oligonucleotide; CD40LG exon 3; Set A
uaccuuuuugcauuucaaagcuguuuucuuu

SEQ ID NO: 34151 - RNA, 27 nt, Artificial Sequence
  Synthetic Oligonucleotide; CD40LG exon 3; Set C
ccuuuuugcauuucaaagcuguuuucu

SEQ ID NO: 34152 - RNA, 29 nt, Artificial Sequence
  Synthetic Oligonucleotide; CD40LG exon 3; Set A
accuuuuugcauuucaaagcuguuuucuu

SEQ ID NO: 34153 - RNA, 36 nt, Artificial Sequence
  Synthetic Oligonucleotide; CD40LG exon 3; Set A
accuaccuuuuugcauuucaaagcuguuuucuuucu

SEQ ID NO: 34154 - RNA, 38 nt, Artificial Sequence
  Synthetic Oligonucleotide; CD40LG exon 3; Set A
aaccuaccuuuuugcauuucaaagcuguuuucuuucuu

SEQ ID NO: 34155 - RNA, 32 nt, Artificial Sequence
  Synthetic Oligonucleotide; CD40LG exon 3; Set A
cuaccuuuuugcauuucaaagcuguuuucuuu

SEQ ID NO: 34156 - RNA, 26 nt, Artificial Sequence
  Synthetic Oligonucleotide; CD40LG exon 3; Set C
ccuuuuugcauuucaaagcuguuuuc

SEQ ID NO: 34157 - RNA, 28 nt, Artificial Sequence
  Synthetic Oligonucleotide; CD40LG exon 3; Set A
accuuuuugcauuucaaagcuguuuucu

SEQ ID NO: 34158 - RNA, 30 nt, Artificial Sequence
  Synthetic Oligonucleotide; CD40LG exon 3; Set A
uaccuuuuugcauuucaaagcuguuuucuu

SEQ ID NO: 34159 - RNA, 37 nt, Artificial Sequence
  Synthetic Oligonucleotide; CD40LG exon 3; Set A
aaccuaccuuuuugcauuucaaagcuguuuucuuucu

SEQ ID NO: 34160 - RNA, 35 nt, Artificial Sequence
  Synthetic Oligonucleotide; CD40LG exon 3; Set A
accuaccuuuuugcauuucaaagcuguuuucuuuc

SEQ ID NO: 34161 - RNA, 27 nt, Artificial Sequence
  Synthetic Oligonucleotide; CD40LG exon 3; Set C
accuuuuugcauuucaaagcuguuuuc

SEQ ID NO: 34162 - RNA, 29 nt, Artificial Sequence
  Synthetic Oligonucleotide; CD40LG exon 3; Set A
uaccuuuuugcauuucaaagcuguuuucu

SEQ ID NO: 34163 - RNA, 31 nt, Artificial Sequence
  Synthetic Oligonucleotide; CD40LG exon 3; Set A
cuaccuuuuugcauuucaaagcuguuuucuu

SEQ ID NO: 34164 - RNA, 36 nt, Artificial Sequence
  Synthetic Oligonucleotide; CD40LG exon 3; Set A
aaccuaccuuuuugcauuucaaagcuguuuucuuuc

SEQ ID NO: 34165 - RNA, 34 nt, Artificial Sequence
  Synthetic Oligonucleotide; CD40LG exon 3; Set A
accuaccuuuuugcauuucaaagcuguuuucuuu

SEQ ID NO: 34166 - RNA, 28 nt, Artificial Sequence
  Synthetic Oligonucleotide; CD40LG exon 3; Set C
uaccuuuuugcauuucaaagcuguuuuc

SEQ ID NO: 34167 - RNA, 30 nt, Artificial Sequence
  Synthetic Oligonucleotide; CD40LG exon 3; Set A
cuaccuuuuugcauuucaaagcuguuuucu

SEQ ID NO: 34168 - RNA, 35 nt, Artificial Sequence
  Synthetic Oligonucleotide; CD40LG exon 3; Set A
aaccuaccuuuuugcauuucaaagcuguuuucuuu

SEQ ID NO: 34169 - RNA, 29 nt, Artificial Sequence
  Synthetic Oligonucleotide; CD40LG exon 3; Set A
cuaccuuuuugcauuucaaagcuguuuuc

SEQ ID NO: 34170 - RNA, 28 nt, Artificial Sequence
  Synthetic Oligonucleotide; CD40LG exon 3; Set C
cuaccuuuuugcauuucaaagcuguuuu

SEQ ID NO: 34171 - RNA, 20 nt, Artificial Sequence
  Synthetic Oligonucleotide; CD40LG exon 3; Set C
cuuuuugcauuucaaagcug

SEQ ID NO: 34172 - RNA, 30 nt, Artificial Sequence
  Synthetic Oligonucleotide; CD40LG exon 3; Set A
accuaccuuuuugcauuucaaagcuguuuu

SEQ ID NO: 34173 - RNA, 29 nt, Artificial Sequence
  Synthetic Oligonucleotide; CD40LG exon 3; Set A
accuaccuuuuugcauuucaaagcuguuu

SEQ ID NO: 34174 - RNA, 25 nt, Artificial Sequence
  Synthetic Oligonucleotide; CD40LG exon 3; Set C
cuaccuuuuugcauuucaaagcugu

SEQ ID NO: 34175 - RNA, 31 nt, Artificial Sequence
  Synthetic Oligonucleotide; CD40LG exon 3; Set A
aaccuaccuuuuugcauuucaaagcuguuuu

SEQ ID NO: 34176 - RNA, 30 nt, Artificial Sequence
  Synthetic Oligonucleotide; CD40LG exon 3; Set A
aaccuaccuuuuugcauuucaaagcuguuu

SEQ ID NO: 34177 - RNA, 28 nt, Artificial Sequence
  Synthetic Oligonucleotide; CD40LG exon 3; Set A
accuaccuuuuugcauuucaaagcuguu

SEQ ID NO: 34178 - RNA, 29 nt, Artificial Sequence
  Synthetic Oligonucleotide; CD40LG exon 3; Set A
aaccuaccuuuuugcauuucaaagcuguu

SEQ ID NO: 34179 - RNA, 27 nt, Artificial Sequence
  Synthetic Oligonucleotide; CD40LG exon 3; Set A
accuaccuuuuugcauuucaaagcugu

SEQ ID NO: 34180 - RNA, 28 nt, Artificial Sequence
  Synthetic Oligonucleotide; CD40LG exon 3; Set A
aaccuaccuuuuugcauuucaaagcugu

SEQ ID NO: 34181 - RNA, 35 nt, Artificial Sequence
  Synthetic Oligonucleotide; CD40LG exon 3; Set A
uagcaaaccuaccuuuuugcauuucaaagcuguuu

SEQ ID NO: 34182 - RNA, 22 nt, Artificial Sequence
  Synthetic Oligonucleotide; CD40LG exon 3; Set C
accuaccuuuuugcauuucaaa

SEQ ID NO: 34183 - RNA, 23 nt, Artificial Sequence
  Synthetic Oligonucleotide; CD40LG exon 3; Set C
aaccuaccuuuuugcauuucaaa

SEQ ID NO: 34184 - RNA, 21 nt, Artificial Sequence
  Synthetic Oligonucleotide; CD40LG exon 3; Set C
accuaccuuuuugcauuucaa

SEQ ID NO: 34185 - RNA, 22 nt, Artificial Sequence
  Synthetic Oligonucleotide; CD40LG exon 3; Set C
aaccuaccuuuuugcauuucaa

SEQ ID NO: 34186 - RNA, 20 nt, Artificial Sequence
  Synthetic Oligonucleotide; CD40LG exon 3; Set C
accuaccuuuuugcauuuca

SEQ ID NO: 34187 - RNA, 15 nt, Artificial Sequence
  Synthetic Oligonucleotide; CD40LG exon 3; Set C
cuaccuuuuugcauu

SEQ ID NO: 34188 - RNA, 21 nt, Artificial Sequence
  Synthetic Oligonucleotide; CD40LG exon 3; Set C
aaccuaccuuuuugcauuuca

SEQ ID NO: 34189 - RNA, 19 nt, Artificial Sequence
  Synthetic Oligonucleotide; CD40LG exon 3; Set C
accuaccuuuuugcauuuc

SEQ ID NO: 34190 - RNA, 33 nt, Artificial Sequence
  Synthetic Oligonucleotide; CD40LG exon 3; Set A
auagcaaaccuaccuuuuugcauuucaaagcug

SEQ ID NO: 34191 - RNA, 18 nt, Artificial Sequence
  Synthetic Oligonucleotide; CD40LG exon 3; Set C
accuaccuuuuugcauuu

SEQ ID NO: 34192 - RNA, 20 nt, Artificial Sequence
  Synthetic Oligonucleotide; CD40LG exon 3; Set C
aaccuaccuuuuugcauuuc

SEQ ID NO: 34193 - RNA, 19 nt, Artificial Sequence
  Synthetic Oligonucleotide; CD40LG exon 3; Set C
aaccuaccuuuuugcauuu

SEQ ID NO: 34194 - RNA, 17 nt, Artificial Sequence
  Synthetic Oligonucleotide; CD40LG exon 3; Set C
accuaccuuuuugcauu

SEQ ID NO: 34195 - RNA, 28 nt, Artificial Sequence
  Synthetic Oligonucleotide; CD40LG exon 3; Set C
uagcaaaccuaccuuuuugcauuucaaa

SEQ ID NO: 34196 - RNA, 18 nt, Artificial Sequence
  Synthetic Oligonucleotide; CD40LG exon 3; Set C
aaccuaccuuuuugcauu

SEQ ID NO: 34197 - RNA, 40 nt, Artificial Sequence
  Synthetic Oligonucleotide; CD40LG exon 3; Set A
agcaaauagcaaaccuaccuuuuugcauuucaaagcuguu

SEQ ID NO: 34198 - RNA, 40 nt, Artificial Sequence
  Synthetic Oligonucleotide; CD40LG exon 3; Set A
uagcaaauagcaaaccuaccuuuuugcauuucaaagcugu

SEQ ID NO: 34199 - RNA, 40 nt, Artificial Sequence
  Synthetic Oligonucleotide; CD40LG exon 3; Set A
uuagcaaauagcaaaccuaccuuuuugcauuucaaagcug

SEQ ID NO: 34200 - RNA, 34 nt, Artificial Sequence
  Synthetic Oligonucleotide; CD40LG exon 3; Set A
agcaaauagcaaaccuaccuuuuugcauuucaaa

SEQ ID NO: 34201 - RNA, 35 nt, Artificial Sequence
  Synthetic Oligonucleotide; CD40LG exon 3; Set A
uagcaaauagcaaaccuaccuuuuugcauuucaaa

SEQ ID NO: 34202 - RNA, 33 nt, Artificial Sequence
  Synthetic Oligonucleotide; CD40LG exon 3; Set A
agcaaauagcaaaccuaccuuuuugcauuucaa

SEQ ID NO: 34203 - RNA, 23 nt, Artificial Sequence
  Synthetic Oligonucleotide; CD40LG exon 3; Set C
auagcaaaccuaccuuuuugcau

SEQ ID NO: 34204 - RNA, 34 nt, Artificial Sequence
  Synthetic Oligonucleotide; CD40LG exon 3; Set A
uagcaaauagcaaaccuaccuuuuugcauuucaa

SEQ ID NO: 34205 - RNA, 33 nt, Artificial Sequence
  Synthetic Oligonucleotide; CD40LG exon 3; Set A
uagcaaauagcaaaccuaccuuuuugcauuuca

SEQ ID NO: 34206 - RNA, 32 nt, Artificial Sequence
  Synthetic Oligonucleotide; CD40LG exon 3; Set A
uagcaaauagcaaaccuaccuuuuugcauuuc

SEQ ID NO: 34207 - RNA, 31 nt, Artificial Sequence
  Synthetic Oligonucleotide; CD40LG exon 3; Set A
uagcaaauagcaaaccuaccuuuuugcauuu

SEQ ID NO: 34208 - RNA, 17 nt, Artificial Sequence
  Synthetic Oligonucleotide; CD40LG exon 3; Set C
aauagcaaaccuaccuu

SEQ ID NO: 34209 - RNA, 31 nt, Artificial Sequence
  Synthetic Oligonucleotide; CD40LG exon 3; Set A
auuagcaaauagcaaaccuaccuuuuugcau

SEQ ID NO: 34210 - RNA, 18 nt, Artificial Sequence
  Synthetic Oligonucleotide; CD40LG exon 3; Set C
aaauagcaaaccuaccuu

SEQ ID NO: 34211 - RNA, 32 nt, Artificial Sequence
  Synthetic Oligonucleotide; CD40LG exon 3; Set A
aauuagcaaauagcaaaccuaccuuuuugcau

SEQ ID NO: 34212 - RNA, 33 nt, Artificial Sequence
  Synthetic Oligonucleotide; CD40LG exon 3; Set A
aaauuagcaaauagcaaaccuaccuuuuugcau

SEQ ID NO: 34213 - RNA, 40 nt, Artificial Sequence
  Synthetic Oligonucleotide; CD40LG exon 3; Set A
auagaaauuagcaaauagcaaaccuaccuuuuugcauuuc

SEQ ID NO: 34214 - RNA, 34 nt, Artificial Sequence
  Synthetic Oligonucleotide; CD40LG exon 3; Set A
gaaauuagcaaauagcaaaccuaccuuuuugcau

SEQ ID NO: 34215 - RNA, 39 nt, Artificial Sequence
  Synthetic Oligonucleotide; CD40LG exon 3; Set A
auagaaauuagcaaauagcaaaccuaccuuuuugcauuu

SEQ ID NO: 34216 - RNA, 35 nt, Artificial Sequence
  Synthetic Oligonucleotide; CD40LG exon 3; Set A
agaaauuagcaaauagcaaaccuaccuuuuugcau

SEQ ID NO: 34217 - RNA, 40 nt, Artificial Sequence
  Synthetic Oligonucleotide; CD40LG exon 3; Set A
cauagaaauuagcaaauagcaaaccuaccuuuuugcauuu

SEQ ID NO: 34218 - RNA, 38 nt, Artificial Sequence
  Synthetic Oligonucleotide; CD40LG exon 3; Set A
auagaaauuagcaaauagcaaaccuaccuuuuugcauu

SEQ ID NO: 34219 - RNA, 39 nt, Artificial Sequence
  Synthetic Oligonucleotide; CD40LG exon 3; Set A
cauagaaauuagcaaauagcaaaccuaccuuuuugcauu

SEQ ID NO: 34220 - RNA, 40 nt, Artificial Sequence
  Synthetic Oligonucleotide; CD40LG exon 3; Set A
ucauagaaauuagcaaauagcaaaccuaccuuuuugcauu

SEQ ID NO: 34221 - RNA, 23 nt, Artificial Sequence
  Synthetic Oligonucleotide; CD40LG exon 3; Set C
auuagcaaauagcaaaccuaccu

SEQ ID NO: 34222 - RNA, 24 nt, Artificial Sequence
  Synthetic Oligonucleotide; CD40LG exon 3; Set C
aauuagcaaauagcaaaccuaccu

SEQ ID NO: 34223 - RNA, 33 nt, Artificial Sequence
  Synthetic Oligonucleotide; CD40LG exon 3; Set C
auagaaauuagcaaauagcaaaccuaccuuuuu

SEQ ID NO: 34224 - RNA, 25 nt, Artificial Sequence
  Synthetic Oligonucleotide; CD40LG exon 3; Set C
aaauuagcaaauagcaaaccuaccu

SEQ ID NO: 34225 - RNA, 23 nt, Artificial Sequence
  Synthetic Oligonucleotide; CD40LG exon 3; Set C
aauuagcaaauagcaaaccuacc

SEQ ID NO: 34226 - RNA, 32 nt, Artificial Sequence
  Synthetic Oligonucleotide; CD40LG exon 3; Set C
auagaaauuagcaaauagcaaaccuaccuuuu

SEQ ID NO: 34227 - RNA, 34 nt, Artificial Sequence
  Synthetic Oligonucleotide; CD40LG exon 3; Set C
cauagaaauuagcaaauagcaaaccuaccuuuuu

SEQ ID NO: 34228 - RNA, 18 nt, Artificial Sequence
  Synthetic Oligonucleotide; CD40LG exon 3; Set C
uuagcaaauagcaaaccu

SEQ ID NO: 34229 - RNA, 26 nt, Artificial Sequence
  Synthetic Oligonucleotide; CD40LG exon 3; Set C
gaaauuagcaaauagcaaaccuaccu

SEQ ID NO: 34230 - RNA, 24 nt, Artificial Sequence
  Synthetic Oligonucleotide; CD40LG exon 3; Set C
aaauuagcaaauagcaaaccuacc

SEQ ID NO: 34231 - RNA, 22 nt, Artificial Sequence
  Synthetic Oligonucleotide; CD40LG exon 3; Set C
aauuagcaaauagcaaaccuac

SEQ ID NO: 34232 - RNA, 33 nt, Artificial Sequence
  Synthetic Oligonucleotide; CD40LG exon 3; Set C
cauagaaauuagcaaauagcaaaccuaccuuuu

SEQ ID NO: 34233 - RNA, 31 nt, Artificial Sequence
  Synthetic Oligonucleotide; CD40LG exon 3; Set C
auagaaauuagcaaauagcaaaccuaccuuu

SEQ ID NO: 34234 - RNA, 35 nt, Artificial Sequence
  Synthetic Oligonucleotide; CD40LG exon 3; Set A
ucauagaaauuagcaaauagcaaaccuaccuuuuu

SEQ ID NO: 34235 - RNA, 29 nt, Artificial Sequence
  Synthetic Oligonucleotide; CD40LG exon 3; Set C
uagaaauuagcaaauagcaaaccuaccuu

SEQ ID NO: 34236 - RNA, 19 nt, Artificial Sequence
  Synthetic Oligonucleotide; CD40LG exon 3; Set C
auuagcaaauagcaaaccu

SEQ ID NO: 34237 - RNA, 25 nt, Artificial Sequence
  Synthetic Oligonucleotide; CD40LG exon 3; Set C
gaaauuagcaaauagcaaaccuacc

SEQ ID NO: 34238 - RNA, 23 nt, Artificial Sequence
  Synthetic Oligonucleotide; CD40LG exon 3; Set C
aaauuagcaaauagcaaaccuac

SEQ ID NO: 34239 - RNA, 21 nt, Artificial Sequence
  Synthetic Oligonucleotide; CD40LG exon 3; Set C
aauuagcaaauagcaaaccua

SEQ ID NO: 34240 - RNA, 34 nt, Artificial Sequence
  Synthetic Oligonucleotide; CD40LG exon 3; Set A
ucauagaaauuagcaaauagcaaaccuaccuuuu

SEQ ID NO: 34241 - RNA, 32 nt, Artificial Sequence
  Synthetic Oligonucleotide; CD40LG exon 3; Set C
cauagaaauuagcaaauagcaaaccuaccuuu

SEQ ID NO: 34242 - RNA, 24 nt, Artificial Sequence
  Synthetic Oligonucleotide; CD40LG exon 3; Set C
gaaauuagcaaauagcaaaccuac

SEQ ID NO: 34243 - RNA, 22 nt, Artificial Sequence
  Synthetic Oligonucleotide; CD40LG exon 3; Set C
aaauuagcaaauagcaaaccua

SEQ ID NO: 34244 - RNA, 33 nt, Artificial Sequence
  Synthetic Oligonucleotide; CD40LG exon 3; Set A
ucauagaaauuagcaaauagcaaaccuaccuuu

SEQ ID NO: 34245 - RNA, 15 nt, Artificial Sequence
  Synthetic Oligonucleotide; CD40LG exon 3; Set C
uuagcaaauagcaaa

SEQ ID NO: 34246 - RNA, 23 nt, Artificial Sequence
  Synthetic Oligonucleotide; CD40LG exon 3; Set C
gaaauuagcaaauagcaaaccua

SEQ ID NO: 34247 - RNA, 16 nt, Artificial Sequence
  Synthetic Oligonucleotide; CD40LG exon 3; Set C
auuagcaaauagcaaa

SEQ ID NO: 34248 - RNA, 33 nt, Artificial Sequence
  Synthetic Oligonucleotide; CD40LG exon 3; Set B
uucauagaaauuagcaaauagcaaaccuaccuu

SEQ ID NO: 34249 - RNA, 23 nt, Artificial Sequence
  Synthetic Oligonucleotide; CD40LG exon 3; Set C
agaaauuagcaaauagcaaaccu

SEQ ID NO: 34250 - RNA, 40 nt, Artificial Sequence
  Synthetic Oligonucleotide; CD40LG exon 3; Set A
aggcauucauagaaauuagcaaauagcaaaccuaccuuuu

SEQ ID NO: 34251 - RNA, 20 nt, Artificial Sequence
  Synthetic Oligonucleotide; CD40LG exon 3; Set C
agaaauuagcaaauagcaaa

SEQ ID NO: 34252 - RNA, 39 nt, Artificial Sequence
  Synthetic Oligonucleotide; CD40LG exon 3; Set A
aggcauucauagaaauuagcaaauagcaaaccuaccuuu

SEQ ID NO: 34253 - RNA, 40 nt, Artificial Sequence
  Synthetic Oligonucleotide; CD40LG exon 3; Set A
uaggcauucauagaaauuagcaaauagcaaaccuaccuuu

SEQ ID NO: 34254 - RNA, 29 nt, Artificial Sequence
  Synthetic Oligonucleotide; CD40LG exon 3; Set C
auucauagaaauuagcaaauagcaaaccu

SEQ ID NO: 34255 - RNA, 39 nt, Artificial Sequence
  Synthetic Oligonucleotide; CD40LG exon 3; Set B
uuaggcauucauagaaauuagcaaauagcaaaccuaccu

SEQ ID NO: 34256 - RNA, 26 nt, Artificial Sequence
  Synthetic Oligonucleotide; CD40LG exon 3; Set C
auucauagaaauuagcaaauagcaaa

SEQ ID NO: 34257 - RNA, 40 nt, Artificial Sequence
  Synthetic Oligonucleotide; CD40LG exon 3; Set B
uuuaggcauucauagaaauuagcaaauagcaaaccuaccu

SEQ ID NO: 34258 - RNA, 38 nt, Artificial Sequence
  Synthetic Oligonucleotide; CD40LG exon 3; Set B
uuaggcauucauagaaauuagcaaauagcaaaccuacc

SEQ ID NO: 34259 - RNA, 17 nt, Artificial Sequence
  Synthetic Oligonucleotide; CD40LG exon 3; Set C
auagaaauuagcaaaua

SEQ ID NO: 34260 - RNA, 15 nt, Artificial Sequence
  Synthetic Oligonucleotide; CD40LG exon 3; Set C
uagaaauuagcaaau

SEQ ID NO: 34261 - RNA, 39 nt, Artificial Sequence
  Synthetic Oligonucleotide; CD40LG exon 3; Set B
uuuaggcauucauagaaauuagcaaauagcaaaccuacc

SEQ ID NO: 34262 - RNA, 37 nt, Artificial Sequence
  Synthetic Oligonucleotide; CD40LG exon 3; Set B
uuaggcauucauagaaauuagcaaauagcaaaccuac

SEQ ID NO: 34263 - RNA, 18 nt, Artificial Sequence
  Synthetic Oligonucleotide; CD40LG exon 3; Set C
cauagaaauuagcaaaua

SEQ ID NO: 34264 - RNA, 40 nt, Artificial Sequence
  Synthetic Oligonucleotide; CD40LG exon 3; Set B
uuuuaggcauucauagaaauuagcaaauagcaaaccuacc

SEQ ID NO: 34265 - RNA, 38 nt, Artificial Sequence
  Synthetic Oligonucleotide; CD40LG exon 3; Set B
uuuaggcauucauagaaauuagcaaauagcaaaccuac

SEQ ID NO: 34266 - RNA, 36 nt, Artificial Sequence
  Synthetic Oligonucleotide; CD40LG exon 3; Set B
uuaggcauucauagaaauuagcaaauagcaaaccua

SEQ ID NO: 34267 - RNA, 19 nt, Artificial Sequence
  Synthetic Oligonucleotide; CD40LG exon 3; Set C
ucauagaaauuagcaaaua

SEQ ID NO: 34268 - RNA, 39 nt, Artificial Sequence
  Synthetic Oligonucleotide; CD40LG exon 3; Set B
uuuuaggcauucauagaaauuagcaaauagcaaaccuac

SEQ ID NO: 34269 - RNA, 37 nt, Artificial Sequence
  Synthetic Oligonucleotide; CD40LG exon 3; Set B
uuuaggcauucauagaaauuagcaaauagcaaaccua

SEQ ID NO: 34270 - RNA, 40 nt, Artificial Sequence
  Synthetic Oligonucleotide; CD40LG exon 3; Set B
uuuuuaggcauucauagaaauuagcaaauagcaaaccuac

SEQ ID NO: 34271 - RNA, 38 nt, Artificial Sequence
  Synthetic Oligonucleotide; CD40LG exon 3; Set B
uuuuaggcauucauagaaauuagcaaauagcaaaccua

SEQ ID NO: 34272 - RNA, 39 nt, Artificial Sequence
  Synthetic Oligonucleotide; CD40LG exon 3; Set B
uuuuuaggcauucauagaaauuagcaaauagcaaaccua

SEQ ID NO: 34273 - RNA, 18 nt, Artificial Sequence
  Synthetic Oligonucleotide; CD40LG exon 3; Set C
uucauagaaauuagcaaa

SEQ ID NO: 34274 - RNA, 40 nt, Artificial Sequence
  Synthetic Oligonucleotide; CD40LG exon 3; Set B
guuuuuaggcauucauagaaauuagcaaauagcaaaccua

SEQ ID NO: 34275 - RNA, 36 nt, Artificial Sequence
  Synthetic Oligonucleotide; CD40LG exon 3; Set C
uuuuuaggcauucauagaaauuagcaaauagcaaac

SEQ ID NO: 34276 - RNA, 38 nt, Artificial Sequence
  Synthetic Oligonucleotide; CD40LG exon 3; Set B
guuuuuaggcauucauagaaauuagcaaauagcaaacc

SEQ ID NO: 34277 - RNA, 37 nt, Artificial Sequence
  Synthetic Oligonucleotide; CD40LG exon 3; Set B
guuuuuaggcauucauagaaauuagcaaauagcaaac

SEQ ID NO: 34278 - RNA, 39 nt, Artificial Sequence
  Synthetic Oligonucleotide; CD40LG exon 3; Set B
aguuuuuaggcauucauagaaauuagcaaauagcaaacc

SEQ ID NO: 34279 - RNA, 26 nt, Artificial Sequence
  Synthetic Oligonucleotide; CD40LG exon 3; Set C
uaggcauucauagaaauuagcaaaua

SEQ ID NO: 34280 - RNA, 38 nt, Artificial Sequence
  Synthetic Oligonucleotide; CD40LG exon 3; Set B
aguuuuuaggcauucauagaaauuagcaaauagcaaac

SEQ ID NO: 34281 - RNA, 40 nt, Artificial Sequence
  Synthetic Oligonucleotide; CD40LG exon 3; Set B
uaguuuuuaggcauucauagaaauuagcaaauagcaaacc

SEQ ID NO: 34282 - RNA, 39 nt, Artificial Sequence
  Synthetic Oligonucleotide; CD40LG exon 3; Set B
uaguuuuuaggcauucauagaaauuagcaaauagcaaac

SEQ ID NO: 34283 - RNA, 40 nt, Artificial Sequence
  Synthetic Oligonucleotide; CD40LG exon 3; Set B
uuaguuuuuaggcauucauagaaauuagcaaauagcaaac

SEQ ID NO: 34284 - RNA, 30 nt, Artificial Sequence
  Synthetic Oligonucleotide; CD40LG exon 3; Set C
uuuuaggcauucauagaaauuagcaaauag

SEQ ID NO: 34285 - RNA, 31 nt, Artificial Sequence
  Synthetic Oligonucleotide; CD40LG exon 3; Set C
uuuuuaggcauucauagaaauuagcaaauag

SEQ ID NO: 34286 - RNA, 32 nt, Artificial Sequence
  Synthetic Oligonucleotide; CD40LG exon 3; Set C
guuuuuaggcauucauagaaauuagcaaauag

SEQ ID NO: 34287 - RNA, 33 nt, Artificial Sequence
  Synthetic Oligonucleotide; CD40LG exon 3; Set C
aguuuuuaggcauucauagaaauuagcaaauag

SEQ ID NO: 34288 - RNA, 34 nt, Artificial Sequence
  Synthetic Oligonucleotide; CD40LG exon 3; Set C
uaguuuuuaggcauucauagaaauuagcaaauag

SEQ ID NO: 34289 - RNA, 17 nt, Artificial Sequence
  Synthetic Oligonucleotide; CD40LG exon 3; Set C
aggcauucauagaaauu

SEQ ID NO: 34290 - RNA, 19 nt, Artificial Sequence
  Synthetic Oligonucleotide; CD40LG exon 3; Set C
uaggcauucauagaaauua

SEQ ID NO: 34291 - RNA, 21 nt, Artificial Sequence
  Synthetic Oligonucleotide; CD40LG exon 3; Set C
uuaggcauucauagaaauuag

SEQ ID NO: 34292 - RNA, 23 nt, Artificial Sequence
  Synthetic Oligonucleotide; CD40LG exon 3; Set C
uuuaggcauucauagaaauuagc

SEQ ID NO: 34293 - RNA, 35 nt, Artificial Sequence
  Synthetic Oligonucleotide; CD40LG exon 3; Set C
uuaguuuuuaggcauucauagaaauuagcaaauag

SEQ ID NO: 34294 - RNA, 16 nt, Artificial Sequence
  Synthetic Oligonucleotide; CD40LG exon 3; Set C
aggcauucauagaaau

SEQ ID NO: 34295 - RNA, 18 nt, Artificial Sequence
  Synthetic Oligonucleotide; CD40LG exon 3; Set C
uaggcauucauagaaauu

SEQ ID NO: 34296 - RNA, 22 nt, Artificial Sequence
  Synthetic Oligonucleotide; CD40LG exon 3; Set C
uuuaggcauucauagaaauuag

SEQ ID NO: 34297 - RNA, 24 nt, Artificial Sequence
  Synthetic Oligonucleotide; CD40LG exon 3; Set C
uuuuaggcauucauagaaauuagc

SEQ ID NO: 34298 - RNA, 36 nt, Artificial Sequence
  Synthetic Oligonucleotide; CD40LG exon 3; Set C
uuuaguuuuuaggcauucauagaaauuagcaaauag

SEQ ID NO: 34299 - RNA, 17 nt, Artificial Sequence
  Synthetic Oligonucleotide; CD40LG exon 3; Set C
uaggcauucauagaaau

SEQ ID NO: 34300 - RNA, 15 nt, Artificial Sequence
  Synthetic Oligonucleotide; CD40LG exon 3; Set C
aggcauucauagaaa

SEQ ID NO: 34301 - RNA, 23 nt, Artificial Sequence
  Synthetic Oligonucleotide; CD40LG exon 3; Set C
uuuuaggcauucauagaaauuag

SEQ ID NO: 34302 - RNA, 25 nt, Artificial Sequence
  Synthetic Oligonucleotide; CD40LG exon 3; Set C
uuuuuaggcauucauagaaauuagc

SEQ ID NO: 34303 - RNA, 37 nt, Artificial Sequence
  Synthetic Oligonucleotide; CD40LG exon 3; Set C
uuuuaguuuuuaggcauucauagaaauuagcaaauag

SEQ ID NO: 34304 - RNA, 16 nt, Artificial Sequence
  Synthetic Oligonucleotide; CD40LG exon 3; Set C
uaggcauucauagaaa

SEQ ID NO: 34305 - RNA, 24 nt, Artificial Sequence
  Synthetic Oligonucleotide; CD40LG exon 3; Set C
uuuuuaggcauucauagaaauuag

SEQ ID NO: 34306 - RNA, 26 nt, Artificial Sequence
  Synthetic Oligonucleotide; CD40LG exon 3; Set C
guuuuuaggcauucauagaaauuagc

SEQ ID NO: 34307 - RNA, 38 nt, Artificial Sequence
  Synthetic Oligonucleotide; CD40LG exon 3; Set C
cuuuuaguuuuuaggcauucauagaaauuagcaaauag

SEQ ID NO: 34308 - RNA, 15 nt, Artificial Sequence
  Synthetic Oligonucleotide; CD40LG exon 3; Set C
uaggcauucauagaa

SEQ ID NO: 34309 - RNA, 25 nt, Artificial Sequence
  Synthetic Oligonucleotide; CD40LG exon 3; Set C
guuuuuaggcauucauagaaauuag

SEQ ID NO: 34310 - RNA, 27 nt, Artificial Sequence
  Synthetic Oligonucleotide; CD40LG exon 3; Set C
aguuuuuaggcauucauagaaauuagc

SEQ ID NO: 34311 - RNA, 39 nt, Artificial Sequence
  Synthetic Oligonucleotide; CD40LG exon 3; Set B
ccuuuuaguuuuuaggcauucauagaaauuagcaaauag

SEQ ID NO: 34312 - RNA, 26 nt, Artificial Sequence
  Synthetic Oligonucleotide; CD40LG exon 3; Set C
aguuuuuaggcauucauagaaauuag

SEQ ID NO: 34313 - RNA, 28 nt, Artificial Sequence
  Synthetic Oligonucleotide; CD40LG exon 3; Set C
uaguuuuuaggcauucauagaaauuagc

SEQ ID NO: 34314 - RNA, 40 nt, Artificial Sequence
  Synthetic Oligonucleotide; CD40LG exon 3; Set B
uccuuuuaguuuuuaggcauucauagaaauuagcaaauag

SEQ ID NO: 34315 - RNA, 27 nt, Artificial Sequence
  Synthetic Oligonucleotide; CD40LG exon 3; Set C
uaguuuuuaggcauucauagaaauuag

SEQ ID NO: 34316 - RNA, 29 nt, Artificial Sequence
  Synthetic Oligonucleotide; CD40LG exon 3; Set C
uuaguuuuuaggcauucauagaaauuagc

SEQ ID NO: 34317 - RNA, 28 nt, Artificial Sequence
  Synthetic Oligonucleotide; CD40LG exon 3; Set C
uuaguuuuuaggcauucauagaaauuag

SEQ ID NO: 34318 - RNA, 30 nt, Artificial Sequence
  Synthetic Oligonucleotide; CD40LG exon 3; Set C
uuuaguuuuuaggcauucauagaaauuagc

SEQ ID NO: 34319 - RNA, 29 nt, Artificial Sequence
  Synthetic Oligonucleotide; CD40LG exon 3; Set C
uuuaguuuuuaggcauucauagaaauuag

SEQ ID NO: 34320 - RNA, 31 nt, Artificial Sequence
  Synthetic Oligonucleotide; CD40LG exon 3; Set C
uuuuaguuuuuaggcauucauagaaauuagc

SEQ ID NO: 34321 - RNA, 30 nt, Artificial Sequence
  Synthetic Oligonucleotide; CD40LG exon 3; Set C
uuuuaguuuuuaggcauucauagaaauuag

SEQ ID NO: 34322 - RNA, 32 nt, Artificial Sequence
  Synthetic Oligonucleotide; CD40LG exon 3; Set C
cuuuuaguuuuuaggcauucauagaaauuagc

SEQ ID NO: 34323 - RNA, 15 nt, Artificial Sequence
  Synthetic Oligonucleotide; CD40LG exon 3; Set C
uuuuaggcauucaua

SEQ ID NO: 34324 - RNA, 31 nt, Artificial Sequence
  Synthetic Oligonucleotide; CD40LG exon 3; Set C
cuuuuaguuuuuaggcauucauagaaauuag

SEQ ID NO: 34325 - RNA, 33 nt, Artificial Sequence
  Synthetic Oligonucleotide; CD40LG exon 3; Set B
ccuuuuaguuuuuaggcauucauagaaauuagc

SEQ ID NO: 34326 - RNA, 16 nt, Artificial Sequence
  Synthetic Oligonucleotide; CD40LG exon 3; Set C
uuuuuaggcauucaua

SEQ ID NO: 34327 - RNA, 32 nt, Artificial Sequence
  Synthetic Oligonucleotide; CD40LG exon 3; Set C
ccuuuuaguuuuuaggcauucauagaaauuag

SEQ ID NO: 34328 - RNA, 34 nt, Artificial Sequence
  Synthetic Oligonucleotide; CD40LG exon 3; Set B
uccuuuuaguuuuuaggcauucauagaaauuagc

SEQ ID NO: 34329 - RNA, 15 nt, Artificial Sequence
  Synthetic Oligonucleotide; CD40LG exon 3; Set C
uuuuuaggcauucau

SEQ ID NO: 34330 - RNA, 17 nt, Artificial Sequence
  Synthetic Oligonucleotide; CD40LG exon 3; Set C
guuuuuaggcauucaua

SEQ ID NO: 34331 - RNA, 33 nt, Artificial Sequence
  Synthetic Oligonucleotide; CD40LG exon 3; Set C
uccuuuuaguuuuuaggcauucauagaaauuag

SEQ ID NO: 34332 - RNA, 35 nt, Artificial Sequence
  Synthetic Oligonucleotide; CD40LG exon 3; Set B
uuccuuuuaguuuuuaggcauucauagaaauuagc

SEQ ID NO: 34333 - RNA, 16 nt, Artificial Sequence
  Synthetic Oligonucleotide; CD40LG exon 3; Set C
guuuuuaggcauucau

SEQ ID NO: 34334 - RNA, 18 nt, Artificial Sequence
  Synthetic Oligonucleotide; CD40LG exon 3; Set C
aguuuuuaggcauucaua

SEQ ID NO: 34335 - RNA, 34 nt, Artificial Sequence
  Synthetic Oligonucleotide; CD40LG exon 3; Set C
uuccuuuuaguuuuuaggcauucauagaaauuag

SEQ ID NO: 34336 - RNA, 17 nt, Artificial Sequence
  Synthetic Oligonucleotide; CD40LG exon 3; Set C
aguuuuuaggcauucau

SEQ ID NO: 34337 - RNA, 15 nt, Artificial Sequence
  Synthetic Oligonucleotide; CD40LG exon 3; Set C
guuuuuaggcauuca

SEQ ID NO: 34338 - RNA, 19 nt, Artificial Sequence
  Synthetic Oligonucleotide; CD40LG exon 3; Set C
uaguuuuuaggcauucaua

SEQ ID NO: 34339 - RNA, 18 nt, Artificial Sequence
  Synthetic Oligonucleotide; CD40LG exon 3; Set C
uaguuuuuaggcauucau

SEQ ID NO: 34340 - RNA, 16 nt, Artificial Sequence
  Synthetic Oligonucleotide; CD40LG exon 3; Set C
aguuuuuaggcauuca

SEQ ID NO: 34341 - RNA, 20 nt, Artificial Sequence
  Synthetic Oligonucleotide; CD40LG exon 3; Set C
uuaguuuuuaggcauucaua

SEQ ID NO: 34342 - RNA, 19 nt, Artificial Sequence
  Synthetic Oligonucleotide; CD40LG exon 3; Set C
uuaguuuuuaggcauucau

SEQ ID NO: 34343 - RNA, 17 nt, Artificial Sequence
  Synthetic Oligonucleotide; CD40LG exon 3; Set C
uaguuuuuaggcauuca

SEQ ID NO: 34344 - RNA, 21 nt, Artificial Sequence
  Synthetic Oligonucleotide; CD40LG exon 3; Set C
uuuaguuuuuaggcauucaua

SEQ ID NO: 34345 - RNA, 20 nt, Artificial Sequence
  Synthetic Oligonucleotide; CD40LG exon 3; Set C
uuuaguuuuuaggcauucau

SEQ ID NO: 34346 - RNA, 18 nt, Artificial Sequence
  Synthetic Oligonucleotide; CD40LG exon 3; Set C
uuaguuuuuaggcauuca

SEQ ID NO: 34347 - RNA, 22 nt, Artificial Sequence
  Synthetic Oligonucleotide; CD40LG exon 3; Set C
uuuuaguuuuuaggcauucaua

SEQ ID NO: 34348 - RNA, 19 nt, Artificial Sequence
  Synthetic Oligonucleotide; CD40LG exon 3; Set C
uuuaguuuuuaggcauuca

SEQ ID NO: 34349 - RNA, 23 nt, Artificial Sequence
  Synthetic Oligonucleotide; CD40LG exon 3; Set C
cuuuuaguuuuuaggcauucaua

SEQ ID NO: 34350 - RNA, 22 nt, Artificial Sequence
  Synthetic Oligonucleotide; CD40LG exon 3; Set C
cuuuuaguuuuuaggcauucau

SEQ ID NO: 34351 - RNA, 24 nt, Artificial Sequence
  Synthetic Oligonucleotide; CD40LG exon 3; Set C
ccuuuuaguuuuuaggcauucaua

SEQ ID NO: 34352 - RNA, 23 nt, Artificial Sequence
  Synthetic Oligonucleotide; CD40LG exon 3; Set C
ccuuuuaguuuuuaggcauucau

SEQ ID NO: 34353 - RNA, 21 nt, Artificial Sequence
  Synthetic Oligonucleotide; CD40LG exon 3; Set C
cuuuuaguuuuuaggcauuca

SEQ ID NO: 34354 - RNA, 25 nt, Artificial Sequence
  Synthetic Oligonucleotide; CD40LG exon 3; Set C
uccuuuuaguuuuuaggcauucaua

SEQ ID NO: 34355 - RNA, 15 nt, Artificial Sequence
  Synthetic Oligonucleotide; CD40LG exon 3; Set C
uuaguuuuuaggcau

SEQ ID NO: 34356 - RNA, 24 nt, Artificial Sequence
  Synthetic Oligonucleotide; CD40LG exon 3; Set C
uccuuuuaguuuuuaggcauucau

SEQ ID NO: 34357 - RNA, 22 nt, Artificial Sequence
  Synthetic Oligonucleotide; CD40LG exon 3; Set C
ccuuuuaguuuuuaggcauuca

SEQ ID NO: 34358 - RNA, 26 nt, Artificial Sequence
  Synthetic Oligonucleotide; CD40LG exon 3; Set C
uuccuuuuaguuuuuaggcauucaua

SEQ ID NO: 34359 - RNA, 16 nt, Artificial Sequence
  Synthetic Oligonucleotide; CD40LG exon 3; Set C
uuuaguuuuuaggcau

SEQ ID NO: 34360 - RNA, 23 nt, Artificial Sequence
  Synthetic Oligonucleotide; CD40LG exon 3; Set C
uccuuuuaguuuuuaggcauuca

SEQ ID NO: 34361 - RNA, 17 nt, Artificial Sequence
  Synthetic Oligonucleotide; CD40LG exon 3; Set C
uuuuaguuuuuaggcau

SEQ ID NO: 34362 - RNA, 15 nt, Artificial Sequence
  Synthetic Oligonucleotide; CD40LG exon 3; Set C
uuuaguuuuuaggca

SEQ ID NO: 34363 - RNA, 18 nt, Artificial Sequence
  Synthetic Oligonucleotide; CD40LG exon 3; Set C
cuuuuaguuuuuaggcau

SEQ ID NO: 34364 - RNA, 16 nt, Artificial Sequence
  Synthetic Oligonucleotide; CD40LG exon 3; Set C
uuuuaguuuuuaggca

SEQ ID NO: 34365 - RNA, 19 nt, Artificial Sequence
  Synthetic Oligonucleotide; CD40LG exon 3; Set C
ccuuuuaguuuuuaggcau

SEQ ID NO: 34366 - RNA, 20 nt, Artificial Sequence
  Synthetic Oligonucleotide; CD40LG exon 3; Set C
uccuuuuaguuuuuaggcau

SEQ ID NO: 34367 - RNA, 18 nt, Artificial Sequence
  Synthetic Oligonucleotide; CD40LG exon 3; Set C
ccuuuuaguuuuuaggca

SEQ ID NO: 34368 - RNA, 21 nt, Artificial Sequence
  Synthetic Oligonucleotide; CD40LG exon 3; Set C
uuccuuuuaguuuuuaggcau

SEQ ID NO: 34369 - RNA, 20 nt, Artificial Sequence
  Synthetic Oligonucleotide; CD40LG exon 3; Set C
uuccuuuuaguuuuuaggca

SEQ ID NO: 34370 - RNA, 19 nt, Artificial Sequence
  Synthetic Oligonucleotide; CD40LG exon 3; Set C
uuccuuuuaguuuuuaggc

SEQ ID NO: 34371 - RNA, 15 nt, Artificial Sequence
  Synthetic Oligonucleotide; NDFIP1 exon 2; Set C
uaauguaagcauaaa

SEQ ID NO: 34372 - RNA, 16 nt, Artificial Sequence
  Synthetic Oligonucleotide; NDFIP1 exon 2; Set C
uuaauguaagcauaaa

SEQ ID NO: 34373 - RNA, 15 nt, Artificial Sequence
  Synthetic Oligonucleotide; NDFIP1 exon 2; Set C
uuaauguaagcauaa

SEQ ID NO: 34374 - RNA, 17 nt, Artificial Sequence
  Synthetic Oligonucleotide; NDFIP1 exon 2; Set C
uuuaauguaagcauaaa

SEQ ID NO: 34375 - RNA, 16 nt, Artificial Sequence
  Synthetic Oligonucleotide; NDFIP1 exon 2; Set C
uuuaauguaagcauaa

SEQ ID NO: 34376 - RNA, 18 nt, Artificial Sequence
  Synthetic Oligonucleotide; NDFIP1 exon 2; Set C
uuuuaauguaagcauaaa

SEQ ID NO: 34377 - RNA, 17 nt, Artificial Sequence
  Synthetic Oligonucleotide; NDFIP1 exon 2; Set C
uuuuaauguaagcauaa

SEQ ID NO: 34378 - RNA, 15 nt, Artificial Sequence
  Synthetic Oligonucleotide; NDFIP1 exon 2; Set C
uuuaauguaagcaua

SEQ ID NO: 34379 - RNA, 19 nt, Artificial Sequence
  Synthetic Oligonucleotide; NDFIP1 exon 2; Set C
auuuuaauguaagcauaaa

SEQ ID NO: 34380 - RNA, 18 nt, Artificial Sequence
  Synthetic Oligonucleotide; NDFIP1 exon 2; Set C
auuuuaauguaagcauaa

SEQ ID NO: 34381 - RNA, 16 nt, Artificial Sequence
  Synthetic Oligonucleotide; NDFIP1 exon 2; Set C
uuuuaauguaagcaua

SEQ ID NO: 34382 - RNA, 20 nt, Artificial Sequence
  Synthetic Oligonucleotide; NDFIP1 exon 2; Set C
uauuuuaauguaagcauaaa

SEQ ID NO: 34383 - RNA, 19 nt, Artificial Sequence
  Synthetic Oligonucleotide; NDFIP1 exon 2; Set C
uauuuuaauguaagcauaa

SEQ ID NO: 34384 - RNA, 17 nt, Artificial Sequence
  Synthetic Oligonucleotide; NDFIP1 exon 2; Set C
auuuuaauguaagcaua

SEQ ID NO: 34385 - RNA, 21 nt, Artificial Sequence
  Synthetic Oligonucleotide; NDFIP1 exon 2; Set C
auauuuuaauguaagcauaaa

SEQ ID NO: 34386 - RNA, 20 nt, Artificial Sequence
  Synthetic Oligonucleotide; NDFIP1 exon 2; Set C
auauuuuaauguaagcauaa

SEQ ID NO: 34387 - RNA, 18 nt, Artificial Sequence
  Synthetic Oligonucleotide; NDFIP1 exon 2; Set C
uauuuuaauguaagcaua

SEQ ID NO: 34388 - RNA, 22 nt, Artificial Sequence
  Synthetic Oligonucleotide; NDFIP1 exon 2; Set C
cauauuuuaauguaagcauaaa

SEQ ID NO: 34389 - RNA, 21 nt, Artificial Sequence
  Synthetic Oligonucleotide; NDFIP1 exon 2; Set C
cauauuuuaauguaagcauaa

SEQ ID NO: 34390 - RNA, 19 nt, Artificial Sequence
  Synthetic Oligonucleotide; NDFIP1 exon 2; Set C
auauuuuaauguaagcaua

SEQ ID NO: 34391 - RNA, 23 nt, Artificial Sequence
  Synthetic Oligonucleotide; NDFIP1 exon 2; Set C
ucauauuuuaauguaagcauaaa

SEQ ID NO: 34392 - RNA, 22 nt, Artificial Sequence
  Synthetic Oligonucleotide; NDFIP1 exon 2; Set C
ucauauuuuaauguaagcauaa

SEQ ID NO: 34393 - RNA, 20 nt, Artificial Sequence
  Synthetic Oligonucleotide; NDFIP1 exon 2; Set C
cauauuuuaauguaagcaua

SEQ ID NO: 34394 - RNA, 24 nt, Artificial Sequence
  Synthetic Oligonucleotide; NDFIP1 exon 2; Set C
uucauauuuuaauguaagcauaaa

SEQ ID NO: 34395 - RNA, 23 nt, Artificial Sequence
  Synthetic Oligonucleotide; NDFIP1 exon 2; Set C
uucauauuuuaauguaagcauaa

SEQ ID NO: 34396 - RNA, 21 nt, Artificial Sequence
  Synthetic Oligonucleotide; NDFIP1 exon 2; Set C
ucauauuuuaauguaagcaua

SEQ ID NO: 34397 - RNA, 25 nt, Artificial Sequence
  Synthetic Oligonucleotide; NDFIP1 exon 2; Set C
uuucauauuuuaauguaagcauaaa

SEQ ID NO: 34398 - RNA, 24 nt, Artificial Sequence
  Synthetic Oligonucleotide; NDFIP1 exon 2; Set C
uuucauauuuuaauguaagcauaa

SEQ ID NO: 34399 - RNA, 22 nt, Artificial Sequence
  Synthetic Oligonucleotide; NDFIP1 exon 2; Set C
uucauauuuuaauguaagcaua

SEQ ID NO: 34400 - RNA, 23 nt, Artificial Sequence
  Synthetic Oligonucleotide; NDFIP1 exon 2; Set C
uuucauauuuuaauguaagcaua

SEQ ID NO: 34401 - RNA, 15 nt, Artificial Sequence
  Synthetic Oligonucleotide; NDFIP1 exon 2; Set C
ucauauuuuaaugua

SEQ ID NO: 34402 - RNA, 16 nt, Artificial Sequence
  Synthetic Oligonucleotide; NDFIP1 exon 2; Set C
uucauauuuuaaugua

SEQ ID NO: 34403 - RNA, 15 nt, Artificial Sequence
  Synthetic Oligonucleotide; NDFIP1 exon 2; Set C
uucauauuuuaaugu

SEQ ID NO: 34404 - RNA, 17 nt, Artificial Sequence
  Synthetic Oligonucleotide; NDFIP1 exon 2; Set C
uuucauauuuuaaugua

SEQ ID NO: 34405 - RNA, 16 nt, Artificial Sequence
  Synthetic Oligonucleotide; NDFIP1 exon 2; Set C
uuucauauuuuaaugu

SEQ ID NO: 34406 - RNA, 18 nt, Artificial Sequence
  Synthetic Oligonucleotide; NDFIP1 exon 2; Set C
auuucauauuuuaaugua

SEQ ID NO: 34407 - RNA, 15 nt, Artificial Sequence
  Synthetic Oligonucleotide; NDFIP1 exon 2; Set C
uuucauauuuuaaug

SEQ ID NO: 34408 - RNA, 17 nt, Artificial Sequence
  Synthetic Oligonucleotide; NDFIP1 exon 2; Set C
auuucauauuuuaaugu

SEQ ID NO: 34409 - RNA, 34 nt, Artificial Sequence
  Synthetic Oligonucleotide; NDFIP1 exon 2; Set C
uaaauaaaaauuucauauuuuaauguaagcauaa

SEQ ID NO: 34410 - RNA, 16 nt, Artificial Sequence
  Synthetic Oligonucleotide; NDFIP1 exon 2; Set C
auuucauauuuuaaug

SEQ ID NO: 34411 - RNA, 36 nt, Artificial Sequence
  Synthetic Oligonucleotide; NDFIP1 exon 2; Set C
cuaaauaaaaauuucauauuuuaauguaagcauaaa

SEQ ID NO: 34412 - RNA, 15 nt, Artificial Sequence
  Synthetic Oligonucleotide; NDFIP1 exon 2; Set C
auuucauauuuuaau

SEQ ID NO: 34413 - RNA, 35 nt, Artificial Sequence
  Synthetic Oligonucleotide; NDFIP1 exon 2; Set C
cuaaauaaaaauuucauauuuuaauguaagcauaa

SEQ ID NO: 34414 - RNA, 37 nt, Artificial Sequence
  Synthetic Oligonucleotide; NDFIP1 exon 2; Set C
acuaaauaaaaauuucauauuuuaauguaagcauaaa

SEQ ID NO: 34415 - RNA, 36 nt, Artificial Sequence
  Synthetic Oligonucleotide; NDFIP1 exon 2; Set C
acuaaauaaaaauuucauauuuuaauguaagcauaa

SEQ ID NO: 34416 - RNA, 34 nt, Artificial Sequence
  Synthetic Oligonucleotide; NDFIP1 exon 2; Set C
cuaaauaaaaauuucauauuuuaauguaagcaua

SEQ ID NO: 34417 - RNA, 38 nt, Artificial Sequence
  Synthetic Oligonucleotide; NDFIP1 exon 2; Set C
aacuaaauaaaaauuucauauuuuaauguaagcauaaa

SEQ ID NO: 34418 - RNA, 37 nt, Artificial Sequence
  Synthetic Oligonucleotide; NDFIP1 exon 2; Set C
aacuaaauaaaaauuucauauuuuaauguaagcauaa

SEQ ID NO: 34419 - RNA, 35 nt, Artificial Sequence
  Synthetic Oligonucleotide; NDFIP1 exon 2; Set C
acuaaauaaaaauuucauauuuuaauguaagcaua

SEQ ID NO: 34420 - RNA, 39 nt, Artificial Sequence
  Synthetic Oligonucleotide; NDFIP1 exon 2; Set C
caacuaaauaaaaauuucauauuuuaauguaagcauaaa

SEQ ID NO: 34421 - RNA, 38 nt, Artificial Sequence
  Synthetic Oligonucleotide; NDFIP1 exon 2; Set C
caacuaaauaaaaauuucauauuuuaauguaagcauaa

SEQ ID NO: 34422 - RNA, 36 nt, Artificial Sequence
  Synthetic Oligonucleotide; NDFIP1 exon 2; Set C
aacuaaauaaaaauuucauauuuuaauguaagcaua

SEQ ID NO: 34423 - RNA, 40 nt, Artificial Sequence
  Synthetic Oligonucleotide; NDFIP1 exon 2; Set C
gcaacuaaauaaaaauuucauauuuuaauguaagcauaaa

SEQ ID NO: 34424 - RNA, 39 nt, Artificial Sequence
  Synthetic Oligonucleotide; NDFIP1 exon 2; Set C
gcaacuaaauaaaaauuucauauuuuaauguaagcauaa

SEQ ID NO: 34425 - RNA, 37 nt, Artificial Sequence
  Synthetic Oligonucleotide; NDFIP1 exon 2; Set C
caacuaaauaaaaauuucauauuuuaauguaagcaua

SEQ ID NO: 34426 - RNA, 40 nt, Artificial Sequence
  Synthetic Oligonucleotide; NDFIP1 exon 2; Set C
ugcaacuaaauaaaaauuucauauuuuaauguaagcauaa

SEQ ID NO: 34427 - RNA, 38 nt, Artificial Sequence
  Synthetic Oligonucleotide; NDFIP1 exon 2; Set C
gcaacuaaauaaaaauuucauauuuuaauguaagcaua

SEQ ID NO: 34428 - RNA, 26 nt, Artificial Sequence
  Synthetic Oligonucleotide; NDFIP1 exon 2; Set C
aaauaaaaauuucauauuuuaaugua

SEQ ID NO: 34429 - RNA, 25 nt, Artificial Sequence
  Synthetic Oligonucleotide; NDFIP1 exon 2; Set C
aaauaaaaauuucauauuuuaaugu

SEQ ID NO: 34430 - RNA, 39 nt, Artificial Sequence
  Synthetic Oligonucleotide; NDFIP1 exon 2; Set C
ugcaacuaaauaaaaauuucauauuuuaauguaagcaua

SEQ ID NO: 34431 - RNA, 27 nt, Artificial Sequence
  Synthetic Oligonucleotide; NDFIP1 exon 2; Set C
uaaauaaaaauuucauauuuuaaugua

SEQ ID NO: 34432 - RNA, 26 nt, Artificial Sequence
  Synthetic Oligonucleotide; NDFIP1 exon 2; Set C
uaaauaaaaauuucauauuuuaaugu

SEQ ID NO: 34433 - RNA, 24 nt, Artificial Sequence
  Synthetic Oligonucleotide; NDFIP1 exon 2; Set C
aaauaaaaauuucauauuuuaaug

SEQ ID NO: 34434 - RNA, 28 nt, Artificial Sequence
  Synthetic Oligonucleotide; NDFIP1 exon 2; Set C
cuaaauaaaaauuucauauuuuaaugua

SEQ ID NO: 34435 - RNA, 23 nt, Artificial Sequence
  Synthetic Oligonucleotide; NDFIP1 exon 2; Set C
aaauaaaaauuucauauuuuaau

SEQ ID NO: 34436 - RNA, 27 nt, Artificial Sequence
  Synthetic Oligonucleotide; NDFIP1 exon 2; Set C
cuaaauaaaaauuucauauuuuaaugu

SEQ ID NO: 34437 - RNA, 25 nt, Artificial Sequence
  Synthetic Oligonucleotide; NDFIP1 exon 2; Set C
uaaauaaaaauuucauauuuuaaug

SEQ ID NO: 34438 - RNA, 29 nt, Artificial Sequence
  Synthetic Oligonucleotide; NDFIP1 exon 2; Set C
acuaaauaaaaauuucauauuuuaaugua

SEQ ID NO: 34439 - RNA, 24 nt, Artificial Sequence
  Synthetic Oligonucleotide; NDFIP1 exon 2; Set C
uaaauaaaaauuucauauuuuaau

SEQ ID NO: 34440 - RNA, 22 nt, Artificial Sequence
  Synthetic Oligonucleotide; NDFIP1 exon 2; Set C
aaauaaaaauuucauauuuuaa

SEQ ID NO: 34441 - RNA, 28 nt, Artificial Sequence
  Synthetic Oligonucleotide; NDFIP1 exon 2; Set C
acuaaauaaaaauuucauauuuuaaugu

SEQ ID NO: 34442 - RNA, 26 nt, Artificial Sequence
  Synthetic Oligonucleotide; NDFIP1 exon 2; Set C
cuaaauaaaaauuucauauuuuaaug

SEQ ID NO: 34443 - RNA, 30 nt, Artificial Sequence
  Synthetic Oligonucleotide; NDFIP1 exon 2; Set C
aacuaaauaaaaauuucauauuuuaaugua

SEQ ID NO: 34444 - RNA, 25 nt, Artificial Sequence
  Synthetic Oligonucleotide; NDFIP1 exon 2; Set C
cuaaauaaaaauuucauauuuuaau

SEQ ID NO: 34445 - RNA, 23 nt, Artificial Sequence
  Synthetic Oligonucleotide; NDFIP1 exon 2; Set C
uaaauaaaaauuucauauuuuaa

SEQ ID NO: 34446 - RNA, 21 nt, Artificial Sequence
  Synthetic Oligonucleotide; NDFIP1 exon 2; Set C
aaauaaaaauuucauauuuua

SEQ ID NO: 34447 - RNA, 29 nt, Artificial Sequence
  Synthetic Oligonucleotide; NDFIP1 exon 2; Set C
aacuaaauaaaaauuucauauuuuaaugu

SEQ ID NO: 34448 - RNA, 27 nt, Artificial Sequence
  Synthetic Oligonucleotide; NDFIP1 exon 2; Set C
acuaaauaaaaauuucauauuuuaaug

SEQ ID NO: 34449 - RNA, 31 nt, Artificial Sequence
  Synthetic Oligonucleotide; NDFIP1 exon 2; Set C
caacuaaauaaaaauuucauauuuuaaugua

SEQ ID NO: 34450 - RNA, 26 nt, Artificial Sequence
  Synthetic Oligonucleotide; NDFIP1 exon 2; Set C
acuaaauaaaaauuucauauuuuaau

SEQ ID NO: 34451 - RNA, 24 nt, Artificial Sequence
  Synthetic Oligonucleotide; NDFIP1 exon 2; Set C
cuaaauaaaaauuucauauuuuaa

SEQ ID NO: 34452 - RNA, 22 nt, Artificial Sequence
  Synthetic Oligonucleotide; NDFIP1 exon 2; Set C
uaaauaaaaauuucauauuuua

SEQ ID NO: 34453 - RNA, 30 nt, Artificial Sequence
  Synthetic Oligonucleotide; NDFIP1 exon 2; Set C
caacuaaauaaaaauuucauauuuuaaugu

SEQ ID NO: 34454 - RNA, 28 nt, Artificial Sequence
  Synthetic Oligonucleotide; NDFIP1 exon 2; Set C
aacuaaauaaaaauuucauauuuuaaug

SEQ ID NO: 34455 - RNA, 32 nt, Artificial Sequence
  Synthetic Oligonucleotide; NDFIP1 exon 2; Set C
gcaacuaaauaaaaauuucauauuuuaaugua

SEQ ID NO: 34456 - RNA, 27 nt, Artificial Sequence
  Synthetic Oligonucleotide; NDFIP1 exon 2; Set C
aacuaaauaaaaauuucauauuuuaau

SEQ ID NO: 34457 - RNA, 25 nt, Artificial Sequence
  Synthetic Oligonucleotide; NDFIP1 exon 2; Set C
acuaaauaaaaauuucauauuuuaa

SEQ ID NO: 34458 - RNA, 23 nt, Artificial Sequence
  Synthetic Oligonucleotide; NDFIP1 exon 2; Set C
cuaaauaaaaauuucauauuuua

SEQ ID NO: 34459 - RNA, 31 nt, Artificial Sequence
  Synthetic Oligonucleotide; NDFIP1 exon 2; Set C
gcaacuaaauaaaaauuucauauuuuaaugu

SEQ ID NO: 34460 - RNA, 29 nt, Artificial Sequence
  Synthetic Oligonucleotide; NDFIP1 exon 2; Set C
caacuaaauaaaaauuucauauuuuaaug

SEQ ID NO: 34461 - RNA, 33 nt, Artificial Sequence
  Synthetic Oligonucleotide; NDFIP1 exon 2; Set C
ugcaacuaaauaaaaauuucauauuuuaaugua

SEQ ID NO: 34462 - RNA, 21 nt, Artificial Sequence
  Synthetic Oligonucleotide; NDFIP1 exon 2; Set C
uaaauaaaaauuucauauuuu

SEQ ID NO: 34463 - RNA, 28 nt, Artificial Sequence
  Synthetic Oligonucleotide; NDFIP1 exon 2; Set C
caacuaaauaaaaauuucauauuuuaau

SEQ ID NO: 34464 - RNA, 26 nt, Artificial Sequence
  Synthetic Oligonucleotide; NDFIP1 exon 2; Set C
aacuaaauaaaaauuucauauuuuaa

SEQ ID NO: 34465 - RNA, 24 nt, Artificial Sequence
  Synthetic Oligonucleotide; NDFIP1 exon 2; Set C
acuaaauaaaaauuucauauuuua

SEQ ID NO: 34466 - RNA, 30 nt, Artificial Sequence
  Synthetic Oligonucleotide; NDFIP1 exon 2; Set C
gcaacuaaauaaaaauuucauauuuuaaug

SEQ ID NO: 34467 - RNA, 32 nt, Artificial Sequence
  Synthetic Oligonucleotide; NDFIP1 exon 2; Set C
ugcaacuaaauaaaaauuucauauuuuaaugu

SEQ ID NO: 34468 - RNA, 22 nt, Artificial Sequence
  Synthetic Oligonucleotide; NDFIP1 exon 2; Set C
cuaaauaaaaauuucauauuuu

SEQ ID NO: 34469 - RNA, 29 nt, Artificial Sequence
  Synthetic Oligonucleotide; NDFIP1 exon 2; Set C
gcaacuaaauaaaaauuucauauuuuaau

SEQ ID NO: 34470 - RNA, 27 nt, Artificial Sequence
  Synthetic Oligonucleotide; NDFIP1 exon 2; Set C
caacuaaauaaaaauuucauauuuuaa

SEQ ID NO: 34471 - RNA, 25 nt, Artificial Sequence
  Synthetic Oligonucleotide; NDFIP1 exon 2; Set C
aacuaaauaaaaauuucauauuuua

SEQ ID NO: 34472 - RNA, 31 nt, Artificial Sequence
  Synthetic Oligonucleotide; NDFIP1 exon 2; Set C
ugcaacuaaauaaaaauuucauauuuuaaug

SEQ ID NO: 34473 - RNA, 23 nt, Artificial Sequence
  Synthetic Oligonucleotide; NDFIP1 exon 2; Set C
acuaaauaaaaauuucauauuuu

SEQ ID NO: 34474 - RNA, 21 nt, Artificial Sequence
  Synthetic Oligonucleotide; NDFIP1 exon 2; Set C
cuaaauaaaaauuucauauuu

SEQ ID NO: 34475 - RNA, 28 nt, Artificial Sequence
  Synthetic Oligonucleotide; NDFIP1 exon 2; Set C
gcaacuaaauaaaaauuucauauuuuaa

SEQ ID NO: 34476 - RNA, 30 nt, Artificial Sequence
  Synthetic Oligonucleotide; NDFIP1 exon 2; Set C
ugcaacuaaauaaaaauuucauauuuuaau

SEQ ID NO: 34477 - RNA, 26 nt, Artificial Sequence
  Synthetic Oligonucleotide; NDFIP1 exon 2; Set C
caacuaaauaaaaauuucauauuuua

SEQ ID NO: 34478 - RNA, 24 nt, Artificial Sequence
  Synthetic Oligonucleotide; NDFIP1 exon 2; Set C
aacuaaauaaaaauuucauauuuu

SEQ ID NO: 34479 - RNA, 22 nt, Artificial Sequence
  Synthetic Oligonucleotide; NDFIP1 exon 2; Set C
acuaaauaaaaauuucauauuu

SEQ ID NO: 34480 - RNA, 29 nt, Artificial Sequence
  Synthetic Oligonucleotide; NDFIP1 exon 2; Set C
ugcaacuaaauaaaaauuucauauuuuaa

SEQ ID NO: 34481 - RNA, 17 nt, Artificial Sequence
  Synthetic Oligonucleotide; NDFIP1 exon 2; Set C
uaaauaaaaauuucaua

SEQ ID NO: 34482 - RNA, 27 nt, Artificial Sequence
  Synthetic Oligonucleotide; NDFIP1 exon 2; Set C
gcaacuaaauaaaaauuucauauuuua

SEQ ID NO: 34483 - RNA, 25 nt, Artificial Sequence
  Synthetic Oligonucleotide; NDFIP1 exon 2; Set C
caacuaaauaaaaauuucauauuuu

SEQ ID NO: 34484 - RNA, 23 nt, Artificial Sequence
  Synthetic Oligonucleotide; NDFIP1 exon 2; Set C
aacuaaauaaaaauuucauauuu

SEQ ID NO: 34485 - RNA, 21 nt, Artificial Sequence
  Synthetic Oligonucleotide; NDFIP1 exon 2; Set C
acuaaauaaaaauuucauauu

SEQ ID NO: 34486 - RNA, 18 nt, Artificial Sequence
  Synthetic Oligonucleotide; NDFIP1 exon 2; Set C
cuaaauaaaaauuucaua

SEQ ID NO: 34487 - RNA, 28 nt, Artificial Sequence
  Synthetic Oligonucleotide; NDFIP1 exon 2; Set C
ugcaacuaaauaaaaauuucauauuuua

SEQ ID NO: 34488 - RNA, 26 nt, Artificial Sequence
  Synthetic Oligonucleotide; NDFIP1 exon 2; Set C
gcaacuaaauaaaaauuucauauuuu

SEQ ID NO: 34489 - RNA, 24 nt, Artificial Sequence
  Synthetic Oligonucleotide; NDFIP1 exon 2; Set C
caacuaaauaaaaauuucauauuu

SEQ ID NO: 34490 - RNA, 22 nt, Artificial Sequence
  Synthetic Oligonucleotide; NDFIP1 exon 2; Set C
aacuaaauaaaaauuucauauu

SEQ ID NO: 34491 - RNA, 20 nt, Artificial Sequence
  Synthetic Oligonucleotide; NDFIP1 exon 2; Set C
acuaaauaaaaauuucauau

SEQ ID NO: 34492 - RNA, 17 nt, Artificial Sequence
  Synthetic Oligonucleotide; NDFIP1 exon 2; Set C
cuaaauaaaaauuucau

SEQ ID NO: 34493 - RNA, 19 nt, Artificial Sequence
  Synthetic Oligonucleotide; NDFIP1 exon 2; Set C
acuaaauaaaaauuucaua

SEQ ID NO: 34494 - RNA, 25 nt, Artificial Sequence
  Synthetic Oligonucleotide; NDFIP1 exon 2; Set C
gcaacuaaauaaaaauuucauauuu

SEQ ID NO: 34495 - RNA, 23 nt, Artificial Sequence
  Synthetic Oligonucleotide; NDFIP1 exon 2; Set C
caacuaaauaaaaauuucauauu

SEQ ID NO: 34496 - RNA, 21 nt, Artificial Sequence
  Synthetic Oligonucleotide; NDFIP1 exon 2; Set C
aacuaaauaaaaauuucauau

SEQ ID NO: 34497 - RNA, 27 nt, Artificial Sequence
  Synthetic Oligonucleotide; NDFIP1 exon 2; Set C
ugcaacuaaauaaaaauuucauauuuu

SEQ ID NO: 34498 - RNA, 18 nt, Artificial Sequence
  Synthetic Oligonucleotide; NDFIP1 exon 2; Set C
acuaaauaaaaauuucau

SEQ ID NO: 34499 - RNA, 20 nt, Artificial Sequence
  Synthetic Oligonucleotide; NDFIP1 exon 2; Set C
aacuaaauaaaaauuucaua

SEQ ID NO: 34500 - RNA, 24 nt, Artificial Sequence
  Synthetic Oligonucleotide; NDFIP1 exon 2; Set C
gcaacuaaauaaaaauuucauauu

SEQ ID NO: 34501 - RNA, 22 nt, Artificial Sequence
  Synthetic Oligonucleotide; NDFIP1 exon 2; Set C
caacuaaauaaaaauuucauau

SEQ ID NO: 34502 - RNA, 26 nt, Artificial Sequence
  Synthetic Oligonucleotide; NDFIP1 exon 2; Set C
ugcaacuaaauaaaaauuucauauuu

SEQ ID NO: 34503 - RNA, 19 nt, Artificial Sequence
  Synthetic Oligonucleotide; NDFIP1 exon 2; Set C
aacuaaauaaaaauuucau

SEQ ID NO: 34504 - RNA, 21 nt, Artificial Sequence
  Synthetic Oligonucleotide; NDFIP1 exon 2; Set C
caacuaaauaaaaauuucaua

SEQ ID NO: 34505 - RNA, 17 nt, Artificial Sequence
  Synthetic Oligonucleotide; NDFIP1 exon 2; Set C
acuaaauaaaaauuuca

SEQ ID NO: 34506 - RNA, 23 nt, Artificial Sequence
  Synthetic Oligonucleotide; NDFIP1 exon 2; Set C
gcaacuaaauaaaaauuucauau

SEQ ID NO: 34507 - RNA, 25 nt, Artificial Sequence
  Synthetic Oligonucleotide; NDFIP1 exon 2; Set C
ugcaacuaaauaaaaauuucauauu

SEQ ID NO: 34508 - RNA, 20 nt, Artificial Sequence
  Synthetic Oligonucleotide; NDFIP1 exon 2; Set C
caacuaaauaaaaauuucau

SEQ ID NO: 34509 - RNA, 22 nt, Artificial Sequence
  Synthetic Oligonucleotide; NDFIP1 exon 2; Set C
gcaacuaaauaaaaauuucaua

SEQ ID NO: 34510 - RNA, 18 nt, Artificial Sequence
  Synthetic Oligonucleotide; NDFIP1 exon 2; Set C
aacuaaauaaaaauuuca

SEQ ID NO: 34511 - RNA, 16 nt, Artificial Sequence
  Synthetic Oligonucleotide; NDFIP1 exon 2; Set C
acuaaauaaaaauuuc

SEQ ID NO: 34512 - RNA, 24 nt, Artificial Sequence
  Synthetic Oligonucleotide; NDFIP1 exon 2; Set C
ugcaacuaaauaaaaauuucauau

SEQ ID NO: 34513 - RNA, 21 nt, Artificial Sequence
  Synthetic Oligonucleotide; NDFIP1 exon 2; Set C
gcaacuaaauaaaaauuucau

SEQ ID NO: 34514 - RNA, 19 nt, Artificial Sequence
  Synthetic Oligonucleotide; NDFIP1 exon 2; Set C
caacuaaauaaaaauuuca

SEQ ID NO: 34515 - RNA, 23 nt, Artificial Sequence
  Synthetic Oligonucleotide; NDFIP1 exon 2; Set C
ugcaacuaaauaaaaauuucaua

SEQ ID NO: 34516 - RNA, 17 nt, Artificial Sequence
  Synthetic Oligonucleotide; NDFIP1 exon 2; Set C
aacuaaauaaaaauuuc

SEQ ID NO: 34517 - RNA, 15 nt, Artificial Sequence
  Synthetic Oligonucleotide; NDFIP1 exon 2; Set C
acuaaauaaaaauuu

SEQ ID NO: 34518 - RNA, 22 nt, Artificial Sequence
  Synthetic Oligonucleotide; NDFIP1 exon 2; Set C
ugcaacuaaauaaaaauuucau

SEQ ID NO: 34519 - RNA, 20 nt, Artificial Sequence
  Synthetic Oligonucleotide; NDFIP1 exon 2; Set C
gcaacuaaauaaaaauuuca

SEQ ID NO: 34520 - RNA, 18 nt, Artificial Sequence
  Synthetic Oligonucleotide; NDFIP1 exon 2; Set C
caacuaaauaaaaauuuc

SEQ ID NO: 34521 - RNA, 16 nt, Artificial Sequence
  Synthetic Oligonucleotide; NDFIP1 exon 2; Set C
aacuaaauaaaaauuu

SEQ ID NO: 34522 - RNA, 21 nt, Artificial Sequence
  Synthetic Oligonucleotide; NDFIP1 exon 2; Set C
ugcaacuaaauaaaaauuuca

SEQ ID NO: 34523 - RNA, 19 nt, Artificial Sequence
  Synthetic Oligonucleotide; NDFIP1 exon 2; Set C
gcaacuaaauaaaaauuuc

SEQ ID NO: 34524 - RNA, 17 nt, Artificial Sequence
  Synthetic Oligonucleotide; NDFIP1 exon 2; Set C
caacuaaauaaaaauuu

SEQ ID NO: 34525 - RNA, 18 nt, Artificial Sequence
  Synthetic Oligonucleotide; NDFIP1 exon 2; Set C
gcaacuaaauaaaaauuu

SEQ ID NO: 34526 - RNA, 20 nt, Artificial Sequence
  Synthetic Oligonucleotide; NDFIP1 exon 2; Set C
ugcaacuaaauaaaaauuuc

SEQ ID NO: 34527 - RNA, 19 nt, Artificial Sequence
  Synthetic Oligonucleotide; NDFIP1 exon 2; Set C
ugcaacuaaauaaaaauuu

SEQ ID NO: 34528 - RNA, 18 nt, Artificial Sequence
  Synthetic Oligonucleotide; NDFIP1 exon 2; Set C
uguaagguggaggagcau

SEQ ID NO: 34529 - RNA, 17 nt, Artificial Sequence
  Synthetic Oligonucleotide; NDFIP1 exon 2; Set C
uguaagguggaggagca

SEQ ID NO: 34530 - RNA, 16 nt, Artificial Sequence
  Synthetic Oligonucleotide; NDFIP1 exon 2; Set C
uguaagguggaggagc

SEQ ID NO: 34531 - RNA, 15 nt, Artificial Sequence
  Synthetic Oligonucleotide; NDFIP1 exon 2; Set C
uuuuaaggauuccgu

SEQ ID NO: 34532 - RNA, 16 nt, Artificial Sequence
  Synthetic Oligonucleotide; NDFIP1 exon 2; Set C
uuuuuaaggauuccgu

SEQ ID NO: 34533 - RNA, 17 nt, Artificial Sequence
  Synthetic Oligonucleotide; NDFIP1 exon 2; Set C
guuuuuaaggauuccgu

SEQ ID NO: 34534 - RNA, 18 nt, Artificial Sequence
  Synthetic Oligonucleotide; NDFIP1 exon 2; Set C
uguuuuuaaggauuccgu

SEQ ID NO: 34535 - RNA, 19 nt, Artificial Sequence
  Synthetic Oligonucleotide; NDFIP1 exon 2; Set C
guguuuuuaaggauuccgu

SEQ ID NO: 34536 - RNA, 17 nt, Artificial Sequence
  Synthetic Oligonucleotide; NDFIP1 exon 2; Set C
uguuuuuaaggauuccg

SEQ ID NO: 34537 - RNA, 16 nt, Artificial Sequence
  Synthetic Oligonucleotide; NDFIP1 exon 2; Set C
uguuuuuaaggauucc

SEQ ID NO: 34538 - RNA, 18 nt, Artificial Sequence
  Synthetic Oligonucleotide; NDFIP1 exon 2; Set C
guguuuuuaaggauuccg

SEQ ID NO: 34539 - RNA, 17 nt, Artificial Sequence
  Synthetic Oligonucleotide; NDFIP1 exon 2; Set C
guguuuuuaaggauucc

SEQ ID NO: 34540 - RNA, 19 nt, Artificial Sequence
  Synthetic Oligonucleotide; NDFIP1 exon 2; Set C
auaaagccaauuagaaaga

SEQ ID NO: 34541 - RNA, 26 nt, Artificial Sequence
  Synthetic Oligonucleotide; NDFIP1 exon 2; Set C
uguaagcauaaagccaauuagaaaga

SEQ ID NO: 34542 - RNA, 27 nt, Artificial Sequence
  Synthetic Oligonucleotide; NDFIP1 exon 2; Set C
auguaagcauaaagccaauuagaaaga

SEQ ID NO: 34543 - RNA, 28 nt, Artificial Sequence
  Synthetic Oligonucleotide; NDFIP1 exon 2; Set C
aauguaagcauaaagccaauuagaaaga

SEQ ID NO: 34544 - RNA, 29 nt, Artificial Sequence
  Synthetic Oligonucleotide; NDFIP1 exon 2; Set C
uaauguaagcauaaagccaauuagaaaga

SEQ ID NO: 34545 - RNA, 30 nt, Artificial Sequence
  Synthetic Oligonucleotide; NDFIP1 exon 2; Set C
uuaauguaagcauaaagccaauuagaaaga

SEQ ID NO: 34546 - RNA, 31 nt, Artificial Sequence
  Synthetic Oligonucleotide; NDFIP1 exon 2; Set C
uuuaauguaagcauaaagccaauuagaaaga

SEQ ID NO: 34547 - RNA, 32 nt, Artificial Sequence
  Synthetic Oligonucleotide; NDFIP1 exon 2; Set C
uuuuaauguaagcauaaagccaauuagaaaga

SEQ ID NO: 34548 - RNA, 33 nt, Artificial Sequence
  Synthetic Oligonucleotide; NDFIP1 exon 2; Set C
auuuuaauguaagcauaaagccaauuagaaaga

SEQ ID NO: 34549 - RNA, 19 nt, Artificial Sequence
  Synthetic Oligonucleotide; NDFIP1 exon 2; Set C
uguaagcauaaagccaauu

SEQ ID NO: 34550 - RNA, 34 nt, Artificial Sequence
  Synthetic Oligonucleotide; NDFIP1 exon 2; Set C
uauuuuaauguaagcauaaagccaauuagaaaga

SEQ ID NO: 34551 - RNA, 20 nt, Artificial Sequence
  Synthetic Oligonucleotide; NDFIP1 exon 2; Set C
auguaagcauaaagccaauu

SEQ ID NO: 34552 - RNA, 19 nt, Artificial Sequence
  Synthetic Oligonucleotide; NDFIP1 exon 2; Set C
auguaagcauaaagccaau

SEQ ID NO: 34553 - RNA, 35 nt, Artificial Sequence
  Synthetic Oligonucleotide; NDFIP1 exon 2; Set C
auauuuuaauguaagcauaaagccaauuagaaaga

SEQ ID NO: 34554 - RNA, 21 nt, Artificial Sequence
  Synthetic Oligonucleotide; NDFIP1 exon 2; Set C
aauguaagcauaaagccaauu

SEQ ID NO: 34555 - RNA, 20 nt, Artificial Sequence
  Synthetic Oligonucleotide; NDFIP1 exon 2; Set C
aauguaagcauaaagccaau

SEQ ID NO: 34556 - RNA, 36 nt, Artificial Sequence
  Synthetic Oligonucleotide; NDFIP1 exon 2; Set C
cauauuuuaauguaagcauaaagccaauuagaaaga

SEQ ID NO: 34557 - RNA, 22 nt, Artificial Sequence
  Synthetic Oligonucleotide; NDFIP1 exon 2; Set C
uaauguaagcauaaagccaauu

SEQ ID NO: 34558 - RNA, 21 nt, Artificial Sequence
  Synthetic Oligonucleotide; NDFIP1 exon 2; Set C
uaauguaagcauaaagccaau

SEQ ID NO: 34559 - RNA, 37 nt, Artificial Sequence
  Synthetic Oligonucleotide; NDFIP1 exon 2; Set C
ucauauuuuaauguaagcauaaagccaauuagaaaga

SEQ ID NO: 34560 - RNA, 23 nt, Artificial Sequence
  Synthetic Oligonucleotide; NDFIP1 exon 2; Set C
uuaauguaagcauaaagccaauu

SEQ ID NO: 34561 - RNA, 22 nt, Artificial Sequence
  Synthetic Oligonucleotide; NDFIP1 exon 2; Set C
uuaauguaagcauaaagccaau

SEQ ID NO: 34562 - RNA, 38 nt, Artificial Sequence
  Synthetic Oligonucleotide; NDFIP1 exon 2; Set C
uucauauuuuaauguaagcauaaagccaauuagaaaga

SEQ ID NO: 34563 - RNA, 24 nt, Artificial Sequence
  Synthetic Oligonucleotide; NDFIP1 exon 2; Set C
uuuaauguaagcauaaagccaauu

SEQ ID NO: 34564 - RNA, 23 nt, Artificial Sequence
  Synthetic Oligonucleotide; NDFIP1 exon 2; Set C
uuuaauguaagcauaaagccaau

SEQ ID NO: 34565 - RNA, 39 nt, Artificial Sequence
  Synthetic Oligonucleotide; NDFIP1 exon 2; Set C
uuucauauuuuaauguaagcauaaagccaauuagaaaga

SEQ ID NO: 34566 - RNA, 25 nt, Artificial Sequence
  Synthetic Oligonucleotide; NDFIP1 exon 2; Set C
uuuuaauguaagcauaaagccaauu

SEQ ID NO: 34567 - RNA, 24 nt, Artificial Sequence
  Synthetic Oligonucleotide; NDFIP1 exon 2; Set C
uuuuaauguaagcauaaagccaau

SEQ ID NO: 34568 - RNA, 40 nt, Artificial Sequence
  Synthetic Oligonucleotide; NDFIP1 exon 2; Set C
auuucauauuuuaauguaagcauaaagccaauuagaaaga

SEQ ID NO: 34569 - RNA, 26 nt, Artificial Sequence
  Synthetic Oligonucleotide; NDFIP1 exon 2; Set C
auuuuaauguaagcauaaagccaauu

SEQ ID NO: 34570 - RNA, 25 nt, Artificial Sequence
  Synthetic Oligonucleotide; NDFIP1 exon 2; Set C
auuuuaauguaagcauaaagccaau

SEQ ID NO: 34571 - RNA, 27 nt, Artificial Sequence
  Synthetic Oligonucleotide; NDFIP1 exon 2; Set C
uauuuuaauguaagcauaaagccaauu

SEQ ID NO: 34572 - RNA, 26 nt, Artificial Sequence
  Synthetic Oligonucleotide; NDFIP1 exon 2; Set C
uauuuuaauguaagcauaaagccaau

SEQ ID NO: 34573 - RNA, 28 nt, Artificial Sequence
  Synthetic Oligonucleotide; NDFIP1 exon 2; Set C
auauuuuaauguaagcauaaagccaauu

SEQ ID NO: 34574 - RNA, 27 nt, Artificial Sequence
  Synthetic Oligonucleotide; NDFIP1 exon 2; Set C
auauuuuaauguaagcauaaagccaau

SEQ ID NO: 34575 - RNA, 29 nt, Artificial Sequence
  Synthetic Oligonucleotide; NDFIP1 exon 2; Set C
cauauuuuaauguaagcauaaagccaauu

SEQ ID NO: 34576 - RNA, 28 nt, Artificial Sequence
  Synthetic Oligonucleotide; NDFIP1 exon 2; Set C
cauauuuuaauguaagcauaaagccaau

SEQ ID NO: 34577 - RNA, 30 nt, Artificial Sequence
  Synthetic Oligonucleotide; NDFIP1 exon 2; Set C
ucauauuuuaauguaagcauaaagccaauu

SEQ ID NO: 34578 - RNA, 29 nt, Artificial Sequence
  Synthetic Oligonucleotide; NDFIP1 exon 2; Set C
ucauauuuuaauguaagcauaaagccaau

SEQ ID NO: 34579 - RNA, 31 nt, Artificial Sequence
  Synthetic Oligonucleotide; NDFIP1 exon 2; Set C
uucauauuuuaauguaagcauaaagccaauu

SEQ ID NO: 34580 - RNA, 30 nt, Artificial Sequence
  Synthetic Oligonucleotide; NDFIP1 exon 2; Set C
uucauauuuuaauguaagcauaaagccaau

SEQ ID NO: 34581 - RNA, 32 nt, Artificial Sequence
  Synthetic Oligonucleotide; NDFIP1 exon 2; Set C
uuucauauuuuaauguaagcauaaagccaauu

SEQ ID NO: 34582 - RNA, 31 nt, Artificial Sequence
  Synthetic Oligonucleotide; NDFIP1 exon 2; Set C
uuucauauuuuaauguaagcauaaagccaau

SEQ ID NO: 34583 - RNA, 33 nt, Artificial Sequence
  Synthetic Oligonucleotide; NDFIP1 exon 2; Set C
auuucauauuuuaauguaagcauaaagccaauu

SEQ ID NO: 34584 - RNA, 32 nt, Artificial Sequence
  Synthetic Oligonucleotide; NDFIP1 exon 2; Set C
auuucauauuuuaauguaagcauaaagccaau

SEQ ID NO: 34585 - RNA, 26 nt, Artificial Sequence
  Synthetic Oligonucleotide; NDFIP1 exon 2; Set C
auuucauauuuuaauguaagcauaaa

SEQ ID NO: 34586 - RNA, 25 nt, Artificial Sequence
  Synthetic Oligonucleotide; NDFIP1 exon 2; Set C
auuucauauuuuaauguaagcauaa

SEQ ID NO: 34587 - RNA, 24 nt, Artificial Sequence
  Synthetic Oligonucleotide; NDFIP1 exon 2; Set C
auuucauauuuuaauguaagcaua

SEQ ID NO: 34588 - RNA, 40 nt, Artificial Sequence
  Synthetic Oligonucleotide; NDFIP1 exon 2; Set C
aaauaaaaauuucauauuuuaauguaagcauaaagccaau

SEQ ID NO: 34589 - RNA, 34 nt, Artificial Sequence
  Synthetic Oligonucleotide; NDFIP1 exon 2; Set C
aaauaaaaauuucauauuuuaauguaagcauaaa

SEQ ID NO: 34590 - RNA, 33 nt, Artificial Sequence
  Synthetic Oligonucleotide; NDFIP1 exon 2; Set C
aaauaaaaauuucauauuuuaauguaagcauaa

SEQ ID NO: 34591 - RNA, 35 nt, Artificial Sequence
  Synthetic Oligonucleotide; NDFIP1 exon 2; Set C
uaaauaaaaauuucauauuuuaauguaagcauaaa

SEQ ID NO: 34592 - RNA, 32 nt, Artificial Sequence
  Synthetic Oligonucleotide; NDFIP1 exon 2; Set C
aaauaaaaauuucauauuuuaauguaagcaua

SEQ ID NO: 34593 - RNA, 33 nt, Artificial Sequence
  Synthetic Oligonucleotide; NDFIP1 exon 2; Set C
uaaauaaaaauuucauauuuuaauguaagcaua

SEQ ID NO: 34594 - RNA, 20 nt, Artificial Sequence
  Synthetic Oligonucleotide; NDFIP1 exon 2; Set C
aaauaaaaauuucauauuuu

SEQ ID NO: 34595 - RNA, 19 nt, Artificial Sequence
  Synthetic Oligonucleotide; NDFIP1 exon 2; Set C
aaauaaaaauuucauauuu

SEQ ID NO: 34596 - RNA, 20 nt, Artificial Sequence
  Synthetic Oligonucleotide; NDFIP1 exon 2; Set C
uaaauaaaaauuucauauuu

SEQ ID NO: 34597 - RNA, 18 nt, Artificial Sequence
  Synthetic Oligonucleotide; NDFIP1 exon 2; Set C
aaauaaaaauuucauauu

SEQ ID NO: 34598 - RNA, 19 nt, Artificial Sequence
  Synthetic Oligonucleotide; NDFIP1 exon 2; Set C
uaaauaaaaauuucauauu

SEQ ID NO: 34599 - RNA, 17 nt, Artificial Sequence
  Synthetic Oligonucleotide; NDFIP1 exon 2; Set C
aaauaaaaauuucauau

SEQ ID NO: 34600 - RNA, 16 nt, Artificial Sequence
  Synthetic Oligonucleotide; NDFIP1 exon 2; Set C
aaauaaaaauuucaua

SEQ ID NO: 34601 - RNA, 20 nt, Artificial Sequence
  Synthetic Oligonucleotide; NDFIP1 exon 2; Set C
cuaaauaaaaauuucauauu

SEQ ID NO: 34602 - RNA, 18 nt, Artificial Sequence
  Synthetic Oligonucleotide; NDFIP1 exon 2; Set C
uaaauaaaaauuucauau

SEQ ID NO: 34603 - RNA, 15 nt, Artificial Sequence
  Synthetic Oligonucleotide; NDFIP1 exon 2; Set C
aaauaaaaauuucau

SEQ ID NO: 34604 - RNA, 19 nt, Artificial Sequence
  Synthetic Oligonucleotide; NDFIP1 exon 2; Set C
cuaaauaaaaauuucauau

SEQ ID NO: 34605 - RNA, 16 nt, Artificial Sequence
  Synthetic Oligonucleotide; NDFIP1 exon 2; Set C
uaaauaaaaauuucau

SEQ ID NO: 34606 - RNA, 15 nt, Artificial Sequence
  Synthetic Oligonucleotide; NDFIP1 exon 2; Set C
uaaauaaaaauuuca

SEQ ID NO: 34607 - RNA, 16 nt, Artificial Sequence
  Synthetic Oligonucleotide; NDFIP1 exon 2; Set C
cuaaauaaaaauuuca

SEQ ID NO: 34608 - RNA, 15 nt, Artificial Sequence
  Synthetic Oligonucleotide; NDFIP1 exon 2; Set C
cuaaauaaaaauuuc

SEQ ID NO: 34609 - RNA, 15 nt, Artificial Sequence
  Synthetic Oligonucleotide; NDFIP1 exon 2; Set C
aacuaaauaaaaauu

SEQ ID NO: 34610 - RNA, 16 nt, Artificial Sequence
  Synthetic Oligonucleotide; NDFIP1 exon 2; Set C
caacuaaauaaaaauu

SEQ ID NO: 34611 - RNA, 17 nt, Artificial Sequence
  Synthetic Oligonucleotide; NDFIP1 exon 2; Set C
gcaacuaaauaaaaauu

SEQ ID NO: 34612 - RNA, 18 nt, Artificial Sequence
  Synthetic Oligonucleotide; NDFIP1 exon 2; Set C
ugcaacuaaauaaaaauu

SEQ ID NO: 34613 - RNA, 40 nt, Artificial Sequence
  Synthetic Oligonucleotide; NDFIP1 exon 2; Set A
agacucuucuucauucugcaacuaaauaaaaauuucauau

SEQ ID NO: 34614 - RNA, 39 nt, Artificial Sequence
  Synthetic Oligonucleotide; NDFIP1 exon 2; Set A
agacucuucuucauucugcaacuaaauaaaaauuucaua

SEQ ID NO: 34615 - RNA, 38 nt, Artificial Sequence
  Synthetic Oligonucleotide; NDFIP1 exon 2; Set C
agacucuucuucauucugcaacuaaauaaaaauuucau

SEQ ID NO: 34616 - RNA, 40 nt, Artificial Sequence
  Synthetic Oligonucleotide; NDFIP1 exon 2; Set A
cagacucuucuucauucugcaacuaaauaaaaauuucaua

SEQ ID NO: 34617 - RNA, 39 nt, Artificial Sequence
  Synthetic Oligonucleotide; NDFIP1 exon 2; Set A
cagacucuucuucauucugcaacuaaauaaaaauuucau

SEQ ID NO: 34618 - RNA, 37 nt, Artificial Sequence
  Synthetic Oligonucleotide; NDFIP1 exon 2; Set C
agacucuucuucauucugcaacuaaauaaaaauuuca

SEQ ID NO: 34619 - RNA, 38 nt, Artificial Sequence
  Synthetic Oligonucleotide; NDFIP1 exon 2; Set A
cagacucuucuucauucugcaacuaaauaaaaauuuca

SEQ ID NO: 34620 - RNA, 36 nt, Artificial Sequence
  Synthetic Oligonucleotide; NDFIP1 exon 2; Set C
agacucuucuucauucugcaacuaaauaaaaauuuc

SEQ ID NO: 34621 - RNA, 37 nt, Artificial Sequence
  Synthetic Oligonucleotide; NDFIP1 exon 2; Set C
cagacucuucuucauucugcaacuaaauaaaaauuuc

SEQ ID NO: 34622 - RNA, 35 nt, Artificial Sequence
  Synthetic Oligonucleotide; NDFIP1 exon 2; Set C
agacucuucuucauucugcaacuaaauaaaaauuu

SEQ ID NO: 34623 - RNA, 36 nt, Artificial Sequence
  Synthetic Oligonucleotide; NDFIP1 exon 2; Set C
cagacucuucuucauucugcaacuaaauaaaaauuu

SEQ ID NO: 34624 - RNA, 25 nt, Artificial Sequence
  Synthetic Oligonucleotide; NDFIP1 exon 2; Set C
agacucuucuucauucugcaacuaa

SEQ ID NO: 34625 - RNA, 27 nt, Artificial Sequence
  Synthetic Oligonucleotide; NDFIP1 exon 2; Set C
cagacucuucuucauucugcaacuaaa

SEQ ID NO: 34626 - RNA, 26 nt, Artificial Sequence
  Synthetic Oligonucleotide; NDFIP1 exon 2; Set A
cagacucuucuucauucugcaacuaa

SEQ ID NO: 34627 - RNA, 23 nt, Artificial Sequence
  Synthetic Oligonucleotide; NDFIP1 exon 2; Set C
agacucuucuucauucugcaacu

SEQ ID NO: 34628 - RNA, 25 nt, Artificial Sequence
  Synthetic Oligonucleotide; NDFIP1 exon 2; Set A
cagacucuucuucauucugcaacua

SEQ ID NO: 34629 - RNA, 24 nt, Artificial Sequence
  Synthetic Oligonucleotide; NDFIP1 exon 2; Set A
cagacucuucuucauucugcaacu

SEQ ID NO: 34630 - RNA, 22 nt, Artificial Sequence
  Synthetic Oligonucleotide; NDFIP1 exon 2; Set C
agacucuucuucauucugcaac

SEQ ID NO: 34631 - RNA, 23 nt, Artificial Sequence
  Synthetic Oligonucleotide; NDFIP1 exon 2; Set C
cagacucuucuucauucugcaac

SEQ ID NO: 34632 - RNA, 21 nt, Artificial Sequence
  Synthetic Oligonucleotide; NDFIP1 exon 2; Set C
agacucuucuucauucugcaa

SEQ ID NO: 34633 - RNA, 22 nt, Artificial Sequence
  Synthetic Oligonucleotide; NDFIP1 exon 2; Set C
cagacucuucuucauucugcaa

SEQ ID NO: 34634 - RNA, 21 nt, Artificial Sequence
  Synthetic Oligonucleotide; NDFIP1 exon 2; Set C
cagacucuucuucauucugca

SEQ ID NO: 34635 - RNA, 40 nt, Artificial Sequence
  Synthetic Oligonucleotide; NDFIP1 exon 2; Set C
cuguucagguucuccagacucuucuucauucugcaacuaa

SEQ ID NO: 34636 - RNA, 37 nt, Artificial Sequence
  Synthetic Oligonucleotide; NDFIP1 exon 2; Set C
uguucagguucuccagacucuucuucauucugcaacu

SEQ ID NO: 34637 - RNA, 39 nt, Artificial Sequence
  Synthetic Oligonucleotide; NDFIP1 exon 2; Set C
cuguucagguucuccagacucuucuucauucugcaacua

SEQ ID NO: 34638 - RNA, 38 nt, Artificial Sequence
  Synthetic Oligonucleotide; NDFIP1 exon 2; Set C
cuguucagguucuccagacucuucuucauucugcaacu

SEQ ID NO: 34639 - RNA, 36 nt, Artificial Sequence
  Synthetic Oligonucleotide; NDFIP1 exon 2; Set C
uguucagguucuccagacucuucuucauucugcaac

SEQ ID NO: 34640 - RNA, 37 nt, Artificial Sequence
  Synthetic Oligonucleotide; NDFIP1 exon 2; Set C
cuguucagguucuccagacucuucuucauucugcaac

SEQ ID NO: 34641 - RNA, 35 nt, Artificial Sequence
  Synthetic Oligonucleotide; NDFIP1 exon 2; Set C
uguucagguucuccagacucuucuucauucugcaa

SEQ ID NO: 34642 - RNA, 36 nt, Artificial Sequence
  Synthetic Oligonucleotide; NDFIP1 exon 2; Set C
cuguucagguucuccagacucuucuucauucugcaa

SEQ ID NO: 34643 - RNA, 35 nt, Artificial Sequence
  Synthetic Oligonucleotide; NDFIP1 exon 2; Set C
cuguucagguucuccagacucuucuucauucugca

SEQ ID NO: 34644 - RNA, 34 nt, Artificial Sequence
  Synthetic Oligonucleotide; NDFIP1 exon 2; Set C
cuguucagguucuccagacucuucuucauucugc

SEQ ID NO: 34645 - RNA, 18 nt, Artificial Sequence
  Synthetic Oligonucleotide; NDFIP1 exon 2; Set C
cuguucagguucuccaga

SEQ ID NO: 34646 - RNA, 21 nt, Artificial Sequence
  Synthetic Oligonucleotide; NDFIP1 exon 2; Set C
ggagcaucaccugcagccugu

SEQ ID NO: 34647 - RNA, 31 nt, Artificial Sequence
  Synthetic Oligonucleotide; NDFIP1 exon 2; Set C
guaagguggaggagcaucaccugcagccugu

SEQ ID NO: 34648 - RNA, 30 nt, Artificial Sequence
  Synthetic Oligonucleotide; NDFIP1 exon 2; Set C
guaagguggaggagcaucaccugcagccug

SEQ ID NO: 34649 - RNA, 32 nt, Artificial Sequence
  Synthetic Oligonucleotide; NDFIP1 exon 2; Set C
uguaagguggaggagcaucaccugcagccugu

SEQ ID NO: 34650 - RNA, 31 nt, Artificial Sequence
  Synthetic Oligonucleotide; NDFIP1 exon 2; Set C
uguaagguggaggagcaucaccugcagccug

SEQ ID NO: 34651 - RNA, 16 nt, Artificial Sequence
  Synthetic Oligonucleotide; NDFIP1 exon 2; Set C
uaagguggaggagcau

SEQ ID NO: 34652 - RNA, 15 nt, Artificial Sequence
  Synthetic Oligonucleotide; NDFIP1 exon 2; Set C
uaagguggaggagca

SEQ ID NO: 34653 - RNA, 17 nt, Artificial Sequence
  Synthetic Oligonucleotide; NDFIP1 exon 2; Set C
guaagguggaggagcau

SEQ ID NO: 34654 - RNA, 16 nt, Artificial Sequence
  Synthetic Oligonucleotide; NDFIP1 exon 2; Set C
guaagguggaggagca

SEQ ID NO: 34655 - RNA, 15 nt, Artificial Sequence
  Synthetic Oligonucleotide; NDFIP1 exon 2; Set C
guaagguggaggagc

SEQ ID NO: 34656 - RNA, 15 nt, Artificial Sequence
  Synthetic Oligonucleotide; NDFIP1 exon 2; Set C
uguaagguggaggag

SEQ ID NO: 34657 - RNA, 34 nt, Artificial Sequence
  Synthetic Oligonucleotide; NDFIP1 exon 2; Set C
ucugcagaaaugcugcuguaagguggaggagcau

SEQ ID NO: 34658 - RNA, 33 nt, Artificial Sequence
  Synthetic Oligonucleotide; NDFIP1 exon 2; Set C
ucugcagaaaugcugcuguaagguggaggagca

SEQ ID NO: 34659 - RNA, 32 nt, Artificial Sequence
  Synthetic Oligonucleotide; NDFIP1 exon 2; Set C
ucugcagaaaugcugcuguaagguggaggagc

SEQ ID NO: 34660 - RNA, 31 nt, Artificial Sequence
  Synthetic Oligonucleotide; NDFIP1 exon 2; Set C
ucugcagaaaugcugcuguaagguggaggag

SEQ ID NO: 34661 - RNA, 30 nt, Artificial Sequence
  Synthetic Oligonucleotide; NDFIP1 exon 2; Set C
ucugcagaaaugcugcuguaagguggagga

SEQ ID NO: 34662 - RNA, 37 nt, Artificial Sequence
  Synthetic Oligonucleotide; NDFIP1 exon 2; Set C
cgugaucaccuugcccuguuaccuaccugcgcucucu

SEQ ID NO: 34663 - RNA, 38 nt, Artificial Sequence
  Synthetic Oligonucleotide; NDFIP1 exon 2; Set C
ccgugaucaccuugcccuguuaccuaccugcgcucucu

SEQ ID NO: 34664 - RNA, 39 nt, Artificial Sequence
  Synthetic Oligonucleotide; NDFIP1 exon 2; Set C
uccgugaucaccuugcccuguuaccuaccugcgcucucu

SEQ ID NO: 34665 - RNA, 40 nt, Artificial Sequence
  Synthetic Oligonucleotide; NDFIP1 exon 2; Set C
uuccgugaucaccuugcccuguuaccuaccugcgcucucu

SEQ ID NO: 34666 - RNA, 26 nt, Artificial Sequence
  Synthetic Oligonucleotide; NDFIP1 exon 2; Set C
cgugaucaccuugcccuguuaccuac

SEQ ID NO: 34667 - RNA, 27 nt, Artificial Sequence
  Synthetic Oligonucleotide; NDFIP1 exon 2; Set C
ccgugaucaccuugcccuguuaccuac

SEQ ID NO: 34668 - RNA, 28 nt, Artificial Sequence
  Synthetic Oligonucleotide; NDFIP1 exon 2; Set C
uccgugaucaccuugcccuguuaccuac

SEQ ID NO: 34669 - RNA, 29 nt, Artificial Sequence
  Synthetic Oligonucleotide; NDFIP1 exon 2; Set C
uuccgugaucaccuugcccuguuaccuac

SEQ ID NO: 34670 - RNA, 20 nt, Artificial Sequence
  Synthetic Oligonucleotide; NDFIP1 exon 2; Set B
cgugaucaccuugcccuguu

SEQ ID NO: 34671 - RNA, 21 nt, Artificial Sequence
  Synthetic Oligonucleotide; NDFIP1 exon 2; Set B
ccgugaucaccuugcccuguu

SEQ ID NO: 34672 - RNA, 22 nt, Artificial Sequence
  Synthetic Oligonucleotide; NDFIP1 exon 2; Set B
uccgugaucaccuugcccuguu

SEQ ID NO: 34673 - RNA, 35 nt, Artificial Sequence
  Synthetic Oligonucleotide; NDFIP1 exon 2; Set C
uaaggauuccgugaucaccuugcccuguuaccuac

SEQ ID NO: 34674 - RNA, 23 nt, Artificial Sequence
  Synthetic Oligonucleotide; NDFIP1 exon 2; Set B
uuccgugaucaccuugcccuguu

SEQ ID NO: 34675 - RNA, 36 nt, Artificial Sequence
  Synthetic Oligonucleotide; NDFIP1 exon 2; Set C
uuaaggauuccgugaucaccuugcccuguuaccuac

SEQ ID NO: 34676 - RNA, 37 nt, Artificial Sequence
  Synthetic Oligonucleotide; NDFIP1 exon 2; Set C
uuuaaggauuccgugaucaccuugcccuguuaccuac

SEQ ID NO: 34677 - RNA, 38 nt, Artificial Sequence
  Synthetic Oligonucleotide; NDFIP1 exon 2; Set C
uuuuaaggauuccgugaucaccuugcccuguuaccuac

SEQ ID NO: 34678 - RNA, 39 nt, Artificial Sequence
  Synthetic Oligonucleotide; NDFIP1 exon 2; Set C
uuuuuaaggauuccgugaucaccuugcccuguuaccuac

SEQ ID NO: 34679 - RNA, 40 nt, Artificial Sequence
  Synthetic Oligonucleotide; NDFIP1 exon 2; Set C
guuuuuaaggauuccgugaucaccuugcccuguuaccuac

SEQ ID NO: 34680 - RNA, 29 nt, Artificial Sequence
  Synthetic Oligonucleotide; NDFIP1 exon 2; Set C
uaaggauuccgugaucaccuugcccuguu

SEQ ID NO: 34681 - RNA, 30 nt, Artificial Sequence
  Synthetic Oligonucleotide; NDFIP1 exon 2; Set C
uuaaggauuccgugaucaccuugcccuguu

SEQ ID NO: 34682 - RNA, 31 nt, Artificial Sequence
  Synthetic Oligonucleotide; NDFIP1 exon 2; Set C
uuuaaggauuccgugaucaccuugcccuguu

SEQ ID NO: 34683 - RNA, 32 nt, Artificial Sequence
  Synthetic Oligonucleotide; NDFIP1 exon 2; Set C
uuuuaaggauuccgugaucaccuugcccuguu

SEQ ID NO: 34684 - RNA, 30 nt, Artificial Sequence
  Synthetic Oligonucleotide; NDFIP1 exon 2; Set C
uuuaaggauuccgugaucaccuugcccugu

SEQ ID NO: 34685 - RNA, 33 nt, Artificial Sequence
  Synthetic Oligonucleotide; NDFIP1 exon 2; Set C
uuuuuaaggauuccgugaucaccuugcccuguu

SEQ ID NO: 34686 - RNA, 31 nt, Artificial Sequence
  Synthetic Oligonucleotide; NDFIP1 exon 2; Set C
uuuuaaggauuccgugaucaccuugcccugu

SEQ ID NO: 34687 - RNA, 34 nt, Artificial Sequence
  Synthetic Oligonucleotide; NDFIP1 exon 2; Set C
guuuuuaaggauuccgugaucaccuugcccuguu

SEQ ID NO: 34688 - RNA, 32 nt, Artificial Sequence
  Synthetic Oligonucleotide; NDFIP1 exon 2; Set C
uuuuuaaggauuccgugaucaccuugcccugu

SEQ ID NO: 34689 - RNA, 35 nt, Artificial Sequence
  Synthetic Oligonucleotide; NDFIP1 exon 2; Set C
uguuuuuaaggauuccgugaucaccuugcccuguu

SEQ ID NO: 34690 - RNA, 33 nt, Artificial Sequence
  Synthetic Oligonucleotide; NDFIP1 exon 2; Set C
guuuuuaaggauuccgugaucaccuugcccugu

SEQ ID NO: 34691 - RNA, 36 nt, Artificial Sequence
  Synthetic Oligonucleotide; NDFIP1 exon 2; Set C
guguuuuuaaggauuccgugaucaccuugcccuguu

SEQ ID NO: 34692 - RNA, 34 nt, Artificial Sequence
  Synthetic Oligonucleotide; NDFIP1 exon 2; Set C
uguuuuuaaggauuccgugaucaccuugcccugu

SEQ ID NO: 34693 - RNA, 35 nt, Artificial Sequence
  Synthetic Oligonucleotide; NDFIP1 exon 2; Set C
guguuuuuaaggauuccgugaucaccuugcccugu

SEQ ID NO: 34694 - RNA, 18 nt, Artificial Sequence
  Synthetic Oligonucleotide; NDFIP1 exon 2; Set C
uaaggauuccgugaucac

SEQ ID NO: 34695 - RNA, 17 nt, Artificial Sequence
  Synthetic Oligonucleotide; NDFIP1 exon 2; Set C
uaaggauuccgugauca

SEQ ID NO: 34696 - RNA, 19 nt, Artificial Sequence
  Synthetic Oligonucleotide; NDFIP1 exon 2; Set C
uuaaggauuccgugaucac

SEQ ID NO: 34697 - RNA, 18 nt, Artificial Sequence
  Synthetic Oligonucleotide; NDFIP1 exon 2; Set C
uuaaggauuccgugauca

SEQ ID NO: 34698 - RNA, 20 nt, Artificial Sequence
  Synthetic Oligonucleotide; NDFIP1 exon 2; Set C
uuuaaggauuccgugaucac

SEQ ID NO: 34699 - RNA, 19 nt, Artificial Sequence
  Synthetic Oligonucleotide; NDFIP1 exon 2; Set C
uuuaaggauuccgugauca

SEQ ID NO: 34700 - RNA, 21 nt, Artificial Sequence
  Synthetic Oligonucleotide; NDFIP1 exon 2; Set C
uuuuaaggauuccgugaucac

SEQ ID NO: 34701 - RNA, 17 nt, Artificial Sequence
  Synthetic Oligonucleotide; NDFIP1 exon 2; Set C
uuaaggauuccgugauc

SEQ ID NO: 34702 - RNA, 20 nt, Artificial Sequence
  Synthetic Oligonucleotide; NDFIP1 exon 2; Set C
uuuuaaggauuccgugauca

SEQ ID NO: 34703 - RNA, 22 nt, Artificial Sequence
  Synthetic Oligonucleotide; NDFIP1 exon 2; Set C
uuuuuaaggauuccgugaucac

SEQ ID NO: 34704 - RNA, 16 nt, Artificial Sequence
  Synthetic Oligonucleotide; NDFIP1 exon 2; Set C
uuaaggauuccgugau

SEQ ID NO: 34705 - RNA, 18 nt, Artificial Sequence
  Synthetic Oligonucleotide; NDFIP1 exon 2; Set C
uuuaaggauuccgugauc

SEQ ID NO: 34706 - RNA, 21 nt, Artificial Sequence
  Synthetic Oligonucleotide; NDFIP1 exon 2; Set C
uuuuuaaggauuccgugauca

SEQ ID NO: 34707 - RNA, 23 nt, Artificial Sequence
  Synthetic Oligonucleotide; NDFIP1 exon 2; Set C
guuuuuaaggauuccgugaucac

SEQ ID NO: 34708 - RNA, 17 nt, Artificial Sequence
  Synthetic Oligonucleotide; NDFIP1 exon 2; Set C
uuuaaggauuccgugau

SEQ ID NO: 34709 - RNA, 15 nt, Artificial Sequence
  Synthetic Oligonucleotide; NDFIP1 exon 2; Set C
uuaaggauuccguga

SEQ ID NO: 34710 - RNA, 19 nt, Artificial Sequence
  Synthetic Oligonucleotide; NDFIP1 exon 2; Set C
uuuuaaggauuccgugauc

SEQ ID NO: 34711 - RNA, 22 nt, Artificial Sequence
  Synthetic Oligonucleotide; NDFIP1 exon 2; Set C
guuuuuaaggauuccgugauca

SEQ ID NO: 34712 - RNA, 24 nt, Artificial Sequence
  Synthetic Oligonucleotide; NDFIP1 exon 2; Set C
uguuuuuaaggauuccgugaucac

SEQ ID NO: 34713 - RNA, 18 nt, Artificial Sequence
  Synthetic Oligonucleotide; NDFIP1 exon 2; Set C
uuuuaaggauuccgugau

SEQ ID NO: 34714 - RNA, 16 nt, Artificial Sequence
  Synthetic Oligonucleotide; NDFIP1 exon 2; Set C
uuuaaggauuccguga

SEQ ID NO: 34715 - RNA, 20 nt, Artificial Sequence
  Synthetic Oligonucleotide; NDFIP1 exon 2; Set C
uuuuuaaggauuccgugauc

SEQ ID NO: 34716 - RNA, 23 nt, Artificial Sequence
  Synthetic Oligonucleotide; NDFIP1 exon 2; Set C
uguuuuuaaggauuccgugauca

SEQ ID NO: 34717 - RNA, 25 nt, Artificial Sequence
  Synthetic Oligonucleotide; NDFIP1 exon 2; Set C
guguuuuuaaggauuccgugaucac

SEQ ID NO: 34718 - RNA, 15 nt, Artificial Sequence
  Synthetic Oligonucleotide; NDFIP1 exon 2; Set C
uuuaaggauuccgug

SEQ ID NO: 34719 - RNA, 19 nt, Artificial Sequence
  Synthetic Oligonucleotide; NDFIP1 exon 2; Set C
uuuuuaaggauuccgugau

SEQ ID NO: 34720 - RNA, 17 nt, Artificial Sequence
  Synthetic Oligonucleotide; NDFIP1 exon 2; Set C
uuuuaaggauuccguga

SEQ ID NO: 34721 - RNA, 21 nt, Artificial Sequence
  Synthetic Oligonucleotide; NDFIP1 exon 2; Set C
guuuuuaaggauuccgugauc

SEQ ID NO: 34722 - RNA, 24 nt, Artificial Sequence
  Synthetic Oligonucleotide; NDFIP1 exon 2; Set C
guguuuuuaaggauuccgugauca

SEQ ID NO: 34723 - RNA, 16 nt, Artificial Sequence
  Synthetic Oligonucleotide; NDFIP1 exon 2; Set C
uuuuaaggauuccgug

SEQ ID NO: 34724 - RNA, 20 nt, Artificial Sequence
  Synthetic Oligonucleotide; NDFIP1 exon 2; Set C
guuuuuaaggauuccgugau

SEQ ID NO: 34725 - RNA, 18 nt, Artificial Sequence
  Synthetic Oligonucleotide; NDFIP1 exon 2; Set C
uuuuuaaggauuccguga

SEQ ID NO: 34726 - RNA, 22 nt, Artificial Sequence
  Synthetic Oligonucleotide; NDFIP1 exon 2; Set C
uguuuuuaaggauuccgugauc

SEQ ID NO: 34727 - RNA, 17 nt, Artificial Sequence
  Synthetic Oligonucleotide; NDFIP1 exon 2; Set C
uuuuuaaggauuccgug

SEQ ID NO: 34728 - RNA, 21 nt, Artificial Sequence
  Synthetic Oligonucleotide; NDFIP1 exon 2; Set C
uguuuuuaaggauuccgugau

SEQ ID NO: 34729 - RNA, 19 nt, Artificial Sequence
  Synthetic Oligonucleotide; NDFIP1 exon 2; Set C
guuuuuaaggauuccguga

SEQ ID NO: 34730 - RNA, 23 nt, Artificial Sequence
  Synthetic Oligonucleotide; NDFIP1 exon 2; Set C
guguuuuuaaggauuccgugauc

SEQ ID NO: 34731 - RNA, 18 nt, Artificial Sequence
  Synthetic Oligonucleotide; NDFIP1 exon 2; Set C
guuuuuaaggauuccgug

SEQ ID NO: 34732 - RNA, 22 nt, Artificial Sequence
  Synthetic Oligonucleotide; NDFIP1 exon 2; Set C
guguuuuuaaggauuccgugau

SEQ ID NO: 34733 - RNA, 20 nt, Artificial Sequence
  Synthetic Oligonucleotide; NDFIP1 exon 2; Set C
uguuuuuaaggauuccguga

SEQ ID NO: 34734 - RNA, 15 nt, Artificial Sequence
  Synthetic Oligonucleotide; NDFIP1 exon 2; Set C
uuuuuaaggauuccg

SEQ ID NO: 34735 - RNA, 19 nt, Artificial Sequence
  Synthetic Oligonucleotide; NDFIP1 exon 2; Set C
uguuuuuaaggauuccgug

SEQ ID NO: 34736 - RNA, 21 nt, Artificial Sequence
  Synthetic Oligonucleotide; NDFIP1 exon 2; Set C
guguuuuuaaggauuccguga

SEQ ID NO: 34737 - RNA, 16 nt, Artificial Sequence
  Synthetic Oligonucleotide; NDFIP1 exon 2; Set C
guuuuuaaggauuccg

SEQ ID NO: 34738 - RNA, 20 nt, Artificial Sequence
  Synthetic Oligonucleotide; NDFIP1 exon 2; Set C
guguuuuuaaggauuccgug

SEQ ID NO: 34739 - RNA, 15 nt, Artificial Sequence
  Synthetic Oligonucleotide; NDFIP1 exon 2; Set C
guuuuuaaggauucc

SEQ ID NO: 34740 - RNA, 15 nt, Artificial Sequence
  Synthetic Oligonucleotide; NDFIP1 exon 2; Set C
uguuuuuaaggauuc

SEQ ID NO: 34741 - RNA, 16 nt, Artificial Sequence
  Synthetic Oligonucleotide; NDFIP1 exon 2; Set C
guguuuuuaaggauuc

SEQ ID NO: 34742 - RNA, 17 nt, Artificial Sequence
  Synthetic Oligonucleotide; NDFIP1 exon 2; Set C
aaagccaauuagaaaga

SEQ ID NO: 34743 - RNA, 18 nt, Artificial Sequence
  Synthetic Oligonucleotide; NDFIP1 exon 2; Set C
uaaagccaauuagaaaga

SEQ ID NO: 34744 - RNA, 25 nt, Artificial Sequence
  Synthetic Oligonucleotide; NDFIP1 exon 2; Set C
guaagcauaaagccaauuagaaaga

SEQ ID NO: 34745 - RNA, 26 nt, Artificial Sequence
  Synthetic Oligonucleotide; NDFIP1 exon 2; Set C
auguaagcauaaagccaauuagaaag

SEQ ID NO: 34746 - RNA, 27 nt, Artificial Sequence
  Synthetic Oligonucleotide; NDFIP1 exon 2; Set C
aauguaagcauaaagccaauuagaaag

SEQ ID NO: 34747 - RNA, 28 nt, Artificial Sequence
  Synthetic Oligonucleotide; NDFIP1 exon 2; Set C
uaauguaagcauaaagccaauuagaaag

SEQ ID NO: 34748 - RNA, 29 nt, Artificial Sequence
  Synthetic Oligonucleotide; NDFIP1 exon 2; Set C
uuaauguaagcauaaagccaauuagaaag

SEQ ID NO: 34749 - RNA, 18 nt, Artificial Sequence
  Synthetic Oligonucleotide; NDFIP1 exon 2; Set C
guaagcauaaagccaauu

SEQ ID NO: 34750 - RNA, 30 nt, Artificial Sequence
  Synthetic Oligonucleotide; NDFIP1 exon 2; Set C
uuuaauguaagcauaaagccaauuagaaag

SEQ ID NO: 34751 - RNA, 17 nt, Artificial Sequence
  Synthetic Oligonucleotide; NDFIP1 exon 2; Set C
guaagcauaaagccaau

SEQ ID NO: 34752 - RNA, 31 nt, Artificial Sequence
  Synthetic Oligonucleotide; NDFIP1 exon 2; Set C
uuuuaauguaagcauaaagccaauuagaaag

SEQ ID NO: 34753 - RNA, 18 nt, Artificial Sequence
  Synthetic Oligonucleotide; NDFIP1 exon 2; Set C
uguaagcauaaagccaau

SEQ ID NO: 34754 - RNA, 32 nt, Artificial Sequence
  Synthetic Oligonucleotide; NDFIP1 exon 2; Set C
auuuuaauguaagcauaaagccaauuagaaag

SEQ ID NO: 34755 - RNA, 33 nt, Artificial Sequence
  Synthetic Oligonucleotide; NDFIP1 exon 2; Set C
uauuuuaauguaagcauaaagccaauuagaaag

SEQ ID NO: 34756 - RNA, 34 nt, Artificial Sequence
  Synthetic Oligonucleotide; NDFIP1 exon 2; Set C
auauuuuaauguaagcauaaagccaauuagaaag

SEQ ID NO: 34757 - RNA, 35 nt, Artificial Sequence
  Synthetic Oligonucleotide; NDFIP1 exon 2; Set C
cauauuuuaauguaagcauaaagccaauuagaaag

SEQ ID NO: 34758 - RNA, 36 nt, Artificial Sequence
  Synthetic Oligonucleotide; NDFIP1 exon 2; Set C
ucauauuuuaauguaagcauaaagccaauuagaaag

SEQ ID NO: 34759 - RNA, 37 nt, Artificial Sequence
  Synthetic Oligonucleotide; NDFIP1 exon 2; Set C
uucauauuuuaauguaagcauaaagccaauuagaaag

SEQ ID NO: 34760 - RNA, 38 nt, Artificial Sequence
  Synthetic Oligonucleotide; NDFIP1 exon 2; Set C
uuucauauuuuaauguaagcauaaagccaauuagaaag

SEQ ID NO: 34761 - RNA, 27 nt, Artificial Sequence
  Synthetic Oligonucleotide; NDFIP1 exon 2; Set C
aauuucauauuuuaauguaagcauaaa

SEQ ID NO: 34762 - RNA, 26 nt, Artificial Sequence
  Synthetic Oligonucleotide; NDFIP1 exon 2; Set C
aauuucauauuuuaauguaagcauaa

SEQ ID NO: 34763 - RNA, 28 nt, Artificial Sequence
  Synthetic Oligonucleotide; NDFIP1 exon 2; Set C
aaauuucauauuuuaauguaagcauaaa

SEQ ID NO: 34764 - RNA, 27 nt, Artificial Sequence
  Synthetic Oligonucleotide; NDFIP1 exon 2; Set C
aaauuucauauuuuaauguaagcauaa

SEQ ID NO: 34765 - RNA, 25 nt, Artificial Sequence
  Synthetic Oligonucleotide; NDFIP1 exon 2; Set C
aauuucauauuuuaauguaagcaua

SEQ ID NO: 34766 - RNA, 29 nt, Artificial Sequence
  Synthetic Oligonucleotide; NDFIP1 exon 2; Set C
aaaauuucauauuuuaauguaagcauaaa

SEQ ID NO: 34767 - RNA, 28 nt, Artificial Sequence
  Synthetic Oligonucleotide; NDFIP1 exon 2; Set C
aaaauuucauauuuuaauguaagcauaa

SEQ ID NO: 34768 - RNA, 26 nt, Artificial Sequence
  Synthetic Oligonucleotide; NDFIP1 exon 2; Set C
aaauuucauauuuuaauguaagcaua

SEQ ID NO: 34769 - RNA, 27 nt, Artificial Sequence
  Synthetic Oligonucleotide; NDFIP1 exon 2; Set C
aaaauuucauauuuuaauguaagcaua

SEQ ID NO: 34770 - RNA, 19 nt, Artificial Sequence
  Synthetic Oligonucleotide; NDFIP1 exon 2; Set C
aauuucauauuuuaaugua

SEQ ID NO: 34771 - RNA, 18 nt, Artificial Sequence
  Synthetic Oligonucleotide; NDFIP1 exon 2; Set C
aauuucauauuuuaaugu

SEQ ID NO: 34772 - RNA, 20 nt, Artificial Sequence
  Synthetic Oligonucleotide; NDFIP1 exon 2; Set C
aaauuucauauuuuaaugua

SEQ ID NO: 34773 - RNA, 17 nt, Artificial Sequence
  Synthetic Oligonucleotide; NDFIP1 exon 2; Set C
aauuucauauuuuaaug

SEQ ID NO: 34774 - RNA, 19 nt, Artificial Sequence
  Synthetic Oligonucleotide; NDFIP1 exon 2; Set C
aaauuucauauuuuaaugu

SEQ ID NO: 34775 - RNA, 21 nt, Artificial Sequence
  Synthetic Oligonucleotide; NDFIP1 exon 2; Set C
aaaauuucauauuuuaaugua

SEQ ID NO: 34776 - RNA, 16 nt, Artificial Sequence
  Synthetic Oligonucleotide; NDFIP1 exon 2; Set C
aauuucauauuuuaau

SEQ ID NO: 34777 - RNA, 20 nt, Artificial Sequence
  Synthetic Oligonucleotide; NDFIP1 exon 2; Set C
aaaauuucauauuuuaaugu

SEQ ID NO: 34778 - RNA, 18 nt, Artificial Sequence
  Synthetic Oligonucleotide; NDFIP1 exon 2; Set C
aaauuucauauuuuaaug

SEQ ID NO: 34779 - RNA, 15 nt, Artificial Sequence
  Synthetic Oligonucleotide; NDFIP1 exon 2; Set C
aauuucauauuuuaa

SEQ ID NO: 34780 - RNA, 17 nt, Artificial Sequence
  Synthetic Oligonucleotide; NDFIP1 exon 2; Set C
aaauuucauauuuuaau

SEQ ID NO: 34781 - RNA, 19 nt, Artificial Sequence
  Synthetic Oligonucleotide; NDFIP1 exon 2; Set C
aaaauuucauauuuuaaug

SEQ ID NO: 34782 - RNA, 18 nt, Artificial Sequence
  Synthetic Oligonucleotide; NDFIP1 exon 2; Set C
aaaauuucauauuuuaau

SEQ ID NO: 34783 - RNA, 16 nt, Artificial Sequence
  Synthetic Oligonucleotide; NDFIP1 exon 2; Set C
aaauuucauauuuuaa

SEQ ID NO: 34784 - RNA, 17 nt, Artificial Sequence
  Synthetic Oligonucleotide; NDFIP1 exon 2; Set C
aaaauuucauauuuuaa

SEQ ID NO: 34785 - RNA, 15 nt, Artificial Sequence
  Synthetic Oligonucleotide; NDFIP1 exon 2; Set C
aaauuucauauuuua

SEQ ID NO: 34786 - RNA, 16 nt, Artificial Sequence
  Synthetic Oligonucleotide; NDFIP1 exon 2; Set C
aaaauuucauauuuua

SEQ ID NO: 34787 - RNA, 15 nt, Artificial Sequence
  Synthetic Oligonucleotide; NDFIP1 exon 2; Set C
aaaauuucauauuuu

SEQ ID NO: 34788 - RNA, 15 nt, Artificial Sequence
  Synthetic Oligonucleotide; NDFIP1 exon 2; Set C
caacuaaauaaaaau

SEQ ID NO: 34789 - RNA, 16 nt, Artificial Sequence
  Synthetic Oligonucleotide; NDFIP1 exon 2; Set C
gcaacuaaauaaaaau

SEQ ID NO: 34790 - RNA, 17 nt, Artificial Sequence
  Synthetic Oligonucleotide; NDFIP1 exon 2; Set C
ugcaacuaaauaaaaau

SEQ ID NO: 34791 - RNA, 15 nt, Artificial Sequence
  Synthetic Oligonucleotide; NDFIP1 exon 2; Set C
ugcaacuaaauaaaa

SEQ ID NO: 34792 - RNA, 34 nt, Artificial Sequence
  Synthetic Oligonucleotide; NDFIP1 exon 2; Set C
agacucuucuucauucugcaacuaaauaaaaauu

SEQ ID NO: 34793 - RNA, 35 nt, Artificial Sequence
  Synthetic Oligonucleotide; NDFIP1 exon 2; Set C
cagacucuucuucauucugcaacuaaauaaaaauu

SEQ ID NO: 34794 - RNA, 26 nt, Artificial Sequence
  Synthetic Oligonucleotide; NDFIP1 exon 2; Set C
agacucuucuucauucugcaacuaaa

SEQ ID NO: 34795 - RNA, 24 nt, Artificial Sequence
  Synthetic Oligonucleotide; NDFIP1 exon 2; Set C
agacucuucuucauucugcaacua

SEQ ID NO: 34796 - RNA, 20 nt, Artificial Sequence
  Synthetic Oligonucleotide; NDFIP1 exon 2; Set C
agacucuucuucauucugca

SEQ ID NO: 34797 - RNA, 19 nt, Artificial Sequence
  Synthetic Oligonucleotide; NDFIP1 exon 2; Set C
agacucuucuucauucugc

SEQ ID NO: 34798 - RNA, 20 nt, Artificial Sequence
  Synthetic Oligonucleotide; NDFIP1 exon 2; Set C
cagacucuucuucauucugc

SEQ ID NO: 34799 - RNA, 40 nt, Artificial Sequence
  Synthetic Oligonucleotide; NDFIP1 exon 2; Set C
uguucagguucuccagacucuucuucauucugcaacuaaa

SEQ ID NO: 34800 - RNA, 39 nt, Artificial Sequence
  Synthetic Oligonucleotide; NDFIP1 exon 2; Set C
uguucagguucuccagacucuucuucauucugcaacuaa

SEQ ID NO: 34801 - RNA, 38 nt, Artificial Sequence
  Synthetic Oligonucleotide; NDFIP1 exon 2; Set C
uguucagguucuccagacucuucuucauucugcaacua

SEQ ID NO: 34802 - RNA, 34 nt, Artificial Sequence
  Synthetic Oligonucleotide; NDFIP1 exon 2; Set C
uguucagguucuccagacucuucuucauucugca

SEQ ID NO: 34803 - RNA, 33 nt, Artificial Sequence
  Synthetic Oligonucleotide; NDFIP1 exon 2; Set C
uguucagguucuccagacucuucuucauucugc

SEQ ID NO: 34804 - RNA, 17 nt, Artificial Sequence
  Synthetic Oligonucleotide; NDFIP1 exon 2; Set C
uguucagguucuccaga

SEQ ID NO: 34805 - RNA, 16 nt, Artificial Sequence
  Synthetic Oligonucleotide; NDFIP1 exon 2; Set C
uguucagguucuccag

SEQ ID NO: 34806 - RNA, 17 nt, Artificial Sequence
  Synthetic Oligonucleotide; NDFIP1 exon 2; Set C
cuguucagguucuccag

SEQ ID NO: 34807 - RNA, 31 nt, Artificial Sequence
  Synthetic Oligonucleotide; NDFIP1 exon 2; Set C
caucaccugcagccuguucagguucuccaga

SEQ ID NO: 34808 - RNA, 32 nt, Artificial Sequence
  Synthetic Oligonucleotide; NDFIP1 exon 2; Set C
gcaucaccugcagccuguucagguucuccaga

SEQ ID NO: 34809 - RNA, 30 nt, Artificial Sequence
  Synthetic Oligonucleotide; NDFIP1 exon 2; Set C
caucaccugcagccuguucagguucuccag

SEQ ID NO: 34810 - RNA, 33 nt, Artificial Sequence
  Synthetic Oligonucleotide; NDFIP1 exon 2; Set C
agcaucaccugcagccuguucagguucuccaga

SEQ ID NO: 34811 - RNA, 31 nt, Artificial Sequence
  Synthetic Oligonucleotide; NDFIP1 exon 2; Set C
gcaucaccugcagccuguucagguucuccag

SEQ ID NO: 34812 - RNA, 34 nt, Artificial Sequence
  Synthetic Oligonucleotide; NDFIP1 exon 2; Set C
gagcaucaccugcagccuguucagguucuccaga

SEQ ID NO: 34813 - RNA, 32 nt, Artificial Sequence
  Synthetic Oligonucleotide; NDFIP1 exon 2; Set C
agcaucaccugcagccuguucagguucuccag

SEQ ID NO: 34814 - RNA, 33 nt, Artificial Sequence
  Synthetic Oligonucleotide; NDFIP1 exon 2; Set C
gagcaucaccugcagccuguucagguucuccag

SEQ ID NO: 34815 - RNA, 35 nt, Artificial Sequence
  Synthetic Oligonucleotide; NDFIP1 exon 2; Set C
ggagcaucaccugcagccuguucagguucuccaga

SEQ ID NO: 34816 - RNA, 34 nt, Artificial Sequence
  Synthetic Oligonucleotide; NDFIP1 exon 2; Set C
ggagcaucaccugcagccuguucagguucuccag

SEQ ID NO: 34817 - RNA, 36 nt, Artificial Sequence
  Synthetic Oligonucleotide; NDFIP1 exon 2; Set C
aggagcaucaccugcagccuguucagguucuccaga

SEQ ID NO: 34818 - RNA, 35 nt, Artificial Sequence
  Synthetic Oligonucleotide; NDFIP1 exon 2; Set C
aggagcaucaccugcagccuguucagguucuccag

SEQ ID NO: 34819 - RNA, 37 nt, Artificial Sequence
  Synthetic Oligonucleotide; NDFIP1 exon 2; Set C
gaggagcaucaccugcagccuguucagguucuccaga

SEQ ID NO: 34820 - RNA, 36 nt, Artificial Sequence
  Synthetic Oligonucleotide; NDFIP1 exon 2; Set C
gaggagcaucaccugcagccuguucagguucuccag

SEQ ID NO: 34821 - RNA, 17 nt, Artificial Sequence
  Synthetic Oligonucleotide; NDFIP1 exon 2; Set A
caucaccugcagccugu

SEQ ID NO: 34822 - RNA, 16 nt, Artificial Sequence
  Synthetic Oligonucleotide; NDFIP1 exon 2; Set C
caucaccugcagccug

SEQ ID NO: 34823 - RNA, 18 nt, Artificial Sequence
  Synthetic Oligonucleotide; NDFIP1 exon 2; Set A
gcaucaccugcagccugu

SEQ ID NO: 34824 - RNA, 17 nt, Artificial Sequence
  Synthetic Oligonucleotide; NDFIP1 exon 2; Set A
gcaucaccugcagccug

SEQ ID NO: 34825 - RNA, 19 nt, Artificial Sequence
  Synthetic Oligonucleotide; NDFIP1 exon 2; Set A
agcaucaccugcagccugu

SEQ ID NO: 34826 - RNA, 18 nt, Artificial Sequence
  Synthetic Oligonucleotide; NDFIP1 exon 2; Set A
agcaucaccugcagccug

SEQ ID NO: 34827 - RNA, 20 nt, Artificial Sequence
  Synthetic Oligonucleotide; NDFIP1 exon 2; Set A
gagcaucaccugcagccugu

SEQ ID NO: 34828 - RNA, 19 nt, Artificial Sequence
  Synthetic Oligonucleotide; NDFIP1 exon 2; Set A
gagcaucaccugcagccug

SEQ ID NO: 34829 - RNA, 20 nt, Artificial Sequence
  Synthetic Oligonucleotide; NDFIP1 exon 2; Set A
ggagcaucaccugcagccug

SEQ ID NO: 34830 - RNA, 22 nt, Artificial Sequence
  Synthetic Oligonucleotide; NDFIP1 exon 2; Set C
aggagcaucaccugcagccugu

SEQ ID NO: 34831 - RNA, 21 nt, Artificial Sequence
  Synthetic Oligonucleotide; NDFIP1 exon 2; Set A
aggagcaucaccugcagccug

SEQ ID NO: 34832 - RNA, 23 nt, Artificial Sequence
  Synthetic Oligonucleotide; NDFIP1 exon 2; Set C
gaggagcaucaccugcagccugu

SEQ ID NO: 34833 - RNA, 22 nt, Artificial Sequence
  Synthetic Oligonucleotide; NDFIP1 exon 2; Set C
gaggagcaucaccugcagccug

SEQ ID NO: 34834 - RNA, 30 nt, Artificial Sequence
  Synthetic Oligonucleotide; NDFIP1 exon 2; Set C
uaagguggaggagcaucaccugcagccugu

SEQ ID NO: 34835 - RNA, 29 nt, Artificial Sequence
  Synthetic Oligonucleotide; NDFIP1 exon 2; Set C
uaagguggaggagcaucaccugcagccug

SEQ ID NO: 34836 - RNA, 40 nt, Artificial Sequence
  Synthetic Oligonucleotide; NDFIP1 exon 2; Set C
aaugcugcuguaagguggaggagcaucaccugcagccugu

SEQ ID NO: 34837 - RNA, 39 nt, Artificial Sequence
  Synthetic Oligonucleotide; NDFIP1 exon 2; Set C
aaugcugcuguaagguggaggagcaucaccugcagccug

SEQ ID NO: 34838 - RNA, 17 nt, Artificial Sequence
  Synthetic Oligonucleotide; NDFIP1 exon 2; Set C
uaagguggaggagcauc

SEQ ID NO: 34839 - RNA, 19 nt, Artificial Sequence
  Synthetic Oligonucleotide; NDFIP1 exon 2; Set C
guaagguggaggagcauca

SEQ ID NO: 34840 - RNA, 18 nt, Artificial Sequence
  Synthetic Oligonucleotide; NDFIP1 exon 2; Set C
guaagguggaggagcauc

SEQ ID NO: 34841 - RNA, 20 nt, Artificial Sequence
  Synthetic Oligonucleotide; NDFIP1 exon 2; Set C
uguaagguggaggagcauca

SEQ ID NO: 34842 - RNA, 19 nt, Artificial Sequence
  Synthetic Oligonucleotide; NDFIP1 exon 2; Set C
uguaagguggaggagcauc

SEQ ID NO: 34843 - RNA, 26 nt, Artificial Sequence
  Synthetic Oligonucleotide; NDFIP1 exon 2; Set A
aaugcugcuguaagguggaggagcau

SEQ ID NO: 34844 - RNA, 25 nt, Artificial Sequence
  Synthetic Oligonucleotide; NDFIP1 exon 2; Set A
aaugcugcuguaagguggaggagca

SEQ ID NO: 34845 - RNA, 24 nt, Artificial Sequence
  Synthetic Oligonucleotide; NDFIP1 exon 2; Set A
aaugcugcuguaagguggaggagc

SEQ ID NO: 34846 - RNA, 23 nt, Artificial Sequence
  Synthetic Oligonucleotide; NDFIP1 exon 2; Set A
aaugcugcuguaagguggaggag

SEQ ID NO: 34847 - RNA, 22 nt, Artificial Sequence
  Synthetic Oligonucleotide; NDFIP1 exon 2; Set A
aaugcugcuguaagguggagga

SEQ ID NO: 34848 - RNA, 21 nt, Artificial Sequence
  Synthetic Oligonucleotide; NDFIP1 exon 2; Set C
aaugcugcuguaagguggagg

SEQ ID NO: 34849 - RNA, 20 nt, Artificial Sequence
  Synthetic Oligonucleotide; NDFIP1 exon 2; Set C
aaugcugcuguaagguggag

SEQ ID NO: 34850 - RNA, 35 nt, Artificial Sequence
  Synthetic Oligonucleotide; NDFIP1 exon 2; Set C
cucugcagaaaugcugcuguaagguggaggagcau

SEQ ID NO: 34851 - RNA, 34 nt, Artificial Sequence
  Synthetic Oligonucleotide; NDFIP1 exon 2; Set C
cucugcagaaaugcugcuguaagguggaggagca

SEQ ID NO: 34852 - RNA, 36 nt, Artificial Sequence
  Synthetic Oligonucleotide; NDFIP1 exon 2; Set C
ucucugcagaaaugcugcuguaagguggaggagcau

SEQ ID NO: 34853 - RNA, 33 nt, Artificial Sequence
  Synthetic Oligonucleotide; NDFIP1 exon 2; Set C
cucugcagaaaugcugcuguaagguggaggagc

SEQ ID NO: 34854 - RNA, 35 nt, Artificial Sequence
  Synthetic Oligonucleotide; NDFIP1 exon 2; Set C
ucucugcagaaaugcugcuguaagguggaggagca

SEQ ID NO: 34855 - RNA, 37 nt, Artificial Sequence
  Synthetic Oligonucleotide; NDFIP1 exon 2; Set C
cucucugcagaaaugcugcuguaagguggaggagcau

SEQ ID NO: 34856 - RNA, 32 nt, Artificial Sequence
  Synthetic Oligonucleotide; NDFIP1 exon 2; Set C
cucugcagaaaugcugcuguaagguggaggag

SEQ ID NO: 34857 - RNA, 34 nt, Artificial Sequence
  Synthetic Oligonucleotide; NDFIP1 exon 2; Set C
ucucugcagaaaugcugcuguaagguggaggagc

SEQ ID NO: 34858 - RNA, 36 nt, Artificial Sequence
  Synthetic Oligonucleotide; NDFIP1 exon 2; Set C
cucucugcagaaaugcugcuguaagguggaggagca

SEQ ID NO: 34859 - RNA, 38 nt, Artificial Sequence
  Synthetic Oligonucleotide; NDFIP1 exon 2; Set C
gcucucugcagaaaugcugcuguaagguggaggagcau

SEQ ID NO: 34860 - RNA, 33 nt, Artificial Sequence
  Synthetic Oligonucleotide; NDFIP1 exon 2; Set C
ucucugcagaaaugcugcuguaagguggaggag

SEQ ID NO: 34861 - RNA, 31 nt, Artificial Sequence
  Synthetic Oligonucleotide; NDFIP1 exon 2; Set C
cucugcagaaaugcugcuguaagguggagga

SEQ ID NO: 34862 - RNA, 35 nt, Artificial Sequence
  Synthetic Oligonucleotide; NDFIP1 exon 2; Set C
cucucugcagaaaugcugcuguaagguggaggagc

SEQ ID NO: 34863 - RNA, 37 nt, Artificial Sequence
  Synthetic Oligonucleotide; NDFIP1 exon 2; Set C
gcucucugcagaaaugcugcuguaagguggaggagca

SEQ ID NO: 34864 - RNA, 39 nt, Artificial Sequence
  Synthetic Oligonucleotide; NDFIP1 exon 2; Set C
cgcucucugcagaaaugcugcuguaagguggaggagcau

SEQ ID NO: 34865 - RNA, 29 nt, Artificial Sequence
  Synthetic Oligonucleotide; NDFIP1 exon 2; Set A
ucugcagaaaugcugcuguaagguggagg

SEQ ID NO: 34866 - RNA, 34 nt, Artificial Sequence
  Synthetic Oligonucleotide; NDFIP1 exon 2; Set C
cucucugcagaaaugcugcuguaagguggaggag

SEQ ID NO: 34867 - RNA, 32 nt, Artificial Sequence
  Synthetic Oligonucleotide; NDFIP1 exon 2; Set C
ucucugcagaaaugcugcuguaagguggagga

SEQ ID NO: 34868 - RNA, 36 nt, Artificial Sequence
  Synthetic Oligonucleotide; NDFIP1 exon 2; Set C
gcucucugcagaaaugcugcuguaagguggaggagc

SEQ ID NO: 34869 - RNA, 38 nt, Artificial Sequence
  Synthetic Oligonucleotide; NDFIP1 exon 2; Set C
cgcucucugcagaaaugcugcuguaagguggaggagca

SEQ ID NO: 34870 - RNA, 30 nt, Artificial Sequence
  Synthetic Oligonucleotide; NDFIP1 exon 2; Set C
cucugcagaaaugcugcuguaagguggagg

SEQ ID NO: 34871 - RNA, 28 nt, Artificial Sequence
  Synthetic Oligonucleotide; NDFIP1 exon 2; Set A
ucugcagaaaugcugcuguaagguggag

SEQ ID NO: 34872 - RNA, 35 nt, Artificial Sequence
  Synthetic Oligonucleotide; NDFIP1 exon 2; Set C
gcucucugcagaaaugcugcuguaagguggaggag

SEQ ID NO: 34873 - RNA, 33 nt, Artificial Sequence
  Synthetic Oligonucleotide; NDFIP1 exon 2; Set C
cucucugcagaaaugcugcuguaagguggagga

SEQ ID NO: 34874 - RNA, 37 nt, Artificial Sequence
  Synthetic Oligonucleotide; NDFIP1 exon 2; Set C
cgcucucugcagaaaugcugcuguaagguggaggagc

SEQ ID NO: 34875 - RNA, 31 nt, Artificial Sequence
  Synthetic Oligonucleotide; NDFIP1 exon 2; Set C
ucucugcagaaaugcugcuguaagguggagg

SEQ ID NO: 34876 - RNA, 29 nt, Artificial Sequence
  Synthetic Oligonucleotide; NDFIP1 exon 2; Set A
cucugcagaaaugcugcuguaagguggag

SEQ ID NO: 34877 - RNA, 36 nt, Artificial Sequence
  Synthetic Oligonucleotide; NDFIP1 exon 2; Set C
cgcucucugcagaaaugcugcuguaagguggaggag

SEQ ID NO: 34878 - RNA, 34 nt, Artificial Sequence
  Synthetic Oligonucleotide; NDFIP1 exon 2; Set C
gcucucugcagaaaugcugcuguaagguggagga

SEQ ID NO: 34879 - RNA, 32 nt, Artificial Sequence
  Synthetic Oligonucleotide; NDFIP1 exon 2; Set C
cucucugcagaaaugcugcuguaagguggagg

SEQ ID NO: 34880 - RNA, 30 nt, Artificial Sequence
  Synthetic Oligonucleotide; NDFIP1 exon 2; Set A
ucucugcagaaaugcugcuguaagguggag

SEQ ID NO: 34881 - RNA, 35 nt, Artificial Sequence
  Synthetic Oligonucleotide; NDFIP1 exon 2; Set C
cgcucucugcagaaaugcugcuguaagguggagga

SEQ ID NO: 34882 - RNA, 33 nt, Artificial Sequence
  Synthetic Oligonucleotide; NDFIP1 exon 2; Set C
gcucucugcagaaaugcugcuguaagguggagg

SEQ ID NO: 34883 - RNA, 31 nt, Artificial Sequence
  Synthetic Oligonucleotide; NDFIP1 exon 2; Set A
cucucugcagaaaugcugcuguaagguggag

SEQ ID NO: 34884 - RNA, 34 nt, Artificial Sequence
  Synthetic Oligonucleotide; NDFIP1 exon 2; Set C
cgcucucugcagaaaugcugcuguaagguggagg

SEQ ID NO: 34885 - RNA, 32 nt, Artificial Sequence
  Synthetic Oligonucleotide; NDFIP1 exon 2; Set C
gcucucugcagaaaugcugcuguaagguggag

SEQ ID NO: 34886 - RNA, 33 nt, Artificial Sequence
  Synthetic Oligonucleotide; NDFIP1 exon 2; Set C
cgcucucugcagaaaugcugcuguaagguggag

SEQ ID NO: 34887 - RNA, 21 nt, Artificial Sequence
  Synthetic Oligonucleotide; NDFIP1 exon 2; Set C
ucugcagaaaugcugcuguaa

SEQ ID NO: 34888 - RNA, 20 nt, Artificial Sequence
  Synthetic Oligonucleotide; NDFIP1 exon 2; Set C
ucugcagaaaugcugcugua

SEQ ID NO: 34889 - RNA, 22 nt, Artificial Sequence
  Synthetic Oligonucleotide; NDFIP1 exon 2; Set C
cucugcagaaaugcugcuguaa

SEQ ID NO: 34890 - RNA, 19 nt, Artificial Sequence
  Synthetic Oligonucleotide; NDFIP1 exon 2; Set C
ucugcagaaaugcugcugu

SEQ ID NO: 34891 - RNA, 21 nt, Artificial Sequence
  Synthetic Oligonucleotide; NDFIP1 exon 2; Set C
cucugcagaaaugcugcugua

SEQ ID NO: 34892 - RNA, 23 nt, Artificial Sequence
  Synthetic Oligonucleotide; NDFIP1 exon 2; Set A
ucucugcagaaaugcugcuguaa

SEQ ID NO: 34893 - RNA, 20 nt, Artificial Sequence
  Synthetic Oligonucleotide; NDFIP1 exon 2; Set C
cucugcagaaaugcugcugu

SEQ ID NO: 34894 - RNA, 22 nt, Artificial Sequence
  Synthetic Oligonucleotide; NDFIP1 exon 2; Set A
ucucugcagaaaugcugcugua

SEQ ID NO: 34895 - RNA, 40 nt, Artificial Sequence
  Synthetic Oligonucleotide; NDFIP1 exon 2; Set C
uaccugcgcucucugcagaaaugcugcuguaagguggagg

SEQ ID NO: 34896 - RNA, 24 nt, Artificial Sequence
  Synthetic Oligonucleotide; NDFIP1 exon 2; Set A
cucucugcagaaaugcugcuguaa

SEQ ID NO: 34897 - RNA, 21 nt, Artificial Sequence
  Synthetic Oligonucleotide; NDFIP1 exon 2; Set A
ucucugcagaaaugcugcugu

SEQ ID NO: 34898 - RNA, 23 nt, Artificial Sequence
  Synthetic Oligonucleotide; NDFIP1 exon 2; Set A
cucucugcagaaaugcugcugua

SEQ ID NO: 34899 - RNA, 39 nt, Artificial Sequence
  Synthetic Oligonucleotide; NDFIP1 exon 2; Set C
uaccugcgcucucugcagaaaugcugcuguaagguggag

SEQ ID NO: 34900 - RNA, 25 nt, Artificial Sequence
  Synthetic Oligonucleotide; NDFIP1 exon 2; Set A
gcucucugcagaaaugcugcuguaa

SEQ ID NO: 34901 - RNA, 22 nt, Artificial Sequence
  Synthetic Oligonucleotide; NDFIP1 exon 2; Set A
cucucugcagaaaugcugcugu

SEQ ID NO: 34902 - RNA, 24 nt, Artificial Sequence
  Synthetic Oligonucleotide; NDFIP1 exon 2; Set A
gcucucugcagaaaugcugcugua

SEQ ID NO: 34903 - RNA, 26 nt, Artificial Sequence
  Synthetic Oligonucleotide; NDFIP1 exon 2; Set A
cgcucucugcagaaaugcugcuguaa

SEQ ID NO: 34904 - RNA, 23 nt, Artificial Sequence
  Synthetic Oligonucleotide; NDFIP1 exon 2; Set A
gcucucugcagaaaugcugcugu

SEQ ID NO: 34905 - RNA, 25 nt, Artificial Sequence
  Synthetic Oligonucleotide; NDFIP1 exon 2; Set A
cgcucucugcagaaaugcugcugua

SEQ ID NO: 34906 - RNA, 24 nt, Artificial Sequence
  Synthetic Oligonucleotide; NDFIP1 exon 2; Set A
cgcucucugcagaaaugcugcugu

SEQ ID NO: 34907 - RNA, 32 nt, Artificial Sequence
  Synthetic Oligonucleotide; NDFIP1 exon 2; Set C
uaccugcgcucucugcagaaaugcugcuguaa

SEQ ID NO: 34908 - RNA, 31 nt, Artificial Sequence
  Synthetic Oligonucleotide; NDFIP1 exon 2; Set C
uaccugcgcucucugcagaaaugcugcugua

SEQ ID NO: 34909 - RNA, 30 nt, Artificial Sequence
  Synthetic Oligonucleotide; NDFIP1 exon 2; Set C
uaccugcgcucucugcagaaaugcugcugu

SEQ ID NO: 34910 - RNA, 38 nt, Artificial Sequence
  Synthetic Oligonucleotide; NDFIP1 exon 2; Set C
guuaccuaccugcgcucucugcagaaaugcugcuguaa

SEQ ID NO: 34911 - RNA, 37 nt, Artificial Sequence
  Synthetic Oligonucleotide; NDFIP1 exon 2; Set C
guuaccuaccugcgcucucugcagaaaugcugcugua

SEQ ID NO: 34912 - RNA, 39 nt, Artificial Sequence
  Synthetic Oligonucleotide; NDFIP1 exon 2; Set C
uguuaccuaccugcgcucucugcagaaaugcugcuguaa

SEQ ID NO: 34913 - RNA, 36 nt, Artificial Sequence
  Synthetic Oligonucleotide; NDFIP1 exon 2; Set C
guuaccuaccugcgcucucugcagaaaugcugcugu

SEQ ID NO: 34914 - RNA, 38 nt, Artificial Sequence
  Synthetic Oligonucleotide; NDFIP1 exon 2; Set C
uguuaccuaccugcgcucucugcagaaaugcugcugua

SEQ ID NO: 34915 - RNA, 40 nt, Artificial Sequence
  Synthetic Oligonucleotide; NDFIP1 exon 2; Set C
cuguuaccuaccugcgcucucugcagaaaugcugcuguaa

SEQ ID NO: 34916 - RNA, 37 nt, Artificial Sequence
  Synthetic Oligonucleotide; NDFIP1 exon 2; Set C
uguuaccuaccugcgcucucugcagaaaugcugcugu

SEQ ID NO: 34917 - RNA, 39 nt, Artificial Sequence
  Synthetic Oligonucleotide; NDFIP1 exon 2; Set C
cuguuaccuaccugcgcucucugcagaaaugcugcugua

SEQ ID NO: 34918 - RNA, 38 nt, Artificial Sequence
  Synthetic Oligonucleotide; NDFIP1 exon 2; Set C
cuguuaccuaccugcgcucucugcagaaaugcugcugu

SEQ ID NO: 34919 - RNA, 22 nt, Artificial Sequence
  Synthetic Oligonucleotide; NDFIP1 exon 2; Set A
uaccugcgcucucugcagaaau

SEQ ID NO: 34920 - RNA, 28 nt, Artificial Sequence
  Synthetic Oligonucleotide; NDFIP1 exon 2; Set C
guuaccuaccugcgcucucugcagaaau

SEQ ID NO: 34921 - RNA, 20 nt, Artificial Sequence
  Synthetic Oligonucleotide; NDFIP1 exon 2; Set B
guuaccuaccugcgcucucu

SEQ ID NO: 34922 - RNA, 21 nt, Artificial Sequence
  Synthetic Oligonucleotide; NDFIP1 exon 2; Set B
uguuaccuaccugcgcucucu

SEQ ID NO: 34923 - RNA, 19 nt, Artificial Sequence
  Synthetic Oligonucleotide; NDFIP1 exon 2; Set B
guuaccuaccugcgcucuc

SEQ ID NO: 34924 - RNA, 22 nt, Artificial Sequence
  Synthetic Oligonucleotide; NDFIP1 exon 2; Set B
cuguuaccuaccugcgcucucu

SEQ ID NO: 34925 - RNA, 40 nt, Artificial Sequence
  Synthetic Oligonucleotide; NDFIP1 exon 2; Set C
ucaccuugcccuguuaccuaccugcgcucucugcagaaau

SEQ ID NO: 34926 - RNA, 31 nt, Artificial Sequence
  Synthetic Oligonucleotide; NDFIP1 exon 2; Set C
caccuugcccuguuaccuaccugcgcucucu

SEQ ID NO: 34927 - RNA, 32 nt, Artificial Sequence
  Synthetic Oligonucleotide; NDFIP1 exon 2; Set C
ucaccuugcccuguuaccuaccugcgcucucu

SEQ ID NO: 34928 - RNA, 33 nt, Artificial Sequence
  Synthetic Oligonucleotide; NDFIP1 exon 2; Set C
aucaccuugcccuguuaccuaccugcgcucucu

SEQ ID NO: 34929 - RNA, 31 nt, Artificial Sequence
  Synthetic Oligonucleotide; NDFIP1 exon 2; Set C
ucaccuugcccuguuaccuaccugcgcucuc

SEQ ID NO: 34930 - RNA, 34 nt, Artificial Sequence
  Synthetic Oligonucleotide; NDFIP1 exon 2; Set C
gaucaccuugcccuguuaccuaccugcgcucucu

SEQ ID NO: 34931 - RNA, 35 nt, Artificial Sequence
  Synthetic Oligonucleotide; NDFIP1 exon 2; Set C
ugaucaccuugcccuguuaccuaccugcgcucucu

SEQ ID NO: 34932 - RNA, 36 nt, Artificial Sequence
  Synthetic Oligonucleotide; NDFIP1 exon 2; Set C
gugaucaccuugcccuguuaccuaccugcgcucucu

SEQ ID NO: 34933 - RNA, 35 nt, Artificial Sequence
  Synthetic Oligonucleotide; NDFIP1 exon 2; Set C
gugaucaccuugcccuguuaccuaccugcgcucuc

SEQ ID NO: 34934 - RNA, 36 nt, Artificial Sequence
  Synthetic Oligonucleotide; NDFIP1 exon 2; Set C
cgugaucaccuugcccuguuaccuaccugcgcucuc

SEQ ID NO: 34935 - RNA, 37 nt, Artificial Sequence
  Synthetic Oligonucleotide; NDFIP1 exon 2; Set C
ccgugaucaccuugcccuguuaccuaccugcgcucuc

SEQ ID NO: 34936 - RNA, 35 nt, Artificial Sequence
  Synthetic Oligonucleotide; NDFIP1 exon 2; Set C
cgugaucaccuugcccuguuaccuaccugcgcucu

SEQ ID NO: 34937 - RNA, 38 nt, Artificial Sequence
  Synthetic Oligonucleotide; NDFIP1 exon 2; Set C
uccgugaucaccuugcccuguuaccuaccugcgcucuc

SEQ ID NO: 34938 - RNA, 36 nt, Artificial Sequence
  Synthetic Oligonucleotide; NDFIP1 exon 2; Set C
ccgugaucaccuugcccuguuaccuaccugcgcucu

SEQ ID NO: 34939 - RNA, 34 nt, Artificial Sequence
  Synthetic Oligonucleotide; NDFIP1 exon 2; Set C
cgugaucaccuugcccuguuaccuaccugcgcuc

SEQ ID NO: 34940 - RNA, 39 nt, Artificial Sequence
  Synthetic Oligonucleotide; NDFIP1 exon 2; Set C
uuccgugaucaccuugcccuguuaccuaccugcgcucuc

SEQ ID NO: 34941 - RNA, 37 nt, Artificial Sequence
  Synthetic Oligonucleotide; NDFIP1 exon 2; Set C
uccgugaucaccuugcccuguuaccuaccugcgcucu

SEQ ID NO: 34942 - RNA, 35 nt, Artificial Sequence
  Synthetic Oligonucleotide; NDFIP1 exon 2; Set C
ccgugaucaccuugcccuguuaccuaccugcgcuc

SEQ ID NO: 34943 - RNA, 33 nt, Artificial Sequence
  Synthetic Oligonucleotide; NDFIP1 exon 2; Set C
cgugaucaccuugcccuguuaccuaccugcgcu

SEQ ID NO: 34944 - RNA, 20 nt, Artificial Sequence
  Synthetic Oligonucleotide; NDFIP1 exon 2; Set B
caccuugcccuguuaccuac

SEQ ID NO: 34945 - RNA, 38 nt, Artificial Sequence
  Synthetic Oligonucleotide; NDFIP1 exon 2; Set C
uuccgugaucaccuugcccuguuaccuaccugcgcucu

SEQ ID NO: 34946 - RNA, 36 nt, Artificial Sequence
  Synthetic Oligonucleotide; NDFIP1 exon 2; Set C
uccgugaucaccuugcccuguuaccuaccugcgcuc

SEQ ID NO: 34947 - RNA, 32 nt, Artificial Sequence
  Synthetic Oligonucleotide; NDFIP1 exon 2; Set C
cgugaucaccuugcccuguuaccuaccugcgc

SEQ ID NO: 34948 - RNA, 34 nt, Artificial Sequence
  Synthetic Oligonucleotide; NDFIP1 exon 2; Set C
ccgugaucaccuugcccuguuaccuaccugcgcu

SEQ ID NO: 34949 - RNA, 21 nt, Artificial Sequence
  Synthetic Oligonucleotide; NDFIP1 exon 2; Set B
ucaccuugcccuguuaccuac

SEQ ID NO: 34950 - RNA, 37 nt, Artificial Sequence
  Synthetic Oligonucleotide; NDFIP1 exon 2; Set C
uuccgugaucaccuugcccuguuaccuaccugcgcuc

SEQ ID NO: 34951 - RNA, 35 nt, Artificial Sequence
  Synthetic Oligonucleotide; NDFIP1 exon 2; Set C
uccgugaucaccuugcccuguuaccuaccugcgcu

SEQ ID NO: 34952 - RNA, 33 nt, Artificial Sequence
  Synthetic Oligonucleotide; NDFIP1 exon 2; Set C
ccgugaucaccuugcccuguuaccuaccugcgc

SEQ ID NO: 34953 - RNA, 22 nt, Artificial Sequence
  Synthetic Oligonucleotide; NDFIP1 exon 2; Set B
aucaccuugcccuguuaccuac

SEQ ID NO: 34954 - RNA, 34 nt, Artificial Sequence
  Synthetic Oligonucleotide; NDFIP1 exon 2; Set C
uccgugaucaccuugcccuguuaccuaccugcgc

SEQ ID NO: 34955 - RNA, 36 nt, Artificial Sequence
  Synthetic Oligonucleotide; NDFIP1 exon 2; Set C
uuccgugaucaccuugcccuguuaccuaccugcgcu

SEQ ID NO: 34956 - RNA, 23 nt, Artificial Sequence
  Synthetic Oligonucleotide; NDFIP1 exon 2; Set B
gaucaccuugcccuguuaccuac

SEQ ID NO: 34957 - RNA, 35 nt, Artificial Sequence
  Synthetic Oligonucleotide; NDFIP1 exon 2; Set C
uuccgugaucaccuugcccuguuaccuaccugcgc

SEQ ID NO: 34958 - RNA, 24 nt, Artificial Sequence
  Synthetic Oligonucleotide; NDFIP1 exon 2; Set B
ugaucaccuugcccuguuaccuac

SEQ ID NO: 34959 - RNA, 25 nt, Artificial Sequence
  Synthetic Oligonucleotide; NDFIP1 exon 2; Set C
gugaucaccuugcccuguuaccuac

SEQ ID NO: 34960 - RNA, 15 nt, Artificial Sequence
  Synthetic Oligonucleotide; NDFIP1 exon 2; Set C
ucaccuugcccuguu

SEQ ID NO: 34961 - RNA, 16 nt, Artificial Sequence
  Synthetic Oligonucleotide; NDFIP1 exon 2; Set C
aucaccuugcccuguu

SEQ ID NO: 34962 - RNA, 17 nt, Artificial Sequence
  Synthetic Oligonucleotide; NDFIP1 exon 2; Set C
gaucaccuugcccuguu

SEQ ID NO: 34963 - RNA, 18 nt, Artificial Sequence
  Synthetic Oligonucleotide; NDFIP1 exon 2; Set C
ugaucaccuugcccuguu

SEQ ID NO: 34964 - RNA, 19 nt, Artificial Sequence
  Synthetic Oligonucleotide; NDFIP1 exon 2; Set B
gugaucaccuugcccuguu

SEQ ID NO: 34965 - RNA, 18 nt, Artificial Sequence
  Synthetic Oligonucleotide; NDFIP1 exon 2; Set B
gugaucaccuugcccugu

SEQ ID NO: 34966 - RNA, 19 nt, Artificial Sequence
  Synthetic Oligonucleotide; NDFIP1 exon 2; Set B
cgugaucaccuugcccugu

SEQ ID NO: 34967 - RNA, 17 nt, Artificial Sequence
  Synthetic Oligonucleotide; NDFIP1 exon 2; Set C
gugaucaccuugcccug

SEQ ID NO: 34968 - RNA, 20 nt, Artificial Sequence
  Synthetic Oligonucleotide; NDFIP1 exon 2; Set B
ccgugaucaccuugcccugu

SEQ ID NO: 34969 - RNA, 18 nt, Artificial Sequence
  Synthetic Oligonucleotide; NDFIP1 exon 2; Set B
cgugaucaccuugcccug

SEQ ID NO: 34970 - RNA, 21 nt, Artificial Sequence
  Synthetic Oligonucleotide; NDFIP1 exon 2; Set B
uccgugaucaccuugcccugu

SEQ ID NO: 34971 - RNA, 19 nt, Artificial Sequence
  Synthetic Oligonucleotide; NDFIP1 exon 2; Set B
ccgugaucaccuugcccug

SEQ ID NO: 34972 - RNA, 22 nt, Artificial Sequence
  Synthetic Oligonucleotide; NDFIP1 exon 2; Set B
uuccgugaucaccuugcccugu

SEQ ID NO: 34973 - RNA, 20 nt, Artificial Sequence
  Synthetic Oligonucleotide; NDFIP1 exon 2; Set B
uccgugaucaccuugcccug

SEQ ID NO: 34974 - RNA, 21 nt, Artificial Sequence
  Synthetic Oligonucleotide; NDFIP1 exon 2; Set B
uuccgugaucaccuugcccug

SEQ ID NO: 34975 - RNA, 28 nt, Artificial Sequence
  Synthetic Oligonucleotide; NDFIP1 exon 2; Set C
uaaggauuccgugaucaccuugcccugu

SEQ ID NO: 34976 - RNA, 29 nt, Artificial Sequence
  Synthetic Oligonucleotide; NDFIP1 exon 2; Set C
uuaaggauuccgugaucaccuugcccugu

SEQ ID NO: 34977 - RNA, 27 nt, Artificial Sequence
  Synthetic Oligonucleotide; NDFIP1 exon 2; Set C
uaaggauuccgugaucaccuugcccug

SEQ ID NO: 34978 - RNA, 28 nt, Artificial Sequence
  Synthetic Oligonucleotide; NDFIP1 exon 2; Set C
uuaaggauuccgugaucaccuugcccug

SEQ ID NO: 34979 - RNA, 29 nt, Artificial Sequence
  Synthetic Oligonucleotide; NDFIP1 exon 2; Set C
uuuaaggauuccgugaucaccuugcccug

SEQ ID NO: 34980 - RNA, 30 nt, Artificial Sequence
  Synthetic Oligonucleotide; NDFIP1 exon 2; Set C
uuuuaaggauuccgugaucaccuugcccug

SEQ ID NO: 34981 - RNA, 31 nt, Artificial Sequence
  Synthetic Oligonucleotide; NDFIP1 exon 2; Set C
uuuuuaaggauuccgugaucaccuugcccug

SEQ ID NO: 34982 - RNA, 32 nt, Artificial Sequence
  Synthetic Oligonucleotide; NDFIP1 exon 2; Set C
guuuuuaaggauuccgugaucaccuugcccug

SEQ ID NO: 34983 - RNA, 37 nt, Artificial Sequence
  Synthetic Oligonucleotide; NDFIP1 exon 2; Set C
aguguuuuuaaggauuccgugaucaccuugcccuguu

SEQ ID NO: 34984 - RNA, 33 nt, Artificial Sequence
  Synthetic Oligonucleotide; NDFIP1 exon 2; Set C
uguuuuuaaggauuccgugaucaccuugcccug

SEQ ID NO: 34985 - RNA, 34 nt, Artificial Sequence
  Synthetic Oligonucleotide; NDFIP1 exon 2; Set C
guguuuuuaaggauuccgugaucaccuugcccug

SEQ ID NO: 34986 - RNA, 16 nt, Artificial Sequence
  Synthetic Oligonucleotide; NDFIP1 exon 2; Set C
uaaggauuccgugauc

SEQ ID NO: 34987 - RNA, 15 nt, Artificial Sequence
  Synthetic Oligonucleotide; NDFIP1 exon 2; Set C
uaaggauuccgugau

SEQ ID NO: 34988 - RNA, 26 nt, Artificial Sequence
  Synthetic Oligonucleotide; NDFIP1 exon 2; Set C
aguguuuuuaaggauuccgugaucac

SEQ ID NO: 34989 - RNA, 25 nt, Artificial Sequence
  Synthetic Oligonucleotide; NDFIP1 exon 2; Set C
aguguuuuuaaggauuccgugauca

SEQ ID NO: 34990 - RNA, 23 nt, Artificial Sequence
  Synthetic Oligonucleotide; NDFIP1 exon 2; Set C
aguguuuuuaaggauuccgugau

SEQ ID NO: 34991 - RNA, 22 nt, Artificial Sequence
  Synthetic Oligonucleotide; NDFIP1 exon 2; Set C
aguguuuuuaaggauuccguga

SEQ ID NO: 34992 - RNA, 21 nt, Artificial Sequence
  Synthetic Oligonucleotide; NDFIP1 exon 2; Set C
aguguuuuuaaggauuccgug

SEQ ID NO: 34993 - RNA, 20 nt, Artificial Sequence
  Synthetic Oligonucleotide; NDFIP1 exon 2; Set C
aguguuuuuaaggauuccgu

SEQ ID NO: 34994 - RNA, 19 nt, Artificial Sequence
  Synthetic Oligonucleotide; NDFIP1 exon 2; Set C
aguguuuuuaaggauuccg

SEQ ID NO: 34995 - RNA, 18 nt, Artificial Sequence
  Synthetic Oligonucleotide; NDFIP1 exon 2; Set C
aguguuuuuaaggauucc

SEQ ID NO: 34996 - RNA, 17 nt, Artificial Sequence
  Synthetic Oligonucleotide; NDFIP1 exon 2; Set C
aguguuuuuaaggauuc

SEQ ID NO: 34997 - RNA, 16 nt, Artificial Sequence
  Synthetic Oligonucleotide; NDFIP1 exon 2; Set C
aaagccaauuagaaag

SEQ ID NO: 34998 - RNA, 17 nt, Artificial Sequence
  Synthetic Oligonucleotide; NDFIP1 exon 2; Set C
uaaagccaauuagaaag

SEQ ID NO: 34999 - RNA, 18 nt, Artificial Sequence
  Synthetic Oligonucleotide; NDFIP1 exon 2; Set C
auaaagccaauuagaaag

SEQ ID NO: 35000 - RNA, 24 nt, Artificial Sequence
  Synthetic Oligonucleotide; NDFIP1 exon 2; Set C
guaagcauaaagccaauuagaaag

SEQ ID NO: 35001 - RNA, 25 nt, Artificial Sequence
  Synthetic Oligonucleotide; NDFIP1 exon 2; Set C
uguaagcauaaagccaauuagaaag

SEQ ID NO: 35002 - RNA, 26 nt, Artificial Sequence
  Synthetic Oligonucleotide; NDFIP1 exon 2; Set C
aauguaagcauaaagccaauuagaaa

SEQ ID NO: 35003 - RNA, 27 nt, Artificial Sequence
  Synthetic Oligonucleotide; NDFIP1 exon 2; Set C
uaauguaagcauaaagccaauuagaaa

SEQ ID NO: 35004 - RNA, 28 nt, Artificial Sequence
  Synthetic Oligonucleotide; NDFIP1 exon 2; Set C
uuaauguaagcauaaagccaauuagaaa

SEQ ID NO: 35005 - RNA, 29 nt, Artificial Sequence
  Synthetic Oligonucleotide; NDFIP1 exon 2; Set C
uuuaauguaagcauaaagccaauuagaaa

SEQ ID NO: 35006 - RNA, 30 nt, Artificial Sequence
  Synthetic Oligonucleotide; NDFIP1 exon 2; Set C
uuuuaauguaagcauaaagccaauuagaaa

SEQ ID NO: 35007 - RNA, 31 nt, Artificial Sequence
  Synthetic Oligonucleotide; NDFIP1 exon 2; Set C
auuuuaauguaagcauaaagccaauuagaaa

SEQ ID NO: 35008 - RNA, 32 nt, Artificial Sequence
  Synthetic Oligonucleotide; NDFIP1 exon 2; Set C
uauuuuaauguaagcauaaagccaauuagaaa

SEQ ID NO: 35009 - RNA, 33 nt, Artificial Sequence
  Synthetic Oligonucleotide; NDFIP1 exon 2; Set C
auauuuuaauguaagcauaaagccaauuagaaa

SEQ ID NO: 35010 - RNA, 34 nt, Artificial Sequence
  Synthetic Oligonucleotide; NDFIP1 exon 2; Set C
cauauuuuaauguaagcauaaagccaauuagaaa

SEQ ID NO: 35011 - RNA, 35 nt, Artificial Sequence
  Synthetic Oligonucleotide; NDFIP1 exon 2; Set C
ucauauuuuaauguaagcauaaagccaauuagaaa

SEQ ID NO: 35012 - RNA, 36 nt, Artificial Sequence
  Synthetic Oligonucleotide; NDFIP1 exon 2; Set C
uucauauuuuaauguaagcauaaagccaauuagaaa

SEQ ID NO: 35013 - RNA, 39 nt, Artificial Sequence
  Synthetic Oligonucleotide; NDFIP1 exon 2; Set C
auuucauauuuuaauguaagcauaaagccaauuagaaag

SEQ ID NO: 35014 - RNA, 37 nt, Artificial Sequence
  Synthetic Oligonucleotide; NDFIP1 exon 2; Set C
uuucauauuuuaauguaagcauaaagccaauuagaaa

SEQ ID NO: 35015 - RNA, 34 nt, Artificial Sequence
  Synthetic Oligonucleotide; NDFIP1 exon 2; Set C
aauuucauauuuuaauguaagcauaaagccaauu

SEQ ID NO: 35016 - RNA, 33 nt, Artificial Sequence
  Synthetic Oligonucleotide; NDFIP1 exon 2; Set C
aauuucauauuuuaauguaagcauaaagccaau

SEQ ID NO: 35017 - RNA, 35 nt, Artificial Sequence
  Synthetic Oligonucleotide; NDFIP1 exon 2; Set C
aaauuucauauuuuaauguaagcauaaagccaauu

SEQ ID NO: 35018 - RNA, 34 nt, Artificial Sequence
  Synthetic Oligonucleotide; NDFIP1 exon 2; Set C
aaauuucauauuuuaauguaagcauaaagccaau

SEQ ID NO: 35019 - RNA, 36 nt, Artificial Sequence
  Synthetic Oligonucleotide; NDFIP1 exon 2; Set C
aaaauuucauauuuuaauguaagcauaaagccaauu

SEQ ID NO: 35020 - RNA, 35 nt, Artificial Sequence
  Synthetic Oligonucleotide; NDFIP1 exon 2; Set C
aaaauuucauauuuuaauguaagcauaaagccaau

SEQ ID NO: 35021 - RNA, 15 nt, Artificial Sequence
  Synthetic Oligonucleotide; NDFIP1 exon 2; Set C
cauauuuuaauguaa

SEQ ID NO: 35022 - RNA, 30 nt, Artificial Sequence
  Synthetic Oligonucleotide; NDFIP1 exon 2; Set C
aaaaauuucauauuuuaauguaagcauaaa

SEQ ID NO: 35023 - RNA, 16 nt, Artificial Sequence
  Synthetic Oligonucleotide; NDFIP1 exon 2; Set C
ucauauuuuaauguaa

SEQ ID NO: 35024 - RNA, 29 nt, Artificial Sequence
  Synthetic Oligonucleotide; NDFIP1 exon 2; Set C
aaaaauuucauauuuuaauguaagcauaa

SEQ ID NO: 35025 - RNA, 31 nt, Artificial Sequence
  Synthetic Oligonucleotide; NDFIP1 exon 2; Set C
uaaaaauuucauauuuuaauguaagcauaaa

SEQ ID NO: 35026 - RNA, 17 nt, Artificial Sequence
  Synthetic Oligonucleotide; NDFIP1 exon 2; Set C
uucauauuuuaauguaa

SEQ ID NO: 35027 - RNA, 30 nt, Artificial Sequence
  Synthetic Oligonucleotide; NDFIP1 exon 2; Set C
uaaaaauuucauauuuuaauguaagcauaa

SEQ ID NO: 35028 - RNA, 28 nt, Artificial Sequence
  Synthetic Oligonucleotide; NDFIP1 exon 2; Set C
aaaaauuucauauuuuaauguaagcaua

SEQ ID NO: 35029 - RNA, 32 nt, Artificial Sequence
  Synthetic Oligonucleotide; NDFIP1 exon 2; Set C
auaaaaauuucauauuuuaauguaagcauaaa

SEQ ID NO: 35030 - RNA, 18 nt, Artificial Sequence
  Synthetic Oligonucleotide; NDFIP1 exon 2; Set C
uuucauauuuuaauguaa

SEQ ID NO: 35031 - RNA, 31 nt, Artificial Sequence
  Synthetic Oligonucleotide; NDFIP1 exon 2; Set C
auaaaaauuucauauuuuaauguaagcauaa

SEQ ID NO: 35032 - RNA, 29 nt, Artificial Sequence
  Synthetic Oligonucleotide; NDFIP1 exon 2; Set C
uaaaaauuucauauuuuaauguaagcaua

SEQ ID NO: 35033 - RNA, 33 nt, Artificial Sequence
  Synthetic Oligonucleotide; NDFIP1 exon 2; Set C
aauaaaaauuucauauuuuaauguaagcauaaa

SEQ ID NO: 35034 - RNA, 19 nt, Artificial Sequence
  Synthetic Oligonucleotide; NDFIP1 exon 2; Set C
auuucauauuuuaauguaa

SEQ ID NO: 35035 - RNA, 32 nt, Artificial Sequence
  Synthetic Oligonucleotide; NDFIP1 exon 2; Set C
aauaaaaauuucauauuuuaauguaagcauaa

SEQ ID NO: 35036 - RNA, 30 nt, Artificial Sequence
  Synthetic Oligonucleotide; NDFIP1 exon 2; Set C
auaaaaauuucauauuuuaauguaagcaua

SEQ ID NO: 35037 - RNA, 31 nt, Artificial Sequence
  Synthetic Oligonucleotide; NDFIP1 exon 2; Set C
aauaaaaauuucauauuuuaauguaagcaua

SEQ ID NO: 35038 - RNA, 22 nt, Artificial Sequence
  Synthetic Oligonucleotide; NDFIP1 exon 2; Set C
aaaaauuucauauuuuaaugua

SEQ ID NO: 35039 - RNA, 21 nt, Artificial Sequence
  Synthetic Oligonucleotide; NDFIP1 exon 2; Set C
aaaaauuucauauuuuaaugu

SEQ ID NO: 35040 - RNA, 23 nt, Artificial Sequence
  Synthetic Oligonucleotide; NDFIP1 exon 2; Set C
uaaaaauuucauauuuuaaugua

SEQ ID NO: 35041 - RNA, 20 nt, Artificial Sequence
  Synthetic Oligonucleotide; NDFIP1 exon 2; Set C
aaaaauuucauauuuuaaug

SEQ ID NO: 35042 - RNA, 22 nt, Artificial Sequence
  Synthetic Oligonucleotide; NDFIP1 exon 2; Set C
uaaaaauuucauauuuuaaugu

SEQ ID NO: 35043 - RNA, 24 nt, Artificial Sequence
  Synthetic Oligonucleotide; NDFIP1 exon 2; Set C
auaaaaauuucauauuuuaaugua

SEQ ID NO: 35044 - RNA, 19 nt, Artificial Sequence
  Synthetic Oligonucleotide; NDFIP1 exon 2; Set C
aaaaauuucauauuuuaau

SEQ ID NO: 35045 - RNA, 21 nt, Artificial Sequence
  Synthetic Oligonucleotide; NDFIP1 exon 2; Set C
uaaaaauuucauauuuuaaug

SEQ ID NO: 35046 - RNA, 23 nt, Artificial Sequence
  Synthetic Oligonucleotide; NDFIP1 exon 2; Set C
auaaaaauuucauauuuuaaugu

SEQ ID NO: 35047 - RNA, 25 nt, Artificial Sequence
  Synthetic Oligonucleotide; NDFIP1 exon 2; Set C
aauaaaaauuucauauuuuaaugua

SEQ ID NO: 35048 - RNA, 27 nt, Artificial Sequence
  Synthetic Oligonucleotide; NDFIP1 exon 2; Set C
aaauaaaaauuucauauuuuaauguaa

SEQ ID NO: 35049 - RNA, 18 nt, Artificial Sequence
  Synthetic Oligonucleotide; NDFIP1 exon 2; Set C
aaaaauuucauauuuuaa

SEQ ID NO: 35050 - RNA, 20 nt, Artificial Sequence
  Synthetic Oligonucleotide; NDFIP1 exon 2; Set C
uaaaaauuucauauuuuaau

SEQ ID NO: 35051 - RNA, 24 nt, Artificial Sequence
  Synthetic Oligonucleotide; NDFIP1 exon 2; Set C
aauaaaaauuucauauuuuaaugu

SEQ ID NO: 35052 - RNA, 22 nt, Artificial Sequence
  Synthetic Oligonucleotide; NDFIP1 exon 2; Set C
auaaaaauuucauauuuuaaug

SEQ ID NO: 35053 - RNA, 28 nt, Artificial Sequence
  Synthetic Oligonucleotide; NDFIP1 exon 2; Set C
uaaauaaaaauuucauauuuuaauguaa

SEQ ID NO: 35054 - RNA, 19 nt, Artificial Sequence
  Synthetic Oligonucleotide; NDFIP1 exon 2; Set C
uaaaaauuucauauuuuaa

SEQ ID NO: 35055 - RNA, 21 nt, Artificial Sequence
  Synthetic Oligonucleotide; NDFIP1 exon 2; Set C
auaaaaauuucauauuuuaau

SEQ ID NO: 35056 - RNA, 17 nt, Artificial Sequence
  Synthetic Oligonucleotide; NDFIP1 exon 2; Set C
aaaaauuucauauuuua

SEQ ID NO: 35057 - RNA, 23 nt, Artificial Sequence
  Synthetic Oligonucleotide; NDFIP1 exon 2; Set C
aauaaaaauuucauauuuuaaug

SEQ ID NO: 35058 - RNA, 29 nt, Artificial Sequence
  Synthetic Oligonucleotide; NDFIP1 exon 2; Set C
cuaaauaaaaauuucauauuuuaauguaa

SEQ ID NO: 35059 - RNA, 22 nt, Artificial Sequence
  Synthetic Oligonucleotide; NDFIP1 exon 2; Set C
aauaaaaauuucauauuuuaau

SEQ ID NO: 35060 - RNA, 20 nt, Artificial Sequence
  Synthetic Oligonucleotide; NDFIP1 exon 2; Set C
auaaaaauuucauauuuuaa

SEQ ID NO: 35061 - RNA, 18 nt, Artificial Sequence
  Synthetic Oligonucleotide; NDFIP1 exon 2; Set C
uaaaaauuucauauuuua

SEQ ID NO: 35062 - RNA, 16 nt, Artificial Sequence
  Synthetic Oligonucleotide; NDFIP1 exon 2; Set C
aaaaauuucauauuuu

SEQ ID NO: 35063 - RNA, 30 nt, Artificial Sequence
  Synthetic Oligonucleotide; NDFIP1 exon 2; Set C
acuaaauaaaaauuucauauuuuaauguaa

SEQ ID NO: 35064 - RNA, 21 nt, Artificial Sequence
  Synthetic Oligonucleotide; NDFIP1 exon 2; Set C
aauaaaaauuucauauuuuaa

SEQ ID NO: 35065 - RNA, 19 nt, Artificial Sequence
  Synthetic Oligonucleotide; NDFIP1 exon 2; Set C
auaaaaauuucauauuuua

SEQ ID NO: 35066 - RNA, 15 nt, Artificial Sequence
  Synthetic Oligonucleotide; NDFIP1 exon 2; Set C
aaaaauuucauauuu

SEQ ID NO: 35067 - RNA, 17 nt, Artificial Sequence
  Synthetic Oligonucleotide; NDFIP1 exon 2; Set C
uaaaaauuucauauuuu

SEQ ID NO: 35068 - RNA, 31 nt, Artificial Sequence
  Synthetic Oligonucleotide; NDFIP1 exon 2; Set C
aacuaaauaaaaauuucauauuuuaauguaa

SEQ ID NO: 35069 - RNA, 20 nt, Artificial Sequence
  Synthetic Oligonucleotide; NDFIP1 exon 2; Set C
aauaaaaauuucauauuuua

SEQ ID NO: 35070 - RNA, 16 nt, Artificial Sequence
  Synthetic Oligonucleotide; NDFIP1 exon 2; Set C
uaaaaauuucauauuu

SEQ ID NO: 35071 - RNA, 18 nt, Artificial Sequence
  Synthetic Oligonucleotide; NDFIP1 exon 2; Set C
auaaaaauuucauauuuu

SEQ ID NO: 35072 - RNA, 32 nt, Artificial Sequence
  Synthetic Oligonucleotide; NDFIP1 exon 2; Set C
caacuaaauaaaaauuucauauuuuaauguaa

SEQ ID NO: 35073 - RNA, 19 nt, Artificial Sequence
  Synthetic Oligonucleotide; NDFIP1 exon 2; Set C
aauaaaaauuucauauuuu

SEQ ID NO: 35074 - RNA, 15 nt, Artificial Sequence
  Synthetic Oligonucleotide; NDFIP1 exon 2; Set C
uaaaaauuucauauu

SEQ ID NO: 35075 - RNA, 17 nt, Artificial Sequence
  Synthetic Oligonucleotide; NDFIP1 exon 2; Set C
auaaaaauuucauauuu

SEQ ID NO: 35076 - RNA, 33 nt, Artificial Sequence
  Synthetic Oligonucleotide; NDFIP1 exon 2; Set C
gcaacuaaauaaaaauuucauauuuuaauguaa

SEQ ID NO: 35077 - RNA, 18 nt, Artificial Sequence
  Synthetic Oligonucleotide; NDFIP1 exon 2; Set C
aauaaaaauuucauauuu

SEQ ID NO: 35078 - RNA, 16 nt, Artificial Sequence
  Synthetic Oligonucleotide; NDFIP1 exon 2; Set C
auaaaaauuucauauu

SEQ ID NO: 35079 - RNA, 34 nt, Artificial Sequence
  Synthetic Oligonucleotide; NDFIP1 exon 2; Set C
ugcaacuaaauaaaaauuucauauuuuaauguaa

SEQ ID NO: 35080 - RNA, 17 nt, Artificial Sequence
  Synthetic Oligonucleotide; NDFIP1 exon 2; Set C
aauaaaaauuucauauu

SEQ ID NO: 35081 - RNA, 15 nt, Artificial Sequence
  Synthetic Oligonucleotide; NDFIP1 exon 2; Set C
auaaaaauuucauau

SEQ ID NO: 35082 - RNA, 16 nt, Artificial Sequence
  Synthetic Oligonucleotide; NDFIP1 exon 2; Set C
aauaaaaauuucauau

SEQ ID NO: 35083 - RNA, 15 nt, Artificial Sequence
  Synthetic Oligonucleotide; NDFIP1 exon 2; Set C
aauaaaaauuucaua

SEQ ID NO: 35084 - RNA, 37 nt, Artificial Sequence
  Synthetic Oligonucleotide; NDFIP1 exon 2; Set C
auucugcaacuaaauaaaaauuucauauuuuaaugua

SEQ ID NO: 35085 - RNA, 36 nt, Artificial Sequence
  Synthetic Oligonucleotide; NDFIP1 exon 2; Set C
auucugcaacuaaauaaaaauuucauauuuuaaugu

SEQ ID NO: 35086 - RNA, 38 nt, Artificial Sequence
  Synthetic Oligonucleotide; NDFIP1 exon 2; Set C
cauucugcaacuaaauaaaaauuucauauuuuaaugua

SEQ ID NO: 35087 - RNA, 37 nt, Artificial Sequence
  Synthetic Oligonucleotide; NDFIP1 exon 2; Set C
cauucugcaacuaaauaaaaauuucauauuuuaaugu

SEQ ID NO: 35088 - RNA, 35 nt, Artificial Sequence
  Synthetic Oligonucleotide; NDFIP1 exon 2; Set C
auucugcaacuaaauaaaaauuucauauuuuaaug

SEQ ID NO: 35089 - RNA, 39 nt, Artificial Sequence
  Synthetic Oligonucleotide; NDFIP1 exon 2; Set C
ucauucugcaacuaaauaaaaauuucauauuuuaaugua

SEQ ID NO: 35090 - RNA, 34 nt, Artificial Sequence
  Synthetic Oligonucleotide; NDFIP1 exon 2; Set C
auucugcaacuaaauaaaaauuucauauuuuaau

SEQ ID NO: 35091 - RNA, 36 nt, Artificial Sequence
  Synthetic Oligonucleotide; NDFIP1 exon 2; Set C
cauucugcaacuaaauaaaaauuucauauuuuaaug

SEQ ID NO: 35092 - RNA, 38 nt, Artificial Sequence
  Synthetic Oligonucleotide; NDFIP1 exon 2; Set C
ucauucugcaacuaaauaaaaauuucauauuuuaaugu

SEQ ID NO: 35093 - RNA, 35 nt, Artificial Sequence
  Synthetic Oligonucleotide; NDFIP1 exon 2; Set C
cauucugcaacuaaauaaaaauuucauauuuuaau

SEQ ID NO: 35094 - RNA, 33 nt, Artificial Sequence
  Synthetic Oligonucleotide; NDFIP1 exon 2; Set C
auucugcaacuaaauaaaaauuucauauuuuaa

SEQ ID NO: 35095 - RNA, 37 nt, Artificial Sequence
  Synthetic Oligonucleotide; NDFIP1 exon 2; Set C
ucauucugcaacuaaauaaaaauuucauauuuuaaug

SEQ ID NO: 35096 - RNA, 34 nt, Artificial Sequence
  Synthetic Oligonucleotide; NDFIP1 exon 2; Set C
cauucugcaacuaaauaaaaauuucauauuuuaa

SEQ ID NO: 35097 - RNA, 36 nt, Artificial Sequence
  Synthetic Oligonucleotide; NDFIP1 exon 2; Set C
ucauucugcaacuaaauaaaaauuucauauuuuaau

SEQ ID NO: 35098 - RNA, 32 nt, Artificial Sequence
  Synthetic Oligonucleotide; NDFIP1 exon 2; Set C
auucugcaacuaaauaaaaauuucauauuuua

SEQ ID NO: 35099 - RNA, 35 nt, Artificial Sequence
  Synthetic Oligonucleotide; NDFIP1 exon 2; Set C
ucauucugcaacuaaauaaaaauuucauauuuuaa

SEQ ID NO: 35100 - RNA, 33 nt, Artificial Sequence
  Synthetic Oligonucleotide; NDFIP1 exon 2; Set C
cauucugcaacuaaauaaaaauuucauauuuua

SEQ ID NO: 35101 - RNA, 31 nt, Artificial Sequence
  Synthetic Oligonucleotide; NDFIP1 exon 2; Set C
auucugcaacuaaauaaaaauuucauauuuu

SEQ ID NO: 35102 - RNA, 34 nt, Artificial Sequence
  Synthetic Oligonucleotide; NDFIP1 exon 2; Set C
ucauucugcaacuaaauaaaaauuucauauuuua

SEQ ID NO: 35103 - RNA, 32 nt, Artificial Sequence
  Synthetic Oligonucleotide; NDFIP1 exon 2; Set C
cauucugcaacuaaauaaaaauuucauauuuu

SEQ ID NO: 35104 - RNA, 30 nt, Artificial Sequence
  Synthetic Oligonucleotide; NDFIP1 exon 2; Set C
auucugcaacuaaauaaaaauuucauauuu

SEQ ID NO: 35105 - RNA, 31 nt, Artificial Sequence
  Synthetic Oligonucleotide; NDFIP1 exon 2; Set C
cauucugcaacuaaauaaaaauuucauauuu

SEQ ID NO: 35106 - RNA, 29 nt, Artificial Sequence
  Synthetic Oligonucleotide; NDFIP1 exon 2; Set C
auucugcaacuaaauaaaaauuucauauu

SEQ ID NO: 35107 - RNA, 33 nt, Artificial Sequence
  Synthetic Oligonucleotide; NDFIP1 exon 2; Set C
ucauucugcaacuaaauaaaaauuucauauuuu

SEQ ID NO: 35108 - RNA, 30 nt, Artificial Sequence
  Synthetic Oligonucleotide; NDFIP1 exon 2; Set C
cauucugcaacuaaauaaaaauuucauauu

SEQ ID NO: 35109 - RNA, 28 nt, Artificial Sequence
  Synthetic Oligonucleotide; NDFIP1 exon 2; Set C
auucugcaacuaaauaaaaauuucauau

SEQ ID NO: 35110 - RNA, 32 nt, Artificial Sequence
  Synthetic Oligonucleotide; NDFIP1 exon 2; Set C
ucauucugcaacuaaauaaaaauuucauauuu

SEQ ID NO: 35111 - RNA, 27 nt, Artificial Sequence
  Synthetic Oligonucleotide; NDFIP1 exon 2; Set C
auucugcaacuaaauaaaaauuucaua

SEQ ID NO: 35112 - RNA, 29 nt, Artificial Sequence
  Synthetic Oligonucleotide; NDFIP1 exon 2; Set C
cauucugcaacuaaauaaaaauuucauau

SEQ ID NO: 35113 - RNA, 31 nt, Artificial Sequence
  Synthetic Oligonucleotide; NDFIP1 exon 2; Set C
ucauucugcaacuaaauaaaaauuucauauu

SEQ ID NO: 35114 - RNA, 26 nt, Artificial Sequence
  Synthetic Oligonucleotide; NDFIP1 exon 2; Set C
auucugcaacuaaauaaaaauuucau

SEQ ID NO: 35115 - RNA, 28 nt, Artificial Sequence
  Synthetic Oligonucleotide; NDFIP1 exon 2; Set C
cauucugcaacuaaauaaaaauuucaua

SEQ ID NO: 35116 - RNA, 30 nt, Artificial Sequence
  Synthetic Oligonucleotide; NDFIP1 exon 2; Set C
ucauucugcaacuaaauaaaaauuucauau

SEQ ID NO: 35117 - RNA, 27 nt, Artificial Sequence
  Synthetic Oligonucleotide; NDFIP1 exon 2; Set C
cauucugcaacuaaauaaaaauuucau

SEQ ID NO: 35118 - RNA, 25 nt, Artificial Sequence
  Synthetic Oligonucleotide; NDFIP1 exon 2; Set C
auucugcaacuaaauaaaaauuuca

SEQ ID NO: 35119 - RNA, 29 nt, Artificial Sequence
  Synthetic Oligonucleotide; NDFIP1 exon 2; Set C
ucauucugcaacuaaauaaaaauuucaua

SEQ ID NO: 35120 - RNA, 15 nt, Artificial Sequence
  Synthetic Oligonucleotide; NDFIP1 exon 2; Set C
gcaacuaaauaaaaa

SEQ ID NO: 35121 - RNA, 28 nt, Artificial Sequence
  Synthetic Oligonucleotide; NDFIP1 exon 2; Set C
ucauucugcaacuaaauaaaaauuucau

SEQ ID NO: 35122 - RNA, 26 nt, Artificial Sequence
  Synthetic Oligonucleotide; NDFIP1 exon 2; Set C
cauucugcaacuaaauaaaaauuuca

SEQ ID NO: 35123 - RNA, 24 nt, Artificial Sequence
  Synthetic Oligonucleotide; NDFIP1 exon 2; Set C
auucugcaacuaaauaaaaauuuc

SEQ ID NO: 35124 - RNA, 16 nt, Artificial Sequence
  Synthetic Oligonucleotide; NDFIP1 exon 2; Set C
ugcaacuaaauaaaaa

SEQ ID NO: 35125 - RNA, 27 nt, Artificial Sequence
  Synthetic Oligonucleotide; NDFIP1 exon 2; Set C
ucauucugcaacuaaauaaaaauuuca

SEQ ID NO: 35126 - RNA, 25 nt, Artificial Sequence
  Synthetic Oligonucleotide; NDFIP1 exon 2; Set C
cauucugcaacuaaauaaaaauuuc

SEQ ID NO: 35127 - RNA, 23 nt, Artificial Sequence
  Synthetic Oligonucleotide; NDFIP1 exon 2; Set C
auucugcaacuaaauaaaaauuu

SEQ ID NO: 35128 - RNA, 24 nt, Artificial Sequence
  Synthetic Oligonucleotide; NDFIP1 exon 2; Set C
cauucugcaacuaaauaaaaauuu

SEQ ID NO: 35129 - RNA, 26 nt, Artificial Sequence
  Synthetic Oligonucleotide; NDFIP1 exon 2; Set C
ucauucugcaacuaaauaaaaauuuc

SEQ ID NO: 35130 - RNA, 33 nt, Artificial Sequence
  Synthetic Oligonucleotide; NDFIP1 exon 2; Set C
agacucuucuucauucugcaacuaaauaaaaau

SEQ ID NO: 35131 - RNA, 34 nt, Artificial Sequence
  Synthetic Oligonucleotide; NDFIP1 exon 2; Set C
cagacucuucuucauucugcaacuaaauaaaaau

SEQ ID NO: 35132 - RNA, 31 nt, Artificial Sequence
  Synthetic Oligonucleotide; NDFIP1 exon 2; Set C
agacucuucuucauucugcaacuaaauaaaa

SEQ ID NO: 35133 - RNA, 32 nt, Artificial Sequence
  Synthetic Oligonucleotide; NDFIP1 exon 2; Set C
cagacucuucuucauucugcaacuaaauaaaa

SEQ ID NO: 35134 - RNA, 38 nt, Artificial Sequence
  Synthetic Oligonucleotide; NDFIP1 exon 2; Set C
ggaggagcaucaccugcagccuguucagguucuccaga

SEQ ID NO: 35135 - RNA, 37 nt, Artificial Sequence
  Synthetic Oligonucleotide; NDFIP1 exon 2; Set C
ggaggagcaucaccugcagccuguucagguucuccag

SEQ ID NO: 35136 - RNA, 24 nt, Artificial Sequence
  Synthetic Oligonucleotide; NDFIP1 exon 2; Set C
ggaggagcaucaccugcagccugu

SEQ ID NO: 35137 - RNA, 23 nt, Artificial Sequence
  Synthetic Oligonucleotide; NDFIP1 exon 2; Set C
ggaggagcaucaccugcagccug

SEQ ID NO: 35138 - RNA, 15 nt, Artificial Sequence
  Synthetic Oligonucleotide; NDFIP1 exon 2; Set C
aggagcaucaccugc

SEQ ID NO: 35139 - RNA, 16 nt, Artificial Sequence
  Synthetic Oligonucleotide; NDFIP1 exon 2; Set C
gaggagcaucaccugc

SEQ ID NO: 35140 - RNA, 23 nt, Artificial Sequence
  Synthetic Oligonucleotide; NDFIP1 exon 2; Set A
uaagguggaggagcaucaccugc

SEQ ID NO: 35141 - RNA, 24 nt, Artificial Sequence
  Synthetic Oligonucleotide; NDFIP1 exon 2; Set A
guaagguggaggagcaucaccugc

SEQ ID NO: 35142 - RNA, 25 nt, Artificial Sequence
  Synthetic Oligonucleotide; NDFIP1 exon 2; Set C
uguaagguggaggagcaucaccugc

SEQ ID NO: 35143 - RNA, 18 nt, Artificial Sequence
  Synthetic Oligonucleotide; NDFIP1 exon 2; Set C
uaagguggaggagcauca

SEQ ID NO: 35144 - RNA, 28 nt, Artificial Sequence
  Synthetic Oligonucleotide; NDFIP1 exon 2; Set C
aaugcugcuguaagguggaggagcauca

SEQ ID NO: 35145 - RNA, 27 nt, Artificial Sequence
  Synthetic Oligonucleotide; NDFIP1 exon 2; Set A
aaugcugcuguaagguggaggagcauc

SEQ ID NO: 35146 - RNA, 27 nt, Artificial Sequence
  Synthetic Oligonucleotide; NDFIP1 exon 2; Set A
aaaugcugcuguaagguggaggagcau

SEQ ID NO: 35147 - RNA, 26 nt, Artificial Sequence
  Synthetic Oligonucleotide; NDFIP1 exon 2; Set A
aaaugcugcuguaagguggaggagca

SEQ ID NO: 35148 - RNA, 25 nt, Artificial Sequence
  Synthetic Oligonucleotide; NDFIP1 exon 2; Set A
aaaugcugcuguaagguggaggagc

SEQ ID NO: 35149 - RNA, 24 nt, Artificial Sequence
  Synthetic Oligonucleotide; NDFIP1 exon 2; Set A
aaaugcugcuguaagguggaggag

SEQ ID NO: 35150 - RNA, 36 nt, Artificial Sequence
  Synthetic Oligonucleotide; NDFIP1 exon 2; Set C
ucugcagaaaugcugcuguaagguggaggagcauca

SEQ ID NO: 35151 - RNA, 35 nt, Artificial Sequence
  Synthetic Oligonucleotide; NDFIP1 exon 2; Set C
ucugcagaaaugcugcuguaagguggaggagcauc

SEQ ID NO: 35152 - RNA, 27 nt, Artificial Sequence
  Synthetic Oligonucleotide; NDFIP1 exon 2; Set A
ucugcagaaaugcugcuguaaggugga

SEQ ID NO: 35153 - RNA, 38 nt, Artificial Sequence
  Synthetic Oligonucleotide; NDFIP1 exon 2; Set C
uaccugcgcucucugcagaaaugcugcuguaaggugga

SEQ ID NO: 35154 - RNA, 15 nt, Artificial Sequence
  Synthetic Oligonucleotide; NDFIP1 exon 2; Set C
gcucucugcagaaau

SEQ ID NO: 35155 - RNA, 16 nt, Artificial Sequence
  Synthetic Oligonucleotide; NDFIP1 exon 2; Set C
cgcucucugcagaaau

SEQ ID NO: 35156 - RNA, 29 nt, Artificial Sequence
  Synthetic Oligonucleotide; NDFIP1 exon 2; Set C
uguuaccuaccugcgcucucugcagaaau

SEQ ID NO: 35157 - RNA, 30 nt, Artificial Sequence
  Synthetic Oligonucleotide; NDFIP1 exon 2; Set C
cuguuaccuaccugcgcucucugcagaaau

SEQ ID NO: 35158 - RNA, 20 nt, Artificial Sequence
  Synthetic Oligonucleotide; NDFIP1 exon 2; Set B
uguuaccuaccugcgcucuc

SEQ ID NO: 35159 - RNA, 18 nt, Artificial Sequence
  Synthetic Oligonucleotide; NDFIP1 exon 2; Set B
guuaccuaccugcgcucu

SEQ ID NO: 35160 - RNA, 39 nt, Artificial Sequence
  Synthetic Oligonucleotide; NDFIP1 exon 2; Set C
caccuugcccuguuaccuaccugcgcucucugcagaaau

SEQ ID NO: 35161 - RNA, 21 nt, Artificial Sequence
  Synthetic Oligonucleotide; NDFIP1 exon 2; Set B
cuguuaccuaccugcgcucuc

SEQ ID NO: 35162 - RNA, 19 nt, Artificial Sequence
  Synthetic Oligonucleotide; NDFIP1 exon 2; Set B
uguuaccuaccugcgcucu

SEQ ID NO: 35163 - RNA, 17 nt, Artificial Sequence
  Synthetic Oligonucleotide; NDFIP1 exon 2; Set B
guuaccuaccugcgcuc

SEQ ID NO: 35164 - RNA, 20 nt, Artificial Sequence
  Synthetic Oligonucleotide; NDFIP1 exon 2; Set B
cuguuaccuaccugcgcucu

SEQ ID NO: 35165 - RNA, 18 nt, Artificial Sequence
  Synthetic Oligonucleotide; NDFIP1 exon 2; Set B
uguuaccuaccugcgcuc

SEQ ID NO: 35166 - RNA, 16 nt, Artificial Sequence
  Synthetic Oligonucleotide; NDFIP1 exon 2; Set C
guuaccuaccugcgcu

SEQ ID NO: 35167 - RNA, 19 nt, Artificial Sequence
  Synthetic Oligonucleotide; NDFIP1 exon 2; Set B
cuguuaccuaccugcgcuc

SEQ ID NO: 35168 - RNA, 15 nt, Artificial Sequence
  Synthetic Oligonucleotide; NDFIP1 exon 2; Set C
guuaccuaccugcgc

SEQ ID NO: 35169 - RNA, 17 nt, Artificial Sequence
  Synthetic Oligonucleotide; NDFIP1 exon 2; Set B
uguuaccuaccugcgcu

SEQ ID NO: 35170 - RNA, 16 nt, Artificial Sequence
  Synthetic Oligonucleotide; NDFIP1 exon 2; Set C
uguuaccuaccugcgc

SEQ ID NO: 35171 - RNA, 18 nt, Artificial Sequence
  Synthetic Oligonucleotide; NDFIP1 exon 2; Set B
cuguuaccuaccugcgcu

SEQ ID NO: 35172 - RNA, 17 nt, Artificial Sequence
  Synthetic Oligonucleotide; NDFIP1 exon 2; Set C
cuguuaccuaccugcgc

SEQ ID NO: 35173 - RNA, 30 nt, Artificial Sequence
  Synthetic Oligonucleotide; NDFIP1 exon 2; Set C
caccuugcccuguuaccuaccugcgcucuc

SEQ ID NO: 35174 - RNA, 29 nt, Artificial Sequence
  Synthetic Oligonucleotide; NDFIP1 exon 2; Set C
caccuugcccuguuaccuaccugcgcucu

SEQ ID NO: 35175 - RNA, 32 nt, Artificial Sequence
  Synthetic Oligonucleotide; NDFIP1 exon 2; Set C
aucaccuugcccuguuaccuaccugcgcucuc

SEQ ID NO: 35176 - RNA, 30 nt, Artificial Sequence
  Synthetic Oligonucleotide; NDFIP1 exon 2; Set C
ucaccuugcccuguuaccuaccugcgcucu

SEQ ID NO: 35177 - RNA, 28 nt, Artificial Sequence
  Synthetic Oligonucleotide; NDFIP1 exon 2; Set C
caccuugcccuguuaccuaccugcgcuc

SEQ ID NO: 35178 - RNA, 33 nt, Artificial Sequence
  Synthetic Oligonucleotide; NDFIP1 exon 2; Set C
gaucaccuugcccuguuaccuaccugcgcucuc

SEQ ID NO: 35179 - RNA, 31 nt, Artificial Sequence
  Synthetic Oligonucleotide; NDFIP1 exon 2; Set C
aucaccuugcccuguuaccuaccugcgcucu

SEQ ID NO: 35180 - RNA, 29 nt, Artificial Sequence
  Synthetic Oligonucleotide; NDFIP1 exon 2; Set C
ucaccuugcccuguuaccuaccugcgcuc

SEQ ID NO: 35181 - RNA, 27 nt, Artificial Sequence
  Synthetic Oligonucleotide; NDFIP1 exon 2; Set C
caccuugcccuguuaccuaccugcgcu

SEQ ID NO: 35182 - RNA, 34 nt, Artificial Sequence
  Synthetic Oligonucleotide; NDFIP1 exon 2; Set C
ugaucaccuugcccuguuaccuaccugcgcucuc

SEQ ID NO: 35183 - RNA, 32 nt, Artificial Sequence
  Synthetic Oligonucleotide; NDFIP1 exon 2; Set C
gaucaccuugcccuguuaccuaccugcgcucu

SEQ ID NO: 35184 - RNA, 30 nt, Artificial Sequence
  Synthetic Oligonucleotide; NDFIP1 exon 2; Set C
aucaccuugcccuguuaccuaccugcgcuc

SEQ ID NO: 35185 - RNA, 28 nt, Artificial Sequence
  Synthetic Oligonucleotide; NDFIP1 exon 2; Set C
ucaccuugcccuguuaccuaccugcgcu

SEQ ID NO: 35186 - RNA, 26 nt, Artificial Sequence
  Synthetic Oligonucleotide; NDFIP1 exon 2; Set C
caccuugcccuguuaccuaccugcgc

SEQ ID NO: 35187 - RNA, 33 nt, Artificial Sequence
  Synthetic Oligonucleotide; NDFIP1 exon 2; Set C
ugaucaccuugcccuguuaccuaccugcgcucu

SEQ ID NO: 35188 - RNA, 31 nt, Artificial Sequence
  Synthetic Oligonucleotide; NDFIP1 exon 2; Set C
gaucaccuugcccuguuaccuaccugcgcuc

SEQ ID NO: 35189 - RNA, 27 nt, Artificial Sequence
  Synthetic Oligonucleotide; NDFIP1 exon 2; Set C
ucaccuugcccuguuaccuaccugcgc

SEQ ID NO: 35190 - RNA, 29 nt, Artificial Sequence
  Synthetic Oligonucleotide; NDFIP1 exon 2; Set C
aucaccuugcccuguuaccuaccugcgcu

SEQ ID NO: 35191 - RNA, 34 nt, Artificial Sequence
  Synthetic Oligonucleotide; NDFIP1 exon 2; Set C
gugaucaccuugcccuguuaccuaccugcgcucu

SEQ ID NO: 35192 - RNA, 32 nt, Artificial Sequence
  Synthetic Oligonucleotide; NDFIP1 exon 2; Set C
ugaucaccuugcccuguuaccuaccugcgcuc

SEQ ID NO: 35193 - RNA, 30 nt, Artificial Sequence
  Synthetic Oligonucleotide; NDFIP1 exon 2; Set C
gaucaccuugcccuguuaccuaccugcgcu

SEQ ID NO: 35194 - RNA, 28 nt, Artificial Sequence
  Synthetic Oligonucleotide; NDFIP1 exon 2; Set C
aucaccuugcccuguuaccuaccugcgc

SEQ ID NO: 35195 - RNA, 33 nt, Artificial Sequence
  Synthetic Oligonucleotide; NDFIP1 exon 2; Set C
gugaucaccuugcccuguuaccuaccugcgcuc

SEQ ID NO: 35196 - RNA, 29 nt, Artificial Sequence
  Synthetic Oligonucleotide; NDFIP1 exon 2; Set C
gaucaccuugcccuguuaccuaccugcgc

SEQ ID NO: 35197 - RNA, 31 nt, Artificial Sequence
  Synthetic Oligonucleotide; NDFIP1 exon 2; Set C
ugaucaccuugcccuguuaccuaccugcgcu

SEQ ID NO: 35198 - RNA, 32 nt, Artificial Sequence
  Synthetic Oligonucleotide; NDFIP1 exon 2; Set C
gugaucaccuugcccuguuaccuaccugcgcu

SEQ ID NO: 35199 - RNA, 30 nt, Artificial Sequence
  Synthetic Oligonucleotide; NDFIP1 exon 2; Set C
ugaucaccuugcccuguuaccuaccugcgc

SEQ ID NO: 35200 - RNA, 31 nt, Artificial Sequence
  Synthetic Oligonucleotide; NDFIP1 exon 2; Set C
gugaucaccuugcccuguuaccuaccugcgc

SEQ ID NO: 35201 - RNA, 27 nt, Artificial Sequence
  Synthetic Oligonucleotide; NDFIP1 exon 2; Set C
cgugaucaccuugcccuguuaccuacc

SEQ ID NO: 35202 - RNA, 28 nt, Artificial Sequence
  Synthetic Oligonucleotide; NDFIP1 exon 2; Set C
ccgugaucaccuugcccuguuaccuacc

SEQ ID NO: 35203 - RNA, 29 nt, Artificial Sequence
  Synthetic Oligonucleotide; NDFIP1 exon 2; Set C
uccgugaucaccuugcccuguuaccuacc

SEQ ID NO: 35204 - RNA, 30 nt, Artificial Sequence
  Synthetic Oligonucleotide; NDFIP1 exon 2; Set C
uuccgugaucaccuugcccuguuaccuacc

SEQ ID NO: 35205 - RNA, 15 nt, Artificial Sequence
  Synthetic Oligonucleotide; NDFIP1 exon 2; Set C
aucaccuugcccugu

SEQ ID NO: 35206 - RNA, 27 nt, Artificial Sequence
  Synthetic Oligonucleotide; NDFIP1 exon 2; Set C
uccgugaucaccuugcccuguuaccua

SEQ ID NO: 35207 - RNA, 16 nt, Artificial Sequence
  Synthetic Oligonucleotide; NDFIP1 exon 2; Set C
gaucaccuugcccugu

SEQ ID NO: 35208 - RNA, 17 nt, Artificial Sequence
  Synthetic Oligonucleotide; NDFIP1 exon 2; Set C
ugaucaccuugcccugu

SEQ ID NO: 35209 - RNA, 15 nt, Artificial Sequence
  Synthetic Oligonucleotide; NDFIP1 exon 2; Set C
gaucaccuugcccug

SEQ ID NO: 35210 - RNA, 21 nt, Artificial Sequence
  Synthetic Oligonucleotide; NDFIP1 exon 2; Set B
cgugaucaccuugcccuguua

SEQ ID NO: 35211 - RNA, 16 nt, Artificial Sequence
  Synthetic Oligonucleotide; NDFIP1 exon 2; Set C
ugaucaccuugcccug

SEQ ID NO: 35212 - RNA, 22 nt, Artificial Sequence
  Synthetic Oligonucleotide; NDFIP1 exon 2; Set B
ccgugaucaccuugcccuguua

SEQ ID NO: 35213 - RNA, 23 nt, Artificial Sequence
  Synthetic Oligonucleotide; NDFIP1 exon 2; Set C
uccgugaucaccuugcccuguua

SEQ ID NO: 35214 - RNA, 36 nt, Artificial Sequence
  Synthetic Oligonucleotide; NDFIP1 exon 2; Set C
uaaggauuccgugaucaccuugcccuguuaccuacc

SEQ ID NO: 35215 - RNA, 24 nt, Artificial Sequence
  Synthetic Oligonucleotide; NDFIP1 exon 2; Set C
uuccgugaucaccuugcccuguua

SEQ ID NO: 35216 - RNA, 37 nt, Artificial Sequence
  Synthetic Oligonucleotide; NDFIP1 exon 2; Set C
uuaaggauuccgugaucaccuugcccuguuaccuacc

SEQ ID NO: 35217 - RNA, 17 nt, Artificial Sequence
  Synthetic Oligonucleotide; NDFIP1 exon 2; Set B
cgugaucaccuugcccu

SEQ ID NO: 35218 - RNA, 38 nt, Artificial Sequence
  Synthetic Oligonucleotide; NDFIP1 exon 2; Set C
uuuaaggauuccgugaucaccuugcccuguuaccuacc

SEQ ID NO: 35219 - RNA, 39 nt, Artificial Sequence
  Synthetic Oligonucleotide; NDFIP1 exon 2; Set C
uuuuaaggauuccgugaucaccuugcccuguuaccuacc

SEQ ID NO: 35220 - RNA, 35 nt, Artificial Sequence
  Synthetic Oligonucleotide; NDFIP1 exon 2; Set C
uuaaggauuccgugaucaccuugcccuguuaccua

SEQ ID NO: 35221 - RNA, 19 nt, Artificial Sequence
  Synthetic Oligonucleotide; NDFIP1 exon 2; Set B
uccgugaucaccuugcccu

SEQ ID NO: 35222 - RNA, 40 nt, Artificial Sequence
  Synthetic Oligonucleotide; NDFIP1 exon 2; Set C
uuuuuaaggauuccgugaucaccuugcccuguuaccuacc

SEQ ID NO: 35223 - RNA, 36 nt, Artificial Sequence
  Synthetic Oligonucleotide; NDFIP1 exon 2; Set C
uuuaaggauuccgugaucaccuugcccuguuaccua

SEQ ID NO: 35224 - RNA, 37 nt, Artificial Sequence
  Synthetic Oligonucleotide; NDFIP1 exon 2; Set C
uuuuaaggauuccgugaucaccuugcccuguuaccua

SEQ ID NO: 35225 - RNA, 30 nt, Artificial Sequence
  Synthetic Oligonucleotide; NDFIP1 exon 2; Set C
uaaggauuccgugaucaccuugcccuguua

SEQ ID NO: 35226 - RNA, 38 nt, Artificial Sequence
  Synthetic Oligonucleotide; NDFIP1 exon 2; Set C
uuuuuaaggauuccgugaucaccuugcccuguuaccua

SEQ ID NO: 35227 - RNA, 31 nt, Artificial Sequence
  Synthetic Oligonucleotide; NDFIP1 exon 2; Set C
uuaaggauuccgugaucaccuugcccuguua

SEQ ID NO: 35228 - RNA, 39 nt, Artificial Sequence
  Synthetic Oligonucleotide; NDFIP1 exon 2; Set C
guuuuuaaggauuccgugaucaccuugcccuguuaccua

SEQ ID NO: 35229 - RNA, 32 nt, Artificial Sequence
  Synthetic Oligonucleotide; NDFIP1 exon 2; Set C
uuuaaggauuccgugaucaccuugcccuguua

SEQ ID NO: 35230 - RNA, 40 nt, Artificial Sequence
  Synthetic Oligonucleotide; NDFIP1 exon 2; Set C
uguuuuuaaggauuccgugaucaccuugcccuguuaccua

SEQ ID NO: 35231 - RNA, 33 nt, Artificial Sequence
  Synthetic Oligonucleotide; NDFIP1 exon 2; Set C
uuuuaaggauuccgugaucaccuugcccuguua

SEQ ID NO: 35232 - RNA, 34 nt, Artificial Sequence
  Synthetic Oligonucleotide; NDFIP1 exon 2; Set C
uuuuuaaggauuccgugaucaccuugcccuguua

SEQ ID NO: 35233 - RNA, 35 nt, Artificial Sequence
  Synthetic Oligonucleotide; NDFIP1 exon 2; Set C
guuuuuaaggauuccgugaucaccuugcccuguua

SEQ ID NO: 35234 - RNA, 27 nt, Artificial Sequence
  Synthetic Oligonucleotide; NDFIP1 exon 2; Set C
uuaaggauuccgugaucaccuugcccu

SEQ ID NO: 35235 - RNA, 36 nt, Artificial Sequence
  Synthetic Oligonucleotide; NDFIP1 exon 2; Set C
uguuuuuaaggauuccgugaucaccuugcccuguua

SEQ ID NO: 35236 - RNA, 28 nt, Artificial Sequence
  Synthetic Oligonucleotide; NDFIP1 exon 2; Set C
uuuaaggauuccgugaucaccuugcccu

SEQ ID NO: 35237 - RNA, 37 nt, Artificial Sequence
  Synthetic Oligonucleotide; NDFIP1 exon 2; Set C
guguuuuuaaggauuccgugaucaccuugcccuguua

SEQ ID NO: 35238 - RNA, 29 nt, Artificial Sequence
  Synthetic Oligonucleotide; NDFIP1 exon 2; Set C
uuuuaaggauuccgugaucaccuugcccu

SEQ ID NO: 35239 - RNA, 30 nt, Artificial Sequence
  Synthetic Oligonucleotide; NDFIP1 exon 2; Set C
uuuuuaaggauuccgugaucaccuugcccu

SEQ ID NO: 35240 - RNA, 31 nt, Artificial Sequence
  Synthetic Oligonucleotide; NDFIP1 exon 2; Set C
guuuuuaaggauuccgugaucaccuugcccu

SEQ ID NO: 35241 - RNA, 36 nt, Artificial Sequence
  Synthetic Oligonucleotide; NDFIP1 exon 2; Set C
aguguuuuuaaggauuccgugaucaccuugcccugu

SEQ ID NO: 35242 - RNA, 32 nt, Artificial Sequence
  Synthetic Oligonucleotide; NDFIP1 exon 2; Set C
uguuuuuaaggauuccgugaucaccuugcccu

SEQ ID NO: 35243 - RNA, 35 nt, Artificial Sequence
  Synthetic Oligonucleotide; NDFIP1 exon 2; Set C
aguguuuuuaaggauuccgugaucaccuugcccug

SEQ ID NO: 35244 - RNA, 19 nt, Artificial Sequence
  Synthetic Oligonucleotide; NDFIP1 exon 2; Set C
uaaggauuccgugaucacc

SEQ ID NO: 35245 - RNA, 33 nt, Artificial Sequence
  Synthetic Oligonucleotide; NDFIP1 exon 2; Set C
guguuuuuaaggauuccgugaucaccuugcccu

SEQ ID NO: 35246 - RNA, 21 nt, Artificial Sequence
  Synthetic Oligonucleotide; NDFIP1 exon 2; Set C
uuaaggauuccgugaucaccu

SEQ ID NO: 35247 - RNA, 20 nt, Artificial Sequence
  Synthetic Oligonucleotide; NDFIP1 exon 2; Set C
uuaaggauuccgugaucacc

SEQ ID NO: 35248 - RNA, 22 nt, Artificial Sequence
  Synthetic Oligonucleotide; NDFIP1 exon 2; Set C
uuuaaggauuccgugaucaccu

SEQ ID NO: 35249 - RNA, 21 nt, Artificial Sequence
  Synthetic Oligonucleotide; NDFIP1 exon 2; Set C
uuuaaggauuccgugaucacc

SEQ ID NO: 35250 - RNA, 23 nt, Artificial Sequence
  Synthetic Oligonucleotide; NDFIP1 exon 2; Set C
uuuuaaggauuccgugaucaccu

SEQ ID NO: 35251 - RNA, 22 nt, Artificial Sequence
  Synthetic Oligonucleotide; NDFIP1 exon 2; Set C
uuuuaaggauuccgugaucacc

SEQ ID NO: 35252 - RNA, 24 nt, Artificial Sequence
  Synthetic Oligonucleotide; NDFIP1 exon 2; Set C
uuuuuaaggauuccgugaucaccu

SEQ ID NO: 35253 - RNA, 23 nt, Artificial Sequence
  Synthetic Oligonucleotide; NDFIP1 exon 2; Set C
uuuuuaaggauuccgugaucacc

SEQ ID NO: 35254 - RNA, 25 nt, Artificial Sequence
  Synthetic Oligonucleotide; NDFIP1 exon 2; Set B
guuuuuaaggauuccgugaucaccu

SEQ ID NO: 35255 - RNA, 24 nt, Artificial Sequence
  Synthetic Oligonucleotide; NDFIP1 exon 2; Set C
guuuuuaaggauuccgugaucacc

SEQ ID NO: 35256 - RNA, 26 nt, Artificial Sequence
  Synthetic Oligonucleotide; NDFIP1 exon 2; Set B
uguuuuuaaggauuccgugaucaccu

SEQ ID NO: 35257 - RNA, 25 nt, Artificial Sequence
  Synthetic Oligonucleotide; NDFIP1 exon 2; Set C
uguuuuuaaggauuccgugaucacc

SEQ ID NO: 35258 - RNA, 27 nt, Artificial Sequence
  Synthetic Oligonucleotide; NDFIP1 exon 2; Set B
guguuuuuaaggauuccgugaucaccu

SEQ ID NO: 35259 - RNA, 26 nt, Artificial Sequence
  Synthetic Oligonucleotide; NDFIP1 exon 2; Set B
guguuuuuaaggauuccgugaucacc

SEQ ID NO: 35260 - RNA, 24 nt, Artificial Sequence
  Synthetic Oligonucleotide; NDFIP1 exon 2; Set C
aguguuuuuaaggauuccgugauc

SEQ ID NO: 35261 - RNA, 15 nt, Artificial Sequence
  Synthetic Oligonucleotide; NDFIP1 exon 2; Set C
guguuuuuaaggauu

SEQ ID NO: 35262 - RNA, 15 nt, Artificial Sequence
  Synthetic Oligonucleotide; NDFIP1 exon 2; Set C
aaagccaauuagaaa

SEQ ID NO: 35263 - RNA, 16 nt, Artificial Sequence
  Synthetic Oligonucleotide; NDFIP1 exon 2; Set C
uaaagccaauuagaaa

SEQ ID NO: 35264 - RNA, 17 nt, Artificial Sequence
  Synthetic Oligonucleotide; NDFIP1 exon 2; Set C
auaaagccaauuagaaa

SEQ ID NO: 35265 - RNA, 23 nt, Artificial Sequence
  Synthetic Oligonucleotide; NDFIP1 exon 2; Set C
guaagcauaaagccaauuagaaa

SEQ ID NO: 35266 - RNA, 24 nt, Artificial Sequence
  Synthetic Oligonucleotide; NDFIP1 exon 2; Set C
uguaagcauaaagccaauuagaaa

SEQ ID NO: 35267 - RNA, 25 nt, Artificial Sequence
  Synthetic Oligonucleotide; NDFIP1 exon 2; Set C
auguaagcauaaagccaauuagaaa

SEQ ID NO: 35268 - RNA, 40 nt, Artificial Sequence
  Synthetic Oligonucleotide; NDFIP1 exon 2; Set C
aauuucauauuuuaauguaagcauaaagccaauuagaaag

SEQ ID NO: 35269 - RNA, 38 nt, Artificial Sequence
  Synthetic Oligonucleotide; NDFIP1 exon 2; Set C
auuucauauuuuaauguaagcauaaagccaauuagaaa

SEQ ID NO: 35270 - RNA, 37 nt, Artificial Sequence
  Synthetic Oligonucleotide; NDFIP1 exon 2; Set C
aaaaauuucauauuuuaauguaagcauaaagccaauu

SEQ ID NO: 35271 - RNA, 36 nt, Artificial Sequence
  Synthetic Oligonucleotide; NDFIP1 exon 2; Set C
aaaaauuucauauuuuaauguaagcauaaagccaau

SEQ ID NO: 35272 - RNA, 38 nt, Artificial Sequence
  Synthetic Oligonucleotide; NDFIP1 exon 2; Set C
uaaaaauuucauauuuuaauguaagcauaaagccaauu

SEQ ID NO: 35273 - RNA, 37 nt, Artificial Sequence
  Synthetic Oligonucleotide; NDFIP1 exon 2; Set C
uaaaaauuucauauuuuaauguaagcauaaagccaau

SEQ ID NO: 35274 - RNA, 39 nt, Artificial Sequence
  Synthetic Oligonucleotide; NDFIP1 exon 2; Set C
auaaaaauuucauauuuuaauguaagcauaaagccaauu

SEQ ID NO: 35275 - RNA, 38 nt, Artificial Sequence
  Synthetic Oligonucleotide; NDFIP1 exon 2; Set C
auaaaaauuucauauuuuaauguaagcauaaagccaau

SEQ ID NO: 35276 - RNA, 40 nt, Artificial Sequence
  Synthetic Oligonucleotide; NDFIP1 exon 2; Set C
aauaaaaauuucauauuuuaauguaagcauaaagccaauu

SEQ ID NO: 35277 - RNA, 39 nt, Artificial Sequence
  Synthetic Oligonucleotide; NDFIP1 exon 2; Set C
aauaaaaauuucauauuuuaauguaagcauaaagccaau

SEQ ID NO: 35278 - RNA, 15 nt, Artificial Sequence
  Synthetic Oligonucleotide; NDFIP1 exon 2; Set C
auauuuuaauguaag

SEQ ID NO: 35279 - RNA, 16 nt, Artificial Sequence
  Synthetic Oligonucleotide; NDFIP1 exon 2; Set C
cauauuuuaauguaag

SEQ ID NO: 35280 - RNA, 17 nt, Artificial Sequence
  Synthetic Oligonucleotide; NDFIP1 exon 2; Set C
ucauauuuuaauguaag

SEQ ID NO: 35281 - RNA, 18 nt, Artificial Sequence
  Synthetic Oligonucleotide; NDFIP1 exon 2; Set C
uucauauuuuaauguaag

SEQ ID NO: 35282 - RNA, 19 nt, Artificial Sequence
  Synthetic Oligonucleotide; NDFIP1 exon 2; Set C
uuucauauuuuaauguaag

SEQ ID NO: 35283 - RNA, 28 nt, Artificial Sequence
  Synthetic Oligonucleotide; NDFIP1 exon 2; Set C
aaauaaaaauuucauauuuuaauguaag

SEQ ID NO: 35284 - RNA, 29 nt, Artificial Sequence
  Synthetic Oligonucleotide; NDFIP1 exon 2; Set C
uaaauaaaaauuucauauuuuaauguaag

SEQ ID NO: 35285 - RNA, 30 nt, Artificial Sequence
  Synthetic Oligonucleotide; NDFIP1 exon 2; Set C
cuaaauaaaaauuucauauuuuaauguaag

SEQ ID NO: 35286 - RNA, 31 nt, Artificial Sequence
  Synthetic Oligonucleotide; NDFIP1 exon 2; Set C
acuaaauaaaaauuucauauuuuaauguaag

SEQ ID NO: 35287 - RNA, 32 nt, Artificial Sequence
  Synthetic Oligonucleotide; NDFIP1 exon 2; Set C
aacuaaauaaaaauuucauauuuuaauguaag

SEQ ID NO: 35288 - RNA, 33 nt, Artificial Sequence
  Synthetic Oligonucleotide; NDFIP1 exon 2; Set C
caacuaaauaaaaauuucauauuuuaauguaag

SEQ ID NO: 35289 - RNA, 34 nt, Artificial Sequence
  Synthetic Oligonucleotide; NDFIP1 exon 2; Set C
gcaacuaaauaaaaauuucauauuuuaauguaag

SEQ ID NO: 35290 - RNA, 35 nt, Artificial Sequence
  Synthetic Oligonucleotide; NDFIP1 exon 2; Set C
ugcaacuaaauaaaaauuucauauuuuaauguaag

SEQ ID NO: 35291 - RNA, 40 nt, Artificial Sequence
  Synthetic Oligonucleotide; NDFIP1 exon 2; Set C
uucauucugcaacuaaauaaaaauuucauauuuuaaugua

SEQ ID NO: 35292 - RNA, 39 nt, Artificial Sequence
  Synthetic Oligonucleotide; NDFIP1 exon 2; Set C
uucauucugcaacuaaauaaaaauuucauauuuuaaugu

SEQ ID NO: 35293 - RNA, 40 nt, Artificial Sequence
  Synthetic Oligonucleotide; NDFIP1 exon 2; Set C
cuucauucugcaacuaaauaaaaauuucauauuuuaaugu

SEQ ID NO: 35294 - RNA, 38 nt, Artificial Sequence
  Synthetic Oligonucleotide; NDFIP1 exon 2; Set C
uucauucugcaacuaaauaaaaauuucauauuuuaaug

SEQ ID NO: 35295 - RNA, 37 nt, Artificial Sequence
  Synthetic Oligonucleotide; NDFIP1 exon 2; Set C
uucauucugcaacuaaauaaaaauuucauauuuuaau

SEQ ID NO: 35296 - RNA, 39 nt, Artificial Sequence
  Synthetic Oligonucleotide; NDFIP1 exon 2; Set C
cuucauucugcaacuaaauaaaaauuucauauuuuaaug

SEQ ID NO: 35297 - RNA, 38 nt, Artificial Sequence
  Synthetic Oligonucleotide; NDFIP1 exon 2; Set C
cuucauucugcaacuaaauaaaaauuucauauuuuaau

SEQ ID NO: 35298 - RNA, 36 nt, Artificial Sequence
  Synthetic Oligonucleotide; NDFIP1 exon 2; Set C
uucauucugcaacuaaauaaaaauuucauauuuuaa

SEQ ID NO: 35299 - RNA, 40 nt, Artificial Sequence
  Synthetic Oligonucleotide; NDFIP1 exon 2; Set C
ucuucauucugcaacuaaauaaaaauuucauauuuuaaug

SEQ ID NO: 35300 - RNA, 37 nt, Artificial Sequence
  Synthetic Oligonucleotide; NDFIP1 exon 2; Set C
cuucauucugcaacuaaauaaaaauuucauauuuuaa

SEQ ID NO: 35301 - RNA, 39 nt, Artificial Sequence
  Synthetic Oligonucleotide; NDFIP1 exon 2; Set C
ucuucauucugcaacuaaauaaaaauuucauauuuuaau

SEQ ID NO: 35302 - RNA, 35 nt, Artificial Sequence
  Synthetic Oligonucleotide; NDFIP1 exon 2; Set C
uucauucugcaacuaaauaaaaauuucauauuuua

SEQ ID NO: 35303 - RNA, 38 nt, Artificial Sequence
  Synthetic Oligonucleotide; NDFIP1 exon 2; Set C
ucuucauucugcaacuaaauaaaaauuucauauuuuaa

SEQ ID NO: 35304 - RNA, 36 nt, Artificial Sequence
  Synthetic Oligonucleotide; NDFIP1 exon 2; Set C
cuucauucugcaacuaaauaaaaauuucauauuuua

SEQ ID NO: 35305 - RNA, 34 nt, Artificial Sequence
  Synthetic Oligonucleotide; NDFIP1 exon 2; Set C
uucauucugcaacuaaauaaaaauuucauauuuu

SEQ ID NO: 35306 - RNA, 37 nt, Artificial Sequence
  Synthetic Oligonucleotide; NDFIP1 exon 2; Set C
ucuucauucugcaacuaaauaaaaauuucauauuuua

SEQ ID NO: 35307 - RNA, 35 nt, Artificial Sequence
  Synthetic Oligonucleotide; NDFIP1 exon 2; Set C
cuucauucugcaacuaaauaaaaauuucauauuuu

SEQ ID NO: 35308 - RNA, 33 nt, Artificial Sequence
  Synthetic Oligonucleotide; NDFIP1 exon 2; Set C
uucauucugcaacuaaauaaaaauuucauauuu

SEQ ID NO: 35309 - RNA, 34 nt, Artificial Sequence
  Synthetic Oligonucleotide; NDFIP1 exon 2; Set C
cuucauucugcaacuaaauaaaaauuucauauuu

SEQ ID NO: 35310 - RNA, 36 nt, Artificial Sequence
  Synthetic Oligonucleotide; NDFIP1 exon 2; Set C
ucuucauucugcaacuaaauaaaaauuucauauuuu

SEQ ID NO: 35311 - RNA, 32 nt, Artificial Sequence
  Synthetic Oligonucleotide; NDFIP1 exon 2; Set C
uucauucugcaacuaaauaaaaauuucauauu

SEQ ID NO: 35312 - RNA, 33 nt, Artificial Sequence
  Synthetic Oligonucleotide; NDFIP1 exon 2; Set C
cuucauucugcaacuaaauaaaaauuucauauu

SEQ ID NO: 35313 - RNA, 35 nt, Artificial Sequence
  Synthetic Oligonucleotide; NDFIP1 exon 2; Set C
ucuucauucugcaacuaaauaaaaauuucauauuu

SEQ ID NO: 35314 - RNA, 31 nt, Artificial Sequence
  Synthetic Oligonucleotide; NDFIP1 exon 2; Set C
uucauucugcaacuaaauaaaaauuucauau

SEQ ID NO: 35315 - RNA, 30 nt, Artificial Sequence
  Synthetic Oligonucleotide; NDFIP1 exon 2; Set C
uucauucugcaacuaaauaaaaauuucaua

SEQ ID NO: 35316 - RNA, 32 nt, Artificial Sequence
  Synthetic Oligonucleotide; NDFIP1 exon 2; Set C
cuucauucugcaacuaaauaaaaauuucauau

SEQ ID NO: 35317 - RNA, 34 nt, Artificial Sequence
  Synthetic Oligonucleotide; NDFIP1 exon 2; Set C
ucuucauucugcaacuaaauaaaaauuucauauu

SEQ ID NO: 35318 - RNA, 29 nt, Artificial Sequence
  Synthetic Oligonucleotide; NDFIP1 exon 2; Set C
uucauucugcaacuaaauaaaaauuucau

SEQ ID NO: 35319 - RNA, 31 nt, Artificial Sequence
  Synthetic Oligonucleotide; NDFIP1 exon 2; Set C
cuucauucugcaacuaaauaaaaauuucaua

SEQ ID NO: 35320 - RNA, 33 nt, Artificial Sequence
  Synthetic Oligonucleotide; NDFIP1 exon 2; Set C
ucuucauucugcaacuaaauaaaaauuucauau

SEQ ID NO: 35321 - RNA, 30 nt, Artificial Sequence
  Synthetic Oligonucleotide; NDFIP1 exon 2; Set C
cuucauucugcaacuaaauaaaaauuucau

SEQ ID NO: 35322 - RNA, 32 nt, Artificial Sequence
  Synthetic Oligonucleotide; NDFIP1 exon 2; Set C
ucuucauucugcaacuaaauaaaaauuucaua

SEQ ID NO: 35323 - RNA, 28 nt, Artificial Sequence
  Synthetic Oligonucleotide; NDFIP1 exon 2; Set C
uucauucugcaacuaaauaaaaauuuca

SEQ ID NO: 35324 - RNA, 22 nt, Artificial Sequence
  Synthetic Oligonucleotide; NDFIP1 exon 2; Set C
auucugcaacuaaauaaaaauu

SEQ ID NO: 35325 - RNA, 31 nt, Artificial Sequence
  Synthetic Oligonucleotide; NDFIP1 exon 2; Set C
ucuucauucugcaacuaaauaaaaauuucau

SEQ ID NO: 35326 - RNA, 29 nt, Artificial Sequence
  Synthetic Oligonucleotide; NDFIP1 exon 2; Set C
cuucauucugcaacuaaauaaaaauuuca

SEQ ID NO: 35327 - RNA, 25 nt, Artificial Sequence
  Synthetic Oligonucleotide; NDFIP1 exon 2; Set C
ucauucugcaacuaaauaaaaauuu

SEQ ID NO: 35328 - RNA, 27 nt, Artificial Sequence
  Synthetic Oligonucleotide; NDFIP1 exon 2; Set C
uucauucugcaacuaaauaaaaauuuc

SEQ ID NO: 35329 - RNA, 23 nt, Artificial Sequence
  Synthetic Oligonucleotide; NDFIP1 exon 2; Set C
cauucugcaacuaaauaaaaauu

SEQ ID NO: 35330 - RNA, 30 nt, Artificial Sequence
  Synthetic Oligonucleotide; NDFIP1 exon 2; Set C
ucuucauucugcaacuaaauaaaaauuuca

SEQ ID NO: 35331 - RNA, 28 nt, Artificial Sequence
  Synthetic Oligonucleotide; NDFIP1 exon 2; Set C
cuucauucugcaacuaaauaaaaauuuc

SEQ ID NO: 35332 - RNA, 26 nt, Artificial Sequence
  Synthetic Oligonucleotide; NDFIP1 exon 2; Set C
uucauucugcaacuaaauaaaaauuu

SEQ ID NO: 35333 - RNA, 24 nt, Artificial Sequence
  Synthetic Oligonucleotide; NDFIP1 exon 2; Set C
ucauucugcaacuaaauaaaaauu

SEQ ID NO: 35334 - RNA, 27 nt, Artificial Sequence
  Synthetic Oligonucleotide; NDFIP1 exon 2; Set C
cuucauucugcaacuaaauaaaaauuu

SEQ ID NO: 35335 - RNA, 29 nt, Artificial Sequence
  Synthetic Oligonucleotide; NDFIP1 exon 2; Set C
ucuucauucugcaacuaaauaaaaauuuc

SEQ ID NO: 35336 - RNA, 28 nt, Artificial Sequence
  Synthetic Oligonucleotide; NDFIP1 exon 2; Set C
ucuucauucugcaacuaaauaaaaauuu

SEQ ID NO: 35337 - RNA, 15 nt, Artificial Sequence
  Synthetic Oligonucleotide; NDFIP1 exon 2; Set C
cauucugcaacuaaa

SEQ ID NO: 35338 - RNA, 16 nt, Artificial Sequence
  Synthetic Oligonucleotide; NDFIP1 exon 2; Set C
ucauucugcaacuaaa

SEQ ID NO: 35339 - RNA, 15 nt, Artificial Sequence
  Synthetic Oligonucleotide; NDFIP1 exon 2; Set C
ucauucugcaacuaa

SEQ ID NO: 35340 - RNA, 18 nt, Artificial Sequence
  Synthetic Oligonucleotide; NDFIP1 exon 2; Set C
cuucauucugcaacuaaa

SEQ ID NO: 35341 - RNA, 17 nt, Artificial Sequence
  Synthetic Oligonucleotide; NDFIP1 exon 2; Set C
cuucauucugcaacuaa

SEQ ID NO: 35342 - RNA, 16 nt, Artificial Sequence
  Synthetic Oligonucleotide; NDFIP1 exon 2; Set C
cuucauucugcaacua

SEQ ID NO: 35343 - RNA, 32 nt, Artificial Sequence
  Synthetic Oligonucleotide; NDFIP1 exon 2; Set C
agacucuucuucauucugcaacuaaauaaaaa

SEQ ID NO: 35344 - RNA, 15 nt, Artificial Sequence
  Synthetic Oligonucleotide; NDFIP1 exon 2; Set C
cuucauucugcaacu

SEQ ID NO: 35345 - RNA, 33 nt, Artificial Sequence
  Synthetic Oligonucleotide; NDFIP1 exon 2; Set C
cagacucuucuucauucugcaacuaaauaaaaa

SEQ ID NO: 35346 - RNA, 40 nt, Artificial Sequence
  Synthetic Oligonucleotide; NDFIP1 exon 2; Set A
ucuccagacucuucuucauucugcaacuaaauaaaaauuu

SEQ ID NO: 35347 - RNA, 30 nt, Artificial Sequence
  Synthetic Oligonucleotide; NDFIP1 exon 2; Set C
agacucuucuucauucugcaacuaaauaaa

SEQ ID NO: 35348 - RNA, 31 nt, Artificial Sequence
  Synthetic Oligonucleotide; NDFIP1 exon 2; Set C
cagacucuucuucauucugcaacuaaauaaa

SEQ ID NO: 35349 - RNA, 29 nt, Artificial Sequence
  Synthetic Oligonucleotide; NDFIP1 exon 2; Set C
agacucuucuucauucugcaacuaaauaa

SEQ ID NO: 35350 - RNA, 30 nt, Artificial Sequence
  Synthetic Oligonucleotide; NDFIP1 exon 2; Set C
cagacucuucuucauucugcaacuaaauaa

SEQ ID NO: 35351 - RNA, 28 nt, Artificial Sequence
  Synthetic Oligonucleotide; NDFIP1 exon 2; Set C
agacucuucuucauucugcaacuaaaua

SEQ ID NO: 35352 - RNA, 27 nt, Artificial Sequence
  Synthetic Oligonucleotide; NDFIP1 exon 2; Set C
agacucuucuucauucugcaacuaaau

SEQ ID NO: 35353 - RNA, 29 nt, Artificial Sequence
  Synthetic Oligonucleotide; NDFIP1 exon 2; Set A
cagacucuucuucauucugcaacuaaaua

SEQ ID NO: 35354 - RNA, 28 nt, Artificial Sequence
  Synthetic Oligonucleotide; NDFIP1 exon 2; Set C
cagacucuucuucauucugcaacuaaau

SEQ ID NO: 35355 - RNA, 28 nt, Artificial Sequence
  Synthetic Oligonucleotide; NDFIP1 exon 2; Set A
ucuccagacucuucuucauucugcaacu

SEQ ID NO: 35356 - RNA, 40 nt, Artificial Sequence
  Synthetic Oligonucleotide; NDFIP1 exon 2; Set C
gcagccuguucagguucuccagacucuucuucauucugca

SEQ ID NO: 35357 - RNA, 39 nt, Artificial Sequence
  Synthetic Oligonucleotide; NDFIP1 exon 2; Set C
gcagccuguucagguucuccagacucuucuucauucugc

SEQ ID NO: 35358 - RNA, 29 nt, Artificial Sequence
  Synthetic Oligonucleotide; NDFIP1 exon 2; Set A
cuguucagguucuccagacucuucuucau

SEQ ID NO: 35359 - RNA, 40 nt, Artificial Sequence
  Synthetic Oligonucleotide; NDFIP1 exon 2; Set C
ugcagccuguucagguucuccagacucuucuucauucugc

SEQ ID NO: 35360 - RNA, 28 nt, Artificial Sequence
  Synthetic Oligonucleotide; NDFIP1 exon 2; Set A
cuguucagguucuccagacucuucuuca

SEQ ID NO: 35361 - RNA, 24 nt, Artificial Sequence
  Synthetic Oligonucleotide; NDFIP1 exon 2; Set C
ugcagccuguucagguucuccaga

SEQ ID NO: 35362 - RNA, 23 nt, Artificial Sequence
  Synthetic Oligonucleotide; NDFIP1 exon 2; Set A
ugcagccuguucagguucuccag

SEQ ID NO: 35363 - RNA, 29 nt, Artificial Sequence
  Synthetic Oligonucleotide; NDFIP1 exon 2; Set C
ucaccugcagccuguucagguucuccaga

SEQ ID NO: 35364 - RNA, 30 nt, Artificial Sequence
  Synthetic Oligonucleotide; NDFIP1 exon 2; Set C
aucaccugcagccuguucagguucuccaga

SEQ ID NO: 35365 - RNA, 28 nt, Artificial Sequence
  Synthetic Oligonucleotide; NDFIP1 exon 2; Set C
ucaccugcagccuguucagguucuccag

SEQ ID NO: 35366 - RNA, 29 nt, Artificial Sequence
  Synthetic Oligonucleotide; NDFIP1 exon 2; Set C
aucaccugcagccuguucagguucuccag

SEQ ID NO: 35367 - RNA, 15 nt, Artificial Sequence
  Synthetic Oligonucleotide; NDFIP1 exon 2; Set C
ucaccugcagccugu

SEQ ID NO: 35368 - RNA, 16 nt, Artificial Sequence
  Synthetic Oligonucleotide; NDFIP1 exon 2; Set C
aucaccugcagccugu

SEQ ID NO: 35369 - RNA, 15 nt, Artificial Sequence
  Synthetic Oligonucleotide; NDFIP1 exon 2; Set C
aucaccugcagccug

SEQ ID NO: 35370 - RNA, 15 nt, Artificial Sequence
  Synthetic Oligonucleotide; NDFIP1 exon 2; Set C
ggagcaucaccugca

SEQ ID NO: 35371 - RNA, 16 nt, Artificial Sequence
  Synthetic Oligonucleotide; NDFIP1 exon 2; Set C
aggagcaucaccugca

SEQ ID NO: 35372 - RNA, 17 nt, Artificial Sequence
  Synthetic Oligonucleotide; NDFIP1 exon 2; Set A
gaggagcaucaccugca

SEQ ID NO: 35373 - RNA, 17 nt, Artificial Sequence
  Synthetic Oligonucleotide; NDFIP1 exon 2; Set A
ggaggagcaucaccugc

SEQ ID NO: 35374 - RNA, 24 nt, Artificial Sequence
  Synthetic Oligonucleotide; NDFIP1 exon 2; Set C
uaagguggaggagcaucaccugca

SEQ ID NO: 35375 - RNA, 25 nt, Artificial Sequence
  Synthetic Oligonucleotide; NDFIP1 exon 2; Set C
guaagguggaggagcaucaccugca

SEQ ID NO: 35376 - RNA, 26 nt, Artificial Sequence
  Synthetic Oligonucleotide; NDFIP1 exon 2; Set C
uguaagguggaggagcaucaccugca

SEQ ID NO: 35377 - RNA, 40 nt, Artificial Sequence
  Synthetic Oligonucleotide; NDFIP1 exon 2; Set C
aaaugcugcuguaagguggaggagcaucaccugcagccug

SEQ ID NO: 35378 - RNA, 33 nt, Artificial Sequence
  Synthetic Oligonucleotide; NDFIP1 exon 2; Set C
aaugcugcuguaagguggaggagcaucaccugc

SEQ ID NO: 35379 - RNA, 28 nt, Artificial Sequence
  Synthetic Oligonucleotide; NDFIP1 exon 2; Set A
gaaaugcugcuguaagguggaggagcau

SEQ ID NO: 35380 - RNA, 27 nt, Artificial Sequence
  Synthetic Oligonucleotide; NDFIP1 exon 2; Set A
gaaaugcugcuguaagguggaggagca

SEQ ID NO: 35381 - RNA, 29 nt, Artificial Sequence
  Synthetic Oligonucleotide; NDFIP1 exon 2; Set A
agaaaugcugcuguaagguggaggagcau

SEQ ID NO: 35382 - RNA, 26 nt, Artificial Sequence
  Synthetic Oligonucleotide; NDFIP1 exon 2; Set A
gaaaugcugcuguaagguggaggagc

SEQ ID NO: 35383 - RNA, 28 nt, Artificial Sequence
  Synthetic Oligonucleotide; NDFIP1 exon 2; Set A
agaaaugcugcuguaagguggaggagca

SEQ ID NO: 35384 - RNA, 25 nt, Artificial Sequence
  Synthetic Oligonucleotide; NDFIP1 exon 2; Set A
gaaaugcugcuguaagguggaggag

SEQ ID NO: 35385 - RNA, 23 nt, Artificial Sequence
  Synthetic Oligonucleotide; NDFIP1 exon 2; Set A
aaaugcugcuguaagguggagga

SEQ ID NO: 35386 - RNA, 27 nt, Artificial Sequence
  Synthetic Oligonucleotide; NDFIP1 exon 2; Set A
agaaaugcugcuguaagguggaggagc

SEQ ID NO: 35387 - RNA, 26 nt, Artificial Sequence
  Synthetic Oligonucleotide; NDFIP1 exon 2; Set A
agaaaugcugcuguaagguggaggag

SEQ ID NO: 35388 - RNA, 24 nt, Artificial Sequence
  Synthetic Oligonucleotide; NDFIP1 exon 2; Set A
gaaaugcugcuguaagguggagga

SEQ ID NO: 35389 - RNA, 22 nt, Artificial Sequence
  Synthetic Oligonucleotide; NDFIP1 exon 2; Set C
aaaugcugcuguaagguggagg

SEQ ID NO: 35390 - RNA, 25 nt, Artificial Sequence
  Synthetic Oligonucleotide; NDFIP1 exon 2; Set A
agaaaugcugcuguaagguggagga

SEQ ID NO: 35391 - RNA, 23 nt, Artificial Sequence
  Synthetic Oligonucleotide; NDFIP1 exon 2; Set A
gaaaugcugcuguaagguggagg

SEQ ID NO: 35392 - RNA, 21 nt, Artificial Sequence
  Synthetic Oligonucleotide; NDFIP1 exon 2; Set C
aaaugcugcuguaagguggag

SEQ ID NO: 35393 - RNA, 19 nt, Artificial Sequence
  Synthetic Oligonucleotide; NDFIP1 exon 2; Set C
aaugcugcuguaaggugga

SEQ ID NO: 35394 - RNA, 37 nt, Artificial Sequence
  Synthetic Oligonucleotide; NDFIP1 exon 2; Set C
cucugcagaaaugcugcuguaagguggaggagcauca

SEQ ID NO: 35395 - RNA, 24 nt, Artificial Sequence
  Synthetic Oligonucleotide; NDFIP1 exon 2; Set A
agaaaugcugcuguaagguggagg

SEQ ID NO: 35396 - RNA, 36 nt, Artificial Sequence
  Synthetic Oligonucleotide; NDFIP1 exon 2; Set C
cucugcagaaaugcugcuguaagguggaggagcauc

SEQ ID NO: 35397 - RNA, 38 nt, Artificial Sequence
  Synthetic Oligonucleotide; NDFIP1 exon 2; Set C
ucucugcagaaaugcugcuguaagguggaggagcauca

SEQ ID NO: 35398 - RNA, 37 nt, Artificial Sequence
  Synthetic Oligonucleotide; NDFIP1 exon 2; Set C
ucucugcagaaaugcugcuguaagguggaggagcauc

SEQ ID NO: 35399 - RNA, 39 nt, Artificial Sequence
  Synthetic Oligonucleotide; NDFIP1 exon 2; Set C
cucucugcagaaaugcugcuguaagguggaggagcauca

SEQ ID NO: 35400 - RNA, 38 nt, Artificial Sequence
  Synthetic Oligonucleotide; NDFIP1 exon 2; Set C
cucucugcagaaaugcugcuguaagguggaggagcauc

SEQ ID NO: 35401 - RNA, 40 nt, Artificial Sequence
  Synthetic Oligonucleotide; NDFIP1 exon 2; Set C
gcucucugcagaaaugcugcuguaagguggaggagcauca

SEQ ID NO: 35402 - RNA, 39 nt, Artificial Sequence
  Synthetic Oligonucleotide; NDFIP1 exon 2; Set C
gcucucugcagaaaugcugcuguaagguggaggagcauc

SEQ ID NO: 35403 - RNA, 40 nt, Artificial Sequence
  Synthetic Oligonucleotide; NDFIP1 exon 2; Set C
cgcucucugcagaaaugcugcuguaagguggaggagcauc

SEQ ID NO: 35404 - RNA, 15 nt, Artificial Sequence
  Synthetic Oligonucleotide; NDFIP1 exon 2; Set C
gaaaugcugcuguaa

SEQ ID NO: 35405 - RNA, 16 nt, Artificial Sequence
  Synthetic Oligonucleotide; NDFIP1 exon 2; Set C
agaaaugcugcuguaa

SEQ ID NO: 35406 - RNA, 28 nt, Artificial Sequence
  Synthetic Oligonucleotide; NDFIP1 exon 2; Set A
cucugcagaaaugcugcuguaaggugga

SEQ ID NO: 35407 - RNA, 15 nt, Artificial Sequence
  Synthetic Oligonucleotide; NDFIP1 exon 2; Set C
agaaaugcugcugua

SEQ ID NO: 35408 - RNA, 29 nt, Artificial Sequence
  Synthetic Oligonucleotide; NDFIP1 exon 2; Set A
ucucugcagaaaugcugcuguaaggugga

SEQ ID NO: 35409 - RNA, 30 nt, Artificial Sequence
  Synthetic Oligonucleotide; NDFIP1 exon 2; Set C
cucucugcagaaaugcugcuguaaggugga

SEQ ID NO: 35410 - RNA, 31 nt, Artificial Sequence
  Synthetic Oligonucleotide; NDFIP1 exon 2; Set C
gcucucugcagaaaugcugcuguaaggugga

SEQ ID NO: 35411 - RNA, 32 nt, Artificial Sequence
  Synthetic Oligonucleotide; NDFIP1 exon 2; Set C
cgcucucugcagaaaugcugcuguaaggugga

SEQ ID NO: 35412 - RNA, 40 nt, Artificial Sequence
  Synthetic Oligonucleotide; NDFIP1 exon 2; Set C
accugcgcucucugcagaaaugcugcuguaagguggagga

SEQ ID NO: 35413 - RNA, 39 nt, Artificial Sequence
  Synthetic Oligonucleotide; NDFIP1 exon 2; Set C
accugcgcucucugcagaaaugcugcuguaagguggagg

SEQ ID NO: 35414 - RNA, 38 nt, Artificial Sequence
  Synthetic Oligonucleotide; NDFIP1 exon 2; Set C
accugcgcucucugcagaaaugcugcuguaagguggag

SEQ ID NO: 35415 - RNA, 40 nt, Artificial Sequence
  Synthetic Oligonucleotide; NDFIP1 exon 2; Set C
cuaccugcgcucucugcagaaaugcugcuguaagguggag

SEQ ID NO: 35416 - RNA, 31 nt, Artificial Sequence
  Synthetic Oligonucleotide; NDFIP1 exon 2; Set C
accugcgcucucugcagaaaugcugcuguaa

SEQ ID NO: 35417 - RNA, 30 nt, Artificial Sequence
  Synthetic Oligonucleotide; NDFIP1 exon 2; Set C
accugcgcucucugcagaaaugcugcugua

SEQ ID NO: 35418 - RNA, 29 nt, Artificial Sequence
  Synthetic Oligonucleotide; NDFIP1 exon 2; Set C
accugcgcucucugcagaaaugcugcugu

SEQ ID NO: 35419 - RNA, 33 nt, Artificial Sequence
  Synthetic Oligonucleotide; NDFIP1 exon 2; Set C
cuaccugcgcucucugcagaaaugcugcuguaa

SEQ ID NO: 35420 - RNA, 32 nt, Artificial Sequence
  Synthetic Oligonucleotide; NDFIP1 exon 2; Set C
cuaccugcgcucucugcagaaaugcugcugua

SEQ ID NO: 35421 - RNA, 31 nt, Artificial Sequence
  Synthetic Oligonucleotide; NDFIP1 exon 2; Set C
cuaccugcgcucucugcagaaaugcugcugu

SEQ ID NO: 35422 - RNA, 37 nt, Artificial Sequence
  Synthetic Oligonucleotide; NDFIP1 exon 2; Set C
uuaccuaccugcgcucucugcagaaaugcugcuguaa

SEQ ID NO: 35423 - RNA, 15 nt, Artificial Sequence
  Synthetic Oligonucleotide; NDFIP1 exon 2; Set C
cgcucucugcagaaa

SEQ ID NO: 35424 - RNA, 36 nt, Artificial Sequence
  Synthetic Oligonucleotide; NDFIP1 exon 2; Set C
uuaccuaccugcgcucucugcagaaaugcugcugua

SEQ ID NO: 35425 - RNA, 35 nt, Artificial Sequence
  Synthetic Oligonucleotide; NDFIP1 exon 2; Set C
uuaccuaccugcgcucucugcagaaaugcugcugu

SEQ ID NO: 35426 - RNA, 21 nt, Artificial Sequence
  Synthetic Oligonucleotide; NDFIP1 exon 2; Set A
accugcgcucucugcagaaau

SEQ ID NO: 35427 - RNA, 40 nt, Artificial Sequence
  Synthetic Oligonucleotide; NDFIP1 exon 2; Set C
ccuguuaccuaccugcgcucucugcagaaaugcugcugua

SEQ ID NO: 35428 - RNA, 39 nt, Artificial Sequence
  Synthetic Oligonucleotide; NDFIP1 exon 2; Set C
ccuguuaccuaccugcgcucucugcagaaaugcugcugu

SEQ ID NO: 35429 - RNA, 21 nt, Artificial Sequence
  Synthetic Oligonucleotide; NDFIP1 exon 2; Set A
uaccugcgcucucugcagaaa

SEQ ID NO: 35430 - RNA, 27 nt, Artificial Sequence
  Synthetic Oligonucleotide; NDFIP1 exon 2; Set C
guuaccuaccugcgcucucugcagaaa

SEQ ID NO: 35431 - RNA, 15 nt, Artificial Sequence
  Synthetic Oligonucleotide; NDFIP1 exon 2; Set C
cuaccugcgcucucu

SEQ ID NO: 35432 - RNA, 19 nt, Artificial Sequence
  Synthetic Oligonucleotide; NDFIP1 exon 2; Set B
uuaccuaccugcgcucucu

SEQ ID NO: 35433 - RNA, 23 nt, Artificial Sequence
  Synthetic Oligonucleotide; NDFIP1 exon 2; Set C
ccuguuaccuaccugcgcucucu

SEQ ID NO: 35434 - RNA, 38 nt, Artificial Sequence
  Synthetic Oligonucleotide; NDFIP1 exon 2; Set C
caccuugcccuguuaccuaccugcgcucucugcagaaa

SEQ ID NO: 35435 - RNA, 39 nt, Artificial Sequence
  Synthetic Oligonucleotide; NDFIP1 exon 2; Set C
ucaccuugcccuguuaccuaccugcgcucucugcagaaa

SEQ ID NO: 35436 - RNA, 29 nt, Artificial Sequence
  Synthetic Oligonucleotide; NDFIP1 exon 2; Set C
ccuugcccuguuaccuaccugcgcucucu

SEQ ID NO: 35437 - RNA, 30 nt, Artificial Sequence
  Synthetic Oligonucleotide; NDFIP1 exon 2; Set C
accuugcccuguuaccuaccugcgcucucu

SEQ ID NO: 35438 - RNA, 18 nt, Artificial Sequence
  Synthetic Oligonucleotide; NDFIP1 exon 2; Set C
ccuugcccuguuaccuac

SEQ ID NO: 35439 - RNA, 19 nt, Artificial Sequence
  Synthetic Oligonucleotide; NDFIP1 exon 2; Set B
accuugcccuguuaccuac

SEQ ID NO: 35440 - RNA, 21 nt, Artificial Sequence
  Synthetic Oligonucleotide; NDFIP1 exon 2; Set B
caccuugcccuguuaccuacc

SEQ ID NO: 35441 - RNA, 40 nt, Artificial Sequence
  Synthetic Oligonucleotide; NDFIP1 exon 2; Set C
auuccgugaucaccuugcccuguuaccuaccugcgcucuc

SEQ ID NO: 35442 - RNA, 22 nt, Artificial Sequence
  Synthetic Oligonucleotide; NDFIP1 exon 2; Set B
ucaccuugcccuguuaccuacc

SEQ ID NO: 35443 - RNA, 23 nt, Artificial Sequence
  Synthetic Oligonucleotide; NDFIP1 exon 2; Set B
aucaccuugcccuguuaccuacc

SEQ ID NO: 35444 - RNA, 19 nt, Artificial Sequence
  Synthetic Oligonucleotide; NDFIP1 exon 2; Set B
caccuugcccuguuaccua

SEQ ID NO: 35445 - RNA, 24 nt, Artificial Sequence
  Synthetic Oligonucleotide; NDFIP1 exon 2; Set C
gaucaccuugcccuguuaccuacc

SEQ ID NO: 35446 - RNA, 20 nt, Artificial Sequence
  Synthetic Oligonucleotide; NDFIP1 exon 2; Set B
ucaccuugcccuguuaccua

SEQ ID NO: 35447 - RNA, 25 nt, Artificial Sequence
  Synthetic Oligonucleotide; NDFIP1 exon 2; Set C
ugaucaccuugcccuguuaccuacc

SEQ ID NO: 35448 - RNA, 26 nt, Artificial Sequence
  Synthetic Oligonucleotide; NDFIP1 exon 2; Set C
gugaucaccuugcccuguuaccuacc

SEQ ID NO: 35449 - RNA, 22 nt, Artificial Sequence
  Synthetic Oligonucleotide; NDFIP1 exon 2; Set B
gaucaccuugcccuguuaccua

SEQ ID NO: 35450 - RNA, 15 nt, Artificial Sequence
  Synthetic Oligonucleotide; NDFIP1 exon 2; Set C
caccuugcccuguua

SEQ ID NO: 35451 - RNA, 23 nt, Artificial Sequence
  Synthetic Oligonucleotide; NDFIP1 exon 2; Set B
ugaucaccuugcccuguuaccua

SEQ ID NO: 35452 - RNA, 16 nt, Artificial Sequence
  Synthetic Oligonucleotide; NDFIP1 exon 2; Set C
ucaccuugcccuguua

SEQ ID NO: 35453 - RNA, 24 nt, Artificial Sequence
  Synthetic Oligonucleotide; NDFIP1 exon 2; Set C
gugaucaccuugcccuguuaccua

SEQ ID NO: 35454 - RNA, 17 nt, Artificial Sequence
  Synthetic Oligonucleotide; NDFIP1 exon 2; Set C
aucaccuugcccuguua

SEQ ID NO: 35455 - RNA, 25 nt, Artificial Sequence
  Synthetic Oligonucleotide; NDFIP1 exon 2; Set C
cgugaucaccuugcccuguuaccua

SEQ ID NO: 35456 - RNA, 18 nt, Artificial Sequence
  Synthetic Oligonucleotide; NDFIP1 exon 2; Set C
gaucaccuugcccuguua

SEQ ID NO: 35457 - RNA, 26 nt, Artificial Sequence
  Synthetic Oligonucleotide; NDFIP1 exon 2; Set C
ccgugaucaccuugcccuguuaccua

SEQ ID NO: 35458 - RNA, 19 nt, Artificial Sequence
  Synthetic Oligonucleotide; NDFIP1 exon 2; Set C
ugaucaccuugcccuguua

SEQ ID NO: 35459 - RNA, 30 nt, Artificial Sequence
  Synthetic Oligonucleotide; NDFIP1 exon 2; Set C
auuccgugaucaccuugcccuguuaccuac

SEQ ID NO: 35460 - RNA, 20 nt, Artificial Sequence
  Synthetic Oligonucleotide; NDFIP1 exon 2; Set B
gugaucaccuugcccuguua

SEQ ID NO: 35461 - RNA, 28 nt, Artificial Sequence
  Synthetic Oligonucleotide; NDFIP1 exon 2; Set C
uuccgugaucaccuugcccuguuaccua

SEQ ID NO: 35462 - RNA, 15 nt, Artificial Sequence
  Synthetic Oligonucleotide; NDFIP1 exon 2; Set C
ugaucaccuugcccu

SEQ ID NO: 35463 - RNA, 34 nt, Artificial Sequence
  Synthetic Oligonucleotide; NDFIP1 exon 2; Set C
aaggauuccgugaucaccuugcccuguuaccuac

SEQ ID NO: 35464 - RNA, 16 nt, Artificial Sequence
  Synthetic Oligonucleotide; NDFIP1 exon 2; Set C
gugaucaccuugcccu

SEQ ID NO: 35465 - RNA, 24 nt, Artificial Sequence
  Synthetic Oligonucleotide; NDFIP1 exon 2; Set B
auuccgugaucaccuugcccuguu

SEQ ID NO: 35466 - RNA, 34 nt, Artificial Sequence
  Synthetic Oligonucleotide; NDFIP1 exon 2; Set C
uaaggauuccgugaucaccuugcccuguuaccua

SEQ ID NO: 35467 - RNA, 18 nt, Artificial Sequence
  Synthetic Oligonucleotide; NDFIP1 exon 2; Set B
ccgugaucaccuugcccu

SEQ ID NO: 35468 - RNA, 23 nt, Artificial Sequence
  Synthetic Oligonucleotide; NDFIP1 exon 2; Set B
auuccgugaucaccuugcccugu

SEQ ID NO: 35469 - RNA, 22 nt, Artificial Sequence
  Synthetic Oligonucleotide; NDFIP1 exon 2; Set B
auuccgugaucaccuugcccug

SEQ ID NO: 35470 - RNA, 20 nt, Artificial Sequence
  Synthetic Oligonucleotide; NDFIP1 exon 2; Set B
uuccgugaucaccuugcccu

SEQ ID NO: 35471 - RNA, 28 nt, Artificial Sequence
  Synthetic Oligonucleotide; NDFIP1 exon 2; Set C
aaggauuccgugaucaccuugcccuguu

SEQ ID NO: 35472 - RNA, 15 nt, Artificial Sequence
  Synthetic Oligonucleotide; NDFIP1 exon 2; Set C
uuccgugaucaccuu

SEQ ID NO: 35473 - RNA, 26 nt, Artificial Sequence
  Synthetic Oligonucleotide; NDFIP1 exon 2; Set C
uaaggauuccgugaucaccuugcccu

SEQ ID NO: 35474 - RNA, 38 nt, Artificial Sequence
  Synthetic Oligonucleotide; NDFIP1 exon 2; Set C
aguguuuuuaaggauuccgugaucaccuugcccuguua

SEQ ID NO: 35475 - RNA, 21 nt, Artificial Sequence
  Synthetic Oligonucleotide; NDFIP1 exon 2; Set C
uaaggauuccgugaucaccuu

SEQ ID NO: 35476 - RNA, 20 nt, Artificial Sequence
  Synthetic Oligonucleotide; NDFIP1 exon 2; Set C
uaaggauuccgugaucaccu

SEQ ID NO: 35477 - RNA, 22 nt, Artificial Sequence
  Synthetic Oligonucleotide; NDFIP1 exon 2; Set C
uuaaggauuccgugaucaccuu

SEQ ID NO: 35478 - RNA, 17 nt, Artificial Sequence
  Synthetic Oligonucleotide; NDFIP1 exon 2; Set C
aaggauuccgugaucac

SEQ ID NO: 35479 - RNA, 23 nt, Artificial Sequence
  Synthetic Oligonucleotide; NDFIP1 exon 2; Set C
uuuaaggauuccgugaucaccuu

SEQ ID NO: 35480 - RNA, 16 nt, Artificial Sequence
  Synthetic Oligonucleotide; NDFIP1 exon 2; Set C
aaggauuccgugauca

SEQ ID NO: 35481 - RNA, 24 nt, Artificial Sequence
  Synthetic Oligonucleotide; NDFIP1 exon 2; Set C
uuuuaaggauuccgugaucaccuu

SEQ ID NO: 35482 - RNA, 15 nt, Artificial Sequence
  Synthetic Oligonucleotide; NDFIP1 exon 2; Set C
aaggauuccgugauc

SEQ ID NO: 35483 - RNA, 25 nt, Artificial Sequence
  Synthetic Oligonucleotide; NDFIP1 exon 2; Set C
uuuuuaaggauuccgugaucaccuu

SEQ ID NO: 35484 - RNA, 26 nt, Artificial Sequence
  Synthetic Oligonucleotide; NDFIP1 exon 2; Set B
guuuuuaaggauuccgugaucaccuu

SEQ ID NO: 35485 - RNA, 27 nt, Artificial Sequence
  Synthetic Oligonucleotide; NDFIP1 exon 2; Set B
uguuuuuaaggauuccgugaucaccuu

SEQ ID NO: 35486 - RNA, 28 nt, Artificial Sequence
  Synthetic Oligonucleotide; NDFIP1 exon 2; Set B
guguuuuuaaggauuccgugaucaccuu

SEQ ID NO: 35487 - RNA, 28 nt, Artificial Sequence
  Synthetic Oligonucleotide; NDFIP1 exon 2; Set B
aguguuuuuaaggauuccgugaucaccu

SEQ ID NO: 35488 - RNA, 27 nt, Artificial Sequence
  Synthetic Oligonucleotide; NDFIP1 exon 2; Set B
aguguuuuuaaggauuccgugaucacc

SEQ ID NO: 35489 - RNA, 16 nt, Artificial Sequence
  Synthetic Oligonucleotide; NDFIP1 exon 2; Set C
aguguuuuuaaggauu

SEQ ID NO: 35490 - RNA, 18 nt, Artificial Sequence
  Synthetic Oligonucleotide; NDFIP1 exon 3; Set C
gauuagcugaauugaaau

SEQ ID NO: 35491 - RNA, 19 nt, Artificial Sequence
  Synthetic Oligonucleotide; NDFIP1 exon 3; Set C
ugauuagcugaauugaaau

SEQ ID NO: 35492 - RNA, 17 nt, Artificial Sequence
  Synthetic Oligonucleotide; NDFIP1 exon 3; Set C
gauuagcugaauugaaa

SEQ ID NO: 35493 - RNA, 16 nt, Artificial Sequence
  Synthetic Oligonucleotide; NDFIP1 exon 3; Set C
gauuagcugaauugaa

SEQ ID NO: 35494 - RNA, 18 nt, Artificial Sequence
  Synthetic Oligonucleotide; NDFIP1 exon 3; Set C
ugauuagcugaauugaaa

SEQ ID NO: 35495 - RNA, 17 nt, Artificial Sequence
  Synthetic Oligonucleotide; NDFIP1 exon 3; Set C
ugauuagcugaauugaa

SEQ ID NO: 35496 - RNA, 16 nt, Artificial Sequence
  Synthetic Oligonucleotide; NDFIP1 exon 3; Set C
ugauuagcugaauuga

SEQ ID NO: 35497 - RNA, 19 nt, Artificial Sequence
  Synthetic Oligonucleotide; NDFIP1 exon 3; Set C
uaacugggcaguguuguag

SEQ ID NO: 35498 - RNA, 18 nt, Artificial Sequence
  Synthetic Oligonucleotide; NDFIP1 exon 3; Set C
uaacugggcaguguugua

SEQ ID NO: 35499 - RNA, 20 nt, Artificial Sequence
  Synthetic Oligonucleotide; NDFIP1 exon 3; Set C
auaacugggcaguguuguag

SEQ ID NO: 35500 - RNA, 17 nt, Artificial Sequence
  Synthetic Oligonucleotide; NDFIP1 exon 3; Set C
uaacugggcaguguugu

SEQ ID NO: 35501 - RNA, 19 nt, Artificial Sequence
  Synthetic Oligonucleotide; NDFIP1 exon 3; Set C
auaacugggcaguguugua

SEQ ID NO: 35502 - RNA, 21 nt, Artificial Sequence
  Synthetic Oligonucleotide; NDFIP1 exon 3; Set C
cauaacugggcaguguuguag

SEQ ID NO: 35503 - RNA, 18 nt, Artificial Sequence
  Synthetic Oligonucleotide; NDFIP1 exon 3; Set C
auaacugggcaguguugu

SEQ ID NO: 35504 - RNA, 16 nt, Artificial Sequence
  Synthetic Oligonucleotide; NDFIP1 exon 3; Set C
uaacugggcaguguug

SEQ ID NO: 35505 - RNA, 20 nt, Artificial Sequence
  Synthetic Oligonucleotide; NDFIP1 exon 3; Set C
cauaacugggcaguguugua

SEQ ID NO: 35506 - RNA, 22 nt, Artificial Sequence
  Synthetic Oligonucleotide; NDFIP1 exon 3; Set C
ucauaacugggcaguguuguag

SEQ ID NO: 35507 - RNA, 19 nt, Artificial Sequence
  Synthetic Oligonucleotide; NDFIP1 exon 3; Set C
cauaacugggcaguguugu

SEQ ID NO: 35508 - RNA, 17 nt, Artificial Sequence
  Synthetic Oligonucleotide; NDFIP1 exon 3; Set C
auaacugggcaguguug

SEQ ID NO: 35509 - RNA, 15 nt, Artificial Sequence
  Synthetic Oligonucleotide; NDFIP1 exon 3; Set C
uaacugggcaguguu

SEQ ID NO: 35510 - RNA, 21 nt, Artificial Sequence
  Synthetic Oligonucleotide; NDFIP1 exon 3; Set C
ucauaacugggcaguguugua

SEQ ID NO: 35511 - RNA, 23 nt, Artificial Sequence
  Synthetic Oligonucleotide; NDFIP1 exon 3; Set C
aucauaacugggcaguguuguag

SEQ ID NO: 35512 - RNA, 20 nt, Artificial Sequence
  Synthetic Oligonucleotide; NDFIP1 exon 3; Set C
ucauaacugggcaguguugu

SEQ ID NO: 35513 - RNA, 18 nt, Artificial Sequence
  Synthetic Oligonucleotide; NDFIP1 exon 3; Set C
cauaacugggcaguguug

SEQ ID NO: 35514 - RNA, 16 nt, Artificial Sequence
  Synthetic Oligonucleotide; NDFIP1 exon 3; Set C
auaacugggcaguguu

SEQ ID NO: 35515 - RNA, 22 nt, Artificial Sequence
  Synthetic Oligonucleotide; NDFIP1 exon 3; Set C
aucauaacugggcaguguugua

SEQ ID NO: 35516 - RNA, 21 nt, Artificial Sequence
  Synthetic Oligonucleotide; NDFIP1 exon 3; Set C
aucauaacugggcaguguugu

SEQ ID NO: 35517 - RNA, 19 nt, Artificial Sequence
  Synthetic Oligonucleotide; NDFIP1 exon 3; Set C
ucauaacugggcaguguug

SEQ ID NO: 35518 - RNA, 17 nt, Artificial Sequence
  Synthetic Oligonucleotide; NDFIP1 exon 3; Set C
cauaacugggcaguguu

SEQ ID NO: 35519 - RNA, 15 nt, Artificial Sequence
  Synthetic Oligonucleotide; NDFIP1 exon 3; Set C
auaacugggcagugu

SEQ ID NO: 35520 - RNA, 20 nt, Artificial Sequence
  Synthetic Oligonucleotide; NDFIP1 exon 3; Set C
aucauaacugggcaguguug

SEQ ID NO: 35521 - RNA, 18 nt, Artificial Sequence
  Synthetic Oligonucleotide; NDFIP1 exon 3; Set C
ucauaacugggcaguguu

SEQ ID NO: 35522 - RNA, 16 nt, Artificial Sequence
  Synthetic Oligonucleotide; NDFIP1 exon 3; Set C
cauaacugggcagugu

SEQ ID NO: 35523 - RNA, 19 nt, Artificial Sequence
  Synthetic Oligonucleotide; NDFIP1 exon 3; Set C
aucauaacugggcaguguu

SEQ ID NO: 35524 - RNA, 17 nt, Artificial Sequence
  Synthetic Oligonucleotide; NDFIP1 exon 3; Set C
ucauaacugggcagugu

SEQ ID NO: 35525 - RNA, 18 nt, Artificial Sequence
  Synthetic Oligonucleotide; NDFIP1 exon 3; Set C
aucauaacugggcagugu

SEQ ID NO: 35526 - RNA, 17 nt, Artificial Sequence
  Synthetic Oligonucleotide; NDFIP1 exon 3; Set C
auuagcugaauugaaau

SEQ ID NO: 35527 - RNA, 16 nt, Artificial Sequence
  Synthetic Oligonucleotide; NDFIP1 exon 3; Set C
auuagcugaauugaaa

SEQ ID NO: 35528 - RNA, 15 nt, Artificial Sequence
  Synthetic Oligonucleotide; NDFIP1 exon 3; Set C
auuagcugaauugaa

SEQ ID NO: 35529 - RNA, 15 nt, Artificial Sequence
  Synthetic Oligonucleotide; NDFIP1 exon 3; Set C
gauuagcugaauuga

SEQ ID NO: 35530 - RNA, 15 nt, Artificial Sequence
  Synthetic Oligonucleotide; NDFIP1 exon 3; Set C
ugauuagcugaauug

SEQ ID NO: 35531 - RNA, 28 nt, Artificial Sequence
  Synthetic Oligonucleotide; NDFIP1 exon 3; Set C
auuuuuugaugauuagcugaauugaaau

SEQ ID NO: 35532 - RNA, 27 nt, Artificial Sequence
  Synthetic Oligonucleotide; NDFIP1 exon 3; Set C
auuuuuugaugauuagcugaauugaaa

SEQ ID NO: 35533 - RNA, 26 nt, Artificial Sequence
  Synthetic Oligonucleotide; NDFIP1 exon 3; Set C
auuuuuugaugauuagcugaauugaa

SEQ ID NO: 35534 - RNA, 25 nt, Artificial Sequence
  Synthetic Oligonucleotide; NDFIP1 exon 3; Set C
auuuuuugaugauuagcugaauuga

SEQ ID NO: 35535 - RNA, 24 nt, Artificial Sequence
  Synthetic Oligonucleotide; NDFIP1 exon 3; Set C
auuuuuugaugauuagcugaauug

SEQ ID NO: 35536 - RNA, 23 nt, Artificial Sequence
  Synthetic Oligonucleotide; NDFIP1 exon 3; Set C
auuuuuugaugauuagcugaauu

SEQ ID NO: 35537 - RNA, 22 nt, Artificial Sequence
  Synthetic Oligonucleotide; NDFIP1 exon 3; Set C
auuuuuugaugauuagcugaau

SEQ ID NO: 35538 - RNA, 21 nt, Artificial Sequence
  Synthetic Oligonucleotide; NDFIP1 exon 3; Set C
auuuuuugaugauuagcugaa

SEQ ID NO: 35539 - RNA, 20 nt, Artificial Sequence
  Synthetic Oligonucleotide; NDFIP1 exon 3; Set C
auuuuuugaugauuagcuga

SEQ ID NO: 35540 - RNA, 40 nt, Artificial Sequence
  Synthetic Oligonucleotide; NDFIP1 exon 3; Set A
uuaacagucacaauuuuuugaugauuagcugaauugaaau

SEQ ID NO: 35541 - RNA, 39 nt, Artificial Sequence
  Synthetic Oligonucleotide; NDFIP1 exon 3; Set A
uuaacagucacaauuuuuugaugauuagcugaauugaaa

SEQ ID NO: 35542 - RNA, 40 nt, Artificial Sequence
  Synthetic Oligonucleotide; NDFIP1 exon 3; Set A
uuuaacagucacaauuuuuugaugauuagcugaauugaaa

SEQ ID NO: 35543 - RNA, 38 nt, Artificial Sequence
  Synthetic Oligonucleotide; NDFIP1 exon 3; Set A
uuaacagucacaauuuuuugaugauuagcugaauugaa

SEQ ID NO: 35544 - RNA, 39 nt, Artificial Sequence
  Synthetic Oligonucleotide; NDFIP1 exon 3; Set A
uuuaacagucacaauuuuuugaugauuagcugaauugaa

SEQ ID NO: 35545 - RNA, 37 nt, Artificial Sequence
  Synthetic Oligonucleotide; NDFIP1 exon 3; Set A
uuaacagucacaauuuuuugaugauuagcugaauuga

SEQ ID NO: 35546 - RNA, 40 nt, Artificial Sequence
  Synthetic Oligonucleotide; NDFIP1 exon 3; Set A
uuuuaacagucacaauuuuuugaugauuagcugaauugaa

SEQ ID NO: 35547 - RNA, 38 nt, Artificial Sequence
  Synthetic Oligonucleotide; NDFIP1 exon 3; Set A
uuuaacagucacaauuuuuugaugauuagcugaauuga

SEQ ID NO: 35548 - RNA, 36 nt, Artificial Sequence
  Synthetic Oligonucleotide; NDFIP1 exon 3; Set A
uuaacagucacaauuuuuugaugauuagcugaauug

SEQ ID NO: 35549 - RNA, 39 nt, Artificial Sequence
  Synthetic Oligonucleotide; NDFIP1 exon 3; Set A
uuuuaacagucacaauuuuuugaugauuagcugaauuga

SEQ ID NO: 35550 - RNA, 37 nt, Artificial Sequence
  Synthetic Oligonucleotide; NDFIP1 exon 3; Set A
uuuaacagucacaauuuuuugaugauuagcugaauug

SEQ ID NO: 35551 - RNA, 40 nt, Artificial Sequence
  Synthetic Oligonucleotide; NDFIP1 exon 3; Set A
auuuuaacagucacaauuuuuugaugauuagcugaauuga

SEQ ID NO: 35552 - RNA, 36 nt, Artificial Sequence
  Synthetic Oligonucleotide; NDFIP1 exon 3; Set A
uuuaacagucacaauuuuuugaugauuagcugaauu

SEQ ID NO: 35553 - RNA, 38 nt, Artificial Sequence
  Synthetic Oligonucleotide; NDFIP1 exon 3; Set A
uuuuaacagucacaauuuuuugaugauuagcugaauug

SEQ ID NO: 35554 - RNA, 37 nt, Artificial Sequence
  Synthetic Oligonucleotide; NDFIP1 exon 3; Set A
uuuuaacagucacaauuuuuugaugauuagcugaauu

SEQ ID NO: 35555 - RNA, 39 nt, Artificial Sequence
  Synthetic Oligonucleotide; NDFIP1 exon 3; Set A
auuuuaacagucacaauuuuuugaugauuagcugaauug

SEQ ID NO: 35556 - RNA, 38 nt, Artificial Sequence
  Synthetic Oligonucleotide; NDFIP1 exon 3; Set A
auuuuaacagucacaauuuuuugaugauuagcugaauu

SEQ ID NO: 35557 - RNA, 36 nt, Artificial Sequence
  Synthetic Oligonucleotide; NDFIP1 exon 3; Set A
uuuuaacagucacaauuuuuugaugauuagcugaau

SEQ ID NO: 35558 - RNA, 40 nt, Artificial Sequence
  Synthetic Oligonucleotide; NDFIP1 exon 3; Set A
aauuuuaacagucacaauuuuuugaugauuagcugaauug

SEQ ID NO: 35559 - RNA, 37 nt, Artificial Sequence
  Synthetic Oligonucleotide; NDFIP1 exon 3; Set A
auuuuaacagucacaauuuuuugaugauuagcugaau

SEQ ID NO: 35560 - RNA, 39 nt, Artificial Sequence
  Synthetic Oligonucleotide; NDFIP1 exon 3; Set A
aauuuuaacagucacaauuuuuugaugauuagcugaauu

SEQ ID NO: 35561 - RNA, 36 nt, Artificial Sequence
  Synthetic Oligonucleotide; NDFIP1 exon 3; Set A
auuuuaacagucacaauuuuuugaugauuagcugaa

SEQ ID NO: 35562 - RNA, 40 nt, Artificial Sequence
  Synthetic Oligonucleotide; NDFIP1 exon 3; Set A
gaauuuuaacagucacaauuuuuugaugauuagcugaauu

SEQ ID NO: 35563 - RNA, 38 nt, Artificial Sequence
  Synthetic Oligonucleotide; NDFIP1 exon 3; Set A
aauuuuaacagucacaauuuuuugaugauuagcugaau

SEQ ID NO: 35564 - RNA, 37 nt, Artificial Sequence
  Synthetic Oligonucleotide; NDFIP1 exon 3; Set A
aauuuuaacagucacaauuuuuugaugauuagcugaa

SEQ ID NO: 35565 - RNA, 39 nt, Artificial Sequence
  Synthetic Oligonucleotide; NDFIP1 exon 3; Set A
gaauuuuaacagucacaauuuuuugaugauuagcugaau

SEQ ID NO: 35566 - RNA, 38 nt, Artificial Sequence
  Synthetic Oligonucleotide; NDFIP1 exon 3; Set A
gaauuuuaacagucacaauuuuuugaugauuagcugaa

SEQ ID NO: 35567 - RNA, 40 nt, Artificial Sequence
  Synthetic Oligonucleotide; NDFIP1 exon 3; Set A
agaauuuuaacagucacaauuuuuugaugauuagcugaau

SEQ ID NO: 35568 - RNA, 39 nt, Artificial Sequence
  Synthetic Oligonucleotide; NDFIP1 exon 3; Set A
agaauuuuaacagucacaauuuuuugaugauuagcugaa

SEQ ID NO: 35569 - RNA, 30 nt, Artificial Sequence
  Synthetic Oligonucleotide; NDFIP1 exon 3; Set C
gaauuuuaacagucacaauuuuuugaugau

SEQ ID NO: 35570 - RNA, 31 nt, Artificial Sequence
  Synthetic Oligonucleotide; NDFIP1 exon 3; Set C
agaauuuuaacagucacaauuuuuugaugau

SEQ ID NO: 35571 - RNA, 15 nt, Artificial Sequence
  Synthetic Oligonucleotide; NDFIP1 exon 3; Set C
uuguagcuacauugu

SEQ ID NO: 35572 - RNA, 16 nt, Artificial Sequence
  Synthetic Oligonucleotide; NDFIP1 exon 3; Set C
guuguagcuacauugu

SEQ ID NO: 35573 - RNA, 15 nt, Artificial Sequence
  Synthetic Oligonucleotide; NDFIP1 exon 3; Set C
guuguagcuacauug

SEQ ID NO: 35574 - RNA, 17 nt, Artificial Sequence
  Synthetic Oligonucleotide; NDFIP1 exon 3; Set C
uguuguagcuacauugu

SEQ ID NO: 35575 - RNA, 16 nt, Artificial Sequence
  Synthetic Oligonucleotide; NDFIP1 exon 3; Set C
uguuguagcuacauug

SEQ ID NO: 35576 - RNA, 18 nt, Artificial Sequence
  Synthetic Oligonucleotide; NDFIP1 exon 3; Set C
guguuguagcuacauugu

SEQ ID NO: 35577 - RNA, 15 nt, Artificial Sequence
  Synthetic Oligonucleotide; NDFIP1 exon 3; Set C
uguuguagcuacauu

SEQ ID NO: 35578 - RNA, 24 nt, Artificial Sequence
  Synthetic Oligonucleotide; NDFIP1 exon 3; Set A
ugggcaguguuguagcuacauugu

SEQ ID NO: 35579 - RNA, 23 nt, Artificial Sequence
  Synthetic Oligonucleotide; NDFIP1 exon 3; Set A
ugggcaguguuguagcuacauug

SEQ ID NO: 35580 - RNA, 22 nt, Artificial Sequence
  Synthetic Oligonucleotide; NDFIP1 exon 3; Set A
ugggcaguguuguagcuacauu

SEQ ID NO: 35581 - RNA, 28 nt, Artificial Sequence
  Synthetic Oligonucleotide; NDFIP1 exon 3; Set A
uaacugggcaguguuguagcuacauugu

SEQ ID NO: 35582 - RNA, 27 nt, Artificial Sequence
  Synthetic Oligonucleotide; NDFIP1 exon 3; Set A
uaacugggcaguguuguagcuacauug

SEQ ID NO: 35583 - RNA, 29 nt, Artificial Sequence
  Synthetic Oligonucleotide; NDFIP1 exon 3; Set A
auaacugggcaguguuguagcuacauugu

SEQ ID NO: 35584 - RNA, 26 nt, Artificial Sequence
  Synthetic Oligonucleotide; NDFIP1 exon 3; Set A
uaacugggcaguguuguagcuacauu

SEQ ID NO: 35585 - RNA, 28 nt, Artificial Sequence
  Synthetic Oligonucleotide; NDFIP1 exon 3; Set A
auaacugggcaguguuguagcuacauug

SEQ ID NO: 35586 - RNA, 30 nt, Artificial Sequence
  Synthetic Oligonucleotide; NDFIP1 exon 3; Set C
cauaacugggcaguguuguagcuacauugu

SEQ ID NO: 35587 - RNA, 27 nt, Artificial Sequence
  Synthetic Oligonucleotide; NDFIP1 exon 3; Set A
auaacugggcaguguuguagcuacauu

SEQ ID NO: 35588 - RNA, 29 nt, Artificial Sequence
  Synthetic Oligonucleotide; NDFIP1 exon 3; Set A
cauaacugggcaguguuguagcuacauug

SEQ ID NO: 35589 - RNA, 31 nt, Artificial Sequence
  Synthetic Oligonucleotide; NDFIP1 exon 3; Set C
ucauaacugggcaguguuguagcuacauugu

SEQ ID NO: 35590 - RNA, 28 nt, Artificial Sequence
  Synthetic Oligonucleotide; NDFIP1 exon 3; Set A
cauaacugggcaguguuguagcuacauu

SEQ ID NO: 35591 - RNA, 30 nt, Artificial Sequence
  Synthetic Oligonucleotide; NDFIP1 exon 3; Set A
ucauaacugggcaguguuguagcuacauug

SEQ ID NO: 35592 - RNA, 32 nt, Artificial Sequence
  Synthetic Oligonucleotide; NDFIP1 exon 3; Set C
aucauaacugggcaguguuguagcuacauugu

SEQ ID NO: 35593 - RNA, 29 nt, Artificial Sequence
  Synthetic Oligonucleotide; NDFIP1 exon 3; Set A
ucauaacugggcaguguuguagcuacauu

SEQ ID NO: 35594 - RNA, 31 nt, Artificial Sequence
  Synthetic Oligonucleotide; NDFIP1 exon 3; Set A
aucauaacugggcaguguuguagcuacauug

SEQ ID NO: 35595 - RNA, 15 nt, Artificial Sequence
  Synthetic Oligonucleotide; NDFIP1 exon 3; Set C
ugggcaguguuguag

SEQ ID NO: 35596 - RNA, 30 nt, Artificial Sequence
  Synthetic Oligonucleotide; NDFIP1 exon 3; Set A
aucauaacugggcaguguuguagcuacauu

SEQ ID NO: 35597 - RNA, 15 nt, Artificial Sequence
  Synthetic Oligonucleotide; NDFIP1 exon 3; Set C
cugggcaguguugua

SEQ ID NO: 35598 - RNA, 29 nt, Artificial Sequence
  Synthetic Oligonucleotide; NDFIP1 exon 3; Set A
aucauaacugggcaguguuguagcuacau

SEQ ID NO: 35599 - RNA, 16 nt, Artificial Sequence
  Synthetic Oligonucleotide; NDFIP1 exon 3; Set C
acugggcaguguugua

SEQ ID NO: 35600 - RNA, 15 nt, Artificial Sequence
  Synthetic Oligonucleotide; NDFIP1 exon 3; Set C
acugggcaguguugu

SEQ ID NO: 35601 - RNA, 16 nt, Artificial Sequence
  Synthetic Oligonucleotide; NDFIP1 exon 3; Set C
aacugggcaguguugu

SEQ ID NO: 35602 - RNA, 38 nt, Artificial Sequence
  Synthetic Oligonucleotide; NDFIP1 exon 3; Set C
cgcuucaucauaacugggcaguguuguagcuacauugu

SEQ ID NO: 35603 - RNA, 15 nt, Artificial Sequence
  Synthetic Oligonucleotide; NDFIP1 exon 3; Set C
aacugggcaguguug

SEQ ID NO: 35604 - RNA, 37 nt, Artificial Sequence
  Synthetic Oligonucleotide; NDFIP1 exon 3; Set C
cgcuucaucauaacugggcaguguuguagcuacauug

SEQ ID NO: 35605 - RNA, 39 nt, Artificial Sequence
  Synthetic Oligonucleotide; NDFIP1 exon 3; Set C
ccgcuucaucauaacugggcaguguuguagcuacauugu

SEQ ID NO: 35606 - RNA, 36 nt, Artificial Sequence
  Synthetic Oligonucleotide; NDFIP1 exon 3; Set C
cgcuucaucauaacugggcaguguuguagcuacauu

SEQ ID NO: 35607 - RNA, 38 nt, Artificial Sequence
  Synthetic Oligonucleotide; NDFIP1 exon 3; Set C
ccgcuucaucauaacugggcaguguuguagcuacauug

SEQ ID NO: 35608 - RNA, 37 nt, Artificial Sequence
  Synthetic Oligonucleotide; NDFIP1 exon 3; Set C
ccgcuucaucauaacugggcaguguuguagcuacauu

SEQ ID NO: 35609 - RNA, 22 nt, Artificial Sequence
  Synthetic Oligonucleotide; NDFIP1 exon 3; Set A
caucauaacugggcaguguugu

SEQ ID NO: 35610 - RNA, 23 nt, Artificial Sequence
  Synthetic Oligonucleotide; NDFIP1 exon 3; Set A
ucaucauaacugggcaguguugu

SEQ ID NO: 35611 - RNA, 21 nt, Artificial Sequence
  Synthetic Oligonucleotide; NDFIP1 exon 3; Set C
caucauaacugggcaguguug

SEQ ID NO: 35612 - RNA, 27 nt, Artificial Sequence
  Synthetic Oligonucleotide; NDFIP1 exon 3; Set A
cuucaucauaacugggcaguguuguag

SEQ ID NO: 35613 - RNA, 15 nt, Artificial Sequence
  Synthetic Oligonucleotide; NDFIP1 exon 3; Set C
cauaacugggcagug

SEQ ID NO: 35614 - RNA, 22 nt, Artificial Sequence
  Synthetic Oligonucleotide; NDFIP1 exon 3; Set C
ucaucauaacugggcaguguug

SEQ ID NO: 35615 - RNA, 20 nt, Artificial Sequence
  Synthetic Oligonucleotide; NDFIP1 exon 3; Set C
caucauaacugggcaguguu

SEQ ID NO: 35616 - RNA, 26 nt, Artificial Sequence
  Synthetic Oligonucleotide; NDFIP1 exon 3; Set A
cuucaucauaacugggcaguguugua

SEQ ID NO: 35617 - RNA, 16 nt, Artificial Sequence
  Synthetic Oligonucleotide; NDFIP1 exon 3; Set C
ucauaacugggcagug

SEQ ID NO: 35618 - RNA, 25 nt, Artificial Sequence
  Synthetic Oligonucleotide; NDFIP1 exon 3; Set A
cuucaucauaacugggcaguguugu

SEQ ID NO: 35619 - RNA, 21 nt, Artificial Sequence
  Synthetic Oligonucleotide; NDFIP1 exon 3; Set C
ucaucauaacugggcaguguu

SEQ ID NO: 35620 - RNA, 19 nt, Artificial Sequence
  Synthetic Oligonucleotide; NDFIP1 exon 3; Set C
caucauaacugggcagugu

SEQ ID NO: 35621 - RNA, 29 nt, Artificial Sequence
  Synthetic Oligonucleotide; NDFIP1 exon 3; Set A
cgcuucaucauaacugggcaguguuguag

SEQ ID NO: 35622 - RNA, 17 nt, Artificial Sequence
  Synthetic Oligonucleotide; NDFIP1 exon 3; Set C
aucauaacugggcagug

SEQ ID NO: 35623 - RNA, 15 nt, Artificial Sequence
  Synthetic Oligonucleotide; NDFIP1 exon 3; Set C
ucauaacugggcagu

SEQ ID NO: 35624 - RNA, 26 nt, Artificial Sequence
  Synthetic Oligonucleotide; NDFIP1 exon 3; Set A
gcuucaucauaacugggcaguguugu

SEQ ID NO: 35625 - RNA, 24 nt, Artificial Sequence
  Synthetic Oligonucleotide; NDFIP1 exon 3; Set A
cuucaucauaacugggcaguguug

SEQ ID NO: 35626 - RNA, 20 nt, Artificial Sequence
  Synthetic Oligonucleotide; NDFIP1 exon 3; Set C
ucaucauaacugggcagugu

SEQ ID NO: 35627 - RNA, 28 nt, Artificial Sequence
  Synthetic Oligonucleotide; NDFIP1 exon 3; Set C
cgcuucaucauaacugggcaguguugua

SEQ ID NO: 35628 - RNA, 30 nt, Artificial Sequence
  Synthetic Oligonucleotide; NDFIP1 exon 3; Set C
ccgcuucaucauaacugggcaguguuguag

SEQ ID NO: 35629 - RNA, 16 nt, Artificial Sequence
  Synthetic Oligonucleotide; NDFIP1 exon 3; Set C
aucauaacugggcagu

SEQ ID NO: 35630 - RNA, 27 nt, Artificial Sequence
  Synthetic Oligonucleotide; NDFIP1 exon 3; Set A
cgcuucaucauaacugggcaguguugu

SEQ ID NO: 35631 - RNA, 25 nt, Artificial Sequence
  Synthetic Oligonucleotide; NDFIP1 exon 3; Set A
gcuucaucauaacugggcaguguug

SEQ ID NO: 35632 - RNA, 23 nt, Artificial Sequence
  Synthetic Oligonucleotide; NDFIP1 exon 3; Set A
cuucaucauaacugggcaguguu

SEQ ID NO: 35633 - RNA, 29 nt, Artificial Sequence
  Synthetic Oligonucleotide; NDFIP1 exon 3; Set C
ccgcuucaucauaacugggcaguguugua

SEQ ID NO: 35634 - RNA, 15 nt, Artificial Sequence
  Synthetic Oligonucleotide; NDFIP1 exon 3; Set C
aucauaacugggcag

SEQ ID NO: 35635 - RNA, 28 nt, Artificial Sequence
  Synthetic Oligonucleotide; NDFIP1 exon 3; Set C
ccgcuucaucauaacugggcaguguugu

SEQ ID NO: 35636 - RNA, 26 nt, Artificial Sequence
  Synthetic Oligonucleotide; NDFIP1 exon 3; Set A
cgcuucaucauaacugggcaguguug

SEQ ID NO: 35637 - RNA, 24 nt, Artificial Sequence
  Synthetic Oligonucleotide; NDFIP1 exon 3; Set A
gcuucaucauaacugggcaguguu

SEQ ID NO: 35638 - RNA, 22 nt, Artificial Sequence
  Synthetic Oligonucleotide; NDFIP1 exon 3; Set A
cuucaucauaacugggcagugu

SEQ ID NO: 35639 - RNA, 27 nt, Artificial Sequence
  Synthetic Oligonucleotide; NDFIP1 exon 3; Set C
ccgcuucaucauaacugggcaguguug

SEQ ID NO: 35640 - RNA, 25 nt, Artificial Sequence
  Synthetic Oligonucleotide; NDFIP1 exon 3; Set A
cgcuucaucauaacugggcaguguu

SEQ ID NO: 35641 - RNA, 23 nt, Artificial Sequence
  Synthetic Oligonucleotide; NDFIP1 exon 3; Set A
gcuucaucauaacugggcagugu

SEQ ID NO: 35642 - RNA, 26 nt, Artificial Sequence
  Synthetic Oligonucleotide; NDFIP1 exon 3; Set C
ccgcuucaucauaacugggcaguguu

SEQ ID NO: 35643 - RNA, 24 nt, Artificial Sequence
  Synthetic Oligonucleotide; NDFIP1 exon 3; Set A
cgcuucaucauaacugggcagugu

SEQ ID NO: 35644 - RNA, 25 nt, Artificial Sequence
  Synthetic Oligonucleotide; NDFIP1 exon 3; Set A
ccgcuucaucauaacugggcagugu

SEQ ID NO: 35645 - RNA, 23 nt, Artificial Sequence
  Synthetic Oligonucleotide; NDFIP1 exon 3; Set A
cgcuucaucauaacugggcagug

SEQ ID NO: 35646 - RNA, 24 nt, Artificial Sequence
  Synthetic Oligonucleotide; NDFIP1 exon 3; Set A
ccgcuucaucauaacugggcagug

SEQ ID NO: 35647 - RNA, 22 nt, Artificial Sequence
  Synthetic Oligonucleotide; NDFIP1 exon 3; Set A
cgcuucaucauaacugggcagu

SEQ ID NO: 35648 - RNA, 39 nt, Artificial Sequence
  Synthetic Oligonucleotide; NDFIP1 exon 3; Set C
ugguccucuccgcuucaucauaacugggcaguguuguag

SEQ ID NO: 35649 - RNA, 38 nt, Artificial Sequence
  Synthetic Oligonucleotide; NDFIP1 exon 3; Set C
ugguccucuccgcuucaucauaacugggcaguguugua

SEQ ID NO: 35650 - RNA, 40 nt, Artificial Sequence
  Synthetic Oligonucleotide; NDFIP1 exon 3; Set C
uugguccucuccgcuucaucauaacugggcaguguuguag

SEQ ID NO: 35651 - RNA, 37 nt, Artificial Sequence
  Synthetic Oligonucleotide; NDFIP1 exon 3; Set C
ugguccucuccgcuucaucauaacugggcaguguugu

SEQ ID NO: 35652 - RNA, 39 nt, Artificial Sequence
  Synthetic Oligonucleotide; NDFIP1 exon 3; Set C
uugguccucuccgcuucaucauaacugggcaguguugua

SEQ ID NO: 35653 - RNA, 17 nt, Artificial Sequence
  Synthetic Oligonucleotide; NDFIP1 exon 3; Set C
cgcuucaucauaacugg

SEQ ID NO: 35654 - RNA, 38 nt, Artificial Sequence
  Synthetic Oligonucleotide; NDFIP1 exon 3; Set C
uugguccucuccgcuucaucauaacugggcaguguugu

SEQ ID NO: 35655 - RNA, 36 nt, Artificial Sequence
  Synthetic Oligonucleotide; NDFIP1 exon 3; Set C
ugguccucuccgcuucaucauaacugggcaguguug

SEQ ID NO: 35656 - RNA, 18 nt, Artificial Sequence
  Synthetic Oligonucleotide; NDFIP1 exon 3; Set C
ccgcuucaucauaacugg

SEQ ID NO: 35657 - RNA, 37 nt, Artificial Sequence
  Synthetic Oligonucleotide; NDFIP1 exon 3; Set C
uugguccucuccgcuucaucauaacugggcaguguug

SEQ ID NO: 35658 - RNA, 35 nt, Artificial Sequence
  Synthetic Oligonucleotide; NDFIP1 exon 3; Set C
ugguccucuccgcuucaucauaacugggcaguguu

SEQ ID NO: 35659 - RNA, 36 nt, Artificial Sequence
  Synthetic Oligonucleotide; NDFIP1 exon 3; Set C
uugguccucuccgcuucaucauaacugggcaguguu

SEQ ID NO: 35660 - RNA, 34 nt, Artificial Sequence
  Synthetic Oligonucleotide; NDFIP1 exon 3; Set C
ugguccucuccgcuucaucauaacugggcagugu

SEQ ID NO: 35661 - RNA, 35 nt, Artificial Sequence
  Synthetic Oligonucleotide; NDFIP1 exon 3; Set C
uugguccucuccgcuucaucauaacugggcagugu

SEQ ID NO: 35662 - RNA, 34 nt, Artificial Sequence
  Synthetic Oligonucleotide; NDFIP1 exon 3; Set C
uugguccucuccgcuucaucauaacugggcagug

SEQ ID NO: 35663 - RNA, 33 nt, Artificial Sequence
  Synthetic Oligonucleotide; NDFIP1 exon 3; Set C
uugguccucuccgcuucaucauaacugggcagu

SEQ ID NO: 35664 - RNA, 28 nt, Artificial Sequence
  Synthetic Oligonucleotide; NDFIP1 exon 3; Set C
uugguccucuccgcuucaucauaacugg

SEQ ID NO: 35665 - RNA, 23 nt, Artificial Sequence
  Synthetic Oligonucleotide; NDFIP1 exon 3; Set A
ugguccucuccgcuucaucauaa

SEQ ID NO: 35666 - RNA, 24 nt, Artificial Sequence
  Synthetic Oligonucleotide; NDFIP1 exon 3; Set A
uugguccucuccgcuucaucauaa

SEQ ID NO: 35667 - RNA, 22 nt, Artificial Sequence
  Synthetic Oligonucleotide; NDFIP1 exon 3; Set A
ugguccucuccgcuucaucaua

SEQ ID NO: 35668 - RNA, 23 nt, Artificial Sequence
  Synthetic Oligonucleotide; NDFIP1 exon 3; Set A
uugguccucuccgcuucaucaua

SEQ ID NO: 35669 - RNA, 22 nt, Artificial Sequence
  Synthetic Oligonucleotide; NDFIP1 exon 3; Set A
uugguccucuccgcuucaucau

SEQ ID NO: 35670 - RNA, 21 nt, Artificial Sequence
  Synthetic Oligonucleotide; NDFIP1 exon 3; Set A
uugguccucuccgcuucauca

SEQ ID NO: 35671 - RNA, 20 nt, Artificial Sequence
  Synthetic Oligonucleotide; NDFIP1 exon 3; Set A
uugguccucuccgcuucauc

SEQ ID NO: 35672 - RNA, 30 nt, Artificial Sequence
  Synthetic Oligonucleotide; NDFIP1 exon 3; Set C
ucagccuugguccucuccgcuucaucauaa

SEQ ID NO: 35673 - RNA, 31 nt, Artificial Sequence
  Synthetic Oligonucleotide; NDFIP1 exon 3; Set C
uucagccuugguccucuccgcuucaucauaa

SEQ ID NO: 35674 - RNA, 30 nt, Artificial Sequence
  Synthetic Oligonucleotide; NDFIP1 exon 3; Set C
uucagccuugguccucuccgcuucaucaua

SEQ ID NO: 35675 - RNA, 29 nt, Artificial Sequence
  Synthetic Oligonucleotide; NDFIP1 exon 3; Set C
uucagccuugguccucuccgcuucaucau

SEQ ID NO: 35676 - RNA, 27 nt, Artificial Sequence
  Synthetic Oligonucleotide; NDFIP1 exon 3; Set C
uucagccuugguccucuccgcuucauc

SEQ ID NO: 35677 - RNA, 37 nt, Artificial Sequence
  Synthetic Oligonucleotide; NDFIP1 exon 3; Set C
aguagcuucagccuugguccucuccgcuucaucauaa

SEQ ID NO: 35678 - RNA, 38 nt, Artificial Sequence
  Synthetic Oligonucleotide; NDFIP1 exon 3; Set C
uaguagcuucagccuugguccucuccgcuucaucauaa

SEQ ID NO: 35679 - RNA, 36 nt, Artificial Sequence
  Synthetic Oligonucleotide; NDFIP1 exon 3; Set C
aguagcuucagccuugguccucuccgcuucaucaua

SEQ ID NO: 35680 - RNA, 37 nt, Artificial Sequence
  Synthetic Oligonucleotide; NDFIP1 exon 3; Set C
uaguagcuucagccuugguccucuccgcuucaucaua

SEQ ID NO: 35681 - RNA, 35 nt, Artificial Sequence
  Synthetic Oligonucleotide; NDFIP1 exon 3; Set C
aguagcuucagccuugguccucuccgcuucaucau

SEQ ID NO: 35682 - RNA, 36 nt, Artificial Sequence
  Synthetic Oligonucleotide; NDFIP1 exon 3; Set C
uaguagcuucagccuugguccucuccgcuucaucau

SEQ ID NO: 35683 - RNA, 34 nt, Artificial Sequence
  Synthetic Oligonucleotide; NDFIP1 exon 3; Set C
aguagcuucagccuugguccucuccgcuucauca

SEQ ID NO: 35684 - RNA, 33 nt, Artificial Sequence
  Synthetic Oligonucleotide; NDFIP1 exon 3; Set C
aguagcuucagccuugguccucuccgcuucauc

SEQ ID NO: 35685 - RNA, 35 nt, Artificial Sequence
  Synthetic Oligonucleotide; NDFIP1 exon 3; Set C
uaguagcuucagccuugguccucuccgcuucauca

SEQ ID NO: 35686 - RNA, 34 nt, Artificial Sequence
  Synthetic Oligonucleotide; NDFIP1 exon 3; Set C
uaguagcuucagccuugguccucuccgcuucauc

SEQ ID NO: 35687 - RNA, 17 nt, Artificial Sequence
  Synthetic Oligonucleotide; NDFIP1 exon 3; Set C
aguagcuucagccuugg

SEQ ID NO: 35688 - RNA, 16 nt, Artificial Sequence
  Synthetic Oligonucleotide; NDFIP1 exon 3; Set C
aguagcuucagccuug

SEQ ID NO: 35689 - RNA, 18 nt, Artificial Sequence
  Synthetic Oligonucleotide; NDFIP1 exon 3; Set C
uaguagcuucagccuugg

SEQ ID NO: 35690 - RNA, 17 nt, Artificial Sequence
  Synthetic Oligonucleotide; NDFIP1 exon 3; Set C
uaguagcuucagccuug

SEQ ID NO: 35691 - RNA, 25 nt, Artificial Sequence
  Synthetic Oligonucleotide; NDFIP1 exon 3; Set A
aaagggauaguagcuucagccuugg

SEQ ID NO: 35692 - RNA, 24 nt, Artificial Sequence
  Synthetic Oligonucleotide; NDFIP1 exon 3; Set A
aaagggauaguagcuucagccuug

SEQ ID NO: 35693 - RNA, 18 nt, Artificial Sequence
  Synthetic Oligonucleotide; NDFIP1 exon 3; Set C
aaagggauaguagcuuca

SEQ ID NO: 35694 - RNA, 17 nt, Artificial Sequence
  Synthetic Oligonucleotide; NDFIP1 exon 3; Set C
aaagggauaguagcuuc

SEQ ID NO: 35695 - RNA, 15 nt, Artificial Sequence
  Synthetic Oligonucleotide; NDFIP1 exon 3; Set C
aacauggcaaauuau

SEQ ID NO: 35696 - RNA, 16 nt, Artificial Sequence
  Synthetic Oligonucleotide; NDFIP1 exon 3; Set C
uaacauggcaaauuau

SEQ ID NO: 35697 - RNA, 15 nt, Artificial Sequence
  Synthetic Oligonucleotide; NDFIP1 exon 3; Set C
uaacauggcaaauua

SEQ ID NO: 35698 - RNA, 17 nt, Artificial Sequence
  Synthetic Oligonucleotide; NDFIP1 exon 3; Set C
guaacauggcaaauuau

SEQ ID NO: 35699 - RNA, 16 nt, Artificial Sequence
  Synthetic Oligonucleotide; NDFIP1 exon 3; Set C
guaacauggcaaauua

SEQ ID NO: 35700 - RNA, 15 nt, Artificial Sequence
  Synthetic Oligonucleotide; NDFIP1 exon 3; Set C
guaacauggcaaauu

SEQ ID NO: 35701 - RNA, 35 nt, Artificial Sequence
  Synthetic Oligonucleotide; NDFIP1 exon 3; Set A
uuaacagucacaauuuuuugaugauuagcugaauu

SEQ ID NO: 35702 - RNA, 34 nt, Artificial Sequence
  Synthetic Oligonucleotide; NDFIP1 exon 3; Set A
uuaacagucacaauuuuuugaugauuagcugaau

SEQ ID NO: 35703 - RNA, 33 nt, Artificial Sequence
  Synthetic Oligonucleotide; NDFIP1 exon 3; Set A
uuaacagucacaauuuuuugaugauuagcugaa

SEQ ID NO: 35704 - RNA, 35 nt, Artificial Sequence
  Synthetic Oligonucleotide; NDFIP1 exon 3; Set A
uuuaacagucacaauuuuuugaugauuagcugaau

SEQ ID NO: 35705 - RNA, 34 nt, Artificial Sequence
  Synthetic Oligonucleotide; NDFIP1 exon 3; Set A
uuuaacagucacaauuuuuugaugauuagcugaa

SEQ ID NO: 35706 - RNA, 32 nt, Artificial Sequence
  Synthetic Oligonucleotide; NDFIP1 exon 3; Set A
uuaacagucacaauuuuuugaugauuagcuga

SEQ ID NO: 35707 - RNA, 35 nt, Artificial Sequence
  Synthetic Oligonucleotide; NDFIP1 exon 3; Set A
uuuuaacagucacaauuuuuugaugauuagcugaa

SEQ ID NO: 35708 - RNA, 33 nt, Artificial Sequence
  Synthetic Oligonucleotide; NDFIP1 exon 3; Set A
uuuaacagucacaauuuuuugaugauuagcuga

SEQ ID NO: 35709 - RNA, 34 nt, Artificial Sequence
  Synthetic Oligonucleotide; NDFIP1 exon 3; Set A
uuuuaacagucacaauuuuuugaugauuagcuga

SEQ ID NO: 35710 - RNA, 35 nt, Artificial Sequence
  Synthetic Oligonucleotide; NDFIP1 exon 3; Set A
auuuuaacagucacaauuuuuugaugauuagcuga

SEQ ID NO: 35711 - RNA, 36 nt, Artificial Sequence
  Synthetic Oligonucleotide; NDFIP1 exon 3; Set A
aauuuuaacagucacaauuuuuugaugauuagcuga

SEQ ID NO: 35712 - RNA, 37 nt, Artificial Sequence
  Synthetic Oligonucleotide; NDFIP1 exon 3; Set A
gaauuuuaacagucacaauuuuuugaugauuagcuga

SEQ ID NO: 35713 - RNA, 38 nt, Artificial Sequence
  Synthetic Oligonucleotide; NDFIP1 exon 3; Set A
agaauuuuaacagucacaauuuuuugaugauuagcuga

SEQ ID NO: 35714 - RNA, 26 nt, Artificial Sequence
  Synthetic Oligonucleotide; NDFIP1 exon 3; Set C
uuaacagucacaauuuuuugaugauu

SEQ ID NO: 35715 - RNA, 25 nt, Artificial Sequence
  Synthetic Oligonucleotide; NDFIP1 exon 3; Set C
uuaacagucacaauuuuuugaugau

SEQ ID NO: 35716 - RNA, 27 nt, Artificial Sequence
  Synthetic Oligonucleotide; NDFIP1 exon 3; Set C
uuuaacagucacaauuuuuugaugauu

SEQ ID NO: 35717 - RNA, 26 nt, Artificial Sequence
  Synthetic Oligonucleotide; NDFIP1 exon 3; Set C
uuuaacagucacaauuuuuugaugau

SEQ ID NO: 35718 - RNA, 24 nt, Artificial Sequence
  Synthetic Oligonucleotide; NDFIP1 exon 3; Set C
uuaacagucacaauuuuuugauga

SEQ ID NO: 35719 - RNA, 28 nt, Artificial Sequence
  Synthetic Oligonucleotide; NDFIP1 exon 3; Set C
uuuuaacagucacaauuuuuugaugauu

SEQ ID NO: 35720 - RNA, 27 nt, Artificial Sequence
  Synthetic Oligonucleotide; NDFIP1 exon 3; Set C
uuuuaacagucacaauuuuuugaugau

SEQ ID NO: 35721 - RNA, 25 nt, Artificial Sequence
  Synthetic Oligonucleotide; NDFIP1 exon 3; Set C
uuuaacagucacaauuuuuugauga

SEQ ID NO: 35722 - RNA, 29 nt, Artificial Sequence
  Synthetic Oligonucleotide; NDFIP1 exon 3; Set C
auuuuaacagucacaauuuuuugaugauu

SEQ ID NO: 35723 - RNA, 28 nt, Artificial Sequence
  Synthetic Oligonucleotide; NDFIP1 exon 3; Set C
auuuuaacagucacaauuuuuugaugau

SEQ ID NO: 35724 - RNA, 26 nt, Artificial Sequence
  Synthetic Oligonucleotide; NDFIP1 exon 3; Set C
uuuuaacagucacaauuuuuugauga

SEQ ID NO: 35725 - RNA, 30 nt, Artificial Sequence
  Synthetic Oligonucleotide; NDFIP1 exon 3; Set C
aauuuuaacagucacaauuuuuugaugauu

SEQ ID NO: 35726 - RNA, 29 nt, Artificial Sequence
  Synthetic Oligonucleotide; NDFIP1 exon 3; Set C
aauuuuaacagucacaauuuuuugaugau

SEQ ID NO: 35727 - RNA, 27 nt, Artificial Sequence
  Synthetic Oligonucleotide; NDFIP1 exon 3; Set C
auuuuaacagucacaauuuuuugauga

SEQ ID NO: 35728 - RNA, 31 nt, Artificial Sequence
  Synthetic Oligonucleotide; NDFIP1 exon 3; Set C
gaauuuuaacagucacaauuuuuugaugauu

SEQ ID NO: 35729 - RNA, 28 nt, Artificial Sequence
  Synthetic Oligonucleotide; NDFIP1 exon 3; Set C
aauuuuaacagucacaauuuuuugauga

SEQ ID NO: 35730 - RNA, 32 nt, Artificial Sequence
  Synthetic Oligonucleotide; NDFIP1 exon 3; Set C
agaauuuuaacagucacaauuuuuugaugauu

SEQ ID NO: 35731 - RNA, 29 nt, Artificial Sequence
  Synthetic Oligonucleotide; NDFIP1 exon 3; Set C
gaauuuuaacagucacaauuuuuugauga

SEQ ID NO: 35732 - RNA, 30 nt, Artificial Sequence
  Synthetic Oligonucleotide; NDFIP1 exon 3; Set C
agaauuuuaacagucacaauuuuuugauga

SEQ ID NO: 35733 - RNA, 15 nt, Artificial Sequence
  Synthetic Oligonucleotide; NDFIP1 exon 3; Set C
uuaacagucacaauu

SEQ ID NO: 35734 - RNA, 16 nt, Artificial Sequence
  Synthetic Oligonucleotide; NDFIP1 exon 3; Set C
uuuaacagucacaauu

SEQ ID NO: 35735 - RNA, 17 nt, Artificial Sequence
  Synthetic Oligonucleotide; NDFIP1 exon 3; Set C
uuuuaacagucacaauu

SEQ ID NO: 35736 - RNA, 18 nt, Artificial Sequence
  Synthetic Oligonucleotide; NDFIP1 exon 3; Set C
auuuuaacagucacaauu

SEQ ID NO: 35737 - RNA, 19 nt, Artificial Sequence
  Synthetic Oligonucleotide; NDFIP1 exon 3; Set C
aauuuuaacagucacaauu

SEQ ID NO: 35738 - RNA, 20 nt, Artificial Sequence
  Synthetic Oligonucleotide; NDFIP1 exon 3; Set C
gaauuuuaacagucacaauu

SEQ ID NO: 35739 - RNA, 21 nt, Artificial Sequence
  Synthetic Oligonucleotide; NDFIP1 exon 3; Set C
agaauuuuaacagucacaauu

SEQ ID NO: 35740 - RNA, 37 nt, Artificial Sequence
  Synthetic Oligonucleotide; NDFIP1 exon 3; Set A
acucauccuuguagucaaaauaugcugcagaauuuua

SEQ ID NO: 35741 - RNA, 36 nt, Artificial Sequence
  Synthetic Oligonucleotide; NDFIP1 exon 3; Set A
acucauccuuguagucaaaauaugcugcagaauuuu

SEQ ID NO: 35742 - RNA, 38 nt, Artificial Sequence
  Synthetic Oligonucleotide; NDFIP1 exon 3; Set A
gacucauccuuguagucaaaauaugcugcagaauuuua

SEQ ID NO: 35743 - RNA, 39 nt, Artificial Sequence
  Synthetic Oligonucleotide; NDFIP1 exon 3; Set A
agacucauccuuguagucaaaauaugcugcagaauuuua

SEQ ID NO: 35744 - RNA, 35 nt, Artificial Sequence
  Synthetic Oligonucleotide; NDFIP1 exon 3; Set A
acucauccuuguagucaaaauaugcugcagaauuu

SEQ ID NO: 35745 - RNA, 37 nt, Artificial Sequence
  Synthetic Oligonucleotide; NDFIP1 exon 3; Set A
gacucauccuuguagucaaaauaugcugcagaauuuu

SEQ ID NO: 35746 - RNA, 38 nt, Artificial Sequence
  Synthetic Oligonucleotide; NDFIP1 exon 3; Set A
agacucauccuuguagucaaaauaugcugcagaauuuu

SEQ ID NO: 35747 - RNA, 36 nt, Artificial Sequence
  Synthetic Oligonucleotide; NDFIP1 exon 3; Set A
gacucauccuuguagucaaaauaugcugcagaauuu

SEQ ID NO: 35748 - RNA, 37 nt, Artificial Sequence
  Synthetic Oligonucleotide; NDFIP1 exon 3; Set A
agacucauccuuguagucaaaauaugcugcagaauuu

SEQ ID NO: 35749 - RNA, 35 nt, Artificial Sequence
  Synthetic Oligonucleotide; NDFIP1 exon 3; Set A
gacucauccuuguagucaaaauaugcugcagaauu

SEQ ID NO: 35750 - RNA, 36 nt, Artificial Sequence
  Synthetic Oligonucleotide; NDFIP1 exon 3; Set A
agacucauccuuguagucaaaauaugcugcagaauu

SEQ ID NO: 35751 - RNA, 35 nt, Artificial Sequence
  Synthetic Oligonucleotide; NDFIP1 exon 3; Set A
agacucauccuuguagucaaaauaugcugcagaau

SEQ ID NO: 35752 - RNA, 16 nt, Artificial Sequence
  Synthetic Oligonucleotide; NDFIP1 exon 3; Set C
acucauccuuguaguc

SEQ ID NO: 35753 - RNA, 15 nt, Artificial Sequence
  Synthetic Oligonucleotide; NDFIP1 exon 3; Set C
acucauccuuguagu

SEQ ID NO: 35754 - RNA, 17 nt, Artificial Sequence
  Synthetic Oligonucleotide; NDFIP1 exon 3; Set C
gacucauccuuguaguc

SEQ ID NO: 35755 - RNA, 16 nt, Artificial Sequence
  Synthetic Oligonucleotide; NDFIP1 exon 3; Set C
gacucauccuuguagu

SEQ ID NO: 35756 - RNA, 18 nt, Artificial Sequence
  Synthetic Oligonucleotide; NDFIP1 exon 3; Set C
agacucauccuuguaguc

SEQ ID NO: 35757 - RNA, 15 nt, Artificial Sequence
  Synthetic Oligonucleotide; NDFIP1 exon 3; Set C
gacucauccuuguag

SEQ ID NO: 35758 - RNA, 17 nt, Artificial Sequence
  Synthetic Oligonucleotide; NDFIP1 exon 3; Set C
agacucauccuuguagu

SEQ ID NO: 35759 - RNA, 16 nt, Artificial Sequence
  Synthetic Oligonucleotide; NDFIP1 exon 3; Set C
agacucauccuuguag

SEQ ID NO: 35760 - RNA, 27 nt, Artificial Sequence
  Synthetic Oligonucleotide; NDFIP1 exon 3; Set A
uggaaacccagacucauccuuguaguc

SEQ ID NO: 35761 - RNA, 26 nt, Artificial Sequence
  Synthetic Oligonucleotide; NDFIP1 exon 3; Set A
uggaaacccagacucauccuuguagu

SEQ ID NO: 35762 - RNA, 25 nt, Artificial Sequence
  Synthetic Oligonucleotide; NDFIP1 exon 3; Set A
uggaaacccagacucauccuuguag

SEQ ID NO: 35763 - RNA, 30 nt, Artificial Sequence
  Synthetic Oligonucleotide; NDFIP1 exon 3; Set C
uguaagaugggggcuuuggaaacccagacu

SEQ ID NO: 35764 - RNA, 31 nt, Artificial Sequence
  Synthetic Oligonucleotide; NDFIP1 exon 3; Set C
uuguaagaugggggcuuuggaaacccagacu

SEQ ID NO: 35765 - RNA, 29 nt, Artificial Sequence
  Synthetic Oligonucleotide; NDFIP1 exon 3; Set C
uguaagaugggggcuuuggaaacccagac

SEQ ID NO: 35766 - RNA, 32 nt, Artificial Sequence
  Synthetic Oligonucleotide; NDFIP1 exon 3; Set C
auuguaagaugggggcuuuggaaacccagacu

SEQ ID NO: 35767 - RNA, 30 nt, Artificial Sequence
  Synthetic Oligonucleotide; NDFIP1 exon 3; Set C
uuguaagaugggggcuuuggaaacccagac

SEQ ID NO: 35768 - RNA, 29 nt, Artificial Sequence
  Synthetic Oligonucleotide; NDFIP1 exon 3; Set C
uuguaagaugggggcuuuggaaacccaga

SEQ ID NO: 35769 - RNA, 31 nt, Artificial Sequence
  Synthetic Oligonucleotide; NDFIP1 exon 3; Set C
auuguaagaugggggcuuuggaaacccagac

SEQ ID NO: 35770 - RNA, 30 nt, Artificial Sequence
  Synthetic Oligonucleotide; NDFIP1 exon 3; Set C
auuguaagaugggggcuuuggaaacccaga

SEQ ID NO: 35771 - RNA, 40 nt, Artificial Sequence
  Synthetic Oligonucleotide; NDFIP1 exon 3; Set C
guagcuacauuguaagaugggggcuuuggaaacccagacu

SEQ ID NO: 35772 - RNA, 20 nt, Artificial Sequence
  Synthetic Oligonucleotide; NDFIP1 exon 3; Set C
uuguaagaugggggcuuugg

SEQ ID NO: 35773 - RNA, 40 nt, Artificial Sequence
  Synthetic Oligonucleotide; NDFIP1 exon 3; Set C
uguagcuacauuguaagaugggggcuuuggaaacccagac

SEQ ID NO: 35774 - RNA, 21 nt, Artificial Sequence
  Synthetic Oligonucleotide; NDFIP1 exon 3; Set C
auuguaagaugggggcuuugg

SEQ ID NO: 35775 - RNA, 39 nt, Artificial Sequence
  Synthetic Oligonucleotide; NDFIP1 exon 3; Set C
uguagcuacauuguaagaugggggcuuuggaaacccaga

SEQ ID NO: 35776 - RNA, 40 nt, Artificial Sequence
  Synthetic Oligonucleotide; NDFIP1 exon 3; Set C
uuguagcuacauuguaagaugggggcuuuggaaacccaga

SEQ ID NO: 35777 - RNA, 30 nt, Artificial Sequence
  Synthetic Oligonucleotide; NDFIP1 exon 3; Set C
uguagcuacauuguaagaugggggcuuugg

SEQ ID NO: 35778 - RNA, 31 nt, Artificial Sequence
  Synthetic Oligonucleotide; NDFIP1 exon 3; Set C
uuguagcuacauuguaagaugggggcuuugg

SEQ ID NO: 35779 - RNA, 32 nt, Artificial Sequence
  Synthetic Oligonucleotide; NDFIP1 exon 3; Set C
guuguagcuacauuguaagaugggggcuuugg

SEQ ID NO: 35780 - RNA, 33 nt, Artificial Sequence
  Synthetic Oligonucleotide; NDFIP1 exon 3; Set C
uguuguagcuacauuguaagaugggggcuuugg

SEQ ID NO: 35781 - RNA, 34 nt, Artificial Sequence
  Synthetic Oligonucleotide; NDFIP1 exon 3; Set C
guguuguagcuacauuguaagaugggggcuuugg

SEQ ID NO: 35782 - RNA, 35 nt, Artificial Sequence
  Synthetic Oligonucleotide; NDFIP1 exon 3; Set C
aguguuguagcuacauuguaagaugggggcuuugg

SEQ ID NO: 35783 - RNA, 21 nt, Artificial Sequence
  Synthetic Oligonucleotide; NDFIP1 exon 3; Set C
uguagcuacauuguaagaugg

SEQ ID NO: 35784 - RNA, 40 nt, Artificial Sequence
  Synthetic Oligonucleotide; NDFIP1 exon 3; Set C
ugggcaguguuguagcuacauuguaagaugggggcuuugg

SEQ ID NO: 35785 - RNA, 22 nt, Artificial Sequence
  Synthetic Oligonucleotide; NDFIP1 exon 3; Set C
uuguagcuacauuguaagaugg

SEQ ID NO: 35786 - RNA, 23 nt, Artificial Sequence
  Synthetic Oligonucleotide; NDFIP1 exon 3; Set C
guuguagcuacauuguaagaugg

SEQ ID NO: 35787 - RNA, 24 nt, Artificial Sequence
  Synthetic Oligonucleotide; NDFIP1 exon 3; Set C
uguuguagcuacauuguaagaugg

SEQ ID NO: 35788 - RNA, 31 nt, Artificial Sequence
  Synthetic Oligonucleotide; NDFIP1 exon 3; Set C
ugggcaguguuguagcuacauuguaagaugg

SEQ ID NO: 35789 - RNA, 17 nt, Artificial Sequence
  Synthetic Oligonucleotide; NDFIP1 exon 3; Set C
guguuguagcuacauug

SEQ ID NO: 35790 - RNA, 19 nt, Artificial Sequence
  Synthetic Oligonucleotide; NDFIP1 exon 3; Set C
aguguuguagcuacauugu

SEQ ID NO: 35791 - RNA, 16 nt, Artificial Sequence
  Synthetic Oligonucleotide; NDFIP1 exon 3; Set C
guguuguagcuacauu

SEQ ID NO: 35792 - RNA, 18 nt, Artificial Sequence
  Synthetic Oligonucleotide; NDFIP1 exon 3; Set C
aguguuguagcuacauug

SEQ ID NO: 35793 - RNA, 20 nt, Artificial Sequence
  Synthetic Oligonucleotide; NDFIP1 exon 3; Set C
caguguuguagcuacauugu

SEQ ID NO: 35794 - RNA, 17 nt, Artificial Sequence
  Synthetic Oligonucleotide; NDFIP1 exon 3; Set C
aguguuguagcuacauu

SEQ ID NO: 35795 - RNA, 19 nt, Artificial Sequence
  Synthetic Oligonucleotide; NDFIP1 exon 3; Set C
caguguuguagcuacauug

SEQ ID NO: 35796 - RNA, 35 nt, Artificial Sequence
  Synthetic Oligonucleotide; NDFIP1 exon 3; Set C
uaacugggcaguguuguagcuacauuguaagaugg

SEQ ID NO: 35797 - RNA, 15 nt, Artificial Sequence
  Synthetic Oligonucleotide; NDFIP1 exon 3; Set C
guguuguagcuacau

SEQ ID NO: 35798 - RNA, 18 nt, Artificial Sequence
  Synthetic Oligonucleotide; NDFIP1 exon 3; Set C
caguguuguagcuacauu

SEQ ID NO: 35799 - RNA, 22 nt, Artificial Sequence
  Synthetic Oligonucleotide; NDFIP1 exon 3; Set A
ggcaguguuguagcuacauugu

SEQ ID NO: 35800 - RNA, 36 nt, Artificial Sequence
  Synthetic Oligonucleotide; NDFIP1 exon 3; Set C
auaacugggcaguguuguagcuacauuguaagaugg

SEQ ID NO: 35801 - RNA, 16 nt, Artificial Sequence
  Synthetic Oligonucleotide; NDFIP1 exon 3; Set C
aguguuguagcuacau

SEQ ID NO: 35802 - RNA, 21 nt, Artificial Sequence
  Synthetic Oligonucleotide; NDFIP1 exon 3; Set A
ggcaguguuguagcuacauug

SEQ ID NO: 35803 - RNA, 23 nt, Artificial Sequence
  Synthetic Oligonucleotide; NDFIP1 exon 3; Set A
gggcaguguuguagcuacauugu

SEQ ID NO: 35804 - RNA, 37 nt, Artificial Sequence
  Synthetic Oligonucleotide; NDFIP1 exon 3; Set C
cauaacugggcaguguuguagcuacauuguaagaugg

SEQ ID NO: 35805 - RNA, 20 nt, Artificial Sequence
  Synthetic Oligonucleotide; NDFIP1 exon 3; Set C
ggcaguguuguagcuacauu

SEQ ID NO: 35806 - RNA, 22 nt, Artificial Sequence
  Synthetic Oligonucleotide; NDFIP1 exon 3; Set A
gggcaguguuguagcuacauug

SEQ ID NO: 35807 - RNA, 38 nt, Artificial Sequence
  Synthetic Oligonucleotide; NDFIP1 exon 3; Set C
ucauaacugggcaguguuguagcuacauuguaagaugg

SEQ ID NO: 35808 - RNA, 21 nt, Artificial Sequence
  Synthetic Oligonucleotide; NDFIP1 exon 3; Set A
gggcaguguuguagcuacauu

SEQ ID NO: 35809 - RNA, 25 nt, Artificial Sequence
  Synthetic Oligonucleotide; NDFIP1 exon 3; Set A
cugggcaguguuguagcuacauugu

SEQ ID NO: 35810 - RNA, 39 nt, Artificial Sequence
  Synthetic Oligonucleotide; NDFIP1 exon 3; Set C
aucauaacugggcaguguuguagcuacauuguaagaugg

SEQ ID NO: 35811 - RNA, 24 nt, Artificial Sequence
  Synthetic Oligonucleotide; NDFIP1 exon 3; Set A
cugggcaguguuguagcuacauug

SEQ ID NO: 35812 - RNA, 26 nt, Artificial Sequence
  Synthetic Oligonucleotide; NDFIP1 exon 3; Set A
acugggcaguguuguagcuacauugu

SEQ ID NO: 35813 - RNA, 23 nt, Artificial Sequence
  Synthetic Oligonucleotide; NDFIP1 exon 3; Set A
cugggcaguguuguagcuacauu

SEQ ID NO: 35814 - RNA, 25 nt, Artificial Sequence
  Synthetic Oligonucleotide; NDFIP1 exon 3; Set A
acugggcaguguuguagcuacauug

SEQ ID NO: 35815 - RNA, 27 nt, Artificial Sequence
  Synthetic Oligonucleotide; NDFIP1 exon 3; Set A
aacugggcaguguuguagcuacauugu

SEQ ID NO: 35816 - RNA, 21 nt, Artificial Sequence
  Synthetic Oligonucleotide; NDFIP1 exon 3; Set A
ugggcaguguuguagcuacau

SEQ ID NO: 35817 - RNA, 29 nt, Artificial Sequence
  Synthetic Oligonucleotide; NDFIP1 exon 3; Set A
uaacugggcaguguuguagcuacauugua

SEQ ID NO: 35818 - RNA, 24 nt, Artificial Sequence
  Synthetic Oligonucleotide; NDFIP1 exon 3; Set A
acugggcaguguuguagcuacauu

SEQ ID NO: 35819 - RNA, 26 nt, Artificial Sequence
  Synthetic Oligonucleotide; NDFIP1 exon 3; Set A
aacugggcaguguuguagcuacauug

SEQ ID NO: 35820 - RNA, 25 nt, Artificial Sequence
  Synthetic Oligonucleotide; NDFIP1 exon 3; Set A
aacugggcaguguuguagcuacauu

SEQ ID NO: 35821 - RNA, 34 nt, Artificial Sequence
  Synthetic Oligonucleotide; NDFIP1 exon 3; Set C
aucauaacugggcaguguuguagcuacauuguaa

SEQ ID NO: 35822 - RNA, 25 nt, Artificial Sequence
  Synthetic Oligonucleotide; NDFIP1 exon 3; Set A
uaacugggcaguguuguagcuacau

SEQ ID NO: 35823 - RNA, 33 nt, Artificial Sequence
  Synthetic Oligonucleotide; NDFIP1 exon 3; Set C
aucauaacugggcaguguuguagcuacauugua

SEQ ID NO: 35824 - RNA, 26 nt, Artificial Sequence
  Synthetic Oligonucleotide; NDFIP1 exon 3; Set A
auaacugggcaguguuguagcuacau

SEQ ID NO: 35825 - RNA, 33 nt, Artificial Sequence
  Synthetic Oligonucleotide; NDFIP1 exon 3; Set C
caucauaacugggcaguguuguagcuacauugu

SEQ ID NO: 35826 - RNA, 27 nt, Artificial Sequence
  Synthetic Oligonucleotide; NDFIP1 exon 3; Set A
cauaacugggcaguguuguagcuacau

SEQ ID NO: 35827 - RNA, 32 nt, Artificial Sequence
  Synthetic Oligonucleotide; NDFIP1 exon 3; Set C
caucauaacugggcaguguuguagcuacauug

SEQ ID NO: 35828 - RNA, 34 nt, Artificial Sequence
  Synthetic Oligonucleotide; NDFIP1 exon 3; Set C
ucaucauaacugggcaguguuguagcuacauugu

SEQ ID NO: 35829 - RNA, 16 nt, Artificial Sequence
  Synthetic Oligonucleotide; NDFIP1 exon 3; Set C
cugggcaguguuguag

SEQ ID NO: 35830 - RNA, 28 nt, Artificial Sequence
  Synthetic Oligonucleotide; NDFIP1 exon 3; Set A
ucauaacugggcaguguuguagcuacau

SEQ ID NO: 35831 - RNA, 31 nt, Artificial Sequence
  Synthetic Oligonucleotide; NDFIP1 exon 3; Set C
caucauaacugggcaguguuguagcuacauu

SEQ ID NO: 35832 - RNA, 33 nt, Artificial Sequence
  Synthetic Oligonucleotide; NDFIP1 exon 3; Set C
ucaucauaacugggcaguguuguagcuacauug

SEQ ID NO: 35833 - RNA, 35 nt, Artificial Sequence
  Synthetic Oligonucleotide; NDFIP1 exon 3; Set C
uucaucauaacugggcaguguuguagcuacauugu

SEQ ID NO: 35834 - RNA, 17 nt, Artificial Sequence
  Synthetic Oligonucleotide; NDFIP1 exon 3; Set C
acugggcaguguuguag

SEQ ID NO: 35835 - RNA, 32 nt, Artificial Sequence
  Synthetic Oligonucleotide; NDFIP1 exon 3; Set C
ucaucauaacugggcaguguuguagcuacauu

SEQ ID NO: 35836 - RNA, 34 nt, Artificial Sequence
  Synthetic Oligonucleotide; NDFIP1 exon 3; Set C
uucaucauaacugggcaguguuguagcuacauug

SEQ ID NO: 35837 - RNA, 36 nt, Artificial Sequence
  Synthetic Oligonucleotide; NDFIP1 exon 3; Set C
cuucaucauaacugggcaguguuguagcuacauugu

SEQ ID NO: 35838 - RNA, 18 nt, Artificial Sequence
  Synthetic Oligonucleotide; NDFIP1 exon 3; Set C
aacugggcaguguuguag

SEQ ID NO: 35839 - RNA, 33 nt, Artificial Sequence
  Synthetic Oligonucleotide; NDFIP1 exon 3; Set C
uucaucauaacugggcaguguuguagcuacauu

SEQ ID NO: 35840 - RNA, 35 nt, Artificial Sequence
  Synthetic Oligonucleotide; NDFIP1 exon 3; Set C
cuucaucauaacugggcaguguuguagcuacauug

SEQ ID NO: 35841 - RNA, 37 nt, Artificial Sequence
  Synthetic Oligonucleotide; NDFIP1 exon 3; Set C
gcuucaucauaacugggcaguguuguagcuacauugu

SEQ ID NO: 35842 - RNA, 17 nt, Artificial Sequence
  Synthetic Oligonucleotide; NDFIP1 exon 3; Set C
aacugggcaguguugua

SEQ ID NO: 35843 - RNA, 34 nt, Artificial Sequence
  Synthetic Oligonucleotide; NDFIP1 exon 3; Set C
cuucaucauaacugggcaguguuguagcuacauu

SEQ ID NO: 35844 - RNA, 36 nt, Artificial Sequence
  Synthetic Oligonucleotide; NDFIP1 exon 3; Set C
gcuucaucauaacugggcaguguuguagcuacauug

SEQ ID NO: 35845 - RNA, 35 nt, Artificial Sequence
  Synthetic Oligonucleotide; NDFIP1 exon 3; Set C
gcuucaucauaacugggcaguguuguagcuacauu

SEQ ID NO: 35846 - RNA, 33 nt, Artificial Sequence
  Synthetic Oligonucleotide; NDFIP1 exon 3; Set C
cuucaucauaacugggcaguguuguagcuacau

SEQ ID NO: 35847 - RNA, 35 nt, Artificial Sequence
  Synthetic Oligonucleotide; NDFIP1 exon 3; Set C
cgcuucaucauaacugggcaguguuguagcuacau

SEQ ID NO: 35848 - RNA, 24 nt, Artificial Sequence
  Synthetic Oligonucleotide; NDFIP1 exon 3; Set A
caucauaacugggcaguguuguag

SEQ ID NO: 35849 - RNA, 36 nt, Artificial Sequence
  Synthetic Oligonucleotide; NDFIP1 exon 3; Set C
ccgcuucaucauaacugggcaguguuguagcuacau

SEQ ID NO: 35850 - RNA, 23 nt, Artificial Sequence
  Synthetic Oligonucleotide; NDFIP1 exon 3; Set A
caucauaacugggcaguguugua

SEQ ID NO: 35851 - RNA, 25 nt, Artificial Sequence
  Synthetic Oligonucleotide; NDFIP1 exon 3; Set A
ucaucauaacugggcaguguuguag

SEQ ID NO: 35852 - RNA, 24 nt, Artificial Sequence
  Synthetic Oligonucleotide; NDFIP1 exon 3; Set A
ucaucauaacugggcaguguugua

SEQ ID NO: 35853 - RNA, 26 nt, Artificial Sequence
  Synthetic Oligonucleotide; NDFIP1 exon 3; Set A
uucaucauaacugggcaguguuguag

SEQ ID NO: 35854 - RNA, 25 nt, Artificial Sequence
  Synthetic Oligonucleotide; NDFIP1 exon 3; Set A
uucaucauaacugggcaguguugua

SEQ ID NO: 35855 - RNA, 24 nt, Artificial Sequence
  Synthetic Oligonucleotide; NDFIP1 exon 3; Set A
uucaucauaacugggcaguguugu

SEQ ID NO: 35856 - RNA, 28 nt, Artificial Sequence
  Synthetic Oligonucleotide; NDFIP1 exon 3; Set A
gcuucaucauaacugggcaguguuguag

SEQ ID NO: 35857 - RNA, 23 nt, Artificial Sequence
  Synthetic Oligonucleotide; NDFIP1 exon 3; Set C
uucaucauaacugggcaguguug

SEQ ID NO: 35858 - RNA, 27 nt, Artificial Sequence
  Synthetic Oligonucleotide; NDFIP1 exon 3; Set A
gcuucaucauaacugggcaguguugua

SEQ ID NO: 35859 - RNA, 22 nt, Artificial Sequence
  Synthetic Oligonucleotide; NDFIP1 exon 3; Set C
uucaucauaacugggcaguguu

SEQ ID NO: 35860 - RNA, 18 nt, Artificial Sequence
  Synthetic Oligonucleotide; NDFIP1 exon 3; Set C
caucauaacugggcagug

SEQ ID NO: 35861 - RNA, 21 nt, Artificial Sequence
  Synthetic Oligonucleotide; NDFIP1 exon 3; Set C
uucaucauaacugggcagugu

SEQ ID NO: 35862 - RNA, 19 nt, Artificial Sequence
  Synthetic Oligonucleotide; NDFIP1 exon 3; Set C
ucaucauaacugggcagug

SEQ ID NO: 35863 - RNA, 17 nt, Artificial Sequence
  Synthetic Oligonucleotide; NDFIP1 exon 3; Set C
caucauaacugggcagu

SEQ ID NO: 35864 - RNA, 20 nt, Artificial Sequence
  Synthetic Oligonucleotide; NDFIP1 exon 3; Set C
uucaucauaacugggcagug

SEQ ID NO: 35865 - RNA, 18 nt, Artificial Sequence
  Synthetic Oligonucleotide; NDFIP1 exon 3; Set C
ucaucauaacugggcagu

SEQ ID NO: 35866 - RNA, 16 nt, Artificial Sequence
  Synthetic Oligonucleotide; NDFIP1 exon 3; Set C
caucauaacugggcag

SEQ ID NO: 35867 - RNA, 21 nt, Artificial Sequence
  Synthetic Oligonucleotide; NDFIP1 exon 3; Set C
cuucaucauaacugggcagug

SEQ ID NO: 35868 - RNA, 17 nt, Artificial Sequence
  Synthetic Oligonucleotide; NDFIP1 exon 3; Set C
ucaucauaacugggcag

SEQ ID NO: 35869 - RNA, 22 nt, Artificial Sequence
  Synthetic Oligonucleotide; NDFIP1 exon 3; Set A
gcuucaucauaacugggcagug

SEQ ID NO: 35870 - RNA, 20 nt, Artificial Sequence
  Synthetic Oligonucleotide; NDFIP1 exon 3; Set C
cuucaucauaacugggcagu

SEQ ID NO: 35871 - RNA, 21 nt, Artificial Sequence
  Synthetic Oligonucleotide; NDFIP1 exon 3; Set A
gcuucaucauaacugggcagu

SEQ ID NO: 35872 - RNA, 19 nt, Artificial Sequence
  Synthetic Oligonucleotide; NDFIP1 exon 3; Set C
cuucaucauaacugggcag

SEQ ID NO: 35873 - RNA, 20 nt, Artificial Sequence
  Synthetic Oligonucleotide; NDFIP1 exon 3; Set C
gcuucaucauaacugggcag

SEQ ID NO: 35874 - RNA, 23 nt, Artificial Sequence
  Synthetic Oligonucleotide; NDFIP1 exon 3; Set A
ccgcuucaucauaacugggcagu

SEQ ID NO: 35875 - RNA, 21 nt, Artificial Sequence
  Synthetic Oligonucleotide; NDFIP1 exon 3; Set A
cgcuucaucauaacugggcag

SEQ ID NO: 35876 - RNA, 22 nt, Artificial Sequence
  Synthetic Oligonucleotide; NDFIP1 exon 3; Set A
ccgcuucaucauaacugggcag

SEQ ID NO: 35877 - RNA, 15 nt, Artificial Sequence
  Synthetic Oligonucleotide; NDFIP1 exon 3; Set C
cuucaucauaacugg

SEQ ID NO: 35878 - RNA, 19 nt, Artificial Sequence
  Synthetic Oligonucleotide; NDFIP1 exon 3; Set C
cgcuucaucauaacugggc

SEQ ID NO: 35879 - RNA, 16 nt, Artificial Sequence
  Synthetic Oligonucleotide; NDFIP1 exon 3; Set C
gcuucaucauaacugg

SEQ ID NO: 35880 - RNA, 18 nt, Artificial Sequence
  Synthetic Oligonucleotide; NDFIP1 exon 3; Set C
cgcuucaucauaacuggg

SEQ ID NO: 35881 - RNA, 19 nt, Artificial Sequence
  Synthetic Oligonucleotide; NDFIP1 exon 3; Set C
ccgcuucaucauaacuggg

SEQ ID NO: 35882 - RNA, 16 nt, Artificial Sequence
  Synthetic Oligonucleotide; NDFIP1 exon 3; Set C
cgcuucaucauaacug

SEQ ID NO: 35883 - RNA, 39 nt, Artificial Sequence
  Synthetic Oligonucleotide; NDFIP1 exon 3; Set C
cuugguccucuccgcuucaucauaacugggcaguguugu

SEQ ID NO: 35884 - RNA, 15 nt, Artificial Sequence
  Synthetic Oligonucleotide; NDFIP1 exon 3; Set C
cgcuucaucauaacu

SEQ ID NO: 35885 - RNA, 17 nt, Artificial Sequence
  Synthetic Oligonucleotide; NDFIP1 exon 3; Set C
ccgcuucaucauaacug

SEQ ID NO: 35886 - RNA, 38 nt, Artificial Sequence
  Synthetic Oligonucleotide; NDFIP1 exon 3; Set C
cuugguccucuccgcuucaucauaacugggcaguguug

SEQ ID NO: 35887 - RNA, 16 nt, Artificial Sequence
  Synthetic Oligonucleotide; NDFIP1 exon 3; Set C
ccgcuucaucauaacu

SEQ ID NO: 35888 - RNA, 33 nt, Artificial Sequence
  Synthetic Oligonucleotide; NDFIP1 exon 3; Set C
ugguccucuccgcuucaucauaacugggcagug

SEQ ID NO: 35889 - RNA, 15 nt, Artificial Sequence
  Synthetic Oligonucleotide; NDFIP1 exon 3; Set C
ccgcuucaucauaac

SEQ ID NO: 35890 - RNA, 32 nt, Artificial Sequence
  Synthetic Oligonucleotide; NDFIP1 exon 3; Set C
ugguccucuccgcuucaucauaacugggcagu

SEQ ID NO: 35891 - RNA, 31 nt, Artificial Sequence
  Synthetic Oligonucleotide; NDFIP1 exon 3; Set C
ugguccucuccgcuucaucauaacugggcag

SEQ ID NO: 35892 - RNA, 32 nt, Artificial Sequence
  Synthetic Oligonucleotide; NDFIP1 exon 3; Set C
uugguccucuccgcuucaucauaacugggcag

SEQ ID NO: 35893 - RNA, 30 nt, Artificial Sequence
  Synthetic Oligonucleotide; NDFIP1 exon 3; Set C
uugguccucuccgcuucaucauaacugggc

SEQ ID NO: 35894 - RNA, 27 nt, Artificial Sequence
  Synthetic Oligonucleotide; NDFIP1 exon 3; Set C
ugguccucuccgcuucaucauaacugg

SEQ ID NO: 35895 - RNA, 29 nt, Artificial Sequence
  Synthetic Oligonucleotide; NDFIP1 exon 3; Set C
uugguccucuccgcuucaucauaacuggg

SEQ ID NO: 35896 - RNA, 40 nt, Artificial Sequence
  Synthetic Oligonucleotide; NDFIP1 exon 3; Set C
ucagccuugguccucuccgcuucaucauaacugggcagug

SEQ ID NO: 35897 - RNA, 26 nt, Artificial Sequence
  Synthetic Oligonucleotide; NDFIP1 exon 3; Set A
ugguccucuccgcuucaucauaacug

SEQ ID NO: 35898 - RNA, 39 nt, Artificial Sequence
  Synthetic Oligonucleotide; NDFIP1 exon 3; Set C
ucagccuugguccucuccgcuucaucauaacugggcagu

SEQ ID NO: 35899 - RNA, 27 nt, Artificial Sequence
  Synthetic Oligonucleotide; NDFIP1 exon 3; Set A
uugguccucuccgcuucaucauaacug

SEQ ID NO: 35900 - RNA, 25 nt, Artificial Sequence
  Synthetic Oligonucleotide; NDFIP1 exon 3; Set A
ugguccucuccgcuucaucauaacu

SEQ ID NO: 35901 - RNA, 40 nt, Artificial Sequence
  Synthetic Oligonucleotide; NDFIP1 exon 3; Set C
uucagccuugguccucuccgcuucaucauaacugggcagu

SEQ ID NO: 35902 - RNA, 38 nt, Artificial Sequence
  Synthetic Oligonucleotide; NDFIP1 exon 3; Set C
ucagccuugguccucuccgcuucaucauaacugggcag

SEQ ID NO: 35903 - RNA, 26 nt, Artificial Sequence
  Synthetic Oligonucleotide; NDFIP1 exon 3; Set A
uugguccucuccgcuucaucauaacu

SEQ ID NO: 35904 - RNA, 39 nt, Artificial Sequence
  Synthetic Oligonucleotide; NDFIP1 exon 3; Set C
uucagccuugguccucuccgcuucaucauaacugggcag

SEQ ID NO: 35905 - RNA, 25 nt, Artificial Sequence
  Synthetic Oligonucleotide; NDFIP1 exon 3; Set A
uugguccucuccgcuucaucauaac

SEQ ID NO: 35906 - RNA, 21 nt, Artificial Sequence
  Synthetic Oligonucleotide; NDFIP1 exon 3; Set A
ugguccucuccgcuucaucau

SEQ ID NO: 35907 - RNA, 20 nt, Artificial Sequence
  Synthetic Oligonucleotide; NDFIP1 exon 3; Set A
ugguccucuccgcuucauca

SEQ ID NO: 35908 - RNA, 34 nt, Artificial Sequence
  Synthetic Oligonucleotide; NDFIP1 exon 3; Set C
ucagccuugguccucuccgcuucaucauaacugg

SEQ ID NO: 35909 - RNA, 19 nt, Artificial Sequence
  Synthetic Oligonucleotide; NDFIP1 exon 3; Set A
ugguccucuccgcuucauc

SEQ ID NO: 35910 - RNA, 35 nt, Artificial Sequence
  Synthetic Oligonucleotide; NDFIP1 exon 3; Set C
uucagccuugguccucuccgcuucaucauaacugg

SEQ ID NO: 35911 - RNA, 34 nt, Artificial Sequence
  Synthetic Oligonucleotide; NDFIP1 exon 3; Set C
uucagccuugguccucuccgcuucaucauaacug

SEQ ID NO: 35912 - RNA, 37 nt, Artificial Sequence
  Synthetic Oligonucleotide; NDFIP1 exon 3; Set C
gcuucagccuugguccucuccgcuucaucauaacugg

SEQ ID NO: 35913 - RNA, 33 nt, Artificial Sequence
  Synthetic Oligonucleotide; NDFIP1 exon 3; Set C
uucagccuugguccucuccgcuucaucauaacu

SEQ ID NO: 35914 - RNA, 32 nt, Artificial Sequence
  Synthetic Oligonucleotide; NDFIP1 exon 3; Set C
uucagccuugguccucuccgcuucaucauaac

SEQ ID NO: 35915 - RNA, 29 nt, Artificial Sequence
  Synthetic Oligonucleotide; NDFIP1 exon 3; Set C
ucagccuugguccucuccgcuucaucaua

SEQ ID NO: 35916 - RNA, 32 nt, Artificial Sequence
  Synthetic Oligonucleotide; NDFIP1 exon 3; Set C
cuucagccuugguccucuccgcuucaucauaa

SEQ ID NO: 35917 - RNA, 28 nt, Artificial Sequence
  Synthetic Oligonucleotide; NDFIP1 exon 3; Set C
ucagccuugguccucuccgcuucaucau

SEQ ID NO: 35918 - RNA, 16 nt, Artificial Sequence
  Synthetic Oligonucleotide; NDFIP1 exon 3; Set C
uugguccucuccgcuu

SEQ ID NO: 35919 - RNA, 33 nt, Artificial Sequence
  Synthetic Oligonucleotide; NDFIP1 exon 3; Set C
gcuucagccuugguccucuccgcuucaucauaa

SEQ ID NO: 35920 - RNA, 31 nt, Artificial Sequence
  Synthetic Oligonucleotide; NDFIP1 exon 3; Set C
cuucagccuugguccucuccgcuucaucaua

SEQ ID NO: 35921 - RNA, 27 nt, Artificial Sequence
  Synthetic Oligonucleotide; NDFIP1 exon 3; Set C
ucagccuugguccucuccgcuucauca

SEQ ID NO: 35922 - RNA, 26 nt, Artificial Sequence
  Synthetic Oligonucleotide; NDFIP1 exon 3; Set C
ucagccuugguccucuccgcuucauc

SEQ ID NO: 35923 - RNA, 32 nt, Artificial Sequence
  Synthetic Oligonucleotide; NDFIP1 exon 3; Set C
gcuucagccuugguccucuccgcuucaucaua

SEQ ID NO: 35924 - RNA, 28 nt, Artificial Sequence
  Synthetic Oligonucleotide; NDFIP1 exon 3; Set C
uucagccuugguccucuccgcuucauca

SEQ ID NO: 35925 - RNA, 40 nt, Artificial Sequence
  Synthetic Oligonucleotide; NDFIP1 exon 3; Set C
aguagcuucagccuugguccucuccgcuucaucauaacug

SEQ ID NO: 35926 - RNA, 31 nt, Artificial Sequence
  Synthetic Oligonucleotide; NDFIP1 exon 3; Set C
gcuucagccuugguccucuccgcuucaucau

SEQ ID NO: 35927 - RNA, 39 nt, Artificial Sequence
  Synthetic Oligonucleotide; NDFIP1 exon 3; Set C
aguagcuucagccuugguccucuccgcuucaucauaacu

SEQ ID NO: 35928 - RNA, 30 nt, Artificial Sequence
  Synthetic Oligonucleotide; NDFIP1 exon 3; Set C
gcuucagccuugguccucuccgcuucauca

SEQ ID NO: 35929 - RNA, 40 nt, Artificial Sequence
  Synthetic Oligonucleotide; NDFIP1 exon 3; Set C
uaguagcuucagccuugguccucuccgcuucaucauaacu

SEQ ID NO: 35930 - RNA, 38 nt, Artificial Sequence
  Synthetic Oligonucleotide; NDFIP1 exon 3; Set C
aguagcuucagccuugguccucuccgcuucaucauaac

SEQ ID NO: 35931 - RNA, 29 nt, Artificial Sequence
  Synthetic Oligonucleotide; NDFIP1 exon 3; Set C
gcuucagccuugguccucuccgcuucauc

SEQ ID NO: 35932 - RNA, 39 nt, Artificial Sequence
  Synthetic Oligonucleotide; NDFIP1 exon 3; Set C
uaguagcuucagccuugguccucuccgcuucaucauaac

SEQ ID NO: 35933 - RNA, 21 nt, Artificial Sequence
  Synthetic Oligonucleotide; NDFIP1 exon 3; Set A
uucagccuugguccucuccgc

SEQ ID NO: 35934 - RNA, 29 nt, Artificial Sequence
  Synthetic Oligonucleotide; NDFIP1 exon 3; Set C
aguagcuucagccuugguccucuccgcuu

SEQ ID NO: 35935 - RNA, 40 nt, Artificial Sequence
  Synthetic Oligonucleotide; NDFIP1 exon 3; Set C
agggauaguagcuucagccuugguccucuccgcuucauca

SEQ ID NO: 35936 - RNA, 30 nt, Artificial Sequence
  Synthetic Oligonucleotide; NDFIP1 exon 3; Set C
uaguagcuucagccuugguccucuccgcuu

SEQ ID NO: 35937 - RNA, 39 nt, Artificial Sequence
  Synthetic Oligonucleotide; NDFIP1 exon 3; Set C
agggauaguagcuucagccuugguccucuccgcuucauc

SEQ ID NO: 35938 - RNA, 27 nt, Artificial Sequence
  Synthetic Oligonucleotide; NDFIP1 exon 3; Set C
aguagcuucagccuugguccucuccgc

SEQ ID NO: 35939 - RNA, 40 nt, Artificial Sequence
  Synthetic Oligonucleotide; NDFIP1 exon 3; Set C
aagggauaguagcuucagccuugguccucuccgcuucauc

SEQ ID NO: 35940 - RNA, 28 nt, Artificial Sequence
  Synthetic Oligonucleotide; NDFIP1 exon 3; Set C
uaguagcuucagccuugguccucuccgc

SEQ ID NO: 35941 - RNA, 26 nt, Artificial Sequence
  Synthetic Oligonucleotide; NDFIP1 exon 3; Set C
aguagcuucagccuugguccucuccg

SEQ ID NO: 35942 - RNA, 27 nt, Artificial Sequence
  Synthetic Oligonucleotide; NDFIP1 exon 3; Set C
uaguagcuucagccuugguccucuccg

SEQ ID NO: 35943 - RNA, 37 nt, Artificial Sequence
  Synthetic Oligonucleotide; NDFIP1 exon 3; Set C
aaagggauaguagcuucagccuugguccucuccgcuu

SEQ ID NO: 35944 - RNA, 35 nt, Artificial Sequence
  Synthetic Oligonucleotide; NDFIP1 exon 3; Set C
aaagggauaguagcuucagccuugguccucuccgc

SEQ ID NO: 35945 - RNA, 34 nt, Artificial Sequence
  Synthetic Oligonucleotide; NDFIP1 exon 3; Set C
aaagggauaguagcuucagccuugguccucuccg

SEQ ID NO: 35946 - RNA, 23 nt, Artificial Sequence
  Synthetic Oligonucleotide; NDFIP1 exon 3; Set A
agggauaguagcuucagccuugg

SEQ ID NO: 35947 - RNA, 22 nt, Artificial Sequence
  Synthetic Oligonucleotide; NDFIP1 exon 3; Set A
agggauaguagcuucagccuug

SEQ ID NO: 35948 - RNA, 24 nt, Artificial Sequence
  Synthetic Oligonucleotide; NDFIP1 exon 3; Set A
aagggauaguagcuucagccuugg

SEQ ID NO: 35949 - RNA, 23 nt, Artificial Sequence
  Synthetic Oligonucleotide; NDFIP1 exon 3; Set A
aagggauaguagcuucagccuug

SEQ ID NO: 35950 - RNA, 26 nt, Artificial Sequence
  Synthetic Oligonucleotide; NDFIP1 exon 3; Set A
caaagggauaguagcuucagccuugg

SEQ ID NO: 35951 - RNA, 25 nt, Artificial Sequence
  Synthetic Oligonucleotide; NDFIP1 exon 3; Set A
caaagggauaguagcuucagccuug

SEQ ID NO: 35952 - RNA, 27 nt, Artificial Sequence
  Synthetic Oligonucleotide; NDFIP1 exon 3; Set A
ccaaagggauaguagcuucagccuugg

SEQ ID NO: 35953 - RNA, 26 nt, Artificial Sequence
  Synthetic Oligonucleotide; NDFIP1 exon 3; Set A
ccaaagggauaguagcuucagccuug

SEQ ID NO: 35954 - RNA, 16 nt, Artificial Sequence
  Synthetic Oligonucleotide; NDFIP1 exon 3; Set C
agggauaguagcuuca

SEQ ID NO: 35955 - RNA, 15 nt, Artificial Sequence
  Synthetic Oligonucleotide; NDFIP1 exon 3; Set C
agggauaguagcuuc

SEQ ID NO: 35956 - RNA, 17 nt, Artificial Sequence
  Synthetic Oligonucleotide; NDFIP1 exon 3; Set C
aagggauaguagcuuca

SEQ ID NO: 35957 - RNA, 16 nt, Artificial Sequence
  Synthetic Oligonucleotide; NDFIP1 exon 3; Set C
aagggauaguagcuuc

SEQ ID NO: 35958 - RNA, 19 nt, Artificial Sequence
  Synthetic Oligonucleotide; NDFIP1 exon 3; Set C
caaagggauaguagcuuca

SEQ ID NO: 35959 - RNA, 18 nt, Artificial Sequence
  Synthetic Oligonucleotide; NDFIP1 exon 3; Set C
caaagggauaguagcuuc

SEQ ID NO: 35960 - RNA, 20 nt, Artificial Sequence
  Synthetic Oligonucleotide; NDFIP1 exon 3; Set C
ccaaagggauaguagcuuca

SEQ ID NO: 35961 - RNA, 16 nt, Artificial Sequence
  Synthetic Oligonucleotide; NDFIP1 exon 3; Set C
aaagggauaguagcuu

SEQ ID NO: 35962 - RNA, 19 nt, Artificial Sequence
  Synthetic Oligonucleotide; NDFIP1 exon 3; Set C
ccaaagggauaguagcuuc

SEQ ID NO: 35963 - RNA, 15 nt, Artificial Sequence
  Synthetic Oligonucleotide; NDFIP1 exon 3; Set C
aaagggauaguagcu

SEQ ID NO: 35964 - RNA, 40 nt, Artificial Sequence
  Synthetic Oligonucleotide; NDFIP1 exon 3; Set C
uauacucacucucccaggaaccaaagggauaguagcuuca

SEQ ID NO: 35965 - RNA, 39 nt, Artificial Sequence
  Synthetic Oligonucleotide; NDFIP1 exon 3; Set C
uauacucacucucccaggaaccaaagggauaguagcuuc

SEQ ID NO: 35966 - RNA, 40 nt, Artificial Sequence
  Synthetic Oligonucleotide; NDFIP1 exon 3; Set C
uuauacucacucucccaggaaccaaagggauaguagcuuc

SEQ ID NO: 35967 - RNA, 33 nt, Artificial Sequence
  Synthetic Oligonucleotide; NDFIP1 exon 3; Set C
uauacucacucucccaggaaccaaagggauagu

SEQ ID NO: 35968 - RNA, 32 nt, Artificial Sequence
  Synthetic Oligonucleotide; NDFIP1 exon 3; Set C
uauacucacucucccaggaaccaaagggauag

SEQ ID NO: 35969 - RNA, 34 nt, Artificial Sequence
  Synthetic Oligonucleotide; NDFIP1 exon 3; Set C
uuauacucacucucccaggaaccaaagggauagu

SEQ ID NO: 35970 - RNA, 33 nt, Artificial Sequence
  Synthetic Oligonucleotide; NDFIP1 exon 3; Set C
uuauacucacucucccaggaaccaaagggauag

SEQ ID NO: 35971 - RNA, 35 nt, Artificial Sequence
  Synthetic Oligonucleotide; NDFIP1 exon 3; Set C
auuauacucacucucccaggaaccaaagggauagu

SEQ ID NO: 35972 - RNA, 34 nt, Artificial Sequence
  Synthetic Oligonucleotide; NDFIP1 exon 3; Set C
auuauacucacucucccaggaaccaaagggauag

SEQ ID NO: 35973 - RNA, 36 nt, Artificial Sequence
  Synthetic Oligonucleotide; NDFIP1 exon 3; Set C
aauuauacucacucucccaggaaccaaagggauagu

SEQ ID NO: 35974 - RNA, 35 nt, Artificial Sequence
  Synthetic Oligonucleotide; NDFIP1 exon 3; Set B
aauuauacucacucucccaggaaccaaagggauag

SEQ ID NO: 35975 - RNA, 25 nt, Artificial Sequence
  Synthetic Oligonucleotide; NDFIP1 exon 3; Set B
uauacucacucucccaggaaccaaa

SEQ ID NO: 35976 - RNA, 26 nt, Artificial Sequence
  Synthetic Oligonucleotide; NDFIP1 exon 3; Set B
uuauacucacucucccaggaaccaaa

SEQ ID NO: 35977 - RNA, 27 nt, Artificial Sequence
  Synthetic Oligonucleotide; NDFIP1 exon 3; Set B
auuauacucacucucccaggaaccaaa

SEQ ID NO: 35978 - RNA, 28 nt, Artificial Sequence
  Synthetic Oligonucleotide; NDFIP1 exon 3; Set B
aauuauacucacucucccaggaaccaaa

SEQ ID NO: 35979 - RNA, 27 nt, Artificial Sequence
  Synthetic Oligonucleotide; NDFIP1 exon 3; Set B
aauuauacucacucucccaggaaccaa

SEQ ID NO: 35980 - RNA, 37 nt, Artificial Sequence
  Synthetic Oligonucleotide; NDFIP1 exon 3; Set C
aacauggcaaauuauacucacucucccaggaaccaaa

SEQ ID NO: 35981 - RNA, 38 nt, Artificial Sequence
  Synthetic Oligonucleotide; NDFIP1 exon 3; Set C
uaacauggcaaauuauacucacucucccaggaaccaaa

SEQ ID NO: 35982 - RNA, 39 nt, Artificial Sequence
  Synthetic Oligonucleotide; NDFIP1 exon 3; Set C
guaacauggcaaauuauacucacucucccaggaaccaaa

SEQ ID NO: 35983 - RNA, 17 nt, Artificial Sequence
  Synthetic Oligonucleotide; NDFIP1 exon 3; Set C
aacauggcaaauuauac

SEQ ID NO: 35984 - RNA, 16 nt, Artificial Sequence
  Synthetic Oligonucleotide; NDFIP1 exon 3; Set C
aacauggcaaauuaua

SEQ ID NO: 35985 - RNA, 18 nt, Artificial Sequence
  Synthetic Oligonucleotide; NDFIP1 exon 3; Set C
uaacauggcaaauuauac

SEQ ID NO: 35986 - RNA, 17 nt, Artificial Sequence
  Synthetic Oligonucleotide; NDFIP1 exon 3; Set C
uaacauggcaaauuaua

SEQ ID NO: 35987 - RNA, 19 nt, Artificial Sequence
  Synthetic Oligonucleotide; NDFIP1 exon 3; Set C
guaacauggcaaauuauac

SEQ ID NO: 35988 - RNA, 18 nt, Artificial Sequence
  Synthetic Oligonucleotide; NDFIP1 exon 3; Set C
guaacauggcaaauuaua

SEQ ID NO: 35989 - RNA, 21 nt, Artificial Sequence
  Synthetic Oligonucleotide; NDFIP1 exon 3; Set C
ucaaguaacauggcaaauuau

SEQ ID NO: 35990 - RNA, 20 nt, Artificial Sequence
  Synthetic Oligonucleotide; NDFIP1 exon 3; Set C
ucaaguaacauggcaaauua

SEQ ID NO: 35991 - RNA, 40 nt, Artificial Sequence
  Synthetic Oligonucleotide; NDFIP1 exon 3; Set C
aauucccacagagcagccaucaaguaacauggcaaauuau

SEQ ID NO: 35992 - RNA, 39 nt, Artificial Sequence
  Synthetic Oligonucleotide; NDFIP1 exon 3; Set C
aauucccacagagcagccaucaaguaacauggcaaauua

SEQ ID NO: 35993 - RNA, 40 nt, Artificial Sequence
  Synthetic Oligonucleotide; NDFIP1 exon 3; Set C
uaauucccacagagcagccaucaaguaacauggcaaauua

SEQ ID NO: 35994 - RNA, 38 nt, Artificial Sequence
  Synthetic Oligonucleotide; NDFIP1 exon 3; Set C
aauucccacagagcagccaucaaguaacauggcaaauu

SEQ ID NO: 35995 - RNA, 39 nt, Artificial Sequence
  Synthetic Oligonucleotide; NDFIP1 exon 3; Set C
uaauucccacagagcagccaucaaguaacauggcaaauu

SEQ ID NO: 35996 - RNA, 37 nt, Artificial Sequence
  Synthetic Oligonucleotide; NDFIP1 exon 3; Set C
aauucccacagagcagccaucaaguaacauggcaaau

SEQ ID NO: 35997 - RNA, 40 nt, Artificial Sequence
  Synthetic Oligonucleotide; NDFIP1 exon 3; Set C
uuaauucccacagagcagccaucaaguaacauggcaaauu

SEQ ID NO: 35998 - RNA, 38 nt, Artificial Sequence
  Synthetic Oligonucleotide; NDFIP1 exon 3; Set C
uaauucccacagagcagccaucaaguaacauggcaaau

SEQ ID NO: 35999 - RNA, 39 nt, Artificial Sequence
  Synthetic Oligonucleotide; NDFIP1 exon 3; Set C
uuaauucccacagagcagccaucaaguaacauggcaaau

SEQ ID NO: 36000 - RNA, 40 nt, Artificial Sequence
  Synthetic Oligonucleotide; NDFIP1 exon 3; Set C
cuuaauucccacagagcagccaucaaguaacauggcaaau

SEQ ID NO: 36001 - RNA, 28 nt, Artificial Sequence
  Synthetic Oligonucleotide; NDFIP1 exon 3; Set B
aauucccacagagcagccaucaaguaac

SEQ ID NO: 36002 - RNA, 29 nt, Artificial Sequence
  Synthetic Oligonucleotide; NDFIP1 exon 3; Set B
uaauucccacagagcagccaucaaguaac

SEQ ID NO: 36003 - RNA, 30 nt, Artificial Sequence
  Synthetic Oligonucleotide; NDFIP1 exon 3; Set B
uuaauucccacagagcagccaucaaguaac

SEQ ID NO: 36004 - RNA, 28 nt, Artificial Sequence
  Synthetic Oligonucleotide; NDFIP1 exon 3; Set B
uaauucccacagagcagccaucaaguaa

SEQ ID NO: 36005 - RNA, 31 nt, Artificial Sequence
  Synthetic Oligonucleotide; NDFIP1 exon 3; Set B
cuuaauucccacagagcagccaucaaguaac

SEQ ID NO: 36006 - RNA, 29 nt, Artificial Sequence
  Synthetic Oligonucleotide; NDFIP1 exon 3; Set B
uuaauucccacagagcagccaucaaguaa

SEQ ID NO: 36007 - RNA, 30 nt, Artificial Sequence
  Synthetic Oligonucleotide; NDFIP1 exon 3; Set B
cuuaauucccacagagcagccaucaaguaa

SEQ ID NO: 36008 - RNA, 28 nt, Artificial Sequence
  Synthetic Oligonucleotide; NDFIP1 exon 3; Set B
uuaauucccacagagcagccaucaagua

SEQ ID NO: 36009 - RNA, 29 nt, Artificial Sequence
  Synthetic Oligonucleotide; NDFIP1 exon 3; Set B
cuuaauucccacagagcagccaucaagua

SEQ ID NO: 36010 - RNA, 37 nt, Artificial Sequence
  Synthetic Oligonucleotide; NDFIP1 exon 3; Set A
agucaaaauaugcugcagaauuuuaacagucacaauu

SEQ ID NO: 36011 - RNA, 38 nt, Artificial Sequence
  Synthetic Oligonucleotide; NDFIP1 exon 3; Set A
uagucaaaauaugcugcagaauuuuaacagucacaauu

SEQ ID NO: 36012 - RNA, 24 nt, Artificial Sequence
  Synthetic Oligonucleotide; NDFIP1 exon 3; Set C
gucaaaauaugcugcagaauuuua

SEQ ID NO: 36013 - RNA, 25 nt, Artificial Sequence
  Synthetic Oligonucleotide; NDFIP1 exon 3; Set C
agucaaaauaugcugcagaauuuua

SEQ ID NO: 36014 - RNA, 23 nt, Artificial Sequence
  Synthetic Oligonucleotide; NDFIP1 exon 3; Set C
gucaaaauaugcugcagaauuuu

SEQ ID NO: 36015 - RNA, 26 nt, Artificial Sequence
  Synthetic Oligonucleotide; NDFIP1 exon 3; Set C
uagucaaaauaugcugcagaauuuua

SEQ ID NO: 36016 - RNA, 24 nt, Artificial Sequence
  Synthetic Oligonucleotide; NDFIP1 exon 3; Set C
agucaaaauaugcugcagaauuuu

SEQ ID NO: 36017 - RNA, 25 nt, Artificial Sequence
  Synthetic Oligonucleotide; NDFIP1 exon 3; Set C
uagucaaaauaugcugcagaauuuu

SEQ ID NO: 36018 - RNA, 23 nt, Artificial Sequence
  Synthetic Oligonucleotide; NDFIP1 exon 3; Set C
agucaaaauaugcugcagaauuu

SEQ ID NO: 36019 - RNA, 24 nt, Artificial Sequence
  Synthetic Oligonucleotide; NDFIP1 exon 3; Set C
uagucaaaauaugcugcagaauuu

SEQ ID NO: 36020 - RNA, 23 nt, Artificial Sequence
  Synthetic Oligonucleotide; NDFIP1 exon 3; Set C
uagucaaaauaugcugcagaauu

SEQ ID NO: 36021 - RNA, 22 nt, Artificial Sequence
  Synthetic Oligonucleotide; NDFIP1 exon 3; Set C
uagucaaaauaugcugcagaau

SEQ ID NO: 36022 - RNA, 21 nt, Artificial Sequence
  Synthetic Oligonucleotide; NDFIP1 exon 3; Set C
uagucaaaauaugcugcagaa

SEQ ID NO: 36023 - RNA, 20 nt, Artificial Sequence
  Synthetic Oligonucleotide; NDFIP1 exon 3; Set C
uagucaaaauaugcugcaga

SEQ ID NO: 36024 - RNA, 34 nt, Artificial Sequence
  Synthetic Oligonucleotide; NDFIP1 exon 3; Set A
acucauccuuguagucaaaauaugcugcagaauu

SEQ ID NO: 36025 - RNA, 33 nt, Artificial Sequence
  Synthetic Oligonucleotide; NDFIP1 exon 3; Set A
acucauccuuguagucaaaauaugcugcagaau

SEQ ID NO: 36026 - RNA, 32 nt, Artificial Sequence
  Synthetic Oligonucleotide; NDFIP1 exon 3; Set A
acucauccuuguagucaaaauaugcugcagaa

SEQ ID NO: 36027 - RNA, 34 nt, Artificial Sequence
  Synthetic Oligonucleotide; NDFIP1 exon 3; Set A
gacucauccuuguagucaaaauaugcugcagaau

SEQ ID NO: 36028 - RNA, 33 nt, Artificial Sequence
  Synthetic Oligonucleotide; NDFIP1 exon 3; Set A
gacucauccuuguagucaaaauaugcugcagaa

SEQ ID NO: 36029 - RNA, 31 nt, Artificial Sequence
  Synthetic Oligonucleotide; NDFIP1 exon 3; Set A
acucauccuuguagucaaaauaugcugcaga

SEQ ID NO: 36030 - RNA, 34 nt, Artificial Sequence
  Synthetic Oligonucleotide; NDFIP1 exon 3; Set A
agacucauccuuguagucaaaauaugcugcagaa

SEQ ID NO: 36031 - RNA, 32 nt, Artificial Sequence
  Synthetic Oligonucleotide; NDFIP1 exon 3; Set A
gacucauccuuguagucaaaauaugcugcaga

SEQ ID NO: 36032 - RNA, 33 nt, Artificial Sequence
  Synthetic Oligonucleotide; NDFIP1 exon 3; Set A
agacucauccuuguagucaaaauaugcugcaga

SEQ ID NO: 36033 - RNA, 15 nt, Artificial Sequence
  Synthetic Oligonucleotide; NDFIP1 exon 3; Set C
agacucauccuugua

SEQ ID NO: 36034 - RNA, 24 nt, Artificial Sequence
  Synthetic Oligonucleotide; NDFIP1 exon 3; Set A
uggaaacccagacucauccuugua

SEQ ID NO: 36035 - RNA, 23 nt, Artificial Sequence
  Synthetic Oligonucleotide; NDFIP1 exon 3; Set A
uggaaacccagacucauccuugu

SEQ ID NO: 36036 - RNA, 34 nt, Artificial Sequence
  Synthetic Oligonucleotide; NDFIP1 exon 3; Set C
ugggggcuuuggaaacccagacucauccuuguag

SEQ ID NO: 36037 - RNA, 23 nt, Artificial Sequence
  Synthetic Oligonucleotide; NDFIP1 exon 3; Set A
ugggggcuuuggaaacccagacu

SEQ ID NO: 36038 - RNA, 22 nt, Artificial Sequence
  Synthetic Oligonucleotide; NDFIP1 exon 3; Set A
ugggggcuuuggaaacccagac

SEQ ID NO: 36039 - RNA, 21 nt, Artificial Sequence
  Synthetic Oligonucleotide; NDFIP1 exon 3; Set A
ugggggcuuuggaaacccaga

SEQ ID NO: 36040 - RNA, 28 nt, Artificial Sequence
  Synthetic Oligonucleotide; NDFIP1 exon 3; Set C
uguaagaugggggcuuuggaaacccaga

SEQ ID NO: 36041 - RNA, 33 nt, Artificial Sequence
  Synthetic Oligonucleotide; NDFIP1 exon 3; Set C
cauuguaagaugggggcuuuggaaacccagacu

SEQ ID NO: 36042 - RNA, 32 nt, Artificial Sequence
  Synthetic Oligonucleotide; NDFIP1 exon 3; Set C
cauuguaagaugggggcuuuggaaacccagac

SEQ ID NO: 36043 - RNA, 31 nt, Artificial Sequence
  Synthetic Oligonucleotide; NDFIP1 exon 3; Set C
cauuguaagaugggggcuuuggaaacccaga

SEQ ID NO: 36044 - RNA, 39 nt, Artificial Sequence
  Synthetic Oligonucleotide; NDFIP1 exon 3; Set C
uagcuacauuguaagaugggggcuuuggaaacccagacu

SEQ ID NO: 36045 - RNA, 38 nt, Artificial Sequence
  Synthetic Oligonucleotide; NDFIP1 exon 3; Set C
uagcuacauuguaagaugggggcuuuggaaacccagac

SEQ ID NO: 36046 - RNA, 19 nt, Artificial Sequence
  Synthetic Oligonucleotide; NDFIP1 exon 3; Set C
uguaagaugggggcuuugg

SEQ ID NO: 36047 - RNA, 37 nt, Artificial Sequence
  Synthetic Oligonucleotide; NDFIP1 exon 3; Set C
uagcuacauuguaagaugggggcuuuggaaacccaga

SEQ ID NO: 36048 - RNA, 39 nt, Artificial Sequence
  Synthetic Oligonucleotide; NDFIP1 exon 3; Set C
guagcuacauuguaagaugggggcuuuggaaacccagac

SEQ ID NO: 36049 - RNA, 38 nt, Artificial Sequence
  Synthetic Oligonucleotide; NDFIP1 exon 3; Set C
guagcuacauuguaagaugggggcuuuggaaacccaga

SEQ ID NO: 36050 - RNA, 22 nt, Artificial Sequence
  Synthetic Oligonucleotide; NDFIP1 exon 3; Set A
cauuguaagaugggggcuuugg

SEQ ID NO: 36051 - RNA, 28 nt, Artificial Sequence
  Synthetic Oligonucleotide; NDFIP1 exon 3; Set A
uagcuacauuguaagaugggggcuuugg

SEQ ID NO: 36052 - RNA, 29 nt, Artificial Sequence
  Synthetic Oligonucleotide; NDFIP1 exon 3; Set C
guagcuacauuguaagaugggggcuuugg

SEQ ID NO: 36053 - RNA, 32 nt, Artificial Sequence
  Synthetic Oligonucleotide; NDFIP1 exon 3; Set C
uuguagcuacauuguaagaugggggcuuugga

SEQ ID NO: 36054 - RNA, 34 nt, Artificial Sequence
  Synthetic Oligonucleotide; NDFIP1 exon 3; Set C
uguuguagcuacauuguaagaugggggcuuugga

SEQ ID NO: 36055 - RNA, 36 nt, Artificial Sequence
  Synthetic Oligonucleotide; NDFIP1 exon 3; Set C
caguguuguagcuacauuguaagaugggggcuuugg

SEQ ID NO: 36056 - RNA, 37 nt, Artificial Sequence
  Synthetic Oligonucleotide; NDFIP1 exon 3; Set C
gcaguguuguagcuacauuguaagaugggggcuuugg

SEQ ID NO: 36057 - RNA, 19 nt, Artificial Sequence
  Synthetic Oligonucleotide; NDFIP1 exon 3; Set C
uagcuacauuguaagaugg

SEQ ID NO: 36058 - RNA, 38 nt, Artificial Sequence
  Synthetic Oligonucleotide; NDFIP1 exon 3; Set C
ggcaguguuguagcuacauuguaagaugggggcuuugg

SEQ ID NO: 36059 - RNA, 20 nt, Artificial Sequence
  Synthetic Oligonucleotide; NDFIP1 exon 3; Set C
guagcuacauuguaagaugg

SEQ ID NO: 36060 - RNA, 39 nt, Artificial Sequence
  Synthetic Oligonucleotide; NDFIP1 exon 3; Set C
gggcaguguuguagcuacauuguaagaugggggcuuugg

SEQ ID NO: 36061 - RNA, 26 nt, Artificial Sequence
  Synthetic Oligonucleotide; NDFIP1 exon 3; Set A
uguuguagcuacauuguaagaugggg

SEQ ID NO: 36062 - RNA, 25 nt, Artificial Sequence
  Synthetic Oligonucleotide; NDFIP1 exon 3; Set C
guguuguagcuacauuguaagaugg

SEQ ID NO: 36063 - RNA, 15 nt, Artificial Sequence
  Synthetic Oligonucleotide; NDFIP1 exon 3; Set C
guagcuacauuguaa

SEQ ID NO: 36064 - RNA, 26 nt, Artificial Sequence
  Synthetic Oligonucleotide; NDFIP1 exon 3; Set C
aguguuguagcuacauuguaagaugg

SEQ ID NO: 36065 - RNA, 16 nt, Artificial Sequence
  Synthetic Oligonucleotide; NDFIP1 exon 3; Set C
uguagcuacauuguaa

SEQ ID NO: 36066 - RNA, 27 nt, Artificial Sequence
  Synthetic Oligonucleotide; NDFIP1 exon 3; Set A
caguguuguagcuacauuguaagaugg

SEQ ID NO: 36067 - RNA, 15 nt, Artificial Sequence
  Synthetic Oligonucleotide; NDFIP1 exon 3; Set C
uguagcuacauugua

SEQ ID NO: 36068 - RNA, 17 nt, Artificial Sequence
  Synthetic Oligonucleotide; NDFIP1 exon 3; Set C
uuguagcuacauuguaa

SEQ ID NO: 36069 - RNA, 16 nt, Artificial Sequence
  Synthetic Oligonucleotide; NDFIP1 exon 3; Set C
uuguagcuacauugua

SEQ ID NO: 36070 - RNA, 18 nt, Artificial Sequence
  Synthetic Oligonucleotide; NDFIP1 exon 3; Set C
guuguagcuacauuguaa

SEQ ID NO: 36071 - RNA, 29 nt, Artificial Sequence
  Synthetic Oligonucleotide; NDFIP1 exon 3; Set A
ggcaguguuguagcuacauuguaagaugg

SEQ ID NO: 36072 - RNA, 17 nt, Artificial Sequence
  Synthetic Oligonucleotide; NDFIP1 exon 3; Set C
guuguagcuacauugua

SEQ ID NO: 36073 - RNA, 19 nt, Artificial Sequence
  Synthetic Oligonucleotide; NDFIP1 exon 3; Set C
uguuguagcuacauuguaa

SEQ ID NO: 36074 - RNA, 30 nt, Artificial Sequence
  Synthetic Oligonucleotide; NDFIP1 exon 3; Set A
gggcaguguuguagcuacauuguaagaugg

SEQ ID NO: 36075 - RNA, 18 nt, Artificial Sequence
  Synthetic Oligonucleotide; NDFIP1 exon 3; Set C
uguuguagcuacauugua

SEQ ID NO: 36076 - RNA, 20 nt, Artificial Sequence
  Synthetic Oligonucleotide; NDFIP1 exon 3; Set C
guguuguagcuacauuguaa

SEQ ID NO: 36077 - RNA, 19 nt, Artificial Sequence
  Synthetic Oligonucleotide; NDFIP1 exon 3; Set C
guguuguagcuacauugua

SEQ ID NO: 36078 - RNA, 21 nt, Artificial Sequence
  Synthetic Oligonucleotide; NDFIP1 exon 3; Set C
aguguuguagcuacauuguaa

SEQ ID NO: 36079 - RNA, 32 nt, Artificial Sequence
  Synthetic Oligonucleotide; NDFIP1 exon 3; Set C
cugggcaguguuguagcuacauuguaagaugg

SEQ ID NO: 36080 - RNA, 20 nt, Artificial Sequence
  Synthetic Oligonucleotide; NDFIP1 exon 3; Set C
aguguuguagcuacauugua

SEQ ID NO: 36081 - RNA, 22 nt, Artificial Sequence
  Synthetic Oligonucleotide; NDFIP1 exon 3; Set C
caguguuguagcuacauuguaa

SEQ ID NO: 36082 - RNA, 33 nt, Artificial Sequence
  Synthetic Oligonucleotide; NDFIP1 exon 3; Set C
acugggcaguguuguagcuacauuguaagaugg

SEQ ID NO: 36083 - RNA, 21 nt, Artificial Sequence
  Synthetic Oligonucleotide; NDFIP1 exon 3; Set C
caguguuguagcuacauugua

SEQ ID NO: 36084 - RNA, 37 nt, Artificial Sequence
  Synthetic Oligonucleotide; NDFIP1 exon 3; Set C
uaacugggcaguguuguagcuacauuguaagaugggg

SEQ ID NO: 36085 - RNA, 34 nt, Artificial Sequence
  Synthetic Oligonucleotide; NDFIP1 exon 3; Set C
aacugggcaguguuguagcuacauuguaagaugg

SEQ ID NO: 36086 - RNA, 38 nt, Artificial Sequence
  Synthetic Oligonucleotide; NDFIP1 exon 3; Set C
auaacugggcaguguuguagcuacauuguaagaugggg

SEQ ID NO: 36087 - RNA, 36 nt, Artificial Sequence
  Synthetic Oligonucleotide; NDFIP1 exon 3; Set C
uaacugggcaguguuguagcuacauuguaagauggg

SEQ ID NO: 36088 - RNA, 21 nt, Artificial Sequence
  Synthetic Oligonucleotide; NDFIP1 exon 3; Set C
gcaguguuguagcuacauugu

SEQ ID NO: 36089 - RNA, 39 nt, Artificial Sequence
  Synthetic Oligonucleotide; NDFIP1 exon 3; Set C
cauaacugggcaguguuguagcuacauuguaagaugggg

SEQ ID NO: 36090 - RNA, 37 nt, Artificial Sequence
  Synthetic Oligonucleotide; NDFIP1 exon 3; Set C
auaacugggcaguguuguagcuacauuguaagauggg

SEQ ID NO: 36091 - RNA, 20 nt, Artificial Sequence
  Synthetic Oligonucleotide; NDFIP1 exon 3; Set C
gcaguguuguagcuacauug

SEQ ID NO: 36092 - RNA, 26 nt, Artificial Sequence
  Synthetic Oligonucleotide; NDFIP1 exon 3; Set A
ugggcaguguuguagcuacauuguaa

SEQ ID NO: 36093 - RNA, 40 nt, Artificial Sequence
  Synthetic Oligonucleotide; NDFIP1 exon 3; Set C
ucauaacugggcaguguuguagcuacauuguaagaugggg

SEQ ID NO: 36094 - RNA, 38 nt, Artificial Sequence
  Synthetic Oligonucleotide; NDFIP1 exon 3; Set C
cauaacugggcaguguuguagcuacauuguaagauggg

SEQ ID NO: 36095 - RNA, 19 nt, Artificial Sequence
  Synthetic Oligonucleotide; NDFIP1 exon 3; Set C
gcaguguuguagcuacauu

SEQ ID NO: 36096 - RNA, 17 nt, Artificial Sequence
  Synthetic Oligonucleotide; NDFIP1 exon 3; Set C
caguguuguagcuacau

SEQ ID NO: 36097 - RNA, 25 nt, Artificial Sequence
  Synthetic Oligonucleotide; NDFIP1 exon 3; Set A
ugggcaguguuguagcuacauugua

SEQ ID NO: 36098 - RNA, 39 nt, Artificial Sequence
  Synthetic Oligonucleotide; NDFIP1 exon 3; Set C
ucauaacugggcaguguuguagcuacauuguaagauggg

SEQ ID NO: 36099 - RNA, 18 nt, Artificial Sequence
  Synthetic Oligonucleotide; NDFIP1 exon 3; Set C
gcaguguuguagcuacau

SEQ ID NO: 36100 - RNA, 40 nt, Artificial Sequence
  Synthetic Oligonucleotide; NDFIP1 exon 3; Set C
aucauaacugggcaguguuguagcuacauuguaagauggg

SEQ ID NO: 36101 - RNA, 19 nt, Artificial Sequence
  Synthetic Oligonucleotide; NDFIP1 exon 3; Set C
ggcaguguuguagcuacau

SEQ ID NO: 36102 - RNA, 40 nt, Artificial Sequence
  Synthetic Oligonucleotide; NDFIP1 exon 3; Set C
caucauaacugggcaguguuguagcuacauuguaagaugg

SEQ ID NO: 36103 - RNA, 20 nt, Artificial Sequence
  Synthetic Oligonucleotide; NDFIP1 exon 3; Set A
gggcaguguuguagcuacau

SEQ ID NO: 36104 - RNA, 30 nt, Artificial Sequence
  Synthetic Oligonucleotide; NDFIP1 exon 3; Set A
uaacugggcaguguuguagcuacauuguaa

SEQ ID NO: 36105 - RNA, 31 nt, Artificial Sequence
  Synthetic Oligonucleotide; NDFIP1 exon 3; Set A
auaacugggcaguguuguagcuacauuguaa

SEQ ID NO: 36106 - RNA, 22 nt, Artificial Sequence
  Synthetic Oligonucleotide; NDFIP1 exon 3; Set A
cugggcaguguuguagcuacau

SEQ ID NO: 36107 - RNA, 30 nt, Artificial Sequence
  Synthetic Oligonucleotide; NDFIP1 exon 3; Set A
auaacugggcaguguuguagcuacauugua

SEQ ID NO: 36108 - RNA, 32 nt, Artificial Sequence
  Synthetic Oligonucleotide; NDFIP1 exon 3; Set A
cauaacugggcaguguuguagcuacauuguaa

SEQ ID NO: 36109 - RNA, 23 nt, Artificial Sequence
  Synthetic Oligonucleotide; NDFIP1 exon 3; Set A
acugggcaguguuguagcuacau

SEQ ID NO: 36110 - RNA, 31 nt, Artificial Sequence
  Synthetic Oligonucleotide; NDFIP1 exon 3; Set C
cauaacugggcaguguuguagcuacauugua

SEQ ID NO: 36111 - RNA, 33 nt, Artificial Sequence
  Synthetic Oligonucleotide; NDFIP1 exon 3; Set C
ucauaacugggcaguguuguagcuacauuguaa

SEQ ID NO: 36112 - RNA, 24 nt, Artificial Sequence
  Synthetic Oligonucleotide; NDFIP1 exon 3; Set A
aacugggcaguguuguagcuacau

SEQ ID NO: 36113 - RNA, 32 nt, Artificial Sequence
  Synthetic Oligonucleotide; NDFIP1 exon 3; Set C
ucauaacugggcaguguuguagcuacauugua

SEQ ID NO: 36114 - RNA, 38 nt, Artificial Sequence
  Synthetic Oligonucleotide; NDFIP1 exon 3; Set C
cuucaucauaacugggcaguguuguagcuacauuguaa

SEQ ID NO: 36115 - RNA, 37 nt, Artificial Sequence
  Synthetic Oligonucleotide; NDFIP1 exon 3; Set C
cuucaucauaacugggcaguguuguagcuacauugua

SEQ ID NO: 36116 - RNA, 30 nt, Artificial Sequence
  Synthetic Oligonucleotide; NDFIP1 exon 3; Set C
caucauaacugggcaguguuguagcuacau

SEQ ID NO: 36117 - RNA, 40 nt, Artificial Sequence
  Synthetic Oligonucleotide; NDFIP1 exon 3; Set C
cgcuucaucauaacugggcaguguuguagcuacauuguaa

SEQ ID NO: 36118 - RNA, 31 nt, Artificial Sequence
  Synthetic Oligonucleotide; NDFIP1 exon 3; Set C
ucaucauaacugggcaguguuguagcuacau

SEQ ID NO: 36119 - RNA, 39 nt, Artificial Sequence
  Synthetic Oligonucleotide; NDFIP1 exon 3; Set C
cgcuucaucauaacugggcaguguuguagcuacauugua

SEQ ID NO: 36120 - RNA, 32 nt, Artificial Sequence
  Synthetic Oligonucleotide; NDFIP1 exon 3; Set C
uucaucauaacugggcaguguuguagcuacau

SEQ ID NO: 36121 - RNA, 40 nt, Artificial Sequence
  Synthetic Oligonucleotide; NDFIP1 exon 3; Set C
ccgcuucaucauaacugggcaguguuguagcuacauugua

SEQ ID NO: 36122 - RNA, 34 nt, Artificial Sequence
  Synthetic Oligonucleotide; NDFIP1 exon 3; Set C
gcuucaucauaacugggcaguguuguagcuacau

SEQ ID NO: 36123 - RNA, 19 nt, Artificial Sequence
  Synthetic Oligonucleotide; NDFIP1 exon 3; Set C
uucaucauaacugggcagu

SEQ ID NO: 36124 - RNA, 15 nt, Artificial Sequence
  Synthetic Oligonucleotide; NDFIP1 exon 3; Set C
caucauaacugggca

SEQ ID NO: 36125 - RNA, 18 nt, Artificial Sequence
  Synthetic Oligonucleotide; NDFIP1 exon 3; Set C
uucaucauaacugggcag

SEQ ID NO: 36126 - RNA, 16 nt, Artificial Sequence
  Synthetic Oligonucleotide; NDFIP1 exon 3; Set C
ucaucauaacugggca

SEQ ID NO: 36127 - RNA, 15 nt, Artificial Sequence
  Synthetic Oligonucleotide; NDFIP1 exon 3; Set C
ucaucauaacugggc

SEQ ID NO: 36128 - RNA, 16 nt, Artificial Sequence
  Synthetic Oligonucleotide; NDFIP1 exon 3; Set C
uucaucauaacugggc

SEQ ID NO: 36129 - RNA, 18 nt, Artificial Sequence
  Synthetic Oligonucleotide; NDFIP1 exon 3; Set C
cuucaucauaacugggca

SEQ ID NO: 36130 - RNA, 37 nt, Artificial Sequence
  Synthetic Oligonucleotide; NDFIP1 exon 3; Set C
guccucuccgcuucaucauaacugggcaguguuguag

SEQ ID NO: 36131 - RNA, 15 nt, Artificial Sequence
  Synthetic Oligonucleotide; NDFIP1 exon 3; Set C
uucaucauaacuggg

SEQ ID NO: 36132 - RNA, 17 nt, Artificial Sequence
  Synthetic Oligonucleotide; NDFIP1 exon 3; Set C
cuucaucauaacugggc

SEQ ID NO: 36133 - RNA, 19 nt, Artificial Sequence
  Synthetic Oligonucleotide; NDFIP1 exon 3; Set C
gcuucaucauaacugggca

SEQ ID NO: 36134 - RNA, 36 nt, Artificial Sequence
  Synthetic Oligonucleotide; NDFIP1 exon 3; Set C
guccucuccgcuucaucauaacugggcaguguugua

SEQ ID NO: 36135 - RNA, 38 nt, Artificial Sequence
  Synthetic Oligonucleotide; NDFIP1 exon 3; Set C
gguccucuccgcuucaucauaacugggcaguguuguag

SEQ ID NO: 36136 - RNA, 16 nt, Artificial Sequence
  Synthetic Oligonucleotide; NDFIP1 exon 3; Set C
cuucaucauaacuggg

SEQ ID NO: 36137 - RNA, 18 nt, Artificial Sequence
  Synthetic Oligonucleotide; NDFIP1 exon 3; Set C
gcuucaucauaacugggc

SEQ ID NO: 36138 - RNA, 20 nt, Artificial Sequence
  Synthetic Oligonucleotide; NDFIP1 exon 3; Set A
cgcuucaucauaacugggca

SEQ ID NO: 36139 - RNA, 35 nt, Artificial Sequence
  Synthetic Oligonucleotide; NDFIP1 exon 3; Set C
guccucuccgcuucaucauaacugggcaguguugu

SEQ ID NO: 36140 - RNA, 37 nt, Artificial Sequence
  Synthetic Oligonucleotide; NDFIP1 exon 3; Set C
gguccucuccgcuucaucauaacugggcaguguugua

SEQ ID NO: 36141 - RNA, 17 nt, Artificial Sequence
  Synthetic Oligonucleotide; NDFIP1 exon 3; Set C
gcuucaucauaacuggg

SEQ ID NO: 36142 - RNA, 21 nt, Artificial Sequence
  Synthetic Oligonucleotide; NDFIP1 exon 3; Set A
ccgcuucaucauaacugggca

SEQ ID NO: 36143 - RNA, 36 nt, Artificial Sequence
  Synthetic Oligonucleotide; NDFIP1 exon 3; Set C
gguccucuccgcuucaucauaacugggcaguguugu

SEQ ID NO: 36144 - RNA, 34 nt, Artificial Sequence
  Synthetic Oligonucleotide; NDFIP1 exon 3; Set C
guccucuccgcuucaucauaacugggcaguguug

SEQ ID NO: 36145 - RNA, 20 nt, Artificial Sequence
  Synthetic Oligonucleotide; NDFIP1 exon 3; Set A
ccgcuucaucauaacugggc

SEQ ID NO: 36146 - RNA, 35 nt, Artificial Sequence
  Synthetic Oligonucleotide; NDFIP1 exon 3; Set C
gguccucuccgcuucaucauaacugggcaguguug

SEQ ID NO: 36147 - RNA, 33 nt, Artificial Sequence
  Synthetic Oligonucleotide; NDFIP1 exon 3; Set C
guccucuccgcuucaucauaacugggcaguguu

SEQ ID NO: 36148 - RNA, 15 nt, Artificial Sequence
  Synthetic Oligonucleotide; NDFIP1 exon 3; Set C
gcuucaucauaacug

SEQ ID NO: 36149 - RNA, 34 nt, Artificial Sequence
  Synthetic Oligonucleotide; NDFIP1 exon 3; Set C
gguccucuccgcuucaucauaacugggcaguguu

SEQ ID NO: 36150 - RNA, 32 nt, Artificial Sequence
  Synthetic Oligonucleotide; NDFIP1 exon 3; Set C
guccucuccgcuucaucauaacugggcagugu

SEQ ID NO: 36151 - RNA, 40 nt, Artificial Sequence
  Synthetic Oligonucleotide; NDFIP1 exon 3; Set C
cuugguccucuccgcuucaucauaacugggcaguguugua

SEQ ID NO: 36152 - RNA, 33 nt, Artificial Sequence
  Synthetic Oligonucleotide; NDFIP1 exon 3; Set C
gguccucuccgcuucaucauaacugggcagugu

SEQ ID NO: 36153 - RNA, 37 nt, Artificial Sequence
  Synthetic Oligonucleotide; NDFIP1 exon 3; Set C
cuugguccucuccgcuucaucauaacugggcaguguu

SEQ ID NO: 36154 - RNA, 36 nt, Artificial Sequence
  Synthetic Oligonucleotide; NDFIP1 exon 3; Set C
cuugguccucuccgcuucaucauaacugggcagugu

SEQ ID NO: 36155 - RNA, 35 nt, Artificial Sequence
  Synthetic Oligonucleotide; NDFIP1 exon 3; Set C
cuugguccucuccgcuucaucauaacugggcagug

SEQ ID NO: 36156 - RNA, 34 nt, Artificial Sequence
  Synthetic Oligonucleotide; NDFIP1 exon 3; Set C
cuugguccucuccgcuucaucauaacugggcagu

SEQ ID NO: 36157 - RNA, 30 nt, Artificial Sequence
  Synthetic Oligonucleotide; NDFIP1 exon 3; Set C
ugguccucuccgcuucaucauaacugggca

SEQ ID NO: 36158 - RNA, 33 nt, Artificial Sequence
  Synthetic Oligonucleotide; NDFIP1 exon 3; Set C
cuugguccucuccgcuucaucauaacugggcag

SEQ ID NO: 36159 - RNA, 29 nt, Artificial Sequence
  Synthetic Oligonucleotide; NDFIP1 exon 3; Set C
ugguccucuccgcuucaucauaacugggc

SEQ ID NO: 36160 - RNA, 31 nt, Artificial Sequence
  Synthetic Oligonucleotide; NDFIP1 exon 3; Set C
uugguccucuccgcuucaucauaacugggca

SEQ ID NO: 36161 - RNA, 28 nt, Artificial Sequence
  Synthetic Oligonucleotide; NDFIP1 exon 3; Set C
ugguccucuccgcuucaucauaacuggg

SEQ ID NO: 36162 - RNA, 21 nt, Artificial Sequence
  Synthetic Oligonucleotide; NDFIP1 exon 3; Set A
guccucuccgcuucaucauaa

SEQ ID NO: 36163 - RNA, 29 nt, Artificial Sequence
  Synthetic Oligonucleotide; NDFIP1 exon 3; Set C
cuugguccucuccgcuucaucauaacugg

SEQ ID NO: 36164 - RNA, 22 nt, Artificial Sequence
  Synthetic Oligonucleotide; NDFIP1 exon 3; Set A
gguccucuccgcuucaucauaa

SEQ ID NO: 36165 - RNA, 24 nt, Artificial Sequence
  Synthetic Oligonucleotide; NDFIP1 exon 3; Set A
ugguccucuccgcuucaucauaac

SEQ ID NO: 36166 - RNA, 21 nt, Artificial Sequence
  Synthetic Oligonucleotide; NDFIP1 exon 3; Set A
gguccucuccgcuucaucaua

SEQ ID NO: 36167 - RNA, 37 nt, Artificial Sequence
  Synthetic Oligonucleotide; NDFIP1 exon 3; Set C
ucagccuugguccucuccgcuucaucauaacugggca

SEQ ID NO: 36168 - RNA, 40 nt, Artificial Sequence
  Synthetic Oligonucleotide; NDFIP1 exon 3; Set C
cuucagccuugguccucuccgcuucaucauaacugggcag

SEQ ID NO: 36169 - RNA, 36 nt, Artificial Sequence
  Synthetic Oligonucleotide; NDFIP1 exon 3; Set C
ucagccuugguccucuccgcuucaucauaacugggc

SEQ ID NO: 36170 - RNA, 38 nt, Artificial Sequence
  Synthetic Oligonucleotide; NDFIP1 exon 3; Set C
uucagccuugguccucuccgcuucaucauaacugggca

SEQ ID NO: 36171 - RNA, 25 nt, Artificial Sequence
  Synthetic Oligonucleotide; NDFIP1 exon 3; Set A
cuugguccucuccgcuucaucauaa

SEQ ID NO: 36172 - RNA, 35 nt, Artificial Sequence
  Synthetic Oligonucleotide; NDFIP1 exon 3; Set C
ucagccuugguccucuccgcuucaucauaacuggg

SEQ ID NO: 36173 - RNA, 37 nt, Artificial Sequence
  Synthetic Oligonucleotide; NDFIP1 exon 3; Set C
uucagccuugguccucuccgcuucaucauaacugggc

SEQ ID NO: 36174 - RNA, 24 nt, Artificial Sequence
  Synthetic Oligonucleotide; NDFIP1 exon 3; Set A
cuugguccucuccgcuucaucaua

SEQ ID NO: 36175 - RNA, 36 nt, Artificial Sequence
  Synthetic Oligonucleotide; NDFIP1 exon 3; Set C
uucagccuugguccucuccgcuucaucauaacuggg

SEQ ID NO: 36176 - RNA, 23 nt, Artificial Sequence
  Synthetic Oligonucleotide; NDFIP1 exon 3; Set A
cuugguccucuccgcuucaucau

SEQ ID NO: 36177 - RNA, 33 nt, Artificial Sequence
  Synthetic Oligonucleotide; NDFIP1 exon 3; Set C
ucagccuugguccucuccgcuucaucauaacug

SEQ ID NO: 36178 - RNA, 22 nt, Artificial Sequence
  Synthetic Oligonucleotide; NDFIP1 exon 3; Set A
cuugguccucuccgcuucauca

SEQ ID NO: 36179 - RNA, 36 nt, Artificial Sequence
  Synthetic Oligonucleotide; NDFIP1 exon 3; Set C
cuucagccuugguccucuccgcuucaucauaacugg

SEQ ID NO: 36180 - RNA, 32 nt, Artificial Sequence
  Synthetic Oligonucleotide; NDFIP1 exon 3; Set C
ucagccuugguccucuccgcuucaucauaacu

SEQ ID NO: 36181 - RNA, 18 nt, Artificial Sequence
  Synthetic Oligonucleotide; NDFIP1 exon 3; Set A
ugguccucuccgcuucau

SEQ ID NO: 36182 - RNA, 38 nt, Artificial Sequence
  Synthetic Oligonucleotide; NDFIP1 exon 3; Set C
gcuucagccuugguccucuccgcuucaucauaacuggg

SEQ ID NO: 36183 - RNA, 21 nt, Artificial Sequence
  Synthetic Oligonucleotide; NDFIP1 exon 3; Set A
cuugguccucuccgcuucauc

SEQ ID NO: 36184 - RNA, 35 nt, Artificial Sequence
  Synthetic Oligonucleotide; NDFIP1 exon 3; Set C
cuucagccuugguccucuccgcuucaucauaacug

SEQ ID NO: 36185 - RNA, 31 nt, Artificial Sequence
  Synthetic Oligonucleotide; NDFIP1 exon 3; Set C
ucagccuugguccucuccgcuucaucauaac

SEQ ID NO: 36186 - RNA, 19 nt, Artificial Sequence
  Synthetic Oligonucleotide; NDFIP1 exon 3; Set A
uugguccucuccgcuucau

SEQ ID NO: 36187 - RNA, 17 nt, Artificial Sequence
  Synthetic Oligonucleotide; NDFIP1 exon 3; Set A
ugguccucuccgcuuca

SEQ ID NO: 36188 - RNA, 36 nt, Artificial Sequence
  Synthetic Oligonucleotide; NDFIP1 exon 3; Set C
gcuucagccuugguccucuccgcuucaucauaacug

SEQ ID NO: 36189 - RNA, 34 nt, Artificial Sequence
  Synthetic Oligonucleotide; NDFIP1 exon 3; Set C
cuucagccuugguccucuccgcuucaucauaacu

SEQ ID NO: 36190 - RNA, 18 nt, Artificial Sequence
  Synthetic Oligonucleotide; NDFIP1 exon 3; Set A
uugguccucuccgcuuca

SEQ ID NO: 36191 - RNA, 15 nt, Artificial Sequence
  Synthetic Oligonucleotide; NDFIP1 exon 3; Set C
ugguccucuccgcuu

SEQ ID NO: 36192 - RNA, 35 nt, Artificial Sequence
  Synthetic Oligonucleotide; NDFIP1 exon 3; Set C
gcuucagccuugguccucuccgcuucaucauaacu

SEQ ID NO: 36193 - RNA, 17 nt, Artificial Sequence
  Synthetic Oligonucleotide; NDFIP1 exon 3; Set C
uugguccucuccgcuuc

SEQ ID NO: 36194 - RNA, 34 nt, Artificial Sequence
  Synthetic Oligonucleotide; NDFIP1 exon 3; Set C
gcuucagccuugguccucuccgcuucaucauaac

SEQ ID NO: 36195 - RNA, 15 nt, Artificial Sequence
  Synthetic Oligonucleotide; NDFIP1 exon 3; Set C
uugguccucuccgcu

SEQ ID NO: 36196 - RNA, 34 nt, Artificial Sequence
  Synthetic Oligonucleotide; NDFIP1 exon 3; Set C
agcuucagccuugguccucuccgcuucaucauaa

SEQ ID NO: 36197 - RNA, 30 nt, Artificial Sequence
  Synthetic Oligonucleotide; NDFIP1 exon 3; Set C
cuucagccuugguccucuccgcuucaucau

SEQ ID NO: 36198 - RNA, 35 nt, Artificial Sequence
  Synthetic Oligonucleotide; NDFIP1 exon 3; Set C
uagcuucagccuugguccucuccgcuucaucauaa

SEQ ID NO: 36199 - RNA, 33 nt, Artificial Sequence
  Synthetic Oligonucleotide; NDFIP1 exon 3; Set C
agcuucagccuugguccucuccgcuucaucaua

SEQ ID NO: 36200 - RNA, 29 nt, Artificial Sequence
  Synthetic Oligonucleotide; NDFIP1 exon 3; Set C
cuucagccuugguccucuccgcuucauca

SEQ ID NO: 36201 - RNA, 25 nt, Artificial Sequence
  Synthetic Oligonucleotide; NDFIP1 exon 3; Set C
ucagccuugguccucuccgcuucau

SEQ ID NO: 36202 - RNA, 36 nt, Artificial Sequence
  Synthetic Oligonucleotide; NDFIP1 exon 3; Set C
guagcuucagccuugguccucuccgcuucaucauaa

SEQ ID NO: 36203 - RNA, 28 nt, Artificial Sequence
  Synthetic Oligonucleotide; NDFIP1 exon 3; Set C
cuucagccuugguccucuccgcuucauc

SEQ ID NO: 36204 - RNA, 34 nt, Artificial Sequence
  Synthetic Oligonucleotide; NDFIP1 exon 3; Set C
uagcuucagccuugguccucuccgcuucaucaua

SEQ ID NO: 36205 - RNA, 32 nt, Artificial Sequence
  Synthetic Oligonucleotide; NDFIP1 exon 3; Set C
agcuucagccuugguccucuccgcuucaucau

SEQ ID NO: 36206 - RNA, 26 nt, Artificial Sequence
  Synthetic Oligonucleotide; NDFIP1 exon 3; Set C
uucagccuugguccucuccgcuucau

SEQ ID NO: 36207 - RNA, 24 nt, Artificial Sequence
  Synthetic Oligonucleotide; NDFIP1 exon 3; Set C
ucagccuugguccucuccgcuuca

SEQ ID NO: 36208 - RNA, 35 nt, Artificial Sequence
  Synthetic Oligonucleotide; NDFIP1 exon 3; Set C
guagcuucagccuugguccucuccgcuucaucaua

SEQ ID NO: 36209 - RNA, 33 nt, Artificial Sequence
  Synthetic Oligonucleotide; NDFIP1 exon 3; Set C
uagcuucagccuugguccucuccgcuucaucau

SEQ ID NO: 36210 - RNA, 31 nt, Artificial Sequence
  Synthetic Oligonucleotide; NDFIP1 exon 3; Set C
agcuucagccuugguccucuccgcuucauca

SEQ ID NO: 36211 - RNA, 25 nt, Artificial Sequence
  Synthetic Oligonucleotide; NDFIP1 exon 3; Set C
uucagccuugguccucuccgcuuca

SEQ ID NO: 36212 - RNA, 30 nt, Artificial Sequence
  Synthetic Oligonucleotide; NDFIP1 exon 3; Set C
agcuucagccuugguccucuccgcuucauc

SEQ ID NO: 36213 - RNA, 34 nt, Artificial Sequence
  Synthetic Oligonucleotide; NDFIP1 exon 3; Set C
guagcuucagccuugguccucuccgcuucaucau

SEQ ID NO: 36214 - RNA, 32 nt, Artificial Sequence
  Synthetic Oligonucleotide; NDFIP1 exon 3; Set C
uagcuucagccuugguccucuccgcuucauca

SEQ ID NO: 36215 - RNA, 22 nt, Artificial Sequence
  Synthetic Oligonucleotide; NDFIP1 exon 3; Set C
ucagccuugguccucuccgcuu

SEQ ID NO: 36216 - RNA, 24 nt, Artificial Sequence
  Synthetic Oligonucleotide; NDFIP1 exon 3; Set C
uucagccuugguccucuccgcuuc

SEQ ID NO: 36217 - RNA, 39 nt, Artificial Sequence
  Synthetic Oligonucleotide; NDFIP1 exon 3; Set C
auaguagcuucagccuugguccucuccgcuucaucauaa

SEQ ID NO: 36218 - RNA, 31 nt, Artificial Sequence
  Synthetic Oligonucleotide; NDFIP1 exon 3; Set C
uagcuucagccuugguccucuccgcuucauc

SEQ ID NO: 36219 - RNA, 33 nt, Artificial Sequence
  Synthetic Oligonucleotide; NDFIP1 exon 3; Set C
guagcuucagccuugguccucuccgcuucauca

SEQ ID NO: 36220 - RNA, 23 nt, Artificial Sequence
  Synthetic Oligonucleotide; NDFIP1 exon 3; Set C
uucagccuugguccucuccgcuu

SEQ ID NO: 36221 - RNA, 21 nt, Artificial Sequence
  Synthetic Oligonucleotide; NDFIP1 exon 3; Set C
ucagccuugguccucuccgcu

SEQ ID NO: 36222 - RNA, 32 nt, Artificial Sequence
  Synthetic Oligonucleotide; NDFIP1 exon 3; Set C
guagcuucagccuugguccucuccgcuucauc

SEQ ID NO: 36223 - RNA, 38 nt, Artificial Sequence
  Synthetic Oligonucleotide; NDFIP1 exon 3; Set C
auaguagcuucagccuugguccucuccgcuucaucaua

SEQ ID NO: 36224 - RNA, 20 nt, Artificial Sequence
  Synthetic Oligonucleotide; NDFIP1 exon 3; Set A
ucagccuugguccucuccgc

SEQ ID NO: 36225 - RNA, 22 nt, Artificial Sequence
  Synthetic Oligonucleotide; NDFIP1 exon 3; Set C
uucagccuugguccucuccgcu

SEQ ID NO: 36226 - RNA, 37 nt, Artificial Sequence
  Synthetic Oligonucleotide; NDFIP1 exon 3; Set C
auaguagcuucagccuugguccucuccgcuucaucau

SEQ ID NO: 36227 - RNA, 19 nt, Artificial Sequence
  Synthetic Oligonucleotide; NDFIP1 exon 3; Set A
ucagccuugguccucuccg

SEQ ID NO: 36228 - RNA, 25 nt, Artificial Sequence
  Synthetic Oligonucleotide; NDFIP1 exon 3; Set C
gcuucagccuugguccucuccgcuu

SEQ ID NO: 36229 - RNA, 36 nt, Artificial Sequence
  Synthetic Oligonucleotide; NDFIP1 exon 3; Set C
auaguagcuucagccuugguccucuccgcuucauca

SEQ ID NO: 36230 - RNA, 20 nt, Artificial Sequence
  Synthetic Oligonucleotide; NDFIP1 exon 3; Set A
uucagccuugguccucuccg

SEQ ID NO: 36231 - RNA, 32 nt, Artificial Sequence
  Synthetic Oligonucleotide; NDFIP1 exon 3; Set C
aguagcuucagccuugguccucuccgcuucau

SEQ ID NO: 36232 - RNA, 35 nt, Artificial Sequence
  Synthetic Oligonucleotide; NDFIP1 exon 3; Set C
auaguagcuucagccuugguccucuccgcuucauc

SEQ ID NO: 36233 - RNA, 23 nt, Artificial Sequence
  Synthetic Oligonucleotide; NDFIP1 exon 3; Set C
gcuucagccuugguccucuccgc

SEQ ID NO: 36234 - RNA, 33 nt, Artificial Sequence
  Synthetic Oligonucleotide; NDFIP1 exon 3; Set C
uaguagcuucagccuugguccucuccgcuucau

SEQ ID NO: 36235 - RNA, 31 nt, Artificial Sequence
  Synthetic Oligonucleotide; NDFIP1 exon 3; Set C
aguagcuucagccuugguccucuccgcuuca

SEQ ID NO: 36236 - RNA, 22 nt, Artificial Sequence
  Synthetic Oligonucleotide; NDFIP1 exon 3; Set C
gcuucagccuugguccucuccg

SEQ ID NO: 36237 - RNA, 32 nt, Artificial Sequence
  Synthetic Oligonucleotide; NDFIP1 exon 3; Set C
uaguagcuucagccuugguccucuccgcuuca

SEQ ID NO: 36238 - RNA, 30 nt, Artificial Sequence
  Synthetic Oligonucleotide; NDFIP1 exon 3; Set C
aguagcuucagccuugguccucuccgcuuc

SEQ ID NO: 36239 - RNA, 31 nt, Artificial Sequence
  Synthetic Oligonucleotide; NDFIP1 exon 3; Set C
uaguagcuucagccuugguccucuccgcuuc

SEQ ID NO: 36240 - RNA, 28 nt, Artificial Sequence
  Synthetic Oligonucleotide; NDFIP1 exon 3; Set C
aguagcuucagccuugguccucuccgcu

SEQ ID NO: 36241 - RNA, 29 nt, Artificial Sequence
  Synthetic Oligonucleotide; NDFIP1 exon 3; Set C
uaguagcuucagccuugguccucuccgcu

SEQ ID NO: 36242 - RNA, 40 nt, Artificial Sequence
  Synthetic Oligonucleotide; NDFIP1 exon 3; Set C
aaagggauaguagcuucagccuugguccucuccgcuucau

SEQ ID NO: 36243 - RNA, 35 nt, Artificial Sequence
  Synthetic Oligonucleotide; NDFIP1 exon 3; Set C
agggauaguagcuucagccuugguccucuccgcuu

SEQ ID NO: 36244 - RNA, 39 nt, Artificial Sequence
  Synthetic Oligonucleotide; NDFIP1 exon 3; Set C
aaagggauaguagcuucagccuugguccucuccgcuuca

SEQ ID NO: 36245 - RNA, 36 nt, Artificial Sequence
  Synthetic Oligonucleotide; NDFIP1 exon 3; Set C
aagggauaguagcuucagccuugguccucuccgcuu

SEQ ID NO: 36246 - RNA, 40 nt, Artificial Sequence
  Synthetic Oligonucleotide; NDFIP1 exon 3; Set C
caaagggauaguagcuucagccuugguccucuccgcuuca

SEQ ID NO: 36247 - RNA, 38 nt, Artificial Sequence
  Synthetic Oligonucleotide; NDFIP1 exon 3; Set C
aaagggauaguagcuucagccuugguccucuccgcuuc

SEQ ID NO: 36248 - RNA, 33 nt, Artificial Sequence
  Synthetic Oligonucleotide; NDFIP1 exon 3; Set C
agggauaguagcuucagccuugguccucuccgc

SEQ ID NO: 36249 - RNA, 34 nt, Artificial Sequence
  Synthetic Oligonucleotide; NDFIP1 exon 3; Set C
aagggauaguagcuucagccuugguccucuccgc

SEQ ID NO: 36250 - RNA, 32 nt, Artificial Sequence
  Synthetic Oligonucleotide; NDFIP1 exon 3; Set C
agggauaguagcuucagccuugguccucuccg

SEQ ID NO: 36251 - RNA, 38 nt, Artificial Sequence
  Synthetic Oligonucleotide; NDFIP1 exon 3; Set C
caaagggauaguagcuucagccuugguccucuccgcuu

SEQ ID NO: 36252 - RNA, 36 nt, Artificial Sequence
  Synthetic Oligonucleotide; NDFIP1 exon 3; Set C
aaagggauaguagcuucagccuugguccucuccgcu

SEQ ID NO: 36253 - RNA, 15 nt, Artificial Sequence
  Synthetic Oligonucleotide; NDFIP1 exon 3; Set C
uagcuucagccuugg

SEQ ID NO: 36254 - RNA, 33 nt, Artificial Sequence
  Synthetic Oligonucleotide; NDFIP1 exon 3; Set C
aagggauaguagcuucagccuugguccucuccg

SEQ ID NO: 36255 - RNA, 39 nt, Artificial Sequence
  Synthetic Oligonucleotide; NDFIP1 exon 3; Set C
ccaaagggauaguagcuucagccuugguccucuccgcuu

SEQ ID NO: 36256 - RNA, 37 nt, Artificial Sequence
  Synthetic Oligonucleotide; NDFIP1 exon 3; Set C
caaagggauaguagcuucagccuugguccucuccgcu

SEQ ID NO: 36257 - RNA, 19 nt, Artificial Sequence
  Synthetic Oligonucleotide; NDFIP1 exon 3; Set C
aguagcuucagccuugguc

SEQ ID NO: 36258 - RNA, 16 nt, Artificial Sequence
  Synthetic Oligonucleotide; NDFIP1 exon 3; Set C
guagcuucagccuugg

SEQ ID NO: 36259 - RNA, 36 nt, Artificial Sequence
  Synthetic Oligonucleotide; NDFIP1 exon 3; Set C
caaagggauaguagcuucagccuugguccucuccgc

SEQ ID NO: 36260 - RNA, 38 nt, Artificial Sequence
  Synthetic Oligonucleotide; NDFIP1 exon 3; Set C
ccaaagggauaguagcuucagccuugguccucuccgcu

SEQ ID NO: 36261 - RNA, 18 nt, Artificial Sequence
  Synthetic Oligonucleotide; NDFIP1 exon 3; Set C
aguagcuucagccuuggu

SEQ ID NO: 36262 - RNA, 20 nt, Artificial Sequence
  Synthetic Oligonucleotide; NDFIP1 exon 3; Set A
uaguagcuucagccuugguc

SEQ ID NO: 36263 - RNA, 15 nt, Artificial Sequence
  Synthetic Oligonucleotide; NDFIP1 exon 3; Set C
guagcuucagccuug

SEQ ID NO: 36264 - RNA, 37 nt, Artificial Sequence
  Synthetic Oligonucleotide; NDFIP1 exon 3; Set C
ccaaagggauaguagcuucagccuugguccucuccgc

SEQ ID NO: 36265 - RNA, 35 nt, Artificial Sequence
  Synthetic Oligonucleotide; NDFIP1 exon 3; Set C
caaagggauaguagcuucagccuugguccucuccg

SEQ ID NO: 36266 - RNA, 19 nt, Artificial Sequence
  Synthetic Oligonucleotide; NDFIP1 exon 3; Set C
uaguagcuucagccuuggu

SEQ ID NO: 36267 - RNA, 36 nt, Artificial Sequence
  Synthetic Oligonucleotide; NDFIP1 exon 3; Set C
ccaaagggauaguagcuucagccuugguccucuccg

SEQ ID NO: 36268 - RNA, 19 nt, Artificial Sequence
  Synthetic Oligonucleotide; NDFIP1 exon 3; Set C
auaguagcuucagccuugg

SEQ ID NO: 36269 - RNA, 15 nt, Artificial Sequence
  Synthetic Oligonucleotide; NDFIP1 exon 3; Set C
aguagcuucagccuu

SEQ ID NO: 36270 - RNA, 18 nt, Artificial Sequence
  Synthetic Oligonucleotide; NDFIP1 exon 3; Set C
auaguagcuucagccuug

SEQ ID NO: 36271 - RNA, 16 nt, Artificial Sequence
  Synthetic Oligonucleotide; NDFIP1 exon 3; Set C
uaguagcuucagccuu

SEQ ID NO: 36272 - RNA, 27 nt, Artificial Sequence
  Synthetic Oligonucleotide; NDFIP1 exon 3; Set A
aaagggauaguagcuucagccuugguc

SEQ ID NO: 36273 - RNA, 26 nt, Artificial Sequence
  Synthetic Oligonucleotide; NDFIP1 exon 3; Set A
aaagggauaguagcuucagccuuggu

SEQ ID NO: 36274 - RNA, 23 nt, Artificial Sequence
  Synthetic Oligonucleotide; NDFIP1 exon 3; Set C
aaagggauaguagcuucagccuu

SEQ ID NO: 36275 - RNA, 24 nt, Artificial Sequence
  Synthetic Oligonucleotide; NDFIP1 exon 3; Set A
caaagggauaguagcuucagccuu

SEQ ID NO: 36276 - RNA, 32 nt, Artificial Sequence
  Synthetic Oligonucleotide; NDFIP1 exon 3; Set C
aggaaccaaagggauaguagcuucagccuugg

SEQ ID NO: 36277 - RNA, 31 nt, Artificial Sequence
  Synthetic Oligonucleotide; NDFIP1 exon 3; Set A
aggaaccaaagggauaguagcuucagccuug

SEQ ID NO: 36278 - RNA, 15 nt, Artificial Sequence
  Synthetic Oligonucleotide; NDFIP1 exon 3; Set C
aagggauaguagcuu

SEQ ID NO: 36279 - RNA, 17 nt, Artificial Sequence
  Synthetic Oligonucleotide; NDFIP1 exon 3; Set C
caaagggauaguagcuu

SEQ ID NO: 36280 - RNA, 16 nt, Artificial Sequence
  Synthetic Oligonucleotide; NDFIP1 exon 3; Set C
caaagggauaguagcu

SEQ ID NO: 36281 - RNA, 18 nt, Artificial Sequence
  Synthetic Oligonucleotide; NDFIP1 exon 3; Set C
ccaaagggauaguagcuu

SEQ ID NO: 36282 - RNA, 17 nt, Artificial Sequence
  Synthetic Oligonucleotide; NDFIP1 exon 3; Set C
ccaaagggauaguagcu

SEQ ID NO: 36283 - RNA, 25 nt, Artificial Sequence
  Synthetic Oligonucleotide; NDFIP1 exon 3; Set A
aggaaccaaagggauaguagcuuca

SEQ ID NO: 36284 - RNA, 24 nt, Artificial Sequence
  Synthetic Oligonucleotide; NDFIP1 exon 3; Set C
aggaaccaaagggauaguagcuuc

SEQ ID NO: 36285 - RNA, 18 nt, Artificial Sequence
  Synthetic Oligonucleotide; NDFIP1 exon 3; Set C
aggaaccaaagggauagu

SEQ ID NO: 36286 - RNA, 17 nt, Artificial Sequence
  Synthetic Oligonucleotide; NDFIP1 exon 3; Set C
aggaaccaaagggauag

SEQ ID NO: 36287 - RNA, 38 nt, Artificial Sequence
  Synthetic Oligonucleotide; NDFIP1 exon 3; Set C
uacucacucucccaggaaccaaagggauaguagcuuca

SEQ ID NO: 36288 - RNA, 37 nt, Artificial Sequence
  Synthetic Oligonucleotide; NDFIP1 exon 3; Set C
uacucacucucccaggaaccaaagggauaguagcuuc

SEQ ID NO: 36289 - RNA, 39 nt, Artificial Sequence
  Synthetic Oligonucleotide; NDFIP1 exon 3; Set C
auacucacucucccaggaaccaaagggauaguagcuuca

SEQ ID NO: 36290 - RNA, 38 nt, Artificial Sequence
  Synthetic Oligonucleotide; NDFIP1 exon 3; Set C
auacucacucucccaggaaccaaagggauaguagcuuc

SEQ ID NO: 36291 - RNA, 36 nt, Artificial Sequence
  Synthetic Oligonucleotide; NDFIP1 exon 3; Set C
auacucacucucccaggaaccaaagggauaguagcu

SEQ ID NO: 36292 - RNA, 38 nt, Artificial Sequence
  Synthetic Oligonucleotide; NDFIP1 exon 3; Set C
uauacucacucucccaggaaccaaagggauaguagcuu

SEQ ID NO: 36293 - RNA, 37 nt, Artificial Sequence
  Synthetic Oligonucleotide; NDFIP1 exon 3; Set C
uauacucacucucccaggaaccaaagggauaguagcu

SEQ ID NO: 36294 - RNA, 39 nt, Artificial Sequence
  Synthetic Oligonucleotide; NDFIP1 exon 3; Set C
uuauacucacucucccaggaaccaaagggauaguagcuu

SEQ ID NO: 36295 - RNA, 38 nt, Artificial Sequence
  Synthetic Oligonucleotide; NDFIP1 exon 3; Set C
uuauacucacucucccaggaaccaaagggauaguagcu

SEQ ID NO: 36296 - RNA, 40 nt, Artificial Sequence
  Synthetic Oligonucleotide; NDFIP1 exon 3; Set C
auuauacucacucucccaggaaccaaagggauaguagcuu

SEQ ID NO: 36297 - RNA, 31 nt, Artificial Sequence
  Synthetic Oligonucleotide; NDFIP1 exon 3; Set C
uacucacucucccaggaaccaaagggauagu

SEQ ID NO: 36298 - RNA, 39 nt, Artificial Sequence
  Synthetic Oligonucleotide; NDFIP1 exon 3; Set C
auuauacucacucucccaggaaccaaagggauaguagcu

SEQ ID NO: 36299 - RNA, 30 nt, Artificial Sequence
  Synthetic Oligonucleotide; NDFIP1 exon 3; Set C
uacucacucucccaggaaccaaagggauag

SEQ ID NO: 36300 - RNA, 32 nt, Artificial Sequence
  Synthetic Oligonucleotide; NDFIP1 exon 3; Set C
auacucacucucccaggaaccaaagggauagu

SEQ ID NO: 36301 - RNA, 40 nt, Artificial Sequence
  Synthetic Oligonucleotide; NDFIP1 exon 3; Set C
aauuauacucacucucccaggaaccaaagggauaguagcu

SEQ ID NO: 36302 - RNA, 31 nt, Artificial Sequence
  Synthetic Oligonucleotide; NDFIP1 exon 3; Set B
auacucacucucccaggaaccaaagggauag

SEQ ID NO: 36303 - RNA, 27 nt, Artificial Sequence
  Synthetic Oligonucleotide; NDFIP1 exon 3; Set B
uauacucacucucccaggaaccaaagg

SEQ ID NO: 36304 - RNA, 24 nt, Artificial Sequence
  Synthetic Oligonucleotide; NDFIP1 exon 3; Set B
auacucacucucccaggaaccaaa

SEQ ID NO: 36305 - RNA, 26 nt, Artificial Sequence
  Synthetic Oligonucleotide; NDFIP1 exon 3; Set B
uauacucacucucccaggaaccaaag

SEQ ID NO: 36306 - RNA, 28 nt, Artificial Sequence
  Synthetic Oligonucleotide; NDFIP1 exon 3; Set B
uuauacucacucucccaggaaccaaagg

SEQ ID NO: 36307 - RNA, 27 nt, Artificial Sequence
  Synthetic Oligonucleotide; NDFIP1 exon 3; Set B
uuauacucacucucccaggaaccaaag

SEQ ID NO: 36308 - RNA, 29 nt, Artificial Sequence
  Synthetic Oligonucleotide; NDFIP1 exon 3; Set B
auuauacucacucucccaggaaccaaagg

SEQ ID NO: 36309 - RNA, 24 nt, Artificial Sequence
  Synthetic Oligonucleotide; NDFIP1 exon 3; Set B
uauacucacucucccaggaaccaa

SEQ ID NO: 36310 - RNA, 28 nt, Artificial Sequence
  Synthetic Oligonucleotide; NDFIP1 exon 3; Set B
auuauacucacucucccaggaaccaaag

SEQ ID NO: 36311 - RNA, 30 nt, Artificial Sequence
  Synthetic Oligonucleotide; NDFIP1 exon 3; Set B
aauuauacucacucucccaggaaccaaagg

SEQ ID NO: 36312 - RNA, 25 nt, Artificial Sequence
  Synthetic Oligonucleotide; NDFIP1 exon 3; Set B
uuauacucacucucccaggaaccaa

SEQ ID NO: 36313 - RNA, 23 nt, Artificial Sequence
  Synthetic Oligonucleotide; NDFIP1 exon 3; Set B
uauacucacucucccaggaacca

SEQ ID NO: 36314 - RNA, 29 nt, Artificial Sequence
  Synthetic Oligonucleotide; NDFIP1 exon 3; Set B
aauuauacucacucucccaggaaccaaag

SEQ ID NO: 36315 - RNA, 26 nt, Artificial Sequence
  Synthetic Oligonucleotide; NDFIP1 exon 3; Set B
auuauacucacucucccaggaaccaa

SEQ ID NO: 36316 - RNA, 24 nt, Artificial Sequence
  Synthetic Oligonucleotide; NDFIP1 exon 3; Set B
uuauacucacucucccaggaacca

SEQ ID NO: 36317 - RNA, 25 nt, Artificial Sequence
  Synthetic Oligonucleotide; NDFIP1 exon 3; Set B
auuauacucacucucccaggaacca

SEQ ID NO: 36318 - RNA, 26 nt, Artificial Sequence
  Synthetic Oligonucleotide; NDFIP1 exon 3; Set B
aauuauacucacucucccaggaacca

SEQ ID NO: 36319 - RNA, 34 nt, Artificial Sequence
  Synthetic Oligonucleotide; NDFIP1 exon 3; Set B
auggcaaauuauacucacucucccaggaaccaaa

SEQ ID NO: 36320 - RNA, 35 nt, Artificial Sequence
  Synthetic Oligonucleotide; NDFIP1 exon 3; Set C
cauggcaaauuauacucacucucccaggaaccaaa

SEQ ID NO: 36321 - RNA, 39 nt, Artificial Sequence
  Synthetic Oligonucleotide; NDFIP1 exon 3; Set C
aacauggcaaauuauacucacucucccaggaaccaaagg

SEQ ID NO: 36322 - RNA, 36 nt, Artificial Sequence
  Synthetic Oligonucleotide; NDFIP1 exon 3; Set C
acauggcaaauuauacucacucucccaggaaccaaa

SEQ ID NO: 36323 - RNA, 38 nt, Artificial Sequence
  Synthetic Oligonucleotide; NDFIP1 exon 3; Set C
aacauggcaaauuauacucacucucccaggaaccaaag

SEQ ID NO: 36324 - RNA, 40 nt, Artificial Sequence
  Synthetic Oligonucleotide; NDFIP1 exon 3; Set C
uaacauggcaaauuauacucacucucccaggaaccaaagg

SEQ ID NO: 36325 - RNA, 35 nt, Artificial Sequence
  Synthetic Oligonucleotide; NDFIP1 exon 3; Set C
acauggcaaauuauacucacucucccaggaaccaa

SEQ ID NO: 36326 - RNA, 39 nt, Artificial Sequence
  Synthetic Oligonucleotide; NDFIP1 exon 3; Set C
uaacauggcaaauuauacucacucucccaggaaccaaag

SEQ ID NO: 36327 - RNA, 36 nt, Artificial Sequence
  Synthetic Oligonucleotide; NDFIP1 exon 3; Set C
aacauggcaaauuauacucacucucccaggaaccaa

SEQ ID NO: 36328 - RNA, 40 nt, Artificial Sequence
  Synthetic Oligonucleotide; NDFIP1 exon 3; Set C
guaacauggcaaauuauacucacucucccaggaaccaaag

SEQ ID NO: 36329 - RNA, 37 nt, Artificial Sequence
  Synthetic Oligonucleotide; NDFIP1 exon 3; Set C
uaacauggcaaauuauacucacucucccaggaaccaa

SEQ ID NO: 36330 - RNA, 35 nt, Artificial Sequence
  Synthetic Oligonucleotide; NDFIP1 exon 3; Set C
aacauggcaaauuauacucacucucccaggaacca

SEQ ID NO: 36331 - RNA, 38 nt, Artificial Sequence
  Synthetic Oligonucleotide; NDFIP1 exon 3; Set C
guaacauggcaaauuauacucacucucccaggaaccaa

SEQ ID NO: 36332 - RNA, 36 nt, Artificial Sequence
  Synthetic Oligonucleotide; NDFIP1 exon 3; Set C
uaacauggcaaauuauacucacucucccaggaacca

SEQ ID NO: 36333 - RNA, 37 nt, Artificial Sequence
  Synthetic Oligonucleotide; NDFIP1 exon 3; Set C
guaacauggcaaauuauacucacucucccaggaacca

SEQ ID NO: 36334 - RNA, 15 nt, Artificial Sequence
  Synthetic Oligonucleotide; NDFIP1 exon 3; Set C
cauggcaaauuauac

SEQ ID NO: 36335 - RNA, 16 nt, Artificial Sequence
  Synthetic Oligonucleotide; NDFIP1 exon 3; Set C
acauggcaaauuauac

SEQ ID NO: 36336 - RNA, 18 nt, Artificial Sequence
  Synthetic Oligonucleotide; NDFIP1 exon 3; Set C
aacauggcaaauuauacu

SEQ ID NO: 36337 - RNA, 15 nt, Artificial Sequence
  Synthetic Oligonucleotide; NDFIP1 exon 3; Set C
acauggcaaauuaua

SEQ ID NO: 36338 - RNA, 19 nt, Artificial Sequence
  Synthetic Oligonucleotide; NDFIP1 exon 3; Set C
uaacauggcaaauuauacu

SEQ ID NO: 36339 - RNA, 20 nt, Artificial Sequence
  Synthetic Oligonucleotide; NDFIP1 exon 3; Set C
guaacauggcaaauuauacu

SEQ ID NO: 36340 - RNA, 22 nt, Artificial Sequence
  Synthetic Oligonucleotide; NDFIP1 exon 3; Set C
ucaaguaacauggcaaauuaua

SEQ ID NO: 36341 - RNA, 22 nt, Artificial Sequence
  Synthetic Oligonucleotide; NDFIP1 exon 3; Set C
aucaaguaacauggcaaauuau

SEQ ID NO: 36342 - RNA, 21 nt, Artificial Sequence
  Synthetic Oligonucleotide; NDFIP1 exon 3; Set C
aucaaguaacauggcaaauua

SEQ ID NO: 36343 - RNA, 23 nt, Artificial Sequence
  Synthetic Oligonucleotide; NDFIP1 exon 3; Set C
caucaaguaacauggcaaauuau

SEQ ID NO: 36344 - RNA, 19 nt, Artificial Sequence
  Synthetic Oligonucleotide; NDFIP1 exon 3; Set C
ucaaguaacauggcaaauu

SEQ ID NO: 36345 - RNA, 20 nt, Artificial Sequence
  Synthetic Oligonucleotide; NDFIP1 exon 3; Set C
aucaaguaacauggcaaauu

SEQ ID NO: 36346 - RNA, 18 nt, Artificial Sequence
  Synthetic Oligonucleotide; NDFIP1 exon 3; Set C
ucaaguaacauggcaaau

SEQ ID NO: 36347 - RNA, 19 nt, Artificial Sequence
  Synthetic Oligonucleotide; NDFIP1 exon 3; Set C
aucaaguaacauggcaaau

SEQ ID NO: 36348 - RNA, 35 nt, Artificial Sequence
  Synthetic Oligonucleotide; NDFIP1 exon 3; Set C
ccacagagcagccaucaaguaacauggcaaauuau

SEQ ID NO: 36349 - RNA, 34 nt, Artificial Sequence
  Synthetic Oligonucleotide; NDFIP1 exon 3; Set C
ccacagagcagccaucaaguaacauggcaaauua

SEQ ID NO: 36350 - RNA, 31 nt, Artificial Sequence
  Synthetic Oligonucleotide; NDFIP1 exon 3; Set B
aauucccacagagcagccaucaaguaacaug

SEQ ID NO: 36351 - RNA, 30 nt, Artificial Sequence
  Synthetic Oligonucleotide; NDFIP1 exon 3; Set B
aauucccacagagcagccaucaaguaacau

SEQ ID NO: 36352 - RNA, 32 nt, Artificial Sequence
  Synthetic Oligonucleotide; NDFIP1 exon 3; Set B
uaauucccacagagcagccaucaaguaacaug

SEQ ID NO: 36353 - RNA, 29 nt, Artificial Sequence
  Synthetic Oligonucleotide; NDFIP1 exon 3; Set B
aauucccacagagcagccaucaaguaaca

SEQ ID NO: 36354 - RNA, 31 nt, Artificial Sequence
  Synthetic Oligonucleotide; NDFIP1 exon 3; Set B
uaauucccacagagcagccaucaaguaacau

SEQ ID NO: 36355 - RNA, 33 nt, Artificial Sequence
  Synthetic Oligonucleotide; NDFIP1 exon 3; Set B
uuaauucccacagagcagccaucaaguaacaug

SEQ ID NO: 36356 - RNA, 30 nt, Artificial Sequence
  Synthetic Oligonucleotide; NDFIP1 exon 3; Set B
uaauucccacagagcagccaucaaguaaca

SEQ ID NO: 36357 - RNA, 32 nt, Artificial Sequence
  Synthetic Oligonucleotide; NDFIP1 exon 3; Set B
uuaauucccacagagcagccaucaaguaacau

SEQ ID NO: 36358 - RNA, 34 nt, Artificial Sequence
  Synthetic Oligonucleotide; NDFIP1 exon 3; Set C
cuuaauucccacagagcagccaucaaguaacaug

SEQ ID NO: 36359 - RNA, 27 nt, Artificial Sequence
  Synthetic Oligonucleotide; NDFIP1 exon 3; Set B
aauucccacagagcagccaucaaguaa

SEQ ID NO: 36360 - RNA, 31 nt, Artificial Sequence
  Synthetic Oligonucleotide; NDFIP1 exon 3; Set B
uuaauucccacagagcagccaucaaguaaca

SEQ ID NO: 36361 - RNA, 33 nt, Artificial Sequence
  Synthetic Oligonucleotide; NDFIP1 exon 3; Set C
cuuaauucccacagagcagccaucaaguaacau

SEQ ID NO: 36362 - RNA, 26 nt, Artificial Sequence
  Synthetic Oligonucleotide; NDFIP1 exon 3; Set B
aauucccacagagcagccaucaagua

SEQ ID NO: 36363 - RNA, 32 nt, Artificial Sequence
  Synthetic Oligonucleotide; NDFIP1 exon 3; Set C
cuuaauucccacagagcagccaucaaguaaca

SEQ ID NO: 36364 - RNA, 27 nt, Artificial Sequence
  Synthetic Oligonucleotide; NDFIP1 exon 3; Set B
uaauucccacagagcagccaucaagua

SEQ ID NO: 36365 - RNA, 16 nt, Artificial Sequence
  Synthetic Oligonucleotide; NDFIP1 exon 3; Set C
uuagcugaauugaaau

SEQ ID NO: 36366 - RNA, 15 nt, Artificial Sequence
  Synthetic Oligonucleotide; NDFIP1 exon 3; Set C
uuagcugaauugaaa

SEQ ID NO: 36367 - RNA, 20 nt, Artificial Sequence
  Synthetic Oligonucleotide; NDFIP1 exon 3; Set C
augauuagcugaauugaaau

SEQ ID NO: 36368 - RNA, 19 nt, Artificial Sequence
  Synthetic Oligonucleotide; NDFIP1 exon 3; Set C
augauuagcugaauugaaa

SEQ ID NO: 36369 - RNA, 18 nt, Artificial Sequence
  Synthetic Oligonucleotide; NDFIP1 exon 3; Set C
augauuagcugaauugaa

SEQ ID NO: 36370 - RNA, 17 nt, Artificial Sequence
  Synthetic Oligonucleotide; NDFIP1 exon 3; Set C
augauuagcugaauuga

SEQ ID NO: 36371 - RNA, 24 nt, Artificial Sequence
  Synthetic Oligonucleotide; NDFIP1 exon 3; Set C
uuugaugauuagcugaauugaaau

SEQ ID NO: 36372 - RNA, 16 nt, Artificial Sequence
  Synthetic Oligonucleotide; NDFIP1 exon 3; Set C
augauuagcugaauug

SEQ ID NO: 36373 - RNA, 25 nt, Artificial Sequence
  Synthetic Oligonucleotide; NDFIP1 exon 3; Set C
uuuugaugauuagcugaauugaaau

SEQ ID NO: 36374 - RNA, 23 nt, Artificial Sequence
  Synthetic Oligonucleotide; NDFIP1 exon 3; Set C
uuugaugauuagcugaauugaaa

SEQ ID NO: 36375 - RNA, 15 nt, Artificial Sequence
  Synthetic Oligonucleotide; NDFIP1 exon 3; Set C
augauuagcugaauu

SEQ ID NO: 36376 - RNA, 26 nt, Artificial Sequence
  Synthetic Oligonucleotide; NDFIP1 exon 3; Set C
uuuuugaugauuagcugaauugaaau

SEQ ID NO: 36377 - RNA, 24 nt, Artificial Sequence
  Synthetic Oligonucleotide; NDFIP1 exon 3; Set C
uuuugaugauuagcugaauugaaa

SEQ ID NO: 36378 - RNA, 22 nt, Artificial Sequence
  Synthetic Oligonucleotide; NDFIP1 exon 3; Set C
uuugaugauuagcugaauugaa

SEQ ID NO: 36379 - RNA, 27 nt, Artificial Sequence
  Synthetic Oligonucleotide; NDFIP1 exon 3; Set C
uuuuuugaugauuagcugaauugaaau

SEQ ID NO: 36380 - RNA, 25 nt, Artificial Sequence
  Synthetic Oligonucleotide; NDFIP1 exon 3; Set C
uuuuugaugauuagcugaauugaaa

SEQ ID NO: 36381 - RNA, 23 nt, Artificial Sequence
  Synthetic Oligonucleotide; NDFIP1 exon 3; Set C
uuuugaugauuagcugaauugaa

SEQ ID NO: 36382 - RNA, 21 nt, Artificial Sequence
  Synthetic Oligonucleotide; NDFIP1 exon 3; Set C
uuugaugauuagcugaauuga

SEQ ID NO: 36383 - RNA, 26 nt, Artificial Sequence
  Synthetic Oligonucleotide; NDFIP1 exon 3; Set C
uuuuuugaugauuagcugaauugaaa

SEQ ID NO: 36384 - RNA, 24 nt, Artificial Sequence
  Synthetic Oligonucleotide; NDFIP1 exon 3; Set C
uuuuugaugauuagcugaauugaa

SEQ ID NO: 36385 - RNA, 22 nt, Artificial Sequence
  Synthetic Oligonucleotide; NDFIP1 exon 3; Set C
uuuugaugauuagcugaauuga

SEQ ID NO: 36386 - RNA, 20 nt, Artificial Sequence
  Synthetic Oligonucleotide; NDFIP1 exon 3; Set C
uuugaugauuagcugaauug

SEQ ID NO: 36387 - RNA, 25 nt, Artificial Sequence
  Synthetic Oligonucleotide; NDFIP1 exon 3; Set C
uuuuuugaugauuagcugaauugaa

SEQ ID NO: 36388 - RNA, 23 nt, Artificial Sequence
  Synthetic Oligonucleotide; NDFIP1 exon 3; Set C
uuuuugaugauuagcugaauuga

SEQ ID NO: 36389 - RNA, 19 nt, Artificial Sequence
  Synthetic Oligonucleotide; NDFIP1 exon 3; Set C
uuugaugauuagcugaauu

SEQ ID NO: 36390 - RNA, 21 nt, Artificial Sequence
  Synthetic Oligonucleotide; NDFIP1 exon 3; Set C
uuuugaugauuagcugaauug

SEQ ID NO: 36391 - RNA, 24 nt, Artificial Sequence
  Synthetic Oligonucleotide; NDFIP1 exon 3; Set C
uuuuuugaugauuagcugaauuga

SEQ ID NO: 36392 - RNA, 20 nt, Artificial Sequence
  Synthetic Oligonucleotide; NDFIP1 exon 3; Set C
uuuugaugauuagcugaauu

SEQ ID NO: 36393 - RNA, 18 nt, Artificial Sequence
  Synthetic Oligonucleotide; NDFIP1 exon 3; Set C
uuugaugauuagcugaau

SEQ ID NO: 36394 - RNA, 22 nt, Artificial Sequence
  Synthetic Oligonucleotide; NDFIP1 exon 3; Set C
uuuuugaugauuagcugaauug

SEQ ID NO: 36395 - RNA, 17 nt, Artificial Sequence
  Synthetic Oligonucleotide; NDFIP1 exon 3; Set C
uuugaugauuagcugaa

SEQ ID NO: 36396 - RNA, 21 nt, Artificial Sequence
  Synthetic Oligonucleotide; NDFIP1 exon 3; Set C
uuuuugaugauuagcugaauu

SEQ ID NO: 36397 - RNA, 19 nt, Artificial Sequence
  Synthetic Oligonucleotide; NDFIP1 exon 3; Set C
uuuugaugauuagcugaau

SEQ ID NO: 36398 - RNA, 23 nt, Artificial Sequence
  Synthetic Oligonucleotide; NDFIP1 exon 3; Set C
uuuuuugaugauuagcugaauug

SEQ ID NO: 36399 - RNA, 18 nt, Artificial Sequence
  Synthetic Oligonucleotide; NDFIP1 exon 3; Set C
uuuugaugauuagcugaa

SEQ ID NO: 36400 - RNA, 22 nt, Artificial Sequence
  Synthetic Oligonucleotide; NDFIP1 exon 3; Set C
uuuuuugaugauuagcugaauu

SEQ ID NO: 36401 - RNA, 20 nt, Artificial Sequence
  Synthetic Oligonucleotide; NDFIP1 exon 3; Set C
uuuuugaugauuagcugaau

SEQ ID NO: 36402 - RNA, 19 nt, Artificial Sequence
  Synthetic Oligonucleotide; NDFIP1 exon 3; Set C
uuuuugaugauuagcugaa

SEQ ID NO: 36403 - RNA, 21 nt, Artificial Sequence
  Synthetic Oligonucleotide; NDFIP1 exon 3; Set C
uuuuuugaugauuagcugaau

SEQ ID NO: 36404 - RNA, 20 nt, Artificial Sequence
  Synthetic Oligonucleotide; NDFIP1 exon 3; Set C
uuuuuugaugauuagcugaa

SEQ ID NO: 36405 - RNA, 15 nt, Artificial Sequence
  Synthetic Oligonucleotide; NDFIP1 exon 3; Set C
auuuuuugaugauua

SEQ ID NO: 36406 - RNA, 36 nt, Artificial Sequence
  Synthetic Oligonucleotide; NDFIP1 exon 3; Set A
gucaaaauaugcugcagaauuuuaacagucacaauu

SEQ ID NO: 36407 - RNA, 39 nt, Artificial Sequence
  Synthetic Oligonucleotide; NDFIP1 exon 3; Set A
guagucaaaauaugcugcagaauuuuaacagucacaauu

SEQ ID NO: 36408 - RNA, 40 nt, Artificial Sequence
  Synthetic Oligonucleotide; NDFIP1 exon 3; Set A
uguagucaaaauaugcugcagaauuuuaacagucacaauu

SEQ ID NO: 36409 - RNA, 22 nt, Artificial Sequence
  Synthetic Oligonucleotide; NDFIP1 exon 3; Set C
gucaaaauaugcugcagaauuu

SEQ ID NO: 36410 - RNA, 21 nt, Artificial Sequence
  Synthetic Oligonucleotide; NDFIP1 exon 3; Set C
gucaaaauaugcugcagaauu

SEQ ID NO: 36411 - RNA, 27 nt, Artificial Sequence
  Synthetic Oligonucleotide; NDFIP1 exon 3; Set C
guagucaaaauaugcugcagaauuuua

SEQ ID NO: 36412 - RNA, 22 nt, Artificial Sequence
  Synthetic Oligonucleotide; NDFIP1 exon 3; Set C
agucaaaauaugcugcagaauu

SEQ ID NO: 36413 - RNA, 26 nt, Artificial Sequence
  Synthetic Oligonucleotide; NDFIP1 exon 3; Set C
guagucaaaauaugcugcagaauuuu

SEQ ID NO: 36414 - RNA, 28 nt, Artificial Sequence
  Synthetic Oligonucleotide; NDFIP1 exon 3; Set C
uguagucaaaauaugcugcagaauuuua

SEQ ID NO: 36415 - RNA, 20 nt, Artificial Sequence
  Synthetic Oligonucleotide; NDFIP1 exon 3; Set C
gucaaaauaugcugcagaau

SEQ ID NO: 36416 - RNA, 25 nt, Artificial Sequence
  Synthetic Oligonucleotide; NDFIP1 exon 3; Set C
guagucaaaauaugcugcagaauuu

SEQ ID NO: 36417 - RNA, 27 nt, Artificial Sequence
  Synthetic Oligonucleotide; NDFIP1 exon 3; Set C
uguagucaaaauaugcugcagaauuuu

SEQ ID NO: 36418 - RNA, 21 nt, Artificial Sequence
  Synthetic Oligonucleotide; NDFIP1 exon 3; Set C
agucaaaauaugcugcagaau

SEQ ID NO: 36419 - RNA, 19 nt, Artificial Sequence
  Synthetic Oligonucleotide; NDFIP1 exon 3; Set C
gucaaaauaugcugcagaa

SEQ ID NO: 36420 - RNA, 24 nt, Artificial Sequence
  Synthetic Oligonucleotide; NDFIP1 exon 3; Set C
guagucaaaauaugcugcagaauu

SEQ ID NO: 36421 - RNA, 26 nt, Artificial Sequence
  Synthetic Oligonucleotide; NDFIP1 exon 3; Set C
uguagucaaaauaugcugcagaauuu

SEQ ID NO: 36422 - RNA, 20 nt, Artificial Sequence
  Synthetic Oligonucleotide; NDFIP1 exon 3; Set C
agucaaaauaugcugcagaa

SEQ ID NO: 36423 - RNA, 18 nt, Artificial Sequence
  Synthetic Oligonucleotide; NDFIP1 exon 3; Set C
gucaaaauaugcugcaga

SEQ ID NO: 36424 - RNA, 25 nt, Artificial Sequence
  Synthetic Oligonucleotide; NDFIP1 exon 3; Set C
uguagucaaaauaugcugcagaauu

SEQ ID NO: 36425 - RNA, 23 nt, Artificial Sequence
  Synthetic Oligonucleotide; NDFIP1 exon 3; Set C
guagucaaaauaugcugcagaau

SEQ ID NO: 36426 - RNA, 19 nt, Artificial Sequence
  Synthetic Oligonucleotide; NDFIP1 exon 3; Set C
agucaaaauaugcugcaga

SEQ ID NO: 36427 - RNA, 22 nt, Artificial Sequence
  Synthetic Oligonucleotide; NDFIP1 exon 3; Set C
guagucaaaauaugcugcagaa

SEQ ID NO: 36428 - RNA, 24 nt, Artificial Sequence
  Synthetic Oligonucleotide; NDFIP1 exon 3; Set C
uguagucaaaauaugcugcagaau

SEQ ID NO: 36429 - RNA, 23 nt, Artificial Sequence
  Synthetic Oligonucleotide; NDFIP1 exon 3; Set C
uguagucaaaauaugcugcagaa

SEQ ID NO: 36430 - RNA, 21 nt, Artificial Sequence
  Synthetic Oligonucleotide; NDFIP1 exon 3; Set C
guagucaaaauaugcugcaga

SEQ ID NO: 36431 - RNA, 22 nt, Artificial Sequence
  Synthetic Oligonucleotide; NDFIP1 exon 3; Set C
uguagucaaaauaugcugcaga

SEQ ID NO: 36432 - RNA, 40 nt, Artificial Sequence
  Synthetic Oligonucleotide; NDFIP1 exon 3; Set C
gaaacccagacucauccuuguagucaaaauaugcugcaga

SEQ ID NO: 36433 - RNA, 25 nt, Artificial Sequence
  Synthetic Oligonucleotide; NDFIP1 exon 3; Set A
gaaacccagacucauccuuguaguc

SEQ ID NO: 36434 - RNA, 24 nt, Artificial Sequence
  Synthetic Oligonucleotide; NDFIP1 exon 3; Set A
gaaacccagacucauccuuguagu

SEQ ID NO: 36435 - RNA, 26 nt, Artificial Sequence
  Synthetic Oligonucleotide; NDFIP1 exon 3; Set A
ggaaacccagacucauccuuguaguc

SEQ ID NO: 36436 - RNA, 23 nt, Artificial Sequence
  Synthetic Oligonucleotide; NDFIP1 exon 3; Set C
gaaacccagacucauccuuguag

SEQ ID NO: 36437 - RNA, 25 nt, Artificial Sequence
  Synthetic Oligonucleotide; NDFIP1 exon 3; Set A
ggaaacccagacucauccuuguagu

SEQ ID NO: 36438 - RNA, 24 nt, Artificial Sequence
  Synthetic Oligonucleotide; NDFIP1 exon 3; Set A
ggaaacccagacucauccuuguag

SEQ ID NO: 36439 - RNA, 36 nt, Artificial Sequence
  Synthetic Oligonucleotide; NDFIP1 exon 3; Set C
ugggggcuuuggaaacccagacucauccuuguaguc

SEQ ID NO: 36440 - RNA, 35 nt, Artificial Sequence
  Synthetic Oligonucleotide; NDFIP1 exon 3; Set C
ugggggcuuuggaaacccagacucauccuuguagu

SEQ ID NO: 36441 - RNA, 33 nt, Artificial Sequence
  Synthetic Oligonucleotide; NDFIP1 exon 3; Set C
ugggggcuuuggaaacccagacucauccuugua

SEQ ID NO: 36442 - RNA, 39 nt, Artificial Sequence
  Synthetic Oligonucleotide; NDFIP1 exon 3; Set C
uaagaugggggcuuuggaaacccagacucauccuuguag

SEQ ID NO: 36443 - RNA, 40 nt, Artificial Sequence
  Synthetic Oligonucleotide; NDFIP1 exon 3; Set C
guaagaugggggcuuuggaaacccagacucauccuuguag

SEQ ID NO: 36444 - RNA, 40 nt, Artificial Sequence
  Synthetic Oligonucleotide; NDFIP1 exon 3; Set C
uguaagaugggggcuuuggaaacccagacucauccuugua

SEQ ID NO: 36445 - RNA, 39 nt, Artificial Sequence
  Synthetic Oligonucleotide; NDFIP1 exon 3; Set C
uguaagaugggggcuuuggaaacccagacucauccuugu

SEQ ID NO: 36446 - RNA, 40 nt, Artificial Sequence
  Synthetic Oligonucleotide; NDFIP1 exon 3; Set C
uuguaagaugggggcuuuggaaacccagacucauccuugu

SEQ ID NO: 36447 - RNA, 28 nt, Artificial Sequence
  Synthetic Oligonucleotide; NDFIP1 exon 3; Set C
uaagaugggggcuuuggaaacccagacu

SEQ ID NO: 36448 - RNA, 29 nt, Artificial Sequence
  Synthetic Oligonucleotide; NDFIP1 exon 3; Set C
guaagaugggggcuuuggaaacccagacu

SEQ ID NO: 36449 - RNA, 27 nt, Artificial Sequence
  Synthetic Oligonucleotide; NDFIP1 exon 3; Set A
uaagaugggggcuuuggaaacccagac

SEQ ID NO: 36450 - RNA, 26 nt, Artificial Sequence
  Synthetic Oligonucleotide; NDFIP1 exon 3; Set A
uaagaugggggcuuuggaaacccaga

SEQ ID NO: 36451 - RNA, 28 nt, Artificial Sequence
  Synthetic Oligonucleotide; NDFIP1 exon 3; Set C
guaagaugggggcuuuggaaacccagac

SEQ ID NO: 36452 - RNA, 27 nt, Artificial Sequence
  Synthetic Oligonucleotide; NDFIP1 exon 3; Set A
guaagaugggggcuuuggaaacccaga

SEQ ID NO: 36453 - RNA, 21 nt, Artificial Sequence
  Synthetic Oligonucleotide; NDFIP1 exon 3; Set C
uguaagaugggggcuuuggaa

SEQ ID NO: 36454 - RNA, 18 nt, Artificial Sequence
  Synthetic Oligonucleotide; NDFIP1 exon 3; Set C
guaagaugggggcuuugg

SEQ ID NO: 36455 - RNA, 20 nt, Artificial Sequence
  Synthetic Oligonucleotide; NDFIP1 exon 3; Set A
uguaagaugggggcuuugga

SEQ ID NO: 36456 - RNA, 22 nt, Artificial Sequence
  Synthetic Oligonucleotide; NDFIP1 exon 3; Set A
uuguaagaugggggcuuuggaa

SEQ ID NO: 36457 - RNA, 21 nt, Artificial Sequence
  Synthetic Oligonucleotide; NDFIP1 exon 3; Set A
uuguaagaugggggcuuugga

SEQ ID NO: 36458 - RNA, 23 nt, Artificial Sequence
  Synthetic Oligonucleotide; NDFIP1 exon 3; Set A
auuguaagaugggggcuuuggaa

SEQ ID NO: 36459 - RNA, 22 nt, Artificial Sequence
  Synthetic Oligonucleotide; NDFIP1 exon 3; Set A
auuguaagaugggggcuuugga

SEQ ID NO: 36460 - RNA, 24 nt, Artificial Sequence
  Synthetic Oligonucleotide; NDFIP1 exon 3; Set A
cauuguaagaugggggcuuuggaa

SEQ ID NO: 36461 - RNA, 23 nt, Artificial Sequence
  Synthetic Oligonucleotide; NDFIP1 exon 3; Set A
cauuguaagaugggggcuuugga

SEQ ID NO: 36462 - RNA, 30 nt, Artificial Sequence
  Synthetic Oligonucleotide; NDFIP1 exon 3; Set A
uagcuacauuguaagaugggggcuuuggaa

SEQ ID NO: 36463 - RNA, 29 nt, Artificial Sequence
  Synthetic Oligonucleotide; NDFIP1 exon 3; Set C
uagcuacauuguaagaugggggcuuugga

SEQ ID NO: 36464 - RNA, 31 nt, Artificial Sequence
  Synthetic Oligonucleotide; NDFIP1 exon 3; Set C
guagcuacauuguaagaugggggcuuuggaa

SEQ ID NO: 36465 - RNA, 30 nt, Artificial Sequence
  Synthetic Oligonucleotide; NDFIP1 exon 3; Set C
guagcuacauuguaagaugggggcuuugga

SEQ ID NO: 36466 - RNA, 32 nt, Artificial Sequence
  Synthetic Oligonucleotide; NDFIP1 exon 3; Set C
uguagcuacauuguaagaugggggcuuuggaa

SEQ ID NO: 36467 - RNA, 31 nt, Artificial Sequence
  Synthetic Oligonucleotide; NDFIP1 exon 3; Set C
uguagcuacauuguaagaugggggcuuugga

SEQ ID NO: 36468 - RNA, 33 nt, Artificial Sequence
  Synthetic Oligonucleotide; NDFIP1 exon 3; Set C
uuguagcuacauuguaagaugggggcuuuggaa

SEQ ID NO: 36469 - RNA, 15 nt, Artificial Sequence
  Synthetic Oligonucleotide; NDFIP1 exon 3; Set C
cauuguaagaugggg

SEQ ID NO: 36470 - RNA, 34 nt, Artificial Sequence
  Synthetic Oligonucleotide; NDFIP1 exon 3; Set C
guuguagcuacauuguaagaugggggcuuuggaa

SEQ ID NO: 36471 - RNA, 33 nt, Artificial Sequence
  Synthetic Oligonucleotide; NDFIP1 exon 3; Set C
guuguagcuacauuguaagaugggggcuuugga

SEQ ID NO: 36472 - RNA, 35 nt, Artificial Sequence
  Synthetic Oligonucleotide; NDFIP1 exon 3; Set C
uguuguagcuacauuguaagaugggggcuuuggaa

SEQ ID NO: 36473 - RNA, 36 nt, Artificial Sequence
  Synthetic Oligonucleotide; NDFIP1 exon 3; Set C
guguuguagcuacauuguaagaugggggcuuuggaa

SEQ ID NO: 36474 - RNA, 35 nt, Artificial Sequence
  Synthetic Oligonucleotide; NDFIP1 exon 3; Set C
guguuguagcuacauuguaagaugggggcuuugga

SEQ ID NO: 36475 - RNA, 37 nt, Artificial Sequence
  Synthetic Oligonucleotide; NDFIP1 exon 3; Set C
aguguuguagcuacauuguaagaugggggcuuuggaa

SEQ ID NO: 36476 - RNA, 36 nt, Artificial Sequence
  Synthetic Oligonucleotide; NDFIP1 exon 3; Set C
aguguuguagcuacauuguaagaugggggcuuugga

SEQ ID NO: 36477 - RNA, 38 nt, Artificial Sequence
  Synthetic Oligonucleotide; NDFIP1 exon 3; Set C
caguguuguagcuacauuguaagaugggggcuuuggaa

SEQ ID NO: 36478 - RNA, 37 nt, Artificial Sequence
  Synthetic Oligonucleotide; NDFIP1 exon 3; Set C
caguguuguagcuacauuguaagaugggggcuuugga

SEQ ID NO: 36479 - RNA, 21 nt, Artificial Sequence
  Synthetic Oligonucleotide; NDFIP1 exon 3; Set C
uagcuacauuguaagaugggg

SEQ ID NO: 36480 - RNA, 22 nt, Artificial Sequence
  Synthetic Oligonucleotide; NDFIP1 exon 3; Set C
guagcuacauuguaagaugggg

SEQ ID NO: 36481 - RNA, 20 nt, Artificial Sequence
  Synthetic Oligonucleotide; NDFIP1 exon 3; Set C
uagcuacauuguaagauggg

SEQ ID NO: 36482 - RNA, 23 nt, Artificial Sequence
  Synthetic Oligonucleotide; NDFIP1 exon 3; Set C
uguagcuacauuguaagaugggg

SEQ ID NO: 36483 - RNA, 21 nt, Artificial Sequence
  Synthetic Oligonucleotide; NDFIP1 exon 3; Set C
guagcuacauuguaagauggg

SEQ ID NO: 36484 - RNA, 24 nt, Artificial Sequence
  Synthetic Oligonucleotide; NDFIP1 exon 3; Set C
uuguagcuacauuguaagaugggg

SEQ ID NO: 36485 - RNA, 22 nt, Artificial Sequence
  Synthetic Oligonucleotide; NDFIP1 exon 3; Set C
uguagcuacauuguaagauggg

SEQ ID NO: 36486 - RNA, 25 nt, Artificial Sequence
  Synthetic Oligonucleotide; NDFIP1 exon 3; Set A
guuguagcuacauuguaagaugggg

SEQ ID NO: 36487 - RNA, 23 nt, Artificial Sequence
  Synthetic Oligonucleotide; NDFIP1 exon 3; Set C
uuguagcuacauuguaagauggg

SEQ ID NO: 36488 - RNA, 24 nt, Artificial Sequence
  Synthetic Oligonucleotide; NDFIP1 exon 3; Set C
guuguagcuacauuguaagauggg

SEQ ID NO: 36489 - RNA, 27 nt, Artificial Sequence
  Synthetic Oligonucleotide; NDFIP1 exon 3; Set A
guguuguagcuacauuguaagaugggg

SEQ ID NO: 36490 - RNA, 25 nt, Artificial Sequence
  Synthetic Oligonucleotide; NDFIP1 exon 3; Set C
uguuguagcuacauuguaagauggg

SEQ ID NO: 36491 - RNA, 28 nt, Artificial Sequence
  Synthetic Oligonucleotide; NDFIP1 exon 3; Set A
aguguuguagcuacauuguaagaugggg

SEQ ID NO: 36492 - RNA, 26 nt, Artificial Sequence
  Synthetic Oligonucleotide; NDFIP1 exon 3; Set A
guguuguagcuacauuguaagauggg

SEQ ID NO: 36493 - RNA, 29 nt, Artificial Sequence
  Synthetic Oligonucleotide; NDFIP1 exon 3; Set A
caguguuguagcuacauuguaagaugggg

SEQ ID NO: 36494 - RNA, 27 nt, Artificial Sequence
  Synthetic Oligonucleotide; NDFIP1 exon 3; Set A
aguguuguagcuacauuguaagauggg

SEQ ID NO: 36495 - RNA, 28 nt, Artificial Sequence
  Synthetic Oligonucleotide; NDFIP1 exon 3; Set A
caguguuguagcuacauuguaagauggg

SEQ ID NO: 36496 - RNA, 28 nt, Artificial Sequence
  Synthetic Oligonucleotide; NDFIP1 exon 3; Set A
gcaguguuguagcuacauuguaagaugg

SEQ ID NO: 36497 - RNA, 33 nt, Artificial Sequence
  Synthetic Oligonucleotide; NDFIP1 exon 3; Set C
ugggcaguguuguagcuacauuguaagaugggg

SEQ ID NO: 36498 - RNA, 34 nt, Artificial Sequence
  Synthetic Oligonucleotide; NDFIP1 exon 3; Set C
cugggcaguguuguagcuacauuguaagaugggg

SEQ ID NO: 36499 - RNA, 32 nt, Artificial Sequence
  Synthetic Oligonucleotide; NDFIP1 exon 3; Set C
ugggcaguguuguagcuacauuguaagauggg

SEQ ID NO: 36500 - RNA, 35 nt, Artificial Sequence
  Synthetic Oligonucleotide; NDFIP1 exon 3; Set C
acugggcaguguuguagcuacauuguaagaugggg

SEQ ID NO: 36501 - RNA, 36 nt, Artificial Sequence
  Synthetic Oligonucleotide; NDFIP1 exon 3; Set C
aacugggcaguguuguagcuacauuguaagaugggg

SEQ ID NO: 36502 - RNA, 23 nt, Artificial Sequence
  Synthetic Oligonucleotide; NDFIP1 exon 3; Set C
gcaguguuguagcuacauuguaa

SEQ ID NO: 36503 - RNA, 22 nt, Artificial Sequence
  Synthetic Oligonucleotide; NDFIP1 exon 3; Set A
gcaguguuguagcuacauugua

SEQ ID NO: 36504 - RNA, 24 nt, Artificial Sequence
  Synthetic Oligonucleotide; NDFIP1 exon 3; Set A
ggcaguguuguagcuacauuguaa

SEQ ID NO: 36505 - RNA, 23 nt, Artificial Sequence
  Synthetic Oligonucleotide; NDFIP1 exon 3; Set A
ggcaguguuguagcuacauugua

SEQ ID NO: 36506 - RNA, 25 nt, Artificial Sequence
  Synthetic Oligonucleotide; NDFIP1 exon 3; Set A
gggcaguguuguagcuacauuguaa

SEQ ID NO: 36507 - RNA, 24 nt, Artificial Sequence
  Synthetic Oligonucleotide; NDFIP1 exon 3; Set A
gggcaguguuguagcuacauugua

SEQ ID NO: 36508 - RNA, 27 nt, Artificial Sequence
  Synthetic Oligonucleotide; NDFIP1 exon 3; Set A
cugggcaguguuguagcuacauuguaa

SEQ ID NO: 36509 - RNA, 26 nt, Artificial Sequence
  Synthetic Oligonucleotide; NDFIP1 exon 3; Set A
cugggcaguguuguagcuacauugua

SEQ ID NO: 36510 - RNA, 28 nt, Artificial Sequence
  Synthetic Oligonucleotide; NDFIP1 exon 3; Set A
acugggcaguguuguagcuacauuguaa

SEQ ID NO: 36511 - RNA, 27 nt, Artificial Sequence
  Synthetic Oligonucleotide; NDFIP1 exon 3; Set A
acugggcaguguuguagcuacauugua

SEQ ID NO: 36512 - RNA, 29 nt, Artificial Sequence
  Synthetic Oligonucleotide; NDFIP1 exon 3; Set A
aacugggcaguguuguagcuacauuguaa

SEQ ID NO: 36513 - RNA, 28 nt, Artificial Sequence
  Synthetic Oligonucleotide; NDFIP1 exon 3; Set A
aacugggcaguguuguagcuacauugua

SEQ ID NO: 36514 - RNA, 35 nt, Artificial Sequence
  Synthetic Oligonucleotide; NDFIP1 exon 3; Set C
caucauaacugggcaguguuguagcuacauuguaa

SEQ ID NO: 36515 - RNA, 34 nt, Artificial Sequence
  Synthetic Oligonucleotide; NDFIP1 exon 3; Set C
caucauaacugggcaguguuguagcuacauugua

SEQ ID NO: 36516 - RNA, 36 nt, Artificial Sequence
  Synthetic Oligonucleotide; NDFIP1 exon 3; Set C
ucaucauaacugggcaguguuguagcuacauuguaa

SEQ ID NO: 36517 - RNA, 35 nt, Artificial Sequence
  Synthetic Oligonucleotide; NDFIP1 exon 3; Set C
ucaucauaacugggcaguguuguagcuacauugua

SEQ ID NO: 36518 - RNA, 37 nt, Artificial Sequence
  Synthetic Oligonucleotide; NDFIP1 exon 3; Set C
uucaucauaacugggcaguguuguagcuacauuguaa

SEQ ID NO: 36519 - RNA, 36 nt, Artificial Sequence
  Synthetic Oligonucleotide; NDFIP1 exon 3; Set C
uucaucauaacugggcaguguuguagcuacauugua

SEQ ID NO: 36520 - RNA, 39 nt, Artificial Sequence
  Synthetic Oligonucleotide; NDFIP1 exon 3; Set C
gcuucaucauaacugggcaguguuguagcuacauuguaa

SEQ ID NO: 36521 - RNA, 38 nt, Artificial Sequence
  Synthetic Oligonucleotide; NDFIP1 exon 3; Set C
gcuucaucauaacugggcaguguuguagcuacauugua

SEQ ID NO: 36522 - RNA, 17 nt, Artificial Sequence
  Synthetic Oligonucleotide; NDFIP1 exon 3; Set C
uucaucauaacugggca

SEQ ID NO: 36523 - RNA, 31 nt, Artificial Sequence
  Synthetic Oligonucleotide; NDFIP1 exon 3; Set C
guccucuccgcuucaucauaacugggcagug

SEQ ID NO: 36524 - RNA, 40 nt, Artificial Sequence
  Synthetic Oligonucleotide; NDFIP1 exon 3; Set C
ccuugguccucuccgcuucaucauaacugggcaguguugu

SEQ ID NO: 36525 - RNA, 32 nt, Artificial Sequence
  Synthetic Oligonucleotide; NDFIP1 exon 3; Set C
gguccucuccgcuucaucauaacugggcagug

SEQ ID NO: 36526 - RNA, 30 nt, Artificial Sequence
  Synthetic Oligonucleotide; NDFIP1 exon 3; Set C
guccucuccgcuucaucauaacugggcagu

SEQ ID NO: 36527 - RNA, 39 nt, Artificial Sequence
  Synthetic Oligonucleotide; NDFIP1 exon 3; Set C
ccuugguccucuccgcuucaucauaacugggcaguguug

SEQ ID NO: 36528 - RNA, 31 nt, Artificial Sequence
  Synthetic Oligonucleotide; NDFIP1 exon 3; Set C
gguccucuccgcuucaucauaacugggcagu

SEQ ID NO: 36529 - RNA, 29 nt, Artificial Sequence
  Synthetic Oligonucleotide; NDFIP1 exon 3; Set C
guccucuccgcuucaucauaacugggcag

SEQ ID NO: 36530 - RNA, 40 nt, Artificial Sequence
  Synthetic Oligonucleotide; NDFIP1 exon 3; Set C
gccuugguccucuccgcuucaucauaacugggcaguguug

SEQ ID NO: 36531 - RNA, 38 nt, Artificial Sequence
  Synthetic Oligonucleotide; NDFIP1 exon 3; Set C
ccuugguccucuccgcuucaucauaacugggcaguguu

SEQ ID NO: 36532 - RNA, 30 nt, Artificial Sequence
  Synthetic Oligonucleotide; NDFIP1 exon 3; Set C
gguccucuccgcuucaucauaacugggcag

SEQ ID NO: 36533 - RNA, 39 nt, Artificial Sequence
  Synthetic Oligonucleotide; NDFIP1 exon 3; Set C
gccuugguccucuccgcuucaucauaacugggcaguguu

SEQ ID NO: 36534 - RNA, 37 nt, Artificial Sequence
  Synthetic Oligonucleotide; NDFIP1 exon 3; Set C
ccuugguccucuccgcuucaucauaacugggcagugu

SEQ ID NO: 36535 - RNA, 40 nt, Artificial Sequence
  Synthetic Oligonucleotide; NDFIP1 exon 3; Set C
agccuugguccucuccgcuucaucauaacugggcaguguu

SEQ ID NO: 36536 - RNA, 36 nt, Artificial Sequence
  Synthetic Oligonucleotide; NDFIP1 exon 3; Set C
ccuugguccucuccgcuucaucauaacugggcagug

SEQ ID NO: 36537 - RNA, 39 nt, Artificial Sequence
  Synthetic Oligonucleotide; NDFIP1 exon 3; Set C
agccuugguccucuccgcuucaucauaacugggcagugu

SEQ ID NO: 36538 - RNA, 25 nt, Artificial Sequence
  Synthetic Oligonucleotide; NDFIP1 exon 3; Set A
guccucuccgcuucaucauaacugg

SEQ ID NO: 36539 - RNA, 35 nt, Artificial Sequence
  Synthetic Oligonucleotide; NDFIP1 exon 3; Set C
ccuugguccucuccgcuucaucauaacugggcagu

SEQ ID NO: 36540 - RNA, 40 nt, Artificial Sequence
  Synthetic Oligonucleotide; NDFIP1 exon 3; Set C
cagccuugguccucuccgcuucaucauaacugggcagugu

SEQ ID NO: 36541 - RNA, 26 nt, Artificial Sequence
  Synthetic Oligonucleotide; NDFIP1 exon 3; Set A
gguccucuccgcuucaucauaacugg

SEQ ID NO: 36542 - RNA, 24 nt, Artificial Sequence
  Synthetic Oligonucleotide; NDFIP1 exon 3; Set A
guccucuccgcuucaucauaacug

SEQ ID NO: 36543 - RNA, 32 nt, Artificial Sequence
  Synthetic Oligonucleotide; NDFIP1 exon 3; Set C
cuugguccucuccgcuucaucauaacugggca

SEQ ID NO: 36544 - RNA, 25 nt, Artificial Sequence
  Synthetic Oligonucleotide; NDFIP1 exon 3; Set A
gguccucuccgcuucaucauaacug

SEQ ID NO: 36545 - RNA, 31 nt, Artificial Sequence
  Synthetic Oligonucleotide; NDFIP1 exon 3; Set C
cuugguccucuccgcuucaucauaacugggc

SEQ ID NO: 36546 - RNA, 24 nt, Artificial Sequence
  Synthetic Oligonucleotide; NDFIP1 exon 3; Set A
gguccucuccgcuucaucauaacu

SEQ ID NO: 36547 - RNA, 30 nt, Artificial Sequence
  Synthetic Oligonucleotide; NDFIP1 exon 3; Set C
cuugguccucuccgcuucaucauaacuggg

SEQ ID NO: 36548 - RNA, 23 nt, Artificial Sequence
  Synthetic Oligonucleotide; NDFIP1 exon 3; Set A
gguccucuccgcuucaucauaac

SEQ ID NO: 36549 - RNA, 20 nt, Artificial Sequence
  Synthetic Oligonucleotide; NDFIP1 exon 3; Set A
guccucuccgcuucaucaua

SEQ ID NO: 36550 - RNA, 30 nt, Artificial Sequence
  Synthetic Oligonucleotide; NDFIP1 exon 3; Set C
ccuugguccucuccgcuucaucauaacugg

SEQ ID NO: 36551 - RNA, 28 nt, Artificial Sequence
  Synthetic Oligonucleotide; NDFIP1 exon 3; Set A
cuugguccucuccgcuucaucauaacug

SEQ ID NO: 36552 - RNA, 19 nt, Artificial Sequence
  Synthetic Oligonucleotide; NDFIP1 exon 3; Set A
guccucuccgcuucaucau

SEQ ID NO: 36553 - RNA, 27 nt, Artificial Sequence
  Synthetic Oligonucleotide; NDFIP1 exon 3; Set A
cuugguccucuccgcuucaucauaacu

SEQ ID NO: 36554 - RNA, 20 nt, Artificial Sequence
  Synthetic Oligonucleotide; NDFIP1 exon 3; Set A
gguccucuccgcuucaucau

SEQ ID NO: 36555 - RNA, 18 nt, Artificial Sequence
  Synthetic Oligonucleotide; NDFIP1 exon 3; Set A
guccucuccgcuucauca

SEQ ID NO: 36556 - RNA, 26 nt, Artificial Sequence
  Synthetic Oligonucleotide; NDFIP1 exon 3; Set A
cuugguccucuccgcuucaucauaac

SEQ ID NO: 36557 - RNA, 17 nt, Artificial Sequence
  Synthetic Oligonucleotide; NDFIP1 exon 3; Set C
guccucuccgcuucauc

SEQ ID NO: 36558 - RNA, 19 nt, Artificial Sequence
  Synthetic Oligonucleotide; NDFIP1 exon 3; Set A
gguccucuccgcuucauca

SEQ ID NO: 36559 - RNA, 39 nt, Artificial Sequence
  Synthetic Oligonucleotide; NDFIP1 exon 3; Set C
cuucagccuugguccucuccgcuucaucauaacugggca

SEQ ID NO: 36560 - RNA, 26 nt, Artificial Sequence
  Synthetic Oligonucleotide; NDFIP1 exon 3; Set A
ccuugguccucuccgcuucaucauaa

SEQ ID NO: 36561 - RNA, 18 nt, Artificial Sequence
  Synthetic Oligonucleotide; NDFIP1 exon 3; Set A
gguccucuccgcuucauc

SEQ ID NO: 36562 - RNA, 38 nt, Artificial Sequence
  Synthetic Oligonucleotide; NDFIP1 exon 3; Set C
cuucagccuugguccucuccgcuucaucauaacugggc

SEQ ID NO: 36563 - RNA, 40 nt, Artificial Sequence
  Synthetic Oligonucleotide; NDFIP1 exon 3; Set C
gcuucagccuugguccucuccgcuucaucauaacugggca

SEQ ID NO: 36564 - RNA, 25 nt, Artificial Sequence
  Synthetic Oligonucleotide; NDFIP1 exon 3; Set C
ccuugguccucuccgcuucaucaua

SEQ ID NO: 36565 - RNA, 37 nt, Artificial Sequence
  Synthetic Oligonucleotide; NDFIP1 exon 3; Set C
cuucagccuugguccucuccgcuucaucauaacuggg

SEQ ID NO: 36566 - RNA, 39 nt, Artificial Sequence
  Synthetic Oligonucleotide; NDFIP1 exon 3; Set C
gcuucagccuugguccucuccgcuucaucauaacugggc

SEQ ID NO: 36567 - RNA, 24 nt, Artificial Sequence
  Synthetic Oligonucleotide; NDFIP1 exon 3; Set C
ccuugguccucuccgcuucaucau

SEQ ID NO: 36568 - RNA, 23 nt, Artificial Sequence
  Synthetic Oligonucleotide; NDFIP1 exon 3; Set C
ccuugguccucuccgcuucauca

SEQ ID NO: 36569 - RNA, 22 nt, Artificial Sequence
  Synthetic Oligonucleotide; NDFIP1 exon 3; Set A
ccuugguccucuccgcuucauc

SEQ ID NO: 36570 - RNA, 38 nt, Artificial Sequence
  Synthetic Oligonucleotide; NDFIP1 exon 3; Set C
agcuucagccuugguccucuccgcuucaucauaacugg

SEQ ID NO: 36571 - RNA, 20 nt, Artificial Sequence
  Synthetic Oligonucleotide; NDFIP1 exon 3; Set A
cuugguccucuccgcuucau

SEQ ID NO: 36572 - RNA, 16 nt, Artificial Sequence
  Synthetic Oligonucleotide; NDFIP1 exon 3; Set C
ugguccucuccgcuuc

SEQ ID NO: 36573 - RNA, 39 nt, Artificial Sequence
  Synthetic Oligonucleotide; NDFIP1 exon 3; Set C
uagcuucagccuugguccucuccgcuucaucauaacugg

SEQ ID NO: 36574 - RNA, 37 nt, Artificial Sequence
  Synthetic Oligonucleotide; NDFIP1 exon 3; Set C
agcuucagccuugguccucuccgcuucaucauaacug

SEQ ID NO: 36575 - RNA, 33 nt, Artificial Sequence
  Synthetic Oligonucleotide; NDFIP1 exon 3; Set C
cuucagccuugguccucuccgcuucaucauaac

SEQ ID NO: 36576 - RNA, 19 nt, Artificial Sequence
  Synthetic Oligonucleotide; NDFIP1 exon 3; Set A
cuugguccucuccgcuuca

SEQ ID NO: 36577 - RNA, 40 nt, Artificial Sequence
  Synthetic Oligonucleotide; NDFIP1 exon 3; Set C
guagcuucagccuugguccucuccgcuucaucauaacugg

SEQ ID NO: 36578 - RNA, 36 nt, Artificial Sequence
  Synthetic Oligonucleotide; NDFIP1 exon 3; Set C
agcuucagccuugguccucuccgcuucaucauaacu

SEQ ID NO: 36579 - RNA, 38 nt, Artificial Sequence
  Synthetic Oligonucleotide; NDFIP1 exon 3; Set C
uagcuucagccuugguccucuccgcuucaucauaacug

SEQ ID NO: 36580 - RNA, 17 nt, Artificial Sequence
  Synthetic Oligonucleotide; NDFIP1 exon 3; Set C
cuugguccucuccgcuu

SEQ ID NO: 36581 - RNA, 39 nt, Artificial Sequence
  Synthetic Oligonucleotide; NDFIP1 exon 3; Set C
guagcuucagccuugguccucuccgcuucaucauaacug

SEQ ID NO: 36582 - RNA, 37 nt, Artificial Sequence
  Synthetic Oligonucleotide; NDFIP1 exon 3; Set C
uagcuucagccuugguccucuccgcuucaucauaacu

SEQ ID NO: 36583 - RNA, 35 nt, Artificial Sequence
  Synthetic Oligonucleotide; NDFIP1 exon 3; Set C
agcuucagccuugguccucuccgcuucaucauaac

SEQ ID NO: 36584 - RNA, 38 nt, Artificial Sequence
  Synthetic Oligonucleotide; NDFIP1 exon 3; Set C
guagcuucagccuugguccucuccgcuucaucauaacu

SEQ ID NO: 36585 - RNA, 36 nt, Artificial Sequence
  Synthetic Oligonucleotide; NDFIP1 exon 3; Set C
uagcuucagccuugguccucuccgcuucaucauaac

SEQ ID NO: 36586 - RNA, 15 nt, Artificial Sequence
  Synthetic Oligonucleotide; NDFIP1 exon 3; Set C
cuugguccucuccgc

SEQ ID NO: 36587 - RNA, 37 nt, Artificial Sequence
  Synthetic Oligonucleotide; NDFIP1 exon 3; Set C
guagcuucagccuugguccucuccgcuucaucauaac

SEQ ID NO: 36588 - RNA, 27 nt, Artificial Sequence
  Synthetic Oligonucleotide; NDFIP1 exon 3; Set C
cuucagccuugguccucuccgcuucau

SEQ ID NO: 36589 - RNA, 23 nt, Artificial Sequence
  Synthetic Oligonucleotide; NDFIP1 exon 3; Set C
ucagccuugguccucuccgcuuc

SEQ ID NO: 36590 - RNA, 40 nt, Artificial Sequence
  Synthetic Oligonucleotide; NDFIP1 exon 3; Set C
auaguagcuucagccuugguccucuccgcuucaucauaac

SEQ ID NO: 36591 - RNA, 28 nt, Artificial Sequence
  Synthetic Oligonucleotide; NDFIP1 exon 3; Set C
gcuucagccuugguccucuccgcuucau

SEQ ID NO: 36592 - RNA, 26 nt, Artificial Sequence
  Synthetic Oligonucleotide; NDFIP1 exon 3; Set C
cuucagccuugguccucuccgcuuca

SEQ ID NO: 36593 - RNA, 27 nt, Artificial Sequence
  Synthetic Oligonucleotide; NDFIP1 exon 3; Set C
gcuucagccuugguccucuccgcuuca

SEQ ID NO: 36594 - RNA, 25 nt, Artificial Sequence
  Synthetic Oligonucleotide; NDFIP1 exon 3; Set C
cuucagccuugguccucuccgcuuc

SEQ ID NO: 36595 - RNA, 40 nt, Artificial Sequence
  Synthetic Oligonucleotide; NDFIP1 exon 3; Set C
gauaguagcuucagccuugguccucuccgcuucaucauaa

SEQ ID NO: 36596 - RNA, 24 nt, Artificial Sequence
  Synthetic Oligonucleotide; NDFIP1 exon 3; Set C
cuucagccuugguccucuccgcuu

SEQ ID NO: 36597 - RNA, 26 nt, Artificial Sequence
  Synthetic Oligonucleotide; NDFIP1 exon 3; Set C
gcuucagccuugguccucuccgcuuc

SEQ ID NO: 36598 - RNA, 39 nt, Artificial Sequence
  Synthetic Oligonucleotide; NDFIP1 exon 3; Set C
gauaguagcuucagccuugguccucuccgcuucaucaua

SEQ ID NO: 36599 - RNA, 23 nt, Artificial Sequence
  Synthetic Oligonucleotide; NDFIP1 exon 3; Set C
cuucagccuugguccucuccgcu

SEQ ID NO: 36600 - RNA, 40 nt, Artificial Sequence
  Synthetic Oligonucleotide; NDFIP1 exon 3; Set C
ggauaguagcuucagccuugguccucuccgcuucaucaua

SEQ ID NO: 36601 - RNA, 38 nt, Artificial Sequence
  Synthetic Oligonucleotide; NDFIP1 exon 3; Set C
gauaguagcuucagccuugguccucuccgcuucaucau

SEQ ID NO: 36602 - RNA, 22 nt, Artificial Sequence
  Synthetic Oligonucleotide; NDFIP1 exon 3; Set C
cuucagccuugguccucuccgc

SEQ ID NO: 36603 - RNA, 24 nt, Artificial Sequence
  Synthetic Oligonucleotide; NDFIP1 exon 3; Set C
gcuucagccuugguccucuccgcu

SEQ ID NO: 36604 - RNA, 39 nt, Artificial Sequence
  Synthetic Oligonucleotide; NDFIP1 exon 3; Set C
ggauaguagcuucagccuugguccucuccgcuucaucau

SEQ ID NO: 36605 - RNA, 37 nt, Artificial Sequence
  Synthetic Oligonucleotide; NDFIP1 exon 3; Set C
gauaguagcuucagccuugguccucuccgcuucauca

SEQ ID NO: 36606 - RNA, 21 nt, Artificial Sequence
  Synthetic Oligonucleotide; NDFIP1 exon 3; Set A
cuucagccuugguccucuccg

SEQ ID NO: 36607 - RNA, 36 nt, Artificial Sequence
  Synthetic Oligonucleotide; NDFIP1 exon 3; Set C
gauaguagcuucagccuugguccucuccgcuucauc

SEQ ID NO: 36608 - RNA, 40 nt, Artificial Sequence
  Synthetic Oligonucleotide; NDFIP1 exon 3; Set C
gggauaguagcuucagccuugguccucuccgcuucaucau

SEQ ID NO: 36609 - RNA, 38 nt, Artificial Sequence
  Synthetic Oligonucleotide; NDFIP1 exon 3; Set C
ggauaguagcuucagccuugguccucuccgcuucauca

SEQ ID NO: 36610 - RNA, 24 nt, Artificial Sequence
  Synthetic Oligonucleotide; NDFIP1 exon 3; Set C
agcuucagccuugguccucuccgc

SEQ ID NO: 36611 - RNA, 28 nt, Artificial Sequence
  Synthetic Oligonucleotide; NDFIP1 exon 3; Set C
guagcuucagccuugguccucuccgcuu

SEQ ID NO: 36612 - RNA, 34 nt, Artificial Sequence
  Synthetic Oligonucleotide; NDFIP1 exon 3; Set C
auaguagcuucagccuugguccucuccgcuucau

SEQ ID NO: 36613 - RNA, 37 nt, Artificial Sequence
  Synthetic Oligonucleotide; NDFIP1 exon 3; Set C
ggauaguagcuucagccuugguccucuccgcuucauc

SEQ ID NO: 36614 - RNA, 39 nt, Artificial Sequence
  Synthetic Oligonucleotide; NDFIP1 exon 3; Set C
gggauaguagcuucagccuugguccucuccgcuucauca

SEQ ID NO: 36615 - RNA, 25 nt, Artificial Sequence
  Synthetic Oligonucleotide; NDFIP1 exon 3; Set C
uagcuucagccuugguccucuccgc

SEQ ID NO: 36616 - RNA, 38 nt, Artificial Sequence
  Synthetic Oligonucleotide; NDFIP1 exon 3; Set C
gggauaguagcuucagccuugguccucuccgcuucauc

SEQ ID NO: 36617 - RNA, 26 nt, Artificial Sequence
  Synthetic Oligonucleotide; NDFIP1 exon 3; Set C
guagcuucagccuugguccucuccgc

SEQ ID NO: 36618 - RNA, 25 nt, Artificial Sequence
  Synthetic Oligonucleotide; NDFIP1 exon 3; Set C
guagcuucagccuugguccucuccg

SEQ ID NO: 36619 - RNA, 31 nt, Artificial Sequence
  Synthetic Oligonucleotide; NDFIP1 exon 3; Set C
auaguagcuucagccuugguccucuccgcuu

SEQ ID NO: 36620 - RNA, 38 nt, Artificial Sequence
  Synthetic Oligonucleotide; NDFIP1 exon 3; Set C
agggauaguagcuucagccuugguccucuccgcuucau

SEQ ID NO: 36621 - RNA, 29 nt, Artificial Sequence
  Synthetic Oligonucleotide; NDFIP1 exon 3; Set C
auaguagcuucagccuugguccucuccgc

SEQ ID NO: 36622 - RNA, 39 nt, Artificial Sequence
  Synthetic Oligonucleotide; NDFIP1 exon 3; Set C
aagggauaguagcuucagccuugguccucuccgcuucau

SEQ ID NO: 36623 - RNA, 37 nt, Artificial Sequence
  Synthetic Oligonucleotide; NDFIP1 exon 3; Set C
agggauaguagcuucagccuugguccucuccgcuuca

SEQ ID NO: 36624 - RNA, 28 nt, Artificial Sequence
  Synthetic Oligonucleotide; NDFIP1 exon 3; Set C
auaguagcuucagccuugguccucuccg

SEQ ID NO: 36625 - RNA, 38 nt, Artificial Sequence
  Synthetic Oligonucleotide; NDFIP1 exon 3; Set C
aagggauaguagcuucagccuugguccucuccgcuuca

SEQ ID NO: 36626 - RNA, 36 nt, Artificial Sequence
  Synthetic Oligonucleotide; NDFIP1 exon 3; Set C
agggauaguagcuucagccuugguccucuccgcuuc

SEQ ID NO: 36627 - RNA, 37 nt, Artificial Sequence
  Synthetic Oligonucleotide; NDFIP1 exon 3; Set C
aagggauaguagcuucagccuugguccucuccgcuuc

SEQ ID NO: 36628 - RNA, 15 nt, Artificial Sequence
  Synthetic Oligonucleotide; NDFIP1 exon 3; Set C
gcuucagccuugguc

SEQ ID NO: 36629 - RNA, 34 nt, Artificial Sequence
  Synthetic Oligonucleotide; NDFIP1 exon 3; Set C
agggauaguagcuucagccuugguccucuccgcu

SEQ ID NO: 36630 - RNA, 35 nt, Artificial Sequence
  Synthetic Oligonucleotide; NDFIP1 exon 3; Set C
aagggauaguagcuucagccuugguccucuccgcu

SEQ ID NO: 36631 - RNA, 39 nt, Artificial Sequence
  Synthetic Oligonucleotide; NDFIP1 exon 3; Set C
caaagggauaguagcuucagccuugguccucuccgcuuc

SEQ ID NO: 36632 - RNA, 40 nt, Artificial Sequence
  Synthetic Oligonucleotide; NDFIP1 exon 3; Set C
ccaaagggauaguagcuucagccuugguccucuccgcuuc

SEQ ID NO: 36633 - RNA, 20 nt, Artificial Sequence
  Synthetic Oligonucleotide; NDFIP1 exon 3; Set C
gauaguagcuucagccuugg

SEQ ID NO: 36634 - RNA, 19 nt, Artificial Sequence
  Synthetic Oligonucleotide; NDFIP1 exon 3; Set C
gauaguagcuucagccuug

SEQ ID NO: 36635 - RNA, 21 nt, Artificial Sequence
  Synthetic Oligonucleotide; NDFIP1 exon 3; Set A
ggauaguagcuucagccuugg

SEQ ID NO: 36636 - RNA, 25 nt, Artificial Sequence
  Synthetic Oligonucleotide; NDFIP1 exon 3; Set A
agggauaguagcuucagccuugguc

SEQ ID NO: 36637 - RNA, 15 nt, Artificial Sequence
  Synthetic Oligonucleotide; NDFIP1 exon 3; Set C
uaguagcuucagccu

SEQ ID NO: 36638 - RNA, 20 nt, Artificial Sequence
  Synthetic Oligonucleotide; NDFIP1 exon 3; Set C
ggauaguagcuucagccuug

SEQ ID NO: 36639 - RNA, 22 nt, Artificial Sequence
  Synthetic Oligonucleotide; NDFIP1 exon 3; Set A
gggauaguagcuucagccuugg

SEQ ID NO: 36640 - RNA, 24 nt, Artificial Sequence
  Synthetic Oligonucleotide; NDFIP1 exon 3; Set A
agggauaguagcuucagccuuggu

SEQ ID NO: 36641 - RNA, 26 nt, Artificial Sequence
  Synthetic Oligonucleotide; NDFIP1 exon 3; Set A
aagggauaguagcuucagccuugguc

SEQ ID NO: 36642 - RNA, 21 nt, Artificial Sequence
  Synthetic Oligonucleotide; NDFIP1 exon 3; Set A
gggauaguagcuucagccuug

SEQ ID NO: 36643 - RNA, 25 nt, Artificial Sequence
  Synthetic Oligonucleotide; NDFIP1 exon 3; Set A
aagggauaguagcuucagccuuggu

SEQ ID NO: 36644 - RNA, 28 nt, Artificial Sequence
  Synthetic Oligonucleotide; NDFIP1 exon 3; Set A
caaagggauaguagcuucagccuugguc

SEQ ID NO: 36645 - RNA, 21 nt, Artificial Sequence
  Synthetic Oligonucleotide; NDFIP1 exon 3; Set A
agggauaguagcuucagccuu

SEQ ID NO: 36646 - RNA, 27 nt, Artificial Sequence
  Synthetic Oligonucleotide; NDFIP1 exon 3; Set A
caaagggauaguagcuucagccuuggu

SEQ ID NO: 36647 - RNA, 29 nt, Artificial Sequence
  Synthetic Oligonucleotide; NDFIP1 exon 3; Set C
ccaaagggauaguagcuucagccuugguc

SEQ ID NO: 36648 - RNA, 22 nt, Artificial Sequence
  Synthetic Oligonucleotide; NDFIP1 exon 3; Set A
aagggauaguagcuucagccuu

SEQ ID NO: 36649 - RNA, 28 nt, Artificial Sequence
  Synthetic Oligonucleotide; NDFIP1 exon 3; Set A
ccaaagggauaguagcuucagccuuggu

SEQ ID NO: 36650 - RNA, 28 nt, Artificial Sequence
  Synthetic Oligonucleotide; NDFIP1 exon 3; Set A
accaaagggauaguagcuucagccuugg

SEQ ID NO: 36651 - RNA, 22 nt, Artificial Sequence
  Synthetic Oligonucleotide; NDFIP1 exon 3; Set C
aaagggauaguagcuucagccu

SEQ ID NO: 36652 - RNA, 27 nt, Artificial Sequence
  Synthetic Oligonucleotide; NDFIP1 exon 3; Set A
accaaagggauaguagcuucagccuug

SEQ ID NO: 36653 - RNA, 29 nt, Artificial Sequence
  Synthetic Oligonucleotide; NDFIP1 exon 3; Set A
aaccaaagggauaguagcuucagccuugg

SEQ ID NO: 36654 - RNA, 15 nt, Artificial Sequence
  Synthetic Oligonucleotide; NDFIP1 exon 3; Set C
gggauaguagcuuca

SEQ ID NO: 36655 - RNA, 25 nt, Artificial Sequence
  Synthetic Oligonucleotide; NDFIP1 exon 3; Set A
ccaaagggauaguagcuucagccuu

SEQ ID NO: 36656 - RNA, 28 nt, Artificial Sequence
  Synthetic Oligonucleotide; NDFIP1 exon 3; Set A
aaccaaagggauaguagcuucagccuug

SEQ ID NO: 36657 - RNA, 31 nt, Artificial Sequence
  Synthetic Oligonucleotide; NDFIP1 exon 3; Set C
ggaaccaaagggauaguagcuucagccuugg

SEQ ID NO: 36658 - RNA, 19 nt, Artificial Sequence
  Synthetic Oligonucleotide; NDFIP1 exon 3; Set C
aaagggauaguagcuucag

SEQ ID NO: 36659 - RNA, 30 nt, Artificial Sequence
  Synthetic Oligonucleotide; NDFIP1 exon 3; Set A
ggaaccaaagggauaguagcuucagccuug

SEQ ID NO: 36660 - RNA, 21 nt, Artificial Sequence
  Synthetic Oligonucleotide; NDFIP1 exon 3; Set C
accaaagggauaguagcuuca

SEQ ID NO: 36661 - RNA, 20 nt, Artificial Sequence
  Synthetic Oligonucleotide; NDFIP1 exon 3; Set C
accaaagggauaguagcuuc

SEQ ID NO: 36662 - RNA, 22 nt, Artificial Sequence
  Synthetic Oligonucleotide; NDFIP1 exon 3; Set C
aaccaaagggauaguagcuuca

SEQ ID NO: 36663 - RNA, 21 nt, Artificial Sequence
  Synthetic Oligonucleotide; NDFIP1 exon 3; Set C
aaccaaagggauaguagcuuc

SEQ ID NO: 36664 - RNA, 15 nt, Artificial Sequence
  Synthetic Oligonucleotide; NDFIP1 exon 3; Set C
caaagggauaguagc

SEQ ID NO: 36665 - RNA, 38 nt, Artificial Sequence
  Synthetic Oligonucleotide; NDFIP1 exon 3; Set C
ucucccaggaaccaaagggauaguagcuucagccuugg

SEQ ID NO: 36666 - RNA, 24 nt, Artificial Sequence
  Synthetic Oligonucleotide; NDFIP1 exon 3; Set A
ggaaccaaagggauaguagcuuca

SEQ ID NO: 36667 - RNA, 16 nt, Artificial Sequence
  Synthetic Oligonucleotide; NDFIP1 exon 3; Set C
ccaaagggauaguagc

SEQ ID NO: 36668 - RNA, 37 nt, Artificial Sequence
  Synthetic Oligonucleotide; NDFIP1 exon 3; Set C
ucucccaggaaccaaagggauaguagcuucagccuug

SEQ ID NO: 36669 - RNA, 23 nt, Artificial Sequence
  Synthetic Oligonucleotide; NDFIP1 exon 3; Set C
ggaaccaaagggauaguagcuuc

SEQ ID NO: 36670 - RNA, 15 nt, Artificial Sequence
  Synthetic Oligonucleotide; NDFIP1 exon 3; Set C
ccaaagggauaguag

SEQ ID NO: 36671 - RNA, 23 nt, Artificial Sequence
  Synthetic Oligonucleotide; NDFIP1 exon 3; Set C
aggaaccaaagggauaguagcuu

SEQ ID NO: 36672 - RNA, 22 nt, Artificial Sequence
  Synthetic Oligonucleotide; NDFIP1 exon 3; Set C
aggaaccaaagggauaguagcu

SEQ ID NO: 36673 - RNA, 15 nt, Artificial Sequence
  Synthetic Oligonucleotide; NDFIP1 exon 3; Set C
aaccaaagggauagu

SEQ ID NO: 36674 - RNA, 17 nt, Artificial Sequence
  Synthetic Oligonucleotide; NDFIP1 exon 3; Set C
ggaaccaaagggauagu

SEQ ID NO: 36675 - RNA, 31 nt, Artificial Sequence
  Synthetic Oligonucleotide; NDFIP1 exon 3; Set C
ucucccaggaaccaaagggauaguagcuuca

SEQ ID NO: 36676 - RNA, 16 nt, Artificial Sequence
  Synthetic Oligonucleotide; NDFIP1 exon 3; Set C
ggaaccaaagggauag

SEQ ID NO: 36677 - RNA, 30 nt, Artificial Sequence
  Synthetic Oligonucleotide; NDFIP1 exon 3; Set A
ucucccaggaaccaaagggauaguagcuuc

SEQ ID NO: 36678 - RNA, 37 nt, Artificial Sequence
  Synthetic Oligonucleotide; NDFIP1 exon 3; Set C
acucacucucccaggaaccaaagggauaguagcuuca

SEQ ID NO: 36679 - RNA, 24 nt, Artificial Sequence
  Synthetic Oligonucleotide; NDFIP1 exon 3; Set B
ucucccaggaaccaaagggauagu

SEQ ID NO: 36680 - RNA, 36 nt, Artificial Sequence
  Synthetic Oligonucleotide; NDFIP1 exon 3; Set C
acucacucucccaggaaccaaagggauaguagcuuc

SEQ ID NO: 36681 - RNA, 23 nt, Artificial Sequence
  Synthetic Oligonucleotide; NDFIP1 exon 3; Set B
ucucccaggaaccaaagggauag

SEQ ID NO: 36682 - RNA, 36 nt, Artificial Sequence
  Synthetic Oligonucleotide; NDFIP1 exon 3; Set C
uacucacucucccaggaaccaaagggauaguagcuu

SEQ ID NO: 36683 - RNA, 35 nt, Artificial Sequence
  Synthetic Oligonucleotide; NDFIP1 exon 3; Set C
uacucacucucccaggaaccaaagggauaguagcu

SEQ ID NO: 36684 - RNA, 37 nt, Artificial Sequence
  Synthetic Oligonucleotide; NDFIP1 exon 3; Set C
auacucacucucccaggaaccaaagggauaguagcuu

SEQ ID NO: 36685 - RNA, 30 nt, Artificial Sequence
  Synthetic Oligonucleotide; NDFIP1 exon 3; Set C
acucacucucccaggaaccaaagggauagu

SEQ ID NO: 36686 - RNA, 36 nt, Artificial Sequence
  Synthetic Oligonucleotide; NDFIP1 exon 3; Set C
uauacucacucucccaggaaccaaagggauaguagc

SEQ ID NO: 36687 - RNA, 29 nt, Artificial Sequence
  Synthetic Oligonucleotide; NDFIP1 exon 3; Set B
acucacucucccaggaaccaaagggauag

SEQ ID NO: 36688 - RNA, 37 nt, Artificial Sequence
  Synthetic Oligonucleotide; NDFIP1 exon 3; Set C
uuauacucacucucccaggaaccaaagggauaguagc

SEQ ID NO: 36689 - RNA, 35 nt, Artificial Sequence
  Synthetic Oligonucleotide; NDFIP1 exon 3; Set C
uauacucacucucccaggaaccaaagggauaguag

SEQ ID NO: 36690 - RNA, 38 nt, Artificial Sequence
  Synthetic Oligonucleotide; NDFIP1 exon 3; Set C
auuauacucacucucccaggaaccaaagggauaguagc

SEQ ID NO: 36691 - RNA, 34 nt, Artificial Sequence
  Synthetic Oligonucleotide; NDFIP1 exon 3; Set C
uauacucacucucccaggaaccaaagggauagua

SEQ ID NO: 36692 - RNA, 36 nt, Artificial Sequence
  Synthetic Oligonucleotide; NDFIP1 exon 3; Set C
uuauacucacucucccaggaaccaaagggauaguag

SEQ ID NO: 36693 - RNA, 39 nt, Artificial Sequence
  Synthetic Oligonucleotide; NDFIP1 exon 3; Set C
aauuauacucacucucccaggaaccaaagggauaguagc

SEQ ID NO: 36694 - RNA, 35 nt, Artificial Sequence
  Synthetic Oligonucleotide; NDFIP1 exon 3; Set C
uuauacucacucucccaggaaccaaagggauagua

SEQ ID NO: 36695 - RNA, 37 nt, Artificial Sequence
  Synthetic Oligonucleotide; NDFIP1 exon 3; Set C
auuauacucacucucccaggaaccaaagggauaguag

SEQ ID NO: 36696 - RNA, 36 nt, Artificial Sequence
  Synthetic Oligonucleotide; NDFIP1 exon 3; Set C
auuauacucacucucccaggaaccaaagggauagua

SEQ ID NO: 36697 - RNA, 38 nt, Artificial Sequence
  Synthetic Oligonucleotide; NDFIP1 exon 3; Set C
aauuauacucacucucccaggaaccaaagggauaguag

SEQ ID NO: 36698 - RNA, 31 nt, Artificial Sequence
  Synthetic Oligonucleotide; NDFIP1 exon 3; Set C
uauacucacucucccaggaaccaaagggaua

SEQ ID NO: 36699 - RNA, 37 nt, Artificial Sequence
  Synthetic Oligonucleotide; NDFIP1 exon 3; Set C
aauuauacucacucucccaggaaccaaagggauagua

SEQ ID NO: 36700 - RNA, 32 nt, Artificial Sequence
  Synthetic Oligonucleotide; NDFIP1 exon 3; Set C
uuauacucacucucccaggaaccaaagggaua

SEQ ID NO: 36701 - RNA, 30 nt, Artificial Sequence
  Synthetic Oligonucleotide; NDFIP1 exon 3; Set C
uauacucacucucccaggaaccaaagggau

SEQ ID NO: 36702 - RNA, 33 nt, Artificial Sequence
  Synthetic Oligonucleotide; NDFIP1 exon 3; Set C
auuauacucacucucccaggaaccaaagggaua

SEQ ID NO: 36703 - RNA, 31 nt, Artificial Sequence
  Synthetic Oligonucleotide; NDFIP1 exon 3; Set C
uuauacucacucucccaggaaccaaagggau

SEQ ID NO: 36704 - RNA, 22 nt, Artificial Sequence
  Synthetic Oligonucleotide; NDFIP1 exon 3; Set B
acucacucucccaggaaccaaa

SEQ ID NO: 36705 - RNA, 26 nt, Artificial Sequence
  Synthetic Oligonucleotide; NDFIP1 exon 3; Set B
auacucacucucccaggaaccaaagg

SEQ ID NO: 36706 - RNA, 34 nt, Artificial Sequence
  Synthetic Oligonucleotide; NDFIP1 exon 3; Set B
aauuauacucacucucccaggaaccaaagggaua

SEQ ID NO: 36707 - RNA, 32 nt, Artificial Sequence
  Synthetic Oligonucleotide; NDFIP1 exon 3; Set C
auuauacucacucucccaggaaccaaagggau

SEQ ID NO: 36708 - RNA, 30 nt, Artificial Sequence
  Synthetic Oligonucleotide; NDFIP1 exon 3; Set C
uuauacucacucucccaggaaccaaaggga

SEQ ID NO: 36709 - RNA, 23 nt, Artificial Sequence
  Synthetic Oligonucleotide; NDFIP1 exon 3; Set B
uacucacucucccaggaaccaaa

SEQ ID NO: 36710 - RNA, 25 nt, Artificial Sequence
  Synthetic Oligonucleotide; NDFIP1 exon 3; Set B
auacucacucucccaggaaccaaag

SEQ ID NO: 36711 - RNA, 33 nt, Artificial Sequence
  Synthetic Oligonucleotide; NDFIP1 exon 3; Set B
aauuauacucacucucccaggaaccaaagggau

SEQ ID NO: 36712 - RNA, 22 nt, Artificial Sequence
  Synthetic Oligonucleotide; NDFIP1 exon 3; Set B
uacucacucucccaggaaccaa

SEQ ID NO: 36713 - RNA, 32 nt, Artificial Sequence
  Synthetic Oligonucleotide; NDFIP1 exon 3; Set B
aauuauacucacucucccaggaaccaaaggga

SEQ ID NO: 36714 - RNA, 23 nt, Artificial Sequence
  Synthetic Oligonucleotide; NDFIP1 exon 3; Set B
auacucacucucccaggaaccaa

SEQ ID NO: 36715 - RNA, 22 nt, Artificial Sequence
  Synthetic Oligonucleotide; NDFIP1 exon 3; Set B
auacucacucucccaggaacca

SEQ ID NO: 36716 - RNA, 36 nt, Artificial Sequence
  Synthetic Oligonucleotide; NDFIP1 exon 3; Set C
auggcaaauuauacucacucucccaggaaccaaagg

SEQ ID NO: 36717 - RNA, 18 nt, Artificial Sequence
  Synthetic Oligonucleotide; NDFIP1 exon 3; Set C
uauacucacucucccagg

SEQ ID NO: 36718 - RNA, 35 nt, Artificial Sequence
  Synthetic Oligonucleotide; NDFIP1 exon 3; Set B
auggcaaauuauacucacucucccaggaaccaaag

SEQ ID NO: 36719 - RNA, 37 nt, Artificial Sequence
  Synthetic Oligonucleotide; NDFIP1 exon 3; Set C
cauggcaaauuauacucacucucccaggaaccaaagg

SEQ ID NO: 36720 - RNA, 19 nt, Artificial Sequence
  Synthetic Oligonucleotide; NDFIP1 exon 3; Set C
uuauacucacucucccagg

SEQ ID NO: 36721 - RNA, 36 nt, Artificial Sequence
  Synthetic Oligonucleotide; NDFIP1 exon 3; Set C
cauggcaaauuauacucacucucccaggaaccaaag

SEQ ID NO: 36722 - RNA, 38 nt, Artificial Sequence
  Synthetic Oligonucleotide; NDFIP1 exon 3; Set C
acauggcaaauuauacucacucucccaggaaccaaagg

SEQ ID NO: 36723 - RNA, 20 nt, Artificial Sequence
  Synthetic Oligonucleotide; NDFIP1 exon 3; Set C
auuauacucacucucccagg

SEQ ID NO: 36724 - RNA, 33 nt, Artificial Sequence
  Synthetic Oligonucleotide; NDFIP1 exon 3; Set C
auggcaaauuauacucacucucccaggaaccaa

SEQ ID NO: 36725 - RNA, 37 nt, Artificial Sequence
  Synthetic Oligonucleotide; NDFIP1 exon 3; Set C
acauggcaaauuauacucacucucccaggaaccaaag

SEQ ID NO: 36726 - RNA, 21 nt, Artificial Sequence
  Synthetic Oligonucleotide; NDFIP1 exon 3; Set C
aauuauacucacucucccagg

SEQ ID NO: 36727 - RNA, 34 nt, Artificial Sequence
  Synthetic Oligonucleotide; NDFIP1 exon 3; Set C
cauggcaaauuauacucacucucccaggaaccaa

SEQ ID NO: 36728 - RNA, 32 nt, Artificial Sequence
  Synthetic Oligonucleotide; NDFIP1 exon 3; Set C
auggcaaauuauacucacucucccaggaacca

SEQ ID NO: 36729 - RNA, 33 nt, Artificial Sequence
  Synthetic Oligonucleotide; NDFIP1 exon 3; Set C
cauggcaaauuauacucacucucccaggaacca

SEQ ID NO: 36730 - RNA, 34 nt, Artificial Sequence
  Synthetic Oligonucleotide; NDFIP1 exon 3; Set C
acauggcaaauuauacucacucucccaggaacca

SEQ ID NO: 36731 - RNA, 15 nt, Artificial Sequence
  Synthetic Oligonucleotide; NDFIP1 exon 3; Set C
aauuauacucacucu

SEQ ID NO: 36732 - RNA, 30 nt, Artificial Sequence
  Synthetic Oligonucleotide; NDFIP1 exon 3; Set B
aacauggcaaauuauacucacucucccagg

SEQ ID NO: 36733 - RNA, 31 nt, Artificial Sequence
  Synthetic Oligonucleotide; NDFIP1 exon 3; Set B
uaacauggcaaauuauacucacucucccagg

SEQ ID NO: 36734 - RNA, 32 nt, Artificial Sequence
  Synthetic Oligonucleotide; NDFIP1 exon 3; Set B
guaacauggcaaauuauacucacucucccagg

SEQ ID NO: 36735 - RNA, 24 nt, Artificial Sequence
  Synthetic Oligonucleotide; NDFIP1 exon 3; Set C
aacauggcaaauuauacucacucu

SEQ ID NO: 36736 - RNA, 25 nt, Artificial Sequence
  Synthetic Oligonucleotide; NDFIP1 exon 3; Set C
uaacauggcaaauuauacucacucu

SEQ ID NO: 36737 - RNA, 26 nt, Artificial Sequence
  Synthetic Oligonucleotide; NDFIP1 exon 3; Set C
guaacauggcaaauuauacucacucu

SEQ ID NO: 36738 - RNA, 15 nt, Artificial Sequence
  Synthetic Oligonucleotide; NDFIP1 exon 3; Set C
auggcaaauuauacu

SEQ ID NO: 36739 - RNA, 16 nt, Artificial Sequence
  Synthetic Oligonucleotide; NDFIP1 exon 3; Set C
cauggcaaauuauacu

SEQ ID NO: 36740 - RNA, 17 nt, Artificial Sequence
  Synthetic Oligonucleotide; NDFIP1 exon 3; Set C
acauggcaaauuauacu

SEQ ID NO: 36741 - RNA, 20 nt, Artificial Sequence
  Synthetic Oligonucleotide; NDFIP1 exon 3; Set C
uaacauggcaaauuauacuc

SEQ ID NO: 36742 - RNA, 21 nt, Artificial Sequence
  Synthetic Oligonucleotide; NDFIP1 exon 3; Set C
guaacauggcaaauuauacuc

SEQ ID NO: 36743 - RNA, 24 nt, Artificial Sequence
  Synthetic Oligonucleotide; NDFIP1 exon 3; Set C
ucaaguaacauggcaaauuauacu

SEQ ID NO: 36744 - RNA, 23 nt, Artificial Sequence
  Synthetic Oligonucleotide; NDFIP1 exon 3; Set C
ucaaguaacauggcaaauuauac

SEQ ID NO: 36745 - RNA, 24 nt, Artificial Sequence
  Synthetic Oligonucleotide; NDFIP1 exon 3; Set C
aucaaguaacauggcaaauuauac

SEQ ID NO: 36746 - RNA, 23 nt, Artificial Sequence
  Synthetic Oligonucleotide; NDFIP1 exon 3; Set C
aucaaguaacauggcaaauuaua

SEQ ID NO: 36747 - RNA, 24 nt, Artificial Sequence
  Synthetic Oligonucleotide; NDFIP1 exon 3; Set C
caucaaguaacauggcaaauuaua

SEQ ID NO: 36748 - RNA, 22 nt, Artificial Sequence
  Synthetic Oligonucleotide; NDFIP1 exon 3; Set C
caucaaguaacauggcaaauua

SEQ ID NO: 36749 - RNA, 21 nt, Artificial Sequence
  Synthetic Oligonucleotide; NDFIP1 exon 3; Set C
caucaaguaacauggcaaauu

SEQ ID NO: 36750 - RNA, 20 nt, Artificial Sequence
  Synthetic Oligonucleotide; NDFIP1 exon 3; Set C
caucaaguaacauggcaaau

SEQ ID NO: 36751 - RNA, 36 nt, Artificial Sequence
  Synthetic Oligonucleotide; NDFIP1 exon 3; Set C
ccacagagcagccaucaaguaacauggcaaauuaua

SEQ ID NO: 36752 - RNA, 33 nt, Artificial Sequence
  Synthetic Oligonucleotide; NDFIP1 exon 3; Set C
ccacagagcagccaucaaguaacauggcaaauu

SEQ ID NO: 36753 - RNA, 32 nt, Artificial Sequence
  Synthetic Oligonucleotide; NDFIP1 exon 3; Set C
ccacagagcagccaucaaguaacauggcaaau

SEQ ID NO: 36754 - RNA, 26 nt, Artificial Sequence
  Synthetic Oligonucleotide; NDFIP1 exon 3; Set B
ccacagagcagccaucaaguaacaug

SEQ ID NO: 36755 - RNA, 25 nt, Artificial Sequence
  Synthetic Oligonucleotide; NDFIP1 exon 3; Set B
ccacagagcagccaucaaguaacau

SEQ ID NO: 36756 - RNA, 24 nt, Artificial Sequence
  Synthetic Oligonucleotide; NDFIP1 exon 3; Set B
ccacagagcagccaucaaguaaca

SEQ ID NO: 36757 - RNA, 23 nt, Artificial Sequence
  Synthetic Oligonucleotide; NDFIP1 exon 3; Set B
ccacagagcagccaucaaguaac

SEQ ID NO: 36758 - RNA, 22 nt, Artificial Sequence
  Synthetic Oligonucleotide; NDFIP1 exon 3; Set B
ccacagagcagccaucaaguaa

SEQ ID NO: 36759 - RNA, 21 nt, Artificial Sequence
  Synthetic Oligonucleotide; NDFIP1 exon 3; Set B
ccacagagcagccaucaagua

SEQ ID NO: 36760 - RNA, 22 nt, Artificial Sequence
  Synthetic Oligonucleotide; NDFIP1 exon 3; Set B
aauucccacagagcagccauca

SEQ ID NO: 36761 - RNA, 23 nt, Artificial Sequence
  Synthetic Oligonucleotide; NDFIP1 exon 3; Set B
uaauucccacagagcagccauca

SEQ ID NO: 36762 - RNA, 24 nt, Artificial Sequence
  Synthetic Oligonucleotide; NDFIP1 exon 3; Set B
uuaauucccacagagcagccauca

SEQ ID NO: 36763 - RNA, 25 nt, Artificial Sequence
  Synthetic Oligonucleotide; NDFIP1 exon 3; Set B
cuuaauucccacagagcagccauca

SEQ ID NO: 36764 - RNA, 24 nt, Artificial Sequence
  Synthetic Oligonucleotide; NDFIP1 exon 3; Set B
cuuaauucccacagagcagccauc

SEQ ID NO: 36765 - RNA, 22 nt, Artificial Sequence
  Synthetic Oligonucleotide; NDFIP1 exon 4; Set C
aacaugaaaaucccaucauuuc

SEQ ID NO: 36766 - RNA, 23 nt, Artificial Sequence
  Synthetic Oligonucleotide; NDFIP1 exon 4; Set C
uaacaugaaaaucccaucauuuc

SEQ ID NO: 36767 - RNA, 24 nt, Artificial Sequence
  Synthetic Oligonucleotide; NDFIP1 exon 4; Set C
uuaacaugaaaaucccaucauuuc

SEQ ID NO: 36768 - RNA, 15 nt, Artificial Sequence
  Synthetic Oligonucleotide; NDFIP1 exon 4; Set C
aacaugaaaauccca

SEQ ID NO: 36769 - RNA, 29 nt, Artificial Sequence
  Synthetic Oligonucleotide; NDFIP1 exon 4; Set C
aaaaguuaacaugaaaaucccaucauuuc

SEQ ID NO: 36770 - RNA, 16 nt, Artificial Sequence
  Synthetic Oligonucleotide; NDFIP1 exon 4; Set C
uaacaugaaaauccca

SEQ ID NO: 36771 - RNA, 30 nt, Artificial Sequence
  Synthetic Oligonucleotide; NDFIP1 exon 4; Set C
aaaaaguuaacaugaaaaucccaucauuuc

SEQ ID NO: 36772 - RNA, 17 nt, Artificial Sequence
  Synthetic Oligonucleotide; NDFIP1 exon 4; Set C
uuaacaugaaaauccca

SEQ ID NO: 36773 - RNA, 15 nt, Artificial Sequence
  Synthetic Oligonucleotide; NDFIP1 exon 4; Set C
uaacaugaaaauccc

SEQ ID NO: 36774 - RNA, 18 nt, Artificial Sequence
  Synthetic Oligonucleotide; NDFIP1 exon 4; Set C
guuaacaugaaaauccca

SEQ ID NO: 36775 - RNA, 16 nt, Artificial Sequence
  Synthetic Oligonucleotide; NDFIP1 exon 4; Set C
uuaacaugaaaauccc

SEQ ID NO: 36776 - RNA, 15 nt, Artificial Sequence
  Synthetic Oligonucleotide; NDFIP1 exon 4; Set C
uuaacaugaaaaucc

SEQ ID NO: 36777 - RNA, 17 nt, Artificial Sequence
  Synthetic Oligonucleotide; NDFIP1 exon 4; Set C
guuaacaugaaaauccc

SEQ ID NO: 36778 - RNA, 16 nt, Artificial Sequence
  Synthetic Oligonucleotide; NDFIP1 exon 4; Set C
guuaacaugaaaaucc

SEQ ID NO: 36779 - RNA, 15 nt, Artificial Sequence
  Synthetic Oligonucleotide; NDFIP1 exon 4; Set C
guuaacaugaaaauc

SEQ ID NO: 36780 - RNA, 22 nt, Artificial Sequence
  Synthetic Oligonucleotide; NDFIP1 exon 4; Set C
aaaaguuaacaugaaaauccca

SEQ ID NO: 36781 - RNA, 23 nt, Artificial Sequence
  Synthetic Oligonucleotide; NDFIP1 exon 4; Set C
aaaaaguuaacaugaaaauccca

SEQ ID NO: 36782 - RNA, 21 nt, Artificial Sequence
  Synthetic Oligonucleotide; NDFIP1 exon 4; Set C
aaaaguuaacaugaaaauccc

SEQ ID NO: 36783 - RNA, 20 nt, Artificial Sequence
  Synthetic Oligonucleotide; NDFIP1 exon 4; Set C
aaaaguuaacaugaaaaucc

SEQ ID NO: 36784 - RNA, 22 nt, Artificial Sequence
  Synthetic Oligonucleotide; NDFIP1 exon 4; Set C
aaaaaguuaacaugaaaauccc

SEQ ID NO: 36785 - RNA, 19 nt, Artificial Sequence
  Synthetic Oligonucleotide; NDFIP1 exon 4; Set C
aaaaguuaacaugaaaauc

SEQ ID NO: 36786 - RNA, 21 nt, Artificial Sequence
  Synthetic Oligonucleotide; NDFIP1 exon 4; Set C
aaaaaguuaacaugaaaaucc

SEQ ID NO: 36787 - RNA, 18 nt, Artificial Sequence
  Synthetic Oligonucleotide; NDFIP1 exon 4; Set C
aaaaguuaacaugaaaau

SEQ ID NO: 36788 - RNA, 20 nt, Artificial Sequence
  Synthetic Oligonucleotide; NDFIP1 exon 4; Set C
aaaaaguuaacaugaaaauc

SEQ ID NO: 36789 - RNA, 17 nt, Artificial Sequence
  Synthetic Oligonucleotide; NDFIP1 exon 4; Set C
aaaaguuaacaugaaaa

SEQ ID NO: 36790 - RNA, 19 nt, Artificial Sequence
  Synthetic Oligonucleotide; NDFIP1 exon 4; Set C
aaaaaguuaacaugaaaau

SEQ ID NO: 36791 - RNA, 18 nt, Artificial Sequence
  Synthetic Oligonucleotide; NDFIP1 exon 4; Set C
aaaaaguuaacaugaaaa

SEQ ID NO: 36792 - RNA, 16 nt, Artificial Sequence
  Synthetic Oligonucleotide; NDFIP1 exon 4; Set C
aaaaguuaacaugaaa

SEQ ID NO: 36793 - RNA, 17 nt, Artificial Sequence
  Synthetic Oligonucleotide; NDFIP1 exon 4; Set C
aaaaaguuaacaugaaa

SEQ ID NO: 36794 - RNA, 15 nt, Artificial Sequence
  Synthetic Oligonucleotide; NDFIP1 exon 4; Set C
aaaaguuaacaugaa

SEQ ID NO: 36795 - RNA, 16 nt, Artificial Sequence
  Synthetic Oligonucleotide; NDFIP1 exon 4; Set C
aaaaaguuaacaugaa

SEQ ID NO: 36796 - RNA, 15 nt, Artificial Sequence
  Synthetic Oligonucleotide; NDFIP1 exon 4; Set C
aaaaaguuaacauga

SEQ ID NO: 36797 - RNA, 17 nt, Artificial Sequence
  Synthetic Oligonucleotide; NDFIP1 exon 4; Set C
uggucagcaucaucaaa

SEQ ID NO: 36798 - RNA, 31 nt, Artificial Sequence
  Synthetic Oligonucleotide; NDFIP1 exon 4; Set C
uuccuauccucagcuggucagcaucaucaaa

SEQ ID NO: 36799 - RNA, 38 nt, Artificial Sequence
  Synthetic Oligonucleotide; NDFIP1 exon 4; Set C
ccaucauuuccuauccucagcuggucagcaucaucaaa

SEQ ID NO: 36800 - RNA, 39 nt, Artificial Sequence
  Synthetic Oligonucleotide; NDFIP1 exon 4; Set C
cccaucauuuccuauccucagcuggucagcaucaucaaa

SEQ ID NO: 36801 - RNA, 40 nt, Artificial Sequence
  Synthetic Oligonucleotide; NDFIP1 exon 4; Set C
ucccaucauuuccuauccucagcuggucagcaucaucaaa

SEQ ID NO: 36802 - RNA, 15 nt, Artificial Sequence
  Synthetic Oligonucleotide; NDFIP1 exon 4; Set C
aaucccaucauuucc

SEQ ID NO: 36803 - RNA, 16 nt, Artificial Sequence
  Synthetic Oligonucleotide; NDFIP1 exon 4; Set C
aaaucccaucauuucc

SEQ ID NO: 36804 - RNA, 15 nt, Artificial Sequence
  Synthetic Oligonucleotide; NDFIP1 exon 4; Set C
aaaucccaucauuuc

SEQ ID NO: 36805 - RNA, 16 nt, Artificial Sequence
  Synthetic Oligonucleotide; NDFIP1 exon 4; Set C
aaaaucccaucauuuc

SEQ ID NO: 36806 - RNA, 17 nt, Artificial Sequence
  Synthetic Oligonucleotide; NDFIP1 exon 4; Set C
gaaaaucccaucauuuc

SEQ ID NO: 36807 - RNA, 18 nt, Artificial Sequence
  Synthetic Oligonucleotide; NDFIP1 exon 4; Set C
ugaaaaucccaucauuuc

SEQ ID NO: 36808 - RNA, 19 nt, Artificial Sequence
  Synthetic Oligonucleotide; NDFIP1 exon 4; Set C
augaaaaucccaucauuuc

SEQ ID NO: 36809 - RNA, 25 nt, Artificial Sequence
  Synthetic Oligonucleotide; NDFIP1 exon 4; Set C
aacaugaaaaucccaucauuuccua

SEQ ID NO: 36810 - RNA, 20 nt, Artificial Sequence
  Synthetic Oligonucleotide; NDFIP1 exon 4; Set C
caugaaaaucccaucauuuc

SEQ ID NO: 36811 - RNA, 26 nt, Artificial Sequence
  Synthetic Oligonucleotide; NDFIP1 exon 4; Set C
uaacaugaaaaucccaucauuuccua

SEQ ID NO: 36812 - RNA, 21 nt, Artificial Sequence
  Synthetic Oligonucleotide; NDFIP1 exon 4; Set C
acaugaaaaucccaucauuuc

SEQ ID NO: 36813 - RNA, 23 nt, Artificial Sequence
  Synthetic Oligonucleotide; NDFIP1 exon 4; Set C
aacaugaaaaucccaucauuucc

SEQ ID NO: 36814 - RNA, 27 nt, Artificial Sequence
  Synthetic Oligonucleotide; NDFIP1 exon 4; Set C
uuaacaugaaaaucccaucauuuccua

SEQ ID NO: 36815 - RNA, 24 nt, Artificial Sequence
  Synthetic Oligonucleotide; NDFIP1 exon 4; Set C
uaacaugaaaaucccaucauuucc

SEQ ID NO: 36816 - RNA, 25 nt, Artificial Sequence
  Synthetic Oligonucleotide; NDFIP1 exon 4; Set C
uuaacaugaaaaucccaucauuucc

SEQ ID NO: 36817 - RNA, 26 nt, Artificial Sequence
  Synthetic Oligonucleotide; NDFIP1 exon 4; Set C
guuaacaugaaaaucccaucauuucc

SEQ ID NO: 36818 - RNA, 25 nt, Artificial Sequence
  Synthetic Oligonucleotide; NDFIP1 exon 4; Set C
guuaacaugaaaaucccaucauuuc

SEQ ID NO: 36819 - RNA, 32 nt, Artificial Sequence
  Synthetic Oligonucleotide; NDFIP1 exon 4; Set C
aaaaguuaacaugaaaaucccaucauuuccua

SEQ ID NO: 36820 - RNA, 33 nt, Artificial Sequence
  Synthetic Oligonucleotide; NDFIP1 exon 4; Set C
aaaaaguuaacaugaaaaucccaucauuuccua

SEQ ID NO: 36821 - RNA, 30 nt, Artificial Sequence
  Synthetic Oligonucleotide; NDFIP1 exon 4; Set C
aaaaguuaacaugaaaaucccaucauuucc

SEQ ID NO: 36822 - RNA, 31 nt, Artificial Sequence
  Synthetic Oligonucleotide; NDFIP1 exon 4; Set C
aaaaaguuaacaugaaaaucccaucauuucc

SEQ ID NO: 36823 - RNA, 19 nt, Artificial Sequence
  Synthetic Oligonucleotide; NDFIP1 exon 4; Set C
aguuaacaugaaaauccca

SEQ ID NO: 36824 - RNA, 20 nt, Artificial Sequence
  Synthetic Oligonucleotide; NDFIP1 exon 4; Set C
aaguuaacaugaaaauccca

SEQ ID NO: 36825 - RNA, 18 nt, Artificial Sequence
  Synthetic Oligonucleotide; NDFIP1 exon 4; Set C
aguuaacaugaaaauccc

SEQ ID NO: 36826 - RNA, 17 nt, Artificial Sequence
  Synthetic Oligonucleotide; NDFIP1 exon 4; Set C
aguuaacaugaaaaucc

SEQ ID NO: 36827 - RNA, 21 nt, Artificial Sequence
  Synthetic Oligonucleotide; NDFIP1 exon 4; Set C
aaaguuaacaugaaaauccca

SEQ ID NO: 36828 - RNA, 19 nt, Artificial Sequence
  Synthetic Oligonucleotide; NDFIP1 exon 4; Set C
aaguuaacaugaaaauccc

SEQ ID NO: 36829 - RNA, 16 nt, Artificial Sequence
  Synthetic Oligonucleotide; NDFIP1 exon 4; Set C
aguuaacaugaaaauc

SEQ ID NO: 36830 - RNA, 18 nt, Artificial Sequence
  Synthetic Oligonucleotide; NDFIP1 exon 4; Set C
aaguuaacaugaaaaucc

SEQ ID NO: 36831 - RNA, 20 nt, Artificial Sequence
  Synthetic Oligonucleotide; NDFIP1 exon 4; Set C
aaaguuaacaugaaaauccc

SEQ ID NO: 36832 - RNA, 15 nt, Artificial Sequence
  Synthetic Oligonucleotide; NDFIP1 exon 4; Set C
aguuaacaugaaaau

SEQ ID NO: 36833 - RNA, 17 nt, Artificial Sequence
  Synthetic Oligonucleotide; NDFIP1 exon 4; Set C
aaguuaacaugaaaauc

SEQ ID NO: 36834 - RNA, 19 nt, Artificial Sequence
  Synthetic Oligonucleotide; NDFIP1 exon 4; Set C
aaaguuaacaugaaaaucc

SEQ ID NO: 36835 - RNA, 16 nt, Artificial Sequence
  Synthetic Oligonucleotide; NDFIP1 exon 4; Set C
aaguuaacaugaaaau

SEQ ID NO: 36836 - RNA, 18 nt, Artificial Sequence
  Synthetic Oligonucleotide; NDFIP1 exon 4; Set C
aaaguuaacaugaaaauc

SEQ ID NO: 36837 - RNA, 15 nt, Artificial Sequence
  Synthetic Oligonucleotide; NDFIP1 exon 4; Set C
aaguuaacaugaaaa

SEQ ID NO: 36838 - RNA, 17 nt, Artificial Sequence
  Synthetic Oligonucleotide; NDFIP1 exon 4; Set C
aaaguuaacaugaaaau

SEQ ID NO: 36839 - RNA, 16 nt, Artificial Sequence
  Synthetic Oligonucleotide; NDFIP1 exon 4; Set C
aaaguuaacaugaaaa

SEQ ID NO: 36840 - RNA, 35 nt, Artificial Sequence
  Synthetic Oligonucleotide; NDFIP1 exon 4; Set C
cauacuuacugaaaaaaguuaacaugaaaauccca

SEQ ID NO: 36841 - RNA, 36 nt, Artificial Sequence
  Synthetic Oligonucleotide; NDFIP1 exon 4; Set C
acauacuuacugaaaaaaguuaacaugaaaauccca

SEQ ID NO: 36842 - RNA, 34 nt, Artificial Sequence
  Synthetic Oligonucleotide; NDFIP1 exon 4; Set C
cauacuuacugaaaaaaguuaacaugaaaauccc

SEQ ID NO: 36843 - RNA, 33 nt, Artificial Sequence
  Synthetic Oligonucleotide; NDFIP1 exon 4; Set C
cauacuuacugaaaaaaguuaacaugaaaaucc

SEQ ID NO: 36844 - RNA, 37 nt, Artificial Sequence
  Synthetic Oligonucleotide; NDFIP1 exon 4; Set C
uacauacuuacugaaaaaaguuaacaugaaaauccca

SEQ ID NO: 36845 - RNA, 35 nt, Artificial Sequence
  Synthetic Oligonucleotide; NDFIP1 exon 4; Set C
acauacuuacugaaaaaaguuaacaugaaaauccc

SEQ ID NO: 36846 - RNA, 32 nt, Artificial Sequence
  Synthetic Oligonucleotide; NDFIP1 exon 4; Set C
cauacuuacugaaaaaaguuaacaugaaaauc

SEQ ID NO: 36847 - RNA, 34 nt, Artificial Sequence
  Synthetic Oligonucleotide; NDFIP1 exon 4; Set C
acauacuuacugaaaaaaguuaacaugaaaaucc

SEQ ID NO: 36848 - RNA, 38 nt, Artificial Sequence
  Synthetic Oligonucleotide; NDFIP1 exon 4; Set C
auacauacuuacugaaaaaaguuaacaugaaaauccca

SEQ ID NO: 36849 - RNA, 36 nt, Artificial Sequence
  Synthetic Oligonucleotide; NDFIP1 exon 4; Set C
uacauacuuacugaaaaaaguuaacaugaaaauccc

SEQ ID NO: 36850 - RNA, 31 nt, Artificial Sequence
  Synthetic Oligonucleotide; NDFIP1 exon 4; Set C
cauacuuacugaaaaaaguuaacaugaaaau

SEQ ID NO: 36851 - RNA, 33 nt, Artificial Sequence
  Synthetic Oligonucleotide; NDFIP1 exon 4; Set C
acauacuuacugaaaaaaguuaacaugaaaauc

SEQ ID NO: 36852 - RNA, 35 nt, Artificial Sequence
  Synthetic Oligonucleotide; NDFIP1 exon 4; Set C
uacauacuuacugaaaaaaguuaacaugaaaaucc

SEQ ID NO: 36853 - RNA, 39 nt, Artificial Sequence
  Synthetic Oligonucleotide; NDFIP1 exon 4; Set A
cauacauacuuacugaaaaaaguuaacaugaaaauccca

SEQ ID NO: 36854 - RNA, 37 nt, Artificial Sequence
  Synthetic Oligonucleotide; NDFIP1 exon 4; Set C
auacauacuuacugaaaaaaguuaacaugaaaauccc

SEQ ID NO: 36855 - RNA, 30 nt, Artificial Sequence
  Synthetic Oligonucleotide; NDFIP1 exon 4; Set C
cauacuuacugaaaaaaguuaacaugaaaa

SEQ ID NO: 36856 - RNA, 32 nt, Artificial Sequence
  Synthetic Oligonucleotide; NDFIP1 exon 4; Set C
acauacuuacugaaaaaaguuaacaugaaaau

SEQ ID NO: 36857 - RNA, 34 nt, Artificial Sequence
  Synthetic Oligonucleotide; NDFIP1 exon 4; Set C
uacauacuuacugaaaaaaguuaacaugaaaauc

SEQ ID NO: 36858 - RNA, 36 nt, Artificial Sequence
  Synthetic Oligonucleotide; NDFIP1 exon 4; Set C
auacauacuuacugaaaaaaguuaacaugaaaaucc

SEQ ID NO: 36859 - RNA, 38 nt, Artificial Sequence
  Synthetic Oligonucleotide; NDFIP1 exon 4; Set C
cauacauacuuacugaaaaaaguuaacaugaaaauccc

SEQ ID NO: 36860 - RNA, 31 nt, Artificial Sequence
  Synthetic Oligonucleotide; NDFIP1 exon 4; Set C
acauacuuacugaaaaaaguuaacaugaaaa

SEQ ID NO: 36861 - RNA, 33 nt, Artificial Sequence
  Synthetic Oligonucleotide; NDFIP1 exon 4; Set C
uacauacuuacugaaaaaaguuaacaugaaaau

SEQ ID NO: 36862 - RNA, 35 nt, Artificial Sequence
  Synthetic Oligonucleotide; NDFIP1 exon 4; Set C
auacauacuuacugaaaaaaguuaacaugaaaauc

SEQ ID NO: 36863 - RNA, 37 nt, Artificial Sequence
  Synthetic Oligonucleotide; NDFIP1 exon 4; Set C
cauacauacuuacugaaaaaaguuaacaugaaaaucc

SEQ ID NO: 36864 - RNA, 29 nt, Artificial Sequence
  Synthetic Oligonucleotide; NDFIP1 exon 4; Set C
cauacuuacugaaaaaaguuaacaugaaa

SEQ ID NO: 36865 - RNA, 32 nt, Artificial Sequence
  Synthetic Oligonucleotide; NDFIP1 exon 4; Set C
uacauacuuacugaaaaaaguuaacaugaaaa

SEQ ID NO: 36866 - RNA, 34 nt, Artificial Sequence
  Synthetic Oligonucleotide; NDFIP1 exon 4; Set C
auacauacuuacugaaaaaaguuaacaugaaaau

SEQ ID NO: 36867 - RNA, 36 nt, Artificial Sequence
  Synthetic Oligonucleotide; NDFIP1 exon 4; Set C
cauacauacuuacugaaaaaaguuaacaugaaaauc

SEQ ID NO: 36868 - RNA, 30 nt, Artificial Sequence
  Synthetic Oligonucleotide; NDFIP1 exon 4; Set C
acauacuuacugaaaaaaguuaacaugaaa

SEQ ID NO: 36869 - RNA, 33 nt, Artificial Sequence
  Synthetic Oligonucleotide; NDFIP1 exon 4; Set C
auacauacuuacugaaaaaaguuaacaugaaaa

SEQ ID NO: 36870 - RNA, 35 nt, Artificial Sequence
  Synthetic Oligonucleotide; NDFIP1 exon 4; Set C
cauacauacuuacugaaaaaaguuaacaugaaaau

SEQ ID NO: 36871 - RNA, 31 nt, Artificial Sequence
  Synthetic Oligonucleotide; NDFIP1 exon 4; Set C
uacauacuuacugaaaaaaguuaacaugaaa

SEQ ID NO: 36872 - RNA, 29 nt, Artificial Sequence
  Synthetic Oligonucleotide; NDFIP1 exon 4; Set C
acauacuuacugaaaaaaguuaacaugaa

SEQ ID NO: 36873 - RNA, 34 nt, Artificial Sequence
  Synthetic Oligonucleotide; NDFIP1 exon 4; Set C
cauacauacuuacugaaaaaaguuaacaugaaaa

SEQ ID NO: 36874 - RNA, 32 nt, Artificial Sequence
  Synthetic Oligonucleotide; NDFIP1 exon 4; Set C
auacauacuuacugaaaaaaguuaacaugaaa

SEQ ID NO: 36875 - RNA, 30 nt, Artificial Sequence
  Synthetic Oligonucleotide; NDFIP1 exon 4; Set C
uacauacuuacugaaaaaaguuaacaugaa

SEQ ID NO: 36876 - RNA, 28 nt, Artificial Sequence
  Synthetic Oligonucleotide; NDFIP1 exon 4; Set C
acauacuuacugaaaaaaguuaacauga

SEQ ID NO: 36877 - RNA, 33 nt, Artificial Sequence
  Synthetic Oligonucleotide; NDFIP1 exon 4; Set C
cauacauacuuacugaaaaaaguuaacaugaaa

SEQ ID NO: 36878 - RNA, 31 nt, Artificial Sequence
  Synthetic Oligonucleotide; NDFIP1 exon 4; Set C
auacauacuuacugaaaaaaguuaacaugaa

SEQ ID NO: 36879 - RNA, 29 nt, Artificial Sequence
  Synthetic Oligonucleotide; NDFIP1 exon 4; Set C
uacauacuuacugaaaaaaguuaacauga

SEQ ID NO: 36880 - RNA, 30 nt, Artificial Sequence
  Synthetic Oligonucleotide; NDFIP1 exon 4; Set C
auacauacuuacugaaaaaaguuaacauga

SEQ ID NO: 36881 - RNA, 32 nt, Artificial Sequence
  Synthetic Oligonucleotide; NDFIP1 exon 4; Set C
cauacauacuuacugaaaaaaguuaacaugaa

SEQ ID NO: 36882 - RNA, 28 nt, Artificial Sequence
  Synthetic Oligonucleotide; NDFIP1 exon 4; Set C
uacauacuuacugaaaaaaguuaacaug

SEQ ID NO: 36883 - RNA, 23 nt, Artificial Sequence
  Synthetic Oligonucleotide; NDFIP1 exon 4; Set C
cauacuuacugaaaaaaguuaac

SEQ ID NO: 36884 - RNA, 29 nt, Artificial Sequence
  Synthetic Oligonucleotide; NDFIP1 exon 4; Set C
auacauacuuacugaaaaaaguuaacaug

SEQ ID NO: 36885 - RNA, 31 nt, Artificial Sequence
  Synthetic Oligonucleotide; NDFIP1 exon 4; Set C
cauacauacuuacugaaaaaaguuaacauga

SEQ ID NO: 36886 - RNA, 24 nt, Artificial Sequence
  Synthetic Oligonucleotide; NDFIP1 exon 4; Set C
acauacuuacugaaaaaaguuaac

SEQ ID NO: 36887 - RNA, 22 nt, Artificial Sequence
  Synthetic Oligonucleotide; NDFIP1 exon 4; Set C
cauacuuacugaaaaaaguuaa

SEQ ID NO: 36888 - RNA, 30 nt, Artificial Sequence
  Synthetic Oligonucleotide; NDFIP1 exon 4; Set C
cauacauacuuacugaaaaaaguuaacaug

SEQ ID NO: 36889 - RNA, 28 nt, Artificial Sequence
  Synthetic Oligonucleotide; NDFIP1 exon 4; Set C
auacauacuuacugaaaaaaguuaacau

SEQ ID NO: 36890 - RNA, 21 nt, Artificial Sequence
  Synthetic Oligonucleotide; NDFIP1 exon 4; Set C
cauacuuacugaaaaaaguua

SEQ ID NO: 36891 - RNA, 25 nt, Artificial Sequence
  Synthetic Oligonucleotide; NDFIP1 exon 4; Set C
uacauacuuacugaaaaaaguuaac

SEQ ID NO: 36892 - RNA, 23 nt, Artificial Sequence
  Synthetic Oligonucleotide; NDFIP1 exon 4; Set C
acauacuuacugaaaaaaguuaa

SEQ ID NO: 36893 - RNA, 27 nt, Artificial Sequence
  Synthetic Oligonucleotide; NDFIP1 exon 4; Set C
auacauacuuacugaaaaaaguuaaca

SEQ ID NO: 36894 - RNA, 29 nt, Artificial Sequence
  Synthetic Oligonucleotide; NDFIP1 exon 4; Set C
cauacauacuuacugaaaaaaguuaacau

SEQ ID NO: 36895 - RNA, 22 nt, Artificial Sequence
  Synthetic Oligonucleotide; NDFIP1 exon 4; Set C
acauacuuacugaaaaaaguua

SEQ ID NO: 36896 - RNA, 26 nt, Artificial Sequence
  Synthetic Oligonucleotide; NDFIP1 exon 4; Set C
auacauacuuacugaaaaaaguuaac

SEQ ID NO: 36897 - RNA, 24 nt, Artificial Sequence
  Synthetic Oligonucleotide; NDFIP1 exon 4; Set C
uacauacuuacugaaaaaaguuaa

SEQ ID NO: 36898 - RNA, 28 nt, Artificial Sequence
  Synthetic Oligonucleotide; NDFIP1 exon 4; Set C
cauacauacuuacugaaaaaaguuaaca

SEQ ID NO: 36899 - RNA, 23 nt, Artificial Sequence
  Synthetic Oligonucleotide; NDFIP1 exon 4; Set C
uacauacuuacugaaaaaaguua

SEQ ID NO: 36900 - RNA, 25 nt, Artificial Sequence
  Synthetic Oligonucleotide; NDFIP1 exon 4; Set C
auacauacuuacugaaaaaaguuaa

SEQ ID NO: 36901 - RNA, 27 nt, Artificial Sequence
  Synthetic Oligonucleotide; NDFIP1 exon 4; Set C
cauacauacuuacugaaaaaaguuaac

SEQ ID NO: 36902 - RNA, 24 nt, Artificial Sequence
  Synthetic Oligonucleotide; NDFIP1 exon 4; Set C
auacauacuuacugaaaaaaguua

SEQ ID NO: 36903 - RNA, 26 nt, Artificial Sequence
  Synthetic Oligonucleotide; NDFIP1 exon 4; Set C
cauacauacuuacugaaaaaaguuaa

SEQ ID NO: 36904 - RNA, 25 nt, Artificial Sequence
  Synthetic Oligonucleotide; NDFIP1 exon 4; Set C
cauacauacuuacugaaaaaaguua

SEQ ID NO: 36905 - RNA, 23 nt, Artificial Sequence
  Synthetic Oligonucleotide; NDFIP1 exon 4; Set C
auacauacuuacugaaaaaaguu

SEQ ID NO: 36906 - RNA, 24 nt, Artificial Sequence
  Synthetic Oligonucleotide; NDFIP1 exon 4; Set C
cauacauacuuacugaaaaaaguu

SEQ ID NO: 36907 - RNA, 19 nt, Artificial Sequence
  Synthetic Oligonucleotide; NDFIP1 exon 4; Set C
auacauacuuacugaaaaa

SEQ ID NO: 36908 - RNA, 18 nt, Artificial Sequence
  Synthetic Oligonucleotide; NDFIP1 exon 4; Set C
auacauacuuacugaaaa

SEQ ID NO: 36909 - RNA, 29 nt, Artificial Sequence
  Synthetic Oligonucleotide; NDFIP1 exon 4; Set C
aaaagaaaaagaauuauuucuaggcaaag

SEQ ID NO: 36910 - RNA, 28 nt, Artificial Sequence
  Synthetic Oligonucleotide; NDFIP1 exon 4; Set C
aaaagaaaaagaauuauuucuaggcaaa

SEQ ID NO: 36911 - RNA, 30 nt, Artificial Sequence
  Synthetic Oligonucleotide; NDFIP1 exon 4; Set C
gaaaagaaaaagaauuauuucuaggcaaag

SEQ ID NO: 36912 - RNA, 29 nt, Artificial Sequence
  Synthetic Oligonucleotide; NDFIP1 exon 4; Set C
gaaaagaaaaagaauuauuucuaggcaaa

SEQ ID NO: 36913 - RNA, 31 nt, Artificial Sequence
  Synthetic Oligonucleotide; NDFIP1 exon 4; Set C
ugaaaagaaaaagaauuauuucuaggcaaag

SEQ ID NO: 36914 - RNA, 30 nt, Artificial Sequence
  Synthetic Oligonucleotide; NDFIP1 exon 4; Set C
ugaaaagaaaaagaauuauuucuaggcaaa

SEQ ID NO: 36915 - RNA, 32 nt, Artificial Sequence
  Synthetic Oligonucleotide; NDFIP1 exon 4; Set C
augaaaagaaaaagaauuauuucuaggcaaag

SEQ ID NO: 36916 - RNA, 31 nt, Artificial Sequence
  Synthetic Oligonucleotide; NDFIP1 exon 4; Set C
augaaaagaaaaagaauuauuucuaggcaaa

SEQ ID NO: 36917 - RNA, 33 nt, Artificial Sequence
  Synthetic Oligonucleotide; NDFIP1 exon 4; Set C
aaugaaaagaaaaagaauuauuucuaggcaaag

SEQ ID NO: 36918 - RNA, 32 nt, Artificial Sequence
  Synthetic Oligonucleotide; NDFIP1 exon 4; Set C
aaugaaaagaaaaagaauuauuucuaggcaaa

SEQ ID NO: 36919 - RNA, 34 nt, Artificial Sequence
  Synthetic Oligonucleotide; NDFIP1 exon 4; Set C
aaaugaaaagaaaaagaauuauuucuaggcaaag

SEQ ID NO: 36920 - RNA, 33 nt, Artificial Sequence
  Synthetic Oligonucleotide; NDFIP1 exon 4; Set C
aaaugaaaagaaaaagaauuauuucuaggcaaa

SEQ ID NO: 36921 - RNA, 15 nt, Artificial Sequence
  Synthetic Oligonucleotide; NDFIP1 exon 4; Set C
gucagcaucaucaaa

SEQ ID NO: 36922 - RNA, 16 nt, Artificial Sequence
  Synthetic Oligonucleotide; NDFIP1 exon 4; Set C
ggucagcaucaucaaa

SEQ ID NO: 36923 - RNA, 15 nt, Artificial Sequence
  Synthetic Oligonucleotide; NDFIP1 exon 4; Set C
ggucagcaucaucaa

SEQ ID NO: 36924 - RNA, 16 nt, Artificial Sequence
  Synthetic Oligonucleotide; NDFIP1 exon 4; Set C
uggucagcaucaucaa

SEQ ID NO: 36925 - RNA, 15 nt, Artificial Sequence
  Synthetic Oligonucleotide; NDFIP1 exon 4; Set C
uggucagcaucauca

SEQ ID NO: 36926 - RNA, 30 nt, Artificial Sequence
  Synthetic Oligonucleotide; NDFIP1 exon 4; Set C
uccuauccucagcuggucagcaucaucaaa

SEQ ID NO: 36927 - RNA, 30 nt, Artificial Sequence
  Synthetic Oligonucleotide; NDFIP1 exon 4; Set C
uuccuauccucagcuggucagcaucaucaa

SEQ ID NO: 36928 - RNA, 37 nt, Artificial Sequence
  Synthetic Oligonucleotide; NDFIP1 exon 4; Set C
ccaucauuuccuauccucagcuggucagcaucaucaa

SEQ ID NO: 36929 - RNA, 38 nt, Artificial Sequence
  Synthetic Oligonucleotide; NDFIP1 exon 4; Set C
cccaucauuuccuauccucagcuggucagcaucaucaa

SEQ ID NO: 36930 - RNA, 39 nt, Artificial Sequence
  Synthetic Oligonucleotide; NDFIP1 exon 4; Set C
ucccaucauuuccuauccucagcuggucagcaucaucaa

SEQ ID NO: 36931 - RNA, 40 nt, Artificial Sequence
  Synthetic Oligonucleotide; NDFIP1 exon 4; Set C
aucccaucauuuccuauccucagcuggucagcaucaucaa

SEQ ID NO: 36932 - RNA, 39 nt, Artificial Sequence
  Synthetic Oligonucleotide; NDFIP1 exon 4; Set C
aucccaucauuuccuauccucagcuggucagcaucauca

SEQ ID NO: 36933 - RNA, 40 nt, Artificial Sequence
  Synthetic Oligonucleotide; NDFIP1 exon 4; Set C
aaucccaucauuuccuauccucagcuggucagcaucauca

SEQ ID NO: 36934 - RNA, 38 nt, Artificial Sequence
  Synthetic Oligonucleotide; NDFIP1 exon 4; Set C
aucccaucauuuccuauccucagcuggucagcaucauc

SEQ ID NO: 36935 - RNA, 35 nt, Artificial Sequence
  Synthetic Oligonucleotide; NDFIP1 exon 4; Set C
ucccaucauuuccuauccucagcuggucagcauca

SEQ ID NO: 36936 - RNA, 39 nt, Artificial Sequence
  Synthetic Oligonucleotide; NDFIP1 exon 4; Set C
aaucccaucauuuccuauccucagcuggucagcaucauc

SEQ ID NO: 36937 - RNA, 36 nt, Artificial Sequence
  Synthetic Oligonucleotide; NDFIP1 exon 4; Set C
aucccaucauuuccuauccucagcuggucagcauca

SEQ ID NO: 36938 - RNA, 40 nt, Artificial Sequence
  Synthetic Oligonucleotide; NDFIP1 exon 4; Set C
aaaucccaucauuuccuauccucagcuggucagcaucauc

SEQ ID NO: 36939 - RNA, 38 nt, Artificial Sequence
  Synthetic Oligonucleotide; NDFIP1 exon 4; Set C
aaucccaucauuuccuauccucagcuggucagcaucau

SEQ ID NO: 36940 - RNA, 37 nt, Artificial Sequence
  Synthetic Oligonucleotide; NDFIP1 exon 4; Set C
aaucccaucauuuccuauccucagcuggucagcauca

SEQ ID NO: 36941 - RNA, 35 nt, Artificial Sequence
  Synthetic Oligonucleotide; NDFIP1 exon 4; Set C
aucccaucauuuccuauccucagcuggucagcauc

SEQ ID NO: 36942 - RNA, 39 nt, Artificial Sequence
  Synthetic Oligonucleotide; NDFIP1 exon 4; Set C
aaaucccaucauuuccuauccucagcuggucagcaucau

SEQ ID NO: 36943 - RNA, 38 nt, Artificial Sequence
  Synthetic Oligonucleotide; NDFIP1 exon 4; Set C
aaaucccaucauuuccuauccucagcuggucagcauca

SEQ ID NO: 36944 - RNA, 36 nt, Artificial Sequence
  Synthetic Oligonucleotide; NDFIP1 exon 4; Set C
aaucccaucauuuccuauccucagcuggucagcauc

SEQ ID NO: 36945 - RNA, 39 nt, Artificial Sequence
  Synthetic Oligonucleotide; NDFIP1 exon 4; Set C
aaaaucccaucauuuccuauccucagcuggucagcauca

SEQ ID NO: 36946 - RNA, 37 nt, Artificial Sequence
  Synthetic Oligonucleotide; NDFIP1 exon 4; Set C
aaaucccaucauuuccuauccucagcuggucagcauc

SEQ ID NO: 36947 - RNA, 24 nt, Artificial Sequence
  Synthetic Oligonucleotide; NDFIP1 exon 4; Set A
ccaucauuuccuauccucagcugg

SEQ ID NO: 36948 - RNA, 30 nt, Artificial Sequence
  Synthetic Oligonucleotide; NDFIP1 exon 4; Set C
aucccaucauuuccuauccucagcugguca

SEQ ID NO: 36949 - RNA, 25 nt, Artificial Sequence
  Synthetic Oligonucleotide; NDFIP1 exon 4; Set A
cccaucauuuccuauccucagcugg

SEQ ID NO: 36950 - RNA, 31 nt, Artificial Sequence
  Synthetic Oligonucleotide; NDFIP1 exon 4; Set C
aaucccaucauuuccuauccucagcugguca

SEQ ID NO: 36951 - RNA, 26 nt, Artificial Sequence
  Synthetic Oligonucleotide; NDFIP1 exon 4; Set A
ucccaucauuuccuauccucagcugg

SEQ ID NO: 36952 - RNA, 30 nt, Artificial Sequence
  Synthetic Oligonucleotide; NDFIP1 exon 4; Set C
aaucccaucauuuccuauccucagcugguc

SEQ ID NO: 36953 - RNA, 32 nt, Artificial Sequence
  Synthetic Oligonucleotide; NDFIP1 exon 4; Set C
aaaucccaucauuuccuauccucagcugguca

SEQ ID NO: 36954 - RNA, 27 nt, Artificial Sequence
  Synthetic Oligonucleotide; NDFIP1 exon 4; Set A
aucccaucauuuccuauccucagcugg

SEQ ID NO: 36955 - RNA, 29 nt, Artificial Sequence
  Synthetic Oligonucleotide; NDFIP1 exon 4; Set C
aaucccaucauuuccuauccucagcuggu

SEQ ID NO: 36956 - RNA, 31 nt, Artificial Sequence
  Synthetic Oligonucleotide; NDFIP1 exon 4; Set A
aaaucccaucauuuccuauccucagcugguc

SEQ ID NO: 36957 - RNA, 28 nt, Artificial Sequence
  Synthetic Oligonucleotide; NDFIP1 exon 4; Set A
aaucccaucauuuccuauccucagcugg

SEQ ID NO: 36958 - RNA, 30 nt, Artificial Sequence
  Synthetic Oligonucleotide; NDFIP1 exon 4; Set A
aaaucccaucauuuccuauccucagcuggu

SEQ ID NO: 36959 - RNA, 29 nt, Artificial Sequence
  Synthetic Oligonucleotide; NDFIP1 exon 4; Set A
aaaucccaucauuuccuauccucagcugg

SEQ ID NO: 36960 - RNA, 30 nt, Artificial Sequence
  Synthetic Oligonucleotide; NDFIP1 exon 4; Set A
aaaaucccaucauuuccuauccucagcugg

SEQ ID NO: 36961 - RNA, 31 nt, Artificial Sequence
  Synthetic Oligonucleotide; NDFIP1 exon 4; Set A
gaaaaucccaucauuuccuauccucagcugg

SEQ ID NO: 36962 - RNA, 32 nt, Artificial Sequence
  Synthetic Oligonucleotide; NDFIP1 exon 4; Set A
ugaaaaucccaucauuuccuauccucagcugg

SEQ ID NO: 36963 - RNA, 33 nt, Artificial Sequence
  Synthetic Oligonucleotide; NDFIP1 exon 4; Set A
augaaaaucccaucauuuccuauccucagcugg

SEQ ID NO: 36964 - RNA, 39 nt, Artificial Sequence
  Synthetic Oligonucleotide; NDFIP1 exon 4; Set C
aacaugaaaaucccaucauuuccuauccucagcugguca

SEQ ID NO: 36965 - RNA, 34 nt, Artificial Sequence
  Synthetic Oligonucleotide; NDFIP1 exon 4; Set A
caugaaaaucccaucauuuccuauccucagcugg

SEQ ID NO: 36966 - RNA, 38 nt, Artificial Sequence
  Synthetic Oligonucleotide; NDFIP1 exon 4; Set C
aacaugaaaaucccaucauuuccuauccucagcugguc

SEQ ID NO: 36967 - RNA, 40 nt, Artificial Sequence
  Synthetic Oligonucleotide; NDFIP1 exon 4; Set C
uaacaugaaaaucccaucauuuccuauccucagcugguca

SEQ ID NO: 36968 - RNA, 35 nt, Artificial Sequence
  Synthetic Oligonucleotide; NDFIP1 exon 4; Set C
acaugaaaaucccaucauuuccuauccucagcugg

SEQ ID NO: 36969 - RNA, 37 nt, Artificial Sequence
  Synthetic Oligonucleotide; NDFIP1 exon 4; Set C
aacaugaaaaucccaucauuuccuauccucagcuggu

SEQ ID NO: 36970 - RNA, 39 nt, Artificial Sequence
  Synthetic Oligonucleotide; NDFIP1 exon 4; Set C
uaacaugaaaaucccaucauuuccuauccucagcugguc

SEQ ID NO: 36971 - RNA, 36 nt, Artificial Sequence
  Synthetic Oligonucleotide; NDFIP1 exon 4; Set A
aacaugaaaaucccaucauuuccuauccucagcugg

SEQ ID NO: 36972 - RNA, 38 nt, Artificial Sequence
  Synthetic Oligonucleotide; NDFIP1 exon 4; Set C
uaacaugaaaaucccaucauuuccuauccucagcuggu

SEQ ID NO: 36973 - RNA, 40 nt, Artificial Sequence
  Synthetic Oligonucleotide; NDFIP1 exon 4; Set C
uuaacaugaaaaucccaucauuuccuauccucagcugguc

SEQ ID NO: 36974 - RNA, 37 nt, Artificial Sequence
  Synthetic Oligonucleotide; NDFIP1 exon 4; Set A
uaacaugaaaaucccaucauuuccuauccucagcugg

SEQ ID NO: 36975 - RNA, 39 nt, Artificial Sequence
  Synthetic Oligonucleotide; NDFIP1 exon 4; Set C
uuaacaugaaaaucccaucauuuccuauccucagcuggu

SEQ ID NO: 36976 - RNA, 15 nt, Artificial Sequence
  Synthetic Oligonucleotide; NDFIP1 exon 4; Set C
ucccaucauuuccua

SEQ ID NO: 36977 - RNA, 38 nt, Artificial Sequence
  Synthetic Oligonucleotide; NDFIP1 exon 4; Set C
uuaacaugaaaaucccaucauuuccuauccucagcugg

SEQ ID NO: 36978 - RNA, 40 nt, Artificial Sequence
  Synthetic Oligonucleotide; NDFIP1 exon 4; Set C
guuaacaugaaaaucccaucauuuccuauccucagcuggu

SEQ ID NO: 36979 - RNA, 16 nt, Artificial Sequence
  Synthetic Oligonucleotide; NDFIP1 exon 4; Set C
aucccaucauuuccua

SEQ ID NO: 36980 - RNA, 39 nt, Artificial Sequence
  Synthetic Oligonucleotide; NDFIP1 exon 4; Set C
guuaacaugaaaaucccaucauuuccuauccucagcugg

SEQ ID NO: 36981 - RNA, 17 nt, Artificial Sequence
  Synthetic Oligonucleotide; NDFIP1 exon 4; Set C
aaucccaucauuuccua

SEQ ID NO: 36982 - RNA, 15 nt, Artificial Sequence
  Synthetic Oligonucleotide; NDFIP1 exon 4; Set C
aucccaucauuuccu

SEQ ID NO: 36983 - RNA, 18 nt, Artificial Sequence
  Synthetic Oligonucleotide; NDFIP1 exon 4; Set C
aaaucccaucauuuccua

SEQ ID NO: 36984 - RNA, 16 nt, Artificial Sequence
  Synthetic Oligonucleotide; NDFIP1 exon 4; Set C
aaucccaucauuuccu

SEQ ID NO: 36985 - RNA, 19 nt, Artificial Sequence
  Synthetic Oligonucleotide; NDFIP1 exon 4; Set C
aaaaucccaucauuuccua

SEQ ID NO: 36986 - RNA, 17 nt, Artificial Sequence
  Synthetic Oligonucleotide; NDFIP1 exon 4; Set C
aaaucccaucauuuccu

SEQ ID NO: 36987 - RNA, 20 nt, Artificial Sequence
  Synthetic Oligonucleotide; NDFIP1 exon 4; Set C
gaaaaucccaucauuuccua

SEQ ID NO: 36988 - RNA, 18 nt, Artificial Sequence
  Synthetic Oligonucleotide; NDFIP1 exon 4; Set C
aaaaucccaucauuuccu

SEQ ID NO: 36989 - RNA, 17 nt, Artificial Sequence
  Synthetic Oligonucleotide; NDFIP1 exon 4; Set C
aaaaucccaucauuucc

SEQ ID NO: 36990 - RNA, 21 nt, Artificial Sequence
  Synthetic Oligonucleotide; NDFIP1 exon 4; Set C
ugaaaaucccaucauuuccua

SEQ ID NO: 36991 - RNA, 19 nt, Artificial Sequence
  Synthetic Oligonucleotide; NDFIP1 exon 4; Set C
gaaaaucccaucauuuccu

SEQ ID NO: 36992 - RNA, 18 nt, Artificial Sequence
  Synthetic Oligonucleotide; NDFIP1 exon 4; Set C
gaaaaucccaucauuucc

SEQ ID NO: 36993 - RNA, 22 nt, Artificial Sequence
  Synthetic Oligonucleotide; NDFIP1 exon 4; Set C
augaaaaucccaucauuuccua

SEQ ID NO: 36994 - RNA, 20 nt, Artificial Sequence
  Synthetic Oligonucleotide; NDFIP1 exon 4; Set C
ugaaaaucccaucauuuccu

SEQ ID NO: 36995 - RNA, 19 nt, Artificial Sequence
  Synthetic Oligonucleotide; NDFIP1 exon 4; Set C
ugaaaaucccaucauuucc

SEQ ID NO: 36996 - RNA, 23 nt, Artificial Sequence
  Synthetic Oligonucleotide; NDFIP1 exon 4; Set C
caugaaaaucccaucauuuccua

SEQ ID NO: 36997 - RNA, 21 nt, Artificial Sequence
  Synthetic Oligonucleotide; NDFIP1 exon 4; Set C
augaaaaucccaucauuuccu

SEQ ID NO: 36998 - RNA, 20 nt, Artificial Sequence
  Synthetic Oligonucleotide; NDFIP1 exon 4; Set C
augaaaaucccaucauuucc

SEQ ID NO: 36999 - RNA, 24 nt, Artificial Sequence
  Synthetic Oligonucleotide; NDFIP1 exon 4; Set C
acaugaaaaucccaucauuuccua

SEQ ID NO: 37000 - RNA, 22 nt, Artificial Sequence
  Synthetic Oligonucleotide; NDFIP1 exon 4; Set C
caugaaaaucccaucauuuccu

SEQ ID NO: 37001 - RNA, 21 nt, Artificial Sequence
  Synthetic Oligonucleotide; NDFIP1 exon 4; Set C
caugaaaaucccaucauuucc

SEQ ID NO: 37002 - RNA, 23 nt, Artificial Sequence
  Synthetic Oligonucleotide; NDFIP1 exon 4; Set C
acaugaaaaucccaucauuuccu

SEQ ID NO: 37003 - RNA, 22 nt, Artificial Sequence
  Synthetic Oligonucleotide; NDFIP1 exon 4; Set C
acaugaaaaucccaucauuucc

SEQ ID NO: 37004 - RNA, 24 nt, Artificial Sequence
  Synthetic Oligonucleotide; NDFIP1 exon 4; Set C
aacaugaaaaucccaucauuuccu

SEQ ID NO: 37005 - RNA, 25 nt, Artificial Sequence
  Synthetic Oligonucleotide; NDFIP1 exon 4; Set C
uaacaugaaaaucccaucauuuccu

SEQ ID NO: 37006 - RNA, 28 nt, Artificial Sequence
  Synthetic Oligonucleotide; NDFIP1 exon 4; Set C
guuaacaugaaaaucccaucauuuccua

SEQ ID NO: 37007 - RNA, 26 nt, Artificial Sequence
  Synthetic Oligonucleotide; NDFIP1 exon 4; Set C
uuaacaugaaaaucccaucauuuccu

SEQ ID NO: 37008 - RNA, 27 nt, Artificial Sequence
  Synthetic Oligonucleotide; NDFIP1 exon 4; Set C
guuaacaugaaaaucccaucauuuccu

SEQ ID NO: 37009 - RNA, 21 nt, Artificial Sequence
  Synthetic Oligonucleotide; NDFIP1 exon 4; Set C
aacaugaaaaucccaucauuu

SEQ ID NO: 37010 - RNA, 20 nt, Artificial Sequence
  Synthetic Oligonucleotide; NDFIP1 exon 4; Set C
aacaugaaaaucccaucauu

SEQ ID NO: 37011 - RNA, 22 nt, Artificial Sequence
  Synthetic Oligonucleotide; NDFIP1 exon 4; Set C
uaacaugaaaaucccaucauuu

SEQ ID NO: 37012 - RNA, 21 nt, Artificial Sequence
  Synthetic Oligonucleotide; NDFIP1 exon 4; Set C
uaacaugaaaaucccaucauu

SEQ ID NO: 37013 - RNA, 23 nt, Artificial Sequence
  Synthetic Oligonucleotide; NDFIP1 exon 4; Set C
uuaacaugaaaaucccaucauuu

SEQ ID NO: 37014 - RNA, 26 nt, Artificial Sequence
  Synthetic Oligonucleotide; NDFIP1 exon 4; Set C
aguuaacaugaaaaucccaucauuuc

SEQ ID NO: 37015 - RNA, 22 nt, Artificial Sequence
  Synthetic Oligonucleotide; NDFIP1 exon 4; Set C
uuaacaugaaaaucccaucauu

SEQ ID NO: 37016 - RNA, 24 nt, Artificial Sequence
  Synthetic Oligonucleotide; NDFIP1 exon 4; Set C
guuaacaugaaaaucccaucauuu

SEQ ID NO: 37017 - RNA, 27 nt, Artificial Sequence
  Synthetic Oligonucleotide; NDFIP1 exon 4; Set C
aaguuaacaugaaaaucccaucauuuc

SEQ ID NO: 37018 - RNA, 31 nt, Artificial Sequence
  Synthetic Oligonucleotide; NDFIP1 exon 4; Set C
aaaaguuaacaugaaaaucccaucauuuccu

SEQ ID NO: 37019 - RNA, 23 nt, Artificial Sequence
  Synthetic Oligonucleotide; NDFIP1 exon 4; Set C
guuaacaugaaaaucccaucauu

SEQ ID NO: 37020 - RNA, 28 nt, Artificial Sequence
  Synthetic Oligonucleotide; NDFIP1 exon 4; Set C
aaaguuaacaugaaaaucccaucauuuc

SEQ ID NO: 37021 - RNA, 32 nt, Artificial Sequence
  Synthetic Oligonucleotide; NDFIP1 exon 4; Set C
aaaaaguuaacaugaaaaucccaucauuuccu

SEQ ID NO: 37022 - RNA, 28 nt, Artificial Sequence
  Synthetic Oligonucleotide; NDFIP1 exon 4; Set C
aaaaguuaacaugaaaaucccaucauuu

SEQ ID NO: 37023 - RNA, 27 nt, Artificial Sequence
  Synthetic Oligonucleotide; NDFIP1 exon 4; Set C
aaaaguuaacaugaaaaucccaucauu

SEQ ID NO: 37024 - RNA, 29 nt, Artificial Sequence
  Synthetic Oligonucleotide; NDFIP1 exon 4; Set C
aaaaaguuaacaugaaaaucccaucauuu

SEQ ID NO: 37025 - RNA, 28 nt, Artificial Sequence
  Synthetic Oligonucleotide; NDFIP1 exon 4; Set C
aaaaaguuaacaugaaaaucccaucauu

SEQ ID NO: 37026 - RNA, 15 nt, Artificial Sequence
  Synthetic Oligonucleotide; NDFIP1 exon 4; Set C
aaaguuaacaugaaa

SEQ ID NO: 37027 - RNA, 28 nt, Artificial Sequence
  Synthetic Oligonucleotide; NDFIP1 exon 4; Set C
cauacuuacugaaaaaaguuaacaugaa

SEQ ID NO: 37028 - RNA, 27 nt, Artificial Sequence
  Synthetic Oligonucleotide; NDFIP1 exon 4; Set C
cauacuuacugaaaaaaguuaacauga

SEQ ID NO: 37029 - RNA, 26 nt, Artificial Sequence
  Synthetic Oligonucleotide; NDFIP1 exon 4; Set C
cauacuuacugaaaaaaguuaacaug

SEQ ID NO: 37030 - RNA, 27 nt, Artificial Sequence
  Synthetic Oligonucleotide; NDFIP1 exon 4; Set C
acauacuuacugaaaaaaguuaacaug

SEQ ID NO: 37031 - RNA, 25 nt, Artificial Sequence
  Synthetic Oligonucleotide; NDFIP1 exon 4; Set C
cauacuuacugaaaaaaguuaacau

SEQ ID NO: 37032 - RNA, 24 nt, Artificial Sequence
  Synthetic Oligonucleotide; NDFIP1 exon 4; Set C
cauacuuacugaaaaaaguuaaca

SEQ ID NO: 37033 - RNA, 26 nt, Artificial Sequence
  Synthetic Oligonucleotide; NDFIP1 exon 4; Set C
acauacuuacugaaaaaaguuaacau

SEQ ID NO: 37034 - RNA, 25 nt, Artificial Sequence
  Synthetic Oligonucleotide; NDFIP1 exon 4; Set C
acauacuuacugaaaaaaguuaaca

SEQ ID NO: 37035 - RNA, 27 nt, Artificial Sequence
  Synthetic Oligonucleotide; NDFIP1 exon 4; Set C
uacauacuuacugaaaaaaguuaacau

SEQ ID NO: 37036 - RNA, 26 nt, Artificial Sequence
  Synthetic Oligonucleotide; NDFIP1 exon 4; Set C
uacauacuuacugaaaaaaguuaaca

SEQ ID NO: 37037 - RNA, 20 nt, Artificial Sequence
  Synthetic Oligonucleotide; NDFIP1 exon 4; Set C
cauacuuacugaaaaaaguu

SEQ ID NO: 37038 - RNA, 21 nt, Artificial Sequence
  Synthetic Oligonucleotide; NDFIP1 exon 4; Set C
acauacuuacugaaaaaaguu

SEQ ID NO: 37039 - RNA, 22 nt, Artificial Sequence
  Synthetic Oligonucleotide; NDFIP1 exon 4; Set C
uacauacuuacugaaaaaaguu

SEQ ID NO: 37040 - RNA, 16 nt, Artificial Sequence
  Synthetic Oligonucleotide; NDFIP1 exon 4; Set C
cauacuuacugaaaaa

SEQ ID NO: 37041 - RNA, 17 nt, Artificial Sequence
  Synthetic Oligonucleotide; NDFIP1 exon 4; Set C
acauacuuacugaaaaa

SEQ ID NO: 37042 - RNA, 15 nt, Artificial Sequence
  Synthetic Oligonucleotide; NDFIP1 exon 4; Set C
cauacuuacugaaaa

SEQ ID NO: 37043 - RNA, 18 nt, Artificial Sequence
  Synthetic Oligonucleotide; NDFIP1 exon 4; Set C
uacauacuuacugaaaaa

SEQ ID NO: 37044 - RNA, 16 nt, Artificial Sequence
  Synthetic Oligonucleotide; NDFIP1 exon 4; Set C
acauacuuacugaaaa

SEQ ID NO: 37045 - RNA, 17 nt, Artificial Sequence
  Synthetic Oligonucleotide; NDFIP1 exon 4; Set C
uacauacuuacugaaaa

SEQ ID NO: 37046 - RNA, 20 nt, Artificial Sequence
  Synthetic Oligonucleotide; NDFIP1 exon 4; Set C
cauacauacuuacugaaaaa

SEQ ID NO: 37047 - RNA, 19 nt, Artificial Sequence
  Synthetic Oligonucleotide; NDFIP1 exon 4; Set C
cauacauacuuacugaaaa

SEQ ID NO: 37048 - RNA, 40 nt, Artificial Sequence
  Synthetic Oligonucleotide; NDFIP1 exon 4; Set C
guagggggugguucugauaugcauacauacuuacugaaaa

SEQ ID NO: 37049 - RNA, 29 nt, Artificial Sequence
  Synthetic Oligonucleotide; NDFIP1 exon 4; Set C
uguagggggugguucugauaugcauacau

SEQ ID NO: 37050 - RNA, 30 nt, Artificial Sequence
  Synthetic Oligonucleotide; NDFIP1 exon 4; Set C
uuguagggggugguucugauaugcauacau

SEQ ID NO: 37051 - RNA, 29 nt, Artificial Sequence
  Synthetic Oligonucleotide; NDFIP1 exon 4; Set C
uuguagggggugguucugauaugcauaca

SEQ ID NO: 37052 - RNA, 31 nt, Artificial Sequence
  Synthetic Oligonucleotide; NDFIP1 exon 4; Set C
uuuguagggggugguucugauaugcauacau

SEQ ID NO: 37053 - RNA, 26 nt, Artificial Sequence
  Synthetic Oligonucleotide; NDFIP1 exon 4; Set B
uguagggggugguucugauaugcaua

SEQ ID NO: 37054 - RNA, 30 nt, Artificial Sequence
  Synthetic Oligonucleotide; NDFIP1 exon 4; Set C
uuuguagggggugguucugauaugcauaca

SEQ ID NO: 37055 - RNA, 27 nt, Artificial Sequence
  Synthetic Oligonucleotide; NDFIP1 exon 4; Set B
uuguagggggugguucugauaugcaua

SEQ ID NO: 37056 - RNA, 29 nt, Artificial Sequence
  Synthetic Oligonucleotide; NDFIP1 exon 4; Set B
uuuguagggggugguucugauaugcauac

SEQ ID NO: 37057 - RNA, 28 nt, Artificial Sequence
  Synthetic Oligonucleotide; NDFIP1 exon 4; Set B
uuuguagggggugguucugauaugcaua

SEQ ID NO: 37058 - RNA, 15 nt, Artificial Sequence
  Synthetic Oligonucleotide; NDFIP1 exon 4; Set C
gcacucuaguuugua

SEQ ID NO: 37059 - RNA, 17 nt, Artificial Sequence
  Synthetic Oligonucleotide; NDFIP1 exon 4; Set C
aagggaagacauaaaga

SEQ ID NO: 37060 - RNA, 16 nt, Artificial Sequence
  Synthetic Oligonucleotide; NDFIP1 exon 4; Set C
aagggaagacauaaag

SEQ ID NO: 37061 - RNA, 18 nt, Artificial Sequence
  Synthetic Oligonucleotide; NDFIP1 exon 4; Set C
aaagggaagacauaaaga

SEQ ID NO: 37062 - RNA, 15 nt, Artificial Sequence
  Synthetic Oligonucleotide; NDFIP1 exon 4; Set C
aagggaagacauaaa

SEQ ID NO: 37063 - RNA, 17 nt, Artificial Sequence
  Synthetic Oligonucleotide; NDFIP1 exon 4; Set C
aaagggaagacauaaag

SEQ ID NO: 37064 - RNA, 16 nt, Artificial Sequence
  Synthetic Oligonucleotide; NDFIP1 exon 4; Set C
aaagggaagacauaaa

SEQ ID NO: 37065 - RNA, 15 nt, Artificial Sequence
  Synthetic Oligonucleotide; NDFIP1 exon 4; Set C
aaagggaagacauaa

SEQ ID NO: 37066 - RNA, 40 nt, Artificial Sequence
  Synthetic Oligonucleotide; NDFIP1 exon 4; Set C
aaaagaaaaagaauuauuucuaggcaaagggaagacauaa

SEQ ID NO: 37067 - RNA, 39 nt, Artificial Sequence
  Synthetic Oligonucleotide; NDFIP1 exon 4; Set C
aaaagaaaaagaauuauuucuaggcaaagggaagacaua

SEQ ID NO: 37068 - RNA, 40 nt, Artificial Sequence
  Synthetic Oligonucleotide; NDFIP1 exon 4; Set C
gaaaagaaaaagaauuauuucuaggcaaagggaagacaua

SEQ ID NO: 37069 - RNA, 21 nt, Artificial Sequence
  Synthetic Oligonucleotide; NDFIP1 exon 4; Set C
aagaauuauuucuaggcaaag

SEQ ID NO: 37070 - RNA, 20 nt, Artificial Sequence
  Synthetic Oligonucleotide; NDFIP1 exon 4; Set C
aagaauuauuucuaggcaaa

SEQ ID NO: 37071 - RNA, 22 nt, Artificial Sequence
  Synthetic Oligonucleotide; NDFIP1 exon 4; Set C
aaagaauuauuucuaggcaaag

SEQ ID NO: 37072 - RNA, 21 nt, Artificial Sequence
  Synthetic Oligonucleotide; NDFIP1 exon 4; Set C
aaagaauuauuucuaggcaaa

SEQ ID NO: 37073 - RNA, 19 nt, Artificial Sequence
  Synthetic Oligonucleotide; NDFIP1 exon 4; Set C
augaaaagaaaaagaauua

SEQ ID NO: 37074 - RNA, 20 nt, Artificial Sequence
  Synthetic Oligonucleotide; NDFIP1 exon 4; Set C
aaugaaaagaaaaagaauua

SEQ ID NO: 37075 - RNA, 19 nt, Artificial Sequence
  Synthetic Oligonucleotide; NDFIP1 exon 4; Set C
aaugaaaagaaaaagaauu

SEQ ID NO: 37076 - RNA, 21 nt, Artificial Sequence
  Synthetic Oligonucleotide; NDFIP1 exon 4; Set C
aaaugaaaagaaaaagaauua

SEQ ID NO: 37077 - RNA, 20 nt, Artificial Sequence
  Synthetic Oligonucleotide; NDFIP1 exon 4; Set C
aaaugaaaagaaaaagaauu

SEQ ID NO: 37078 - RNA, 19 nt, Artificial Sequence
  Synthetic Oligonucleotide; NDFIP1 exon 4; Set C
aaaugaaaagaaaaagaau

SEQ ID NO: 37079 - RNA, 18 nt, Artificial Sequence
  Synthetic Oligonucleotide; NDFIP1 exon 4; Set C
aaaugaaaagaaaaagaa

SEQ ID NO: 37080 - RNA, 17 nt, Artificial Sequence
  Synthetic Oligonucleotide; NDFIP1 exon 4; Set C
aaaugaaaagaaaaaga

SEQ ID NO: 37081 - RNA, 16 nt, Artificial Sequence
  Synthetic Oligonucleotide; NDFIP1 exon 4; Set C
aaaugaaaagaaaaag

SEQ ID NO: 37082 - RNA, 15 nt, Artificial Sequence
  Synthetic Oligonucleotide; NDFIP1 exon 4; Set C
aaaugaaaagaaaaa

SEQ ID NO: 37083 - RNA, 28 nt, Artificial Sequence
  Synthetic Oligonucleotide; NDFIP1 exon 4; Set A
cuauccucagcuggucagcaucaucaaa

SEQ ID NO: 37084 - RNA, 29 nt, Artificial Sequence
  Synthetic Oligonucleotide; NDFIP1 exon 4; Set C
ccuauccucagcuggucagcaucaucaaa

SEQ ID NO: 37085 - RNA, 27 nt, Artificial Sequence
  Synthetic Oligonucleotide; NDFIP1 exon 4; Set A
cuauccucagcuggucagcaucaucaa

SEQ ID NO: 37086 - RNA, 28 nt, Artificial Sequence
  Synthetic Oligonucleotide; NDFIP1 exon 4; Set C
ccuauccucagcuggucagcaucaucaa

SEQ ID NO: 37087 - RNA, 29 nt, Artificial Sequence
  Synthetic Oligonucleotide; NDFIP1 exon 4; Set C
uccuauccucagcuggucagcaucaucaa

SEQ ID NO: 37088 - RNA, 32 nt, Artificial Sequence
  Synthetic Oligonucleotide; NDFIP1 exon 4; Set C
uuuccuauccucagcuggucagcaucaucaaa

SEQ ID NO: 37089 - RNA, 28 nt, Artificial Sequence
  Synthetic Oligonucleotide; NDFIP1 exon 4; Set C
uccuauccucagcuggucagcaucauca

SEQ ID NO: 37090 - RNA, 33 nt, Artificial Sequence
  Synthetic Oligonucleotide; NDFIP1 exon 4; Set C
auuuccuauccucagcuggucagcaucaucaaa

SEQ ID NO: 37091 - RNA, 29 nt, Artificial Sequence
  Synthetic Oligonucleotide; NDFIP1 exon 4; Set C
uuccuauccucagcuggucagcaucauca

SEQ ID NO: 37092 - RNA, 32 nt, Artificial Sequence
  Synthetic Oligonucleotide; NDFIP1 exon 4; Set C
auuuccuauccucagcuggucagcaucaucaa

SEQ ID NO: 37093 - RNA, 28 nt, Artificial Sequence
  Synthetic Oligonucleotide; NDFIP1 exon 4; Set C
uuccuauccucagcuggucagcaucauc

SEQ ID NO: 37094 - RNA, 25 nt, Artificial Sequence
  Synthetic Oligonucleotide; NDFIP1 exon 4; Set C
uccuauccucagcuggucagcauca

SEQ ID NO: 37095 - RNA, 27 nt, Artificial Sequence
  Synthetic Oligonucleotide; NDFIP1 exon 4; Set C
uuccuauccucagcuggucagcaucau

SEQ ID NO: 37096 - RNA, 26 nt, Artificial Sequence
  Synthetic Oligonucleotide; NDFIP1 exon 4; Set C
uuccuauccucagcuggucagcauca

SEQ ID NO: 37097 - RNA, 25 nt, Artificial Sequence
  Synthetic Oligonucleotide; NDFIP1 exon 4; Set A
uuccuauccucagcuggucagcauc

SEQ ID NO: 37098 - RNA, 36 nt, Artificial Sequence
  Synthetic Oligonucleotide; NDFIP1 exon 4; Set C
ccaucauuuccuauccucagcuggucagcaucauca

SEQ ID NO: 37099 - RNA, 35 nt, Artificial Sequence
  Synthetic Oligonucleotide; NDFIP1 exon 4; Set C
ccaucauuuccuauccucagcuggucagcaucauc

SEQ ID NO: 37100 - RNA, 37 nt, Artificial Sequence
  Synthetic Oligonucleotide; NDFIP1 exon 4; Set C
cccaucauuuccuauccucagcuggucagcaucauca

SEQ ID NO: 37101 - RNA, 20 nt, Artificial Sequence
  Synthetic Oligonucleotide; NDFIP1 exon 4; Set A
uuccuauccucagcugguca

SEQ ID NO: 37102 - RNA, 38 nt, Artificial Sequence
  Synthetic Oligonucleotide; NDFIP1 exon 4; Set C
ucccaucauuuccuauccucagcuggucagcaucauca

SEQ ID NO: 37103 - RNA, 34 nt, Artificial Sequence
  Synthetic Oligonucleotide; NDFIP1 exon 4; Set C
ccaucauuuccuauccucagcuggucagcaucau

SEQ ID NO: 37104 - RNA, 36 nt, Artificial Sequence
  Synthetic Oligonucleotide; NDFIP1 exon 4; Set C
cccaucauuuccuauccucagcuggucagcaucauc

SEQ ID NO: 37105 - RNA, 33 nt, Artificial Sequence
  Synthetic Oligonucleotide; NDFIP1 exon 4; Set C
ccaucauuuccuauccucagcuggucagcauca

SEQ ID NO: 37106 - RNA, 19 nt, Artificial Sequence
  Synthetic Oligonucleotide; NDFIP1 exon 4; Set C
uuccuauccucagcugguc

SEQ ID NO: 37107 - RNA, 37 nt, Artificial Sequence
  Synthetic Oligonucleotide; NDFIP1 exon 4; Set C
ucccaucauuuccuauccucagcuggucagcaucauc

SEQ ID NO: 37108 - RNA, 35 nt, Artificial Sequence
  Synthetic Oligonucleotide; NDFIP1 exon 4; Set C
cccaucauuuccuauccucagcuggucagcaucau

SEQ ID NO: 37109 - RNA, 16 nt, Artificial Sequence
  Synthetic Oligonucleotide; NDFIP1 exon 4; Set C
uccuauccucagcugg

SEQ ID NO: 37110 - RNA, 34 nt, Artificial Sequence
  Synthetic Oligonucleotide; NDFIP1 exon 4; Set C
cccaucauuuccuauccucagcuggucagcauca

SEQ ID NO: 37111 - RNA, 32 nt, Artificial Sequence
  Synthetic Oligonucleotide; NDFIP1 exon 4; Set C
ccaucauuuccuauccucagcuggucagcauc

SEQ ID NO: 37112 - RNA, 18 nt, Artificial Sequence
  Synthetic Oligonucleotide; NDFIP1 exon 4; Set C
uuccuauccucagcuggu

SEQ ID NO: 37113 - RNA, 36 nt, Artificial Sequence
  Synthetic Oligonucleotide; NDFIP1 exon 4; Set C
ucccaucauuuccuauccucagcuggucagcaucau

SEQ ID NO: 37114 - RNA, 17 nt, Artificial Sequence
  Synthetic Oligonucleotide; NDFIP1 exon 4; Set C
uuccuauccucagcugg

SEQ ID NO: 37115 - RNA, 33 nt, Artificial Sequence
  Synthetic Oligonucleotide; NDFIP1 exon 4; Set C
cccaucauuuccuauccucagcuggucagcauc

SEQ ID NO: 37116 - RNA, 37 nt, Artificial Sequence
  Synthetic Oligonucleotide; NDFIP1 exon 4; Set C
aucccaucauuuccuauccucagcuggucagcaucau

SEQ ID NO: 37117 - RNA, 34 nt, Artificial Sequence
  Synthetic Oligonucleotide; NDFIP1 exon 4; Set C
ucccaucauuuccuauccucagcuggucagcauc

SEQ ID NO: 37118 - RNA, 40 nt, Artificial Sequence
  Synthetic Oligonucleotide; NDFIP1 exon 4; Set C
aaaaucccaucauuuccuauccucagcuggucagcaucau

SEQ ID NO: 37119 - RNA, 27 nt, Artificial Sequence
  Synthetic Oligonucleotide; NDFIP1 exon 4; Set C
ccaucauuuccuauccucagcugguca

SEQ ID NO: 37120 - RNA, 40 nt, Artificial Sequence
  Synthetic Oligonucleotide; NDFIP1 exon 4; Set C
gaaaaucccaucauuuccuauccucagcuggucagcauca

SEQ ID NO: 37121 - RNA, 38 nt, Artificial Sequence
  Synthetic Oligonucleotide; NDFIP1 exon 4; Set C
aaaaucccaucauuuccuauccucagcuggucagcauc

SEQ ID NO: 37122 - RNA, 26 nt, Artificial Sequence
  Synthetic Oligonucleotide; NDFIP1 exon 4; Set A
ccaucauuuccuauccucagcugguc

SEQ ID NO: 37123 - RNA, 28 nt, Artificial Sequence
  Synthetic Oligonucleotide; NDFIP1 exon 4; Set C
cccaucauuuccuauccucagcugguca

SEQ ID NO: 37124 - RNA, 39 nt, Artificial Sequence
  Synthetic Oligonucleotide; NDFIP1 exon 4; Set C
gaaaaucccaucauuuccuauccucagcuggucagcauc

SEQ ID NO: 37125 - RNA, 25 nt, Artificial Sequence
  Synthetic Oligonucleotide; NDFIP1 exon 4; Set A
ccaucauuuccuauccucagcuggu

SEQ ID NO: 37126 - RNA, 27 nt, Artificial Sequence
  Synthetic Oligonucleotide; NDFIP1 exon 4; Set C
cccaucauuuccuauccucagcugguc

SEQ ID NO: 37127 - RNA, 29 nt, Artificial Sequence
  Synthetic Oligonucleotide; NDFIP1 exon 4; Set C
ucccaucauuuccuauccucagcugguca

SEQ ID NO: 37128 - RNA, 40 nt, Artificial Sequence
  Synthetic Oligonucleotide; NDFIP1 exon 4; Set C
ugaaaaucccaucauuuccuauccucagcuggucagcauc

SEQ ID NO: 37129 - RNA, 26 nt, Artificial Sequence
  Synthetic Oligonucleotide; NDFIP1 exon 4; Set C
cccaucauuuccuauccucagcuggu

SEQ ID NO: 37130 - RNA, 28 nt, Artificial Sequence
  Synthetic Oligonucleotide; NDFIP1 exon 4; Set C
ucccaucauuuccuauccucagcugguc

SEQ ID NO: 37131 - RNA, 27 nt, Artificial Sequence
  Synthetic Oligonucleotide; NDFIP1 exon 4; Set C
ucccaucauuuccuauccucagcuggu

SEQ ID NO: 37132 - RNA, 29 nt, Artificial Sequence
  Synthetic Oligonucleotide; NDFIP1 exon 4; Set C
aucccaucauuuccuauccucagcugguc

SEQ ID NO: 37133 - RNA, 28 nt, Artificial Sequence
  Synthetic Oligonucleotide; NDFIP1 exon 4; Set C
aucccaucauuuccuauccucagcuggu

SEQ ID NO: 37134 - RNA, 33 nt, Artificial Sequence
  Synthetic Oligonucleotide; NDFIP1 exon 4; Set C
aaaaucccaucauuuccuauccucagcugguca

SEQ ID NO: 37135 - RNA, 32 nt, Artificial Sequence
  Synthetic Oligonucleotide; NDFIP1 exon 4; Set A
aaaaucccaucauuuccuauccucagcugguc

SEQ ID NO: 37136 - RNA, 34 nt, Artificial Sequence
  Synthetic Oligonucleotide; NDFIP1 exon 4; Set C
gaaaaucccaucauuuccuauccucagcugguca

SEQ ID NO: 37137 - RNA, 31 nt, Artificial Sequence
  Synthetic Oligonucleotide; NDFIP1 exon 4; Set A
aaaaucccaucauuuccuauccucagcuggu

SEQ ID NO: 37138 - RNA, 33 nt, Artificial Sequence
  Synthetic Oligonucleotide; NDFIP1 exon 4; Set C
gaaaaucccaucauuuccuauccucagcugguc

SEQ ID NO: 37139 - RNA, 35 nt, Artificial Sequence
  Synthetic Oligonucleotide; NDFIP1 exon 4; Set C
ugaaaaucccaucauuuccuauccucagcugguca

SEQ ID NO: 37140 - RNA, 32 nt, Artificial Sequence
  Synthetic Oligonucleotide; NDFIP1 exon 4; Set A
gaaaaucccaucauuuccuauccucagcuggu

SEQ ID NO: 37141 - RNA, 34 nt, Artificial Sequence
  Synthetic Oligonucleotide; NDFIP1 exon 4; Set C
ugaaaaucccaucauuuccuauccucagcugguc

SEQ ID NO: 37142 - RNA, 36 nt, Artificial Sequence
  Synthetic Oligonucleotide; NDFIP1 exon 4; Set C
augaaaaucccaucauuuccuauccucagcugguca

SEQ ID NO: 37143 - RNA, 33 nt, Artificial Sequence
  Synthetic Oligonucleotide; NDFIP1 exon 4; Set C
ugaaaaucccaucauuuccuauccucagcuggu

SEQ ID NO: 37144 - RNA, 35 nt, Artificial Sequence
  Synthetic Oligonucleotide; NDFIP1 exon 4; Set C
augaaaaucccaucauuuccuauccucagcugguc

SEQ ID NO: 37145 - RNA, 37 nt, Artificial Sequence
  Synthetic Oligonucleotide; NDFIP1 exon 4; Set C
caugaaaaucccaucauuuccuauccucagcugguca

SEQ ID NO: 37146 - RNA, 34 nt, Artificial Sequence
  Synthetic Oligonucleotide; NDFIP1 exon 4; Set A
augaaaaucccaucauuuccuauccucagcuggu

SEQ ID NO: 37147 - RNA, 36 nt, Artificial Sequence
  Synthetic Oligonucleotide; NDFIP1 exon 4; Set C
caugaaaaucccaucauuuccuauccucagcugguc

SEQ ID NO: 37148 - RNA, 38 nt, Artificial Sequence
  Synthetic Oligonucleotide; NDFIP1 exon 4; Set C
acaugaaaaucccaucauuuccuauccucagcugguca

SEQ ID NO: 37149 - RNA, 35 nt, Artificial Sequence
  Synthetic Oligonucleotide; NDFIP1 exon 4; Set C
caugaaaaucccaucauuuccuauccucagcuggu

SEQ ID NO: 37150 - RNA, 37 nt, Artificial Sequence
  Synthetic Oligonucleotide; NDFIP1 exon 4; Set C
acaugaaaaucccaucauuuccuauccucagcugguc

SEQ ID NO: 37151 - RNA, 36 nt, Artificial Sequence
  Synthetic Oligonucleotide; NDFIP1 exon 4; Set C
acaugaaaaucccaucauuuccuauccucagcuggu

SEQ ID NO: 37152 - RNA, 40 nt, Artificial Sequence
  Synthetic Oligonucleotide; NDFIP1 exon 4; Set C
aguuaacaugaaaaucccaucauuuccuauccucagcugg

SEQ ID NO: 37153 - RNA, 28 nt, Artificial Sequence
  Synthetic Oligonucleotide; NDFIP1 exon 4; Set C
aacaugaaaaucccaucauuuccuaucc

SEQ ID NO: 37154 - RNA, 15 nt, Artificial Sequence
  Synthetic Oligonucleotide; NDFIP1 exon 4; Set C
aaaaucccaucauuu

SEQ ID NO: 37155 - RNA, 29 nt, Artificial Sequence
  Synthetic Oligonucleotide; NDFIP1 exon 4; Set C
uaacaugaaaaucccaucauuuccuaucc

SEQ ID NO: 37156 - RNA, 27 nt, Artificial Sequence
  Synthetic Oligonucleotide; NDFIP1 exon 4; Set C
aacaugaaaaucccaucauuuccuauc

SEQ ID NO: 37157 - RNA, 16 nt, Artificial Sequence
  Synthetic Oligonucleotide; NDFIP1 exon 4; Set C
gaaaaucccaucauuu

SEQ ID NO: 37158 - RNA, 30 nt, Artificial Sequence
  Synthetic Oligonucleotide; NDFIP1 exon 4; Set C
uuaacaugaaaaucccaucauuuccuaucc

SEQ ID NO: 37159 - RNA, 28 nt, Artificial Sequence
  Synthetic Oligonucleotide; NDFIP1 exon 4; Set C
uaacaugaaaaucccaucauuuccuauc

SEQ ID NO: 37160 - RNA, 15 nt, Artificial Sequence
  Synthetic Oligonucleotide; NDFIP1 exon 4; Set C
gaaaaucccaucauu

SEQ ID NO: 37161 - RNA, 17 nt, Artificial Sequence
  Synthetic Oligonucleotide; NDFIP1 exon 4; Set C
ugaaaaucccaucauuu

SEQ ID NO: 37162 - RNA, 29 nt, Artificial Sequence
  Synthetic Oligonucleotide; NDFIP1 exon 4; Set C
uuaacaugaaaaucccaucauuuccuauc

SEQ ID NO: 37163 - RNA, 16 nt, Artificial Sequence
  Synthetic Oligonucleotide; NDFIP1 exon 4; Set C
ugaaaaucccaucauu

SEQ ID NO: 37164 - RNA, 18 nt, Artificial Sequence
  Synthetic Oligonucleotide; NDFIP1 exon 4; Set C
augaaaaucccaucauuu

SEQ ID NO: 37165 - RNA, 17 nt, Artificial Sequence
  Synthetic Oligonucleotide; NDFIP1 exon 4; Set C
augaaaaucccaucauu

SEQ ID NO: 37166 - RNA, 19 nt, Artificial Sequence
  Synthetic Oligonucleotide; NDFIP1 exon 4; Set C
caugaaaaucccaucauuu

SEQ ID NO: 37167 - RNA, 18 nt, Artificial Sequence
  Synthetic Oligonucleotide; NDFIP1 exon 4; Set C
caugaaaaucccaucauu

SEQ ID NO: 37168 - RNA, 20 nt, Artificial Sequence
  Synthetic Oligonucleotide; NDFIP1 exon 4; Set C
acaugaaaaucccaucauuu

SEQ ID NO: 37169 - RNA, 29 nt, Artificial Sequence
  Synthetic Oligonucleotide; NDFIP1 exon 4; Set C
aguuaacaugaaaaucccaucauuuccua

SEQ ID NO: 37170 - RNA, 19 nt, Artificial Sequence
  Synthetic Oligonucleotide; NDFIP1 exon 4; Set C
acaugaaaaucccaucauu

SEQ ID NO: 37171 - RNA, 35 nt, Artificial Sequence
  Synthetic Oligonucleotide; NDFIP1 exon 4; Set C
aaaaguuaacaugaaaaucccaucauuuccuaucc

SEQ ID NO: 37172 - RNA, 30 nt, Artificial Sequence
  Synthetic Oligonucleotide; NDFIP1 exon 4; Set C
aaguuaacaugaaaaucccaucauuuccua

SEQ ID NO: 37173 - RNA, 28 nt, Artificial Sequence
  Synthetic Oligonucleotide; NDFIP1 exon 4; Set C
aguuaacaugaaaaucccaucauuuccu

SEQ ID NO: 37174 - RNA, 36 nt, Artificial Sequence
  Synthetic Oligonucleotide; NDFIP1 exon 4; Set C
aaaaaguuaacaugaaaaucccaucauuuccuaucc

SEQ ID NO: 37175 - RNA, 34 nt, Artificial Sequence
  Synthetic Oligonucleotide; NDFIP1 exon 4; Set C
aaaaguuaacaugaaaaucccaucauuuccuauc

SEQ ID NO: 37176 - RNA, 27 nt, Artificial Sequence
  Synthetic Oligonucleotide; NDFIP1 exon 4; Set C
aguuaacaugaaaaucccaucauuucc

SEQ ID NO: 37177 - RNA, 31 nt, Artificial Sequence
  Synthetic Oligonucleotide; NDFIP1 exon 4; Set C
aaaguuaacaugaaaaucccaucauuuccua

SEQ ID NO: 37178 - RNA, 29 nt, Artificial Sequence
  Synthetic Oligonucleotide; NDFIP1 exon 4; Set C
aaguuaacaugaaaaucccaucauuuccu

SEQ ID NO: 37179 - RNA, 35 nt, Artificial Sequence
  Synthetic Oligonucleotide; NDFIP1 exon 4; Set C
aaaaaguuaacaugaaaaucccaucauuuccuauc

SEQ ID NO: 37180 - RNA, 28 nt, Artificial Sequence
  Synthetic Oligonucleotide; NDFIP1 exon 4; Set C
aaguuaacaugaaaaucccaucauuucc

SEQ ID NO: 37181 - RNA, 30 nt, Artificial Sequence
  Synthetic Oligonucleotide; NDFIP1 exon 4; Set C
aaaguuaacaugaaaaucccaucauuuccu

SEQ ID NO: 37182 - RNA, 29 nt, Artificial Sequence
  Synthetic Oligonucleotide; NDFIP1 exon 4; Set C
aaaguuaacaugaaaaucccaucauuucc

SEQ ID NO: 37183 - RNA, 40 nt, Artificial Sequence
  Synthetic Oligonucleotide; NDFIP1 exon 4; Set C
cauacuuacugaaaaaaguuaacaugaaaaucccaucauu

SEQ ID NO: 37184 - RNA, 19 nt, Artificial Sequence
  Synthetic Oligonucleotide; NDFIP1 exon 4; Set C
cauacuuacugaaaaaagu

SEQ ID NO: 37185 - RNA, 20 nt, Artificial Sequence
  Synthetic Oligonucleotide; NDFIP1 exon 4; Set C
acauacuuacugaaaaaagu

SEQ ID NO: 37186 - RNA, 18 nt, Artificial Sequence
  Synthetic Oligonucleotide; NDFIP1 exon 4; Set C
cauacuuacugaaaaaag

SEQ ID NO: 37187 - RNA, 17 nt, Artificial Sequence
  Synthetic Oligonucleotide; NDFIP1 exon 4; Set C
cauacuuacugaaaaaa

SEQ ID NO: 37188 - RNA, 21 nt, Artificial Sequence
  Synthetic Oligonucleotide; NDFIP1 exon 4; Set C
uacauacuuacugaaaaaagu

SEQ ID NO: 37189 - RNA, 19 nt, Artificial Sequence
  Synthetic Oligonucleotide; NDFIP1 exon 4; Set C
acauacuuacugaaaaaag

SEQ ID NO: 37190 - RNA, 18 nt, Artificial Sequence
  Synthetic Oligonucleotide; NDFIP1 exon 4; Set C
acauacuuacugaaaaaa

SEQ ID NO: 37191 - RNA, 22 nt, Artificial Sequence
  Synthetic Oligonucleotide; NDFIP1 exon 4; Set C
auacauacuuacugaaaaaagu

SEQ ID NO: 37192 - RNA, 20 nt, Artificial Sequence
  Synthetic Oligonucleotide; NDFIP1 exon 4; Set C
uacauacuuacugaaaaaag

SEQ ID NO: 37193 - RNA, 19 nt, Artificial Sequence
  Synthetic Oligonucleotide; NDFIP1 exon 4; Set C
uacauacuuacugaaaaaa

SEQ ID NO: 37194 - RNA, 21 nt, Artificial Sequence
  Synthetic Oligonucleotide; NDFIP1 exon 4; Set C
auacauacuuacugaaaaaag

SEQ ID NO: 37195 - RNA, 23 nt, Artificial Sequence
  Synthetic Oligonucleotide; NDFIP1 exon 4; Set C
cauacauacuuacugaaaaaagu

SEQ ID NO: 37196 - RNA, 20 nt, Artificial Sequence
  Synthetic Oligonucleotide; NDFIP1 exon 4; Set C
auacauacuuacugaaaaaa

SEQ ID NO: 37197 - RNA, 22 nt, Artificial Sequence
  Synthetic Oligonucleotide; NDFIP1 exon 4; Set C
cauacauacuuacugaaaaaag

SEQ ID NO: 37198 - RNA, 21 nt, Artificial Sequence
  Synthetic Oligonucleotide; NDFIP1 exon 4; Set C
cauacauacuuacugaaaaaa

SEQ ID NO: 37199 - RNA, 39 nt, Artificial Sequence
  Synthetic Oligonucleotide; NDFIP1 exon 4; Set C
agggggugguucugauaugcauacauacuuacugaaaaa

SEQ ID NO: 37200 - RNA, 40 nt, Artificial Sequence
  Synthetic Oligonucleotide; NDFIP1 exon 4; Set C
uagggggugguucugauaugcauacauacuuacugaaaaa

SEQ ID NO: 37201 - RNA, 38 nt, Artificial Sequence
  Synthetic Oligonucleotide; NDFIP1 exon 4; Set C
agggggugguucugauaugcauacauacuuacugaaaa

SEQ ID NO: 37202 - RNA, 39 nt, Artificial Sequence
  Synthetic Oligonucleotide; NDFIP1 exon 4; Set C
uagggggugguucugauaugcauacauacuuacugaaaa

SEQ ID NO: 37203 - RNA, 26 nt, Artificial Sequence
  Synthetic Oligonucleotide; NDFIP1 exon 4; Set B
agggggugguucugauaugcauacau

SEQ ID NO: 37204 - RNA, 25 nt, Artificial Sequence
  Synthetic Oligonucleotide; NDFIP1 exon 4; Set B
agggggugguucugauaugcauaca

SEQ ID NO: 37205 - RNA, 27 nt, Artificial Sequence
  Synthetic Oligonucleotide; NDFIP1 exon 4; Set B
uagggggugguucugauaugcauacau

SEQ ID NO: 37206 - RNA, 26 nt, Artificial Sequence
  Synthetic Oligonucleotide; NDFIP1 exon 4; Set B
uagggggugguucugauaugcauaca

SEQ ID NO: 37207 - RNA, 24 nt, Artificial Sequence
  Synthetic Oligonucleotide; NDFIP1 exon 4; Set B
agggggugguucugauaugcauac

SEQ ID NO: 37208 - RNA, 28 nt, Artificial Sequence
  Synthetic Oligonucleotide; NDFIP1 exon 4; Set C
guagggggugguucugauaugcauacau

SEQ ID NO: 37209 - RNA, 23 nt, Artificial Sequence
  Synthetic Oligonucleotide; NDFIP1 exon 4; Set B
agggggugguucugauaugcaua

SEQ ID NO: 37210 - RNA, 27 nt, Artificial Sequence
  Synthetic Oligonucleotide; NDFIP1 exon 4; Set C
guagggggugguucugauaugcauaca

SEQ ID NO: 37211 - RNA, 25 nt, Artificial Sequence
  Synthetic Oligonucleotide; NDFIP1 exon 4; Set B
uagggggugguucugauaugcauac

SEQ ID NO: 37212 - RNA, 24 nt, Artificial Sequence
  Synthetic Oligonucleotide; NDFIP1 exon 4; Set B
uagggggugguucugauaugcaua

SEQ ID NO: 37213 - RNA, 28 nt, Artificial Sequence
  Synthetic Oligonucleotide; NDFIP1 exon 4; Set C
uguagggggugguucugauaugcauaca

SEQ ID NO: 37214 - RNA, 26 nt, Artificial Sequence
  Synthetic Oligonucleotide; NDFIP1 exon 4; Set B
guagggggugguucugauaugcauac

SEQ ID NO: 37215 - RNA, 25 nt, Artificial Sequence
  Synthetic Oligonucleotide; NDFIP1 exon 4; Set B
guagggggugguucugauaugcaua

SEQ ID NO: 37216 - RNA, 27 nt, Artificial Sequence
  Synthetic Oligonucleotide; NDFIP1 exon 4; Set B
uguagggggugguucugauaugcauac

SEQ ID NO: 37217 - RNA, 24 nt, Artificial Sequence
  Synthetic Oligonucleotide; NDFIP1 exon 4; Set B
guagggggugguucugauaugcau

SEQ ID NO: 37218 - RNA, 28 nt, Artificial Sequence
  Synthetic Oligonucleotide; NDFIP1 exon 4; Set B
uuguagggggugguucugauaugcauac

SEQ ID NO: 37219 - RNA, 25 nt, Artificial Sequence
  Synthetic Oligonucleotide; NDFIP1 exon 4; Set B
uguagggggugguucugauaugcau

SEQ ID NO: 37220 - RNA, 26 nt, Artificial Sequence
  Synthetic Oligonucleotide; NDFIP1 exon 4; Set B
uuguagggggugguucugauaugcau

SEQ ID NO: 37221 - RNA, 27 nt, Artificial Sequence
  Synthetic Oligonucleotide; NDFIP1 exon 4; Set B
uuuguagggggugguucugauaugcau

SEQ ID NO: 37222 - RNA, 39 nt, Artificial Sequence
  Synthetic Oligonucleotide; NDFIP1 exon 4; Set C
cacucuaguuuguagggggugguucugauaugcauacau

SEQ ID NO: 37223 - RNA, 38 nt, Artificial Sequence
  Synthetic Oligonucleotide; NDFIP1 exon 4; Set C
cacucuaguuuguagggggugguucugauaugcauaca

SEQ ID NO: 37224 - RNA, 40 nt, Artificial Sequence
  Synthetic Oligonucleotide; NDFIP1 exon 4; Set C
gcacucuaguuuguagggggugguucugauaugcauacau

SEQ ID NO: 37225 - RNA, 39 nt, Artificial Sequence
  Synthetic Oligonucleotide; NDFIP1 exon 4; Set C
gcacucuaguuuguagggggugguucugauaugcauaca

SEQ ID NO: 37226 - RNA, 37 nt, Artificial Sequence
  Synthetic Oligonucleotide; NDFIP1 exon 4; Set C
cacucuaguuuguagggggugguucugauaugcauac

SEQ ID NO: 37227 - RNA, 36 nt, Artificial Sequence
  Synthetic Oligonucleotide; NDFIP1 exon 4; Set C
cacucuaguuuguagggggugguucugauaugcaua

SEQ ID NO: 37228 - RNA, 38 nt, Artificial Sequence
  Synthetic Oligonucleotide; NDFIP1 exon 4; Set C
gcacucuaguuuguagggggugguucugauaugcauac

SEQ ID NO: 37229 - RNA, 37 nt, Artificial Sequence
  Synthetic Oligonucleotide; NDFIP1 exon 4; Set C
gcacucuaguuuguagggggugguucugauaugcaua

SEQ ID NO: 37230 - RNA, 35 nt, Artificial Sequence
  Synthetic Oligonucleotide; NDFIP1 exon 4; Set C
cacucuaguuuguagggggugguucugauaugcau

SEQ ID NO: 37231 - RNA, 36 nt, Artificial Sequence
  Synthetic Oligonucleotide; NDFIP1 exon 4; Set C
gcacucuaguuuguagggggugguucugauaugcau

SEQ ID NO: 37232 - RNA, 16 nt, Artificial Sequence
  Synthetic Oligonucleotide; NDFIP1 exon 4; Set C
cacucuaguuuguagg

SEQ ID NO: 37233 - RNA, 15 nt, Artificial Sequence
  Synthetic Oligonucleotide; NDFIP1 exon 4; Set C
cacucuaguuuguag

SEQ ID NO: 37234 - RNA, 17 nt, Artificial Sequence
  Synthetic Oligonucleotide; NDFIP1 exon 4; Set C
gcacucuaguuuguagg

SEQ ID NO: 37235 - RNA, 16 nt, Artificial Sequence
  Synthetic Oligonucleotide; NDFIP1 exon 4; Set C
gcacucuaguuuguag

SEQ ID NO: 37236 - RNA, 20 nt, Artificial Sequence
  Synthetic Oligonucleotide; NDFIP1 exon 4; Set C
aaagcacucuaguuuguagg

SEQ ID NO: 37237 - RNA, 19 nt, Artificial Sequence
  Synthetic Oligonucleotide; NDFIP1 exon 4; Set C
aaagcacucuaguuuguag

SEQ ID NO: 37238 - RNA, 18 nt, Artificial Sequence
  Synthetic Oligonucleotide; NDFIP1 exon 4; Set C
aaagcacucuaguuugua

SEQ ID NO: 37239 - RNA, 17 nt, Artificial Sequence
  Synthetic Oligonucleotide; NDFIP1 exon 4; Set C
aaagcacucuaguuugu

SEQ ID NO: 37240 - RNA, 16 nt, Artificial Sequence
  Synthetic Oligonucleotide; NDFIP1 exon 4; Set C
aaagcacucuaguuug

SEQ ID NO: 37241 - RNA, 15 nt, Artificial Sequence
  Synthetic Oligonucleotide; NDFIP1 exon 4; Set C
aaagcacucuaguuu

SEQ ID NO: 37242 - RNA, 30 nt, Artificial Sequence
  Synthetic Oligonucleotide; NDFIP1 exon 4; Set C
uuauuucuaggcaaagggaagacauaaaga

SEQ ID NO: 37243 - RNA, 31 nt, Artificial Sequence
  Synthetic Oligonucleotide; NDFIP1 exon 4; Set C
auuauuucuaggcaaagggaagacauaaaga

SEQ ID NO: 37244 - RNA, 30 nt, Artificial Sequence
  Synthetic Oligonucleotide; NDFIP1 exon 4; Set C
auuauuucuaggcaaagggaagacauaaag

SEQ ID NO: 37245 - RNA, 32 nt, Artificial Sequence
  Synthetic Oligonucleotide; NDFIP1 exon 4; Set C
aauuauuucuaggcaaagggaagacauaaaga

SEQ ID NO: 37246 - RNA, 27 nt, Artificial Sequence
  Synthetic Oligonucleotide; NDFIP1 exon 4; Set C
uuauuucuaggcaaagggaagacauaa

SEQ ID NO: 37247 - RNA, 29 nt, Artificial Sequence
  Synthetic Oligonucleotide; NDFIP1 exon 4; Set C
auuauuucuaggcaaagggaagacauaaa

SEQ ID NO: 37248 - RNA, 31 nt, Artificial Sequence
  Synthetic Oligonucleotide; NDFIP1 exon 4; Set C
aauuauuucuaggcaaagggaagacauaaag

SEQ ID NO: 37249 - RNA, 33 nt, Artificial Sequence
  Synthetic Oligonucleotide; NDFIP1 exon 4; Set C
gaauuauuucuaggcaaagggaagacauaaaga

SEQ ID NO: 37250 - RNA, 28 nt, Artificial Sequence
  Synthetic Oligonucleotide; NDFIP1 exon 4; Set C
auuauuucuaggcaaagggaagacauaa

SEQ ID NO: 37251 - RNA, 30 nt, Artificial Sequence
  Synthetic Oligonucleotide; NDFIP1 exon 4; Set C
aauuauuucuaggcaaagggaagacauaaa

SEQ ID NO: 37252 - RNA, 32 nt, Artificial Sequence
  Synthetic Oligonucleotide; NDFIP1 exon 4; Set C
gaauuauuucuaggcaaagggaagacauaaag

SEQ ID NO: 37253 - RNA, 34 nt, Artificial Sequence
  Synthetic Oligonucleotide; NDFIP1 exon 4; Set A
agaauuauuucuaggcaaagggaagacauaaaga

SEQ ID NO: 37254 - RNA, 29 nt, Artificial Sequence
  Synthetic Oligonucleotide; NDFIP1 exon 4; Set C
aauuauuucuaggcaaagggaagacauaa

SEQ ID NO: 37255 - RNA, 27 nt, Artificial Sequence
  Synthetic Oligonucleotide; NDFIP1 exon 4; Set C
auuauuucuaggcaaagggaagacaua

SEQ ID NO: 37256 - RNA, 31 nt, Artificial Sequence
  Synthetic Oligonucleotide; NDFIP1 exon 4; Set C
gaauuauuucuaggcaaagggaagacauaaa

SEQ ID NO: 37257 - RNA, 33 nt, Artificial Sequence
  Synthetic Oligonucleotide; NDFIP1 exon 4; Set C
agaauuauuucuaggcaaagggaagacauaaag

SEQ ID NO: 37258 - RNA, 35 nt, Artificial Sequence
  Synthetic Oligonucleotide; NDFIP1 exon 4; Set C
aagaauuauuucuaggcaaagggaagacauaaaga

SEQ ID NO: 37259 - RNA, 30 nt, Artificial Sequence
  Synthetic Oligonucleotide; NDFIP1 exon 4; Set C
gaauuauuucuaggcaaagggaagacauaa

SEQ ID NO: 37260 - RNA, 28 nt, Artificial Sequence
  Synthetic Oligonucleotide; NDFIP1 exon 4; Set C
aauuauuucuaggcaaagggaagacaua

SEQ ID NO: 37261 - RNA, 32 nt, Artificial Sequence
  Synthetic Oligonucleotide; NDFIP1 exon 4; Set C
agaauuauuucuaggcaaagggaagacauaaa

SEQ ID NO: 37262 - RNA, 34 nt, Artificial Sequence
  Synthetic Oligonucleotide; NDFIP1 exon 4; Set C
aagaauuauuucuaggcaaagggaagacauaaag

SEQ ID NO: 37263 - RNA, 36 nt, Artificial Sequence
  Synthetic Oligonucleotide; NDFIP1 exon 4; Set C
aaagaauuauuucuaggcaaagggaagacauaaaga

SEQ ID NO: 37264 - RNA, 31 nt, Artificial Sequence
  Synthetic Oligonucleotide; NDFIP1 exon 4; Set C
agaauuauuucuaggcaaagggaagacauaa

SEQ ID NO: 37265 - RNA, 29 nt, Artificial Sequence
  Synthetic Oligonucleotide; NDFIP1 exon 4; Set C
gaauuauuucuaggcaaagggaagacaua

SEQ ID NO: 37266 - RNA, 33 nt, Artificial Sequence
  Synthetic Oligonucleotide; NDFIP1 exon 4; Set C
aagaauuauuucuaggcaaagggaagacauaaa

SEQ ID NO: 37267 - RNA, 35 nt, Artificial Sequence
  Synthetic Oligonucleotide; NDFIP1 exon 4; Set C
aaagaauuauuucuaggcaaagggaagacauaaag

SEQ ID NO: 37268 - RNA, 32 nt, Artificial Sequence
  Synthetic Oligonucleotide; NDFIP1 exon 4; Set C
aagaauuauuucuaggcaaagggaagacauaa

SEQ ID NO: 37269 - RNA, 30 nt, Artificial Sequence
  Synthetic Oligonucleotide; NDFIP1 exon 4; Set C
agaauuauuucuaggcaaagggaagacaua

SEQ ID NO: 37270 - RNA, 34 nt, Artificial Sequence
  Synthetic Oligonucleotide; NDFIP1 exon 4; Set C
aaagaauuauuucuaggcaaagggaagacauaaa

SEQ ID NO: 37271 - RNA, 33 nt, Artificial Sequence
  Synthetic Oligonucleotide; NDFIP1 exon 4; Set C
aaagaauuauuucuaggcaaagggaagacauaa

SEQ ID NO: 37272 - RNA, 31 nt, Artificial Sequence
  Synthetic Oligonucleotide; NDFIP1 exon 4; Set C
aagaauuauuucuaggcaaagggaagacaua

SEQ ID NO: 37273 - RNA, 32 nt, Artificial Sequence
  Synthetic Oligonucleotide; NDFIP1 exon 4; Set C
aaagaauuauuucuaggcaaagggaagacaua

SEQ ID NO: 37274 - RNA, 16 nt, Artificial Sequence
  Synthetic Oligonucleotide; NDFIP1 exon 4; Set C
uuauuucuaggcaaag

SEQ ID NO: 37275 - RNA, 15 nt, Artificial Sequence
  Synthetic Oligonucleotide; NDFIP1 exon 4; Set C
uuauuucuaggcaaa

SEQ ID NO: 37276 - RNA, 17 nt, Artificial Sequence
  Synthetic Oligonucleotide; NDFIP1 exon 4; Set C
auuauuucuaggcaaag

SEQ ID NO: 37277 - RNA, 16 nt, Artificial Sequence
  Synthetic Oligonucleotide; NDFIP1 exon 4; Set C
auuauuucuaggcaaa

SEQ ID NO: 37278 - RNA, 18 nt, Artificial Sequence
  Synthetic Oligonucleotide; NDFIP1 exon 4; Set C
aauuauuucuaggcaaag

SEQ ID NO: 37279 - RNA, 17 nt, Artificial Sequence
  Synthetic Oligonucleotide; NDFIP1 exon 4; Set C
aauuauuucuaggcaaa

SEQ ID NO: 37280 - RNA, 19 nt, Artificial Sequence
  Synthetic Oligonucleotide; NDFIP1 exon 4; Set C
gaauuauuucuaggcaaag

SEQ ID NO: 37281 - RNA, 18 nt, Artificial Sequence
  Synthetic Oligonucleotide; NDFIP1 exon 4; Set C
gaauuauuucuaggcaaa

SEQ ID NO: 37282 - RNA, 20 nt, Artificial Sequence
  Synthetic Oligonucleotide; NDFIP1 exon 4; Set C
agaauuauuucuaggcaaag

SEQ ID NO: 37283 - RNA, 38 nt, Artificial Sequence
  Synthetic Oligonucleotide; NDFIP1 exon 4; Set C
aaaagaaaaagaauuauuucuaggcaaagggaagacau

SEQ ID NO: 37284 - RNA, 19 nt, Artificial Sequence
  Synthetic Oligonucleotide; NDFIP1 exon 4; Set C
agaauuauuucuaggcaaa

SEQ ID NO: 37285 - RNA, 39 nt, Artificial Sequence
  Synthetic Oligonucleotide; NDFIP1 exon 4; Set C
gaaaagaaaaagaauuauuucuaggcaaagggaagacau

SEQ ID NO: 37286 - RNA, 40 nt, Artificial Sequence
  Synthetic Oligonucleotide; NDFIP1 exon 4; Set C
ugaaaagaaaaagaauuauuucuaggcaaagggaagacau

SEQ ID NO: 37287 - RNA, 16 nt, Artificial Sequence
  Synthetic Oligonucleotide; NDFIP1 exon 4; Set C
aaaagaaaaagaauua

SEQ ID NO: 37288 - RNA, 15 nt, Artificial Sequence
  Synthetic Oligonucleotide; NDFIP1 exon 4; Set C
aaaagaaaaagaauu

SEQ ID NO: 37289 - RNA, 17 nt, Artificial Sequence
  Synthetic Oligonucleotide; NDFIP1 exon 4; Set C
gaaaagaaaaagaauua

SEQ ID NO: 37290 - RNA, 16 nt, Artificial Sequence
  Synthetic Oligonucleotide; NDFIP1 exon 4; Set C
gaaaagaaaaagaauu

SEQ ID NO: 37291 - RNA, 18 nt, Artificial Sequence
  Synthetic Oligonucleotide; NDFIP1 exon 4; Set C
ugaaaagaaaaagaauua

SEQ ID NO: 37292 - RNA, 17 nt, Artificial Sequence
  Synthetic Oligonucleotide; NDFIP1 exon 4; Set C
ugaaaagaaaaagaauu

SEQ ID NO: 37293 - RNA, 15 nt, Artificial Sequence
  Synthetic Oligonucleotide; NDFIP1 exon 4; Set C
gaaaagaaaaagaau

SEQ ID NO: 37294 - RNA, 16 nt, Artificial Sequence
  Synthetic Oligonucleotide; NDFIP1 exon 4; Set C
ugaaaagaaaaagaau

SEQ ID NO: 37295 - RNA, 18 nt, Artificial Sequence
  Synthetic Oligonucleotide; NDFIP1 exon 4; Set C
augaaaagaaaaagaauu

SEQ ID NO: 37296 - RNA, 15 nt, Artificial Sequence
  Synthetic Oligonucleotide; NDFIP1 exon 4; Set C
ugaaaagaaaaagaa

SEQ ID NO: 37297 - RNA, 17 nt, Artificial Sequence
  Synthetic Oligonucleotide; NDFIP1 exon 4; Set C
augaaaagaaaaagaau

SEQ ID NO: 37298 - RNA, 18 nt, Artificial Sequence
  Synthetic Oligonucleotide; NDFIP1 exon 4; Set C
aaugaaaagaaaaagaau

SEQ ID NO: 37299 - RNA, 16 nt, Artificial Sequence
  Synthetic Oligonucleotide; NDFIP1 exon 4; Set C
augaaaagaaaaagaa

SEQ ID NO: 37300 - RNA, 17 nt, Artificial Sequence
  Synthetic Oligonucleotide; NDFIP1 exon 4; Set C
aaugaaaagaaaaagaa

SEQ ID NO: 37301 - RNA, 15 nt, Artificial Sequence
  Synthetic Oligonucleotide; NDFIP1 exon 4; Set C
augaaaagaaaaaga

SEQ ID NO: 37302 - RNA, 16 nt, Artificial Sequence
  Synthetic Oligonucleotide; NDFIP1 exon 4; Set C
aaugaaaagaaaaaga

SEQ ID NO: 37303 - RNA, 15 nt, Artificial Sequence
  Synthetic Oligonucleotide; NDFIP1 exon 4; Set C
aaugaaaagaaaaag

SEQ ID NO: 37304 - RNA, 40 nt, Artificial Sequence
  Synthetic Oligonucleotide; NDFIP1 exon 4; Set A
aaaaucaucccgacccacaaaauccucauccuaaaugaaa

SEQ ID NO: 37305 - RNA, 39 nt, Artificial Sequence
  Synthetic Oligonucleotide; NDFIP1 exon 4; Set A
aaaaucaucccgacccacaaaauccucauccuaaaugaa

SEQ ID NO: 37306 - RNA, 38 nt, Artificial Sequence
  Synthetic Oligonucleotide; NDFIP1 exon 4; Set A
aaaaucaucccgacccacaaaauccucauccuaaauga

SEQ ID NO: 37307 - RNA, 40 nt, Artificial Sequence
  Synthetic Oligonucleotide; NDFIP1 exon 4; Set A
caaaaucaucccgacccacaaaauccucauccuaaaugaa

SEQ ID NO: 37308 - RNA, 39 nt, Artificial Sequence
  Synthetic Oligonucleotide; NDFIP1 exon 4; Set A
caaaaucaucccgacccacaaaauccucauccuaaauga

SEQ ID NO: 37309 - RNA, 37 nt, Artificial Sequence
  Synthetic Oligonucleotide; NDFIP1 exon 4; Set A
aaaaucaucccgacccacaaaauccucauccuaaaug

SEQ ID NO: 37310 - RNA, 36 nt, Artificial Sequence
  Synthetic Oligonucleotide; NDFIP1 exon 4; Set A
aaaaucaucccgacccacaaaauccucauccuaaau

SEQ ID NO: 37311 - RNA, 26 nt, Artificial Sequence
  Synthetic Oligonucleotide; NDFIP1 exon 4; Set C
cuauccucagcuggucagcaucauca

SEQ ID NO: 37312 - RNA, 25 nt, Artificial Sequence
  Synthetic Oligonucleotide; NDFIP1 exon 4; Set A
cuauccucagcuggucagcaucauc

SEQ ID NO: 37313 - RNA, 27 nt, Artificial Sequence
  Synthetic Oligonucleotide; NDFIP1 exon 4; Set C
ccuauccucagcuggucagcaucauca

SEQ ID NO: 37314 - RNA, 24 nt, Artificial Sequence
  Synthetic Oligonucleotide; NDFIP1 exon 4; Set A
cuauccucagcuggucagcaucau

SEQ ID NO: 37315 - RNA, 26 nt, Artificial Sequence
  Synthetic Oligonucleotide; NDFIP1 exon 4; Set C
ccuauccucagcuggucagcaucauc

SEQ ID NO: 37316 - RNA, 31 nt, Artificial Sequence
  Synthetic Oligonucleotide; NDFIP1 exon 4; Set C
uuuccuauccucagcuggucagcaucaucaa

SEQ ID NO: 37317 - RNA, 23 nt, Artificial Sequence
  Synthetic Oligonucleotide; NDFIP1 exon 4; Set A
cuauccucagcuggucagcauca

SEQ ID NO: 37318 - RNA, 27 nt, Artificial Sequence
  Synthetic Oligonucleotide; NDFIP1 exon 4; Set C
uccuauccucagcuggucagcaucauc

SEQ ID NO: 37319 - RNA, 25 nt, Artificial Sequence
  Synthetic Oligonucleotide; NDFIP1 exon 4; Set C
ccuauccucagcuggucagcaucau

SEQ ID NO: 37320 - RNA, 24 nt, Artificial Sequence
  Synthetic Oligonucleotide; NDFIP1 exon 4; Set C
ccuauccucagcuggucagcauca

SEQ ID NO: 37321 - RNA, 22 nt, Artificial Sequence
  Synthetic Oligonucleotide; NDFIP1 exon 4; Set A
cuauccucagcuggucagcauc

SEQ ID NO: 37322 - RNA, 26 nt, Artificial Sequence
  Synthetic Oligonucleotide; NDFIP1 exon 4; Set C
uccuauccucagcuggucagcaucau

SEQ ID NO: 37323 - RNA, 23 nt, Artificial Sequence
  Synthetic Oligonucleotide; NDFIP1 exon 4; Set A
ccuauccucagcuggucagcauc

SEQ ID NO: 37324 - RNA, 31 nt, Artificial Sequence
  Synthetic Oligonucleotide; NDFIP1 exon 4; Set C
auuuccuauccucagcuggucagcaucauca

SEQ ID NO: 37325 - RNA, 24 nt, Artificial Sequence
  Synthetic Oligonucleotide; NDFIP1 exon 4; Set A
uccuauccucagcuggucagcauc

SEQ ID NO: 37326 - RNA, 30 nt, Artificial Sequence
  Synthetic Oligonucleotide; NDFIP1 exon 4; Set C
auuuccuauccucagcuggucagcaucauc

SEQ ID NO: 37327 - RNA, 27 nt, Artificial Sequence
  Synthetic Oligonucleotide; NDFIP1 exon 4; Set C
uuuccuauccucagcuggucagcauca

SEQ ID NO: 37328 - RNA, 29 nt, Artificial Sequence
  Synthetic Oligonucleotide; NDFIP1 exon 4; Set C
auuuccuauccucagcuggucagcaucau

SEQ ID NO: 37329 - RNA, 28 nt, Artificial Sequence
  Synthetic Oligonucleotide; NDFIP1 exon 4; Set C
auuuccuauccucagcuggucagcauca

SEQ ID NO: 37330 - RNA, 27 nt, Artificial Sequence
  Synthetic Oligonucleotide; NDFIP1 exon 4; Set A
auuuccuauccucagcuggucagcauc

SEQ ID NO: 37331 - RNA, 17 nt, Artificial Sequence
  Synthetic Oligonucleotide; NDFIP1 exon 4; Set C
cuauccucagcugguca

SEQ ID NO: 37332 - RNA, 16 nt, Artificial Sequence
  Synthetic Oligonucleotide; NDFIP1 exon 4; Set C
cuauccucagcugguc

SEQ ID NO: 37333 - RNA, 18 nt, Artificial Sequence
  Synthetic Oligonucleotide; NDFIP1 exon 4; Set A
ccuauccucagcugguca

SEQ ID NO: 37334 - RNA, 15 nt, Artificial Sequence
  Synthetic Oligonucleotide; NDFIP1 exon 4; Set C
cuauccucagcuggu

SEQ ID NO: 37335 - RNA, 17 nt, Artificial Sequence
  Synthetic Oligonucleotide; NDFIP1 exon 4; Set C
ccuauccucagcugguc

SEQ ID NO: 37336 - RNA, 19 nt, Artificial Sequence
  Synthetic Oligonucleotide; NDFIP1 exon 4; Set A
uccuauccucagcugguca

SEQ ID NO: 37337 - RNA, 16 nt, Artificial Sequence
  Synthetic Oligonucleotide; NDFIP1 exon 4; Set C
ccuauccucagcuggu

SEQ ID NO: 37338 - RNA, 18 nt, Artificial Sequence
  Synthetic Oligonucleotide; NDFIP1 exon 4; Set C
uccuauccucagcugguc

SEQ ID NO: 37339 - RNA, 15 nt, Artificial Sequence
  Synthetic Oligonucleotide; NDFIP1 exon 4; Set C
ccuauccucagcugg

SEQ ID NO: 37340 - RNA, 17 nt, Artificial Sequence
  Synthetic Oligonucleotide; NDFIP1 exon 4; Set C
uccuauccucagcuggu

SEQ ID NO: 37341 - RNA, 22 nt, Artificial Sequence
  Synthetic Oligonucleotide; NDFIP1 exon 4; Set A
auuuccuauccucagcugguca

SEQ ID NO: 37342 - RNA, 18 nt, Artificial Sequence
  Synthetic Oligonucleotide; NDFIP1 exon 4; Set C
uuuccuauccucagcugg

SEQ ID NO: 37343 - RNA, 19 nt, Artificial Sequence
  Synthetic Oligonucleotide; NDFIP1 exon 4; Set C
auuuccuauccucagcugg

SEQ ID NO: 37344 - RNA, 32 nt, Artificial Sequence
  Synthetic Oligonucleotide; NDFIP1 exon 4; Set C
aaucccaucauuuccuauccucagcuggucag

SEQ ID NO: 37345 - RNA, 33 nt, Artificial Sequence
  Synthetic Oligonucleotide; NDFIP1 exon 4; Set C
aaaucccaucauuuccuauccucagcuggucag

SEQ ID NO: 37346 - RNA, 16 nt, Artificial Sequence
  Synthetic Oligonucleotide; NDFIP1 exon 4; Set C
ccaucauuuccuaucc

SEQ ID NO: 37347 - RNA, 40 nt, Artificial Sequence
  Synthetic Oligonucleotide; NDFIP1 exon 4; Set C
aacaugaaaaucccaucauuuccuauccucagcuggucag

SEQ ID NO: 37348 - RNA, 17 nt, Artificial Sequence
  Synthetic Oligonucleotide; NDFIP1 exon 4; Set C
cccaucauuuccuaucc

SEQ ID NO: 37349 - RNA, 15 nt, Artificial Sequence
  Synthetic Oligonucleotide; NDFIP1 exon 4; Set C
ccaucauuuccuauc

SEQ ID NO: 37350 - RNA, 18 nt, Artificial Sequence
  Synthetic Oligonucleotide; NDFIP1 exon 4; Set C
ucccaucauuuccuaucc

SEQ ID NO: 37351 - RNA, 16 nt, Artificial Sequence
  Synthetic Oligonucleotide; NDFIP1 exon 4; Set C
cccaucauuuccuauc

SEQ ID NO: 37352 - RNA, 19 nt, Artificial Sequence
  Synthetic Oligonucleotide; NDFIP1 exon 4; Set C
aucccaucauuuccuaucc

SEQ ID NO: 37353 - RNA, 17 nt, Artificial Sequence
  Synthetic Oligonucleotide; NDFIP1 exon 4; Set C
ucccaucauuuccuauc

SEQ ID NO: 37354 - RNA, 20 nt, Artificial Sequence
  Synthetic Oligonucleotide; NDFIP1 exon 4; Set C
aaucccaucauuuccuaucc

SEQ ID NO: 37355 - RNA, 18 nt, Artificial Sequence
  Synthetic Oligonucleotide; NDFIP1 exon 4; Set C
aucccaucauuuccuauc

SEQ ID NO: 37356 - RNA, 21 nt, Artificial Sequence
  Synthetic Oligonucleotide; NDFIP1 exon 4; Set C
aaaucccaucauuuccuaucc

SEQ ID NO: 37357 - RNA, 19 nt, Artificial Sequence
  Synthetic Oligonucleotide; NDFIP1 exon 4; Set C
aaucccaucauuuccuauc

SEQ ID NO: 37358 - RNA, 22 nt, Artificial Sequence
  Synthetic Oligonucleotide; NDFIP1 exon 4; Set C
aaaaucccaucauuuccuaucc

SEQ ID NO: 37359 - RNA, 20 nt, Artificial Sequence
  Synthetic Oligonucleotide; NDFIP1 exon 4; Set C
aaaucccaucauuuccuauc

SEQ ID NO: 37360 - RNA, 18 nt, Artificial Sequence
  Synthetic Oligonucleotide; NDFIP1 exon 4; Set C
aaucccaucauuuccuau

SEQ ID NO: 37361 - RNA, 23 nt, Artificial Sequence
  Synthetic Oligonucleotide; NDFIP1 exon 4; Set C
gaaaaucccaucauuuccuaucc

SEQ ID NO: 37362 - RNA, 21 nt, Artificial Sequence
  Synthetic Oligonucleotide; NDFIP1 exon 4; Set C
aaaaucccaucauuuccuauc

SEQ ID NO: 37363 - RNA, 19 nt, Artificial Sequence
  Synthetic Oligonucleotide; NDFIP1 exon 4; Set C
aaaucccaucauuuccuau

SEQ ID NO: 37364 - RNA, 24 nt, Artificial Sequence
  Synthetic Oligonucleotide; NDFIP1 exon 4; Set C
ugaaaaucccaucauuuccuaucc

SEQ ID NO: 37365 - RNA, 22 nt, Artificial Sequence
  Synthetic Oligonucleotide; NDFIP1 exon 4; Set C
gaaaaucccaucauuuccuauc

SEQ ID NO: 37366 - RNA, 25 nt, Artificial Sequence
  Synthetic Oligonucleotide; NDFIP1 exon 4; Set C
augaaaaucccaucauuuccuaucc

SEQ ID NO: 37367 - RNA, 23 nt, Artificial Sequence
  Synthetic Oligonucleotide; NDFIP1 exon 4; Set C
ugaaaaucccaucauuuccuauc

SEQ ID NO: 37368 - RNA, 26 nt, Artificial Sequence
  Synthetic Oligonucleotide; NDFIP1 exon 4; Set C
caugaaaaucccaucauuuccuaucc

SEQ ID NO: 37369 - RNA, 24 nt, Artificial Sequence
  Synthetic Oligonucleotide; NDFIP1 exon 4; Set C
augaaaaucccaucauuuccuauc

SEQ ID NO: 37370 - RNA, 27 nt, Artificial Sequence
  Synthetic Oligonucleotide; NDFIP1 exon 4; Set C
acaugaaaaucccaucauuuccuaucc

SEQ ID NO: 37371 - RNA, 25 nt, Artificial Sequence
  Synthetic Oligonucleotide; NDFIP1 exon 4; Set C
caugaaaaucccaucauuuccuauc

SEQ ID NO: 37372 - RNA, 26 nt, Artificial Sequence
  Synthetic Oligonucleotide; NDFIP1 exon 4; Set C
acaugaaaaucccaucauuuccuauc

SEQ ID NO: 37373 - RNA, 26 nt, Artificial Sequence
  Synthetic Oligonucleotide; NDFIP1 exon 4; Set C
aacaugaaaaucccaucauuuccuau

SEQ ID NO: 37374 - RNA, 31 nt, Artificial Sequence
  Synthetic Oligonucleotide; NDFIP1 exon 4; Set A
guuaacaugaaaaucccaucauuuccuaucc

SEQ ID NO: 37375 - RNA, 27 nt, Artificial Sequence
  Synthetic Oligonucleotide; NDFIP1 exon 4; Set C
uaacaugaaaaucccaucauuuccuau

SEQ ID NO: 37376 - RNA, 30 nt, Artificial Sequence
  Synthetic Oligonucleotide; NDFIP1 exon 4; Set C
guuaacaugaaaaucccaucauuuccuauc

SEQ ID NO: 37377 - RNA, 28 nt, Artificial Sequence
  Synthetic Oligonucleotide; NDFIP1 exon 4; Set C
uuaacaugaaaaucccaucauuuccuau

SEQ ID NO: 37378 - RNA, 29 nt, Artificial Sequence
  Synthetic Oligonucleotide; NDFIP1 exon 4; Set C
guuaacaugaaaaucccaucauuuccuau

SEQ ID NO: 37379 - RNA, 33 nt, Artificial Sequence
  Synthetic Oligonucleotide; NDFIP1 exon 4; Set C
aaaaguuaacaugaaaaucccaucauuuccuau

SEQ ID NO: 37380 - RNA, 34 nt, Artificial Sequence
  Synthetic Oligonucleotide; NDFIP1 exon 4; Set C
aaaaaguuaacaugaaaaucccaucauuuccuau

SEQ ID NO: 37381 - RNA, 25 nt, Artificial Sequence
  Synthetic Oligonucleotide; NDFIP1 exon 4; Set C
aguuaacaugaaaaucccaucauuu

SEQ ID NO: 37382 - RNA, 24 nt, Artificial Sequence
  Synthetic Oligonucleotide; NDFIP1 exon 4; Set C
aguuaacaugaaaaucccaucauu

SEQ ID NO: 37383 - RNA, 26 nt, Artificial Sequence
  Synthetic Oligonucleotide; NDFIP1 exon 4; Set C
aaguuaacaugaaaaucccaucauuu

SEQ ID NO: 37384 - RNA, 25 nt, Artificial Sequence
  Synthetic Oligonucleotide; NDFIP1 exon 4; Set C
aaguuaacaugaaaaucccaucauu

SEQ ID NO: 37385 - RNA, 27 nt, Artificial Sequence
  Synthetic Oligonucleotide; NDFIP1 exon 4; Set C
aaaguuaacaugaaaaucccaucauuu

SEQ ID NO: 37386 - RNA, 26 nt, Artificial Sequence
  Synthetic Oligonucleotide; NDFIP1 exon 4; Set C
aaaguuaacaugaaaaucccaucauu

SEQ ID NO: 37387 - RNA, 24 nt, Artificial Sequence
  Synthetic Oligonucleotide; NDFIP1 exon 4; Set C
aaaaaaguuaacaugaaaauccca

SEQ ID NO: 37388 - RNA, 23 nt, Artificial Sequence
  Synthetic Oligonucleotide; NDFIP1 exon 4; Set C
aaaaaaguuaacaugaaaauccc

SEQ ID NO: 37389 - RNA, 22 nt, Artificial Sequence
  Synthetic Oligonucleotide; NDFIP1 exon 4; Set C
aaaaaaguuaacaugaaaaucc

SEQ ID NO: 37390 - RNA, 21 nt, Artificial Sequence
  Synthetic Oligonucleotide; NDFIP1 exon 4; Set C
aaaaaaguuaacaugaaaauc

SEQ ID NO: 37391 - RNA, 20 nt, Artificial Sequence
  Synthetic Oligonucleotide; NDFIP1 exon 4; Set C
aaaaaaguuaacaugaaaau

SEQ ID NO: 37392 - RNA, 19 nt, Artificial Sequence
  Synthetic Oligonucleotide; NDFIP1 exon 4; Set C
aaaaaaguuaacaugaaaa

SEQ ID NO: 37393 - RNA, 18 nt, Artificial Sequence
  Synthetic Oligonucleotide; NDFIP1 exon 4; Set C
aaaaaaguuaacaugaaa

SEQ ID NO: 37394 - RNA, 34 nt, Artificial Sequence
  Synthetic Oligonucleotide; NDFIP1 exon 4; Set C
auacuuacugaaaaaaguuaacaugaaaauccca

SEQ ID NO: 37395 - RNA, 33 nt, Artificial Sequence
  Synthetic Oligonucleotide; NDFIP1 exon 4; Set C
auacuuacugaaaaaaguuaacaugaaaauccc

SEQ ID NO: 37396 - RNA, 32 nt, Artificial Sequence
  Synthetic Oligonucleotide; NDFIP1 exon 4; Set C
auacuuacugaaaaaaguuaacaugaaaaucc

SEQ ID NO: 37397 - RNA, 31 nt, Artificial Sequence
  Synthetic Oligonucleotide; NDFIP1 exon 4; Set C
auacuuacugaaaaaaguuaacaugaaaauc

SEQ ID NO: 37398 - RNA, 30 nt, Artificial Sequence
  Synthetic Oligonucleotide; NDFIP1 exon 4; Set C
auacuuacugaaaaaaguuaacaugaaaau

SEQ ID NO: 37399 - RNA, 29 nt, Artificial Sequence
  Synthetic Oligonucleotide; NDFIP1 exon 4; Set C
auacuuacugaaaaaaguuaacaugaaaa

SEQ ID NO: 37400 - RNA, 40 nt, Artificial Sequence
  Synthetic Oligonucleotide; NDFIP1 exon 4; Set C
agggggugguucugauaugcauacauacuuacugaaaaaa

SEQ ID NO: 37401 - RNA, 22 nt, Artificial Sequence
  Synthetic Oligonucleotide; NDFIP1 exon 4; Set B
agggggugguucugauaugcau

SEQ ID NO: 37402 - RNA, 23 nt, Artificial Sequence
  Synthetic Oligonucleotide; NDFIP1 exon 4; Set B
uagggggugguucugauaugcau

SEQ ID NO: 37403 - RNA, 32 nt, Artificial Sequence
  Synthetic Oligonucleotide; NDFIP1 exon 4; Set C
guuuguagggggugguucugauaugcauacau

SEQ ID NO: 37404 - RNA, 31 nt, Artificial Sequence
  Synthetic Oligonucleotide; NDFIP1 exon 4; Set C
guuuguagggggugguucugauaugcauaca

SEQ ID NO: 37405 - RNA, 33 nt, Artificial Sequence
  Synthetic Oligonucleotide; NDFIP1 exon 4; Set C
aguuuguagggggugguucugauaugcauacau

SEQ ID NO: 37406 - RNA, 30 nt, Artificial Sequence
  Synthetic Oligonucleotide; NDFIP1 exon 4; Set C
guuuguagggggugguucugauaugcauac

SEQ ID NO: 37407 - RNA, 32 nt, Artificial Sequence
  Synthetic Oligonucleotide; NDFIP1 exon 4; Set C
aguuuguagggggugguucugauaugcauaca

SEQ ID NO: 37408 - RNA, 34 nt, Artificial Sequence
  Synthetic Oligonucleotide; NDFIP1 exon 4; Set C
uaguuuguagggggugguucugauaugcauacau

SEQ ID NO: 37409 - RNA, 29 nt, Artificial Sequence
  Synthetic Oligonucleotide; NDFIP1 exon 4; Set C
guuuguagggggugguucugauaugcaua

SEQ ID NO: 37410 - RNA, 33 nt, Artificial Sequence
  Synthetic Oligonucleotide; NDFIP1 exon 4; Set C
uaguuuguagggggugguucugauaugcauaca

SEQ ID NO: 37411 - RNA, 31 nt, Artificial Sequence
  Synthetic Oligonucleotide; NDFIP1 exon 4; Set C
aguuuguagggggugguucugauaugcauac

SEQ ID NO: 37412 - RNA, 30 nt, Artificial Sequence
  Synthetic Oligonucleotide; NDFIP1 exon 4; Set C
aguuuguagggggugguucugauaugcaua

SEQ ID NO: 37413 - RNA, 28 nt, Artificial Sequence
  Synthetic Oligonucleotide; NDFIP1 exon 4; Set C
guuuguagggggugguucugauaugcau

SEQ ID NO: 37414 - RNA, 32 nt, Artificial Sequence
  Synthetic Oligonucleotide; NDFIP1 exon 4; Set C
uaguuuguagggggugguucugauaugcauac

SEQ ID NO: 37415 - RNA, 31 nt, Artificial Sequence
  Synthetic Oligonucleotide; NDFIP1 exon 4; Set C
uaguuuguagggggugguucugauaugcaua

SEQ ID NO: 37416 - RNA, 29 nt, Artificial Sequence
  Synthetic Oligonucleotide; NDFIP1 exon 4; Set C
aguuuguagggggugguucugauaugcau

SEQ ID NO: 37417 - RNA, 30 nt, Artificial Sequence
  Synthetic Oligonucleotide; NDFIP1 exon 4; Set C
uaguuuguagggggugguucugauaugcau

SEQ ID NO: 37418 - RNA, 38 nt, Artificial Sequence
  Synthetic Oligonucleotide; NDFIP1 exon 4; Set C
agcacucuaguuuguagggggugguucugauaugcaua

SEQ ID NO: 37419 - RNA, 39 nt, Artificial Sequence
  Synthetic Oligonucleotide; NDFIP1 exon 4; Set C
aagcacucuaguuuguagggggugguucugauaugcaua

SEQ ID NO: 37420 - RNA, 40 nt, Artificial Sequence
  Synthetic Oligonucleotide; NDFIP1 exon 4; Set C
aaagcacucuaguuuguagggggugguucugauaugcaua

SEQ ID NO: 37421 - RNA, 39 nt, Artificial Sequence
  Synthetic Oligonucleotide; NDFIP1 exon 4; Set C
aaagcacucuaguuuguagggggugguucugauaugcau

SEQ ID NO: 37422 - RNA, 18 nt, Artificial Sequence
  Synthetic Oligonucleotide; NDFIP1 exon 4; Set C
agcacucuaguuuguagg

SEQ ID NO: 37423 - RNA, 17 nt, Artificial Sequence
  Synthetic Oligonucleotide; NDFIP1 exon 4; Set C
agcacucuaguuuguag

SEQ ID NO: 37424 - RNA, 19 nt, Artificial Sequence
  Synthetic Oligonucleotide; NDFIP1 exon 4; Set C
aagcacucuaguuuguagg

SEQ ID NO: 37425 - RNA, 16 nt, Artificial Sequence
  Synthetic Oligonucleotide; NDFIP1 exon 4; Set C
agcacucuaguuugua

SEQ ID NO: 37426 - RNA, 18 nt, Artificial Sequence
  Synthetic Oligonucleotide; NDFIP1 exon 4; Set C
aagcacucuaguuuguag

SEQ ID NO: 37427 - RNA, 17 nt, Artificial Sequence
  Synthetic Oligonucleotide; NDFIP1 exon 4; Set C
aagcacucuaguuugua

SEQ ID NO: 37428 - RNA, 15 nt, Artificial Sequence
  Synthetic Oligonucleotide; NDFIP1 exon 4; Set C
agcacucuaguuugu

SEQ ID NO: 37429 - RNA, 16 nt, Artificial Sequence
  Synthetic Oligonucleotide; NDFIP1 exon 4; Set C
aagcacucuaguuugu

SEQ ID NO: 37430 - RNA, 15 nt, Artificial Sequence
  Synthetic Oligonucleotide; NDFIP1 exon 4; Set C
aagcacucuaguuug

SEQ ID NO: 37431 - RNA, 27 nt, Artificial Sequence
  Synthetic Oligonucleotide; NDFIP1 exon 5; Set C
aauuagagagagaccaaauccugaaau

SEQ ID NO: 37432 - RNA, 28 nt, Artificial Sequence
  Synthetic Oligonucleotide; NDFIP1 exon 5; Set C
uaauuagagagagaccaaauccugaaau

SEQ ID NO: 37433 - RNA, 15 nt, Artificial Sequence
  Synthetic Oligonucleotide; NDFIP1 exon 5; Set C
caauccaguuaaaga

SEQ ID NO: 37434 - RNA, 19 nt, Artificial Sequence
  Synthetic Oligonucleotide; NDFIP1 exon 5; Set C
aaaacccaauccaguuaaa

SEQ ID NO: 37435 - RNA, 18 nt, Artificial Sequence
  Synthetic Oligonucleotide; NDFIP1 exon 5; Set C
aaaacccaauccaguuaa

SEQ ID NO: 37436 - RNA, 17 nt, Artificial Sequence
  Synthetic Oligonucleotide; NDFIP1 exon 5; Set C
aaaacccaauccaguua

SEQ ID NO: 37437 - RNA, 16 nt, Artificial Sequence
  Synthetic Oligonucleotide; NDFIP1 exon 5; Set C
aaaacccaauccaguu

SEQ ID NO: 37438 - RNA, 25 nt, Artificial Sequence
  Synthetic Oligonucleotide; NDFIP1 exon 5; Set C
guggucaggcaaaaagacaggaaaa

SEQ ID NO: 37439 - RNA, 27 nt, Artificial Sequence
  Synthetic Oligonucleotide; NDFIP1 exon 5; Set C
aguggucaggcaaaaagacaggaaaaa

SEQ ID NO: 37440 - RNA, 26 nt, Artificial Sequence
  Synthetic Oligonucleotide; NDFIP1 exon 5; Set C
aguggucaggcaaaaagacaggaaaa

SEQ ID NO: 37441 - RNA, 19 nt, Artificial Sequence
  Synthetic Oligonucleotide; NDFIP1 exon 5; Set C
guggucaggcaaaaagaca

SEQ ID NO: 37442 - RNA, 20 nt, Artificial Sequence
  Synthetic Oligonucleotide; NDFIP1 exon 5; Set C
aguggucaggcaaaaagaca

SEQ ID NO: 37443 - RNA, 37 nt, Artificial Sequence
  Synthetic Oligonucleotide; NDFIP1 exon 5; Set A
uaauuagagagagaccaaauccugaaauggccccaua

SEQ ID NO: 37444 - RNA, 20 nt, Artificial Sequence
  Synthetic Oligonucleotide; NDFIP1 exon 5; Set C
gagagaccaaauccugaaau

SEQ ID NO: 37445 - RNA, 19 nt, Artificial Sequence
  Synthetic Oligonucleotide; NDFIP1 exon 5; Set C
gagagaccaaauccugaaa

SEQ ID NO: 37446 - RNA, 24 nt, Artificial Sequence
  Synthetic Oligonucleotide; NDFIP1 exon 5; Set C
uagagagagaccaaauccugaaau

SEQ ID NO: 37447 - RNA, 25 nt, Artificial Sequence
  Synthetic Oligonucleotide; NDFIP1 exon 5; Set C
uuagagagagaccaaauccugaaau

SEQ ID NO: 37448 - RNA, 23 nt, Artificial Sequence
  Synthetic Oligonucleotide; NDFIP1 exon 5; Set C
uagagagagaccaaauccugaaa

SEQ ID NO: 37449 - RNA, 26 nt, Artificial Sequence
  Synthetic Oligonucleotide; NDFIP1 exon 5; Set C
auuagagagagaccaaauccugaaau

SEQ ID NO: 37450 - RNA, 24 nt, Artificial Sequence
  Synthetic Oligonucleotide; NDFIP1 exon 5; Set C
uuagagagagaccaaauccugaaa

SEQ ID NO: 37451 - RNA, 22 nt, Artificial Sequence
  Synthetic Oligonucleotide; NDFIP1 exon 5; Set C
uagagagagaccaaauccugaa

SEQ ID NO: 37452 - RNA, 25 nt, Artificial Sequence
  Synthetic Oligonucleotide; NDFIP1 exon 5; Set C
auuagagagagaccaaauccugaaa

SEQ ID NO: 37453 - RNA, 23 nt, Artificial Sequence
  Synthetic Oligonucleotide; NDFIP1 exon 5; Set C
uuagagagagaccaaauccugaa

SEQ ID NO: 37454 - RNA, 26 nt, Artificial Sequence
  Synthetic Oligonucleotide; NDFIP1 exon 5; Set C
aauuagagagagaccaaauccugaaa

SEQ ID NO: 37455 - RNA, 24 nt, Artificial Sequence
  Synthetic Oligonucleotide; NDFIP1 exon 5; Set C
auuagagagagaccaaauccugaa

SEQ ID NO: 37456 - RNA, 29 nt, Artificial Sequence
  Synthetic Oligonucleotide; NDFIP1 exon 5; Set C
uuaauuagagagagaccaaauccugaaau

SEQ ID NO: 37457 - RNA, 27 nt, Artificial Sequence
  Synthetic Oligonucleotide; NDFIP1 exon 5; Set C
uaauuagagagagaccaaauccugaaa

SEQ ID NO: 37458 - RNA, 25 nt, Artificial Sequence
  Synthetic Oligonucleotide; NDFIP1 exon 5; Set C
aauuagagagagaccaaauccugaa

SEQ ID NO: 37459 - RNA, 23 nt, Artificial Sequence
  Synthetic Oligonucleotide; NDFIP1 exon 5; Set C
auuagagagagaccaaauccuga

SEQ ID NO: 37460 - RNA, 30 nt, Artificial Sequence
  Synthetic Oligonucleotide; NDFIP1 exon 5; Set C
uuuaauuagagagagaccaaauccugaaau

SEQ ID NO: 37461 - RNA, 26 nt, Artificial Sequence
  Synthetic Oligonucleotide; NDFIP1 exon 5; Set C
uaauuagagagagaccaaauccugaa

SEQ ID NO: 37462 - RNA, 28 nt, Artificial Sequence
  Synthetic Oligonucleotide; NDFIP1 exon 5; Set C
uuaauuagagagagaccaaauccugaaa

SEQ ID NO: 37463 - RNA, 18 nt, Artificial Sequence
  Synthetic Oligonucleotide; NDFIP1 exon 5; Set C
uagagagagaccaaaucc

SEQ ID NO: 37464 - RNA, 20 nt, Artificial Sequence
  Synthetic Oligonucleotide; NDFIP1 exon 5; Set C
uuagagagagaccaaauccu

SEQ ID NO: 37465 - RNA, 24 nt, Artificial Sequence
  Synthetic Oligonucleotide; NDFIP1 exon 5; Set C
aauuagagagagaccaaauccuga

SEQ ID NO: 37466 - RNA, 22 nt, Artificial Sequence
  Synthetic Oligonucleotide; NDFIP1 exon 5; Set C
auuagagagagaccaaauccug

SEQ ID NO: 37467 - RNA, 17 nt, Artificial Sequence
  Synthetic Oligonucleotide; NDFIP1 exon 5; Set C
uagagagagaccaaauc

SEQ ID NO: 37468 - RNA, 29 nt, Artificial Sequence
  Synthetic Oligonucleotide; NDFIP1 exon 5; Set C
uuuaauuagagagagaccaaauccugaaa

SEQ ID NO: 37469 - RNA, 27 nt, Artificial Sequence
  Synthetic Oligonucleotide; NDFIP1 exon 5; Set C
uuaauuagagagagaccaaauccugaa

SEQ ID NO: 37470 - RNA, 19 nt, Artificial Sequence
  Synthetic Oligonucleotide; NDFIP1 exon 5; Set C
uuagagagagaccaaaucc

SEQ ID NO: 37471 - RNA, 21 nt, Artificial Sequence
  Synthetic Oligonucleotide; NDFIP1 exon 5; Set C
auuagagagagaccaaauccu

SEQ ID NO: 37472 - RNA, 25 nt, Artificial Sequence
  Synthetic Oligonucleotide; NDFIP1 exon 5; Set C
uaauuagagagagaccaaauccuga

SEQ ID NO: 37473 - RNA, 23 nt, Artificial Sequence
  Synthetic Oligonucleotide; NDFIP1 exon 5; Set C
aauuagagagagaccaaauccug

SEQ ID NO: 37474 - RNA, 16 nt, Artificial Sequence
  Synthetic Oligonucleotide; NDFIP1 exon 5; Set C
uagagagagaccaaau

SEQ ID NO: 37475 - RNA, 18 nt, Artificial Sequence
  Synthetic Oligonucleotide; NDFIP1 exon 5; Set C
uuagagagagaccaaauc

SEQ ID NO: 37476 - RNA, 28 nt, Artificial Sequence
  Synthetic Oligonucleotide; NDFIP1 exon 5; Set C
uuuaauuagagagagaccaaauccugaa

SEQ ID NO: 37477 - RNA, 20 nt, Artificial Sequence
  Synthetic Oligonucleotide; NDFIP1 exon 5; Set C
auuagagagagaccaaaucc

SEQ ID NO: 37478 - RNA, 22 nt, Artificial Sequence
  Synthetic Oligonucleotide; NDFIP1 exon 5; Set C
aauuagagagagaccaaauccu

SEQ ID NO: 37479 - RNA, 26 nt, Artificial Sequence
  Synthetic Oligonucleotide; NDFIP1 exon 5; Set C
uuaauuagagagagaccaaauccuga

SEQ ID NO: 37480 - RNA, 24 nt, Artificial Sequence
  Synthetic Oligonucleotide; NDFIP1 exon 5; Set C
uaauuagagagagaccaaauccug

SEQ ID NO: 37481 - RNA, 17 nt, Artificial Sequence
  Synthetic Oligonucleotide; NDFIP1 exon 5; Set C
uuagagagagaccaaau

SEQ ID NO: 37482 - RNA, 19 nt, Artificial Sequence
  Synthetic Oligonucleotide; NDFIP1 exon 5; Set C
auuagagagagaccaaauc

SEQ ID NO: 37483 - RNA, 15 nt, Artificial Sequence
  Synthetic Oligonucleotide; NDFIP1 exon 5; Set C
uagagagagaccaaa

SEQ ID NO: 37484 - RNA, 21 nt, Artificial Sequence
  Synthetic Oligonucleotide; NDFIP1 exon 5; Set C
aauuagagagagaccaaaucc

SEQ ID NO: 37485 - RNA, 23 nt, Artificial Sequence
  Synthetic Oligonucleotide; NDFIP1 exon 5; Set C
uaauuagagagagaccaaauccu

SEQ ID NO: 37486 - RNA, 27 nt, Artificial Sequence
  Synthetic Oligonucleotide; NDFIP1 exon 5; Set C
uuuaauuagagagagaccaaauccuga

SEQ ID NO: 37487 - RNA, 25 nt, Artificial Sequence
  Synthetic Oligonucleotide; NDFIP1 exon 5; Set C
uuaauuagagagagaccaaauccug

SEQ ID NO: 37488 - RNA, 18 nt, Artificial Sequence
  Synthetic Oligonucleotide; NDFIP1 exon 5; Set C
auuagagagagaccaaau

SEQ ID NO: 37489 - RNA, 20 nt, Artificial Sequence
  Synthetic Oligonucleotide; NDFIP1 exon 5; Set C
aauuagagagagaccaaauc

SEQ ID NO: 37490 - RNA, 16 nt, Artificial Sequence
  Synthetic Oligonucleotide; NDFIP1 exon 5; Set C
uuagagagagaccaaa

SEQ ID NO: 37491 - RNA, 22 nt, Artificial Sequence
  Synthetic Oligonucleotide; NDFIP1 exon 5; Set C
uaauuagagagagaccaaaucc

SEQ ID NO: 37492 - RNA, 24 nt, Artificial Sequence
  Synthetic Oligonucleotide; NDFIP1 exon 5; Set C
uuaauuagagagagaccaaauccu

SEQ ID NO: 37493 - RNA, 26 nt, Artificial Sequence
  Synthetic Oligonucleotide; NDFIP1 exon 5; Set C
uuuaauuagagagagaccaaauccug

SEQ ID NO: 37494 - RNA, 19 nt, Artificial Sequence
  Synthetic Oligonucleotide; NDFIP1 exon 5; Set C
aauuagagagagaccaaau

SEQ ID NO: 37495 - RNA, 21 nt, Artificial Sequence
  Synthetic Oligonucleotide; NDFIP1 exon 5; Set C
uaauuagagagagaccaaauc

SEQ ID NO: 37496 - RNA, 17 nt, Artificial Sequence
  Synthetic Oligonucleotide; NDFIP1 exon 5; Set C
auuagagagagaccaaa

SEQ ID NO: 37497 - RNA, 23 nt, Artificial Sequence
  Synthetic Oligonucleotide; NDFIP1 exon 5; Set C
uuaauuagagagagaccaaaucc

SEQ ID NO: 37498 - RNA, 25 nt, Artificial Sequence
  Synthetic Oligonucleotide; NDFIP1 exon 5; Set C
uuuaauuagagagagaccaaauccu

SEQ ID NO: 37499 - RNA, 20 nt, Artificial Sequence
  Synthetic Oligonucleotide; NDFIP1 exon 5; Set C
uaauuagagagagaccaaau

SEQ ID NO: 37500 - RNA, 22 nt, Artificial Sequence
  Synthetic Oligonucleotide; NDFIP1 exon 5; Set C
uuaauuagagagagaccaaauc

SEQ ID NO: 37501 - RNA, 18 nt, Artificial Sequence
  Synthetic Oligonucleotide; NDFIP1 exon 5; Set C
aauuagagagagaccaaa

SEQ ID NO: 37502 - RNA, 24 nt, Artificial Sequence
  Synthetic Oligonucleotide; NDFIP1 exon 5; Set C
uuuaauuagagagagaccaaaucc

SEQ ID NO: 37503 - RNA, 16 nt, Artificial Sequence
  Synthetic Oligonucleotide; NDFIP1 exon 5; Set C
auuagagagagaccaa

SEQ ID NO: 37504 - RNA, 21 nt, Artificial Sequence
  Synthetic Oligonucleotide; NDFIP1 exon 5; Set C
uuaauuagagagagaccaaau

SEQ ID NO: 37505 - RNA, 23 nt, Artificial Sequence
  Synthetic Oligonucleotide; NDFIP1 exon 5; Set C
uuuaauuagagagagaccaaauc

SEQ ID NO: 37506 - RNA, 19 nt, Artificial Sequence
  Synthetic Oligonucleotide; NDFIP1 exon 5; Set C
uaauuagagagagaccaaa

SEQ ID NO: 37507 - RNA, 17 nt, Artificial Sequence
  Synthetic Oligonucleotide; NDFIP1 exon 5; Set C
aauuagagagagaccaa

SEQ ID NO: 37508 - RNA, 22 nt, Artificial Sequence
  Synthetic Oligonucleotide; NDFIP1 exon 5; Set C
uuuaauuagagagagaccaaau

SEQ ID NO: 37509 - RNA, 20 nt, Artificial Sequence
  Synthetic Oligonucleotide; NDFIP1 exon 5; Set C
uuaauuagagagagaccaaa

SEQ ID NO: 37510 - RNA, 18 nt, Artificial Sequence
  Synthetic Oligonucleotide; NDFIP1 exon 5; Set C
uaauuagagagagaccaa

SEQ ID NO: 37511 - RNA, 21 nt, Artificial Sequence
  Synthetic Oligonucleotide; NDFIP1 exon 5; Set C
uuuaauuagagagagaccaaa

SEQ ID NO: 37512 - RNA, 19 nt, Artificial Sequence
  Synthetic Oligonucleotide; NDFIP1 exon 5; Set C
uuaauuagagagagaccaa

SEQ ID NO: 37513 - RNA, 20 nt, Artificial Sequence
  Synthetic Oligonucleotide; NDFIP1 exon 5; Set C
uuuaauuagagagagaccaa

SEQ ID NO: 37514 - RNA, 18 nt, Artificial Sequence
  Synthetic Oligonucleotide; NDFIP1 exon 5; Set C
ccaucuuuucuguuauac

SEQ ID NO: 37515 - RNA, 17 nt, Artificial Sequence
  Synthetic Oligonucleotide; NDFIP1 exon 5; Set C
ccaucuuuucuguuaua

SEQ ID NO: 37516 - RNA, 24 nt, Artificial Sequence
  Synthetic Oligonucleotide; NDFIP1 exon 5; Set C
uagagcccaucuuuucuguuauac

SEQ ID NO: 37517 - RNA, 23 nt, Artificial Sequence
  Synthetic Oligonucleotide; NDFIP1 exon 5; Set C
uagagcccaucuuuucuguuaua

SEQ ID NO: 37518 - RNA, 25 nt, Artificial Sequence
  Synthetic Oligonucleotide; NDFIP1 exon 5; Set B
guagagcccaucuuuucuguuauac

SEQ ID NO: 37519 - RNA, 22 nt, Artificial Sequence
  Synthetic Oligonucleotide; NDFIP1 exon 5; Set C
uagagcccaucuuuucuguuau

SEQ ID NO: 37520 - RNA, 24 nt, Artificial Sequence
  Synthetic Oligonucleotide; NDFIP1 exon 5; Set C
guagagcccaucuuuucuguuaua

SEQ ID NO: 37521 - RNA, 23 nt, Artificial Sequence
  Synthetic Oligonucleotide; NDFIP1 exon 5; Set C
guagagcccaucuuuucuguuau

SEQ ID NO: 37522 - RNA, 22 nt, Artificial Sequence
  Synthetic Oligonucleotide; NDFIP1 exon 5; Set C
guagagcccaucuuuucuguua

SEQ ID NO: 37523 - RNA, 21 nt, Artificial Sequence
  Synthetic Oligonucleotide; NDFIP1 exon 5; Set C
guagagcccaucuuuucuguu

SEQ ID NO: 37524 - RNA, 17 nt, Artificial Sequence
  Synthetic Oligonucleotide; NDFIP1 exon 5; Set C
aaagcagaggaggggaa

SEQ ID NO: 37525 - RNA, 18 nt, Artificial Sequence
  Synthetic Oligonucleotide; NDFIP1 exon 5; Set C
aaaagcagaggaggggaa

SEQ ID NO: 37526 - RNA, 40 nt, Artificial Sequence
  Synthetic Oligonucleotide; NDFIP1 exon 5; Set C
aguuaaagaggaaugccacugcaaaagcagaggaggggaa

SEQ ID NO: 37527 - RNA, 25 nt, Artificial Sequence
  Synthetic Oligonucleotide; NDFIP1 exon 5; Set C
guuaaagaggaaugccacugcaaaa

SEQ ID NO: 37528 - RNA, 26 nt, Artificial Sequence
  Synthetic Oligonucleotide; NDFIP1 exon 5; Set C
aguuaaagaggaaugccacugcaaaa

SEQ ID NO: 37529 - RNA, 24 nt, Artificial Sequence
  Synthetic Oligonucleotide; NDFIP1 exon 5; Set C
guuaaagaggaaugccacugcaaa

SEQ ID NO: 37530 - RNA, 25 nt, Artificial Sequence
  Synthetic Oligonucleotide; NDFIP1 exon 5; Set C
aguuaaagaggaaugccacugcaaa

SEQ ID NO: 37531 - RNA, 32 nt, Artificial Sequence
  Synthetic Oligonucleotide; NDFIP1 exon 5; Set A
caauccaguuaaagaggaaugccacugcaaaa

SEQ ID NO: 37532 - RNA, 37 nt, Artificial Sequence
  Synthetic Oligonucleotide; NDFIP1 exon 5; Set A
aaacccaauccaguuaaagaggaaugccacugcaaaa

SEQ ID NO: 37533 - RNA, 15 nt, Artificial Sequence
  Synthetic Oligonucleotide; NDFIP1 exon 5; Set C
aguuaaagaggaaug

SEQ ID NO: 37534 - RNA, 38 nt, Artificial Sequence
  Synthetic Oligonucleotide; NDFIP1 exon 5; Set A
aaaacccaauccaguuaaagaggaaugccacugcaaaa

SEQ ID NO: 37535 - RNA, 36 nt, Artificial Sequence
  Synthetic Oligonucleotide; NDFIP1 exon 5; Set A
aaacccaauccaguuaaagaggaaugccacugcaaa

SEQ ID NO: 37536 - RNA, 37 nt, Artificial Sequence
  Synthetic Oligonucleotide; NDFIP1 exon 5; Set A
aaaacccaauccaguuaaagaggaaugccacugcaaa

SEQ ID NO: 37537 - RNA, 27 nt, Artificial Sequence
  Synthetic Oligonucleotide; NDFIP1 exon 5; Set C
aaaacccaauccaguuaaagaggaaug

SEQ ID NO: 37538 - RNA, 20 nt, Artificial Sequence
  Synthetic Oligonucleotide; NDFIP1 exon 5; Set C
aaacccaauccaguuaaaga

SEQ ID NO: 37539 - RNA, 21 nt, Artificial Sequence
  Synthetic Oligonucleotide; NDFIP1 exon 5; Set C
aaaacccaauccaguuaaaga

SEQ ID NO: 37540 - RNA, 19 nt, Artificial Sequence
  Synthetic Oligonucleotide; NDFIP1 exon 5; Set C
aaacccaauccaguuaaag

SEQ ID NO: 37541 - RNA, 18 nt, Artificial Sequence
  Synthetic Oligonucleotide; NDFIP1 exon 5; Set C
aaacccaauccaguuaaa

SEQ ID NO: 37542 - RNA, 20 nt, Artificial Sequence
  Synthetic Oligonucleotide; NDFIP1 exon 5; Set C
aaaacccaauccaguuaaag

SEQ ID NO: 37543 - RNA, 17 nt, Artificial Sequence
  Synthetic Oligonucleotide; NDFIP1 exon 5; Set C
aaacccaauccaguuaa

SEQ ID NO: 37544 - RNA, 16 nt, Artificial Sequence
  Synthetic Oligonucleotide; NDFIP1 exon 5; Set C
aaacccaauccaguua

SEQ ID NO: 37545 - RNA, 20 nt, Artificial Sequence
  Synthetic Oligonucleotide; NDFIP1 exon 5; Set C
aaaaacccaauccaguuaaa

SEQ ID NO: 37546 - RNA, 15 nt, Artificial Sequence
  Synthetic Oligonucleotide; NDFIP1 exon 5; Set C
aaacccaauccaguu

SEQ ID NO: 37547 - RNA, 19 nt, Artificial Sequence
  Synthetic Oligonucleotide; NDFIP1 exon 5; Set C
aaaaacccaauccaguuaa

SEQ ID NO: 37548 - RNA, 18 nt, Artificial Sequence
  Synthetic Oligonucleotide; NDFIP1 exon 5; Set C
aaaaacccaauccaguua

SEQ ID NO: 37549 - RNA, 15 nt, Artificial Sequence
  Synthetic Oligonucleotide; NDFIP1 exon 5; Set C
aaaacccaauccagu

SEQ ID NO: 37550 - RNA, 17 nt, Artificial Sequence
  Synthetic Oligonucleotide; NDFIP1 exon 5; Set C
aaaaacccaauccaguu

SEQ ID NO: 37551 - RNA, 25 nt, Artificial Sequence
  Synthetic Oligonucleotide; NDFIP1 exon 5; Set C
acaggaaaaacccaauccaguuaaa

SEQ ID NO: 37552 - RNA, 24 nt, Artificial Sequence
  Synthetic Oligonucleotide; NDFIP1 exon 5; Set C
acaggaaaaacccaauccaguuaa

SEQ ID NO: 37553 - RNA, 23 nt, Artificial Sequence
  Synthetic Oligonucleotide; NDFIP1 exon 5; Set C
acaggaaaaacccaauccaguua

SEQ ID NO: 37554 - RNA, 22 nt, Artificial Sequence
  Synthetic Oligonucleotide; NDFIP1 exon 5; Set C
acaggaaaaacccaauccaguu

SEQ ID NO: 37555 - RNA, 32 nt, Artificial Sequence
  Synthetic Oligonucleotide; NDFIP1 exon 5; Set C
aaaagacaggaaaaacccaauccaguuaaaga

SEQ ID NO: 37556 - RNA, 21 nt, Artificial Sequence
  Synthetic Oligonucleotide; NDFIP1 exon 5; Set C
acaggaaaaacccaauccagu

SEQ ID NO: 37557 - RNA, 30 nt, Artificial Sequence
  Synthetic Oligonucleotide; NDFIP1 exon 5; Set C
aaaagacaggaaaaacccaauccaguuaaa

SEQ ID NO: 37558 - RNA, 29 nt, Artificial Sequence
  Synthetic Oligonucleotide; NDFIP1 exon 5; Set C
aaaagacaggaaaaacccaauccaguuaa

SEQ ID NO: 37559 - RNA, 28 nt, Artificial Sequence
  Synthetic Oligonucleotide; NDFIP1 exon 5; Set C
aaaagacaggaaaaacccaauccaguua

SEQ ID NO: 37560 - RNA, 27 nt, Artificial Sequence
  Synthetic Oligonucleotide; NDFIP1 exon 5; Set C
aaaagacaggaaaaacccaauccaguu

SEQ ID NO: 37561 - RNA, 26 nt, Artificial Sequence
  Synthetic Oligonucleotide; NDFIP1 exon 5; Set C
aaaagacaggaaaaacccaauccagu

SEQ ID NO: 37562 - RNA, 39 nt, Artificial Sequence
  Synthetic Oligonucleotide; NDFIP1 exon 5; Set A
ggucaggcaaaaagacaggaaaaacccaauccaguuaaa

SEQ ID NO: 37563 - RNA, 38 nt, Artificial Sequence
  Synthetic Oligonucleotide; NDFIP1 exon 5; Set A
ggucaggcaaaaagacaggaaaaacccaauccaguuaa

SEQ ID NO: 37564 - RNA, 40 nt, Artificial Sequence
  Synthetic Oligonucleotide; NDFIP1 exon 5; Set A
uggucaggcaaaaagacaggaaaaacccaauccaguuaaa

SEQ ID NO: 37565 - RNA, 39 nt, Artificial Sequence
  Synthetic Oligonucleotide; NDFIP1 exon 5; Set A
uggucaggcaaaaagacaggaaaaacccaauccaguuaa

SEQ ID NO: 37566 - RNA, 36 nt, Artificial Sequence
  Synthetic Oligonucleotide; NDFIP1 exon 5; Set A
ggucaggcaaaaagacaggaaaaacccaauccaguu

SEQ ID NO: 37567 - RNA, 40 nt, Artificial Sequence
  Synthetic Oligonucleotide; NDFIP1 exon 5; Set A
guggucaggcaaaaagacaggaaaaacccaauccaguuaa

SEQ ID NO: 37568 - RNA, 38 nt, Artificial Sequence
  Synthetic Oligonucleotide; NDFIP1 exon 5; Set A
uggucaggcaaaaagacaggaaaaacccaauccaguua

SEQ ID NO: 37569 - RNA, 37 nt, Artificial Sequence
  Synthetic Oligonucleotide; NDFIP1 exon 5; Set A
uggucaggcaaaaagacaggaaaaacccaauccaguu

SEQ ID NO: 37570 - RNA, 39 nt, Artificial Sequence
  Synthetic Oligonucleotide; NDFIP1 exon 5; Set C
guggucaggcaaaaagacaggaaaaacccaauccaguua

SEQ ID NO: 37571 - RNA, 38 nt, Artificial Sequence
  Synthetic Oligonucleotide; NDFIP1 exon 5; Set C
guggucaggcaaaaagacaggaaaaacccaauccaguu

SEQ ID NO: 37572 - RNA, 36 nt, Artificial Sequence
  Synthetic Oligonucleotide; NDFIP1 exon 5; Set A
uggucaggcaaaaagacaggaaaaacccaauccagu

SEQ ID NO: 37573 - RNA, 40 nt, Artificial Sequence
  Synthetic Oligonucleotide; NDFIP1 exon 5; Set C
aguggucaggcaaaaagacaggaaaaacccaauccaguua

SEQ ID NO: 37574 - RNA, 39 nt, Artificial Sequence
  Synthetic Oligonucleotide; NDFIP1 exon 5; Set C
aguggucaggcaaaaagacaggaaaaacccaauccaguu

SEQ ID NO: 37575 - RNA, 37 nt, Artificial Sequence
  Synthetic Oligonucleotide; NDFIP1 exon 5; Set C
guggucaggcaaaaagacaggaaaaacccaauccagu

SEQ ID NO: 37576 - RNA, 15 nt, Artificial Sequence
  Synthetic Oligonucleotide; NDFIP1 exon 5; Set C
aaaagacaggaaaaa

SEQ ID NO: 37577 - RNA, 38 nt, Artificial Sequence
  Synthetic Oligonucleotide; NDFIP1 exon 5; Set C
aguggucaggcaaaaagacaggaaaaacccaauccagu

SEQ ID NO: 37578 - RNA, 31 nt, Artificial Sequence
  Synthetic Oligonucleotide; NDFIP1 exon 5; Set A
uggucaggcaaaaagacaggaaaaacccaau

SEQ ID NO: 37579 - RNA, 30 nt, Artificial Sequence
  Synthetic Oligonucleotide; NDFIP1 exon 5; Set A
uggucaggcaaaaagacaggaaaaacccaa

SEQ ID NO: 37580 - RNA, 32 nt, Artificial Sequence
  Synthetic Oligonucleotide; NDFIP1 exon 5; Set A
guggucaggcaaaaagacaggaaaaacccaau

SEQ ID NO: 37581 - RNA, 34 nt, Artificial Sequence
  Synthetic Oligonucleotide; NDFIP1 exon 5; Set A
aguggucaggcaaaaagacaggaaaaacccaauc

SEQ ID NO: 37582 - RNA, 31 nt, Artificial Sequence
  Synthetic Oligonucleotide; NDFIP1 exon 5; Set A
guggucaggcaaaaagacaggaaaaacccaa

SEQ ID NO: 37583 - RNA, 33 nt, Artificial Sequence
  Synthetic Oligonucleotide; NDFIP1 exon 5; Set A
aguggucaggcaaaaagacaggaaaaacccaau

SEQ ID NO: 37584 - RNA, 32 nt, Artificial Sequence
  Synthetic Oligonucleotide; NDFIP1 exon 5; Set A
aguggucaggcaaaaagacaggaaaaacccaa

SEQ ID NO: 37585 - RNA, 24 nt, Artificial Sequence
  Synthetic Oligonucleotide; NDFIP1 exon 5; Set C
ggucaggcaaaaagacaggaaaaa

SEQ ID NO: 37586 - RNA, 23 nt, Artificial Sequence
  Synthetic Oligonucleotide; NDFIP1 exon 5; Set C
ggucaggcaaaaagacaggaaaa

SEQ ID NO: 37587 - RNA, 25 nt, Artificial Sequence
  Synthetic Oligonucleotide; NDFIP1 exon 5; Set C
uggucaggcaaaaagacaggaaaaa

SEQ ID NO: 37588 - RNA, 24 nt, Artificial Sequence
  Synthetic Oligonucleotide; NDFIP1 exon 5; Set C
uggucaggcaaaaagacaggaaaa

SEQ ID NO: 37589 - RNA, 26 nt, Artificial Sequence
  Synthetic Oligonucleotide; NDFIP1 exon 5; Set C
guggucaggcaaaaagacaggaaaaa

SEQ ID NO: 37590 - RNA, 24 nt, Artificial Sequence
  Synthetic Oligonucleotide; NDFIP1 exon 5; Set C
guggucaggcaaaaagacaggaaa

SEQ ID NO: 37591 - RNA, 25 nt, Artificial Sequence
  Synthetic Oligonucleotide; NDFIP1 exon 5; Set C
aguggucaggcaaaaagacaggaaa

SEQ ID NO: 37592 - RNA, 17 nt, Artificial Sequence
  Synthetic Oligonucleotide; NDFIP1 exon 5; Set C
ggucaggcaaaaagaca

SEQ ID NO: 37593 - RNA, 18 nt, Artificial Sequence
  Synthetic Oligonucleotide; NDFIP1 exon 5; Set C
uggucaggcaaaaagaca

SEQ ID NO: 37594 - RNA, 15 nt, Artificial Sequence
  Synthetic Oligonucleotide; NDFIP1 exon 5; Set C
aguggucaggcaaaa

SEQ ID NO: 37595 - RNA, 37 nt, Artificial Sequence
  Synthetic Oligonucleotide; NDFIP1 exon 5; Set C
uaccuuccugcagcugaaguggucaggcaaaaagaca

SEQ ID NO: 37596 - RNA, 38 nt, Artificial Sequence
  Synthetic Oligonucleotide; NDFIP1 exon 5; Set C
auaccuuccugcagcugaaguggucaggcaaaaagaca

SEQ ID NO: 37597 - RNA, 33 nt, Artificial Sequence
  Synthetic Oligonucleotide; NDFIP1 exon 5; Set C
auaccuuccugcagcugaaguggucaggcaaaa

SEQ ID NO: 37598 - RNA, 22 nt, Artificial Sequence
  Synthetic Oligonucleotide; NDFIP1 exon 5; Set A
uaccuuccugcagcugaagugg

SEQ ID NO: 37599 - RNA, 23 nt, Artificial Sequence
  Synthetic Oligonucleotide; NDFIP1 exon 5; Set A
auaccuuccugcagcugaagugg

SEQ ID NO: 37600 - RNA, 21 nt, Artificial Sequence
  Synthetic Oligonucleotide; NDFIP1 exon 5; Set A
uaccuuccugcagcugaagug

SEQ ID NO: 37601 - RNA, 22 nt, Artificial Sequence
  Synthetic Oligonucleotide; NDFIP1 exon 5; Set A
auaccuuccugcagcugaagug

SEQ ID NO: 37602 - RNA, 20 nt, Artificial Sequence
  Synthetic Oligonucleotide; NDFIP1 exon 5; Set A
uaccuuccugcagcugaagu

SEQ ID NO: 37603 - RNA, 21 nt, Artificial Sequence
  Synthetic Oligonucleotide; NDFIP1 exon 5; Set A
auaccuuccugcagcugaagu

SEQ ID NO: 37604 - RNA, 39 nt, Artificial Sequence
  Synthetic Oligonucleotide; NDFIP1 exon 5; Set C
auccugaaauggccccauaccuuccugcagcugaagugg

SEQ ID NO: 37605 - RNA, 40 nt, Artificial Sequence
  Synthetic Oligonucleotide; NDFIP1 exon 5; Set C
aauccugaaauggccccauaccuuccugcagcugaagugg

SEQ ID NO: 37606 - RNA, 38 nt, Artificial Sequence
  Synthetic Oligonucleotide; NDFIP1 exon 5; Set C
auccugaaauggccccauaccuuccugcagcugaagug

SEQ ID NO: 37607 - RNA, 39 nt, Artificial Sequence
  Synthetic Oligonucleotide; NDFIP1 exon 5; Set C
aauccugaaauggccccauaccuuccugcagcugaagug

SEQ ID NO: 37608 - RNA, 38 nt, Artificial Sequence
  Synthetic Oligonucleotide; NDFIP1 exon 5; Set C
aauccugaaauggccccauaccuuccugcagcugaagu

SEQ ID NO: 37609 - RNA, 40 nt, Artificial Sequence
  Synthetic Oligonucleotide; NDFIP1 exon 5; Set C
aaauccugaaauggccccauaccuuccugcagcugaagug

SEQ ID NO: 37610 - RNA, 39 nt, Artificial Sequence
  Synthetic Oligonucleotide; NDFIP1 exon 5; Set C
uagagagagaccaaauccugaaauggccccauaccuucc

SEQ ID NO: 37611 - RNA, 30 nt, Artificial Sequence
  Synthetic Oligonucleotide; NDFIP1 exon 5; Set A
gagagaccaaauccugaaauggccccauac

SEQ ID NO: 37612 - RNA, 40 nt, Artificial Sequence
  Synthetic Oligonucleotide; NDFIP1 exon 5; Set C
uuagagagagaccaaauccugaaauggccccauaccuucc

SEQ ID NO: 37613 - RNA, 29 nt, Artificial Sequence
  Synthetic Oligonucleotide; NDFIP1 exon 5; Set A
gagagaccaaauccugaaauggccccaua

SEQ ID NO: 37614 - RNA, 34 nt, Artificial Sequence
  Synthetic Oligonucleotide; NDFIP1 exon 5; Set C
uagagagagaccaaauccugaaauggccccauac

SEQ ID NO: 37615 - RNA, 33 nt, Artificial Sequence
  Synthetic Oligonucleotide; NDFIP1 exon 5; Set C
uagagagagaccaaauccugaaauggccccaua

SEQ ID NO: 37616 - RNA, 35 nt, Artificial Sequence
  Synthetic Oligonucleotide; NDFIP1 exon 5; Set C
uuagagagagaccaaauccugaaauggccccauac

SEQ ID NO: 37617 - RNA, 34 nt, Artificial Sequence
  Synthetic Oligonucleotide; NDFIP1 exon 5; Set C
uuagagagagaccaaauccugaaauggccccaua

SEQ ID NO: 37618 - RNA, 36 nt, Artificial Sequence
  Synthetic Oligonucleotide; NDFIP1 exon 5; Set C
auuagagagagaccaaauccugaaauggccccauac

SEQ ID NO: 37619 - RNA, 35 nt, Artificial Sequence
  Synthetic Oligonucleotide; NDFIP1 exon 5; Set C
auuagagagagaccaaauccugaaauggccccaua

SEQ ID NO: 37620 - RNA, 37 nt, Artificial Sequence
  Synthetic Oligonucleotide; NDFIP1 exon 5; Set C
aauuagagagagaccaaauccugaaauggccccauac

SEQ ID NO: 37621 - RNA, 36 nt, Artificial Sequence
  Synthetic Oligonucleotide; NDFIP1 exon 5; Set A
aauuagagagagaccaaauccugaaauggccccaua

SEQ ID NO: 37622 - RNA, 18 nt, Artificial Sequence
  Synthetic Oligonucleotide; NDFIP1 exon 5; Set C
gagaccaaauccugaaau

SEQ ID NO: 37623 - RNA, 38 nt, Artificial Sequence
  Synthetic Oligonucleotide; NDFIP1 exon 5; Set C
uaauuagagagagaccaaauccugaaauggccccauac

SEQ ID NO: 37624 - RNA, 19 nt, Artificial Sequence
  Synthetic Oligonucleotide; NDFIP1 exon 5; Set C
agagaccaaauccugaaau

SEQ ID NO: 37625 - RNA, 39 nt, Artificial Sequence
  Synthetic Oligonucleotide; NDFIP1 exon 5; Set C
uuaauuagagagagaccaaauccugaaauggccccauac

SEQ ID NO: 37626 - RNA, 38 nt, Artificial Sequence
  Synthetic Oligonucleotide; NDFIP1 exon 5; Set A
uuaauuagagagagaccaaauccugaaauggccccaua

SEQ ID NO: 37627 - RNA, 40 nt, Artificial Sequence
  Synthetic Oligonucleotide; NDFIP1 exon 5; Set C
uuuaauuagagagagaccaaauccugaaauggccccauac

SEQ ID NO: 37628 - RNA, 18 nt, Artificial Sequence
  Synthetic Oligonucleotide; NDFIP1 exon 5; Set C
agagaccaaauccugaaa

SEQ ID NO: 37629 - RNA, 39 nt, Artificial Sequence
  Synthetic Oligonucleotide; NDFIP1 exon 5; Set A
uuuaauuagagagagaccaaauccugaaauggccccaua

SEQ ID NO: 37630 - RNA, 21 nt, Artificial Sequence
  Synthetic Oligonucleotide; NDFIP1 exon 5; Set C
agagagaccaaauccugaaau

SEQ ID NO: 37631 - RNA, 17 nt, Artificial Sequence
  Synthetic Oligonucleotide; NDFIP1 exon 5; Set C
agagaccaaauccugaa

SEQ ID NO: 37632 - RNA, 22 nt, Artificial Sequence
  Synthetic Oligonucleotide; NDFIP1 exon 5; Set C
gagagagaccaaauccugaaau

SEQ ID NO: 37633 - RNA, 18 nt, Artificial Sequence
  Synthetic Oligonucleotide; NDFIP1 exon 5; Set C
gagagaccaaauccugaa

SEQ ID NO: 37634 - RNA, 20 nt, Artificial Sequence
  Synthetic Oligonucleotide; NDFIP1 exon 5; Set C
agagagaccaaauccugaaa

SEQ ID NO: 37635 - RNA, 16 nt, Artificial Sequence
  Synthetic Oligonucleotide; NDFIP1 exon 5; Set C
agagaccaaauccuga

SEQ ID NO: 37636 - RNA, 23 nt, Artificial Sequence
  Synthetic Oligonucleotide; NDFIP1 exon 5; Set C
agagagagaccaaauccugaaau

SEQ ID NO: 37637 - RNA, 19 nt, Artificial Sequence
  Synthetic Oligonucleotide; NDFIP1 exon 5; Set C
agagagaccaaauccugaa

SEQ ID NO: 37638 - RNA, 21 nt, Artificial Sequence
  Synthetic Oligonucleotide; NDFIP1 exon 5; Set C
gagagagaccaaauccugaaa

SEQ ID NO: 37639 - RNA, 17 nt, Artificial Sequence
  Synthetic Oligonucleotide; NDFIP1 exon 5; Set C
gagagaccaaauccuga

SEQ ID NO: 37640 - RNA, 15 nt, Artificial Sequence
  Synthetic Oligonucleotide; NDFIP1 exon 5; Set C
agagaccaaauccug

SEQ ID NO: 37641 - RNA, 20 nt, Artificial Sequence
  Synthetic Oligonucleotide; NDFIP1 exon 5; Set C
gagagagaccaaauccugaa

SEQ ID NO: 37642 - RNA, 22 nt, Artificial Sequence
  Synthetic Oligonucleotide; NDFIP1 exon 5; Set C
agagagagaccaaauccugaaa

SEQ ID NO: 37643 - RNA, 18 nt, Artificial Sequence
  Synthetic Oligonucleotide; NDFIP1 exon 5; Set C
agagagaccaaauccuga

SEQ ID NO: 37644 - RNA, 16 nt, Artificial Sequence
  Synthetic Oligonucleotide; NDFIP1 exon 5; Set C
gagagaccaaauccug

SEQ ID NO: 37645 - RNA, 21 nt, Artificial Sequence
  Synthetic Oligonucleotide; NDFIP1 exon 5; Set C
agagagagaccaaauccugaa

SEQ ID NO: 37646 - RNA, 15 nt, Artificial Sequence
  Synthetic Oligonucleotide; NDFIP1 exon 5; Set C
gagagaccaaauccu

SEQ ID NO: 37647 - RNA, 19 nt, Artificial Sequence
  Synthetic Oligonucleotide; NDFIP1 exon 5; Set C
gagagagaccaaauccuga

SEQ ID NO: 37648 - RNA, 17 nt, Artificial Sequence
  Synthetic Oligonucleotide; NDFIP1 exon 5; Set C
agagagaccaaauccug

SEQ ID NO: 37649 - RNA, 16 nt, Artificial Sequence
  Synthetic Oligonucleotide; NDFIP1 exon 5; Set C
agagagaccaaauccu

SEQ ID NO: 37650 - RNA, 20 nt, Artificial Sequence
  Synthetic Oligonucleotide; NDFIP1 exon 5; Set C
agagagagaccaaauccuga

SEQ ID NO: 37651 - RNA, 18 nt, Artificial Sequence
  Synthetic Oligonucleotide; NDFIP1 exon 5; Set C
gagagagaccaaauccug

SEQ ID NO: 37652 - RNA, 15 nt, Artificial Sequence
  Synthetic Oligonucleotide; NDFIP1 exon 5; Set C
agagagaccaaaucc

SEQ ID NO: 37653 - RNA, 17 nt, Artificial Sequence
  Synthetic Oligonucleotide; NDFIP1 exon 5; Set C
gagagagaccaaauccu

SEQ ID NO: 37654 - RNA, 21 nt, Artificial Sequence
  Synthetic Oligonucleotide; NDFIP1 exon 5; Set C
uagagagagaccaaauccuga

SEQ ID NO: 37655 - RNA, 19 nt, Artificial Sequence
  Synthetic Oligonucleotide; NDFIP1 exon 5; Set C
agagagagaccaaauccug

SEQ ID NO: 37656 - RNA, 16 nt, Artificial Sequence
  Synthetic Oligonucleotide; NDFIP1 exon 5; Set C
gagagagaccaaaucc

SEQ ID NO: 37657 - RNA, 18 nt, Artificial Sequence
  Synthetic Oligonucleotide; NDFIP1 exon 5; Set C
agagagagaccaaauccu

SEQ ID NO: 37658 - RNA, 22 nt, Artificial Sequence
  Synthetic Oligonucleotide; NDFIP1 exon 5; Set C
uuagagagagaccaaauccuga

SEQ ID NO: 37659 - RNA, 20 nt, Artificial Sequence
  Synthetic Oligonucleotide; NDFIP1 exon 5; Set C
uagagagagaccaaauccug

SEQ ID NO: 37660 - RNA, 15 nt, Artificial Sequence
  Synthetic Oligonucleotide; NDFIP1 exon 5; Set C
gagagagaccaaauc

SEQ ID NO: 37661 - RNA, 17 nt, Artificial Sequence
  Synthetic Oligonucleotide; NDFIP1 exon 5; Set C
agagagagaccaaaucc

SEQ ID NO: 37662 - RNA, 19 nt, Artificial Sequence
  Synthetic Oligonucleotide; NDFIP1 exon 5; Set C
uagagagagaccaaauccu

SEQ ID NO: 37663 - RNA, 21 nt, Artificial Sequence
  Synthetic Oligonucleotide; NDFIP1 exon 5; Set C
uuagagagagaccaaauccug

SEQ ID NO: 37664 - RNA, 16 nt, Artificial Sequence
  Synthetic Oligonucleotide; NDFIP1 exon 5; Set C
agagagagaccaaauc

SEQ ID NO: 37665 - RNA, 31 nt, Artificial Sequence
  Synthetic Oligonucleotide; NDFIP1 exon 5; Set C
auuuaauuagagagagaccaaauccugaaau

SEQ ID NO: 37666 - RNA, 15 nt, Artificial Sequence
  Synthetic Oligonucleotide; NDFIP1 exon 5; Set C
agagagagaccaaau

SEQ ID NO: 37667 - RNA, 32 nt, Artificial Sequence
  Synthetic Oligonucleotide; NDFIP1 exon 5; Set C
cauuuaauuagagagagaccaaauccugaaau

SEQ ID NO: 37668 - RNA, 33 nt, Artificial Sequence
  Synthetic Oligonucleotide; NDFIP1 exon 5; Set C
ccauuuaauuagagagagaccaaauccugaaau

SEQ ID NO: 37669 - RNA, 15 nt, Artificial Sequence
  Synthetic Oligonucleotide; NDFIP1 exon 5; Set C
uuagagagagaccaa

SEQ ID NO: 37670 - RNA, 24 nt, Artificial Sequence
  Synthetic Oligonucleotide; NDFIP1 exon 5; Set C
auuuaauuagagagagaccaaauc

SEQ ID NO: 37671 - RNA, 23 nt, Artificial Sequence
  Synthetic Oligonucleotide; NDFIP1 exon 5; Set C
auuuaauuagagagagaccaaau

SEQ ID NO: 37672 - RNA, 25 nt, Artificial Sequence
  Synthetic Oligonucleotide; NDFIP1 exon 5; Set C
cauuuaauuagagagagaccaaauc

SEQ ID NO: 37673 - RNA, 24 nt, Artificial Sequence
  Synthetic Oligonucleotide; NDFIP1 exon 5; Set C
cauuuaauuagagagagaccaaau

SEQ ID NO: 37674 - RNA, 26 nt, Artificial Sequence
  Synthetic Oligonucleotide; NDFIP1 exon 5; Set C
ccauuuaauuagagagagaccaaauc

SEQ ID NO: 37675 - RNA, 25 nt, Artificial Sequence
  Synthetic Oligonucleotide; NDFIP1 exon 5; Set C
ccauuuaauuagagagagaccaaau

SEQ ID NO: 37676 - RNA, 15 nt, Artificial Sequence
  Synthetic Oligonucleotide; NDFIP1 exon 5; Set C
uaauuagagagagac

SEQ ID NO: 37677 - RNA, 24 nt, Artificial Sequence
  Synthetic Oligonucleotide; NDFIP1 exon 5; Set C
ccauuuaauuagagagagaccaaa

SEQ ID NO: 37678 - RNA, 40 nt, Artificial Sequence
  Synthetic Oligonucleotide; NDFIP1 exon 5; Set A
aaucaggauccauuuaauuagagagagaccaaauccugaa

SEQ ID NO: 37679 - RNA, 39 nt, Artificial Sequence
  Synthetic Oligonucleotide; NDFIP1 exon 5; Set A
aaucaggauccauuuaauuagagagagaccaaauccuga

SEQ ID NO: 37680 - RNA, 15 nt, Artificial Sequence
  Synthetic Oligonucleotide; NDFIP1 exon 5; Set C
uuuaauuagagagag

SEQ ID NO: 37681 - RNA, 40 nt, Artificial Sequence
  Synthetic Oligonucleotide; NDFIP1 exon 5; Set A
caaucaggauccauuuaauuagagagagaccaaauccuga

SEQ ID NO: 37682 - RNA, 38 nt, Artificial Sequence
  Synthetic Oligonucleotide; NDFIP1 exon 5; Set A
aaucaggauccauuuaauuagagagagaccaaauccug

SEQ ID NO: 37683 - RNA, 37 nt, Artificial Sequence
  Synthetic Oligonucleotide; NDFIP1 exon 5; Set A
aaucaggauccauuuaauuagagagagaccaaauccu

SEQ ID NO: 37684 - RNA, 39 nt, Artificial Sequence
  Synthetic Oligonucleotide; NDFIP1 exon 5; Set A
caaucaggauccauuuaauuagagagagaccaaauccug

SEQ ID NO: 37685 - RNA, 36 nt, Artificial Sequence
  Synthetic Oligonucleotide; NDFIP1 exon 5; Set A
aaucaggauccauuuaauuagagagagaccaaaucc

SEQ ID NO: 37686 - RNA, 38 nt, Artificial Sequence
  Synthetic Oligonucleotide; NDFIP1 exon 5; Set A
caaucaggauccauuuaauuagagagagaccaaauccu

SEQ ID NO: 37687 - RNA, 40 nt, Artificial Sequence
  Synthetic Oligonucleotide; NDFIP1 exon 5; Set A
acaaucaggauccauuuaauuagagagagaccaaauccug

SEQ ID NO: 37688 - RNA, 35 nt, Artificial Sequence
  Synthetic Oligonucleotide; NDFIP1 exon 5; Set A
aaucaggauccauuuaauuagagagagaccaaauc

SEQ ID NO: 37689 - RNA, 15 nt, Artificial Sequence
  Synthetic Oligonucleotide; NDFIP1 exon 5; Set C
cauuuaauuagagag

SEQ ID NO: 37690 - RNA, 37 nt, Artificial Sequence
  Synthetic Oligonucleotide; NDFIP1 exon 5; Set A
caaucaggauccauuuaauuagagagagaccaaaucc

SEQ ID NO: 37691 - RNA, 39 nt, Artificial Sequence
  Synthetic Oligonucleotide; NDFIP1 exon 5; Set A
acaaucaggauccauuuaauuagagagagaccaaauccu

SEQ ID NO: 37692 - RNA, 34 nt, Artificial Sequence
  Synthetic Oligonucleotide; NDFIP1 exon 5; Set A
aaucaggauccauuuaauuagagagagaccaaau

SEQ ID NO: 37693 - RNA, 36 nt, Artificial Sequence
  Synthetic Oligonucleotide; NDFIP1 exon 5; Set A
caaucaggauccauuuaauuagagagagaccaaauc

SEQ ID NO: 37694 - RNA, 16 nt, Artificial Sequence
  Synthetic Oligonucleotide; NDFIP1 exon 5; Set C
ccauuuaauuagagag

SEQ ID NO: 37695 - RNA, 38 nt, Artificial Sequence
  Synthetic Oligonucleotide; NDFIP1 exon 5; Set A
acaaucaggauccauuuaauuagagagagaccaaaucc

SEQ ID NO: 37696 - RNA, 35 nt, Artificial Sequence
  Synthetic Oligonucleotide; NDFIP1 exon 5; Set A
caaucaggauccauuuaauuagagagagaccaaau

SEQ ID NO: 37697 - RNA, 37 nt, Artificial Sequence
  Synthetic Oligonucleotide; NDFIP1 exon 5; Set A
acaaucaggauccauuuaauuagagagagaccaaauc

SEQ ID NO: 37698 - RNA, 33 nt, Artificial Sequence
  Synthetic Oligonucleotide; NDFIP1 exon 5; Set A
aaucaggauccauuuaauuagagagagaccaaa

SEQ ID NO: 37699 - RNA, 36 nt, Artificial Sequence
  Synthetic Oligonucleotide; NDFIP1 exon 5; Set A
acaaucaggauccauuuaauuagagagagaccaaau

SEQ ID NO: 37700 - RNA, 34 nt, Artificial Sequence
  Synthetic Oligonucleotide; NDFIP1 exon 5; Set A
caaucaggauccauuuaauuagagagagaccaaa

SEQ ID NO: 37701 - RNA, 32 nt, Artificial Sequence
  Synthetic Oligonucleotide; NDFIP1 exon 5; Set A
aaucaggauccauuuaauuagagagagaccaa

SEQ ID NO: 37702 - RNA, 35 nt, Artificial Sequence
  Synthetic Oligonucleotide; NDFIP1 exon 5; Set A
acaaucaggauccauuuaauuagagagagaccaaa

SEQ ID NO: 37703 - RNA, 33 nt, Artificial Sequence
  Synthetic Oligonucleotide; NDFIP1 exon 5; Set A
caaucaggauccauuuaauuagagagagaccaa

SEQ ID NO: 37704 - RNA, 34 nt, Artificial Sequence
  Synthetic Oligonucleotide; NDFIP1 exon 5; Set A
acaaucaggauccauuuaauuagagagagaccaa

SEQ ID NO: 37705 - RNA, 25 nt, Artificial Sequence
  Synthetic Oligonucleotide; NDFIP1 exon 5; Set C
aaucaggauccauuuaauuagagag

SEQ ID NO: 37706 - RNA, 26 nt, Artificial Sequence
  Synthetic Oligonucleotide; NDFIP1 exon 5; Set C
caaucaggauccauuuaauuagagag

SEQ ID NO: 37707 - RNA, 24 nt, Artificial Sequence
  Synthetic Oligonucleotide; NDFIP1 exon 5; Set C
aaucaggauccauuuaauuagaga

SEQ ID NO: 37708 - RNA, 27 nt, Artificial Sequence
  Synthetic Oligonucleotide; NDFIP1 exon 5; Set C
acaaucaggauccauuuaauuagagag

SEQ ID NO: 37709 - RNA, 25 nt, Artificial Sequence
  Synthetic Oligonucleotide; NDFIP1 exon 5; Set C
caaucaggauccauuuaauuagaga

SEQ ID NO: 37710 - RNA, 26 nt, Artificial Sequence
  Synthetic Oligonucleotide; NDFIP1 exon 5; Set C
acaaucaggauccauuuaauuagaga

SEQ ID NO: 37711 - RNA, 24 nt, Artificial Sequence
  Synthetic Oligonucleotide; NDFIP1 exon 5; Set C
caaucaggauccauuuaauuagag

SEQ ID NO: 37712 - RNA, 21 nt, Artificial Sequence
  Synthetic Oligonucleotide; NDFIP1 exon 5; Set C
aaucaggauccauuuaauuag

SEQ ID NO: 37713 - RNA, 25 nt, Artificial Sequence
  Synthetic Oligonucleotide; NDFIP1 exon 5; Set C
acaaucaggauccauuuaauuagag

SEQ ID NO: 37714 - RNA, 20 nt, Artificial Sequence
  Synthetic Oligonucleotide; NDFIP1 exon 5; Set C
aaucaggauccauuuaauua

SEQ ID NO: 37715 - RNA, 22 nt, Artificial Sequence
  Synthetic Oligonucleotide; NDFIP1 exon 5; Set C
caaucaggauccauuuaauuag

SEQ ID NO: 37716 - RNA, 19 nt, Artificial Sequence
  Synthetic Oligonucleotide; NDFIP1 exon 5; Set C
aaucaggauccauuuaauu

SEQ ID NO: 37717 - RNA, 21 nt, Artificial Sequence
  Synthetic Oligonucleotide; NDFIP1 exon 5; Set C
caaucaggauccauuuaauua

SEQ ID NO: 37718 - RNA, 23 nt, Artificial Sequence
  Synthetic Oligonucleotide; NDFIP1 exon 5; Set C
acaaucaggauccauuuaauuag

SEQ ID NO: 37719 - RNA, 18 nt, Artificial Sequence
  Synthetic Oligonucleotide; NDFIP1 exon 5; Set C
aaucaggauccauuuaau

SEQ ID NO: 37720 - RNA, 20 nt, Artificial Sequence
  Synthetic Oligonucleotide; NDFIP1 exon 5; Set C
caaucaggauccauuuaauu

SEQ ID NO: 37721 - RNA, 22 nt, Artificial Sequence
  Synthetic Oligonucleotide; NDFIP1 exon 5; Set C
acaaucaggauccauuuaauua

SEQ ID NO: 37722 - RNA, 17 nt, Artificial Sequence
  Synthetic Oligonucleotide; NDFIP1 exon 5; Set C
aaucaggauccauuuaa

SEQ ID NO: 37723 - RNA, 19 nt, Artificial Sequence
  Synthetic Oligonucleotide; NDFIP1 exon 5; Set C
caaucaggauccauuuaau

SEQ ID NO: 37724 - RNA, 21 nt, Artificial Sequence
  Synthetic Oligonucleotide; NDFIP1 exon 5; Set C
acaaucaggauccauuuaauu

SEQ ID NO: 37725 - RNA, 18 nt, Artificial Sequence
  Synthetic Oligonucleotide; NDFIP1 exon 5; Set C
caaucaggauccauuuaa

SEQ ID NO: 37726 - RNA, 20 nt, Artificial Sequence
  Synthetic Oligonucleotide; NDFIP1 exon 5; Set C
acaaucaggauccauuuaau

SEQ ID NO: 37727 - RNA, 19 nt, Artificial Sequence
  Synthetic Oligonucleotide; NDFIP1 exon 5; Set C
acaaucaggauccauuuaa

SEQ ID NO: 37728 - RNA, 17 nt, Artificial Sequence
  Synthetic Oligonucleotide; NDFIP1 exon 5; Set C
caaucaggauccauuua

SEQ ID NO: 37729 - RNA, 18 nt, Artificial Sequence
  Synthetic Oligonucleotide; NDFIP1 exon 5; Set C
acaaucaggauccauuua

SEQ ID NO: 37730 - RNA, 17 nt, Artificial Sequence
  Synthetic Oligonucleotide; NDFIP1 exon 5; Set C
acaaucaggauccauuu

SEQ ID NO: 37731 - RNA, 40 nt, Artificial Sequence
  Synthetic Oligonucleotide; NDFIP1 exon 5; Set C
guagagcccaucuuuucuguuauacaacuuacccugacaa

SEQ ID NO: 37732 - RNA, 16 nt, Artificial Sequence
  Synthetic Oligonucleotide; NDFIP1 exon 5; Set C
ccaucuuuucuguuau

SEQ ID NO: 37733 - RNA, 15 nt, Artificial Sequence
  Synthetic Oligonucleotide; NDFIP1 exon 5; Set C
ccaucuuuucuguua

SEQ ID NO: 37734 - RNA, 23 nt, Artificial Sequence
  Synthetic Oligonucleotide; NDFIP1 exon 5; Set C
agagcccaucuuuucuguuauac

SEQ ID NO: 37735 - RNA, 22 nt, Artificial Sequence
  Synthetic Oligonucleotide; NDFIP1 exon 5; Set C
agagcccaucuuuucuguuaua

SEQ ID NO: 37736 - RNA, 21 nt, Artificial Sequence
  Synthetic Oligonucleotide; NDFIP1 exon 5; Set C
agagcccaucuuuucuguuau

SEQ ID NO: 37737 - RNA, 20 nt, Artificial Sequence
  Synthetic Oligonucleotide; NDFIP1 exon 5; Set C
agagcccaucuuuucuguua

SEQ ID NO: 37738 - RNA, 21 nt, Artificial Sequence
  Synthetic Oligonucleotide; NDFIP1 exon 5; Set C
uagagcccaucuuuucuguua

SEQ ID NO: 37739 - RNA, 19 nt, Artificial Sequence
  Synthetic Oligonucleotide; NDFIP1 exon 5; Set C
agagcccaucuuuucuguu

SEQ ID NO: 37740 - RNA, 20 nt, Artificial Sequence
  Synthetic Oligonucleotide; NDFIP1 exon 5; Set C
uagagcccaucuuuucuguu

SEQ ID NO: 37741 - RNA, 16 nt, Artificial Sequence
  Synthetic Oligonucleotide; NDFIP1 exon 5; Set C
uagagcccaucuuuuc

SEQ ID NO: 37742 - RNA, 15 nt, Artificial Sequence
  Synthetic Oligonucleotide; NDFIP1 exon 5; Set C
uagagcccaucuuuu

SEQ ID NO: 37743 - RNA, 17 nt, Artificial Sequence
  Synthetic Oligonucleotide; NDFIP1 exon 5; Set C
guagagcccaucuuuuc

SEQ ID NO: 37744 - RNA, 16 nt, Artificial Sequence
  Synthetic Oligonucleotide; NDFIP1 exon 5; Set C
guagagcccaucuuuu

SEQ ID NO: 37745 - RNA, 15 nt, Artificial Sequence
  Synthetic Oligonucleotide; NDFIP1 exon 5; Set C
guagagcccaucuuu

SEQ ID NO: 37746 - RNA, 18 nt, Artificial Sequence
  Synthetic Oligonucleotide; NDFIP1 exon 5; Set C
aaagcagaggaggggaaa

SEQ ID NO: 37747 - RNA, 19 nt, Artificial Sequence
  Synthetic Oligonucleotide; NDFIP1 exon 5; Set C
aaaagcagaggaggggaaa

SEQ ID NO: 37748 - RNA, 16 nt, Artificial Sequence
  Synthetic Oligonucleotide; NDFIP1 exon 5; Set C
aaagcagaggagggga

SEQ ID NO: 37749 - RNA, 17 nt, Artificial Sequence
  Synthetic Oligonucleotide; NDFIP1 exon 5; Set C
aaaagcagaggagggga

SEQ ID NO: 37750 - RNA, 16 nt, Artificial Sequence
  Synthetic Oligonucleotide; NDFIP1 exon 5; Set C
aaaagcagaggagggg

SEQ ID NO: 37751 - RNA, 34 nt, Artificial Sequence
  Synthetic Oligonucleotide; NDFIP1 exon 5; Set C
agaggaaugccacugcaaaagcagaggaggggaa

SEQ ID NO: 37752 - RNA, 35 nt, Artificial Sequence
  Synthetic Oligonucleotide; NDFIP1 exon 5; Set C
aagaggaaugccacugcaaaagcagaggaggggaa

SEQ ID NO: 37753 - RNA, 36 nt, Artificial Sequence
  Synthetic Oligonucleotide; NDFIP1 exon 5; Set C
aaagaggaaugccacugcaaaagcagaggaggggaa

SEQ ID NO: 37754 - RNA, 37 nt, Artificial Sequence
  Synthetic Oligonucleotide; NDFIP1 exon 5; Set C
uaaagaggaaugccacugcaaaagcagaggaggggaa

SEQ ID NO: 37755 - RNA, 35 nt, Artificial Sequence
  Synthetic Oligonucleotide; NDFIP1 exon 5; Set C
aaagaggaaugccacugcaaaagcagaggagggga

SEQ ID NO: 37756 - RNA, 38 nt, Artificial Sequence
  Synthetic Oligonucleotide; NDFIP1 exon 5; Set C
uuaaagaggaaugccacugcaaaagcagaggaggggaa

SEQ ID NO: 37757 - RNA, 36 nt, Artificial Sequence
  Synthetic Oligonucleotide; NDFIP1 exon 5; Set C
uaaagaggaaugccacugcaaaagcagaggagggga

SEQ ID NO: 37758 - RNA, 39 nt, Artificial Sequence
  Synthetic Oligonucleotide; NDFIP1 exon 5; Set C
guuaaagaggaaugccacugcaaaagcagaggaggggaa

SEQ ID NO: 37759 - RNA, 37 nt, Artificial Sequence
  Synthetic Oligonucleotide; NDFIP1 exon 5; Set C
uuaaagaggaaugccacugcaaaagcagaggagggga

SEQ ID NO: 37760 - RNA, 38 nt, Artificial Sequence
  Synthetic Oligonucleotide; NDFIP1 exon 5; Set C
guuaaagaggaaugccacugcaaaagcagaggagggga

SEQ ID NO: 37761 - RNA, 39 nt, Artificial Sequence
  Synthetic Oligonucleotide; NDFIP1 exon 5; Set C
aguuaaagaggaaugccacugcaaaagcagaggagggga

SEQ ID NO: 37762 - RNA, 38 nt, Artificial Sequence
  Synthetic Oligonucleotide; NDFIP1 exon 5; Set C
aguuaaagaggaaugccacugcaaaagcagaggagggg

SEQ ID NO: 37763 - RNA, 20 nt, Artificial Sequence
  Synthetic Oligonucleotide; NDFIP1 exon 5; Set C
agaggaaugccacugcaaaa

SEQ ID NO: 37764 - RNA, 21 nt, Artificial Sequence
  Synthetic Oligonucleotide; NDFIP1 exon 5; Set C
aagaggaaugccacugcaaaa

SEQ ID NO: 37765 - RNA, 22 nt, Artificial Sequence
  Synthetic Oligonucleotide; NDFIP1 exon 5; Set C
aaagaggaaugccacugcaaaa

SEQ ID NO: 37766 - RNA, 20 nt, Artificial Sequence
  Synthetic Oligonucleotide; NDFIP1 exon 5; Set C
aagaggaaugccacugcaaa

SEQ ID NO: 37767 - RNA, 23 nt, Artificial Sequence
  Synthetic Oligonucleotide; NDFIP1 exon 5; Set C
uaaagaggaaugccacugcaaaa

SEQ ID NO: 37768 - RNA, 21 nt, Artificial Sequence
  Synthetic Oligonucleotide; NDFIP1 exon 5; Set C
aaagaggaaugccacugcaaa

SEQ ID NO: 37769 - RNA, 24 nt, Artificial Sequence
  Synthetic Oligonucleotide; NDFIP1 exon 5; Set C
uuaaagaggaaugccacugcaaaa

SEQ ID NO: 37770 - RNA, 22 nt, Artificial Sequence
  Synthetic Oligonucleotide; NDFIP1 exon 5; Set C
uaaagaggaaugccacugcaaa

SEQ ID NO: 37771 - RNA, 23 nt, Artificial Sequence
  Synthetic Oligonucleotide; NDFIP1 exon 5; Set C
uuaaagaggaaugccacugcaaa

SEQ ID NO: 37772 - RNA, 30 nt, Artificial Sequence
  Synthetic Oligonucleotide; NDFIP1 exon 5; Set A
auccaguuaaagaggaaugccacugcaaaa

SEQ ID NO: 37773 - RNA, 31 nt, Artificial Sequence
  Synthetic Oligonucleotide; NDFIP1 exon 5; Set A
aauccaguuaaagaggaaugccacugcaaaa

SEQ ID NO: 37774 - RNA, 29 nt, Artificial Sequence
  Synthetic Oligonucleotide; NDFIP1 exon 5; Set A
auccaguuaaagaggaaugccacugcaaa

SEQ ID NO: 37775 - RNA, 30 nt, Artificial Sequence
  Synthetic Oligonucleotide; NDFIP1 exon 5; Set A
aauccaguuaaagaggaaugccacugcaaa

SEQ ID NO: 37776 - RNA, 31 nt, Artificial Sequence
  Synthetic Oligonucleotide; NDFIP1 exon 5; Set A
caauccaguuaaagaggaaugccacugcaaa

SEQ ID NO: 37777 - RNA, 39 nt, Artificial Sequence
  Synthetic Oligonucleotide; NDFIP1 exon 5; Set A
aaaaacccaauccaguuaaagaggaaugccacugcaaaa

SEQ ID NO: 37778 - RNA, 38 nt, Artificial Sequence
  Synthetic Oligonucleotide; NDFIP1 exon 5; Set A
aaaaacccaauccaguuaaagaggaaugccacugcaaa

SEQ ID NO: 37779 - RNA, 19 nt, Artificial Sequence
  Synthetic Oligonucleotide; NDFIP1 exon 5; Set C
auccaguuaaagaggaaug

SEQ ID NO: 37780 - RNA, 20 nt, Artificial Sequence
  Synthetic Oligonucleotide; NDFIP1 exon 5; Set C
aauccaguuaaagaggaaug

SEQ ID NO: 37781 - RNA, 21 nt, Artificial Sequence
  Synthetic Oligonucleotide; NDFIP1 exon 5; Set C
caauccaguuaaagaggaaug

SEQ ID NO: 37782 - RNA, 26 nt, Artificial Sequence
  Synthetic Oligonucleotide; NDFIP1 exon 5; Set C
aaacccaauccaguuaaagaggaaug

SEQ ID NO: 37783 - RNA, 28 nt, Artificial Sequence
  Synthetic Oligonucleotide; NDFIP1 exon 5; Set C
aaaaacccaauccaguuaaagaggaaug

SEQ ID NO: 37784 - RNA, 33 nt, Artificial Sequence
  Synthetic Oligonucleotide; NDFIP1 exon 5; Set A
acaggaaaaacccaauccaguuaaagaggaaug

SEQ ID NO: 37785 - RNA, 22 nt, Artificial Sequence
  Synthetic Oligonucleotide; NDFIP1 exon 5; Set C
aaaaacccaauccaguuaaaga

SEQ ID NO: 37786 - RNA, 21 nt, Artificial Sequence
  Synthetic Oligonucleotide; NDFIP1 exon 5; Set C
aaaaacccaauccaguuaaag

SEQ ID NO: 37787 - RNA, 38 nt, Artificial Sequence
  Synthetic Oligonucleotide; NDFIP1 exon 5; Set A
aaaagacaggaaaaacccaauccaguuaaagaggaaug

SEQ ID NO: 37788 - RNA, 27 nt, Artificial Sequence
  Synthetic Oligonucleotide; NDFIP1 exon 5; Set C
acaggaaaaacccaauccaguuaaaga

SEQ ID NO: 37789 - RNA, 16 nt, Artificial Sequence
  Synthetic Oligonucleotide; NDFIP1 exon 5; Set C
aaaaacccaauccagu

SEQ ID NO: 37790 - RNA, 26 nt, Artificial Sequence
  Synthetic Oligonucleotide; NDFIP1 exon 5; Set C
acaggaaaaacccaauccaguuaaag

SEQ ID NO: 37791 - RNA, 31 nt, Artificial Sequence
  Synthetic Oligonucleotide; NDFIP1 exon 5; Set C
aaaagacaggaaaaacccaauccaguuaaag

SEQ ID NO: 37792 - RNA, 33 nt, Artificial Sequence
  Synthetic Oligonucleotide; NDFIP1 exon 5; Set C
aaaaagacaggaaaaacccaauccaguuaaaga

SEQ ID NO: 37793 - RNA, 32 nt, Artificial Sequence
  Synthetic Oligonucleotide; NDFIP1 exon 5; Set C
aaaaagacaggaaaaacccaauccaguuaaag

SEQ ID NO: 37794 - RNA, 31 nt, Artificial Sequence
  Synthetic Oligonucleotide; NDFIP1 exon 5; Set C
aaaaagacaggaaaaacccaauccaguuaaa

SEQ ID NO: 37795 - RNA, 30 nt, Artificial Sequence
  Synthetic Oligonucleotide; NDFIP1 exon 5; Set C
aaaaagacaggaaaaacccaauccaguuaa

SEQ ID NO: 37796 - RNA, 32 nt, Artificial Sequence
  Synthetic Oligonucleotide; NDFIP1 exon 5; Set C
caaaaagacaggaaaaacccaauccaguuaaa

SEQ ID NO: 37797 - RNA, 29 nt, Artificial Sequence
  Synthetic Oligonucleotide; NDFIP1 exon 5; Set C
aaaaagacaggaaaaacccaauccaguua

SEQ ID NO: 37798 - RNA, 31 nt, Artificial Sequence
  Synthetic Oligonucleotide; NDFIP1 exon 5; Set C
caaaaagacaggaaaaacccaauccaguuaa

SEQ ID NO: 37799 - RNA, 17 nt, Artificial Sequence
  Synthetic Oligonucleotide; NDFIP1 exon 5; Set C
acaggaaaaacccaauc

SEQ ID NO: 37800 - RNA, 28 nt, Artificial Sequence
  Synthetic Oligonucleotide; NDFIP1 exon 5; Set C
aaaaagacaggaaaaacccaauccaguu

SEQ ID NO: 37801 - RNA, 30 nt, Artificial Sequence
  Synthetic Oligonucleotide; NDFIP1 exon 5; Set C
caaaaagacaggaaaaacccaauccaguua

SEQ ID NO: 37802 - RNA, 16 nt, Artificial Sequence
  Synthetic Oligonucleotide; NDFIP1 exon 5; Set C
acaggaaaaacccaau

SEQ ID NO: 37803 - RNA, 27 nt, Artificial Sequence
  Synthetic Oligonucleotide; NDFIP1 exon 5; Set C
aaaaagacaggaaaaacccaauccagu

SEQ ID NO: 37804 - RNA, 29 nt, Artificial Sequence
  Synthetic Oligonucleotide; NDFIP1 exon 5; Set C
caaaaagacaggaaaaacccaauccaguu

SEQ ID NO: 37805 - RNA, 15 nt, Artificial Sequence
  Synthetic Oligonucleotide; NDFIP1 exon 5; Set C
acaggaaaaacccaa

SEQ ID NO: 37806 - RNA, 28 nt, Artificial Sequence
  Synthetic Oligonucleotide; NDFIP1 exon 5; Set C
caaaaagacaggaaaaacccaauccagu

SEQ ID NO: 37807 - RNA, 40 nt, Artificial Sequence
  Synthetic Oligonucleotide; NDFIP1 exon 5; Set A
ggucaggcaaaaagacaggaaaaacccaauccaguuaaag

SEQ ID NO: 37808 - RNA, 22 nt, Artificial Sequence
  Synthetic Oligonucleotide; NDFIP1 exon 5; Set C
aaaagacaggaaaaacccaauc

SEQ ID NO: 37809 - RNA, 21 nt, Artificial Sequence
  Synthetic Oligonucleotide; NDFIP1 exon 5; Set C
aaaagacaggaaaaacccaau

SEQ ID NO: 37810 - RNA, 20 nt, Artificial Sequence
  Synthetic Oligonucleotide; NDFIP1 exon 5; Set C
aaaagacaggaaaaacccaa

SEQ ID NO: 37811 - RNA, 37 nt, Artificial Sequence
  Synthetic Oligonucleotide; NDFIP1 exon 5; Set A
ggucaggcaaaaagacaggaaaaacccaauccaguua

SEQ ID NO: 37812 - RNA, 35 nt, Artificial Sequence
  Synthetic Oligonucleotide; NDFIP1 exon 5; Set A
ggucaggcaaaaagacaggaaaaacccaauccagu

SEQ ID NO: 37813 - RNA, 40 nt, Artificial Sequence
  Synthetic Oligonucleotide; NDFIP1 exon 5; Set A
aaguggucaggcaaaaagacaggaaaaacccaauccaguu

SEQ ID NO: 37814 - RNA, 16 nt, Artificial Sequence
  Synthetic Oligonucleotide; NDFIP1 exon 5; Set C
aaaaagacaggaaaaa

SEQ ID NO: 37815 - RNA, 15 nt, Artificial Sequence
  Synthetic Oligonucleotide; NDFIP1 exon 5; Set C
aaaaagacaggaaaa

SEQ ID NO: 37816 - RNA, 39 nt, Artificial Sequence
  Synthetic Oligonucleotide; NDFIP1 exon 5; Set A
aaguggucaggcaaaaagacaggaaaaacccaauccagu

SEQ ID NO: 37817 - RNA, 17 nt, Artificial Sequence
  Synthetic Oligonucleotide; NDFIP1 exon 5; Set C
caaaaagacaggaaaaa

SEQ ID NO: 37818 - RNA, 31 nt, Artificial Sequence
  Synthetic Oligonucleotide; NDFIP1 exon 5; Set A
ggucaggcaaaaagacaggaaaaacccaauc

SEQ ID NO: 37819 - RNA, 16 nt, Artificial Sequence
  Synthetic Oligonucleotide; NDFIP1 exon 5; Set C
caaaaagacaggaaaa

SEQ ID NO: 37820 - RNA, 30 nt, Artificial Sequence
  Synthetic Oligonucleotide; NDFIP1 exon 5; Set A
ggucaggcaaaaagacaggaaaaacccaau

SEQ ID NO: 37821 - RNA, 32 nt, Artificial Sequence
  Synthetic Oligonucleotide; NDFIP1 exon 5; Set A
uggucaggcaaaaagacaggaaaaacccaauc

SEQ ID NO: 37822 - RNA, 29 nt, Artificial Sequence
  Synthetic Oligonucleotide; NDFIP1 exon 5; Set A
ggucaggcaaaaagacaggaaaaacccaa

SEQ ID NO: 37823 - RNA, 33 nt, Artificial Sequence
  Synthetic Oligonucleotide; NDFIP1 exon 5; Set A
guggucaggcaaaaagacaggaaaaacccaauc

SEQ ID NO: 37824 - RNA, 18 nt, Artificial Sequence
  Synthetic Oligonucleotide; NDFIP1 exon 5; Set C
ggcaaaaagacaggaaaa

SEQ ID NO: 37825 - RNA, 34 nt, Artificial Sequence
  Synthetic Oligonucleotide; NDFIP1 exon 5; Set A
aaguggucaggcaaaaagacaggaaaaacccaau

SEQ ID NO: 37826 - RNA, 33 nt, Artificial Sequence
  Synthetic Oligonucleotide; NDFIP1 exon 5; Set A
aaguggucaggcaaaaagacaggaaaaacccaa

SEQ ID NO: 37827 - RNA, 22 nt, Artificial Sequence
  Synthetic Oligonucleotide; NDFIP1 exon 5; Set C
ggucaggcaaaaagacaggaaa

SEQ ID NO: 37828 - RNA, 23 nt, Artificial Sequence
  Synthetic Oligonucleotide; NDFIP1 exon 5; Set C
uggucaggcaaaaagacaggaaa

SEQ ID NO: 37829 - RNA, 28 nt, Artificial Sequence
  Synthetic Oligonucleotide; NDFIP1 exon 5; Set C
aaguggucaggcaaaaagacaggaaaaa

SEQ ID NO: 37830 - RNA, 27 nt, Artificial Sequence
  Synthetic Oligonucleotide; NDFIP1 exon 5; Set C
aaguggucaggcaaaaagacaggaaaa

SEQ ID NO: 37831 - RNA, 21 nt, Artificial Sequence
  Synthetic Oligonucleotide; NDFIP1 exon 5; Set C
aaguggucaggcaaaaagaca

SEQ ID NO: 37832 - RNA, 15 nt, Artificial Sequence
  Synthetic Oligonucleotide; NDFIP1 exon 5; Set C
guggucaggcaaaaa

SEQ ID NO: 37833 - RNA, 16 nt, Artificial Sequence
  Synthetic Oligonucleotide; NDFIP1 exon 5; Set C
aguggucaggcaaaaa

SEQ ID NO: 37834 - RNA, 39 nt, Artificial Sequence
  Synthetic Oligonucleotide; NDFIP1 exon 5; Set C
uccugcagcugaaguggucaggcaaaaagacaggaaaaa

SEQ ID NO: 37835 - RNA, 38 nt, Artificial Sequence
  Synthetic Oligonucleotide; NDFIP1 exon 5; Set C
uccugcagcugaaguggucaggcaaaaagacaggaaaa

SEQ ID NO: 37836 - RNA, 40 nt, Artificial Sequence
  Synthetic Oligonucleotide; NDFIP1 exon 5; Set C
uuccugcagcugaaguggucaggcaaaaagacaggaaaaa

SEQ ID NO: 37837 - RNA, 16 nt, Artificial Sequence
  Synthetic Oligonucleotide; NDFIP1 exon 5; Set C
aaguggucaggcaaaa

SEQ ID NO: 37838 - RNA, 39 nt, Artificial Sequence
  Synthetic Oligonucleotide; NDFIP1 exon 5; Set C
uuccugcagcugaaguggucaggcaaaaagacaggaaaa

SEQ ID NO: 37839 - RNA, 15 nt, Artificial Sequence
  Synthetic Oligonucleotide; NDFIP1 exon 5; Set C
aaguggucaggcaaa

SEQ ID NO: 37840 - RNA, 40 nt, Artificial Sequence
  Synthetic Oligonucleotide; NDFIP1 exon 5; Set C
cuuccugcagcugaaguggucaggcaaaaagacaggaaaa

SEQ ID NO: 37841 - RNA, 32 nt, Artificial Sequence
  Synthetic Oligonucleotide; NDFIP1 exon 5; Set C
uccugcagcugaaguggucaggcaaaaagaca

SEQ ID NO: 37842 - RNA, 27 nt, Artificial Sequence
  Synthetic Oligonucleotide; NDFIP1 exon 5; Set A
uccugcagcugaaguggucaggcaaaa

SEQ ID NO: 37843 - RNA, 32 nt, Artificial Sequence
  Synthetic Oligonucleotide; NDFIP1 exon 5; Set C
uaccuuccugcagcugaaguggucaggcaaaa

SEQ ID NO: 37844 - RNA, 31 nt, Artificial Sequence
  Synthetic Oligonucleotide; NDFIP1 exon 5; Set C
uaccuuccugcagcugaaguggucaggcaaa

SEQ ID NO: 37845 - RNA, 32 nt, Artificial Sequence
  Synthetic Oligonucleotide; NDFIP1 exon 5; Set C
auaccuuccugcagcugaaguggucaggcaaa

SEQ ID NO: 37846 - RNA, 18 nt, Artificial Sequence
  Synthetic Oligonucleotide; NDFIP1 exon 5; Set C
uccugcagcugaaguggu

SEQ ID NO: 37847 - RNA, 17 nt, Artificial Sequence
  Synthetic Oligonucleotide; NDFIP1 exon 5; Set C
uccugcagcugaagugg

SEQ ID NO: 37848 - RNA, 16 nt, Artificial Sequence
  Synthetic Oligonucleotide; NDFIP1 exon 5; Set C
uccugcagcugaagug

SEQ ID NO: 37849 - RNA, 18 nt, Artificial Sequence
  Synthetic Oligonucleotide; NDFIP1 exon 5; Set C
uuccugcagcugaagugg

SEQ ID NO: 37850 - RNA, 15 nt, Artificial Sequence
  Synthetic Oligonucleotide; NDFIP1 exon 5; Set C
uccugcagcugaagu

SEQ ID NO: 37851 - RNA, 17 nt, Artificial Sequence
  Synthetic Oligonucleotide; NDFIP1 exon 5; Set C
uuccugcagcugaagug

SEQ ID NO: 37852 - RNA, 20 nt, Artificial Sequence
  Synthetic Oligonucleotide; NDFIP1 exon 5; Set A
ccuuccugcagcugaagugg

SEQ ID NO: 37853 - RNA, 21 nt, Artificial Sequence
  Synthetic Oligonucleotide; NDFIP1 exon 5; Set A
accuuccugcagcugaagugg

SEQ ID NO: 37854 - RNA, 19 nt, Artificial Sequence
  Synthetic Oligonucleotide; NDFIP1 exon 5; Set C
ccuuccugcagcugaagug

SEQ ID NO: 37855 - RNA, 23 nt, Artificial Sequence
  Synthetic Oligonucleotide; NDFIP1 exon 5; Set A
uaccuuccugcagcugaaguggu

SEQ ID NO: 37856 - RNA, 20 nt, Artificial Sequence
  Synthetic Oligonucleotide; NDFIP1 exon 5; Set A
accuuccugcagcugaagug

SEQ ID NO: 37857 - RNA, 24 nt, Artificial Sequence
  Synthetic Oligonucleotide; NDFIP1 exon 5; Set A
auaccuuccugcagcugaaguggu

SEQ ID NO: 37858 - RNA, 19 nt, Artificial Sequence
  Synthetic Oligonucleotide; NDFIP1 exon 5; Set A
accuuccugcagcugaagu

SEQ ID NO: 37859 - RNA, 24 nt, Artificial Sequence
  Synthetic Oligonucleotide; NDFIP1 exon 5; Set A
cauaccuuccugcagcugaagugg

SEQ ID NO: 37860 - RNA, 23 nt, Artificial Sequence
  Synthetic Oligonucleotide; NDFIP1 exon 5; Set A
cauaccuuccugcagcugaagug

SEQ ID NO: 37861 - RNA, 22 nt, Artificial Sequence
  Synthetic Oligonucleotide; NDFIP1 exon 5; Set A
cauaccuuccugcagcugaagu

SEQ ID NO: 37862 - RNA, 20 nt, Artificial Sequence
  Synthetic Oligonucleotide; NDFIP1 exon 5; Set C
auaccuuccugcagcugaag

SEQ ID NO: 37863 - RNA, 33 nt, Artificial Sequence
  Synthetic Oligonucleotide; NDFIP1 exon 5; Set C
aauggccccauaccuuccugcagcugaaguggu

SEQ ID NO: 37864 - RNA, 32 nt, Artificial Sequence
  Synthetic Oligonucleotide; NDFIP1 exon 5; Set C
aauggccccauaccuuccugcagcugaagugg

SEQ ID NO: 37865 - RNA, 31 nt, Artificial Sequence
  Synthetic Oligonucleotide; NDFIP1 exon 5; Set C
aauggccccauaccuuccugcagcugaagug

SEQ ID NO: 37866 - RNA, 33 nt, Artificial Sequence
  Synthetic Oligonucleotide; NDFIP1 exon 5; Set C
aaauggccccauaccuuccugcagcugaagugg

SEQ ID NO: 37867 - RNA, 30 nt, Artificial Sequence
  Synthetic Oligonucleotide; NDFIP1 exon 5; Set C
aauggccccauaccuuccugcagcugaagu

SEQ ID NO: 37868 - RNA, 34 nt, Artificial Sequence
  Synthetic Oligonucleotide; NDFIP1 exon 5; Set C
gaaauggccccauaccuuccugcagcugaagugg

SEQ ID NO: 37869 - RNA, 32 nt, Artificial Sequence
  Synthetic Oligonucleotide; NDFIP1 exon 5; Set C
aaauggccccauaccuuccugcagcugaagug

SEQ ID NO: 37870 - RNA, 33 nt, Artificial Sequence
  Synthetic Oligonucleotide; NDFIP1 exon 5; Set C
gaaauggccccauaccuuccugcagcugaagug

SEQ ID NO: 37871 - RNA, 31 nt, Artificial Sequence
  Synthetic Oligonucleotide; NDFIP1 exon 5; Set C
aaauggccccauaccuuccugcagcugaagu

SEQ ID NO: 37872 - RNA, 35 nt, Artificial Sequence
  Synthetic Oligonucleotide; NDFIP1 exon 5; Set C
ugaaauggccccauaccuuccugcagcugaagugg

SEQ ID NO: 37873 - RNA, 32 nt, Artificial Sequence
  Synthetic Oligonucleotide; NDFIP1 exon 5; Set C
gaaauggccccauaccuuccugcagcugaagu

SEQ ID NO: 37874 - RNA, 34 nt, Artificial Sequence
  Synthetic Oligonucleotide; NDFIP1 exon 5; Set C
ugaaauggccccauaccuuccugcagcugaagug

SEQ ID NO: 37875 - RNA, 36 nt, Artificial Sequence
  Synthetic Oligonucleotide; NDFIP1 exon 5; Set C
cugaaauggccccauaccuuccugcagcugaagugg

SEQ ID NO: 37876 - RNA, 37 nt, Artificial Sequence
  Synthetic Oligonucleotide; NDFIP1 exon 5; Set C
ccugaaauggccccauaccuuccugcagcugaagugg

SEQ ID NO: 37877 - RNA, 33 nt, Artificial Sequence
  Synthetic Oligonucleotide; NDFIP1 exon 5; Set C
ugaaauggccccauaccuuccugcagcugaagu

SEQ ID NO: 37878 - RNA, 35 nt, Artificial Sequence
  Synthetic Oligonucleotide; NDFIP1 exon 5; Set C
cugaaauggccccauaccuuccugcagcugaagug

SEQ ID NO: 37879 - RNA, 39 nt, Artificial Sequence
  Synthetic Oligonucleotide; NDFIP1 exon 5; Set C
uccugaaauggccccauaccuuccugcagcugaaguggu

SEQ ID NO: 37880 - RNA, 38 nt, Artificial Sequence
  Synthetic Oligonucleotide; NDFIP1 exon 5; Set C
uccugaaauggccccauaccuuccugcagcugaagugg

SEQ ID NO: 37881 - RNA, 36 nt, Artificial Sequence
  Synthetic Oligonucleotide; NDFIP1 exon 5; Set C
ccugaaauggccccauaccuuccugcagcugaagug

SEQ ID NO: 37882 - RNA, 34 nt, Artificial Sequence
  Synthetic Oligonucleotide; NDFIP1 exon 5; Set C
cugaaauggccccauaccuuccugcagcugaagu

SEQ ID NO: 37883 - RNA, 40 nt, Artificial Sequence
  Synthetic Oligonucleotide; NDFIP1 exon 5; Set C
auccugaaauggccccauaccuuccugcagcugaaguggu

SEQ ID NO: 37884 - RNA, 37 nt, Artificial Sequence
  Synthetic Oligonucleotide; NDFIP1 exon 5; Set C
uccugaaauggccccauaccuuccugcagcugaagug

SEQ ID NO: 37885 - RNA, 35 nt, Artificial Sequence
  Synthetic Oligonucleotide; NDFIP1 exon 5; Set C
ccugaaauggccccauaccuuccugcagcugaagu

SEQ ID NO: 37886 - RNA, 36 nt, Artificial Sequence
  Synthetic Oligonucleotide; NDFIP1 exon 5; Set C
uccugaaauggccccauaccuuccugcagcugaagu

SEQ ID NO: 37887 - RNA, 37 nt, Artificial Sequence
  Synthetic Oligonucleotide; NDFIP1 exon 5; Set C
auccugaaauggccccauaccuuccugcagcugaagu

SEQ ID NO: 37888 - RNA, 39 nt, Artificial Sequence
  Synthetic Oligonucleotide; NDFIP1 exon 5; Set C
aaauccugaaauggccccauaccuuccugcagcugaagu

SEQ ID NO: 37889 - RNA, 40 nt, Artificial Sequence
  Synthetic Oligonucleotide; NDFIP1 exon 5; Set C
caaauccugaaauggccccauaccuuccugcagcugaagu

SEQ ID NO: 37890 - RNA, 18 nt, Artificial Sequence
  Synthetic Oligonucleotide; NDFIP1 exon 5; Set C
aauggccccauaccuucc

SEQ ID NO: 37891 - RNA, 19 nt, Artificial Sequence
  Synthetic Oligonucleotide; NDFIP1 exon 5; Set C
aaauggccccauaccuucc

SEQ ID NO: 37892 - RNA, 20 nt, Artificial Sequence
  Synthetic Oligonucleotide; NDFIP1 exon 5; Set A
gaaauggccccauaccuucc

SEQ ID NO: 37893 - RNA, 21 nt, Artificial Sequence
  Synthetic Oligonucleotide; NDFIP1 exon 5; Set A
ugaaauggccccauaccuucc

SEQ ID NO: 37894 - RNA, 22 nt, Artificial Sequence
  Synthetic Oligonucleotide; NDFIP1 exon 5; Set A
cugaaauggccccauaccuucc

SEQ ID NO: 37895 - RNA, 23 nt, Artificial Sequence
  Synthetic Oligonucleotide; NDFIP1 exon 5; Set A
ccugaaauggccccauaccuucc

SEQ ID NO: 37896 - RNA, 24 nt, Artificial Sequence
  Synthetic Oligonucleotide; NDFIP1 exon 5; Set A
uccugaaauggccccauaccuucc

SEQ ID NO: 37897 - RNA, 25 nt, Artificial Sequence
  Synthetic Oligonucleotide; NDFIP1 exon 5; Set A
auccugaaauggccccauaccuucc

SEQ ID NO: 37898 - RNA, 26 nt, Artificial Sequence
  Synthetic Oligonucleotide; NDFIP1 exon 5; Set A
aauccugaaauggccccauaccuucc

SEQ ID NO: 37899 - RNA, 24 nt, Artificial Sequence
  Synthetic Oligonucleotide; NDFIP1 exon 5; Set A
auccugaaauggccccauaccuuc

SEQ ID NO: 37900 - RNA, 27 nt, Artificial Sequence
  Synthetic Oligonucleotide; NDFIP1 exon 5; Set A
aaauccugaaauggccccauaccuucc

SEQ ID NO: 37901 - RNA, 25 nt, Artificial Sequence
  Synthetic Oligonucleotide; NDFIP1 exon 5; Set A
aauccugaaauggccccauaccuuc

SEQ ID NO: 37902 - RNA, 18 nt, Artificial Sequence
  Synthetic Oligonucleotide; NDFIP1 exon 5; Set C
ccugaaauggccccauac

SEQ ID NO: 37903 - RNA, 28 nt, Artificial Sequence
  Synthetic Oligonucleotide; NDFIP1 exon 5; Set A
caaauccugaaauggccccauaccuucc

SEQ ID NO: 37904 - RNA, 26 nt, Artificial Sequence
  Synthetic Oligonucleotide; NDFIP1 exon 5; Set A
aaauccugaaauggccccauaccuuc

SEQ ID NO: 37905 - RNA, 17 nt, Artificial Sequence
  Synthetic Oligonucleotide; NDFIP1 exon 5; Set C
ccugaaauggccccaua

SEQ ID NO: 37906 - RNA, 19 nt, Artificial Sequence
  Synthetic Oligonucleotide; NDFIP1 exon 5; Set C
uccugaaauggccccauac

SEQ ID NO: 37907 - RNA, 18 nt, Artificial Sequence
  Synthetic Oligonucleotide; NDFIP1 exon 5; Set C
uccugaaauggccccaua

SEQ ID NO: 37908 - RNA, 20 nt, Artificial Sequence
  Synthetic Oligonucleotide; NDFIP1 exon 5; Set C
auccugaaauggccccauac

SEQ ID NO: 37909 - RNA, 19 nt, Artificial Sequence
  Synthetic Oligonucleotide; NDFIP1 exon 5; Set C
auccugaaauggccccaua

SEQ ID NO: 37910 - RNA, 21 nt, Artificial Sequence
  Synthetic Oligonucleotide; NDFIP1 exon 5; Set C
aauccugaaauggccccauac

SEQ ID NO: 37911 - RNA, 20 nt, Artificial Sequence
  Synthetic Oligonucleotide; NDFIP1 exon 5; Set C
aauccugaaauggccccaua

SEQ ID NO: 37912 - RNA, 22 nt, Artificial Sequence
  Synthetic Oligonucleotide; NDFIP1 exon 5; Set C
aaauccugaaauggccccauac

SEQ ID NO: 37913 - RNA, 21 nt, Artificial Sequence
  Synthetic Oligonucleotide; NDFIP1 exon 5; Set C
aaauccugaaauggccccaua

SEQ ID NO: 37914 - RNA, 23 nt, Artificial Sequence
  Synthetic Oligonucleotide; NDFIP1 exon 5; Set C
caaauccugaaauggccccauac

SEQ ID NO: 37915 - RNA, 22 nt, Artificial Sequence
  Synthetic Oligonucleotide; NDFIP1 exon 5; Set C
caaauccugaaauggccccaua

SEQ ID NO: 37916 - RNA, 34 nt, Artificial Sequence
  Synthetic Oligonucleotide; NDFIP1 exon 5; Set C
agagaccaaauccugaaauggccccauaccuucc

SEQ ID NO: 37917 - RNA, 35 nt, Artificial Sequence
  Synthetic Oligonucleotide; NDFIP1 exon 5; Set C
gagagaccaaauccugaaauggccccauaccuucc

SEQ ID NO: 37918 - RNA, 36 nt, Artificial Sequence
  Synthetic Oligonucleotide; NDFIP1 exon 5; Set C
agagagaccaaauccugaaauggccccauaccuucc

SEQ ID NO: 37919 - RNA, 34 nt, Artificial Sequence
  Synthetic Oligonucleotide; NDFIP1 exon 5; Set C
gagagaccaaauccugaaauggccccauaccuuc

SEQ ID NO: 37920 - RNA, 37 nt, Artificial Sequence
  Synthetic Oligonucleotide; NDFIP1 exon 5; Set C
gagagagaccaaauccugaaauggccccauaccuucc

SEQ ID NO: 37921 - RNA, 38 nt, Artificial Sequence
  Synthetic Oligonucleotide; NDFIP1 exon 5; Set C
agagagagaccaaauccugaaauggccccauaccuucc

SEQ ID NO: 37922 - RNA, 29 nt, Artificial Sequence
  Synthetic Oligonucleotide; NDFIP1 exon 5; Set A
agagaccaaauccugaaauggccccauac

SEQ ID NO: 37923 - RNA, 28 nt, Artificial Sequence
  Synthetic Oligonucleotide; NDFIP1 exon 5; Set A
agagaccaaauccugaaauggccccaua

SEQ ID NO: 37924 - RNA, 38 nt, Artificial Sequence
  Synthetic Oligonucleotide; NDFIP1 exon 5; Set C
uagagagagaccaaauccugaaauggccccauaccuuc

SEQ ID NO: 37925 - RNA, 31 nt, Artificial Sequence
  Synthetic Oligonucleotide; NDFIP1 exon 5; Set A
agagagaccaaauccugaaauggccccauac

SEQ ID NO: 37926 - RNA, 39 nt, Artificial Sequence
  Synthetic Oligonucleotide; NDFIP1 exon 5; Set C
uuagagagagaccaaauccugaaauggccccauaccuuc

SEQ ID NO: 37927 - RNA, 37 nt, Artificial Sequence
  Synthetic Oligonucleotide; NDFIP1 exon 5; Set C
uagagagagaccaaauccugaaauggccccauaccuu

SEQ ID NO: 37928 - RNA, 30 nt, Artificial Sequence
  Synthetic Oligonucleotide; NDFIP1 exon 5; Set A
agagagaccaaauccugaaauggccccaua

SEQ ID NO: 37929 - RNA, 32 nt, Artificial Sequence
  Synthetic Oligonucleotide; NDFIP1 exon 5; Set C
gagagagaccaaauccugaaauggccccauac

SEQ ID NO: 37930 - RNA, 40 nt, Artificial Sequence
  Synthetic Oligonucleotide; NDFIP1 exon 5; Set C
auuagagagagaccaaauccugaaauggccccauaccuuc

SEQ ID NO: 37931 - RNA, 36 nt, Artificial Sequence
  Synthetic Oligonucleotide; NDFIP1 exon 5; Set C
uagagagagaccaaauccugaaauggccccauaccu

SEQ ID NO: 37932 - RNA, 38 nt, Artificial Sequence
  Synthetic Oligonucleotide; NDFIP1 exon 5; Set C
uuagagagagaccaaauccugaaauggccccauaccuu

SEQ ID NO: 37933 - RNA, 31 nt, Artificial Sequence
  Synthetic Oligonucleotide; NDFIP1 exon 5; Set C
gagagagaccaaauccugaaauggccccaua

SEQ ID NO: 37934 - RNA, 33 nt, Artificial Sequence
  Synthetic Oligonucleotide; NDFIP1 exon 5; Set C
agagagagaccaaauccugaaauggccccauac

SEQ ID NO: 37935 - RNA, 35 nt, Artificial Sequence
  Synthetic Oligonucleotide; NDFIP1 exon 5; Set C
uagagagagaccaaauccugaaauggccccauacc

SEQ ID NO: 37936 - RNA, 37 nt, Artificial Sequence
  Synthetic Oligonucleotide; NDFIP1 exon 5; Set C
uuagagagagaccaaauccugaaauggccccauaccu

SEQ ID NO: 37937 - RNA, 39 nt, Artificial Sequence
  Synthetic Oligonucleotide; NDFIP1 exon 5; Set C
auuagagagagaccaaauccugaaauggccccauaccuu

SEQ ID NO: 37938 - RNA, 32 nt, Artificial Sequence
  Synthetic Oligonucleotide; NDFIP1 exon 5; Set C
agagagagaccaaauccugaaauggccccaua

SEQ ID NO: 37939 - RNA, 36 nt, Artificial Sequence
  Synthetic Oligonucleotide; NDFIP1 exon 5; Set C
uuagagagagaccaaauccugaaauggccccauacc

SEQ ID NO: 37940 - RNA, 38 nt, Artificial Sequence
  Synthetic Oligonucleotide; NDFIP1 exon 5; Set C
auuagagagagaccaaauccugaaauggccccauaccu

SEQ ID NO: 37941 - RNA, 40 nt, Artificial Sequence
  Synthetic Oligonucleotide; NDFIP1 exon 5; Set C
aauuagagagagaccaaauccugaaauggccccauaccuu

SEQ ID NO: 37942 - RNA, 15 nt, Artificial Sequence
  Synthetic Oligonucleotide; NDFIP1 exon 5; Set C
accaaauccugaaau

SEQ ID NO: 37943 - RNA, 37 nt, Artificial Sequence
  Synthetic Oligonucleotide; NDFIP1 exon 5; Set C
auuagagagagaccaaauccugaaauggccccauacc

SEQ ID NO: 37944 - RNA, 39 nt, Artificial Sequence
  Synthetic Oligonucleotide; NDFIP1 exon 5; Set C
aauuagagagagaccaaauccugaaauggccccauaccu

SEQ ID NO: 37945 - RNA, 16 nt, Artificial Sequence
  Synthetic Oligonucleotide; NDFIP1 exon 5; Set C
gaccaaauccugaaau

SEQ ID NO: 37946 - RNA, 38 nt, Artificial Sequence
  Synthetic Oligonucleotide; NDFIP1 exon 5; Set C
aauuagagagagaccaaauccugaaauggccccauacc

SEQ ID NO: 37947 - RNA, 40 nt, Artificial Sequence
  Synthetic Oligonucleotide; NDFIP1 exon 5; Set C
uaauuagagagagaccaaauccugaaauggccccauaccu

SEQ ID NO: 37948 - RNA, 17 nt, Artificial Sequence
  Synthetic Oligonucleotide; NDFIP1 exon 5; Set C
agaccaaauccugaaau

SEQ ID NO: 37949 - RNA, 15 nt, Artificial Sequence
  Synthetic Oligonucleotide; NDFIP1 exon 5; Set C
gaccaaauccugaaa

SEQ ID NO: 37950 - RNA, 39 nt, Artificial Sequence
  Synthetic Oligonucleotide; NDFIP1 exon 5; Set C
uaauuagagagagaccaaauccugaaauggccccauacc

SEQ ID NO: 37951 - RNA, 33 nt, Artificial Sequence
  Synthetic Oligonucleotide; NDFIP1 exon 5; Set C
uuagagagagaccaaauccugaaauggccccau

SEQ ID NO: 37952 - RNA, 16 nt, Artificial Sequence
  Synthetic Oligonucleotide; NDFIP1 exon 5; Set C
agaccaaauccugaaa

SEQ ID NO: 37953 - RNA, 40 nt, Artificial Sequence
  Synthetic Oligonucleotide; NDFIP1 exon 5; Set C
uuaauuagagagagaccaaauccugaaauggccccauacc

SEQ ID NO: 37954 - RNA, 34 nt, Artificial Sequence
  Synthetic Oligonucleotide; NDFIP1 exon 5; Set A
auuagagagagaccaaauccugaaauggccccau

SEQ ID NO: 37955 - RNA, 17 nt, Artificial Sequence
  Synthetic Oligonucleotide; NDFIP1 exon 5; Set C
gagaccaaauccugaaa

SEQ ID NO: 37956 - RNA, 15 nt, Artificial Sequence
  Synthetic Oligonucleotide; NDFIP1 exon 5; Set C
agaccaaauccugaa

SEQ ID NO: 37957 - RNA, 35 nt, Artificial Sequence
  Synthetic Oligonucleotide; NDFIP1 exon 5; Set A
aauuagagagagaccaaauccugaaauggccccau

SEQ ID NO: 37958 - RNA, 16 nt, Artificial Sequence
  Synthetic Oligonucleotide; NDFIP1 exon 5; Set C
gagaccaaauccugaa

SEQ ID NO: 37959 - RNA, 36 nt, Artificial Sequence
  Synthetic Oligonucleotide; NDFIP1 exon 5; Set A
uaauuagagagagaccaaauccugaaauggccccau

SEQ ID NO: 37960 - RNA, 15 nt, Artificial Sequence
  Synthetic Oligonucleotide; NDFIP1 exon 5; Set C
gagaccaaauccuga

SEQ ID NO: 37961 - RNA, 37 nt, Artificial Sequence
  Synthetic Oligonucleotide; NDFIP1 exon 5; Set A
uuaauuagagagagaccaaauccugaaauggccccau

SEQ ID NO: 37962 - RNA, 40 nt, Artificial Sequence
  Synthetic Oligonucleotide; NDFIP1 exon 5; Set A
auuuaauuagagagagaccaaauccugaaauggccccaua

SEQ ID NO: 37963 - RNA, 38 nt, Artificial Sequence
  Synthetic Oligonucleotide; NDFIP1 exon 5; Set A
uuuaauuagagagagaccaaauccugaaauggccccau

SEQ ID NO: 37964 - RNA, 30 nt, Artificial Sequence
  Synthetic Oligonucleotide; NDFIP1 exon 5; Set C
auuuaauuagagagagaccaaauccugaaa

SEQ ID NO: 37965 - RNA, 29 nt, Artificial Sequence
  Synthetic Oligonucleotide; NDFIP1 exon 5; Set C
auuuaauuagagagagaccaaauccugaa

SEQ ID NO: 37966 - RNA, 31 nt, Artificial Sequence
  Synthetic Oligonucleotide; NDFIP1 exon 5; Set C
cauuuaauuagagagagaccaaauccugaaa

SEQ ID NO: 37967 - RNA, 32 nt, Artificial Sequence
  Synthetic Oligonucleotide; NDFIP1 exon 5; Set C
ccauuuaauuagagagagaccaaauccugaaa

SEQ ID NO: 37968 - RNA, 30 nt, Artificial Sequence
  Synthetic Oligonucleotide; NDFIP1 exon 5; Set C
cauuuaauuagagagagaccaaauccugaa

SEQ ID NO: 37969 - RNA, 28 nt, Artificial Sequence
  Synthetic Oligonucleotide; NDFIP1 exon 5; Set C
auuuaauuagagagagaccaaauccuga

SEQ ID NO: 37970 - RNA, 31 nt, Artificial Sequence
  Synthetic Oligonucleotide; NDFIP1 exon 5; Set A
ccauuuaauuagagagagaccaaauccugaa

SEQ ID NO: 37971 - RNA, 29 nt, Artificial Sequence
  Synthetic Oligonucleotide; NDFIP1 exon 5; Set C
cauuuaauuagagagagaccaaauccuga

SEQ ID NO: 37972 - RNA, 27 nt, Artificial Sequence
  Synthetic Oligonucleotide; NDFIP1 exon 5; Set C
auuuaauuagagagagaccaaauccug

SEQ ID NO: 37973 - RNA, 26 nt, Artificial Sequence
  Synthetic Oligonucleotide; NDFIP1 exon 5; Set C
auuuaauuagagagagaccaaauccu

SEQ ID NO: 37974 - RNA, 30 nt, Artificial Sequence
  Synthetic Oligonucleotide; NDFIP1 exon 5; Set A
ccauuuaauuagagagagaccaaauccuga

SEQ ID NO: 37975 - RNA, 28 nt, Artificial Sequence
  Synthetic Oligonucleotide; NDFIP1 exon 5; Set C
cauuuaauuagagagagaccaaauccug

SEQ ID NO: 37976 - RNA, 25 nt, Artificial Sequence
  Synthetic Oligonucleotide; NDFIP1 exon 5; Set C
auuuaauuagagagagaccaaaucc

SEQ ID NO: 37977 - RNA, 27 nt, Artificial Sequence
  Synthetic Oligonucleotide; NDFIP1 exon 5; Set C
cauuuaauuagagagagaccaaauccu

SEQ ID NO: 37978 - RNA, 29 nt, Artificial Sequence
  Synthetic Oligonucleotide; NDFIP1 exon 5; Set C
ccauuuaauuagagagagaccaaauccug

SEQ ID NO: 37979 - RNA, 15 nt, Artificial Sequence
  Synthetic Oligonucleotide; NDFIP1 exon 5; Set C
auuagagagagacca

SEQ ID NO: 37980 - RNA, 26 nt, Artificial Sequence
  Synthetic Oligonucleotide; NDFIP1 exon 5; Set C
cauuuaauuagagagagaccaaaucc

SEQ ID NO: 37981 - RNA, 28 nt, Artificial Sequence
  Synthetic Oligonucleotide; NDFIP1 exon 5; Set C
ccauuuaauuagagagagaccaaauccu

SEQ ID NO: 37982 - RNA, 16 nt, Artificial Sequence
  Synthetic Oligonucleotide; NDFIP1 exon 5; Set C
aauuagagagagacca

SEQ ID NO: 37983 - RNA, 27 nt, Artificial Sequence
  Synthetic Oligonucleotide; NDFIP1 exon 5; Set C
ccauuuaauuagagagagaccaaaucc

SEQ ID NO: 37984 - RNA, 17 nt, Artificial Sequence
  Synthetic Oligonucleotide; NDFIP1 exon 5; Set C
uaauuagagagagacca

SEQ ID NO: 37985 - RNA, 15 nt, Artificial Sequence
  Synthetic Oligonucleotide; NDFIP1 exon 5; Set C
aauuagagagagacc

SEQ ID NO: 37986 - RNA, 22 nt, Artificial Sequence
  Synthetic Oligonucleotide; NDFIP1 exon 5; Set C
auuuaauuagagagagaccaaa

SEQ ID NO: 37987 - RNA, 18 nt, Artificial Sequence
  Synthetic Oligonucleotide; NDFIP1 exon 5; Set C
uuaauuagagagagacca

SEQ ID NO: 37988 - RNA, 16 nt, Artificial Sequence
  Synthetic Oligonucleotide; NDFIP1 exon 5; Set C
uaauuagagagagacc

SEQ ID NO: 37989 - RNA, 23 nt, Artificial Sequence
  Synthetic Oligonucleotide; NDFIP1 exon 5; Set C
cauuuaauuagagagagaccaaa

SEQ ID NO: 37990 - RNA, 21 nt, Artificial Sequence
  Synthetic Oligonucleotide; NDFIP1 exon 5; Set C
auuuaauuagagagagaccaa

SEQ ID NO: 37991 - RNA, 19 nt, Artificial Sequence
  Synthetic Oligonucleotide; NDFIP1 exon 5; Set C
uuuaauuagagagagacca

SEQ ID NO: 37992 - RNA, 17 nt, Artificial Sequence
  Synthetic Oligonucleotide; NDFIP1 exon 5; Set C
uuaauuagagagagacc

SEQ ID NO: 37993 - RNA, 22 nt, Artificial Sequence
  Synthetic Oligonucleotide; NDFIP1 exon 5; Set C
cauuuaauuagagagagaccaa

SEQ ID NO: 37994 - RNA, 16 nt, Artificial Sequence
  Synthetic Oligonucleotide; NDFIP1 exon 5; Set C
uuaauuagagagagac

SEQ ID NO: 37995 - RNA, 18 nt, Artificial Sequence
  Synthetic Oligonucleotide; NDFIP1 exon 5; Set C
uuuaauuagagagagacc

SEQ ID NO: 37996 - RNA, 23 nt, Artificial Sequence
  Synthetic Oligonucleotide; NDFIP1 exon 5; Set C
ccauuuaauuagagagagaccaa

SEQ ID NO: 37997 - RNA, 15 nt, Artificial Sequence
  Synthetic Oligonucleotide; NDFIP1 exon 5; Set C
uuaauuagagagaga

SEQ ID NO: 37998 - RNA, 17 nt, Artificial Sequence
  Synthetic Oligonucleotide; NDFIP1 exon 5; Set C
uuuaauuagagagagac

SEQ ID NO: 37999 - RNA, 16 nt, Artificial Sequence
  Synthetic Oligonucleotide; NDFIP1 exon 5; Set C
uuuaauuagagagaga

SEQ ID NO: 38000 - RNA, 15 nt, Artificial Sequence
  Synthetic Oligonucleotide; NDFIP1 exon 5; Set C
auuuaauuagagaga

SEQ ID NO: 38001 - RNA, 16 nt, Artificial Sequence
  Synthetic Oligonucleotide; NDFIP1 exon 5; Set C
cauuuaauuagagaga

SEQ ID NO: 38002 - RNA, 17 nt, Artificial Sequence
  Synthetic Oligonucleotide; NDFIP1 exon 5; Set C
ccauuuaauuagagaga

SEQ ID NO: 38003 - RNA, 15 nt, Artificial Sequence
  Synthetic Oligonucleotide; NDFIP1 exon 5; Set C
ccauuuaauuagaga

SEQ ID NO: 38004 - RNA, 27 nt, Artificial Sequence
  Synthetic Oligonucleotide; NDFIP1 exon 5; Set C
aaucaggauccauuuaauuagagagag

SEQ ID NO: 38005 - RNA, 26 nt, Artificial Sequence
  Synthetic Oligonucleotide; NDFIP1 exon 5; Set C
aaucaggauccauuuaauuagagaga

SEQ ID NO: 38006 - RNA, 28 nt, Artificial Sequence
  Synthetic Oligonucleotide; NDFIP1 exon 5; Set C
caaucaggauccauuuaauuagagagag

SEQ ID NO: 38007 - RNA, 27 nt, Artificial Sequence
  Synthetic Oligonucleotide; NDFIP1 exon 5; Set C
caaucaggauccauuuaauuagagaga

SEQ ID NO: 38008 - RNA, 29 nt, Artificial Sequence
  Synthetic Oligonucleotide; NDFIP1 exon 5; Set C
acaaucaggauccauuuaauuagagagag

SEQ ID NO: 38009 - RNA, 28 nt, Artificial Sequence
  Synthetic Oligonucleotide; NDFIP1 exon 5; Set C
acaaucaggauccauuuaauuagagaga

SEQ ID NO: 38010 - RNA, 23 nt, Artificial Sequence
  Synthetic Oligonucleotide; NDFIP1 exon 5; Set C
aaucaggauccauuuaauuagag

SEQ ID NO: 38011 - RNA, 22 nt, Artificial Sequence
  Synthetic Oligonucleotide; NDFIP1 exon 5; Set C
aaucaggauccauuuaauuaga

SEQ ID NO: 38012 - RNA, 23 nt, Artificial Sequence
  Synthetic Oligonucleotide; NDFIP1 exon 5; Set C
caaucaggauccauuuaauuaga

SEQ ID NO: 38013 - RNA, 24 nt, Artificial Sequence
  Synthetic Oligonucleotide; NDFIP1 exon 5; Set C
acaaucaggauccauuuaauuaga

SEQ ID NO: 38014 - RNA, 16 nt, Artificial Sequence
  Synthetic Oligonucleotide; NDFIP1 exon 5; Set C
aaucaggauccauuua

SEQ ID NO: 38015 - RNA, 15 nt, Artificial Sequence
  Synthetic Oligonucleotide; NDFIP1 exon 5; Set C
aaucaggauccauuu

SEQ ID NO: 38016 - RNA, 16 nt, Artificial Sequence
  Synthetic Oligonucleotide; NDFIP1 exon 5; Set C
caaucaggauccauuu

SEQ ID NO: 38017 - RNA, 37 nt, Artificial Sequence
  Synthetic Oligonucleotide; NDFIP1 exon 5; Set A
uacaacuuacccugacaaucaggauccauuuaauuag

SEQ ID NO: 38018 - RNA, 36 nt, Artificial Sequence
  Synthetic Oligonucleotide; NDFIP1 exon 5; Set A
uacaacuuacccugacaaucaggauccauuuaauua

SEQ ID NO: 38019 - RNA, 38 nt, Artificial Sequence
  Synthetic Oligonucleotide; NDFIP1 exon 5; Set A
auacaacuuacccugacaaucaggauccauuuaauuag

SEQ ID NO: 38020 - RNA, 35 nt, Artificial Sequence
  Synthetic Oligonucleotide; NDFIP1 exon 5; Set B
uacaacuuacccugacaaucaggauccauuuaauu

SEQ ID NO: 38021 - RNA, 37 nt, Artificial Sequence
  Synthetic Oligonucleotide; NDFIP1 exon 5; Set A
auacaacuuacccugacaaucaggauccauuuaauua

SEQ ID NO: 38022 - RNA, 39 nt, Artificial Sequence
  Synthetic Oligonucleotide; NDFIP1 exon 5; Set A
uauacaacuuacccugacaaucaggauccauuuaauuag

SEQ ID NO: 38023 - RNA, 34 nt, Artificial Sequence
  Synthetic Oligonucleotide; NDFIP1 exon 5; Set B
uacaacuuacccugacaaucaggauccauuuaau

SEQ ID NO: 38024 - RNA, 36 nt, Artificial Sequence
  Synthetic Oligonucleotide; NDFIP1 exon 5; Set B
auacaacuuacccugacaaucaggauccauuuaauu

SEQ ID NO: 38025 - RNA, 38 nt, Artificial Sequence
  Synthetic Oligonucleotide; NDFIP1 exon 5; Set A
uauacaacuuacccugacaaucaggauccauuuaauua

SEQ ID NO: 38026 - RNA, 40 nt, Artificial Sequence
  Synthetic Oligonucleotide; NDFIP1 exon 5; Set A
uuauacaacuuacccugacaaucaggauccauuuaauuag

SEQ ID NO: 38027 - RNA, 33 nt, Artificial Sequence
  Synthetic Oligonucleotide; NDFIP1 exon 5; Set B
uacaacuuacccugacaaucaggauccauuuaa

SEQ ID NO: 38028 - RNA, 35 nt, Artificial Sequence
  Synthetic Oligonucleotide; NDFIP1 exon 5; Set B
auacaacuuacccugacaaucaggauccauuuaau

SEQ ID NO: 38029 - RNA, 37 nt, Artificial Sequence
  Synthetic Oligonucleotide; NDFIP1 exon 5; Set B
uauacaacuuacccugacaaucaggauccauuuaauu

SEQ ID NO: 38030 - RNA, 39 nt, Artificial Sequence
  Synthetic Oligonucleotide; NDFIP1 exon 5; Set A
uuauacaacuuacccugacaaucaggauccauuuaauua

SEQ ID NO: 38031 - RNA, 34 nt, Artificial Sequence
  Synthetic Oligonucleotide; NDFIP1 exon 5; Set B
auacaacuuacccugacaaucaggauccauuuaa

SEQ ID NO: 38032 - RNA, 36 nt, Artificial Sequence
  Synthetic Oligonucleotide; NDFIP1 exon 5; Set B
uauacaacuuacccugacaaucaggauccauuuaau

SEQ ID NO: 38033 - RNA, 38 nt, Artificial Sequence
  Synthetic Oligonucleotide; NDFIP1 exon 5; Set B
uuauacaacuuacccugacaaucaggauccauuuaauu

SEQ ID NO: 38034 - RNA, 40 nt, Artificial Sequence
  Synthetic Oligonucleotide; NDFIP1 exon 5; Set C
guuauacaacuuacccugacaaucaggauccauuuaauua

SEQ ID NO: 38035 - RNA, 35 nt, Artificial Sequence
  Synthetic Oligonucleotide; NDFIP1 exon 5; Set B
uauacaacuuacccugacaaucaggauccauuuaa

SEQ ID NO: 38036 - RNA, 37 nt, Artificial Sequence
  Synthetic Oligonucleotide; NDFIP1 exon 5; Set B
uuauacaacuuacccugacaaucaggauccauuuaau

SEQ ID NO: 38037 - RNA, 39 nt, Artificial Sequence
  Synthetic Oligonucleotide; NDFIP1 exon 5; Set B
guuauacaacuuacccugacaaucaggauccauuuaauu

SEQ ID NO: 38038 - RNA, 33 nt, Artificial Sequence
  Synthetic Oligonucleotide; NDFIP1 exon 5; Set B
auacaacuuacccugacaaucaggauccauuua

SEQ ID NO: 38039 - RNA, 36 nt, Artificial Sequence
  Synthetic Oligonucleotide; NDFIP1 exon 5; Set B
uuauacaacuuacccugacaaucaggauccauuuaa

SEQ ID NO: 38040 - RNA, 38 nt, Artificial Sequence
  Synthetic Oligonucleotide; NDFIP1 exon 5; Set B
guuauacaacuuacccugacaaucaggauccauuuaau

SEQ ID NO: 38041 - RNA, 34 nt, Artificial Sequence
  Synthetic Oligonucleotide; NDFIP1 exon 5; Set B
uauacaacuuacccugacaaucaggauccauuua

SEQ ID NO: 38042 - RNA, 37 nt, Artificial Sequence
  Synthetic Oligonucleotide; NDFIP1 exon 5; Set B
guuauacaacuuacccugacaaucaggauccauuuaa

SEQ ID NO: 38043 - RNA, 35 nt, Artificial Sequence
  Synthetic Oligonucleotide; NDFIP1 exon 5; Set B
uuauacaacuuacccugacaaucaggauccauuua

SEQ ID NO: 38044 - RNA, 33 nt, Artificial Sequence
  Synthetic Oligonucleotide; NDFIP1 exon 5; Set B
uauacaacuuacccugacaaucaggauccauuu

SEQ ID NO: 38045 - RNA, 34 nt, Artificial Sequence
  Synthetic Oligonucleotide; NDFIP1 exon 5; Set B
uuauacaacuuacccugacaaucaggauccauuu

SEQ ID NO: 38046 - RNA, 36 nt, Artificial Sequence
  Synthetic Oligonucleotide; NDFIP1 exon 5; Set C
guuauacaacuuacccugacaaucaggauccauuua

SEQ ID NO: 38047 - RNA, 35 nt, Artificial Sequence
  Synthetic Oligonucleotide; NDFIP1 exon 5; Set C
guuauacaacuuacccugacaaucaggauccauuu

SEQ ID NO: 38048 - RNA, 40 nt, Artificial Sequence
  Synthetic Oligonucleotide; NDFIP1 exon 5; Set C
uucuguuauacaacuuacccugacaaucaggauccauuua

SEQ ID NO: 38049 - RNA, 40 nt, Artificial Sequence
  Synthetic Oligonucleotide; NDFIP1 exon 5; Set C
uuucuguuauacaacuuacccugacaaucaggauccauuu

SEQ ID NO: 38050 - RNA, 20 nt, Artificial Sequence
  Synthetic Oligonucleotide; NDFIP1 exon 5; Set C
auacaacuuacccugacaau

SEQ ID NO: 38051 - RNA, 21 nt, Artificial Sequence
  Synthetic Oligonucleotide; NDFIP1 exon 5; Set C
uauacaacuuacccugacaau

SEQ ID NO: 38052 - RNA, 20 nt, Artificial Sequence
  Synthetic Oligonucleotide; NDFIP1 exon 5; Set C
uauacaacuuacccugacaa

SEQ ID NO: 38053 - RNA, 22 nt, Artificial Sequence
  Synthetic Oligonucleotide; NDFIP1 exon 5; Set C
uuauacaacuuacccugacaau

SEQ ID NO: 38054 - RNA, 21 nt, Artificial Sequence
  Synthetic Oligonucleotide; NDFIP1 exon 5; Set C
uuauacaacuuacccugacaa

SEQ ID NO: 38055 - RNA, 23 nt, Artificial Sequence
  Synthetic Oligonucleotide; NDFIP1 exon 5; Set C
guuauacaacuuacccugacaau

SEQ ID NO: 38056 - RNA, 22 nt, Artificial Sequence
  Synthetic Oligonucleotide; NDFIP1 exon 5; Set C
guuauacaacuuacccugacaa

SEQ ID NO: 38057 - RNA, 20 nt, Artificial Sequence
  Synthetic Oligonucleotide; NDFIP1 exon 5; Set C
uuauacaacuuacccugaca

SEQ ID NO: 38058 - RNA, 21 nt, Artificial Sequence
  Synthetic Oligonucleotide; NDFIP1 exon 5; Set C
guuauacaacuuacccugaca

SEQ ID NO: 38059 - RNA, 27 nt, Artificial Sequence
  Synthetic Oligonucleotide; NDFIP1 exon 5; Set B
uucuguuauacaacuuacccugacaau

SEQ ID NO: 38060 - RNA, 26 nt, Artificial Sequence
  Synthetic Oligonucleotide; NDFIP1 exon 5; Set B
uucuguuauacaacuuacccugacaa

SEQ ID NO: 38061 - RNA, 28 nt, Artificial Sequence
  Synthetic Oligonucleotide; NDFIP1 exon 5; Set B
uuucuguuauacaacuuacccugacaau

SEQ ID NO: 38062 - RNA, 27 nt, Artificial Sequence
  Synthetic Oligonucleotide; NDFIP1 exon 5; Set B
uuucuguuauacaacuuacccugacaa

SEQ ID NO: 38063 - RNA, 29 nt, Artificial Sequence
  Synthetic Oligonucleotide; NDFIP1 exon 5; Set B
uuuucuguuauacaacuuacccugacaau

SEQ ID NO: 38064 - RNA, 25 nt, Artificial Sequence
  Synthetic Oligonucleotide; NDFIP1 exon 5; Set B
uucuguuauacaacuuacccugaca

SEQ ID NO: 38065 - RNA, 28 nt, Artificial Sequence
  Synthetic Oligonucleotide; NDFIP1 exon 5; Set B
uuuucuguuauacaacuuacccugacaa

SEQ ID NO: 38066 - RNA, 26 nt, Artificial Sequence
  Synthetic Oligonucleotide; NDFIP1 exon 5; Set B
uuucuguuauacaacuuacccugaca

SEQ ID NO: 38067 - RNA, 27 nt, Artificial Sequence
  Synthetic Oligonucleotide; NDFIP1 exon 5; Set B
uuuucuguuauacaacuuacccugaca

SEQ ID NO: 38068 - RNA, 34 nt, Artificial Sequence
  Synthetic Oligonucleotide; NDFIP1 exon 5; Set B
ccaucuuuucuguuauacaacuuacccugacaau

SEQ ID NO: 38069 - RNA, 33 nt, Artificial Sequence
  Synthetic Oligonucleotide; NDFIP1 exon 5; Set B
ccaucuuuucuguuauacaacuuacccugacaa

SEQ ID NO: 38070 - RNA, 32 nt, Artificial Sequence
  Synthetic Oligonucleotide; NDFIP1 exon 5; Set B
ccaucuuuucuguuauacaacuuacccugaca

SEQ ID NO: 38071 - RNA, 39 nt, Artificial Sequence
  Synthetic Oligonucleotide; NDFIP1 exon 5; Set C
agagcccaucuuuucuguuauacaacuuacccugacaau

SEQ ID NO: 38072 - RNA, 38 nt, Artificial Sequence
  Synthetic Oligonucleotide; NDFIP1 exon 5; Set C
agagcccaucuuuucuguuauacaacuuacccugacaa

SEQ ID NO: 38073 - RNA, 40 nt, Artificial Sequence
  Synthetic Oligonucleotide; NDFIP1 exon 5; Set C
uagagcccaucuuuucuguuauacaacuuacccugacaau

SEQ ID NO: 38074 - RNA, 39 nt, Artificial Sequence
  Synthetic Oligonucleotide; NDFIP1 exon 5; Set C
uagagcccaucuuuucuguuauacaacuuacccugacaa

SEQ ID NO: 38075 - RNA, 37 nt, Artificial Sequence
  Synthetic Oligonucleotide; NDFIP1 exon 5; Set C
agagcccaucuuuucuguuauacaacuuacccugaca

SEQ ID NO: 38076 - RNA, 38 nt, Artificial Sequence
  Synthetic Oligonucleotide; NDFIP1 exon 5; Set C
uagagcccaucuuuucuguuauacaacuuacccugaca

SEQ ID NO: 38077 - RNA, 39 nt, Artificial Sequence
  Synthetic Oligonucleotide; NDFIP1 exon 5; Set C
guagagcccaucuuuucuguuauacaacuuacccugaca

SEQ ID NO: 38078 - RNA, 15 nt, Artificial Sequence
  Synthetic Oligonucleotide; NDFIP1 exon 5; Set C
agagcccaucuuuuc

SEQ ID NO: 38079 - RNA, 31 nt, Artificial Sequence
  Synthetic Oligonucleotide; NDFIP1 exon 5; Set A
gaaagauguuagacauguccuguuacccaag

SEQ ID NO: 38080 - RNA, 32 nt, Artificial Sequence
  Synthetic Oligonucleotide; NDFIP1 exon 5; Set A
ggaaagauguuagacauguccuguuacccaag

SEQ ID NO: 38081 - RNA, 30 nt, Artificial Sequence
  Synthetic Oligonucleotide; NDFIP1 exon 5; Set A
gaaagauguuagacauguccuguuacccaa

SEQ ID NO: 38082 - RNA, 29 nt, Artificial Sequence
  Synthetic Oligonucleotide; NDFIP1 exon 5; Set A
gaaagauguuagacauguccuguuaccca

SEQ ID NO: 38083 - RNA, 31 nt, Artificial Sequence
  Synthetic Oligonucleotide; NDFIP1 exon 5; Set A
ggaaagauguuagacauguccuguuacccaa

SEQ ID NO: 38084 - RNA, 30 nt, Artificial Sequence
  Synthetic Oligonucleotide; NDFIP1 exon 5; Set A
ggaaagauguuagacauguccuguuaccca

SEQ ID NO: 38085 - RNA, 28 nt, Artificial Sequence
  Synthetic Oligonucleotide; NDFIP1 exon 5; Set A
gaaagauguuagacauguccuguuaccc

SEQ ID NO: 38086 - RNA, 27 nt, Artificial Sequence
  Synthetic Oligonucleotide; NDFIP1 exon 5; Set A
gaaagauguuagacauguccuguuacc

SEQ ID NO: 38087 - RNA, 29 nt, Artificial Sequence
  Synthetic Oligonucleotide; NDFIP1 exon 5; Set A
ggaaagauguuagacauguccuguuaccc

SEQ ID NO: 38088 - RNA, 35 nt, Artificial Sequence
  Synthetic Oligonucleotide; NDFIP1 exon 5; Set C
aggggaaagauguuagacauguccuguuacccaag

SEQ ID NO: 38089 - RNA, 28 nt, Artificial Sequence
  Synthetic Oligonucleotide; NDFIP1 exon 5; Set A
ggaaagauguuagacauguccuguuacc

SEQ ID NO: 38090 - RNA, 34 nt, Artificial Sequence
  Synthetic Oligonucleotide; NDFIP1 exon 5; Set C
aggggaaagauguuagacauguccuguuacccaa

SEQ ID NO: 38091 - RNA, 16 nt, Artificial Sequence
  Synthetic Oligonucleotide; NDFIP1 exon 5; Set C
aagcagaggaggggaa

SEQ ID NO: 38092 - RNA, 15 nt, Artificial Sequence
  Synthetic Oligonucleotide; NDFIP1 exon 5; Set C
aaagcagaggagggg

SEQ ID NO: 38093 - RNA, 15 nt, Artificial Sequence
  Synthetic Oligonucleotide; NDFIP1 exon 5; Set C
aaaagcagaggaggg

SEQ ID NO: 38094 - RNA, 28 nt, Artificial Sequence
  Synthetic Oligonucleotide; NDFIP1 exon 5; Set C
augccacugcaaaagcagaggaggggaa

SEQ ID NO: 38095 - RNA, 27 nt, Artificial Sequence
  Synthetic Oligonucleotide; NDFIP1 exon 5; Set C
augccacugcaaaagcagaggagggga

SEQ ID NO: 38096 - RNA, 35 nt, Artificial Sequence
  Synthetic Oligonucleotide; NDFIP1 exon 5; Set C
agaggaaugccacugcaaaagcagaggaggggaaa

SEQ ID NO: 38097 - RNA, 36 nt, Artificial Sequence
  Synthetic Oligonucleotide; NDFIP1 exon 5; Set C
aagaggaaugccacugcaaaagcagaggaggggaaa

SEQ ID NO: 38098 - RNA, 33 nt, Artificial Sequence
  Synthetic Oligonucleotide; NDFIP1 exon 5; Set C
agaggaaugccacugcaaaagcagaggagggga

SEQ ID NO: 38099 - RNA, 37 nt, Artificial Sequence
  Synthetic Oligonucleotide; NDFIP1 exon 5; Set C
aaagaggaaugccacugcaaaagcagaggaggggaaa

SEQ ID NO: 38100 - RNA, 34 nt, Artificial Sequence
  Synthetic Oligonucleotide; NDFIP1 exon 5; Set C
aagaggaaugccacugcaaaagcagaggagggga

SEQ ID NO: 38101 - RNA, 32 nt, Artificial Sequence
  Synthetic Oligonucleotide; NDFIP1 exon 5; Set C
agaggaaugccacugcaaaagcagaggagggg

SEQ ID NO: 38102 - RNA, 38 nt, Artificial Sequence
  Synthetic Oligonucleotide; NDFIP1 exon 5; Set C
uaaagaggaaugccacugcaaaagcagaggaggggaaa

SEQ ID NO: 38103 - RNA, 33 nt, Artificial Sequence
  Synthetic Oligonucleotide; NDFIP1 exon 5; Set C
aagaggaaugccacugcaaaagcagaggagggg

SEQ ID NO: 38104 - RNA, 39 nt, Artificial Sequence
  Synthetic Oligonucleotide; NDFIP1 exon 5; Set C
uuaaagaggaaugccacugcaaaagcagaggaggggaaa

SEQ ID NO: 38105 - RNA, 34 nt, Artificial Sequence
  Synthetic Oligonucleotide; NDFIP1 exon 5; Set C
aaagaggaaugccacugcaaaagcagaggagggg

SEQ ID NO: 38106 - RNA, 40 nt, Artificial Sequence
  Synthetic Oligonucleotide; NDFIP1 exon 5; Set C
guuaaagaggaaugccacugcaaaagcagaggaggggaaa

SEQ ID NO: 38107 - RNA, 35 nt, Artificial Sequence
  Synthetic Oligonucleotide; NDFIP1 exon 5; Set C
uaaagaggaaugccacugcaaaagcagaggagggg

SEQ ID NO: 38108 - RNA, 33 nt, Artificial Sequence
  Synthetic Oligonucleotide; NDFIP1 exon 5; Set A
aaagaggaaugccacugcaaaagcagaggaggg

SEQ ID NO: 38109 - RNA, 32 nt, Artificial Sequence
  Synthetic Oligonucleotide; NDFIP1 exon 5; Set A
aaagaggaaugccacugcaaaagcagaggagg

SEQ ID NO: 38110 - RNA, 36 nt, Artificial Sequence
  Synthetic Oligonucleotide; NDFIP1 exon 5; Set C
uuaaagaggaaugccacugcaaaagcagaggagggg

SEQ ID NO: 38111 - RNA, 34 nt, Artificial Sequence
  Synthetic Oligonucleotide; NDFIP1 exon 5; Set C
uaaagaggaaugccacugcaaaagcagaggaggg

SEQ ID NO: 38112 - RNA, 33 nt, Artificial Sequence
  Synthetic Oligonucleotide; NDFIP1 exon 5; Set A
uaaagaggaaugccacugcaaaagcagaggagg

SEQ ID NO: 38113 - RNA, 37 nt, Artificial Sequence
  Synthetic Oligonucleotide; NDFIP1 exon 5; Set C
guuaaagaggaaugccacugcaaaagcagaggagggg

SEQ ID NO: 38114 - RNA, 35 nt, Artificial Sequence
  Synthetic Oligonucleotide; NDFIP1 exon 5; Set C
uuaaagaggaaugccacugcaaaagcagaggaggg

SEQ ID NO: 38115 - RNA, 34 nt, Artificial Sequence
  Synthetic Oligonucleotide; NDFIP1 exon 5; Set A
uuaaagaggaaugccacugcaaaagcagaggagg

SEQ ID NO: 38116 - RNA, 36 nt, Artificial Sequence
  Synthetic Oligonucleotide; NDFIP1 exon 5; Set C
guuaaagaggaaugccacugcaaaagcagaggaggg

SEQ ID NO: 38117 - RNA, 35 nt, Artificial Sequence
  Synthetic Oligonucleotide; NDFIP1 exon 5; Set A
guuaaagaggaaugccacugcaaaagcagaggagg

SEQ ID NO: 38118 - RNA, 37 nt, Artificial Sequence
  Synthetic Oligonucleotide; NDFIP1 exon 5; Set C
aguuaaagaggaaugccacugcaaaagcagaggaggg

SEQ ID NO: 38119 - RNA, 36 nt, Artificial Sequence
  Synthetic Oligonucleotide; NDFIP1 exon 5; Set A
aguuaaagaggaaugccacugcaaaagcagaggagg

SEQ ID NO: 38120 - RNA, 40 nt, Artificial Sequence
  Synthetic Oligonucleotide; NDFIP1 exon 5; Set C
auccaguuaaagaggaaugccacugcaaaagcagaggagg

SEQ ID NO: 38121 - RNA, 19 nt, Artificial Sequence
  Synthetic Oligonucleotide; NDFIP1 exon 5; Set C
agaggaaugccacugcaaa

SEQ ID NO: 38122 - RNA, 23 nt, Artificial Sequence
  Synthetic Oligonucleotide; NDFIP1 exon 5; Set C
aaagaggaaugccacugcaaaag

SEQ ID NO: 38123 - RNA, 24 nt, Artificial Sequence
  Synthetic Oligonucleotide; NDFIP1 exon 5; Set C
uaaagaggaaugccacugcaaaag

SEQ ID NO: 38124 - RNA, 25 nt, Artificial Sequence
  Synthetic Oligonucleotide; NDFIP1 exon 5; Set C
uuaaagaggaaugccacugcaaaag

SEQ ID NO: 38125 - RNA, 26 nt, Artificial Sequence
  Synthetic Oligonucleotide; NDFIP1 exon 5; Set C
guuaaagaggaaugccacugcaaaag

SEQ ID NO: 38126 - RNA, 27 nt, Artificial Sequence
  Synthetic Oligonucleotide; NDFIP1 exon 5; Set C
aguuaaagaggaaugccacugcaaaag

SEQ ID NO: 38127 - RNA, 32 nt, Artificial Sequence
  Synthetic Oligonucleotide; NDFIP1 exon 5; Set A
aauccaguuaaagaggaaugccacugcaaaag

SEQ ID NO: 38128 - RNA, 33 nt, Artificial Sequence
  Synthetic Oligonucleotide; NDFIP1 exon 5; Set A
caauccaguuaaagaggaaugccacugcaaaag

SEQ ID NO: 38129 - RNA, 38 nt, Artificial Sequence
  Synthetic Oligonucleotide; NDFIP1 exon 5; Set A
aaacccaauccaguuaaagaggaaugccacugcaaaag

SEQ ID NO: 38130 - RNA, 39 nt, Artificial Sequence
  Synthetic Oligonucleotide; NDFIP1 exon 5; Set A
aaaacccaauccaguuaaagaggaaugccacugcaaaag

SEQ ID NO: 38131 - RNA, 39 nt, Artificial Sequence
  Synthetic Oligonucleotide; NDFIP1 exon 5; Set A
aaaaagacaggaaaaacccaauccaguuaaagaggaaug

SEQ ID NO: 38132 - RNA, 40 nt, Artificial Sequence
  Synthetic Oligonucleotide; NDFIP1 exon 5; Set A
caaaaagacaggaaaaacccaauccaguuaaagaggaaug

SEQ ID NO: 38133 - RNA, 31 nt, Artificial Sequence
  Synthetic Oligonucleotide; NDFIP1 exon 5; Set C
aaagacaggaaaaacccaauccaguuaaaga

SEQ ID NO: 38134 - RNA, 30 nt, Artificial Sequence
  Synthetic Oligonucleotide; NDFIP1 exon 5; Set C
aaagacaggaaaaacccaauccaguuaaag

SEQ ID NO: 38135 - RNA, 29 nt, Artificial Sequence
  Synthetic Oligonucleotide; NDFIP1 exon 5; Set C
aaagacaggaaaaacccaauccaguuaaa

SEQ ID NO: 38136 - RNA, 28 nt, Artificial Sequence
  Synthetic Oligonucleotide; NDFIP1 exon 5; Set C
aaagacaggaaaaacccaauccaguuaa

SEQ ID NO: 38137 - RNA, 34 nt, Artificial Sequence
  Synthetic Oligonucleotide; NDFIP1 exon 5; Set C
caaaaagacaggaaaaacccaauccaguuaaaga

SEQ ID NO: 38138 - RNA, 27 nt, Artificial Sequence
  Synthetic Oligonucleotide; NDFIP1 exon 5; Set C
aaagacaggaaaaacccaauccaguua

SEQ ID NO: 38139 - RNA, 33 nt, Artificial Sequence
  Synthetic Oligonucleotide; NDFIP1 exon 5; Set C
caaaaagacaggaaaaacccaauccaguuaaag

SEQ ID NO: 38140 - RNA, 35 nt, Artificial Sequence
  Synthetic Oligonucleotide; NDFIP1 exon 5; Set A
gcaaaaagacaggaaaaacccaauccaguuaaaga

SEQ ID NO: 38141 - RNA, 26 nt, Artificial Sequence
  Synthetic Oligonucleotide; NDFIP1 exon 5; Set C
aaagacaggaaaaacccaauccaguu

SEQ ID NO: 38142 - RNA, 36 nt, Artificial Sequence
  Synthetic Oligonucleotide; NDFIP1 exon 5; Set A
ggcaaaaagacaggaaaaacccaauccaguuaaaga

SEQ ID NO: 38143 - RNA, 34 nt, Artificial Sequence
  Synthetic Oligonucleotide; NDFIP1 exon 5; Set C
gcaaaaagacaggaaaaacccaauccaguuaaag

SEQ ID NO: 38144 - RNA, 25 nt, Artificial Sequence
  Synthetic Oligonucleotide; NDFIP1 exon 5; Set C
aaagacaggaaaaacccaauccagu

SEQ ID NO: 38145 - RNA, 33 nt, Artificial Sequence
  Synthetic Oligonucleotide; NDFIP1 exon 5; Set C
gcaaaaagacaggaaaaacccaauccaguuaaa

SEQ ID NO: 38146 - RNA, 35 nt, Artificial Sequence
  Synthetic Oligonucleotide; NDFIP1 exon 5; Set A
ggcaaaaagacaggaaaaacccaauccaguuaaag

SEQ ID NO: 38147 - RNA, 32 nt, Artificial Sequence
  Synthetic Oligonucleotide; NDFIP1 exon 5; Set C
gcaaaaagacaggaaaaacccaauccaguuaa

SEQ ID NO: 38148 - RNA, 34 nt, Artificial Sequence
  Synthetic Oligonucleotide; NDFIP1 exon 5; Set A
ggcaaaaagacaggaaaaacccaauccaguuaaa

SEQ ID NO: 38149 - RNA, 33 nt, Artificial Sequence
  Synthetic Oligonucleotide; NDFIP1 exon 5; Set A
ggcaaaaagacaggaaaaacccaauccaguuaa

SEQ ID NO: 38150 - RNA, 31 nt, Artificial Sequence
  Synthetic Oligonucleotide; NDFIP1 exon 5; Set A
gcaaaaagacaggaaaaacccaauccaguua

SEQ ID NO: 38151 - RNA, 30 nt, Artificial Sequence
  Synthetic Oligonucleotide; NDFIP1 exon 5; Set C
gcaaaaagacaggaaaaacccaauccaguu

SEQ ID NO: 38152 - RNA, 32 nt, Artificial Sequence
  Synthetic Oligonucleotide; NDFIP1 exon 5; Set A
ggcaaaaagacaggaaaaacccaauccaguua

SEQ ID NO: 38153 - RNA, 31 nt, Artificial Sequence
  Synthetic Oligonucleotide; NDFIP1 exon 5; Set A
ggcaaaaagacaggaaaaacccaauccaguu

SEQ ID NO: 38154 - RNA, 29 nt, Artificial Sequence
  Synthetic Oligonucleotide; NDFIP1 exon 5; Set C
gcaaaaagacaggaaaaacccaauccagu

SEQ ID NO: 38155 - RNA, 30 nt, Artificial Sequence
  Synthetic Oligonucleotide; NDFIP1 exon 5; Set A
ggcaaaaagacaggaaaaacccaauccagu

SEQ ID NO: 38156 - RNA, 19 nt, Artificial Sequence
  Synthetic Oligonucleotide; NDFIP1 exon 5; Set C
aaagacaggaaaaacccaa

SEQ ID NO: 38157 - RNA, 23 nt, Artificial Sequence
  Synthetic Oligonucleotide; NDFIP1 exon 5; Set C
aaaaagacaggaaaaacccaauc

SEQ ID NO: 38158 - RNA, 22 nt, Artificial Sequence
  Synthetic Oligonucleotide; NDFIP1 exon 5; Set C
aaaaagacaggaaaaacccaau

SEQ ID NO: 38159 - RNA, 24 nt, Artificial Sequence
  Synthetic Oligonucleotide; NDFIP1 exon 5; Set C
caaaaagacaggaaaaacccaauc

SEQ ID NO: 38160 - RNA, 21 nt, Artificial Sequence
  Synthetic Oligonucleotide; NDFIP1 exon 5; Set C
aaaaagacaggaaaaacccaa

SEQ ID NO: 38161 - RNA, 23 nt, Artificial Sequence
  Synthetic Oligonucleotide; NDFIP1 exon 5; Set C
caaaaagacaggaaaaacccaau

SEQ ID NO: 38162 - RNA, 22 nt, Artificial Sequence
  Synthetic Oligonucleotide; NDFIP1 exon 5; Set C
caaaaagacaggaaaaacccaa

SEQ ID NO: 38163 - RNA, 23 nt, Artificial Sequence
  Synthetic Oligonucleotide; NDFIP1 exon 5; Set C
gcaaaaagacaggaaaaacccaa

SEQ ID NO: 38164 - RNA, 25 nt, Artificial Sequence
  Synthetic Oligonucleotide; NDFIP1 exon 5; Set C
ggcaaaaagacaggaaaaacccaau

SEQ ID NO: 38165 - RNA, 24 nt, Artificial Sequence
  Synthetic Oligonucleotide; NDFIP1 exon 5; Set C
ggcaaaaagacaggaaaaacccaa

SEQ ID NO: 38166 - RNA, 18 nt, Artificial Sequence
  Synthetic Oligonucleotide; NDFIP1 exon 5; Set C
gcaaaaagacaggaaaaa

SEQ ID NO: 38167 - RNA, 17 nt, Artificial Sequence
  Synthetic Oligonucleotide; NDFIP1 exon 5; Set C
gcaaaaagacaggaaaa

SEQ ID NO: 38168 - RNA, 19 nt, Artificial Sequence
  Synthetic Oligonucleotide; NDFIP1 exon 5; Set C
ggcaaaaagacaggaaaaa

SEQ ID NO: 38169 - RNA, 15 nt, Artificial Sequence
  Synthetic Oligonucleotide; NDFIP1 exon 5; Set C
caaaaagacaggaaa

SEQ ID NO: 38170 - RNA, 35 nt, Artificial Sequence
  Synthetic Oligonucleotide; NDFIP1 exon 5; Set A
aaguggucaggcaaaaagacaggaaaaacccaauc

SEQ ID NO: 38171 - RNA, 26 nt, Artificial Sequence
  Synthetic Oligonucleotide; NDFIP1 exon 5; Set C
aaguggucaggcaaaaagacaggaaa

SEQ ID NO: 38172 - RNA, 18 nt, Artificial Sequence
  Synthetic Oligonucleotide; NDFIP1 exon 5; Set C
guggucaggcaaaaagac

SEQ ID NO: 38173 - RNA, 19 nt, Artificial Sequence
  Synthetic Oligonucleotide; NDFIP1 exon 5; Set C
aguggucaggcaaaaagac

SEQ ID NO: 38174 - RNA, 17 nt, Artificial Sequence
  Synthetic Oligonucleotide; NDFIP1 exon 5; Set C
aaguggucaggcaaaaa

SEQ ID NO: 38175 - RNA, 37 nt, Artificial Sequence
  Synthetic Oligonucleotide; NDFIP1 exon 5; Set C
uccugcagcugaaguggucaggcaaaaagacaggaaa

SEQ ID NO: 38176 - RNA, 38 nt, Artificial Sequence
  Synthetic Oligonucleotide; NDFIP1 exon 5; Set C
uuccugcagcugaaguggucaggcaaaaagacaggaaa

SEQ ID NO: 38177 - RNA, 39 nt, Artificial Sequence
  Synthetic Oligonucleotide; NDFIP1 exon 5; Set C
cuuccugcagcugaaguggucaggcaaaaagacaggaaa

SEQ ID NO: 38178 - RNA, 40 nt, Artificial Sequence
  Synthetic Oligonucleotide; NDFIP1 exon 5; Set C
ccuuccugcagcugaaguggucaggcaaaaagacaggaaa

SEQ ID NO: 38179 - RNA, 33 nt, Artificial Sequence
  Synthetic Oligonucleotide; NDFIP1 exon 5; Set C
uuccugcagcugaaguggucaggcaaaaagaca

SEQ ID NO: 38180 - RNA, 34 nt, Artificial Sequence
  Synthetic Oligonucleotide; NDFIP1 exon 5; Set C
cuuccugcagcugaaguggucaggcaaaaagaca

SEQ ID NO: 38181 - RNA, 35 nt, Artificial Sequence
  Synthetic Oligonucleotide; NDFIP1 exon 5; Set C
ccuuccugcagcugaaguggucaggcaaaaagaca

SEQ ID NO: 38182 - RNA, 36 nt, Artificial Sequence
  Synthetic Oligonucleotide; NDFIP1 exon 5; Set C
accuuccugcagcugaaguggucaggcaaaaagaca

SEQ ID NO: 38183 - RNA, 28 nt, Artificial Sequence
  Synthetic Oligonucleotide; NDFIP1 exon 5; Set A
uuccugcagcugaaguggucaggcaaaa

SEQ ID NO: 38184 - RNA, 26 nt, Artificial Sequence
  Synthetic Oligonucleotide; NDFIP1 exon 5; Set C
uccugcagcugaaguggucaggcaaa

SEQ ID NO: 38185 - RNA, 39 nt, Artificial Sequence
  Synthetic Oligonucleotide; NDFIP1 exon 5; Set C
cauaccuuccugcagcugaaguggucaggcaaaaagaca

SEQ ID NO: 38186 - RNA, 29 nt, Artificial Sequence
  Synthetic Oligonucleotide; NDFIP1 exon 5; Set C
cuuccugcagcugaaguggucaggcaaaa

SEQ ID NO: 38187 - RNA, 25 nt, Artificial Sequence
  Synthetic Oligonucleotide; NDFIP1 exon 5; Set C
uccugcagcugaaguggucaggcaa

SEQ ID NO: 38188 - RNA, 30 nt, Artificial Sequence
  Synthetic Oligonucleotide; NDFIP1 exon 5; Set C
ccuuccugcagcugaaguggucaggcaaaa

SEQ ID NO: 38189 - RNA, 31 nt, Artificial Sequence
  Synthetic Oligonucleotide; NDFIP1 exon 5; Set C
accuuccugcagcugaaguggucaggcaaaa

SEQ ID NO: 38190 - RNA, 33 nt, Artificial Sequence
  Synthetic Oligonucleotide; NDFIP1 exon 5; Set C
uaccuuccugcagcugaaguggucaggcaaaaa

SEQ ID NO: 38191 - RNA, 34 nt, Artificial Sequence
  Synthetic Oligonucleotide; NDFIP1 exon 5; Set C
auaccuuccugcagcugaaguggucaggcaaaaa

SEQ ID NO: 38192 - RNA, 34 nt, Artificial Sequence
  Synthetic Oligonucleotide; NDFIP1 exon 5; Set C
cauaccuuccugcagcugaaguggucaggcaaaa

SEQ ID NO: 38193 - RNA, 30 nt, Artificial Sequence
  Synthetic Oligonucleotide; NDFIP1 exon 5; Set C
uaccuuccugcagcugaaguggucaggcaa

SEQ ID NO: 38194 - RNA, 33 nt, Artificial Sequence
  Synthetic Oligonucleotide; NDFIP1 exon 5; Set C
cauaccuuccugcagcugaaguggucaggcaaa

SEQ ID NO: 38195 - RNA, 31 nt, Artificial Sequence
  Synthetic Oligonucleotide; NDFIP1 exon 5; Set C
auaccuuccugcagcugaaguggucaggcaa

SEQ ID NO: 38196 - RNA, 28 nt, Artificial Sequence
  Synthetic Oligonucleotide; NDFIP1 exon 5; Set C
uaccuuccugcagcugaaguggucaggc

SEQ ID NO: 38197 - RNA, 30 nt, Artificial Sequence
  Synthetic Oligonucleotide; NDFIP1 exon 5; Set C
auaccuuccugcagcugaaguggucaggca

SEQ ID NO: 38198 - RNA, 19 nt, Artificial Sequence
  Synthetic Oligonucleotide; NDFIP1 exon 5; Set A
uuccugcagcugaaguggu

SEQ ID NO: 38199 - RNA, 29 nt, Artificial Sequence
  Synthetic Oligonucleotide; NDFIP1 exon 5; Set C
auaccuuccugcagcugaaguggucaggc

SEQ ID NO: 38200 - RNA, 20 nt, Artificial Sequence
  Synthetic Oligonucleotide; NDFIP1 exon 5; Set A
cuuccugcagcugaaguggu

SEQ ID NO: 38201 - RNA, 19 nt, Artificial Sequence
  Synthetic Oligonucleotide; NDFIP1 exon 5; Set C
cuuccugcagcugaagugg

SEQ ID NO: 38202 - RNA, 21 nt, Artificial Sequence
  Synthetic Oligonucleotide; NDFIP1 exon 5; Set A
ccuuccugcagcugaaguggu

SEQ ID NO: 38203 - RNA, 16 nt, Artificial Sequence
  Synthetic Oligonucleotide; NDFIP1 exon 5; Set C
uuccugcagcugaagu

SEQ ID NO: 38204 - RNA, 18 nt, Artificial Sequence
  Synthetic Oligonucleotide; NDFIP1 exon 5; Set C
cuuccugcagcugaagug

SEQ ID NO: 38205 - RNA, 22 nt, Artificial Sequence
  Synthetic Oligonucleotide; NDFIP1 exon 5; Set A
accuuccugcagcugaaguggu

SEQ ID NO: 38206 - RNA, 17 nt, Artificial Sequence
  Synthetic Oligonucleotide; NDFIP1 exon 5; Set C
cuuccugcagcugaagu

SEQ ID NO: 38207 - RNA, 18 nt, Artificial Sequence
  Synthetic Oligonucleotide; NDFIP1 exon 5; Set C
ccuuccugcagcugaagu

SEQ ID NO: 38208 - RNA, 25 nt, Artificial Sequence
  Synthetic Oligonucleotide; NDFIP1 exon 5; Set A
cauaccuuccugcagcugaaguggu

SEQ ID NO: 38209 - RNA, 40 nt, Artificial Sequence
  Synthetic Oligonucleotide; NDFIP1 exon 5; Set C
aauggccccauaccuuccugcagcugaaguggucaggcaa

SEQ ID NO: 38210 - RNA, 19 nt, Artificial Sequence
  Synthetic Oligonucleotide; NDFIP1 exon 5; Set C
uaccuuccugcagcugaag

SEQ ID NO: 38211 - RNA, 34 nt, Artificial Sequence
  Synthetic Oligonucleotide; NDFIP1 exon 5; Set C
aaauggccccauaccuuccugcagcugaaguggu

SEQ ID NO: 38212 - RNA, 35 nt, Artificial Sequence
  Synthetic Oligonucleotide; NDFIP1 exon 5; Set C
gaaauggccccauaccuuccugcagcugaaguggu

SEQ ID NO: 38213 - RNA, 36 nt, Artificial Sequence
  Synthetic Oligonucleotide; NDFIP1 exon 5; Set C
ugaaauggccccauaccuuccugcagcugaaguggu

SEQ ID NO: 38214 - RNA, 37 nt, Artificial Sequence
  Synthetic Oligonucleotide; NDFIP1 exon 5; Set C
cugaaauggccccauaccuuccugcagcugaaguggu

SEQ ID NO: 38215 - RNA, 29 nt, Artificial Sequence
  Synthetic Oligonucleotide; NDFIP1 exon 5; Set C
aauggccccauaccuuccugcagcugaag

SEQ ID NO: 38216 - RNA, 38 nt, Artificial Sequence
  Synthetic Oligonucleotide; NDFIP1 exon 5; Set C
ccugaaauggccccauaccuuccugcagcugaaguggu

SEQ ID NO: 38217 - RNA, 30 nt, Artificial Sequence
  Synthetic Oligonucleotide; NDFIP1 exon 5; Set C
aaauggccccauaccuuccugcagcugaag

SEQ ID NO: 38218 - RNA, 31 nt, Artificial Sequence
  Synthetic Oligonucleotide; NDFIP1 exon 5; Set C
gaaauggccccauaccuuccugcagcugaag

SEQ ID NO: 38219 - RNA, 32 nt, Artificial Sequence
  Synthetic Oligonucleotide; NDFIP1 exon 5; Set C
ugaaauggccccauaccuuccugcagcugaag

SEQ ID NO: 38220 - RNA, 33 nt, Artificial Sequence
  Synthetic Oligonucleotide; NDFIP1 exon 5; Set C
cugaaauggccccauaccuuccugcagcugaag

SEQ ID NO: 38221 - RNA, 34 nt, Artificial Sequence
  Synthetic Oligonucleotide; NDFIP1 exon 5; Set C
ccugaaauggccccauaccuuccugcagcugaag

SEQ ID NO: 38222 - RNA, 35 nt, Artificial Sequence
  Synthetic Oligonucleotide; NDFIP1 exon 5; Set C
uccugaaauggccccauaccuuccugcagcugaag

SEQ ID NO: 38223 - RNA, 36 nt, Artificial Sequence
  Synthetic Oligonucleotide; NDFIP1 exon 5; Set C
auccugaaauggccccauaccuuccugcagcugaag

SEQ ID NO: 38224 - RNA, 37 nt, Artificial Sequence
  Synthetic Oligonucleotide; NDFIP1 exon 5; Set C
aauccugaaauggccccauaccuuccugcagcugaag

SEQ ID NO: 38225 - RNA, 38 nt, Artificial Sequence
  Synthetic Oligonucleotide; NDFIP1 exon 5; Set C
aaauccugaaauggccccauaccuuccugcagcugaag

SEQ ID NO: 38226 - RNA, 39 nt, Artificial Sequence
  Synthetic Oligonucleotide; NDFIP1 exon 5; Set C
caaauccugaaauggccccauaccuuccugcagcugaag

SEQ ID NO: 38227 - RNA, 17 nt, Artificial Sequence
  Synthetic Oligonucleotide; NDFIP1 exon 5; Set C
aauggccccauaccuuc

SEQ ID NO: 38228 - RNA, 18 nt, Artificial Sequence
  Synthetic Oligonucleotide; NDFIP1 exon 5; Set C
aaauggccccauaccuuc

SEQ ID NO: 38229 - RNA, 19 nt, Artificial Sequence
  Synthetic Oligonucleotide; NDFIP1 exon 5; Set C
gaaauggccccauaccuuc

SEQ ID NO: 38230 - RNA, 20 nt, Artificial Sequence
  Synthetic Oligonucleotide; NDFIP1 exon 5; Set C
ugaaauggccccauaccuuc

SEQ ID NO: 38231 - RNA, 21 nt, Artificial Sequence
  Synthetic Oligonucleotide; NDFIP1 exon 5; Set A
cugaaauggccccauaccuuc

SEQ ID NO: 38232 - RNA, 22 nt, Artificial Sequence
  Synthetic Oligonucleotide; NDFIP1 exon 5; Set A
ccugaaauggccccauaccuuc

SEQ ID NO: 38233 - RNA, 15 nt, Artificial Sequence
  Synthetic Oligonucleotide; NDFIP1 exon 5; Set C
gaaauggccccauac

SEQ ID NO: 38234 - RNA, 23 nt, Artificial Sequence
  Synthetic Oligonucleotide; NDFIP1 exon 5; Set A
uccugaaauggccccauaccuuc

SEQ ID NO: 38235 - RNA, 21 nt, Artificial Sequence
  Synthetic Oligonucleotide; NDFIP1 exon 5; Set A
ccugaaauggccccauaccuu

SEQ ID NO: 38236 - RNA, 16 nt, Artificial Sequence
  Synthetic Oligonucleotide; NDFIP1 exon 5; Set C
ugaaauggccccauac

SEQ ID NO: 38237 - RNA, 20 nt, Artificial Sequence
  Synthetic Oligonucleotide; NDFIP1 exon 5; Set A
ccugaaauggccccauaccu

SEQ ID NO: 38238 - RNA, 22 nt, Artificial Sequence
  Synthetic Oligonucleotide; NDFIP1 exon 5; Set A
uccugaaauggccccauaccuu

SEQ ID NO: 38239 - RNA, 15 nt, Artificial Sequence
  Synthetic Oligonucleotide; NDFIP1 exon 5; Set C
ugaaauggccccaua

SEQ ID NO: 38240 - RNA, 17 nt, Artificial Sequence
  Synthetic Oligonucleotide; NDFIP1 exon 5; Set C
cugaaauggccccauac

SEQ ID NO: 38241 - RNA, 19 nt, Artificial Sequence
  Synthetic Oligonucleotide; NDFIP1 exon 5; Set A
ccugaaauggccccauacc

SEQ ID NO: 38242 - RNA, 21 nt, Artificial Sequence
  Synthetic Oligonucleotide; NDFIP1 exon 5; Set A
uccugaaauggccccauaccu

SEQ ID NO: 38243 - RNA, 23 nt, Artificial Sequence
  Synthetic Oligonucleotide; NDFIP1 exon 5; Set A
auccugaaauggccccauaccuu

SEQ ID NO: 38244 - RNA, 16 nt, Artificial Sequence
  Synthetic Oligonucleotide; NDFIP1 exon 5; Set C
cugaaauggccccaua

SEQ ID NO: 38245 - RNA, 20 nt, Artificial Sequence
  Synthetic Oligonucleotide; NDFIP1 exon 5; Set A
uccugaaauggccccauacc

SEQ ID NO: 38246 - RNA, 22 nt, Artificial Sequence
  Synthetic Oligonucleotide; NDFIP1 exon 5; Set A
auccugaaauggccccauaccu

SEQ ID NO: 38247 - RNA, 24 nt, Artificial Sequence
  Synthetic Oligonucleotide; NDFIP1 exon 5; Set A
aauccugaaauggccccauaccuu

SEQ ID NO: 38248 - RNA, 27 nt, Artificial Sequence
  Synthetic Oligonucleotide; NDFIP1 exon 5; Set A
caaauccugaaauggccccauaccuuc

SEQ ID NO: 38249 - RNA, 21 nt, Artificial Sequence
  Synthetic Oligonucleotide; NDFIP1 exon 5; Set A
auccugaaauggccccauacc

SEQ ID NO: 38250 - RNA, 23 nt, Artificial Sequence
  Synthetic Oligonucleotide; NDFIP1 exon 5; Set A
aauccugaaauggccccauaccu

SEQ ID NO: 38251 - RNA, 25 nt, Artificial Sequence
  Synthetic Oligonucleotide; NDFIP1 exon 5; Set A
aaauccugaaauggccccauaccuu

SEQ ID NO: 38252 - RNA, 22 nt, Artificial Sequence
  Synthetic Oligonucleotide; NDFIP1 exon 5; Set A
aauccugaaauggccccauacc

SEQ ID NO: 38253 - RNA, 24 nt, Artificial Sequence
  Synthetic Oligonucleotide; NDFIP1 exon 5; Set A
aaauccugaaauggccccauaccu

SEQ ID NO: 38254 - RNA, 26 nt, Artificial Sequence
  Synthetic Oligonucleotide; NDFIP1 exon 5; Set A
caaauccugaaauggccccauaccuu

SEQ ID NO: 38255 - RNA, 31 nt, Artificial Sequence
  Synthetic Oligonucleotide; NDFIP1 exon 5; Set C
gaccaaauccugaaauggccccauaccuucc

SEQ ID NO: 38256 - RNA, 23 nt, Artificial Sequence
  Synthetic Oligonucleotide; NDFIP1 exon 5; Set C
aaauccugaaauggccccauacc

SEQ ID NO: 38257 - RNA, 25 nt, Artificial Sequence
  Synthetic Oligonucleotide; NDFIP1 exon 5; Set A
caaauccugaaauggccccauaccu

SEQ ID NO: 38258 - RNA, 32 nt, Artificial Sequence
  Synthetic Oligonucleotide; NDFIP1 exon 5; Set C
agaccaaauccugaaauggccccauaccuucc

SEQ ID NO: 38259 - RNA, 24 nt, Artificial Sequence
  Synthetic Oligonucleotide; NDFIP1 exon 5; Set A
caaauccugaaauggccccauacc

SEQ ID NO: 38260 - RNA, 18 nt, Artificial Sequence
  Synthetic Oligonucleotide; NDFIP1 exon 5; Set C
auccugaaauggccccau

SEQ ID NO: 38261 - RNA, 33 nt, Artificial Sequence
  Synthetic Oligonucleotide; NDFIP1 exon 5; Set C
gagaccaaauccugaaauggccccauaccuucc

SEQ ID NO: 38262 - RNA, 19 nt, Artificial Sequence
  Synthetic Oligonucleotide; NDFIP1 exon 5; Set C
aauccugaaauggccccau

SEQ ID NO: 38263 - RNA, 20 nt, Artificial Sequence
  Synthetic Oligonucleotide; NDFIP1 exon 5; Set C
aaauccugaaauggccccau

SEQ ID NO: 38264 - RNA, 33 nt, Artificial Sequence
  Synthetic Oligonucleotide; NDFIP1 exon 5; Set C
agagaccaaauccugaaauggccccauaccuuc

SEQ ID NO: 38265 - RNA, 21 nt, Artificial Sequence
  Synthetic Oligonucleotide; NDFIP1 exon 5; Set C
caaauccugaaauggccccau

SEQ ID NO: 38266 - RNA, 26 nt, Artificial Sequence
  Synthetic Oligonucleotide; NDFIP1 exon 5; Set A
gaccaaauccugaaauggccccauac

SEQ ID NO: 38267 - RNA, 32 nt, Artificial Sequence
  Synthetic Oligonucleotide; NDFIP1 exon 5; Set C
agagaccaaauccugaaauggccccauaccuu

SEQ ID NO: 38268 - RNA, 25 nt, Artificial Sequence
  Synthetic Oligonucleotide; NDFIP1 exon 5; Set A
gaccaaauccugaaauggccccaua

SEQ ID NO: 38269 - RNA, 27 nt, Artificial Sequence
  Synthetic Oligonucleotide; NDFIP1 exon 5; Set A
agaccaaauccugaaauggccccauac

SEQ ID NO: 38270 - RNA, 35 nt, Artificial Sequence
  Synthetic Oligonucleotide; NDFIP1 exon 5; Set C
agagagaccaaauccugaaauggccccauaccuuc

SEQ ID NO: 38271 - RNA, 31 nt, Artificial Sequence
  Synthetic Oligonucleotide; NDFIP1 exon 5; Set C
agagaccaaauccugaaauggccccauaccu

SEQ ID NO: 38272 - RNA, 33 nt, Artificial Sequence
  Synthetic Oligonucleotide; NDFIP1 exon 5; Set C
gagagaccaaauccugaaauggccccauaccuu

SEQ ID NO: 38273 - RNA, 26 nt, Artificial Sequence
  Synthetic Oligonucleotide; NDFIP1 exon 5; Set A
agaccaaauccugaaauggccccaua

SEQ ID NO: 38274 - RNA, 28 nt, Artificial Sequence
  Synthetic Oligonucleotide; NDFIP1 exon 5; Set A
gagaccaaauccugaaauggccccauac

SEQ ID NO: 38275 - RNA, 36 nt, Artificial Sequence
  Synthetic Oligonucleotide; NDFIP1 exon 5; Set C
gagagagaccaaauccugaaauggccccauaccuuc

SEQ ID NO: 38276 - RNA, 30 nt, Artificial Sequence
  Synthetic Oligonucleotide; NDFIP1 exon 5; Set C
agagaccaaauccugaaauggccccauacc

SEQ ID NO: 38277 - RNA, 32 nt, Artificial Sequence
  Synthetic Oligonucleotide; NDFIP1 exon 5; Set C
gagagaccaaauccugaaauggccccauaccu

SEQ ID NO: 38278 - RNA, 34 nt, Artificial Sequence
  Synthetic Oligonucleotide; NDFIP1 exon 5; Set C
agagagaccaaauccugaaauggccccauaccuu

SEQ ID NO: 38279 - RNA, 27 nt, Artificial Sequence
  Synthetic Oligonucleotide; NDFIP1 exon 5; Set A
gagaccaaauccugaaauggccccaua

SEQ ID NO: 38280 - RNA, 37 nt, Artificial Sequence
  Synthetic Oligonucleotide; NDFIP1 exon 5; Set C
agagagagaccaaauccugaaauggccccauaccuuc

SEQ ID NO: 38281 - RNA, 31 nt, Artificial Sequence
  Synthetic Oligonucleotide; NDFIP1 exon 5; Set C
gagagaccaaauccugaaauggccccauacc

SEQ ID NO: 38282 - RNA, 33 nt, Artificial Sequence
  Synthetic Oligonucleotide; NDFIP1 exon 5; Set C
agagagaccaaauccugaaauggccccauaccu

SEQ ID NO: 38283 - RNA, 35 nt, Artificial Sequence
  Synthetic Oligonucleotide; NDFIP1 exon 5; Set C
gagagagaccaaauccugaaauggccccauaccuu

SEQ ID NO: 38284 - RNA, 32 nt, Artificial Sequence
  Synthetic Oligonucleotide; NDFIP1 exon 5; Set C
agagagaccaaauccugaaauggccccauacc

SEQ ID NO: 38285 - RNA, 34 nt, Artificial Sequence
  Synthetic Oligonucleotide; NDFIP1 exon 5; Set C
gagagagaccaaauccugaaauggccccauaccu

SEQ ID NO: 38286 - RNA, 36 nt, Artificial Sequence
  Synthetic Oligonucleotide; NDFIP1 exon 5; Set C
agagagagaccaaauccugaaauggccccauaccuu

SEQ ID NO: 38287 - RNA, 33 nt, Artificial Sequence
  Synthetic Oligonucleotide; NDFIP1 exon 5; Set C
gagagagaccaaauccugaaauggccccauacc

SEQ ID NO: 38288 - RNA, 35 nt, Artificial Sequence
  Synthetic Oligonucleotide; NDFIP1 exon 5; Set C
agagagagaccaaauccugaaauggccccauaccu

SEQ ID NO: 38289 - RNA, 27 nt, Artificial Sequence
  Synthetic Oligonucleotide; NDFIP1 exon 5; Set A
agagaccaaauccugaaauggccccau

SEQ ID NO: 38290 - RNA, 34 nt, Artificial Sequence
  Synthetic Oligonucleotide; NDFIP1 exon 5; Set C
agagagagaccaaauccugaaauggccccauacc

SEQ ID NO: 38291 - RNA, 28 nt, Artificial Sequence
  Synthetic Oligonucleotide; NDFIP1 exon 5; Set A
gagagaccaaauccugaaauggccccau

SEQ ID NO: 38292 - RNA, 29 nt, Artificial Sequence
  Synthetic Oligonucleotide; NDFIP1 exon 5; Set A
agagagaccaaauccugaaauggccccau

SEQ ID NO: 38293 - RNA, 30 nt, Artificial Sequence
  Synthetic Oligonucleotide; NDFIP1 exon 5; Set C
gagagagaccaaauccugaaauggccccau

SEQ ID NO: 38294 - RNA, 31 nt, Artificial Sequence
  Synthetic Oligonucleotide; NDFIP1 exon 5; Set A
agagagagaccaaauccugaaauggccccau

SEQ ID NO: 38295 - RNA, 32 nt, Artificial Sequence
  Synthetic Oligonucleotide; NDFIP1 exon 5; Set C
uagagagagaccaaauccugaaauggccccau

SEQ ID NO: 38296 - RNA, 18 nt, Artificial Sequence
  Synthetic Oligonucleotide; NDFIP1 exon 5; Set C
auuuaauuagagagagac

SEQ ID NO: 38297 - RNA, 22 nt, Artificial Sequence
  Synthetic Oligonucleotide; NDFIP1 exon 5; Set C
ccauuuaauuagagagagacca

SEQ ID NO: 38298 - RNA, 17 nt, Artificial Sequence
  Synthetic Oligonucleotide; NDFIP1 exon 5; Set C
auuuaauuagagagaga

SEQ ID NO: 38299 - RNA, 19 nt, Artificial Sequence
  Synthetic Oligonucleotide; NDFIP1 exon 5; Set C
cauuuaauuagagagagac

SEQ ID NO: 38300 - RNA, 21 nt, Artificial Sequence
  Synthetic Oligonucleotide; NDFIP1 exon 5; Set C
ccauuuaauuagagagagacc

SEQ ID NO: 38301 - RNA, 16 nt, Artificial Sequence
  Synthetic Oligonucleotide; NDFIP1 exon 5; Set C
auuuaauuagagagag

SEQ ID NO: 38302 - RNA, 20 nt, Artificial Sequence
  Synthetic Oligonucleotide; NDFIP1 exon 5; Set C
ccauuuaauuagagagagac

SEQ ID NO: 38303 - RNA, 18 nt, Artificial Sequence
  Synthetic Oligonucleotide; NDFIP1 exon 5; Set C
cauuuaauuagagagaga

SEQ ID NO: 38304 - RNA, 17 nt, Artificial Sequence
  Synthetic Oligonucleotide; NDFIP1 exon 5; Set C
cauuuaauuagagagag

SEQ ID NO: 38305 - RNA, 19 nt, Artificial Sequence
  Synthetic Oligonucleotide; NDFIP1 exon 5; Set C
ccauuuaauuagagagaga

SEQ ID NO: 38306 - RNA, 18 nt, Artificial Sequence
  Synthetic Oligonucleotide; NDFIP1 exon 5; Set C
ccauuuaauuagagagag

SEQ ID NO: 38307 - RNA, 31 nt, Artificial Sequence
  Synthetic Oligonucleotide; NDFIP1 exon 5; Set A
aaucaggauccauuuaauuagagagagacca

SEQ ID NO: 38308 - RNA, 32 nt, Artificial Sequence
  Synthetic Oligonucleotide; NDFIP1 exon 5; Set A
caaucaggauccauuuaauuagagagagacca

SEQ ID NO: 38309 - RNA, 30 nt, Artificial Sequence
  Synthetic Oligonucleotide; NDFIP1 exon 5; Set A
aaucaggauccauuuaauuagagagagacc

SEQ ID NO: 38310 - RNA, 29 nt, Artificial Sequence
  Synthetic Oligonucleotide; NDFIP1 exon 5; Set C
aaucaggauccauuuaauuagagagagac

SEQ ID NO: 38311 - RNA, 33 nt, Artificial Sequence
  Synthetic Oligonucleotide; NDFIP1 exon 5; Set A
acaaucaggauccauuuaauuagagagagacca

SEQ ID NO: 38312 - RNA, 31 nt, Artificial Sequence
  Synthetic Oligonucleotide; NDFIP1 exon 5; Set A
caaucaggauccauuuaauuagagagagacc

SEQ ID NO: 38313 - RNA, 30 nt, Artificial Sequence
  Synthetic Oligonucleotide; NDFIP1 exon 5; Set C
caaucaggauccauuuaauuagagagagac

SEQ ID NO: 38314 - RNA, 28 nt, Artificial Sequence
  Synthetic Oligonucleotide; NDFIP1 exon 5; Set C
aaucaggauccauuuaauuagagagaga

SEQ ID NO: 38315 - RNA, 32 nt, Artificial Sequence
  Synthetic Oligonucleotide; NDFIP1 exon 5; Set A
acaaucaggauccauuuaauuagagagagacc

SEQ ID NO: 38316 - RNA, 29 nt, Artificial Sequence
  Synthetic Oligonucleotide; NDFIP1 exon 5; Set C
caaucaggauccauuuaauuagagagaga

SEQ ID NO: 38317 - RNA, 31 nt, Artificial Sequence
  Synthetic Oligonucleotide; NDFIP1 exon 5; Set A
acaaucaggauccauuuaauuagagagagac

SEQ ID NO: 38318 - RNA, 30 nt, Artificial Sequence
  Synthetic Oligonucleotide; NDFIP1 exon 5; Set C
acaaucaggauccauuuaauuagagagaga

SEQ ID NO: 38319 - RNA, 15 nt, Artificial Sequence
  Synthetic Oligonucleotide; NDFIP1 exon 5; Set C
caaucaggauccauu

SEQ ID NO: 38320 - RNA, 16 nt, Artificial Sequence
  Synthetic Oligonucleotide; NDFIP1 exon 5; Set C
acaaucaggauccauu

SEQ ID NO: 38321 - RNA, 15 nt, Artificial Sequence
  Synthetic Oligonucleotide; NDFIP1 exon 5; Set C
acaaucaggauccau

SEQ ID NO: 38322 - RNA, 40 nt, Artificial Sequence
  Synthetic Oligonucleotide; NDFIP1 exon 5; Set C
uacaacuuacccugacaaucaggauccauuuaauuagaga

SEQ ID NO: 38323 - RNA, 39 nt, Artificial Sequence
  Synthetic Oligonucleotide; NDFIP1 exon 5; Set A
uacaacuuacccugacaaucaggauccauuuaauuagag

SEQ ID NO: 38324 - RNA, 40 nt, Artificial Sequence
  Synthetic Oligonucleotide; NDFIP1 exon 5; Set A
auacaacuuacccugacaaucaggauccauuuaauuagag

SEQ ID NO: 38325 - RNA, 38 nt, Artificial Sequence
  Synthetic Oligonucleotide; NDFIP1 exon 5; Set A
uacaacuuacccugacaaucaggauccauuuaauuaga

SEQ ID NO: 38326 - RNA, 39 nt, Artificial Sequence
  Synthetic Oligonucleotide; NDFIP1 exon 5; Set A
auacaacuuacccugacaaucaggauccauuuaauuaga

SEQ ID NO: 38327 - RNA, 40 nt, Artificial Sequence
  Synthetic Oligonucleotide; NDFIP1 exon 5; Set A
uauacaacuuacccugacaaucaggauccauuuaauuaga

SEQ ID NO: 38328 - RNA, 32 nt, Artificial Sequence
  Synthetic Oligonucleotide; NDFIP1 exon 5; Set B
uacaacuuacccugacaaucaggauccauuua

SEQ ID NO: 38329 - RNA, 31 nt, Artificial Sequence
  Synthetic Oligonucleotide; NDFIP1 exon 5; Set B
uacaacuuacccugacaaucaggauccauuu

SEQ ID NO: 38330 - RNA, 32 nt, Artificial Sequence
  Synthetic Oligonucleotide; NDFIP1 exon 5; Set B
auacaacuuacccugacaaucaggauccauuu

SEQ ID NO: 38331 - RNA, 39 nt, Artificial Sequence
  Synthetic Oligonucleotide; NDFIP1 exon 5; Set C
uucuguuauacaacuuacccugacaaucaggauccauuu

SEQ ID NO: 38332 - RNA, 19 nt, Artificial Sequence
  Synthetic Oligonucleotide; NDFIP1 exon 5; Set C
uacaacuuacccugacaau

SEQ ID NO: 38333 - RNA, 18 nt, Artificial Sequence
  Synthetic Oligonucleotide; NDFIP1 exon 5; Set C
uacaacuuacccugacaa

SEQ ID NO: 38334 - RNA, 19 nt, Artificial Sequence
  Synthetic Oligonucleotide; NDFIP1 exon 5; Set C
auacaacuuacccugacaa

SEQ ID NO: 38335 - RNA, 17 nt, Artificial Sequence
  Synthetic Oligonucleotide; NDFIP1 exon 5; Set C
uacaacuuacccugaca

SEQ ID NO: 38336 - RNA, 18 nt, Artificial Sequence
  Synthetic Oligonucleotide; NDFIP1 exon 5; Set C
auacaacuuacccugaca

SEQ ID NO: 38337 - RNA, 19 nt, Artificial Sequence
  Synthetic Oligonucleotide; NDFIP1 exon 5; Set C
uauacaacuuacccugaca

SEQ ID NO: 38338 - RNA, 15 nt, Artificial Sequence
  Synthetic Oligonucleotide; NDFIP1 exon 6; Set C
aaacuaaaaaauaag

SEQ ID NO: 38339 - RNA, 16 nt, Artificial Sequence
  Synthetic Oligonucleotide; NDFIP1 exon 6; Set C
auauccagggaaauag

SEQ ID NO: 38340 - RNA, 15 nt, Artificial Sequence
  Synthetic Oligonucleotide; NDFIP1 exon 6; Set C
auauccagggaaaua

SEQ ID NO: 38341 - RNA, 17 nt, Artificial Sequence
  Synthetic Oligonucleotide; NDFIP1 exon 6; Set C
aauauccagggaaauag

SEQ ID NO: 38342 - RNA, 16 nt, Artificial Sequence
  Synthetic Oligonucleotide; NDFIP1 exon 6; Set C
aauauccagggaaaua

SEQ ID NO: 38343 - RNA, 18 nt, Artificial Sequence
  Synthetic Oligonucleotide; NDFIP1 exon 6; Set C
aaauauccagggaaauag

SEQ ID NO: 38344 - RNA, 15 nt, Artificial Sequence
  Synthetic Oligonucleotide; NDFIP1 exon 6; Set C
aauauccagggaaau

SEQ ID NO: 38345 - RNA, 17 nt, Artificial Sequence
  Synthetic Oligonucleotide; NDFIP1 exon 6; Set C
aaauauccagggaaaua

SEQ ID NO: 38346 - RNA, 16 nt, Artificial Sequence
  Synthetic Oligonucleotide; NDFIP1 exon 6; Set C
aaauauccagggaaau

SEQ ID NO: 38347 - RNA, 18 nt, Artificial Sequence
  Synthetic Oligonucleotide; NDFIP1 exon 6; Set C
aaaauauccagggaaaua

SEQ ID NO: 38348 - RNA, 15 nt, Artificial Sequence
  Synthetic Oligonucleotide; NDFIP1 exon 6; Set C
aaauauccagggaaa

SEQ ID NO: 38349 - RNA, 17 nt, Artificial Sequence
  Synthetic Oligonucleotide; NDFIP1 exon 6; Set C
aaaauauccagggaaau

SEQ ID NO: 38350 - RNA, 19 nt, Artificial Sequence
  Synthetic Oligonucleotide; NDFIP1 exon 6; Set C
caaaauauccagggaaaua

SEQ ID NO: 38351 - RNA, 16 nt, Artificial Sequence
  Synthetic Oligonucleotide; NDFIP1 exon 6; Set C
aaaauauccagggaaa

SEQ ID NO: 38352 - RNA, 18 nt, Artificial Sequence
  Synthetic Oligonucleotide; NDFIP1 exon 6; Set C
caaaauauccagggaaau

SEQ ID NO: 38353 - RNA, 20 nt, Artificial Sequence
  Synthetic Oligonucleotide; NDFIP1 exon 6; Set C
ucaaaauauccagggaaaua

SEQ ID NO: 38354 - RNA, 17 nt, Artificial Sequence
  Synthetic Oligonucleotide; NDFIP1 exon 6; Set C
caaaauauccagggaaa

SEQ ID NO: 38355 - RNA, 15 nt, Artificial Sequence
  Synthetic Oligonucleotide; NDFIP1 exon 6; Set C
aaaauauccagggaa

SEQ ID NO: 38356 - RNA, 21 nt, Artificial Sequence
  Synthetic Oligonucleotide; NDFIP1 exon 6; Set C
aucaaaauauccagggaaaua

SEQ ID NO: 38357 - RNA, 16 nt, Artificial Sequence
  Synthetic Oligonucleotide; NDFIP1 exon 6; Set C
caaaauauccagggaa

SEQ ID NO: 38358 - RNA, 15 nt, Artificial Sequence
  Synthetic Oligonucleotide; NDFIP1 exon 6; Set C
caaaauauccaggga

SEQ ID NO: 38359 - RNA, 15 nt, Artificial Sequence
  Synthetic Oligonucleotide; NDFIP1 exon 6; Set C
uaaaacaaggaacac

SEQ ID NO: 38360 - RNA, 38 nt, Artificial Sequence
  Synthetic Oligonucleotide; NDFIP1 exon 6; Set A
uucuuacauuaaaaacacuuaccuaaaacaaggaacac

SEQ ID NO: 38361 - RNA, 37 nt, Artificial Sequence
  Synthetic Oligonucleotide; NDFIP1 exon 6; Set C
uucuuacauuaaaaacacuuaccuaaaacaaggaaca

SEQ ID NO: 38362 - RNA, 39 nt, Artificial Sequence
  Synthetic Oligonucleotide; NDFIP1 exon 6; Set A
uuucuuacauuaaaaacacuuaccuaaaacaaggaacac

SEQ ID NO: 38363 - RNA, 38 nt, Artificial Sequence
  Synthetic Oligonucleotide; NDFIP1 exon 6; Set C
uuucuuacauuaaaaacacuuaccuaaaacaaggaaca

SEQ ID NO: 38364 - RNA, 40 nt, Artificial Sequence
  Synthetic Oligonucleotide; NDFIP1 exon 6; Set A
uuuucuuacauuaaaaacacuuaccuaaaacaaggaacac

SEQ ID NO: 38365 - RNA, 39 nt, Artificial Sequence
  Synthetic Oligonucleotide; NDFIP1 exon 6; Set A
uuuucuuacauuaaaaacacuuaccuaaaacaaggaaca

SEQ ID NO: 38366 - RNA, 40 nt, Artificial Sequence
  Synthetic Oligonucleotide; NDFIP1 exon 6; Set A
cuuuucuuacauuaaaaacacuuaccuaaaacaaggaaca

SEQ ID NO: 38367 - RNA, 21 nt, Artificial Sequence
  Synthetic Oligonucleotide; NDFIP1 exon 6; Set C
uucuuacauuaaaaacacuua

SEQ ID NO: 38368 - RNA, 22 nt, Artificial Sequence
  Synthetic Oligonucleotide; NDFIP1 exon 6; Set C
uuucuuacauuaaaaacacuua

SEQ ID NO: 38369 - RNA, 20 nt, Artificial Sequence
  Synthetic Oligonucleotide; NDFIP1 exon 6; Set C
uucuuacauuaaaaacacuu

SEQ ID NO: 38370 - RNA, 23 nt, Artificial Sequence
  Synthetic Oligonucleotide; NDFIP1 exon 6; Set C
uuuucuuacauuaaaaacacuua

SEQ ID NO: 38371 - RNA, 21 nt, Artificial Sequence
  Synthetic Oligonucleotide; NDFIP1 exon 6; Set C
uuucuuacauuaaaaacacuu

SEQ ID NO: 38372 - RNA, 19 nt, Artificial Sequence
  Synthetic Oligonucleotide; NDFIP1 exon 6; Set C
uucuuacauuaaaaacacu

SEQ ID NO: 38373 - RNA, 24 nt, Artificial Sequence
  Synthetic Oligonucleotide; NDFIP1 exon 6; Set C
cuuuucuuacauuaaaaacacuua

SEQ ID NO: 38374 - RNA, 22 nt, Artificial Sequence
  Synthetic Oligonucleotide; NDFIP1 exon 6; Set C
uuuucuuacauuaaaaacacuu

SEQ ID NO: 38375 - RNA, 18 nt, Artificial Sequence
  Synthetic Oligonucleotide; NDFIP1 exon 6; Set C
uucuuacauuaaaaacac

SEQ ID NO: 38376 - RNA, 20 nt, Artificial Sequence
  Synthetic Oligonucleotide; NDFIP1 exon 6; Set C
uuucuuacauuaaaaacacu

SEQ ID NO: 38377 - RNA, 25 nt, Artificial Sequence
  Synthetic Oligonucleotide; NDFIP1 exon 6; Set C
ccuuuucuuacauuaaaaacacuua

SEQ ID NO: 38378 - RNA, 17 nt, Artificial Sequence
  Synthetic Oligonucleotide; NDFIP1 exon 6; Set C
uucuuacauuaaaaaca

SEQ ID NO: 38379 - RNA, 23 nt, Artificial Sequence
  Synthetic Oligonucleotide; NDFIP1 exon 6; Set C
cuuuucuuacauuaaaaacacuu

SEQ ID NO: 38380 - RNA, 19 nt, Artificial Sequence
  Synthetic Oligonucleotide; NDFIP1 exon 6; Set C
uuucuuacauuaaaaacac

SEQ ID NO: 38381 - RNA, 21 nt, Artificial Sequence
  Synthetic Oligonucleotide; NDFIP1 exon 6; Set C
uuuucuuacauuaaaaacacu

SEQ ID NO: 38382 - RNA, 16 nt, Artificial Sequence
  Synthetic Oligonucleotide; NDFIP1 exon 6; Set C
uucuuacauuaaaaac

SEQ ID NO: 38383 - RNA, 18 nt, Artificial Sequence
  Synthetic Oligonucleotide; NDFIP1 exon 6; Set C
uuucuuacauuaaaaaca

SEQ ID NO: 38384 - RNA, 24 nt, Artificial Sequence
  Synthetic Oligonucleotide; NDFIP1 exon 6; Set C
ccuuuucuuacauuaaaaacacuu

SEQ ID NO: 38385 - RNA, 20 nt, Artificial Sequence
  Synthetic Oligonucleotide; NDFIP1 exon 6; Set C
uuuucuuacauuaaaaacac

SEQ ID NO: 38386 - RNA, 22 nt, Artificial Sequence
  Synthetic Oligonucleotide; NDFIP1 exon 6; Set C
cuuuucuuacauuaaaaacacu

SEQ ID NO: 38387 - RNA, 17 nt, Artificial Sequence
  Synthetic Oligonucleotide; NDFIP1 exon 6; Set C
uuucuuacauuaaaaac

SEQ ID NO: 38388 - RNA, 15 nt, Artificial Sequence
  Synthetic Oligonucleotide; NDFIP1 exon 6; Set C
uucuuacauuaaaaa

SEQ ID NO: 38389 - RNA, 19 nt, Artificial Sequence
  Synthetic Oligonucleotide; NDFIP1 exon 6; Set C
uuuucuuacauuaaaaaca

SEQ ID NO: 38390 - RNA, 21 nt, Artificial Sequence
  Synthetic Oligonucleotide; NDFIP1 exon 6; Set C
cuuuucuuacauuaaaaacac

SEQ ID NO: 38391 - RNA, 23 nt, Artificial Sequence
  Synthetic Oligonucleotide; NDFIP1 exon 6; Set C
ccuuuucuuacauuaaaaacacu

SEQ ID NO: 38392 - RNA, 18 nt, Artificial Sequence
  Synthetic Oligonucleotide; NDFIP1 exon 6; Set C
uuuucuuacauuaaaaac

SEQ ID NO: 38393 - RNA, 16 nt, Artificial Sequence
  Synthetic Oligonucleotide; NDFIP1 exon 6; Set C
uuucuuacauuaaaaa

SEQ ID NO: 38394 - RNA, 20 nt, Artificial Sequence
  Synthetic Oligonucleotide; NDFIP1 exon 6; Set C
cuuuucuuacauuaaaaaca

SEQ ID NO: 38395 - RNA, 22 nt, Artificial Sequence
  Synthetic Oligonucleotide; NDFIP1 exon 6; Set C
ccuuuucuuacauuaaaaacac

SEQ ID NO: 38396 - RNA, 19 nt, Artificial Sequence
  Synthetic Oligonucleotide; NDFIP1 exon 6; Set C
cuuuucuuacauuaaaaac

SEQ ID NO: 38397 - RNA, 17 nt, Artificial Sequence
  Synthetic Oligonucleotide; NDFIP1 exon 6; Set C
uuuucuuacauuaaaaa

SEQ ID NO: 38398 - RNA, 15 nt, Artificial Sequence
  Synthetic Oligonucleotide; NDFIP1 exon 6; Set C
uuucuuacauuaaaa

SEQ ID NO: 38399 - RNA, 21 nt, Artificial Sequence
  Synthetic Oligonucleotide; NDFIP1 exon 6; Set C
ccuuuucuuacauuaaaaaca

SEQ ID NO: 38400 - RNA, 20 nt, Artificial Sequence
  Synthetic Oligonucleotide; NDFIP1 exon 6; Set C
ccuuuucuuacauuaaaaac

SEQ ID NO: 38401 - RNA, 18 nt, Artificial Sequence
  Synthetic Oligonucleotide; NDFIP1 exon 6; Set C
cuuuucuuacauuaaaaa

SEQ ID NO: 38402 - RNA, 16 nt, Artificial Sequence
  Synthetic Oligonucleotide; NDFIP1 exon 6; Set C
uuuucuuacauuaaaa

SEQ ID NO: 38403 - RNA, 19 nt, Artificial Sequence
  Synthetic Oligonucleotide; NDFIP1 exon 6; Set C
ccuuuucuuacauuaaaaa

SEQ ID NO: 38404 - RNA, 17 nt, Artificial Sequence
  Synthetic Oligonucleotide; NDFIP1 exon 6; Set C
cuuuucuuacauuaaaa

SEQ ID NO: 38405 - RNA, 18 nt, Artificial Sequence
  Synthetic Oligonucleotide; NDFIP1 exon 6; Set C
ccuuuucuuacauuaaaa

SEQ ID NO: 38406 - RNA, 17 nt, Artificial Sequence
  Synthetic Oligonucleotide; NDFIP1 exon 6; Set C
uuaacagacacaauuuc

SEQ ID NO: 38407 - RNA, 16 nt, Artificial Sequence
  Synthetic Oligonucleotide; NDFIP1 exon 6; Set C
uuaacagacacaauuu

SEQ ID NO: 38408 - RNA, 18 nt, Artificial Sequence
  Synthetic Oligonucleotide; NDFIP1 exon 6; Set C
cuuaacagacacaauuuc

SEQ ID NO: 38409 - RNA, 17 nt, Artificial Sequence
  Synthetic Oligonucleotide; NDFIP1 exon 6; Set C
cuuaacagacacaauuu

SEQ ID NO: 38410 - RNA, 19 nt, Artificial Sequence
  Synthetic Oligonucleotide; NDFIP1 exon 6; Set C
gcuuaacagacacaauuuc

SEQ ID NO: 38411 - RNA, 18 nt, Artificial Sequence
  Synthetic Oligonucleotide; NDFIP1 exon 6; Set C
gcuuaacagacacaauuu

SEQ ID NO: 38412 - RNA, 20 nt, Artificial Sequence
  Synthetic Oligonucleotide; NDFIP1 exon 6; Set C
agcuuaacagacacaauuuc

SEQ ID NO: 38413 - RNA, 19 nt, Artificial Sequence
  Synthetic Oligonucleotide; NDFIP1 exon 6; Set C
agcuuaacagacacaauuu

SEQ ID NO: 38414 - RNA, 24 nt, Artificial Sequence
  Synthetic Oligonucleotide; NDFIP1 exon 6; Set C
uagcagcuuaacagacacaauuuc

SEQ ID NO: 38415 - RNA, 23 nt, Artificial Sequence
  Synthetic Oligonucleotide; NDFIP1 exon 6; Set C
uagcagcuuaacagacacaauuu

SEQ ID NO: 38416 - RNA, 25 nt, Artificial Sequence
  Synthetic Oligonucleotide; NDFIP1 exon 6; Set C
auagcagcuuaacagacacaauuuc

SEQ ID NO: 38417 - RNA, 24 nt, Artificial Sequence
  Synthetic Oligonucleotide; NDFIP1 exon 6; Set C
auagcagcuuaacagacacaauuu

SEQ ID NO: 38418 - RNA, 26 nt, Artificial Sequence
  Synthetic Oligonucleotide; NDFIP1 exon 6; Set C
uauagcagcuuaacagacacaauuuc

SEQ ID NO: 38419 - RNA, 25 nt, Artificial Sequence
  Synthetic Oligonucleotide; NDFIP1 exon 6; Set C
uauagcagcuuaacagacacaauuu

SEQ ID NO: 38420 - RNA, 27 nt, Artificial Sequence
  Synthetic Oligonucleotide; NDFIP1 exon 6; Set C
uuauagcagcuuaacagacacaauuuc

SEQ ID NO: 38421 - RNA, 26 nt, Artificial Sequence
  Synthetic Oligonucleotide; NDFIP1 exon 6; Set C
uuauagcagcuuaacagacacaauuu

SEQ ID NO: 38422 - RNA, 16 nt, Artificial Sequence
  Synthetic Oligonucleotide; NDFIP1 exon 6; Set C
uagcagcuuaacagac

SEQ ID NO: 38423 - RNA, 15 nt, Artificial Sequence
  Synthetic Oligonucleotide; NDFIP1 exon 6; Set C
uagcagcuuaacaga

SEQ ID NO: 38424 - RNA, 17 nt, Artificial Sequence
  Synthetic Oligonucleotide; NDFIP1 exon 6; Set C
auagcagcuuaacagac

SEQ ID NO: 38425 - RNA, 33 nt, Artificial Sequence
  Synthetic Oligonucleotide; NDFIP1 exon 6; Set A
aacacuuuauagcagcuuaacagacacaauuuc

SEQ ID NO: 38426 - RNA, 16 nt, Artificial Sequence
  Synthetic Oligonucleotide; NDFIP1 exon 6; Set C
auagcagcuuaacaga

SEQ ID NO: 38427 - RNA, 32 nt, Artificial Sequence
  Synthetic Oligonucleotide; NDFIP1 exon 6; Set A
aacacuuuauagcagcuuaacagacacaauuu

SEQ ID NO: 38428 - RNA, 18 nt, Artificial Sequence
  Synthetic Oligonucleotide; NDFIP1 exon 6; Set C
uauagcagcuuaacagac

SEQ ID NO: 38429 - RNA, 17 nt, Artificial Sequence
  Synthetic Oligonucleotide; NDFIP1 exon 6; Set C
uauagcagcuuaacaga

SEQ ID NO: 38430 - RNA, 19 nt, Artificial Sequence
  Synthetic Oligonucleotide; NDFIP1 exon 6; Set C
uuauagcagcuuaacagac

SEQ ID NO: 38431 - RNA, 15 nt, Artificial Sequence
  Synthetic Oligonucleotide; NDFIP1 exon 6; Set C
auagcagcuuaacag

SEQ ID NO: 38432 - RNA, 18 nt, Artificial Sequence
  Synthetic Oligonucleotide; NDFIP1 exon 6; Set C
uuauagcagcuuaacaga

SEQ ID NO: 38433 - RNA, 16 nt, Artificial Sequence
  Synthetic Oligonucleotide; NDFIP1 exon 6; Set C
uauagcagcuuaacag

SEQ ID NO: 38434 - RNA, 17 nt, Artificial Sequence
  Synthetic Oligonucleotide; NDFIP1 exon 6; Set C
uuauagcagcuuaacag

SEQ ID NO: 38435 - RNA, 40 nt, Artificial Sequence
  Synthetic Oligonucleotide; NDFIP1 exon 6; Set A
aaggcaaaacacuuuauagcagcuuaacagacacaauuuc

SEQ ID NO: 38436 - RNA, 23 nt, Artificial Sequence
  Synthetic Oligonucleotide; NDFIP1 exon 6; Set C
acacuuuauagcagcuuaacaga

SEQ ID NO: 38437 - RNA, 39 nt, Artificial Sequence
  Synthetic Oligonucleotide; NDFIP1 exon 6; Set A
aaggcaaaacacuuuauagcagcuuaacagacacaauuu

SEQ ID NO: 38438 - RNA, 25 nt, Artificial Sequence
  Synthetic Oligonucleotide; NDFIP1 exon 6; Set C
aacacuuuauagcagcuuaacagac

SEQ ID NO: 38439 - RNA, 24 nt, Artificial Sequence
  Synthetic Oligonucleotide; NDFIP1 exon 6; Set C
aacacuuuauagcagcuuaacaga

SEQ ID NO: 38440 - RNA, 40 nt, Artificial Sequence
  Synthetic Oligonucleotide; NDFIP1 exon 6; Set A
uaaggcaaaacacuuuauagcagcuuaacagacacaauuu

SEQ ID NO: 38441 - RNA, 23 nt, Artificial Sequence
  Synthetic Oligonucleotide; NDFIP1 exon 6; Set C
aacacuuuauagcagcuuaacag

SEQ ID NO: 38442 - RNA, 32 nt, Artificial Sequence
  Synthetic Oligonucleotide; NDFIP1 exon 6; Set A
aaggcaaaacacuuuauagcagcuuaacagac

SEQ ID NO: 38443 - RNA, 31 nt, Artificial Sequence
  Synthetic Oligonucleotide; NDFIP1 exon 6; Set A
aaggcaaaacacuuuauagcagcuuaacaga

SEQ ID NO: 38444 - RNA, 33 nt, Artificial Sequence
  Synthetic Oligonucleotide; NDFIP1 exon 6; Set A
uaaggcaaaacacuuuauagcagcuuaacagac

SEQ ID NO: 38445 - RNA, 32 nt, Artificial Sequence
  Synthetic Oligonucleotide; NDFIP1 exon 6; Set A
uaaggcaaaacacuuuauagcagcuuaacaga

SEQ ID NO: 38446 - RNA, 34 nt, Artificial Sequence
  Synthetic Oligonucleotide; NDFIP1 exon 6; Set A
auaaggcaaaacacuuuauagcagcuuaacagac

SEQ ID NO: 38447 - RNA, 33 nt, Artificial Sequence
  Synthetic Oligonucleotide; NDFIP1 exon 6; Set A
auaaggcaaaacacuuuauagcagcuuaacaga

SEQ ID NO: 38448 - RNA, 31 nt, Artificial Sequence
  Synthetic Oligonucleotide; NDFIP1 exon 6; Set A
uaaggcaaaacacuuuauagcagcuuaacag

SEQ ID NO: 38449 - RNA, 32 nt, Artificial Sequence
  Synthetic Oligonucleotide; NDFIP1 exon 6; Set A
auaaggcaaaacacuuuauagcagcuuaacag

SEQ ID NO: 38450 - RNA, 38 nt, Artificial Sequence
  Synthetic Oligonucleotide; NDFIP1 exon 6; Set A
aaaaauaaggcaaaacacuuuauagcagcuuaacagac

SEQ ID NO: 38451 - RNA, 37 nt, Artificial Sequence
  Synthetic Oligonucleotide; NDFIP1 exon 6; Set A
aaaaauaaggcaaaacacuuuauagcagcuuaacaga

SEQ ID NO: 38452 - RNA, 36 nt, Artificial Sequence
  Synthetic Oligonucleotide; NDFIP1 exon 6; Set C
aaaaauaaggcaaaacacuuuauagcagcuuaacag

SEQ ID NO: 38453 - RNA, 40 nt, Artificial Sequence
  Synthetic Oligonucleotide; NDFIP1 exon 6; Set A
uaaaaaauaaggcaaaacacuuuauagcagcuuaacagac

SEQ ID NO: 38454 - RNA, 39 nt, Artificial Sequence
  Synthetic Oligonucleotide; NDFIP1 exon 6; Set A
uaaaaaauaaggcaaaacacuuuauagcagcuuaacaga

SEQ ID NO: 38455 - RNA, 40 nt, Artificial Sequence
  Synthetic Oligonucleotide; NDFIP1 exon 6; Set A
cuaaaaaauaaggcaaaacacuuuauagcagcuuaacaga

SEQ ID NO: 38456 - RNA, 38 nt, Artificial Sequence
  Synthetic Oligonucleotide; NDFIP1 exon 6; Set C
uaaaaaauaaggcaaaacacuuuauagcagcuuaacag

SEQ ID NO: 38457 - RNA, 40 nt, Artificial Sequence
  Synthetic Oligonucleotide; NDFIP1 exon 6; Set A
acuaaaaaauaaggcaaaacacuuuauagcagcuuaacag

SEQ ID NO: 38458 - RNA, 36 nt, Artificial Sequence
  Synthetic Oligonucleotide; NDFIP1 exon 6; Set C
acuaaaaaauaaggcaaaacacuuuauagcagcuua

SEQ ID NO: 38459 - RNA, 37 nt, Artificial Sequence
  Synthetic Oligonucleotide; NDFIP1 exon 6; Set C
aacuaaaaaauaaggcaaaacacuuuauagcagcuua

SEQ ID NO: 38460 - RNA, 38 nt, Artificial Sequence
  Synthetic Oligonucleotide; NDFIP1 exon 6; Set C
aaacuaaaaaauaaggcaaaacacuuuauagcagcuua

SEQ ID NO: 38461 - RNA, 24 nt, Artificial Sequence
  Synthetic Oligonucleotide; NDFIP1 exon 6; Set C
aaaaauaaggcaaaacacuuuaua

SEQ ID NO: 38462 - RNA, 26 nt, Artificial Sequence
  Synthetic Oligonucleotide; NDFIP1 exon 6; Set C
uaaaaaauaaggcaaaacacuuuaua

SEQ ID NO: 38463 - RNA, 28 nt, Artificial Sequence
  Synthetic Oligonucleotide; NDFIP1 exon 6; Set C
acuaaaaaauaaggcaaaacacuuuaua

SEQ ID NO: 38464 - RNA, 29 nt, Artificial Sequence
  Synthetic Oligonucleotide; NDFIP1 exon 6; Set C
aacuaaaaaauaaggcaaaacacuuuaua

SEQ ID NO: 38465 - RNA, 27 nt, Artificial Sequence
  Synthetic Oligonucleotide; NDFIP1 exon 6; Set C
acuaaaaaauaaggcaaaacacuuuau

SEQ ID NO: 38466 - RNA, 30 nt, Artificial Sequence
  Synthetic Oligonucleotide; NDFIP1 exon 6; Set C
aaacuaaaaaauaaggcaaaacacuuuaua

SEQ ID NO: 38467 - RNA, 28 nt, Artificial Sequence
  Synthetic Oligonucleotide; NDFIP1 exon 6; Set C
aacuaaaaaauaaggcaaaacacuuuau

SEQ ID NO: 38468 - RNA, 27 nt, Artificial Sequence
  Synthetic Oligonucleotide; NDFIP1 exon 6; Set C
aacuaaaaaauaaggcaaaacacuuua

SEQ ID NO: 38469 - RNA, 29 nt, Artificial Sequence
  Synthetic Oligonucleotide; NDFIP1 exon 6; Set C
aaacuaaaaaauaaggcaaaacacuuuau

SEQ ID NO: 38470 - RNA, 28 nt, Artificial Sequence
  Synthetic Oligonucleotide; NDFIP1 exon 6; Set C
aaacuaaaaaauaaggcaaaacacuuua

SEQ ID NO: 38471 - RNA, 40 nt, Artificial Sequence
  Synthetic Oligonucleotide; NDFIP1 exon 6; Set C
auagguggaaaacuaaaaaauaaggcaaaacacuuuauag

SEQ ID NO: 38472 - RNA, 22 nt, Artificial Sequence
  Synthetic Oligonucleotide; NDFIP1 exon 6; Set C
aaacuaaaaaauaaggcaaaac

SEQ ID NO: 38473 - RNA, 39 nt, Artificial Sequence
  Synthetic Oligonucleotide; NDFIP1 exon 6; Set C
auagguggaaaacuaaaaaauaaggcaaaacacuuuaua

SEQ ID NO: 38474 - RNA, 40 nt, Artificial Sequence
  Synthetic Oligonucleotide; NDFIP1 exon 6; Set C
aauagguggaaaacuaaaaaauaaggcaaaacacuuuaua

SEQ ID NO: 38475 - RNA, 38 nt, Artificial Sequence
  Synthetic Oligonucleotide; NDFIP1 exon 6; Set C
auagguggaaaacuaaaaaauaaggcaaaacacuuuau

SEQ ID NO: 38476 - RNA, 37 nt, Artificial Sequence
  Synthetic Oligonucleotide; NDFIP1 exon 6; Set C
auagguggaaaacuaaaaaauaaggcaaaacacuuua

SEQ ID NO: 38477 - RNA, 39 nt, Artificial Sequence
  Synthetic Oligonucleotide; NDFIP1 exon 6; Set C
aauagguggaaaacuaaaaaauaaggcaaaacacuuuau

SEQ ID NO: 38478 - RNA, 38 nt, Artificial Sequence
  Synthetic Oligonucleotide; NDFIP1 exon 6; Set C
aauagguggaaaacuaaaaaauaaggcaaaacacuuua

SEQ ID NO: 38479 - RNA, 40 nt, Artificial Sequence
  Synthetic Oligonucleotide; NDFIP1 exon 6; Set C
aaauagguggaaaacuaaaaaauaaggcaaaacacuuuau

SEQ ID NO: 38480 - RNA, 39 nt, Artificial Sequence
  Synthetic Oligonucleotide; NDFIP1 exon 6; Set C
aaauagguggaaaacuaaaaaauaaggcaaaacacuuua

SEQ ID NO: 38481 - RNA, 40 nt, Artificial Sequence
  Synthetic Oligonucleotide; NDFIP1 exon 6; Set C
gaaauagguggaaaacuaaaaaauaaggcaaaacacuuua

SEQ ID NO: 38482 - RNA, 32 nt, Artificial Sequence
  Synthetic Oligonucleotide; NDFIP1 exon 6; Set C
aauagguggaaaacuaaaaaauaaggcaaaac

SEQ ID NO: 38483 - RNA, 33 nt, Artificial Sequence
  Synthetic Oligonucleotide; NDFIP1 exon 6; Set C
aaauagguggaaaacuaaaaaauaaggcaaaac

SEQ ID NO: 38484 - RNA, 35 nt, Artificial Sequence
  Synthetic Oligonucleotide; NDFIP1 exon 6; Set C
gaaauagguggaaaacuaaaaaauaaggcaaaaca

SEQ ID NO: 38485 - RNA, 34 nt, Artificial Sequence
  Synthetic Oligonucleotide; NDFIP1 exon 6; Set C
gaaauagguggaaaacuaaaaaauaaggcaaaac

SEQ ID NO: 38486 - RNA, 23 nt, Artificial Sequence
  Synthetic Oligonucleotide; NDFIP1 exon 6; Set C
uagguggaaaacuaaaaaauaag

SEQ ID NO: 38487 - RNA, 24 nt, Artificial Sequence
  Synthetic Oligonucleotide; NDFIP1 exon 6; Set C
auagguggaaaacuaaaaaauaag

SEQ ID NO: 38488 - RNA, 22 nt, Artificial Sequence
  Synthetic Oligonucleotide; NDFIP1 exon 6; Set C
uagguggaaaacuaaaaaauaa

SEQ ID NO: 38489 - RNA, 25 nt, Artificial Sequence
  Synthetic Oligonucleotide; NDFIP1 exon 6; Set C
aauagguggaaaacuaaaaaauaag

SEQ ID NO: 38490 - RNA, 23 nt, Artificial Sequence
  Synthetic Oligonucleotide; NDFIP1 exon 6; Set C
auagguggaaaacuaaaaaauaa

SEQ ID NO: 38491 - RNA, 21 nt, Artificial Sequence
  Synthetic Oligonucleotide; NDFIP1 exon 6; Set C
uagguggaaaacuaaaaaaua

SEQ ID NO: 38492 - RNA, 26 nt, Artificial Sequence
  Synthetic Oligonucleotide; NDFIP1 exon 6; Set C
aaauagguggaaaacuaaaaaauaag

SEQ ID NO: 38493 - RNA, 24 nt, Artificial Sequence
  Synthetic Oligonucleotide; NDFIP1 exon 6; Set C
aauagguggaaaacuaaaaaauaa

SEQ ID NO: 38494 - RNA, 22 nt, Artificial Sequence
  Synthetic Oligonucleotide; NDFIP1 exon 6; Set C
auagguggaaaacuaaaaaaua

SEQ ID NO: 38495 - RNA, 25 nt, Artificial Sequence
  Synthetic Oligonucleotide; NDFIP1 exon 6; Set C
aaauagguggaaaacuaaaaaauaa

SEQ ID NO: 38496 - RNA, 27 nt, Artificial Sequence
  Synthetic Oligonucleotide; NDFIP1 exon 6; Set C
gaaauagguggaaaacuaaaaaauaag

SEQ ID NO: 38497 - RNA, 23 nt, Artificial Sequence
  Synthetic Oligonucleotide; NDFIP1 exon 6; Set C
aauagguggaaaacuaaaaaaua

SEQ ID NO: 38498 - RNA, 26 nt, Artificial Sequence
  Synthetic Oligonucleotide; NDFIP1 exon 6; Set C
gaaauagguggaaaacuaaaaaauaa

SEQ ID NO: 38499 - RNA, 28 nt, Artificial Sequence
  Synthetic Oligonucleotide; NDFIP1 exon 6; Set C
ggaaauagguggaaaacuaaaaaauaag

SEQ ID NO: 38500 - RNA, 24 nt, Artificial Sequence
  Synthetic Oligonucleotide; NDFIP1 exon 6; Set C
aaauagguggaaaacuaaaaaaua

SEQ ID NO: 38501 - RNA, 27 nt, Artificial Sequence
  Synthetic Oligonucleotide; NDFIP1 exon 6; Set C
ggaaauagguggaaaacuaaaaaauaa

SEQ ID NO: 38502 - RNA, 29 nt, Artificial Sequence
  Synthetic Oligonucleotide; NDFIP1 exon 6; Set C
gggaaauagguggaaaacuaaaaaauaag

SEQ ID NO: 38503 - RNA, 25 nt, Artificial Sequence
  Synthetic Oligonucleotide; NDFIP1 exon 6; Set C
gaaauagguggaaaacuaaaaaaua

SEQ ID NO: 38504 - RNA, 23 nt, Artificial Sequence
  Synthetic Oligonucleotide; NDFIP1 exon 6; Set C
aaauagguggaaaacuaaaaaau

SEQ ID NO: 38505 - RNA, 28 nt, Artificial Sequence
  Synthetic Oligonucleotide; NDFIP1 exon 6; Set C
gggaaauagguggaaaacuaaaaaauaa

SEQ ID NO: 38506 - RNA, 30 nt, Artificial Sequence
  Synthetic Oligonucleotide; NDFIP1 exon 6; Set C
agggaaauagguggaaaacuaaaaaauaag

SEQ ID NO: 38507 - RNA, 26 nt, Artificial Sequence
  Synthetic Oligonucleotide; NDFIP1 exon 6; Set C
ggaaauagguggaaaacuaaaaaaua

SEQ ID NO: 38508 - RNA, 18 nt, Artificial Sequence
  Synthetic Oligonucleotide; NDFIP1 exon 6; Set C
auagguggaaaacuaaaa

SEQ ID NO: 38509 - RNA, 22 nt, Artificial Sequence
  Synthetic Oligonucleotide; NDFIP1 exon 6; Set C
aaauagguggaaaacuaaaaaa

SEQ ID NO: 38510 - RNA, 24 nt, Artificial Sequence
  Synthetic Oligonucleotide; NDFIP1 exon 6; Set C
gaaauagguggaaaacuaaaaaau

SEQ ID NO: 38511 - RNA, 31 nt, Artificial Sequence
  Synthetic Oligonucleotide; NDFIP1 exon 6; Set C
cagggaaauagguggaaaacuaaaaaauaag

SEQ ID NO: 38512 - RNA, 29 nt, Artificial Sequence
  Synthetic Oligonucleotide; NDFIP1 exon 6; Set C
agggaaauagguggaaaacuaaaaaauaa

SEQ ID NO: 38513 - RNA, 27 nt, Artificial Sequence
  Synthetic Oligonucleotide; NDFIP1 exon 6; Set C
gggaaauagguggaaaacuaaaaaaua

SEQ ID NO: 38514 - RNA, 19 nt, Artificial Sequence
  Synthetic Oligonucleotide; NDFIP1 exon 6; Set C
aauagguggaaaacuaaaa

SEQ ID NO: 38515 - RNA, 23 nt, Artificial Sequence
  Synthetic Oligonucleotide; NDFIP1 exon 6; Set C
gaaauagguggaaaacuaaaaaa

SEQ ID NO: 38516 - RNA, 30 nt, Artificial Sequence
  Synthetic Oligonucleotide; NDFIP1 exon 6; Set C
cagggaaauagguggaaaacuaaaaaauaa

SEQ ID NO: 38517 - RNA, 28 nt, Artificial Sequence
  Synthetic Oligonucleotide; NDFIP1 exon 6; Set C
agggaaauagguggaaaacuaaaaaaua

SEQ ID NO: 38518 - RNA, 20 nt, Artificial Sequence
  Synthetic Oligonucleotide; NDFIP1 exon 6; Set C
aaauagguggaaaacuaaaa

SEQ ID NO: 38519 - RNA, 16 nt, Artificial Sequence
  Synthetic Oligonucleotide; NDFIP1 exon 6; Set C
auagguggaaaacuaa

SEQ ID NO: 38520 - RNA, 18 nt, Artificial Sequence
  Synthetic Oligonucleotide; NDFIP1 exon 6; Set C
aauagguggaaaacuaaa

SEQ ID NO: 38521 - RNA, 29 nt, Artificial Sequence
  Synthetic Oligonucleotide; NDFIP1 exon 6; Set C
cagggaaauagguggaaaacuaaaaaaua

SEQ ID NO: 38522 - RNA, 21 nt, Artificial Sequence
  Synthetic Oligonucleotide; NDFIP1 exon 6; Set C
gaaauagguggaaaacuaaaa

SEQ ID NO: 38523 - RNA, 17 nt, Artificial Sequence
  Synthetic Oligonucleotide; NDFIP1 exon 6; Set C
aauagguggaaaacuaa

SEQ ID NO: 38524 - RNA, 19 nt, Artificial Sequence
  Synthetic Oligonucleotide; NDFIP1 exon 6; Set C
aaauagguggaaaacuaaa

SEQ ID NO: 38525 - RNA, 22 nt, Artificial Sequence
  Synthetic Oligonucleotide; NDFIP1 exon 6; Set C
ggaaauagguggaaaacuaaaa

SEQ ID NO: 38526 - RNA, 18 nt, Artificial Sequence
  Synthetic Oligonucleotide; NDFIP1 exon 6; Set C
aaauagguggaaaacuaa

SEQ ID NO: 38527 - RNA, 16 nt, Artificial Sequence
  Synthetic Oligonucleotide; NDFIP1 exon 6; Set C
aauagguggaaaacua

SEQ ID NO: 38528 - RNA, 20 nt, Artificial Sequence
  Synthetic Oligonucleotide; NDFIP1 exon 6; Set C
gaaauagguggaaaacuaaa

SEQ ID NO: 38529 - RNA, 23 nt, Artificial Sequence
  Synthetic Oligonucleotide; NDFIP1 exon 6; Set C
gggaaauagguggaaaacuaaaa

SEQ ID NO: 38530 - RNA, 19 nt, Artificial Sequence
  Synthetic Oligonucleotide; NDFIP1 exon 6; Set C
gaaauagguggaaaacuaa

SEQ ID NO: 38531 - RNA, 15 nt, Artificial Sequence
  Synthetic Oligonucleotide; NDFIP1 exon 6; Set C
aauagguggaaaacu

SEQ ID NO: 38532 - RNA, 17 nt, Artificial Sequence
  Synthetic Oligonucleotide; NDFIP1 exon 6; Set C
aaauagguggaaaacua

SEQ ID NO: 38533 - RNA, 21 nt, Artificial Sequence
  Synthetic Oligonucleotide; NDFIP1 exon 6; Set C
ggaaauagguggaaaacuaaa

SEQ ID NO: 38534 - RNA, 36 nt, Artificial Sequence
  Synthetic Oligonucleotide; NDFIP1 exon 6; Set C
auauccagggaaauagguggaaaacuaaaaaauaag

SEQ ID NO: 38535 - RNA, 24 nt, Artificial Sequence
  Synthetic Oligonucleotide; NDFIP1 exon 6; Set C
agggaaauagguggaaaacuaaaa

SEQ ID NO: 38536 - RNA, 20 nt, Artificial Sequence
  Synthetic Oligonucleotide; NDFIP1 exon 6; Set C
ggaaauagguggaaaacuaa

SEQ ID NO: 38537 - RNA, 16 nt, Artificial Sequence
  Synthetic Oligonucleotide; NDFIP1 exon 6; Set C
aaauagguggaaaacu

SEQ ID NO: 38538 - RNA, 18 nt, Artificial Sequence
  Synthetic Oligonucleotide; NDFIP1 exon 6; Set C
gaaauagguggaaaacua

SEQ ID NO: 38539 - RNA, 35 nt, Artificial Sequence
  Synthetic Oligonucleotide; NDFIP1 exon 6; Set C
auauccagggaaauagguggaaaacuaaaaaauaa

SEQ ID NO: 38540 - RNA, 37 nt, Artificial Sequence
  Synthetic Oligonucleotide; NDFIP1 exon 6; Set C
aauauccagggaaauagguggaaaacuaaaaaauaag

SEQ ID NO: 38541 - RNA, 25 nt, Artificial Sequence
  Synthetic Oligonucleotide; NDFIP1 exon 6; Set C
cagggaaauagguggaaaacuaaaa

SEQ ID NO: 38542 - RNA, 21 nt, Artificial Sequence
  Synthetic Oligonucleotide; NDFIP1 exon 6; Set C
gggaaauagguggaaaacuaa

SEQ ID NO: 38543 - RNA, 15 nt, Artificial Sequence
  Synthetic Oligonucleotide; NDFIP1 exon 6; Set C
aaauagguggaaaac

SEQ ID NO: 38544 - RNA, 17 nt, Artificial Sequence
  Synthetic Oligonucleotide; NDFIP1 exon 6; Set C
gaaauagguggaaaacu

SEQ ID NO: 38545 - RNA, 19 nt, Artificial Sequence
  Synthetic Oligonucleotide; NDFIP1 exon 6; Set C
ggaaauagguggaaaacua

SEQ ID NO: 38546 - RNA, 36 nt, Artificial Sequence
  Synthetic Oligonucleotide; NDFIP1 exon 6; Set C
aauauccagggaaauagguggaaaacuaaaaaauaa

SEQ ID NO: 38547 - RNA, 38 nt, Artificial Sequence
  Synthetic Oligonucleotide; NDFIP1 exon 6; Set C
aaauauccagggaaauagguggaaaacuaaaaaauaag

SEQ ID NO: 38548 - RNA, 34 nt, Artificial Sequence
  Synthetic Oligonucleotide; NDFIP1 exon 6; Set C
auauccagggaaauagguggaaaacuaaaaaaua

SEQ ID NO: 38549 - RNA, 22 nt, Artificial Sequence
  Synthetic Oligonucleotide; NDFIP1 exon 6; Set C
agggaaauagguggaaaacuaa

SEQ ID NO: 38550 - RNA, 16 nt, Artificial Sequence
  Synthetic Oligonucleotide; NDFIP1 exon 6; Set C
gaaauagguggaaaac

SEQ ID NO: 38551 - RNA, 18 nt, Artificial Sequence
  Synthetic Oligonucleotide; NDFIP1 exon 6; Set C
ggaaauagguggaaaacu

SEQ ID NO: 38552 - RNA, 24 nt, Artificial Sequence
  Synthetic Oligonucleotide; NDFIP1 exon 6; Set C
cagggaaauagguggaaaacuaaa

SEQ ID NO: 38553 - RNA, 37 nt, Artificial Sequence
  Synthetic Oligonucleotide; NDFIP1 exon 6; Set C
aaauauccagggaaauagguggaaaacuaaaaaauaa

SEQ ID NO: 38554 - RNA, 39 nt, Artificial Sequence
  Synthetic Oligonucleotide; NDFIP1 exon 6; Set C
aaaauauccagggaaauagguggaaaacuaaaaaauaag

SEQ ID NO: 38555 - RNA, 35 nt, Artificial Sequence
  Synthetic Oligonucleotide; NDFIP1 exon 6; Set C
aauauccagggaaauagguggaaaacuaaaaaaua

SEQ ID NO: 38556 - RNA, 15 nt, Artificial Sequence
  Synthetic Oligonucleotide; NDFIP1 exon 6; Set C
gaaauagguggaaaa

SEQ ID NO: 38557 - RNA, 23 nt, Artificial Sequence
  Synthetic Oligonucleotide; NDFIP1 exon 6; Set C
cagggaaauagguggaaaacuaa

SEQ ID NO: 38558 - RNA, 17 nt, Artificial Sequence
  Synthetic Oligonucleotide; NDFIP1 exon 6; Set C
ggaaauagguggaaaac

SEQ ID NO: 38559 - RNA, 19 nt, Artificial Sequence
  Synthetic Oligonucleotide; NDFIP1 exon 6; Set C
gggaaauagguggaaaacu

SEQ ID NO: 38560 - RNA, 21 nt, Artificial Sequence
  Synthetic Oligonucleotide; NDFIP1 exon 6; Set C
agggaaauagguggaaaacua

SEQ ID NO: 38561 - RNA, 33 nt, Artificial Sequence
  Synthetic Oligonucleotide; NDFIP1 exon 6; Set C
auauccagggaaauagguggaaaacuaaaaaau

SEQ ID NO: 38562 - RNA, 38 nt, Artificial Sequence
  Synthetic Oligonucleotide; NDFIP1 exon 6; Set C
aaaauauccagggaaauagguggaaaacuaaaaaauaa

SEQ ID NO: 38563 - RNA, 40 nt, Artificial Sequence
  Synthetic Oligonucleotide; NDFIP1 exon 6; Set C
caaaauauccagggaaauagguggaaaacuaaaaaauaag

SEQ ID NO: 38564 - RNA, 36 nt, Artificial Sequence
  Synthetic Oligonucleotide; NDFIP1 exon 6; Set C
aaauauccagggaaauagguggaaaacuaaaaaaua

SEQ ID NO: 38565 - RNA, 16 nt, Artificial Sequence
  Synthetic Oligonucleotide; NDFIP1 exon 6; Set C
ggaaauagguggaaaa

SEQ ID NO: 38566 - RNA, 20 nt, Artificial Sequence
  Synthetic Oligonucleotide; NDFIP1 exon 6; Set C
agggaaauagguggaaaacu

SEQ ID NO: 38567 - RNA, 22 nt, Artificial Sequence
  Synthetic Oligonucleotide; NDFIP1 exon 6; Set C
cagggaaauagguggaaaacua

SEQ ID NO: 38568 - RNA, 32 nt, Artificial Sequence
  Synthetic Oligonucleotide; NDFIP1 exon 6; Set C
auauccagggaaauagguggaaaacuaaaaaa

SEQ ID NO: 38569 - RNA, 34 nt, Artificial Sequence
  Synthetic Oligonucleotide; NDFIP1 exon 6; Set C
aauauccagggaaauagguggaaaacuaaaaaau

SEQ ID NO: 38570 - RNA, 39 nt, Artificial Sequence
  Synthetic Oligonucleotide; NDFIP1 exon 6; Set C
caaaauauccagggaaauagguggaaaacuaaaaaauaa

SEQ ID NO: 38571 - RNA, 37 nt, Artificial Sequence
  Synthetic Oligonucleotide; NDFIP1 exon 6; Set C
aaaauauccagggaaauagguggaaaacuaaaaaaua

SEQ ID NO: 38572 - RNA, 17 nt, Artificial Sequence
  Synthetic Oligonucleotide; NDFIP1 exon 6; Set C
gggaaauagguggaaaa

SEQ ID NO: 38573 - RNA, 21 nt, Artificial Sequence
  Synthetic Oligonucleotide; NDFIP1 exon 6; Set C
cagggaaauagguggaaaacu

SEQ ID NO: 38574 - RNA, 33 nt, Artificial Sequence
  Synthetic Oligonucleotide; NDFIP1 exon 6; Set C
aauauccagggaaauagguggaaaacuaaaaaa

SEQ ID NO: 38575 - RNA, 35 nt, Artificial Sequence
  Synthetic Oligonucleotide; NDFIP1 exon 6; Set C
aaauauccagggaaauagguggaaaacuaaaaaau

SEQ ID NO: 38576 - RNA, 31 nt, Artificial Sequence
  Synthetic Oligonucleotide; NDFIP1 exon 6; Set C
auauccagggaaauagguggaaaacuaaaaa

SEQ ID NO: 38577 - RNA, 40 nt, Artificial Sequence
  Synthetic Oligonucleotide; NDFIP1 exon 6; Set C
ucaaaauauccagggaaauagguggaaaacuaaaaaauaa

SEQ ID NO: 38578 - RNA, 38 nt, Artificial Sequence
  Synthetic Oligonucleotide; NDFIP1 exon 6; Set C
caaaauauccagggaaauagguggaaaacuaaaaaaua

SEQ ID NO: 38579 - RNA, 18 nt, Artificial Sequence
  Synthetic Oligonucleotide; NDFIP1 exon 6; Set C
agggaaauagguggaaaa

SEQ ID NO: 38580 - RNA, 30 nt, Artificial Sequence
  Synthetic Oligonucleotide; NDFIP1 exon 6; Set C
auauccagggaaauagguggaaaacuaaaa

SEQ ID NO: 38581 - RNA, 20 nt, Artificial Sequence
  Synthetic Oligonucleotide; NDFIP1 exon 6; Set C
cagggaaauagguggaaaac

SEQ ID NO: 38582 - RNA, 34 nt, Artificial Sequence
  Synthetic Oligonucleotide; NDFIP1 exon 6; Set C
aaauauccagggaaauagguggaaaacuaaaaaa

SEQ ID NO: 38583 - RNA, 32 nt, Artificial Sequence
  Synthetic Oligonucleotide; NDFIP1 exon 6; Set C
aauauccagggaaauagguggaaaacuaaaaa

SEQ ID NO: 38584 - RNA, 39 nt, Artificial Sequence
  Synthetic Oligonucleotide; NDFIP1 exon 6; Set C
ucaaaauauccagggaaauagguggaaaacuaaaaaaua

SEQ ID NO: 38585 - RNA, 19 nt, Artificial Sequence
  Synthetic Oligonucleotide; NDFIP1 exon 6; Set C
cagggaaauagguggaaaa

SEQ ID NO: 38586 - RNA, 31 nt, Artificial Sequence
  Synthetic Oligonucleotide; NDFIP1 exon 6; Set C
aauauccagggaaauagguggaaaacuaaaa

SEQ ID NO: 38587 - RNA, 29 nt, Artificial Sequence
  Synthetic Oligonucleotide; NDFIP1 exon 6; Set C
auauccagggaaauagguggaaaacuaaa

SEQ ID NO: 38588 - RNA, 40 nt, Artificial Sequence
  Synthetic Oligonucleotide; NDFIP1 exon 6; Set C
aucaaaauauccagggaaauagguggaaaacuaaaaaaua

SEQ ID NO: 38589 - RNA, 32 nt, Artificial Sequence
  Synthetic Oligonucleotide; NDFIP1 exon 6; Set C
aaauauccagggaaauagguggaaaacuaaaa

SEQ ID NO: 38590 - RNA, 28 nt, Artificial Sequence
  Synthetic Oligonucleotide; NDFIP1 exon 6; Set C
auauccagggaaauagguggaaaacuaa

SEQ ID NO: 38591 - RNA, 30 nt, Artificial Sequence
  Synthetic Oligonucleotide; NDFIP1 exon 6; Set C
aauauccagggaaauagguggaaaacuaaa

SEQ ID NO: 38592 - RNA, 33 nt, Artificial Sequence
  Synthetic Oligonucleotide; NDFIP1 exon 6; Set C
aaaauauccagggaaauagguggaaaacuaaaa

SEQ ID NO: 38593 - RNA, 29 nt, Artificial Sequence
  Synthetic Oligonucleotide; NDFIP1 exon 6; Set C
aauauccagggaaauagguggaaaacuaa

SEQ ID NO: 38594 - RNA, 27 nt, Artificial Sequence
  Synthetic Oligonucleotide; NDFIP1 exon 6; Set C
auauccagggaaauagguggaaaacua

SEQ ID NO: 38595 - RNA, 31 nt, Artificial Sequence
  Synthetic Oligonucleotide; NDFIP1 exon 6; Set C
aaauauccagggaaauagguggaaaacuaaa

SEQ ID NO: 38596 - RNA, 34 nt, Artificial Sequence
  Synthetic Oligonucleotide; NDFIP1 exon 6; Set C
caaaauauccagggaaauagguggaaaacuaaaa

SEQ ID NO: 38597 - RNA, 30 nt, Artificial Sequence
  Synthetic Oligonucleotide; NDFIP1 exon 6; Set C
aaauauccagggaaauagguggaaaacuaa

SEQ ID NO: 38598 - RNA, 26 nt, Artificial Sequence
  Synthetic Oligonucleotide; NDFIP1 exon 6; Set C
auauccagggaaauagguggaaaacu

SEQ ID NO: 38599 - RNA, 28 nt, Artificial Sequence
  Synthetic Oligonucleotide; NDFIP1 exon 6; Set C
aauauccagggaaauagguggaaaacua

SEQ ID NO: 38600 - RNA, 32 nt, Artificial Sequence
  Synthetic Oligonucleotide; NDFIP1 exon 6; Set C
aaaauauccagggaaauagguggaaaacuaaa

SEQ ID NO: 38601 - RNA, 35 nt, Artificial Sequence
  Synthetic Oligonucleotide; NDFIP1 exon 6; Set C
ucaaaauauccagggaaauagguggaaaacuaaaa

SEQ ID NO: 38602 - RNA, 31 nt, Artificial Sequence
  Synthetic Oligonucleotide; NDFIP1 exon 6; Set C
aaaauauccagggaaauagguggaaaacuaa

SEQ ID NO: 38603 - RNA, 25 nt, Artificial Sequence
  Synthetic Oligonucleotide; NDFIP1 exon 6; Set C
auauccagggaaauagguggaaaac

SEQ ID NO: 38604 - RNA, 27 nt, Artificial Sequence
  Synthetic Oligonucleotide; NDFIP1 exon 6; Set C
aauauccagggaaauagguggaaaacu

SEQ ID NO: 38605 - RNA, 29 nt, Artificial Sequence
  Synthetic Oligonucleotide; NDFIP1 exon 6; Set C
aaauauccagggaaauagguggaaaacua

SEQ ID NO: 38606 - RNA, 33 nt, Artificial Sequence
  Synthetic Oligonucleotide; NDFIP1 exon 6; Set C
caaaauauccagggaaauagguggaaaacuaaa

SEQ ID NO: 38607 - RNA, 24 nt, Artificial Sequence
  Synthetic Oligonucleotide; NDFIP1 exon 6; Set C
auauccagggaaauagguggaaaa

SEQ ID NO: 38608 - RNA, 36 nt, Artificial Sequence
  Synthetic Oligonucleotide; NDFIP1 exon 6; Set C
aucaaaauauccagggaaauagguggaaaacuaaaa

SEQ ID NO: 38609 - RNA, 32 nt, Artificial Sequence
  Synthetic Oligonucleotide; NDFIP1 exon 6; Set C
caaaauauccagggaaauagguggaaaacuaa

SEQ ID NO: 38610 - RNA, 26 nt, Artificial Sequence
  Synthetic Oligonucleotide; NDFIP1 exon 6; Set C
aauauccagggaaauagguggaaaac

SEQ ID NO: 38611 - RNA, 28 nt, Artificial Sequence
  Synthetic Oligonucleotide; NDFIP1 exon 6; Set C
aaauauccagggaaauagguggaaaacu

SEQ ID NO: 38612 - RNA, 30 nt, Artificial Sequence
  Synthetic Oligonucleotide; NDFIP1 exon 6; Set C
aaaauauccagggaaauagguggaaaacua

SEQ ID NO: 38613 - RNA, 25 nt, Artificial Sequence
  Synthetic Oligonucleotide; NDFIP1 exon 6; Set C
aauauccagggaaauagguggaaaa

SEQ ID NO: 38614 - RNA, 33 nt, Artificial Sequence
  Synthetic Oligonucleotide; NDFIP1 exon 6; Set C
ucaaaauauccagggaaauagguggaaaacuaa

SEQ ID NO: 38615 - RNA, 27 nt, Artificial Sequence
  Synthetic Oligonucleotide; NDFIP1 exon 6; Set C
aaauauccagggaaauagguggaaaac

SEQ ID NO: 38616 - RNA, 29 nt, Artificial Sequence
  Synthetic Oligonucleotide; NDFIP1 exon 6; Set C
aaaauauccagggaaauagguggaaaacu

SEQ ID NO: 38617 - RNA, 31 nt, Artificial Sequence
  Synthetic Oligonucleotide; NDFIP1 exon 6; Set C
caaaauauccagggaaauagguggaaaacua

SEQ ID NO: 38618 - RNA, 26 nt, Artificial Sequence
  Synthetic Oligonucleotide; NDFIP1 exon 6; Set C
aaauauccagggaaauagguggaaaa

SEQ ID NO: 38619 - RNA, 34 nt, Artificial Sequence
  Synthetic Oligonucleotide; NDFIP1 exon 6; Set C
aucaaaauauccagggaaauagguggaaaacuaa

SEQ ID NO: 38620 - RNA, 28 nt, Artificial Sequence
  Synthetic Oligonucleotide; NDFIP1 exon 6; Set C
aaaauauccagggaaauagguggaaaac

SEQ ID NO: 38621 - RNA, 30 nt, Artificial Sequence
  Synthetic Oligonucleotide; NDFIP1 exon 6; Set C
caaaauauccagggaaauagguggaaaacu

SEQ ID NO: 38622 - RNA, 27 nt, Artificial Sequence
  Synthetic Oligonucleotide; NDFIP1 exon 6; Set C
aaaauauccagggaaauagguggaaaa

SEQ ID NO: 38623 - RNA, 29 nt, Artificial Sequence
  Synthetic Oligonucleotide; NDFIP1 exon 6; Set C
caaaauauccagggaaauagguggaaaac

SEQ ID NO: 38624 - RNA, 31 nt, Artificial Sequence
  Synthetic Oligonucleotide; NDFIP1 exon 6; Set C
ucaaaauauccagggaaauagguggaaaacu

SEQ ID NO: 38625 - RNA, 28 nt, Artificial Sequence
  Synthetic Oligonucleotide; NDFIP1 exon 6; Set C
caaaauauccagggaaauagguggaaaa

SEQ ID NO: 38626 - RNA, 32 nt, Artificial Sequence
  Synthetic Oligonucleotide; NDFIP1 exon 6; Set C
aucaaaauauccagggaaauagguggaaaacu

SEQ ID NO: 38627 - RNA, 29 nt, Artificial Sequence
  Synthetic Oligonucleotide; NDFIP1 exon 6; Set C
ucaaaauauccagggaaauagguggaaaa

SEQ ID NO: 38628 - RNA, 30 nt, Artificial Sequence
  Synthetic Oligonucleotide; NDFIP1 exon 6; Set C
aucaaaauauccagggaaauagguggaaaa

SEQ ID NO: 38629 - RNA, 19 nt, Artificial Sequence
  Synthetic Oligonucleotide; NDFIP1 exon 6; Set C
aaaauauccagggaaauag

SEQ ID NO: 38630 - RNA, 20 nt, Artificial Sequence
  Synthetic Oligonucleotide; NDFIP1 exon 6; Set C
caaaauauccagggaaauag

SEQ ID NO: 38631 - RNA, 40 nt, Artificial Sequence
  Synthetic Oligonucleotide; NDFIP1 exon 6; Set A
uacugaccaucaaaauauccagggaaauagguggaaaacu

SEQ ID NO: 38632 - RNA, 21 nt, Artificial Sequence
  Synthetic Oligonucleotide; NDFIP1 exon 6; Set C
ucaaaauauccagggaaauag

SEQ ID NO: 38633 - RNA, 39 nt, Artificial Sequence
  Synthetic Oligonucleotide; NDFIP1 exon 6; Set A
uacugaccaucaaaauauccagggaaauagguggaaaac

SEQ ID NO: 38634 - RNA, 38 nt, Artificial Sequence
  Synthetic Oligonucleotide; NDFIP1 exon 6; Set A
uacugaccaucaaaauauccagggaaauagguggaaaa

SEQ ID NO: 38635 - RNA, 22 nt, Artificial Sequence
  Synthetic Oligonucleotide; NDFIP1 exon 6; Set C
aucaaaauauccagggaaauag

SEQ ID NO: 38636 - RNA, 40 nt, Artificial Sequence
  Synthetic Oligonucleotide; NDFIP1 exon 6; Set A
guacugaccaucaaaauauccagggaaauagguggaaaac

SEQ ID NO: 38637 - RNA, 19 nt, Artificial Sequence
  Synthetic Oligonucleotide; NDFIP1 exon 6; Set C
ucaaaauauccagggaaau

SEQ ID NO: 38638 - RNA, 39 nt, Artificial Sequence
  Synthetic Oligonucleotide; NDFIP1 exon 6; Set A
guacugaccaucaaaauauccagggaaauagguggaaaa

SEQ ID NO: 38639 - RNA, 18 nt, Artificial Sequence
  Synthetic Oligonucleotide; NDFIP1 exon 6; Set C
ucaaaauauccagggaaa

SEQ ID NO: 38640 - RNA, 20 nt, Artificial Sequence
  Synthetic Oligonucleotide; NDFIP1 exon 6; Set C
aucaaaauauccagggaaau

SEQ ID NO: 38641 - RNA, 19 nt, Artificial Sequence
  Synthetic Oligonucleotide; NDFIP1 exon 6; Set C
aucaaaauauccagggaaa

SEQ ID NO: 38642 - RNA, 17 nt, Artificial Sequence
  Synthetic Oligonucleotide; NDFIP1 exon 6; Set C
ucaaaauauccagggaa

SEQ ID NO: 38643 - RNA, 18 nt, Artificial Sequence
  Synthetic Oligonucleotide; NDFIP1 exon 6; Set C
aucaaaauauccagggaa

SEQ ID NO: 38644 - RNA, 16 nt, Artificial Sequence
  Synthetic Oligonucleotide; NDFIP1 exon 6; Set C
ucaaaauauccaggga

SEQ ID NO: 38645 - RNA, 17 nt, Artificial Sequence
  Synthetic Oligonucleotide; NDFIP1 exon 6; Set C
aucaaaauauccaggga

SEQ ID NO: 38646 - RNA, 15 nt, Artificial Sequence
  Synthetic Oligonucleotide; NDFIP1 exon 6; Set C
ucaaaauauccaggg

SEQ ID NO: 38647 - RNA, 16 nt, Artificial Sequence
  Synthetic Oligonucleotide; NDFIP1 exon 6; Set C
aucaaaauauccaggg

SEQ ID NO: 38648 - RNA, 15 nt, Artificial Sequence
  Synthetic Oligonucleotide; NDFIP1 exon 6; Set C
aucaaaauauccagg

SEQ ID NO: 38649 - RNA, 30 nt, Artificial Sequence
  Synthetic Oligonucleotide; NDFIP1 exon 6; Set C
uacugaccaucaaaauauccagggaaauag

SEQ ID NO: 38650 - RNA, 29 nt, Artificial Sequence
  Synthetic Oligonucleotide; NDFIP1 exon 6; Set C
uacugaccaucaaaauauccagggaaaua

SEQ ID NO: 38651 - RNA, 31 nt, Artificial Sequence
  Synthetic Oligonucleotide; NDFIP1 exon 6; Set A
guacugaccaucaaaauauccagggaaauag

SEQ ID NO: 38652 - RNA, 30 nt, Artificial Sequence
  Synthetic Oligonucleotide; NDFIP1 exon 6; Set A
guacugaccaucaaaauauccagggaaaua

SEQ ID NO: 38653 - RNA, 28 nt, Artificial Sequence
  Synthetic Oligonucleotide; NDFIP1 exon 6; Set C
uacugaccaucaaaauauccagggaaau

SEQ ID NO: 38654 - RNA, 32 nt, Artificial Sequence
  Synthetic Oligonucleotide; NDFIP1 exon 6; Set A
aguacugaccaucaaaauauccagggaaauag

SEQ ID NO: 38655 - RNA, 27 nt, Artificial Sequence
  Synthetic Oligonucleotide; NDFIP1 exon 6; Set C
uacugaccaucaaaauauccagggaaa

SEQ ID NO: 38656 - RNA, 29 nt, Artificial Sequence
  Synthetic Oligonucleotide; NDFIP1 exon 6; Set A
guacugaccaucaaaauauccagggaaau

SEQ ID NO: 38657 - RNA, 31 nt, Artificial Sequence
  Synthetic Oligonucleotide; NDFIP1 exon 6; Set A
aguacugaccaucaaaauauccagggaaaua

SEQ ID NO: 38658 - RNA, 33 nt, Artificial Sequence
  Synthetic Oligonucleotide; NDFIP1 exon 6; Set A
caguacugaccaucaaaauauccagggaaauag

SEQ ID NO: 38659 - RNA, 28 nt, Artificial Sequence
  Synthetic Oligonucleotide; NDFIP1 exon 6; Set A
guacugaccaucaaaauauccagggaaa

SEQ ID NO: 38660 - RNA, 26 nt, Artificial Sequence
  Synthetic Oligonucleotide; NDFIP1 exon 6; Set C
uacugaccaucaaaauauccagggaa

SEQ ID NO: 38661 - RNA, 30 nt, Artificial Sequence
  Synthetic Oligonucleotide; NDFIP1 exon 6; Set A
aguacugaccaucaaaauauccagggaaau

SEQ ID NO: 38662 - RNA, 32 nt, Artificial Sequence
  Synthetic Oligonucleotide; NDFIP1 exon 6; Set A
caguacugaccaucaaaauauccagggaaaua

SEQ ID NO: 38663 - RNA, 29 nt, Artificial Sequence
  Synthetic Oligonucleotide; NDFIP1 exon 6; Set A
aguacugaccaucaaaauauccagggaaa

SEQ ID NO: 38664 - RNA, 27 nt, Artificial Sequence
  Synthetic Oligonucleotide; NDFIP1 exon 6; Set A
guacugaccaucaaaauauccagggaa

SEQ ID NO: 38665 - RNA, 31 nt, Artificial Sequence
  Synthetic Oligonucleotide; NDFIP1 exon 6; Set A
caguacugaccaucaaaauauccagggaaau

SEQ ID NO: 38666 - RNA, 25 nt, Artificial Sequence
  Synthetic Oligonucleotide; NDFIP1 exon 6; Set A
uacugaccaucaaaauauccaggga

SEQ ID NO: 38667 - RNA, 30 nt, Artificial Sequence
  Synthetic Oligonucleotide; NDFIP1 exon 6; Set A
caguacugaccaucaaaauauccagggaaa

SEQ ID NO: 38668 - RNA, 28 nt, Artificial Sequence
  Synthetic Oligonucleotide; NDFIP1 exon 6; Set A
aguacugaccaucaaaauauccagggaa

SEQ ID NO: 38669 - RNA, 26 nt, Artificial Sequence
  Synthetic Oligonucleotide; NDFIP1 exon 6; Set A
guacugaccaucaaaauauccaggga

SEQ ID NO: 38670 - RNA, 24 nt, Artificial Sequence
  Synthetic Oligonucleotide; NDFIP1 exon 6; Set C
uacugaccaucaaaauauccaggg

SEQ ID NO: 38671 - RNA, 29 nt, Artificial Sequence
  Synthetic Oligonucleotide; NDFIP1 exon 6; Set A
caguacugaccaucaaaauauccagggaa

SEQ ID NO: 38672 - RNA, 27 nt, Artificial Sequence
  Synthetic Oligonucleotide; NDFIP1 exon 6; Set A
aguacugaccaucaaaauauccaggga

SEQ ID NO: 38673 - RNA, 25 nt, Artificial Sequence
  Synthetic Oligonucleotide; NDFIP1 exon 6; Set C
guacugaccaucaaaauauccaggg

SEQ ID NO: 38674 - RNA, 23 nt, Artificial Sequence
  Synthetic Oligonucleotide; NDFIP1 exon 6; Set C
uacugaccaucaaaauauccagg

SEQ ID NO: 38675 - RNA, 28 nt, Artificial Sequence
  Synthetic Oligonucleotide; NDFIP1 exon 6; Set A
caguacugaccaucaaaauauccaggga

SEQ ID NO: 38676 - RNA, 22 nt, Artificial Sequence
  Synthetic Oligonucleotide; NDFIP1 exon 6; Set C
uacugaccaucaaaauauccag

SEQ ID NO: 38677 - RNA, 24 nt, Artificial Sequence
  Synthetic Oligonucleotide; NDFIP1 exon 6; Set C
guacugaccaucaaaauauccagg

SEQ ID NO: 38678 - RNA, 23 nt, Artificial Sequence
  Synthetic Oligonucleotide; NDFIP1 exon 6; Set C
guacugaccaucaaaauauccag

SEQ ID NO: 38679 - RNA, 17 nt, Artificial Sequence
  Synthetic Oligonucleotide; NDFIP1 exon 6; Set C
uacugaccaucaaaaua

SEQ ID NO: 38680 - RNA, 18 nt, Artificial Sequence
  Synthetic Oligonucleotide; NDFIP1 exon 6; Set C
guacugaccaucaaaaua

SEQ ID NO: 38681 - RNA, 16 nt, Artificial Sequence
  Synthetic Oligonucleotide; NDFIP1 exon 6; Set C
uacugaccaucaaaau

SEQ ID NO: 38682 - RNA, 19 nt, Artificial Sequence
  Synthetic Oligonucleotide; NDFIP1 exon 6; Set C
aguacugaccaucaaaaua

SEQ ID NO: 38683 - RNA, 17 nt, Artificial Sequence
  Synthetic Oligonucleotide; NDFIP1 exon 6; Set C
guacugaccaucaaaau

SEQ ID NO: 38684 - RNA, 15 nt, Artificial Sequence
  Synthetic Oligonucleotide; NDFIP1 exon 6; Set C
uacugaccaucaaaa

SEQ ID NO: 38685 - RNA, 20 nt, Artificial Sequence
  Synthetic Oligonucleotide; NDFIP1 exon 6; Set C
caguacugaccaucaaaaua

SEQ ID NO: 38686 - RNA, 18 nt, Artificial Sequence
  Synthetic Oligonucleotide; NDFIP1 exon 6; Set C
aguacugaccaucaaaau

SEQ ID NO: 38687 - RNA, 16 nt, Artificial Sequence
  Synthetic Oligonucleotide; NDFIP1 exon 6; Set C
guacugaccaucaaaa

SEQ ID NO: 38688 - RNA, 19 nt, Artificial Sequence
  Synthetic Oligonucleotide; NDFIP1 exon 6; Set C
caguacugaccaucaaaau

SEQ ID NO: 38689 - RNA, 15 nt, Artificial Sequence
  Synthetic Oligonucleotide; NDFIP1 exon 6; Set C
guacugaccaucaaa

SEQ ID NO: 38690 - RNA, 33 nt, Artificial Sequence
  Synthetic Oligonucleotide; NDFIP1 exon 6; Set C
cacccaccagagccaguacugaccaucaaaaua

SEQ ID NO: 38691 - RNA, 34 nt, Artificial Sequence
  Synthetic Oligonucleotide; NDFIP1 exon 6; Set C
acacccaccagagccaguacugaccaucaaaaua

SEQ ID NO: 38692 - RNA, 32 nt, Artificial Sequence
  Synthetic Oligonucleotide; NDFIP1 exon 6; Set C
cacccaccagagccaguacugaccaucaaaau

SEQ ID NO: 38693 - RNA, 35 nt, Artificial Sequence
  Synthetic Oligonucleotide; NDFIP1 exon 6; Set C
aacacccaccagagccaguacugaccaucaaaaua

SEQ ID NO: 38694 - RNA, 33 nt, Artificial Sequence
  Synthetic Oligonucleotide; NDFIP1 exon 6; Set C
acacccaccagagccaguacugaccaucaaaau

SEQ ID NO: 38695 - RNA, 34 nt, Artificial Sequence
  Synthetic Oligonucleotide; NDFIP1 exon 6; Set C
aacacccaccagagccaguacugaccaucaaaau

SEQ ID NO: 38696 - RNA, 32 nt, Artificial Sequence
  Synthetic Oligonucleotide; NDFIP1 exon 6; Set C
acacccaccagagccaguacugaccaucaaaa

SEQ ID NO: 38697 - RNA, 40 nt, Artificial Sequence
  Synthetic Oligonucleotide; NDFIP1 exon 6; Set C
acaaggaacacccaccagagccaguacugaccaucaaaau

SEQ ID NO: 38698 - RNA, 39 nt, Artificial Sequence
  Synthetic Oligonucleotide; NDFIP1 exon 6; Set C
acaaggaacacccaccagagccaguacugaccaucaaaa

SEQ ID NO: 38699 - RNA, 40 nt, Artificial Sequence
  Synthetic Oligonucleotide; NDFIP1 exon 6; Set C
aacaaggaacacccaccagagccaguacugaccaucaaaa

SEQ ID NO: 38700 - RNA, 38 nt, Artificial Sequence
  Synthetic Oligonucleotide; NDFIP1 exon 6; Set C
acaaggaacacccaccagagccaguacugaccaucaaa

SEQ ID NO: 38701 - RNA, 39 nt, Artificial Sequence
  Synthetic Oligonucleotide; NDFIP1 exon 6; Set C
aacaaggaacacccaccagagccaguacugaccaucaaa

SEQ ID NO: 38702 - RNA, 40 nt, Artificial Sequence
  Synthetic Oligonucleotide; NDFIP1 exon 6; Set C
aaacaaggaacacccaccagagccaguacugaccaucaaa

SEQ ID NO: 38703 - RNA, 38 nt, Artificial Sequence
  Synthetic Oligonucleotide; NDFIP1 exon 6; Set C
aacaaggaacacccaccagagccaguacugaccaucaa

SEQ ID NO: 38704 - RNA, 39 nt, Artificial Sequence
  Synthetic Oligonucleotide; NDFIP1 exon 6; Set C
aaacaaggaacacccaccagagccaguacugaccaucaa

SEQ ID NO: 38705 - RNA, 20 nt, Artificial Sequence
  Synthetic Oligonucleotide; NDFIP1 exon 6; Set A
acacccaccagagccaguac

SEQ ID NO: 38706 - RNA, 40 nt, Artificial Sequence
  Synthetic Oligonucleotide; NDFIP1 exon 6; Set C
aaaacaaggaacacccaccagagccaguacugaccaucaa

SEQ ID NO: 38707 - RNA, 19 nt, Artificial Sequence
  Synthetic Oligonucleotide; NDFIP1 exon 6; Set A
acacccaccagagccagua

SEQ ID NO: 38708 - RNA, 21 nt, Artificial Sequence
  Synthetic Oligonucleotide; NDFIP1 exon 6; Set A
aacacccaccagagccaguac

SEQ ID NO: 38709 - RNA, 20 nt, Artificial Sequence
  Synthetic Oligonucleotide; NDFIP1 exon 6; Set A
aacacccaccagagccagua

SEQ ID NO: 38710 - RNA, 27 nt, Artificial Sequence
  Synthetic Oligonucleotide; NDFIP1 exon 6; Set C
acaaggaacacccaccagagccaguac

SEQ ID NO: 38711 - RNA, 28 nt, Artificial Sequence
  Synthetic Oligonucleotide; NDFIP1 exon 6; Set C
aacaaggaacacccaccagagccaguac

SEQ ID NO: 38712 - RNA, 26 nt, Artificial Sequence
  Synthetic Oligonucleotide; NDFIP1 exon 6; Set C
acaaggaacacccaccagagccagua

SEQ ID NO: 38713 - RNA, 29 nt, Artificial Sequence
  Synthetic Oligonucleotide; NDFIP1 exon 6; Set C
aaacaaggaacacccaccagagccaguac

SEQ ID NO: 38714 - RNA, 27 nt, Artificial Sequence
  Synthetic Oligonucleotide; NDFIP1 exon 6; Set C
aacaaggaacacccaccagagccagua

SEQ ID NO: 38715 - RNA, 30 nt, Artificial Sequence
  Synthetic Oligonucleotide; NDFIP1 exon 6; Set C
aaaacaaggaacacccaccagagccaguac

SEQ ID NO: 38716 - RNA, 28 nt, Artificial Sequence
  Synthetic Oligonucleotide; NDFIP1 exon 6; Set C
aaacaaggaacacccaccagagccagua

SEQ ID NO: 38717 - RNA, 31 nt, Artificial Sequence
  Synthetic Oligonucleotide; NDFIP1 exon 6; Set C
uaaaacaaggaacacccaccagagccaguac

SEQ ID NO: 38718 - RNA, 29 nt, Artificial Sequence
  Synthetic Oligonucleotide; NDFIP1 exon 6; Set A
aaaacaaggaacacccaccagagccagua

SEQ ID NO: 38719 - RNA, 27 nt, Artificial Sequence
  Synthetic Oligonucleotide; NDFIP1 exon 6; Set C
aaacaaggaacacccaccagagccagu

SEQ ID NO: 38720 - RNA, 30 nt, Artificial Sequence
  Synthetic Oligonucleotide; NDFIP1 exon 6; Set C
uaaaacaaggaacacccaccagagccagua

SEQ ID NO: 38721 - RNA, 28 nt, Artificial Sequence
  Synthetic Oligonucleotide; NDFIP1 exon 6; Set A
aaaacaaggaacacccaccagagccagu

SEQ ID NO: 38722 - RNA, 29 nt, Artificial Sequence
  Synthetic Oligonucleotide; NDFIP1 exon 6; Set A
uaaaacaaggaacacccaccagagccagu

SEQ ID NO: 38723 - RNA, 28 nt, Artificial Sequence
  Synthetic Oligonucleotide; NDFIP1 exon 6; Set A
uaaaacaaggaacacccaccagagccag

SEQ ID NO: 38724 - RNA, 36 nt, Artificial Sequence
  Synthetic Oligonucleotide; NDFIP1 exon 6; Set C
uuaccuaaaacaaggaacacccaccagagccaguac

SEQ ID NO: 38725 - RNA, 35 nt, Artificial Sequence
  Synthetic Oligonucleotide; NDFIP1 exon 6; Set C
uuaccuaaaacaaggaacacccaccagagccagua

SEQ ID NO: 38726 - RNA, 37 nt, Artificial Sequence
  Synthetic Oligonucleotide; NDFIP1 exon 6; Set C
cuuaccuaaaacaaggaacacccaccagagccaguac

SEQ ID NO: 38727 - RNA, 36 nt, Artificial Sequence
  Synthetic Oligonucleotide; NDFIP1 exon 6; Set C
cuuaccuaaaacaaggaacacccaccagagccagua

SEQ ID NO: 38728 - RNA, 38 nt, Artificial Sequence
  Synthetic Oligonucleotide; NDFIP1 exon 6; Set C
acuuaccuaaaacaaggaacacccaccagagccaguac

SEQ ID NO: 38729 - RNA, 39 nt, Artificial Sequence
  Synthetic Oligonucleotide; NDFIP1 exon 6; Set C
cacuuaccuaaaacaaggaacacccaccagagccaguac

SEQ ID NO: 38730 - RNA, 37 nt, Artificial Sequence
  Synthetic Oligonucleotide; NDFIP1 exon 6; Set C
acuuaccuaaaacaaggaacacccaccagagccagua

SEQ ID NO: 38731 - RNA, 40 nt, Artificial Sequence
  Synthetic Oligonucleotide; NDFIP1 exon 6; Set C
acacuuaccuaaaacaaggaacacccaccagagccaguac

SEQ ID NO: 38732 - RNA, 38 nt, Artificial Sequence
  Synthetic Oligonucleotide; NDFIP1 exon 6; Set C
cacuuaccuaaaacaaggaacacccaccagagccagua

SEQ ID NO: 38733 - RNA, 39 nt, Artificial Sequence
  Synthetic Oligonucleotide; NDFIP1 exon 6; Set C
acacuuaccuaaaacaaggaacacccaccagagccagua

SEQ ID NO: 38734 - RNA, 40 nt, Artificial Sequence
  Synthetic Oligonucleotide; NDFIP1 exon 6; Set C
aacacuuaccuaaaacaaggaacacccaccagagccagua

SEQ ID NO: 38735 - RNA, 20 nt, Artificial Sequence
  Synthetic Oligonucleotide; NDFIP1 exon 6; Set C
uuaccuaaaacaaggaacac

SEQ ID NO: 38736 - RNA, 19 nt, Artificial Sequence
  Synthetic Oligonucleotide; NDFIP1 exon 6; Set C
uuaccuaaaacaaggaaca

SEQ ID NO: 38737 - RNA, 21 nt, Artificial Sequence
  Synthetic Oligonucleotide; NDFIP1 exon 6; Set C
cuuaccuaaaacaaggaacac

SEQ ID NO: 38738 - RNA, 20 nt, Artificial Sequence
  Synthetic Oligonucleotide; NDFIP1 exon 6; Set C
cuuaccuaaaacaaggaaca

SEQ ID NO: 38739 - RNA, 22 nt, Artificial Sequence
  Synthetic Oligonucleotide; NDFIP1 exon 6; Set C
acuuaccuaaaacaaggaacac

SEQ ID NO: 38740 - RNA, 18 nt, Artificial Sequence
  Synthetic Oligonucleotide; NDFIP1 exon 6; Set C
uuaccuaaaacaaggaac

SEQ ID NO: 38741 - RNA, 21 nt, Artificial Sequence
  Synthetic Oligonucleotide; NDFIP1 exon 6; Set C
acuuaccuaaaacaaggaaca

SEQ ID NO: 38742 - RNA, 23 nt, Artificial Sequence
  Synthetic Oligonucleotide; NDFIP1 exon 6; Set C
cacuuaccuaaaacaaggaacac

SEQ ID NO: 38743 - RNA, 19 nt, Artificial Sequence
  Synthetic Oligonucleotide; NDFIP1 exon 6; Set C
cuuaccuaaaacaaggaac

SEQ ID NO: 38744 - RNA, 22 nt, Artificial Sequence
  Synthetic Oligonucleotide; NDFIP1 exon 6; Set C
cacuuaccuaaaacaaggaaca

SEQ ID NO: 38745 - RNA, 24 nt, Artificial Sequence
  Synthetic Oligonucleotide; NDFIP1 exon 6; Set C
acacuuaccuaaaacaaggaacac

SEQ ID NO: 38746 - RNA, 20 nt, Artificial Sequence
  Synthetic Oligonucleotide; NDFIP1 exon 6; Set C
acuuaccuaaaacaaggaac

SEQ ID NO: 38747 - RNA, 23 nt, Artificial Sequence
  Synthetic Oligonucleotide; NDFIP1 exon 6; Set C
acacuuaccuaaaacaaggaaca

SEQ ID NO: 38748 - RNA, 25 nt, Artificial Sequence
  Synthetic Oligonucleotide; NDFIP1 exon 6; Set C
aacacuuaccuaaaacaaggaacac

SEQ ID NO: 38749 - RNA, 21 nt, Artificial Sequence
  Synthetic Oligonucleotide; NDFIP1 exon 6; Set C
cacuuaccuaaaacaaggaac

SEQ ID NO: 38750 - RNA, 24 nt, Artificial Sequence
  Synthetic Oligonucleotide; NDFIP1 exon 6; Set C
aacacuuaccuaaaacaaggaaca

SEQ ID NO: 38751 - RNA, 26 nt, Artificial Sequence
  Synthetic Oligonucleotide; NDFIP1 exon 6; Set C
aaacacuuaccuaaaacaaggaacac

SEQ ID NO: 38752 - RNA, 22 nt, Artificial Sequence
  Synthetic Oligonucleotide; NDFIP1 exon 6; Set C
acacuuaccuaaaacaaggaac

SEQ ID NO: 38753 - RNA, 25 nt, Artificial Sequence
  Synthetic Oligonucleotide; NDFIP1 exon 6; Set C
aaacacuuaccuaaaacaaggaaca

SEQ ID NO: 38754 - RNA, 27 nt, Artificial Sequence
  Synthetic Oligonucleotide; NDFIP1 exon 6; Set C
aaaacacuuaccuaaaacaaggaacac

SEQ ID NO: 38755 - RNA, 23 nt, Artificial Sequence
  Synthetic Oligonucleotide; NDFIP1 exon 6; Set C
aacacuuaccuaaaacaaggaac

SEQ ID NO: 38756 - RNA, 26 nt, Artificial Sequence
  Synthetic Oligonucleotide; NDFIP1 exon 6; Set C
aaaacacuuaccuaaaacaaggaaca

SEQ ID NO: 38757 - RNA, 24 nt, Artificial Sequence
  Synthetic Oligonucleotide; NDFIP1 exon 6; Set C
aaacacuuaccuaaaacaaggaac

SEQ ID NO: 38758 - RNA, 22 nt, Artificial Sequence
  Synthetic Oligonucleotide; NDFIP1 exon 6; Set C
aacacuuaccuaaaacaaggaa

SEQ ID NO: 38759 - RNA, 25 nt, Artificial Sequence
  Synthetic Oligonucleotide; NDFIP1 exon 6; Set C
aaaacacuuaccuaaaacaaggaac

SEQ ID NO: 38760 - RNA, 23 nt, Artificial Sequence
  Synthetic Oligonucleotide; NDFIP1 exon 6; Set C
aaacacuuaccuaaaacaaggaa

SEQ ID NO: 38761 - RNA, 24 nt, Artificial Sequence
  Synthetic Oligonucleotide; NDFIP1 exon 6; Set C
aaaacacuuaccuaaaacaaggaa

SEQ ID NO: 38762 - RNA, 15 nt, Artificial Sequence
  Synthetic Oligonucleotide; NDFIP1 exon 6; Set C
cacuuaccuaaaaca

SEQ ID NO: 38763 - RNA, 17 nt, Artificial Sequence
  Synthetic Oligonucleotide; NDFIP1 exon 6; Set C
acacuuaccuaaaacaa

SEQ ID NO: 38764 - RNA, 16 nt, Artificial Sequence
  Synthetic Oligonucleotide; NDFIP1 exon 6; Set C
acacuuaccuaaaaca

SEQ ID NO: 38765 - RNA, 18 nt, Artificial Sequence
  Synthetic Oligonucleotide; NDFIP1 exon 6; Set C
aacacuuaccuaaaacaa

SEQ ID NO: 38766 - RNA, 15 nt, Artificial Sequence
  Synthetic Oligonucleotide; NDFIP1 exon 6; Set C
acacuuaccuaaaac

SEQ ID NO: 38767 - RNA, 17 nt, Artificial Sequence
  Synthetic Oligonucleotide; NDFIP1 exon 6; Set C
aacacuuaccuaaaaca

SEQ ID NO: 38768 - RNA, 19 nt, Artificial Sequence
  Synthetic Oligonucleotide; NDFIP1 exon 6; Set C
aaacacuuaccuaaaacaa

SEQ ID NO: 38769 - RNA, 16 nt, Artificial Sequence
  Synthetic Oligonucleotide; NDFIP1 exon 6; Set C
aacacuuaccuaaaac

SEQ ID NO: 38770 - RNA, 18 nt, Artificial Sequence
  Synthetic Oligonucleotide; NDFIP1 exon 6; Set C
aaacacuuaccuaaaaca

SEQ ID NO: 38771 - RNA, 20 nt, Artificial Sequence
  Synthetic Oligonucleotide; NDFIP1 exon 6; Set C
aaaacacuuaccuaaaacaa

SEQ ID NO: 38772 - RNA, 15 nt, Artificial Sequence
  Synthetic Oligonucleotide; NDFIP1 exon 6; Set C
aacacuuaccuaaaa

SEQ ID NO: 38773 - RNA, 17 nt, Artificial Sequence
  Synthetic Oligonucleotide; NDFIP1 exon 6; Set C
aaacacuuaccuaaaac

SEQ ID NO: 38774 - RNA, 19 nt, Artificial Sequence
  Synthetic Oligonucleotide; NDFIP1 exon 6; Set C
aaaacacuuaccuaaaaca

SEQ ID NO: 38775 - RNA, 35 nt, Artificial Sequence
  Synthetic Oligonucleotide; NDFIP1 exon 6; Set C
uuacauuaaaaacacuuaccuaaaacaaggaacac

SEQ ID NO: 38776 - RNA, 16 nt, Artificial Sequence
  Synthetic Oligonucleotide; NDFIP1 exon 6; Set C
aaacacuuaccuaaaa

SEQ ID NO: 38777 - RNA, 34 nt, Artificial Sequence
  Synthetic Oligonucleotide; NDFIP1 exon 6; Set C
uuacauuaaaaacacuuaccuaaaacaaggaaca

SEQ ID NO: 38778 - RNA, 18 nt, Artificial Sequence
  Synthetic Oligonucleotide; NDFIP1 exon 6; Set C
aaaacacuuaccuaaaac

SEQ ID NO: 38779 - RNA, 36 nt, Artificial Sequence
  Synthetic Oligonucleotide; NDFIP1 exon 6; Set C
cuuacauuaaaaacacuuaccuaaaacaaggaacac

SEQ ID NO: 38780 - RNA, 15 nt, Artificial Sequence
  Synthetic Oligonucleotide; NDFIP1 exon 6; Set C
aaacacuuaccuaaa

SEQ ID NO: 38781 - RNA, 17 nt, Artificial Sequence
  Synthetic Oligonucleotide; NDFIP1 exon 6; Set C
aaaacacuuaccuaaaa

SEQ ID NO: 38782 - RNA, 35 nt, Artificial Sequence
  Synthetic Oligonucleotide; NDFIP1 exon 6; Set C
cuuacauuaaaaacacuuaccuaaaacaaggaaca

SEQ ID NO: 38783 - RNA, 37 nt, Artificial Sequence
  Synthetic Oligonucleotide; NDFIP1 exon 6; Set A
ucuuacauuaaaaacacuuaccuaaaacaaggaacac

SEQ ID NO: 38784 - RNA, 33 nt, Artificial Sequence
  Synthetic Oligonucleotide; NDFIP1 exon 6; Set C
uuacauuaaaaacacuuaccuaaaacaaggaac

SEQ ID NO: 38785 - RNA, 16 nt, Artificial Sequence
  Synthetic Oligonucleotide; NDFIP1 exon 6; Set C
aaaacacuuaccuaaa

SEQ ID NO: 38786 - RNA, 36 nt, Artificial Sequence
  Synthetic Oligonucleotide; NDFIP1 exon 6; Set C
ucuuacauuaaaaacacuuaccuaaaacaaggaaca

SEQ ID NO: 38787 - RNA, 34 nt, Artificial Sequence
  Synthetic Oligonucleotide; NDFIP1 exon 6; Set C
cuuacauuaaaaacacuuaccuaaaacaaggaac

SEQ ID NO: 38788 - RNA, 15 nt, Artificial Sequence
  Synthetic Oligonucleotide; NDFIP1 exon 6; Set C
aaaacacuuaccuaa

SEQ ID NO: 38789 - RNA, 35 nt, Artificial Sequence
  Synthetic Oligonucleotide; NDFIP1 exon 6; Set C
ucuuacauuaaaaacacuuaccuaaaacaaggaac

SEQ ID NO: 38790 - RNA, 36 nt, Artificial Sequence
  Synthetic Oligonucleotide; NDFIP1 exon 6; Set C
uucuuacauuaaaaacacuuaccuaaaacaaggaac

SEQ ID NO: 38791 - RNA, 37 nt, Artificial Sequence
  Synthetic Oligonucleotide; NDFIP1 exon 6; Set C
uuucuuacauuaaaaacacuuaccuaaaacaaggaac

SEQ ID NO: 38792 - RNA, 35 nt, Artificial Sequence
  Synthetic Oligonucleotide; NDFIP1 exon 6; Set C
uucuuacauuaaaaacacuuaccuaaaacaaggaa

SEQ ID NO: 38793 - RNA, 38 nt, Artificial Sequence
  Synthetic Oligonucleotide; NDFIP1 exon 6; Set C
uuuucuuacauuaaaaacacuuaccuaaaacaaggaac

SEQ ID NO: 38794 - RNA, 36 nt, Artificial Sequence
  Synthetic Oligonucleotide; NDFIP1 exon 6; Set C
uuucuuacauuaaaaacacuuaccuaaaacaaggaa

SEQ ID NO: 38795 - RNA, 27 nt, Artificial Sequence
  Synthetic Oligonucleotide; NDFIP1 exon 6; Set C
uuacauuaaaaacacuuaccuaaaaca

SEQ ID NO: 38796 - RNA, 39 nt, Artificial Sequence
  Synthetic Oligonucleotide; NDFIP1 exon 6; Set C
cuuuucuuacauuaaaaacacuuaccuaaaacaaggaac

SEQ ID NO: 38797 - RNA, 29 nt, Artificial Sequence
  Synthetic Oligonucleotide; NDFIP1 exon 6; Set C
cuuacauuaaaaacacuuaccuaaaacaa

SEQ ID NO: 38798 - RNA, 37 nt, Artificial Sequence
  Synthetic Oligonucleotide; NDFIP1 exon 6; Set C
uuuucuuacauuaaaaacacuuaccuaaaacaaggaa

SEQ ID NO: 38799 - RNA, 26 nt, Artificial Sequence
  Synthetic Oligonucleotide; NDFIP1 exon 6; Set C
uuacauuaaaaacacuuaccuaaaac

SEQ ID NO: 38800 - RNA, 28 nt, Artificial Sequence
  Synthetic Oligonucleotide; NDFIP1 exon 6; Set C
cuuacauuaaaaacacuuaccuaaaaca

SEQ ID NO: 38801 - RNA, 40 nt, Artificial Sequence
  Synthetic Oligonucleotide; NDFIP1 exon 6; Set A
ccuuuucuuacauuaaaaacacuuaccuaaaacaaggaac

SEQ ID NO: 38802 - RNA, 30 nt, Artificial Sequence
  Synthetic Oligonucleotide; NDFIP1 exon 6; Set C
ucuuacauuaaaaacacuuaccuaaaacaa

SEQ ID NO: 38803 - RNA, 38 nt, Artificial Sequence
  Synthetic Oligonucleotide; NDFIP1 exon 6; Set C
cuuuucuuacauuaaaaacacuuaccuaaaacaaggaa

SEQ ID NO: 38804 - RNA, 25 nt, Artificial Sequence
  Synthetic Oligonucleotide; NDFIP1 exon 6; Set C
uuacauuaaaaacacuuaccuaaaa

SEQ ID NO: 38805 - RNA, 27 nt, Artificial Sequence
  Synthetic Oligonucleotide; NDFIP1 exon 6; Set C
cuuacauuaaaaacacuuaccuaaaac

SEQ ID NO: 38806 - RNA, 29 nt, Artificial Sequence
  Synthetic Oligonucleotide; NDFIP1 exon 6; Set C
ucuuacauuaaaaacacuuaccuaaaaca

SEQ ID NO: 38807 - RNA, 31 nt, Artificial Sequence
  Synthetic Oligonucleotide; NDFIP1 exon 6; Set C
uucuuacauuaaaaacacuuaccuaaaacaa

SEQ ID NO: 38808 - RNA, 39 nt, Artificial Sequence
  Synthetic Oligonucleotide; NDFIP1 exon 6; Set A
ccuuuucuuacauuaaaaacacuuaccuaaaacaaggaa

SEQ ID NO: 38809 - RNA, 26 nt, Artificial Sequence
  Synthetic Oligonucleotide; NDFIP1 exon 6; Set C
cuuacauuaaaaacacuuaccuaaaa

SEQ ID NO: 38810 - RNA, 24 nt, Artificial Sequence
  Synthetic Oligonucleotide; NDFIP1 exon 6; Set C
uuacauuaaaaacacuuaccuaaa

SEQ ID NO: 38811 - RNA, 28 nt, Artificial Sequence
  Synthetic Oligonucleotide; NDFIP1 exon 6; Set C
ucuuacauuaaaaacacuuaccuaaaac

SEQ ID NO: 38812 - RNA, 30 nt, Artificial Sequence
  Synthetic Oligonucleotide; NDFIP1 exon 6; Set C
uucuuacauuaaaaacacuuaccuaaaaca

SEQ ID NO: 38813 - RNA, 32 nt, Artificial Sequence
  Synthetic Oligonucleotide; NDFIP1 exon 6; Set C
uuucuuacauuaaaaacacuuaccuaaaacaa

SEQ ID NO: 38814 - RNA, 23 nt, Artificial Sequence
  Synthetic Oligonucleotide; NDFIP1 exon 6; Set C
uuacauuaaaaacacuuaccuaa

SEQ ID NO: 38815 - RNA, 27 nt, Artificial Sequence
  Synthetic Oligonucleotide; NDFIP1 exon 6; Set C
ucuuacauuaaaaacacuuaccuaaaa

SEQ ID NO: 38816 - RNA, 25 nt, Artificial Sequence
  Synthetic Oligonucleotide; NDFIP1 exon 6; Set C
cuuacauuaaaaacacuuaccuaaa

SEQ ID NO: 38817 - RNA, 29 nt, Artificial Sequence
  Synthetic Oligonucleotide; NDFIP1 exon 6; Set C
uucuuacauuaaaaacacuuaccuaaaac

SEQ ID NO: 38818 - RNA, 31 nt, Artificial Sequence
  Synthetic Oligonucleotide; NDFIP1 exon 6; Set C
uuucuuacauuaaaaacacuuaccuaaaaca

SEQ ID NO: 38819 - RNA, 33 nt, Artificial Sequence
  Synthetic Oligonucleotide; NDFIP1 exon 6; Set C
uuuucuuacauuaaaaacacuuaccuaaaacaa

SEQ ID NO: 38820 - RNA, 24 nt, Artificial Sequence
  Synthetic Oligonucleotide; NDFIP1 exon 6; Set C
cuuacauuaaaaacacuuaccuaa

SEQ ID NO: 38821 - RNA, 28 nt, Artificial Sequence
  Synthetic Oligonucleotide; NDFIP1 exon 6; Set C
uucuuacauuaaaaacacuuaccuaaaa

SEQ ID NO: 38822 - RNA, 26 nt, Artificial Sequence
  Synthetic Oligonucleotide; NDFIP1 exon 6; Set C
ucuuacauuaaaaacacuuaccuaaa

SEQ ID NO: 38823 - RNA, 30 nt, Artificial Sequence
  Synthetic Oligonucleotide; NDFIP1 exon 6; Set C
uuucuuacauuaaaaacacuuaccuaaaac

SEQ ID NO: 38824 - RNA, 32 nt, Artificial Sequence
  Synthetic Oligonucleotide; NDFIP1 exon 6; Set C
uuuucuuacauuaaaaacacuuaccuaaaaca

SEQ ID NO: 38825 - RNA, 34 nt, Artificial Sequence
  Synthetic Oligonucleotide; NDFIP1 exon 6; Set C
cuuuucuuacauuaaaaacacuuaccuaaaacaa

SEQ ID NO: 38826 - RNA, 25 nt, Artificial Sequence
  Synthetic Oligonucleotide; NDFIP1 exon 6; Set C
ucuuacauuaaaaacacuuaccuaa

SEQ ID NO: 38827 - RNA, 29 nt, Artificial Sequence
  Synthetic Oligonucleotide; NDFIP1 exon 6; Set C
uuucuuacauuaaaaacacuuaccuaaaa

SEQ ID NO: 38828 - RNA, 27 nt, Artificial Sequence
  Synthetic Oligonucleotide; NDFIP1 exon 6; Set C
uucuuacauuaaaaacacuuaccuaaa

SEQ ID NO: 38829 - RNA, 31 nt, Artificial Sequence
  Synthetic Oligonucleotide; NDFIP1 exon 6; Set C
uuuucuuacauuaaaaacacuuaccuaaaac

SEQ ID NO: 38830 - RNA, 33 nt, Artificial Sequence
  Synthetic Oligonucleotide; NDFIP1 exon 6; Set C
cuuuucuuacauuaaaaacacuuaccuaaaaca

SEQ ID NO: 38831 - RNA, 35 nt, Artificial Sequence
  Synthetic Oligonucleotide; NDFIP1 exon 6; Set C
ccuuuucuuacauuaaaaacacuuaccuaaaacaa

SEQ ID NO: 38832 - RNA, 26 nt, Artificial Sequence
  Synthetic Oligonucleotide; NDFIP1 exon 6; Set C
uucuuacauuaaaaacacuuaccuaa

SEQ ID NO: 38833 - RNA, 28 nt, Artificial Sequence
  Synthetic Oligonucleotide; NDFIP1 exon 6; Set C
uuucuuacauuaaaaacacuuaccuaaa

SEQ ID NO: 38834 - RNA, 30 nt, Artificial Sequence
  Synthetic Oligonucleotide; NDFIP1 exon 6; Set C
uuuucuuacauuaaaaacacuuaccuaaaa

SEQ ID NO: 38835 - RNA, 32 nt, Artificial Sequence
  Synthetic Oligonucleotide; NDFIP1 exon 6; Set C
cuuuucuuacauuaaaaacacuuaccuaaaac

SEQ ID NO: 38836 - RNA, 34 nt, Artificial Sequence
  Synthetic Oligonucleotide; NDFIP1 exon 6; Set C
ccuuuucuuacauuaaaaacacuuaccuaaaaca

SEQ ID NO: 38837 - RNA, 36 nt, Artificial Sequence
  Synthetic Oligonucleotide; NDFIP1 exon 6; Set A
gccuuuucuuacauuaaaaacacuuaccuaaaacaa

SEQ ID NO: 38838 - RNA, 27 nt, Artificial Sequence
  Synthetic Oligonucleotide; NDFIP1 exon 6; Set C
uuucuuacauuaaaaacacuuaccuaa

SEQ ID NO: 38839 - RNA, 29 nt, Artificial Sequence
  Synthetic Oligonucleotide; NDFIP1 exon 6; Set C
uuuucuuacauuaaaaacacuuaccuaaa

SEQ ID NO: 38840 - RNA, 31 nt, Artificial Sequence
  Synthetic Oligonucleotide; NDFIP1 exon 6; Set C
cuuuucuuacauuaaaaacacuuaccuaaaa

SEQ ID NO: 38841 - RNA, 33 nt, Artificial Sequence
  Synthetic Oligonucleotide; NDFIP1 exon 6; Set C
ccuuuucuuacauuaaaaacacuuaccuaaaac

SEQ ID NO: 38842 - RNA, 35 nt, Artificial Sequence
  Synthetic Oligonucleotide; NDFIP1 exon 6; Set A
gccuuuucuuacauuaaaaacacuuaccuaaaaca

SEQ ID NO: 38843 - RNA, 28 nt, Artificial Sequence
  Synthetic Oligonucleotide; NDFIP1 exon 6; Set C
uuuucuuacauuaaaaacacuuaccuaa

SEQ ID NO: 38844 - RNA, 30 nt, Artificial Sequence
  Synthetic Oligonucleotide; NDFIP1 exon 6; Set C
cuuuucuuacauuaaaaacacuuaccuaaa

SEQ ID NO: 38845 - RNA, 32 nt, Artificial Sequence
  Synthetic Oligonucleotide; NDFIP1 exon 6; Set C
ccuuuucuuacauuaaaaacacuuaccuaaaa

SEQ ID NO: 38846 - RNA, 34 nt, Artificial Sequence
  Synthetic Oligonucleotide; NDFIP1 exon 6; Set C
gccuuuucuuacauuaaaaacacuuaccuaaaac

SEQ ID NO: 38847 - RNA, 18 nt, Artificial Sequence
  Synthetic Oligonucleotide; NDFIP1 exon 6; Set C
uuacauuaaaaacacuua

SEQ ID NO: 38848 - RNA, 29 nt, Artificial Sequence
  Synthetic Oligonucleotide; NDFIP1 exon 6; Set C
cuuuucuuacauuaaaaacacuuaccuaa

SEQ ID NO: 38849 - RNA, 31 nt, Artificial Sequence
  Synthetic Oligonucleotide; NDFIP1 exon 6; Set C
ccuuuucuuacauuaaaaacacuuaccuaaa

SEQ ID NO: 38850 - RNA, 33 nt, Artificial Sequence
  Synthetic Oligonucleotide; NDFIP1 exon 6; Set C
gccuuuucuuacauuaaaaacacuuaccuaaaa

SEQ ID NO: 38851 - RNA, 19 nt, Artificial Sequence
  Synthetic Oligonucleotide; NDFIP1 exon 6; Set C
cuuacauuaaaaacacuua

SEQ ID NO: 38852 - RNA, 17 nt, Artificial Sequence
  Synthetic Oligonucleotide; NDFIP1 exon 6; Set C
uuacauuaaaaacacuu

SEQ ID NO: 38853 - RNA, 30 nt, Artificial Sequence
  Synthetic Oligonucleotide; NDFIP1 exon 6; Set C
ccuuuucuuacauuaaaaacacuuaccuaa

SEQ ID NO: 38854 - RNA, 32 nt, Artificial Sequence
  Synthetic Oligonucleotide; NDFIP1 exon 6; Set C
gccuuuucuuacauuaaaaacacuuaccuaaa

SEQ ID NO: 38855 - RNA, 20 nt, Artificial Sequence
  Synthetic Oligonucleotide; NDFIP1 exon 6; Set C
ucuuacauuaaaaacacuua

SEQ ID NO: 38856 - RNA, 18 nt, Artificial Sequence
  Synthetic Oligonucleotide; NDFIP1 exon 6; Set C
cuuacauuaaaaacacuu

SEQ ID NO: 38857 - RNA, 16 nt, Artificial Sequence
  Synthetic Oligonucleotide; NDFIP1 exon 6; Set C
uuacauuaaaaacacu

SEQ ID NO: 38858 - RNA, 31 nt, Artificial Sequence
  Synthetic Oligonucleotide; NDFIP1 exon 6; Set C
gccuuuucuuacauuaaaaacacuuaccuaa

SEQ ID NO: 38859 - RNA, 19 nt, Artificial Sequence
  Synthetic Oligonucleotide; NDFIP1 exon 6; Set C
ucuuacauuaaaaacacuu

SEQ ID NO: 38860 - RNA, 15 nt, Artificial Sequence
  Synthetic Oligonucleotide; NDFIP1 exon 6; Set C
uuacauuaaaaacac

SEQ ID NO: 38861 - RNA, 17 nt, Artificial Sequence
  Synthetic Oligonucleotide; NDFIP1 exon 6; Set C
cuuacauuaaaaacacu

SEQ ID NO: 38862 - RNA, 16 nt, Artificial Sequence
  Synthetic Oligonucleotide; NDFIP1 exon 6; Set C
cuuacauuaaaaacac

SEQ ID NO: 38863 - RNA, 18 nt, Artificial Sequence
  Synthetic Oligonucleotide; NDFIP1 exon 6; Set C
ucuuacauuaaaaacacu

SEQ ID NO: 38864 - RNA, 15 nt, Artificial Sequence
  Synthetic Oligonucleotide; NDFIP1 exon 6; Set C
cuuacauuaaaaaca

SEQ ID NO: 38865 - RNA, 17 nt, Artificial Sequence
  Synthetic Oligonucleotide; NDFIP1 exon 6; Set C
ucuuacauuaaaaacac

SEQ ID NO: 38866 - RNA, 16 nt, Artificial Sequence
  Synthetic Oligonucleotide; NDFIP1 exon 6; Set C
ucuuacauuaaaaaca

SEQ ID NO: 38867 - RNA, 15 nt, Artificial Sequence
  Synthetic Oligonucleotide; NDFIP1 exon 6; Set C
ucuuacauuaaaaac

SEQ ID NO: 38868 - RNA, 26 nt, Artificial Sequence
  Synthetic Oligonucleotide; NDFIP1 exon 6; Set C
gccuuuucuuacauuaaaaacacuua

SEQ ID NO: 38869 - RNA, 25 nt, Artificial Sequence
  Synthetic Oligonucleotide; NDFIP1 exon 6; Set C
gccuuuucuuacauuaaaaacacuu

SEQ ID NO: 38870 - RNA, 24 nt, Artificial Sequence
  Synthetic Oligonucleotide; NDFIP1 exon 6; Set C
gccuuuucuuacauuaaaaacacu

SEQ ID NO: 38871 - RNA, 23 nt, Artificial Sequence
  Synthetic Oligonucleotide; NDFIP1 exon 6; Set C
gccuuuucuuacauuaaaaacac

SEQ ID NO: 38872 - RNA, 22 nt, Artificial Sequence
  Synthetic Oligonucleotide; NDFIP1 exon 6; Set C
gccuuuucuuacauuaaaaaca

SEQ ID NO: 38873 - RNA, 21 nt, Artificial Sequence
  Synthetic Oligonucleotide; NDFIP1 exon 6; Set C
gccuuuucuuacauuaaaaac

SEQ ID NO: 38874 - RNA, 20 nt, Artificial Sequence
  Synthetic Oligonucleotide; NDFIP1 exon 6; Set C
gccuuuucuuacauuaaaaa

SEQ ID NO: 38875 - RNA, 19 nt, Artificial Sequence
  Synthetic Oligonucleotide; NDFIP1 exon 6; Set C
gccuuuucuuacauuaaaa

SEQ ID NO: 38876 - RNA, 40 nt, Artificial Sequence
  Synthetic Oligonucleotide; NDFIP1 exon 6; Set C
uuuaauguaauguuuucuugccuuuucuuacauuaaaaac

SEQ ID NO: 38877 - RNA, 39 nt, Artificial Sequence
  Synthetic Oligonucleotide; NDFIP1 exon 6; Set C
uuuaauguaauguuuucuugccuuuucuuacauuaaaaa

SEQ ID NO: 38878 - RNA, 40 nt, Artificial Sequence
  Synthetic Oligonucleotide; NDFIP1 exon 6; Set C
auuuaauguaauguuuucuugccuuuucuuacauuaaaaa

SEQ ID NO: 38879 - RNA, 38 nt, Artificial Sequence
  Synthetic Oligonucleotide; NDFIP1 exon 6; Set C
uuuaauguaauguuuucuugccuuuucuuacauuaaaa

SEQ ID NO: 38880 - RNA, 39 nt, Artificial Sequence
  Synthetic Oligonucleotide; NDFIP1 exon 6; Set C
auuuaauguaauguuuucuugccuuuucuuacauuaaaa

SEQ ID NO: 38881 - RNA, 40 nt, Artificial Sequence
  Synthetic Oligonucleotide; NDFIP1 exon 6; Set C
aauuuaauguaauguuuucuugccuuuucuuacauuaaaa

SEQ ID NO: 38882 - RNA, 32 nt, Artificial Sequence
  Synthetic Oligonucleotide; NDFIP1 exon 6; Set A
acacuuuauagcagcuuaacagacacaauuuc

SEQ ID NO: 38883 - RNA, 31 nt, Artificial Sequence
  Synthetic Oligonucleotide; NDFIP1 exon 6; Set A
acacuuuauagcagcuuaacagacacaauuu

SEQ ID NO: 38884 - RNA, 24 nt, Artificial Sequence
  Synthetic Oligonucleotide; NDFIP1 exon 6; Set C
acacuuuauagcagcuuaacagac

SEQ ID NO: 38885 - RNA, 22 nt, Artificial Sequence
  Synthetic Oligonucleotide; NDFIP1 exon 6; Set C
acacuuuauagcagcuuaacag

SEQ ID NO: 38886 - RNA, 18 nt, Artificial Sequence
  Synthetic Oligonucleotide; NDFIP1 exon 6; Set C
acacuuuauagcagcuua

SEQ ID NO: 38887 - RNA, 19 nt, Artificial Sequence
  Synthetic Oligonucleotide; NDFIP1 exon 6; Set C
aacacuuuauagcagcuua

SEQ ID NO: 38888 - RNA, 17 nt, Artificial Sequence
  Synthetic Oligonucleotide; NDFIP1 exon 6; Set C
acacuuuauagcagcuu

SEQ ID NO: 38889 - RNA, 18 nt, Artificial Sequence
  Synthetic Oligonucleotide; NDFIP1 exon 6; Set C
aacacuuuauagcagcuu

SEQ ID NO: 38890 - RNA, 16 nt, Artificial Sequence
  Synthetic Oligonucleotide; NDFIP1 exon 6; Set C
acacuuuauagcagcu

SEQ ID NO: 38891 - RNA, 15 nt, Artificial Sequence
  Synthetic Oligonucleotide; NDFIP1 exon 6; Set C
acacuuuauagcagc

SEQ ID NO: 38892 - RNA, 17 nt, Artificial Sequence
  Synthetic Oligonucleotide; NDFIP1 exon 6; Set C
aacacuuuauagcagcu

SEQ ID NO: 38893 - RNA, 30 nt, Artificial Sequence
  Synthetic Oligonucleotide; NDFIP1 exon 6; Set A
aaggcaaaacacuuuauagcagcuuaacag

SEQ ID NO: 38894 - RNA, 16 nt, Artificial Sequence
  Synthetic Oligonucleotide; NDFIP1 exon 6; Set C
aacacuuuauagcagc

SEQ ID NO: 38895 - RNA, 35 nt, Artificial Sequence
  Synthetic Oligonucleotide; NDFIP1 exon 6; Set A
aauaaggcaaaacacuuuauagcagcuuaacagac

SEQ ID NO: 38896 - RNA, 34 nt, Artificial Sequence
  Synthetic Oligonucleotide; NDFIP1 exon 6; Set A
aauaaggcaaaacacuuuauagcagcuuaacaga

SEQ ID NO: 38897 - RNA, 36 nt, Artificial Sequence
  Synthetic Oligonucleotide; NDFIP1 exon 6; Set A
aaauaaggcaaaacacuuuauagcagcuuaacagac

SEQ ID NO: 38898 - RNA, 35 nt, Artificial Sequence
  Synthetic Oligonucleotide; NDFIP1 exon 6; Set A
aaauaaggcaaaacacuuuauagcagcuuaacaga

SEQ ID NO: 38899 - RNA, 33 nt, Artificial Sequence
  Synthetic Oligonucleotide; NDFIP1 exon 6; Set A
aauaaggcaaaacacuuuauagcagcuuaacag

SEQ ID NO: 38900 - RNA, 37 nt, Artificial Sequence
  Synthetic Oligonucleotide; NDFIP1 exon 6; Set A
aaaauaaggcaaaacacuuuauagcagcuuaacagac

SEQ ID NO: 38901 - RNA, 36 nt, Artificial Sequence
  Synthetic Oligonucleotide; NDFIP1 exon 6; Set A
aaaauaaggcaaaacacuuuauagcagcuuaacaga

SEQ ID NO: 38902 - RNA, 34 nt, Artificial Sequence
  Synthetic Oligonucleotide; NDFIP1 exon 6; Set A
aaauaaggcaaaacacuuuauagcagcuuaacag

SEQ ID NO: 38903 - RNA, 26 nt, Artificial Sequence
  Synthetic Oligonucleotide; NDFIP1 exon 6; Set C
aaggcaaaacacuuuauagcagcuua

SEQ ID NO: 38904 - RNA, 39 nt, Artificial Sequence
  Synthetic Oligonucleotide; NDFIP1 exon 6; Set A
aaaaaauaaggcaaaacacuuuauagcagcuuaacagac

SEQ ID NO: 38905 - RNA, 35 nt, Artificial Sequence
  Synthetic Oligonucleotide; NDFIP1 exon 6; Set C
aaaauaaggcaaaacacuuuauagcagcuuaacag

SEQ ID NO: 38906 - RNA, 27 nt, Artificial Sequence
  Synthetic Oligonucleotide; NDFIP1 exon 6; Set C
uaaggcaaaacacuuuauagcagcuua

SEQ ID NO: 38907 - RNA, 25 nt, Artificial Sequence
  Synthetic Oligonucleotide; NDFIP1 exon 6; Set C
aaggcaaaacacuuuauagcagcuu

SEQ ID NO: 38908 - RNA, 38 nt, Artificial Sequence
  Synthetic Oligonucleotide; NDFIP1 exon 6; Set A
aaaaaauaaggcaaaacacuuuauagcagcuuaacaga

SEQ ID NO: 38909 - RNA, 28 nt, Artificial Sequence
  Synthetic Oligonucleotide; NDFIP1 exon 6; Set C
auaaggcaaaacacuuuauagcagcuua

SEQ ID NO: 38910 - RNA, 26 nt, Artificial Sequence
  Synthetic Oligonucleotide; NDFIP1 exon 6; Set C
uaaggcaaaacacuuuauagcagcuu

SEQ ID NO: 38911 - RNA, 24 nt, Artificial Sequence
  Synthetic Oligonucleotide; NDFIP1 exon 6; Set C
aaggcaaaacacuuuauagcagcu

SEQ ID NO: 38912 - RNA, 37 nt, Artificial Sequence
  Synthetic Oligonucleotide; NDFIP1 exon 6; Set C
aaaaaauaaggcaaaacacuuuauagcagcuuaacag

SEQ ID NO: 38913 - RNA, 29 nt, Artificial Sequence
  Synthetic Oligonucleotide; NDFIP1 exon 6; Set C
aauaaggcaaaacacuuuauagcagcuua

SEQ ID NO: 38914 - RNA, 23 nt, Artificial Sequence
  Synthetic Oligonucleotide; NDFIP1 exon 6; Set C
aaggcaaaacacuuuauagcagc

SEQ ID NO: 38915 - RNA, 27 nt, Artificial Sequence
  Synthetic Oligonucleotide; NDFIP1 exon 6; Set C
auaaggcaaaacacuuuauagcagcuu

SEQ ID NO: 38916 - RNA, 25 nt, Artificial Sequence
  Synthetic Oligonucleotide; NDFIP1 exon 6; Set C
uaaggcaaaacacuuuauagcagcu

SEQ ID NO: 38917 - RNA, 30 nt, Artificial Sequence
  Synthetic Oligonucleotide; NDFIP1 exon 6; Set C
aaauaaggcaaaacacuuuauagcagcuua

SEQ ID NO: 38918 - RNA, 24 nt, Artificial Sequence
  Synthetic Oligonucleotide; NDFIP1 exon 6; Set C
uaaggcaaaacacuuuauagcagc

SEQ ID NO: 38919 - RNA, 26 nt, Artificial Sequence
  Synthetic Oligonucleotide; NDFIP1 exon 6; Set C
auaaggcaaaacacuuuauagcagcu

SEQ ID NO: 38920 - RNA, 39 nt, Artificial Sequence
  Synthetic Oligonucleotide; NDFIP1 exon 6; Set A
cuaaaaaauaaggcaaaacacuuuauagcagcuuaacag

SEQ ID NO: 38921 - RNA, 31 nt, Artificial Sequence
  Synthetic Oligonucleotide; NDFIP1 exon 6; Set C
aaaauaaggcaaaacacuuuauagcagcuua

SEQ ID NO: 38922 - RNA, 25 nt, Artificial Sequence
  Synthetic Oligonucleotide; NDFIP1 exon 6; Set C
auaaggcaaaacacuuuauagcagc

SEQ ID NO: 38923 - RNA, 32 nt, Artificial Sequence
  Synthetic Oligonucleotide; NDFIP1 exon 6; Set C
aaaaauaaggcaaaacacuuuauagcagcuua

SEQ ID NO: 38924 - RNA, 30 nt, Artificial Sequence
  Synthetic Oligonucleotide; NDFIP1 exon 6; Set C
aaaauaaggcaaaacacuuuauagcagcuu

SEQ ID NO: 38925 - RNA, 33 nt, Artificial Sequence
  Synthetic Oligonucleotide; NDFIP1 exon 6; Set C
aaaaaauaaggcaaaacacuuuauagcagcuua

SEQ ID NO: 38926 - RNA, 19 nt, Artificial Sequence
  Synthetic Oligonucleotide; NDFIP1 exon 6; Set C
aaggcaaaacacuuuauag

SEQ ID NO: 38927 - RNA, 31 nt, Artificial Sequence
  Synthetic Oligonucleotide; NDFIP1 exon 6; Set C
aaaaauaaggcaaaacacuuuauagcagcuu

SEQ ID NO: 38928 - RNA, 18 nt, Artificial Sequence
  Synthetic Oligonucleotide; NDFIP1 exon 6; Set C
aaggcaaaacacuuuaua

SEQ ID NO: 38929 - RNA, 34 nt, Artificial Sequence
  Synthetic Oligonucleotide; NDFIP1 exon 6; Set C
uaaaaaauaaggcaaaacacuuuauagcagcuua

SEQ ID NO: 38930 - RNA, 20 nt, Artificial Sequence
  Synthetic Oligonucleotide; NDFIP1 exon 6; Set C
uaaggcaaaacacuuuauag

SEQ ID NO: 38931 - RNA, 32 nt, Artificial Sequence
  Synthetic Oligonucleotide; NDFIP1 exon 6; Set C
aaaaaauaaggcaaaacacuuuauagcagcuu

SEQ ID NO: 38932 - RNA, 30 nt, Artificial Sequence
  Synthetic Oligonucleotide; NDFIP1 exon 6; Set C
aaaaauaaggcaaaacacuuuauagcagcu

SEQ ID NO: 38933 - RNA, 19 nt, Artificial Sequence
  Synthetic Oligonucleotide; NDFIP1 exon 6; Set C
uaaggcaaaacacuuuaua

SEQ ID NO: 38934 - RNA, 17 nt, Artificial Sequence
  Synthetic Oligonucleotide; NDFIP1 exon 6; Set C
aaggcaaaacacuuuau

SEQ ID NO: 38935 - RNA, 35 nt, Artificial Sequence
  Synthetic Oligonucleotide; NDFIP1 exon 6; Set C
cuaaaaaauaaggcaaaacacuuuauagcagcuua

SEQ ID NO: 38936 - RNA, 21 nt, Artificial Sequence
  Synthetic Oligonucleotide; NDFIP1 exon 6; Set C
auaaggcaaaacacuuuauag

SEQ ID NO: 38937 - RNA, 29 nt, Artificial Sequence
  Synthetic Oligonucleotide; NDFIP1 exon 6; Set C
aaaaauaaggcaaaacacuuuauagcagc

SEQ ID NO: 38938 - RNA, 33 nt, Artificial Sequence
  Synthetic Oligonucleotide; NDFIP1 exon 6; Set C
uaaaaaauaaggcaaaacacuuuauagcagcuu

SEQ ID NO: 38939 - RNA, 31 nt, Artificial Sequence
  Synthetic Oligonucleotide; NDFIP1 exon 6; Set C
aaaaaauaaggcaaaacacuuuauagcagcu

SEQ ID NO: 38940 - RNA, 16 nt, Artificial Sequence
  Synthetic Oligonucleotide; NDFIP1 exon 6; Set C
aaggcaaaacacuuua

SEQ ID NO: 38941 - RNA, 20 nt, Artificial Sequence
  Synthetic Oligonucleotide; NDFIP1 exon 6; Set C
auaaggcaaaacacuuuaua

SEQ ID NO: 38942 - RNA, 18 nt, Artificial Sequence
  Synthetic Oligonucleotide; NDFIP1 exon 6; Set C
uaaggcaaaacacuuuau

SEQ ID NO: 38943 - RNA, 30 nt, Artificial Sequence
  Synthetic Oligonucleotide; NDFIP1 exon 6; Set C
aaaaaauaaggcaaaacacuuuauagcagc

SEQ ID NO: 38944 - RNA, 34 nt, Artificial Sequence
  Synthetic Oligonucleotide; NDFIP1 exon 6; Set C
cuaaaaaauaaggcaaaacacuuuauagcagcuu

SEQ ID NO: 38945 - RNA, 32 nt, Artificial Sequence
  Synthetic Oligonucleotide; NDFIP1 exon 6; Set C
uaaaaaauaaggcaaaacacuuuauagcagcu

SEQ ID NO: 38946 - RNA, 17 nt, Artificial Sequence
  Synthetic Oligonucleotide; NDFIP1 exon 6; Set C
uaaggcaaaacacuuua

SEQ ID NO: 38947 - RNA, 21 nt, Artificial Sequence
  Synthetic Oligonucleotide; NDFIP1 exon 6; Set C
aauaaggcaaaacacuuuaua

SEQ ID NO: 38948 - RNA, 19 nt, Artificial Sequence
  Synthetic Oligonucleotide; NDFIP1 exon 6; Set C
auaaggcaaaacacuuuau

SEQ ID NO: 38949 - RNA, 23 nt, Artificial Sequence
  Synthetic Oligonucleotide; NDFIP1 exon 6; Set C
aaauaaggcaaaacacuuuauag

SEQ ID NO: 38950 - RNA, 31 nt, Artificial Sequence
  Synthetic Oligonucleotide; NDFIP1 exon 6; Set C
uaaaaaauaaggcaaaacacuuuauagcagc

SEQ ID NO: 38951 - RNA, 35 nt, Artificial Sequence
  Synthetic Oligonucleotide; NDFIP1 exon 6; Set C
acuaaaaaauaaggcaaaacacuuuauagcagcuu

SEQ ID NO: 38952 - RNA, 33 nt, Artificial Sequence
  Synthetic Oligonucleotide; NDFIP1 exon 6; Set C
cuaaaaaauaaggcaaaacacuuuauagcagcu

SEQ ID NO: 38953 - RNA, 18 nt, Artificial Sequence
  Synthetic Oligonucleotide; NDFIP1 exon 6; Set C
auaaggcaaaacacuuua

SEQ ID NO: 38954 - RNA, 22 nt, Artificial Sequence
  Synthetic Oligonucleotide; NDFIP1 exon 6; Set C
aaauaaggcaaaacacuuuaua

SEQ ID NO: 38955 - RNA, 20 nt, Artificial Sequence
  Synthetic Oligonucleotide; NDFIP1 exon 6; Set C
aauaaggcaaaacacuuuau

SEQ ID NO: 38956 - RNA, 24 nt, Artificial Sequence
  Synthetic Oligonucleotide; NDFIP1 exon 6; Set C
aaaauaaggcaaaacacuuuauag

SEQ ID NO: 38957 - RNA, 32 nt, Artificial Sequence
  Synthetic Oligonucleotide; NDFIP1 exon 6; Set C
cuaaaaaauaaggcaaaacacuuuauagcagc

SEQ ID NO: 38958 - RNA, 36 nt, Artificial Sequence
  Synthetic Oligonucleotide; NDFIP1 exon 6; Set C
aacuaaaaaauaaggcaaaacacuuuauagcagcuu

SEQ ID NO: 38959 - RNA, 34 nt, Artificial Sequence
  Synthetic Oligonucleotide; NDFIP1 exon 6; Set C
acuaaaaaauaaggcaaaacacuuuauagcagcu

SEQ ID NO: 38960 - RNA, 19 nt, Artificial Sequence
  Synthetic Oligonucleotide; NDFIP1 exon 6; Set C
aauaaggcaaaacacuuua

SEQ ID NO: 38961 - RNA, 23 nt, Artificial Sequence
  Synthetic Oligonucleotide; NDFIP1 exon 6; Set C
aaaauaaggcaaaacacuuuaua

SEQ ID NO: 38962 - RNA, 21 nt, Artificial Sequence
  Synthetic Oligonucleotide; NDFIP1 exon 6; Set C
aaauaaggcaaaacacuuuau

SEQ ID NO: 38963 - RNA, 25 nt, Artificial Sequence
  Synthetic Oligonucleotide; NDFIP1 exon 6; Set C
aaaaauaaggcaaaacacuuuauag

SEQ ID NO: 38964 - RNA, 33 nt, Artificial Sequence
  Synthetic Oligonucleotide; NDFIP1 exon 6; Set C
acuaaaaaauaaggcaaaacacuuuauagcagc

SEQ ID NO: 38965 - RNA, 37 nt, Artificial Sequence
  Synthetic Oligonucleotide; NDFIP1 exon 6; Set C
aaacuaaaaaauaaggcaaaacacuuuauagcagcuu

SEQ ID NO: 38966 - RNA, 35 nt, Artificial Sequence
  Synthetic Oligonucleotide; NDFIP1 exon 6; Set C
aacuaaaaaauaaggcaaaacacuuuauagcagcu

SEQ ID NO: 38967 - RNA, 20 nt, Artificial Sequence
  Synthetic Oligonucleotide; NDFIP1 exon 6; Set C
aaauaaggcaaaacacuuua

SEQ ID NO: 38968 - RNA, 22 nt, Artificial Sequence
  Synthetic Oligonucleotide; NDFIP1 exon 6; Set C
aaaauaaggcaaaacacuuuau

SEQ ID NO: 38969 - RNA, 26 nt, Artificial Sequence
  Synthetic Oligonucleotide; NDFIP1 exon 6; Set C
aaaaaauaaggcaaaacacuuuauag

SEQ ID NO: 38970 - RNA, 34 nt, Artificial Sequence
  Synthetic Oligonucleotide; NDFIP1 exon 6; Set C
aacuaaaaaauaaggcaaaacacuuuauagcagc

SEQ ID NO: 38971 - RNA, 36 nt, Artificial Sequence
  Synthetic Oligonucleotide; NDFIP1 exon 6; Set C
aaacuaaaaaauaaggcaaaacacuuuauagcagcu

SEQ ID NO: 38972 - RNA, 21 nt, Artificial Sequence
  Synthetic Oligonucleotide; NDFIP1 exon 6; Set C
aaaauaaggcaaaacacuuua

SEQ ID NO: 38973 - RNA, 25 nt, Artificial Sequence
  Synthetic Oligonucleotide; NDFIP1 exon 6; Set C
aaaaaauaaggcaaaacacuuuaua

SEQ ID NO: 38974 - RNA, 23 nt, Artificial Sequence
  Synthetic Oligonucleotide; NDFIP1 exon 6; Set C
aaaaauaaggcaaaacacuuuau

SEQ ID NO: 38975 - RNA, 27 nt, Artificial Sequence
  Synthetic Oligonucleotide; NDFIP1 exon 6; Set C
uaaaaaauaaggcaaaacacuuuauag

SEQ ID NO: 38976 - RNA, 35 nt, Artificial Sequence
  Synthetic Oligonucleotide; NDFIP1 exon 6; Set C
aaacuaaaaaauaaggcaaaacacuuuauagcagc

SEQ ID NO: 38977 - RNA, 22 nt, Artificial Sequence
  Synthetic Oligonucleotide; NDFIP1 exon 6; Set C
aaaaauaaggcaaaacacuuua

SEQ ID NO: 38978 - RNA, 24 nt, Artificial Sequence
  Synthetic Oligonucleotide; NDFIP1 exon 6; Set C
aaaaaauaaggcaaaacacuuuau

SEQ ID NO: 38979 - RNA, 28 nt, Artificial Sequence
  Synthetic Oligonucleotide; NDFIP1 exon 6; Set C
cuaaaaaauaaggcaaaacacuuuauag

SEQ ID NO: 38980 - RNA, 23 nt, Artificial Sequence
  Synthetic Oligonucleotide; NDFIP1 exon 6; Set C
aaaaaauaaggcaaaacacuuua

SEQ ID NO: 38981 - RNA, 27 nt, Artificial Sequence
  Synthetic Oligonucleotide; NDFIP1 exon 6; Set C
cuaaaaaauaaggcaaaacacuuuaua

SEQ ID NO: 38982 - RNA, 25 nt, Artificial Sequence
  Synthetic Oligonucleotide; NDFIP1 exon 6; Set C
uaaaaaauaaggcaaaacacuuuau

SEQ ID NO: 38983 - RNA, 29 nt, Artificial Sequence
  Synthetic Oligonucleotide; NDFIP1 exon 6; Set C
acuaaaaaauaaggcaaaacacuuuauag

SEQ ID NO: 38984 - RNA, 24 nt, Artificial Sequence
  Synthetic Oligonucleotide; NDFIP1 exon 6; Set C
uaaaaaauaaggcaaaacacuuua

SEQ ID NO: 38985 - RNA, 26 nt, Artificial Sequence
  Synthetic Oligonucleotide; NDFIP1 exon 6; Set C
cuaaaaaauaaggcaaaacacuuuau

SEQ ID NO: 38986 - RNA, 30 nt, Artificial Sequence
  Synthetic Oligonucleotide; NDFIP1 exon 6; Set C
aacuaaaaaauaaggcaaaacacuuuauag

SEQ ID NO: 38987 - RNA, 25 nt, Artificial Sequence
  Synthetic Oligonucleotide; NDFIP1 exon 6; Set C
cuaaaaaauaaggcaaaacacuuua

SEQ ID NO: 38988 - RNA, 31 nt, Artificial Sequence
  Synthetic Oligonucleotide; NDFIP1 exon 6; Set C
aaacuaaaaaauaaggcaaaacacuuuauag

SEQ ID NO: 38989 - RNA, 26 nt, Artificial Sequence
  Synthetic Oligonucleotide; NDFIP1 exon 6; Set C
acuaaaaaauaaggcaaaacacuuua

SEQ ID NO: 38990 - RNA, 17 nt, Artificial Sequence
  Synthetic Oligonucleotide; NDFIP1 exon 6; Set C
aaaaauaaggcaaaaca

SEQ ID NO: 38991 - RNA, 16 nt, Artificial Sequence
  Synthetic Oligonucleotide; NDFIP1 exon 6; Set C
aaaaauaaggcaaaac

SEQ ID NO: 38992 - RNA, 18 nt, Artificial Sequence
  Synthetic Oligonucleotide; NDFIP1 exon 6; Set C
aaaaaauaaggcaaaaca

SEQ ID NO: 38993 - RNA, 17 nt, Artificial Sequence
  Synthetic Oligonucleotide; NDFIP1 exon 6; Set C
aaaaaauaaggcaaaac

SEQ ID NO: 38994 - RNA, 19 nt, Artificial Sequence
  Synthetic Oligonucleotide; NDFIP1 exon 6; Set C
uaaaaaauaaggcaaaaca

SEQ ID NO: 38995 - RNA, 18 nt, Artificial Sequence
  Synthetic Oligonucleotide; NDFIP1 exon 6; Set C
uaaaaaauaaggcaaaac

SEQ ID NO: 38996 - RNA, 20 nt, Artificial Sequence
  Synthetic Oligonucleotide; NDFIP1 exon 6; Set C
cuaaaaaauaaggcaaaaca

SEQ ID NO: 38997 - RNA, 19 nt, Artificial Sequence
  Synthetic Oligonucleotide; NDFIP1 exon 6; Set C
cuaaaaaauaaggcaaaac

SEQ ID NO: 38998 - RNA, 21 nt, Artificial Sequence
  Synthetic Oligonucleotide; NDFIP1 exon 6; Set C
acuaaaaaauaaggcaaaaca

SEQ ID NO: 38999 - RNA, 20 nt, Artificial Sequence
  Synthetic Oligonucleotide; NDFIP1 exon 6; Set C
acuaaaaaauaaggcaaaac

SEQ ID NO: 39000 - RNA, 22 nt, Artificial Sequence
  Synthetic Oligonucleotide; NDFIP1 exon 6; Set C
aacuaaaaaauaaggcaaaaca

SEQ ID NO: 39001 - RNA, 39 nt, Artificial Sequence
  Synthetic Oligonucleotide; NDFIP1 exon 6; Set C
uagguggaaaacuaaaaaauaaggcaaaacacuuuauag

SEQ ID NO: 39002 - RNA, 21 nt, Artificial Sequence
  Synthetic Oligonucleotide; NDFIP1 exon 6; Set C
aacuaaaaaauaaggcaaaac

SEQ ID NO: 39003 - RNA, 23 nt, Artificial Sequence
  Synthetic Oligonucleotide; NDFIP1 exon 6; Set C
aaacuaaaaaauaaggcaaaaca

SEQ ID NO: 39004 - RNA, 38 nt, Artificial Sequence
  Synthetic Oligonucleotide; NDFIP1 exon 6; Set C
uagguggaaaacuaaaaaauaaggcaaaacacuuuaua

SEQ ID NO: 39005 - RNA, 37 nt, Artificial Sequence
  Synthetic Oligonucleotide; NDFIP1 exon 6; Set C
uagguggaaaacuaaaaaauaaggcaaaacacuuuau

SEQ ID NO: 39006 - RNA, 36 nt, Artificial Sequence
  Synthetic Oligonucleotide; NDFIP1 exon 6; Set C
uagguggaaaacuaaaaaauaaggcaaaacacuuua

SEQ ID NO: 39007 - RNA, 31 nt, Artificial Sequence
  Synthetic Oligonucleotide; NDFIP1 exon 6; Set C
uagguggaaaacuaaaaaauaaggcaaaaca

SEQ ID NO: 39008 - RNA, 30 nt, Artificial Sequence
  Synthetic Oligonucleotide; NDFIP1 exon 6; Set C
uagguggaaaacuaaaaaauaaggcaaaac

SEQ ID NO: 39009 - RNA, 32 nt, Artificial Sequence
  Synthetic Oligonucleotide; NDFIP1 exon 6; Set C
auagguggaaaacuaaaaaauaaggcaaaaca

SEQ ID NO: 39010 - RNA, 31 nt, Artificial Sequence
  Synthetic Oligonucleotide; NDFIP1 exon 6; Set C
auagguggaaaacuaaaaaauaaggcaaaac

SEQ ID NO: 39011 - RNA, 33 nt, Artificial Sequence
  Synthetic Oligonucleotide; NDFIP1 exon 6; Set C
aauagguggaaaacuaaaaaauaaggcaaaaca

SEQ ID NO: 39012 - RNA, 34 nt, Artificial Sequence
  Synthetic Oligonucleotide; NDFIP1 exon 6; Set C
aaauagguggaaaacuaaaaaauaaggcaaaaca

SEQ ID NO: 39013 - RNA, 36 nt, Artificial Sequence
  Synthetic Oligonucleotide; NDFIP1 exon 6; Set C
ggaaauagguggaaaacuaaaaaauaaggcaaaaca

SEQ ID NO: 39014 - RNA, 35 nt, Artificial Sequence
  Synthetic Oligonucleotide; NDFIP1 exon 6; Set C
ggaaauagguggaaaacuaaaaaauaaggcaaaac

SEQ ID NO: 39015 - RNA, 37 nt, Artificial Sequence
  Synthetic Oligonucleotide; NDFIP1 exon 6; Set C
gggaaauagguggaaaacuaaaaaauaaggcaaaaca

SEQ ID NO: 39016 - RNA, 36 nt, Artificial Sequence
  Synthetic Oligonucleotide; NDFIP1 exon 6; Set C
gggaaauagguggaaaacuaaaaaauaaggcaaaac

SEQ ID NO: 39017 - RNA, 38 nt, Artificial Sequence
  Synthetic Oligonucleotide; NDFIP1 exon 6; Set C
agggaaauagguggaaaacuaaaaaauaaggcaaaaca

SEQ ID NO: 39018 - RNA, 37 nt, Artificial Sequence
  Synthetic Oligonucleotide; NDFIP1 exon 6; Set C
agggaaauagguggaaaacuaaaaaauaaggcaaaac

SEQ ID NO: 39019 - RNA, 39 nt, Artificial Sequence
  Synthetic Oligonucleotide; NDFIP1 exon 6; Set C
cagggaaauagguggaaaacuaaaaaauaaggcaaaaca

SEQ ID NO: 39020 - RNA, 38 nt, Artificial Sequence
  Synthetic Oligonucleotide; NDFIP1 exon 6; Set C
cagggaaauagguggaaaacuaaaaaauaaggcaaaac

SEQ ID NO: 39021 - RNA, 20 nt, Artificial Sequence
  Synthetic Oligonucleotide; NDFIP1 exon 6; Set C
uagguggaaaacuaaaaaau

SEQ ID NO: 39022 - RNA, 19 nt, Artificial Sequence
  Synthetic Oligonucleotide; NDFIP1 exon 6; Set C
uagguggaaaacuaaaaaa

SEQ ID NO: 39023 - RNA, 21 nt, Artificial Sequence
  Synthetic Oligonucleotide; NDFIP1 exon 6; Set C
auagguggaaaacuaaaaaau

SEQ ID NO: 39024 - RNA, 20 nt, Artificial Sequence
  Synthetic Oligonucleotide; NDFIP1 exon 6; Set C
auagguggaaaacuaaaaaa

SEQ ID NO: 39025 - RNA, 22 nt, Artificial Sequence
  Synthetic Oligonucleotide; NDFIP1 exon 6; Set C
aauagguggaaaacuaaaaaau

SEQ ID NO: 39026 - RNA, 18 nt, Artificial Sequence
  Synthetic Oligonucleotide; NDFIP1 exon 6; Set C
uagguggaaaacuaaaaa

SEQ ID NO: 39027 - RNA, 17 nt, Artificial Sequence
  Synthetic Oligonucleotide; NDFIP1 exon 6; Set C
uagguggaaaacuaaaa

SEQ ID NO: 39028 - RNA, 21 nt, Artificial Sequence
  Synthetic Oligonucleotide; NDFIP1 exon 6; Set C
aauagguggaaaacuaaaaaa

SEQ ID NO: 39029 - RNA, 19 nt, Artificial Sequence
  Synthetic Oligonucleotide; NDFIP1 exon 6; Set C
auagguggaaaacuaaaaa

SEQ ID NO: 39030 - RNA, 16 nt, Artificial Sequence
  Synthetic Oligonucleotide; NDFIP1 exon 6; Set C
uagguggaaaacuaaa

SEQ ID NO: 39031 - RNA, 20 nt, Artificial Sequence
  Synthetic Oligonucleotide; NDFIP1 exon 6; Set C
aauagguggaaaacuaaaaa

SEQ ID NO: 39032 - RNA, 15 nt, Artificial Sequence
  Synthetic Oligonucleotide; NDFIP1 exon 6; Set C
uagguggaaaacuaa

SEQ ID NO: 39033 - RNA, 17 nt, Artificial Sequence
  Synthetic Oligonucleotide; NDFIP1 exon 6; Set C
auagguggaaaacuaaa

SEQ ID NO: 39034 - RNA, 25 nt, Artificial Sequence
  Synthetic Oligonucleotide; NDFIP1 exon 6; Set C
ggaaauagguggaaaacuaaaaaau

SEQ ID NO: 39035 - RNA, 21 nt, Artificial Sequence
  Synthetic Oligonucleotide; NDFIP1 exon 6; Set C
aaauagguggaaaacuaaaaa

SEQ ID NO: 39036 - RNA, 32 nt, Artificial Sequence
  Synthetic Oligonucleotide; NDFIP1 exon 6; Set C
ccagggaaauagguggaaaacuaaaaaauaag

SEQ ID NO: 39037 - RNA, 24 nt, Artificial Sequence
  Synthetic Oligonucleotide; NDFIP1 exon 6; Set C
ggaaauagguggaaaacuaaaaaa

SEQ ID NO: 39038 - RNA, 26 nt, Artificial Sequence
  Synthetic Oligonucleotide; NDFIP1 exon 6; Set C
gggaaauagguggaaaacuaaaaaau

SEQ ID NO: 39039 - RNA, 22 nt, Artificial Sequence
  Synthetic Oligonucleotide; NDFIP1 exon 6; Set C
gaaauagguggaaaacuaaaaa

SEQ ID NO: 39040 - RNA, 31 nt, Artificial Sequence
  Synthetic Oligonucleotide; NDFIP1 exon 6; Set C
ccagggaaauagguggaaaacuaaaaaauaa

SEQ ID NO: 39041 - RNA, 15 nt, Artificial Sequence
  Synthetic Oligonucleotide; NDFIP1 exon 6; Set C
auagguggaaaacua

SEQ ID NO: 39042 - RNA, 25 nt, Artificial Sequence
  Synthetic Oligonucleotide; NDFIP1 exon 6; Set C
gggaaauagguggaaaacuaaaaaa

SEQ ID NO: 39043 - RNA, 27 nt, Artificial Sequence
  Synthetic Oligonucleotide; NDFIP1 exon 6; Set C
agggaaauagguggaaaacuaaaaaau

SEQ ID NO: 39044 - RNA, 23 nt, Artificial Sequence
  Synthetic Oligonucleotide; NDFIP1 exon 6; Set C
ggaaauagguggaaaacuaaaaa

SEQ ID NO: 39045 - RNA, 30 nt, Artificial Sequence
  Synthetic Oligonucleotide; NDFIP1 exon 6; Set C
ccagggaaauagguggaaaacuaaaaaaua

SEQ ID NO: 39046 - RNA, 26 nt, Artificial Sequence
  Synthetic Oligonucleotide; NDFIP1 exon 6; Set C
agggaaauagguggaaaacuaaaaaa

SEQ ID NO: 39047 - RNA, 28 nt, Artificial Sequence
  Synthetic Oligonucleotide; NDFIP1 exon 6; Set C
cagggaaauagguggaaaacuaaaaaau

SEQ ID NO: 39048 - RNA, 24 nt, Artificial Sequence
  Synthetic Oligonucleotide; NDFIP1 exon 6; Set C
gggaaauagguggaaaacuaaaaa

SEQ ID NO: 39049 - RNA, 27 nt, Artificial Sequence
  Synthetic Oligonucleotide; NDFIP1 exon 6; Set C
cagggaaauagguggaaaacuaaaaaa

SEQ ID NO: 39050 - RNA, 25 nt, Artificial Sequence
  Synthetic Oligonucleotide; NDFIP1 exon 6; Set C
agggaaauagguggaaaacuaaaaa

SEQ ID NO: 39051 - RNA, 22 nt, Artificial Sequence
  Synthetic Oligonucleotide; NDFIP1 exon 6; Set C
gggaaauagguggaaaacuaaa

SEQ ID NO: 39052 - RNA, 26 nt, Artificial Sequence
  Synthetic Oligonucleotide; NDFIP1 exon 6; Set C
cagggaaauagguggaaaacuaaaaa

SEQ ID NO: 39053 - RNA, 23 nt, Artificial Sequence
  Synthetic Oligonucleotide; NDFIP1 exon 6; Set C
agggaaauagguggaaaacuaaa

SEQ ID NO: 39054 - RNA, 26 nt, Artificial Sequence
  Synthetic Oligonucleotide; NDFIP1 exon 6; Set C
ccagggaaauagguggaaaacuaaaa

SEQ ID NO: 39055 - RNA, 20 nt, Artificial Sequence
  Synthetic Oligonucleotide; NDFIP1 exon 6; Set C
gggaaauagguggaaaacua

SEQ ID NO: 39056 - RNA, 25 nt, Artificial Sequence
  Synthetic Oligonucleotide; NDFIP1 exon 6; Set C
ccagggaaauagguggaaaacuaaa

SEQ ID NO: 39057 - RNA, 24 nt, Artificial Sequence
  Synthetic Oligonucleotide; NDFIP1 exon 6; Set C
ccagggaaauagguggaaaacuaa

SEQ ID NO: 39058 - RNA, 18 nt, Artificial Sequence
  Synthetic Oligonucleotide; NDFIP1 exon 6; Set C
gggaaauagguggaaaac

SEQ ID NO: 39059 - RNA, 19 nt, Artificial Sequence
  Synthetic Oligonucleotide; NDFIP1 exon 6; Set C
agggaaauagguggaaaac

SEQ ID NO: 39060 - RNA, 23 nt, Artificial Sequence
  Synthetic Oligonucleotide; NDFIP1 exon 6; Set C
ccagggaaauagguggaaaacua

SEQ ID NO: 39061 - RNA, 22 nt, Artificial Sequence
  Synthetic Oligonucleotide; NDFIP1 exon 6; Set C
ccagggaaauagguggaaaacu

SEQ ID NO: 39062 - RNA, 36 nt, Artificial Sequence
  Synthetic Oligonucleotide; NDFIP1 exon 6; Set C
aaaauauccagggaaauagguggaaaacuaaaaaau

SEQ ID NO: 39063 - RNA, 21 nt, Artificial Sequence
  Synthetic Oligonucleotide; NDFIP1 exon 6; Set C
ccagggaaauagguggaaaac

SEQ ID NO: 39064 - RNA, 35 nt, Artificial Sequence
  Synthetic Oligonucleotide; NDFIP1 exon 6; Set C
aaaauauccagggaaauagguggaaaacuaaaaaa

SEQ ID NO: 39065 - RNA, 37 nt, Artificial Sequence
  Synthetic Oligonucleotide; NDFIP1 exon 6; Set C
caaaauauccagggaaauagguggaaaacuaaaaaau

SEQ ID NO: 39066 - RNA, 33 nt, Artificial Sequence
  Synthetic Oligonucleotide; NDFIP1 exon 6; Set C
aaauauccagggaaauagguggaaaacuaaaaa

SEQ ID NO: 39067 - RNA, 20 nt, Artificial Sequence
  Synthetic Oligonucleotide; NDFIP1 exon 6; Set C
ccagggaaauagguggaaaa

SEQ ID NO: 39068 - RNA, 36 nt, Artificial Sequence
  Synthetic Oligonucleotide; NDFIP1 exon 6; Set C
caaaauauccagggaaauagguggaaaacuaaaaaa

SEQ ID NO: 39069 - RNA, 38 nt, Artificial Sequence
  Synthetic Oligonucleotide; NDFIP1 exon 6; Set C
ucaaaauauccagggaaauagguggaaaacuaaaaaau

SEQ ID NO: 39070 - RNA, 34 nt, Artificial Sequence
  Synthetic Oligonucleotide; NDFIP1 exon 6; Set C
aaaauauccagggaaauagguggaaaacuaaaaa

SEQ ID NO: 39071 - RNA, 37 nt, Artificial Sequence
  Synthetic Oligonucleotide; NDFIP1 exon 6; Set C
ucaaaauauccagggaaauagguggaaaacuaaaaaa

SEQ ID NO: 39072 - RNA, 39 nt, Artificial Sequence
  Synthetic Oligonucleotide; NDFIP1 exon 6; Set C
aucaaaauauccagggaaauagguggaaaacuaaaaaau

SEQ ID NO: 39073 - RNA, 35 nt, Artificial Sequence
  Synthetic Oligonucleotide; NDFIP1 exon 6; Set C
caaaauauccagggaaauagguggaaaacuaaaaa

SEQ ID NO: 39074 - RNA, 38 nt, Artificial Sequence
  Synthetic Oligonucleotide; NDFIP1 exon 6; Set C
aucaaaauauccagggaaauagguggaaaacuaaaaaa

SEQ ID NO: 39075 - RNA, 36 nt, Artificial Sequence
  Synthetic Oligonucleotide; NDFIP1 exon 6; Set C
ucaaaauauccagggaaauagguggaaaacuaaaaa

SEQ ID NO: 39076 - RNA, 37 nt, Artificial Sequence
  Synthetic Oligonucleotide; NDFIP1 exon 6; Set C
aucaaaauauccagggaaauagguggaaaacuaaaaa

SEQ ID NO: 39077 - RNA, 34 nt, Artificial Sequence
  Synthetic Oligonucleotide; NDFIP1 exon 6; Set C
ucaaaauauccagggaaauagguggaaaacuaaa

SEQ ID NO: 39078 - RNA, 35 nt, Artificial Sequence
  Synthetic Oligonucleotide; NDFIP1 exon 6; Set C
aucaaaauauccagggaaauagguggaaaacuaaa

SEQ ID NO: 39079 - RNA, 32 nt, Artificial Sequence
  Synthetic Oligonucleotide; NDFIP1 exon 6; Set C
ucaaaauauccagggaaauagguggaaaacua

SEQ ID NO: 39080 - RNA, 33 nt, Artificial Sequence
  Synthetic Oligonucleotide; NDFIP1 exon 6; Set C
aucaaaauauccagggaaauagguggaaaacua

SEQ ID NO: 39081 - RNA, 30 nt, Artificial Sequence
  Synthetic Oligonucleotide; NDFIP1 exon 6; Set C
ucaaaauauccagggaaauagguggaaaac

SEQ ID NO: 39082 - RNA, 31 nt, Artificial Sequence
  Synthetic Oligonucleotide; NDFIP1 exon 6; Set C
aucaaaauauccagggaaauagguggaaaac

SEQ ID NO: 39083 - RNA, 40 nt, Artificial Sequence
  Synthetic Oligonucleotide; NDFIP1 exon 6; Set A
aguacugaccaucaaaauauccagggaaauagguggaaaa

SEQ ID NO: 39084 - RNA, 27 nt, Artificial Sequence
  Synthetic Oligonucleotide; NDFIP1 exon 6; Set C
cugaccaucaaaauauccagggaaaua

SEQ ID NO: 39085 - RNA, 29 nt, Artificial Sequence
  Synthetic Oligonucleotide; NDFIP1 exon 6; Set C
acugaccaucaaaauauccagggaaauag

SEQ ID NO: 39086 - RNA, 28 nt, Artificial Sequence
  Synthetic Oligonucleotide; NDFIP1 exon 6; Set C
acugaccaucaaaauauccagggaaaua

SEQ ID NO: 39087 - RNA, 26 nt, Artificial Sequence
  Synthetic Oligonucleotide; NDFIP1 exon 6; Set C
cugaccaucaaaauauccagggaaau

SEQ ID NO: 39088 - RNA, 25 nt, Artificial Sequence
  Synthetic Oligonucleotide; NDFIP1 exon 6; Set C
cugaccaucaaaauauccagggaaa

SEQ ID NO: 39089 - RNA, 27 nt, Artificial Sequence
  Synthetic Oligonucleotide; NDFIP1 exon 6; Set C
acugaccaucaaaauauccagggaaau

SEQ ID NO: 39090 - RNA, 26 nt, Artificial Sequence
  Synthetic Oligonucleotide; NDFIP1 exon 6; Set C
acugaccaucaaaauauccagggaaa

SEQ ID NO: 39091 - RNA, 24 nt, Artificial Sequence
  Synthetic Oligonucleotide; NDFIP1 exon 6; Set C
cugaccaucaaaauauccagggaa

SEQ ID NO: 39092 - RNA, 25 nt, Artificial Sequence
  Synthetic Oligonucleotide; NDFIP1 exon 6; Set C
acugaccaucaaaauauccagggaa

SEQ ID NO: 39093 - RNA, 24 nt, Artificial Sequence
  Synthetic Oligonucleotide; NDFIP1 exon 6; Set C
acugaccaucaaaauauccaggga

SEQ ID NO: 39094 - RNA, 23 nt, Artificial Sequence
  Synthetic Oligonucleotide; NDFIP1 exon 6; Set C
acugaccaucaaaauauccaggg

SEQ ID NO: 39095 - RNA, 26 nt, Artificial Sequence
  Synthetic Oligonucleotide; NDFIP1 exon 6; Set A
aguacugaccaucaaaauauccaggg

SEQ ID NO: 39096 - RNA, 27 nt, Artificial Sequence
  Synthetic Oligonucleotide; NDFIP1 exon 6; Set A
caguacugaccaucaaaauauccaggg

SEQ ID NO: 39097 - RNA, 25 nt, Artificial Sequence
  Synthetic Oligonucleotide; NDFIP1 exon 6; Set C
aguacugaccaucaaaauauccagg

SEQ ID NO: 39098 - RNA, 21 nt, Artificial Sequence
  Synthetic Oligonucleotide; NDFIP1 exon 6; Set C
uacugaccaucaaaauaucca

SEQ ID NO: 39099 - RNA, 38 nt, Artificial Sequence
  Synthetic Oligonucleotide; NDFIP1 exon 6; Set C
cagagccaguacugaccaucaaaauauccagggaaaua

SEQ ID NO: 39100 - RNA, 24 nt, Artificial Sequence
  Synthetic Oligonucleotide; NDFIP1 exon 6; Set C
aguacugaccaucaaaauauccag

SEQ ID NO: 39101 - RNA, 26 nt, Artificial Sequence
  Synthetic Oligonucleotide; NDFIP1 exon 6; Set C
caguacugaccaucaaaauauccagg

SEQ ID NO: 39102 - RNA, 22 nt, Artificial Sequence
  Synthetic Oligonucleotide; NDFIP1 exon 6; Set C
guacugaccaucaaaauaucca

SEQ ID NO: 39103 - RNA, 37 nt, Artificial Sequence
  Synthetic Oligonucleotide; NDFIP1 exon 6; Set C
cagagccaguacugaccaucaaaauauccagggaaau

SEQ ID NO: 39104 - RNA, 25 nt, Artificial Sequence
  Synthetic Oligonucleotide; NDFIP1 exon 6; Set C
caguacugaccaucaaaauauccag

SEQ ID NO: 39105 - RNA, 16 nt, Artificial Sequence
  Synthetic Oligonucleotide; NDFIP1 exon 6; Set C
acugaccaucaaaaua

SEQ ID NO: 39106 - RNA, 36 nt, Artificial Sequence
  Synthetic Oligonucleotide; NDFIP1 exon 6; Set C
cagagccaguacugaccaucaaaauauccagggaaa

SEQ ID NO: 39107 - RNA, 15 nt, Artificial Sequence
  Synthetic Oligonucleotide; NDFIP1 exon 6; Set C
acugaccaucaaaau

SEQ ID NO: 39108 - RNA, 17 nt, Artificial Sequence
  Synthetic Oligonucleotide; NDFIP1 exon 6; Set C
aguacugaccaucaaaa

SEQ ID NO: 39109 - RNA, 18 nt, Artificial Sequence
  Synthetic Oligonucleotide; NDFIP1 exon 6; Set C
caguacugaccaucaaaa

SEQ ID NO: 39110 - RNA, 16 nt, Artificial Sequence
  Synthetic Oligonucleotide; NDFIP1 exon 6; Set C
aguacugaccaucaaa

SEQ ID NO: 39111 - RNA, 17 nt, Artificial Sequence
  Synthetic Oligonucleotide; NDFIP1 exon 6; Set C
caguacugaccaucaaa

SEQ ID NO: 39112 - RNA, 15 nt, Artificial Sequence
  Synthetic Oligonucleotide; NDFIP1 exon 6; Set C
aguacugaccaucaa

SEQ ID NO: 39113 - RNA, 16 nt, Artificial Sequence
  Synthetic Oligonucleotide; NDFIP1 exon 6; Set C
caguacugaccaucaa

SEQ ID NO: 39114 - RNA, 15 nt, Artificial Sequence
  Synthetic Oligonucleotide; NDFIP1 exon 6; Set C
caguacugaccauca

SEQ ID NO: 39115 - RNA, 40 nt, Artificial Sequence
  Synthetic Oligonucleotide; NDFIP1 exon 6; Set C
cacccaccagagccaguacugaccaucaaaauauccaggg

SEQ ID NO: 39116 - RNA, 39 nt, Artificial Sequence
  Synthetic Oligonucleotide; NDFIP1 exon 6; Set C
cacccaccagagccaguacugaccaucaaaauauccagg

SEQ ID NO: 39117 - RNA, 38 nt, Artificial Sequence
  Synthetic Oligonucleotide; NDFIP1 exon 6; Set C
cacccaccagagccaguacugaccaucaaaauauccag

SEQ ID NO: 39118 - RNA, 40 nt, Artificial Sequence
  Synthetic Oligonucleotide; NDFIP1 exon 6; Set C
acacccaccagagccaguacugaccaucaaaauauccagg

SEQ ID NO: 39119 - RNA, 39 nt, Artificial Sequence
  Synthetic Oligonucleotide; NDFIP1 exon 6; Set C
acacccaccagagccaguacugaccaucaaaauauccag

SEQ ID NO: 39120 - RNA, 40 nt, Artificial Sequence
  Synthetic Oligonucleotide; NDFIP1 exon 6; Set C
aacacccaccagagccaguacugaccaucaaaauauccag

SEQ ID NO: 39121 - RNA, 31 nt, Artificial Sequence
  Synthetic Oligonucleotide; NDFIP1 exon 6; Set C
cacccaccagagccaguacugaccaucaaaa

SEQ ID NO: 39122 - RNA, 36 nt, Artificial Sequence
  Synthetic Oligonucleotide; NDFIP1 exon 6; Set C
gaacacccaccagagccaguacugaccaucaaaaua

SEQ ID NO: 39123 - RNA, 30 nt, Artificial Sequence
  Synthetic Oligonucleotide; NDFIP1 exon 6; Set C
cacccaccagagccaguacugaccaucaaa

SEQ ID NO: 39124 - RNA, 37 nt, Artificial Sequence
  Synthetic Oligonucleotide; NDFIP1 exon 6; Set C
ggaacacccaccagagccaguacugaccaucaaaaua

SEQ ID NO: 39125 - RNA, 35 nt, Artificial Sequence
  Synthetic Oligonucleotide; NDFIP1 exon 6; Set C
gaacacccaccagagccaguacugaccaucaaaau

SEQ ID NO: 39126 - RNA, 33 nt, Artificial Sequence
  Synthetic Oligonucleotide; NDFIP1 exon 6; Set C
aacacccaccagagccaguacugaccaucaaaa

SEQ ID NO: 39127 - RNA, 31 nt, Artificial Sequence
  Synthetic Oligonucleotide; NDFIP1 exon 6; Set C
acacccaccagagccaguacugaccaucaaa

SEQ ID NO: 39128 - RNA, 29 nt, Artificial Sequence
  Synthetic Oligonucleotide; NDFIP1 exon 6; Set C
cacccaccagagccaguacugaccaucaa

SEQ ID NO: 39129 - RNA, 34 nt, Artificial Sequence
  Synthetic Oligonucleotide; NDFIP1 exon 6; Set C
gaacacccaccagagccaguacugaccaucaaaa

SEQ ID NO: 39130 - RNA, 32 nt, Artificial Sequence
  Synthetic Oligonucleotide; NDFIP1 exon 6; Set C
aacacccaccagagccaguacugaccaucaaa

SEQ ID NO: 39131 - RNA, 30 nt, Artificial Sequence
  Synthetic Oligonucleotide; NDFIP1 exon 6; Set C
acacccaccagagccaguacugaccaucaa

SEQ ID NO: 39132 - RNA, 28 nt, Artificial Sequence
  Synthetic Oligonucleotide; NDFIP1 exon 6; Set C
cacccaccagagccaguacugaccauca

SEQ ID NO: 39133 - RNA, 33 nt, Artificial Sequence
  Synthetic Oligonucleotide; NDFIP1 exon 6; Set C
gaacacccaccagagccaguacugaccaucaaa

SEQ ID NO: 39134 - RNA, 31 nt, Artificial Sequence
  Synthetic Oligonucleotide; NDFIP1 exon 6; Set C
aacacccaccagagccaguacugaccaucaa

SEQ ID NO: 39135 - RNA, 29 nt, Artificial Sequence
  Synthetic Oligonucleotide; NDFIP1 exon 6; Set C
acacccaccagagccaguacugaccauca

SEQ ID NO: 39136 - RNA, 27 nt, Artificial Sequence
  Synthetic Oligonucleotide; NDFIP1 exon 6; Set C
cacccaccagagccaguacugaccauc

SEQ ID NO: 39137 - RNA, 40 nt, Artificial Sequence
  Synthetic Oligonucleotide; NDFIP1 exon 6; Set C
caaggaacacccaccagagccaguacugaccaucaaaaua

SEQ ID NO: 39138 - RNA, 32 nt, Artificial Sequence
  Synthetic Oligonucleotide; NDFIP1 exon 6; Set C
gaacacccaccagagccaguacugaccaucaa

SEQ ID NO: 39139 - RNA, 30 nt, Artificial Sequence
  Synthetic Oligonucleotide; NDFIP1 exon 6; Set C
aacacccaccagagccaguacugaccauca

SEQ ID NO: 39140 - RNA, 28 nt, Artificial Sequence
  Synthetic Oligonucleotide; NDFIP1 exon 6; Set C
acacccaccagagccaguacugaccauc

SEQ ID NO: 39141 - RNA, 39 nt, Artificial Sequence
  Synthetic Oligonucleotide; NDFIP1 exon 6; Set C
caaggaacacccaccagagccaguacugaccaucaaaau

SEQ ID NO: 39142 - RNA, 29 nt, Artificial Sequence
  Synthetic Oligonucleotide; NDFIP1 exon 6; Set C
aacacccaccagagccaguacugaccauc

SEQ ID NO: 39143 - RNA, 38 nt, Artificial Sequence
  Synthetic Oligonucleotide; NDFIP1 exon 6; Set C
caaggaacacccaccagagccaguacugaccaucaaaa

SEQ ID NO: 39144 - RNA, 37 nt, Artificial Sequence
  Synthetic Oligonucleotide; NDFIP1 exon 6; Set C
caaggaacacccaccagagccaguacugaccaucaaa

SEQ ID NO: 39145 - RNA, 36 nt, Artificial Sequence
  Synthetic Oligonucleotide; NDFIP1 exon 6; Set C
caaggaacacccaccagagccaguacugaccaucaa

SEQ ID NO: 39146 - RNA, 37 nt, Artificial Sequence
  Synthetic Oligonucleotide; NDFIP1 exon 6; Set C
acaaggaacacccaccagagccaguacugaccaucaa

SEQ ID NO: 39147 - RNA, 35 nt, Artificial Sequence
  Synthetic Oligonucleotide; NDFIP1 exon 6; Set C
caaggaacacccaccagagccaguacugaccauca

SEQ ID NO: 39148 - RNA, 36 nt, Artificial Sequence
  Synthetic Oligonucleotide; NDFIP1 exon 6; Set C
acaaggaacacccaccagagccaguacugaccauca

SEQ ID NO: 39149 - RNA, 19 nt, Artificial Sequence
  Synthetic Oligonucleotide; NDFIP1 exon 6; Set A
cacccaccagagccaguac

SEQ ID NO: 39150 - RNA, 37 nt, Artificial Sequence
  Synthetic Oligonucleotide; NDFIP1 exon 6; Set C
aacaaggaacacccaccagagccaguacugaccauca

SEQ ID NO: 39151 - RNA, 35 nt, Artificial Sequence
  Synthetic Oligonucleotide; NDFIP1 exon 6; Set C
acaaggaacacccaccagagccaguacugaccauc

SEQ ID NO: 39152 - RNA, 18 nt, Artificial Sequence
  Synthetic Oligonucleotide; NDFIP1 exon 6; Set A
cacccaccagagccagua

SEQ ID NO: 39153 - RNA, 38 nt, Artificial Sequence
  Synthetic Oligonucleotide; NDFIP1 exon 6; Set C
aaacaaggaacacccaccagagccaguacugaccauca

SEQ ID NO: 39154 - RNA, 36 nt, Artificial Sequence
  Synthetic Oligonucleotide; NDFIP1 exon 6; Set C
aacaaggaacacccaccagagccaguacugaccauc

SEQ ID NO: 39155 - RNA, 17 nt, Artificial Sequence
  Synthetic Oligonucleotide; NDFIP1 exon 6; Set A
cacccaccagagccagu

SEQ ID NO: 39156 - RNA, 39 nt, Artificial Sequence
  Synthetic Oligonucleotide; NDFIP1 exon 6; Set C
aaaacaaggaacacccaccagagccaguacugaccauca

SEQ ID NO: 39157 - RNA, 37 nt, Artificial Sequence
  Synthetic Oligonucleotide; NDFIP1 exon 6; Set C
aaacaaggaacacccaccagagccaguacugaccauc

SEQ ID NO: 39158 - RNA, 22 nt, Artificial Sequence
  Synthetic Oligonucleotide; NDFIP1 exon 6; Set A
gaacacccaccagagccaguac

SEQ ID NO: 39159 - RNA, 18 nt, Artificial Sequence
  Synthetic Oligonucleotide; NDFIP1 exon 6; Set A
acacccaccagagccagu

SEQ ID NO: 39160 - RNA, 40 nt, Artificial Sequence
  Synthetic Oligonucleotide; NDFIP1 exon 6; Set C
uaaaacaaggaacacccaccagagccaguacugaccauca

SEQ ID NO: 39161 - RNA, 38 nt, Artificial Sequence
  Synthetic Oligonucleotide; NDFIP1 exon 6; Set C
aaaacaaggaacacccaccagagccaguacugaccauc

SEQ ID NO: 39162 - RNA, 16 nt, Artificial Sequence
  Synthetic Oligonucleotide; NDFIP1 exon 6; Set A
cacccaccagagccag

SEQ ID NO: 39163 - RNA, 21 nt, Artificial Sequence
  Synthetic Oligonucleotide; NDFIP1 exon 6; Set A
gaacacccaccagagccagua

SEQ ID NO: 39164 - RNA, 23 nt, Artificial Sequence
  Synthetic Oligonucleotide; NDFIP1 exon 6; Set C
ggaacacccaccagagccaguac

SEQ ID NO: 39165 - RNA, 19 nt, Artificial Sequence
  Synthetic Oligonucleotide; NDFIP1 exon 6; Set A
aacacccaccagagccagu

SEQ ID NO: 39166 - RNA, 39 nt, Artificial Sequence
  Synthetic Oligonucleotide; NDFIP1 exon 6; Set C
uaaaacaaggaacacccaccagagccaguacugaccauc

SEQ ID NO: 39167 - RNA, 17 nt, Artificial Sequence
  Synthetic Oligonucleotide; NDFIP1 exon 6; Set A
acacccaccagagccag

SEQ ID NO: 39168 - RNA, 18 nt, Artificial Sequence
  Synthetic Oligonucleotide; NDFIP1 exon 6; Set A
aacacccaccagagccag

SEQ ID NO: 39169 - RNA, 26 nt, Artificial Sequence
  Synthetic Oligonucleotide; NDFIP1 exon 6; Set C
caaggaacacccaccagagccaguac

SEQ ID NO: 39170 - RNA, 28 nt, Artificial Sequence
  Synthetic Oligonucleotide; NDFIP1 exon 6; Set C
acaaggaacacccaccagagccaguacu

SEQ ID NO: 39171 - RNA, 25 nt, Artificial Sequence
  Synthetic Oligonucleotide; NDFIP1 exon 6; Set C
caaggaacacccaccagagccagua

SEQ ID NO: 39172 - RNA, 29 nt, Artificial Sequence
  Synthetic Oligonucleotide; NDFIP1 exon 6; Set C
aacaaggaacacccaccagagccaguacu

SEQ ID NO: 39173 - RNA, 31 nt, Artificial Sequence
  Synthetic Oligonucleotide; NDFIP1 exon 6; Set C
aaacaaggaacacccaccagagccaguacug

SEQ ID NO: 39174 - RNA, 24 nt, Artificial Sequence
  Synthetic Oligonucleotide; NDFIP1 exon 6; Set C
caaggaacacccaccagagccagu

SEQ ID NO: 39175 - RNA, 30 nt, Artificial Sequence
  Synthetic Oligonucleotide; NDFIP1 exon 6; Set C
aaacaaggaacacccaccagagccaguacu

SEQ ID NO: 39176 - RNA, 32 nt, Artificial Sequence
  Synthetic Oligonucleotide; NDFIP1 exon 6; Set C
aaaacaaggaacacccaccagagccaguacug

SEQ ID NO: 39177 - RNA, 25 nt, Artificial Sequence
  Synthetic Oligonucleotide; NDFIP1 exon 6; Set C
acaaggaacacccaccagagccagu

SEQ ID NO: 39178 - RNA, 23 nt, Artificial Sequence
  Synthetic Oligonucleotide; NDFIP1 exon 6; Set A
caaggaacacccaccagagccag

SEQ ID NO: 39179 - RNA, 31 nt, Artificial Sequence
  Synthetic Oligonucleotide; NDFIP1 exon 6; Set C
aaaacaaggaacacccaccagagccaguacu

SEQ ID NO: 39180 - RNA, 33 nt, Artificial Sequence
  Synthetic Oligonucleotide; NDFIP1 exon 6; Set C
uaaaacaaggaacacccaccagagccaguacug

SEQ ID NO: 39181 - RNA, 26 nt, Artificial Sequence
  Synthetic Oligonucleotide; NDFIP1 exon 6; Set C
aacaaggaacacccaccagagccagu

SEQ ID NO: 39182 - RNA, 24 nt, Artificial Sequence
  Synthetic Oligonucleotide; NDFIP1 exon 6; Set C
acaaggaacacccaccagagccag

SEQ ID NO: 39183 - RNA, 32 nt, Artificial Sequence
  Synthetic Oligonucleotide; NDFIP1 exon 6; Set C
uaaaacaaggaacacccaccagagccaguacu

SEQ ID NO: 39184 - RNA, 25 nt, Artificial Sequence
  Synthetic Oligonucleotide; NDFIP1 exon 6; Set A
aacaaggaacacccaccagagccag

SEQ ID NO: 39185 - RNA, 26 nt, Artificial Sequence
  Synthetic Oligonucleotide; NDFIP1 exon 6; Set A
aaacaaggaacacccaccagagccag

SEQ ID NO: 39186 - RNA, 27 nt, Artificial Sequence
  Synthetic Oligonucleotide; NDFIP1 exon 6; Set A
aaaacaaggaacacccaccagagccag

SEQ ID NO: 39187 - RNA, 18 nt, Artificial Sequence
  Synthetic Oligonucleotide; NDFIP1 exon 6; Set C
acaaggaacacccaccag

SEQ ID NO: 39188 - RNA, 19 nt, Artificial Sequence
  Synthetic Oligonucleotide; NDFIP1 exon 6; Set C
aacaaggaacacccaccag

SEQ ID NO: 39189 - RNA, 34 nt, Artificial Sequence
  Synthetic Oligonucleotide; NDFIP1 exon 6; Set C
uuaccuaaaacaaggaacacccaccagagccagu

SEQ ID NO: 39190 - RNA, 40 nt, Artificial Sequence
  Synthetic Oligonucleotide; NDFIP1 exon 6; Set C
cacuuaccuaaaacaaggaacacccaccagagccaguacu

SEQ ID NO: 39191 - RNA, 20 nt, Artificial Sequence
  Synthetic Oligonucleotide; NDFIP1 exon 6; Set C
aaacaaggaacacccaccag

SEQ ID NO: 39192 - RNA, 35 nt, Artificial Sequence
  Synthetic Oligonucleotide; NDFIP1 exon 6; Set C
cuuaccuaaaacaaggaacacccaccagagccagu

SEQ ID NO: 39193 - RNA, 33 nt, Artificial Sequence
  Synthetic Oligonucleotide; NDFIP1 exon 6; Set C
uuaccuaaaacaaggaacacccaccagagccag

SEQ ID NO: 39194 - RNA, 21 nt, Artificial Sequence
  Synthetic Oligonucleotide; NDFIP1 exon 6; Set C
aaaacaaggaacacccaccag

SEQ ID NO: 39195 - RNA, 36 nt, Artificial Sequence
  Synthetic Oligonucleotide; NDFIP1 exon 6; Set C
acuuaccuaaaacaaggaacacccaccagagccagu

SEQ ID NO: 39196 - RNA, 34 nt, Artificial Sequence
  Synthetic Oligonucleotide; NDFIP1 exon 6; Set C
cuuaccuaaaacaaggaacacccaccagagccag

SEQ ID NO: 39197 - RNA, 22 nt, Artificial Sequence
  Synthetic Oligonucleotide; NDFIP1 exon 6; Set C
uaaaacaaggaacacccaccag

SEQ ID NO: 39198 - RNA, 37 nt, Artificial Sequence
  Synthetic Oligonucleotide; NDFIP1 exon 6; Set C
cacuuaccuaaaacaaggaacacccaccagagccagu

SEQ ID NO: 39199 - RNA, 35 nt, Artificial Sequence
  Synthetic Oligonucleotide; NDFIP1 exon 6; Set C
acuuaccuaaaacaaggaacacccaccagagccag

SEQ ID NO: 39200 - RNA, 38 nt, Artificial Sequence
  Synthetic Oligonucleotide; NDFIP1 exon 6; Set C
acacuuaccuaaaacaaggaacacccaccagagccagu

SEQ ID NO: 39201 - RNA, 36 nt, Artificial Sequence
  Synthetic Oligonucleotide; NDFIP1 exon 6; Set C
cacuuaccuaaaacaaggaacacccaccagagccag

SEQ ID NO: 39202 - RNA, 39 nt, Artificial Sequence
  Synthetic Oligonucleotide; NDFIP1 exon 6; Set C
aacacuuaccuaaaacaaggaacacccaccagagccagu

SEQ ID NO: 39203 - RNA, 37 nt, Artificial Sequence
  Synthetic Oligonucleotide; NDFIP1 exon 6; Set C
acacuuaccuaaaacaaggaacacccaccagagccag

SEQ ID NO: 39204 - RNA, 40 nt, Artificial Sequence
  Synthetic Oligonucleotide; NDFIP1 exon 6; Set C
aaacacuuaccuaaaacaaggaacacccaccagagccagu

SEQ ID NO: 39205 - RNA, 38 nt, Artificial Sequence
  Synthetic Oligonucleotide; NDFIP1 exon 6; Set C
aacacuuaccuaaaacaaggaacacccaccagagccag

SEQ ID NO: 39206 - RNA, 39 nt, Artificial Sequence
  Synthetic Oligonucleotide; NDFIP1 exon 6; Set C
aaacacuuaccuaaaacaaggaacacccaccagagccag

SEQ ID NO: 39207 - RNA, 27 nt, Artificial Sequence
  Synthetic Oligonucleotide; NDFIP1 exon 6; Set A
uuaccuaaaacaaggaacacccaccag

SEQ ID NO: 39208 - RNA, 40 nt, Artificial Sequence
  Synthetic Oligonucleotide; NDFIP1 exon 6; Set C
aaaacacuuaccuaaaacaaggaacacccaccagagccag

SEQ ID NO: 39209 - RNA, 28 nt, Artificial Sequence
  Synthetic Oligonucleotide; NDFIP1 exon 6; Set A
cuuaccuaaaacaaggaacacccaccag

SEQ ID NO: 39210 - RNA, 30 nt, Artificial Sequence
  Synthetic Oligonucleotide; NDFIP1 exon 6; Set A
cacuuaccuaaaacaaggaacacccaccag

SEQ ID NO: 39211 - RNA, 31 nt, Artificial Sequence
  Synthetic Oligonucleotide; NDFIP1 exon 6; Set A
acacuuaccuaaaacaaggaacacccaccag

SEQ ID NO: 39212 - RNA, 32 nt, Artificial Sequence
  Synthetic Oligonucleotide; NDFIP1 exon 6; Set A
aacacuuaccuaaaacaaggaacacccaccag

SEQ ID NO: 39213 - RNA, 33 nt, Artificial Sequence
  Synthetic Oligonucleotide; NDFIP1 exon 6; Set A
aaacacuuaccuaaaacaaggaacacccaccag

SEQ ID NO: 39214 - RNA, 34 nt, Artificial Sequence
  Synthetic Oligonucleotide; NDFIP1 exon 6; Set A
aaaacacuuaccuaaaacaaggaacacccaccag

SEQ ID NO: 39215 - RNA, 17 nt, Artificial Sequence
  Synthetic Oligonucleotide; NDFIP1 exon 6; Set C
uuaccuaaaacaaggaa

SEQ ID NO: 39216 - RNA, 18 nt, Artificial Sequence
  Synthetic Oligonucleotide; NDFIP1 exon 6; Set C
cuuaccuaaaacaaggaa

SEQ ID NO: 39217 - RNA, 16 nt, Artificial Sequence
  Synthetic Oligonucleotide; NDFIP1 exon 6; Set C
uuaccuaaaacaagga

SEQ ID NO: 39218 - RNA, 19 nt, Artificial Sequence
  Synthetic Oligonucleotide; NDFIP1 exon 6; Set C
acuuaccuaaaacaaggaa

SEQ ID NO: 39219 - RNA, 17 nt, Artificial Sequence
  Synthetic Oligonucleotide; NDFIP1 exon 6; Set C
cuuaccuaaaacaagga

SEQ ID NO: 39220 - RNA, 20 nt, Artificial Sequence
  Synthetic Oligonucleotide; NDFIP1 exon 6; Set C
cacuuaccuaaaacaaggaa

SEQ ID NO: 39221 - RNA, 18 nt, Artificial Sequence
  Synthetic Oligonucleotide; NDFIP1 exon 6; Set C
acuuaccuaaaacaagga

SEQ ID NO: 39222 - RNA, 21 nt, Artificial Sequence
  Synthetic Oligonucleotide; NDFIP1 exon 6; Set C
acacuuaccuaaaacaaggaa

SEQ ID NO: 39223 - RNA, 19 nt, Artificial Sequence
  Synthetic Oligonucleotide; NDFIP1 exon 6; Set C
cacuuaccuaaaacaagga

SEQ ID NO: 39224 - RNA, 28 nt, Artificial Sequence
  Synthetic Oligonucleotide; NDFIP1 exon 6; Set C
aaaaacacuuaccuaaaacaaggaacac

SEQ ID NO: 39225 - RNA, 20 nt, Artificial Sequence
  Synthetic Oligonucleotide; NDFIP1 exon 6; Set C
acacuuaccuaaaacaagga

SEQ ID NO: 39226 - RNA, 18 nt, Artificial Sequence
  Synthetic Oligonucleotide; NDFIP1 exon 6; Set C
cacuuaccuaaaacaagg

SEQ ID NO: 39227 - RNA, 27 nt, Artificial Sequence
  Synthetic Oligonucleotide; NDFIP1 exon 6; Set C
aaaaacacuuaccuaaaacaaggaaca

SEQ ID NO: 39228 - RNA, 29 nt, Artificial Sequence
  Synthetic Oligonucleotide; NDFIP1 exon 6; Set C
uaaaaacacuuaccuaaaacaaggaacac

SEQ ID NO: 39229 - RNA, 15 nt, Artificial Sequence
  Synthetic Oligonucleotide; NDFIP1 exon 6; Set C
acuuaccuaaaacaa

SEQ ID NO: 39230 - RNA, 21 nt, Artificial Sequence
  Synthetic Oligonucleotide; NDFIP1 exon 6; Set C
aacacuuaccuaaaacaagga

SEQ ID NO: 39231 - RNA, 17 nt, Artificial Sequence
  Synthetic Oligonucleotide; NDFIP1 exon 6; Set C
cacuuaccuaaaacaag

SEQ ID NO: 39232 - RNA, 19 nt, Artificial Sequence
  Synthetic Oligonucleotide; NDFIP1 exon 6; Set C
acacuuaccuaaaacaagg

SEQ ID NO: 39233 - RNA, 28 nt, Artificial Sequence
  Synthetic Oligonucleotide; NDFIP1 exon 6; Set C
uaaaaacacuuaccuaaaacaaggaaca

SEQ ID NO: 39234 - RNA, 30 nt, Artificial Sequence
  Synthetic Oligonucleotide; NDFIP1 exon 6; Set C
uuaaaaacacuuaccuaaaacaaggaacac

SEQ ID NO: 39235 - RNA, 26 nt, Artificial Sequence
  Synthetic Oligonucleotide; NDFIP1 exon 6; Set C
aaaaacacuuaccuaaaacaaggaac

SEQ ID NO: 39236 - RNA, 16 nt, Artificial Sequence
  Synthetic Oligonucleotide; NDFIP1 exon 6; Set C
cacuuaccuaaaacaa

SEQ ID NO: 39237 - RNA, 22 nt, Artificial Sequence
  Synthetic Oligonucleotide; NDFIP1 exon 6; Set C
aaacacuuaccuaaaacaagga

SEQ ID NO: 39238 - RNA, 18 nt, Artificial Sequence
  Synthetic Oligonucleotide; NDFIP1 exon 6; Set C
acacuuaccuaaaacaag

SEQ ID NO: 39239 - RNA, 20 nt, Artificial Sequence
  Synthetic Oligonucleotide; NDFIP1 exon 6; Set C
aacacuuaccuaaaacaagg

SEQ ID NO: 39240 - RNA, 29 nt, Artificial Sequence
  Synthetic Oligonucleotide; NDFIP1 exon 6; Set C
uuaaaaacacuuaccuaaaacaaggaaca

SEQ ID NO: 39241 - RNA, 31 nt, Artificial Sequence
  Synthetic Oligonucleotide; NDFIP1 exon 6; Set C
auuaaaaacacuuaccuaaaacaaggaacac

SEQ ID NO: 39242 - RNA, 27 nt, Artificial Sequence
  Synthetic Oligonucleotide; NDFIP1 exon 6; Set C
uaaaaacacuuaccuaaaacaaggaac

SEQ ID NO: 39243 - RNA, 23 nt, Artificial Sequence
  Synthetic Oligonucleotide; NDFIP1 exon 6; Set C
aaaacacuuaccuaaaacaagga

SEQ ID NO: 39244 - RNA, 19 nt, Artificial Sequence
  Synthetic Oligonucleotide; NDFIP1 exon 6; Set C
aacacuuaccuaaaacaag

SEQ ID NO: 39245 - RNA, 21 nt, Artificial Sequence
  Synthetic Oligonucleotide; NDFIP1 exon 6; Set C
aaacacuuaccuaaaacaagg

SEQ ID NO: 39246 - RNA, 30 nt, Artificial Sequence
  Synthetic Oligonucleotide; NDFIP1 exon 6; Set C
auuaaaaacacuuaccuaaaacaaggaaca

SEQ ID NO: 39247 - RNA, 32 nt, Artificial Sequence
  Synthetic Oligonucleotide; NDFIP1 exon 6; Set C
cauuaaaaacacuuaccuaaaacaaggaacac

SEQ ID NO: 39248 - RNA, 28 nt, Artificial Sequence
  Synthetic Oligonucleotide; NDFIP1 exon 6; Set C
uuaaaaacacuuaccuaaaacaaggaac

SEQ ID NO: 39249 - RNA, 20 nt, Artificial Sequence
  Synthetic Oligonucleotide; NDFIP1 exon 6; Set C
aaacacuuaccuaaaacaag

SEQ ID NO: 39250 - RNA, 22 nt, Artificial Sequence
  Synthetic Oligonucleotide; NDFIP1 exon 6; Set C
aaaacacuuaccuaaaacaagg

SEQ ID NO: 39251 - RNA, 31 nt, Artificial Sequence
  Synthetic Oligonucleotide; NDFIP1 exon 6; Set C
cauuaaaaacacuuaccuaaaacaaggaaca

SEQ ID NO: 39252 - RNA, 29 nt, Artificial Sequence
  Synthetic Oligonucleotide; NDFIP1 exon 6; Set C
auuaaaaacacuuaccuaaaacaaggaac

SEQ ID NO: 39253 - RNA, 21 nt, Artificial Sequence
  Synthetic Oligonucleotide; NDFIP1 exon 6; Set C
aaaacacuuaccuaaaacaag

SEQ ID NO: 39254 - RNA, 20 nt, Artificial Sequence
  Synthetic Oligonucleotide; NDFIP1 exon 6; Set C
aaaaacacuuaccuaaaaca

SEQ ID NO: 39255 - RNA, 19 nt, Artificial Sequence
  Synthetic Oligonucleotide; NDFIP1 exon 6; Set C
aaaaacacuuaccuaaaac

SEQ ID NO: 39256 - RNA, 21 nt, Artificial Sequence
  Synthetic Oligonucleotide; NDFIP1 exon 6; Set C
uaaaaacacuuaccuaaaaca

SEQ ID NO: 39257 - RNA, 18 nt, Artificial Sequence
  Synthetic Oligonucleotide; NDFIP1 exon 6; Set C
aaaaacacuuaccuaaaa

SEQ ID NO: 39258 - RNA, 20 nt, Artificial Sequence
  Synthetic Oligonucleotide; NDFIP1 exon 6; Set C
uaaaaacacuuaccuaaaac

SEQ ID NO: 39259 - RNA, 22 nt, Artificial Sequence
  Synthetic Oligonucleotide; NDFIP1 exon 6; Set C
uuaaaaacacuuaccuaaaaca

SEQ ID NO: 39260 - RNA, 32 nt, Artificial Sequence
  Synthetic Oligonucleotide; NDFIP1 exon 6; Set C
uuacauuaaaaacacuuaccuaaaacaaggaa

SEQ ID NO: 39261 - RNA, 17 nt, Artificial Sequence
  Synthetic Oligonucleotide; NDFIP1 exon 6; Set C
aaaaacacuuaccuaaa

SEQ ID NO: 39262 - RNA, 19 nt, Artificial Sequence
  Synthetic Oligonucleotide; NDFIP1 exon 6; Set C
uaaaaacacuuaccuaaaa

SEQ ID NO: 39263 - RNA, 21 nt, Artificial Sequence
  Synthetic Oligonucleotide; NDFIP1 exon 6; Set C
uuaaaaacacuuaccuaaaac

SEQ ID NO: 39264 - RNA, 23 nt, Artificial Sequence
  Synthetic Oligonucleotide; NDFIP1 exon 6; Set C
auuaaaaacacuuaccuaaaaca

SEQ ID NO: 39265 - RNA, 33 nt, Artificial Sequence
  Synthetic Oligonucleotide; NDFIP1 exon 6; Set C
cuuacauuaaaaacacuuaccuaaaacaaggaa

SEQ ID NO: 39266 - RNA, 16 nt, Artificial Sequence
  Synthetic Oligonucleotide; NDFIP1 exon 6; Set C
aaaaacacuuaccuaa

SEQ ID NO: 39267 - RNA, 20 nt, Artificial Sequence
  Synthetic Oligonucleotide; NDFIP1 exon 6; Set C
uuaaaaacacuuaccuaaaa

SEQ ID NO: 39268 - RNA, 18 nt, Artificial Sequence
  Synthetic Oligonucleotide; NDFIP1 exon 6; Set C
uaaaaacacuuaccuaaa

SEQ ID NO: 39269 - RNA, 22 nt, Artificial Sequence
  Synthetic Oligonucleotide; NDFIP1 exon 6; Set C
auuaaaaacacuuaccuaaaac

SEQ ID NO: 39270 - RNA, 34 nt, Artificial Sequence
  Synthetic Oligonucleotide; NDFIP1 exon 6; Set C
ucuuacauuaaaaacacuuaccuaaaacaaggaa

SEQ ID NO: 39271 - RNA, 32 nt, Artificial Sequence
  Synthetic Oligonucleotide; NDFIP1 exon 6; Set C
cuuacauuaaaaacacuuaccuaaaacaagga

SEQ ID NO: 39272 - RNA, 17 nt, Artificial Sequence
  Synthetic Oligonucleotide; NDFIP1 exon 6; Set C
uaaaaacacuuaccuaa

SEQ ID NO: 39273 - RNA, 19 nt, Artificial Sequence
  Synthetic Oligonucleotide; NDFIP1 exon 6; Set C
uuaaaaacacuuaccuaaa

SEQ ID NO: 39274 - RNA, 21 nt, Artificial Sequence
  Synthetic Oligonucleotide; NDFIP1 exon 6; Set C
auuaaaaacacuuaccuaaaa

SEQ ID NO: 39275 - RNA, 33 nt, Artificial Sequence
  Synthetic Oligonucleotide; NDFIP1 exon 6; Set C
ucuuacauuaaaaacacuuaccuaaaacaagga

SEQ ID NO: 39276 - RNA, 31 nt, Artificial Sequence
  Synthetic Oligonucleotide; NDFIP1 exon 6; Set C
cuuacauuaaaaacacuuaccuaaaacaagg

SEQ ID NO: 39277 - RNA, 18 nt, Artificial Sequence
  Synthetic Oligonucleotide; NDFIP1 exon 6; Set C
uuaaaaacacuuaccuaa

SEQ ID NO: 39278 - RNA, 20 nt, Artificial Sequence
  Synthetic Oligonucleotide; NDFIP1 exon 6; Set C
auuaaaaacacuuaccuaaa

SEQ ID NO: 39279 - RNA, 28 nt, Artificial Sequence
  Synthetic Oligonucleotide; NDFIP1 exon 6; Set C
uuacauuaaaaacacuuaccuaaaacaa

SEQ ID NO: 39280 - RNA, 34 nt, Artificial Sequence
  Synthetic Oligonucleotide; NDFIP1 exon 6; Set C
uucuuacauuaaaaacacuuaccuaaaacaagga

SEQ ID NO: 39281 - RNA, 30 nt, Artificial Sequence
  Synthetic Oligonucleotide; NDFIP1 exon 6; Set C
cuuacauuaaaaacacuuaccuaaaacaag

SEQ ID NO: 39282 - RNA, 32 nt, Artificial Sequence
  Synthetic Oligonucleotide; NDFIP1 exon 6; Set C
ucuuacauuaaaaacacuuaccuaaaacaagg

SEQ ID NO: 39283 - RNA, 19 nt, Artificial Sequence
  Synthetic Oligonucleotide; NDFIP1 exon 6; Set C
auuaaaaacacuuaccuaa

SEQ ID NO: 39284 - RNA, 35 nt, Artificial Sequence
  Synthetic Oligonucleotide; NDFIP1 exon 6; Set C
uuucuuacauuaaaaacacuuaccuaaaacaagga

SEQ ID NO: 39285 - RNA, 31 nt, Artificial Sequence
  Synthetic Oligonucleotide; NDFIP1 exon 6; Set C
ucuuacauuaaaaacacuuaccuaaaacaag

SEQ ID NO: 39286 - RNA, 33 nt, Artificial Sequence
  Synthetic Oligonucleotide; NDFIP1 exon 6; Set C
uucuuacauuaaaaacacuuaccuaaaacaagg

SEQ ID NO: 39287 - RNA, 36 nt, Artificial Sequence
  Synthetic Oligonucleotide; NDFIP1 exon 6; Set C
uuuucuuacauuaaaaacacuuaccuaaaacaagga

SEQ ID NO: 39288 - RNA, 32 nt, Artificial Sequence
  Synthetic Oligonucleotide; NDFIP1 exon 6; Set C
uucuuacauuaaaaacacuuaccuaaaacaag

SEQ ID NO: 39289 - RNA, 34 nt, Artificial Sequence
  Synthetic Oligonucleotide; NDFIP1 exon 6; Set C
uuucuuacauuaaaaacacuuaccuaaaacaagg

SEQ ID NO: 39290 - RNA, 37 nt, Artificial Sequence
  Synthetic Oligonucleotide; NDFIP1 exon 6; Set C
cuuuucuuacauuaaaaacacuuaccuaaaacaagga

SEQ ID NO: 39291 - RNA, 33 nt, Artificial Sequence
  Synthetic Oligonucleotide; NDFIP1 exon 6; Set C
uuucuuacauuaaaaacacuuaccuaaaacaag

SEQ ID NO: 39292 - RNA, 35 nt, Artificial Sequence
  Synthetic Oligonucleotide; NDFIP1 exon 6; Set C
uuuucuuacauuaaaaacacuuaccuaaaacaagg

SEQ ID NO: 39293 - RNA, 40 nt, Artificial Sequence
  Synthetic Oligonucleotide; NDFIP1 exon 6; Set A
gccuuuucuuacauuaaaaacacuuaccuaaaacaaggaa

SEQ ID NO: 39294 - RNA, 38 nt, Artificial Sequence
  Synthetic Oligonucleotide; NDFIP1 exon 6; Set A
ccuuuucuuacauuaaaaacacuuaccuaaaacaagga

SEQ ID NO: 39295 - RNA, 34 nt, Artificial Sequence
  Synthetic Oligonucleotide; NDFIP1 exon 6; Set C
uuuucuuacauuaaaaacacuuaccuaaaacaag

SEQ ID NO: 39296 - RNA, 36 nt, Artificial Sequence
  Synthetic Oligonucleotide; NDFIP1 exon 6; Set C
cuuuucuuacauuaaaaacacuuaccuaaaacaagg

SEQ ID NO: 39297 - RNA, 39 nt, Artificial Sequence
  Synthetic Oligonucleotide; NDFIP1 exon 6; Set A
gccuuuucuuacauuaaaaacacuuaccuaaaacaagga

SEQ ID NO: 39298 - RNA, 35 nt, Artificial Sequence
  Synthetic Oligonucleotide; NDFIP1 exon 6; Set C
cuuuucuuacauuaaaaacacuuaccuaaaacaag

SEQ ID NO: 39299 - RNA, 37 nt, Artificial Sequence
  Synthetic Oligonucleotide; NDFIP1 exon 6; Set C
ccuuuucuuacauuaaaaacacuuaccuaaaacaagg

SEQ ID NO: 39300 - RNA, 36 nt, Artificial Sequence
  Synthetic Oligonucleotide; NDFIP1 exon 6; Set C
ccuuuucuuacauuaaaaacacuuaccuaaaacaag

SEQ ID NO: 39301 - RNA, 38 nt, Artificial Sequence
  Synthetic Oligonucleotide; NDFIP1 exon 6; Set A
gccuuuucuuacauuaaaaacacuuaccuaaaacaagg

SEQ ID NO: 39302 - RNA, 15 nt, Artificial Sequence
  Synthetic Oligonucleotide; NDFIP1 exon 6; Set C
cauuaaaaacacuua

SEQ ID NO: 39303 - RNA, 37 nt, Artificial Sequence
  Synthetic Oligonucleotide; NDFIP1 exon 6; Set A
gccuuuucuuacauuaaaaacacuuaccuaaaacaag

SEQ ID NO: 39304 - RNA, 16 nt, Artificial Sequence
  Synthetic Oligonucleotide; NDFIP1 exon 6; Set C
acauuaaaaacacuua

SEQ ID NO: 39305 - RNA, 17 nt, Artificial Sequence
  Synthetic Oligonucleotide; NDFIP1 exon 6; Set C
uacauuaaaaacacuua

SEQ ID NO: 39306 - RNA, 15 nt, Artificial Sequence
  Synthetic Oligonucleotide; NDFIP1 exon 6; Set C
acauuaaaaacacuu

SEQ ID NO: 39307 - RNA, 16 nt, Artificial Sequence
  Synthetic Oligonucleotide; NDFIP1 exon 6; Set C
uacauuaaaaacacuu

SEQ ID NO: 39308 - RNA, 15 nt, Artificial Sequence
  Synthetic Oligonucleotide; NDFIP1 exon 6; Set C
uacauuaaaaacacu

SEQ ID NO: 39309 - RNA, 40 nt, Artificial Sequence
  Synthetic Oligonucleotide; NDFIP1 exon 6; Set B
uuuucuugccuuuucuuacauuaaaaacacuuaccuaaaa

SEQ ID NO: 39310 - RNA, 39 nt, Artificial Sequence
  Synthetic Oligonucleotide; NDFIP1 exon 6; Set B
uuuucuugccuuuucuuacauuaaaaacacuuaccuaaa

SEQ ID NO: 39311 - RNA, 38 nt, Artificial Sequence
  Synthetic Oligonucleotide; NDFIP1 exon 6; Set B
uuuucuugccuuuucuuacauuaaaaacacuuaccuaa

SEQ ID NO: 39312 - RNA, 40 nt, Artificial Sequence
  Synthetic Oligonucleotide; NDFIP1 exon 6; Set B
guuuucuugccuuuucuuacauuaaaaacacuuaccuaaa

SEQ ID NO: 39313 - RNA, 39 nt, Artificial Sequence
  Synthetic Oligonucleotide; NDFIP1 exon 6; Set B
guuuucuugccuuuucuuacauuaaaaacacuuaccuaa

SEQ ID NO: 39314 - RNA, 15 nt, Artificial Sequence
  Synthetic Oligonucleotide; NDFIP1 exon 6; Set C
uuuucuuacauuaaa

SEQ ID NO: 39315 - RNA, 16 nt, Artificial Sequence
  Synthetic Oligonucleotide; NDFIP1 exon 6; Set C
cuuuucuuacauuaaa

SEQ ID NO: 39316 - RNA, 33 nt, Artificial Sequence
  Synthetic Oligonucleotide; NDFIP1 exon 6; Set C
uuuucuugccuuuucuuacauuaaaaacacuua

SEQ ID NO: 39317 - RNA, 17 nt, Artificial Sequence
  Synthetic Oligonucleotide; NDFIP1 exon 6; Set C
ccuuuucuuacauuaaa

SEQ ID NO: 39318 - RNA, 15 nt, Artificial Sequence
  Synthetic Oligonucleotide; NDFIP1 exon 6; Set C
cuuuucuuacauuaa

SEQ ID NO: 39319 - RNA, 34 nt, Artificial Sequence
  Synthetic Oligonucleotide; NDFIP1 exon 6; Set B
guuuucuugccuuuucuuacauuaaaaacacuua

SEQ ID NO: 39320 - RNA, 32 nt, Artificial Sequence
  Synthetic Oligonucleotide; NDFIP1 exon 6; Set C
uuuucuugccuuuucuuacauuaaaaacacuu

SEQ ID NO: 39321 - RNA, 18 nt, Artificial Sequence
  Synthetic Oligonucleotide; NDFIP1 exon 6; Set C
gccuuuucuuacauuaaa

SEQ ID NO: 39322 - RNA, 16 nt, Artificial Sequence
  Synthetic Oligonucleotide; NDFIP1 exon 6; Set C
ccuuuucuuacauuaa

SEQ ID NO: 39323 - RNA, 35 nt, Artificial Sequence
  Synthetic Oligonucleotide; NDFIP1 exon 6; Set B
uguuuucuugccuuuucuuacauuaaaaacacuua

SEQ ID NO: 39324 - RNA, 33 nt, Artificial Sequence
  Synthetic Oligonucleotide; NDFIP1 exon 6; Set B
guuuucuugccuuuucuuacauuaaaaacacuu

SEQ ID NO: 39325 - RNA, 31 nt, Artificial Sequence
  Synthetic Oligonucleotide; NDFIP1 exon 6; Set C
uuuucuugccuuuucuuacauuaaaaacacu

SEQ ID NO: 39326 - RNA, 15 nt, Artificial Sequence
  Synthetic Oligonucleotide; NDFIP1 exon 6; Set C
ccuuuucuuacauua

SEQ ID NO: 39327 - RNA, 17 nt, Artificial Sequence
  Synthetic Oligonucleotide; NDFIP1 exon 6; Set C
gccuuuucuuacauuaa

SEQ ID NO: 39328 - RNA, 30 nt, Artificial Sequence
  Synthetic Oligonucleotide; NDFIP1 exon 6; Set C
uuuucuugccuuuucuuacauuaaaaacac

SEQ ID NO: 39329 - RNA, 16 nt, Artificial Sequence
  Synthetic Oligonucleotide; NDFIP1 exon 6; Set C
gccuuuucuuacauua

SEQ ID NO: 39330 - RNA, 37 nt, Artificial Sequence
  Synthetic Oligonucleotide; NDFIP1 exon 6; Set B
aauguuuucuugccuuuucuuacauuaaaaacacuua

SEQ ID NO: 39331 - RNA, 29 nt, Artificial Sequence
  Synthetic Oligonucleotide; NDFIP1 exon 6; Set C
uuuucuugccuuuucuuacauuaaaaaca

SEQ ID NO: 39332 - RNA, 31 nt, Artificial Sequence
  Synthetic Oligonucleotide; NDFIP1 exon 6; Set C
guuuucuugccuuuucuuacauuaaaaacac

SEQ ID NO: 39333 - RNA, 15 nt, Artificial Sequence
  Synthetic Oligonucleotide; NDFIP1 exon 6; Set C
gccuuuucuuacauu

SEQ ID NO: 39334 - RNA, 28 nt, Artificial Sequence
  Synthetic Oligonucleotide; NDFIP1 exon 6; Set C
uuuucuugccuuuucuuacauuaaaaac

SEQ ID NO: 39335 - RNA, 30 nt, Artificial Sequence
  Synthetic Oligonucleotide; NDFIP1 exon 6; Set C
guuuucuugccuuuucuuacauuaaaaaca

SEQ ID NO: 39336 - RNA, 29 nt, Artificial Sequence
  Synthetic Oligonucleotide; NDFIP1 exon 6; Set C
guuuucuugccuuuucuuacauuaaaaac

SEQ ID NO: 39337 - RNA, 27 nt, Artificial Sequence
  Synthetic Oligonucleotide; NDFIP1 exon 6; Set C
uuuucuugccuuuucuuacauuaaaaa

SEQ ID NO: 39338 - RNA, 28 nt, Artificial Sequence
  Synthetic Oligonucleotide; NDFIP1 exon 6; Set C
guuuucuugccuuuucuuacauuaaaaa

SEQ ID NO: 39339 - RNA, 26 nt, Artificial Sequence
  Synthetic Oligonucleotide; NDFIP1 exon 6; Set C
uuuucuugccuuuucuuacauuaaaa

SEQ ID NO: 39340 - RNA, 30 nt, Artificial Sequence
  Synthetic Oligonucleotide; NDFIP1 exon 6; Set C
uuuaauguaauguuuucuugccuuuucuua

SEQ ID NO: 39341 - RNA, 29 nt, Artificial Sequence
  Synthetic Oligonucleotide; NDFIP1 exon 6; Set C
uuuaauguaauguuuucuugccuuuucuu

SEQ ID NO: 39342 - RNA, 31 nt, Artificial Sequence
  Synthetic Oligonucleotide; NDFIP1 exon 6; Set C
auuuaauguaauguuuucuugccuuuucuua

SEQ ID NO: 39343 - RNA, 28 nt, Artificial Sequence
  Synthetic Oligonucleotide; NDFIP1 exon 6; Set C
uuuaauguaauguuuucuugccuuuucu

SEQ ID NO: 39344 - RNA, 30 nt, Artificial Sequence
  Synthetic Oligonucleotide; NDFIP1 exon 6; Set C
auuuaauguaauguuuucuugccuuuucuu

SEQ ID NO: 39345 - RNA, 32 nt, Artificial Sequence
  Synthetic Oligonucleotide; NDFIP1 exon 6; Set C
aauuuaauguaauguuuucuugccuuuucuua

SEQ ID NO: 39346 - RNA, 27 nt, Artificial Sequence
  Synthetic Oligonucleotide; NDFIP1 exon 6; Set C
uuuaauguaauguuuucuugccuuuuc

SEQ ID NO: 39347 - RNA, 29 nt, Artificial Sequence
  Synthetic Oligonucleotide; NDFIP1 exon 6; Set C
auuuaauguaauguuuucuugccuuuucu

SEQ ID NO: 39348 - RNA, 31 nt, Artificial Sequence
  Synthetic Oligonucleotide; NDFIP1 exon 6; Set C
aauuuaauguaauguuuucuugccuuuucuu

SEQ ID NO: 39349 - RNA, 26 nt, Artificial Sequence
  Synthetic Oligonucleotide; NDFIP1 exon 6; Set C
uuuaauguaauguuuucuugccuuuu

SEQ ID NO: 39350 - RNA, 28 nt, Artificial Sequence
  Synthetic Oligonucleotide; NDFIP1 exon 6; Set C
auuuaauguaauguuuucuugccuuuuc

SEQ ID NO: 39351 - RNA, 30 nt, Artificial Sequence
  Synthetic Oligonucleotide; NDFIP1 exon 6; Set C
aauuuaauguaauguuuucuugccuuuucu

SEQ ID NO: 39352 - RNA, 27 nt, Artificial Sequence
  Synthetic Oligonucleotide; NDFIP1 exon 6; Set C
auuuaauguaauguuuucuugccuuuu

SEQ ID NO: 39353 - RNA, 29 nt, Artificial Sequence
  Synthetic Oligonucleotide; NDFIP1 exon 6; Set C
aauuuaauguaauguuuucuugccuuuuc

SEQ ID NO: 39354 - RNA, 25 nt, Artificial Sequence
  Synthetic Oligonucleotide; NDFIP1 exon 6; Set C
uuuaauguaauguuuucuugccuuu

SEQ ID NO: 39355 - RNA, 28 nt, Artificial Sequence
  Synthetic Oligonucleotide; NDFIP1 exon 6; Set C
aauuuaauguaauguuuucuugccuuuu

SEQ ID NO: 39356 - RNA, 26 nt, Artificial Sequence
  Synthetic Oligonucleotide; NDFIP1 exon 6; Set C
auuuaauguaauguuuucuugccuuu

SEQ ID NO: 39357 - RNA, 24 nt, Artificial Sequence
  Synthetic Oligonucleotide; NDFIP1 exon 6; Set C
uuuaauguaauguuuucuugccuu

SEQ ID NO: 39358 - RNA, 27 nt, Artificial Sequence
  Synthetic Oligonucleotide; NDFIP1 exon 6; Set C
aauuuaauguaauguuuucuugccuuu

SEQ ID NO: 39359 - RNA, 25 nt, Artificial Sequence
  Synthetic Oligonucleotide; NDFIP1 exon 6; Set C
auuuaauguaauguuuucuugccuu

SEQ ID NO: 39360 - RNA, 23 nt, Artificial Sequence
  Synthetic Oligonucleotide; NDFIP1 exon 6; Set C
uuuaauguaauguuuucuugccu

SEQ ID NO: 39361 - RNA, 26 nt, Artificial Sequence
  Synthetic Oligonucleotide; NDFIP1 exon 6; Set C
aauuuaauguaauguuuucuugccuu

SEQ ID NO: 39362 - RNA, 24 nt, Artificial Sequence
  Synthetic Oligonucleotide; NDFIP1 exon 6; Set C
auuuaauguaauguuuucuugccu

SEQ ID NO: 39363 - RNA, 22 nt, Artificial Sequence
  Synthetic Oligonucleotide; NDFIP1 exon 6; Set C
uuuaauguaauguuuucuugcc

SEQ ID NO: 39364 - RNA, 25 nt, Artificial Sequence
  Synthetic Oligonucleotide; NDFIP1 exon 6; Set C
aauuuaauguaauguuuucuugccu

SEQ ID NO: 39365 - RNA, 23 nt, Artificial Sequence
  Synthetic Oligonucleotide; NDFIP1 exon 6; Set C
auuuaauguaauguuuucuugcc

SEQ ID NO: 39366 - RNA, 24 nt, Artificial Sequence
  Synthetic Oligonucleotide; NDFIP1 exon 6; Set C
aauuuaauguaauguuuucuugcc

SEQ ID NO: 39367 - RNA, 28 nt, Artificial Sequence
  Synthetic Oligonucleotide; NDFIP1 exon 6; Set C
aauaaggcaaaacacuuuauagcagcuu

SEQ ID NO: 39368 - RNA, 29 nt, Artificial Sequence
  Synthetic Oligonucleotide; NDFIP1 exon 6; Set C
aaauaaggcaaaacacuuuauagcagcuu

SEQ ID NO: 39369 - RNA, 27 nt, Artificial Sequence
  Synthetic Oligonucleotide; NDFIP1 exon 6; Set C
aauaaggcaaaacacuuuauagcagcu

SEQ ID NO: 39370 - RNA, 26 nt, Artificial Sequence
  Synthetic Oligonucleotide; NDFIP1 exon 6; Set C
aauaaggcaaaacacuuuauagcagc

SEQ ID NO: 39371 - RNA, 28 nt, Artificial Sequence
  Synthetic Oligonucleotide; NDFIP1 exon 6; Set C
aaauaaggcaaaacacuuuauagcagcu

SEQ ID NO: 39372 - RNA, 27 nt, Artificial Sequence
  Synthetic Oligonucleotide; NDFIP1 exon 6; Set C
aaauaaggcaaaacacuuuauagcagc

SEQ ID NO: 39373 - RNA, 29 nt, Artificial Sequence
  Synthetic Oligonucleotide; NDFIP1 exon 6; Set C
aaaauaaggcaaaacacuuuauagcagcu

SEQ ID NO: 39374 - RNA, 28 nt, Artificial Sequence
  Synthetic Oligonucleotide; NDFIP1 exon 6; Set C
aaaauaaggcaaaacacuuuauagcagc

SEQ ID NO: 39375 - RNA, 22 nt, Artificial Sequence
  Synthetic Oligonucleotide; NDFIP1 exon 6; Set C
aauaaggcaaaacacuuuauag

SEQ ID NO: 39376 - RNA, 15 nt, Artificial Sequence
  Synthetic Oligonucleotide; NDFIP1 exon 6; Set C
aaauaaggcaaaaca

SEQ ID NO: 39377 - RNA, 16 nt, Artificial Sequence
  Synthetic Oligonucleotide; NDFIP1 exon 6; Set C
aaaauaaggcaaaaca

SEQ ID NO: 39378 - RNA, 15 nt, Artificial Sequence
  Synthetic Oligonucleotide; NDFIP1 exon 6; Set C
aaaauaaggcaaaac

SEQ ID NO: 39379 - RNA, 40 nt, Artificial Sequence
  Synthetic Oligonucleotide; NDFIP1 exon 6; Set A
ccagggaaauagguggaaaacuaaaaaauaaggcaaaaca

SEQ ID NO: 39380 - RNA, 39 nt, Artificial Sequence
  Synthetic Oligonucleotide; NDFIP1 exon 6; Set C
ccagggaaauagguggaaaacuaaaaaauaaggcaaaac

SEQ ID NO: 39381 - RNA, 29 nt, Artificial Sequence
  Synthetic Oligonucleotide; NDFIP1 exon 6; Set C
ccagggaaauagguggaaaacuaaaaaau

SEQ ID NO: 39382 - RNA, 28 nt, Artificial Sequence
  Synthetic Oligonucleotide; NDFIP1 exon 6; Set C
ccagggaaauagguggaaaacuaaaaaa

SEQ ID NO: 39383 - RNA, 27 nt, Artificial Sequence
  Synthetic Oligonucleotide; NDFIP1 exon 6; Set C
ccagggaaauagguggaaaacuaaaaa

SEQ ID NO: 39384 - RNA, 40 nt, Artificial Sequence
  Synthetic Oligonucleotide; NDFIP1 exon 6; Set A
cugaccaucaaaauauccagggaaauagguggaaaacuaa

SEQ ID NO: 39385 - RNA, 39 nt, Artificial Sequence
  Synthetic Oligonucleotide; NDFIP1 exon 6; Set A
cugaccaucaaaauauccagggaaauagguggaaaacua

SEQ ID NO: 39386 - RNA, 38 nt, Artificial Sequence
  Synthetic Oligonucleotide; NDFIP1 exon 6; Set A
cugaccaucaaaauauccagggaaauagguggaaaacu

SEQ ID NO: 39387 - RNA, 40 nt, Artificial Sequence
  Synthetic Oligonucleotide; NDFIP1 exon 6; Set A
acugaccaucaaaauauccagggaaauagguggaaaacua

SEQ ID NO: 39388 - RNA, 39 nt, Artificial Sequence
  Synthetic Oligonucleotide; NDFIP1 exon 6; Set A
acugaccaucaaaauauccagggaaauagguggaaaacu

SEQ ID NO: 39389 - RNA, 37 nt, Artificial Sequence
  Synthetic Oligonucleotide; NDFIP1 exon 6; Set A
cugaccaucaaaauauccagggaaauagguggaaaac

SEQ ID NO: 39390 - RNA, 36 nt, Artificial Sequence
  Synthetic Oligonucleotide; NDFIP1 exon 6; Set A
cugaccaucaaaauauccagggaaauagguggaaaa

SEQ ID NO: 39391 - RNA, 38 nt, Artificial Sequence
  Synthetic Oligonucleotide; NDFIP1 exon 6; Set A
acugaccaucaaaauauccagggaaauagguggaaaac

SEQ ID NO: 39392 - RNA, 37 nt, Artificial Sequence
  Synthetic Oligonucleotide; NDFIP1 exon 6; Set A
acugaccaucaaaauauccagggaaauagguggaaaa

SEQ ID NO: 39393 - RNA, 28 nt, Artificial Sequence
  Synthetic Oligonucleotide; NDFIP1 exon 6; Set C
cugaccaucaaaauauccagggaaauag

SEQ ID NO: 39394 - RNA, 23 nt, Artificial Sequence
  Synthetic Oligonucleotide; NDFIP1 exon 6; Set C
cugaccaucaaaauauccaggga

SEQ ID NO: 39395 - RNA, 22 nt, Artificial Sequence
  Synthetic Oligonucleotide; NDFIP1 exon 6; Set C
cugaccaucaaaauauccaggg

SEQ ID NO: 39396 - RNA, 21 nt, Artificial Sequence
  Synthetic Oligonucleotide; NDFIP1 exon 6; Set C
cugaccaucaaaauauccagg

SEQ ID NO: 39397 - RNA, 20 nt, Artificial Sequence
  Synthetic Oligonucleotide; NDFIP1 exon 6; Set C
cugaccaucaaaauauccag

SEQ ID NO: 39398 - RNA, 22 nt, Artificial Sequence
  Synthetic Oligonucleotide; NDFIP1 exon 6; Set C
acugaccaucaaaauauccagg

SEQ ID NO: 39399 - RNA, 21 nt, Artificial Sequence
  Synthetic Oligonucleotide; NDFIP1 exon 6; Set C
acugaccaucaaaauauccag

SEQ ID NO: 39400 - RNA, 39 nt, Artificial Sequence
  Synthetic Oligonucleotide; NDFIP1 exon 6; Set C
cagagccaguacugaccaucaaaauauccagggaaauag

SEQ ID NO: 39401 - RNA, 15 nt, Artificial Sequence
  Synthetic Oligonucleotide; NDFIP1 exon 6; Set C
cugaccaucaaaaua

SEQ ID NO: 39402 - RNA, 39 nt, Artificial Sequence
  Synthetic Oligonucleotide; NDFIP1 exon 6; Set C
ccagagccaguacugaccaucaaaauauccagggaaaua

SEQ ID NO: 39403 - RNA, 23 nt, Artificial Sequence
  Synthetic Oligonucleotide; NDFIP1 exon 6; Set C
aguacugaccaucaaaauaucca

SEQ ID NO: 39404 - RNA, 40 nt, Artificial Sequence
  Synthetic Oligonucleotide; NDFIP1 exon 6; Set C
accagagccaguacugaccaucaaaauauccagggaaaua

SEQ ID NO: 39405 - RNA, 38 nt, Artificial Sequence
  Synthetic Oligonucleotide; NDFIP1 exon 6; Set C
ccagagccaguacugaccaucaaaauauccagggaaau

SEQ ID NO: 39406 - RNA, 24 nt, Artificial Sequence
  Synthetic Oligonucleotide; NDFIP1 exon 6; Set C
caguacugaccaucaaaauaucca

SEQ ID NO: 39407 - RNA, 37 nt, Artificial Sequence
  Synthetic Oligonucleotide; NDFIP1 exon 6; Set C
ccagagccaguacugaccaucaaaauauccagggaaa

SEQ ID NO: 39408 - RNA, 35 nt, Artificial Sequence
  Synthetic Oligonucleotide; NDFIP1 exon 6; Set C
cagagccaguacugaccaucaaaauauccagggaa

SEQ ID NO: 39409 - RNA, 39 nt, Artificial Sequence
  Synthetic Oligonucleotide; NDFIP1 exon 6; Set C
accagagccaguacugaccaucaaaauauccagggaaau

SEQ ID NO: 39410 - RNA, 38 nt, Artificial Sequence
  Synthetic Oligonucleotide; NDFIP1 exon 6; Set C
accagagccaguacugaccaucaaaauauccagggaaa

SEQ ID NO: 39411 - RNA, 36 nt, Artificial Sequence
  Synthetic Oligonucleotide; NDFIP1 exon 6; Set C
ccagagccaguacugaccaucaaaauauccagggaa

SEQ ID NO: 39412 - RNA, 34 nt, Artificial Sequence
  Synthetic Oligonucleotide; NDFIP1 exon 6; Set C
cagagccaguacugaccaucaaaauauccaggga

SEQ ID NO: 39413 - RNA, 37 nt, Artificial Sequence
  Synthetic Oligonucleotide; NDFIP1 exon 6; Set C
accagagccaguacugaccaucaaaauauccagggaa

SEQ ID NO: 39414 - RNA, 33 nt, Artificial Sequence
  Synthetic Oligonucleotide; NDFIP1 exon 6; Set C
cagagccaguacugaccaucaaaauauccaggg

SEQ ID NO: 39415 - RNA, 32 nt, Artificial Sequence
  Synthetic Oligonucleotide; NDFIP1 exon 6; Set A
cagagccaguacugaccaucaaaauauccagg

SEQ ID NO: 39416 - RNA, 31 nt, Artificial Sequence
  Synthetic Oligonucleotide; NDFIP1 exon 6; Set A
cagagccaguacugaccaucaaaauauccag

SEQ ID NO: 39417 - RNA, 26 nt, Artificial Sequence
  Synthetic Oligonucleotide; NDFIP1 exon 6; Set A
cagagccaguacugaccaucaaaaua

SEQ ID NO: 39418 - RNA, 25 nt, Artificial Sequence
  Synthetic Oligonucleotide; NDFIP1 exon 6; Set A
cagagccaguacugaccaucaaaau

SEQ ID NO: 39419 - RNA, 24 nt, Artificial Sequence
  Synthetic Oligonucleotide; NDFIP1 exon 6; Set A
cagagccaguacugaccaucaaaa

SEQ ID NO: 39420 - RNA, 23 nt, Artificial Sequence
  Synthetic Oligonucleotide; NDFIP1 exon 6; Set A
cagagccaguacugaccaucaaa

SEQ ID NO: 39421 - RNA, 37 nt, Artificial Sequence
  Synthetic Oligonucleotide; NDFIP1 exon 6; Set C
cacccaccagagccaguacugaccaucaaaauaucca

SEQ ID NO: 39422 - RNA, 22 nt, Artificial Sequence
  Synthetic Oligonucleotide; NDFIP1 exon 6; Set A
cagagccaguacugaccaucaa

SEQ ID NO: 39423 - RNA, 38 nt, Artificial Sequence
  Synthetic Oligonucleotide; NDFIP1 exon 6; Set C
acacccaccagagccaguacugaccaucaaaauaucca

SEQ ID NO: 39424 - RNA, 39 nt, Artificial Sequence
  Synthetic Oligonucleotide; NDFIP1 exon 6; Set C
aacacccaccagagccaguacugaccaucaaaauaucca

SEQ ID NO: 39425 - RNA, 40 nt, Artificial Sequence
  Synthetic Oligonucleotide; NDFIP1 exon 6; Set C
gaacacccaccagagccaguacugaccaucaaaauaucca

SEQ ID NO: 39426 - RNA, 38 nt, Artificial Sequence
  Synthetic Oligonucleotide; NDFIP1 exon 6; Set C
aggaacacccaccagagccaguacugaccaucaaaaua

SEQ ID NO: 39427 - RNA, 36 nt, Artificial Sequence
  Synthetic Oligonucleotide; NDFIP1 exon 6; Set C
ggaacacccaccagagccaguacugaccaucaaaau

SEQ ID NO: 39428 - RNA, 39 nt, Artificial Sequence
  Synthetic Oligonucleotide; NDFIP1 exon 6; Set C
aaggaacacccaccagagccaguacugaccaucaaaaua

SEQ ID NO: 39429 - RNA, 37 nt, Artificial Sequence
  Synthetic Oligonucleotide; NDFIP1 exon 6; Set C
aggaacacccaccagagccaguacugaccaucaaaau

SEQ ID NO: 39430 - RNA, 35 nt, Artificial Sequence
  Synthetic Oligonucleotide; NDFIP1 exon 6; Set C
ggaacacccaccagagccaguacugaccaucaaaa

SEQ ID NO: 39431 - RNA, 38 nt, Artificial Sequence
  Synthetic Oligonucleotide; NDFIP1 exon 6; Set C
aaggaacacccaccagagccaguacugaccaucaaaau

SEQ ID NO: 39432 - RNA, 36 nt, Artificial Sequence
  Synthetic Oligonucleotide; NDFIP1 exon 6; Set C
aggaacacccaccagagccaguacugaccaucaaaa

SEQ ID NO: 39433 - RNA, 34 nt, Artificial Sequence
  Synthetic Oligonucleotide; NDFIP1 exon 6; Set C
ggaacacccaccagagccaguacugaccaucaaa

SEQ ID NO: 39434 - RNA, 37 nt, Artificial Sequence
  Synthetic Oligonucleotide; NDFIP1 exon 6; Set C
aaggaacacccaccagagccaguacugaccaucaaaa

SEQ ID NO: 39435 - RNA, 35 nt, Artificial Sequence
  Synthetic Oligonucleotide; NDFIP1 exon 6; Set C
aggaacacccaccagagccaguacugaccaucaaa

SEQ ID NO: 39436 - RNA, 33 nt, Artificial Sequence
  Synthetic Oligonucleotide; NDFIP1 exon 6; Set C
ggaacacccaccagagccaguacugaccaucaa

SEQ ID NO: 39437 - RNA, 31 nt, Artificial Sequence
  Synthetic Oligonucleotide; NDFIP1 exon 6; Set C
gaacacccaccagagccaguacugaccauca

SEQ ID NO: 39438 - RNA, 36 nt, Artificial Sequence
  Synthetic Oligonucleotide; NDFIP1 exon 6; Set C
aaggaacacccaccagagccaguacugaccaucaaa

SEQ ID NO: 39439 - RNA, 34 nt, Artificial Sequence
  Synthetic Oligonucleotide; NDFIP1 exon 6; Set C
aggaacacccaccagagccaguacugaccaucaa

SEQ ID NO: 39440 - RNA, 32 nt, Artificial Sequence
  Synthetic Oligonucleotide; NDFIP1 exon 6; Set C
ggaacacccaccagagccaguacugaccauca

SEQ ID NO: 39441 - RNA, 30 nt, Artificial Sequence
  Synthetic Oligonucleotide; NDFIP1 exon 6; Set C
gaacacccaccagagccaguacugaccauc

SEQ ID NO: 39442 - RNA, 35 nt, Artificial Sequence
  Synthetic Oligonucleotide; NDFIP1 exon 6; Set C
aaggaacacccaccagagccaguacugaccaucaa

SEQ ID NO: 39443 - RNA, 33 nt, Artificial Sequence
  Synthetic Oligonucleotide; NDFIP1 exon 6; Set C
aggaacacccaccagagccaguacugaccauca

SEQ ID NO: 39444 - RNA, 31 nt, Artificial Sequence
  Synthetic Oligonucleotide; NDFIP1 exon 6; Set C
ggaacacccaccagagccaguacugaccauc

SEQ ID NO: 39445 - RNA, 34 nt, Artificial Sequence
  Synthetic Oligonucleotide; NDFIP1 exon 6; Set C
aaggaacacccaccagagccaguacugaccauca

SEQ ID NO: 39446 - RNA, 33 nt, Artificial Sequence
  Synthetic Oligonucleotide; NDFIP1 exon 6; Set C
aaggaacacccaccagagccaguacugaccauc

SEQ ID NO: 39447 - RNA, 21 nt, Artificial Sequence
  Synthetic Oligonucleotide; NDFIP1 exon 6; Set A
cacccaccagagccaguacug

SEQ ID NO: 39448 - RNA, 34 nt, Artificial Sequence
  Synthetic Oligonucleotide; NDFIP1 exon 6; Set C
caaggaacacccaccagagccaguacugaccauc

SEQ ID NO: 39449 - RNA, 20 nt, Artificial Sequence
  Synthetic Oligonucleotide; NDFIP1 exon 6; Set A
cacccaccagagccaguacu

SEQ ID NO: 39450 - RNA, 22 nt, Artificial Sequence
  Synthetic Oligonucleotide; NDFIP1 exon 6; Set C
acacccaccagagccaguacug

SEQ ID NO: 39451 - RNA, 21 nt, Artificial Sequence
  Synthetic Oligonucleotide; NDFIP1 exon 6; Set C
acacccaccagagccaguacu

SEQ ID NO: 39452 - RNA, 23 nt, Artificial Sequence
  Synthetic Oligonucleotide; NDFIP1 exon 6; Set A
aacacccaccagagccaguacug

SEQ ID NO: 39453 - RNA, 22 nt, Artificial Sequence
  Synthetic Oligonucleotide; NDFIP1 exon 6; Set A
aacacccaccagagccaguacu

SEQ ID NO: 39454 - RNA, 23 nt, Artificial Sequence
  Synthetic Oligonucleotide; NDFIP1 exon 6; Set C
gaacacccaccagagccaguacu

SEQ ID NO: 39455 - RNA, 22 nt, Artificial Sequence
  Synthetic Oligonucleotide; NDFIP1 exon 6; Set C
ggaacacccaccagagccagua

SEQ ID NO: 39456 - RNA, 24 nt, Artificial Sequence
  Synthetic Oligonucleotide; NDFIP1 exon 6; Set C
aggaacacccaccagagccaguac

SEQ ID NO: 39457 - RNA, 20 nt, Artificial Sequence
  Synthetic Oligonucleotide; NDFIP1 exon 6; Set A
gaacacccaccagagccagu

SEQ ID NO: 39458 - RNA, 28 nt, Artificial Sequence
  Synthetic Oligonucleotide; NDFIP1 exon 6; Set C
caaggaacacccaccagagccaguacug

SEQ ID NO: 39459 - RNA, 25 nt, Artificial Sequence
  Synthetic Oligonucleotide; NDFIP1 exon 6; Set C
aaggaacacccaccagagccaguac

SEQ ID NO: 39460 - RNA, 23 nt, Artificial Sequence
  Synthetic Oligonucleotide; NDFIP1 exon 6; Set C
aggaacacccaccagagccagua

SEQ ID NO: 39461 - RNA, 21 nt, Artificial Sequence
  Synthetic Oligonucleotide; NDFIP1 exon 6; Set C
ggaacacccaccagagccagu

SEQ ID NO: 39462 - RNA, 19 nt, Artificial Sequence
  Synthetic Oligonucleotide; NDFIP1 exon 6; Set A
gaacacccaccagagccag

SEQ ID NO: 39463 - RNA, 27 nt, Artificial Sequence
  Synthetic Oligonucleotide; NDFIP1 exon 6; Set C
caaggaacacccaccagagccaguacu

SEQ ID NO: 39464 - RNA, 29 nt, Artificial Sequence
  Synthetic Oligonucleotide; NDFIP1 exon 6; Set C
acaaggaacacccaccagagccaguacug

SEQ ID NO: 39465 - RNA, 24 nt, Artificial Sequence
  Synthetic Oligonucleotide; NDFIP1 exon 6; Set A
aaggaacacccaccagagccagua

SEQ ID NO: 39466 - RNA, 22 nt, Artificial Sequence
  Synthetic Oligonucleotide; NDFIP1 exon 6; Set C
aggaacacccaccagagccagu

SEQ ID NO: 39467 - RNA, 20 nt, Artificial Sequence
  Synthetic Oligonucleotide; NDFIP1 exon 6; Set A
ggaacacccaccagagccag

SEQ ID NO: 39468 - RNA, 30 nt, Artificial Sequence
  Synthetic Oligonucleotide; NDFIP1 exon 6; Set C
aacaaggaacacccaccagagccaguacug

SEQ ID NO: 39469 - RNA, 23 nt, Artificial Sequence
  Synthetic Oligonucleotide; NDFIP1 exon 6; Set A
aaggaacacccaccagagccagu

SEQ ID NO: 39470 - RNA, 21 nt, Artificial Sequence
  Synthetic Oligonucleotide; NDFIP1 exon 6; Set A
aggaacacccaccagagccag

SEQ ID NO: 39471 - RNA, 22 nt, Artificial Sequence
  Synthetic Oligonucleotide; NDFIP1 exon 6; Set A
aaggaacacccaccagagccag

SEQ ID NO: 39472 - RNA, 38 nt, Artificial Sequence
  Synthetic Oligonucleotide; NDFIP1 exon 6; Set C
uuaccuaaaacaaggaacacccaccagagccaguacug

SEQ ID NO: 39473 - RNA, 37 nt, Artificial Sequence
  Synthetic Oligonucleotide; NDFIP1 exon 6; Set C
uuaccuaaaacaaggaacacccaccagagccaguacu

SEQ ID NO: 39474 - RNA, 17 nt, Artificial Sequence
  Synthetic Oligonucleotide; NDFIP1 exon 6; Set C
caaggaacacccaccag

SEQ ID NO: 39475 - RNA, 39 nt, Artificial Sequence
  Synthetic Oligonucleotide; NDFIP1 exon 6; Set C
cuuaccuaaaacaaggaacacccaccagagccaguacug

SEQ ID NO: 39476 - RNA, 19 nt, Artificial Sequence
  Synthetic Oligonucleotide; NDFIP1 exon 6; Set C
acaaggaacacccaccaga

SEQ ID NO: 39477 - RNA, 38 nt, Artificial Sequence
  Synthetic Oligonucleotide; NDFIP1 exon 6; Set C
cuuaccuaaaacaaggaacacccaccagagccaguacu

SEQ ID NO: 39478 - RNA, 40 nt, Artificial Sequence
  Synthetic Oligonucleotide; NDFIP1 exon 6; Set C
acuuaccuaaaacaaggaacacccaccagagccaguacug

SEQ ID NO: 39479 - RNA, 20 nt, Artificial Sequence
  Synthetic Oligonucleotide; NDFIP1 exon 6; Set C
aacaaggaacacccaccaga

SEQ ID NO: 39480 - RNA, 39 nt, Artificial Sequence
  Synthetic Oligonucleotide; NDFIP1 exon 6; Set C
acuuaccuaaaacaaggaacacccaccagagccaguacu

SEQ ID NO: 39481 - RNA, 17 nt, Artificial Sequence
  Synthetic Oligonucleotide; NDFIP1 exon 6; Set C
acaaggaacacccacca

SEQ ID NO: 39482 - RNA, 21 nt, Artificial Sequence
  Synthetic Oligonucleotide; NDFIP1 exon 6; Set C
aaacaaggaacacccaccaga

SEQ ID NO: 39483 - RNA, 18 nt, Artificial Sequence
  Synthetic Oligonucleotide; NDFIP1 exon 6; Set C
aacaaggaacacccacca

SEQ ID NO: 39484 - RNA, 16 nt, Artificial Sequence
  Synthetic Oligonucleotide; NDFIP1 exon 6; Set C
acaaggaacacccacc

SEQ ID NO: 39485 - RNA, 22 nt, Artificial Sequence
  Synthetic Oligonucleotide; NDFIP1 exon 6; Set C
aaaacaaggaacacccaccaga

SEQ ID NO: 39486 - RNA, 19 nt, Artificial Sequence
  Synthetic Oligonucleotide; NDFIP1 exon 6; Set C
aaacaaggaacacccacca

SEQ ID NO: 39487 - RNA, 17 nt, Artificial Sequence
  Synthetic Oligonucleotide; NDFIP1 exon 6; Set C
aacaaggaacacccacc

SEQ ID NO: 39488 - RNA, 23 nt, Artificial Sequence
  Synthetic Oligonucleotide; NDFIP1 exon 6; Set C
uaaaacaaggaacacccaccaga

SEQ ID NO: 39489 - RNA, 20 nt, Artificial Sequence
  Synthetic Oligonucleotide; NDFIP1 exon 6; Set C
aaaacaaggaacacccacca

SEQ ID NO: 39490 - RNA, 18 nt, Artificial Sequence
  Synthetic Oligonucleotide; NDFIP1 exon 6; Set C
aaacaaggaacacccacc

SEQ ID NO: 39491 - RNA, 21 nt, Artificial Sequence
  Synthetic Oligonucleotide; NDFIP1 exon 6; Set C
uaaaacaaggaacacccacca

SEQ ID NO: 39492 - RNA, 19 nt, Artificial Sequence
  Synthetic Oligonucleotide; NDFIP1 exon 6; Set C
aaaacaaggaacacccacc

SEQ ID NO: 39493 - RNA, 20 nt, Artificial Sequence
  Synthetic Oligonucleotide; NDFIP1 exon 6; Set C
uaaaacaaggaacacccacc

SEQ ID NO: 39494 - RNA, 26 nt, Artificial Sequence
  Synthetic Oligonucleotide; NDFIP1 exon 6; Set A
uuaccuaaaacaaggaacacccacca

SEQ ID NO: 39495 - RNA, 29 nt, Artificial Sequence
  Synthetic Oligonucleotide; NDFIP1 exon 6; Set A
acuuaccuaaaacaaggaacacccaccag

SEQ ID NO: 39496 - RNA, 25 nt, Artificial Sequence
  Synthetic Oligonucleotide; NDFIP1 exon 6; Set A
uuaccuaaaacaaggaacacccacc

SEQ ID NO: 39497 - RNA, 27 nt, Artificial Sequence
  Synthetic Oligonucleotide; NDFIP1 exon 6; Set A
cuuaccuaaaacaaggaacacccacca

SEQ ID NO: 39498 - RNA, 26 nt, Artificial Sequence
  Synthetic Oligonucleotide; NDFIP1 exon 6; Set A
cuuaccuaaaacaaggaacacccacc

SEQ ID NO: 39499 - RNA, 28 nt, Artificial Sequence
  Synthetic Oligonucleotide; NDFIP1 exon 6; Set A
acuuaccuaaaacaaggaacacccacca

SEQ ID NO: 39500 - RNA, 32 nt, Artificial Sequence
  Synthetic Oligonucleotide; NDFIP1 exon 6; Set C
acacuuaccuaaaacaaggaacacccaccaga

SEQ ID NO: 39501 - RNA, 29 nt, Artificial Sequence
  Synthetic Oligonucleotide; NDFIP1 exon 6; Set A
cacuuaccuaaaacaaggaacacccacca

SEQ ID NO: 39502 - RNA, 27 nt, Artificial Sequence
  Synthetic Oligonucleotide; NDFIP1 exon 6; Set A
acuuaccuaaaacaaggaacacccacc

SEQ ID NO: 39503 - RNA, 33 nt, Artificial Sequence
  Synthetic Oligonucleotide; NDFIP1 exon 6; Set C
aacacuuaccuaaaacaaggaacacccaccaga

SEQ ID NO: 39504 - RNA, 30 nt, Artificial Sequence
  Synthetic Oligonucleotide; NDFIP1 exon 6; Set C
acacuuaccuaaaacaaggaacacccacca

SEQ ID NO: 39505 - RNA, 28 nt, Artificial Sequence
  Synthetic Oligonucleotide; NDFIP1 exon 6; Set A
cacuuaccuaaaacaaggaacacccacc

SEQ ID NO: 39506 - RNA, 34 nt, Artificial Sequence
  Synthetic Oligonucleotide; NDFIP1 exon 6; Set A
aaacacuuaccuaaaacaaggaacacccaccaga

SEQ ID NO: 39507 - RNA, 31 nt, Artificial Sequence
  Synthetic Oligonucleotide; NDFIP1 exon 6; Set A
aacacuuaccuaaaacaaggaacacccacca

SEQ ID NO: 39508 - RNA, 29 nt, Artificial Sequence
  Synthetic Oligonucleotide; NDFIP1 exon 6; Set A
acacuuaccuaaaacaaggaacacccacc

SEQ ID NO: 39509 - RNA, 35 nt, Artificial Sequence
  Synthetic Oligonucleotide; NDFIP1 exon 6; Set A
aaaacacuuaccuaaaacaaggaacacccaccaga

SEQ ID NO: 39510 - RNA, 30 nt, Artificial Sequence
  Synthetic Oligonucleotide; NDFIP1 exon 6; Set A
aacacuuaccuaaaacaaggaacacccacc

SEQ ID NO: 39511 - RNA, 32 nt, Artificial Sequence
  Synthetic Oligonucleotide; NDFIP1 exon 6; Set A
aaacacuuaccuaaaacaaggaacacccacca

SEQ ID NO: 39512 - RNA, 35 nt, Artificial Sequence
  Synthetic Oligonucleotide; NDFIP1 exon 6; Set A
aaaaacacuuaccuaaaacaaggaacacccaccag

SEQ ID NO: 39513 - RNA, 31 nt, Artificial Sequence
  Synthetic Oligonucleotide; NDFIP1 exon 6; Set A
aaacacuuaccuaaaacaaggaacacccacc

SEQ ID NO: 39514 - RNA, 33 nt, Artificial Sequence
  Synthetic Oligonucleotide; NDFIP1 exon 6; Set A
aaaacacuuaccuaaaacaaggaacacccacca

SEQ ID NO: 39515 - RNA, 32 nt, Artificial Sequence
  Synthetic Oligonucleotide; NDFIP1 exon 6; Set A
aaaacacuuaccuaaaacaaggaacacccacc

SEQ ID NO: 39516 - RNA, 15 nt, Artificial Sequence
  Synthetic Oligonucleotide; NDFIP1 exon 6; Set C
uuaccuaaaacaagg

SEQ ID NO: 39517 - RNA, 16 nt, Artificial Sequence
  Synthetic Oligonucleotide; NDFIP1 exon 6; Set C
cuuaccuaaaacaagg

SEQ ID NO: 39518 - RNA, 15 nt, Artificial Sequence
  Synthetic Oligonucleotide; NDFIP1 exon 6; Set C
cuuaccuaaaacaag

SEQ ID NO: 39519 - RNA, 17 nt, Artificial Sequence
  Synthetic Oligonucleotide; NDFIP1 exon 6; Set C
acuuaccuaaaacaagg

SEQ ID NO: 39520 - RNA, 16 nt, Artificial Sequence
  Synthetic Oligonucleotide; NDFIP1 exon 6; Set C
acuuaccuaaaacaag

SEQ ID NO: 39521 - RNA, 25 nt, Artificial Sequence
  Synthetic Oligonucleotide; NDFIP1 exon 6; Set C
aaaaacacuuaccuaaaacaaggaa

SEQ ID NO: 39522 - RNA, 26 nt, Artificial Sequence
  Synthetic Oligonucleotide; NDFIP1 exon 6; Set C
uaaaaacacuuaccuaaaacaaggaa

SEQ ID NO: 39523 - RNA, 24 nt, Artificial Sequence
  Synthetic Oligonucleotide; NDFIP1 exon 6; Set C
aaaaacacuuaccuaaaacaagga

SEQ ID NO: 39524 - RNA, 33 nt, Artificial Sequence
  Synthetic Oligonucleotide; NDFIP1 exon 6; Set C
acauuaaaaacacuuaccuaaaacaaggaacac

SEQ ID NO: 39525 - RNA, 27 nt, Artificial Sequence
  Synthetic Oligonucleotide; NDFIP1 exon 6; Set C
uuaaaaacacuuaccuaaaacaaggaa

SEQ ID NO: 39526 - RNA, 25 nt, Artificial Sequence
  Synthetic Oligonucleotide; NDFIP1 exon 6; Set C
uaaaaacacuuaccuaaaacaagga

SEQ ID NO: 39527 - RNA, 32 nt, Artificial Sequence
  Synthetic Oligonucleotide; NDFIP1 exon 6; Set C
acauuaaaaacacuuaccuaaaacaaggaaca

SEQ ID NO: 39528 - RNA, 34 nt, Artificial Sequence
  Synthetic Oligonucleotide; NDFIP1 exon 6; Set C
uacauuaaaaacacuuaccuaaaacaaggaacac

SEQ ID NO: 39529 - RNA, 30 nt, Artificial Sequence
  Synthetic Oligonucleotide; NDFIP1 exon 6; Set C
cauuaaaaacacuuaccuaaaacaaggaac

SEQ ID NO: 39530 - RNA, 28 nt, Artificial Sequence
  Synthetic Oligonucleotide; NDFIP1 exon 6; Set C
auuaaaaacacuuaccuaaaacaaggaa

SEQ ID NO: 39531 - RNA, 26 nt, Artificial Sequence
  Synthetic Oligonucleotide; NDFIP1 exon 6; Set C
uuaaaaacacuuaccuaaaacaagga

SEQ ID NO: 39532 - RNA, 22 nt, Artificial Sequence
  Synthetic Oligonucleotide; NDFIP1 exon 6; Set C
aaaaacacuuaccuaaaacaag

SEQ ID NO: 39533 - RNA, 33 nt, Artificial Sequence
  Synthetic Oligonucleotide; NDFIP1 exon 6; Set C
uacauuaaaaacacuuaccuaaaacaaggaaca

SEQ ID NO: 39534 - RNA, 31 nt, Artificial Sequence
  Synthetic Oligonucleotide; NDFIP1 exon 6; Set C
acauuaaaaacacuuaccuaaaacaaggaac

SEQ ID NO: 39535 - RNA, 21 nt, Artificial Sequence
  Synthetic Oligonucleotide; NDFIP1 exon 6; Set C
aaaaacacuuaccuaaaacaa

SEQ ID NO: 39536 - RNA, 29 nt, Artificial Sequence
  Synthetic Oligonucleotide; NDFIP1 exon 6; Set C
cauuaaaaacacuuaccuaaaacaaggaa

SEQ ID NO: 39537 - RNA, 27 nt, Artificial Sequence
  Synthetic Oligonucleotide; NDFIP1 exon 6; Set C
auuaaaaacacuuaccuaaaacaagga

SEQ ID NO: 39538 - RNA, 32 nt, Artificial Sequence
  Synthetic Oligonucleotide; NDFIP1 exon 6; Set C
uacauuaaaaacacuuaccuaaaacaaggaac

SEQ ID NO: 39539 - RNA, 22 nt, Artificial Sequence
  Synthetic Oligonucleotide; NDFIP1 exon 6; Set C
uaaaaacacuuaccuaaaacaa

SEQ ID NO: 39540 - RNA, 30 nt, Artificial Sequence
  Synthetic Oligonucleotide; NDFIP1 exon 6; Set C
acauuaaaaacacuuaccuaaaacaaggaa

SEQ ID NO: 39541 - RNA, 23 nt, Artificial Sequence
  Synthetic Oligonucleotide; NDFIP1 exon 6; Set C
uuaaaaacacuuaccuaaaacaa

SEQ ID NO: 39542 - RNA, 31 nt, Artificial Sequence
  Synthetic Oligonucleotide; NDFIP1 exon 6; Set C
uacauuaaaaacacuuaccuaaaacaaggaa

SEQ ID NO: 39543 - RNA, 24 nt, Artificial Sequence
  Synthetic Oligonucleotide; NDFIP1 exon 6; Set C
auuaaaaacacuuaccuaaaacaa

SEQ ID NO: 39544 - RNA, 25 nt, Artificial Sequence
  Synthetic Oligonucleotide; NDFIP1 exon 6; Set C
cauuaaaaacacuuaccuaaaacaa

SEQ ID NO: 39545 - RNA, 31 nt, Artificial Sequence
  Synthetic Oligonucleotide; NDFIP1 exon 6; Set C
uuacauuaaaaacacuuaccuaaaacaagga

SEQ ID NO: 39546 - RNA, 24 nt, Artificial Sequence
  Synthetic Oligonucleotide; NDFIP1 exon 6; Set C
cauuaaaaacacuuaccuaaaaca

SEQ ID NO: 39547 - RNA, 26 nt, Artificial Sequence
  Synthetic Oligonucleotide; NDFIP1 exon 6; Set C
acauuaaaaacacuuaccuaaaacaa

SEQ ID NO: 39548 - RNA, 30 nt, Artificial Sequence
  Synthetic Oligonucleotide; NDFIP1 exon 6; Set C
uuacauuaaaaacacuuaccuaaaacaagg

SEQ ID NO: 39549 - RNA, 23 nt, Artificial Sequence
  Synthetic Oligonucleotide; NDFIP1 exon 6; Set C
cauuaaaaacacuuaccuaaaac

SEQ ID NO: 39550 - RNA, 25 nt, Artificial Sequence
  Synthetic Oligonucleotide; NDFIP1 exon 6; Set C
acauuaaaaacacuuaccuaaaaca

SEQ ID NO: 39551 - RNA, 27 nt, Artificial Sequence
  Synthetic Oligonucleotide; NDFIP1 exon 6; Set C
uacauuaaaaacacuuaccuaaaacaa

SEQ ID NO: 39552 - RNA, 29 nt, Artificial Sequence
  Synthetic Oligonucleotide; NDFIP1 exon 6; Set C
uuacauuaaaaacacuuaccuaaaacaag

SEQ ID NO: 39553 - RNA, 22 nt, Artificial Sequence
  Synthetic Oligonucleotide; NDFIP1 exon 6; Set C
cauuaaaaacacuuaccuaaaa

SEQ ID NO: 39554 - RNA, 24 nt, Artificial Sequence
  Synthetic Oligonucleotide; NDFIP1 exon 6; Set C
acauuaaaaacacuuaccuaaaac

SEQ ID NO: 39555 - RNA, 26 nt, Artificial Sequence
  Synthetic Oligonucleotide; NDFIP1 exon 6; Set C
uacauuaaaaacacuuaccuaaaaca

SEQ ID NO: 39556 - RNA, 21 nt, Artificial Sequence
  Synthetic Oligonucleotide; NDFIP1 exon 6; Set C
cauuaaaaacacuuaccuaaa

SEQ ID NO: 39557 - RNA, 23 nt, Artificial Sequence
  Synthetic Oligonucleotide; NDFIP1 exon 6; Set C
acauuaaaaacacuuaccuaaaa

SEQ ID NO: 39558 - RNA, 25 nt, Artificial Sequence
  Synthetic Oligonucleotide; NDFIP1 exon 6; Set C
uacauuaaaaacacuuaccuaaaac

SEQ ID NO: 39559 - RNA, 20 nt, Artificial Sequence
  Synthetic Oligonucleotide; NDFIP1 exon 6; Set C
cauuaaaaacacuuaccuaa

SEQ ID NO: 39560 - RNA, 22 nt, Artificial Sequence
  Synthetic Oligonucleotide; NDFIP1 exon 6; Set C
acauuaaaaacacuuaccuaaa

SEQ ID NO: 39561 - RNA, 24 nt, Artificial Sequence
  Synthetic Oligonucleotide; NDFIP1 exon 6; Set C
uacauuaaaaacacuuaccuaaaa

SEQ ID NO: 39562 - RNA, 21 nt, Artificial Sequence
  Synthetic Oligonucleotide; NDFIP1 exon 6; Set C
acauuaaaaacacuuaccuaa

SEQ ID NO: 39563 - RNA, 23 nt, Artificial Sequence
  Synthetic Oligonucleotide; NDFIP1 exon 6; Set C
uacauuaaaaacacuuaccuaaa

SEQ ID NO: 39564 - RNA, 22 nt, Artificial Sequence
  Synthetic Oligonucleotide; NDFIP1 exon 6; Set C
uacauuaaaaacacuuaccuaa

SEQ ID NO: 39565 - RNA, 40 nt, Artificial Sequence
  Synthetic Oligonucleotide; NDFIP1 exon 6; Set B
uguuuucuugccuuuucuuacauuaaaaacacuuaccuaa

SEQ ID NO: 39566 - RNA, 36 nt, Artificial Sequence
  Synthetic Oligonucleotide; NDFIP1 exon 6; Set B
auguuuucuugccuuuucuuacauuaaaaacacuua

SEQ ID NO: 39567 - RNA, 34 nt, Artificial Sequence
  Synthetic Oligonucleotide; NDFIP1 exon 6; Set B
uguuuucuugccuuuucuuacauuaaaaacacuu

SEQ ID NO: 39568 - RNA, 32 nt, Artificial Sequence
  Synthetic Oligonucleotide; NDFIP1 exon 6; Set C
guuuucuugccuuuucuuacauuaaaaacacu

SEQ ID NO: 39569 - RNA, 35 nt, Artificial Sequence
  Synthetic Oligonucleotide; NDFIP1 exon 6; Set B
auguuuucuugccuuuucuuacauuaaaaacacuu

SEQ ID NO: 39570 - RNA, 33 nt, Artificial Sequence
  Synthetic Oligonucleotide; NDFIP1 exon 6; Set B
uguuuucuugccuuuucuuacauuaaaaacacu

SEQ ID NO: 39571 - RNA, 36 nt, Artificial Sequence
  Synthetic Oligonucleotide; NDFIP1 exon 6; Set B
aauguuuucuugccuuuucuuacauuaaaaacacuu

SEQ ID NO: 39572 - RNA, 32 nt, Artificial Sequence
  Synthetic Oligonucleotide; NDFIP1 exon 6; Set C
uguuuucuugccuuuucuuacauuaaaaacac

SEQ ID NO: 39573 - RNA, 34 nt, Artificial Sequence
  Synthetic Oligonucleotide; NDFIP1 exon 6; Set B
auguuuucuugccuuuucuuacauuaaaaacacu

SEQ ID NO: 39574 - RNA, 31 nt, Artificial Sequence
  Synthetic Oligonucleotide; NDFIP1 exon 6; Set C
uguuuucuugccuuuucuuacauuaaaaaca

SEQ ID NO: 39575 - RNA, 33 nt, Artificial Sequence
  Synthetic Oligonucleotide; NDFIP1 exon 6; Set C
auguuuucuugccuuuucuuacauuaaaaacac

SEQ ID NO: 39576 - RNA, 35 nt, Artificial Sequence
  Synthetic Oligonucleotide; NDFIP1 exon 6; Set C
aauguuuucuugccuuuucuuacauuaaaaacacu

SEQ ID NO: 39577 - RNA, 30 nt, Artificial Sequence
  Synthetic Oligonucleotide; NDFIP1 exon 6; Set C
uguuuucuugccuuuucuuacauuaaaaac

SEQ ID NO: 39578 - RNA, 32 nt, Artificial Sequence
  Synthetic Oligonucleotide; NDFIP1 exon 6; Set C
auguuuucuugccuuuucuuacauuaaaaaca

SEQ ID NO: 39579 - RNA, 34 nt, Artificial Sequence
  Synthetic Oligonucleotide; NDFIP1 exon 6; Set C
aauguuuucuugccuuuucuuacauuaaaaacac

SEQ ID NO: 39580 - RNA, 31 nt, Artificial Sequence
  Synthetic Oligonucleotide; NDFIP1 exon 6; Set C
auguuuucuugccuuuucuuacauuaaaaac

SEQ ID NO: 39581 - RNA, 29 nt, Artificial Sequence
  Synthetic Oligonucleotide; NDFIP1 exon 6; Set C
uguuuucuugccuuuucuuacauuaaaaa

SEQ ID NO: 39582 - RNA, 27 nt, Artificial Sequence
  Synthetic Oligonucleotide; NDFIP1 exon 6; Set C
guuuucuugccuuuucuuacauuaaaa

SEQ ID NO: 39583 - RNA, 33 nt, Artificial Sequence
  Synthetic Oligonucleotide; NDFIP1 exon 6; Set C
aauguuuucuugccuuuucuuacauuaaaaaca

SEQ ID NO: 39584 - RNA, 32 nt, Artificial Sequence
  Synthetic Oligonucleotide; NDFIP1 exon 6; Set C
aauguuuucuugccuuuucuuacauuaaaaac

SEQ ID NO: 39585 - RNA, 30 nt, Artificial Sequence
  Synthetic Oligonucleotide; NDFIP1 exon 6; Set C
auguuuucuugccuuuucuuacauuaaaaa

SEQ ID NO: 39586 - RNA, 28 nt, Artificial Sequence
  Synthetic Oligonucleotide; NDFIP1 exon 6; Set C
uguuuucuugccuuuucuuacauuaaaa

SEQ ID NO: 39587 - RNA, 31 nt, Artificial Sequence
  Synthetic Oligonucleotide; NDFIP1 exon 6; Set C
aauguuuucuugccuuuucuuacauuaaaaa

SEQ ID NO: 39588 - RNA, 29 nt, Artificial Sequence
  Synthetic Oligonucleotide; NDFIP1 exon 6; Set C
auguuuucuugccuuuucuuacauuaaaa

SEQ ID NO: 39589 - RNA, 30 nt, Artificial Sequence
  Synthetic Oligonucleotide; NDFIP1 exon 6; Set C
aauguuuucuugccuuuucuuacauuaaaa

SEQ ID NO: 39590 - RNA, 18 nt, Artificial Sequence
  Synthetic Oligonucleotide; NDFIP1 exon 6; Set C
uuuucuugccuuuucuua

SEQ ID NO: 39591 - RNA, 17 nt, Artificial Sequence
  Synthetic Oligonucleotide; NDFIP1 exon 6; Set C
uuuucuugccuuuucuu

SEQ ID NO: 39592 - RNA, 19 nt, Artificial Sequence
  Synthetic Oligonucleotide; NDFIP1 exon 6; Set C
guuuucuugccuuuucuua

SEQ ID NO: 39593 - RNA, 16 nt, Artificial Sequence
  Synthetic Oligonucleotide; NDFIP1 exon 6; Set C
uuuucuugccuuuucu

SEQ ID NO: 39594 - RNA, 18 nt, Artificial Sequence
  Synthetic Oligonucleotide; NDFIP1 exon 6; Set C
guuuucuugccuuuucuu

SEQ ID NO: 39595 - RNA, 20 nt, Artificial Sequence
  Synthetic Oligonucleotide; NDFIP1 exon 6; Set C
uguuuucuugccuuuucuua

SEQ ID NO: 39596 - RNA, 15 nt, Artificial Sequence
  Synthetic Oligonucleotide; NDFIP1 exon 6; Set C
uuuucuugccuuuuc

SEQ ID NO: 39597 - RNA, 17 nt, Artificial Sequence
  Synthetic Oligonucleotide; NDFIP1 exon 6; Set C
guuuucuugccuuuucu

SEQ ID NO: 39598 - RNA, 19 nt, Artificial Sequence
  Synthetic Oligonucleotide; NDFIP1 exon 6; Set C
uguuuucuugccuuuucuu

SEQ ID NO: 39599 - RNA, 21 nt, Artificial Sequence
  Synthetic Oligonucleotide; NDFIP1 exon 6; Set C
auguuuucuugccuuuucuua

SEQ ID NO: 39600 - RNA, 16 nt, Artificial Sequence
  Synthetic Oligonucleotide; NDFIP1 exon 6; Set C
guuuucuugccuuuuc

SEQ ID NO: 39601 - RNA, 18 nt, Artificial Sequence
  Synthetic Oligonucleotide; NDFIP1 exon 6; Set C
uguuuucuugccuuuucu

SEQ ID NO: 39602 - RNA, 20 nt, Artificial Sequence
  Synthetic Oligonucleotide; NDFIP1 exon 6; Set C
auguuuucuugccuuuucuu

SEQ ID NO: 39603 - RNA, 22 nt, Artificial Sequence
  Synthetic Oligonucleotide; NDFIP1 exon 6; Set C
aauguuuucuugccuuuucuua

SEQ ID NO: 39604 - RNA, 15 nt, Artificial Sequence
  Synthetic Oligonucleotide; NDFIP1 exon 6; Set C
guuuucuugccuuuu

SEQ ID NO: 39605 - RNA, 17 nt, Artificial Sequence
  Synthetic Oligonucleotide; NDFIP1 exon 6; Set C
uguuuucuugccuuuuc

SEQ ID NO: 39606 - RNA, 19 nt, Artificial Sequence
  Synthetic Oligonucleotide; NDFIP1 exon 6; Set C
auguuuucuugccuuuucu

SEQ ID NO: 39607 - RNA, 21 nt, Artificial Sequence
  Synthetic Oligonucleotide; NDFIP1 exon 6; Set C
aauguuuucuugccuuuucuu

SEQ ID NO: 39608 - RNA, 37 nt, Artificial Sequence
  Synthetic Oligonucleotide; NDFIP1 exon 6; Set C
uuuaauguaauguuuucuugccuuuucuuacauuaaa

SEQ ID NO: 39609 - RNA, 16 nt, Artificial Sequence
  Synthetic Oligonucleotide; NDFIP1 exon 6; Set C
uguuuucuugccuuuu

SEQ ID NO: 39610 - RNA, 18 nt, Artificial Sequence
  Synthetic Oligonucleotide; NDFIP1 exon 6; Set C
auguuuucuugccuuuuc

SEQ ID NO: 39611 - RNA, 20 nt, Artificial Sequence
  Synthetic Oligonucleotide; NDFIP1 exon 6; Set C
aauguuuucuugccuuuucu

SEQ ID NO: 39612 - RNA, 38 nt, Artificial Sequence
  Synthetic Oligonucleotide; NDFIP1 exon 6; Set C
auuuaauguaauguuuucuugccuuuucuuacauuaaa

SEQ ID NO: 39613 - RNA, 36 nt, Artificial Sequence
  Synthetic Oligonucleotide; NDFIP1 exon 6; Set C
uuuaauguaauguuuucuugccuuuucuuacauuaa

SEQ ID NO: 39614 - RNA, 17 nt, Artificial Sequence
  Synthetic Oligonucleotide; NDFIP1 exon 6; Set C
auguuuucuugccuuuu

SEQ ID NO: 39615 - RNA, 15 nt, Artificial Sequence
  Synthetic Oligonucleotide; NDFIP1 exon 6; Set C
uguuuucuugccuuu

SEQ ID NO: 39616 - RNA, 19 nt, Artificial Sequence
  Synthetic Oligonucleotide; NDFIP1 exon 6; Set C
aauguuuucuugccuuuuc

SEQ ID NO: 39617 - RNA, 39 nt, Artificial Sequence
  Synthetic Oligonucleotide; NDFIP1 exon 6; Set C
aauuuaauguaauguuuucuugccuuuucuuacauuaaa

SEQ ID NO: 39618 - RNA, 35 nt, Artificial Sequence
  Synthetic Oligonucleotide; NDFIP1 exon 6; Set B
uuuaauguaauguuuucuugccuuuucuuacauua

SEQ ID NO: 39619 - RNA, 37 nt, Artificial Sequence
  Synthetic Oligonucleotide; NDFIP1 exon 6; Set C
auuuaauguaauguuuucuugccuuuucuuacauuaa

SEQ ID NO: 39620 - RNA, 18 nt, Artificial Sequence
  Synthetic Oligonucleotide; NDFIP1 exon 6; Set C
aauguuuucuugccuuuu

SEQ ID NO: 39621 - RNA, 16 nt, Artificial Sequence
  Synthetic Oligonucleotide; NDFIP1 exon 6; Set C
auguuuucuugccuuu

SEQ ID NO: 39622 - RNA, 36 nt, Artificial Sequence
  Synthetic Oligonucleotide; NDFIP1 exon 6; Set B
auuuaauguaauguuuucuugccuuuucuuacauua

SEQ ID NO: 39623 - RNA, 38 nt, Artificial Sequence
  Synthetic Oligonucleotide; NDFIP1 exon 6; Set C
aauuuaauguaauguuuucuugccuuuucuuacauuaa

SEQ ID NO: 39624 - RNA, 34 nt, Artificial Sequence
  Synthetic Oligonucleotide; NDFIP1 exon 6; Set C
uuuaauguaauguuuucuugccuuuucuuacauu

SEQ ID NO: 39625 - RNA, 17 nt, Artificial Sequence
  Synthetic Oligonucleotide; NDFIP1 exon 6; Set C
aauguuuucuugccuuu

SEQ ID NO: 39626 - RNA, 15 nt, Artificial Sequence
  Synthetic Oligonucleotide; NDFIP1 exon 6; Set C
auguuuucuugccuu

SEQ ID NO: 39627 - RNA, 37 nt, Artificial Sequence
  Synthetic Oligonucleotide; NDFIP1 exon 6; Set C
aauuuaauguaauguuuucuugccuuuucuuacauua

SEQ ID NO: 39628 - RNA, 35 nt, Artificial Sequence
  Synthetic Oligonucleotide; NDFIP1 exon 6; Set C
auuuaauguaauguuuucuugccuuuucuuacauu

SEQ ID NO: 39629 - RNA, 33 nt, Artificial Sequence
  Synthetic Oligonucleotide; NDFIP1 exon 6; Set C
uuuaauguaauguuuucuugccuuuucuuacau

SEQ ID NO: 39630 - RNA, 16 nt, Artificial Sequence
  Synthetic Oligonucleotide; NDFIP1 exon 6; Set C
aauguuuucuugccuu

SEQ ID NO: 39631 - RNA, 36 nt, Artificial Sequence
  Synthetic Oligonucleotide; NDFIP1 exon 6; Set C
aauuuaauguaauguuuucuugccuuuucuuacauu

SEQ ID NO: 39632 - RNA, 34 nt, Artificial Sequence
  Synthetic Oligonucleotide; NDFIP1 exon 6; Set C
auuuaauguaauguuuucuugccuuuucuuacau

SEQ ID NO: 39633 - RNA, 32 nt, Artificial Sequence
  Synthetic Oligonucleotide; NDFIP1 exon 6; Set C
uuuaauguaauguuuucuugccuuuucuuaca

SEQ ID NO: 39634 - RNA, 15 nt, Artificial Sequence
  Synthetic Oligonucleotide; NDFIP1 exon 6; Set C
aauguuuucuugccu

SEQ ID NO: 39635 - RNA, 35 nt, Artificial Sequence
  Synthetic Oligonucleotide; NDFIP1 exon 6; Set C
aauuuaauguaauguuuucuugccuuuucuuacau

SEQ ID NO: 39636 - RNA, 33 nt, Artificial Sequence
  Synthetic Oligonucleotide; NDFIP1 exon 6; Set C
auuuaauguaauguuuucuugccuuuucuuaca

SEQ ID NO: 39637 - RNA, 34 nt, Artificial Sequence
  Synthetic Oligonucleotide; NDFIP1 exon 6; Set C
aauuuaauguaauguuuucuugccuuuucuuaca

SEQ ID NO: 39638 - RNA, 32 nt, Artificial Sequence
  Synthetic Oligonucleotide; NDFIP1 exon 6; Set C
auuuaauguaauguuuucuugccuuuucuuac

SEQ ID NO: 39639 - RNA, 33 nt, Artificial Sequence
  Synthetic Oligonucleotide; NDFIP1 exon 6; Set C
aauuuaauguaauguuuucuugccuuuucuuac

SEQ ID NO: 39640 - RNA, 15 nt, Artificial Sequence
  Synthetic Oligonucleotide; NDFIP1 exon 6; Set C
uuuaauguaauguuu

SEQ ID NO: 39641 - RNA, 16 nt, Artificial Sequence
  Synthetic Oligonucleotide; NDFIP1 exon 6; Set C
auuuaauguaauguuu

SEQ ID NO: 39642 - RNA, 17 nt, Artificial Sequence
  Synthetic Oligonucleotide; NDFIP1 exon 6; Set C
aauuuaauguaauguuu

SEQ ID NO: 39643 - RNA, 15 nt, Artificial Sequence
  Synthetic Oligonucleotide; NDFIP1 exon 6; Set C
auuuaauguaauguu

SEQ ID NO: 39644 - RNA, 16 nt, Artificial Sequence
  Synthetic Oligonucleotide; NDFIP1 exon 6; Set C
aauuuaauguaauguu

SEQ ID NO: 39645 - RNA, 15 nt, Artificial Sequence
  Synthetic Oligonucleotide; NDFIP1 exon 6; Set C
aauuuaauguaaugu

SEQ ID NO: 39646 - RNA, 19 nt, Artificial Sequence
  Synthetic Oligonucleotide; NDFIP1 exon 6; Set C
cugaccaucaaaauaucca

SEQ ID NO: 39647 - RNA, 38 nt, Artificial Sequence
  Synthetic Oligonucleotide; NDFIP1 exon 6; Set A
agagccaguacugaccaucaaaauauccagggaaauag

SEQ ID NO: 39648 - RNA, 20 nt, Artificial Sequence
  Synthetic Oligonucleotide; NDFIP1 exon 6; Set C
acugaccaucaaaauaucca

SEQ ID NO: 39649 - RNA, 37 nt, Artificial Sequence
  Synthetic Oligonucleotide; NDFIP1 exon 6; Set C
agagccaguacugaccaucaaaauauccagggaaaua

SEQ ID NO: 39650 - RNA, 36 nt, Artificial Sequence
  Synthetic Oligonucleotide; NDFIP1 exon 6; Set A
agagccaguacugaccaucaaaauauccagggaaau

SEQ ID NO: 39651 - RNA, 40 nt, Artificial Sequence
  Synthetic Oligonucleotide; NDFIP1 exon 6; Set C
ccagagccaguacugaccaucaaaauauccagggaaauag

SEQ ID NO: 39652 - RNA, 35 nt, Artificial Sequence
  Synthetic Oligonucleotide; NDFIP1 exon 6; Set C
agagccaguacugaccaucaaaauauccagggaaa

SEQ ID NO: 39653 - RNA, 34 nt, Artificial Sequence
  Synthetic Oligonucleotide; NDFIP1 exon 6; Set C
agagccaguacugaccaucaaaauauccagggaa

SEQ ID NO: 39654 - RNA, 33 nt, Artificial Sequence
  Synthetic Oligonucleotide; NDFIP1 exon 6; Set C
agagccaguacugaccaucaaaauauccaggga

SEQ ID NO: 39655 - RNA, 32 nt, Artificial Sequence
  Synthetic Oligonucleotide; NDFIP1 exon 6; Set A
agagccaguacugaccaucaaaauauccaggg

SEQ ID NO: 39656 - RNA, 35 nt, Artificial Sequence
  Synthetic Oligonucleotide; NDFIP1 exon 6; Set C
ccagagccaguacugaccaucaaaauauccaggga

SEQ ID NO: 39657 - RNA, 31 nt, Artificial Sequence
  Synthetic Oligonucleotide; NDFIP1 exon 6; Set A
agagccaguacugaccaucaaaauauccagg

SEQ ID NO: 39658 - RNA, 36 nt, Artificial Sequence
  Synthetic Oligonucleotide; NDFIP1 exon 6; Set C
accagagccaguacugaccaucaaaauauccaggga

SEQ ID NO: 39659 - RNA, 30 nt, Artificial Sequence
  Synthetic Oligonucleotide; NDFIP1 exon 6; Set A
agagccaguacugaccaucaaaauauccag

SEQ ID NO: 39660 - RNA, 34 nt, Artificial Sequence
  Synthetic Oligonucleotide; NDFIP1 exon 6; Set C
ccagagccaguacugaccaucaaaauauccaggg

SEQ ID NO: 39661 - RNA, 35 nt, Artificial Sequence
  Synthetic Oligonucleotide; NDFIP1 exon 6; Set C
accagagccaguacugaccaucaaaauauccaggg

SEQ ID NO: 39662 - RNA, 33 nt, Artificial Sequence
  Synthetic Oligonucleotide; NDFIP1 exon 6; Set C
ccagagccaguacugaccaucaaaauauccagg

SEQ ID NO: 39663 - RNA, 32 nt, Artificial Sequence
  Synthetic Oligonucleotide; NDFIP1 exon 6; Set A
ccagagccaguacugaccaucaaaauauccag

SEQ ID NO: 39664 - RNA, 34 nt, Artificial Sequence
  Synthetic Oligonucleotide; NDFIP1 exon 6; Set C
accagagccaguacugaccaucaaaauauccagg

SEQ ID NO: 39665 - RNA, 30 nt, Artificial Sequence
  Synthetic Oligonucleotide; NDFIP1 exon 6; Set A
cagagccaguacugaccaucaaaauaucca

SEQ ID NO: 39666 - RNA, 33 nt, Artificial Sequence
  Synthetic Oligonucleotide; NDFIP1 exon 6; Set C
accagagccaguacugaccaucaaaauauccag

SEQ ID NO: 39667 - RNA, 25 nt, Artificial Sequence
  Synthetic Oligonucleotide; NDFIP1 exon 6; Set C
agagccaguacugaccaucaaaaua

SEQ ID NO: 39668 - RNA, 24 nt, Artificial Sequence
  Synthetic Oligonucleotide; NDFIP1 exon 6; Set C
agagccaguacugaccaucaaaau

SEQ ID NO: 39669 - RNA, 27 nt, Artificial Sequence
  Synthetic Oligonucleotide; NDFIP1 exon 6; Set A
ccagagccaguacugaccaucaaaaua

SEQ ID NO: 39670 - RNA, 23 nt, Artificial Sequence
  Synthetic Oligonucleotide; NDFIP1 exon 6; Set C
agagccaguacugaccaucaaaa

SEQ ID NO: 39671 - RNA, 28 nt, Artificial Sequence
  Synthetic Oligonucleotide; NDFIP1 exon 6; Set A
accagagccaguacugaccaucaaaaua

SEQ ID NO: 39672 - RNA, 26 nt, Artificial Sequence
  Synthetic Oligonucleotide; NDFIP1 exon 6; Set A
ccagagccaguacugaccaucaaaau

SEQ ID NO: 39673 - RNA, 22 nt, Artificial Sequence
  Synthetic Oligonucleotide; NDFIP1 exon 6; Set C
agagccaguacugaccaucaaa

SEQ ID NO: 39674 - RNA, 27 nt, Artificial Sequence
  Synthetic Oligonucleotide; NDFIP1 exon 6; Set A
accagagccaguacugaccaucaaaau

SEQ ID NO: 39675 - RNA, 25 nt, Artificial Sequence
  Synthetic Oligonucleotide; NDFIP1 exon 6; Set A
ccagagccaguacugaccaucaaaa

SEQ ID NO: 39676 - RNA, 21 nt, Artificial Sequence
  Synthetic Oligonucleotide; NDFIP1 exon 6; Set A
agagccaguacugaccaucaa

SEQ ID NO: 39677 - RNA, 26 nt, Artificial Sequence
  Synthetic Oligonucleotide; NDFIP1 exon 6; Set A
accagagccaguacugaccaucaaaa

SEQ ID NO: 39678 - RNA, 24 nt, Artificial Sequence
  Synthetic Oligonucleotide; NDFIP1 exon 6; Set A
ccagagccaguacugaccaucaaa

SEQ ID NO: 39679 - RNA, 25 nt, Artificial Sequence
  Synthetic Oligonucleotide; NDFIP1 exon 6; Set A
accagagccaguacugaccaucaaa

SEQ ID NO: 39680 - RNA, 23 nt, Artificial Sequence
  Synthetic Oligonucleotide; NDFIP1 exon 6; Set A
ccagagccaguacugaccaucaa

SEQ ID NO: 39681 - RNA, 21 nt, Artificial Sequence
  Synthetic Oligonucleotide; NDFIP1 exon 6; Set A
cagagccaguacugaccauca

SEQ ID NO: 39682 - RNA, 24 nt, Artificial Sequence
  Synthetic Oligonucleotide; NDFIP1 exon 6; Set A
accagagccaguacugaccaucaa

SEQ ID NO: 39683 - RNA, 20 nt, Artificial Sequence
  Synthetic Oligonucleotide; NDFIP1 exon 6; Set A
cagagccaguacugaccauc

SEQ ID NO: 39684 - RNA, 23 nt, Artificial Sequence
  Synthetic Oligonucleotide; NDFIP1 exon 6; Set A
accagagccaguacugaccauca

SEQ ID NO: 39685 - RNA, 32 nt, Artificial Sequence
  Synthetic Oligonucleotide; NDFIP1 exon 6; Set C
aggaacacccaccagagccaguacugaccauc

SEQ ID NO: 39686 - RNA, 24 nt, Artificial Sequence
  Synthetic Oligonucleotide; NDFIP1 exon 6; Set C
gaacacccaccagagccaguacug

SEQ ID NO: 39687 - RNA, 25 nt, Artificial Sequence
  Synthetic Oligonucleotide; NDFIP1 exon 6; Set C
ggaacacccaccagagccaguacug

SEQ ID NO: 39688 - RNA, 24 nt, Artificial Sequence
  Synthetic Oligonucleotide; NDFIP1 exon 6; Set C
ggaacacccaccagagccaguacu

SEQ ID NO: 39689 - RNA, 26 nt, Artificial Sequence
  Synthetic Oligonucleotide; NDFIP1 exon 6; Set C
aggaacacccaccagagccaguacug

SEQ ID NO: 39690 - RNA, 25 nt, Artificial Sequence
  Synthetic Oligonucleotide; NDFIP1 exon 6; Set C
aggaacacccaccagagccaguacu

SEQ ID NO: 39691 - RNA, 27 nt, Artificial Sequence
  Synthetic Oligonucleotide; NDFIP1 exon 6; Set C
aaggaacacccaccagagccaguacug

SEQ ID NO: 39692 - RNA, 26 nt, Artificial Sequence
  Synthetic Oligonucleotide; NDFIP1 exon 6; Set C
aaggaacacccaccagagccaguacu

SEQ ID NO: 39693 - RNA, 15 nt, Artificial Sequence
  Synthetic Oligonucleotide; NDFIP1 exon 6; Set C
aggaacacccaccag

SEQ ID NO: 39694 - RNA, 16 nt, Artificial Sequence
  Synthetic Oligonucleotide; NDFIP1 exon 6; Set C
aaggaacacccaccag

SEQ ID NO: 39695 - RNA, 18 nt, Artificial Sequence
  Synthetic Oligonucleotide; NDFIP1 exon 6; Set C
caaggaacacccaccaga

SEQ ID NO: 39696 - RNA, 16 nt, Artificial Sequence
  Synthetic Oligonucleotide; NDFIP1 exon 6; Set C
caaggaacacccacca

SEQ ID NO: 39697 - RNA, 15 nt, Artificial Sequence
  Synthetic Oligonucleotide; NDFIP1 exon 6; Set C
caaggaacacccacc

SEQ ID NO: 39698 - RNA, 28 nt, Artificial Sequence
  Synthetic Oligonucleotide; NDFIP1 exon 6; Set A
uuaccuaaaacaaggaacacccaccaga

SEQ ID NO: 39699 - RNA, 29 nt, Artificial Sequence
  Synthetic Oligonucleotide; NDFIP1 exon 6; Set A
cuuaccuaaaacaaggaacacccaccaga

SEQ ID NO: 39700 - RNA, 30 nt, Artificial Sequence
  Synthetic Oligonucleotide; NDFIP1 exon 6; Set A
acuuaccuaaaacaaggaacacccaccaga

SEQ ID NO: 39701 - RNA, 31 nt, Artificial Sequence
  Synthetic Oligonucleotide; NDFIP1 exon 6; Set C
cacuuaccuaaaacaaggaacacccaccaga

SEQ ID NO: 39702 - RNA, 36 nt, Artificial Sequence
  Synthetic Oligonucleotide; NDFIP1 exon 6; Set A
uaaaaacacuuaccuaaaacaaggaacacccaccag

SEQ ID NO: 39703 - RNA, 34 nt, Artificial Sequence
  Synthetic Oligonucleotide; NDFIP1 exon 6; Set A
aaaaacacuuaccuaaaacaaggaacacccacca

SEQ ID NO: 39704 - RNA, 37 nt, Artificial Sequence
  Synthetic Oligonucleotide; NDFIP1 exon 6; Set A
uuaaaaacacuuaccuaaaacaaggaacacccaccag

SEQ ID NO: 39705 - RNA, 33 nt, Artificial Sequence
  Synthetic Oligonucleotide; NDFIP1 exon 6; Set A
aaaaacacuuaccuaaaacaaggaacacccacc

SEQ ID NO: 39706 - RNA, 38 nt, Artificial Sequence
  Synthetic Oligonucleotide; NDFIP1 exon 6; Set A
auuaaaaacacuuaccuaaaacaaggaacacccaccag

SEQ ID NO: 39707 - RNA, 36 nt, Artificial Sequence
  Synthetic Oligonucleotide; NDFIP1 exon 6; Set A
uuaaaaacacuuaccuaaaacaaggaacacccacca

SEQ ID NO: 39708 - RNA, 39 nt, Artificial Sequence
  Synthetic Oligonucleotide; NDFIP1 exon 6; Set A
cauuaaaaacacuuaccuaaaacaaggaacacccaccag

SEQ ID NO: 39709 - RNA, 35 nt, Artificial Sequence
  Synthetic Oligonucleotide; NDFIP1 exon 6; Set A
uuaaaaacacuuaccuaaaacaaggaacacccacc

SEQ ID NO: 39710 - RNA, 37 nt, Artificial Sequence
  Synthetic Oligonucleotide; NDFIP1 exon 6; Set A
auuaaaaacacuuaccuaaaacaaggaacacccacca

SEQ ID NO: 39711 - RNA, 40 nt, Artificial Sequence
  Synthetic Oligonucleotide; NDFIP1 exon 6; Set A
acauuaaaaacacuuaccuaaaacaaggaacacccaccag

SEQ ID NO: 39712 - RNA, 40 nt, Artificial Sequence
  Synthetic Oligonucleotide; NDFIP1 exon 6; Set A
uuacauuaaaaacacuuaccuaaaacaaggaacacccacc

SEQ ID NO: 39713 - RNA, 23 nt, Artificial Sequence
  Synthetic Oligonucleotide; NDFIP1 exon 6; Set C
aaaaacacuuaccuaaaacaagg

SEQ ID NO: 39714 - RNA, 24 nt, Artificial Sequence
  Synthetic Oligonucleotide; NDFIP1 exon 6; Set C
uaaaaacacuuaccuaaaacaagg

SEQ ID NO: 39715 - RNA, 23 nt, Artificial Sequence
  Synthetic Oligonucleotide; NDFIP1 exon 6; Set C
uaaaaacacuuaccuaaaacaag

SEQ ID NO: 39716 - RNA, 25 nt, Artificial Sequence
  Synthetic Oligonucleotide; NDFIP1 exon 6; Set C
uuaaaaacacuuaccuaaaacaagg

SEQ ID NO: 39717 - RNA, 28 nt, Artificial Sequence
  Synthetic Oligonucleotide; NDFIP1 exon 6; Set C
cauuaaaaacacuuaccuaaaacaagga

SEQ ID NO: 39718 - RNA, 24 nt, Artificial Sequence
  Synthetic Oligonucleotide; NDFIP1 exon 6; Set C
uuaaaaacacuuaccuaaaacaag

SEQ ID NO: 39719 - RNA, 26 nt, Artificial Sequence
  Synthetic Oligonucleotide; NDFIP1 exon 6; Set C
auuaaaaacacuuaccuaaaacaagg

SEQ ID NO: 39720 - RNA, 29 nt, Artificial Sequence
  Synthetic Oligonucleotide; NDFIP1 exon 6; Set C
acauuaaaaacacuuaccuaaaacaagga

SEQ ID NO: 39721 - RNA, 25 nt, Artificial Sequence
  Synthetic Oligonucleotide; NDFIP1 exon 6; Set C
auuaaaaacacuuaccuaaaacaag

SEQ ID NO: 39722 - RNA, 27 nt, Artificial Sequence
  Synthetic Oligonucleotide; NDFIP1 exon 6; Set C
cauuaaaaacacuuaccuaaaacaagg

SEQ ID NO: 39723 - RNA, 30 nt, Artificial Sequence
  Synthetic Oligonucleotide; NDFIP1 exon 6; Set C
uacauuaaaaacacuuaccuaaaacaagga

SEQ ID NO: 39724 - RNA, 26 nt, Artificial Sequence
  Synthetic Oligonucleotide; NDFIP1 exon 6; Set C
cauuaaaaacacuuaccuaaaacaag

SEQ ID NO: 39725 - RNA, 28 nt, Artificial Sequence
  Synthetic Oligonucleotide; NDFIP1 exon 6; Set C
acauuaaaaacacuuaccuaaaacaagg

SEQ ID NO: 39726 - RNA, 27 nt, Artificial Sequence
  Synthetic Oligonucleotide; NDFIP1 exon 6; Set C
acauuaaaaacacuuaccuaaaacaag

SEQ ID NO: 39727 - RNA, 29 nt, Artificial Sequence
  Synthetic Oligonucleotide; NDFIP1 exon 6; Set C
uacauuaaaaacacuuaccuaaaacaagg

SEQ ID NO: 39728 - RNA, 28 nt, Artificial Sequence
  Synthetic Oligonucleotide; NDFIP1 exon 6; Set C
uacauuaaaaacacuuaccuaaaacaag

SEQ ID NO: 39729 - RNA, 25 nt, Artificial Sequence
  Synthetic Oligonucleotide; NDFIP1 exon 6; Set C
uuuucuugccuuuucuuacauuaaa

SEQ ID NO: 39730 - RNA, 26 nt, Artificial Sequence
  Synthetic Oligonucleotide; NDFIP1 exon 6; Set C
guuuucuugccuuuucuuacauuaaa

SEQ ID NO: 39731 - RNA, 24 nt, Artificial Sequence
  Synthetic Oligonucleotide; NDFIP1 exon 6; Set C
uuuucuugccuuuucuuacauuaa

SEQ ID NO: 39732 - RNA, 27 nt, Artificial Sequence
  Synthetic Oligonucleotide; NDFIP1 exon 6; Set C
uguuuucuugccuuuucuuacauuaaa

SEQ ID NO: 39733 - RNA, 23 nt, Artificial Sequence
  Synthetic Oligonucleotide; NDFIP1 exon 6; Set C
uuuucuugccuuuucuuacauua

SEQ ID NO: 39734 - RNA, 25 nt, Artificial Sequence
  Synthetic Oligonucleotide; NDFIP1 exon 6; Set C
guuuucuugccuuuucuuacauuaa

SEQ ID NO: 39735 - RNA, 28 nt, Artificial Sequence
  Synthetic Oligonucleotide; NDFIP1 exon 6; Set C
auguuuucuugccuuuucuuacauuaaa

SEQ ID NO: 39736 - RNA, 24 nt, Artificial Sequence
  Synthetic Oligonucleotide; NDFIP1 exon 6; Set C
guuuucuugccuuuucuuacauua

SEQ ID NO: 39737 - RNA, 22 nt, Artificial Sequence
  Synthetic Oligonucleotide; NDFIP1 exon 6; Set C
uuuucuugccuuuucuuacauu

SEQ ID NO: 39738 - RNA, 26 nt, Artificial Sequence
  Synthetic Oligonucleotide; NDFIP1 exon 6; Set C
uguuuucuugccuuuucuuacauuaa

SEQ ID NO: 39739 - RNA, 29 nt, Artificial Sequence
  Synthetic Oligonucleotide; NDFIP1 exon 6; Set C
aauguuuucuugccuuuucuuacauuaaa

SEQ ID NO: 39740 - RNA, 25 nt, Artificial Sequence
  Synthetic Oligonucleotide; NDFIP1 exon 6; Set C
uguuuucuugccuuuucuuacauua

SEQ ID NO: 39741 - RNA, 23 nt, Artificial Sequence
  Synthetic Oligonucleotide; NDFIP1 exon 6; Set C
guuuucuugccuuuucuuacauu

SEQ ID NO: 39742 - RNA, 27 nt, Artificial Sequence
  Synthetic Oligonucleotide; NDFIP1 exon 6; Set C
auguuuucuugccuuuucuuacauuaa

SEQ ID NO: 39743 - RNA, 21 nt, Artificial Sequence
  Synthetic Oligonucleotide; NDFIP1 exon 6; Set C
uuuucuugccuuuucuuacau

SEQ ID NO: 39744 - RNA, 26 nt, Artificial Sequence
  Synthetic Oligonucleotide; NDFIP1 exon 6; Set C
auguuuucuugccuuuucuuacauua

SEQ ID NO: 39745 - RNA, 24 nt, Artificial Sequence
  Synthetic Oligonucleotide; NDFIP1 exon 6; Set C
uguuuucuugccuuuucuuacauu

SEQ ID NO: 39746 - RNA, 28 nt, Artificial Sequence
  Synthetic Oligonucleotide; NDFIP1 exon 6; Set C
aauguuuucuugccuuuucuuacauuaa

SEQ ID NO: 39747 - RNA, 22 nt, Artificial Sequence
  Synthetic Oligonucleotide; NDFIP1 exon 6; Set C
guuuucuugccuuuucuuacau

SEQ ID NO: 39748 - RNA, 20 nt, Artificial Sequence
  Synthetic Oligonucleotide; NDFIP1 exon 6; Set C
uuuucuugccuuuucuuaca

SEQ ID NO: 39749 - RNA, 27 nt, Artificial Sequence
  Synthetic Oligonucleotide; NDFIP1 exon 6; Set C
aauguuuucuugccuuuucuuacauua

SEQ ID NO: 39750 - RNA, 25 nt, Artificial Sequence
  Synthetic Oligonucleotide; NDFIP1 exon 6; Set C
auguuuucuugccuuuucuuacauu

SEQ ID NO: 39751 - RNA, 19 nt, Artificial Sequence
  Synthetic Oligonucleotide; NDFIP1 exon 6; Set C
uuuucuugccuuuucuuac

SEQ ID NO: 39752 - RNA, 26 nt, Artificial Sequence
  Synthetic Oligonucleotide; NDFIP1 exon 6; Set C
aauguuuucuugccuuuucuuacauu

SEQ ID NO: 39753 - RNA, 31 nt, Artificial Sequence
  Synthetic Oligonucleotide; NDFIP1 exon 6; Set C
uuuaauguaauguuuucuugccuuuucuuac

SEQ ID NO: 39754 - RNA, 17 nt, Artificial Sequence
  Synthetic Oligonucleotide; PDCD1LG2 exon 2; Set C
uugugaaacuuugcugg

SEQ ID NO: 39755 - RNA, 18 nt, Artificial Sequence
  Synthetic Oligonucleotide; PDCD1LG2 exon 2; Set C
cuugugaaacuuugcugg

SEQ ID NO: 39756 - RNA, 16 nt, Artificial Sequence
  Synthetic Oligonucleotide; PDCD1LG2 exon 2; Set C
uugugaaacuuugcug

SEQ ID NO: 39757 - RNA, 15 nt, Artificial Sequence
  Synthetic Oligonucleotide; PDCD1LG2 exon 2; Set C
uugugaaacuuugcu

SEQ ID NO: 39758 - RNA, 19 nt, Artificial Sequence
  Synthetic Oligonucleotide; PDCD1LG2 exon 2; Set C
ccuugugaaacuuugcugg

SEQ ID NO: 39759 - RNA, 17 nt, Artificial Sequence
  Synthetic Oligonucleotide; PDCD1LG2 exon 2; Set C
cuugugaaacuuugcug

SEQ ID NO: 39760 - RNA, 16 nt, Artificial Sequence
  Synthetic Oligonucleotide; PDCD1LG2 exon 2; Set C
cuugugaaacuuugcu

SEQ ID NO: 39761 - RNA, 20 nt, Artificial Sequence
  Synthetic Oligonucleotide; PDCD1LG2 exon 2; Set C
gccuugugaaacuuugcugg

SEQ ID NO: 39762 - RNA, 18 nt, Artificial Sequence
  Synthetic Oligonucleotide; PDCD1LG2 exon 2; Set C
ccuugugaaacuuugcug

SEQ ID NO: 39763 - RNA, 17 nt, Artificial Sequence
  Synthetic Oligonucleotide; PDCD1LG2 exon 2; Set C
ccuugugaaacuuugcu

SEQ ID NO: 39764 - RNA, 21 nt, Artificial Sequence
  Synthetic Oligonucleotide; PDCD1LG2 exon 2; Set A
ggccuugugaaacuuugcugg

SEQ ID NO: 39765 - RNA, 19 nt, Artificial Sequence
  Synthetic Oligonucleotide; PDCD1LG2 exon 2; Set C
gccuugugaaacuuugcug

SEQ ID NO: 39766 - RNA, 18 nt, Artificial Sequence
  Synthetic Oligonucleotide; PDCD1LG2 exon 2; Set C
gccuugugaaacuuugcu

SEQ ID NO: 39767 - RNA, 22 nt, Artificial Sequence
  Synthetic Oligonucleotide; PDCD1LG2 exon 2; Set A
gggccuugugaaacuuugcugg

SEQ ID NO: 39768 - RNA, 20 nt, Artificial Sequence
  Synthetic Oligonucleotide; PDCD1LG2 exon 2; Set C
ggccuugugaaacuuugcug

SEQ ID NO: 39769 - RNA, 19 nt, Artificial Sequence
  Synthetic Oligonucleotide; PDCD1LG2 exon 2; Set C
ggccuugugaaacuuugcu

SEQ ID NO: 39770 - RNA, 21 nt, Artificial Sequence
  Synthetic Oligonucleotide; PDCD1LG2 exon 2; Set A
gggccuugugaaacuuugcug

SEQ ID NO: 39771 - RNA, 20 nt, Artificial Sequence
  Synthetic Oligonucleotide; PDCD1LG2 exon 2; Set A
gggccuugugaaacuuugcu

SEQ ID NO: 39772 - RNA, 19 nt, Artificial Sequence
  Synthetic Oligonucleotide; PDCD1LG2 exon 2; Set C
gaagaucauguucuguauu

SEQ ID NO: 39773 - RNA, 20 nt, Artificial Sequence
  Synthetic Oligonucleotide; PDCD1LG2 exon 2; Set C
ggaagaucauguucuguauu

SEQ ID NO: 39774 - RNA, 18 nt, Artificial Sequence
  Synthetic Oligonucleotide; PDCD1LG2 exon 2; Set C
gaagaucauguucuguau

SEQ ID NO: 39775 - RNA, 21 nt, Artificial Sequence
  Synthetic Oligonucleotide; PDCD1LG2 exon 2; Set C
aggaagaucauguucuguauu

SEQ ID NO: 39776 - RNA, 19 nt, Artificial Sequence
  Synthetic Oligonucleotide; PDCD1LG2 exon 2; Set C
ggaagaucauguucuguau

SEQ ID NO: 39777 - RNA, 17 nt, Artificial Sequence
  Synthetic Oligonucleotide; PDCD1LG2 exon 2; Set C
gaagaucauguucugua

SEQ ID NO: 39778 - RNA, 20 nt, Artificial Sequence
  Synthetic Oligonucleotide; PDCD1LG2 exon 2; Set C
aggaagaucauguucuguau

SEQ ID NO: 39779 - RNA, 18 nt, Artificial Sequence
  Synthetic Oligonucleotide; PDCD1LG2 exon 2; Set C
ggaagaucauguucugua

SEQ ID NO: 39780 - RNA, 16 nt, Artificial Sequence
  Synthetic Oligonucleotide; PDCD1LG2 exon 2; Set C
gaagaucauguucugu

SEQ ID NO: 39781 - RNA, 19 nt, Artificial Sequence
  Synthetic Oligonucleotide; PDCD1LG2 exon 2; Set C
aggaagaucauguucugua

SEQ ID NO: 39782 - RNA, 17 nt, Artificial Sequence
  Synthetic Oligonucleotide; PDCD1LG2 exon 2; Set C
ggaagaucauguucugu

SEQ ID NO: 39783 - RNA, 18 nt, Artificial Sequence
  Synthetic Oligonucleotide; PDCD1LG2 exon 2; Set C
aggaagaucauguucugu

SEQ ID NO: 39784 - RNA, 16 nt, Artificial Sequence
  Synthetic Oligonucleotide; PDCD1LG2 exon 2; Set C
ggaagaucauguucug

SEQ ID NO: 39785 - RNA, 17 nt, Artificial Sequence
  Synthetic Oligonucleotide; PDCD1LG2 exon 2; Set C
aggaagaucauguucug

SEQ ID NO: 39786 - RNA, 16 nt, Artificial Sequence
  Synthetic Oligonucleotide; PDCD1LG2 exon 2; Set C
aggaagaucauguucu

SEQ ID NO: 39787 - RNA, 15 nt, Artificial Sequence
  Synthetic Oligonucleotide; PDCD1LG2 exon 2; Set C
aggaagaucauguuc

SEQ ID NO: 39788 - RNA, 28 nt, Artificial Sequence
  Synthetic Oligonucleotide; PDCD1LG2 exon 2; Set B
cuuaagccucucccuuuguccuuucuua

SEQ ID NO: 39789 - RNA, 29 nt, Artificial Sequence
  Synthetic Oligonucleotide; PDCD1LG2 exon 2; Set B
ucuuaagccucucccuuuguccuuucuua

SEQ ID NO: 39790 - RNA, 30 nt, Artificial Sequence
  Synthetic Oligonucleotide; PDCD1LG2 exon 2; Set B
uucuuaagccucucccuuuguccuuucuua

SEQ ID NO: 39791 - RNA, 31 nt, Artificial Sequence
  Synthetic Oligonucleotide; PDCD1LG2 exon 2; Set B
uuucuuaagccucucccuuuguccuuucuua

SEQ ID NO: 39792 - RNA, 32 nt, Artificial Sequence
  Synthetic Oligonucleotide; PDCD1LG2 exon 2; Set B
cuuucuuaagccucucccuuuguccuuucuua

SEQ ID NO: 39793 - RNA, 33 nt, Artificial Sequence
  Synthetic Oligonucleotide; PDCD1LG2 exon 2; Set C
ucuuucuuaagccucucccuuuguccuuucuua

SEQ ID NO: 39794 - RNA, 34 nt, Artificial Sequence
  Synthetic Oligonucleotide; PDCD1LG2 exon 2; Set C
uucuuucuuaagccucucccuuuguccuuucuua

SEQ ID NO: 39795 - RNA, 22 nt, Artificial Sequence
  Synthetic Oligonucleotide; PDCD1LG2 exon 2; Set C
uuucuuaagccucucccuuugu

SEQ ID NO: 39796 - RNA, 23 nt, Artificial Sequence
  Synthetic Oligonucleotide; PDCD1LG2 exon 2; Set B
cuuucuuaagccucucccuuugu

SEQ ID NO: 39797 - RNA, 24 nt, Artificial Sequence
  Synthetic Oligonucleotide; PDCD1LG2 exon 2; Set B
ucuuucuuaagccucucccuuugu

SEQ ID NO: 39798 - RNA, 25 nt, Artificial Sequence
  Synthetic Oligonucleotide; PDCD1LG2 exon 2; Set B
uucuuucuuaagccucucccuuugu

SEQ ID NO: 39799 - RNA, 20 nt, Artificial Sequence
  Synthetic Oligonucleotide; PDCD1LG2 exon 2; Set C
uugugaaacuuugcuggguc

SEQ ID NO: 39800 - RNA, 21 nt, Artificial Sequence
  Synthetic Oligonucleotide; PDCD1LG2 exon 2; Set C
cuugugaaacuuugcuggguc

SEQ ID NO: 39801 - RNA, 18 nt, Artificial Sequence
  Synthetic Oligonucleotide; PDCD1LG2 exon 2; Set C
uugugaaacuuugcuggg

SEQ ID NO: 39802 - RNA, 22 nt, Artificial Sequence
  Synthetic Oligonucleotide; PDCD1LG2 exon 2; Set A
ccuugugaaacuuugcuggguc

SEQ ID NO: 39803 - RNA, 20 nt, Artificial Sequence
  Synthetic Oligonucleotide; PDCD1LG2 exon 2; Set C
cuugugaaacuuugcugggu

SEQ ID NO: 39804 - RNA, 19 nt, Artificial Sequence
  Synthetic Oligonucleotide; PDCD1LG2 exon 2; Set C
cuugugaaacuuugcuggg

SEQ ID NO: 39805 - RNA, 23 nt, Artificial Sequence
  Synthetic Oligonucleotide; PDCD1LG2 exon 2; Set A
gccuugugaaacuuugcuggguc

SEQ ID NO: 39806 - RNA, 21 nt, Artificial Sequence
  Synthetic Oligonucleotide; PDCD1LG2 exon 2; Set C
ccuugugaaacuuugcugggu

SEQ ID NO: 39807 - RNA, 20 nt, Artificial Sequence
  Synthetic Oligonucleotide; PDCD1LG2 exon 2; Set C
ccuugugaaacuuugcuggg

SEQ ID NO: 39808 - RNA, 24 nt, Artificial Sequence
  Synthetic Oligonucleotide; PDCD1LG2 exon 2; Set A
ggccuugugaaacuuugcuggguc

SEQ ID NO: 39809 - RNA, 22 nt, Artificial Sequence
  Synthetic Oligonucleotide; PDCD1LG2 exon 2; Set A
gccuugugaaacuuugcugggu

SEQ ID NO: 39810 - RNA, 21 nt, Artificial Sequence
  Synthetic Oligonucleotide; PDCD1LG2 exon 2; Set A
gccuugugaaacuuugcuggg

SEQ ID NO: 39811 - RNA, 25 nt, Artificial Sequence
  Synthetic Oligonucleotide; PDCD1LG2 exon 2; Set C
gggccuugugaaacuuugcuggguc

SEQ ID NO: 39812 - RNA, 23 nt, Artificial Sequence
  Synthetic Oligonucleotide; PDCD1LG2 exon 2; Set A
ggccuugugaaacuuugcugggu

SEQ ID NO: 39813 - RNA, 22 nt, Artificial Sequence
  Synthetic Oligonucleotide; PDCD1LG2 exon 2; Set A
ggccuugugaaacuuugcuggg

SEQ ID NO: 39814 - RNA, 24 nt, Artificial Sequence
  Synthetic Oligonucleotide; PDCD1LG2 exon 2; Set A
gggccuugugaaacuuugcugggu

SEQ ID NO: 39815 - RNA, 23 nt, Artificial Sequence
  Synthetic Oligonucleotide; PDCD1LG2 exon 2; Set A
gggccuugugaaacuuugcuggg

SEQ ID NO: 39816 - RNA, 34 nt, Artificial Sequence
  Synthetic Oligonucleotide; PDCD1LG2 exon 2; Set C
uugaaagucucagggccuugugaaacuuugcugg

SEQ ID NO: 39817 - RNA, 35 nt, Artificial Sequence
  Synthetic Oligonucleotide; PDCD1LG2 exon 2; Set C
auugaaagucucagggccuugugaaacuuugcugg

SEQ ID NO: 39818 - RNA, 33 nt, Artificial Sequence
  Synthetic Oligonucleotide; PDCD1LG2 exon 2; Set A
uugaaagucucagggccuugugaaacuuugcug

SEQ ID NO: 39819 - RNA, 32 nt, Artificial Sequence
  Synthetic Oligonucleotide; PDCD1LG2 exon 2; Set A
uugaaagucucagggccuugugaaacuuugcu

SEQ ID NO: 39820 - RNA, 36 nt, Artificial Sequence
  Synthetic Oligonucleotide; PDCD1LG2 exon 2; Set A
aauugaaagucucagggccuugugaaacuuugcugg

SEQ ID NO: 39821 - RNA, 34 nt, Artificial Sequence
  Synthetic Oligonucleotide; PDCD1LG2 exon 2; Set A
auugaaagucucagggccuugugaaacuuugcug

SEQ ID NO: 39822 - RNA, 33 nt, Artificial Sequence
  Synthetic Oligonucleotide; PDCD1LG2 exon 2; Set A
auugaaagucucagggccuugugaaacuuugcu

SEQ ID NO: 39823 - RNA, 35 nt, Artificial Sequence
  Synthetic Oligonucleotide; PDCD1LG2 exon 2; Set A
aauugaaagucucagggccuugugaaacuuugcug

SEQ ID NO: 39824 - RNA, 34 nt, Artificial Sequence
  Synthetic Oligonucleotide; PDCD1LG2 exon 2; Set A
aauugaaagucucagggccuugugaaacuuugcu

SEQ ID NO: 39825 - RNA, 20 nt, Artificial Sequence
  Synthetic Oligonucleotide; PDCD1LG2 exon 2; Set C
uugaaagucucagggccuug

SEQ ID NO: 39826 - RNA, 21 nt, Artificial Sequence
  Synthetic Oligonucleotide; PDCD1LG2 exon 2; Set C
auugaaagucucagggccuug

SEQ ID NO: 39827 - RNA, 19 nt, Artificial Sequence
  Synthetic Oligonucleotide; PDCD1LG2 exon 2; Set C
uugaaagucucagggccuu

SEQ ID NO: 39828 - RNA, 22 nt, Artificial Sequence
  Synthetic Oligonucleotide; PDCD1LG2 exon 2; Set C
aauugaaagucucagggccuug

SEQ ID NO: 39829 - RNA, 20 nt, Artificial Sequence
  Synthetic Oligonucleotide; PDCD1LG2 exon 2; Set C
auugaaagucucagggccuu

SEQ ID NO: 39830 - RNA, 18 nt, Artificial Sequence
  Synthetic Oligonucleotide; PDCD1LG2 exon 2; Set C
uugaaagucucagggccu

SEQ ID NO: 39831 - RNA, 19 nt, Artificial Sequence
  Synthetic Oligonucleotide; PDCD1LG2 exon 2; Set C
auugaaagucucagggccu

SEQ ID NO: 39832 - RNA, 17 nt, Artificial Sequence
  Synthetic Oligonucleotide; PDCD1LG2 exon 2; Set C
uugaaagucucagggcc

SEQ ID NO: 39833 - RNA, 21 nt, Artificial Sequence
  Synthetic Oligonucleotide; PDCD1LG2 exon 2; Set C
aauugaaagucucagggccuu

SEQ ID NO: 39834 - RNA, 18 nt, Artificial Sequence
  Synthetic Oligonucleotide; PDCD1LG2 exon 2; Set C
auugaaagucucagggcc

SEQ ID NO: 39835 - RNA, 16 nt, Artificial Sequence
  Synthetic Oligonucleotide; PDCD1LG2 exon 2; Set C
uugaaagucucagggc

SEQ ID NO: 39836 - RNA, 20 nt, Artificial Sequence
  Synthetic Oligonucleotide; PDCD1LG2 exon 2; Set C
aauugaaagucucagggccu

SEQ ID NO: 39837 - RNA, 17 nt, Artificial Sequence
  Synthetic Oligonucleotide; PDCD1LG2 exon 2; Set C
auugaaagucucagggc

SEQ ID NO: 39838 - RNA, 15 nt, Artificial Sequence
  Synthetic Oligonucleotide; PDCD1LG2 exon 2; Set C
uugaaagucucaggg

SEQ ID NO: 39839 - RNA, 19 nt, Artificial Sequence
  Synthetic Oligonucleotide; PDCD1LG2 exon 2; Set C
aauugaaagucucagggcc

SEQ ID NO: 39840 - RNA, 16 nt, Artificial Sequence
  Synthetic Oligonucleotide; PDCD1LG2 exon 2; Set C
auugaaagucucaggg

SEQ ID NO: 39841 - RNA, 18 nt, Artificial Sequence
  Synthetic Oligonucleotide; PDCD1LG2 exon 2; Set C
aauugaaagucucagggc

SEQ ID NO: 39842 - RNA, 17 nt, Artificial Sequence
  Synthetic Oligonucleotide; PDCD1LG2 exon 2; Set C
aauugaaagucucaggg

SEQ ID NO: 39843 - RNA, 29 nt, Artificial Sequence
  Synthetic Oligonucleotide; PDCD1LG2 exon 2; Set A
aauagacaauugaaagucucagggccuug

SEQ ID NO: 39844 - RNA, 30 nt, Artificial Sequence
  Synthetic Oligonucleotide; PDCD1LG2 exon 2; Set A
aaauagacaauugaaagucucagggccuug

SEQ ID NO: 39845 - RNA, 28 nt, Artificial Sequence
  Synthetic Oligonucleotide; PDCD1LG2 exon 2; Set A
aauagacaauugaaagucucagggccuu

SEQ ID NO: 39846 - RNA, 29 nt, Artificial Sequence
  Synthetic Oligonucleotide; PDCD1LG2 exon 2; Set A
aaauagacaauugaaagucucagggccuu

SEQ ID NO: 39847 - RNA, 28 nt, Artificial Sequence
  Synthetic Oligonucleotide; PDCD1LG2 exon 2; Set A
aaauagacaauugaaagucucagggccu

SEQ ID NO: 39848 - RNA, 28 nt, Artificial Sequence
  Synthetic Oligonucleotide; PDCD1LG2 exon 2; Set C
ucuguauuugaucugaaauagacaauug

SEQ ID NO: 39849 - RNA, 29 nt, Artificial Sequence
  Synthetic Oligonucleotide; PDCD1LG2 exon 2; Set C
uucuguauuugaucugaaauagacaauug

SEQ ID NO: 39850 - RNA, 28 nt, Artificial Sequence
  Synthetic Oligonucleotide; PDCD1LG2 exon 2; Set C
uucuguauuugaucugaaauagacaauu

SEQ ID NO: 39851 - RNA, 30 nt, Artificial Sequence
  Synthetic Oligonucleotide; PDCD1LG2 exon 2; Set C
guucuguauuugaucugaaauagacaauug

SEQ ID NO: 39852 - RNA, 29 nt, Artificial Sequence
  Synthetic Oligonucleotide; PDCD1LG2 exon 2; Set C
guucuguauuugaucugaaauagacaauu

SEQ ID NO: 39853 - RNA, 31 nt, Artificial Sequence
  Synthetic Oligonucleotide; PDCD1LG2 exon 2; Set C
uguucuguauuugaucugaaauagacaauug

SEQ ID NO: 39854 - RNA, 30 nt, Artificial Sequence
  Synthetic Oligonucleotide; PDCD1LG2 exon 2; Set C
uguucuguauuugaucugaaauagacaauu

SEQ ID NO: 39855 - RNA, 28 nt, Artificial Sequence
  Synthetic Oligonucleotide; PDCD1LG2 exon 2; Set C
guucuguauuugaucugaaauagacaau

SEQ ID NO: 39856 - RNA, 29 nt, Artificial Sequence
  Synthetic Oligonucleotide; PDCD1LG2 exon 2; Set C
uguucuguauuugaucugaaauagacaau

SEQ ID NO: 39857 - RNA, 17 nt, Artificial Sequence
  Synthetic Oligonucleotide; PDCD1LG2 exon 2; Set C
uguauuugaucugaaau

SEQ ID NO: 39858 - RNA, 18 nt, Artificial Sequence
  Synthetic Oligonucleotide; PDCD1LG2 exon 2; Set C
cuguauuugaucugaaau

SEQ ID NO: 39859 - RNA, 19 nt, Artificial Sequence
  Synthetic Oligonucleotide; PDCD1LG2 exon 2; Set C
ucuguauuugaucugaaau

SEQ ID NO: 39860 - RNA, 17 nt, Artificial Sequence
  Synthetic Oligonucleotide; PDCD1LG2 exon 2; Set C
cuguauuugaucugaaa

SEQ ID NO: 39861 - RNA, 20 nt, Artificial Sequence
  Synthetic Oligonucleotide; PDCD1LG2 exon 2; Set C
uucuguauuugaucugaaau

SEQ ID NO: 39862 - RNA, 18 nt, Artificial Sequence
  Synthetic Oligonucleotide; PDCD1LG2 exon 2; Set C
ucuguauuugaucugaaa

SEQ ID NO: 39863 - RNA, 19 nt, Artificial Sequence
  Synthetic Oligonucleotide; PDCD1LG2 exon 2; Set C
uucuguauuugaucugaaa

SEQ ID NO: 39864 - RNA, 21 nt, Artificial Sequence
  Synthetic Oligonucleotide; PDCD1LG2 exon 2; Set C
guucuguauuugaucugaaau

SEQ ID NO: 39865 - RNA, 22 nt, Artificial Sequence
  Synthetic Oligonucleotide; PDCD1LG2 exon 2; Set C
uguucuguauuugaucugaaau

SEQ ID NO: 39866 - RNA, 20 nt, Artificial Sequence
  Synthetic Oligonucleotide; PDCD1LG2 exon 2; Set C
guucuguauuugaucugaaa

SEQ ID NO: 39867 - RNA, 21 nt, Artificial Sequence
  Synthetic Oligonucleotide; PDCD1LG2 exon 2; Set C
uguucuguauuugaucugaaa

SEQ ID NO: 39868 - RNA, 40 nt, Artificial Sequence
  Synthetic Oligonucleotide; PDCD1LG2 exon 2; Set A
aggaagaucauguucuguauuugaucugaaauagacaauu

SEQ ID NO: 39869 - RNA, 39 nt, Artificial Sequence
  Synthetic Oligonucleotide; PDCD1LG2 exon 2; Set A
aggaagaucauguucuguauuugaucugaaauagacaau

SEQ ID NO: 39870 - RNA, 31 nt, Artificial Sequence
  Synthetic Oligonucleotide; PDCD1LG2 exon 2; Set C
ggaagaucauguucuguauuugaucugaaau

SEQ ID NO: 39871 - RNA, 32 nt, Artificial Sequence
  Synthetic Oligonucleotide; PDCD1LG2 exon 2; Set C
aggaagaucauguucuguauuugaucugaaau

SEQ ID NO: 39872 - RNA, 31 nt, Artificial Sequence
  Synthetic Oligonucleotide; PDCD1LG2 exon 2; Set C
aggaagaucauguucuguauuugaucugaaa

SEQ ID NO: 39873 - RNA, 15 nt, Artificial Sequence
  Synthetic Oligonucleotide; PDCD1LG2 exon 2; Set C
gaagaucauguucug

SEQ ID NO: 39874 - RNA, 15 nt, Artificial Sequence
  Synthetic Oligonucleotide; PDCD1LG2 exon 2; Set C
ggaagaucauguucu

SEQ ID NO: 39875 - RNA, 26 nt, Artificial Sequence
  Synthetic Oligonucleotide; PDCD1LG2 exon 2; Set B
uaagccucucccuuuguccuuucuua

SEQ ID NO: 39876 - RNA, 27 nt, Artificial Sequence
  Synthetic Oligonucleotide; PDCD1LG2 exon 2; Set B
uuaagccucucccuuuguccuuucuua

SEQ ID NO: 39877 - RNA, 35 nt, Artificial Sequence
  Synthetic Oligonucleotide; PDCD1LG2 exon 2; Set C
cuucuuucuuaagccucucccuuuguccuuucuua

SEQ ID NO: 39878 - RNA, 36 nt, Artificial Sequence
  Synthetic Oligonucleotide; PDCD1LG2 exon 2; Set C
ucuucuuucuuaagccucucccuuuguccuuucuua

SEQ ID NO: 39879 - RNA, 19 nt, Artificial Sequence
  Synthetic Oligonucleotide; PDCD1LG2 exon 2; Set C
cuuaagccucucccuuugu

SEQ ID NO: 39880 - RNA, 20 nt, Artificial Sequence
  Synthetic Oligonucleotide; PDCD1LG2 exon 2; Set C
ucuuaagccucucccuuugu

SEQ ID NO: 39881 - RNA, 18 nt, Artificial Sequence
  Synthetic Oligonucleotide; PDCD1LG2 exon 2; Set C
cuuaagccucucccuuug

SEQ ID NO: 39882 - RNA, 21 nt, Artificial Sequence
  Synthetic Oligonucleotide; PDCD1LG2 exon 2; Set C
uucuuaagccucucccuuugu

SEQ ID NO: 39883 - RNA, 19 nt, Artificial Sequence
  Synthetic Oligonucleotide; PDCD1LG2 exon 2; Set C
ucuuaagccucucccuuug

SEQ ID NO: 39884 - RNA, 20 nt, Artificial Sequence
  Synthetic Oligonucleotide; PDCD1LG2 exon 2; Set C
uucuuaagccucucccuuug

SEQ ID NO: 39885 - RNA, 18 nt, Artificial Sequence
  Synthetic Oligonucleotide; PDCD1LG2 exon 2; Set C
ucuuaagccucucccuuu

SEQ ID NO: 39886 - RNA, 21 nt, Artificial Sequence
  Synthetic Oligonucleotide; PDCD1LG2 exon 2; Set C
uuucuuaagccucucccuuug

SEQ ID NO: 39887 - RNA, 19 nt, Artificial Sequence
  Synthetic Oligonucleotide; PDCD1LG2 exon 2; Set C
uucuuaagccucucccuuu

SEQ ID NO: 39888 - RNA, 22 nt, Artificial Sequence
  Synthetic Oligonucleotide; PDCD1LG2 exon 2; Set C
cuuucuuaagccucucccuuug

SEQ ID NO: 39889 - RNA, 20 nt, Artificial Sequence
  Synthetic Oligonucleotide; PDCD1LG2 exon 2; Set C
uuucuuaagccucucccuuu

SEQ ID NO: 39890 - RNA, 23 nt, Artificial Sequence
  Synthetic Oligonucleotide; PDCD1LG2 exon 2; Set C
ucuuucuuaagccucucccuuug

SEQ ID NO: 39891 - RNA, 21 nt, Artificial Sequence
  Synthetic Oligonucleotide; PDCD1LG2 exon 2; Set C
cuuucuuaagccucucccuuu

SEQ ID NO: 39892 - RNA, 26 nt, Artificial Sequence
  Synthetic Oligonucleotide; PDCD1LG2 exon 2; Set B
cuucuuucuuaagccucucccuuugu

SEQ ID NO: 39893 - RNA, 24 nt, Artificial Sequence
  Synthetic Oligonucleotide; PDCD1LG2 exon 2; Set C
uucuuucuuaagccucucccuuug

SEQ ID NO: 39894 - RNA, 22 nt, Artificial Sequence
  Synthetic Oligonucleotide; PDCD1LG2 exon 2; Set C
ucuuucuuaagccucucccuuu

SEQ ID NO: 39895 - RNA, 27 nt, Artificial Sequence
  Synthetic Oligonucleotide; PDCD1LG2 exon 2; Set B
ucuucuuucuuaagccucucccuuugu

SEQ ID NO: 39896 - RNA, 23 nt, Artificial Sequence
  Synthetic Oligonucleotide; PDCD1LG2 exon 2; Set C
uucuuucuuaagccucucccuuu

SEQ ID NO: 39897 - RNA, 19 nt, Artificial Sequence
  Synthetic Oligonucleotide; PDCD1LG2 exon 2; Set C
uugugaaacuuugcugggu

SEQ ID NO: 39898 - RNA, 16 nt, Artificial Sequence
  Synthetic Oligonucleotide; PDCD1LG2 exon 2; Set C
ugugaaacuuugcugg

SEQ ID NO: 39899 - RNA, 15 nt, Artificial Sequence
  Synthetic Oligonucleotide; PDCD1LG2 exon 2; Set C
ugugaaacuuugcug

SEQ ID NO: 39900 - RNA, 37 nt, Artificial Sequence
  Synthetic Oligonucleotide; PDCD1LG2 exon 2; Set C
uugaaagucucagggccuugugaaacuuugcuggguc

SEQ ID NO: 39901 - RNA, 38 nt, Artificial Sequence
  Synthetic Oligonucleotide; PDCD1LG2 exon 2; Set C
auugaaagucucagggccuugugaaacuuugcuggguc

SEQ ID NO: 39902 - RNA, 36 nt, Artificial Sequence
  Synthetic Oligonucleotide; PDCD1LG2 exon 2; Set C
uugaaagucucagggccuugugaaacuuugcugggu

SEQ ID NO: 39903 - RNA, 35 nt, Artificial Sequence
  Synthetic Oligonucleotide; PDCD1LG2 exon 2; Set C
uugaaagucucagggccuugugaaacuuugcuggg

SEQ ID NO: 39904 - RNA, 39 nt, Artificial Sequence
  Synthetic Oligonucleotide; PDCD1LG2 exon 2; Set C
aauugaaagucucagggccuugugaaacuuugcuggguc

SEQ ID NO: 39905 - RNA, 37 nt, Artificial Sequence
  Synthetic Oligonucleotide; PDCD1LG2 exon 2; Set C
auugaaagucucagggccuugugaaacuuugcugggu

SEQ ID NO: 39906 - RNA, 36 nt, Artificial Sequence
  Synthetic Oligonucleotide; PDCD1LG2 exon 2; Set C
auugaaagucucagggccuugugaaacuuugcuggg

SEQ ID NO: 39907 - RNA, 38 nt, Artificial Sequence
  Synthetic Oligonucleotide; PDCD1LG2 exon 2; Set C
aauugaaagucucagggccuugugaaacuuugcugggu

SEQ ID NO: 39908 - RNA, 37 nt, Artificial Sequence
  Synthetic Oligonucleotide; PDCD1LG2 exon 2; Set C
aauugaaagucucagggccuugugaaacuuugcuggg

SEQ ID NO: 39909 - RNA, 21 nt, Artificial Sequence
  Synthetic Oligonucleotide; PDCD1LG2 exon 2; Set C
uugaaagucucagggccuugu

SEQ ID NO: 39910 - RNA, 22 nt, Artificial Sequence
  Synthetic Oligonucleotide; PDCD1LG2 exon 2; Set C
auugaaagucucagggccuugu

SEQ ID NO: 39911 - RNA, 23 nt, Artificial Sequence
  Synthetic Oligonucleotide; PDCD1LG2 exon 2; Set C
aauugaaagucucagggccuugu

SEQ ID NO: 39912 - RNA, 27 nt, Artificial Sequence
  Synthetic Oligonucleotide; PDCD1LG2 exon 2; Set A
aauagacaauugaaagucucagggccu

SEQ ID NO: 39913 - RNA, 26 nt, Artificial Sequence
  Synthetic Oligonucleotide; PDCD1LG2 exon 2; Set C
aauagacaauugaaagucucagggcc

SEQ ID NO: 39914 - RNA, 27 nt, Artificial Sequence
  Synthetic Oligonucleotide; PDCD1LG2 exon 2; Set C
aaauagacaauugaaagucucagggcc

SEQ ID NO: 39915 - RNA, 25 nt, Artificial Sequence
  Synthetic Oligonucleotide; PDCD1LG2 exon 2; Set C
aauagacaauugaaagucucagggc

SEQ ID NO: 39916 - RNA, 26 nt, Artificial Sequence
  Synthetic Oligonucleotide; PDCD1LG2 exon 2; Set C
aaauagacaauugaaagucucagggc

SEQ ID NO: 39917 - RNA, 24 nt, Artificial Sequence
  Synthetic Oligonucleotide; PDCD1LG2 exon 2; Set C
aauagacaauugaaagucucaggg

SEQ ID NO: 39918 - RNA, 25 nt, Artificial Sequence
  Synthetic Oligonucleotide; PDCD1LG2 exon 2; Set C
aaauagacaauugaaagucucaggg

SEQ ID NO: 39919 - RNA, 40 nt, Artificial Sequence
  Synthetic Oligonucleotide; PDCD1LG2 exon 2; Set A
auuugaucugaaauagacaauugaaagucucagggccuug

SEQ ID NO: 39920 - RNA, 39 nt, Artificial Sequence
  Synthetic Oligonucleotide; PDCD1LG2 exon 2; Set A
auuugaucugaaauagacaauugaaagucucagggccuu

SEQ ID NO: 39921 - RNA, 38 nt, Artificial Sequence
  Synthetic Oligonucleotide; PDCD1LG2 exon 2; Set A
auuugaucugaaauagacaauugaaagucucagggccu

SEQ ID NO: 39922 - RNA, 40 nt, Artificial Sequence
  Synthetic Oligonucleotide; PDCD1LG2 exon 2; Set A
uauuugaucugaaauagacaauugaaagucucagggccuu

SEQ ID NO: 39923 - RNA, 37 nt, Artificial Sequence
  Synthetic Oligonucleotide; PDCD1LG2 exon 2; Set A
auuugaucugaaauagacaauugaaagucucagggcc

SEQ ID NO: 39924 - RNA, 39 nt, Artificial Sequence
  Synthetic Oligonucleotide; PDCD1LG2 exon 2; Set A
uauuugaucugaaauagacaauugaaagucucagggccu

SEQ ID NO: 39925 - RNA, 36 nt, Artificial Sequence
  Synthetic Oligonucleotide; PDCD1LG2 exon 2; Set A
auuugaucugaaauagacaauugaaagucucagggc

SEQ ID NO: 39926 - RNA, 40 nt, Artificial Sequence
  Synthetic Oligonucleotide; PDCD1LG2 exon 2; Set A
guauuugaucugaaauagacaauugaaagucucagggccu

SEQ ID NO: 39927 - RNA, 38 nt, Artificial Sequence
  Synthetic Oligonucleotide; PDCD1LG2 exon 2; Set A
uauuugaucugaaauagacaauugaaagucucagggcc

SEQ ID NO: 39928 - RNA, 35 nt, Artificial Sequence
  Synthetic Oligonucleotide; PDCD1LG2 exon 2; Set A
auuugaucugaaauagacaauugaaagucucaggg

SEQ ID NO: 39929 - RNA, 39 nt, Artificial Sequence
  Synthetic Oligonucleotide; PDCD1LG2 exon 2; Set A
guauuugaucugaaauagacaauugaaagucucagggcc

SEQ ID NO: 39930 - RNA, 37 nt, Artificial Sequence
  Synthetic Oligonucleotide; PDCD1LG2 exon 2; Set A
uauuugaucugaaauagacaauugaaagucucagggc

SEQ ID NO: 39931 - RNA, 40 nt, Artificial Sequence
  Synthetic Oligonucleotide; PDCD1LG2 exon 2; Set A
uguauuugaucugaaauagacaauugaaagucucagggcc

SEQ ID NO: 39932 - RNA, 38 nt, Artificial Sequence
  Synthetic Oligonucleotide; PDCD1LG2 exon 2; Set A
guauuugaucugaaauagacaauugaaagucucagggc

SEQ ID NO: 39933 - RNA, 36 nt, Artificial Sequence
  Synthetic Oligonucleotide; PDCD1LG2 exon 2; Set A
uauuugaucugaaauagacaauugaaagucucaggg

SEQ ID NO: 39934 - RNA, 39 nt, Artificial Sequence
  Synthetic Oligonucleotide; PDCD1LG2 exon 2; Set A
uguauuugaucugaaauagacaauugaaagucucagggc

SEQ ID NO: 39935 - RNA, 37 nt, Artificial Sequence
  Synthetic Oligonucleotide; PDCD1LG2 exon 2; Set A
guauuugaucugaaauagacaauugaaagucucaggg

SEQ ID NO: 39936 - RNA, 40 nt, Artificial Sequence
  Synthetic Oligonucleotide; PDCD1LG2 exon 2; Set A
cuguauuugaucugaaauagacaauugaaagucucagggc

SEQ ID NO: 39937 - RNA, 38 nt, Artificial Sequence
  Synthetic Oligonucleotide; PDCD1LG2 exon 2; Set A
uguauuugaucugaaauagacaauugaaagucucaggg

SEQ ID NO: 39938 - RNA, 39 nt, Artificial Sequence
  Synthetic Oligonucleotide; PDCD1LG2 exon 2; Set A
cuguauuugaucugaaauagacaauugaaagucucaggg

SEQ ID NO: 39939 - RNA, 40 nt, Artificial Sequence
  Synthetic Oligonucleotide; PDCD1LG2 exon 2; Set A
ucuguauuugaucugaaauagacaauugaaagucucaggg

SEQ ID NO: 39940 - RNA, 23 nt, Artificial Sequence
  Synthetic Oligonucleotide; PDCD1LG2 exon 2; Set C
auuugaucugaaauagacaauug

SEQ ID NO: 39941 - RNA, 22 nt, Artificial Sequence
  Synthetic Oligonucleotide; PDCD1LG2 exon 2; Set C
auuugaucugaaauagacaauu

SEQ ID NO: 39942 - RNA, 24 nt, Artificial Sequence
  Synthetic Oligonucleotide; PDCD1LG2 exon 2; Set C
uauuugaucugaaauagacaauug

SEQ ID NO: 39943 - RNA, 23 nt, Artificial Sequence
  Synthetic Oligonucleotide; PDCD1LG2 exon 2; Set C
uauuugaucugaaauagacaauu

SEQ ID NO: 39944 - RNA, 25 nt, Artificial Sequence
  Synthetic Oligonucleotide; PDCD1LG2 exon 2; Set C
guauuugaucugaaauagacaauug

SEQ ID NO: 39945 - RNA, 21 nt, Artificial Sequence
  Synthetic Oligonucleotide; PDCD1LG2 exon 2; Set C
auuugaucugaaauagacaau

SEQ ID NO: 39946 - RNA, 24 nt, Artificial Sequence
  Synthetic Oligonucleotide; PDCD1LG2 exon 2; Set C
guauuugaucugaaauagacaauu

SEQ ID NO: 39947 - RNA, 26 nt, Artificial Sequence
  Synthetic Oligonucleotide; PDCD1LG2 exon 2; Set C
uguauuugaucugaaauagacaauug

SEQ ID NO: 39948 - RNA, 22 nt, Artificial Sequence
  Synthetic Oligonucleotide; PDCD1LG2 exon 2; Set C
uauuugaucugaaauagacaau

SEQ ID NO: 39949 - RNA, 25 nt, Artificial Sequence
  Synthetic Oligonucleotide; PDCD1LG2 exon 2; Set C
uguauuugaucugaaauagacaauu

SEQ ID NO: 39950 - RNA, 27 nt, Artificial Sequence
  Synthetic Oligonucleotide; PDCD1LG2 exon 2; Set C
cuguauuugaucugaaauagacaauug

SEQ ID NO: 39951 - RNA, 23 nt, Artificial Sequence
  Synthetic Oligonucleotide; PDCD1LG2 exon 2; Set C
guauuugaucugaaauagacaau

SEQ ID NO: 39952 - RNA, 26 nt, Artificial Sequence
  Synthetic Oligonucleotide; PDCD1LG2 exon 2; Set C
cuguauuugaucugaaauagacaauu

SEQ ID NO: 39953 - RNA, 24 nt, Artificial Sequence
  Synthetic Oligonucleotide; PDCD1LG2 exon 2; Set C
uguauuugaucugaaauagacaau

SEQ ID NO: 39954 - RNA, 27 nt, Artificial Sequence
  Synthetic Oligonucleotide; PDCD1LG2 exon 2; Set C
ucuguauuugaucugaaauagacaauu

SEQ ID NO: 39955 - RNA, 25 nt, Artificial Sequence
  Synthetic Oligonucleotide; PDCD1LG2 exon 2; Set C
cuguauuugaucugaaauagacaau

SEQ ID NO: 39956 - RNA, 26 nt, Artificial Sequence
  Synthetic Oligonucleotide; PDCD1LG2 exon 2; Set C
ucuguauuugaucugaaauagacaau

SEQ ID NO: 39957 - RNA, 27 nt, Artificial Sequence
  Synthetic Oligonucleotide; PDCD1LG2 exon 2; Set C
uucuguauuugaucugaaauagacaau

SEQ ID NO: 39958 - RNA, 32 nt, Artificial Sequence
  Synthetic Oligonucleotide; PDCD1LG2 exon 2; Set C
auguucuguauuugaucugaaauagacaauug

SEQ ID NO: 39959 - RNA, 31 nt, Artificial Sequence
  Synthetic Oligonucleotide; PDCD1LG2 exon 2; Set C
auguucuguauuugaucugaaauagacaauu

SEQ ID NO: 39960 - RNA, 33 nt, Artificial Sequence
  Synthetic Oligonucleotide; PDCD1LG2 exon 2; Set C
cauguucuguauuugaucugaaauagacaauug

SEQ ID NO: 39961 - RNA, 15 nt, Artificial Sequence
  Synthetic Oligonucleotide; PDCD1LG2 exon 2; Set C
uauuugaucugaaau

SEQ ID NO: 39962 - RNA, 32 nt, Artificial Sequence
  Synthetic Oligonucleotide; PDCD1LG2 exon 2; Set C
cauguucuguauuugaucugaaauagacaauu

SEQ ID NO: 39963 - RNA, 30 nt, Artificial Sequence
  Synthetic Oligonucleotide; PDCD1LG2 exon 2; Set C
auguucuguauuugaucugaaauagacaau

SEQ ID NO: 39964 - RNA, 16 nt, Artificial Sequence
  Synthetic Oligonucleotide; PDCD1LG2 exon 2; Set C
guauuugaucugaaau

SEQ ID NO: 39965 - RNA, 31 nt, Artificial Sequence
  Synthetic Oligonucleotide; PDCD1LG2 exon 2; Set C
cauguucuguauuugaucugaaauagacaau

SEQ ID NO: 39966 - RNA, 15 nt, Artificial Sequence
  Synthetic Oligonucleotide; PDCD1LG2 exon 2; Set C
guauuugaucugaaa

SEQ ID NO: 39967 - RNA, 16 nt, Artificial Sequence
  Synthetic Oligonucleotide; PDCD1LG2 exon 2; Set C
uguauuugaucugaaa

SEQ ID NO: 39968 - RNA, 39 nt, Artificial Sequence
  Synthetic Oligonucleotide; PDCD1LG2 exon 2; Set A
gaagaucauguucuguauuugaucugaaauagacaauug

SEQ ID NO: 39969 - RNA, 38 nt, Artificial Sequence
  Synthetic Oligonucleotide; PDCD1LG2 exon 2; Set A
gaagaucauguucuguauuugaucugaaauagacaauu

SEQ ID NO: 39970 - RNA, 40 nt, Artificial Sequence
  Synthetic Oligonucleotide; PDCD1LG2 exon 2; Set A
ggaagaucauguucuguauuugaucugaaauagacaauug

SEQ ID NO: 39971 - RNA, 39 nt, Artificial Sequence
  Synthetic Oligonucleotide; PDCD1LG2 exon 2; Set A
ggaagaucauguucuguauuugaucugaaauagacaauu

SEQ ID NO: 39972 - RNA, 37 nt, Artificial Sequence
  Synthetic Oligonucleotide; PDCD1LG2 exon 2; Set A
gaagaucauguucuguauuugaucugaaauagacaau

SEQ ID NO: 39973 - RNA, 23 nt, Artificial Sequence
  Synthetic Oligonucleotide; PDCD1LG2 exon 2; Set C
auguucuguauuugaucugaaau

SEQ ID NO: 39974 - RNA, 38 nt, Artificial Sequence
  Synthetic Oligonucleotide; PDCD1LG2 exon 2; Set A
ggaagaucauguucuguauuugaucugaaauagacaau

SEQ ID NO: 39975 - RNA, 24 nt, Artificial Sequence
  Synthetic Oligonucleotide; PDCD1LG2 exon 2; Set C
cauguucuguauuugaucugaaau

SEQ ID NO: 39976 - RNA, 22 nt, Artificial Sequence
  Synthetic Oligonucleotide; PDCD1LG2 exon 2; Set C
auguucuguauuugaucugaaa

SEQ ID NO: 39977 - RNA, 23 nt, Artificial Sequence
  Synthetic Oligonucleotide; PDCD1LG2 exon 2; Set C
cauguucuguauuugaucugaaa

SEQ ID NO: 39978 - RNA, 25 nt, Artificial Sequence
  Synthetic Oligonucleotide; PDCD1LG2 exon 2; Set C
ucauguucuguauuugaucugaaau

SEQ ID NO: 39979 - RNA, 24 nt, Artificial Sequence
  Synthetic Oligonucleotide; PDCD1LG2 exon 2; Set C
ucauguucuguauuugaucugaaa

SEQ ID NO: 39980 - RNA, 30 nt, Artificial Sequence
  Synthetic Oligonucleotide; PDCD1LG2 exon 2; Set C
gaagaucauguucuguauuugaucugaaau

SEQ ID NO: 39981 - RNA, 29 nt, Artificial Sequence
  Synthetic Oligonucleotide; PDCD1LG2 exon 2; Set C
gaagaucauguucuguauuugaucugaaa

SEQ ID NO: 39982 - RNA, 30 nt, Artificial Sequence
  Synthetic Oligonucleotide; PDCD1LG2 exon 2; Set C
ggaagaucauguucuguauuugaucugaaa

SEQ ID NO: 39983 - RNA, 40 nt, Artificial Sequence
  Synthetic Oligonucleotide; PDCD1LG2 exon 2; Set C
uuccaggcucaacauuagcaggaggaagaucauguucugu

SEQ ID NO: 39984 - RNA, 39 nt, Artificial Sequence
  Synthetic Oligonucleotide; PDCD1LG2 exon 2; Set C
uuccaggcucaacauuagcaggaggaagaucauguucug

SEQ ID NO: 39985 - RNA, 40 nt, Artificial Sequence
  Synthetic Oligonucleotide; PDCD1LG2 exon 2; Set C
auuccaggcucaacauuagcaggaggaagaucauguucug

SEQ ID NO: 39986 - RNA, 39 nt, Artificial Sequence
  Synthetic Oligonucleotide; PDCD1LG2 exon 2; Set C
auuccaggcucaacauuagcaggaggaagaucauguucu

SEQ ID NO: 39987 - RNA, 40 nt, Artificial Sequence
  Synthetic Oligonucleotide; PDCD1LG2 exon 2; Set C
aauuccaggcucaacauuagcaggaggaagaucauguucu

SEQ ID NO: 39988 - RNA, 39 nt, Artificial Sequence
  Synthetic Oligonucleotide; PDCD1LG2 exon 2; Set C
aauuccaggcucaacauuagcaggaggaagaucauguuc

SEQ ID NO: 39989 - RNA, 40 nt, Artificial Sequence
  Synthetic Oligonucleotide; PDCD1LG2 exon 2; Set C
caauuccaggcucaacauuagcaggaggaagaucauguuc

SEQ ID NO: 39990 - RNA, 38 nt, Artificial Sequence
  Synthetic Oligonucleotide; PDCD1LG2 exon 2; Set C
aauuccaggcucaacauuagcaggaggaagaucauguu

SEQ ID NO: 39991 - RNA, 39 nt, Artificial Sequence
  Synthetic Oligonucleotide; PDCD1LG2 exon 2; Set C
caauuccaggcucaacauuagcaggaggaagaucauguu

SEQ ID NO: 39992 - RNA, 38 nt, Artificial Sequence
  Synthetic Oligonucleotide; PDCD1LG2 exon 2; Set C
caauuccaggcucaacauuagcaggaggaagaucaugu

SEQ ID NO: 39993 - RNA, 38 nt, Artificial Sequence
  Synthetic Oligonucleotide; PDCD1LG2 exon 2; Set C
uguccuuucuuaccugcuaucuggugaagcugcaauuc

SEQ ID NO: 39994 - RNA, 24 nt, Artificial Sequence
  Synthetic Oligonucleotide; PDCD1LG2 exon 2; Set B
agccucucccuuuguccuuucuua

SEQ ID NO: 39995 - RNA, 25 nt, Artificial Sequence
  Synthetic Oligonucleotide; PDCD1LG2 exon 2; Set B
aagccucucccuuuguccuuucuua

SEQ ID NO: 39996 - RNA, 27 nt, Artificial Sequence
  Synthetic Oligonucleotide; PDCD1LG2 exon 2; Set B
cuuaagccucucccuuuguccuuucuu

SEQ ID NO: 39997 - RNA, 28 nt, Artificial Sequence
  Synthetic Oligonucleotide; PDCD1LG2 exon 2; Set B
ucuuaagccucucccuuuguccuuucuu

SEQ ID NO: 39998 - RNA, 26 nt, Artificial Sequence
  Synthetic Oligonucleotide; PDCD1LG2 exon 2; Set B
cuuaagccucucccuuuguccuuucu

SEQ ID NO: 39999 - RNA, 29 nt, Artificial Sequence
  Synthetic Oligonucleotide; PDCD1LG2 exon 2; Set B
uucuuaagccucucccuuuguccuuucuu

SEQ ID NO: 40000 - RNA, 27 nt, Artificial Sequence
  Synthetic Oligonucleotide; PDCD1LG2 exon 2; Set B
ucuuaagccucucccuuuguccuuucu

SEQ ID NO: 40001 - RNA, 30 nt, Artificial Sequence
  Synthetic Oligonucleotide; PDCD1LG2 exon 2; Set B
uuucuuaagccucucccuuuguccuuucuu

SEQ ID NO: 40002 - RNA, 28 nt, Artificial Sequence
  Synthetic Oligonucleotide; PDCD1LG2 exon 2; Set B
uucuuaagccucucccuuuguccuuucu

SEQ ID NO: 40003 - RNA, 24 nt, Artificial Sequence
  Synthetic Oligonucleotide; PDCD1LG2 exon 2; Set B
cuuaagccucucccuuuguccuuu

SEQ ID NO: 40004 - RNA, 29 nt, Artificial Sequence
  Synthetic Oligonucleotide; PDCD1LG2 exon 2; Set B
uuucuuaagccucucccuuuguccuuucu

SEQ ID NO: 40005 - RNA, 31 nt, Artificial Sequence
  Synthetic Oligonucleotide; PDCD1LG2 exon 2; Set B
cuuucuuaagccucucccuuuguccuuucuu

SEQ ID NO: 40006 - RNA, 25 nt, Artificial Sequence
  Synthetic Oligonucleotide; PDCD1LG2 exon 2; Set B
ucuuaagccucucccuuuguccuuu

SEQ ID NO: 40007 - RNA, 16 nt, Artificial Sequence
  Synthetic Oligonucleotide; PDCD1LG2 exon 2; Set C
aagccucucccuuugu

SEQ ID NO: 40008 - RNA, 32 nt, Artificial Sequence
  Synthetic Oligonucleotide; PDCD1LG2 exon 2; Set B
ucuuucuuaagccucucccuuuguccuuucuu

SEQ ID NO: 40009 - RNA, 30 nt, Artificial Sequence
  Synthetic Oligonucleotide; PDCD1LG2 exon 2; Set B
cuuucuuaagccucucccuuuguccuuucu

SEQ ID NO: 40010 - RNA, 26 nt, Artificial Sequence
  Synthetic Oligonucleotide; PDCD1LG2 exon 2; Set B
uucuuaagccucucccuuuguccuuu

SEQ ID NO: 40011 - RNA, 28 nt, Artificial Sequence
  Synthetic Oligonucleotide; PDCD1LG2 exon 2; Set B
uuucuuaagccucucccuuuguccuuuc

SEQ ID NO: 40012 - RNA, 17 nt, Artificial Sequence
  Synthetic Oligonucleotide; PDCD1LG2 exon 2; Set C
uaagccucucccuuugu

SEQ ID NO: 40013 - RNA, 31 nt, Artificial Sequence
  Synthetic Oligonucleotide; PDCD1LG2 exon 2; Set B
ucuuucuuaagccucucccuuuguccuuucu

SEQ ID NO: 40014 - RNA, 33 nt, Artificial Sequence
  Synthetic Oligonucleotide; PDCD1LG2 exon 2; Set B
uucuuucuuaagccucucccuuuguccuuucuu

SEQ ID NO: 40015 - RNA, 27 nt, Artificial Sequence
  Synthetic Oligonucleotide; PDCD1LG2 exon 2; Set B
uuucuuaagccucucccuuuguccuuu

SEQ ID NO: 40016 - RNA, 29 nt, Artificial Sequence
  Synthetic Oligonucleotide; PDCD1LG2 exon 2; Set B
cuuucuuaagccucucccuuuguccuuuc

SEQ ID NO: 40017 - RNA, 18 nt, Artificial Sequence
  Synthetic Oligonucleotide; PDCD1LG2 exon 2; Set C
uuaagccucucccuuugu

SEQ ID NO: 40018 - RNA, 32 nt, Artificial Sequence
  Synthetic Oligonucleotide; PDCD1LG2 exon 2; Set B
uucuuucuuaagccucucccuuuguccuuucu

SEQ ID NO: 40019 - RNA, 20 nt, Artificial Sequence
  Synthetic Oligonucleotide; PDCD1LG2 exon 2; Set C
cuuaagccucucccuuuguc

SEQ ID NO: 40020 - RNA, 28 nt, Artificial Sequence
  Synthetic Oligonucleotide; PDCD1LG2 exon 2; Set B
cuuucuuaagccucucccuuuguccuuu

SEQ ID NO: 40021 - RNA, 30 nt, Artificial Sequence
  Synthetic Oligonucleotide; PDCD1LG2 exon 2; Set B
ucuuucuuaagccucucccuuuguccuuuc

SEQ ID NO: 40022 - RNA, 37 nt, Artificial Sequence
  Synthetic Oligonucleotide; PDCD1LG2 exon 2; Set C
cucuucuuucuuaagccucucccuuuguccuuucuua

SEQ ID NO: 40023 - RNA, 17 nt, Artificial Sequence
  Synthetic Oligonucleotide; PDCD1LG2 exon 2; Set C
uuaagccucucccuuug

SEQ ID NO: 40024 - RNA, 21 nt, Artificial Sequence
  Synthetic Oligonucleotide; PDCD1LG2 exon 2; Set C
ucuuaagccucucccuuuguc

SEQ ID NO: 40025 - RNA, 29 nt, Artificial Sequence
  Synthetic Oligonucleotide; PDCD1LG2 exon 2; Set B
ucuuucuuaagccucucccuuuguccuuu

SEQ ID NO: 40026 - RNA, 31 nt, Artificial Sequence
  Synthetic Oligonucleotide; PDCD1LG2 exon 2; Set B
uucuuucuuaagccucucccuuuguccuuuc

SEQ ID NO: 40027 - RNA, 38 nt, Artificial Sequence
  Synthetic Oligonucleotide; PDCD1LG2 exon 2; Set C
gcucuucuuucuuaagccucucccuuuguccuuucuua

SEQ ID NO: 40028 - RNA, 16 nt, Artificial Sequence
  Synthetic Oligonucleotide; PDCD1LG2 exon 2; Set C
uuaagccucucccuuu

SEQ ID NO: 40029 - RNA, 22 nt, Artificial Sequence
  Synthetic Oligonucleotide; PDCD1LG2 exon 2; Set C
uucuuaagccucucccuuuguc

SEQ ID NO: 40030 - RNA, 30 nt, Artificial Sequence
  Synthetic Oligonucleotide; PDCD1LG2 exon 2; Set B
uucuuucuuaagccucucccuuuguccuuu

SEQ ID NO: 40031 - RNA, 39 nt, Artificial Sequence
  Synthetic Oligonucleotide; PDCD1LG2 exon 2; Set C
ugcucuucuuucuuaagccucucccuuuguccuuucuua

SEQ ID NO: 40032 - RNA, 17 nt, Artificial Sequence
  Synthetic Oligonucleotide; PDCD1LG2 exon 2; Set C
cuuaagccucucccuuu

SEQ ID NO: 40033 - RNA, 23 nt, Artificial Sequence
  Synthetic Oligonucleotide; PDCD1LG2 exon 2; Set C
uuucuuaagccucucccuuuguc

SEQ ID NO: 40034 - RNA, 24 nt, Artificial Sequence
  Synthetic Oligonucleotide; PDCD1LG2 exon 2; Set B
cuuucuuaagccucucccuuuguc

SEQ ID NO: 40035 - RNA, 25 nt, Artificial Sequence
  Synthetic Oligonucleotide; PDCD1LG2 exon 2; Set B
ucuuucuuaagccucucccuuuguc

SEQ ID NO: 40036 - RNA, 26 nt, Artificial Sequence
  Synthetic Oligonucleotide; PDCD1LG2 exon 2; Set B
uucuuucuuaagccucucccuuuguc

SEQ ID NO: 40037 - RNA, 25 nt, Artificial Sequence
  Synthetic Oligonucleotide; PDCD1LG2 exon 2; Set B
cuucuuucuuaagccucucccuuug

SEQ ID NO: 40038 - RNA, 26 nt, Artificial Sequence
  Synthetic Oligonucleotide; PDCD1LG2 exon 2; Set B
ucuucuuucuuaagccucucccuuug

SEQ ID NO: 40039 - RNA, 24 nt, Artificial Sequence
  Synthetic Oligonucleotide; PDCD1LG2 exon 2; Set B
cuucuuucuuaagccucucccuuu

SEQ ID NO: 40040 - RNA, 29 nt, Artificial Sequence
  Synthetic Oligonucleotide; PDCD1LG2 exon 2; Set B
gcucuucuuucuuaagccucucccuuugu

SEQ ID NO: 40041 - RNA, 25 nt, Artificial Sequence
  Synthetic Oligonucleotide; PDCD1LG2 exon 2; Set B
ucuucuuucuuaagccucucccuuu

SEQ ID NO: 40042 - RNA, 30 nt, Artificial Sequence
  Synthetic Oligonucleotide; PDCD1LG2 exon 2; Set B
ugcucuucuuucuuaagccucucccuuugu

SEQ ID NO: 40043 - RNA, 15 nt, Artificial Sequence
  Synthetic Oligonucleotide; PDCD1LG2 exon 2; Set C
ucuucuuucuuaagc

SEQ ID NO: 40044 - RNA, 15 nt, Artificial Sequence
  Synthetic Oligonucleotide; PDCD1LG2 exon 2; Set C
cucuucuuucuuaag

SEQ ID NO: 40045 - RNA, 16 nt, Artificial Sequence
  Synthetic Oligonucleotide; PDCD1LG2 exon 2; Set C
gcucuucuuucuuaag

SEQ ID NO: 40046 - RNA, 15 nt, Artificial Sequence
  Synthetic Oligonucleotide; PDCD1LG2 exon 2; Set C
gcucuucuuucuuaa

SEQ ID NO: 40047 - RNA, 17 nt, Artificial Sequence
  Synthetic Oligonucleotide; PDCD1LG2 exon 2; Set C
ugcucuucuuucuuaag

SEQ ID NO: 40048 - RNA, 16 nt, Artificial Sequence
  Synthetic Oligonucleotide; PDCD1LG2 exon 2; Set C
ugcucuucuuucuuaa

SEQ ID NO: 40049 - RNA, 15 nt, Artificial Sequence
  Synthetic Oligonucleotide; PDCD1LG2 exon 2; Set C
ugcucuucuuucuua

SEQ ID NO: 40050 - RNA, 19 nt, Artificial Sequence
  Synthetic Oligonucleotide; PDCD1LG2 exon 2; Set C
ugugaaacuuugcuggguc

SEQ ID NO: 40051 - RNA, 18 nt, Artificial Sequence
  Synthetic Oligonucleotide; PDCD1LG2 exon 2; Set C
ugugaaacuuugcugggu

SEQ ID NO: 40052 - RNA, 15 nt, Artificial Sequence
  Synthetic Oligonucleotide; PDCD1LG2 exon 2; Set C
gugaaacuuugcugg

SEQ ID NO: 40053 - RNA, 17 nt, Artificial Sequence
  Synthetic Oligonucleotide; PDCD1LG2 exon 2; Set C
ugugaaacuuugcuggg

SEQ ID NO: 40054 - RNA, 16 nt, Artificial Sequence
  Synthetic Oligonucleotide; PDCD1LG2 exon 2; Set C
ccuugugaaacuuugc

SEQ ID NO: 40055 - RNA, 17 nt, Artificial Sequence
  Synthetic Oligonucleotide; PDCD1LG2 exon 2; Set C
gccuugugaaacuuugc

SEQ ID NO: 40056 - RNA, 18 nt, Artificial Sequence
  Synthetic Oligonucleotide; PDCD1LG2 exon 2; Set C
ggccuugugaaacuuugc

SEQ ID NO: 40057 - RNA, 19 nt, Artificial Sequence
  Synthetic Oligonucleotide; PDCD1LG2 exon 2; Set C
gggccuugugaaacuuugc

SEQ ID NO: 40058 - RNA, 18 nt, Artificial Sequence
  Synthetic Oligonucleotide; PDCD1LG2 exon 2; Set C
gggccuugugaaacuuug

SEQ ID NO: 40059 - RNA, 24 nt, Artificial Sequence
  Synthetic Oligonucleotide; PDCD1LG2 exon 2; Set A
uugaaagucucagggccuugugaa

SEQ ID NO: 40060 - RNA, 25 nt, Artificial Sequence
  Synthetic Oligonucleotide; PDCD1LG2 exon 2; Set A
auugaaagucucagggccuugugaa

SEQ ID NO: 40061 - RNA, 23 nt, Artificial Sequence
  Synthetic Oligonucleotide; PDCD1LG2 exon 2; Set A
uugaaagucucagggccuuguga

SEQ ID NO: 40062 - RNA, 22 nt, Artificial Sequence
  Synthetic Oligonucleotide; PDCD1LG2 exon 2; Set C
uugaaagucucagggccuugug

SEQ ID NO: 40063 - RNA, 26 nt, Artificial Sequence
  Synthetic Oligonucleotide; PDCD1LG2 exon 2; Set A
aauugaaagucucagggccuugugaa

SEQ ID NO: 40064 - RNA, 24 nt, Artificial Sequence
  Synthetic Oligonucleotide; PDCD1LG2 exon 2; Set A
auugaaagucucagggccuuguga

SEQ ID NO: 40065 - RNA, 23 nt, Artificial Sequence
  Synthetic Oligonucleotide; PDCD1LG2 exon 2; Set C
auugaaagucucagggccuugug

SEQ ID NO: 40066 - RNA, 25 nt, Artificial Sequence
  Synthetic Oligonucleotide; PDCD1LG2 exon 2; Set A
aauugaaagucucagggccuuguga

SEQ ID NO: 40067 - RNA, 24 nt, Artificial Sequence
  Synthetic Oligonucleotide; PDCD1LG2 exon 2; Set C
aauugaaagucucagggccuugug

SEQ ID NO: 40068 - RNA, 30 nt, Artificial Sequence
  Synthetic Oligonucleotide; PDCD1LG2 exon 2; Set A
aauagacaauugaaagucucagggccuugu

SEQ ID NO: 40069 - RNA, 31 nt, Artificial Sequence
  Synthetic Oligonucleotide; PDCD1LG2 exon 2; Set A
aaauagacaauugaaagucucagggccuugu

SEQ ID NO: 40070 - RNA, 34 nt, Artificial Sequence
  Synthetic Oligonucleotide; PDCD1LG2 exon 2; Set C
ucauguucuguauuugaucugaaauagacaauug

SEQ ID NO: 40071 - RNA, 33 nt, Artificial Sequence
  Synthetic Oligonucleotide; PDCD1LG2 exon 2; Set C
ucauguucuguauuugaucugaaauagacaauu

SEQ ID NO: 40072 - RNA, 32 nt, Artificial Sequence
  Synthetic Oligonucleotide; PDCD1LG2 exon 2; Set C
ucauguucuguauuugaucugaaauagacaau

SEQ ID NO: 40073 - RNA, 38 nt, Artificial Sequence
  Synthetic Oligonucleotide; PDCD1LG2 exon 2; Set C
uuccaggcucaacauuagcaggaggaagaucauguucu

SEQ ID NO: 40074 - RNA, 37 nt, Artificial Sequence
  Synthetic Oligonucleotide; PDCD1LG2 exon 2; Set C
uuccaggcucaacauuagcaggaggaagaucauguuc

SEQ ID NO: 40075 - RNA, 38 nt, Artificial Sequence
  Synthetic Oligonucleotide; PDCD1LG2 exon 2; Set C
auuccaggcucaacauuagcaggaggaagaucauguuc

SEQ ID NO: 40076 - RNA, 36 nt, Artificial Sequence
  Synthetic Oligonucleotide; PDCD1LG2 exon 2; Set C
uuccaggcucaacauuagcaggaggaagaucauguu

SEQ ID NO: 40077 - RNA, 37 nt, Artificial Sequence
  Synthetic Oligonucleotide; PDCD1LG2 exon 2; Set C
auuccaggcucaacauuagcaggaggaagaucauguu

SEQ ID NO: 40078 - RNA, 35 nt, Artificial Sequence
  Synthetic Oligonucleotide; PDCD1LG2 exon 2; Set C
uuccaggcucaacauuagcaggaggaagaucaugu

SEQ ID NO: 40079 - RNA, 36 nt, Artificial Sequence
  Synthetic Oligonucleotide; PDCD1LG2 exon 2; Set C
auuccaggcucaacauuagcaggaggaagaucaugu

SEQ ID NO: 40080 - RNA, 37 nt, Artificial Sequence
  Synthetic Oligonucleotide; PDCD1LG2 exon 2; Set C
aauuccaggcucaacauuagcaggaggaagaucaugu

SEQ ID NO: 40081 - RNA, 30 nt, Artificial Sequence
  Synthetic Oligonucleotide; PDCD1LG2 exon 2; Set A
caauuccaggcucaacauuagcaggaggaa

SEQ ID NO: 40082 - RNA, 27 nt, Artificial Sequence
  Synthetic Oligonucleotide; PDCD1LG2 exon 2; Set A
aauuccaggcucaacauuagcaggagg

SEQ ID NO: 40083 - RNA, 28 nt, Artificial Sequence
  Synthetic Oligonucleotide; PDCD1LG2 exon 2; Set A
caauuccaggcucaacauuagcaggagg

SEQ ID NO: 40084 - RNA, 29 nt, Artificial Sequence
  Synthetic Oligonucleotide; PDCD1LG2 exon 2; Set A
uuaccugcuaucuggugaagcugcaauuc

SEQ ID NO: 40085 - RNA, 28 nt, Artificial Sequence
  Synthetic Oligonucleotide; PDCD1LG2 exon 2; Set A
uuaccugcuaucuggugaagcugcaauu

SEQ ID NO: 40086 - RNA, 27 nt, Artificial Sequence
  Synthetic Oligonucleotide; PDCD1LG2 exon 2; Set A
uuaccugcuaucuggugaagcugcaau

SEQ ID NO: 40087 - RNA, 26 nt, Artificial Sequence
  Synthetic Oligonucleotide; PDCD1LG2 exon 2; Set A
uuaccugcuaucuggugaagcugcaa

SEQ ID NO: 40088 - RNA, 37 nt, Artificial Sequence
  Synthetic Oligonucleotide; PDCD1LG2 exon 2; Set C
uguccuuucuuaccugcuaucuggugaagcugcaauu

SEQ ID NO: 40089 - RNA, 39 nt, Artificial Sequence
  Synthetic Oligonucleotide; PDCD1LG2 exon 2; Set C
uuguccuuucuuaccugcuaucuggugaagcugcaauuc

SEQ ID NO: 40090 - RNA, 36 nt, Artificial Sequence
  Synthetic Oligonucleotide; PDCD1LG2 exon 2; Set C
uguccuuucuuaccugcuaucuggugaagcugcaau

SEQ ID NO: 40091 - RNA, 38 nt, Artificial Sequence
  Synthetic Oligonucleotide; PDCD1LG2 exon 2; Set C
uuguccuuucuuaccugcuaucuggugaagcugcaauu

SEQ ID NO: 40092 - RNA, 40 nt, Artificial Sequence
  Synthetic Oligonucleotide; PDCD1LG2 exon 2; Set C
uuuguccuuucuuaccugcuaucuggugaagcugcaauuc

SEQ ID NO: 40093 - RNA, 35 nt, Artificial Sequence
  Synthetic Oligonucleotide; PDCD1LG2 exon 2; Set C
uguccuuucuuaccugcuaucuggugaagcugcaa

SEQ ID NO: 40094 - RNA, 37 nt, Artificial Sequence
  Synthetic Oligonucleotide; PDCD1LG2 exon 2; Set C
uuguccuuucuuaccugcuaucuggugaagcugcaau

SEQ ID NO: 40095 - RNA, 39 nt, Artificial Sequence
  Synthetic Oligonucleotide; PDCD1LG2 exon 2; Set C
uuuguccuuucuuaccugcuaucuggugaagcugcaauu

SEQ ID NO: 40096 - RNA, 36 nt, Artificial Sequence
  Synthetic Oligonucleotide; PDCD1LG2 exon 2; Set C
uuguccuuucuuaccugcuaucuggugaagcugcaa

SEQ ID NO: 40097 - RNA, 38 nt, Artificial Sequence
  Synthetic Oligonucleotide; PDCD1LG2 exon 2; Set C
uuuguccuuucuuaccugcuaucuggugaagcugcaau

SEQ ID NO: 40098 - RNA, 37 nt, Artificial Sequence
  Synthetic Oligonucleotide; PDCD1LG2 exon 2; Set C
uuuguccuuucuuaccugcuaucuggugaagcugcaa

SEQ ID NO: 40099 - RNA, 15 nt, Artificial Sequence
  Synthetic Oligonucleotide; PDCD1LG2 exon 2; Set C
cuuuguccuuucuua

SEQ ID NO: 40100 - RNA, 16 nt, Artificial Sequence
  Synthetic Oligonucleotide; PDCD1LG2 exon 2; Set C
ccuuuguccuuucuua

SEQ ID NO: 40101 - RNA, 24 nt, Artificial Sequence
  Synthetic Oligonucleotide; PDCD1LG2 exon 2; Set B
aagccucucccuuuguccuuucuu

SEQ ID NO: 40102 - RNA, 25 nt, Artificial Sequence
  Synthetic Oligonucleotide; PDCD1LG2 exon 2; Set B
uaagccucucccuuuguccuuucuu

SEQ ID NO: 40103 - RNA, 23 nt, Artificial Sequence
  Synthetic Oligonucleotide; PDCD1LG2 exon 2; Set B
aagccucucccuuuguccuuucu

SEQ ID NO: 40104 - RNA, 26 nt, Artificial Sequence
  Synthetic Oligonucleotide; PDCD1LG2 exon 2; Set B
uuaagccucucccuuuguccuuucuu

SEQ ID NO: 40105 - RNA, 24 nt, Artificial Sequence
  Synthetic Oligonucleotide; PDCD1LG2 exon 2; Set B
uaagccucucccuuuguccuuucu

SEQ ID NO: 40106 - RNA, 25 nt, Artificial Sequence
  Synthetic Oligonucleotide; PDCD1LG2 exon 2; Set B
uuaagccucucccuuuguccuuucu

SEQ ID NO: 40107 - RNA, 23 nt, Artificial Sequence
  Synthetic Oligonucleotide; PDCD1LG2 exon 2; Set B
uuaagccucucccuuuguccuuu

SEQ ID NO: 40108 - RNA, 25 nt, Artificial Sequence
  Synthetic Oligonucleotide; PDCD1LG2 exon 2; Set B
cuuaagccucucccuuuguccuuuc

SEQ ID NO: 40109 - RNA, 26 nt, Artificial Sequence
  Synthetic Oligonucleotide; PDCD1LG2 exon 2; Set B
ucuuaagccucucccuuuguccuuuc

SEQ ID NO: 40110 - RNA, 15 nt, Artificial Sequence
  Synthetic Oligonucleotide; PDCD1LG2 exon 2; Set C
agccucucccuuugu

SEQ ID NO: 40111 - RNA, 17 nt, Artificial Sequence
  Synthetic Oligonucleotide; PDCD1LG2 exon 2; Set C
aagccucucccuuuguc

SEQ ID NO: 40112 - RNA, 27 nt, Artificial Sequence
  Synthetic Oligonucleotide; PDCD1LG2 exon 2; Set B
uucuuaagccucucccuuuguccuuuc

SEQ ID NO: 40113 - RNA, 18 nt, Artificial Sequence
  Synthetic Oligonucleotide; PDCD1LG2 exon 2; Set C
uaagccucucccuuuguc

SEQ ID NO: 40114 - RNA, 15 nt, Artificial Sequence
  Synthetic Oligonucleotide; PDCD1LG2 exon 2; Set C
aagccucucccuuug

SEQ ID NO: 40115 - RNA, 19 nt, Artificial Sequence
  Synthetic Oligonucleotide; PDCD1LG2 exon 2; Set C
uuaagccucucccuuuguc

SEQ ID NO: 40116 - RNA, 16 nt, Artificial Sequence
  Synthetic Oligonucleotide; PDCD1LG2 exon 2; Set C
uaagccucucccuuug

SEQ ID NO: 40117 - RNA, 34 nt, Artificial Sequence
  Synthetic Oligonucleotide; PDCD1LG2 exon 2; Set C
cuucuuucuuaagccucucccuuuguccuuucuu

SEQ ID NO: 40118 - RNA, 15 nt, Artificial Sequence
  Synthetic Oligonucleotide; PDCD1LG2 exon 2; Set C
uaagccucucccuuu

SEQ ID NO: 40119 - RNA, 35 nt, Artificial Sequence
  Synthetic Oligonucleotide; PDCD1LG2 exon 2; Set C
ucuucuuucuuaagccucucccuuuguccuuucuu

SEQ ID NO: 40120 - RNA, 33 nt, Artificial Sequence
  Synthetic Oligonucleotide; PDCD1LG2 exon 2; Set C
cuucuuucuuaagccucucccuuuguccuuucu

SEQ ID NO: 40121 - RNA, 34 nt, Artificial Sequence
  Synthetic Oligonucleotide; PDCD1LG2 exon 2; Set C
ucuucuuucuuaagccucucccuuuguccuuucu

SEQ ID NO: 40122 - RNA, 31 nt, Artificial Sequence
  Synthetic Oligonucleotide; PDCD1LG2 exon 2; Set B
cuucuuucuuaagccucucccuuuguccuuu

SEQ ID NO: 40123 - RNA, 33 nt, Artificial Sequence
  Synthetic Oligonucleotide; PDCD1LG2 exon 2; Set C
ucuucuuucuuaagccucucccuuuguccuuuc

SEQ ID NO: 40124 - RNA, 32 nt, Artificial Sequence
  Synthetic Oligonucleotide; PDCD1LG2 exon 2; Set B
ucuucuuucuuaagccucucccuuuguccuuu

SEQ ID NO: 40125 - RNA, 15 nt, Artificial Sequence
  Synthetic Oligonucleotide; PDCD1LG2 exon 2; Set C
cuuaagccucucccu

SEQ ID NO: 40126 - RNA, 16 nt, Artificial Sequence
  Synthetic Oligonucleotide; PDCD1LG2 exon 2; Set C
ucuuaagccucucccu

SEQ ID NO: 40127 - RNA, 27 nt, Artificial Sequence
  Synthetic Oligonucleotide; PDCD1LG2 exon 2; Set B
cuucuuucuuaagccucucccuuuguc

SEQ ID NO: 40128 - RNA, 17 nt, Artificial Sequence
  Synthetic Oligonucleotide; PDCD1LG2 exon 2; Set C
uucuuaagccucucccu

SEQ ID NO: 40129 - RNA, 19 nt, Artificial Sequence
  Synthetic Oligonucleotide; PDCD1LG2 exon 2; Set C
uuucuuaagccucucccuu

SEQ ID NO: 40130 - RNA, 28 nt, Artificial Sequence
  Synthetic Oligonucleotide; PDCD1LG2 exon 2; Set B
ucuucuuucuuaagccucucccuuuguc

SEQ ID NO: 40131 - RNA, 18 nt, Artificial Sequence
  Synthetic Oligonucleotide; PDCD1LG2 exon 2; Set C
uuucuuaagccucucccu

SEQ ID NO: 40132 - RNA, 20 nt, Artificial Sequence
  Synthetic Oligonucleotide; PDCD1LG2 exon 2; Set C
cuuucuuaagccucucccuu

SEQ ID NO: 40133 - RNA, 19 nt, Artificial Sequence
  Synthetic Oligonucleotide; PDCD1LG2 exon 2; Set C
cuuucuuaagccucucccu

SEQ ID NO: 40134 - RNA, 21 nt, Artificial Sequence
  Synthetic Oligonucleotide; PDCD1LG2 exon 2; Set C
ucuuucuuaagccucucccuu

SEQ ID NO: 40135 - RNA, 28 nt, Artificial Sequence
  Synthetic Oligonucleotide; PDCD1LG2 exon 2; Set B
cucuucuuucuuaagccucucccuuugu

SEQ ID NO: 40136 - RNA, 20 nt, Artificial Sequence
  Synthetic Oligonucleotide; PDCD1LG2 exon 2; Set C
ucuuucuuaagccucucccu

SEQ ID NO: 40137 - RNA, 22 nt, Artificial Sequence
  Synthetic Oligonucleotide; PDCD1LG2 exon 2; Set C
uucuuucuuaagccucucccuu

SEQ ID NO: 40138 - RNA, 27 nt, Artificial Sequence
  Synthetic Oligonucleotide; PDCD1LG2 exon 2; Set B
cucuucuuucuuaagccucucccuuug

SEQ ID NO: 40139 - RNA, 21 nt, Artificial Sequence
  Synthetic Oligonucleotide; PDCD1LG2 exon 2; Set C
uucuuucuuaagccucucccu

SEQ ID NO: 40140 - RNA, 28 nt, Artificial Sequence
  Synthetic Oligonucleotide; PDCD1LG2 exon 2; Set B
gcucuucuuucuuaagccucucccuuug

SEQ ID NO: 40141 - RNA, 26 nt, Artificial Sequence
  Synthetic Oligonucleotide; PDCD1LG2 exon 2; Set B
cucuucuuucuuaagccucucccuuu

SEQ ID NO: 40142 - RNA, 29 nt, Artificial Sequence
  Synthetic Oligonucleotide; PDCD1LG2 exon 2; Set B
ugcucuucuuucuuaagccucucccuuug

SEQ ID NO: 40143 - RNA, 27 nt, Artificial Sequence
  Synthetic Oligonucleotide; PDCD1LG2 exon 2; Set B
gcucuucuuucuuaagccucucccuuu

SEQ ID NO: 40144 - RNA, 28 nt, Artificial Sequence
  Synthetic Oligonucleotide; PDCD1LG2 exon 2; Set B
ugcucuucuuucuuaagccucucccuuu

SEQ ID NO: 40145 - RNA, 16 nt, Artificial Sequence
  Synthetic Oligonucleotide; PDCD1LG2 exon 2; Set C
cucuucuuucuuaagc

SEQ ID NO: 40146 - RNA, 17 nt, Artificial Sequence
  Synthetic Oligonucleotide; PDCD1LG2 exon 2; Set C
gcucuucuuucuuaagc

SEQ ID NO: 40147 - RNA, 18 nt, Artificial Sequence
  Synthetic Oligonucleotide; PDCD1LG2 exon 2; Set C
ugcucuucuuucuuaagc

SEQ ID NO: 40148 - RNA, 35 nt, Artificial Sequence
  Synthetic Oligonucleotide; PDCD1LG2 exon 3; Set A
gauauuuugucauugucugccuuuacuuuacauuc

SEQ ID NO: 40149 - RNA, 34 nt, Artificial Sequence
  Synthetic Oligonucleotide; PDCD1LG2 exon 3; Set A
gauauuuugucauugucugccuuuacuuuacauu

SEQ ID NO: 40150 - RNA, 19 nt, Artificial Sequence
  Synthetic Oligonucleotide; PDCD1LG2 exon 3; Set C
cauuccagggucacauugc

SEQ ID NO: 40151 - RNA, 18 nt, Artificial Sequence
  Synthetic Oligonucleotide; PDCD1LG2 exon 3; Set C
cauuccagggucacauug

SEQ ID NO: 40152 - RNA, 20 nt, Artificial Sequence
  Synthetic Oligonucleotide; PDCD1LG2 exon 3; Set A
gcauuccagggucacauugc

SEQ ID NO: 40153 - RNA, 19 nt, Artificial Sequence
  Synthetic Oligonucleotide; PDCD1LG2 exon 3; Set C
gcauuccagggucacauug

SEQ ID NO: 40154 - RNA, 21 nt, Artificial Sequence
  Synthetic Oligonucleotide; PDCD1LG2 exon 3; Set A
ugcauuccagggucacauugc

SEQ ID NO: 40155 - RNA, 17 nt, Artificial Sequence
  Synthetic Oligonucleotide; PDCD1LG2 exon 3; Set C
cauuccagggucacauu

SEQ ID NO: 40156 - RNA, 20 nt, Artificial Sequence
  Synthetic Oligonucleotide; PDCD1LG2 exon 3; Set A
ugcauuccagggucacauug

SEQ ID NO: 40157 - RNA, 22 nt, Artificial Sequence
  Synthetic Oligonucleotide; PDCD1LG2 exon 3; Set A
uugcauuccagggucacauugc

SEQ ID NO: 40158 - RNA, 18 nt, Artificial Sequence
  Synthetic Oligonucleotide; PDCD1LG2 exon 3; Set C
gcauuccagggucacauu

SEQ ID NO: 40159 - RNA, 21 nt, Artificial Sequence
  Synthetic Oligonucleotide; PDCD1LG2 exon 3; Set A
uugcauuccagggucacauug

SEQ ID NO: 40160 - RNA, 23 nt, Artificial Sequence
  Synthetic Oligonucleotide; PDCD1LG2 exon 3; Set A
guugcauuccagggucacauugc

SEQ ID NO: 40161 - RNA, 19 nt, Artificial Sequence
  Synthetic Oligonucleotide; PDCD1LG2 exon 3; Set C
ugcauuccagggucacauu

SEQ ID NO: 40162 - RNA, 22 nt, Artificial Sequence
  Synthetic Oligonucleotide; PDCD1LG2 exon 3; Set A
guugcauuccagggucacauug

SEQ ID NO: 40163 - RNA, 24 nt, Artificial Sequence
  Synthetic Oligonucleotide; PDCD1LG2 exon 3; Set A
aguugcauuccagggucacauugc

SEQ ID NO: 40164 - RNA, 20 nt, Artificial Sequence
  Synthetic Oligonucleotide; PDCD1LG2 exon 3; Set A
uugcauuccagggucacauu

SEQ ID NO: 40165 - RNA, 23 nt, Artificial Sequence
  Synthetic Oligonucleotide; PDCD1LG2 exon 3; Set A
aguugcauuccagggucacauug

SEQ ID NO: 40166 - RNA, 25 nt, Artificial Sequence
  Synthetic Oligonucleotide; PDCD1LG2 exon 3; Set A
aaguugcauuccagggucacauugc

SEQ ID NO: 40167 - RNA, 21 nt, Artificial Sequence
  Synthetic Oligonucleotide; PDCD1LG2 exon 3; Set A
guugcauuccagggucacauu

SEQ ID NO: 40168 - RNA, 24 nt, Artificial Sequence
  Synthetic Oligonucleotide; PDCD1LG2 exon 3; Set A
aaguugcauuccagggucacauug

SEQ ID NO: 40169 - RNA, 22 nt, Artificial Sequence
  Synthetic Oligonucleotide; PDCD1LG2 exon 3; Set A
aguugcauuccagggucacauu

SEQ ID NO: 40170 - RNA, 20 nt, Artificial Sequence
  Synthetic Oligonucleotide; PDCD1LG2 exon 3; Set A
guugcauuccagggucacau

SEQ ID NO: 40171 - RNA, 23 nt, Artificial Sequence
  Synthetic Oligonucleotide; PDCD1LG2 exon 3; Set A
aaguugcauuccagggucacauu

SEQ ID NO: 40172 - RNA, 21 nt, Artificial Sequence
  Synthetic Oligonucleotide; PDCD1LG2 exon 3; Set A
aguugcauuccagggucacau

SEQ ID NO: 40173 - RNA, 22 nt, Artificial Sequence
  Synthetic Oligonucleotide; PDCD1LG2 exon 3; Set A
aaguugcauuccagggucacau

SEQ ID NO: 40174 - RNA, 18 nt, Artificial Sequence
  Synthetic Oligonucleotide; PDCD1LG2 exon 3; Set C
guugcauuccagggucac

SEQ ID NO: 40175 - RNA, 15 nt, Artificial Sequence
  Synthetic Oligonucleotide; PDCD1LG2 exon 3; Set C
uugcauuccaggguc

SEQ ID NO: 40176 - RNA, 17 nt, Artificial Sequence
  Synthetic Oligonucleotide; PDCD1LG2 exon 3; Set C
guugcauuccaggguca

SEQ ID NO: 40177 - RNA, 19 nt, Artificial Sequence
  Synthetic Oligonucleotide; PDCD1LG2 exon 3; Set C
aguugcauuccagggucac

SEQ ID NO: 40178 - RNA, 16 nt, Artificial Sequence
  Synthetic Oligonucleotide; PDCD1LG2 exon 3; Set C
guugcauuccaggguc

SEQ ID NO: 40179 - RNA, 18 nt, Artificial Sequence
  Synthetic Oligonucleotide; PDCD1LG2 exon 3; Set C
aguugcauuccaggguca

SEQ ID NO: 40180 - RNA, 20 nt, Artificial Sequence
  Synthetic Oligonucleotide; PDCD1LG2 exon 3; Set C
aaguugcauuccagggucac

SEQ ID NO: 40181 - RNA, 17 nt, Artificial Sequence
  Synthetic Oligonucleotide; PDCD1LG2 exon 3; Set C
aguugcauuccaggguc

SEQ ID NO: 40182 - RNA, 15 nt, Artificial Sequence
  Synthetic Oligonucleotide; PDCD1LG2 exon 3; Set C
guugcauuccagggu

SEQ ID NO: 40183 - RNA, 19 nt, Artificial Sequence
  Synthetic Oligonucleotide; PDCD1LG2 exon 3; Set C
aaguugcauuccaggguca

SEQ ID NO: 40184 - RNA, 18 nt, Artificial Sequence
  Synthetic Oligonucleotide; PDCD1LG2 exon 3; Set C
aaguugcauuccaggguc

SEQ ID NO: 40185 - RNA, 16 nt, Artificial Sequence
  Synthetic Oligonucleotide; PDCD1LG2 exon 3; Set C
aguugcauuccagggu

SEQ ID NO: 40186 - RNA, 17 nt, Artificial Sequence
  Synthetic Oligonucleotide; PDCD1LG2 exon 3; Set C
aaguugcauuccagggu

SEQ ID NO: 40187 - RNA, 33 nt, Artificial Sequence
  Synthetic Oligonucleotide; PDCD1LG2 exon 3; Set C
ccagugucaaaguugcauuccagggucacauug

SEQ ID NO: 40188 - RNA, 35 nt, Artificial Sequence
  Synthetic Oligonucleotide; PDCD1LG2 exon 3; Set C
uccagugucaaaguugcauuccagggucacauugc

SEQ ID NO: 40189 - RNA, 34 nt, Artificial Sequence
  Synthetic Oligonucleotide; PDCD1LG2 exon 3; Set C
uccagugucaaaguugcauuccagggucacauug

SEQ ID NO: 40190 - RNA, 36 nt, Artificial Sequence
  Synthetic Oligonucleotide; PDCD1LG2 exon 3; Set C
uuccagugucaaaguugcauuccagggucacauugc

SEQ ID NO: 40191 - RNA, 35 nt, Artificial Sequence
  Synthetic Oligonucleotide; PDCD1LG2 exon 3; Set C
uuccagugucaaaguugcauuccagggucacauug

SEQ ID NO: 40192 - RNA, 33 nt, Artificial Sequence
  Synthetic Oligonucleotide; PDCD1LG2 exon 3; Set C
uccagugucaaaguugcauuccagggucacauu

SEQ ID NO: 40193 - RNA, 34 nt, Artificial Sequence
  Synthetic Oligonucleotide; PDCD1LG2 exon 3; Set C
uuccagugucaaaguugcauuccagggucacauu

SEQ ID NO: 40194 - RNA, 32 nt, Artificial Sequence
  Synthetic Oligonucleotide; PDCD1LG2 exon 3; Set C
uccagugucaaaguugcauuccagggucacau

SEQ ID NO: 40195 - RNA, 33 nt, Artificial Sequence
  Synthetic Oligonucleotide; PDCD1LG2 exon 3; Set C
uuccagugucaaaguugcauuccagggucacau

SEQ ID NO: 40196 - RNA, 30 nt, Artificial Sequence
  Synthetic Oligonucleotide; PDCD1LG2 exon 3; Set C
uccagugucaaaguugcauuccagggucac

SEQ ID NO: 40197 - RNA, 27 nt, Artificial Sequence
  Synthetic Oligonucleotide; PDCD1LG2 exon 3; Set A
ccagugucaaaguugcauuccaggguc

SEQ ID NO: 40198 - RNA, 29 nt, Artificial Sequence
  Synthetic Oligonucleotide; PDCD1LG2 exon 3; Set C
uccagugucaaaguugcauuccaggguca

SEQ ID NO: 40199 - RNA, 31 nt, Artificial Sequence
  Synthetic Oligonucleotide; PDCD1LG2 exon 3; Set C
uuccagugucaaaguugcauuccagggucac

SEQ ID NO: 40200 - RNA, 28 nt, Artificial Sequence
  Synthetic Oligonucleotide; PDCD1LG2 exon 3; Set A
uccagugucaaaguugcauuccaggguc

SEQ ID NO: 40201 - RNA, 26 nt, Artificial Sequence
  Synthetic Oligonucleotide; PDCD1LG2 exon 3; Set A
ccagugucaaaguugcauuccagggu

SEQ ID NO: 40202 - RNA, 30 nt, Artificial Sequence
  Synthetic Oligonucleotide; PDCD1LG2 exon 3; Set C
uuccagugucaaaguugcauuccaggguca

SEQ ID NO: 40203 - RNA, 29 nt, Artificial Sequence
  Synthetic Oligonucleotide; PDCD1LG2 exon 3; Set A
uuccagugucaaaguugcauuccaggguc

SEQ ID NO: 40204 - RNA, 27 nt, Artificial Sequence
  Synthetic Oligonucleotide; PDCD1LG2 exon 3; Set A
uccagugucaaaguugcauuccagggu

SEQ ID NO: 40205 - RNA, 28 nt, Artificial Sequence
  Synthetic Oligonucleotide; PDCD1LG2 exon 3; Set A
uuccagugucaaaguugcauuccagggu

SEQ ID NO: 40206 - RNA, 15 nt, Artificial Sequence
  Synthetic Oligonucleotide; PDCD1LG2 exon 3; Set C
ugucaaaguugcauu

SEQ ID NO: 40207 - RNA, 15 nt, Artificial Sequence
  Synthetic Oligonucleotide; PDCD1LG2 exon 3; Set C
gugucaaaguugcau

SEQ ID NO: 40208 - RNA, 17 nt, Artificial Sequence
  Synthetic Oligonucleotide; PDCD1LG2 exon 3; Set C
agugucaaaguugcauu

SEQ ID NO: 40209 - RNA, 16 nt, Artificial Sequence
  Synthetic Oligonucleotide; PDCD1LG2 exon 3; Set C
agugucaaaguugcau

SEQ ID NO: 40210 - RNA, 18 nt, Artificial Sequence
  Synthetic Oligonucleotide; PDCD1LG2 exon 3; Set C
cagugucaaaguugcauu

SEQ ID NO: 40211 - RNA, 20 nt, Artificial Sequence
  Synthetic Oligonucleotide; PDCD1LG2 exon 3; Set C
ccagugucaaaguugcauuc

SEQ ID NO: 40212 - RNA, 24 nt, Artificial Sequence
  Synthetic Oligonucleotide; PDCD1LG2 exon 3; Set A
uuccagugucaaaguugcauucca

SEQ ID NO: 40213 - RNA, 15 nt, Artificial Sequence
  Synthetic Oligonucleotide; PDCD1LG2 exon 3; Set C
agugucaaaguugca

SEQ ID NO: 40214 - RNA, 17 nt, Artificial Sequence
  Synthetic Oligonucleotide; PDCD1LG2 exon 3; Set C
cagugucaaaguugcau

SEQ ID NO: 40215 - RNA, 19 nt, Artificial Sequence
  Synthetic Oligonucleotide; PDCD1LG2 exon 3; Set C
ccagugucaaaguugcauu

SEQ ID NO: 40216 - RNA, 21 nt, Artificial Sequence
  Synthetic Oligonucleotide; PDCD1LG2 exon 3; Set C
uccagugucaaaguugcauuc

SEQ ID NO: 40217 - RNA, 23 nt, Artificial Sequence
  Synthetic Oligonucleotide; PDCD1LG2 exon 3; Set C
uuccagugucaaaguugcauucc

SEQ ID NO: 40218 - RNA, 18 nt, Artificial Sequence
  Synthetic Oligonucleotide; PDCD1LG2 exon 3; Set C
ccagugucaaaguugcau

SEQ ID NO: 40219 - RNA, 16 nt, Artificial Sequence
  Synthetic Oligonucleotide; PDCD1LG2 exon 3; Set C
cagugucaaaguugca

SEQ ID NO: 40220 - RNA, 20 nt, Artificial Sequence
  Synthetic Oligonucleotide; PDCD1LG2 exon 3; Set C
uccagugucaaaguugcauu

SEQ ID NO: 40221 - RNA, 22 nt, Artificial Sequence
  Synthetic Oligonucleotide; PDCD1LG2 exon 3; Set C
uuccagugucaaaguugcauuc

SEQ ID NO: 40222 - RNA, 19 nt, Artificial Sequence
  Synthetic Oligonucleotide; PDCD1LG2 exon 3; Set C
uccagugucaaaguugcau

SEQ ID NO: 40223 - RNA, 17 nt, Artificial Sequence
  Synthetic Oligonucleotide; PDCD1LG2 exon 3; Set C
ccagugucaaaguugca

SEQ ID NO: 40224 - RNA, 15 nt, Artificial Sequence
  Synthetic Oligonucleotide; PDCD1LG2 exon 3; Set C
cagugucaaaguugc

SEQ ID NO: 40225 - RNA, 21 nt, Artificial Sequence
  Synthetic Oligonucleotide; PDCD1LG2 exon 3; Set C
uuccagugucaaaguugcauu

SEQ ID NO: 40226 - RNA, 20 nt, Artificial Sequence
  Synthetic Oligonucleotide; PDCD1LG2 exon 3; Set C
uuccagugucaaaguugcau

SEQ ID NO: 40227 - RNA, 18 nt, Artificial Sequence
  Synthetic Oligonucleotide; PDCD1LG2 exon 3; Set C
uccagugucaaaguugca

SEQ ID NO: 40228 - RNA, 16 nt, Artificial Sequence
  Synthetic Oligonucleotide; PDCD1LG2 exon 3; Set C
ccagugucaaaguugc

SEQ ID NO: 40229 - RNA, 19 nt, Artificial Sequence
  Synthetic Oligonucleotide; PDCD1LG2 exon 3; Set C
uuccagugucaaaguugca

SEQ ID NO: 40230 - RNA, 17 nt, Artificial Sequence
  Synthetic Oligonucleotide; PDCD1LG2 exon 3; Set C
uccagugucaaaguugc

SEQ ID NO: 40231 - RNA, 15 nt, Artificial Sequence
  Synthetic Oligonucleotide; PDCD1LG2 exon 3; Set C
ccagugucaaaguug

SEQ ID NO: 40232 - RNA, 18 nt, Artificial Sequence
  Synthetic Oligonucleotide; PDCD1LG2 exon 3; Set C
uuccagugucaaaguugc

SEQ ID NO: 40233 - RNA, 16 nt, Artificial Sequence
  Synthetic Oligonucleotide; PDCD1LG2 exon 3; Set C
uccagugucaaaguug

SEQ ID NO: 40234 - RNA, 15 nt, Artificial Sequence
  Synthetic Oligonucleotide; PDCD1LG2 exon 3; Set C
uccagugucaaaguu

SEQ ID NO: 40235 - RNA, 17 nt, Artificial Sequence
  Synthetic Oligonucleotide; PDCD1LG2 exon 3; Set C
uuccagugucaaaguug

SEQ ID NO: 40236 - RNA, 16 nt, Artificial Sequence
  Synthetic Oligonucleotide; PDCD1LG2 exon 3; Set C
uuccagugucaaaguu

SEQ ID NO: 40237 - RNA, 15 nt, Artificial Sequence
  Synthetic Oligonucleotide; PDCD1LG2 exon 3; Set C
uuccagugucaaagu

SEQ ID NO: 40238 - RNA, 15 nt, Artificial Sequence
  Synthetic Oligonucleotide; PDCD1LG2 exon 3; Set C
cuuuacuuuacauuc

SEQ ID NO: 40239 - RNA, 24 nt, Artificial Sequence
  Synthetic Oligonucleotide; PDCD1LG2 exon 3; Set C
auugucugccuuuacuuuacauuc

SEQ ID NO: 40240 - RNA, 23 nt, Artificial Sequence
  Synthetic Oligonucleotide; PDCD1LG2 exon 3; Set C
auugucugccuuuacuuuacauu

SEQ ID NO: 40241 - RNA, 22 nt, Artificial Sequence
  Synthetic Oligonucleotide; PDCD1LG2 exon 3; Set C
auugucugccuuuacuuuacau

SEQ ID NO: 40242 - RNA, 21 nt, Artificial Sequence
  Synthetic Oligonucleotide; PDCD1LG2 exon 3; Set C
auugucugccuuuacuuuaca

SEQ ID NO: 40243 - RNA, 20 nt, Artificial Sequence
  Synthetic Oligonucleotide; PDCD1LG2 exon 3; Set C
auugucugccuuuacuuuac

SEQ ID NO: 40244 - RNA, 19 nt, Artificial Sequence
  Synthetic Oligonucleotide; PDCD1LG2 exon 3; Set C
auugucugccuuuacuuua

SEQ ID NO: 40245 - RNA, 29 nt, Artificial Sequence
  Synthetic Oligonucleotide; PDCD1LG2 exon 3; Set A
uugucauugucugccuuuacuuuacauuc

SEQ ID NO: 40246 - RNA, 28 nt, Artificial Sequence
  Synthetic Oligonucleotide; PDCD1LG2 exon 3; Set A
uugucauugucugccuuuacuuuacauu

SEQ ID NO: 40247 - RNA, 30 nt, Artificial Sequence
  Synthetic Oligonucleotide; PDCD1LG2 exon 3; Set A
uuugucauugucugccuuuacuuuacauuc

SEQ ID NO: 40248 - RNA, 18 nt, Artificial Sequence
  Synthetic Oligonucleotide; PDCD1LG2 exon 3; Set C
auugucugccuuuacuuu

SEQ ID NO: 40249 - RNA, 29 nt, Artificial Sequence
  Synthetic Oligonucleotide; PDCD1LG2 exon 3; Set A
uuugucauugucugccuuuacuuuacauu

SEQ ID NO: 40250 - RNA, 31 nt, Artificial Sequence
  Synthetic Oligonucleotide; PDCD1LG2 exon 3; Set A
uuuugucauugucugccuuuacuuuacauuc

SEQ ID NO: 40251 - RNA, 27 nt, Artificial Sequence
  Synthetic Oligonucleotide; PDCD1LG2 exon 3; Set A
uugucauugucugccuuuacuuuacau

SEQ ID NO: 40252 - RNA, 17 nt, Artificial Sequence
  Synthetic Oligonucleotide; PDCD1LG2 exon 3; Set C
auugucugccuuuacuu

SEQ ID NO: 40253 - RNA, 30 nt, Artificial Sequence
  Synthetic Oligonucleotide; PDCD1LG2 exon 3; Set A
uuuugucauugucugccuuuacuuuacauu

SEQ ID NO: 40254 - RNA, 32 nt, Artificial Sequence
  Synthetic Oligonucleotide; PDCD1LG2 exon 3; Set A
auuuugucauugucugccuuuacuuuacauuc

SEQ ID NO: 40255 - RNA, 28 nt, Artificial Sequence
  Synthetic Oligonucleotide; PDCD1LG2 exon 3; Set A
uuugucauugucugccuuuacuuuacau

SEQ ID NO: 40256 - RNA, 26 nt, Artificial Sequence
  Synthetic Oligonucleotide; PDCD1LG2 exon 3; Set A
uugucauugucugccuuuacuuuaca

SEQ ID NO: 40257 - RNA, 16 nt, Artificial Sequence
  Synthetic Oligonucleotide; PDCD1LG2 exon 3; Set C
auugucugccuuuacu

SEQ ID NO: 40258 - RNA, 31 nt, Artificial Sequence
  Synthetic Oligonucleotide; PDCD1LG2 exon 3; Set A
auuuugucauugucugccuuuacuuuacauu

SEQ ID NO: 40259 - RNA, 33 nt, Artificial Sequence
  Synthetic Oligonucleotide; PDCD1LG2 exon 3; Set A
uauuuugucauugucugccuuuacuuuacauuc

SEQ ID NO: 40260 - RNA, 29 nt, Artificial Sequence
  Synthetic Oligonucleotide; PDCD1LG2 exon 3; Set A
uuuugucauugucugccuuuacuuuacau

SEQ ID NO: 40261 - RNA, 27 nt, Artificial Sequence
  Synthetic Oligonucleotide; PDCD1LG2 exon 3; Set A
uuugucauugucugccuuuacuuuaca

SEQ ID NO: 40262 - RNA, 25 nt, Artificial Sequence
  Synthetic Oligonucleotide; PDCD1LG2 exon 3; Set A
uugucauugucugccuuuacuuuac

SEQ ID NO: 40263 - RNA, 32 nt, Artificial Sequence
  Synthetic Oligonucleotide; PDCD1LG2 exon 3; Set A
uauuuugucauugucugccuuuacuuuacauu

SEQ ID NO: 40264 - RNA, 24 nt, Artificial Sequence
  Synthetic Oligonucleotide; PDCD1LG2 exon 3; Set C
uugucauugucugccuuuacuuua

SEQ ID NO: 40265 - RNA, 34 nt, Artificial Sequence
  Synthetic Oligonucleotide; PDCD1LG2 exon 3; Set A
auauuuugucauugucugccuuuacuuuacauuc

SEQ ID NO: 40266 - RNA, 30 nt, Artificial Sequence
  Synthetic Oligonucleotide; PDCD1LG2 exon 3; Set A
auuuugucauugucugccuuuacuuuacau

SEQ ID NO: 40267 - RNA, 28 nt, Artificial Sequence
  Synthetic Oligonucleotide; PDCD1LG2 exon 3; Set A
uuuugucauugucugccuuuacuuuaca

SEQ ID NO: 40268 - RNA, 26 nt, Artificial Sequence
  Synthetic Oligonucleotide; PDCD1LG2 exon 3; Set A
uuugucauugucugccuuuacuuuac

SEQ ID NO: 40269 - RNA, 33 nt, Artificial Sequence
  Synthetic Oligonucleotide; PDCD1LG2 exon 3; Set A
auauuuugucauugucugccuuuacuuuacauu

SEQ ID NO: 40270 - RNA, 25 nt, Artificial Sequence
  Synthetic Oligonucleotide; PDCD1LG2 exon 3; Set C
uuugucauugucugccuuuacuuua

SEQ ID NO: 40271 - RNA, 31 nt, Artificial Sequence
  Synthetic Oligonucleotide; PDCD1LG2 exon 3; Set A
uauuuugucauugucugccuuuacuuuacau

SEQ ID NO: 40272 - RNA, 29 nt, Artificial Sequence
  Synthetic Oligonucleotide; PDCD1LG2 exon 3; Set A
auuuugucauugucugccuuuacuuuaca

SEQ ID NO: 40273 - RNA, 27 nt, Artificial Sequence
  Synthetic Oligonucleotide; PDCD1LG2 exon 3; Set A
uuuugucauugucugccuuuacuuuac

SEQ ID NO: 40274 - RNA, 23 nt, Artificial Sequence
  Synthetic Oligonucleotide; PDCD1LG2 exon 3; Set C
uugucauugucugccuuuacuuu

SEQ ID NO: 40275 - RNA, 26 nt, Artificial Sequence
  Synthetic Oligonucleotide; PDCD1LG2 exon 3; Set C
uuuugucauugucugccuuuacuuua

SEQ ID NO: 40276 - RNA, 32 nt, Artificial Sequence
  Synthetic Oligonucleotide; PDCD1LG2 exon 3; Set A
auauuuugucauugucugccuuuacuuuacau

SEQ ID NO: 40277 - RNA, 30 nt, Artificial Sequence
  Synthetic Oligonucleotide; PDCD1LG2 exon 3; Set A
uauuuugucauugucugccuuuacuuuaca

SEQ ID NO: 40278 - RNA, 28 nt, Artificial Sequence
  Synthetic Oligonucleotide; PDCD1LG2 exon 3; Set A
auuuugucauugucugccuuuacuuuac

SEQ ID NO: 40279 - RNA, 24 nt, Artificial Sequence
  Synthetic Oligonucleotide; PDCD1LG2 exon 3; Set C
uuugucauugucugccuuuacuuu

SEQ ID NO: 40280 - RNA, 22 nt, Artificial Sequence
  Synthetic Oligonucleotide; PDCD1LG2 exon 3; Set C
uugucauugucugccuuuacuu

SEQ ID NO: 40281 - RNA, 27 nt, Artificial Sequence
  Synthetic Oligonucleotide; PDCD1LG2 exon 3; Set C
auuuugucauugucugccuuuacuuua

SEQ ID NO: 40282 - RNA, 33 nt, Artificial Sequence
  Synthetic Oligonucleotide; PDCD1LG2 exon 3; Set A
gauauuuugucauugucugccuuuacuuuacau

SEQ ID NO: 40283 - RNA, 31 nt, Artificial Sequence
  Synthetic Oligonucleotide; PDCD1LG2 exon 3; Set A
auauuuugucauugucugccuuuacuuuaca

SEQ ID NO: 40284 - RNA, 29 nt, Artificial Sequence
  Synthetic Oligonucleotide; PDCD1LG2 exon 3; Set A
uauuuugucauugucugccuuuacuuuac

SEQ ID NO: 40285 - RNA, 25 nt, Artificial Sequence
  Synthetic Oligonucleotide; PDCD1LG2 exon 3; Set C
uuuugucauugucugccuuuacuuu

SEQ ID NO: 40286 - RNA, 23 nt, Artificial Sequence
  Synthetic Oligonucleotide; PDCD1LG2 exon 3; Set C
uuugucauugucugccuuuacuu

SEQ ID NO: 40287 - RNA, 28 nt, Artificial Sequence
  Synthetic Oligonucleotide; PDCD1LG2 exon 3; Set A
uauuuugucauugucugccuuuacuuua

SEQ ID NO: 40288 - RNA, 32 nt, Artificial Sequence
  Synthetic Oligonucleotide; PDCD1LG2 exon 3; Set A
gauauuuugucauugucugccuuuacuuuaca

SEQ ID NO: 40289 - RNA, 30 nt, Artificial Sequence
  Synthetic Oligonucleotide; PDCD1LG2 exon 3; Set A
auauuuugucauugucugccuuuacuuuac

SEQ ID NO: 40290 - RNA, 26 nt, Artificial Sequence
  Synthetic Oligonucleotide; PDCD1LG2 exon 3; Set C
auuuugucauugucugccuuuacuuu

SEQ ID NO: 40291 - RNA, 24 nt, Artificial Sequence
  Synthetic Oligonucleotide; PDCD1LG2 exon 3; Set C
uuuugucauugucugccuuuacuu

SEQ ID NO: 40292 - RNA, 22 nt, Artificial Sequence
  Synthetic Oligonucleotide; PDCD1LG2 exon 3; Set C
uuugucauugucugccuuuacu

SEQ ID NO: 40293 - RNA, 29 nt, Artificial Sequence
  Synthetic Oligonucleotide; PDCD1LG2 exon 3; Set A
auauuuugucauugucugccuuuacuuua

SEQ ID NO: 40294 - RNA, 31 nt, Artificial Sequence
  Synthetic Oligonucleotide; PDCD1LG2 exon 3; Set A
gauauuuugucauugucugccuuuacuuuac

SEQ ID NO: 40295 - RNA, 27 nt, Artificial Sequence
  Synthetic Oligonucleotide; PDCD1LG2 exon 3; Set C
uauuuugucauugucugccuuuacuuu

SEQ ID NO: 40296 - RNA, 25 nt, Artificial Sequence
  Synthetic Oligonucleotide; PDCD1LG2 exon 3; Set C
auuuugucauugucugccuuuacuu

SEQ ID NO: 40297 - RNA, 23 nt, Artificial Sequence
  Synthetic Oligonucleotide; PDCD1LG2 exon 3; Set C
uuuugucauugucugccuuuacu

SEQ ID NO: 40298 - RNA, 21 nt, Artificial Sequence
  Synthetic Oligonucleotide; PDCD1LG2 exon 3; Set C
uuugucauugucugccuuuac

SEQ ID NO: 40299 - RNA, 30 nt, Artificial Sequence
  Synthetic Oligonucleotide; PDCD1LG2 exon 3; Set A
gauauuuugucauugucugccuuuacuuua

SEQ ID NO: 40300 - RNA, 28 nt, Artificial Sequence
  Synthetic Oligonucleotide; PDCD1LG2 exon 3; Set C
auauuuugucauugucugccuuuacuuu

SEQ ID NO: 40301 - RNA, 26 nt, Artificial Sequence
  Synthetic Oligonucleotide; PDCD1LG2 exon 3; Set C
uauuuugucauugucugccuuuacuu

SEQ ID NO: 40302 - RNA, 24 nt, Artificial Sequence
  Synthetic Oligonucleotide; PDCD1LG2 exon 3; Set C
auuuugucauugucugccuuuacu

SEQ ID NO: 40303 - RNA, 22 nt, Artificial Sequence
  Synthetic Oligonucleotide; PDCD1LG2 exon 3; Set C
uuuugucauugucugccuuuac

SEQ ID NO: 40304 - RNA, 29 nt, Artificial Sequence
  Synthetic Oligonucleotide; PDCD1LG2 exon 3; Set A
gauauuuugucauugucugccuuuacuuu

SEQ ID NO: 40305 - RNA, 27 nt, Artificial Sequence
  Synthetic Oligonucleotide; PDCD1LG2 exon 3; Set C
auauuuugucauugucugccuuuacuu

SEQ ID NO: 40306 - RNA, 25 nt, Artificial Sequence
  Synthetic Oligonucleotide; PDCD1LG2 exon 3; Set C
uauuuugucauugucugccuuuacu

SEQ ID NO: 40307 - RNA, 23 nt, Artificial Sequence
  Synthetic Oligonucleotide; PDCD1LG2 exon 3; Set C
auuuugucauugucugccuuuac

SEQ ID NO: 40308 - RNA, 21 nt, Artificial Sequence
  Synthetic Oligonucleotide; PDCD1LG2 exon 3; Set C
uuuugucauugucugccuuua

SEQ ID NO: 40309 - RNA, 28 nt, Artificial Sequence
  Synthetic Oligonucleotide; PDCD1LG2 exon 3; Set A
gauauuuugucauugucugccuuuacuu

SEQ ID NO: 40310 - RNA, 26 nt, Artificial Sequence
  Synthetic Oligonucleotide; PDCD1LG2 exon 3; Set C
auauuuugucauugucugccuuuacu

SEQ ID NO: 40311 - RNA, 24 nt, Artificial Sequence
  Synthetic Oligonucleotide; PDCD1LG2 exon 3; Set C
uauuuugucauugucugccuuuac

SEQ ID NO: 40312 - RNA, 22 nt, Artificial Sequence
  Synthetic Oligonucleotide; PDCD1LG2 exon 3; Set C
auuuugucauugucugccuuua

SEQ ID NO: 40313 - RNA, 27 nt, Artificial Sequence
  Synthetic Oligonucleotide; PDCD1LG2 exon 3; Set A
gauauuuugucauugucugccuuuacu

SEQ ID NO: 40314 - RNA, 25 nt, Artificial Sequence
  Synthetic Oligonucleotide; PDCD1LG2 exon 3; Set C
auauuuugucauugucugccuuuac

SEQ ID NO: 40315 - RNA, 23 nt, Artificial Sequence
  Synthetic Oligonucleotide; PDCD1LG2 exon 3; Set C
uauuuugucauugucugccuuua

SEQ ID NO: 40316 - RNA, 26 nt, Artificial Sequence
  Synthetic Oligonucleotide; PDCD1LG2 exon 3; Set C
gauauuuugucauugucugccuuuac

SEQ ID NO: 40317 - RNA, 24 nt, Artificial Sequence
  Synthetic Oligonucleotide; PDCD1LG2 exon 3; Set C
auauuuugucauugucugccuuua

SEQ ID NO: 40318 - RNA, 25 nt, Artificial Sequence
  Synthetic Oligonucleotide; PDCD1LG2 exon 3; Set C
gauauuuugucauugucugccuuua

SEQ ID NO: 40319 - RNA, 23 nt, Artificial Sequence
  Synthetic Oligonucleotide; PDCD1LG2 exon 3; Set C
auauuuugucauugucugccuuu

SEQ ID NO: 40320 - RNA, 24 nt, Artificial Sequence
  Synthetic Oligonucleotide; PDCD1LG2 exon 3; Set C
gauauuuugucauugucugccuuu

SEQ ID NO: 40321 - RNA, 18 nt, Artificial Sequence
  Synthetic Oligonucleotide; PDCD1LG2 exon 3; Set C
uugcugccaugcucuauu

SEQ ID NO: 40322 - RNA, 22 nt, Artificial Sequence
  Synthetic Oligonucleotide; PDCD1LG2 exon 3; Set A
cacauugcugccaugcucuauu

SEQ ID NO: 40323 - RNA, 23 nt, Artificial Sequence
  Synthetic Oligonucleotide; PDCD1LG2 exon 3; Set A
ucacauugcugccaugcucuauu

SEQ ID NO: 40324 - RNA, 24 nt, Artificial Sequence
  Synthetic Oligonucleotide; PDCD1LG2 exon 3; Set A
gucacauugcugccaugcucuauu

SEQ ID NO: 40325 - RNA, 22 nt, Artificial Sequence
  Synthetic Oligonucleotide; PDCD1LG2 exon 3; Set A
ucacauugcugccaugcucuau

SEQ ID NO: 40326 - RNA, 25 nt, Artificial Sequence
  Synthetic Oligonucleotide; PDCD1LG2 exon 3; Set C
ggucacauugcugccaugcucuauu

SEQ ID NO: 40327 - RNA, 23 nt, Artificial Sequence
  Synthetic Oligonucleotide; PDCD1LG2 exon 3; Set A
gucacauugcugccaugcucuau

SEQ ID NO: 40328 - RNA, 21 nt, Artificial Sequence
  Synthetic Oligonucleotide; PDCD1LG2 exon 3; Set A
ucacauugcugccaugcucua

SEQ ID NO: 40329 - RNA, 24 nt, Artificial Sequence
  Synthetic Oligonucleotide; PDCD1LG2 exon 3; Set C
ggucacauugcugccaugcucuau

SEQ ID NO: 40330 - RNA, 22 nt, Artificial Sequence
  Synthetic Oligonucleotide; PDCD1LG2 exon 3; Set A
gucacauugcugccaugcucua

SEQ ID NO: 40331 - RNA, 21 nt, Artificial Sequence
  Synthetic Oligonucleotide; PDCD1LG2 exon 3; Set A
gucacauugcugccaugcucu

SEQ ID NO: 40332 - RNA, 23 nt, Artificial Sequence
  Synthetic Oligonucleotide; PDCD1LG2 exon 3; Set C
ggucacauugcugccaugcucua

SEQ ID NO: 40333 - RNA, 22 nt, Artificial Sequence
  Synthetic Oligonucleotide; PDCD1LG2 exon 3; Set C
ggucacauugcugccaugcucu

SEQ ID NO: 40334 - RNA, 31 nt, Artificial Sequence
  Synthetic Oligonucleotide; PDCD1LG2 exon 3; Set C
uuccagggucacauugcugccaugcucuauu

SEQ ID NO: 40335 - RNA, 15 nt, Artificial Sequence
  Synthetic Oligonucleotide; PDCD1LG2 exon 3; Set C
ucacauugcugccau

SEQ ID NO: 40336 - RNA, 32 nt, Artificial Sequence
  Synthetic Oligonucleotide; PDCD1LG2 exon 3; Set C
auuccagggucacauugcugccaugcucuauu

SEQ ID NO: 40337 - RNA, 30 nt, Artificial Sequence
  Synthetic Oligonucleotide; PDCD1LG2 exon 3; Set C
uuccagggucacauugcugccaugcucuau

SEQ ID NO: 40338 - RNA, 16 nt, Artificial Sequence
  Synthetic Oligonucleotide; PDCD1LG2 exon 3; Set C
gucacauugcugccau

SEQ ID NO: 40339 - RNA, 33 nt, Artificial Sequence
  Synthetic Oligonucleotide; PDCD1LG2 exon 3; Set C
cauuccagggucacauugcugccaugcucuauu

SEQ ID NO: 40340 - RNA, 31 nt, Artificial Sequence
  Synthetic Oligonucleotide; PDCD1LG2 exon 3; Set C
auuccagggucacauugcugccaugcucuau

SEQ ID NO: 40341 - RNA, 29 nt, Artificial Sequence
  Synthetic Oligonucleotide; PDCD1LG2 exon 3; Set C
uuccagggucacauugcugccaugcucua

SEQ ID NO: 40342 - RNA, 17 nt, Artificial Sequence
  Synthetic Oligonucleotide; PDCD1LG2 exon 3; Set C
ggucacauugcugccau

SEQ ID NO: 40343 - RNA, 15 nt, Artificial Sequence
  Synthetic Oligonucleotide; PDCD1LG2 exon 3; Set C
gucacauugcugcca

SEQ ID NO: 40344 - RNA, 34 nt, Artificial Sequence
  Synthetic Oligonucleotide; PDCD1LG2 exon 3; Set C
gcauuccagggucacauugcugccaugcucuauu

SEQ ID NO: 40345 - RNA, 32 nt, Artificial Sequence
  Synthetic Oligonucleotide; PDCD1LG2 exon 3; Set C
cauuccagggucacauugcugccaugcucuau

SEQ ID NO: 40346 - RNA, 28 nt, Artificial Sequence
  Synthetic Oligonucleotide; PDCD1LG2 exon 3; Set C
uuccagggucacauugcugccaugcucu

SEQ ID NO: 40347 - RNA, 30 nt, Artificial Sequence
  Synthetic Oligonucleotide; PDCD1LG2 exon 3; Set C
auuccagggucacauugcugccaugcucua

SEQ ID NO: 40348 - RNA, 16 nt, Artificial Sequence
  Synthetic Oligonucleotide; PDCD1LG2 exon 3; Set C
ggucacauugcugcca

SEQ ID NO: 40349 - RNA, 35 nt, Artificial Sequence
  Synthetic Oligonucleotide; PDCD1LG2 exon 3; Set C
ugcauuccagggucacauugcugccaugcucuauu

SEQ ID NO: 40350 - RNA, 33 nt, Artificial Sequence
  Synthetic Oligonucleotide; PDCD1LG2 exon 3; Set C
gcauuccagggucacauugcugccaugcucuau

SEQ ID NO: 40351 - RNA, 29 nt, Artificial Sequence
  Synthetic Oligonucleotide; PDCD1LG2 exon 3; Set C
auuccagggucacauugcugccaugcucu

SEQ ID NO: 40352 - RNA, 31 nt, Artificial Sequence
  Synthetic Oligonucleotide; PDCD1LG2 exon 3; Set C
cauuccagggucacauugcugccaugcucua

SEQ ID NO: 40353 - RNA, 36 nt, Artificial Sequence
  Synthetic Oligonucleotide; PDCD1LG2 exon 3; Set C
uugcauuccagggucacauugcugccaugcucuauu

SEQ ID NO: 40354 - RNA, 34 nt, Artificial Sequence
  Synthetic Oligonucleotide; PDCD1LG2 exon 3; Set C
ugcauuccagggucacauugcugccaugcucuau

SEQ ID NO: 40355 - RNA, 30 nt, Artificial Sequence
  Synthetic Oligonucleotide; PDCD1LG2 exon 3; Set C
cauuccagggucacauugcugccaugcucu

SEQ ID NO: 40356 - RNA, 32 nt, Artificial Sequence
  Synthetic Oligonucleotide; PDCD1LG2 exon 3; Set C
gcauuccagggucacauugcugccaugcucua

SEQ ID NO: 40357 - RNA, 37 nt, Artificial Sequence
  Synthetic Oligonucleotide; PDCD1LG2 exon 3; Set C
guugcauuccagggucacauugcugccaugcucuauu

SEQ ID NO: 40358 - RNA, 35 nt, Artificial Sequence
  Synthetic Oligonucleotide; PDCD1LG2 exon 3; Set C
uugcauuccagggucacauugcugccaugcucuau

SEQ ID NO: 40359 - RNA, 31 nt, Artificial Sequence
  Synthetic Oligonucleotide; PDCD1LG2 exon 3; Set C
gcauuccagggucacauugcugccaugcucu

SEQ ID NO: 40360 - RNA, 33 nt, Artificial Sequence
  Synthetic Oligonucleotide; PDCD1LG2 exon 3; Set C
ugcauuccagggucacauugcugccaugcucua

SEQ ID NO: 40361 - RNA, 38 nt, Artificial Sequence
  Synthetic Oligonucleotide; PDCD1LG2 exon 3; Set C
aguugcauuccagggucacauugcugccaugcucuauu

SEQ ID NO: 40362 - RNA, 36 nt, Artificial Sequence
  Synthetic Oligonucleotide; PDCD1LG2 exon 3; Set C
guugcauuccagggucacauugcugccaugcucuau

SEQ ID NO: 40363 - RNA, 32 nt, Artificial Sequence
  Synthetic Oligonucleotide; PDCD1LG2 exon 3; Set C
ugcauuccagggucacauugcugccaugcucu

SEQ ID NO: 40364 - RNA, 34 nt, Artificial Sequence
  Synthetic Oligonucleotide; PDCD1LG2 exon 3; Set C
uugcauuccagggucacauugcugccaugcucua

SEQ ID NO: 40365 - RNA, 39 nt, Artificial Sequence
  Synthetic Oligonucleotide; PDCD1LG2 exon 3; Set C
aaguugcauuccagggucacauugcugccaugcucuauu

SEQ ID NO: 40366 - RNA, 37 nt, Artificial Sequence
  Synthetic Oligonucleotide; PDCD1LG2 exon 3; Set C
aguugcauuccagggucacauugcugccaugcucuau

SEQ ID NO: 40367 - RNA, 33 nt, Artificial Sequence
  Synthetic Oligonucleotide; PDCD1LG2 exon 3; Set C
uugcauuccagggucacauugcugccaugcucu

SEQ ID NO: 40368 - RNA, 35 nt, Artificial Sequence
  Synthetic Oligonucleotide; PDCD1LG2 exon 3; Set C
guugcauuccagggucacauugcugccaugcucua

SEQ ID NO: 40369 - RNA, 23 nt, Artificial Sequence
  Synthetic Oligonucleotide; PDCD1LG2 exon 3; Set C
uuccagggucacauugcugccau

SEQ ID NO: 40370 - RNA, 38 nt, Artificial Sequence
  Synthetic Oligonucleotide; PDCD1LG2 exon 3; Set C
aaguugcauuccagggucacauugcugccaugcucuau

SEQ ID NO: 40371 - RNA, 34 nt, Artificial Sequence
  Synthetic Oligonucleotide; PDCD1LG2 exon 3; Set C
guugcauuccagggucacauugcugccaugcucu

SEQ ID NO: 40372 - RNA, 40 nt, Artificial Sequence
  Synthetic Oligonucleotide; PDCD1LG2 exon 3; Set C
aaaguugcauuccagggucacauugcugccaugcucuauu

SEQ ID NO: 40373 - RNA, 36 nt, Artificial Sequence
  Synthetic Oligonucleotide; PDCD1LG2 exon 3; Set C
aguugcauuccagggucacauugcugccaugcucua

SEQ ID NO: 40374 - RNA, 24 nt, Artificial Sequence
  Synthetic Oligonucleotide; PDCD1LG2 exon 3; Set C
auuccagggucacauugcugccau

SEQ ID NO: 40375 - RNA, 22 nt, Artificial Sequence
  Synthetic Oligonucleotide; PDCD1LG2 exon 3; Set C
uuccagggucacauugcugcca

SEQ ID NO: 40376 - RNA, 35 nt, Artificial Sequence
  Synthetic Oligonucleotide; PDCD1LG2 exon 3; Set C
aguugcauuccagggucacauugcugccaugcucu

SEQ ID NO: 40377 - RNA, 39 nt, Artificial Sequence
  Synthetic Oligonucleotide; PDCD1LG2 exon 3; Set C
aaaguugcauuccagggucacauugcugccaugcucuau

SEQ ID NO: 40378 - RNA, 37 nt, Artificial Sequence
  Synthetic Oligonucleotide; PDCD1LG2 exon 3; Set C
aaguugcauuccagggucacauugcugccaugcucua

SEQ ID NO: 40379 - RNA, 25 nt, Artificial Sequence
  Synthetic Oligonucleotide; PDCD1LG2 exon 3; Set C
cauuccagggucacauugcugccau

SEQ ID NO: 40380 - RNA, 23 nt, Artificial Sequence
  Synthetic Oligonucleotide; PDCD1LG2 exon 3; Set C
auuccagggucacauugcugcca

SEQ ID NO: 40381 - RNA, 36 nt, Artificial Sequence
  Synthetic Oligonucleotide; PDCD1LG2 exon 3; Set C
aaguugcauuccagggucacauugcugccaugcucu

SEQ ID NO: 40382 - RNA, 40 nt, Artificial Sequence
  Synthetic Oligonucleotide; PDCD1LG2 exon 3; Set C
caaaguugcauuccagggucacauugcugccaugcucuau

SEQ ID NO: 40383 - RNA, 38 nt, Artificial Sequence
  Synthetic Oligonucleotide; PDCD1LG2 exon 3; Set C
aaaguugcauuccagggucacauugcugccaugcucua

SEQ ID NO: 40384 - RNA, 26 nt, Artificial Sequence
  Synthetic Oligonucleotide; PDCD1LG2 exon 3; Set C
gcauuccagggucacauugcugccau

SEQ ID NO: 40385 - RNA, 24 nt, Artificial Sequence
  Synthetic Oligonucleotide; PDCD1LG2 exon 3; Set C
cauuccagggucacauugcugcca

SEQ ID NO: 40386 - RNA, 37 nt, Artificial Sequence
  Synthetic Oligonucleotide; PDCD1LG2 exon 3; Set C
aaaguugcauuccagggucacauugcugccaugcucu

SEQ ID NO: 40387 - RNA, 39 nt, Artificial Sequence
  Synthetic Oligonucleotide; PDCD1LG2 exon 3; Set C
caaaguugcauuccagggucacauugcugccaugcucua

SEQ ID NO: 40388 - RNA, 27 nt, Artificial Sequence
  Synthetic Oligonucleotide; PDCD1LG2 exon 3; Set C
ugcauuccagggucacauugcugccau

SEQ ID NO: 40389 - RNA, 15 nt, Artificial Sequence
  Synthetic Oligonucleotide; PDCD1LG2 exon 3; Set C
ccagggucacauugc

SEQ ID NO: 40390 - RNA, 25 nt, Artificial Sequence
  Synthetic Oligonucleotide; PDCD1LG2 exon 3; Set C
gcauuccagggucacauugcugcca

SEQ ID NO: 40391 - RNA, 38 nt, Artificial Sequence
  Synthetic Oligonucleotide; PDCD1LG2 exon 3; Set C
caaaguugcauuccagggucacauugcugccaugcucu

SEQ ID NO: 40392 - RNA, 40 nt, Artificial Sequence
  Synthetic Oligonucleotide; PDCD1LG2 exon 3; Set C
ucaaaguugcauuccagggucacauugcugccaugcucua

SEQ ID NO: 40393 - RNA, 28 nt, Artificial Sequence
  Synthetic Oligonucleotide; PDCD1LG2 exon 3; Set C
uugcauuccagggucacauugcugccau

SEQ ID NO: 40394 - RNA, 16 nt, Artificial Sequence
  Synthetic Oligonucleotide; PDCD1LG2 exon 3; Set C
uccagggucacauugc

SEQ ID NO: 40395 - RNA, 26 nt, Artificial Sequence
  Synthetic Oligonucleotide; PDCD1LG2 exon 3; Set C
ugcauuccagggucacauugcugcca

SEQ ID NO: 40396 - RNA, 15 nt, Artificial Sequence
  Synthetic Oligonucleotide; PDCD1LG2 exon 3; Set C
uccagggucacauug

SEQ ID NO: 40397 - RNA, 39 nt, Artificial Sequence
  Synthetic Oligonucleotide; PDCD1LG2 exon 3; Set C
ucaaaguugcauuccagggucacauugcugccaugcucu

SEQ ID NO: 40398 - RNA, 29 nt, Artificial Sequence
  Synthetic Oligonucleotide; PDCD1LG2 exon 3; Set C
guugcauuccagggucacauugcugccau

SEQ ID NO: 40399 - RNA, 17 nt, Artificial Sequence
  Synthetic Oligonucleotide; PDCD1LG2 exon 3; Set C
uuccagggucacauugc

SEQ ID NO: 40400 - RNA, 27 nt, Artificial Sequence
  Synthetic Oligonucleotide; PDCD1LG2 exon 3; Set C
uugcauuccagggucacauugcugcca

SEQ ID NO: 40401 - RNA, 16 nt, Artificial Sequence
  Synthetic Oligonucleotide; PDCD1LG2 exon 3; Set C
uuccagggucacauug

SEQ ID NO: 40402 - RNA, 30 nt, Artificial Sequence
  Synthetic Oligonucleotide; PDCD1LG2 exon 3; Set C
aguugcauuccagggucacauugcugccau

SEQ ID NO: 40403 - RNA, 18 nt, Artificial Sequence
  Synthetic Oligonucleotide; PDCD1LG2 exon 3; Set C
auuccagggucacauugc

SEQ ID NO: 40404 - RNA, 28 nt, Artificial Sequence
  Synthetic Oligonucleotide; PDCD1LG2 exon 3; Set C
guugcauuccagggucacauugcugcca

SEQ ID NO: 40405 - RNA, 17 nt, Artificial Sequence
  Synthetic Oligonucleotide; PDCD1LG2 exon 3; Set C
auuccagggucacauug

SEQ ID NO: 40406 - RNA, 31 nt, Artificial Sequence
  Synthetic Oligonucleotide; PDCD1LG2 exon 3; Set C
aaguugcauuccagggucacauugcugccau

SEQ ID NO: 40407 - RNA, 15 nt, Artificial Sequence
  Synthetic Oligonucleotide; PDCD1LG2 exon 3; Set C
uuccagggucacauu

SEQ ID NO: 40408 - RNA, 29 nt, Artificial Sequence
  Synthetic Oligonucleotide; PDCD1LG2 exon 3; Set C
aguugcauuccagggucacauugcugcca

SEQ ID NO: 40409 - RNA, 32 nt, Artificial Sequence
  Synthetic Oligonucleotide; PDCD1LG2 exon 3; Set C
aaaguugcauuccagggucacauugcugccau

SEQ ID NO: 40410 - RNA, 16 nt, Artificial Sequence
  Synthetic Oligonucleotide; PDCD1LG2 exon 3; Set C
auuccagggucacauu

SEQ ID NO: 40411 - RNA, 30 nt, Artificial Sequence
  Synthetic Oligonucleotide; PDCD1LG2 exon 3; Set C
aaguugcauuccagggucacauugcugcca

SEQ ID NO: 40412 - RNA, 33 nt, Artificial Sequence
  Synthetic Oligonucleotide; PDCD1LG2 exon 3; Set C
caaaguugcauuccagggucacauugcugccau

SEQ ID NO: 40413 - RNA, 15 nt, Artificial Sequence
  Synthetic Oligonucleotide; PDCD1LG2 exon 3; Set C
auuccagggucacau

SEQ ID NO: 40414 - RNA, 34 nt, Artificial Sequence
  Synthetic Oligonucleotide; PDCD1LG2 exon 3; Set C
ucaaaguugcauuccagggucacauugcugccau

SEQ ID NO: 40415 - RNA, 16 nt, Artificial Sequence
  Synthetic Oligonucleotide; PDCD1LG2 exon 3; Set C
cauuccagggucacau

SEQ ID NO: 40416 - RNA, 35 nt, Artificial Sequence
  Synthetic Oligonucleotide; PDCD1LG2 exon 3; Set C
gucaaaguugcauuccagggucacauugcugccau

SEQ ID NO: 40417 - RNA, 17 nt, Artificial Sequence
  Synthetic Oligonucleotide; PDCD1LG2 exon 3; Set C
gcauuccagggucacau

SEQ ID NO: 40418 - RNA, 15 nt, Artificial Sequence
  Synthetic Oligonucleotide; PDCD1LG2 exon 3; Set C
cauuccagggucaca

SEQ ID NO: 40419 - RNA, 36 nt, Artificial Sequence
  Synthetic Oligonucleotide; PDCD1LG2 exon 3; Set C
ugucaaaguugcauuccagggucacauugcugccau

SEQ ID NO: 40420 - RNA, 18 nt, Artificial Sequence
  Synthetic Oligonucleotide; PDCD1LG2 exon 3; Set C
ugcauuccagggucacau

SEQ ID NO: 40421 - RNA, 16 nt, Artificial Sequence
  Synthetic Oligonucleotide; PDCD1LG2 exon 3; Set C
gcauuccagggucaca

SEQ ID NO: 40422 - RNA, 37 nt, Artificial Sequence
  Synthetic Oligonucleotide; PDCD1LG2 exon 3; Set C
gugucaaaguugcauuccagggucacauugcugccau

SEQ ID NO: 40423 - RNA, 19 nt, Artificial Sequence
  Synthetic Oligonucleotide; PDCD1LG2 exon 3; Set C
uugcauuccagggucacau

SEQ ID NO: 40424 - RNA, 15 nt, Artificial Sequence
  Synthetic Oligonucleotide; PDCD1LG2 exon 3; Set C
gcauuccagggucac

SEQ ID NO: 40425 - RNA, 35 nt, Artificial Sequence
  Synthetic Oligonucleotide; PDCD1LG2 exon 3; Set C
ugucaaaguugcauuccagggucacauugcugcca

SEQ ID NO: 40426 - RNA, 17 nt, Artificial Sequence
  Synthetic Oligonucleotide; PDCD1LG2 exon 3; Set C
ugcauuccagggucaca

SEQ ID NO: 40427 - RNA, 38 nt, Artificial Sequence
  Synthetic Oligonucleotide; PDCD1LG2 exon 3; Set C
agugucaaaguugcauuccagggucacauugcugccau

SEQ ID NO: 40428 - RNA, 26 nt, Artificial Sequence
  Synthetic Oligonucleotide; PDCD1LG2 exon 3; Set A
aaaguugcauuccagggucacauugc

SEQ ID NO: 40429 - RNA, 16 nt, Artificial Sequence
  Synthetic Oligonucleotide; PDCD1LG2 exon 3; Set C
ugcauuccagggucac

SEQ ID NO: 40430 - RNA, 36 nt, Artificial Sequence
  Synthetic Oligonucleotide; PDCD1LG2 exon 3; Set C
gugucaaaguugcauuccagggucacauugcugcca

SEQ ID NO: 40431 - RNA, 18 nt, Artificial Sequence
  Synthetic Oligonucleotide; PDCD1LG2 exon 3; Set C
uugcauuccagggucaca

SEQ ID NO: 40432 - RNA, 25 nt, Artificial Sequence
  Synthetic Oligonucleotide; PDCD1LG2 exon 3; Set A
aaaguugcauuccagggucacauug

SEQ ID NO: 40433 - RNA, 39 nt, Artificial Sequence
  Synthetic Oligonucleotide; PDCD1LG2 exon 3; Set C
cagugucaaaguugcauuccagggucacauugcugccau

SEQ ID NO: 40434 - RNA, 27 nt, Artificial Sequence
  Synthetic Oligonucleotide; PDCD1LG2 exon 3; Set A
caaaguugcauuccagggucacauugc

SEQ ID NO: 40435 - RNA, 15 nt, Artificial Sequence
  Synthetic Oligonucleotide; PDCD1LG2 exon 3; Set C
ugcauuccaggguca

SEQ ID NO: 40436 - RNA, 17 nt, Artificial Sequence
  Synthetic Oligonucleotide; PDCD1LG2 exon 3; Set C
uugcauuccagggucac

SEQ ID NO: 40437 - RNA, 37 nt, Artificial Sequence
  Synthetic Oligonucleotide; PDCD1LG2 exon 3; Set C
agugucaaaguugcauuccagggucacauugcugcca

SEQ ID NO: 40438 - RNA, 19 nt, Artificial Sequence
  Synthetic Oligonucleotide; PDCD1LG2 exon 3; Set A
guugcauuccagggucaca

SEQ ID NO: 40439 - RNA, 26 nt, Artificial Sequence
  Synthetic Oligonucleotide; PDCD1LG2 exon 3; Set A
caaaguugcauuccagggucacauug

SEQ ID NO: 40440 - RNA, 40 nt, Artificial Sequence
  Synthetic Oligonucleotide; PDCD1LG2 exon 3; Set C
ccagugucaaaguugcauuccagggucacauugcugccau

SEQ ID NO: 40441 - RNA, 28 nt, Artificial Sequence
  Synthetic Oligonucleotide; PDCD1LG2 exon 3; Set A
ucaaaguugcauuccagggucacauugc

SEQ ID NO: 40442 - RNA, 24 nt, Artificial Sequence
  Synthetic Oligonucleotide; PDCD1LG2 exon 3; Set A
aaaguugcauuccagggucacauu

SEQ ID NO: 40443 - RNA, 16 nt, Artificial Sequence
  Synthetic Oligonucleotide; PDCD1LG2 exon 3; Set C
uugcauuccaggguca

SEQ ID NO: 40444 - RNA, 38 nt, Artificial Sequence
  Synthetic Oligonucleotide; PDCD1LG2 exon 3; Set C
cagugucaaaguugcauuccagggucacauugcugcca

SEQ ID NO: 40445 - RNA, 20 nt, Artificial Sequence
  Synthetic Oligonucleotide; PDCD1LG2 exon 3; Set A
aguugcauuccagggucaca

SEQ ID NO: 40446 - RNA, 27 nt, Artificial Sequence
  Synthetic Oligonucleotide; PDCD1LG2 exon 3; Set A
ucaaaguugcauuccagggucacauug

SEQ ID NO: 40447 - RNA, 29 nt, Artificial Sequence
  Synthetic Oligonucleotide; PDCD1LG2 exon 3; Set C
gucaaaguugcauuccagggucacauugc

SEQ ID NO: 40448 - RNA, 25 nt, Artificial Sequence
  Synthetic Oligonucleotide; PDCD1LG2 exon 3; Set A
caaaguugcauuccagggucacauu

SEQ ID NO: 40449 - RNA, 23 nt, Artificial Sequence
  Synthetic Oligonucleotide; PDCD1LG2 exon 3; Set A
aaaguugcauuccagggucacau

SEQ ID NO: 40450 - RNA, 39 nt, Artificial Sequence
  Synthetic Oligonucleotide; PDCD1LG2 exon 3; Set C
ccagugucaaaguugcauuccagggucacauugcugcca

SEQ ID NO: 40451 - RNA, 21 nt, Artificial Sequence
  Synthetic Oligonucleotide; PDCD1LG2 exon 3; Set A
aaguugcauuccagggucaca

SEQ ID NO: 40452 - RNA, 28 nt, Artificial Sequence
  Synthetic Oligonucleotide; PDCD1LG2 exon 3; Set A
gucaaaguugcauuccagggucacauug

SEQ ID NO: 40453 - RNA, 30 nt, Artificial Sequence
  Synthetic Oligonucleotide; PDCD1LG2 exon 3; Set C
ugucaaaguugcauuccagggucacauugc

SEQ ID NO: 40454 - RNA, 26 nt, Artificial Sequence
  Synthetic Oligonucleotide; PDCD1LG2 exon 3; Set A
ucaaaguugcauuccagggucacauu

SEQ ID NO: 40455 - RNA, 24 nt, Artificial Sequence
  Synthetic Oligonucleotide; PDCD1LG2 exon 3; Set A
caaaguugcauuccagggucacau

SEQ ID NO: 40456 - RNA, 40 nt, Artificial Sequence
  Synthetic Oligonucleotide; PDCD1LG2 exon 3; Set C
uccagugucaaaguugcauuccagggucacauugcugcca

SEQ ID NO: 40457 - RNA, 22 nt, Artificial Sequence
  Synthetic Oligonucleotide; PDCD1LG2 exon 3; Set A
aaaguugcauuccagggucaca

SEQ ID NO: 40458 - RNA, 29 nt, Artificial Sequence
  Synthetic Oligonucleotide; PDCD1LG2 exon 3; Set A
ugucaaaguugcauuccagggucacauug

SEQ ID NO: 40459 - RNA, 31 nt, Artificial Sequence
  Synthetic Oligonucleotide; PDCD1LG2 exon 3; Set C
gugucaaaguugcauuccagggucacauugc

SEQ ID NO: 40460 - RNA, 27 nt, Artificial Sequence
  Synthetic Oligonucleotide; PDCD1LG2 exon 3; Set A
gucaaaguugcauuccagggucacauu

SEQ ID NO: 40461 - RNA, 25 nt, Artificial Sequence
  Synthetic Oligonucleotide; PDCD1LG2 exon 3; Set A
ucaaaguugcauuccagggucacau

SEQ ID NO: 40462 - RNA, 21 nt, Artificial Sequence
  Synthetic Oligonucleotide; PDCD1LG2 exon 3; Set C
aaaguugcauuccagggucac

SEQ ID NO: 40463 - RNA, 23 nt, Artificial Sequence
  Synthetic Oligonucleotide; PDCD1LG2 exon 3; Set A
caaaguugcauuccagggucaca

SEQ ID NO: 40464 - RNA, 30 nt, Artificial Sequence
  Synthetic Oligonucleotide; PDCD1LG2 exon 3; Set A
gugucaaaguugcauuccagggucacauug

SEQ ID NO: 40465 - RNA, 32 nt, Artificial Sequence
  Synthetic Oligonucleotide; PDCD1LG2 exon 3; Set C
agugucaaaguugcauuccagggucacauugc

SEQ ID NO: 40466 - RNA, 28 nt, Artificial Sequence
  Synthetic Oligonucleotide; PDCD1LG2 exon 3; Set A
ugucaaaguugcauuccagggucacauu

SEQ ID NO: 40467 - RNA, 20 nt, Artificial Sequence
  Synthetic Oligonucleotide; PDCD1LG2 exon 3; Set C
aaaguugcauuccaggguca

SEQ ID NO: 40468 - RNA, 26 nt, Artificial Sequence
  Synthetic Oligonucleotide; PDCD1LG2 exon 3; Set A
gucaaaguugcauuccagggucacau

SEQ ID NO: 40469 - RNA, 22 nt, Artificial Sequence
  Synthetic Oligonucleotide; PDCD1LG2 exon 3; Set A
caaaguugcauuccagggucac

SEQ ID NO: 40470 - RNA, 24 nt, Artificial Sequence
  Synthetic Oligonucleotide; PDCD1LG2 exon 3; Set A
ucaaaguugcauuccagggucaca

SEQ ID NO: 40471 - RNA, 19 nt, Artificial Sequence
  Synthetic Oligonucleotide; PDCD1LG2 exon 3; Set C
aaaguugcauuccaggguc

SEQ ID NO: 40472 - RNA, 31 nt, Artificial Sequence
  Synthetic Oligonucleotide; PDCD1LG2 exon 3; Set A
agugucaaaguugcauuccagggucacauug

SEQ ID NO: 40473 - RNA, 33 nt, Artificial Sequence
  Synthetic Oligonucleotide; PDCD1LG2 exon 3; Set C
cagugucaaaguugcauuccagggucacauugc

SEQ ID NO: 40474 - RNA, 29 nt, Artificial Sequence
  Synthetic Oligonucleotide; PDCD1LG2 exon 3; Set A
gugucaaaguugcauuccagggucacauu

SEQ ID NO: 40475 - RNA, 21 nt, Artificial Sequence
  Synthetic Oligonucleotide; PDCD1LG2 exon 3; Set C
caaaguugcauuccaggguca

SEQ ID NO: 40476 - RNA, 27 nt, Artificial Sequence
  Synthetic Oligonucleotide; PDCD1LG2 exon 3; Set A
ugucaaaguugcauuccagggucacau

SEQ ID NO: 40477 - RNA, 23 nt, Artificial Sequence
  Synthetic Oligonucleotide; PDCD1LG2 exon 3; Set A
ucaaaguugcauuccagggucac

SEQ ID NO: 40478 - RNA, 25 nt, Artificial Sequence
  Synthetic Oligonucleotide; PDCD1LG2 exon 3; Set A
gucaaaguugcauuccagggucaca

SEQ ID NO: 40479 - RNA, 20 nt, Artificial Sequence
  Synthetic Oligonucleotide; PDCD1LG2 exon 3; Set C
caaaguugcauuccaggguc

SEQ ID NO: 40480 - RNA, 18 nt, Artificial Sequence
  Synthetic Oligonucleotide; PDCD1LG2 exon 3; Set C
aaaguugcauuccagggu

SEQ ID NO: 40481 - RNA, 32 nt, Artificial Sequence
  Synthetic Oligonucleotide; PDCD1LG2 exon 3; Set C
cagugucaaaguugcauuccagggucacauug

SEQ ID NO: 40482 - RNA, 34 nt, Artificial Sequence
  Synthetic Oligonucleotide; PDCD1LG2 exon 3; Set C
ccagugucaaaguugcauuccagggucacauugc

SEQ ID NO: 40483 - RNA, 30 nt, Artificial Sequence
  Synthetic Oligonucleotide; PDCD1LG2 exon 3; Set A
agugucaaaguugcauuccagggucacauu

SEQ ID NO: 40484 - RNA, 22 nt, Artificial Sequence
  Synthetic Oligonucleotide; PDCD1LG2 exon 3; Set A
ucaaaguugcauuccaggguca

SEQ ID NO: 40485 - RNA, 28 nt, Artificial Sequence
  Synthetic Oligonucleotide; PDCD1LG2 exon 3; Set A
gugucaaaguugcauuccagggucacau

SEQ ID NO: 40486 - RNA, 24 nt, Artificial Sequence
  Synthetic Oligonucleotide; PDCD1LG2 exon 3; Set A
gucaaaguugcauuccagggucac

SEQ ID NO: 40487 - RNA, 26 nt, Artificial Sequence
  Synthetic Oligonucleotide; PDCD1LG2 exon 3; Set A
ugucaaaguugcauuccagggucaca

SEQ ID NO: 40488 - RNA, 19 nt, Artificial Sequence
  Synthetic Oligonucleotide; PDCD1LG2 exon 3; Set C
caaaguugcauuccagggu

SEQ ID NO: 40489 - RNA, 21 nt, Artificial Sequence
  Synthetic Oligonucleotide; PDCD1LG2 exon 3; Set C
ucaaaguugcauuccaggguc

SEQ ID NO: 40490 - RNA, 31 nt, Artificial Sequence
  Synthetic Oligonucleotide; PDCD1LG2 exon 3; Set C
cagugucaaaguugcauuccagggucacauu

SEQ ID NO: 40491 - RNA, 23 nt, Artificial Sequence
  Synthetic Oligonucleotide; PDCD1LG2 exon 3; Set A
gucaaaguugcauuccaggguca

SEQ ID NO: 40492 - RNA, 29 nt, Artificial Sequence
  Synthetic Oligonucleotide; PDCD1LG2 exon 3; Set A
agugucaaaguugcauuccagggucacau

SEQ ID NO: 40493 - RNA, 25 nt, Artificial Sequence
  Synthetic Oligonucleotide; PDCD1LG2 exon 3; Set A
ugucaaaguugcauuccagggucac

SEQ ID NO: 40494 - RNA, 27 nt, Artificial Sequence
  Synthetic Oligonucleotide; PDCD1LG2 exon 3; Set A
gugucaaaguugcauuccagggucaca

SEQ ID NO: 40495 - RNA, 20 nt, Artificial Sequence
  Synthetic Oligonucleotide; PDCD1LG2 exon 3; Set C
ucaaaguugcauuccagggu

SEQ ID NO: 40496 - RNA, 22 nt, Artificial Sequence
  Synthetic Oligonucleotide; PDCD1LG2 exon 3; Set A
gucaaaguugcauuccaggguc

SEQ ID NO: 40497 - RNA, 32 nt, Artificial Sequence
  Synthetic Oligonucleotide; PDCD1LG2 exon 3; Set C
ccagugucaaaguugcauuccagggucacauu

SEQ ID NO: 40498 - RNA, 24 nt, Artificial Sequence
  Synthetic Oligonucleotide; PDCD1LG2 exon 3; Set A
ugucaaaguugcauuccaggguca

SEQ ID NO: 40499 - RNA, 30 nt, Artificial Sequence
  Synthetic Oligonucleotide; PDCD1LG2 exon 3; Set C
cagugucaaaguugcauuccagggucacau

SEQ ID NO: 40500 - RNA, 26 nt, Artificial Sequence
  Synthetic Oligonucleotide; PDCD1LG2 exon 3; Set A
gugucaaaguugcauuccagggucac

SEQ ID NO: 40501 - RNA, 28 nt, Artificial Sequence
  Synthetic Oligonucleotide; PDCD1LG2 exon 3; Set A
agugucaaaguugcauuccagggucaca

SEQ ID NO: 40502 - RNA, 23 nt, Artificial Sequence
  Synthetic Oligonucleotide; PDCD1LG2 exon 3; Set A
ugucaaaguugcauuccaggguc

SEQ ID NO: 40503 - RNA, 21 nt, Artificial Sequence
  Synthetic Oligonucleotide; PDCD1LG2 exon 3; Set C
gucaaaguugcauuccagggu

SEQ ID NO: 40504 - RNA, 25 nt, Artificial Sequence
  Synthetic Oligonucleotide; PDCD1LG2 exon 3; Set A
gugucaaaguugcauuccaggguca

SEQ ID NO: 40505 - RNA, 31 nt, Artificial Sequence
  Synthetic Oligonucleotide; PDCD1LG2 exon 3; Set C
ccagugucaaaguugcauuccagggucacau

SEQ ID NO: 40506 - RNA, 27 nt, Artificial Sequence
  Synthetic Oligonucleotide; PDCD1LG2 exon 3; Set A
agugucaaaguugcauuccagggucac

SEQ ID NO: 40507 - RNA, 29 nt, Artificial Sequence
  Synthetic Oligonucleotide; PDCD1LG2 exon 3; Set C
cagugucaaaguugcauuccagggucaca

SEQ ID NO: 40508 - RNA, 22 nt, Artificial Sequence
  Synthetic Oligonucleotide; PDCD1LG2 exon 3; Set A
ugucaaaguugcauuccagggu

SEQ ID NO: 40509 - RNA, 24 nt, Artificial Sequence
  Synthetic Oligonucleotide; PDCD1LG2 exon 3; Set A
gugucaaaguugcauuccaggguc

SEQ ID NO: 40510 - RNA, 26 nt, Artificial Sequence
  Synthetic Oligonucleotide; PDCD1LG2 exon 3; Set A
agugucaaaguugcauuccaggguca

SEQ ID NO: 40511 - RNA, 28 nt, Artificial Sequence
  Synthetic Oligonucleotide; PDCD1LG2 exon 3; Set A
cagugucaaaguugcauuccagggucac

SEQ ID NO: 40512 - RNA, 30 nt, Artificial Sequence
  Synthetic Oligonucleotide; PDCD1LG2 exon 3; Set C
ccagugucaaaguugcauuccagggucaca

SEQ ID NO: 40513 - RNA, 25 nt, Artificial Sequence
  Synthetic Oligonucleotide; PDCD1LG2 exon 3; Set A
agugucaaaguugcauuccaggguc

SEQ ID NO: 40514 - RNA, 23 nt, Artificial Sequence
  Synthetic Oligonucleotide; PDCD1LG2 exon 3; Set A
gugucaaaguugcauuccagggu

SEQ ID NO: 40515 - RNA, 27 nt, Artificial Sequence
  Synthetic Oligonucleotide; PDCD1LG2 exon 3; Set A
cagugucaaaguugcauuccaggguca

SEQ ID NO: 40516 - RNA, 29 nt, Artificial Sequence
  Synthetic Oligonucleotide; PDCD1LG2 exon 3; Set C
ccagugucaaaguugcauuccagggucac

SEQ ID NO: 40517 - RNA, 31 nt, Artificial Sequence
  Synthetic Oligonucleotide; PDCD1LG2 exon 3; Set C
uccagugucaaaguugcauuccagggucaca

SEQ ID NO: 40518 - RNA, 15 nt, Artificial Sequence
  Synthetic Oligonucleotide; PDCD1LG2 exon 3; Set C
caaaguugcauucca

SEQ ID NO: 40519 - RNA, 24 nt, Artificial Sequence
  Synthetic Oligonucleotide; PDCD1LG2 exon 3; Set A
agugucaaaguugcauuccagggu

SEQ ID NO: 40520 - RNA, 26 nt, Artificial Sequence
  Synthetic Oligonucleotide; PDCD1LG2 exon 3; Set A
cagugucaaaguugcauuccaggguc

SEQ ID NO: 40521 - RNA, 28 nt, Artificial Sequence
  Synthetic Oligonucleotide; PDCD1LG2 exon 3; Set C
ccagugucaaaguugcauuccaggguca

SEQ ID NO: 40522 - RNA, 32 nt, Artificial Sequence
  Synthetic Oligonucleotide; PDCD1LG2 exon 3; Set C
uuccagugucaaaguugcauuccagggucaca

SEQ ID NO: 40523 - RNA, 16 nt, Artificial Sequence
  Synthetic Oligonucleotide; PDCD1LG2 exon 3; Set C
ucaaaguugcauucca

SEQ ID NO: 40524 - RNA, 25 nt, Artificial Sequence
  Synthetic Oligonucleotide; PDCD1LG2 exon 3; Set A
cagugucaaaguugcauuccagggu

SEQ ID NO: 40525 - RNA, 15 nt, Artificial Sequence
  Synthetic Oligonucleotide; PDCD1LG2 exon 3; Set C
ucaaaguugcauucc

SEQ ID NO: 40526 - RNA, 17 nt, Artificial Sequence
  Synthetic Oligonucleotide; PDCD1LG2 exon 3; Set C
gucaaaguugcauucca

SEQ ID NO: 40527 - RNA, 18 nt, Artificial Sequence
  Synthetic Oligonucleotide; PDCD1LG2 exon 3; Set C
ugucaaaguugcauucca

SEQ ID NO: 40528 - RNA, 16 nt, Artificial Sequence
  Synthetic Oligonucleotide; PDCD1LG2 exon 3; Set C
gucaaaguugcauucc

SEQ ID NO: 40529 - RNA, 15 nt, Artificial Sequence
  Synthetic Oligonucleotide; PDCD1LG2 exon 3; Set C
gucaaaguugcauuc

SEQ ID NO: 40530 - RNA, 17 nt, Artificial Sequence
  Synthetic Oligonucleotide; PDCD1LG2 exon 3; Set C
ugucaaaguugcauucc

SEQ ID NO: 40531 - RNA, 19 nt, Artificial Sequence
  Synthetic Oligonucleotide; PDCD1LG2 exon 3; Set C
gugucaaaguugcauucca

SEQ ID NO: 40532 - RNA, 16 nt, Artificial Sequence
  Synthetic Oligonucleotide; PDCD1LG2 exon 3; Set C
ugucaaaguugcauuc

SEQ ID NO: 40533 - RNA, 20 nt, Artificial Sequence
  Synthetic Oligonucleotide; PDCD1LG2 exon 3; Set C
agugucaaaguugcauucca

SEQ ID NO: 40534 - RNA, 18 nt, Artificial Sequence
  Synthetic Oligonucleotide; PDCD1LG2 exon 3; Set C
gugucaaaguugcauucc

SEQ ID NO: 40535 - RNA, 17 nt, Artificial Sequence
  Synthetic Oligonucleotide; PDCD1LG2 exon 3; Set C
gugucaaaguugcauuc

SEQ ID NO: 40536 - RNA, 19 nt, Artificial Sequence
  Synthetic Oligonucleotide; PDCD1LG2 exon 3; Set C
agugucaaaguugcauucc

SEQ ID NO: 40537 - RNA, 21 nt, Artificial Sequence
  Synthetic Oligonucleotide; PDCD1LG2 exon 3; Set C
cagugucaaaguugcauucca

SEQ ID NO: 40538 - RNA, 16 nt, Artificial Sequence
  Synthetic Oligonucleotide; PDCD1LG2 exon 3; Set C
gugucaaaguugcauu

SEQ ID NO: 40539 - RNA, 18 nt, Artificial Sequence
  Synthetic Oligonucleotide; PDCD1LG2 exon 3; Set C
agugucaaaguugcauuc

SEQ ID NO: 40540 - RNA, 22 nt, Artificial Sequence
  Synthetic Oligonucleotide; PDCD1LG2 exon 3; Set C
ccagugucaaaguugcauucca

SEQ ID NO: 40541 - RNA, 20 nt, Artificial Sequence
  Synthetic Oligonucleotide; PDCD1LG2 exon 3; Set C
cagugucaaaguugcauucc

SEQ ID NO: 40542 - RNA, 19 nt, Artificial Sequence
  Synthetic Oligonucleotide; PDCD1LG2 exon 3; Set C
cagugucaaaguugcauuc

SEQ ID NO: 40543 - RNA, 23 nt, Artificial Sequence
  Synthetic Oligonucleotide; PDCD1LG2 exon 3; Set A
uccagugucaaaguugcauucca

SEQ ID NO: 40544 - RNA, 21 nt, Artificial Sequence
  Synthetic Oligonucleotide; PDCD1LG2 exon 3; Set C
ccagugucaaaguugcauucc

SEQ ID NO: 40545 - RNA, 40 nt, Artificial Sequence
  Synthetic Oligonucleotide; PDCD1LG2 exon 3; Set C
cacaugacuuccagugucaaaguugcauuccagggucaca

SEQ ID NO: 40546 - RNA, 22 nt, Artificial Sequence
  Synthetic Oligonucleotide; PDCD1LG2 exon 3; Set C
uccagugucaaaguugcauucc

SEQ ID NO: 40547 - RNA, 39 nt, Artificial Sequence
  Synthetic Oligonucleotide; PDCD1LG2 exon 3; Set C
cacaugacuuccagugucaaaguugcauuccagggucac

SEQ ID NO: 40548 - RNA, 38 nt, Artificial Sequence
  Synthetic Oligonucleotide; PDCD1LG2 exon 3; Set C
cacaugacuuccagugucaaaguugcauuccaggguca

SEQ ID NO: 40549 - RNA, 40 nt, Artificial Sequence
  Synthetic Oligonucleotide; PDCD1LG2 exon 3; Set C
ucacaugacuuccagugucaaaguugcauuccagggucac

SEQ ID NO: 40550 - RNA, 37 nt, Artificial Sequence
  Synthetic Oligonucleotide; PDCD1LG2 exon 3; Set C
cacaugacuuccagugucaaaguugcauuccaggguc

SEQ ID NO: 40551 - RNA, 39 nt, Artificial Sequence
  Synthetic Oligonucleotide; PDCD1LG2 exon 3; Set C
ucacaugacuuccagugucaaaguugcauuccaggguca

SEQ ID NO: 40552 - RNA, 38 nt, Artificial Sequence
  Synthetic Oligonucleotide; PDCD1LG2 exon 3; Set C
ucacaugacuuccagugucaaaguugcauuccaggguc

SEQ ID NO: 40553 - RNA, 36 nt, Artificial Sequence
  Synthetic Oligonucleotide; PDCD1LG2 exon 3; Set C
cacaugacuuccagugucaaaguugcauuccagggu

SEQ ID NO: 40554 - RNA, 37 nt, Artificial Sequence
  Synthetic Oligonucleotide; PDCD1LG2 exon 3; Set C
ucacaugacuuccagugucaaaguugcauuccagggu

SEQ ID NO: 40555 - RNA, 30 nt, Artificial Sequence
  Synthetic Oligonucleotide; PDCD1LG2 exon 3; Set A
cacaugacuuccagugucaaaguugcauuc

SEQ ID NO: 40556 - RNA, 29 nt, Artificial Sequence
  Synthetic Oligonucleotide; PDCD1LG2 exon 3; Set A
cacaugacuuccagugucaaaguugcauu

SEQ ID NO: 40557 - RNA, 31 nt, Artificial Sequence
  Synthetic Oligonucleotide; PDCD1LG2 exon 3; Set A
ucacaugacuuccagugucaaaguugcauuc

SEQ ID NO: 40558 - RNA, 28 nt, Artificial Sequence
  Synthetic Oligonucleotide; PDCD1LG2 exon 3; Set A
cacaugacuuccagugucaaaguugcau

SEQ ID NO: 40559 - RNA, 30 nt, Artificial Sequence
  Synthetic Oligonucleotide; PDCD1LG2 exon 3; Set A
ucacaugacuuccagugucaaaguugcauu

SEQ ID NO: 40560 - RNA, 29 nt, Artificial Sequence
  Synthetic Oligonucleotide; PDCD1LG2 exon 3; Set A
ucacaugacuuccagugucaaaguugcau

SEQ ID NO: 40561 - RNA, 27 nt, Artificial Sequence
  Synthetic Oligonucleotide; PDCD1LG2 exon 3; Set A
cacaugacuuccagugucaaaguugca

SEQ ID NO: 40562 - RNA, 28 nt, Artificial Sequence
  Synthetic Oligonucleotide; PDCD1LG2 exon 3; Set A
ucacaugacuuccagugucaaaguugca

SEQ ID NO: 40563 - RNA, 26 nt, Artificial Sequence
  Synthetic Oligonucleotide; PDCD1LG2 exon 3; Set A
cacaugacuuccagugucaaaguugc

SEQ ID NO: 40564 - RNA, 27 nt, Artificial Sequence
  Synthetic Oligonucleotide; PDCD1LG2 exon 3; Set A
ucacaugacuuccagugucaaaguugc

SEQ ID NO: 40565 - RNA, 25 nt, Artificial Sequence
  Synthetic Oligonucleotide; PDCD1LG2 exon 3; Set C
cacaugacuuccagugucaaaguug

SEQ ID NO: 40566 - RNA, 24 nt, Artificial Sequence
  Synthetic Oligonucleotide; PDCD1LG2 exon 3; Set C
cacaugacuuccagugucaaaguu

SEQ ID NO: 40567 - RNA, 26 nt, Artificial Sequence
  Synthetic Oligonucleotide; PDCD1LG2 exon 3; Set A
ucacaugacuuccagugucaaaguug

SEQ ID NO: 40568 - RNA, 25 nt, Artificial Sequence
  Synthetic Oligonucleotide; PDCD1LG2 exon 3; Set A
ucacaugacuuccagugucaaaguu

SEQ ID NO: 40569 - RNA, 23 nt, Artificial Sequence
  Synthetic Oligonucleotide; PDCD1LG2 exon 3; Set C
cacaugacuuccagugucaaagu

SEQ ID NO: 40570 - RNA, 22 nt, Artificial Sequence
  Synthetic Oligonucleotide; PDCD1LG2 exon 3; Set C
cacaugacuuccagugucaaag

SEQ ID NO: 40571 - RNA, 24 nt, Artificial Sequence
  Synthetic Oligonucleotide; PDCD1LG2 exon 3; Set A
ucacaugacuuccagugucaaagu

SEQ ID NO: 40572 - RNA, 23 nt, Artificial Sequence
  Synthetic Oligonucleotide; PDCD1LG2 exon 3; Set C
ucacaugacuuccagugucaaag

SEQ ID NO: 40573 - RNA, 39 nt, Artificial Sequence
  Synthetic Oligonucleotide; PDCD1LG2 exon 3; Set C
uccaagguucacaugacuuccagugucaaaguugcauuc

SEQ ID NO: 40574 - RNA, 38 nt, Artificial Sequence
  Synthetic Oligonucleotide; PDCD1LG2 exon 3; Set C
uccaagguucacaugacuuccagugucaaaguugcauu

SEQ ID NO: 40575 - RNA, 37 nt, Artificial Sequence
  Synthetic Oligonucleotide; PDCD1LG2 exon 3; Set C
uccaagguucacaugacuuccagugucaaaguugcau

SEQ ID NO: 40576 - RNA, 36 nt, Artificial Sequence
  Synthetic Oligonucleotide; PDCD1LG2 exon 3; Set C
uccaagguucacaugacuuccagugucaaaguugca

SEQ ID NO: 40577 - RNA, 35 nt, Artificial Sequence
  Synthetic Oligonucleotide; PDCD1LG2 exon 3; Set C
uccaagguucacaugacuuccagugucaaaguugc

SEQ ID NO: 40578 - RNA, 34 nt, Artificial Sequence
  Synthetic Oligonucleotide; PDCD1LG2 exon 3; Set C
uccaagguucacaugacuuccagugucaaaguug

SEQ ID NO: 40579 - RNA, 33 nt, Artificial Sequence
  Synthetic Oligonucleotide; PDCD1LG2 exon 3; Set C
uccaagguucacaugacuuccagugucaaaguu

SEQ ID NO: 40580 - RNA, 32 nt, Artificial Sequence
  Synthetic Oligonucleotide; PDCD1LG2 exon 3; Set C
uccaagguucacaugacuuccagugucaaagu

SEQ ID NO: 40581 - RNA, 31 nt, Artificial Sequence
  Synthetic Oligonucleotide; PDCD1LG2 exon 3; Set A
uccaagguucacaugacuuccagugucaaag

SEQ ID NO: 40582 - RNA, 40 nt, Artificial Sequence
  Synthetic Oligonucleotide; PDCD1LG2 exon 3; Set C
uuauugcuccaagguucacaugacuuccagugucaaaguu

SEQ ID NO: 40583 - RNA, 39 nt, Artificial Sequence
  Synthetic Oligonucleotide; PDCD1LG2 exon 3; Set C
uuauugcuccaagguucacaugacuuccagugucaaagu

SEQ ID NO: 40584 - RNA, 38 nt, Artificial Sequence
  Synthetic Oligonucleotide; PDCD1LG2 exon 3; Set C
uuauugcuccaagguucacaugacuuccagugucaaag

SEQ ID NO: 40585 - RNA, 40 nt, Artificial Sequence
  Synthetic Oligonucleotide; PDCD1LG2 exon 3; Set C
guuauugcuccaagguucacaugacuuccagugucaaagu

SEQ ID NO: 40586 - RNA, 39 nt, Artificial Sequence
  Synthetic Oligonucleotide; PDCD1LG2 exon 3; Set C
guuauugcuccaagguucacaugacuuccagugucaaag

SEQ ID NO: 40587 - RNA, 40 nt, Artificial Sequence
  Synthetic Oligonucleotide; PDCD1LG2 exon 3; Set C
uguuauugcuccaagguucacaugacuuccagugucaaag

SEQ ID NO: 40588 - RNA, 20 nt, Artificial Sequence
  Synthetic Oligonucleotide; PDCD1LG2 exon 3; Set C
guuauugcuccaagguucac

SEQ ID NO: 40589 - RNA, 21 nt, Artificial Sequence
  Synthetic Oligonucleotide; PDCD1LG2 exon 3; Set C
uguuauugcuccaagguucac

SEQ ID NO: 40590 - RNA, 20 nt, Artificial Sequence
  Synthetic Oligonucleotide; PDCD1LG2 exon 3; Set C
uguuauugcuccaagguuca

SEQ ID NO: 40591 - RNA, 22 nt, Artificial Sequence
  Synthetic Oligonucleotide; PDCD1LG2 exon 3; Set C
cuguuauugcuccaagguucac

SEQ ID NO: 40592 - RNA, 21 nt, Artificial Sequence
  Synthetic Oligonucleotide; PDCD1LG2 exon 3; Set C
cuguuauugcuccaagguuca

SEQ ID NO: 40593 - RNA, 23 nt, Artificial Sequence
  Synthetic Oligonucleotide; PDCD1LG2 exon 3; Set A
gcuguuauugcuccaagguucac

SEQ ID NO: 40594 - RNA, 22 nt, Artificial Sequence
  Synthetic Oligonucleotide; PDCD1LG2 exon 3; Set A
gcuguuauugcuccaagguuca

SEQ ID NO: 40595 - RNA, 24 nt, Artificial Sequence
  Synthetic Oligonucleotide; PDCD1LG2 exon 3; Set A
ggcuguuauugcuccaagguucac

SEQ ID NO: 40596 - RNA, 23 nt, Artificial Sequence
  Synthetic Oligonucleotide; PDCD1LG2 exon 3; Set A
ggcuguuauugcuccaagguuca

SEQ ID NO: 40597 - RNA, 25 nt, Artificial Sequence
  Synthetic Oligonucleotide; PDCD1LG2 exon 3; Set A
uggcuguuauugcuccaagguucac

SEQ ID NO: 40598 - RNA, 24 nt, Artificial Sequence
  Synthetic Oligonucleotide; PDCD1LG2 exon 3; Set A
uggcuguuauugcuccaagguuca

SEQ ID NO: 40599 - RNA, 26 nt, Artificial Sequence
  Synthetic Oligonucleotide; PDCD1LG2 exon 3; Set A
cuggcuguuauugcuccaagguucac

SEQ ID NO: 40600 - RNA, 27 nt, Artificial Sequence
  Synthetic Oligonucleotide; PDCD1LG2 exon 3; Set A
acuggcuguuauugcuccaagguucac

SEQ ID NO: 40601 - RNA, 25 nt, Artificial Sequence
  Synthetic Oligonucleotide; PDCD1LG2 exon 3; Set A
cuggcuguuauugcuccaagguuca

SEQ ID NO: 40602 - RNA, 26 nt, Artificial Sequence
  Synthetic Oligonucleotide; PDCD1LG2 exon 3; Set A
acuggcuguuauugcuccaagguuca

SEQ ID NO: 40603 - RNA, 15 nt, Artificial Sequence
  Synthetic Oligonucleotide; PDCD1LG2 exon 3; Set C
ggcuguuauugcucc

SEQ ID NO: 40604 - RNA, 16 nt, Artificial Sequence
  Synthetic Oligonucleotide; PDCD1LG2 exon 3; Set C
uggcuguuauugcucc

SEQ ID NO: 40605 - RNA, 17 nt, Artificial Sequence
  Synthetic Oligonucleotide; PDCD1LG2 exon 3; Set C
cuggcuguuauugcucc

SEQ ID NO: 40606 - RNA, 18 nt, Artificial Sequence
  Synthetic Oligonucleotide; PDCD1LG2 exon 3; Set C
acuggcuguuauugcucc

SEQ ID NO: 40607 - RNA, 35 nt, Artificial Sequence
  Synthetic Oligonucleotide; PDCD1LG2 exon 3; Set C
uguaucauuuuccaccuuuugcaaacuggcuguua

SEQ ID NO: 40608 - RNA, 34 nt, Artificial Sequence
  Synthetic Oligonucleotide; PDCD1LG2 exon 3; Set C
uguaucauuuuccaccuuuugcaaacuggcuguu

SEQ ID NO: 40609 - RNA, 33 nt, Artificial Sequence
  Synthetic Oligonucleotide; PDCD1LG2 exon 3; Set C
uguaucauuuuccaccuuuugcaaacuggcugu

SEQ ID NO: 40610 - RNA, 32 nt, Artificial Sequence
  Synthetic Oligonucleotide; PDCD1LG2 exon 3; Set A
uguaucauuuuccaccuuuugcaaacuggcug

SEQ ID NO: 40611 - RNA, 31 nt, Artificial Sequence
  Synthetic Oligonucleotide; PDCD1LG2 exon 3; Set A
uguaucauuuuccaccuuuugcaaacuggcu

SEQ ID NO: 40612 - RNA, 22 nt, Artificial Sequence
  Synthetic Oligonucleotide; PDCD1LG2 exon 3; Set C
guguggggauguaucauuuucc

SEQ ID NO: 40613 - RNA, 23 nt, Artificial Sequence
  Synthetic Oligonucleotide; PDCD1LG2 exon 3; Set A
gguguggggauguaucauuuucc

SEQ ID NO: 40614 - RNA, 21 nt, Artificial Sequence
  Synthetic Oligonucleotide; PDCD1LG2 exon 3; Set C
guguggggauguaucauuuuc

SEQ ID NO: 40615 - RNA, 20 nt, Artificial Sequence
  Synthetic Oligonucleotide; PDCD1LG2 exon 3; Set C
guguggggauguaucauuuu

SEQ ID NO: 40616 - RNA, 22 nt, Artificial Sequence
  Synthetic Oligonucleotide; PDCD1LG2 exon 3; Set C
gguguggggauguaucauuuuc

SEQ ID NO: 40617 - RNA, 21 nt, Artificial Sequence
  Synthetic Oligonucleotide; PDCD1LG2 exon 3; Set C
gguguggggauguaucauuuu

SEQ ID NO: 40618 - RNA, 20 nt, Artificial Sequence
  Synthetic Oligonucleotide; PDCD1LG2 exon 3; Set C
gguguggggauguaucauuu

SEQ ID NO: 40619 - RNA, 19 nt, Artificial Sequence
  Synthetic Oligonucleotide; PDCD1LG2 exon 3; Set C
gguguggggauguaucauu

SEQ ID NO: 40620 - RNA, 29 nt, Artificial Sequence
  Synthetic Oligonucleotide; PDCD1LG2 exon 3; Set C
uuucacgguguggggauguaucauuuucc

SEQ ID NO: 40621 - RNA, 28 nt, Artificial Sequence
  Synthetic Oligonucleotide; PDCD1LG2 exon 3; Set A
uuucacgguguggggauguaucauuuuc

SEQ ID NO: 40622 - RNA, 27 nt, Artificial Sequence
  Synthetic Oligonucleotide; PDCD1LG2 exon 3; Set A
uuucacgguguggggauguaucauuuu

SEQ ID NO: 40623 - RNA, 26 nt, Artificial Sequence
  Synthetic Oligonucleotide; PDCD1LG2 exon 3; Set A
uuucacgguguggggauguaucauuu

SEQ ID NO: 40624 - RNA, 25 nt, Artificial Sequence
  Synthetic Oligonucleotide; PDCD1LG2 exon 3; Set A
uuucacgguguggggauguaucauu

SEQ ID NO: 40625 - RNA, 24 nt, Artificial Sequence
  Synthetic Oligonucleotide; PDCD1LG2 exon 3; Set A
uuucacgguguggggauguaucau

SEQ ID NO: 40626 - RNA, 23 nt, Artificial Sequence
  Synthetic Oligonucleotide; PDCD1LG2 exon 3; Set A
uuucacgguguggggauguauca

SEQ ID NO: 40627 - RNA, 37 nt, Artificial Sequence
  Synthetic Oligonucleotide; PDCD1LG2 exon 3; Set C
aguggcucuuucacgguguggggauguaucauuuucc

SEQ ID NO: 40628 - RNA, 36 nt, Artificial Sequence
  Synthetic Oligonucleotide; PDCD1LG2 exon 3; Set C
aguggcucuuucacgguguggggauguaucauuuuc

SEQ ID NO: 40629 - RNA, 38 nt, Artificial Sequence
  Synthetic Oligonucleotide; PDCD1LG2 exon 3; Set C
aaguggcucuuucacgguguggggauguaucauuuucc

SEQ ID NO: 40630 - RNA, 19 nt, Artificial Sequence
  Synthetic Oligonucleotide; PDCD1LG2 exon 3; Set A
uuucacgguguggggaugu

SEQ ID NO: 40631 - RNA, 35 nt, Artificial Sequence
  Synthetic Oligonucleotide; PDCD1LG2 exon 3; Set C
aguggcucuuucacgguguggggauguaucauuuu

SEQ ID NO: 40632 - RNA, 37 nt, Artificial Sequence
  Synthetic Oligonucleotide; PDCD1LG2 exon 3; Set C
aaguggcucuuucacgguguggggauguaucauuuuc

SEQ ID NO: 40633 - RNA, 36 nt, Artificial Sequence
  Synthetic Oligonucleotide; PDCD1LG2 exon 3; Set C
aaguggcucuuucacgguguggggauguaucauuuu

SEQ ID NO: 40634 - RNA, 34 nt, Artificial Sequence
  Synthetic Oligonucleotide; PDCD1LG2 exon 3; Set C
aguggcucuuucacgguguggggauguaucauuu

SEQ ID NO: 40635 - RNA, 33 nt, Artificial Sequence
  Synthetic Oligonucleotide; PDCD1LG2 exon 3; Set C
aguggcucuuucacgguguggggauguaucauu

SEQ ID NO: 40636 - RNA, 35 nt, Artificial Sequence
  Synthetic Oligonucleotide; PDCD1LG2 exon 3; Set C
aaguggcucuuucacgguguggggauguaucauuu

SEQ ID NO: 40637 - RNA, 34 nt, Artificial Sequence
  Synthetic Oligonucleotide; PDCD1LG2 exon 3; Set C
aaguggcucuuucacgguguggggauguaucauu

SEQ ID NO: 40638 - RNA, 33 nt, Artificial Sequence
  Synthetic Oligonucleotide; PDCD1LG2 exon 3; Set C
aaguggcucuuucacgguguggggauguaucau

SEQ ID NO: 40639 - RNA, 27 nt, Artificial Sequence
  Synthetic Oligonucleotide; PDCD1LG2 exon 3; Set C
aguggcucuuucacgguguggggaugu

SEQ ID NO: 40640 - RNA, 28 nt, Artificial Sequence
  Synthetic Oligonucleotide; PDCD1LG2 exon 3; Set C
aaguggcucuuucacgguguggggaugu

SEQ ID NO: 40641 - RNA, 18 nt, Artificial Sequence
  Synthetic Oligonucleotide; PDCD1LG2 exon 3; Set C
aguggcucuuucacggug

SEQ ID NO: 40642 - RNA, 17 nt, Artificial Sequence
  Synthetic Oligonucleotide; PDCD1LG2 exon 3; Set C
aguggcucuuucacggu

SEQ ID NO: 40643 - RNA, 19 nt, Artificial Sequence
  Synthetic Oligonucleotide; PDCD1LG2 exon 3; Set C
aaguggcucuuucacggug

SEQ ID NO: 40644 - RNA, 18 nt, Artificial Sequence
  Synthetic Oligonucleotide; PDCD1LG2 exon 3; Set C
aaguggcucuuucacggu

SEQ ID NO: 40645 - RNA, 40 nt, Artificial Sequence
  Synthetic Oligonucleotide; PDCD1LG2 exon 3; Set C
uucccuaggggcagcugcuccuccagcaaaguggcucuuu

SEQ ID NO: 40646 - RNA, 19 nt, Artificial Sequence
  Synthetic Oligonucleotide; PDCD1LG2 exon 3; Set C
acuuggacuugagguaugu

SEQ ID NO: 40647 - RNA, 20 nt, Artificial Sequence
  Synthetic Oligonucleotide; PDCD1LG2 exon 3; Set C
cacuuggacuugagguaugu

SEQ ID NO: 40648 - RNA, 21 nt, Artificial Sequence
  Synthetic Oligonucleotide; PDCD1LG2 exon 3; Set C
ucacuuggacuugagguaugu

SEQ ID NO: 40649 - RNA, 29 nt, Artificial Sequence
  Synthetic Oligonucleotide; PDCD1LG2 exon 3; Set C
uucgucccucacuuggacuugagguaugu

SEQ ID NO: 40650 - RNA, 34 nt, Artificial Sequence
  Synthetic Oligonucleotide; PDCD1LG2 exon 3; Set C
uguccuucgucccucacuuggacuugagguaugu

SEQ ID NO: 40651 - RNA, 33 nt, Artificial Sequence
  Synthetic Oligonucleotide; PDCD1LG2 exon 3; Set C
uguccuucgucccucacuuggacuugagguaug

SEQ ID NO: 40652 - RNA, 40 nt, Artificial Sequence
  Synthetic Oligonucleotide; PDCD1LG2 exon 3; Set C
auugguacuguccuucgucccucacuuggacuugagguau

SEQ ID NO: 40653 - RNA, 19 nt, Artificial Sequence
  Synthetic Oligonucleotide; PDCD1LG2 exon 3; Set B
uguccuucgucccucacuu

SEQ ID NO: 40654 - RNA, 18 nt, Artificial Sequence
  Synthetic Oligonucleotide; PDCD1LG2 exon 3; Set B
uguccuucgucccucacu

SEQ ID NO: 40655 - RNA, 17 nt, Artificial Sequence
  Synthetic Oligonucleotide; PDCD1LG2 exon 3; Set C
uguccuucgucccucac

SEQ ID NO: 40656 - RNA, 26 nt, Artificial Sequence
  Synthetic Oligonucleotide; PDCD1LG2 exon 3; Set C
uugguacuguccuucgucccucacuu

SEQ ID NO: 40657 - RNA, 27 nt, Artificial Sequence
  Synthetic Oligonucleotide; PDCD1LG2 exon 3; Set C
auugguacuguccuucgucccucacuu

SEQ ID NO: 40658 - RNA, 25 nt, Artificial Sequence
  Synthetic Oligonucleotide; PDCD1LG2 exon 3; Set C
uugguacuguccuucgucccucacu

SEQ ID NO: 40659 - RNA, 28 nt, Artificial Sequence
  Synthetic Oligonucleotide; PDCD1LG2 exon 3; Set C
cauugguacuguccuucgucccucacuu

SEQ ID NO: 40660 - RNA, 26 nt, Artificial Sequence
  Synthetic Oligonucleotide; PDCD1LG2 exon 3; Set C
auugguacuguccuucgucccucacu

SEQ ID NO: 40661 - RNA, 27 nt, Artificial Sequence
  Synthetic Oligonucleotide; PDCD1LG2 exon 3; Set C
cauugguacuguccuucgucccucacu

SEQ ID NO: 40662 - RNA, 25 nt, Artificial Sequence
  Synthetic Oligonucleotide; PDCD1LG2 exon 3; Set B
auugguacuguccuucgucccucac

SEQ ID NO: 40663 - RNA, 26 nt, Artificial Sequence
  Synthetic Oligonucleotide; PDCD1LG2 exon 3; Set C
cauugguacuguccuucgucccucac

SEQ ID NO: 40664 - RNA, 24 nt, Artificial Sequence
  Synthetic Oligonucleotide; PDCD1LG2 exon 3; Set B
auugguacuguccuucgucccuca

SEQ ID NO: 40665 - RNA, 25 nt, Artificial Sequence
  Synthetic Oligonucleotide; PDCD1LG2 exon 3; Set C
cauugguacuguccuucgucccuca

SEQ ID NO: 40666 - RNA, 23 nt, Artificial Sequence
  Synthetic Oligonucleotide; PDCD1LG2 exon 3; Set B
auugguacuguccuucgucccuc

SEQ ID NO: 40667 - RNA, 32 nt, Artificial Sequence
  Synthetic Oligonucleotide; PDCD1LG2 exon 3; Set C
uaugcauugguacuguccuucgucccucacuu

SEQ ID NO: 40668 - RNA, 24 nt, Artificial Sequence
  Synthetic Oligonucleotide; PDCD1LG2 exon 3; Set B
cauugguacuguccuucgucccuc

SEQ ID NO: 40669 - RNA, 33 nt, Artificial Sequence
  Synthetic Oligonucleotide; PDCD1LG2 exon 3; Set C
uuaugcauugguacuguccuucgucccucacuu

SEQ ID NO: 40670 - RNA, 31 nt, Artificial Sequence
  Synthetic Oligonucleotide; PDCD1LG2 exon 3; Set C
uaugcauugguacuguccuucgucccucacu

SEQ ID NO: 40671 - RNA, 34 nt, Artificial Sequence
  Synthetic Oligonucleotide; PDCD1LG2 exon 3; Set C
auuaugcauugguacuguccuucgucccucacuu

SEQ ID NO: 40672 - RNA, 32 nt, Artificial Sequence
  Synthetic Oligonucleotide; PDCD1LG2 exon 3; Set C
uuaugcauugguacuguccuucgucccucacu

SEQ ID NO: 40673 - RNA, 30 nt, Artificial Sequence
  Synthetic Oligonucleotide; PDCD1LG2 exon 3; Set C
uaugcauugguacuguccuucgucccucac

SEQ ID NO: 40674 - RNA, 35 nt, Artificial Sequence
  Synthetic Oligonucleotide; PDCD1LG2 exon 3; Set C
gauuaugcauugguacuguccuucgucccucacuu

SEQ ID NO: 40675 - RNA, 33 nt, Artificial Sequence
  Synthetic Oligonucleotide; PDCD1LG2 exon 3; Set C
auuaugcauugguacuguccuucgucccucacu

SEQ ID NO: 40676 - RNA, 31 nt, Artificial Sequence
  Synthetic Oligonucleotide; PDCD1LG2 exon 3; Set C
uuaugcauugguacuguccuucgucccucac

SEQ ID NO: 40677 - RNA, 29 nt, Artificial Sequence
  Synthetic Oligonucleotide; PDCD1LG2 exon 3; Set C
uaugcauugguacuguccuucgucccuca

SEQ ID NO: 40678 - RNA, 36 nt, Artificial Sequence
  Synthetic Oligonucleotide; PDCD1LG2 exon 3; Set C
ugauuaugcauugguacuguccuucgucccucacuu

SEQ ID NO: 40679 - RNA, 34 nt, Artificial Sequence
  Synthetic Oligonucleotide; PDCD1LG2 exon 3; Set C
gauuaugcauugguacuguccuucgucccucacu

SEQ ID NO: 40680 - RNA, 32 nt, Artificial Sequence
  Synthetic Oligonucleotide; PDCD1LG2 exon 3; Set C
auuaugcauugguacuguccuucgucccucac

SEQ ID NO: 40681 - RNA, 30 nt, Artificial Sequence
  Synthetic Oligonucleotide; PDCD1LG2 exon 3; Set C
uuaugcauugguacuguccuucgucccuca

SEQ ID NO: 40682 - RNA, 28 nt, Artificial Sequence
  Synthetic Oligonucleotide; PDCD1LG2 exon 3; Set C
uaugcauugguacuguccuucgucccuc

SEQ ID NO: 40683 - RNA, 35 nt, Artificial Sequence
  Synthetic Oligonucleotide; PDCD1LG2 exon 3; Set C
ugauuaugcauugguacuguccuucgucccucacu

SEQ ID NO: 40684 - RNA, 33 nt, Artificial Sequence
  Synthetic Oligonucleotide; PDCD1LG2 exon 3; Set C
gauuaugcauugguacuguccuucgucccucac

SEQ ID NO: 40685 - RNA, 15 nt, Artificial Sequence
  Synthetic Oligonucleotide; PDCD1LG2 exon 3; Set C
uugguacuguccuuc

SEQ ID NO: 40686 - RNA, 31 nt, Artificial Sequence
  Synthetic Oligonucleotide; PDCD1LG2 exon 3; Set C
auuaugcauugguacuguccuucgucccuca

SEQ ID NO: 40687 - RNA, 29 nt, Artificial Sequence
  Synthetic Oligonucleotide; PDCD1LG2 exon 3; Set C
uuaugcauugguacuguccuucgucccuc

SEQ ID NO: 40688 - RNA, 34 nt, Artificial Sequence
  Synthetic Oligonucleotide; PDCD1LG2 exon 3; Set C
ugauuaugcauugguacuguccuucgucccucac

SEQ ID NO: 40689 - RNA, 16 nt, Artificial Sequence
  Synthetic Oligonucleotide; PDCD1LG2 exon 3; Set C
auugguacuguccuuc

SEQ ID NO: 40690 - RNA, 32 nt, Artificial Sequence
  Synthetic Oligonucleotide; PDCD1LG2 exon 3; Set C
gauuaugcauugguacuguccuucgucccuca

SEQ ID NO: 40691 - RNA, 30 nt, Artificial Sequence
  Synthetic Oligonucleotide; PDCD1LG2 exon 3; Set C
auuaugcauugguacuguccuucgucccuc

SEQ ID NO: 40692 - RNA, 17 nt, Artificial Sequence
  Synthetic Oligonucleotide; PDCD1LG2 exon 3; Set C
cauugguacuguccuuc

SEQ ID NO: 40693 - RNA, 33 nt, Artificial Sequence
  Synthetic Oligonucleotide; PDCD1LG2 exon 3; Set C
ugauuaugcauugguacuguccuucgucccuca

SEQ ID NO: 40694 - RNA, 31 nt, Artificial Sequence
  Synthetic Oligonucleotide; PDCD1LG2 exon 3; Set C
gauuaugcauugguacuguccuucgucccuc

SEQ ID NO: 40695 - RNA, 32 nt, Artificial Sequence
  Synthetic Oligonucleotide; PDCD1LG2 exon 3; Set C
ugauuaugcauugguacuguccuucgucccuc

SEQ ID NO: 40696 - RNA, 21 nt, Artificial Sequence
  Synthetic Oligonucleotide; PDCD1LG2 exon 3; Set C
uaugcauugguacuguccuuc

SEQ ID NO: 40697 - RNA, 22 nt, Artificial Sequence
  Synthetic Oligonucleotide; PDCD1LG2 exon 3; Set C
uuaugcauugguacuguccuuc

SEQ ID NO: 40698 - RNA, 23 nt, Artificial Sequence
  Synthetic Oligonucleotide; PDCD1LG2 exon 3; Set C
auuaugcauugguacuguccuuc

SEQ ID NO: 40699 - RNA, 24 nt, Artificial Sequence
  Synthetic Oligonucleotide; PDCD1LG2 exon 3; Set B
gauuaugcauugguacuguccuuc

SEQ ID NO: 40700 - RNA, 25 nt, Artificial Sequence
  Synthetic Oligonucleotide; PDCD1LG2 exon 3; Set B
ugauuaugcauugguacuguccuuc

SEQ ID NO: 40701 - RNA, 16 nt, Artificial Sequence
  Synthetic Oligonucleotide; PDCD1LG2 exon 3; Set C
uaugcauugguacugu

SEQ ID NO: 40702 - RNA, 18 nt, Artificial Sequence
  Synthetic Oligonucleotide; PDCD1LG2 exon 3; Set C
uuaugcauugguacuguc

SEQ ID NO: 40703 - RNA, 17 nt, Artificial Sequence
  Synthetic Oligonucleotide; PDCD1LG2 exon 3; Set C
uuaugcauugguacugu

SEQ ID NO: 40704 - RNA, 19 nt, Artificial Sequence
  Synthetic Oligonucleotide; PDCD1LG2 exon 3; Set C
auuaugcauugguacuguc

SEQ ID NO: 40705 - RNA, 18 nt, Artificial Sequence
  Synthetic Oligonucleotide; PDCD1LG2 exon 3; Set C
auuaugcauugguacugu

SEQ ID NO: 40706 - RNA, 20 nt, Artificial Sequence
  Synthetic Oligonucleotide; PDCD1LG2 exon 3; Set C
gauuaugcauugguacuguc

SEQ ID NO: 40707 - RNA, 19 nt, Artificial Sequence
  Synthetic Oligonucleotide; PDCD1LG2 exon 3; Set C
gauuaugcauugguacugu

SEQ ID NO: 40708 - RNA, 21 nt, Artificial Sequence
  Synthetic Oligonucleotide; PDCD1LG2 exon 3; Set C
ugauuaugcauugguacuguc

SEQ ID NO: 40709 - RNA, 20 nt, Artificial Sequence
  Synthetic Oligonucleotide; PDCD1LG2 exon 3; Set C
ugauuaugcauugguacugu

SEQ ID NO: 40710 - RNA, 15 nt, Artificial Sequence
  Synthetic Oligonucleotide; PDCD1LG2 exon 3; Set C
ugauuaugcauuggu

SEQ ID NO: 40711 - RNA, 29 nt, Artificial Sequence
  Synthetic Oligonucleotide; PDCD1LG2 exon 3; Set B
guuggagagaugcuuccauggauucuagu

SEQ ID NO: 40712 - RNA, 28 nt, Artificial Sequence
  Synthetic Oligonucleotide; PDCD1LG2 exon 3; Set B
guuggagagaugcuuccauggauucuag

SEQ ID NO: 40713 - RNA, 15 nt, Artificial Sequence
  Synthetic Oligonucleotide; PDCD1LG2 exon 3; Set C
guuggagagaugcuu

SEQ ID NO: 40714 - RNA, 16 nt, Artificial Sequence
  Synthetic Oligonucleotide; PDCD1LG2 exon 3; Set C
uguuggagagaugcuu

SEQ ID NO: 40715 - RNA, 15 nt, Artificial Sequence
  Synthetic Oligonucleotide; PDCD1LG2 exon 3; Set C
uguuggagagaugcu

SEQ ID NO: 40716 - RNA, 17 nt, Artificial Sequence
  Synthetic Oligonucleotide; PDCD1LG2 exon 3; Set C
cuguuggagagaugcuu

SEQ ID NO: 40717 - RNA, 16 nt, Artificial Sequence
  Synthetic Oligonucleotide; PDCD1LG2 exon 3; Set C
cuguuggagagaugcu

SEQ ID NO: 40718 - RNA, 15 nt, Artificial Sequence
  Synthetic Oligonucleotide; PDCD1LG2 exon 3; Set C
cuguuggagagaugc

SEQ ID NO: 40719 - RNA, 16 nt, Artificial Sequence
  Synthetic Oligonucleotide; PDCD1LG2 exon 3; Set C
ccuuuacuuuacauuc

SEQ ID NO: 40720 - RNA, 15 nt, Artificial Sequence
  Synthetic Oligonucleotide; PDCD1LG2 exon 3; Set C
ccuuuacuuuacauu

SEQ ID NO: 40721 - RNA, 17 nt, Artificial Sequence
  Synthetic Oligonucleotide; PDCD1LG2 exon 3; Set C
gccuuuacuuuacauuc

SEQ ID NO: 40722 - RNA, 16 nt, Artificial Sequence
  Synthetic Oligonucleotide; PDCD1LG2 exon 3; Set C
gccuuuacuuuacauu

SEQ ID NO: 40723 - RNA, 18 nt, Artificial Sequence
  Synthetic Oligonucleotide; PDCD1LG2 exon 3; Set C
ugccuuuacuuuacauuc

SEQ ID NO: 40724 - RNA, 17 nt, Artificial Sequence
  Synthetic Oligonucleotide; PDCD1LG2 exon 3; Set C
ugccuuuacuuuacauu

SEQ ID NO: 40725 - RNA, 15 nt, Artificial Sequence
  Synthetic Oligonucleotide; PDCD1LG2 exon 3; Set C
gccuuuacuuuacau

SEQ ID NO: 40726 - RNA, 16 nt, Artificial Sequence
  Synthetic Oligonucleotide; PDCD1LG2 exon 3; Set C
ugccuuuacuuuacau

SEQ ID NO: 40727 - RNA, 15 nt, Artificial Sequence
  Synthetic Oligonucleotide; PDCD1LG2 exon 3; Set C
ugccuuuacuuuaca

SEQ ID NO: 40728 - RNA, 15 nt, Artificial Sequence
  Synthetic Oligonucleotide; PDCD1LG2 exon 3; Set C
auugucugccuuuac

SEQ ID NO: 40729 - RNA, 21 nt, Artificial Sequence
  Synthetic Oligonucleotide; PDCD1LG2 exon 3; Set C
uugucauugucugccuuuacu

SEQ ID NO: 40730 - RNA, 20 nt, Artificial Sequence
  Synthetic Oligonucleotide; PDCD1LG2 exon 3; Set C
uugucauugucugccuuuac

SEQ ID NO: 40731 - RNA, 19 nt, Artificial Sequence
  Synthetic Oligonucleotide; PDCD1LG2 exon 3; Set C
uugucauugucugccuuua

SEQ ID NO: 40732 - RNA, 20 nt, Artificial Sequence
  Synthetic Oligonucleotide; PDCD1LG2 exon 3; Set C
uuugucauugucugccuuua

SEQ ID NO: 40733 - RNA, 18 nt, Artificial Sequence
  Synthetic Oligonucleotide; PDCD1LG2 exon 3; Set C
uugucauugucugccuuu

SEQ ID NO: 40734 - RNA, 19 nt, Artificial Sequence
  Synthetic Oligonucleotide; PDCD1LG2 exon 3; Set C
uuugucauugucugccuuu

SEQ ID NO: 40735 - RNA, 17 nt, Artificial Sequence
  Synthetic Oligonucleotide; PDCD1LG2 exon 3; Set C
uugucauugucugccuu

SEQ ID NO: 40736 - RNA, 20 nt, Artificial Sequence
  Synthetic Oligonucleotide; PDCD1LG2 exon 3; Set C
uuuugucauugucugccuuu

SEQ ID NO: 40737 - RNA, 18 nt, Artificial Sequence
  Synthetic Oligonucleotide; PDCD1LG2 exon 3; Set C
uuugucauugucugccuu

SEQ ID NO: 40738 - RNA, 21 nt, Artificial Sequence
  Synthetic Oligonucleotide; PDCD1LG2 exon 3; Set C
auuuugucauugucugccuuu

SEQ ID NO: 40739 - RNA, 19 nt, Artificial Sequence
  Synthetic Oligonucleotide; PDCD1LG2 exon 3; Set C
uuuugucauugucugccuu

SEQ ID NO: 40740 - RNA, 22 nt, Artificial Sequence
  Synthetic Oligonucleotide; PDCD1LG2 exon 3; Set C
uauuuugucauugucugccuuu

SEQ ID NO: 40741 - RNA, 20 nt, Artificial Sequence
  Synthetic Oligonucleotide; PDCD1LG2 exon 3; Set C
auuuugucauugucugccuu

SEQ ID NO: 40742 - RNA, 21 nt, Artificial Sequence
  Synthetic Oligonucleotide; PDCD1LG2 exon 3; Set C
uauuuugucauugucugccuu

SEQ ID NO: 40743 - RNA, 22 nt, Artificial Sequence
  Synthetic Oligonucleotide; PDCD1LG2 exon 3; Set C
auauuuugucauugucugccuu

SEQ ID NO: 40744 - RNA, 23 nt, Artificial Sequence
  Synthetic Oligonucleotide; PDCD1LG2 exon 3; Set C
gauauuuugucauugucugccuu

SEQ ID NO: 40745 - RNA, 34 nt, Artificial Sequence
  Synthetic Oligonucleotide; PDCD1LG2 exon 3; Set C
uugcugccaugcucuauuauguacaguuccuuag

SEQ ID NO: 40746 - RNA, 38 nt, Artificial Sequence
  Synthetic Oligonucleotide; PDCD1LG2 exon 3; Set C
cacauugcugccaugcucuauuauguacaguuccuuag

SEQ ID NO: 40747 - RNA, 39 nt, Artificial Sequence
  Synthetic Oligonucleotide; PDCD1LG2 exon 3; Set C
ucacauugcugccaugcucuauuauguacaguuccuuag

SEQ ID NO: 40748 - RNA, 37 nt, Artificial Sequence
  Synthetic Oligonucleotide; PDCD1LG2 exon 3; Set C
cacauugcugccaugcucuauuauguacaguuccuua

SEQ ID NO: 40749 - RNA, 40 nt, Artificial Sequence
  Synthetic Oligonucleotide; PDCD1LG2 exon 3; Set C
gucacauugcugccaugcucuauuauguacaguuccuuag

SEQ ID NO: 40750 - RNA, 38 nt, Artificial Sequence
  Synthetic Oligonucleotide; PDCD1LG2 exon 3; Set C
ucacauugcugccaugcucuauuauguacaguuccuua

SEQ ID NO: 40751 - RNA, 39 nt, Artificial Sequence
  Synthetic Oligonucleotide; PDCD1LG2 exon 3; Set C
gucacauugcugccaugcucuauuauguacaguuccuua

SEQ ID NO: 40752 - RNA, 40 nt, Artificial Sequence
  Synthetic Oligonucleotide; PDCD1LG2 exon 3; Set C
ggucacauugcugccaugcucuauuauguacaguuccuua

SEQ ID NO: 40753 - RNA, 17 nt, Artificial Sequence
  Synthetic Oligonucleotide; PDCD1LG2 exon 3; Set C
ugcugccaugcucuauu

SEQ ID NO: 40754 - RNA, 16 nt, Artificial Sequence
  Synthetic Oligonucleotide; PDCD1LG2 exon 3; Set C
ugcugccaugcucuau

SEQ ID NO: 40755 - RNA, 17 nt, Artificial Sequence
  Synthetic Oligonucleotide; PDCD1LG2 exon 3; Set C
uugcugccaugcucuau

SEQ ID NO: 40756 - RNA, 19 nt, Artificial Sequence
  Synthetic Oligonucleotide; PDCD1LG2 exon 3; Set C
auugcugccaugcucuauu

SEQ ID NO: 40757 - RNA, 15 nt, Artificial Sequence
  Synthetic Oligonucleotide; PDCD1LG2 exon 3; Set C
ugcugccaugcucua

SEQ ID NO: 40758 - RNA, 18 nt, Artificial Sequence
  Synthetic Oligonucleotide; PDCD1LG2 exon 3; Set C
auugcugccaugcucuau

SEQ ID NO: 40759 - RNA, 20 nt, Artificial Sequence
  Synthetic Oligonucleotide; PDCD1LG2 exon 3; Set C
cauugcugccaugcucuauu

SEQ ID NO: 40760 - RNA, 16 nt, Artificial Sequence
  Synthetic Oligonucleotide; PDCD1LG2 exon 3; Set C
uugcugccaugcucua

SEQ ID NO: 40761 - RNA, 15 nt, Artificial Sequence
  Synthetic Oligonucleotide; PDCD1LG2 exon 3; Set C
uugcugccaugcucu

SEQ ID NO: 40762 - RNA, 19 nt, Artificial Sequence
  Synthetic Oligonucleotide; PDCD1LG2 exon 3; Set C
cauugcugccaugcucuau

SEQ ID NO: 40763 - RNA, 21 nt, Artificial Sequence
  Synthetic Oligonucleotide; PDCD1LG2 exon 3; Set A
acauugcugccaugcucuauu

SEQ ID NO: 40764 - RNA, 17 nt, Artificial Sequence
  Synthetic Oligonucleotide; PDCD1LG2 exon 3; Set C
auugcugccaugcucua

SEQ ID NO: 40765 - RNA, 16 nt, Artificial Sequence
  Synthetic Oligonucleotide; PDCD1LG2 exon 3; Set C
auugcugccaugcucu

SEQ ID NO: 40766 - RNA, 20 nt, Artificial Sequence
  Synthetic Oligonucleotide; PDCD1LG2 exon 3; Set A
acauugcugccaugcucuau

SEQ ID NO: 40767 - RNA, 18 nt, Artificial Sequence
  Synthetic Oligonucleotide; PDCD1LG2 exon 3; Set C
cauugcugccaugcucua

SEQ ID NO: 40768 - RNA, 17 nt, Artificial Sequence
  Synthetic Oligonucleotide; PDCD1LG2 exon 3; Set C
cauugcugccaugcucu

SEQ ID NO: 40769 - RNA, 21 nt, Artificial Sequence
  Synthetic Oligonucleotide; PDCD1LG2 exon 3; Set A
cacauugcugccaugcucuau

SEQ ID NO: 40770 - RNA, 19 nt, Artificial Sequence
  Synthetic Oligonucleotide; PDCD1LG2 exon 3; Set A
acauugcugccaugcucua

SEQ ID NO: 40771 - RNA, 18 nt, Artificial Sequence
  Synthetic Oligonucleotide; PDCD1LG2 exon 3; Set A
acauugcugccaugcucu

SEQ ID NO: 40772 - RNA, 20 nt, Artificial Sequence
  Synthetic Oligonucleotide; PDCD1LG2 exon 3; Set A
cacauugcugccaugcucua

SEQ ID NO: 40773 - RNA, 19 nt, Artificial Sequence
  Synthetic Oligonucleotide; PDCD1LG2 exon 3; Set A
cacauugcugccaugcucu

SEQ ID NO: 40774 - RNA, 20 nt, Artificial Sequence
  Synthetic Oligonucleotide; PDCD1LG2 exon 3; Set A
ucacauugcugccaugcucu

SEQ ID NO: 40775 - RNA, 29 nt, Artificial Sequence
  Synthetic Oligonucleotide; PDCD1LG2 exon 3; Set C
ccagggucacauugcugccaugcucuauu

SEQ ID NO: 40776 - RNA, 30 nt, Artificial Sequence
  Synthetic Oligonucleotide; PDCD1LG2 exon 3; Set C
uccagggucacauugcugccaugcucuauu

SEQ ID NO: 40777 - RNA, 28 nt, Artificial Sequence
  Synthetic Oligonucleotide; PDCD1LG2 exon 3; Set C
ccagggucacauugcugccaugcucuau

SEQ ID NO: 40778 - RNA, 29 nt, Artificial Sequence
  Synthetic Oligonucleotide; PDCD1LG2 exon 3; Set C
uccagggucacauugcugccaugcucuau

SEQ ID NO: 40779 - RNA, 27 nt, Artificial Sequence
  Synthetic Oligonucleotide; PDCD1LG2 exon 3; Set C
ccagggucacauugcugccaugcucua

SEQ ID NO: 40780 - RNA, 26 nt, Artificial Sequence
  Synthetic Oligonucleotide; PDCD1LG2 exon 3; Set C
ccagggucacauugcugccaugcucu

SEQ ID NO: 40781 - RNA, 28 nt, Artificial Sequence
  Synthetic Oligonucleotide; PDCD1LG2 exon 3; Set C
uccagggucacauugcugccaugcucua

SEQ ID NO: 40782 - RNA, 27 nt, Artificial Sequence
  Synthetic Oligonucleotide; PDCD1LG2 exon 3; Set C
uccagggucacauugcugccaugcucu

SEQ ID NO: 40783 - RNA, 21 nt, Artificial Sequence
  Synthetic Oligonucleotide; PDCD1LG2 exon 3; Set A
ccagggucacauugcugccau

SEQ ID NO: 40784 - RNA, 22 nt, Artificial Sequence
  Synthetic Oligonucleotide; PDCD1LG2 exon 3; Set C
uccagggucacauugcugccau

SEQ ID NO: 40785 - RNA, 20 nt, Artificial Sequence
  Synthetic Oligonucleotide; PDCD1LG2 exon 3; Set A
ccagggucacauugcugcca

SEQ ID NO: 40786 - RNA, 21 nt, Artificial Sequence
  Synthetic Oligonucleotide; PDCD1LG2 exon 3; Set C
uccagggucacauugcugcca

SEQ ID NO: 40787 - RNA, 40 nt, Artificial Sequence
  Synthetic Oligonucleotide; PDCD1LG2 exon 3; Set C
gucaaaguugcauuccagggucacauugcugccaugcucu

SEQ ID NO: 40788 - RNA, 31 nt, Artificial Sequence
  Synthetic Oligonucleotide; PDCD1LG2 exon 3; Set C
aaaguugcauuccagggucacauugcugcca

SEQ ID NO: 40789 - RNA, 32 nt, Artificial Sequence
  Synthetic Oligonucleotide; PDCD1LG2 exon 3; Set C
caaaguugcauuccagggucacauugcugcca

SEQ ID NO: 40790 - RNA, 33 nt, Artificial Sequence
  Synthetic Oligonucleotide; PDCD1LG2 exon 3; Set C
ucaaaguugcauuccagggucacauugcugcca

SEQ ID NO: 40791 - RNA, 34 nt, Artificial Sequence
  Synthetic Oligonucleotide; PDCD1LG2 exon 3; Set C
gucaaaguugcauuccagggucacauugcugcca

SEQ ID NO: 40792 - RNA, 40 nt, Artificial Sequence
  Synthetic Oligonucleotide; PDCD1LG2 exon 3; Set C
acaugacuuccagugucaaaguugcauuccagggucacau

SEQ ID NO: 40793 - RNA, 39 nt, Artificial Sequence
  Synthetic Oligonucleotide; PDCD1LG2 exon 3; Set C
acaugacuuccagugucaaaguugcauuccagggucaca

SEQ ID NO: 40794 - RNA, 38 nt, Artificial Sequence
  Synthetic Oligonucleotide; PDCD1LG2 exon 3; Set C
acaugacuuccagugucaaaguugcauuccagggucac

SEQ ID NO: 40795 - RNA, 37 nt, Artificial Sequence
  Synthetic Oligonucleotide; PDCD1LG2 exon 3; Set C
acaugacuuccagugucaaaguugcauuccaggguca

SEQ ID NO: 40796 - RNA, 36 nt, Artificial Sequence
  Synthetic Oligonucleotide; PDCD1LG2 exon 3; Set C
acaugacuuccagugucaaaguugcauuccaggguc

SEQ ID NO: 40797 - RNA, 35 nt, Artificial Sequence
  Synthetic Oligonucleotide; PDCD1LG2 exon 3; Set C
acaugacuuccagugucaaaguugcauuccagggu

SEQ ID NO: 40798 - RNA, 31 nt, Artificial Sequence
  Synthetic Oligonucleotide; PDCD1LG2 exon 3; Set A
acaugacuuccagugucaaaguugcauucca

SEQ ID NO: 40799 - RNA, 32 nt, Artificial Sequence
  Synthetic Oligonucleotide; PDCD1LG2 exon 3; Set C
cacaugacuuccagugucaaaguugcauucca

SEQ ID NO: 40800 - RNA, 30 nt, Artificial Sequence
  Synthetic Oligonucleotide; PDCD1LG2 exon 3; Set A
acaugacuuccagugucaaaguugcauucc

SEQ ID NO: 40801 - RNA, 29 nt, Artificial Sequence
  Synthetic Oligonucleotide; PDCD1LG2 exon 3; Set A
acaugacuuccagugucaaaguugcauuc

SEQ ID NO: 40802 - RNA, 33 nt, Artificial Sequence
  Synthetic Oligonucleotide; PDCD1LG2 exon 3; Set C
ucacaugacuuccagugucaaaguugcauucca

SEQ ID NO: 40803 - RNA, 31 nt, Artificial Sequence
  Synthetic Oligonucleotide; PDCD1LG2 exon 3; Set A
cacaugacuuccagugucaaaguugcauucc

SEQ ID NO: 40804 - RNA, 28 nt, Artificial Sequence
  Synthetic Oligonucleotide; PDCD1LG2 exon 3; Set A
acaugacuuccagugucaaaguugcauu

SEQ ID NO: 40805 - RNA, 32 nt, Artificial Sequence
  Synthetic Oligonucleotide; PDCD1LG2 exon 3; Set C
ucacaugacuuccagugucaaaguugcauucc

SEQ ID NO: 40806 - RNA, 27 nt, Artificial Sequence
  Synthetic Oligonucleotide; PDCD1LG2 exon 3; Set A
acaugacuuccagugucaaaguugcau

SEQ ID NO: 40807 - RNA, 26 nt, Artificial Sequence
  Synthetic Oligonucleotide; PDCD1LG2 exon 3; Set A
acaugacuuccagugucaaaguugca

SEQ ID NO: 40808 - RNA, 25 nt, Artificial Sequence
  Synthetic Oligonucleotide; PDCD1LG2 exon 3; Set A
acaugacuuccagugucaaaguugc

SEQ ID NO: 40809 - RNA, 24 nt, Artificial Sequence
  Synthetic Oligonucleotide; PDCD1LG2 exon 3; Set C
acaugacuuccagugucaaaguug

SEQ ID NO: 40810 - RNA, 23 nt, Artificial Sequence
  Synthetic Oligonucleotide; PDCD1LG2 exon 3; Set C
acaugacuuccagugucaaaguu

SEQ ID NO: 40811 - RNA, 35 nt, Artificial Sequence
  Synthetic Oligonucleotide; PDCD1LG2 exon 3; Set C
agguucacaugacuuccagugucaaaguugcauuc

SEQ ID NO: 40812 - RNA, 22 nt, Artificial Sequence
  Synthetic Oligonucleotide; PDCD1LG2 exon 3; Set C
acaugacuuccagugucaaagu

SEQ ID NO: 40813 - RNA, 34 nt, Artificial Sequence
  Synthetic Oligonucleotide; PDCD1LG2 exon 3; Set C
agguucacaugacuuccagugucaaaguugcauu

SEQ ID NO: 40814 - RNA, 21 nt, Artificial Sequence
  Synthetic Oligonucleotide; PDCD1LG2 exon 3; Set C
acaugacuuccagugucaaag

SEQ ID NO: 40815 - RNA, 33 nt, Artificial Sequence
  Synthetic Oligonucleotide; PDCD1LG2 exon 3; Set C
agguucacaugacuuccagugucaaaguugcau

SEQ ID NO: 40816 - RNA, 32 nt, Artificial Sequence
  Synthetic Oligonucleotide; PDCD1LG2 exon 3; Set C
agguucacaugacuuccagugucaaaguugca

SEQ ID NO: 40817 - RNA, 40 nt, Artificial Sequence
  Synthetic Oligonucleotide; PDCD1LG2 exon 3; Set C
uccaagguucacaugacuuccagugucaaaguugcauucc

SEQ ID NO: 40818 - RNA, 31 nt, Artificial Sequence
  Synthetic Oligonucleotide; PDCD1LG2 exon 3; Set A
agguucacaugacuuccagugucaaaguugc

SEQ ID NO: 40819 - RNA, 21 nt, Artificial Sequence
  Synthetic Oligonucleotide; PDCD1LG2 exon 3; Set C
cacaugacuuccagugucaaa

SEQ ID NO: 40820 - RNA, 30 nt, Artificial Sequence
  Synthetic Oligonucleotide; PDCD1LG2 exon 3; Set A
agguucacaugacuuccagugucaaaguug

SEQ ID NO: 40821 - RNA, 22 nt, Artificial Sequence
  Synthetic Oligonucleotide; PDCD1LG2 exon 3; Set C
ucacaugacuuccagugucaaa

SEQ ID NO: 40822 - RNA, 20 nt, Artificial Sequence
  Synthetic Oligonucleotide; PDCD1LG2 exon 3; Set C
cacaugacuuccagugucaa

SEQ ID NO: 40823 - RNA, 29 nt, Artificial Sequence
  Synthetic Oligonucleotide; PDCD1LG2 exon 3; Set A
agguucacaugacuuccagugucaaaguu

SEQ ID NO: 40824 - RNA, 21 nt, Artificial Sequence
  Synthetic Oligonucleotide; PDCD1LG2 exon 3; Set C
ucacaugacuuccagugucaa

SEQ ID NO: 40825 - RNA, 19 nt, Artificial Sequence
  Synthetic Oligonucleotide; PDCD1LG2 exon 3; Set C
cacaugacuuccaguguca

SEQ ID NO: 40826 - RNA, 28 nt, Artificial Sequence
  Synthetic Oligonucleotide; PDCD1LG2 exon 3; Set A
agguucacaugacuuccagugucaaagu

SEQ ID NO: 40827 - RNA, 20 nt, Artificial Sequence
  Synthetic Oligonucleotide; PDCD1LG2 exon 3; Set C
ucacaugacuuccaguguca

SEQ ID NO: 40828 - RNA, 18 nt, Artificial Sequence
  Synthetic Oligonucleotide; PDCD1LG2 exon 3; Set C
cacaugacuuccaguguc

SEQ ID NO: 40829 - RNA, 27 nt, Artificial Sequence
  Synthetic Oligonucleotide; PDCD1LG2 exon 3; Set A
agguucacaugacuuccagugucaaag

SEQ ID NO: 40830 - RNA, 17 nt, Artificial Sequence
  Synthetic Oligonucleotide; PDCD1LG2 exon 3; Set C
cacaugacuuccagugu

SEQ ID NO: 40831 - RNA, 19 nt, Artificial Sequence
  Synthetic Oligonucleotide; PDCD1LG2 exon 3; Set C
ucacaugacuuccaguguc

SEQ ID NO: 40832 - RNA, 18 nt, Artificial Sequence
  Synthetic Oligonucleotide; PDCD1LG2 exon 3; Set C
ucacaugacuuccagugu

SEQ ID NO: 40833 - RNA, 16 nt, Artificial Sequence
  Synthetic Oligonucleotide; PDCD1LG2 exon 3; Set C
cacaugacuuccagug

SEQ ID NO: 40834 - RNA, 15 nt, Artificial Sequence
  Synthetic Oligonucleotide; PDCD1LG2 exon 3; Set C
cacaugacuuccagu

SEQ ID NO: 40835 - RNA, 17 nt, Artificial Sequence
  Synthetic Oligonucleotide; PDCD1LG2 exon 3; Set C
ucacaugacuuccagug

SEQ ID NO: 40836 - RNA, 16 nt, Artificial Sequence
  Synthetic Oligonucleotide; PDCD1LG2 exon 3; Set C
ucacaugacuuccagu

SEQ ID NO: 40837 - RNA, 15 nt, Artificial Sequence
  Synthetic Oligonucleotide; PDCD1LG2 exon 3; Set C
ucacaugacuuccag

SEQ ID NO: 40838 - RNA, 40 nt, Artificial Sequence
  Synthetic Oligonucleotide; PDCD1LG2 exon 3; Set C
auugcuccaagguucacaugacuuccagugucaaaguugc

SEQ ID NO: 40839 - RNA, 30 nt, Artificial Sequence
  Synthetic Oligonucleotide; PDCD1LG2 exon 3; Set A
uccaagguucacaugacuuccagugucaaa

SEQ ID NO: 40840 - RNA, 39 nt, Artificial Sequence
  Synthetic Oligonucleotide; PDCD1LG2 exon 3; Set C
auugcuccaagguucacaugacuuccagugucaaaguug

SEQ ID NO: 40841 - RNA, 29 nt, Artificial Sequence
  Synthetic Oligonucleotide; PDCD1LG2 exon 3; Set A
uccaagguucacaugacuuccagugucaa

SEQ ID NO: 40842 - RNA, 38 nt, Artificial Sequence
  Synthetic Oligonucleotide; PDCD1LG2 exon 3; Set C
auugcuccaagguucacaugacuuccagugucaaaguu

SEQ ID NO: 40843 - RNA, 40 nt, Artificial Sequence
  Synthetic Oligonucleotide; PDCD1LG2 exon 3; Set C
uauugcuccaagguucacaugacuuccagugucaaaguug

SEQ ID NO: 40844 - RNA, 28 nt, Artificial Sequence
  Synthetic Oligonucleotide; PDCD1LG2 exon 3; Set C
uccaagguucacaugacuuccaguguca

SEQ ID NO: 40845 - RNA, 39 nt, Artificial Sequence
  Synthetic Oligonucleotide; PDCD1LG2 exon 3; Set C
uauugcuccaagguucacaugacuuccagugucaaaguu

SEQ ID NO: 40846 - RNA, 37 nt, Artificial Sequence
  Synthetic Oligonucleotide; PDCD1LG2 exon 3; Set C
auugcuccaagguucacaugacuuccagugucaaagu

SEQ ID NO: 40847 - RNA, 27 nt, Artificial Sequence
  Synthetic Oligonucleotide; PDCD1LG2 exon 3; Set A
uccaagguucacaugacuuccaguguc

SEQ ID NO: 40848 - RNA, 36 nt, Artificial Sequence
  Synthetic Oligonucleotide; PDCD1LG2 exon 3; Set C
auugcuccaagguucacaugacuuccagugucaaag

SEQ ID NO: 40849 - RNA, 38 nt, Artificial Sequence
  Synthetic Oligonucleotide; PDCD1LG2 exon 3; Set C
uauugcuccaagguucacaugacuuccagugucaaagu

SEQ ID NO: 40850 - RNA, 26 nt, Artificial Sequence
  Synthetic Oligonucleotide; PDCD1LG2 exon 3; Set A
uccaagguucacaugacuuccagugu

SEQ ID NO: 40851 - RNA, 37 nt, Artificial Sequence
  Synthetic Oligonucleotide; PDCD1LG2 exon 3; Set C
uauugcuccaagguucacaugacuuccagugucaaag

SEQ ID NO: 40852 - RNA, 25 nt, Artificial Sequence
  Synthetic Oligonucleotide; PDCD1LG2 exon 3; Set A
uccaagguucacaugacuuccagug

SEQ ID NO: 40853 - RNA, 24 nt, Artificial Sequence
  Synthetic Oligonucleotide; PDCD1LG2 exon 3; Set A
uccaagguucacaugacuuccagu

SEQ ID NO: 40854 - RNA, 23 nt, Artificial Sequence
  Synthetic Oligonucleotide; PDCD1LG2 exon 3; Set A
uccaagguucacaugacuuccag

SEQ ID NO: 40855 - RNA, 37 nt, Artificial Sequence
  Synthetic Oligonucleotide; PDCD1LG2 exon 3; Set C
uuauugcuccaagguucacaugacuuccagugucaaa

SEQ ID NO: 40856 - RNA, 22 nt, Artificial Sequence
  Synthetic Oligonucleotide; PDCD1LG2 exon 3; Set A
uccaagguucacaugacuucca

SEQ ID NO: 40857 - RNA, 38 nt, Artificial Sequence
  Synthetic Oligonucleotide; PDCD1LG2 exon 3; Set C
guuauugcuccaagguucacaugacuuccagugucaaa

SEQ ID NO: 40858 - RNA, 36 nt, Artificial Sequence
  Synthetic Oligonucleotide; PDCD1LG2 exon 3; Set C
uuauugcuccaagguucacaugacuuccagugucaa

SEQ ID NO: 40859 - RNA, 21 nt, Artificial Sequence
  Synthetic Oligonucleotide; PDCD1LG2 exon 3; Set C
uccaagguucacaugacuucc

SEQ ID NO: 40860 - RNA, 39 nt, Artificial Sequence
  Synthetic Oligonucleotide; PDCD1LG2 exon 3; Set C
uguuauugcuccaagguucacaugacuuccagugucaaa

SEQ ID NO: 40861 - RNA, 37 nt, Artificial Sequence
  Synthetic Oligonucleotide; PDCD1LG2 exon 3; Set C
guuauugcuccaagguucacaugacuuccagugucaa

SEQ ID NO: 40862 - RNA, 35 nt, Artificial Sequence
  Synthetic Oligonucleotide; PDCD1LG2 exon 3; Set C
uuauugcuccaagguucacaugacuuccaguguca

SEQ ID NO: 40863 - RNA, 20 nt, Artificial Sequence
  Synthetic Oligonucleotide; PDCD1LG2 exon 3; Set C
uccaagguucacaugacuuc

SEQ ID NO: 40864 - RNA, 38 nt, Artificial Sequence
  Synthetic Oligonucleotide; PDCD1LG2 exon 3; Set C
uguuauugcuccaagguucacaugacuuccagugucaa

SEQ ID NO: 40865 - RNA, 40 nt, Artificial Sequence
  Synthetic Oligonucleotide; PDCD1LG2 exon 3; Set C
cuguuauugcuccaagguucacaugacuuccagugucaaa

SEQ ID NO: 40866 - RNA, 36 nt, Artificial Sequence
  Synthetic Oligonucleotide; PDCD1LG2 exon 3; Set C
guuauugcuccaagguucacaugacuuccaguguca

SEQ ID NO: 40867 - RNA, 34 nt, Artificial Sequence
  Synthetic Oligonucleotide; PDCD1LG2 exon 3; Set C
uuauugcuccaagguucacaugacuuccaguguc

SEQ ID NO: 40868 - RNA, 33 nt, Artificial Sequence
  Synthetic Oligonucleotide; PDCD1LG2 exon 3; Set C
uuauugcuccaagguucacaugacuuccagugu

SEQ ID NO: 40869 - RNA, 39 nt, Artificial Sequence
  Synthetic Oligonucleotide; PDCD1LG2 exon 3; Set C
cuguuauugcuccaagguucacaugacuuccagugucaa

SEQ ID NO: 40870 - RNA, 37 nt, Artificial Sequence
  Synthetic Oligonucleotide; PDCD1LG2 exon 3; Set C
uguuauugcuccaagguucacaugacuuccaguguca

SEQ ID NO: 40871 - RNA, 35 nt, Artificial Sequence
  Synthetic Oligonucleotide; PDCD1LG2 exon 3; Set C
guuauugcuccaagguucacaugacuuccaguguc

SEQ ID NO: 40872 - RNA, 34 nt, Artificial Sequence
  Synthetic Oligonucleotide; PDCD1LG2 exon 3; Set C
guuauugcuccaagguucacaugacuuccagugu

SEQ ID NO: 40873 - RNA, 32 nt, Artificial Sequence
  Synthetic Oligonucleotide; PDCD1LG2 exon 3; Set C
uuauugcuccaagguucacaugacuuccagug

SEQ ID NO: 40874 - RNA, 40 nt, Artificial Sequence
  Synthetic Oligonucleotide; PDCD1LG2 exon 3; Set C
gcuguuauugcuccaagguucacaugacuuccagugucaa

SEQ ID NO: 40875 - RNA, 38 nt, Artificial Sequence
  Synthetic Oligonucleotide; PDCD1LG2 exon 3; Set C
cuguuauugcuccaagguucacaugacuuccaguguca

SEQ ID NO: 40876 - RNA, 36 nt, Artificial Sequence
  Synthetic Oligonucleotide; PDCD1LG2 exon 3; Set C
uguuauugcuccaagguucacaugacuuccaguguc

SEQ ID NO: 40877 - RNA, 35 nt, Artificial Sequence
  Synthetic Oligonucleotide; PDCD1LG2 exon 3; Set C
uguuauugcuccaagguucacaugacuuccagugu

SEQ ID NO: 40878 - RNA, 31 nt, Artificial Sequence
  Synthetic Oligonucleotide; PDCD1LG2 exon 3; Set C
uuauugcuccaagguucacaugacuuccagu

SEQ ID NO: 40879 - RNA, 33 nt, Artificial Sequence
  Synthetic Oligonucleotide; PDCD1LG2 exon 3; Set C
guuauugcuccaagguucacaugacuuccagug

SEQ ID NO: 40880 - RNA, 39 nt, Artificial Sequence
  Synthetic Oligonucleotide; PDCD1LG2 exon 3; Set C
gcuguuauugcuccaagguucacaugacuuccaguguca

SEQ ID NO: 40881 - RNA, 37 nt, Artificial Sequence
  Synthetic Oligonucleotide; PDCD1LG2 exon 3; Set C
cuguuauugcuccaagguucacaugacuuccaguguc

SEQ ID NO: 40882 - RNA, 36 nt, Artificial Sequence
  Synthetic Oligonucleotide; PDCD1LG2 exon 3; Set C
cuguuauugcuccaagguucacaugacuuccagugu

SEQ ID NO: 40883 - RNA, 32 nt, Artificial Sequence
  Synthetic Oligonucleotide; PDCD1LG2 exon 3; Set C
guuauugcuccaagguucacaugacuuccagu

SEQ ID NO: 40884 - RNA, 30 nt, Artificial Sequence
  Synthetic Oligonucleotide; PDCD1LG2 exon 3; Set A
uuauugcuccaagguucacaugacuuccag

SEQ ID NO: 40885 - RNA, 34 nt, Artificial Sequence
  Synthetic Oligonucleotide; PDCD1LG2 exon 3; Set C
uguuauugcuccaagguucacaugacuuccagug

SEQ ID NO: 40886 - RNA, 40 nt, Artificial Sequence
  Synthetic Oligonucleotide; PDCD1LG2 exon 3; Set C
ggcuguuauugcuccaagguucacaugacuuccaguguca

SEQ ID NO: 40887 - RNA, 38 nt, Artificial Sequence
  Synthetic Oligonucleotide; PDCD1LG2 exon 3; Set C
gcuguuauugcuccaagguucacaugacuuccaguguc

SEQ ID NO: 40888 - RNA, 29 nt, Artificial Sequence
  Synthetic Oligonucleotide; PDCD1LG2 exon 3; Set A
uuauugcuccaagguucacaugacuucca

SEQ ID NO: 40889 - RNA, 37 nt, Artificial Sequence
  Synthetic Oligonucleotide; PDCD1LG2 exon 3; Set C
gcuguuauugcuccaagguucacaugacuuccagugu

SEQ ID NO: 40890 - RNA, 33 nt, Artificial Sequence
  Synthetic Oligonucleotide; PDCD1LG2 exon 3; Set C
uguuauugcuccaagguucacaugacuuccagu

SEQ ID NO: 40891 - RNA, 31 nt, Artificial Sequence
  Synthetic Oligonucleotide; PDCD1LG2 exon 3; Set C
guuauugcuccaagguucacaugacuuccag

SEQ ID NO: 40892 - RNA, 35 nt, Artificial Sequence
  Synthetic Oligonucleotide; PDCD1LG2 exon 3; Set C
cuguuauugcuccaagguucacaugacuuccagug

SEQ ID NO: 40893 - RNA, 39 nt, Artificial Sequence
  Synthetic Oligonucleotide; PDCD1LG2 exon 3; Set C
ggcuguuauugcuccaagguucacaugacuuccaguguc

SEQ ID NO: 40894 - RNA, 28 nt, Artificial Sequence
  Synthetic Oligonucleotide; PDCD1LG2 exon 3; Set A
uuauugcuccaagguucacaugacuucc

SEQ ID NO: 40895 - RNA, 30 nt, Artificial Sequence
  Synthetic Oligonucleotide; PDCD1LG2 exon 3; Set C
guuauugcuccaagguucacaugacuucca

SEQ ID NO: 40896 - RNA, 38 nt, Artificial Sequence
  Synthetic Oligonucleotide; PDCD1LG2 exon 3; Set C
ggcuguuauugcuccaagguucacaugacuuccagugu

SEQ ID NO: 40897 - RNA, 34 nt, Artificial Sequence
  Synthetic Oligonucleotide; PDCD1LG2 exon 3; Set C
cuguuauugcuccaagguucacaugacuuccagu

SEQ ID NO: 40898 - RNA, 32 nt, Artificial Sequence
  Synthetic Oligonucleotide; PDCD1LG2 exon 3; Set C
uguuauugcuccaagguucacaugacuuccag

SEQ ID NO: 40899 - RNA, 36 nt, Artificial Sequence
  Synthetic Oligonucleotide; PDCD1LG2 exon 3; Set C
gcuguuauugcuccaagguucacaugacuuccagug

SEQ ID NO: 40900 - RNA, 40 nt, Artificial Sequence
  Synthetic Oligonucleotide; PDCD1LG2 exon 3; Set C
uggcuguuauugcuccaagguucacaugacuuccaguguc

SEQ ID NO: 40901 - RNA, 27 nt, Artificial Sequence
  Synthetic Oligonucleotide; PDCD1LG2 exon 3; Set A
uuauugcuccaagguucacaugacuuc

SEQ ID NO: 40902 - RNA, 29 nt, Artificial Sequence
  Synthetic Oligonucleotide; PDCD1LG2 exon 3; Set A
guuauugcuccaagguucacaugacuucc

SEQ ID NO: 40903 - RNA, 31 nt, Artificial Sequence
  Synthetic Oligonucleotide; PDCD1LG2 exon 3; Set C
uguuauugcuccaagguucacaugacuucca

SEQ ID NO: 40904 - RNA, 39 nt, Artificial Sequence
  Synthetic Oligonucleotide; PDCD1LG2 exon 3; Set C
uggcuguuauugcuccaagguucacaugacuuccagugu

SEQ ID NO: 40905 - RNA, 35 nt, Artificial Sequence
  Synthetic Oligonucleotide; PDCD1LG2 exon 3; Set C
gcuguuauugcuccaagguucacaugacuuccagu

SEQ ID NO: 40906 - RNA, 33 nt, Artificial Sequence
  Synthetic Oligonucleotide; PDCD1LG2 exon 3; Set C
cuguuauugcuccaagguucacaugacuuccag

SEQ ID NO: 40907 - RNA, 37 nt, Artificial Sequence
  Synthetic Oligonucleotide; PDCD1LG2 exon 3; Set C
ggcuguuauugcuccaagguucacaugacuuccagug

SEQ ID NO: 40908 - RNA, 28 nt, Artificial Sequence
  Synthetic Oligonucleotide; PDCD1LG2 exon 3; Set A
guuauugcuccaagguucacaugacuuc

SEQ ID NO: 40909 - RNA, 30 nt, Artificial Sequence
  Synthetic Oligonucleotide; PDCD1LG2 exon 3; Set A
uguuauugcuccaagguucacaugacuucc

SEQ ID NO: 40910 - RNA, 32 nt, Artificial Sequence
  Synthetic Oligonucleotide; PDCD1LG2 exon 3; Set C
cuguuauugcuccaagguucacaugacuucca

SEQ ID NO: 40911 - RNA, 40 nt, Artificial Sequence
  Synthetic Oligonucleotide; PDCD1LG2 exon 3; Set C
cuggcuguuauugcuccaagguucacaugacuuccagugu

SEQ ID NO: 40912 - RNA, 36 nt, Artificial Sequence
  Synthetic Oligonucleotide; PDCD1LG2 exon 3; Set C
ggcuguuauugcuccaagguucacaugacuuccagu

SEQ ID NO: 40913 - RNA, 34 nt, Artificial Sequence
  Synthetic Oligonucleotide; PDCD1LG2 exon 3; Set C
gcuguuauugcuccaagguucacaugacuuccag

SEQ ID NO: 40914 - RNA, 38 nt, Artificial Sequence
  Synthetic Oligonucleotide; PDCD1LG2 exon 3; Set C
uggcuguuauugcuccaagguucacaugacuuccagug

SEQ ID NO: 40915 - RNA, 29 nt, Artificial Sequence
  Synthetic Oligonucleotide; PDCD1LG2 exon 3; Set A
uguuauugcuccaagguucacaugacuuc

SEQ ID NO: 40916 - RNA, 31 nt, Artificial Sequence
  Synthetic Oligonucleotide; PDCD1LG2 exon 3; Set C
cuguuauugcuccaagguucacaugacuucc

SEQ ID NO: 40917 - RNA, 33 nt, Artificial Sequence
  Synthetic Oligonucleotide; PDCD1LG2 exon 3; Set C
gcuguuauugcuccaagguucacaugacuucca

SEQ ID NO: 40918 - RNA, 37 nt, Artificial Sequence
  Synthetic Oligonucleotide; PDCD1LG2 exon 3; Set C
uggcuguuauugcuccaagguucacaugacuuccagu

SEQ ID NO: 40919 - RNA, 35 nt, Artificial Sequence
  Synthetic Oligonucleotide; PDCD1LG2 exon 3; Set C
ggcuguuauugcuccaagguucacaugacuuccag

SEQ ID NO: 40920 - RNA, 39 nt, Artificial Sequence
  Synthetic Oligonucleotide; PDCD1LG2 exon 3; Set C
cuggcuguuauugcuccaagguucacaugacuuccagug

SEQ ID NO: 40921 - RNA, 30 nt, Artificial Sequence
  Synthetic Oligonucleotide; PDCD1LG2 exon 3; Set A
cuguuauugcuccaagguucacaugacuuc

SEQ ID NO: 40922 - RNA, 32 nt, Artificial Sequence
  Synthetic Oligonucleotide; PDCD1LG2 exon 3; Set C
gcuguuauugcuccaagguucacaugacuucc

SEQ ID NO: 40923 - RNA, 34 nt, Artificial Sequence
  Synthetic Oligonucleotide; PDCD1LG2 exon 3; Set C
ggcuguuauugcuccaagguucacaugacuucca

SEQ ID NO: 40924 - RNA, 38 nt, Artificial Sequence
  Synthetic Oligonucleotide; PDCD1LG2 exon 3; Set C
cuggcuguuauugcuccaagguucacaugacuuccagu

SEQ ID NO: 40925 - RNA, 36 nt, Artificial Sequence
  Synthetic Oligonucleotide; PDCD1LG2 exon 3; Set C
uggcuguuauugcuccaagguucacaugacuuccag

SEQ ID NO: 40926 - RNA, 40 nt, Artificial Sequence
  Synthetic Oligonucleotide; PDCD1LG2 exon 3; Set C
acuggcuguuauugcuccaagguucacaugacuuccagug

SEQ ID NO: 40927 - RNA, 31 nt, Artificial Sequence
  Synthetic Oligonucleotide; PDCD1LG2 exon 3; Set C
gcuguuauugcuccaagguucacaugacuuc

SEQ ID NO: 40928 - RNA, 33 nt, Artificial Sequence
  Synthetic Oligonucleotide; PDCD1LG2 exon 3; Set C
ggcuguuauugcuccaagguucacaugacuucc

SEQ ID NO: 40929 - RNA, 35 nt, Artificial Sequence
  Synthetic Oligonucleotide; PDCD1LG2 exon 3; Set C
uggcuguuauugcuccaagguucacaugacuucca

SEQ ID NO: 40930 - RNA, 39 nt, Artificial Sequence
  Synthetic Oligonucleotide; PDCD1LG2 exon 3; Set C
acuggcuguuauugcuccaagguucacaugacuuccagu

SEQ ID NO: 40931 - RNA, 37 nt, Artificial Sequence
  Synthetic Oligonucleotide; PDCD1LG2 exon 3; Set C
cuggcuguuauugcuccaagguucacaugacuuccag

SEQ ID NO: 40932 - RNA, 32 nt, Artificial Sequence
  Synthetic Oligonucleotide; PDCD1LG2 exon 3; Set C
ggcuguuauugcuccaagguucacaugacuuc

SEQ ID NO: 40933 - RNA, 34 nt, Artificial Sequence
  Synthetic Oligonucleotide; PDCD1LG2 exon 3; Set C
uggcuguuauugcuccaagguucacaugacuucc

SEQ ID NO: 40934 - RNA, 36 nt, Artificial Sequence
  Synthetic Oligonucleotide; PDCD1LG2 exon 3; Set C
cuggcuguuauugcuccaagguucacaugacuucca

SEQ ID NO: 40935 - RNA, 38 nt, Artificial Sequence
  Synthetic Oligonucleotide; PDCD1LG2 exon 3; Set C
acuggcuguuauugcuccaagguucacaugacuuccag

SEQ ID NO: 40936 - RNA, 33 nt, Artificial Sequence
  Synthetic Oligonucleotide; PDCD1LG2 exon 3; Set C
uggcuguuauugcuccaagguucacaugacuuc

SEQ ID NO: 40937 - RNA, 35 nt, Artificial Sequence
  Synthetic Oligonucleotide; PDCD1LG2 exon 3; Set C
cuggcuguuauugcuccaagguucacaugacuucc

SEQ ID NO: 40938 - RNA, 37 nt, Artificial Sequence
  Synthetic Oligonucleotide; PDCD1LG2 exon 3; Set C
acuggcuguuauugcuccaagguucacaugacuucca

SEQ ID NO: 40939 - RNA, 34 nt, Artificial Sequence
  Synthetic Oligonucleotide; PDCD1LG2 exon 3; Set C
cuggcuguuauugcuccaagguucacaugacuuc

SEQ ID NO: 40940 - RNA, 36 nt, Artificial Sequence
  Synthetic Oligonucleotide; PDCD1LG2 exon 3; Set C
acuggcuguuauugcuccaagguucacaugacuucc

SEQ ID NO: 40941 - RNA, 18 nt, Artificial Sequence
  Synthetic Oligonucleotide; PDCD1LG2 exon 3; Set C
uauugcuccaagguucac

SEQ ID NO: 40942 - RNA, 20 nt, Artificial Sequence
  Synthetic Oligonucleotide; PDCD1LG2 exon 3; Set C
uuauugcuccaagguucaca

SEQ ID NO: 40943 - RNA, 35 nt, Artificial Sequence
  Synthetic Oligonucleotide; PDCD1LG2 exon 3; Set C
acuggcuguuauugcuccaagguucacaugacuuc

SEQ ID NO: 40944 - RNA, 19 nt, Artificial Sequence
  Synthetic Oligonucleotide; PDCD1LG2 exon 3; Set C
uuauugcuccaagguucac

SEQ ID NO: 40945 - RNA, 21 nt, Artificial Sequence
  Synthetic Oligonucleotide; PDCD1LG2 exon 3; Set C
guuauugcuccaagguucaca

SEQ ID NO: 40946 - RNA, 18 nt, Artificial Sequence
  Synthetic Oligonucleotide; PDCD1LG2 exon 3; Set C
uuauugcuccaagguuca

SEQ ID NO: 40947 - RNA, 22 nt, Artificial Sequence
  Synthetic Oligonucleotide; PDCD1LG2 exon 3; Set C
uguuauugcuccaagguucaca

SEQ ID NO: 40948 - RNA, 19 nt, Artificial Sequence
  Synthetic Oligonucleotide; PDCD1LG2 exon 3; Set C
guuauugcuccaagguuca

SEQ ID NO: 40949 - RNA, 23 nt, Artificial Sequence
  Synthetic Oligonucleotide; PDCD1LG2 exon 3; Set A
cuguuauugcuccaagguucaca

SEQ ID NO: 40950 - RNA, 24 nt, Artificial Sequence
  Synthetic Oligonucleotide; PDCD1LG2 exon 3; Set A
gcuguuauugcuccaagguucaca

SEQ ID NO: 40951 - RNA, 25 nt, Artificial Sequence
  Synthetic Oligonucleotide; PDCD1LG2 exon 3; Set A
ggcuguuauugcuccaagguucaca

SEQ ID NO: 40952 - RNA, 26 nt, Artificial Sequence
  Synthetic Oligonucleotide; PDCD1LG2 exon 3; Set A
uggcuguuauugcuccaagguucaca

SEQ ID NO: 40953 - RNA, 27 nt, Artificial Sequence
  Synthetic Oligonucleotide; PDCD1LG2 exon 3; Set C
cuggcuguuauugcuccaagguucaca

SEQ ID NO: 40954 - RNA, 28 nt, Artificial Sequence
  Synthetic Oligonucleotide; PDCD1LG2 exon 3; Set C
acuggcuguuauugcuccaagguucaca

SEQ ID NO: 40955 - RNA, 16 nt, Artificial Sequence
  Synthetic Oligonucleotide; PDCD1LG2 exon 3; Set C
uguuauugcuccaagg

SEQ ID NO: 40956 - RNA, 17 nt, Artificial Sequence
  Synthetic Oligonucleotide; PDCD1LG2 exon 3; Set C
cuguuauugcuccaagg

SEQ ID NO: 40957 - RNA, 18 nt, Artificial Sequence
  Synthetic Oligonucleotide; PDCD1LG2 exon 3; Set C
gcuguuauugcuccaagg

SEQ ID NO: 40958 - RNA, 19 nt, Artificial Sequence
  Synthetic Oligonucleotide; PDCD1LG2 exon 3; Set C
ggcuguuauugcuccaagg

SEQ ID NO: 40959 - RNA, 20 nt, Artificial Sequence
  Synthetic Oligonucleotide; PDCD1LG2 exon 3; Set C
uggcuguuauugcuccaagg

SEQ ID NO: 40960 - RNA, 21 nt, Artificial Sequence
  Synthetic Oligonucleotide; PDCD1LG2 exon 3; Set A
cuggcuguuauugcuccaagg

SEQ ID NO: 40961 - RNA, 22 nt, Artificial Sequence
  Synthetic Oligonucleotide; PDCD1LG2 exon 3; Set A
acuggcuguuauugcuccaagg

SEQ ID NO: 40962 - RNA, 33 nt, Artificial Sequence
  Synthetic Oligonucleotide; PDCD1LG2 exon 3; Set C
uugcaaacuggcuguuauugcuccaagguucac

SEQ ID NO: 40963 - RNA, 32 nt, Artificial Sequence
  Synthetic Oligonucleotide; PDCD1LG2 exon 3; Set C
uugcaaacuggcuguuauugcuccaagguuca

SEQ ID NO: 40964 - RNA, 34 nt, Artificial Sequence
  Synthetic Oligonucleotide; PDCD1LG2 exon 3; Set C
uuugcaaacuggcuguuauugcuccaagguucac

SEQ ID NO: 40965 - RNA, 33 nt, Artificial Sequence
  Synthetic Oligonucleotide; PDCD1LG2 exon 3; Set C
uuugcaaacuggcuguuauugcuccaagguuca

SEQ ID NO: 40966 - RNA, 23 nt, Artificial Sequence
  Synthetic Oligonucleotide; PDCD1LG2 exon 3; Set A
ugcaaacuggcuguuauugcucc

SEQ ID NO: 40967 - RNA, 24 nt, Artificial Sequence
  Synthetic Oligonucleotide; PDCD1LG2 exon 3; Set A
uugcaaacuggcuguuauugcucc

SEQ ID NO: 40968 - RNA, 40 nt, Artificial Sequence
  Synthetic Oligonucleotide; PDCD1LG2 exon 3; Set C
uccaccuuuugcaaacuggcuguuauugcuccaagguuca

SEQ ID NO: 40969 - RNA, 25 nt, Artificial Sequence
  Synthetic Oligonucleotide; PDCD1LG2 exon 3; Set A
uuugcaaacuggcuguuauugcucc

SEQ ID NO: 40970 - RNA, 19 nt, Artificial Sequence
  Synthetic Oligonucleotide; PDCD1LG2 exon 3; Set C
uugcaaacuggcuguuauu

SEQ ID NO: 40971 - RNA, 16 nt, Artificial Sequence
  Synthetic Oligonucleotide; PDCD1LG2 exon 3; Set C
ugcaaacuggcuguua

SEQ ID NO: 40972 - RNA, 18 nt, Artificial Sequence
  Synthetic Oligonucleotide; PDCD1LG2 exon 3; Set C
uugcaaacuggcuguuau

SEQ ID NO: 40973 - RNA, 17 nt, Artificial Sequence
  Synthetic Oligonucleotide; PDCD1LG2 exon 3; Set C
uugcaaacuggcuguua

SEQ ID NO: 40974 - RNA, 15 nt, Artificial Sequence
  Synthetic Oligonucleotide; PDCD1LG2 exon 3; Set C
ugcaaacuggcuguu

SEQ ID NO: 40975 - RNA, 19 nt, Artificial Sequence
  Synthetic Oligonucleotide; PDCD1LG2 exon 3; Set C
uuugcaaacuggcuguuau

SEQ ID NO: 40976 - RNA, 32 nt, Artificial Sequence
  Synthetic Oligonucleotide; PDCD1LG2 exon 3; Set C
uccaccuuuugcaaacuggcuguuauugcucc

SEQ ID NO: 40977 - RNA, 16 nt, Artificial Sequence
  Synthetic Oligonucleotide; PDCD1LG2 exon 3; Set C
uugcaaacuggcuguu

SEQ ID NO: 40978 - RNA, 18 nt, Artificial Sequence
  Synthetic Oligonucleotide; PDCD1LG2 exon 3; Set C
uuugcaaacuggcuguua

SEQ ID NO: 40979 - RNA, 33 nt, Artificial Sequence
  Synthetic Oligonucleotide; PDCD1LG2 exon 3; Set C
uuccaccuuuugcaaacuggcuguuauugcucc

SEQ ID NO: 40980 - RNA, 15 nt, Artificial Sequence
  Synthetic Oligonucleotide; PDCD1LG2 exon 3; Set C
uugcaaacuggcugu

SEQ ID NO: 40981 - RNA, 17 nt, Artificial Sequence
  Synthetic Oligonucleotide; PDCD1LG2 exon 3; Set C
uuugcaaacuggcuguu

SEQ ID NO: 40982 - RNA, 34 nt, Artificial Sequence
  Synthetic Oligonucleotide; PDCD1LG2 exon 3; Set C
uuuccaccuuuugcaaacuggcuguuauugcucc

SEQ ID NO: 40983 - RNA, 16 nt, Artificial Sequence
  Synthetic Oligonucleotide; PDCD1LG2 exon 3; Set C
uuugcaaacuggcugu

SEQ ID NO: 40984 - RNA, 35 nt, Artificial Sequence
  Synthetic Oligonucleotide; PDCD1LG2 exon 3; Set C
uuuuccaccuuuugcaaacuggcuguuauugcucc

SEQ ID NO: 40985 - RNA, 15 nt, Artificial Sequence
  Synthetic Oligonucleotide; PDCD1LG2 exon 3; Set C
uuugcaaacuggcug

SEQ ID NO: 40986 - RNA, 36 nt, Artificial Sequence
  Synthetic Oligonucleotide; PDCD1LG2 exon 3; Set C
auuuuccaccuuuugcaaacuggcuguuauugcucc

SEQ ID NO: 40987 - RNA, 37 nt, Artificial Sequence
  Synthetic Oligonucleotide; PDCD1LG2 exon 3; Set C
cauuuuccaccuuuugcaaacuggcuguuauugcucc

SEQ ID NO: 40988 - RNA, 38 nt, Artificial Sequence
  Synthetic Oligonucleotide; PDCD1LG2 exon 3; Set C
ucauuuuccaccuuuugcaaacuggcuguuauugcucc

SEQ ID NO: 40989 - RNA, 28 nt, Artificial Sequence
  Synthetic Oligonucleotide; PDCD1LG2 exon 3; Set A
uuccaccuuuugcaaacuggcuguuauu

SEQ ID NO: 40990 - RNA, 25 nt, Artificial Sequence
  Synthetic Oligonucleotide; PDCD1LG2 exon 3; Set A
uccaccuuuugcaaacuggcuguua

SEQ ID NO: 40991 - RNA, 39 nt, Artificial Sequence
  Synthetic Oligonucleotide; PDCD1LG2 exon 3; Set C
aucauuuuccaccuuuugcaaacuggcuguuauugcucc

SEQ ID NO: 40992 - RNA, 27 nt, Artificial Sequence
  Synthetic Oligonucleotide; PDCD1LG2 exon 3; Set A
uuccaccuuuugcaaacuggcuguuau

SEQ ID NO: 40993 - RNA, 29 nt, Artificial Sequence
  Synthetic Oligonucleotide; PDCD1LG2 exon 3; Set A
uuuccaccuuuugcaaacuggcuguuauu

SEQ ID NO: 40994 - RNA, 26 nt, Artificial Sequence
  Synthetic Oligonucleotide; PDCD1LG2 exon 3; Set A
uuccaccuuuugcaaacuggcuguua

SEQ ID NO: 40995 - RNA, 24 nt, Artificial Sequence
  Synthetic Oligonucleotide; PDCD1LG2 exon 3; Set A
uccaccuuuugcaaacuggcuguu

SEQ ID NO: 40996 - RNA, 40 nt, Artificial Sequence
  Synthetic Oligonucleotide; PDCD1LG2 exon 3; Set C
uaucauuuuccaccuuuugcaaacuggcuguuauugcucc

SEQ ID NO: 40997 - RNA, 28 nt, Artificial Sequence
  Synthetic Oligonucleotide; PDCD1LG2 exon 3; Set A
uuuccaccuuuugcaaacuggcuguuau

SEQ ID NO: 40998 - RNA, 27 nt, Artificial Sequence
  Synthetic Oligonucleotide; PDCD1LG2 exon 3; Set A
uuuccaccuuuugcaaacuggcuguua

SEQ ID NO: 40999 - RNA, 25 nt, Artificial Sequence
  Synthetic Oligonucleotide; PDCD1LG2 exon 3; Set A
uuccaccuuuugcaaacuggcuguu

SEQ ID NO: 41000 - RNA, 23 nt, Artificial Sequence
  Synthetic Oligonucleotide; PDCD1LG2 exon 3; Set A
uccaccuuuugcaaacuggcugu

SEQ ID NO: 41001 - RNA, 26 nt, Artificial Sequence
  Synthetic Oligonucleotide; PDCD1LG2 exon 3; Set A
uuuccaccuuuugcaaacuggcuguu

SEQ ID NO: 41002 - RNA, 24 nt, Artificial Sequence
  Synthetic Oligonucleotide; PDCD1LG2 exon 3; Set A
uuccaccuuuugcaaacuggcugu

SEQ ID NO: 41003 - RNA, 28 nt, Artificial Sequence
  Synthetic Oligonucleotide; PDCD1LG2 exon 3; Set A
uuuuccaccuuuugcaaacuggcuguua

SEQ ID NO: 41004 - RNA, 22 nt, Artificial Sequence
  Synthetic Oligonucleotide; PDCD1LG2 exon 3; Set A
uccaccuuuugcaaacuggcug

SEQ ID NO: 41005 - RNA, 25 nt, Artificial Sequence
  Synthetic Oligonucleotide; PDCD1LG2 exon 3; Set A
uuuccaccuuuugcaaacuggcugu

SEQ ID NO: 41006 - RNA, 29 nt, Artificial Sequence
  Synthetic Oligonucleotide; PDCD1LG2 exon 3; Set A
auuuuccaccuuuugcaaacuggcuguua

SEQ ID NO: 41007 - RNA, 27 nt, Artificial Sequence
  Synthetic Oligonucleotide; PDCD1LG2 exon 3; Set A
uuuuccaccuuuugcaaacuggcuguu

SEQ ID NO: 41008 - RNA, 23 nt, Artificial Sequence
  Synthetic Oligonucleotide; PDCD1LG2 exon 3; Set A
uuccaccuuuugcaaacuggcug

SEQ ID NO: 41009 - RNA, 21 nt, Artificial Sequence
  Synthetic Oligonucleotide; PDCD1LG2 exon 3; Set A
uccaccuuuugcaaacuggcu

SEQ ID NO: 41010 - RNA, 30 nt, Artificial Sequence
  Synthetic Oligonucleotide; PDCD1LG2 exon 3; Set A
cauuuuccaccuuuugcaaacuggcuguua

SEQ ID NO: 41011 - RNA, 28 nt, Artificial Sequence
  Synthetic Oligonucleotide; PDCD1LG2 exon 3; Set A
auuuuccaccuuuugcaaacuggcuguu

SEQ ID NO: 41012 - RNA, 26 nt, Artificial Sequence
  Synthetic Oligonucleotide; PDCD1LG2 exon 3; Set A
uuuuccaccuuuugcaaacuggcugu

SEQ ID NO: 41013 - RNA, 24 nt, Artificial Sequence
  Synthetic Oligonucleotide; PDCD1LG2 exon 3; Set A
uuuccaccuuuugcaaacuggcug

SEQ ID NO: 41014 - RNA, 22 nt, Artificial Sequence
  Synthetic Oligonucleotide; PDCD1LG2 exon 3; Set A
uuccaccuuuugcaaacuggcu

SEQ ID NO: 41015 - RNA, 20 nt, Artificial Sequence
  Synthetic Oligonucleotide; PDCD1LG2 exon 3; Set A
uccaccuuuugcaaacuggc

SEQ ID NO: 41016 - RNA, 31 nt, Artificial Sequence
  Synthetic Oligonucleotide; PDCD1LG2 exon 3; Set A
ucauuuuccaccuuuugcaaacuggcuguua

SEQ ID NO: 41017 - RNA, 29 nt, Artificial Sequence
  Synthetic Oligonucleotide; PDCD1LG2 exon 3; Set A
cauuuuccaccuuuugcaaacuggcuguu

SEQ ID NO: 41018 - RNA, 27 nt, Artificial Sequence
  Synthetic Oligonucleotide; PDCD1LG2 exon 3; Set A
auuuuccaccuuuugcaaacuggcugu

SEQ ID NO: 41019 - RNA, 25 nt, Artificial Sequence
  Synthetic Oligonucleotide; PDCD1LG2 exon 3; Set A
uuuuccaccuuuugcaaacuggcug

SEQ ID NO: 41020 - RNA, 23 nt, Artificial Sequence
  Synthetic Oligonucleotide; PDCD1LG2 exon 3; Set A
uuuccaccuuuugcaaacuggcu

SEQ ID NO: 41021 - RNA, 21 nt, Artificial Sequence
  Synthetic Oligonucleotide; PDCD1LG2 exon 3; Set A
uuccaccuuuugcaaacuggc

SEQ ID NO: 41022 - RNA, 32 nt, Artificial Sequence
  Synthetic Oligonucleotide; PDCD1LG2 exon 3; Set A
aucauuuuccaccuuuugcaaacuggcuguua

SEQ ID NO: 41023 - RNA, 30 nt, Artificial Sequence
  Synthetic Oligonucleotide; PDCD1LG2 exon 3; Set A
ucauuuuccaccuuuugcaaacuggcuguu

SEQ ID NO: 41024 - RNA, 28 nt, Artificial Sequence
  Synthetic Oligonucleotide; PDCD1LG2 exon 3; Set A
cauuuuccaccuuuugcaaacuggcugu

SEQ ID NO: 41025 - RNA, 26 nt, Artificial Sequence
  Synthetic Oligonucleotide; PDCD1LG2 exon 3; Set A
auuuuccaccuuuugcaaacuggcug

SEQ ID NO: 41026 - RNA, 24 nt, Artificial Sequence
  Synthetic Oligonucleotide; PDCD1LG2 exon 3; Set A
uuuuccaccuuuugcaaacuggcu

SEQ ID NO: 41027 - RNA, 22 nt, Artificial Sequence
  Synthetic Oligonucleotide; PDCD1LG2 exon 3; Set A
uuuccaccuuuugcaaacuggc

SEQ ID NO: 41028 - RNA, 20 nt, Artificial Sequence
  Synthetic Oligonucleotide; PDCD1LG2 exon 3; Set C
uuccaccuuuugcaaacugg

SEQ ID NO: 41029 - RNA, 33 nt, Artificial Sequence
  Synthetic Oligonucleotide; PDCD1LG2 exon 3; Set A
uaucauuuuccaccuuuugcaaacuggcuguua

SEQ ID NO: 41030 - RNA, 31 nt, Artificial Sequence
  Synthetic Oligonucleotide; PDCD1LG2 exon 3; Set A
aucauuuuccaccuuuugcaaacuggcuguu

SEQ ID NO: 41031 - RNA, 29 nt, Artificial Sequence
  Synthetic Oligonucleotide; PDCD1LG2 exon 3; Set A
ucauuuuccaccuuuugcaaacuggcugu

SEQ ID NO: 41032 - RNA, 27 nt, Artificial Sequence
  Synthetic Oligonucleotide; PDCD1LG2 exon 3; Set A
cauuuuccaccuuuugcaaacuggcug

SEQ ID NO: 41033 - RNA, 25 nt, Artificial Sequence
  Synthetic Oligonucleotide; PDCD1LG2 exon 3; Set A
auuuuccaccuuuugcaaacuggcu

SEQ ID NO: 41034 - RNA, 21 nt, Artificial Sequence
  Synthetic Oligonucleotide; PDCD1LG2 exon 3; Set C
uuuccaccuuuugcaaacugg

SEQ ID NO: 41035 - RNA, 37 nt, Artificial Sequence
  Synthetic Oligonucleotide; PDCD1LG2 exon 3; Set C
uguaucauuuuccaccuuuugcaaacuggcuguuauu

SEQ ID NO: 41036 - RNA, 32 nt, Artificial Sequence
  Synthetic Oligonucleotide; PDCD1LG2 exon 3; Set A
uaucauuuuccaccuuuugcaaacuggcuguu

SEQ ID NO: 41037 - RNA, 30 nt, Artificial Sequence
  Synthetic Oligonucleotide; PDCD1LG2 exon 3; Set A
aucauuuuccaccuuuugcaaacuggcugu

SEQ ID NO: 41038 - RNA, 34 nt, Artificial Sequence
  Synthetic Oligonucleotide; PDCD1LG2 exon 3; Set C
guaucauuuuccaccuuuugcaaacuggcuguua

SEQ ID NO: 41039 - RNA, 28 nt, Artificial Sequence
  Synthetic Oligonucleotide; PDCD1LG2 exon 3; Set A
ucauuuuccaccuuuugcaaacuggcug

SEQ ID NO: 41040 - RNA, 26 nt, Artificial Sequence
  Synthetic Oligonucleotide; PDCD1LG2 exon 3; Set A
cauuuuccaccuuuugcaaacuggcu

SEQ ID NO: 41041 - RNA, 24 nt, Artificial Sequence
  Synthetic Oligonucleotide; PDCD1LG2 exon 3; Set A
auuuuccaccuuuugcaaacuggc

SEQ ID NO: 41042 - RNA, 20 nt, Artificial Sequence
  Synthetic Oligonucleotide; PDCD1LG2 exon 3; Set C
uuuccaccuuuugcaaacug

SEQ ID NO: 41043 - RNA, 36 nt, Artificial Sequence
  Synthetic Oligonucleotide; PDCD1LG2 exon 3; Set C
uguaucauuuuccaccuuuugcaaacuggcuguuau

SEQ ID NO: 41044 - RNA, 31 nt, Artificial Sequence
  Synthetic Oligonucleotide; PDCD1LG2 exon 3; Set A
uaucauuuuccaccuuuugcaaacuggcugu

SEQ ID NO: 41045 - RNA, 33 nt, Artificial Sequence
  Synthetic Oligonucleotide; PDCD1LG2 exon 3; Set C
guaucauuuuccaccuuuugcaaacuggcuguu

SEQ ID NO: 41046 - RNA, 29 nt, Artificial Sequence
  Synthetic Oligonucleotide; PDCD1LG2 exon 3; Set A
aucauuuuccaccuuuugcaaacuggcug

SEQ ID NO: 41047 - RNA, 27 nt, Artificial Sequence
  Synthetic Oligonucleotide; PDCD1LG2 exon 3; Set A
ucauuuuccaccuuuugcaaacuggcu

SEQ ID NO: 41048 - RNA, 25 nt, Artificial Sequence
  Synthetic Oligonucleotide; PDCD1LG2 exon 3; Set A
cauuuuccaccuuuugcaaacuggc

SEQ ID NO: 41049 - RNA, 32 nt, Artificial Sequence
  Synthetic Oligonucleotide; PDCD1LG2 exon 3; Set C
guaucauuuuccaccuuuugcaaacuggcugu

SEQ ID NO: 41050 - RNA, 30 nt, Artificial Sequence
  Synthetic Oligonucleotide; PDCD1LG2 exon 3; Set A
uaucauuuuccaccuuuugcaaacuggcug

SEQ ID NO: 41051 - RNA, 28 nt, Artificial Sequence
  Synthetic Oligonucleotide; PDCD1LG2 exon 3; Set A
aucauuuuccaccuuuugcaaacuggcu

SEQ ID NO: 41052 - RNA, 26 nt, Artificial Sequence
  Synthetic Oligonucleotide; PDCD1LG2 exon 3; Set A
ucauuuuccaccuuuugcaaacuggc

SEQ ID NO: 41053 - RNA, 31 nt, Artificial Sequence
  Synthetic Oligonucleotide; PDCD1LG2 exon 3; Set A
guaucauuuuccaccuuuugcaaacuggcug

SEQ ID NO: 41054 - RNA, 29 nt, Artificial Sequence
  Synthetic Oligonucleotide; PDCD1LG2 exon 3; Set A
uaucauuuuccaccuuuugcaaacuggcu

SEQ ID NO: 41055 - RNA, 27 nt, Artificial Sequence
  Synthetic Oligonucleotide; PDCD1LG2 exon 3; Set A
aucauuuuccaccuuuugcaaacuggc

SEQ ID NO: 41056 - RNA, 25 nt, Artificial Sequence
  Synthetic Oligonucleotide; PDCD1LG2 exon 3; Set A
ucauuuuccaccuuuugcaaacugg

SEQ ID NO: 41057 - RNA, 30 nt, Artificial Sequence
  Synthetic Oligonucleotide; PDCD1LG2 exon 3; Set A
guaucauuuuccaccuuuugcaaacuggcu

SEQ ID NO: 41058 - RNA, 28 nt, Artificial Sequence
  Synthetic Oligonucleotide; PDCD1LG2 exon 3; Set A
uaucauuuuccaccuuuugcaaacuggc

SEQ ID NO: 41059 - RNA, 26 nt, Artificial Sequence
  Synthetic Oligonucleotide; PDCD1LG2 exon 3; Set A
aucauuuuccaccuuuugcaaacugg

SEQ ID NO: 41060 - RNA, 29 nt, Artificial Sequence
  Synthetic Oligonucleotide; PDCD1LG2 exon 3; Set A
guaucauuuuccaccuuuugcaaacuggc

SEQ ID NO: 41061 - RNA, 27 nt, Artificial Sequence
  Synthetic Oligonucleotide; PDCD1LG2 exon 3; Set A
uaucauuuuccaccuuuugcaaacugg

SEQ ID NO: 41062 - RNA, 30 nt, Artificial Sequence
  Synthetic Oligonucleotide; PDCD1LG2 exon 3; Set A
uguaucauuuuccaccuuuugcaaacuggc

SEQ ID NO: 41063 - RNA, 28 nt, Artificial Sequence
  Synthetic Oligonucleotide; PDCD1LG2 exon 3; Set A
guaucauuuuccaccuuuugcaaacugg

SEQ ID NO: 41064 - RNA, 26 nt, Artificial Sequence
  Synthetic Oligonucleotide; PDCD1LG2 exon 3; Set C
uaucauuuuccaccuuuugcaaacug

SEQ ID NO: 41065 - RNA, 29 nt, Artificial Sequence
  Synthetic Oligonucleotide; PDCD1LG2 exon 3; Set A
uguaucauuuuccaccuuuugcaaacugg

SEQ ID NO: 41066 - RNA, 27 nt, Artificial Sequence
  Synthetic Oligonucleotide; PDCD1LG2 exon 3; Set A
guaucauuuuccaccuuuugcaaacug

SEQ ID NO: 41067 - RNA, 28 nt, Artificial Sequence
  Synthetic Oligonucleotide; PDCD1LG2 exon 3; Set A
uguaucauuuuccaccuuuugcaaacug

SEQ ID NO: 41068 - RNA, 26 nt, Artificial Sequence
  Synthetic Oligonucleotide; PDCD1LG2 exon 3; Set C
guaucauuuuccaccuuuugcaaacu

SEQ ID NO: 41069 - RNA, 27 nt, Artificial Sequence
  Synthetic Oligonucleotide; PDCD1LG2 exon 3; Set A
uguaucauuuuccaccuuuugcaaacu

SEQ ID NO: 41070 - RNA, 40 nt, Artificial Sequence
  Synthetic Oligonucleotide; PDCD1LG2 exon 3; Set C
guguggggauguaucauuuuccaccuuuugcaaacuggcu

SEQ ID NO: 41071 - RNA, 22 nt, Artificial Sequence
  Synthetic Oligonucleotide; PDCD1LG2 exon 3; Set C
uguaucauuuuccaccuuuugc

SEQ ID NO: 41072 - RNA, 39 nt, Artificial Sequence
  Synthetic Oligonucleotide; PDCD1LG2 exon 3; Set C
guguggggauguaucauuuuccaccuuuugcaaacuggc

SEQ ID NO: 41073 - RNA, 21 nt, Artificial Sequence
  Synthetic Oligonucleotide; PDCD1LG2 exon 3; Set C
uguaucauuuuccaccuuuug

SEQ ID NO: 41074 - RNA, 40 nt, Artificial Sequence
  Synthetic Oligonucleotide; PDCD1LG2 exon 3; Set C
gguguggggauguaucauuuuccaccuuuugcaaacuggc

SEQ ID NO: 41075 - RNA, 38 nt, Artificial Sequence
  Synthetic Oligonucleotide; PDCD1LG2 exon 3; Set C
guguggggauguaucauuuuccaccuuuugcaaacugg

SEQ ID NO: 41076 - RNA, 20 nt, Artificial Sequence
  Synthetic Oligonucleotide; PDCD1LG2 exon 3; Set C
uguaucauuuuccaccuuuu

SEQ ID NO: 41077 - RNA, 39 nt, Artificial Sequence
  Synthetic Oligonucleotide; PDCD1LG2 exon 3; Set C
gguguggggauguaucauuuuccaccuuuugcaaacugg

SEQ ID NO: 41078 - RNA, 37 nt, Artificial Sequence
  Synthetic Oligonucleotide; PDCD1LG2 exon 3; Set C
guguggggauguaucauuuuccaccuuuugcaaacug

SEQ ID NO: 41079 - RNA, 38 nt, Artificial Sequence
  Synthetic Oligonucleotide; PDCD1LG2 exon 3; Set C
gguguggggauguaucauuuuccaccuuuugcaaacug

SEQ ID NO: 41080 - RNA, 36 nt, Artificial Sequence
  Synthetic Oligonucleotide; PDCD1LG2 exon 3; Set C
guguggggauguaucauuuuccaccuuuugcaaacu

SEQ ID NO: 41081 - RNA, 37 nt, Artificial Sequence
  Synthetic Oligonucleotide; PDCD1LG2 exon 3; Set C
gguguggggauguaucauuuuccaccuuuugcaaacu

SEQ ID NO: 41082 - RNA, 31 nt, Artificial Sequence
  Synthetic Oligonucleotide; PDCD1LG2 exon 3; Set C
gguguggggauguaucauuuuccaccuuuug

SEQ ID NO: 41083 - RNA, 38 nt, Artificial Sequence
  Synthetic Oligonucleotide; PDCD1LG2 exon 3; Set C
uuucacgguguggggauguaucauuuuccaccuuuugc

SEQ ID NO: 41084 - RNA, 37 nt, Artificial Sequence
  Synthetic Oligonucleotide; PDCD1LG2 exon 3; Set C
uuucacgguguggggauguaucauuuuccaccuuuug

SEQ ID NO: 41085 - RNA, 36 nt, Artificial Sequence
  Synthetic Oligonucleotide; PDCD1LG2 exon 3; Set C
uuucacgguguggggauguaucauuuuccaccuuuu

SEQ ID NO: 41086 - RNA, 19 nt, Artificial Sequence
  Synthetic Oligonucleotide; PDCD1LG2 exon 3; Set C
guguggggauguaucauuu

SEQ ID NO: 41087 - RNA, 18 nt, Artificial Sequence
  Synthetic Oligonucleotide; PDCD1LG2 exon 3; Set C
guguggggauguaucauu

SEQ ID NO: 41088 - RNA, 17 nt, Artificial Sequence
  Synthetic Oligonucleotide; PDCD1LG2 exon 3; Set C
guguggggauguaucau

SEQ ID NO: 41089 - RNA, 18 nt, Artificial Sequence
  Synthetic Oligonucleotide; PDCD1LG2 exon 3; Set C
gguguggggauguaucau

SEQ ID NO: 41090 - RNA, 16 nt, Artificial Sequence
  Synthetic Oligonucleotide; PDCD1LG2 exon 3; Set C
guguggggauguauca

SEQ ID NO: 41091 - RNA, 17 nt, Artificial Sequence
  Synthetic Oligonucleotide; PDCD1LG2 exon 3; Set C
gguguggggauguauca

SEQ ID NO: 41092 - RNA, 15 nt, Artificial Sequence
  Synthetic Oligonucleotide; PDCD1LG2 exon 3; Set C
guguggggauguauc

SEQ ID NO: 41093 - RNA, 30 nt, Artificial Sequence
  Synthetic Oligonucleotide; PDCD1LG2 exon 3; Set C
cuuucacgguguggggauguaucauuuucc

SEQ ID NO: 41094 - RNA, 16 nt, Artificial Sequence
  Synthetic Oligonucleotide; PDCD1LG2 exon 3; Set C
gguguggggauguauc

SEQ ID NO: 41095 - RNA, 29 nt, Artificial Sequence
  Synthetic Oligonucleotide; PDCD1LG2 exon 3; Set A
cuuucacgguguggggauguaucauuuuc

SEQ ID NO: 41096 - RNA, 31 nt, Artificial Sequence
  Synthetic Oligonucleotide; PDCD1LG2 exon 3; Set C
ucuuucacgguguggggauguaucauuuucc

SEQ ID NO: 41097 - RNA, 15 nt, Artificial Sequence
  Synthetic Oligonucleotide; PDCD1LG2 exon 3; Set C
gguguggggauguau

SEQ ID NO: 41098 - RNA, 28 nt, Artificial Sequence
  Synthetic Oligonucleotide; PDCD1LG2 exon 3; Set A
cuuucacgguguggggauguaucauuuu

SEQ ID NO: 41099 - RNA, 30 nt, Artificial Sequence
  Synthetic Oligonucleotide; PDCD1LG2 exon 3; Set A
ucuuucacgguguggggauguaucauuuuc

SEQ ID NO: 41100 - RNA, 32 nt, Artificial Sequence
  Synthetic Oligonucleotide; PDCD1LG2 exon 3; Set C
cucuuucacgguguggggauguaucauuuucc

SEQ ID NO: 41101 - RNA, 29 nt, Artificial Sequence
  Synthetic Oligonucleotide; PDCD1LG2 exon 3; Set A
ucuuucacgguguggggauguaucauuuu

SEQ ID NO: 41102 - RNA, 31 nt, Artificial Sequence
  Synthetic Oligonucleotide; PDCD1LG2 exon 3; Set C
cucuuucacgguguggggauguaucauuuuc

SEQ ID NO: 41103 - RNA, 33 nt, Artificial Sequence
  Synthetic Oligonucleotide; PDCD1LG2 exon 3; Set C
gcucuuucacgguguggggauguaucauuuucc

SEQ ID NO: 41104 - RNA, 27 nt, Artificial Sequence
  Synthetic Oligonucleotide; PDCD1LG2 exon 3; Set A
cuuucacgguguggggauguaucauuu

SEQ ID NO: 41105 - RNA, 30 nt, Artificial Sequence
  Synthetic Oligonucleotide; PDCD1LG2 exon 3; Set C
cucuuucacgguguggggauguaucauuuu

SEQ ID NO: 41106 - RNA, 32 nt, Artificial Sequence
  Synthetic Oligonucleotide; PDCD1LG2 exon 3; Set C
gcucuuucacgguguggggauguaucauuuuc

SEQ ID NO: 41107 - RNA, 31 nt, Artificial Sequence
  Synthetic Oligonucleotide; PDCD1LG2 exon 3; Set C
gcucuuucacgguguggggauguaucauuuu

SEQ ID NO: 41108 - RNA, 36 nt, Artificial Sequence
  Synthetic Oligonucleotide; PDCD1LG2 exon 3; Set C
guggcucuuucacgguguggggauguaucauuuucc

SEQ ID NO: 41109 - RNA, 22 nt, Artificial Sequence
  Synthetic Oligonucleotide; PDCD1LG2 exon 3; Set A
uuucacgguguggggauguauc

SEQ ID NO: 41110 - RNA, 35 nt, Artificial Sequence
  Synthetic Oligonucleotide; PDCD1LG2 exon 3; Set C
guggcucuuucacgguguggggauguaucauuuuc

SEQ ID NO: 41111 - RNA, 21 nt, Artificial Sequence
  Synthetic Oligonucleotide; PDCD1LG2 exon 3; Set A
uuucacgguguggggauguau

SEQ ID NO: 41112 - RNA, 34 nt, Artificial Sequence
  Synthetic Oligonucleotide; PDCD1LG2 exon 3; Set C
guggcucuuucacgguguggggauguaucauuuu

SEQ ID NO: 41113 - RNA, 20 nt, Artificial Sequence
  Synthetic Oligonucleotide; PDCD1LG2 exon 3; Set A
uuucacgguguggggaugua

SEQ ID NO: 41114 - RNA, 39 nt, Artificial Sequence
  Synthetic Oligonucleotide; PDCD1LG2 exon 3; Set C
aaaguggcucuuucacgguguggggauguaucauuuucc

SEQ ID NO: 41115 - RNA, 20 nt, Artificial Sequence
  Synthetic Oligonucleotide; PDCD1LG2 exon 3; Set A
cuuucacgguguggggaugu

SEQ ID NO: 41116 - RNA, 38 nt, Artificial Sequence
  Synthetic Oligonucleotide; PDCD1LG2 exon 3; Set C
aaaguggcucuuucacgguguggggauguaucauuuuc

SEQ ID NO: 41117 - RNA, 40 nt, Artificial Sequence
  Synthetic Oligonucleotide; PDCD1LG2 exon 3; Set C
caaaguggcucuuucacgguguggggauguaucauuuucc

SEQ ID NO: 41118 - RNA, 21 nt, Artificial Sequence
  Synthetic Oligonucleotide; PDCD1LG2 exon 3; Set A
ucuuucacgguguggggaugu

SEQ ID NO: 41119 - RNA, 37 nt, Artificial Sequence
  Synthetic Oligonucleotide; PDCD1LG2 exon 3; Set C
aaaguggcucuuucacgguguggggauguaucauuuu

SEQ ID NO: 41120 - RNA, 22 nt, Artificial Sequence
  Synthetic Oligonucleotide; PDCD1LG2 exon 3; Set A
cucuuucacgguguggggaugu

SEQ ID NO: 41121 - RNA, 32 nt, Artificial Sequence
  Synthetic Oligonucleotide; PDCD1LG2 exon 3; Set C
aguggcucuuucacgguguggggauguaucau

SEQ ID NO: 41122 - RNA, 31 nt, Artificial Sequence
  Synthetic Oligonucleotide; PDCD1LG2 exon 3; Set C
aguggcucuuucacgguguggggauguauca

SEQ ID NO: 41123 - RNA, 30 nt, Artificial Sequence
  Synthetic Oligonucleotide; PDCD1LG2 exon 3; Set C
aguggcucuuucacgguguggggauguauc

SEQ ID NO: 41124 - RNA, 32 nt, Artificial Sequence
  Synthetic Oligonucleotide; PDCD1LG2 exon 3; Set C
aaguggcucuuucacgguguggggauguauca

SEQ ID NO: 41125 - RNA, 29 nt, Artificial Sequence
  Synthetic Oligonucleotide; PDCD1LG2 exon 3; Set C
aguggcucuuucacgguguggggauguau

SEQ ID NO: 41126 - RNA, 31 nt, Artificial Sequence
  Synthetic Oligonucleotide; PDCD1LG2 exon 3; Set C
aaguggcucuuucacgguguggggauguauc

SEQ ID NO: 41127 - RNA, 26 nt, Artificial Sequence
  Synthetic Oligonucleotide; PDCD1LG2 exon 3; Set C
guggcucuuucacgguguggggaugu

SEQ ID NO: 41128 - RNA, 30 nt, Artificial Sequence
  Synthetic Oligonucleotide; PDCD1LG2 exon 3; Set C
aaguggcucuuucacgguguggggauguau

SEQ ID NO: 41129 - RNA, 28 nt, Artificial Sequence
  Synthetic Oligonucleotide; PDCD1LG2 exon 3; Set C
aguggcucuuucacgguguggggaugua

SEQ ID NO: 41130 - RNA, 29 nt, Artificial Sequence
  Synthetic Oligonucleotide; PDCD1LG2 exon 3; Set C
aaguggcucuuucacgguguggggaugua

SEQ ID NO: 41131 - RNA, 29 nt, Artificial Sequence
  Synthetic Oligonucleotide; PDCD1LG2 exon 3; Set C
aaaguggcucuuucacgguguggggaugu

SEQ ID NO: 41132 - RNA, 27 nt, Artificial Sequence
  Synthetic Oligonucleotide; PDCD1LG2 exon 3; Set C
aaguggcucuuucacgguguggggaug

SEQ ID NO: 41133 - RNA, 17 nt, Artificial Sequence
  Synthetic Oligonucleotide; PDCD1LG2 exon 3; Set C
guggcucuuucacggug

SEQ ID NO: 41134 - RNA, 19 nt, Artificial Sequence
  Synthetic Oligonucleotide; PDCD1LG2 exon 3; Set A
aguggcucuuucacggugu

SEQ ID NO: 41135 - RNA, 16 nt, Artificial Sequence
  Synthetic Oligonucleotide; PDCD1LG2 exon 3; Set C
guggcucuuucacggu

SEQ ID NO: 41136 - RNA, 20 nt, Artificial Sequence
  Synthetic Oligonucleotide; PDCD1LG2 exon 3; Set A
aaguggcucuuucacggugu

SEQ ID NO: 41137 - RNA, 20 nt, Artificial Sequence
  Synthetic Oligonucleotide; PDCD1LG2 exon 3; Set C
aaaguggcucuuucacggug

SEQ ID NO: 41138 - RNA, 19 nt, Artificial Sequence
  Synthetic Oligonucleotide; PDCD1LG2 exon 3; Set C
aaaguggcucuuucacggu

SEQ ID NO: 41139 - RNA, 21 nt, Artificial Sequence
  Synthetic Oligonucleotide; PDCD1LG2 exon 3; Set C
caaaguggcucuuucacggug

SEQ ID NO: 41140 - RNA, 20 nt, Artificial Sequence
  Synthetic Oligonucleotide; PDCD1LG2 exon 3; Set C
caaaguggcucuuucacggu

SEQ ID NO: 41141 - RNA, 22 nt, Artificial Sequence
  Synthetic Oligonucleotide; PDCD1LG2 exon 3; Set A
gcaaaguggcucuuucacggug

SEQ ID NO: 41142 - RNA, 21 nt, Artificial Sequence
  Synthetic Oligonucleotide; PDCD1LG2 exon 3; Set A
gcaaaguggcucuuucacggu

SEQ ID NO: 41143 - RNA, 15 nt, Artificial Sequence
  Synthetic Oligonucleotide; PDCD1LG2 exon 3; Set C
gcaaaguggcucuuu

SEQ ID NO: 41144 - RNA, 34 nt, Artificial Sequence
  Synthetic Oligonucleotide; PDCD1LG2 exon 3; Set C
gcugcuccuccagcaaaguggcucuuucacggug

SEQ ID NO: 41145 - RNA, 33 nt, Artificial Sequence
  Synthetic Oligonucleotide; PDCD1LG2 exon 3; Set C
gcugcuccuccagcaaaguggcucuuucacggu

SEQ ID NO: 41146 - RNA, 35 nt, Artificial Sequence
  Synthetic Oligonucleotide; PDCD1LG2 exon 3; Set C
agcugcuccuccagcaaaguggcucuuucacggug

SEQ ID NO: 41147 - RNA, 34 nt, Artificial Sequence
  Synthetic Oligonucleotide; PDCD1LG2 exon 3; Set C
agcugcuccuccagcaaaguggcucuuucacggu

SEQ ID NO: 41148 - RNA, 25 nt, Artificial Sequence
  Synthetic Oligonucleotide; PDCD1LG2 exon 3; Set A
ugcuccuccagcaaaguggcucuuu

SEQ ID NO: 41149 - RNA, 27 nt, Artificial Sequence
  Synthetic Oligonucleotide; PDCD1LG2 exon 3; Set C
gcugcuccuccagcaaaguggcucuuu

SEQ ID NO: 41150 - RNA, 28 nt, Artificial Sequence
  Synthetic Oligonucleotide; PDCD1LG2 exon 3; Set C
agcugcuccuccagcaaaguggcucuuu

SEQ ID NO: 41151 - RNA, 35 nt, Artificial Sequence
  Synthetic Oligonucleotide; PDCD1LG2 exon 3; Set C
uaggggcagcugcuccuccagcaaaguggcucuuu

SEQ ID NO: 41152 - RNA, 19 nt, Artificial Sequence
  Synthetic Oligonucleotide; PDCD1LG2 exon 3; Set A
gcugcuccuccagcaaagu

SEQ ID NO: 41153 - RNA, 36 nt, Artificial Sequence
  Synthetic Oligonucleotide; PDCD1LG2 exon 3; Set C
cuaggggcagcugcuccuccagcaaaguggcucuuu

SEQ ID NO: 41154 - RNA, 20 nt, Artificial Sequence
  Synthetic Oligonucleotide; PDCD1LG2 exon 3; Set A
agcugcuccuccagcaaagu

SEQ ID NO: 41155 - RNA, 18 nt, Artificial Sequence
  Synthetic Oligonucleotide; PDCD1LG2 exon 3; Set C
gcugcuccuccagcaaag

SEQ ID NO: 41156 - RNA, 37 nt, Artificial Sequence
  Synthetic Oligonucleotide; PDCD1LG2 exon 3; Set C
ccuaggggcagcugcuccuccagcaaaguggcucuuu

SEQ ID NO: 41157 - RNA, 19 nt, Artificial Sequence
  Synthetic Oligonucleotide; PDCD1LG2 exon 3; Set C
agcugcuccuccagcaaag

SEQ ID NO: 41158 - RNA, 38 nt, Artificial Sequence
  Synthetic Oligonucleotide; PDCD1LG2 exon 3; Set C
cccuaggggcagcugcuccuccagcaaaguggcucuuu

SEQ ID NO: 41159 - RNA, 39 nt, Artificial Sequence
  Synthetic Oligonucleotide; PDCD1LG2 exon 3; Set C
ucccuaggggcagcugcuccuccagcaaaguggcucuuu

SEQ ID NO: 41160 - RNA, 27 nt, Artificial Sequence
  Synthetic Oligonucleotide; PDCD1LG2 exon 3; Set C
uaggggcagcugcuccuccagcaaagu

SEQ ID NO: 41161 - RNA, 28 nt, Artificial Sequence
  Synthetic Oligonucleotide; PDCD1LG2 exon 3; Set C
cuaggggcagcugcuccuccagcaaagu

SEQ ID NO: 41162 - RNA, 26 nt, Artificial Sequence
  Synthetic Oligonucleotide; PDCD1LG2 exon 3; Set C
uaggggcagcugcuccuccagcaaag

SEQ ID NO: 41163 - RNA, 29 nt, Artificial Sequence
  Synthetic Oligonucleotide; PDCD1LG2 exon 3; Set C
ccuaggggcagcugcuccuccagcaaagu

SEQ ID NO: 41164 - RNA, 27 nt, Artificial Sequence
  Synthetic Oligonucleotide; PDCD1LG2 exon 3; Set C
cuaggggcagcugcuccuccagcaaag

SEQ ID NO: 41165 - RNA, 30 nt, Artificial Sequence
  Synthetic Oligonucleotide; PDCD1LG2 exon 3; Set C
cccuaggggcagcugcuccuccagcaaagu

SEQ ID NO: 41166 - RNA, 28 nt, Artificial Sequence
  Synthetic Oligonucleotide; PDCD1LG2 exon 3; Set C
ccuaggggcagcugcuccuccagcaaag

SEQ ID NO: 41167 - RNA, 31 nt, Artificial Sequence
  Synthetic Oligonucleotide; PDCD1LG2 exon 3; Set C
ucccuaggggcagcugcuccuccagcaaagu

SEQ ID NO: 41168 - RNA, 29 nt, Artificial Sequence
  Synthetic Oligonucleotide; PDCD1LG2 exon 3; Set C
cccuaggggcagcugcuccuccagcaaag

SEQ ID NO: 41169 - RNA, 32 nt, Artificial Sequence
  Synthetic Oligonucleotide; PDCD1LG2 exon 3; Set C
uucccuaggggcagcugcuccuccagcaaagu

SEQ ID NO: 41170 - RNA, 30 nt, Artificial Sequence
  Synthetic Oligonucleotide; PDCD1LG2 exon 3; Set C
ucccuaggggcagcugcuccuccagcaaag

SEQ ID NO: 41171 - RNA, 31 nt, Artificial Sequence
  Synthetic Oligonucleotide; PDCD1LG2 exon 3; Set C
uucccuaggggcagcugcuccuccagcaaag

SEQ ID NO: 41172 - RNA, 15 nt, Artificial Sequence
  Synthetic Oligonucleotide; PDCD1LG2 exon 3; Set A
ucccuaggggcagcu

SEQ ID NO: 41173 - RNA, 16 nt, Artificial Sequence
  Synthetic Oligonucleotide; PDCD1LG2 exon 3; Set A
uucccuaggggcagcu

SEQ ID NO: 41174 - RNA, 15 nt, Artificial Sequence
  Synthetic Oligonucleotide; PDCD1LG2 exon 3; Set C
uucccuaggggcagc

SEQ ID NO: 41175 - RNA, 31 nt, Artificial Sequence
  Synthetic Oligonucleotide; PDCD1LG2 exon 3; Set C
auguggaacgaggccuucccuaggggcagcu

SEQ ID NO: 41176 - RNA, 32 nt, Artificial Sequence
  Synthetic Oligonucleotide; PDCD1LG2 exon 3; Set C
uauguggaacgaggccuucccuaggggcagcu

SEQ ID NO: 41177 - RNA, 18 nt, Artificial Sequence
  Synthetic Oligonucleotide; PDCD1LG2 exon 3; Set C
cuuggacuugagguaugu

SEQ ID NO: 41178 - RNA, 17 nt, Artificial Sequence
  Synthetic Oligonucleotide; PDCD1LG2 exon 3; Set C
cuuggacuugagguaug

SEQ ID NO: 41179 - RNA, 16 nt, Artificial Sequence
  Synthetic Oligonucleotide; PDCD1LG2 exon 3; Set C
cuuggacuugagguau

SEQ ID NO: 41180 - RNA, 18 nt, Artificial Sequence
  Synthetic Oligonucleotide; PDCD1LG2 exon 3; Set C
acuuggacuugagguaug

SEQ ID NO: 41181 - RNA, 17 nt, Artificial Sequence
  Synthetic Oligonucleotide; PDCD1LG2 exon 3; Set C
acuuggacuugagguau

SEQ ID NO: 41182 - RNA, 19 nt, Artificial Sequence
  Synthetic Oligonucleotide; PDCD1LG2 exon 3; Set C
cacuuggacuugagguaug

SEQ ID NO: 41183 - RNA, 18 nt, Artificial Sequence
  Synthetic Oligonucleotide; PDCD1LG2 exon 3; Set C
cacuuggacuugagguau

SEQ ID NO: 41184 - RNA, 20 nt, Artificial Sequence
  Synthetic Oligonucleotide; PDCD1LG2 exon 3; Set C
ucacuuggacuugagguaug

SEQ ID NO: 41185 - RNA, 22 nt, Artificial Sequence
  Synthetic Oligonucleotide; PDCD1LG2 exon 3; Set A
cucacuuggacuugagguaugu

SEQ ID NO: 41186 - RNA, 19 nt, Artificial Sequence
  Synthetic Oligonucleotide; PDCD1LG2 exon 3; Set C
ucacuuggacuugagguau

SEQ ID NO: 41187 - RNA, 21 nt, Artificial Sequence
  Synthetic Oligonucleotide; PDCD1LG2 exon 3; Set C
cucacuuggacuugagguaug

SEQ ID NO: 41188 - RNA, 20 nt, Artificial Sequence
  Synthetic Oligonucleotide; PDCD1LG2 exon 3; Set C
cucacuuggacuugagguau

SEQ ID NO: 41189 - RNA, 28 nt, Artificial Sequence
  Synthetic Oligonucleotide; PDCD1LG2 exon 3; Set C
uucgucccucacuuggacuugagguaug

SEQ ID NO: 41190 - RNA, 27 nt, Artificial Sequence
  Synthetic Oligonucleotide; PDCD1LG2 exon 3; Set C
uucgucccucacuuggacuugagguau

SEQ ID NO: 41191 - RNA, 33 nt, Artificial Sequence
  Synthetic Oligonucleotide; PDCD1LG2 exon 3; Set C
guccuucgucccucacuuggacuugagguaugu

SEQ ID NO: 41192 - RNA, 32 nt, Artificial Sequence
  Synthetic Oligonucleotide; PDCD1LG2 exon 3; Set C
guccuucgucccucacuuggacuugagguaug

SEQ ID NO: 41193 - RNA, 31 nt, Artificial Sequence
  Synthetic Oligonucleotide; PDCD1LG2 exon 3; Set C
guccuucgucccucacuuggacuugagguau

SEQ ID NO: 41194 - RNA, 32 nt, Artificial Sequence
  Synthetic Oligonucleotide; PDCD1LG2 exon 3; Set C
uguccuucgucccucacuuggacuugagguau

SEQ ID NO: 41195 - RNA, 21 nt, Artificial Sequence
  Synthetic Oligonucleotide; PDCD1LG2 exon 3; Set A
uucgucccucacuuggacuug

SEQ ID NO: 41196 - RNA, 39 nt, Artificial Sequence
  Synthetic Oligonucleotide; PDCD1LG2 exon 3; Set C
gguacuguccuucgucccucacuuggacuugagguaugu

SEQ ID NO: 41197 - RNA, 40 nt, Artificial Sequence
  Synthetic Oligonucleotide; PDCD1LG2 exon 3; Set C
ugguacuguccuucgucccucacuuggacuugagguaugu

SEQ ID NO: 41198 - RNA, 38 nt, Artificial Sequence
  Synthetic Oligonucleotide; PDCD1LG2 exon 3; Set C
gguacuguccuucgucccucacuuggacuugagguaug

SEQ ID NO: 41199 - RNA, 39 nt, Artificial Sequence
  Synthetic Oligonucleotide; PDCD1LG2 exon 3; Set C
ugguacuguccuucgucccucacuuggacuugagguaug

SEQ ID NO: 41200 - RNA, 37 nt, Artificial Sequence
  Synthetic Oligonucleotide; PDCD1LG2 exon 3; Set C
gguacuguccuucgucccucacuuggacuugagguau

SEQ ID NO: 41201 - RNA, 40 nt, Artificial Sequence
  Synthetic Oligonucleotide; PDCD1LG2 exon 3; Set C
uugguacuguccuucgucccucacuuggacuugagguaug

SEQ ID NO: 41202 - RNA, 38 nt, Artificial Sequence
  Synthetic Oligonucleotide; PDCD1LG2 exon 3; Set C
ugguacuguccuucgucccucacuuggacuugagguau

SEQ ID NO: 41203 - RNA, 26 nt, Artificial Sequence
  Synthetic Oligonucleotide; PDCD1LG2 exon 3; Set C
uguccuucgucccucacuuggacuug

SEQ ID NO: 41204 - RNA, 39 nt, Artificial Sequence
  Synthetic Oligonucleotide; PDCD1LG2 exon 3; Set C
uugguacuguccuucgucccucacuuggacuugagguau

SEQ ID NO: 41205 - RNA, 18 nt, Artificial Sequence
  Synthetic Oligonucleotide; PDCD1LG2 exon 3; Set B
guccuucgucccucacuu

SEQ ID NO: 41206 - RNA, 17 nt, Artificial Sequence
  Synthetic Oligonucleotide; PDCD1LG2 exon 3; Set C
guccuucgucccucacu

SEQ ID NO: 41207 - RNA, 33 nt, Artificial Sequence
  Synthetic Oligonucleotide; PDCD1LG2 exon 3; Set C
uugguacuguccuucgucccucacuuggacuug

SEQ ID NO: 41208 - RNA, 16 nt, Artificial Sequence
  Synthetic Oligonucleotide; PDCD1LG2 exon 3; Set C
guccuucgucccucac

SEQ ID NO: 41209 - RNA, 34 nt, Artificial Sequence
  Synthetic Oligonucleotide; PDCD1LG2 exon 3; Set C
auugguacuguccuucgucccucacuuggacuug

SEQ ID NO: 41210 - RNA, 15 nt, Artificial Sequence
  Synthetic Oligonucleotide; PDCD1LG2 exon 3; Set C
guccuucgucccuca

SEQ ID NO: 41211 - RNA, 35 nt, Artificial Sequence
  Synthetic Oligonucleotide; PDCD1LG2 exon 3; Set C
cauugguacuguccuucgucccucacuuggacuug

SEQ ID NO: 41212 - RNA, 16 nt, Artificial Sequence
  Synthetic Oligonucleotide; PDCD1LG2 exon 3; Set C
uguccuucgucccuca

SEQ ID NO: 41213 - RNA, 15 nt, Artificial Sequence
  Synthetic Oligonucleotide; PDCD1LG2 exon 3; Set C
uguccuucgucccuc

SEQ ID NO: 41214 - RNA, 24 nt, Artificial Sequence
  Synthetic Oligonucleotide; PDCD1LG2 exon 3; Set C
gguacuguccuucgucccucacuu

SEQ ID NO: 41215 - RNA, 25 nt, Artificial Sequence
  Synthetic Oligonucleotide; PDCD1LG2 exon 3; Set C
ugguacuguccuucgucccucacuu

SEQ ID NO: 41216 - RNA, 23 nt, Artificial Sequence
  Synthetic Oligonucleotide; PDCD1LG2 exon 3; Set C
gguacuguccuucgucccucacu

SEQ ID NO: 41217 - RNA, 39 nt, Artificial Sequence
  Synthetic Oligonucleotide; PDCD1LG2 exon 3; Set C
uaugcauugguacuguccuucgucccucacuuggacuug

SEQ ID NO: 41218 - RNA, 24 nt, Artificial Sequence
  Synthetic Oligonucleotide; PDCD1LG2 exon 3; Set C
ugguacuguccuucgucccucacu

SEQ ID NO: 41219 - RNA, 22 nt, Artificial Sequence
  Synthetic Oligonucleotide; PDCD1LG2 exon 3; Set B
gguacuguccuucgucccucac

SEQ ID NO: 41220 - RNA, 40 nt, Artificial Sequence
  Synthetic Oligonucleotide; PDCD1LG2 exon 3; Set C
uuaugcauugguacuguccuucgucccucacuuggacuug

SEQ ID NO: 41221 - RNA, 23 nt, Artificial Sequence
  Synthetic Oligonucleotide; PDCD1LG2 exon 3; Set B
ugguacuguccuucgucccucac

SEQ ID NO: 41222 - RNA, 21 nt, Artificial Sequence
  Synthetic Oligonucleotide; PDCD1LG2 exon 3; Set B
gguacuguccuucgucccuca

SEQ ID NO: 41223 - RNA, 24 nt, Artificial Sequence
  Synthetic Oligonucleotide; PDCD1LG2 exon 3; Set C
uugguacuguccuucgucccucac

SEQ ID NO: 41224 - RNA, 22 nt, Artificial Sequence
  Synthetic Oligonucleotide; PDCD1LG2 exon 3; Set B
ugguacuguccuucgucccuca

SEQ ID NO: 41225 - RNA, 20 nt, Artificial Sequence
  Synthetic Oligonucleotide; PDCD1LG2 exon 3; Set B
gguacuguccuucgucccuc

SEQ ID NO: 41226 - RNA, 23 nt, Artificial Sequence
  Synthetic Oligonucleotide; PDCD1LG2 exon 3; Set B
uugguacuguccuucgucccuca

SEQ ID NO: 41227 - RNA, 21 nt, Artificial Sequence
  Synthetic Oligonucleotide; PDCD1LG2 exon 3; Set B
ugguacuguccuucgucccuc

SEQ ID NO: 41228 - RNA, 22 nt, Artificial Sequence
  Synthetic Oligonucleotide; PDCD1LG2 exon 3; Set B
uugguacuguccuucgucccuc

SEQ ID NO: 41229 - RNA, 15 nt, Artificial Sequence
  Synthetic Oligonucleotide; PDCD1LG2 exon 3; Set C
auugguacuguccuu

SEQ ID NO: 41230 - RNA, 16 nt, Artificial Sequence
  Synthetic Oligonucleotide; PDCD1LG2 exon 3; Set C
cauugguacuguccuu

SEQ ID NO: 41231 - RNA, 15 nt, Artificial Sequence
  Synthetic Oligonucleotide; PDCD1LG2 exon 3; Set C
cauugguacuguccu

SEQ ID NO: 41232 - RNA, 20 nt, Artificial Sequence
  Synthetic Oligonucleotide; PDCD1LG2 exon 3; Set C
uaugcauugguacuguccuu

SEQ ID NO: 41233 - RNA, 21 nt, Artificial Sequence
  Synthetic Oligonucleotide; PDCD1LG2 exon 3; Set C
uuaugcauugguacuguccuu

SEQ ID NO: 41234 - RNA, 25 nt, Artificial Sequence
  Synthetic Oligonucleotide; PDCD1LG2 exon 3; Set B
gauuaugcauugguacuguccuucg

SEQ ID NO: 41235 - RNA, 22 nt, Artificial Sequence
  Synthetic Oligonucleotide; PDCD1LG2 exon 3; Set C
auuaugcauugguacuguccuu

SEQ ID NO: 41236 - RNA, 20 nt, Artificial Sequence
  Synthetic Oligonucleotide; PDCD1LG2 exon 3; Set C
uuaugcauugguacuguccu

SEQ ID NO: 41237 - RNA, 26 nt, Artificial Sequence
  Synthetic Oligonucleotide; PDCD1LG2 exon 3; Set B
ugauuaugcauugguacuguccuucg

SEQ ID NO: 41238 - RNA, 17 nt, Artificial Sequence
  Synthetic Oligonucleotide; PDCD1LG2 exon 3; Set C
uaugcauugguacuguc

SEQ ID NO: 41239 - RNA, 23 nt, Artificial Sequence
  Synthetic Oligonucleotide; PDCD1LG2 exon 3; Set B
gauuaugcauugguacuguccuu

SEQ ID NO: 41240 - RNA, 19 nt, Artificial Sequence
  Synthetic Oligonucleotide; PDCD1LG2 exon 3; Set C
uuaugcauugguacugucc

SEQ ID NO: 41241 - RNA, 21 nt, Artificial Sequence
  Synthetic Oligonucleotide; PDCD1LG2 exon 3; Set C
auuaugcauugguacuguccu

SEQ ID NO: 41242 - RNA, 24 nt, Artificial Sequence
  Synthetic Oligonucleotide; PDCD1LG2 exon 3; Set B
ugauuaugcauugguacuguccuu

SEQ ID NO: 41243 - RNA, 22 nt, Artificial Sequence
  Synthetic Oligonucleotide; PDCD1LG2 exon 3; Set C
gauuaugcauugguacuguccu

SEQ ID NO: 41244 - RNA, 20 nt, Artificial Sequence
  Synthetic Oligonucleotide; PDCD1LG2 exon 3; Set C
auuaugcauugguacugucc

SEQ ID NO: 41245 - RNA, 23 nt, Artificial Sequence
  Synthetic Oligonucleotide; PDCD1LG2 exon 3; Set B
ugauuaugcauugguacuguccu

SEQ ID NO: 41246 - RNA, 21 nt, Artificial Sequence
  Synthetic Oligonucleotide; PDCD1LG2 exon 3; Set C
gauuaugcauugguacugucc

SEQ ID NO: 41247 - RNA, 22 nt, Artificial Sequence
  Synthetic Oligonucleotide; PDCD1LG2 exon 3; Set C
ugauuaugcauugguacugucc

SEQ ID NO: 41248 - RNA, 18 nt, Artificial Sequence
  Synthetic Oligonucleotide; PDCD1LG2 exon 3; Set C
gauuaugcauugguacug

SEQ ID NO: 41249 - RNA, 19 nt, Artificial Sequence
  Synthetic Oligonucleotide; PDCD1LG2 exon 3; Set C
ugauuaugcauugguacug

SEQ ID NO: 41250 - RNA, 17 nt, Artificial Sequence
  Synthetic Oligonucleotide; PDCD1LG2 exon 3; Set C
gauuaugcauugguacu

SEQ ID NO: 41251 - RNA, 18 nt, Artificial Sequence
  Synthetic Oligonucleotide; PDCD1LG2 exon 3; Set C
ugauuaugcauugguacu

SEQ ID NO: 41252 - RNA, 15 nt, Artificial Sequence
  Synthetic Oligonucleotide; PDCD1LG2 exon 3; Set C
gauuaugcauuggua

SEQ ID NO: 41253 - RNA, 16 nt, Artificial Sequence
  Synthetic Oligonucleotide; PDCD1LG2 exon 3; Set C
ugauuaugcauuggua

SEQ ID NO: 41254 - RNA, 17 nt, Artificial Sequence
  Synthetic Oligonucleotide; PDCD1LG2 exon 3; Set C
cuuccauggauucuagu

SEQ ID NO: 41255 - RNA, 18 nt, Artificial Sequence
  Synthetic Oligonucleotide; PDCD1LG2 exon 3; Set C
gcuuccauggauucuagu

SEQ ID NO: 41256 - RNA, 16 nt, Artificial Sequence
  Synthetic Oligonucleotide; PDCD1LG2 exon 3; Set C
cuuccauggauucuag

SEQ ID NO: 41257 - RNA, 19 nt, Artificial Sequence
  Synthetic Oligonucleotide; PDCD1LG2 exon 3; Set C
ugcuuccauggauucuagu

SEQ ID NO: 41258 - RNA, 17 nt, Artificial Sequence
  Synthetic Oligonucleotide; PDCD1LG2 exon 3; Set C
gcuuccauggauucuag

SEQ ID NO: 41259 - RNA, 18 nt, Artificial Sequence
  Synthetic Oligonucleotide; PDCD1LG2 exon 3; Set C
ugcuuccauggauucuag

SEQ ID NO: 41260 - RNA, 20 nt, Artificial Sequence
  Synthetic Oligonucleotide; PDCD1LG2 exon 3; Set C
augcuuccauggauucuagu

SEQ ID NO: 41261 - RNA, 19 nt, Artificial Sequence
  Synthetic Oligonucleotide; PDCD1LG2 exon 3; Set C
augcuuccauggauucuag

SEQ ID NO: 41262 - RNA, 28 nt, Artificial Sequence
  Synthetic Oligonucleotide; PDCD1LG2 exon 3; Set B
uuggagagaugcuuccauggauucuagu

SEQ ID NO: 41263 - RNA, 27 nt, Artificial Sequence
  Synthetic Oligonucleotide; PDCD1LG2 exon 3; Set B
uuggagagaugcuuccauggauucuag

SEQ ID NO: 41264 - RNA, 30 nt, Artificial Sequence
  Synthetic Oligonucleotide; PDCD1LG2 exon 3; Set B
uguuggagagaugcuuccauggauucuagu

SEQ ID NO: 41265 - RNA, 29 nt, Artificial Sequence
  Synthetic Oligonucleotide; PDCD1LG2 exon 3; Set B
uguuggagagaugcuuccauggauucuag

SEQ ID NO: 41266 - RNA, 31 nt, Artificial Sequence
  Synthetic Oligonucleotide; PDCD1LG2 exon 3; Set C
cuguuggagagaugcuuccauggauucuagu

SEQ ID NO: 41267 - RNA, 30 nt, Artificial Sequence
  Synthetic Oligonucleotide; PDCD1LG2 exon 3; Set B
cuguuggagagaugcuuccauggauucuag

SEQ ID NO: 41268 - RNA, 32 nt, Artificial Sequence
  Synthetic Oligonucleotide; PDCD1LG2 exon 3; Set C
ucuguuggagagaugcuuccauggauucuagu

SEQ ID NO: 41269 - RNA, 31 nt, Artificial Sequence
  Synthetic Oligonucleotide; PDCD1LG2 exon 3; Set B
ucuguuggagagaugcuuccauggauucuag

SEQ ID NO: 41270 - RNA, 18 nt, Artificial Sequence
  Synthetic Oligonucleotide; PDCD1LG2 exon 3; Set C
ucuguuggagagaugcuu

SEQ ID NO: 41271 - RNA, 17 nt, Artificial Sequence
  Synthetic Oligonucleotide; PDCD1LG2 exon 3; Set C
ucuguuggagagaugcu

SEQ ID NO: 41272 - RNA, 16 nt, Artificial Sequence
  Synthetic Oligonucleotide; PDCD1LG2 exon 3; Set C
ucuguuggagagaugc

SEQ ID NO: 41273 - RNA, 15 nt, Artificial Sequence
  Synthetic Oligonucleotide; PDCD1LG2 exon 3; Set C
ucuguuggagagaug

SEQ ID NO: 41274 - RNA, 19 nt, Artificial Sequence
  Synthetic Oligonucleotide; PDCD1LG2 exon 3; Set C
auuuugucauugucugccu

SEQ ID NO: 41275 - RNA, 20 nt, Artificial Sequence
  Synthetic Oligonucleotide; PDCD1LG2 exon 3; Set C
uauuuugucauugucugccu

SEQ ID NO: 41276 - RNA, 21 nt, Artificial Sequence
  Synthetic Oligonucleotide; PDCD1LG2 exon 3; Set C
auauuuugucauugucugccu

SEQ ID NO: 41277 - RNA, 19 nt, Artificial Sequence
  Synthetic Oligonucleotide; PDCD1LG2 exon 3; Set C
uauuuugucauugucugcc

SEQ ID NO: 41278 - RNA, 18 nt, Artificial Sequence
  Synthetic Oligonucleotide; PDCD1LG2 exon 3; Set C
uauuuugucauugucugc

SEQ ID NO: 41279 - RNA, 22 nt, Artificial Sequence
  Synthetic Oligonucleotide; PDCD1LG2 exon 3; Set C
gauauuuugucauugucugccu

SEQ ID NO: 41280 - RNA, 20 nt, Artificial Sequence
  Synthetic Oligonucleotide; PDCD1LG2 exon 3; Set C
auauuuugucauugucugcc

SEQ ID NO: 41281 - RNA, 19 nt, Artificial Sequence
  Synthetic Oligonucleotide; PDCD1LG2 exon 3; Set C
auauuuugucauugucugc

SEQ ID NO: 41282 - RNA, 21 nt, Artificial Sequence
  Synthetic Oligonucleotide; PDCD1LG2 exon 3; Set C
gauauuuugucauugucugcc

SEQ ID NO: 41283 - RNA, 20 nt, Artificial Sequence
  Synthetic Oligonucleotide; PDCD1LG2 exon 3; Set C
gauauuuugucauugucugc

SEQ ID NO: 41284 - RNA, 39 nt, Artificial Sequence
  Synthetic Oligonucleotide; PDCD1LG2 exon 3; Set C
gugaauaaagcugaaaagaaaacaagauauuuugucauu

SEQ ID NO: 41285 - RNA, 40 nt, Artificial Sequence
  Synthetic Oligonucleotide; PDCD1LG2 exon 3; Set C
ugugaauaaagcugaaaagaaaacaagauauuuugucauu

SEQ ID NO: 41286 - RNA, 34 nt, Artificial Sequence
  Synthetic Oligonucleotide; PDCD1LG2 exon 3; Set C
gugaauaaagcugaaaagaaaacaagauauuuug

SEQ ID NO: 41287 - RNA, 33 nt, Artificial Sequence
  Synthetic Oligonucleotide; PDCD1LG2 exon 3; Set C
gugaauaaagcugaaaagaaaacaagauauuuu

SEQ ID NO: 41288 - RNA, 35 nt, Artificial Sequence
  Synthetic Oligonucleotide; PDCD1LG2 exon 3; Set C
ugugaauaaagcugaaaagaaaacaagauauuuug

SEQ ID NO: 41289 - RNA, 32 nt, Artificial Sequence
  Synthetic Oligonucleotide; PDCD1LG2 exon 3; Set C
gugaauaaagcugaaaagaaaacaagauauuu

SEQ ID NO: 41290 - RNA, 34 nt, Artificial Sequence
  Synthetic Oligonucleotide; PDCD1LG2 exon 3; Set C
ugugaauaaagcugaaaagaaaacaagauauuuu

SEQ ID NO: 41291 - RNA, 31 nt, Artificial Sequence
  Synthetic Oligonucleotide; PDCD1LG2 exon 3; Set C
gugaauaaagcugaaaagaaaacaagauauu

SEQ ID NO: 41292 - RNA, 33 nt, Artificial Sequence
  Synthetic Oligonucleotide; PDCD1LG2 exon 3; Set C
ugugaauaaagcugaaaagaaaacaagauauuu

SEQ ID NO: 41293 - RNA, 30 nt, Artificial Sequence
  Synthetic Oligonucleotide; PDCD1LG2 exon 3; Set C
gugaauaaagcugaaaagaaaacaagauau

SEQ ID NO: 41294 - RNA, 32 nt, Artificial Sequence
  Synthetic Oligonucleotide; PDCD1LG2 exon 3; Set C
ugugaauaaagcugaaaagaaaacaagauauu

SEQ ID NO: 41295 - RNA, 29 nt, Artificial Sequence
  Synthetic Oligonucleotide; PDCD1LG2 exon 3; Set C
gugaauaaagcugaaaagaaaacaagaua

SEQ ID NO: 41296 - RNA, 31 nt, Artificial Sequence
  Synthetic Oligonucleotide; PDCD1LG2 exon 3; Set C
ugugaauaaagcugaaaagaaaacaagauau

SEQ ID NO: 41297 - RNA, 28 nt, Artificial Sequence
  Synthetic Oligonucleotide; PDCD1LG2 exon 3; Set C
gugaauaaagcugaaaagaaaacaagau

SEQ ID NO: 41298 - RNA, 30 nt, Artificial Sequence
  Synthetic Oligonucleotide; PDCD1LG2 exon 3; Set C
ugugaauaaagcugaaaagaaaacaagaua

SEQ ID NO: 41299 - RNA, 29 nt, Artificial Sequence
  Synthetic Oligonucleotide; PDCD1LG2 exon 3; Set C
ugugaauaaagcugaaaagaaaacaagau

SEQ ID NO: 41300 - RNA, 18 nt, Artificial Sequence
  Synthetic Oligonucleotide; PDCD1LG2 exon 3; Set C
uuagggacugucacugug

SEQ ID NO: 41301 - RNA, 19 nt, Artificial Sequence
  Synthetic Oligonucleotide; PDCD1LG2 exon 3; Set C
auuauguacaguuccuuag

SEQ ID NO: 41302 - RNA, 20 nt, Artificial Sequence
  Synthetic Oligonucleotide; PDCD1LG2 exon 3; Set C
uauuauguacaguuccuuag

SEQ ID NO: 41303 - RNA, 19 nt, Artificial Sequence
  Synthetic Oligonucleotide; PDCD1LG2 exon 3; Set C
uauuauguacaguuccuua

SEQ ID NO: 41304 - RNA, 21 nt, Artificial Sequence
  Synthetic Oligonucleotide; PDCD1LG2 exon 3; Set C
cuauuauguacaguuccuuag

SEQ ID NO: 41305 - RNA, 22 nt, Artificial Sequence
  Synthetic Oligonucleotide; PDCD1LG2 exon 3; Set C
ucuauuauguacaguuccuuag

SEQ ID NO: 41306 - RNA, 20 nt, Artificial Sequence
  Synthetic Oligonucleotide; PDCD1LG2 exon 3; Set C
cuauuauguacaguuccuua

SEQ ID NO: 41307 - RNA, 21 nt, Artificial Sequence
  Synthetic Oligonucleotide; PDCD1LG2 exon 3; Set C
ucuauuauguacaguuccuua

SEQ ID NO: 41308 - RNA, 27 nt, Artificial Sequence
  Synthetic Oligonucleotide; PDCD1LG2 exon 3; Set A
caugcucuauuauguacaguuccuuag

SEQ ID NO: 41309 - RNA, 26 nt, Artificial Sequence
  Synthetic Oligonucleotide; PDCD1LG2 exon 3; Set A
caugcucuauuauguacaguuccuua

SEQ ID NO: 41310 - RNA, 28 nt, Artificial Sequence
  Synthetic Oligonucleotide; PDCD1LG2 exon 3; Set A
ccaugcucuauuauguacaguuccuuag

SEQ ID NO: 41311 - RNA, 27 nt, Artificial Sequence
  Synthetic Oligonucleotide; PDCD1LG2 exon 3; Set A
ccaugcucuauuauguacaguuccuua

SEQ ID NO: 41312 - RNA, 33 nt, Artificial Sequence
  Synthetic Oligonucleotide; PDCD1LG2 exon 3; Set C
ugcugccaugcucuauuauguacaguuccuuag

SEQ ID NO: 41313 - RNA, 32 nt, Artificial Sequence
  Synthetic Oligonucleotide; PDCD1LG2 exon 3; Set C
ugcugccaugcucuauuauguacaguuccuua

SEQ ID NO: 41314 - RNA, 33 nt, Artificial Sequence
  Synthetic Oligonucleotide; PDCD1LG2 exon 3; Set C
uugcugccaugcucuauuauguacaguuccuua

SEQ ID NO: 41315 - RNA, 35 nt, Artificial Sequence
  Synthetic Oligonucleotide; PDCD1LG2 exon 3; Set C
auugcugccaugcucuauuauguacaguuccuuag

SEQ ID NO: 41316 - RNA, 34 nt, Artificial Sequence
  Synthetic Oligonucleotide; PDCD1LG2 exon 3; Set C
auugcugccaugcucuauuauguacaguuccuua

SEQ ID NO: 41317 - RNA, 36 nt, Artificial Sequence
  Synthetic Oligonucleotide; PDCD1LG2 exon 3; Set C
cauugcugccaugcucuauuauguacaguuccuuag

SEQ ID NO: 41318 - RNA, 35 nt, Artificial Sequence
  Synthetic Oligonucleotide; PDCD1LG2 exon 3; Set C
cauugcugccaugcucuauuauguacaguuccuua

SEQ ID NO: 41319 - RNA, 37 nt, Artificial Sequence
  Synthetic Oligonucleotide; PDCD1LG2 exon 3; Set C
acauugcugccaugcucuauuauguacaguuccuuag

SEQ ID NO: 41320 - RNA, 36 nt, Artificial Sequence
  Synthetic Oligonucleotide; PDCD1LG2 exon 3; Set C
acauugcugccaugcucuauuauguacaguuccuua

SEQ ID NO: 41321 - RNA, 37 nt, Artificial Sequence
  Synthetic Oligonucleotide; PDCD1LG2 exon 3; Set C
agguucacaugacuuccagugucaaaguugcauucca

SEQ ID NO: 41322 - RNA, 36 nt, Artificial Sequence
  Synthetic Oligonucleotide; PDCD1LG2 exon 3; Set C
agguucacaugacuuccagugucaaaguugcauucc

SEQ ID NO: 41323 - RNA, 20 nt, Artificial Sequence
  Synthetic Oligonucleotide; PDCD1LG2 exon 3; Set C
acaugacuuccagugucaaa

SEQ ID NO: 41324 - RNA, 19 nt, Artificial Sequence
  Synthetic Oligonucleotide; PDCD1LG2 exon 3; Set C
acaugacuuccagugucaa

SEQ ID NO: 41325 - RNA, 18 nt, Artificial Sequence
  Synthetic Oligonucleotide; PDCD1LG2 exon 3; Set C
acaugacuuccaguguca

SEQ ID NO: 41326 - RNA, 17 nt, Artificial Sequence
  Synthetic Oligonucleotide; PDCD1LG2 exon 3; Set C
acaugacuuccaguguc

SEQ ID NO: 41327 - RNA, 16 nt, Artificial Sequence
  Synthetic Oligonucleotide; PDCD1LG2 exon 3; Set C
acaugacuuccagugu

SEQ ID NO: 41328 - RNA, 15 nt, Artificial Sequence
  Synthetic Oligonucleotide; PDCD1LG2 exon 3; Set C
acaugacuuccagug

SEQ ID NO: 41329 - RNA, 26 nt, Artificial Sequence
  Synthetic Oligonucleotide; PDCD1LG2 exon 3; Set A
agguucacaugacuuccagugucaaa

SEQ ID NO: 41330 - RNA, 25 nt, Artificial Sequence
  Synthetic Oligonucleotide; PDCD1LG2 exon 3; Set A
agguucacaugacuuccagugucaa

SEQ ID NO: 41331 - RNA, 24 nt, Artificial Sequence
  Synthetic Oligonucleotide; PDCD1LG2 exon 3; Set A
agguucacaugacuuccaguguca

SEQ ID NO: 41332 - RNA, 23 nt, Artificial Sequence
  Synthetic Oligonucleotide; PDCD1LG2 exon 3; Set A
agguucacaugacuuccaguguc

SEQ ID NO: 41333 - RNA, 22 nt, Artificial Sequence
  Synthetic Oligonucleotide; PDCD1LG2 exon 3; Set A
agguucacaugacuuccagugu

SEQ ID NO: 41334 - RNA, 21 nt, Artificial Sequence
  Synthetic Oligonucleotide; PDCD1LG2 exon 3; Set C
agguucacaugacuuccagug

SEQ ID NO: 41335 - RNA, 20 nt, Artificial Sequence
  Synthetic Oligonucleotide; PDCD1LG2 exon 3; Set C
agguucacaugacuuccagu

SEQ ID NO: 41336 - RNA, 19 nt, Artificial Sequence
  Synthetic Oligonucleotide; PDCD1LG2 exon 3; Set C
agguucacaugacuuccag

SEQ ID NO: 41337 - RNA, 18 nt, Artificial Sequence
  Synthetic Oligonucleotide; PDCD1LG2 exon 3; Set C
agguucacaugacuucca

SEQ ID NO: 41338 - RNA, 17 nt, Artificial Sequence
  Synthetic Oligonucleotide; PDCD1LG2 exon 3; Set C
agguucacaugacuucc

SEQ ID NO: 41339 - RNA, 35 nt, Artificial Sequence
  Synthetic Oligonucleotide; PDCD1LG2 exon 3; Set C
auugcuccaagguucacaugacuuccagugucaaa

SEQ ID NO: 41340 - RNA, 16 nt, Artificial Sequence
  Synthetic Oligonucleotide; PDCD1LG2 exon 3; Set C
agguucacaugacuuc

SEQ ID NO: 41341 - RNA, 36 nt, Artificial Sequence
  Synthetic Oligonucleotide; PDCD1LG2 exon 3; Set C
uauugcuccaagguucacaugacuuccagugucaaa

SEQ ID NO: 41342 - RNA, 34 nt, Artificial Sequence
  Synthetic Oligonucleotide; PDCD1LG2 exon 3; Set C
auugcuccaagguucacaugacuuccagugucaa

SEQ ID NO: 41343 - RNA, 35 nt, Artificial Sequence
  Synthetic Oligonucleotide; PDCD1LG2 exon 3; Set C
uauugcuccaagguucacaugacuuccagugucaa

SEQ ID NO: 41344 - RNA, 33 nt, Artificial Sequence
  Synthetic Oligonucleotide; PDCD1LG2 exon 3; Set C
auugcuccaagguucacaugacuuccaguguca

SEQ ID NO: 41345 - RNA, 34 nt, Artificial Sequence
  Synthetic Oligonucleotide; PDCD1LG2 exon 3; Set C
uauugcuccaagguucacaugacuuccaguguca

SEQ ID NO: 41346 - RNA, 32 nt, Artificial Sequence
  Synthetic Oligonucleotide; PDCD1LG2 exon 3; Set C
auugcuccaagguucacaugacuuccaguguc

SEQ ID NO: 41347 - RNA, 31 nt, Artificial Sequence
  Synthetic Oligonucleotide; PDCD1LG2 exon 3; Set C
auugcuccaagguucacaugacuuccagugu

SEQ ID NO: 41348 - RNA, 33 nt, Artificial Sequence
  Synthetic Oligonucleotide; PDCD1LG2 exon 3; Set C
uauugcuccaagguucacaugacuuccaguguc

SEQ ID NO: 41349 - RNA, 32 nt, Artificial Sequence
  Synthetic Oligonucleotide; PDCD1LG2 exon 3; Set C
uauugcuccaagguucacaugacuuccagugu

SEQ ID NO: 41350 - RNA, 30 nt, Artificial Sequence
  Synthetic Oligonucleotide; PDCD1LG2 exon 3; Set C
auugcuccaagguucacaugacuuccagug

SEQ ID NO: 41351 - RNA, 29 nt, Artificial Sequence
  Synthetic Oligonucleotide; PDCD1LG2 exon 3; Set C
auugcuccaagguucacaugacuuccagu

SEQ ID NO: 41352 - RNA, 31 nt, Artificial Sequence
  Synthetic Oligonucleotide; PDCD1LG2 exon 3; Set C
uauugcuccaagguucacaugacuuccagug

SEQ ID NO: 41353 - RNA, 30 nt, Artificial Sequence
  Synthetic Oligonucleotide; PDCD1LG2 exon 3; Set C
uauugcuccaagguucacaugacuuccagu

SEQ ID NO: 41354 - RNA, 28 nt, Artificial Sequence
  Synthetic Oligonucleotide; PDCD1LG2 exon 3; Set A
auugcuccaagguucacaugacuuccag

SEQ ID NO: 41355 - RNA, 27 nt, Artificial Sequence
  Synthetic Oligonucleotide; PDCD1LG2 exon 3; Set A
auugcuccaagguucacaugacuucca

SEQ ID NO: 41356 - RNA, 29 nt, Artificial Sequence
  Synthetic Oligonucleotide; PDCD1LG2 exon 3; Set A
uauugcuccaagguucacaugacuuccag

SEQ ID NO: 41357 - RNA, 26 nt, Artificial Sequence
  Synthetic Oligonucleotide; PDCD1LG2 exon 3; Set A
auugcuccaagguucacaugacuucc

SEQ ID NO: 41358 - RNA, 28 nt, Artificial Sequence
  Synthetic Oligonucleotide; PDCD1LG2 exon 3; Set A
uauugcuccaagguucacaugacuucca

SEQ ID NO: 41359 - RNA, 25 nt, Artificial Sequence
  Synthetic Oligonucleotide; PDCD1LG2 exon 3; Set A
auugcuccaagguucacaugacuuc

SEQ ID NO: 41360 - RNA, 27 nt, Artificial Sequence
  Synthetic Oligonucleotide; PDCD1LG2 exon 3; Set A
uauugcuccaagguucacaugacuucc

SEQ ID NO: 41361 - RNA, 26 nt, Artificial Sequence
  Synthetic Oligonucleotide; PDCD1LG2 exon 3; Set A
uauugcuccaagguucacaugacuuc

SEQ ID NO: 41362 - RNA, 18 nt, Artificial Sequence
  Synthetic Oligonucleotide; PDCD1LG2 exon 3; Set C
auugcuccaagguucaca

SEQ ID NO: 41363 - RNA, 17 nt, Artificial Sequence
  Synthetic Oligonucleotide; PDCD1LG2 exon 3; Set C
auugcuccaagguucac

SEQ ID NO: 41364 - RNA, 19 nt, Artificial Sequence
  Synthetic Oligonucleotide; PDCD1LG2 exon 3; Set C
uauugcuccaagguucaca

SEQ ID NO: 41365 - RNA, 16 nt, Artificial Sequence
  Synthetic Oligonucleotide; PDCD1LG2 exon 3; Set C
auugcuccaagguuca

SEQ ID NO: 41366 - RNA, 17 nt, Artificial Sequence
  Synthetic Oligonucleotide; PDCD1LG2 exon 3; Set C
uauugcuccaagguuca

SEQ ID NO: 41367 - RNA, 40 nt, Artificial Sequence
  Synthetic Oligonucleotide; PDCD1LG2 exon 3; Set C
ugcaaacuggcuguuauugcuccaagguucacaugacuuc

SEQ ID NO: 41368 - RNA, 15 nt, Artificial Sequence
  Synthetic Oligonucleotide; PDCD1LG2 exon 3; Set C
guuauugcuccaagg

SEQ ID NO: 41369 - RNA, 33 nt, Artificial Sequence
  Synthetic Oligonucleotide; PDCD1LG2 exon 3; Set C
ugcaaacuggcuguuauugcuccaagguucaca

SEQ ID NO: 41370 - RNA, 32 nt, Artificial Sequence
  Synthetic Oligonucleotide; PDCD1LG2 exon 3; Set C
ugcaaacuggcuguuauugcuccaagguucac

SEQ ID NO: 41371 - RNA, 34 nt, Artificial Sequence
  Synthetic Oligonucleotide; PDCD1LG2 exon 3; Set C
uugcaaacuggcuguuauugcuccaagguucaca

SEQ ID NO: 41372 - RNA, 31 nt, Artificial Sequence
  Synthetic Oligonucleotide; PDCD1LG2 exon 3; Set C
ugcaaacuggcuguuauugcuccaagguuca

SEQ ID NO: 41373 - RNA, 35 nt, Artificial Sequence
  Synthetic Oligonucleotide; PDCD1LG2 exon 3; Set C
uuugcaaacuggcuguuauugcuccaagguucaca

SEQ ID NO: 41374 - RNA, 27 nt, Artificial Sequence
  Synthetic Oligonucleotide; PDCD1LG2 exon 3; Set A
ugcaaacuggcuguuauugcuccaagg

SEQ ID NO: 41375 - RNA, 28 nt, Artificial Sequence
  Synthetic Oligonucleotide; PDCD1LG2 exon 3; Set A
uugcaaacuggcuguuauugcuccaagg

SEQ ID NO: 41376 - RNA, 29 nt, Artificial Sequence
  Synthetic Oligonucleotide; PDCD1LG2 exon 3; Set A
uuugcaaacuggcuguuauugcuccaagg

SEQ ID NO: 41377 - RNA, 18 nt, Artificial Sequence
  Synthetic Oligonucleotide; PDCD1LG2 exon 3; Set C
ugcaaacuggcuguuauu

SEQ ID NO: 41378 - RNA, 36 nt, Artificial Sequence
  Synthetic Oligonucleotide; PDCD1LG2 exon 3; Set C
uccaccuuuugcaaacuggcuguuauugcuccaagg

SEQ ID NO: 41379 - RNA, 17 nt, Artificial Sequence
  Synthetic Oligonucleotide; PDCD1LG2 exon 3; Set C
ugcaaacuggcuguuau

SEQ ID NO: 41380 - RNA, 37 nt, Artificial Sequence
  Synthetic Oligonucleotide; PDCD1LG2 exon 3; Set C
uuccaccuuuugcaaacuggcuguuauugcuccaagg

SEQ ID NO: 41381 - RNA, 20 nt, Artificial Sequence
  Synthetic Oligonucleotide; PDCD1LG2 exon 3; Set C
uuugcaaacuggcuguuauu

SEQ ID NO: 41382 - RNA, 38 nt, Artificial Sequence
  Synthetic Oligonucleotide; PDCD1LG2 exon 3; Set C
uuuccaccuuuugcaaacuggcuguuauugcuccaagg

SEQ ID NO: 41383 - RNA, 39 nt, Artificial Sequence
  Synthetic Oligonucleotide; PDCD1LG2 exon 3; Set C
uuuuccaccuuuugcaaacuggcuguuauugcuccaagg

SEQ ID NO: 41384 - RNA, 40 nt, Artificial Sequence
  Synthetic Oligonucleotide; PDCD1LG2 exon 3; Set C
auuuuccaccuuuugcaaacuggcuguuauugcuccaagg

SEQ ID NO: 41385 - RNA, 27 nt, Artificial Sequence
  Synthetic Oligonucleotide; PDCD1LG2 exon 3; Set A
uccaccuuuugcaaacuggcuguuauu

SEQ ID NO: 41386 - RNA, 26 nt, Artificial Sequence
  Synthetic Oligonucleotide; PDCD1LG2 exon 3; Set A
uccaccuuuugcaaacuggcuguuau

SEQ ID NO: 41387 - RNA, 30 nt, Artificial Sequence
  Synthetic Oligonucleotide; PDCD1LG2 exon 3; Set A
uuuuccaccuuuugcaaacuggcuguuauu

SEQ ID NO: 41388 - RNA, 29 nt, Artificial Sequence
  Synthetic Oligonucleotide; PDCD1LG2 exon 3; Set A
uuuuccaccuuuugcaaacuggcuguuau

SEQ ID NO: 41389 - RNA, 31 nt, Artificial Sequence
  Synthetic Oligonucleotide; PDCD1LG2 exon 3; Set A
auuuuccaccuuuugcaaacuggcuguuauu

SEQ ID NO: 41390 - RNA, 30 nt, Artificial Sequence
  Synthetic Oligonucleotide; PDCD1LG2 exon 3; Set A
auuuuccaccuuuugcaaacuggcuguuau

SEQ ID NO: 41391 - RNA, 32 nt, Artificial Sequence
  Synthetic Oligonucleotide; PDCD1LG2 exon 3; Set A
cauuuuccaccuuuugcaaacuggcuguuauu

SEQ ID NO: 41392 - RNA, 31 nt, Artificial Sequence
  Synthetic Oligonucleotide; PDCD1LG2 exon 3; Set A
cauuuuccaccuuuugcaaacuggcuguuau

SEQ ID NO: 41393 - RNA, 33 nt, Artificial Sequence
  Synthetic Oligonucleotide; PDCD1LG2 exon 3; Set A
ucauuuuccaccuuuugcaaacuggcuguuauu

SEQ ID NO: 41394 - RNA, 32 nt, Artificial Sequence
  Synthetic Oligonucleotide; PDCD1LG2 exon 3; Set A
ucauuuuccaccuuuugcaaacuggcuguuau

SEQ ID NO: 41395 - RNA, 34 nt, Artificial Sequence
  Synthetic Oligonucleotide; PDCD1LG2 exon 3; Set A
aucauuuuccaccuuuugcaaacuggcuguuauu

SEQ ID NO: 41396 - RNA, 19 nt, Artificial Sequence
  Synthetic Oligonucleotide; PDCD1LG2 exon 3; Set C
uccaccuuuugcaaacugg

SEQ ID NO: 41397 - RNA, 33 nt, Artificial Sequence
  Synthetic Oligonucleotide; PDCD1LG2 exon 3; Set A
aucauuuuccaccuuuugcaaacuggcuguuau

SEQ ID NO: 41398 - RNA, 35 nt, Artificial Sequence
  Synthetic Oligonucleotide; PDCD1LG2 exon 3; Set A
uaucauuuuccaccuuuugcaaacuggcuguuauu

SEQ ID NO: 41399 - RNA, 18 nt, Artificial Sequence
  Synthetic Oligonucleotide; PDCD1LG2 exon 3; Set C
uccaccuuuugcaaacug

SEQ ID NO: 41400 - RNA, 34 nt, Artificial Sequence
  Synthetic Oligonucleotide; PDCD1LG2 exon 3; Set A
uaucauuuuccaccuuuugcaaacuggcuguuau

SEQ ID NO: 41401 - RNA, 36 nt, Artificial Sequence
  Synthetic Oligonucleotide; PDCD1LG2 exon 3; Set C
guaucauuuuccaccuuuugcaaacuggcuguuauu

SEQ ID NO: 41402 - RNA, 23 nt, Artificial Sequence
  Synthetic Oligonucleotide; PDCD1LG2 exon 3; Set A
uuuuccaccuuuugcaaacuggc

SEQ ID NO: 41403 - RNA, 19 nt, Artificial Sequence
  Synthetic Oligonucleotide; PDCD1LG2 exon 3; Set C
uuccaccuuuugcaaacug

SEQ ID NO: 41404 - RNA, 17 nt, Artificial Sequence
  Synthetic Oligonucleotide; PDCD1LG2 exon 3; Set C
uccaccuuuugcaaacu

SEQ ID NO: 41405 - RNA, 35 nt, Artificial Sequence
  Synthetic Oligonucleotide; PDCD1LG2 exon 3; Set C
guaucauuuuccaccuuuugcaaacuggcuguuau

SEQ ID NO: 41406 - RNA, 22 nt, Artificial Sequence
  Synthetic Oligonucleotide; PDCD1LG2 exon 3; Set C
uuuuccaccuuuugcaaacugg

SEQ ID NO: 41407 - RNA, 18 nt, Artificial Sequence
  Synthetic Oligonucleotide; PDCD1LG2 exon 3; Set C
uuccaccuuuugcaaacu

SEQ ID NO: 41408 - RNA, 38 nt, Artificial Sequence
  Synthetic Oligonucleotide; PDCD1LG2 exon 3; Set C
auguaucauuuuccaccuuuugcaaacuggcuguuauu

SEQ ID NO: 41409 - RNA, 23 nt, Artificial Sequence
  Synthetic Oligonucleotide; PDCD1LG2 exon 3; Set C
auuuuccaccuuuugcaaacugg

SEQ ID NO: 41410 - RNA, 19 nt, Artificial Sequence
  Synthetic Oligonucleotide; PDCD1LG2 exon 3; Set C
uuuccaccuuuugcaaacu

SEQ ID NO: 41411 - RNA, 21 nt, Artificial Sequence
  Synthetic Oligonucleotide; PDCD1LG2 exon 3; Set C
uuuuccaccuuuugcaaacug

SEQ ID NO: 41412 - RNA, 37 nt, Artificial Sequence
  Synthetic Oligonucleotide; PDCD1LG2 exon 3; Set C
auguaucauuuuccaccuuuugcaaacuggcuguuau

SEQ ID NO: 41413 - RNA, 36 nt, Artificial Sequence
  Synthetic Oligonucleotide; PDCD1LG2 exon 3; Set C
auguaucauuuuccaccuuuugcaaacuggcuguua

SEQ ID NO: 41414 - RNA, 24 nt, Artificial Sequence
  Synthetic Oligonucleotide; PDCD1LG2 exon 3; Set C
cauuuuccaccuuuugcaaacugg

SEQ ID NO: 41415 - RNA, 22 nt, Artificial Sequence
  Synthetic Oligonucleotide; PDCD1LG2 exon 3; Set C
auuuuccaccuuuugcaaacug

SEQ ID NO: 41416 - RNA, 20 nt, Artificial Sequence
  Synthetic Oligonucleotide; PDCD1LG2 exon 3; Set C
uuuuccaccuuuugcaaacu

SEQ ID NO: 41417 - RNA, 35 nt, Artificial Sequence
  Synthetic Oligonucleotide; PDCD1LG2 exon 3; Set C
auguaucauuuuccaccuuuugcaaacuggcuguu

SEQ ID NO: 41418 - RNA, 23 nt, Artificial Sequence
  Synthetic Oligonucleotide; PDCD1LG2 exon 3; Set C
cauuuuccaccuuuugcaaacug

SEQ ID NO: 41419 - RNA, 21 nt, Artificial Sequence
  Synthetic Oligonucleotide; PDCD1LG2 exon 3; Set C
auuuuccaccuuuugcaaacu

SEQ ID NO: 41420 - RNA, 34 nt, Artificial Sequence
  Synthetic Oligonucleotide; PDCD1LG2 exon 3; Set C
auguaucauuuuccaccuuuugcaaacuggcugu

SEQ ID NO: 41421 - RNA, 24 nt, Artificial Sequence
  Synthetic Oligonucleotide; PDCD1LG2 exon 3; Set C
ucauuuuccaccuuuugcaaacug

SEQ ID NO: 41422 - RNA, 22 nt, Artificial Sequence
  Synthetic Oligonucleotide; PDCD1LG2 exon 3; Set C
cauuuuccaccuuuugcaaacu

SEQ ID NO: 41423 - RNA, 33 nt, Artificial Sequence
  Synthetic Oligonucleotide; PDCD1LG2 exon 3; Set A
auguaucauuuuccaccuuuugcaaacuggcug

SEQ ID NO: 41424 - RNA, 25 nt, Artificial Sequence
  Synthetic Oligonucleotide; PDCD1LG2 exon 3; Set C
aucauuuuccaccuuuugcaaacug

SEQ ID NO: 41425 - RNA, 23 nt, Artificial Sequence
  Synthetic Oligonucleotide; PDCD1LG2 exon 3; Set C
ucauuuuccaccuuuugcaaacu

SEQ ID NO: 41426 - RNA, 32 nt, Artificial Sequence
  Synthetic Oligonucleotide; PDCD1LG2 exon 3; Set A
auguaucauuuuccaccuuuugcaaacuggcu

SEQ ID NO: 41427 - RNA, 24 nt, Artificial Sequence
  Synthetic Oligonucleotide; PDCD1LG2 exon 3; Set C
aucauuuuccaccuuuugcaaacu

SEQ ID NO: 41428 - RNA, 31 nt, Artificial Sequence
  Synthetic Oligonucleotide; PDCD1LG2 exon 3; Set A
auguaucauuuuccaccuuuugcaaacuggc

SEQ ID NO: 41429 - RNA, 25 nt, Artificial Sequence
  Synthetic Oligonucleotide; PDCD1LG2 exon 3; Set C
uaucauuuuccaccuuuugcaaacu

SEQ ID NO: 41430 - RNA, 30 nt, Artificial Sequence
  Synthetic Oligonucleotide; PDCD1LG2 exon 3; Set A
auguaucauuuuccaccuuuugcaaacugg

SEQ ID NO: 41431 - RNA, 16 nt, Artificial Sequence
  Synthetic Oligonucleotide; PDCD1LG2 exon 3; Set C
auuuuccaccuuuugc

SEQ ID NO: 41432 - RNA, 29 nt, Artificial Sequence
  Synthetic Oligonucleotide; PDCD1LG2 exon 3; Set A
auguaucauuuuccaccuuuugcaaacug

SEQ ID NO: 41433 - RNA, 15 nt, Artificial Sequence
  Synthetic Oligonucleotide; PDCD1LG2 exon 3; Set C
auuuuccaccuuuug

SEQ ID NO: 41434 - RNA, 17 nt, Artificial Sequence
  Synthetic Oligonucleotide; PDCD1LG2 exon 3; Set C
cauuuuccaccuuuugc

SEQ ID NO: 41435 - RNA, 28 nt, Artificial Sequence
  Synthetic Oligonucleotide; PDCD1LG2 exon 3; Set A
auguaucauuuuccaccuuuugcaaacu

SEQ ID NO: 41436 - RNA, 16 nt, Artificial Sequence
  Synthetic Oligonucleotide; PDCD1LG2 exon 3; Set C
cauuuuccaccuuuug

SEQ ID NO: 41437 - RNA, 18 nt, Artificial Sequence
  Synthetic Oligonucleotide; PDCD1LG2 exon 3; Set C
ucauuuuccaccuuuugc

SEQ ID NO: 41438 - RNA, 17 nt, Artificial Sequence
  Synthetic Oligonucleotide; PDCD1LG2 exon 3; Set C
ucauuuuccaccuuuug

SEQ ID NO: 41439 - RNA, 19 nt, Artificial Sequence
  Synthetic Oligonucleotide; PDCD1LG2 exon 3; Set C
aucauuuuccaccuuuugc

SEQ ID NO: 41440 - RNA, 40 nt, Artificial Sequence
  Synthetic Oligonucleotide; PDCD1LG2 exon 3; Set C
uguggggauguaucauuuuccaccuuuugcaaacuggcug

SEQ ID NO: 41441 - RNA, 18 nt, Artificial Sequence
  Synthetic Oligonucleotide; PDCD1LG2 exon 3; Set C
aucauuuuccaccuuuug

SEQ ID NO: 41442 - RNA, 16 nt, Artificial Sequence
  Synthetic Oligonucleotide; PDCD1LG2 exon 3; Set C
ucauuuuccaccuuuu

SEQ ID NO: 41443 - RNA, 20 nt, Artificial Sequence
  Synthetic Oligonucleotide; PDCD1LG2 exon 3; Set C
uaucauuuuccaccuuuugc

SEQ ID NO: 41444 - RNA, 39 nt, Artificial Sequence
  Synthetic Oligonucleotide; PDCD1LG2 exon 3; Set C
uguggggauguaucauuuuccaccuuuugcaaacuggcu

SEQ ID NO: 41445 - RNA, 19 nt, Artificial Sequence
  Synthetic Oligonucleotide; PDCD1LG2 exon 3; Set C
uaucauuuuccaccuuuug

SEQ ID NO: 41446 - RNA, 17 nt, Artificial Sequence
  Synthetic Oligonucleotide; PDCD1LG2 exon 3; Set C
aucauuuuccaccuuuu

SEQ ID NO: 41447 - RNA, 21 nt, Artificial Sequence
  Synthetic Oligonucleotide; PDCD1LG2 exon 3; Set C
guaucauuuuccaccuuuugc

SEQ ID NO: 41448 - RNA, 38 nt, Artificial Sequence
  Synthetic Oligonucleotide; PDCD1LG2 exon 3; Set C
uguggggauguaucauuuuccaccuuuugcaaacuggc

SEQ ID NO: 41449 - RNA, 20 nt, Artificial Sequence
  Synthetic Oligonucleotide; PDCD1LG2 exon 3; Set C
guaucauuuuccaccuuuug

SEQ ID NO: 41450 - RNA, 18 nt, Artificial Sequence
  Synthetic Oligonucleotide; PDCD1LG2 exon 3; Set C
uaucauuuuccaccuuuu

SEQ ID NO: 41451 - RNA, 19 nt, Artificial Sequence
  Synthetic Oligonucleotide; PDCD1LG2 exon 3; Set C
guaucauuuuccaccuuuu

SEQ ID NO: 41452 - RNA, 31 nt, Artificial Sequence
  Synthetic Oligonucleotide; PDCD1LG2 exon 3; Set C
guguggggauguaucauuuuccaccuuuugc

SEQ ID NO: 41453 - RNA, 30 nt, Artificial Sequence
  Synthetic Oligonucleotide; PDCD1LG2 exon 3; Set A
guguggggauguaucauuuuccaccuuuug

SEQ ID NO: 41454 - RNA, 32 nt, Artificial Sequence
  Synthetic Oligonucleotide; PDCD1LG2 exon 3; Set C
gguguggggauguaucauuuuccaccuuuugc

SEQ ID NO: 41455 - RNA, 29 nt, Artificial Sequence
  Synthetic Oligonucleotide; PDCD1LG2 exon 3; Set A
guguggggauguaucauuuuccaccuuuu

SEQ ID NO: 41456 - RNA, 30 nt, Artificial Sequence
  Synthetic Oligonucleotide; PDCD1LG2 exon 3; Set C
gguguggggauguaucauuuuccaccuuuu

SEQ ID NO: 41457 - RNA, 19 nt, Artificial Sequence
  Synthetic Oligonucleotide; PDCD1LG2 exon 3; Set C
uggggauguaucauuuucc

SEQ ID NO: 41458 - RNA, 20 nt, Artificial Sequence
  Synthetic Oligonucleotide; PDCD1LG2 exon 3; Set C
guggggauguaucauuuucc

SEQ ID NO: 41459 - RNA, 18 nt, Artificial Sequence
  Synthetic Oligonucleotide; PDCD1LG2 exon 3; Set C
uggggauguaucauuuuc

SEQ ID NO: 41460 - RNA, 17 nt, Artificial Sequence
  Synthetic Oligonucleotide; PDCD1LG2 exon 3; Set C
uggggauguaucauuuu

SEQ ID NO: 41461 - RNA, 21 nt, Artificial Sequence
  Synthetic Oligonucleotide; PDCD1LG2 exon 3; Set C
uguggggauguaucauuuucc

SEQ ID NO: 41462 - RNA, 19 nt, Artificial Sequence
  Synthetic Oligonucleotide; PDCD1LG2 exon 3; Set C
guggggauguaucauuuuc

SEQ ID NO: 41463 - RNA, 18 nt, Artificial Sequence
  Synthetic Oligonucleotide; PDCD1LG2 exon 3; Set C
guggggauguaucauuuu

SEQ ID NO: 41464 - RNA, 20 nt, Artificial Sequence
  Synthetic Oligonucleotide; PDCD1LG2 exon 3; Set C
uguggggauguaucauuuuc

SEQ ID NO: 41465 - RNA, 38 nt, Artificial Sequence
  Synthetic Oligonucleotide; PDCD1LG2 exon 3; Set C
cuuucacgguguggggauguaucauuuuccaccuuuug

SEQ ID NO: 41466 - RNA, 19 nt, Artificial Sequence
  Synthetic Oligonucleotide; PDCD1LG2 exon 3; Set C
uguggggauguaucauuuu

SEQ ID NO: 41467 - RNA, 17 nt, Artificial Sequence
  Synthetic Oligonucleotide; PDCD1LG2 exon 3; Set C
guggggauguaucauuu

SEQ ID NO: 41468 - RNA, 18 nt, Artificial Sequence
  Synthetic Oligonucleotide; PDCD1LG2 exon 3; Set C
uguggggauguaucauuu

SEQ ID NO: 41469 - RNA, 17 nt, Artificial Sequence
  Synthetic Oligonucleotide; PDCD1LG2 exon 3; Set C
uguggggauguaucauu

SEQ ID NO: 41470 - RNA, 16 nt, Artificial Sequence
  Synthetic Oligonucleotide; PDCD1LG2 exon 3; Set C
uguggggauguaucau

SEQ ID NO: 41471 - RNA, 15 nt, Artificial Sequence
  Synthetic Oligonucleotide; PDCD1LG2 exon 3; Set C
uguggggauguauca

SEQ ID NO: 41472 - RNA, 28 nt, Artificial Sequence
  Synthetic Oligonucleotide; PDCD1LG2 exon 3; Set C
uucacgguguggggauguaucauuuucc

SEQ ID NO: 41473 - RNA, 27 nt, Artificial Sequence
  Synthetic Oligonucleotide; PDCD1LG2 exon 3; Set A
uucacgguguggggauguaucauuuuc

SEQ ID NO: 41474 - RNA, 26 nt, Artificial Sequence
  Synthetic Oligonucleotide; PDCD1LG2 exon 3; Set A
uucacgguguggggauguaucauuuu

SEQ ID NO: 41475 - RNA, 25 nt, Artificial Sequence
  Synthetic Oligonucleotide; PDCD1LG2 exon 3; Set A
uucacgguguggggauguaucauuu

SEQ ID NO: 41476 - RNA, 24 nt, Artificial Sequence
  Synthetic Oligonucleotide; PDCD1LG2 exon 3; Set A
uucacgguguggggauguaucauu

SEQ ID NO: 41477 - RNA, 23 nt, Artificial Sequence
  Synthetic Oligonucleotide; PDCD1LG2 exon 3; Set A
uucacgguguggggauguaucau

SEQ ID NO: 41478 - RNA, 26 nt, Artificial Sequence
  Synthetic Oligonucleotide; PDCD1LG2 exon 3; Set A
cuuucacgguguggggauguaucauu

SEQ ID NO: 41479 - RNA, 28 nt, Artificial Sequence
  Synthetic Oligonucleotide; PDCD1LG2 exon 3; Set A
ucuuucacgguguggggauguaucauuu

SEQ ID NO: 41480 - RNA, 22 nt, Artificial Sequence
  Synthetic Oligonucleotide; PDCD1LG2 exon 3; Set A
uucacgguguggggauguauca

SEQ ID NO: 41481 - RNA, 25 nt, Artificial Sequence
  Synthetic Oligonucleotide; PDCD1LG2 exon 3; Set A
cuuucacgguguggggauguaucau

SEQ ID NO: 41482 - RNA, 27 nt, Artificial Sequence
  Synthetic Oligonucleotide; PDCD1LG2 exon 3; Set A
ucuuucacgguguggggauguaucauu

SEQ ID NO: 41483 - RNA, 29 nt, Artificial Sequence
  Synthetic Oligonucleotide; PDCD1LG2 exon 3; Set C
cucuuucacgguguggggauguaucauuu

SEQ ID NO: 41484 - RNA, 24 nt, Artificial Sequence
  Synthetic Oligonucleotide; PDCD1LG2 exon 3; Set A
cuuucacgguguggggauguauca

SEQ ID NO: 41485 - RNA, 26 nt, Artificial Sequence
  Synthetic Oligonucleotide; PDCD1LG2 exon 3; Set A
ucuuucacgguguggggauguaucau

SEQ ID NO: 41486 - RNA, 28 nt, Artificial Sequence
  Synthetic Oligonucleotide; PDCD1LG2 exon 3; Set C
cucuuucacgguguggggauguaucauu

SEQ ID NO: 41487 - RNA, 30 nt, Artificial Sequence
  Synthetic Oligonucleotide; PDCD1LG2 exon 3; Set C
gcucuuucacgguguggggauguaucauuu

SEQ ID NO: 41488 - RNA, 23 nt, Artificial Sequence
  Synthetic Oligonucleotide; PDCD1LG2 exon 3; Set A
cuuucacgguguggggauguauc

SEQ ID NO: 41489 - RNA, 25 nt, Artificial Sequence
  Synthetic Oligonucleotide; PDCD1LG2 exon 3; Set A
ucuuucacgguguggggauguauca

SEQ ID NO: 41490 - RNA, 27 nt, Artificial Sequence
  Synthetic Oligonucleotide; PDCD1LG2 exon 3; Set A
cucuuucacgguguggggauguaucau

SEQ ID NO: 41491 - RNA, 29 nt, Artificial Sequence
  Synthetic Oligonucleotide; PDCD1LG2 exon 3; Set C
gcucuuucacgguguggggauguaucauu

SEQ ID NO: 41492 - RNA, 18 nt, Artificial Sequence
  Synthetic Oligonucleotide; PDCD1LG2 exon 3; Set A
uucacgguguggggaugu

SEQ ID NO: 41493 - RNA, 22 nt, Artificial Sequence
  Synthetic Oligonucleotide; PDCD1LG2 exon 3; Set A
cuuucacgguguggggauguau

SEQ ID NO: 41494 - RNA, 24 nt, Artificial Sequence
  Synthetic Oligonucleotide; PDCD1LG2 exon 3; Set A
ucuuucacgguguggggauguauc

SEQ ID NO: 41495 - RNA, 26 nt, Artificial Sequence
  Synthetic Oligonucleotide; PDCD1LG2 exon 3; Set C
cucuuucacgguguggggauguauca

SEQ ID NO: 41496 - RNA, 28 nt, Artificial Sequence
  Synthetic Oligonucleotide; PDCD1LG2 exon 3; Set C
gcucuuucacgguguggggauguaucau

SEQ ID NO: 41497 - RNA, 23 nt, Artificial Sequence
  Synthetic Oligonucleotide; PDCD1LG2 exon 3; Set A
ucuuucacgguguggggauguau

SEQ ID NO: 41498 - RNA, 25 nt, Artificial Sequence
  Synthetic Oligonucleotide; PDCD1LG2 exon 3; Set A
cucuuucacgguguggggauguauc

SEQ ID NO: 41499 - RNA, 33 nt, Artificial Sequence
  Synthetic Oligonucleotide; PDCD1LG2 exon 3; Set C
guggcucuuucacgguguggggauguaucauuu

SEQ ID NO: 41500 - RNA, 27 nt, Artificial Sequence
  Synthetic Oligonucleotide; PDCD1LG2 exon 3; Set C
gcucuuucacgguguggggauguauca

SEQ ID NO: 41501 - RNA, 21 nt, Artificial Sequence
  Synthetic Oligonucleotide; PDCD1LG2 exon 3; Set A
cuuucacgguguggggaugua

SEQ ID NO: 41502 - RNA, 24 nt, Artificial Sequence
  Synthetic Oligonucleotide; PDCD1LG2 exon 3; Set A
cucuuucacgguguggggauguau

SEQ ID NO: 41503 - RNA, 32 nt, Artificial Sequence
  Synthetic Oligonucleotide; PDCD1LG2 exon 3; Set C
guggcucuuucacgguguggggauguaucauu

SEQ ID NO: 41504 - RNA, 26 nt, Artificial Sequence
  Synthetic Oligonucleotide; PDCD1LG2 exon 3; Set C
gcucuuucacgguguggggauguauc

SEQ ID NO: 41505 - RNA, 22 nt, Artificial Sequence
  Synthetic Oligonucleotide; PDCD1LG2 exon 3; Set A
ucuuucacgguguggggaugua

SEQ ID NO: 41506 - RNA, 18 nt, Artificial Sequence
  Synthetic Oligonucleotide; PDCD1LG2 exon 3; Set C
uuucacgguguggggaug

SEQ ID NO: 41507 - RNA, 39 nt, Artificial Sequence
  Synthetic Oligonucleotide; PDCD1LG2 exon 3; Set C
caaaguggcucuuucacgguguggggauguaucauuuuc

SEQ ID NO: 41508 - RNA, 31 nt, Artificial Sequence
  Synthetic Oligonucleotide; PDCD1LG2 exon 3; Set C
guggcucuuucacgguguggggauguaucau

SEQ ID NO: 41509 - RNA, 25 nt, Artificial Sequence
  Synthetic Oligonucleotide; PDCD1LG2 exon 3; Set C
gcucuuucacgguguggggauguau

SEQ ID NO: 41510 - RNA, 23 nt, Artificial Sequence
  Synthetic Oligonucleotide; PDCD1LG2 exon 3; Set A
cucuuucacgguguggggaugua

SEQ ID NO: 41511 - RNA, 38 nt, Artificial Sequence
  Synthetic Oligonucleotide; PDCD1LG2 exon 3; Set C
caaaguggcucuuucacgguguggggauguaucauuuu

SEQ ID NO: 41512 - RNA, 40 nt, Artificial Sequence
  Synthetic Oligonucleotide; PDCD1LG2 exon 3; Set C
gcaaaguggcucuuucacgguguggggauguaucauuuuc

SEQ ID NO: 41513 - RNA, 30 nt, Artificial Sequence
  Synthetic Oligonucleotide; PDCD1LG2 exon 3; Set C
guggcucuuucacgguguggggauguauca

SEQ ID NO: 41514 - RNA, 36 nt, Artificial Sequence
  Synthetic Oligonucleotide; PDCD1LG2 exon 3; Set C
aaaguggcucuuucacgguguggggauguaucauuu

SEQ ID NO: 41515 - RNA, 24 nt, Artificial Sequence
  Synthetic Oligonucleotide; PDCD1LG2 exon 3; Set C
gcucuuucacgguguggggaugua

SEQ ID NO: 41516 - RNA, 23 nt, Artificial Sequence
  Synthetic Oligonucleotide; PDCD1LG2 exon 3; Set C
gcucuuucacgguguggggaugu

SEQ ID NO: 41517 - RNA, 39 nt, Artificial Sequence
  Synthetic Oligonucleotide; PDCD1LG2 exon 3; Set C
gcaaaguggcucuuucacgguguggggauguaucauuuu

SEQ ID NO: 41518 - RNA, 29 nt, Artificial Sequence
  Synthetic Oligonucleotide; PDCD1LG2 exon 3; Set C
guggcucuuucacgguguggggauguauc

SEQ ID NO: 41519 - RNA, 35 nt, Artificial Sequence
  Synthetic Oligonucleotide; PDCD1LG2 exon 3; Set C
aaaguggcucuuucacgguguggggauguaucauu

SEQ ID NO: 41520 - RNA, 37 nt, Artificial Sequence
  Synthetic Oligonucleotide; PDCD1LG2 exon 3; Set C
caaaguggcucuuucacgguguggggauguaucauuu

SEQ ID NO: 41521 - RNA, 28 nt, Artificial Sequence
  Synthetic Oligonucleotide; PDCD1LG2 exon 3; Set C
guggcucuuucacgguguggggauguau

SEQ ID NO: 41522 - RNA, 34 nt, Artificial Sequence
  Synthetic Oligonucleotide; PDCD1LG2 exon 3; Set C
aaaguggcucuuucacgguguggggauguaucau

SEQ ID NO: 41523 - RNA, 36 nt, Artificial Sequence
  Synthetic Oligonucleotide; PDCD1LG2 exon 3; Set C
caaaguggcucuuucacgguguggggauguaucauu

SEQ ID NO: 41524 - RNA, 38 nt, Artificial Sequence
  Synthetic Oligonucleotide; PDCD1LG2 exon 3; Set C
gcaaaguggcucuuucacgguguggggauguaucauuu

SEQ ID NO: 41525 - RNA, 33 nt, Artificial Sequence
  Synthetic Oligonucleotide; PDCD1LG2 exon 3; Set C
aaaguggcucuuucacgguguggggauguauca

SEQ ID NO: 41526 - RNA, 35 nt, Artificial Sequence
  Synthetic Oligonucleotide; PDCD1LG2 exon 3; Set C
caaaguggcucuuucacgguguggggauguaucau

SEQ ID NO: 41527 - RNA, 37 nt, Artificial Sequence
  Synthetic Oligonucleotide; PDCD1LG2 exon 3; Set C
gcaaaguggcucuuucacgguguggggauguaucauu

SEQ ID NO: 41528 - RNA, 27 nt, Artificial Sequence
  Synthetic Oligonucleotide; PDCD1LG2 exon 3; Set C
guggcucuuucacgguguggggaugua

SEQ ID NO: 41529 - RNA, 32 nt, Artificial Sequence
  Synthetic Oligonucleotide; PDCD1LG2 exon 3; Set C
aaaguggcucuuucacgguguggggauguauc

SEQ ID NO: 41530 - RNA, 34 nt, Artificial Sequence
  Synthetic Oligonucleotide; PDCD1LG2 exon 3; Set C
caaaguggcucuuucacgguguggggauguauca

SEQ ID NO: 41531 - RNA, 36 nt, Artificial Sequence
  Synthetic Oligonucleotide; PDCD1LG2 exon 3; Set C
gcaaaguggcucuuucacgguguggggauguaucau

SEQ ID NO: 41532 - RNA, 31 nt, Artificial Sequence
  Synthetic Oligonucleotide; PDCD1LG2 exon 3; Set C
aaaguggcucuuucacgguguggggauguau

SEQ ID NO: 41533 - RNA, 33 nt, Artificial Sequence
  Synthetic Oligonucleotide; PDCD1LG2 exon 3; Set C
caaaguggcucuuucacgguguggggauguauc

SEQ ID NO: 41534 - RNA, 35 nt, Artificial Sequence
  Synthetic Oligonucleotide; PDCD1LG2 exon 3; Set C
gcaaaguggcucuuucacgguguggggauguauca

SEQ ID NO: 41535 - RNA, 32 nt, Artificial Sequence
  Synthetic Oligonucleotide; PDCD1LG2 exon 3; Set C
caaaguggcucuuucacgguguggggauguau

SEQ ID NO: 41536 - RNA, 34 nt, Artificial Sequence
  Synthetic Oligonucleotide; PDCD1LG2 exon 3; Set C
gcaaaguggcucuuucacgguguggggauguauc

SEQ ID NO: 41537 - RNA, 30 nt, Artificial Sequence
  Synthetic Oligonucleotide; PDCD1LG2 exon 3; Set C
aaaguggcucuuucacgguguggggaugua

SEQ ID NO: 41538 - RNA, 26 nt, Artificial Sequence
  Synthetic Oligonucleotide; PDCD1LG2 exon 3; Set C
aguggcucuuucacgguguggggaug

SEQ ID NO: 41539 - RNA, 33 nt, Artificial Sequence
  Synthetic Oligonucleotide; PDCD1LG2 exon 3; Set C
gcaaaguggcucuuucacgguguggggauguau

SEQ ID NO: 41540 - RNA, 31 nt, Artificial Sequence
  Synthetic Oligonucleotide; PDCD1LG2 exon 3; Set C
caaaguggcucuuucacgguguggggaugua

SEQ ID NO: 41541 - RNA, 30 nt, Artificial Sequence
  Synthetic Oligonucleotide; PDCD1LG2 exon 3; Set C
caaaguggcucuuucacgguguggggaugu

SEQ ID NO: 41542 - RNA, 32 nt, Artificial Sequence
  Synthetic Oligonucleotide; PDCD1LG2 exon 3; Set C
gcaaaguggcucuuucacgguguggggaugua

SEQ ID NO: 41543 - RNA, 31 nt, Artificial Sequence
  Synthetic Oligonucleotide; PDCD1LG2 exon 3; Set C
gcaaaguggcucuuucacgguguggggaugu

SEQ ID NO: 41544 - RNA, 21 nt, Artificial Sequence
  Synthetic Oligonucleotide; PDCD1LG2 exon 3; Set A
aguggcucuuucacggugugg

SEQ ID NO: 41545 - RNA, 20 nt, Artificial Sequence
  Synthetic Oligonucleotide; PDCD1LG2 exon 3; Set A
aguggcucuuucacggugug

SEQ ID NO: 41546 - RNA, 22 nt, Artificial Sequence
  Synthetic Oligonucleotide; PDCD1LG2 exon 3; Set A
aaguggcucuuucacggugugg

SEQ ID NO: 41547 - RNA, 21 nt, Artificial Sequence
  Synthetic Oligonucleotide; PDCD1LG2 exon 3; Set A
aaguggcucuuucacggugug

SEQ ID NO: 41548 - RNA, 40 nt, Artificial Sequence
  Synthetic Oligonucleotide; PDCD1LG2 exon 3; Set C
gcuccuccagcaaaguggcucuuucacgguguggggaugu

SEQ ID NO: 41549 - RNA, 31 nt, Artificial Sequence
  Synthetic Oligonucleotide; PDCD1LG2 exon 3; Set C
gcuccuccagcaaaguggcucuuucacggug

SEQ ID NO: 41550 - RNA, 30 nt, Artificial Sequence
  Synthetic Oligonucleotide; PDCD1LG2 exon 3; Set C
gcuccuccagcaaaguggcucuuucacggu

SEQ ID NO: 41551 - RNA, 32 nt, Artificial Sequence
  Synthetic Oligonucleotide; PDCD1LG2 exon 3; Set C
ugcuccuccagcaaaguggcucuuucacggug

SEQ ID NO: 41552 - RNA, 31 nt, Artificial Sequence
  Synthetic Oligonucleotide; PDCD1LG2 exon 3; Set C
ugcuccuccagcaaaguggcucuuucacggu

SEQ ID NO: 41553 - RNA, 33 nt, Artificial Sequence
  Synthetic Oligonucleotide; PDCD1LG2 exon 3; Set C
cugcuccuccagcaaaguggcucuuucacggug

SEQ ID NO: 41554 - RNA, 35 nt, Artificial Sequence
  Synthetic Oligonucleotide; PDCD1LG2 exon 3; Set C
gcugcuccuccagcaaaguggcucuuucacggugu

SEQ ID NO: 41555 - RNA, 32 nt, Artificial Sequence
  Synthetic Oligonucleotide; PDCD1LG2 exon 3; Set C
cugcuccuccagcaaaguggcucuuucacggu

SEQ ID NO: 41556 - RNA, 36 nt, Artificial Sequence
  Synthetic Oligonucleotide; PDCD1LG2 exon 3; Set C
agcugcuccuccagcaaaguggcucuuucacggugu

SEQ ID NO: 41557 - RNA, 36 nt, Artificial Sequence
  Synthetic Oligonucleotide; PDCD1LG2 exon 3; Set C
cagcugcuccuccagcaaaguggcucuuucacggug

SEQ ID NO: 41558 - RNA, 35 nt, Artificial Sequence
  Synthetic Oligonucleotide; PDCD1LG2 exon 3; Set C
cagcugcuccuccagcaaaguggcucuuucacggu

SEQ ID NO: 41559 - RNA, 24 nt, Artificial Sequence
  Synthetic Oligonucleotide; PDCD1LG2 exon 3; Set A
gcuccuccagcaaaguggcucuuu

SEQ ID NO: 41560 - RNA, 26 nt, Artificial Sequence
  Synthetic Oligonucleotide; PDCD1LG2 exon 3; Set C
cugcuccuccagcaaaguggcucuuu

SEQ ID NO: 41561 - RNA, 28 nt, Artificial Sequence
  Synthetic Oligonucleotide; PDCD1LG2 exon 3; Set C
gcugcuccuccagcaaaguggcucuuuc

SEQ ID NO: 41562 - RNA, 40 nt, Artificial Sequence
  Synthetic Oligonucleotide; PDCD1LG2 exon 3; Set C
aggggcagcugcuccuccagcaaaguggcucuuucacggu

SEQ ID NO: 41563 - RNA, 26 nt, Artificial Sequence
  Synthetic Oligonucleotide; PDCD1LG2 exon 3; Set C
gcugcuccuccagcaaaguggcucuu

SEQ ID NO: 41564 - RNA, 29 nt, Artificial Sequence
  Synthetic Oligonucleotide; PDCD1LG2 exon 3; Set C
cagcugcuccuccagcaaaguggcucuuu

SEQ ID NO: 41565 - RNA, 27 nt, Artificial Sequence
  Synthetic Oligonucleotide; PDCD1LG2 exon 3; Set C
agcugcuccuccagcaaaguggcucuu

SEQ ID NO: 41566 - RNA, 25 nt, Artificial Sequence
  Synthetic Oligonucleotide; PDCD1LG2 exon 3; Set C
gcugcuccuccagcaaaguggcucu

SEQ ID NO: 41567 - RNA, 26 nt, Artificial Sequence
  Synthetic Oligonucleotide; PDCD1LG2 exon 3; Set C
agcugcuccuccagcaaaguggcucu

SEQ ID NO: 41568 - RNA, 24 nt, Artificial Sequence
  Synthetic Oligonucleotide; PDCD1LG2 exon 3; Set C
gcugcuccuccagcaaaguggcuc

SEQ ID NO: 41569 - RNA, 25 nt, Artificial Sequence
  Synthetic Oligonucleotide; PDCD1LG2 exon 3; Set C
agcugcuccuccagcaaaguggcuc

SEQ ID NO: 41570 - RNA, 23 nt, Artificial Sequence
  Synthetic Oligonucleotide; PDCD1LG2 exon 3; Set C
gcugcuccuccagcaaaguggcu

SEQ ID NO: 41571 - RNA, 16 nt, Artificial Sequence
  Synthetic Oligonucleotide; PDCD1LG2 exon 3; Set C
gcuccuccagcaaagu

SEQ ID NO: 41572 - RNA, 24 nt, Artificial Sequence
  Synthetic Oligonucleotide; PDCD1LG2 exon 3; Set C
agcugcuccuccagcaaaguggcu

SEQ ID NO: 41573 - RNA, 17 nt, Artificial Sequence
  Synthetic Oligonucleotide; PDCD1LG2 exon 3; Set C
ugcuccuccagcaaagu

SEQ ID NO: 41574 - RNA, 15 nt, Artificial Sequence
  Synthetic Oligonucleotide; PDCD1LG2 exon 3; Set C
gcuccuccagcaaag

SEQ ID NO: 41575 - RNA, 34 nt, Artificial Sequence
  Synthetic Oligonucleotide; PDCD1LG2 exon 3; Set C
aggggcagcugcuccuccagcaaaguggcucuuu

SEQ ID NO: 41576 - RNA, 18 nt, Artificial Sequence
  Synthetic Oligonucleotide; PDCD1LG2 exon 3; Set C
cugcuccuccagcaaagu

SEQ ID NO: 41577 - RNA, 16 nt, Artificial Sequence
  Synthetic Oligonucleotide; PDCD1LG2 exon 3; Set C
ugcuccuccagcaaag

SEQ ID NO: 41578 - RNA, 20 nt, Artificial Sequence
  Synthetic Oligonucleotide; PDCD1LG2 exon 3; Set A
gcugcuccuccagcaaagug

SEQ ID NO: 41579 - RNA, 17 nt, Artificial Sequence
  Synthetic Oligonucleotide; PDCD1LG2 exon 3; Set C
cugcuccuccagcaaag

SEQ ID NO: 41580 - RNA, 21 nt, Artificial Sequence
  Synthetic Oligonucleotide; PDCD1LG2 exon 3; Set A
agcugcuccuccagcaaagug

SEQ ID NO: 41581 - RNA, 34 nt, Artificial Sequence
  Synthetic Oligonucleotide; PDCD1LG2 exon 3; Set C
uaggggcagcugcuccuccagcaaaguggcucuu

SEQ ID NO: 41582 - RNA, 21 nt, Artificial Sequence
  Synthetic Oligonucleotide; PDCD1LG2 exon 3; Set A
cagcugcuccuccagcaaagu

SEQ ID NO: 41583 - RNA, 35 nt, Artificial Sequence
  Synthetic Oligonucleotide; PDCD1LG2 exon 3; Set C
cuaggggcagcugcuccuccagcaaaguggcucuu

SEQ ID NO: 41584 - RNA, 33 nt, Artificial Sequence
  Synthetic Oligonucleotide; PDCD1LG2 exon 3; Set C
uaggggcagcugcuccuccagcaaaguggcucu

SEQ ID NO: 41585 - RNA, 17 nt, Artificial Sequence
  Synthetic Oligonucleotide; PDCD1LG2 exon 3; Set C
gcugcuccuccagcaaa

SEQ ID NO: 41586 - RNA, 20 nt, Artificial Sequence
  Synthetic Oligonucleotide; PDCD1LG2 exon 3; Set A
cagcugcuccuccagcaaag

SEQ ID NO: 41587 - RNA, 36 nt, Artificial Sequence
  Synthetic Oligonucleotide; PDCD1LG2 exon 3; Set C
ccuaggggcagcugcuccuccagcaaaguggcucuu

SEQ ID NO: 41588 - RNA, 34 nt, Artificial Sequence
  Synthetic Oligonucleotide; PDCD1LG2 exon 3; Set C
cuaggggcagcugcuccuccagcaaaguggcucu

SEQ ID NO: 41589 - RNA, 32 nt, Artificial Sequence
  Synthetic Oligonucleotide; PDCD1LG2 exon 3; Set C
uaggggcagcugcuccuccagcaaaguggcuc

SEQ ID NO: 41590 - RNA, 18 nt, Artificial Sequence
  Synthetic Oligonucleotide; PDCD1LG2 exon 3; Set C
agcugcuccuccagcaaa

SEQ ID NO: 41591 - RNA, 37 nt, Artificial Sequence
  Synthetic Oligonucleotide; PDCD1LG2 exon 3; Set C
cccuaggggcagcugcuccuccagcaaaguggcucuu

SEQ ID NO: 41592 - RNA, 35 nt, Artificial Sequence
  Synthetic Oligonucleotide; PDCD1LG2 exon 3; Set C
ccuaggggcagcugcuccuccagcaaaguggcucu

SEQ ID NO: 41593 - RNA, 33 nt, Artificial Sequence
  Synthetic Oligonucleotide; PDCD1LG2 exon 3; Set C
cuaggggcagcugcuccuccagcaaaguggcuc

SEQ ID NO: 41594 - RNA, 38 nt, Artificial Sequence
  Synthetic Oligonucleotide; PDCD1LG2 exon 3; Set C
ucccuaggggcagcugcuccuccagcaaaguggcucuu

SEQ ID NO: 41595 - RNA, 36 nt, Artificial Sequence
  Synthetic Oligonucleotide; PDCD1LG2 exon 3; Set C
cccuaggggcagcugcuccuccagcaaaguggcucu

SEQ ID NO: 41596 - RNA, 34 nt, Artificial Sequence
  Synthetic Oligonucleotide; PDCD1LG2 exon 3; Set C
ccuaggggcagcugcuccuccagcaaaguggcuc

SEQ ID NO: 41597 - RNA, 39 nt, Artificial Sequence
  Synthetic Oligonucleotide; PDCD1LG2 exon 3; Set C
uucccuaggggcagcugcuccuccagcaaaguggcucuu

SEQ ID NO: 41598 - RNA, 37 nt, Artificial Sequence
  Synthetic Oligonucleotide; PDCD1LG2 exon 3; Set C
ucccuaggggcagcugcuccuccagcaaaguggcucu

SEQ ID NO: 41599 - RNA, 35 nt, Artificial Sequence
  Synthetic Oligonucleotide; PDCD1LG2 exon 3; Set C
cccuaggggcagcugcuccuccagcaaaguggcuc

SEQ ID NO: 41600 - RNA, 38 nt, Artificial Sequence
  Synthetic Oligonucleotide; PDCD1LG2 exon 3; Set C
uucccuaggggcagcugcuccuccagcaaaguggcucu

SEQ ID NO: 41601 - RNA, 36 nt, Artificial Sequence
  Synthetic Oligonucleotide; PDCD1LG2 exon 3; Set C
ucccuaggggcagcugcuccuccagcaaaguggcuc

SEQ ID NO: 41602 - RNA, 37 nt, Artificial Sequence
  Synthetic Oligonucleotide; PDCD1LG2 exon 3; Set C
uucccuaggggcagcugcuccuccagcaaaguggcuc

SEQ ID NO: 41603 - RNA, 30 nt, Artificial Sequence
  Synthetic Oligonucleotide; PDCD1LG2 exon 3; Set C
ccuaggggcagcugcuccuccagcaaagug

SEQ ID NO: 41604 - RNA, 36 nt, Artificial Sequence
  Synthetic Oligonucleotide; PDCD1LG2 exon 3; Set C
uucccuaggggcagcugcuccuccagcaaaguggcu

SEQ ID NO: 41605 - RNA, 31 nt, Artificial Sequence
  Synthetic Oligonucleotide; PDCD1LG2 exon 3; Set C
cccuaggggcagcugcuccuccagcaaagug

SEQ ID NO: 41606 - RNA, 32 nt, Artificial Sequence
  Synthetic Oligonucleotide; PDCD1LG2 exon 3; Set C
ucccuaggggcagcugcuccuccagcaaagug

SEQ ID NO: 41607 - RNA, 33 nt, Artificial Sequence
  Synthetic Oligonucleotide; PDCD1LG2 exon 3; Set C
uucccuaggggcagcugcuccuccagcaaagug

SEQ ID NO: 41608 - RNA, 30 nt, Artificial Sequence
  Synthetic Oligonucleotide; PDCD1LG2 exon 3; Set C
uucccuaggggcagcugcuccuccagcaaa

SEQ ID NO: 41609 - RNA, 16 nt, Artificial Sequence
  Synthetic Oligonucleotide; PDCD1LG2 exon 3; Set A
ccuaggggcagcugcu

SEQ ID NO: 41610 - RNA, 15 nt, Artificial Sequence
  Synthetic Oligonucleotide; PDCD1LG2 exon 3; Set A
ccuaggggcagcugc

SEQ ID NO: 41611 - RNA, 17 nt, Artificial Sequence
  Synthetic Oligonucleotide; PDCD1LG2 exon 3; Set A
cccuaggggcagcugcu

SEQ ID NO: 41612 - RNA, 16 nt, Artificial Sequence
  Synthetic Oligonucleotide; PDCD1LG2 exon 3; Set A
cccuaggggcagcugc

SEQ ID NO: 41613 - RNA, 18 nt, Artificial Sequence
  Synthetic Oligonucleotide; PDCD1LG2 exon 3; Set A
ucccuaggggcagcugcu

SEQ ID NO: 41614 - RNA, 17 nt, Artificial Sequence
  Synthetic Oligonucleotide; PDCD1LG2 exon 3; Set A
ucccuaggggcagcugc

SEQ ID NO: 41615 - RNA, 19 nt, Artificial Sequence
  Synthetic Oligonucleotide; PDCD1LG2 exon 3; Set A
uucccuaggggcagcugcu

SEQ ID NO: 41616 - RNA, 18 nt, Artificial Sequence
  Synthetic Oligonucleotide; PDCD1LG2 exon 3; Set A
uucccuaggggcagcugc

SEQ ID NO: 41617 - RNA, 16 nt, Artificial Sequence
  Synthetic Oligonucleotide; PDCD1LG2 exon 3; Set A
ucccuaggggcagcug

SEQ ID NO: 41618 - RNA, 17 nt, Artificial Sequence
  Synthetic Oligonucleotide; PDCD1LG2 exon 3; Set A
uucccuaggggcagcug

SEQ ID NO: 41619 - RNA, 33 nt, Artificial Sequence
  Synthetic Oligonucleotide; PDCD1LG2 exon 3; Set C
uguggaacgaggccuucccuaggggcagcugcu

SEQ ID NO: 41620 - RNA, 32 nt, Artificial Sequence
  Synthetic Oligonucleotide; PDCD1LG2 exon 3; Set C
uguggaacgaggccuucccuaggggcagcugc

SEQ ID NO: 41621 - RNA, 34 nt, Artificial Sequence
  Synthetic Oligonucleotide; PDCD1LG2 exon 3; Set C
auguggaacgaggccuucccuaggggcagcugcu

SEQ ID NO: 41622 - RNA, 33 nt, Artificial Sequence
  Synthetic Oligonucleotide; PDCD1LG2 exon 3; Set C
auguggaacgaggccuucccuaggggcagcugc

SEQ ID NO: 41623 - RNA, 35 nt, Artificial Sequence
  Synthetic Oligonucleotide; PDCD1LG2 exon 3; Set C
uauguggaacgaggccuucccuaggggcagcugcu

SEQ ID NO: 41624 - RNA, 30 nt, Artificial Sequence
  Synthetic Oligonucleotide; PDCD1LG2 exon 3; Set C
uguggaacgaggccuucccuaggggcagcu

SEQ ID NO: 41625 - RNA, 34 nt, Artificial Sequence
  Synthetic Oligonucleotide; PDCD1LG2 exon 3; Set C
uauguggaacgaggccuucccuaggggcagcugc

SEQ ID NO: 41626 - RNA, 32 nt, Artificial Sequence
  Synthetic Oligonucleotide; PDCD1LG2 exon 3; Set C
auguggaacgaggccuucccuaggggcagcug

SEQ ID NO: 41627 - RNA, 29 nt, Artificial Sequence
  Synthetic Oligonucleotide; PDCD1LG2 exon 3; Set C
uguggaacgaggccuucccuaggggcagc

SEQ ID NO: 41628 - RNA, 33 nt, Artificial Sequence
  Synthetic Oligonucleotide; PDCD1LG2 exon 3; Set C
uauguggaacgaggccuucccuaggggcagcug

SEQ ID NO: 41629 - RNA, 30 nt, Artificial Sequence
  Synthetic Oligonucleotide; PDCD1LG2 exon 3; Set C
auguggaacgaggccuucccuaggggcagc

SEQ ID NO: 41630 - RNA, 31 nt, Artificial Sequence
  Synthetic Oligonucleotide; PDCD1LG2 exon 3; Set C
uauguggaacgaggccuucccuaggggcagc

SEQ ID NO: 41631 - RNA, 38 nt, Artificial Sequence
  Synthetic Oligonucleotide; PDCD1LG2 exon 3; Set C
uugagguauguggaacgaggccuucccuaggggcagcu

SEQ ID NO: 41632 - RNA, 22 nt, Artificial Sequence
  Synthetic Oligonucleotide; PDCD1LG2 exon 3; Set A
uguggaacgaggccuucccuag

SEQ ID NO: 41633 - RNA, 23 nt, Artificial Sequence
  Synthetic Oligonucleotide; PDCD1LG2 exon 3; Set A
auguggaacgaggccuucccuag

SEQ ID NO: 41634 - RNA, 21 nt, Artificial Sequence
  Synthetic Oligonucleotide; PDCD1LG2 exon 3; Set A
uguggaacgaggccuucccua

SEQ ID NO: 41635 - RNA, 20 nt, Artificial Sequence
  Synthetic Oligonucleotide; PDCD1LG2 exon 3; Set A
uguggaacgaggccuucccu

SEQ ID NO: 41636 - RNA, 24 nt, Artificial Sequence
  Synthetic Oligonucleotide; PDCD1LG2 exon 3; Set A
uauguggaacgaggccuucccuag

SEQ ID NO: 41637 - RNA, 22 nt, Artificial Sequence
  Synthetic Oligonucleotide; PDCD1LG2 exon 3; Set A
auguggaacgaggccuucccua

SEQ ID NO: 41638 - RNA, 21 nt, Artificial Sequence
  Synthetic Oligonucleotide; PDCD1LG2 exon 3; Set A
auguggaacgaggccuucccu

SEQ ID NO: 41639 - RNA, 19 nt, Artificial Sequence
  Synthetic Oligonucleotide; PDCD1LG2 exon 3; Set A
uguggaacgaggccuuccc

SEQ ID NO: 41640 - RNA, 23 nt, Artificial Sequence
  Synthetic Oligonucleotide; PDCD1LG2 exon 3; Set A
uauguggaacgaggccuucccua

SEQ ID NO: 41641 - RNA, 22 nt, Artificial Sequence
  Synthetic Oligonucleotide; PDCD1LG2 exon 3; Set A
uauguggaacgaggccuucccu

SEQ ID NO: 41642 - RNA, 20 nt, Artificial Sequence
  Synthetic Oligonucleotide; PDCD1LG2 exon 3; Set A
auguggaacgaggccuuccc

SEQ ID NO: 41643 - RNA, 17 nt, Artificial Sequence
  Synthetic Oligonucleotide; PDCD1LG2 exon 3; Set C
uguggaacgaggccuuc

SEQ ID NO: 41644 - RNA, 21 nt, Artificial Sequence
  Synthetic Oligonucleotide; PDCD1LG2 exon 3; Set A
uauguggaacgaggccuuccc

SEQ ID NO: 41645 - RNA, 19 nt, Artificial Sequence
  Synthetic Oligonucleotide; PDCD1LG2 exon 3; Set A
auguggaacgaggccuucc

SEQ ID NO: 41646 - RNA, 18 nt, Artificial Sequence
  Synthetic Oligonucleotide; PDCD1LG2 exon 3; Set C
auguggaacgaggccuuc

SEQ ID NO: 41647 - RNA, 20 nt, Artificial Sequence
  Synthetic Oligonucleotide; PDCD1LG2 exon 3; Set A
uauguggaacgaggccuucc

SEQ ID NO: 41648 - RNA, 19 nt, Artificial Sequence
  Synthetic Oligonucleotide; PDCD1LG2 exon 3; Set C
uauguggaacgaggccuuc

SEQ ID NO: 41649 - RNA, 37 nt, Artificial Sequence
  Synthetic Oligonucleotide; PDCD1LG2 exon 3; Set C
cuuggacuugagguauguggaacgaggccuucccuag

SEQ ID NO: 41650 - RNA, 38 nt, Artificial Sequence
  Synthetic Oligonucleotide; PDCD1LG2 exon 3; Set C
acuuggacuugagguauguggaacgaggccuucccuag

SEQ ID NO: 41651 - RNA, 36 nt, Artificial Sequence
  Synthetic Oligonucleotide; PDCD1LG2 exon 3; Set C
cuuggacuugagguauguggaacgaggccuucccua

SEQ ID NO: 41652 - RNA, 35 nt, Artificial Sequence
  Synthetic Oligonucleotide; PDCD1LG2 exon 3; Set C
cuuggacuugagguauguggaacgaggccuucccu

SEQ ID NO: 41653 - RNA, 39 nt, Artificial Sequence
  Synthetic Oligonucleotide; PDCD1LG2 exon 3; Set C
cacuuggacuugagguauguggaacgaggccuucccuag

SEQ ID NO: 41654 - RNA, 37 nt, Artificial Sequence
  Synthetic Oligonucleotide; PDCD1LG2 exon 3; Set C
acuuggacuugagguauguggaacgaggccuucccua

SEQ ID NO: 41655 - RNA, 36 nt, Artificial Sequence
  Synthetic Oligonucleotide; PDCD1LG2 exon 3; Set C
acuuggacuugagguauguggaacgaggccuucccu

SEQ ID NO: 41656 - RNA, 34 nt, Artificial Sequence
  Synthetic Oligonucleotide; PDCD1LG2 exon 3; Set C
cuuggacuugagguauguggaacgaggccuuccc

SEQ ID NO: 41657 - RNA, 40 nt, Artificial Sequence
  Synthetic Oligonucleotide; PDCD1LG2 exon 3; Set C
ucacuuggacuugagguauguggaacgaggccuucccuag

SEQ ID NO: 41658 - RNA, 38 nt, Artificial Sequence
  Synthetic Oligonucleotide; PDCD1LG2 exon 3; Set C
cacuuggacuugagguauguggaacgaggccuucccua

SEQ ID NO: 41659 - RNA, 37 nt, Artificial Sequence
  Synthetic Oligonucleotide; PDCD1LG2 exon 3; Set C
cacuuggacuugagguauguggaacgaggccuucccu

SEQ ID NO: 41660 - RNA, 33 nt, Artificial Sequence
  Synthetic Oligonucleotide; PDCD1LG2 exon 3; Set C
cuuggacuugagguauguggaacgaggccuucc

SEQ ID NO: 41661 - RNA, 35 nt, Artificial Sequence
  Synthetic Oligonucleotide; PDCD1LG2 exon 3; Set C
acuuggacuugagguauguggaacgaggccuuccc

SEQ ID NO: 41662 - RNA, 39 nt, Artificial Sequence
  Synthetic Oligonucleotide; PDCD1LG2 exon 3; Set C
ucacuuggacuugagguauguggaacgaggccuucccua

SEQ ID NO: 41663 - RNA, 32 nt, Artificial Sequence
  Synthetic Oligonucleotide; PDCD1LG2 exon 3; Set C
cuuggacuugagguauguggaacgaggccuuc

SEQ ID NO: 41664 - RNA, 38 nt, Artificial Sequence
  Synthetic Oligonucleotide; PDCD1LG2 exon 3; Set C
ucacuuggacuugagguauguggaacgaggccuucccu

SEQ ID NO: 41665 - RNA, 34 nt, Artificial Sequence
  Synthetic Oligonucleotide; PDCD1LG2 exon 3; Set C
acuuggacuugagguauguggaacgaggccuucc

SEQ ID NO: 41666 - RNA, 36 nt, Artificial Sequence
  Synthetic Oligonucleotide; PDCD1LG2 exon 3; Set C
cacuuggacuugagguauguggaacgaggccuuccc

SEQ ID NO: 41667 - RNA, 33 nt, Artificial Sequence
  Synthetic Oligonucleotide; PDCD1LG2 exon 3; Set C
acuuggacuugagguauguggaacgaggccuuc

SEQ ID NO: 41668 - RNA, 39 nt, Artificial Sequence
  Synthetic Oligonucleotide; PDCD1LG2 exon 3; Set C
cucacuuggacuugagguauguggaacgaggccuucccu

SEQ ID NO: 41669 - RNA, 35 nt, Artificial Sequence
  Synthetic Oligonucleotide; PDCD1LG2 exon 3; Set C
cacuuggacuugagguauguggaacgaggccuucc

SEQ ID NO: 41670 - RNA, 37 nt, Artificial Sequence
  Synthetic Oligonucleotide; PDCD1LG2 exon 3; Set C
ucacuuggacuugagguauguggaacgaggccuuccc

SEQ ID NO: 41671 - RNA, 34 nt, Artificial Sequence
  Synthetic Oligonucleotide; PDCD1LG2 exon 3; Set C
cacuuggacuugagguauguggaacgaggccuuc

SEQ ID NO: 41672 - RNA, 36 nt, Artificial Sequence
  Synthetic Oligonucleotide; PDCD1LG2 exon 3; Set C
ucacuuggacuugagguauguggaacgaggccuucc

SEQ ID NO: 41673 - RNA, 35 nt, Artificial Sequence
  Synthetic Oligonucleotide; PDCD1LG2 exon 3; Set C
ucacuuggacuugagguauguggaacgaggccuuc

SEQ ID NO: 41674 - RNA, 36 nt, Artificial Sequence
  Synthetic Oligonucleotide; PDCD1LG2 exon 3; Set C
cucacuuggacuugagguauguggaacgaggccuuc

SEQ ID NO: 41675 - RNA, 28 nt, Artificial Sequence
  Synthetic Oligonucleotide; PDCD1LG2 exon 3; Set C
ucgucccucacuuggacuugagguaugu

SEQ ID NO: 41676 - RNA, 27 nt, Artificial Sequence
  Synthetic Oligonucleotide; PDCD1LG2 exon 3; Set C
ucgucccucacuuggacuugagguaug

SEQ ID NO: 41677 - RNA, 30 nt, Artificial Sequence
  Synthetic Oligonucleotide; PDCD1LG2 exon 3; Set C
cuucgucccucacuuggacuugagguaugu

SEQ ID NO: 41678 - RNA, 26 nt, Artificial Sequence
  Synthetic Oligonucleotide; PDCD1LG2 exon 3; Set C
ucgucccucacuuggacuugagguau

SEQ ID NO: 41679 - RNA, 29 nt, Artificial Sequence
  Synthetic Oligonucleotide; PDCD1LG2 exon 3; Set C
cuucgucccucacuuggacuugagguaug

SEQ ID NO: 41680 - RNA, 31 nt, Artificial Sequence
  Synthetic Oligonucleotide; PDCD1LG2 exon 3; Set C
ccuucgucccucacuuggacuugagguaugu

SEQ ID NO: 41681 - RNA, 28 nt, Artificial Sequence
  Synthetic Oligonucleotide; PDCD1LG2 exon 3; Set C
cuucgucccucacuuggacuugagguau

SEQ ID NO: 41682 - RNA, 32 nt, Artificial Sequence
  Synthetic Oligonucleotide; PDCD1LG2 exon 3; Set C
uccuucgucccucacuuggacuugagguaugu

SEQ ID NO: 41683 - RNA, 30 nt, Artificial Sequence
  Synthetic Oligonucleotide; PDCD1LG2 exon 3; Set C
ccuucgucccucacuuggacuugagguaug

SEQ ID NO: 41684 - RNA, 31 nt, Artificial Sequence
  Synthetic Oligonucleotide; PDCD1LG2 exon 3; Set C
uccuucgucccucacuuggacuugagguaug

SEQ ID NO: 41685 - RNA, 29 nt, Artificial Sequence
  Synthetic Oligonucleotide; PDCD1LG2 exon 3; Set C
ccuucgucccucacuuggacuugagguau

SEQ ID NO: 41686 - RNA, 30 nt, Artificial Sequence
  Synthetic Oligonucleotide; PDCD1LG2 exon 3; Set C
uccuucgucccucacuuggacuugagguau

SEQ ID NO: 41687 - RNA, 35 nt, Artificial Sequence
  Synthetic Oligonucleotide; PDCD1LG2 exon 3; Set C
cuguccuucgucccucacuuggacuugagguaugu

SEQ ID NO: 41688 - RNA, 36 nt, Artificial Sequence
  Synthetic Oligonucleotide; PDCD1LG2 exon 3; Set C
acuguccuucgucccucacuuggacuugagguaugu

SEQ ID NO: 41689 - RNA, 34 nt, Artificial Sequence
  Synthetic Oligonucleotide; PDCD1LG2 exon 3; Set C
cuguccuucgucccucacuuggacuugagguaug

SEQ ID NO: 41690 - RNA, 35 nt, Artificial Sequence
  Synthetic Oligonucleotide; PDCD1LG2 exon 3; Set C
acuguccuucgucccucacuuggacuugagguaug

SEQ ID NO: 41691 - RNA, 33 nt, Artificial Sequence
  Synthetic Oligonucleotide; PDCD1LG2 exon 3; Set C
cuguccuucgucccucacuuggacuugagguau

SEQ ID NO: 41692 - RNA, 37 nt, Artificial Sequence
  Synthetic Oligonucleotide; PDCD1LG2 exon 3; Set C
uacuguccuucgucccucacuuggacuugagguaugu

SEQ ID NO: 41693 - RNA, 38 nt, Artificial Sequence
  Synthetic Oligonucleotide; PDCD1LG2 exon 3; Set C
guacuguccuucgucccucacuuggacuugagguaugu

SEQ ID NO: 41694 - RNA, 34 nt, Artificial Sequence
  Synthetic Oligonucleotide; PDCD1LG2 exon 3; Set C
acuguccuucgucccucacuuggacuugagguau

SEQ ID NO: 41695 - RNA, 36 nt, Artificial Sequence
  Synthetic Oligonucleotide; PDCD1LG2 exon 3; Set C
uacuguccuucgucccucacuuggacuugagguaug

SEQ ID NO: 41696 - RNA, 37 nt, Artificial Sequence
  Synthetic Oligonucleotide; PDCD1LG2 exon 3; Set C
guacuguccuucgucccucacuuggacuugagguaug

SEQ ID NO: 41697 - RNA, 35 nt, Artificial Sequence
  Synthetic Oligonucleotide; PDCD1LG2 exon 3; Set C
uacuguccuucgucccucacuuggacuugagguau

SEQ ID NO: 41698 - RNA, 36 nt, Artificial Sequence
  Synthetic Oligonucleotide; PDCD1LG2 exon 3; Set C
guacuguccuucgucccucacuuggacuugagguau

SEQ ID NO: 41699 - RNA, 25 nt, Artificial Sequence
  Synthetic Oligonucleotide; PDCD1LG2 exon 3; Set C
guccuucgucccucacuuggacuug

SEQ ID NO: 41700 - RNA, 15 nt, Artificial Sequence
  Synthetic Oligonucleotide; PDCD1LG2 exon 3; Set C
cuucgucccucacuu

SEQ ID NO: 41701 - RNA, 16 nt, Artificial Sequence
  Synthetic Oligonucleotide; PDCD1LG2 exon 3; Set C
ccuucgucccucacuu

SEQ ID NO: 41702 - RNA, 17 nt, Artificial Sequence
  Synthetic Oligonucleotide; PDCD1LG2 exon 3; Set C
uccuucgucccucacuu

SEQ ID NO: 41703 - RNA, 15 nt, Artificial Sequence
  Synthetic Oligonucleotide; PDCD1LG2 exon 3; Set C
ccuucgucccucacu

SEQ ID NO: 41704 - RNA, 31 nt, Artificial Sequence
  Synthetic Oligonucleotide; PDCD1LG2 exon 3; Set C
gguacuguccuucgucccucacuuggacuug

SEQ ID NO: 41705 - RNA, 16 nt, Artificial Sequence
  Synthetic Oligonucleotide; PDCD1LG2 exon 3; Set C
uccuucgucccucacu

SEQ ID NO: 41706 - RNA, 32 nt, Artificial Sequence
  Synthetic Oligonucleotide; PDCD1LG2 exon 3; Set C
ugguacuguccuucgucccucacuuggacuug

SEQ ID NO: 41707 - RNA, 15 nt, Artificial Sequence
  Synthetic Oligonucleotide; PDCD1LG2 exon 3; Set C
uccuucgucccucac

SEQ ID NO: 41708 - RNA, 20 nt, Artificial Sequence
  Synthetic Oligonucleotide; PDCD1LG2 exon 3; Set B
cuguccuucgucccucacuu

SEQ ID NO: 41709 - RNA, 21 nt, Artificial Sequence
  Synthetic Oligonucleotide; PDCD1LG2 exon 3; Set B
acuguccuucgucccucacuu

SEQ ID NO: 41710 - RNA, 19 nt, Artificial Sequence
  Synthetic Oligonucleotide; PDCD1LG2 exon 3; Set B
cuguccuucgucccucacu

SEQ ID NO: 41711 - RNA, 22 nt, Artificial Sequence
  Synthetic Oligonucleotide; PDCD1LG2 exon 3; Set B
uacuguccuucgucccucacuu

SEQ ID NO: 41712 - RNA, 20 nt, Artificial Sequence
  Synthetic Oligonucleotide; PDCD1LG2 exon 3; Set B
acuguccuucgucccucacu

SEQ ID NO: 41713 - RNA, 18 nt, Artificial Sequence
  Synthetic Oligonucleotide; PDCD1LG2 exon 3; Set B
cuguccuucgucccucac

SEQ ID NO: 41714 - RNA, 23 nt, Artificial Sequence
  Synthetic Oligonucleotide; PDCD1LG2 exon 3; Set B
guacuguccuucgucccucacuu

SEQ ID NO: 41715 - RNA, 21 nt, Artificial Sequence
  Synthetic Oligonucleotide; PDCD1LG2 exon 3; Set B
uacuguccuucgucccucacu

SEQ ID NO: 41716 - RNA, 19 nt, Artificial Sequence
  Synthetic Oligonucleotide; PDCD1LG2 exon 3; Set B
acuguccuucgucccucac

SEQ ID NO: 41717 - RNA, 17 nt, Artificial Sequence
  Synthetic Oligonucleotide; PDCD1LG2 exon 3; Set C
cuguccuucgucccuca

SEQ ID NO: 41718 - RNA, 22 nt, Artificial Sequence
  Synthetic Oligonucleotide; PDCD1LG2 exon 3; Set B
guacuguccuucgucccucacu

SEQ ID NO: 41719 - RNA, 20 nt, Artificial Sequence
  Synthetic Oligonucleotide; PDCD1LG2 exon 3; Set B
uacuguccuucgucccucac

SEQ ID NO: 41720 - RNA, 18 nt, Artificial Sequence
  Synthetic Oligonucleotide; PDCD1LG2 exon 3; Set B
acuguccuucgucccuca

SEQ ID NO: 41721 - RNA, 21 nt, Artificial Sequence
  Synthetic Oligonucleotide; PDCD1LG2 exon 3; Set B
guacuguccuucgucccucac

SEQ ID NO: 41722 - RNA, 20 nt, Artificial Sequence
  Synthetic Oligonucleotide; PDCD1LG2 exon 3; Set B
guacuguccuucgucccuca

SEQ ID NO: 41723 - RNA, 29 nt, Artificial Sequence
  Synthetic Oligonucleotide; PDCD1LG2 exon 3; Set C
gcauugguacuguccuucgucccucacuu

SEQ ID NO: 41724 - RNA, 30 nt, Artificial Sequence
  Synthetic Oligonucleotide; PDCD1LG2 exon 3; Set C
ugcauugguacuguccuucgucccucacuu

SEQ ID NO: 41725 - RNA, 28 nt, Artificial Sequence
  Synthetic Oligonucleotide; PDCD1LG2 exon 3; Set C
gcauugguacuguccuucgucccucacu

SEQ ID NO: 41726 - RNA, 31 nt, Artificial Sequence
  Synthetic Oligonucleotide; PDCD1LG2 exon 3; Set C
augcauugguacuguccuucgucccucacuu

SEQ ID NO: 41727 - RNA, 29 nt, Artificial Sequence
  Synthetic Oligonucleotide; PDCD1LG2 exon 3; Set C
ugcauugguacuguccuucgucccucacu

SEQ ID NO: 41728 - RNA, 27 nt, Artificial Sequence
  Synthetic Oligonucleotide; PDCD1LG2 exon 3; Set C
gcauugguacuguccuucgucccucac

SEQ ID NO: 41729 - RNA, 30 nt, Artificial Sequence
  Synthetic Oligonucleotide; PDCD1LG2 exon 3; Set C
augcauugguacuguccuucgucccucacu

SEQ ID NO: 41730 - RNA, 28 nt, Artificial Sequence
  Synthetic Oligonucleotide; PDCD1LG2 exon 3; Set C
ugcauugguacuguccuucgucccucac

SEQ ID NO: 41731 - RNA, 26 nt, Artificial Sequence
  Synthetic Oligonucleotide; PDCD1LG2 exon 3; Set C
gcauugguacuguccuucgucccuca

SEQ ID NO: 41732 - RNA, 29 nt, Artificial Sequence
  Synthetic Oligonucleotide; PDCD1LG2 exon 3; Set C
augcauugguacuguccuucgucccucac

SEQ ID NO: 41733 - RNA, 27 nt, Artificial Sequence
  Synthetic Oligonucleotide; PDCD1LG2 exon 3; Set C
ugcauugguacuguccuucgucccuca

SEQ ID NO: 41734 - RNA, 25 nt, Artificial Sequence
  Synthetic Oligonucleotide; PDCD1LG2 exon 3; Set C
gcauugguacuguccuucgucccuc

SEQ ID NO: 41735 - RNA, 28 nt, Artificial Sequence
  Synthetic Oligonucleotide; PDCD1LG2 exon 3; Set C
augcauugguacuguccuucgucccuca

SEQ ID NO: 41736 - RNA, 26 nt, Artificial Sequence
  Synthetic Oligonucleotide; PDCD1LG2 exon 3; Set C
ugcauugguacuguccuucgucccuc

SEQ ID NO: 41737 - RNA, 27 nt, Artificial Sequence
  Synthetic Oligonucleotide; PDCD1LG2 exon 3; Set C
augcauugguacuguccuucgucccuc

SEQ ID NO: 41738 - RNA, 15 nt, Artificial Sequence
  Synthetic Oligonucleotide; PDCD1LG2 exon 3; Set C
ugguacuguccuucg

SEQ ID NO: 41739 - RNA, 16 nt, Artificial Sequence
  Synthetic Oligonucleotide; PDCD1LG2 exon 3; Set C
uugguacuguccuucg

SEQ ID NO: 41740 - RNA, 37 nt, Artificial Sequence
  Synthetic Oligonucleotide; PDCD1LG2 exon 3; Set C
augauuaugcauugguacuguccuucgucccucacuu

SEQ ID NO: 41741 - RNA, 17 nt, Artificial Sequence
  Synthetic Oligonucleotide; PDCD1LG2 exon 3; Set C
auugguacuguccuucg

SEQ ID NO: 41742 - RNA, 38 nt, Artificial Sequence
  Synthetic Oligonucleotide; PDCD1LG2 exon 3; Set C
gaugauuaugcauugguacuguccuucgucccucacuu

SEQ ID NO: 41743 - RNA, 36 nt, Artificial Sequence
  Synthetic Oligonucleotide; PDCD1LG2 exon 3; Set C
augauuaugcauugguacuguccuucgucccucacu

SEQ ID NO: 41744 - RNA, 18 nt, Artificial Sequence
  Synthetic Oligonucleotide; PDCD1LG2 exon 3; Set C
cauugguacuguccuucg

SEQ ID NO: 41745 - RNA, 37 nt, Artificial Sequence
  Synthetic Oligonucleotide; PDCD1LG2 exon 3; Set C
gaugauuaugcauugguacuguccuucgucccucacu

SEQ ID NO: 41746 - RNA, 35 nt, Artificial Sequence
  Synthetic Oligonucleotide; PDCD1LG2 exon 3; Set C
augauuaugcauugguacuguccuucgucccucac

SEQ ID NO: 41747 - RNA, 40 nt, Artificial Sequence
  Synthetic Oligonucleotide; PDCD1LG2 exon 3; Set C
uagaugauuaugcauugguacuguccuucgucccucacuu

SEQ ID NO: 41748 - RNA, 36 nt, Artificial Sequence
  Synthetic Oligonucleotide; PDCD1LG2 exon 3; Set C
gaugauuaugcauugguacuguccuucgucccucac

SEQ ID NO: 41749 - RNA, 18 nt, Artificial Sequence
  Synthetic Oligonucleotide; PDCD1LG2 exon 3; Set C
gcauugguacuguccuuc

SEQ ID NO: 41750 - RNA, 34 nt, Artificial Sequence
  Synthetic Oligonucleotide; PDCD1LG2 exon 3; Set C
augauuaugcauugguacuguccuucgucccuca

SEQ ID NO: 41751 - RNA, 39 nt, Artificial Sequence
  Synthetic Oligonucleotide; PDCD1LG2 exon 3; Set C
uagaugauuaugcauugguacuguccuucgucccucacu

SEQ ID NO: 41752 - RNA, 19 nt, Artificial Sequence
  Synthetic Oligonucleotide; PDCD1LG2 exon 3; Set C
ugcauugguacuguccuuc

SEQ ID NO: 41753 - RNA, 35 nt, Artificial Sequence
  Synthetic Oligonucleotide; PDCD1LG2 exon 3; Set C
gaugauuaugcauugguacuguccuucgucccuca

SEQ ID NO: 41754 - RNA, 33 nt, Artificial Sequence
  Synthetic Oligonucleotide; PDCD1LG2 exon 3; Set C
augauuaugcauugguacuguccuucgucccuc

SEQ ID NO: 41755 - RNA, 38 nt, Artificial Sequence
  Synthetic Oligonucleotide; PDCD1LG2 exon 3; Set C
uagaugauuaugcauugguacuguccuucgucccucac

SEQ ID NO: 41756 - RNA, 20 nt, Artificial Sequence
  Synthetic Oligonucleotide; PDCD1LG2 exon 3; Set C
augcauugguacuguccuuc

SEQ ID NO: 41757 - RNA, 34 nt, Artificial Sequence
  Synthetic Oligonucleotide; PDCD1LG2 exon 3; Set C
gaugauuaugcauugguacuguccuucgucccuc

SEQ ID NO: 41758 - RNA, 22 nt, Artificial Sequence
  Synthetic Oligonucleotide; PDCD1LG2 exon 3; Set B
uaugcauugguacuguccuucg

SEQ ID NO: 41759 - RNA, 37 nt, Artificial Sequence
  Synthetic Oligonucleotide; PDCD1LG2 exon 3; Set C
uagaugauuaugcauugguacuguccuucgucccuca

SEQ ID NO: 41760 - RNA, 23 nt, Artificial Sequence
  Synthetic Oligonucleotide; PDCD1LG2 exon 3; Set B
uuaugcauugguacuguccuucg

SEQ ID NO: 41761 - RNA, 24 nt, Artificial Sequence
  Synthetic Oligonucleotide; PDCD1LG2 exon 3; Set B
auuaugcauugguacuguccuucg

SEQ ID NO: 41762 - RNA, 19 nt, Artificial Sequence
  Synthetic Oligonucleotide; PDCD1LG2 exon 3; Set C
uaugcauugguacuguccu

SEQ ID NO: 41763 - RNA, 16 nt, Artificial Sequence
  Synthetic Oligonucleotide; PDCD1LG2 exon 3; Set C
augcauugguacuguc

SEQ ID NO: 41764 - RNA, 18 nt, Artificial Sequence
  Synthetic Oligonucleotide; PDCD1LG2 exon 3; Set C
uaugcauugguacugucc

SEQ ID NO: 41765 - RNA, 15 nt, Artificial Sequence
  Synthetic Oligonucleotide; PDCD1LG2 exon 3; Set C
augcauugguacugu

SEQ ID NO: 41766 - RNA, 26 nt, Artificial Sequence
  Synthetic Oligonucleotide; PDCD1LG2 exon 3; Set B
augauuaugcauugguacuguccuuc

SEQ ID NO: 41767 - RNA, 27 nt, Artificial Sequence
  Synthetic Oligonucleotide; PDCD1LG2 exon 3; Set B
gaugauuaugcauugguacuguccuuc

SEQ ID NO: 41768 - RNA, 15 nt, Artificial Sequence
  Synthetic Oligonucleotide; PDCD1LG2 exon 3; Set C
uaugcauugguacug

SEQ ID NO: 41769 - RNA, 16 nt, Artificial Sequence
  Synthetic Oligonucleotide; PDCD1LG2 exon 3; Set C
uuaugcauugguacug

SEQ ID NO: 41770 - RNA, 29 nt, Artificial Sequence
  Synthetic Oligonucleotide; PDCD1LG2 exon 3; Set B
uagaugauuaugcauugguacuguccuuc

SEQ ID NO: 41771 - RNA, 15 nt, Artificial Sequence
  Synthetic Oligonucleotide; PDCD1LG2 exon 3; Set C
uuaugcauugguacu

SEQ ID NO: 41772 - RNA, 17 nt, Artificial Sequence
  Synthetic Oligonucleotide; PDCD1LG2 exon 3; Set C
auuaugcauugguacug

SEQ ID NO: 41773 - RNA, 22 nt, Artificial Sequence
  Synthetic Oligonucleotide; PDCD1LG2 exon 3; Set C
augauuaugcauugguacuguc

SEQ ID NO: 41774 - RNA, 16 nt, Artificial Sequence
  Synthetic Oligonucleotide; PDCD1LG2 exon 3; Set C
auuaugcauugguacu

SEQ ID NO: 41775 - RNA, 21 nt, Artificial Sequence
  Synthetic Oligonucleotide; PDCD1LG2 exon 3; Set C
augauuaugcauugguacugu

SEQ ID NO: 41776 - RNA, 23 nt, Artificial Sequence
  Synthetic Oligonucleotide; PDCD1LG2 exon 3; Set C
gaugauuaugcauugguacuguc

SEQ ID NO: 41777 - RNA, 15 nt, Artificial Sequence
  Synthetic Oligonucleotide; PDCD1LG2 exon 3; Set C
auuaugcauugguac

SEQ ID NO: 41778 - RNA, 22 nt, Artificial Sequence
  Synthetic Oligonucleotide; PDCD1LG2 exon 3; Set C
gaugauuaugcauugguacugu

SEQ ID NO: 41779 - RNA, 16 nt, Artificial Sequence
  Synthetic Oligonucleotide; PDCD1LG2 exon 3; Set C
gauuaugcauugguac

SEQ ID NO: 41780 - RNA, 17 nt, Artificial Sequence
  Synthetic Oligonucleotide; PDCD1LG2 exon 3; Set C
ugauuaugcauugguac

SEQ ID NO: 41781 - RNA, 24 nt, Artificial Sequence
  Synthetic Oligonucleotide; PDCD1LG2 exon 3; Set C
uagaugauuaugcauugguacugu

SEQ ID NO: 41782 - RNA, 16 nt, Artificial Sequence
  Synthetic Oligonucleotide; PDCD1LG2 exon 3; Set C
augauuaugcauuggu

SEQ ID NO: 41783 - RNA, 15 nt, Artificial Sequence
  Synthetic Oligonucleotide; PDCD1LG2 exon 3; Set C
augauuaugcauugg

SEQ ID NO: 41784 - RNA, 17 nt, Artificial Sequence
  Synthetic Oligonucleotide; PDCD1LG2 exon 3; Set C
gaugauuaugcauuggu

SEQ ID NO: 41785 - RNA, 16 nt, Artificial Sequence
  Synthetic Oligonucleotide; PDCD1LG2 exon 3; Set C
gaugauuaugcauugg

SEQ ID NO: 41786 - RNA, 15 nt, Artificial Sequence
  Synthetic Oligonucleotide; PDCD1LG2 exon 3; Set C
gaugauuaugcauug

SEQ ID NO: 41787 - RNA, 18 nt, Artificial Sequence
  Synthetic Oligonucleotide; PDCD1LG2 exon 3; Set C
uagaugauuaugcauugg

SEQ ID NO: 41788 - RNA, 17 nt, Artificial Sequence
  Synthetic Oligonucleotide; PDCD1LG2 exon 3; Set C
uagaugauuaugcauug

SEQ ID NO: 41789 - RNA, 16 nt, Artificial Sequence
  Synthetic Oligonucleotide; PDCD1LG2 exon 3; Set C
uagaugauuaugcauu

SEQ ID NO: 41790 - RNA, 15 nt, Artificial Sequence
  Synthetic Oligonucleotide; PDCD1LG2 exon 3; Set C
uagaugauuaugcau

SEQ ID NO: 41791 - RNA, 37 nt, Artificial Sequence
  Synthetic Oligonucleotide; PDCD1LG2 exon 3; Set C
ccaggcgaccccauagaugauuaugcauugguacugu

SEQ ID NO: 41792 - RNA, 30 nt, Artificial Sequence
  Synthetic Oligonucleotide; PDCD1LG2 exon 3; Set C
ccaggcgaccccauagaugauuaugcauug

SEQ ID NO: 41793 - RNA, 29 nt, Artificial Sequence
  Synthetic Oligonucleotide; PDCD1LG2 exon 3; Set C
ccaggcgaccccauagaugauuaugcauu

SEQ ID NO: 41794 - RNA, 28 nt, Artificial Sequence
  Synthetic Oligonucleotide; PDCD1LG2 exon 3; Set C
ccaggcgaccccauagaugauuaugcau

SEQ ID NO: 41795 - RNA, 37 nt, Artificial Sequence
  Synthetic Oligonucleotide; PDCD1LG2 exon 3; Set C
guagucccaggcgaccccauagaugauuaugcauugg

SEQ ID NO: 41796 - RNA, 24 nt, Artificial Sequence
  Synthetic Oligonucleotide; PDCD1LG2 exon 3; Set B
ccaggcgaccccauagaugauuau

SEQ ID NO: 41797 - RNA, 36 nt, Artificial Sequence
  Synthetic Oligonucleotide; PDCD1LG2 exon 3; Set C
guagucccaggcgaccccauagaugauuaugcauug

SEQ ID NO: 41798 - RNA, 35 nt, Artificial Sequence
  Synthetic Oligonucleotide; PDCD1LG2 exon 3; Set C
guagucccaggcgaccccauagaugauuaugcauu

SEQ ID NO: 41799 - RNA, 23 nt, Artificial Sequence
  Synthetic Oligonucleotide; PDCD1LG2 exon 3; Set B
ccaggcgaccccauagaugauua

SEQ ID NO: 41800 - RNA, 36 nt, Artificial Sequence
  Synthetic Oligonucleotide; PDCD1LG2 exon 3; Set C
uguagucccaggcgaccccauagaugauuaugcauu

SEQ ID NO: 41801 - RNA, 34 nt, Artificial Sequence
  Synthetic Oligonucleotide; PDCD1LG2 exon 3; Set C
guagucccaggcgaccccauagaugauuaugcau

SEQ ID NO: 41802 - RNA, 22 nt, Artificial Sequence
  Synthetic Oligonucleotide; PDCD1LG2 exon 3; Set B
ccaggcgaccccauagaugauu

SEQ ID NO: 41803 - RNA, 21 nt, Artificial Sequence
  Synthetic Oligonucleotide; PDCD1LG2 exon 3; Set B
ccaggcgaccccauagaugau

SEQ ID NO: 41804 - RNA, 37 nt, Artificial Sequence
  Synthetic Oligonucleotide; PDCD1LG2 exon 3; Set C
uuguagucccaggcgaccccauagaugauuaugcauu

SEQ ID NO: 41805 - RNA, 35 nt, Artificial Sequence
  Synthetic Oligonucleotide; PDCD1LG2 exon 3; Set C
uguagucccaggcgaccccauagaugauuaugcau

SEQ ID NO: 41806 - RNA, 39 nt, Artificial Sequence
  Synthetic Oligonucleotide; PDCD1LG2 exon 3; Set C
cuuguagucccaggcgaccccauagaugauuaugcauug

SEQ ID NO: 41807 - RNA, 20 nt, Artificial Sequence
  Synthetic Oligonucleotide; PDCD1LG2 exon 3; Set B
ccaggcgaccccauagauga

SEQ ID NO: 41808 - RNA, 38 nt, Artificial Sequence
  Synthetic Oligonucleotide; PDCD1LG2 exon 3; Set C
cuuguagucccaggcgaccccauagaugauuaugcauu

SEQ ID NO: 41809 - RNA, 36 nt, Artificial Sequence
  Synthetic Oligonucleotide; PDCD1LG2 exon 3; Set C
uuguagucccaggcgaccccauagaugauuaugcau

SEQ ID NO: 41810 - RNA, 37 nt, Artificial Sequence
  Synthetic Oligonucleotide; PDCD1LG2 exon 3; Set C
cuuguagucccaggcgaccccauagaugauuaugcau

SEQ ID NO: 41811 - RNA, 30 nt, Artificial Sequence
  Synthetic Oligonucleotide; PDCD1LG2 exon 3; Set C
guagucccaggcgaccccauagaugauuau

SEQ ID NO: 41812 - RNA, 29 nt, Artificial Sequence
  Synthetic Oligonucleotide; PDCD1LG2 exon 3; Set C
guagucccaggcgaccccauagaugauua

SEQ ID NO: 41813 - RNA, 30 nt, Artificial Sequence
  Synthetic Oligonucleotide; PDCD1LG2 exon 3; Set C
uguagucccaggcgaccccauagaugauua

SEQ ID NO: 41814 - RNA, 28 nt, Artificial Sequence
  Synthetic Oligonucleotide; PDCD1LG2 exon 3; Set C
guagucccaggcgaccccauagaugauu

SEQ ID NO: 41815 - RNA, 27 nt, Artificial Sequence
  Synthetic Oligonucleotide; PDCD1LG2 exon 3; Set C
guagucccaggcgaccccauagaugau

SEQ ID NO: 41816 - RNA, 31 nt, Artificial Sequence
  Synthetic Oligonucleotide; PDCD1LG2 exon 3; Set C
uuguagucccaggcgaccccauagaugauua

SEQ ID NO: 41817 - RNA, 33 nt, Artificial Sequence
  Synthetic Oligonucleotide; PDCD1LG2 exon 3; Set C
cuuguagucccaggcgaccccauagaugauuau

SEQ ID NO: 41818 - RNA, 26 nt, Artificial Sequence
  Synthetic Oligonucleotide; PDCD1LG2 exon 3; Set C
guagucccaggcgaccccauagauga

SEQ ID NO: 41819 - RNA, 28 nt, Artificial Sequence
  Synthetic Oligonucleotide; PDCD1LG2 exon 3; Set C
uguagucccaggcgaccccauagaugau

SEQ ID NO: 41820 - RNA, 32 nt, Artificial Sequence
  Synthetic Oligonucleotide; PDCD1LG2 exon 3; Set C
cuuguagucccaggcgaccccauagaugauua

SEQ ID NO: 41821 - RNA, 30 nt, Artificial Sequence
  Synthetic Oligonucleotide; PDCD1LG2 exon 3; Set C
uuguagucccaggcgaccccauagaugauu

SEQ ID NO: 41822 - RNA, 29 nt, Artificial Sequence
  Synthetic Oligonucleotide; PDCD1LG2 exon 3; Set C
uuguagucccaggcgaccccauagaugau

SEQ ID NO: 41823 - RNA, 31 nt, Artificial Sequence
  Synthetic Oligonucleotide; PDCD1LG2 exon 3; Set C
cuuguagucccaggcgaccccauagaugauu

SEQ ID NO: 41824 - RNA, 30 nt, Artificial Sequence
  Synthetic Oligonucleotide; PDCD1LG2 exon 3; Set C
cuuguagucccaggcgaccccauagaugau

SEQ ID NO: 41825 - RNA, 28 nt, Artificial Sequence
  Synthetic Oligonucleotide; PDCD1LG2 exon 3; Set C
uuguagucccaggcgaccccauagauga

SEQ ID NO: 41826 - RNA, 29 nt, Artificial Sequence
  Synthetic Oligonucleotide; PDCD1LG2 exon 3; Set C
cuuguagucccaggcgaccccauagauga

SEQ ID NO: 41827 - RNA, 18 nt, Artificial Sequence
  Synthetic Oligonucleotide; PDCD1LG2 exon 3; Set C
cagagucagguacuugua

SEQ ID NO: 41828 - RNA, 19 nt, Artificial Sequence
  Synthetic Oligonucleotide; PDCD1LG2 exon 3; Set C
ucagagucagguacuugua

SEQ ID NO: 41829 - RNA, 20 nt, Artificial Sequence
  Synthetic Oligonucleotide; PDCD1LG2 exon 3; Set C
uucagagucagguacuugua

SEQ ID NO: 41830 - RNA, 32 nt, Artificial Sequence
  Synthetic Oligonucleotide; PDCD1LG2 exon 3; Set C
aguccuugacaccacucaccuuugacuuucag

SEQ ID NO: 41831 - RNA, 31 nt, Artificial Sequence
  Synthetic Oligonucleotide; PDCD1LG2 exon 3; Set C
aguccuugacaccacucaccuuugacuuuca

SEQ ID NO: 41832 - RNA, 33 nt, Artificial Sequence
  Synthetic Oligonucleotide; PDCD1LG2 exon 3; Set C
uaguccuugacaccacucaccuuugacuuucag

SEQ ID NO: 41833 - RNA, 30 nt, Artificial Sequence
  Synthetic Oligonucleotide; PDCD1LG2 exon 3; Set C
aguccuugacaccacucaccuuugacuuuc

SEQ ID NO: 41834 - RNA, 32 nt, Artificial Sequence
  Synthetic Oligonucleotide; PDCD1LG2 exon 3; Set C
uaguccuugacaccacucaccuuugacuuuca

SEQ ID NO: 41835 - RNA, 31 nt, Artificial Sequence
  Synthetic Oligonucleotide; PDCD1LG2 exon 3; Set C
uaguccuugacaccacucaccuuugacuuuc

SEQ ID NO: 41836 - RNA, 27 nt, Artificial Sequence
  Synthetic Oligonucleotide; PDCD1LG2 exon 3; Set B
gcuuccauggauucuaguccuugacac

SEQ ID NO: 41837 - RNA, 28 nt, Artificial Sequence
  Synthetic Oligonucleotide; PDCD1LG2 exon 3; Set B
ugcuuccauggauucuaguccuugacac

SEQ ID NO: 41838 - RNA, 29 nt, Artificial Sequence
  Synthetic Oligonucleotide; PDCD1LG2 exon 3; Set B
augcuuccauggauucuaguccuugacac

SEQ ID NO: 41839 - RNA, 37 nt, Artificial Sequence
  Synthetic Oligonucleotide; PDCD1LG2 exon 3; Set C
uuggagagaugcuuccauggauucuaguccuugacac

SEQ ID NO: 41840 - RNA, 38 nt, Artificial Sequence
  Synthetic Oligonucleotide; PDCD1LG2 exon 3; Set C
guuggagagaugcuuccauggauucuaguccuugacac

SEQ ID NO: 41841 - RNA, 21 nt, Artificial Sequence
  Synthetic Oligonucleotide; PDCD1LG2 exon 3; Set C
gaugcuuccauggauucuagu

SEQ ID NO: 41842 - RNA, 39 nt, Artificial Sequence
  Synthetic Oligonucleotide; PDCD1LG2 exon 3; Set C
uguuggagagaugcuuccauggauucuaguccuugacac

SEQ ID NO: 41843 - RNA, 17 nt, Artificial Sequence
  Synthetic Oligonucleotide; PDCD1LG2 exon 3; Set C
ugcuuccauggauucua

SEQ ID NO: 41844 - RNA, 20 nt, Artificial Sequence
  Synthetic Oligonucleotide; PDCD1LG2 exon 3; Set C
gaugcuuccauggauucuag

SEQ ID NO: 41845 - RNA, 40 nt, Artificial Sequence
  Synthetic Oligonucleotide; PDCD1LG2 exon 3; Set C
cuguuggagagaugcuuccauggauucuaguccuugacac

SEQ ID NO: 41846 - RNA, 18 nt, Artificial Sequence
  Synthetic Oligonucleotide; PDCD1LG2 exon 3; Set C
augcuuccauggauucua

SEQ ID NO: 41847 - RNA, 27 nt, Artificial Sequence
  Synthetic Oligonucleotide; PDCD1LG2 exon 3; Set B
uggagagaugcuuccauggauucuagu

SEQ ID NO: 41848 - RNA, 26 nt, Artificial Sequence
  Synthetic Oligonucleotide; PDCD1LG2 exon 3; Set B
uggagagaugcuuccauggauucuag

SEQ ID NO: 41849 - RNA, 27 nt, Artificial Sequence
  Synthetic Oligonucleotide; PDCD1LG2 exon 3; Set B
guuggagagaugcuuccauggauucua

SEQ ID NO: 41850 - RNA, 28 nt, Artificial Sequence
  Synthetic Oligonucleotide; PDCD1LG2 exon 3; Set B
uguuggagagaugcuuccauggauucua

SEQ ID NO: 41851 - RNA, 26 nt, Artificial Sequence
  Synthetic Oligonucleotide; PDCD1LG2 exon 3; Set B
guuggagagaugcuuccauggauucu

SEQ ID NO: 41852 - RNA, 33 nt, Artificial Sequence
  Synthetic Oligonucleotide; PDCD1LG2 exon 3; Set C
cucuguuggagagaugcuuccauggauucuagu

SEQ ID NO: 41853 - RNA, 29 nt, Artificial Sequence
  Synthetic Oligonucleotide; PDCD1LG2 exon 3; Set B
cuguuggagagaugcuuccauggauucua

SEQ ID NO: 41854 - RNA, 25 nt, Artificial Sequence
  Synthetic Oligonucleotide; PDCD1LG2 exon 3; Set B
guuggagagaugcuuccauggauuc

SEQ ID NO: 41855 - RNA, 27 nt, Artificial Sequence
  Synthetic Oligonucleotide; PDCD1LG2 exon 3; Set B
uguuggagagaugcuuccauggauucu

SEQ ID NO: 41856 - RNA, 32 nt, Artificial Sequence
  Synthetic Oligonucleotide; PDCD1LG2 exon 3; Set B
cucuguuggagagaugcuuccauggauucuag

SEQ ID NO: 41857 - RNA, 34 nt, Artificial Sequence
  Synthetic Oligonucleotide; PDCD1LG2 exon 3; Set C
ccucuguuggagagaugcuuccauggauucuagu

SEQ ID NO: 41858 - RNA, 26 nt, Artificial Sequence
  Synthetic Oligonucleotide; PDCD1LG2 exon 3; Set B
uguuggagagaugcuuccauggauuc

SEQ ID NO: 41859 - RNA, 28 nt, Artificial Sequence
  Synthetic Oligonucleotide; PDCD1LG2 exon 3; Set B
cuguuggagagaugcuuccauggauucu

SEQ ID NO: 41860 - RNA, 24 nt, Artificial Sequence
  Synthetic Oligonucleotide; PDCD1LG2 exon 3; Set B
guuggagagaugcuuccauggauu

SEQ ID NO: 41861 - RNA, 27 nt, Artificial Sequence
  Synthetic Oligonucleotide; PDCD1LG2 exon 3; Set B
cuguuggagagaugcuuccauggauuc

SEQ ID NO: 41862 - RNA, 19 nt, Artificial Sequence
  Synthetic Oligonucleotide; PDCD1LG2 exon 3; Set C
cucuguuggagagaugcuu

SEQ ID NO: 41863 - RNA, 18 nt, Artificial Sequence
  Synthetic Oligonucleotide; PDCD1LG2 exon 3; Set C
cucuguuggagagaugcu

SEQ ID NO: 41864 - RNA, 20 nt, Artificial Sequence
  Synthetic Oligonucleotide; PDCD1LG2 exon 3; Set C
ccucuguuggagagaugcuu

SEQ ID NO: 41865 - RNA, 17 nt, Artificial Sequence
  Synthetic Oligonucleotide; PDCD1LG2 exon 3; Set C
cucuguuggagagaugc

SEQ ID NO: 41866 - RNA, 19 nt, Artificial Sequence
  Synthetic Oligonucleotide; PDCD1LG2 exon 3; Set C
ccucuguuggagagaugcu

SEQ ID NO: 41867 - RNA, 18 nt, Artificial Sequence
  Synthetic Oligonucleotide; PDCD1LG2 exon 3; Set C
ccucuguuggagagaugc

SEQ ID NO: 41868 - RNA, 16 nt, Artificial Sequence
  Synthetic Oligonucleotide; PDCD1LG2 exon 3; Set C
cucuguuggagagaug

SEQ ID NO: 41869 - RNA, 17 nt, Artificial Sequence
  Synthetic Oligonucleotide; PDCD1LG2 exon 3; Set C
ccucuguuggagagaug

SEQ ID NO: 41870 - RNA, 19 nt, Artificial Sequence
  Synthetic Oligonucleotide; PDCD1LG2 exon 3; Set C
cugccuuuacuuuacauuc

SEQ ID NO: 41871 - RNA, 18 nt, Artificial Sequence
  Synthetic Oligonucleotide; PDCD1LG2 exon 3; Set C
cugccuuuacuuuacauu

SEQ ID NO: 41872 - RNA, 17 nt, Artificial Sequence
  Synthetic Oligonucleotide; PDCD1LG2 exon 3; Set C
cugccuuuacuuuacau

SEQ ID NO: 41873 - RNA, 16 nt, Artificial Sequence
  Synthetic Oligonucleotide; PDCD1LG2 exon 3; Set C
cugccuuuacuuuaca

SEQ ID NO: 41874 - RNA, 23 nt, Artificial Sequence
  Synthetic Oligonucleotide; PDCD1LG2 exon 3; Set C
uugucugccuuuacuuuacauuc

SEQ ID NO: 41875 - RNA, 15 nt, Artificial Sequence
  Synthetic Oligonucleotide; PDCD1LG2 exon 3; Set C
cugccuuuacuuuac

SEQ ID NO: 41876 - RNA, 22 nt, Artificial Sequence
  Synthetic Oligonucleotide; PDCD1LG2 exon 3; Set C
uugucugccuuuacuuuacauu

SEQ ID NO: 41877 - RNA, 21 nt, Artificial Sequence
  Synthetic Oligonucleotide; PDCD1LG2 exon 3; Set C
uugucugccuuuacuuuacau

SEQ ID NO: 41878 - RNA, 20 nt, Artificial Sequence
  Synthetic Oligonucleotide; PDCD1LG2 exon 3; Set C
uugucugccuuuacuuuaca

SEQ ID NO: 41879 - RNA, 19 nt, Artificial Sequence
  Synthetic Oligonucleotide; PDCD1LG2 exon 3; Set C
uugucugccuuuacuuuac

SEQ ID NO: 41880 - RNA, 18 nt, Artificial Sequence
  Synthetic Oligonucleotide; PDCD1LG2 exon 3; Set C
uugucugccuuuacuuua

SEQ ID NO: 41881 - RNA, 17 nt, Artificial Sequence
  Synthetic Oligonucleotide; PDCD1LG2 exon 3; Set C
uugucugccuuuacuuu

SEQ ID NO: 41882 - RNA, 16 nt, Artificial Sequence
  Synthetic Oligonucleotide; PDCD1LG2 exon 3; Set C
uugucugccuuuacuu

SEQ ID NO: 41883 - RNA, 15 nt, Artificial Sequence
  Synthetic Oligonucleotide; PDCD1LG2 exon 3; Set C
uugucugccuuuacu

SEQ ID NO: 41884 - RNA, 16 nt, Artificial Sequence
  Synthetic Oligonucleotide; PDCD1LG2 exon 3; Set C
uugucauugucugccu

SEQ ID NO: 41885 - RNA, 17 nt, Artificial Sequence
  Synthetic Oligonucleotide; PDCD1LG2 exon 3; Set C
uuugucauugucugccu

SEQ ID NO: 41886 - RNA, 15 nt, Artificial Sequence
  Synthetic Oligonucleotide; PDCD1LG2 exon 3; Set C
uugucauugucugcc

SEQ ID NO: 41887 - RNA, 18 nt, Artificial Sequence
  Synthetic Oligonucleotide; PDCD1LG2 exon 3; Set C
uuuugucauugucugccu

SEQ ID NO: 41888 - RNA, 16 nt, Artificial Sequence
  Synthetic Oligonucleotide; PDCD1LG2 exon 3; Set C
uuugucauugucugcc

SEQ ID NO: 41889 - RNA, 15 nt, Artificial Sequence
  Synthetic Oligonucleotide; PDCD1LG2 exon 3; Set C
uuugucauugucugc

SEQ ID NO: 41890 - RNA, 17 nt, Artificial Sequence
  Synthetic Oligonucleotide; PDCD1LG2 exon 3; Set C
uuuugucauugucugcc

SEQ ID NO: 41891 - RNA, 16 nt, Artificial Sequence
  Synthetic Oligonucleotide; PDCD1LG2 exon 3; Set C
uuuugucauugucugc

SEQ ID NO: 41892 - RNA, 18 nt, Artificial Sequence
  Synthetic Oligonucleotide; PDCD1LG2 exon 3; Set C
auuuugucauugucugcc

SEQ ID NO: 41893 - RNA, 17 nt, Artificial Sequence
  Synthetic Oligonucleotide; PDCD1LG2 exon 3; Set C
auuuugucauugucugc

SEQ ID NO: 41894 - RNA, 15 nt, Artificial Sequence
  Synthetic Oligonucleotide; PDCD1LG2 exon 3; Set C
gauauuuugucauug

SEQ ID NO: 41895 - RNA, 17 nt, Artificial Sequence
  Synthetic Oligonucleotide; PDCD1LG2 exon 3; Set C
uagggacugucacugug

SEQ ID NO: 41896 - RNA, 16 nt, Artificial Sequence
  Synthetic Oligonucleotide; PDCD1LG2 exon 3; Set C
uagggacugucacugu

SEQ ID NO: 41897 - RNA, 17 nt, Artificial Sequence
  Synthetic Oligonucleotide; PDCD1LG2 exon 3; Set C
uuagggacugucacugu

SEQ ID NO: 41898 - RNA, 33 nt, Artificial Sequence
  Synthetic Oligonucleotide; PDCD1LG2 exon 3; Set C
auuauguacaguuccuuagggacugucacugug

SEQ ID NO: 41899 - RNA, 34 nt, Artificial Sequence
  Synthetic Oligonucleotide; PDCD1LG2 exon 3; Set C
uauuauguacaguuccuuagggacugucacugug

SEQ ID NO: 41900 - RNA, 32 nt, Artificial Sequence
  Synthetic Oligonucleotide; PDCD1LG2 exon 3; Set C
auuauguacaguuccuuagggacugucacugu

SEQ ID NO: 41901 - RNA, 35 nt, Artificial Sequence
  Synthetic Oligonucleotide; PDCD1LG2 exon 3; Set C
cuauuauguacaguuccuuagggacugucacugug

SEQ ID NO: 41902 - RNA, 33 nt, Artificial Sequence
  Synthetic Oligonucleotide; PDCD1LG2 exon 3; Set C
uauuauguacaguuccuuagggacugucacugu

SEQ ID NO: 41903 - RNA, 36 nt, Artificial Sequence
  Synthetic Oligonucleotide; PDCD1LG2 exon 3; Set C
ucuauuauguacaguuccuuagggacugucacugug

SEQ ID NO: 41904 - RNA, 34 nt, Artificial Sequence
  Synthetic Oligonucleotide; PDCD1LG2 exon 3; Set C
cuauuauguacaguuccuuagggacugucacugu

SEQ ID NO: 41905 - RNA, 35 nt, Artificial Sequence
  Synthetic Oligonucleotide; PDCD1LG2 exon 3; Set C
ucuauuauguacaguuccuuagggacugucacugu

SEQ ID NO: 41906 - RNA, 40 nt, Artificial Sequence
  Synthetic Oligonucleotide; PDCD1LG2 exon 3; Set C
caugcucuauuauguacaguuccuuagggacugucacugu

SEQ ID NO: 41907 - RNA, 18 nt, Artificial Sequence
  Synthetic Oligonucleotide; PDCD1LG2 exon 3; Set C
auuauguacaguuccuua

SEQ ID NO: 41908 - RNA, 26 nt, Artificial Sequence
  Synthetic Oligonucleotide; PDCD1LG2 exon 3; Set A
gucacauugcugccaugcucuauuau

SEQ ID NO: 41909 - RNA, 27 nt, Artificial Sequence
  Synthetic Oligonucleotide; PDCD1LG2 exon 3; Set C
ggucacauugcugccaugcucuauuau

SEQ ID NO: 41910 - RNA, 25 nt, Artificial Sequence
  Synthetic Oligonucleotide; PDCD1LG2 exon 3; Set A
gucacauugcugccaugcucuauua

SEQ ID NO: 41911 - RNA, 26 nt, Artificial Sequence
  Synthetic Oligonucleotide; PDCD1LG2 exon 3; Set C
ggucacauugcugccaugcucuauua

SEQ ID NO: 41912 - RNA, 33 nt, Artificial Sequence
  Synthetic Oligonucleotide; PDCD1LG2 exon 3; Set C
uuccagggucacauugcugccaugcucuauuau

SEQ ID NO: 41913 - RNA, 37 nt, Artificial Sequence
  Synthetic Oligonucleotide; PDCD1LG2 exon 3; Set C
cauuccagggucacauugcugccaugcucuauuaugu

SEQ ID NO: 41914 - RNA, 34 nt, Artificial Sequence
  Synthetic Oligonucleotide; PDCD1LG2 exon 3; Set C
auuccagggucacauugcugccaugcucuauuau

SEQ ID NO: 41915 - RNA, 32 nt, Artificial Sequence
  Synthetic Oligonucleotide; PDCD1LG2 exon 3; Set C
uuccagggucacauugcugccaugcucuauua

SEQ ID NO: 41916 - RNA, 38 nt, Artificial Sequence
  Synthetic Oligonucleotide; PDCD1LG2 exon 3; Set C
gcauuccagggucacauugcugccaugcucuauuaugu

SEQ ID NO: 41917 - RNA, 35 nt, Artificial Sequence
  Synthetic Oligonucleotide; PDCD1LG2 exon 3; Set C
cauuccagggucacauugcugccaugcucuauuau

SEQ ID NO: 41918 - RNA, 33 nt, Artificial Sequence
  Synthetic Oligonucleotide; PDCD1LG2 exon 3; Set C
auuccagggucacauugcugccaugcucuauua

SEQ ID NO: 41919 - RNA, 39 nt, Artificial Sequence
  Synthetic Oligonucleotide; PDCD1LG2 exon 3; Set C
ugcauuccagggucacauugcugccaugcucuauuaugu

SEQ ID NO: 41920 - RNA, 36 nt, Artificial Sequence
  Synthetic Oligonucleotide; PDCD1LG2 exon 3; Set C
gcauuccagggucacauugcugccaugcucuauuau

SEQ ID NO: 41921 - RNA, 34 nt, Artificial Sequence
  Synthetic Oligonucleotide; PDCD1LG2 exon 3; Set C
cauuccagggucacauugcugccaugcucuauua

SEQ ID NO: 41922 - RNA, 40 nt, Artificial Sequence
  Synthetic Oligonucleotide; PDCD1LG2 exon 3; Set C
uugcauuccagggucacauugcugccaugcucuauuaugu

SEQ ID NO: 41923 - RNA, 37 nt, Artificial Sequence
  Synthetic Oligonucleotide; PDCD1LG2 exon 3; Set C
ugcauuccagggucacauugcugccaugcucuauuau

SEQ ID NO: 41924 - RNA, 35 nt, Artificial Sequence
  Synthetic Oligonucleotide; PDCD1LG2 exon 3; Set C
gcauuccagggucacauugcugccaugcucuauua

SEQ ID NO: 41925 - RNA, 39 nt, Artificial Sequence
  Synthetic Oligonucleotide; PDCD1LG2 exon 3; Set C
uugcauuccagggucacauugcugccaugcucuauuaug

SEQ ID NO: 41926 - RNA, 38 nt, Artificial Sequence
  Synthetic Oligonucleotide; PDCD1LG2 exon 3; Set C
uugcauuccagggucacauugcugccaugcucuauuau

SEQ ID NO: 41927 - RNA, 36 nt, Artificial Sequence
  Synthetic Oligonucleotide; PDCD1LG2 exon 3; Set C
ugcauuccagggucacauugcugccaugcucuauua

SEQ ID NO: 41928 - RNA, 40 nt, Artificial Sequence
  Synthetic Oligonucleotide; PDCD1LG2 exon 3; Set C
guugcauuccagggucacauugcugccaugcucuauuaug

SEQ ID NO: 41929 - RNA, 39 nt, Artificial Sequence
  Synthetic Oligonucleotide; PDCD1LG2 exon 3; Set C
guugcauuccagggucacauugcugccaugcucuauuau

SEQ ID NO: 41930 - RNA, 37 nt, Artificial Sequence
  Synthetic Oligonucleotide; PDCD1LG2 exon 3; Set C
uugcauuccagggucacauugcugccaugcucuauua

SEQ ID NO: 41931 - RNA, 40 nt, Artificial Sequence
  Synthetic Oligonucleotide; PDCD1LG2 exon 3; Set C
aguugcauuccagggucacauugcugccaugcucuauuau

SEQ ID NO: 41932 - RNA, 38 nt, Artificial Sequence
  Synthetic Oligonucleotide; PDCD1LG2 exon 3; Set C
guugcauuccagggucacauugcugccaugcucuauua

SEQ ID NO: 41933 - RNA, 39 nt, Artificial Sequence
  Synthetic Oligonucleotide; PDCD1LG2 exon 3; Set C
aguugcauuccagggucacauugcugccaugcucuauua

SEQ ID NO: 41934 - RNA, 40 nt, Artificial Sequence
  Synthetic Oligonucleotide; PDCD1LG2 exon 3; Set C
aaguugcauuccagggucacauugcugccaugcucuauua

SEQ ID NO: 41935 - RNA, 15 nt, Artificial Sequence
  Synthetic Oligonucleotide; PDCD1LG2 exon 3; Set C
uuuuccaccuuuugc

SEQ ID NO: 41936 - RNA, 40 nt, Artificial Sequence
  Synthetic Oligonucleotide; PDCD1LG2 exon 3; Set C
uggggauguaucauuuuccaccuuuugcaaacuggcuguu

SEQ ID NO: 41937 - RNA, 39 nt, Artificial Sequence
  Synthetic Oligonucleotide; PDCD1LG2 exon 3; Set C
uggggauguaucauuuuccaccuuuugcaaacuggcugu

SEQ ID NO: 41938 - RNA, 40 nt, Artificial Sequence
  Synthetic Oligonucleotide; PDCD1LG2 exon 3; Set C
guggggauguaucauuuuccaccuuuugcaaacuggcugu

SEQ ID NO: 41939 - RNA, 38 nt, Artificial Sequence
  Synthetic Oligonucleotide; PDCD1LG2 exon 3; Set C
uggggauguaucauuuuccaccuuuugcaaacuggcug

SEQ ID NO: 41940 - RNA, 39 nt, Artificial Sequence
  Synthetic Oligonucleotide; PDCD1LG2 exon 3; Set C
guggggauguaucauuuuccaccuuuugcaaacuggcug

SEQ ID NO: 41941 - RNA, 37 nt, Artificial Sequence
  Synthetic Oligonucleotide; PDCD1LG2 exon 3; Set C
uggggauguaucauuuuccaccuuuugcaaacuggcu

SEQ ID NO: 41942 - RNA, 15 nt, Artificial Sequence
  Synthetic Oligonucleotide; PDCD1LG2 exon 3; Set C
cauuuuccaccuuuu

SEQ ID NO: 41943 - RNA, 38 nt, Artificial Sequence
  Synthetic Oligonucleotide; PDCD1LG2 exon 3; Set C
guggggauguaucauuuuccaccuuuugcaaacuggcu

SEQ ID NO: 41944 - RNA, 36 nt, Artificial Sequence
  Synthetic Oligonucleotide; PDCD1LG2 exon 3; Set C
uggggauguaucauuuuccaccuuuugcaaacuggc

SEQ ID NO: 41945 - RNA, 37 nt, Artificial Sequence
  Synthetic Oligonucleotide; PDCD1LG2 exon 3; Set C
guggggauguaucauuuuccaccuuuugcaaacuggc

SEQ ID NO: 41946 - RNA, 35 nt, Artificial Sequence
  Synthetic Oligonucleotide; PDCD1LG2 exon 3; Set C
uggggauguaucauuuuccaccuuuugcaaacugg

SEQ ID NO: 41947 - RNA, 36 nt, Artificial Sequence
  Synthetic Oligonucleotide; PDCD1LG2 exon 3; Set C
guggggauguaucauuuuccaccuuuugcaaacugg

SEQ ID NO: 41948 - RNA, 34 nt, Artificial Sequence
  Synthetic Oligonucleotide; PDCD1LG2 exon 3; Set C
uggggauguaucauuuuccaccuuuugcaaacug

SEQ ID NO: 41949 - RNA, 37 nt, Artificial Sequence
  Synthetic Oligonucleotide; PDCD1LG2 exon 3; Set C
uguggggauguaucauuuuccaccuuuugcaaacugg

SEQ ID NO: 41950 - RNA, 35 nt, Artificial Sequence
  Synthetic Oligonucleotide; PDCD1LG2 exon 3; Set C
guggggauguaucauuuuccaccuuuugcaaacug

SEQ ID NO: 41951 - RNA, 33 nt, Artificial Sequence
  Synthetic Oligonucleotide; PDCD1LG2 exon 3; Set C
uggggauguaucauuuuccaccuuuugcaaacu

SEQ ID NO: 41952 - RNA, 23 nt, Artificial Sequence
  Synthetic Oligonucleotide; PDCD1LG2 exon 3; Set C
auguaucauuuuccaccuuuugc

SEQ ID NO: 41953 - RNA, 36 nt, Artificial Sequence
  Synthetic Oligonucleotide; PDCD1LG2 exon 3; Set C
uguggggauguaucauuuuccaccuuuugcaaacug

SEQ ID NO: 41954 - RNA, 34 nt, Artificial Sequence
  Synthetic Oligonucleotide; PDCD1LG2 exon 3; Set C
guggggauguaucauuuuccaccuuuugcaaacu

SEQ ID NO: 41955 - RNA, 22 nt, Artificial Sequence
  Synthetic Oligonucleotide; PDCD1LG2 exon 3; Set C
auguaucauuuuccaccuuuug

SEQ ID NO: 41956 - RNA, 35 nt, Artificial Sequence
  Synthetic Oligonucleotide; PDCD1LG2 exon 3; Set C
uguggggauguaucauuuuccaccuuuugcaaacu

SEQ ID NO: 41957 - RNA, 21 nt, Artificial Sequence
  Synthetic Oligonucleotide; PDCD1LG2 exon 3; Set C
auguaucauuuuccaccuuuu

SEQ ID NO: 41958 - RNA, 30 nt, Artificial Sequence
  Synthetic Oligonucleotide; PDCD1LG2 exon 3; Set C
uguggggauguaucauuuuccaccuuuugc

SEQ ID NO: 41959 - RNA, 29 nt, Artificial Sequence
  Synthetic Oligonucleotide; PDCD1LG2 exon 3; Set A
uguggggauguaucauuuuccaccuuuug

SEQ ID NO: 41960 - RNA, 28 nt, Artificial Sequence
  Synthetic Oligonucleotide; PDCD1LG2 exon 3; Set A
uguggggauguaucauuuuccaccuuuu

SEQ ID NO: 41961 - RNA, 37 nt, Artificial Sequence
  Synthetic Oligonucleotide; PDCD1LG2 exon 3; Set C
uucacgguguggggauguaucauuuuccaccuuuugc

SEQ ID NO: 41962 - RNA, 36 nt, Artificial Sequence
  Synthetic Oligonucleotide; PDCD1LG2 exon 3; Set C
uucacgguguggggauguaucauuuuccaccuuuug

SEQ ID NO: 41963 - RNA, 35 nt, Artificial Sequence
  Synthetic Oligonucleotide; PDCD1LG2 exon 3; Set C
uucacgguguggggauguaucauuuuccaccuuuu

SEQ ID NO: 41964 - RNA, 39 nt, Artificial Sequence
  Synthetic Oligonucleotide; PDCD1LG2 exon 3; Set C
cuuucacgguguggggauguaucauuuuccaccuuuugc

SEQ ID NO: 41965 - RNA, 16 nt, Artificial Sequence
  Synthetic Oligonucleotide; PDCD1LG2 exon 3; Set C
uggggauguaucauuu

SEQ ID NO: 41966 - RNA, 40 nt, Artificial Sequence
  Synthetic Oligonucleotide; PDCD1LG2 exon 3; Set C
ucuuucacgguguggggauguaucauuuuccaccuuuugc

SEQ ID NO: 41967 - RNA, 15 nt, Artificial Sequence
  Synthetic Oligonucleotide; PDCD1LG2 exon 3; Set C
uggggauguaucauu

SEQ ID NO: 41968 - RNA, 39 nt, Artificial Sequence
  Synthetic Oligonucleotide; PDCD1LG2 exon 3; Set C
ucuuucacgguguggggauguaucauuuuccaccuuuug

SEQ ID NO: 41969 - RNA, 37 nt, Artificial Sequence
  Synthetic Oligonucleotide; PDCD1LG2 exon 3; Set C
cuuucacgguguggggauguaucauuuuccaccuuuu

SEQ ID NO: 41970 - RNA, 16 nt, Artificial Sequence
  Synthetic Oligonucleotide; PDCD1LG2 exon 3; Set C
guggggauguaucauu

SEQ ID NO: 41971 - RNA, 40 nt, Artificial Sequence
  Synthetic Oligonucleotide; PDCD1LG2 exon 3; Set C
cucuuucacgguguggggauguaucauuuuccaccuuuug

SEQ ID NO: 41972 - RNA, 38 nt, Artificial Sequence
  Synthetic Oligonucleotide; PDCD1LG2 exon 3; Set C
ucuuucacgguguggggauguaucauuuuccaccuuuu

SEQ ID NO: 41973 - RNA, 15 nt, Artificial Sequence
  Synthetic Oligonucleotide; PDCD1LG2 exon 3; Set C
guggggauguaucau

SEQ ID NO: 41974 - RNA, 39 nt, Artificial Sequence
  Synthetic Oligonucleotide; PDCD1LG2 exon 3; Set C
cucuuucacgguguggggauguaucauuuuccaccuuuu

SEQ ID NO: 41975 - RNA, 40 nt, Artificial Sequence
  Synthetic Oligonucleotide; PDCD1LG2 exon 3; Set C
gcucuuucacgguguggggauguaucauuuuccaccuuuu

SEQ ID NO: 41976 - RNA, 27 nt, Artificial Sequence
  Synthetic Oligonucleotide; PDCD1LG2 exon 3; Set A
ucacgguguggggauguaucauuuucc

SEQ ID NO: 41977 - RNA, 26 nt, Artificial Sequence
  Synthetic Oligonucleotide; PDCD1LG2 exon 3; Set A
ucacgguguggggauguaucauuuuc

SEQ ID NO: 41978 - RNA, 25 nt, Artificial Sequence
  Synthetic Oligonucleotide; PDCD1LG2 exon 3; Set A
ucacgguguggggauguaucauuuu

SEQ ID NO: 41979 - RNA, 34 nt, Artificial Sequence
  Synthetic Oligonucleotide; PDCD1LG2 exon 3; Set C
ggcucuuucacgguguggggauguaucauuuucc

SEQ ID NO: 41980 - RNA, 35 nt, Artificial Sequence
  Synthetic Oligonucleotide; PDCD1LG2 exon 3; Set C
uggcucuuucacgguguggggauguaucauuuucc

SEQ ID NO: 41981 - RNA, 33 nt, Artificial Sequence
  Synthetic Oligonucleotide; PDCD1LG2 exon 3; Set C
ggcucuuucacgguguggggauguaucauuuuc

SEQ ID NO: 41982 - RNA, 21 nt, Artificial Sequence
  Synthetic Oligonucleotide; PDCD1LG2 exon 3; Set A
uucacgguguggggauguauc

SEQ ID NO: 41983 - RNA, 32 nt, Artificial Sequence
  Synthetic Oligonucleotide; PDCD1LG2 exon 3; Set C
ggcucuuucacgguguggggauguaucauuuu

SEQ ID NO: 41984 - RNA, 34 nt, Artificial Sequence
  Synthetic Oligonucleotide; PDCD1LG2 exon 3; Set C
uggcucuuucacgguguggggauguaucauuuuc

SEQ ID NO: 41985 - RNA, 20 nt, Artificial Sequence
  Synthetic Oligonucleotide; PDCD1LG2 exon 3; Set A
uucacgguguggggauguau

SEQ ID NO: 41986 - RNA, 33 nt, Artificial Sequence
  Synthetic Oligonucleotide; PDCD1LG2 exon 3; Set C
uggcucuuucacgguguggggauguaucauuuu

SEQ ID NO: 41987 - RNA, 31 nt, Artificial Sequence
  Synthetic Oligonucleotide; PDCD1LG2 exon 3; Set C
ggcucuuucacgguguggggauguaucauuu

SEQ ID NO: 41988 - RNA, 19 nt, Artificial Sequence
  Synthetic Oligonucleotide; PDCD1LG2 exon 3; Set A
uucacgguguggggaugua

SEQ ID NO: 41989 - RNA, 32 nt, Artificial Sequence
  Synthetic Oligonucleotide; PDCD1LG2 exon 3; Set C
uggcucuuucacgguguggggauguaucauuu

SEQ ID NO: 41990 - RNA, 30 nt, Artificial Sequence
  Synthetic Oligonucleotide; PDCD1LG2 exon 3; Set C
ggcucuuucacgguguggggauguaucauu

SEQ ID NO: 41991 - RNA, 31 nt, Artificial Sequence
  Synthetic Oligonucleotide; PDCD1LG2 exon 3; Set C
uggcucuuucacgguguggggauguaucauu

SEQ ID NO: 41992 - RNA, 29 nt, Artificial Sequence
  Synthetic Oligonucleotide; PDCD1LG2 exon 3; Set C
ggcucuuucacgguguggggauguaucau

SEQ ID NO: 41993 - RNA, 30 nt, Artificial Sequence
  Synthetic Oligonucleotide; PDCD1LG2 exon 3; Set C
uggcucuuucacgguguggggauguaucau

SEQ ID NO: 41994 - RNA, 28 nt, Artificial Sequence
  Synthetic Oligonucleotide; PDCD1LG2 exon 3; Set C
ggcucuuucacgguguggggauguauca

SEQ ID NO: 41995 - RNA, 29 nt, Artificial Sequence
  Synthetic Oligonucleotide; PDCD1LG2 exon 3; Set C
uggcucuuucacgguguggggauguauca

SEQ ID NO: 41996 - RNA, 27 nt, Artificial Sequence
  Synthetic Oligonucleotide; PDCD1LG2 exon 3; Set C
ggcucuuucacgguguggggauguauc

SEQ ID NO: 41997 - RNA, 19 nt, Artificial Sequence
  Synthetic Oligonucleotide; PDCD1LG2 exon 3; Set A
cuuucacgguguggggaug

SEQ ID NO: 41998 - RNA, 28 nt, Artificial Sequence
  Synthetic Oligonucleotide; PDCD1LG2 exon 3; Set C
uggcucuuucacgguguggggauguauc

SEQ ID NO: 41999 - RNA, 26 nt, Artificial Sequence
  Synthetic Oligonucleotide; PDCD1LG2 exon 3; Set C
ggcucuuucacgguguggggauguau

SEQ ID NO: 42000 - RNA, 20 nt, Artificial Sequence
  Synthetic Oligonucleotide; PDCD1LG2 exon 3; Set A
ucuuucacgguguggggaug

SEQ ID NO: 42001 - RNA, 27 nt, Artificial Sequence
  Synthetic Oligonucleotide; PDCD1LG2 exon 3; Set C
uggcucuuucacgguguggggauguau

SEQ ID NO: 42002 - RNA, 21 nt, Artificial Sequence
  Synthetic Oligonucleotide; PDCD1LG2 exon 3; Set A
cucuuucacgguguggggaug

SEQ ID NO: 42003 - RNA, 24 nt, Artificial Sequence
  Synthetic Oligonucleotide; PDCD1LG2 exon 3; Set C
ggcucuuucacgguguggggaugu

SEQ ID NO: 42004 - RNA, 26 nt, Artificial Sequence
  Synthetic Oligonucleotide; PDCD1LG2 exon 3; Set C
uggcucuuucacgguguggggaugua

SEQ ID NO: 42005 - RNA, 22 nt, Artificial Sequence
  Synthetic Oligonucleotide; PDCD1LG2 exon 3; Set A
gcucuuucacgguguggggaug

SEQ ID NO: 42006 - RNA, 25 nt, Artificial Sequence
  Synthetic Oligonucleotide; PDCD1LG2 exon 3; Set C
uggcucuuucacgguguggggaugu

SEQ ID NO: 42007 - RNA, 25 nt, Artificial Sequence
  Synthetic Oligonucleotide; PDCD1LG2 exon 3; Set C
guggcucuuucacgguguggggaug

SEQ ID NO: 42008 - RNA, 15 nt, Artificial Sequence
  Synthetic Oligonucleotide; PDCD1LG2 exon 3; Set C
ucuuucacggugugg

SEQ ID NO: 42009 - RNA, 16 nt, Artificial Sequence
  Synthetic Oligonucleotide; PDCD1LG2 exon 3; Set C
cucuuucacggugugg

SEQ ID NO: 42010 - RNA, 15 nt, Artificial Sequence
  Synthetic Oligonucleotide; PDCD1LG2 exon 3; Set C
cucuuucacggugug

SEQ ID NO: 42011 - RNA, 28 nt, Artificial Sequence
  Synthetic Oligonucleotide; PDCD1LG2 exon 3; Set C
aaaguggcucuuucacgguguggggaug

SEQ ID NO: 42012 - RNA, 16 nt, Artificial Sequence
  Synthetic Oligonucleotide; PDCD1LG2 exon 3; Set C
gcucuuucacggugug

SEQ ID NO: 42013 - RNA, 29 nt, Artificial Sequence
  Synthetic Oligonucleotide; PDCD1LG2 exon 3; Set C
caaaguggcucuuucacgguguggggaug

SEQ ID NO: 42014 - RNA, 15 nt, Artificial Sequence
  Synthetic Oligonucleotide; PDCD1LG2 exon 3; Set C
gcucuuucacggugu

SEQ ID NO: 42015 - RNA, 30 nt, Artificial Sequence
  Synthetic Oligonucleotide; PDCD1LG2 exon 3; Set C
gcaaaguggcucuuucacgguguggggaug

SEQ ID NO: 42016 - RNA, 20 nt, Artificial Sequence
  Synthetic Oligonucleotide; PDCD1LG2 exon 3; Set A
guggcucuuucacggugugg

SEQ ID NO: 42017 - RNA, 15 nt, Artificial Sequence
  Synthetic Oligonucleotide; PDCD1LG2 exon 3; Set C
ggcucuuucacggug

SEQ ID NO: 42018 - RNA, 19 nt, Artificial Sequence
  Synthetic Oligonucleotide; PDCD1LG2 exon 3; Set A
guggcucuuucacggugug

SEQ ID NO: 42019 - RNA, 16 nt, Artificial Sequence
  Synthetic Oligonucleotide; PDCD1LG2 exon 3; Set C
uggcucuuucacggug

SEQ ID NO: 42020 - RNA, 18 nt, Artificial Sequence
  Synthetic Oligonucleotide; PDCD1LG2 exon 3; Set A
guggcucuuucacggugu

SEQ ID NO: 42021 - RNA, 15 nt, Artificial Sequence
  Synthetic Oligonucleotide; PDCD1LG2 exon 3; Set C
uggcucuuucacggu

SEQ ID NO: 42022 - RNA, 23 nt, Artificial Sequence
  Synthetic Oligonucleotide; PDCD1LG2 exon 3; Set A
aaaguggcucuuucacggugugg

SEQ ID NO: 42023 - RNA, 22 nt, Artificial Sequence
  Synthetic Oligonucleotide; PDCD1LG2 exon 3; Set A
aaaguggcucuuucacggugug

SEQ ID NO: 42024 - RNA, 37 nt, Artificial Sequence
  Synthetic Oligonucleotide; PDCD1LG2 exon 3; Set C
ccuccagcaaaguggcucuuucacgguguggggaugu

SEQ ID NO: 42025 - RNA, 21 nt, Artificial Sequence
  Synthetic Oligonucleotide; PDCD1LG2 exon 3; Set C
aaaguggcucuuucacggugu

SEQ ID NO: 42026 - RNA, 23 nt, Artificial Sequence
  Synthetic Oligonucleotide; PDCD1LG2 exon 3; Set A
caaaguggcucuuucacggugug

SEQ ID NO: 42027 - RNA, 38 nt, Artificial Sequence
  Synthetic Oligonucleotide; PDCD1LG2 exon 3; Set C
uccuccagcaaaguggcucuuucacgguguggggaugu

SEQ ID NO: 42028 - RNA, 22 nt, Artificial Sequence
  Synthetic Oligonucleotide; PDCD1LG2 exon 3; Set A
caaaguggcucuuucacggugu

SEQ ID NO: 42029 - RNA, 24 nt, Artificial Sequence
  Synthetic Oligonucleotide; PDCD1LG2 exon 3; Set A
gcaaaguggcucuuucacggugug

SEQ ID NO: 42030 - RNA, 23 nt, Artificial Sequence
  Synthetic Oligonucleotide; PDCD1LG2 exon 3; Set A
gcaaaguggcucuuucacggugu

SEQ ID NO: 42031 - RNA, 39 nt, Artificial Sequence
  Synthetic Oligonucleotide; PDCD1LG2 exon 3; Set C
gcuccuccagcaaaguggcucuuucacgguguggggaug

SEQ ID NO: 42032 - RNA, 40 nt, Artificial Sequence
  Synthetic Oligonucleotide; PDCD1LG2 exon 3; Set C
ugcuccuccagcaaaguggcucuuucacgguguggggaug

SEQ ID NO: 42033 - RNA, 15 nt, Artificial Sequence
  Synthetic Oligonucleotide; PDCD1LG2 exon 3; Set C
caaaguggcucuuuc

SEQ ID NO: 42034 - RNA, 28 nt, Artificial Sequence
  Synthetic Oligonucleotide; PDCD1LG2 exon 3; Set C
ccuccagcaaaguggcucuuucacggug

SEQ ID NO: 42035 - RNA, 16 nt, Artificial Sequence
  Synthetic Oligonucleotide; PDCD1LG2 exon 3; Set C
gcaaaguggcucuuuc

SEQ ID NO: 42036 - RNA, 27 nt, Artificial Sequence
  Synthetic Oligonucleotide; PDCD1LG2 exon 3; Set C
ccuccagcaaaguggcucuuucacggu

SEQ ID NO: 42037 - RNA, 29 nt, Artificial Sequence
  Synthetic Oligonucleotide; PDCD1LG2 exon 3; Set C
uccuccagcaaaguggcucuuucacggug

SEQ ID NO: 42038 - RNA, 28 nt, Artificial Sequence
  Synthetic Oligonucleotide; PDCD1LG2 exon 3; Set C
uccuccagcaaaguggcucuuucacggu

SEQ ID NO: 42039 - RNA, 30 nt, Artificial Sequence
  Synthetic Oligonucleotide; PDCD1LG2 exon 3; Set C
cuccuccagcaaaguggcucuuucacggug

SEQ ID NO: 42040 - RNA, 32 nt, Artificial Sequence
  Synthetic Oligonucleotide; PDCD1LG2 exon 3; Set C
gcuccuccagcaaaguggcucuuucacggugu

SEQ ID NO: 42041 - RNA, 29 nt, Artificial Sequence
  Synthetic Oligonucleotide; PDCD1LG2 exon 3; Set C
cuccuccagcaaaguggcucuuucacggu

SEQ ID NO: 42042 - RNA, 33 nt, Artificial Sequence
  Synthetic Oligonucleotide; PDCD1LG2 exon 3; Set C
ugcuccuccagcaaaguggcucuuucacggugu

SEQ ID NO: 42043 - RNA, 37 nt, Artificial Sequence
  Synthetic Oligonucleotide; PDCD1LG2 exon 3; Set C
gcugcuccuccagcaaaguggcucuuucacggugugg

SEQ ID NO: 42044 - RNA, 34 nt, Artificial Sequence
  Synthetic Oligonucleotide; PDCD1LG2 exon 3; Set C
cugcuccuccagcaaaguggcucuuucacggugu

SEQ ID NO: 42045 - RNA, 36 nt, Artificial Sequence
  Synthetic Oligonucleotide; PDCD1LG2 exon 3; Set C
gcugcuccuccagcaaaguggcucuuucacggugug

SEQ ID NO: 42046 - RNA, 38 nt, Artificial Sequence
  Synthetic Oligonucleotide; PDCD1LG2 exon 3; Set C
agcugcuccuccagcaaaguggcucuuucacggugugg

SEQ ID NO: 42047 - RNA, 37 nt, Artificial Sequence
  Synthetic Oligonucleotide; PDCD1LG2 exon 3; Set C
agcugcuccuccagcaaaguggcucuuucacggugug

SEQ ID NO: 42048 - RNA, 21 nt, Artificial Sequence
  Synthetic Oligonucleotide; PDCD1LG2 exon 3; Set A
ccuccagcaaaguggcucuuu

SEQ ID NO: 42049 - RNA, 37 nt, Artificial Sequence
  Synthetic Oligonucleotide; PDCD1LG2 exon 3; Set C
cagcugcuccuccagcaaaguggcucuuucacggugu

SEQ ID NO: 42050 - RNA, 22 nt, Artificial Sequence
  Synthetic Oligonucleotide; PDCD1LG2 exon 3; Set A
uccuccagcaaaguggcucuuu

SEQ ID NO: 42051 - RNA, 23 nt, Artificial Sequence
  Synthetic Oligonucleotide; PDCD1LG2 exon 3; Set A
cuccuccagcaaaguggcucuuu

SEQ ID NO: 42052 - RNA, 37 nt, Artificial Sequence
  Synthetic Oligonucleotide; PDCD1LG2 exon 3; Set C
gcagcugcuccuccagcaaaguggcucuuucacggug

SEQ ID NO: 42053 - RNA, 36 nt, Artificial Sequence
  Synthetic Oligonucleotide; PDCD1LG2 exon 3; Set C
gcagcugcuccuccagcaaaguggcucuuucacggu

SEQ ID NO: 42054 - RNA, 26 nt, Artificial Sequence
  Synthetic Oligonucleotide; PDCD1LG2 exon 3; Set A
ugcuccuccagcaaaguggcucuuuc

SEQ ID NO: 42055 - RNA, 23 nt, Artificial Sequence
  Synthetic Oligonucleotide; PDCD1LG2 exon 3; Set A
gcuccuccagcaaaguggcucuu

SEQ ID NO: 42056 - RNA, 27 nt, Artificial Sequence
  Synthetic Oligonucleotide; PDCD1LG2 exon 3; Set C
cugcuccuccagcaaaguggcucuuuc

SEQ ID NO: 42057 - RNA, 24 nt, Artificial Sequence
  Synthetic Oligonucleotide; PDCD1LG2 exon 3; Set A
ugcuccuccagcaaaguggcucuu

SEQ ID NO: 42058 - RNA, 22 nt, Artificial Sequence
  Synthetic Oligonucleotide; PDCD1LG2 exon 3; Set A
gcuccuccagcaaaguggcucu

SEQ ID NO: 42059 - RNA, 25 nt, Artificial Sequence
  Synthetic Oligonucleotide; PDCD1LG2 exon 3; Set C
cugcuccuccagcaaaguggcucuu

SEQ ID NO: 42060 - RNA, 23 nt, Artificial Sequence
  Synthetic Oligonucleotide; PDCD1LG2 exon 3; Set A
ugcuccuccagcaaaguggcucu

SEQ ID NO: 42061 - RNA, 21 nt, Artificial Sequence
  Synthetic Oligonucleotide; PDCD1LG2 exon 3; Set A
gcuccuccagcaaaguggcuc

SEQ ID NO: 42062 - RNA, 29 nt, Artificial Sequence
  Synthetic Oligonucleotide; PDCD1LG2 exon 3; Set C
agcugcuccuccagcaaaguggcucuuuc

SEQ ID NO: 42063 - RNA, 24 nt, Artificial Sequence
  Synthetic Oligonucleotide; PDCD1LG2 exon 3; Set C
cugcuccuccagcaaaguggcucu

SEQ ID NO: 42064 - RNA, 22 nt, Artificial Sequence
  Synthetic Oligonucleotide; PDCD1LG2 exon 3; Set A
ugcuccuccagcaaaguggcuc

SEQ ID NO: 42065 - RNA, 23 nt, Artificial Sequence
  Synthetic Oligonucleotide; PDCD1LG2 exon 3; Set A
cugcuccuccagcaaaguggcuc

SEQ ID NO: 42066 - RNA, 21 nt, Artificial Sequence
  Synthetic Oligonucleotide; PDCD1LG2 exon 3; Set A
ugcuccuccagcaaaguggcu

SEQ ID NO: 42067 - RNA, 30 nt, Artificial Sequence
  Synthetic Oligonucleotide; PDCD1LG2 exon 3; Set C
gcagcugcuccuccagcaaaguggcucuuu

SEQ ID NO: 42068 - RNA, 28 nt, Artificial Sequence
  Synthetic Oligonucleotide; PDCD1LG2 exon 3; Set C
cagcugcuccuccagcaaaguggcucuu

SEQ ID NO: 42069 - RNA, 22 nt, Artificial Sequence
  Synthetic Oligonucleotide; PDCD1LG2 exon 3; Set A
cugcuccuccagcaaaguggcu

SEQ ID NO: 42070 - RNA, 27 nt, Artificial Sequence
  Synthetic Oligonucleotide; PDCD1LG2 exon 3; Set C
cagcugcuccuccagcaaaguggcucu

SEQ ID NO: 42071 - RNA, 17 nt, Artificial Sequence
  Synthetic Oligonucleotide; PDCD1LG2 exon 3; Set C
gcuccuccagcaaagug

SEQ ID NO: 42072 - RNA, 26 nt, Artificial Sequence
  Synthetic Oligonucleotide; PDCD1LG2 exon 3; Set C
cagcugcuccuccagcaaaguggcuc

SEQ ID NO: 42073 - RNA, 18 nt, Artificial Sequence
  Synthetic Oligonucleotide; PDCD1LG2 exon 3; Set C
ugcuccuccagcaaagug

SEQ ID NO: 42074 - RNA, 19 nt, Artificial Sequence
  Synthetic Oligonucleotide; PDCD1LG2 exon 3; Set C
cugcuccuccagcaaagug

SEQ ID NO: 42075 - RNA, 25 nt, Artificial Sequence
  Synthetic Oligonucleotide; PDCD1LG2 exon 3; Set C
cagcugcuccuccagcaaaguggcu

SEQ ID NO: 42076 - RNA, 36 nt, Artificial Sequence
  Synthetic Oligonucleotide; PDCD1LG2 exon 3; Set C
uaggggcagcugcuccuccagcaaaguggcucuuuc

SEQ ID NO: 42077 - RNA, 33 nt, Artificial Sequence
  Synthetic Oligonucleotide; PDCD1LG2 exon 3; Set C
aggggcagcugcuccuccagcaaaguggcucuu

SEQ ID NO: 42078 - RNA, 15 nt, Artificial Sequence
  Synthetic Oligonucleotide; PDCD1LG2 exon 3; Set C
ugcuccuccagcaaa

SEQ ID NO: 42079 - RNA, 37 nt, Artificial Sequence
  Synthetic Oligonucleotide; PDCD1LG2 exon 3; Set C
cuaggggcagcugcuccuccagcaaaguggcucuuuc

SEQ ID NO: 42080 - RNA, 22 nt, Artificial Sequence
  Synthetic Oligonucleotide; PDCD1LG2 exon 3; Set A
cagcugcuccuccagcaaagug

SEQ ID NO: 42081 - RNA, 16 nt, Artificial Sequence
  Synthetic Oligonucleotide; PDCD1LG2 exon 3; Set C
cugcuccuccagcaaa

SEQ ID NO: 42082 - RNA, 38 nt, Artificial Sequence
  Synthetic Oligonucleotide; PDCD1LG2 exon 3; Set C
ccuaggggcagcugcuccuccagcaaaguggcucuuuc

SEQ ID NO: 42083 - RNA, 39 nt, Artificial Sequence
  Synthetic Oligonucleotide; PDCD1LG2 exon 3; Set C
cccuaggggcagcugcuccuccagcaaaguggcucuuuc

SEQ ID NO: 42084 - RNA, 22 nt, Artificial Sequence
  Synthetic Oligonucleotide; PDCD1LG2 exon 3; Set A
gcagcugcuccuccagcaaagu

SEQ ID NO: 42085 - RNA, 16 nt, Artificial Sequence
  Synthetic Oligonucleotide; PDCD1LG2 exon 3; Set A
gcugcuccuccagcaa

SEQ ID NO: 42086 - RNA, 40 nt, Artificial Sequence
  Synthetic Oligonucleotide; PDCD1LG2 exon 3; Set C
ucccuaggggcagcugcuccuccagcaaaguggcucuuuc

SEQ ID NO: 42087 - RNA, 21 nt, Artificial Sequence
  Synthetic Oligonucleotide; PDCD1LG2 exon 3; Set A
gcagcugcuccuccagcaaag

SEQ ID NO: 42088 - RNA, 19 nt, Artificial Sequence
  Synthetic Oligonucleotide; PDCD1LG2 exon 3; Set A
cagcugcuccuccagcaaa

SEQ ID NO: 42089 - RNA, 31 nt, Artificial Sequence
  Synthetic Oligonucleotide; PDCD1LG2 exon 3; Set C
uaggggcagcugcuccuccagcaaaguggcu

SEQ ID NO: 42090 - RNA, 17 nt, Artificial Sequence
  Synthetic Oligonucleotide; PDCD1LG2 exon 3; Set A
agcugcuccuccagcaa

SEQ ID NO: 42091 - RNA, 15 nt, Artificial Sequence
  Synthetic Oligonucleotide; PDCD1LG2 exon 3; Set A
gcugcuccuccagca

SEQ ID NO: 42092 - RNA, 32 nt, Artificial Sequence
  Synthetic Oligonucleotide; PDCD1LG2 exon 3; Set C
cuaggggcagcugcuccuccagcaaaguggcu

SEQ ID NO: 42093 - RNA, 16 nt, Artificial Sequence
  Synthetic Oligonucleotide; PDCD1LG2 exon 3; Set A
agcugcuccuccagca

SEQ ID NO: 42094 - RNA, 33 nt, Artificial Sequence
  Synthetic Oligonucleotide; PDCD1LG2 exon 3; Set C
ccuaggggcagcugcuccuccagcaaaguggcu

SEQ ID NO: 42095 - RNA, 26 nt, Artificial Sequence
  Synthetic Oligonucleotide; PDCD1LG2 exon 3; Set C
aggggcagcugcuccuccagcaaagu

SEQ ID NO: 42096 - RNA, 28 nt, Artificial Sequence
  Synthetic Oligonucleotide; PDCD1LG2 exon 3; Set C
uaggggcagcugcuccuccagcaaagug

SEQ ID NO: 42097 - RNA, 34 nt, Artificial Sequence
  Synthetic Oligonucleotide; PDCD1LG2 exon 3; Set C
cccuaggggcagcugcuccuccagcaaaguggcu

SEQ ID NO: 42098 - RNA, 25 nt, Artificial Sequence
  Synthetic Oligonucleotide; PDCD1LG2 exon 3; Set C
aggggcagcugcuccuccagcaaag

SEQ ID NO: 42099 - RNA, 29 nt, Artificial Sequence
  Synthetic Oligonucleotide; PDCD1LG2 exon 3; Set C
cuaggggcagcugcuccuccagcaaagug

SEQ ID NO: 42100 - RNA, 35 nt, Artificial Sequence
  Synthetic Oligonucleotide; PDCD1LG2 exon 3; Set C
ucccuaggggcagcugcuccuccagcaaaguggcu

SEQ ID NO: 42101 - RNA, 25 nt, Artificial Sequence
  Synthetic Oligonucleotide; PDCD1LG2 exon 3; Set C
uaggggcagcugcuccuccagcaaa

SEQ ID NO: 42102 - RNA, 26 nt, Artificial Sequence
  Synthetic Oligonucleotide; PDCD1LG2 exon 3; Set C
cuaggggcagcugcuccuccagcaaa

SEQ ID NO: 42103 - RNA, 24 nt, Artificial Sequence
  Synthetic Oligonucleotide; PDCD1LG2 exon 3; Set C
uaggggcagcugcuccuccagcaa

SEQ ID NO: 42104 - RNA, 27 nt, Artificial Sequence
  Synthetic Oligonucleotide; PDCD1LG2 exon 3; Set C
ccuaggggcagcugcuccuccagcaaa

SEQ ID NO: 42105 - RNA, 25 nt, Artificial Sequence
  Synthetic Oligonucleotide; PDCD1LG2 exon 3; Set C
cuaggggcagcugcuccuccagcaa

SEQ ID NO: 42106 - RNA, 23 nt, Artificial Sequence
  Synthetic Oligonucleotide; PDCD1LG2 exon 3; Set C
uaggggcagcugcuccuccagca

SEQ ID NO: 42107 - RNA, 28 nt, Artificial Sequence
  Synthetic Oligonucleotide; PDCD1LG2 exon 3; Set C
cccuaggggcagcugcuccuccagcaaa

SEQ ID NO: 42108 - RNA, 26 nt, Artificial Sequence
  Synthetic Oligonucleotide; PDCD1LG2 exon 3; Set C
ccuaggggcagcugcuccuccagcaa

SEQ ID NO: 42109 - RNA, 24 nt, Artificial Sequence
  Synthetic Oligonucleotide; PDCD1LG2 exon 3; Set C
cuaggggcagcugcuccuccagca

SEQ ID NO: 42110 - RNA, 29 nt, Artificial Sequence
  Synthetic Oligonucleotide; PDCD1LG2 exon 3; Set C
ucccuaggggcagcugcuccuccagcaaa

SEQ ID NO: 42111 - RNA, 27 nt, Artificial Sequence
  Synthetic Oligonucleotide; PDCD1LG2 exon 3; Set C
cccuaggggcagcugcuccuccagcaa

SEQ ID NO: 42112 - RNA, 25 nt, Artificial Sequence
  Synthetic Oligonucleotide; PDCD1LG2 exon 3; Set C
ccuaggggcagcugcuccuccagca

SEQ ID NO: 42113 - RNA, 28 nt, Artificial Sequence
  Synthetic Oligonucleotide; PDCD1LG2 exon 3; Set C
ucccuaggggcagcugcuccuccagcaa

SEQ ID NO: 42114 - RNA, 26 nt, Artificial Sequence
  Synthetic Oligonucleotide; PDCD1LG2 exon 3; Set C
cccuaggggcagcugcuccuccagca

SEQ ID NO: 42115 - RNA, 29 nt, Artificial Sequence
  Synthetic Oligonucleotide; PDCD1LG2 exon 3; Set C
uucccuaggggcagcugcuccuccagcaa

SEQ ID NO: 42116 - RNA, 27 nt, Artificial Sequence
  Synthetic Oligonucleotide; PDCD1LG2 exon 3; Set C
ucccuaggggcagcugcuccuccagca

SEQ ID NO: 42117 - RNA, 28 nt, Artificial Sequence
  Synthetic Oligonucleotide; PDCD1LG2 exon 3; Set C
uucccuaggggcagcugcuccuccagca

SEQ ID NO: 42118 - RNA, 38 nt, Artificial Sequence
  Synthetic Oligonucleotide; PDCD1LG2 exon 3; Set C
gaggccuucccuaggggcagcugcuccuccagcaaagu

SEQ ID NO: 42119 - RNA, 39 nt, Artificial Sequence
  Synthetic Oligonucleotide; PDCD1LG2 exon 3; Set C
cgaggccuucccuaggggcagcugcuccuccagcaaagu

SEQ ID NO: 42120 - RNA, 37 nt, Artificial Sequence
  Synthetic Oligonucleotide; PDCD1LG2 exon 3; Set C
gaggccuucccuaggggcagcugcuccuccagcaaag

SEQ ID NO: 42121 - RNA, 38 nt, Artificial Sequence
  Synthetic Oligonucleotide; PDCD1LG2 exon 3; Set C
cgaggccuucccuaggggcagcugcuccuccagcaaag

SEQ ID NO: 42122 - RNA, 15 nt, Artificial Sequence
  Synthetic Oligonucleotide; PDCD1LG2 exon 3; Set C
cuaggggcagcugcu

SEQ ID NO: 42123 - RNA, 22 nt, Artificial Sequence
  Synthetic Oligonucleotide; PDCD1LG2 exon 3; Set C
uucccuaggggcagcugcuccu

SEQ ID NO: 42124 - RNA, 21 nt, Artificial Sequence
  Synthetic Oligonucleotide; PDCD1LG2 exon 3; Set C
uucccuaggggcagcugcucc

SEQ ID NO: 42125 - RNA, 15 nt, Artificial Sequence
  Synthetic Oligonucleotide; PDCD1LG2 exon 3; Set A
cccuaggggcagcug

SEQ ID NO: 42126 - RNA, 22 nt, Artificial Sequence
  Synthetic Oligonucleotide; PDCD1LG2 exon 3; Set C
gaggccuucccuaggggcagcu

SEQ ID NO: 42127 - RNA, 23 nt, Artificial Sequence
  Synthetic Oligonucleotide; PDCD1LG2 exon 3; Set C
cgaggccuucccuaggggcagcu

SEQ ID NO: 42128 - RNA, 31 nt, Artificial Sequence
  Synthetic Oligonucleotide; PDCD1LG2 exon 3; Set C
uguggaacgaggccuucccuaggggcagcug

SEQ ID NO: 42129 - RNA, 28 nt, Artificial Sequence
  Synthetic Oligonucleotide; PDCD1LG2 exon 3; Set C
uguggaacgaggccuucccuaggggcag

SEQ ID NO: 42130 - RNA, 29 nt, Artificial Sequence
  Synthetic Oligonucleotide; PDCD1LG2 exon 3; Set C
auguggaacgaggccuucccuaggggcag

SEQ ID NO: 42131 - RNA, 30 nt, Artificial Sequence
  Synthetic Oligonucleotide; PDCD1LG2 exon 3; Set C
uauguggaacgaggccuucccuaggggcag

SEQ ID NO: 42132 - RNA, 40 nt, Artificial Sequence
  Synthetic Oligonucleotide; PDCD1LG2 exon 3; Set C
uugagguauguggaacgaggccuucccuaggggcagcugc

SEQ ID NO: 42133 - RNA, 39 nt, Artificial Sequence
  Synthetic Oligonucleotide; PDCD1LG2 exon 3; Set C
uugagguauguggaacgaggccuucccuaggggcagcug

SEQ ID NO: 42134 - RNA, 23 nt, Artificial Sequence
  Synthetic Oligonucleotide; PDCD1LG2 exon 3; Set A
uguggaacgaggccuucccuagg

SEQ ID NO: 42135 - RNA, 24 nt, Artificial Sequence
  Synthetic Oligonucleotide; PDCD1LG2 exon 3; Set A
auguggaacgaggccuucccuagg

SEQ ID NO: 42136 - RNA, 37 nt, Artificial Sequence
  Synthetic Oligonucleotide; PDCD1LG2 exon 3; Set C
uugagguauguggaacgaggccuucccuaggggcagc

SEQ ID NO: 42137 - RNA, 25 nt, Artificial Sequence
  Synthetic Oligonucleotide; PDCD1LG2 exon 3; Set A
uauguggaacgaggccuucccuagg

SEQ ID NO: 42138 - RNA, 18 nt, Artificial Sequence
  Synthetic Oligonucleotide; PDCD1LG2 exon 3; Set A
uguggaacgaggccuucc

SEQ ID NO: 42139 - RNA, 30 nt, Artificial Sequence
  Synthetic Oligonucleotide; PDCD1LG2 exon 3; Set C
uugagguauguggaacgaggccuucccuag

SEQ ID NO: 42140 - RNA, 29 nt, Artificial Sequence
  Synthetic Oligonucleotide; PDCD1LG2 exon 3; Set C
uugagguauguggaacgaggccuucccua

SEQ ID NO: 42141 - RNA, 28 nt, Artificial Sequence
  Synthetic Oligonucleotide; PDCD1LG2 exon 3; Set C
uugagguauguggaacgaggccuucccu

SEQ ID NO: 42142 - RNA, 27 nt, Artificial Sequence
  Synthetic Oligonucleotide; PDCD1LG2 exon 3; Set C
uugagguauguggaacgaggccuuccc

SEQ ID NO: 42143 - RNA, 26 nt, Artificial Sequence
  Synthetic Oligonucleotide; PDCD1LG2 exon 3; Set A
uugagguauguggaacgaggccuucc

SEQ ID NO: 42144 - RNA, 25 nt, Artificial Sequence
  Synthetic Oligonucleotide; PDCD1LG2 exon 3; Set A
uugagguauguggaacgaggccuuc

SEQ ID NO: 42145 - RNA, 39 nt, Artificial Sequence
  Synthetic Oligonucleotide; PDCD1LG2 exon 3; Set C
acuuggacuugagguauguggaacgaggccuucccuagg

SEQ ID NO: 42146 - RNA, 40 nt, Artificial Sequence
  Synthetic Oligonucleotide; PDCD1LG2 exon 3; Set C
cacuuggacuugagguauguggaacgaggccuucccuagg

SEQ ID NO: 42147 - RNA, 40 nt, Artificial Sequence
  Synthetic Oligonucleotide; PDCD1LG2 exon 3; Set C
cucacuuggacuugagguauguggaacgaggccuucccua

SEQ ID NO: 42148 - RNA, 38 nt, Artificial Sequence
  Synthetic Oligonucleotide; PDCD1LG2 exon 3; Set C
cucacuuggacuugagguauguggaacgaggccuuccc

SEQ ID NO: 42149 - RNA, 37 nt, Artificial Sequence
  Synthetic Oligonucleotide; PDCD1LG2 exon 3; Set C
cucacuuggacuugagguauguggaacgaggccuucc

SEQ ID NO: 42150 - RNA, 27 nt, Artificial Sequence
  Synthetic Oligonucleotide; PDCD1LG2 exon 3; Set A
acuuggacuugagguauguggaacgag

SEQ ID NO: 42151 - RNA, 28 nt, Artificial Sequence
  Synthetic Oligonucleotide; PDCD1LG2 exon 3; Set A
cacuuggacuugagguauguggaacgag

SEQ ID NO: 42152 - RNA, 29 nt, Artificial Sequence
  Synthetic Oligonucleotide; PDCD1LG2 exon 3; Set A
ucacuuggacuugagguauguggaacgag

SEQ ID NO: 42153 - RNA, 27 nt, Artificial Sequence
  Synthetic Oligonucleotide; PDCD1LG2 exon 3; Set A
cacuuggacuugagguauguggaacga

SEQ ID NO: 42154 - RNA, 37 nt, Artificial Sequence
  Synthetic Oligonucleotide; PDCD1LG2 exon 3; Set C
uucgucccucacuuggacuugagguauguggaacgag

SEQ ID NO: 42155 - RNA, 36 nt, Artificial Sequence
  Synthetic Oligonucleotide; PDCD1LG2 exon 3; Set C
uucgucccucacuuggacuugagguauguggaacga

SEQ ID NO: 42156 - RNA, 20 nt, Artificial Sequence
  Synthetic Oligonucleotide; PDCD1LG2 exon 3; Set A
ucgucccucacuuggacuug

SEQ ID NO: 42157 - RNA, 22 nt, Artificial Sequence
  Synthetic Oligonucleotide; PDCD1LG2 exon 3; Set A
cuucgucccucacuuggacuug

SEQ ID NO: 42158 - RNA, 23 nt, Artificial Sequence
  Synthetic Oligonucleotide; PDCD1LG2 exon 3; Set A
ccuucgucccucacuuggacuug

SEQ ID NO: 42159 - RNA, 24 nt, Artificial Sequence
  Synthetic Oligonucleotide; PDCD1LG2 exon 3; Set A
uccuucgucccucacuuggacuug

SEQ ID NO: 42160 - RNA, 27 nt, Artificial Sequence
  Synthetic Oligonucleotide; PDCD1LG2 exon 3; Set C
cuguccuucgucccucacuuggacuug

SEQ ID NO: 42161 - RNA, 25 nt, Artificial Sequence
  Synthetic Oligonucleotide; PDCD1LG2 exon 3; Set C
uguccuucgucccucacuuggacuu

SEQ ID NO: 42162 - RNA, 15 nt, Artificial Sequence
  Synthetic Oligonucleotide; PDCD1LG2 exon 3; Set C
uucgucccucacuug

SEQ ID NO: 42163 - RNA, 28 nt, Artificial Sequence
  Synthetic Oligonucleotide; PDCD1LG2 exon 3; Set C
acuguccuucgucccucacuuggacuug

SEQ ID NO: 42164 - RNA, 29 nt, Artificial Sequence
  Synthetic Oligonucleotide; PDCD1LG2 exon 3; Set C
uacuguccuucgucccucacuuggacuug

SEQ ID NO: 42165 - RNA, 30 nt, Artificial Sequence
  Synthetic Oligonucleotide; PDCD1LG2 exon 3; Set C
guacuguccuucgucccucacuuggacuug

SEQ ID NO: 42166 - RNA, 21 nt, Artificial Sequence
  Synthetic Oligonucleotide; PDCD1LG2 exon 3; Set B
uguccuucgucccucacuugg

SEQ ID NO: 42167 - RNA, 20 nt, Artificial Sequence
  Synthetic Oligonucleotide; PDCD1LG2 exon 3; Set B
uguccuucgucccucacuug

SEQ ID NO: 42168 - RNA, 32 nt, Artificial Sequence
  Synthetic Oligonucleotide; PDCD1LG2 exon 3; Set C
uugguacuguccuucgucccucacuuggacuu

SEQ ID NO: 42169 - RNA, 33 nt, Artificial Sequence
  Synthetic Oligonucleotide; PDCD1LG2 exon 3; Set C
auugguacuguccuucgucccucacuuggacuu

SEQ ID NO: 42170 - RNA, 36 nt, Artificial Sequence
  Synthetic Oligonucleotide; PDCD1LG2 exon 3; Set C
gcauugguacuguccuucgucccucacuuggacuug

SEQ ID NO: 42171 - RNA, 34 nt, Artificial Sequence
  Synthetic Oligonucleotide; PDCD1LG2 exon 3; Set C
cauugguacuguccuucgucccucacuuggacuu

SEQ ID NO: 42172 - RNA, 32 nt, Artificial Sequence
  Synthetic Oligonucleotide; PDCD1LG2 exon 3; Set C
auugguacuguccuucgucccucacuuggacu

SEQ ID NO: 42173 - RNA, 37 nt, Artificial Sequence
  Synthetic Oligonucleotide; PDCD1LG2 exon 3; Set C
ugcauugguacuguccuucgucccucacuuggacuug

SEQ ID NO: 42174 - RNA, 31 nt, Artificial Sequence
  Synthetic Oligonucleotide; PDCD1LG2 exon 3; Set C
auugguacuguccuucgucccucacuuggac

SEQ ID NO: 42175 - RNA, 33 nt, Artificial Sequence
  Synthetic Oligonucleotide; PDCD1LG2 exon 3; Set C
cauugguacuguccuucgucccucacuuggacu

SEQ ID NO: 42176 - RNA, 16 nt, Artificial Sequence
  Synthetic Oligonucleotide; PDCD1LG2 exon 3; Set C
cuguccuucgucccuc

SEQ ID NO: 42177 - RNA, 38 nt, Artificial Sequence
  Synthetic Oligonucleotide; PDCD1LG2 exon 3; Set C
augcauugguacuguccuucgucccucacuuggacuug

SEQ ID NO: 42178 - RNA, 32 nt, Artificial Sequence
  Synthetic Oligonucleotide; PDCD1LG2 exon 3; Set C
cauugguacuguccuucgucccucacuuggac

SEQ ID NO: 42179 - RNA, 30 nt, Artificial Sequence
  Synthetic Oligonucleotide; PDCD1LG2 exon 3; Set C
auugguacuguccuucgucccucacuugga

SEQ ID NO: 42180 - RNA, 19 nt, Artificial Sequence
  Synthetic Oligonucleotide; PDCD1LG2 exon 3; Set B
uacuguccuucgucccuca

SEQ ID NO: 42181 - RNA, 17 nt, Artificial Sequence
  Synthetic Oligonucleotide; PDCD1LG2 exon 3; Set C
acuguccuucgucccuc

SEQ ID NO: 42182 - RNA, 27 nt, Artificial Sequence
  Synthetic Oligonucleotide; PDCD1LG2 exon 3; Set C
uugguacuguccuucgucccucacuug

SEQ ID NO: 42183 - RNA, 29 nt, Artificial Sequence
  Synthetic Oligonucleotide; PDCD1LG2 exon 3; Set C
auugguacuguccuucgucccucacuugg

SEQ ID NO: 42184 - RNA, 31 nt, Artificial Sequence
  Synthetic Oligonucleotide; PDCD1LG2 exon 3; Set C
cauugguacuguccuucgucccucacuugga

SEQ ID NO: 42185 - RNA, 18 nt, Artificial Sequence
  Synthetic Oligonucleotide; PDCD1LG2 exon 3; Set C
uacuguccuucgucccuc

SEQ ID NO: 42186 - RNA, 38 nt, Artificial Sequence
  Synthetic Oligonucleotide; PDCD1LG2 exon 3; Set C
uaugcauugguacuguccuucgucccucacuuggacuu

SEQ ID NO: 42187 - RNA, 28 nt, Artificial Sequence
  Synthetic Oligonucleotide; PDCD1LG2 exon 3; Set C
auugguacuguccuucgucccucacuug

SEQ ID NO: 42188 - RNA, 30 nt, Artificial Sequence
  Synthetic Oligonucleotide; PDCD1LG2 exon 3; Set C
cauugguacuguccuucgucccucacuugg

SEQ ID NO: 42189 - RNA, 19 nt, Artificial Sequence
  Synthetic Oligonucleotide; PDCD1LG2 exon 3; Set B
guacuguccuucgucccuc

SEQ ID NO: 42190 - RNA, 39 nt, Artificial Sequence
  Synthetic Oligonucleotide; PDCD1LG2 exon 3; Set C
uuaugcauugguacuguccuucgucccucacuuggacuu

SEQ ID NO: 42191 - RNA, 29 nt, Artificial Sequence
  Synthetic Oligonucleotide; PDCD1LG2 exon 3; Set C
cauugguacuguccuucgucccucacuug

SEQ ID NO: 42192 - RNA, 37 nt, Artificial Sequence
  Synthetic Oligonucleotide; PDCD1LG2 exon 3; Set C
uaugcauugguacuguccuucgucccucacuuggacu

SEQ ID NO: 42193 - RNA, 40 nt, Artificial Sequence
  Synthetic Oligonucleotide; PDCD1LG2 exon 3; Set C
auuaugcauugguacuguccuucgucccucacuuggacuu

SEQ ID NO: 42194 - RNA, 36 nt, Artificial Sequence
  Synthetic Oligonucleotide; PDCD1LG2 exon 3; Set C
uaugcauugguacuguccuucgucccucacuuggac

SEQ ID NO: 42195 - RNA, 38 nt, Artificial Sequence
  Synthetic Oligonucleotide; PDCD1LG2 exon 3; Set C
uuaugcauugguacuguccuucgucccucacuuggacu

SEQ ID NO: 42196 - RNA, 37 nt, Artificial Sequence
  Synthetic Oligonucleotide; PDCD1LG2 exon 3; Set C
uuaugcauugguacuguccuucgucccucacuuggac

SEQ ID NO: 42197 - RNA, 39 nt, Artificial Sequence
  Synthetic Oligonucleotide; PDCD1LG2 exon 3; Set C
auuaugcauugguacuguccuucgucccucacuuggacu

SEQ ID NO: 42198 - RNA, 35 nt, Artificial Sequence
  Synthetic Oligonucleotide; PDCD1LG2 exon 3; Set C
uaugcauugguacuguccuucgucccucacuugga

SEQ ID NO: 42199 - RNA, 38 nt, Artificial Sequence
  Synthetic Oligonucleotide; PDCD1LG2 exon 3; Set C
auuaugcauugguacuguccuucgucccucacuuggac

SEQ ID NO: 42200 - RNA, 40 nt, Artificial Sequence
  Synthetic Oligonucleotide; PDCD1LG2 exon 3; Set C
gauuaugcauugguacuguccuucgucccucacuuggacu

SEQ ID NO: 42201 - RNA, 34 nt, Artificial Sequence
  Synthetic Oligonucleotide; PDCD1LG2 exon 3; Set C
uaugcauugguacuguccuucgucccucacuugg

SEQ ID NO: 42202 - RNA, 36 nt, Artificial Sequence
  Synthetic Oligonucleotide; PDCD1LG2 exon 3; Set C
uuaugcauugguacuguccuucgucccucacuugga

SEQ ID NO: 42203 - RNA, 39 nt, Artificial Sequence
  Synthetic Oligonucleotide; PDCD1LG2 exon 3; Set C
gauuaugcauugguacuguccuucgucccucacuuggac

SEQ ID NO: 42204 - RNA, 33 nt, Artificial Sequence
  Synthetic Oligonucleotide; PDCD1LG2 exon 3; Set C
uaugcauugguacuguccuucgucccucacuug

SEQ ID NO: 42205 - RNA, 35 nt, Artificial Sequence
  Synthetic Oligonucleotide; PDCD1LG2 exon 3; Set C
uuaugcauugguacuguccuucgucccucacuugg

SEQ ID NO: 42206 - RNA, 37 nt, Artificial Sequence
  Synthetic Oligonucleotide; PDCD1LG2 exon 3; Set C
auuaugcauugguacuguccuucgucccucacuugga

SEQ ID NO: 42207 - RNA, 40 nt, Artificial Sequence
  Synthetic Oligonucleotide; PDCD1LG2 exon 3; Set C
ugauuaugcauugguacuguccuucgucccucacuuggac

SEQ ID NO: 42208 - RNA, 34 nt, Artificial Sequence
  Synthetic Oligonucleotide; PDCD1LG2 exon 3; Set C
uuaugcauugguacuguccuucgucccucacuug

SEQ ID NO: 42209 - RNA, 36 nt, Artificial Sequence
  Synthetic Oligonucleotide; PDCD1LG2 exon 3; Set C
auuaugcauugguacuguccuucgucccucacuugg

SEQ ID NO: 42210 - RNA, 38 nt, Artificial Sequence
  Synthetic Oligonucleotide; PDCD1LG2 exon 3; Set C
gauuaugcauugguacuguccuucgucccucacuugga

SEQ ID NO: 42211 - RNA, 22 nt, Artificial Sequence
  Synthetic Oligonucleotide; PDCD1LG2 exon 3; Set B
auugguacuguccuucgucccu

SEQ ID NO: 42212 - RNA, 35 nt, Artificial Sequence
  Synthetic Oligonucleotide; PDCD1LG2 exon 3; Set C
auuaugcauugguacuguccuucgucccucacuug

SEQ ID NO: 42213 - RNA, 37 nt, Artificial Sequence
  Synthetic Oligonucleotide; PDCD1LG2 exon 3; Set C
gauuaugcauugguacuguccuucgucccucacuugg

SEQ ID NO: 42214 - RNA, 39 nt, Artificial Sequence
  Synthetic Oligonucleotide; PDCD1LG2 exon 3; Set C
ugauuaugcauugguacuguccuucgucccucacuugga

SEQ ID NO: 42215 - RNA, 23 nt, Artificial Sequence
  Synthetic Oligonucleotide; PDCD1LG2 exon 3; Set B
cauugguacuguccuucgucccu

SEQ ID NO: 42216 - RNA, 21 nt, Artificial Sequence
  Synthetic Oligonucleotide; PDCD1LG2 exon 3; Set B
auugguacuguccuucguccc

SEQ ID NO: 42217 - RNA, 36 nt, Artificial Sequence
  Synthetic Oligonucleotide; PDCD1LG2 exon 3; Set C
gauuaugcauugguacuguccuucgucccucacuug

SEQ ID NO: 42218 - RNA, 38 nt, Artificial Sequence
  Synthetic Oligonucleotide; PDCD1LG2 exon 3; Set C
ugauuaugcauugguacuguccuucgucccucacuugg

SEQ ID NO: 42219 - RNA, 22 nt, Artificial Sequence
  Synthetic Oligonucleotide; PDCD1LG2 exon 3; Set B
cauugguacuguccuucguccc

SEQ ID NO: 42220 - RNA, 37 nt, Artificial Sequence
  Synthetic Oligonucleotide; PDCD1LG2 exon 3; Set C
ugauuaugcauugguacuguccuucgucccucacuug

SEQ ID NO: 42221 - RNA, 27 nt, Artificial Sequence
  Synthetic Oligonucleotide; PDCD1LG2 exon 3; Set C
uaugcauugguacuguccuucgucccu

SEQ ID NO: 42222 - RNA, 28 nt, Artificial Sequence
  Synthetic Oligonucleotide; PDCD1LG2 exon 3; Set C
uuaugcauugguacuguccuucgucccu

SEQ ID NO: 42223 - RNA, 26 nt, Artificial Sequence
  Synthetic Oligonucleotide; PDCD1LG2 exon 3; Set C
uaugcauugguacuguccuucguccc

SEQ ID NO: 42224 - RNA, 29 nt, Artificial Sequence
  Synthetic Oligonucleotide; PDCD1LG2 exon 3; Set C
auuaugcauugguacuguccuucgucccu

SEQ ID NO: 42225 - RNA, 27 nt, Artificial Sequence
  Synthetic Oligonucleotide; PDCD1LG2 exon 3; Set C
uuaugcauugguacuguccuucguccc

SEQ ID NO: 42226 - RNA, 30 nt, Artificial Sequence
  Synthetic Oligonucleotide; PDCD1LG2 exon 3; Set C
gauuaugcauugguacuguccuucgucccu

SEQ ID NO: 42227 - RNA, 28 nt, Artificial Sequence
  Synthetic Oligonucleotide; PDCD1LG2 exon 3; Set C
auuaugcauugguacuguccuucguccc

SEQ ID NO: 42228 - RNA, 17 nt, Artificial Sequence
  Synthetic Oligonucleotide; PDCD1LG2 exon 3; Set C
gcauugguacuguccuu

SEQ ID NO: 42229 - RNA, 31 nt, Artificial Sequence
  Synthetic Oligonucleotide; PDCD1LG2 exon 3; Set C
ugauuaugcauugguacuguccuucgucccu

SEQ ID NO: 42230 - RNA, 29 nt, Artificial Sequence
  Synthetic Oligonucleotide; PDCD1LG2 exon 3; Set C
gauuaugcauugguacuguccuucguccc

SEQ ID NO: 42231 - RNA, 40 nt, Artificial Sequence
  Synthetic Oligonucleotide; PDCD1LG2 exon 3; Set C
auagaugauuaugcauugguacuguccuucgucccucacu

SEQ ID NO: 42232 - RNA, 18 nt, Artificial Sequence
  Synthetic Oligonucleotide; PDCD1LG2 exon 3; Set C
ugcauugguacuguccuu

SEQ ID NO: 42233 - RNA, 16 nt, Artificial Sequence
  Synthetic Oligonucleotide; PDCD1LG2 exon 3; Set C
gcauugguacuguccu

SEQ ID NO: 42234 - RNA, 30 nt, Artificial Sequence
  Synthetic Oligonucleotide; PDCD1LG2 exon 3; Set C
ugauuaugcauugguacuguccuucguccc

SEQ ID NO: 42235 - RNA, 39 nt, Artificial Sequence
  Synthetic Oligonucleotide; PDCD1LG2 exon 3; Set C
auagaugauuaugcauugguacuguccuucgucccucac

SEQ ID NO: 42236 - RNA, 19 nt, Artificial Sequence
  Synthetic Oligonucleotide; PDCD1LG2 exon 3; Set C
augcauugguacuguccuu

SEQ ID NO: 42237 - RNA, 17 nt, Artificial Sequence
  Synthetic Oligonucleotide; PDCD1LG2 exon 3; Set C
ugcauugguacuguccu

SEQ ID NO: 42238 - RNA, 15 nt, Artificial Sequence
  Synthetic Oligonucleotide; PDCD1LG2 exon 3; Set C
gcauugguacugucc

SEQ ID NO: 42239 - RNA, 38 nt, Artificial Sequence
  Synthetic Oligonucleotide; PDCD1LG2 exon 3; Set C
auagaugauuaugcauugguacuguccuucgucccuca

SEQ ID NO: 42240 - RNA, 36 nt, Artificial Sequence
  Synthetic Oligonucleotide; PDCD1LG2 exon 3; Set C
uagaugauuaugcauugguacuguccuucgucccuc

SEQ ID NO: 42241 - RNA, 18 nt, Artificial Sequence
  Synthetic Oligonucleotide; PDCD1LG2 exon 3; Set C
augcauugguacuguccu

SEQ ID NO: 42242 - RNA, 16 nt, Artificial Sequence
  Synthetic Oligonucleotide; PDCD1LG2 exon 3; Set C
ugcauugguacugucc

SEQ ID NO: 42243 - RNA, 15 nt, Artificial Sequence
  Synthetic Oligonucleotide; PDCD1LG2 exon 3; Set C
ugcauugguacuguc

SEQ ID NO: 42244 - RNA, 17 nt, Artificial Sequence
  Synthetic Oligonucleotide; PDCD1LG2 exon 3; Set C
augcauugguacugucc

SEQ ID NO: 42245 - RNA, 27 nt, Artificial Sequence
  Synthetic Oligonucleotide; PDCD1LG2 exon 3; Set B
ugauuaugcauugguacuguccuucgu

SEQ ID NO: 42246 - RNA, 27 nt, Artificial Sequence
  Synthetic Oligonucleotide; PDCD1LG2 exon 3; Set B
augauuaugcauugguacuguccuucg

SEQ ID NO: 42247 - RNA, 25 nt, Artificial Sequence
  Synthetic Oligonucleotide; PDCD1LG2 exon 3; Set B
augauuaugcauugguacuguccuu

SEQ ID NO: 42248 - RNA, 28 nt, Artificial Sequence
  Synthetic Oligonucleotide; PDCD1LG2 exon 3; Set B
agaugauuaugcauugguacuguccuuc

SEQ ID NO: 42249 - RNA, 26 nt, Artificial Sequence
  Synthetic Oligonucleotide; PDCD1LG2 exon 3; Set B
gaugauuaugcauugguacuguccuu

SEQ ID NO: 42250 - RNA, 24 nt, Artificial Sequence
  Synthetic Oligonucleotide; PDCD1LG2 exon 3; Set B
augauuaugcauugguacuguccu

SEQ ID NO: 42251 - RNA, 23 nt, Artificial Sequence
  Synthetic Oligonucleotide; PDCD1LG2 exon 3; Set C
augauuaugcauugguacugucc

SEQ ID NO: 42252 - RNA, 25 nt, Artificial Sequence
  Synthetic Oligonucleotide; PDCD1LG2 exon 3; Set B
gaugauuaugcauugguacuguccu

SEQ ID NO: 42253 - RNA, 30 nt, Artificial Sequence
  Synthetic Oligonucleotide; PDCD1LG2 exon 3; Set B
auagaugauuaugcauugguacuguccuuc

SEQ ID NO: 42254 - RNA, 24 nt, Artificial Sequence
  Synthetic Oligonucleotide; PDCD1LG2 exon 3; Set B
gaugauuaugcauugguacugucc

SEQ ID NO: 42255 - RNA, 20 nt, Artificial Sequence
  Synthetic Oligonucleotide; PDCD1LG2 exon 3; Set C
augauuaugcauugguacug

SEQ ID NO: 42256 - RNA, 25 nt, Artificial Sequence
  Synthetic Oligonucleotide; PDCD1LG2 exon 3; Set C
uagaugauuaugcauugguacuguc

SEQ ID NO: 42257 - RNA, 19 nt, Artificial Sequence
  Synthetic Oligonucleotide; PDCD1LG2 exon 3; Set C
augauuaugcauugguacu

SEQ ID NO: 42258 - RNA, 21 nt, Artificial Sequence
  Synthetic Oligonucleotide; PDCD1LG2 exon 3; Set C
gaugauuaugcauugguacug

SEQ ID NO: 42259 - RNA, 34 nt, Artificial Sequence
  Synthetic Oligonucleotide; PDCD1LG2 exon 3; Set C
ccccauagaugauuaugcauugguacuguccuuc

SEQ ID NO: 42260 - RNA, 18 nt, Artificial Sequence
  Synthetic Oligonucleotide; PDCD1LG2 exon 3; Set C
augauuaugcauugguac

SEQ ID NO: 42261 - RNA, 25 nt, Artificial Sequence
  Synthetic Oligonucleotide; PDCD1LG2 exon 3; Set C
auagaugauuaugcauugguacugu

SEQ ID NO: 42262 - RNA, 17 nt, Artificial Sequence
  Synthetic Oligonucleotide; PDCD1LG2 exon 3; Set C
augauuaugcauuggua

SEQ ID NO: 42263 - RNA, 18 nt, Artificial Sequence
  Synthetic Oligonucleotide; PDCD1LG2 exon 3; Set C
gaugauuaugcauuggua

SEQ ID NO: 42264 - RNA, 29 nt, Artificial Sequence
  Synthetic Oligonucleotide; PDCD1LG2 exon 3; Set B
ccccauagaugauuaugcauugguacugu

SEQ ID NO: 42265 - RNA, 19 nt, Artificial Sequence
  Synthetic Oligonucleotide; PDCD1LG2 exon 3; Set C
uagaugauuaugcauuggu

SEQ ID NO: 42266 - RNA, 15 nt, Artificial Sequence
  Synthetic Oligonucleotide; PDCD1LG2 exon 3; Set C
agaugauuaugcauu

SEQ ID NO: 42267 - RNA, 19 nt, Artificial Sequence
  Synthetic Oligonucleotide; PDCD1LG2 exon 3; Set C
auagaugauuaugcauugg

SEQ ID NO: 42268 - RNA, 18 nt, Artificial Sequence
  Synthetic Oligonucleotide; PDCD1LG2 exon 3; Set C
auagaugauuaugcauug

SEQ ID NO: 42269 - RNA, 17 nt, Artificial Sequence
  Synthetic Oligonucleotide; PDCD1LG2 exon 3; Set C
auagaugauuaugcauu

SEQ ID NO: 42270 - RNA, 18 nt, Artificial Sequence
  Synthetic Oligonucleotide; PDCD1LG2 exon 3; Set C
cauagaugauuaugcauu

SEQ ID NO: 42271 - RNA, 16 nt, Artificial Sequence
  Synthetic Oligonucleotide; PDCD1LG2 exon 3; Set C
auagaugauuaugcau

SEQ ID NO: 42272 - RNA, 36 nt, Artificial Sequence
  Synthetic Oligonucleotide; PDCD1LG2 exon 3; Set C
caggcgaccccauagaugauuaugcauugguacugu

SEQ ID NO: 42273 - RNA, 38 nt, Artificial Sequence
  Synthetic Oligonucleotide; PDCD1LG2 exon 3; Set C
ccaggcgaccccauagaugauuaugcauugguacuguc

SEQ ID NO: 42274 - RNA, 21 nt, Artificial Sequence
  Synthetic Oligonucleotide; PDCD1LG2 exon 3; Set C
ccccauagaugauuaugcauu

SEQ ID NO: 42275 - RNA, 20 nt, Artificial Sequence
  Synthetic Oligonucleotide; PDCD1LG2 exon 3; Set C
ccccauagaugauuaugcau

SEQ ID NO: 42276 - RNA, 16 nt, Artificial Sequence
  Synthetic Oligonucleotide; PDCD1LG2 exon 3; Set C
ccccauagaugauuau

SEQ ID NO: 42277 - RNA, 30 nt, Artificial Sequence
  Synthetic Oligonucleotide; PDCD1LG2 exon 3; Set C
caggcgaccccauagaugauuaugcauugg

SEQ ID NO: 42278 - RNA, 32 nt, Artificial Sequence
  Synthetic Oligonucleotide; PDCD1LG2 exon 3; Set C
ccaggcgaccccauagaugauuaugcauuggu

SEQ ID NO: 42279 - RNA, 15 nt, Artificial Sequence
  Synthetic Oligonucleotide; PDCD1LG2 exon 3; Set C
ccccauagaugauua

SEQ ID NO: 42280 - RNA, 29 nt, Artificial Sequence
  Synthetic Oligonucleotide; PDCD1LG2 exon 3; Set C
caggcgaccccauagaugauuaugcauug

SEQ ID NO: 42281 - RNA, 31 nt, Artificial Sequence
  Synthetic Oligonucleotide; PDCD1LG2 exon 3; Set C
ccaggcgaccccauagaugauuaugcauugg

SEQ ID NO: 42282 - RNA, 28 nt, Artificial Sequence
  Synthetic Oligonucleotide; PDCD1LG2 exon 3; Set C
caggcgaccccauagaugauuaugcauu

SEQ ID NO: 42283 - RNA, 27 nt, Artificial Sequence
  Synthetic Oligonucleotide; PDCD1LG2 exon 3; Set C
caggcgaccccauagaugauuaugcau

SEQ ID NO: 42284 - RNA, 38 nt, Artificial Sequence
  Synthetic Oligonucleotide; PDCD1LG2 exon 3; Set C
guagucccaggcgaccccauagaugauuaugcauuggu

SEQ ID NO: 42285 - RNA, 23 nt, Artificial Sequence
  Synthetic Oligonucleotide; PDCD1LG2 exon 3; Set B
caggcgaccccauagaugauuau

SEQ ID NO: 42286 - RNA, 39 nt, Artificial Sequence
  Synthetic Oligonucleotide; PDCD1LG2 exon 3; Set C
uguagucccaggcgaccccauagaugauuaugcauuggu

SEQ ID NO: 42287 - RNA, 22 nt, Artificial Sequence
  Synthetic Oligonucleotide; PDCD1LG2 exon 3; Set B
caggcgaccccauagaugauua

SEQ ID NO: 42288 - RNA, 38 nt, Artificial Sequence
  Synthetic Oligonucleotide; PDCD1LG2 exon 3; Set C
uguagucccaggcgaccccauagaugauuaugcauugg

SEQ ID NO: 42289 - RNA, 40 nt, Artificial Sequence
  Synthetic Oligonucleotide; PDCD1LG2 exon 3; Set C
uuguagucccaggcgaccccauagaugauuaugcauuggu

SEQ ID NO: 42290 - RNA, 21 nt, Artificial Sequence
  Synthetic Oligonucleotide; PDCD1LG2 exon 3; Set B
caggcgaccccauagaugauu

SEQ ID NO: 42291 - RNA, 37 nt, Artificial Sequence
  Synthetic Oligonucleotide; PDCD1LG2 exon 3; Set C
uguagucccaggcgaccccauagaugauuaugcauug

SEQ ID NO: 42292 - RNA, 39 nt, Artificial Sequence
  Synthetic Oligonucleotide; PDCD1LG2 exon 3; Set C
uuguagucccaggcgaccccauagaugauuaugcauugg

SEQ ID NO: 42293 - RNA, 20 nt, Artificial Sequence
  Synthetic Oligonucleotide; PDCD1LG2 exon 3; Set B
caggcgaccccauagaugau

SEQ ID NO: 42294 - RNA, 38 nt, Artificial Sequence
  Synthetic Oligonucleotide; PDCD1LG2 exon 3; Set C
uuguagucccaggcgaccccauagaugauuaugcauug

SEQ ID NO: 42295 - RNA, 40 nt, Artificial Sequence
  Synthetic Oligonucleotide; PDCD1LG2 exon 3; Set C
cuuguagucccaggcgaccccauagaugauuaugcauugg

SEQ ID NO: 42296 - RNA, 19 nt, Artificial Sequence
  Synthetic Oligonucleotide; PDCD1LG2 exon 3; Set B
caggcgaccccauagauga

SEQ ID NO: 42297 - RNA, 31 nt, Artificial Sequence
  Synthetic Oligonucleotide; PDCD1LG2 exon 3; Set C
uguagucccaggcgaccccauagaugauuau

SEQ ID NO: 42298 - RNA, 32 nt, Artificial Sequence
  Synthetic Oligonucleotide; PDCD1LG2 exon 3; Set C
uuguagucccaggcgaccccauagaugauuau

SEQ ID NO: 42299 - RNA, 29 nt, Artificial Sequence
  Synthetic Oligonucleotide; PDCD1LG2 exon 3; Set C
uguagucccaggcgaccccauagaugauu

SEQ ID NO: 42300 - RNA, 27 nt, Artificial Sequence
  Synthetic Oligonucleotide; PDCD1LG2 exon 3; Set C
uguagucccaggcgaccccauagauga

SEQ ID NO: 42301 - RNA, 36 nt, Artificial Sequence
  Synthetic Oligonucleotide; PDCD1LG2 exon 3; Set C
gguacuuguagucccaggcgaccccauagaugauua

SEQ ID NO: 42302 - RNA, 37 nt, Artificial Sequence
  Synthetic Oligonucleotide; PDCD1LG2 exon 3; Set C
agguacuuguagucccaggcgaccccauagaugauua

SEQ ID NO: 42303 - RNA, 40 nt, Artificial Sequence
  Synthetic Oligonucleotide; PDCD1LG2 exon 3; Set C
cagagucagguacuuguagucccaggcgaccccauagaug

SEQ ID NO: 42304 - RNA, 39 nt, Artificial Sequence
  Synthetic Oligonucleotide; PDCD1LG2 exon 3; Set C
cagagucagguacuuguagucccaggcgaccccauagau

SEQ ID NO: 42305 - RNA, 40 nt, Artificial Sequence
  Synthetic Oligonucleotide; PDCD1LG2 exon 3; Set C
ucagagucagguacuuguagucccaggcgaccccauagau

SEQ ID NO: 42306 - RNA, 38 nt, Artificial Sequence
  Synthetic Oligonucleotide; PDCD1LG2 exon 3; Set C
ucagagucagguacuuguagucccaggcgaccccauag

SEQ ID NO: 42307 - RNA, 39 nt, Artificial Sequence
  Synthetic Oligonucleotide; PDCD1LG2 exon 3; Set C
uucagagucagguacuuguagucccaggcgaccccauag

SEQ ID NO: 42308 - RNA, 24 nt, Artificial Sequence
  Synthetic Oligonucleotide; PDCD1LG2 exon 3; Set B
cagagucagguacuuguaguccca

SEQ ID NO: 42309 - RNA, 25 nt, Artificial Sequence
  Synthetic Oligonucleotide; PDCD1LG2 exon 3; Set B
ucagagucagguacuuguaguccca

SEQ ID NO: 42310 - RNA, 26 nt, Artificial Sequence
  Synthetic Oligonucleotide; PDCD1LG2 exon 3; Set B
uucagagucagguacuuguaguccca

SEQ ID NO: 42311 - RNA, 17 nt, Artificial Sequence
  Synthetic Oligonucleotide; PDCD1LG2 exon 3; Set C
cagagucagguacuugu

SEQ ID NO: 42312 - RNA, 18 nt, Artificial Sequence
  Synthetic Oligonucleotide; PDCD1LG2 exon 3; Set C
ucagagucagguacuugu

SEQ ID NO: 42313 - RNA, 16 nt, Artificial Sequence
  Synthetic Oligonucleotide; PDCD1LG2 exon 3; Set C
cagagucagguacuug

SEQ ID NO: 42314 - RNA, 15 nt, Artificial Sequence
  Synthetic Oligonucleotide; PDCD1LG2 exon 3; Set C
cagagucagguacuu

SEQ ID NO: 42315 - RNA, 19 nt, Artificial Sequence
  Synthetic Oligonucleotide; PDCD1LG2 exon 3; Set C
uucagagucagguacuugu

SEQ ID NO: 42316 - RNA, 17 nt, Artificial Sequence
  Synthetic Oligonucleotide; PDCD1LG2 exon 3; Set C
ucagagucagguacuug

SEQ ID NO: 42317 - RNA, 16 nt, Artificial Sequence
  Synthetic Oligonucleotide; PDCD1LG2 exon 3; Set C
ucagagucagguacuu

SEQ ID NO: 42318 - RNA, 18 nt, Artificial Sequence
  Synthetic Oligonucleotide; PDCD1LG2 exon 3; Set C
uucagagucagguacuug

SEQ ID NO: 42319 - RNA, 17 nt, Artificial Sequence
  Synthetic Oligonucleotide; PDCD1LG2 exon 3; Set C
uucagagucagguacuu

SEQ ID NO: 42320 - RNA, 23 nt, Artificial Sequence
  Synthetic Oligonucleotide; PDCD1LG2 exon 3; Set B
caccacucaccuuugacuuucag

SEQ ID NO: 42321 - RNA, 22 nt, Artificial Sequence
  Synthetic Oligonucleotide; PDCD1LG2 exon 3; Set B
caccacucaccuuugacuuuca

SEQ ID NO: 42322 - RNA, 21 nt, Artificial Sequence
  Synthetic Oligonucleotide; PDCD1LG2 exon 3; Set B
caccacucaccuuugacuuuc

SEQ ID NO: 42323 - RNA, 34 nt, Artificial Sequence
  Synthetic Oligonucleotide; PDCD1LG2 exon 3; Set C
cuaguccuugacaccacucaccuuugacuuucag

SEQ ID NO: 42324 - RNA, 33 nt, Artificial Sequence
  Synthetic Oligonucleotide; PDCD1LG2 exon 3; Set C
cuaguccuugacaccacucaccuuugacuuuca

SEQ ID NO: 42325 - RNA, 35 nt, Artificial Sequence
  Synthetic Oligonucleotide; PDCD1LG2 exon 3; Set C
ucuaguccuugacaccacucaccuuugacuuucag

SEQ ID NO: 42326 - RNA, 32 nt, Artificial Sequence
  Synthetic Oligonucleotide; PDCD1LG2 exon 3; Set C
cuaguccuugacaccacucaccuuugacuuuc

SEQ ID NO: 42327 - RNA, 34 nt, Artificial Sequence
  Synthetic Oligonucleotide; PDCD1LG2 exon 3; Set C
ucuaguccuugacaccacucaccuuugacuuuca

SEQ ID NO: 42328 - RNA, 36 nt, Artificial Sequence
  Synthetic Oligonucleotide; PDCD1LG2 exon 3; Set C
uucuaguccuugacaccacucaccuuugacuuucag

SEQ ID NO: 42329 - RNA, 35 nt, Artificial Sequence
  Synthetic Oligonucleotide; PDCD1LG2 exon 3; Set C
uucuaguccuugacaccacucaccuuugacuuuca

SEQ ID NO: 42330 - RNA, 37 nt, Artificial Sequence
  Synthetic Oligonucleotide; PDCD1LG2 exon 3; Set C
auucuaguccuugacaccacucaccuuugacuuucag

SEQ ID NO: 42331 - RNA, 34 nt, Artificial Sequence
  Synthetic Oligonucleotide; PDCD1LG2 exon 3; Set C
uucuaguccuugacaccacucaccuuugacuuuc

SEQ ID NO: 42332 - RNA, 36 nt, Artificial Sequence
  Synthetic Oligonucleotide; PDCD1LG2 exon 3; Set C
auucuaguccuugacaccacucaccuuugacuuuca

SEQ ID NO: 42333 - RNA, 16 nt, Artificial Sequence
  Synthetic Oligonucleotide; PDCD1LG2 exon 3; Set C
aguccuugacaccacu

SEQ ID NO: 42334 - RNA, 17 nt, Artificial Sequence
  Synthetic Oligonucleotide; PDCD1LG2 exon 3; Set C
uaguccuugacaccacu

SEQ ID NO: 42335 - RNA, 15 nt, Artificial Sequence
  Synthetic Oligonucleotide; PDCD1LG2 exon 3; Set C
ucuaguccuugacac

SEQ ID NO: 42336 - RNA, 16 nt, Artificial Sequence
  Synthetic Oligonucleotide; PDCD1LG2 exon 3; Set C
uucuaguccuugacac

SEQ ID NO: 42337 - RNA, 17 nt, Artificial Sequence
  Synthetic Oligonucleotide; PDCD1LG2 exon 3; Set C
auucuaguccuugacac

SEQ ID NO: 42338 - RNA, 30 nt, Artificial Sequence
  Synthetic Oligonucleotide; PDCD1LG2 exon 3; Set C
cuuccauggauucuaguccuugacaccacu

SEQ ID NO: 42339 - RNA, 31 nt, Artificial Sequence
  Synthetic Oligonucleotide; PDCD1LG2 exon 3; Set C
gcuuccauggauucuaguccuugacaccacu

SEQ ID NO: 42340 - RNA, 32 nt, Artificial Sequence
  Synthetic Oligonucleotide; PDCD1LG2 exon 3; Set C
ugcuuccauggauucuaguccuugacaccacu

SEQ ID NO: 42341 - RNA, 33 nt, Artificial Sequence
  Synthetic Oligonucleotide; PDCD1LG2 exon 3; Set C
augcuuccauggauucuaguccuugacaccacu

SEQ ID NO: 42342 - RNA, 26 nt, Artificial Sequence
  Synthetic Oligonucleotide; PDCD1LG2 exon 3; Set B
cuuccauggauucuaguccuugacac

SEQ ID NO: 42343 - RNA, 30 nt, Artificial Sequence
  Synthetic Oligonucleotide; PDCD1LG2 exon 3; Set C
gaugcuuccauggauucuaguccuugacac

SEQ ID NO: 42344 - RNA, 36 nt, Artificial Sequence
  Synthetic Oligonucleotide; PDCD1LG2 exon 3; Set C
uggagagaugcuuccauggauucuaguccuugacac

SEQ ID NO: 42345 - RNA, 15 nt, Artificial Sequence
  Synthetic Oligonucleotide; PDCD1LG2 exon 3; Set C
cuuccauggauucua

SEQ ID NO: 42346 - RNA, 16 nt, Artificial Sequence
  Synthetic Oligonucleotide; PDCD1LG2 exon 3; Set C
gcuuccauggauucua

SEQ ID NO: 42347 - RNA, 15 nt, Artificial Sequence
  Synthetic Oligonucleotide; PDCD1LG2 exon 3; Set C
gcuuccauggauucu

SEQ ID NO: 42348 - RNA, 22 nt, Artificial Sequence
  Synthetic Oligonucleotide; PDCD1LG2 exon 3; Set C
agaugcuuccauggauucuagu

SEQ ID NO: 42349 - RNA, 16 nt, Artificial Sequence
  Synthetic Oligonucleotide; PDCD1LG2 exon 3; Set C
ugcuuccauggauucu

SEQ ID NO: 42350 - RNA, 21 nt, Artificial Sequence
  Synthetic Oligonucleotide; PDCD1LG2 exon 3; Set C
agaugcuuccauggauucuag

SEQ ID NO: 42351 - RNA, 23 nt, Artificial Sequence
  Synthetic Oligonucleotide; PDCD1LG2 exon 3; Set B
gagaugcuuccauggauucuagu

SEQ ID NO: 42352 - RNA, 19 nt, Artificial Sequence
  Synthetic Oligonucleotide; PDCD1LG2 exon 3; Set C
gaugcuuccauggauucua

SEQ ID NO: 42353 - RNA, 15 nt, Artificial Sequence
  Synthetic Oligonucleotide; PDCD1LG2 exon 3; Set C
ugcuuccauggauuc

SEQ ID NO: 42354 - RNA, 17 nt, Artificial Sequence
  Synthetic Oligonucleotide; PDCD1LG2 exon 3; Set C
augcuuccauggauucu

SEQ ID NO: 42355 - RNA, 16 nt, Artificial Sequence
  Synthetic Oligonucleotide; PDCD1LG2 exon 3; Set C
augcuuccauggauuc

SEQ ID NO: 42356 - RNA, 18 nt, Artificial Sequence
  Synthetic Oligonucleotide; PDCD1LG2 exon 3; Set C
gaugcuuccauggauucu

SEQ ID NO: 42357 - RNA, 15 nt, Artificial Sequence
  Synthetic Oligonucleotide; PDCD1LG2 exon 3; Set C
augcuuccauggauu

SEQ ID NO: 42358 - RNA, 25 nt, Artificial Sequence
  Synthetic Oligonucleotide; PDCD1LG2 exon 3; Set B
uggagagaugcuuccauggauucua

SEQ ID NO: 42359 - RNA, 26 nt, Artificial Sequence
  Synthetic Oligonucleotide; PDCD1LG2 exon 3; Set B
uuggagagaugcuuccauggauucua

SEQ ID NO: 42360 - RNA, 24 nt, Artificial Sequence
  Synthetic Oligonucleotide; PDCD1LG2 exon 3; Set B
uggagagaugcuuccauggauucu

SEQ ID NO: 42361 - RNA, 25 nt, Artificial Sequence
  Synthetic Oligonucleotide; PDCD1LG2 exon 3; Set B
uuggagagaugcuuccauggauucu

SEQ ID NO: 42362 - RNA, 23 nt, Artificial Sequence
  Synthetic Oligonucleotide; PDCD1LG2 exon 3; Set B
uggagagaugcuuccauggauuc

SEQ ID NO: 42363 - RNA, 24 nt, Artificial Sequence
  Synthetic Oligonucleotide; PDCD1LG2 exon 3; Set B
uuggagagaugcuuccauggauuc

SEQ ID NO: 42364 - RNA, 23 nt, Artificial Sequence
  Synthetic Oligonucleotide; PDCD1LG2 exon 3; Set B
uuggagagaugcuuccauggauu

SEQ ID NO: 42365 - RNA, 30 nt, Artificial Sequence
  Synthetic Oligonucleotide; PDCD1LG2 exon 3; Set B
ucuguuggagagaugcuuccauggauucua

SEQ ID NO: 42366 - RNA, 33 nt, Artificial Sequence
  Synthetic Oligonucleotide; PDCD1LG2 exon 3; Set C
ccucuguuggagagaugcuuccauggauucuag

SEQ ID NO: 42367 - RNA, 29 nt, Artificial Sequence
  Synthetic Oligonucleotide; PDCD1LG2 exon 3; Set B
ucuguuggagagaugcuuccauggauucu

SEQ ID NO: 42368 - RNA, 25 nt, Artificial Sequence
  Synthetic Oligonucleotide; PDCD1LG2 exon 3; Set B
uguuggagagaugcuuccauggauu

SEQ ID NO: 42369 - RNA, 28 nt, Artificial Sequence
  Synthetic Oligonucleotide; PDCD1LG2 exon 3; Set B
ucuguuggagagaugcuuccauggauuc

SEQ ID NO: 42370 - RNA, 26 nt, Artificial Sequence
  Synthetic Oligonucleotide; PDCD1LG2 exon 3; Set B
cuguuggagagaugcuuccauggauu

SEQ ID NO: 42371 - RNA, 27 nt, Artificial Sequence
  Synthetic Oligonucleotide; PDCD1LG2 exon 3; Set B
ucuguuggagagaugcuuccauggauu

SEQ ID NO: 42372 - RNA, 15 nt, Artificial Sequence
  Synthetic Oligonucleotide; PDCD1LG2 exon 3; Set C
cucuguuggagagau

SEQ ID NO: 42373 - RNA, 16 nt, Artificial Sequence
  Synthetic Oligonucleotide; PDCD1LG2 exon 3; Set C
ccucuguuggagagau

SEQ ID NO: 42374 - RNA, 20 nt, Artificial Sequence
  Synthetic Oligonucleotide; PDCD1LG2 exon 4; Set C
aaaagaaauaagacuuuauu

SEQ ID NO: 42375 - RNA, 19 nt, Artificial Sequence
  Synthetic Oligonucleotide; PDCD1LG2 exon 4; Set C
aaaagaaauaagacuuuau

SEQ ID NO: 42376 - RNA, 21 nt, Artificial Sequence
  Synthetic Oligonucleotide; PDCD1LG2 exon 4; Set C
aaaaagaaauaagacuuuauu

SEQ ID NO: 42377 - RNA, 20 nt, Artificial Sequence
  Synthetic Oligonucleotide; PDCD1LG2 exon 4; Set C
aaaaagaaauaagacuuuau

SEQ ID NO: 42378 - RNA, 22 nt, Artificial Sequence
  Synthetic Oligonucleotide; PDCD1LG2 exon 4; Set C
gaaaaagaaauaagacuuuauu

SEQ ID NO: 42379 - RNA, 21 nt, Artificial Sequence
  Synthetic Oligonucleotide; PDCD1LG2 exon 4; Set C
gaaaaagaaauaagacuuuau

SEQ ID NO: 42380 - RNA, 28 nt, Artificial Sequence
  Synthetic Oligonucleotide; PDCD1LG2 exon 4; Set C
uagagaagaaaaagaaauaagacuuuau

SEQ ID NO: 42381 - RNA, 30 nt, Artificial Sequence
  Synthetic Oligonucleotide; PDCD1LG2 exon 4; Set C
auagagaagaaaaagaaauaagacuuuauu

SEQ ID NO: 42382 - RNA, 29 nt, Artificial Sequence
  Synthetic Oligonucleotide; PDCD1LG2 exon 4; Set C
auagagaagaaaaagaaauaagacuuuau

SEQ ID NO: 42383 - RNA, 31 nt, Artificial Sequence
  Synthetic Oligonucleotide; PDCD1LG2 exon 4; Set C
aauagagaagaaaaagaaauaagacuuuauu

SEQ ID NO: 42384 - RNA, 30 nt, Artificial Sequence
  Synthetic Oligonucleotide; PDCD1LG2 exon 4; Set C
aauagagaagaaaaagaaauaagacuuuau

SEQ ID NO: 42385 - RNA, 32 nt, Artificial Sequence
  Synthetic Oligonucleotide; PDCD1LG2 exon 4; Set C
caauagagaagaaaaagaaauaagacuuuauu

SEQ ID NO: 42386 - RNA, 31 nt, Artificial Sequence
  Synthetic Oligonucleotide; PDCD1LG2 exon 4; Set C
caauagagaagaaaaagaaauaagacuuuau

SEQ ID NO: 42387 - RNA, 33 nt, Artificial Sequence
  Synthetic Oligonucleotide; PDCD1LG2 exon 4; Set C
acaauagagaagaaaaagaaauaagacuuuauu

SEQ ID NO: 42388 - RNA, 32 nt, Artificial Sequence
  Synthetic Oligonucleotide; PDCD1LG2 exon 4; Set C
acaauagagaagaaaaagaaauaagacuuuau

SEQ ID NO: 42389 - RNA, 34 nt, Artificial Sequence
  Synthetic Oligonucleotide; PDCD1LG2 exon 4; Set C
gacaauagagaagaaaaagaaauaagacuuuauu

SEQ ID NO: 42390 - RNA, 33 nt, Artificial Sequence
  Synthetic Oligonucleotide; PDCD1LG2 exon 4; Set C
gacaauagagaagaaaaagaaauaagacuuuau

SEQ ID NO: 42391 - RNA, 15 nt, Artificial Sequence
  Synthetic Oligonucleotide; PDCD1LG2 exon 4; Set C
caauagagaagaaaa

SEQ ID NO: 42392 - RNA, 16 nt, Artificial Sequence
  Synthetic Oligonucleotide; PDCD1LG2 exon 4; Set C
acaauagagaagaaaa

SEQ ID NO: 42393 - RNA, 15 nt, Artificial Sequence
  Synthetic Oligonucleotide; PDCD1LG2 exon 4; Set C
acaauagagaagaaa

SEQ ID NO: 42394 - RNA, 17 nt, Artificial Sequence
  Synthetic Oligonucleotide; PDCD1LG2 exon 4; Set C
gacaauagagaagaaaa

SEQ ID NO: 42395 - RNA, 16 nt, Artificial Sequence
  Synthetic Oligonucleotide; PDCD1LG2 exon 4; Set C
gacaauagagaagaaa

SEQ ID NO: 42396 - RNA, 15 nt, Artificial Sequence
  Synthetic Oligonucleotide; PDCD1LG2 exon 4; Set C
gacaauagagaagaa

SEQ ID NO: 42397 - RNA, 15 nt, Artificial Sequence
  Synthetic Oligonucleotide; PDCD1LG2 exon 4; Set C
uuuaggaugugagug

SEQ ID NO: 42398 - RNA, 15 nt, Artificial Sequence
  Synthetic Oligonucleotide; PDCD1LG2 exon 4; Set C
aaauaagacuuuauu

SEQ ID NO: 42399 - RNA, 15 nt, Artificial Sequence
  Synthetic Oligonucleotide; PDCD1LG2 exon 4; Set C
aaaagaaauaagacu

SEQ ID NO: 42400 - RNA, 16 nt, Artificial Sequence
  Synthetic Oligonucleotide; PDCD1LG2 exon 4; Set C
aaaaagaaauaagacu

SEQ ID NO: 42401 - RNA, 15 nt, Artificial Sequence
  Synthetic Oligonucleotide; PDCD1LG2 exon 4; Set C
aaaaagaaauaagac

SEQ ID NO: 42402 - RNA, 17 nt, Artificial Sequence
  Synthetic Oligonucleotide; PDCD1LG2 exon 4; Set C
gaaaaagaaauaagacu

SEQ ID NO: 42403 - RNA, 16 nt, Artificial Sequence
  Synthetic Oligonucleotide; PDCD1LG2 exon 4; Set C
gaaaaagaaauaagac

SEQ ID NO: 42404 - RNA, 29 nt, Artificial Sequence
  Synthetic Oligonucleotide; PDCD1LG2 exon 4; Set C
uagagaagaaaaagaaauaagacuuuauu

SEQ ID NO: 42405 - RNA, 15 nt, Artificial Sequence
  Synthetic Oligonucleotide; PDCD1LG2 exon 4; Set C
gaaaaagaaauaaga

SEQ ID NO: 42406 - RNA, 24 nt, Artificial Sequence
  Synthetic Oligonucleotide; PDCD1LG2 exon 4; Set C
uagagaagaaaaagaaauaagacu

SEQ ID NO: 42407 - RNA, 25 nt, Artificial Sequence
  Synthetic Oligonucleotide; PDCD1LG2 exon 4; Set C
auagagaagaaaaagaaauaagacu

SEQ ID NO: 42408 - RNA, 23 nt, Artificial Sequence
  Synthetic Oligonucleotide; PDCD1LG2 exon 4; Set C
uagagaagaaaaagaaauaagac

SEQ ID NO: 42409 - RNA, 22 nt, Artificial Sequence
  Synthetic Oligonucleotide; PDCD1LG2 exon 4; Set C
uagagaagaaaaagaaauaaga

SEQ ID NO: 42410 - RNA, 24 nt, Artificial Sequence
  Synthetic Oligonucleotide; PDCD1LG2 exon 4; Set C
auagagaagaaaaagaaauaagac

SEQ ID NO: 42411 - RNA, 26 nt, Artificial Sequence
  Synthetic Oligonucleotide; PDCD1LG2 exon 4; Set C
aauagagaagaaaaagaaauaagacu

SEQ ID NO: 42412 - RNA, 21 nt, Artificial Sequence
  Synthetic Oligonucleotide; PDCD1LG2 exon 4; Set C
uagagaagaaaaagaaauaag

SEQ ID NO: 42413 - RNA, 23 nt, Artificial Sequence
  Synthetic Oligonucleotide; PDCD1LG2 exon 4; Set C
auagagaagaaaaagaaauaaga

SEQ ID NO: 42414 - RNA, 25 nt, Artificial Sequence
  Synthetic Oligonucleotide; PDCD1LG2 exon 4; Set C
aauagagaagaaaaagaaauaagac

SEQ ID NO: 42415 - RNA, 27 nt, Artificial Sequence
  Synthetic Oligonucleotide; PDCD1LG2 exon 4; Set C
caauagagaagaaaaagaaauaagacu

SEQ ID NO: 42416 - RNA, 22 nt, Artificial Sequence
  Synthetic Oligonucleotide; PDCD1LG2 exon 4; Set C
auagagaagaaaaagaaauaag

SEQ ID NO: 42417 - RNA, 24 nt, Artificial Sequence
  Synthetic Oligonucleotide; PDCD1LG2 exon 4; Set C
aauagagaagaaaaagaaauaaga

SEQ ID NO: 42418 - RNA, 26 nt, Artificial Sequence
  Synthetic Oligonucleotide; PDCD1LG2 exon 4; Set C
caauagagaagaaaaagaaauaagac

SEQ ID NO: 42419 - RNA, 28 nt, Artificial Sequence
  Synthetic Oligonucleotide; PDCD1LG2 exon 4; Set C
acaauagagaagaaaaagaaauaagacu

SEQ ID NO: 42420 - RNA, 23 nt, Artificial Sequence
  Synthetic Oligonucleotide; PDCD1LG2 exon 4; Set C
aauagagaagaaaaagaaauaag

SEQ ID NO: 42421 - RNA, 25 nt, Artificial Sequence
  Synthetic Oligonucleotide; PDCD1LG2 exon 4; Set C
caauagagaagaaaaagaaauaaga

SEQ ID NO: 42422 - RNA, 27 nt, Artificial Sequence
  Synthetic Oligonucleotide; PDCD1LG2 exon 4; Set C
acaauagagaagaaaaagaaauaagac

SEQ ID NO: 42423 - RNA, 29 nt, Artificial Sequence
  Synthetic Oligonucleotide; PDCD1LG2 exon 4; Set C
gacaauagagaagaaaaagaaauaagacu

SEQ ID NO: 42424 - RNA, 24 nt, Artificial Sequence
  Synthetic Oligonucleotide; PDCD1LG2 exon 4; Set C
caauagagaagaaaaagaaauaag

SEQ ID NO: 42425 - RNA, 26 nt, Artificial Sequence
  Synthetic Oligonucleotide; PDCD1LG2 exon 4; Set C
acaauagagaagaaaaagaaauaaga

SEQ ID NO: 42426 - RNA, 28 nt, Artificial Sequence
  Synthetic Oligonucleotide; PDCD1LG2 exon 4; Set C
gacaauagagaagaaaaagaaauaagac

SEQ ID NO: 42427 - RNA, 17 nt, Artificial Sequence
  Synthetic Oligonucleotide; PDCD1LG2 exon 4; Set C
uagagaagaaaaagaaa

SEQ ID NO: 42428 - RNA, 25 nt, Artificial Sequence
  Synthetic Oligonucleotide; PDCD1LG2 exon 4; Set C
acaauagagaagaaaaagaaauaag

SEQ ID NO: 42429 - RNA, 27 nt, Artificial Sequence
  Synthetic Oligonucleotide; PDCD1LG2 exon 4; Set C
gacaauagagaagaaaaagaaauaaga

SEQ ID NO: 42430 - RNA, 18 nt, Artificial Sequence
  Synthetic Oligonucleotide; PDCD1LG2 exon 4; Set C
auagagaagaaaaagaaa

SEQ ID NO: 42431 - RNA, 26 nt, Artificial Sequence
  Synthetic Oligonucleotide; PDCD1LG2 exon 4; Set C
gacaauagagaagaaaaagaaauaag

SEQ ID NO: 42432 - RNA, 19 nt, Artificial Sequence
  Synthetic Oligonucleotide; PDCD1LG2 exon 4; Set C
aauagagaagaaaaagaaa

SEQ ID NO: 42433 - RNA, 20 nt, Artificial Sequence
  Synthetic Oligonucleotide; PDCD1LG2 exon 4; Set C
caauagagaagaaaaagaaa

SEQ ID NO: 42434 - RNA, 21 nt, Artificial Sequence
  Synthetic Oligonucleotide; PDCD1LG2 exon 4; Set C
acaauagagaagaaaaagaaa

SEQ ID NO: 42435 - RNA, 22 nt, Artificial Sequence
  Synthetic Oligonucleotide; PDCD1LG2 exon 4; Set C
gacaauagagaagaaaaagaaa

SEQ ID NO: 42436 - RNA, 40 nt, Artificial Sequence
  Synthetic Oligonucleotide; PDCD1LG2 exon 4; Set A
guguuuauuuuccuguaggaagcuggacaauagagaagaa

SEQ ID NO: 42437 - RNA, 33 nt, Artificial Sequence
  Synthetic Oligonucleotide; PDCD1LG2 exon 4; Set A
guguuuauuuuccuguaggaagcuggacaauag

SEQ ID NO: 42438 - RNA, 32 nt, Artificial Sequence
  Synthetic Oligonucleotide; PDCD1LG2 exon 4; Set A
guguuuauuuuccuguaggaagcuggacaaua

SEQ ID NO: 42439 - RNA, 34 nt, Artificial Sequence
  Synthetic Oligonucleotide; PDCD1LG2 exon 4; Set A
aguguuuauuuuccuguaggaagcuggacaauag

SEQ ID NO: 42440 - RNA, 33 nt, Artificial Sequence
  Synthetic Oligonucleotide; PDCD1LG2 exon 4; Set A
aguguuuauuuuccuguaggaagcuggacaaua

SEQ ID NO: 42441 - RNA, 31 nt, Artificial Sequence
  Synthetic Oligonucleotide; PDCD1LG2 exon 4; Set A
guguuuauuuuccuguaggaagcuggacaau

SEQ ID NO: 42442 - RNA, 32 nt, Artificial Sequence
  Synthetic Oligonucleotide; PDCD1LG2 exon 4; Set A
aguguuuauuuuccuguaggaagcuggacaau

SEQ ID NO: 42443 - RNA, 30 nt, Artificial Sequence
  Synthetic Oligonucleotide; PDCD1LG2 exon 4; Set A
guguuuauuuuccuguaggaagcuggacaa

SEQ ID NO: 42444 - RNA, 31 nt, Artificial Sequence
  Synthetic Oligonucleotide; PDCD1LG2 exon 4; Set A
aguguuuauuuuccuguaggaagcuggacaa

SEQ ID NO: 42445 - RNA, 29 nt, Artificial Sequence
  Synthetic Oligonucleotide; PDCD1LG2 exon 4; Set A
guguuuauuuuccuguaggaagcuggaca

SEQ ID NO: 42446 - RNA, 30 nt, Artificial Sequence
  Synthetic Oligonucleotide; PDCD1LG2 exon 4; Set A
aguguuuauuuuccuguaggaagcuggaca

SEQ ID NO: 42447 - RNA, 28 nt, Artificial Sequence
  Synthetic Oligonucleotide; PDCD1LG2 exon 4; Set A
guguuuauuuuccuguaggaagcuggac

SEQ ID NO: 42448 - RNA, 29 nt, Artificial Sequence
  Synthetic Oligonucleotide; PDCD1LG2 exon 4; Set A
aguguuuauuuuccuguaggaagcuggac

SEQ ID NO: 42449 - RNA, 40 nt, Artificial Sequence
  Synthetic Oligonucleotide; PDCD1LG2 exon 4; Set C
ggaugugaguguuuauuuuccuguaggaagcuggacaaua

SEQ ID NO: 42450 - RNA, 39 nt, Artificial Sequence
  Synthetic Oligonucleotide; PDCD1LG2 exon 4; Set C
ggaugugaguguuuauuuuccuguaggaagcuggacaau

SEQ ID NO: 42451 - RNA, 40 nt, Artificial Sequence
  Synthetic Oligonucleotide; PDCD1LG2 exon 4; Set C
aggaugugaguguuuauuuuccuguaggaagcuggacaau

SEQ ID NO: 42452 - RNA, 38 nt, Artificial Sequence
  Synthetic Oligonucleotide; PDCD1LG2 exon 4; Set C
ggaugugaguguuuauuuuccuguaggaagcuggacaa

SEQ ID NO: 42453 - RNA, 39 nt, Artificial Sequence
  Synthetic Oligonucleotide; PDCD1LG2 exon 4; Set C
aggaugugaguguuuauuuuccuguaggaagcuggacaa

SEQ ID NO: 42454 - RNA, 37 nt, Artificial Sequence
  Synthetic Oligonucleotide; PDCD1LG2 exon 4; Set C
ggaugugaguguuuauuuuccuguaggaagcuggaca

SEQ ID NO: 42455 - RNA, 40 nt, Artificial Sequence
  Synthetic Oligonucleotide; PDCD1LG2 exon 4; Set C
uaggaugugaguguuuauuuuccuguaggaagcuggacaa

SEQ ID NO: 42456 - RNA, 38 nt, Artificial Sequence
  Synthetic Oligonucleotide; PDCD1LG2 exon 4; Set C
aggaugugaguguuuauuuuccuguaggaagcuggaca

SEQ ID NO: 42457 - RNA, 36 nt, Artificial Sequence
  Synthetic Oligonucleotide; PDCD1LG2 exon 4; Set C
ggaugugaguguuuauuuuccuguaggaagcuggac

SEQ ID NO: 42458 - RNA, 39 nt, Artificial Sequence
  Synthetic Oligonucleotide; PDCD1LG2 exon 4; Set C
uaggaugugaguguuuauuuuccuguaggaagcuggaca

SEQ ID NO: 42459 - RNA, 37 nt, Artificial Sequence
  Synthetic Oligonucleotide; PDCD1LG2 exon 4; Set C
aggaugugaguguuuauuuuccuguaggaagcuggac

SEQ ID NO: 42460 - RNA, 40 nt, Artificial Sequence
  Synthetic Oligonucleotide; PDCD1LG2 exon 4; Set C
uuaggaugugaguguuuauuuuccuguaggaagcuggaca

SEQ ID NO: 42461 - RNA, 38 nt, Artificial Sequence
  Synthetic Oligonucleotide; PDCD1LG2 exon 4; Set C
uaggaugugaguguuuauuuuccuguaggaagcuggac

SEQ ID NO: 42462 - RNA, 39 nt, Artificial Sequence
  Synthetic Oligonucleotide; PDCD1LG2 exon 4; Set C
uuaggaugugaguguuuauuuuccuguaggaagcuggac

SEQ ID NO: 42463 - RNA, 40 nt, Artificial Sequence
  Synthetic Oligonucleotide; PDCD1LG2 exon 4; Set C
uuuaggaugugaguguuuauuuuccuguaggaagcuggac

SEQ ID NO: 42464 - RNA, 18 nt, Artificial Sequence
  Synthetic Oligonucleotide; PDCD1LG2 exon 4; Set C
ggaugugaguguuuauuu

SEQ ID NO: 42465 - RNA, 19 nt, Artificial Sequence
  Synthetic Oligonucleotide; PDCD1LG2 exon 4; Set C
aggaugugaguguuuauuu

SEQ ID NO: 42466 - RNA, 20 nt, Artificial Sequence
  Synthetic Oligonucleotide; PDCD1LG2 exon 4; Set C
uaggaugugaguguuuauuu

SEQ ID NO: 42467 - RNA, 21 nt, Artificial Sequence
  Synthetic Oligonucleotide; PDCD1LG2 exon 4; Set C
uuaggaugugaguguuuauuu

SEQ ID NO: 42468 - RNA, 19 nt, Artificial Sequence
  Synthetic Oligonucleotide; PDCD1LG2 exon 4; Set C
uaggaugugaguguuuauu

SEQ ID NO: 42469 - RNA, 22 nt, Artificial Sequence
  Synthetic Oligonucleotide; PDCD1LG2 exon 4; Set C
uuuaggaugugaguguuuauuu

SEQ ID NO: 42470 - RNA, 20 nt, Artificial Sequence
  Synthetic Oligonucleotide; PDCD1LG2 exon 4; Set C
uuaggaugugaguguuuauu

SEQ ID NO: 42471 - RNA, 21 nt, Artificial Sequence
  Synthetic Oligonucleotide; PDCD1LG2 exon 4; Set C
uuuaggaugugaguguuuauu

SEQ ID NO: 42472 - RNA, 19 nt, Artificial Sequence
  Synthetic Oligonucleotide; PDCD1LG2 exon 4; Set C
uuaggaugugaguguuuau

SEQ ID NO: 42473 - RNA, 17 nt, Artificial Sequence
  Synthetic Oligonucleotide; PDCD1LG2 exon 4; Set C
uaggaugugaguguuua

SEQ ID NO: 42474 - RNA, 20 nt, Artificial Sequence
  Synthetic Oligonucleotide; PDCD1LG2 exon 4; Set C
uuuaggaugugaguguuuau

SEQ ID NO: 42475 - RNA, 18 nt, Artificial Sequence
  Synthetic Oligonucleotide; PDCD1LG2 exon 4; Set C
uuaggaugugaguguuua

SEQ ID NO: 42476 - RNA, 19 nt, Artificial Sequence
  Synthetic Oligonucleotide; PDCD1LG2 exon 4; Set C
uuuaggaugugaguguuua

SEQ ID NO: 42477 - RNA, 18 nt, Artificial Sequence
  Synthetic Oligonucleotide; PDCD1LG2 exon 4; Set C
uuuaggaugugaguguuu

SEQ ID NO: 42478 - RNA, 17 nt, Artificial Sequence
  Synthetic Oligonucleotide; PDCD1LG2 exon 4; Set C
uuuaggaugugaguguu

SEQ ID NO: 42479 - RNA, 16 nt, Artificial Sequence
  Synthetic Oligonucleotide; PDCD1LG2 exon 4; Set C
uuuaggaugugagugu

SEQ ID NO: 42480 - RNA, 16 nt, Artificial Sequence
  Synthetic Oligonucleotide; PDCD1LG2 exon 4; Set C
cuuuaggaugugagug

SEQ ID NO: 42481 - RNA, 15 nt, Artificial Sequence
  Synthetic Oligonucleotide; PDCD1LG2 exon 4; Set C
cuuuaggaugugagu

SEQ ID NO: 42482 - RNA, 20 nt, Artificial Sequence
  Synthetic Oligonucleotide; PDCD1LG2 exon 4; Set C
gaaccuuuaggaugugagug

SEQ ID NO: 42483 - RNA, 21 nt, Artificial Sequence
  Synthetic Oligonucleotide; PDCD1LG2 exon 4; Set C
ggaaccuuuaggaugugagug

SEQ ID NO: 42484 - RNA, 19 nt, Artificial Sequence
  Synthetic Oligonucleotide; PDCD1LG2 exon 4; Set C
gaaccuuuaggaugugagu

SEQ ID NO: 42485 - RNA, 22 nt, Artificial Sequence
  Synthetic Oligonucleotide; PDCD1LG2 exon 4; Set C
uggaaccuuuaggaugugagug

SEQ ID NO: 42486 - RNA, 20 nt, Artificial Sequence
  Synthetic Oligonucleotide; PDCD1LG2 exon 4; Set C
ggaaccuuuaggaugugagu

SEQ ID NO: 42487 - RNA, 21 nt, Artificial Sequence
  Synthetic Oligonucleotide; PDCD1LG2 exon 4; Set C
uggaaccuuuaggaugugagu

SEQ ID NO: 42488 - RNA, 32 nt, Artificial Sequence
  Synthetic Oligonucleotide; PDCD1LG2 exon 4; Set A
caucuguuucuggaaccuuuaggaugugagug

SEQ ID NO: 42489 - RNA, 33 nt, Artificial Sequence
  Synthetic Oligonucleotide; PDCD1LG2 exon 4; Set A
ucaucuguuucuggaaccuuuaggaugugagug

SEQ ID NO: 42490 - RNA, 31 nt, Artificial Sequence
  Synthetic Oligonucleotide; PDCD1LG2 exon 4; Set A
caucuguuucuggaaccuuuaggaugugagu

SEQ ID NO: 42491 - RNA, 32 nt, Artificial Sequence
  Synthetic Oligonucleotide; PDCD1LG2 exon 4; Set A
ucaucuguuucuggaaccuuuaggaugugagu

SEQ ID NO: 42492 - RNA, 24 nt, Artificial Sequence
  Synthetic Oligonucleotide; PDCD1LG2 exon 4; Set A
caucuguuucuggaaccuuuagga

SEQ ID NO: 42493 - RNA, 23 nt, Artificial Sequence
  Synthetic Oligonucleotide; PDCD1LG2 exon 4; Set C
caucuguuucuggaaccuuuagg

SEQ ID NO: 42494 - RNA, 22 nt, Artificial Sequence
  Synthetic Oligonucleotide; PDCD1LG2 exon 4; Set C
caucuguuucuggaaccuuuag

SEQ ID NO: 42495 - RNA, 21 nt, Artificial Sequence
  Synthetic Oligonucleotide; PDCD1LG2 exon 4; Set C
caucuguuucuggaaccuuua

SEQ ID NO: 42496 - RNA, 20 nt, Artificial Sequence
  Synthetic Oligonucleotide; PDCD1LG2 exon 4; Set C
caucuguuucuggaaccuuu

SEQ ID NO: 42497 - RNA, 33 nt, Artificial Sequence
  Synthetic Oligonucleotide; PDCD1LG2 exon 4; Set C
aguggcugguguuggcaggaacgcugacguuug

SEQ ID NO: 42498 - RNA, 34 nt, Artificial Sequence
  Synthetic Oligonucleotide; PDCD1LG2 exon 4; Set C
gaguggcugguguuggcaggaacgcugacguuug

SEQ ID NO: 42499 - RNA, 32 nt, Artificial Sequence
  Synthetic Oligonucleotide; PDCD1LG2 exon 4; Set C
aguggcugguguuggcaggaacgcugacguuu

SEQ ID NO: 42500 - RNA, 33 nt, Artificial Sequence
  Synthetic Oligonucleotide; PDCD1LG2 exon 4; Set C
gaguggcugguguuggcaggaacgcugacguuu

SEQ ID NO: 42501 - RNA, 31 nt, Artificial Sequence
  Synthetic Oligonucleotide; PDCD1LG2 exon 4; Set C
aguggcugguguuggcaggaacgcugacguu

SEQ ID NO: 42502 - RNA, 32 nt, Artificial Sequence
  Synthetic Oligonucleotide; PDCD1LG2 exon 4; Set C
gaguggcugguguuggcaggaacgcugacguu

SEQ ID NO: 42503 - RNA, 15 nt, Artificial Sequence
  Synthetic Oligonucleotide; PDCD1LG2 exon 4; Set C
aggggguggcuuuag

SEQ ID NO: 42504 - RNA, 23 nt, Artificial Sequence
  Synthetic Oligonucleotide; PDCD1LG2 exon 4; Set A
uuucugccaggggguggcuuuag

SEQ ID NO: 42505 - RNA, 22 nt, Artificial Sequence
  Synthetic Oligonucleotide; PDCD1LG2 exon 4; Set C
uuucugccaggggguggcuuua

SEQ ID NO: 42506 - RNA, 22 nt, Artificial Sequence
  Synthetic Oligonucleotide; PDCD1LG2 exon 4; Set C
aaauaagacuuuauuuucugau

SEQ ID NO: 42507 - RNA, 27 nt, Artificial Sequence
  Synthetic Oligonucleotide; PDCD1LG2 exon 4; Set C
aaaagaaauaagacuuuauuuucugau

SEQ ID NO: 42508 - RNA, 28 nt, Artificial Sequence
  Synthetic Oligonucleotide; PDCD1LG2 exon 4; Set C
aaaaagaaauaagacuuuauuuucugau

SEQ ID NO: 42509 - RNA, 26 nt, Artificial Sequence
  Synthetic Oligonucleotide; PDCD1LG2 exon 4; Set C
aaaagaaauaagacuuuauuuucuga

SEQ ID NO: 42510 - RNA, 16 nt, Artificial Sequence
  Synthetic Oligonucleotide; PDCD1LG2 exon 4; Set C
aaauaagacuuuauuu

SEQ ID NO: 42511 - RNA, 29 nt, Artificial Sequence
  Synthetic Oligonucleotide; PDCD1LG2 exon 4; Set C
gaaaaagaaauaagacuuuauuuucugau

SEQ ID NO: 42512 - RNA, 27 nt, Artificial Sequence
  Synthetic Oligonucleotide; PDCD1LG2 exon 4; Set C
aaaaagaaauaagacuuuauuuucuga

SEQ ID NO: 42513 - RNA, 16 nt, Artificial Sequence
  Synthetic Oligonucleotide; PDCD1LG2 exon 4; Set C
gaaauaagacuuuauu

SEQ ID NO: 42514 - RNA, 28 nt, Artificial Sequence
  Synthetic Oligonucleotide; PDCD1LG2 exon 4; Set C
gaaaaagaaauaagacuuuauuuucuga

SEQ ID NO: 42515 - RNA, 15 nt, Artificial Sequence
  Synthetic Oligonucleotide; PDCD1LG2 exon 4; Set C
gaaauaagacuuuau

SEQ ID NO: 42516 - RNA, 17 nt, Artificial Sequence
  Synthetic Oligonucleotide; PDCD1LG2 exon 4; Set C
agaaauaagacuuuauu

SEQ ID NO: 42517 - RNA, 16 nt, Artificial Sequence
  Synthetic Oligonucleotide; PDCD1LG2 exon 4; Set C
agaaauaagacuuuau

SEQ ID NO: 42518 - RNA, 18 nt, Artificial Sequence
  Synthetic Oligonucleotide; PDCD1LG2 exon 4; Set C
aagaaauaagacuuuauu

SEQ ID NO: 42519 - RNA, 17 nt, Artificial Sequence
  Synthetic Oligonucleotide; PDCD1LG2 exon 4; Set C
aagaaauaagacuuuau

SEQ ID NO: 42520 - RNA, 19 nt, Artificial Sequence
  Synthetic Oligonucleotide; PDCD1LG2 exon 4; Set C
aaagaaauaagacuuuauu

SEQ ID NO: 42521 - RNA, 21 nt, Artificial Sequence
  Synthetic Oligonucleotide; PDCD1LG2 exon 4; Set C
aaaagaaauaagacuuuauuu

SEQ ID NO: 42522 - RNA, 18 nt, Artificial Sequence
  Synthetic Oligonucleotide; PDCD1LG2 exon 4; Set C
aaagaaauaagacuuuau

SEQ ID NO: 42523 - RNA, 22 nt, Artificial Sequence
  Synthetic Oligonucleotide; PDCD1LG2 exon 4; Set C
aaaaagaaauaagacuuuauuu

SEQ ID NO: 42524 - RNA, 23 nt, Artificial Sequence
  Synthetic Oligonucleotide; PDCD1LG2 exon 4; Set C
gaaaaagaaauaagacuuuauuu

SEQ ID NO: 42525 - RNA, 36 nt, Artificial Sequence
  Synthetic Oligonucleotide; PDCD1LG2 exon 4; Set C
uagagaagaaaaagaaauaagacuuuauuuucugau

SEQ ID NO: 42526 - RNA, 18 nt, Artificial Sequence
  Synthetic Oligonucleotide; PDCD1LG2 exon 4; Set C
aaaagaaauaagacuuua

SEQ ID NO: 42527 - RNA, 37 nt, Artificial Sequence
  Synthetic Oligonucleotide; PDCD1LG2 exon 4; Set C
auagagaagaaaaagaaauaagacuuuauuuucugau

SEQ ID NO: 42528 - RNA, 35 nt, Artificial Sequence
  Synthetic Oligonucleotide; PDCD1LG2 exon 4; Set C
uagagaagaaaaagaaauaagacuuuauuuucuga

SEQ ID NO: 42529 - RNA, 19 nt, Artificial Sequence
  Synthetic Oligonucleotide; PDCD1LG2 exon 4; Set C
aaaaagaaauaagacuuua

SEQ ID NO: 42530 - RNA, 17 nt, Artificial Sequence
  Synthetic Oligonucleotide; PDCD1LG2 exon 4; Set C
aaaagaaauaagacuuu

SEQ ID NO: 42531 - RNA, 38 nt, Artificial Sequence
  Synthetic Oligonucleotide; PDCD1LG2 exon 4; Set C
aauagagaagaaaaagaaauaagacuuuauuuucugau

SEQ ID NO: 42532 - RNA, 36 nt, Artificial Sequence
  Synthetic Oligonucleotide; PDCD1LG2 exon 4; Set C
auagagaagaaaaagaaauaagacuuuauuuucuga

SEQ ID NO: 42533 - RNA, 18 nt, Artificial Sequence
  Synthetic Oligonucleotide; PDCD1LG2 exon 4; Set C
aaaaagaaauaagacuuu

SEQ ID NO: 42534 - RNA, 20 nt, Artificial Sequence
  Synthetic Oligonucleotide; PDCD1LG2 exon 4; Set C
gaaaaagaaauaagacuuua

SEQ ID NO: 42535 - RNA, 16 nt, Artificial Sequence
  Synthetic Oligonucleotide; PDCD1LG2 exon 4; Set C
aaaagaaauaagacuu

SEQ ID NO: 42536 - RNA, 39 nt, Artificial Sequence
  Synthetic Oligonucleotide; PDCD1LG2 exon 4; Set C
caauagagaagaaaaagaaauaagacuuuauuuucugau

SEQ ID NO: 42537 - RNA, 37 nt, Artificial Sequence
  Synthetic Oligonucleotide; PDCD1LG2 exon 4; Set C
aauagagaagaaaaagaaauaagacuuuauuuucuga

SEQ ID NO: 42538 - RNA, 19 nt, Artificial Sequence
  Synthetic Oligonucleotide; PDCD1LG2 exon 4; Set C
gaaaaagaaauaagacuuu

SEQ ID NO: 42539 - RNA, 17 nt, Artificial Sequence
  Synthetic Oligonucleotide; PDCD1LG2 exon 4; Set C
aaaaagaaauaagacuu

SEQ ID NO: 42540 - RNA, 40 nt, Artificial Sequence
  Synthetic Oligonucleotide; PDCD1LG2 exon 4; Set C
acaauagagaagaaaaagaaauaagacuuuauuuucugau

SEQ ID NO: 42541 - RNA, 38 nt, Artificial Sequence
  Synthetic Oligonucleotide; PDCD1LG2 exon 4; Set C
caauagagaagaaaaagaaauaagacuuuauuuucuga

SEQ ID NO: 42542 - RNA, 18 nt, Artificial Sequence
  Synthetic Oligonucleotide; PDCD1LG2 exon 4; Set C
gaaaaagaaauaagacuu

SEQ ID NO: 42543 - RNA, 27 nt, Artificial Sequence
  Synthetic Oligonucleotide; PDCD1LG2 exon 4; Set C
gagaagaaaaagaaauaagacuuuauu

SEQ ID NO: 42544 - RNA, 39 nt, Artificial Sequence
  Synthetic Oligonucleotide; PDCD1LG2 exon 4; Set C
acaauagagaagaaaaagaaauaagacuuuauuuucuga

SEQ ID NO: 42545 - RNA, 26 nt, Artificial Sequence
  Synthetic Oligonucleotide; PDCD1LG2 exon 4; Set C
gagaagaaaaagaaauaagacuuuau

SEQ ID NO: 42546 - RNA, 28 nt, Artificial Sequence
  Synthetic Oligonucleotide; PDCD1LG2 exon 4; Set C
agagaagaaaaagaaauaagacuuuauu

SEQ ID NO: 42547 - RNA, 40 nt, Artificial Sequence
  Synthetic Oligonucleotide; PDCD1LG2 exon 4; Set C
gacaauagagaagaaaaagaaauaagacuuuauuuucuga

SEQ ID NO: 42548 - RNA, 30 nt, Artificial Sequence
  Synthetic Oligonucleotide; PDCD1LG2 exon 4; Set C
uagagaagaaaaagaaauaagacuuuauuu

SEQ ID NO: 42549 - RNA, 27 nt, Artificial Sequence
  Synthetic Oligonucleotide; PDCD1LG2 exon 4; Set C
agagaagaaaaagaaauaagacuuuau

SEQ ID NO: 42550 - RNA, 31 nt, Artificial Sequence
  Synthetic Oligonucleotide; PDCD1LG2 exon 4; Set C
auagagaagaaaaagaaauaagacuuuauuu

SEQ ID NO: 42551 - RNA, 32 nt, Artificial Sequence
  Synthetic Oligonucleotide; PDCD1LG2 exon 4; Set C
aauagagaagaaaaagaaauaagacuuuauuu

SEQ ID NO: 42552 - RNA, 33 nt, Artificial Sequence
  Synthetic Oligonucleotide; PDCD1LG2 exon 4; Set C
caauagagaagaaaaagaaauaagacuuuauuu

SEQ ID NO: 42553 - RNA, 27 nt, Artificial Sequence
  Synthetic Oligonucleotide; PDCD1LG2 exon 4; Set C
uagagaagaaaaagaaauaagacuuua

SEQ ID NO: 42554 - RNA, 34 nt, Artificial Sequence
  Synthetic Oligonucleotide; PDCD1LG2 exon 4; Set C
acaauagagaagaaaaagaaauaagacuuuauuu

SEQ ID NO: 42555 - RNA, 28 nt, Artificial Sequence
  Synthetic Oligonucleotide; PDCD1LG2 exon 4; Set C
auagagaagaaaaagaaauaagacuuua

SEQ ID NO: 42556 - RNA, 26 nt, Artificial Sequence
  Synthetic Oligonucleotide; PDCD1LG2 exon 4; Set C
uagagaagaaaaagaaauaagacuuu

SEQ ID NO: 42557 - RNA, 35 nt, Artificial Sequence
  Synthetic Oligonucleotide; PDCD1LG2 exon 4; Set C
gacaauagagaagaaaaagaaauaagacuuuauuu

SEQ ID NO: 42558 - RNA, 27 nt, Artificial Sequence
  Synthetic Oligonucleotide; PDCD1LG2 exon 4; Set C
auagagaagaaaaagaaauaagacuuu

SEQ ID NO: 42559 - RNA, 29 nt, Artificial Sequence
  Synthetic Oligonucleotide; PDCD1LG2 exon 4; Set C
aauagagaagaaaaagaaauaagacuuua

SEQ ID NO: 42560 - RNA, 25 nt, Artificial Sequence
  Synthetic Oligonucleotide; PDCD1LG2 exon 4; Set C
uagagaagaaaaagaaauaagacuu

SEQ ID NO: 42561 - RNA, 28 nt, Artificial Sequence
  Synthetic Oligonucleotide; PDCD1LG2 exon 4; Set C
aauagagaagaaaaagaaauaagacuuu

SEQ ID NO: 42562 - RNA, 30 nt, Artificial Sequence
  Synthetic Oligonucleotide; PDCD1LG2 exon 4; Set C
caauagagaagaaaaagaaauaagacuuua

SEQ ID NO: 42563 - RNA, 26 nt, Artificial Sequence
  Synthetic Oligonucleotide; PDCD1LG2 exon 4; Set C
auagagaagaaaaagaaauaagacuu

SEQ ID NO: 42564 - RNA, 35 nt, Artificial Sequence
  Synthetic Oligonucleotide; PDCD1LG2 exon 4; Set C
ggacaauagagaagaaaaagaaauaagacuuuauu

SEQ ID NO: 42565 - RNA, 29 nt, Artificial Sequence
  Synthetic Oligonucleotide; PDCD1LG2 exon 4; Set C
caauagagaagaaaaagaaauaagacuuu

SEQ ID NO: 42566 - RNA, 31 nt, Artificial Sequence
  Synthetic Oligonucleotide; PDCD1LG2 exon 4; Set C
acaauagagaagaaaaagaaauaagacuuua

SEQ ID NO: 42567 - RNA, 27 nt, Artificial Sequence
  Synthetic Oligonucleotide; PDCD1LG2 exon 4; Set C
aauagagaagaaaaagaaauaagacuu

SEQ ID NO: 42568 - RNA, 34 nt, Artificial Sequence
  Synthetic Oligonucleotide; PDCD1LG2 exon 4; Set C
ggacaauagagaagaaaaagaaauaagacuuuau

SEQ ID NO: 42569 - RNA, 36 nt, Artificial Sequence
  Synthetic Oligonucleotide; PDCD1LG2 exon 4; Set C
uggacaauagagaagaaaaagaaauaagacuuuauu

SEQ ID NO: 42570 - RNA, 20 nt, Artificial Sequence
  Synthetic Oligonucleotide; PDCD1LG2 exon 4; Set C
agagaagaaaaagaaauaag

SEQ ID NO: 42571 - RNA, 30 nt, Artificial Sequence
  Synthetic Oligonucleotide; PDCD1LG2 exon 4; Set C
acaauagagaagaaaaagaaauaagacuuu

SEQ ID NO: 42572 - RNA, 32 nt, Artificial Sequence
  Synthetic Oligonucleotide; PDCD1LG2 exon 4; Set C
gacaauagagaagaaaaagaaauaagacuuua

SEQ ID NO: 42573 - RNA, 28 nt, Artificial Sequence
  Synthetic Oligonucleotide; PDCD1LG2 exon 4; Set C
caauagagaagaaaaagaaauaagacuu

SEQ ID NO: 42574 - RNA, 35 nt, Artificial Sequence
  Synthetic Oligonucleotide; PDCD1LG2 exon 4; Set C
uggacaauagagaagaaaaagaaauaagacuuuau

SEQ ID NO: 42575 - RNA, 31 nt, Artificial Sequence
  Synthetic Oligonucleotide; PDCD1LG2 exon 4; Set C
gacaauagagaagaaaaagaaauaagacuuu

SEQ ID NO: 42576 - RNA, 29 nt, Artificial Sequence
  Synthetic Oligonucleotide; PDCD1LG2 exon 4; Set C
acaauagagaagaaaaagaaauaagacuu

SEQ ID NO: 42577 - RNA, 20 nt, Artificial Sequence
  Synthetic Oligonucleotide; PDCD1LG2 exon 4; Set C
uagagaagaaaaagaaauaa

SEQ ID NO: 42578 - RNA, 30 nt, Artificial Sequence
  Synthetic Oligonucleotide; PDCD1LG2 exon 4; Set C
gacaauagagaagaaaaagaaauaagacuu

SEQ ID NO: 42579 - RNA, 15 nt, Artificial Sequence
  Synthetic Oligonucleotide; PDCD1LG2 exon 4; Set C
gagaagaaaaagaaa

SEQ ID NO: 42580 - RNA, 21 nt, Artificial Sequence
  Synthetic Oligonucleotide; PDCD1LG2 exon 4; Set C
auagagaagaaaaagaaauaa

SEQ ID NO: 42581 - RNA, 19 nt, Artificial Sequence
  Synthetic Oligonucleotide; PDCD1LG2 exon 4; Set C
uagagaagaaaaagaaaua

SEQ ID NO: 42582 - RNA, 16 nt, Artificial Sequence
  Synthetic Oligonucleotide; PDCD1LG2 exon 4; Set C
agagaagaaaaagaaa

SEQ ID NO: 42583 - RNA, 22 nt, Artificial Sequence
  Synthetic Oligonucleotide; PDCD1LG2 exon 4; Set C
aauagagaagaaaaagaaauaa

SEQ ID NO: 42584 - RNA, 20 nt, Artificial Sequence
  Synthetic Oligonucleotide; PDCD1LG2 exon 4; Set C
auagagaagaaaaagaaaua

SEQ ID NO: 42585 - RNA, 18 nt, Artificial Sequence
  Synthetic Oligonucleotide; PDCD1LG2 exon 4; Set C
uagagaagaaaaagaaau

SEQ ID NO: 42586 - RNA, 23 nt, Artificial Sequence
  Synthetic Oligonucleotide; PDCD1LG2 exon 4; Set C
caauagagaagaaaaagaaauaa

SEQ ID NO: 42587 - RNA, 21 nt, Artificial Sequence
  Synthetic Oligonucleotide; PDCD1LG2 exon 4; Set C
aauagagaagaaaaagaaaua

SEQ ID NO: 42588 - RNA, 19 nt, Artificial Sequence
  Synthetic Oligonucleotide; PDCD1LG2 exon 4; Set C
auagagaagaaaaagaaau

SEQ ID NO: 42589 - RNA, 24 nt, Artificial Sequence
  Synthetic Oligonucleotide; PDCD1LG2 exon 4; Set C
acaauagagaagaaaaagaaauaa

SEQ ID NO: 42590 - RNA, 22 nt, Artificial Sequence
  Synthetic Oligonucleotide; PDCD1LG2 exon 4; Set C
caauagagaagaaaaagaaaua

SEQ ID NO: 42591 - RNA, 20 nt, Artificial Sequence
  Synthetic Oligonucleotide; PDCD1LG2 exon 4; Set C
aauagagaagaaaaagaaau

SEQ ID NO: 42592 - RNA, 16 nt, Artificial Sequence
  Synthetic Oligonucleotide; PDCD1LG2 exon 4; Set C
uagagaagaaaaagaa

SEQ ID NO: 42593 - RNA, 27 nt, Artificial Sequence
  Synthetic Oligonucleotide; PDCD1LG2 exon 4; Set C
ggacaauagagaagaaaaagaaauaag

SEQ ID NO: 42594 - RNA, 25 nt, Artificial Sequence
  Synthetic Oligonucleotide; PDCD1LG2 exon 4; Set C
gacaauagagaagaaaaagaaauaa

SEQ ID NO: 42595 - RNA, 23 nt, Artificial Sequence
  Synthetic Oligonucleotide; PDCD1LG2 exon 4; Set C
acaauagagaagaaaaagaaaua

SEQ ID NO: 42596 - RNA, 21 nt, Artificial Sequence
  Synthetic Oligonucleotide; PDCD1LG2 exon 4; Set C
caauagagaagaaaaagaaau

SEQ ID NO: 42597 - RNA, 17 nt, Artificial Sequence
  Synthetic Oligonucleotide; PDCD1LG2 exon 4; Set C
auagagaagaaaaagaa

SEQ ID NO: 42598 - RNA, 15 nt, Artificial Sequence
  Synthetic Oligonucleotide; PDCD1LG2 exon 4; Set C
uagagaagaaaaaga

SEQ ID NO: 42599 - RNA, 28 nt, Artificial Sequence
  Synthetic Oligonucleotide; PDCD1LG2 exon 4; Set C
uggacaauagagaagaaaaagaaauaag

SEQ ID NO: 42600 - RNA, 24 nt, Artificial Sequence
  Synthetic Oligonucleotide; PDCD1LG2 exon 4; Set C
gacaauagagaagaaaaagaaaua

SEQ ID NO: 42601 - RNA, 22 nt, Artificial Sequence
  Synthetic Oligonucleotide; PDCD1LG2 exon 4; Set C
acaauagagaagaaaaagaaau

SEQ ID NO: 42602 - RNA, 16 nt, Artificial Sequence
  Synthetic Oligonucleotide; PDCD1LG2 exon 4; Set C
auagagaagaaaaaga

SEQ ID NO: 42603 - RNA, 18 nt, Artificial Sequence
  Synthetic Oligonucleotide; PDCD1LG2 exon 4; Set C
aauagagaagaaaaagaa

SEQ ID NO: 42604 - RNA, 23 nt, Artificial Sequence
  Synthetic Oligonucleotide; PDCD1LG2 exon 4; Set C
gacaauagagaagaaaaagaaau

SEQ ID NO: 42605 - RNA, 15 nt, Artificial Sequence
  Synthetic Oligonucleotide; PDCD1LG2 exon 4; Set C
auagagaagaaaaag

SEQ ID NO: 42606 - RNA, 17 nt, Artificial Sequence
  Synthetic Oligonucleotide; PDCD1LG2 exon 4; Set C
aauagagaagaaaaaga

SEQ ID NO: 42607 - RNA, 19 nt, Artificial Sequence
  Synthetic Oligonucleotide; PDCD1LG2 exon 4; Set C
caauagagaagaaaaagaa

SEQ ID NO: 42608 - RNA, 16 nt, Artificial Sequence
  Synthetic Oligonucleotide; PDCD1LG2 exon 4; Set C
aauagagaagaaaaag

SEQ ID NO: 42609 - RNA, 18 nt, Artificial Sequence
  Synthetic Oligonucleotide; PDCD1LG2 exon 4; Set C
caauagagaagaaaaaga

SEQ ID NO: 42610 - RNA, 20 nt, Artificial Sequence
  Synthetic Oligonucleotide; PDCD1LG2 exon 4; Set C
acaauagagaagaaaaagaa

SEQ ID NO: 42611 - RNA, 23 nt, Artificial Sequence
  Synthetic Oligonucleotide; PDCD1LG2 exon 4; Set C
ggacaauagagaagaaaaagaaa

SEQ ID NO: 42612 - RNA, 15 nt, Artificial Sequence
  Synthetic Oligonucleotide; PDCD1LG2 exon 4; Set C
aauagagaagaaaaa

SEQ ID NO: 42613 - RNA, 17 nt, Artificial Sequence
  Synthetic Oligonucleotide; PDCD1LG2 exon 4; Set C
caauagagaagaaaaag

SEQ ID NO: 42614 - RNA, 19 nt, Artificial Sequence
  Synthetic Oligonucleotide; PDCD1LG2 exon 4; Set C
acaauagagaagaaaaaga

SEQ ID NO: 42615 - RNA, 21 nt, Artificial Sequence
  Synthetic Oligonucleotide; PDCD1LG2 exon 4; Set C
gacaauagagaagaaaaagaa

SEQ ID NO: 42616 - RNA, 24 nt, Artificial Sequence
  Synthetic Oligonucleotide; PDCD1LG2 exon 4; Set C
uggacaauagagaagaaaaagaaa

SEQ ID NO: 42617 - RNA, 16 nt, Artificial Sequence
  Synthetic Oligonucleotide; PDCD1LG2 exon 4; Set C
caauagagaagaaaaa

SEQ ID NO: 42618 - RNA, 18 nt, Artificial Sequence
  Synthetic Oligonucleotide; PDCD1LG2 exon 4; Set C
acaauagagaagaaaaag

SEQ ID NO: 42619 - RNA, 20 nt, Artificial Sequence
  Synthetic Oligonucleotide; PDCD1LG2 exon 4; Set C
gacaauagagaagaaaaaga

SEQ ID NO: 42620 - RNA, 17 nt, Artificial Sequence
  Synthetic Oligonucleotide; PDCD1LG2 exon 4; Set C
acaauagagaagaaaaa

SEQ ID NO: 42621 - RNA, 19 nt, Artificial Sequence
  Synthetic Oligonucleotide; PDCD1LG2 exon 4; Set C
gacaauagagaagaaaaag

SEQ ID NO: 42622 - RNA, 18 nt, Artificial Sequence
  Synthetic Oligonucleotide; PDCD1LG2 exon 4; Set C
gacaauagagaagaaaaa

SEQ ID NO: 42623 - RNA, 18 nt, Artificial Sequence
  Synthetic Oligonucleotide; PDCD1LG2 exon 4; Set C
ggacaauagagaagaaaa

SEQ ID NO: 42624 - RNA, 19 nt, Artificial Sequence
  Synthetic Oligonucleotide; PDCD1LG2 exon 4; Set C
uggacaauagagaagaaaa

SEQ ID NO: 42625 - RNA, 17 nt, Artificial Sequence
  Synthetic Oligonucleotide; PDCD1LG2 exon 4; Set C
ggacaauagagaagaaa

SEQ ID NO: 42626 - RNA, 18 nt, Artificial Sequence
  Synthetic Oligonucleotide; PDCD1LG2 exon 4; Set C
uggacaauagagaagaaa

SEQ ID NO: 42627 - RNA, 16 nt, Artificial Sequence
  Synthetic Oligonucleotide; PDCD1LG2 exon 4; Set C
ggacaauagagaagaa

SEQ ID NO: 42628 - RNA, 17 nt, Artificial Sequence
  Synthetic Oligonucleotide; PDCD1LG2 exon 4; Set C
uggacaauagagaagaa

SEQ ID NO: 42629 - RNA, 40 nt, Artificial Sequence
  Synthetic Oligonucleotide; PDCD1LG2 exon 4; Set A
uuuuccuguaggaagcuggacaauagagaagaaaaagaaa

SEQ ID NO: 42630 - RNA, 35 nt, Artificial Sequence
  Synthetic Oligonucleotide; PDCD1LG2 exon 4; Set A
uuuuccuguaggaagcuggacaauagagaagaaaa

SEQ ID NO: 42631 - RNA, 34 nt, Artificial Sequence
  Synthetic Oligonucleotide; PDCD1LG2 exon 4; Set A
uuuuccuguaggaagcuggacaauagagaagaaa

SEQ ID NO: 42632 - RNA, 36 nt, Artificial Sequence
  Synthetic Oligonucleotide; PDCD1LG2 exon 4; Set A
auuuuccuguaggaagcuggacaauagagaagaaaa

SEQ ID NO: 42633 - RNA, 37 nt, Artificial Sequence
  Synthetic Oligonucleotide; PDCD1LG2 exon 4; Set A
uauuuuccuguaggaagcuggacaauagagaagaaaa

SEQ ID NO: 42634 - RNA, 35 nt, Artificial Sequence
  Synthetic Oligonucleotide; PDCD1LG2 exon 4; Set A
auuuuccuguaggaagcuggacaauagagaagaaa

SEQ ID NO: 42635 - RNA, 33 nt, Artificial Sequence
  Synthetic Oligonucleotide; PDCD1LG2 exon 4; Set A
uuuuccuguaggaagcuggacaauagagaagaa

SEQ ID NO: 42636 - RNA, 38 nt, Artificial Sequence
  Synthetic Oligonucleotide; PDCD1LG2 exon 4; Set A
uuauuuuccuguaggaagcuggacaauagagaagaaaa

SEQ ID NO: 42637 - RNA, 36 nt, Artificial Sequence
  Synthetic Oligonucleotide; PDCD1LG2 exon 4; Set A
uauuuuccuguaggaagcuggacaauagagaagaaa

SEQ ID NO: 42638 - RNA, 34 nt, Artificial Sequence
  Synthetic Oligonucleotide; PDCD1LG2 exon 4; Set A
auuuuccuguaggaagcuggacaauagagaagaa

SEQ ID NO: 42639 - RNA, 37 nt, Artificial Sequence
  Synthetic Oligonucleotide; PDCD1LG2 exon 4; Set A
uuauuuuccuguaggaagcuggacaauagagaagaaa

SEQ ID NO: 42640 - RNA, 39 nt, Artificial Sequence
  Synthetic Oligonucleotide; PDCD1LG2 exon 4; Set A
uuuauuuuccuguaggaagcuggacaauagagaagaaaa

SEQ ID NO: 42641 - RNA, 35 nt, Artificial Sequence
  Synthetic Oligonucleotide; PDCD1LG2 exon 4; Set A
uauuuuccuguaggaagcuggacaauagagaagaa

SEQ ID NO: 42642 - RNA, 40 nt, Artificial Sequence
  Synthetic Oligonucleotide; PDCD1LG2 exon 4; Set A
guuuauuuuccuguaggaagcuggacaauagagaagaaaa

SEQ ID NO: 42643 - RNA, 38 nt, Artificial Sequence
  Synthetic Oligonucleotide; PDCD1LG2 exon 4; Set A
uuuauuuuccuguaggaagcuggacaauagagaagaaa

SEQ ID NO: 42644 - RNA, 36 nt, Artificial Sequence
  Synthetic Oligonucleotide; PDCD1LG2 exon 4; Set A
uuauuuuccuguaggaagcuggacaauagagaagaa

SEQ ID NO: 42645 - RNA, 39 nt, Artificial Sequence
  Synthetic Oligonucleotide; PDCD1LG2 exon 4; Set A
guuuauuuuccuguaggaagcuggacaauagagaagaaa

SEQ ID NO: 42646 - RNA, 37 nt, Artificial Sequence
  Synthetic Oligonucleotide; PDCD1LG2 exon 4; Set A
uuuauuuuccuguaggaagcuggacaauagagaagaa

SEQ ID NO: 42647 - RNA, 40 nt, Artificial Sequence
  Synthetic Oligonucleotide; PDCD1LG2 exon 4; Set A
uguuuauuuuccuguaggaagcuggacaauagagaagaaa

SEQ ID NO: 42648 - RNA, 38 nt, Artificial Sequence
  Synthetic Oligonucleotide; PDCD1LG2 exon 4; Set A
guuuauuuuccuguaggaagcuggacaauagagaagaa

SEQ ID NO: 42649 - RNA, 39 nt, Artificial Sequence
  Synthetic Oligonucleotide; PDCD1LG2 exon 4; Set A
uguuuauuuuccuguaggaagcuggacaauagagaagaa

SEQ ID NO: 42650 - RNA, 26 nt, Artificial Sequence
  Synthetic Oligonucleotide; PDCD1LG2 exon 4; Set A
uuuuccuguaggaagcuggacaauag

SEQ ID NO: 42651 - RNA, 25 nt, Artificial Sequence
  Synthetic Oligonucleotide; PDCD1LG2 exon 4; Set A
uuuuccuguaggaagcuggacaaua

SEQ ID NO: 42652 - RNA, 27 nt, Artificial Sequence
  Synthetic Oligonucleotide; PDCD1LG2 exon 4; Set A
auuuuccuguaggaagcuggacaauag

SEQ ID NO: 42653 - RNA, 26 nt, Artificial Sequence
  Synthetic Oligonucleotide; PDCD1LG2 exon 4; Set A
auuuuccuguaggaagcuggacaaua

SEQ ID NO: 42654 - RNA, 24 nt, Artificial Sequence
  Synthetic Oligonucleotide; PDCD1LG2 exon 4; Set A
uuuuccuguaggaagcuggacaau

SEQ ID NO: 42655 - RNA, 28 nt, Artificial Sequence
  Synthetic Oligonucleotide; PDCD1LG2 exon 4; Set A
uauuuuccuguaggaagcuggacaauag

SEQ ID NO: 42656 - RNA, 27 nt, Artificial Sequence
  Synthetic Oligonucleotide; PDCD1LG2 exon 4; Set A
uauuuuccuguaggaagcuggacaaua

SEQ ID NO: 42657 - RNA, 25 nt, Artificial Sequence
  Synthetic Oligonucleotide; PDCD1LG2 exon 4; Set A
auuuuccuguaggaagcuggacaau

SEQ ID NO: 42658 - RNA, 23 nt, Artificial Sequence
  Synthetic Oligonucleotide; PDCD1LG2 exon 4; Set A
uuuuccuguaggaagcuggacaa

SEQ ID NO: 42659 - RNA, 29 nt, Artificial Sequence
  Synthetic Oligonucleotide; PDCD1LG2 exon 4; Set A
uuauuuuccuguaggaagcuggacaauag

SEQ ID NO: 42660 - RNA, 28 nt, Artificial Sequence
  Synthetic Oligonucleotide; PDCD1LG2 exon 4; Set A
uuauuuuccuguaggaagcuggacaaua

SEQ ID NO: 42661 - RNA, 26 nt, Artificial Sequence
  Synthetic Oligonucleotide; PDCD1LG2 exon 4; Set A
uauuuuccuguaggaagcuggacaau

SEQ ID NO: 42662 - RNA, 24 nt, Artificial Sequence
  Synthetic Oligonucleotide; PDCD1LG2 exon 4; Set A
auuuuccuguaggaagcuggacaa

SEQ ID NO: 42663 - RNA, 30 nt, Artificial Sequence
  Synthetic Oligonucleotide; PDCD1LG2 exon 4; Set A
uuuauuuuccuguaggaagcuggacaauag

SEQ ID NO: 42664 - RNA, 22 nt, Artificial Sequence
  Synthetic Oligonucleotide; PDCD1LG2 exon 4; Set A
uuuuccuguaggaagcuggaca

SEQ ID NO: 42665 - RNA, 29 nt, Artificial Sequence
  Synthetic Oligonucleotide; PDCD1LG2 exon 4; Set A
uuuauuuuccuguaggaagcuggacaaua

SEQ ID NO: 42666 - RNA, 27 nt, Artificial Sequence
  Synthetic Oligonucleotide; PDCD1LG2 exon 4; Set A
uuauuuuccuguaggaagcuggacaau

SEQ ID NO: 42667 - RNA, 25 nt, Artificial Sequence
  Synthetic Oligonucleotide; PDCD1LG2 exon 4; Set A
uauuuuccuguaggaagcuggacaa

SEQ ID NO: 42668 - RNA, 31 nt, Artificial Sequence
  Synthetic Oligonucleotide; PDCD1LG2 exon 4; Set A
guuuauuuuccuguaggaagcuggacaauag

SEQ ID NO: 42669 - RNA, 23 nt, Artificial Sequence
  Synthetic Oligonucleotide; PDCD1LG2 exon 4; Set A
auuuuccuguaggaagcuggaca

SEQ ID NO: 42670 - RNA, 21 nt, Artificial Sequence
  Synthetic Oligonucleotide; PDCD1LG2 exon 4; Set C
uuuuccuguaggaagcuggac

SEQ ID NO: 42671 - RNA, 35 nt, Artificial Sequence
  Synthetic Oligonucleotide; PDCD1LG2 exon 4; Set A
guguuuauuuuccuguaggaagcuggacaauagag

SEQ ID NO: 42672 - RNA, 30 nt, Artificial Sequence
  Synthetic Oligonucleotide; PDCD1LG2 exon 4; Set A
guuuauuuuccuguaggaagcuggacaaua

SEQ ID NO: 42673 - RNA, 28 nt, Artificial Sequence
  Synthetic Oligonucleotide; PDCD1LG2 exon 4; Set A
uuuauuuuccuguaggaagcuggacaau

SEQ ID NO: 42674 - RNA, 26 nt, Artificial Sequence
  Synthetic Oligonucleotide; PDCD1LG2 exon 4; Set A
uuauuuuccuguaggaagcuggacaa

SEQ ID NO: 42675 - RNA, 32 nt, Artificial Sequence
  Synthetic Oligonucleotide; PDCD1LG2 exon 4; Set A
uguuuauuuuccuguaggaagcuggacaauag

SEQ ID NO: 42676 - RNA, 24 nt, Artificial Sequence
  Synthetic Oligonucleotide; PDCD1LG2 exon 4; Set A
uauuuuccuguaggaagcuggaca

SEQ ID NO: 42677 - RNA, 22 nt, Artificial Sequence
  Synthetic Oligonucleotide; PDCD1LG2 exon 4; Set C
auuuuccuguaggaagcuggac

SEQ ID NO: 42678 - RNA, 34 nt, Artificial Sequence
  Synthetic Oligonucleotide; PDCD1LG2 exon 4; Set A
guguuuauuuuccuguaggaagcuggacaauaga

SEQ ID NO: 42679 - RNA, 36 nt, Artificial Sequence
  Synthetic Oligonucleotide; PDCD1LG2 exon 4; Set A
aguguuuauuuuccuguaggaagcuggacaauagag

SEQ ID NO: 42680 - RNA, 31 nt, Artificial Sequence
  Synthetic Oligonucleotide; PDCD1LG2 exon 4; Set A
uguuuauuuuccuguaggaagcuggacaaua

SEQ ID NO: 42681 - RNA, 29 nt, Artificial Sequence
  Synthetic Oligonucleotide; PDCD1LG2 exon 4; Set A
guuuauuuuccuguaggaagcuggacaau

SEQ ID NO: 42682 - RNA, 27 nt, Artificial Sequence
  Synthetic Oligonucleotide; PDCD1LG2 exon 4; Set A
uuuauuuuccuguaggaagcuggacaa

SEQ ID NO: 42683 - RNA, 25 nt, Artificial Sequence
  Synthetic Oligonucleotide; PDCD1LG2 exon 4; Set A
uuauuuuccuguaggaagcuggaca

SEQ ID NO: 42684 - RNA, 23 nt, Artificial Sequence
  Synthetic Oligonucleotide; PDCD1LG2 exon 4; Set C
uauuuuccuguaggaagcuggac

SEQ ID NO: 42685 - RNA, 35 nt, Artificial Sequence
  Synthetic Oligonucleotide; PDCD1LG2 exon 4; Set A
aguguuuauuuuccuguaggaagcuggacaauaga

SEQ ID NO: 42686 - RNA, 30 nt, Artificial Sequence
  Synthetic Oligonucleotide; PDCD1LG2 exon 4; Set A
uguuuauuuuccuguaggaagcuggacaau

SEQ ID NO: 42687 - RNA, 28 nt, Artificial Sequence
  Synthetic Oligonucleotide; PDCD1LG2 exon 4; Set A
guuuauuuuccuguaggaagcuggacaa

SEQ ID NO: 42688 - RNA, 26 nt, Artificial Sequence
  Synthetic Oligonucleotide; PDCD1LG2 exon 4; Set A
uuuauuuuccuguaggaagcuggaca

SEQ ID NO: 42689 - RNA, 24 nt, Artificial Sequence
  Synthetic Oligonucleotide; PDCD1LG2 exon 4; Set C
uuauuuuccuguaggaagcuggac

SEQ ID NO: 42690 - RNA, 29 nt, Artificial Sequence
  Synthetic Oligonucleotide; PDCD1LG2 exon 4; Set A
uguuuauuuuccuguaggaagcuggacaa

SEQ ID NO: 42691 - RNA, 35 nt, Artificial Sequence
  Synthetic Oligonucleotide; PDCD1LG2 exon 4; Set A
gaguguuuauuuuccuguaggaagcuggacaauag

SEQ ID NO: 42692 - RNA, 27 nt, Artificial Sequence
  Synthetic Oligonucleotide; PDCD1LG2 exon 4; Set A
guuuauuuuccuguaggaagcuggaca

SEQ ID NO: 42693 - RNA, 25 nt, Artificial Sequence
  Synthetic Oligonucleotide; PDCD1LG2 exon 4; Set A
uuuauuuuccuguaggaagcuggac

SEQ ID NO: 42694 - RNA, 34 nt, Artificial Sequence
  Synthetic Oligonucleotide; PDCD1LG2 exon 4; Set A
gaguguuuauuuuccuguaggaagcuggacaaua

SEQ ID NO: 42695 - RNA, 36 nt, Artificial Sequence
  Synthetic Oligonucleotide; PDCD1LG2 exon 4; Set A
ugaguguuuauuuuccuguaggaagcuggacaauag

SEQ ID NO: 42696 - RNA, 28 nt, Artificial Sequence
  Synthetic Oligonucleotide; PDCD1LG2 exon 4; Set A
uguuuauuuuccuguaggaagcuggaca

SEQ ID NO: 42697 - RNA, 26 nt, Artificial Sequence
  Synthetic Oligonucleotide; PDCD1LG2 exon 4; Set A
guuuauuuuccuguaggaagcuggac

SEQ ID NO: 42698 - RNA, 35 nt, Artificial Sequence
  Synthetic Oligonucleotide; PDCD1LG2 exon 4; Set A
ugaguguuuauuuuccuguaggaagcuggacaaua

SEQ ID NO: 42699 - RNA, 33 nt, Artificial Sequence
  Synthetic Oligonucleotide; PDCD1LG2 exon 4; Set A
gaguguuuauuuuccuguaggaagcuggacaau

SEQ ID NO: 42700 - RNA, 37 nt, Artificial Sequence
  Synthetic Oligonucleotide; PDCD1LG2 exon 4; Set A
gugaguguuuauuuuccuguaggaagcuggacaauag

SEQ ID NO: 42701 - RNA, 27 nt, Artificial Sequence
  Synthetic Oligonucleotide; PDCD1LG2 exon 4; Set A
uguuuauuuuccuguaggaagcuggac

SEQ ID NO: 42702 - RNA, 36 nt, Artificial Sequence
  Synthetic Oligonucleotide; PDCD1LG2 exon 4; Set C
gugaguguuuauuuuccuguaggaagcuggacaaua

SEQ ID NO: 42703 - RNA, 34 nt, Artificial Sequence
  Synthetic Oligonucleotide; PDCD1LG2 exon 4; Set A
ugaguguuuauuuuccuguaggaagcuggacaau

SEQ ID NO: 42704 - RNA, 32 nt, Artificial Sequence
  Synthetic Oligonucleotide; PDCD1LG2 exon 4; Set A
gaguguuuauuuuccuguaggaagcuggacaa

SEQ ID NO: 42705 - RNA, 38 nt, Artificial Sequence
  Synthetic Oligonucleotide; PDCD1LG2 exon 4; Set A
ugugaguguuuauuuuccuguaggaagcuggacaauag

SEQ ID NO: 42706 - RNA, 37 nt, Artificial Sequence
  Synthetic Oligonucleotide; PDCD1LG2 exon 4; Set C
ugugaguguuuauuuuccuguaggaagcuggacaaua

SEQ ID NO: 42707 - RNA, 35 nt, Artificial Sequence
  Synthetic Oligonucleotide; PDCD1LG2 exon 4; Set A
gugaguguuuauuuuccuguaggaagcuggacaau

SEQ ID NO: 42708 - RNA, 33 nt, Artificial Sequence
  Synthetic Oligonucleotide; PDCD1LG2 exon 4; Set A
ugaguguuuauuuuccuguaggaagcuggacaa

SEQ ID NO: 42709 - RNA, 39 nt, Artificial Sequence
  Synthetic Oligonucleotide; PDCD1LG2 exon 4; Set A
augugaguguuuauuuuccuguaggaagcuggacaauag

SEQ ID NO: 42710 - RNA, 31 nt, Artificial Sequence
  Synthetic Oligonucleotide; PDCD1LG2 exon 4; Set A
gaguguuuauuuuccuguaggaagcuggaca

SEQ ID NO: 42711 - RNA, 38 nt, Artificial Sequence
  Synthetic Oligonucleotide; PDCD1LG2 exon 4; Set C
augugaguguuuauuuuccuguaggaagcuggacaaua

SEQ ID NO: 42712 - RNA, 36 nt, Artificial Sequence
  Synthetic Oligonucleotide; PDCD1LG2 exon 4; Set C
ugugaguguuuauuuuccuguaggaagcuggacaau

SEQ ID NO: 42713 - RNA, 34 nt, Artificial Sequence
  Synthetic Oligonucleotide; PDCD1LG2 exon 4; Set C
gugaguguuuauuuuccuguaggaagcuggacaa

SEQ ID NO: 42714 - RNA, 40 nt, Artificial Sequence
  Synthetic Oligonucleotide; PDCD1LG2 exon 4; Set C
gaugugaguguuuauuuuccuguaggaagcuggacaauag

SEQ ID NO: 42715 - RNA, 32 nt, Artificial Sequence
  Synthetic Oligonucleotide; PDCD1LG2 exon 4; Set A
ugaguguuuauuuuccuguaggaagcuggaca

SEQ ID NO: 42716 - RNA, 30 nt, Artificial Sequence
  Synthetic Oligonucleotide; PDCD1LG2 exon 4; Set A
gaguguuuauuuuccuguaggaagcuggac

SEQ ID NO: 42717 - RNA, 39 nt, Artificial Sequence
  Synthetic Oligonucleotide; PDCD1LG2 exon 4; Set C
gaugugaguguuuauuuuccuguaggaagcuggacaaua

SEQ ID NO: 42718 - RNA, 37 nt, Artificial Sequence
  Synthetic Oligonucleotide; PDCD1LG2 exon 4; Set A
augugaguguuuauuuuccuguaggaagcuggacaau

SEQ ID NO: 42719 - RNA, 35 nt, Artificial Sequence
  Synthetic Oligonucleotide; PDCD1LG2 exon 4; Set C
ugugaguguuuauuuuccuguaggaagcuggacaa

SEQ ID NO: 42720 - RNA, 33 nt, Artificial Sequence
  Synthetic Oligonucleotide; PDCD1LG2 exon 4; Set C
gugaguguuuauuuuccuguaggaagcuggaca

SEQ ID NO: 42721 - RNA, 31 nt, Artificial Sequence
  Synthetic Oligonucleotide; PDCD1LG2 exon 4; Set A
ugaguguuuauuuuccuguaggaagcuggac

SEQ ID NO: 42722 - RNA, 38 nt, Artificial Sequence
  Synthetic Oligonucleotide; PDCD1LG2 exon 4; Set C
gaugugaguguuuauuuuccuguaggaagcuggacaau

SEQ ID NO: 42723 - RNA, 36 nt, Artificial Sequence
  Synthetic Oligonucleotide; PDCD1LG2 exon 4; Set C
augugaguguuuauuuuccuguaggaagcuggacaa

SEQ ID NO: 42724 - RNA, 34 nt, Artificial Sequence
  Synthetic Oligonucleotide; PDCD1LG2 exon 4; Set C
ugugaguguuuauuuuccuguaggaagcuggaca

SEQ ID NO: 42725 - RNA, 32 nt, Artificial Sequence
  Synthetic Oligonucleotide; PDCD1LG2 exon 4; Set A
gugaguguuuauuuuccuguaggaagcuggac

SEQ ID NO: 42726 - RNA, 37 nt, Artificial Sequence
  Synthetic Oligonucleotide; PDCD1LG2 exon 4; Set C
gaugugaguguuuauuuuccuguaggaagcuggacaa

SEQ ID NO: 42727 - RNA, 35 nt, Artificial Sequence
  Synthetic Oligonucleotide; PDCD1LG2 exon 4; Set C
augugaguguuuauuuuccuguaggaagcuggaca

SEQ ID NO: 42728 - RNA, 33 nt, Artificial Sequence
  Synthetic Oligonucleotide; PDCD1LG2 exon 4; Set A
ugugaguguuuauuuuccuguaggaagcuggac

SEQ ID NO: 42729 - RNA, 36 nt, Artificial Sequence
  Synthetic Oligonucleotide; PDCD1LG2 exon 4; Set C
gaugugaguguuuauuuuccuguaggaagcuggaca

SEQ ID NO: 42730 - RNA, 34 nt, Artificial Sequence
  Synthetic Oligonucleotide; PDCD1LG2 exon 4; Set A
augugaguguuuauuuuccuguaggaagcuggac

SEQ ID NO: 42731 - RNA, 35 nt, Artificial Sequence
  Synthetic Oligonucleotide; PDCD1LG2 exon 4; Set C
gaugugaguguuuauuuuccuguaggaagcuggac

SEQ ID NO: 42732 - RNA, 39 nt, Artificial Sequence
  Synthetic Oligonucleotide; PDCD1LG2 exon 4; Set C
uuuaggaugugaguguuuauuuuccuguaggaagcugga

SEQ ID NO: 42733 - RNA, 38 nt, Artificial Sequence
  Synthetic Oligonucleotide; PDCD1LG2 exon 4; Set C
uuuaggaugugaguguuuauuuuccuguaggaagcugg

SEQ ID NO: 42734 - RNA, 15 nt, Artificial Sequence
  Synthetic Oligonucleotide; PDCD1LG2 exon 4; Set C
ugugaguguuuauuu

SEQ ID NO: 42735 - RNA, 17 nt, Artificial Sequence
  Synthetic Oligonucleotide; PDCD1LG2 exon 4; Set C
gaugugaguguuuauuu

SEQ ID NO: 42736 - RNA, 19 nt, Artificial Sequence
  Synthetic Oligonucleotide; PDCD1LG2 exon 4; Set C
ggaugugaguguuuauuuu

SEQ ID NO: 42737 - RNA, 16 nt, Artificial Sequence
  Synthetic Oligonucleotide; PDCD1LG2 exon 4; Set C
gaugugaguguuuauu

SEQ ID NO: 42738 - RNA, 20 nt, Artificial Sequence
  Synthetic Oligonucleotide; PDCD1LG2 exon 4; Set C
aggaugugaguguuuauuuu

SEQ ID NO: 42739 - RNA, 22 nt, Artificial Sequence
  Synthetic Oligonucleotide; PDCD1LG2 exon 4; Set C
uaggaugugaguguuuauuuuc

SEQ ID NO: 42740 - RNA, 17 nt, Artificial Sequence
  Synthetic Oligonucleotide; PDCD1LG2 exon 4; Set C
ggaugugaguguuuauu

SEQ ID NO: 42741 - RNA, 21 nt, Artificial Sequence
  Synthetic Oligonucleotide; PDCD1LG2 exon 4; Set C
uaggaugugaguguuuauuuu

SEQ ID NO: 42742 - RNA, 23 nt, Artificial Sequence
  Synthetic Oligonucleotide; PDCD1LG2 exon 4; Set C
uuaggaugugaguguuuauuuuc

SEQ ID NO: 42743 - RNA, 18 nt, Artificial Sequence
  Synthetic Oligonucleotide; PDCD1LG2 exon 4; Set C
aggaugugaguguuuauu

SEQ ID NO: 42744 - RNA, 16 nt, Artificial Sequence
  Synthetic Oligonucleotide; PDCD1LG2 exon 4; Set C
ggaugugaguguuuau

SEQ ID NO: 42745 - RNA, 22 nt, Artificial Sequence
  Synthetic Oligonucleotide; PDCD1LG2 exon 4; Set C
uuaggaugugaguguuuauuuu

SEQ ID NO: 42746 - RNA, 24 nt, Artificial Sequence
  Synthetic Oligonucleotide; PDCD1LG2 exon 4; Set C
uuuaggaugugaguguuuauuuuc

SEQ ID NO: 42747 - RNA, 17 nt, Artificial Sequence
  Synthetic Oligonucleotide; PDCD1LG2 exon 4; Set C
aggaugugaguguuuau

SEQ ID NO: 42748 - RNA, 15 nt, Artificial Sequence
  Synthetic Oligonucleotide; PDCD1LG2 exon 4; Set C
ggaugugaguguuua

SEQ ID NO: 42749 - RNA, 23 nt, Artificial Sequence
  Synthetic Oligonucleotide; PDCD1LG2 exon 4; Set C
uuuaggaugugaguguuuauuuu

SEQ ID NO: 42750 - RNA, 18 nt, Artificial Sequence
  Synthetic Oligonucleotide; PDCD1LG2 exon 4; Set C
uaggaugugaguguuuau

SEQ ID NO: 42751 - RNA, 16 nt, Artificial Sequence
  Synthetic Oligonucleotide; PDCD1LG2 exon 4; Set C
aggaugugaguguuua

SEQ ID NO: 42752 - RNA, 23 nt, Artificial Sequence
  Synthetic Oligonucleotide; PDCD1LG2 exon 4; Set C
cuuuaggaugugaguguuuauuu

SEQ ID NO: 42753 - RNA, 15 nt, Artificial Sequence
  Synthetic Oligonucleotide; PDCD1LG2 exon 4; Set C
aggaugugaguguuu

SEQ ID NO: 42754 - RNA, 22 nt, Artificial Sequence
  Synthetic Oligonucleotide; PDCD1LG2 exon 4; Set C
cuuuaggaugugaguguuuauu

SEQ ID NO: 42755 - RNA, 16 nt, Artificial Sequence
  Synthetic Oligonucleotide; PDCD1LG2 exon 4; Set C
uaggaugugaguguuu

SEQ ID NO: 42756 - RNA, 21 nt, Artificial Sequence
  Synthetic Oligonucleotide; PDCD1LG2 exon 4; Set C
cuuuaggaugugaguguuuau

SEQ ID NO: 42757 - RNA, 17 nt, Artificial Sequence
  Synthetic Oligonucleotide; PDCD1LG2 exon 4; Set C
uuaggaugugaguguuu

SEQ ID NO: 42758 - RNA, 15 nt, Artificial Sequence
  Synthetic Oligonucleotide; PDCD1LG2 exon 4; Set C
uaggaugugaguguu

SEQ ID NO: 42759 - RNA, 20 nt, Artificial Sequence
  Synthetic Oligonucleotide; PDCD1LG2 exon 4; Set C
cuuuaggaugugaguguuua

SEQ ID NO: 42760 - RNA, 16 nt, Artificial Sequence
  Synthetic Oligonucleotide; PDCD1LG2 exon 4; Set C
uuaggaugugaguguu

SEQ ID NO: 42761 - RNA, 27 nt, Artificial Sequence
  Synthetic Oligonucleotide; PDCD1LG2 exon 4; Set C
gaaccuuuaggaugugaguguuuauuu

SEQ ID NO: 42762 - RNA, 15 nt, Artificial Sequence
  Synthetic Oligonucleotide; PDCD1LG2 exon 4; Set C
uuaggaugugagugu

SEQ ID NO: 42763 - RNA, 28 nt, Artificial Sequence
  Synthetic Oligonucleotide; PDCD1LG2 exon 4; Set A
ggaaccuuuaggaugugaguguuuauuu

SEQ ID NO: 42764 - RNA, 26 nt, Artificial Sequence
  Synthetic Oligonucleotide; PDCD1LG2 exon 4; Set C
gaaccuuuaggaugugaguguuuauu

SEQ ID NO: 42765 - RNA, 29 nt, Artificial Sequence
  Synthetic Oligonucleotide; PDCD1LG2 exon 4; Set A
uggaaccuuuaggaugugaguguuuauuu

SEQ ID NO: 42766 - RNA, 25 nt, Artificial Sequence
  Synthetic Oligonucleotide; PDCD1LG2 exon 4; Set C
gaaccuuuaggaugugaguguuuau

SEQ ID NO: 42767 - RNA, 17 nt, Artificial Sequence
  Synthetic Oligonucleotide; PDCD1LG2 exon 4; Set C
cuuuaggaugugagugu

SEQ ID NO: 42768 - RNA, 24 nt, Artificial Sequence
  Synthetic Oligonucleotide; PDCD1LG2 exon 4; Set C
gaaccuuuaggaugugaguguuua

SEQ ID NO: 42769 - RNA, 18 nt, Artificial Sequence
  Synthetic Oligonucleotide; PDCD1LG2 exon 4; Set C
gaaccuuuaggaugugag

SEQ ID NO: 42770 - RNA, 23 nt, Artificial Sequence
  Synthetic Oligonucleotide; PDCD1LG2 exon 4; Set C
cuggaaccuuuaggaugugagug

SEQ ID NO: 42771 - RNA, 17 nt, Artificial Sequence
  Synthetic Oligonucleotide; PDCD1LG2 exon 4; Set C
gaaccuuuaggauguga

SEQ ID NO: 42772 - RNA, 22 nt, Artificial Sequence
  Synthetic Oligonucleotide; PDCD1LG2 exon 4; Set C
cuggaaccuuuaggaugugagu

SEQ ID NO: 42773 - RNA, 39 nt, Artificial Sequence
  Synthetic Oligonucleotide; PDCD1LG2 exon 4; Set C
caucuguuucuggaaccuuuaggaugugaguguuuauuu

SEQ ID NO: 42774 - RNA, 15 nt, Artificial Sequence
  Synthetic Oligonucleotide; PDCD1LG2 exon 4; Set C
gaaccuuuaggaugu

SEQ ID NO: 42775 - RNA, 40 nt, Artificial Sequence
  Synthetic Oligonucleotide; PDCD1LG2 exon 4; Set C
ucaucuguuucuggaaccuuuaggaugugaguguuuauuu

SEQ ID NO: 42776 - RNA, 38 nt, Artificial Sequence
  Synthetic Oligonucleotide; PDCD1LG2 exon 4; Set C
caucuguuucuggaaccuuuaggaugugaguguuuauu

SEQ ID NO: 42777 - RNA, 17 nt, Artificial Sequence
  Synthetic Oligonucleotide; PDCD1LG2 exon 4; Set C
uggaaccuuuaggaugu

SEQ ID NO: 42778 - RNA, 37 nt, Artificial Sequence
  Synthetic Oligonucleotide; PDCD1LG2 exon 4; Set A
caucuguuucuggaaccuuuaggaugugaguguuuau

SEQ ID NO: 42779 - RNA, 39 nt, Artificial Sequence
  Synthetic Oligonucleotide; PDCD1LG2 exon 4; Set C
ucaucuguuucuggaaccuuuaggaugugaguguuuauu

SEQ ID NO: 42780 - RNA, 28 nt, Artificial Sequence
  Synthetic Oligonucleotide; PDCD1LG2 exon 4; Set A
uguuucuggaaccuuuaggaugugagug

SEQ ID NO: 42781 - RNA, 36 nt, Artificial Sequence
  Synthetic Oligonucleotide; PDCD1LG2 exon 4; Set C
caucuguuucuggaaccuuuaggaugugaguguuua

SEQ ID NO: 42782 - RNA, 15 nt, Artificial Sequence
  Synthetic Oligonucleotide; PDCD1LG2 exon 4; Set C
uggaaccuuuaggau

SEQ ID NO: 42783 - RNA, 35 nt, Artificial Sequence
  Synthetic Oligonucleotide; PDCD1LG2 exon 4; Set A
caucuguuucuggaaccuuuaggaugugaguguuu

SEQ ID NO: 42784 - RNA, 34 nt, Artificial Sequence
  Synthetic Oligonucleotide; PDCD1LG2 exon 4; Set A
caucuguuucuggaaccuuuaggaugugaguguu

SEQ ID NO: 42785 - RNA, 33 nt, Artificial Sequence
  Synthetic Oligonucleotide; PDCD1LG2 exon 4; Set A
caucuguuucuggaaccuuuaggaugugagugu

SEQ ID NO: 42786 - RNA, 30 nt, Artificial Sequence
  Synthetic Oligonucleotide; PDCD1LG2 exon 4; Set A
caucuguuucuggaaccuuuaggaugugag

SEQ ID NO: 42787 - RNA, 29 nt, Artificial Sequence
  Synthetic Oligonucleotide; PDCD1LG2 exon 4; Set A
caucuguuucuggaaccuuuaggauguga

SEQ ID NO: 42788 - RNA, 28 nt, Artificial Sequence
  Synthetic Oligonucleotide; PDCD1LG2 exon 4; Set A
caucuguuucuggaaccuuuaggaugug

SEQ ID NO: 42789 - RNA, 27 nt, Artificial Sequence
  Synthetic Oligonucleotide; PDCD1LG2 exon 4; Set A
caucuguuucuggaaccuuuaggaugu

SEQ ID NO: 42790 - RNA, 26 nt, Artificial Sequence
  Synthetic Oligonucleotide; PDCD1LG2 exon 4; Set A
caucuguuucuggaaccuuuaggaug

SEQ ID NO: 42791 - RNA, 25 nt, Artificial Sequence
  Synthetic Oligonucleotide; PDCD1LG2 exon 4; Set A
caucuguuucuggaaccuuuaggau

SEQ ID NO: 42792 - RNA, 25 nt, Artificial Sequence
  Synthetic Oligonucleotide; PDCD1LG2 exon 4; Set A
ucaucuguuucuggaaccuuuagga

SEQ ID NO: 42793 - RNA, 24 nt, Artificial Sequence
  Synthetic Oligonucleotide; PDCD1LG2 exon 4; Set C
ucaucuguuucuggaaccuuuagg

SEQ ID NO: 42794 - RNA, 23 nt, Artificial Sequence
  Synthetic Oligonucleotide; PDCD1LG2 exon 4; Set C
ucaucuguuucuggaaccuuuag

SEQ ID NO: 42795 - RNA, 22 nt, Artificial Sequence
  Synthetic Oligonucleotide; PDCD1LG2 exon 4; Set C
ucaucuguuucuggaaccuuua

SEQ ID NO: 42796 - RNA, 21 nt, Artificial Sequence
  Synthetic Oligonucleotide; PDCD1LG2 exon 4; Set C
ucaucuguuucuggaaccuuu

SEQ ID NO: 42797 - RNA, 19 nt, Artificial Sequence
  Synthetic Oligonucleotide; PDCD1LG2 exon 4; Set C
caucuguuucuggaaccuu

SEQ ID NO: 42798 - RNA, 15 nt, Artificial Sequence
  Synthetic Oligonucleotide; PDCD1LG2 exon 4; Set C
caucuguuucuggaa

SEQ ID NO: 42799 - RNA, 35 nt, Artificial Sequence
  Synthetic Oligonucleotide; PDCD1LG2 exon 4; Set C
gagcucuaccucaucuguuucuggaaccuuuagga

SEQ ID NO: 42800 - RNA, 36 nt, Artificial Sequence
  Synthetic Oligonucleotide; PDCD1LG2 exon 4; Set C
ugagcucuaccucaucuguuucuggaaccuuuagga

SEQ ID NO: 42801 - RNA, 34 nt, Artificial Sequence
  Synthetic Oligonucleotide; PDCD1LG2 exon 4; Set C
gagcucuaccucaucuguuucuggaaccuuuagg

SEQ ID NO: 42802 - RNA, 37 nt, Artificial Sequence
  Synthetic Oligonucleotide; PDCD1LG2 exon 4; Set C
gugagcucuaccucaucuguuucuggaaccuuuagga

SEQ ID NO: 42803 - RNA, 35 nt, Artificial Sequence
  Synthetic Oligonucleotide; PDCD1LG2 exon 4; Set C
ugagcucuaccucaucuguuucuggaaccuuuagg

SEQ ID NO: 42804 - RNA, 33 nt, Artificial Sequence
  Synthetic Oligonucleotide; PDCD1LG2 exon 4; Set C
gagcucuaccucaucuguuucuggaaccuuuag

SEQ ID NO: 42805 - RNA, 32 nt, Artificial Sequence
  Synthetic Oligonucleotide; PDCD1LG2 exon 4; Set C
gagcucuaccucaucuguuucuggaaccuuua

SEQ ID NO: 42806 - RNA, 36 nt, Artificial Sequence
  Synthetic Oligonucleotide; PDCD1LG2 exon 4; Set C
gugagcucuaccucaucuguuucuggaaccuuuagg

SEQ ID NO: 42807 - RNA, 34 nt, Artificial Sequence
  Synthetic Oligonucleotide; PDCD1LG2 exon 4; Set C
ugagcucuaccucaucuguuucuggaaccuuuag

SEQ ID NO: 42808 - RNA, 31 nt, Artificial Sequence
  Synthetic Oligonucleotide; PDCD1LG2 exon 4; Set C
gagcucuaccucaucuguuucuggaaccuuu

SEQ ID NO: 42809 - RNA, 33 nt, Artificial Sequence
  Synthetic Oligonucleotide; PDCD1LG2 exon 4; Set C
ugagcucuaccucaucuguuucuggaaccuuua

SEQ ID NO: 42810 - RNA, 35 nt, Artificial Sequence
  Synthetic Oligonucleotide; PDCD1LG2 exon 4; Set C
gugagcucuaccucaucuguuucuggaaccuuuag

SEQ ID NO: 42811 - RNA, 32 nt, Artificial Sequence
  Synthetic Oligonucleotide; PDCD1LG2 exon 4; Set C
ugagcucuaccucaucuguuucuggaaccuuu

SEQ ID NO: 42812 - RNA, 34 nt, Artificial Sequence
  Synthetic Oligonucleotide; PDCD1LG2 exon 4; Set C
gugagcucuaccucaucuguuucuggaaccuuua

SEQ ID NO: 42813 - RNA, 33 nt, Artificial Sequence
  Synthetic Oligonucleotide; PDCD1LG2 exon 4; Set C
gugagcucuaccucaucuguuucuggaaccuuu

SEQ ID NO: 42814 - RNA, 34 nt, Artificial Sequence
  Synthetic Oligonucleotide; PDCD1LG2 exon 4; Set C
uaaccuguagccuggcaggugagcucuaccucau

SEQ ID NO: 42815 - RNA, 35 nt, Artificial Sequence
  Synthetic Oligonucleotide; PDCD1LG2 exon 4; Set C
auaaccuguagccuggcaggugagcucuaccucau

SEQ ID NO: 42816 - RNA, 33 nt, Artificial Sequence
  Synthetic Oligonucleotide; PDCD1LG2 exon 4; Set C
uaaccuguagccuggcaggugagcucuaccuca

SEQ ID NO: 42817 - RNA, 36 nt, Artificial Sequence
  Synthetic Oligonucleotide; PDCD1LG2 exon 4; Set C
gauaaccuguagccuggcaggugagcucuaccucau

SEQ ID NO: 42818 - RNA, 34 nt, Artificial Sequence
  Synthetic Oligonucleotide; PDCD1LG2 exon 4; Set C
auaaccuguagccuggcaggugagcucuaccuca

SEQ ID NO: 42819 - RNA, 23 nt, Artificial Sequence
  Synthetic Oligonucleotide; PDCD1LG2 exon 4; Set A
uaaccuguagccuggcaggugag

SEQ ID NO: 42820 - RNA, 22 nt, Artificial Sequence
  Synthetic Oligonucleotide; PDCD1LG2 exon 4; Set A
uaaccuguagccuggcagguga

SEQ ID NO: 42821 - RNA, 24 nt, Artificial Sequence
  Synthetic Oligonucleotide; PDCD1LG2 exon 4; Set A
auaaccuguagccuggcaggugag

SEQ ID NO: 42822 - RNA, 21 nt, Artificial Sequence
  Synthetic Oligonucleotide; PDCD1LG2 exon 4; Set A
uaaccuguagccuggcaggug

SEQ ID NO: 42823 - RNA, 23 nt, Artificial Sequence
  Synthetic Oligonucleotide; PDCD1LG2 exon 4; Set A
auaaccuguagccuggcagguga

SEQ ID NO: 42824 - RNA, 22 nt, Artificial Sequence
  Synthetic Oligonucleotide; PDCD1LG2 exon 4; Set A
auaaccuguagccuggcaggug

SEQ ID NO: 42825 - RNA, 15 nt, Artificial Sequence
  Synthetic Oligonucleotide; PDCD1LG2 exon 4; Set C
gauaaccuguagccu

SEQ ID NO: 42826 - RNA, 30 nt, Artificial Sequence
  Synthetic Oligonucleotide; PDCD1LG2 exon 4; Set C
uuuggccaggauacuucugccagaggauaa

SEQ ID NO: 42827 - RNA, 31 nt, Artificial Sequence
  Synthetic Oligonucleotide; PDCD1LG2 exon 4; Set C
guuuggccaggauacuucugccagaggauaa

SEQ ID NO: 42828 - RNA, 30 nt, Artificial Sequence
  Synthetic Oligonucleotide; PDCD1LG2 exon 4; Set C
guuuggccaggauacuucugccagaggaua

SEQ ID NO: 42829 - RNA, 16 nt, Artificial Sequence
  Synthetic Oligonucleotide; PDCD1LG2 exon 4; Set C
uuuggccaggauacuu

SEQ ID NO: 42830 - RNA, 17 nt, Artificial Sequence
  Synthetic Oligonucleotide; PDCD1LG2 exon 4; Set C
guuuggccaggauacuu

SEQ ID NO: 42831 - RNA, 16 nt, Artificial Sequence
  Synthetic Oligonucleotide; PDCD1LG2 exon 4; Set C
guuuggccaggauacu

SEQ ID NO: 42832 - RNA, 24 nt, Artificial Sequence
  Synthetic Oligonucleotide; PDCD1LG2 exon 4; Set A
uguuggcaggaacgcugacguuug

SEQ ID NO: 42833 - RNA, 23 nt, Artificial Sequence
  Synthetic Oligonucleotide; PDCD1LG2 exon 4; Set A
uguuggcaggaacgcugacguuu

SEQ ID NO: 42834 - RNA, 25 nt, Artificial Sequence
  Synthetic Oligonucleotide; PDCD1LG2 exon 4; Set C
guguuggcaggaacgcugacguuug

SEQ ID NO: 42835 - RNA, 22 nt, Artificial Sequence
  Synthetic Oligonucleotide; PDCD1LG2 exon 4; Set A
uguuggcaggaacgcugacguu

SEQ ID NO: 42836 - RNA, 24 nt, Artificial Sequence
  Synthetic Oligonucleotide; PDCD1LG2 exon 4; Set C
guguuggcaggaacgcugacguuu

SEQ ID NO: 42837 - RNA, 26 nt, Artificial Sequence
  Synthetic Oligonucleotide; PDCD1LG2 exon 4; Set C
gguguuggcaggaacgcugacguuug

SEQ ID NO: 42838 - RNA, 23 nt, Artificial Sequence
  Synthetic Oligonucleotide; PDCD1LG2 exon 4; Set C
guguuggcaggaacgcugacguu

SEQ ID NO: 42839 - RNA, 25 nt, Artificial Sequence
  Synthetic Oligonucleotide; PDCD1LG2 exon 4; Set C
gguguuggcaggaacgcugacguuu

SEQ ID NO: 42840 - RNA, 24 nt, Artificial Sequence
  Synthetic Oligonucleotide; PDCD1LG2 exon 4; Set C
gguguuggcaggaacgcugacguu

SEQ ID NO: 42841 - RNA, 40 nt, Artificial Sequence
  Synthetic Oligonucleotide; PDCD1LG2 exon 4; Set C
gguccuggaguggcugguguuggcaggaacgcugacguuu

SEQ ID NO: 42842 - RNA, 39 nt, Artificial Sequence
  Synthetic Oligonucleotide; PDCD1LG2 exon 4; Set C
gguccuggaguggcugguguuggcaggaacgcugacguu

SEQ ID NO: 42843 - RNA, 21 nt, Artificial Sequence
  Synthetic Oligonucleotide; PDCD1LG2 exon 4; Set A
uuucugccaggggguggcuuu

SEQ ID NO: 42844 - RNA, 20 nt, Artificial Sequence
  Synthetic Oligonucleotide; PDCD1LG2 exon 4; Set A
uuucugccaggggguggcuu

SEQ ID NO: 42845 - RNA, 15 nt, Artificial Sequence
  Synthetic Oligonucleotide; PDCD1LG2 exon 4; Set C
uuucugccagggggu

SEQ ID NO: 42846 - RNA, 40 nt, Artificial Sequence
  Synthetic Oligonucleotide; PDCD1LG2 exon 4; Set C
agaccuaggaagugggggcagcucuuacuuugaaggucaa

SEQ ID NO: 42847 - RNA, 16 nt, Artificial Sequence
  Synthetic Oligonucleotide; PDCD1LG2 exon 4; Set C
agaccuaggaaguggg

SEQ ID NO: 42848 - RNA, 15 nt, Artificial Sequence
  Synthetic Oligonucleotide; PDCD1LG2 exon 4; Set C
acuuuauuuucugau

SEQ ID NO: 42849 - RNA, 16 nt, Artificial Sequence
  Synthetic Oligonucleotide; PDCD1LG2 exon 4; Set C
gacuuuauuuucugau

SEQ ID NO: 42850 - RNA, 17 nt, Artificial Sequence
  Synthetic Oligonucleotide; PDCD1LG2 exon 4; Set C
agacuuuauuuucugau

SEQ ID NO: 42851 - RNA, 15 nt, Artificial Sequence
  Synthetic Oligonucleotide; PDCD1LG2 exon 4; Set C
gacuuuauuuucuga

SEQ ID NO: 42852 - RNA, 18 nt, Artificial Sequence
  Synthetic Oligonucleotide; PDCD1LG2 exon 4; Set C
aagacuuuauuuucugau

SEQ ID NO: 42853 - RNA, 16 nt, Artificial Sequence
  Synthetic Oligonucleotide; PDCD1LG2 exon 4; Set C
agacuuuauuuucuga

SEQ ID NO: 42854 - RNA, 19 nt, Artificial Sequence
  Synthetic Oligonucleotide; PDCD1LG2 exon 4; Set C
uaagacuuuauuuucugau

SEQ ID NO: 42855 - RNA, 17 nt, Artificial Sequence
  Synthetic Oligonucleotide; PDCD1LG2 exon 4; Set C
aagacuuuauuuucuga

SEQ ID NO: 42856 - RNA, 20 nt, Artificial Sequence
  Synthetic Oligonucleotide; PDCD1LG2 exon 4; Set C
auaagacuuuauuuucugau

SEQ ID NO: 42857 - RNA, 21 nt, Artificial Sequence
  Synthetic Oligonucleotide; PDCD1LG2 exon 4; Set C
aaauaagacuuuauuuucuga

SEQ ID NO: 42858 - RNA, 26 nt, Artificial Sequence
  Synthetic Oligonucleotide; PDCD1LG2 exon 4; Set C
aaagaaauaagacuuuauuuucugau

SEQ ID NO: 42859 - RNA, 34 nt, Artificial Sequence
  Synthetic Oligonucleotide; PDCD1LG2 exon 4; Set C
gagaagaaaaagaaauaagacuuuauuuucugau

SEQ ID NO: 42860 - RNA, 35 nt, Artificial Sequence
  Synthetic Oligonucleotide; PDCD1LG2 exon 4; Set C
agagaagaaaaagaaauaagacuuuauuuucugau

SEQ ID NO: 42861 - RNA, 23 nt, Artificial Sequence
  Synthetic Oligonucleotide; PDCD1LG2 exon 4; Set C
agaaaaagaaauaagacuuuauu

SEQ ID NO: 42862 - RNA, 22 nt, Artificial Sequence
  Synthetic Oligonucleotide; PDCD1LG2 exon 4; Set C
agaaaaagaaauaagacuuuau

SEQ ID NO: 42863 - RNA, 25 nt, Artificial Sequence
  Synthetic Oligonucleotide; PDCD1LG2 exon 4; Set C
agaagaaaaagaaauaagacuuuau

SEQ ID NO: 42864 - RNA, 18 nt, Artificial Sequence
  Synthetic Oligonucleotide; PDCD1LG2 exon 4; Set C
agaaaaagaaauaagacu

SEQ ID NO: 42865 - RNA, 17 nt, Artificial Sequence
  Synthetic Oligonucleotide; PDCD1LG2 exon 4; Set C
agaaaaagaaauaagac

SEQ ID NO: 42866 - RNA, 16 nt, Artificial Sequence
  Synthetic Oligonucleotide; PDCD1LG2 exon 4; Set C
agaaaaagaaauaaga

SEQ ID NO: 42867 - RNA, 15 nt, Artificial Sequence
  Synthetic Oligonucleotide; PDCD1LG2 exon 4; Set C
agaaaaagaaauaag

SEQ ID NO: 42868 - RNA, 22 nt, Artificial Sequence
  Synthetic Oligonucleotide; PDCD1LG2 exon 4; Set C
gagaagaaaaagaaauaagacu

SEQ ID NO: 42869 - RNA, 23 nt, Artificial Sequence
  Synthetic Oligonucleotide; PDCD1LG2 exon 4; Set C
agagaagaaaaagaaauaagacu

SEQ ID NO: 42870 - RNA, 21 nt, Artificial Sequence
  Synthetic Oligonucleotide; PDCD1LG2 exon 4; Set C
gagaagaaaaagaaauaagac

SEQ ID NO: 42871 - RNA, 20 nt, Artificial Sequence
  Synthetic Oligonucleotide; PDCD1LG2 exon 4; Set C
gagaagaaaaagaaauaaga

SEQ ID NO: 42872 - RNA, 22 nt, Artificial Sequence
  Synthetic Oligonucleotide; PDCD1LG2 exon 4; Set C
agagaagaaaaagaaauaagac

SEQ ID NO: 42873 - RNA, 19 nt, Artificial Sequence
  Synthetic Oligonucleotide; PDCD1LG2 exon 4; Set C
gagaagaaaaagaaauaag

SEQ ID NO: 42874 - RNA, 21 nt, Artificial Sequence
  Synthetic Oligonucleotide; PDCD1LG2 exon 4; Set C
agagaagaaaaagaaauaaga

SEQ ID NO: 42875 - RNA, 18 nt, Artificial Sequence
  Synthetic Oligonucleotide; PDCD1LG2 exon 4; Set C
gagaagaaaaagaaauaa

SEQ ID NO: 42876 - RNA, 19 nt, Artificial Sequence
  Synthetic Oligonucleotide; PDCD1LG2 exon 4; Set C
agagaagaaaaagaaauaa

SEQ ID NO: 42877 - RNA, 17 nt, Artificial Sequence
  Synthetic Oligonucleotide; PDCD1LG2 exon 4; Set C
gagaagaaaaagaaaua

SEQ ID NO: 42878 - RNA, 18 nt, Artificial Sequence
  Synthetic Oligonucleotide; PDCD1LG2 exon 4; Set C
agagaagaaaaagaaaua

SEQ ID NO: 42879 - RNA, 30 nt, Artificial Sequence
  Synthetic Oligonucleotide; PDCD1LG2 exon 4; Set C
ggacaauagagaagaaaaagaaauaagacu

SEQ ID NO: 42880 - RNA, 31 nt, Artificial Sequence
  Synthetic Oligonucleotide; PDCD1LG2 exon 4; Set C
uggacaauagagaagaaaaagaaauaagacu

SEQ ID NO: 42881 - RNA, 29 nt, Artificial Sequence
  Synthetic Oligonucleotide; PDCD1LG2 exon 4; Set C
ggacaauagagaagaaaaagaaauaagac

SEQ ID NO: 42882 - RNA, 28 nt, Artificial Sequence
  Synthetic Oligonucleotide; PDCD1LG2 exon 4; Set C
ggacaauagagaagaaaaagaaauaaga

SEQ ID NO: 42883 - RNA, 30 nt, Artificial Sequence
  Synthetic Oligonucleotide; PDCD1LG2 exon 4; Set C
uggacaauagagaagaaaaagaaauaagac

SEQ ID NO: 42884 - RNA, 29 nt, Artificial Sequence
  Synthetic Oligonucleotide; PDCD1LG2 exon 4; Set C
uggacaauagagaagaaaaagaaauaaga

SEQ ID NO: 42885 - RNA, 26 nt, Artificial Sequence
  Synthetic Oligonucleotide; PDCD1LG2 exon 4; Set C
ggacaauagagaagaaaaagaaauaa

SEQ ID NO: 42886 - RNA, 27 nt, Artificial Sequence
  Synthetic Oligonucleotide; PDCD1LG2 exon 4; Set C
uggacaauagagaagaaaaagaaauaa

SEQ ID NO: 42887 - RNA, 25 nt, Artificial Sequence
  Synthetic Oligonucleotide; PDCD1LG2 exon 4; Set C
ggacaauagagaagaaaaagaaaua

SEQ ID NO: 42888 - RNA, 26 nt, Artificial Sequence
  Synthetic Oligonucleotide; PDCD1LG2 exon 4; Set C
uggacaauagagaagaaaaagaaaua

SEQ ID NO: 42889 - RNA, 20 nt, Artificial Sequence
  Synthetic Oligonucleotide; PDCD1LG2 exon 4; Set C
uggacaauagagaagaaaaa

SEQ ID NO: 42890 - RNA, 37 nt, Artificial Sequence
  Synthetic Oligonucleotide; PDCD1LG2 exon 4; Set C
guaggaagcuggacaauagagaagaaaaagaaauaag

SEQ ID NO: 42891 - RNA, 33 nt, Artificial Sequence
  Synthetic Oligonucleotide; PDCD1LG2 exon 4; Set C
guaggaagcuggacaauagagaagaaaaagaaa

SEQ ID NO: 42892 - RNA, 28 nt, Artificial Sequence
  Synthetic Oligonucleotide; PDCD1LG2 exon 4; Set C
guaggaagcuggacaauagagaagaaaa

SEQ ID NO: 42893 - RNA, 38 nt, Artificial Sequence
  Synthetic Oligonucleotide; PDCD1LG2 exon 4; Set A
uuccuguaggaagcuggacaauagagaagaaaaagaaa

SEQ ID NO: 42894 - RNA, 27 nt, Artificial Sequence
  Synthetic Oligonucleotide; PDCD1LG2 exon 4; Set C
guaggaagcuggacaauagagaagaaa

SEQ ID NO: 42895 - RNA, 39 nt, Artificial Sequence
  Synthetic Oligonucleotide; PDCD1LG2 exon 4; Set A
uuuccuguaggaagcuggacaauagagaagaaaaagaaa

SEQ ID NO: 42896 - RNA, 26 nt, Artificial Sequence
  Synthetic Oligonucleotide; PDCD1LG2 exon 4; Set C
guaggaagcuggacaauagagaagaa

SEQ ID NO: 42897 - RNA, 33 nt, Artificial Sequence
  Synthetic Oligonucleotide; PDCD1LG2 exon 4; Set A
uuccuguaggaagcuggacaauagagaagaaaa

SEQ ID NO: 42898 - RNA, 37 nt, Artificial Sequence
  Synthetic Oligonucleotide; PDCD1LG2 exon 4; Set A
uuuuccuguaggaagcuggacaauagagaagaaaaag

SEQ ID NO: 42899 - RNA, 34 nt, Artificial Sequence
  Synthetic Oligonucleotide; PDCD1LG2 exon 4; Set A
uuuccuguaggaagcuggacaauagagaagaaaa

SEQ ID NO: 42900 - RNA, 32 nt, Artificial Sequence
  Synthetic Oligonucleotide; PDCD1LG2 exon 4; Set A
uuccuguaggaagcuggacaauagagaagaaa

SEQ ID NO: 42901 - RNA, 36 nt, Artificial Sequence
  Synthetic Oligonucleotide; PDCD1LG2 exon 4; Set A
uuuuccuguaggaagcuggacaauagagaagaaaaa

SEQ ID NO: 42902 - RNA, 33 nt, Artificial Sequence
  Synthetic Oligonucleotide; PDCD1LG2 exon 4; Set A
uuuccuguaggaagcuggacaauagagaagaaa

SEQ ID NO: 42903 - RNA, 31 nt, Artificial Sequence
  Synthetic Oligonucleotide; PDCD1LG2 exon 4; Set A
uuccuguaggaagcuggacaauagagaagaa

SEQ ID NO: 42904 - RNA, 37 nt, Artificial Sequence
  Synthetic Oligonucleotide; PDCD1LG2 exon 4; Set A
auuuuccuguaggaagcuggacaauagagaagaaaaa

SEQ ID NO: 42905 - RNA, 32 nt, Artificial Sequence
  Synthetic Oligonucleotide; PDCD1LG2 exon 4; Set A
uuuccuguaggaagcuggacaauagagaagaa

SEQ ID NO: 42906 - RNA, 38 nt, Artificial Sequence
  Synthetic Oligonucleotide; PDCD1LG2 exon 4; Set A
uauuuuccuguaggaagcuggacaauagagaagaaaaa

SEQ ID NO: 42907 - RNA, 19 nt, Artificial Sequence
  Synthetic Oligonucleotide; PDCD1LG2 exon 4; Set C
guaggaagcuggacaauag

SEQ ID NO: 42908 - RNA, 39 nt, Artificial Sequence
  Synthetic Oligonucleotide; PDCD1LG2 exon 4; Set A
uuauuuuccuguaggaagcuggacaauagagaagaaaaa

SEQ ID NO: 42909 - RNA, 18 nt, Artificial Sequence
  Synthetic Oligonucleotide; PDCD1LG2 exon 4; Set C
guaggaagcuggacaaua

SEQ ID NO: 42910 - RNA, 17 nt, Artificial Sequence
  Synthetic Oligonucleotide; PDCD1LG2 exon 4; Set C
guaggaagcuggacaau

SEQ ID NO: 42911 - RNA, 16 nt, Artificial Sequence
  Synthetic Oligonucleotide; PDCD1LG2 exon 4; Set C
guaggaagcuggacaa

SEQ ID NO: 42912 - RNA, 15 nt, Artificial Sequence
  Synthetic Oligonucleotide; PDCD1LG2 exon 4; Set C
guaggaagcuggaca

SEQ ID NO: 42913 - RNA, 24 nt, Artificial Sequence
  Synthetic Oligonucleotide; PDCD1LG2 exon 4; Set A
uuccuguaggaagcuggacaauag

SEQ ID NO: 42914 - RNA, 23 nt, Artificial Sequence
  Synthetic Oligonucleotide; PDCD1LG2 exon 4; Set A
uuccuguaggaagcuggacaaua

SEQ ID NO: 42915 - RNA, 25 nt, Artificial Sequence
  Synthetic Oligonucleotide; PDCD1LG2 exon 4; Set A
uuuccuguaggaagcuggacaauag

SEQ ID NO: 42916 - RNA, 27 nt, Artificial Sequence
  Synthetic Oligonucleotide; PDCD1LG2 exon 4; Set A
uuuuccuguaggaagcuggacaauaga

SEQ ID NO: 42917 - RNA, 24 nt, Artificial Sequence
  Synthetic Oligonucleotide; PDCD1LG2 exon 4; Set A
uuuccuguaggaagcuggacaaua

SEQ ID NO: 42918 - RNA, 22 nt, Artificial Sequence
  Synthetic Oligonucleotide; PDCD1LG2 exon 4; Set C
uuccuguaggaagcuggacaau

SEQ ID NO: 42919 - RNA, 23 nt, Artificial Sequence
  Synthetic Oligonucleotide; PDCD1LG2 exon 4; Set A
uuuccuguaggaagcuggacaau

SEQ ID NO: 42920 - RNA, 21 nt, Artificial Sequence
  Synthetic Oligonucleotide; PDCD1LG2 exon 4; Set C
uuccuguaggaagcuggacaa

SEQ ID NO: 42921 - RNA, 39 nt, Artificial Sequence
  Synthetic Oligonucleotide; PDCD1LG2 exon 4; Set A
guguuuauuuuccuguaggaagcuggacaauagagaaga

SEQ ID NO: 42922 - RNA, 22 nt, Artificial Sequence
  Synthetic Oligonucleotide; PDCD1LG2 exon 4; Set A
uuuccuguaggaagcuggacaa

SEQ ID NO: 42923 - RNA, 20 nt, Artificial Sequence
  Synthetic Oligonucleotide; PDCD1LG2 exon 4; Set A
uuccuguaggaagcuggaca

SEQ ID NO: 42924 - RNA, 40 nt, Artificial Sequence
  Synthetic Oligonucleotide; PDCD1LG2 exon 4; Set A
aguguuuauuuuccuguaggaagcuggacaauagagaaga

SEQ ID NO: 42925 - RNA, 21 nt, Artificial Sequence
  Synthetic Oligonucleotide; PDCD1LG2 exon 4; Set A
uuuccuguaggaagcuggaca

SEQ ID NO: 42926 - RNA, 19 nt, Artificial Sequence
  Synthetic Oligonucleotide; PDCD1LG2 exon 4; Set C
uuccuguaggaagcuggac

SEQ ID NO: 42927 - RNA, 20 nt, Artificial Sequence
  Synthetic Oligonucleotide; PDCD1LG2 exon 4; Set C
uuuccuguaggaagcuggac

SEQ ID NO: 42928 - RNA, 36 nt, Artificial Sequence
  Synthetic Oligonucleotide; PDCD1LG2 exon 4; Set A
gaguguuuauuuuccuguaggaagcuggacaauaga

SEQ ID NO: 42929 - RNA, 37 nt, Artificial Sequence
  Synthetic Oligonucleotide; PDCD1LG2 exon 4; Set A
ugaguguuuauuuuccuguaggaagcuggacaauaga

SEQ ID NO: 42930 - RNA, 38 nt, Artificial Sequence
  Synthetic Oligonucleotide; PDCD1LG2 exon 4; Set C
gugaguguuuauuuuccuguaggaagcuggacaauaga

SEQ ID NO: 42931 - RNA, 40 nt, Artificial Sequence
  Synthetic Oligonucleotide; PDCD1LG2 exon 4; Set C
ugugaguguuuauuuuccuguaggaagcuggacaauagag

SEQ ID NO: 42932 - RNA, 39 nt, Artificial Sequence
  Synthetic Oligonucleotide; PDCD1LG2 exon 4; Set C
ugugaguguuuauuuuccuguaggaagcuggacaauaga

SEQ ID NO: 42933 - RNA, 27 nt, Artificial Sequence
  Synthetic Oligonucleotide; PDCD1LG2 exon 4; Set A
guguuuauuuuccuguaggaagcugga

SEQ ID NO: 42934 - RNA, 26 nt, Artificial Sequence
  Synthetic Oligonucleotide; PDCD1LG2 exon 4; Set A
guguuuauuuuccuguaggaagcugg

SEQ ID NO: 42935 - RNA, 28 nt, Artificial Sequence
  Synthetic Oligonucleotide; PDCD1LG2 exon 4; Set A
aguguuuauuuuccuguaggaagcugga

SEQ ID NO: 42936 - RNA, 27 nt, Artificial Sequence
  Synthetic Oligonucleotide; PDCD1LG2 exon 4; Set A
aguguuuauuuuccuguaggaagcugg

SEQ ID NO: 42937 - RNA, 35 nt, Artificial Sequence
  Synthetic Oligonucleotide; PDCD1LG2 exon 4; Set C
ggaugugaguguuuauuuuccuguaggaagcugga

SEQ ID NO: 42938 - RNA, 34 nt, Artificial Sequence
  Synthetic Oligonucleotide; PDCD1LG2 exon 4; Set C
ggaugugaguguuuauuuuccuguaggaagcugg

SEQ ID NO: 42939 - RNA, 36 nt, Artificial Sequence
  Synthetic Oligonucleotide; PDCD1LG2 exon 4; Set C
aggaugugaguguuuauuuuccuguaggaagcugga

SEQ ID NO: 42940 - RNA, 35 nt, Artificial Sequence
  Synthetic Oligonucleotide; PDCD1LG2 exon 4; Set A
aggaugugaguguuuauuuuccuguaggaagcugg

SEQ ID NO: 42941 - RNA, 37 nt, Artificial Sequence
  Synthetic Oligonucleotide; PDCD1LG2 exon 4; Set C
uaggaugugaguguuuauuuuccuguaggaagcugga

SEQ ID NO: 42942 - RNA, 17 nt, Artificial Sequence
  Synthetic Oligonucleotide; PDCD1LG2 exon 4; Set C
guguuuauuuuccugua

SEQ ID NO: 42943 - RNA, 36 nt, Artificial Sequence
  Synthetic Oligonucleotide; PDCD1LG2 exon 4; Set C
uaggaugugaguguuuauuuuccuguaggaagcugg

SEQ ID NO: 42944 - RNA, 38 nt, Artificial Sequence
  Synthetic Oligonucleotide; PDCD1LG2 exon 4; Set C
uuaggaugugaguguuuauuuuccuguaggaagcugga

SEQ ID NO: 42945 - RNA, 18 nt, Artificial Sequence
  Synthetic Oligonucleotide; PDCD1LG2 exon 4; Set C
aguguuuauuuuccugua

SEQ ID NO: 42946 - RNA, 37 nt, Artificial Sequence
  Synthetic Oligonucleotide; PDCD1LG2 exon 4; Set C
uuaggaugugaguguuuauuuuccuguaggaagcugg

SEQ ID NO: 42947 - RNA, 40 nt, Artificial Sequence
  Synthetic Oligonucleotide; PDCD1LG2 exon 4; Set C
cuuuaggaugugaguguuuauuuuccuguaggaagcugga

SEQ ID NO: 42948 - RNA, 39 nt, Artificial Sequence
  Synthetic Oligonucleotide; PDCD1LG2 exon 4; Set C
cuuuaggaugugaguguuuauuuuccuguaggaagcugg

SEQ ID NO: 42949 - RNA, 25 nt, Artificial Sequence
  Synthetic Oligonucleotide; PDCD1LG2 exon 4; Set C
ggaugugaguguuuauuuuccugua

SEQ ID NO: 42950 - RNA, 26 nt, Artificial Sequence
  Synthetic Oligonucleotide; PDCD1LG2 exon 4; Set C
aggaugugaguguuuauuuuccugua

SEQ ID NO: 42951 - RNA, 27 nt, Artificial Sequence
  Synthetic Oligonucleotide; PDCD1LG2 exon 4; Set A
uaggaugugaguguuuauuuuccugua

SEQ ID NO: 42952 - RNA, 16 nt, Artificial Sequence
  Synthetic Oligonucleotide; PDCD1LG2 exon 4; Set C
ugugaguguuuauuuu

SEQ ID NO: 42953 - RNA, 28 nt, Artificial Sequence
  Synthetic Oligonucleotide; PDCD1LG2 exon 4; Set A
uuaggaugugaguguuuauuuuccugua

SEQ ID NO: 42954 - RNA, 19 nt, Artificial Sequence
  Synthetic Oligonucleotide; PDCD1LG2 exon 4; Set C
gaugugaguguuuauuuuc

SEQ ID NO: 42955 - RNA, 29 nt, Artificial Sequence
  Synthetic Oligonucleotide; PDCD1LG2 exon 4; Set A
uuuaggaugugaguguuuauuuuccugua

SEQ ID NO: 42956 - RNA, 16 nt, Artificial Sequence
  Synthetic Oligonucleotide; PDCD1LG2 exon 4; Set C
augugaguguuuauuu

SEQ ID NO: 42957 - RNA, 18 nt, Artificial Sequence
  Synthetic Oligonucleotide; PDCD1LG2 exon 4; Set C
gaugugaguguuuauuuu

SEQ ID NO: 42958 - RNA, 20 nt, Artificial Sequence
  Synthetic Oligonucleotide; PDCD1LG2 exon 4; Set C
ggaugugaguguuuauuuuc

SEQ ID NO: 42959 - RNA, 15 nt, Artificial Sequence
  Synthetic Oligonucleotide; PDCD1LG2 exon 4; Set C
augugaguguuuauu

SEQ ID NO: 42960 - RNA, 21 nt, Artificial Sequence
  Synthetic Oligonucleotide; PDCD1LG2 exon 4; Set C
aggaugugaguguuuauuuuc

SEQ ID NO: 42961 - RNA, 15 nt, Artificial Sequence
  Synthetic Oligonucleotide; PDCD1LG2 exon 4; Set C
gaugugaguguuuau

SEQ ID NO: 42962 - RNA, 25 nt, Artificial Sequence
  Synthetic Oligonucleotide; PDCD1LG2 exon 4; Set C
cuuuaggaugugaguguuuauuuuc

SEQ ID NO: 42963 - RNA, 24 nt, Artificial Sequence
  Synthetic Oligonucleotide; PDCD1LG2 exon 4; Set C
cuuuaggaugugaguguuuauuuu

SEQ ID NO: 42964 - RNA, 29 nt, Artificial Sequence
  Synthetic Oligonucleotide; PDCD1LG2 exon 4; Set A
gaaccuuuaggaugugaguguuuauuuuc

SEQ ID NO: 42965 - RNA, 28 nt, Artificial Sequence
  Synthetic Oligonucleotide; PDCD1LG2 exon 4; Set C
gaaccuuuaggaugugaguguuuauuuu

SEQ ID NO: 42966 - RNA, 19 nt, Artificial Sequence
  Synthetic Oligonucleotide; PDCD1LG2 exon 4; Set C
cuuuaggaugugaguguuu

SEQ ID NO: 42967 - RNA, 29 nt, Artificial Sequence
  Synthetic Oligonucleotide; PDCD1LG2 exon 4; Set A
ggaaccuuuaggaugugaguguuuauuuu

SEQ ID NO: 42968 - RNA, 31 nt, Artificial Sequence
  Synthetic Oligonucleotide; PDCD1LG2 exon 4; Set A
uggaaccuuuaggaugugaguguuuauuuuc

SEQ ID NO: 42969 - RNA, 18 nt, Artificial Sequence
  Synthetic Oligonucleotide; PDCD1LG2 exon 4; Set C
cuuuaggaugugaguguu

SEQ ID NO: 42970 - RNA, 30 nt, Artificial Sequence
  Synthetic Oligonucleotide; PDCD1LG2 exon 4; Set A
uggaaccuuuaggaugugaguguuuauuuu

SEQ ID NO: 42971 - RNA, 27 nt, Artificial Sequence
  Synthetic Oligonucleotide; PDCD1LG2 exon 4; Set A
ggaaccuuuaggaugugaguguuuauu

SEQ ID NO: 42972 - RNA, 28 nt, Artificial Sequence
  Synthetic Oligonucleotide; PDCD1LG2 exon 4; Set A
uggaaccuuuaggaugugaguguuuauu

SEQ ID NO: 42973 - RNA, 26 nt, Artificial Sequence
  Synthetic Oligonucleotide; PDCD1LG2 exon 4; Set A
ggaaccuuuaggaugugaguguuuau

SEQ ID NO: 42974 - RNA, 25 nt, Artificial Sequence
  Synthetic Oligonucleotide; PDCD1LG2 exon 4; Set A
ggaaccuuuaggaugugaguguuua

SEQ ID NO: 42975 - RNA, 27 nt, Artificial Sequence
  Synthetic Oligonucleotide; PDCD1LG2 exon 4; Set A
uggaaccuuuaggaugugaguguuuau

SEQ ID NO: 42976 - RNA, 23 nt, Artificial Sequence
  Synthetic Oligonucleotide; PDCD1LG2 exon 4; Set C
gaaccuuuaggaugugaguguuu

SEQ ID NO: 42977 - RNA, 26 nt, Artificial Sequence
  Synthetic Oligonucleotide; PDCD1LG2 exon 4; Set A
uggaaccuuuaggaugugaguguuua

SEQ ID NO: 42978 - RNA, 22 nt, Artificial Sequence
  Synthetic Oligonucleotide; PDCD1LG2 exon 4; Set C
gaaccuuuaggaugugaguguu

SEQ ID NO: 42979 - RNA, 24 nt, Artificial Sequence
  Synthetic Oligonucleotide; PDCD1LG2 exon 4; Set A
ggaaccuuuaggaugugaguguuu

SEQ ID NO: 42980 - RNA, 21 nt, Artificial Sequence
  Synthetic Oligonucleotide; PDCD1LG2 exon 4; Set C
gaaccuuuaggaugugagugu

SEQ ID NO: 42981 - RNA, 23 nt, Artificial Sequence
  Synthetic Oligonucleotide; PDCD1LG2 exon 4; Set C
ggaaccuuuaggaugugaguguu

SEQ ID NO: 42982 - RNA, 25 nt, Artificial Sequence
  Synthetic Oligonucleotide; PDCD1LG2 exon 4; Set A
uggaaccuuuaggaugugaguguuu

SEQ ID NO: 42983 - RNA, 22 nt, Artificial Sequence
  Synthetic Oligonucleotide; PDCD1LG2 exon 4; Set C
ggaaccuuuaggaugugagugu

SEQ ID NO: 42984 - RNA, 24 nt, Artificial Sequence
  Synthetic Oligonucleotide; PDCD1LG2 exon 4; Set A
uggaaccuuuaggaugugaguguu

SEQ ID NO: 42985 - RNA, 23 nt, Artificial Sequence
  Synthetic Oligonucleotide; PDCD1LG2 exon 4; Set A
uggaaccuuuaggaugugagugu

SEQ ID NO: 42986 - RNA, 19 nt, Artificial Sequence
  Synthetic Oligonucleotide; PDCD1LG2 exon 4; Set C
ggaaccuuuaggaugugag

SEQ ID NO: 42987 - RNA, 24 nt, Artificial Sequence
  Synthetic Oligonucleotide; PDCD1LG2 exon 4; Set A
ucuggaaccuuuaggaugugagug

SEQ ID NO: 42988 - RNA, 20 nt, Artificial Sequence
  Synthetic Oligonucleotide; PDCD1LG2 exon 4; Set C
uggaaccuuuaggaugugag

SEQ ID NO: 42989 - RNA, 16 nt, Artificial Sequence
  Synthetic Oligonucleotide; PDCD1LG2 exon 4; Set C
gaaccuuuaggaugug

SEQ ID NO: 42990 - RNA, 18 nt, Artificial Sequence
  Synthetic Oligonucleotide; PDCD1LG2 exon 4; Set C
ggaaccuuuaggauguga

SEQ ID NO: 42991 - RNA, 40 nt, Artificial Sequence
  Synthetic Oligonucleotide; PDCD1LG2 exon 4; Set C
caucuguuucuggaaccuuuaggaugugaguguuuauuuu

SEQ ID NO: 42992 - RNA, 25 nt, Artificial Sequence
  Synthetic Oligonucleotide; PDCD1LG2 exon 4; Set A
uucuggaaccuuuaggaugugagug

SEQ ID NO: 42993 - RNA, 23 nt, Artificial Sequence
  Synthetic Oligonucleotide; PDCD1LG2 exon 4; Set A
ucuggaaccuuuaggaugugagu

SEQ ID NO: 42994 - RNA, 19 nt, Artificial Sequence
  Synthetic Oligonucleotide; PDCD1LG2 exon 4; Set C
uggaaccuuuaggauguga

SEQ ID NO: 42995 - RNA, 17 nt, Artificial Sequence
  Synthetic Oligonucleotide; PDCD1LG2 exon 4; Set C
ggaaccuuuaggaugug

SEQ ID NO: 42996 - RNA, 26 nt, Artificial Sequence
  Synthetic Oligonucleotide; PDCD1LG2 exon 4; Set A
uuucuggaaccuuuaggaugugagug

SEQ ID NO: 42997 - RNA, 24 nt, Artificial Sequence
  Synthetic Oligonucleotide; PDCD1LG2 exon 4; Set A
uucuggaaccuuuaggaugugagu

SEQ ID NO: 42998 - RNA, 16 nt, Artificial Sequence
  Synthetic Oligonucleotide; PDCD1LG2 exon 4; Set C
ggaaccuuuaggaugu

SEQ ID NO: 42999 - RNA, 18 nt, Artificial Sequence
  Synthetic Oligonucleotide; PDCD1LG2 exon 4; Set C
uggaaccuuuaggaugug

SEQ ID NO: 43000 - RNA, 25 nt, Artificial Sequence
  Synthetic Oligonucleotide; PDCD1LG2 exon 4; Set A
uuucuggaaccuuuaggaugugagu

SEQ ID NO: 43001 - RNA, 15 nt, Artificial Sequence
  Synthetic Oligonucleotide; PDCD1LG2 exon 4; Set C
ggaaccuuuaggaug

SEQ ID NO: 43002 - RNA, 38 nt, Artificial Sequence
  Synthetic Oligonucleotide; PDCD1LG2 exon 4; Set C
ucaucuguuucuggaaccuuuaggaugugaguguuuau

SEQ ID NO: 43003 - RNA, 16 nt, Artificial Sequence
  Synthetic Oligonucleotide; PDCD1LG2 exon 4; Set C
uggaaccuuuaggaug

SEQ ID NO: 43004 - RNA, 27 nt, Artificial Sequence
  Synthetic Oligonucleotide; PDCD1LG2 exon 4; Set A
uguuucuggaaccuuuaggaugugagu

SEQ ID NO: 43005 - RNA, 37 nt, Artificial Sequence
  Synthetic Oligonucleotide; PDCD1LG2 exon 4; Set C
ucaucuguuucuggaaccuuuaggaugugaguguuua

SEQ ID NO: 43006 - RNA, 36 nt, Artificial Sequence
  Synthetic Oligonucleotide; PDCD1LG2 exon 4; Set C
ucaucuguuucuggaaccuuuaggaugugaguguuu

SEQ ID NO: 43007 - RNA, 15 nt, Artificial Sequence
  Synthetic Oligonucleotide; PDCD1LG2 exon 4; Set C
cuggaaccuuuagga

SEQ ID NO: 43008 - RNA, 35 nt, Artificial Sequence
  Synthetic Oligonucleotide; PDCD1LG2 exon 4; Set C
ucaucuguuucuggaaccuuuaggaugugaguguu

SEQ ID NO: 43009 - RNA, 16 nt, Artificial Sequence
  Synthetic Oligonucleotide; PDCD1LG2 exon 4; Set C
ucuggaaccuuuagga

SEQ ID NO: 43010 - RNA, 34 nt, Artificial Sequence
  Synthetic Oligonucleotide; PDCD1LG2 exon 4; Set C
ucaucuguuucuggaaccuuuaggaugugagugu

SEQ ID NO: 43011 - RNA, 15 nt, Artificial Sequence
  Synthetic Oligonucleotide; PDCD1LG2 exon 4; Set C
ucuggaaccuuuagg

SEQ ID NO: 43012 - RNA, 17 nt, Artificial Sequence
  Synthetic Oligonucleotide; PDCD1LG2 exon 4; Set C
uucuggaaccuuuagga

SEQ ID NO: 43013 - RNA, 16 nt, Artificial Sequence
  Synthetic Oligonucleotide; PDCD1LG2 exon 4; Set C
uucuggaaccuuuagg

SEQ ID NO: 43014 - RNA, 15 nt, Artificial Sequence
  Synthetic Oligonucleotide; PDCD1LG2 exon 4; Set C
uucuggaaccuuuag

SEQ ID NO: 43015 - RNA, 31 nt, Artificial Sequence
  Synthetic Oligonucleotide; PDCD1LG2 exon 4; Set A
ucaucuguuucuggaaccuuuaggaugugag

SEQ ID NO: 43016 - RNA, 20 nt, Artificial Sequence
  Synthetic Oligonucleotide; PDCD1LG2 exon 4; Set C
uguuucuggaaccuuuagga

SEQ ID NO: 43017 - RNA, 30 nt, Artificial Sequence
  Synthetic Oligonucleotide; PDCD1LG2 exon 4; Set A
ucaucuguuucuggaaccuuuaggauguga

SEQ ID NO: 43018 - RNA, 19 nt, Artificial Sequence
  Synthetic Oligonucleotide; PDCD1LG2 exon 4; Set C
uguuucuggaaccuuuagg

SEQ ID NO: 43019 - RNA, 29 nt, Artificial Sequence
  Synthetic Oligonucleotide; PDCD1LG2 exon 4; Set A
ucaucuguuucuggaaccuuuaggaugug

SEQ ID NO: 43020 - RNA, 18 nt, Artificial Sequence
  Synthetic Oligonucleotide; PDCD1LG2 exon 4; Set C
uguuucuggaaccuuuag

SEQ ID NO: 43021 - RNA, 28 nt, Artificial Sequence
  Synthetic Oligonucleotide; PDCD1LG2 exon 4; Set A
ucaucuguuucuggaaccuuuaggaugu

SEQ ID NO: 43022 - RNA, 17 nt, Artificial Sequence
  Synthetic Oligonucleotide; PDCD1LG2 exon 4; Set C
uguuucuggaaccuuua

SEQ ID NO: 43023 - RNA, 27 nt, Artificial Sequence
  Synthetic Oligonucleotide; PDCD1LG2 exon 4; Set A
ucaucuguuucuggaaccuuuaggaug

SEQ ID NO: 43024 - RNA, 16 nt, Artificial Sequence
  Synthetic Oligonucleotide; PDCD1LG2 exon 4; Set C
uguuucuggaaccuuu

SEQ ID NO: 43025 - RNA, 26 nt, Artificial Sequence
  Synthetic Oligonucleotide; PDCD1LG2 exon 4; Set A
ucaucuguuucuggaaccuuuaggau

SEQ ID NO: 43026 - RNA, 40 nt, Artificial Sequence
  Synthetic Oligonucleotide; PDCD1LG2 exon 4; Set C
gcucuaccucaucuguuucuggaaccuuuaggaugugagu

SEQ ID NO: 43027 - RNA, 20 nt, Artificial Sequence
  Synthetic Oligonucleotide; PDCD1LG2 exon 4; Set C
ucaucuguuucuggaaccuu

SEQ ID NO: 43028 - RNA, 40 nt, Artificial Sequence
  Synthetic Oligonucleotide; PDCD1LG2 exon 4; Set C
gagcucuaccucaucuguuucuggaaccuuuaggauguga

SEQ ID NO: 43029 - RNA, 39 nt, Artificial Sequence
  Synthetic Oligonucleotide; PDCD1LG2 exon 4; Set C
gagcucuaccucaucuguuucuggaaccuuuaggaugug

SEQ ID NO: 43030 - RNA, 38 nt, Artificial Sequence
  Synthetic Oligonucleotide; PDCD1LG2 exon 4; Set C
gagcucuaccucaucuguuucuggaaccuuuaggaugu

SEQ ID NO: 43031 - RNA, 40 nt, Artificial Sequence
  Synthetic Oligonucleotide; PDCD1LG2 exon 4; Set C
ugagcucuaccucaucuguuucuggaaccuuuaggaugug

SEQ ID NO: 43032 - RNA, 33 nt, Artificial Sequence
  Synthetic Oligonucleotide; PDCD1LG2 exon 4; Set C
gcucuaccucaucuguuucuggaaccuuuagga

SEQ ID NO: 43033 - RNA, 39 nt, Artificial Sequence
  Synthetic Oligonucleotide; PDCD1LG2 exon 4; Set C
ugagcucuaccucaucuguuucuggaaccuuuaggaugu

SEQ ID NO: 43034 - RNA, 37 nt, Artificial Sequence
  Synthetic Oligonucleotide; PDCD1LG2 exon 4; Set C
gagcucuaccucaucuguuucuggaaccuuuaggaug

SEQ ID NO: 43035 - RNA, 34 nt, Artificial Sequence
  Synthetic Oligonucleotide; PDCD1LG2 exon 4; Set C
agcucuaccucaucuguuucuggaaccuuuagga

SEQ ID NO: 43036 - RNA, 32 nt, Artificial Sequence
  Synthetic Oligonucleotide; PDCD1LG2 exon 4; Set C
gcucuaccucaucuguuucuggaaccuuuagg

SEQ ID NO: 43037 - RNA, 16 nt, Artificial Sequence
  Synthetic Oligonucleotide; PDCD1LG2 exon 4; Set C
ucaucuguuucuggaa

SEQ ID NO: 43038 - RNA, 36 nt, Artificial Sequence
  Synthetic Oligonucleotide; PDCD1LG2 exon 4; Set C
gagcucuaccucaucuguuucuggaaccuuuaggau

SEQ ID NO: 43039 - RNA, 40 nt, Artificial Sequence
  Synthetic Oligonucleotide; PDCD1LG2 exon 4; Set C
gugagcucuaccucaucuguuucuggaaccuuuaggaugu

SEQ ID NO: 43040 - RNA, 38 nt, Artificial Sequence
  Synthetic Oligonucleotide; PDCD1LG2 exon 4; Set C
ugagcucuaccucaucuguuucuggaaccuuuaggaug

SEQ ID NO: 43041 - RNA, 33 nt, Artificial Sequence
  Synthetic Oligonucleotide; PDCD1LG2 exon 4; Set C
agcucuaccucaucuguuucuggaaccuuuagg

SEQ ID NO: 43042 - RNA, 31 nt, Artificial Sequence
  Synthetic Oligonucleotide; PDCD1LG2 exon 4; Set A
gcucuaccucaucuguuucuggaaccuuuag

SEQ ID NO: 43043 - RNA, 37 nt, Artificial Sequence
  Synthetic Oligonucleotide; PDCD1LG2 exon 4; Set C
ugagcucuaccucaucuguuucuggaaccuuuaggau

SEQ ID NO: 43044 - RNA, 15 nt, Artificial Sequence
  Synthetic Oligonucleotide; PDCD1LG2 exon 4; Set C
ucaucuguuucugga

SEQ ID NO: 43045 - RNA, 39 nt, Artificial Sequence
  Synthetic Oligonucleotide; PDCD1LG2 exon 4; Set C
gugagcucuaccucaucuguuucuggaaccuuuaggaug

SEQ ID NO: 43046 - RNA, 30 nt, Artificial Sequence
  Synthetic Oligonucleotide; PDCD1LG2 exon 4; Set C
gcucuaccucaucuguuucuggaaccuuua

SEQ ID NO: 43047 - RNA, 32 nt, Artificial Sequence
  Synthetic Oligonucleotide; PDCD1LG2 exon 4; Set A
agcucuaccucaucuguuucuggaaccuuuag

SEQ ID NO: 43048 - RNA, 38 nt, Artificial Sequence
  Synthetic Oligonucleotide; PDCD1LG2 exon 4; Set C
gugagcucuaccucaucuguuucuggaaccuuuaggau

SEQ ID NO: 43049 - RNA, 29 nt, Artificial Sequence
  Synthetic Oligonucleotide; PDCD1LG2 exon 4; Set C
gcucuaccucaucuguuucuggaaccuuu

SEQ ID NO: 43050 - RNA, 31 nt, Artificial Sequence
  Synthetic Oligonucleotide; PDCD1LG2 exon 4; Set C
agcucuaccucaucuguuucuggaaccuuua

SEQ ID NO: 43051 - RNA, 30 nt, Artificial Sequence
  Synthetic Oligonucleotide; PDCD1LG2 exon 4; Set A
agcucuaccucaucuguuucuggaaccuuu

SEQ ID NO: 43052 - RNA, 30 nt, Artificial Sequence
  Synthetic Oligonucleotide; PDCD1LG2 exon 4; Set C
gagcucuaccucaucuguuucuggaaccuu

SEQ ID NO: 43053 - RNA, 31 nt, Artificial Sequence
  Synthetic Oligonucleotide; PDCD1LG2 exon 4; Set C
ugagcucuaccucaucuguuucuggaaccuu

SEQ ID NO: 43054 - RNA, 32 nt, Artificial Sequence
  Synthetic Oligonucleotide; PDCD1LG2 exon 4; Set C
gugagcucuaccucaucuguuucuggaaccuu

SEQ ID NO: 43055 - RNA, 26 nt, Artificial Sequence
  Synthetic Oligonucleotide; PDCD1LG2 exon 4; Set A
gagcucuaccucaucuguuucuggaa

SEQ ID NO: 43056 - RNA, 27 nt, Artificial Sequence
  Synthetic Oligonucleotide; PDCD1LG2 exon 4; Set A
ugagcucuaccucaucuguuucuggaa

SEQ ID NO: 43057 - RNA, 28 nt, Artificial Sequence
  Synthetic Oligonucleotide; PDCD1LG2 exon 4; Set A
gugagcucuaccucaucuguuucuggaa

SEQ ID NO: 43058 - RNA, 26 nt, Artificial Sequence
  Synthetic Oligonucleotide; PDCD1LG2 exon 4; Set A
ugagcucuaccucaucuguuucugga

SEQ ID NO: 43059 - RNA, 27 nt, Artificial Sequence
  Synthetic Oligonucleotide; PDCD1LG2 exon 4; Set A
gugagcucuaccucaucuguuucugga

SEQ ID NO: 43060 - RNA, 25 nt, Artificial Sequence
  Synthetic Oligonucleotide; PDCD1LG2 exon 4; Set A
ugagcucuaccucaucuguuucugg

SEQ ID NO: 43061 - RNA, 26 nt, Artificial Sequence
  Synthetic Oligonucleotide; PDCD1LG2 exon 4; Set A
gugagcucuaccucaucuguuucugg

SEQ ID NO: 43062 - RNA, 38 nt, Artificial Sequence
  Synthetic Oligonucleotide; PDCD1LG2 exon 4; Set C
agccuggcaggugagcucuaccucaucuguuucuggaa

SEQ ID NO: 43063 - RNA, 15 nt, Artificial Sequence
  Synthetic Oligonucleotide; PDCD1LG2 exon 4; Set C
ugagcucuaccucau

SEQ ID NO: 43064 - RNA, 39 nt, Artificial Sequence
  Synthetic Oligonucleotide; PDCD1LG2 exon 4; Set C
uagccuggcaggugagcucuaccucaucuguuucuggaa

SEQ ID NO: 43065 - RNA, 37 nt, Artificial Sequence
  Synthetic Oligonucleotide; PDCD1LG2 exon 4; Set C
agccuggcaggugagcucuaccucaucuguuucugga

SEQ ID NO: 43066 - RNA, 16 nt, Artificial Sequence
  Synthetic Oligonucleotide; PDCD1LG2 exon 4; Set C
gugagcucuaccucau

SEQ ID NO: 43067 - RNA, 40 nt, Artificial Sequence
  Synthetic Oligonucleotide; PDCD1LG2 exon 4; Set C
guagccuggcaggugagcucuaccucaucuguuucuggaa

SEQ ID NO: 43068 - RNA, 38 nt, Artificial Sequence
  Synthetic Oligonucleotide; PDCD1LG2 exon 4; Set C
uagccuggcaggugagcucuaccucaucuguuucugga

SEQ ID NO: 43069 - RNA, 15 nt, Artificial Sequence
  Synthetic Oligonucleotide; PDCD1LG2 exon 4; Set C
gugagcucuaccuca

SEQ ID NO: 43070 - RNA, 39 nt, Artificial Sequence
  Synthetic Oligonucleotide; PDCD1LG2 exon 4; Set C
guagccuggcaggugagcucuaccucaucuguuucugga

SEQ ID NO: 43071 - RNA, 37 nt, Artificial Sequence
  Synthetic Oligonucleotide; PDCD1LG2 exon 4; Set C
uagccuggcaggugagcucuaccucaucuguuucugg

SEQ ID NO: 43072 - RNA, 38 nt, Artificial Sequence
  Synthetic Oligonucleotide; PDCD1LG2 exon 4; Set C
guagccuggcaggugagcucuaccucaucuguuucugg

SEQ ID NO: 43073 - RNA, 26 nt, Artificial Sequence
  Synthetic Oligonucleotide; PDCD1LG2 exon 4; Set C
agccuggcaggugagcucuaccucau

SEQ ID NO: 43074 - RNA, 27 nt, Artificial Sequence
  Synthetic Oligonucleotide; PDCD1LG2 exon 4; Set C
uagccuggcaggugagcucuaccucau

SEQ ID NO: 43075 - RNA, 28 nt, Artificial Sequence
  Synthetic Oligonucleotide; PDCD1LG2 exon 4; Set C
guagccuggcaggugagcucuaccucau

SEQ ID NO: 43076 - RNA, 26 nt, Artificial Sequence
  Synthetic Oligonucleotide; PDCD1LG2 exon 4; Set C
uagccuggcaggugagcucuaccuca

SEQ ID NO: 43077 - RNA, 29 nt, Artificial Sequence
  Synthetic Oligonucleotide; PDCD1LG2 exon 4; Set C
uguagccuggcaggugagcucuaccucau

SEQ ID NO: 43078 - RNA, 27 nt, Artificial Sequence
  Synthetic Oligonucleotide; PDCD1LG2 exon 4; Set C
guagccuggcaggugagcucuaccuca

SEQ ID NO: 43079 - RNA, 33 nt, Artificial Sequence
  Synthetic Oligonucleotide; PDCD1LG2 exon 4; Set C
aaccuguagccuggcaggugagcucuaccucau

SEQ ID NO: 43080 - RNA, 35 nt, Artificial Sequence
  Synthetic Oligonucleotide; PDCD1LG2 exon 4; Set C
gauaaccuguagccuggcaggugagcucuaccuca

SEQ ID NO: 43081 - RNA, 15 nt, Artificial Sequence
  Synthetic Oligonucleotide; PDCD1LG2 exon 4; Set C
uagccuggcagguga

SEQ ID NO: 43082 - RNA, 17 nt, Artificial Sequence
  Synthetic Oligonucleotide; PDCD1LG2 exon 4; Set A
guagccuggcaggugag

SEQ ID NO: 43083 - RNA, 16 nt, Artificial Sequence
  Synthetic Oligonucleotide; PDCD1LG2 exon 4; Set A
guagccuggcagguga

SEQ ID NO: 43084 - RNA, 15 nt, Artificial Sequence
  Synthetic Oligonucleotide; PDCD1LG2 exon 4; Set C
guagccuggcaggug

SEQ ID NO: 43085 - RNA, 25 nt, Artificial Sequence
  Synthetic Oligonucleotide; PDCD1LG2 exon 4; Set C
uaaccuguagccuggcaggugagcu

SEQ ID NO: 43086 - RNA, 26 nt, Artificial Sequence
  Synthetic Oligonucleotide; PDCD1LG2 exon 4; Set C
auaaccuguagccuggcaggugagcu

SEQ ID NO: 43087 - RNA, 24 nt, Artificial Sequence
  Synthetic Oligonucleotide; PDCD1LG2 exon 4; Set C
uaaccuguagccuggcaggugagc

SEQ ID NO: 43088 - RNA, 25 nt, Artificial Sequence
  Synthetic Oligonucleotide; PDCD1LG2 exon 4; Set C
auaaccuguagccuggcaggugagc

SEQ ID NO: 43089 - RNA, 20 nt, Artificial Sequence
  Synthetic Oligonucleotide; PDCD1LG2 exon 4; Set A
aaccuguagccuggcaggug

SEQ ID NO: 43090 - RNA, 25 nt, Artificial Sequence
  Synthetic Oligonucleotide; PDCD1LG2 exon 4; Set A
gauaaccuguagccuggcaggugag

SEQ ID NO: 43091 - RNA, 24 nt, Artificial Sequence
  Synthetic Oligonucleotide; PDCD1LG2 exon 4; Set A
gauaaccuguagccuggcagguga

SEQ ID NO: 43092 - RNA, 23 nt, Artificial Sequence
  Synthetic Oligonucleotide; PDCD1LG2 exon 4; Set A
gauaaccuguagccuggcaggug

SEQ ID NO: 43093 - RNA, 36 nt, Artificial Sequence
  Synthetic Oligonucleotide; PDCD1LG2 exon 4; Set C
cuucugccagaggauaaccuguagccuggcagguga

SEQ ID NO: 43094 - RNA, 35 nt, Artificial Sequence
  Synthetic Oligonucleotide; PDCD1LG2 exon 4; Set C
cuucugccagaggauaaccuguagccuggcaggug

SEQ ID NO: 43095 - RNA, 37 nt, Artificial Sequence
  Synthetic Oligonucleotide; PDCD1LG2 exon 4; Set C
acuucugccagaggauaaccuguagccuggcagguga

SEQ ID NO: 43096 - RNA, 36 nt, Artificial Sequence
  Synthetic Oligonucleotide; PDCD1LG2 exon 4; Set C
acuucugccagaggauaaccuguagccuggcaggug

SEQ ID NO: 43097 - RNA, 27 nt, Artificial Sequence
  Synthetic Oligonucleotide; PDCD1LG2 exon 4; Set C
cuucugccagaggauaaccuguagccu

SEQ ID NO: 43098 - RNA, 28 nt, Artificial Sequence
  Synthetic Oligonucleotide; PDCD1LG2 exon 4; Set C
acuucugccagaggauaaccuguagccu

SEQ ID NO: 43099 - RNA, 25 nt, Artificial Sequence
  Synthetic Oligonucleotide; PDCD1LG2 exon 4; Set A
cuucugccagaggauaaccuguagc

SEQ ID NO: 43100 - RNA, 24 nt, Artificial Sequence
  Synthetic Oligonucleotide; PDCD1LG2 exon 4; Set A
cuucugccagaggauaaccuguag

SEQ ID NO: 43101 - RNA, 26 nt, Artificial Sequence
  Synthetic Oligonucleotide; PDCD1LG2 exon 4; Set A
acuucugccagaggauaaccuguagc

SEQ ID NO: 43102 - RNA, 23 nt, Artificial Sequence
  Synthetic Oligonucleotide; PDCD1LG2 exon 4; Set A
cuucugccagaggauaaccugua

SEQ ID NO: 43103 - RNA, 25 nt, Artificial Sequence
  Synthetic Oligonucleotide; PDCD1LG2 exon 4; Set A
acuucugccagaggauaaccuguag

SEQ ID NO: 43104 - RNA, 24 nt, Artificial Sequence
  Synthetic Oligonucleotide; PDCD1LG2 exon 4; Set A
acuucugccagaggauaaccugua

SEQ ID NO: 43105 - RNA, 17 nt, Artificial Sequence
  Synthetic Oligonucleotide; PDCD1LG2 exon 4; Set C
cuucugccagaggauaa

SEQ ID NO: 43106 - RNA, 16 nt, Artificial Sequence
  Synthetic Oligonucleotide; PDCD1LG2 exon 4; Set C
cuucugccagaggaua

SEQ ID NO: 43107 - RNA, 18 nt, Artificial Sequence
  Synthetic Oligonucleotide; PDCD1LG2 exon 4; Set C
acuucugccagaggauaa

SEQ ID NO: 43108 - RNA, 17 nt, Artificial Sequence
  Synthetic Oligonucleotide; PDCD1LG2 exon 4; Set C
acuucugccagaggaua

SEQ ID NO: 43109 - RNA, 39 nt, Artificial Sequence
  Synthetic Oligonucleotide; PDCD1LG2 exon 4; Set C
uuggccaggauacuucugccagaggauaaccuguagccu

SEQ ID NO: 43110 - RNA, 40 nt, Artificial Sequence
  Synthetic Oligonucleotide; PDCD1LG2 exon 4; Set C
uuuggccaggauacuucugccagaggauaaccuguagccu

SEQ ID NO: 43111 - RNA, 38 nt, Artificial Sequence
  Synthetic Oligonucleotide; PDCD1LG2 exon 4; Set C
uuggccaggauacuucugccagaggauaaccuguagcc

SEQ ID NO: 43112 - RNA, 37 nt, Artificial Sequence
  Synthetic Oligonucleotide; PDCD1LG2 exon 4; Set C
uuggccaggauacuucugccagaggauaaccuguagc

SEQ ID NO: 43113 - RNA, 39 nt, Artificial Sequence
  Synthetic Oligonucleotide; PDCD1LG2 exon 4; Set C
uuuggccaggauacuucugccagaggauaaccuguagcc

SEQ ID NO: 43114 - RNA, 36 nt, Artificial Sequence
  Synthetic Oligonucleotide; PDCD1LG2 exon 4; Set C
uuggccaggauacuucugccagaggauaaccuguag

SEQ ID NO: 43115 - RNA, 38 nt, Artificial Sequence
  Synthetic Oligonucleotide; PDCD1LG2 exon 4; Set C
uuuggccaggauacuucugccagaggauaaccuguagc

SEQ ID NO: 43116 - RNA, 40 nt, Artificial Sequence
  Synthetic Oligonucleotide; PDCD1LG2 exon 4; Set C
guuuggccaggauacuucugccagaggauaaccuguagcc

SEQ ID NO: 43117 - RNA, 35 nt, Artificial Sequence
  Synthetic Oligonucleotide; PDCD1LG2 exon 4; Set C
uuggccaggauacuucugccagaggauaaccugua

SEQ ID NO: 43118 - RNA, 37 nt, Artificial Sequence
  Synthetic Oligonucleotide; PDCD1LG2 exon 4; Set C
uuuggccaggauacuucugccagaggauaaccuguag

SEQ ID NO: 43119 - RNA, 39 nt, Artificial Sequence
  Synthetic Oligonucleotide; PDCD1LG2 exon 4; Set C
guuuggccaggauacuucugccagaggauaaccuguagc

SEQ ID NO: 43120 - RNA, 36 nt, Artificial Sequence
  Synthetic Oligonucleotide; PDCD1LG2 exon 4; Set C
uuuggccaggauacuucugccagaggauaaccugua

SEQ ID NO: 43121 - RNA, 38 nt, Artificial Sequence
  Synthetic Oligonucleotide; PDCD1LG2 exon 4; Set C
guuuggccaggauacuucugccagaggauaaccuguag

SEQ ID NO: 43122 - RNA, 34 nt, Artificial Sequence
  Synthetic Oligonucleotide; PDCD1LG2 exon 4; Set C
uuggccaggauacuucugccagaggauaaccugu

SEQ ID NO: 43123 - RNA, 37 nt, Artificial Sequence
  Synthetic Oligonucleotide; PDCD1LG2 exon 4; Set C
guuuggccaggauacuucugccagaggauaaccugua

SEQ ID NO: 43124 - RNA, 35 nt, Artificial Sequence
  Synthetic Oligonucleotide; PDCD1LG2 exon 4; Set C
uuuggccaggauacuucugccagaggauaaccugu

SEQ ID NO: 43125 - RNA, 36 nt, Artificial Sequence
  Synthetic Oligonucleotide; PDCD1LG2 exon 4; Set C
guuuggccaggauacuucugccagaggauaaccugu

SEQ ID NO: 43126 - RNA, 29 nt, Artificial Sequence
  Synthetic Oligonucleotide; PDCD1LG2 exon 4; Set C
uuggccaggauacuucugccagaggauaa

SEQ ID NO: 43127 - RNA, 28 nt, Artificial Sequence
  Synthetic Oligonucleotide; PDCD1LG2 exon 4; Set C
uuggccaggauacuucugccagaggaua

SEQ ID NO: 43128 - RNA, 29 nt, Artificial Sequence
  Synthetic Oligonucleotide; PDCD1LG2 exon 4; Set C
uuuggccaggauacuucugccagaggaua

SEQ ID NO: 43129 - RNA, 27 nt, Artificial Sequence
  Synthetic Oligonucleotide; PDCD1LG2 exon 4; Set C
uuggccaggauacuucugccagaggau

SEQ ID NO: 43130 - RNA, 28 nt, Artificial Sequence
  Synthetic Oligonucleotide; PDCD1LG2 exon 4; Set C
uuuggccaggauacuucugccagaggau

SEQ ID NO: 43131 - RNA, 29 nt, Artificial Sequence
  Synthetic Oligonucleotide; PDCD1LG2 exon 4; Set C
guuuggccaggauacuucugccagaggau

SEQ ID NO: 43132 - RNA, 15 nt, Artificial Sequence
  Synthetic Oligonucleotide; PDCD1LG2 exon 4; Set C
uuggccaggauacuu

SEQ ID NO: 43133 - RNA, 15 nt, Artificial Sequence
  Synthetic Oligonucleotide; PDCD1LG2 exon 4; Set C
uuuggccaggauacu

SEQ ID NO: 43134 - RNA, 36 nt, Artificial Sequence
  Synthetic Oligonucleotide; PDCD1LG2 exon 4; Set C
uguuggcaggaacgcugacguuuggccaggauacuu

SEQ ID NO: 43135 - RNA, 37 nt, Artificial Sequence
  Synthetic Oligonucleotide; PDCD1LG2 exon 4; Set C
guguuggcaggaacgcugacguuuggccaggauacuu

SEQ ID NO: 43136 - RNA, 35 nt, Artificial Sequence
  Synthetic Oligonucleotide; PDCD1LG2 exon 4; Set C
uguuggcaggaacgcugacguuuggccaggauacu

SEQ ID NO: 43137 - RNA, 38 nt, Artificial Sequence
  Synthetic Oligonucleotide; PDCD1LG2 exon 4; Set C
gguguuggcaggaacgcugacguuuggccaggauacuu

SEQ ID NO: 43138 - RNA, 36 nt, Artificial Sequence
  Synthetic Oligonucleotide; PDCD1LG2 exon 4; Set C
guguuggcaggaacgcugacguuuggccaggauacu

SEQ ID NO: 43139 - RNA, 37 nt, Artificial Sequence
  Synthetic Oligonucleotide; PDCD1LG2 exon 4; Set C
gguguuggcaggaacgcugacguuuggccaggauacu

SEQ ID NO: 43140 - RNA, 20 nt, Artificial Sequence
  Synthetic Oligonucleotide; PDCD1LG2 exon 4; Set A
gguccuggaguggcuggugu

SEQ ID NO: 43141 - RNA, 19 nt, Artificial Sequence
  Synthetic Oligonucleotide; PDCD1LG2 exon 4; Set A
gguccuggaguggcuggug

SEQ ID NO: 43142 - RNA, 18 nt, Artificial Sequence
  Synthetic Oligonucleotide; PDCD1LG2 exon 4; Set A
gguccuggaguggcuggu

SEQ ID NO: 43143 - RNA, 34 nt, Artificial Sequence
  Synthetic Oligonucleotide; PDCD1LG2 exon 4; Set C
uagaggccuucagggguccuggaguggcuggugu

SEQ ID NO: 43144 - RNA, 35 nt, Artificial Sequence
  Synthetic Oligonucleotide; PDCD1LG2 exon 4; Set C
guagaggccuucagggguccuggaguggcuggugu

SEQ ID NO: 43145 - RNA, 33 nt, Artificial Sequence
  Synthetic Oligonucleotide; PDCD1LG2 exon 4; Set C
uagaggccuucagggguccuggaguggcuggug

SEQ ID NO: 43146 - RNA, 36 nt, Artificial Sequence
  Synthetic Oligonucleotide; PDCD1LG2 exon 4; Set C
gguagaggccuucagggguccuggaguggcuggugu

SEQ ID NO: 43147 - RNA, 34 nt, Artificial Sequence
  Synthetic Oligonucleotide; PDCD1LG2 exon 4; Set C
guagaggccuucagggguccuggaguggcuggug

SEQ ID NO: 43148 - RNA, 32 nt, Artificial Sequence
  Synthetic Oligonucleotide; PDCD1LG2 exon 4; Set C
uagaggccuucagggguccuggaguggcuggu

SEQ ID NO: 43149 - RNA, 35 nt, Artificial Sequence
  Synthetic Oligonucleotide; PDCD1LG2 exon 4; Set C
gguagaggccuucagggguccuggaguggcuggug

SEQ ID NO: 43150 - RNA, 33 nt, Artificial Sequence
  Synthetic Oligonucleotide; PDCD1LG2 exon 4; Set C
guagaggccuucagggguccuggaguggcuggu

SEQ ID NO: 43151 - RNA, 34 nt, Artificial Sequence
  Synthetic Oligonucleotide; PDCD1LG2 exon 4; Set C
gguagaggccuucagggguccuggaguggcuggu

SEQ ID NO: 43152 - RNA, 25 nt, Artificial Sequence
  Synthetic Oligonucleotide; PDCD1LG2 exon 4; Set C
uagaggccuucagggguccuggagu

SEQ ID NO: 43153 - RNA, 24 nt, Artificial Sequence
  Synthetic Oligonucleotide; PDCD1LG2 exon 4; Set C
uagaggccuucagggguccuggag

SEQ ID NO: 43154 - RNA, 26 nt, Artificial Sequence
  Synthetic Oligonucleotide; PDCD1LG2 exon 4; Set C
guagaggccuucagggguccuggagu

SEQ ID NO: 43155 - RNA, 27 nt, Artificial Sequence
  Synthetic Oligonucleotide; PDCD1LG2 exon 4; Set C
gguagaggccuucagggguccuggagu

SEQ ID NO: 43156 - RNA, 25 nt, Artificial Sequence
  Synthetic Oligonucleotide; PDCD1LG2 exon 4; Set C
guagaggccuucagggguccuggag

SEQ ID NO: 43157 - RNA, 26 nt, Artificial Sequence
  Synthetic Oligonucleotide; PDCD1LG2 exon 4; Set C
gguagaggccuucagggguccuggag

SEQ ID NO: 43158 - RNA, 17 nt, Artificial Sequence
  Synthetic Oligonucleotide; PDCD1LG2 exon 4; Set A
uagaggccuucaggggu

SEQ ID NO: 43159 - RNA, 18 nt, Artificial Sequence
  Synthetic Oligonucleotide; PDCD1LG2 exon 4; Set A
guagaggccuucaggggu

SEQ ID NO: 43160 - RNA, 19 nt, Artificial Sequence
  Synthetic Oligonucleotide; PDCD1LG2 exon 4; Set A
gguagaggccuucaggggu

SEQ ID NO: 43161 - RNA, 36 nt, Artificial Sequence
  Synthetic Oligonucleotide; PDCD1LG2 exon 4; Set C
gguggcuuuaggcgcagaacacuggugaccugguag

SEQ ID NO: 43162 - RNA, 35 nt, Artificial Sequence
  Synthetic Oligonucleotide; PDCD1LG2 exon 4; Set C
gguggcuuuaggcgcagaacacuggugaccuggua

SEQ ID NO: 43163 - RNA, 34 nt, Artificial Sequence
  Synthetic Oligonucleotide; PDCD1LG2 exon 4; Set C
gguggcuuuaggcgcagaacacuggugaccuggu

SEQ ID NO: 43164 - RNA, 16 nt, Artificial Sequence
  Synthetic Oligonucleotide; PDCD1LG2 exon 4; Set C
uuucugccagggggug

SEQ ID NO: 43165 - RNA, 40 nt, Artificial Sequence
  Synthetic Oligonucleotide; PDCD1LG2 exon 4; Set C
cagaacacacagcugaaguuucugccaggggguggcuuua

SEQ ID NO: 43166 - RNA, 39 nt, Artificial Sequence
  Synthetic Oligonucleotide; PDCD1LG2 exon 4; Set C
cagaacacacagcugaaguuucugccaggggguggcuuu

SEQ ID NO: 43167 - RNA, 40 nt, Artificial Sequence
  Synthetic Oligonucleotide; PDCD1LG2 exon 4; Set C
ccagaacacacagcugaaguuucugccaggggguggcuuu

SEQ ID NO: 43168 - RNA, 38 nt, Artificial Sequence
  Synthetic Oligonucleotide; PDCD1LG2 exon 4; Set C
cagaacacacagcugaaguuucugccaggggguggcuu

SEQ ID NO: 43169 - RNA, 33 nt, Artificial Sequence
  Synthetic Oligonucleotide; PDCD1LG2 exon 4; Set C
cagaacacacagcugaaguuucugccagggggu

SEQ ID NO: 43170 - RNA, 34 nt, Artificial Sequence
  Synthetic Oligonucleotide; PDCD1LG2 exon 4; Set C
ccagaacacacagcugaaguuucugccagggggu

SEQ ID NO: 43171 - RNA, 32 nt, Artificial Sequence
  Synthetic Oligonucleotide; PDCD1LG2 exon 4; Set C
cagaacacacagcugaaguuucugccaggggg

SEQ ID NO: 43172 - RNA, 21 nt, Artificial Sequence
  Synthetic Oligonucleotide; PDCD1LG2 exon 4; Set C
cagaacacacagcugaaguuu

SEQ ID NO: 43173 - RNA, 40 nt, Artificial Sequence
  Synthetic Oligonucleotide; PDCD1LG2 exon 4; Set C
uucccucacgugaguauuccagaacacacagcugaaguuu

SEQ ID NO: 43174 - RNA, 22 nt, Artificial Sequence
  Synthetic Oligonucleotide; PDCD1LG2 exon 4; Set B
uucccucacgugaguauuccag

SEQ ID NO: 43175 - RNA, 26 nt, Artificial Sequence
  Synthetic Oligonucleotide; PDCD1LG2 exon 4; Set B
aggucaaugcuggccaaaguaaguuc

SEQ ID NO: 43176 - RNA, 33 nt, Artificial Sequence
  Synthetic Oligonucleotide; PDCD1LG2 exon 4; Set C
gggggcagcucuuacuuugaaggucaaugcugg

SEQ ID NO: 43177 - RNA, 32 nt, Artificial Sequence
  Synthetic Oligonucleotide; PDCD1LG2 exon 4; Set C
gggggcagcucuuacuuugaaggucaaugcug

SEQ ID NO: 43178 - RNA, 31 nt, Artificial Sequence
  Synthetic Oligonucleotide; PDCD1LG2 exon 4; Set C
gggggcagcucuuacuuugaaggucaaugcu

SEQ ID NO: 43179 - RNA, 30 nt, Artificial Sequence
  Synthetic Oligonucleotide; PDCD1LG2 exon 4; Set C
gggggcagcucuuacuuugaaggucaaugc

SEQ ID NO: 43180 - RNA, 29 nt, Artificial Sequence
  Synthetic Oligonucleotide; PDCD1LG2 exon 4; Set C
gggggcagcucuuacuuugaaggucaaug

SEQ ID NO: 43181 - RNA, 28 nt, Artificial Sequence
  Synthetic Oligonucleotide; PDCD1LG2 exon 4; Set C
gggggcagcucuuacuuugaaggucaau

SEQ ID NO: 43182 - RNA, 27 nt, Artificial Sequence
  Synthetic Oligonucleotide; PDCD1LG2 exon 4; Set C
gggggcagcucuuacuuugaaggucaa

SEQ ID NO: 43183 - RNA, 40 nt, Artificial Sequence
  Synthetic Oligonucleotide; PDCD1LG2 exon 4; Set C
ccuaggaagugggggcagcucuuacuuugaaggucaaugc

SEQ ID NO: 43184 - RNA, 39 nt, Artificial Sequence
  Synthetic Oligonucleotide; PDCD1LG2 exon 4; Set C
ccuaggaagugggggcagcucuuacuuugaaggucaaug

SEQ ID NO: 43185 - RNA, 38 nt, Artificial Sequence
  Synthetic Oligonucleotide; PDCD1LG2 exon 4; Set C
ccuaggaagugggggcagcucuuacuuugaaggucaau

SEQ ID NO: 43186 - RNA, 40 nt, Artificial Sequence
  Synthetic Oligonucleotide; PDCD1LG2 exon 4; Set C
accuaggaagugggggcagcucuuacuuugaaggucaaug

SEQ ID NO: 43187 - RNA, 39 nt, Artificial Sequence
  Synthetic Oligonucleotide; PDCD1LG2 exon 4; Set C
accuaggaagugggggcagcucuuacuuugaaggucaau

SEQ ID NO: 43188 - RNA, 37 nt, Artificial Sequence
  Synthetic Oligonucleotide; PDCD1LG2 exon 4; Set C
ccuaggaagugggggcagcucuuacuuugaaggucaa

SEQ ID NO: 43189 - RNA, 40 nt, Artificial Sequence
  Synthetic Oligonucleotide; PDCD1LG2 exon 4; Set C
gaccuaggaagugggggcagcucuuacuuugaaggucaau

SEQ ID NO: 43190 - RNA, 38 nt, Artificial Sequence
  Synthetic Oligonucleotide; PDCD1LG2 exon 4; Set C
accuaggaagugggggcagcucuuacuuugaaggucaa

SEQ ID NO: 43191 - RNA, 36 nt, Artificial Sequence
  Synthetic Oligonucleotide; PDCD1LG2 exon 4; Set C
ccuaggaagugggggcagcucuuacuuugaagguca

SEQ ID NO: 43192 - RNA, 39 nt, Artificial Sequence
  Synthetic Oligonucleotide; PDCD1LG2 exon 4; Set C
gaccuaggaagugggggcagcucuuacuuugaaggucaa

SEQ ID NO: 43193 - RNA, 37 nt, Artificial Sequence
  Synthetic Oligonucleotide; PDCD1LG2 exon 4; Set C
accuaggaagugggggcagcucuuacuuugaagguca

SEQ ID NO: 43194 - RNA, 38 nt, Artificial Sequence
  Synthetic Oligonucleotide; PDCD1LG2 exon 4; Set C
gaccuaggaagugggggcagcucuuacuuugaagguca

SEQ ID NO: 43195 - RNA, 36 nt, Artificial Sequence
  Synthetic Oligonucleotide; PDCD1LG2 exon 4; Set C
accuaggaagugggggcagcucuuacuuugaagguc

SEQ ID NO: 43196 - RNA, 39 nt, Artificial Sequence
  Synthetic Oligonucleotide; PDCD1LG2 exon 4; Set C
agaccuaggaagugggggcagcucuuacuuugaagguca

SEQ ID NO: 43197 - RNA, 37 nt, Artificial Sequence
  Synthetic Oligonucleotide; PDCD1LG2 exon 4; Set C
gaccuaggaagugggggcagcucuuacuuugaagguc

SEQ ID NO: 43198 - RNA, 36 nt, Artificial Sequence
  Synthetic Oligonucleotide; PDCD1LG2 exon 4; Set C
gaccuaggaagugggggcagcucuuacuuugaaggu

SEQ ID NO: 43199 - RNA, 38 nt, Artificial Sequence
  Synthetic Oligonucleotide; PDCD1LG2 exon 4; Set C
agaccuaggaagugggggcagcucuuacuuugaagguc

SEQ ID NO: 43200 - RNA, 35 nt, Artificial Sequence
  Synthetic Oligonucleotide; PDCD1LG2 exon 4; Set C
gaccuaggaagugggggcagcucuuacuuugaagg

SEQ ID NO: 43201 - RNA, 37 nt, Artificial Sequence
  Synthetic Oligonucleotide; PDCD1LG2 exon 4; Set C
agaccuaggaagugggggcagcucuuacuuugaaggu

SEQ ID NO: 43202 - RNA, 36 nt, Artificial Sequence
  Synthetic Oligonucleotide; PDCD1LG2 exon 4; Set C
agaccuaggaagugggggcagcucuuacuuugaagg

SEQ ID NO: 43203 - RNA, 15 nt, Artificial Sequence
  Synthetic Oligonucleotide; PDCD1LG2 exon 4; Set C
gaccuaggaaguggg

SEQ ID NO: 43204 - RNA, 15 nt, Artificial Sequence
  Synthetic Oligonucleotide; PDCD1LG2 exon 4; Set C
agaccuaggaagugg

SEQ ID NO: 43205 - RNA, 31 nt, Artificial Sequence
  Synthetic Oligonucleotide; PDCD1LG2 exon 4; Set B
ugaacccuaacugauagaccuaggaaguggg

SEQ ID NO: 43206 - RNA, 32 nt, Artificial Sequence
  Synthetic Oligonucleotide; PDCD1LG2 exon 4; Set C
cugaacccuaacugauagaccuaggaaguggg

SEQ ID NO: 43207 - RNA, 33 nt, Artificial Sequence
  Synthetic Oligonucleotide; PDCD1LG2 exon 4; Set C
ucugaacccuaacugauagaccuaggaaguggg

SEQ ID NO: 43208 - RNA, 37 nt, Artificial Sequence
  Synthetic Oligonucleotide; PDCD1LG2 exon 4; Set C
cuugucugaacccuaacugauagaccuaggaaguggg

SEQ ID NO: 43209 - RNA, 38 nt, Artificial Sequence
  Synthetic Oligonucleotide; PDCD1LG2 exon 4; Set C
ucuugucugaacccuaacugauagaccuaggaaguggg

SEQ ID NO: 43210 - RNA, 21 nt, Artificial Sequence
  Synthetic Oligonucleotide; PDCD1LG2 exon 4; Set C
ugaacccuaacugauagaccu

SEQ ID NO: 43211 - RNA, 22 nt, Artificial Sequence
  Synthetic Oligonucleotide; PDCD1LG2 exon 4; Set C
cugaacccuaacugauagaccu

SEQ ID NO: 43212 - RNA, 19 nt, Artificial Sequence
  Synthetic Oligonucleotide; PDCD1LG2 exon 4; Set C
ugaacccuaacugauagac

SEQ ID NO: 43213 - RNA, 23 nt, Artificial Sequence
  Synthetic Oligonucleotide; PDCD1LG2 exon 4; Set B
ucugaacccuaacugauagaccu

SEQ ID NO: 43214 - RNA, 21 nt, Artificial Sequence
  Synthetic Oligonucleotide; PDCD1LG2 exon 4; Set C
cugaacccuaacugauagacc

SEQ ID NO: 43215 - RNA, 18 nt, Artificial Sequence
  Synthetic Oligonucleotide; PDCD1LG2 exon 4; Set C
ugaacccuaacugauaga

SEQ ID NO: 43216 - RNA, 20 nt, Artificial Sequence
  Synthetic Oligonucleotide; PDCD1LG2 exon 4; Set C
cugaacccuaacugauagac

SEQ ID NO: 43217 - RNA, 22 nt, Artificial Sequence
  Synthetic Oligonucleotide; PDCD1LG2 exon 4; Set C
ucugaacccuaacugauagacc

SEQ ID NO: 43218 - RNA, 19 nt, Artificial Sequence
  Synthetic Oligonucleotide; PDCD1LG2 exon 4; Set C
cugaacccuaacugauaga

SEQ ID NO: 43219 - RNA, 21 nt, Artificial Sequence
  Synthetic Oligonucleotide; PDCD1LG2 exon 4; Set C
ucugaacccuaacugauagac

SEQ ID NO: 43220 - RNA, 20 nt, Artificial Sequence
  Synthetic Oligonucleotide; PDCD1LG2 exon 4; Set C
ucugaacccuaacugauaga

SEQ ID NO: 43221 - RNA, 27 nt, Artificial Sequence
  Synthetic Oligonucleotide; PDCD1LG2 exon 4; Set B
cuugucugaacccuaacugauagaccu

SEQ ID NO: 43222 - RNA, 28 nt, Artificial Sequence
  Synthetic Oligonucleotide; PDCD1LG2 exon 4; Set B
ucuugucugaacccuaacugauagaccu

SEQ ID NO: 43223 - RNA, 25 nt, Artificial Sequence
  Synthetic Oligonucleotide; PDCD1LG2 exon 4; Set B
cuugucugaacccuaacugauagac

SEQ ID NO: 43224 - RNA, 27 nt, Artificial Sequence
  Synthetic Oligonucleotide; PDCD1LG2 exon 4; Set B
ucuugucugaacccuaacugauagacc

SEQ ID NO: 43225 - RNA, 24 nt, Artificial Sequence
  Synthetic Oligonucleotide; PDCD1LG2 exon 4; Set C
cuugucugaacccuaacugauaga

SEQ ID NO: 43226 - RNA, 26 nt, Artificial Sequence
  Synthetic Oligonucleotide; PDCD1LG2 exon 4; Set B
ucuugucugaacccuaacugauagac

SEQ ID NO: 43227 - RNA, 25 nt, Artificial Sequence
  Synthetic Oligonucleotide; PDCD1LG2 exon 4; Set B
ucuugucugaacccuaacugauaga

SEQ ID NO: 43228 - RNA, 18 nt, Artificial Sequence
  Synthetic Oligonucleotide; PDCD1LG2 exon 4; Set C
uaagacuuuauuuucuga

SEQ ID NO: 43229 - RNA, 21 nt, Artificial Sequence
  Synthetic Oligonucleotide; PDCD1LG2 exon 4; Set C
aauaagacuuuauuuucugau

SEQ ID NO: 43230 - RNA, 19 nt, Artificial Sequence
  Synthetic Oligonucleotide; PDCD1LG2 exon 4; Set C
auaagacuuuauuuucuga

SEQ ID NO: 43231 - RNA, 20 nt, Artificial Sequence
  Synthetic Oligonucleotide; PDCD1LG2 exon 4; Set C
aauaagacuuuauuuucuga

SEQ ID NO: 43232 - RNA, 23 nt, Artificial Sequence
  Synthetic Oligonucleotide; PDCD1LG2 exon 4; Set C
gaaauaagacuuuauuuucugau

SEQ ID NO: 43233 - RNA, 24 nt, Artificial Sequence
  Synthetic Oligonucleotide; PDCD1LG2 exon 4; Set C
agaaauaagacuuuauuuucugau

SEQ ID NO: 43234 - RNA, 22 nt, Artificial Sequence
  Synthetic Oligonucleotide; PDCD1LG2 exon 4; Set C
gaaauaagacuuuauuuucuga

SEQ ID NO: 43235 - RNA, 25 nt, Artificial Sequence
  Synthetic Oligonucleotide; PDCD1LG2 exon 4; Set C
aagaaauaagacuuuauuuucugau

SEQ ID NO: 43236 - RNA, 23 nt, Artificial Sequence
  Synthetic Oligonucleotide; PDCD1LG2 exon 4; Set C
agaaauaagacuuuauuuucuga

SEQ ID NO: 43237 - RNA, 24 nt, Artificial Sequence
  Synthetic Oligonucleotide; PDCD1LG2 exon 4; Set C
aagaaauaagacuuuauuuucuga

SEQ ID NO: 43238 - RNA, 25 nt, Artificial Sequence
  Synthetic Oligonucleotide; PDCD1LG2 exon 4; Set C
aaagaaauaagacuuuauuuucuga

SEQ ID NO: 43239 - RNA, 15 nt, Artificial Sequence
  Synthetic Oligonucleotide; PDCD1LG2 exon 4; Set C
aauaagacuuuauuu

SEQ ID NO: 43240 - RNA, 17 nt, Artificial Sequence
  Synthetic Oligonucleotide; PDCD1LG2 exon 4; Set C
gaaauaagacuuuauuu

SEQ ID NO: 43241 - RNA, 30 nt, Artificial Sequence
  Synthetic Oligonucleotide; PDCD1LG2 exon 4; Set C
agaaaaagaaauaagacuuuauuuucugau

SEQ ID NO: 43242 - RNA, 18 nt, Artificial Sequence
  Synthetic Oligonucleotide; PDCD1LG2 exon 4; Set C
agaaauaagacuuuauuu

SEQ ID NO: 43243 - RNA, 19 nt, Artificial Sequence
  Synthetic Oligonucleotide; PDCD1LG2 exon 4; Set C
aagaaauaagacuuuauuu

SEQ ID NO: 43244 - RNA, 20 nt, Artificial Sequence
  Synthetic Oligonucleotide; PDCD1LG2 exon 4; Set C
aaagaaauaagacuuuauuu

SEQ ID NO: 43245 - RNA, 15 nt, Artificial Sequence
  Synthetic Oligonucleotide; PDCD1LG2 exon 4; Set C
agaaauaagacuuua

SEQ ID NO: 43246 - RNA, 16 nt, Artificial Sequence
  Synthetic Oligonucleotide; PDCD1LG2 exon 4; Set C
aagaaauaagacuuua

SEQ ID NO: 43247 - RNA, 33 nt, Artificial Sequence
  Synthetic Oligonucleotide; PDCD1LG2 exon 4; Set C
gagaagaaaaagaaauaagacuuuauuuucuga

SEQ ID NO: 43248 - RNA, 17 nt, Artificial Sequence
  Synthetic Oligonucleotide; PDCD1LG2 exon 4; Set C
aaagaaauaagacuuua

SEQ ID NO: 43249 - RNA, 15 nt, Artificial Sequence
  Synthetic Oligonucleotide; PDCD1LG2 exon 4; Set C
aagaaauaagacuuu

SEQ ID NO: 43250 - RNA, 34 nt, Artificial Sequence
  Synthetic Oligonucleotide; PDCD1LG2 exon 4; Set C
agagaagaaaaagaaauaagacuuuauuuucuga

SEQ ID NO: 43251 - RNA, 24 nt, Artificial Sequence
  Synthetic Oligonucleotide; PDCD1LG2 exon 4; Set C
agaaaaagaaauaagacuuuauuu

SEQ ID NO: 43252 - RNA, 16 nt, Artificial Sequence
  Synthetic Oligonucleotide; PDCD1LG2 exon 4; Set C
aaagaaauaagacuuu

SEQ ID NO: 43253 - RNA, 15 nt, Artificial Sequence
  Synthetic Oligonucleotide; PDCD1LG2 exon 4; Set C
aaagaaauaagacuu

SEQ ID NO: 43254 - RNA, 24 nt, Artificial Sequence
  Synthetic Oligonucleotide; PDCD1LG2 exon 4; Set C
aagaaaaagaaauaagacuuuauu

SEQ ID NO: 43255 - RNA, 23 nt, Artificial Sequence
  Synthetic Oligonucleotide; PDCD1LG2 exon 4; Set C
aagaaaaagaaauaagacuuuau

SEQ ID NO: 43256 - RNA, 25 nt, Artificial Sequence
  Synthetic Oligonucleotide; PDCD1LG2 exon 4; Set C
gaagaaaaagaaauaagacuuuauu

SEQ ID NO: 43257 - RNA, 21 nt, Artificial Sequence
  Synthetic Oligonucleotide; PDCD1LG2 exon 4; Set C
agaaaaagaaauaagacuuua

SEQ ID NO: 43258 - RNA, 24 nt, Artificial Sequence
  Synthetic Oligonucleotide; PDCD1LG2 exon 4; Set C
gaagaaaaagaaauaagacuuuau

SEQ ID NO: 43259 - RNA, 26 nt, Artificial Sequence
  Synthetic Oligonucleotide; PDCD1LG2 exon 4; Set C
agaagaaaaagaaauaagacuuuauu

SEQ ID NO: 43260 - RNA, 28 nt, Artificial Sequence
  Synthetic Oligonucleotide; PDCD1LG2 exon 4; Set C
gagaagaaaaagaaauaagacuuuauuu

SEQ ID NO: 43261 - RNA, 29 nt, Artificial Sequence
  Synthetic Oligonucleotide; PDCD1LG2 exon 4; Set C
agagaagaaaaagaaauaagacuuuauuu

SEQ ID NO: 43262 - RNA, 25 nt, Artificial Sequence
  Synthetic Oligonucleotide; PDCD1LG2 exon 4; Set C
gagaagaaaaagaaauaagacuuua

SEQ ID NO: 43263 - RNA, 26 nt, Artificial Sequence
  Synthetic Oligonucleotide; PDCD1LG2 exon 4; Set C
agagaagaaaaagaaauaagacuuua

SEQ ID NO: 43264 - RNA, 24 nt, Artificial Sequence
  Synthetic Oligonucleotide; PDCD1LG2 exon 4; Set C
gagaagaaaaagaaauaagacuuu

SEQ ID NO: 43265 - RNA, 21 nt, Artificial Sequence
  Synthetic Oligonucleotide; PDCD1LG2 exon 4; Set C
agaagaaaaagaaauaagacu

SEQ ID NO: 43266 - RNA, 25 nt, Artificial Sequence
  Synthetic Oligonucleotide; PDCD1LG2 exon 4; Set C
agagaagaaaaagaaauaagacuuu

SEQ ID NO: 43267 - RNA, 23 nt, Artificial Sequence
  Synthetic Oligonucleotide; PDCD1LG2 exon 4; Set C
gagaagaaaaagaaauaagacuu

SEQ ID NO: 43268 - RNA, 16 nt, Artificial Sequence
  Synthetic Oligonucleotide; PDCD1LG2 exon 4; Set C
aagaaaaagaaauaag

SEQ ID NO: 43269 - RNA, 18 nt, Artificial Sequence
  Synthetic Oligonucleotide; PDCD1LG2 exon 4; Set C
gaagaaaaagaaauaaga

SEQ ID NO: 43270 - RNA, 20 nt, Artificial Sequence
  Synthetic Oligonucleotide; PDCD1LG2 exon 4; Set C
agaagaaaaagaaauaagac

SEQ ID NO: 43271 - RNA, 24 nt, Artificial Sequence
  Synthetic Oligonucleotide; PDCD1LG2 exon 4; Set C
agagaagaaaaagaaauaagacuu

SEQ ID NO: 43272 - RNA, 17 nt, Artificial Sequence
  Synthetic Oligonucleotide; PDCD1LG2 exon 4; Set C
gaagaaaaagaaauaag

SEQ ID NO: 43273 - RNA, 19 nt, Artificial Sequence
  Synthetic Oligonucleotide; PDCD1LG2 exon 4; Set C
agaagaaaaagaaauaaga

SEQ ID NO: 43274 - RNA, 18 nt, Artificial Sequence
  Synthetic Oligonucleotide; PDCD1LG2 exon 4; Set C
agaagaaaaagaaauaag

SEQ ID NO: 43275 - RNA, 36 nt, Artificial Sequence
  Synthetic Oligonucleotide; PDCD1LG2 exon 4; Set C
ggacaauagagaagaaaaagaaauaagacuuuauuu

SEQ ID NO: 43276 - RNA, 37 nt, Artificial Sequence
  Synthetic Oligonucleotide; PDCD1LG2 exon 4; Set C
uggacaauagagaagaaaaagaaauaagacuuuauuu

SEQ ID NO: 43277 - RNA, 37 nt, Artificial Sequence
  Synthetic Oligonucleotide; PDCD1LG2 exon 4; Set C
cuggacaauagagaagaaaaagaaauaagacuuuauu

SEQ ID NO: 43278 - RNA, 33 nt, Artificial Sequence
  Synthetic Oligonucleotide; PDCD1LG2 exon 4; Set C
ggacaauagagaagaaaaagaaauaagacuuua

SEQ ID NO: 43279 - RNA, 36 nt, Artificial Sequence
  Synthetic Oligonucleotide; PDCD1LG2 exon 4; Set C
cuggacaauagagaagaaaaagaaauaagacuuuau

SEQ ID NO: 43280 - RNA, 38 nt, Artificial Sequence
  Synthetic Oligonucleotide; PDCD1LG2 exon 4; Set C
gcuggacaauagagaagaaaaagaaauaagacuuuauu

SEQ ID NO: 43281 - RNA, 16 nt, Artificial Sequence
  Synthetic Oligonucleotide; PDCD1LG2 exon 4; Set C
gagaagaaaaagaaau

SEQ ID NO: 43282 - RNA, 34 nt, Artificial Sequence
  Synthetic Oligonucleotide; PDCD1LG2 exon 4; Set C
uggacaauagagaagaaaaagaaauaagacuuua

SEQ ID NO: 43283 - RNA, 32 nt, Artificial Sequence
  Synthetic Oligonucleotide; PDCD1LG2 exon 4; Set C
ggacaauagagaagaaaaagaaauaagacuuu

SEQ ID NO: 43284 - RNA, 37 nt, Artificial Sequence
  Synthetic Oligonucleotide; PDCD1LG2 exon 4; Set C
gcuggacaauagagaagaaaaagaaauaagacuuuau

SEQ ID NO: 43285 - RNA, 39 nt, Artificial Sequence
  Synthetic Oligonucleotide; PDCD1LG2 exon 4; Set C
agcuggacaauagagaagaaaaagaaauaagacuuuauu

SEQ ID NO: 43286 - RNA, 17 nt, Artificial Sequence
  Synthetic Oligonucleotide; PDCD1LG2 exon 4; Set C
agagaagaaaaagaaau

SEQ ID NO: 43287 - RNA, 33 nt, Artificial Sequence
  Synthetic Oligonucleotide; PDCD1LG2 exon 4; Set C
uggacaauagagaagaaaaagaaauaagacuuu

SEQ ID NO: 43288 - RNA, 31 nt, Artificial Sequence
  Synthetic Oligonucleotide; PDCD1LG2 exon 4; Set C
ggacaauagagaagaaaaagaaauaagacuu

SEQ ID NO: 43289 - RNA, 38 nt, Artificial Sequence
  Synthetic Oligonucleotide; PDCD1LG2 exon 4; Set C
agcuggacaauagagaagaaaaagaaauaagacuuuau

SEQ ID NO: 43290 - RNA, 40 nt, Artificial Sequence
  Synthetic Oligonucleotide; PDCD1LG2 exon 4; Set C
aagcuggacaauagagaagaaaaagaaauaagacuuuauu

SEQ ID NO: 43291 - RNA, 32 nt, Artificial Sequence
  Synthetic Oligonucleotide; PDCD1LG2 exon 4; Set C
uggacaauagagaagaaaaagaaauaagacuu

SEQ ID NO: 43292 - RNA, 39 nt, Artificial Sequence
  Synthetic Oligonucleotide; PDCD1LG2 exon 4; Set C
aagcuggacaauagagaagaaaaagaaauaagacuuuau

SEQ ID NO: 43293 - RNA, 15 nt, Artificial Sequence
  Synthetic Oligonucleotide; PDCD1LG2 exon 4; Set C
agagaagaaaaagaa

SEQ ID NO: 43294 - RNA, 40 nt, Artificial Sequence
  Synthetic Oligonucleotide; PDCD1LG2 exon 4; Set C
gaagcuggacaauagagaagaaaaagaaauaagacuuuau

SEQ ID NO: 43295 - RNA, 30 nt, Artificial Sequence
  Synthetic Oligonucleotide; PDCD1LG2 exon 4; Set C
cuggacaauagagaagaaaaagaaauaaga

SEQ ID NO: 43296 - RNA, 29 nt, Artificial Sequence
  Synthetic Oligonucleotide; PDCD1LG2 exon 4; Set C
cuggacaauagagaagaaaaagaaauaag

SEQ ID NO: 43297 - RNA, 35 nt, Artificial Sequence
  Synthetic Oligonucleotide; PDCD1LG2 exon 4; Set C
aagcuggacaauagagaagaaaaagaaauaagacu

SEQ ID NO: 43298 - RNA, 30 nt, Artificial Sequence
  Synthetic Oligonucleotide; PDCD1LG2 exon 4; Set C
gcuggacaauagagaagaaaaagaaauaag

SEQ ID NO: 43299 - RNA, 32 nt, Artificial Sequence
  Synthetic Oligonucleotide; PDCD1LG2 exon 4; Set C
agcuggacaauagagaagaaaaagaaauaaga

SEQ ID NO: 43300 - RNA, 36 nt, Artificial Sequence
  Synthetic Oligonucleotide; PDCD1LG2 exon 4; Set C
gaagcuggacaauagagaagaaaaagaaauaagacu

SEQ ID NO: 43301 - RNA, 34 nt, Artificial Sequence
  Synthetic Oligonucleotide; PDCD1LG2 exon 4; Set C
aagcuggacaauagagaagaaaaagaaauaagac

SEQ ID NO: 43302 - RNA, 24 nt, Artificial Sequence
  Synthetic Oligonucleotide; PDCD1LG2 exon 4; Set C
ggacaauagagaagaaaaagaaau

SEQ ID NO: 43303 - RNA, 31 nt, Artificial Sequence
  Synthetic Oligonucleotide; PDCD1LG2 exon 4; Set C
agcuggacaauagagaagaaaaagaaauaag

SEQ ID NO: 43304 - RNA, 33 nt, Artificial Sequence
  Synthetic Oligonucleotide; PDCD1LG2 exon 4; Set C
aagcuggacaauagagaagaaaaagaaauaaga

SEQ ID NO: 43305 - RNA, 37 nt, Artificial Sequence
  Synthetic Oligonucleotide; PDCD1LG2 exon 4; Set A
ggaagcuggacaauagagaagaaaaagaaauaagacu

SEQ ID NO: 43306 - RNA, 35 nt, Artificial Sequence
  Synthetic Oligonucleotide; PDCD1LG2 exon 4; Set C
gaagcuggacaauagagaagaaaaagaaauaagac

SEQ ID NO: 43307 - RNA, 25 nt, Artificial Sequence
  Synthetic Oligonucleotide; PDCD1LG2 exon 4; Set C
uggacaauagagaagaaaaagaaau

SEQ ID NO: 43308 - RNA, 32 nt, Artificial Sequence
  Synthetic Oligonucleotide; PDCD1LG2 exon 4; Set C
aagcuggacaauagagaagaaaaagaaauaag

SEQ ID NO: 43309 - RNA, 34 nt, Artificial Sequence
  Synthetic Oligonucleotide; PDCD1LG2 exon 4; Set C
gaagcuggacaauagagaagaaaaagaaauaaga

SEQ ID NO: 43310 - RNA, 36 nt, Artificial Sequence
  Synthetic Oligonucleotide; PDCD1LG2 exon 4; Set C
ggaagcuggacaauagagaagaaaaagaaauaagac

SEQ ID NO: 43311 - RNA, 22 nt, Artificial Sequence
  Synthetic Oligonucleotide; PDCD1LG2 exon 4; Set C
ggacaauagagaagaaaaagaa

SEQ ID NO: 43312 - RNA, 25 nt, Artificial Sequence
  Synthetic Oligonucleotide; PDCD1LG2 exon 4; Set C
cuggacaauagagaagaaaaagaaa

SEQ ID NO: 43313 - RNA, 33 nt, Artificial Sequence
  Synthetic Oligonucleotide; PDCD1LG2 exon 4; Set C
gaagcuggacaauagagaagaaaaagaaauaag

SEQ ID NO: 43314 - RNA, 35 nt, Artificial Sequence
  Synthetic Oligonucleotide; PDCD1LG2 exon 4; Set C
ggaagcuggacaauagagaagaaaaagaaauaaga

SEQ ID NO: 43315 - RNA, 23 nt, Artificial Sequence
  Synthetic Oligonucleotide; PDCD1LG2 exon 4; Set C
uggacaauagagaagaaaaagaa

SEQ ID NO: 43316 - RNA, 21 nt, Artificial Sequence
  Synthetic Oligonucleotide; PDCD1LG2 exon 4; Set C
ggacaauagagaagaaaaaga

SEQ ID NO: 43317 - RNA, 26 nt, Artificial Sequence
  Synthetic Oligonucleotide; PDCD1LG2 exon 4; Set C
gcuggacaauagagaagaaaaagaaa

SEQ ID NO: 43318 - RNA, 34 nt, Artificial Sequence
  Synthetic Oligonucleotide; PDCD1LG2 exon 4; Set C
ggaagcuggacaauagagaagaaaaagaaauaag

SEQ ID NO: 43319 - RNA, 40 nt, Artificial Sequence
  Synthetic Oligonucleotide; PDCD1LG2 exon 4; Set A
guaggaagcuggacaauagagaagaaaaagaaauaagacu

SEQ ID NO: 43320 - RNA, 20 nt, Artificial Sequence
  Synthetic Oligonucleotide; PDCD1LG2 exon 4; Set C
ggacaauagagaagaaaaag

SEQ ID NO: 43321 - RNA, 22 nt, Artificial Sequence
  Synthetic Oligonucleotide; PDCD1LG2 exon 4; Set C
uggacaauagagaagaaaaaga

SEQ ID NO: 43322 - RNA, 27 nt, Artificial Sequence
  Synthetic Oligonucleotide; PDCD1LG2 exon 4; Set C
agcuggacaauagagaagaaaaagaaa

SEQ ID NO: 43323 - RNA, 39 nt, Artificial Sequence
  Synthetic Oligonucleotide; PDCD1LG2 exon 4; Set A
guaggaagcuggacaauagagaagaaaaagaaauaagac

SEQ ID NO: 43324 - RNA, 19 nt, Artificial Sequence
  Synthetic Oligonucleotide; PDCD1LG2 exon 4; Set C
ggacaauagagaagaaaaa

SEQ ID NO: 43325 - RNA, 21 nt, Artificial Sequence
  Synthetic Oligonucleotide; PDCD1LG2 exon 4; Set C
uggacaauagagaagaaaaag

SEQ ID NO: 43326 - RNA, 28 nt, Artificial Sequence
  Synthetic Oligonucleotide; PDCD1LG2 exon 4; Set C
aagcuggacaauagagaagaaaaagaaa

SEQ ID NO: 43327 - RNA, 38 nt, Artificial Sequence
  Synthetic Oligonucleotide; PDCD1LG2 exon 4; Set A
guaggaagcuggacaauagagaagaaaaagaaauaaga

SEQ ID NO: 43328 - RNA, 40 nt, Artificial Sequence
  Synthetic Oligonucleotide; PDCD1LG2 exon 4; Set A
uguaggaagcuggacaauagagaagaaaaagaaauaagac

SEQ ID NO: 43329 - RNA, 29 nt, Artificial Sequence
  Synthetic Oligonucleotide; PDCD1LG2 exon 4; Set C
gaagcuggacaauagagaagaaaaagaaa

SEQ ID NO: 43330 - RNA, 39 nt, Artificial Sequence
  Synthetic Oligonucleotide; PDCD1LG2 exon 4; Set A
uguaggaagcuggacaauagagaagaaaaagaaauaaga

SEQ ID NO: 43331 - RNA, 20 nt, Artificial Sequence
  Synthetic Oligonucleotide; PDCD1LG2 exon 4; Set C
cuggacaauagagaagaaaa

SEQ ID NO: 43332 - RNA, 30 nt, Artificial Sequence
  Synthetic Oligonucleotide; PDCD1LG2 exon 4; Set C
ggaagcuggacaauagagaagaaaaagaaa

SEQ ID NO: 43333 - RNA, 38 nt, Artificial Sequence
  Synthetic Oligonucleotide; PDCD1LG2 exon 4; Set C
uguaggaagcuggacaauagagaagaaaaagaaauaag

SEQ ID NO: 43334 - RNA, 36 nt, Artificial Sequence
  Synthetic Oligonucleotide; PDCD1LG2 exon 4; Set C
guaggaagcuggacaauagagaagaaaaagaaauaa

SEQ ID NO: 43335 - RNA, 21 nt, Artificial Sequence
  Synthetic Oligonucleotide; PDCD1LG2 exon 4; Set C
gcuggacaauagagaagaaaa

SEQ ID NO: 43336 - RNA, 19 nt, Artificial Sequence
  Synthetic Oligonucleotide; PDCD1LG2 exon 4; Set C
cuggacaauagagaagaaa

SEQ ID NO: 43337 - RNA, 35 nt, Artificial Sequence
  Synthetic Oligonucleotide; PDCD1LG2 exon 4; Set C
guaggaagcuggacaauagagaagaaaaagaaaua

SEQ ID NO: 43338 - RNA, 15 nt, Artificial Sequence
  Synthetic Oligonucleotide; PDCD1LG2 exon 4; Set C
ggacaauagagaaga

SEQ ID NO: 43339 - RNA, 22 nt, Artificial Sequence
  Synthetic Oligonucleotide; PDCD1LG2 exon 4; Set C
agcuggacaauagagaagaaaa

SEQ ID NO: 43340 - RNA, 20 nt, Artificial Sequence
  Synthetic Oligonucleotide; PDCD1LG2 exon 4; Set C
gcuggacaauagagaagaaa

SEQ ID NO: 43341 - RNA, 18 nt, Artificial Sequence
  Synthetic Oligonucleotide; PDCD1LG2 exon 4; Set C
cuggacaauagagaagaa

SEQ ID NO: 43342 - RNA, 16 nt, Artificial Sequence
  Synthetic Oligonucleotide; PDCD1LG2 exon 4; Set C
uggacaauagagaaga

SEQ ID NO: 43343 - RNA, 23 nt, Artificial Sequence
  Synthetic Oligonucleotide; PDCD1LG2 exon 4; Set C
aagcuggacaauagagaagaaaa

SEQ ID NO: 43344 - RNA, 21 nt, Artificial Sequence
  Synthetic Oligonucleotide; PDCD1LG2 exon 4; Set C
agcuggacaauagagaagaaa

SEQ ID NO: 43345 - RNA, 19 nt, Artificial Sequence
  Synthetic Oligonucleotide; PDCD1LG2 exon 4; Set C
gcuggacaauagagaagaa

SEQ ID NO: 43346 - RNA, 24 nt, Artificial Sequence
  Synthetic Oligonucleotide; PDCD1LG2 exon 4; Set C
gaagcuggacaauagagaagaaaa

SEQ ID NO: 43347 - RNA, 22 nt, Artificial Sequence
  Synthetic Oligonucleotide; PDCD1LG2 exon 4; Set C
aagcuggacaauagagaagaaa

SEQ ID NO: 43348 - RNA, 20 nt, Artificial Sequence
  Synthetic Oligonucleotide; PDCD1LG2 exon 4; Set C
agcuggacaauagagaagaa

SEQ ID NO: 43349 - RNA, 34 nt, Artificial Sequence
  Synthetic Oligonucleotide; PDCD1LG2 exon 4; Set C
uguaggaagcuggacaauagagaagaaaaagaaa

SEQ ID NO: 43350 - RNA, 25 nt, Artificial Sequence
  Synthetic Oligonucleotide; PDCD1LG2 exon 4; Set C
ggaagcuggacaauagagaagaaaa

SEQ ID NO: 43351 - RNA, 23 nt, Artificial Sequence
  Synthetic Oligonucleotide; PDCD1LG2 exon 4; Set C
gaagcuggacaauagagaagaaa

SEQ ID NO: 43352 - RNA, 21 nt, Artificial Sequence
  Synthetic Oligonucleotide; PDCD1LG2 exon 4; Set C
aagcuggacaauagagaagaa

SEQ ID NO: 43353 - RNA, 24 nt, Artificial Sequence
  Synthetic Oligonucleotide; PDCD1LG2 exon 4; Set C
ggaagcuggacaauagagaagaaa

SEQ ID NO: 43354 - RNA, 22 nt, Artificial Sequence
  Synthetic Oligonucleotide; PDCD1LG2 exon 4; Set C
gaagcuggacaauagagaagaa

SEQ ID NO: 43355 - RNA, 40 nt, Artificial Sequence
  Synthetic Oligonucleotide; PDCD1LG2 exon 4; Set A
uuccuguaggaagcuggacaauagagaagaaaaagaaaua

SEQ ID NO: 43356 - RNA, 27 nt, Artificial Sequence
  Synthetic Oligonucleotide; PDCD1LG2 exon 4; Set C
uaggaagcuggacaauagagaagaaaa

SEQ ID NO: 43357 - RNA, 23 nt, Artificial Sequence
  Synthetic Oligonucleotide; PDCD1LG2 exon 4; Set C
ggaagcuggacaauagagaagaa

SEQ ID NO: 43358 - RNA, 39 nt, Artificial Sequence
  Synthetic Oligonucleotide; PDCD1LG2 exon 4; Set A
uuccuguaggaagcuggacaauagagaagaaaaagaaau

SEQ ID NO: 43359 - RNA, 26 nt, Artificial Sequence
  Synthetic Oligonucleotide; PDCD1LG2 exon 4; Set C
uaggaagcuggacaauagagaagaaa

SEQ ID NO: 43360 - RNA, 40 nt, Artificial Sequence
  Synthetic Oligonucleotide; PDCD1LG2 exon 4; Set A
uuuccuguaggaagcuggacaauagagaagaaaaagaaau

SEQ ID NO: 43361 - RNA, 29 nt, Artificial Sequence
  Synthetic Oligonucleotide; PDCD1LG2 exon 4; Set C
uguaggaagcuggacaauagagaagaaaa

SEQ ID NO: 43362 - RNA, 25 nt, Artificial Sequence
  Synthetic Oligonucleotide; PDCD1LG2 exon 4; Set C
uaggaagcuggacaauagagaagaa

SEQ ID NO: 43363 - RNA, 28 nt, Artificial Sequence
  Synthetic Oligonucleotide; PDCD1LG2 exon 4; Set C
uguaggaagcuggacaauagagaagaaa

SEQ ID NO: 43364 - RNA, 27 nt, Artificial Sequence
  Synthetic Oligonucleotide; PDCD1LG2 exon 4; Set C
uguaggaagcuggacaauagagaagaa

SEQ ID NO: 43365 - RNA, 35 nt, Artificial Sequence
  Synthetic Oligonucleotide; PDCD1LG2 exon 4; Set A
uuccuguaggaagcuggacaauagagaagaaaaag

SEQ ID NO: 43366 - RNA, 39 nt, Artificial Sequence
  Synthetic Oligonucleotide; PDCD1LG2 exon 4; Set A
uuuuccuguaggaagcuggacaauagagaagaaaaagaa

SEQ ID NO: 43367 - RNA, 34 nt, Artificial Sequence
  Synthetic Oligonucleotide; PDCD1LG2 exon 4; Set A
uuccuguaggaagcuggacaauagagaagaaaaa

SEQ ID NO: 43368 - RNA, 36 nt, Artificial Sequence
  Synthetic Oligonucleotide; PDCD1LG2 exon 4; Set A
uuuccuguaggaagcuggacaauagagaagaaaaag

SEQ ID NO: 43369 - RNA, 38 nt, Artificial Sequence
  Synthetic Oligonucleotide; PDCD1LG2 exon 4; Set A
uuuuccuguaggaagcuggacaauagagaagaaaaaga

SEQ ID NO: 43370 - RNA, 40 nt, Artificial Sequence
  Synthetic Oligonucleotide; PDCD1LG2 exon 4; Set A
auuuuccuguaggaagcuggacaauagagaagaaaaagaa

SEQ ID NO: 43371 - RNA, 15 nt, Artificial Sequence
  Synthetic Oligonucleotide; PDCD1LG2 exon 4; Set C
gaagcuggacaauag

SEQ ID NO: 43372 - RNA, 35 nt, Artificial Sequence
  Synthetic Oligonucleotide; PDCD1LG2 exon 4; Set A
uuuccuguaggaagcuggacaauagagaagaaaaa

SEQ ID NO: 43373 - RNA, 39 nt, Artificial Sequence
  Synthetic Oligonucleotide; PDCD1LG2 exon 4; Set A
auuuuccuguaggaagcuggacaauagagaagaaaaaga

SEQ ID NO: 43374 - RNA, 16 nt, Artificial Sequence
  Synthetic Oligonucleotide; PDCD1LG2 exon 4; Set C
ggaagcuggacaauag

SEQ ID NO: 43375 - RNA, 38 nt, Artificial Sequence
  Synthetic Oligonucleotide; PDCD1LG2 exon 4; Set A
auuuuccuguaggaagcuggacaauagagaagaaaaag

SEQ ID NO: 43376 - RNA, 40 nt, Artificial Sequence
  Synthetic Oligonucleotide; PDCD1LG2 exon 4; Set A
uauuuuccuguaggaagcuggacaauagagaagaaaaaga

SEQ ID NO: 43377 - RNA, 15 nt, Artificial Sequence
  Synthetic Oligonucleotide; PDCD1LG2 exon 4; Set C
ggaagcuggacaaua

SEQ ID NO: 43378 - RNA, 39 nt, Artificial Sequence
  Synthetic Oligonucleotide; PDCD1LG2 exon 4; Set A
uauuuuccuguaggaagcuggacaauagagaagaaaaag

SEQ ID NO: 43379 - RNA, 18 nt, Artificial Sequence
  Synthetic Oligonucleotide; PDCD1LG2 exon 4; Set C
uaggaagcuggacaauag

SEQ ID NO: 43380 - RNA, 40 nt, Artificial Sequence
  Synthetic Oligonucleotide; PDCD1LG2 exon 4; Set A
uuauuuuccuguaggaagcuggacaauagagaagaaaaag

SEQ ID NO: 43381 - RNA, 17 nt, Artificial Sequence
  Synthetic Oligonucleotide; PDCD1LG2 exon 4; Set C
uaggaagcuggacaaua

SEQ ID NO: 43382 - RNA, 16 nt, Artificial Sequence
  Synthetic Oligonucleotide; PDCD1LG2 exon 4; Set C
uaggaagcuggacaau

SEQ ID NO: 43383 - RNA, 20 nt, Artificial Sequence
  Synthetic Oligonucleotide; PDCD1LG2 exon 4; Set C
uguaggaagcuggacaauag

SEQ ID NO: 43384 - RNA, 40 nt, Artificial Sequence
  Synthetic Oligonucleotide; PDCD1LG2 exon 4; Set A
uuuauuuuccuguaggaagcuggacaauagagaagaaaaa

SEQ ID NO: 43385 - RNA, 32 nt, Artificial Sequence
  Synthetic Oligonucleotide; PDCD1LG2 exon 4; Set A
uuuuccuguaggaagcuggacaauagagaaga

SEQ ID NO: 43386 - RNA, 19 nt, Artificial Sequence
  Synthetic Oligonucleotide; PDCD1LG2 exon 4; Set C
uguaggaagcuggacaaua

SEQ ID NO: 43387 - RNA, 33 nt, Artificial Sequence
  Synthetic Oligonucleotide; PDCD1LG2 exon 4; Set A
auuuuccuguaggaagcuggacaauagagaaga

SEQ ID NO: 43388 - RNA, 18 nt, Artificial Sequence
  Synthetic Oligonucleotide; PDCD1LG2 exon 4; Set C
uguaggaagcuggacaau

SEQ ID NO: 43389 - RNA, 34 nt, Artificial Sequence
  Synthetic Oligonucleotide; PDCD1LG2 exon 4; Set A
uauuuuccuguaggaagcuggacaauagagaaga

SEQ ID NO: 43390 - RNA, 17 nt, Artificial Sequence
  Synthetic Oligonucleotide; PDCD1LG2 exon 4; Set C
uguaggaagcuggacaa

SEQ ID NO: 43391 - RNA, 25 nt, Artificial Sequence
  Synthetic Oligonucleotide; PDCD1LG2 exon 4; Set A
uuccuguaggaagcuggacaauaga

SEQ ID NO: 43392 - RNA, 35 nt, Artificial Sequence
  Synthetic Oligonucleotide; PDCD1LG2 exon 4; Set A
uuauuuuccuguaggaagcuggacaauagagaaga

SEQ ID NO: 43393 - RNA, 16 nt, Artificial Sequence
  Synthetic Oligonucleotide; PDCD1LG2 exon 4; Set C
uguaggaagcuggaca

SEQ ID NO: 43394 - RNA, 26 nt, Artificial Sequence
  Synthetic Oligonucleotide; PDCD1LG2 exon 4; Set A
uuuccuguaggaagcuggacaauaga

SEQ ID NO: 43395 - RNA, 28 nt, Artificial Sequence
  Synthetic Oligonucleotide; PDCD1LG2 exon 4; Set A
uuuuccuguaggaagcuggacaauagag

SEQ ID NO: 43396 - RNA, 15 nt, Artificial Sequence
  Synthetic Oligonucleotide; PDCD1LG2 exon 4; Set C
uguaggaagcuggac

SEQ ID NO: 43397 - RNA, 29 nt, Artificial Sequence
  Synthetic Oligonucleotide; PDCD1LG2 exon 4; Set A
auuuuccuguaggaagcuggacaauagag

SEQ ID NO: 43398 - RNA, 28 nt, Artificial Sequence
  Synthetic Oligonucleotide; PDCD1LG2 exon 4; Set A
auuuuccuguaggaagcuggacaauaga

SEQ ID NO: 43399 - RNA, 30 nt, Artificial Sequence
  Synthetic Oligonucleotide; PDCD1LG2 exon 4; Set A
uauuuuccuguaggaagcuggacaauagag

SEQ ID NO: 43400 - RNA, 38 nt, Artificial Sequence
  Synthetic Oligonucleotide; PDCD1LG2 exon 4; Set A
uguuuauuuuccuguaggaagcuggacaauagagaaga

SEQ ID NO: 43401 - RNA, 29 nt, Artificial Sequence
  Synthetic Oligonucleotide; PDCD1LG2 exon 4; Set A
uauuuuccuguaggaagcuggacaauaga

SEQ ID NO: 43402 - RNA, 31 nt, Artificial Sequence
  Synthetic Oligonucleotide; PDCD1LG2 exon 4; Set A
uuauuuuccuguaggaagcuggacaauagag

SEQ ID NO: 43403 - RNA, 30 nt, Artificial Sequence
  Synthetic Oligonucleotide; PDCD1LG2 exon 4; Set A
uuauuuuccuguaggaagcuggacaauaga

SEQ ID NO: 43404 - RNA, 32 nt, Artificial Sequence
  Synthetic Oligonucleotide; PDCD1LG2 exon 4; Set A
uuuauuuuccuguaggaagcuggacaauagag

SEQ ID NO: 43405 - RNA, 38 nt, Artificial Sequence
  Synthetic Oligonucleotide; PDCD1LG2 exon 4; Set A
guguuuauuuuccuguaggaagcuggacaauagagaag

SEQ ID NO: 43406 - RNA, 31 nt, Artificial Sequence
  Synthetic Oligonucleotide; PDCD1LG2 exon 4; Set A
uuuauuuuccuguaggaagcuggacaauaga

SEQ ID NO: 43407 - RNA, 33 nt, Artificial Sequence
  Synthetic Oligonucleotide; PDCD1LG2 exon 4; Set A
guuuauuuuccuguaggaagcuggacaauagag

SEQ ID NO: 43408 - RNA, 37 nt, Artificial Sequence
  Synthetic Oligonucleotide; PDCD1LG2 exon 4; Set A
guguuuauuuuccuguaggaagcuggacaauagagaa

SEQ ID NO: 43409 - RNA, 39 nt, Artificial Sequence
  Synthetic Oligonucleotide; PDCD1LG2 exon 4; Set A
aguguuuauuuuccuguaggaagcuggacaauagagaag

SEQ ID NO: 43410 - RNA, 32 nt, Artificial Sequence
  Synthetic Oligonucleotide; PDCD1LG2 exon 4; Set A
guuuauuuuccuguaggaagcuggacaauaga

SEQ ID NO: 43411 - RNA, 34 nt, Artificial Sequence
  Synthetic Oligonucleotide; PDCD1LG2 exon 4; Set A
uguuuauuuuccuguaggaagcuggacaauagag

SEQ ID NO: 43412 - RNA, 36 nt, Artificial Sequence
  Synthetic Oligonucleotide; PDCD1LG2 exon 4; Set A
guguuuauuuuccuguaggaagcuggacaauagaga

SEQ ID NO: 43413 - RNA, 38 nt, Artificial Sequence
  Synthetic Oligonucleotide; PDCD1LG2 exon 4; Set A
aguguuuauuuuccuguaggaagcuggacaauagagaa

SEQ ID NO: 43414 - RNA, 33 nt, Artificial Sequence
  Synthetic Oligonucleotide; PDCD1LG2 exon 4; Set A
uguuuauuuuccuguaggaagcuggacaauaga

SEQ ID NO: 43415 - RNA, 37 nt, Artificial Sequence
  Synthetic Oligonucleotide; PDCD1LG2 exon 4; Set A
aguguuuauuuuccuguaggaagcuggacaauagaga

SEQ ID NO: 43416 - RNA, 20 nt, Artificial Sequence
  Synthetic Oligonucleotide; PDCD1LG2 exon 4; Set C
uuuuccuguaggaagcugga

SEQ ID NO: 43417 - RNA, 19 nt, Artificial Sequence
  Synthetic Oligonucleotide; PDCD1LG2 exon 4; Set C
uuuuccuguaggaagcugg

SEQ ID NO: 43418 - RNA, 37 nt, Artificial Sequence
  Synthetic Oligonucleotide; PDCD1LG2 exon 4; Set A
gaguguuuauuuuccuguaggaagcuggacaauagag

SEQ ID NO: 43419 - RNA, 21 nt, Artificial Sequence
  Synthetic Oligonucleotide; PDCD1LG2 exon 4; Set C
auuuuccuguaggaagcugga

SEQ ID NO: 43420 - RNA, 20 nt, Artificial Sequence
  Synthetic Oligonucleotide; PDCD1LG2 exon 4; Set C
auuuuccuguaggaagcugg

SEQ ID NO: 43421 - RNA, 38 nt, Artificial Sequence
  Synthetic Oligonucleotide; PDCD1LG2 exon 4; Set A
ugaguguuuauuuuccuguaggaagcuggacaauagag

SEQ ID NO: 43422 - RNA, 22 nt, Artificial Sequence
  Synthetic Oligonucleotide; PDCD1LG2 exon 4; Set C
uauuuuccuguaggaagcugga

SEQ ID NO: 43423 - RNA, 21 nt, Artificial Sequence
  Synthetic Oligonucleotide; PDCD1LG2 exon 4; Set C
uauuuuccuguaggaagcugg

SEQ ID NO: 43424 - RNA, 39 nt, Artificial Sequence
  Synthetic Oligonucleotide; PDCD1LG2 exon 4; Set C
gugaguguuuauuuuccuguaggaagcuggacaauagag

SEQ ID NO: 43425 - RNA, 23 nt, Artificial Sequence
  Synthetic Oligonucleotide; PDCD1LG2 exon 4; Set C
uuauuuuccuguaggaagcugga

SEQ ID NO: 43426 - RNA, 22 nt, Artificial Sequence
  Synthetic Oligonucleotide; PDCD1LG2 exon 4; Set C
uuauuuuccuguaggaagcugg

SEQ ID NO: 43427 - RNA, 24 nt, Artificial Sequence
  Synthetic Oligonucleotide; PDCD1LG2 exon 4; Set C
uuuauuuuccuguaggaagcugga

SEQ ID NO: 43428 - RNA, 23 nt, Artificial Sequence
  Synthetic Oligonucleotide; PDCD1LG2 exon 4; Set C
uuuauuuuccuguaggaagcugg

SEQ ID NO: 43429 - RNA, 25 nt, Artificial Sequence
  Synthetic Oligonucleotide; PDCD1LG2 exon 4; Set A
guuuauuuuccuguaggaagcugga

SEQ ID NO: 43430 - RNA, 40 nt, Artificial Sequence
  Synthetic Oligonucleotide; PDCD1LG2 exon 4; Set C
augugaguguuuauuuuccuguaggaagcuggacaauaga

SEQ ID NO: 43431 - RNA, 24 nt, Artificial Sequence
  Synthetic Oligonucleotide; PDCD1LG2 exon 4; Set C
guuuauuuuccuguaggaagcugg

SEQ ID NO: 43432 - RNA, 26 nt, Artificial Sequence
  Synthetic Oligonucleotide; PDCD1LG2 exon 4; Set A
uguuuauuuuccuguaggaagcugga

SEQ ID NO: 43433 - RNA, 25 nt, Artificial Sequence
  Synthetic Oligonucleotide; PDCD1LG2 exon 4; Set C
uguuuauuuuccuguaggaagcugg

SEQ ID NO: 43434 - RNA, 29 nt, Artificial Sequence
  Synthetic Oligonucleotide; PDCD1LG2 exon 4; Set A
gaguguuuauuuuccuguaggaagcugga

SEQ ID NO: 43435 - RNA, 25 nt, Artificial Sequence
  Synthetic Oligonucleotide; PDCD1LG2 exon 4; Set C
guguuuauuuuccuguaggaagcug

SEQ ID NO: 43436 - RNA, 28 nt, Artificial Sequence
  Synthetic Oligonucleotide; PDCD1LG2 exon 4; Set A
gaguguuuauuuuccuguaggaagcugg

SEQ ID NO: 43437 - RNA, 30 nt, Artificial Sequence
  Synthetic Oligonucleotide; PDCD1LG2 exon 4; Set A
ugaguguuuauuuuccuguaggaagcugga

SEQ ID NO: 43438 - RNA, 24 nt, Artificial Sequence
  Synthetic Oligonucleotide; PDCD1LG2 exon 4; Set C
guguuuauuuuccuguaggaagcu

SEQ ID NO: 43439 - RNA, 26 nt, Artificial Sequence
  Synthetic Oligonucleotide; PDCD1LG2 exon 4; Set C
aguguuuauuuuccuguaggaagcug

SEQ ID NO: 43440 - RNA, 29 nt, Artificial Sequence
  Synthetic Oligonucleotide; PDCD1LG2 exon 4; Set A
ugaguguuuauuuuccuguaggaagcugg

SEQ ID NO: 43441 - RNA, 31 nt, Artificial Sequence
  Synthetic Oligonucleotide; PDCD1LG2 exon 4; Set A
gugaguguuuauuuuccuguaggaagcugga

SEQ ID NO: 43442 - RNA, 23 nt, Artificial Sequence
  Synthetic Oligonucleotide; PDCD1LG2 exon 4; Set C
guguuuauuuuccuguaggaagc

SEQ ID NO: 43443 - RNA, 25 nt, Artificial Sequence
  Synthetic Oligonucleotide; PDCD1LG2 exon 4; Set C
aguguuuauuuuccuguaggaagcu

SEQ ID NO: 43444 - RNA, 30 nt, Artificial Sequence
  Synthetic Oligonucleotide; PDCD1LG2 exon 4; Set A
gugaguguuuauuuuccuguaggaagcugg

SEQ ID NO: 43445 - RNA, 32 nt, Artificial Sequence
  Synthetic Oligonucleotide; PDCD1LG2 exon 4; Set A
ugugaguguuuauuuuccuguaggaagcugga

SEQ ID NO: 43446 - RNA, 22 nt, Artificial Sequence
  Synthetic Oligonucleotide; PDCD1LG2 exon 4; Set C
guguuuauuuuccuguaggaag

SEQ ID NO: 43447 - RNA, 24 nt, Artificial Sequence
  Synthetic Oligonucleotide; PDCD1LG2 exon 4; Set C
aguguuuauuuuccuguaggaagc

SEQ ID NO: 43448 - RNA, 31 nt, Artificial Sequence
  Synthetic Oligonucleotide; PDCD1LG2 exon 4; Set A
ugugaguguuuauuuuccuguaggaagcugg

SEQ ID NO: 43449 - RNA, 33 nt, Artificial Sequence
  Synthetic Oligonucleotide; PDCD1LG2 exon 4; Set A
augugaguguuuauuuuccuguaggaagcugga

SEQ ID NO: 43450 - RNA, 21 nt, Artificial Sequence
  Synthetic Oligonucleotide; PDCD1LG2 exon 4; Set C
guguuuauuuuccuguaggaa

SEQ ID NO: 43451 - RNA, 23 nt, Artificial Sequence
  Synthetic Oligonucleotide; PDCD1LG2 exon 4; Set C
aguguuuauuuuccuguaggaag

SEQ ID NO: 43452 - RNA, 32 nt, Artificial Sequence
  Synthetic Oligonucleotide; PDCD1LG2 exon 4; Set A
augugaguguuuauuuuccuguaggaagcugg

SEQ ID NO: 43453 - RNA, 34 nt, Artificial Sequence
  Synthetic Oligonucleotide; PDCD1LG2 exon 4; Set C
gaugugaguguuuauuuuccuguaggaagcugga

SEQ ID NO: 43454 - RNA, 20 nt, Artificial Sequence
  Synthetic Oligonucleotide; PDCD1LG2 exon 4; Set C
guguuuauuuuccuguagga

SEQ ID NO: 43455 - RNA, 22 nt, Artificial Sequence
  Synthetic Oligonucleotide; PDCD1LG2 exon 4; Set C
aguguuuauuuuccuguaggaa

SEQ ID NO: 43456 - RNA, 33 nt, Artificial Sequence
  Synthetic Oligonucleotide; PDCD1LG2 exon 4; Set A
gaugugaguguuuauuuuccuguaggaagcugg

SEQ ID NO: 43457 - RNA, 21 nt, Artificial Sequence
  Synthetic Oligonucleotide; PDCD1LG2 exon 4; Set C
aguguuuauuuuccuguagga

SEQ ID NO: 43458 - RNA, 33 nt, Artificial Sequence
  Synthetic Oligonucleotide; PDCD1LG2 exon 4; Set A
ggaugugaguguuuauuuuccuguaggaagcug

SEQ ID NO: 43459 - RNA, 16 nt, Artificial Sequence
  Synthetic Oligonucleotide; PDCD1LG2 exon 4; Set C
guguuuauuuuccugu

SEQ ID NO: 43460 - RNA, 32 nt, Artificial Sequence
  Synthetic Oligonucleotide; PDCD1LG2 exon 4; Set A
ggaugugaguguuuauuuuccuguaggaagcu

SEQ ID NO: 43461 - RNA, 34 nt, Artificial Sequence
  Synthetic Oligonucleotide; PDCD1LG2 exon 4; Set A
aggaugugaguguuuauuuuccuguaggaagcug

SEQ ID NO: 43462 - RNA, 19 nt, Artificial Sequence
  Synthetic Oligonucleotide; PDCD1LG2 exon 4; Set C
gaguguuuauuuuccugua

SEQ ID NO: 43463 - RNA, 17 nt, Artificial Sequence
  Synthetic Oligonucleotide; PDCD1LG2 exon 4; Set C
aguguuuauuuuccugu

SEQ ID NO: 43464 - RNA, 31 nt, Artificial Sequence
  Synthetic Oligonucleotide; PDCD1LG2 exon 4; Set A
ggaugugaguguuuauuuuccuguaggaagc

SEQ ID NO: 43465 - RNA, 33 nt, Artificial Sequence
  Synthetic Oligonucleotide; PDCD1LG2 exon 4; Set A
aggaugugaguguuuauuuuccuguaggaagcu

SEQ ID NO: 43466 - RNA, 35 nt, Artificial Sequence
  Synthetic Oligonucleotide; PDCD1LG2 exon 4; Set A
uaggaugugaguguuuauuuuccuguaggaagcug

SEQ ID NO: 43467 - RNA, 20 nt, Artificial Sequence
  Synthetic Oligonucleotide; PDCD1LG2 exon 4; Set C
ugaguguuuauuuuccugua

SEQ ID NO: 43468 - RNA, 30 nt, Artificial Sequence
  Synthetic Oligonucleotide; PDCD1LG2 exon 4; Set A
ggaugugaguguuuauuuuccuguaggaag

SEQ ID NO: 43469 - RNA, 32 nt, Artificial Sequence
  Synthetic Oligonucleotide; PDCD1LG2 exon 4; Set A
aggaugugaguguuuauuuuccuguaggaagc

SEQ ID NO: 43470 - RNA, 34 nt, Artificial Sequence
  Synthetic Oligonucleotide; PDCD1LG2 exon 4; Set A
uaggaugugaguguuuauuuuccuguaggaagcu

SEQ ID NO: 43471 - RNA, 36 nt, Artificial Sequence
  Synthetic Oligonucleotide; PDCD1LG2 exon 4; Set A
uuaggaugugaguguuuauuuuccuguaggaagcug

SEQ ID NO: 43472 - RNA, 21 nt, Artificial Sequence
  Synthetic Oligonucleotide; PDCD1LG2 exon 4; Set C
gugaguguuuauuuuccugua

SEQ ID NO: 43473 - RNA, 29 nt, Artificial Sequence
  Synthetic Oligonucleotide; PDCD1LG2 exon 4; Set A
ggaugugaguguuuauuuuccuguaggaa

SEQ ID NO: 43474 - RNA, 31 nt, Artificial Sequence
  Synthetic Oligonucleotide; PDCD1LG2 exon 4; Set A
aggaugugaguguuuauuuuccuguaggaag

SEQ ID NO: 43475 - RNA, 33 nt, Artificial Sequence
  Synthetic Oligonucleotide; PDCD1LG2 exon 4; Set A
uaggaugugaguguuuauuuuccuguaggaagc

SEQ ID NO: 43476 - RNA, 35 nt, Artificial Sequence
  Synthetic Oligonucleotide; PDCD1LG2 exon 4; Set A
uuaggaugugaguguuuauuuuccuguaggaagcu

SEQ ID NO: 43477 - RNA, 37 nt, Artificial Sequence
  Synthetic Oligonucleotide; PDCD1LG2 exon 4; Set A
uuuaggaugugaguguuuauuuuccuguaggaagcug

SEQ ID NO: 43478 - RNA, 22 nt, Artificial Sequence
  Synthetic Oligonucleotide; PDCD1LG2 exon 4; Set C
ugugaguguuuauuuuccugua

SEQ ID NO: 43479 - RNA, 28 nt, Artificial Sequence
  Synthetic Oligonucleotide; PDCD1LG2 exon 4; Set A
ggaugugaguguuuauuuuccuguagga

SEQ ID NO: 43480 - RNA, 30 nt, Artificial Sequence
  Synthetic Oligonucleotide; PDCD1LG2 exon 4; Set A
aggaugugaguguuuauuuuccuguaggaa

SEQ ID NO: 43481 - RNA, 32 nt, Artificial Sequence
  Synthetic Oligonucleotide; PDCD1LG2 exon 4; Set A
uaggaugugaguguuuauuuuccuguaggaag

SEQ ID NO: 43482 - RNA, 34 nt, Artificial Sequence
  Synthetic Oligonucleotide; PDCD1LG2 exon 4; Set A
uuaggaugugaguguuuauuuuccuguaggaagc

SEQ ID NO: 43483 - RNA, 36 nt, Artificial Sequence
  Synthetic Oligonucleotide; PDCD1LG2 exon 4; Set A
uuuaggaugugaguguuuauuuuccuguaggaagcu

SEQ ID NO: 43484 - RNA, 23 nt, Artificial Sequence
  Synthetic Oligonucleotide; PDCD1LG2 exon 4; Set C
augugaguguuuauuuuccugua

SEQ ID NO: 43485 - RNA, 29 nt, Artificial Sequence
  Synthetic Oligonucleotide; PDCD1LG2 exon 4; Set A
aggaugugaguguuuauuuuccuguagga

SEQ ID NO: 43486 - RNA, 31 nt, Artificial Sequence
  Synthetic Oligonucleotide; PDCD1LG2 exon 4; Set A
uaggaugugaguguuuauuuuccuguaggaa

SEQ ID NO: 43487 - RNA, 33 nt, Artificial Sequence
  Synthetic Oligonucleotide; PDCD1LG2 exon 4; Set A
uuaggaugugaguguuuauuuuccuguaggaag

SEQ ID NO: 43488 - RNA, 35 nt, Artificial Sequence
  Synthetic Oligonucleotide; PDCD1LG2 exon 4; Set A
uuuaggaugugaguguuuauuuuccuguaggaagc

SEQ ID NO: 43489 - RNA, 24 nt, Artificial Sequence
  Synthetic Oligonucleotide; PDCD1LG2 exon 4; Set C
gaugugaguguuuauuuuccugua

SEQ ID NO: 43490 - RNA, 30 nt, Artificial Sequence
  Synthetic Oligonucleotide; PDCD1LG2 exon 4; Set A
uaggaugugaguguuuauuuuccuguagga

SEQ ID NO: 43491 - RNA, 32 nt, Artificial Sequence
  Synthetic Oligonucleotide; PDCD1LG2 exon 4; Set A
uuaggaugugaguguuuauuuuccuguaggaa

SEQ ID NO: 43492 - RNA, 34 nt, Artificial Sequence
  Synthetic Oligonucleotide; PDCD1LG2 exon 4; Set A
uuuaggaugugaguguuuauuuuccuguaggaag

SEQ ID NO: 43493 - RNA, 15 nt, Artificial Sequence
  Synthetic Oligonucleotide; PDCD1LG2 exon 4; Set C
ugaguguuuauuuuc

SEQ ID NO: 43494 - RNA, 31 nt, Artificial Sequence
  Synthetic Oligonucleotide; PDCD1LG2 exon 4; Set A
uuaggaugugaguguuuauuuuccuguagga

SEQ ID NO: 43495 - RNA, 33 nt, Artificial Sequence
  Synthetic Oligonucleotide; PDCD1LG2 exon 4; Set A
uuuaggaugugaguguuuauuuuccuguaggaa

SEQ ID NO: 43496 - RNA, 16 nt, Artificial Sequence
  Synthetic Oligonucleotide; PDCD1LG2 exon 4; Set C
gugaguguuuauuuuc

SEQ ID NO: 43497 - RNA, 24 nt, Artificial Sequence
  Synthetic Oligonucleotide; PDCD1LG2 exon 4; Set C
ggaugugaguguuuauuuuccugu

SEQ ID NO: 43498 - RNA, 32 nt, Artificial Sequence
  Synthetic Oligonucleotide; PDCD1LG2 exon 4; Set A
uuuaggaugugaguguuuauuuuccuguagga

SEQ ID NO: 43499 - RNA, 28 nt, Artificial Sequence
  Synthetic Oligonucleotide; PDCD1LG2 exon 4; Set A
uaggaugugaguguuuauuuuccuguag

SEQ ID NO: 43500 - RNA, 15 nt, Artificial Sequence
  Synthetic Oligonucleotide; PDCD1LG2 exon 4; Set C
gugaguguuuauuuu

SEQ ID NO: 43501 - RNA, 17 nt, Artificial Sequence
  Synthetic Oligonucleotide; PDCD1LG2 exon 4; Set C
ugugaguguuuauuuuc

SEQ ID NO: 43502 - RNA, 25 nt, Artificial Sequence
  Synthetic Oligonucleotide; PDCD1LG2 exon 4; Set C
aggaugugaguguuuauuuuccugu

SEQ ID NO: 43503 - RNA, 29 nt, Artificial Sequence
  Synthetic Oligonucleotide; PDCD1LG2 exon 4; Set A
uuaggaugugaguguuuauuuuccuguag

SEQ ID NO: 43504 - RNA, 18 nt, Artificial Sequence
  Synthetic Oligonucleotide; PDCD1LG2 exon 4; Set C
augugaguguuuauuuuc

SEQ ID NO: 43505 - RNA, 26 nt, Artificial Sequence
  Synthetic Oligonucleotide; PDCD1LG2 exon 4; Set C
uaggaugugaguguuuauuuuccugu

SEQ ID NO: 43506 - RNA, 30 nt, Artificial Sequence
  Synthetic Oligonucleotide; PDCD1LG2 exon 4; Set A
uuuaggaugugaguguuuauuuuccuguag

SEQ ID NO: 43507 - RNA, 17 nt, Artificial Sequence
  Synthetic Oligonucleotide; PDCD1LG2 exon 4; Set C
augugaguguuuauuuu

SEQ ID NO: 43508 - RNA, 27 nt, Artificial Sequence
  Synthetic Oligonucleotide; PDCD1LG2 exon 4; Set A
uuaggaugugaguguuuauuuuccugu

SEQ ID NO: 43509 - RNA, 30 nt, Artificial Sequence
  Synthetic Oligonucleotide; PDCD1LG2 exon 4; Set A
cuuuaggaugugaguguuuauuuuccugua

SEQ ID NO: 43510 - RNA, 28 nt, Artificial Sequence
  Synthetic Oligonucleotide; PDCD1LG2 exon 4; Set A
uuuaggaugugaguguuuauuuuccugu

SEQ ID NO: 43511 - RNA, 25 nt, Artificial Sequence
  Synthetic Oligonucleotide; PDCD1LG2 exon 4; Set C
uuuaggaugugaguguuuauuuucc

SEQ ID NO: 43512 - RNA, 34 nt, Artificial Sequence
  Synthetic Oligonucleotide; PDCD1LG2 exon 4; Set A
gaaccuuuaggaugugaguguuuauuuuccugua

SEQ ID NO: 43513 - RNA, 35 nt, Artificial Sequence
  Synthetic Oligonucleotide; PDCD1LG2 exon 4; Set A
ggaaccuuuaggaugugaguguuuauuuuccugua

SEQ ID NO: 43514 - RNA, 36 nt, Artificial Sequence
  Synthetic Oligonucleotide; PDCD1LG2 exon 4; Set A
uggaaccuuuaggaugugaguguuuauuuuccugua

SEQ ID NO: 43515 - RNA, 30 nt, Artificial Sequence
  Synthetic Oligonucleotide; PDCD1LG2 exon 4; Set A
ggaaccuuuaggaugugaguguuuauuuuc

SEQ ID NO: 43516 - RNA, 30 nt, Artificial Sequence
  Synthetic Oligonucleotide; PDCD1LG2 exon 4; Set A
cuggaaccuuuaggaugugaguguuuauuu

SEQ ID NO: 43517 - RNA, 17 nt, Artificial Sequence
  Synthetic Oligonucleotide; PDCD1LG2 exon 4; Set C
ccuuuaggaugugagug

SEQ ID NO: 43518 - RNA, 31 nt, Artificial Sequence
  Synthetic Oligonucleotide; PDCD1LG2 exon 4; Set A
ucuggaaccuuuaggaugugaguguuuauuu

SEQ ID NO: 43519 - RNA, 29 nt, Artificial Sequence
  Synthetic Oligonucleotide; PDCD1LG2 exon 4; Set A
cuggaaccuuuaggaugugaguguuuauu

SEQ ID NO: 43520 - RNA, 18 nt, Artificial Sequence
  Synthetic Oligonucleotide; PDCD1LG2 exon 4; Set C
accuuuaggaugugagug

SEQ ID NO: 43521 - RNA, 16 nt, Artificial Sequence
  Synthetic Oligonucleotide; PDCD1LG2 exon 4; Set C
ccuuuaggaugugagu

SEQ ID NO: 43522 - RNA, 32 nt, Artificial Sequence
  Synthetic Oligonucleotide; PDCD1LG2 exon 4; Set A
uucuggaaccuuuaggaugugaguguuuauuu

SEQ ID NO: 43523 - RNA, 28 nt, Artificial Sequence
  Synthetic Oligonucleotide; PDCD1LG2 exon 4; Set A
cuggaaccuuuaggaugugaguguuuau

SEQ ID NO: 43524 - RNA, 30 nt, Artificial Sequence
  Synthetic Oligonucleotide; PDCD1LG2 exon 4; Set A
ucuggaaccuuuaggaugugaguguuuauu

SEQ ID NO: 43525 - RNA, 19 nt, Artificial Sequence
  Synthetic Oligonucleotide; PDCD1LG2 exon 4; Set C
aaccuuuaggaugugagug

SEQ ID NO: 43526 - RNA, 17 nt, Artificial Sequence
  Synthetic Oligonucleotide; PDCD1LG2 exon 4; Set C
accuuuaggaugugagu

SEQ ID NO: 43527 - RNA, 33 nt, Artificial Sequence
  Synthetic Oligonucleotide; PDCD1LG2 exon 4; Set A
uuucuggaaccuuuaggaugugaguguuuauuu

SEQ ID NO: 43528 - RNA, 27 nt, Artificial Sequence
  Synthetic Oligonucleotide; PDCD1LG2 exon 4; Set A
cuggaaccuuuaggaugugaguguuua

SEQ ID NO: 43529 - RNA, 29 nt, Artificial Sequence
  Synthetic Oligonucleotide; PDCD1LG2 exon 4; Set A
ucuggaaccuuuaggaugugaguguuuau

SEQ ID NO: 43530 - RNA, 31 nt, Artificial Sequence
  Synthetic Oligonucleotide; PDCD1LG2 exon 4; Set A
uucuggaaccuuuaggaugugaguguuuauu

SEQ ID NO: 43531 - RNA, 18 nt, Artificial Sequence
  Synthetic Oligonucleotide; PDCD1LG2 exon 4; Set C
aaccuuuaggaugugagu

SEQ ID NO: 43532 - RNA, 28 nt, Artificial Sequence
  Synthetic Oligonucleotide; PDCD1LG2 exon 4; Set A
ucuggaaccuuuaggaugugaguguuua

SEQ ID NO: 43533 - RNA, 30 nt, Artificial Sequence
  Synthetic Oligonucleotide; PDCD1LG2 exon 4; Set A
uucuggaaccuuuaggaugugaguguuuau

SEQ ID NO: 43534 - RNA, 32 nt, Artificial Sequence
  Synthetic Oligonucleotide; PDCD1LG2 exon 4; Set A
uuucuggaaccuuuaggaugugaguguuuauu

SEQ ID NO: 43535 - RNA, 26 nt, Artificial Sequence
  Synthetic Oligonucleotide; PDCD1LG2 exon 4; Set A
cuggaaccuuuaggaugugaguguuu

SEQ ID NO: 43536 - RNA, 35 nt, Artificial Sequence
  Synthetic Oligonucleotide; PDCD1LG2 exon 4; Set A
uguuucuggaaccuuuaggaugugaguguuuauuu

SEQ ID NO: 43537 - RNA, 29 nt, Artificial Sequence
  Synthetic Oligonucleotide; PDCD1LG2 exon 4; Set A
uucuggaaccuuuaggaugugaguguuua

SEQ ID NO: 43538 - RNA, 31 nt, Artificial Sequence
  Synthetic Oligonucleotide; PDCD1LG2 exon 4; Set A
uuucuggaaccuuuaggaugugaguguuuau

SEQ ID NO: 43539 - RNA, 25 nt, Artificial Sequence
  Synthetic Oligonucleotide; PDCD1LG2 exon 4; Set A
cuggaaccuuuaggaugugaguguu

SEQ ID NO: 43540 - RNA, 27 nt, Artificial Sequence
  Synthetic Oligonucleotide; PDCD1LG2 exon 4; Set A
ucuggaaccuuuaggaugugaguguuu

SEQ ID NO: 43541 - RNA, 34 nt, Artificial Sequence
  Synthetic Oligonucleotide; PDCD1LG2 exon 4; Set A
uguuucuggaaccuuuaggaugugaguguuuauu

SEQ ID NO: 43542 - RNA, 30 nt, Artificial Sequence
  Synthetic Oligonucleotide; PDCD1LG2 exon 4; Set A
uuucuggaaccuuuaggaugugaguguuua

SEQ ID NO: 43543 - RNA, 24 nt, Artificial Sequence
  Synthetic Oligonucleotide; PDCD1LG2 exon 4; Set A
cuggaaccuuuaggaugugagugu

SEQ ID NO: 43544 - RNA, 26 nt, Artificial Sequence
  Synthetic Oligonucleotide; PDCD1LG2 exon 4; Set A
ucuggaaccuuuaggaugugaguguu

SEQ ID NO: 43545 - RNA, 28 nt, Artificial Sequence
  Synthetic Oligonucleotide; PDCD1LG2 exon 4; Set A
uucuggaaccuuuaggaugugaguguuu

SEQ ID NO: 43546 - RNA, 33 nt, Artificial Sequence
  Synthetic Oligonucleotide; PDCD1LG2 exon 4; Set A
uguuucuggaaccuuuaggaugugaguguuuau

SEQ ID NO: 43547 - RNA, 25 nt, Artificial Sequence
  Synthetic Oligonucleotide; PDCD1LG2 exon 4; Set A
ucuggaaccuuuaggaugugagugu

SEQ ID NO: 43548 - RNA, 27 nt, Artificial Sequence
  Synthetic Oligonucleotide; PDCD1LG2 exon 4; Set A
uucuggaaccuuuaggaugugaguguu

SEQ ID NO: 43549 - RNA, 32 nt, Artificial Sequence
  Synthetic Oligonucleotide; PDCD1LG2 exon 4; Set A
uguuucuggaaccuuuaggaugugaguguuua

SEQ ID NO: 43550 - RNA, 26 nt, Artificial Sequence
  Synthetic Oligonucleotide; PDCD1LG2 exon 4; Set A
uucuggaaccuuuaggaugugagugu

SEQ ID NO: 43551 - RNA, 21 nt, Artificial Sequence
  Synthetic Oligonucleotide; PDCD1LG2 exon 4; Set C
cuggaaccuuuaggaugugag

SEQ ID NO: 43552 - RNA, 31 nt, Artificial Sequence
  Synthetic Oligonucleotide; PDCD1LG2 exon 4; Set A
uguuucuggaaccuuuaggaugugaguguuu

SEQ ID NO: 43553 - RNA, 22 nt, Artificial Sequence
  Synthetic Oligonucleotide; PDCD1LG2 exon 4; Set C
ucuggaaccuuuaggaugugag

SEQ ID NO: 43554 - RNA, 20 nt, Artificial Sequence
  Synthetic Oligonucleotide; PDCD1LG2 exon 4; Set C
cuggaaccuuuaggauguga

SEQ ID NO: 43555 - RNA, 30 nt, Artificial Sequence
  Synthetic Oligonucleotide; PDCD1LG2 exon 4; Set A
uguuucuggaaccuuuaggaugugaguguu

SEQ ID NO: 43556 - RNA, 27 nt, Artificial Sequence
  Synthetic Oligonucleotide; PDCD1LG2 exon 4; Set A
guuucuggaaccuuuaggaugugagug

SEQ ID NO: 43557 - RNA, 23 nt, Artificial Sequence
  Synthetic Oligonucleotide; PDCD1LG2 exon 4; Set C
uucuggaaccuuuaggaugugag

SEQ ID NO: 43558 - RNA, 19 nt, Artificial Sequence
  Synthetic Oligonucleotide; PDCD1LG2 exon 4; Set C
cuggaaccuuuaggaugug

SEQ ID NO: 43559 - RNA, 21 nt, Artificial Sequence
  Synthetic Oligonucleotide; PDCD1LG2 exon 4; Set C
ucuggaaccuuuaggauguga

SEQ ID NO: 43560 - RNA, 29 nt, Artificial Sequence
  Synthetic Oligonucleotide; PDCD1LG2 exon 4; Set A
uguuucuggaaccuuuaggaugugagugu

SEQ ID NO: 43561 - RNA, 26 nt, Artificial Sequence
  Synthetic Oligonucleotide; PDCD1LG2 exon 4; Set A
guuucuggaaccuuuaggaugugagu

SEQ ID NO: 43562 - RNA, 18 nt, Artificial Sequence
  Synthetic Oligonucleotide; PDCD1LG2 exon 4; Set C
cuggaaccuuuaggaugu

SEQ ID NO: 43563 - RNA, 24 nt, Artificial Sequence
  Synthetic Oligonucleotide; PDCD1LG2 exon 4; Set C
uuucuggaaccuuuaggaugugag

SEQ ID NO: 43564 - RNA, 20 nt, Artificial Sequence
  Synthetic Oligonucleotide; PDCD1LG2 exon 4; Set C
ucuggaaccuuuaggaugug

SEQ ID NO: 43565 - RNA, 22 nt, Artificial Sequence
  Synthetic Oligonucleotide; PDCD1LG2 exon 4; Set C
uucuggaaccuuuaggauguga

SEQ ID NO: 43566 - RNA, 19 nt, Artificial Sequence
  Synthetic Oligonucleotide; PDCD1LG2 exon 4; Set C
ucuggaaccuuuaggaugu

SEQ ID NO: 43567 - RNA, 21 nt, Artificial Sequence
  Synthetic Oligonucleotide; PDCD1LG2 exon 4; Set C
uucuggaaccuuuaggaugug

SEQ ID NO: 43568 - RNA, 17 nt, Artificial Sequence
  Synthetic Oligonucleotide; PDCD1LG2 exon 4; Set C
cuggaaccuuuaggaug

SEQ ID NO: 43569 - RNA, 30 nt, Artificial Sequence
  Synthetic Oligonucleotide; PDCD1LG2 exon 4; Set A
ucuguuucuggaaccuuuaggaugugagug

SEQ ID NO: 43570 - RNA, 16 nt, Artificial Sequence
  Synthetic Oligonucleotide; PDCD1LG2 exon 4; Set C
cuggaaccuuuaggau

SEQ ID NO: 43571 - RNA, 20 nt, Artificial Sequence
  Synthetic Oligonucleotide; PDCD1LG2 exon 4; Set C
uucuggaaccuuuaggaugu

SEQ ID NO: 43572 - RNA, 26 nt, Artificial Sequence
  Synthetic Oligonucleotide; PDCD1LG2 exon 4; Set A
uguuucuggaaccuuuaggaugugag

SEQ ID NO: 43573 - RNA, 18 nt, Artificial Sequence
  Synthetic Oligonucleotide; PDCD1LG2 exon 4; Set C
ucuggaaccuuuaggaug

SEQ ID NO: 43574 - RNA, 31 nt, Artificial Sequence
  Synthetic Oligonucleotide; PDCD1LG2 exon 4; Set A
aucuguuucuggaaccuuuaggaugugagug

SEQ ID NO: 43575 - RNA, 29 nt, Artificial Sequence
  Synthetic Oligonucleotide; PDCD1LG2 exon 4; Set A
ucuguuucuggaaccuuuaggaugugagu

SEQ ID NO: 43576 - RNA, 17 nt, Artificial Sequence
  Synthetic Oligonucleotide; PDCD1LG2 exon 4; Set C
ucuggaaccuuuaggau

SEQ ID NO: 43577 - RNA, 21 nt, Artificial Sequence
  Synthetic Oligonucleotide; PDCD1LG2 exon 4; Set C
uuucuggaaccuuuaggaugu

SEQ ID NO: 43578 - RNA, 25 nt, Artificial Sequence
  Synthetic Oligonucleotide; PDCD1LG2 exon 4; Set A
uguuucuggaaccuuuaggauguga

SEQ ID NO: 43579 - RNA, 19 nt, Artificial Sequence
  Synthetic Oligonucleotide; PDCD1LG2 exon 4; Set C
uucuggaaccuuuaggaug

SEQ ID NO: 43580 - RNA, 30 nt, Artificial Sequence
  Synthetic Oligonucleotide; PDCD1LG2 exon 4; Set A
aucuguuucuggaaccuuuaggaugugagu

SEQ ID NO: 43581 - RNA, 18 nt, Artificial Sequence
  Synthetic Oligonucleotide; PDCD1LG2 exon 4; Set C
uucuggaaccuuuaggau

SEQ ID NO: 43582 - RNA, 24 nt, Artificial Sequence
  Synthetic Oligonucleotide; PDCD1LG2 exon 4; Set C
uguuucuggaaccuuuaggaugug

SEQ ID NO: 43583 - RNA, 19 nt, Artificial Sequence
  Synthetic Oligonucleotide; PDCD1LG2 exon 4; Set C
uuucuggaaccuuuaggau

SEQ ID NO: 43584 - RNA, 23 nt, Artificial Sequence
  Synthetic Oligonucleotide; PDCD1LG2 exon 4; Set C
uguuucuggaaccuuuaggaugu

SEQ ID NO: 43585 - RNA, 18 nt, Artificial Sequence
  Synthetic Oligonucleotide; PDCD1LG2 exon 4; Set C
uuucuggaaccuuuagga

SEQ ID NO: 43586 - RNA, 22 nt, Artificial Sequence
  Synthetic Oligonucleotide; PDCD1LG2 exon 4; Set C
uguuucuggaaccuuuaggaug

SEQ ID NO: 43587 - RNA, 17 nt, Artificial Sequence
  Synthetic Oligonucleotide; PDCD1LG2 exon 4; Set C
uuucuggaaccuuuagg

SEQ ID NO: 43588 - RNA, 19 nt, Artificial Sequence
  Synthetic Oligonucleotide; PDCD1LG2 exon 4; Set C
guuucuggaaccuuuagga

SEQ ID NO: 43589 - RNA, 21 nt, Artificial Sequence
  Synthetic Oligonucleotide; PDCD1LG2 exon 4; Set C
uguuucuggaaccuuuaggau

SEQ ID NO: 43590 - RNA, 16 nt, Artificial Sequence
  Synthetic Oligonucleotide; PDCD1LG2 exon 4; Set C
uuucuggaaccuuuag

SEQ ID NO: 43591 - RNA, 18 nt, Artificial Sequence
  Synthetic Oligonucleotide; PDCD1LG2 exon 4; Set C
guuucuggaaccuuuagg

SEQ ID NO: 43592 - RNA, 15 nt, Artificial Sequence
  Synthetic Oligonucleotide; PDCD1LG2 exon 4; Set C
uuucuggaaccuuua

SEQ ID NO: 43593 - RNA, 17 nt, Artificial Sequence
  Synthetic Oligonucleotide; PDCD1LG2 exon 4; Set C
guuucuggaaccuuuag

SEQ ID NO: 43594 - RNA, 16 nt, Artificial Sequence
  Synthetic Oligonucleotide; PDCD1LG2 exon 4; Set C
guuucuggaaccuuua

SEQ ID NO: 43595 - RNA, 22 nt, Artificial Sequence
  Synthetic Oligonucleotide; PDCD1LG2 exon 4; Set C
ucuguuucuggaaccuuuagga

SEQ ID NO: 43596 - RNA, 15 nt, Artificial Sequence
  Synthetic Oligonucleotide; PDCD1LG2 exon 4; Set C
guuucuggaaccuuu

SEQ ID NO: 43597 - RNA, 23 nt, Artificial Sequence
  Synthetic Oligonucleotide; PDCD1LG2 exon 4; Set C
aucuguuucuggaaccuuuagga

SEQ ID NO: 43598 - RNA, 21 nt, Artificial Sequence
  Synthetic Oligonucleotide; PDCD1LG2 exon 4; Set C
ucuguuucuggaaccuuuagg

SEQ ID NO: 43599 - RNA, 40 nt, Artificial Sequence
  Synthetic Oligonucleotide; PDCD1LG2 exon 4; Set C
cucuaccucaucuguuucuggaaccuuuaggaugugagug

SEQ ID NO: 43600 - RNA, 22 nt, Artificial Sequence
  Synthetic Oligonucleotide; PDCD1LG2 exon 4; Set C
aucuguuucuggaaccuuuagg

SEQ ID NO: 43601 - RNA, 20 nt, Artificial Sequence
  Synthetic Oligonucleotide; PDCD1LG2 exon 4; Set C
ucuguuucuggaaccuuuag

SEQ ID NO: 43602 - RNA, 39 nt, Artificial Sequence
  Synthetic Oligonucleotide; PDCD1LG2 exon 4; Set C
cucuaccucaucuguuucuggaaccuuuaggaugugagu

SEQ ID NO: 43603 - RNA, 19 nt, Artificial Sequence
  Synthetic Oligonucleotide; PDCD1LG2 exon 4; Set C
ucuguuucuggaaccuuua

SEQ ID NO: 43604 - RNA, 21 nt, Artificial Sequence
  Synthetic Oligonucleotide; PDCD1LG2 exon 4; Set C
aucuguuucuggaaccuuuag

SEQ ID NO: 43605 - RNA, 15 nt, Artificial Sequence
  Synthetic Oligonucleotide; PDCD1LG2 exon 4; Set C
uguuucuggaaccuu

SEQ ID NO: 43606 - RNA, 18 nt, Artificial Sequence
  Synthetic Oligonucleotide; PDCD1LG2 exon 4; Set C
ucuguuucuggaaccuuu

SEQ ID NO: 43607 - RNA, 20 nt, Artificial Sequence
  Synthetic Oligonucleotide; PDCD1LG2 exon 4; Set C
aucuguuucuggaaccuuua

SEQ ID NO: 43608 - RNA, 19 nt, Artificial Sequence
  Synthetic Oligonucleotide; PDCD1LG2 exon 4; Set C
aucuguuucuggaaccuuu

SEQ ID NO: 43609 - RNA, 39 nt, Artificial Sequence
  Synthetic Oligonucleotide; PDCD1LG2 exon 4; Set C
gcucuaccucaucuguuucuggaaccuuuaggaugugag

SEQ ID NO: 43610 - RNA, 40 nt, Artificial Sequence
  Synthetic Oligonucleotide; PDCD1LG2 exon 4; Set C
agcucuaccucaucuguuucuggaaccuuuaggaugugag

SEQ ID NO: 43611 - RNA, 38 nt, Artificial Sequence
  Synthetic Oligonucleotide; PDCD1LG2 exon 4; Set C
gcucuaccucaucuguuucuggaaccuuuaggauguga

SEQ ID NO: 43612 - RNA, 39 nt, Artificial Sequence
  Synthetic Oligonucleotide; PDCD1LG2 exon 4; Set C
agcucuaccucaucuguuucuggaaccuuuaggauguga

SEQ ID NO: 43613 - RNA, 37 nt, Artificial Sequence
  Synthetic Oligonucleotide; PDCD1LG2 exon 4; Set C
gcucuaccucaucuguuucuggaaccuuuaggaugug

SEQ ID NO: 43614 - RNA, 36 nt, Artificial Sequence
  Synthetic Oligonucleotide; PDCD1LG2 exon 4; Set C
gcucuaccucaucuguuucuggaaccuuuaggaugu

SEQ ID NO: 43615 - RNA, 38 nt, Artificial Sequence
  Synthetic Oligonucleotide; PDCD1LG2 exon 4; Set C
agcucuaccucaucuguuucuggaaccuuuaggaugug

SEQ ID NO: 43616 - RNA, 37 nt, Artificial Sequence
  Synthetic Oligonucleotide; PDCD1LG2 exon 4; Set C
agcucuaccucaucuguuucuggaaccuuuaggaugu

SEQ ID NO: 43617 - RNA, 35 nt, Artificial Sequence
  Synthetic Oligonucleotide; PDCD1LG2 exon 4; Set C
gcucuaccucaucuguuucuggaaccuuuaggaug

SEQ ID NO: 43618 - RNA, 32 nt, Artificial Sequence
  Synthetic Oligonucleotide; PDCD1LG2 exon 4; Set C
cucuaccucaucuguuucuggaaccuuuagga

SEQ ID NO: 43619 - RNA, 34 nt, Artificial Sequence
  Synthetic Oligonucleotide; PDCD1LG2 exon 4; Set C
gcucuaccucaucuguuucuggaaccuuuaggau

SEQ ID NO: 43620 - RNA, 36 nt, Artificial Sequence
  Synthetic Oligonucleotide; PDCD1LG2 exon 4; Set C
agcucuaccucaucuguuucuggaaccuuuaggaug

SEQ ID NO: 43621 - RNA, 35 nt, Artificial Sequence
  Synthetic Oligonucleotide; PDCD1LG2 exon 4; Set C
agcucuaccucaucuguuucuggaaccuuuaggau

SEQ ID NO: 43622 - RNA, 28 nt, Artificial Sequence
  Synthetic Oligonucleotide; PDCD1LG2 exon 4; Set A
cucuaccucaucuguuucuggaaccuuu

SEQ ID NO: 43623 - RNA, 39 nt, Artificial Sequence
  Synthetic Oligonucleotide; PDCD1LG2 exon 4; Set C
ggugagcucuaccucaucuguuucuggaaccuuuaggau

SEQ ID NO: 43624 - RNA, 38 nt, Artificial Sequence
  Synthetic Oligonucleotide; PDCD1LG2 exon 4; Set C
ggugagcucuaccucaucuguuucuggaaccuuuagga

SEQ ID NO: 43625 - RNA, 28 nt, Artificial Sequence
  Synthetic Oligonucleotide; PDCD1LG2 exon 4; Set C
gcucuaccucaucuguuucuggaaccuu

SEQ ID NO: 43626 - RNA, 37 nt, Artificial Sequence
  Synthetic Oligonucleotide; PDCD1LG2 exon 4; Set C
ggugagcucuaccucaucuguuucuggaaccuuuagg

SEQ ID NO: 43627 - RNA, 39 nt, Artificial Sequence
  Synthetic Oligonucleotide; PDCD1LG2 exon 4; Set C
aggugagcucuaccucaucuguuucuggaaccuuuagga

SEQ ID NO: 43628 - RNA, 29 nt, Artificial Sequence
  Synthetic Oligonucleotide; PDCD1LG2 exon 4; Set A
agcucuaccucaucuguuucuggaaccuu

SEQ ID NO: 43629 - RNA, 36 nt, Artificial Sequence
  Synthetic Oligonucleotide; PDCD1LG2 exon 4; Set C
ggugagcucuaccucaucuguuucuggaaccuuuag

SEQ ID NO: 43630 - RNA, 38 nt, Artificial Sequence
  Synthetic Oligonucleotide; PDCD1LG2 exon 4; Set C
aggugagcucuaccucaucuguuucuggaaccuuuagg

SEQ ID NO: 43631 - RNA, 35 nt, Artificial Sequence
  Synthetic Oligonucleotide; PDCD1LG2 exon 4; Set C
ggugagcucuaccucaucuguuucuggaaccuuua

SEQ ID NO: 43632 - RNA, 37 nt, Artificial Sequence
  Synthetic Oligonucleotide; PDCD1LG2 exon 4; Set C
aggugagcucuaccucaucuguuucuggaaccuuuag

SEQ ID NO: 43633 - RNA, 34 nt, Artificial Sequence
  Synthetic Oligonucleotide; PDCD1LG2 exon 4; Set C
ggugagcucuaccucaucuguuucuggaaccuuu

SEQ ID NO: 43634 - RNA, 36 nt, Artificial Sequence
  Synthetic Oligonucleotide; PDCD1LG2 exon 4; Set C
aggugagcucuaccucaucuguuucuggaaccuuua

SEQ ID NO: 43635 - RNA, 24 nt, Artificial Sequence
  Synthetic Oligonucleotide; PDCD1LG2 exon 4; Set A
gcucuaccucaucuguuucuggaa

SEQ ID NO: 43636 - RNA, 35 nt, Artificial Sequence
  Synthetic Oligonucleotide; PDCD1LG2 exon 4; Set C
aggugagcucuaccucaucuguuucuggaaccuuu

SEQ ID NO: 43637 - RNA, 25 nt, Artificial Sequence
  Synthetic Oligonucleotide; PDCD1LG2 exon 4; Set A
agcucuaccucaucuguuucuggaa

SEQ ID NO: 43638 - RNA, 23 nt, Artificial Sequence
  Synthetic Oligonucleotide; PDCD1LG2 exon 4; Set A
gcucuaccucaucuguuucugga

SEQ ID NO: 43639 - RNA, 24 nt, Artificial Sequence
  Synthetic Oligonucleotide; PDCD1LG2 exon 4; Set A
agcucuaccucaucuguuucugga

SEQ ID NO: 43640 - RNA, 22 nt, Artificial Sequence
  Synthetic Oligonucleotide; PDCD1LG2 exon 4; Set A
gcucuaccucaucuguuucugg

SEQ ID NO: 43641 - RNA, 25 nt, Artificial Sequence
  Synthetic Oligonucleotide; PDCD1LG2 exon 4; Set A
gagcucuaccucaucuguuucugga

SEQ ID NO: 43642 - RNA, 23 nt, Artificial Sequence
  Synthetic Oligonucleotide; PDCD1LG2 exon 4; Set A
agcucuaccucaucuguuucugg

SEQ ID NO: 43643 - RNA, 24 nt, Artificial Sequence
  Synthetic Oligonucleotide; PDCD1LG2 exon 4; Set A
gagcucuaccucaucuguuucugg

SEQ ID NO: 43644 - RNA, 24 nt, Artificial Sequence
  Synthetic Oligonucleotide; PDCD1LG2 exon 4; Set A
ugagcucuaccucaucuguuucug

SEQ ID NO: 43645 - RNA, 25 nt, Artificial Sequence
  Synthetic Oligonucleotide; PDCD1LG2 exon 4; Set A
gugagcucuaccucaucuguuucug

SEQ ID NO: 43646 - RNA, 40 nt, Artificial Sequence
  Synthetic Oligonucleotide; PDCD1LG2 exon 4; Set C
ccuggcaggugagcucuaccucaucuguuucuggaaccuu

SEQ ID NO: 43647 - RNA, 24 nt, Artificial Sequence
  Synthetic Oligonucleotide; PDCD1LG2 exon 4; Set A
gugagcucuaccucaucuguuucu

SEQ ID NO: 43648 - RNA, 19 nt, Artificial Sequence
  Synthetic Oligonucleotide; PDCD1LG2 exon 4; Set C
ugagcucuaccucaucugu

SEQ ID NO: 43649 - RNA, 36 nt, Artificial Sequence
  Synthetic Oligonucleotide; PDCD1LG2 exon 4; Set C
ccuggcaggugagcucuaccucaucuguuucuggaa

SEQ ID NO: 43650 - RNA, 20 nt, Artificial Sequence
  Synthetic Oligonucleotide; PDCD1LG2 exon 4; Set A
gugagcucuaccucaucugu

SEQ ID NO: 43651 - RNA, 37 nt, Artificial Sequence
  Synthetic Oligonucleotide; PDCD1LG2 exon 4; Set C
gccuggcaggugagcucuaccucaucuguuucuggaa

SEQ ID NO: 43652 - RNA, 35 nt, Artificial Sequence
  Synthetic Oligonucleotide; PDCD1LG2 exon 4; Set C
ccuggcaggugagcucuaccucaucuguuucugga

SEQ ID NO: 43653 - RNA, 34 nt, Artificial Sequence
  Synthetic Oligonucleotide; PDCD1LG2 exon 4; Set C
ccuggcaggugagcucuaccucaucuguuucugg

SEQ ID NO: 43654 - RNA, 36 nt, Artificial Sequence
  Synthetic Oligonucleotide; PDCD1LG2 exon 4; Set C
gccuggcaggugagcucuaccucaucuguuucugga

SEQ ID NO: 43655 - RNA, 35 nt, Artificial Sequence
  Synthetic Oligonucleotide; PDCD1LG2 exon 4; Set C
gccuggcaggugagcucuaccucaucuguuucugg

SEQ ID NO: 43656 - RNA, 36 nt, Artificial Sequence
  Synthetic Oligonucleotide; PDCD1LG2 exon 4; Set C
agccuggcaggugagcucuaccucaucuguuucugg

SEQ ID NO: 43657 - RNA, 17 nt, Artificial Sequence
  Synthetic Oligonucleotide; PDCD1LG2 exon 4; Set C
ggugagcucuaccucau

SEQ ID NO: 43658 - RNA, 40 nt, Artificial Sequence
  Synthetic Oligonucleotide; PDCD1LG2 exon 4; Set C
uguagccuggcaggugagcucuaccucaucuguuucugga

SEQ ID NO: 43659 - RNA, 39 nt, Artificial Sequence
  Synthetic Oligonucleotide; PDCD1LG2 exon 4; Set C
uguagccuggcaggugagcucuaccucaucuguuucugg

SEQ ID NO: 43660 - RNA, 37 nt, Artificial Sequence
  Synthetic Oligonucleotide; PDCD1LG2 exon 4; Set C
guagccuggcaggugagcucuaccucaucuguuucug

SEQ ID NO: 43661 - RNA, 24 nt, Artificial Sequence
  Synthetic Oligonucleotide; PDCD1LG2 exon 4; Set C
ccuggcaggugagcucuaccucau

SEQ ID NO: 43662 - RNA, 32 nt, Artificial Sequence
  Synthetic Oligonucleotide; PDCD1LG2 exon 4; Set C
guagccuggcaggugagcucuaccucaucugu

SEQ ID NO: 43663 - RNA, 25 nt, Artificial Sequence
  Synthetic Oligonucleotide; PDCD1LG2 exon 4; Set C
gccuggcaggugagcucuaccucau

SEQ ID NO: 43664 - RNA, 23 nt, Artificial Sequence
  Synthetic Oligonucleotide; PDCD1LG2 exon 4; Set C
ccuggcaggugagcucuaccuca

SEQ ID NO: 43665 - RNA, 24 nt, Artificial Sequence
  Synthetic Oligonucleotide; PDCD1LG2 exon 4; Set C
gccuggcaggugagcucuaccuca

SEQ ID NO: 43666 - RNA, 25 nt, Artificial Sequence
  Synthetic Oligonucleotide; PDCD1LG2 exon 4; Set C
agccuggcaggugagcucuaccuca

SEQ ID NO: 43667 - RNA, 40 nt, Artificial Sequence
  Synthetic Oligonucleotide; PDCD1LG2 exon 4; Set C
uaaccuguagccuggcaggugagcucuaccucaucuguuu

SEQ ID NO: 43668 - RNA, 28 nt, Artificial Sequence
  Synthetic Oligonucleotide; PDCD1LG2 exon 4; Set C
uguagccuggcaggugagcucuaccuca

SEQ ID NO: 43669 - RNA, 38 nt, Artificial Sequence
  Synthetic Oligonucleotide; PDCD1LG2 exon 4; Set C
uaaccuguagccuggcaggugagcucuaccucaucugu

SEQ ID NO: 43670 - RNA, 39 nt, Artificial Sequence
  Synthetic Oligonucleotide; PDCD1LG2 exon 4; Set C
auaaccuguagccuggcaggugagcucuaccucaucugu

SEQ ID NO: 43671 - RNA, 40 nt, Artificial Sequence
  Synthetic Oligonucleotide; PDCD1LG2 exon 4; Set C
gauaaccuguagccuggcaggugagcucuaccucaucugu

SEQ ID NO: 43672 - RNA, 32 nt, Artificial Sequence
  Synthetic Oligonucleotide; PDCD1LG2 exon 4; Set C
aaccuguagccuggcaggugagcucuaccuca

SEQ ID NO: 43673 - RNA, 17 nt, Artificial Sequence
  Synthetic Oligonucleotide; PDCD1LG2 exon 4; Set A
agccuggcaggugagcu

SEQ ID NO: 43674 - RNA, 18 nt, Artificial Sequence
  Synthetic Oligonucleotide; PDCD1LG2 exon 4; Set A
uagccuggcaggugagcu

SEQ ID NO: 43675 - RNA, 15 nt, Artificial Sequence
  Synthetic Oligonucleotide; PDCD1LG2 exon 4; Set C
agccuggcaggugag

SEQ ID NO: 43676 - RNA, 19 nt, Artificial Sequence
  Synthetic Oligonucleotide; PDCD1LG2 exon 4; Set A
guagccuggcaggugagcu

SEQ ID NO: 43677 - RNA, 17 nt, Artificial Sequence
  Synthetic Oligonucleotide; PDCD1LG2 exon 4; Set A
uagccuggcaggugagc

SEQ ID NO: 43678 - RNA, 16 nt, Artificial Sequence
  Synthetic Oligonucleotide; PDCD1LG2 exon 4; Set C
uagccuggcaggugag

SEQ ID NO: 43679 - RNA, 18 nt, Artificial Sequence
  Synthetic Oligonucleotide; PDCD1LG2 exon 4; Set A
guagccuggcaggugagc

SEQ ID NO: 43680 - RNA, 18 nt, Artificial Sequence
  Synthetic Oligonucleotide; PDCD1LG2 exon 4; Set A
uguagccuggcaggugag

SEQ ID NO: 43681 - RNA, 17 nt, Artificial Sequence
  Synthetic Oligonucleotide; PDCD1LG2 exon 4; Set A
uguagccuggcagguga

SEQ ID NO: 43682 - RNA, 16 nt, Artificial Sequence
  Synthetic Oligonucleotide; PDCD1LG2 exon 4; Set C
uguagccuggcaggug

SEQ ID NO: 43683 - RNA, 24 nt, Artificial Sequence
  Synthetic Oligonucleotide; PDCD1LG2 exon 4; Set C
aaccuguagccuggcaggugagcu

SEQ ID NO: 43684 - RNA, 22 nt, Artificial Sequence
  Synthetic Oligonucleotide; PDCD1LG2 exon 4; Set A
aaccuguagccuggcaggugag

SEQ ID NO: 43685 - RNA, 21 nt, Artificial Sequence
  Synthetic Oligonucleotide; PDCD1LG2 exon 4; Set A
aaccuguagccuggcagguga

SEQ ID NO: 43686 - RNA, 27 nt, Artificial Sequence
  Synthetic Oligonucleotide; PDCD1LG2 exon 4; Set C
gauaaccuguagccuggcaggugagcu

SEQ ID NO: 43687 - RNA, 26 nt, Artificial Sequence
  Synthetic Oligonucleotide; PDCD1LG2 exon 4; Set C
gauaaccuguagccuggcaggugagc

SEQ ID NO: 43688 - RNA, 20 nt, Artificial Sequence
  Synthetic Oligonucleotide; PDCD1LG2 exon 4; Set A
uaaccuguagccuggcaggu

SEQ ID NO: 43689 - RNA, 21 nt, Artificial Sequence
  Synthetic Oligonucleotide; PDCD1LG2 exon 4; Set A
auaaccuguagccuggcaggu

SEQ ID NO: 43690 - RNA, 19 nt, Artificial Sequence
  Synthetic Oligonucleotide; PDCD1LG2 exon 4; Set A
uaaccuguagccuggcagg

SEQ ID NO: 43691 - RNA, 22 nt, Artificial Sequence
  Synthetic Oligonucleotide; PDCD1LG2 exon 4; Set A
gauaaccuguagccuggcaggu

SEQ ID NO: 43692 - RNA, 20 nt, Artificial Sequence
  Synthetic Oligonucleotide; PDCD1LG2 exon 4; Set A
auaaccuguagccuggcagg

SEQ ID NO: 43693 - RNA, 39 nt, Artificial Sequence
  Synthetic Oligonucleotide; PDCD1LG2 exon 4; Set C
cuucugccagaggauaaccuguagccuggcaggugagcu

SEQ ID NO: 43694 - RNA, 38 nt, Artificial Sequence
  Synthetic Oligonucleotide; PDCD1LG2 exon 4; Set C
cuucugccagaggauaaccuguagccuggcaggugagc

SEQ ID NO: 43695 - RNA, 40 nt, Artificial Sequence
  Synthetic Oligonucleotide; PDCD1LG2 exon 4; Set C
acuucugccagaggauaaccuguagccuggcaggugagcu

SEQ ID NO: 43696 - RNA, 37 nt, Artificial Sequence
  Synthetic Oligonucleotide; PDCD1LG2 exon 4; Set C
cuucugccagaggauaaccuguagccuggcaggugag

SEQ ID NO: 43697 - RNA, 39 nt, Artificial Sequence
  Synthetic Oligonucleotide; PDCD1LG2 exon 4; Set C
acuucugccagaggauaaccuguagccuggcaggugagc

SEQ ID NO: 43698 - RNA, 38 nt, Artificial Sequence
  Synthetic Oligonucleotide; PDCD1LG2 exon 4; Set C
acuucugccagaggauaaccuguagccuggcaggugag

SEQ ID NO: 43699 - RNA, 26 nt, Artificial Sequence
  Synthetic Oligonucleotide; PDCD1LG2 exon 4; Set A
cuucugccagaggauaaccuguagcc

SEQ ID NO: 43700 - RNA, 27 nt, Artificial Sequence
  Synthetic Oligonucleotide; PDCD1LG2 exon 4; Set C
acuucugccagaggauaaccuguagcc

SEQ ID NO: 43701 - RNA, 22 nt, Artificial Sequence
  Synthetic Oligonucleotide; PDCD1LG2 exon 4; Set A
cuucugccagaggauaaccugu

SEQ ID NO: 43702 - RNA, 23 nt, Artificial Sequence
  Synthetic Oligonucleotide; PDCD1LG2 exon 4; Set A
acuucugccagaggauaaccugu

SEQ ID NO: 43703 - RNA, 18 nt, Artificial Sequence
  Synthetic Oligonucleotide; PDCD1LG2 exon 4; Set C
cuucugccagaggauaac

SEQ ID NO: 43704 - RNA, 19 nt, Artificial Sequence
  Synthetic Oligonucleotide; PDCD1LG2 exon 4; Set C
acuucugccagaggauaac

SEQ ID NO: 43705 - RNA, 15 nt, Artificial Sequence
  Synthetic Oligonucleotide; PDCD1LG2 exon 4; Set C
cuucugccagaggau

SEQ ID NO: 43706 - RNA, 20 nt, Artificial Sequence
  Synthetic Oligonucleotide; PDCD1LG2 exon 4; Set C
auacuucugccagaggauaa

SEQ ID NO: 43707 - RNA, 16 nt, Artificial Sequence
  Synthetic Oligonucleotide; PDCD1LG2 exon 4; Set C
acuucugccagaggau

SEQ ID NO: 43708 - RNA, 21 nt, Artificial Sequence
  Synthetic Oligonucleotide; PDCD1LG2 exon 4; Set C
gauacuucugccagaggauaa

SEQ ID NO: 43709 - RNA, 20 nt, Artificial Sequence
  Synthetic Oligonucleotide; PDCD1LG2 exon 4; Set C
gauacuucugccagaggaua

SEQ ID NO: 43710 - RNA, 30 nt, Artificial Sequence
  Synthetic Oligonucleotide; PDCD1LG2 exon 4; Set C
uuggccaggauacuucugccagaggauaac

SEQ ID NO: 43711 - RNA, 31 nt, Artificial Sequence
  Synthetic Oligonucleotide; PDCD1LG2 exon 4; Set C
uuuggccaggauacuucugccagaggauaac

SEQ ID NO: 43712 - RNA, 32 nt, Artificial Sequence
  Synthetic Oligonucleotide; PDCD1LG2 exon 4; Set C
guuuggccaggauacuucugccagaggauaac

SEQ ID NO: 43713 - RNA, 15 nt, Artificial Sequence
  Synthetic Oligonucleotide; PDCD1LG2 exon 4; Set C
guuuggccaggauac

SEQ ID NO: 43714 - RNA, 27 nt, Artificial Sequence
  Synthetic Oligonucleotide; PDCD1LG2 exon 4; Set C
ugguguuggcaggaacgcugacguuug

SEQ ID NO: 43715 - RNA, 26 nt, Artificial Sequence
  Synthetic Oligonucleotide; PDCD1LG2 exon 4; Set C
ugguguuggcaggaacgcugacguuu

SEQ ID NO: 43716 - RNA, 25 nt, Artificial Sequence
  Synthetic Oligonucleotide; PDCD1LG2 exon 4; Set C
ugguguuggcaggaacgcugacguu

SEQ ID NO: 43717 - RNA, 32 nt, Artificial Sequence
  Synthetic Oligonucleotide; PDCD1LG2 exon 4; Set C
guggcugguguuggcaggaacgcugacguuug

SEQ ID NO: 43718 - RNA, 31 nt, Artificial Sequence
  Synthetic Oligonucleotide; PDCD1LG2 exon 4; Set C
guggcugguguuggcaggaacgcugacguuu

SEQ ID NO: 43719 - RNA, 40 nt, Artificial Sequence
  Synthetic Oligonucleotide; PDCD1LG2 exon 4; Set C
ggguccuggaguggcugguguuggcaggaacgcugacguu

SEQ ID NO: 43720 - RNA, 28 nt, Artificial Sequence
  Synthetic Oligonucleotide; PDCD1LG2 exon 4; Set C
uaggcgcagaacacuggugaccugguag

SEQ ID NO: 43721 - RNA, 29 nt, Artificial Sequence
  Synthetic Oligonucleotide; PDCD1LG2 exon 4; Set C
uuaggcgcagaacacuggugaccugguag

SEQ ID NO: 43722 - RNA, 27 nt, Artificial Sequence
  Synthetic Oligonucleotide; PDCD1LG2 exon 4; Set C
uaggcgcagaacacuggugaccuggua

SEQ ID NO: 43723 - RNA, 30 nt, Artificial Sequence
  Synthetic Oligonucleotide; PDCD1LG2 exon 4; Set C
uuuaggcgcagaacacuggugaccugguag

SEQ ID NO: 43724 - RNA, 28 nt, Artificial Sequence
  Synthetic Oligonucleotide; PDCD1LG2 exon 4; Set C
uuaggcgcagaacacuggugaccuggua

SEQ ID NO: 43725 - RNA, 29 nt, Artificial Sequence
  Synthetic Oligonucleotide; PDCD1LG2 exon 4; Set C
uuuaggcgcagaacacuggugaccuggua

SEQ ID NO: 43726 - RNA, 27 nt, Artificial Sequence
  Synthetic Oligonucleotide; PDCD1LG2 exon 4; Set C
uuaggcgcagaacacuggugaccuggu

SEQ ID NO: 43727 - RNA, 28 nt, Artificial Sequence
  Synthetic Oligonucleotide; PDCD1LG2 exon 4; Set C
uuuaggcgcagaacacuggugaccuggu

SEQ ID NO: 43728 - RNA, 35 nt, Artificial Sequence
  Synthetic Oligonucleotide; PDCD1LG2 exon 4; Set C
guggcuuuaggcgcagaacacuggugaccugguag

SEQ ID NO: 43729 - RNA, 37 nt, Artificial Sequence
  Synthetic Oligonucleotide; PDCD1LG2 exon 4; Set C
ggguggcuuuaggcgcagaacacuggugaccugguag

SEQ ID NO: 43730 - RNA, 38 nt, Artificial Sequence
  Synthetic Oligonucleotide; PDCD1LG2 exon 4; Set C
gggguggcuuuaggcgcagaacacuggugaccugguag

SEQ ID NO: 43731 - RNA, 36 nt, Artificial Sequence
  Synthetic Oligonucleotide; PDCD1LG2 exon 4; Set C
ggguggcuuuaggcgcagaacacuggugaccuggua

SEQ ID NO: 43732 - RNA, 39 nt, Artificial Sequence
  Synthetic Oligonucleotide; PDCD1LG2 exon 4; Set C
ggggguggcuuuaggcgcagaacacuggugaccugguag

SEQ ID NO: 43733 - RNA, 35 nt, Artificial Sequence
  Synthetic Oligonucleotide; PDCD1LG2 exon 4; Set C
ggguggcuuuaggcgcagaacacuggugaccuggu

SEQ ID NO: 43734 - RNA, 37 nt, Artificial Sequence
  Synthetic Oligonucleotide; PDCD1LG2 exon 4; Set C
gggguggcuuuaggcgcagaacacuggugaccuggua

SEQ ID NO: 43735 - RNA, 40 nt, Artificial Sequence
  Synthetic Oligonucleotide; PDCD1LG2 exon 4; Set C
aggggguggcuuuaggcgcagaacacuggugaccugguag

SEQ ID NO: 43736 - RNA, 38 nt, Artificial Sequence
  Synthetic Oligonucleotide; PDCD1LG2 exon 4; Set C
ggggguggcuuuaggcgcagaacacuggugaccuggua

SEQ ID NO: 43737 - RNA, 36 nt, Artificial Sequence
  Synthetic Oligonucleotide; PDCD1LG2 exon 4; Set C
gggguggcuuuaggcgcagaacacuggugaccuggu

SEQ ID NO: 43738 - RNA, 37 nt, Artificial Sequence
  Synthetic Oligonucleotide; PDCD1LG2 exon 4; Set C
ggggguggcuuuaggcgcagaacacuggugaccuggu

SEQ ID NO: 43739 - RNA, 39 nt, Artificial Sequence
  Synthetic Oligonucleotide; PDCD1LG2 exon 4; Set C
aggggguggcuuuaggcgcagaacacuggugaccuggua

SEQ ID NO: 43740 - RNA, 38 nt, Artificial Sequence
  Synthetic Oligonucleotide; PDCD1LG2 exon 4; Set C
aggggguggcuuuaggcgcagaacacuggugaccuggu

SEQ ID NO: 43741 - RNA, 39 nt, Artificial Sequence
  Synthetic Oligonucleotide; PDCD1LG2 exon 4; Set C
ccagaacacacagcugaaguuucugccaggggguggcuu

SEQ ID NO: 43742 - RNA, 34 nt, Artificial Sequence
  Synthetic Oligonucleotide; PDCD1LG2 exon 4; Set C
cagaacacacagcugaaguuucugccagggggug

SEQ ID NO: 43743 - RNA, 35 nt, Artificial Sequence
  Synthetic Oligonucleotide; PDCD1LG2 exon 4; Set C
ccagaacacacagcugaaguuucugccagggggug

SEQ ID NO: 43744 - RNA, 33 nt, Artificial Sequence
  Synthetic Oligonucleotide; PDCD1LG2 exon 4; Set C
ccagaacacacagcugaaguuucugccaggggg

SEQ ID NO: 43745 - RNA, 31 nt, Artificial Sequence
  Synthetic Oligonucleotide; PDCD1LG2 exon 4; Set C
cagaacacacagcugaaguuucugccagggg

SEQ ID NO: 43746 - RNA, 30 nt, Artificial Sequence
  Synthetic Oligonucleotide; PDCD1LG2 exon 4; Set C
cagaacacacagcugaaguuucugccaggg

SEQ ID NO: 43747 - RNA, 32 nt, Artificial Sequence
  Synthetic Oligonucleotide; PDCD1LG2 exon 4; Set C
ccagaacacacagcugaaguuucugccagggg

SEQ ID NO: 43748 - RNA, 31 nt, Artificial Sequence
  Synthetic Oligonucleotide; PDCD1LG2 exon 4; Set C
ccagaacacacagcugaaguuucugccaggg

SEQ ID NO: 43749 - RNA, 29 nt, Artificial Sequence
  Synthetic Oligonucleotide; PDCD1LG2 exon 4; Set C
cagaacacacagcugaaguuucugccagg

SEQ ID NO: 43750 - RNA, 22 nt, Artificial Sequence
  Synthetic Oligonucleotide; PDCD1LG2 exon 4; Set C
ccagaacacacagcugaaguuu

SEQ ID NO: 43751 - RNA, 21 nt, Artificial Sequence
  Synthetic Oligonucleotide; PDCD1LG2 exon 4; Set B
uucccucacgugaguauucca

SEQ ID NO: 43752 - RNA, 38 nt, Artificial Sequence
  Synthetic Oligonucleotide; PDCD1LG2 exon 4; Set C
ugcuggccaaaguaaguucccucacgugaguauuccag

SEQ ID NO: 43753 - RNA, 39 nt, Artificial Sequence
  Synthetic Oligonucleotide; PDCD1LG2 exon 4; Set C
augcuggccaaaguaaguucccucacgugaguauuccag

SEQ ID NO: 43754 - RNA, 40 nt, Artificial Sequence
  Synthetic Oligonucleotide; PDCD1LG2 exon 4; Set C
aaugcuggccaaaguaaguucccucacgugaguauuccag

SEQ ID NO: 43755 - RNA, 20 nt, Artificial Sequence
  Synthetic Oligonucleotide; PDCD1LG2 exon 4; Set C
augcuggccaaaguaaguuc

SEQ ID NO: 43756 - RNA, 21 nt, Artificial Sequence
  Synthetic Oligonucleotide; PDCD1LG2 exon 4; Set C
aaugcuggccaaaguaaguuc

SEQ ID NO: 43757 - RNA, 22 nt, Artificial Sequence
  Synthetic Oligonucleotide; PDCD1LG2 exon 4; Set C
caaugcuggccaaaguaaguuc

SEQ ID NO: 43758 - RNA, 23 nt, Artificial Sequence
  Synthetic Oligonucleotide; PDCD1LG2 exon 4; Set C
ucaaugcuggccaaaguaaguuc

SEQ ID NO: 43759 - RNA, 24 nt, Artificial Sequence
  Synthetic Oligonucleotide; PDCD1LG2 exon 4; Set C
gucaaugcuggccaaaguaaguuc

SEQ ID NO: 43760 - RNA, 25 nt, Artificial Sequence
  Synthetic Oligonucleotide; PDCD1LG2 exon 4; Set B
ggucaaugcuggccaaaguaaguuc

SEQ ID NO: 43761 - RNA, 34 nt, Artificial Sequence
  Synthetic Oligonucleotide; PDCD1LG2 exon 4; Set C
ugggggcagcucuuacuuugaaggucaaugcugg

SEQ ID NO: 43762 - RNA, 35 nt, Artificial Sequence
  Synthetic Oligonucleotide; PDCD1LG2 exon 4; Set C
gugggggcagcucuuacuuugaaggucaaugcugg

SEQ ID NO: 43763 - RNA, 33 nt, Artificial Sequence
  Synthetic Oligonucleotide; PDCD1LG2 exon 4; Set C
ugggggcagcucuuacuuugaaggucaaugcug

SEQ ID NO: 43764 - RNA, 32 nt, Artificial Sequence
  Synthetic Oligonucleotide; PDCD1LG2 exon 4; Set C
ugggggcagcucuuacuuugaaggucaaugcu

SEQ ID NO: 43765 - RNA, 36 nt, Artificial Sequence
  Synthetic Oligonucleotide; PDCD1LG2 exon 4; Set C
agugggggcagcucuuacuuugaaggucaaugcugg

SEQ ID NO: 43766 - RNA, 34 nt, Artificial Sequence
  Synthetic Oligonucleotide; PDCD1LG2 exon 4; Set C
gugggggcagcucuuacuuugaaggucaaugcug

SEQ ID NO: 43767 - RNA, 31 nt, Artificial Sequence
  Synthetic Oligonucleotide; PDCD1LG2 exon 4; Set C
ugggggcagcucuuacuuugaaggucaaugc

SEQ ID NO: 43768 - RNA, 33 nt, Artificial Sequence
  Synthetic Oligonucleotide; PDCD1LG2 exon 4; Set C
gugggggcagcucuuacuuugaaggucaaugcu

SEQ ID NO: 43769 - RNA, 35 nt, Artificial Sequence
  Synthetic Oligonucleotide; PDCD1LG2 exon 4; Set C
agugggggcagcucuuacuuugaaggucaaugcug

SEQ ID NO: 43770 - RNA, 30 nt, Artificial Sequence
  Synthetic Oligonucleotide; PDCD1LG2 exon 4; Set C
ugggggcagcucuuacuuugaaggucaaug

SEQ ID NO: 43771 - RNA, 32 nt, Artificial Sequence
  Synthetic Oligonucleotide; PDCD1LG2 exon 4; Set C
gugggggcagcucuuacuuugaaggucaaugc

SEQ ID NO: 43772 - RNA, 34 nt, Artificial Sequence
  Synthetic Oligonucleotide; PDCD1LG2 exon 4; Set C
agugggggcagcucuuacuuugaaggucaaugcu

SEQ ID NO: 43773 - RNA, 29 nt, Artificial Sequence
  Synthetic Oligonucleotide; PDCD1LG2 exon 4; Set C
ugggggcagcucuuacuuugaaggucaau

SEQ ID NO: 43774 - RNA, 31 nt, Artificial Sequence
  Synthetic Oligonucleotide; PDCD1LG2 exon 4; Set C
gugggggcagcucuuacuuugaaggucaaug

SEQ ID NO: 43775 - RNA, 33 nt, Artificial Sequence
  Synthetic Oligonucleotide; PDCD1LG2 exon 4; Set C
agugggggcagcucuuacuuugaaggucaaugc

SEQ ID NO: 43776 - RNA, 30 nt, Artificial Sequence
  Synthetic Oligonucleotide; PDCD1LG2 exon 4; Set C
gugggggcagcucuuacuuugaaggucaau

SEQ ID NO: 43777 - RNA, 28 nt, Artificial Sequence
  Synthetic Oligonucleotide; PDCD1LG2 exon 4; Set C
ugggggcagcucuuacuuugaaggucaa

SEQ ID NO: 43778 - RNA, 32 nt, Artificial Sequence
  Synthetic Oligonucleotide; PDCD1LG2 exon 4; Set C
agugggggcagcucuuacuuugaaggucaaug

SEQ ID NO: 43779 - RNA, 26 nt, Artificial Sequence
  Synthetic Oligonucleotide; PDCD1LG2 exon 4; Set C
gggggcagcucuuacuuugaagguca

SEQ ID NO: 43780 - RNA, 31 nt, Artificial Sequence
  Synthetic Oligonucleotide; PDCD1LG2 exon 4; Set C
agugggggcagcucuuacuuugaaggucaau

SEQ ID NO: 43781 - RNA, 25 nt, Artificial Sequence
  Synthetic Oligonucleotide; PDCD1LG2 exon 4; Set C
gggggcagcucuuacuuugaagguc

SEQ ID NO: 43782 - RNA, 30 nt, Artificial Sequence
  Synthetic Oligonucleotide; PDCD1LG2 exon 4; Set C
agugggggcagcucuuacuuugaaggucaa

SEQ ID NO: 43783 - RNA, 24 nt, Artificial Sequence
  Synthetic Oligonucleotide; PDCD1LG2 exon 4; Set B
gggggcagcucuuacuuugaaggu

SEQ ID NO: 43784 - RNA, 23 nt, Artificial Sequence
  Synthetic Oligonucleotide; PDCD1LG2 exon 4; Set B
gggggcagcucuuacuuugaagg

SEQ ID NO: 43785 - RNA, 35 nt, Artificial Sequence
  Synthetic Oligonucleotide; PDCD1LG2 exon 4; Set C
ccuaggaagugggggcagcucuuacuuugaagguc

SEQ ID NO: 43786 - RNA, 34 nt, Artificial Sequence
  Synthetic Oligonucleotide; PDCD1LG2 exon 4; Set C
ccuaggaagugggggcagcucuuacuuugaaggu

SEQ ID NO: 43787 - RNA, 33 nt, Artificial Sequence
  Synthetic Oligonucleotide; PDCD1LG2 exon 4; Set C
ccuaggaagugggggcagcucuuacuuugaagg

SEQ ID NO: 43788 - RNA, 35 nt, Artificial Sequence
  Synthetic Oligonucleotide; PDCD1LG2 exon 4; Set C
accuaggaagugggggcagcucuuacuuugaaggu

SEQ ID NO: 43789 - RNA, 34 nt, Artificial Sequence
  Synthetic Oligonucleotide; PDCD1LG2 exon 4; Set C
accuaggaagugggggcagcucuuacuuugaagg

SEQ ID NO: 43790 - RNA, 30 nt, Artificial Sequence
  Synthetic Oligonucleotide; PDCD1LG2 exon 4; Set B
ugaacccuaacugauagaccuaggaagugg

SEQ ID NO: 43791 - RNA, 31 nt, Artificial Sequence
  Synthetic Oligonucleotide; PDCD1LG2 exon 4; Set B
cugaacccuaacugauagaccuaggaagugg

SEQ ID NO: 43792 - RNA, 32 nt, Artificial Sequence
  Synthetic Oligonucleotide; PDCD1LG2 exon 4; Set B
ucugaacccuaacugauagaccuaggaagugg

SEQ ID NO: 43793 - RNA, 29 nt, Artificial Sequence
  Synthetic Oligonucleotide; PDCD1LG2 exon 4; Set B
cugaacccuaacugauagaccuaggaagu

SEQ ID NO: 43794 - RNA, 31 nt, Artificial Sequence
  Synthetic Oligonucleotide; PDCD1LG2 exon 4; Set B
ucugaacccuaacugauagaccuaggaagug

SEQ ID NO: 43795 - RNA, 30 nt, Artificial Sequence
  Synthetic Oligonucleotide; PDCD1LG2 exon 4; Set B
ucugaacccuaacugauagaccuaggaagu

SEQ ID NO: 43796 - RNA, 36 nt, Artificial Sequence
  Synthetic Oligonucleotide; PDCD1LG2 exon 4; Set C
cuugucugaacccuaacugauagaccuaggaagugg

SEQ ID NO: 43797 - RNA, 37 nt, Artificial Sequence
  Synthetic Oligonucleotide; PDCD1LG2 exon 4; Set C
ucuugucugaacccuaacugauagaccuaggaagugg

SEQ ID NO: 43798 - RNA, 36 nt, Artificial Sequence
  Synthetic Oligonucleotide; PDCD1LG2 exon 4; Set C
ucuugucugaacccuaacugauagaccuaggaagug

SEQ ID NO: 43799 - RNA, 35 nt, Artificial Sequence
  Synthetic Oligonucleotide; PDCD1LG2 exon 4; Set C
ucuugucugaacccuaacugauagaccuaggaagu

SEQ ID NO: 43800 - RNA, 20 nt, Artificial Sequence
  Synthetic Oligonucleotide; PDCD1LG2 exon 4; Set C
ugaacccuaacugauagacc

SEQ ID NO: 43801 - RNA, 26 nt, Artificial Sequence
  Synthetic Oligonucleotide; PDCD1LG2 exon 4; Set B
cuugucugaacccuaacugauagacc

SEQ ID NO: 43802 - RNA, 21 nt, Artificial Sequence
  Synthetic Oligonucleotide; REL exon 2; Set C
gguuauacgcaccugaaaagu

SEQ ID NO: 43803 - RNA, 15 nt, Artificial Sequence
  Synthetic Oligonucleotide; REL exon 2; Set C
uggguuguucaauua

SEQ ID NO: 43804 - RNA, 15 nt, Artificial Sequence
  Synthetic Oligonucleotide; REL exon 2; Set C
uauguucgguuguug

SEQ ID NO: 43805 - RNA, 16 nt, Artificial Sequence
  Synthetic Oligonucleotide; REL exon 2; Set C
guauguucgguuguug

SEQ ID NO: 43806 - RNA, 15 nt, Artificial Sequence
  Synthetic Oligonucleotide; REL exon 2; Set C
guauguucgguuguu

SEQ ID NO: 43807 - RNA, 17 nt, Artificial Sequence
  Synthetic Oligonucleotide; REL exon 2; Set C
gguauguucgguuguug

SEQ ID NO: 43808 - RNA, 16 nt, Artificial Sequence
  Synthetic Oligonucleotide; REL exon 2; Set C
gguauguucgguuguu

SEQ ID NO: 43809 - RNA, 18 nt, Artificial Sequence
  Synthetic Oligonucleotide; REL exon 2; Set C
ggguauguucgguuguug

SEQ ID NO: 43810 - RNA, 17 nt, Artificial Sequence
  Synthetic Oligonucleotide; REL exon 2; Set C
ggguauguucgguuguu

SEQ ID NO: 43811 - RNA, 40 nt, Artificial Sequence
  Synthetic Oligonucleotide; REL exon 2; Set A
aguuuuuaaaaaggaggaggucagugagauuaauauagca

SEQ ID NO: 43812 - RNA, 39 nt, Artificial Sequence
  Synthetic Oligonucleotide; REL exon 2; Set A
aguuuuuaaaaaggaggaggucagugagauuaauauagc

SEQ ID NO: 43813 - RNA, 38 nt, Artificial Sequence
  Synthetic Oligonucleotide; REL exon 2; Set A
aguuuuuaaaaaggaggaggucagugagauuaauauag

SEQ ID NO: 43814 - RNA, 37 nt, Artificial Sequence
  Synthetic Oligonucleotide; REL exon 2; Set A
aguuuuuaaaaaggaggaggucagugagauuaauaua

SEQ ID NO: 43815 - RNA, 28 nt, Artificial Sequence
  Synthetic Oligonucleotide; REL exon 2; Set C
aguuuuuaaaaaggaggaggucagugag

SEQ ID NO: 43816 - RNA, 27 nt, Artificial Sequence
  Synthetic Oligonucleotide; REL exon 2; Set C
aguuuuuaaaaaggaggaggucaguga

SEQ ID NO: 43817 - RNA, 26 nt, Artificial Sequence
  Synthetic Oligonucleotide; REL exon 2; Set C
aguuuuuaaaaaggaggaggucagug

SEQ ID NO: 43818 - RNA, 25 nt, Artificial Sequence
  Synthetic Oligonucleotide; REL exon 2; Set C
aguuuuuaaaaaggaggaggucagu

SEQ ID NO: 43819 - RNA, 24 nt, Artificial Sequence
  Synthetic Oligonucleotide; REL exon 2; Set C
aguuuuuaaaaaggaggaggucag

SEQ ID NO: 43820 - RNA, 23 nt, Artificial Sequence
  Synthetic Oligonucleotide; REL exon 2; Set C
aguuuuuaaaaaggaggagguca

SEQ ID NO: 43821 - RNA, 22 nt, Artificial Sequence
  Synthetic Oligonucleotide; REL exon 2; Set C
aguuuuuaaaaaggaggagguc

SEQ ID NO: 43822 - RNA, 40 nt, Artificial Sequence
  Synthetic Oligonucleotide; REL exon 2; Set A
auacgcaccugaaaaguuuuuaaaaaggaggaggucagug

SEQ ID NO: 43823 - RNA, 39 nt, Artificial Sequence
  Synthetic Oligonucleotide; REL exon 2; Set A
auacgcaccugaaaaguuuuuaaaaaggaggaggucagu

SEQ ID NO: 43824 - RNA, 38 nt, Artificial Sequence
  Synthetic Oligonucleotide; REL exon 2; Set A
auacgcaccugaaaaguuuuuaaaaaggaggaggucag

SEQ ID NO: 43825 - RNA, 40 nt, Artificial Sequence
  Synthetic Oligonucleotide; REL exon 2; Set A
uauacgcaccugaaaaguuuuuaaaaaggaggaggucagu

SEQ ID NO: 43826 - RNA, 39 nt, Artificial Sequence
  Synthetic Oligonucleotide; REL exon 2; Set A
uauacgcaccugaaaaguuuuuaaaaaggaggaggucag

SEQ ID NO: 43827 - RNA, 37 nt, Artificial Sequence
  Synthetic Oligonucleotide; REL exon 2; Set A
auacgcaccugaaaaguuuuuaaaaaggaggagguca

SEQ ID NO: 43828 - RNA, 40 nt, Artificial Sequence
  Synthetic Oligonucleotide; REL exon 2; Set A
uuauacgcaccugaaaaguuuuuaaaaaggaggaggucag

SEQ ID NO: 43829 - RNA, 38 nt, Artificial Sequence
  Synthetic Oligonucleotide; REL exon 2; Set A
uauacgcaccugaaaaguuuuuaaaaaggaggagguca

SEQ ID NO: 43830 - RNA, 36 nt, Artificial Sequence
  Synthetic Oligonucleotide; REL exon 2; Set A
auacgcaccugaaaaguuuuuaaaaaggaggagguc

SEQ ID NO: 43831 - RNA, 15 nt, Artificial Sequence
  Synthetic Oligonucleotide; REL exon 2; Set C
gaaaaguuuuuaaaa

SEQ ID NO: 43832 - RNA, 39 nt, Artificial Sequence
  Synthetic Oligonucleotide; REL exon 2; Set A
uuauacgcaccugaaaaguuuuuaaaaaggaggagguca

SEQ ID NO: 43833 - RNA, 37 nt, Artificial Sequence
  Synthetic Oligonucleotide; REL exon 2; Set A
uauacgcaccugaaaaguuuuuaaaaaggaggagguc

SEQ ID NO: 43834 - RNA, 35 nt, Artificial Sequence
  Synthetic Oligonucleotide; REL exon 2; Set A
auacgcaccugaaaaguuuuuaaaaaggaggaggu

SEQ ID NO: 43835 - RNA, 16 nt, Artificial Sequence
  Synthetic Oligonucleotide; REL exon 2; Set C
ugaaaaguuuuuaaaa

SEQ ID NO: 43836 - RNA, 40 nt, Artificial Sequence
  Synthetic Oligonucleotide; REL exon 2; Set A
guuauacgcaccugaaaaguuuuuaaaaaggaggagguca

SEQ ID NO: 43837 - RNA, 38 nt, Artificial Sequence
  Synthetic Oligonucleotide; REL exon 2; Set A
uuauacgcaccugaaaaguuuuuaaaaaggaggagguc

SEQ ID NO: 43838 - RNA, 36 nt, Artificial Sequence
  Synthetic Oligonucleotide; REL exon 2; Set A
uauacgcaccugaaaaguuuuuaaaaaggaggaggu

SEQ ID NO: 43839 - RNA, 17 nt, Artificial Sequence
  Synthetic Oligonucleotide; REL exon 2; Set C
cugaaaaguuuuuaaaa

SEQ ID NO: 43840 - RNA, 39 nt, Artificial Sequence
  Synthetic Oligonucleotide; REL exon 2; Set A
guuauacgcaccugaaaaguuuuuaaaaaggaggagguc

SEQ ID NO: 43841 - RNA, 37 nt, Artificial Sequence
  Synthetic Oligonucleotide; REL exon 2; Set A
uuauacgcaccugaaaaguuuuuaaaaaggaggaggu

SEQ ID NO: 43842 - RNA, 15 nt, Artificial Sequence
  Synthetic Oligonucleotide; REL exon 2; Set C
ugaaaaguuuuuaaa

SEQ ID NO: 43843 - RNA, 40 nt, Artificial Sequence
  Synthetic Oligonucleotide; REL exon 2; Set A
gguuauacgcaccugaaaaguuuuuaaaaaggaggagguc

SEQ ID NO: 43844 - RNA, 38 nt, Artificial Sequence
  Synthetic Oligonucleotide; REL exon 2; Set A
guuauacgcaccugaaaaguuuuuaaaaaggaggaggu

SEQ ID NO: 43845 - RNA, 16 nt, Artificial Sequence
  Synthetic Oligonucleotide; REL exon 2; Set C
cugaaaaguuuuuaaa

SEQ ID NO: 43846 - RNA, 39 nt, Artificial Sequence
  Synthetic Oligonucleotide; REL exon 2; Set A
gguuauacgcaccugaaaaguuuuuaaaaaggaggaggu

SEQ ID NO: 43847 - RNA, 15 nt, Artificial Sequence
  Synthetic Oligonucleotide; REL exon 2; Set C
cugaaaaguuuuuaa

SEQ ID NO: 43848 - RNA, 25 nt, Artificial Sequence
  Synthetic Oligonucleotide; REL exon 2; Set C
auacgcaccugaaaaguuuuuaaaa

SEQ ID NO: 43849 - RNA, 26 nt, Artificial Sequence
  Synthetic Oligonucleotide; REL exon 2; Set C
uauacgcaccugaaaaguuuuuaaaa

SEQ ID NO: 43850 - RNA, 24 nt, Artificial Sequence
  Synthetic Oligonucleotide; REL exon 2; Set C
auacgcaccugaaaaguuuuuaaa

SEQ ID NO: 43851 - RNA, 27 nt, Artificial Sequence
  Synthetic Oligonucleotide; REL exon 2; Set C
uuauacgcaccugaaaaguuuuuaaaa

SEQ ID NO: 43852 - RNA, 25 nt, Artificial Sequence
  Synthetic Oligonucleotide; REL exon 2; Set C
uauacgcaccugaaaaguuuuuaaa

SEQ ID NO: 43853 - RNA, 23 nt, Artificial Sequence
  Synthetic Oligonucleotide; REL exon 2; Set C
auacgcaccugaaaaguuuuuaa

SEQ ID NO: 43854 - RNA, 28 nt, Artificial Sequence
  Synthetic Oligonucleotide; REL exon 2; Set C
guuauacgcaccugaaaaguuuuuaaaa

SEQ ID NO: 43855 - RNA, 26 nt, Artificial Sequence
  Synthetic Oligonucleotide; REL exon 2; Set C
uuauacgcaccugaaaaguuuuuaaa

SEQ ID NO: 43856 - RNA, 24 nt, Artificial Sequence
  Synthetic Oligonucleotide; REL exon 2; Set C
uauacgcaccugaaaaguuuuuaa

SEQ ID NO: 43857 - RNA, 22 nt, Artificial Sequence
  Synthetic Oligonucleotide; REL exon 2; Set C
auacgcaccugaaaaguuuuua

SEQ ID NO: 43858 - RNA, 29 nt, Artificial Sequence
  Synthetic Oligonucleotide; REL exon 2; Set C
gguuauacgcaccugaaaaguuuuuaaaa

SEQ ID NO: 43859 - RNA, 27 nt, Artificial Sequence
  Synthetic Oligonucleotide; REL exon 2; Set C
guuauacgcaccugaaaaguuuuuaaa

SEQ ID NO: 43860 - RNA, 25 nt, Artificial Sequence
  Synthetic Oligonucleotide; REL exon 2; Set C
uuauacgcaccugaaaaguuuuuaa

SEQ ID NO: 43861 - RNA, 23 nt, Artificial Sequence
  Synthetic Oligonucleotide; REL exon 2; Set C
uauacgcaccugaaaaguuuuua

SEQ ID NO: 43862 - RNA, 21 nt, Artificial Sequence
  Synthetic Oligonucleotide; REL exon 2; Set C
auacgcaccugaaaaguuuuu

SEQ ID NO: 43863 - RNA, 20 nt, Artificial Sequence
  Synthetic Oligonucleotide; REL exon 2; Set C
auacgcaccugaaaaguuuu

SEQ ID NO: 43864 - RNA, 28 nt, Artificial Sequence
  Synthetic Oligonucleotide; REL exon 2; Set C
gguuauacgcaccugaaaaguuuuuaaa

SEQ ID NO: 43865 - RNA, 26 nt, Artificial Sequence
  Synthetic Oligonucleotide; REL exon 2; Set C
guuauacgcaccugaaaaguuuuuaa

SEQ ID NO: 43866 - RNA, 24 nt, Artificial Sequence
  Synthetic Oligonucleotide; REL exon 2; Set C
uuauacgcaccugaaaaguuuuua

SEQ ID NO: 43867 - RNA, 22 nt, Artificial Sequence
  Synthetic Oligonucleotide; REL exon 2; Set C
uauacgcaccugaaaaguuuuu

SEQ ID NO: 43868 - RNA, 21 nt, Artificial Sequence
  Synthetic Oligonucleotide; REL exon 2; Set C
uauacgcaccugaaaaguuuu

SEQ ID NO: 43869 - RNA, 27 nt, Artificial Sequence
  Synthetic Oligonucleotide; REL exon 2; Set C
gguuauacgcaccugaaaaguuuuuaa

SEQ ID NO: 43870 - RNA, 25 nt, Artificial Sequence
  Synthetic Oligonucleotide; REL exon 2; Set C
guuauacgcaccugaaaaguuuuua

SEQ ID NO: 43871 - RNA, 23 nt, Artificial Sequence
  Synthetic Oligonucleotide; REL exon 2; Set C
uuauacgcaccugaaaaguuuuu

SEQ ID NO: 43872 - RNA, 19 nt, Artificial Sequence
  Synthetic Oligonucleotide; REL exon 2; Set C
auacgcaccugaaaaguuu

SEQ ID NO: 43873 - RNA, 18 nt, Artificial Sequence
  Synthetic Oligonucleotide; REL exon 2; Set C
auacgcaccugaaaaguu

SEQ ID NO: 43874 - RNA, 22 nt, Artificial Sequence
  Synthetic Oligonucleotide; REL exon 2; Set C
uuauacgcaccugaaaaguuuu

SEQ ID NO: 43875 - RNA, 26 nt, Artificial Sequence
  Synthetic Oligonucleotide; REL exon 2; Set C
gguuauacgcaccugaaaaguuuuua

SEQ ID NO: 43876 - RNA, 24 nt, Artificial Sequence
  Synthetic Oligonucleotide; REL exon 2; Set C
guuauacgcaccugaaaaguuuuu

SEQ ID NO: 43877 - RNA, 20 nt, Artificial Sequence
  Synthetic Oligonucleotide; REL exon 2; Set C
uauacgcaccugaaaaguuu

SEQ ID NO: 43878 - RNA, 17 nt, Artificial Sequence
  Synthetic Oligonucleotide; REL exon 2; Set C
auacgcaccugaaaagu

SEQ ID NO: 43879 - RNA, 19 nt, Artificial Sequence
  Synthetic Oligonucleotide; REL exon 2; Set C
uauacgcaccugaaaaguu

SEQ ID NO: 43880 - RNA, 23 nt, Artificial Sequence
  Synthetic Oligonucleotide; REL exon 2; Set C
guuauacgcaccugaaaaguuuu

SEQ ID NO: 43881 - RNA, 25 nt, Artificial Sequence
  Synthetic Oligonucleotide; REL exon 2; Set C
gguuauacgcaccugaaaaguuuuu

SEQ ID NO: 43882 - RNA, 21 nt, Artificial Sequence
  Synthetic Oligonucleotide; REL exon 2; Set C
uuauacgcaccugaaaaguuu

SEQ ID NO: 43883 - RNA, 18 nt, Artificial Sequence
  Synthetic Oligonucleotide; REL exon 2; Set C
uauacgcaccugaaaagu

SEQ ID NO: 43884 - RNA, 20 nt, Artificial Sequence
  Synthetic Oligonucleotide; REL exon 2; Set C
uuauacgcaccugaaaaguu

SEQ ID NO: 43885 - RNA, 24 nt, Artificial Sequence
  Synthetic Oligonucleotide; REL exon 2; Set C
gguuauacgcaccugaaaaguuuu

SEQ ID NO: 43886 - RNA, 22 nt, Artificial Sequence
  Synthetic Oligonucleotide; REL exon 2; Set C
guuauacgcaccugaaaaguuu

SEQ ID NO: 43887 - RNA, 19 nt, Artificial Sequence
  Synthetic Oligonucleotide; REL exon 2; Set C
uuauacgcaccugaaaagu

SEQ ID NO: 43888 - RNA, 21 nt, Artificial Sequence
  Synthetic Oligonucleotide; REL exon 2; Set C
guuauacgcaccugaaaaguu

SEQ ID NO: 43889 - RNA, 23 nt, Artificial Sequence
  Synthetic Oligonucleotide; REL exon 2; Set C
gguuauacgcaccugaaaaguuu

SEQ ID NO: 43890 - RNA, 20 nt, Artificial Sequence
  Synthetic Oligonucleotide; REL exon 2; Set C
guuauacgcaccugaaaagu

SEQ ID NO: 43891 - RNA, 22 nt, Artificial Sequence
  Synthetic Oligonucleotide; REL exon 2; Set C
gguuauacgcaccugaaaaguu

SEQ ID NO: 43892 - RNA, 37 nt, Artificial Sequence
  Synthetic Oligonucleotide; REL exon 2; Set A
uauauacggguuauacgcaccugaaaaguuuuuaaaa

SEQ ID NO: 43893 - RNA, 15 nt, Artificial Sequence
  Synthetic Oligonucleotide; REL exon 2; Set C
uuauacgcaccugaa

SEQ ID NO: 43894 - RNA, 16 nt, Artificial Sequence
  Synthetic Oligonucleotide; REL exon 2; Set C
guuauacgcaccugaa

SEQ ID NO: 43895 - RNA, 15 nt, Artificial Sequence
  Synthetic Oligonucleotide; REL exon 2; Set C
guuauacgcaccuga

SEQ ID NO: 43896 - RNA, 17 nt, Artificial Sequence
  Synthetic Oligonucleotide; REL exon 2; Set C
gguuauacgcaccugaa

SEQ ID NO: 43897 - RNA, 16 nt, Artificial Sequence
  Synthetic Oligonucleotide; REL exon 2; Set C
gguuauacgcaccuga

SEQ ID NO: 43898 - RNA, 15 nt, Artificial Sequence
  Synthetic Oligonucleotide; REL exon 2; Set C
gguuauacgcaccug

SEQ ID NO: 43899 - RNA, 29 nt, Artificial Sequence
  Synthetic Oligonucleotide; REL exon 2; Set A
uauauacggguuauacgcaccugaaaagu

SEQ ID NO: 43900 - RNA, 38 nt, Artificial Sequence
  Synthetic Oligonucleotide; REL exon 2; Set A
aauuaucucuauauacggguuauacgcaccugaaaagu

SEQ ID NO: 43901 - RNA, 39 nt, Artificial Sequence
  Synthetic Oligonucleotide; REL exon 2; Set A
caauuaucucuauauacggguuauacgcaccugaaaagu

SEQ ID NO: 43902 - RNA, 40 nt, Artificial Sequence
  Synthetic Oligonucleotide; REL exon 2; Set C
ucaauuaucucuauauacggguuauacgcaccugaaaagu

SEQ ID NO: 43903 - RNA, 15 nt, Artificial Sequence
  Synthetic Oligonucleotide; REL exon 2; Set C
uauauacggguuaua

SEQ ID NO: 43904 - RNA, 26 nt, Artificial Sequence
  Synthetic Oligonucleotide; REL exon 2; Set C
ucaauuaucucuauauacggguuaua

SEQ ID NO: 43905 - RNA, 27 nt, Artificial Sequence
  Synthetic Oligonucleotide; REL exon 2; Set C
uucaauuaucucuauauacggguuaua

SEQ ID NO: 43906 - RNA, 26 nt, Artificial Sequence
  Synthetic Oligonucleotide; REL exon 2; Set C
uucaauuaucucuauauacggguuau

SEQ ID NO: 43907 - RNA, 28 nt, Artificial Sequence
  Synthetic Oligonucleotide; REL exon 2; Set C
guucaauuaucucuauauacggguuaua

SEQ ID NO: 43908 - RNA, 27 nt, Artificial Sequence
  Synthetic Oligonucleotide; REL exon 2; Set C
guucaauuaucucuauauacggguuau

SEQ ID NO: 43909 - RNA, 25 nt, Artificial Sequence
  Synthetic Oligonucleotide; REL exon 2; Set C
uucaauuaucucuauauacggguua

SEQ ID NO: 43910 - RNA, 29 nt, Artificial Sequence
  Synthetic Oligonucleotide; REL exon 2; Set C
uguucaauuaucucuauauacggguuaua

SEQ ID NO: 43911 - RNA, 28 nt, Artificial Sequence
  Synthetic Oligonucleotide; REL exon 2; Set C
uguucaauuaucucuauauacggguuau

SEQ ID NO: 43912 - RNA, 26 nt, Artificial Sequence
  Synthetic Oligonucleotide; REL exon 2; Set C
guucaauuaucucuauauacggguua

SEQ ID NO: 43913 - RNA, 30 nt, Artificial Sequence
  Synthetic Oligonucleotide; REL exon 2; Set C
uuguucaauuaucucuauauacggguuaua

SEQ ID NO: 43914 - RNA, 27 nt, Artificial Sequence
  Synthetic Oligonucleotide; REL exon 2; Set C
uguucaauuaucucuauauacggguua

SEQ ID NO: 43915 - RNA, 25 nt, Artificial Sequence
  Synthetic Oligonucleotide; REL exon 2; Set C
guucaauuaucucuauauacggguu

SEQ ID NO: 43916 - RNA, 29 nt, Artificial Sequence
  Synthetic Oligonucleotide; REL exon 2; Set C
uuguucaauuaucucuauauacggguuau

SEQ ID NO: 43917 - RNA, 31 nt, Artificial Sequence
  Synthetic Oligonucleotide; REL exon 2; Set A
guuguucaauuaucucuauauacggguuaua

SEQ ID NO: 43918 - RNA, 24 nt, Artificial Sequence
  Synthetic Oligonucleotide; REL exon 2; Set C
guucaauuaucucuauauacgggu

SEQ ID NO: 43919 - RNA, 26 nt, Artificial Sequence
  Synthetic Oligonucleotide; REL exon 2; Set C
uguucaauuaucucuauauacggguu

SEQ ID NO: 43920 - RNA, 28 nt, Artificial Sequence
  Synthetic Oligonucleotide; REL exon 2; Set C
uuguucaauuaucucuauauacggguua

SEQ ID NO: 43921 - RNA, 30 nt, Artificial Sequence
  Synthetic Oligonucleotide; REL exon 2; Set A
guuguucaauuaucucuauauacggguuau

SEQ ID NO: 43922 - RNA, 32 nt, Artificial Sequence
  Synthetic Oligonucleotide; REL exon 2; Set A
gguuguucaauuaucucuauauacggguuaua

SEQ ID NO: 43923 - RNA, 25 nt, Artificial Sequence
  Synthetic Oligonucleotide; REL exon 2; Set C
uguucaauuaucucuauauacgggu

SEQ ID NO: 43924 - RNA, 27 nt, Artificial Sequence
  Synthetic Oligonucleotide; REL exon 2; Set C
uuguucaauuaucucuauauacggguu

SEQ ID NO: 43925 - RNA, 31 nt, Artificial Sequence
  Synthetic Oligonucleotide; REL exon 2; Set A
gguuguucaauuaucucuauauacggguuau

SEQ ID NO: 43926 - RNA, 29 nt, Artificial Sequence
  Synthetic Oligonucleotide; REL exon 2; Set A
guuguucaauuaucucuauauacggguua

SEQ ID NO: 43927 - RNA, 33 nt, Artificial Sequence
  Synthetic Oligonucleotide; REL exon 2; Set A
ggguuguucaauuaucucuauauacggguuaua

SEQ ID NO: 43928 - RNA, 26 nt, Artificial Sequence
  Synthetic Oligonucleotide; REL exon 2; Set C
uuguucaauuaucucuauauacgggu

SEQ ID NO: 43929 - RNA, 32 nt, Artificial Sequence
  Synthetic Oligonucleotide; REL exon 2; Set A
ggguuguucaauuaucucuauauacggguuau

SEQ ID NO: 43930 - RNA, 30 nt, Artificial Sequence
  Synthetic Oligonucleotide; REL exon 2; Set A
gguuguucaauuaucucuauauacggguua

SEQ ID NO: 43931 - RNA, 28 nt, Artificial Sequence
  Synthetic Oligonucleotide; REL exon 2; Set C
guuguucaauuaucucuauauacggguu

SEQ ID NO: 43932 - RNA, 34 nt, Artificial Sequence
  Synthetic Oligonucleotide; REL exon 2; Set A
uggguuguucaauuaucucuauauacggguuaua

SEQ ID NO: 43933 - RNA, 27 nt, Artificial Sequence
  Synthetic Oligonucleotide; REL exon 2; Set C
guuguucaauuaucucuauauacgggu

SEQ ID NO: 43934 - RNA, 31 nt, Artificial Sequence
  Synthetic Oligonucleotide; REL exon 2; Set A
ggguuguucaauuaucucuauauacggguua

SEQ ID NO: 43935 - RNA, 29 nt, Artificial Sequence
  Synthetic Oligonucleotide; REL exon 2; Set A
gguuguucaauuaucucuauauacggguu

SEQ ID NO: 43936 - RNA, 33 nt, Artificial Sequence
  Synthetic Oligonucleotide; REL exon 2; Set A
uggguuguucaauuaucucuauauacggguuau

SEQ ID NO: 43937 - RNA, 35 nt, Artificial Sequence
  Synthetic Oligonucleotide; REL exon 2; Set A
cuggguuguucaauuaucucuauauacggguuaua

SEQ ID NO: 43938 - RNA, 28 nt, Artificial Sequence
  Synthetic Oligonucleotide; REL exon 2; Set A
gguuguucaauuaucucuauauacgggu

SEQ ID NO: 43939 - RNA, 30 nt, Artificial Sequence
  Synthetic Oligonucleotide; REL exon 2; Set A
ggguuguucaauuaucucuauauacggguu

SEQ ID NO: 43940 - RNA, 32 nt, Artificial Sequence
  Synthetic Oligonucleotide; REL exon 2; Set A
uggguuguucaauuaucucuauauacggguua

SEQ ID NO: 43941 - RNA, 34 nt, Artificial Sequence
  Synthetic Oligonucleotide; REL exon 2; Set A
cuggguuguucaauuaucucuauauacggguuau

SEQ ID NO: 43942 - RNA, 29 nt, Artificial Sequence
  Synthetic Oligonucleotide; REL exon 2; Set A
ggguuguucaauuaucucuauauacgggu

SEQ ID NO: 43943 - RNA, 31 nt, Artificial Sequence
  Synthetic Oligonucleotide; REL exon 2; Set A
uggguuguucaauuaucucuauauacggguu

SEQ ID NO: 43944 - RNA, 33 nt, Artificial Sequence
  Synthetic Oligonucleotide; REL exon 2; Set A
cuggguuguucaauuaucucuauauacggguua

SEQ ID NO: 43945 - RNA, 30 nt, Artificial Sequence
  Synthetic Oligonucleotide; REL exon 2; Set A
uggguuguucaauuaucucuauauacgggu

SEQ ID NO: 43946 - RNA, 15 nt, Artificial Sequence
  Synthetic Oligonucleotide; REL exon 2; Set C
uucaauuaucucuau

SEQ ID NO: 43947 - RNA, 16 nt, Artificial Sequence
  Synthetic Oligonucleotide; REL exon 2; Set C
guucaauuaucucuau

SEQ ID NO: 43948 - RNA, 17 nt, Artificial Sequence
  Synthetic Oligonucleotide; REL exon 2; Set C
uguucaauuaucucuau

SEQ ID NO: 43949 - RNA, 18 nt, Artificial Sequence
  Synthetic Oligonucleotide; REL exon 2; Set C
uuguucaauuaucucuau

SEQ ID NO: 43950 - RNA, 19 nt, Artificial Sequence
  Synthetic Oligonucleotide; REL exon 2; Set C
guuguucaauuaucucuau

SEQ ID NO: 43951 - RNA, 20 nt, Artificial Sequence
  Synthetic Oligonucleotide; REL exon 2; Set C
gguuguucaauuaucucuau

SEQ ID NO: 43952 - RNA, 21 nt, Artificial Sequence
  Synthetic Oligonucleotide; REL exon 2; Set C
ggguuguucaauuaucucuau

SEQ ID NO: 43953 - RNA, 22 nt, Artificial Sequence
  Synthetic Oligonucleotide; REL exon 2; Set C
uggguuguucaauuaucucuau

SEQ ID NO: 43954 - RNA, 23 nt, Artificial Sequence
  Synthetic Oligonucleotide; REL exon 2; Set C
cuggguuguucaauuaucucuau

SEQ ID NO: 43955 - RNA, 15 nt, Artificial Sequence
  Synthetic Oligonucleotide; REL exon 2; Set C
ggguuguucaauuau

SEQ ID NO: 43956 - RNA, 16 nt, Artificial Sequence
  Synthetic Oligonucleotide; REL exon 2; Set C
cuggguuguucaauua

SEQ ID NO: 43957 - RNA, 15 nt, Artificial Sequence
  Synthetic Oligonucleotide; REL exon 2; Set C
cuggguuguucaauu

SEQ ID NO: 43958 - RNA, 16 nt, Artificial Sequence
  Synthetic Oligonucleotide; REL exon 2; Set C
augcugccugcugauc

SEQ ID NO: 43959 - RNA, 15 nt, Artificial Sequence
  Synthetic Oligonucleotide; REL exon 2; Set C
augcugccugcugau

SEQ ID NO: 43960 - RNA, 15 nt, Artificial Sequence
  Synthetic Oligonucleotide; REL exon 2; Set C
aaugcugccugcuga

SEQ ID NO: 43961 - RNA, 27 nt, Artificial Sequence
  Synthetic Oligonucleotide; REL exon 2; Set C
gugcuccccuggaaugcugccugcuga

SEQ ID NO: 43962 - RNA, 22 nt, Artificial Sequence
  Synthetic Oligonucleotide; REL exon 2; Set C
gugcuccccuggaaugcugccu

SEQ ID NO: 43963 - RNA, 16 nt, Artificial Sequence
  Synthetic Oligonucleotide; REL exon 2; Set C
gugcuccccuggaaug

SEQ ID NO: 43964 - RNA, 38 nt, Artificial Sequence
  Synthetic Oligonucleotide; REL exon 2; Set C
uugucugugcugugcuccccuggaaugcugccugcuga

SEQ ID NO: 43965 - RNA, 17 nt, Artificial Sequence
  Synthetic Oligonucleotide; REL exon 2; Set C
ugugcuccccuggaaug

SEQ ID NO: 43966 - RNA, 39 nt, Artificial Sequence
  Synthetic Oligonucleotide; REL exon 2; Set C
guugucugugcugugcuccccuggaaugcugccugcuga

SEQ ID NO: 43967 - RNA, 15 nt, Artificial Sequence
  Synthetic Oligonucleotide; REL exon 2; Set C
gugcuccccuggaau

SEQ ID NO: 43968 - RNA, 40 nt, Artificial Sequence
  Synthetic Oligonucleotide; REL exon 2; Set C
uguugucugugcugugcuccccuggaaugcugccugcuga

SEQ ID NO: 43969 - RNA, 27 nt, Artificial Sequence
  Synthetic Oligonucleotide; REL exon 2; Set C
uugucugugcugugcuccccuggaaug

SEQ ID NO: 43970 - RNA, 28 nt, Artificial Sequence
  Synthetic Oligonucleotide; REL exon 2; Set C
guugucugugcugugcuccccuggaaug

SEQ ID NO: 43971 - RNA, 29 nt, Artificial Sequence
  Synthetic Oligonucleotide; REL exon 2; Set C
uguugucugugcugugcuccccuggaaug

SEQ ID NO: 43972 - RNA, 30 nt, Artificial Sequence
  Synthetic Oligonucleotide; REL exon 2; Set C
uuguugucugugcugugcuccccuggaaug

SEQ ID NO: 43973 - RNA, 31 nt, Artificial Sequence
  Synthetic Oligonucleotide; REL exon 2; Set C
guuguugucugugcugugcuccccuggaaug

SEQ ID NO: 43974 - RNA, 32 nt, Artificial Sequence
  Synthetic Oligonucleotide; REL exon 2; Set C
gguuguugucugugcugugcuccccuggaaug

SEQ ID NO: 43975 - RNA, 38 nt, Artificial Sequence
  Synthetic Oligonucleotide; REL exon 2; Set C
auguucgguuguugucugugcugugcuccccuggaaug

SEQ ID NO: 43976 - RNA, 39 nt, Artificial Sequence
  Synthetic Oligonucleotide; REL exon 2; Set C
uauguucgguuguugucugugcugugcuccccuggaaug

SEQ ID NO: 43977 - RNA, 40 nt, Artificial Sequence
  Synthetic Oligonucleotide; REL exon 2; Set C
guauguucgguuguugucugugcugugcuccccuggaaug

SEQ ID NO: 43978 - RNA, 17 nt, Artificial Sequence
  Synthetic Oligonucleotide; REL exon 2; Set C
uuguugucugugcugug

SEQ ID NO: 43979 - RNA, 18 nt, Artificial Sequence
  Synthetic Oligonucleotide; REL exon 2; Set C
guuguugucugugcugug

SEQ ID NO: 43980 - RNA, 19 nt, Artificial Sequence
  Synthetic Oligonucleotide; REL exon 2; Set C
gguuguugucugugcugug

SEQ ID NO: 43981 - RNA, 25 nt, Artificial Sequence
  Synthetic Oligonucleotide; REL exon 2; Set A
auguucgguuguugucugugcugug

SEQ ID NO: 43982 - RNA, 26 nt, Artificial Sequence
  Synthetic Oligonucleotide; REL exon 2; Set A
uauguucgguuguugucugugcugug

SEQ ID NO: 43983 - RNA, 27 nt, Artificial Sequence
  Synthetic Oligonucleotide; REL exon 2; Set A
guauguucgguuguugucugugcugug

SEQ ID NO: 43984 - RNA, 28 nt, Artificial Sequence
  Synthetic Oligonucleotide; REL exon 2; Set C
gguauguucgguuguugucugugcugug

SEQ ID NO: 43985 - RNA, 29 nt, Artificial Sequence
  Synthetic Oligonucleotide; REL exon 2; Set C
ggguauguucgguuguugucugugcugug

SEQ ID NO: 43986 - RNA, 38 nt, Artificial Sequence
  Synthetic Oligonucleotide; REL exon 2; Set C
uggauagaaggguauguucgguuguugucugugcugug

SEQ ID NO: 43987 - RNA, 15 nt, Artificial Sequence
  Synthetic Oligonucleotide; REL exon 2; Set C
gguauguucgguugu

SEQ ID NO: 43988 - RNA, 16 nt, Artificial Sequence
  Synthetic Oligonucleotide; REL exon 2; Set C
ggguauguucgguugu

SEQ ID NO: 43989 - RNA, 15 nt, Artificial Sequence
  Synthetic Oligonucleotide; REL exon 2; Set C
ggguauguucgguug

SEQ ID NO: 43990 - RNA, 24 nt, Artificial Sequence
  Synthetic Oligonucleotide; REL exon 2; Set C
auagaaggguauguucgguuguug

SEQ ID NO: 43991 - RNA, 25 nt, Artificial Sequence
  Synthetic Oligonucleotide; REL exon 2; Set B
gauagaaggguauguucgguuguug

SEQ ID NO: 43992 - RNA, 23 nt, Artificial Sequence
  Synthetic Oligonucleotide; REL exon 2; Set C
auagaaggguauguucgguuguu

SEQ ID NO: 43993 - RNA, 26 nt, Artificial Sequence
  Synthetic Oligonucleotide; REL exon 2; Set B
ggauagaaggguauguucgguuguug

SEQ ID NO: 43994 - RNA, 24 nt, Artificial Sequence
  Synthetic Oligonucleotide; REL exon 2; Set C
gauagaaggguauguucgguuguu

SEQ ID NO: 43995 - RNA, 22 nt, Artificial Sequence
  Synthetic Oligonucleotide; REL exon 2; Set C
auagaaggguauguucgguugu

SEQ ID NO: 43996 - RNA, 21 nt, Artificial Sequence
  Synthetic Oligonucleotide; REL exon 2; Set C
auagaaggguauguucgguug

SEQ ID NO: 43997 - RNA, 27 nt, Artificial Sequence
  Synthetic Oligonucleotide; REL exon 2; Set B
uggauagaaggguauguucgguuguug

SEQ ID NO: 43998 - RNA, 25 nt, Artificial Sequence
  Synthetic Oligonucleotide; REL exon 2; Set B
ggauagaaggguauguucgguuguu

SEQ ID NO: 43999 - RNA, 23 nt, Artificial Sequence
  Synthetic Oligonucleotide; REL exon 2; Set C
gauagaaggguauguucgguugu

SEQ ID NO: 44000 - RNA, 20 nt, Artificial Sequence
  Synthetic Oligonucleotide; REL exon 2; Set C
auagaaggguauguucgguu

SEQ ID NO: 44001 - RNA, 22 nt, Artificial Sequence
  Synthetic Oligonucleotide; REL exon 2; Set C
gauagaaggguauguucgguug

SEQ ID NO: 44002 - RNA, 26 nt, Artificial Sequence
  Synthetic Oligonucleotide; REL exon 2; Set B
uggauagaaggguauguucgguuguu

SEQ ID NO: 44003 - RNA, 24 nt, Artificial Sequence
  Synthetic Oligonucleotide; REL exon 2; Set B
ggauagaaggguauguucgguugu

SEQ ID NO: 44004 - RNA, 19 nt, Artificial Sequence
  Synthetic Oligonucleotide; REL exon 2; Set C
auagaaggguauguucggu

SEQ ID NO: 44005 - RNA, 21 nt, Artificial Sequence
  Synthetic Oligonucleotide; REL exon 2; Set C
gauagaaggguauguucgguu

SEQ ID NO: 44006 - RNA, 23 nt, Artificial Sequence
  Synthetic Oligonucleotide; REL exon 2; Set C
ggauagaaggguauguucgguug

SEQ ID NO: 44007 - RNA, 25 nt, Artificial Sequence
  Synthetic Oligonucleotide; REL exon 2; Set B
uggauagaaggguauguucgguugu

SEQ ID NO: 44008 - RNA, 20 nt, Artificial Sequence
  Synthetic Oligonucleotide; REL exon 2; Set C
gauagaaggguauguucggu

SEQ ID NO: 44009 - RNA, 22 nt, Artificial Sequence
  Synthetic Oligonucleotide; REL exon 2; Set C
ggauagaaggguauguucgguu

SEQ ID NO: 44010 - RNA, 24 nt, Artificial Sequence
  Synthetic Oligonucleotide; REL exon 2; Set B
uggauagaaggguauguucgguug

SEQ ID NO: 44011 - RNA, 21 nt, Artificial Sequence
  Synthetic Oligonucleotide; REL exon 2; Set C
ggauagaaggguauguucggu

SEQ ID NO: 44012 - RNA, 23 nt, Artificial Sequence
  Synthetic Oligonucleotide; REL exon 2; Set C
uggauagaaggguauguucgguu

SEQ ID NO: 44013 - RNA, 22 nt, Artificial Sequence
  Synthetic Oligonucleotide; REL exon 2; Set C
uggauagaaggguauguucggu

SEQ ID NO: 44014 - RNA, 15 nt, Artificial Sequence
  Synthetic Oligonucleotide; REL exon 2; Set C
ggauagaaggguaug

SEQ ID NO: 44015 - RNA, 16 nt, Artificial Sequence
  Synthetic Oligonucleotide; REL exon 2; Set C
uggauagaaggguaug

SEQ ID NO: 44016 - RNA, 15 nt, Artificial Sequence
  Synthetic Oligonucleotide; REL exon 2; Set C
uggauagaaggguau

SEQ ID NO: 44017 - RNA, 15 nt, Artificial Sequence
  Synthetic Oligonucleotide; REL exon 2; Set C
gagauuaauauagca

SEQ ID NO: 44018 - RNA, 16 nt, Artificial Sequence
  Synthetic Oligonucleotide; REL exon 2; Set C
ugagauuaauauagca

SEQ ID NO: 44019 - RNA, 15 nt, Artificial Sequence
  Synthetic Oligonucleotide; REL exon 2; Set C
ugagauuaauauagc

SEQ ID NO: 44020 - RNA, 17 nt, Artificial Sequence
  Synthetic Oligonucleotide; REL exon 2; Set C
gugagauuaauauagca

SEQ ID NO: 44021 - RNA, 16 nt, Artificial Sequence
  Synthetic Oligonucleotide; REL exon 2; Set C
gugagauuaauauagc

SEQ ID NO: 44022 - RNA, 18 nt, Artificial Sequence
  Synthetic Oligonucleotide; REL exon 2; Set C
agugagauuaauauagca

SEQ ID NO: 44023 - RNA, 17 nt, Artificial Sequence
  Synthetic Oligonucleotide; REL exon 2; Set C
agugagauuaauauagc

SEQ ID NO: 44024 - RNA, 15 nt, Artificial Sequence
  Synthetic Oligonucleotide; REL exon 2; Set C
gugagauuaauauag

SEQ ID NO: 44025 - RNA, 19 nt, Artificial Sequence
  Synthetic Oligonucleotide; REL exon 2; Set C
cagugagauuaauauagca

SEQ ID NO: 44026 - RNA, 18 nt, Artificial Sequence
  Synthetic Oligonucleotide; REL exon 2; Set C
cagugagauuaauauagc

SEQ ID NO: 44027 - RNA, 16 nt, Artificial Sequence
  Synthetic Oligonucleotide; REL exon 2; Set C
agugagauuaauauag

SEQ ID NO: 44028 - RNA, 20 nt, Artificial Sequence
  Synthetic Oligonucleotide; REL exon 2; Set C
ucagugagauuaauauagca

SEQ ID NO: 44029 - RNA, 15 nt, Artificial Sequence
  Synthetic Oligonucleotide; REL exon 2; Set C
agugagauuaauaua

SEQ ID NO: 44030 - RNA, 19 nt, Artificial Sequence
  Synthetic Oligonucleotide; REL exon 2; Set C
ucagugagauuaauauagc

SEQ ID NO: 44031 - RNA, 17 nt, Artificial Sequence
  Synthetic Oligonucleotide; REL exon 2; Set C
cagugagauuaauauag

SEQ ID NO: 44032 - RNA, 21 nt, Artificial Sequence
  Synthetic Oligonucleotide; REL exon 2; Set C
gucagugagauuaauauagca

SEQ ID NO: 44033 - RNA, 16 nt, Artificial Sequence
  Synthetic Oligonucleotide; REL exon 2; Set C
cagugagauuaauaua

SEQ ID NO: 44034 - RNA, 20 nt, Artificial Sequence
  Synthetic Oligonucleotide; REL exon 2; Set C
gucagugagauuaauauagc

SEQ ID NO: 44035 - RNA, 18 nt, Artificial Sequence
  Synthetic Oligonucleotide; REL exon 2; Set C
ucagugagauuaauauag

SEQ ID NO: 44036 - RNA, 22 nt, Artificial Sequence
  Synthetic Oligonucleotide; REL exon 2; Set C
ggucagugagauuaauauagca

SEQ ID NO: 44037 - RNA, 17 nt, Artificial Sequence
  Synthetic Oligonucleotide; REL exon 2; Set C
ucagugagauuaauaua

SEQ ID NO: 44038 - RNA, 21 nt, Artificial Sequence
  Synthetic Oligonucleotide; REL exon 2; Set C
ggucagugagauuaauauagc

SEQ ID NO: 44039 - RNA, 19 nt, Artificial Sequence
  Synthetic Oligonucleotide; REL exon 2; Set C
gucagugagauuaauauag

SEQ ID NO: 44040 - RNA, 18 nt, Artificial Sequence
  Synthetic Oligonucleotide; REL exon 2; Set C
gucagugagauuaauaua

SEQ ID NO: 44041 - RNA, 20 nt, Artificial Sequence
  Synthetic Oligonucleotide; REL exon 2; Set C
ggucagugagauuaauauag

SEQ ID NO: 44042 - RNA, 19 nt, Artificial Sequence
  Synthetic Oligonucleotide; REL exon 2; Set C
ggucagugagauuaauaua

SEQ ID NO: 44043 - RNA, 32 nt, Artificial Sequence
  Synthetic Oligonucleotide; REL exon 2; Set A
aaaaggaggaggucagugagauuaauauagca

SEQ ID NO: 44044 - RNA, 31 nt, Artificial Sequence
  Synthetic Oligonucleotide; REL exon 2; Set A
aaaaggaggaggucagugagauuaauauagc

SEQ ID NO: 44045 - RNA, 33 nt, Artificial Sequence
  Synthetic Oligonucleotide; REL exon 2; Set A
aaaaaggaggaggucagugagauuaauauagca

SEQ ID NO: 44046 - RNA, 30 nt, Artificial Sequence
  Synthetic Oligonucleotide; REL exon 2; Set C
aaaaggaggaggucagugagauuaauauag

SEQ ID NO: 44047 - RNA, 32 nt, Artificial Sequence
  Synthetic Oligonucleotide; REL exon 2; Set A
aaaaaggaggaggucagugagauuaauauagc

SEQ ID NO: 44048 - RNA, 34 nt, Artificial Sequence
  Synthetic Oligonucleotide; REL exon 2; Set A
uaaaaaggaggaggucagugagauuaauauagca

SEQ ID NO: 44049 - RNA, 29 nt, Artificial Sequence
  Synthetic Oligonucleotide; REL exon 2; Set C
aaaaggaggaggucagugagauuaauaua

SEQ ID NO: 44050 - RNA, 33 nt, Artificial Sequence
  Synthetic Oligonucleotide; REL exon 2; Set A
uaaaaaggaggaggucagugagauuaauauagc

SEQ ID NO: 44051 - RNA, 31 nt, Artificial Sequence
  Synthetic Oligonucleotide; REL exon 2; Set C
aaaaaggaggaggucagugagauuaauauag

SEQ ID NO: 44052 - RNA, 35 nt, Artificial Sequence
  Synthetic Oligonucleotide; REL exon 2; Set A
uuaaaaaggaggaggucagugagauuaauauagca

SEQ ID NO: 44053 - RNA, 30 nt, Artificial Sequence
  Synthetic Oligonucleotide; REL exon 2; Set C
aaaaaggaggaggucagugagauuaauaua

SEQ ID NO: 44054 - RNA, 34 nt, Artificial Sequence
  Synthetic Oligonucleotide; REL exon 2; Set A
uuaaaaaggaggaggucagugagauuaauauagc

SEQ ID NO: 44055 - RNA, 32 nt, Artificial Sequence
  Synthetic Oligonucleotide; REL exon 2; Set C
uaaaaaggaggaggucagugagauuaauauag

SEQ ID NO: 44056 - RNA, 36 nt, Artificial Sequence
  Synthetic Oligonucleotide; REL exon 2; Set A
uuuaaaaaggaggaggucagugagauuaauauagca

SEQ ID NO: 44057 - RNA, 31 nt, Artificial Sequence
  Synthetic Oligonucleotide; REL exon 2; Set C
uaaaaaggaggaggucagugagauuaauaua

SEQ ID NO: 44058 - RNA, 35 nt, Artificial Sequence
  Synthetic Oligonucleotide; REL exon 2; Set A
uuuaaaaaggaggaggucagugagauuaauauagc

SEQ ID NO: 44059 - RNA, 33 nt, Artificial Sequence
  Synthetic Oligonucleotide; REL exon 2; Set C
uuaaaaaggaggaggucagugagauuaauauag

SEQ ID NO: 44060 - RNA, 37 nt, Artificial Sequence
  Synthetic Oligonucleotide; REL exon 2; Set A
uuuuaaaaaggaggaggucagugagauuaauauagca

SEQ ID NO: 44061 - RNA, 32 nt, Artificial Sequence
  Synthetic Oligonucleotide; REL exon 2; Set C
uuaaaaaggaggaggucagugagauuaauaua

SEQ ID NO: 44062 - RNA, 36 nt, Artificial Sequence
  Synthetic Oligonucleotide; REL exon 2; Set A
uuuuaaaaaggaggaggucagugagauuaauauagc

SEQ ID NO: 44063 - RNA, 34 nt, Artificial Sequence
  Synthetic Oligonucleotide; REL exon 2; Set C
uuuaaaaaggaggaggucagugagauuaauauag

SEQ ID NO: 44064 - RNA, 38 nt, Artificial Sequence
  Synthetic Oligonucleotide; REL exon 2; Set A
uuuuuaaaaaggaggaggucagugagauuaauauagca

SEQ ID NO: 44065 - RNA, 33 nt, Artificial Sequence
  Synthetic Oligonucleotide; REL exon 2; Set C
uuuaaaaaggaggaggucagugagauuaauaua

SEQ ID NO: 44066 - RNA, 35 nt, Artificial Sequence
  Synthetic Oligonucleotide; REL exon 2; Set C
uuuuaaaaaggaggaggucagugagauuaauauag

SEQ ID NO: 44067 - RNA, 37 nt, Artificial Sequence
  Synthetic Oligonucleotide; REL exon 2; Set A
uuuuuaaaaaggaggaggucagugagauuaauauagc

SEQ ID NO: 44068 - RNA, 39 nt, Artificial Sequence
  Synthetic Oligonucleotide; REL exon 2; Set A
guuuuuaaaaaggaggaggucagugagauuaauauagca

SEQ ID NO: 44069 - RNA, 34 nt, Artificial Sequence
  Synthetic Oligonucleotide; REL exon 2; Set C
uuuuaaaaaggaggaggucagugagauuaauaua

SEQ ID NO: 44070 - RNA, 38 nt, Artificial Sequence
  Synthetic Oligonucleotide; REL exon 2; Set A
guuuuuaaaaaggaggaggucagugagauuaauauagc

SEQ ID NO: 44071 - RNA, 36 nt, Artificial Sequence
  Synthetic Oligonucleotide; REL exon 2; Set C
uuuuuaaaaaggaggaggucagugagauuaauauag

SEQ ID NO: 44072 - RNA, 35 nt, Artificial Sequence
  Synthetic Oligonucleotide; REL exon 2; Set C
uuuuuaaaaaggaggaggucagugagauuaauaua

SEQ ID NO: 44073 - RNA, 37 nt, Artificial Sequence
  Synthetic Oligonucleotide; REL exon 2; Set A
guuuuuaaaaaggaggaggucagugagauuaauauag

SEQ ID NO: 44074 - RNA, 36 nt, Artificial Sequence
  Synthetic Oligonucleotide; REL exon 2; Set A
guuuuuaaaaaggaggaggucagugagauuaauaua

SEQ ID NO: 44075 - RNA, 20 nt, Artificial Sequence
  Synthetic Oligonucleotide; REL exon 2; Set C
aaaaggaggaggucagugag

SEQ ID NO: 44076 - RNA, 19 nt, Artificial Sequence
  Synthetic Oligonucleotide; REL exon 2; Set C
aaaaggaggaggucaguga

SEQ ID NO: 44077 - RNA, 21 nt, Artificial Sequence
  Synthetic Oligonucleotide; REL exon 2; Set C
aaaaaggaggaggucagugag

SEQ ID NO: 44078 - RNA, 22 nt, Artificial Sequence
  Synthetic Oligonucleotide; REL exon 2; Set C
uaaaaaggaggaggucagugag

SEQ ID NO: 44079 - RNA, 20 nt, Artificial Sequence
  Synthetic Oligonucleotide; REL exon 2; Set C
aaaaaggaggaggucaguga

SEQ ID NO: 44080 - RNA, 18 nt, Artificial Sequence
  Synthetic Oligonucleotide; REL exon 2; Set C
aaaaggaggaggucagug

SEQ ID NO: 44081 - RNA, 17 nt, Artificial Sequence
  Synthetic Oligonucleotide; REL exon 2; Set C
aaaaggaggaggucagu

SEQ ID NO: 44082 - RNA, 23 nt, Artificial Sequence
  Synthetic Oligonucleotide; REL exon 2; Set C
uuaaaaaggaggaggucagugag

SEQ ID NO: 44083 - RNA, 21 nt, Artificial Sequence
  Synthetic Oligonucleotide; REL exon 2; Set C
uaaaaaggaggaggucaguga

SEQ ID NO: 44084 - RNA, 19 nt, Artificial Sequence
  Synthetic Oligonucleotide; REL exon 2; Set C
aaaaaggaggaggucagug

SEQ ID NO: 44085 - RNA, 16 nt, Artificial Sequence
  Synthetic Oligonucleotide; REL exon 2; Set C
aaaaggaggaggucag

SEQ ID NO: 44086 - RNA, 24 nt, Artificial Sequence
  Synthetic Oligonucleotide; REL exon 2; Set C
uuuaaaaaggaggaggucagugag

SEQ ID NO: 44087 - RNA, 22 nt, Artificial Sequence
  Synthetic Oligonucleotide; REL exon 2; Set C
uuaaaaaggaggaggucaguga

SEQ ID NO: 44088 - RNA, 18 nt, Artificial Sequence
  Synthetic Oligonucleotide; REL exon 2; Set C
aaaaaggaggaggucagu

SEQ ID NO: 44089 - RNA, 20 nt, Artificial Sequence
  Synthetic Oligonucleotide; REL exon 2; Set C
uaaaaaggaggaggucagug

SEQ ID NO: 44090 - RNA, 15 nt, Artificial Sequence
  Synthetic Oligonucleotide; REL exon 2; Set C
aaaaggaggagguca

SEQ ID NO: 44091 - RNA, 17 nt, Artificial Sequence
  Synthetic Oligonucleotide; REL exon 2; Set C
aaaaaggaggaggucag

SEQ ID NO: 44092 - RNA, 25 nt, Artificial Sequence
  Synthetic Oligonucleotide; REL exon 2; Set C
uuuuaaaaaggaggaggucagugag

SEQ ID NO: 44093 - RNA, 23 nt, Artificial Sequence
  Synthetic Oligonucleotide; REL exon 2; Set C
uuuaaaaaggaggaggucaguga

SEQ ID NO: 44094 - RNA, 19 nt, Artificial Sequence
  Synthetic Oligonucleotide; REL exon 2; Set C
uaaaaaggaggaggucagu

SEQ ID NO: 44095 - RNA, 21 nt, Artificial Sequence
  Synthetic Oligonucleotide; REL exon 2; Set C
uuaaaaaggaggaggucagug

SEQ ID NO: 44096 - RNA, 18 nt, Artificial Sequence
  Synthetic Oligonucleotide; REL exon 2; Set C
uaaaaaggaggaggucag

SEQ ID NO: 44097 - RNA, 16 nt, Artificial Sequence
  Synthetic Oligonucleotide; REL exon 2; Set C
aaaaaggaggagguca

SEQ ID NO: 44098 - RNA, 24 nt, Artificial Sequence
  Synthetic Oligonucleotide; REL exon 2; Set C
uuuuaaaaaggaggaggucaguga

SEQ ID NO: 44099 - RNA, 20 nt, Artificial Sequence
  Synthetic Oligonucleotide; REL exon 2; Set C
uuaaaaaggaggaggucagu

SEQ ID NO: 44100 - RNA, 26 nt, Artificial Sequence
  Synthetic Oligonucleotide; REL exon 2; Set C
uuuuuaaaaaggaggaggucagugag

SEQ ID NO: 44101 - RNA, 22 nt, Artificial Sequence
  Synthetic Oligonucleotide; REL exon 2; Set C
uuuaaaaaggaggaggucagug

SEQ ID NO: 44102 - RNA, 19 nt, Artificial Sequence
  Synthetic Oligonucleotide; REL exon 2; Set C
uuaaaaaggaggaggucag

SEQ ID NO: 44103 - RNA, 17 nt, Artificial Sequence
  Synthetic Oligonucleotide; REL exon 2; Set C
uaaaaaggaggagguca

SEQ ID NO: 44104 - RNA, 27 nt, Artificial Sequence
  Synthetic Oligonucleotide; REL exon 2; Set C
guuuuuaaaaaggaggaggucagugag

SEQ ID NO: 44105 - RNA, 21 nt, Artificial Sequence
  Synthetic Oligonucleotide; REL exon 2; Set C
uuuaaaaaggaggaggucagu

SEQ ID NO: 44106 - RNA, 25 nt, Artificial Sequence
  Synthetic Oligonucleotide; REL exon 2; Set C
uuuuuaaaaaggaggaggucaguga

SEQ ID NO: 44107 - RNA, 23 nt, Artificial Sequence
  Synthetic Oligonucleotide; REL exon 2; Set C
uuuuaaaaaggaggaggucagug

SEQ ID NO: 44108 - RNA, 20 nt, Artificial Sequence
  Synthetic Oligonucleotide; REL exon 2; Set C
uuuaaaaaggaggaggucag

SEQ ID NO: 44109 - RNA, 18 nt, Artificial Sequence
  Synthetic Oligonucleotide; REL exon 2; Set C
uuaaaaaggaggagguca

SEQ ID NO: 44110 - RNA, 16 nt, Artificial Sequence
  Synthetic Oligonucleotide; REL exon 2; Set C
uaaaaaggaggagguc

SEQ ID NO: 44111 - RNA, 26 nt, Artificial Sequence
  Synthetic Oligonucleotide; REL exon 2; Set C
guuuuuaaaaaggaggaggucaguga

SEQ ID NO: 44112 - RNA, 22 nt, Artificial Sequence
  Synthetic Oligonucleotide; REL exon 2; Set C
uuuuaaaaaggaggaggucagu

SEQ ID NO: 44113 - RNA, 24 nt, Artificial Sequence
  Synthetic Oligonucleotide; REL exon 2; Set C
uuuuuaaaaaggaggaggucagug

SEQ ID NO: 44114 - RNA, 21 nt, Artificial Sequence
  Synthetic Oligonucleotide; REL exon 2; Set C
uuuuaaaaaggaggaggucag

SEQ ID NO: 44115 - RNA, 19 nt, Artificial Sequence
  Synthetic Oligonucleotide; REL exon 2; Set C
uuuaaaaaggaggagguca

SEQ ID NO: 44116 - RNA, 17 nt, Artificial Sequence
  Synthetic Oligonucleotide; REL exon 2; Set C
uuaaaaaggaggagguc

SEQ ID NO: 44117 - RNA, 23 nt, Artificial Sequence
  Synthetic Oligonucleotide; REL exon 2; Set C
uuuuuaaaaaggaggaggucagu

SEQ ID NO: 44118 - RNA, 25 nt, Artificial Sequence
  Synthetic Oligonucleotide; REL exon 2; Set C
guuuuuaaaaaggaggaggucagug

SEQ ID NO: 44119 - RNA, 20 nt, Artificial Sequence
  Synthetic Oligonucleotide; REL exon 2; Set C
uuuuaaaaaggaggagguca

SEQ ID NO: 44120 - RNA, 18 nt, Artificial Sequence
  Synthetic Oligonucleotide; REL exon 2; Set C
uuuaaaaaggaggagguc

SEQ ID NO: 44121 - RNA, 22 nt, Artificial Sequence
  Synthetic Oligonucleotide; REL exon 2; Set C
uuuuuaaaaaggaggaggucag

SEQ ID NO: 44122 - RNA, 24 nt, Artificial Sequence
  Synthetic Oligonucleotide; REL exon 2; Set C
guuuuuaaaaaggaggaggucagu

SEQ ID NO: 44123 - RNA, 23 nt, Artificial Sequence
  Synthetic Oligonucleotide; REL exon 2; Set C
guuuuuaaaaaggaggaggucag

SEQ ID NO: 44124 - RNA, 19 nt, Artificial Sequence
  Synthetic Oligonucleotide; REL exon 2; Set C
uuuuaaaaaggaggagguc

SEQ ID NO: 44125 - RNA, 17 nt, Artificial Sequence
  Synthetic Oligonucleotide; REL exon 2; Set C
uuuaaaaaggaggaggu

SEQ ID NO: 44126 - RNA, 21 nt, Artificial Sequence
  Synthetic Oligonucleotide; REL exon 2; Set C
uuuuuaaaaaggaggagguca

SEQ ID NO: 44127 - RNA, 22 nt, Artificial Sequence
  Synthetic Oligonucleotide; REL exon 2; Set C
guuuuuaaaaaggaggagguca

SEQ ID NO: 44128 - RNA, 18 nt, Artificial Sequence
  Synthetic Oligonucleotide; REL exon 2; Set C
uuuuaaaaaggaggaggu

SEQ ID NO: 44129 - RNA, 20 nt, Artificial Sequence
  Synthetic Oligonucleotide; REL exon 2; Set C
uuuuuaaaaaggaggagguc

SEQ ID NO: 44130 - RNA, 32 nt, Artificial Sequence
  Synthetic Oligonucleotide; REL exon 2; Set C
gaaaaguuuuuaaaaaggaggaggucagugag

SEQ ID NO: 44131 - RNA, 21 nt, Artificial Sequence
  Synthetic Oligonucleotide; REL exon 2; Set C
guuuuuaaaaaggaggagguc

SEQ ID NO: 44132 - RNA, 19 nt, Artificial Sequence
  Synthetic Oligonucleotide; REL exon 2; Set C
uuuuuaaaaaggaggaggu

SEQ ID NO: 44133 - RNA, 33 nt, Artificial Sequence
  Synthetic Oligonucleotide; REL exon 2; Set C
ugaaaaguuuuuaaaaaggaggaggucagugag

SEQ ID NO: 44134 - RNA, 31 nt, Artificial Sequence
  Synthetic Oligonucleotide; REL exon 2; Set C
gaaaaguuuuuaaaaaggaggaggucaguga

SEQ ID NO: 44135 - RNA, 20 nt, Artificial Sequence
  Synthetic Oligonucleotide; REL exon 2; Set C
guuuuuaaaaaggaggaggu

SEQ ID NO: 44136 - RNA, 32 nt, Artificial Sequence
  Synthetic Oligonucleotide; REL exon 2; Set C
ugaaaaguuuuuaaaaaggaggaggucaguga

SEQ ID NO: 44137 - RNA, 34 nt, Artificial Sequence
  Synthetic Oligonucleotide; REL exon 2; Set C
cugaaaaguuuuuaaaaaggaggaggucagugag

SEQ ID NO: 44138 - RNA, 30 nt, Artificial Sequence
  Synthetic Oligonucleotide; REL exon 2; Set C
gaaaaguuuuuaaaaaggaggaggucagug

SEQ ID NO: 44139 - RNA, 21 nt, Artificial Sequence
  Synthetic Oligonucleotide; REL exon 2; Set C
aguuuuuaaaaaggaggaggu

SEQ ID NO: 44140 - RNA, 29 nt, Artificial Sequence
  Synthetic Oligonucleotide; REL exon 2; Set C
gaaaaguuuuuaaaaaggaggaggucagu

SEQ ID NO: 44141 - RNA, 33 nt, Artificial Sequence
  Synthetic Oligonucleotide; REL exon 2; Set C
cugaaaaguuuuuaaaaaggaggaggucaguga

SEQ ID NO: 44142 - RNA, 31 nt, Artificial Sequence
  Synthetic Oligonucleotide; REL exon 2; Set C
ugaaaaguuuuuaaaaaggaggaggucagug

SEQ ID NO: 44143 - RNA, 28 nt, Artificial Sequence
  Synthetic Oligonucleotide; REL exon 2; Set C
gaaaaguuuuuaaaaaggaggaggucag

SEQ ID NO: 44144 - RNA, 30 nt, Artificial Sequence
  Synthetic Oligonucleotide; REL exon 2; Set C
ugaaaaguuuuuaaaaaggaggaggucagu

SEQ ID NO: 44145 - RNA, 32 nt, Artificial Sequence
  Synthetic Oligonucleotide; REL exon 2; Set C
cugaaaaguuuuuaaaaaggaggaggucagug

SEQ ID NO: 44146 - RNA, 29 nt, Artificial Sequence
  Synthetic Oligonucleotide; REL exon 2; Set C
ugaaaaguuuuuaaaaaggaggaggucag

SEQ ID NO: 44147 - RNA, 27 nt, Artificial Sequence
  Synthetic Oligonucleotide; REL exon 2; Set C
gaaaaguuuuuaaaaaggaggagguca

SEQ ID NO: 44148 - RNA, 31 nt, Artificial Sequence
  Synthetic Oligonucleotide; REL exon 2; Set C
cugaaaaguuuuuaaaaaggaggaggucagu

SEQ ID NO: 44149 - RNA, 28 nt, Artificial Sequence
  Synthetic Oligonucleotide; REL exon 2; Set C
ugaaaaguuuuuaaaaaggaggagguca

SEQ ID NO: 44150 - RNA, 26 nt, Artificial Sequence
  Synthetic Oligonucleotide; REL exon 2; Set C
gaaaaguuuuuaaaaaggaggagguc

SEQ ID NO: 44151 - RNA, 30 nt, Artificial Sequence
  Synthetic Oligonucleotide; REL exon 2; Set C
cugaaaaguuuuuaaaaaggaggaggucag

SEQ ID NO: 44152 - RNA, 27 nt, Artificial Sequence
  Synthetic Oligonucleotide; REL exon 2; Set C
ugaaaaguuuuuaaaaaggaggagguc

SEQ ID NO: 44153 - RNA, 25 nt, Artificial Sequence
  Synthetic Oligonucleotide; REL exon 2; Set C
gaaaaguuuuuaaaaaggaggaggu

SEQ ID NO: 44154 - RNA, 29 nt, Artificial Sequence
  Synthetic Oligonucleotide; REL exon 2; Set C
cugaaaaguuuuuaaaaaggaggagguca

SEQ ID NO: 44155 - RNA, 26 nt, Artificial Sequence
  Synthetic Oligonucleotide; REL exon 2; Set C
ugaaaaguuuuuaaaaaggaggaggu

SEQ ID NO: 44156 - RNA, 28 nt, Artificial Sequence
  Synthetic Oligonucleotide; REL exon 2; Set C
cugaaaaguuuuuaaaaaggaggagguc

SEQ ID NO: 44157 - RNA, 27 nt, Artificial Sequence
  Synthetic Oligonucleotide; REL exon 2; Set C
cugaaaaguuuuuaaaaaggaggaggu

SEQ ID NO: 44158 - RNA, 17 nt, Artificial Sequence
  Synthetic Oligonucleotide; REL exon 2; Set C
gaaaaguuuuuaaaaag

SEQ ID NO: 44159 - RNA, 16 nt, Artificial Sequence
  Synthetic Oligonucleotide; REL exon 2; Set C
gaaaaguuuuuaaaaa

SEQ ID NO: 44160 - RNA, 18 nt, Artificial Sequence
  Synthetic Oligonucleotide; REL exon 2; Set C
ugaaaaguuuuuaaaaag

SEQ ID NO: 44161 - RNA, 17 nt, Artificial Sequence
  Synthetic Oligonucleotide; REL exon 2; Set C
ugaaaaguuuuuaaaaa

SEQ ID NO: 44162 - RNA, 19 nt, Artificial Sequence
  Synthetic Oligonucleotide; REL exon 2; Set C
cugaaaaguuuuuaaaaag

SEQ ID NO: 44163 - RNA, 18 nt, Artificial Sequence
  Synthetic Oligonucleotide; REL exon 2; Set C
cugaaaaguuuuuaaaaa

SEQ ID NO: 44164 - RNA, 27 nt, Artificial Sequence
  Synthetic Oligonucleotide; REL exon 2; Set C
auacgcaccugaaaaguuuuuaaaaag

SEQ ID NO: 44165 - RNA, 29 nt, Artificial Sequence
  Synthetic Oligonucleotide; REL exon 2; Set C
uauacgcaccugaaaaguuuuuaaaaagg

SEQ ID NO: 44166 - RNA, 26 nt, Artificial Sequence
  Synthetic Oligonucleotide; REL exon 2; Set C
auacgcaccugaaaaguuuuuaaaaa

SEQ ID NO: 44167 - RNA, 28 nt, Artificial Sequence
  Synthetic Oligonucleotide; REL exon 2; Set C
uauacgcaccugaaaaguuuuuaaaaag

SEQ ID NO: 44168 - RNA, 30 nt, Artificial Sequence
  Synthetic Oligonucleotide; REL exon 2; Set C
uuauacgcaccugaaaaguuuuuaaaaagg

SEQ ID NO: 44169 - RNA, 27 nt, Artificial Sequence
  Synthetic Oligonucleotide; REL exon 2; Set C
uauacgcaccugaaaaguuuuuaaaaa

SEQ ID NO: 44170 - RNA, 29 nt, Artificial Sequence
  Synthetic Oligonucleotide; REL exon 2; Set C
uuauacgcaccugaaaaguuuuuaaaaag

SEQ ID NO: 44171 - RNA, 31 nt, Artificial Sequence
  Synthetic Oligonucleotide; REL exon 2; Set C
guuauacgcaccugaaaaguuuuuaaaaagg

SEQ ID NO: 44172 - RNA, 28 nt, Artificial Sequence
  Synthetic Oligonucleotide; REL exon 2; Set C
uuauacgcaccugaaaaguuuuuaaaaa

SEQ ID NO: 44173 - RNA, 30 nt, Artificial Sequence
  Synthetic Oligonucleotide; REL exon 2; Set C
guuauacgcaccugaaaaguuuuuaaaaag

SEQ ID NO: 44174 - RNA, 32 nt, Artificial Sequence
  Synthetic Oligonucleotide; REL exon 2; Set C
gguuauacgcaccugaaaaguuuuuaaaaagg

SEQ ID NO: 44175 - RNA, 29 nt, Artificial Sequence
  Synthetic Oligonucleotide; REL exon 2; Set C
guuauacgcaccugaaaaguuuuuaaaaa

SEQ ID NO: 44176 - RNA, 31 nt, Artificial Sequence
  Synthetic Oligonucleotide; REL exon 2; Set C
gguuauacgcaccugaaaaguuuuuaaaaag

SEQ ID NO: 44177 - RNA, 30 nt, Artificial Sequence
  Synthetic Oligonucleotide; REL exon 2; Set C
gguuauacgcaccugaaaaguuuuuaaaaa

SEQ ID NO: 44178 - RNA, 36 nt, Artificial Sequence
  Synthetic Oligonucleotide; REL exon 2; Set A
uauauacggguuauacgcaccugaaaaguuuuuaaa

SEQ ID NO: 44179 - RNA, 35 nt, Artificial Sequence
  Synthetic Oligonucleotide; REL exon 2; Set A
uauauacggguuauacgcaccugaaaaguuuuuaa

SEQ ID NO: 44180 - RNA, 34 nt, Artificial Sequence
  Synthetic Oligonucleotide; REL exon 2; Set A
uauauacggguuauacgcaccugaaaaguuuuua

SEQ ID NO: 44181 - RNA, 33 nt, Artificial Sequence
  Synthetic Oligonucleotide; REL exon 2; Set A
uauauacggguuauacgcaccugaaaaguuuuu

SEQ ID NO: 44182 - RNA, 32 nt, Artificial Sequence
  Synthetic Oligonucleotide; REL exon 2; Set A
uauauacggguuauacgcaccugaaaaguuuu

SEQ ID NO: 44183 - RNA, 31 nt, Artificial Sequence
  Synthetic Oligonucleotide; REL exon 2; Set A
uauauacggguuauacgcaccugaaaaguuu

SEQ ID NO: 44184 - RNA, 30 nt, Artificial Sequence
  Synthetic Oligonucleotide; REL exon 2; Set A
uauauacggguuauacgcaccugaaaaguu

SEQ ID NO: 44185 - RNA, 40 nt, Artificial Sequence
  Synthetic Oligonucleotide; REL exon 2; Set A
uuaucucuauauacggguuauacgcaccugaaaaguuuuu

SEQ ID NO: 44186 - RNA, 25 nt, Artificial Sequence
  Synthetic Oligonucleotide; REL exon 2; Set A
uauauacggguuauacgcaccugaa

SEQ ID NO: 44187 - RNA, 39 nt, Artificial Sequence
  Synthetic Oligonucleotide; REL exon 2; Set A
uuaucucuauauacggguuauacgcaccugaaaaguuuu

SEQ ID NO: 44188 - RNA, 24 nt, Artificial Sequence
  Synthetic Oligonucleotide; REL exon 2; Set A
uauauacggguuauacgcaccuga

SEQ ID NO: 44189 - RNA, 40 nt, Artificial Sequence
  Synthetic Oligonucleotide; REL exon 2; Set A
auuaucucuauauacggguuauacgcaccugaaaaguuuu

SEQ ID NO: 44190 - RNA, 38 nt, Artificial Sequence
  Synthetic Oligonucleotide; REL exon 2; Set A
uuaucucuauauacggguuauacgcaccugaaaaguuu

SEQ ID NO: 44191 - RNA, 37 nt, Artificial Sequence
  Synthetic Oligonucleotide; REL exon 2; Set A
uuaucucuauauacggguuauacgcaccugaaaaguu

SEQ ID NO: 44192 - RNA, 23 nt, Artificial Sequence
  Synthetic Oligonucleotide; REL exon 2; Set A
uauauacggguuauacgcaccug

SEQ ID NO: 44193 - RNA, 39 nt, Artificial Sequence
  Synthetic Oligonucleotide; REL exon 2; Set A
auuaucucuauauacggguuauacgcaccugaaaaguuu

SEQ ID NO: 44194 - RNA, 36 nt, Artificial Sequence
  Synthetic Oligonucleotide; REL exon 2; Set A
uuaucucuauauacggguuauacgcaccugaaaagu

SEQ ID NO: 44195 - RNA, 38 nt, Artificial Sequence
  Synthetic Oligonucleotide; REL exon 2; Set A
auuaucucuauauacggguuauacgcaccugaaaaguu

SEQ ID NO: 44196 - RNA, 40 nt, Artificial Sequence
  Synthetic Oligonucleotide; REL exon 2; Set A
aauuaucucuauauacggguuauacgcaccugaaaaguuu

SEQ ID NO: 44197 - RNA, 37 nt, Artificial Sequence
  Synthetic Oligonucleotide; REL exon 2; Set A
auuaucucuauauacggguuauacgcaccugaaaagu

SEQ ID NO: 44198 - RNA, 39 nt, Artificial Sequence
  Synthetic Oligonucleotide; REL exon 2; Set A
aauuaucucuauauacggguuauacgcaccugaaaaguu

SEQ ID NO: 44199 - RNA, 40 nt, Artificial Sequence
  Synthetic Oligonucleotide; REL exon 2; Set A
caauuaucucuauauacggguuauacgcaccugaaaaguu

SEQ ID NO: 44200 - RNA, 32 nt, Artificial Sequence
  Synthetic Oligonucleotide; REL exon 2; Set A
uuaucucuauauacggguuauacgcaccugaa

SEQ ID NO: 44201 - RNA, 31 nt, Artificial Sequence
  Synthetic Oligonucleotide; REL exon 2; Set C
uuaucucuauauacggguuauacgcaccuga

SEQ ID NO: 44202 - RNA, 33 nt, Artificial Sequence
  Synthetic Oligonucleotide; REL exon 2; Set A
auuaucucuauauacggguuauacgcaccugaa

SEQ ID NO: 44203 - RNA, 32 nt, Artificial Sequence
  Synthetic Oligonucleotide; REL exon 2; Set C
auuaucucuauauacggguuauacgcaccuga

SEQ ID NO: 44204 - RNA, 34 nt, Artificial Sequence
  Synthetic Oligonucleotide; REL exon 2; Set A
aauuaucucuauauacggguuauacgcaccugaa

SEQ ID NO: 44205 - RNA, 30 nt, Artificial Sequence
  Synthetic Oligonucleotide; REL exon 2; Set A
uuaucucuauauacggguuauacgcaccug

SEQ ID NO: 44206 - RNA, 33 nt, Artificial Sequence
  Synthetic Oligonucleotide; REL exon 2; Set A
aauuaucucuauauacggguuauacgcaccuga

SEQ ID NO: 44207 - RNA, 35 nt, Artificial Sequence
  Synthetic Oligonucleotide; REL exon 2; Set A
caauuaucucuauauacggguuauacgcaccugaa

SEQ ID NO: 44208 - RNA, 31 nt, Artificial Sequence
  Synthetic Oligonucleotide; REL exon 2; Set A
auuaucucuauauacggguuauacgcaccug

SEQ ID NO: 44209 - RNA, 34 nt, Artificial Sequence
  Synthetic Oligonucleotide; REL exon 2; Set C
caauuaucucuauauacggguuauacgcaccuga

SEQ ID NO: 44210 - RNA, 36 nt, Artificial Sequence
  Synthetic Oligonucleotide; REL exon 2; Set C
ucaauuaucucuauauacggguuauacgcaccugaa

SEQ ID NO: 44211 - RNA, 32 nt, Artificial Sequence
  Synthetic Oligonucleotide; REL exon 2; Set A
aauuaucucuauauacggguuauacgcaccug

SEQ ID NO: 44212 - RNA, 35 nt, Artificial Sequence
  Synthetic Oligonucleotide; REL exon 2; Set C
ucaauuaucucuauauacggguuauacgcaccuga

SEQ ID NO: 44213 - RNA, 37 nt, Artificial Sequence
  Synthetic Oligonucleotide; REL exon 2; Set C
uucaauuaucucuauauacggguuauacgcaccugaa

SEQ ID NO: 44214 - RNA, 33 nt, Artificial Sequence
  Synthetic Oligonucleotide; REL exon 2; Set A
caauuaucucuauauacggguuauacgcaccug

SEQ ID NO: 44215 - RNA, 36 nt, Artificial Sequence
  Synthetic Oligonucleotide; REL exon 2; Set C
uucaauuaucucuauauacggguuauacgcaccuga

SEQ ID NO: 44216 - RNA, 38 nt, Artificial Sequence
  Synthetic Oligonucleotide; REL exon 2; Set C
guucaauuaucucuauauacggguuauacgcaccugaa

SEQ ID NO: 44217 - RNA, 34 nt, Artificial Sequence
  Synthetic Oligonucleotide; REL exon 2; Set A
ucaauuaucucuauauacggguuauacgcaccug

SEQ ID NO: 44218 - RNA, 37 nt, Artificial Sequence
  Synthetic Oligonucleotide; REL exon 2; Set C
guucaauuaucucuauauacggguuauacgcaccuga

SEQ ID NO: 44219 - RNA, 39 nt, Artificial Sequence
  Synthetic Oligonucleotide; REL exon 2; Set C
uguucaauuaucucuauauacggguuauacgcaccugaa

SEQ ID NO: 44220 - RNA, 35 nt, Artificial Sequence
  Synthetic Oligonucleotide; REL exon 2; Set A
uucaauuaucucuauauacggguuauacgcaccug

SEQ ID NO: 44221 - RNA, 38 nt, Artificial Sequence
  Synthetic Oligonucleotide; REL exon 2; Set C
uguucaauuaucucuauauacggguuauacgcaccuga

SEQ ID NO: 44222 - RNA, 40 nt, Artificial Sequence
  Synthetic Oligonucleotide; REL exon 2; Set C
uuguucaauuaucucuauauacggguuauacgcaccugaa

SEQ ID NO: 44223 - RNA, 36 nt, Artificial Sequence
  Synthetic Oligonucleotide; REL exon 2; Set C
guucaauuaucucuauauacggguuauacgcaccug

SEQ ID NO: 44224 - RNA, 39 nt, Artificial Sequence
  Synthetic Oligonucleotide; REL exon 2; Set C
uuguucaauuaucucuauauacggguuauacgcaccuga

SEQ ID NO: 44225 - RNA, 37 nt, Artificial Sequence
  Synthetic Oligonucleotide; REL exon 2; Set C
uguucaauuaucucuauauacggguuauacgcaccug

SEQ ID NO: 44226 - RNA, 22 nt, Artificial Sequence
  Synthetic Oligonucleotide; REL exon 2; Set C
uuaucucuauauacggguuaua

SEQ ID NO: 44227 - RNA, 40 nt, Artificial Sequence
  Synthetic Oligonucleotide; REL exon 2; Set C
guuguucaauuaucucuauauacggguuauacgcaccuga

SEQ ID NO: 44228 - RNA, 38 nt, Artificial Sequence
  Synthetic Oligonucleotide; REL exon 2; Set C
uuguucaauuaucucuauauacggguuauacgcaccug

SEQ ID NO: 44229 - RNA, 21 nt, Artificial Sequence
  Synthetic Oligonucleotide; REL exon 2; Set C
uuaucucuauauacggguuau

SEQ ID NO: 44230 - RNA, 23 nt, Artificial Sequence
  Synthetic Oligonucleotide; REL exon 2; Set C
auuaucucuauauacggguuaua

SEQ ID NO: 44231 - RNA, 39 nt, Artificial Sequence
  Synthetic Oligonucleotide; REL exon 2; Set C
guuguucaauuaucucuauauacggguuauacgcaccug

SEQ ID NO: 44232 - RNA, 22 nt, Artificial Sequence
  Synthetic Oligonucleotide; REL exon 2; Set C
auuaucucuauauacggguuau

SEQ ID NO: 44233 - RNA, 20 nt, Artificial Sequence
  Synthetic Oligonucleotide; REL exon 2; Set C
uuaucucuauauacggguua

SEQ ID NO: 44234 - RNA, 24 nt, Artificial Sequence
  Synthetic Oligonucleotide; REL exon 2; Set C
aauuaucucuauauacggguuaua

SEQ ID NO: 44235 - RNA, 40 nt, Artificial Sequence
  Synthetic Oligonucleotide; REL exon 2; Set C
gguuguucaauuaucucuauauacggguuauacgcaccug

SEQ ID NO: 44236 - RNA, 23 nt, Artificial Sequence
  Synthetic Oligonucleotide; REL exon 2; Set C
aauuaucucuauauacggguuau

SEQ ID NO: 44237 - RNA, 21 nt, Artificial Sequence
  Synthetic Oligonucleotide; REL exon 2; Set C
auuaucucuauauacggguua

SEQ ID NO: 44238 - RNA, 19 nt, Artificial Sequence
  Synthetic Oligonucleotide; REL exon 2; Set C
uuaucucuauauacggguu

SEQ ID NO: 44239 - RNA, 25 nt, Artificial Sequence
  Synthetic Oligonucleotide; REL exon 2; Set C
caauuaucucuauauacggguuaua

SEQ ID NO: 44240 - RNA, 18 nt, Artificial Sequence
  Synthetic Oligonucleotide; REL exon 2; Set C
uuaucucuauauacgggu

SEQ ID NO: 44241 - RNA, 24 nt, Artificial Sequence
  Synthetic Oligonucleotide; REL exon 2; Set C
caauuaucucuauauacggguuau

SEQ ID NO: 44242 - RNA, 22 nt, Artificial Sequence
  Synthetic Oligonucleotide; REL exon 2; Set C
aauuaucucuauauacggguua

SEQ ID NO: 44243 - RNA, 20 nt, Artificial Sequence
  Synthetic Oligonucleotide; REL exon 2; Set C
auuaucucuauauacggguu

SEQ ID NO: 44244 - RNA, 19 nt, Artificial Sequence
  Synthetic Oligonucleotide; REL exon 2; Set C
auuaucucuauauacgggu

SEQ ID NO: 44245 - RNA, 23 nt, Artificial Sequence
  Synthetic Oligonucleotide; REL exon 2; Set C
caauuaucucuauauacggguua

SEQ ID NO: 44246 - RNA, 25 nt, Artificial Sequence
  Synthetic Oligonucleotide; REL exon 2; Set C
ucaauuaucucuauauacggguuau

SEQ ID NO: 44247 - RNA, 21 nt, Artificial Sequence
  Synthetic Oligonucleotide; REL exon 2; Set C
aauuaucucuauauacggguu

SEQ ID NO: 44248 - RNA, 20 nt, Artificial Sequence
  Synthetic Oligonucleotide; REL exon 2; Set C
aauuaucucuauauacgggu

SEQ ID NO: 44249 - RNA, 22 nt, Artificial Sequence
  Synthetic Oligonucleotide; REL exon 2; Set C
caauuaucucuauauacggguu

SEQ ID NO: 44250 - RNA, 24 nt, Artificial Sequence
  Synthetic Oligonucleotide; REL exon 2; Set C
ucaauuaucucuauauacggguua

SEQ ID NO: 44251 - RNA, 21 nt, Artificial Sequence
  Synthetic Oligonucleotide; REL exon 2; Set C
caauuaucucuauauacgggu

SEQ ID NO: 44252 - RNA, 23 nt, Artificial Sequence
  Synthetic Oligonucleotide; REL exon 2; Set C
ucaauuaucucuauauacggguu

SEQ ID NO: 44253 - RNA, 22 nt, Artificial Sequence
  Synthetic Oligonucleotide; REL exon 2; Set C
ucaauuaucucuauauacgggu

SEQ ID NO: 44254 - RNA, 24 nt, Artificial Sequence
  Synthetic Oligonucleotide; REL exon 2; Set C
uucaauuaucucuauauacggguu

SEQ ID NO: 44255 - RNA, 23 nt, Artificial Sequence
  Synthetic Oligonucleotide; REL exon 2; Set C
uucaauuaucucuauauacgggu

SEQ ID NO: 44256 - RNA, 32 nt, Artificial Sequence
  Synthetic Oligonucleotide; REL exon 2; Set A
cuggguuguucaauuaucucuauauacggguu

SEQ ID NO: 44257 - RNA, 31 nt, Artificial Sequence
  Synthetic Oligonucleotide; REL exon 2; Set A
cuggguuguucaauuaucucuauauacgggu

SEQ ID NO: 44258 - RNA, 16 nt, Artificial Sequence
  Synthetic Oligonucleotide; REL exon 2; Set C
uggguuguucaauuau

SEQ ID NO: 44259 - RNA, 17 nt, Artificial Sequence
  Synthetic Oligonucleotide; REL exon 2; Set C
cuggguuguucaauuau

SEQ ID NO: 44260 - RNA, 35 nt, Artificial Sequence
  Synthetic Oligonucleotide; REL exon 2; Set C
aaaacgcauuccccucugccuggguuguucaauua

SEQ ID NO: 44261 - RNA, 34 nt, Artificial Sequence
  Synthetic Oligonucleotide; REL exon 2; Set C
aaaacgcauuccccucugccuggguuguucaauu

SEQ ID NO: 44262 - RNA, 33 nt, Artificial Sequence
  Synthetic Oligonucleotide; REL exon 2; Set C
aaaacgcauuccccucugccuggguuguucaau

SEQ ID NO: 44263 - RNA, 32 nt, Artificial Sequence
  Synthetic Oligonucleotide; REL exon 2; Set C
aaaacgcauuccccucugccuggguuguucaa

SEQ ID NO: 44264 - RNA, 31 nt, Artificial Sequence
  Synthetic Oligonucleotide; REL exon 2; Set C
aaaacgcauuccccucugccuggguuguuca

SEQ ID NO: 44265 - RNA, 30 nt, Artificial Sequence
  Synthetic Oligonucleotide; REL exon 2; Set C
aaaacgcauuccccucugccuggguuguuc

SEQ ID NO: 44266 - RNA, 29 nt, Artificial Sequence
  Synthetic Oligonucleotide; REL exon 2; Set C
aaaacgcauuccccucugccuggguuguu

SEQ ID NO: 44267 - RNA, 28 nt, Artificial Sequence
  Synthetic Oligonucleotide; REL exon 2; Set C
aaaacgcauuccccucugccuggguugu

SEQ ID NO: 44268 - RNA, 27 nt, Artificial Sequence
  Synthetic Oligonucleotide; REL exon 2; Set C
aaaacgcauuccccucugccuggguug

SEQ ID NO: 44269 - RNA, 40 nt, Artificial Sequence
  Synthetic Oligonucleotide; REL exon 2; Set C
uguaucuaaaacgcauuccccucugccuggguuguucaau

SEQ ID NO: 44270 - RNA, 39 nt, Artificial Sequence
  Synthetic Oligonucleotide; REL exon 2; Set C
uguaucuaaaacgcauuccccucugccuggguuguucaa

SEQ ID NO: 44271 - RNA, 40 nt, Artificial Sequence
  Synthetic Oligonucleotide; REL exon 2; Set C
uuguaucuaaaacgcauuccccucugccuggguuguucaa

SEQ ID NO: 44272 - RNA, 38 nt, Artificial Sequence
  Synthetic Oligonucleotide; REL exon 2; Set C
uguaucuaaaacgcauuccccucugccuggguuguuca

SEQ ID NO: 44273 - RNA, 37 nt, Artificial Sequence
  Synthetic Oligonucleotide; REL exon 2; Set C
uguaucuaaaacgcauuccccucugccuggguuguuc

SEQ ID NO: 44274 - RNA, 39 nt, Artificial Sequence
  Synthetic Oligonucleotide; REL exon 2; Set C
uuguaucuaaaacgcauuccccucugccuggguuguuca

SEQ ID NO: 44275 - RNA, 36 nt, Artificial Sequence
  Synthetic Oligonucleotide; REL exon 2; Set C
uguaucuaaaacgcauuccccucugccuggguuguu

SEQ ID NO: 44276 - RNA, 38 nt, Artificial Sequence
  Synthetic Oligonucleotide; REL exon 2; Set C
uuguaucuaaaacgcauuccccucugccuggguuguuc

SEQ ID NO: 44277 - RNA, 40 nt, Artificial Sequence
  Synthetic Oligonucleotide; REL exon 2; Set C
uuuguaucuaaaacgcauuccccucugccuggguuguuca

SEQ ID NO: 44278 - RNA, 37 nt, Artificial Sequence
  Synthetic Oligonucleotide; REL exon 2; Set C
uuguaucuaaaacgcauuccccucugccuggguuguu

SEQ ID NO: 44279 - RNA, 35 nt, Artificial Sequence
  Synthetic Oligonucleotide; REL exon 2; Set C
uguaucuaaaacgcauuccccucugccuggguugu

SEQ ID NO: 44280 - RNA, 39 nt, Artificial Sequence
  Synthetic Oligonucleotide; REL exon 2; Set C
uuuguaucuaaaacgcauuccccucugccuggguuguuc

SEQ ID NO: 44281 - RNA, 38 nt, Artificial Sequence
  Synthetic Oligonucleotide; REL exon 2; Set C
uuuguaucuaaaacgcauuccccucugccuggguuguu

SEQ ID NO: 44282 - RNA, 36 nt, Artificial Sequence
  Synthetic Oligonucleotide; REL exon 2; Set C
uuguaucuaaaacgcauuccccucugccuggguugu

SEQ ID NO: 44283 - RNA, 34 nt, Artificial Sequence
  Synthetic Oligonucleotide; REL exon 2; Set C
uguaucuaaaacgcauuccccucugccuggguug

SEQ ID NO: 44284 - RNA, 37 nt, Artificial Sequence
  Synthetic Oligonucleotide; REL exon 2; Set C
uuuguaucuaaaacgcauuccccucugccuggguugu

SEQ ID NO: 44285 - RNA, 35 nt, Artificial Sequence
  Synthetic Oligonucleotide; REL exon 2; Set C
uuguaucuaaaacgcauuccccucugccuggguug

SEQ ID NO: 44286 - RNA, 33 nt, Artificial Sequence
  Synthetic Oligonucleotide; REL exon 2; Set C
uguaucuaaaacgcauuccccucugccuggguu

SEQ ID NO: 44287 - RNA, 36 nt, Artificial Sequence
  Synthetic Oligonucleotide; REL exon 2; Set C
uuuguaucuaaaacgcauuccccucugccuggguug

SEQ ID NO: 44288 - RNA, 34 nt, Artificial Sequence
  Synthetic Oligonucleotide; REL exon 2; Set C
uuguaucuaaaacgcauuccccucugccuggguu

SEQ ID NO: 44289 - RNA, 32 nt, Artificial Sequence
  Synthetic Oligonucleotide; REL exon 2; Set C
uguaucuaaaacgcauuccccucugccugggu

SEQ ID NO: 44290 - RNA, 31 nt, Artificial Sequence
  Synthetic Oligonucleotide; REL exon 2; Set C
uguaucuaaaacgcauuccccucugccuggg

SEQ ID NO: 44291 - RNA, 35 nt, Artificial Sequence
  Synthetic Oligonucleotide; REL exon 2; Set C
uuuguaucuaaaacgcauuccccucugccuggguu

SEQ ID NO: 44292 - RNA, 33 nt, Artificial Sequence
  Synthetic Oligonucleotide; REL exon 2; Set C
uuguaucuaaaacgcauuccccucugccugggu

SEQ ID NO: 44293 - RNA, 32 nt, Artificial Sequence
  Synthetic Oligonucleotide; REL exon 2; Set C
uuguaucuaaaacgcauuccccucugccuggg

SEQ ID NO: 44294 - RNA, 34 nt, Artificial Sequence
  Synthetic Oligonucleotide; REL exon 2; Set C
uuuguaucuaaaacgcauuccccucugccugggu

SEQ ID NO: 44295 - RNA, 33 nt, Artificial Sequence
  Synthetic Oligonucleotide; REL exon 2; Set C
uuuguaucuaaaacgcauuccccucugccuggg

SEQ ID NO: 44296 - RNA, 31 nt, Artificial Sequence
  Synthetic Oligonucleotide; REL exon 2; Set C
uuguaucuaaaacgcauuccccucugccugg

SEQ ID NO: 44297 - RNA, 32 nt, Artificial Sequence
  Synthetic Oligonucleotide; REL exon 2; Set C
uuuguaucuaaaacgcauuccccucugccugg

SEQ ID NO: 44298 - RNA, 31 nt, Artificial Sequence
  Synthetic Oligonucleotide; REL exon 2; Set A
uuuguaucuaaaacgcauuccccucugccug

SEQ ID NO: 44299 - RNA, 18 nt, Artificial Sequence
  Synthetic Oligonucleotide; REL exon 2; Set C
ugaucgcccuucacauuu

SEQ ID NO: 44300 - RNA, 38 nt, Artificial Sequence
  Synthetic Oligonucleotide; REL exon 2; Set C
augcugccugcugaucgcccuucacauuuguaucuaaa

SEQ ID NO: 44301 - RNA, 31 nt, Artificial Sequence
  Synthetic Oligonucleotide; REL exon 2; Set C
augcugccugcugaucgcccuucacauuugu

SEQ ID NO: 44302 - RNA, 30 nt, Artificial Sequence
  Synthetic Oligonucleotide; REL exon 2; Set C
augcugccugcugaucgcccuucacauuug

SEQ ID NO: 44303 - RNA, 29 nt, Artificial Sequence
  Synthetic Oligonucleotide; REL exon 2; Set C
augcugccugcugaucgcccuucacauuu

SEQ ID NO: 44304 - RNA, 30 nt, Artificial Sequence
  Synthetic Oligonucleotide; REL exon 2; Set C
aaugcugccugcugaucgcccuucacauuu

SEQ ID NO: 44305 - RNA, 15 nt, Artificial Sequence
  Synthetic Oligonucleotide; REL exon 2; Set C
ugcugccugcugauc

SEQ ID NO: 44306 - RNA, 17 nt, Artificial Sequence
  Synthetic Oligonucleotide; REL exon 2; Set C
aaugcugccugcugauc

SEQ ID NO: 44307 - RNA, 16 nt, Artificial Sequence
  Synthetic Oligonucleotide; REL exon 2; Set C
aaugcugccugcugau

SEQ ID NO: 44308 - RNA, 18 nt, Artificial Sequence
  Synthetic Oligonucleotide; REL exon 2; Set C
gaaugcugccugcugauc

SEQ ID NO: 44309 - RNA, 19 nt, Artificial Sequence
  Synthetic Oligonucleotide; REL exon 2; Set A
ggaaugcugccugcugauc

SEQ ID NO: 44310 - RNA, 17 nt, Artificial Sequence
  Synthetic Oligonucleotide; REL exon 2; Set C
gaaugcugccugcugau

SEQ ID NO: 44311 - RNA, 16 nt, Artificial Sequence
  Synthetic Oligonucleotide; REL exon 2; Set C
gaaugcugccugcuga

SEQ ID NO: 44312 - RNA, 18 nt, Artificial Sequence
  Synthetic Oligonucleotide; REL exon 2; Set A
ggaaugcugccugcugau

SEQ ID NO: 44313 - RNA, 17 nt, Artificial Sequence
  Synthetic Oligonucleotide; REL exon 2; Set A
ggaaugcugccugcuga

SEQ ID NO: 44314 - RNA, 18 nt, Artificial Sequence
  Synthetic Oligonucleotide; REL exon 2; Set A
uggaaugcugccugcuga

SEQ ID NO: 44315 - RNA, 27 nt, Artificial Sequence
  Synthetic Oligonucleotide; REL exon 2; Set C
gcuccccuggaaugcugccugcugauc

SEQ ID NO: 44316 - RNA, 24 nt, Artificial Sequence
  Synthetic Oligonucleotide; REL exon 2; Set C
cuccccuggaaugcugccugcuga

SEQ ID NO: 44317 - RNA, 28 nt, Artificial Sequence
  Synthetic Oligonucleotide; REL exon 2; Set C
ugcuccccuggaaugcugccugcugauc

SEQ ID NO: 44318 - RNA, 26 nt, Artificial Sequence
  Synthetic Oligonucleotide; REL exon 2; Set C
gcuccccuggaaugcugccugcugau

SEQ ID NO: 44319 - RNA, 25 nt, Artificial Sequence
  Synthetic Oligonucleotide; REL exon 2; Set C
gcuccccuggaaugcugccugcuga

SEQ ID NO: 44320 - RNA, 29 nt, Artificial Sequence
  Synthetic Oligonucleotide; REL exon 2; Set C
gugcuccccuggaaugcugccugcugauc

SEQ ID NO: 44321 - RNA, 27 nt, Artificial Sequence
  Synthetic Oligonucleotide; REL exon 2; Set C
ugcuccccuggaaugcugccugcugau

SEQ ID NO: 44322 - RNA, 26 nt, Artificial Sequence
  Synthetic Oligonucleotide; REL exon 2; Set C
ugcuccccuggaaugcugccugcuga

SEQ ID NO: 44323 - RNA, 28 nt, Artificial Sequence
  Synthetic Oligonucleotide; REL exon 2; Set C
gugcuccccuggaaugcugccugcugau

SEQ ID NO: 44324 - RNA, 30 nt, Artificial Sequence
  Synthetic Oligonucleotide; REL exon 2; Set C
ugugcuccccuggaaugcugccugcugauc

SEQ ID NO: 44325 - RNA, 29 nt, Artificial Sequence
  Synthetic Oligonucleotide; REL exon 2; Set C
ugugcuccccuggaaugcugccugcugau

SEQ ID NO: 44326 - RNA, 28 nt, Artificial Sequence
  Synthetic Oligonucleotide; REL exon 2; Set C
ugugcuccccuggaaugcugccugcuga

SEQ ID NO: 44327 - RNA, 20 nt, Artificial Sequence
  Synthetic Oligonucleotide; REL exon 2; Set C
gcuccccuggaaugcugccu

SEQ ID NO: 44328 - RNA, 21 nt, Artificial Sequence
  Synthetic Oligonucleotide; REL exon 2; Set C
ugcuccccuggaaugcugccu

SEQ ID NO: 44329 - RNA, 23 nt, Artificial Sequence
  Synthetic Oligonucleotide; REL exon 2; Set C
ugugcuccccuggaaugcugccu

SEQ ID NO: 44330 - RNA, 21 nt, Artificial Sequence
  Synthetic Oligonucleotide; REL exon 2; Set C
gugcuccccuggaaugcugcc

SEQ ID NO: 44331 - RNA, 22 nt, Artificial Sequence
  Synthetic Oligonucleotide; REL exon 2; Set C
ugugcuccccuggaaugcugcc

SEQ ID NO: 44332 - RNA, 20 nt, Artificial Sequence
  Synthetic Oligonucleotide; REL exon 2; Set A
gugcuccccuggaaugcugc

SEQ ID NO: 44333 - RNA, 17 nt, Artificial Sequence
  Synthetic Oligonucleotide; REL exon 2; Set A
ugcuccccuggaaugcu

SEQ ID NO: 44334 - RNA, 21 nt, Artificial Sequence
  Synthetic Oligonucleotide; REL exon 2; Set A
ugugcuccccuggaaugcugc

SEQ ID NO: 44335 - RNA, 19 nt, Artificial Sequence
  Synthetic Oligonucleotide; REL exon 2; Set A
gugcuccccuggaaugcug

SEQ ID NO: 44336 - RNA, 40 nt, Artificial Sequence
  Synthetic Oligonucleotide; REL exon 2; Set C
uugucugugcugugcuccccuggaaugcugccugcugauc

SEQ ID NO: 44337 - RNA, 16 nt, Artificial Sequence
  Synthetic Oligonucleotide; REL exon 2; Set C
ugcuccccuggaaugc

SEQ ID NO: 44338 - RNA, 18 nt, Artificial Sequence
  Synthetic Oligonucleotide; REL exon 2; Set A
gugcuccccuggaaugcu

SEQ ID NO: 44339 - RNA, 20 nt, Artificial Sequence
  Synthetic Oligonucleotide; REL exon 2; Set A
ugugcuccccuggaaugcug

SEQ ID NO: 44340 - RNA, 15 nt, Artificial Sequence
  Synthetic Oligonucleotide; REL exon 2; Set C
ugcuccccuggaaug

SEQ ID NO: 44341 - RNA, 39 nt, Artificial Sequence
  Synthetic Oligonucleotide; REL exon 2; Set C
uugucugugcugugcuccccuggaaugcugccugcugau

SEQ ID NO: 44342 - RNA, 17 nt, Artificial Sequence
  Synthetic Oligonucleotide; REL exon 2; Set A
gugcuccccuggaaugc

SEQ ID NO: 44343 - RNA, 19 nt, Artificial Sequence
  Synthetic Oligonucleotide; REL exon 2; Set A
ugugcuccccuggaaugcu

SEQ ID NO: 44344 - RNA, 40 nt, Artificial Sequence
  Synthetic Oligonucleotide; REL exon 2; Set C
guugucugugcugugcuccccuggaaugcugccugcugau

SEQ ID NO: 44345 - RNA, 18 nt, Artificial Sequence
  Synthetic Oligonucleotide; REL exon 2; Set A
ugugcuccccuggaaugc

SEQ ID NO: 44346 - RNA, 16 nt, Artificial Sequence
  Synthetic Oligonucleotide; REL exon 2; Set C
ugugcuccccuggaau

SEQ ID NO: 44347 - RNA, 15 nt, Artificial Sequence
  Synthetic Oligonucleotide; REL exon 2; Set C
ugugcuccccuggaa

SEQ ID NO: 44348 - RNA, 33 nt, Artificial Sequence
  Synthetic Oligonucleotide; REL exon 2; Set C
uugucugugcugugcuccccuggaaugcugccu

SEQ ID NO: 44349 - RNA, 34 nt, Artificial Sequence
  Synthetic Oligonucleotide; REL exon 2; Set C
guugucugugcugugcuccccuggaaugcugccu

SEQ ID NO: 44350 - RNA, 32 nt, Artificial Sequence
  Synthetic Oligonucleotide; REL exon 2; Set C
uugucugugcugugcuccccuggaaugcugcc

SEQ ID NO: 44351 - RNA, 35 nt, Artificial Sequence
  Synthetic Oligonucleotide; REL exon 2; Set C
uguugucugugcugugcuccccuggaaugcugccu

SEQ ID NO: 44352 - RNA, 33 nt, Artificial Sequence
  Synthetic Oligonucleotide; REL exon 2; Set C
guugucugugcugugcuccccuggaaugcugcc

SEQ ID NO: 44353 - RNA, 31 nt, Artificial Sequence
  Synthetic Oligonucleotide; REL exon 2; Set C
uugucugugcugugcuccccuggaaugcugc

SEQ ID NO: 44354 - RNA, 36 nt, Artificial Sequence
  Synthetic Oligonucleotide; REL exon 2; Set C
uuguugucugugcugugcuccccuggaaugcugccu

SEQ ID NO: 44355 - RNA, 34 nt, Artificial Sequence
  Synthetic Oligonucleotide; REL exon 2; Set C
uguugucugugcugugcuccccuggaaugcugcc

SEQ ID NO: 44356 - RNA, 32 nt, Artificial Sequence
  Synthetic Oligonucleotide; REL exon 2; Set C
guugucugugcugugcuccccuggaaugcugc

SEQ ID NO: 44357 - RNA, 37 nt, Artificial Sequence
  Synthetic Oligonucleotide; REL exon 2; Set C
guuguugucugugcugugcuccccuggaaugcugccu

SEQ ID NO: 44358 - RNA, 29 nt, Artificial Sequence
  Synthetic Oligonucleotide; REL exon 2; Set C
uugucugugcugugcuccccuggaaugcu

SEQ ID NO: 44359 - RNA, 35 nt, Artificial Sequence
  Synthetic Oligonucleotide; REL exon 2; Set C
uuguugucugugcugugcuccccuggaaugcugcc

SEQ ID NO: 44360 - RNA, 33 nt, Artificial Sequence
  Synthetic Oligonucleotide; REL exon 2; Set C
uguugucugugcugugcuccccuggaaugcugc

SEQ ID NO: 44361 - RNA, 31 nt, Artificial Sequence
  Synthetic Oligonucleotide; REL exon 2; Set C
guugucugugcugugcuccccuggaaugcug

SEQ ID NO: 44362 - RNA, 38 nt, Artificial Sequence
  Synthetic Oligonucleotide; REL exon 2; Set C
gguuguugucugugcugugcuccccuggaaugcugccu

SEQ ID NO: 44363 - RNA, 28 nt, Artificial Sequence
  Synthetic Oligonucleotide; REL exon 2; Set C
uugucugugcugugcuccccuggaaugc

SEQ ID NO: 44364 - RNA, 30 nt, Artificial Sequence
  Synthetic Oligonucleotide; REL exon 2; Set C
guugucugugcugugcuccccuggaaugcu

SEQ ID NO: 44365 - RNA, 36 nt, Artificial Sequence
  Synthetic Oligonucleotide; REL exon 2; Set C
guuguugucugugcugugcuccccuggaaugcugcc

SEQ ID NO: 44366 - RNA, 34 nt, Artificial Sequence
  Synthetic Oligonucleotide; REL exon 2; Set C
uuguugucugugcugugcuccccuggaaugcugc

SEQ ID NO: 44367 - RNA, 32 nt, Artificial Sequence
  Synthetic Oligonucleotide; REL exon 2; Set C
uguugucugugcugugcuccccuggaaugcug

SEQ ID NO: 44368 - RNA, 29 nt, Artificial Sequence
  Synthetic Oligonucleotide; REL exon 2; Set C
guugucugugcugugcuccccuggaaugc

SEQ ID NO: 44369 - RNA, 31 nt, Artificial Sequence
  Synthetic Oligonucleotide; REL exon 2; Set C
uguugucugugcugugcuccccuggaaugcu

SEQ ID NO: 44370 - RNA, 37 nt, Artificial Sequence
  Synthetic Oligonucleotide; REL exon 2; Set C
gguuguugucugugcugugcuccccuggaaugcugcc

SEQ ID NO: 44371 - RNA, 35 nt, Artificial Sequence
  Synthetic Oligonucleotide; REL exon 2; Set C
guuguugucugugcugugcuccccuggaaugcugc

SEQ ID NO: 44372 - RNA, 33 nt, Artificial Sequence
  Synthetic Oligonucleotide; REL exon 2; Set C
uuguugucugugcugugcuccccuggaaugcug

SEQ ID NO: 44373 - RNA, 26 nt, Artificial Sequence
  Synthetic Oligonucleotide; REL exon 2; Set C
uugucugugcugugcuccccuggaau

SEQ ID NO: 44374 - RNA, 30 nt, Artificial Sequence
  Synthetic Oligonucleotide; REL exon 2; Set C
uguugucugugcugugcuccccuggaaugc

SEQ ID NO: 44375 - RNA, 32 nt, Artificial Sequence
  Synthetic Oligonucleotide; REL exon 2; Set C
uuguugucugugcugugcuccccuggaaugcu

SEQ ID NO: 44376 - RNA, 36 nt, Artificial Sequence
  Synthetic Oligonucleotide; REL exon 2; Set C
gguuguugucugugcugugcuccccuggaaugcugc

SEQ ID NO: 44377 - RNA, 34 nt, Artificial Sequence
  Synthetic Oligonucleotide; REL exon 2; Set C
guuguugucugugcugugcuccccuggaaugcug

SEQ ID NO: 44378 - RNA, 27 nt, Artificial Sequence
  Synthetic Oligonucleotide; REL exon 2; Set C
guugucugugcugugcuccccuggaau

SEQ ID NO: 44379 - RNA, 31 nt, Artificial Sequence
  Synthetic Oligonucleotide; REL exon 2; Set C
uuguugucugugcugugcuccccuggaaugc

SEQ ID NO: 44380 - RNA, 33 nt, Artificial Sequence
  Synthetic Oligonucleotide; REL exon 2; Set C
guuguugucugugcugugcuccccuggaaugcu

SEQ ID NO: 44381 - RNA, 25 nt, Artificial Sequence
  Synthetic Oligonucleotide; REL exon 2; Set C
uugucugugcugugcuccccuggaa

SEQ ID NO: 44382 - RNA, 35 nt, Artificial Sequence
  Synthetic Oligonucleotide; REL exon 2; Set C
gguuguugucugugcugugcuccccuggaaugcug

SEQ ID NO: 44383 - RNA, 28 nt, Artificial Sequence
  Synthetic Oligonucleotide; REL exon 2; Set C
uguugucugugcugugcuccccuggaau

SEQ ID NO: 44384 - RNA, 32 nt, Artificial Sequence
  Synthetic Oligonucleotide; REL exon 2; Set C
guuguugucugugcugugcuccccuggaaugc

SEQ ID NO: 44385 - RNA, 34 nt, Artificial Sequence
  Synthetic Oligonucleotide; REL exon 2; Set C
gguuguugucugugcugugcuccccuggaaugcu

SEQ ID NO: 44386 - RNA, 26 nt, Artificial Sequence
  Synthetic Oligonucleotide; REL exon 2; Set C
guugucugugcugugcuccccuggaa

SEQ ID NO: 44387 - RNA, 24 nt, Artificial Sequence
  Synthetic Oligonucleotide; REL exon 2; Set C
uugucugugcugugcuccccugga

SEQ ID NO: 44388 - RNA, 29 nt, Artificial Sequence
  Synthetic Oligonucleotide; REL exon 2; Set C
uuguugucugugcugugcuccccuggaau

SEQ ID NO: 44389 - RNA, 33 nt, Artificial Sequence
  Synthetic Oligonucleotide; REL exon 2; Set C
gguuguugucugugcugugcuccccuggaaugc

SEQ ID NO: 44390 - RNA, 27 nt, Artificial Sequence
  Synthetic Oligonucleotide; REL exon 2; Set C
uguugucugugcugugcuccccuggaa

SEQ ID NO: 44391 - RNA, 25 nt, Artificial Sequence
  Synthetic Oligonucleotide; REL exon 2; Set C
guugucugugcugugcuccccugga

SEQ ID NO: 44392 - RNA, 30 nt, Artificial Sequence
  Synthetic Oligonucleotide; REL exon 2; Set C
guuguugucugugcugugcuccccuggaau

SEQ ID NO: 44393 - RNA, 28 nt, Artificial Sequence
  Synthetic Oligonucleotide; REL exon 2; Set C
uuguugucugugcugugcuccccuggaa

SEQ ID NO: 44394 - RNA, 26 nt, Artificial Sequence
  Synthetic Oligonucleotide; REL exon 2; Set C
uguugucugugcugugcuccccugga

SEQ ID NO: 44395 - RNA, 31 nt, Artificial Sequence
  Synthetic Oligonucleotide; REL exon 2; Set C
gguuguugucugugcugugcuccccuggaau

SEQ ID NO: 44396 - RNA, 29 nt, Artificial Sequence
  Synthetic Oligonucleotide; REL exon 2; Set C
guuguugucugugcugugcuccccuggaa

SEQ ID NO: 44397 - RNA, 27 nt, Artificial Sequence
  Synthetic Oligonucleotide; REL exon 2; Set C
uuguugucugugcugugcuccccugga

SEQ ID NO: 44398 - RNA, 30 nt, Artificial Sequence
  Synthetic Oligonucleotide; REL exon 2; Set C
gguuguugucugugcugugcuccccuggaa

SEQ ID NO: 44399 - RNA, 28 nt, Artificial Sequence
  Synthetic Oligonucleotide; REL exon 2; Set C
guuguugucugugcugugcuccccugga

SEQ ID NO: 44400 - RNA, 29 nt, Artificial Sequence
  Synthetic Oligonucleotide; REL exon 2; Set C
gguuguugucugugcugugcuccccugga

SEQ ID NO: 44401 - RNA, 40 nt, Artificial Sequence
  Synthetic Oligonucleotide; REL exon 2; Set C
auguucgguuguugucugugcugugcuccccuggaaugcu

SEQ ID NO: 44402 - RNA, 39 nt, Artificial Sequence
  Synthetic Oligonucleotide; REL exon 2; Set C
auguucgguuguugucugugcugugcuccccuggaaugc

SEQ ID NO: 44403 - RNA, 40 nt, Artificial Sequence
  Synthetic Oligonucleotide; REL exon 2; Set C
uauguucgguuguugucugugcugugcuccccuggaaugc

SEQ ID NO: 44404 - RNA, 37 nt, Artificial Sequence
  Synthetic Oligonucleotide; REL exon 2; Set C
auguucgguuguugucugugcugugcuccccuggaau

SEQ ID NO: 44405 - RNA, 17 nt, Artificial Sequence
  Synthetic Oligonucleotide; REL exon 2; Set C
guugucugugcugugcu

SEQ ID NO: 44406 - RNA, 38 nt, Artificial Sequence
  Synthetic Oligonucleotide; REL exon 2; Set C
uauguucgguuguugucugugcugugcuccccuggaau

SEQ ID NO: 44407 - RNA, 36 nt, Artificial Sequence
  Synthetic Oligonucleotide; REL exon 2; Set C
auguucgguuguugucugugcugugcuccccuggaa

SEQ ID NO: 44408 - RNA, 16 nt, Artificial Sequence
  Synthetic Oligonucleotide; REL exon 2; Set C
guugucugugcugugc

SEQ ID NO: 44409 - RNA, 18 nt, Artificial Sequence
  Synthetic Oligonucleotide; REL exon 2; Set C
uguugucugugcugugcu

SEQ ID NO: 44410 - RNA, 15 nt, Artificial Sequence
  Synthetic Oligonucleotide; REL exon 2; Set C
guugucugugcugug

SEQ ID NO: 44411 - RNA, 39 nt, Artificial Sequence
  Synthetic Oligonucleotide; REL exon 2; Set C
guauguucgguuguugucugugcugugcuccccuggaau

SEQ ID NO: 44412 - RNA, 37 nt, Artificial Sequence
  Synthetic Oligonucleotide; REL exon 2; Set C
uauguucgguuguugucugugcugugcuccccuggaa

SEQ ID NO: 44413 - RNA, 35 nt, Artificial Sequence
  Synthetic Oligonucleotide; REL exon 2; Set C
auguucgguuguugucugugcugugcuccccugga

SEQ ID NO: 44414 - RNA, 17 nt, Artificial Sequence
  Synthetic Oligonucleotide; REL exon 2; Set C
uguugucugugcugugc

SEQ ID NO: 44415 - RNA, 19 nt, Artificial Sequence
  Synthetic Oligonucleotide; REL exon 2; Set C
uuguugucugugcugugcu

SEQ ID NO: 44416 - RNA, 16 nt, Artificial Sequence
  Synthetic Oligonucleotide; REL exon 2; Set C
uguugucugugcugug

SEQ ID NO: 44417 - RNA, 40 nt, Artificial Sequence
  Synthetic Oligonucleotide; REL exon 2; Set C
gguauguucgguuguugucugugcugugcuccccuggaau

SEQ ID NO: 44418 - RNA, 36 nt, Artificial Sequence
  Synthetic Oligonucleotide; REL exon 2; Set C
uauguucgguuguugucugugcugugcuccccugga

SEQ ID NO: 44419 - RNA, 38 nt, Artificial Sequence
  Synthetic Oligonucleotide; REL exon 2; Set C
guauguucgguuguugucugugcugugcuccccuggaa

SEQ ID NO: 44420 - RNA, 18 nt, Artificial Sequence
  Synthetic Oligonucleotide; REL exon 2; Set C
uuguugucugugcugugc

SEQ ID NO: 44421 - RNA, 20 nt, Artificial Sequence
  Synthetic Oligonucleotide; REL exon 2; Set A
guuguugucugugcugugcu

SEQ ID NO: 44422 - RNA, 22 nt, Artificial Sequence
  Synthetic Oligonucleotide; REL exon 2; Set A
gguuguugucugugcugugcuc

SEQ ID NO: 44423 - RNA, 15 nt, Artificial Sequence
  Synthetic Oligonucleotide; REL exon 2; Set C
uguugucugugcugu

SEQ ID NO: 44424 - RNA, 37 nt, Artificial Sequence
  Synthetic Oligonucleotide; REL exon 2; Set C
guauguucgguuguugucugugcugugcuccccugga

SEQ ID NO: 44425 - RNA, 39 nt, Artificial Sequence
  Synthetic Oligonucleotide; REL exon 2; Set C
gguauguucgguuguugucugugcugugcuccccuggaa

SEQ ID NO: 44426 - RNA, 19 nt, Artificial Sequence
  Synthetic Oligonucleotide; REL exon 2; Set A
guuguugucugugcugugc

SEQ ID NO: 44427 - RNA, 21 nt, Artificial Sequence
  Synthetic Oligonucleotide; REL exon 2; Set A
gguuguugucugugcugugcu

SEQ ID NO: 44428 - RNA, 16 nt, Artificial Sequence
  Synthetic Oligonucleotide; REL exon 2; Set C
uuguugucugugcugu

SEQ ID NO: 44429 - RNA, 38 nt, Artificial Sequence
  Synthetic Oligonucleotide; REL exon 2; Set C
gguauguucgguuguugucugugcugugcuccccugga

SEQ ID NO: 44430 - RNA, 40 nt, Artificial Sequence
  Synthetic Oligonucleotide; REL exon 2; Set C
ggguauguucgguuguugucugugcugugcuccccuggaa

SEQ ID NO: 44431 - RNA, 20 nt, Artificial Sequence
  Synthetic Oligonucleotide; REL exon 2; Set A
gguuguugucugugcugugc

SEQ ID NO: 44432 - RNA, 17 nt, Artificial Sequence
  Synthetic Oligonucleotide; REL exon 2; Set C
guuguugucugugcugu

SEQ ID NO: 44433 - RNA, 39 nt, Artificial Sequence
  Synthetic Oligonucleotide; REL exon 2; Set C
ggguauguucgguuguugucugugcugugcuccccugga

SEQ ID NO: 44434 - RNA, 18 nt, Artificial Sequence
  Synthetic Oligonucleotide; REL exon 2; Set C
gguuguugucugugcugu

SEQ ID NO: 44435 - RNA, 27 nt, Artificial Sequence
  Synthetic Oligonucleotide; REL exon 2; Set C
auguucgguuguugucugugcugugcu

SEQ ID NO: 44436 - RNA, 26 nt, Artificial Sequence
  Synthetic Oligonucleotide; REL exon 2; Set A
auguucgguuguugucugugcugugc

SEQ ID NO: 44437 - RNA, 28 nt, Artificial Sequence
  Synthetic Oligonucleotide; REL exon 2; Set C
uauguucgguuguugucugugcugugcu

SEQ ID NO: 44438 - RNA, 27 nt, Artificial Sequence
  Synthetic Oligonucleotide; REL exon 2; Set A
uauguucgguuguugucugugcugugc

SEQ ID NO: 44439 - RNA, 29 nt, Artificial Sequence
  Synthetic Oligonucleotide; REL exon 2; Set C
guauguucgguuguugucugugcugugcu

SEQ ID NO: 44440 - RNA, 24 nt, Artificial Sequence
  Synthetic Oligonucleotide; REL exon 2; Set A
auguucgguuguugucugugcugu

SEQ ID NO: 44441 - RNA, 28 nt, Artificial Sequence
  Synthetic Oligonucleotide; REL exon 2; Set C
guauguucgguuguugucugugcugugc

SEQ ID NO: 44442 - RNA, 30 nt, Artificial Sequence
  Synthetic Oligonucleotide; REL exon 2; Set C
gguauguucgguuguugucugugcugugcu

SEQ ID NO: 44443 - RNA, 25 nt, Artificial Sequence
  Synthetic Oligonucleotide; REL exon 2; Set A
uauguucgguuguugucugugcugu

SEQ ID NO: 44444 - RNA, 29 nt, Artificial Sequence
  Synthetic Oligonucleotide; REL exon 2; Set C
gguauguucgguuguugucugugcugugc

SEQ ID NO: 44445 - RNA, 31 nt, Artificial Sequence
  Synthetic Oligonucleotide; REL exon 2; Set C
ggguauguucgguuguugucugugcugugcu

SEQ ID NO: 44446 - RNA, 26 nt, Artificial Sequence
  Synthetic Oligonucleotide; REL exon 2; Set A
guauguucgguuguugucugugcugu

SEQ ID NO: 44447 - RNA, 30 nt, Artificial Sequence
  Synthetic Oligonucleotide; REL exon 2; Set C
ggguauguucgguuguugucugugcugugc

SEQ ID NO: 44448 - RNA, 27 nt, Artificial Sequence
  Synthetic Oligonucleotide; REL exon 2; Set C
gguauguucgguuguugucugugcugu

SEQ ID NO: 44449 - RNA, 28 nt, Artificial Sequence
  Synthetic Oligonucleotide; REL exon 2; Set C
ggguauguucgguuguugucugugcugu

SEQ ID NO: 44450 - RNA, 38 nt, Artificial Sequence
  Synthetic Oligonucleotide; REL exon 2; Set C
gauagaaggguauguucgguuguugucugugcugugcu

SEQ ID NO: 44451 - RNA, 35 nt, Artificial Sequence
  Synthetic Oligonucleotide; REL exon 2; Set C
auagaaggguauguucgguuguugucugugcugug

SEQ ID NO: 44452 - RNA, 37 nt, Artificial Sequence
  Synthetic Oligonucleotide; REL exon 2; Set C
gauagaaggguauguucgguuguugucugugcugugc

SEQ ID NO: 44453 - RNA, 39 nt, Artificial Sequence
  Synthetic Oligonucleotide; REL exon 2; Set C
ggauagaaggguauguucgguuguugucugugcugugcu

SEQ ID NO: 44454 - RNA, 36 nt, Artificial Sequence
  Synthetic Oligonucleotide; REL exon 2; Set C
gauagaaggguauguucgguuguugucugugcugug

SEQ ID NO: 44455 - RNA, 34 nt, Artificial Sequence
  Synthetic Oligonucleotide; REL exon 2; Set C
auagaaggguauguucgguuguugucugugcugu

SEQ ID NO: 44456 - RNA, 38 nt, Artificial Sequence
  Synthetic Oligonucleotide; REL exon 2; Set C
ggauagaaggguauguucgguuguugucugugcugugc

SEQ ID NO: 44457 - RNA, 40 nt, Artificial Sequence
  Synthetic Oligonucleotide; REL exon 2; Set C
uggauagaaggguauguucgguuguugucugugcugugcu

SEQ ID NO: 44458 - RNA, 37 nt, Artificial Sequence
  Synthetic Oligonucleotide; REL exon 2; Set C
ggauagaaggguauguucgguuguugucugugcugug

SEQ ID NO: 44459 - RNA, 35 nt, Artificial Sequence
  Synthetic Oligonucleotide; REL exon 2; Set C
gauagaaggguauguucgguuguugucugugcugu

SEQ ID NO: 44460 - RNA, 39 nt, Artificial Sequence
  Synthetic Oligonucleotide; REL exon 2; Set C
uggauagaaggguauguucgguuguugucugugcugugc

SEQ ID NO: 44461 - RNA, 36 nt, Artificial Sequence
  Synthetic Oligonucleotide; REL exon 2; Set C
ggauagaaggguauguucgguuguugucugugcugu

SEQ ID NO: 44462 - RNA, 37 nt, Artificial Sequence
  Synthetic Oligonucleotide; REL exon 2; Set C
uggauagaaggguauguucgguuguugucugugcugu

SEQ ID NO: 44463 - RNA, 33 nt, Artificial Sequence
  Synthetic Oligonucleotide; REL exon 2; Set B
auuaccuggauagaaggguauguucgguuguug

SEQ ID NO: 44464 - RNA, 32 nt, Artificial Sequence
  Synthetic Oligonucleotide; REL exon 2; Set B
auuaccuggauagaaggguauguucgguuguu

SEQ ID NO: 44465 - RNA, 34 nt, Artificial Sequence
  Synthetic Oligonucleotide; REL exon 2; Set B
uauuaccuggauagaaggguauguucgguuguug

SEQ ID NO: 44466 - RNA, 31 nt, Artificial Sequence
  Synthetic Oligonucleotide; REL exon 2; Set B
auuaccuggauagaaggguauguucgguugu

SEQ ID NO: 44467 - RNA, 35 nt, Artificial Sequence
  Synthetic Oligonucleotide; REL exon 2; Set C
cuauuaccuggauagaaggguauguucgguuguug

SEQ ID NO: 44468 - RNA, 33 nt, Artificial Sequence
  Synthetic Oligonucleotide; REL exon 2; Set B
uauuaccuggauagaaggguauguucgguuguu

SEQ ID NO: 44469 - RNA, 30 nt, Artificial Sequence
  Synthetic Oligonucleotide; REL exon 2; Set B
auuaccuggauagaaggguauguucgguug

SEQ ID NO: 44470 - RNA, 34 nt, Artificial Sequence
  Synthetic Oligonucleotide; REL exon 2; Set C
cuauuaccuggauagaaggguauguucgguuguu

SEQ ID NO: 44471 - RNA, 32 nt, Artificial Sequence
  Synthetic Oligonucleotide; REL exon 2; Set B
uauuaccuggauagaaggguauguucgguugu

SEQ ID NO: 44472 - RNA, 29 nt, Artificial Sequence
  Synthetic Oligonucleotide; REL exon 2; Set B
auuaccuggauagaaggguauguucgguu

SEQ ID NO: 44473 - RNA, 31 nt, Artificial Sequence
  Synthetic Oligonucleotide; REL exon 2; Set B
uauuaccuggauagaaggguauguucgguug

SEQ ID NO: 44474 - RNA, 33 nt, Artificial Sequence
  Synthetic Oligonucleotide; REL exon 2; Set C
cuauuaccuggauagaaggguauguucgguugu

SEQ ID NO: 44475 - RNA, 28 nt, Artificial Sequence
  Synthetic Oligonucleotide; REL exon 2; Set B
auuaccuggauagaaggguauguucggu

SEQ ID NO: 44476 - RNA, 30 nt, Artificial Sequence
  Synthetic Oligonucleotide; REL exon 2; Set B
uauuaccuggauagaaggguauguucgguu

SEQ ID NO: 44477 - RNA, 32 nt, Artificial Sequence
  Synthetic Oligonucleotide; REL exon 2; Set B
cuauuaccuggauagaaggguauguucgguug

SEQ ID NO: 44478 - RNA, 29 nt, Artificial Sequence
  Synthetic Oligonucleotide; REL exon 2; Set B
uauuaccuggauagaaggguauguucggu

SEQ ID NO: 44479 - RNA, 31 nt, Artificial Sequence
  Synthetic Oligonucleotide; REL exon 2; Set B
cuauuaccuggauagaaggguauguucgguu

SEQ ID NO: 44480 - RNA, 30 nt, Artificial Sequence
  Synthetic Oligonucleotide; REL exon 2; Set B
cuauuaccuggauagaaggguauguucggu

SEQ ID NO: 44481 - RNA, 40 nt, Artificial Sequence
  Synthetic Oligonucleotide; REL exon 2; Set C
aagggucuauuaccuggauagaaggguauguucgguuguu

SEQ ID NO: 44482 - RNA, 39 nt, Artificial Sequence
  Synthetic Oligonucleotide; REL exon 2; Set C
aagggucuauuaccuggauagaaggguauguucgguugu

SEQ ID NO: 44483 - RNA, 38 nt, Artificial Sequence
  Synthetic Oligonucleotide; REL exon 2; Set C
aagggucuauuaccuggauagaaggguauguucgguug

SEQ ID NO: 44484 - RNA, 40 nt, Artificial Sequence
  Synthetic Oligonucleotide; REL exon 2; Set C
gaagggucuauuaccuggauagaaggguauguucgguugu

SEQ ID NO: 44485 - RNA, 22 nt, Artificial Sequence
  Synthetic Oligonucleotide; REL exon 2; Set C
auuaccuggauagaaggguaug

SEQ ID NO: 44486 - RNA, 37 nt, Artificial Sequence
  Synthetic Oligonucleotide; REL exon 2; Set C
aagggucuauuaccuggauagaaggguauguucgguu

SEQ ID NO: 44487 - RNA, 39 nt, Artificial Sequence
  Synthetic Oligonucleotide; REL exon 2; Set C
gaagggucuauuaccuggauagaaggguauguucgguug

SEQ ID NO: 44488 - RNA, 21 nt, Artificial Sequence
  Synthetic Oligonucleotide; REL exon 2; Set C
auuaccuggauagaaggguau

SEQ ID NO: 44489 - RNA, 23 nt, Artificial Sequence
  Synthetic Oligonucleotide; REL exon 2; Set C
uauuaccuggauagaaggguaug

SEQ ID NO: 44490 - RNA, 36 nt, Artificial Sequence
  Synthetic Oligonucleotide; REL exon 2; Set C
aagggucuauuaccuggauagaaggguauguucggu

SEQ ID NO: 44491 - RNA, 38 nt, Artificial Sequence
  Synthetic Oligonucleotide; REL exon 2; Set C
gaagggucuauuaccuggauagaaggguauguucgguu

SEQ ID NO: 44492 - RNA, 40 nt, Artificial Sequence
  Synthetic Oligonucleotide; REL exon 2; Set C
agaagggucuauuaccuggauagaaggguauguucgguug

SEQ ID NO: 44493 - RNA, 22 nt, Artificial Sequence
  Synthetic Oligonucleotide; REL exon 2; Set C
uauuaccuggauagaaggguau

SEQ ID NO: 44494 - RNA, 20 nt, Artificial Sequence
  Synthetic Oligonucleotide; REL exon 2; Set C
auuaccuggauagaagggua

SEQ ID NO: 44495 - RNA, 24 nt, Artificial Sequence
  Synthetic Oligonucleotide; REL exon 2; Set C
cuauuaccuggauagaaggguaug

SEQ ID NO: 44496 - RNA, 37 nt, Artificial Sequence
  Synthetic Oligonucleotide; REL exon 2; Set C
gaagggucuauuaccuggauagaaggguauguucggu

SEQ ID NO: 44497 - RNA, 39 nt, Artificial Sequence
  Synthetic Oligonucleotide; REL exon 2; Set C
agaagggucuauuaccuggauagaaggguauguucgguu

SEQ ID NO: 44498 - RNA, 23 nt, Artificial Sequence
  Synthetic Oligonucleotide; REL exon 2; Set C
cuauuaccuggauagaaggguau

SEQ ID NO: 44499 - RNA, 21 nt, Artificial Sequence
  Synthetic Oligonucleotide; REL exon 2; Set C
uauuaccuggauagaagggua

SEQ ID NO: 44500 - RNA, 19 nt, Artificial Sequence
  Synthetic Oligonucleotide; REL exon 2; Set C
auuaccuggauagaagggu

SEQ ID NO: 44501 - RNA, 38 nt, Artificial Sequence
  Synthetic Oligonucleotide; REL exon 2; Set C
agaagggucuauuaccuggauagaaggguauguucggu

SEQ ID NO: 44502 - RNA, 22 nt, Artificial Sequence
  Synthetic Oligonucleotide; REL exon 2; Set C
cuauuaccuggauagaagggua

SEQ ID NO: 44503 - RNA, 21 nt, Artificial Sequence
  Synthetic Oligonucleotide; REL exon 2; Set C
cuauuaccuggauagaagggu

SEQ ID NO: 44504 - RNA, 30 nt, Artificial Sequence
  Synthetic Oligonucleotide; REL exon 2; Set B
aagggucuauuaccuggauagaaggguaug

SEQ ID NO: 44505 - RNA, 29 nt, Artificial Sequence
  Synthetic Oligonucleotide; REL exon 2; Set B
aagggucuauuaccuggauagaaggguau

SEQ ID NO: 44506 - RNA, 31 nt, Artificial Sequence
  Synthetic Oligonucleotide; REL exon 2; Set B
gaagggucuauuaccuggauagaaggguaug

SEQ ID NO: 44507 - RNA, 30 nt, Artificial Sequence
  Synthetic Oligonucleotide; REL exon 2; Set B
gaagggucuauuaccuggauagaaggguau

SEQ ID NO: 44508 - RNA, 28 nt, Artificial Sequence
  Synthetic Oligonucleotide; REL exon 2; Set B
aagggucuauuaccuggauagaagggua

SEQ ID NO: 44509 - RNA, 32 nt, Artificial Sequence
  Synthetic Oligonucleotide; REL exon 2; Set B
agaagggucuauuaccuggauagaaggguaug

SEQ ID NO: 44510 - RNA, 31 nt, Artificial Sequence
  Synthetic Oligonucleotide; REL exon 2; Set B
agaagggucuauuaccuggauagaaggguau

SEQ ID NO: 44511 - RNA, 29 nt, Artificial Sequence
  Synthetic Oligonucleotide; REL exon 2; Set B
gaagggucuauuaccuggauagaagggua

SEQ ID NO: 44512 - RNA, 27 nt, Artificial Sequence
  Synthetic Oligonucleotide; REL exon 2; Set B
aagggucuauuaccuggauagaagggu

SEQ ID NO: 44513 - RNA, 30 nt, Artificial Sequence
  Synthetic Oligonucleotide; REL exon 2; Set B
agaagggucuauuaccuggauagaagggua

SEQ ID NO: 44514 - RNA, 28 nt, Artificial Sequence
  Synthetic Oligonucleotide; REL exon 2; Set B
gaagggucuauuaccuggauagaagggu

SEQ ID NO: 44515 - RNA, 26 nt, Artificial Sequence
  Synthetic Oligonucleotide; REL exon 2; Set B
aagggucuauuaccuggauagaaggg

SEQ ID NO: 44516 - RNA, 29 nt, Artificial Sequence
  Synthetic Oligonucleotide; REL exon 2; Set B
agaagggucuauuaccuggauagaagggu

SEQ ID NO: 44517 - RNA, 27 nt, Artificial Sequence
  Synthetic Oligonucleotide; REL exon 2; Set B
gaagggucuauuaccuggauagaaggg

SEQ ID NO: 44518 - RNA, 28 nt, Artificial Sequence
  Synthetic Oligonucleotide; REL exon 2; Set B
agaagggucuauuaccuggauagaaggg

SEQ ID NO: 44519 - RNA, 22 nt, Artificial Sequence
  Synthetic Oligonucleotide; REL exon 2; Set C
agaagggucuauuaccuggaua

SEQ ID NO: 44520 - RNA, 21 nt, Artificial Sequence
  Synthetic Oligonucleotide; REL exon 2; Set C
agaagggucuauuaccuggau

SEQ ID NO: 44521 - RNA, 40 nt, Artificial Sequence
  Synthetic Oligonucleotide; REL exon 2; Set C
uagacacagaagaagggucuauuaccuggauagaagggua

SEQ ID NO: 44522 - RNA, 39 nt, Artificial Sequence
  Synthetic Oligonucleotide; REL exon 2; Set C
uagacacagaagaagggucuauuaccuggauagaagggu

SEQ ID NO: 44523 - RNA, 40 nt, Artificial Sequence
  Synthetic Oligonucleotide; REL exon 2; Set C
auagugagauagacacagaagaagggucuauuaccuggau

SEQ ID NO: 44524 - RNA, 39 nt, Artificial Sequence
  Synthetic Oligonucleotide; REL exon 2; Set C
auagugagauagacacagaagaagggucuauuaccugga

SEQ ID NO: 44525 - RNA, 38 nt, Artificial Sequence
  Synthetic Oligonucleotide; REL exon 2; Set C
auagugagauagacacagaagaagggucuauuaccugg

SEQ ID NO: 44526 - RNA, 30 nt, Artificial Sequence
  Synthetic Oligonucleotide; REL exon 2; Set B
agugagauagacacagaagaagggucuauu

SEQ ID NO: 44527 - RNA, 15 nt, Artificial Sequence
  Synthetic Oligonucleotide; REL exon 2; Set C
uagacacagaagaag

SEQ ID NO: 44528 - RNA, 31 nt, Artificial Sequence
  Synthetic Oligonucleotide; REL exon 2; Set B
uagugagauagacacagaagaagggucuauu

SEQ ID NO: 44529 - RNA, 32 nt, Artificial Sequence
  Synthetic Oligonucleotide; REL exon 2; Set B
auagugagauagacacagaagaagggucuauu

SEQ ID NO: 44530 - RNA, 31 nt, Artificial Sequence
  Synthetic Oligonucleotide; REL exon 2; Set B
auagugagauagacacagaagaagggucuau

SEQ ID NO: 44531 - RNA, 30 nt, Artificial Sequence
  Synthetic Oligonucleotide; REL exon 2; Set B
auagugagauagacacagaagaagggucua

SEQ ID NO: 44532 - RNA, 22 nt, Artificial Sequence
  Synthetic Oligonucleotide; REL exon 2; Set C
agugagauagacacagaagaag

SEQ ID NO: 44533 - RNA, 21 nt, Artificial Sequence
  Synthetic Oligonucleotide; REL exon 2; Set C
agugagauagacacagaagaa

SEQ ID NO: 44534 - RNA, 23 nt, Artificial Sequence
  Synthetic Oligonucleotide; REL exon 2; Set C
uagugagauagacacagaagaag

SEQ ID NO: 44535 - RNA, 20 nt, Artificial Sequence
  Synthetic Oligonucleotide; REL exon 2; Set C
agugagauagacacagaaga

SEQ ID NO: 44536 - RNA, 22 nt, Artificial Sequence
  Synthetic Oligonucleotide; REL exon 2; Set C
uagugagauagacacagaagaa

SEQ ID NO: 44537 - RNA, 24 nt, Artificial Sequence
  Synthetic Oligonucleotide; REL exon 2; Set C
auagugagauagacacagaagaag

SEQ ID NO: 44538 - RNA, 21 nt, Artificial Sequence
  Synthetic Oligonucleotide; REL exon 2; Set C
uagugagauagacacagaaga

SEQ ID NO: 44539 - RNA, 23 nt, Artificial Sequence
  Synthetic Oligonucleotide; REL exon 2; Set C
auagugagauagacacagaagaa

SEQ ID NO: 44540 - RNA, 22 nt, Artificial Sequence
  Synthetic Oligonucleotide; REL exon 2; Set C
auagugagauagacacagaaga

SEQ ID NO: 44541 - RNA, 39 nt, Artificial Sequence
  Synthetic Oligonucleotide; REL exon 2; Set B
uauaugaagcaacuaauagugagauagacacagaagaag

SEQ ID NO: 44542 - RNA, 40 nt, Artificial Sequence
  Synthetic Oligonucleotide; REL exon 2; Set B
guauaugaagcaacuaauagugagauagacacagaagaag

SEQ ID NO: 44543 - RNA, 39 nt, Artificial Sequence
  Synthetic Oligonucleotide; REL exon 2; Set B
guauaugaagcaacuaauagugagauagacacagaagaa

SEQ ID NO: 44544 - RNA, 19 nt, Artificial Sequence
  Synthetic Oligonucleotide; REL exon 2; Set C
aaaggaggaggucagugag

SEQ ID NO: 44545 - RNA, 36 nt, Artificial Sequence
  Synthetic Oligonucleotide; REL exon 2; Set A
aguuuuuaaaaaggaggaggucagugagauuaauau

SEQ ID NO: 44546 - RNA, 15 nt, Artificial Sequence
  Synthetic Oligonucleotide; REL exon 2; Set C
aaaaaggaggagguc

SEQ ID NO: 44547 - RNA, 15 nt, Artificial Sequence
  Synthetic Oligonucleotide; REL exon 2; Set C
uaaaaaggaggaggu

SEQ ID NO: 44548 - RNA, 16 nt, Artificial Sequence
  Synthetic Oligonucleotide; REL exon 2; Set C
uuaaaaaggaggaggu

SEQ ID NO: 44549 - RNA, 18 nt, Artificial Sequence
  Synthetic Oligonucleotide; REL exon 2; Set C
gaaaaguuuuuaaaaagg

SEQ ID NO: 44550 - RNA, 19 nt, Artificial Sequence
  Synthetic Oligonucleotide; REL exon 2; Set C
ugaaaaguuuuuaaaaagg

SEQ ID NO: 44551 - RNA, 20 nt, Artificial Sequence
  Synthetic Oligonucleotide; REL exon 2; Set C
cugaaaaguuuuuaaaaagg

SEQ ID NO: 44552 - RNA, 22 nt, Artificial Sequence
  Synthetic Oligonucleotide; REL exon 2; Set C
cgcaccugaaaaguuuuuaaaa

SEQ ID NO: 44553 - RNA, 28 nt, Artificial Sequence
  Synthetic Oligonucleotide; REL exon 2; Set C
auacgcaccugaaaaguuuuuaaaaagg

SEQ ID NO: 44554 - RNA, 23 nt, Artificial Sequence
  Synthetic Oligonucleotide; REL exon 2; Set C
acgcaccugaaaaguuuuuaaaa

SEQ ID NO: 44555 - RNA, 21 nt, Artificial Sequence
  Synthetic Oligonucleotide; REL exon 2; Set C
cgcaccugaaaaguuuuuaaa

SEQ ID NO: 44556 - RNA, 24 nt, Artificial Sequence
  Synthetic Oligonucleotide; REL exon 2; Set C
uacgcaccugaaaaguuuuuaaaa

SEQ ID NO: 44557 - RNA, 22 nt, Artificial Sequence
  Synthetic Oligonucleotide; REL exon 2; Set C
acgcaccugaaaaguuuuuaaa

SEQ ID NO: 44558 - RNA, 20 nt, Artificial Sequence
  Synthetic Oligonucleotide; REL exon 2; Set C
cgcaccugaaaaguuuuuaa

SEQ ID NO: 44559 - RNA, 23 nt, Artificial Sequence
  Synthetic Oligonucleotide; REL exon 2; Set C
uacgcaccugaaaaguuuuuaaa

SEQ ID NO: 44560 - RNA, 21 nt, Artificial Sequence
  Synthetic Oligonucleotide; REL exon 2; Set C
acgcaccugaaaaguuuuuaa

SEQ ID NO: 44561 - RNA, 22 nt, Artificial Sequence
  Synthetic Oligonucleotide; REL exon 2; Set C
uacgcaccugaaaaguuuuuaa

SEQ ID NO: 44562 - RNA, 20 nt, Artificial Sequence
  Synthetic Oligonucleotide; REL exon 2; Set C
acgcaccugaaaaguuuuua

SEQ ID NO: 44563 - RNA, 21 nt, Artificial Sequence
  Synthetic Oligonucleotide; REL exon 2; Set C
uacgcaccugaaaaguuuuua

SEQ ID NO: 44564 - RNA, 20 nt, Artificial Sequence
  Synthetic Oligonucleotide; REL exon 2; Set C
uacgcaccugaaaaguuuuu

SEQ ID NO: 44565 - RNA, 15 nt, Artificial Sequence
  Synthetic Oligonucleotide; REL exon 2; Set C
cgcaccugaaaaguu

SEQ ID NO: 44566 - RNA, 19 nt, Artificial Sequence
  Synthetic Oligonucleotide; REL exon 2; Set C
uacgcaccugaaaaguuuu

SEQ ID NO: 44567 - RNA, 30 nt, Artificial Sequence
  Synthetic Oligonucleotide; REL exon 2; Set C
ggguuauacgcaccugaaaaguuuuuaaaa

SEQ ID NO: 44568 - RNA, 16 nt, Artificial Sequence
  Synthetic Oligonucleotide; REL exon 2; Set C
acgcaccugaaaaguu

SEQ ID NO: 44569 - RNA, 15 nt, Artificial Sequence
  Synthetic Oligonucleotide; REL exon 2; Set C
acgcaccugaaaagu

SEQ ID NO: 44570 - RNA, 17 nt, Artificial Sequence
  Synthetic Oligonucleotide; REL exon 2; Set C
uacgcaccugaaaaguu

SEQ ID NO: 44571 - RNA, 16 nt, Artificial Sequence
  Synthetic Oligonucleotide; REL exon 2; Set C
uacgcaccugaaaagu

SEQ ID NO: 44572 - RNA, 40 nt, Artificial Sequence
  Synthetic Oligonucleotide; REL exon 2; Set A
uauauacggguuauacgcaccugaaaaguuuuuaaaaagg

SEQ ID NO: 44573 - RNA, 16 nt, Artificial Sequence
  Synthetic Oligonucleotide; REL exon 2; Set C
auacgcaccugaaaag

SEQ ID NO: 44574 - RNA, 39 nt, Artificial Sequence
  Synthetic Oligonucleotide; REL exon 2; Set A
uauauacggguuauacgcaccugaaaaguuuuuaaaaag

SEQ ID NO: 44575 - RNA, 17 nt, Artificial Sequence
  Synthetic Oligonucleotide; REL exon 2; Set C
uauacgcaccugaaaag

SEQ ID NO: 44576 - RNA, 15 nt, Artificial Sequence
  Synthetic Oligonucleotide; REL exon 2; Set C
auacgcaccugaaaa

SEQ ID NO: 44577 - RNA, 38 nt, Artificial Sequence
  Synthetic Oligonucleotide; REL exon 2; Set A
uauauacggguuauacgcaccugaaaaguuuuuaaaaa

SEQ ID NO: 44578 - RNA, 18 nt, Artificial Sequence
  Synthetic Oligonucleotide; REL exon 2; Set C
uuauacgcaccugaaaag

SEQ ID NO: 44579 - RNA, 16 nt, Artificial Sequence
  Synthetic Oligonucleotide; REL exon 2; Set C
uauacgcaccugaaaa

SEQ ID NO: 44580 - RNA, 19 nt, Artificial Sequence
  Synthetic Oligonucleotide; REL exon 2; Set C
guuauacgcaccugaaaag

SEQ ID NO: 44581 - RNA, 17 nt, Artificial Sequence
  Synthetic Oligonucleotide; REL exon 2; Set C
uuauacgcaccugaaaa

SEQ ID NO: 44582 - RNA, 15 nt, Artificial Sequence
  Synthetic Oligonucleotide; REL exon 2; Set C
uauacgcaccugaaa

SEQ ID NO: 44583 - RNA, 22 nt, Artificial Sequence
  Synthetic Oligonucleotide; REL exon 2; Set C
ggguuauacgcaccugaaaagu

SEQ ID NO: 44584 - RNA, 20 nt, Artificial Sequence
  Synthetic Oligonucleotide; REL exon 2; Set C
gguuauacgcaccugaaaag

SEQ ID NO: 44585 - RNA, 18 nt, Artificial Sequence
  Synthetic Oligonucleotide; REL exon 2; Set C
guuauacgcaccugaaaa

SEQ ID NO: 44586 - RNA, 16 nt, Artificial Sequence
  Synthetic Oligonucleotide; REL exon 2; Set C
uuauacgcaccugaaa

SEQ ID NO: 44587 - RNA, 19 nt, Artificial Sequence
  Synthetic Oligonucleotide; REL exon 2; Set C
gguuauacgcaccugaaaa

SEQ ID NO: 44588 - RNA, 17 nt, Artificial Sequence
  Synthetic Oligonucleotide; REL exon 2; Set C
guuauacgcaccugaaa

SEQ ID NO: 44589 - RNA, 18 nt, Artificial Sequence
  Synthetic Oligonucleotide; REL exon 2; Set C
gguuauacgcaccugaaa

SEQ ID NO: 44590 - RNA, 40 nt, Artificial Sequence
  Synthetic Oligonucleotide; REL exon 2; Set A
uaucucuauauacggguuauacgcaccugaaaaguuuuua

SEQ ID NO: 44591 - RNA, 39 nt, Artificial Sequence
  Synthetic Oligonucleotide; REL exon 2; Set A
uaucucuauauacggguuauacgcaccugaaaaguuuuu

SEQ ID NO: 44592 - RNA, 38 nt, Artificial Sequence
  Synthetic Oligonucleotide; REL exon 2; Set A
uaucucuauauacggguuauacgcaccugaaaaguuuu

SEQ ID NO: 44593 - RNA, 37 nt, Artificial Sequence
  Synthetic Oligonucleotide; REL exon 2; Set A
uaucucuauauacggguuauacgcaccugaaaaguuu

SEQ ID NO: 44594 - RNA, 36 nt, Artificial Sequence
  Synthetic Oligonucleotide; REL exon 2; Set A
uaucucuauauacggguuauacgcaccugaaaaguu

SEQ ID NO: 44595 - RNA, 35 nt, Artificial Sequence
  Synthetic Oligonucleotide; REL exon 2; Set A
uaucucuauauacggguuauacgcaccugaaaagu

SEQ ID NO: 44596 - RNA, 21 nt, Artificial Sequence
  Synthetic Oligonucleotide; REL exon 2; Set C
uaucucuauauacggguuaua

SEQ ID NO: 44597 - RNA, 20 nt, Artificial Sequence
  Synthetic Oligonucleotide; REL exon 2; Set C
uaucucuauauacggguuau

SEQ ID NO: 44598 - RNA, 19 nt, Artificial Sequence
  Synthetic Oligonucleotide; REL exon 2; Set C
uaucucuauauacggguua

SEQ ID NO: 44599 - RNA, 31 nt, Artificial Sequence
  Synthetic Oligonucleotide; REL exon 2; Set A
guucaauuaucucuauauacggguuauacgc

SEQ ID NO: 44600 - RNA, 32 nt, Artificial Sequence
  Synthetic Oligonucleotide; REL exon 2; Set A
uguucaauuaucucuauauacggguuauacgc

SEQ ID NO: 44601 - RNA, 30 nt, Artificial Sequence
  Synthetic Oligonucleotide; REL exon 2; Set A
guucaauuaucucuauauacggguuauacg

SEQ ID NO: 44602 - RNA, 29 nt, Artificial Sequence
  Synthetic Oligonucleotide; REL exon 2; Set C
guucaauuaucucuauauacggguuauac

SEQ ID NO: 44603 - RNA, 31 nt, Artificial Sequence
  Synthetic Oligonucleotide; REL exon 2; Set A
uguucaauuaucucuauauacggguuauacg

SEQ ID NO: 44604 - RNA, 33 nt, Artificial Sequence
  Synthetic Oligonucleotide; REL exon 2; Set A
uuguucaauuaucucuauauacggguuauacgc

SEQ ID NO: 44605 - RNA, 30 nt, Artificial Sequence
  Synthetic Oligonucleotide; REL exon 2; Set C
uguucaauuaucucuauauacggguuauac

SEQ ID NO: 44606 - RNA, 32 nt, Artificial Sequence
  Synthetic Oligonucleotide; REL exon 2; Set A
uuguucaauuaucucuauauacggguuauacg

SEQ ID NO: 44607 - RNA, 34 nt, Artificial Sequence
  Synthetic Oligonucleotide; REL exon 2; Set A
guuguucaauuaucucuauauacggguuauacgc

SEQ ID NO: 44608 - RNA, 31 nt, Artificial Sequence
  Synthetic Oligonucleotide; REL exon 2; Set A
uuguucaauuaucucuauauacggguuauac

SEQ ID NO: 44609 - RNA, 35 nt, Artificial Sequence
  Synthetic Oligonucleotide; REL exon 2; Set A
gguuguucaauuaucucuauauacggguuauacgc

SEQ ID NO: 44610 - RNA, 33 nt, Artificial Sequence
  Synthetic Oligonucleotide; REL exon 2; Set A
guuguucaauuaucucuauauacggguuauacg

SEQ ID NO: 44611 - RNA, 32 nt, Artificial Sequence
  Synthetic Oligonucleotide; REL exon 2; Set A
guuguucaauuaucucuauauacggguuauac

SEQ ID NO: 44612 - RNA, 36 nt, Artificial Sequence
  Synthetic Oligonucleotide; REL exon 2; Set C
ggguuguucaauuaucucuauauacggguuauacgc

SEQ ID NO: 44613 - RNA, 34 nt, Artificial Sequence
  Synthetic Oligonucleotide; REL exon 2; Set A
gguuguucaauuaucucuauauacggguuauacg

SEQ ID NO: 44614 - RNA, 33 nt, Artificial Sequence
  Synthetic Oligonucleotide; REL exon 2; Set A
gguuguucaauuaucucuauauacggguuauac

SEQ ID NO: 44615 - RNA, 35 nt, Artificial Sequence
  Synthetic Oligonucleotide; REL exon 2; Set A
ggguuguucaauuaucucuauauacggguuauacg

SEQ ID NO: 44616 - RNA, 37 nt, Artificial Sequence
  Synthetic Oligonucleotide; REL exon 2; Set C
uggguuguucaauuaucucuauauacggguuauacgc

SEQ ID NO: 44617 - RNA, 34 nt, Artificial Sequence
  Synthetic Oligonucleotide; REL exon 2; Set A
ggguuguucaauuaucucuauauacggguuauac

SEQ ID NO: 44618 - RNA, 36 nt, Artificial Sequence
  Synthetic Oligonucleotide; REL exon 2; Set A
uggguuguucaauuaucucuauauacggguuauacg

SEQ ID NO: 44619 - RNA, 35 nt, Artificial Sequence
  Synthetic Oligonucleotide; REL exon 2; Set A
uggguuguucaauuaucucuauauacggguuauac

SEQ ID NO: 44620 - RNA, 17 nt, Artificial Sequence
  Synthetic Oligonucleotide; REL exon 2; Set C
ccuggguuguucaauua

SEQ ID NO: 44621 - RNA, 16 nt, Artificial Sequence
  Synthetic Oligonucleotide; REL exon 2; Set C
ccuggguuguucaauu

SEQ ID NO: 44622 - RNA, 15 nt, Artificial Sequence
  Synthetic Oligonucleotide; REL exon 2; Set C
ccuggguuguucaau

SEQ ID NO: 44623 - RNA, 40 nt, Artificial Sequence
  Synthetic Oligonucleotide; REL exon 2; Set C
aacgcauuccccucugccuggguuguucaauuaucucuau

SEQ ID NO: 44624 - RNA, 33 nt, Artificial Sequence
  Synthetic Oligonucleotide; REL exon 2; Set C
aacgcauuccccucugccuggguuguucaauua

SEQ ID NO: 44625 - RNA, 32 nt, Artificial Sequence
  Synthetic Oligonucleotide; REL exon 2; Set C
aacgcauuccccucugccuggguuguucaauu

SEQ ID NO: 44626 - RNA, 34 nt, Artificial Sequence
  Synthetic Oligonucleotide; REL exon 2; Set C
aaacgcauuccccucugccuggguuguucaauua

SEQ ID NO: 44627 - RNA, 31 nt, Artificial Sequence
  Synthetic Oligonucleotide; REL exon 2; Set C
aacgcauuccccucugccuggguuguucaau

SEQ ID NO: 44628 - RNA, 33 nt, Artificial Sequence
  Synthetic Oligonucleotide; REL exon 2; Set C
aaacgcauuccccucugccuggguuguucaauu

SEQ ID NO: 44629 - RNA, 30 nt, Artificial Sequence
  Synthetic Oligonucleotide; REL exon 2; Set C
aacgcauuccccucugccuggguuguucaa

SEQ ID NO: 44630 - RNA, 32 nt, Artificial Sequence
  Synthetic Oligonucleotide; REL exon 2; Set C
aaacgcauuccccucugccuggguuguucaau

SEQ ID NO: 44631 - RNA, 31 nt, Artificial Sequence
  Synthetic Oligonucleotide; REL exon 2; Set C
aaacgcauuccccucugccuggguuguucaa

SEQ ID NO: 44632 - RNA, 29 nt, Artificial Sequence
  Synthetic Oligonucleotide; REL exon 2; Set C
aacgcauuccccucugccuggguuguuca

SEQ ID NO: 44633 - RNA, 28 nt, Artificial Sequence
  Synthetic Oligonucleotide; REL exon 2; Set C
aacgcauuccccucugccuggguuguuc

SEQ ID NO: 44634 - RNA, 30 nt, Artificial Sequence
  Synthetic Oligonucleotide; REL exon 2; Set C
aaacgcauuccccucugccuggguuguuca

SEQ ID NO: 44635 - RNA, 27 nt, Artificial Sequence
  Synthetic Oligonucleotide; REL exon 2; Set C
aacgcauuccccucugccuggguuguu

SEQ ID NO: 44636 - RNA, 29 nt, Artificial Sequence
  Synthetic Oligonucleotide; REL exon 2; Set C
aaacgcauuccccucugccuggguuguuc

SEQ ID NO: 44637 - RNA, 28 nt, Artificial Sequence
  Synthetic Oligonucleotide; REL exon 2; Set C
aaacgcauuccccucugccuggguuguu

SEQ ID NO: 44638 - RNA, 26 nt, Artificial Sequence
  Synthetic Oligonucleotide; REL exon 2; Set C
aacgcauuccccucugccuggguugu

SEQ ID NO: 44639 - RNA, 27 nt, Artificial Sequence
  Synthetic Oligonucleotide; REL exon 2; Set C
aaacgcauuccccucugccuggguugu

SEQ ID NO: 44640 - RNA, 25 nt, Artificial Sequence
  Synthetic Oligonucleotide; REL exon 2; Set C
aacgcauuccccucugccuggguug

SEQ ID NO: 44641 - RNA, 26 nt, Artificial Sequence
  Synthetic Oligonucleotide; REL exon 2; Set C
aaacgcauuccccucugccuggguug

SEQ ID NO: 44642 - RNA, 24 nt, Artificial Sequence
  Synthetic Oligonucleotide; REL exon 2; Set C
aacgcauuccccucugccuggguu

SEQ ID NO: 44643 - RNA, 25 nt, Artificial Sequence
  Synthetic Oligonucleotide; REL exon 2; Set C
aaacgcauuccccucugccuggguu

SEQ ID NO: 44644 - RNA, 23 nt, Artificial Sequence
  Synthetic Oligonucleotide; REL exon 2; Set C
aacgcauuccccucugccugggu

SEQ ID NO: 44645 - RNA, 22 nt, Artificial Sequence
  Synthetic Oligonucleotide; REL exon 2; Set C
aacgcauuccccucugccuggg

SEQ ID NO: 44646 - RNA, 26 nt, Artificial Sequence
  Synthetic Oligonucleotide; REL exon 2; Set C
aaaacgcauuccccucugccuggguu

SEQ ID NO: 44647 - RNA, 24 nt, Artificial Sequence
  Synthetic Oligonucleotide; REL exon 2; Set C
aaacgcauuccccucugccugggu

SEQ ID NO: 44648 - RNA, 23 nt, Artificial Sequence
  Synthetic Oligonucleotide; REL exon 2; Set C
aaacgcauuccccucugccuggg

SEQ ID NO: 44649 - RNA, 25 nt, Artificial Sequence
  Synthetic Oligonucleotide; REL exon 2; Set C
aaaacgcauuccccucugccugggu

SEQ ID NO: 44650 - RNA, 21 nt, Artificial Sequence
  Synthetic Oligonucleotide; REL exon 2; Set A
aacgcauuccccucugccugg

SEQ ID NO: 44651 - RNA, 24 nt, Artificial Sequence
  Synthetic Oligonucleotide; REL exon 2; Set A
aaaacgcauuccccucugccuggg

SEQ ID NO: 44652 - RNA, 22 nt, Artificial Sequence
  Synthetic Oligonucleotide; REL exon 2; Set A
aaacgcauuccccucugccugg

SEQ ID NO: 44653 - RNA, 23 nt, Artificial Sequence
  Synthetic Oligonucleotide; REL exon 2; Set A
aaaacgcauuccccucugccugg

SEQ ID NO: 44654 - RNA, 22 nt, Artificial Sequence
  Synthetic Oligonucleotide; REL exon 2; Set A
aaaacgcauuccccucugccug

SEQ ID NO: 44655 - RNA, 30 nt, Artificial Sequence
  Synthetic Oligonucleotide; REL exon 2; Set C
uguaucuaaaacgcauuccccucugccugg

SEQ ID NO: 44656 - RNA, 29 nt, Artificial Sequence
  Synthetic Oligonucleotide; REL exon 2; Set A
uguaucuaaaacgcauuccccucugccug

SEQ ID NO: 44657 - RNA, 30 nt, Artificial Sequence
  Synthetic Oligonucleotide; REL exon 2; Set A
uuguaucuaaaacgcauuccccucugccug

SEQ ID NO: 44658 - RNA, 28 nt, Artificial Sequence
  Synthetic Oligonucleotide; REL exon 2; Set A
gaucgcccuucacauuuguaucuaaaac

SEQ ID NO: 44659 - RNA, 25 nt, Artificial Sequence
  Synthetic Oligonucleotide; REL exon 2; Set C
aucgcccuucacauuuguaucuaaa

SEQ ID NO: 44660 - RNA, 29 nt, Artificial Sequence
  Synthetic Oligonucleotide; REL exon 2; Set A
ugaucgcccuucacauuuguaucuaaaac

SEQ ID NO: 44661 - RNA, 26 nt, Artificial Sequence
  Synthetic Oligonucleotide; REL exon 2; Set A
gaucgcccuucacauuuguaucuaaa

SEQ ID NO: 44662 - RNA, 28 nt, Artificial Sequence
  Synthetic Oligonucleotide; REL exon 2; Set A
ugaucgcccuucacauuuguaucuaaaa

SEQ ID NO: 44663 - RNA, 27 nt, Artificial Sequence
  Synthetic Oligonucleotide; REL exon 2; Set A
ugaucgcccuucacauuuguaucuaaa

SEQ ID NO: 44664 - RNA, 32 nt, Artificial Sequence
  Synthetic Oligonucleotide; REL exon 2; Set C
ccugcugaucgcccuucacauuuguaucuaaa

SEQ ID NO: 44665 - RNA, 19 nt, Artificial Sequence
  Synthetic Oligonucleotide; REL exon 2; Set C
gaucgcccuucacauuugu

SEQ ID NO: 44666 - RNA, 16 nt, Artificial Sequence
  Synthetic Oligonucleotide; REL exon 2; Set C
aucgcccuucacauuu

SEQ ID NO: 44667 - RNA, 18 nt, Artificial Sequence
  Synthetic Oligonucleotide; REL exon 2; Set C
gaucgcccuucacauuug

SEQ ID NO: 44668 - RNA, 20 nt, Artificial Sequence
  Synthetic Oligonucleotide; REL exon 2; Set C
ugaucgcccuucacauuugu

SEQ ID NO: 44669 - RNA, 38 nt, Artificial Sequence
  Synthetic Oligonucleotide; REL exon 2; Set C
gcugccugcugaucgcccuucacauuuguaucuaaaac

SEQ ID NO: 44670 - RNA, 17 nt, Artificial Sequence
  Synthetic Oligonucleotide; REL exon 2; Set C
gaucgcccuucacauuu

SEQ ID NO: 44671 - RNA, 19 nt, Artificial Sequence
  Synthetic Oligonucleotide; REL exon 2; Set C
ugaucgcccuucacauuug

SEQ ID NO: 44672 - RNA, 39 nt, Artificial Sequence
  Synthetic Oligonucleotide; REL exon 2; Set C
ugcugccugcugaucgcccuucacauuuguaucuaaaac

SEQ ID NO: 44673 - RNA, 36 nt, Artificial Sequence
  Synthetic Oligonucleotide; REL exon 2; Set C
gcugccugcugaucgcccuucacauuuguaucuaaa

SEQ ID NO: 44674 - RNA, 38 nt, Artificial Sequence
  Synthetic Oligonucleotide; REL exon 2; Set C
ugcugccugcugaucgcccuucacauuuguaucuaaaa

SEQ ID NO: 44675 - RNA, 40 nt, Artificial Sequence
  Synthetic Oligonucleotide; REL exon 2; Set C
augcugccugcugaucgcccuucacauuuguaucuaaaac

SEQ ID NO: 44676 - RNA, 37 nt, Artificial Sequence
  Synthetic Oligonucleotide; REL exon 2; Set C
ugcugccugcugaucgcccuucacauuuguaucuaaa

SEQ ID NO: 44677 - RNA, 39 nt, Artificial Sequence
  Synthetic Oligonucleotide; REL exon 2; Set C
augcugccugcugaucgcccuucacauuuguaucuaaaa

SEQ ID NO: 44678 - RNA, 40 nt, Artificial Sequence
  Synthetic Oligonucleotide; REL exon 2; Set C
aaugcugccugcugaucgcccuucacauuuguaucuaaaa

SEQ ID NO: 44679 - RNA, 25 nt, Artificial Sequence
  Synthetic Oligonucleotide; REL exon 2; Set C
ccugcugaucgcccuucacauuugu

SEQ ID NO: 44680 - RNA, 39 nt, Artificial Sequence
  Synthetic Oligonucleotide; REL exon 2; Set C
aaugcugccugcugaucgcccuucacauuuguaucuaaa

SEQ ID NO: 44681 - RNA, 24 nt, Artificial Sequence
  Synthetic Oligonucleotide; REL exon 2; Set A
ccugcugaucgcccuucacauuug

SEQ ID NO: 44682 - RNA, 40 nt, Artificial Sequence
  Synthetic Oligonucleotide; REL exon 2; Set C
gaaugcugccugcugaucgcccuucacauuuguaucuaaa

SEQ ID NO: 44683 - RNA, 23 nt, Artificial Sequence
  Synthetic Oligonucleotide; REL exon 2; Set A
ccugcugaucgcccuucacauuu

SEQ ID NO: 44684 - RNA, 24 nt, Artificial Sequence
  Synthetic Oligonucleotide; REL exon 2; Set C
gccugcugaucgcccuucacauuu

SEQ ID NO: 44685 - RNA, 25 nt, Artificial Sequence
  Synthetic Oligonucleotide; REL exon 2; Set C
ugccugcugaucgcccuucacauuu

SEQ ID NO: 44686 - RNA, 29 nt, Artificial Sequence
  Synthetic Oligonucleotide; REL exon 2; Set C
gcugccugcugaucgcccuucacauuugu

SEQ ID NO: 44687 - RNA, 26 nt, Artificial Sequence
  Synthetic Oligonucleotide; REL exon 2; Set C
cugccugcugaucgcccuucacauuu

SEQ ID NO: 44688 - RNA, 28 nt, Artificial Sequence
  Synthetic Oligonucleotide; REL exon 2; Set C
gcugccugcugaucgcccuucacauuug

SEQ ID NO: 44689 - RNA, 30 nt, Artificial Sequence
  Synthetic Oligonucleotide; REL exon 2; Set C
ugcugccugcugaucgcccuucacauuugu

SEQ ID NO: 44690 - RNA, 27 nt, Artificial Sequence
  Synthetic Oligonucleotide; REL exon 2; Set C
gcugccugcugaucgcccuucacauuu

SEQ ID NO: 44691 - RNA, 29 nt, Artificial Sequence
  Synthetic Oligonucleotide; REL exon 2; Set C
ugcugccugcugaucgcccuucacauuug

SEQ ID NO: 44692 - RNA, 28 nt, Artificial Sequence
  Synthetic Oligonucleotide; REL exon 2; Set C
ugcugccugcugaucgcccuucacauuu

SEQ ID NO: 44693 - RNA, 32 nt, Artificial Sequence
  Synthetic Oligonucleotide; REL exon 2; Set C
aaugcugccugcugaucgcccuucacauuugu

SEQ ID NO: 44694 - RNA, 31 nt, Artificial Sequence
  Synthetic Oligonucleotide; REL exon 2; Set C
aaugcugccugcugaucgcccuucacauuug

SEQ ID NO: 44695 - RNA, 33 nt, Artificial Sequence
  Synthetic Oligonucleotide; REL exon 2; Set C
gaaugcugccugcugaucgcccuucacauuugu

SEQ ID NO: 44696 - RNA, 32 nt, Artificial Sequence
  Synthetic Oligonucleotide; REL exon 2; Set C
gaaugcugccugcugaucgcccuucacauuug

SEQ ID NO: 44697 - RNA, 34 nt, Artificial Sequence
  Synthetic Oligonucleotide; REL exon 2; Set C
ggaaugcugccugcugaucgcccuucacauuugu

SEQ ID NO: 44698 - RNA, 31 nt, Artificial Sequence
  Synthetic Oligonucleotide; REL exon 2; Set C
gaaugcugccugcugaucgcccuucacauuu

SEQ ID NO: 44699 - RNA, 33 nt, Artificial Sequence
  Synthetic Oligonucleotide; REL exon 2; Set C
ggaaugcugccugcugaucgcccuucacauuug

SEQ ID NO: 44700 - RNA, 32 nt, Artificial Sequence
  Synthetic Oligonucleotide; REL exon 2; Set C
ggaaugcugccugcugaucgcccuucacauuu

SEQ ID NO: 44701 - RNA, 34 nt, Artificial Sequence
  Synthetic Oligonucleotide; REL exon 2; Set C
uggaaugcugccugcugaucgcccuucacauuug

SEQ ID NO: 44702 - RNA, 33 nt, Artificial Sequence
  Synthetic Oligonucleotide; REL exon 2; Set C
uggaaugcugccugcugaucgcccuucacauuu

SEQ ID NO: 44703 - RNA, 39 nt, Artificial Sequence
  Synthetic Oligonucleotide; REL exon 2; Set C
cuccccuggaaugcugccugcugaucgcccuucacauuu

SEQ ID NO: 44704 - RNA, 40 nt, Artificial Sequence
  Synthetic Oligonucleotide; REL exon 2; Set C
gcuccccuggaaugcugccugcugaucgcccuucacauuu

SEQ ID NO: 44705 - RNA, 20 nt, Artificial Sequence
  Synthetic Oligonucleotide; REL exon 2; Set A
uggaaugcugccugcugauc

SEQ ID NO: 44706 - RNA, 19 nt, Artificial Sequence
  Synthetic Oligonucleotide; REL exon 2; Set A
uggaaugcugccugcugau

SEQ ID NO: 44707 - RNA, 26 nt, Artificial Sequence
  Synthetic Oligonucleotide; REL exon 2; Set C
cuccccuggaaugcugccugcugauc

SEQ ID NO: 44708 - RNA, 25 nt, Artificial Sequence
  Synthetic Oligonucleotide; REL exon 2; Set C
cuccccuggaaugcugccugcugau

SEQ ID NO: 44709 - RNA, 19 nt, Artificial Sequence
  Synthetic Oligonucleotide; REL exon 2; Set A
cuccccuggaaugcugccu

SEQ ID NO: 44710 - RNA, 18 nt, Artificial Sequence
  Synthetic Oligonucleotide; REL exon 2; Set A
cuccccuggaaugcugcc

SEQ ID NO: 44711 - RNA, 19 nt, Artificial Sequence
  Synthetic Oligonucleotide; REL exon 2; Set A
gcuccccuggaaugcugcc

SEQ ID NO: 44712 - RNA, 17 nt, Artificial Sequence
  Synthetic Oligonucleotide; REL exon 2; Set A
cuccccuggaaugcugc

SEQ ID NO: 44713 - RNA, 20 nt, Artificial Sequence
  Synthetic Oligonucleotide; REL exon 2; Set A
ugcuccccuggaaugcugcc

SEQ ID NO: 44714 - RNA, 18 nt, Artificial Sequence
  Synthetic Oligonucleotide; REL exon 2; Set A
gcuccccuggaaugcugc

SEQ ID NO: 44715 - RNA, 15 nt, Artificial Sequence
  Synthetic Oligonucleotide; REL exon 2; Set C
cuccccuggaaugcu

SEQ ID NO: 44716 - RNA, 19 nt, Artificial Sequence
  Synthetic Oligonucleotide; REL exon 2; Set A
ugcuccccuggaaugcugc

SEQ ID NO: 44717 - RNA, 17 nt, Artificial Sequence
  Synthetic Oligonucleotide; REL exon 2; Set A
gcuccccuggaaugcug

SEQ ID NO: 44718 - RNA, 16 nt, Artificial Sequence
  Synthetic Oligonucleotide; REL exon 2; Set C
gcuccccuggaaugcu

SEQ ID NO: 44719 - RNA, 18 nt, Artificial Sequence
  Synthetic Oligonucleotide; REL exon 2; Set A
ugcuccccuggaaugcug

SEQ ID NO: 44720 - RNA, 15 nt, Artificial Sequence
  Synthetic Oligonucleotide; REL exon 2; Set C
gcuccccuggaaugc

SEQ ID NO: 44721 - RNA, 30 nt, Artificial Sequence
  Synthetic Oligonucleotide; REL exon 2; Set C
uugucugugcugugcuccccuggaaugcug

SEQ ID NO: 44722 - RNA, 23 nt, Artificial Sequence
  Synthetic Oligonucleotide; REL exon 2; Set C
uugucugugcugugcuccccugg

SEQ ID NO: 44723 - RNA, 24 nt, Artificial Sequence
  Synthetic Oligonucleotide; REL exon 2; Set C
guugucugugcugugcuccccugg

SEQ ID NO: 44724 - RNA, 25 nt, Artificial Sequence
  Synthetic Oligonucleotide; REL exon 2; Set C
uguugucugugcugugcuccccugg

SEQ ID NO: 44725 - RNA, 26 nt, Artificial Sequence
  Synthetic Oligonucleotide; REL exon 2; Set C
uuguugucugugcugugcuccccugg

SEQ ID NO: 44726 - RNA, 27 nt, Artificial Sequence
  Synthetic Oligonucleotide; REL exon 2; Set C
guuguugucugugcugugcuccccugg

SEQ ID NO: 44727 - RNA, 28 nt, Artificial Sequence
  Synthetic Oligonucleotide; REL exon 2; Set C
gguuguugucugugcugugcuccccugg

SEQ ID NO: 44728 - RNA, 17 nt, Artificial Sequence
  Synthetic Oligonucleotide; REL exon 2; Set C
uugucugugcugugcuc

SEQ ID NO: 44729 - RNA, 16 nt, Artificial Sequence
  Synthetic Oligonucleotide; REL exon 2; Set C
uugucugugcugugcu

SEQ ID NO: 44730 - RNA, 18 nt, Artificial Sequence
  Synthetic Oligonucleotide; REL exon 2; Set C
guugucugugcugugcuc

SEQ ID NO: 44731 - RNA, 15 nt, Artificial Sequence
  Synthetic Oligonucleotide; REL exon 2; Set C
uugucugugcugugc

SEQ ID NO: 44732 - RNA, 19 nt, Artificial Sequence
  Synthetic Oligonucleotide; REL exon 2; Set A
uguugucugugcugugcuc

SEQ ID NO: 44733 - RNA, 20 nt, Artificial Sequence
  Synthetic Oligonucleotide; REL exon 2; Set A
uuguugucugugcugugcuc

SEQ ID NO: 44734 - RNA, 21 nt, Artificial Sequence
  Synthetic Oligonucleotide; REL exon 2; Set A
guuguugucugugcugugcuc

SEQ ID NO: 44735 - RNA, 34 nt, Artificial Sequence
  Synthetic Oligonucleotide; REL exon 2; Set C
auguucgguuguugucugugcugugcuccccugg

SEQ ID NO: 44736 - RNA, 35 nt, Artificial Sequence
  Synthetic Oligonucleotide; REL exon 2; Set C
uauguucgguuguugucugugcugugcuccccugg

SEQ ID NO: 44737 - RNA, 36 nt, Artificial Sequence
  Synthetic Oligonucleotide; REL exon 2; Set C
guauguucgguuguugucugugcugugcuccccugg

SEQ ID NO: 44738 - RNA, 37 nt, Artificial Sequence
  Synthetic Oligonucleotide; REL exon 2; Set C
gguauguucgguuguugucugugcugugcuccccugg

SEQ ID NO: 44739 - RNA, 38 nt, Artificial Sequence
  Synthetic Oligonucleotide; REL exon 2; Set C
ggguauguucgguuguugucugugcugugcuccccugg

SEQ ID NO: 44740 - RNA, 28 nt, Artificial Sequence
  Synthetic Oligonucleotide; REL exon 2; Set C
auguucgguuguugucugugcugugcuc

SEQ ID NO: 44741 - RNA, 29 nt, Artificial Sequence
  Synthetic Oligonucleotide; REL exon 2; Set C
uauguucgguuguugucugugcugugcuc

SEQ ID NO: 44742 - RNA, 30 nt, Artificial Sequence
  Synthetic Oligonucleotide; REL exon 2; Set C
guauguucgguuguugucugugcugugcuc

SEQ ID NO: 44743 - RNA, 31 nt, Artificial Sequence
  Synthetic Oligonucleotide; REL exon 2; Set C
gguauguucgguuguugucugugcugugcuc

SEQ ID NO: 44744 - RNA, 32 nt, Artificial Sequence
  Synthetic Oligonucleotide; REL exon 2; Set C
ggguauguucgguuguugucugugcugugcuc

SEQ ID NO: 44745 - RNA, 38 nt, Artificial Sequence
  Synthetic Oligonucleotide; REL exon 2; Set C
auagaaggguauguucgguuguugucugugcugugcuc

SEQ ID NO: 44746 - RNA, 37 nt, Artificial Sequence
  Synthetic Oligonucleotide; REL exon 2; Set C
auagaaggguauguucgguuguugucugugcugugcu

SEQ ID NO: 44747 - RNA, 39 nt, Artificial Sequence
  Synthetic Oligonucleotide; REL exon 2; Set C
gauagaaggguauguucgguuguugucugugcugugcuc

SEQ ID NO: 44748 - RNA, 36 nt, Artificial Sequence
  Synthetic Oligonucleotide; REL exon 2; Set C
auagaaggguauguucgguuguugucugugcugugc

SEQ ID NO: 44749 - RNA, 40 nt, Artificial Sequence
  Synthetic Oligonucleotide; REL exon 2; Set C
ggauagaaggguauguucgguuguugucugugcugugcuc

SEQ ID NO: 44750 - RNA, 15 nt, Artificial Sequence
  Synthetic Oligonucleotide; REL exon 2; Set C
auguucgguuguugu

SEQ ID NO: 44751 - RNA, 16 nt, Artificial Sequence
  Synthetic Oligonucleotide; REL exon 2; Set C
uauguucgguuguugu

SEQ ID NO: 44752 - RNA, 18 nt, Artificial Sequence
  Synthetic Oligonucleotide; REL exon 2; Set C
guauguucgguuguuguc

SEQ ID NO: 44753 - RNA, 17 nt, Artificial Sequence
  Synthetic Oligonucleotide; REL exon 2; Set C
guauguucgguuguugu

SEQ ID NO: 44754 - RNA, 19 nt, Artificial Sequence
  Synthetic Oligonucleotide; REL exon 2; Set C
gguauguucgguuguuguc

SEQ ID NO: 44755 - RNA, 18 nt, Artificial Sequence
  Synthetic Oligonucleotide; REL exon 2; Set C
gguauguucgguuguugu

SEQ ID NO: 44756 - RNA, 20 nt, Artificial Sequence
  Synthetic Oligonucleotide; REL exon 2; Set C
ggguauguucgguuguuguc

SEQ ID NO: 44757 - RNA, 19 nt, Artificial Sequence
  Synthetic Oligonucleotide; REL exon 2; Set C
ggguauguucgguuguugu

SEQ ID NO: 44758 - RNA, 28 nt, Artificial Sequence
  Synthetic Oligonucleotide; REL exon 2; Set B
uggauagaaggguauguucgguuguugu

SEQ ID NO: 44759 - RNA, 20 nt, Artificial Sequence
  Synthetic Oligonucleotide; REL exon 2; Set C
uauuaccuggauagaagggu

SEQ ID NO: 44760 - RNA, 18 nt, Artificial Sequence
  Synthetic Oligonucleotide; REL exon 2; Set C
auuaccuggauagaaggg

SEQ ID NO: 44761 - RNA, 19 nt, Artificial Sequence
  Synthetic Oligonucleotide; REL exon 2; Set C
uauuaccuggauagaaggg

SEQ ID NO: 44762 - RNA, 20 nt, Artificial Sequence
  Synthetic Oligonucleotide; REL exon 2; Set C
cuauuaccuggauagaaggg

SEQ ID NO: 44763 - RNA, 20 nt, Artificial Sequence
  Synthetic Oligonucleotide; REL exon 2; Set C
aagggucuauuaccuggaua

SEQ ID NO: 44764 - RNA, 19 nt, Artificial Sequence
  Synthetic Oligonucleotide; REL exon 2; Set C
aagggucuauuaccuggau

SEQ ID NO: 44765 - RNA, 21 nt, Artificial Sequence
  Synthetic Oligonucleotide; REL exon 2; Set C
gaagggucuauuaccuggaua

SEQ ID NO: 44766 - RNA, 20 nt, Artificial Sequence
  Synthetic Oligonucleotide; REL exon 2; Set C
gaagggucuauuaccuggau

SEQ ID NO: 44767 - RNA, 18 nt, Artificial Sequence
  Synthetic Oligonucleotide; REL exon 2; Set C
aagggucuauuaccugga

SEQ ID NO: 44768 - RNA, 17 nt, Artificial Sequence
  Synthetic Oligonucleotide; REL exon 2; Set C
aagggucuauuaccugg

SEQ ID NO: 44769 - RNA, 19 nt, Artificial Sequence
  Synthetic Oligonucleotide; REL exon 2; Set C
gaagggucuauuaccugga

SEQ ID NO: 44770 - RNA, 18 nt, Artificial Sequence
  Synthetic Oligonucleotide; REL exon 2; Set C
gaagggucuauuaccugg

SEQ ID NO: 44771 - RNA, 20 nt, Artificial Sequence
  Synthetic Oligonucleotide; REL exon 2; Set C
agaagggucuauuaccugga

SEQ ID NO: 44772 - RNA, 19 nt, Artificial Sequence
  Synthetic Oligonucleotide; REL exon 2; Set C
agaagggucuauuaccugg

SEQ ID NO: 44773 - RNA, 38 nt, Artificial Sequence
  Synthetic Oligonucleotide; REL exon 2; Set C
uagacacagaagaagggucuauuaccuggauagaaggg

SEQ ID NO: 44774 - RNA, 32 nt, Artificial Sequence
  Synthetic Oligonucleotide; REL exon 2; Set B
uagacacagaagaagggucuauuaccuggaua

SEQ ID NO: 44775 - RNA, 31 nt, Artificial Sequence
  Synthetic Oligonucleotide; REL exon 2; Set B
uagacacagaagaagggucuauuaccuggau

SEQ ID NO: 44776 - RNA, 30 nt, Artificial Sequence
  Synthetic Oligonucleotide; REL exon 2; Set B
uagacacagaagaagggucuauuaccugga

SEQ ID NO: 44777 - RNA, 29 nt, Artificial Sequence
  Synthetic Oligonucleotide; REL exon 2; Set B
uagacacagaagaagggucuauuaccugg

SEQ ID NO: 44778 - RNA, 39 nt, Artificial Sequence
  Synthetic Oligonucleotide; REL exon 2; Set C
agugagauagacacagaagaagggucuauuaccuggaua

SEQ ID NO: 44779 - RNA, 38 nt, Artificial Sequence
  Synthetic Oligonucleotide; REL exon 2; Set C
agugagauagacacagaagaagggucuauuaccuggau

SEQ ID NO: 44780 - RNA, 40 nt, Artificial Sequence
  Synthetic Oligonucleotide; REL exon 2; Set C
uagugagauagacacagaagaagggucuauuaccuggaua

SEQ ID NO: 44781 - RNA, 39 nt, Artificial Sequence
  Synthetic Oligonucleotide; REL exon 2; Set C
uagugagauagacacagaagaagggucuauuaccuggau

SEQ ID NO: 44782 - RNA, 37 nt, Artificial Sequence
  Synthetic Oligonucleotide; REL exon 2; Set C
agugagauagacacagaagaagggucuauuaccugga

SEQ ID NO: 44783 - RNA, 23 nt, Artificial Sequence
  Synthetic Oligonucleotide; REL exon 2; Set C
uagacacagaagaagggucuauu

SEQ ID NO: 44784 - RNA, 36 nt, Artificial Sequence
  Synthetic Oligonucleotide; REL exon 2; Set C
agugagauagacacagaagaagggucuauuaccugg

SEQ ID NO: 44785 - RNA, 38 nt, Artificial Sequence
  Synthetic Oligonucleotide; REL exon 2; Set C
uagugagauagacacagaagaagggucuauuaccugga

SEQ ID NO: 44786 - RNA, 22 nt, Artificial Sequence
  Synthetic Oligonucleotide; REL exon 2; Set C
uagacacagaagaagggucuau

SEQ ID NO: 44787 - RNA, 37 nt, Artificial Sequence
  Synthetic Oligonucleotide; REL exon 2; Set C
uagugagauagacacagaagaagggucuauuaccugg

SEQ ID NO: 44788 - RNA, 21 nt, Artificial Sequence
  Synthetic Oligonucleotide; REL exon 2; Set C
uagacacagaagaagggucua

SEQ ID NO: 44789 - RNA, 29 nt, Artificial Sequence
  Synthetic Oligonucleotide; REL exon 2; Set B
agugagauagacacagaagaagggucuau

SEQ ID NO: 44790 - RNA, 30 nt, Artificial Sequence
  Synthetic Oligonucleotide; REL exon 2; Set B
uagugagauagacacagaagaagggucuau

SEQ ID NO: 44791 - RNA, 28 nt, Artificial Sequence
  Synthetic Oligonucleotide; REL exon 2; Set B
agugagauagacacagaagaagggucua

SEQ ID NO: 44792 - RNA, 29 nt, Artificial Sequence
  Synthetic Oligonucleotide; REL exon 2; Set B
uagugagauagacacagaagaagggucua

SEQ ID NO: 44793 - RNA, 35 nt, Artificial Sequence
  Synthetic Oligonucleotide; REL exon 2; Set B
ugaagcaacuaauagugagauagacacagaagaag

SEQ ID NO: 44794 - RNA, 34 nt, Artificial Sequence
  Synthetic Oligonucleotide; REL exon 2; Set B
ugaagcaacuaauagugagauagacacagaagaa

SEQ ID NO: 44795 - RNA, 36 nt, Artificial Sequence
  Synthetic Oligonucleotide; REL exon 2; Set B
augaagcaacuaauagugagauagacacagaagaag

SEQ ID NO: 44796 - RNA, 33 nt, Artificial Sequence
  Synthetic Oligonucleotide; REL exon 2; Set B
ugaagcaacuaauagugagauagacacagaaga

SEQ ID NO: 44797 - RNA, 35 nt, Artificial Sequence
  Synthetic Oligonucleotide; REL exon 2; Set B
augaagcaacuaauagugagauagacacagaagaa

SEQ ID NO: 44798 - RNA, 37 nt, Artificial Sequence
  Synthetic Oligonucleotide; REL exon 2; Set B
uaugaagcaacuaauagugagauagacacagaagaag

SEQ ID NO: 44799 - RNA, 34 nt, Artificial Sequence
  Synthetic Oligonucleotide; REL exon 2; Set B
augaagcaacuaauagugagauagacacagaaga

SEQ ID NO: 44800 - RNA, 36 nt, Artificial Sequence
  Synthetic Oligonucleotide; REL exon 2; Set B
uaugaagcaacuaauagugagauagacacagaagaa

SEQ ID NO: 44801 - RNA, 38 nt, Artificial Sequence
  Synthetic Oligonucleotide; REL exon 2; Set B
auaugaagcaacuaauagugagauagacacagaagaag

SEQ ID NO: 44802 - RNA, 35 nt, Artificial Sequence
  Synthetic Oligonucleotide; REL exon 2; Set B
uaugaagcaacuaauagugagauagacacagaaga

SEQ ID NO: 44803 - RNA, 37 nt, Artificial Sequence
  Synthetic Oligonucleotide; REL exon 2; Set B
auaugaagcaacuaauagugagauagacacagaagaa

SEQ ID NO: 44804 - RNA, 36 nt, Artificial Sequence
  Synthetic Oligonucleotide; REL exon 2; Set B
auaugaagcaacuaauagugagauagacacagaaga

SEQ ID NO: 44805 - RNA, 38 nt, Artificial Sequence
  Synthetic Oligonucleotide; REL exon 2; Set B
uauaugaagcaacuaauagugagauagacacagaagaa

SEQ ID NO: 44806 - RNA, 37 nt, Artificial Sequence
  Synthetic Oligonucleotide; REL exon 2; Set B
uauaugaagcaacuaauagugagauagacacagaaga

SEQ ID NO: 44807 - RNA, 38 nt, Artificial Sequence
  Synthetic Oligonucleotide; REL exon 2; Set B
guauaugaagcaacuaauagugagauagacacagaaga

SEQ ID NO: 44808 - RNA, 23 nt, Artificial Sequence
  Synthetic Oligonucleotide; REL exon 2; Set C
ugaagcaacuaauagugagauag

SEQ ID NO: 44809 - RNA, 24 nt, Artificial Sequence
  Synthetic Oligonucleotide; REL exon 2; Set C
augaagcaacuaauagugagauag

SEQ ID NO: 44810 - RNA, 25 nt, Artificial Sequence
  Synthetic Oligonucleotide; REL exon 2; Set C
uaugaagcaacuaauagugagauag

SEQ ID NO: 44811 - RNA, 26 nt, Artificial Sequence
  Synthetic Oligonucleotide; REL exon 2; Set C
auaugaagcaacuaauagugagauag

SEQ ID NO: 44812 - RNA, 27 nt, Artificial Sequence
  Synthetic Oligonucleotide; REL exon 2; Set C
uauaugaagcaacuaauagugagauag

SEQ ID NO: 44813 - RNA, 28 nt, Artificial Sequence
  Synthetic Oligonucleotide; REL exon 2; Set C
guauaugaagcaacuaauagugagauag

SEQ ID NO: 44814 - RNA, 19 nt, Artificial Sequence
  Synthetic Oligonucleotide; REL exon 2; Set C
auaugaagcaacuaauagu

SEQ ID NO: 44815 - RNA, 20 nt, Artificial Sequence
  Synthetic Oligonucleotide; REL exon 2; Set C
uauaugaagcaacuaauagu

SEQ ID NO: 44816 - RNA, 19 nt, Artificial Sequence
  Synthetic Oligonucleotide; REL exon 2; Set C
uauaugaagcaacuaauag

SEQ ID NO: 44817 - RNA, 21 nt, Artificial Sequence
  Synthetic Oligonucleotide; REL exon 2; Set C
guauaugaagcaacuaauagu

SEQ ID NO: 44818 - RNA, 18 nt, Artificial Sequence
  Synthetic Oligonucleotide; REL exon 2; Set C
uauaugaagcaacuaaua

SEQ ID NO: 44819 - RNA, 20 nt, Artificial Sequence
  Synthetic Oligonucleotide; REL exon 2; Set C
guauaugaagcaacuaauag

SEQ ID NO: 44820 - RNA, 19 nt, Artificial Sequence
  Synthetic Oligonucleotide; REL exon 2; Set C
guauaugaagcaacuaaua

SEQ ID NO: 44821 - RNA, 15 nt, Artificial Sequence
  Synthetic Oligonucleotide; REL exon 2; Set C
cagugagauuaauau

SEQ ID NO: 44822 - RNA, 16 nt, Artificial Sequence
  Synthetic Oligonucleotide; REL exon 2; Set C
ucagugagauuaauau

SEQ ID NO: 44823 - RNA, 17 nt, Artificial Sequence
  Synthetic Oligonucleotide; REL exon 2; Set C
gucagugagauuaauau

SEQ ID NO: 44824 - RNA, 15 nt, Artificial Sequence
  Synthetic Oligonucleotide; REL exon 2; Set C
ucagugagauuaaua

SEQ ID NO: 44825 - RNA, 18 nt, Artificial Sequence
  Synthetic Oligonucleotide; REL exon 2; Set C
ggucagugagauuaauau

SEQ ID NO: 44826 - RNA, 16 nt, Artificial Sequence
  Synthetic Oligonucleotide; REL exon 2; Set C
gucagugagauuaaua

SEQ ID NO: 44827 - RNA, 17 nt, Artificial Sequence
  Synthetic Oligonucleotide; REL exon 2; Set C
ggucagugagauuaaua

SEQ ID NO: 44828 - RNA, 29 nt, Artificial Sequence
  Synthetic Oligonucleotide; REL exon 2; Set A
aggaggaggucagugagauuaauauagca

SEQ ID NO: 44829 - RNA, 28 nt, Artificial Sequence
  Synthetic Oligonucleotide; REL exon 2; Set A
aggaggaggucagugagauuaauauagc

SEQ ID NO: 44830 - RNA, 30 nt, Artificial Sequence
  Synthetic Oligonucleotide; REL exon 2; Set A
aaggaggaggucagugagauuaauauagca

SEQ ID NO: 44831 - RNA, 29 nt, Artificial Sequence
  Synthetic Oligonucleotide; REL exon 2; Set A
aaggaggaggucagugagauuaauauagc

SEQ ID NO: 44832 - RNA, 27 nt, Artificial Sequence
  Synthetic Oligonucleotide; REL exon 2; Set C
aggaggaggucagugagauuaauauag

SEQ ID NO: 44833 - RNA, 31 nt, Artificial Sequence
  Synthetic Oligonucleotide; REL exon 2; Set A
aaaggaggaggucagugagauuaauauagca

SEQ ID NO: 44834 - RNA, 26 nt, Artificial Sequence
  Synthetic Oligonucleotide; REL exon 2; Set C
aggaggaggucagugagauuaauaua

SEQ ID NO: 44835 - RNA, 30 nt, Artificial Sequence
  Synthetic Oligonucleotide; REL exon 2; Set A
aaaggaggaggucagugagauuaauauagc

SEQ ID NO: 44836 - RNA, 28 nt, Artificial Sequence
  Synthetic Oligonucleotide; REL exon 2; Set C
aaggaggaggucagugagauuaauauag

SEQ ID NO: 44837 - RNA, 27 nt, Artificial Sequence
  Synthetic Oligonucleotide; REL exon 2; Set C
aaggaggaggucagugagauuaauaua

SEQ ID NO: 44838 - RNA, 29 nt, Artificial Sequence
  Synthetic Oligonucleotide; REL exon 2; Set C
aaaggaggaggucagugagauuaauauag

SEQ ID NO: 44839 - RNA, 28 nt, Artificial Sequence
  Synthetic Oligonucleotide; REL exon 2; Set C
aaaggaggaggucagugagauuaauaua

SEQ ID NO: 44840 - RNA, 28 nt, Artificial Sequence
  Synthetic Oligonucleotide; REL exon 2; Set C
aaaaggaggaggucagugagauuaauau

SEQ ID NO: 44841 - RNA, 27 nt, Artificial Sequence
  Synthetic Oligonucleotide; REL exon 2; Set C
aaaaggaggaggucagugagauuaaua

SEQ ID NO: 44842 - RNA, 29 nt, Artificial Sequence
  Synthetic Oligonucleotide; REL exon 2; Set C
aaaaaggaggaggucagugagauuaauau

SEQ ID NO: 44843 - RNA, 30 nt, Artificial Sequence
  Synthetic Oligonucleotide; REL exon 2; Set C
uaaaaaggaggaggucagugagauuaauau

SEQ ID NO: 44844 - RNA, 28 nt, Artificial Sequence
  Synthetic Oligonucleotide; REL exon 2; Set C
aaaaaggaggaggucagugagauuaaua

SEQ ID NO: 44845 - RNA, 31 nt, Artificial Sequence
  Synthetic Oligonucleotide; REL exon 2; Set C
uuaaaaaggaggaggucagugagauuaauau

SEQ ID NO: 44846 - RNA, 29 nt, Artificial Sequence
  Synthetic Oligonucleotide; REL exon 2; Set C
uaaaaaggaggaggucagugagauuaaua

SEQ ID NO: 44847 - RNA, 32 nt, Artificial Sequence
  Synthetic Oligonucleotide; REL exon 2; Set C
uuuaaaaaggaggaggucagugagauuaauau

SEQ ID NO: 44848 - RNA, 30 nt, Artificial Sequence
  Synthetic Oligonucleotide; REL exon 2; Set C
uuaaaaaggaggaggucagugagauuaaua

SEQ ID NO: 44849 - RNA, 17 nt, Artificial Sequence
  Synthetic Oligonucleotide; REL exon 2; Set C
aggaggaggucagugag

SEQ ID NO: 44850 - RNA, 33 nt, Artificial Sequence
  Synthetic Oligonucleotide; REL exon 2; Set C
uuuuaaaaaggaggaggucagugagauuaauau

SEQ ID NO: 44851 - RNA, 31 nt, Artificial Sequence
  Synthetic Oligonucleotide; REL exon 2; Set C
uuuaaaaaggaggaggucagugagauuaaua

SEQ ID NO: 44852 - RNA, 40 nt, Artificial Sequence
  Synthetic Oligonucleotide; REL exon 2; Set A
aaguuuuuaaaaaggaggaggucagugagauuaauauagc

SEQ ID NO: 44853 - RNA, 18 nt, Artificial Sequence
  Synthetic Oligonucleotide; REL exon 2; Set C
aaggaggaggucagugag

SEQ ID NO: 44854 - RNA, 16 nt, Artificial Sequence
  Synthetic Oligonucleotide; REL exon 2; Set C
aggaggaggucaguga

SEQ ID NO: 44855 - RNA, 32 nt, Artificial Sequence
  Synthetic Oligonucleotide; REL exon 2; Set C
uuuuaaaaaggaggaggucagugagauuaaua

SEQ ID NO: 44856 - RNA, 34 nt, Artificial Sequence
  Synthetic Oligonucleotide; REL exon 2; Set C
uuuuuaaaaaggaggaggucagugagauuaauau

SEQ ID NO: 44857 - RNA, 39 nt, Artificial Sequence
  Synthetic Oligonucleotide; REL exon 2; Set A
aaguuuuuaaaaaggaggaggucagugagauuaauauag

SEQ ID NO: 44858 - RNA, 17 nt, Artificial Sequence
  Synthetic Oligonucleotide; REL exon 2; Set C
aaggaggaggucaguga

SEQ ID NO: 44859 - RNA, 15 nt, Artificial Sequence
  Synthetic Oligonucleotide; REL exon 2; Set C
aggaggaggucagug

SEQ ID NO: 44860 - RNA, 35 nt, Artificial Sequence
  Synthetic Oligonucleotide; REL exon 2; Set A
guuuuuaaaaaggaggaggucagugagauuaauau

SEQ ID NO: 44861 - RNA, 33 nt, Artificial Sequence
  Synthetic Oligonucleotide; REL exon 2; Set C
uuuuuaaaaaggaggaggucagugagauuaaua

SEQ ID NO: 44862 - RNA, 38 nt, Artificial Sequence
  Synthetic Oligonucleotide; REL exon 2; Set A
aaguuuuuaaaaaggaggaggucagugagauuaauaua

SEQ ID NO: 44863 - RNA, 40 nt, Artificial Sequence
  Synthetic Oligonucleotide; REL exon 2; Set C
aaaguuuuuaaaaaggaggaggucagugagauuaauauag

SEQ ID NO: 44864 - RNA, 18 nt, Artificial Sequence
  Synthetic Oligonucleotide; REL exon 2; Set C
aaaggaggaggucaguga

SEQ ID NO: 44865 - RNA, 16 nt, Artificial Sequence
  Synthetic Oligonucleotide; REL exon 2; Set C
aaggaggaggucagug

SEQ ID NO: 44866 - RNA, 34 nt, Artificial Sequence
  Synthetic Oligonucleotide; REL exon 2; Set A
guuuuuaaaaaggaggaggucagugagauuaaua

SEQ ID NO: 44867 - RNA, 39 nt, Artificial Sequence
  Synthetic Oligonucleotide; REL exon 2; Set C
aaaguuuuuaaaaaggaggaggucagugagauuaauaua

SEQ ID NO: 44868 - RNA, 15 nt, Artificial Sequence
  Synthetic Oligonucleotide; REL exon 2; Set C
aaggaggaggucagu

SEQ ID NO: 44869 - RNA, 17 nt, Artificial Sequence
  Synthetic Oligonucleotide; REL exon 2; Set C
aaaggaggaggucagug

SEQ ID NO: 44870 - RNA, 35 nt, Artificial Sequence
  Synthetic Oligonucleotide; REL exon 2; Set A
aguuuuuaaaaaggaggaggucagugagauuaaua

SEQ ID NO: 44871 - RNA, 40 nt, Artificial Sequence
  Synthetic Oligonucleotide; REL exon 2; Set C
aaaaguuuuuaaaaaggaggaggucagugagauuaauaua

SEQ ID NO: 44872 - RNA, 16 nt, Artificial Sequence
  Synthetic Oligonucleotide; REL exon 2; Set C
aaaggaggaggucagu

SEQ ID NO: 44873 - RNA, 15 nt, Artificial Sequence
  Synthetic Oligonucleotide; REL exon 2; Set C
aaaggaggaggucag

SEQ ID NO: 44874 - RNA, 40 nt, Artificial Sequence
  Synthetic Oligonucleotide; REL exon 2; Set A
gaaaaguuuuuaaaaaggaggaggucagugagauuaauau

SEQ ID NO: 44875 - RNA, 39 nt, Artificial Sequence
  Synthetic Oligonucleotide; REL exon 2; Set A
gaaaaguuuuuaaaaaggaggaggucagugagauuaaua

SEQ ID NO: 44876 - RNA, 40 nt, Artificial Sequence
  Synthetic Oligonucleotide; REL exon 2; Set A
ugaaaaguuuuuaaaaaggaggaggucagugagauuaaua

SEQ ID NO: 44877 - RNA, 29 nt, Artificial Sequence
  Synthetic Oligonucleotide; REL exon 2; Set C
aaguuuuuaaaaaggaggaggucagugag

SEQ ID NO: 44878 - RNA, 30 nt, Artificial Sequence
  Synthetic Oligonucleotide; REL exon 2; Set C
aaaguuuuuaaaaaggaggaggucagugag

SEQ ID NO: 44879 - RNA, 28 nt, Artificial Sequence
  Synthetic Oligonucleotide; REL exon 2; Set C
aaguuuuuaaaaaggaggaggucaguga

SEQ ID NO: 44880 - RNA, 29 nt, Artificial Sequence
  Synthetic Oligonucleotide; REL exon 2; Set C
aaaguuuuuaaaaaggaggaggucaguga

SEQ ID NO: 44881 - RNA, 31 nt, Artificial Sequence
  Synthetic Oligonucleotide; REL exon 2; Set C
aaaaguuuuuaaaaaggaggaggucagugag

SEQ ID NO: 44882 - RNA, 27 nt, Artificial Sequence
  Synthetic Oligonucleotide; REL exon 2; Set C
aaguuuuuaaaaaggaggaggucagug

SEQ ID NO: 44883 - RNA, 26 nt, Artificial Sequence
  Synthetic Oligonucleotide; REL exon 2; Set C
aaguuuuuaaaaaggaggaggucagu

SEQ ID NO: 44884 - RNA, 30 nt, Artificial Sequence
  Synthetic Oligonucleotide; REL exon 2; Set C
aaaaguuuuuaaaaaggaggaggucaguga

SEQ ID NO: 44885 - RNA, 28 nt, Artificial Sequence
  Synthetic Oligonucleotide; REL exon 2; Set C
aaaguuuuuaaaaaggaggaggucagug

SEQ ID NO: 44886 - RNA, 25 nt, Artificial Sequence
  Synthetic Oligonucleotide; REL exon 2; Set C
aaguuuuuaaaaaggaggaggucag

SEQ ID NO: 44887 - RNA, 27 nt, Artificial Sequence
  Synthetic Oligonucleotide; REL exon 2; Set C
aaaguuuuuaaaaaggaggaggucagu

SEQ ID NO: 44888 - RNA, 29 nt, Artificial Sequence
  Synthetic Oligonucleotide; REL exon 2; Set C
aaaaguuuuuaaaaaggaggaggucagug

SEQ ID NO: 44889 - RNA, 26 nt, Artificial Sequence
  Synthetic Oligonucleotide; REL exon 2; Set C
aaaguuuuuaaaaaggaggaggucag

SEQ ID NO: 44890 - RNA, 24 nt, Artificial Sequence
  Synthetic Oligonucleotide; REL exon 2; Set C
aaguuuuuaaaaaggaggagguca

SEQ ID NO: 44891 - RNA, 28 nt, Artificial Sequence
  Synthetic Oligonucleotide; REL exon 2; Set C
aaaaguuuuuaaaaaggaggaggucagu

SEQ ID NO: 44892 - RNA, 25 nt, Artificial Sequence
  Synthetic Oligonucleotide; REL exon 2; Set C
aaaguuuuuaaaaaggaggagguca

SEQ ID NO: 44893 - RNA, 23 nt, Artificial Sequence
  Synthetic Oligonucleotide; REL exon 2; Set C
aaguuuuuaaaaaggaggagguc

SEQ ID NO: 44894 - RNA, 27 nt, Artificial Sequence
  Synthetic Oligonucleotide; REL exon 2; Set C
aaaaguuuuuaaaaaggaggaggucag

SEQ ID NO: 44895 - RNA, 24 nt, Artificial Sequence
  Synthetic Oligonucleotide; REL exon 2; Set C
aaaguuuuuaaaaaggaggagguc

SEQ ID NO: 44896 - RNA, 22 nt, Artificial Sequence
  Synthetic Oligonucleotide; REL exon 2; Set C
aaguuuuuaaaaaggaggaggu

SEQ ID NO: 44897 - RNA, 26 nt, Artificial Sequence
  Synthetic Oligonucleotide; REL exon 2; Set C
aaaaguuuuuaaaaaggaggagguca

SEQ ID NO: 44898 - RNA, 23 nt, Artificial Sequence
  Synthetic Oligonucleotide; REL exon 2; Set C
aaaguuuuuaaaaaggaggaggu

SEQ ID NO: 44899 - RNA, 25 nt, Artificial Sequence
  Synthetic Oligonucleotide; REL exon 2; Set C
aaaaguuuuuaaaaaggaggagguc

SEQ ID NO: 44900 - RNA, 24 nt, Artificial Sequence
  Synthetic Oligonucleotide; REL exon 2; Set C
aaaaguuuuuaaaaaggaggaggu

SEQ ID NO: 44901 - RNA, 39 nt, Artificial Sequence
  Synthetic Oligonucleotide; REL exon 2; Set A
cgcaccugaaaaguuuuuaaaaaggaggaggucagugag

SEQ ID NO: 44902 - RNA, 15 nt, Artificial Sequence
  Synthetic Oligonucleotide; REL exon 2; Set C
guuuuuaaaaaggag

SEQ ID NO: 44903 - RNA, 40 nt, Artificial Sequence
  Synthetic Oligonucleotide; REL exon 2; Set A
acgcaccugaaaaguuuuuaaaaaggaggaggucagugag

SEQ ID NO: 44904 - RNA, 38 nt, Artificial Sequence
  Synthetic Oligonucleotide; REL exon 2; Set A
cgcaccugaaaaguuuuuaaaaaggaggaggucaguga

SEQ ID NO: 44905 - RNA, 16 nt, Artificial Sequence
  Synthetic Oligonucleotide; REL exon 2; Set C
aguuuuuaaaaaggag

SEQ ID NO: 44906 - RNA, 39 nt, Artificial Sequence
  Synthetic Oligonucleotide; REL exon 2; Set A
acgcaccugaaaaguuuuuaaaaaggaggaggucaguga

SEQ ID NO: 44907 - RNA, 37 nt, Artificial Sequence
  Synthetic Oligonucleotide; REL exon 2; Set A
cgcaccugaaaaguuuuuaaaaaggaggaggucagug

SEQ ID NO: 44908 - RNA, 15 nt, Artificial Sequence
  Synthetic Oligonucleotide; REL exon 2; Set C
aguuuuuaaaaagga

SEQ ID NO: 44909 - RNA, 40 nt, Artificial Sequence
  Synthetic Oligonucleotide; REL exon 2; Set A
uacgcaccugaaaaguuuuuaaaaaggaggaggucaguga

SEQ ID NO: 44910 - RNA, 36 nt, Artificial Sequence
  Synthetic Oligonucleotide; REL exon 2; Set A
cgcaccugaaaaguuuuuaaaaaggaggaggucagu

SEQ ID NO: 44911 - RNA, 38 nt, Artificial Sequence
  Synthetic Oligonucleotide; REL exon 2; Set A
acgcaccugaaaaguuuuuaaaaaggaggaggucagug

SEQ ID NO: 44912 - RNA, 35 nt, Artificial Sequence
  Synthetic Oligonucleotide; REL exon 2; Set A
cgcaccugaaaaguuuuuaaaaaggaggaggucag

SEQ ID NO: 44913 - RNA, 37 nt, Artificial Sequence
  Synthetic Oligonucleotide; REL exon 2; Set A
acgcaccugaaaaguuuuuaaaaaggaggaggucagu

SEQ ID NO: 44914 - RNA, 39 nt, Artificial Sequence
  Synthetic Oligonucleotide; REL exon 2; Set A
uacgcaccugaaaaguuuuuaaaaaggaggaggucagug

SEQ ID NO: 44915 - RNA, 36 nt, Artificial Sequence
  Synthetic Oligonucleotide; REL exon 2; Set A
acgcaccugaaaaguuuuuaaaaaggaggaggucag

SEQ ID NO: 44916 - RNA, 34 nt, Artificial Sequence
  Synthetic Oligonucleotide; REL exon 2; Set A
cgcaccugaaaaguuuuuaaaaaggaggagguca

SEQ ID NO: 44917 - RNA, 38 nt, Artificial Sequence
  Synthetic Oligonucleotide; REL exon 2; Set A
uacgcaccugaaaaguuuuuaaaaaggaggaggucagu

SEQ ID NO: 44918 - RNA, 37 nt, Artificial Sequence
  Synthetic Oligonucleotide; REL exon 2; Set A
uacgcaccugaaaaguuuuuaaaaaggaggaggucag

SEQ ID NO: 44919 - RNA, 35 nt, Artificial Sequence
  Synthetic Oligonucleotide; REL exon 2; Set A
acgcaccugaaaaguuuuuaaaaaggaggagguca

SEQ ID NO: 44920 - RNA, 33 nt, Artificial Sequence
  Synthetic Oligonucleotide; REL exon 2; Set A
cgcaccugaaaaguuuuuaaaaaggaggagguc

SEQ ID NO: 44921 - RNA, 15 nt, Artificial Sequence
  Synthetic Oligonucleotide; REL exon 2; Set C
aaaguuuuuaaaaag

SEQ ID NO: 44922 - RNA, 21 nt, Artificial Sequence
  Synthetic Oligonucleotide; REL exon 2; Set C
ugaaaaguuuuuaaaaaggag

SEQ ID NO: 44923 - RNA, 19 nt, Artificial Sequence
  Synthetic Oligonucleotide; REL exon 2; Set C
gaaaaguuuuuaaaaagga

SEQ ID NO: 44924 - RNA, 36 nt, Artificial Sequence
  Synthetic Oligonucleotide; REL exon 2; Set A
uacgcaccugaaaaguuuuuaaaaaggaggagguca

SEQ ID NO: 44925 - RNA, 34 nt, Artificial Sequence
  Synthetic Oligonucleotide; REL exon 2; Set A
acgcaccugaaaaguuuuuaaaaaggaggagguc

SEQ ID NO: 44926 - RNA, 32 nt, Artificial Sequence
  Synthetic Oligonucleotide; REL exon 2; Set A
cgcaccugaaaaguuuuuaaaaaggaggaggu

SEQ ID NO: 44927 - RNA, 20 nt, Artificial Sequence
  Synthetic Oligonucleotide; REL exon 2; Set C
ugaaaaguuuuuaaaaagga

SEQ ID NO: 44928 - RNA, 22 nt, Artificial Sequence
  Synthetic Oligonucleotide; REL exon 2; Set C
cugaaaaguuuuuaaaaaggag

SEQ ID NO: 44929 - RNA, 35 nt, Artificial Sequence
  Synthetic Oligonucleotide; REL exon 2; Set A
uacgcaccugaaaaguuuuuaaaaaggaggagguc

SEQ ID NO: 44930 - RNA, 33 nt, Artificial Sequence
  Synthetic Oligonucleotide; REL exon 2; Set A
acgcaccugaaaaguuuuuaaaaaggaggaggu

SEQ ID NO: 44931 - RNA, 15 nt, Artificial Sequence
  Synthetic Oligonucleotide; REL exon 2; Set C
aaaaguuuuuaaaaa

SEQ ID NO: 44932 - RNA, 21 nt, Artificial Sequence
  Synthetic Oligonucleotide; REL exon 2; Set C
cugaaaaguuuuuaaaaagga

SEQ ID NO: 44933 - RNA, 34 nt, Artificial Sequence
  Synthetic Oligonucleotide; REL exon 2; Set A
uacgcaccugaaaaguuuuuaaaaaggaggaggu

SEQ ID NO: 44934 - RNA, 40 nt, Artificial Sequence
  Synthetic Oligonucleotide; REL exon 2; Set A
ggguuauacgcaccugaaaaguuuuuaaaaaggaggaggu

SEQ ID NO: 44935 - RNA, 30 nt, Artificial Sequence
  Synthetic Oligonucleotide; REL exon 2; Set C
auacgcaccugaaaaguuuuuaaaaaggag

SEQ ID NO: 44936 - RNA, 31 nt, Artificial Sequence
  Synthetic Oligonucleotide; REL exon 2; Set C
uauacgcaccugaaaaguuuuuaaaaaggag

SEQ ID NO: 44937 - RNA, 29 nt, Artificial Sequence
  Synthetic Oligonucleotide; REL exon 2; Set C
auacgcaccugaaaaguuuuuaaaaagga

SEQ ID NO: 44938 - RNA, 30 nt, Artificial Sequence
  Synthetic Oligonucleotide; REL exon 2; Set C
uauacgcaccugaaaaguuuuuaaaaagga

SEQ ID NO: 44939 - RNA, 32 nt, Artificial Sequence
  Synthetic Oligonucleotide; REL exon 2; Set C
uuauacgcaccugaaaaguuuuuaaaaaggag

SEQ ID NO: 44940 - RNA, 31 nt, Artificial Sequence
  Synthetic Oligonucleotide; REL exon 2; Set C
uuauacgcaccugaaaaguuuuuaaaaagga

SEQ ID NO: 44941 - RNA, 33 nt, Artificial Sequence
  Synthetic Oligonucleotide; REL exon 2; Set C
guuauacgcaccugaaaaguuuuuaaaaaggag

SEQ ID NO: 44942 - RNA, 34 nt, Artificial Sequence
  Synthetic Oligonucleotide; REL exon 2; Set A
gguuauacgcaccugaaaaguuuuuaaaaaggag

SEQ ID NO: 44943 - RNA, 32 nt, Artificial Sequence
  Synthetic Oligonucleotide; REL exon 2; Set C
guuauacgcaccugaaaaguuuuuaaaaagga

SEQ ID NO: 44944 - RNA, 19 nt, Artificial Sequence
  Synthetic Oligonucleotide; REL exon 2; Set C
cgcaccugaaaaguuuuua

SEQ ID NO: 44945 - RNA, 33 nt, Artificial Sequence
  Synthetic Oligonucleotide; REL exon 2; Set A
gguuauacgcaccugaaaaguuuuuaaaaagga

SEQ ID NO: 44946 - RNA, 18 nt, Artificial Sequence
  Synthetic Oligonucleotide; REL exon 2; Set C
cgcaccugaaaaguuuuu

SEQ ID NO: 44947 - RNA, 17 nt, Artificial Sequence
  Synthetic Oligonucleotide; REL exon 2; Set C
cgcaccugaaaaguuuu

SEQ ID NO: 44948 - RNA, 19 nt, Artificial Sequence
  Synthetic Oligonucleotide; REL exon 2; Set C
acgcaccugaaaaguuuuu

SEQ ID NO: 44949 - RNA, 18 nt, Artificial Sequence
  Synthetic Oligonucleotide; REL exon 2; Set C
acgcaccugaaaaguuuu

SEQ ID NO: 44950 - RNA, 16 nt, Artificial Sequence
  Synthetic Oligonucleotide; REL exon 2; Set C
cgcaccugaaaaguuu

SEQ ID NO: 44951 - RNA, 17 nt, Artificial Sequence
  Synthetic Oligonucleotide; REL exon 2; Set C
acgcaccugaaaaguuu

SEQ ID NO: 44952 - RNA, 18 nt, Artificial Sequence
  Synthetic Oligonucleotide; REL exon 2; Set C
uacgcaccugaaaaguuu

SEQ ID NO: 44953 - RNA, 29 nt, Artificial Sequence
  Synthetic Oligonucleotide; REL exon 2; Set C
ggguuauacgcaccugaaaaguuuuuaaa

SEQ ID NO: 44954 - RNA, 28 nt, Artificial Sequence
  Synthetic Oligonucleotide; REL exon 2; Set A
ggguuauacgcaccugaaaaguuuuuaa

SEQ ID NO: 44955 - RNA, 27 nt, Artificial Sequence
  Synthetic Oligonucleotide; REL exon 2; Set A
ggguuauacgcaccugaaaaguuuuua

SEQ ID NO: 44956 - RNA, 26 nt, Artificial Sequence
  Synthetic Oligonucleotide; REL exon 2; Set A
ggguuauacgcaccugaaaaguuuuu

SEQ ID NO: 44957 - RNA, 25 nt, Artificial Sequence
  Synthetic Oligonucleotide; REL exon 2; Set A
ggguuauacgcaccugaaaaguuuu

SEQ ID NO: 44958 - RNA, 24 nt, Artificial Sequence
  Synthetic Oligonucleotide; REL exon 2; Set C
ggguuauacgcaccugaaaaguuu

SEQ ID NO: 44959 - RNA, 23 nt, Artificial Sequence
  Synthetic Oligonucleotide; REL exon 2; Set C
ggguuauacgcaccugaaaaguu

SEQ ID NO: 44960 - RNA, 18 nt, Artificial Sequence
  Synthetic Oligonucleotide; REL exon 2; Set C
ggguuauacgcaccugaa

SEQ ID NO: 44961 - RNA, 17 nt, Artificial Sequence
  Synthetic Oligonucleotide; REL exon 2; Set C
ggguuauacgcaccuga

SEQ ID NO: 44962 - RNA, 16 nt, Artificial Sequence
  Synthetic Oligonucleotide; REL exon 2; Set C
ggguuauacgcaccug

SEQ ID NO: 44963 - RNA, 28 nt, Artificial Sequence
  Synthetic Oligonucleotide; REL exon 2; Set A
uauauacggguuauacgcaccugaaaag

SEQ ID NO: 44964 - RNA, 27 nt, Artificial Sequence
  Synthetic Oligonucleotide; REL exon 2; Set A
uauauacggguuauacgcaccugaaaa

SEQ ID NO: 44965 - RNA, 26 nt, Artificial Sequence
  Synthetic Oligonucleotide; REL exon 2; Set A
uauauacggguuauacgcaccugaaa

SEQ ID NO: 44966 - RNA, 35 nt, Artificial Sequence
  Synthetic Oligonucleotide; REL exon 2; Set A
uuaucucuauauacggguuauacgcaccugaaaag

SEQ ID NO: 44967 - RNA, 36 nt, Artificial Sequence
  Synthetic Oligonucleotide; REL exon 2; Set A
auuaucucuauauacggguuauacgcaccugaaaag

SEQ ID NO: 44968 - RNA, 34 nt, Artificial Sequence
  Synthetic Oligonucleotide; REL exon 2; Set A
uuaucucuauauacggguuauacgcaccugaaaa

SEQ ID NO: 44969 - RNA, 31 nt, Artificial Sequence
  Synthetic Oligonucleotide; REL exon 2; Set A
uaucucuauauacggguuauacgcaccugaa

SEQ ID NO: 44970 - RNA, 37 nt, Artificial Sequence
  Synthetic Oligonucleotide; REL exon 2; Set A
aauuaucucuauauacggguuauacgcaccugaaaag

SEQ ID NO: 44971 - RNA, 35 nt, Artificial Sequence
  Synthetic Oligonucleotide; REL exon 2; Set A
auuaucucuauauacggguuauacgcaccugaaaa

SEQ ID NO: 44972 - RNA, 33 nt, Artificial Sequence
  Synthetic Oligonucleotide; REL exon 2; Set A
uuaucucuauauacggguuauacgcaccugaaa

SEQ ID NO: 44973 - RNA, 30 nt, Artificial Sequence
  Synthetic Oligonucleotide; REL exon 2; Set C
uaucucuauauacggguuauacgcaccuga

SEQ ID NO: 44974 - RNA, 18 nt, Artificial Sequence
  Synthetic Oligonucleotide; REL exon 2; Set C
uauauacggguuauacgc

SEQ ID NO: 44975 - RNA, 38 nt, Artificial Sequence
  Synthetic Oligonucleotide; REL exon 2; Set A
caauuaucucuauauacggguuauacgcaccugaaaag

SEQ ID NO: 44976 - RNA, 36 nt, Artificial Sequence
  Synthetic Oligonucleotide; REL exon 2; Set A
aauuaucucuauauacggguuauacgcaccugaaaa

SEQ ID NO: 44977 - RNA, 34 nt, Artificial Sequence
  Synthetic Oligonucleotide; REL exon 2; Set A
auuaucucuauauacggguuauacgcaccugaaa

SEQ ID NO: 44978 - RNA, 29 nt, Artificial Sequence
  Synthetic Oligonucleotide; REL exon 2; Set A
uaucucuauauacggguuauacgcaccug

SEQ ID NO: 44979 - RNA, 17 nt, Artificial Sequence
  Synthetic Oligonucleotide; REL exon 2; Set C
uauauacggguuauacg

SEQ ID NO: 44980 - RNA, 37 nt, Artificial Sequence
  Synthetic Oligonucleotide; REL exon 2; Set A
caauuaucucuauauacggguuauacgcaccugaaaa

SEQ ID NO: 44981 - RNA, 39 nt, Artificial Sequence
  Synthetic Oligonucleotide; REL exon 2; Set A
ucaauuaucucuauauacggguuauacgcaccugaaaag

SEQ ID NO: 44982 - RNA, 35 nt, Artificial Sequence
  Synthetic Oligonucleotide; REL exon 2; Set A
aauuaucucuauauacggguuauacgcaccugaaa

SEQ ID NO: 44983 - RNA, 16 nt, Artificial Sequence
  Synthetic Oligonucleotide; REL exon 2; Set C
uauauacggguuauac

SEQ ID NO: 44984 - RNA, 40 nt, Artificial Sequence
  Synthetic Oligonucleotide; REL exon 2; Set A
uucaauuaucucuauauacggguuauacgcaccugaaaag

SEQ ID NO: 44985 - RNA, 38 nt, Artificial Sequence
  Synthetic Oligonucleotide; REL exon 2; Set A
ucaauuaucucuauauacggguuauacgcaccugaaaa

SEQ ID NO: 44986 - RNA, 36 nt, Artificial Sequence
  Synthetic Oligonucleotide; REL exon 2; Set A
caauuaucucuauauacggguuauacgcaccugaaa

SEQ ID NO: 44987 - RNA, 39 nt, Artificial Sequence
  Synthetic Oligonucleotide; REL exon 2; Set A
uucaauuaucucuauauacggguuauacgcaccugaaaa

SEQ ID NO: 44988 - RNA, 37 nt, Artificial Sequence
  Synthetic Oligonucleotide; REL exon 2; Set A
ucaauuaucucuauauacggguuauacgcaccugaaa

SEQ ID NO: 44989 - RNA, 40 nt, Artificial Sequence
  Synthetic Oligonucleotide; REL exon 2; Set C
guucaauuaucucuauauacggguuauacgcaccugaaaa

SEQ ID NO: 44990 - RNA, 38 nt, Artificial Sequence
  Synthetic Oligonucleotide; REL exon 2; Set A
uucaauuaucucuauauacggguuauacgcaccugaaa

SEQ ID NO: 44991 - RNA, 39 nt, Artificial Sequence
  Synthetic Oligonucleotide; REL exon 2; Set C
guucaauuaucucuauauacggguuauacgcaccugaaa

SEQ ID NO: 44992 - RNA, 40 nt, Artificial Sequence
  Synthetic Oligonucleotide; REL exon 2; Set C
uguucaauuaucucuauauacggguuauacgcaccugaaa

SEQ ID NO: 44993 - RNA, 25 nt, Artificial Sequence
  Synthetic Oligonucleotide; REL exon 2; Set C
uuaucucuauauacggguuauacgc

SEQ ID NO: 44994 - RNA, 26 nt, Artificial Sequence
  Synthetic Oligonucleotide; REL exon 2; Set C
auuaucucuauauacggguuauacgc

SEQ ID NO: 44995 - RNA, 24 nt, Artificial Sequence
  Synthetic Oligonucleotide; REL exon 2; Set C
uuaucucuauauacggguuauacg

SEQ ID NO: 44996 - RNA, 23 nt, Artificial Sequence
  Synthetic Oligonucleotide; REL exon 2; Set C
uuaucucuauauacggguuauac

SEQ ID NO: 44997 - RNA, 27 nt, Artificial Sequence
  Synthetic Oligonucleotide; REL exon 2; Set C
aauuaucucuauauacggguuauacgc

SEQ ID NO: 44998 - RNA, 25 nt, Artificial Sequence
  Synthetic Oligonucleotide; REL exon 2; Set C
auuaucucuauauacggguuauacg

SEQ ID NO: 44999 - RNA, 24 nt, Artificial Sequence
  Synthetic Oligonucleotide; REL exon 2; Set C
auuaucucuauauacggguuauac

SEQ ID NO: 45000 - RNA, 28 nt, Artificial Sequence
  Synthetic Oligonucleotide; REL exon 2; Set A
caauuaucucuauauacggguuauacgc

SEQ ID NO: 45001 - RNA, 26 nt, Artificial Sequence
  Synthetic Oligonucleotide; REL exon 2; Set C
aauuaucucuauauacggguuauacg

SEQ ID NO: 45002 - RNA, 25 nt, Artificial Sequence
  Synthetic Oligonucleotide; REL exon 2; Set C
aauuaucucuauauacggguuauac

SEQ ID NO: 45003 - RNA, 27 nt, Artificial Sequence
  Synthetic Oligonucleotide; REL exon 2; Set C
caauuaucucuauauacggguuauacg

SEQ ID NO: 45004 - RNA, 29 nt, Artificial Sequence
  Synthetic Oligonucleotide; REL exon 2; Set A
ucaauuaucucuauauacggguuauacgc

SEQ ID NO: 45005 - RNA, 18 nt, Artificial Sequence
  Synthetic Oligonucleotide; REL exon 2; Set C
uaucucuauauacggguu

SEQ ID NO: 45006 - RNA, 26 nt, Artificial Sequence
  Synthetic Oligonucleotide; REL exon 2; Set C
caauuaucucuauauacggguuauac

SEQ ID NO: 45007 - RNA, 30 nt, Artificial Sequence
  Synthetic Oligonucleotide; REL exon 2; Set A
uucaauuaucucuauauacggguuauacgc

SEQ ID NO: 45008 - RNA, 28 nt, Artificial Sequence
  Synthetic Oligonucleotide; REL exon 2; Set C
ucaauuaucucuauauacggguuauacg

SEQ ID NO: 45009 - RNA, 17 nt, Artificial Sequence
  Synthetic Oligonucleotide; REL exon 2; Set C
uaucucuauauacgggu

SEQ ID NO: 45010 - RNA, 27 nt, Artificial Sequence
  Synthetic Oligonucleotide; REL exon 2; Set C
ucaauuaucucuauauacggguuauac

SEQ ID NO: 45011 - RNA, 29 nt, Artificial Sequence
  Synthetic Oligonucleotide; REL exon 2; Set C
uucaauuaucucuauauacggguuauacg

SEQ ID NO: 45012 - RNA, 28 nt, Artificial Sequence
  Synthetic Oligonucleotide; REL exon 2; Set C
uucaauuaucucuauauacggguuauac

SEQ ID NO: 45013 - RNA, 38 nt, Artificial Sequence
  Synthetic Oligonucleotide; REL exon 2; Set C
cuggguuguucaauuaucucuauauacggguuauacgc

SEQ ID NO: 45014 - RNA, 22 nt, Artificial Sequence
  Synthetic Oligonucleotide; REL exon 2; Set C
uucaauuaucucuauauacggg

SEQ ID NO: 45015 - RNA, 37 nt, Artificial Sequence
  Synthetic Oligonucleotide; REL exon 2; Set A
cuggguuguucaauuaucucuauauacggguuauacg

SEQ ID NO: 45016 - RNA, 23 nt, Artificial Sequence
  Synthetic Oligonucleotide; REL exon 2; Set C
guucaauuaucucuauauacggg

SEQ ID NO: 45017 - RNA, 36 nt, Artificial Sequence
  Synthetic Oligonucleotide; REL exon 2; Set A
cuggguuguucaauuaucucuauauacggguuauac

SEQ ID NO: 45018 - RNA, 24 nt, Artificial Sequence
  Synthetic Oligonucleotide; REL exon 2; Set C
uguucaauuaucucuauauacggg

SEQ ID NO: 45019 - RNA, 25 nt, Artificial Sequence
  Synthetic Oligonucleotide; REL exon 2; Set C
uuguucaauuaucucuauauacggg

SEQ ID NO: 45020 - RNA, 36 nt, Artificial Sequence
  Synthetic Oligonucleotide; REL exon 2; Set A
ccuggguuguucaauuaucucuauauacggguuaua

SEQ ID NO: 45021 - RNA, 26 nt, Artificial Sequence
  Synthetic Oligonucleotide; REL exon 2; Set C
guuguucaauuaucucuauauacggg

SEQ ID NO: 45022 - RNA, 35 nt, Artificial Sequence
  Synthetic Oligonucleotide; REL exon 2; Set A
ccuggguuguucaauuaucucuauauacggguuau

SEQ ID NO: 45023 - RNA, 37 nt, Artificial Sequence
  Synthetic Oligonucleotide; REL exon 2; Set C
gccuggguuguucaauuaucucuauauacggguuaua

SEQ ID NO: 45024 - RNA, 27 nt, Artificial Sequence
  Synthetic Oligonucleotide; REL exon 2; Set C
gguuguucaauuaucucuauauacggg

SEQ ID NO: 45025 - RNA, 34 nt, Artificial Sequence
  Synthetic Oligonucleotide; REL exon 2; Set A
ccuggguuguucaauuaucucuauauacggguua

SEQ ID NO: 45026 - RNA, 36 nt, Artificial Sequence
  Synthetic Oligonucleotide; REL exon 2; Set C
gccuggguuguucaauuaucucuauauacggguuau

SEQ ID NO: 45027 - RNA, 28 nt, Artificial Sequence
  Synthetic Oligonucleotide; REL exon 2; Set A
ggguuguucaauuaucucuauauacggg

SEQ ID NO: 45028 - RNA, 33 nt, Artificial Sequence
  Synthetic Oligonucleotide; REL exon 2; Set A
ccuggguuguucaauuaucucuauauacggguu

SEQ ID NO: 45029 - RNA, 35 nt, Artificial Sequence
  Synthetic Oligonucleotide; REL exon 2; Set C
gccuggguuguucaauuaucucuauauacggguua

SEQ ID NO: 45030 - RNA, 29 nt, Artificial Sequence
  Synthetic Oligonucleotide; REL exon 2; Set A
uggguuguucaauuaucucuauauacggg

SEQ ID NO: 45031 - RNA, 32 nt, Artificial Sequence
  Synthetic Oligonucleotide; REL exon 2; Set A
ccuggguuguucaauuaucucuauauacgggu

SEQ ID NO: 45032 - RNA, 34 nt, Artificial Sequence
  Synthetic Oligonucleotide; REL exon 2; Set C
gccuggguuguucaauuaucucuauauacggguu

SEQ ID NO: 45033 - RNA, 30 nt, Artificial Sequence
  Synthetic Oligonucleotide; REL exon 2; Set A
cuggguuguucaauuaucucuauauacggg

SEQ ID NO: 45034 - RNA, 33 nt, Artificial Sequence
  Synthetic Oligonucleotide; REL exon 2; Set C
gccuggguuguucaauuaucucuauauacgggu

SEQ ID NO: 45035 - RNA, 22 nt, Artificial Sequence
  Synthetic Oligonucleotide; REL exon 2; Set C
ggguuguucaauuaucucuaua

SEQ ID NO: 45036 - RNA, 23 nt, Artificial Sequence
  Synthetic Oligonucleotide; REL exon 2; Set C
uggguuguucaauuaucucuaua

SEQ ID NO: 45037 - RNA, 24 nt, Artificial Sequence
  Synthetic Oligonucleotide; REL exon 2; Set C
ccuggguuguucaauuaucucuau

SEQ ID NO: 45038 - RNA, 25 nt, Artificial Sequence
  Synthetic Oligonucleotide; REL exon 2; Set A
gccuggguuguucaauuaucucuau

SEQ ID NO: 45039 - RNA, 18 nt, Artificial Sequence
  Synthetic Oligonucleotide; REL exon 2; Set C
gccuggguuguucaauua

SEQ ID NO: 45040 - RNA, 17 nt, Artificial Sequence
  Synthetic Oligonucleotide; REL exon 2; Set C
gccuggguuguucaauu

SEQ ID NO: 45041 - RNA, 16 nt, Artificial Sequence
  Synthetic Oligonucleotide; REL exon 2; Set C
gccuggguuguucaau

SEQ ID NO: 45042 - RNA, 15 nt, Artificial Sequence
  Synthetic Oligonucleotide; REL exon 2; Set C
gccuggguuguucaa

SEQ ID NO: 45043 - RNA, 34 nt, Artificial Sequence
  Synthetic Oligonucleotide; REL exon 2; Set C
aacgcauuccccucugccuggguuguucaauuau

SEQ ID NO: 45044 - RNA, 35 nt, Artificial Sequence
  Synthetic Oligonucleotide; REL exon 2; Set C
aaacgcauuccccucugccuggguuguucaauuau

SEQ ID NO: 45045 - RNA, 36 nt, Artificial Sequence
  Synthetic Oligonucleotide; REL exon 2; Set C
aaaacgcauuccccucugccuggguuguucaauuau

SEQ ID NO: 45046 - RNA, 20 nt, Artificial Sequence
  Synthetic Oligonucleotide; REL exon 2; Set A
aacgcauuccccucugccug

SEQ ID NO: 45047 - RNA, 21 nt, Artificial Sequence
  Synthetic Oligonucleotide; REL exon 2; Set A
aaacgcauuccccucugccug

SEQ ID NO: 45048 - RNA, 17 nt, Artificial Sequence
  Synthetic Oligonucleotide; REL exon 2; Set C
uuuguaucuaaaacgca

SEQ ID NO: 45049 - RNA, 27 nt, Artificial Sequence
  Synthetic Oligonucleotide; REL exon 2; Set C
aucgcccuucacauuuguaucuaaaac

SEQ ID NO: 45050 - RNA, 26 nt, Artificial Sequence
  Synthetic Oligonucleotide; REL exon 2; Set C
aucgcccuucacauuuguaucuaaaa

SEQ ID NO: 45051 - RNA, 27 nt, Artificial Sequence
  Synthetic Oligonucleotide; REL exon 2; Set A
gaucgcccuucacauuuguaucuaaaa

SEQ ID NO: 45052 - RNA, 34 nt, Artificial Sequence
  Synthetic Oligonucleotide; REL exon 2; Set C
ccugcugaucgcccuucacauuuguaucuaaaac

SEQ ID NO: 45053 - RNA, 33 nt, Artificial Sequence
  Synthetic Oligonucleotide; REL exon 2; Set C
ccugcugaucgcccuucacauuuguaucuaaaa

SEQ ID NO: 45054 - RNA, 35 nt, Artificial Sequence
  Synthetic Oligonucleotide; REL exon 2; Set C
gccugcugaucgcccuucacauuuguaucuaaaac

SEQ ID NO: 45055 - RNA, 18 nt, Artificial Sequence
  Synthetic Oligonucleotide; REL exon 2; Set C
aucgcccuucacauuugu

SEQ ID NO: 45056 - RNA, 34 nt, Artificial Sequence
  Synthetic Oligonucleotide; REL exon 2; Set C
gccugcugaucgcccuucacauuuguaucuaaaa

SEQ ID NO: 45057 - RNA, 36 nt, Artificial Sequence
  Synthetic Oligonucleotide; REL exon 2; Set C
ugccugcugaucgcccuucacauuuguaucuaaaac

SEQ ID NO: 45058 - RNA, 17 nt, Artificial Sequence
  Synthetic Oligonucleotide; REL exon 2; Set C
aucgcccuucacauuug

SEQ ID NO: 45059 - RNA, 33 nt, Artificial Sequence
  Synthetic Oligonucleotide; REL exon 2; Set C
gccugcugaucgcccuucacauuuguaucuaaa

SEQ ID NO: 45060 - RNA, 35 nt, Artificial Sequence
  Synthetic Oligonucleotide; REL exon 2; Set C
ugccugcugaucgcccuucacauuuguaucuaaaa

SEQ ID NO: 45061 - RNA, 37 nt, Artificial Sequence
  Synthetic Oligonucleotide; REL exon 2; Set C
cugccugcugaucgcccuucacauuuguaucuaaaac

SEQ ID NO: 45062 - RNA, 34 nt, Artificial Sequence
  Synthetic Oligonucleotide; REL exon 2; Set C
ugccugcugaucgcccuucacauuuguaucuaaa

SEQ ID NO: 45063 - RNA, 36 nt, Artificial Sequence
  Synthetic Oligonucleotide; REL exon 2; Set C
cugccugcugaucgcccuucacauuuguaucuaaaa

SEQ ID NO: 45064 - RNA, 35 nt, Artificial Sequence
  Synthetic Oligonucleotide; REL exon 2; Set C
cugccugcugaucgcccuucacauuuguaucuaaa

SEQ ID NO: 45065 - RNA, 37 nt, Artificial Sequence
  Synthetic Oligonucleotide; REL exon 2; Set C
gcugccugcugaucgcccuucacauuuguaucuaaaa

SEQ ID NO: 45066 - RNA, 26 nt, Artificial Sequence
  Synthetic Oligonucleotide; REL exon 2; Set C
gccugcugaucgcccuucacauuugu

SEQ ID NO: 45067 - RNA, 25 nt, Artificial Sequence
  Synthetic Oligonucleotide; REL exon 2; Set C
gccugcugaucgcccuucacauuug

SEQ ID NO: 45068 - RNA, 27 nt, Artificial Sequence
  Synthetic Oligonucleotide; REL exon 2; Set C
ugccugcugaucgcccuucacauuugu

SEQ ID NO: 45069 - RNA, 26 nt, Artificial Sequence
  Synthetic Oligonucleotide; REL exon 2; Set C
ugccugcugaucgcccuucacauuug

SEQ ID NO: 45070 - RNA, 28 nt, Artificial Sequence
  Synthetic Oligonucleotide; REL exon 2; Set C
cugccugcugaucgcccuucacauuugu

SEQ ID NO: 45071 - RNA, 27 nt, Artificial Sequence
  Synthetic Oligonucleotide; REL exon 2; Set C
cugccugcugaucgcccuucacauuug

SEQ ID NO: 45072 - RNA, 35 nt, Artificial Sequence
  Synthetic Oligonucleotide; REL exon 2; Set C
uggaaugcugccugcugaucgcccuucacauuugu

SEQ ID NO: 45073 - RNA, 40 nt, Artificial Sequence
  Synthetic Oligonucleotide; REL exon 2; Set C
cuccccuggaaugcugccugcugaucgcccuucacauuug

SEQ ID NO: 45074 - RNA, 16 nt, Artificial Sequence
  Synthetic Oligonucleotide; REL exon 2; Set C
cuccccuggaaugcug

SEQ ID NO: 45075 - RNA, 39 nt, Artificial Sequence
  Synthetic Oligonucleotide; REL exon 2; Set C
ugucugugcugugcuccccuggaaugcugccugcugauc

SEQ ID NO: 45076 - RNA, 36 nt, Artificial Sequence
  Synthetic Oligonucleotide; REL exon 2; Set C
gucugugcugugcuccccuggaaugcugccugcuga

SEQ ID NO: 45077 - RNA, 38 nt, Artificial Sequence
  Synthetic Oligonucleotide; REL exon 2; Set C
ugucugugcugugcuccccuggaaugcugccugcugau

SEQ ID NO: 45078 - RNA, 37 nt, Artificial Sequence
  Synthetic Oligonucleotide; REL exon 2; Set C
ugucugugcugugcuccccuggaaugcugccugcuga

SEQ ID NO: 45079 - RNA, 32 nt, Artificial Sequence
  Synthetic Oligonucleotide; REL exon 2; Set C
ugucugugcugugcuccccuggaaugcugccu

SEQ ID NO: 45080 - RNA, 25 nt, Artificial Sequence
  Synthetic Oligonucleotide; REL exon 2; Set C
gucugugcugugcuccccuggaaug

SEQ ID NO: 45081 - RNA, 26 nt, Artificial Sequence
  Synthetic Oligonucleotide; REL exon 2; Set C
ugucugugcugugcuccccuggaaug

SEQ ID NO: 45082 - RNA, 25 nt, Artificial Sequence
  Synthetic Oligonucleotide; REL exon 2; Set C
ugucugugcugugcuccccuggaau

SEQ ID NO: 45083 - RNA, 16 nt, Artificial Sequence
  Synthetic Oligonucleotide; REL exon 2; Set C
auguucgguuguuguc

SEQ ID NO: 45084 - RNA, 17 nt, Artificial Sequence
  Synthetic Oligonucleotide; REL exon 2; Set C
uauguucgguuguuguc

SEQ ID NO: 45085 - RNA, 26 nt, Artificial Sequence
  Synthetic Oligonucleotide; REL exon 2; Set B
auagaaggguauguucgguuguuguc

SEQ ID NO: 45086 - RNA, 25 nt, Artificial Sequence
  Synthetic Oligonucleotide; REL exon 2; Set B
auagaaggguauguucgguuguugu

SEQ ID NO: 45087 - RNA, 27 nt, Artificial Sequence
  Synthetic Oligonucleotide; REL exon 2; Set B
gauagaaggguauguucgguuguuguc

SEQ ID NO: 45088 - RNA, 26 nt, Artificial Sequence
  Synthetic Oligonucleotide; REL exon 2; Set B
gauagaaggguauguucgguuguugu

SEQ ID NO: 45089 - RNA, 28 nt, Artificial Sequence
  Synthetic Oligonucleotide; REL exon 2; Set B
ggauagaaggguauguucgguuguuguc

SEQ ID NO: 45090 - RNA, 27 nt, Artificial Sequence
  Synthetic Oligonucleotide; REL exon 2; Set B
ggauagaaggguauguucgguuguugu

SEQ ID NO: 45091 - RNA, 29 nt, Artificial Sequence
  Synthetic Oligonucleotide; REL exon 2; Set B
uggauagaaggguauguucgguuguuguc

SEQ ID NO: 45092 - RNA, 34 nt, Artificial Sequence
  Synthetic Oligonucleotide; REL exon 2; Set C
auuaccuggauagaaggguauguucgguuguugu

SEQ ID NO: 45093 - RNA, 35 nt, Artificial Sequence
  Synthetic Oligonucleotide; REL exon 2; Set C
uauuaccuggauagaaggguauguucgguuguugu

SEQ ID NO: 45094 - RNA, 36 nt, Artificial Sequence
  Synthetic Oligonucleotide; REL exon 2; Set C
cuauuaccuggauagaaggguauguucgguuguugu

SEQ ID NO: 45095 - RNA, 40 nt, Artificial Sequence
  Synthetic Oligonucleotide; REL exon 2; Set C
aagaagggucuauuaccuggauagaaggguauguucgguu

SEQ ID NO: 45096 - RNA, 39 nt, Artificial Sequence
  Synthetic Oligonucleotide; REL exon 2; Set C
aagaagggucuauuaccuggauagaaggguauguucggu

SEQ ID NO: 45097 - RNA, 40 nt, Artificial Sequence
  Synthetic Oligonucleotide; REL exon 2; Set C
gaagaagggucuauuaccuggauagaaggguauguucggu

SEQ ID NO: 45098 - RNA, 33 nt, Artificial Sequence
  Synthetic Oligonucleotide; REL exon 2; Set B
aagaagggucuauuaccuggauagaaggguaug

SEQ ID NO: 45099 - RNA, 32 nt, Artificial Sequence
  Synthetic Oligonucleotide; REL exon 2; Set B
aagaagggucuauuaccuggauagaaggguau

SEQ ID NO: 45100 - RNA, 34 nt, Artificial Sequence
  Synthetic Oligonucleotide; REL exon 2; Set B
gaagaagggucuauuaccuggauagaaggguaug

SEQ ID NO: 45101 - RNA, 33 nt, Artificial Sequence
  Synthetic Oligonucleotide; REL exon 2; Set B
gaagaagggucuauuaccuggauagaaggguau

SEQ ID NO: 45102 - RNA, 31 nt, Artificial Sequence
  Synthetic Oligonucleotide; REL exon 2; Set B
aagaagggucuauuaccuggauagaagggua

SEQ ID NO: 45103 - RNA, 32 nt, Artificial Sequence
  Synthetic Oligonucleotide; REL exon 2; Set B
gaagaagggucuauuaccuggauagaagggua

SEQ ID NO: 45104 - RNA, 30 nt, Artificial Sequence
  Synthetic Oligonucleotide; REL exon 2; Set B
aagaagggucuauuaccuggauagaagggu

SEQ ID NO: 45105 - RNA, 29 nt, Artificial Sequence
  Synthetic Oligonucleotide; REL exon 2; Set B
aagaagggucuauuaccuggauagaaggg

SEQ ID NO: 45106 - RNA, 15 nt, Artificial Sequence
  Synthetic Oligonucleotide; REL exon 2; Set C
gaagaagggucuauu

SEQ ID NO: 45107 - RNA, 40 nt, Artificial Sequence
  Synthetic Oligonucleotide; REL exon 2; Set C
aauagugagauagacacagaagaagggucuauuaccugga

SEQ ID NO: 45108 - RNA, 39 nt, Artificial Sequence
  Synthetic Oligonucleotide; REL exon 2; Set B
aauagugagauagacacagaagaagggucuauuaccugg

SEQ ID NO: 45109 - RNA, 33 nt, Artificial Sequence
  Synthetic Oligonucleotide; REL exon 2; Set B
aauagugagauagacacagaagaagggucuauu

SEQ ID NO: 45110 - RNA, 32 nt, Artificial Sequence
  Synthetic Oligonucleotide; REL exon 2; Set B
aauagugagauagacacagaagaagggucuau

SEQ ID NO: 45111 - RNA, 19 nt, Artificial Sequence
  Synthetic Oligonucleotide; REL exon 2; Set C
gagauagacacagaagaag

SEQ ID NO: 45112 - RNA, 31 nt, Artificial Sequence
  Synthetic Oligonucleotide; REL exon 2; Set B
aauagugagauagacacagaagaagggucua

SEQ ID NO: 45113 - RNA, 18 nt, Artificial Sequence
  Synthetic Oligonucleotide; REL exon 2; Set C
gagauagacacagaagaa

SEQ ID NO: 45114 - RNA, 20 nt, Artificial Sequence
  Synthetic Oligonucleotide; REL exon 2; Set C
ugagauagacacagaagaag

SEQ ID NO: 45115 - RNA, 17 nt, Artificial Sequence
  Synthetic Oligonucleotide; REL exon 2; Set C
gagauagacacagaaga

SEQ ID NO: 45116 - RNA, 19 nt, Artificial Sequence
  Synthetic Oligonucleotide; REL exon 2; Set C
ugagauagacacagaagaa

SEQ ID NO: 45117 - RNA, 21 nt, Artificial Sequence
  Synthetic Oligonucleotide; REL exon 2; Set C
gugagauagacacagaagaag

SEQ ID NO: 45118 - RNA, 18 nt, Artificial Sequence
  Synthetic Oligonucleotide; REL exon 2; Set C
ugagauagacacagaaga

SEQ ID NO: 45119 - RNA, 20 nt, Artificial Sequence
  Synthetic Oligonucleotide; REL exon 2; Set C
gugagauagacacagaagaa

SEQ ID NO: 45120 - RNA, 19 nt, Artificial Sequence
  Synthetic Oligonucleotide; REL exon 2; Set C
gugagauagacacagaaga

SEQ ID NO: 45121 - RNA, 25 nt, Artificial Sequence
  Synthetic Oligonucleotide; REL exon 2; Set C
aauagugagauagacacagaagaag

SEQ ID NO: 45122 - RNA, 19 nt, Artificial Sequence
  Synthetic Oligonucleotide; REL exon 2; Set C
agugagauagacacagaag

SEQ ID NO: 45123 - RNA, 24 nt, Artificial Sequence
  Synthetic Oligonucleotide; REL exon 2; Set C
aauagugagauagacacagaagaa

SEQ ID NO: 45124 - RNA, 20 nt, Artificial Sequence
  Synthetic Oligonucleotide; REL exon 2; Set C
uagugagauagacacagaag

SEQ ID NO: 45125 - RNA, 23 nt, Artificial Sequence
  Synthetic Oligonucleotide; REL exon 2; Set C
aauagugagauagacacagaaga

SEQ ID NO: 45126 - RNA, 21 nt, Artificial Sequence
  Synthetic Oligonucleotide; REL exon 2; Set C
auagugagauagacacagaag

SEQ ID NO: 45127 - RNA, 20 nt, Artificial Sequence
  Synthetic Oligonucleotide; REL exon 2; Set C
auagugagauagacacagaa

SEQ ID NO: 45128 - RNA, 16 nt, Artificial Sequence
  Synthetic Oligonucleotide; REL exon 2; Set C
ugaagcaacuaauagu

SEQ ID NO: 45129 - RNA, 15 nt, Artificial Sequence
  Synthetic Oligonucleotide; REL exon 2; Set C
ugaagcaacuaauag

SEQ ID NO: 45130 - RNA, 17 nt, Artificial Sequence
  Synthetic Oligonucleotide; REL exon 2; Set C
augaagcaacuaauagu

SEQ ID NO: 45131 - RNA, 16 nt, Artificial Sequence
  Synthetic Oligonucleotide; REL exon 2; Set C
augaagcaacuaauag

SEQ ID NO: 45132 - RNA, 18 nt, Artificial Sequence
  Synthetic Oligonucleotide; REL exon 2; Set C
uaugaagcaacuaauagu

SEQ ID NO: 45133 - RNA, 15 nt, Artificial Sequence
  Synthetic Oligonucleotide; REL exon 2; Set C
augaagcaacuaaua

SEQ ID NO: 45134 - RNA, 17 nt, Artificial Sequence
  Synthetic Oligonucleotide; REL exon 2; Set C
uaugaagcaacuaauag

SEQ ID NO: 45135 - RNA, 16 nt, Artificial Sequence
  Synthetic Oligonucleotide; REL exon 2; Set C
uaugaagcaacuaaua

SEQ ID NO: 45136 - RNA, 18 nt, Artificial Sequence
  Synthetic Oligonucleotide; REL exon 2; Set C
auaugaagcaacuaauag

SEQ ID NO: 45137 - RNA, 17 nt, Artificial Sequence
  Synthetic Oligonucleotide; REL exon 2; Set C
auaugaagcaacuaaua

SEQ ID NO: 45138 - RNA, 17 nt, Artificial Sequence
  Synthetic Oligonucleotide; REL exon 3; Set C
aaauacaugauccaaau

SEQ ID NO: 45139 - RNA, 18 nt, Artificial Sequence
  Synthetic Oligonucleotide; REL exon 3; Set C
uaaauacaugauccaaau

SEQ ID NO: 45140 - RNA, 19 nt, Artificial Sequence
  Synthetic Oligonucleotide; REL exon 3; Set C
uuaaauacaugauccaaau

SEQ ID NO: 45141 - RNA, 17 nt, Artificial Sequence
  Synthetic Oligonucleotide; REL exon 3; Set C
uaaauacaugauccaaa

SEQ ID NO: 45142 - RNA, 20 nt, Artificial Sequence
  Synthetic Oligonucleotide; REL exon 3; Set C
auuaaauacaugauccaaau

SEQ ID NO: 45143 - RNA, 18 nt, Artificial Sequence
  Synthetic Oligonucleotide; REL exon 3; Set C
uuaaauacaugauccaaa

SEQ ID NO: 45144 - RNA, 21 nt, Artificial Sequence
  Synthetic Oligonucleotide; REL exon 3; Set C
aauuaaauacaugauccaaau

SEQ ID NO: 45145 - RNA, 19 nt, Artificial Sequence
  Synthetic Oligonucleotide; REL exon 3; Set C
auuaaauacaugauccaaa

SEQ ID NO: 45146 - RNA, 22 nt, Artificial Sequence
  Synthetic Oligonucleotide; REL exon 3; Set C
aaauuaaauacaugauccaaau

SEQ ID NO: 45147 - RNA, 20 nt, Artificial Sequence
  Synthetic Oligonucleotide; REL exon 3; Set C
aauuaaauacaugauccaaa

SEQ ID NO: 45148 - RNA, 23 nt, Artificial Sequence
  Synthetic Oligonucleotide; REL exon 3; Set C
gaaauuaaauacaugauccaaau

SEQ ID NO: 45149 - RNA, 21 nt, Artificial Sequence
  Synthetic Oligonucleotide; REL exon 3; Set C
aaauuaaauacaugauccaaa

SEQ ID NO: 45150 - RNA, 24 nt, Artificial Sequence
  Synthetic Oligonucleotide; REL exon 3; Set C
ggaaauuaaauacaugauccaaau

SEQ ID NO: 45151 - RNA, 22 nt, Artificial Sequence
  Synthetic Oligonucleotide; REL exon 3; Set C
gaaauuaaauacaugauccaaa

SEQ ID NO: 45152 - RNA, 25 nt, Artificial Sequence
  Synthetic Oligonucleotide; REL exon 3; Set C
gggaaauuaaauacaugauccaaau

SEQ ID NO: 45153 - RNA, 23 nt, Artificial Sequence
  Synthetic Oligonucleotide; REL exon 3; Set C
ggaaauuaaauacaugauccaaa

SEQ ID NO: 45154 - RNA, 26 nt, Artificial Sequence
  Synthetic Oligonucleotide; REL exon 3; Set C
ggggaaauuaaauacaugauccaaau

SEQ ID NO: 45155 - RNA, 24 nt, Artificial Sequence
  Synthetic Oligonucleotide; REL exon 3; Set C
gggaaauuaaauacaugauccaaa

SEQ ID NO: 45156 - RNA, 22 nt, Artificial Sequence
  Synthetic Oligonucleotide; REL exon 3; Set C
ggaaauuaaauacaugauccaa

SEQ ID NO: 45157 - RNA, 25 nt, Artificial Sequence
  Synthetic Oligonucleotide; REL exon 3; Set C
ggggaaauuaaauacaugauccaaa

SEQ ID NO: 45158 - RNA, 23 nt, Artificial Sequence
  Synthetic Oligonucleotide; REL exon 3; Set C
gggaaauuaaauacaugauccaa

SEQ ID NO: 45159 - RNA, 24 nt, Artificial Sequence
  Synthetic Oligonucleotide; REL exon 3; Set C
ggggaaauuaaauacaugauccaa

SEQ ID NO: 45160 - RNA, 25 nt, Artificial Sequence
  Synthetic Oligonucleotide; REL exon 3; Set C
auaugggucauucuuuguuacuaau

SEQ ID NO: 45161 - RNA, 26 nt, Artificial Sequence
  Synthetic Oligonucleotide; REL exon 3; Set C
uauaugggucauucuuuguuacuaau

SEQ ID NO: 45162 - RNA, 25 nt, Artificial Sequence
  Synthetic Oligonucleotide; REL exon 3; Set C
uauaugggucauucuuuguuacuaa

SEQ ID NO: 45163 - RNA, 27 nt, Artificial Sequence
  Synthetic Oligonucleotide; REL exon 3; Set C
uuauaugggucauucuuuguuacuaau

SEQ ID NO: 45164 - RNA, 26 nt, Artificial Sequence
  Synthetic Oligonucleotide; REL exon 3; Set C
uuauaugggucauucuuuguuacuaa

SEQ ID NO: 45165 - RNA, 28 nt, Artificial Sequence
  Synthetic Oligonucleotide; REL exon 3; Set C
uuuauaugggucauucuuuguuacuaau

SEQ ID NO: 45166 - RNA, 27 nt, Artificial Sequence
  Synthetic Oligonucleotide; REL exon 3; Set C
uuuauaugggucauucuuuguuacuaa

SEQ ID NO: 45167 - RNA, 29 nt, Artificial Sequence
  Synthetic Oligonucleotide; REL exon 3; Set C
guuuauaugggucauucuuuguuacuaau

SEQ ID NO: 45168 - RNA, 28 nt, Artificial Sequence
  Synthetic Oligonucleotide; REL exon 3; Set C
guuuauaugggucauucuuuguuacuaa

SEQ ID NO: 45169 - RNA, 30 nt, Artificial Sequence
  Synthetic Oligonucleotide; REL exon 3; Set A
gguuuauaugggucauucuuuguuacuaau

SEQ ID NO: 45170 - RNA, 29 nt, Artificial Sequence
  Synthetic Oligonucleotide; REL exon 3; Set A
gguuuauaugggucauucuuuguuacuaa

SEQ ID NO: 45171 - RNA, 16 nt, Artificial Sequence
  Synthetic Oligonucleotide; REL exon 3; Set C
uaugggucauucuuug

SEQ ID NO: 45172 - RNA, 17 nt, Artificial Sequence
  Synthetic Oligonucleotide; REL exon 3; Set C
auaugggucauucuuug

SEQ ID NO: 45173 - RNA, 18 nt, Artificial Sequence
  Synthetic Oligonucleotide; REL exon 3; Set C
uauaugggucauucuuug

SEQ ID NO: 45174 - RNA, 16 nt, Artificial Sequence
  Synthetic Oligonucleotide; REL exon 3; Set C
auaugggucauucuuu

SEQ ID NO: 45175 - RNA, 19 nt, Artificial Sequence
  Synthetic Oligonucleotide; REL exon 3; Set C
uuauaugggucauucuuug

SEQ ID NO: 45176 - RNA, 17 nt, Artificial Sequence
  Synthetic Oligonucleotide; REL exon 3; Set C
uauaugggucauucuuu

SEQ ID NO: 45177 - RNA, 15 nt, Artificial Sequence
  Synthetic Oligonucleotide; REL exon 3; Set C
auaugggucauucuu

SEQ ID NO: 45178 - RNA, 20 nt, Artificial Sequence
  Synthetic Oligonucleotide; REL exon 3; Set C
uuuauaugggucauucuuug

SEQ ID NO: 45179 - RNA, 18 nt, Artificial Sequence
  Synthetic Oligonucleotide; REL exon 3; Set C
uuauaugggucauucuuu

SEQ ID NO: 45180 - RNA, 16 nt, Artificial Sequence
  Synthetic Oligonucleotide; REL exon 3; Set C
uauaugggucauucuu

SEQ ID NO: 45181 - RNA, 21 nt, Artificial Sequence
  Synthetic Oligonucleotide; REL exon 3; Set C
guuuauaugggucauucuuug

SEQ ID NO: 45182 - RNA, 19 nt, Artificial Sequence
  Synthetic Oligonucleotide; REL exon 3; Set C
uuuauaugggucauucuuu

SEQ ID NO: 45183 - RNA, 17 nt, Artificial Sequence
  Synthetic Oligonucleotide; REL exon 3; Set C
uuauaugggucauucuu

SEQ ID NO: 45184 - RNA, 15 nt, Artificial Sequence
  Synthetic Oligonucleotide; REL exon 3; Set C
uauaugggucauucu

SEQ ID NO: 45185 - RNA, 22 nt, Artificial Sequence
  Synthetic Oligonucleotide; REL exon 3; Set C
gguuuauaugggucauucuuug

SEQ ID NO: 45186 - RNA, 20 nt, Artificial Sequence
  Synthetic Oligonucleotide; REL exon 3; Set C
guuuauaugggucauucuuu

SEQ ID NO: 45187 - RNA, 18 nt, Artificial Sequence
  Synthetic Oligonucleotide; REL exon 3; Set C
uuuauaugggucauucuu

SEQ ID NO: 45188 - RNA, 16 nt, Artificial Sequence
  Synthetic Oligonucleotide; REL exon 3; Set C
uuauaugggucauucu

SEQ ID NO: 45189 - RNA, 21 nt, Artificial Sequence
  Synthetic Oligonucleotide; REL exon 3; Set C
gguuuauaugggucauucuuu

SEQ ID NO: 45190 - RNA, 19 nt, Artificial Sequence
  Synthetic Oligonucleotide; REL exon 3; Set C
guuuauaugggucauucuu

SEQ ID NO: 45191 - RNA, 17 nt, Artificial Sequence
  Synthetic Oligonucleotide; REL exon 3; Set C
uuuauaugggucauucu

SEQ ID NO: 45192 - RNA, 20 nt, Artificial Sequence
  Synthetic Oligonucleotide; REL exon 3; Set C
gguuuauaugggucauucuu

SEQ ID NO: 45193 - RNA, 18 nt, Artificial Sequence
  Synthetic Oligonucleotide; REL exon 3; Set C
guuuauaugggucauucu

SEQ ID NO: 45194 - RNA, 19 nt, Artificial Sequence
  Synthetic Oligonucleotide; REL exon 3; Set C
gguuuauaugggucauucu

SEQ ID NO: 45195 - RNA, 29 nt, Artificial Sequence
  Synthetic Oligonucleotide; REL exon 3; Set A
aggaugagguuuauaugggucauucuuug

SEQ ID NO: 45196 - RNA, 30 nt, Artificial Sequence
  Synthetic Oligonucleotide; REL exon 3; Set A
gaggaugagguuuauaugggucauucuuug

SEQ ID NO: 45197 - RNA, 28 nt, Artificial Sequence
  Synthetic Oligonucleotide; REL exon 3; Set A
aggaugagguuuauaugggucauucuuu

SEQ ID NO: 45198 - RNA, 31 nt, Artificial Sequence
  Synthetic Oligonucleotide; REL exon 3; Set A
ugaggaugagguuuauaugggucauucuuug

SEQ ID NO: 45199 - RNA, 29 nt, Artificial Sequence
  Synthetic Oligonucleotide; REL exon 3; Set A
gaggaugagguuuauaugggucauucuuu

SEQ ID NO: 45200 - RNA, 20 nt, Artificial Sequence
  Synthetic Oligonucleotide; REL exon 3; Set C
aggaugagguuuauaugggu

SEQ ID NO: 45201 - RNA, 21 nt, Artificial Sequence
  Synthetic Oligonucleotide; REL exon 3; Set C
gaggaugagguuuauaugggu

SEQ ID NO: 45202 - RNA, 22 nt, Artificial Sequence
  Synthetic Oligonucleotide; REL exon 3; Set C
ugaggaugagguuuauaugggu

SEQ ID NO: 45203 - RNA, 16 nt, Artificial Sequence
  Synthetic Oligonucleotide; REL exon 3; Set C
gaggaugagguuuaua

SEQ ID NO: 45204 - RNA, 37 nt, Artificial Sequence
  Synthetic Oligonucleotide; REL exon 3; Set A
uuuccaacuaaaucaugaggaugagguuuauaugggu

SEQ ID NO: 45205 - RNA, 38 nt, Artificial Sequence
  Synthetic Oligonucleotide; REL exon 3; Set A
uuuuccaacuaaaucaugaggaugagguuuauaugggu

SEQ ID NO: 45206 - RNA, 20 nt, Artificial Sequence
  Synthetic Oligonucleotide; REL exon 3; Set C
uuuccaacuaaaucaugagg

SEQ ID NO: 45207 - RNA, 21 nt, Artificial Sequence
  Synthetic Oligonucleotide; REL exon 3; Set C
uuuuccaacuaaaucaugagg

SEQ ID NO: 45208 - RNA, 20 nt, Artificial Sequence
  Synthetic Oligonucleotide; REL exon 3; Set C
uuuuccaacuaaaucaugag

SEQ ID NO: 45209 - RNA, 26 nt, Artificial Sequence
  Synthetic Oligonucleotide; REL exon 3; Set A
uaguagccgucucugcagucuuuucc

SEQ ID NO: 45210 - RNA, 27 nt, Artificial Sequence
  Synthetic Oligonucleotide; REL exon 3; Set A
auaguagccgucucugcagucuuuucc

SEQ ID NO: 45211 - RNA, 26 nt, Artificial Sequence
  Synthetic Oligonucleotide; REL exon 3; Set A
auaguagccgucucugcagucuuuuc

SEQ ID NO: 45212 - RNA, 25 nt, Artificial Sequence
  Synthetic Oligonucleotide; REL exon 3; Set A
auaguagccgucucugcagucuuuu

SEQ ID NO: 45213 - RNA, 15 nt, Artificial Sequence
  Synthetic Oligonucleotide; REL exon 3; Set C
cauaguagccgucuc

SEQ ID NO: 45214 - RNA, 16 nt, Artificial Sequence
  Synthetic Oligonucleotide; REL exon 3; Set C
ucauaguagccgucuc

SEQ ID NO: 45215 - RNA, 17 nt, Artificial Sequence
  Synthetic Oligonucleotide; REL exon 3; Set C
uucauaguagccgucuc

SEQ ID NO: 45216 - RNA, 37 nt, Artificial Sequence
  Synthetic Oligonucleotide; REL exon 3; Set C
gaaauuaaauacaugauccaaauagacugcauuauaa

SEQ ID NO: 45217 - RNA, 36 nt, Artificial Sequence
  Synthetic Oligonucleotide; REL exon 3; Set C
gaaauuaaauacaugauccaaauagacugcauuaua

SEQ ID NO: 45218 - RNA, 38 nt, Artificial Sequence
  Synthetic Oligonucleotide; REL exon 3; Set C
ggaaauuaaauacaugauccaaauagacugcauuauaa

SEQ ID NO: 45219 - RNA, 33 nt, Artificial Sequence
  Synthetic Oligonucleotide; REL exon 3; Set C
aaauuaaauacaugauccaaauagacugcauua

SEQ ID NO: 45220 - RNA, 37 nt, Artificial Sequence
  Synthetic Oligonucleotide; REL exon 3; Set A
ggaaauuaaauacaugauccaaauagacugcauuaua

SEQ ID NO: 45221 - RNA, 39 nt, Artificial Sequence
  Synthetic Oligonucleotide; REL exon 3; Set A
gggaaauuaaauacaugauccaaauagacugcauuauaa

SEQ ID NO: 45222 - RNA, 34 nt, Artificial Sequence
  Synthetic Oligonucleotide; REL exon 3; Set C
gaaauuaaauacaugauccaaauagacugcauua

SEQ ID NO: 45223 - RNA, 38 nt, Artificial Sequence
  Synthetic Oligonucleotide; REL exon 3; Set A
gggaaauuaaauacaugauccaaauagacugcauuaua

SEQ ID NO: 45224 - RNA, 40 nt, Artificial Sequence
  Synthetic Oligonucleotide; REL exon 3; Set A
ggggaaauuaaauacaugauccaaauagacugcauuauaa

SEQ ID NO: 45225 - RNA, 35 nt, Artificial Sequence
  Synthetic Oligonucleotide; REL exon 3; Set C
ggaaauuaaauacaugauccaaauagacugcauua

SEQ ID NO: 45226 - RNA, 39 nt, Artificial Sequence
  Synthetic Oligonucleotide; REL exon 3; Set A
ggggaaauuaaauacaugauccaaauagacugcauuaua

SEQ ID NO: 45227 - RNA, 37 nt, Artificial Sequence
  Synthetic Oligonucleotide; REL exon 3; Set A
gggaaauuaaauacaugauccaaauagacugcauuau

SEQ ID NO: 45228 - RNA, 36 nt, Artificial Sequence
  Synthetic Oligonucleotide; REL exon 3; Set A
gggaaauuaaauacaugauccaaauagacugcauua

SEQ ID NO: 45229 - RNA, 38 nt, Artificial Sequence
  Synthetic Oligonucleotide; REL exon 3; Set A
ggggaaauuaaauacaugauccaaauagacugcauuau

SEQ ID NO: 45230 - RNA, 15 nt, Artificial Sequence
  Synthetic Oligonucleotide; REL exon 3; Set C
auacaugauccaaau

SEQ ID NO: 45231 - RNA, 37 nt, Artificial Sequence
  Synthetic Oligonucleotide; REL exon 3; Set A
ggggaaauuaaauacaugauccaaauagacugcauua

SEQ ID NO: 45232 - RNA, 16 nt, Artificial Sequence
  Synthetic Oligonucleotide; REL exon 3; Set C
aauacaugauccaaau

SEQ ID NO: 45233 - RNA, 15 nt, Artificial Sequence
  Synthetic Oligonucleotide; REL exon 3; Set C
aauacaugauccaaa

SEQ ID NO: 45234 - RNA, 16 nt, Artificial Sequence
  Synthetic Oligonucleotide; REL exon 3; Set C
aaauacaugauccaaa

SEQ ID NO: 45235 - RNA, 15 nt, Artificial Sequence
  Synthetic Oligonucleotide; REL exon 3; Set C
aaauacaugauccaa

SEQ ID NO: 45236 - RNA, 16 nt, Artificial Sequence
  Synthetic Oligonucleotide; REL exon 3; Set C
uaaauacaugauccaa

SEQ ID NO: 45237 - RNA, 17 nt, Artificial Sequence
  Synthetic Oligonucleotide; REL exon 3; Set C
uuaaauacaugauccaa

SEQ ID NO: 45238 - RNA, 18 nt, Artificial Sequence
  Synthetic Oligonucleotide; REL exon 3; Set C
auuaaauacaugauccaa

SEQ ID NO: 45239 - RNA, 16 nt, Artificial Sequence
  Synthetic Oligonucleotide; REL exon 3; Set C
uuaaauacaugaucca

SEQ ID NO: 45240 - RNA, 19 nt, Artificial Sequence
  Synthetic Oligonucleotide; REL exon 3; Set C
aauuaaauacaugauccaa

SEQ ID NO: 45241 - RNA, 17 nt, Artificial Sequence
  Synthetic Oligonucleotide; REL exon 3; Set C
auuaaauacaugaucca

SEQ ID NO: 45242 - RNA, 20 nt, Artificial Sequence
  Synthetic Oligonucleotide; REL exon 3; Set C
aaauuaaauacaugauccaa

SEQ ID NO: 45243 - RNA, 18 nt, Artificial Sequence
  Synthetic Oligonucleotide; REL exon 3; Set C
aauuaaauacaugaucca

SEQ ID NO: 45244 - RNA, 21 nt, Artificial Sequence
  Synthetic Oligonucleotide; REL exon 3; Set C
gaaauuaaauacaugauccaa

SEQ ID NO: 45245 - RNA, 19 nt, Artificial Sequence
  Synthetic Oligonucleotide; REL exon 3; Set C
aaauuaaauacaugaucca

SEQ ID NO: 45246 - RNA, 20 nt, Artificial Sequence
  Synthetic Oligonucleotide; REL exon 3; Set C
gaaauuaaauacaugaucca

SEQ ID NO: 45247 - RNA, 21 nt, Artificial Sequence
  Synthetic Oligonucleotide; REL exon 3; Set C
ggaaauuaaauacaugaucca

SEQ ID NO: 45248 - RNA, 22 nt, Artificial Sequence
  Synthetic Oligonucleotide; REL exon 3; Set C
gggaaauuaaauacaugaucca

SEQ ID NO: 45249 - RNA, 23 nt, Artificial Sequence
  Synthetic Oligonucleotide; REL exon 3; Set C
ggggaaauuaaauacaugaucca

SEQ ID NO: 45250 - RNA, 40 nt, Artificial Sequence
  Synthetic Oligonucleotide; REL exon 3; Set C
auaaucugaaaaaagggggaaauuaaauacaugauccaaa

SEQ ID NO: 45251 - RNA, 29 nt, Artificial Sequence
  Synthetic Oligonucleotide; REL exon 3; Set C
auaaucugaaaaaagggggaaauuaaaua

SEQ ID NO: 45252 - RNA, 28 nt, Artificial Sequence
  Synthetic Oligonucleotide; REL exon 3; Set C
auaaucugaaaaaagggggaaauuaaau

SEQ ID NO: 45253 - RNA, 30 nt, Artificial Sequence
  Synthetic Oligonucleotide; REL exon 3; Set C
cauaaucugaaaaaagggggaaauuaaaua

SEQ ID NO: 45254 - RNA, 29 nt, Artificial Sequence
  Synthetic Oligonucleotide; REL exon 3; Set C
cauaaucugaaaaaagggggaaauuaaau

SEQ ID NO: 45255 - RNA, 27 nt, Artificial Sequence
  Synthetic Oligonucleotide; REL exon 3; Set C
auaaucugaaaaaagggggaaauuaaa

SEQ ID NO: 45256 - RNA, 31 nt, Artificial Sequence
  Synthetic Oligonucleotide; REL exon 3; Set C
ucauaaucugaaaaaagggggaaauuaaaua

SEQ ID NO: 45257 - RNA, 30 nt, Artificial Sequence
  Synthetic Oligonucleotide; REL exon 3; Set C
ucauaaucugaaaaaagggggaaauuaaau

SEQ ID NO: 45258 - RNA, 28 nt, Artificial Sequence
  Synthetic Oligonucleotide; REL exon 3; Set C
cauaaucugaaaaaagggggaaauuaaa

SEQ ID NO: 45259 - RNA, 26 nt, Artificial Sequence
  Synthetic Oligonucleotide; REL exon 3; Set C
auaaucugaaaaaagggggaaauuaa

SEQ ID NO: 45260 - RNA, 32 nt, Artificial Sequence
  Synthetic Oligonucleotide; REL exon 3; Set C
uucauaaucugaaaaaagggggaaauuaaaua

SEQ ID NO: 45261 - RNA, 25 nt, Artificial Sequence
  Synthetic Oligonucleotide; REL exon 3; Set C
auaaucugaaaaaagggggaaauua

SEQ ID NO: 45262 - RNA, 31 nt, Artificial Sequence
  Synthetic Oligonucleotide; REL exon 3; Set C
uucauaaucugaaaaaagggggaaauuaaau

SEQ ID NO: 45263 - RNA, 29 nt, Artificial Sequence
  Synthetic Oligonucleotide; REL exon 3; Set C
ucauaaucugaaaaaagggggaaauuaaa

SEQ ID NO: 45264 - RNA, 27 nt, Artificial Sequence
  Synthetic Oligonucleotide; REL exon 3; Set C
cauaaucugaaaaaagggggaaauuaa

SEQ ID NO: 45265 - RNA, 33 nt, Artificial Sequence
  Synthetic Oligonucleotide; REL exon 3; Set C
guucauaaucugaaaaaagggggaaauuaaaua

SEQ ID NO: 45266 - RNA, 26 nt, Artificial Sequence
  Synthetic Oligonucleotide; REL exon 3; Set C
cauaaucugaaaaaagggggaaauua

SEQ ID NO: 45267 - RNA, 24 nt, Artificial Sequence
  Synthetic Oligonucleotide; REL exon 3; Set C
auaaucugaaaaaagggggaaauu

SEQ ID NO: 45268 - RNA, 30 nt, Artificial Sequence
  Synthetic Oligonucleotide; REL exon 3; Set C
uucauaaucugaaaaaagggggaaauuaaa

SEQ ID NO: 45269 - RNA, 32 nt, Artificial Sequence
  Synthetic Oligonucleotide; REL exon 3; Set C
guucauaaucugaaaaaagggggaaauuaaau

SEQ ID NO: 45270 - RNA, 28 nt, Artificial Sequence
  Synthetic Oligonucleotide; REL exon 3; Set C
ucauaaucugaaaaaagggggaaauuaa

SEQ ID NO: 45271 - RNA, 34 nt, Artificial Sequence
  Synthetic Oligonucleotide; REL exon 3; Set C
aguucauaaucugaaaaaagggggaaauuaaaua

SEQ ID NO: 45272 - RNA, 27 nt, Artificial Sequence
  Synthetic Oligonucleotide; REL exon 3; Set C
ucauaaucugaaaaaagggggaaauua

SEQ ID NO: 45273 - RNA, 25 nt, Artificial Sequence
  Synthetic Oligonucleotide; REL exon 3; Set C
cauaaucugaaaaaagggggaaauu

SEQ ID NO: 45274 - RNA, 23 nt, Artificial Sequence
  Synthetic Oligonucleotide; REL exon 3; Set C
auaaucugaaaaaagggggaaau

SEQ ID NO: 45275 - RNA, 29 nt, Artificial Sequence
  Synthetic Oligonucleotide; REL exon 3; Set C
uucauaaucugaaaaaagggggaaauuaa

SEQ ID NO: 45276 - RNA, 33 nt, Artificial Sequence
  Synthetic Oligonucleotide; REL exon 3; Set C
aguucauaaucugaaaaaagggggaaauuaaau

SEQ ID NO: 45277 - RNA, 31 nt, Artificial Sequence
  Synthetic Oligonucleotide; REL exon 3; Set C
guucauaaucugaaaaaagggggaaauuaaa

SEQ ID NO: 45278 - RNA, 28 nt, Artificial Sequence
  Synthetic Oligonucleotide; REL exon 3; Set C
uucauaaucugaaaaaagggggaaauua

SEQ ID NO: 45279 - RNA, 26 nt, Artificial Sequence
  Synthetic Oligonucleotide; REL exon 3; Set C
ucauaaucugaaaaaagggggaaauu

SEQ ID NO: 45280 - RNA, 24 nt, Artificial Sequence
  Synthetic Oligonucleotide; REL exon 3; Set C
cauaaucugaaaaaagggggaaau

SEQ ID NO: 45281 - RNA, 32 nt, Artificial Sequence
  Synthetic Oligonucleotide; REL exon 3; Set C
aguucauaaucugaaaaaagggggaaauuaaa

SEQ ID NO: 45282 - RNA, 30 nt, Artificial Sequence
  Synthetic Oligonucleotide; REL exon 3; Set C
guucauaaucugaaaaaagggggaaauuaa

SEQ ID NO: 45283 - RNA, 27 nt, Artificial Sequence
  Synthetic Oligonucleotide; REL exon 3; Set C
uucauaaucugaaaaaagggggaaauu

SEQ ID NO: 45284 - RNA, 29 nt, Artificial Sequence
  Synthetic Oligonucleotide; REL exon 3; Set C
guucauaaucugaaaaaagggggaaauua

SEQ ID NO: 45285 - RNA, 25 nt, Artificial Sequence
  Synthetic Oligonucleotide; REL exon 3; Set C
ucauaaucugaaaaaagggggaaau

SEQ ID NO: 45286 - RNA, 31 nt, Artificial Sequence
  Synthetic Oligonucleotide; REL exon 3; Set C
aguucauaaucugaaaaaagggggaaauuaa

SEQ ID NO: 45287 - RNA, 26 nt, Artificial Sequence
  Synthetic Oligonucleotide; REL exon 3; Set C
uucauaaucugaaaaaagggggaaau

SEQ ID NO: 45288 - RNA, 30 nt, Artificial Sequence
  Synthetic Oligonucleotide; REL exon 3; Set C
aguucauaaucugaaaaaagggggaaauua

SEQ ID NO: 45289 - RNA, 28 nt, Artificial Sequence
  Synthetic Oligonucleotide; REL exon 3; Set C
guucauaaucugaaaaaagggggaaauu

SEQ ID NO: 45290 - RNA, 24 nt, Artificial Sequence
  Synthetic Oligonucleotide; REL exon 3; Set C
ucauaaucugaaaaaagggggaaa

SEQ ID NO: 45291 - RNA, 29 nt, Artificial Sequence
  Synthetic Oligonucleotide; REL exon 3; Set C
aguucauaaucugaaaaaagggggaaauu

SEQ ID NO: 45292 - RNA, 27 nt, Artificial Sequence
  Synthetic Oligonucleotide; REL exon 3; Set C
guucauaaucugaaaaaagggggaaau

SEQ ID NO: 45293 - RNA, 25 nt, Artificial Sequence
  Synthetic Oligonucleotide; REL exon 3; Set C
uucauaaucugaaaaaagggggaaa

SEQ ID NO: 45294 - RNA, 28 nt, Artificial Sequence
  Synthetic Oligonucleotide; REL exon 3; Set C
aguucauaaucugaaaaaagggggaaau

SEQ ID NO: 45295 - RNA, 24 nt, Artificial Sequence
  Synthetic Oligonucleotide; REL exon 3; Set C
uucauaaucugaaaaaagggggaa

SEQ ID NO: 45296 - RNA, 26 nt, Artificial Sequence
  Synthetic Oligonucleotide; REL exon 3; Set C
guucauaaucugaaaaaagggggaaa

SEQ ID NO: 45297 - RNA, 27 nt, Artificial Sequence
  Synthetic Oligonucleotide; REL exon 3; Set C
aguucauaaucugaaaaaagggggaaa

SEQ ID NO: 45298 - RNA, 25 nt, Artificial Sequence
  Synthetic Oligonucleotide; REL exon 3; Set C
guucauaaucugaaaaaagggggaa

SEQ ID NO: 45299 - RNA, 26 nt, Artificial Sequence
  Synthetic Oligonucleotide; REL exon 3; Set C
aguucauaaucugaaaaaagggggaa

SEQ ID NO: 45300 - RNA, 24 nt, Artificial Sequence
  Synthetic Oligonucleotide; REL exon 3; Set C
guucauaaucugaaaaaaggggga

SEQ ID NO: 45301 - RNA, 25 nt, Artificial Sequence
  Synthetic Oligonucleotide; REL exon 3; Set C
aguucauaaucugaaaaaaggggga

SEQ ID NO: 45302 - RNA, 24 nt, Artificial Sequence
  Synthetic Oligonucleotide; REL exon 3; Set C
aguucauaaucugaaaaaaggggg

SEQ ID NO: 45303 - RNA, 29 nt, Artificial Sequence
  Synthetic Oligonucleotide; REL exon 3; Set C
ucuuuguuacuaauguaauucucacuuuu

SEQ ID NO: 45304 - RNA, 40 nt, Artificial Sequence
  Synthetic Oligonucleotide; REL exon 3; Set A
auaugggucauucuuuguuacuaauguaauucucacuuuu

SEQ ID NO: 45305 - RNA, 39 nt, Artificial Sequence
  Synthetic Oligonucleotide; REL exon 3; Set A
auaugggucauucuuuguuacuaauguaauucucacuuu

SEQ ID NO: 45306 - RNA, 40 nt, Artificial Sequence
  Synthetic Oligonucleotide; REL exon 3; Set A
uauaugggucauucuuuguuacuaauguaauucucacuuu

SEQ ID NO: 45307 - RNA, 20 nt, Artificial Sequence
  Synthetic Oligonucleotide; REL exon 3; Set C
ggucauucuuuguuacuaau

SEQ ID NO: 45308 - RNA, 19 nt, Artificial Sequence
  Synthetic Oligonucleotide; REL exon 3; Set C
ggucauucuuuguuacuaa

SEQ ID NO: 45309 - RNA, 21 nt, Artificial Sequence
  Synthetic Oligonucleotide; REL exon 3; Set C
gggucauucuuuguuacuaau

SEQ ID NO: 45310 - RNA, 20 nt, Artificial Sequence
  Synthetic Oligonucleotide; REL exon 3; Set C
gggucauucuuuguuacuaa

SEQ ID NO: 45311 - RNA, 22 nt, Artificial Sequence
  Synthetic Oligonucleotide; REL exon 3; Set C
ugggucauucuuuguuacuaau

SEQ ID NO: 45312 - RNA, 21 nt, Artificial Sequence
  Synthetic Oligonucleotide; REL exon 3; Set C
ugggucauucuuuguuacuaa

SEQ ID NO: 45313 - RNA, 23 nt, Artificial Sequence
  Synthetic Oligonucleotide; REL exon 3; Set C
augggucauucuuuguuacuaau

SEQ ID NO: 45314 - RNA, 22 nt, Artificial Sequence
  Synthetic Oligonucleotide; REL exon 3; Set C
augggucauucuuuguuacuaa

SEQ ID NO: 45315 - RNA, 24 nt, Artificial Sequence
  Synthetic Oligonucleotide; REL exon 3; Set C
uaugggucauucuuuguuacuaau

SEQ ID NO: 45316 - RNA, 23 nt, Artificial Sequence
  Synthetic Oligonucleotide; REL exon 3; Set C
uaugggucauucuuuguuacuaa

SEQ ID NO: 45317 - RNA, 24 nt, Artificial Sequence
  Synthetic Oligonucleotide; REL exon 3; Set C
auaugggucauucuuuguuacuaa

SEQ ID NO: 45318 - RNA, 15 nt, Artificial Sequence
  Synthetic Oligonucleotide; REL exon 3; Set C
augggucauucuuug

SEQ ID NO: 45319 - RNA, 15 nt, Artificial Sequence
  Synthetic Oligonucleotide; REL exon 3; Set C
uaugggucauucuuu

SEQ ID NO: 45320 - RNA, 37 nt, Artificial Sequence
  Synthetic Oligonucleotide; REL exon 3; Set A
aggaugagguuuauaugggucauucuuuguuacuaau

SEQ ID NO: 45321 - RNA, 36 nt, Artificial Sequence
  Synthetic Oligonucleotide; REL exon 3; Set A
aggaugagguuuauaugggucauucuuuguuacuaa

SEQ ID NO: 45322 - RNA, 38 nt, Artificial Sequence
  Synthetic Oligonucleotide; REL exon 3; Set A
gaggaugagguuuauaugggucauucuuuguuacuaau

SEQ ID NO: 45323 - RNA, 37 nt, Artificial Sequence
  Synthetic Oligonucleotide; REL exon 3; Set A
gaggaugagguuuauaugggucauucuuuguuacuaa

SEQ ID NO: 45324 - RNA, 39 nt, Artificial Sequence
  Synthetic Oligonucleotide; REL exon 3; Set A
ugaggaugagguuuauaugggucauucuuuguuacuaau

SEQ ID NO: 45325 - RNA, 38 nt, Artificial Sequence
  Synthetic Oligonucleotide; REL exon 3; Set A
ugaggaugagguuuauaugggucauucuuuguuacuaa

SEQ ID NO: 45326 - RNA, 40 nt, Artificial Sequence
  Synthetic Oligonucleotide; REL exon 3; Set A
augaggaugagguuuauaugggucauucuuuguuacuaau

SEQ ID NO: 45327 - RNA, 39 nt, Artificial Sequence
  Synthetic Oligonucleotide; REL exon 3; Set A
augaggaugagguuuauaugggucauucuuuguuacuaa

SEQ ID NO: 45328 - RNA, 27 nt, Artificial Sequence
  Synthetic Oligonucleotide; REL exon 3; Set A
aggaugagguuuauaugggucauucuu

SEQ ID NO: 45329 - RNA, 32 nt, Artificial Sequence
  Synthetic Oligonucleotide; REL exon 3; Set A
augaggaugagguuuauaugggucauucuuug

SEQ ID NO: 45330 - RNA, 30 nt, Artificial Sequence
  Synthetic Oligonucleotide; REL exon 3; Set A
ugaggaugagguuuauaugggucauucuuu

SEQ ID NO: 45331 - RNA, 28 nt, Artificial Sequence
  Synthetic Oligonucleotide; REL exon 3; Set A
gaggaugagguuuauaugggucauucuu

SEQ ID NO: 45332 - RNA, 26 nt, Artificial Sequence
  Synthetic Oligonucleotide; REL exon 3; Set A
aggaugagguuuauaugggucauucu

SEQ ID NO: 45333 - RNA, 31 nt, Artificial Sequence
  Synthetic Oligonucleotide; REL exon 3; Set A
augaggaugagguuuauaugggucauucuuu

SEQ ID NO: 45334 - RNA, 27 nt, Artificial Sequence
  Synthetic Oligonucleotide; REL exon 3; Set A
gaggaugagguuuauaugggucauucu

SEQ ID NO: 45335 - RNA, 29 nt, Artificial Sequence
  Synthetic Oligonucleotide; REL exon 3; Set A
ugaggaugagguuuauaugggucauucuu

SEQ ID NO: 45336 - RNA, 28 nt, Artificial Sequence
  Synthetic Oligonucleotide; REL exon 3; Set A
ugaggaugagguuuauaugggucauucu

SEQ ID NO: 45337 - RNA, 30 nt, Artificial Sequence
  Synthetic Oligonucleotide; REL exon 3; Set A
augaggaugagguuuauaugggucauucuu

SEQ ID NO: 45338 - RNA, 29 nt, Artificial Sequence
  Synthetic Oligonucleotide; REL exon 3; Set A
augaggaugagguuuauaugggucauucu

SEQ ID NO: 45339 - RNA, 19 nt, Artificial Sequence
  Synthetic Oligonucleotide; REL exon 3; Set C
aggaugagguuuauauggg

SEQ ID NO: 45340 - RNA, 18 nt, Artificial Sequence
  Synthetic Oligonucleotide; REL exon 3; Set C
aggaugagguuuauaugg

SEQ ID NO: 45341 - RNA, 20 nt, Artificial Sequence
  Synthetic Oligonucleotide; REL exon 3; Set C
gaggaugagguuuauauggg

SEQ ID NO: 45342 - RNA, 23 nt, Artificial Sequence
  Synthetic Oligonucleotide; REL exon 3; Set C
augaggaugagguuuauaugggu

SEQ ID NO: 45343 - RNA, 17 nt, Artificial Sequence
  Synthetic Oligonucleotide; REL exon 3; Set C
aggaugagguuuauaug

SEQ ID NO: 45344 - RNA, 19 nt, Artificial Sequence
  Synthetic Oligonucleotide; REL exon 3; Set C
gaggaugagguuuauaugg

SEQ ID NO: 45345 - RNA, 21 nt, Artificial Sequence
  Synthetic Oligonucleotide; REL exon 3; Set C
ugaggaugagguuuauauggg

SEQ ID NO: 45346 - RNA, 16 nt, Artificial Sequence
  Synthetic Oligonucleotide; REL exon 3; Set C
aggaugagguuuauau

SEQ ID NO: 45347 - RNA, 18 nt, Artificial Sequence
  Synthetic Oligonucleotide; REL exon 3; Set C
gaggaugagguuuauaug

SEQ ID NO: 45348 - RNA, 20 nt, Artificial Sequence
  Synthetic Oligonucleotide; REL exon 3; Set C
ugaggaugagguuuauaugg

SEQ ID NO: 45349 - RNA, 15 nt, Artificial Sequence
  Synthetic Oligonucleotide; REL exon 3; Set C
aggaugagguuuaua

SEQ ID NO: 45350 - RNA, 17 nt, Artificial Sequence
  Synthetic Oligonucleotide; REL exon 3; Set C
gaggaugagguuuauau

SEQ ID NO: 45351 - RNA, 19 nt, Artificial Sequence
  Synthetic Oligonucleotide; REL exon 3; Set C
ugaggaugagguuuauaug

SEQ ID NO: 45352 - RNA, 40 nt, Artificial Sequence
  Synthetic Oligonucleotide; REL exon 3; Set A
caacuaaaucaugaggaugagguuuauaugggucauucuu

SEQ ID NO: 45353 - RNA, 18 nt, Artificial Sequence
  Synthetic Oligonucleotide; REL exon 3; Set C
ugaggaugagguuuauau

SEQ ID NO: 45354 - RNA, 15 nt, Artificial Sequence
  Synthetic Oligonucleotide; REL exon 3; Set C
gaggaugagguuuau

SEQ ID NO: 45355 - RNA, 17 nt, Artificial Sequence
  Synthetic Oligonucleotide; REL exon 3; Set C
ugaggaugagguuuaua

SEQ ID NO: 45356 - RNA, 39 nt, Artificial Sequence
  Synthetic Oligonucleotide; REL exon 3; Set A
caacuaaaucaugaggaugagguuuauaugggucauucu

SEQ ID NO: 45357 - RNA, 16 nt, Artificial Sequence
  Synthetic Oligonucleotide; REL exon 3; Set C
ugaggaugagguuuau

SEQ ID NO: 45358 - RNA, 18 nt, Artificial Sequence
  Synthetic Oligonucleotide; REL exon 3; Set C
augaggaugagguuuaua

SEQ ID NO: 45359 - RNA, 40 nt, Artificial Sequence
  Synthetic Oligonucleotide; REL exon 3; Set C
ccaacuaaaucaugaggaugagguuuauaugggucauucu

SEQ ID NO: 45360 - RNA, 15 nt, Artificial Sequence
  Synthetic Oligonucleotide; REL exon 3; Set C
ugaggaugagguuua

SEQ ID NO: 45361 - RNA, 17 nt, Artificial Sequence
  Synthetic Oligonucleotide; REL exon 3; Set C
augaggaugagguuuau

SEQ ID NO: 45362 - RNA, 16 nt, Artificial Sequence
  Synthetic Oligonucleotide; REL exon 3; Set C
augaggaugagguuua

SEQ ID NO: 45363 - RNA, 15 nt, Artificial Sequence
  Synthetic Oligonucleotide; REL exon 3; Set C
augaggaugagguuu

SEQ ID NO: 45364 - RNA, 33 nt, Artificial Sequence
  Synthetic Oligonucleotide; REL exon 3; Set A
caacuaaaucaugaggaugagguuuauaugggu

SEQ ID NO: 45365 - RNA, 34 nt, Artificial Sequence
  Synthetic Oligonucleotide; REL exon 3; Set A
ccaacuaaaucaugaggaugagguuuauaugggu

SEQ ID NO: 45366 - RNA, 35 nt, Artificial Sequence
  Synthetic Oligonucleotide; REL exon 3; Set A
uccaacuaaaucaugaggaugagguuuauaugggu

SEQ ID NO: 45367 - RNA, 36 nt, Artificial Sequence
  Synthetic Oligonucleotide; REL exon 3; Set A
uuccaacuaaaucaugaggaugagguuuauaugggu

SEQ ID NO: 45368 - RNA, 34 nt, Artificial Sequence
  Synthetic Oligonucleotide; REL exon 3; Set A
uccaacuaaaucaugaggaugagguuuauauggg

SEQ ID NO: 45369 - RNA, 33 nt, Artificial Sequence
  Synthetic Oligonucleotide; REL exon 3; Set A
uccaacuaaaucaugaggaugagguuuauaugg

SEQ ID NO: 45370 - RNA, 35 nt, Artificial Sequence
  Synthetic Oligonucleotide; REL exon 3; Set A
uuccaacuaaaucaugaggaugagguuuauauggg

SEQ ID NO: 45371 - RNA, 28 nt, Artificial Sequence
  Synthetic Oligonucleotide; REL exon 3; Set C
caacuaaaucaugaggaugagguuuaua

SEQ ID NO: 45372 - RNA, 32 nt, Artificial Sequence
  Synthetic Oligonucleotide; REL exon 3; Set A
uccaacuaaaucaugaggaugagguuuauaug

SEQ ID NO: 45373 - RNA, 34 nt, Artificial Sequence
  Synthetic Oligonucleotide; REL exon 3; Set A
uuccaacuaaaucaugaggaugagguuuauaugg

SEQ ID NO: 45374 - RNA, 36 nt, Artificial Sequence
  Synthetic Oligonucleotide; REL exon 3; Set A
uuuccaacuaaaucaugaggaugagguuuauauggg

SEQ ID NO: 45375 - RNA, 29 nt, Artificial Sequence
  Synthetic Oligonucleotide; REL exon 3; Set C
ccaacuaaaucaugaggaugagguuuaua

SEQ ID NO: 45376 - RNA, 27 nt, Artificial Sequence
  Synthetic Oligonucleotide; REL exon 3; Set C
caacuaaaucaugaggaugagguuuau

SEQ ID NO: 45377 - RNA, 31 nt, Artificial Sequence
  Synthetic Oligonucleotide; REL exon 3; Set A
uccaacuaaaucaugaggaugagguuuauau

SEQ ID NO: 45378 - RNA, 33 nt, Artificial Sequence
  Synthetic Oligonucleotide; REL exon 3; Set A
uuccaacuaaaucaugaggaugagguuuauaug

SEQ ID NO: 45379 - RNA, 35 nt, Artificial Sequence
  Synthetic Oligonucleotide; REL exon 3; Set A
uuuccaacuaaaucaugaggaugagguuuauaugg

SEQ ID NO: 45380 - RNA, 37 nt, Artificial Sequence
  Synthetic Oligonucleotide; REL exon 3; Set A
uuuuccaacuaaaucaugaggaugagguuuauauggg

SEQ ID NO: 45381 - RNA, 30 nt, Artificial Sequence
  Synthetic Oligonucleotide; REL exon 3; Set A
uccaacuaaaucaugaggaugagguuuaua

SEQ ID NO: 45382 - RNA, 28 nt, Artificial Sequence
  Synthetic Oligonucleotide; REL exon 3; Set C
ccaacuaaaucaugaggaugagguuuau

SEQ ID NO: 45383 - RNA, 32 nt, Artificial Sequence
  Synthetic Oligonucleotide; REL exon 3; Set A
uuccaacuaaaucaugaggaugagguuuauau

SEQ ID NO: 45384 - RNA, 34 nt, Artificial Sequence
  Synthetic Oligonucleotide; REL exon 3; Set A
uuuccaacuaaaucaugaggaugagguuuauaug

SEQ ID NO: 45385 - RNA, 36 nt, Artificial Sequence
  Synthetic Oligonucleotide; REL exon 3; Set A
uuuuccaacuaaaucaugaggaugagguuuauaugg

SEQ ID NO: 45386 - RNA, 31 nt, Artificial Sequence
  Synthetic Oligonucleotide; REL exon 3; Set A
uuccaacuaaaucaugaggaugagguuuaua

SEQ ID NO: 45387 - RNA, 29 nt, Artificial Sequence
  Synthetic Oligonucleotide; REL exon 3; Set C
uccaacuaaaucaugaggaugagguuuau

SEQ ID NO: 45388 - RNA, 27 nt, Artificial Sequence
  Synthetic Oligonucleotide; REL exon 3; Set C
ccaacuaaaucaugaggaugagguuua

SEQ ID NO: 45389 - RNA, 33 nt, Artificial Sequence
  Synthetic Oligonucleotide; REL exon 3; Set A
uuuccaacuaaaucaugaggaugagguuuauau

SEQ ID NO: 45390 - RNA, 35 nt, Artificial Sequence
  Synthetic Oligonucleotide; REL exon 3; Set A
uuuuccaacuaaaucaugaggaugagguuuauaug

SEQ ID NO: 45391 - RNA, 32 nt, Artificial Sequence
  Synthetic Oligonucleotide; REL exon 3; Set A
uuuccaacuaaaucaugaggaugagguuuaua

SEQ ID NO: 45392 - RNA, 30 nt, Artificial Sequence
  Synthetic Oligonucleotide; REL exon 3; Set A
uuccaacuaaaucaugaggaugagguuuau

SEQ ID NO: 45393 - RNA, 28 nt, Artificial Sequence
  Synthetic Oligonucleotide; REL exon 3; Set C
uccaacuaaaucaugaggaugagguuua

SEQ ID NO: 45394 - RNA, 34 nt, Artificial Sequence
  Synthetic Oligonucleotide; REL exon 3; Set A
uuuuccaacuaaaucaugaggaugagguuuauau

SEQ ID NO: 45395 - RNA, 27 nt, Artificial Sequence
  Synthetic Oligonucleotide; REL exon 3; Set C
uccaacuaaaucaugaggaugagguuu

SEQ ID NO: 45396 - RNA, 33 nt, Artificial Sequence
  Synthetic Oligonucleotide; REL exon 3; Set A
uuuuccaacuaaaucaugaggaugagguuuaua

SEQ ID NO: 45397 - RNA, 31 nt, Artificial Sequence
  Synthetic Oligonucleotide; REL exon 3; Set A
uuuccaacuaaaucaugaggaugagguuuau

SEQ ID NO: 45398 - RNA, 29 nt, Artificial Sequence
  Synthetic Oligonucleotide; REL exon 3; Set A
uuccaacuaaaucaugaggaugagguuua

SEQ ID NO: 45399 - RNA, 28 nt, Artificial Sequence
  Synthetic Oligonucleotide; REL exon 3; Set C
uuccaacuaaaucaugaggaugagguuu

SEQ ID NO: 45400 - RNA, 26 nt, Artificial Sequence
  Synthetic Oligonucleotide; REL exon 3; Set C
uccaacuaaaucaugaggaugagguu

SEQ ID NO: 45401 - RNA, 32 nt, Artificial Sequence
  Synthetic Oligonucleotide; REL exon 3; Set A
uuuuccaacuaaaucaugaggaugagguuuau

SEQ ID NO: 45402 - RNA, 30 nt, Artificial Sequence
  Synthetic Oligonucleotide; REL exon 3; Set A
uuuccaacuaaaucaugaggaugagguuua

SEQ ID NO: 45403 - RNA, 29 nt, Artificial Sequence
  Synthetic Oligonucleotide; REL exon 3; Set C
uuuccaacuaaaucaugaggaugagguuu

SEQ ID NO: 45404 - RNA, 27 nt, Artificial Sequence
  Synthetic Oligonucleotide; REL exon 3; Set C
uuccaacuaaaucaugaggaugagguu

SEQ ID NO: 45405 - RNA, 25 nt, Artificial Sequence
  Synthetic Oligonucleotide; REL exon 3; Set C
uccaacuaaaucaugaggaugaggu

SEQ ID NO: 45406 - RNA, 31 nt, Artificial Sequence
  Synthetic Oligonucleotide; REL exon 3; Set A
uuuuccaacuaaaucaugaggaugagguuua

SEQ ID NO: 45407 - RNA, 30 nt, Artificial Sequence
  Synthetic Oligonucleotide; REL exon 3; Set A
uuuuccaacuaaaucaugaggaugagguuu

SEQ ID NO: 45408 - RNA, 28 nt, Artificial Sequence
  Synthetic Oligonucleotide; REL exon 3; Set C
uuuccaacuaaaucaugaggaugagguu

SEQ ID NO: 45409 - RNA, 26 nt, Artificial Sequence
  Synthetic Oligonucleotide; REL exon 3; Set C
uuccaacuaaaucaugaggaugaggu

SEQ ID NO: 45410 - RNA, 29 nt, Artificial Sequence
  Synthetic Oligonucleotide; REL exon 3; Set C
uuuuccaacuaaaucaugaggaugagguu

SEQ ID NO: 45411 - RNA, 27 nt, Artificial Sequence
  Synthetic Oligonucleotide; REL exon 3; Set C
uuuccaacuaaaucaugaggaugaggu

SEQ ID NO: 45412 - RNA, 28 nt, Artificial Sequence
  Synthetic Oligonucleotide; REL exon 3; Set C
uuuuccaacuaaaucaugaggaugaggu

SEQ ID NO: 45413 - RNA, 16 nt, Artificial Sequence
  Synthetic Oligonucleotide; REL exon 3; Set C
caacuaaaucaugagg

SEQ ID NO: 45414 - RNA, 17 nt, Artificial Sequence
  Synthetic Oligonucleotide; REL exon 3; Set C
ccaacuaaaucaugagg

SEQ ID NO: 45415 - RNA, 18 nt, Artificial Sequence
  Synthetic Oligonucleotide; REL exon 3; Set C
uccaacuaaaucaugagg

SEQ ID NO: 45416 - RNA, 16 nt, Artificial Sequence
  Synthetic Oligonucleotide; REL exon 3; Set C
ccaacuaaaucaugag

SEQ ID NO: 45417 - RNA, 19 nt, Artificial Sequence
  Synthetic Oligonucleotide; REL exon 3; Set C
uuccaacuaaaucaugagg

SEQ ID NO: 45418 - RNA, 17 nt, Artificial Sequence
  Synthetic Oligonucleotide; REL exon 3; Set C
uccaacuaaaucaugag

SEQ ID NO: 45419 - RNA, 18 nt, Artificial Sequence
  Synthetic Oligonucleotide; REL exon 3; Set C
uuccaacuaaaucaugag

SEQ ID NO: 45420 - RNA, 16 nt, Artificial Sequence
  Synthetic Oligonucleotide; REL exon 3; Set C
uccaacuaaaucauga

SEQ ID NO: 45421 - RNA, 19 nt, Artificial Sequence
  Synthetic Oligonucleotide; REL exon 3; Set C
uuuccaacuaaaucaugag

SEQ ID NO: 45422 - RNA, 17 nt, Artificial Sequence
  Synthetic Oligonucleotide; REL exon 3; Set C
uuccaacuaaaucauga

SEQ ID NO: 45423 - RNA, 40 nt, Artificial Sequence
  Synthetic Oligonucleotide; REL exon 3; Set C
cucugcagucuuuuccaacuaaaucaugaggaugagguuu

SEQ ID NO: 45424 - RNA, 18 nt, Artificial Sequence
  Synthetic Oligonucleotide; REL exon 3; Set C
uuuccaacuaaaucauga

SEQ ID NO: 45425 - RNA, 19 nt, Artificial Sequence
  Synthetic Oligonucleotide; REL exon 3; Set C
uuuuccaacuaaaucauga

SEQ ID NO: 45426 - RNA, 31 nt, Artificial Sequence
  Synthetic Oligonucleotide; REL exon 3; Set A
cucugcagucuuuuccaacuaaaucaugagg

SEQ ID NO: 45427 - RNA, 36 nt, Artificial Sequence
  Synthetic Oligonucleotide; REL exon 3; Set C
gccgucucugcagucuuuuccaacuaaaucaugagg

SEQ ID NO: 45428 - RNA, 35 nt, Artificial Sequence
  Synthetic Oligonucleotide; REL exon 3; Set C
gccgucucugcagucuuuuccaacuaaaucaugag

SEQ ID NO: 45429 - RNA, 34 nt, Artificial Sequence
  Synthetic Oligonucleotide; REL exon 3; Set C
gccgucucugcagucuuuuccaacuaaaucauga

SEQ ID NO: 45430 - RNA, 40 nt, Artificial Sequence
  Synthetic Oligonucleotide; REL exon 3; Set C
uaguagccgucucugcagucuuuuccaacuaaaucaugag

SEQ ID NO: 45431 - RNA, 39 nt, Artificial Sequence
  Synthetic Oligonucleotide; REL exon 3; Set C
uaguagccgucucugcagucuuuuccaacuaaaucauga

SEQ ID NO: 45432 - RNA, 40 nt, Artificial Sequence
  Synthetic Oligonucleotide; REL exon 3; Set C
auaguagccgucucugcagucuuuuccaacuaaaucauga

SEQ ID NO: 45433 - RNA, 16 nt, Artificial Sequence
  Synthetic Oligonucleotide; REL exon 3; Set C
cucugcagucuuuucc

SEQ ID NO: 45434 - RNA, 23 nt, Artificial Sequence
  Synthetic Oligonucleotide; REL exon 3; Set A
gccgucucugcagucuuuuccaa

SEQ ID NO: 45435 - RNA, 22 nt, Artificial Sequence
  Synthetic Oligonucleotide; REL exon 3; Set A
gccgucucugcagucuuuucca

SEQ ID NO: 45436 - RNA, 21 nt, Artificial Sequence
  Synthetic Oligonucleotide; REL exon 3; Set A
gccgucucugcagucuuuucc

SEQ ID NO: 45437 - RNA, 20 nt, Artificial Sequence
  Synthetic Oligonucleotide; REL exon 3; Set A
gccgucucugcagucuuuuc

SEQ ID NO: 45438 - RNA, 19 nt, Artificial Sequence
  Synthetic Oligonucleotide; REL exon 3; Set A
gccgucucugcagucuuuu

SEQ ID NO: 45439 - RNA, 18 nt, Artificial Sequence
  Synthetic Oligonucleotide; REL exon 3; Set A
gccgucucugcagucuuu

SEQ ID NO: 45440 - RNA, 28 nt, Artificial Sequence
  Synthetic Oligonucleotide; REL exon 3; Set A
uaguagccgucucugcagucuuuuccaa

SEQ ID NO: 45441 - RNA, 29 nt, Artificial Sequence
  Synthetic Oligonucleotide; REL exon 3; Set A
auaguagccgucucugcagucuuuuccaa

SEQ ID NO: 45442 - RNA, 27 nt, Artificial Sequence
  Synthetic Oligonucleotide; REL exon 3; Set C
uaguagccgucucugcagucuuuucca

SEQ ID NO: 45443 - RNA, 28 nt, Artificial Sequence
  Synthetic Oligonucleotide; REL exon 3; Set C
auaguagccgucucugcagucuuuucca

SEQ ID NO: 45444 - RNA, 30 nt, Artificial Sequence
  Synthetic Oligonucleotide; REL exon 3; Set C
cauaguagccgucucugcagucuuuuccaa

SEQ ID NO: 45445 - RNA, 25 nt, Artificial Sequence
  Synthetic Oligonucleotide; REL exon 3; Set A
uaguagccgucucugcagucuuuuc

SEQ ID NO: 45446 - RNA, 29 nt, Artificial Sequence
  Synthetic Oligonucleotide; REL exon 3; Set C
cauaguagccgucucugcagucuuuucca

SEQ ID NO: 45447 - RNA, 31 nt, Artificial Sequence
  Synthetic Oligonucleotide; REL exon 3; Set C
ucauaguagccgucucugcagucuuuuccaa

SEQ ID NO: 45448 - RNA, 24 nt, Artificial Sequence
  Synthetic Oligonucleotide; REL exon 3; Set A
uaguagccgucucugcagucuuuu

SEQ ID NO: 45449 - RNA, 28 nt, Artificial Sequence
  Synthetic Oligonucleotide; REL exon 3; Set C
cauaguagccgucucugcagucuuuucc

SEQ ID NO: 45450 - RNA, 30 nt, Artificial Sequence
  Synthetic Oligonucleotide; REL exon 3; Set C
ucauaguagccgucucugcagucuuuucca

SEQ ID NO: 45451 - RNA, 32 nt, Artificial Sequence
  Synthetic Oligonucleotide; REL exon 3; Set C
uucauaguagccgucucugcagucuuuuccaa

SEQ ID NO: 45452 - RNA, 23 nt, Artificial Sequence
  Synthetic Oligonucleotide; REL exon 3; Set A
uaguagccgucucugcagucuuu

SEQ ID NO: 45453 - RNA, 27 nt, Artificial Sequence
  Synthetic Oligonucleotide; REL exon 3; Set A
cauaguagccgucucugcagucuuuuc

SEQ ID NO: 45454 - RNA, 29 nt, Artificial Sequence
  Synthetic Oligonucleotide; REL exon 3; Set C
ucauaguagccgucucugcagucuuuucc

SEQ ID NO: 45455 - RNA, 31 nt, Artificial Sequence
  Synthetic Oligonucleotide; REL exon 3; Set C
uucauaguagccgucucugcagucuuuucca

SEQ ID NO: 45456 - RNA, 24 nt, Artificial Sequence
  Synthetic Oligonucleotide; REL exon 3; Set A
auaguagccgucucugcagucuuu

SEQ ID NO: 45457 - RNA, 26 nt, Artificial Sequence
  Synthetic Oligonucleotide; REL exon 3; Set A
cauaguagccgucucugcagucuuuu

SEQ ID NO: 45458 - RNA, 28 nt, Artificial Sequence
  Synthetic Oligonucleotide; REL exon 3; Set A
ucauaguagccgucucugcagucuuuuc

SEQ ID NO: 45459 - RNA, 30 nt, Artificial Sequence
  Synthetic Oligonucleotide; REL exon 3; Set C
uucauaguagccgucucugcagucuuuucc

SEQ ID NO: 45460 - RNA, 25 nt, Artificial Sequence
  Synthetic Oligonucleotide; REL exon 3; Set A
cauaguagccgucucugcagucuuu

SEQ ID NO: 45461 - RNA, 27 nt, Artificial Sequence
  Synthetic Oligonucleotide; REL exon 3; Set A
ucauaguagccgucucugcagucuuuu

SEQ ID NO: 45462 - RNA, 29 nt, Artificial Sequence
  Synthetic Oligonucleotide; REL exon 3; Set A
uucauaguagccgucucugcagucuuuuc

SEQ ID NO: 45463 - RNA, 26 nt, Artificial Sequence
  Synthetic Oligonucleotide; REL exon 3; Set A
ucauaguagccgucucugcagucuuu

SEQ ID NO: 45464 - RNA, 28 nt, Artificial Sequence
  Synthetic Oligonucleotide; REL exon 3; Set A
uucauaguagccgucucugcagucuuuu

SEQ ID NO: 45465 - RNA, 27 nt, Artificial Sequence
  Synthetic Oligonucleotide; REL exon 3; Set A
uucauaguagccgucucugcagucuuu

SEQ ID NO: 45466 - RNA, 15 nt, Artificial Sequence
  Synthetic Oligonucleotide; REL exon 3; Set C
ucauaguagccgucu

SEQ ID NO: 45467 - RNA, 18 nt, Artificial Sequence
  Synthetic Oligonucleotide; REL exon 3; Set C
cuucauaguagccgucuc

SEQ ID NO: 45468 - RNA, 19 nt, Artificial Sequence
  Synthetic Oligonucleotide; REL exon 3; Set C
gcuucauaguagccgucuc

SEQ ID NO: 45469 - RNA, 15 nt, Artificial Sequence
  Synthetic Oligonucleotide; REL exon 3; Set C
uacuuacaacaaagg

SEQ ID NO: 45470 - RNA, 16 nt, Artificial Sequence
  Synthetic Oligonucleotide; REL exon 3; Set C
guacuuacaacaaagg

SEQ ID NO: 45471 - RNA, 15 nt, Artificial Sequence
  Synthetic Oligonucleotide; REL exon 3; Set C
guacuuacaacaaag

SEQ ID NO: 45472 - RNA, 17 nt, Artificial Sequence
  Synthetic Oligonucleotide; REL exon 3; Set C
uguacuuacaacaaagg

SEQ ID NO: 45473 - RNA, 16 nt, Artificial Sequence
  Synthetic Oligonucleotide; REL exon 3; Set C
uguacuuacaacaaag

SEQ ID NO: 45474 - RNA, 18 nt, Artificial Sequence
  Synthetic Oligonucleotide; REL exon 3; Set C
guguacuuacaacaaagg

SEQ ID NO: 45475 - RNA, 17 nt, Artificial Sequence
  Synthetic Oligonucleotide; REL exon 3; Set C
guguacuuacaacaaag

SEQ ID NO: 45476 - RNA, 15 nt, Artificial Sequence
  Synthetic Oligonucleotide; REL exon 3; Set C
uguacuuacaacaaa

SEQ ID NO: 45477 - RNA, 19 nt, Artificial Sequence
  Synthetic Oligonucleotide; REL exon 3; Set C
uguguacuuacaacaaagg

SEQ ID NO: 45478 - RNA, 18 nt, Artificial Sequence
  Synthetic Oligonucleotide; REL exon 3; Set C
uguguacuuacaacaaag

SEQ ID NO: 45479 - RNA, 16 nt, Artificial Sequence
  Synthetic Oligonucleotide; REL exon 3; Set C
guguacuuacaacaaa

SEQ ID NO: 45480 - RNA, 20 nt, Artificial Sequence
  Synthetic Oligonucleotide; REL exon 3; Set C
cuguguacuuacaacaaagg

SEQ ID NO: 45481 - RNA, 19 nt, Artificial Sequence
  Synthetic Oligonucleotide; REL exon 3; Set C
cuguguacuuacaacaaag

SEQ ID NO: 45482 - RNA, 15 nt, Artificial Sequence
  Synthetic Oligonucleotide; REL exon 3; Set C
guguacuuacaacaa

SEQ ID NO: 45483 - RNA, 17 nt, Artificial Sequence
  Synthetic Oligonucleotide; REL exon 3; Set C
uguguacuuacaacaaa

SEQ ID NO: 45484 - RNA, 21 nt, Artificial Sequence
  Synthetic Oligonucleotide; REL exon 3; Set C
acuguguacuuacaacaaagg

SEQ ID NO: 45485 - RNA, 20 nt, Artificial Sequence
  Synthetic Oligonucleotide; REL exon 3; Set C
acuguguacuuacaacaaag

SEQ ID NO: 45486 - RNA, 18 nt, Artificial Sequence
  Synthetic Oligonucleotide; REL exon 3; Set C
cuguguacuuacaacaaa

SEQ ID NO: 45487 - RNA, 16 nt, Artificial Sequence
  Synthetic Oligonucleotide; REL exon 3; Set C
uguguacuuacaacaa

SEQ ID NO: 45488 - RNA, 17 nt, Artificial Sequence
  Synthetic Oligonucleotide; REL exon 3; Set C
cuguguacuuacaacaa

SEQ ID NO: 45489 - RNA, 19 nt, Artificial Sequence
  Synthetic Oligonucleotide; REL exon 3; Set C
acuguguacuuacaacaaa

SEQ ID NO: 45490 - RNA, 15 nt, Artificial Sequence
  Synthetic Oligonucleotide; REL exon 3; Set C
uguguacuuacaaca

SEQ ID NO: 45491 - RNA, 18 nt, Artificial Sequence
  Synthetic Oligonucleotide; REL exon 3; Set C
acuguguacuuacaacaa

SEQ ID NO: 45492 - RNA, 16 nt, Artificial Sequence
  Synthetic Oligonucleotide; REL exon 3; Set C
cuguguacuuacaaca

SEQ ID NO: 45493 - RNA, 17 nt, Artificial Sequence
  Synthetic Oligonucleotide; REL exon 3; Set C
acuguguacuuacaaca

SEQ ID NO: 45494 - RNA, 28 nt, Artificial Sequence
  Synthetic Oligonucleotide; REL exon 3; Set B
gucuguaacuguguacuuacaacaaagg

SEQ ID NO: 45495 - RNA, 27 nt, Artificial Sequence
  Synthetic Oligonucleotide; REL exon 3; Set C
gucuguaacuguguacuuacaacaaag

SEQ ID NO: 45496 - RNA, 15 nt, Artificial Sequence
  Synthetic Oligonucleotide; REL exon 3; Set C
ucuguaacuguguac

SEQ ID NO: 45497 - RNA, 16 nt, Artificial Sequence
  Synthetic Oligonucleotide; REL exon 3; Set C
gucuguaacuguguac

SEQ ID NO: 45498 - RNA, 15 nt, Artificial Sequence
  Synthetic Oligonucleotide; REL exon 3; Set C
gucuguaacugugua

SEQ ID NO: 45499 - RNA, 39 nt, Artificial Sequence
  Synthetic Oligonucleotide; REL exon 3; Set B
auuucugaagaugucuguaacuguguacuuacaacaaag

SEQ ID NO: 45500 - RNA, 27 nt, Artificial Sequence
  Synthetic Oligonucleotide; REL exon 3; Set C
uuucugaagaugucuguaacuguguac

SEQ ID NO: 45501 - RNA, 26 nt, Artificial Sequence
  Synthetic Oligonucleotide; REL exon 3; Set C
uuucugaagaugucuguaacugugua

SEQ ID NO: 45502 - RNA, 28 nt, Artificial Sequence
  Synthetic Oligonucleotide; REL exon 3; Set C
auuucugaagaugucuguaacuguguac

SEQ ID NO: 45503 - RNA, 27 nt, Artificial Sequence
  Synthetic Oligonucleotide; REL exon 3; Set C
auuucugaagaugucuguaacugugua

SEQ ID NO: 45504 - RNA, 26 nt, Artificial Sequence
  Synthetic Oligonucleotide; REL exon 3; Set C
auuucugaagaugucuguaacugugu

SEQ ID NO: 45505 - RNA, 25 nt, Artificial Sequence
  Synthetic Oligonucleotide; REL exon 3; Set C
auuucugaagaugucuguaacugug

SEQ ID NO: 45506 - RNA, 19 nt, Artificial Sequence
  Synthetic Oligonucleotide; REL exon 3; Set C
augucuuaucuuauuucug

SEQ ID NO: 45507 - RNA, 18 nt, Artificial Sequence
  Synthetic Oligonucleotide; REL exon 3; Set C
augucuuaucuuauuucu

SEQ ID NO: 45508 - RNA, 17 nt, Artificial Sequence
  Synthetic Oligonucleotide; REL exon 3; Set C
augucuuaucuuauuuc

SEQ ID NO: 45509 - RNA, 16 nt, Artificial Sequence
  Synthetic Oligonucleotide; REL exon 3; Set C
augucuuaucuuauuu

SEQ ID NO: 45510 - RNA, 18 nt, Artificial Sequence
  Synthetic Oligonucleotide; REL exon 3; Set C
aaauagacugcauuauaa

SEQ ID NO: 45511 - RNA, 29 nt, Artificial Sequence
  Synthetic Oligonucleotide; REL exon 3; Set C
auacaugauccaaauagacugcauuauaa

SEQ ID NO: 45512 - RNA, 28 nt, Artificial Sequence
  Synthetic Oligonucleotide; REL exon 3; Set C
auacaugauccaaauagacugcauuaua

SEQ ID NO: 45513 - RNA, 30 nt, Artificial Sequence
  Synthetic Oligonucleotide; REL exon 3; Set C
aauacaugauccaaauagacugcauuauaa

SEQ ID NO: 45514 - RNA, 29 nt, Artificial Sequence
  Synthetic Oligonucleotide; REL exon 3; Set C
aauacaugauccaaauagacugcauuaua

SEQ ID NO: 45515 - RNA, 27 nt, Artificial Sequence
  Synthetic Oligonucleotide; REL exon 3; Set C
auacaugauccaaauagacugcauuau

SEQ ID NO: 45516 - RNA, 31 nt, Artificial Sequence
  Synthetic Oligonucleotide; REL exon 3; Set C
aaauacaugauccaaauagacugcauuauaa

SEQ ID NO: 45517 - RNA, 26 nt, Artificial Sequence
  Synthetic Oligonucleotide; REL exon 3; Set C
auacaugauccaaauagacugcauua

SEQ ID NO: 45518 - RNA, 30 nt, Artificial Sequence
  Synthetic Oligonucleotide; REL exon 3; Set C
aaauacaugauccaaauagacugcauuaua

SEQ ID NO: 45519 - RNA, 28 nt, Artificial Sequence
  Synthetic Oligonucleotide; REL exon 3; Set C
aauacaugauccaaauagacugcauuau

SEQ ID NO: 45520 - RNA, 32 nt, Artificial Sequence
  Synthetic Oligonucleotide; REL exon 3; Set C
uaaauacaugauccaaauagacugcauuauaa

SEQ ID NO: 45521 - RNA, 27 nt, Artificial Sequence
  Synthetic Oligonucleotide; REL exon 3; Set C
aauacaugauccaaauagacugcauua

SEQ ID NO: 45522 - RNA, 31 nt, Artificial Sequence
  Synthetic Oligonucleotide; REL exon 3; Set C
uaaauacaugauccaaauagacugcauuaua

SEQ ID NO: 45523 - RNA, 29 nt, Artificial Sequence
  Synthetic Oligonucleotide; REL exon 3; Set C
aaauacaugauccaaauagacugcauuau

SEQ ID NO: 45524 - RNA, 33 nt, Artificial Sequence
  Synthetic Oligonucleotide; REL exon 3; Set C
uuaaauacaugauccaaauagacugcauuauaa

SEQ ID NO: 45525 - RNA, 28 nt, Artificial Sequence
  Synthetic Oligonucleotide; REL exon 3; Set C
aaauacaugauccaaauagacugcauua

SEQ ID NO: 45526 - RNA, 32 nt, Artificial Sequence
  Synthetic Oligonucleotide; REL exon 3; Set C
uuaaauacaugauccaaauagacugcauuaua

SEQ ID NO: 45527 - RNA, 30 nt, Artificial Sequence
  Synthetic Oligonucleotide; REL exon 3; Set C
uaaauacaugauccaaauagacugcauuau

SEQ ID NO: 45528 - RNA, 34 nt, Artificial Sequence
  Synthetic Oligonucleotide; REL exon 3; Set C
auuaaauacaugauccaaauagacugcauuauaa

SEQ ID NO: 45529 - RNA, 29 nt, Artificial Sequence
  Synthetic Oligonucleotide; REL exon 3; Set C
uaaauacaugauccaaauagacugcauua

SEQ ID NO: 45530 - RNA, 33 nt, Artificial Sequence
  Synthetic Oligonucleotide; REL exon 3; Set C
auuaaauacaugauccaaauagacugcauuaua

SEQ ID NO: 45531 - RNA, 31 nt, Artificial Sequence
  Synthetic Oligonucleotide; REL exon 3; Set C
uuaaauacaugauccaaauagacugcauuau

SEQ ID NO: 45532 - RNA, 35 nt, Artificial Sequence
  Synthetic Oligonucleotide; REL exon 3; Set C
aauuaaauacaugauccaaauagacugcauuauaa

SEQ ID NO: 45533 - RNA, 30 nt, Artificial Sequence
  Synthetic Oligonucleotide; REL exon 3; Set C
uuaaauacaugauccaaauagacugcauua

SEQ ID NO: 45534 - RNA, 34 nt, Artificial Sequence
  Synthetic Oligonucleotide; REL exon 3; Set C
aauuaaauacaugauccaaauagacugcauuaua

SEQ ID NO: 45535 - RNA, 32 nt, Artificial Sequence
  Synthetic Oligonucleotide; REL exon 3; Set C
auuaaauacaugauccaaauagacugcauuau

SEQ ID NO: 45536 - RNA, 36 nt, Artificial Sequence
  Synthetic Oligonucleotide; REL exon 3; Set C
aaauuaaauacaugauccaaauagacugcauuauaa

SEQ ID NO: 45537 - RNA, 31 nt, Artificial Sequence
  Synthetic Oligonucleotide; REL exon 3; Set C
auuaaauacaugauccaaauagacugcauua

SEQ ID NO: 45538 - RNA, 35 nt, Artificial Sequence
  Synthetic Oligonucleotide; REL exon 3; Set C
aaauuaaauacaugauccaaauagacugcauuaua

SEQ ID NO: 45539 - RNA, 33 nt, Artificial Sequence
  Synthetic Oligonucleotide; REL exon 3; Set C
aauuaaauacaugauccaaauagacugcauuau

SEQ ID NO: 45540 - RNA, 32 nt, Artificial Sequence
  Synthetic Oligonucleotide; REL exon 3; Set C
aauuaaauacaugauccaaauagacugcauua

SEQ ID NO: 45541 - RNA, 34 nt, Artificial Sequence
  Synthetic Oligonucleotide; REL exon 3; Set C
aaauuaaauacaugauccaaauagacugcauuau

SEQ ID NO: 45542 - RNA, 35 nt, Artificial Sequence
  Synthetic Oligonucleotide; REL exon 3; Set C
gaaauuaaauacaugauccaaauagacugcauuau

SEQ ID NO: 45543 - RNA, 36 nt, Artificial Sequence
  Synthetic Oligonucleotide; REL exon 3; Set C
ggaaauuaaauacaugauccaaauagacugcauuau

SEQ ID NO: 45544 - RNA, 15 nt, Artificial Sequence
  Synthetic Oligonucleotide; REL exon 3; Set C
uaaauacaugaucca

SEQ ID NO: 45545 - RNA, 39 nt, Artificial Sequence
  Synthetic Oligonucleotide; REL exon 3; Set C
auaaucugaaaaaagggggaaauuaaauacaugauccaa

SEQ ID NO: 45546 - RNA, 40 nt, Artificial Sequence
  Synthetic Oligonucleotide; REL exon 3; Set C
cauaaucugaaaaaagggggaaauuaaauacaugauccaa

SEQ ID NO: 45547 - RNA, 38 nt, Artificial Sequence
  Synthetic Oligonucleotide; REL exon 3; Set C
auaaucugaaaaaagggggaaauuaaauacaugaucca

SEQ ID NO: 45548 - RNA, 39 nt, Artificial Sequence
  Synthetic Oligonucleotide; REL exon 3; Set A
cauaaucugaaaaaagggggaaauuaaauacaugaucca

SEQ ID NO: 45549 - RNA, 40 nt, Artificial Sequence
  Synthetic Oligonucleotide; REL exon 3; Set A
ucauaaucugaaaaaagggggaaauuaaauacaugaucca

SEQ ID NO: 45550 - RNA, 22 nt, Artificial Sequence
  Synthetic Oligonucleotide; REL exon 3; Set C
auaaucugaaaaaagggggaaa

SEQ ID NO: 45551 - RNA, 23 nt, Artificial Sequence
  Synthetic Oligonucleotide; REL exon 3; Set C
cauaaucugaaaaaagggggaaa

SEQ ID NO: 45552 - RNA, 21 nt, Artificial Sequence
  Synthetic Oligonucleotide; REL exon 3; Set C
auaaucugaaaaaagggggaa

SEQ ID NO: 45553 - RNA, 22 nt, Artificial Sequence
  Synthetic Oligonucleotide; REL exon 3; Set C
cauaaucugaaaaaagggggaa

SEQ ID NO: 45554 - RNA, 20 nt, Artificial Sequence
  Synthetic Oligonucleotide; REL exon 3; Set C
auaaucugaaaaaaggggga

SEQ ID NO: 45555 - RNA, 23 nt, Artificial Sequence
  Synthetic Oligonucleotide; REL exon 3; Set C
ucauaaucugaaaaaagggggaa

SEQ ID NO: 45556 - RNA, 21 nt, Artificial Sequence
  Synthetic Oligonucleotide; REL exon 3; Set C
cauaaucugaaaaaaggggga

SEQ ID NO: 45557 - RNA, 19 nt, Artificial Sequence
  Synthetic Oligonucleotide; REL exon 3; Set C
auaaucugaaaaaaggggg

SEQ ID NO: 45558 - RNA, 22 nt, Artificial Sequence
  Synthetic Oligonucleotide; REL exon 3; Set C
ucauaaucugaaaaaaggggga

SEQ ID NO: 45559 - RNA, 20 nt, Artificial Sequence
  Synthetic Oligonucleotide; REL exon 3; Set C
cauaaucugaaaaaaggggg

SEQ ID NO: 45560 - RNA, 18 nt, Artificial Sequence
  Synthetic Oligonucleotide; REL exon 3; Set C
auaaucugaaaaaagggg

SEQ ID NO: 45561 - RNA, 23 nt, Artificial Sequence
  Synthetic Oligonucleotide; REL exon 3; Set C
uucauaaucugaaaaaaggggga

SEQ ID NO: 45562 - RNA, 21 nt, Artificial Sequence
  Synthetic Oligonucleotide; REL exon 3; Set C
ucauaaucugaaaaaaggggg

SEQ ID NO: 45563 - RNA, 19 nt, Artificial Sequence
  Synthetic Oligonucleotide; REL exon 3; Set C
cauaaucugaaaaaagggg

SEQ ID NO: 45564 - RNA, 22 nt, Artificial Sequence
  Synthetic Oligonucleotide; REL exon 3; Set C
uucauaaucugaaaaaaggggg

SEQ ID NO: 45565 - RNA, 20 nt, Artificial Sequence
  Synthetic Oligonucleotide; REL exon 3; Set C
ucauaaucugaaaaaagggg

SEQ ID NO: 45566 - RNA, 23 nt, Artificial Sequence
  Synthetic Oligonucleotide; REL exon 3; Set C
guucauaaucugaaaaaaggggg

SEQ ID NO: 45567 - RNA, 21 nt, Artificial Sequence
  Synthetic Oligonucleotide; REL exon 3; Set C
uucauaaucugaaaaaagggg

SEQ ID NO: 45568 - RNA, 22 nt, Artificial Sequence
  Synthetic Oligonucleotide; REL exon 3; Set C
guucauaaucugaaaaaagggg

SEQ ID NO: 45569 - RNA, 23 nt, Artificial Sequence
  Synthetic Oligonucleotide; REL exon 3; Set C
aguucauaaucugaaaaaagggg

SEQ ID NO: 45570 - RNA, 40 nt, Artificial Sequence
  Synthetic Oligonucleotide; REL exon 3; Set A
uuuccuuuuccauaauaguucauaaucugaaaaaaggggg

SEQ ID NO: 45571 - RNA, 39 nt, Artificial Sequence
  Synthetic Oligonucleotide; REL exon 3; Set A
uuuccuuuuccauaauaguucauaaucugaaaaaagggg

SEQ ID NO: 45572 - RNA, 40 nt, Artificial Sequence
  Synthetic Oligonucleotide; REL exon 3; Set A
uuuuccuuuuccauaauaguucauaaucugaaaaaagggg

SEQ ID NO: 45573 - RNA, 24 nt, Artificial Sequence
  Synthetic Oligonucleotide; REL exon 3; Set C
uuuccuuuuccauaauaguucaua

SEQ ID NO: 45574 - RNA, 23 nt, Artificial Sequence
  Synthetic Oligonucleotide; REL exon 3; Set C
uuuccuuuuccauaauaguucau

SEQ ID NO: 45575 - RNA, 25 nt, Artificial Sequence
  Synthetic Oligonucleotide; REL exon 3; Set C
uuuuccuuuuccauaauaguucaua

SEQ ID NO: 45576 - RNA, 22 nt, Artificial Sequence
  Synthetic Oligonucleotide; REL exon 3; Set C
uuuccuuuuccauaauaguuca

SEQ ID NO: 45577 - RNA, 24 nt, Artificial Sequence
  Synthetic Oligonucleotide; REL exon 3; Set C
uuuuccuuuuccauaauaguucau

SEQ ID NO: 45578 - RNA, 21 nt, Artificial Sequence
  Synthetic Oligonucleotide; REL exon 3; Set C
uuuccuuuuccauaauaguuc

SEQ ID NO: 45579 - RNA, 23 nt, Artificial Sequence
  Synthetic Oligonucleotide; REL exon 3; Set C
uuuuccuuuuccauaauaguuca

SEQ ID NO: 45580 - RNA, 22 nt, Artificial Sequence
  Synthetic Oligonucleotide; REL exon 3; Set C
uuuuccuuuuccauaauaguuc

SEQ ID NO: 45581 - RNA, 39 nt, Artificial Sequence
  Synthetic Oligonucleotide; REL exon 3; Set A
aauguaauucucacuuuuccuuuuccauaauaguucaua

SEQ ID NO: 45582 - RNA, 40 nt, Artificial Sequence
  Synthetic Oligonucleotide; REL exon 3; Set A
uaauguaauucucacuuuuccuuuuccauaauaguucaua

SEQ ID NO: 45583 - RNA, 38 nt, Artificial Sequence
  Synthetic Oligonucleotide; REL exon 3; Set A
aauguaauucucacuuuuccuuuuccauaauaguucau

SEQ ID NO: 45584 - RNA, 39 nt, Artificial Sequence
  Synthetic Oligonucleotide; REL exon 3; Set A
uaauguaauucucacuuuuccuuuuccauaauaguucau

SEQ ID NO: 45585 - RNA, 37 nt, Artificial Sequence
  Synthetic Oligonucleotide; REL exon 3; Set A
aauguaauucucacuuuuccuuuuccauaauaguuca

SEQ ID NO: 45586 - RNA, 36 nt, Artificial Sequence
  Synthetic Oligonucleotide; REL exon 3; Set A
aauguaauucucacuuuuccuuuuccauaauaguuc

SEQ ID NO: 45587 - RNA, 38 nt, Artificial Sequence
  Synthetic Oligonucleotide; REL exon 3; Set A
uaauguaauucucacuuuuccuuuuccauaauaguuca

SEQ ID NO: 45588 - RNA, 37 nt, Artificial Sequence
  Synthetic Oligonucleotide; REL exon 3; Set A
uaauguaauucucacuuuuccuuuuccauaauaguuc

SEQ ID NO: 45589 - RNA, 36 nt, Artificial Sequence
  Synthetic Oligonucleotide; REL exon 3; Set A
uaauguaauucucacuuuuccuuuuccauaauaguu

SEQ ID NO: 45590 - RNA, 18 nt, Artificial Sequence
  Synthetic Oligonucleotide; REL exon 3; Set C
aauguaauucucacuuuu

SEQ ID NO: 45591 - RNA, 19 nt, Artificial Sequence
  Synthetic Oligonucleotide; REL exon 3; Set C
uaauguaauucucacuuuu

SEQ ID NO: 45592 - RNA, 17 nt, Artificial Sequence
  Synthetic Oligonucleotide; REL exon 3; Set C
aauguaauucucacuuu

SEQ ID NO: 45593 - RNA, 18 nt, Artificial Sequence
  Synthetic Oligonucleotide; REL exon 3; Set C
uaauguaauucucacuuu

SEQ ID NO: 45594 - RNA, 26 nt, Artificial Sequence
  Synthetic Oligonucleotide; REL exon 3; Set C
uuguuacuaauguaauucucacuuuu

SEQ ID NO: 45595 - RNA, 27 nt, Artificial Sequence
  Synthetic Oligonucleotide; REL exon 3; Set C
uuuguuacuaauguaauucucacuuuu

SEQ ID NO: 45596 - RNA, 25 nt, Artificial Sequence
  Synthetic Oligonucleotide; REL exon 3; Set C
uuguuacuaauguaauucucacuuu

SEQ ID NO: 45597 - RNA, 28 nt, Artificial Sequence
  Synthetic Oligonucleotide; REL exon 3; Set C
cuuuguuacuaauguaauucucacuuuu

SEQ ID NO: 45598 - RNA, 26 nt, Artificial Sequence
  Synthetic Oligonucleotide; REL exon 3; Set C
uuuguuacuaauguaauucucacuuu

SEQ ID NO: 45599 - RNA, 27 nt, Artificial Sequence
  Synthetic Oligonucleotide; REL exon 3; Set C
cuuuguuacuaauguaauucucacuuu

SEQ ID NO: 45600 - RNA, 28 nt, Artificial Sequence
  Synthetic Oligonucleotide; REL exon 3; Set C
ucuuuguuacuaauguaauucucacuuu

SEQ ID NO: 45601 - RNA, 35 nt, Artificial Sequence
  Synthetic Oligonucleotide; REL exon 3; Set A
ggucauucuuuguuacuaauguaauucucacuuuu

SEQ ID NO: 45602 - RNA, 36 nt, Artificial Sequence
  Synthetic Oligonucleotide; REL exon 3; Set A
gggucauucuuuguuacuaauguaauucucacuuuu

SEQ ID NO: 45603 - RNA, 34 nt, Artificial Sequence
  Synthetic Oligonucleotide; REL exon 3; Set A
ggucauucuuuguuacuaauguaauucucacuuu

SEQ ID NO: 45604 - RNA, 37 nt, Artificial Sequence
  Synthetic Oligonucleotide; REL exon 3; Set A
ugggucauucuuuguuacuaauguaauucucacuuuu

SEQ ID NO: 45605 - RNA, 35 nt, Artificial Sequence
  Synthetic Oligonucleotide; REL exon 3; Set A
gggucauucuuuguuacuaauguaauucucacuuu

SEQ ID NO: 45606 - RNA, 38 nt, Artificial Sequence
  Synthetic Oligonucleotide; REL exon 3; Set A
augggucauucuuuguuacuaauguaauucucacuuuu

SEQ ID NO: 45607 - RNA, 36 nt, Artificial Sequence
  Synthetic Oligonucleotide; REL exon 3; Set A
ugggucauucuuuguuacuaauguaauucucacuuu

SEQ ID NO: 45608 - RNA, 39 nt, Artificial Sequence
  Synthetic Oligonucleotide; REL exon 3; Set A
uaugggucauucuuuguuacuaauguaauucucacuuuu

SEQ ID NO: 45609 - RNA, 37 nt, Artificial Sequence
  Synthetic Oligonucleotide; REL exon 3; Set A
augggucauucuuuguuacuaauguaauucucacuuu

SEQ ID NO: 45610 - RNA, 38 nt, Artificial Sequence
  Synthetic Oligonucleotide; REL exon 3; Set A
uaugggucauucuuuguuacuaauguaauucucacuuu

SEQ ID NO: 45611 - RNA, 22 nt, Artificial Sequence
  Synthetic Oligonucleotide; REL exon 3; Set C
augaggaugagguuuauauggg

SEQ ID NO: 45612 - RNA, 21 nt, Artificial Sequence
  Synthetic Oligonucleotide; REL exon 3; Set C
augaggaugagguuuauaugg

SEQ ID NO: 45613 - RNA, 20 nt, Artificial Sequence
  Synthetic Oligonucleotide; REL exon 3; Set C
augaggaugagguuuauaug

SEQ ID NO: 45614 - RNA, 19 nt, Artificial Sequence
  Synthetic Oligonucleotide; REL exon 3; Set C
augaggaugagguuuauau

SEQ ID NO: 45615 - RNA, 32 nt, Artificial Sequence
  Synthetic Oligonucleotide; REL exon 3; Set A
caacuaaaucaugaggaugagguuuauauggg

SEQ ID NO: 45616 - RNA, 31 nt, Artificial Sequence
  Synthetic Oligonucleotide; REL exon 3; Set C
caacuaaaucaugaggaugagguuuauaugg

SEQ ID NO: 45617 - RNA, 33 nt, Artificial Sequence
  Synthetic Oligonucleotide; REL exon 3; Set A
ccaacuaaaucaugaggaugagguuuauauggg

SEQ ID NO: 45618 - RNA, 30 nt, Artificial Sequence
  Synthetic Oligonucleotide; REL exon 3; Set C
caacuaaaucaugaggaugagguuuauaug

SEQ ID NO: 45619 - RNA, 32 nt, Artificial Sequence
  Synthetic Oligonucleotide; REL exon 3; Set A
ccaacuaaaucaugaggaugagguuuauaugg

SEQ ID NO: 45620 - RNA, 29 nt, Artificial Sequence
  Synthetic Oligonucleotide; REL exon 3; Set C
caacuaaaucaugaggaugagguuuauau

SEQ ID NO: 45621 - RNA, 31 nt, Artificial Sequence
  Synthetic Oligonucleotide; REL exon 3; Set C
ccaacuaaaucaugaggaugagguuuauaug

SEQ ID NO: 45622 - RNA, 30 nt, Artificial Sequence
  Synthetic Oligonucleotide; REL exon 3; Set C
ccaacuaaaucaugaggaugagguuuauau

SEQ ID NO: 45623 - RNA, 26 nt, Artificial Sequence
  Synthetic Oligonucleotide; REL exon 3; Set C
caacuaaaucaugaggaugagguuua

SEQ ID NO: 45624 - RNA, 25 nt, Artificial Sequence
  Synthetic Oligonucleotide; REL exon 3; Set C
caacuaaaucaugaggaugagguuu

SEQ ID NO: 45625 - RNA, 26 nt, Artificial Sequence
  Synthetic Oligonucleotide; REL exon 3; Set C
ccaacuaaaucaugaggaugagguuu

SEQ ID NO: 45626 - RNA, 24 nt, Artificial Sequence
  Synthetic Oligonucleotide; REL exon 3; Set C
caacuaaaucaugaggaugagguu

SEQ ID NO: 45627 - RNA, 25 nt, Artificial Sequence
  Synthetic Oligonucleotide; REL exon 3; Set C
ccaacuaaaucaugaggaugagguu

SEQ ID NO: 45628 - RNA, 23 nt, Artificial Sequence
  Synthetic Oligonucleotide; REL exon 3; Set C
caacuaaaucaugaggaugaggu

SEQ ID NO: 45629 - RNA, 24 nt, Artificial Sequence
  Synthetic Oligonucleotide; REL exon 3; Set C
ccaacuaaaucaugaggaugaggu

SEQ ID NO: 45630 - RNA, 15 nt, Artificial Sequence
  Synthetic Oligonucleotide; REL exon 3; Set C
caacuaaaucaugag

SEQ ID NO: 45631 - RNA, 15 nt, Artificial Sequence
  Synthetic Oligonucleotide; REL exon 3; Set C
ccaacuaaaucauga

SEQ ID NO: 45632 - RNA, 15 nt, Artificial Sequence
  Synthetic Oligonucleotide; REL exon 3; Set C
uccaacuaaaucaug

SEQ ID NO: 45633 - RNA, 16 nt, Artificial Sequence
  Synthetic Oligonucleotide; REL exon 3; Set C
uuccaacuaaaucaug

SEQ ID NO: 45634 - RNA, 39 nt, Artificial Sequence
  Synthetic Oligonucleotide; REL exon 3; Set C
cucugcagucuuuuccaacuaaaucaugaggaugagguu

SEQ ID NO: 45635 - RNA, 17 nt, Artificial Sequence
  Synthetic Oligonucleotide; REL exon 3; Set C
uuuccaacuaaaucaug

SEQ ID NO: 45636 - RNA, 38 nt, Artificial Sequence
  Synthetic Oligonucleotide; REL exon 3; Set C
cucugcagucuuuuccaacuaaaucaugaggaugaggu

SEQ ID NO: 45637 - RNA, 18 nt, Artificial Sequence
  Synthetic Oligonucleotide; REL exon 3; Set C
uuuuccaacuaaaucaug

SEQ ID NO: 45638 - RNA, 30 nt, Artificial Sequence
  Synthetic Oligonucleotide; REL exon 3; Set A
cucugcagucuuuuccaacuaaaucaugag

SEQ ID NO: 45639 - RNA, 29 nt, Artificial Sequence
  Synthetic Oligonucleotide; REL exon 3; Set A
cucugcagucuuuuccaacuaaaucauga

SEQ ID NO: 45640 - RNA, 33 nt, Artificial Sequence
  Synthetic Oligonucleotide; REL exon 3; Set C
gccgucucugcagucuuuuccaacuaaaucaug

SEQ ID NO: 45641 - RNA, 40 nt, Artificial Sequence
  Synthetic Oligonucleotide; REL exon 3; Set C
aguagccgucucugcagucuuuuccaacuaaaucaugagg

SEQ ID NO: 45642 - RNA, 39 nt, Artificial Sequence
  Synthetic Oligonucleotide; REL exon 3; Set C
aguagccgucucugcagucuuuuccaacuaaaucaugag

SEQ ID NO: 45643 - RNA, 18 nt, Artificial Sequence
  Synthetic Oligonucleotide; REL exon 3; Set C
cucugcagucuuuuccaa

SEQ ID NO: 45644 - RNA, 38 nt, Artificial Sequence
  Synthetic Oligonucleotide; REL exon 3; Set C
uaguagccgucucugcagucuuuuccaacuaaaucaug

SEQ ID NO: 45645 - RNA, 17 nt, Artificial Sequence
  Synthetic Oligonucleotide; REL exon 3; Set C
cucugcagucuuuucca

SEQ ID NO: 45646 - RNA, 39 nt, Artificial Sequence
  Synthetic Oligonucleotide; REL exon 3; Set C
auaguagccgucucugcagucuuuuccaacuaaaucaug

SEQ ID NO: 45647 - RNA, 40 nt, Artificial Sequence
  Synthetic Oligonucleotide; REL exon 3; Set C
cauaguagccgucucugcagucuuuuccaacuaaaucaug

SEQ ID NO: 45648 - RNA, 15 nt, Artificial Sequence
  Synthetic Oligonucleotide; REL exon 3; Set C
cucugcagucuuuuc

SEQ ID NO: 45649 - RNA, 20 nt, Artificial Sequence
  Synthetic Oligonucleotide; REL exon 3; Set A
ccgucucugcagucuuuucc

SEQ ID NO: 45650 - RNA, 27 nt, Artificial Sequence
  Synthetic Oligonucleotide; REL exon 3; Set A
aguagccgucucugcagucuuuuccaa

SEQ ID NO: 45651 - RNA, 25 nt, Artificial Sequence
  Synthetic Oligonucleotide; REL exon 3; Set A
aguagccgucucugcagucuuuucc

SEQ ID NO: 45652 - RNA, 24 nt, Artificial Sequence
  Synthetic Oligonucleotide; REL exon 3; Set A
aguagccgucucugcagucuuuuc

SEQ ID NO: 45653 - RNA, 23 nt, Artificial Sequence
  Synthetic Oligonucleotide; REL exon 3; Set A
aguagccgucucugcagucuuuu

SEQ ID NO: 45654 - RNA, 22 nt, Artificial Sequence
  Synthetic Oligonucleotide; REL exon 3; Set A
aguagccgucucugcagucuuu

SEQ ID NO: 45655 - RNA, 33 nt, Artificial Sequence
  Synthetic Oligonucleotide; REL exon 3; Set C
cuucauaguagccgucucugcagucuuuuccaa

SEQ ID NO: 45656 - RNA, 34 nt, Artificial Sequence
  Synthetic Oligonucleotide; REL exon 3; Set C
gcuucauaguagccgucucugcagucuuuuccaa

SEQ ID NO: 45657 - RNA, 31 nt, Artificial Sequence
  Synthetic Oligonucleotide; REL exon 3; Set C
cuucauaguagccgucucugcagucuuuucc

SEQ ID NO: 45658 - RNA, 33 nt, Artificial Sequence
  Synthetic Oligonucleotide; REL exon 3; Set C
gcuucauaguagccgucucugcagucuuuucca

SEQ ID NO: 45659 - RNA, 30 nt, Artificial Sequence
  Synthetic Oligonucleotide; REL exon 3; Set A
cuucauaguagccgucucugcagucuuuuc

SEQ ID NO: 45660 - RNA, 32 nt, Artificial Sequence
  Synthetic Oligonucleotide; REL exon 3; Set C
gcuucauaguagccgucucugcagucuuuucc

SEQ ID NO: 45661 - RNA, 29 nt, Artificial Sequence
  Synthetic Oligonucleotide; REL exon 3; Set A
cuucauaguagccgucucugcagucuuuu

SEQ ID NO: 45662 - RNA, 31 nt, Artificial Sequence
  Synthetic Oligonucleotide; REL exon 3; Set C
gcuucauaguagccgucucugcagucuuuuc

SEQ ID NO: 45663 - RNA, 30 nt, Artificial Sequence
  Synthetic Oligonucleotide; REL exon 3; Set C
gcuucauaguagccgucucugcagucuuuu

SEQ ID NO: 45664 - RNA, 28 nt, Artificial Sequence
  Synthetic Oligonucleotide; REL exon 3; Set A
cuucauaguagccgucucugcagucuuu

SEQ ID NO: 45665 - RNA, 29 nt, Artificial Sequence
  Synthetic Oligonucleotide; REL exon 3; Set C
gcuucauaguagccgucucugcagucuuu

SEQ ID NO: 45666 - RNA, 16 nt, Artificial Sequence
  Synthetic Oligonucleotide; REL exon 3; Set C
uucauaguagccgucu

SEQ ID NO: 45667 - RNA, 15 nt, Artificial Sequence
  Synthetic Oligonucleotide; REL exon 3; Set C
uucauaguagccguc

SEQ ID NO: 45668 - RNA, 15 nt, Artificial Sequence
  Synthetic Oligonucleotide; REL exon 3; Set C
gcuucauaguagccg

SEQ ID NO: 45669 - RNA, 39 nt, Artificial Sequence
  Synthetic Oligonucleotide; REL exon 3; Set C
aggucugcguucuuguccaaauucugcuucauaguagcc

SEQ ID NO: 45670 - RNA, 40 nt, Artificial Sequence
  Synthetic Oligonucleotide; REL exon 3; Set C
aaggucugcguucuuguccaaauucugcuucauaguagcc

SEQ ID NO: 45671 - RNA, 34 nt, Artificial Sequence
  Synthetic Oligonucleotide; REL exon 3; Set C
aggucugcguucuuguccaaauucugcuucauag

SEQ ID NO: 45672 - RNA, 33 nt, Artificial Sequence
  Synthetic Oligonucleotide; REL exon 3; Set C
aggucugcguucuuguccaaauucugcuucaua

SEQ ID NO: 45673 - RNA, 35 nt, Artificial Sequence
  Synthetic Oligonucleotide; REL exon 3; Set A
aaggucugcguucuuguccaaauucugcuucauag

SEQ ID NO: 45674 - RNA, 34 nt, Artificial Sequence
  Synthetic Oligonucleotide; REL exon 3; Set C
aaggucugcguucuuguccaaauucugcuucaua

SEQ ID NO: 45675 - RNA, 36 nt, Artificial Sequence
  Synthetic Oligonucleotide; REL exon 3; Set A
aaaggucugcguucuuguccaaauucugcuucauag

SEQ ID NO: 45676 - RNA, 32 nt, Artificial Sequence
  Synthetic Oligonucleotide; REL exon 3; Set C
aggucugcguucuuguccaaauucugcuucau

SEQ ID NO: 45677 - RNA, 35 nt, Artificial Sequence
  Synthetic Oligonucleotide; REL exon 3; Set A
aaaggucugcguucuuguccaaauucugcuucaua

SEQ ID NO: 45678 - RNA, 37 nt, Artificial Sequence
  Synthetic Oligonucleotide; REL exon 3; Set A
caaaggucugcguucuuguccaaauucugcuucauag

SEQ ID NO: 45679 - RNA, 33 nt, Artificial Sequence
  Synthetic Oligonucleotide; REL exon 3; Set A
aaggucugcguucuuguccaaauucugcuucau

SEQ ID NO: 45680 - RNA, 36 nt, Artificial Sequence
  Synthetic Oligonucleotide; REL exon 3; Set C
caaaggucugcguucuuguccaaauucugcuucaua

SEQ ID NO: 45681 - RNA, 38 nt, Artificial Sequence
  Synthetic Oligonucleotide; REL exon 3; Set C
acaaaggucugcguucuuguccaaauucugcuucauag

SEQ ID NO: 45682 - RNA, 34 nt, Artificial Sequence
  Synthetic Oligonucleotide; REL exon 3; Set A
aaaggucugcguucuuguccaaauucugcuucau

SEQ ID NO: 45683 - RNA, 32 nt, Artificial Sequence
  Synthetic Oligonucleotide; REL exon 3; Set C
aaggucugcguucuuguccaaauucugcuuca

SEQ ID NO: 45684 - RNA, 37 nt, Artificial Sequence
  Synthetic Oligonucleotide; REL exon 3; Set C
acaaaggucugcguucuuguccaaauucugcuucaua

SEQ ID NO: 45685 - RNA, 35 nt, Artificial Sequence
  Synthetic Oligonucleotide; REL exon 3; Set C
caaaggucugcguucuuguccaaauucugcuucau

SEQ ID NO: 45686 - RNA, 33 nt, Artificial Sequence
  Synthetic Oligonucleotide; REL exon 3; Set A
aaaggucugcguucuuguccaaauucugcuuca

SEQ ID NO: 45687 - RNA, 36 nt, Artificial Sequence
  Synthetic Oligonucleotide; REL exon 3; Set C
acaaaggucugcguucuuguccaaauucugcuucau

SEQ ID NO: 45688 - RNA, 34 nt, Artificial Sequence
  Synthetic Oligonucleotide; REL exon 3; Set C
caaaggucugcguucuuguccaaauucugcuuca

SEQ ID NO: 45689 - RNA, 35 nt, Artificial Sequence
  Synthetic Oligonucleotide; REL exon 3; Set C
acaaaggucugcguucuuguccaaauucugcuuca

SEQ ID NO: 45690 - RNA, 21 nt, Artificial Sequence
  Synthetic Oligonucleotide; REL exon 3; Set C
cuguguacuuacaacaaaggu

SEQ ID NO: 45691 - RNA, 22 nt, Artificial Sequence
  Synthetic Oligonucleotide; REL exon 3; Set C
acuguguacuuacaacaaaggu

SEQ ID NO: 45692 - RNA, 27 nt, Artificial Sequence
  Synthetic Oligonucleotide; REL exon 3; Set C
ucuguaacuguguacuuacaacaaagg

SEQ ID NO: 45693 - RNA, 26 nt, Artificial Sequence
  Synthetic Oligonucleotide; REL exon 3; Set C
ucuguaacuguguacuuacaacaaag

SEQ ID NO: 45694 - RNA, 25 nt, Artificial Sequence
  Synthetic Oligonucleotide; REL exon 3; Set C
ucuguaacuguguacuuacaacaaa

SEQ ID NO: 45695 - RNA, 26 nt, Artificial Sequence
  Synthetic Oligonucleotide; REL exon 3; Set C
gucuguaacuguguacuuacaacaaa

SEQ ID NO: 45696 - RNA, 24 nt, Artificial Sequence
  Synthetic Oligonucleotide; REL exon 3; Set C
ucuguaacuguguacuuacaacaa

SEQ ID NO: 45697 - RNA, 25 nt, Artificial Sequence
  Synthetic Oligonucleotide; REL exon 3; Set C
gucuguaacuguguacuuacaacaa

SEQ ID NO: 45698 - RNA, 23 nt, Artificial Sequence
  Synthetic Oligonucleotide; REL exon 3; Set C
ucuguaacuguguacuuacaaca

SEQ ID NO: 45699 - RNA, 24 nt, Artificial Sequence
  Synthetic Oligonucleotide; REL exon 3; Set C
gucuguaacuguguacuuacaaca

SEQ ID NO: 45700 - RNA, 36 nt, Artificial Sequence
  Synthetic Oligonucleotide; REL exon 3; Set B
cugaagaugucuguaacuguguacuuacaacaaagg

SEQ ID NO: 45701 - RNA, 35 nt, Artificial Sequence
  Synthetic Oligonucleotide; REL exon 3; Set B
cugaagaugucuguaacuguguacuuacaacaaag

SEQ ID NO: 45702 - RNA, 37 nt, Artificial Sequence
  Synthetic Oligonucleotide; REL exon 3; Set B
ucugaagaugucuguaacuguguacuuacaacaaagg

SEQ ID NO: 45703 - RNA, 36 nt, Artificial Sequence
  Synthetic Oligonucleotide; REL exon 3; Set B
ucugaagaugucuguaacuguguacuuacaacaaag

SEQ ID NO: 45704 - RNA, 34 nt, Artificial Sequence
  Synthetic Oligonucleotide; REL exon 3; Set B
cugaagaugucuguaacuguguacuuacaacaaa

SEQ ID NO: 45705 - RNA, 38 nt, Artificial Sequence
  Synthetic Oligonucleotide; REL exon 3; Set B
uucugaagaugucuguaacuguguacuuacaacaaagg

SEQ ID NO: 45706 - RNA, 37 nt, Artificial Sequence
  Synthetic Oligonucleotide; REL exon 3; Set B
uucugaagaugucuguaacuguguacuuacaacaaag

SEQ ID NO: 45707 - RNA, 35 nt, Artificial Sequence
  Synthetic Oligonucleotide; REL exon 3; Set B
ucugaagaugucuguaacuguguacuuacaacaaa

SEQ ID NO: 45708 - RNA, 33 nt, Artificial Sequence
  Synthetic Oligonucleotide; REL exon 3; Set B
cugaagaugucuguaacuguguacuuacaacaa

SEQ ID NO: 45709 - RNA, 39 nt, Artificial Sequence
  Synthetic Oligonucleotide; REL exon 3; Set B
uuucugaagaugucuguaacuguguacuuacaacaaagg

SEQ ID NO: 45710 - RNA, 38 nt, Artificial Sequence
  Synthetic Oligonucleotide; REL exon 3; Set B
uuucugaagaugucuguaacuguguacuuacaacaaag

SEQ ID NO: 45711 - RNA, 36 nt, Artificial Sequence
  Synthetic Oligonucleotide; REL exon 3; Set B
uucugaagaugucuguaacuguguacuuacaacaaa

SEQ ID NO: 45712 - RNA, 34 nt, Artificial Sequence
  Synthetic Oligonucleotide; REL exon 3; Set B
ucugaagaugucuguaacuguguacuuacaacaa

SEQ ID NO: 45713 - RNA, 40 nt, Artificial Sequence
  Synthetic Oligonucleotide; REL exon 3; Set B
auuucugaagaugucuguaacuguguacuuacaacaaagg

SEQ ID NO: 45714 - RNA, 32 nt, Artificial Sequence
  Synthetic Oligonucleotide; REL exon 3; Set B
cugaagaugucuguaacuguguacuuacaaca

SEQ ID NO: 45715 - RNA, 37 nt, Artificial Sequence
  Synthetic Oligonucleotide; REL exon 3; Set B
uuucugaagaugucuguaacuguguacuuacaacaaa

SEQ ID NO: 45716 - RNA, 35 nt, Artificial Sequence
  Synthetic Oligonucleotide; REL exon 3; Set B
uucugaagaugucuguaacuguguacuuacaacaa

SEQ ID NO: 45717 - RNA, 33 nt, Artificial Sequence
  Synthetic Oligonucleotide; REL exon 3; Set B
ucugaagaugucuguaacuguguacuuacaaca

SEQ ID NO: 45718 - RNA, 38 nt, Artificial Sequence
  Synthetic Oligonucleotide; REL exon 3; Set B
auuucugaagaugucuguaacuguguacuuacaacaaa

SEQ ID NO: 45719 - RNA, 36 nt, Artificial Sequence
  Synthetic Oligonucleotide; REL exon 3; Set B
uuucugaagaugucuguaacuguguacuuacaacaa

SEQ ID NO: 45720 - RNA, 34 nt, Artificial Sequence
  Synthetic Oligonucleotide; REL exon 3; Set B
uucugaagaugucuguaacuguguacuuacaaca

SEQ ID NO: 45721 - RNA, 37 nt, Artificial Sequence
  Synthetic Oligonucleotide; REL exon 3; Set B
auuucugaagaugucuguaacuguguacuuacaacaa

SEQ ID NO: 45722 - RNA, 35 nt, Artificial Sequence
  Synthetic Oligonucleotide; REL exon 3; Set B
uuucugaagaugucuguaacuguguacuuacaaca

SEQ ID NO: 45723 - RNA, 36 nt, Artificial Sequence
  Synthetic Oligonucleotide; REL exon 3; Set B
auuucugaagaugucuguaacuguguacuuacaaca

SEQ ID NO: 45724 - RNA, 24 nt, Artificial Sequence
  Synthetic Oligonucleotide; REL exon 3; Set C
cugaagaugucuguaacuguguac

SEQ ID NO: 45725 - RNA, 23 nt, Artificial Sequence
  Synthetic Oligonucleotide; REL exon 3; Set C
cugaagaugucuguaacugugua

SEQ ID NO: 45726 - RNA, 25 nt, Artificial Sequence
  Synthetic Oligonucleotide; REL exon 3; Set C
ucugaagaugucuguaacuguguac

SEQ ID NO: 45727 - RNA, 22 nt, Artificial Sequence
  Synthetic Oligonucleotide; REL exon 3; Set C
cugaagaugucuguaacugugu

SEQ ID NO: 45728 - RNA, 24 nt, Artificial Sequence
  Synthetic Oligonucleotide; REL exon 3; Set C
ucugaagaugucuguaacugugua

SEQ ID NO: 45729 - RNA, 26 nt, Artificial Sequence
  Synthetic Oligonucleotide; REL exon 3; Set C
uucugaagaugucuguaacuguguac

SEQ ID NO: 45730 - RNA, 23 nt, Artificial Sequence
  Synthetic Oligonucleotide; REL exon 3; Set C
ucugaagaugucuguaacugugu

SEQ ID NO: 45731 - RNA, 21 nt, Artificial Sequence
  Synthetic Oligonucleotide; REL exon 3; Set C
cugaagaugucuguaacugug

SEQ ID NO: 45732 - RNA, 25 nt, Artificial Sequence
  Synthetic Oligonucleotide; REL exon 3; Set C
uucugaagaugucuguaacugugua

SEQ ID NO: 45733 - RNA, 24 nt, Artificial Sequence
  Synthetic Oligonucleotide; REL exon 3; Set C
uucugaagaugucuguaacugugu

SEQ ID NO: 45734 - RNA, 22 nt, Artificial Sequence
  Synthetic Oligonucleotide; REL exon 3; Set C
ucugaagaugucuguaacugug

SEQ ID NO: 45735 - RNA, 20 nt, Artificial Sequence
  Synthetic Oligonucleotide; REL exon 3; Set C
cugaagaugucuguaacugu

SEQ ID NO: 45736 - RNA, 19 nt, Artificial Sequence
  Synthetic Oligonucleotide; REL exon 3; Set C
cugaagaugucuguaacug

SEQ ID NO: 45737 - RNA, 25 nt, Artificial Sequence
  Synthetic Oligonucleotide; REL exon 3; Set C
uuucugaagaugucuguaacugugu

SEQ ID NO: 45738 - RNA, 23 nt, Artificial Sequence
  Synthetic Oligonucleotide; REL exon 3; Set C
uucugaagaugucuguaacugug

SEQ ID NO: 45739 - RNA, 21 nt, Artificial Sequence
  Synthetic Oligonucleotide; REL exon 3; Set C
ucugaagaugucuguaacugu

SEQ ID NO: 45740 - RNA, 20 nt, Artificial Sequence
  Synthetic Oligonucleotide; REL exon 3; Set C
ucugaagaugucuguaacug

SEQ ID NO: 45741 - RNA, 24 nt, Artificial Sequence
  Synthetic Oligonucleotide; REL exon 3; Set C
uuucugaagaugucuguaacugug

SEQ ID NO: 45742 - RNA, 22 nt, Artificial Sequence
  Synthetic Oligonucleotide; REL exon 3; Set C
uucugaagaugucuguaacugu

SEQ ID NO: 45743 - RNA, 21 nt, Artificial Sequence
  Synthetic Oligonucleotide; REL exon 3; Set C
uucugaagaugucuguaacug

SEQ ID NO: 45744 - RNA, 19 nt, Artificial Sequence
  Synthetic Oligonucleotide; REL exon 3; Set C
ucugaagaugucuguaacu

SEQ ID NO: 45745 - RNA, 23 nt, Artificial Sequence
  Synthetic Oligonucleotide; REL exon 3; Set C
uuucugaagaugucuguaacugu

SEQ ID NO: 45746 - RNA, 22 nt, Artificial Sequence
  Synthetic Oligonucleotide; REL exon 3; Set C
uuucugaagaugucuguaacug

SEQ ID NO: 45747 - RNA, 20 nt, Artificial Sequence
  Synthetic Oligonucleotide; REL exon 3; Set C
uucugaagaugucuguaacu

SEQ ID NO: 45748 - RNA, 24 nt, Artificial Sequence
  Synthetic Oligonucleotide; REL exon 3; Set C
auuucugaagaugucuguaacugu

SEQ ID NO: 45749 - RNA, 23 nt, Artificial Sequence
  Synthetic Oligonucleotide; REL exon 3; Set C
auuucugaagaugucuguaacug

SEQ ID NO: 45750 - RNA, 21 nt, Artificial Sequence
  Synthetic Oligonucleotide; REL exon 3; Set C
uuucugaagaugucuguaacu

SEQ ID NO: 45751 - RNA, 22 nt, Artificial Sequence
  Synthetic Oligonucleotide; REL exon 3; Set C
auuucugaagaugucuguaacu

SEQ ID NO: 45752 - RNA, 15 nt, Artificial Sequence
  Synthetic Oligonucleotide; REL exon 3; Set C
uuucugaagaugucu

SEQ ID NO: 45753 - RNA, 40 nt, Artificial Sequence
  Synthetic Oligonucleotide; REL exon 3; Set B
augucuuaucuuauuucugaagaugucuguaacuguguac

SEQ ID NO: 45754 - RNA, 16 nt, Artificial Sequence
  Synthetic Oligonucleotide; REL exon 3; Set C
auuucugaagaugucu

SEQ ID NO: 45755 - RNA, 39 nt, Artificial Sequence
  Synthetic Oligonucleotide; REL exon 3; Set B
augucuuaucuuauuucugaagaugucuguaacugugua

SEQ ID NO: 45756 - RNA, 15 nt, Artificial Sequence
  Synthetic Oligonucleotide; REL exon 3; Set C
auuucugaagauguc

SEQ ID NO: 45757 - RNA, 38 nt, Artificial Sequence
  Synthetic Oligonucleotide; REL exon 3; Set B
augucuuaucuuauuucugaagaugucuguaacugugu

SEQ ID NO: 45758 - RNA, 37 nt, Artificial Sequence
  Synthetic Oligonucleotide; REL exon 3; Set B
augucuuaucuuauuucugaagaugucuguaacugug

SEQ ID NO: 45759 - RNA, 36 nt, Artificial Sequence
  Synthetic Oligonucleotide; REL exon 3; Set B
augucuuaucuuauuucugaagaugucuguaacugu

SEQ ID NO: 45760 - RNA, 35 nt, Artificial Sequence
  Synthetic Oligonucleotide; REL exon 3; Set B
augucuuaucuuauuucugaagaugucuguaacug

SEQ ID NO: 45761 - RNA, 34 nt, Artificial Sequence
  Synthetic Oligonucleotide; REL exon 3; Set B
augucuuaucuuauuucugaagaugucuguaacu

SEQ ID NO: 45762 - RNA, 40 nt, Artificial Sequence
  Synthetic Oligonucleotide; REL exon 3; Set B
cauccuaugucuuaucuuauuucugaagaugucuguaacu

SEQ ID NO: 45763 - RNA, 28 nt, Artificial Sequence
  Synthetic Oligonucleotide; REL exon 3; Set C
augucuuaucuuauuucugaagaugucu

SEQ ID NO: 45764 - RNA, 27 nt, Artificial Sequence
  Synthetic Oligonucleotide; REL exon 3; Set C
augucuuaucuuauuucugaagauguc

SEQ ID NO: 45765 - RNA, 15 nt, Artificial Sequence
  Synthetic Oligonucleotide; REL exon 3; Set C
augucuuaucuuauu

SEQ ID NO: 45766 - RNA, 25 nt, Artificial Sequence
  Synthetic Oligonucleotide; REL exon 3; Set C
cauccuaugucuuaucuuauuucug

SEQ ID NO: 45767 - RNA, 24 nt, Artificial Sequence
  Synthetic Oligonucleotide; REL exon 3; Set C
cauccuaugucuuaucuuauuucu

SEQ ID NO: 45768 - RNA, 23 nt, Artificial Sequence
  Synthetic Oligonucleotide; REL exon 3; Set C
cauccuaugucuuaucuuauuuc

SEQ ID NO: 45769 - RNA, 22 nt, Artificial Sequence
  Synthetic Oligonucleotide; REL exon 3; Set C
cauccuaugucuuaucuuauuu

SEQ ID NO: 45770 - RNA, 21 nt, Artificial Sequence
  Synthetic Oligonucleotide; REL exon 3; Set C
cauccuaugucuuaucuuauu

SEQ ID NO: 45771 - RNA, 17 nt, Artificial Sequence
  Synthetic Oligonucleotide; REL exon 3; Set C
aauagacugcauuauaa

SEQ ID NO: 45772 - RNA, 16 nt, Artificial Sequence
  Synthetic Oligonucleotide; REL exon 3; Set C
aauagacugcauuaua

SEQ ID NO: 45773 - RNA, 17 nt, Artificial Sequence
  Synthetic Oligonucleotide; REL exon 3; Set C
aaauagacugcauuaua

SEQ ID NO: 45774 - RNA, 15 nt, Artificial Sequence
  Synthetic Oligonucleotide; REL exon 3; Set C
aauagacugcauuau

SEQ ID NO: 45775 - RNA, 19 nt, Artificial Sequence
  Synthetic Oligonucleotide; REL exon 3; Set C
caaauagacugcauuauaa

SEQ ID NO: 45776 - RNA, 18 nt, Artificial Sequence
  Synthetic Oligonucleotide; REL exon 3; Set C
caaauagacugcauuaua

SEQ ID NO: 45777 - RNA, 16 nt, Artificial Sequence
  Synthetic Oligonucleotide; REL exon 3; Set C
aaauagacugcauuau

SEQ ID NO: 45778 - RNA, 20 nt, Artificial Sequence
  Synthetic Oligonucleotide; REL exon 3; Set C
ccaaauagacugcauuauaa

SEQ ID NO: 45779 - RNA, 15 nt, Artificial Sequence
  Synthetic Oligonucleotide; REL exon 3; Set C
aaauagacugcauua

SEQ ID NO: 45780 - RNA, 19 nt, Artificial Sequence
  Synthetic Oligonucleotide; REL exon 3; Set C
ccaaauagacugcauuaua

SEQ ID NO: 45781 - RNA, 17 nt, Artificial Sequence
  Synthetic Oligonucleotide; REL exon 3; Set C
caaauagacugcauuau

SEQ ID NO: 45782 - RNA, 16 nt, Artificial Sequence
  Synthetic Oligonucleotide; REL exon 3; Set C
caaauagacugcauua

SEQ ID NO: 45783 - RNA, 18 nt, Artificial Sequence
  Synthetic Oligonucleotide; REL exon 3; Set C
ccaaauagacugcauuau

SEQ ID NO: 45784 - RNA, 17 nt, Artificial Sequence
  Synthetic Oligonucleotide; REL exon 3; Set C
ccaaauagacugcauua

SEQ ID NO: 45785 - RNA, 19 nt, Artificial Sequence
  Synthetic Oligonucleotide; REL exon 3; Set C
uaaauacaugauccaaaua

SEQ ID NO: 45786 - RNA, 20 nt, Artificial Sequence
  Synthetic Oligonucleotide; REL exon 3; Set C
uuaaauacaugauccaaaua

SEQ ID NO: 45787 - RNA, 21 nt, Artificial Sequence
  Synthetic Oligonucleotide; REL exon 3; Set C
auuaaauacaugauccaaaua

SEQ ID NO: 45788 - RNA, 22 nt, Artificial Sequence
  Synthetic Oligonucleotide; REL exon 3; Set C
aauuaaauacaugauccaaaua

SEQ ID NO: 45789 - RNA, 23 nt, Artificial Sequence
  Synthetic Oligonucleotide; REL exon 3; Set C
aaauuaaauacaugauccaaaua

SEQ ID NO: 45790 - RNA, 24 nt, Artificial Sequence
  Synthetic Oligonucleotide; REL exon 3; Set C
gaaauuaaauacaugauccaaaua

SEQ ID NO: 45791 - RNA, 25 nt, Artificial Sequence
  Synthetic Oligonucleotide; REL exon 3; Set C
ggaaauuaaauacaugauccaaaua

SEQ ID NO: 45792 - RNA, 26 nt, Artificial Sequence
  Synthetic Oligonucleotide; REL exon 3; Set C
gggaaauuaaauacaugauccaaaua

SEQ ID NO: 45793 - RNA, 27 nt, Artificial Sequence
  Synthetic Oligonucleotide; REL exon 3; Set C
ggggaaauuaaauacaugauccaaaua

SEQ ID NO: 45794 - RNA, 30 nt, Artificial Sequence
  Synthetic Oligonucleotide; REL exon 3; Set C
aaagggggaaauuaaauacaugauccaaau

SEQ ID NO: 45795 - RNA, 29 nt, Artificial Sequence
  Synthetic Oligonucleotide; REL exon 3; Set C
aaagggggaaauuaaauacaugauccaaa

SEQ ID NO: 45796 - RNA, 18 nt, Artificial Sequence
  Synthetic Oligonucleotide; REL exon 3; Set C
aaagggggaaauuaaaua

SEQ ID NO: 45797 - RNA, 17 nt, Artificial Sequence
  Synthetic Oligonucleotide; REL exon 3; Set C
aaagggggaaauuaaau

SEQ ID NO: 45798 - RNA, 16 nt, Artificial Sequence
  Synthetic Oligonucleotide; REL exon 3; Set C
aaagggggaaauuaaa

SEQ ID NO: 45799 - RNA, 15 nt, Artificial Sequence
  Synthetic Oligonucleotide; REL exon 3; Set C
aaagggggaaauuaa

SEQ ID NO: 45800 - RNA, 20 nt, Artificial Sequence
  Synthetic Oligonucleotide; REL exon 3; Set C
uuuccuuuuccauaauaguu

SEQ ID NO: 45801 - RNA, 19 nt, Artificial Sequence
  Synthetic Oligonucleotide; REL exon 3; Set C
uuuccuuuuccauaauagu

SEQ ID NO: 45802 - RNA, 21 nt, Artificial Sequence
  Synthetic Oligonucleotide; REL exon 3; Set C
uuuuccuuuuccauaauaguu

SEQ ID NO: 45803 - RNA, 20 nt, Artificial Sequence
  Synthetic Oligonucleotide; REL exon 3; Set C
uuuuccuuuuccauaauagu

SEQ ID NO: 45804 - RNA, 35 nt, Artificial Sequence
  Synthetic Oligonucleotide; REL exon 3; Set A
aauguaauucucacuuuuccuuuuccauaauaguu

SEQ ID NO: 45805 - RNA, 34 nt, Artificial Sequence
  Synthetic Oligonucleotide; REL exon 3; Set C
aauguaauucucacuuuuccuuuuccauaauagu

SEQ ID NO: 45806 - RNA, 35 nt, Artificial Sequence
  Synthetic Oligonucleotide; REL exon 3; Set A
uaauguaauucucacuuuuccuuuuccauaauagu

SEQ ID NO: 45807 - RNA, 40 nt, Artificial Sequence
  Synthetic Oligonucleotide; REL exon 3; Set C
ucucugcagucuuuuccaacuaaaucaugaggaugagguu

SEQ ID NO: 45808 - RNA, 39 nt, Artificial Sequence
  Synthetic Oligonucleotide; REL exon 3; Set C
ucucugcagucuuuuccaacuaaaucaugaggaugaggu

SEQ ID NO: 45809 - RNA, 40 nt, Artificial Sequence
  Synthetic Oligonucleotide; REL exon 3; Set C
gucucugcagucuuuuccaacuaaaucaugaggaugaggu

SEQ ID NO: 45810 - RNA, 32 nt, Artificial Sequence
  Synthetic Oligonucleotide; REL exon 3; Set A
ucucugcagucuuuuccaacuaaaucaugagg

SEQ ID NO: 45811 - RNA, 31 nt, Artificial Sequence
  Synthetic Oligonucleotide; REL exon 3; Set A
ucucugcagucuuuuccaacuaaaucaugag

SEQ ID NO: 45812 - RNA, 33 nt, Artificial Sequence
  Synthetic Oligonucleotide; REL exon 3; Set A
gucucugcagucuuuuccaacuaaaucaugagg

SEQ ID NO: 45813 - RNA, 34 nt, Artificial Sequence
  Synthetic Oligonucleotide; REL exon 3; Set A
cgucucugcagucuuuuccaacuaaaucaugagg

SEQ ID NO: 45814 - RNA, 32 nt, Artificial Sequence
  Synthetic Oligonucleotide; REL exon 3; Set A
gucucugcagucuuuuccaacuaaaucaugag

SEQ ID NO: 45815 - RNA, 30 nt, Artificial Sequence
  Synthetic Oligonucleotide; REL exon 3; Set A
ucucugcagucuuuuccaacuaaaucauga

SEQ ID NO: 45816 - RNA, 28 nt, Artificial Sequence
  Synthetic Oligonucleotide; REL exon 3; Set A
cucugcagucuuuuccaacuaaaucaug

SEQ ID NO: 45817 - RNA, 35 nt, Artificial Sequence
  Synthetic Oligonucleotide; REL exon 3; Set C
ccgucucugcagucuuuuccaacuaaaucaugagg

SEQ ID NO: 45818 - RNA, 33 nt, Artificial Sequence
  Synthetic Oligonucleotide; REL exon 3; Set A
cgucucugcagucuuuuccaacuaaaucaugag

SEQ ID NO: 45819 - RNA, 31 nt, Artificial Sequence
  Synthetic Oligonucleotide; REL exon 3; Set A
gucucugcagucuuuuccaacuaaaucauga

SEQ ID NO: 45820 - RNA, 34 nt, Artificial Sequence
  Synthetic Oligonucleotide; REL exon 3; Set A
ccgucucugcagucuuuuccaacuaaaucaugag

SEQ ID NO: 45821 - RNA, 32 nt, Artificial Sequence
  Synthetic Oligonucleotide; REL exon 3; Set A
cgucucugcagucuuuuccaacuaaaucauga

SEQ ID NO: 45822 - RNA, 37 nt, Artificial Sequence
  Synthetic Oligonucleotide; REL exon 3; Set C
agccgucucugcagucuuuuccaacuaaaucaugagg

SEQ ID NO: 45823 - RNA, 33 nt, Artificial Sequence
  Synthetic Oligonucleotide; REL exon 3; Set A
ccgucucugcagucuuuuccaacuaaaucauga

SEQ ID NO: 45824 - RNA, 36 nt, Artificial Sequence
  Synthetic Oligonucleotide; REL exon 3; Set C
agccgucucugcagucuuuuccaacuaaaucaugag

SEQ ID NO: 45825 - RNA, 38 nt, Artificial Sequence
  Synthetic Oligonucleotide; REL exon 3; Set C
uagccgucucugcagucuuuuccaacuaaaucaugagg

SEQ ID NO: 45826 - RNA, 39 nt, Artificial Sequence
  Synthetic Oligonucleotide; REL exon 3; Set C
guagccgucucugcagucuuuuccaacuaaaucaugagg

SEQ ID NO: 45827 - RNA, 37 nt, Artificial Sequence
  Synthetic Oligonucleotide; REL exon 3; Set C
uagccgucucugcagucuuuuccaacuaaaucaugag

SEQ ID NO: 45828 - RNA, 35 nt, Artificial Sequence
  Synthetic Oligonucleotide; REL exon 3; Set C
agccgucucugcagucuuuuccaacuaaaucauga

SEQ ID NO: 45829 - RNA, 38 nt, Artificial Sequence
  Synthetic Oligonucleotide; REL exon 3; Set C
guagccgucucugcagucuuuuccaacuaaaucaugag

SEQ ID NO: 45830 - RNA, 36 nt, Artificial Sequence
  Synthetic Oligonucleotide; REL exon 3; Set C
uagccgucucugcagucuuuuccaacuaaaucauga

SEQ ID NO: 45831 - RNA, 37 nt, Artificial Sequence
  Synthetic Oligonucleotide; REL exon 3; Set C
guagccgucucugcagucuuuuccaacuaaaucauga

SEQ ID NO: 45832 - RNA, 38 nt, Artificial Sequence
  Synthetic Oligonucleotide; REL exon 3; Set C
aguagccgucucugcagucuuuuccaacuaaaucauga

SEQ ID NO: 45833 - RNA, 37 nt, Artificial Sequence
  Synthetic Oligonucleotide; REL exon 3; Set C
aguagccgucucugcagucuuuuccaacuaaaucaug

SEQ ID NO: 45834 - RNA, 19 nt, Artificial Sequence
  Synthetic Oligonucleotide; REL exon 3; Set C
ucucugcagucuuuuccaa

SEQ ID NO: 45835 - RNA, 18 nt, Artificial Sequence
  Synthetic Oligonucleotide; REL exon 3; Set C
ucucugcagucuuuucca

SEQ ID NO: 45836 - RNA, 20 nt, Artificial Sequence
  Synthetic Oligonucleotide; REL exon 3; Set C
gucucugcagucuuuuccaa

SEQ ID NO: 45837 - RNA, 17 nt, Artificial Sequence
  Synthetic Oligonucleotide; REL exon 3; Set C
ucucugcagucuuuucc

SEQ ID NO: 45838 - RNA, 21 nt, Artificial Sequence
  Synthetic Oligonucleotide; REL exon 3; Set C
cgucucugcagucuuuuccaa

SEQ ID NO: 45839 - RNA, 19 nt, Artificial Sequence
  Synthetic Oligonucleotide; REL exon 3; Set C
gucucugcagucuuuucca

SEQ ID NO: 45840 - RNA, 16 nt, Artificial Sequence
  Synthetic Oligonucleotide; REL exon 3; Set C
ucucugcagucuuuuc

SEQ ID NO: 45841 - RNA, 18 nt, Artificial Sequence
  Synthetic Oligonucleotide; REL exon 3; Set C
gucucugcagucuuuucc

SEQ ID NO: 45842 - RNA, 22 nt, Artificial Sequence
  Synthetic Oligonucleotide; REL exon 3; Set A
ccgucucugcagucuuuuccaa

SEQ ID NO: 45843 - RNA, 20 nt, Artificial Sequence
  Synthetic Oligonucleotide; REL exon 3; Set A
cgucucugcagucuuuucca

SEQ ID NO: 45844 - RNA, 15 nt, Artificial Sequence
  Synthetic Oligonucleotide; REL exon 3; Set C
ucucugcagucuuuu

SEQ ID NO: 45845 - RNA, 17 nt, Artificial Sequence
  Synthetic Oligonucleotide; REL exon 3; Set C
gucucugcagucuuuuc

SEQ ID NO: 45846 - RNA, 19 nt, Artificial Sequence
  Synthetic Oligonucleotide; REL exon 3; Set C
cgucucugcagucuuuucc

SEQ ID NO: 45847 - RNA, 21 nt, Artificial Sequence
  Synthetic Oligonucleotide; REL exon 3; Set A
ccgucucugcagucuuuucca

SEQ ID NO: 45848 - RNA, 16 nt, Artificial Sequence
  Synthetic Oligonucleotide; REL exon 3; Set C
gucucugcagucuuuu

SEQ ID NO: 45849 - RNA, 18 nt, Artificial Sequence
  Synthetic Oligonucleotide; REL exon 3; Set C
cgucucugcagucuuuuc

SEQ ID NO: 45850 - RNA, 24 nt, Artificial Sequence
  Synthetic Oligonucleotide; REL exon 3; Set A
agccgucucugcagucuuuuccaa

SEQ ID NO: 45851 - RNA, 17 nt, Artificial Sequence
  Synthetic Oligonucleotide; REL exon 3; Set C
cgucucugcagucuuuu

SEQ ID NO: 45852 - RNA, 15 nt, Artificial Sequence
  Synthetic Oligonucleotide; REL exon 3; Set C
gucucugcagucuuu

SEQ ID NO: 45853 - RNA, 19 nt, Artificial Sequence
  Synthetic Oligonucleotide; REL exon 3; Set C
ccgucucugcagucuuuuc

SEQ ID NO: 45854 - RNA, 23 nt, Artificial Sequence
  Synthetic Oligonucleotide; REL exon 3; Set A
agccgucucugcagucuuuucca

SEQ ID NO: 45855 - RNA, 25 nt, Artificial Sequence
  Synthetic Oligonucleotide; REL exon 3; Set A
uagccgucucugcagucuuuuccaa

SEQ ID NO: 45856 - RNA, 18 nt, Artificial Sequence
  Synthetic Oligonucleotide; REL exon 3; Set C
ccgucucugcagucuuuu

SEQ ID NO: 45857 - RNA, 16 nt, Artificial Sequence
  Synthetic Oligonucleotide; REL exon 3; Set C
cgucucugcagucuuu

SEQ ID NO: 45858 - RNA, 22 nt, Artificial Sequence
  Synthetic Oligonucleotide; REL exon 3; Set A
agccgucucugcagucuuuucc

SEQ ID NO: 45859 - RNA, 26 nt, Artificial Sequence
  Synthetic Oligonucleotide; REL exon 3; Set A
guagccgucucugcagucuuuuccaa

SEQ ID NO: 45860 - RNA, 24 nt, Artificial Sequence
  Synthetic Oligonucleotide; REL exon 3; Set A
uagccgucucugcagucuuuucca

SEQ ID NO: 45861 - RNA, 17 nt, Artificial Sequence
  Synthetic Oligonucleotide; REL exon 3; Set C
ccgucucugcagucuuu

SEQ ID NO: 45862 - RNA, 21 nt, Artificial Sequence
  Synthetic Oligonucleotide; REL exon 3; Set A
agccgucucugcagucuuuuc

SEQ ID NO: 45863 - RNA, 23 nt, Artificial Sequence
  Synthetic Oligonucleotide; REL exon 3; Set A
uagccgucucugcagucuuuucc

SEQ ID NO: 45864 - RNA, 25 nt, Artificial Sequence
  Synthetic Oligonucleotide; REL exon 3; Set C
guagccgucucugcagucuuuucca

SEQ ID NO: 45865 - RNA, 20 nt, Artificial Sequence
  Synthetic Oligonucleotide; REL exon 3; Set A
agccgucucugcagucuuuu

SEQ ID NO: 45866 - RNA, 22 nt, Artificial Sequence
  Synthetic Oligonucleotide; REL exon 3; Set A
uagccgucucugcagucuuuuc

SEQ ID NO: 45867 - RNA, 24 nt, Artificial Sequence
  Synthetic Oligonucleotide; REL exon 3; Set A
guagccgucucugcagucuuuucc

SEQ ID NO: 45868 - RNA, 26 nt, Artificial Sequence
  Synthetic Oligonucleotide; REL exon 3; Set C
aguagccgucucugcagucuuuucca

SEQ ID NO: 45869 - RNA, 19 nt, Artificial Sequence
  Synthetic Oligonucleotide; REL exon 3; Set A
agccgucucugcagucuuu

SEQ ID NO: 45870 - RNA, 21 nt, Artificial Sequence
  Synthetic Oligonucleotide; REL exon 3; Set A
uagccgucucugcagucuuuu

SEQ ID NO: 45871 - RNA, 23 nt, Artificial Sequence
  Synthetic Oligonucleotide; REL exon 3; Set A
guagccgucucugcagucuuuuc

SEQ ID NO: 45872 - RNA, 22 nt, Artificial Sequence
  Synthetic Oligonucleotide; REL exon 3; Set A
guagccgucucugcagucuuuu

SEQ ID NO: 45873 - RNA, 20 nt, Artificial Sequence
  Synthetic Oligonucleotide; REL exon 3; Set A
uagccgucucugcagucuuu

SEQ ID NO: 45874 - RNA, 21 nt, Artificial Sequence
  Synthetic Oligonucleotide; REL exon 3; Set A
guagccgucucugcagucuuu

SEQ ID NO: 45875 - RNA, 32 nt, Artificial Sequence
  Synthetic Oligonucleotide; REL exon 3; Set C
cuucauaguagccgucucugcagucuuuucca

SEQ ID NO: 45876 - RNA, 17 nt, Artificial Sequence
  Synthetic Oligonucleotide; REL exon 3; Set C
cuucauaguagccgucu

SEQ ID NO: 45877 - RNA, 18 nt, Artificial Sequence
  Synthetic Oligonucleotide; REL exon 3; Set C
gcuucauaguagccgucu

SEQ ID NO: 45878 - RNA, 16 nt, Artificial Sequence
  Synthetic Oligonucleotide; REL exon 3; Set C
cuucauaguagccguc

SEQ ID NO: 45879 - RNA, 15 nt, Artificial Sequence
  Synthetic Oligonucleotide; REL exon 3; Set C
cuucauaguagccgu

SEQ ID NO: 45880 - RNA, 17 nt, Artificial Sequence
  Synthetic Oligonucleotide; REL exon 3; Set C
gcuucauaguagccguc

SEQ ID NO: 45881 - RNA, 16 nt, Artificial Sequence
  Synthetic Oligonucleotide; REL exon 3; Set C
gcuucauaguagccgu

SEQ ID NO: 45882 - RNA, 40 nt, Artificial Sequence
  Synthetic Oligonucleotide; REL exon 3; Set C
aggucugcguucuuguccaaauucugcuucauaguagccg

SEQ ID NO: 45883 - RNA, 39 nt, Artificial Sequence
  Synthetic Oligonucleotide; REL exon 3; Set C
aaggucugcguucuuguccaaauucugcuucauaguagc

SEQ ID NO: 45884 - RNA, 35 nt, Artificial Sequence
  Synthetic Oligonucleotide; REL exon 3; Set C
aggucugcguucuuguccaaauucugcuucauagu

SEQ ID NO: 45885 - RNA, 37 nt, Artificial Sequence
  Synthetic Oligonucleotide; REL exon 3; Set C
aaggucugcguucuuguccaaauucugcuucauagua

SEQ ID NO: 45886 - RNA, 36 nt, Artificial Sequence
  Synthetic Oligonucleotide; REL exon 3; Set C
aaggucugcguucuuguccaaauucugcuucauagu

SEQ ID NO: 45887 - RNA, 37 nt, Artificial Sequence
  Synthetic Oligonucleotide; REL exon 3; Set C
aaaggucugcguucuuguccaaauucugcuucauagu

SEQ ID NO: 45888 - RNA, 39 nt, Artificial Sequence
  Synthetic Oligonucleotide; REL exon 3; Set C
caaaggucugcguucuuguccaaauucugcuucauagua

SEQ ID NO: 45889 - RNA, 38 nt, Artificial Sequence
  Synthetic Oligonucleotide; REL exon 3; Set C
caaaggucugcguucuuguccaaauucugcuucauagu

SEQ ID NO: 45890 - RNA, 40 nt, Artificial Sequence
  Synthetic Oligonucleotide; REL exon 3; Set C
acaaaggucugcguucuuguccaaauucugcuucauagua

SEQ ID NO: 45891 - RNA, 31 nt, Artificial Sequence
  Synthetic Oligonucleotide; REL exon 3; Set C
aggucugcguucuuguccaaauucugcuuca

SEQ ID NO: 45892 - RNA, 39 nt, Artificial Sequence
  Synthetic Oligonucleotide; REL exon 3; Set C
acaaaggucugcguucuuguccaaauucugcuucauagu

SEQ ID NO: 45893 - RNA, 30 nt, Artificial Sequence
  Synthetic Oligonucleotide; REL exon 3; Set A
aggucugcguucuuguccaaauucugcuuc

SEQ ID NO: 45894 - RNA, 31 nt, Artificial Sequence
  Synthetic Oligonucleotide; REL exon 3; Set A
aaggucugcguucuuguccaaauucugcuuc

SEQ ID NO: 45895 - RNA, 32 nt, Artificial Sequence
  Synthetic Oligonucleotide; REL exon 3; Set A
aaaggucugcguucuuguccaaauucugcuuc

SEQ ID NO: 45896 - RNA, 33 nt, Artificial Sequence
  Synthetic Oligonucleotide; REL exon 3; Set A
caaaggucugcguucuuguccaaauucugcuuc

SEQ ID NO: 45897 - RNA, 34 nt, Artificial Sequence
  Synthetic Oligonucleotide; REL exon 3; Set A
acaaaggucugcguucuuguccaaauucugcuuc

SEQ ID NO: 45898 - RNA, 16 nt, Artificial Sequence
  Synthetic Oligonucleotide; REL exon 3; Set C
uacuuacaacaaaggu

SEQ ID NO: 45899 - RNA, 17 nt, Artificial Sequence
  Synthetic Oligonucleotide; REL exon 3; Set C
guacuuacaacaaaggu

SEQ ID NO: 45900 - RNA, 18 nt, Artificial Sequence
  Synthetic Oligonucleotide; REL exon 3; Set C
uguacuuacaacaaaggu

SEQ ID NO: 45901 - RNA, 19 nt, Artificial Sequence
  Synthetic Oligonucleotide; REL exon 3; Set C
guguacuuacaacaaaggu

SEQ ID NO: 45902 - RNA, 20 nt, Artificial Sequence
  Synthetic Oligonucleotide; REL exon 3; Set C
uguguacuuacaacaaaggu

SEQ ID NO: 45903 - RNA, 28 nt, Artificial Sequence
  Synthetic Oligonucleotide; REL exon 3; Set B
ucuguaacuguguacuuacaacaaaggu

SEQ ID NO: 45904 - RNA, 29 nt, Artificial Sequence
  Synthetic Oligonucleotide; REL exon 3; Set B
gucuguaacuguguacuuacaacaaaggu

SEQ ID NO: 45905 - RNA, 38 nt, Artificial Sequence
  Synthetic Oligonucleotide; REL exon 3; Set B
ucugaagaugucuguaacuguguacuuacaacaaaggu

SEQ ID NO: 45906 - RNA, 39 nt, Artificial Sequence
  Synthetic Oligonucleotide; REL exon 3; Set B
uucugaagaugucuguaacuguguacuuacaacaaaggu

SEQ ID NO: 45907 - RNA, 40 nt, Artificial Sequence
  Synthetic Oligonucleotide; REL exon 3; Set B
uuucugaagaugucuguaacuguguacuuacaacaaaggu

SEQ ID NO: 45908 - RNA, 18 nt, Artificial Sequence
  Synthetic Oligonucleotide; REL exon 3; Set C
cugaagaugucuguaacu

SEQ ID NO: 45909 - RNA, 34 nt, Artificial Sequence
  Synthetic Oligonucleotide; REL exon 3; Set B
cauccuaugucuuaucuuauuucugaagaugucu

SEQ ID NO: 45910 - RNA, 33 nt, Artificial Sequence
  Synthetic Oligonucleotide; REL exon 3; Set B
cauccuaugucuuaucuuauuucugaagauguc
